United States Patent 8,461,315 (MICRORNAS AND USES THEREOF) - sequence listing, part 10

SEQ ID NO: 251028 - RNA, 61 nt, Homo Sapiens
gacauauugcuacaaagauuuuuuuuccuaaaugauucaguaauugaaugauuauuuaaua

SEQ ID NO: 251029 - RNA, 61 nt, Homo Sapiens
uauauuguaaugauguuagauaauacucaacaugauucaguaugacaaacuuuuuugagca

SEQ ID NO: 251030 - RNA, 61 nt, Homo Sapiens
uauugacgguacagaugguccccaacuuguaaugauucaauuuaggguuuuucaacuuuac

SEQ ID NO: 251031 - RNA, 61 nt, Homo Sapiens
uacaaaauccagcuaugaauauagagggcuuaugauucagauuguuaucuaucaacuauaa

SEQ ID NO: 251032 - RNA, 61 nt, Homo Sapiens
guaacaccuaacugagccucacucacauuaaaugauucacuugaaauauauacagaaauug

SEQ ID NO: 251033 - RNA, 61 nt, Homo Sapiens
cucuuauauguaccauugguugauaauuauaaugauucauuuggacuugaagaaagauugu

SEQ ID NO: 251034 - RNA, 61 nt, Homo Sapiens
cccaggcacaguaucugaaucacuggggauuaugauucacccucuuuggagaacaugcucu

SEQ ID NO: 251035 - RNA, 61 nt, Homo Sapiens
uaccucccccugggucugucgacuggcccccaugauucaaucacgagaauagcacgggaaa

SEQ ID NO: 251036 - RNA, 61 nt, Homo Sapiens
uaccuccccuugggucucucgacuggcccccaugauucaaucacaagaauagcaugggaaa

SEQ ID NO: 251037 - RNA, 61 nt, Homo Sapiens
ggaaaaucgggccuagaauuaaaaggcagaaaugauucagguaggcagggaaaacugaaca

SEQ ID NO: 251038 - RNA, 61 nt, Homo Sapiens
gaugcaaaacauucacccguaaucuguugaaaugauucacuaucauuuucugcccccccaa

SEQ ID NO: 251039 - RNA, 61 nt, Homo Sapiens
gggagaguggccaguuggaagcacugcuaaaaugauucacauugaaaauauuguuacaaag

SEQ ID NO: 251040 - RNA, 61 nt, Homo Sapiens
gaguuacauuugcauuuaaucagguauucccaugauucacagguauuaauaagaggucugg

SEQ ID NO: 251041 - RNA, 61 nt, Homo Sapiens
aagcaguacuacagaacaaacaaacuagugcaugauucaccaguuuacaugaauuuuacaa

SEQ ID NO: 251042 - RNA, 61 nt, Homo Sapiens
aauauuccuauauuaaaauuuccccuuacucaugauucaucaguuucauugguggaauaag

SEQ ID NO: 251043 - RNA, 61 nt, Homo Sapiens
gaugcugucacucggcagccgcagggaacgcaugauucagguggaaggaaagcugggacaa

SEQ ID NO: 251044 - RNA, 61 nt, Homo Sapiens
cuucuucagcccucccaaaucugguucagcuaugauucaggucuucccccacccccauuug

SEQ ID NO: 251045 - RNA, 61 nt, Homo Sapiens
acuaggaccucauaucuucccuaaauauuucaugauucacaaacucauggguacccagacu

SEQ ID NO: 251046 - RNA, 61 nt, Homo Sapiens
ugaucauauaaaacaucaugcccuccuauguaugauucauucaaccuaaguaaaaacauuc

SEQ ID NO: 251047 - RNA, 61 nt, Homo Sapiens
ugauugacccugauuuuaauugugaaauuauaugauucauauauuuuaugaaucagaauaa

SEQ ID NO: 251048 - RNA, 61 nt, Homo Sapiens
aacccuaaauauguuuacauaccauuaagauaugauucauguaacaauguuaaauuaauua

SEQ ID NO: 251049 - RNA, 57 nt, Homo Sapiens
ggcaugcuaaaaauaauugagguuuucaugauucagcaccugcuuuuguuucuguga

SEQ ID NO: 251050 - RNA, 61 nt, Homo Sapiens
uagaaguuaugaguggguuuaacaauuuuagaugauucagcuuuuguuccauuacuguuga

SEQ ID NO: 251051 - RNA, 61 nt, Homo Sapiens
aggagugagacacaggcaucaacacucucaaaugauucacauguucagccaaaguugagaa

SEQ ID NO: 251052 - RNA, 61 nt, Homo Sapiens
uugguguuguuauggcaaguuuuugguaaugaugauucaaucauuuugggaaauucuugca

SEQ ID NO: 251053 - RNA, 61 nt, Homo Sapiens
ugagagaaaucacaaaguauuagaguuuaccaugauucagagaaguucuucaggccuguag

SEQ ID NO: 251054 - RNA, 61 nt, Homo Sapiens
aacuccaguucaugcuggaucuuaaccaaaaaugauucaauacuguuaucacuaaaacagc

SEQ ID NO: 251055 - RNA, 61 nt, Homo Sapiens
ugauuacaguauuuuaugcagacuauuaggaaugauucagugcauuuaacugaacacagag

SEQ ID NO: 251056 - RNA, 61 nt, Homo Sapiens
acaaaucaugcuaacuuugacguggccugagaugauucagauuguccucacaggcaugcca

SEQ ID NO: 251057 - RNA, 61 nt, Homo Sapiens
ggauugggggugaguguuuuuuucuaugcagaugauucauucuaggccugcuggcucuggu

SEQ ID NO: 251058 - RNA, 61 nt, Homo Sapiens
guuggggagaagaaacaagaccauggccuugaugauucacuaauacacuuguguuuaagca

SEQ ID NO: 251059 - RNA, 61 nt, Homo Sapiens
uacaaaaagcugcacauauuacuacuuagguaugauucacauuggaucauuuguuuuuaaa

SEQ ID NO: 251060 - RNA, 61 nt, Homo Sapiens
acaauguaugugaaaguguagagaaaaaccaaugauucauauuggugauaaguggaaaaaa

SEQ ID NO: 251061 - RNA, 61 nt, Homo Sapiens
auuaacucucaauuagcaugaugcugguguuaugauucaguucauauggccccucuuaacc

SEQ ID NO: 251062 - RNA, 61 nt, Homo Sapiens
gaccccugaauuccaaaauauauucgguuacaugauucacauaucguguauauagcuuuag

SEQ ID NO: 251063 - RNA, 61 nt, Homo Sapiens
uuagauuuuccucuggagaguaugaaccauuaugauucaagaggguaugaacuagucaaaa

SEQ ID NO: 251064 - RNA, 61 nt, Homo Sapiens
uuacuuucuacaaacucuccguaguauauucaugauucaguguagaauguauagacuuuau

SEQ ID NO: 251065 - RNA, 61 nt, Homo Sapiens
uaacuuguuaagcaauauuuuuaagggccaaaugauucaaaacaucacagguauuuaugug

SEQ ID NO: 251066 - RNA, 61 nt, Homo Sapiens
aauagccaugacaagaguuugcauuuucuugaugauucaucuccaugagugcacaaucccu

SEQ ID NO: 251067 - RNA, 61 nt, Homo Sapiens
guuacuagcaucaggagcuuacuguuuuauuaugauucaucuucaguaauuuuuagaagca

SEQ ID NO: 251068 - RNA, 61 nt, Homo Sapiens
acagaguuuaaauaauuucaguaauucuuagaugauucagcuucaucauuaagaauaucuu

SEQ ID NO: 251069 - RNA, 61 nt, Homo Sapiens
acaccuaagagaaaaagaucgaauuuuucagaugauucagaaauuuucauucagguauuug

SEQ ID NO: 251070 - RNA, 61 nt, Homo Sapiens
aaaguaauguauaucuguaauauauaaucaaaugauucauuuuucuguuagacuaggcaaa

SEQ ID NO: 251071 - RNA, 61 nt, Homo Sapiens
guuguauuaguaaauuauuagaauccaauuaaugauucaauuaacauauaucuuauccaau

SEQ ID NO: 251072 - RNA, 61 nt, Homo Sapiens
uuuuaaagauggaauaauuuuuuuaaguucuaugauucaugauguuauuauaauuuugaau

SEQ ID NO: 251073 - RNA, 61 nt, Homo Sapiens
guuauuugaggggaaaaaacuuuagucagaaaugauucagguucacaauuucaaugcuucu

SEQ ID NO: 251074 - RNA, 61 nt, Homo Sapiens
uaccucacaaaaucaugcaauuauaugugaaaugauucaugaguguacauuacuuuuuaac

SEQ ID NO: 251075 - RNA, 61 nt, Homo Sapiens
agaggaaaaagaccaccuuucuaccuugguuaugauucagucuuggauuuugaggggcacu

SEQ ID NO: 251076 - RNA, 61 nt, Homo Sapiens
uguuuuaaaguuuaaugccuauuauggucuaaugauucaaaaaauaucguuagggugaagc

SEQ ID NO: 251077 - RNA, 61 nt, Homo Sapiens
uauuuauauagauuugauuaguguugucagcaugauucaugucaaacgaaaaaucaguccu

SEQ ID NO: 251078 - RNA, 61 nt, Homo Sapiens
uggauuuggucacaagguuuaaggugacccaaugauucagcuauuuaaaaaaaaaagagga

SEQ ID NO: 251079 - RNA, 61 nt, Homo Sapiens
uugaaucaguuuuuaaaauauuuagucuaagaugauucaaaguaguuuuauuuuaauacag

SEQ ID NO: 251080 - RNA, 61 nt, Homo Sapiens
uguguguuuuucuuuauacugcaaauuaauaaugauucacuuuauaguuugggagacagaa

SEQ ID NO: 251081 - RNA, 61 nt, Homo Sapiens
accaccaccaaccacugcgaccacaagaaggaugauucaacagguuuuccugaagaauuga

SEQ ID NO: 251082 - RNA, 61 nt, Homo Sapiens
aaaucuuuuuggucaggaggauuauauucucaugauucagcauguguauagaaagacuuuc

SEQ ID NO: 251083 - RNA, 61 nt, Homo Sapiens
ucaaguguuuuacuaucucacugcuguuuuuaugauucaggcuuauaacaaauauuguauc

SEQ ID NO: 251084 - RNA, 61 nt, Homo Sapiens
ugcaguuuggcaucugcaguacaccaagcacaugauucaugucugagccaggucugcuuau

SEQ ID NO: 251085 - RNA, 61 nt, Homo Sapiens
accacaguuuuaagaguuucuugagggguucaugauucauuucucuccuuuguugagccuu

SEQ ID NO: 251086 - RNA, 61 nt, Homo Sapiens
cucccuuacccugaccaaucuccauauccuaaugauucaauaaucaucaaagaaugcaauu

SEQ ID NO: 251087 - RNA, 61 nt, Homo Sapiens
gauuuuuguccaauucauuuaaaaccuauagaugauucaguuaauuucuuuucuaauaaaa

SEQ ID NO: 251088 - RNA, 61 nt, Homo Sapiens
ccacaggacuguugaaacuauggcaaaucuaaugauucagcgagcaaguaauagauuuucu

SEQ ID NO: 251089 - RNA, 61 nt, Homo Sapiens
auuauauagauauuuaaagcuagaauacaagaugauucaaauuguuccaaguauuaucuga

SEQ ID NO: 251090 - RNA, 61 nt, Homo Sapiens
accugcagcuggugaauuaguguucguagaaaugauucaauguguaagcuaguauucugug

SEQ ID NO: 251091 - RNA, 61 nt, Homo Sapiens
cccccaaauuuaauaaagacagaggguucucaugauucacauugguugugcuauugcugau

SEQ ID NO: 251092 - RNA, 61 nt, Homo Sapiens
gaacacaguaacugauagguaaaaagacugcaugauucacuuuuacacuuauauuucauug

SEQ ID NO: 251093 - RNA, 61 nt, Homo Sapiens
auugcugaaauggcuguuggcaguucuuauuaugauucagagaagagcaaauagaccuuaa

SEQ ID NO: 251094 - RNA, 61 nt, Homo Sapiens
gaagaggacuccuuaaauuugggggacuuacaugauucauuuuaacaucugagaaaagcuu

SEQ ID NO: 251095 - RNA, 61 nt, Homo Sapiens
uauuguuuuaaaaauuguaaaaauuauugugaugauucauuuagcauaaagagagguggac

SEQ ID NO: 251096 - RNA, 51 nt, Homo Sapiens
agagccacggaaaaucauaguaugauucaauccagauauggguuaaauucc

SEQ ID NO: 251097 - RNA, 61 nt, Homo Sapiens
ucaaauucucaaugcaggucuaacuauguugaugauucauaauaguauauacauaucaaca

SEQ ID NO: 251098 - RNA, 61 nt, Homo Sapiens
uuugaugaguuuuuaaaaauucuuccccgccaugauucacaaucagaaaucagcucagugg

SEQ ID NO: 251099 - RNA, 61 nt, Homo Sapiens
cauucaauaagcuuuuacuguuauuuauccuaugauucauuuuaagaaauuacuaguugua

SEQ ID NO: 251100 - RNA, 61 nt, Homo Sapiens
agacacuuagauuaagauuuaaucuuuuauaaugauucauaucauaauuuuuaaagguugg

SEQ ID NO: 251101 - RNA, 61 nt, Homo Sapiens
cagguuugaggaugcuggggcagauaguuuuaugauucacauugagcaggccuaucucuuu

SEQ ID NO: 251102 - RNA, 61 nt, Homo Sapiens
gcuauuucugaagucuguaugaauguuacugaugauucaggcuucugauguuaccacgaua

SEQ ID NO: 251103 - RNA, 61 nt, Homo Sapiens
uuuugagugaauacaucaggauuuaaucaucaugauucauacgcaugugaaaaccucaacu

SEQ ID NO: 251104 - RNA, 61 nt, Homo Sapiens
aauaucuuguuaguaauauuaucuuuagcacaugauucaccguuuuggaagggccuucagu

SEQ ID NO: 251105 - RNA, 61 nt, Homo Sapiens
uacacuaauuuuccauacuuuacucucugaaaugauucaaaugcuagugugaaacuugcuc

SEQ ID NO: 251106 - RNA, 61 nt, Homo Sapiens
agggagaauuguggaugguuauuuauagcucaugauucauccaaggacugaguuauucucc

SEQ ID NO: 251107 - RNA, 61 nt, Homo Sapiens
guugccugccuguggcugguaagguaaugucaugauucauccucucuucagugagacugag

SEQ ID NO: 251108 - RNA, 61 nt, Homo Sapiens
ggcaaagcugaaauuuuuauacauucaacucaugauucacauguggcaucagucccaucag

SEQ ID NO: 251109 - RNA, 61 nt, Homo Sapiens
uaaaaucuauucucucccccuuucucccuggaugauucaggaagcugacauuguuuccuca

SEQ ID NO: 251110 - RNA, 61 nt, Homo Sapiens
uaaccaguucucacaacuugcuauacauaagaugauucacacuugaaugaaacccuacaaa

SEQ ID NO: 251111 - RNA, 61 nt, Homo Sapiens
aauuauauagcuuuuuguuuuguuugaauaaaugauucauuccuguuugcuuuucuggugc

SEQ ID NO: 251112 - RNA, 61 nt, Homo Sapiens
uucacauuggaaacaagucagucauucagauaugauucaaaugucuauaaaccgaacugau

SEQ ID NO: 251113 - RNA, 61 nt, Homo Sapiens
uacuguuaagguauuacuuuuuuucaugcugaugauucauaucuaaauuacauuauuaugu

SEQ ID NO: 251114 - RNA, 61 nt, Homo Sapiens
cuggagagaaguuacacaaacuaaacauaagaugauucauauaaccauuucucaacccuua

SEQ ID NO: 251115 - RNA, 61 nt, Homo Sapiens
auuuaaacuaugauaaauuaaauaucagaauaugauucacuuuaauaugauuauuaaucag

SEQ ID NO: 251116 - RNA, 61 nt, Homo Sapiens
gucagggagguggcucagaguccucgcuugaaugauucaggccagucaagagcuccucugc

SEQ ID NO: 251117 - RNA, 61 nt, Homo Sapiens
ugcaucuccaaacauuacucagaaauaauucaugauucaacuauuucucugaauucaguga

SEQ ID NO: 251118 - RNA, 61 nt, Homo Sapiens
ugccagguuuuuaaauguuucauuagguuuuaugauucauuuauaugacuuuaagagccca

SEQ ID NO: 251119 - RNA, 61 nt, Homo Sapiens
aagugcaguauuuuucuacaucaugucaagaaugauucaauguaaauauuuuucauuuuau

SEQ ID NO: 251120 - RNA, 61 nt, Homo Sapiens
cucuucaauccaucuuaccacacaauauuucaugauucaaauucuucaaagucuuauacgc

SEQ ID NO: 251121 - RNA, 61 nt, Homo Sapiens
ggaagauagaaacuagguuuugaaagauuacaugauucaagcgagggauuuuaaaguaaag

SEQ ID NO: 251122 - RNA, 61 nt, Homo Sapiens
auaauaugugauguaacauguagaugauaauaugauucaguagucaacuugagggaaauuu

SEQ ID NO: 251123 - RNA, 61 nt, Homo Sapiens
uucauuuuaaagguuauuugcucccgauuauaugauucaaguguuauaaguuuuagcuuga

SEQ ID NO: 251124 - RNA, 61 nt, Homo Sapiens
cuggacagccuggacauuuuuugcuaugcuuaugauucagggcgcagaauaauauuaagaa

SEQ ID NO: 251125 - RNA, 61 nt, Homo Sapiens
uuucagaaauaaaaguaugaauaauuuugaaaugauucaucagaaaauauucuaacauuug

SEQ ID NO: 251126 - RNA, 61 nt, Homo Sapiens
agguccaauguuguucaccauggugguagaaaugauucacccuuuggacaaaugcauuuag

SEQ ID NO: 251127 - RNA, 61 nt, Homo Sapiens
caaaugaauuuuuggugauuguauaccacaaaugauucaugauguguauuuucuuauucug

SEQ ID NO: 251128 - RNA, 61 nt, Homo Sapiens
uugcugcgugugaaaucauggaagaagcagaaugauucauuuucaauuuaaaaagagugag

SEQ ID NO: 251129 - RNA, 61 nt, Homo Sapiens
cauuaauguuaaggcuaauacugcaauaacaaugauucauuauucuuguuuauucaaauga

SEQ ID NO: 251130 - RNA, 61 nt, Homo Sapiens
uucuucagagugguaauuguuuacuguuuuaaugauucaguuuaaauuugugaacucguaa

SEQ ID NO: 251131 - RNA, 61 nt, Homo Sapiens
auuguuauguaaacaucauaaauaguaaauaaugauucaaugugaauuuuaaaaugcaaau

SEQ ID NO: 251132 - RNA, 61 nt, Homo Sapiens
caaagaugagauuauuggggcuguucauauuaugauucagaaucauuuucuauugugguau

SEQ ID NO: 251133 - RNA, 61 nt, Homo Sapiens
cuaccuacauuuacauguagguagauaugaaaugauucaauauccaugucuccuuuuacuc

SEQ ID NO: 251134 - RNA, 61 nt, Homo Sapiens
gcuggagcagcugauaguggaaaacagaauaaugauucaaagagucuucugucaccauguc

SEQ ID NO: 251135 - RNA, 61 nt, Homo Sapiens
gguuugcagcccuaaugaaauuaugucuaggaugauucagucuauuucccauuuacuagca

SEQ ID NO: 251136 - RNA, 61 nt, Homo Sapiens
cugcuuacucguaaugaucuaguggggaaacaugauucauucacuuaaaauacugauuaag

SEQ ID NO: 251137 - RNA, 61 nt, Homo Sapiens
aauugaaguaguguggagcauuaacuuguggaugauucagaguuaaaagauaaaaagacgc

SEQ ID NO: 251138 - RNA, 61 nt, Homo Sapiens
guuuacaugugucaaggugauuuugaaauacaugauucaugcuugaccacaacuacuguuu

SEQ ID NO: 251139 - RNA, 61 nt, Homo Sapiens
accauuucuucagguuaaauuaaaaauuuauaugauucaaaacagucuuuauuuuucuucu

SEQ ID NO: 251140 - RNA, 61 nt, Homo Sapiens
cguuauuccuuauaaaguaaauucuucuuuuaugauucauaaauguuucccaugaucgcuc

SEQ ID NO: 251141 - RNA, 61 nt, Homo Sapiens
aucaagaagauucagaaaauacaagguuaagaugauucaauuacauugucuaaaaauccuu

SEQ ID NO: 251142 - RNA, 61 nt, Homo Sapiens
ucauuucaccuugacgauucauucucauuaaaugauucauugccagugccacaguuugaag

SEQ ID NO: 251143 - RNA, 61 nt, Homo Sapiens
ggcugggaauugagaauuuauuauugcauuuaugauucaguuucauuucuguugauuuuuu

SEQ ID NO: 251144 - RNA, 61 nt, Homo Sapiens
uauaggcuguucuagccacagugguagauuuaugauucacauccgaaagugugccuuaguu

SEQ ID NO: 251145 - RNA, 61 nt, Homo Sapiens
cacauggcuugcacucagugacaccaaauccaugauucaauguugaucuugagcaaguauu

SEQ ID NO: 251146 - RNA, 61 nt, Homo Sapiens
cuauuuuaacuuagaaaaaccaucguuucauaugauucacccuaauagauaccuccauuau

SEQ ID NO: 251147 - RNA, 61 nt, Homo Sapiens
cugaccuucagcucacgcuucacagugaucgaugauucaggugcagaggaaguacaaacua

SEQ ID NO: 251148 - RNA, 61 nt, Homo Sapiens
cacgagaauagcacaggaaagacuggcccccaugauucaauuaccucccccgggucccucc

SEQ ID NO: 251149 - RNA, 61 nt, Homo Sapiens
cugaacgugcuccucucuccuucucuguacaaugauucagcaucucggcggaagaggaaaa

SEQ ID NO: 251150 - RNA, 61 nt, Homo Sapiens
uucaagccuuaaccuggaauuagaccugggaaugauucaacacucuuguuaaccuuagagc

SEQ ID NO: 251151 - RNA, 61 nt, Homo Sapiens
gauuccaccucuggcuauagagaauuacccuaugauucagcuucgucacaaaauucaacau

SEQ ID NO: 251152 - RNA, 61 nt, Homo Sapiens
uuguaccauuacauguuucauuuaacgaaucaugauucagagggggaagugggguauaaua

SEQ ID NO: 251153 - RNA, 61 nt, Homo Sapiens
guuaaaugugaugaauacugcugagcagugaaugauucaguccucgcuggacucucagucu

SEQ ID NO: 251154 - RNA, 61 nt, Homo Sapiens
gagcaaacagcacuuuacagugugguggcgcaugauucacucagguggagccauggugcuc

SEQ ID NO: 251155 - RNA, 61 nt, Homo Sapiens
gggucauuagugagaaacgguaaagucauaaaugauucauuuauagaaucuaagcuggucu

SEQ ID NO: 251156 - RNA, 61 nt, Homo Sapiens
acgggggaauauaaaagguuguuuugagcuaaugauucaaaagaugaucuuuuacucuuag

SEQ ID NO: 251157 - RNA, 61 nt, Homo Sapiens
auugaaagcagaacaauggaaaaaaaaggucaugauucaugcaaaaugcugacuacuguag

SEQ ID NO: 251158 - RNA, 61 nt, Homo Sapiens
agcugaugauuguaccagucuuaaauuauucaugauucaauaaaauugaugcuuauuuauu

SEQ ID NO: 251159 - RNA, 61 nt, Homo Sapiens
acaauuucuuuuuuaaaaaagacuauuuuauaugauucacaugcuaaagccaggauugugu

SEQ ID NO: 251160 - RNA, 61 nt, Homo Sapiens
acuucuucaugguauuaugaagacuauauagaugauucaaccaagccugcaaaucucccuc

SEQ ID NO: 251161 - RNA, 61 nt, Homo Sapiens
aggauugccauuagugacuuggaccaguuagaugauucacuuuuugccccuagggaugaga

SEQ ID NO: 251162 - RNA, 61 nt, Homo Sapiens
aauuucauguaauuuacccuuugcaauaaaaaugauucauuaaauauauaacuaaauguga

SEQ ID NO: 251163 - RNA, 61 nt, Homo Sapiens
gcuuucaaggauaggcuuuagcucacugcccaugauucagauguccuccagauaccacuga

SEQ ID NO: 251164 - RNA, 61 nt, Homo Sapiens
uaugggaauuugagaaauauaacuuuuguuuaugauucaaaauuguuggauuuaaagaggc

SEQ ID NO: 251165 - RNA, 61 nt, Homo Sapiens
agcuuuuuuagaguuuauauugcuuuuguauaugauucacgcaaccuuggucucaaauagc

SEQ ID NO: 251166 - RNA, 61 nt, Homo Sapiens
ggcauuuuggugcuguuaaaugccuaagauuaugauucagguauccugcucagccaagauc

SEQ ID NO: 251167 - RNA, 61 nt, Homo Sapiens
uuuuuucauaauucaaacaaucuagagggaaaugauucaaaauaaguuugaaaugaaaugg

SEQ ID NO: 251168 - RNA, 61 nt, Homo Sapiens
uuucaguucucaaauuaaaauauuugaugugaugauucacuaccaaagagacccugaagaa

SEQ ID NO: 251169 - RNA, 61 nt, Homo Sapiens
auccuccaaagcaagaggcuaggaguaggaaaugauucaucuuuuaaaggagacuaacucc

SEQ ID NO: 251170 - RNA, 61 nt, Homo Sapiens
agaaccugaaccagaugaacagaauagaagaaugauucauggcauaaauauuuuugacagc

SEQ ID NO: 251171 - RNA, 61 nt, Homo Sapiens
uacuggacaaaaucaauaacuacaaaaggcaaugauucacgcuuuuguuuucauaauaccu

SEQ ID NO: 251172 - RNA, 61 nt, Homo Sapiens
aaaauuuaaaagauuaaaugaaugagaagaaaugauucauaaauuuugaacuaacaguaau

SEQ ID NO: 251173 - RNA, 61 nt, Homo Sapiens
gggcggggcagugaggggugggagaaggugaaugauucauuauuccaccccgagguuugcu

SEQ ID NO: 251174 - RNA, 61 nt, Homo Sapiens
acauccuucccucacucccaugauuggagaaaugauucauugggugaugaguguugggguu

SEQ ID NO: 251175 - RNA, 61 nt, Homo Sapiens
ugccaugacauuggaagaagcagugauucaaaugauucaaaggaagugaauaagaagauga

SEQ ID NO: 251176 - RNA, 61 nt, Homo Sapiens
uuccaugacauuggaaaaaggagugauucaaaugauucaaaggaagugaauaagaagauga

SEQ ID NO: 251177 - RNA, 61 nt, Homo Sapiens
aucuaagcaguuucgauuuucaauguuguccaugauucaaauauucacugcaacaaagcaa

SEQ ID NO: 251178 - RNA, 61 nt, Homo Sapiens
ccuguacuacugauuauuaaccaagcuucugaugauucacauuugaaauauuaaggucuug

SEQ ID NO: 251179 - RNA, 61 nt, Homo Sapiens
aucagaagaagaaggaaccccucauaggaggaugauucagcuuuuuuuugaaagaguucuc

SEQ ID NO: 251180 - RNA, 61 nt, Homo Sapiens
cuugacggugaauggaagacuaaugaaaagaaugauucagucaauaagcaauaugugguga

SEQ ID NO: 251181 - RNA, 61 nt, Homo Sapiens
aauuggaacagaauguuuuaacuuuauauggaugauucagaaucuguucuugcuacccaug

SEQ ID NO: 251182 - RNA, 61 nt, Homo Sapiens
uuaugugauucaucuuauuccccuggaggauaugauucacuaucuugauugugauaagccc

SEQ ID NO: 251183 - RNA, 61 nt, Homo Sapiens
gaaugaagaaucacaggcuucaaggauaugcaugauucaggucugugaguccuauaaaaag

SEQ ID NO: 251184 - RNA, 61 nt, Homo Sapiens
gcagaggaauuuauuaugcaaaaaggaaagaaugauucaaauucaaccaaaugauugguuc

SEQ ID NO: 251185 - RNA, 61 nt, Homo Sapiens
ucucuucuugcauguaccuaucuaccuguucaugauucacauauuagagaccagauauuuu

SEQ ID NO: 251186 - RNA, 61 nt, Homo Sapiens
auccaccuugagaggaaugagaacacaaggaaugauucaaguuuauucagaacgaggaaga

SEQ ID NO: 251187 - RNA, 61 nt, Homo Sapiens
gcucuggcaguucccaagucgucagaugaaaaugauucacaucugaauggaucugaccccu

SEQ ID NO: 251188 - RNA, 61 nt, Homo Sapiens
ugcuuccggacaacugccaaggugcagugaaaugauucaugagaaacugcugaaaaagcug

SEQ ID NO: 251189 - RNA, 61 nt, Homo Sapiens
aaugcaaguaguuuccucgcgugaccucaccaugauucacauacgugccacuguuugaaau

SEQ ID NO: 251190 - RNA, 61 nt, Homo Sapiens
cuuagccaugauuucguuaguagaccuauuuaugauucaauugcaauuuucagauaggaug

SEQ ID NO: 251191 - RNA, 61 nt, Homo Sapiens
aaaucuugaaagacgaaaucaaagcccauuaaugauucagaaucagugcuugaccuccugu

SEQ ID NO: 251192 - RNA, 61 nt, Homo Sapiens
auggaucauucugaugacagauuuauacaaaaugauucaaaccaguaacuuaguaaaauug

SEQ ID NO: 251193 - RNA, 61 nt, Homo Sapiens
uacacacuauauaaguuguucuuucaguuuuaugauucaacuacuguuuuuccuucagcug

SEQ ID NO: 251194 - RNA, 61 nt, Homo Sapiens
ccgucucagacacgcacagugggccugcugcaugauucacacccagucccugccacagacc

SEQ ID NO: 251195 - RNA, 61 nt, Homo Sapiens; identical to SEQ ID NO: 251194

SEQ ID NO: 251196 - RNA, 61 nt, Homo Sapiens
ccauuccaaaguucaacuugaugcuccagggaugauucaagcuccugacugcccggcacag

SEQ ID NO: 251197 - RNA, 61 nt, Homo Sapiens
uuuauuguauaauuaugaagaugucuuuaaaaugauucacuuuuauaacauuguaaaugau

SEQ ID NO: 251198 - RNA, 61 nt, Homo Sapiens
ugugaaaaaauucucagaucuggaaggagaaaugauucaugcuaucaguaucaauaaccau

SEQ ID NO: 251199 - RNA, 61 nt, Homo Sapiens
gaaaauccuaaacauggaagaugauuuaaaaaugauucacccuggaauacaugcuuccagu

SEQ ID NO: 251200 - RNA, 61 nt, Homo Sapiens
uuguggacuuaauuacaaccacugcacuguaaugauucaaugcuguauuaugauauugcug

SEQ ID NO: 251201 - RNA, 61 nt, Homo Sapiens
agcauauaaauuaaaauauuuaaaauuagauaugauucacacuauauucuguuucauaugc

SEQ ID NO: 251202 - RNA, 61 nt, Homo Sapiens
uuauauuuaaugcauuaaacuguuauugugaaugauucaugguucccugaaacacgaaacu

SEQ ID NO: 251203 - RNA, 61 nt, Homo Sapiens
uugcauuuucugauccuguaaaggugcuaaaaugauucaauugcauuucuauuuauaucaa

SEQ ID NO: 251204 - RNA, 61 nt, Homo Sapiens
agcuuggucacuugauuagaguugaggccuuaugauucagcaauaauaagaugcaacauuu

SEQ ID NO: 251205 - RNA, 61 nt, Homo Sapiens
guaaauauggcuuuaauuacaaacaugaggaaugauucacugaagaugaaaagauaggacg

SEQ ID NO: 251206 - RNA, 61 nt, Homo Sapiens
ugcuauagcccaaagcacguaguauuugcugaugauucagcaugagcugcaucuaccuacu

SEQ ID NO: 251207 - RNA, 61 nt, Homo Sapiens
acugagggaauuccugucuucuuuaggaguaaugauucauagaucuagauagguggaaaua

SEQ ID NO: 251208 - RNA, 61 nt, Homo Sapiens
cgcaaaauguuucaaguacuguaacugugucaugauucacccccaaacagugacauuuauu

SEQ ID NO: 251209 - RNA, 61 nt, Homo Sapiens
agccaacuucaaauaccgugaccaaauuuacaugauucauauucauuaugcauuacuuggu

SEQ ID NO: 251210 - RNA, 61 nt, Homo Sapiens
ucccaugugggauggagcagacaagaaaaggaugauucacauggguggguaguguaaauac

SEQ ID NO: 251211 - RNA, 61 nt, Homo Sapiens
gagacuguuugaaucuugucaccacugacagaugauucacaugaaacuuaacgugaucauc

SEQ ID NO: 251212 - RNA, 61 nt, Homo Sapiens
cauuuauaacuucuguuuuuuuauugagaaaaugauucacgaauuccaaaucagauugcca

SEQ ID NO: 251213 - RNA, 61 nt, Homo Sapiens
aucccaccacaagcacauacuaauuuuauuuaugauucaaaugugacucgugccugcccau

SEQ ID NO: 251214 - RNA, 61 nt, Homo Sapiens
ccacggaugggugacaggggaugguuuugggaugauucaagugcauuacauuuauugugca

SEQ ID NO: 251215 - RNA, 61 nt, Homo Sapiens
gcuaaauccucaaaaccuaguaaggggacuaaugauucauuaaaguaaauugaugguuuug

SEQ ID NO: 251216 - RNA, 61 nt, Homo Sapiens
accgccccucagcaaggaugacucagcagggaugauucagcagagauaacucggggaugac

SEQ ID NO: 251217 - RNA, 61 nt, Homo Sapiens
ugucaguagaugaccaaagaagccacaguuaaugauucagaagccucugauccaucccuca

SEQ ID NO: 251218 - RNA, 61 nt, Homo Sapiens
uuggggcaugggaggggggcugggggaccccaugauucagccacggacuccaaugcccagc

SEQ ID NO: 251219 - RNA, 61 nt, Homo Sapiens
auuacggaugaguucuggaaaagacccagcuaugauucauaaaaacacuucuggaugaauc

SEQ ID NO: 251220 - RNA, 61 nt, Homo Sapiens
cccucaucugcucagcagcuauuugaaugagaugauucagaaggggaggggagacagguaa

SEQ ID NO: 251221 - RNA, 61 nt, Homo Sapiens
cuauuuuaaauauuuuuaguauguacuguguaugauucauuaccauuuugaggggauuuau

SEQ ID NO: 251222 - RNA, 61 nt, Homo Sapiens
auuuuccccccacuccucccgggaacccagaaugauucaacgaagugauacacuaaucacg

SEQ ID NO: 251223 - RNA, 61 nt, Homo Sapiens
cacacuggccuuucuguuccccuuccuuaccaugauucagcucuucucuucauacucucua

SEQ ID NO: 251224 - RNA, 61 nt, Homo Sapiens
agcuggguacugacugagaugguugauuuucaugauucaugccuucgggagggcgggggga

SEQ ID NO: 251225 - RNA, 61 nt, Homo Sapiens
gcuauuuguaacuguguccccuuuguguauuaugauucaguucuuuaacacacacuaggcu

SEQ ID NO: 251226 - RNA, 61 nt, Homo Sapiens
uugcugcuuggauuuugaaauuuuucaagaaaugauucaaauugguguuugucuguguuug

SEQ ID NO: 251227 - RNA, 61 nt, Homo Sapiens
auaugaauaugcaguaugggacuuugaaauaaugauucauaauaaaauacuaaacgugugu

SEQ ID NO: 251228 - RNA, 61 nt, Homo Sapiens
auuucaguuuacuagacugaagcagcauuuuaugauucauauuuaggaagcaaaaguaaga

SEQ ID NO: 251229 - RNA, 61 nt, Homo Sapiens
uuauauuuuacuuuuuuauugcugguuuaagaugauucagauuauccuuguacuuugagga

SEQ ID NO: 251230 - RNA, 61 nt, Homo Sapiens
ccagugagcgcgccugcuuuagagacacaggaugauucagaccggaaacagaccucguggg

SEQ ID NO: 251231 - RNA, 61 nt, Homo Sapiens
acuucaugauccugggccugagaacacaggaaugauucauagcccaccccccaccuccaug

SEQ ID NO: 251232 - RNA, 61 nt, Homo Sapiens
auaaaacguaaacacgugcuuguuaaaauguaugauucagggauuuccuguagcugugaau

SEQ ID NO: 251233 - RNA, 61 nt, Homo Sapiens
uuuaaagcucuauuugacuuuaaagauguaaaugauucagguaguuuuacauuuuauaaag

SEQ ID NO: 251234 - RNA, 61 nt, Homo Sapiens
ucaaaauccugagugagucuaauuucucgugaugauucauuagugauucaacuuuaaaaca

SEQ ID NO: 251235 - RNA, 61 nt, Homo Sapiens
caccucuaccucccgaaguguuucugaucuuaugauucaccuuagccuggauggucucgau

SEQ ID NO: 251236 - RNA, 61 nt, Homo Sapiens
cguggcaccccauacuagaaggcuuucgggaaugauucacaaaauguaagguuugugacaa

SEQ ID NO: 251237 - RNA, 61 nt, Homo Sapiens
cuguaccagacaugacaacaagucuuuggggaugauucaguacuuaggaugagggcagaaa

SEQ ID NO: 251238 - RNA, 61 nt, Homo Sapiens
uugaguaugugccacgugcuugugaaaugcuaugauucacauguaacauuuaaacauuaau

SEQ ID NO: 251239 - RNA, 61 nt, Homo Sapiens
ugaggaaaucucuuccaauuucugcuucugaaugauucaauguugggagcaauagaaauaa

SEQ ID NO: 251240 - RNA, 61 nt, Homo Sapiens
aauacauuuuuuugguucuauauaaugcuucaugauucauuuagggaccuagaaauauugu

SEQ ID NO: 251241 - RNA, 61 nt, Homo Sapiens
aucugccccacucgccuuugccccgucaucgaugauucaggcagagccagauucguuaggu

SEQ ID NO: 251242 - RNA, 61 nt, Homo Sapiens
ccaauuagcaauugacuguccuucaaacugcaugauucaugcaggagacaguucaagaaag

SEQ ID NO: 251243 - RNA, 61 nt, Homo Sapiens
auugaaaacuuuggagaacucauuucaaguuaugauucagugcauuuucaacauugauuuu

SEQ ID NO: 251244 - RNA, 61 nt, Homo Sapiens
gaaauuauaccuuuuuaguacuugcugaagaaugauucaggguaaaucacauacuuuguuu

SEQ ID NO: 251245 - RNA, 61 nt, Homo Sapiens
uuucccucaaauagugauggaugguuuaucaaugauucauguauacucauacauuuuuaau

SEQ ID NO: 251246 - RNA, 61 nt, Homo Sapiens
ggucacuucauuuuuauuaauacucuuagagaugauucagauugcuuccccgugcaugauu

SEQ ID NO: 251247 - RNA, 61 nt, Homo Sapiens
uuucuccaaagacauguaaagacaguuuaauaugauucacucauuggggugaaguguucuu

SEQ ID NO: 251248 - RNA, 61 nt, Homo Sapiens
ugagccuaggaggucaaggcugcagugagccaugauucacagcacugcacugcagccuggg

SEQ ID NO: 251249 - RNA, 61 nt, Homo Sapiens
gugcaacauacagguaggucguucugaaaguaugauucaauagagggaugguuucugaggg

SEQ ID NO: 251250 - RNA, 61 nt, Homo Sapiens
ucaccccucccagucuacccauccagccuucaugauucauuccugugucaagguuagucgc

SEQ ID NO: 251251 - RNA, 61 nt, Homo Sapiens
agucccccaucccuuccucccuuacccagcuaugauucaguugucucugcccucccucuua

SEQ ID NO: 251252 - RNA, 61 nt, Homo Sapiens
uguaaaauuuaaauaauuacuuuuuuauaauaugauucacuuaugccacagauucaacauu

SEQ ID NO: 251253 - RNA, 61 nt, Homo Sapiens
cccacagaugauuccuuuauauagauguauaaugauucaaacugcugccuuugccuccagu

SEQ ID NO: 251254 - RNA, 61 nt, Homo Sapiens
aaugcuuuuugauguugauuuugaccuguucaugauucagaagaaaaacaaacuuuuuugg

SEQ ID NO: 251255 - RNA, 61 nt, Homo Sapiens
uaccucccacugggucccucgaccugccuccaugauucagucaugagaauagcaugggaaa

SEQ ID NO: 251256 - RNA, 61 nt, Homo Sapiens
aaaauuaaaaauuaaaaaaaaugcagcuaccaugauucaaaucuugauuggagcuuuugug

SEQ ID NO: 251257 - RNA, 61 nt, Homo Sapiens
cagaccucuugagcuccugguguuuggugacaugauucauaaagcauuugagcgaaaguca

SEQ ID NO: 251258 - RNA, 61 nt, Homo Sapiens
gcgagacaagauuggcgucugugcacagcuaaugauucaauugugcuuggaauguguugau

SEQ ID NO: 251259 - RNA, 61 nt, Homo Sapiens
aagucacaguuaaggagaauaauacagauaaaugauucaaauaauugugugauauuucaga

SEQ ID NO: 251260 - RNA, 61 nt, Homo Sapiens
ugugggugccaggcuguguggggacagcuggaugauucaucccugcuggguuggggagggu

SEQ ID NO: 251261 - RNA, 62 nt, Homo Sapiens
uaggccaaaaauggugagcgaucauuuauuucaugauucaaccugauacauuuacauagugc

SEQ ID NO: 251262 - RNA, 62 nt, Homo Sapiens
agggguggugcuagaagacagacaucuguggaaugauucacauccucucaaguuaggaggau

SEQ ID NO: 251263 - RNA, 62 nt, Homo Sapiens
aguaaccaacuuggaaagcuguauuuguucccaugauucagcaaacaaugaguaccuacugu

SEQ ID NO: 251264 - RNA, 62 nt, Homo Sapiens
caugaacauuuugauacaaauuucaucauuuaaugauucaccaauuucuugcauuaauuuga

SEQ ID NO: 251265 - RNA, 62 nt, Homo Sapiens
auuuuuuuccuaaccuuuugcuauuauaaauaaugauucauuuuauaaccuuuuauauaggu

SEQ ID NO: 251266 - RNA, 62 nt, Homo Sapiens
cuaaguaaagcacagucccuaggacauaguaaaugauucauauauccgaacuacuguuauaa

SEQ ID NO: 251267 - RNA, 62 nt, Homo Sapiens
aaaaccaggauggaugccucacauagaucaugaugauucaauccaaaggcacuuugcagugc

SEQ ID NO: 251268 - RNA, 62 nt, Homo Sapiens
uguuccuuauacucuauuauauaguguuauucaugauucagcugaucuuaacaaaauucgua

SEQ ID NO: 251269 - RNA, 62 nt, Homo Sapiens
aguagcugagaauucaaaaacauccuugcagaaugauucaaaagacaaaagccaggcucaac

SEQ ID NO: 251270 - RNA, 62 nt, Homo Sapiens
auguuauaucugcauaugagugauaugugaucaugauucauuuugcagauuuacauuuugcu

SEQ ID NO: 251271 - RNA, 62 nt, Homo Sapiens
gacuugggcugcuggugccuugagucccacagaugauucauuaggaaaagccagauauacca

SEQ ID NO: 251272 - RNA, 62 nt, Homo Sapiens
ucuuacuucuacagguuccuugagcaccaaagaugauucauaacucuguauaggugacagcu

SEQ ID NO: 251273 - RNA, 62 nt, Homo Sapiens
aaccaagcccugguagggaagagguaagggggaugauucaccuccauauuuccuaagcaggu

SEQ ID NO: 251274 - RNA, 62 nt, Homo Sapiens
uucaucugaagagagacuuaagaugaaagcaaaugauucagcucccuuauacccccauuaaa

SEQ ID NO: 251275 - RNA, 62 nt, Homo Sapiens
gauguuauucuagaauguuuucuuuccagaugaugauucagaagcuaauuuuaaaaaacggu

SEQ ID NO: 251276 - RNA, 62 nt, Homo Sapiens
uugaggcuaaguuuuggacuaccaaggaccagaugauucacauguaggaaacagccagaagc

SEQ ID NO: 251277 - RNA, 62 nt, Homo Sapiens
gugguaauccugaaucucuuuuaaacuauuauaugauucauaaugguucucaggaauuaaua

SEQ ID NO: 251278 - RNA, 62 nt, Homo Sapiens
ugcuuaucgugucugggguucaccggaaauaaaugauucacuggaacaauucuacugucaaa

SEQ ID NO: 251279 - RNA, 62 nt, Homo Sapiens
uauaagaaauaaaaauugggcaauaaaauaaaaugauucaguguuucuuuucuauauuguca

SEQ ID NO: 251280 - RNA, 62 nt, Homo Sapiens
gauacaaaugggcuucucucuugcuuuucucaaugauucagggugacugucaguuguaucug

SEQ ID NO: 251281 - RNA, 62 nt, Homo Sapiens
ccgaucuuggcuuucagucuauaaaguugcagaugauucaaaugacuuauuucugcucugga

SEQ ID NO: 251282 - RNA, 62 nt, Homo Sapiens
ugaagauacaauuuuauuuggauggcugagaaaugauucauuacggacuaagcuguaauuau

SEQ ID NO: 251283 - RNA, 62 nt, Homo Sapiens
gauggggacauggaaaugaggggcacacacagaugauucauguggggaugauguggaaauag

SEQ ID NO: 251284 - RNA, 62 nt, Homo Sapiens
guuuuuuuuacuugguuuguaccaaagaauaaaugauucaugcuuaagugucuguguagaca

SEQ ID NO: 251285 - RNA, 62 nt, Homo Sapiens
aacuucuuaccauauaaaaagaucuuaaaccuaugauucagucauguaugauuugugccacu

SEQ ID NO: 251286 - RNA, 62 nt, Homo Sapiens
gugguaacccaaauucauaaaggaguaggaugaugauucaaaucucuauaccaagauaugcu

SEQ ID NO: 251287 - RNA, 62 nt, Homo Sapiens
uuauacuuucucuuaguuaauagaauguuaacaugauucacaguccuaacuuucuguuauuu

SEQ ID NO: 251288 - RNA, 62 nt, Homo Sapiens
uuggaggaagcuggggaaaggguucuuagaagaugauucaccccugcagggcuggaggaaca

SEQ ID NO: 251289 - RNA, 62 nt, Homo Sapiens
gaauuuaguaacagaaucaauuugauuaaauaaugauucacauuuuucuaaucuuuaguaga

SEQ ID NO: 251290 - RNA, 62 nt, Homo Sapiens
gucugaaguggugccccaggaauaccagaaagaugauucagaaccaugacccagccacaguc

SEQ ID NO: 251291 - RNA, 62 nt, Homo Sapiens
cauagaugacuggauuccugguggagagauguaugauucaaaccacucagaugaccugaguu

SEQ ID NO: 251292 - RNA, 62 nt, Homo Sapiens
uaucucccaccagguuccucggaaacaacuccaugauucaguuaccaugagaacaguauggg

SEQ ID NO: 251293 - RNA, 62 nt, Homo Sapiens
ggcaugggaagaccaaaaccauucucugccugaugauucaaaucuaucaauagaguaaccuc

SEQ ID NO: 251294 - RNA, 62 nt, Homo Sapiens
augauaccuuuguugaaagaauugugaauagcaugauucauuucuagcagaggcugaguuua

SEQ ID NO: 251295 - RNA, 62 nt, Homo Sapiens
guuuaaagagauugugucuguuuaaaaucaguaugauucagagaaggaccaaauuauaugaa

SEQ ID NO: 251296 - RNA, 62 nt, Homo Sapiens
cugcaggcugucacaugacucauugaguaguaaugauucagaagaaaaagaaaaaggagacu

SEQ ID NO: 251297 - RNA, 62 nt, Homo Sapiens
uuaaaacugacauaaaauuuuaugauaauaacaugauucaagaaaugugauguagauuuuug

SEQ ID NO: 251298 - RNA, 62 nt, Homo Sapiens
cuuggcuucuggucuugauguauuugauaagaaugauucauuuucugauauggcuuccuaau

SEQ ID NO: 251299 - RNA, 62 nt, Homo Sapiens
uagguugaauaugguaggucuuugaaaauaugaugauucaauuuucucaauuuucuuugcuu

SEQ ID NO: 251300 - RNA, 62 nt, Homo Sapiens
ugucauagaggaaaagcacagauuauaccuggaugauucaggagcacauucugauuccaggu

SEQ ID NO: 251301 - RNA, 62 nt, Homo Sapiens
uugaauguauuguucuguuuguguuauuucagaugauucaaauaucaaaaggaagauucuuc

SEQ ID NO: 251302 - RNA, 62 nt, Homo Sapiens
ugacauauugcuacaaagauuuuuuuuccuaaaugauucaguaauugaaugauuauuuaaua

SEQ ID NO: 251303 - RNA, 62 nt, Homo Sapiens
uuauauuguaaugauguuagauaauacucaacaugauucaguaugacaaacuuuuuugagca

SEQ ID NO: 251304 - RNA, 62 nt, Homo Sapiens
auauugacgguacagaugguccccaacuuguaaugauucaauuuaggguuuuucaacuuuac

SEQ ID NO: 251305 - RNA, 62 nt, Homo Sapiens
guacaaaauccagcuaugaauauagagggcuuaugauucagauuguuaucuaucaacuauaa

SEQ ID NO: 251306 - RNA, 62 nt, Homo Sapiens
gguaacaccuaacugagccucacucacauuaaaugauucacuugaaauauauacagaaauug

SEQ ID NO: 251307 - RNA, 62 nt, Homo Sapiens
acucuuauauguaccauugguugauaauuauaaugauucauuuggacuugaagaaagauugu

SEQ ID NO: 251308 - RNA, 62 nt, Homo Sapiens
ccccaggcacaguaucugaaucacuggggauuaugauucacccucuuuggagaacaugcucu

SEQ ID NO: 251309 - RNA, 62 nt, Homo Sapiens
uaccucccccugggucugucagacuggcccccaugauucaauucacgagaauagcacgggaa

SEQ ID NO: 251310 - RNA, 62 nt, Homo Sapiens
uaccuccccuugggucucucagacuggcccccaugauucaauucacaagaauagcaugggaa

SEQ ID NO: 251311 - RNA, 62 nt, Homo Sapiens
ggaaaaucgggccuagaauuaaaaaggcagaaaugauucaggcuaggcagggaaaacugaac

SEQ ID NO: 251312 - RNA, 62 nt, Homo Sapiens
gaugcaaaacauucacccguaaaucuguugaaaugauucacucaucauuuucugccccccca

SEQ ID NO: 251313 - RNA, 62 nt, Homo Sapiens
gggagaguggccaguuggaaggcacugcuaaaaugauucacauuugaaaauauuguuacaaa

SEQ ID NO: 251314 - RNA, 62 nt, Homo Sapiens
gaguuacauuugcauuuaaugcagguauucccaugauucacaagguauuaauaagaggucug

SEQ ID NO: 251315 - RNA, 62 nt, Homo Sapiens
aagcaguacuacagaacaaaacaaacuagugcaugauucaccaaguuuacaugaauuuuaca

SEQ ID NO: 251316 - RNA, 62 nt, Homo Sapiens
aauauuccuauauuaaaauuguccccuuacucaugauucauccaguuucauugguggaauaa

SEQ ID NO: 251317 - RNA, 62 nt, Homo Sapiens
gaugcugucacucggcagccagcagggaacgcaugauucaggauggaaggaaagcugggaca

SEQ ID NO: 251318 - RNA, 62 nt, Homo Sapiens
cuucuucagcccucccaaaugcugguucagcuaugauucaggaucuucccccacccccauuu

SEQ ID NO: 251319 - RNA, 62 nt, Homo Sapiens
acuaggaccucauaucuuccucuaaauauuucaugauucacauaacucauggguacccagac

SEQ ID NO: 251320 - RNA, 62 nt, Homo Sapiens
ugaucauauaaaacaucaugccccuccuauguaugauucauugcaaccuaaguaaaaacauu

SEQ ID NO: 251321 - RNA, 62 nt, Homo Sapiens
augauugacccugauuuuaauugugaaauuauaugauucauauauuuuaugaaucagaauaa

SEQ ID NO: 251322 - RNA, 62 nt, Homo Sapiens
aaacccuaaauauguuuacauaccauuaagauaugauucauguaacaauguuaaauuaauua

SEQ ID NO: 251323 - RNA, 57 nt, Homo Sapiens; identical to SEQ ID NO: 251049

SEQ ID NO: 251324 - RNA, 62 nt, Homo Sapiens
auagaaguuaugaguggguuuaacaauuuuagaugauucagcuuuuguuccauuacuguuga

SEQ ID NO: 251325 - RNA, 62 nt, Homo Sapiens
gaggagugagacacaggcaucaacacucucaaaugauucacauguucagccaaaguugagaa

SEQ ID NO: 251326 - RNA, 62 nt, Homo Sapiens
cuugguguuguuauggcaaguuuuugguaaugaugauucaaucauuuugggaaauucuugca

SEQ ID NO: 251327 - RNA, 62 nt, Homo Sapiens
gugagagaaaucacaaaguauuagaguuuaccaugauucagagaaguucuucaggccuguag

SEQ ID NO: 251328 - RNA, 62 nt, Homo Sapiens
aaacuccaguucaugcuggaucuuaaccaaaaaugauucaauacuguuaucacuaaaacagc

SEQ ID NO: 251329 - RNA, 62 nt, Homo Sapiens
uugauuacaguauuuuaugcagacuauuaggaaugauucagugcauuuaacugaacacagag

SEQ ID NO: 251330 - RNA, 62 nt, Homo Sapiens
acaaaucaugcuaacuuugaacguggccugagaugauucagauuuguccucacaggcaugcc

SEQ ID NO: 251331 - RNA, 62 nt, Homo Sapiens
ggauugggggugaguguuuuuuuucuaugcagaugauucauuccuaggccugcuggcucugg

SEQ ID NO: 251332 - RNA, 62 nt, Homo Sapiens
guuggggagaagaaacaagaaccauggccuugaugauucacugaauacacuuguguuuaagc

SEQ ID NO: 251333 - RNA, 62 nt, Homo Sapiens
uacaaaaagcugcacauauuaacuacuuagguaugauucacaguuggaucauuuguuuuuaa

SEQ ID NO: 251334 - RNA, 62 nt, Homo Sapiens
acaauguaugugaaaguguaagagaaaaaccaaugauucauaauuggugauaaguggaaaaa

SEQ ID NO: 251335 - RNA, 62 nt, Homo Sapiens
auuaacucucaauuagcaugcaugcugguguuaugauucaguuucauauggccccucuuaac

SEQ ID NO: 251336 - RNA, 62 nt, Homo Sapiens
gaccccugaauuccaaaauaguauucgguuacaugauucacaauaucguguauauagcuuua

SEQ ID NO: 251337 - RNA, 62 nt, Homo Sapiens
uuagauuuuccucuggagagauaugaaccauuaugauucaaguaggguaugaacuagucaaa

SEQ ID NO: 251338 - RNA, 62 nt, Homo Sapiens
uuuacuuucuacaaacucuccguaguauauucaugauucaguguagaauguauagacuuuau

SEQ ID NO: 251339 - RNA, 62 nt, Homo Sapiens
uuaacuuguuaagcaauauuuuuaagggccaaaugauucaaaacaucacagguauuuaugug

SEQ ID NO: 251340 - RNA, 62 nt, Homo Sapiens
gaauagccaugacaagaguuugcauuuucuugaugauucaucuccaugagugcacaaucccu

SEQ ID NO: 251341 - RNA, 62 nt, Homo Sapiens
uguuacuagcaucaggagcuuacuguuuuauuaugauucaucuucaguaauuuuuagaagca

SEQ ID NO: 251342 - RNA, 62 nt, Homo Sapiens
uacagaguuuaaauaauuucaguaauucuuagaugauucagcuucaucauuaagaauaucuu

SEQ ID NO: 251343 - RNA, 62 nt, Homo Sapiens
cacaccuaagagaaaaagaucgaauuuuucagaugauucagaaauuuucauucagguauuug

SEQ ID NO: 251344 - RNA, 62 nt, Homo Sapiens
aaaaguaauguauaucuguaauauauaaucaaaugauucauuuuucuguuagacuaggcaaa

SEQ ID NO: 251345 - RNA, 62 nt, Homo Sapiens
uguuguauuaguaaauuauuagaauccaauuaaugauucaauuaacauauaucuuauccaau

SEQ ID NO: 251346 - RNA, 62 nt, Homo Sapiens
uuuuaaagauggaauaauuuuuuuuaaguucuaugauucauguauguuauuauaauuuugaa

SEQ ID NO: 251347 - RNA, 62 nt, Homo Sapiens
guuauuugaggggaaaaaacuuuuagucagaaaugauucaggcuucacaauuucaaugcuuc

SEQ ID NO: 251348 - RNA, 62 nt, Homo Sapiens
uaccucacaaaaucaugcaacuuauaugugaaaugauucaugaaguguacauuacuuuuuaa

SEQ ID NO: 251349 - RNA, 62 nt, Homo Sapiens
agaggaaaaagaccaccuuuucuaccuugguuaugauucaguacuuggauuuugaggggcac

SEQ ID NO: 251350 - RNA, 62 nt, Homo Sapiens
uguuuuaaaguuuaaugccucauuauggucuaaugauucaaauaaauaucguuagggugaag

SEQ ID NO: 251351 - RNA, 62 nt, Homo Sapiens
uauuuauauagauuugauuauguguugucagcaugauucaugaucaaacgaaaaaucagucc

SEQ ID NO: 251352 - RNA, 62 nt, Homo Sapiens
guggauuuggucacaagguuuaaggugacccaaugauucagcuauuuaaaaaaaaaagagga

SEQ ID NO: 251353 - RNA, 62 nt, Homo Sapiens
cuugaaucaguuuuuaaaauauuuagucuaagaugauucaaaguaguuuuauuuuaauacag

SEQ ID NO: 251354 - RNA, 62 nt, Homo Sapiens
uuguguguuuuucuuuauacugcaaauuaauaaugauucacuuuauaguuugggagacagaa

SEQ ID NO: 251355 - RNA, 62 nt, Homo Sapiens
aaccaccaccaaccacugcgaccacaagaaggaugauucaacagguuuuccugaagaauuga

SEQ ID NO: 251356 - RNA, 62 nt, Homo Sapiens
uaaaucuuuuuggucaggaggauuauauucucaugauucagcauguguauagaaagacuuuc

SEQ ID NO: 251357 - RNA, 62 nt, Homo Sapiens
gucaaguguuuuacuaucucacugcuguuuuuaugauucaggcuuauaacaaauauuguauc

SEQ ID NO: 251358 - RNA, 62 nt, Homo Sapiens
augcaguuuggcaucugcaguacaccaagcacaugauucaugucugagccaggucugcuuau

SEQ ID NO: 251359 - RNA, 62 nt, Homo Sapiens
accacaguuuuaagaguuucuuugagggguucaugauucauuuucucuccuuuguugagccu

SEQ ID NO: 251360 - RNA, 62 nt, Homo Sapiens
cucccuuacccugaccaaucuuccauauccuaaugauucaauaaaucaucaaagaaugcaau

SEQ ID NO: 251361 - RNA, 62 nt, Homo Sapiens
gauuuuuguccaauucauuuaaaaaccuauagaugauucaguuuaauuucuuuucuaauaaa

SEQ ID NO: 251362 - RNA, 62 nt, Homo Sapiens
ccacaggacuguugaaacuauuggcaaaucuaaugauucagcugagcaaguaauagauuuuc

SEQ ID NO: 251363 - RNA, 62 nt, Homo Sapiens
auuauauagauauuuaaagcauagaauacaagaugauucaaauuuguuccaaguauuaucug

SEQ ID NO: 251364 - RNA, 62 nt, Homo Sapiens
accugcagcuggugaauuagguguucguagaaaugauucaauaguguaagcuaguauucugu

SEQ ID NO: 251365 - RNA, 62 nt, Homo Sapiens
ucccccaaauuuaauaaagacagaggguucucaugauucacauugguugugcuauugcugau

SEQ ID NO: 251366 - RNA, 62 nt, Homo Sapiens
ugaacacaguaacugauagguaaaaagacugcaugauucacuuuuacacuuauauuucauug

SEQ ID NO: 251367 - RNA, 62 nt, Homo Sapiens
uauugcugaaauggcuguuggcaguucuuauuaugauucagagaagagcaaauagaccuuaa

SEQ ID NO: 251368 - RNA, 62 nt, Homo Sapiens
ggaagaggacuccuuaaauuugggggacuuacaugauucauuuuaacaucugagaaaagcuu

SEQ ID NO: 251369 - RNA, 62 nt, Homo Sapiens
guauuguuuuaaaaauuguaaaaauuauugugaugauucauuuagcauaaagagagguggac

SEQ ID NO: 251370 - RNA, 51 nt, Homo Sapiens; identical to SEQ ID NO: 251096

SEQ ID NO: 251371 - RNA, 62 nt, Homo Sapiens
ucaaauucucaaugcaggucauaacuauguugaugauucauacauaguauauacauaucaac

SEQ ID NO: 251372 - RNA, 62 nt, Homo Sapiens
uuugaugaguuuuuaaaaaugucuuccccgccaugauucacauaucagaaaucagcucagug

SEQ ID NO: 251373 - RNA, 62 nt, Homo Sapiens
cauucaauaagcuuuuacugauuauuuauccuaugauucauucuuaagaaauuacuaguugu

SEQ ID NO: 251374 - RNA, 62 nt, Homo Sapiens
agacacuuagauuaagauuugaaucuuuuauaaugauucauauucauaauuuuuaaagguug

SEQ ID NO: 251375 - RNA, 62 nt, Homo Sapiens
cagguuugaggaugcuggggucagauaguuuuaugauucacaauugagcaggccuaucucuu

SEQ ID NO: 251376 - RNA, 62 nt, Homo Sapiens
gcuauuucugaagucuguauagaauguuacugaugauucaggccuucugauguuaccacgau

SEQ ID NO: 251377 - RNA, 62 nt, Homo Sapiens
uuuugagugaauacaucagguauuuaaucaucaugauucauaucgcaugugaaaaccucaac

SEQ ID NO: 251378 - RNA, 62 nt, Homo Sapiens
aauaucuuguuaguaauauuuaucuuuagcacaugauucaccaguuuuggaagggccuucag

SEQ ID NO: 251379 - RNA, 62 nt, Homo Sapiens
uacacuaauuuuccauacuucuacucucugaaaugauucaaacugcuagugugaaacuugcu

SEQ ID NO: 251380 - RNA, 62 nt, Homo Sapiens
aagggagaauuguggaugguuauuuauagcucaugauucauccaaggacugaguuauucucc

SEQ ID NO: 251381 - RNA, 62 nt, Homo Sapiens
aguugccugccuguggcugguaagguaaugucaugauucauccucucuucagugagacugag

SEQ ID NO: 251382 - RNA, 62 nt, Homo Sapiens
uggcaaagcugaaauuuuuauacauucaacucaugauucacauguggcaucagucccaucag

SEQ ID NO: 251383 - RNA, 62 nt, Homo Sapiens
uuaaaaucuauucucucccccuuucucccuggaugauucaggaagcugacauuguuuccuca

SEQ ID NO: 251384 - RNA, 62 nt, Homo Sapiens
uuaaccaguucucacaacuugcuauacauaagaugauucacacuugaaugaaacccuacaaa

SEQ ID NO: 251385 - RNA, 62 nt, Homo Sapiens
aaauuauauagcuuuuuguuuuguuugaauaaaugauucauuccuguuugcuuuucuggugc

SEQ ID NO: 251386 - RNA, 62 nt, Homo Sapiens
uuucacauuggaaacaagucagucauucagauaugauucaaaugucuauaaaccgaacugau

SEQ ID NO: 251387 - RNA, 62 nt, Homo Sapiens
guacuguuaagguauuacuuuuuuucaugcugaugauucauaucuaaauuacauuauuaugu

SEQ ID NO: 251388 - RNA, 62 nt, Homo Sapiens
cuggagagaaguuacacaaaacuaaacauaagaugauucauacuaaccauuucucaacccuu

SEQ ID NO: 251389 - RNA, 62 nt, Homo Sapiens
auuuaaacuaugauaaauuagaauaucagaauaugauucacuauuaauaugauuauuaauca

SEQ ID NO: 251390 - RNA, 62 nt, Homo Sapiens
gucagggagguggcucagagcuccucgcuugaaugauucaggcccagucaagagcuccucug

SEQ ID NO: 251391 - RNA, 62 nt, Homo Sapiens
ugcaucuccaaacauuacucaagaaauaauucaugauucaacguauuucucugaauucagug

SEQ ID NO: 251392 - RNA, 62 nt, Homo Sapiens
ugccagguuuuuaaauguuuacauuagguuuuaugauucauuuuauaugacuuuaagagccc

SEQ ID NO: 251393 - RNA, 62 nt, Homo Sapiens
aaagugcaguauuuuucuacaucaugucaagaaugauucaauguaaauauuuuucauuuuau

SEQ ID NO: 251394 - RNA, 62 nt, Homo Sapiens
ccucuucaauccaucuuaccacacaauauuucaugauucaaauucuucaaagucuuauacgc

SEQ ID NO: 251395 - RNA, 62 nt, Homo Sapiens
aggaagauagaaacuagguuuugaaagauuacaugauucaagcgagggauuuuaaaguaaag

SEQ ID NO: 251396 - RNA, 62 nt, Homo Sapiens
uauaauaugugauguaacauguagaugauaauaugauucaguagucaacuugagggaaauuu

SEQ ID NO: 251397 - RNA, 62 nt, Homo Sapiens
uuucauuuuaaagguuauuugcucccgauuauaugauucaaguguuauaaguuuuagcuuga

SEQ ID NO: 251398 - RNA, 62 nt, Homo Sapiens
cuggacagccuggacauuuuauugcuaugcuuaugauucaggugcgcagaauaauauuaaga

SEQ ID NO: 251399 - RNA, 62 nt, Homo Sapiens
uuucagaaauaaaaguaugagauaauuuugaaaugauucaucaagaaaauauucuaacauuu

SEQ ID NO: 251400 - RNA, 62 nt, Homo Sapiens
agguccaauguuguucaccaguggugguagaaaugauucaccccuuuggacaaaugcauuua

SEQ ID NO: 251401 - RNA, 62 nt, Homo Sapiens
caaaugaauuuuuggugauugguauaccacaaaugauucaugcauguguauuuucuuauucu

SEQ ID NO: 251402 - RNA, 62 nt, Homo Sapiens
uugcugcgugugaaaucaugggaagaagcagaaugauucauuuuucaauuuaaaaagaguga

SEQ ID NO: 251403 - RNA, 62 nt, Homo Sapiens
cauuaauguuaaggcuaauaacugcaauaacaaugauucauuuauucuuguuuauucaaaug

SEQ ID NO: 251404 - RNA, 62 nt, Homo Sapiens
uucuucagagugguaauuguauuacuguuuuaaugauucaguuuuaaauuugugaacucgua

SEQ ID NO: 251405 - RNA, 62 nt, Homo Sapiens
aauuguuauguaaacaucauaaauaguaaauaaugauucaaugugaauuuuaaaaugcaaau

SEQ ID NO: 251406 - RNA, 62 nt, Homo Sapiens
acaaagaugagauuauuggggcuguucauauuaugauucagaaucauuuucuauugugguau

SEQ ID NO: 251407 - RNA, 62 nt, Homo Sapiens
ucuaccuacauuuacauguagguagauaugaaaugauucaauauccaugucuccuuuuacuc

SEQ ID NO: 251408 - RNA, 62 nt, Homo Sapiens
agcuggagcagcugauaguggaaaacagaauaaugauucaaagagucuucugucaccauguc

SEQ ID NO: 251409 - RNA, 62 nt, Homo Sapiens
ugguuugcagcccuaaugaaauuaugucuaggaugauucagucuauuucccauuuacuagca

SEQ ID NO: 251410 - RNA, 62 nt, Homo Sapiens
acugcuuacucguaaugaucuaguggggaaacaugauucauucacuuaaaauacugauuaag

SEQ ID NO: 251411 - RNA, 62 nt, Homo Sapiens
uaauugaaguaguguggagcauuaacuuguggaugauucagaguuaaaagauaaaaagacgc

SEQ ID NO: 251412 - RNA, 62 nt, Homo Sapiens
guuuacaugugucaaggugauuuuugaaauacaugauucaugacuugaccacaacuacuguu

SEQ ID NO: 251413 - RNA, 62 nt, Homo Sapiens
accauuucuucagguuaaauuuaaaaauuuauaugauucaaagacagucuuuauuuuucuuc

SEQ ID NO: 251414 - RNA, 62 nt, Homo Sapiens
cguuauuccuuauaaaguaacauucuucuuuuaugauucauaaaauguuucccaugaucgcu

SEQ ID NO: 251415 - RNA, 62 nt, Homo Sapiens
aucaagaagauucagaaaauuacaagguuaagaugauucaauuuacauugucuaaaaauccu

SEQ ID NO: 251416 - RNA, 62 nt, Homo Sapiens
ucauuucaccuugacgauucgauucucauuaaaugauucauuagccagugccacaguuugaa

SEQ ID NO: 251417 - RNA, 62 nt, Homo Sapiens
ggcugggaauugagaauuuauuuauugcauuuaugauucagucuucauuucuguugauuuuu

SEQ ID NO: 251418 - RNA, 62 nt, Homo Sapiens
auauaggcuguucuagccacagugguagauuuaugauucacauccgaaagugugccuuaguu

SEQ ID NO: 251419 - RNA, 62 nt, Homo Sapiens
ucacauggcuugcacucagugacaccaaauccaugauucaauguugaucuugagcaaguauu

SEQ ID NO: 251420 - RNA, 62 nt, Homo Sapiens
acuauuuuaacuuagaaaaaccaucguuucauaugauucacccuaauagauaccuccauuau

SEQ ID NO: 251421 - RNA, 62 nt, Homo Sapiens
ucugaccuucagcucacgcuucacagugaucgaugauucaggugcagaggaaguacaaacua

SEQ ID NO: 251422 - RNA, 62 nt, Homo Sapiens
ucacgagaauagcacaggaaagacuggcccccaugauucaauuaccucccccgggucccucc

SEQ ID NO: 251423 - RNA, 62 nt, Homo Sapiens
gcugaacgugcuccucucuccuucucuguacaaugauucagcaucucggcggaagaggaaaa

SEQ ID NO: 251424 - RNA, 62 nt, Homo Sapiens
uucaagccuuaaccuggaaucuagaccugggaaugauucaacuacucuuguuaaccuuagag

SEQ ID NO: 251425 - RNA, 62 nt, Homo Sapiens
gauuccaccucuggcuauaguagaauuacccuaugauucagcguucgucacaaaauucaaca

SEQ ID NO: 251426 - RNA, 62 nt, Homo Sapiens
uuguaccauuacauguuucaauuuaacgaaucaugauucagaugggggaagugggguauaau

SEQ ID NO: 251427 - RNA, 62 nt, Homo Sapiens
guuaaaugugaugaauacugucugagcagugaaugauucaguaccucgcuggacucucaguc

SEQ ID NO: 251428 - RNA, 62 nt, Homo Sapiens
gagcaaacagcacuuuacagcugugguggcgcaugauucacugcagguggagccauggugcu

SEQ ID NO: 251429 - RNA, 62 nt, Homo Sapiens
gggucauuagugagaaacgguuaaagucauaaaugauucauuuuauagaaucuaagcugguc

SEQ ID NO: 251430 - RNA, 62 nt, Homo Sapiens
acgggggaauauaaaagguugguuuugagcuaaugauucaaacagaugaucuuuuacucuua

SEQ ID NO: 251431 - RNA, 62 nt, Homo Sapiens
auugaaagcagaacaauggagaaaaaaaggucaugauucaugacaaaaugcugacuacugua

SEQ ID NO: 251432 - RNA, 62 nt, Homo Sapiens
aagcugaugauuguaccagucuuaaauuauucaugauucaauaaaauugaugcuuauuuauu

SEQ ID NO: 251433 - RNA, 62 nt, Homo Sapiens
aacaauuucuuuuuuaaaaaagacuauuuuauaugauucacaugcuaaagccaggauugugu

SEQ ID NO: 251434 - RNA, 62 nt, Homo Sapiens
uacuucuucaugguauuaugaagacuauauagaugauucaaccaagccugcaaaucucccuc

SEQ ID NO: 251435 - RNA, 62 nt, Homo Sapiens
aaggauugccauuagugacuuggaccaguuagaugauucacuuuuugccccuagggaugaga

SEQ ID NO: 251436 - RNA, 62 nt, Homo Sapiens
caauuucauguaauuuacccuuugcaauaaaaaugauucauuaaauauauaacuaaauguga

SEQ ID NO: 251437 - RNA, 61 nt, Homo Sapiens; identical to SEQ ID NO: 251163

SEQ ID NO: 251438 - RNA, 62 nt, Homo Sapiens
uaugggaauuugagaaauaucaacuuuuguuuaugauucaaaaauuguuggauuuaaagagg

SEQ ID NO: 251439 - RNA, 62 nt, Homo Sapiens
agcuuuuuuagaguuuauaucugcuuuuguauaugauucacgucaaccuuggucucaaauag

SEQ ID NO: 251440 - RNA, 62 nt, Homo Sapiens
ggcauuuuggugcuguuaaacugccuaagauuaugauucaggguauccugcucagccaagau

SEQ ID NO: 251441 - RNA, 62 nt, Homo Sapiens
uuuuuucauaauucaaacaagucuagagggaaaugauucaaauauaaguuugaaaugaaaug

SEQ ID NO: 251442 - RNA, 62 nt, Homo Sapiens
uuucaguucucaaauuaaaaauauuugaugugaugauucacuaaccaaagagacccugaaga

SEQ ID NO: 251443 - RNA, 62 nt, Homo Sapiens
auccuccaaagcaagaggcucaggaguaggaaaugauucaucguuuuaaaggagacuaacuc

SEQ ID NO: 251444 - RNA, 62 nt, Homo Sapiens
agaaccugaaccagaugaaccagaauagaagaaugauucaugggcauaaauauuuuugacag

SEQ ID NO: 251445 - RNA, 62 nt, Homo Sapiens
uuacuggacaaaaucaauaacuacaaaaggcaaugauucacgcuuuuguuuucauaauaccu

SEQ ID NO: 251446 - RNA, 62 nt, Homo Sapiens
gaaaauuuaaaagauuaaaugaaugagaagaaaugauucauaaauuuugaacuaacaguaau

SEQ ID NO: 251447 - RNA, 62 nt, Homo Sapiens
ggggcggggcagugaggggugggagaaggugaaugauucauuauuccaccccgagguuugcu

SEQ ID NO: 251448 - RNA, 62 nt, Homo Sapiens
uacauccuucccucacucccaugauuggagaaaugauucauugggugaugaguguugggguu

SEQ ID NO: 251449 - RNA, 62 nt, Homo Sapiens
ugccaugacauuggaagaagacagugauucaaaugauucaaaaggaagugaauaagaagaug

SEQ ID NO: 251450 - RNA, 62 nt, Homo Sapiens
uuccaugacauuggaaaaagagagugauucaaaugauucaaaaggaagugaauaagaagaug

SEQ ID NO: 251451 - RNA, 62 nt, Homo Sapiens
aucuaagcaguuucgauuuuacaauguuguccaugauucaaauuauucacugcaacaaagca

SEQ ID NO: 251452 - RNA, 62 nt, Homo Sapiens
ccuguacuacugauuauuaagccaagcuucugaugauucacauuuugaaauauuaaggucuu

SEQ ID NO: 251453 - RNA, 62 nt, Homo Sapiens
aucagaagaagaaggaacccccucauaggaggaugauucagcuuuuuuuuugaaagaguucu

SEQ ID NO: 251454 - RNA, 62 nt, Homo Sapiens
cuugacggugaauggaagacauaaugaaaagaaugauucaguacaauaagcaauauguggug

SEQ ID NO: 251455 - RNA, 62 nt, Homo Sapiens
aauuggaacagaauguuuuagacuuuauauggaugauucagauaucuguucuugcuacccau

SEQ ID NO: 251456 - RNA, 62 nt, Homo Sapiens
uuaugugauucaucuuauucccccuggaggauaugauucacuaaucuugauugugauaagcc

SEQ ID NO: 251457 - RNA, 62 nt, Homo Sapiens
gaaugaagaaucacaggcuugcaaggauaugcaugauucagguucugugaguccuauaaaaa

SEQ ID NO: 251458 - RNA, 62 nt, Homo Sapiens
gcagaggaauuuauuaugcacaaaaggaaagaaugauucaaauuucaaccaaaugauugguu

SEQ ID NO: 251459 - RNA, 62 nt, Homo Sapiens
ucucuucuugcauguaccuauucuaccuguucaugauucacaguauuagagaccagauauuu

SEQ ID NO: 251460 - RNA, 62 nt, Homo Sapiens
auccaccuugagaggaaugaagaacacaaggaaugauucaaguuuuauucagaacgaggaag

SEQ ID NO: 251461 - RNA, 62 nt, Homo Sapiens
gcucuggcaguucccaagucugucagaugaaaaugauucacagucugaauggaucugacccc

SEQ ID NO: 251462 - RNA, 62 nt, Homo Sapiens
ugcuuccggacaacugccaagggugcagugaaaugauucaugaagaaacugcugaaaaagcu

SEQ ID NO: 251463 - RNA, 62 nt, Homo Sapiens
aaaugcaaguaguuuccucgcgugaccucaccaugauucacauacgugccacuguuugaaau

SEQ ID NO: 251464 - RNA, 62 nt, Homo Sapiens
ccuuagccaugauuucguuaguagaccuauuuaugauucaauugcaauuuucagauaggaug

SEQ ID NO: 251465 - RNA, 62 nt, Homo Sapiens
caaaucuugaaagacgaaaucaaagcccauuaaugauucagaaucagugcuugaccuccugu

SEQ ID NO: 251466 - RNA, 62 nt, Homo Sapiens
uauggaucauucugaugacagauuuauacaaaaugauucaaaccaguaacuuaguaaaauug

SEQ ID NO: 251467 - RNA, 62 nt, Homo Sapiens
uuacacacuauauaaguuguucuuucaguuuuaugauucaacuacuguuuuuccuucagcug

SEQ ID NO: 251468 - RNA, 62 nt, Homo Sapiens
accgucucagacacgcacagugggccugcugcaugauucacacccagucccugccacagacc

SEQ ID NO: 251469 - RNA, 62 nt, Homo Sapiens; identical to SEQ ID NO: 251468

SEQ ID NO: 251470 - RNA, 62 nt, Homo Sapiens
ccauuccaaaguucaacuuggaugcuccagggaugauucaagacuccugacugcccggcaca

SEQ ID NO: 251471 - RNA, 62 nt, Homo Sapiens
uuuauuguauaauuaugaaguaugucuuuaaaaugauucacuauuuauaacauuguaaauga

SEQ ID NO: 251472 - RNA, 62 nt, Homo Sapiens
ugugaaaaaauucucagaucuuggaaggagaaaugauucaugucuaucaguaucaauaacca

SEQ ID NO: 251473 - RNA, 62 nt, Homo Sapiens
ggaaaauccuaaacauggaagaugauuuaaaaaugauucacccuggaauacaugcuuccagu

SEQ ID NO: 251474 - RNA, 62 nt, Homo Sapiens
auuguggacuuaauuacaaccacugcacuguaaugauucaaugcuguauuaugauauugcug

SEQ ID NO: 251475 - RNA, 62 nt, Homo Sapiens
aagcauauaaauuaaaauauuuaaaauuagauaugauucacacuauauucuguuucauaugc

SEQ ID NO: 251476 - RNA, 62 nt, Homo Sapiens
uuauauuuaaugcauuaaacuuguuauugugaaugauucaugaguucccugaaacacgaaac

SEQ ID NO: 251477 - RNA, 62 nt, Homo Sapiens
uugcauuuucugauccuguaaaaggugcuaaaaugauucaaugugcauuucuauuuauauca

SEQ ID NO: 251478 - RNA, 62 nt, Homo Sapiens
agcuuggucacuugauuagauguugaggccuuaugauucagcaaauaauaagaugcaacauu

SEQ ID NO: 251479 - RNA, 62 nt, Homo Sapiens
gguaaauauggcuuuaauuacaaacaugaggaaugauucacugaagaugaaaagauaggacg

SEQ ID NO: 251480 - RNA, 62 nt, Homo Sapiens
cugcuauagcccaaagcacguaguauuugcugaugauucagcaugagcugcaucuaccuacu

SEQ ID NO: 251481 - RNA, 62 nt, Homo Sapiens
aacugagggaauuccugucuucuuuaggaguaaugauucauagaucuagauagguggaaaua

SEQ ID NO: 251482 - RNA, 62 nt, Homo Sapiens
ucgcaaaauguuucaaguacuguaacugugucaugauucacccccaaacagugacauuuauu

SEQ ID NO: 251483 - RNA, 62 nt, Homo Sapiens
aagccaacuucaaauaccgugaccaaauuuacaugauucauauucauuaugcauuacuuggu

SEQ ID NO: 251484 - RNA, 62 nt, Homo Sapiens
ucccaugugggauggagcagcacaagaaaaggaugauucacaauggguggguaguguaaaua

SEQ ID NO: 251485 - RNA, 62 nt, Homo Sapiens
gagacuguuugaaucuuguccaccacugacagaugauucacacugaaacuuaacgugaucau

SEQ ID NO: 251486 - RNA, 62 nt, Homo Sapiens
ccauuuauaacuucuguuuuuuuauugagaaaaugauucacgaauuccaaaucagauugcca

SEQ ID NO: 251487 - RNA, 62 nt, Homo Sapiens
aaucccaccacaagcacauacuaauuuuauuuaugauucaaaugugacucgugccugcccau

SEQ ID NO: 251488 - RNA, 62 nt, Homo Sapiens
uccacggaugggugacaggggaugguuuugggaugauucaagugcauuacauuuauugugca

SEQ ID NO: 251489 - RNA, 62 nt, Homo Sapiens
agcuaaauccucaaaaccuaguaaggggacuaaugauucauuaaaguaaauugaugguuuug

SEQ ID NO: 251490 - RNA, 62 nt, Homo Sapiens
caccgccccucagcaaggaugacucagcagggaugauucagcagagauaacucggggaugac

SEQ ID NO: 251491 - RNA, 62 nt, Homo Sapiens
ugucaguagaugaccaaagaaagccacaguuaaugauucagacagccucugauccaucccuc

SEQ ID NO: 251492 - RNA, 62 nt, Homo Sapiens
auuggggcaugggaggggggcugggggaccccaugauucagccacggacuccaaugcccagc

SEQ ID NO: 251493 - RNA, 62 nt, Homo Sapiens
uauuacggaugaguucuggaaaagacccagcuaugauucauaaaaacacuucuggaugaauc

SEQ ID NO: 251494 - RNA, 62 nt, Homo Sapiens
ccccucaucugcucagcagcuauuugaaugagaugauucagaaggggaggggagacagguaa

SEQ ID NO: 251495 - RNA, 62 nt, Homo Sapiens
ucuauuuuaaauauuuuuaguauguacuguguaugauucauuaccauuuugaggggauuuau

SEQ ID NO: 251496 - RNA, 62 nt, Homo Sapiens
auuuuccccccacuccucccggggaacccagaaugauucaacugaagugauacacuaaucac

SEQ ID NO: 251497 - RNA, 62 nt, Homo Sapiens
cacacuggccuuucuguuccaccuuccuuaccaugauucagccucuucucuucauacucucu

SEQ ID NO: 251498 - RNA, 62 nt, Homo Sapiens
agcuggguacugacugagauagguugauuuucaugauucauggccuucgggagggcgggggg

SEQ ID NO: 251499 - RNA, 62 nt, Homo Sapiens
gcuauuuguaacugugucccucuuuguguauuaugauucaguuucuuuaacacacacuaggc

SEQ ID NO: 251500 - RNA, 62 nt, Homo Sapiens
uugcugcuuggauuuugaaaguuuuucaagaaaugauucaaauuugguguuugucuguguuu

SEQ ID NO: 251501 - RNA, 62 nt, Homo Sapiens
uauaugaauaugcaguaugggacuuugaaauaaugauucauaauaaaauacuaaacgugugu

SEQ ID NO: 251502 - RNA, 62 nt, Homo Sapiens
auuucaguuuacuagacugaaagcagcauuuuaugauucauaauuuaggaagcaaaaguaag

SEQ ID NO: 251503 - RNA, 62 nt, Homo Sapiens
uuuauauuuuacuuuuuuauugcugguuuaagaugauucagauuauccuuguacuuugagga

SEQ ID NO: 251504 - RNA, 62 nt, Homo Sapiens
uccagugagcgcgccugcuuuagagacacaggaugauucagaccggaaacagaccucguggg

SEQ ID NO: 251505 - RNA, 62 nt, Homo Sapiens
gacuucaugauccugggccugagaacacaggaaugauucauagcccaccccccaccuccaug

SEQ ID NO: 251506 - RNA, 62 nt, Homo Sapiens
auaaaacguaaacacgugcuuuguuaaaauguaugauucaggagauuuccuguagcugugaa

SEQ ID NO: 251507 - RNA, 62 nt, Homo Sapiens
uuuaaagcucuauuugacuuguaaagauguaaaugauucaggguaguuuuacauuuuauaaa

SEQ ID NO: 251508 - RNA, 62 nt, Homo Sapiens
ucaaaauccugagugagucuaaauuucucgugaugauucauucagugauucaacuuuaaaac

SEQ ID NO: 251509 - RNA, 62 nt, Homo Sapiens
caccucuaccucccgaaguguuuucugaucuuaugauucaccguuagccuggauggucucga

SEQ ID NO: 251510 - RNA, 62 nt, Homo Sapiens
cguggcaccccauacuagaaaggcuuucgggaaugauucacagaaauguaagguuugugaca

SEQ ID NO: 251511 - RNA, 62 nt, Homo Sapiens
cuguaccagacaugacaacaaagucuuuggggaugauucaguaacuuaggaugagggcagaa

SEQ ID NO: 251512 - RNA, 62 nt, Homo Sapiens
cuugaguaugugccacgugcuugugaaaugcuaugauucacauguaacauuuaaacauuaau

SEQ ID NO: 251513 - RNA, 62 nt, Homo Sapiens
gugaggaaaucucuuccaauuucugcuucugaaugauucaauguugggagcaauagaaauaa

SEQ ID NO: 251514 - RNA, 62 nt, Homo Sapiens
aaauacauuuuuuugguucuauauaaugcuucaugauucauuuagggaccuagaaauauugu

SEQ ID NO: 251515 - RNA, 62 nt, Homo Sapiens
caucugccccacucgccuuugccccgucaucgaugauucaggcagagccagauucguuaggu

SEQ ID NO: 251516 - RNA, 62 nt, Homo Sapiens
ccaauuagcaauugacugucgcuucaaacugcaugauucaugccaggagacaguucaagaaa

SEQ ID NO: 251517 - RNA, 62 nt, Homo Sapiens
aauugaaaacuuuggagaacucauuucaaguuaugauucagugcauuuucaacauugauuuu

SEQ ID NO: 251518 - RNA, 62 nt, Homo Sapiens
agaaauuauaccuuuuuaguacuugcugaagaaugauucaggguaaaucacauacuuuguuu

SEQ ID NO: 251519 - RNA, 62 nt, Homo Sapiens
uuucccucaaauagugaugguaugguuuaucaaugauucaugcuauacucauacauuuuuaa

SEQ ID NO: 251520 - RNA, 62 nt, Homo Sapiens
ggucacuucauuuuuauuaauuacucuuagagaugauucagauuugcuuccccgugcaugau

SEQ ID NO: 251521 - RNA, 62 nt, Homo Sapiens
uuucuccaaagacauguaaaugacaguuuaauaugauucacuucauuggggugaaguguucu

SEQ ID NO: 251522 - RNA, 62 nt, Homo Sapiens
uugagccuaggaggucaaggcugcagugagccaugauucacagcacugcacugcagccuggg

SEQ ID NO: 251523 - RNA, 62 nt, Homo Sapiens
gugcaacauacagguaggucgguucugaaaguaugauucaaugagagggaugguuucugagg

SEQ ID NO: 251524 - RNA, 62 nt, Homo Sapiens
uucaccccucccagucuacccauccagccuucaugauucauuccugugucaagguuagucgc

SEQ ID NO: 251525 - RNA, 62 nt, Homo Sapiens
uagucccccaucccuuccucccuuacccagcuaugauucaguugucucugcccucccucuua

SEQ ID NO: 251526 - RNA, 62 nt, Homo Sapiens
auguaaaauuuaaauaauuacuuuuuuauaauaugauucacuuaugccacagauucaacauu

SEQ ID NO: 251527 - RNA, 62 nt, Homo Sapiens
gcccacagaugauuccuuuauauagauguauaaugauucaaacugcugccuuugccuccagu

SEQ ID NO: 251528 - RNA, 62 nt, Homo Sapiens
gaaugcuuuuugauguugauuuugaccuguucaugauucagaagaaaaacaaacuuuuuugg

SEQ ID NO: 251529 - RNA, 62 nt, Homo Sapiens
uaccucccacugggucccucagaccugccuccaugauucaguucaugagaauagcaugggaa

SEQ ID NO: 251530 - RNA, 62 nt, Homo Sapiens
aaaauuaaaaauuaaaaaaagaugcagcuaccaugauucaaacucuugauuggagcuuuugu

SEQ ID NO: 251531 - RNA, 62 nt, Homo Sapiens
cagaccucuugagcuccuggauguuuggugacaugauucauaaaagcauuugagcgaaaguc

SEQ ID NO: 251532 - RNA, 62 nt, Homo Sapiens
gcgagacaagauuggcgucuugugcacagcuaaugauucaauuugugcuuggaauguguuga

SEQ ID NO: 251533 - RNA, 62 nt, Homo Sapiens
aagucacaguuaaggagaauaaauacagauaaaugauucaaaauaauugugugauauuucag

SEQ ID NO: 251534 - RNA, 62 nt, Homo Sapiens
ugugggugccaggcugugugugggacagcuggaugauucauccccugcuggguuggggaggg

SEQ ID NO: 251535 - RNA, 63 nt, Homo Sapiens
cuaggccaaaaauggugagcgaucauuuauuucaugauucaaccugauacauuuacauagugc

SEQ ID NO: 251536 - RNA, 63 nt, Homo Sapiens
gagggguggugcuagaagacagacaucuguggaaugauucacauccucucaaguuaggaggau

SEQ ID NO: 251537 - RNA, 63 nt, Homo Sapiens
caguaaccaacuuggaaagcuguauuuguucccaugauucagcaaacaaugaguaccuacugu

SEQ ID NO: 251538 - RNA, 63 nt, Homo Sapiens
ucaugaacauuuugauacaaauuucaucauuuaaugauucaccaauuucuugcauuaauuuga

SEQ ID NO: 251539 - RNA, 63 nt, Homo Sapiens
cauuuuuuuccuaaccuuuugcuauuauaaauaaugauucauuuuauaaccuuuuauauaggu

SEQ ID NO: 251540 - RNA, 63 nt, Homo Sapiens
ucuaaguaaagcacagucccuaggacauaguaaaugauucauauauccgaacuacuguuauaa

SEQ ID NO: 251541 - RNA, 63 nt, Homo Sapiens
caaaaccaggauggaugccucacauagaucaugaugauucaauccaaaggcacuuugcagugc

SEQ ID NO: 251542 - RNA, 63 nt, Homo Sapiens
guguuccuuauacucuauuauauaguguuauucaugauucagcugaucuuaacaaaauucgua

SEQ ID NO: 251543 - RNA, 63 nt, Homo Sapiens
gaguagcugagaauucaaaaacauccuugcagaaugauucaaaagacaaaagccaggcucaac

SEQ ID NO: 251544 - RNA, 63 nt, Homo Sapiens
uauguuauaucugcauaugagugauaugugaucaugauucauuuugcagauuuacauuuugcu

SEQ ID NO: 251545 - RNA, 63 nt, Homo Sapiens
ugacuugggcugcuggugccuugagucccacagaugauucauuaggaaaagccagauauacca

SEQ ID NO: 251546 - RNA, 63 nt, Homo Sapiens
cucuuacuucuacagguuccuugagcaccaaagaugauucauaacucuguauaggugacagcu

SEQ ID NO: 251547 - RNA, 63 nt, Homo Sapiens
gaaccaagcccugguagggaagagguaagggggaugauucaccuccauauuuccuaagcaggu

SEQ ID NO: 251548 - RNA, 63 nt, Homo Sapiens
auucaucugaagagagacuuaagaugaaagcaaaugauucagcucccuuauacccccauuaaa

SEQ ID NO: 251549 - RNA, 63 nt, Homo Sapiens
ugauguuauucuagaauguuuucuuuccagaugaugauucagaagcuaauuuuaaaaaacggu

SEQ ID NO: 251550 - RNA, 63 nt, Homo Sapiens
cuugaggcuaaguuuuggacuaccaaggaccagaugauucacauguaggaaacagccagaagc

SEQ ID NO: 251551 - RNA, 63 nt, Homo Sapiens
agugguaauccugaaucucuuuuaaacuauuauaugauucauaaugguucucaggaauuaaua

SEQ ID NO: 251552 - RNA, 63 nt, Homo Sapiens
cugcuuaucgugucugggguucaccggaaauaaaugauucacuggaacaauucuacugucaaa

SEQ ID NO: 251553 - RNA, 63 nt, Homo Sapiens
auauaagaaauaaaaauugggcaauaaaauaaaaugauucaguguuucuuuucuauauuguca

SEQ ID NO: 251554 - RNA, 63 nt, Homo Sapiens
gauacaaaugggcuucucucguugcuuuucucaaugauucaggugugacugucaguuguaucu

SEQ ID NO: 251555 - RNA, 63 nt, Homo Sapiens
ccgaucuuggcuuucagucuaauaaaguugcagaugauucaaaaugacuuauuucugcucugg

SEQ ID NO: 251556 - RNA, 63 nt, Homo Sapiens
ugaagauacaauuuuauuugugauggcugagaaaugauucauuuacggacuaagcuguaauua

SEQ ID NO: 251557 - RNA, 63 nt, Homo Sapiens
gauggggacauggaaaugagggggcacacacagaugauucaugcuggggaugauguggaaaua

SEQ ID NO: 251558 - RNA, 63 nt, Homo Sapiens
guuuuuuuuacuugguuuguaaccaaagaauaaaugauucaugacuuaagugucuguguagac

SEQ ID NO: 251559 - RNA, 63 nt, Homo Sapiens
aacuucuuaccauauaaaaaugaucuuaaaccuaugauucaguacauguaugauuugugccac

SEQ ID NO: 251560 - RNA, 63 nt, Homo Sapiens
gugguaacccaaauucauaauaggaguaggaugaugauucaaauucucuauaccaagauaugc

SEQ ID NO: 251561 - RNA, 63 nt, Homo Sapiens
uuauacuuucucuuaguuaauuagaauguuaacaugauucacagguccuaacuuucuguuauu

SEQ ID NO: 251562 - RNA, 63 nt, Homo Sapiens
uuggaggaagcuggggaaagagguucuuagaagaugauucaccuccugcagggcuggaggaac

SEQ ID NO: 251563 - RNA, 63 nt, Homo Sapiens
gaauuuaguaacagaaucaaauuugauuaaauaaugauucacauuuuuucuaaucuuuaguag

SEQ ID NO: 251564 - RNA, 63 nt, Homo Sapiens
gucugaaguggugccccaggcaauaccagaaagaugauucagagaccaugacccagccacagu

SEQ ID NO: 251565 - RNA, 63 nt, Homo Sapiens
cauagaugacuggauuccuguguggagagauguaugauucaaagccacucagaugaccugagu

SEQ ID NO: 251566 - RNA, 63 nt, Homo Sapiens
uaucucccaccagguuccucgggaaacaacuccaugauucagucuaccaugagaacaguaugg

SEQ ID NO: 251567 - RNA, 63 nt, Homo Sapiens
ggcaugggaagaccaaaacccauucucugccugaugauucaaacucuaucaauagaguaaccu

SEQ ID NO: 251568 - RNA, 63 nt, Homo Sapiens
gaugauaccuuuguugaaagaauugugaauagcaugauucauuucuagcagaggcugaguuua

SEQ ID NO: 251569 - RNA, 63 nt, Homo Sapiens
gguuuaaagagauugugucuguuuaaaaucaguaugauucagagaaggaccaaauuauaugaa

SEQ ID NO: 251570 - RNA, 63 nt, Homo Sapiens
ccugcaggcugucacaugacucauugaguaguaaugauucagaagaaaaagaaaaaggagacu

SEQ ID NO: 251571 - RNA, 63 nt, Homo Sapiens
auuaaaacugacauaaaauuuuaugauaauaacaugauucaagaaaugugauguagauuuuug

SEQ ID NO: 251572 - RNA, 63 nt, Homo Sapiens
acuuggcuucuggucuugauguauuugauaagaaugauucauuuucugauauggcuuccuaau

SEQ ID NO: 251573 - RNA, 63 nt, Homo Sapiens
auagguugaauaugguaggucuuugaaaauaugaugauucaauuuucucaauuuucuuugcuu

SEQ ID NO: 251574 - RNA, 63 nt, Homo Sapiens
uugucauagaggaaaagcacagauuauaccuggaugauucaggagcacauucugauuccaggu

SEQ ID NO: 251575 - RNA, 63 nt, Homo Sapiens
uuugaauguauuguucuguuuguguuauuucagaugauucaaauaucaaaaggaagauucuuc

SEQ ID NO: 251576 - RNA, 63 nt, Homo Sapiens
gugacauauugcuacaaagauuuuuuuuccuaaaugauucaguaauugaaugauuauuuaaua

SEQ ID NO: 251577 - RNA, 63 nt, Homo Sapiens
auuauauuguaaugauguuagauaauacucaacaugauucaguaugacaaacuuuuuugagca

SEQ ID NO: 251578 - RNA, 63 nt, Homo Sapiens
uauauugacgguacagaugguccccaacuuguaaugauucaauuuaggguuuuucaacuuuac

SEQ ID NO: 251579 - RNA, 63 nt, Homo Sapiens
cguacaaaauccagcuaugaauauagagggcuuaugauucagauuguuaucuaucaacuauaa

SEQ ID NO: 251580 - RNA, 63 nt, Homo Sapiens
ugguaacaccuaacugagccucacucacauuaaaugauucacuugaaauauauacagaaauug

SEQ ID NO: 251581 - RNA, 63 nt, Homo Sapiens
uacucuuauauguaccauugguugauaauuauaaugauucauuuggacuugaagaaagauugu

SEQ ID NO: 251582 - RNA, 63 nt, Homo Sapiens
uccccaggcacaguaucugaaucacuggggauuaugauucacccucuuuggagaacaugcucu

SEQ ID NO: 251583 - RNA, 63 nt, Homo Sapiens
uaccucccccugggucugucaagacuggcccccaugauucaaugucacgagaauagcacggga

SEQ ID NO: 251584 - RNA, 63 nt, Homo Sapiens
uaccuccccuugggucucucaagacuggcccccaugauucaauaucacaagaauagcauggga

SEQ ID NO: 251585 - RNA, 63 nt, Homo Sapiens
ggaaaaucgggccuagaauucaaaaaggcagaaaugauucaggucuaggcagggaaaacugaa

SEQ ID NO: 251586 - RNA, 63 nt, Homo Sapiens
gaugcaaaacauucacccguaaaaucuguugaaaugauucacuucaucauuuucugccccccc

SEQ ID NO: 251587 - RNA, 63 nt, Homo Sapiens
gggagaguggccaguuggaaaggcacugcuaaaaugauucacacuuugaaaauauuguuacaa

SEQ ID NO: 251588 - RNA, 63 nt, Homo Sapiens
gaguuacauuugcauuuaauggcagguauucccaugauucacaaagguauuaauaagaggucu

SEQ ID NO: 251589 - RNA, 63 nt, Homo Sapiens
aagcaguacuacagaacaaaaacaaacuagugcaugauucaccaaaguuuacaugaauuuuac

SEQ ID NO: 251590 - RNA, 63 nt, Homo Sapiens
aauauuccuauauuaaaauuaguccccuuacucaugauucaucccaguuucauugguggaaua

SEQ ID NO: 251591 - RNA, 63 nt, Homo Sapiens
gaugcugucacucggcagccaagcagggaacgcaugauucagggauggaaggaaagcugggac

SEQ ID NO: 251592 - RNA, 63 nt, Homo Sapiens
cuucuucagcccucccaaauugcugguucagcuaugauucaggcaucuucccccacccccauu

SEQ ID NO: 251593 - RNA, 63 nt, Homo Sapiens
acuaggaccucauaucuucccucuaaauauuucaugauucacacuaacucauggguacccaga

SEQ ID NO: 251594 - RNA, 63 nt, Homo Sapiens
ugaucauauaaaacaucauguccccuccuauguaugauucauuagcaaccuaaguaaaaacau

SEQ ID NO: 251595 - RNA, 63 nt, Homo Sapiens
uaugauugacccugauuuuaauugugaaauuauaugauucauauauuuuaugaaucagaauaa

SEQ ID NO: 251596 - RNA, 63 nt, Homo Sapiens
gaaacccuaaauauguuuacauaccauuaagauaugauucauguaacaauguuaaauuaauua

SEQ ID NO: 251597 - RNA, 57 nt, Homo Sapiens; identical to SEQ ID NO: 251049

SEQ ID NO: 251598 - RNA, 63 nt, Homo Sapiens
aauagaaguuaugaguggguuuaacaauuuuagaugauucagcuuuuguuccauuacuguuga

SEQ ID NO: 251599 - RNA, 63 nt, Homo Sapiens
ugaggagugagacacaggcaucaacacucucaaaugauucacauguucagccaaaguugagaa

SEQ ID NO: 251600 - RNA, 63 nt, Homo Sapiens
ucuugguguuguuauggcaaguuuuugguaaugaugauucaaucauuuugggaaauucuugca

SEQ ID NO: 251601 - RNA, 63 nt, Homo Sapiens
ugugagagaaaucacaaaguauuagaguuuaccaugauucagagaaguucuucaggccuguag

SEQ ID NO: 251602 - RNA, 63 nt, Homo Sapiens
aaaacuccaguucaugcuggaucuuaaccaaaaaugauucaauacuguuaucacuaaaacagc

SEQ ID NO: 251603 - RNA, 63 nt, Homo Sapiens
cuugauuacaguauuuuaugcagacuauuaggaaugauucagugcauuuaacugaacacagag

SEQ ID NO: 251604 - RNA, 63 nt, Homo Sapiens
acaaaucaugcuaacuuugacacguggccugagaugauucagaguuuguccucacaggcaugc

SEQ ID NO: 251605 - RNA, 63 nt, Homo Sapiens
ggauugggggugaguguuuuguuuucuaugcagaugauucauucccuaggccugcuggcucug

SEQ ID NO: 251606 - RNA, 63 nt, Homo Sapiens
guuggggagaagaaacaagacaccauggccuugaugauucacuggaauacacuuguguuuaag

SEQ ID NO: 251607 - RNA, 63 nt, Homo Sapiens
uacaaaaagcugcacauauuaaacuacuuagguaugauucacagguuggaucauuuguuuuua

SEQ ID NO: 251608 - RNA, 63 nt, Homo Sapiens
acaauguaugugaaaguguaaagagaaaaaccaaugauucauaaauuggugauaaguggaaaa

SEQ ID NO: 251609 - RNA, 63 nt, Homo Sapiens
auuaacucucaauuagcaugccaugcugguguuaugauucaguauucauauggccccucuuaa

SEQ ID NO: 251610 - RNA, 63 nt, Homo Sapiens
gaccccugaauuccaaaauaaguauucgguuacaugauucacauauaucguguauauagcuuu

SEQ ID NO: 251611 - RNA, 63 nt, Homo Sapiens
uuagauuuuccucuggagagaauaugaaccauuaugauucaagauaggguaugaacuagucaa

SEQ ID NO: 251612 - RNA, 63 nt, Homo Sapiens
guuuacuuucuacaaacucuccguaguauauucaugauucaguguagaauguauagacuuuau

SEQ ID NO: 251613 - RNA, 63 nt, Homo Sapiens
uuuaacuuguuaagcaauauuuuuaagggccaaaugauucaaaacaucacagguauuuaugug

SEQ ID NO: 251614 - RNA, 63 nt, Homo Sapiens
ugaauagccaugacaagaguuugcauuuucuugaugauucaucuccaugagugcacaaucccu

SEQ ID NO: 251615 - RNA, 63 nt, Homo Sapiens
auguuacuagcaucaggagcuuacuguuuuauuaugauucaucuucaguaauuuuuagaagca

SEQ ID NO: 251616 - RNA, 63 nt, Homo Sapiens
auacagaguuuaaauaauuucaguaauucuuagaugauucagcuucaucauuaagaauaucuu

SEQ ID NO: 251617 - RNA, 63 nt, Homo Sapiens
acacaccuaagagaaaaagaucgaauuuuucagaugauucagaaauuuucauucagguauuug

SEQ ID NO: 251618 - RNA, 63 nt, Homo Sapiens
aaaaaguaauguauaucuguaauauauaaucaaaugauucauuuuucuguuagacuaggcaaa

SEQ ID NO: 251619 - RNA, 63 nt, Homo Sapiens
auguuguauuaguaaauuauuagaauccaauuaaugauucaauuaacauauaucuuauccaau

SEQ ID NO: 251620 - RNA, 63 nt, Homo Sapiens
uuuuaaagauggaauaauuuauuuuuaaguucuaugauucaugauauguuauuauaauuuuga

SEQ ID NO: 251621 - RNA, 63 nt, Homo Sapiens
guuauuugaggggaaaaaaccuuuuagucagaaaugauucaggccuucacaauuucaaugcuu

SEQ ID NO: 251622 - RNA, 63 nt, Homo Sapiens
uaccucacaaaaucaugcaaacuuauaugugaaaugauucaugaaaguguacauuacuuuuua

SEQ ID NO: 251623 - RNA, 63 nt, Homo Sapiens
agaggaaaaagaccaccuuucucuaccuugguuaugauucaguuacuuggauuuugaggggca

SEQ ID NO: 251624 - RNA, 63 nt, Homo Sapiens
uguuuuaaaguuuaaugccugcauuauggucuaaugauucaaaauaaauaucguuagggugaa

SEQ ID NO: 251625 - RNA, 63 nt, Homo Sapiens
uauuuauauagauuugauuacuguguugucagcaugauucaugaaucaaacgaaaaaucaguc

SEQ ID NO: 251626 - RNA, 63 nt, Homo Sapiens
uguggauuuggucacaagguuuaaggugacccaaugauucagcuauuuaaaaaaaaaagagga

SEQ ID NO: 251627 - RNA, 63 nt, Homo Sapiens
acuugaaucaguuuuuaaaauauuuagucuaagaugauucaaaguaguuuuauuuuaauacag

SEQ ID NO: 251628 - RNA, 63 nt, Homo Sapiens
uuuguguguuuuucuuuauacugcaaauuaauaaugauucacuuuauaguuugggagacagaa

SEQ ID NO: 251629 - RNA, 63 nt, Homo Sapiens
caaccaccaccaaccacugcgaccacaagaaggaugauucaacagguuuuccugaagaauuga

SEQ ID NO: 251630 - RNA, 63 nt, Homo Sapiens
guaaaucuuuuuggucaggaggauuauauucucaugauucagcauguguauagaaagacuuuc

SEQ ID NO: 251631 - RNA, 63 nt, Homo Sapiens
ugucaaguguuuuacuaucucacugcuguuuuuaugauucaggcuuauaacaaauauuguauc

SEQ ID NO: 251632 - RNA, 63 nt, Homo Sapiens
gaugcaguuuggcaucugcaguacaccaagcacaugauucaugucugagccaggucugcuuau

SEQ ID NO: 251633 - RNA, 63 nt, Homo Sapiens
accacaguuuuaagaguuucuuuugagggguucaugauucauucuucucuccuuuguugagcc

SEQ ID NO: 251634 - RNA, 63 nt, Homo Sapiens
cucccuuacccugaccaaucuuuccauauccuaaugauucaauuaaaucaucaaagaaugcaa

SEQ ID NO: 251635 - RNA, 63 nt, Homo Sapiens
gauuuuuguccaauucauuuaaaaaaccuauagaugauucagucuuaauuucuuuucuaauaa

SEQ ID NO: 251636 - RNA, 63 nt, Homo Sapiens
ccacaggacuguugaaacuacuuggcaaaucuaaugauucagcgugagcaaguaauagauuuu

SEQ ID NO: 251637 - RNA, 63 nt, Homo Sapiens
auuauauagauauuuaaagcgauagaauacaagaugauucaaauuuuguuccaaguauuaucu

SEQ ID NO: 251638 - RNA, 63 nt, Homo Sapiens
accugcagcuggugaauuaguguguucguagaaaugauucaauuaguguaagcuaguauucug

SEQ ID NO: 251639 - RNA, 63 nt, Homo Sapiens
uucccccaaauuuaauaaagacagaggguucucaugauucacauugguugugcuauugcugau

SEQ ID NO: 251640 - RNA, 63 nt, Homo Sapiens
augaacacaguaacugauagguaaaaagacugcaugauucacuuuuacacuuauauuucauug

SEQ ID NO: 251641 - RNA, 63 nt, Homo Sapiens
uuauugcugaaauggcuguuggcaguucuuauuaugauucagagaagagcaaauagaccuuaa

SEQ ID NO: 251642 - RNA, 63 nt, Homo Sapiens
uggaagaggacuccuuaaauuugggggacuuacaugauucauuuuaacaucugagaaaagcuu

SEQ ID NO: 251643 - RNA, 63 nt, Homo Sapiens
uguauuguuuuaaaaauuguaaaaauuauugugaugauucauuuagcauaaagagagguggac

SEQ ID NO: 251644 - RNA, 51 nt, Homo Sapiens; identical to SEQ ID NO: 251096

SEQ ID NO: 251645 - RNA, 63 nt, Homo Sapiens
ucaaauucucaaugcagguccauaacuauguugaugauucauaacauaguauauacauaucaa

SEQ ID NO: 251646 - RNA, 63 nt, Homo Sapiens
uuugaugaguuuuuaaaaauggucuuccccgccaugauucacauuaucagaaaucagcucagu

SEQ ID NO: 251647 - RNA, 63 nt, Homo Sapiens
cauucaauaagcuuuuacuguauuauuuauccuaugauucauuucuuaagaaauuacuaguug

SEQ ID NO: 251648 - RNA, 63 nt, Homo Sapiens
agacacuuagauuaagauuuggaaucuuuuauaaugauucauauuucauaauuuuuaaagguu

SEQ ID NO: 251649 - RNA, 63 nt, Homo Sapiens
cagguuugaggaugcugggguucagauaguuuuaugauucacauauugagcaggccuaucucu

SEQ ID NO: 251650 - RNA, 63 nt, Homo Sapiens
gcuauuucugaagucuguauuagaauguuacugaugauucagguccuucugauguuaccacga

SEQ ID NO: 251651 - RNA, 63 nt, Homo Sapiens
uuuugagugaauacaucaggcuauuuaaucaucaugauucauagucgcaugugaaaaccucaa

SEQ ID NO: 251652 - RNA, 63 nt, Homo Sapiens
aauaucuuguuaguaauauuguaucuuuagcacaugauucacccaguuuuggaagggccuuca

SEQ ID NO: 251653 - RNA, 63 nt, Homo Sapiens
uacacuaauuuuccauacuuucuacucucugaaaugauucaaaucugcuagugugaaacuugc

SEQ ID NO: 251654 - RNA, 63 nt, Homo Sapiens
gaagggagaauuguggaugguuauuuauagcucaugauucauccaaggacugaguuauucucc

SEQ ID NO: 251655 - RNA, 63 nt, Homo Sapiens
uaguugccugccuguggcugguaagguaaugucaugauucauccucucuucagugagacugag

SEQ ID NO: 251656 - RNA, 63 nt, Homo Sapiens
guggcaaagcugaaauuuuuauacauucaacucaugauucacauguggcaucagucccaucag

SEQ ID NO: 251657 - RNA, 63 nt, Homo Sapiens
uuuaaaaucuauucucucccccuuucucccuggaugauucaggaagcugacauuguuuccuca

SEQ ID NO: 251658 - RNA, 63 nt, Homo Sapiens
uuuaaccaguucucacaacuugcuauacauaagaugauucacacuugaaugaaacccuacaaa

SEQ ID NO: 251659 - RNA, 63 nt, Homo Sapiens
aaaauuauauagcuuuuuguuuuguuugaauaaaugauucauuccuguuugcuuuucuggugc

SEQ ID NO: 251660 - RNA, 63 nt, Homo Sapiens
uuuucacauuggaaacaagucagucauucagauaugauucaaaugucuauaaaccgaacugau

SEQ ID NO: 251661 - RNA, 63 nt, Homo Sapiens
uguacuguuaagguauuacuuuuuuucaugcugaugauucauaucuaaauuacauuauuaugu

SEQ ID NO: 251662 - RNA, 63 nt, Homo Sapiens
cuggagagaaguuacacaaauacuaaacauaagaugauucauaucuaaccauuucucaacccu

SEQ ID NO: 251663 - RNA, 63 nt, Homo Sapiens
auuuaaacuaugauaaauuaagaauaucagaauaugauucacuaauuaauaugauuauuaauc

SEQ ID NO: 251664 - RNA, 63 nt, Homo Sapiens
gucagggagguggcucagaggcuccucgcuugaaugauucaggccccagucaagagcuccucu

SEQ ID NO: 251665 - RNA, 63 nt, Homo Sapiens
ugcaucuccaaacauuacucgaagaaauaauucaugauucaacuguauuucucugaauucagu

SEQ ID NO: 251666 - RNA, 63 nt, Homo Sapiens
ugccagguuuuuaaauguuucacauuagguuuuaugauucauuauuauaugacuuuaagagcc

SEQ ID NO: 251667 - RNA, 63 nt, Homo Sapiens
gaaagugcaguauuuuucuacaucaugucaagaaugauucaauguaaauauuuuucauuuuau

SEQ ID NO: 251668 - RNA, 63 nt, Homo Sapiens
gccucuucaauccaucuuaccacacaauauuucaugauucaaauucuucaaagucuuauacgc

SEQ ID NO: 251669 - RNA, 63 nt, Homo Sapiens
uaggaagauagaaacuagguuuugaaagauuacaugauucaagcgagggauuuuaaaguaaag

SEQ ID NO: 251670 - RNA, 63 nt, Homo Sapiens
auauaauaugugauguaacauguagaugauaauaugauucaguagucaacuugagggaaauuu

SEQ ID NO: 251671 - RNA, 63 nt, Homo Sapiens
cuuucauuuuaaagguuauuugcucccgauuauaugauucaaguguuauaaguuuuagcuuga

SEQ ID NO: 251672 - RNA, 63 nt, Homo Sapiens
cuggacagccuggacauuuuaauugcuaugcuuaugauucaggcugcgcagaauaauauuaag

SEQ ID NO: 251673 - RNA, 63 nt, Homo Sapiens
uuucagaaauaaaaguaugaugauaauuuugaaaugauucaucuaagaaaauauucuaacauu

SEQ ID NO: 251674 - RNA, 63 nt, Homo Sapiens
agguccaauguuguucaccaaguggugguagaaaugauucacccccuuuggacaaaugcauuu

SEQ ID NO: 251675 - RNA, 63 nt, Homo Sapiens
caaaugaauuuuuggugauuugguauaccacaaaugauucaugucauguguauuuucuuauuc

SEQ ID NO: 251676 - RNA, 63 nt, Homo Sapiens
uugcugcgugugaaaucaugaggaagaagcagaaugauucauucuuucaauuuaaaaagagug

SEQ ID NO: 251677 - RNA, 63 nt, Homo Sapiens
cauuaauguuaaggcuaauagacugcaauaacaaugauucauuuuauucuuguuuauucaaau

SEQ ID NO: 251678 - RNA, 63 nt, Homo Sapiens
uucuucagagugguaauuguaauuacuguuuuaaugauucaguuuuuaaauuugugaacucgu

SEQ ID NO: 251679 - RNA, 63 nt, Homo Sapiens
gaauuguuauguaaacaucauaaauaguaaauaaugauucaaugugaauuuuaaaaugcaaau

SEQ ID NO: 251680 - RNA, 63 nt, Homo Sapiens
gacaaagaugagauuauuggggcuguucauauuaugauucagaaucauuuucuauugugguau

SEQ ID NO: 251681 - RNA, 63 nt, Homo Sapiens
aucuaccuacauuuacauguagguagauaugaaaugauucaauauccaugucuccuuuuacuc

SEQ ID NO: 251682 - RNA, 63 nt, Homo Sapiens
gagcuggagcagcugauaguggaaaacagaauaaugauucaaagagucuucugucaccauguc

SEQ ID NO: 251683 - RNA, 63 nt, Homo Sapiens
gugguuugcagcccuaaugaaauuaugucuaggaugauucagucuauuucccauuuacuagca

SEQ ID NO: 251684 - RNA, 63 nt, Homo Sapiens
uacugcuuacucguaaugaucuaguggggaaacaugauucauucacuuaaaauacugauuaag

SEQ ID NO: 251685 - RNA, 63 nt, Homo Sapiens
auaauugaaguaguguggagcauuaacuuguggaugauucagaguuaaaagauaaaaagacgc

SEQ ID NO: 251686 - RNA, 63 nt, Homo Sapiens
guuuacaugugucaaggugauuuuuugaaauacaugauucaugaacuugaccacaacuacugu

SEQ ID NO: 251687 - RNA, 63 nt, Homo Sapiens
accauuucuucagguuaaaucuuaaaaauuuauaugauucaaaggacagucuuuauuuuucuu

SEQ ID NO: 251688 - RNA, 63 nt, Homo Sapiens
cguuauuccuuauaaaguaaucauucuucuuuuaugauucauauaaauguuucccaugaucgc

SEQ ID NO: 251689 - RNA, 63 nt, Homo Sapiens
aucaagaagauucagaaaauuuacaagguuaagaugauucaaucuuacauugucuaaaaaucc

SEQ ID NO: 251690 - RNA, 63 nt, Homo Sapiens
ucauuucaccuugacgauucagauucucauuaaaugauucauucagccagugccacaguuuga

SEQ ID NO: 251691 - RNA, 63 nt, Homo Sapiens
ggcugggaauugagaauuuauuuuauugcauuuaugauucaguucuucauuucuguugauuuu

SEQ ID NO: 251692 - RNA, 63 nt, Homo Sapiens
cauauaggcuguucuagccacagugguagauuuaugauucacauccgaaagugugccuuaguu

SEQ ID NO: 251693 - RNA, 63 nt, Homo Sapiens
cucacauggcuugcacucagugacaccaaauccaugauucaauguugaucuugagcaaguauu

SEQ ID NO: 251694 - RNA, 63 nt, Homo Sapiens
uacuauuuuaacuuagaaaaaccaucguuucauaugauucacccuaauagauaccuccauuau

SEQ ID NO: 251695 - RNA, 63 nt, Homo Sapiens
uucugaccuucagcucacgcuucacagugaucgaugauucaggugcagaggaaguacaaacua

SEQ ID NO: 251696 - RNA, 63 nt, Homo Sapiens
aucacgagaauagcacaggaaagacuggcccccaugauucaauuaccucccccgggucccucc

SEQ ID NO: 251697 - RNA, 63 nt, Homo Sapiens
ugcugaacgugcuccucucuccuucucuguacaaugauucagcaucucggcggaagaggaaaa

SEQ ID NO: 251698 - RNA, 63 nt, Homo Sapiens
uucaagccuuaaccuggaaugcuagaccugggaaugauucaacguacucuuguuaaccuuaga

SEQ ID NO: 251699 - RNA, 63 nt, Homo Sapiens
gauuccaccucuggcuauagauagaauuacccuaugauucagcgguucgucacaaaauucaac

SEQ ID NO: 251700 - RNA, 63 nt, Homo Sapiens
uuguaccauuacauguuucauauuuaacgaaucaugauucagacugggggaagugggguauaa

SEQ ID NO: 251701 - RNA, 63 nt, Homo Sapiens
guuaaaugugaugaauacugcucugagcagugaaugauucaguaaccucgcuggacucucagu

SEQ ID NO: 251702 - RNA, 63 nt, Homo Sapiens
gagcaaacagcacuuuacagucugugguggcgcaugauucacuagcagguggagccauggugc

SEQ ID NO: 251703 - RNA, 63 nt, Homo Sapiens
gggucauuagugagaaacggcuuaaagucauaaaugauucauucuuauagaaucuaagcuggu

SEQ ID NO: 251704 - RNA, 63 nt, Homo Sapiens
acgggggaauauaaaagguuagguuuugagcuaaugauucaaaccagaugaucuuuuacucuu

SEQ ID NO: 251705 - RNA, 63 nt, Homo Sapiens
auugaaagcagaacaauggaagaaaaaaaggucaugauucauggacaaaaugcugacuacugu

SEQ ID NO: 251706 - RNA, 63 nt, Homo Sapiens
aaagcugaugauuguaccagucuuaaauuauucaugauucaauaaaauugaugcuuauuuauu

SEQ ID NO: 251707 - RNA, 63 nt, Homo Sapiens
aaacaauuucuuuuuuaaaaaagacuauuuuauaugauucacaugcuaaagccaggauugugu

SEQ ID NO: 251708 - RNA, 63 nt, Homo Sapiens
uuacuucuucaugguauuaugaagacuauauagaugauucaaccaagccugcaaaucucccuc

SEQ ID NO: 251709 - RNA, 63 nt, Homo Sapiens
gaaggauugccauuagugacuuggaccaguuagaugauucacuuuuugccccuagggaugaga

SEQ ID NO: 251710 - RNA, 63 nt, Homo Sapiens
ucaauuucauguaauuuacccuuugcaauaaaaaugauucauuaaauauauaacuaaauguga

SEQ ID NO: 251711 - RNA, 61 nt, Homo Sapiens; identical to SEQ ID NO: 251163

SEQ ID NO: 251712 - RNA, 63 nt, Homo Sapiens
uaugggaauuugagaaauaugcaacuuuuguuuaugauucaaaaaauuguuggauuuaaagag

SEQ ID NO: 251713 - RNA, 63 nt, Homo Sapiens
agcuuuuuuagaguuuauaugcugcuuuuguauaugauucacguucaaccuuggucucaaaua

SEQ ID NO: 251714 - RNA, 63 nt, Homo Sapiens
ggcauuuuggugcuguuaaaucugccuaagauuaugauucaggaguauccugcucagccaaga

SEQ ID NO: 251715 - RNA, 63 nt, Homo Sapiens
uuuuuucauaauucaaacaaggucuagagggaaaugauucaaaguauaaguuugaaaugaaau

SEQ ID NO: 251716 - RNA, 63 nt, Homo Sapiens
uuucaguucucaaauuaaaaaauauuugaugugaugauucacuaaaccaaagagacccugaag

SEQ ID NO: 251717 - RNA, 63 nt, Homo Sapiens
auccuccaaagcaagaggcuccaggaguaggaaaugauucaucuguuuuaaaggagacuaacu

SEQ ID NO: 251718 - RNA, 63 nt, Homo Sapiens
agaaccugaaccagaugaacgcagaauagaagaaugauucaugaggcauaaauauuuuugaca

SEQ ID NO: 251719 - RNA, 63 nt, Homo Sapiens
uuuacuggacaaaaucaauaacuacaaaaggcaaugauucacgcuuuuguuuucauaauaccu

SEQ ID NO: 251720 - RNA, 63 nt, Homo Sapiens
ugaaaauuuaaaagauuaaaugaaugagaagaaaugauucauaaauuuugaacuaacaguaau

SEQ ID NO: 251721 - RNA, 63 nt, Homo Sapiens
uggggcggggcagugaggggugggagaaggugaaugauucauuauuccaccccgagguuugcu

SEQ ID NO: 251722 - RNA, 63 nt, Homo Sapiens
cuacauccuucccucacucccaugauuggagaaaugauucauugggugaugaguguugggguu

SEQ ID NO: 251723 - RNA, 63 nt, Homo Sapiens
ugccaugacauuggaagaaggacagugauucaaaugauucaaacaggaagugaauaagaagau

SEQ ID NO: 251724 - RNA, 63 nt, Homo Sapiens
uuccaugacauuggaaaaaggagagugauucaaaugauucaaacaggaagugaauaagaagau

SEQ ID NO: 251725 - RNA, 63 nt, Homo Sapiens
aucuaagcaguuucgauuuuaacaauguuguccaugauucaaaguuauucacugcaacaaagc

SEQ ID NO: 251726 - RNA, 63 nt, Homo Sapiens
ccuguacuacugauuauuaaugccaagcuucugaugauucacaauuuugaaauauuaaggucu

SEQ ID NO: 251727 - RNA, 63 nt, Homo Sapiens
aucagaagaagaaggaacccuccucauaggaggaugauucagcauuuuuuuuugaaagaguuc

SEQ ID NO: 251728 - RNA, 63 nt, Homo Sapiens
cuugacggugaauggaagacgauaaugaaaagaaugauucagucacaauaagcaauauguggu

SEQ ID NO: 251729 - RNA, 63 nt, Homo Sapiens
aauuggaacagaauguuuuaugacuuuauauggaugauucagauuaucuguucuugcuaccca

SEQ ID NO: 251730 - RNA, 63 nt, Homo Sapiens
uuaugugauucaucuuauuccccccuggaggauaugauucacuaaaucuugauugugauaagc

SEQ ID NO: 251731 - RNA, 63 nt, Homo Sapiens
gaaugaagaaucacaggcuuagcaaggauaugcaugauucagguuucugugaguccuauaaaa

SEQ ID NO: 251732 - RNA, 63 nt, Homo Sapiens
gcagaggaauuuauuaugcaucaaaaggaaagaaugauucaaacuuucaaccaaaugauuggu

SEQ ID NO: 251733 - RNA, 63 nt, Homo Sapiens
ucucuucuugcauguaccuauuucuaccuguucaugauucacacguauuagagaccagauauu

SEQ ID NO: 251734 - RNA, 63 nt, Homo Sapiens
auccaccuugagaggaaugagagaacacaaggaaugauucaaguuuuuauucagaacgaggaa

SEQ ID NO: 251735 - RNA, 63 nt, Homo Sapiens
gcucuggcaguucccaaguccugucagaugaaaaugauucacaggucugaauggaucugaccc

SEQ ID NO: 251736 - RNA, 63 nt, Homo Sapiens
ugcuuccggacaacugccaaugggugcagugaaaugauucaugcaagaaacugcugaaaaagc

SEQ ID NO: 251737 - RNA, 63 nt, Homo Sapiens
aaaaugcaaguaguuuccucgcgugaccucaccaugauucacauacgugccacuguuugaaau

SEQ ID NO: 251738 - RNA, 63 nt, Homo Sapiens
gccuuagccaugauuucguuaguagaccuauuuaugauucaauugcaauuuucagauaggaug

SEQ ID NO: 251739 - RNA, 63 nt, Homo Sapiens
gcaaaucuugaaagacgaaaucaaagcccauuaaugauucagaaucagugcuugaccuccugu

SEQ ID NO: 251740 - RNA, 63 nt, Homo Sapiens
guauggaucauucugaugacagauuuauacaaaaugauucaaaccaguaacuuaguaaaauug

SEQ ID NO: 251741 - RNA, 63 nt, Homo Sapiens
cuuacacacuauauaaguuguucuuucaguuuuaugauucaacuacuguuuuuccuucagcug

SEQ ID NO: 251742 - RNA, 63 nt, Homo Sapiens
gaccgucucagacacgcacagugggccugcugcaugauucacacccagucccugccacagacc

SEQ ID NO: 251743 - RNA, 63 nt, Homo Sapiens; identical to SEQ ID NO: 251742

SEQ ID NO: 251744 - RNA, 63 nt, Homo Sapiens
ccauuccaaaguucaacuugagaugcuccagggaugauucaagcacuccugacugcccggcac

SEQ ID NO: 251745 - RNA, 63 nt, Homo Sapiens
uuuauuguauaauuaugaagauaugucuuuaaaaugauucacuuauuuauaacauuguaaaug

SEQ ID NO: 251746 - RNA, 63 nt, Homo Sapiens
ugugaaaaaauucucagaucauuggaaggagaaaugauucauguucuaucaguaucaauaacc

SEQ ID NO: 251747 - RNA, 63 nt, Homo Sapiens
uggaaaauccuaaacauggaagaugauuuaaaaaugauucacccuggaauacaugcuuccagu

SEQ ID NO: 251748 - RNA, 63 nt, Homo Sapiens
uauuguggacuuaauuacaaccacugcacuguaaugauucaaugcuguauuaugauauugcug

SEQ ID NO: 251749 - RNA, 63 nt, Homo Sapiens
aaagcauauaaauuaaaauauuuaaaauuagauaugauucacacuauauucuguuucauaugc

SEQ ID NO: 251750 - RNA, 63 nt, Homo Sapiens
uuauauuuaaugcauuaaaccuuguuauugugaaugauucaugaaguucccugaaacacgaaa

SEQ ID NO: 251751 - RNA, 63 nt, Homo Sapiens
uugcauuuucugauccuguaaaaaggugcuaaaaugauucaauagugcauuucuauuuauauc

SEQ ID NO: 251752 - RNA, 63 nt, Homo Sapiens
agcuuggucacuugauuagauuguugaggccuuaugauucagcgaaauaauaagaugcaacau

SEQ ID NO: 251753 - RNA, 63 nt, Homo Sapiens
ugguaaauauggcuuuaauuacaaacaugaggaaugauucacugaagaugaaaagauaggacg

SEQ ID NO: 251754 - RNA, 63 nt, Homo Sapiens
ccugcuauagcccaaagcacguaguauuugcugaugauucagcaugagcugcaucuaccuacu

SEQ ID NO: 251755 - RNA, 63 nt, Homo Sapiens
aaacugagggaauuccugucuucuuuaggaguaaugauucauagaucuagauagguggaaaua

SEQ ID NO: 251756 - RNA, 63 nt, Homo Sapiens
uucgcaaaauguuucaaguacuguaacugugucaugauucacccccaaacagugacauuuauu

SEQ ID NO: 251757 - RNA, 63 nt, Homo Sapiens
aaagccaacuucaaauaccgugaccaaauuuacaugauucauauucauuaugcauuacuuggu

SEQ ID NO: 251758 - RNA, 63 nt, Homo Sapiens
ucccaugugggauggagcagacacaagaaaaggaugauucacaaauggguggguaguguaaau

SEQ ID NO: 251759 - RNA, 63 nt, Homo Sapiens
gagacuguuugaaucuugucucaccacugacagaugauucacaucugaaacuuaacgugauca

SEQ ID NO: 251760 - RNA, 63 nt, Homo Sapiens
accauuuauaacuucuguuuuuuuauugagaaaaugauucacgaauuccaaaucagauugcca

SEQ ID NO: 251761 - RNA, 63 nt, Homo Sapiens
uaaucccaccacaagcacauacuaauuuuauuuaugauucaaaugugacucgugccugcccau

SEQ ID NO: 251762 - RNA, 63 nt, Homo Sapiens
uuccacggaugggugacaggggaugguuuugggaugauucaagugcauuacauuuauugugca

SEQ ID NO: 251763 - RNA, 63 nt, Homo Sapiens
aagcuaaauccucaaaaccuaguaaggggacuaaugauucauuaaaguaaauugaugguuuug

SEQ ID NO: 251764 - RNA, 63 nt, Homo Sapiens
gcaccgccccucagcaaggaugacucagcagggaugauucagcagagauaacucggggaugac

SEQ ID NO: 251765 - RNA, 63 nt, Homo Sapiens
ugucaguagaugaccaaagacaagccacaguuaaugauucagaucagccucugauccaucccu

SEQ ID NO: 251766 - RNA, 63 nt, Homo Sapiens
aauuggggcaugggaggggggcugggggaccccaugauucagccacggacuccaaugcccagc

SEQ ID NO: 251767 - RNA, 63 nt, Homo Sapiens
cuauuacggaugaguucuggaaaagacccagcuaugauucauaaaaacacuucuggaugaauc

SEQ ID NO: 251768 - RNA, 63 nt, Homo Sapiens
gccccucaucugcucagcagcuauuugaaugagaugauucagaaggggaggggagacagguaa

SEQ ID NO: 251769 - RNA, 63 nt, Homo Sapiens
cucuauuuuaaauauuuuuaguauguacuguguaugauucauuaccauuuugaggggauuuau

SEQ ID NO: 251770 - RNA, 63 nt, Homo Sapiens
auuuuccccccacuccuccccggggaacccagaaugauucaaccugaagugauacacuaauca

SEQ ID NO: 251771 - RNA, 63 nt, Homo Sapiens
cacacuggccuuucuguuccuaccuuccuuaccaugauucagcccucuucucuucauacucuc

SEQ ID NO: 251772 - RNA, 63 nt, Homo Sapiens
agcuggguacugacugagaugagguugauuuucaugauucaugggccuucgggagggcggggg

SEQ ID NO: 251773 - RNA, 63 nt, Homo Sapiens
gcuauuuguaacuguguccccucuuuguguauuaugauucaguuuucuuuaacacacacuagg

SEQ ID NO: 251774 - RNA, 63 nt, Homo Sapiens
uugcugcuuggauuuugaaauguuuuucaagaaaugauucaaaguuugguguuugucuguguu

SEQ ID NO: 251775 - RNA, 63 nt, Homo Sapiens
uuauaugaauaugcaguaugggacuuugaaauaaugauucauaauaaaauacuaaacgugugu

SEQ ID NO: 251776 - RNA, 63 nt, Homo Sapiens
auuucaguuuacuagacugagaagcagcauuuuaugauucauagauuuaggaagcaaaaguaa

SEQ ID NO: 251777 - RNA, 63 nt, Homo Sapiens
auuuauauuuuacuuuuuuauugcugguuuaagaugauucagauuauccuuguacuuugagga

SEQ ID NO: 251778 - RNA, 63 nt, Homo Sapiens
cuccagugagcgcgccugcuuuagagacacaggaugauucagaccggaaacagaccucguggg

SEQ ID NO: 251779 - RNA, 63 nt, Homo Sapiens
ugacuucaugauccugggccugagaacacaggaaugauucauagcccaccccccaccuccaug

SEQ ID NO: 251780 - RNA, 63 nt, Homo Sapiens
auaaaacguaaacacgugcuauuguuaaaauguaugauucagguagauuuccuguagcuguga

SEQ ID NO: 251781 - RNA, 63 nt, Homo Sapiens
uuuaaagcucuauuugacuuaguaaagauguaaaugauucaggaguaguuuuacauuuuauaa

SEQ ID NO: 251782 - RNA, 63 nt, Homo Sapiens
ucaaaauccugagugagucucaaauuucucgugaugauucauuucagugauucaacuuuaaaa

SEQ ID NO: 251783 - RNA, 63 nt, Homo Sapiens
caccucuaccucccgaagugauuuucugaucuuaugauucaccuguuagccuggauggucucg

SEQ ID NO: 251784 - RNA, 63 nt, Homo Sapiens
cguggcaccccauacuagaaaaggcuuucgggaaugauucacaagaaauguaagguuugugac

SEQ ID NO: 251785 - RNA, 63 nt, Homo Sapiens
cuguaccagacaugacaacaaaagucuuuggggaugauucagucaacuuaggaugagggcaga

SEQ ID NO: 251786 - RNA, 63 nt, Homo Sapiens
ccuugaguaugugccacgugcuugugaaaugcuaugauucacauguaacauuuaaacauuaau

SEQ ID NO: 251787 - RNA, 63 nt, Homo Sapiens
agugaggaaaucucuuccaauuucugcuucugaaugauucaauguugggagcaauagaaauaa

SEQ ID NO: 251788 - RNA, 63 nt, Homo Sapiens
aaaauacauuuuuuugguucuauauaaugcuucaugauucauuuagggaccuagaaauauugu

SEQ ID NO: 251789 - RNA, 63 nt, Homo Sapiens
ccaucugccccacucgccuuugccccgucaucgaugauucaggcagagccagauucguuaggu

SEQ ID NO: 251790 - RNA, 63 nt, Homo Sapiens
ccaauuagcaauugacugucagcuucaaacugcaugauucaugcccaggagacaguucaagaa

SEQ ID NO: 251791 - RNA, 63 nt, Homo Sapiens
aaauugaaaacuuuggagaacucauuucaaguuaugauucagugcauuuucaacauugauuuu

SEQ ID NO: 251792 - RNA, 63 nt, Homo Sapiens
aagaaauuauaccuuuuuaguacuugcugaagaaugauucaggguaaaucacauacuuuguuu

SEQ ID NO: 251793 - RNA, 63 nt, Homo Sapiens
uuucccucaaauagugauggauaugguuuaucaaugauucaugacuauacucauacauuuuua

SEQ ID NO: 251794 - RNA, 63 nt, Homo Sapiens
ggucacuucauuuuuauuaauuuacucuuagagaugauucagauuuugcuuccccgugcauga

SEQ ID NO: 251795 - RNA, 63 nt, Homo Sapiens
uuucuccaaagacauguaaauugacaguuuaauaugauucacuaucauuggggugaaguguuc

SEQ ID NO: 251796 - RNA, 63 nt, Homo Sapiens
uuugagccuaggaggucaaggcugcagugagccaugauucacagcacugcacugcagccuggg

SEQ ID NO: 251797 - RNA, 63 nt, Homo Sapiens
gugcaacauacagguaggucggguucugaaaguaugauucaauagagagggaugguuucugag

SEQ ID NO: 251798 - RNA, 63 nt, Homo Sapiens
uuucaccccucccagucuacccauccagccuucaugauucauuccugugucaagguuagucgc

SEQ ID NO: 251799 - RNA, 63 nt, Homo Sapiens
guagucccccaucccuuccucccuuacccagcuaugauucaguugucucugcccucccucuua

SEQ ID NO: 251800 - RNA, 63 nt, Homo Sapiens
uauguaaaauuuaaauaauuacuuuuuuauaauaugauucacuuaugccacagauucaacauu

SEQ ID NO: 251801 - RNA, 63 nt, Homo Sapiens
agcccacagaugauuccuuuauauagauguauaaugauucaaacugcugccuuugccuccagu

SEQ ID NO: 251802 - RNA, 63 nt, Homo Sapiens
agaaugcuuuuugauguugauuuugaccuguucaugauucagaagaaaaacaaacuuuuuugg

SEQ ID NO: 251803 - RNA, 63 nt, Homo Sapiens
uaccucccacugggucccucaagaccugccuccaugauucaguaucaugagaauagcauggga

SEQ ID NO: 251804 - RNA, 63 nt, Homo Sapiens
aaaauuaaaaauuaaaaaaaugaugcagcuaccaugauucaaaccucuugauuggagcuuuug

SEQ ID NO: 251805 - RNA, 63 nt, Homo Sapiens
cagaccucuugagcuccuggcauguuuggugacaugauucauagaaagcauuugagcgaaagu

SEQ ID NO: 251806 - RNA, 63 nt, Homo Sapiens
gcgagacaagauuggcgucuaugugcacagcuaaugauucaauuuugugcuuggaauguguug

SEQ ID NO: 251807 - RNA, 63 nt, Homo Sapiens
aagucacaguuaaggagaaugaaauacagauaaaugauucaaauauaauugugugauauuuca

SEQ ID NO: 251808 - RNA, 63 nt, Homo Sapiens
ugugggugccaggcuguguggugggacagcuggaugauucaucccccugcuggguuggggagg

SEQ ID NO: 251809 - RNA, 64 nt, Homo Sapiens; identical to SEQ ID NO: 39289

SEQ ID NO: 251810 - RNA, 64 nt, Homo Sapiens; identical to SEQ ID NO: 39290

SEQ ID NO: 251811 - RNA, 64 nt, Homo Sapiens; identical to SEQ ID NO: 39291

SEQ ID NO: 251812 - RNA, 64 nt, Homo Sapiens; identical to SEQ ID NO: 39292

SEQ ID NO: 251813 - RNA, 64 nt, Homo Sapiens; identical to SEQ ID NO: 39293

SEQ ID NO: 251814 - RNA, 64 nt, Homo Sapiens; identical to SEQ ID NO: 39294

SEQ ID NO: 251815 - RNA, 64 nt, Homo Sapiens; identical to SEQ ID NO: 39295

SEQ ID NO: 251816 - RNA, 64 nt, Homo Sapiens; identical to SEQ ID NO: 39296

SEQ ID NO: 251817 - RNA, 64 nt, Homo Sapiens; identical to SEQ ID NO: 39297

SEQ ID NO: 251818 - RNA, 64 nt, Homo Sapiens; identical to SEQ ID NO: 39298

SEQ ID NO: 251819 - RNA, 64 nt, Homo Sapiens; identical to SEQ ID NO: 39299

SEQ ID NO: 251820 - RNA, 64 nt, Homo Sapiens; identical to SEQ ID NO: 39300

SEQ ID NO: 251821 - RNA, 64 nt, Homo Sapiens; identical to SEQ ID NO: 39301

SEQ ID NO: 251822 - RNA, 64 nt, Homo Sapiens; identical to SEQ ID NO: 39302

SEQ ID NO: 251823 - RNA, 64 nt, Homo Sapiens; identical to SEQ ID NO: 39303

SEQ ID NO: 251824 - RNA, 64 nt, Homo Sapiens; identical to SEQ ID NO: 39304

SEQ ID NO: 251825 - RNA, 64 nt, Homo Sapiens; identical to SEQ ID NO: 39305

SEQ ID NO: 251826 - RNA, 64 nt, Homo Sapiens; identical to SEQ ID NO: 39306

SEQ ID NO: 251827 - RNA, 64 nt, Homo Sapiens; identical to SEQ ID NO: 39307

SEQ ID NO: 251828 - RNA, 64 nt, Homo Sapiens; identical to SEQ ID NO: 39308

SEQ ID NO: 251829 - RNA, 64 nt, Homo Sapiens; identical to SEQ ID NO: 39309

SEQ ID NO: 251830 - RNA, 64 nt, Homo Sapiens; identical to SEQ ID NO: 39310

SEQ ID NO: 251831 - RNA, 64 nt, Homo Sapiens; identical to SEQ ID NO: 39311

SEQ ID NO: 251832 - RNA, 64 nt, Homo Sapiens; identical to SEQ ID NO: 39312

SEQ ID NO: 251833 - RNA, 64 nt, Homo Sapiens; identical to SEQ ID NO: 39313

SEQ ID NO: 251834 - RNA, 64 nt, Homo Sapiens; identical to SEQ ID NO: 39314

SEQ ID NO: 251835 - RNA, 64 nt, Homo Sapiens; identical to SEQ ID NO: 39315

SEQ ID NO: 251836 - RNA, 64 nt, Homo Sapiens; identical to SEQ ID NO: 39316

SEQ ID NO: 251837 - RNA, 64 nt, Homo Sapiens; identical to SEQ ID NO: 39317

SEQ ID NO: 251838 - RNA, 64 nt, Homo Sapiens; identical to SEQ ID NO: 39318

SEQ ID NO: 251839 - RNA, 64 nt, Homo Sapiens; identical to SEQ ID NO: 39319

SEQ ID NO: 251840 - RNA, 64 nt, Homo Sapiens; identical to SEQ ID NO: 39320

SEQ ID NO: 251841 - RNA, 64 nt, Homo Sapiens; identical to SEQ ID NO: 39321

SEQ ID NO: 251842 - RNA, 64 nt, Homo Sapiens; identical to SEQ ID NO: 39322

SEQ ID NO: 251843 - RNA, 64 nt, Homo Sapiens; identical to SEQ ID NO: 39323

SEQ ID NO: 251844 - RNA, 64 nt, Homo Sapiens; identical to SEQ ID NO: 39324

SEQ ID NO: 251845 - RNA, 64 nt, Homo Sapiens; identical to SEQ ID NO: 39325

SEQ ID NO: 251846 - RNA, 64 nt, Homo Sapiens; identical to SEQ ID NO: 39326

SEQ ID NO: 251847 - RNA, 64 nt, Homo Sapiens; identical to SEQ ID NO: 39327

SEQ ID NO: 251848 - RNA, 64 nt, Homo Sapiens; identical to SEQ ID NO: 39328

SEQ ID NO: 251849 - RNA, 64 nt, Homo Sapiens; identical to SEQ ID NO: 39329

SEQ ID NO: 251850 - RNA, 64 nt, Homo Sapiens; identical to SEQ ID NO: 39330

SEQ ID NO: 251851 - RNA, 64 nt, Homo Sapiens; identical to SEQ ID NO: 39331

SEQ ID NO: 251852 - RNA, 64 nt, Homo Sapiens; identical to SEQ ID NO: 39332

SEQ ID NO: 251853 - RNA, 61 nt, Homo Sapiens; identical to SEQ ID NO: 39333

SEQ ID NO: 251854 - RNA, 64 nt, Homo Sapiens; identical to SEQ ID NO: 39334

SEQ ID NO: 251855 - RNA, 64 nt, Homo Sapiens; identical to SEQ ID NO: 39335

SEQ ID NO: 251856 - RNA, 64 nt, Homo Sapiens; identical to SEQ ID NO: 39336

SEQ ID NO: 251857 - RNA, 64 nt, Homo Sapiens; identical to SEQ ID NO: 39337

SEQ ID NO: 251858 - RNA, 64 nt, Homo Sapiens; identical to SEQ ID NO: 39338

SEQ ID NO: 251859 - RNA, 64 nt, Homo Sapiens; identical to SEQ ID NO: 39339

SEQ ID NO: 251860 - RNA, 64 nt, Homo Sapiens; identical to SEQ ID NO: 39340

SEQ ID NO: 251861 - RNA, 64 nt, Homo Sapiens; identical to SEQ ID NO: 39341

SEQ ID NO: 251862 - RNA, 64 nt, Homo Sapiens; identical to SEQ ID NO: 39342

SEQ ID NO: 251863 - RNA, 64 nt, Homo Sapiens; identical to SEQ ID NO: 39343

SEQ ID NO: 251864 - RNA, 64 nt, Homo Sapiens; identical to SEQ ID NO: 39344

SEQ ID NO: 251865 - RNA, 64 nt, Homo Sapiens; identical to SEQ ID NO: 39345

SEQ ID NO: 251866 - RNA, 64 nt, Homo Sapiens; identical to SEQ ID NO: 39346

SEQ ID NO: 251867 - RNA, 64 nt, Homo Sapiens
uguucaucaccaugccuagccugccaaguagcugucaccauagcagcuauccuccaaccucagc

SEQ ID NO: 251868 - RNA, 64 nt, Homo Sapiens
cuaacugaaauccuauauaugcaucaucuccauuucaccauaucugaauuauauccuuuauuaa

SEQ ID NO: 251869 - RNA, 64 nt, Homo Sapiens
ggucaggcuggucuugaacuguagagacaggguuucaccauauuggcuaauuuuuguauuuuua

SEQ ID NO: 251870 - RNA, 64 nt, Homo Sapiens; identical to SEQ ID NO: 251869

SEQ ID NO: 251871 - RNA, 64 nt, Homo Sapiens
ucgcugaaccaaaacguacugcagccgagcccccuccguccauccucugccccucccccuggcu

SEQ ID NO: 251872 - RNA, 64 nt, Homo Sapiens
cucaacacccuuccuuguccuggaguauggacuguccguccaaaagugagccuaugcuauaagu

SEQ ID NO: 251873 - RNA, 64 nt, Homo Sapiens
ugcccuccuggcaggugggucguccguccguccauccguccacuagaugccuuccccguccguc

SEQ ID NO: 251874 - RNA, 64 nt, Homo Sapiens
cguccacuugcccuccuggccguccguccguccguccguccaucucaaauccagaugccuuccc

SEQ ID NO: 251875 - RNA, 64 nt, Homo Sapiens
agccugugccuccucaccccuccaggagccuggcuccguccagggagacucugagcggccuccg

SEQ ID NO: 251876 - RNA, 56 nt, Homo Sapiens
agccuggcuccguccaggaggcggccuccguccaggggacgccgcagagacucuga

SEQ ID NO: 251877 - RNA, 64 nt, Homo Sapiens
uggugacaaauauucucucugcuagacuuucuggagugauaaucucuguuugucugaacaaagu

SEQ ID NO: 251878 - RNA, 64 nt, Homo Sapiens
uccuguugaccuucccacacuucugcaugaccaaagugauaaauagaacuuuggaggcaaaucu

SEQ ID NO: 251879 - RNA, 64 nt, Homo Sapiens
aauaaauaugaguguccuuuauuugccuaguagaagugauaaauuguguuauauaugauaauuu

SEQ ID NO: 251880 - RNA, 64 nt, Homo Sapiens
aauguaccuagcaagcugguucuugcuuauauauagugauaaacuuuguagcugccucuuuaac

SEQ ID NO: 251881 - RNA, 64 nt, Homo Sapiens; identical to SEQ ID NO: 249425

SEQ ID NO: 251882 - RNA, 64 nt, Homo Sapiens; identical to SEQ ID NO: 249426

SEQ ID NO: 251883 - RNA, 64 nt, Homo Sapiens; identical to SEQ ID NO: 249427

SEQ ID NO: 251884 - RNA, 64 nt, Homo Sapiens; identical to SEQ ID NO: 249428

SEQ ID NO: 251885 - RNA, 64 nt, Homo Sapiens; identical to SEQ ID NO: 249429

SEQ ID NO: 251886 - RNA, 64 nt, Homo Sapiens; identical to SEQ ID NO: 249430

SEQ ID NO: 251887 - RNA, 64 nt, Homo Sapiens; identical to SEQ ID NO: 249431

SEQ ID NO: 251888 - RNA, 64 nt, Homo Sapiens; identical to SEQ ID NO: 249432

SEQ ID NO: 251889 - RNA, 64 nt, Homo Sapiens; identical to SEQ ID NO: 249433

SEQ ID NO: 251890 - RNA, 64 nt, Homo Sapiens; identical to SEQ ID NO: 249434

SEQ ID NO: 251891 - RNA, 64 nt, Homo Sapiens; identical to SEQ ID NO: 249435

SEQ ID NO: 251892 - RNA, 64 nt, Homo Sapiens; identical to SEQ ID NO: 249436

SEQ ID NO: 251893 - RNA, 64 nt, Homo Sapiens; identical to SEQ ID NO: 249437

SEQ ID NO: 251894 - RNA, 64 nt, Homo Sapiens; identical to SEQ ID NO: 249438

SEQ ID NO: 251895 - RNA, 64 nt, Homo Sapiens; identical to SEQ ID NO: 249439

SEQ ID NO: 251896 - RNA, 64 nt, Homo Sapiens; identical to SEQ ID NO: 249440

SEQ ID NO: 251897 - RNA, 64 nt, Homo Sapiens; identical to SEQ ID NO: 249441

SEQ ID NO: 251898 - RNA, 64 nt, Homo Sapiens; identical to SEQ ID NO: 249442

SEQ ID NO: 251899 - RNA, 64 nt, Homo Sapiens; identical to SEQ ID NO: 249443

SEQ ID NO: 251900 - RNA, 64 nt, Homo Sapiens; identical to SEQ ID NO: 249444

SEQ ID NO: 251901 - RNA, 64 nt, Homo Sapiens; identical to SEQ ID NO: 249445

SEQ ID NO: 251902 - RNA, 64 nt, Homo Sapiens; identical to SEQ ID NO: 249446

SEQ ID NO: 251903 - RNA, 64 nt, Homo Sapiens; identical to SEQ ID NO: 249447

SEQ ID NO: 251904 - RNA, 64 nt, Homo Sapiens; identical to SEQ ID NO: 249448

SEQ ID NO: 251905 - RNA, 64 nt, Homo Sapiens; identical to SEQ ID NO: 249449

SEQ ID NO: 251906 - RNA, 64 nt, Homo Sapiens; identical to SEQ ID NO: 249450

SEQ ID NO: 251907 - RNA, 64 nt, Homo Sapiens; identical to SEQ ID NO: 249451

SEQ ID NO: 251908 - RNA, 64 nt, Homo Sapiens; identical to SEQ ID NO: 249452

SEQ ID NO: 251909 - RNA, 64 nt, Homo Sapiens; identical to SEQ ID NO: 249453

SEQ ID NO: 251910 - RNA, 64 nt, Homo Sapiens; identical to SEQ ID NO: 249454

SEQ ID NO: 251911 - RNA, 64 nt, Homo Sapiens; identical to SEQ ID NO: 249455

SEQ ID NO: 251912 - RNA, 64 nt, Homo Sapiens; identical to SEQ ID NO: 249456

SEQ ID NO: 251913 - RNA, 64 nt, Homo Sapiens; identical to SEQ ID NO: 249457

SEQ ID NO: 251914 - RNA, 64 nt, Homo Sapiens; identical to SEQ ID NO: 249458

SEQ ID NO: 251915 - RNA, 64 nt, Homo Sapiens; identical to SEQ ID NO: 249459

SEQ ID NO: 251916 - RNA, 64 nt, Homo Sapiens; identical to SEQ ID NO: 249460

SEQ ID NO: 251917 - RNA, 64 nt, Homo Sapiens; identical to SEQ ID NO: 249461

SEQ ID NO: 251918 - RNA, 64 nt, Homo Sapiens; identical to SEQ ID NO: 249462

SEQ ID NO: 251919 - RNA, 64 nt, Homo Sapiens; identical to SEQ ID NO: 249463

SEQ ID NO: 251920 - RNA, 64 nt, Homo Sapiens; identical to SEQ ID NO: 249464

SEQ ID NO: 251921 - RNA, 64 nt, Homo Sapiens; identical to SEQ ID NO: 249465

SEQ ID NO: 251922 - RNA, 64 nt, Homo Sapiens; identical to SEQ ID NO: 249466

SEQ ID NO: 251923 - RNA, 64 nt, Homo Sapiens; identical to SEQ ID NO: 249467

SEQ ID NO: 251924 - RNA, 64 nt, Homo Sapiens; identical to SEQ ID NO: 249468

SEQ ID NO: 251925 - RNA, 64 nt, Homo Sapiens; identical to SEQ ID NO: 249469

SEQ ID NO: 251926 - RNA, 64 nt, Homo Sapiens; identical to SEQ ID NO: 249470

SEQ ID NO: 251927 - RNA, 64 nt, Homo Sapiens; identical to SEQ ID NO: 249471

SEQ ID NO: 251928 - RNA, 64 nt, Homo Sapiens; identical to SEQ ID NO: 249472

SEQ ID NO: 251929 - RNA, 64 nt, Homo Sapiens; identical to SEQ ID NO: 249473

SEQ ID NO: 251930 - RNA, 64 nt, Homo Sapiens; identical to SEQ ID NO: 249474

SEQ ID NO: 251931 - RNA, 64 nt, Homo Sapiens; identical to SEQ ID NO: 249475

SEQ ID NO: 251932 - RNA, 64 nt, Homo Sapiens; identical to SEQ ID NO: 249476

SEQ ID NO: 251933 - RNA, 64 nt, Homo Sapiens; identical to SEQ ID NO: 249477

SEQ ID NO: 251934 - RNA, 64 nt, Homo Sapiens; identical to SEQ ID NO: 249478

SEQ ID NO: 251935 - RNA, 64 nt, Homo Sapiens; identical to SEQ ID NO: 249479

SEQ ID NO: 251936 - RNA, 64 nt, Homo Sapiens; identical to SEQ ID NO: 249480

SEQ ID NO: 251937 - RNA, 64 nt, Homo Sapiens; identical to SEQ ID NO: 249481

SEQ ID NO: 251938 - RNA, 64 nt, Homo Sapiens; identical to SEQ ID NO: 249482

SEQ ID NO: 251939 - RNA, 64 nt, Homo Sapiens; identical to SEQ ID NO: 249483

SEQ ID NO: 251940 - RNA, 64 nt, Homo Sapiens; identical to SEQ ID NO: 249484

SEQ ID NO: 251941 - RNA, 64 nt, Homo Sapiens
uugucuuagucaguuugagcugcuauaauaaagcaccauagacuugguggcuuauaaacaacag

SEQ ID NO: 251942 - RNA, 64 nt, Homo Sapiens
uguguuucuuuguugccaguguuaccuuugcuguaccauagacuuaaaauuccucuauuguuau

SEQ ID NO: 251943 - RNA, 64 nt, Homo Sapiens
uucaaagcaagucaaccugcuuuuuucuguuuuuacaguggaaucuaggaggccacuuagucgu

SEQ ID NO: 251944 - RNA, 64 nt, Homo Sapiens
ugagaaauggggcauuuuaaucuaagugguuauaacaguggauucugacggggaagguguagcu

SEQ ID NO: 251945 - RNA, 64 nt, Homo Sapiens
uccuauaggcagacguggggaggguggaggggugacaguggaggaaaauccauggauauccacg

SEQ ID NO: 251946 - RNA, 64 nt, Homo Sapiens
gucccuugcugacauggcuuugcuuuguguaaauacaguggaucucaaucuucggggugugaug

SEQ ID NO: 251947 - RNA, 64 nt, Homo Sapiens
gagaagcagcuuauuuaaccuacauuaauaauaaacaguggaaauuuugguuuuguauauuuug

SEQ ID NO: 251948 - RNA, 64 nt, Homo Sapiens
gguuggguuuugugcaggguuguuuucuaugaaaacaguggauuuccuucacuuuggcaucagu

SEQ ID NO: 251949 - RNA, 64 nt, Homo Sapiens
uaaaauaaauaccaaagauaaugcauauuuuugcacaguggagcuuacacuuaaaagaaaacaa

SEQ ID NO: 251950 - RNA, 64 nt, Homo Sapiens
agaguauucagugauauguaaauuaaaugaagauacaguggagaaugggggugaccacaaaaga

SEQ ID NO: 251951 - RNA, 64 nt, Homo Sapiens
uuuguacugaaggcaagaacuggacagucagagaacaguggagggggcaagugacugaagagca

SEQ ID NO: 251952 - RNA, 64 nt, Homo Sapiens
acaaccuguguggaaguauauacaguugagagucacaguggagguucugagacuggauucaguc

SEQ ID NO: 251953 - RNA, 64 nt, Homo Sapiens
ugggugccuggcucuaggcuauguccugagacauacaguggacagggucucuacccuccucaca

SEQ ID NO: 251954 - RNA, 64 nt, Homo Sapiens
gagagucuuaccugaauggcaaucgcccagauuaacaguggagacaguaaugcaaugcaggaag

SEQ ID NO: 251955 - RNA, 64 nt, Homo Sapiens
aggaauaaaguucagugugcugaucauucacaauacaguggauagcuugauaucuucuguuuuc

SEQ ID NO: 251956 - RNA, 64 nt, Homo Sapiens
uuccucugacuugccaaagaaaaagaagggaaccacaguggauaugcuagcauuuuagcugugc

SEQ ID NO: 251957 - RNA, 63 nt, Homo Sapiens
uuucccaaacaauacaaaaagcaaauuacacacccucaccacuguucuuaucucuauagugau

SEQ ID NO: 251958 - RNA, 63 nt, Homo Sapiens
ucagggcugcaaaugucaagacauaacccuguuccucaccaucaugauaccagauacagguga

SEQ ID NO: 251959 - RNA, 63 nt, Homo Sapiens
ccccauccuauucuugguaacuacaccacuuuuccucaccaaccguugaaguccucaccagua

SEQ ID NO: 251960 - RNA, 63 nt, Homo Sapiens
acuacaccacuuuuccucacccgucguugaaguccucaccaguuccuacagagucuaggcugg

SEQ ID NO: 251961 - RNA, 63 nt, Homo Sapiens
cuagccauugcugcagugugaguaccuccagagccucaccagacaaggugccaggccugcccc

SEQ ID NO: 251962 - RNA, 63 nt, Homo Sapiens
cucucucuccauuaucgaacgacugacuguaaaccucaccacacaggguggugcccuggcccc

SEQ ID NO: 251963 - RNA, 63 nt, Homo Sapiens
uagcaucucugcuccccagaaaauuguaagcauccucaccagccuguggauacauucuuuauu

SEQ ID NO: 251964 - RNA, 63 nt, Homo Sapiens
uagccauagucucaaaccugcugagccugccuuccucaccaccgucuccccaaggcuggggug

SEQ ID NO: 251965 - RNA, 63 nt, Homo Sapiens
cggcccggaaacagcgggaaagaagcuggagugccucaccacauacgaucagcgugacagagu

SEQ ID NO: 251966 - RNA, 63 nt, Homo Sapiens
cacacaacacaccucaccucacaccacagcacaccucaccacaccacaccgcacugcaccaua

SEQ ID NO: 251967 - RNA, 63 nt, Homo Sapiens
acaccucaccacaccacaccgcacugcaccauaccucaccacaucucaccacaccacagcaca

SEQ ID NO: 251968 - RNA, 63 nt, Homo Sapiens
auaccucaccacaucucaccacaccacagcacaccucaccacacaacacaccacaccccacac

SEQ ID NO: 251969 - RNA, 63 nt, Homo Sapiens
uccaaagugguugucugagacagaguuggaaacccucaccaacuggccucuucaccuuccaca

SEQ ID NO: 251970 - RNA, 63 nt, Homo Sapiens
ucagggaccagagggcuagguuggcacugcggcccucaccagguccugggcucggacccaacu

SEQ ID NO: 251971 - RNA, 63 nt, Homo Sapiens
accucccugacaccugggcuagucacuggggucccucaccagcuucauugcugucaccuccug

SEQ ID NO: 251972 - RNA, 63 nt, Homo Sapiens
cucuugcguuuuggcccccaacagugacgggacccucaccauccauccaucucaguguggagg

SEQ ID NO: 251973 - RNA, 63 nt, Homo Sapiens
cucccuuucagggccagggcgguucccaggaggccucaccauaccugaccauugcccuagcca

SEQ ID NO: 251974 - RNA, 63 nt, Homo Sapiens
cuuggagucuguucuagggaacccccuguuggcccucaccagccagaaucauguggccagccc

SEQ ID NO: 251975 - RNA, 63 nt, Homo Sapiens
agcccacccugcccgugggcgacgcagcuccacccucaccacugucuccuucugggggucagg

SEQ ID NO: 251976 - RNA, 63 nt, Homo Sapiens
gagaagauggaccggcucuugcagcuuaggagaccucaccaaauggcgggcagaugguggaag

SEQ ID NO: 251977 - RNA, 64 nt, Homo Sapiens; identical to SEQ ID NO: 86383

SEQ ID NO: 251978 - RNA, 64 nt, Homo Sapiens; identical to SEQ ID NO: 86384

SEQ ID NO: 251979 - RNA, 64 nt, Homo Sapiens; identical to SEQ ID NO: 86385

SEQ ID NO: 251980 - RNA, 64 nt, Homo Sapiens; identical to SEQ ID NO: 86386

SEQ ID NO: 251981 - RNA, 64 nt, Homo Sapiens; identical to SEQ ID NO: 86387

SEQ ID NO: 251982 - RNA, 64 nt, Homo Sapiens; identical to SEQ ID NO: 86388

SEQ ID NO: 251983 - RNA, 64 nt, Homo Sapiens; identical to SEQ ID NO: 86389

SEQ ID NO: 251984 - RNA, 64 nt, Homo Sapiens; identical to SEQ ID NO: 86390

SEQ ID NO: 251985 - RNA, 64 nt, Homo Sapiens; identical to SEQ ID NO: 86391

SEQ ID NO: 251986 - RNA, 64 nt, Homo Sapiens; identical to SEQ ID NO: 86392

SEQ ID NO: 251987 - RNA, 64 nt, Homo Sapiens; identical to SEQ ID NO: 86393

SEQ ID NO: 251988 - RNA, 64 nt, Homo Sapiens; identical to SEQ ID NO: 86394

SEQ ID NO: 251989 - RNA, 61 nt, Homo Sapiens; identical to SEQ ID NO: 86395

SEQ ID NO: 251990 - RNA, 64 nt, Homo Sapiens; identical to SEQ ID NO: 86396

SEQ ID NO: 251991 - RNA, 64 nt, Homo Sapiens; identical to SEQ ID NO: 86397

SEQ ID NO: 251992 - RNA, 64 nt, Homo Sapiens; identical to SEQ ID NO: 86398

SEQ ID NO: 251993 - RNA, 64 nt, Homo Sapiens; identical to SEQ ID NO: 86399

SEQ ID NO: 251994 - RNA, 64 nt, Homo Sapiens; identical to SEQ ID NO: 86400

SEQ ID NO: 251995 - RNA, 64 nt, Homo Sapiens; identical to SEQ ID NO: 86401

SEQ ID NO: 251996 - RNA, 64 nt, Homo Sapiens; identical to SEQ ID NO: 86402

SEQ ID NO: 251997 - RNA, 64 nt, Homo Sapiens; identical to SEQ ID NO: 86403

SEQ ID NO: 251998 - RNA, 64 nt, Homo Sapiens; identical to SEQ ID NO: 86404

SEQ ID NO: 251999 - RNA, 64 nt, Homo Sapiens; identical to SEQ ID NO: 86405

SEQ ID NO: 252000 - RNA, 64 nt, Homo Sapiens; identical to SEQ ID NO: 86406

SEQ ID NO: 252001 - RNA, 64 nt, Homo Sapiens; identical to SEQ ID NO: 86407

SEQ ID NO: 252002 - RNA, 64 nt, Homo Sapiens; identical to SEQ ID NO: 86408

SEQ ID NO: 252003 - RNA, 64 nt, Homo Sapiens; identical to SEQ ID NO: 86409

SEQ ID NO: 252004 - RNA, 64 nt, Homo Sapiens; identical to SEQ ID NO: 86410

SEQ ID NO: 252005 - RNA, 64 nt, Homo Sapiens; identical to SEQ ID NO: 86411

SEQ ID NO: 252006 - RNA, 64 nt, Homo Sapiens; identical to SEQ ID NO: 86412

SEQ ID NO: 252007 - RNA, 64 nt, Homo Sapiens; identical to SEQ ID NO: 86413

SEQ ID NO: 252008 - RNA, 64 nt, Homo Sapiens; identical to SEQ ID NO: 86414

SEQ ID NO: 252009 - RNA, 64 nt, Homo Sapiens; identical to SEQ ID NO: 86415

SEQ ID NO: 252010 - RNA, 64 nt, Homo Sapiens; identical to SEQ ID NO: 86416

SEQ ID NO: 252011 - RNA, 64 nt, Homo Sapiens; identical to SEQ ID NO: 86417

SEQ ID NO: 252012 - RNA, 64 nt, Homo Sapiens; identical to SEQ ID NO: 86418

SEQ ID NO: 252013 - RNA, 64 nt, Homo Sapiens; identical to SEQ ID NO: 86419

SEQ ID NO: 252014 - RNA, 64 nt, Homo Sapiens; identical to SEQ ID NO: 86420

SEQ ID NO: 252015 - RNA, 64 nt, Homo Sapiens; identical to SEQ ID NO: 86421

SEQ ID NO: 252016 - RNA, 64 nt, Homo Sapiens; identical to SEQ ID NO: 86422

SEQ ID NO: 252017 - RNA, 64 nt, Homo Sapiens; identical to SEQ ID NO: 86423

SEQ ID NO: 252018 - RNA, 64 nt, Homo Sapiens; identical to SEQ ID NO: 86424

SEQ ID NO: 252019 - RNA, 64 nt, Homo Sapiens; identical to SEQ ID NO: 86425

SEQ ID NO: 252020 - RNA, 64 nt, Homo Sapiens; identical to SEQ ID NO: 86426

SEQ ID NO: 252021 - RNA, 64 nt, Homo Sapiens; identical to SEQ ID NO: 86427

SEQ ID NO: 252022 - RNA, 64 nt, Homo Sapiens; identical to SEQ ID NO: 86428

SEQ ID NO: 252023 - RNA, 64 nt, Homo Sapiens; identical to SEQ ID NO: 86429

SEQ ID NO: 252024 - RNA, 64 nt, Homo Sapiens; identical to SEQ ID NO: 86430

SEQ ID NO: 252025 - RNA, 64 nt, Homo Sapiens; identical to SEQ ID NO: 86431

SEQ ID NO: 252026 - RNA, 64 nt, Homo Sapiens; identical to SEQ ID NO: 86432

SEQ ID NO: 252027 - RNA, 64 nt, Homo Sapiens; identical to SEQ ID NO: 86433

SEQ ID NO: 252028 - RNA, 64 nt, Homo Sapiens; identical to SEQ ID NO: 86434

SEQ ID NO: 252029 - RNA, 64 nt, Homo Sapiens; identical to SEQ ID NO: 86435

SEQ ID NO: 252030 - RNA, 64 nt, Homo Sapiens; identical to SEQ ID NO: 86436

SEQ ID NO: 252031 - RNA, 64 nt, Homo Sapiens; identical to SEQ ID NO: 86437

SEQ ID NO: 252032 - RNA, 64 nt, Homo Sapiens; identical to SEQ ID NO: 86438

SEQ ID NO: 252033 - RNA, 64 nt, Homo Sapiens; identical to SEQ ID NO: 86439

SEQ ID NO: 252034 - RNA, 64 nt, Homo Sapiens; identical to SEQ ID NO: 86440

SEQ ID NO: 252035 - RNA, 64 nt, Homo Sapiens; identical to SEQ ID NO: 86441

SEQ ID NO: 252036 - RNA, 64 nt, Homo Sapiens; identical to SEQ ID NO: 86442

SEQ ID NO: 252037 - RNA, 64 nt, Homo Sapiens; identical to SEQ ID NO: 86443

SEQ ID NO: 252038 - RNA, 64 nt, Homo Sapiens; identical to SEQ ID NO: 86444

SEQ ID NO: 252039 - RNA, 64 nt, Homo Sapiens; identical to SEQ ID NO: 86445

SEQ ID NO: 252040 - RNA, 60 nt, Homo Sapiens; identical to SEQ ID NO: 86446

SEQ ID NO: 252041 - RNA, 64 nt, Homo Sapiens; identical to SEQ ID NO: 86447

SEQ ID NO: 252042 - RNA, 64 nt, Homo Sapiens; identical to SEQ ID NO: 86448

SEQ ID NO: 252043 - RNA, 64 nt, Homo Sapiens; identical to SEQ ID NO: 86449

SEQ ID NO: 252044 - RNA, 64 nt, Homo Sapiens; identical to SEQ ID NO: 86450

SEQ ID NO: 252045 - RNA, 64 nt, Homo Sapiens; identical to SEQ ID NO: 86451

SEQ ID NO: 252046 - RNA, 64 nt, Homo Sapiens; identical to SEQ ID NO: 86452

SEQ ID NO: 252047 - RNA, 64 nt, Homo Sapiens; identical to SEQ ID NO: 86453

SEQ ID NO: 252048 - RNA, 64 nt, Homo Sapiens; identical to SEQ ID NO: 86454

SEQ ID NO: 252049 - RNA, 64 nt, Homo Sapiens; identical to SEQ ID NO: 86455

SEQ ID NO: 252050 - RNA, 64 nt, Homo Sapiens; identical to SEQ ID NO: 86456

SEQ ID NO: 252051 - RNA, 64 nt, Homo Sapiens; identical to SEQ ID NO: 86457

SEQ ID NO: 252052 - RNA, 64 nt, Homo Sapiens; identical to SEQ ID NO: 86458

SEQ ID NO: 252053 - RNA, 64 nt, Homo Sapiens; identical to SEQ ID NO: 86459

SEQ ID NO: 252054 - RNA, 64 nt, Homo Sapiens; identical to SEQ ID NO: 86460

SEQ ID NO: 252055 - RNA, 64 nt, Homo Sapiens; identical to SEQ ID NO: 86461

SEQ ID NO: 252056 - RNA, 55 nt, Homo Sapiens; identical to SEQ ID NO: 86462

SEQ ID NO: 252057 - RNA, 64 nt, Homo Sapiens; identical to SEQ ID NO: 86463

SEQ ID NO: 252058 - RNA, 64 nt, Homo Sapiens; identical to SEQ ID NO: 86464

SEQ ID NO: 252059 - RNA, 64 nt, Homo Sapiens; identical to SEQ ID NO: 86465

SEQ ID NO: 252060 - RNA, 64 nt, Homo Sapiens; identical to SEQ ID NO: 86466

SEQ ID NO: 252061 - RNA, 64 nt, Homo Sapiens; identical to SEQ ID NO: 86467

SEQ ID NO: 252062 - RNA, 64 nt, Homo Sapiens; identical to SEQ ID NO: 86468

SEQ ID NO: 252063 - RNA, 64 nt, Homo Sapiens; identical to SEQ ID NO: 86469

SEQ ID NO: 252064 - RNA, 64 nt, Homo Sapiens; identical to SEQ ID NO: 86470

SEQ ID NO: 252065 - RNA, 64 nt, Homo Sapiens; identical to SEQ ID NO: 86471

SEQ ID NO: 252066 - RNA, 64 nt, Homo Sapiens; identical to SEQ ID NO: 86472

SEQ ID NO: 252067 - RNA, 64 nt, Homo Sapiens; identical to SEQ ID NO: 86473

SEQ ID NO: 252068 - RNA, 64 nt, Homo Sapiens; identical to SEQ ID NO: 86474

SEQ ID NO: 252069 - RNA, 64 nt, Homo Sapiens; identical to SEQ ID NO: 86475

SEQ ID NO: 252070 - RNA, 64 nt, Homo Sapiens; identical to SEQ ID NO: 86476

SEQ ID NO: 252071 - RNA, 64 nt, Homo Sapiens; identical to SEQ ID NO: 86477

SEQ ID NO: 252072 - RNA, 64 nt, Homo Sapiens; identical to SEQ ID NO: 86478

SEQ ID NO: 252073 - RNA, 64 nt, Homo Sapiens; identical to SEQ ID NO: 86479

SEQ ID NO: 252074 - RNA, 64 nt, Homo Sapiens; identical to SEQ ID NO: 86480

SEQ ID NO: 252075 - RNA, 64 nt, Homo Sapiens; identical to SEQ ID NO: 86481

SEQ ID NO: 252076 - RNA, 64 nt, Homo Sapiens; identical to SEQ ID NO: 86482

SEQ ID NO: 252077 - RNA, 64 nt, Homo Sapiens; identical to SEQ ID NO: 86483

SEQ ID NO: 252078 - RNA, 64 nt, Homo Sapiens; identical to SEQ ID NO: 86484

SEQ ID NO: 252079 - RNA, 64 nt, Homo Sapiens; identical to SEQ ID NO: 86485

SEQ ID NO: 252080 - RNA, 64 nt, Homo Sapiens; identical to SEQ ID NO: 86486

SEQ ID NO: 252081 - RNA, 64 nt, Homo Sapiens; identical to SEQ ID NO: 86487

SEQ ID NO: 252082 - RNA, 64 nt, Homo Sapiens; identical to SEQ ID NO: 86488

SEQ ID NO: 252083 - RNA, 64 nt, Homo Sapiens; identical to SEQ ID NO: 86489

SEQ ID NO: 252084 - RNA, 64 nt, Homo Sapiens; identical to SEQ ID NO: 86490

SEQ ID NO: 252085 - RNA, 64 nt, Homo Sapiens; identical to SEQ ID NO: 86491

SEQ ID NO: 252086 - RNA, 64 nt, Homo Sapiens; identical to SEQ ID NO: 86492

SEQ ID NO: 252087 - RNA, 64 nt, Homo Sapiens; identical to SEQ ID NO: 86493

SEQ ID NO: 252088 - RNA, 51 nt, Homo Sapiens; identical to SEQ ID NO: 86494

SEQ ID NO: 252089 - RNA, 64 nt, Homo Sapiens; identical to SEQ ID NO: 86495

SEQ ID NO: 252090 - RNA, 64 nt, Homo Sapiens; identical to SEQ ID NO: 86496

SEQ ID NO: 252091 - RNA, 64 nt, Homo Sapiens; identical to SEQ ID NO: 86497

SEQ ID NO: 252092 - RNA, 64 nt, Homo Sapiens; identical to SEQ ID NO: 86498

SEQ ID NO: 252093 - RNA, 64 nt, Homo Sapiens; identical to SEQ ID NO: 86499

SEQ ID NO: 252094 - RNA, 64 nt, Homo Sapiens; identical to SEQ ID NO: 86500

SEQ ID NO: 252095 - RNA, 64 nt, Homo Sapiens; identical to SEQ ID NO: 86501

SEQ ID NO: 252096 - RNA, 64 nt, Homo Sapiens; identical to SEQ ID NO: 86502

SEQ ID NO: 252097 - RNA, 64 nt, Homo Sapiens; identical to SEQ ID NO: 86503

SEQ ID NO: 252098 - RNA, 64 nt, Homo Sapiens; identical to SEQ ID NO: 86504

SEQ ID NO: 252099 - RNA, 64 nt, Homo Sapiens; identical to SEQ ID NO: 86505

SEQ ID NO: 252100 - RNA, 64 nt, Homo Sapiens; identical to SEQ ID NO: 86506

SEQ ID NO: 252101 - RNA, 64 nt, Homo Sapiens; identical to SEQ ID NO: 86507

SEQ ID NO: 252102 - RNA, 64 nt, Homo Sapiens; identical to SEQ ID NO: 86508

SEQ ID NO: 252103 - RNA, 64 nt, Homo Sapiens; identical to SEQ ID NO: 86509

SEQ ID NO: 252104 - RNA, 64 nt, Homo Sapiens; identical to SEQ ID NO: 86510

SEQ ID NO: 252105 - RNA, 64 nt, Homo Sapiens; identical to SEQ ID NO: 86511

SEQ ID NO: 252106 - RNA, 64 nt, Homo Sapiens; identical to SEQ ID NO: 86512

SEQ ID NO: 252107 - RNA, 64 nt, Homo Sapiens; identical to SEQ ID NO: 86513

SEQ ID NO: 252108 - RNA, 64 nt, Homo Sapiens; identical to SEQ ID NO: 86514

SEQ ID NO: 252109 - RNA, 64 nt, Homo Sapiens; identical to SEQ ID NO: 86515

SEQ ID NO: 252110 - RNA, 64 nt, Homo Sapiens; identical to SEQ ID NO: 86516

SEQ ID NO: 252111 - RNA, 64 nt, Homo Sapiens; identical to SEQ ID NO: 86517

SEQ ID NO: 252112 - RNA, 64 nt, Homo Sapiens; identical to SEQ ID NO: 86518

SEQ ID NO: 252113 - RNA, 64 nt, Homo Sapiens; identical to SEQ ID NO: 86519

SEQ ID NO: 252114 - RNA, 64 nt, Homo Sapiens; identical to SEQ ID NO: 86520

SEQ ID NO: 252115 - RNA, 64 nt, Homo Sapiens; identical to SEQ ID NO: 86521

SEQ ID NO: 252116 - RNA, 64 nt, Homo Sapiens; identical to SEQ ID NO: 86522

SEQ ID NO: 252117 - RNA, 64 nt, Homo Sapiens; identical to SEQ ID NO: 86523

SEQ ID NO: 252118 - RNA, 64 nt, Homo Sapiens; identical to SEQ ID NO: 86524

SEQ ID NO: 252119 - RNA, 64 nt, Homo Sapiens; identical to SEQ ID NO: 86525

SEQ ID NO: 252120 - RNA, 64 nt, Homo Sapiens; identical to SEQ ID NO: 64804

SEQ ID NO: 252121 - RNA, 64 nt, Homo Sapiens; identical to SEQ ID NO: 64805

SEQ ID NO: 252122 - RNA, 64 nt, Homo Sapiens; identical to SEQ ID NO: 64806

SEQ ID NO: 252123 - RNA, 64 nt, Homo Sapiens; identical to SEQ ID NO: 64807

SEQ ID NO: 252124 - RNA, 64 nt, Homo Sapiens; identical to SEQ ID NO: 64808

SEQ ID NO: 252125 - RNA, 64 nt, Homo Sapiens; identical to SEQ ID NO: 64809

SEQ ID NO: 252126 - RNA, 64 nt, Homo Sapiens; identical to SEQ ID NO: 64810

SEQ ID NO: 252127 - RNA, 64 nt, Homo Sapiens; identical to SEQ ID NO: 64811

SEQ ID NO: 252128 - RNA, 64 nt, Homo Sapiens; identical to SEQ ID NO: 64812

SEQ ID NO: 252129 - RNA, 64 nt, Homo Sapiens; identical to SEQ ID NO: 64813

SEQ ID NO: 252130 - RNA, 64 nt, Homo Sapiens; identical to SEQ ID NO: 64814

SEQ ID NO: 252131 - RNA, 64 nt, Homo Sapiens; identical to SEQ ID NO: 64815

SEQ ID NO: 252132 - RNA, 64 nt, Homo Sapiens; identical to SEQ ID NO: 64816

SEQ ID NO: 252133 - RNA, 64 nt, Homo Sapiens; identical to SEQ ID NO: 64817

SEQ ID NO: 252134 - RNA, 64 nt, Homo Sapiens; identical to SEQ ID NO: 64818

SEQ ID NO: 252135 - RNA, 64 nt, Homo Sapiens; identical to SEQ ID NO: 64819

SEQ ID NO: 252136 - RNA, 62 nt, Homo Sapiens
cccugacuccuggugcccucucccuuuguccccccagagagacauaugcccccagagagagc

SEQ ID NO: 252137 - RNA, 62 nt, Homo Sapiens
ucucccuuuguccccccagagagacauaugcccccagagagagcaaaucgaagcgugggagg

SEQ ID NO: 252138 - RNA, 62 nt, Homo Sapiens
caaugggguccuucuguaggaucagccuguggcccagagacaaaucauguuaacucuuccuu

SEQ ID NO: 252139 - RNA, 62 nt, Homo Sapiens
cagaggggaagagggugcuauuccucuuugcacccagagacucugcacaaaacuuuugggaa

SEQ ID NO: 252140 - RNA, 62 nt, Homo Sapiens
cccuagacccugccagaaaagggggcucuucccccagagaaguggcuuggagggaacuuccc

SEQ ID NO: 252141 - RNA, 62 nt, Homo Sapiens
gaggagccugcugcauucuccugcugagggaucccagagagggcaggugcccaccccacagg

SEQ ID NO: 252142 - RNA, 62 nt, Homo Sapiens
ccucagguuguucucugauucuuccucccaaccccagagacugcagauuugugccaugcggc

SEQ ID NO: 252143 - RNA, 62 nt, Homo Sapiens
cucuauccuaaggaagaccaagcaggccuggacccagagacgucccccaucgugggacacga

SEQ ID NO: 252144 - RNA, 62 nt, Homo Sapiens
uuggacuccggacuauccauacugucugcucacccagagaccuccaggcuggccuuuggccg

SEQ ID NO: 252145 - RNA, 62 nt, Homo Sapiens
cugggccuucauggacacauagcuggucacuccccagagaagugcaggaguuucuccugggc

SEQ ID NO: 252146 - RNA, 62 nt, Homo Sapiens
ccccggggcugccguuuugcugggcagugguucccagagagucagagcuggcaccccucagu

SEQ ID NO: 252147 - RNA, 62 nt, Homo Sapiens
uguucccgcugcacggcccaccggcggccagccccagagaccagaacugauccagagcugga

SEQ ID NO: 252148 - RNA, 62 nt, Homo Sapiens
auccaggcacugaacugcucuaagucuagaugcccagagagccccggaggggucuggaggca

SEQ ID NO: 252149 - RNA, 62 nt, Homo Sapiens
guagaaagaguccaguguaaccucgaagagcucccagagauucagaggacaggugacaacca

SEQ ID NO: 252150 - RNA, 62 nt, Homo Sapiens
ccuggcacacaaggcccaagccagggaggggacccagagaggaggugagaggaaggcaaagg

SEQ ID NO: 252151 - RNA, 62 nt, Homo Sapiens
cccugggcucagaucuguaaccuuuccaaaagcccagagaugaacucaggaaaagcaggaac

SEQ ID NO: 252152 - RNA, 62 nt, Homo Sapiens
ccuuguaaguguccccucugcuuugucuugcucccagagacaucuaaccaaucaaauaguuu

SEQ ID NO: 252153 - RNA, 62 nt, Homo Sapiens
aaaccuuggggccccagaugugggcuuggauucccagagaggacagggaagagacauacccc

SEQ ID NO: 252154 - RNA, 62 nt, Homo Sapiens
cugccuucccuacacuagaaauugcaggagcucccagagagaaccugggcuaagaguuuggc

SEQ ID NO: 252155 - RNA, 62 nt, Homo Sapiens
acugaggcuacggggaacuuagcagccucaagcccagagaagacuuuaaaugccugccaagg

SEQ ID NO: 252156 - RNA, 62 nt, Homo Sapiens
uuauaagaacugauguggcccagccacuucagcccagagagagguccaacccugcaaugaag

SEQ ID NO: 252157 - RNA, 62 nt, Homo Sapiens
ugugggcagaagcagugaagacuucagccaagcccagagaagagcguuugccagagguggcc

SEQ ID NO: 252158 - RNA, 62 nt, Homo Sapiens
ccccuuccccaucagaagacgaggggagagcccccagagagccucccaguuggccagaaucu

SEQ ID NO: 252159 - RNA, 62 nt, Homo Sapiens
ccccuuagcacaccuagaggugacucaaucuacccagagaugcccuagggucucuucuugcu

SEQ ID NO: 252160 - RNA, 62 nt, Homo Sapiens
uaaagcuaggcagaugagcccagaagaauggucccagagaaagcagacuggcuccaauagau

SEQ ID NO: 252161 - RNA, 62 nt, Homo Sapiens
ugccuacuguuccccaccucagaagcuuccugcccagagagccagcagccuugggauacuaa

SEQ ID NO: 252162 - RNA, 62 nt, Homo Sapiens
accaaggagcuggggcccaaggccaguccugccccagagacacuccaaguccgccaggggca

SEQ ID NO: 252163 - RNA, 62 nt, Homo Sapiens
aaagagggccccagcccagccccaccacagaucccagagauaggggcccagucuccaugggg

SEQ ID NO: 252164 - RNA, 62 nt, Homo Sapiens
gcacccggggcugcaaacgucuccgugcagcccccagagagaggcccaugggcucagaccag

SEQ ID NO: 252165 - RNA, 62 nt, Homo Sapiens
uucuacccaaaugucaggaccaggauuuucuacccagagaccaagguguucuucccaaagac

SEQ ID NO: 252166 - RNA, 62 nt, Homo Sapiens
uucuacccauaugucaggaccaggauuuucuacccagagaccaagguuaucuuccuaaagac

SEQ ID NO: 252167 - RNA, 62 nt, Homo Sapiens
uucuacccauaugucaggaccgggauuuucuacccagagaccugcauguucucuccaacgac

SEQ ID NO: 252168 - RNA, 62 nt, Homo Sapiens
ccucagucccucccuccuggcauacccccugccccagagaagcugcuauccagccgcaaauc

SEQ ID NO: 252169 - RNA, 62 nt, Homo Sapiens
cccugccaacuuuccagacucuuccugggcagcccagagagauucccaggacccugggucac

SEQ ID NO: 252170 - RNA, 62 nt, Homo Sapiens
ucuccacccaucucuacaucugggcacagcaacccagagauggccaaaagcauucaagccug

SEQ ID NO: 252171 - RNA, 62 nt, Homo Sapiens
gauggccuucuuugucaucuucacucuccacccccagagaggagucagagccauaacucaau

SEQ ID NO: 252172 - RNA, 62 nt, Homo Sapiens
ggaaaauccucuggcuggcuuuccacaagauucccagagacagugccccaaaaugcaagauu

SEQ ID NO: 252173 - RNA, 62 nt, Homo Sapiens
aaucagacuucacacugcaaguucccugaaaacccagagagguccuugcaccugcauccgua

SEQ ID NO: 252174 - RNA, 62 nt, Homo Sapiens
ccuccaccgcugccuaagugggcagggccuugcccagagaugggcagagggcagaggcugga

SEQ ID NO: 252175 - RNA, 62 nt, Homo Sapiens
agcccgaacacccgcauccccuaagccuaggccccagagaucgggcccuggcuauuugggac

SEQ ID NO: 252176 - RNA, 62 nt, Homo Sapiens
ugacaguauuagggagugaacucuuugggcuccccagagaccacccucuuggcuuucccgug

SEQ ID NO: 252177 - RNA, 62 nt, Homo Sapiens
ggggagcccacuguccugggcccucccuguuccccagagaaaucagccuggccagacacagg

SEQ ID NO: 252178 - RNA, 62 nt, Homo Sapiens
uacuugaagggccagagccauccucuccccagcccagagacagcugacggccagggagaagc

SEQ ID NO: 252179 - RNA, 62 nt, Homo Sapiens
cccgacguagcugccccccuggggggccacagcccagagaaccagccuaggaacacucggga

SEQ ID NO: 252180 - RNA, 62 nt, Homo Sapiens
gcuccaguguggggugaggcagugagguuaggcccagagagcuggaguuggcucagaugaaa

SEQ ID NO: 252181 - RNA, 62 nt, Homo Sapiens
gagcagcagcaggacagacccccacgaggccccccagagaggaggaagaucccacggaggaa

SEQ ID NO: 252182 - RNA, 62 nt, Homo Sapiens
ugccugagggacaacagacaucagaacaaacccccagagagaaacagucaaaaucagggccc

SEQ ID NO: 252183 - RNA, 62 nt, Homo Sapiens
gccccaccuucuucaucccuugccugcaccaccccagagaagaccuaccuugcuuugggagc

SEQ ID NO: 252184 - RNA, 62 nt, Homo Sapiens
uccuugaggagaacaagugccggccgcacccucccagagaaccaucgagcuagcucccugca

SEQ ID NO: 252185 - RNA, 62 nt, Homo Sapiens
gcaggcagccacgcccugcagauaggcaggaccccagagaggcugaccccugccagggcaca

SEQ ID NO: 252186 - RNA, 62 nt, Homo Sapiens
gcccaggaaguccccguggugagcaccggccucccagagaaaaagacccucagauguggcca

SEQ ID NO: 252187 - RNA, 62 nt, Homo Sapiens
gggccgcuccaggccccacagagcaggagacccccagagaaagccggggcuggcaggaggcg

SEQ ID NO: 252188 - RNA, 62 nt, Homo Sapiens
ccucaacugacagcugaggaaaggcaauuaggcccagagaggcagagacacucgcuuaagau

SEQ ID NO: 252189 - RNA, 62 nt, Homo Sapiens
aaacuccccaaggugccugaugacaugaagcucccagagauagucugugaaaugaaaguccc

SEQ ID NO: 252190 - RNA, 62 nt, Homo Sapiens
aaacucccuaaaaugccugagcucccgaaagucccagagauggugcaccucccggaagugca

SEQ ID NO: 252191 - RNA, 62 nt, Homo Sapiens
aagcucccugagaugaaacugcuuccaaaagucccagagauggugcaccucccagaagugca

SEQ ID NO: 252192 - RNA, 62 nt, Homo Sapiens
gcugccagcucucaacauagcaggccauaggacccagagaagaaucccagcguugcucaaag

SEQ ID NO: 252193 - RNA, 62 nt, Homo Sapiens
agaauucuuuggcgggaaggguaugauggguucccagagacaagaagcccaaccuucuggcc

SEQ ID NO: 252194 - RNA, 62 nt, Homo Sapiens
gggagagaacacgcugugaaaacacagaagcucccagagaagccuucucagcuuuuaucucu

SEQ ID NO: 252195 - RNA, 62 nt, Homo Sapiens
agaaaggcuggaguuauuauucaacucaaucucccagagaacucagaggcuacaguuucuac

SEQ ID NO: 252196 - RNA, 62 nt, Homo Sapiens
gacagcugcucaggcccuaacucccugggcuucccagagaguccccugcucagucagcccca

SEQ ID NO: 252197 - RNA, 62 nt, Homo Sapiens
gugcccggagcuggccguguagggcuaggccacccagagacucaccuaugccacagugccua

SEQ ID NO: 252198 - RNA, 62 nt, Homo Sapiens
aaagugaugaggagacugagacacaccuguaucccagagagcugggaaaaugaacguccagg

SEQ ID NO: 252199 - RNA, 62 nt, Homo Sapiens
aaggccaggggucuuggugcacccgugacccacccagagagcaccuccugcggcagaacagc

SEQ ID NO: 252200 - RNA, 62 nt, Homo Sapiens
gaacugaaauccuugagaguuccggggagaaacccagagaugccugauuucauuccucgaug

SEQ ID NO: 252201 - RNA, 62 nt, Homo Sapiens
auuccacccuguuacuuauguagaaacugaggcccagagagggaagaugaccugccccaagu

SEQ ID NO: 252202 - RNA, 64 nt, Homo Sapiens; identical to SEQ ID NO: 159617

SEQ ID NO: 252203 - RNA, 64 nt, Homo Sapiens; identical to SEQ ID NO: 159618

SEQ ID NO: 252204 - RNA, 64 nt, Homo Sapiens; identical to SEQ ID NO: 159619

SEQ ID NO: 252205 - RNA, 64 nt, Homo Sapiens; identical to SEQ ID NO: 159620

SEQ ID NO: 252206 - RNA, 64 nt, Homo Sapiens; identical to SEQ ID NO: 159621

SEQ ID NO: 252207 - RNA, 64 nt, Homo Sapiens; identical to SEQ ID NO: 159622

SEQ ID NO: 252208 - RNA, 64 nt, Homo Sapiens; identical to SEQ ID NO: 159623

SEQ ID NO: 252209 - RNA, 64 nt, Homo Sapiens; identical to SEQ ID NO: 159624

SEQ ID NO: 252210 - RNA, 64 nt, Homo Sapiens; identical to SEQ ID NO: 159625

SEQ ID NO: 252211 - RNA, 64 nt, Homo Sapiens; identical to SEQ ID NO: 159626

SEQ ID NO: 252212 - RNA, 64 nt, Homo Sapiens; identical to SEQ ID NO: 159627

SEQ ID NO: 252213 - RNA, 64 nt, Homo Sapiens; identical to SEQ ID NO: 159628

SEQ ID NO: 252214 - RNA, 64 nt, Homo Sapiens; identical to SEQ ID NO: 159629

SEQ ID NO: 252215 - RNA, 64 nt, Homo Sapiens; identical to SEQ ID NO: 159630

SEQ ID NO: 252216 - RNA, 64 nt, Homo Sapiens; identical to SEQ ID NO: 159631

SEQ ID NO: 252217 - RNA, 64 nt, Homo Sapiens; identical to SEQ ID NO: 159632

SEQ ID NO: 252218 - RNA, 64 nt, Homo Sapiens; identical to SEQ ID NO: 159633

SEQ ID NO: 252219 - RNA, 64 nt, Homo Sapiens; identical to SEQ ID NO: 159634

SEQ ID NO: 252220 - RNA, 64 nt, Homo Sapiens; identical to SEQ ID NO: 159635

SEQ ID NO: 252221 - RNA, 64 nt, Homo Sapiens; identical to SEQ ID NO: 159636

SEQ ID NO: 252222 - RNA, 64 nt, Homo Sapiens; identical to SEQ ID NO: 159637

SEQ ID NO: 252223 - RNA, 64 nt, Homo Sapiens; identical to SEQ ID NO: 159638

SEQ ID NO: 252224 - RNA, 64 nt, Homo Sapiens; identical to SEQ ID NO: 159639

SEQ ID NO: 252225 - RNA, 64 nt, Homo Sapiens; identical to SEQ ID NO: 159640

SEQ ID NO: 252226 - RNA, 64 nt, Homo Sapiens; identical to SEQ ID NO: 159641

SEQ ID NO: 252227 - RNA, 64 nt, Homo Sapiens; identical to SEQ ID NO: 159642

SEQ ID NO: 252228 - RNA, 64 nt, Homo Sapiens; identical to SEQ ID NO: 159643

SEQ ID NO: 252229 - RNA, 64 nt, Homo Sapiens; identical to SEQ ID NO: 159644

SEQ ID NO: 252230 - RNA, 64 nt, Homo Sapiens; identical to SEQ ID NO: 159645

SEQ ID NO: 252231 - RNA, 64 nt, Homo Sapiens; identical to SEQ ID NO: 159646

SEQ ID NO: 252232 - RNA, 64 nt, Homo Sapiens; identical to SEQ ID NO: 159647

SEQ ID NO: 252233 - RNA, 64 nt, Homo Sapiens; identical to SEQ ID NO: 159648

SEQ ID NO: 252234 - RNA, 64 nt, Homo Sapiens; identical to SEQ ID NO: 159649

SEQ ID NO: 252235 - RNA, 64 nt, Homo Sapiens; identical to SEQ ID NO: 159650

SEQ ID NO: 252236 - RNA, 64 nt, Homo Sapiens; identical to SEQ ID NO: 159651

SEQ ID NO: 252237 - RNA, 64 nt, Homo Sapiens; identical to SEQ ID NO: 159652

SEQ ID NO: 252238 - RNA, 64 nt, Homo Sapiens; identical to SEQ ID NO: 159653

SEQ ID NO: 252239 - RNA, 64 nt, Homo Sapiens; identical to SEQ ID NO: 159654

SEQ ID NO: 252240 - RNA, 64 nt, Homo Sapiens; identical to SEQ ID NO: 159655

SEQ ID NO: 252241 - RNA, 64 nt, Homo Sapiens; identical to SEQ ID NO: 159656

SEQ ID NO: 252242 - RNA, 64 nt, Homo Sapiens; identical to SEQ ID NO: 159657

SEQ ID NO: 252243 - RNA, 64 nt, Homo Sapiens; identical to SEQ ID NO: 159658

SEQ ID NO: 252244 - RNA, 63 nt, Homo Sapiens
accucuugcacuguugucuuguuucacugaucuuagcuuuaaacacaagagaagucuuuaaaa

SEQ ID NO: 252245 - RNA, 63 nt, Homo Sapiens
cccaucucuaaaaaaugaaaaaaagaagagagguagcuuuaaagugguuuuucucaugauauu

SEQ ID NO: 252246 - RNA, 63 nt, Homo Sapiens
auuauacaugagcagcucaaagccaugcaaaaauagcuuuaaagucuaaguugaccucgagug

SEQ ID NO: 252247 - RNA, 63 nt, Homo Sapiens
uuauuugcugauaccaacuuugcacauuuuuguuagcuuuacaagcauugcaauauggaauuu

SEQ ID NO: 252248 - RNA, 63 nt, Homo Sapiens
guuaugucacuaauaaugaguaguaacccaauuuagcuuuacaaagauuuuuucuauuacuuu

SEQ ID NO: 252249 - RNA, 63 nt, Homo Sapiens
cguggcuaaaaccccacaauaacuuuacauuccuagcuuuacagucuugcugugaauucucug

SEQ ID NO: 252250 - RNA, 63 nt, Homo Sapiens
guacagaucuuacaauuaaggggcuauagcaaguagcuuuacaguugaacaaacugaauauau

SEQ ID NO: 252251 - RNA, 63 nt, Homo Sapiens
cuaggccaagcaacuaguuucggauuuuguaacuagcuuuaaauaucuggaccauuaagaaaa

SEQ ID NO: 252252 - RNA, 63 nt, Homo Sapiens
accugugugccauuuuaagaaaggaaaaaccaauagcuuuaaagaaaaauucagagaguuagg

SEQ ID NO: 252253 - RNA, 63 nt, Homo Sapiens
aauaugucaguuugcaguuauaaaacugauuuuuagcuuuacaaguuucuguuaaucauguau

SEQ ID NO: 252254 - RNA, 63 nt, Homo Sapiens
gcaauauugccaugguuuuaagucacaguuagguagcuuuaggugcaaaguagcaauuuccau

SEQ ID NO: 252255 - RNA, 63 nt, Homo Sapiens
aaauaacaguuugugaacuucuaauguuagcuuuagcuuuagagaguucuaccauagcaaggc

SEQ ID NO: 252256 - RNA, 63 nt, Homo Sapiens
uuuagaaaauaacaguuugucaaggccuaauguuagcuuuagcagugaagaguucuaccauag

SEQ ID NO: 252257 - RNA, 63 nt, Homo Sapiens
gaaaacacguaacuuguuuaaaaguuuuucugguagcuuuagcuuuaugcuaaaaaaaauaau

SEQ ID NO: 252258 - RNA, 63 nt, Homo Sapiens
acguaacuuguuuaaaaguuuuucugguagcuuuagcuuuaugcuaaaaaaaauaaugacauu

SEQ ID NO: 252259 - RNA, 63 nt, Homo Sapiens
aaaaaaagagacugguuagugaugcaguuaguauagcuuuauacucucuccacuuuauagcuc

SEQ ID NO: 252260 - RNA, 63 nt, Homo Sapiens
uuuugacaaucaaagaaaagacuuuuguugaaauagcuuuacuguuucucaaguguuuuggag

SEQ ID NO: 252261 - RNA, 63 nt, Homo Sapiens
gggaaauaagggaauaaggccaaggaagauguauagcuuuagcuuuagccuggcaaccuggag

SEQ ID NO: 252262 - RNA, 63 nt, Homo Sapiens
uaagggaauaaggccaaggaagauguauagcuuuagcuuuagccuggcaaccuggagaaucca

SEQ ID NO: 252263 - RNA, 63 nt, Homo Sapiens
aaaauaucuuuuucaaggcaucagcucugaaccuagcuuuauuuaaacugaauuuccaguaua

SEQ ID NO: 252264 - RNA, 63 nt, Homo Sapiens
agggaaucaaaaauacugcuuucaguuaguagcuagcuuuaagucaggaguuaguaaugagaa

SEQ ID NO: 252265 - RNA, 65 nt, Homo Sapiens
ucaucugaccacugggcaccuuagugccaaccugaaccaaagagaccuccuuguuucagcugggc

SEQ ID NO: 252266 - RNA, 65 nt, Homo Sapiens
uugugggaacaagagaugacuuugaggauaaaaggaccaaagaaaaagcuuuacuuagaugauug

SEQ ID NO: 252267 - RNA, 65 nt, Homo Sapiens
gggcaccugcuggaguccggccugugcuuucugggaccaaagaaugaguuccugauuccaaguca

SEQ ID NO: 252268 - RNA, 65 nt, Homo Sapiens
uauccaagugcuuccuccaagcuuucccugaagcaaccaaagauaaguaauuuuaaggggccaaa

SEQ ID NO: 252269 - RNA, 65 nt, Homo Sapiens
aaaguccuauaauguggaagaaacaaacaguugcuaccaaagauucuucaaauaaacauacaaau

SEQ ID NO: 252270 - RNA, 65 nt, Homo Sapiens
aaauuggccugaauauucucuuggggaaagagggcaccaaagaaaaggguaagugcaucugaggg

SEQ ID NO: 252271 - RNA, 65 nt, Homo Sapiens
gcaucagagccagaaaugcccucccuagguccaggaccaaagauaaaacaaacacgaggaacaug

SEQ ID NO: 252272 - RNA, 65 nt, Homo Sapiens
ggugcuaccauauggagccuaaggauaaagccaauaccaaagaaaacagugacuaaacagagaga

SEQ ID NO: 252273 - RNA, 65 nt, Homo Sapiens
gaguuuugccuuaauuuuuuaaguacugcaccaaaaccaaagagcugaccugacuucuguggaac

SEQ ID NO: 252274 - RNA, 65 nt, Homo Sapiens
ccucaacauaacuaugaaaucauagcucuguuuucaccaaagaacagaccaauuaacauacuuau

SEQ ID NO: 252275 - RNA, 65 nt, Homo Sapiens
uuuuuuguaugcuuaaauaaaaauaaaaauucauaaccaaagagaaucccacauuagcuuguuag

SEQ ID NO: 252276 - RNA, 65 nt, Homo Sapiens
gggugcaguccagacagcuugacugcuuuuaaaugaccaaagaugaccugugguaagcaaccugg

SEQ ID NO: 252277 - RNA, 65 nt, Homo Sapiens
uagggcaagagaggcaggugaggaaauuuauagcaaccaaagaaaaauccagauauuugagaagc

SEQ ID NO: 252278 - RNA, 65 nt, Homo Sapiens
gaagccaaauagguagccaacagacagauauaaacaccaaagacgucagagagaccugcuaaaac

SEQ ID NO: 252279 - RNA, 65 nt, Homo Sapiens
guaauagacaacuccagauugacauugacugcuuaaccaaagaaauugaucuuuuucaagcccga

SEQ ID NO: 252280 - RNA, 65 nt, Homo Sapiens
uucuuucuuacagaucaaagguccaucaucaaaacaccaaagacucaagacacagaagaugauga

SEQ ID NO: 252281 - RNA, 65 nt, Homo Sapiens
uggcugccucccuuccucagcccauuagguuaaacaccaaagaaagacugguguguacugaauag

SEQ ID NO: 252282 - RNA, 65 nt, Homo Sapiens
uuuauuuggaaccuucuaagaggaaaucaaccaggaccaaagagccuuaaaggacacacagcaau

SEQ ID NO: 252283 - RNA, 65 nt, Homo Sapiens
augcccuucuccuuauuguauggacuauggagugcaccaaagagaaaucagcucaggacugccau

SEQ ID NO: 252284 - RNA, 65 nt, Homo Sapiens
aaaguccacccuugguuccucaaaagggccaaagaaccaaagaagccugccccagcuggggaaau

SEQ ID NO: 252285 - RNA, 65 nt, Homo Sapiens
ucugaaauauauaguaaaugauggggagaaccccaaccaaagaaaacaagaaauauuaauaccac

SEQ ID NO: 252286 - RNA, 65 nt, Homo Sapiens
cauccaagcaauaaaguggaacaaccuuaaccaacaccaaagaaaaauaaagcaaaaagcaggcc

SEQ ID NO: 252287 - RNA, 65 nt, Homo Sapiens
acaccuuuccagaaaaaagucaauuguucagguacaccaaagaggaagaagagcuguggaggcca

SEQ ID NO: 252288 - RNA, 65 nt, Homo Sapiens
accuggcacacuggggucugcacaaggcuuugucaaccaaagacagcuucccccuuuugauugcc

SEQ ID NO: 252289 - RNA, 65 nt, Homo Sapiens
aucucaaauuuuaaguuaaacuaccuaaaauaaauaccaaagauaaugcauauuuuugcacagug

SEQ ID NO: 252290 - RNA, 65 nt, Homo Sapiens
ugcuauuaugauguuuugcaaaggaaaauaaucaaaccaaagaguauucagugauauguaaauua

SEQ ID NO: 252291 - RNA, 65 nt, Homo Sapiens
cuuugauugaauucccuuuuucugguuugggaaauaccaaagagguaauguucauuuaucaaaaa

SEQ ID NO: 252292 - RNA, 65 nt, Homo Sapiens
uucagggaaacuccaguauacaccaaugggaauggaccaaagaguacguguuucguaagcccagg

SEQ ID NO: 252293 - RNA, 65 nt, Homo Sapiens
cuggugugcauggggcagcacccaacggcagccaaaccaaagacagggaccagaggucauaggug

SEQ ID NO: 252294 - RNA, 65 nt, Homo Sapiens
agauggaccggcucuugcucagcuuaggagaccucaccaaagagagcgggcagaugguggaaggc

SEQ ID NO: 252295 - RNA, 65 nt, Homo Sapiens
ggaaauggagaguagugagcaaaacaucagauuucaccaaagaaccaaagugacuccacaauugg

SEQ ID NO: 252296 - RNA, 65 nt, Homo Sapiens
caggggaaacugcacuuagacugacagaauugaacaccaaagaauuugcuggcuuccaaauuggg

SEQ ID NO: 252297 - RNA, 65 nt, Homo Sapiens
aagcgcuuuaugcccaugaugucauuucaggcucaaccaaagaggaucaaacaggaauuccaucu

SEQ ID NO: 252298 - RNA, 65 nt, Homo Sapiens
cuuucagcugagaacagauuugacucacagacauuaccaaagaggagcuugugaauccaggaaaa

SEQ ID NO: 252299 - RNA, 60 nt, Homo Sapiens
uccaagccuguggcuggagcugguguguguuuaucuaauaaagucccacaggugccucac

SEQ ID NO: 252300 - RNA, 60 nt, Homo Sapiens
auaauaugguuguugaaaaugugaucaccuuuaucuaaagugggagaagauacauacaca

SEQ ID NO: 252301 - RNA, 60 nt, Homo Sapiens
ucauccagaaguuccucaagggccaggacuuuaucuaauaccucugugugcuccuccuug

SEQ ID NO: 252302 - RNA, 60 nt, Homo Sapiens
gggguuuaauauuacccuuuccuauguguuuuaucuaauuauuuugguuguuaauauggu

SEQ ID NO: 252303 - RNA, 60 nt, Homo Sapiens
gaagccgaaaucugcauaaggaagcccacuuuaucuaaaugauauuagccaggauccuug

SEQ ID NO: 252304 - RNA, 60 nt, Homo Sapiens
gguccaugcacaucccugacaccucacaccuuaucuaagucugaagcuggggagaaaggg

SEQ ID NO: 252305 - RNA, 60 nt, Homo Sapiens
aaaguuucucugguuaccccucuucccuuguuaucuaagcuuuccucaguugucaucucu

SEQ ID NO: 252306 - RNA, 60 nt, Homo Sapiens
gaggcagcuuucaucacacccuuuuaacauuuaucuaaaagaauuuaaauucuuuuucaa

SEQ ID NO: 252307 - RNA, 60 nt, Homo Sapiens
cagccaguccacagguuugcauccuggacuuuaucuaaauagugccaagacacaucacua

SEQ ID NO: 252308 - RNA, 60 nt, Homo Sapiens
cugcuggugaaccaauaccauaagcauguauuaucuaagcacuugaucaagaaauauaca

SEQ ID NO: 252309 - RNA, 60 nt, Homo Sapiens
aauaugguuggcauuaaauuuagcauuucauuaucuaacaaaauuaauauaaauuccagg

SEQ ID NO: 252310 - RNA, 60 nt, Homo Sapiens
uuaaacauccugaaucgggaacaaaggguuuuaucuaauaaagugucucuuccauucacg

SEQ ID NO: 252311 - RNA, 60 nt, Homo Sapiens
uaucugcuuuugguuauaauguguuuuuaauuaucuaaaguaugaagcauuuucuggggu

SEQ ID NO: 252312 - RNA, 60 nt, Homo Sapiens
auugucaugacauuuccaacacugugugaauuaucuaaaugcgucuaccauuuugcacua

SEQ ID NO: 252313 - RNA, 60 nt, Homo Sapiens
uuauuucauaaaauaagaauuuguucuguguuaucuaaagauguaucaguauauugucac

SEQ ID NO: 252314 - RNA, 60 nt, Homo Sapiens
agaacuuauaguaaggaaacucacuugauuuuaucuaaccucaaacuuuccaaguuuaau

SEQ ID NO: 252315 - RNA, 60 nt, Homo Sapiens
auuagaaacaugacauuuaaucuuucaagauuaucuaaacaaggggaagugaggagaauu

SEQ ID NO: 252316 - RNA, 60 nt, Homo Sapiens
uccagaugcuuuuguagaugcuggcuaaaauuaucuaauugaaguuuuaugucccugacu

SEQ ID NO: 252317 - RNA, 60 nt, Homo Sapiens
ucuucuagaauuuauuuuucauuacagauauuaucuaaauuucagggucaaaucauguac

SEQ ID NO: 252318 - RNA, 60 nt, Homo Sapiens
ggucuuugcauauagaugaauggcuuuuauuuaucuaagaagcuaagacuuuuuuuccug

SEQ ID NO: 252319 - RNA, 60 nt, Homo Sapiens
aaucagaaauacuaguuuaaugugcaauuuuuaucuaaccauacaggaucuuucagauca

SEQ ID NO: 252320 - RNA, 60 nt, Homo Sapiens
cagauggaucuuccuuacaagcucauauuuuuaucuaauuaaaauaaccaauacuccacu

SEQ ID NO: 252321 - RNA, 60 nt, Homo Sapiens
ccuggaggguggacucugucgaucccagcguuaucuaacucuuggccuggcccagcccaa

SEQ ID NO: 252322 - RNA, 60 nt, Homo Sapiens
aaucagauuucacagucucaacauuuacacuuaucuaauauauuauacggcuacauuuac

SEQ ID NO: 252323 - RNA, 60 nt, Homo Sapiens
agaaagaaacagagauaauauaugaaagguuuaucuaagaggaaauuaggauaugacaua

SEQ ID NO: 252324 - RNA, 60 nt, Homo Sapiens
cuuuaaaccuaucuuccaggacacaaguuguuaucuaaacucuucaauuuggagugacua

SEQ ID NO: 252325 - RNA, 60 nt, Homo Sapiens
cuccacuucuucuugugaugcuguucuggauuaucuaaugcagauuggauagcaaggcug

SEQ ID NO: 252326 - RNA, 60 nt, Homo Sapiens
uuugugauagggaaacaaaucuuggugguguuaucuaauuacuccauggacauugcugcu

SEQ ID NO: 252327 - RNA, 60 nt, Homo Sapiens
agguuauuucaaaguuugcagugcucacaguuaucuaaugaaccagguauggaagccuac

SEQ ID NO: 252328 - RNA, 60 nt, Homo Sapiens
ugaauugagaaaaaauuacauagguacaauuuaucuaaacuugggauaauuuuucuauau

SEQ ID NO: 252329 - RNA, 60 nt, Homo Sapiens
agaaaauaugcagaauaacuauuucaucauuuaucuaaagcaucuuuuuuuaaaaaccga

SEQ ID NO: 252330 - RNA, 60 nt, Homo Sapiens
cuuaacacccuuuugugaagaucacagcauuuaucuaagaaacugugaggcuuucugguu

SEQ ID NO: 252331 - RNA, 60 nt, Homo Sapiens
auuuauauauguauugauuggcaaccagauuuaucuaaguagaacugaauuggcuaggaa

SEQ ID NO: 252332 - RNA, 60 nt, Homo Sapiens
caguaacuugugaauguuaaguaucaucucuuaucuaaauauuaaaagauaagucaaaca

SEQ ID NO: 252333 - RNA, 60 nt, Homo Sapiens
ucacaaugucaguauuucaguguaguuaauuuaucuaaauuaaagccuuuaguaucagug

SEQ ID NO: 252334 - RNA, 60 nt, Homo Sapiens
cuuauuuuguauaauuuuuaugcucuuugauuaucuaauaaggccaguauuucaaaagcu

SEQ ID NO: 252335 - RNA, 60 nt, Homo Sapiens
ccccauuauuaaaucaaccugagccacauguuaucuaaaggaacugauucacaacuuucu

SEQ ID NO: 252336 - RNA, 60 nt, Homo Sapiens
gucuaguguacaucuagcuaaaagugugguuuaucuaaaccguuuuaauaagcaagauga

SEQ ID NO: 252337 - RNA, 60 nt, Homo Sapiens
uucacuugcacaucauggaggguuuagugcuuaucuaauuugugccucacuggacuuguc

SEQ ID NO: 252338 - RNA, 60 nt, Homo Sapiens
guaaguguuuuccggcugaucuauuuuuauuuaucuaaaaaaguuuagaaauauccuaau

SEQ ID NO: 252339 - RNA, 60 nt, Homo Sapiens
ugcacugaugaacuagauuauauggcuuucuuaucuaaacacaguaugcccauuuguuuu

SEQ ID NO: 252340 - RNA, 60 nt, Homo Sapiens
ucugcuagggaauaucaauauuuccuuaaauuaucuaaaauccugcuucugauaugcagu

SEQ ID NO: 252341 - RNA, 60 nt, Homo Sapiens
auuaucuacguuucucucuauuauugaggauuaucuaauuuaccuuccaagugaauauga

SEQ ID NO: 252342 - RNA, 60 nt, Homo Sapiens
auuauugugacaacucuagaccugccugcuuuaucuaauguaaucaugcucaaugucuac

SEQ ID NO: 252343 - RNA, 60 nt, Homo Sapiens
aaaagaaguaugucaguuauaauaaccugguuaucuaaccuguuccauuccauggaacca

SEQ ID NO: 252344 - RNA, 60 nt, Homo Sapiens
aaccagcacuagcuuguuccaagcuggaauuuaucuaaucuauuuuuguguuuaaaaaag

SEQ ID NO: 252345 - RNA, 60 nt, Homo Sapiens
auucaggggcuagagugauuuuuuuccagauuaucuaaaguuggaugcccacacuaugaa

SEQ ID NO: 252346 - RNA, 60 nt, Homo Sapiens
uggcuagcaaucugccuguaucucucacuauuaucuaaaagaaaccuuccaaugcuucug

SEQ ID NO: 252347 - RNA, 60 nt, Homo Sapiens
auguuaaaaggcauuuauaauuauuuuuaauuaucuaaguuuuaauacaagaacgauuuc

SEQ ID NO: 252348 - RNA, 60 nt, Homo Sapiens
uuguccuuguuaagaauuucuugaagugauuuaucuaaaauaaagguuggcaaacuuuuu

SEQ ID NO: 252349 - RNA, 60 nt, Homo Sapiens
gcauuuauuguuuaggaguauaauuuuauuuuaucuaaaauaauagucuauuuuuucuuu

SEQ ID NO: 252350 - RNA, 60 nt, Homo Sapiens
aaugaaaagggacuuaaaaaguaaacaugauuaucuaaauuacuuaaaauuuuuuaaucu

SEQ ID NO: 252351 - RNA, 60 nt, Homo Sapiens
uuuucaauaugcaaguuaggcuuaauuuuuuuaucuaaugaucaucaugaaaugaauaag

SEQ ID NO: 252352 - RNA, 60 nt, Homo Sapiens
aauugguuauauucuaagauagagauaaaguuaucuaacaugcuuguaaacagaugugau

SEQ ID NO: 252353 - RNA, 60 nt, Homo Sapiens
ccagcaaaacagauucaaagugaagucuucuuaucuaaaccaauauauaguuagcuuuau

SEQ ID NO: 252354 - RNA, 60 nt, Homo Sapiens
uguugaauccauucugguuuaacucuguguuuaucuaaaaauucaagcaaaagaauuauu

SEQ ID NO: 252355 - RNA, 60 nt, Homo Sapiens
uaacugagaaagaaagccuuacuuuaagacuuaucuaauuuuguuuuuaguaguuuccca

SEQ ID NO: 252356 - RNA, 60 nt, Homo Sapiens
ucuuuuauuucuuguuuucuuuuacaaagguuaucuaaugucuuuuuaauuuuaguaauu

SEQ ID NO: 252357 - RNA, 60 nt, Homo Sapiens
ccauaaaagugggaauuucagguuguccccuuaucuaacugggagugaugaaucaucacc

SEQ ID NO: 252358 - RNA, 60 nt, Homo Sapiens
gugcaguuucauuuagauaaaccucaagauuuaucuaacauuacaggauuuuggcucgau

SEQ ID NO: 252359 - RNA, 60 nt, Homo Sapiens
augaauguggccacaaagcugaguccgagcuuaucuaaauaucuccagaagaggggagca

SEQ ID NO: 252360 - RNA, 60 nt, Homo Sapiens
cuuccuuuucuuucagaaauccuaauccaauuaucuaaaugauuuacaauuuauguauuc

SEQ ID NO: 252361 - RNA, 60 nt, Homo Sapiens
uaaugagaaacucagaaaaaaaaacacagcuuaucuaaucagagcuaagacaaacaaaac

SEQ ID NO: 252362 - RNA, 60 nt, Homo Sapiens
ugcaauaagagagccucucuacauuugggcuuaucuaauuauaaaugugaauaugcuuuu

SEQ ID NO: 252363 - RNA, 60 nt, Homo Sapiens
gggaaacugagggcagagagguuaacagauuuaucuaagguccccagcagaauugacagu

SEQ ID NO: 252364 - RNA, 60 nt, Homo Sapiens
uucguguucuguguauaccaaaugauucuguuaucuaaagaagcuuuuugcugggaaaac

SEQ ID NO: 252365 - RNA, 60 nt, Homo Sapiens
caccuggcucucucucuguccugccucccauuaucuaacacauuuuuuacauguacauuu

SEQ ID NO: 252366 - RNA, 60 nt, Homo Sapiens
ugauuugaucuuuuuucaguuucacauaccuuaucuaagguuucccaggauuuaaacaga

SEQ ID NO: 252367 - RNA, 60 nt, Homo Sapiens
uauaauuuuaaaaaaucccuuguaggauuauuaucuaaauuuauaugucuaacuucuacu

SEQ ID NO: 252368 - RNA, 60 nt, Homo Sapiens
uuuuggucuuggcuuguucucauaagucauuuaucuaaguuuguguuucugugugugugu

SEQ ID NO: 252369 - RNA, 60 nt, Homo Sapiens
gguccccaucugucaaaugagaagauuggauuaucuaaucuuuuagauccuuaacaacuc

SEQ ID NO: 252370 - RNA, 60 nt, Homo Sapiens
ugcuggugcuaaauaacagucuuuauuauauuaucuaauuuugacuaaagaaauacuuuu

SEQ ID NO: 252371 - RNA, 60 nt, Homo Sapiens
auucauuugugaguuuggauauagagcacauuaucuaaaccauuuuguaguuccaaaaac

SEQ ID NO: 252372 - RNA, 60 nt, Homo Sapiens
ggaaaaaaugaaagcuauuucaugcaaacauuaucuaauuuagcuuaaaagugaaagugg

SEQ ID NO: 252373 - RNA, 60 nt, Homo Sapiens
caagcuugugaauauguaaauuuuaaacuauuaucuaacuaaguguacugaauugucguu

SEQ ID NO: 252374 - RNA, 60 nt, Homo Sapiens
gcuuucuauuacuuuuuaggcuuuaguauauuaucuaaaguuuggcuuuugauguggaug

SEQ ID NO: 252375 - RNA, 60 nt, Homo Sapiens
augaaacucccuaguuccuucccgaacgucuuaucuaaucgcuguccgguggagauccca

SEQ ID NO: 252376 - RNA, 60 nt, Homo Sapiens
uuuuguuuuguuuuauuauuuguuuuacuuuuaucuaaagauacugcuuagcauuuugca

SEQ ID NO: 252377 - RNA, 60 nt, Homo Sapiens
uacuaaguugguacccuaccuauacaaugguuaucuaacauuuucauuucugguuuuuac

SEQ ID NO: 252378 - RNA, 60 nt, Homo Sapiens
guauuaauuguuugguugcucacuauuucauuaucuaaguuauuuuguacugagaucaua

SEQ ID NO: 252379 - RNA, 60 nt, Homo Sapiens
uauuuuguauucaauguguaaauacuuuuauuaucuaauacuaucuuacgucuaauuagu

SEQ ID NO: 252380 - RNA, 60 nt, Homo Sapiens
ggaguauuuauugucaguuuuguucacuuguuaucuaauacaaaauuauaaagccuucag

SEQ ID NO: 252381 - RNA, 60 nt, Homo Sapiens
aggauucauaaggagcuuaucugaacagauuuaucuaagaaaaaaaaaaaacgacauaaa

SEQ ID NO: 252382 - RNA, 60 nt, Homo Sapiens
gugaaaguauucuaagccaaguuuuaaauauuaucuaacagacaagagugguauauacaa

SEQ ID NO: 252383 - RNA, 60 nt, Homo Sapiens
cuuuuccugcggcaucagaugaauuguuaauuaucuaauuucugaaaugugcagcuccca

SEQ ID NO: 252384 - RNA, 60 nt, Homo Sapiens
auagacuaauauggguaauuacccuuugguuuaucuaaaguguguucaugaugacugagg

SEQ ID NO: 252385 - RNA, 60 nt, Homo Sapiens
gcaaugccuuuauuuaaaaaaauugucuacuuaucuaaauauucauaccacaauuucaaa

SEQ ID NO: 252386 - RNA, 60 nt, Homo Sapiens
guaagugauaugagaaaucuuuaaccagccuuaucuaaaaauaaaaagagaagccauugu

SEQ ID NO: 252387 - RNA, 60 nt, Homo Sapiens
cccugccaauguuuaacuuuuaaaagcaucuuaucuaaaagaaaggcuauccaguagagc

SEQ ID NO: 252388 - RNA, 60 nt, Homo Sapiens
aaaaaaacagaaaauuauuuugauaaaaaauuaucuaaggugagguugauaaaguauuac

SEQ ID NO: 252389 - RNA, 60 nt, Homo Sapiens
uaaauauacacaaauaugaagaaguuucaguuaucuaaaauauuugcuguuaaauucugu

SEQ ID NO: 252390 - RNA, 60 nt, Homo Sapiens
uuuuuuuuuuuuugguauacuuguuuuauuuuaucuaauuuucaagaccuauuggggguu

SEQ ID NO: 252391 - RNA, 60 nt, Homo Sapiens
gcucuaaacucauuaaaaaaaacucagugguuaucuaauaguguguacauaguuaccuuu

SEQ ID NO: 252392 - RNA, 60 nt, Homo Sapiens
acaaauugucagauuucuuacaaaugucuguuaucuaacuucaauuaugaaagugaaaug

SEQ ID NO: 252393 - RNA, 60 nt, Homo Sapiens
gaaugagccaaaaugacuuuauggucaguauuaucuaaauuuuugaaauuguagugcaaa

SEQ ID NO: 252394 - RNA, 60 nt, Homo Sapiens
aacucaauauuaagauguuauuucuugucuuuaucuaauaaauuuccccaagccccauuu

SEQ ID NO: 252395 - RNA, 60 nt, Homo Sapiens
cucagguaugaggcuuuaguuuuugucuguuuaucuaauuccugaacugcuagcccuccc

SEQ ID NO: 252396 - RNA, 60 nt, Homo Sapiens
ugaagaaucuguacuuuguauguauagaauuuaucuaauaaaucauucauagaucauuuu

SEQ ID NO: 252397 - RNA, 60 nt, Homo Sapiens
augugguccauuuuauuuucuaauauugguuuaucuaauguuuucugcguggugcugucu

SEQ ID NO: 252398 - RNA, 60 nt, Homo Sapiens
aggcaugagcccuugaauuucaggcaccuuuuaucuaaugagaguuuuuacagcucauca

SEQ ID NO: 252399 - RNA, 60 nt, Homo Sapiens
uguagcguaauuaaccucucacaaagaugcuuaucuaaccuccccagcagucauggguuu

SEQ ID NO: 252400 - RNA, 60 nt, Homo Sapiens
ccacucagcuaccuaauuccucaaugaccuuuaucuaaaaucuccauggaagcaauaaau

SEQ ID NO: 252401 - RNA, 60 nt, Homo Sapiens
agagcugucauuguccuuuauucaacuaguuuaucuaaauuugugauugcuuaggguuuu

SEQ ID NO: 252402 - RNA, 60 nt, Homo Sapiens
cacuuauuucagguaauagcuuggggauauuuaucuaaagguacccccaacaaaucuucu

SEQ ID NO: 252403 - RNA, 60 nt, Homo Sapiens
aguguguccaguagugcaggaaaugaugucuuaucuaaugauuugcuucucuagaggaga

SEQ ID NO: 252404 - RNA, 60 nt, Homo Sapiens
uuauuugccuuaauauaagcuuuuaagcaguuaucuaacuaguguccacaacccuguaac

SEQ ID NO: 252405 - RNA, 60 nt, Homo Sapiens
cacguggaauuguacuuguauaugauuaccuuaucuaaaaugaauaagaggugauggacc

SEQ ID NO: 252406 - RNA, 60 nt, Homo Sapiens
gcugcuaugcuauagucuccuuuaggcaaguuaucuaaauccauuugugagcugugggac

SEQ ID NO: 252407 - RNA, 60 nt, Homo Sapiens
aaauauugagaugugcuuuuucuacacccuuuaucuaaauauauuucccagcagugacaa

SEQ ID NO: 252408 - RNA, 60 nt, Homo Sapiens
caucagaacauguguuuucaucucaacucguuaucuaaagaauucauuucuguauuauau

SEQ ID NO: 252409 - RNA, 60 nt, Homo Sapiens
auuaaucugagcacaucaagcuauccaguguuaucuaaaagcaagucucugaaagcagaa

SEQ ID NO: 252410 - RNA, 60 nt, Homo Sapiens
uaauuuaaaguuguuugugcauauguacaguuaucuaaguguguguguguauauauauau

SEQ ID NO: 252411 - RNA, 60 nt, Homo Sapiens
uuuuaaaagaaaauauaccuuauuugcuaguuaucuaaugaaacugcuccugguauuaua

SEQ ID NO: 252412 - RNA, 60 nt, Homo Sapiens
aauaaaaagcucuauaaggaggaaaggccuuuaucuaauucuuaucuacagacacuuacu

SEQ ID NO: 252413 - RNA, 60 nt, Homo Sapiens
uuguagccuaaguacguaaacaaauuaauguuaucuaaguuuuucauauuucauggacaa

SEQ ID NO: 252414 - RNA, 60 nt, Homo Sapiens
agcaugauuuuuauauaacuaguuucaguuuuaucuaauaacuuacuuuuuaaaucaaua

SEQ ID NO: 252415 - RNA, 60 nt, Homo Sapiens
accccugagagaugcucaccaagcuucuauuuaucuaauuuaaaacuugaaaguaaagcc

SEQ ID NO: 252416 - RNA, 60 nt, Homo Sapiens
ccucacccaucuaaguugauaucuaaaauuuuaucuaaguugguaucuaaaauuuuucau

SEQ ID NO: 252417 - RNA, 60 nt, Homo Sapiens
uaaaagaccucaggcaccacgacuaagaaguuaucuaaugagguggagaaccugacagag

SEQ ID NO: 252418 - RNA, 60 nt, Homo Sapiens
auauguacagcucuccccucuucucaucuuuuaucuaacugaaacaugccagaaggaauc

SEQ ID NO: 252419 - RNA, 60 nt, Homo Sapiens
uuguuagcccuguguauguaagaaucuggauuaucuaacauguguaaucaugagaguaua

SEQ ID NO: 252420 - RNA, 60 nt, Homo Sapiens
gggcaauuaauuccuucagccagguauucguuaucuaauaaaucacucuguucauuccuc

SEQ ID NO: 252421 - RNA, 60 nt, Homo Sapiens
uaaaggaaauguuaucaaaaacugaaaucauuaucuaaaaagcaauaaagucuccuuggu

SEQ ID NO: 252422 - RNA, 60 nt, Homo Sapiens
ucauaauagcaauuauugccaauccuguguuuaucuaacugauuuguaaaccaagaaauu

SEQ ID NO: 252423 - RNA, 60 nt, Homo Sapiens
ucuuagaucagugguccccauccugcucaguuaucuaaugggaguuaaaguuuuauauuu

SEQ ID NO: 252424 - RNA, 60 nt, Homo Sapiens
aaagggaauuuuaacuuuucaauaaucaguuuaucuaagaaacguuaauuuucaguuuua

SEQ ID NO: 252425 - RNA, 60 nt, Homo Sapiens
ugauuuuguauguuagacuuuuuacauuguuuaucuaauauuauuuaugacaguaauuuu

SEQ ID NO: 252426 - RNA, 60 nt, Homo Sapiens
uguaauucuaggagacacguguugaucuaguuaucuaacauuguuguuauaagaaaauga

SEQ ID NO: 252427 - RNA, 60 nt, Homo Sapiens
ccaacauuuguuuagcuugcuuggcuuuaauuaucuaaagccaaugaaagacuucuuugu

SEQ ID NO: 252428 - RNA, 60 nt, Homo Sapiens
aaauagccccaaacugcaauuccauaugacuuaucuaacaucuuggggggaaagaauauu

SEQ ID NO: 252429 - RNA, 60 nt, Homo Sapiens
ggacgccauuuucuguuauaaucauuuuuguuaucuaauuuggggaaacuauucaucugu

SEQ ID NO: 252430 - RNA, 60 nt, Homo Sapiens
auggcuagcuauugggcaccaguuuuucuguuaucuaaaauuucacacaacuucauuguu

SEQ ID NO: 252431 - RNA, 60 nt, Homo Sapiens
uuuaugguuccaagugcaaaacagguguucuuaucuaaaacgucaauuagaaaauuaucu

SEQ ID NO: 252432 - RNA, 60 nt, Homo Sapiens
uuuauauuuuuaucauuccuuuuucuucauuuaucuaaccccaaagcccugauaugccac

SEQ ID NO: 252433 - RNA, 60 nt, Homo Sapiens
caugauccgugcuuaaugaucaaguguuacuuaucuaauaauccucuagaaagaacccug

SEQ ID NO: 252434 - RNA, 60 nt, Homo Sapiens
agcuuuuaauuaucuacagcguaacuugauuuaucuaauuuuaaucugaaggaugauacu

SEQ ID NO: 252435 - RNA, 60 nt, Homo Sapiens
uguacauaauuuugagguagcuugaccagcuuaucuaaaaugguguguauucaaauaaua

SEQ ID NO: 252436 - RNA, 60 nt, Homo Sapiens
uauaugauaugcagccgcuguauaagucauuuaucuaauccuaaaccuugugauucugcu

SEQ ID NO: 252437 - RNA, 60 nt, Homo Sapiens
uaaaguugauauuauuuuugauaauaaaauuuaucuaauuauaaaaugauuacuuuaaaa

SEQ ID NO: 252438 - RNA, 60 nt, Homo Sapiens
uucucagaacacucuccuaauaccaaagcuuuaucuaagcagacucucccagcauguuuc

SEQ ID NO: 252439 - RNA, 60 nt, Homo Sapiens
uuugaugaucguagagaaagacuugguaauuuaucuaaguaucuuuaauaaaucuuucag

SEQ ID NO: 252440 - RNA, 60 nt, Homo Sapiens
gaggauugaaaaauguauaucacucaauuuuuaucuaagaaggauagguuauaaagggag

SEQ ID NO: 252441 - RNA, 60 nt, Homo Sapiens
aaaucuagcuuuuuuguacagacuuagaaauuaucuaaagauuucaucuuuuuaccucau

SEQ ID NO: 252442 - RNA, 60 nt, Homo Sapiens
uuuuaguucuaacauugaguuuggacaauuuuaucuaauuguaauucucuagggugccag

SEQ ID NO: 252443 - RNA, 60 nt, Homo Sapiens
agaagauggucacuuuaaccuuguaaauauuuaucuaaaaugauauuuacaaaacuguaa

SEQ ID NO: 252444 - RNA, 60 nt, Homo Sapiens
aaaaacaaaggcaaacuuuguacuauccaguuaucuaaggaacaauaaaaacauuaggag

SEQ ID NO: 252445 - RNA, 60 nt, Homo Sapiens
cuguaaguaguugucauauuaaaaguuguuuuaucuaauagcagguguuuaaaaagaaag

SEQ ID NO: 252446 - RNA, 60 nt, Homo Sapiens
auuaacauucuaagucuaccaauauuuucuuuaucuaaauucugguaaugucuucaguaa

SEQ ID NO: 252447 - RNA, 60 nt, Homo Sapiens
ggacacuuuuacuguuuucuaaaaagauacuuaucuaacuaauucuacucucagaggugc

SEQ ID NO: 252448 - RNA, 60 nt, Homo Sapiens
gccugcuucagggcugggcgacaugcaaucuuaucuaaaauucccucaaaauuuucaugg

SEQ ID NO: 252449 - RNA, 60 nt, Homo Sapiens
uuauuguuuguuguggugucaaauuuuaaauuaucuaaauccucuugccuuuuuuuuuuu

SEQ ID NO: 252450 - RNA, 60 nt, Homo Sapiens
uaaauuggcccaggguuggccuuugagcauuuaucuaaauguuuccuguggccguuugaa

SEQ ID NO: 252451 - RNA, 60 nt, Homo Sapiens
auuugcauggaaauuaaguaggcuguuuauuuaucuaaaggaaucaaguccacucuucug

SEQ ID NO: 252452 - RNA, 60 nt, Homo Sapiens
uaaaccagcagguugcuaaaagaaggcauuuuaucuaaaguuauuuuaauaggugguaua

SEQ ID NO: 252453 - RNA, 60 nt, Homo Sapiens
cauuuaaaagguauaaaucaaaauaacaaauuaucuaaaaaaaaucuauccuguacaugu

SEQ ID NO: 252454 - RNA, 60 nt, Homo Sapiens
guaguuagaugaugugacaaccucuaauauuuaucuaauaaauauguauucagaugaaac

SEQ ID NO: 252455 - RNA, 60 nt, Homo Sapiens
uuaucacccucauugauauuaucauuggaauuaucuaaggugagccccaguuuccagggc

SEQ ID NO: 252456 - RNA, 60 nt, Homo Sapiens
guaugccaaauuuuauaugaauuuuucagauuaucuaagcuuccagguuuuauaauuaga

SEQ ID NO: 252457 - RNA, 60 nt, Homo Sapiens
ugaguuuacaauacugcaaacuguguuauuuuaucuaauccauugcuuaaugaguguguu

SEQ ID NO: 252458 - RNA, 60 nt, Homo Sapiens
cauccuauuuagagggugguuuuuuuuaauuuaucuaauggcuacgauauagccagauuc

SEQ ID NO: 252459 - RNA, 60 nt, Homo Sapiens
acugagaacugucacucuaaccucuccagcuuaucuaacaugucauaaacauaauaaauc

SEQ ID NO: 252460 - RNA, 52 nt, Homo Sapiens
aaacauguuuaauguuguaauauuaucuaacuggucuaaacuucaaauauca

SEQ ID NO: 252461 - RNA, 60 nt, Homo Sapiens
guugcauugacugucacauaaugcucauacuuaucuaauguugaguuauuaauauguuau

SEQ ID NO: 252462 - RNA, 60 nt, Homo Sapiens
aacugcaguccuggagcaaucacagaugaguuaucuaagaauacagcuuucugaccuuca

SEQ ID NO: 252463 - RNA, 60 nt, Homo Sapiens
auaagcuaccuuuuguaagugccauguuuauuaucuaaucauuccaaguuuugcauugau

SEQ ID NO: 252464 - RNA, 60 nt, Homo Sapiens
uuaaguaguuuaaguauguucagagugauguuaucuaaguaacauuuugguaguauacuu

SEQ ID NO: 252465 - RNA, 60 nt, Homo Sapiens
cauuucucgaucacugguuuuuuuugugccuuaucuaaaaguguuaacauucuugguauc

SEQ ID NO: 252466 - RNA, 60 nt, Homo Sapiens
augauucuagguguugcuggauccaaauuguuaucuaaagaacuuucuccauggccuaug

SEQ ID NO: 252467 - RNA, 60 nt, Homo Sapiens
gacacaugguaauggugaugcugugccuuguuaucuaagaacaugauuguauaauuuguu

SEQ ID NO: 252468 - RNA, 60 nt, Homo Sapiens
aguggucccucaaggucuucgaauagauguuuaucuaaccugacaguugcaguuuucacc

SEQ ID NO: 252469 - RNA, 60 nt, Homo Sapiens
aauuuuuuaaaaaauaauacuguguuguguuuaucuaaauacguaaacucaagcuaccaa

SEQ ID NO: 252470 - RNA, 60 nt, Homo Sapiens
gguaguacagauaaccccucauaaagaugcuuaucuaaccuccccaguguucagguguuu

SEQ ID NO: 252471 - RNA, 60 nt, Homo Sapiens
ucacuuauuaccuguaugaacaugggcaaauuaucuaaucucucugaucuauuuuuccuc

SEQ ID NO: 252472 - RNA, 60 nt, Homo Sapiens
ggaugggaguggguaaagaguuugggaagguuaucuaacugaaucacuacugaguugaau

SEQ ID NO: 252473 - RNA, 60 nt, Homo Sapiens
aucguaacuugaauaccuugaauguagagauuaucuaaaauuuuauaauuugaugucuca

SEQ ID NO: 252474 - RNA, 60 nt, Homo Sapiens
aaauucauuuuuauaucgaaugauugauuuuuaucuaaaaguaagacaaggucacugugc

SEQ ID NO: 252475 - RNA, 60 nt, Homo Sapiens
gugcucaagagguucucgacagugccuacauuaucuaacuugcuuggaccucgugcuuua

SEQ ID NO: 252476 - RNA, 60 nt, Homo Sapiens
ggaggcagaccugaagaugggaguguggauuuaucuaaauuaagcagcccaacacaaaac

SEQ ID NO: 252477 - RNA, 60 nt, Homo Sapiens
uaaagcuuccuguuuauacaauaaucuuauuuaucuaaacauauaaaauuuuuguaaugg

SEQ ID NO: 252478 - RNA, 60 nt, Homo Sapiens
agaauacauuuaaccugucacuaauaaccuuuaucuaaauaauggauccaggguauaccu

SEQ ID NO: 252479 - RNA, 60 nt, Homo Sapiens
aacuacagcuaucuuaauuucaagcaacauuuaucuaaugugugaacaacgugaugacaa

SEQ ID NO: 252480 - RNA, 60 nt, Homo Sapiens
auauuacacuuauccaucaguucuuccucuuuaucuaacuaugauaacugggaaauguuu

SEQ ID NO: 252481 - RNA, 60 nt, Homo Sapiens
acaugaguaguuggcucugagguggccuucuuaucuaagcgauuagaugacguauuuauu

SEQ ID NO: 252482 - RNA, 60 nt, Homo Sapiens
ugcuuugaguuuguauaauagacugaugcuuuaucuaaaacaucaaucuauaauauauua

SEQ ID NO: 252483 - RNA, 60 nt, Homo Sapiens
ccauuaggguucacgucuuuauguuaauuauuaucuaauuauguacauaugcccccaucc

SEQ ID NO: 252484 - RNA, 60 nt, Homo Sapiens
guaaccuauuuuuguucugguuugguucgguuaucuaauggaaagguaacuggcaaugca

SEQ ID NO: 252485 - RNA, 60 nt, Homo Sapiens
agcccuacaaggauauguuuuccugugaaauuaucuaagagguagguuuagacaucugcu

SEQ ID NO: 252486 - RNA, 60 nt, Homo Sapiens
ccuuauguguaucugcaacacccugaaaaauuaucuaauaaaaaggcacaaagaaaaagc

SEQ ID NO: 252487 - RNA, 60 nt, Homo Sapiens
uaguugaauuucuuuaaaaaguuuucuauuuuaucuaaaaucuuuccauuauaucuaaau

SEQ ID NO: 252488 - RNA, 60 nt, Homo Sapiens
ugcuuuaaaaagucccacugucagauuauauuaucuaacaauugaauauuguaaauauac

SEQ ID NO: 252489 - RNA, 60 nt, Homo Sapiens
uuuuuaaauauuuguugaguacuuacguguuuaucuaacaguucacuuccauuuuucuag

SEQ ID NO: 252490 - RNA, 60 nt, Homo Sapiens
uuuuuucaucuguuguacauaguuguauuuuuaucuaaugccauuuuagaauuuucuaag

SEQ ID NO: 252491 - RNA, 60 nt, Homo Sapiens
gcuucuugcuuuaaguccucacccuuuacauuaucuaauucuucaguuuugaugcugaua

SEQ ID NO: 252492 - RNA, 60 nt, Homo Sapiens
agggguggguaggcacccuccuuccuguuuuuaucuaauaaaaugcuaaccugcccugag

SEQ ID NO: 252493 - RNA, 60 nt, Homo Sapiens
gccuuugacccugcuuauuugucucacugguuaucuaaugaggaacaaacacuaaccuaa

SEQ ID NO: 252494 - RNA, 60 nt, Homo Sapiens
uuuaaagaauggccaauuagcugagaagaauuaucuaaucaauuagugaugucugccaug

SEQ ID NO: 252495 - RNA, 60 nt, Homo Sapiens
cacucuaggaaucuuaggcagaaagggauuuuaucuaaaucacuggaaaggcuggaggag

SEQ ID NO: 252496 - RNA, 60 nt, Homo Sapiens
uguguuguugcuuuaggcucugagcgauuauuaucuaaagucugggagaggauuuuuuuc

SEQ ID NO: 252497 - RNA, 60 nt, Homo Sapiens
gcuauuaaaacaaccuacugaaaaccaguuuuaucuaacaaaaacuaccuguuguaaccu

SEQ ID NO: 252498 - RNA, 60 nt, Homo Sapiens
ucaucuagguuuucuuuaaaauuuucugaauuaucuaauaaguuucuguuugaagugagg

SEQ ID NO: 252499 - RNA, 60 nt, Homo Sapiens
aaagucaaaucuugacagaaccuuugugguuuaucuaagggcugugaguuaaaauuguau

SEQ ID NO: 252500 - RNA, 60 nt, Homo Sapiens
uccuccuaagaguuuuacuauaagugagcuuuaucuaauauggggaaaaagggcuauugc

SEQ ID NO: 252501 - RNA, 60 nt, Homo Sapiens
uuuuauaugcugcuaaauauuccuucccuuuuaucuaauuuuuuauuuaauaguaguauu

SEQ ID NO: 252502 - RNA, 60 nt, Homo Sapiens
uaauauaugcaccuuucagacuaaaccuuauuaucuaaggauagugugaagcacucauuu

SEQ ID NO: 252503 - RNA, 60 nt, Homo Sapiens
ccauuucaaaacaaaacuguuucccuuauuuuaucuaacaucuuacccauucucuauuua

SEQ ID NO: 252504 - RNA, 60 nt, Homo Sapiens
aacugcgcuguaacaaacuuuauuuauauuuuaucuaaaugacuuuauauuaugcauaaa

SEQ ID NO: 252505 - RNA, 60 nt, Homo Sapiens
uaagcgcucauucuauuuuacaccucuugauuaucuaaacaagaugauaccugaagcugu

SEQ ID NO: 252506 - RNA, 60 nt, Homo Sapiens
uaucucuucuggacccauguugcaugggucuuaucuaacuaacauauagaaauguuugaa

SEQ ID NO: 252507 - RNA, 60 nt, Homo Sapiens
aagacaccucauucaaacaauggcauguaguuaucuaaucaaaguacuguucuccuucag

SEQ ID NO: 252508 - RNA, 60 nt, Homo Sapiens
accauaguacuuaaauugaauuuuucucgauuaucuaaaagauguuaagguacaacugug

SEQ ID NO: 252509 - RNA, 60 nt, Homo Sapiens
uugauuggugaaaugcaggguauguggaaguuaucuaauuaaccucaguuguauaugaau

SEQ ID NO: 252510 - RNA, 60 nt, Homo Sapiens
aaaauguauacauuucggaacaacuccauuuuaucuaaaaaaguucuugugauugccagu

SEQ ID NO: 252511 - RNA, 60 nt, Homo Sapiens
auggcagugacaaagugcuagcauuuauuguuaucuaauaaagaccuuggagcauaugug

SEQ ID NO: 252512 - RNA, 60 nt, Homo Sapiens
gcauguaauacacagugagacacaguaauuuuaucuaaauuacagugcaguuuaguuaau

SEQ ID NO: 252513 - RNA, 60 nt, Homo Sapiens
uuccccagcaauuaagauuucgagcagaauuuaucuaaauguguuucaaggaaacacaau

SEQ ID NO: 252514 - RNA, 60 nt, Homo Sapiens
aaguucaugauagugcuuuucuggaaaguauuaucuaauuuccuucugauuuaaguacag

SEQ ID NO: 252515 - RNA, 60 nt, Homo Sapiens
gugagagcugcauagauccauauagcucacuuaucuaaaggaagaucccucugccaaaaa

SEQ ID NO: 252516 - RNA, 60 nt, Homo Sapiens
auggacugcucaggaaacgacuuuucccauuuaucuaaauaaaaugcuggcuauagaugu

SEQ ID NO: 252517 - RNA, 60 nt, Homo Sapiens
guuucagaauucaaucgugauuucucuuuguuaucuaaaugagggaggaaaacucaacug

SEQ ID NO: 252518 - RNA, 60 nt, Homo Sapiens
cucagaucagguuuugaaagugacauauucuuaucuaauuuacaggcuugucuuucuaag

SEQ ID NO: 252519 - RNA, 60 nt, Homo Sapiens
ucaugaaccagaaugaaucaauaaacaccauuaucuaacuuucagugaacuuucaaaacc

SEQ ID NO: 252520 - RNA, 60 nt, Homo Sapiens
aaucuaauucuguugauuuuaggcugaucauuaucuaaaggggaauguuguuuucugacu

SEQ ID NO: 252521 - RNA, 60 nt, Homo Sapiens
auuccugucaccacaagagggaacaaauuuuuaucuaaaaggaguaagguaagaaaaaug

SEQ ID NO: 252522 - RNA, 60 nt, Homo Sapiens
uacuuuuacauauuuguaaauucauuaguauuaucuaaugugcuagaacucuaccugugu

SEQ ID NO: 252523 - RNA, 60 nt, Homo Sapiens
aaagcacugcaagaaaauagacaauaguuuuuaucuaauaucuaaaaagucaaaacguua

SEQ ID NO: 252524 - RNA, 60 nt, Homo Sapiens
auaauacauuccgaggggcucaguucugccuuaucuaaaucaccagagaccaaacaagga

SEQ ID NO: 252525 - RNA, 60 nt, Homo Sapiens
aauuaaacauucauaaucaugauuuaaguguuaucuaaauuuaccuuauuaguguuacca

SEQ ID NO: 252526 - RNA, 60 nt, Homo Sapiens
auugauuauauuuuaaagauaaccaggauauuaucuaauggugaauuguagaauuuugau

SEQ ID NO: 252527 - RNA, 60 nt, Homo Sapiens
uacaagugugguaaaugccauguuuguacuuuaucuaacaucuucucuuucaguagucuu

SEQ ID NO: 252528 - RNA, 60 nt, Homo Sapiens
acuaauguguguggaaagagguguuccucauuaucuaauauuucaauguguuaagaguuu

SEQ ID NO: 252529 - RNA, 60 nt, Homo Sapiens
cuccugacuguaacauauucuguaugaacuuuaucuaaagaaaaauaaaucuguucuggg

SEQ ID NO: 252530 - RNA, 60 nt, Homo Sapiens
gaggcauagguacuguuguaccaaggucacuuaucuaacaaaauaacccuucauguauuu

SEQ ID NO: 252531 - RNA, 60 nt, Homo Sapiens
aaauuuauuugacaagucugcagacaauccuuaucuaaccagcuauuuucuuaauugcua

SEQ ID NO: 252532 - RNA, 60 nt, Homo Sapiens
ccaucucuauguuucuguucgaaaaacagauuaucuaaaggggaacauugguuugugaag

SEQ ID NO: 252533 - RNA, 60 nt, Homo Sapiens
uauaacauacaauuauuuuaacauucccuguuaucuaaaucugaacuaaggcuaccaaau

SEQ ID NO: 252534 - RNA, 60 nt, Homo Sapiens
aguaaauguauuugccuuuguacuuugguuuuaucuaaaauuaaaaguuaauugauauua

SEQ ID NO: 252535 - RNA, 60 nt, Homo Sapiens
aguugcuggaaaaucauauugcaaauuucauuaucuaaugaccacccacaaagaaacaaa

SEQ ID NO: 252536 - RNA, 60 nt, Homo Sapiens
ucgugcggaaucagcuucuagcaagauaguuuaucuaacuuuuguaaugauugauuaaau

SEQ ID NO: 252537 - RNA, 60 nt, Homo Sapiens
uuuauauguucaccaaugggaggucaauauuuaucuaauuuaaaagguaugcuaaccacu

SEQ ID NO: 252538 - RNA, 60 nt, Homo Sapiens
agcaaggcaaaaauguaugccacaucucaguuaucuaaacuagauuagauccaagccaag

SEQ ID NO: 252539 - RNA, 60 nt, Homo Sapiens
uuaacaauucacaaggcacuuucacacccauuaucuaauuuaauccucauaaugacuaug

SEQ ID NO: 252540 - RNA, 60 nt, Homo Sapiens
guuguccaagagcacacugaaaguugaauguuaucuaaugcauuccucuaccuuucagaa

SEQ ID NO: 252541 - RNA, 60 nt, Homo Sapiens
agguugguggaaugaaugcgaagcugaguauuaucuaaacguagaauuugaauaugaccc

SEQ ID NO: 252542 - RNA, 60 nt, Homo Sapiens
uauuuuucaaaaauuuuuugacguuuuuaauuaucuaauuguccagcuuugcuggaaaag

SEQ ID NO: 252543 - RNA, 60 nt, Homo Sapiens
guuaccauuuugggguacccacugcucugguuaucuaauauguaacaagccaccccaaau

SEQ ID NO: 252544 - RNA, 60 nt, Homo Sapiens
aaacuuaugaccucuuccuuuaggagggaguuaucuaaaagaaaugucuauuaaggugau

SEQ ID NO: 252545 - RNA, 60 nt, Homo Sapiens
uaaaaaacacuauuuuacuuaaacuguuucuuaucuaaauucuugcagagugucaauguu

SEQ ID NO: 252546 - RNA, 60 nt, Homo Sapiens
uuugagaccagaauaagccugaagauaaucuuaucuaauuagucaauauucauuucagua

SEQ ID NO: 252547 - RNA, 60 nt, Homo Sapiens
auauguauaugcugugucauguuuuauauauuaucuaaaucuuccugcgguuuauucuau

SEQ ID NO: 252548 - RNA, 60 nt, Homo Sapiens
uaguacaguuucauauuugaguuugcagaauuaucuaauagucuuuuuuuggcuaauauu

SEQ ID NO: 252549 - RNA, 60 nt, Homo Sapiens
gguauucagggaaccugucuuaaauugugcuuaucuaaaucuuggaacuuugagcuaggg

SEQ ID NO: 252550 - RNA, 60 nt, Homo Sapiens
cuacuuuuagaguugaaacagaguaauaacuuaucuaacccucuuuuccuacaaaggaga

SEQ ID NO: 252551 - RNA, 60 nt, Homo Sapiens
caccacucuuauacaggaaaacuguccaaauuaucuaaagauccuccugagaagcuuaaa

SEQ ID NO: 252552 - RNA, 60 nt, Homo Sapiens
caucaggugcagugucaguuucaaaucaaauuaucuaagaaaacaagaaaacaaaggcag

SEQ ID NO: 252553 - RNA, 60 nt, Homo Sapiens
aggucaugacaaggaaaaaaaacaccacauuuaucuaagaagugauuuuggcugcaggac

SEQ ID NO: 252554 - RNA, 60 nt, Homo Sapiens
uauuagcuuuguccuaccaacuucuggaauuuaucuaauuauuguuuuucaaaguuucuu

SEQ ID NO: 252555 - RNA, 60 nt, Homo Sapiens
cucagguguacagguuauucuggguuaauuuuaucuaaugaagcccauuccuuuuuguac

SEQ ID NO: 252556 - RNA, 60 nt, Homo Sapiens
uauaaaaagguguuuugaugacagguagaauuaucuaauugcuuaaacccauauuguaaa

SEQ ID NO: 252557 - RNA, 51 nt, Homo Sapiens
gcugaaaggugaccaaagaauuuaucuaacuaaaucauaagugaagaguaa

SEQ ID NO: 252558 - RNA, 60 nt, Homo Sapiens
uaauaaagucagacaaaaugguggccuaaauuaucuaaugauaauugcaaauagguagga

SEQ ID NO: 252559 - RNA, 60 nt, Homo Sapiens
uuugacaugguagaccuugcguuguucugauuaucuaaaauugguauuuaaucccaaagu

SEQ ID NO: 252560 - RNA, 60 nt, Homo Sapiens
aaaucuuaaauaaauuuucaaaacaaauauuuaucuaaauauauggagcuauuccauuuu

SEQ ID NO: 252561 - RNA, 60 nt, Homo Sapiens
gcaaauaaggauguguucucugaucugcuuuuaucuaaaugagaaaugagugaauguggg

SEQ ID NO: 252562 - RNA, 60 nt, Homo Sapiens
ccaccauucuguagccacccauccuuugccuuaucuaacaaacauuuuuccaggaaggug

SEQ ID NO: 252563 - RNA, 60 nt, Homo Sapiens
aaaugcuacaauaguuuuuuaucuauaaaauuaucuaaagaaucauugucuuucagagac

SEQ ID NO: 252564 - RNA, 60 nt, Homo Sapiens
gcuacugaaacacccacugugaagccaguuuuaucuaacggaaauuuccugcuguaucca

SEQ ID NO: 252565 - RNA, 60 nt, Homo Sapiens
uaaaauucuagacugcuuucuuguaugauuuuaucuaaagggcaaaaauaauacauggaa

SEQ ID NO: 252566 - RNA, 60 nt, Homo Sapiens
uugugaauucucugaauacugucaacacucuuaucuaaguuugccuuuaugaugcagugg

SEQ ID NO: 252567 - RNA, 60 nt, Homo Sapiens
cuccuucaggggagccucaguuuugcccauuuaucuaauugaaucaguuuuuuacccaau

SEQ ID NO: 252568 - RNA, 60 nt, Homo Sapiens
caaucccccgauuuuguaggauaaucucccuuaucuaaagucaacugauuauggacuuua

SEQ ID NO: 252569 - RNA, 60 nt, Homo Sapiens
cugaauuggagguuuauuuuuuaauauauauuaucuaagaagagaucugugugugugaug

SEQ ID NO: 252570 - RNA, 60 nt, Homo Sapiens
uucuuugggacaaaacagaaguccauggaguuaucuaagcucuuguaagugaguuaauuu

SEQ ID NO: 252571 - RNA, 60 nt, Homo Sapiens
caugaaagaacacguacugguuuacaguucuuaucuaagaguguucuaaagccuuucauu

SEQ ID NO: 252572 - RNA, 60 nt, Homo Sapiens
ucaccaaauucacauugcaguuaacaauccuuaucuaacauuugaauagcgucuuuuuau

SEQ ID NO: 252573 - RNA, 60 nt, Homo Sapiens
ugacccugcaauuuacaugaaauacuguuuuuaucuaaugugucaguuuauagacugaac

SEQ ID NO: 252574 - RNA, 60 nt, Homo Sapiens
uaucaccuuuguauucaccuaauaaugaauuuaucuaaucgaaaccaucaucagagucac

SEQ ID NO: 252575 - RNA, 60 nt, Homo Sapiens
gacuuuggcuuuuguaaaucuccuggccuuuuaucuaaaggguaucuauguugguacgac

SEQ ID NO: 252576 - RNA, 60 nt, Homo Sapiens
caagcuugagaaugaauguagcuggauagauuaucuaagucuauagaaaucuuggucagg

SEQ ID NO: 252577 - RNA, 60 nt, Homo Sapiens
auuauucucuguauauaacuucaccauacuuuaucuaauuugugugaaaucuaguuuuua

SEQ ID NO: 252578 - RNA, 60 nt, Homo Sapiens
uaaaaugauaauuaaaaugcuguaaccaacuuaucuaauaaaauuggcaaccagccacua

SEQ ID NO: 252579 - RNA, 60 nt, Homo Sapiens
agaguaacuguaauuggauguuuauuguuuuuaucuaaaguaagguguauguguuugaga

SEQ ID NO: 252580 - RNA, 60 nt, Homo Sapiens
uuagccagcucuuccugucaagggcacagauuaucuaaaaugauuagacacuucaguguc

SEQ ID NO: 252581 - RNA, 60 nt, Homo Sapiens
cacagccauucuguucucacuguaguuuuauuaucuaaggcaggguuaacucuuuauuuu

SEQ ID NO: 252582 - RNA, 60 nt, Homo Sapiens
cucguucaacagugugagcauuugucucuguuaucuaaugauguucucugacccagcaga

SEQ ID NO: 252583 - RNA, 60 nt, Homo Sapiens
gcuugguuauaauuuauaacuuacuuauuuuuaucuaauaauuguagauucaguguauuu

SEQ ID NO: 252584 - RNA, 60 nt, Homo Sapiens
auagaauuaauuuaaagccuuaaacaaaauuuaucuaaagaaauaacuucuauuacuguc

SEQ ID NO: 252585 - RNA, 60 nt, Homo Sapiens
uuuacuuuuuauucaucuuuguguuuuuauuuaucuaaaauggguauugauuuuuaggac

SEQ ID NO: 252586 - RNA, 60 nt, Homo Sapiens
caugucaaucgauaaacccuacuuuccaaauuaucuaaaagauuaccauuuggggcccuu

SEQ ID NO: 252587 - RNA, 60 nt, Homo Sapiens
agauuaccauuuggggcccuuguuuucaaguuaucuaacugaaauauuauuaauuuuuuu

SEQ ID NO: 252588 - RNA, 60 nt, Homo Sapiens
cauauaccuauauauguuuguaucuaugacuuaucuaaucugccuaucaaucuaucuagu

SEQ ID NO: 252589 - RNA, 60 nt, Homo Sapiens
guuucuaaaacaacuugaaguauaguuuuguuaucuaagcaauuuuuguuuuaaguaagu

SEQ ID NO: 252590 - RNA, 60 nt, Homo Sapiens
cuaaugaaauuccuuuuauauauucucagcuuaucuaaacuagccuggaaaacuuuugug

SEQ ID NO: 252591 - RNA, 60 nt, Homo Sapiens
cuuaguuuccuggaauaauacauuuuuuucuuaucuaaauuuaaauuaggguugguauuu

SEQ ID NO: 252592 - RNA, 60 nt, Homo Sapiens
guccugaaauccacuugucaagagugugguuuaucuaaauccuaagaguacaaagccaag

SEQ ID NO: 252593 - RNA, 60 nt, Homo Sapiens
uauuugacuuaaaaauaucgaaaacuguuuuuaucuaagaaagacaagcugaaacaacac

SEQ ID NO: 252594 - RNA, 60 nt, Homo Sapiens
cauguuaguuuggugcuacacuguugucaauuaucuaaaguauucuucaaaauauguaag

SEQ ID NO: 252595 - RNA, 60 nt, Homo Sapiens
ucagacaucuaguggggcagggacucugaguuaucuaaugggagacuuguuggagaggcg

SEQ ID NO: 252596 - RNA, 60 nt, Homo Sapiens
gcuucugccugaaaugugcuuagagcucaguuaucuaaggauucucugacacuagugcau

SEQ ID NO: 252597 - RNA, 64 nt, Homo Sapiens; identical to SEQ ID NO: 190131

SEQ ID NO: 252598 - RNA, 64 nt, Homo Sapiens; identical to SEQ ID NO: 190132

SEQ ID NO: 252599 - RNA, 64 nt, Homo Sapiens; identical to SEQ ID NO: 190133

SEQ ID NO: 252600 - RNA, 64 nt, Homo Sapiens; identical to SEQ ID NO: 190134

SEQ ID NO: 252601 - RNA, 64 nt, Homo Sapiens; identical to SEQ ID NO: 190135

SEQ ID NO: 252602 - RNA, 64 nt, Homo Sapiens; identical to SEQ ID NO: 190136

SEQ ID NO: 252603 - RNA, 64 nt, Homo Sapiens; identical to SEQ ID NO: 190137

SEQ ID NO: 252604 - RNA, 64 nt, Homo Sapiens; identical to SEQ ID NO: 190138

SEQ ID NO: 252605 - RNA, 64 nt, Homo Sapiens; identical to SEQ ID NO: 190139

SEQ ID NO: 252606 - RNA, 64 nt, Homo Sapiens; identical to SEQ ID NO: 190140

SEQ ID NO: 252607 - RNA, 64 nt, Homo Sapiens; identical to SEQ ID NO: 190141

SEQ ID NO: 252608 - RNA, 64 nt, Homo Sapiens; identical to SEQ ID NO: 190142

SEQ ID NO: 252609 - RNA, 64 nt, Homo Sapiens; identical to SEQ ID NO: 190143

SEQ ID NO: 252610 - RNA, 64 nt, Homo Sapiens; identical to SEQ ID NO: 190144

SEQ ID NO: 252611 - RNA, 64 nt, Homo Sapiens; identical to SEQ ID NO: 190145

SEQ ID NO: 252612 - RNA, 64 nt, Homo Sapiens; identical to SEQ ID NO: 190146

SEQ ID NO: 252613 - RNA, 64 nt, Homo Sapiens; identical to SEQ ID NO: 190147

SEQ ID NO: 252614 - RNA, 64 nt, Homo Sapiens; identical to SEQ ID NO: 190148

SEQ ID NO: 252615 - RNA, 64 nt, Homo Sapiens; identical to SEQ ID NO: 190149

SEQ ID NO: 252616 - RNA, 64 nt, Homo Sapiens; identical to SEQ ID NO: 190150

SEQ ID NO: 252617 - RNA, 64 nt, Homo Sapiens; identical to SEQ ID NO: 190151

SEQ ID NO: 252618 - RNA, 64 nt, Homo Sapiens; identical to SEQ ID NO: 190152

SEQ ID NO: 252619 - RNA, 64 nt, Homo Sapiens; identical to SEQ ID NO: 190153

SEQ ID NO: 252620 - RNA, 64 nt, Homo Sapiens; identical to SEQ ID NO: 190154

SEQ ID NO: 252621 - RNA, 64 nt, Homo Sapiens; identical to SEQ ID NO: 190155

SEQ ID NO: 252622 - RNA, 64 nt, Homo Sapiens; identical to SEQ ID NO: 190156

SEQ ID NO: 252623 - RNA, 64 nt, Homo Sapiens; identical to SEQ ID NO: 190157

SEQ ID NO: 252624 - RNA, 64 nt, Homo Sapiens; identical to SEQ ID NO: 190158

SEQ ID NO: 252625 - RNA, 64 nt, Homo Sapiens; identical to SEQ ID NO: 190159

SEQ ID NO: 252626 - RNA, 64 nt, Homo Sapiens; identical to SEQ ID NO: 190160

SEQ ID NO: 252627 - RNA, 64 nt, Homo Sapiens; identical to SEQ ID NO: 190161

SEQ ID NO: 252628 - RNA, 64 nt, Homo Sapiens; identical to SEQ ID NO: 190162

SEQ ID NO: 252629 - RNA, 64 nt, Homo Sapiens; identical to SEQ ID NO: 190163

SEQ ID NO: 252630 - RNA, 64 nt, Homo Sapiens; identical to SEQ ID NO: 190164

SEQ ID NO: 252631 - RNA, 64 nt, Homo Sapiens; identical to SEQ ID NO: 190165

SEQ ID NO: 252632 - RNA, 64 nt, Homo Sapiens; identical to SEQ ID NO: 190166

SEQ ID NO: 252633 - RNA, 64 nt, Homo Sapiens; identical to SEQ ID NO: 190167

SEQ ID NO: 252634 - RNA, 64 nt, Homo Sapiens; identical to SEQ ID NO: 190168

SEQ ID NO: 252635 - RNA, 64 nt, Homo Sapiens; identical to SEQ ID NO: 190169

SEQ ID NO: 252636 - RNA, 64 nt, Homo Sapiens; identical to SEQ ID NO: 190170

SEQ ID NO: 252637 - RNA, 64 nt, Homo Sapiens; identical to SEQ ID NO: 190171

SEQ ID NO: 252638 - RNA, 64 nt, Homo Sapiens; identical to SEQ ID NO: 190172

SEQ ID NO: 252639 - RNA, 64 nt, Homo Sapiens; identical to SEQ ID NO: 190173

SEQ ID NO: 252640 - RNA, 64 nt, Homo Sapiens; identical to SEQ ID NO: 190174

SEQ ID NO: 252641 - RNA, 64 nt, Homo Sapiens; identical to SEQ ID NO: 190175

SEQ ID NO: 252642 - RNA, 64 nt, Homo Sapiens; identical to SEQ ID NO: 190176

SEQ ID NO: 252643 - RNA, 64 nt, Homo Sapiens; identical to SEQ ID NO: 190177

SEQ ID NO: 252644 - RNA, 64 nt, Homo Sapiens; identical to SEQ ID NO: 190178

SEQ ID NO: 252645 - RNA, 64 nt, Homo Sapiens; identical to SEQ ID NO: 190179

SEQ ID NO: 252646 - RNA, 64 nt, Homo Sapiens; identical to SEQ ID NO: 190180

SEQ ID NO: 252647 - RNA, 64 nt, Homo Sapiens; identical to SEQ ID NO: 190181

SEQ ID NO: 252648 - RNA, 64 nt, Homo Sapiens; identical to SEQ ID NO: 190182

SEQ ID NO: 252649 - RNA, 64 nt, Homo Sapiens; identical to SEQ ID NO: 190183

SEQ ID NO: 252650 - RNA, 64 nt, Homo Sapiens; identical to SEQ ID NO: 190184

SEQ ID NO: 252651 - RNA, 64 nt, Homo Sapiens; identical to SEQ ID NO: 190185

SEQ ID NO: 252652 - RNA, 64 nt, Homo Sapiens; identical to SEQ ID NO: 190186

SEQ ID NO: 252653 - RNA, 64 nt, Homo Sapiens; identical to SEQ ID NO: 190187

SEQ ID NO: 252654 - RNA, 64 nt, Homo Sapiens; identical to SEQ ID NO: 190188

SEQ ID NO: 252655 - RNA, 64 nt, Homo Sapiens; identical to SEQ ID NO: 190189

SEQ ID NO: 252656 - RNA, 64 nt, Homo Sapiens; identical to SEQ ID NO: 190190

SEQ ID NO: 252657 - RNA, 64 nt, Homo Sapiens; identical to SEQ ID NO: 190191

SEQ ID NO: 252658 - RNA, 64 nt, Homo Sapiens; identical to SEQ ID NO: 190192

SEQ ID NO: 252659 - RNA, 64 nt, Homo Sapiens; identical to SEQ ID NO: 190193

SEQ ID NO: 252660 - RNA, 64 nt, Homo Sapiens; identical to SEQ ID NO: 190194

SEQ ID NO: 252661 - RNA, 64 nt, Homo Sapiens; identical to SEQ ID NO: 190195

SEQ ID NO: 252662 - RNA, 64 nt, Homo Sapiens; identical to SEQ ID NO: 190196

SEQ ID NO: 252663 - RNA, 64 nt, Homo Sapiens; identical to SEQ ID NO: 190197

SEQ ID NO: 252664 - RNA, 64 nt, Homo Sapiens; identical to SEQ ID NO: 190198

SEQ ID NO: 252665 - RNA, 64 nt, Homo Sapiens; identical to SEQ ID NO: 190199

SEQ ID NO: 252666 - RNA, 64 nt, Homo Sapiens; identical to SEQ ID NO: 190200

SEQ ID NO: 252667 - RNA, 64 nt, Homo Sapiens; identical to SEQ ID NO: 190201

SEQ ID NO: 252668 - RNA, 64 nt, Homo Sapiens; identical to SEQ ID NO: 190202

SEQ ID NO: 252669 - RNA, 64 nt, Homo Sapiens; identical to SEQ ID NO: 190203

SEQ ID NO: 252670 - RNA, 64 nt, Homo Sapiens; identical to SEQ ID NO: 190204

SEQ ID NO: 252671 - RNA, 64 nt, Homo Sapiens; identical to SEQ ID NO: 190205

SEQ ID NO: 252672 - RNA, 64 nt, Homo Sapiens; identical to SEQ ID NO: 190206

SEQ ID NO: 252673 - RNA, 64 nt, Homo Sapiens; identical to SEQ ID NO: 190207

SEQ ID NO: 252674 - RNA, 64 nt, Homo Sapiens; identical to SEQ ID NO: 190208

SEQ ID NO: 252675 - RNA, 64 nt, Homo Sapiens; identical to SEQ ID NO: 190209

SEQ ID NO: 252676 - RNA, 64 nt, Homo Sapiens; identical to SEQ ID NO: 190210

SEQ ID NO: 252677 - RNA, 64 nt, Homo Sapiens; identical to SEQ ID NO: 190211

SEQ ID NO: 252678 - RNA, 64 nt, Homo Sapiens; identical to SEQ ID NO: 190212

SEQ ID NO: 252679 - RNA, 64 nt, Homo Sapiens; identical to SEQ ID NO: 190213

SEQ ID NO: 252680 - RNA, 64 nt, Homo Sapiens; identical to SEQ ID NO: 190214

SEQ ID NO: 252681 - RNA, 64 nt, Homo Sapiens; identical to SEQ ID NO: 190215

SEQ ID NO: 252682 - RNA, 64 nt, Homo Sapiens; identical to SEQ ID NO: 190216

SEQ ID NO: 252683 - RNA, 64 nt, Homo Sapiens; identical to SEQ ID NO: 190217

SEQ ID NO: 252684 - RNA, 64 nt, Homo Sapiens; identical to SEQ ID NO: 190218

SEQ ID NO: 252685 - RNA, 64 nt, Homo Sapiens; identical to SEQ ID NO: 190219

SEQ ID NO: 252686 - RNA, 64 nt, Homo Sapiens; identical to SEQ ID NO: 190220

SEQ ID NO: 252687 - RNA, 64 nt, Homo Sapiens; identical to SEQ ID NO: 190221

SEQ ID NO: 252688 - RNA, 64 nt, Homo Sapiens; identical to SEQ ID NO: 190222

SEQ ID NO: 252689 - RNA, 64 nt, Homo Sapiens; identical to SEQ ID NO: 190223

SEQ ID NO: 252690 - RNA, 64 nt, Homo Sapiens; identical to SEQ ID NO: 190224

SEQ ID NO: 252691 - RNA, 64 nt, Homo Sapiens; identical to SEQ ID NO: 190225

SEQ ID NO: 252692 - RNA, 64 nt, Homo Sapiens; identical to SEQ ID NO: 190226

SEQ ID NO: 252693 - RNA, 64 nt, Homo Sapiens; identical to SEQ ID NO: 190227

SEQ ID NO: 252694 - RNA, 64 nt, Homo Sapiens; identical to SEQ ID NO: 190228

SEQ ID NO: 252695 - RNA, 64 nt, Homo Sapiens; identical to SEQ ID NO: 190229

SEQ ID NO: 252696 - RNA, 64 nt, Homo Sapiens; identical to SEQ ID NO: 190230

SEQ ID NO: 252697 - RNA, 64 nt, Homo Sapiens; identical to SEQ ID NO: 190231

SEQ ID NO: 252698 - RNA, 64 nt, Homo Sapiens; identical to SEQ ID NO: 190232

SEQ ID NO: 252699 - RNA, 64 nt, Homo Sapiens; identical to SEQ ID NO: 190233

SEQ ID NO: 252700 - RNA, 54 nt, Homo Sapiens; identical to SEQ ID NO: 190234

SEQ ID NO: 252701 - RNA, 64 nt, Homo Sapiens; identical to SEQ ID NO: 190235

SEQ ID NO: 252702 - RNA, 64 nt, Homo Sapiens; identical to SEQ ID NO: 190236

SEQ ID NO: 252703 - RNA, 64 nt, Homo Sapiens; identical to SEQ ID NO: 190237

SEQ ID NO: 252704 - RNA, 64 nt, Homo Sapiens; identical to SEQ ID NO: 190238

SEQ ID NO: 252705 - RNA, 64 nt, Homo Sapiens; identical to SEQ ID NO: 190239

SEQ ID NO: 252706 - RNA, 64 nt, Homo Sapiens; identical to SEQ ID NO: 190240

SEQ ID NO: 252707 - RNA, 64 nt, Homo Sapiens; identical to SEQ ID NO: 190241

SEQ ID NO: 252708 - RNA, 64 nt, Homo Sapiens; identical to SEQ ID NO: 190242

SEQ ID NO: 252709 - RNA, 64 nt, Homo Sapiens; identical to SEQ ID NO: 190243

SEQ ID NO: 252710 - RNA, 64 nt, Homo Sapiens; identical to SEQ ID NO: 190244

SEQ ID NO: 252711 - RNA, 64 nt, Homo Sapiens; identical to SEQ ID NO: 190245

SEQ ID NO: 252712 - RNA, 64 nt, Homo Sapiens; identical to SEQ ID NO: 190246

SEQ ID NO: 252713 - RNA, 64 nt, Homo Sapiens; identical to SEQ ID NO: 190247

SEQ ID NO: 252714 - RNA, 64 nt, Homo Sapiens; identical to SEQ ID NO: 190248

SEQ ID NO: 252715 - RNA, 64 nt, Homo Sapiens; identical to SEQ ID NO: 190249

SEQ ID NO: 252716 - RNA, 64 nt, Homo Sapiens; identical to SEQ ID NO: 190250

SEQ ID NO: 252717 - RNA, 64 nt, Homo Sapiens; identical to SEQ ID NO: 190251

SEQ ID NO: 252718 - RNA, 64 nt, Homo Sapiens; identical to SEQ ID NO: 190252

SEQ ID NO: 252719 - RNA, 64 nt, Homo Sapiens; identical to SEQ ID NO: 190253

SEQ ID NO: 252720 - RNA, 64 nt, Homo Sapiens; identical to SEQ ID NO: 190254

SEQ ID NO: 252721 - RNA, 64 nt, Homo Sapiens; identical to SEQ ID NO: 190255

SEQ ID NO: 252722 - RNA, 64 nt, Homo Sapiens; identical to SEQ ID NO: 190256

SEQ ID NO: 252723 - RNA, 64 nt, Homo Sapiens; identical to SEQ ID NO: 190257

SEQ ID NO: 252724 - RNA, 64 nt, Homo Sapiens; identical to SEQ ID NO: 190258

SEQ ID NO: 252725 - RNA, 64 nt, Homo Sapiens; identical to SEQ ID NO: 190259

SEQ ID NO: 252726 - RNA, 64 nt, Homo Sapiens; identical to SEQ ID NO: 190260

SEQ ID NO: 252727 - RNA, 64 nt, Homo Sapiens; identical to SEQ ID NO: 190261

SEQ ID NO: 252728 - RNA, 64 nt, Homo Sapiens; identical to SEQ ID NO: 190262

SEQ ID NO: 252729 - RNA, 64 nt, Homo Sapiens; identical to SEQ ID NO: 190263

SEQ ID NO: 252730 - RNA, 64 nt, Homo Sapiens; identical to SEQ ID NO: 190264

SEQ ID NO: 252731 - RNA, 64 nt, Homo Sapiens; identical to SEQ ID NO: 190265

SEQ ID NO: 252732 - RNA, 64 nt, Homo Sapiens; identical to SEQ ID NO: 190266

SEQ ID NO: 252733 - RNA, 64 nt, Homo Sapiens; identical to SEQ ID NO: 190267

SEQ ID NO: 252734 - RNA, 64 nt, Homo Sapiens; identical to SEQ ID NO: 190268

SEQ ID NO: 252735 - RNA, 64 nt, Homo Sapiens; identical to SEQ ID NO: 190269

SEQ ID NO: 252736 - RNA, 64 nt, Homo Sapiens; identical to SEQ ID NO: 190270

SEQ ID NO: 252737 - RNA, 61 nt, Homo Sapiens; identical to SEQ ID NO: 190271

SEQ ID NO: 252738 - RNA, 64 nt, Homo Sapiens; identical to SEQ ID NO: 190272

SEQ ID NO: 252739 - RNA, 64 nt, Homo Sapiens; identical to SEQ ID NO: 190273

SEQ ID NO: 252740 - RNA, 63 nt, Homo Sapiens; identical to SEQ ID NO: 190274

SEQ ID NO: 252741 - RNA, 64 nt, Homo Sapiens; identical to SEQ ID NO: 190275

SEQ ID NO: 252742 - RNA, 64 nt, Homo Sapiens; identical to SEQ ID NO: 190276

SEQ ID NO: 252743 - RNA, 64 nt, Homo Sapiens; identical to SEQ ID NO: 190277

SEQ ID NO: 252744 - RNA, 64 nt, Homo Sapiens; identical to SEQ ID NO: 190278

SEQ ID NO: 252745 - RNA, 64 nt, Homo Sapiens; identical to SEQ ID NO: 190279

SEQ ID NO: 252746 - RNA, 64 nt, Homo Sapiens; identical to SEQ ID NO: 190280

SEQ ID NO: 252747 - RNA, 64 nt, Homo Sapiens; identical to SEQ ID NO: 190281

SEQ ID NO: 252748 - RNA, 64 nt, Homo Sapiens; identical to SEQ ID NO: 190282

SEQ ID NO: 252749 - RNA, 64 nt, Homo Sapiens; identical to SEQ ID NO: 190283

SEQ ID NO: 252750 - RNA, 64 nt, Homo Sapiens; identical to SEQ ID NO: 190284

SEQ ID NO: 252751 - RNA, 64 nt, Homo Sapiens; identical to SEQ ID NO: 190285

SEQ ID NO: 252752 - RNA, 64 nt, Homo Sapiens; identical to SEQ ID NO: 190286

SEQ ID NO: 252753 - RNA, 64 nt, Homo Sapiens; identical to SEQ ID NO: 190287

SEQ ID NO: 252754 - RNA, 64 nt, Homo Sapiens; identical to SEQ ID NO: 190288

SEQ ID NO: 252755 - RNA, 64 nt, Homo Sapiens; identical to SEQ ID NO: 190289

SEQ ID NO: 252756 - RNA, 64 nt, Homo Sapiens; identical to SEQ ID NO: 190290

SEQ ID NO: 252757 - RNA, 64 nt, Homo Sapiens; identical to SEQ ID NO: 190291

SEQ ID NO: 252758 - RNA, 64 nt, Homo Sapiens; identical to SEQ ID NO: 190292

SEQ ID NO: 252759 - RNA, 64 nt, Homo Sapiens; identical to SEQ ID NO: 190293

SEQ ID NO: 252760 - RNA, 64 nt, Homo Sapiens; identical to SEQ ID NO: 190294

SEQ ID NO: 252761 - RNA, 64 nt, Homo Sapiens; identical to SEQ ID NO: 190295

SEQ ID NO: 252762 - RNA, 64 nt, Homo Sapiens; identical to SEQ ID NO: 190296

SEQ ID NO: 252763 - RNA, 64 nt, Homo Sapiens; identical to SEQ ID NO: 190297

SEQ ID NO: 252764 - RNA, 64 nt, Homo Sapiens; identical to SEQ ID NO: 190298

SEQ ID NO: 252765 - RNA, 64 nt, Homo Sapiens; identical to SEQ ID NO: 190299

SEQ ID NO: 252766 - RNA, 64 nt, Homo Sapiens; identical to SEQ ID NO: 190300

SEQ ID NO: 252767 - RNA, 64 nt, Homo Sapiens; identical to SEQ ID NO: 190301

SEQ ID NO: 252768 - RNA, 64 nt, Homo Sapiens; identical to SEQ ID NO: 190302

SEQ ID NO: 252769 - RNA, 64 nt, Homo Sapiens; identical to SEQ ID NO: 190303

SEQ ID NO: 252770 - RNA, 64 nt, Homo Sapiens; identical to SEQ ID NO: 190304

SEQ ID NO: 252771 - RNA, 64 nt, Homo Sapiens; identical to SEQ ID NO: 190305

SEQ ID NO: 252772 - RNA, 64 nt, Homo Sapiens; identical to SEQ ID NO: 190306

SEQ ID NO: 252773 - RNA, 64 nt, Homo Sapiens; identical to SEQ ID NO: 190307

SEQ ID NO: 252774 - RNA, 64 nt, Homo Sapiens; identical to SEQ ID NO: 190308

SEQ ID NO: 252775 - RNA, 64 nt, Homo Sapiens; identical to SEQ ID NO: 190309

SEQ ID NO: 252776 - RNA, 64 nt, Homo Sapiens; identical to SEQ ID NO: 190310

SEQ ID NO: 252777 - RNA, 64 nt, Homo Sapiens; identical to SEQ ID NO: 190311

SEQ ID NO: 252778 - RNA, 64 nt, Homo Sapiens; identical to SEQ ID NO: 190312

SEQ ID NO: 252779 - RNA, 64 nt, Homo Sapiens; identical to SEQ ID NO: 190313

SEQ ID NO: 252780 - RNA, 64 nt, Homo Sapiens; identical to SEQ ID NO: 190314

SEQ ID NO: 252781 - RNA, 64 nt, Homo Sapiens; identical to SEQ ID NO: 190315

SEQ ID NO: 252782 - RNA, 64 nt, Homo Sapiens; identical to SEQ ID NO: 190316

SEQ ID NO: 252783 - RNA, 64 nt, Homo Sapiens; identical to SEQ ID NO: 190317

SEQ ID NO: 252784 - RNA, 64 nt, Homo Sapiens; identical to SEQ ID NO: 190318

SEQ ID NO: 252785 - RNA, 64 nt, Homo Sapiens; identical to SEQ ID NO: 190319

SEQ ID NO: 252786 - RNA, 64 nt, Homo Sapiens; identical to SEQ ID NO: 190320

SEQ ID NO: 252787 - RNA, 64 nt, Homo Sapiens; identical to SEQ ID NO: 190321

SEQ ID NO: 252788 - RNA, 64 nt, Homo Sapiens; identical to SEQ ID NO: 190322

SEQ ID NO: 252789 - RNA, 64 nt, Homo Sapiens; identical to SEQ ID NO: 190323

SEQ ID NO: 252790 - RNA, 64 nt, Homo Sapiens; identical to SEQ ID NO: 190324

SEQ ID NO: 252791 - RNA, 64 nt, Homo Sapiens; identical to SEQ ID NO: 190325

SEQ ID NO: 252792 - RNA, 64 nt, Homo Sapiens; identical to SEQ ID NO: 190326

SEQ ID NO: 252793 - RNA, 64 nt, Homo Sapiens; identical to SEQ ID NO: 190327

SEQ ID NO: 252794 - RNA, 64 nt, Homo Sapiens; identical to SEQ ID NO: 190328

SEQ ID NO: 252795 - RNA, 64 nt, Homo Sapiens; identical to SEQ ID NO: 190329

SEQ ID NO: 252796 - RNA, 64 nt, Homo Sapiens; identical to SEQ ID NO: 190330

SEQ ID NO: 252797 - RNA, 64 nt, Homo Sapiens; identical to SEQ ID NO: 190331

SEQ ID NO: 252798 - RNA, 64 nt, Homo Sapiens; identical to SEQ ID NO: 190332

SEQ ID NO: 252799 - RNA, 64 nt, Homo Sapiens; identical to SEQ ID NO: 190333

SEQ ID NO: 252800 - RNA, 64 nt, Homo Sapiens; identical to SEQ ID NO: 190334

SEQ ID NO: 252801 - RNA, 64 nt, Homo Sapiens; identical to SEQ ID NO: 190335

SEQ ID NO: 252802 - RNA, 64 nt, Homo Sapiens; identical to SEQ ID NO: 190336

SEQ ID NO: 252803 - RNA, 64 nt, Homo Sapiens; identical to SEQ ID NO: 190337

SEQ ID NO: 252804 - RNA, 64 nt, Homo Sapiens; identical to SEQ ID NO: 190338

SEQ ID NO: 252805 - RNA, 64 nt, Homo Sapiens; identical to SEQ ID NO: 190339

SEQ ID NO: 252806 - RNA, 61 nt, Homo Sapiens; identical to SEQ ID NO: 190340

SEQ ID NO: 252807 - RNA, 64 nt, Homo Sapiens; identical to SEQ ID NO: 190341

SEQ ID NO: 252808 - RNA, 64 nt, Homo Sapiens; identical to SEQ ID NO: 190342

SEQ ID NO: 252809 - RNA, 64 nt, Homo Sapiens; identical to SEQ ID NO: 190343

SEQ ID NO: 252810 - RNA, 64 nt, Homo Sapiens; identical to SEQ ID NO: 190344

SEQ ID NO: 252811 - RNA, 64 nt, Homo Sapiens; identical to SEQ ID NO: 190345

SEQ ID NO: 252812 - RNA, 64 nt, Homo Sapiens; identical to SEQ ID NO: 190346

SEQ ID NO: 252813 - RNA, 64 nt, Homo Sapiens; identical to SEQ ID NO: 190347

SEQ ID NO: 252814 - RNA, 64 nt, Homo Sapiens; identical to SEQ ID NO: 190348

SEQ ID NO: 252815 - RNA, 64 nt, Homo Sapiens; identical to SEQ ID NO: 190349

SEQ ID NO: 252816 - RNA, 64 nt, Homo Sapiens; identical to SEQ ID NO: 190350

SEQ ID NO: 252817 - RNA, 64 nt, Homo Sapiens; identical to SEQ ID NO: 190351

SEQ ID NO: 252818 - RNA, 64 nt, Homo Sapiens; identical to SEQ ID NO: 190352

SEQ ID NO: 252819 - RNA, 64 nt, Homo Sapiens; identical to SEQ ID NO: 190353

SEQ ID NO: 252820 - RNA, 64 nt, Homo Sapiens; identical to SEQ ID NO: 190354

SEQ ID NO: 252821 - RNA, 64 nt, Homo Sapiens; identical to SEQ ID NO: 190355

SEQ ID NO: 252822 - RNA, 64 nt, Homo Sapiens; identical to SEQ ID NO: 190356

SEQ ID NO: 252823 - RNA, 64 nt, Homo Sapiens; identical to SEQ ID NO: 190357

SEQ ID NO: 252824 - RNA, 64 nt, Homo Sapiens; identical to SEQ ID NO: 190358

SEQ ID NO: 252825 - RNA, 64 nt, Homo Sapiens; identical to SEQ ID NO: 190359

SEQ ID NO: 252826 - RNA, 64 nt, Homo Sapiens; identical to SEQ ID NO: 190360

SEQ ID NO: 252827 - RNA, 64 nt, Homo Sapiens; identical to SEQ ID NO: 190361

SEQ ID NO: 252828 - RNA, 64 nt, Homo Sapiens; identical to SEQ ID NO: 190362

SEQ ID NO: 252829 - RNA, 64 nt, Homo Sapiens; identical to SEQ ID NO: 190363

SEQ ID NO: 252830 - RNA, 64 nt, Homo Sapiens; identical to SEQ ID NO: 190364

SEQ ID NO: 252831 - RNA, 64 nt, Homo Sapiens; identical to SEQ ID NO: 190365

SEQ ID NO: 252832 - RNA, 64 nt, Homo Sapiens; identical to SEQ ID NO: 190366

SEQ ID NO: 252833 - RNA, 63 nt, Homo Sapiens; identical to SEQ ID NO: 190367

SEQ ID NO: 252834 - RNA, 64 nt, Homo Sapiens; identical to SEQ ID NO: 190368

SEQ ID NO: 252835 - RNA, 64 nt, Homo Sapiens; identical to SEQ ID NO: 190369

SEQ ID NO: 252836 - RNA, 64 nt, Homo Sapiens; identical to SEQ ID NO: 190370

SEQ ID NO: 252837 - RNA, 64 nt, Homo Sapiens; identical to SEQ ID NO: 190371

SEQ ID NO: 252838 - RNA, 64 nt, Homo Sapiens; identical to SEQ ID NO: 190372

SEQ ID NO: 252839 - RNA, 64 nt, Homo Sapiens; identical to SEQ ID NO: 190373

SEQ ID NO: 252840 - RNA, 64 nt, Homo Sapiens; identical to SEQ ID NO: 190374

SEQ ID NO: 252841 - RNA, 64 nt, Homo Sapiens; identical to SEQ ID NO: 190375

SEQ ID NO: 252842 - RNA, 64 nt, Homo Sapiens; identical to SEQ ID NO: 190376

SEQ ID NO: 252843 - RNA, 58 nt, Homo Sapiens; identical to SEQ ID NO: 190377

SEQ ID NO: 252844 - RNA, 64 nt, Homo Sapiens; identical to SEQ ID NO: 190378

SEQ ID NO: 252845 - RNA, 64 nt, Homo Sapiens; identical to SEQ ID NO: 190379

SEQ ID NO: 252846 - RNA, 64 nt, Homo Sapiens; identical to SEQ ID NO: 190380

SEQ ID NO: 252847 - RNA, 64 nt, Homo Sapiens; identical to SEQ ID NO: 190381

SEQ ID NO: 252848 - RNA, 64 nt, Homo Sapiens; identical to SEQ ID NO: 190382

SEQ ID NO: 252849 - RNA, 64 nt, Homo Sapiens; identical to SEQ ID NO: 190383

SEQ ID NO: 252850 - RNA, 64 nt, Homo Sapiens; identical to SEQ ID NO: 190384

SEQ ID NO: 252851 - RNA, 64 nt, Homo Sapiens; identical to SEQ ID NO: 190385

SEQ ID NO: 252852 - RNA, 64 nt, Homo Sapiens; identical to SEQ ID NO: 190386

SEQ ID NO: 252853 - RNA, 64 nt, Homo Sapiens; identical to SEQ ID NO: 190387

SEQ ID NO: 252854 - RNA, 64 nt, Homo Sapiens; identical to SEQ ID NO: 190388

SEQ ID NO: 252855 - RNA, 64 nt, Homo Sapiens; identical to SEQ ID NO: 190389

SEQ ID NO: 252856 - RNA, 64 nt, Homo Sapiens; identical to SEQ ID NO: 190390

SEQ ID NO: 252857 - RNA, 64 nt, Homo Sapiens; identical to SEQ ID NO: 190391

SEQ ID NO: 252858 - RNA, 64 nt, Homo Sapiens; identical to SEQ ID NO: 190392

SEQ ID NO: 252859 - RNA, 64 nt, Homo Sapiens; identical to SEQ ID NO: 190393

SEQ ID NO: 252860 - RNA, 64 nt, Homo Sapiens; identical to SEQ ID NO: 190394

SEQ ID NO: 252861 - RNA, 64 nt, Homo Sapiens; identical to SEQ ID NO: 190395

SEQ ID NO: 252862 - RNA, 64 nt, Homo Sapiens; identical to SEQ ID NO: 190396

SEQ ID NO: 252863 - RNA, 64 nt, Homo Sapiens; identical to SEQ ID NO: 190397

SEQ ID NO: 252864 - RNA, 64 nt, Homo Sapiens; identical to SEQ ID NO: 190398

SEQ ID NO: 252865 - RNA, 64 nt, Homo Sapiens; identical to SEQ ID NO: 190399

SEQ ID NO: 252866 - RNA, 67 nt, Homo Sapiens; identical to SEQ ID NO: 190400

SEQ ID NO: 252867 - RNA, 67 nt, Homo Sapiens; identical to SEQ ID NO: 190401

SEQ ID NO: 252868 - RNA, 67 nt, Homo Sapiens; identical to SEQ ID NO: 190402

SEQ ID NO: 252869 - RNA, 67 nt, Homo Sapiens; identical to SEQ ID NO: 190403

SEQ ID NO: 252870 - RNA, 67 nt, Homo Sapiens; identical to SEQ ID NO: 190404

SEQ ID NO: 252871 - RNA, 67 nt, Homo Sapiens; identical to SEQ ID NO: 190405

SEQ ID NO: 252872 - RNA, 67 nt, Homo Sapiens; identical to SEQ ID NO: 190406

SEQ ID NO: 252873 - RNA, 67 nt, Homo Sapiens; identical to SEQ ID NO: 190407

SEQ ID NO: 252874 - RNA, 67 nt, Homo Sapiens; identical to SEQ ID NO: 190408

SEQ ID NO: 252875 - RNA, 67 nt, Homo Sapiens; identical to SEQ ID NO: 190409

SEQ ID NO: 252876 - RNA, 67 nt, Homo Sapiens; identical to SEQ ID NO: 190410

SEQ ID NO: 252877 - RNA, 67 nt, Homo Sapiens; identical to SEQ ID NO: 190411

SEQ ID NO: 252878 - RNA, 67 nt, Homo Sapiens; identical to SEQ ID NO: 190412

SEQ ID NO: 252879 - RNA, 67 nt, Homo Sapiens; identical to SEQ ID NO: 190413

SEQ ID NO: 252880 - RNA, 67 nt, Homo Sapiens; identical to SEQ ID NO: 190414

SEQ ID NO: 252881 - RNA, 67 nt, Homo Sapiens; identical to SEQ ID NO: 190415

SEQ ID NO: 252882 - RNA, 67 nt, Homo Sapiens; identical to SEQ ID NO: 190416

SEQ ID NO: 252883 - RNA, 67 nt, Homo Sapiens; identical to SEQ ID NO: 190417

SEQ ID NO: 252884 - RNA, 67 nt, Homo Sapiens; identical to SEQ ID NO: 190418

SEQ ID NO: 252885 - RNA, 67 nt, Homo Sapiens; identical to SEQ ID NO: 190419

SEQ ID NO: 252886 - RNA, 67 nt, Homo Sapiens; identical to SEQ ID NO: 190420

SEQ ID NO: 252887 - RNA, 67 nt, Homo Sapiens; identical to SEQ ID NO: 190421

SEQ ID NO: 252888 - RNA, 67 nt, Homo Sapiens; identical to SEQ ID NO: 190422

SEQ ID NO: 252889 - RNA, 67 nt, Homo Sapiens; identical to SEQ ID NO: 190423

SEQ ID NO: 252890 - RNA, 67 nt, Homo Sapiens; identical to SEQ ID NO: 190424

SEQ ID NO: 252891 - RNA, 67 nt, Homo Sapiens; identical to SEQ ID NO: 190425

SEQ ID NO: 252892 - RNA, 67 nt, Homo Sapiens; identical to SEQ ID NO: 190426

SEQ ID NO: 252893 - RNA, 67 nt, Homo Sapiens; identical to SEQ ID NO: 190427

SEQ ID NO: 252894 - RNA, 67 nt, Homo Sapiens; identical to SEQ ID NO: 190428

SEQ ID NO: 252895 - RNA, 67 nt, Homo Sapiens; identical to SEQ ID NO: 190429

SEQ ID NO: 252896 - RNA, 67 nt, Homo Sapiens; identical to SEQ ID NO: 190430

SEQ ID NO: 252897 - RNA, 67 nt, Homo Sapiens; identical to SEQ ID NO: 190431

SEQ ID NO: 252898 - RNA, 67 nt, Homo Sapiens; identical to SEQ ID NO: 190432

SEQ ID NO: 252899 - RNA, 67 nt, Homo Sapiens; identical to SEQ ID NO: 190433

SEQ ID NO: 252900 - RNA, 67 nt, Homo Sapiens; identical to SEQ ID NO: 190434

SEQ ID NO: 252901 - RNA, 67 nt, Homo Sapiens; identical to SEQ ID NO: 190435

SEQ ID NO: 252902 - RNA, 67 nt, Homo Sapiens; identical to SEQ ID NO: 190436

SEQ ID NO: 252903 - RNA, 67 nt, Homo Sapiens; identical to SEQ ID NO: 190437

SEQ ID NO: 252904 - RNA, 67 nt, Homo Sapiens; identical to SEQ ID NO: 190438

SEQ ID NO: 252905 - RNA, 67 nt, Homo Sapiens; identical to SEQ ID NO: 190439

SEQ ID NO: 252906 - RNA, 67 nt, Homo Sapiens; identical to SEQ ID NO: 190440

SEQ ID NO: 252907 - RNA, 67 nt, Homo Sapiens; identical to SEQ ID NO: 190441

SEQ ID NO: 252908 - RNA, 67 nt, Homo Sapiens; identical to SEQ ID NO: 190442

SEQ ID NO: 252909 - RNA, 67 nt, Homo Sapiens; identical to SEQ ID NO: 190443

SEQ ID NO: 252910 - RNA, 67 nt, Homo Sapiens; identical to SEQ ID NO: 190444

SEQ ID NO: 252911 - RNA, 67 nt, Homo Sapiens; identical to SEQ ID NO: 190445

SEQ ID NO: 252912 - RNA, 67 nt, Homo Sapiens; identical to SEQ ID NO: 190446

SEQ ID NO: 252913 - RNA, 67 nt, Homo Sapiens; identical to SEQ ID NO: 190447

SEQ ID NO: 252914 - RNA, 67 nt, Homo Sapiens; identical to SEQ ID NO: 190448

SEQ ID NO: 252915 - RNA, 67 nt, Homo Sapiens; identical to SEQ ID NO: 190449

SEQ ID NO: 252916 - RNA, 67 nt, Homo Sapiens; identical to SEQ ID NO: 190450

SEQ ID NO: 252917 - RNA, 67 nt, Homo Sapiens; identical to SEQ ID NO: 190451

SEQ ID NO: 252918 - RNA, 67 nt, Homo Sapiens; identical to SEQ ID NO: 190452

SEQ ID NO: 252919 - RNA, 67 nt, Homo Sapiens; identical to SEQ ID NO: 190453

SEQ ID NO: 252920 - RNA, 67 nt, Homo Sapiens; identical to SEQ ID NO: 190454

SEQ ID NO: 252921 - RNA, 67 nt, Homo Sapiens; identical to SEQ ID NO: 190455

SEQ ID NO: 252922 - RNA, 67 nt, Homo Sapiens; identical to SEQ ID NO: 190456

SEQ ID NO: 252923 - RNA, 67 nt, Homo Sapiens; identical to SEQ ID NO: 190457

SEQ ID NO: 252924 - RNA, 67 nt, Homo Sapiens; identical to SEQ ID NO: 190458

SEQ ID NO: 252925 - RNA, 67 nt, Homo Sapiens; identical to SEQ ID NO: 190459

SEQ ID NO: 252926 - RNA, 67 nt, Homo Sapiens; identical to SEQ ID NO: 190460

SEQ ID NO: 252927 - RNA, 67 nt, Homo Sapiens; identical to SEQ ID NO: 190461

SEQ ID NO: 252928 - RNA, 67 nt, Homo Sapiens; identical to SEQ ID NO: 190462

SEQ ID NO: 252929 - RNA, 67 nt, Homo Sapiens; identical to SEQ ID NO: 190463

SEQ ID NO: 252930 - RNA, 67 nt, Homo Sapiens; identical to SEQ ID NO: 190464

SEQ ID NO: 252931 - RNA, 67 nt, Homo Sapiens; identical to SEQ ID NO: 190465

SEQ ID NO: 252932 - RNA, 67 nt, Homo Sapiens; identical to SEQ ID NO: 190466

SEQ ID NO: 252933 - RNA, 67 nt, Homo Sapiens; identical to SEQ ID NO: 190467

SEQ ID NO: 252934 - RNA, 67 nt, Homo Sapiens; identical to SEQ ID NO: 190468

SEQ ID NO: 252935 - RNA, 67 nt, Homo Sapiens; identical to SEQ ID NO: 190469

SEQ ID NO: 252936 - RNA, 67 nt, Homo Sapiens; identical to SEQ ID NO: 190470

SEQ ID NO: 252937 - RNA, 67 nt, Homo Sapiens; identical to SEQ ID NO: 190471

SEQ ID NO: 252938 - RNA, 67 nt, Homo Sapiens; identical to SEQ ID NO: 190472

SEQ ID NO: 252939 - RNA, 67 nt, Homo Sapiens; identical to SEQ ID NO: 190473

SEQ ID NO: 252940 - RNA, 67 nt, Homo Sapiens; identical to SEQ ID NO: 190474

SEQ ID NO: 252941 - RNA, 67 nt, Homo Sapiens; identical to SEQ ID NO: 190475

SEQ ID NO: 252942 - RNA, 67 nt, Homo Sapiens; identical to SEQ ID NO: 190476

SEQ ID NO: 252943 - RNA, 67 nt, Homo Sapiens; identical to SEQ ID NO: 190477

SEQ ID NO: 252944 - RNA, 67 nt, Homo Sapiens; identical to SEQ ID NO: 190478

SEQ ID NO: 252945 - RNA, 67 nt, Homo Sapiens; identical to SEQ ID NO: 190479

SEQ ID NO: 252946 - RNA, 67 nt, Homo Sapiens; identical to SEQ ID NO: 190480

SEQ ID NO: 252947 - RNA, 67 nt, Homo Sapiens; identical to SEQ ID NO: 190481

SEQ ID NO: 252948 - RNA, 67 nt, Homo Sapiens; identical to SEQ ID NO: 190482

SEQ ID NO: 252949 - RNA, 67 nt, Homo Sapiens; identical to SEQ ID NO: 190483

SEQ ID NO: 252950 - RNA, 67 nt, Homo Sapiens; identical to SEQ ID NO: 190484

SEQ ID NO: 252951 - RNA, 67 nt, Homo Sapiens; identical to SEQ ID NO: 190485

SEQ ID NO: 252952 - RNA, 67 nt, Homo Sapiens; identical to SEQ ID NO: 190486

SEQ ID NO: 252953 - RNA, 67 nt, Homo Sapiens; identical to SEQ ID NO: 190487

SEQ ID NO: 252954 - RNA, 67 nt, Homo Sapiens; identical to SEQ ID NO: 190488

SEQ ID NO: 252955 - RNA, 67 nt, Homo Sapiens; identical to SEQ ID NO: 190489

SEQ ID NO: 252956 - RNA, 67 nt, Homo Sapiens; identical to SEQ ID NO: 190490

SEQ ID NO: 252957 - RNA, 67 nt, Homo Sapiens; identical to SEQ ID NO: 190491

SEQ ID NO: 252958 - RNA, 67 nt, Homo Sapiens; identical to SEQ ID NO: 190492

SEQ ID NO: 252959 - RNA, 67 nt, Homo Sapiens; identical to SEQ ID NO: 190493

SEQ ID NO: 252960 - RNA, 67 nt, Homo Sapiens; identical to SEQ ID NO: 190494

SEQ ID NO: 252961 - RNA, 67 nt, Homo Sapiens; identical to SEQ ID NO: 190495

SEQ ID NO: 252962 - RNA, 67 nt, Homo Sapiens; identical to SEQ ID NO: 190496

SEQ ID NO: 252963 - RNA, 67 nt, Homo Sapiens; identical to SEQ ID NO: 190497

SEQ ID NO: 252964 - RNA, 67 nt, Homo Sapiens; identical to SEQ ID NO: 190498

SEQ ID NO: 252965 - RNA, 67 nt, Homo Sapiens; identical to SEQ ID NO: 190499

SEQ ID NO: 252966 - RNA, 67 nt, Homo Sapiens; identical to SEQ ID NO: 190500

SEQ ID NO: 252967 - RNA, 67 nt, Homo Sapiens; identical to SEQ ID NO: 190501

SEQ ID NO: 252968 - RNA, 67 nt, Homo Sapiens; identical to SEQ ID NO: 190502

SEQ ID NO: 252969 - RNA, 54 nt, Homo Sapiens; identical to SEQ ID NO: 190234

SEQ ID NO: 252970 - RNA, 67 nt, Homo Sapiens; identical to SEQ ID NO: 190504

SEQ ID NO: 252971 - RNA, 67 nt, Homo Sapiens; identical to SEQ ID NO: 190505

SEQ ID NO: 252972 - RNA, 67 nt, Homo Sapiens; identical to SEQ ID NO: 190506

SEQ ID NO: 252973 - RNA, 67 nt, Homo Sapiens; identical to SEQ ID NO: 190507

SEQ ID NO: 252974 - RNA, 67 nt, Homo Sapiens; identical to SEQ ID NO: 190508

SEQ ID NO: 252975 - RNA, 67 nt, Homo Sapiens; identical to SEQ ID NO: 190509

SEQ ID NO: 252976 - RNA, 67 nt, Homo Sapiens; identical to SEQ ID NO: 190510

SEQ ID NO: 252977 - RNA, 67 nt, Homo Sapiens; identical to SEQ ID NO: 190511

SEQ ID NO: 252978 - RNA, 67 nt, Homo Sapiens; identical to SEQ ID NO: 190512

SEQ ID NO: 252979 - RNA, 67 nt, Homo Sapiens; identical to SEQ ID NO: 190513

SEQ ID NO: 252980 - RNA, 67 nt, Homo Sapiens; identical to SEQ ID NO: 190514

SEQ ID NO: 252981 - RNA, 67 nt, Homo Sapiens; identical to SEQ ID NO: 190515

SEQ ID NO: 252982 - RNA, 67 nt, Homo Sapiens; identical to SEQ ID NO: 190516

SEQ ID NO: 252983 - RNA, 67 nt, Homo Sapiens; identical to SEQ ID NO: 190517

SEQ ID NO: 252984 - RNA, 67 nt, Homo Sapiens; identical to SEQ ID NO: 190518

SEQ ID NO: 252985 - RNA, 67 nt, Homo Sapiens; identical to SEQ ID NO: 190519

SEQ ID NO: 252986 - RNA, 67 nt, Homo Sapiens; identical to SEQ ID NO: 190520

SEQ ID NO: 252987 - RNA, 67 nt, Homo Sapiens; identical to SEQ ID NO: 190521

SEQ ID NO: 252988 - RNA, 67 nt, Homo Sapiens; identical to SEQ ID NO: 190522

SEQ ID NO: 252989 - RNA, 67 nt, Homo Sapiens; identical to SEQ ID NO: 190523

SEQ ID NO: 252990 - RNA, 67 nt, Homo Sapiens; identical to SEQ ID NO: 190524

SEQ ID NO: 252991 - RNA, 67 nt, Homo Sapiens; identical to SEQ ID NO: 190525

SEQ ID NO: 252992 - RNA, 67 nt, Homo Sapiens; identical to SEQ ID NO: 190526

SEQ ID NO: 252993 - RNA, 67 nt, Homo Sapiens; identical to SEQ ID NO: 190527

SEQ ID NO: 252994 - RNA, 67 nt, Homo Sapiens; identical to SEQ ID NO: 190528

SEQ ID NO: 252995 - RNA, 67 nt, Homo Sapiens; identical to SEQ ID NO: 190529

SEQ ID NO: 252996 - RNA, 67 nt, Homo Sapiens; identical to SEQ ID NO: 190530

SEQ ID NO: 252997 - RNA, 67 nt, Homo Sapiens; identical to SEQ ID NO: 190531

SEQ ID NO: 252998 - RNA, 67 nt, Homo Sapiens; identical to SEQ ID NO: 190532

SEQ ID NO: 252999 - RNA, 67 nt, Homo Sapiens; identical to SEQ ID NO: 190533

SEQ ID NO: 253000 - RNA, 67 nt, Homo Sapiens; identical to SEQ ID NO: 190534

SEQ ID NO: 253001 - RNA, 67 nt, Homo Sapiens; identical to SEQ ID NO: 190535

SEQ ID NO: 253002 - RNA, 67 nt, Homo Sapiens; identical to SEQ ID NO: 190536

SEQ ID NO: 253003 - RNA, 67 nt, Homo Sapiens; identical to SEQ ID NO: 190537

SEQ ID NO: 253004 - RNA, 67 nt, Homo Sapiens; identical to SEQ ID NO: 190538

SEQ ID NO: 253005 - RNA, 67 nt, Homo Sapiens; identical to SEQ ID NO: 190539

SEQ ID NO: 253006 - RNA, 61 nt, Homo Sapiens; identical to SEQ ID NO: 190271

SEQ ID NO: 253007 - RNA, 67 nt, Homo Sapiens; identical to SEQ ID NO: 190541

SEQ ID NO: 253008 - RNA, 67 nt, Homo Sapiens; identical to SEQ ID NO: 190542

SEQ ID NO: 253009 - RNA, 66 nt, Homo Sapiens; identical to SEQ ID NO: 190543

SEQ ID NO: 253010 - RNA, 67 nt, Homo Sapiens; identical to SEQ ID NO: 190544

SEQ ID NO: 253011 - RNA, 67 nt, Homo Sapiens; identical to SEQ ID NO: 190545

SEQ ID NO: 253012 - RNA, 67 nt, Homo Sapiens; identical to SEQ ID NO: 190546

SEQ ID NO: 253013 - RNA, 67 nt, Homo Sapiens; identical to SEQ ID NO: 190547

SEQ ID NO: 253014 - RNA, 67 nt, Homo Sapiens; identical to SEQ ID NO: 190548

SEQ ID NO: 253015 - RNA, 67 nt, Homo Sapiens; identical to SEQ ID NO: 190549

SEQ ID NO: 253016 - RNA, 67 nt, Homo Sapiens; identical to SEQ ID NO: 190550

SEQ ID NO: 253017 - RNA, 67 nt, Homo Sapiens; identical to SEQ ID NO: 190551

SEQ ID NO: 253018 - RNA, 67 nt, Homo Sapiens; identical to SEQ ID NO: 190552

SEQ ID NO: 253019 - RNA, 67 nt, Homo Sapiens; identical to SEQ ID NO: 190553

SEQ ID NO: 253020 - RNA, 67 nt, Homo Sapiens; identical to SEQ ID NO: 190554

SEQ ID NO: 253021 - RNA, 67 nt, Homo Sapiens; identical to SEQ ID NO: 190555

SEQ ID NO: 253022 - RNA, 67 nt, Homo Sapiens; identical to SEQ ID NO: 190556

SEQ ID NO: 253023 - RNA, 67 nt, Homo Sapiens; identical to SEQ ID NO: 190557

SEQ ID NO: 253024 - RNA, 67 nt, Homo Sapiens; identical to SEQ ID NO: 190558

SEQ ID NO: 253025 - RNA, 67 nt, Homo Sapiens; identical to SEQ ID NO: 190559

SEQ ID NO: 253026 - RNA, 67 nt, Homo Sapiens; identical to SEQ ID NO: 190560

SEQ ID NO: 253027 - RNA, 67 nt, Homo Sapiens; identical to SEQ ID NO: 190561

SEQ ID NO: 253028 - RNA, 67 nt, Homo Sapiens; identical to SEQ ID NO: 190562

SEQ ID NO: 253029 - RNA, 67 nt, Homo Sapiens; identical to SEQ ID NO: 190563

SEQ ID NO: 253030 - RNA, 67 nt, Homo Sapiens; identical to SEQ ID NO: 190564

SEQ ID NO: 253031 - RNA, 67 nt, Homo Sapiens; identical to SEQ ID NO: 190565

SEQ ID NO: 253032 - RNA, 67 nt, Homo Sapiens; identical to SEQ ID NO: 190566

SEQ ID NO: 253033 - RNA, 67 nt, Homo Sapiens; identical to SEQ ID NO: 190567

SEQ ID NO: 253034 - RNA, 67 nt, Homo Sapiens; identical to SEQ ID NO: 190568

SEQ ID NO: 253035 - RNA, 67 nt, Homo Sapiens; identical to SEQ ID NO: 190569

SEQ ID NO: 253036 - RNA, 67 nt, Homo Sapiens; identical to SEQ ID NO: 190570

SEQ ID NO: 253037 - RNA, 67 nt, Homo Sapiens; identical to SEQ ID NO: 190571

SEQ ID NO: 253038 - RNA, 67 nt, Homo Sapiens; identical to SEQ ID NO: 190572

SEQ ID NO: 253039 - RNA, 67 nt, Homo Sapiens; identical to SEQ ID NO: 190573

SEQ ID NO: 253040 - RNA, 67 nt, Homo Sapiens; identical to SEQ ID NO: 190574

SEQ ID NO: 253041 - RNA, 67 nt, Homo Sapiens; identical to SEQ ID NO: 190575

SEQ ID NO: 253042 - RNA, 67 nt, Homo Sapiens; identical to SEQ ID NO: 190576

SEQ ID NO: 253043 - RNA, 67 nt, Homo Sapiens; identical to SEQ ID NO: 190577

SEQ ID NO: 253044 - RNA, 67 nt, Homo Sapiens; identical to SEQ ID NO: 190578

SEQ ID NO: 253045 - RNA, 67 nt, Homo Sapiens; identical to SEQ ID NO: 190579

SEQ ID NO: 253046 - RNA, 67 nt, Homo Sapiens; identical to SEQ ID NO: 190580

SEQ ID NO: 253047 - RNA, 67 nt, Homo Sapiens; identical to SEQ ID NO: 190581

SEQ ID NO: 253048 - RNA, 67 nt, Homo Sapiens; identical to SEQ ID NO: 190582

SEQ ID NO: 253049 - RNA, 67 nt, Homo Sapiens; identical to SEQ ID NO: 190583

SEQ ID NO: 253050 - RNA, 67 nt, Homo Sapiens; identical to SEQ ID NO: 190584

SEQ ID NO: 253051 - RNA, 67 nt, Homo Sapiens; identical to SEQ ID NO: 190585

SEQ ID NO: 253052 - RNA, 67 nt, Homo Sapiens; identical to SEQ ID NO: 190586

SEQ ID NO: 253053 - RNA, 67 nt, Homo Sapiens; identical to SEQ ID NO: 190587

SEQ ID NO: 253054 - RNA, 67 nt, Homo Sapiens; identical to SEQ ID NO: 190588

SEQ ID NO: 253055 - RNA, 67 nt, Homo Sapiens; identical to SEQ ID NO: 190589

SEQ ID NO: 253056 - RNA, 67 nt, Homo Sapiens; identical to SEQ ID NO: 190590

SEQ ID NO: 253057 - RNA, 67 nt, Homo Sapiens; identical to SEQ ID NO: 190591

SEQ ID NO: 253058 - RNA, 67 nt, Homo Sapiens; identical to SEQ ID NO: 190592

SEQ ID NO: 253059 - RNA, 67 nt, Homo Sapiens; identical to SEQ ID NO: 190593

SEQ ID NO: 253060 - RNA, 67 nt, Homo Sapiens; identical to SEQ ID NO: 190594

SEQ ID NO: 253061 - RNA, 67 nt, Homo Sapiens; identical to SEQ ID NO: 190595

SEQ ID NO: 253062 - RNA, 67 nt, Homo Sapiens; identical to SEQ ID NO: 190596

SEQ ID NO: 253063 - RNA, 67 nt, Homo Sapiens; identical to SEQ ID NO: 190597

SEQ ID NO: 253064 - RNA, 67 nt, Homo Sapiens; identical to SEQ ID NO: 190598

SEQ ID NO: 253065 - RNA, 67 nt, Homo Sapiens; identical to SEQ ID NO: 190599

SEQ ID NO: 253066 - RNA, 67 nt, Homo Sapiens; identical to SEQ ID NO: 190600

SEQ ID NO: 253067 - RNA, 67 nt, Homo Sapiens; identical to SEQ ID NO: 190601

SEQ ID NO: 253068 - RNA, 67 nt, Homo Sapiens; identical to SEQ ID NO: 190602

SEQ ID NO: 253069 - RNA, 67 nt, Homo Sapiens; identical to SEQ ID NO: 190603

SEQ ID NO: 253070 - RNA, 67 nt, Homo Sapiens; identical to SEQ ID NO: 190604

SEQ ID NO: 253071 - RNA, 67 nt, Homo Sapiens; identical to SEQ ID NO: 190605

SEQ ID NO: 253072 - RNA, 67 nt, Homo Sapiens; identical to SEQ ID NO: 190606

SEQ ID NO: 253073 - RNA, 67 nt, Homo Sapiens; identical to SEQ ID NO: 190607

SEQ ID NO: 253074 - RNA, 67 nt, Homo Sapiens; identical to SEQ ID NO: 190608

SEQ ID NO: 253075 - RNA, 61 nt, Homo Sapiens; identical to SEQ ID NO: 190340

SEQ ID NO: 253076 - RNA, 67 nt, Homo Sapiens; identical to SEQ ID NO: 190610

SEQ ID NO: 253077 - RNA, 67 nt, Homo Sapiens; identical to SEQ ID NO: 190611

SEQ ID NO: 253078 - RNA, 67 nt, Homo Sapiens; identical to SEQ ID NO: 190612

SEQ ID NO: 253079 - RNA, 67 nt, Homo Sapiens; identical to SEQ ID NO: 190613

SEQ ID NO: 253080 - RNA, 67 nt, Homo Sapiens; identical to SEQ ID NO: 190614

SEQ ID NO: 253081 - RNA, 67 nt, Homo Sapiens; identical to SEQ ID NO: 190615

SEQ ID NO: 253082 - RNA, 67 nt, Homo Sapiens; identical to SEQ ID NO: 190616

SEQ ID NO: 253083 - RNA, 67 nt, Homo Sapiens; identical to SEQ ID NO: 190617

SEQ ID NO: 253084 - RNA, 67 nt, Homo Sapiens; identical to SEQ ID NO: 190618

SEQ ID NO: 253085 - RNA, 67 nt, Homo Sapiens; identical to SEQ ID NO: 190619

SEQ ID NO: 253086 - RNA, 67 nt, Homo Sapiens; identical to SEQ ID NO: 190620

SEQ ID NO: 253087 - RNA, 67 nt, Homo Sapiens; identical to SEQ ID NO: 190621

SEQ ID NO: 253088 - RNA, 67 nt, Homo Sapiens; identical to SEQ ID NO: 190622

SEQ ID NO: 253089 - RNA, 67 nt, Homo Sapiens; identical to SEQ ID NO: 190623

SEQ ID NO: 253090 - RNA, 67 nt, Homo Sapiens; identical to SEQ ID NO: 190624

SEQ ID NO: 253091 - RNA, 67 nt, Homo Sapiens; identical to SEQ ID NO: 190625

SEQ ID NO: 253092 - RNA, 67 nt, Homo Sapiens; identical to SEQ ID NO: 190626

SEQ ID NO: 253093 - RNA, 67 nt, Homo Sapiens; identical to SEQ ID NO: 190627

SEQ ID NO: 253094 - RNA, 67 nt, Homo Sapiens; identical to SEQ ID NO: 190628

SEQ ID NO: 253095 - RNA, 67 nt, Homo Sapiens; identical to SEQ ID NO: 190629

SEQ ID NO: 253096 - RNA, 67 nt, Homo Sapiens; identical to SEQ ID NO: 190630

SEQ ID NO: 253097 - RNA, 67 nt, Homo Sapiens; identical to SEQ ID NO: 190631

SEQ ID NO: 253098 - RNA, 67 nt, Homo Sapiens; identical to SEQ ID NO: 190632

SEQ ID NO: 253099 - RNA, 67 nt, Homo Sapiens; identical to SEQ ID NO: 190633

SEQ ID NO: 253100 - RNA, 67 nt, Homo Sapiens; identical to SEQ ID NO: 190634

SEQ ID NO: 253101 - RNA, 67 nt, Homo Sapiens; identical to SEQ ID NO: 190635

SEQ ID NO: 253102 - RNA, 66 nt, Homo Sapiens; identical to SEQ ID NO: 190636

SEQ ID NO: 253103 - RNA, 67 nt, Homo Sapiens; identical to SEQ ID NO: 190637

SEQ ID NO: 253104 - RNA, 67 nt, Homo Sapiens; identical to SEQ ID NO: 190638

SEQ ID NO: 253105 - RNA, 67 nt, Homo Sapiens; identical to SEQ ID NO: 190639

SEQ ID NO: 253106 - RNA, 67 nt, Homo Sapiens; identical to SEQ ID NO: 190640

SEQ ID NO: 253107 - RNA, 67 nt, Homo Sapiens; identical to SEQ ID NO: 190641

SEQ ID NO: 253108 - RNA, 67 nt, Homo Sapiens; identical to SEQ ID NO: 190642

SEQ ID NO: 253109 - RNA, 67 nt, Homo Sapiens; identical to SEQ ID NO: 190643

SEQ ID NO: 253110 - RNA, 67 nt, Homo Sapiens; identical to SEQ ID NO: 190644

SEQ ID NO: 253111 - RNA, 67 nt, Homo Sapiens; identical to SEQ ID NO: 190645

SEQ ID NO: 253112 - RNA, 58 nt, Homo Sapiens; identical to SEQ ID NO: 190377

SEQ ID NO: 253113 - RNA, 67 nt, Homo Sapiens; identical to SEQ ID NO: 190647

SEQ ID NO: 253114 - RNA, 67 nt, Homo Sapiens; identical to SEQ ID NO: 190648

SEQ ID NO: 253115 - RNA, 67 nt, Homo Sapiens; identical to SEQ ID NO: 190649

SEQ ID NO: 253116 - RNA, 67 nt, Homo Sapiens; identical to SEQ ID NO: 190650

SEQ ID NO: 253117 - RNA, 67 nt, Homo Sapiens; identical to SEQ ID NO: 190651

SEQ ID NO: 253118 - RNA, 67 nt, Homo Sapiens; identical to SEQ ID NO: 190652

SEQ ID NO: 253119 - RNA, 67 nt, Homo Sapiens; identical to SEQ ID NO: 190653

SEQ ID NO: 253120 - RNA, 67 nt, Homo Sapiens; identical to SEQ ID NO: 190654

SEQ ID NO: 253121 - RNA, 67 nt, Homo Sapiens; identical to SEQ ID NO: 190655

SEQ ID NO: 253122 - RNA, 67 nt, Homo Sapiens; identical to SEQ ID NO: 190656

SEQ ID NO: 253123 - RNA, 67 nt, Homo Sapiens; identical to SEQ ID NO: 190657

SEQ ID NO: 253124 - RNA, 67 nt, Homo Sapiens; identical to SEQ ID NO: 190658

SEQ ID NO: 253125 - RNA, 67 nt, Homo Sapiens; identical to SEQ ID NO: 190659

SEQ ID NO: 253126 - RNA, 67 nt, Homo Sapiens; identical to SEQ ID NO: 190660

SEQ ID NO: 253127 - RNA, 67 nt, Homo Sapiens; identical to SEQ ID NO: 190661

SEQ ID NO: 253128 - RNA, 67 nt, Homo Sapiens; identical to SEQ ID NO: 190662

SEQ ID NO: 253129 - RNA, 67 nt, Homo Sapiens; identical to SEQ ID NO: 190663

SEQ ID NO: 253130 - RNA, 67 nt, Homo Sapiens; identical to SEQ ID NO: 190664

SEQ ID NO: 253131 - RNA, 67 nt, Homo Sapiens; identical to SEQ ID NO: 190665

SEQ ID NO: 253132 - RNA, 67 nt, Homo Sapiens; identical to SEQ ID NO: 190666

SEQ ID NO: 253133 - RNA, 67 nt, Homo Sapiens; identical to SEQ ID NO: 190667

SEQ ID NO: 253134 - RNA, 67 nt, Homo Sapiens; identical to SEQ ID NO: 190668

SEQ ID NO: 253135 - RNA, 62 nt, Homo Sapiens
gaccguacucaguaacaggccggaaaauugugcucuagaagaauaaaacugaaaaacucuag

SEQ ID NO: 253136 - RNA, 62 nt, Homo Sapiens
auaagguaaacauucuauauauucuaugccugcucuagaauugaaagacuucagcaguauua

SEQ ID NO: 253137 - RNA, 62 nt, Homo Sapiens
uccacaucugccuuaaaaccaaagagggcuuccucuagaagccaagggaaaggggugcuuuu

SEQ ID NO: 253138 - RNA, 62 nt, Homo Sapiens
ggaacauuauggagagaaaggguacugaggcacucuagaaucugccacauucauuuucaaau

SEQ ID NO: 253139 - RNA, 62 nt, Homo Sapiens
ggcagcuggaauuggaacucagauuuguugaacucuagaacuaaagaucauaauguugucuu

SEQ ID NO: 253140 - RNA, 62 nt, Homo Sapiens
ucagaguucaaggaagaagcaaaauaucacaucucuagaaguguugggaaaaauauaauuuc

SEQ ID NO: 253141 - RNA, 62 nt, Homo Sapiens
cuccuaaguuauuucucauagaacccagccuacucuagaauuucagcagugacauuggagaa

SEQ ID NO: 253142 - RNA, 62 nt, Homo Sapiens
aauacaccagcucauuuggcugcucagucuaacucuagaauggaugcuuuugaauucauuuc

SEQ ID NO: 253143 - RNA, 62 nt, Homo Sapiens
agagaggaauuaacuuccuggucugugcccuucucuagaagaauauaagaugcuccuccucc

SEQ ID NO: 253144 - RNA, 62 nt, Homo Sapiens
cugggaggaaagugcugggcaucuuacaguaacucuagaaguuccuuugacuaggcugcaau

SEQ ID NO: 253145 - RNA, 62 nt, Homo Sapiens
ugaagccauuggagagcugucuuccuguguaccucuagaaucccagcagcagagaaccauca

SEQ ID NO: 253146 - RNA, 58 nt, Homo Sapiens; identical to SEQ ID NO: 102991

SEQ ID NO: 253147 - RNA, 62 nt, Homo Sapiens
acauucucccuugcuugaugcuuuuccugucccucuagaagagaaguauguggacaucucuu

SEQ ID NO: 253148 - RNA, 62 nt, Homo Sapiens
agguuucacaaccgagaugcagcagggagaggcucuagaacauaagauccucacagcacggg

SEQ ID NO: 253149 - RNA, 62 nt, Homo Sapiens
gccaucucaauugugcuuugugaagcugcugucucuagaaguucauuacccuuuucuggguu

SEQ ID NO: 253150 - RNA, 62 nt, Homo Sapiens
cccacuggccaguccuagagaccccagcuggccucuagaacaguccagaccauugucuucca

SEQ ID NO: 253151 - RNA, 62 nt, Homo Sapiens
uccagaaagguggagggcugugcuacaauuaucucuagaaucguuaucaaggaauuguacug

SEQ ID NO: 253152 - RNA, 62 nt, Homo Sapiens
ucagguucccugccacacuacucccuggaggacucuagaagcguccugauccuaacccuggg

SEQ ID NO: 253153 - RNA, 62 nt, Homo Sapiens
gcaguauucaaccuuuuagccgcuuuuucuugcucuagaagacuguuuugcccaggggcucc

SEQ ID NO: 253154 - RNA, 62 nt, Homo Sapiens
uccauauuuauuuuuauguuaggccuucaggacucuagaaugagacuauggauguguucucu

SEQ ID NO: 253155 - RNA, 62 nt, Homo Sapiens
uugacauucucugugggggaugcaguaacaaacucuagaauaaguaacaaacuccagucugu

SEQ ID NO: 253156 - RNA, 62 nt, Homo Sapiens
cccacauuuccaccaacucaauuagggcaguucucuagaacgcccucuuagcuguagucuau

SEQ ID NO: 253157 - RNA, 62 nt, Homo Sapiens
uggauaauaaagaugcuuaucagagccauuuccucuagaauuuaguagguucugcuguuaug

SEQ ID NO: 253158 - RNA, 62 nt, Homo Sapiens
gaaugaaggauugaagaauugaugaagaaugucucuagaagaugacaauguagcuugaaagc

SEQ ID NO: 253159 - RNA, 62 nt, Homo Sapiens
uagauuuucacuucuuuugauuugaagagagucucuagaauagaauauauugguugcucauu

SEQ ID NO: 253160 - RNA, 62 nt, Homo Sapiens
ugauaugauaauccuaccaauuuucaagaagucucuagaaagagauaacacauggaaagacg

SEQ ID NO: 253161 - RNA, 62 nt, Homo Sapiens
ccagccauauuacucuagucccuaccaaacugcucuagaaggucauuuccauuuuguuugug

SEQ ID NO: 253162 - RNA, 62 nt, Homo Sapiens
uugaaaguaagaaaacggauuuaggaugaaaacucuagaacuacccuaugcuguuuauacug

SEQ ID NO: 253163 - RNA, 62 nt, Homo Sapiens
uacagucagauuuauagccagccaucuaucaccucuagaagguuccagagacagugaaacug

SEQ ID NO: 253164 - RNA, 62 nt, Homo Sapiens
ccucuuuaaaaaaaaaaaaguuuuuguuauaucucuagaacauuucaagucuuuuccuuuuu

SEQ ID NO: 253165 - RNA, 62 nt, Homo Sapiens
acagaacguauagaguuaaccaaagugcucuucucuagaaucuuuacaccuccugugugguu

SEQ ID NO: 253166 - RNA, 62 nt, Homo Sapiens
guccccuaaauuucuguucuaguuuuaaauuucucuagaacuugcaauaguuggggguuuua

SEQ ID NO: 253167 - RNA, 62 nt, Homo Sapiens
ucucggccuccacauuaaccauaggauguugacucuagaaccuggacccacccagcgcgucc

SEQ ID NO: 253168 - RNA, 62 nt, Homo Sapiens
uuaauuuucuugugagauaauauucuaagaggcucuagaaacaugaaauacucaguagugau

SEQ ID NO: 253169 - RNA, 53 nt, Homo Sapiens; identical to SEQ ID NO: 103014

SEQ ID NO: 253170 - RNA, 62 nt, Homo Sapiens
ggacaccauguacuauaaccaguuaaauggaacucuagaauaucaagggagcaagaggaagc

SEQ ID NO: 253171 - RNA, 62 nt, Homo Sapiens
aucaaaaacaaagaagcccuauaagaccauuucucuagaacagauguucuuaauauuuuucu

SEQ ID NO: 253172 - RNA, 62 nt, Homo Sapiens
ggagcauguggucuuuuuaaaaaauuguaacccucuagaaaauaucaaagaaaugaaccaga

SEQ ID NO: 253173 - RNA, 62 nt, Homo Sapiens
aaagaacacuaccacugcaauuugacaguuaacucuagaaagguuacugagaauuguugugc

SEQ ID NO: 253174 - RNA, 62 nt, Homo Sapiens
uaguggcgggucugggcuggagagacacccuccucuagaauugaaaaaaguacugugaccug

SEQ ID NO: 253175 - RNA, 62 nt, Homo Sapiens
guuuuggagcucgagaucuucaaaauggugggcucuagaaugugaaacacauguguaacaau

SEQ ID NO: 253176 - RNA, 62 nt, Homo Sapiens
uuacauugauuaaaauguuaguuucagcaaaucucuagaaaugucuccauucaggcaagugu

SEQ ID NO: 253177 - RNA, 62 nt, Homo Sapiens
uguaucuuuuuaugauuuagggcagauaauuccucuagaauguugauaauuguuauuuuuuu

SEQ ID NO: 253178 - RNA, 62 nt, Homo Sapiens
ugggauggacuuacuauucugagcuaccucaucucuagaagcgacccaacauuucuuagcau

SEQ ID NO: 253179 - RNA, 62 nt, Homo Sapiens
gaauccugucuuaaaacuggguuguguaaugucucuagaaagaaacaccuuaaguguauacu

SEQ ID NO: 253180 - RNA, 62 nt, Homo Sapiens
uauuacuuuguucucccauggaaauacuauugcucuagaaugugcuaccuaaaggauauaaa

SEQ ID NO: 253181 - RNA, 62 nt, Homo Sapiens
cuaguacacuggcaucaucuuuaugccuacaucucuagaagagccuagaaccaguuuuaaga

SEQ ID NO: 253182 - RNA, 62 nt, Homo Sapiens
ccugggcccaaggggugaugaggcauccuuuccucuagaagaccugagucuuccugaccgac

SEQ ID NO: 253183 - RNA, 62 nt, Homo Sapiens
uagacaaaaaccauuguugaugaggcagaugccucuagaagagacguuuaaaagccaucaaa

SEQ ID NO: 253184 - RNA, 62 nt, Homo Sapiens
uucaauugcuuuaauuguagaucaagaagcuacucuagaagucggagcagaggaugguacag

SEQ ID NO: 253185 - RNA, 62 nt, Homo Sapiens
guccuguugccaaacaaaagccagucauguaacucuagaagcagugacugguggggcuuucu

SEQ ID NO: 253186 - RNA, 62 nt, Homo Sapiens
ugaugcuucuggggcacguugaccauaugcaccucuagaaccuaaccagggcuuccuucuac

SEQ ID NO: 253187 - RNA, 62 nt, Homo Sapiens
agagcguuccuugaguccguacaccguccucccucuagaagcuggcaucacacucaugcugg

SEQ ID NO: 253188 - RNA, 62 nt, Homo Sapiens
augaaguuccccaaggaaacgaacaaaaugaacucuagaauaucuagcaaauaguuaaagaa

SEQ ID NO: 253189 - RNA, 62 nt, Homo Sapiens
gcauggaagagaacaccucuuuauggcuuacccucuagaauuucuaauuuauguguucuguu

SEQ ID NO: 253190 - RNA, 62 nt, Homo Sapiens
gcaccugggucccagcaucuagagcauggagccucuagaagccaugcucacccgcccacauu

SEQ ID NO: 253191 - RNA, 62 nt, Homo Sapiens
aucaggaaagagagcaccacgugauggaguuucucuagaagcuccagugauaagagauguug

SEQ ID NO: 253192 - RNA, 62 nt, Homo Sapiens
agugugacucaaucuugccugccuucugggagcucuagaauuguucccaacccaguccaugg

SEQ ID NO: 253193 - RNA, 62 nt, Homo Sapiens
cccuuccccagagaccuucagugccauccugacucuagaaggccccccacagcagggcguag

SEQ ID NO: 253194 - RNA, 62 nt, Homo Sapiens
cuugaaagaaccgaagucuuucccauucacuucucuagaaagcugccaagacagaggcagaa

SEQ ID NO: 253195 - RNA, 62 nt, Homo Sapiens
cgaagggaggaggagcacaaucugggaaguuacucuagaaaagcaggcuccaggcagggucc

SEQ ID NO: 253196 - RNA, 62 nt, Homo Sapiens
gaauuugcaggcaaccauguugcguuuacuuccucuagaaaaaaacauaaccauauguguuu

SEQ ID NO: 253197 - RNA, 62 nt, Homo Sapiens
auuucaaacaauuaaaauaagagcuucuuuggcucuagaaaagaagaaacaacuucuuuaaa

SEQ ID NO: 253198 - RNA, 62 nt, Homo Sapiens
ggagaccgauuuacaauuuagaaaauuguguacucuagaaauaaauaauuuuuuucaaauaa

SEQ ID NO: 253199 - RNA, 62 nt, Homo Sapiens
accaccaaacaugacuguuccugcugauguugcucuagaaaaacuccuccuccagauaccaa

SEQ ID NO: 253200 - RNA, 62 nt, Homo Sapiens
cugaggacaguuucuuuugaaacccucuaggucucuagaacaauuaggauuugauuucuuga

SEQ ID NO: 253201 - RNA, 62 nt, Homo Sapiens
aaauauuuaguaaagcuuuacaauagauguuucucuagaacagacuuuauuuucacauaagu

SEQ ID NO: 253202 - RNA, 62 nt, Homo Sapiens
uuaagugcuuuguaaugggaauauuccccuaucucuagaauuuaaaaaauguccaugaugga

SEQ ID NO: 253203 - RNA, 62 nt, Homo Sapiens
uaauuuuacacaugcuggaaugacuguaauuacucuagaauuccaaguagaauacaauaacu

SEQ ID NO: 253204 - RNA, 62 nt, Homo Sapiens
auaacucuuaaaaaaccgucgagauuacaaugcucuagaaucagcauauaagaaaauaaaug

SEQ ID NO: 253205 - RNA, 62 nt, Homo Sapiens
caauauuacauuacagccuguauucauuuguucucuagaaguuuugucagaauuuugacuug

SEQ ID NO: 253206 - RNA, 62 nt, Homo Sapiens
uuguaacuacacugggcaucagaauaaaaggccucuagaaauugcugaacaaugguuaauua

SEQ ID NO: 253207 - RNA, 62 nt, Homo Sapiens
cucuccuucauuaauuuaaauauuuuuaucggcucuagaaaaugcauaagguuaguacaaga

SEQ ID NO: 253208 - RNA, 62 nt, Homo Sapiens
augaacaaagguuaauuuaaaauuauuuaaaacucuagaaagacucucugcacugacuuuuu

SEQ ID NO: 253209 - RNA, 62 nt, Homo Sapiens
caucugucuguauugaucuugaacauuucugucucuagaagucuauucuguugugacuauga

SEQ ID NO: 253210 - RNA, 62 nt, Homo Sapiens
agaaagcaauuuuuaggcagguccuauauacccucuagaaacuucuccuauuuaccaguccu

SEQ ID NO: 253211 - RNA, 62 nt, Homo Sapiens
ugugcgagcacaacacacacgaaagauuuuuacucuagaaacgugucacauuucucuaagau

SEQ ID NO: 253212 - RNA, 62 nt, Homo Sapiens
agaaccagcucuacgagaguguuucccuuuuccucuagaagcagcuuugggaaagcugccuc

SEQ ID NO: 253213 - RNA, 62 nt, Homo Sapiens
augcccugacucuaccagcgcccauaaaugaucucuagaaggacuguuaguaccaaucuguu

SEQ ID NO: 253214 - RNA, 62 nt, Homo Sapiens
aaauauaccauaggcuaaaacuaaggcuuucacucuagaaugcaaagcuguuuugcagcugu

SEQ ID NO: 253215 - RNA, 62 nt, Homo Sapiens
ucccaucugcugcucuuuguagaaaagguuuccucuagaacugaauuccucuggaauugagu

SEQ ID NO: 253216 - RNA, 62 nt, Homo Sapiens
guaaacauugagcucaccuuuuauauauuaaccucuagaauuaaugggccuaugugguuuuu

SEQ ID NO: 253217 - RNA, 62 nt, Homo Sapiens
uaauugugcuuuuuuuuuuugguagguagcuucucuagaauuaaaauauuuagcccuuccuu

SEQ ID NO: 253218 - RNA, 62 nt, Homo Sapiens
gacauaaagguuuauggggauuguaauauaugcucuagaaauacuuugccaaagcugucauc

SEQ ID NO: 253219 - RNA, 62 nt, Homo Sapiens
gcagaaauuaggaaggugauuccuugaauuuucucuagaaauaaccugaaauauuguuuucu

SEQ ID NO: 253220 - RNA, 62 nt, Homo Sapiens
uaaagcugaaaucugcaaauuuuaaaauauaucucuagaacuugaaucuuguuuuuuuuauc

SEQ ID NO: 253221 - RNA, 62 nt, Homo Sapiens
cuuagccugggcaccuggcucugucucccugucucuagaagcaccucaagggauuuagugcc

SEQ ID NO: 253222 - RNA, 62 nt, Homo Sapiens
gauuacuuaagacugugucauacuauauacuucucuagaagagaaaugggaaucaguggucu

SEQ ID NO: 253223 - RNA, 62 nt, Homo Sapiens
ggacuaaacuuauucucucaagaagguucuagcucuagaaagauggugggaaacagccaccg

SEQ ID NO: 253224 - RNA, 62 nt, Homo Sapiens
uucuuacccaguuaacaugaagaaaccacugucucuagaagaaagcuuguuuugcaguauua

SEQ ID NO: 253225 - RNA, 62 nt, Homo Sapiens
accaguugcacauguuuuccccuaaaagcuuacucuagaaaggauauuuuuuggagagggag

SEQ ID NO: 253226 - RNA, 62 nt, Homo Sapiens
cuuaucucccucagacgcagaguuuuuaguuucucuagaaauuuuguuucauauuaggaaua

SEQ ID NO: 253227 - RNA, 62 nt, Homo Sapiens
aucauuaagaugaagagaguaauucacauuuacucuagaaccuuuaacaagcacugaaagga

SEQ ID NO: 253228 - RNA, 62 nt, Homo Sapiens
gucacaggauuaauuaauugccgguuuucauacucuagaaggcugaaacugauguuuaucuu

SEQ ID NO: 253229 - RNA, 62 nt, Homo Sapiens
aauauauuucacaucuuuauuauugcaguuuucucuagaaagcucugagaagcuuucucugc

SEQ ID NO: 253230 - RNA, 62 nt, Homo Sapiens
auugaggaacuguugauuggcaggcacugauucucuagaacacugggcaugaggauguugca

SEQ ID NO: 253231 - RNA, 62 nt, Homo Sapiens
acuuuucagguaauuauggaaaauauuuuaaacucuagaagcuucaauaaugaugugugauu

SEQ ID NO: 253232 - RNA, 62 nt, Homo Sapiens
cucugugugcuuugugguugcugucauauuugcucuagaagaaaaaaaaaaaaggaggggaa

SEQ ID NO: 253233 - RNA, 62 nt, Homo Sapiens
acauuuuauacuuuucauaaaccacaaagucucucuagaauuuuuucugccuucacuaaaau

SEQ ID NO: 253234 - RNA, 62 nt, Homo Sapiens
cuccugggcucaagugauccucuagacucagccucuagaauagcugggacuacaggcacaug

SEQ ID NO: 253235 - RNA, 62 nt, Homo Sapiens
ccaguccccuuucucgggguacaugauuugggcucuagaauuagccuuuugggaauaauagc

SEQ ID NO: 253236 - RNA, 62 nt, Homo Sapiens
uuccuuggcacauauaaaaguucucaaaaaugcucuagaacuuguucuucaguauuuuguuu

SEQ ID NO: 253237 - RNA, 62 nt, Homo Sapiens
auuuaguuuguguuaacuauuguaaucacauucucuagaaccuccaauaauguuagaguuca

SEQ ID NO: 253238 - RNA, 62 nt, Homo Sapiens
ggcacaagaauggcuaaagcaugaaacuaaaucucuagaagaagaggucuugcagucuucag

SEQ ID NO: 253239 - RNA, 62 nt, Homo Sapiens
aucagaaucaaguuguggguucuuaugaaugacucuagaaaaaaggauccacuacuucuugu

SEQ ID NO: 253240 - RNA, 62 nt, Homo Sapiens
ccaaaugccccgaguuaagauuccaaaaggaacucuagaagauucacuaaugaucacauucu

SEQ ID NO: 253241 - RNA, 62 nt, Homo Sapiens
cgugaaauauuuaaguauauaguauauuuauacucuagaacaugcacauuuauauauauaug

SEQ ID NO: 253242 - RNA, 62 nt, Homo Sapiens
aaaccuaaacucuucaggcuaccuuugugugucucuagaagagaaaagcaucuaucuggaga

SEQ ID NO: 253243 - RNA, 62 nt, Homo Sapiens
gaauaaacaucagaguauuuuaaaaaacaguucucuagaaagaacuguuauaauuaaaauga

SEQ ID NO: 253244 - RNA, 62 nt, Homo Sapiens
aacuccugugcuuuugagcaaggacuuuugcccucuagaaagcaacugaggccaggugcggu

SEQ ID NO: 253245 - RNA, 62 nt, Homo Sapiens
cugugucaaaaugauaauuuuguuauguuagccucuagaaaauuuaaguucagaaaaaugca

SEQ ID NO: 253246 - RNA, 62 nt, Homo Sapiens
gcuuauagaggcaaaccacaguaucauuuuaacucuagaauugggcuuguacagaaggauaa

SEQ ID NO: 253247 - RNA, 62 nt, Homo Sapiens
cuuauuguaauuuuccuacuauuuauagagaucucuagaauuuuuugagucauaggucugua

SEQ ID NO: 253248 - RNA, 62 nt, Homo Sapiens
uaccgcagaaauugauguguugucuggucuuccucuagaagguuucaacucuguugacccuc

SEQ ID NO: 253249 - RNA, 62 nt, Homo Sapiens
cugaguaccaugggcuacaguaggcuacccuccucuagaaggacucagggcuucuccucugc

SEQ ID NO: 253250 - RNA, 62 nt, Homo Sapiens
aucucgcaccaccaguuacaccuuuccccucucucuagaaucaagaccaaaccccacauccu

SEQ ID NO: 253251 - RNA, 62 nt, Homo Sapiens
guagggaaaauaaugcuuguccugugugcauacucuagaagauugcauugcauucagaguaa

SEQ ID NO: 253252 - RNA, 62 nt, Homo Sapiens
aagggaacagaaagucugcccacuaauaagagcucuagaaaaggauuaaaaauaaggauaaa

SEQ ID NO: 253253 - RNA, 60 nt, Homo Sapiens; identical to SEQ ID NO: 103098

SEQ ID NO: 253254 - RNA, 62 nt, Homo Sapiens
caauuagggauguuuguuacucccugcuuccucucuagaaucugagccaccgcaccuggccu

SEQ ID NO: 253255 - RNA, 62 nt, Homo Sapiens
ucaaugucuuuguggacauuuacuguaguauucucuagaacuguuuucauugucaagaaugu

SEQ ID NO: 253256 - RNA, 62 nt, Homo Sapiens
uuuauccuaagcacuuguuuaauauuccauuucucuagaauguaauuuuuaagcucuuugcc

SEQ ID NO: 253257 - RNA, 62 nt, Homo Sapiens
cagcuugcuaaauuaggcuauaccuagguaaucucuagaagacaacucugacagacucuuua

SEQ ID NO: 253258 - RNA, 62 nt, Homo Sapiens
uuuucaucaugcacgaauuaauaaucaucauacucuagaaucuugucugucacucacuacau

SEQ ID NO: 253259 - RNA, 62 nt, Homo Sapiens
uucuagguuuguaagugcagcaguuuuauuuccucuagaacucauccuguuucaagggaagu

SEQ ID NO: 253260 - RNA, 62 nt, Homo Sapiens
uaagaauuuuccacuucuucaaaaugaacuuacucuagaaagcuuacccuuggauaaccagu

SEQ ID NO: 253261 - RNA, 62 nt, Homo Sapiens
gcuggugaguauuaccuuucaucugugccaugcucuagaaccuugaccuugauaguucacca

SEQ ID NO: 253262 - RNA, 62 nt, Homo Sapiens
cuuaaugaucaaguguuacuuaucuaauaauccucuagaaagaacccuguuagaucuugguu

SEQ ID NO: 253263 - RNA, 62 nt, Homo Sapiens
gcccuucacuuucuccuggugagggcacgaggcucuagaaauggggaaacucuggugccggg

SEQ ID NO: 253264 - RNA, 62 nt, Homo Sapiens
gaacucucuuucuucucuugacucccccugcucucuagaaagcuccaccugcccaccgggac

SEQ ID NO: 253265 - RNA, 62 nt, Homo Sapiens
aaacgucuuuauuuaggagggauagauuugcucucuagaagguucuaguuuugacauuuuau

SEQ ID NO: 253266 - RNA, 62 nt, Homo Sapiens
aucauauugaugaaaucguaacaucuuuaugacucuagaauaugcagacucaaaccuuccca

SEQ ID NO: 253267 - RNA, 62 nt, Homo Sapiens
gcggaccaaacuacuucauuuuacccagacaacucuagaaauuuguuuuuugguuuuuuuuu

SEQ ID NO: 253268 - RNA, 62 nt, Homo Sapiens
cucuaaagaccauguuggaaucacagucguaucucuagaaaggugcgugaagaccaacaaag

SEQ ID NO: 253269 - RNA, 62 nt, Homo Sapiens
uagucacaaguauuaauaauuaauaugugaugcucuagaaaaauuccugcuuguuaauuaca

SEQ ID NO: 253270 - RNA, 62 nt, Homo Sapiens
ucuguauuguguagaaugauccuuuagaaaugcucuagaagaaagaccaaaaacuguaauau

SEQ ID NO: 253271 - RNA, 62 nt, Homo Sapiens
gucugaugaaaggccgggaaaaaaggagguuucucuagaagaaugauagccaauggugaggg

SEQ ID NO: 253272 - RNA, 62 nt, Homo Sapiens
agcuuugucagguuaauguagcauguuaaggacucuagaaaaaaauaaacuaaggagacgag

SEQ ID NO: 253273 - RNA, 62 nt, Homo Sapiens
uauucggggauaugaaggauucaaugaaugaucucuagaaagauuuaaagaagaauauucag

SEQ ID NO: 253274 - RNA, 62 nt, Homo Sapiens
guuccacccuaacuuggggaaacaaaagccuucucuagaaucugaaggccaggcuuaccucu

SEQ ID NO: 253275 - RNA, 62 nt, Homo Sapiens
aggaaucaauaguuaguagugacauuggugcucucuagaaaucucagcaugagcugcuauag

SEQ ID NO: 253276 - RNA, 62 nt, Homo Sapiens
caggccugcuagcucagccgacgcucuggacacucuagaaaucacuccucagugugaccucc

SEQ ID NO: 253277 - RNA, 62 nt, Homo Sapiens
uaguccugaguauaaauccugugcauagauuccucuagaaaggcaucaaaaggcucaacaga

SEQ ID NO: 253278 - RNA, 62 nt, Homo Sapiens
aauggguucagggucuuguccuuagcuacuagcucuagaaaagucccaaaagcagcagaagg

SEQ ID NO: 253279 - RNA, 62 nt, Homo Sapiens
gacuuuggccuccccccaaggggugaagccaccucuagaaggcuggacuguuccugggaaaa

SEQ ID NO: 253280 - RNA, 62 nt, Homo Sapiens
cuguugccacuuacgggggcaccacugcaugucucuagaauguguguguaugguacuagcac

SEQ ID NO: 253281 - RNA, 62 nt, Homo Sapiens
aauuaucuuuuucucuuaauauacaguauucacucuagaaacugucuucuaagagcuguuca

SEQ ID NO: 253282 - RNA, 62 nt, Homo Sapiens
aggccaucucacuagaauagucaguuuccuaccucuagaaagaauaguaaagguaaaaucuc

SEQ ID NO: 253283 - RNA, 62 nt, Homo Sapiens
ggagccaggacuaagugagaaauaaagaggaacucuagaacucccaaacuuucaccaaaagc

SEQ ID NO: 253284 - RNA, 62 nt, Homo Sapiens
caguauaaacuuucagaggcguccaaggaaagcucuagaaaaauucaggagcuuugaaggaa

SEQ ID NO: 253285 - RNA, 62 nt, Homo Sapiens
aucuucuagaagaaaaaucuccgaagagcucucucuagaaguccaaaauggcuagccauuau

SEQ ID NO: 253286 - RNA, 62 nt, Homo Sapiens
agcugaugucagcuucauguggauuuuaagcacucuagaaacaaugaagcuucuuggcauau

SEQ ID NO: 253287 - RNA, 62 nt, Homo Sapiens
ccugccacuagguuucaccucccaaacccagccucuagaacagccagacccugcagaucccc

SEQ ID NO: 253288 - RNA, 62 nt, Homo Sapiens
acagugucuaaauauaagacaauauugaucagcucuagaauaacuuuaaagaaagacguguu

SEQ ID NO: 253289 - RNA, 62 nt, Homo Sapiens
ucuuugcauuuggcucuacuuacuaacaaccccucuagaauacauuggugauuucauuuaaa

SEQ ID NO: 253290 - RNA, 62 nt, Homo Sapiens
cuuucuauuucuaaccuaugauaauucuuguucucuagaaaguguaguacauguuuuuacua

SEQ ID NO: 253291 - RNA, 62 nt, Homo Sapiens
guaacaaaucagccaauuggauacaguucagccucuagaauggaaugguaguugaggucuuc

SEQ ID NO: 253292 - RNA, 62 nt, Homo Sapiens
acacuagacagaugucuccucuccuaccccuacucuagaaacggaauugagcgguuccccac

SEQ ID NO: 253293 - RNA, 62 nt, Homo Sapiens
ugccuuuuucaaauaucccucuuugucuuuuccucuagaacccaggguucaguuucauguau

SEQ ID NO: 253294 - RNA, 62 nt, Homo Sapiens
acaucuuuaaaccccuuacacccucuacgucucucuagaaugugccacugucccaacucuuu

SEQ ID NO: 253295 - RNA, 62 nt, Homo Sapiens
gagauuuaguuuuacugcuuugacuggugggucucuagaagcaaaacugagugauaacucau

SEQ ID NO: 253296 - RNA, 62 nt, Homo Sapiens
cauaguuuuguuuugguuuauuuuuaacaacgcucuagaaacaaagucaaauuaaucacaaa

SEQ ID NO: 253297 - RNA, 62 nt, Homo Sapiens
cucuuuagaacuugauggcugggcacugccaucucuagaauugccacgagucucucucuucc

SEQ ID NO: 253298 - RNA, 62 nt, Homo Sapiens
gguguacuaguuacacaucuucaacagacccccucuagaaauuuuucagaugcuucugggag

SEQ ID NO: 253299 - RNA, 62 nt, Homo Sapiens
gcagcuguggucauuaaaccauuaguuuaccccucuagaacuggggucugcaaacucccacc

SEQ ID NO: 253300 - RNA, 62 nt, Homo Sapiens
uacagcacuaagagaagccccugagaaaaacccucuagaaaaacagcuguuccucugugugg

SEQ ID NO: 253301 - RNA, 62 nt, Homo Sapiens
ucccucuguggccuccuggcuugcacugcucccucuagaaagauuccuucaggucuggaggc

SEQ ID NO: 253302 - RNA, 62 nt, Homo Sapiens
caguggacaguaugcacucagcugaccacucucucuagaaauagucaagauaugaacuaaga

SEQ ID NO: 253303 - RNA, 62 nt, Homo Sapiens
aacuccccuuaaaaugucuaucuauuaaaagccucuagaaguccuuguuaugcacaagagau

SEQ ID NO: 253304 - RNA, 62 nt, Homo Sapiens
uugaguucucauuuuuuuaagaagaguuauugcucuagaaagccuugugcuagugcccucga

SEQ ID NO: 253305 - RNA, 62 nt, Homo Sapiens
gcaaagccggauuucuggaagaacacugaagacucuagaaaaucccggcggcaaggagaaca

SEQ ID NO: 253306 - RNA, 62 nt, Homo Sapiens
cuguccguggaugaguuuagagcguccugcugcucuagaagaauacucugcuucucucuguc

SEQ ID NO: 253307 - RNA, 62 nt, Homo Sapiens
caggauguuccuucuauuguagcaagagucaacucuagaauuagcugaagguguacuucacc

SEQ ID NO: 253308 - RNA, 62 nt, Homo Sapiens
aacacauaaaauuuagcaauggucuggaacagcucuagaauguuuccuuuuuuucuugauua

SEQ ID NO: 253309 - RNA, 62 nt, Homo Sapiens
gaauugcuaccucuuguauguuuugagaccaucucuagaaaagugauuuugauguauucuaa

SEQ ID NO: 253310 - RNA, 62 nt, Homo Sapiens
uguuacaagggggagggaaguuuucacuaaaacucuagaaggucacuucaagacuuuccuuc

SEQ ID NO: 253311 - RNA, 62 nt, Homo Sapiens
cuccacccucaucucucugccuggcugucugccucuagaacuccuaggcccuagggauccaa

SEQ ID NO: 253312 - RNA, 62 nt, Homo Sapiens
cugguaaaggggugcuggaggccauggaggagcucuagaaacauuagcaugggcugaucuga

SEQ ID NO: 253313 - RNA, 62 nt, Homo Sapiens
uauggcauaugucuccgauuuagaugguuauucucuagaaaauaguauuuaaagacauuuua

SEQ ID NO: 253314 - RNA, 62 nt, Homo Sapiens
ucauccccaccccaccucaccccaacaaacuccucuagaagaagccaagaauuucucucuau

SEQ ID NO: 253315 - RNA, 62 nt, Homo Sapiens
ugaugcuuggaccccuuuuauugaucagagugcucuagaauaauggauggucuuggaugaug

SEQ ID NO: 253316 - RNA, 62 nt, Homo Sapiens
cauuauuuuaaugaaugugagcucuugacuuacucuagaauucuaauacagauacuuucugc

SEQ ID NO: 253317 - RNA, 62 nt, Homo Sapiens
uauuguuugaucuaguuauuuuaauaaaggaacucuagaaguuucaaguggccagugaagug

SEQ ID NO: 253318 - RNA, 62 nt, Homo Sapiens
aauaaguaggacugaguauuuaugugaaaacucucuagaagguaaaaauaaagauaauucuu

SEQ ID NO: 253319 - RNA, 62 nt, Homo Sapiens
uuuucuguguaauuccagaugagucacuguaacucuagaagauuaaccuuccagccaaccua

SEQ ID NO: 253320 - RNA, 62 nt, Homo Sapiens
ccucgcccuuucuuaaagugcaguucuuagcccucuagaaacgaguuggugucuuucgucuc

SEQ ID NO: 253321 - RNA, 62 nt, Homo Sapiens
aaauguacucauuuagacaaacuccuuacagucucuagaauuccccaaagcauauaaucucu

SEQ ID NO: 253322 - RNA, 62 nt, Homo Sapiens
agaaauuauggagaaugauucaaagaagaaagcucuagaaagcuaccuuacgugauagcaua

SEQ ID NO: 253323 - RNA, 62 nt, Homo Sapiens
cauguuuguuuguuuguuuuugacaacacaagcucuagaauucuuaccccacagcugguuac

SEQ ID NO: 253324 - RNA, 62 nt, Homo Sapiens
uuggcaauguugacuaagaacaaaccuuuauccucuagaauugaaaaauguggauaaacagu

SEQ ID NO: 253325 - RNA, 62 nt, Homo Sapiens
aaguagugaggccguuaauuguggagccaaaucucuagaaauauccugaagaaaugguaagg

SEQ ID NO: 253326 - RNA, 62 nt, Homo Sapiens
cuagcagccuaacugcugcuaacaaagaugaacucuagaacuacccugacugugggcuugag

SEQ ID NO: 253327 - RNA, 62 nt, Homo Sapiens
cagaguugcuguuguuuuuuugguguuuuccccucuagaaaaaccauuugaauauuuucauu

SEQ ID NO: 253328 - RNA, 62 nt, Homo Sapiens
ucuugccucauugaguguuuccuucuuuugggcucuagaaagcccagaucucuucccccauu

SEQ ID NO: 253329 - RNA, 62 nt, Homo Sapiens
uuuaucaagaugaagacauuuuacccuaccuacucuagaaauauacaacaauguuauauuuu

SEQ ID NO: 253330 - RNA, 62 nt, Homo Sapiens
ggcuaaugcugcauuuuucuacaacaucaugccucuagaagguuuaagcuagguaggcuuuc

SEQ ID NO: 253331 - RNA, 62 nt, Homo Sapiens
ugucugcguuuacucuuguucaccagacuuuucucuagaagcucuauuaucaacugcugcuu

SEQ ID NO: 253332 - RNA, 62 nt, Homo Sapiens
auaaagcaaagcacuauuccaauuacugcuuucucuagaaauggaacacugaacuaguugga

SEQ ID NO: 253333 - RNA, 62 nt, Homo Sapiens
ugggcuuggaccagaucuaacucugcuuuuaacucuagaauuuuuucagccacuaagaaccc

SEQ ID NO: 253334 - RNA, 62 nt, Homo Sapiens
cagcaggucacacugggggcggcugaaguguucucuagaaucggguuuucccuugccuuaug

SEQ ID NO: 253335 - RNA, 62 nt, Homo Sapiens
gucugaggauguuaacuuuggaacucgcaguccucuagaacagcuucagauuauggcuuuuu

SEQ ID NO: 253336 - RNA, 62 nt, Homo Sapiens
cugcucuccaaugcuaacuuucugacacagugcucuagaacccugccugugguccugagcac

SEQ ID NO: 253337 - RNA, 62 nt, Homo Sapiens
guugaggaaaugguugggaaucgcuguuagaacucuagaaauucuaaucugacuuugccacu

SEQ ID NO: 253338 - RNA, 62 nt, Homo Sapiens
ccuggacagccaggggcuccucgggcccugugcucuagaaggcccauucuaugucugcuucg

SEQ ID NO: 253339 - RNA, 62 nt, Homo Sapiens
aaaagaaucugaacauuuaagugcgaaguuuucucuagaaauauauucaagauauguuuauu

SEQ ID NO: 253340 - RNA, 62 nt, Homo Sapiens
uuauuuugcucgugcuuagcuaaauaugucaucucuagaaaagaugugguuuguuuuggcac

SEQ ID NO: 253341 - RNA, 62 nt, Homo Sapiens
cguucaaaugagcguagcccccugagucaucacucuagaagaaucuguacaucaucaggacu

SEQ ID NO: 253342 - RNA, 62 nt, Homo Sapiens
ugguguucacucuacauaucagguuauggugucucuagaaucuguuguuuguuuccuauaag

SEQ ID NO: 253343 - RNA, 62 nt, Homo Sapiens
augaagaccuacuuucaacuccuuuuuccccccucuagaagaaucaaauugaaucuuuuacu

SEQ ID NO: 253344 - RNA, 62 nt, Homo Sapiens
aggugauugguuuucuuuacagacuccuuguucucuagaagggcuuuuuacuugaauaaaac

SEQ ID NO: 253345 - RNA, 62 nt, Homo Sapiens
auaauuaguguuauagucuugucaaaugcauccucuagaaaauugugaaugagaguuggcau

SEQ ID NO: 253346 - RNA, 62 nt, Homo Sapiens
ucagcacugcacuguuagcuccuguuucuuggcucuagaagaacauagagccucucucuuuu

SEQ ID NO: 253347 - RNA, 62 nt, Homo Sapiens
ggcugcugucauagugaacaugacauuaauaccucuagaaagggagaauuaucacaaccuaa

SEQ ID NO: 253348 - RNA, 62 nt, Homo Sapiens
auuuucuuacaguagauaagauacauuccacccucuagaaguacuugcagguccagguuggu

SEQ ID NO: 253349 - RNA, 62 nt, Homo Sapiens
cugugaauuucaacauuauuauaacuauaaaucucuagaauuauuggugauacuucuaaacu

SEQ ID NO: 253350 - RNA, 62 nt, Homo Sapiens
cauagcuucuuacugaacuucucuagaauugucucuagaaaacaaagucaauggaaauugaa

SEQ ID NO: 253351 - RNA, 51 nt, Homo Sapiens; identical to SEQ ID NO: 103196

SEQ ID NO: 253352 - RNA, 62 nt, Homo Sapiens
ccguaggucuauccuuagaguaaugguuuuugcucuagaauaauuuccuguagaaguagcuu

SEQ ID NO: 253353 - RNA, 62 nt, Homo Sapiens
guguaccauccaauucgccaacugggacccuacucuagaacucugccuccugggguccagug

SEQ ID NO: 253354 - RNA, 62 nt, Homo Sapiens
agguuaaacugaagcaacuucauguacuaguccucuagaaaucccuguaguugacaauucug

SEQ ID NO: 253355 - RNA, 62 nt, Homo Sapiens
acgcacaugcgaccccgaggaaacgaaacccacucuagaaaacgcgaccuuggccgcaccua

SEQ ID NO: 253356 - RNA, 62 nt, Homo Sapiens
gucugcucccacagcaccaucuaagaccccuccucuagaaguggggaaggccagauguguag

SEQ ID NO: 253357 - RNA, 62 nt, Homo Sapiens
cuauguauauuuaaauuuaguaauuuucuaaucucuagaaaucucugcuguucaaaaggugg

SEQ ID NO: 253358 - RNA, 62 nt, Homo Sapiens
uuucuaaaucccaucuugauauacuaugaauacucuagaaugauguaaagcagauaggaaug

SEQ ID NO: 253359 - RNA, 62 nt, Homo Sapiens
aaucauguacuuuaguuuaauguauaaagauccucuagaaaaugauaauauuguguauuaag

SEQ ID NO: 253360 - RNA, 62 nt, Homo Sapiens
ucugguggucucaagacaagaacaagagcugacucuagaaucuucugccuggcugaccucug

SEQ ID NO: 253361 - RNA, 62 nt, Homo Sapiens
gucagugauggcaacaggauggccaaggauggcucuagaacacucuguccaugcgucacucc

SEQ ID NO: 253362 - RNA, 62 nt, Homo Sapiens
uguccuguccaaugcgggggcacugcagaacucucuagaaaugucaugauugagcuucagag

SEQ ID NO: 253363 - RNA, 62 nt, Homo Sapiens
uccacuuuggagaauacucaagugacacuacacucuagaauuacugaauaaucuuugccugg

SEQ ID NO: 253364 - RNA, 62 nt, Homo Sapiens
uuguuuugaacauccuuguacaauaaaguuuucucuagaauauuuauuuuguuuucaaccau

SEQ ID NO: 253365 - RNA, 62 nt, Homo Sapiens
uauggaaaugcacccucccuccugccgcuccucucuagaaccuucuagaaccugggcugugc

SEQ ID NO: 253366 - RNA, 62 nt, Homo Sapiens
cuaagggugccaagagacugguuagucaaagccucuagaaggggauccucguugaaaggagc

SEQ ID NO: 253367 - RNA, 62 nt, Homo Sapiens
auaucuauaaaacaaacauaguaucugucaaucucuagaaaccacaagaugauggagagguc

SEQ ID NO: 253368 - RNA, 62 nt, Homo Sapiens
uguagggacccugccaaguggcaccugauuuacucuagaaaauaaaaguagaaaauacugag

SEQ ID NO: 253369 - RNA, 62 nt, Homo Sapiens
ucccugaaguauuuaauaagaagcauuuugcacucuagaaaguauguuuguguugguuuuuu

SEQ ID NO: 253370 - RNA, 62 nt, Homo Sapiens
guagauuacuuaucagaaaacauauaugucaucucuagaacgaagaaaaagcauaguaguuc

SEQ ID NO: 253371 - RNA, 62 nt, Homo Sapiens
guaggguauaguaucacuccugaguuccacugcucuagaaucuaaccagaaauagaaaccua

SEQ ID NO: 253372 - RNA, 62 nt, Homo Sapiens
guggcguuggugaacggacccagcucacugcucucuagaaacccugcucaccauuggagaau

SEQ ID NO: 253373 - RNA, 62 nt, Homo Sapiens
acuucugaugcaugaaaaaugugguucuggagcucuagaaaccaggacgugaugagguacuc

SEQ ID NO: 253374 - RNA, 62 nt, Homo Sapiens
ggugcagacaucccgucugauuaacacagagucucuagaagaauguucagucggucguguuu

SEQ ID NO: 253375 - RNA, 62 nt, Homo Sapiens
ggcaaguguccagaugccagaaccuucuuuuccucuagaagggauggugcuugguaaccuua

SEQ ID NO: 253376 - RNA, 62 nt, Homo Sapiens
uguaugucgauugauaucgcugcuacaucagacucuagaaaaaagggcugagaggaagcaag

SEQ ID NO: 253377 - RNA, 62 nt, Homo Sapiens
auaauuccucaagcaugagaccuugcuaagcacucuagaauaaguuuuauguucugcucaca

SEQ ID NO: 253378 - RNA, 62 nt, Homo Sapiens
acaaaagugcaaauuucucauuuccugugggucucuagaaacucucucaauauuuaaagcca

SEQ ID NO: 253379 - RNA, 62 nt, Homo Sapiens
gggcuugguaagugaauuuaugagauuuacugcucuagaaaguauagauggccaaaggaccg

SEQ ID NO: 253380 - RNA, 62 nt, Homo Sapiens
uauacauugauauuuauucuuguuuauuaucacucuagaagucaucugagaugggguccugu

SEQ ID NO: 253381 - RNA, 62 nt, Homo Sapiens
ccacugacuuuagugggucuacacuuagagcucucuagaaucuuuuuguaacuuuacgcagg

SEQ ID NO: 253382 - RNA, 62 nt, Homo Sapiens
cuacuuacaguugaccaagcuuuuagccugcucucuagaaccaugcccauuugauccuaacc

SEQ ID NO: 253383 - RNA, 62 nt, Homo Sapiens
uccuucuguuggaggcccucgcuuuuccuccucucuagaaccguacggcccccucuuugcag

SEQ ID NO: 253384 - RNA, 62 nt, Homo Sapiens
cugcucccucugcagggggucuuccaccucagcucuagaagcucaggcccccagcccugugg

SEQ ID NO: 253385 - RNA, 62 nt, Homo Sapiens
uaaaucucuccugugucuuaaaauauauaucacucuagaaaaaaaaaaagaaaaagaacaaa

SEQ ID NO: 253386 - RNA, 62 nt, Homo Sapiens
aacgaguuauucacaccagcuauuuauaagggcucuagaaaaaaacacuaacugggggauuu

SEQ ID NO: 253387 - RNA, 62 nt, Homo Sapiens
ugcugcuacuagaaaugucugcuacacgagcucucuagaaacaaaaaaaaguuuguuaaaag

SEQ ID NO: 253388 - RNA, 62 nt, Homo Sapiens
cgagccgucacaccucaggcgacaccaggccacucuagaagcggggccauuagaaugaggca

SEQ ID NO: 253389 - RNA, 62 nt, Homo Sapiens
uccccuggcaugaaacuuucagauuccccugccucuagaaauuguccugcccuccucaccac

SEQ ID NO: 253390 - RNA, 62 nt, Homo Sapiens
acccaugguucucagcuggggugacacugcuccucuagaagcagguuugaaauuauggguau

SEQ ID NO: 253391 - RNA, 62 nt, Homo Sapiens
uguaaaggcccugucccaauaagcuguguucacucuagaaggcuggcuuuuuguugauuauu

SEQ ID NO: 253392 - RNA, 62 nt, Homo Sapiens
caagguuuuguuuguuaauuaacuuccauguucucuagaaauacauucuccuugucugguau

SEQ ID NO: 253393 - RNA, 62 nt, Homo Sapiens
cguacguaugcacccacagaugguaacuucuacucuagaauauuucuggugugugaacuuua

SEQ ID NO: 253394 - RNA, 62 nt, Homo Sapiens
agaacccagcccagaucggaggacaaguuccucucuagaacccaauccaauuuggagcccca

SEQ ID NO: 253395 - RNA, 62 nt, Homo Sapiens
gagccccagcccaacuccagaacccaacccuucucuagaauccagcccagaucugaggccaa

SEQ ID NO: 253396 - RNA, 62 nt, Homo Sapiens
gugguccaaaugcggaucacuggucagauggacucuagaagcacugagcucccugucucugg

SEQ ID NO: 253397 - RNA, 62 nt, Homo Sapiens
caaaaagccucaugcauagcgggucauguagucucuagaaaauacauaaccugauggaaaug

SEQ ID NO: 253398 - RNA, 62 nt, Homo Sapiens
uuauuuauauccuauuuuuucucaccccaucucucuagaaacaccuauaaaggcuauuauug

SEQ ID NO: 253399 - RNA, 62 nt, Homo Sapiens
uguauaagauccuagauccuaagggucgaaagcucuagaaucugcaauucaaaaguuccaag

SEQ ID NO: 253400 - RNA, 62 nt, Homo Sapiens
cugccgugauggauucuguuugacguauuguucucuagaaggccuggcucugauccagugac

SEQ ID NO: 253401 - RNA, 62 nt, Homo Sapiens
ugcugcugauggagaccagggcccucuggcgucucuagaaacuccccacccucugcccccca

SEQ ID NO: 253402 - RNA, 62 nt, Homo Sapiens
ggagagagguccagauugcgaagcagacaacacucuagaacuugacggaggaauuaacacaa

SEQ ID NO: 253403 - RNA, 62 nt, Homo Sapiens
agaugguaucugaaguccuuggucagcuacgucucuagaauacagccccuccccuacuuuuu

SEQ ID NO: 253404 - RNA, 62 nt, Homo Sapiens
aggauguuggggaaaauccccaguuuccccaucucuagaauguuguuucucucccugggccu

SEQ ID NO: 253405 - RNA, 62 nt, Homo Sapiens
uucucuaaaauuguacucagauuuuuauuuaucucuagaagugaaauucaguaauauuugac

SEQ ID NO: 253406 - RNA, 62 nt, Homo Sapiens
uaagcuuggugaaagaaggguaaauccauguucucuagaaugaguacagugaugagcaugcc

SEQ ID NO: 253407 - RNA, 62 nt, Homo Sapiens
uaauacuugguaauuauacuagucacagaucacucuagaaucagacuguucugggguagcag

SEQ ID NO: 253408 - RNA, 62 nt, Homo Sapiens
gggguuacuucuccccugggcccucuggucuacucuagaagaccccaggaauggggaacucu

SEQ ID NO: 253409 - RNA, 62 nt, Homo Sapiens
uucaaaucucucccaacucuuucaagguccuccucuagaagucccaucuccuuucagaaaaa

SEQ ID NO: 253410 - RNA, 62 nt, Homo Sapiens
auauuggcugucaucaaagguuggagaaaccccucuagaaacaggcccuggguucaagagag

SEQ ID NO: 253411 - RNA, 62 nt, Homo Sapiens
aaauuccuuaacugagcuauacuugguacuugcucuagaacauuugggaaaugacaaacuca

SEQ ID NO: 253412 - RNA, 62 nt, Homo Sapiens
ucucuuccagcaccaucaggguuuuaauggcccucuagaauuaccacugagauacacuauuu

SEQ ID NO: 253413 - RNA, 62 nt, Homo Sapiens
ccacaguaggccucucuuugggguccuugggccucuagaagggaagaaucugggccaaccag

SEQ ID NO: 253414 - RNA, 62 nt, Homo Sapiens
guaagaaauaaauauuugcuggacuucccagccucuagaacuucugcuggugccuugaucuu

SEQ ID NO: 253415 - RNA, 62 nt, Homo Sapiens
uaacccugggaaaagggcauuuaguuuggauccucuagaaacaagggcccaaggacagugcc

SEQ ID NO: 253416 - RNA, 62 nt, Homo Sapiens
uaaauuuaugaaaauacaaaaucuucuucucccucuagaauaguauaacuuauuuucuuauu

SEQ ID NO: 253417 - RNA, 62 nt, Homo Sapiens
ugcuuuguuuuguaagaacuacacagugaaaucucuagaaucgcguggaaggagcaaugcag

SEQ ID NO: 253418 - RNA, 62 nt, Homo Sapiens
cauccaggugucggagcuaacagccugucauucucuagaacaguuaaaccaaacuacagucu

SEQ ID NO: 253419 - RNA, 62 nt, Homo Sapiens
agcugggcucucagcuauuuacacccccuucucucuagaaaggucagggacccccauaaagg

SEQ ID NO: 253420 - RNA, 62 nt, Homo Sapiens
agacgggggcugcuucuccucuucaguauggacucuagaaagucuggcuacaugaauagauu

SEQ ID NO: 253421 - RNA, 62 nt, Homo Sapiens
gugcuaacuugggccagcgggguuugggguaucucuagaaaacagcaacugaacagagcucc

SEQ ID NO: 253422 - RNA, 62 nt, Homo Sapiens
gcgugacccaggccccuguagcccucagccuccucuagaagcuucuguacuccuuguaggau

SEQ ID NO: 253423 - RNA, 62 nt, Homo Sapiens
gccguggccacccccgcugcccagugucugcccucuagaaguaggcuguguuuccagguguu

SEQ ID NO: 253424 - RNA, 62 nt, Homo Sapiens
cauggaaauuaaguguuucguuucccauucuacucuagaaagaaacaggaaagucgcauuau

SEQ ID NO: 253425 - RNA, 62 nt, Homo Sapiens
auuuuuaagaaggagggaauguuuuuuaguagcucuagaaaccaacuauuuuguaaaugcaa

SEQ ID NO: 253426 - RNA, 62 nt, Homo Sapiens
aacauucugugucaccagcacuguccccugggcucuagaaaggaccagcucagaggaugggg

SEQ ID NO: 253427 - RNA, 62 nt, Homo Sapiens
aagaggcugggggacuagaaagaggcccugcccucuagaaagcucagaucuuggcuucuguu

SEQ ID NO: 253428 - RNA, 62 nt, Homo Sapiens
cuuccaagaaugccucuguggugcuguuuggucucuagaaacagggucacuuuuuuaaugua

SEQ ID NO: 253429 - RNA, 62 nt, Homo Sapiens
gacugcugcuguuaaaaaacaugcauuagaaucucuagaacacgaggaaaaacagggucuug

SEQ ID NO: 253430 - RNA, 62 nt, Homo Sapiens
ugugcaaugauuguuaaauuauacugaaguagcucuagaaagacacauguauacaaggcacu

SEQ ID NO: 253431 - RNA, 62 nt, Homo Sapiens
ccguaguagauguucuacuuuguucugcuguucucuagaaagaauauuugguuuuccuguau

SEQ ID NO: 253432 - RNA, 62 nt, Homo Sapiens
acacaucagcauaugagaaucucugagagguccucuagaaaggagagaaaaagcaccucuuu

SEQ ID NO: 253433 - RNA, 62 nt, Homo Sapiens
gauucauauauuacaucaacuucccuuuuuaacucuagaaauucucaguaugggguuucccu

SEQ ID NO: 253434 - RNA, 62 nt, Homo Sapiens
ggguuccuauggccuuguuggagggggccaggcucuagaacgucuaacacaguggagaaccg

SEQ ID NO: 253435 - RNA, 62 nt, Homo Sapiens
ugaucacgaucauauuguagucucucaaagugcucuagaaauugucagugguuuacaugaag

SEQ ID NO: 253436 - RNA, 62 nt, Homo Sapiens
aagaaaaguguuuuuagaaauuugagagugaccucuagaaaaacuauagugauauaucagug

SEQ ID NO: 253437 - RNA, 62 nt, Homo Sapiens
agcaagacugggccccacauagcuuuagcucucucuagaaugccacccaguagcccagagug

SEQ ID NO: 253438 - RNA, 62 nt, Homo Sapiens
uuaagccuuuguugaacugugugguuuucaaccucuagaauuguugugcaggagguagccug

SEQ ID NO: 253439 - RNA, 62 nt, Homo Sapiens
cugucuaacauaccacaugauauaccugauuccucuagaaggguuuggaguaagggacuuca

SEQ ID NO: 253440 - RNA, 62 nt, Homo Sapiens
gauguugaaaucuuugccucacuguggcuagucucuagaauggauauauuacuacuuauaau

SEQ ID NO: 253441 - RNA, 62 nt, Homo Sapiens
caagccccaugagcagcaguagauggugagggcucuagaaacgugaacugaggaaggugcuu

SEQ ID NO: 253442 - RNA, 62 nt, Homo Sapiens
acuauagugauauaucaguguuugggagugaccucuagaaaaaagaaaacuguuuuuagaaa

SEQ ID NO: 253443 - RNA, 62 nt, Homo Sapiens
ggggcgcauugcgauccaacggccggggaaggcucuagaaaagccgcauccugccuguagau

SEQ ID NO: 253444 - RNA, 66 nt, Homo Sapiens
agaagaccguacucaguaacaggccggaaaauugugcucuagaagaauaaaacugaaaaacucuag

SEQ ID NO: 253445 - RNA, 66 nt, Homo Sapiens
ggucauaagguaaacauucuauauauucuaugccugcucuagaauugaaagacuucagcaguauua

SEQ ID NO: 253446 - RNA, 66 nt, Homo Sapiens
aaacuccacaucugccuuaaaaccaaagagggcuuccucuagaagccaagggaaaggggugcuuuu

SEQ ID NO: 253447 - RNA, 66 nt, Homo Sapiens
agaaggaacauuauggagagaaaggguacugaggcacucuagaaucugccacauucauuuucaaau

SEQ ID NO: 253448 - RNA, 66 nt, Homo Sapiens
gugaggcagcuggaauuggaacucagauuuguugaacucuagaacuaaagaucauaauguugucuu

SEQ ID NO: 253449 - RNA, 66 nt, Homo Sapiens
aguuucagaguucaaggaagaagcaaaauaucacaucucuagaaguguugggaaaaauauaauuuc

SEQ ID NO: 253450 - RNA, 66 nt, Homo Sapiens
uuuacuccuaaguuauuucucauagaacccagccuacucuagaauuucagcagugacauuggagaa

SEQ ID NO: 253451 - RNA, 66 nt, Homo Sapiens
ucaaaauacaccagcucauuuggcugcucagucuaacucuagaauggaugcuuuugaauucauuuc

SEQ ID NO: 253452 - RNA, 66 nt, Homo Sapiens
uguuagagaggaauuaacuuccuggucugugcccuucucuagaagaauauaagaugcuccuccucc

SEQ ID NO: 253453 - RNA, 66 nt, Homo Sapiens
cuggcugggaggaaagugcugggcaucuuacaguaacucuagaaguuccuuugacuaggcugcaau

SEQ ID NO: 253454 - RNA, 66 nt, Homo Sapiens
acccugaagccauuggagagcugucuuccuguguaccucuagaaucccagcagcagagaaccauca

SEQ ID NO: 253455 - RNA, 58 nt, Homo Sapiens; identical to SEQ ID NO: 102991

SEQ ID NO: 253456 - RNA, 66 nt, Homo Sapiens
acauucucccuugcuugaugucuucuuuuccugucccucuagaagagagagaaguauguggacauc

SEQ ID NO: 253457 - RNA, 66 nt, Homo Sapiens
agguuucacaaccgagaugccgggagcagggagaggcucuagaacagucuuaagauccucacagca

SEQ ID NO: 253458 - RNA, 66 nt, Homo Sapiens
gccaucucaauugugcuuuggguuugaagcugcugucucuagaagucaucucauuacccuuuucug

SEQ ID NO: 253459 - RNA, 66 nt, Homo Sapiens
cccacuggccaguccuagaguccaaccccagcuggccucuagaacaaaguguccagaccauugucu

SEQ ID NO: 253460 - RNA, 66 nt, Homo Sapiens
uccagaaagguggagggcugacugugcuacaauuaucucuagaauccuguguuaucaaggaauugu

SEQ ID NO: 253461 - RNA, 66 nt, Homo Sapiens
ucagguucccugccacacuaugggcucccuggaggacucuagaagcgugaguccugauccuaaccc

SEQ ID NO: 253462 - RNA, 66 nt, Homo Sapiens
gcaguauucaaccuuuuagccucccgcuuuuucuugcucuagaagaggcucuguuuugcccagggg

SEQ ID NO: 253463 - RNA, 66 nt, Homo Sapiens
uccauauuuauuuuuauguucucuaggccuucaggacucuagaaugguccagacuauggauguguu

SEQ ID NO: 253464 - RNA, 66 nt, Homo Sapiens
uugacauucucugugggggacuguugcaguaacaaacucuagaauauugcaguaacaaacuccagu

SEQ ID NO: 253465 - RNA, 66 nt, Homo Sapiens
cccacauuuccaccaacucacuauauuagggcaguucucuagaacgucaucccucuuagcuguagu

SEQ ID NO: 253466 - RNA, 66 nt, Homo Sapiens
uggauaauaaagaugcuuauuaugcagagccauuuccucuagaauucagcuaguagguucugcugu

SEQ ID NO: 253467 - RNA, 66 nt, Homo Sapiens
gaaugaaggauugaagaauuaagcgaugaagaaugucucuagaagauuaaugacaauguagcuuga

SEQ ID NO: 253468 - RNA, 66 nt, Homo Sapiens
uagauuuucacuucuuuugacauuuuugaagagagucucuagaauaaauugaauauauugguugcu

SEQ ID NO: 253469 - RNA, 66 nt, Homo Sapiens
cauaugauaugauaauccuaccaauuuucaagaagucucuagaaagagauaacacauggaaagacg

SEQ ID NO: 253470 - RNA, 66 nt, Homo Sapiens
aaagccagccauauuacucuagucccuaccaaacugcucuagaaggucauuuccauuuuguuugug

SEQ ID NO: 253471 - RNA, 66 nt, Homo Sapiens
aagauugaaaguaagaaaacggauuuaggaugaaaacucuagaacuacccuaugcuguuuauacug

SEQ ID NO: 253472 - RNA, 66 nt, Homo Sapiens
caacuacagucagauuuauagccagccaucuaucaccucuagaagguuccagagacagugaaacug

SEQ ID NO: 253473 - RNA, 66 nt, Homo Sapiens
ggauccucuuuaaaaaaaaaaaaguuuuuguuauaucucuagaacauuucaagucuuuuccuuuuu

SEQ ID NO: 253474 - RNA, 66 nt, Homo Sapiens
agccacagaacguauagaguuaaccaaagugcucuucucuagaaucuuuacaccuccugugugguu

SEQ ID NO: 253475 - RNA, 66 nt, Homo Sapiens
ucuaguccccuaaauuucuguucuaguuuuaaauuucucuagaacuugcaauaguuggggguuuua

SEQ ID NO: 253476 - RNA, 66 nt, Homo Sapiens
caagucucggccuccacauuaaccauaggauguugacucuagaaccuggacccacccagcgcgucc

SEQ ID NO: 253477 - RNA, 66 nt, Homo Sapiens
ucuuuuaauuuucuugugagauaauauucuaagaggcucuagaaacaugaaauacucaguagugau

SEQ ID NO: 253478 - RNA, 53 nt, Homo Sapiens; identical to SEQ ID NO: 103014

SEQ ID NO: 253479 - RNA, 66 nt, Homo Sapiens
cugaggacaccauguacuauaaccaguuaaauggaacucuagaauaucaagggagcaagaggaagc

SEQ ID NO: 253480 - RNA, 66 nt, Homo Sapiens
uguaaucaaaaacaaagaagcccuauaagaccauuucucuagaacagauguucuuaauauuuuucu

SEQ ID NO: 253481 - RNA, 66 nt, Homo Sapiens
guuuggagcauguggucuuuuuaaaaaauuguaacccucuagaaaauaucaaagaaaugaaccaga

SEQ ID NO: 253482 - RNA, 66 nt, Homo Sapiens
aaagaacacuaccacugcaagugcuuugacaguuaacucuagaaagaacaguuacugagaauuguu

SEQ ID NO: 253483 - RNA, 66 nt, Homo Sapiens
uaguggcgggucugggcuggccugagagacacccuccucuagaauuugaagaaaaaaguacuguga

SEQ ID NO: 253484 - RNA, 66 nt, Homo Sapiens
guuuuggagcucgagaucuucaaucaaaauggugggcucuagaaugcaucugaaacacauguguaa

SEQ ID NO: 253485 - RNA, 66 nt, Homo Sapiens
uuacauugauuaaaauguuaguguguuucagcaaaucucuagaaaugauggucuccauucaggcaa

SEQ ID NO: 253486 - RNA, 66 nt, Homo Sapiens
uguaucuuuuuaugauuuaguuuuggcagauaauuccucuagaaugaucuuugauaauuguuauuu

SEQ ID NO: 253487 - RNA, 66 nt, Homo Sapiens
ugggauggacuuacuauucugcaugagcuaccucaucucuagaagcaaaugacccaacauuucuua

SEQ ID NO: 253488 - RNA, 66 nt, Homo Sapiens
gaauccugucuuaaaacugguacuguuguguaaugucucuagaaagccagaaacaccuuaagugua

SEQ ID NO: 253489 - RNA, 66 nt, Homo Sapiens
uauuacuuuguucucccauguaaagaaauacuauugcucuagaaugguccugcuaccuaaaggaua

SEQ ID NO: 253490 - RNA, 66 nt, Homo Sapiens
cuaguacacuggcaucaucuaagauuaugccuacaucucuagaagaaaaggccuagaaccaguuuu

SEQ ID NO: 253491 - RNA, 66 nt, Homo Sapiens
gcugccugggcccaaggggugaugaggcauccuuuccucuagaagaccugagucuuccugaccgac

SEQ ID NO: 253492 - RNA, 66 nt, Homo Sapiens
cuucuagacaaaaaccauuguugaugaggcagaugccucuagaagagacguuuaaaagccaucaaa

SEQ ID NO: 253493 - RNA, 66 nt, Homo Sapiens
gagaaguuccacaucaucuuaucgaucaagaagcuacucuagaagucggagcagaggaugguacag

SEQ ID NO: 253494 - RNA, 66 nt, Homo Sapiens
uauuguccuguugccaaacaaaagccagucauguaacucuagaagcagugacugguggggcuuucu

SEQ ID NO: 253495 - RNA, 66 nt, Homo Sapiens
auugugaugcuucuggggcacguugaccauaugcaccucuagaaccuaaccagggcuuccuucuac

SEQ ID NO: 253496 - RNA, 66 nt, Homo Sapiens
caugagagcguuccuugaguccguacaccguccucccucuagaagcuggcaucacacucaugcugg

SEQ ID NO: 253497 - RNA, 66 nt, Homo Sapiens
uaauaugaaguuccccaaggaaacgaacaaaaugaacucuagaauaucuagcaaauaguuaaagaa

SEQ ID NO: 253498 - RNA, 66 nt, Homo Sapiens
aguugcauggaagagaacaccucuuuauggcuuacccucuagaauuucuaauuuauguguucuguu

SEQ ID NO: 253499 - RNA, 66 nt, Homo Sapiens
ucuagcaccugggucccagcaucuagagcauggagccucuagaagccaugcucacccgcccacauu

SEQ ID NO: 253500 - RNA, 66 nt, Homo Sapiens
acacaucaggaaagagagcaccacgugauggaguuucucuagaagcuccagugauaagagauguug

SEQ ID NO: 253501 - RNA, 66 nt, Homo Sapiens
uggaagugugacucaaucuugccugccuucugggagcucuagaauuguucccaacccaguccaugg

SEQ ID NO: 253502 - RNA, 66 nt, Homo Sapiens
ucgucccuuccccagagaccuucagugccauccugacucuagaaggccccccacagcagggcguag

SEQ ID NO: 253503 - RNA, 66 nt, Homo Sapiens
uggccuugaaagaaccgaagucuuucccauucacuucucuagaaagcugccaagacagaggcagaa

SEQ ID NO: 253504 - RNA, 66 nt, Homo Sapiens
cgaagggaggaggagcacaaguccucugggaaguuacucuagaaaacuuggcaggcuccaggcagg

SEQ ID NO: 253505 - RNA, 66 nt, Homo Sapiens
gaauuugcaggcaaccauguguuuugcguuuacuuccucuagaaaaagcaaaacauaaccauaugu

SEQ ID NO: 253506 - RNA, 66 nt, Homo Sapiens
auuucaaacaauuaaaauaauaaagagcuucuuuggcucuagaaaauuuggaagaaacaacuucuu

SEQ ID NO: 253507 - RNA, 66 nt, Homo Sapiens
ggagaccgauuuacaauuuaauaagaaaauuguguacucuagaaauuaagaaauaauuuuuuucaa

SEQ ID NO: 253508 - RNA, 66 nt, Homo Sapiens
accaccaaacaugacuguucccaacugcugauguugcucuagaaaacauuacuccuccuccagaua

SEQ ID NO: 253509 - RNA, 66 nt, Homo Sapiens
cugaggacaguuucuuuugauugaaacccucuaggucucuagaacaacugauuaggauuugauuuc

SEQ ID NO: 253510 - RNA, 66 nt, Homo Sapiens
aaauauuuaguaaagcuuuaaagucaauagauguuucucuagaacaaugggacuuuauuuucacau

SEQ ID NO: 253511 - RNA, 66 nt, Homo Sapiens
uuaagugcuuuguaaugggauggaauauuccccuaucucuagaauucacuuaaaaaauguccauga

SEQ ID NO: 253512 - RNA, 66 nt, Homo Sapiens
aagguaauuuuacacaugcuggaaugacuguaauuacucuagaauuccaaguagaauacaauaacu

SEQ ID NO: 253513 - RNA, 66 nt, Homo Sapiens
aaagauaacucuuaaaaaaccgucgagauuacaaugcucuagaaucagcauauaagaaaauaaaug

SEQ ID NO: 253514 - RNA, 66 nt, Homo Sapiens
aauacaauauuacauuacagccuguauucauuuguucucuagaaguuuugucagaauuuugacuug

SEQ ID NO: 253515 - RNA, 66 nt, Homo Sapiens
ccuauuguaacuacacugggcaucagaauaaaaggccucuagaaauugcugaacaaugguuaauua

SEQ ID NO: 253516 - RNA, 66 nt, Homo Sapiens
agcucucuccuucauuaauuuaaauauuuuuaucggcucuagaaaaugcauaagguuaguacaaga

SEQ ID NO: 253517 - RNA, 66 nt, Homo Sapiens
augaacaaagguuaauuuaauuuuaauuauuuaaaacucuagaaaguuucacucucugcacugacu

SEQ ID NO: 253518 - RNA, 66 nt, Homo Sapiens
caucugucuguauugaucuuaugagaacauuucugucucuagaaguacaacuauucuguugugacu

SEQ ID NO: 253519 - RNA, 66 nt, Homo Sapiens
agaaagcaauuuuuaggcaguccuguccuauauacccucuagaaaccccauucuccuauuuaccag

SEQ ID NO: 253520 - RNA, 66 nt, Homo Sapiens
ugugcgagcacaacacacacagaugaaagauuuuuacucuagaaaccuaagugucacauuucucua

SEQ ID NO: 253521 - RNA, 66 nt, Homo Sapiens
agaaccagcucuacgagaguccucguuucccuuuuccucuagaagccugcagcuuugggaaagcug

SEQ ID NO: 253522 - RNA, 66 nt, Homo Sapiens
uugaaugcccugacucuaccagcgcccauaaaugaucucuagaaggacuguuaguaccaaucuguu

SEQ ID NO: 253523 - RNA, 66 nt, Homo Sapiens
aacaaaauauaccauaggcuaaaacuaaggcuuucacucuagaaugcaaagcuguuuugcagcugu

SEQ ID NO: 253524 - RNA, 66 nt, Homo Sapiens
ugauucccaucugcugcucuuuguagaaaagguuuccucuagaacugaauuccucuggaauugagu

SEQ ID NO: 253525 - RNA, 66 nt, Homo Sapiens
cuguguaaacauugagcucaccuuuuauauauuaaccucuagaauuaaugggccuaugugguuuuu

SEQ ID NO: 253526 - RNA, 66 nt, Homo Sapiens
uaauugugcuuuuuuuuuuuccuugguagguagcuucucuagaauuaaauaaaauauuuagcccuu

SEQ ID NO: 253527 - RNA, 66 nt, Homo Sapiens
gacauaaagguuuauggggacaucuuguaauauaugcucuagaaauuuauacuuugccaaagcugu

SEQ ID NO: 253528 - RNA, 66 nt, Homo Sapiens
gcagaaauuaggaaggugauuucuuccuugaauuuucucuagaaaucuagaaccugaaauauuguu

SEQ ID NO: 253529 - RNA, 66 nt, Homo Sapiens
uaaagcugaaaucugcaaauuaucuuuaaaauauaucucuagaacuagggugaaucuuguuuuuuu

SEQ ID NO: 253530 - RNA, 66 nt, Homo Sapiens
cuuagccugggcaccuggcuugcccugucucccugucucuagaagcacaaaccucaagggauuuag

SEQ ID NO: 253531 - RNA, 66 nt, Homo Sapiens
gauuacuuaagacugugucagucuuacuauauacuucucuagaagaaaaugaaaugggaaucagug

SEQ ID NO: 253532 - RNA, 66 nt, Homo Sapiens
ggacuaaacuuauucucucaaccgagaagguucuagcucuagaaagucccauggugggaaacagcc

SEQ ID NO: 253533 - RNA, 66 nt, Homo Sapiens
ccaguucuuacccaguuaacaugaagaaaccacugucucuagaagaaagcuuguuuugcaguauua

SEQ ID NO: 253534 - RNA, 66 nt, Homo Sapiens
ugugaccaguugcacauguuuuccccuaaaagcuuacucuagaaaggauauuuuuuggagagggag

SEQ ID NO: 253535 - RNA, 66 nt, Homo Sapiens
uuuccuuaucucccucagacgcagaguuuuuaguuucucuagaaauuuuguuucauauuaggaaua

SEQ ID NO: 253536 - RNA, 66 nt, Homo Sapiens
auggaucauuaagaugaagagaguaauucacauuuacucuagaaccuuuaacaagcacugaaagga

SEQ ID NO: 253537 - RNA, 66 nt, Homo Sapiens
uucugucacaggauuaauuaauugccgguuuucauacucuagaaggcugaaacugauguuuaucuu

SEQ ID NO: 253538 - RNA, 66 nt, Homo Sapiens
gaauaauauauuucacaucuuuauuauugcaguuuucucuagaaagcucugagaagcuuucucugc

SEQ ID NO: 253539 - RNA, 66 nt, Homo Sapiens
auucauugaggaacuguugauuggcaggcacugauucucuagaacacugggcaugaggauguugca

SEQ ID NO: 253540 - RNA, 66 nt, Homo Sapiens
cuuuacuuuucagguaauuauggaaaauauuuuaaacucuagaagcuucaauaaugaugugugauu

SEQ ID NO: 253541 - RNA, 66 nt, Homo Sapiens
guuucucugugugcuuugugguugcugucauauuugcucuagaagaaaaaaaaaaaaggaggggaa

SEQ ID NO: 253542 - RNA, 66 nt, Homo Sapiens
cuacacauuuuauacuuuucauaaaccacaaagucucucuagaauuuuuucugccuucacuaaaau

SEQ ID NO: 253543 - RNA, 66 nt, Homo Sapiens
ccagcuccugggcucaagugauccucuagacucagccucuagaauagcugggacuacaggcacaug

SEQ ID NO: 253544 - RNA, 66 nt, Homo Sapiens
ccaguccccuuucucgggguuagcacaugauuugggcucuagaauuacucagccuuuugggaauaa

SEQ ID NO: 253545 - RNA, 66 nt, Homo Sapiens
uuccuuggcacauauaaaagguuuuucucaaaaaugcucuagaacugucuuguucuucaguauuuu

SEQ ID NO: 253546 - RNA, 66 nt, Homo Sapiens
auuuaguuuguguuaacuauuucauguaaucacauucucuagaaccuucuuccaauaauguuagag

SEQ ID NO: 253547 - RNA, 66 nt, Homo Sapiens
ggcacaagaauggcuaaagcucagaugaaacuaaaucucuagaagauugaagaggucuugcagucu

SEQ ID NO: 253548 - RNA, 66 nt, Homo Sapiens
aucagaaucaaguuguggguuuguucuuaugaaugacucuagaaaaaagaaaggauccacuacuuc

SEQ ID NO: 253549 - RNA, 66 nt, Homo Sapiens
ccaaaugccccgaguuaagauucuuuccaaaaggaacucuagaagaaaacuucacuaaugaucaca

SEQ ID NO: 253550 - RNA, 66 nt, Homo Sapiens
gucacgugaaauauuuaaguauauaguauauuuauacucuagaacaugcacauuuauauauauaug

SEQ ID NO: 253551 - RNA, 66 nt, Homo Sapiens
uaaaaaaccuaaacucuucaggcuaccuuugugugucucuagaagagaaaagcaucuaucuggaga

SEQ ID NO: 253552 - RNA, 66 nt, Homo Sapiens
cacugaauaaacaucagaguauuuuaaaaaacaguucucuagaaagaacuguuauaauuaaaauga

SEQ ID NO: 253553 - RNA, 66 nt, Homo Sapiens
agaaaacuccugugcuuuugagcaaggacuuuugcccucuagaaagcaacugaggccaggugcggu

SEQ ID NO: 253554 - RNA, 66 nt, Homo Sapiens
uauacugugucaaaaugauaauuuuguuauguuagccucuagaaaauuuaaguucagaaaaaugca

SEQ ID NO: 253555 - RNA, 66 nt, Homo Sapiens
ucuugcuuauagaggcaaaccacaguaucauuuuaacucuagaauugggcuuguacagaaggauaa

SEQ ID NO: 253556 - RNA, 66 nt, Homo Sapiens
cuuauuguaauuuuccuacuuguaauuuauagagaucucuagaauuaggauuuugagucauagguc

SEQ ID NO: 253557 - RNA, 66 nt, Homo Sapiens
uaccgcagaaauugauguguccucugucuggucuuccucuagaaggcuccuuucaacucuguugac

SEQ ID NO: 253558 - RNA, 66 nt, Homo Sapiens
cugaguaccaugggcuacagcugcuaggcuacccuccucuagaagguuccacucagggcuucuccu

SEQ ID NO: 253559 - RNA, 66 nt, Homo Sapiens
aucucgcaccaccaguuacauccuccuuuccccucucucuagaaucugagaagaccaaaccccaca

SEQ ID NO: 253560 - RNA, 66 nt, Homo Sapiens
guagggaaaauaaugcuuguguaaccugugugcauacucuagaagacuuauugcauugcauucaga

SEQ ID NO: 253561 - RNA, 66 nt, Homo Sapiens
aagggaacagaaagucugccuaaacacuaauaagagcucuagaaaaacagggauuaaaaauaagga

SEQ ID NO: 253562 - RNA, 60 nt, Homo Sapiens; identical to SEQ ID NO: 103098

SEQ ID NO: 253563 - RNA, 66 nt, Homo Sapiens
caauuagggauguuuguuacgccuucccugcuuccucucuagaaucggcaugagccaccgcaccug

SEQ ID NO: 253564 - RNA, 66 nt, Homo Sapiens
ucaaugucuuuguggacauuauguuacuguaguauucucuagaacuuuccguuuucauugucaaga

SEQ ID NO: 253565 - RNA, 66 nt, Homo Sapiens
uuuauccuaagcacuuguuuugccaauauuccauuucucuagaauguguuuaauuuuuaagcucuu

SEQ ID NO: 253566 - RNA, 66 nt, Homo Sapiens
aacccagcuugcuaaauuaggcuauaccuagguaaucucuagaagacaacucugacagacucuuua

SEQ ID NO: 253567 - RNA, 66 nt, Homo Sapiens
auauuuuucaucaugcacgaauuaauaaucaucauacucuagaaucuugucugucacucacuacau

SEQ ID NO: 253568 - RNA, 66 nt, Homo Sapiens
auauuucuagguuuguaagugcagcaguuuuauuuccucuagaacucauccuguuucaagggaagu

SEQ ID NO: 253569 - RNA, 66 nt, Homo Sapiens
ccucuaagaauuuuccacuucuucaaaaugaacuuacucuagaaagcuuacccuuggauaaccagu

SEQ ID NO: 253570 - RNA, 66 nt, Homo Sapiens
aggugcuggugaguauuaccuuucaucugugccaugcucuagaaccuugaccuugauaguucacca

SEQ ID NO: 253571 - RNA, 66 nt, Homo Sapiens
cgugcuuaaugaucaaguguuacuuaucuaauaauccucuagaaagaacccuguuagaucuugguu

SEQ ID NO: 253572 - RNA, 66 nt, Homo Sapiens
gcccuucacuuucuccuggucggggagggcacgaggcucuagaaauggcaggggaaacucuggugc

SEQ ID NO: 253573 - RNA, 66 nt, Homo Sapiens
gaacucucuuucuucucuugggacacucccccugcucucuagaaagccuucuccaccugcccaccg

SEQ ID NO: 253574 - RNA, 66 nt, Homo Sapiens
aaacgucuuuauuuaggagguuaugauagauuugcucucuagaaggucucuucuaguuuugacauu

SEQ ID NO: 253575 - RNA, 66 nt, Homo Sapiens
aucauauugaugaaaucguacccaacaucuuuaugacucuagaauacaaaugcagacucaaaccuu

SEQ ID NO: 253576 - RNA, 66 nt, Homo Sapiens
gcggaccaaacuacuucauuuuuuuuacccagacaacucuagaaauguuuuuguuuuuugguuuuu

SEQ ID NO: 253577 - RNA, 66 nt, Homo Sapiens
cucuaaagaccauguuggaaaaagucacagucguaucucuagaaagcccagugcgugaagaccaac

SEQ ID NO: 253578 - RNA, 66 nt, Homo Sapiens
uagucacaaguauuaauaauuacauaauaugugaugcucuagaaaacugaauuccugcuuguuaau

SEQ ID NO: 253579 - RNA, 66 nt, Homo Sapiens
ucuguauuguguagaaugauauauccuuuagaaaugcucuagaagaccuuaagaccaaaaacugua

SEQ ID NO: 253580 - RNA, 66 nt, Homo Sapiens
gucugaugaaaggccgggaaagggaaaaggagguuucucuagaagacaacaugauagccaauggug

SEQ ID NO: 253581 - RNA, 66 nt, Homo Sapiens
auuaagcuuugucagguuaauguagcauguuaaggacucuagaaaaaaauaaacuaaggagacgag

SEQ ID NO: 253582 - RNA, 66 nt, Homo Sapiens
cuuauauucggggauaugaaggauucaaugaaugaucucuagaaagauuuaaagaagaauauucag

SEQ ID NO: 253583 - RNA, 66 nt, Homo Sapiens
auggguuccacccuaacuuggggaaacaaaagccuucucuagaaucugaaggccaggcuuaccucu

SEQ ID NO: 253584 - RNA, 66 nt, Homo Sapiens
aaauaggaaucaauaguuaguagugacauuggugcucucuagaaaucucagcaugagcugcuauag

SEQ ID NO: 253585 - RNA, 66 nt, Homo Sapiens
cuaacaggccugcuagcucagccgacgcucuggacacucuagaaaucacuccucagugugaccucc

SEQ ID NO: 253586 - RNA, 66 nt, Homo Sapiens
cuccuaguccugaguauaaauccugugcauagauuccucuagaaaggcaucaaaaggcucaacaga

SEQ ID NO: 253587 - RNA, 66 nt, Homo Sapiens
aaaaaauggguucagggucuuguccuuagcuacuagcucuagaaaagucccaaaagcagcagaagg

SEQ ID NO: 253588 - RNA, 66 nt, Homo Sapiens
gacuuuggccuccccccaagaaaagggugaagccaccucuagaagggaaacuggacuguuccuggg

SEQ ID NO: 253589 - RNA, 66 nt, Homo Sapiens
cuguugccacuuacgggggcgcacaccacugcaugucucuagaaugguguuguguguaugguacua

SEQ ID NO: 253590 - RNA, 66 nt, Homo Sapiens
aauuaucuuuuucucuuaauuucaauacaguauucacucuagaaacuacgugucuucuaagagcug

SEQ ID NO: 253591 - RNA, 66 nt, Homo Sapiens
aggccaucucacuagaauagucucucaguuuccuaccucuagaaaguauuaauaguaaagguaaaa

SEQ ID NO: 253592 - RNA, 66 nt, Homo Sapiens
ggagccaggacuaagugagaaagcaauaaagaggaacucuagaacucaaccccaaacuuucaccaa

SEQ ID NO: 253593 - RNA, 66 nt, Homo Sapiens
caguauaaacuuucagaggcggaaguccaaggaaagcucuagaaaauucaauucaggagcuuugaa

SEQ ID NO: 253594 - RNA, 66 nt, Homo Sapiens
cuuaaucuucuagaagaaaaaucuccgaagagcucucucuagaaguccaaaauggcuagccauuau

SEQ ID NO: 253595 - RNA, 66 nt, Homo Sapiens
ggguagcugaugucagcuucauguggauuuuaagcacucuagaaacaaugaagcuucuuggcauau

SEQ ID NO: 253596 - RNA, 66 nt, Homo Sapiens
gacuccugccacuagguuucaccucccaaacccagccucuagaacagccagacccugcagaucccc

SEQ ID NO: 253597 - RNA, 66 nt, Homo Sapiens
aaagacagugucuaaauauaagacaauauugaucagcucuagaauaacuuuaaagaaagacguguu

SEQ ID NO: 253598 - RNA, 66 nt, Homo Sapiens
caguucuuugcauuuggcucuacuuacuaacaaccccucuagaauacauuggugauuucauuuaaa

SEQ ID NO: 253599 - RNA, 66 nt, Homo Sapiens
cuuucuauuucuaaccuaugacuaauaauucuuguucucuagaaagcuuuuguaguacauguuuuu

SEQ ID NO: 253600 - RNA, 66 nt, Homo Sapiens
guaacaaaucagccaauuggcuucauacaguucagccucuagaauguugugaaugguaguugaggu

SEQ ID NO: 253601 - RNA, 66 nt, Homo Sapiens
acacuagacagaugucuccuccaccuccuaccccuacucuagaaacuguaggaauugagcgguucc

SEQ ID NO: 253602 - RNA, 66 nt, Homo Sapiens
ugccuuuuucaaauaucccuguaucuuugucuuuuccucuagaaccacagcaggguucaguuucau

SEQ ID NO: 253603 - RNA, 66 nt, Homo Sapiens
acaucuuuaaaccccuuacacuuucccucuacgucucucuagaauguuccugccacugucccaacu

SEQ ID NO: 253604 - RNA, 66 nt, Homo Sapiens
uaaggagauuuaguuuuacugcuuugacuggugggucucuagaagcaaaacugagugauaacucau

SEQ ID NO: 253605 - RNA, 66 nt, Homo Sapiens
cuuccauaguuuuguuuugguuuauuuuuaacaacgcucuagaaacaaagucaaauuaaucacaaa

SEQ ID NO: 253606 - RNA, 66 nt, Homo Sapiens
gggucucuuuagaacuugauggcugggcacugccaucucuagaauugccacgagucucucucuucc

SEQ ID NO: 253607 - RNA, 66 nt, Homo Sapiens
uugggguguacuaguuacacaucuucaacagacccccucuagaaauuuuucagaugcuucugggag

SEQ ID NO: 253608 - RNA, 66 nt, Homo Sapiens
agcagcagcuguggucauuaaaccauuaguuuaccccucuagaacuggggucugcaaacucccacc

SEQ ID NO: 253609 - RNA, 66 nt, Homo Sapiens
cagcuacagcacuaagagaagccccugagaaaaacccucuagaaaaacagcuguuccucugugugg

SEQ ID NO: 253610 - RNA, 66 nt, Homo Sapiens
cuuuucccucuguggccuccuggcuugcacugcucccucuagaaagauuccuucaggucuggaggc

SEQ ID NO: 253611 - RNA, 66 nt, Homo Sapiens
cucucaguggacaguaugcacucagcugaccacucucucuagaaauagucaagauaugaacuaaga

SEQ ID NO: 253612 - RNA, 66 nt, Homo Sapiens
aacuccccuuaaaaugucuaagauucuauuaaaagccucuagaagucucgccuuguuaugcacaag

SEQ ID NO: 253613 - RNA, 66 nt, Homo Sapiens
uugaguucucauuuuuuuaaucgagaagaguuauugcucuagaaagaccgccuugugcuagugccc

SEQ ID NO: 253614 - RNA, 66 nt, Homo Sapiens
gcaaagccggauuucuggaaaacagaacacugaagacucuagaaaagggaucccggcggcaaggag

SEQ ID NO: 253615 - RNA, 66 nt, Homo Sapiens
cuguccguggaugaguuuagugucagcguccugcugcucuagaagaguacauacucugcuucucuc

SEQ ID NO: 253616 - RNA, 66 nt, Homo Sapiens
caggauguuccuucuauugucaccagcaagagucaacucuagaauuacuaagcugaagguguacuu

SEQ ID NO: 253617 - RNA, 66 nt, Homo Sapiens
aacacauaaaauuuagcaauauuaggucuggaacagcucuagaauguuuuuuuccuuuuuuucuug

SEQ ID NO: 253618 - RNA, 66 nt, Homo Sapiens
gaauugcuaccucuuguaugcuaauuuugagaccaucucuagaaaaccaagugauuuugauguauu

SEQ ID NO: 253619 - RNA, 66 nt, Homo Sapiens
uguuacaagggggagggaagcuucuuuucacuaaaacucuagaagggcuuucacuucaagacuuuc

SEQ ID NO: 253620 - RNA, 66 nt, Homo Sapiens
cuccacccucaucucucugcccaacuggcugucugccucuagaacucuguccuaggcccuagggau

SEQ ID NO: 253621 - RNA, 66 nt, Homo Sapiens
gcagcugguaaaggggugcuggaggccauggaggagcucuagaaacauuagcaugggcugaucuga

SEQ ID NO: 253622 - RNA, 66 nt, Homo Sapiens
guuuuauggcauaugucuccgauuuagaugguuauucucuagaaaauaguauuuaaagacauuuua

SEQ ID NO: 253623 - RNA, 66 nt, Homo Sapiens
caccucauccccaccccaccucaccccaacaaacuccucuagaagaagccaagaauuucucucuau

SEQ ID NO: 253624 - RNA, 66 nt, Homo Sapiens
cuccugaugcuuggaccccuuuuauugaucagagugcucuagaauaauggauggucuuggaugaug

SEQ ID NO: 253625 - RNA, 66 nt, Homo Sapiens
gugucauuauuuuaaugaaugugagcucuugacuuacucuagaauucuaauacagauacuuucugc

SEQ ID NO: 253626 - RNA, 66 nt, Homo Sapiens
agucuauuguuugaucuaguuauuuuaauaaaggaacucuagaaguuucaaguggccagugaagug

SEQ ID NO: 253627 - RNA, 66 nt, Homo Sapiens
augaaauaaguaggacugaguauuuaugugaaaacucucuagaagguaaaaauaaagauaauucuu

SEQ ID NO: 253628 - RNA, 66 nt, Homo Sapiens
cugguuuucuguguaauuccagaugagucacuguaacucuagaagauuaaccuuccagccaaccua

SEQ ID NO: 253629 - RNA, 66 nt, Homo Sapiens
accuccucgcccuuucuuaaagugcaguucuuagcccucuagaaacgaguuggugucuuucgucuc

SEQ ID NO: 253630 - RNA, 66 nt, Homo Sapiens
aaauguacucauuuagacaacucuacuccuuacagucucuagaauuaaagccccaaagcauauaau

SEQ ID NO: 253631 - RNA, 66 nt, Homo Sapiens
agaaauuauggagaaugauucauacaaagaagaaagcucuagaaagaguacuaccuuacgugauag

SEQ ID NO: 253632 - RNA, 66 nt, Homo Sapiens
cauguuuguuuguuuguuuuuuacugacaacacaagcucuagaauuuacacuuaccccacagcugg

SEQ ID NO: 253633 - RNA, 66 nt, Homo Sapiens
uuggcaauguugacuaagaacagucaaaccuuuauccucuagaauuauuagaaaaauguggauaaa

SEQ ID NO: 253634 - RNA, 66 nt, Homo Sapiens
aaguagugaggccguuaauuaaggguggagccaaaucucuagaaauagacauccugaagaaauggu

SEQ ID NO: 253635 - RNA, 66 nt, Homo Sapiens
cuagcagccuaacugcugcuugagaacaaagaugaacucuagaacugcuaacccugacugugggcu

SEQ ID NO: 253636 - RNA, 66 nt, Homo Sapiens
cagaguugcuguuguuuuuucauuugguguuuuccccucuagaaaauacuaccauuugaauauuuu

SEQ ID NO: 253637 - RNA, 66 nt, Homo Sapiens
ucuugccucauugaguguuucauuccuucuuuugggcucuagaaagacuccccagaucucuucccc

SEQ ID NO: 253638 - RNA, 66 nt, Homo Sapiens
aacuuuuaucaagaugaagacauuuuacccuaccuacucuagaaauauacaacaauguuauauuuu

SEQ ID NO: 253639 - RNA, 66 nt, Homo Sapiens
uuagggcuaaugcugcauuuuucuacaacaucaugccucuagaagguuuaagcuagguaggcuuuc

SEQ ID NO: 253640 - RNA, 66 nt, Homo Sapiens
ugucugcguuuacucuuguugcuucaccagacuuuucucuagaagcaaaaucuauuaucaacugcu

SEQ ID NO: 253641 - RNA, 66 nt, Homo Sapiens
auaaagcaaagcacuauuccuggaaauuacugcuuucucuagaaauaugaggaacacugaacuagu

SEQ ID NO: 253642 - RNA, 66 nt, Homo Sapiens
ugggcuuggaccagaucuaaaccccucugcuuuuaacucuagaauuuuuuuuuucagccacuaaga

SEQ ID NO: 253643 - RNA, 66 nt, Homo Sapiens
cagcaggucacacugggggcuaugggcugaaguguucucuagaauccguuggguuuucccuugccu

SEQ ID NO: 253644 - RNA, 66 nt, Homo Sapiens
cagagucugaggauguuaacuuuggaacucgcaguccucuagaacagcuucagauuauggcuuuuu

SEQ ID NO: 253645 - RNA, 66 nt, Homo Sapiens
auugcugcucuccaaugcuaacuuucugacacagugcucuagaacccugccugugguccugagcac

SEQ ID NO: 253646 - RNA, 66 nt, Homo Sapiens
aaaaguugaggaaaugguugggaaucgcuguuagaacucuagaaauucuaaucugacuuugccacu

SEQ ID NO: 253647 - RNA, 66 nt, Homo Sapiens
caggccuggacagccaggggcuccucgggcccugugcucuagaaggcccauucuaugucugcuucg

SEQ ID NO: 253648 - RNA, 66 nt, Homo Sapiens
guagaaaagaaucugaacauuuaagugcgaaguuuucucuagaaauauauucaagauauguuuauu

SEQ ID NO: 253649 - RNA, 66 nt, Homo Sapiens
agauuuauuuugcucgugcuuagcuaaauaugucaucucuagaaaagaugugguuuguuuuggcac

SEQ ID NO: 253650 - RNA, 66 nt, Homo Sapiens
acaccguucaaaugagcguagcccccugagucaucacucuagaagaaucuguacaucaucaggacu

SEQ ID NO: 253651 - RNA, 66 nt, Homo Sapiens
aucaugguguucacucuacauaucagguuauggugucucuagaaucuguuguuuguuuccuauaag

SEQ ID NO: 253652 - RNA, 66 nt, Homo Sapiens
caaaaugaagaccuacuuucaacuccuuuuuccccccucuagaagaaucaaauugaaucuuuuacu

SEQ ID NO: 253653 - RNA, 66 nt, Homo Sapiens
uugaaggugauugguuuucuuuacagacuccuuguucucuagaagggcuuuuuacuugaauaaaac

SEQ ID NO: 253654 - RNA, 66 nt, Homo Sapiens
auaauuaguguuauagucuugcaugucaaaugcauccucuagaaaaauuuuugugaaugagaguug

SEQ ID NO: 253655 - RNA, 66 nt, Homo Sapiens
ucagcacugcacuguuagcuuuuuccuguuucuuggcucuagaagaggccacauagagccucucuc

SEQ ID NO: 253656 - RNA, 66 nt, Homo Sapiens
ggcugcugucauagugaacacuaaugacauuaauaccucuagaaaguucuggagaauuaucacaac

SEQ ID NO: 253657 - RNA, 66 nt, Homo Sapiens
auuuucuuacaguagauaagugguauacauuccacccucuagaagucugaacuugcagguccaggu

SEQ ID NO: 253658 - RNA, 66 nt, Homo Sapiens
cugugaauuucaacauuauuaacuauaacuauaaaucucuagaauuacaaauuggugauacuucua

SEQ ID NO: 253659 - RNA, 63 nt, Homo Sapiens; identical to SEQ ID NO: 103195

SEQ ID NO: 253660 - RNA, 51 nt, Homo Sapiens; identical to SEQ ID NO: 103196

SEQ ID NO: 253661 - RNA, 66 nt, Homo Sapiens
ccguaggucuauccuuagaggcuuuaaugguuuuugcucuagaauaaacgauuuccuguagaagua

SEQ ID NO: 253662 - RNA, 66 nt, Homo Sapiens
guguaccauccaauucgccaagugacugggacccuacucuagaacuccuccugccuccuggggucc

SEQ ID NO: 253663 - RNA, 66 nt, Homo Sapiens
agguuaaacugaagcaacuuucugcauguacuaguccucuagaaaucauucccuguaguugacaau

SEQ ID NO: 253664 - RNA, 66 nt, Homo Sapiens
auccacgcacaugcgaccccgaggaaacgaaacccacucuagaaaacgcgaccuuggccgcaccua

SEQ ID NO: 253665 - RNA, 66 nt, Homo Sapiens
gcuugucugcucccacagcaccaucuaagaccccuccucuagaaguggggaaggccagauguguag

SEQ ID NO: 253666 - RNA, 66 nt, Homo Sapiens
aaaacuauguauauuuaaauuuaguaauuuucuaaucucuagaaaucucugcuguucaaaaggugg

SEQ ID NO: 253667 - RNA, 66 nt, Homo Sapiens
cacauuucuaaaucccaucuugauauacuaugaauacucuagaaugauguaaagcagauaggaaug

SEQ ID NO: 253668 - RNA, 66 nt, Homo Sapiens
aaucaaucauguacuuuaguuuaauguauaaagauccucuagaaaaugauaauauuguguauuaag

SEQ ID NO: 253669 - RNA, 66 nt, Homo Sapiens
uuucucugguggucucaagacaagaacaagagcugacucuagaaucuucugccuggcugaccucug

SEQ ID NO: 253670 - RNA, 66 nt, Homo Sapiens
cugggucagugauggcaacaggauggccaaggauggcucuagaacacucuguccaugcgucacucc

SEQ ID NO: 253671 - RNA, 66 nt, Homo Sapiens
auccuguccuguccaaugcgggggcacugcagaacucucuagaaaugucaugauugagcuucagag

SEQ ID NO: 253672 - RNA, 66 nt, Homo Sapiens
uccacuuuggagaauacucacuggagugacacuacacucuagaauugagaacugaauaaucuuugc

SEQ ID NO: 253673 - RNA, 66 nt, Homo Sapiens
uuguuuugaacauccuuguaccaucaauaaaguuuucucuagaauaguauuuuauuuuguuuucaa

SEQ ID NO: 253674 - RNA, 66 nt, Homo Sapiens
gcuguauggaaaugcacccucccuccugccgcuccucucuagaaccuucuagaaccugggcugugc

SEQ ID NO: 253675 - RNA, 66 nt, Homo Sapiens
cauucuaagggugccaagagacugguuagucaaagccucuagaaggggauccucguugaaaggagc

SEQ ID NO: 253676 - RNA, 66 nt, Homo Sapiens
uaccauaucuauaaaacaaacauaguaucugucaaucucuagaaaccacaagaugauggagagguc

SEQ ID NO: 253677 - RNA, 66 nt, Homo Sapiens
cagguguagggacccugccaaguggcaccugauuuacucuagaaaauaaaaguagaaaauacugag

SEQ ID NO: 253678 - RNA, 66 nt, Homo Sapiens
ugugucccugaaguauuuaauaagaagcauuuugcacucuagaaaguauguuuguguugguuuuuu

SEQ ID NO: 253679 - RNA, 66 nt, Homo Sapiens
ugugguagauuacuuaucagaaaacauauaugucaucucuagaacgaagaaaaagcauaguaguuc

SEQ ID NO: 253680 - RNA, 66 nt, Homo Sapiens
cuggguaggguauaguaucacuccugaguuccacugcucuagaaucuaaccagaaauagaaaccua

SEQ ID NO: 253681 - RNA, 66 nt, Homo Sapiens
guggcguuggugaacggaccgaaucagcucacugcucucuagaaacguccccugcucaccauugga

SEQ ID NO: 253682 - RNA, 66 nt, Homo Sapiens
acuucugaugcaugaaaaauacucgugguucuggagcucuagaaaccgcucaggacgugaugaggu

SEQ ID NO: 253683 - RNA, 66 nt, Homo Sapiens
ggugcagacaucccgucugaguuuuuaacacagagucucuagaagacagaauguucagucggucgu

SEQ ID NO: 253684 - RNA, 66 nt, Homo Sapiens
uucuggcaaguguccagaugccagaaccuucuuuuccucuagaagggauggugcuugguaaccuua

SEQ ID NO: 253685 - RNA, 66 nt, Homo Sapiens
cccauguaugucgauugauaucgcugcuacaucagacucuagaaaaaagggcugagaggaagcaag

SEQ ID NO: 253686 - RNA, 66 nt, Homo Sapiens
uacgauaauuccucaagcaugagaccuugcuaagcacucuagaauaaguuuuauguucugcucaca

SEQ ID NO: 253687 - RNA, 66 nt, Homo Sapiens
ugcuacaaaagugcaaauuucucauuuccugugggucucuagaaacucucucaauauuuaaagcca

SEQ ID NO: 253688 - RNA, 66 nt, Homo Sapiens
uccugggcuugguaagugaauuuaugagauuuacugcucuagaaaguauagauggccaaaggaccg

SEQ ID NO: 253689 - RNA, 66 nt, Homo Sapiens
uauacauugauauuuauucucuguuguuuauuaucacucuagaagucauccaucugagaugggguc

SEQ ID NO: 253690 - RNA, 66 nt, Homo Sapiens
ccacugacuuuagugggucucaggacacuuagagcucucuagaaucgugauuuuuguaacuuuacg

SEQ ID NO: 253691 - RNA, 66 nt, Homo Sapiens
cuacuuacaguugaccaagcaaccuuuuagccugcucucuagaaccggauaugcccauuugauccu

SEQ ID NO: 253692 - RNA, 66 nt, Homo Sapiens
uccuucuguuggaggcccucgcaggcuuuuccuccucucuagaacccccaguacggcccccucuuu

SEQ ID NO: 253693 - RNA, 66 nt, Homo Sapiens
cugcucccucugcaggggguguggcuuccaccucagcucuagaagcugccucaggcccccagcccu

SEQ ID NO: 253694 - RNA, 66 nt, Homo Sapiens
uaaaucucuccugugucuuacaaaaaauauauaucacucuagaaaagaagaaaaaaagaaaaagaa

SEQ ID NO: 253695 - RNA, 66 nt, Homo Sapiens
aacgaguuauucacaccagcauuuuauuuauaagggcucuagaaaaaugcaaacacuaacuggggg

SEQ ID NO: 253696 - RNA, 66 nt, Homo Sapiens
ugcugcuacuagaaaugucuaaaggcuacacgagcucucuagaaacaaaaaaaaaaaaguuuguua

SEQ ID NO: 253697 - RNA, 66 nt, Homo Sapiens
cgagccgucacaccucaggcggcagacaccaggccacucuagaagccguuggggccauuagaauga

SEQ ID NO: 253698 - RNA, 66 nt, Homo Sapiens
ccauuccccuggcaugaaacuuucagauuccccugccucuagaaauuguccugcccuccucaccac

SEQ ID NO: 253699 - RNA, 66 nt, Homo Sapiens
cuuaacccaugguucucagcuggggugacacugcuccucuagaagcagguuugaaauuauggguau

SEQ ID NO: 253700 - RNA, 66 nt, Homo Sapiens
uguaaaggcccugucccaauuauuaagcuguguucacucuagaaggaguccuggcuuuuuguugau

SEQ ID NO: 253701 - RNA, 66 nt, Homo Sapiens
caagguuuuguuuguuaauuguauaacuuccauguucucuagaaaucccuacauucuccuugucug

SEQ ID NO: 253702 - RNA, 66 nt, Homo Sapiens
cguacguaugcacccacagauuuaugguaacuucuacucuagaauauauguuucuggugugugaac

SEQ ID NO: 253703 - RNA, 66 nt, Homo Sapiens
cuccagaacccagcccagaucggaggacaaguuccucucuagaacccaauccaauuuggagcccca

SEQ ID NO: 253704 - RNA, 66 nt, Homo Sapiens
uuuggagccccagcccaacuccagaacccaacccuucucuagaauccagcccagaucugaggccaa

SEQ ID NO: 253705 - RNA, 66 nt, Homo Sapiens
uaaugugguccaaaugcggaucacuggucagauggacucuagaagcacugagcucccugucucugg

SEQ ID NO: 253706 - RNA, 66 nt, Homo Sapiens
acuucaaaaagccucaugcauagcgggucauguagucucuagaaaauacauaaccugauggaaaug

SEQ ID NO: 253707 - RNA, 66 nt, Homo Sapiens
augguuauuuauauccuauuuuuucucaccccaucucucuagaaacaccuauaaaggcuauuauug

SEQ ID NO: 253708 - RNA, 66 nt, Homo Sapiens
cucuuguauaagauccuagauccuaagggucgaaagcucuagaaucugcaauucaaaaguuccaag

SEQ ID NO: 253709 - RNA, 66 nt, Homo Sapiens
ugggcugccgugauggauucuguuugacguauuguucucuagaaggccuggcucugauccagugac

SEQ ID NO: 253710 - RNA, 66 nt, Homo Sapiens
ugcugcugauggagaccaggcccagcccucuggcgucucuagaaacccgguccccacccucugccc

SEQ ID NO: 253711 - RNA, 66 nt, Homo Sapiens
ggagagagguccagauugcgacaaaagcagacaacacucuagaacucugcugacggaggaauuaac

SEQ ID NO: 253712 - RNA, 66 nt, Homo Sapiens
agaugguaucugaaguccuuuuuuggucagcuacgucucuagaauagacccagccccuccccuacu

SEQ ID NO: 253713 - RNA, 66 nt, Homo Sapiens
aggauguuggggaaaaucccgccucaguuuccccaucucuagaaugaaaguuguuucucucccugg

SEQ ID NO: 253714 - RNA, 66 nt, Homo Sapiens
uucucuaaaauuguacucagugacauuuuuauuuaucucuagaaguauuugaaauucaguaauauu

SEQ ID NO: 253715 - RNA, 66 nt, Homo Sapiens
uaagcuuggugaaagaagggugccuaaauccauguucucuagaauguaaaaguacagugaugagca

SEQ ID NO: 253716 - RNA, 66 nt, Homo Sapiens
uaauacuugguaauuauacugcagagucacagaucacucuagaaucaucuagacuguucuggggua

SEQ ID NO: 253717 - RNA, 66 nt, Homo Sapiens
gggguuacuucuccccugggcucucccucuggucuacucuagaagacugcccccaggaauggggaa

SEQ ID NO: 253718 - RNA, 66 nt, Homo Sapiens
uucaaaucucucccaacucuaaaauucaagguccuccucuagaaguagcucccaucuccuuucaga

SEQ ID NO: 253719 - RNA, 66 nt, Homo Sapiens
auauuggcugucaucaaaggagaguuggagaaaccccucuagaaacccuaaggcccuggguucaag

SEQ ID NO: 253720 - RNA, 66 nt, Homo Sapiens
uuggaaauuccuuaacugagcuauacuugguacuugcucuagaacauuugggaaaugacaaacuca

SEQ ID NO: 253721 - RNA, 66 nt, Homo Sapiens
gccaucucuuccagcaccaucaggguuuuaauggcccucuagaauuaccacugagauacacuauuu

SEQ ID NO: 253722 - RNA, 66 nt, Homo Sapiens
ccacaguaggccucucuuugccagggguccuugggccucuagaagggggugaagaaucugggccaa

SEQ ID NO: 253723 - RNA, 66 nt, Homo Sapiens
guaagaaauaaauauuugcuucuuggacuucccagccucuagaacuugaaucugcuggugccuuga

SEQ ID NO: 253724 - RNA, 66 nt, Homo Sapiens
uaacccugggaaaagggcauugccuuaguuuggauccucuagaaacaggcaagggcccaaggacag

SEQ ID NO: 253725 - RNA, 66 nt, Homo Sapiens
uaaauuuaugaaaauacaaauauuaucuucuucucccucuagaauacacuguauaacuuauuuucu

SEQ ID NO: 253726 - RNA, 66 nt, Homo Sapiens
ugcuuuguuuuguaagaacugcagacacagugaaaucucuagaaucacuugcguggaaggagcaau

SEQ ID NO: 253727 - RNA, 66 nt, Homo Sapiens
cauccaggugucggagcuaagucucagccugucauucucuagaacaaguaguuaaaccaaacuaca

SEQ ID NO: 253728 - RNA, 66 nt, Homo Sapiens
agcugggcucucagcuauuuaaggacacccccuucucucuagaaagcacagucagggacccccaua

SEQ ID NO: 253729 - RNA, 66 nt, Homo Sapiens
ccuaagacgggggcugcuucuccucuucaguauggacucuagaaagucuggcuacaugaauagauu

SEQ ID NO: 253730 - RNA, 66 nt, Homo Sapiens
cccagugcuaacuugggccagcgggguuugggguaucucuagaaaacagcaacugaacagagcucc

SEQ ID NO: 253731 - RNA, 66 nt, Homo Sapiens
agaggcgugacccaggccccuguagcccucagccuccucuagaagcuucuguacuccuuguaggau

SEQ ID NO: 253732 - RNA, 66 nt, Homo Sapiens
agcugccguggccacccccgcugcccagugucugcccucuagaaguaggcuguguuuccagguguu

SEQ ID NO: 253733 - RNA, 66 nt, Homo Sapiens
cauggaaauuaaguguuucguuauuuucccauucuacucuagaaagaacuaaacaggaaagucgca

SEQ ID NO: 253734 - RNA, 66 nt, Homo Sapiens
auuuuuaagaaggagggaaugcaaguuuuuuaguagcucuagaaacuuaucaacuauuuuguaaau

SEQ ID NO: 253735 - RNA, 66 nt, Homo Sapiens
aacauucugugucaccagcaggggcuguccccugggcucuagaaaguugugaccagcucagaggau

SEQ ID NO: 253736 - RNA, 66 nt, Homo Sapiens
aaggaagaggcugggggacuagaaagaggcccugcccucuagaaagcucagaucuuggcuucuguu

SEQ ID NO: 253737 - RNA, 66 nt, Homo Sapiens
uucucuuccaagaaugccucuguggugcuguuuggucucuagaaacagggucacuuuuuuaaugua

SEQ ID NO: 253738 - RNA, 66 nt, Homo Sapiens
ccucgacugcugcuguuaaaaaacaugcauuagaaucucuagaacacgaggaaaaacagggucuug

SEQ ID NO: 253739 - RNA, 66 nt, Homo Sapiens
cuauugugcaaugauuguuaaauuauacugaaguagcucuagaaagacacauguauacaaggcacu

SEQ ID NO: 253740 - RNA, 66 nt, Homo Sapiens
acagccguaguagauguucuacuuuguucugcuguucucuagaaagaauauuugguuuuccuguau

SEQ ID NO: 253741 - RNA, 66 nt, Homo Sapiens
uaguacacaucagcauaugagaaucucugagagguccucuagaaaggagagaaaaagcaccucuuu

SEQ ID NO: 253742 - RNA, 66 nt, Homo Sapiens
ucuggauucauauauuacaucaacuucccuuuuuaacucuagaaauucucaguaugggguuucccu

SEQ ID NO: 253743 - RNA, 66 nt, Homo Sapiens
cucuggguuccuauggccuuguuggagggggccaggcucuagaacgucuaacacaguggagaaccg

SEQ ID NO: 253744 - RNA, 66 nt, Homo Sapiens
aauuugaucacgaucauauuguagucucucaaagugcucuagaaauugucagugguuuacaugaag

SEQ ID NO: 253745 - RNA, 66 nt, Homo Sapiens
aagaaaaguguuuuuagaaaaguguuugagagugaccucuagaaaaucaaacuauagugauauauc

SEQ ID NO: 253746 - RNA, 66 nt, Homo Sapiens
agcaagacugggccccacauagugagcuuuagcucucucuagaaugggugccacccaguagcccag

SEQ ID NO: 253747 - RNA, 66 nt, Homo Sapiens
uuaagccuuuguugaacuguccuggugguuuucaaccucuagaauugacaguugugcaggagguag

SEQ ID NO: 253748 - RNA, 66 nt, Homo Sapiens
cugucuaacauaccacaugauucauauaccugauuccucuagaaggaauaguuuggaguaagggac

SEQ ID NO: 253749 - RNA, 66 nt, Homo Sapiens
gauguugaaaucuuugccucuaauacuguggcuagucucuagaauguuaugauauauuacuacuua

SEQ ID NO: 253750 - RNA, 66 nt, Homo Sapiens
caagccccaugagcagcagugcuuagauggugagggcucuagaaaccugagugaacugaggaaggu

SEQ ID NO: 253751 - RNA, 66 nt, Homo Sapiens
ucaaacuauagugauauaucaguguuugggagugaccucuagaaaaaagaaaacuguuuuuagaaa

SEQ ID NO: 253752 - RNA, 66 nt, Homo Sapiens
ggggcgcauugcgauccaacagauggccggggaaggcucuagaaaacccagccgcauccugccugu

SEQ ID NO: 253753 - RNA, 64 nt, Homo Sapiens; identical to SEQ ID NO: 24356

SEQ ID NO: 253754 - RNA, 64 nt, Homo Sapiens; identical to SEQ ID NO: 24357

SEQ ID NO: 253755 - RNA, 64 nt, Homo Sapiens; identical to SEQ ID NO: 24358

SEQ ID NO: 253756 - RNA, 64 nt, Homo Sapiens; identical to SEQ ID NO: 24359

SEQ ID NO: 253757 - RNA, 64 nt, Homo Sapiens; identical to SEQ ID NO: 24360

SEQ ID NO: 253758 - RNA, 64 nt, Homo Sapiens; identical to SEQ ID NO: 24361

SEQ ID NO: 253759 - RNA, 64 nt, Homo Sapiens; identical to SEQ ID NO: 24362

SEQ ID NO: 253760 - RNA, 64 nt, Homo Sapiens; identical to SEQ ID NO: 24363

SEQ ID NO: 253761 - RNA, 64 nt, Homo Sapiens; identical to SEQ ID NO: 24364

SEQ ID NO: 253762 - RNA, 64 nt, Homo Sapiens; identical to SEQ ID NO: 24365

SEQ ID NO: 253763 - RNA, 64 nt, Homo Sapiens; identical to SEQ ID NO: 24366

SEQ ID NO: 253764 - RNA, 64 nt, Homo Sapiens; identical to SEQ ID NO: 24367

SEQ ID NO: 253765 - RNA, 64 nt, Homo Sapiens; identical to SEQ ID NO: 24368

SEQ ID NO: 253766 - RNA, 64 nt, Homo Sapiens; identical to SEQ ID NO: 24369

SEQ ID NO: 253767 - RNA, 64 nt, Homo Sapiens; identical to SEQ ID NO: 24370

SEQ ID NO: 253768 - RNA, 64 nt, Homo Sapiens; identical to SEQ ID NO: 24371

SEQ ID NO: 253769 - RNA, 64 nt, Homo Sapiens
uaacucacugacaaaacauauuucaauaguauaugaguaugagauuucuuaucaauuaugagug

SEQ ID NO: 253770 - RNA, 64 nt, Homo Sapiens
aaggcauuuacaguauuugcuuucaacaguuacugaguaugacauuuuagcaugaaauauauca

SEQ ID NO: 253771 - RNA, 64 nt, Homo Sapiens
gaaacuuccuguacauaaauucaagaaaggagaugaguaugauguaugugccauuuguuuggau

SEQ ID NO: 253772 - RNA, 64 nt, Homo Sapiens
agaugaguaugauguaugugccauuuguuuggaugaguaugaagauggagacaaacucagaauc

SEQ ID NO: 253773 - RNA, 64 nt, Homo Sapiens
acaucagaggguccaucaugaagagaaagccuaugaguaugaugaauauggguuggccuauauu

SEQ ID NO: 253774 - RNA, 64 nt, Homo Sapiens
aaugcauaggaaagagaaaucguaugaauguaaugaguaugagggcaguuucagucauagcuca

SEQ ID NO: 253775 - RNA, 64 nt, Homo Sapiens
gugguucaaggauaaaaacauguauaauaauaaagaguaugauugauaccaauauuuaaaaguu

SEQ ID NO: 253776 - RNA, 64 nt, Homo Sapiens
acauccagucgagcagaggaauguucccagccaagaguaugagauuggucucgaggcagagguc

SEQ ID NO: 253777 - RNA, 64 nt, Homo Sapiens
uaguugguaaggccaauguuauuuaaaugaaaguaguuagaaaaaugcucuccuauucuaccaa

SEQ ID NO: 253778 - RNA, 64 nt, Homo Sapiens
acacagugaucaagaguuucucauagugcuuugaaguuagaaauuauguauaggauauuuuaaa

SEQ ID NO: 253779 - RNA, 64 nt, Homo Sapiens
uaagguaaauauuuauucuuuucccaaaguagcuaguuagaacuuuuuccugugcuuccccagc

SEQ ID NO: 253780 - RNA, 64 nt, Homo Sapiens
cugacacaggcuguugagaaagguguuucaauuaaguuagaaaaggggaugaaggagagcuuaa

SEQ ID NO: 253781 - RNA, 64 nt, Homo Sapiens
acuuuaaaaaaaaaaaaaccuucuggaacaaaacaguuagaaaacgaacuuuauuacauacuga

SEQ ID NO: 253782 - RNA, 64 nt, Homo Sapiens
uuuucacccagggaguaagugcuccuagaaaucaaguuagaaagccagaacucagcaggcauug

SEQ ID NO: 253783 - RNA, 64 nt, Homo Sapiens
auucuuauuuaugcccacaaaaaucaguuagaauaguuagaacaugaaagagcugugcauuaua

SEQ ID NO: 253784 - RNA, 64 nt, Homo Sapiens
guuagaacaauucuuauuuaugcauuauaaaaucaguuagaauaguaaucaacugaaagagcug

SEQ ID NO: 253785 - RNA, 64 nt, Homo Sapiens
uuucagguuuaccucuguucacugguccugggacaguuagaauccucuucuacccuugaaggug

SEQ ID NO: 253786 - RNA, 64 nt, Homo Sapiens
aauacagucacaugucacuucaaauguauaaggcaguuagaaauauauuucaauauucaaguua

SEQ ID NO: 253787 - RNA, 64 nt, Homo Sapiens
uagcagacuuuacugggacacuuguggcuuaucuaguuagaacuaaaauaccaauuuaguuuua

SEQ ID NO: 253788 - RNA, 64 nt, Homo Sapiens
ccuuuuguuguugaagauguauucaguucuguagaguuagaauacagcugccguugaagcuaau

SEQ ID NO: 253789 - RNA, 64 nt, Homo Sapiens
aaggucacauauuucaaacaaguuuaagaccacaaguuagaagauuuggauuuuguaaaacaga

SEQ ID NO: 253790 - RNA, 64 nt, Homo Sapiens
uucagucaguguccccaggguccagccuggcuagaguuagaaggcagaccuagccuuuggaagc

SEQ ID NO: 253791 - RNA, 64 nt, Homo Sapiens
agcuccacacagacccuacccuuuccccuagcccaguuagaaaauaagucugggccggcggcgg

SEQ ID NO: 253792 - RNA, 64 nt, Homo Sapiens
ugucugcuuuuugcuauuucugcaguuucaaguuaguuagaagcauguugucaacuaaagacaa

SEQ ID NO: 253793 - RNA, 64 nt, Homo Sapiens
cauggucugcaucaaucuguuugccugcuaaacaaguuagaauaggaaauaguaaaauaaaucc

SEQ ID NO: 253794 - RNA, 64 nt, Homo Sapiens
uaagucuacugaaaaauuuauuauuaaauaugcaaguuagaaauggaacuugaguacaguugaa

SEQ ID NO: 253795 - RNA, 64 nt, Homo Sapiens
gcaauuuucuuauaggaaauucaacuagaaauccaguuagaaguagugaauaaagaaauaaacu

SEQ ID NO: 253796 - RNA, 64 nt, Homo Sapiens
uuuuagcauuuucuuugaaauaauuccuaaagcaaguuagaaaugguugcauguucacugcccc

SEQ ID NO: 253797 - RNA, 64 nt, Homo Sapiens
uuuuagcauuuaaggugugacaauuccuaaagcaaguuagaagugguugcguguucacugcccc

SEQ ID NO: 253798 - RNA, 64 nt, Homo Sapiens
aaguaaaguaggguaagggaaugccagucugaggaguuagaaguuaccguuuuauguaagguaa

SEQ ID NO: 253799 - RNA, 64 nt, Homo Sapiens
aaucaagacgugcaagaguggaagaagaaacaccaguuagaaguuuguuugcgauaauccaagc

SEQ ID NO: 253800 - RNA, 64 nt, Homo Sapiens
ggacucccuggccaggcgcaagaaaaauaggcucaguuagaaaauuauuccauuuguaccuaag

SEQ ID NO: 253801 - RNA, 64 nt, Homo Sapiens
aagcucaaaacuacuuuaguuacuacuuuguuuuaguuagaacauauuauaaaaauuguaaaac

SEQ ID NO: 253802 - RNA, 64 nt, Homo Sapiens
uuguagggauaagaaauacauuuguuuuauacuucuaugcuauauuuugcuauucaaaauuuag

SEQ ID NO: 253803 - RNA, 64 nt, Homo Sapiens
agauuggacuuguucaaauguucauauuuuuguucuaugcuaaaugcaucguuaggggaguagu

SEQ ID NO: 253804 - RNA, 64 nt, Homo Sapiens
guguucagauacuuacaccauucugguugccucucuaugcuauuggcauauguaaaauguccuu

SEQ ID NO: 253805 - RNA, 64 nt, Homo Sapiens
uuuucauaaaggcauuuguaauaauuuaaaccagcuaugcuauugacuuuuguuuuugggguuu

SEQ ID NO: 253806 - RNA, 64 nt, Homo Sapiens
uguauuuuaaaauaaaagccguccuaugacaguucuaugcuaaauuuguguuuuauuauuuucu

SEQ ID NO: 253807 - RNA, 64 nt, Homo Sapiens
cuguugauuuuuaugucuagcccauaauuugggccuaugcuaucuugaauuuuagggaccguuu

SEQ ID NO: 253808 - RNA, 64 nt, Homo Sapiens
guauauaaaaaaaagaaaccugcacauguacccuagaacuuaaauguaacaaaccugcacguug

SEQ ID NO: 253809 - RNA, 64 nt, Homo Sapiens
gcucacgccuguaaucucaggcugggauuuuaauagaacuuacacaacuccauugaaaaacccu

SEQ ID NO: 253810 - RNA, 64 nt, Homo Sapiens
aguuaaucaugccuuuuggagcuagaaggacuuuagaacuuaucuaguuaugcuccuuuauauu

SEQ ID NO: 253811 - RNA, 64 nt, Homo Sapiens
guuggucaauggcuuuuggaacuggaaggaccuuagaacuuaucuguuaugcuccugauagcca

SEQ ID NO: 253812 - RNA, 64 nt, Homo Sapiens
ccuccccaacaaauaauuugccaaguguccaaugagaacuuaucauguugguguguuagguaaa

SEQ ID NO: 253813 - RNA, 64 nt, Homo Sapiens
auaaacuuuuucaauauaagguacaugccuauacagaacuuaacauuuugcacagaauauauca

SEQ ID NO: 253814 - RNA, 64 nt, Homo Sapiens
uuuauagauguauauuguggaauguaaagcuuuaagaacuuaaacaaagguaauaauuaaaaua

SEQ ID NO: 253815 - RNA, 64 nt, Homo Sapiens
auguuaaaaccucucaacacagaaggaauacaggagaacuuacucaaguugguaaagaacauac

SEQ ID NO: 253816 - RNA, 64 nt, Homo Sapiens
cuuugcccugaagucaguucucacaguauagaagagaacuuaaagagggaaaaaacaauaugaa

SEQ ID NO: 253817 - RNA, 64 nt, Homo Sapiens
guuuugcauuuugcaguacaaaggagaaaugauuagaacuuaggaagugccaguggguugguga

SEQ ID NO: 253818 - RNA, 64 nt, Homo Sapiens
guucuuuucuauucuuucagaaugcacaguauaaagaacuuauucaauauaccagguaagaauc

SEQ ID NO: 253819 - RNA, 64 nt, Homo Sapiens
uuucacuaaauaauauauauugcuuuaaaucugaagaacuuaaggguuaauuucaccacaaaau

SEQ ID NO: 253820 - RNA, 64 nt, Homo Sapiens; identical to SEQ ID NO: 99218

SEQ ID NO: 253821 - RNA, 64 nt, Homo Sapiens; identical to SEQ ID NO: 99219

SEQ ID NO: 253822 - RNA, 64 nt, Homo Sapiens; identical to SEQ ID NO: 99220

SEQ ID NO: 253823 - RNA, 64 nt, Homo Sapiens; identical to SEQ ID NO: 99221

SEQ ID NO: 253824 - RNA, 64 nt, Homo Sapiens; identical to SEQ ID NO: 99222

SEQ ID NO: 253825 - RNA, 64 nt, Homo Sapiens; identical to SEQ ID NO: 99223

SEQ ID NO: 253826 - RNA, 64 nt, Homo Sapiens; identical to SEQ ID NO: 99224

SEQ ID NO: 253827 - RNA, 64 nt, Homo Sapiens; identical to SEQ ID NO: 99225

SEQ ID NO: 253828 - RNA, 64 nt, Homo Sapiens; identical to SEQ ID NO: 99226

SEQ ID NO: 253829 - RNA, 64 nt, Homo Sapiens; identical to SEQ ID NO: 99227

SEQ ID NO: 253830 - RNA, 64 nt, Homo Sapiens; identical to SEQ ID NO: 99228

SEQ ID NO: 253831 - RNA, 64 nt, Homo Sapiens; identical to SEQ ID NO: 99229

SEQ ID NO: 253832 - RNA, 64 nt, Homo Sapiens; identical to SEQ ID NO: 99230

SEQ ID NO: 253833 - RNA, 64 nt, Homo Sapiens; identical to SEQ ID NO: 99231

SEQ ID NO: 253834 - RNA, 64 nt, Homo Sapiens; identical to SEQ ID NO: 99232

SEQ ID NO: 253835 - RNA, 64 nt, Homo Sapiens; identical to SEQ ID NO: 99233

SEQ ID NO: 253836 - RNA, 64 nt, Homo Sapiens; identical to SEQ ID NO: 99234

SEQ ID NO: 253837 - RNA, 64 nt, Homo Sapiens; identical to SEQ ID NO: 99235

SEQ ID NO: 253838 - RNA, 64 nt, Homo Sapiens; identical to SEQ ID NO: 99236

SEQ ID NO: 253839 - RNA, 64 nt, Homo Sapiens; identical to SEQ ID NO: 99237

SEQ ID NO: 253840 - RNA, 64 nt, Homo Sapiens; identical to SEQ ID NO: 99238

SEQ ID NO: 253841 - RNA, 64 nt, Homo Sapiens; identical to SEQ ID NO: 99239

SEQ ID NO: 253842 - RNA, 64 nt, Homo Sapiens; identical to SEQ ID NO: 99240

SEQ ID NO: 253843 - RNA, 64 nt, Homo Sapiens; identical to SEQ ID NO: 99241

SEQ ID NO: 253844 - RNA, 64 nt, Homo Sapiens
gaaaagugagaaaauauuugaaagggauuauauuaauugcuaaauauuuuauucacaaagguca

SEQ ID NO: 253845 - RNA, 64 nt, Homo Sapiens
uaauagcuaaucuuauucuaucuccugaagauuuaauugcuauuguuacccauucgaaaucagc

SEQ ID NO: 253846 - RNA, 64 nt, Homo Sapiens
aauuuuauuugguuuguacgcaguucaauuucaaaauugcuaaaauguguuugagcuuuagacu

SEQ ID NO: 253847 - RNA, 64 nt, Homo Sapiens
uguuugagcuuuagacuauaacauuuguuguaauaauugcuagguugaaguucaacauguaaaa

SEQ ID NO: 253848 - RNA, 64 nt, Homo Sapiens
cccuuagugagggcaaaguguaguugguagaagaaauugcuaaauaccuaucuaaugugcuaug

SEQ ID NO: 253849 - RNA, 64 nt, Homo Sapiens
uuucuaacuacuuagcacaguuugagaauacguuaauugcuauuuacuauuuaaaaaguuuuac

SEQ ID NO: 253850 - RNA, 64 nt, Homo Sapiens
aaaauuuuuacucagauuuuuuuuccucuucccuaauugcuaagauuuaaggacguucuuuauu

SEQ ID NO: 253851 - RNA, 64 nt, Homo Sapiens
uuugcuuuuucuuuuuguuuuuaaaacuuauuccaauugcuaaauugguaguuuuucagucuuu

SEQ ID NO: 253852 - RNA, 64 nt, Homo Sapiens
aagaauaaaccaugaaacauugcacugaaaauuaaauugcuaucggcagguauuugcuuuugcu

SEQ ID NO: 253853 - RNA, 64 nt, Homo Sapiens
aagagcaaacuaugaacgguugcacugaaaauuaaauugcuaucgguauguguuugcuuuugcu

SEQ ID NO: 253854 - RNA, 64 nt, Homo Sapiens
acagauguuuuguggauugaaaauuauuuuauggaauugcuacagaggagugcuuuucuucuca

SEQ ID NO: 253855 - RNA, 64 nt, Homo Sapiens
auaacacuuagaaguguuuacuuaccuggaaaauaauugcuaugccguacauucagagugcccc

SEQ ID NO: 253856 - RNA, 64 nt, Homo Sapiens
uauuuuuuuauugccuagaauacuguugaacagcaauugcuauuaaauagugugugucuuauuu

SEQ ID NO: 253857 - RNA, 64 nt, Homo Sapiens
uuggcaacagcacagaaaacacuacauuugcuuaaauugcuauuggcucaugugucauucuggc

SEQ ID NO: 253858 - RNA, 64 nt, Homo Sapiens
gcagaauuaaauuuuuacuugacauuaucauuaaaauugcuagguauggagaacaauuccuauu

SEQ ID NO: 253859 - RNA, 64 nt, Homo Sapiens
uuuccuaaaacacuuuauauuauaaaugaaaauaaauugcuaguuuauauuuuagauauaaaca

SEQ ID NO: 253860 - RNA, 64 nt, Homo Sapiens
ugaucuagagccaguuacuucagcucugucacuuaauugcuacagccuaucuaaacuggauuca

SEQ ID NO: 253861 - RNA, 64 nt, Homo Sapiens
uuuugacauuuuuaguuuaaaauuucuuuaacuuaauugcuaugguaucgcuucauguaacuag

SEQ ID NO: 253862 - RNA, 64 nt, Homo Sapiens
ugugacccagcaaucuuuuagacuuuuugcccuaaauugcuaggaaguaccuuaauucuuuauu

SEQ ID NO: 253863 - RNA, 64 nt, Homo Sapiens
caaucuugaauauuuucucuauuucaaaaaauaaaauugcuaugggaaauucuuuaggauaacc

SEQ ID NO: 253864 - RNA, 64 nt, Homo Sapiens
acuuuacaguaaaauuaaguguguauaaaacauuaauugcuaacaauuguuagcaaacuauuuc

SEQ ID NO: 253865 - RNA, 64 nt, Homo Sapiens
ugccaucacauaguauuaugucaccauaaugaacaauugcuauuuaaauagauaaccaauuuuc

SEQ ID NO: 253866 - RNA, 64 nt, Homo Sapiens
ugcuagcuaaaaaauaucaagugccugauuaaagaauugcuaaaugguugucaauacucgcugu

SEQ ID NO: 253867 - RNA, 64 nt, Homo Sapiens
aggaacauguauuagcuguguuuuagugagaaugaauugcuauccaucauaauuuuugcuguug

SEQ ID NO: 253868 - RNA, 51 nt, Homo Sapiens
acuuuagaggacuuauuuaagaauugcuaagggaaacaggucuuacacaaa

SEQ ID NO: 253869 - RNA, 64 nt, Homo Sapiens
gcaagagaguuuguaauuaagugccaauuauaccaauugcuagacccaggauguaucuuuaauu

SEQ ID NO: 253870 - RNA, 64 nt, Homo Sapiens
cauuuuggcugcuguucuuuucaacauccaggcugacguuuagcauuguuuuuagaucagugcu

SEQ ID NO: 253871 - RNA, 64 nt, Homo Sapiens
cauuuuggcugcugcucuuuucaacauccagguugacguuuaacaaguccaugagaucagugcu

SEQ ID NO: 253872 - RNA, 64 nt, Homo Sapiens
acuacacgguguacauuucccuuguuugaauauagaauuguaacguaacauacugucaauuuuc

SEQ ID NO: 253873 - RNA, 64 nt, Homo Sapiens
uaaaugaccccaaacuggcaaaccugagaaguuugaauuguaguaaaacaaacaaaaacaaaaa

SEQ ID NO: 253874 - RNA, 64 nt, Homo Sapiens
gaauucuuuuuagaucaaaguauguacuguuaaagaauuguauuuucuuuugcaauuguaguuu

SEQ ID NO: 253875 - RNA, 64 nt, Homo Sapiens
gaauucuuuuuagaucacaguauguacuguuaaagaauuguacuuucuuuugcaauuuuaguuu

SEQ ID NO: 253876 - RNA, 64 nt, Homo Sapiens
uguuaagaaggugaagcccaaaagcucuuaaggagaauuguauuucuccagaagcugcagcaag

SEQ ID NO: 253877 - RNA, 64 nt, Homo Sapiens
uauucuacaaaauaugucaugcauucuuucuuaugaauuguauauuuagaaaucuuucuaaaua

SEQ ID NO: 253878 - RNA, 64 nt, Homo Sapiens
ucagagcaacacacaugagaaagagaguaacccggaauuguacuugucaagcaaaaucuauacu

SEQ ID NO: 253879 - RNA, 64 nt, Homo Sapiens
cacagucuuaaaauacuaggaaagaaguggaugggaauuguaggcauagauuucauaucaaggg

SEQ ID NO: 253880 - RNA, 64 nt, Homo Sapiens
uuuuaccagacaaaauuugaauacuuuuuuuccugaauuguauaugaccuuggugcugcaugca

SEQ ID NO: 253881 - RNA, 64 nt, Homo Sapiens
uuucagcgcaagaucucccugauuuugccacguggaauuguacuuguauaugauuaccuuaucu

SEQ ID NO: 253882 - RNA, 64 nt, Homo Sapiens
ucaugcauucuuuucuguuuugcucauaugaagggaauuguacaucauauagauuaauuuuacc

SEQ ID NO: 253883 - RNA, 64 nt, Homo Sapiens
cucaguuaaaagggguagccuauuauaauguaaagaauuguaguggcaagcuaggagaaugggc

SEQ ID NO: 253884 - RNA, 64 nt, Homo Sapiens
cuacaguuuuuuuuguuugguuugugggcuguuggaauuguaauuuuuaauugccuucuaaaaa

SEQ ID NO: 253885 - RNA, 64 nt, Homo Sapiens
uucauugucaaaugcauauuuagauuagauuauugaauuguaauguuuaucugcugcuuuuuuu

SEQ ID NO: 253886 - RNA, 64 nt, Homo Sapiens
ucaucuguugaggucuaaugccuuuacuuggccuauuugccagagaacaucuuaaugcagccug

SEQ ID NO: 253887 - RNA, 64 nt, Homo Sapiens
cugugcuaccaguacuaagaggggaagacuggcaauuugccaagcacuuggggauuauuauaac

SEQ ID NO: 253888 - RNA, 64 nt, Homo Sapiens
uucauucaaagaaugggaaaaggauaugacauauauuugccaguacuucaucuucaagauuuac

SEQ ID NO: 253889 - RNA, 64 nt, Homo Sapiens
aaaauguucuaagcaacuacuuuccuagaguaucauuugccaaccaaaaggcuuucagaggugu

SEQ ID NO: 253890 - RNA, 64 nt, Homo Sapiens
uagaaaacauuccaaaacuuuaagguguugguguauuugccagcuuuauuugcuguacuuuauu

SEQ ID NO: 253891 - RNA, 64 nt, Homo Sapiens
uauuugccagcuuuauuugcuguacuuuauuuguauuugccauucagucuagcuuuuaaguaua

SEQ ID NO: 253892 - RNA, 64 nt, Homo Sapiens
gugcugaguucccuuuucugaguggauuucaagcauuugccaggguaugcuggaggagggacuc

SEQ ID NO: 253893 - RNA, 64 nt, Homo Sapiens
cuagguaacacuuuaaauacuuuuuuacucaaagauuugccaagaacacagcuuauuagugaaa

SEQ ID NO: 253894 - RNA, 64 nt, Homo Sapiens
auuuugggagaacaauaaaaaaaaguuacuuuaaauuugccaaucaucagagagcacaaagauu

SEQ ID NO: 253895 - RNA, 64 nt, Homo Sapiens
aaauugguuucucauaacuugaaugcucaguuucauuugccaauauaacaaccuaugguugaag

SEQ ID NO: 253896 - RNA, 64 nt, Homo Sapiens
guauguucagucucucaagaauuguauccagaggauuugccaaugcucuagcaacaugaucuua

SEQ ID NO: 253897 - RNA, 64 nt, Homo Sapiens
augacguguauauugcucagaccagaaaaauaauauuugccaauugagggaacucaaaauaguu

SEQ ID NO: 253898 - RNA, 64 nt, Homo Sapiens
ucaaacaucugauugacgcuugcaaacugucugaauuugccaugcaagguuuucaaacaauuug

SEQ ID NO: 253899 - RNA, 64 nt, Homo Sapiens
uaugauccaauaacuuauuuugucacagggcuuaauuugccauuuuuggggauuugucgacuca

SEQ ID NO: 253900 - RNA, 64 nt, Homo Sapiens
aaaaaaaaaaaaaaaaaagccccaauuuugucucauuugccaaaaaaagcccaauacuuagagu

SEQ ID NO: 253901 - RNA, 64 nt, Homo Sapiens
uuuguuagcugcgugcgugcugaugaaaauucauauuugccaaccuggcuuuggaaaaaucuca

SEQ ID NO: 253902 - RNA, 64 nt, Homo Sapiens
auaagaaaugguacaauaaacucacaguuugcuuauuugccaccuauucagcugcccucguuua

SEQ ID NO: 253903 - RNA, 64 nt, Homo Sapiens
gauugguuggaucacauacaucuuggagguuaugauuugccacauaguucuaaucuguauauag

SEQ ID NO: 253904 - RNA, 64 nt, Homo Sapiens
gcuuuugccuuuuuggggaugcuuggugagacagauuugccagucagcccuuuugaguucccgc

SEQ ID NO: 253905 - RNA, 64 nt, Homo Sapiens
cugggaacagcugucauggucaccccuggauaacauuugccaccaaguauagaugcuggaucuu

SEQ ID NO: 253906 - RNA, 64 nt, Homo Sapiens
uuaaacugucagaaacuucugugcauguauuuauauuugccagaguauaaacuuuuauacucug

SEQ ID NO: 253907 - RNA, 64 nt, Homo Sapiens
uuauuagcagaaaccauguuuguaaccaaagcacauuugccaaugcuaacuggcuguuguaaua

SEQ ID NO: 253908 - RNA, 64 nt, Homo Sapiens
gguccuugguggccugucccaaauguaaaccuucauuugccaaacuaaaacaaacaaacuacag

SEQ ID NO: 253909 - RNA, 64 nt, Homo Sapiens
auguuuaaaauuuguucagacuucaaaacuugacauuugccagagccagaacccacaggaaaaa

SEQ ID NO: 253910 - RNA, 64 nt, Homo Sapiens
cacacaacauguaagcauguaagaguaaagaauuguaugauauguuccuuuuuucaguucacca

SEQ ID NO: 253911 - RNA, 64 nt, Homo Sapiens
cucugauccaacccuguacugauaguacuucccaguaugauauugugauguuucauacaaugca

SEQ ID NO: 253912 - RNA, 64 nt, Homo Sapiens
ugcacagacaauugcaguaacacuucuauaaauaguaugauaaauugaaaauauuuaaauauug

SEQ ID NO: 253913 - RNA, 64 nt, Homo Sapiens
auuguaucauuuauauuugcaaaauugguaucguguaugauaauaagauguagucaccucagau

SEQ ID NO: 253914 - RNA, 64 nt, Homo Sapiens
uaaagaaaggaaaagaaaacuauuuaauaugcuuauaaccuaguugcuuggaguuuaccuggcu

SEQ ID NO: 253915 - RNA, 64 nt, Homo Sapiens
uaauauauuaaaauuccaaaaucuuguuuugaaaauaaccuaauaauucuauuuauaauacaga

SEQ ID NO: 253916 - RNA, 64 nt, Homo Sapiens
cauccauaguguuuagagagaaaaaaauaaaccaauaaccuaccuacugacaaguaaauuuaua

SEQ ID NO: 253917 - RNA, 64 nt, Homo Sapiens
uguuagauuaggccuuauaaaacuugugugcauuauaaccuaagcugugcaaccugugaagcca

SEQ ID NO: 253918 - RNA, 64 nt, Homo Sapiens
agaggaaguuuguuuuuuaauuuaagagggaaauauaaccuauaaauuuguuucuuccaagcuu

SEQ ID NO: 253919 - RNA, 63 nt, Homo Sapiens
caaauuauuguggguguacuuuggcuuccuuuuguaugauagguccccaucaugaccaccucu

SEQ ID NO: 253920 - RNA, 63 nt, Homo Sapiens
uuuaaaaauuguaaaauucaaguuaaaugacguguaugauauauaagcugaacacauuuucua

SEQ ID NO: 253921 - RNA, 63 nt, Homo Sapiens
augcaucuacagcaggcauggauuguuuaugucguaugauauccuuuauuaaguaaguucacu

SEQ ID NO: 253922 - RNA, 63 nt, Homo Sapiens
auaaaacugccacaauuguauuuuaauuuugagguaugauauuuucagauauuucauaauuuc

SEQ ID NO: 253923 - RNA, 63 nt, Homo Sapiens
aacaaaaaccccugcugcagcauuucaggugcaguaugauauuuccuaaucuuuccuauuucu

SEQ ID NO: 253924 - RNA, 63 nt, Homo Sapiens
agauuguaaaaguaaaaaacuguaaauguauauguaugauagaauuguuuccucuaaguguag

SEQ ID NO: 253925 - RNA, 63 nt, Homo Sapiens
guuugugcagauuaccaaauuacugcugauguaguaugauaaagucagcuucuuggauacaga

SEQ ID NO: 253926 - RNA, 63 nt, Homo Sapiens
ucauuggaauauuugcauuuugcacaaugacugguaugauagcucuugacaaauaaggaaagc

SEQ ID NO: 253927 - RNA, 63 nt, Homo Sapiens
ggaagagacgaaagaaaggaaaauaaacucuuuguaugauauuuauuaggaggaaagaggacu

SEQ ID NO: 253928 - RNA, 63 nt, Homo Sapiens
gcauucaggcuggaaaacacugauguggacucaguaugauaacugagaugggggacgccagac

SEQ ID NO: 253929 - RNA, 63 nt, Homo Sapiens
cuauucugacagaaaagacaaagguuacuaauuguaugauaguguuuuuauauggaagaaugu

SEQ ID NO: 253930 - RNA, 63 nt, Homo Sapiens
uucaucucaaaaauaauuuuuaaaaagccugagguaugauauagcauaaaagauugagaugaa

SEQ ID NO: 253931 - RNA, 63 nt, Homo Sapiens
agcccagugcggcuccacagcauggaaucugauguaugauaugauagaauguggcacuaaaug

SEQ ID NO: 253932 - RNA, 63 nt, Homo Sapiens
uucuuucuguauuucucuauuuguaacuggcuuguaugauauuuugggauuuuuuuuuuuuuu

SEQ ID NO: 253933 - RNA, 63 nt, Homo Sapiens
aaaaacucugguaugacacaacuaaugcauuguguaugauaacggaggaagauuccugcagcc

SEQ ID NO: 253934 - RNA, 63 nt, Homo Sapiens
uggggccuggacacccaucuguaucauaauuccguaugauagagguuuugcuuuagagugcaa

SEQ ID NO: 253935 - RNA, 63 nt, Homo Sapiens
uuaagcaaauauguuauuuaugaagcagccacuguaugauauuaaaaguuuauaagauuuuua

SEQ ID NO: 253936 - RNA, 63 nt, Homo Sapiens
cauuucaucauuuaaguaagcaauuuacagauaguaugauauauaucacuguaauggaauauc

SEQ ID NO: 253937 - RNA, 63 nt, Homo Sapiens
gcauaguagaaggagauuugucuccuaaugguaguaugauauacuuugcuuuucuuuuucaaa

SEQ ID NO: 253938 - RNA, 63 nt, Homo Sapiens
cauaauaugcagcuuaggaugcuauuuugagauguaugauauucaguucauucaccugauuac

SEQ ID NO: 253939 - RNA, 63 nt, Homo Sapiens
caaaauguuuuuuauuacggcuuuucuauugcuguaugauacagaacucuuuuggcauaaaua

SEQ ID NO: 253940 - RNA, 63 nt, Homo Sapiens
guugguuagaagcauagguaacugauuaaguagguaugauacugcauuugaaauaaguggaca

SEQ ID NO: 253941 - RNA, 63 nt, Homo Sapiens
acacaacauguaagcauguaagaguaaagaauuguaugauauguuccuuuuuucaguucacca

SEQ ID NO: 253942 - RNA, 63 nt, Homo Sapiens
ucugauccaacccuguacugauaguacuucccaguaugauauugugauguuucauacaaugca

SEQ ID NO: 253943 - RNA, 63 nt, Homo Sapiens
guauucugggaaugauguaaugcucugaauuuaguaugauauaaagaaaacuuuuuugugcua

SEQ ID NO: 253944 - RNA, 63 nt, Homo Sapiens
uuuuaccaagaacauuuaagugccucagcaucuguaugauauaguggagcaggugcugacaua

SEQ ID NO: 253945 - RNA, 63 nt, Homo Sapiens
uuaaugauggacagcauuauuaggaacccuguaguaugauauuuaacaauauaggcuucaaga

SEQ ID NO: 253946 - RNA, 63 nt, Homo Sapiens
aacuuaguuuuguuuccuagauccuagaagacaguaugauauuuucucuggccaguugcauaa

SEQ ID NO: 253947 - RNA, 63 nt, Homo Sapiens
ucuugauuaugcuacuggugcaauuggaucaguguaugauauggaugaugaugaaauggaccc

SEQ ID NO: 253948 - RNA, 63 nt, Homo Sapiens
guacuuuuuuuaaaggacuggaucccauguacaguaugauaguucaugcuaaaaguauguaaa

SEQ ID NO: 253949 - RNA, 63 nt, Homo Sapiens
uaaauacaucaucuggccaguacacagaguuugguaugauauuacagucucucuuuauauaaa

SEQ ID NO: 253950 - RNA, 63 nt, Homo Sapiens
auuuuuuccucuggacauaauaagagcaaaucuguaugauaacuugaauagccuacucccaag

SEQ ID NO: 253951 - RNA, 63 nt, Homo Sapiens
auaaaggcuuucuacauucugcaaaagauuugaguaugauaugugaaggaacugcucaucuaa

SEQ ID NO: 253952 - RNA, 63 nt, Homo Sapiens
augacaaaaaucuuuccugauguuaaauacaauguaugauaccuuuuagcuaaaaagagggac

SEQ ID NO: 253953 - RNA, 63 nt, Homo Sapiens
ccauaguauauuaaaaauggaaugccuuacuuuguaugauauuuugguuauacaugacacuga

SEQ ID NO: 253954 - RNA, 63 nt, Homo Sapiens
accuuuguaugucugucuuuuuagaaaucaguuguaugauacuguaucucaaaaguauugagu

SEQ ID NO: 253955 - RNA, 63 nt, Homo Sapiens
cauuuauuuaaaaugcauuaacuauaugugauaguaugauaugguaauaauuuuuuaagauuc

SEQ ID NO: 253956 - RNA, 63 nt, Homo Sapiens
aauuaauagcaauaauaauuuuauucuaaaauaguaugauaagagcaucuaugacuuccuuua

SEQ ID NO: 253957 - RNA, 63 nt, Homo Sapiens
aguaaugaaggcaaaauggauuauaagaaugugguaugauacucagaaauguugcuggugaau

SEQ ID NO: 253958 - RNA, 63 nt, Homo Sapiens
acaggaggugaugaaccuuuuuaugugcagcugguaugauagaaggaaauugggaaaacuugu

SEQ ID NO: 253959 - RNA, 63 nt, Homo Sapiens
accacuuuauauccacaaaggcaaauaacuaauguaugauaauagaauaauuugcacuaauua

SEQ ID NO: 253960 - RNA, 63 nt, Homo Sapiens
ugcaugccuagaguagugcuuuauguuaaaguaguaugauaaaacuguuuuccucauguucag

SEQ ID NO: 253961 - RNA, 63 nt, Homo Sapiens
uauauauauacacacacacagauaugggauuauguaugauauaaggguggguauagaugcaua

SEQ ID NO: 253962 - RNA, 63 nt, Homo Sapiens
gauuucagaguacaggucugugcauuaaaaauaguaugauaaauauaaaccauuuuuauuuca

SEQ ID NO: 253963 - RNA, 63 nt, Homo Sapiens
gggcuuucacugugauuuacugcauugcaggcuguaugauaaaacacacauaauuuaaagaga

SEQ ID NO: 253964 - RNA, 63 nt, Homo Sapiens
uuaaaaccaauauuuauaaaaaguguauaugcaguaugauaccacuuuuaaaaaaagauaaau

SEQ ID NO: 253965 - RNA, 63 nt, Homo Sapiens
uuguaaagcucucaccugguuaguauauuucuuguaugauauuuugaccauccuuucuuuuua

SEQ ID NO: 253966 - RNA, 63 nt, Homo Sapiens
cagguguauuccccucuacuugaaaaucacauaguaugauaaaacauauuuuugccaggaaga

SEQ ID NO: 253967 - RNA, 63 nt, Homo Sapiens
uaggucuaaaauauaguuugagcuuacuuuauuguaugauauguuuaauuucacuaugcuuuc

SEQ ID NO: 253968 - RNA, 63 nt, Homo Sapiens
gaaaugugaaguuugcaagaagcguaaaguaaaguaugauaugccaggagcccaugaaguaau

SEQ ID NO: 253969 - RNA, 63 nt, Homo Sapiens
uucagugucacuccauucauuuuaucgggaauaguaugauauuuuauuuugcauuaaacucuu

SEQ ID NO: 253970 - RNA, 63 nt, Homo Sapiens
uuugaaaaggcuuccauuaaauuccuaaaauguguaugauauaggauugcaccucuguaaacu

SEQ ID NO: 253971 - RNA, 63 nt, Homo Sapiens
uauaucauacguauauaaacaagaaguuagcagguaugauauguucagaacuuguuucuuauc

SEQ ID NO: 253972 - RNA, 63 nt, Homo Sapiens
uuugaugguugacuuaauuggcaccauaacuuuguaugauauuauacauuaaccuuuauuuau

SEQ ID NO: 253973 - RNA, 63 nt, Homo Sapiens
aguaggcuuggggcagcuggguuuguccuugauguaugauacuguuauuauaauaauuauuau

SEQ ID NO: 253974 - RNA, 63 nt, Homo Sapiens
ugcacagacaauugcaguaaacuucuauaaauaguaugauaaaugaaaauauuuaaauauugc

SEQ ID NO: 253975 - RNA, 63 nt, Homo Sapiens
auuguaucauuuauauuugcaaauugguaucguguaugauaauagauguagucaccucagaua

SEQ ID NO: 253976 - RNA, 63 nt, Homo Sapiens
uaaaacagauuuuuuguagaaccucuacauuuuguaugauaugugguucagugagcugcacug

SEQ ID NO: 253977 - RNA, 63 nt, Homo Sapiens
uuuuguaauuaauuuucuuagcugaauuuacagguaugauaauuugcccaacagaaaccuuag

SEQ ID NO: 253978 - RNA, 63 nt, Homo Sapiens
uugguauuuacucaaaucuuguaaaguucucuuguaugauaaugcugcuuaaaaggagacuua

SEQ ID NO: 253979 - RNA, 63 nt, Homo Sapiens
caauaaaauuuucuaaauaguuucuuuugauaaguaugauauuccuuuggggaaaauuaacuu

SEQ ID NO: 253980 - RNA, 63 nt, Homo Sapiens
agaaauguaguuugaaucauaaucuaaaucaucguaugauagaagagggaaaguuuuggugcc

SEQ ID NO: 253981 - RNA, 63 nt, Homo Sapiens
uuaaaaucuccuaaaugcuguaacuguauauuuguaugauauucaauuagauuucucacacuc

SEQ ID NO: 253982 - RNA, 63 nt, Homo Sapiens
auagauauaguguaccauacuucuaugccaagcguaugauacuagugcauggccuucuacggc

SEQ ID NO: 253983 - RNA, 63 nt, Homo Sapiens
uuguuagaauggaaaaguacguuuaaacugaauguaugauauugugucuggauauuaacucuu

SEQ ID NO: 253984 - RNA, 63 nt, Homo Sapiens
ccauguuucuuuauccauucaaauuacuccauuguaugauauguucauuucuuuuuauggccg

SEQ ID NO: 253985 - RNA, 63 nt, Homo Sapiens
guaagcuuuuauuaauacugaugacauuauaugguaugauaugaaaaaaucaccaauuuuuua

SEQ ID NO: 253986 - RNA, 63 nt, Homo Sapiens
cguguuuauuuuuguauuuuucucugguugggaguaugauaugaaggaucaagauccucaacu

SEQ ID NO: 253987 - RNA, 63 nt, Homo Sapiens
aaaagaauaaucaauuuaguuuuaaauaucuuaguaugauaucuuguuagugaacaggccugu

SEQ ID NO: 253988 - RNA, 63 nt, Homo Sapiens
guggucuucucacauggugcauuggcucccuuuguaugauaucacgcguuuguccaacagcuc

SEQ ID NO: 253989 - RNA, 63 nt, Homo Sapiens
cuaaaacacugucaaauaaaaaucuuguuuacuguaugauauugauaaauuaacuuuuacaga

SEQ ID NO: 253990 - RNA, 63 nt, Homo Sapiens
gacuagcacuagacaugucacaugcauuuucuuguaugauaguuuuacacgaacugaaaugag

SEQ ID NO: 253991 - RNA, 63 nt, Homo Sapiens
gaaacucaucauuuuagucauauagcuaaguguguaugauaaucuuugacugcuguuauuacc

SEQ ID NO: 253992 - RNA, 63 nt, Homo Sapiens
gcuguguugaaggcugugguuaauaaaacacaaguaugauaaacaggaccuagcguuuagccc

SEQ ID NO: 253993 - RNA, 63 nt, Homo Sapiens
uuuguucuauggaaucaaauuucucacaaugcuguaugauacuauuuaaauuuggaggacaac

SEQ ID NO: 253994 - RNA, 63 nt, Homo Sapiens
cuugguuuaaauucucuuugauguguuuuggauguaugauauguuggugacucaucaauggau

SEQ ID NO: 253995 - RNA, 63 nt, Homo Sapiens
uuuaaaaaggugagcuuauauauaugacacaaaguaugauaccacuguuuccaaaauuauuuc

SEQ ID NO: 253996 - RNA, 63 nt, Homo Sapiens
gcaucagcugcuuugaaggcugaagauuguuuuguaugauacugcacagcaucaggcauuuua

SEQ ID NO: 253997 - RNA, 63 nt, Homo Sapiens
aauguggaaggucaucaauacccccgcccugcuguaugauauuuccacucagcuugguuccug

SEQ ID NO: 253998 - RNA, 63 nt, Homo Sapiens
uauugguugugucuacugcccauuugagaaauuguaugauauuucauaaugggaaaucuuuuu

SEQ ID NO: 253999 - RNA, 63 nt, Homo Sapiens
gagcaagacuccaucucauaaauuaaaaggaaaguaugauaguguuauggauuuuagcucuga

SEQ ID NO: 254000 - RNA, 63 nt, Homo Sapiens
auauugguauaugacauaacaggaaacaguauuguaugauauauuuauaaaugcuauaaagaa

SEQ ID NO: 254001 - RNA, 63 nt, Homo Sapiens
ggucaagacuaacuuucuuuuaaagguucauuuguaugauaaauucauauguguauauauaau

SEQ ID NO: 254002 - RNA, 63 nt, Homo Sapiens
gauuguauuucuguggaagaguaaaaguuguauguaugauauuugaaaaugcuaucccugcac

SEQ ID NO: 254003 - RNA, 63 nt, Homo Sapiens
auccugugggaggaugagagcuacugggccguuguaugauagguugguaggggcuuguugauc

SEQ ID NO: 254004 - RNA, 63 nt, Homo Sapiens
ugguuauuuuacagcauacaagcuucugcuccaguaugauaauuuuuaauugccuaagaauca

SEQ ID NO: 254005 - RNA, 63 nt, Homo Sapiens
gaagaaaaauaaaaauuuauauucuuaaaugcuguaugauaauaaccucaagacagauuuauu

SEQ ID NO: 254006 - RNA, 63 nt, Homo Sapiens
aagacauucuuccccaggagcuucucccuuaucguaugauagauuucucuugcuuccucuucu

SEQ ID NO: 254007 - RNA, 63 nt, Homo Sapiens
aauuauagucuauuauuuuaaagggauuuuucaguaugauaugggccauuuuguucaucuauc

SEQ ID NO: 254008 - RNA, 63 nt, Homo Sapiens
ggcucauuugagcauuuuggaauauuugagaauguaugauacauguaaaauuaaaaaaacuau

SEQ ID NO: 254009 - RNA, 63 nt, Homo Sapiens
aucauuuuagacacuuuaggagggggugaaguuguaugauaaagcagauauuuuaauuauuug

SEQ ID NO: 254010 - RNA, 63 nt, Homo Sapiens
acauaccuaguuuuguguauuggcuuugcuggaguaugauagcaaaaugaagacucuuuuacu

SEQ ID NO: 254011 - RNA, 63 nt, Homo Sapiens
cuuguuucaggaaugguuaauucuucaacguugguaugauaaugauaacuuguuuugacuuga

SEQ ID NO: 254012 - RNA, 63 nt, Homo Sapiens
aaacuauuuugcaguuguaauugguaggugaugguaugauaucaguuuauagaaagaugcuga

SEQ ID NO: 254013 - RNA, 63 nt, Homo Sapiens
uguuugauuuguaaauuacaguacauaguaaguguaugauagaugauucgugaauaaaacuag

SEQ ID NO: 254014 - RNA, 63 nt, Homo Sapiens
uuaacuguacaauaauguuguugcuguaauauuguaugauacuaagaaauaggcauuauuuua

SEQ ID NO: 254015 - RNA, 63 nt, Homo Sapiens
uaaagugcuugagucuauuugaaugaaacuuuuguaugauacauucccguggcugccaccagc

SEQ ID NO: 254016 - RNA, 63 nt, Homo Sapiens
aaagacgguauuaaaauggaacugaacacauguguaugauacugaggcuuuggguggcucacu

SEQ ID NO: 254017 - RNA, 63 nt, Homo Sapiens
augcuugguuuucuuuuuuccaacauuaaggcaguaugauauccaaauuuaaggggagcucuu

SEQ ID NO: 254018 - RNA, 63 nt, Homo Sapiens
uuuucuccuguguuauauaugcauuaugugcagguaugauauuuucuucacuacuuuuucuau

SEQ ID NO: 254019 - RNA, 63 nt, Homo Sapiens
gacuauguuagauuauuuuuaaagaugaaacauguaugauaggauggauucuuucuguauucu

SEQ ID NO: 254020 - RNA, 63 nt, Homo Sapiens
uagaagagucaccagcagguuccaaauugauguguaugauaggaaaaaaaccuuaauuuuaaa

SEQ ID NO: 254021 - RNA, 63 nt, Homo Sapiens
cuguauguaguuuuuagucugaugggauuuguuguaugauaaaggggaauuucaggggacaga

SEQ ID NO: 254022 - RNA, 63 nt, Homo Sapiens
uuuaucacacagccuaaggcuuugaugauggagguaugauaggccaaauuauucugaagguuu

SEQ ID NO: 254023 - RNA, 63 nt, Homo Sapiens
cuaaacaucuguuuuaguauuccuaaaaugaauguaugauauuaugugaaagcauauuuugua

SEQ ID NO: 254024 - RNA, 63 nt, Homo Sapiens
gacauuguccuuugggcuagaauuaaaagagggguaugauaggugcuaaguggaaacugcaug

SEQ ID NO: 254025 - RNA, 63 nt, Homo Sapiens
auaauguauauuuauguagacuguggaguauuuguaugauaccauuuuaauuuuuuaaugucu

SEQ ID NO: 254026 - RNA, 63 nt, Homo Sapiens
aaaacagugguccugaaaacaguugcaaaaacaguaugauaauaucagagcccaaugccuaca

SEQ ID NO: 254027 - RNA, 63 nt, Homo Sapiens
uauuucauugguuuugugaguuuaugcaggcaaguaugauacuaagaagagaggugcacauaa

SEQ ID NO: 254028 - RNA, 63 nt, Homo Sapiens
auacgugcaguaucuuuaaugaguaucuucaugguaugauaguguguguuugugagugcgaag

SEQ ID NO: 254029 - RNA, 63 nt, Homo Sapiens
uuauuuugauguaaagauguugaaaacuuuguaguaugauaggucuguuacacuuuuuggaag

SEQ ID NO: 254030 - RNA, 63 nt, Homo Sapiens
gcauuuaaauauuauauuuacaauggaaauaaaguaugauauuuuuauucauuguuaucuugc

SEQ ID NO: 254031 - RNA, 63 nt, Homo Sapiens
auucacauuaugauauguguuuuauagcagcccguaugauauuagggaugcugaccacagacc

SEQ ID NO: 254032 - RNA, 63 nt, Homo Sapiens
cuuuauuaagauguauaaaaggucaauuucaguguaugauauaccauauaauguuagcuggaa

SEQ ID NO: 254033 - RNA, 63 nt, Homo Sapiens
caauaaugcacuuuucauacuugaaauuuauuuguaugauauaaaguuauuacuuuaaacaaa

SEQ ID NO: 254034 - RNA, 63 nt, Homo Sapiens
agugccucuggauuuagagauauauauccuaggguaugauacuacugugacgggucuaacagc

SEQ ID NO: 254035 - RNA, 63 nt, Homo Sapiens
auaaacuuugaauuaaauacaguugucuugaggguaugauaaguccacaaaaaauuggaaagc

SEQ ID NO: 254036 - RNA, 63 nt, Homo Sapiens
uuagaagauauuuguuuuuuaaaauauauugauguaugauaaagaugaucuaauuugugaaug

SEQ ID NO: 254037 - RNA, 63 nt, Homo Sapiens
auuuucaaaugugaacaaucucacuagcagagaguaugauacauaucgggaguuccuuauuua

SEQ ID NO: 254038 - RNA, 63 nt, Homo Sapiens
ccaagguaauaaaugcuguuagcaacaagaccaguaugauauacuuaaaugugaaggaacaac

SEQ ID NO: 254039 - RNA, 63 nt, Homo Sapiens
aucaagagaauuaugggacguaguagugaguguguaugauagacaauaauuugagggcaaacu

SEQ ID NO: 254040 - RNA, 63 nt, Homo Sapiens
gcagaucccagagucaguaaaucugccugugaaguaugauagucugcauuuguaaugagcauu

SEQ ID NO: 254041 - RNA, 63 nt, Homo Sapiens
aggcagacuauucccaacuuuagcaagccccaaguaugauaauuucauauagaacugauaaug

SEQ ID NO: 254042 - RNA, 63 nt, Homo Sapiens
ugucuugaggaaaagcacuucucugugucugaaguaugauaguggguagugugcauaaaguac

SEQ ID NO: 254043 - RNA, 63 nt, Homo Sapiens
uaaucagagcauugaccagaugcuggcuuuuauguaugauaccuuuaaagauuuaaacuaaua

SEQ ID NO: 254044 - RNA, 63 nt, Homo Sapiens
ugggaaagucuuuaguuauaaaauguuuuguguguaugauauaggauaacauaccugauggag

SEQ ID NO: 254045 - RNA, 63 nt, Homo Sapiens
agugcuuaaaaaguuaauaaaauaaaaugaucuguaugauaccugcaauugaaaagccgaaaa

SEQ ID NO: 254046 - RNA, 63 nt, Homo Sapiens
acuaaugaaguuuuaaauuaacaaccacuacuuguaugauaugaauaauauuuagaaauguua

SEQ ID NO: 254047 - RNA, 63 nt, Homo Sapiens
accaccaauaguguaugugagccuuauuuuuauguaugauaggacuuuuuuuaguccaaaugu

SEQ ID NO: 254048 - RNA, 63 nt, Homo Sapiens
aagauaauuugugggcagggguggaggaugcauguaugauacuccauaaauucaacauucuuu

SEQ ID NO: 254049 - RNA, 63 nt, Homo Sapiens
uuuguaagauaauuuauuugaguagaaaagcaaguaugauauuuuuuaccaguauaguaaaaa

SEQ ID NO: 254050 - RNA, 63 nt, Homo Sapiens
uuguaaaguugauacuuuccuacuuuucuagguguaugauacuuagacugagaaauucauguu

SEQ ID NO: 254051 - RNA, 63 nt, Homo Sapiens
cucuggucuccugguucaacaacaggcuuauauguaugauacauguaauuuaaaccuucagac

SEQ ID NO: 254052 - RNA, 63 nt, Homo Sapiens
ucgacacuguucuuagcucaaacucauacacucguaugauacuucuucuuucauuucuucuac

SEQ ID NO: 254053 - RNA, 63 nt, Homo Sapiens
caacaguuggaggaauccauagaaaacuagaaaguaugauaaagaaugcuagguaaucuucgu

SEQ ID NO: 254054 - RNA, 63 nt, Homo Sapiens
aauuuugaaaagaauagaggaaacacccucacuguaugauauaaaguuauagucauuuaaaaa

SEQ ID NO: 254055 - RNA, 63 nt, Homo Sapiens
uuacggacagcauauaauucucccugcaaggauguaugauaauauguacaaaguaauuccaac

SEQ ID NO: 254056 - RNA, 63 nt, Homo Sapiens
ccuggacauccugaaggagaaguggucugccccguaugauaucaggaccauccugcucucuau

SEQ ID NO: 254057 - RNA, 63 nt, Homo Sapiens
aggaaugugggaaagugauccuggagagaugcuguaugauauaaaaucaugaaauaucucaca

SEQ ID NO: 254058 - RNA, 63 nt, Homo Sapiens
uuguuuugcuauacaguacaaucugaaagcaaaguaugauaguauaaaguauacagaaacauu

SEQ ID NO: 254059 - RNA, 63 nt, Homo Sapiens
agauacauacuaugaaaugaaaaauaaaagaucguaugauauguuaugucagugugauuauaa

SEQ ID NO: 254060 - RNA, 63 nt, Homo Sapiens
aauggaauuuugcacauaauacauuguaauacuguaugauaaucaugugugaaaauaauuuuu

SEQ ID NO: 254061 - RNA, 63 nt, Homo Sapiens
aaccuuauauggguugcuuuugcuuucacaccuguaugauagucauggaaacugaagcccaga

SEQ ID NO: 254062 - RNA, 63 nt, Homo Sapiens
ugccuguaaauguuccccaaauaauuguuguguguaugauacguguauaauaaaaguauucuu

SEQ ID NO: 254063 - RNA, 63 nt, Homo Sapiens
augagcaaguaaauagaauaauauuuuauuaauguaugauauguaauacuuauugucuaaauc

SEQ ID NO: 254064 - RNA, 63 nt, Homo Sapiens
uuguuuucuccccugauuaauggugauauucaaguaugauacaaaaagaauuguaccaccaaa

SEQ ID NO: 254065 - RNA, 63 nt, Homo Sapiens
accccccuuuguauuauagucaugcggucuuauguaugauaaacaguugaauaauuuguccuc

SEQ ID NO: 254066 - RNA, 63 nt, Homo Sapiens
cguacaaaacacacagcaaggauaucucacaauguaugauauaucucuccagagcuuucaucu

SEQ ID NO: 254067 - RNA, 63 nt, Homo Sapiens
gaucuauuuuaauacacuuagagaaacugugcuguaugauacaugucauucucacgacuccgg

SEQ ID NO: 254068 - RNA, 63 nt, Homo Sapiens
aaacaaaucccuaacacgugguaugggugaaccguaugauaugcuuugccauugugaaacuuu

SEQ ID NO: 254069 - RNA, 63 nt, Homo Sapiens
uuagauaugccauucauaucaaguaauguucaaguaugauaaaauuauuuugguugcuuuaaa

SEQ ID NO: 254070 - RNA, 63 nt, Homo Sapiens
uggcuauuuuguuggccaaugggacauuaacaaguaugauacaagcagaggcuugagaagugc

SEQ ID NO: 254071 - RNA, 63 nt, Homo Sapiens
aggagucaaguuacuggugccacagaucuggagguaugauaggucaggggcuagguguugaac

SEQ ID NO: 254072 - RNA, 63 nt, Homo Sapiens
accuguaaaaguauugacucuucuaccaaguugguaugauauuccaggcagcucaaugauuau

SEQ ID NO: 254073 - RNA, 63 nt, Homo Sapiens
cuguauuucaauaaauuccugaauauucuauuuguaugauacauuccuuugaucauuucaugu

SEQ ID NO: 254074 - RNA, 63 nt, Homo Sapiens
uacaacugagugguacagauuauacacaaaaguguaugauaugacauaagacauacaucacau

SEQ ID NO: 254075 - RNA, 63 nt, Homo Sapiens
auugauauaucagccucuuuucaauaaacuuugguaugauauggaaauuuuuguuugauguaa

SEQ ID NO: 254076 - RNA, 63 nt, Homo Sapiens
aaacuuggccuaaaaucaaaccuuggcacagagguaugauacaacuuuaacaggagucaucaa

SEQ ID NO: 254077 - RNA, 63 nt, Homo Sapiens
ccaaccuuauagauuguuggcuuucacaaucuuauaaccuaggauacagguaguuucgaguau

SEQ ID NO: 254078 - RNA, 63 nt, Homo Sapiens
uuaugguuuuuggaguuuuucccuuuuuuugggauaaccuaacauugguuuggaaugauugug

SEQ ID NO: 254079 - RNA, 63 nt, Homo Sapiens
uccagugcaaaauuaaaccauuaguucuugaugauaaccuagcauuaauacuuacaguauuuu

SEQ ID NO: 254080 - RNA, 63 nt, Homo Sapiens
aaugugaacaugcuucagaguguaccuuuugccauaaccuauuuuaauuuacuuuuucugaag

SEQ ID NO: 254081 - RNA, 63 nt, Homo Sapiens
aaaaagcgacauaaaaauauuggaaaugcaucaauaaccuaaggcaaagaaaugaagagauuc

SEQ ID NO: 254082 - RNA, 63 nt, Homo Sapiens
auuguauguuuugcauuccuucuuguauugaaaauaaccuaugaagcaaacaaauuuaaguuu

SEQ ID NO: 254083 - RNA, 63 nt, Homo Sapiens
ugcuuacucaaugccuuuaaccucuguucucugauaaccuacuuuaucuacaauggaaucuuc

SEQ ID NO: 254084 - RNA, 63 nt, Homo Sapiens
caguguuaaaaaucagauaccauuuugguugaaauaaccuacauccuaaagaauguguucuug

SEQ ID NO: 254085 - RNA, 63 nt, Homo Sapiens
caaccuuugcucugaaauucgugugggaaugugauaaccuaaauuguuuuguggguauuagga

SEQ ID NO: 254086 - RNA, 63 nt, Homo Sapiens
caaaguuaucgauauucuuaaggauggugauuuauaaccuaccuaauuuguuaaauuaucucu

SEQ ID NO: 254087 - RNA, 63 nt, Homo Sapiens
ugcuggaaaacaagggaaaucuuccaacaccaaauaaccuaacguucuuuuccuuuauauagg

SEQ ID NO: 254088 - RNA, 62 nt, Homo Sapiens
aagacagugaccuggagugaaacagaaucuacauaaccuaagcccauauacucugcacugug

SEQ ID NO: 254089 - RNA, 63 nt, Homo Sapiens
agucccuuauguaaaauggugcaguauuugcauauaaccuacauaccuucucuugugcaaucc

SEQ ID NO: 254090 - RNA, 63 nt, Homo Sapiens
uaaagaaaggaaaagaaaacauuuaauaugcuuauaaccuagugcuuggaguuuaccuggcuu

SEQ ID NO: 254091 - RNA, 63 nt, Homo Sapiens
uaauauauuaaaauuccaaaucuuguuuugaaaauaaccuaauauucuauuuauaauacagaa

SEQ ID NO: 254092 - RNA, 63 nt, Homo Sapiens
uugagccaacuccugaguuuuggauuugggggcauaaccuaauuuuuuauaucaaauuuaagc

SEQ ID NO: 254093 - RNA, 63 nt, Homo Sapiens
uucuagaguagacaaucuggggcacagcuauucauaaccuauauaugaauucucuguucuggu

SEQ ID NO: 254094 - RNA, 63 nt, Homo Sapiens
ugaccuaaauaagaacacugauuaagaaacaugauaaccuaaauucaaaauucaaacugucac

SEQ ID NO: 254095 - RNA, 63 nt, Homo Sapiens
cacauucucccauauaguuuguaguauuugcauauaaccuaugaaaauaauuaauaaaauggu

SEQ ID NO: 254096 - RNA, 63 nt, Homo Sapiens
aaacaaaccccagcuuguuuaacagaaaugcuaauaaccuacugggaaagauggaggucuaaa

SEQ ID NO: 254097 - RNA, 63 nt, Homo Sapiens
ccucagguuuuaaauuacaaccacaguugaauaauaaccuaaaaauaaauuuuaguuugcuaa

SEQ ID NO: 254098 - RNA, 63 nt, Homo Sapiens
caaaaagcuggaacuuaccacucaaaaacauguauaaccuaauaaauucuacacaaggcuuuc

SEQ ID NO: 254099 - RNA, 63 nt, Homo Sapiens
uuuuagaacaaauuucuaaauuaauuuauucccauaaccuacaauagcacugagaacagaaaa

SEQ ID NO: 254100 - RNA, 63 nt, Homo Sapiens
cugcuggaaagcacccuuuucugaaaacaaagaauaaccuaggagcauuuccagugguguggc

SEQ ID NO: 254101 - RNA, 63 nt, Homo Sapiens
aaaucaucaaaaugagaucacuucagggggcugauaaccuagucgcaugcaagcuugauucac

SEQ ID NO: 254102 - RNA, 63 nt, Homo Sapiens
acuuuucuauaucucaaauuaauauacauuuucauaaccuaccuuuguauuaagacuugcaau

SEQ ID NO: 254103 - RNA, 63 nt, Homo Sapiens
gaaguagaauaaaauugaauaagaaaaagaucuauaaccuagguaaagcauaaucugucagag

SEQ ID NO: 254104 - RNA, 63 nt, Homo Sapiens
uauuuauguauuucuauucugauuucugaaaugauaaccuaguagugucugaugaaguuuuuu

SEQ ID NO: 254105 - RNA, 63 nt, Homo Sapiens
auccauaguguuuagagagaaaaaaauaaaccaauaaccuaccuacugacaaguaaauuuaua

SEQ ID NO: 254106 - RNA, 63 nt, Homo Sapiens
guuagauuaggccuuauaaaacuugugugcauuauaaccuaagcugugcaaccugugaagcca

SEQ ID NO: 254107 - RNA, 63 nt, Homo Sapiens
gaggaaguuuguuuuuuaauuuaagagggaaauauaaccuauaaauuuguuucuuccaagcuu

SEQ ID NO: 254108 - RNA, 63 nt, Homo Sapiens
acuaucauaguuauuaaugugaaauaaaagaugauaaccuaaccuggagguacaaauaauuua

SEQ ID NO: 254109 - RNA, 63 nt, Homo Sapiens
cuuaauuauucuguaagaacuuguacuauacguauaaccuaacaaauuaaaaaugugaaacug

SEQ ID NO: 254110 - RNA, 63 nt, Homo Sapiens
ggaaugauguaguaacacagaucaugcacaacuauaaccuaugcuuuucuauuuuuuauaaau

SEQ ID NO: 254111 - RNA, 63 nt, Homo Sapiens
acagggaauugggagccaucucuugguuucagcauaaccuaagacaccacuuuucaaaggacu

SEQ ID NO: 254112 - RNA, 63 nt, Homo Sapiens
ccaucuacucuuuaguacugacuuucacuguguauaaccuaaauaucauuccuguguuguugu

SEQ ID NO: 254113 - RNA, 63 nt, Homo Sapiens
ugccagauuucuauucaacgauugcuuauacaaauaaccuacaagguuuccuucagauugcug

SEQ ID NO: 254114 - RNA, 63 nt, Homo Sapiens
auccgcaagcaugcuaauuuuaggaggagaacaauaaccuaccccaaacacugcuuugaauua

SEQ ID NO: 254115 - RNA, 63 nt, Homo Sapiens
aauuguuuuuucuaggagauccagcuaguggaaauaaccuaccccugguuacuauguauguug

SEQ ID NO: 254116 - RNA, 63 nt, Homo Sapiens
ggaauguuuggaugccaguuucuggguucucugauaaccuaugaaacugaaacagauggguuu

SEQ ID NO: 254117 - RNA, 63 nt, Homo Sapiens
cacuaagauuuuauguuggagauacuucuuuaaauaaccuacagcuugggucuauggcuguga

SEQ ID NO: 254118 - RNA, 63 nt, Homo Sapiens
uuggaaagggucuaauucauacaugcuuaaaguauaaccuacguuagauaguuuguugucaaa

SEQ ID NO: 254119 - RNA, 63 nt, Homo Sapiens
cauaauuaaaucauagcuaguauaacuuuacagauaaccuaaaaagaauagaaaagaagagag

SEQ ID NO: 254120 - RNA, 63 nt, Homo Sapiens
gcaguugguugaauaauuauaaacaaccaauacauaaccuaugaaaauauauaauuuucucac

SEQ ID NO: 254121 - RNA, 63 nt, Homo Sapiens
uaagggacauuuuauaauuucacaaucauuacuauaaccuaauuuuagguguuugcuaauaua

SEQ ID NO: 254122 - RNA, 63 nt, Homo Sapiens
ugauuuauaguuuguacauggaaaugcugauggauaaccuauauauuuuuuguaggggucaaa

SEQ ID NO: 254123 - RNA, 63 nt, Homo Sapiens
caucaggacuuacaucacuucagagguuugguaauaaccuaugauuaguaaaugugaugcagu

SEQ ID NO: 254124 - RNA, 63 nt, Homo Sapiens
aguccucagcuaaaaauagcguaguauuugcauauaaccuaugcacauccuccuguauacuuu

SEQ ID NO: 254125 - RNA, 63 nt, Homo Sapiens
uuaugauaauaagcuuauauaugugaauaaguuauaaccuaguguauaaaaaauuauuucuaa

SEQ ID NO: 254126 - RNA, 63 nt, Homo Sapiens
uuauauccagauauacaaccacaauaaagcaaaauaaccuacuaucaaaauagaaauguugcu

SEQ ID NO: 254127 - RNA, 63 nt, Homo Sapiens
cuaacuggaagaucaaaaucaugucucuugcugauaaccuaagagcauuaagcucugagucca

SEQ ID NO: 254128 - RNA, 63 nt, Homo Sapiens
auauaaguacuaaaacuguaaaaauccuggaauauaaccuaagaaauaccaauguggacauag

SEQ ID NO: 254129 - RNA, 61 nt, Homo Sapiens
cauguuuccaaaaaucucugaacaaauuauuuaauaaccuauuuguaaaugccguacaaua

SEQ ID NO: 254130 - RNA, 63 nt, Homo Sapiens
accuauuuuguaugcgacuccaugcuucaguuuauaaccuauuuccucacuuugacagaaacu

SEQ ID NO: 254131 - RNA, 63 nt, Homo Sapiens
guagaaccuuuucuuaucucaguggaaccuucuauaaccuaaauauaccauugaugauucuuc

SEQ ID NO: 254132 - RNA, 63 nt, Homo Sapiens
gguguucagggcacuucuuguccucucugucccauaaccuaccuccacccucccccuagccag

SEQ ID NO: 254133 - RNA, 63 nt, Homo Sapiens
agccuugaaagcuuugauaaguuuucaguaauaauaaccuauuuaaucagaugaugauguguu

SEQ ID NO: 254134 - RNA, 63 nt, Homo Sapiens
gaaccuggaaauacaacuuuauauuuuucucccauaaccuaguuccacagauuaauuaguaac

SEQ ID NO: 254135 - RNA, 63 nt, Homo Sapiens
augcagaagauuuagguuuccagagaagcauacauaaccuagcuucuuuuuacucuugccucu

SEQ ID NO: 254136 - RNA, 63 nt, Homo Sapiens
cucuuaaaccugguaacacuugauuugccuucuauaaccuauuuauuucaaguguucauauuu

SEQ ID NO: 254137 - RNA, 63 nt, Homo Sapiens
uaccucuaacuguguaacauuuuagacuucuuaauaaccuaaauauuuaaaauaaugaaugua

SEQ ID NO: 254138 - RNA, 63 nt, Homo Sapiens
acugcagaaggaucugaaaguaccucuguagaaauaaccuaaagguauucauucacuuaaagg

SEQ ID NO: 254139 - RNA, 63 nt, Homo Sapiens
ugaguucuuaaagaauucuaaauuuccauaaucauaaccuaaaaggaucuuucauaaaaauuu

SEQ ID NO: 254140 - RNA, 63 nt, Homo Sapiens
uuuccugggacugccauauuaacuguuaaaugcauaaccuaaucaauugaguaguacagugga

SEQ ID NO: 254141 - RNA, 63 nt, Homo Sapiens
uuuuuuuguacuuguggaucuuuuguacuucucauaaccuaaugucagacuaagaaaaauaaa

SEQ ID NO: 254142 - RNA, 63 nt, Homo Sapiens
acauuacaaagcaaagacuauuuuuaugcuuccauaaccuagaauuaaaaccaaauuaugacc

SEQ ID NO: 254143 - RNA, 63 nt, Homo Sapiens
augaugacuuuuaagcauuuacaucacguacucauaaccuauuaugaaaauaaaugaaacugg

SEQ ID NO: 254144 - RNA, 63 nt, Homo Sapiens
ucucaaaaaaaaaaaaaucuuacaaccucacaaauaaccuaguucaaaaaugggcaaagauuu

SEQ ID NO: 254145 - RNA, 63 nt, Homo Sapiens
aacucaugccugucuuggcuaaagaugauauuuauaaccuaggauaaaauacccacuuuuuau

SEQ ID NO: 254146 - RNA, 63 nt, Homo Sapiens
uggccaggagaauuaucucacuucacacaaauaauaaccuaucaaccuacaggucauuugagu

SEQ ID NO: 254147 - RNA, 63 nt, Homo Sapiens
cggauccccaccugacacuauuggccaaugugcauaaccuacuagcauaccugucucagcugu

SEQ ID NO: 254148 - RNA, 63 nt, Homo Sapiens
uucucccaacugguucgaccuuugcagauacccauaaccuauguugagccuugcuuaccagca

SEQ ID NO: 254149 - RNA, 63 nt, Homo Sapiens
guguacaguagcuuaaaauugcagugauugagcauaaccuacuuguuuguauaaauuauugaa

SEQ ID NO: 254150 - RNA, 63 nt, Homo Sapiens
uuuugucaugguucauuauuauuaaagcacaaaauaaccuauuguuagaaaauauguguuuuu

SEQ ID NO: 254151 - RNA, 63 nt, Homo Sapiens
auuccugaaaaugucauauauuuucauuaauaaauaaccuaaauaugauaaaacauaaagcag

SEQ ID NO: 254152 - RNA, 63 nt, Homo Sapiens
gguggacaaugauuuuuaaaaaacuaacuuuguauaaccuaauauuuguauucucucaucuau

SEQ ID NO: 254153 - RNA, 63 nt, Homo Sapiens
aauuguaucuacauuaaaauuguaauaugacagauaaccuaauaaauuuaaaaacuuaaauau

SEQ ID NO: 254154 - RNA, 63 nt, Homo Sapiens
cgguaguugcuuuaggggguacaacaaaaaaaaauaaccuauauucaaugaaaugaccuaaaa

SEQ ID NO: 254155 - RNA, 63 nt, Homo Sapiens
uuuuaagaaugagaaacugccuuuggggcucuaauaaccuaccuagauuuguuaugaaaauug

SEQ ID NO: 254156 - RNA, 63 nt, Homo Sapiens
cucgacuauuuguuguuauguuuuuugaaggcuauaaccuaacgugacacuugaacuagucga

SEQ ID NO: 254157 - RNA, 63 nt, Homo Sapiens
aagaaguccaaacccagcacgcaacagcccaacauaaccuagaaugucaagacacucaagaua

SEQ ID NO: 254158 - RNA, 63 nt, Homo Sapiens
agacauuaugccugccuaaacaaaaagcaggacauaaccuagcucugaauacaugccacaagg

SEQ ID NO: 254159 - RNA, 63 nt, Homo Sapiens
cccacguagagagaguguggauuauauuacaugauaaccuaccuggggaacaguccagaaagc

SEQ ID NO: 254160 - RNA, 63 nt, Homo Sapiens
uuaaacuguaaauauauugucauacaauguuaaauaaccuauuuuuuuaaaaaaguucaacuu

SEQ ID NO: 254161 - RNA, 63 nt, Homo Sapiens
gcauauauuuugaaauagcuacuagaguuaacaauaaccuauuuuuuauugcauaguagggug

SEQ ID NO: 254162 - RNA, 63 nt, Homo Sapiens
aaguguuuaugacaaauuuagucuugguaacaaauaaccuauauguuuauauuuauuauauaa

SEQ ID NO: 254163 - RNA, 63 nt, Homo Sapiens
ugauguuauagaauuauuuuguagaaacuuucuauaaccuaaaaaagaauguaagggcuauaa

SEQ ID NO: 254164 - RNA, 63 nt, Homo Sapiens
ugaauguauuaaaaacuaauaccaacucuuuguauaaccuaccgccucagcccaggccucggg

SEQ ID NO: 254165 - RNA, 63 nt, Homo Sapiens
ccaauaaaaaugucucagcacacacacaaacauauaaccuaugcacacacacacacacacaca

SEQ ID NO: 254166 - RNA, 63 nt, Homo Sapiens
ugcccggcccaaauauuuuuuauucaggaugguauaaccuaacugauaauagguaauaagguu

SEQ ID NO: 254167 - RNA, 63 nt, Homo Sapiens
cuagauauuuaacaaaacauacggcucaaccucauaaccuauauguguguaugucuacaucug

SEQ ID NO: 254168 - RNA, 63 nt, Homo Sapiens
uuguagcuuaguaaugagucauagcuacccacaauaaccuaauaaaaacucaaguucauccca

SEQ ID NO: 254169 - RNA, 63 nt, Homo Sapiens
agcucauaucuuaaagauaaaagguacuauuauauaaccuauacacaagauacaggagaaaau

SEQ ID NO: 254170 - RNA, 63 nt, Homo Sapiens
ccuauauacugaccugccugacacauuugugaaauaaccuacuacuaugugacuuagugcaca

SEQ ID NO: 254171 - RNA, 63 nt, Homo Sapiens
gggucaggauaugaguccuggaugaauucuguuauaaccuaugcuagcccucuguuuuuguuu

SEQ ID NO: 254172 - RNA, 63 nt, Homo Sapiens
ugaugguaggaugauuguauaaauauuuaaagcauaaccuaacguuaaggauaccugauuuca

SEQ ID NO: 254173 - RNA, 63 nt, Homo Sapiens
uagauuucuagcauuugcuguauaccuugcaugauaaccuagcaaauuugaguuugucuuggu

SEQ ID NO: 254174 - RNA, 63 nt, Homo Sapiens
aaagggcuuugcaagagcuucuacucuccaccgauaaccuaucggaccccagguuugugcucc

SEQ ID NO: 254175 - RNA, 63 nt, Homo Sapiens
gaaaaauaugucuuacuggaaaaaucccucauaauaaccuaauagggcauugcuauuaaaaau

SEQ ID NO: 254176 - RNA, 63 nt, Homo Sapiens
uuuuacauaaaagcuugaacauacagaugaauuauaaccuaugugaagaaaucuuagauauaa

SEQ ID NO: 254177 - RNA, 63 nt, Homo Sapiens
caagcaauaagauuuauguauauuuguuuaauaauaaccuauuucaagucugaguuuugaaaa

SEQ ID NO: 254178 - RNA, 63 nt, Homo Sapiens
ucagacacauuauuuucuucugaacuuggcaauauaaccuaauaaggcagaauaaguuucugu

SEQ ID NO: 254179 - RNA, 63 nt, Homo Sapiens
ggauuauaaagagauaucaaagcacgauuuuagauaaccuaaacggcccagccuauacgaagu

SEQ ID NO: 254180 - RNA, 63 nt, Homo Sapiens
uuucuaaagucaaaauaugaaugcuaagaaggcauaaccuacauccuucucugauuucuucag

SEQ ID NO: 254181 - RNA, 63 nt, Homo Sapiens
auucauuuauguuucauauacaccuuauauacaauaaccuaaaggugauuuuauaugauauuu

SEQ ID NO: 254182 - RNA, 63 nt, Homo Sapiens
guugugcugguaccuguuuuuuuuugauguaauauaaccuaacauuugggaccauuaaaacuu

SEQ ID NO: 254183 - RNA, 63 nt, Homo Sapiens
caugccuucuuuauuccagcaguauaccuugcuauaaccuaaguggugauauuuuaggccagg

SEQ ID NO: 254184 - RNA, 63 nt, Homo Sapiens
gacaccaauuaauuuccuggucuuuaguauauaauaaccuaaaauaccauuguaaccucaguc

SEQ ID NO: 254185 - RNA, 63 nt, Homo Sapiens
uuuugcucaccuuauguaauacuguaacuuccuauaaccuaauauuuucgguaucauuaacca

SEQ ID NO: 254186 - RNA, 63 nt, Homo Sapiens
cuaugcaaaacaucaaaguguguuuuuuaaaaaauaaccuagauuggguaauuuuuaauuuuu

SEQ ID NO: 254187 - RNA, 63 nt, Homo Sapiens
uuauaaaagcagaaaccuaagguaaacugauacauaaccuaaaguuaaguagaagaaagccau

SEQ ID NO: 254188 - RNA, 55 nt, Homo Sapiens
uugaaaaauuccuauugugaguggaauaaccuauuagggagaagaugaugacuaa

SEQ ID NO: 254189 - RNA, 63 nt, Homo Sapiens
gguucucaugcggugcguaagaugauagauuuuauaaccuaacuucacauugauuuacugguu

SEQ ID NO: 254190 - RNA, 63 nt, Homo Sapiens
aagaaaggaggggauagagagagaccacuuuucauaaccuagccuuagaagucacacaguauu

SEQ ID NO: 254191 - RNA, 63 nt, Homo Sapiens
aacaaccucuucaaaguacccaggggguacagaauaaccuacaccuccacuuucuuuaagaau

SEQ ID NO: 254192 - RNA, 63 nt, Homo Sapiens
auguaaaaccccaaacuauaaaaacucuggaagauaaccuaggcaauaccauucuggacauag

SEQ ID NO: 254193 - RNA, 63 nt, Homo Sapiens
cacucuacuguuaaugacagauguucuguuuuuauaaccuaccaaaaggaaacuagaggcuuc

SEQ ID NO: 254194 - RNA, 63 nt, Homo Sapiens
uuucaaaugucuacauaaaauaucacuacccacauaaccuauaauuuguguggccagcaauuu

SEQ ID NO: 254195 - RNA, 63 nt, Homo Sapiens
uacauacuacaucaucuacagaaaucuugaucaauaaccuagaaacuagguuaucuagguuau

SEQ ID NO: 254196 - RNA, 63 nt, Homo Sapiens
uagauuuaaugugaaauuuauagugguauggauauaaccuauucucagcagaaguaucagaag

SEQ ID NO: 254197 - RNA, 63 nt, Homo Sapiens
gaaauuauucauuucuguucuccuacuggucaaauaaccuaagaaaggcugccuuugcaaaaa

SEQ ID NO: 254198 - RNA, 63 nt, Homo Sapiens
uuuuuuuaaugcuuuaaaaaauaugaacacuggauaaccuaauuaggaacuuuuaguuccauu

SEQ ID NO: 254199 - RNA, 63 nt, Homo Sapiens
acacaguagcaaauuuugaacgaugugauugauauaaccuaacaaaucugagccaguuauuau

SEQ ID NO: 254200 - RNA, 63 nt, Homo Sapiens
uaacaccagaaagaaccuugccgaucaccaggcauaaccuaauuuuauccauggaagaaacac

SEQ ID NO: 254201 - RNA, 63 nt, Homo Sapiens
aauaagccugugugguaggccacauagguccgaauaaccuaguuuuacaguugagggagcuga

SEQ ID NO: 254202 - RNA, 63 nt, Homo Sapiens
cagcuguugcauuagcuaaauauuguugaagcaauaaccuagcugcuuuugcauuaugaauua

SEQ ID NO: 254203 - RNA, 63 nt, Homo Sapiens
cauugcagauaccuauuauaaauauuuccauuaauaaccuauuaccagauuuuaauuuaaauu

SEQ ID NO: 254204 - RNA, 63 nt, Homo Sapiens
gacuguauucuguguauuaugaaguaaauugauauaaccuauuccugaauuaugcucuuaugu

SEQ ID NO: 254205 - RNA, 63 nt, Homo Sapiens
agggagaccccgguguguccguucuuuagcaauauaaccuacccagugcgugccgagcaggcu

SEQ ID NO: 254206 - RNA, 63 nt, Homo Sapiens
uuaaagcacugugugacauagcuccuuagagauauaaccuauugucugcucauugucacgugu

SEQ ID NO: 254207 - RNA, 63 nt, Homo Sapiens
cugaccacccacacucaaccucccucugaccucauaaccuaauggccuuggacaccagauucu

SEQ ID NO: 254208 - RNA, 63 nt, Homo Sapiens
cuuccauuacaccacagugaguucacagguaauauaaccuacccaccuguguaaugucaaaaa

SEQ ID NO: 254209 - RNA, 63 nt, Homo Sapiens
aaugauggaaguccaaaauguuaggaggacaucauaaccuaugaaacucaaauaaauguauga

SEQ ID NO: 254210 - RNA, 63 nt, Homo Sapiens
uuuuucucuauucucugcaauuguuuucuguaaauaaccuauuucuaaguacauauguagaua

SEQ ID NO: 254211 - RNA, 63 nt, Homo Sapiens
gccuccauagagggguuugggguguucaccaugauaaccuaguggucuauggcgagggaaaag

SEQ ID NO: 254212 - RNA, 63 nt, Homo Sapiens
ugccaguaagguccaaaggcaucugacugaaauauaaccuaccccuauauuagaaagauauug

SEQ ID NO: 254213 - RNA, 63 nt, Homo Sapiens
ugugauggagaucacccaaucuguacaaggcugauaaccuauaaucacuuugagaaaugaggc

SEQ ID NO: 254214 - RNA, 63 nt, Homo Sapiens
aaucaaucacuugaaagugaagaugaaauucaaauaaccuaaaguguuuggguuuuuuaauug

SEQ ID NO: 254215 - RNA, 63 nt, Homo Sapiens
gauaccugccuuguacuuaguaccuuaauaccaauaaccuaaugguacuuaggcgaguaccau

SEQ ID NO: 254216 - RNA, 63 nt, Homo Sapiens
ugccccuaaccugccuuuucccaucuccccagcauaaccuaauauuuuuuuuuuuuuuuugag

SEQ ID NO: 254217 - RNA, 63 nt, Homo Sapiens
cugagaccgugcuuggugggcucgcccuuuguaauaaccuaauccugggaugcccuccucccc

SEQ ID NO: 254218 - RNA, 63 nt, Homo Sapiens
uccgucugugucccacccaugcagacucucugaauaaccuagccaauaucaaacgagaacagg

SEQ ID NO: 254219 - RNA, 63 nt, Homo Sapiens
uuaaggaacccauuacugccauuuggaauucaaauaaccuaaccaaccuccaccuccuccuuc

SEQ ID NO: 254220 - RNA, 63 nt, Homo Sapiens
ugcuuaacuuuaucucuuaauuucuaaagguaaauaaccuagguucagcuuuugcuuaaacau

SEQ ID NO: 254221 - RNA, 63 nt, Homo Sapiens
guuuuagaggucagauuccucccaaccaggcuaauaaccuaacacauguuuaaaaaaaaucug

SEQ ID NO: 254222 - RNA, 63 nt, Homo Sapiens
ucuucucuucugugaucucaguaggccuaaccuauaaccuagcacagacugcuacagcugcuc

SEQ ID NO: 254223 - RNA, 63 nt, Homo Sapiens
agucccugauacaaaaugacgucguauuugaauauaaccuaugcacauccucccauacuuuaa

SEQ ID NO: 254224 - RNA, 63 nt, Homo Sapiens
cugugaggaaccuaguuaggaugauaucuaggcauaaccuagccauucccugaaaggaggaug

SEQ ID NO: 254225 - RNA, 63 nt, Homo Sapiens
uaccuccagcagcuggacaucaucuguagcuacauaaccuauaauaccucccaauccaaguag

SEQ ID NO: 254226 - RNA, 63 nt, Homo Sapiens
ucagguugcaguuuuaauauacuuuagguauagauaaccuaauacugcuuuauaaaaauggca

SEQ ID NO: 254227 - RNA, 63 nt, Homo Sapiens
uacuccguaaggggaaaugaucaguaagacgauauaaccuacuuauuaagggagacauuuuag

SEQ ID NO: 254228 - RNA, 63 nt, Homo Sapiens
auaauuuagaaaugaauuaauagaaaucugccgauaaccuaaacucucuaaugagaacaaagu

SEQ ID NO: 254229 - RNA, 65 nt, Homo Sapiens
cuccaaccuuauagauuguuggcuuucacaaucuuauaaccuaggauacagguaguuucgaguau

SEQ ID NO: 254230 - RNA, 65 nt, Homo Sapiens
gguuaugguuuuuggaguuuuucccuuuuuuugggauaaccuaacauugguuuggaaugauugug

SEQ ID NO: 254231 - RNA, 65 nt, Homo Sapiens
aauccagugcaaaauuaaaccauuaguucuugaugauaaccuagcauuaauacuuacaguauuuu

SEQ ID NO: 254232 - RNA, 65 nt, Homo Sapiens
guaaugugaacaugcuucagaguguaccuuuugccauaaccuauuuuaauuuacuuuuucugaag

SEQ ID NO: 254233 - RNA, 65 nt, Homo Sapiens
aaaaagcgacauaaaaauauucuggaaaugcaucaauaaccuaaguugcaaagaaaugaagagau

SEQ ID NO: 254234 - RNA, 65 nt, Homo Sapiens
auuguauguuuugcauuccuuuucuuguauugaaaauaaccuauguaaagcaaacaaauuuaagu

SEQ ID NO: 254235 - RNA, 65 nt, Homo Sapiens
ugcuuacucaaugccuuuaaucccucuguucucugauaaccuacuaauuaucuacaauggaaucu

SEQ ID NO: 254236 - RNA, 65 nt, Homo Sapiens
caguguuaaaaaucagauacugcauuuugguugaaauaaccuacaucuccuaaagaauguguucu

SEQ ID NO: 254237 - RNA, 65 nt, Homo Sapiens
caaccuuugcucugaaauucgagugugggaaugugauaaccuaaaucuuguuuuguggguauuag

SEQ ID NO: 254238 - RNA, 65 nt, Homo Sapiens
caaaguuaucgauauucuuacuaggauggugauuuauaaccuaccuuuaauuuguuaaauuaucu

SEQ ID NO: 254239 - RNA, 65 nt, Homo Sapiens
ugcuggaaaacaagggaaauggcuuccaacaccaaauaaccuaacaaguucuuuuccuuuauaua

SEQ ID NO: 254240 - RNA, 62 nt, Homo Sapiens; identical to SEQ ID NO: 254088

SEQ ID NO: 254241 - RNA, 65 nt, Homo Sapiens
caagucccuuauguaaaauggugcaguauuugcauauaaccuacauaccuucucuugugcaaucc

SEQ ID NO: 254242 - RNA, 65 nt, Homo Sapiens
uaaagaaaggaaaagaaaacuuauuuaauaugcuuauaaccuagugugcuuggaguuuaccuggc

SEQ ID NO: 254243 - RNA, 65 nt, Homo Sapiens
uaauauauuaaaauuccaaaaaucuuguuuugaaaauaaccuaauaaauucuauuuauaauacag

SEQ ID NO: 254244 - RNA, 65 nt, Homo Sapiens
uugagccaacuccugaguuugcuggauuugggggcauaaccuaauuuuuuuuauaucaaauuuaa

SEQ ID NO: 254245 - RNA, 65 nt, Homo Sapiens
uucuagaguagacaaucuggguggcacagcuauucauaaccuauaucuaugaauucucuguucug

SEQ ID NO: 254246 - RNA, 65 nt, Homo Sapiens
ugaccuaaauaagaacacugacauuaagaaacaugauaaccuaaaauuucaaaauucaaacuguc

SEQ ID NO: 254247 - RNA, 65 nt, Homo Sapiens
cacauucucccauauaguuuguguaguauuugcauauaaccuaugauaaaauaauuaauaaaaug

SEQ ID NO: 254248 - RNA, 65 nt, Homo Sapiens
guaaacaaaccccagcuuguuuaacagaaaugcuaauaaccuacugggaaagauggaggucuaaa

SEQ ID NO: 254249 - RNA, 65 nt, Homo Sapiens
agccucagguuuuaaauuacaaccacaguugaauaauaaccuaaaaauaaauuuuaguuugcuaa

SEQ ID NO: 254250 - RNA, 65 nt, Homo Sapiens
accaaaaagcuggaacuuaccacucaaaaacauguauaaccuaauaaauucuacacaaggcuuuc

SEQ ID NO: 254251 - RNA, 65 nt, Homo Sapiens
uauuuuagaacaaauuucuaaauuaauuuauucccauaaccuacaauagcacugagaacagaaaa

SEQ ID NO: 254252 - RNA, 65 nt, Homo Sapiens
cugcuggaaagcacccuuuugccugaaaacaaagaauaaccuaggaaagcauuuccaguggugug

SEQ ID NO: 254253 - RNA, 65 nt, Homo Sapiens
aaaucaucaaaaugagaucaaccuucagggggcugauaaccuaguaacgcaugcaagcuugauuc

SEQ ID NO: 254254 - RNA, 65 nt, Homo Sapiens
aaacuuuucuauaucucaaauuaauauacauuuucauaaccuaccuuuguauuaagacuugcaau

SEQ ID NO: 254255 - RNA, 65 nt, Homo Sapiens
gugaaguagaauaaaauugaauaagaaaaagaucuauaaccuagguaaagcauaaucugucagag

SEQ ID NO: 254256 - RNA, 65 nt, Homo Sapiens
uauauuuauguauuucuauucugauuucugaaaugauaaccuaguagugucugaugaaguuuuuu

SEQ ID NO: 254257 - RNA, 65 nt, Homo Sapiens
acauccauaguguuuagagagaaaaaaauaaaccaauaaccuaccuacugacaaguaaauuuaua

SEQ ID NO: 254258 - RNA, 65 nt, Homo Sapiens
uuguuagauuaggccuuauaaaacuugugugcauuauaaccuaagcugugcaaccugugaagcca

SEQ ID NO: 254259 - RNA, 65 nt, Homo Sapiens
cagaggaaguuuguuuuuuaauuuaagagggaaauauaaccuauaaauuuguuucuuccaagcuu

SEQ ID NO: 254260 - RNA, 65 nt, Homo Sapiens
acuaucauaguuauuaauguuagaaauaaaagaugauaaccuaacgacuggagguacaaauaauu

SEQ ID NO: 254261 - RNA, 65 nt, Homo Sapiens
cuuaauuauucuguaagaacuguuguacuauacguauaaccuaacuaaaauuaaaaaugugaaac

SEQ ID NO: 254262 - RNA, 65 nt, Homo Sapiens
ggaaugauguaguaacacagauaucaugcacaacuauaaccuauguucuuuucuauuuuuuauaa

SEQ ID NO: 254263 - RNA, 65 nt, Homo Sapiens
acagggaauugggagccauccuucuugguuucagcauaaccuaagagacaccacuuuucaaagga

SEQ ID NO: 254264 - RNA, 65 nt, Homo Sapiens
ccaucuacucuuuaguacugguacuuucacuguguauaaccuaaauuuaucauuccuguguuguu

SEQ ID NO: 254265 - RNA, 65 nt, Homo Sapiens
ugccagauuucuauucaacgugauugcuuauacaaauaaccuacaagagguuuccuucagauugc

SEQ ID NO: 254266 - RNA, 65 nt, Homo Sapiens
auccgcaagcaugcuaauuuuauaggaggagaacaauaaccuaccgaccaaacacugcuuugaau

SEQ ID NO: 254267 - RNA, 65 nt, Homo Sapiens
aauuguuuuuucuaggagauugccagcuaguggaaauaaccuaccguccugguuacuauguaugu

SEQ ID NO: 254268 - RNA, 65 nt, Homo Sapiens
ggaauguuuggaugccaguuuuucuggguucucugauaaccuaugacaaacugaaacagaugggu

SEQ ID NO: 254269 - RNA, 65 nt, Homo Sapiens
gacacuaagauuuuauguuggagauacuucuuuaaauaaccuacagcuugggucuauggcuguga

SEQ ID NO: 254270 - RNA, 65 nt, Homo Sapiens
uuuuggaaagggucuaauucauacaugcuuaaaguauaaccuacguuagauaguuuguugucaaa

SEQ ID NO: 254271 - RNA, 65 nt, Homo Sapiens
gucauaauuaaaucauagcuaguauaacuuuacagauaaccuaaaaagaauagaaaagaagagag

SEQ ID NO: 254272 - RNA, 65 nt, Homo Sapiens
gcaguugguugaauaauuauacaaacaaccaauacauaaccuaugaaaaaauauauaauuuucuc

SEQ ID NO: 254273 - RNA, 65 nt, Homo Sapiens
uaagggacauuuuauaauuuuacacaaucauuacuauaaccuaaucauuuagguguuugcuaaua

SEQ ID NO: 254274 - RNA, 65 nt, Homo Sapiens
ugauuuauaguuuguacaugaagaaaugcugauggauaaccuauauauauuuuuuguagggguca

SEQ ID NO: 254275 - RNA, 65 nt, Homo Sapiens
caucaggacuuacaucacuugucagagguuugguaauaaccuaugacauuaguaaaugugaugca

SEQ ID NO: 254276 - RNA, 65 nt, Homo Sapiens
caaguccucagcuaaaaauagcguaguauuugcauauaaccuaugcacauccuccuguauacuuu

SEQ ID NO: 254277 - RNA, 65 nt, Homo Sapiens
uauuaugauaauaagcuuauauaugugaauaaguuauaaccuaguguauaaaaaauuauuucuaa

SEQ ID NO: 254278 - RNA, 65 nt, Homo Sapiens
uuuuauauccagauauacaaccacaauaaagcaaaauaaccuacuaucaaaauagaaauguugcu

SEQ ID NO: 254279 - RNA, 65 nt, Homo Sapiens
ugcuaacuggaagaucaaaaucaugucucuugcugauaaccuaagagcauuaagcucugagucca

SEQ ID NO: 254280 - RNA, 65 nt, Homo Sapiens
aaauauaaguacuaaaacuguaaaaauccuggaauauaaccuaagaaauaccaauguggacauag

SEQ ID NO: 254281 - RNA, 63 nt, Homo Sapiens
cauguuuccaaaaaucucuguaaacaaauuauuuaauaaccuaucuuuguaaaugccguacaa

SEQ ID NO: 254282 - RNA, 65 nt, Homo Sapiens
accuauuuuguaugcgacuccucaugcuucaguuuauaaccuauuaauccucacuuugacagaaa

SEQ ID NO: 254283 - RNA, 65 nt, Homo Sapiens
uuguagaaccuuuucuuaucucaguggaaccuucuauaaccuaaauauaccauugaugauucuuc

SEQ ID NO: 254284 - RNA, 65 nt, Homo Sapiens
aagguguucagggcacuucuuguccucucugucccauaaccuaccuccacccucccccuagccag

SEQ ID NO: 254285 - RNA, 65 nt, Homo Sapiens
auagccuugaaagcuuugauaaguuuucaguaauaauaaccuauuuaaucagaugaugauguguu

SEQ ID NO: 254286 - RNA, 65 nt, Homo Sapiens
gaaccuggaaauacaacuuuacauauuuuucucccauaaccuaguuguccacagauuaauuagua

SEQ ID NO: 254287 - RNA, 65 nt, Homo Sapiens
uaaugcagaagauuuagguuuccagagaagcauacauaaccuagcuucuuuuuacucuugccucu

SEQ ID NO: 254288 - RNA, 65 nt, Homo Sapiens
uacucuuaaaccugguaacacuugauuugccuucuauaaccuauuuauuucaaguguucauauuu

SEQ ID NO: 254289 - RNA, 65 nt, Homo Sapiens
ucuaccucuaacuguguaacauuuuagacuucuuaauaaccuaaauauuuaaaauaaugaaugua

SEQ ID NO: 254290 - RNA, 65 nt, Homo Sapiens
acugcagaaggaucugaaaggguaccucuguagaaauaaccuaaagugguauucauucacuuaaa

SEQ ID NO: 254291 - RNA, 65 nt, Homo Sapiens
ugaguucuuaaagaauucuauuaauuuccauaaucauaaccuaaaccaggaucuuucauaaaaau

SEQ ID NO: 254292 - RNA, 65 nt, Homo Sapiens
uuuccugggacugccauauugaaacuguuaaaugcauaaccuaaugucaauugaguaguacagug

SEQ ID NO: 254293 - RNA, 65 nt, Homo Sapiens
gauuuuuuuguacuuguggaucuuuuguacuucucauaaccuaaugucagacuaagaaaaauaaa

SEQ ID NO: 254294 - RNA, 65 nt, Homo Sapiens
gaacauuacaaagcaaagacuauuuuuaugcuuccauaaccuagaauuaaaaccaaauuaugacc

SEQ ID NO: 254295 - RNA, 65 nt, Homo Sapiens
ugaugaugacuuuuaagcauuuacaucacguacucauaaccuauuaugaaaauaaaugaaacugg

SEQ ID NO: 254296 - RNA, 65 nt, Homo Sapiens
ugucucaaaaaaaaaaaaaucuuacaaccucacaaauaaccuaguucaaaaaugggcaaagauuu

SEQ ID NO: 254297 - RNA, 65 nt, Homo Sapiens
aacucaugccugucuuggcuauaaagaugauauuuauaaccuaggcuauaaaauacccacuuuuu

SEQ ID NO: 254298 - RNA, 65 nt, Homo Sapiens
uggccaggagaauuaucucagucuucacacaaauaauaaccuaucuuaaccuacaggucauuuga

SEQ ID NO: 254299 - RNA, 65 nt, Homo Sapiens
cggauccccaccugacacuaguuuggccaaugugcauaaccuacuugagcauaccugucucagcu

SEQ ID NO: 254300 - RNA, 65 nt, Homo Sapiens
aauucucccaacugguucgaccuuugcagauacccauaaccuauguugagccuugcuuaccagca

SEQ ID NO: 254301 - RNA, 65 nt, Homo Sapiens
cuguguacaguagcuuaaaauugcagugauugagcauaaccuacuuguuuguauaaauuauugaa

SEQ ID NO: 254302 - RNA, 65 nt, Homo Sapiens
uauuuugucaugguucauuauuauuaaagcacaaaauaaccuauuguuagaaaauauguguuuuu

SEQ ID NO: 254303 - RNA, 65 nt, Homo Sapiens
guauuccugaaaaugucauauauuuucauuaauaaauaaccuaaauaugauaaaacauaaagcag

SEQ ID NO: 254304 - RNA, 65 nt, Homo Sapiens
uugguggacaaugauuuuuaaaaaacuaacuuuguauaaccuaauauuuguauucucucaucuau

SEQ ID NO: 254305 - RNA, 65 nt, Homo Sapiens
aauuguaucuacauuaaaauauuguaauaugacagauaaccuaauuaaaauuuaaaaacuuaaau

SEQ ID NO: 254306 - RNA, 65 nt, Homo Sapiens
cgguaguugcuuuaggggguaaacaacaaaaaaaaauaaccuauauuuucaaugaaaugaccuaa

SEQ ID NO: 254307 - RNA, 65 nt, Homo Sapiens
uuuuaagaaugagaaacugcugcuuuggggcucuaauaaccuaccgguagauuuguuaugaaaau

SEQ ID NO: 254308 - RNA, 65 nt, Homo Sapiens
cucgacuauuuguuguuauggauuuuuugaaggcuauaaccuaacgugugacacuugaacuaguc

SEQ ID NO: 254309 - RNA, 65 nt, Homo Sapiens
ccaagaaguccaaacccagcacgcaacagcccaacauaaccuagaaugucaagacacucaagaua

SEQ ID NO: 254310 - RNA, 65 nt, Homo Sapiens
aaagacauuaugccugccuaaacaaaaagcaggacauaaccuagcucugaauacaugccacaagg

SEQ ID NO: 254311 - RNA, 65 nt, Homo Sapiens
uucccacguagagagaguguggauuauauuacaugauaaccuaccuggggaacaguccagaaagc

SEQ ID NO: 254312 - RNA, 65 nt, Homo Sapiens
auuuaaacuguaaauauauugucauacaauguuaaauaaccuauuuuuuuaaaaaaguucaacuu

SEQ ID NO: 254313 - RNA, 65 nt, Homo Sapiens
gcauauauuuugaaauagcuugacuagaguuaacaauaaccuauuuguuuuauugcauaguaggg

SEQ ID NO: 254314 - RNA, 65 nt, Homo Sapiens
aaguguuuaugacaaauuuaaagucuugguaacaaauaaccuauauauguuuauauuuauuauau

SEQ ID NO: 254315 - RNA, 65 nt, Homo Sapiens
ugauguuauagaauuauuuuaaguagaaacuuucuauaaccuaaaauaaagaauguaagggcuau

SEQ ID NO: 254316 - RNA, 65 nt, Homo Sapiens
ugaauguauuaaaaacuaauggaccaacucuuuguauaaccuaccaggccucagcccaggccucg

SEQ ID NO: 254317 - RNA, 65 nt, Homo Sapiens
ccaauaaaaaugucucagcacacacacacaaacauauaaccuaugcacacacacacacacacaca

SEQ ID NO: 254318 - RNA, 65 nt, Homo Sapiens
caugcccggcccaaauauuuuuuauucaggaugguauaaccuaacugauaauagguaauaagguu

SEQ ID NO: 254319 - RNA, 65 nt, Homo Sapiens
ugcuagauauuuaacaaaacauacggcucaaccucauaaccuauauguguguaugucuacaucug

SEQ ID NO: 254320 - RNA, 65 nt, Homo Sapiens
ucuuguagcuuaguaaugagucauagcuacccacaauaaccuaauaaaaacucaaguucauccca

SEQ ID NO: 254321 - RNA, 65 nt, Homo Sapiens
ucagcucauaucuuaaagauaaaagguacuauuauauaaccuauacacaagauacaggagaaaau

SEQ ID NO: 254322 - RNA, 65 nt, Homo Sapiens
ccuauauacugaccugccugcaacacauuugugaaauaaccuacucaacuaugugacuuagugca

SEQ ID NO: 254323 - RNA, 65 nt, Homo Sapiens
gggucaggauaugaguccuguugaugaauucuguuauaaccuaugcucuagcccucuguuuuugu

SEQ ID NO: 254324 - RNA, 65 nt, Homo Sapiens
ugaugguaggaugauuguaucaaaauauuuaaagcauaaccuaacuaguuaaggauaccugauuu

SEQ ID NO: 254325 - RNA, 65 nt, Homo Sapiens
uagauuucuagcauuugcugguuauaccuugcaugauaaccuagcauaaauuugaguuugucuug

SEQ ID NO: 254326 - RNA, 65 nt, Homo Sapiens
aaagggcuuugcaagagcuucccuacucuccaccgauaaccuaucugggaccccagguuugugcu

SEQ ID NO: 254327 - RNA, 65 nt, Homo Sapiens
augaaaaauaugucuuacuggaaaaaucccucauaauaaccuaauagggcauugcuauuaaaaau

SEQ ID NO: 254328 - RNA, 65 nt, Homo Sapiens
auuuuuacauaaaagcuugaacauacagaugaauuauaaccuaugugaagaaaucuuagauauaa

SEQ ID NO: 254329 - RNA, 65 nt, Homo Sapiens
gccaagcaauaagauuuauguauauuuguuuaauaauaaccuauuucaagucugaguuuugaaaa

SEQ ID NO: 254330 - RNA, 65 nt, Homo Sapiens
aaucagacacauuauuuucuucugaacuuggcaauauaaccuaauaaggcagaauaaguuucugu

SEQ ID NO: 254331 - RNA, 65 nt, Homo Sapiens
caggauuauaaagagauaucaaagcacgauuuuagauaaccuaaacggcccagccuauacgaagu

SEQ ID NO: 254332 - RNA, 65 nt, Homo Sapiens
ucuuucuaaagucaaaauaugaaugcuaagaaggcauaaccuacauccuucucugauuucuucag

SEQ ID NO: 254333 - RNA, 65 nt, Homo Sapiens
aaauucauuuauguuucauauacaccuuauauacaauaaccuaaaggugauuuuauaugauauuu

SEQ ID NO: 254334 - RNA, 65 nt, Homo Sapiens
guugugcugguaccuguuuuuuuuuuugauguaauauaaccuaacauauuugggaccauuaaaac

SEQ ID NO: 254335 - RNA, 65 nt, Homo Sapiens
caugccuucuuuauuccagcggaguauaccuugcuauaaccuaaggauggugauauuuuaggcca

SEQ ID NO: 254336 - RNA, 65 nt, Homo Sapiens
aggacaccaauuaauuuccuggucuuuaguauauaauaaccuaaaauaccauuguaaccucaguc

SEQ ID NO: 254337 - RNA, 65 nt, Homo Sapiens
uauuuugcucaccuuauguaauacuguaacuuccuauaaccuaauauuuucgguaucauuaacca

SEQ ID NO: 254338 - RNA, 65 nt, Homo Sapiens
cuaugcaaaacaucaaaguguuuguuuuuuaaaaaauaaccuagaauuuggguaauuuuuaauuu

SEQ ID NO: 254339 - RNA, 65 nt, Homo Sapiens
uuauaaaagcagaaaccuaaaugguaaacugauacauaaccuaaacuguuaaguagaagaaagcc

SEQ ID NO: 254340 - RNA, 55 nt, Homo Sapiens; identical to SEQ ID NO: 254188

SEQ ID NO: 254341 - RNA, 65 nt, Homo Sapiens
gguucucaugcggugcguaauugaugauagauuuuauaaccuaacuuuucacauugauuuacugg

SEQ ID NO: 254342 - RNA, 65 nt, Homo Sapiens
aaaagaaaggaggggauagagagagaccacuuuucauaaccuagccuuagaagucacacaguauu

SEQ ID NO: 254343 - RNA, 65 nt, Homo Sapiens
aacaaccucuucaaaguaccaucaggggguacagaauaaccuacacuccuccacuuucuuuaaga

SEQ ID NO: 254344 - RNA, 65 nt, Homo Sapiens
aaauguaaaaccccaaacuauaaaaacucuggaagauaaccuaggcaauaccauucuggacauag

SEQ ID NO: 254345 - RNA, 65 nt, Homo Sapiens
aacacucuacuguuaaugacagauguucuguuuuuauaaccuaccaaaaggaaacuagaggcuuc

SEQ ID NO: 254346 - RNA, 65 nt, Homo Sapiens
uauuucaaaugucuacauaaaauaucacuacccacauaaccuauaauuuguguggccagcaauuu

SEQ ID NO: 254347 - RNA, 65 nt, Homo Sapiens
uguacauacuacaucaucuacagaaaucuugaucaauaaccuagaaacuagguuaucuagguuau

SEQ ID NO: 254348 - RNA, 65 nt, Homo Sapiens
uagauuuaaugugaaauuuaaguagugguauggauauaaccuauuuacucagcagaaguaucaga

SEQ ID NO: 254349 - RNA, 65 nt, Homo Sapiens
gaaauuauucauuucuguucaauccuacuggucaaauaaccuaagagaaaggcugccuuugcaaa

SEQ ID NO: 254350 - RNA, 65 nt, Homo Sapiens
uuuuuuuaaugcuuuaaaaauuauaugaacacuggauaaccuaauuguaggaacuuuuaguucca

SEQ ID NO: 254351 - RNA, 65 nt, Homo Sapiens
acacacaguagcaaauuuugaacgaugugauugauauaaccuaacaaaucugagccaguuauuau

SEQ ID NO: 254352 - RNA, 65 nt, Homo Sapiens
uuuaacaccagaaagaaccuugccgaucaccaggcauaaccuaauuuuauccauggaagaaacac

SEQ ID NO: 254353 - RNA, 65 nt, Homo Sapiens
gcaauaagccugugugguaggccacauagguccgaauaaccuaguuuuacaguugagggagcuga

SEQ ID NO: 254354 - RNA, 65 nt, Homo Sapiens
cagcuguugcauuagcuaaauauauuguugaagcaauaaccuagcgcugcuuuugcauuaugaau

SEQ ID NO: 254355 - RNA, 65 nt, Homo Sapiens
cauugcagauaccuauuauauuaauauuuccauuaauaaccuauugaaccagauuuuaauuuaaa

SEQ ID NO: 254356 - RNA, 65 nt, Homo Sapiens
gacuguauucuguguauuaugugaaguaaauugauauaaccuauuggccugaauuaugcucuuau

SEQ ID NO: 254357 - RNA, 65 nt, Homo Sapiens
ucagggagaccccgguguguccguucuuuagcaauauaaccuacccagugcgugccgagcaggcu

SEQ ID NO: 254358 - RNA, 65 nt, Homo Sapiens
guuuaaagcacugugugacauagcuccuuagagauauaaccuauugucugcucauugucacgugu

SEQ ID NO: 254359 - RNA, 65 nt, Homo Sapiens
ugcugaccacccacacucaaccucccucugaccucauaaccuaauggccuuggacaccagauucu

SEQ ID NO: 254360 - RNA, 65 nt, Homo Sapiens
uccuuccauuacaccacagugaguucacagguaauauaaccuacccaccuguguaaugucaaaaa

SEQ ID NO: 254361 - RNA, 65 nt, Homo Sapiens
aaugauggaaguccaaaauggauuaggaggacaucauaaccuaugaaaaacucaaauaaauguau

SEQ ID NO: 254362 - RNA, 65 nt, Homo Sapiens
uuuuucucuauucucugcaauauuguuuucuguaaauaaccuauuccucuaaguacauauguaga

SEQ ID NO: 254363 - RNA, 65 nt, Homo Sapiens
gccuccauagagggguuuggaggguguucaccaugauaaccuaguagggucuauggcgagggaaa

SEQ ID NO: 254364 - RNA, 65 nt, Homo Sapiens
ugccaguaagguccaaaggcugaucugacugaaauauaaccuaccuaccuauauuagaaagauau

SEQ ID NO: 254365 - RNA, 65 nt, Homo Sapiens
ugugauggagaucacccaaugccuguacaaggcugauaaccuauauuaucacuuugagaaaugag

SEQ ID NO: 254366 - RNA, 65 nt, Homo Sapiens
aaucaaucacuugaaagugaugagaugaaauucaaauaaccuaaagcguguuuggguuuuuuaau

SEQ ID NO: 254367 - RNA, 65 nt, Homo Sapiens
cugauaccugccuuguacuuaguaccuuaauaccaauaaccuaaugguacuuaggcgaguaccau

SEQ ID NO: 254368 - RNA, 65 nt, Homo Sapiens
caugccccuaaccugccuuuucccaucuccccagcauaaccuaauauuuuuuuuuuuuuuuugag

SEQ ID NO: 254369 - RNA, 65 nt, Homo Sapiens
cugagaccgugcuuggugggcccucgcccuuuguaauaaccuaaucuccugggaugcccuccucc

SEQ ID NO: 254370 - RNA, 65 nt, Homo Sapiens
ucuccgucugugucccacccaugcagacucucugaauaaccuagccaauaucaaacgagaacagg

SEQ ID NO: 254371 - RNA, 65 nt, Homo Sapiens
cauuaaggaacccauuacugccauuuggaauucaaauaaccuaaccaaccuccaccuccuccuuc

SEQ ID NO: 254372 - RNA, 65 nt, Homo Sapiens
aaugcuuaacuuuaucucuuaauuucuaaagguaaauaaccuagguucagcuuuugcuuaaacau

SEQ ID NO: 254373 - RNA, 65 nt, Homo Sapiens
ugguuuuagaggucagauuccucccaaccaggcuaauaaccuaacacauguuuaaaaaaaaucug

SEQ ID NO: 254374 - RNA, 65 nt, Homo Sapiens
ucucuucucuucugugaucucaguaggccuaaccuauaaccuagcacagacugcuacagcugcuc

SEQ ID NO: 254375 - RNA, 65 nt, Homo Sapiens
caagucccugauacaaaaugacgucguauuugaauauaaccuaugcacauccucccauacuuuaa

SEQ ID NO: 254376 - RNA, 65 nt, Homo Sapiens
cugugaggaaccuaguuaggugaugauaucuaggcauaaccuagcuucauucccugaaaggagga

SEQ ID NO: 254377 - RNA, 65 nt, Homo Sapiens
uaccuccagcagcuggacauagcaucuguagcuacauaaccuauaccauaccucccaauccaagu

SEQ ID NO: 254378 - RNA, 65 nt, Homo Sapiens
ucagguugcaguuuuaauaucaacuuuagguauagauaaccuaauuaacugcuuuauaaaaaugg

SEQ ID NO: 254379 - RNA, 65 nt, Homo Sapiens
uacuccguaaggggaaaugaagucaguaagacgauauaaccuacuuauauuaagggagacauuuu

SEQ ID NO: 254380 - RNA, 65 nt, Homo Sapiens
auaauuuagaaaugaauuaaguuagaaaucugccgauaaccuaaaugcucucuaaugagaacaaa

SEQ ID NO: 254381 - RNA, 64 nt, Homo Sapiens; identical to SEQ ID NO: 175479

SEQ ID NO: 254382 - RNA, 64 nt, Homo Sapiens; identical to SEQ ID NO: 175480

SEQ ID NO: 254383 - RNA, 64 nt, Homo Sapiens; identical to SEQ ID NO: 175481

SEQ ID NO: 254384 - RNA, 64 nt, Homo Sapiens; identical to SEQ ID NO: 175482

SEQ ID NO: 254385 - RNA, 64 nt, Homo Sapiens; identical to SEQ ID NO: 175483

SEQ ID NO: 254386 - RNA, 64 nt, Homo Sapiens; identical to SEQ ID NO: 175484

SEQ ID NO: 254387 - RNA, 64 nt, Homo Sapiens; identical to SEQ ID NO: 175485

SEQ ID NO: 254388 - RNA, 64 nt, Homo Sapiens; identical to SEQ ID NO: 175486

SEQ ID NO: 254389 - RNA, 64 nt, Homo Sapiens; identical to SEQ ID NO: 175487

SEQ ID NO: 254390 - RNA, 64 nt, Homo Sapiens; identical to SEQ ID NO: 175488

SEQ ID NO: 254391 - RNA, 64 nt, Homo Sapiens; identical to SEQ ID NO: 175489

SEQ ID NO: 254392 - RNA, 64 nt, Homo Sapiens; identical to SEQ ID NO: 175490

SEQ ID NO: 254393 - RNA, 64 nt, Homo Sapiens; identical to SEQ ID NO: 175491

SEQ ID NO: 254394 - RNA, 64 nt, Homo Sapiens; identical to SEQ ID NO: 175492

SEQ ID NO: 254395 - RNA, 64 nt, Homo Sapiens; identical to SEQ ID NO: 175493

SEQ ID NO: 254396 - RNA, 64 nt, Homo Sapiens; identical to SEQ ID NO: 175494

SEQ ID NO: 254397 - RNA, 64 nt, Homo Sapiens; identical to SEQ ID NO: 175495

SEQ ID NO: 254398 - RNA, 64 nt, Homo Sapiens; identical to SEQ ID NO: 175496

SEQ ID NO: 254399 - RNA, 64 nt, Homo Sapiens; identical to SEQ ID NO: 175497

SEQ ID NO: 254400 - RNA, 64 nt, Homo Sapiens; identical to SEQ ID NO: 175498

SEQ ID NO: 254401 - RNA, 64 nt, Homo Sapiens; identical to SEQ ID NO: 175499

SEQ ID NO: 254402 - RNA, 64 nt, Homo Sapiens; identical to SEQ ID NO: 175500

SEQ ID NO: 254403 - RNA, 64 nt, Homo Sapiens; identical to SEQ ID NO: 175501

SEQ ID NO: 254404 - RNA, 64 nt, Homo Sapiens; identical to SEQ ID NO: 175502

SEQ ID NO: 254405 - RNA, 64 nt, Homo Sapiens; identical to SEQ ID NO: 175503

SEQ ID NO: 254406 - RNA, 64 nt, Homo Sapiens; identical to SEQ ID NO: 175504

SEQ ID NO: 254407 - RNA, 64 nt, Homo Sapiens; identical to SEQ ID NO: 175505

SEQ ID NO: 254408 - RNA, 64 nt, Homo Sapiens; identical to SEQ ID NO: 175506

SEQ ID NO: 254409 - RNA, 64 nt, Homo Sapiens; identical to SEQ ID NO: 175507

SEQ ID NO: 254410 - RNA, 64 nt, Homo Sapiens; identical to SEQ ID NO: 175508

SEQ ID NO: 254411 - RNA, 64 nt, Homo Sapiens; identical to SEQ ID NO: 175509

SEQ ID NO: 254412 - RNA, 64 nt, Homo Sapiens; identical to SEQ ID NO: 175510

SEQ ID NO: 254413 - RNA, 64 nt, Homo Sapiens; identical to SEQ ID NO: 175511

SEQ ID NO: 254414 - RNA, 64 nt, Homo Sapiens; identical to SEQ ID NO: 175512

SEQ ID NO: 254415 - RNA, 64 nt, Homo Sapiens; identical to SEQ ID NO: 175513

SEQ ID NO: 254416 - RNA, 64 nt, Homo Sapiens; identical to SEQ ID NO: 175514

SEQ ID NO: 254417 - RNA, 64 nt, Homo Sapiens; identical to SEQ ID NO: 175515

SEQ ID NO: 254418 - RNA, 64 nt, Homo Sapiens; identical to SEQ ID NO: 175516

SEQ ID NO: 254419 - RNA, 64 nt, Homo Sapiens; identical to SEQ ID NO: 175517

SEQ ID NO: 254420 - RNA, 64 nt, Homo Sapiens; identical to SEQ ID NO: 175518

SEQ ID NO: 254421 - RNA, 64 nt, Homo Sapiens; identical to SEQ ID NO: 175519

SEQ ID NO: 254422 - RNA, 64 nt, Homo Sapiens; identical to SEQ ID NO: 175520

SEQ ID NO: 254423 - RNA, 64 nt, Homo Sapiens; identical to SEQ ID NO: 175521

SEQ ID NO: 254424 - RNA, 64 nt, Homo Sapiens; identical to SEQ ID NO: 175522

SEQ ID NO: 254425 - RNA, 64 nt, Homo Sapiens; identical to SEQ ID NO: 175523

SEQ ID NO: 254426 - RNA, 64 nt, Homo Sapiens; identical to SEQ ID NO: 175524

SEQ ID NO: 254427 - RNA, 64 nt, Homo Sapiens; identical to SEQ ID NO: 175525

SEQ ID NO: 254428 - RNA, 64 nt, Homo Sapiens; identical to SEQ ID NO: 175526

SEQ ID NO: 254429 - RNA, 64 nt, Homo Sapiens; identical to SEQ ID NO: 175527

SEQ ID NO: 254430 - RNA, 64 nt, Homo Sapiens; identical to SEQ ID NO: 175528

SEQ ID NO: 254431 - RNA, 64 nt, Homo Sapiens; identical to SEQ ID NO: 175529

SEQ ID NO: 254432 - RNA, 64 nt, Homo Sapiens; identical to SEQ ID NO: 175530

SEQ ID NO: 254433 - RNA, 64 nt, Homo Sapiens; identical to SEQ ID NO: 175531

SEQ ID NO: 254434 - RNA, 64 nt, Homo Sapiens; identical to SEQ ID NO: 175532

SEQ ID NO: 254435 - RNA, 64 nt, Homo Sapiens; identical to SEQ ID NO: 175533

SEQ ID NO: 254436 - RNA, 64 nt, Homo Sapiens; identical to SEQ ID NO: 175534

SEQ ID NO: 254437 - RNA, 64 nt, Homo Sapiens; identical to SEQ ID NO: 175535

SEQ ID NO: 254438 - RNA, 64 nt, Homo Sapiens; identical to SEQ ID NO: 175536

SEQ ID NO: 254439 - RNA, 64 nt, Homo Sapiens; identical to SEQ ID NO: 175537

SEQ ID NO: 254440 - RNA, 64 nt, Homo Sapiens; identical to SEQ ID NO: 175538

SEQ ID NO: 254441 - RNA, 53 nt, Homo Sapiens; identical to SEQ ID NO: 175539

SEQ ID NO: 254442 - RNA, 64 nt, Homo Sapiens; identical to SEQ ID NO: 175540

SEQ ID NO: 254443 - RNA, 64 nt, Homo Sapiens; identical to SEQ ID NO: 175541

SEQ ID NO: 254444 - RNA, 64 nt, Homo Sapiens; identical to SEQ ID NO: 175542

SEQ ID NO: 254445 - RNA, 64 nt, Homo Sapiens; identical to SEQ ID NO: 175543

SEQ ID NO: 254446 - RNA, 64 nt, Homo Sapiens; identical to SEQ ID NO: 175544

SEQ ID NO: 254447 - RNA, 64 nt, Homo Sapiens; identical to SEQ ID NO: 175545

SEQ ID NO: 254448 - RNA, 64 nt, Homo Sapiens; identical to SEQ ID NO: 175546

SEQ ID NO: 254449 - RNA, 64 nt, Homo Sapiens; identical to SEQ ID NO: 175547

SEQ ID NO: 254450 - RNA, 64 nt, Homo Sapiens; identical to SEQ ID NO: 175548

SEQ ID NO: 254451 - RNA, 64 nt, Homo Sapiens; identical to SEQ ID NO: 175549

SEQ ID NO: 254452 - RNA, 64 nt, Homo Sapiens; identical to SEQ ID NO: 175550

SEQ ID NO: 254453 - RNA, 64 nt, Homo Sapiens; identical to SEQ ID NO: 175551

SEQ ID NO: 254454 - RNA, 64 nt, Homo Sapiens; identical to SEQ ID NO: 175552

SEQ ID NO: 254455 - RNA, 64 nt, Homo Sapiens; identical to SEQ ID NO: 175553

SEQ ID NO: 254456 - RNA, 64 nt, Homo Sapiens; identical to SEQ ID NO: 175554

SEQ ID NO: 254457 - RNA, 64 nt, Homo Sapiens; identical to SEQ ID NO: 175555

SEQ ID NO: 254458 - RNA, 64 nt, Homo Sapiens; identical to SEQ ID NO: 175556

SEQ ID NO: 254459 - RNA, 64 nt, Homo Sapiens; identical to SEQ ID NO: 175557

SEQ ID NO: 254460 - RNA, 64 nt, Homo Sapiens; identical to SEQ ID NO: 175558

SEQ ID NO: 254461 - RNA, 64 nt, Homo Sapiens; identical to SEQ ID NO: 175559

SEQ ID NO: 254462 - RNA, 64 nt, Homo Sapiens; identical to SEQ ID NO: 175560

SEQ ID NO: 254463 - RNA, 64 nt, Homo Sapiens; identical to SEQ ID NO: 175561

SEQ ID NO: 254464 - RNA, 64 nt, Homo Sapiens; identical to SEQ ID NO: 175562

SEQ ID NO: 254465 - RNA, 64 nt, Homo Sapiens; identical to SEQ ID NO: 175563

SEQ ID NO: 254466 - RNA, 64 nt, Homo Sapiens; identical to SEQ ID NO: 175564

SEQ ID NO: 254467 - RNA, 64 nt, Homo Sapiens; identical to SEQ ID NO: 175565

SEQ ID NO: 254468 - RNA, 64 nt, Homo Sapiens; identical to SEQ ID NO: 175566

SEQ ID NO: 254469 - RNA, 64 nt, Homo Sapiens
caucuauuccugcccccauccuaggcaaauggagugggggcaggagccuuccagcugagugaag

SEQ ID NO: 254470 - RNA, 64 nt, Homo Sapiens
agaggccugagguucucuaggcagccggccgggaugggggcauuugaaguggagaggccgagca

SEQ ID NO: 254471 - RNA, 64 nt, Homo Sapiens
auugggccccuuggccccuuccgguucugcuuccugggggcaggguuccugccuuggaccccca

SEQ ID NO: 254472 - RNA, 64 nt, Homo Sapiens
cagccccggggcuuggcucccccagcucugagcgugggggcauaggcaggaccccccuuguggu

SEQ ID NO: 254473 - RNA, 64 nt, Homo Sapiens
ucuccuacagcccccugccugauccccugcuggcugggggcagcucccaggauauccugccuuc

SEQ ID NO: 254474 - RNA, 64 nt, Homo Sapiens
aggggagcagcggcugggagugagcagggcagggugggggcagggugggggcacgaagugggcc

SEQ ID NO: 254475 - RNA, 64 nt, Homo Sapiens
ggcugggagugagcagggcagggugggggcagggugggggcacgaagugggcccugggugaccc

SEQ ID NO: 254476 - RNA, 64 nt, Homo Sapiens
ggcgccaguucccuuccaugcugggaagggcagcugggggcaguacaucuuggugaaguugccc

SEQ ID NO: 254477 - RNA, 64 nt, Homo Sapiens
ggccuggagccugggcccacacgucugaucuugaugggggcacucgacggugggaagaugccuu

SEQ ID NO: 254478 - RNA, 64 nt, Homo Sapiens
ggcugggagucagcaagcgacuuugcaaaggccuugggggcacugaccuuuagccuuuuucuuc

SEQ ID NO: 254479 - RNA, 64 nt, Homo Sapiens
aguucagacacaccgugcucauuggguucagacuugggggcagaaguuucauuccaaaguguau

SEQ ID NO: 254480 - RNA, 64 nt, Homo Sapiens
acaguacuuaguccaaaggugcuaacgggggaacugggggcauugugacacccaagucugaugu

SEQ ID NO: 254481 - RNA, 64 nt, Homo Sapiens
gugaugugcuguuuauuuaucagcuugagguccaugggggcagccuugugacuggaagggugga

SEQ ID NO: 254482 - RNA, 64 nt, Homo Sapiens
ucaggaccaggacccagggagugaaggcaggaguugggggcaggauuugcuggccuggcagggg

SEQ ID NO: 254483 - RNA, 64 nt, Homo Sapiens
uuuguggggaccucagccugacuugccagggcucugggggcagauccucgggauuggcgggucc

SEQ ID NO: 254484 - RNA, 64 nt, Homo Sapiens
ugggggcugaaguccugugcucaucuguggguguugggggcaaggaucuccagagcuaccgagu

SEQ ID NO: 254485 - RNA, 64 nt, Homo Sapiens
aggcgauguggaccacgggauugucauggccuccugggggcagaccagcagcagccuggcugcc

SEQ ID NO: 254486 - RNA, 64 nt, Homo Sapiens
gcacagaccccagagccaggccaaccacacccggugggggcacagaaccagcaccucccaccaa

SEQ ID NO: 254487 - RNA, 64 nt, Homo Sapiens
gcacagaccccagaggcaggccagccacacccggugggggcacagaaccagcaccucccaccaa

SEQ ID NO: 254488 - RNA, 64 nt, Homo Sapiens
gcacagaccccagagccaggccagccacacccagugggggcacagaaccagcaccucccaccaa

SEQ ID NO: 254489 - RNA, 64 nt, Homo Sapiens
agugccagaugacagucagagcugaagcaggcccugggggcagaccagccaggaaccucucaga

SEQ ID NO: 254490 - RNA, 51 nt, Homo Sapiens
gucccaggccaacucccuccuugggggcaagucuuuaagaagaacaaguag

SEQ ID NO: 254491 - RNA, 64 nt, Homo Sapiens
acuaagaaugcuaaacuuagguugcccccaugcgugggggcacuuuguagggggggcauuuuug

SEQ ID NO: 254492 - RNA, 64 nt, Homo Sapiens
cccacagugagagacugccuggggugggggcugaugggggcagggaggccucuggagaagaccu

SEQ ID NO: 254493 - RNA, 64 nt, Homo Sapiens
aucuggcccgagcucuccucauguggcuggagguugggggcagggggagagucaccgagggccc

SEQ ID NO: 254494 - RNA, 64 nt, Homo Sapiens
ggugagaugcccacugugugugcagcaaaggcauugggggcacggaacuggcggguggugugug

SEQ ID NO: 254495 - RNA, 64 nt, Homo Sapiens
cccacugugccuucccggccucccgggcuucugcugggggcagaagaaaugccuccccaggucu

SEQ ID NO: 254496 - RNA, 64 nt, Homo Sapiens
cccuccacacaggcauccucagggcacagggcccugggggcaccuuccuccuuucguauuuguu

SEQ ID NO: 254497 - RNA, 64 nt, Homo Sapiens
ccagaacugugaauggccugcuccaggccauggcugggggcagggagugaggggacaauuucug

SEQ ID NO: 254498 - RNA, 64 nt, Homo Sapiens
auuuuuagauucuucugcucccuagugaccuaccugggggcaaagaaauugcaaggacuuuuuu

SEQ ID NO: 254499 - RNA, 64 nt, Homo Sapiens
cuaacuucugagcccaccucccaggguaggcaccugggggcaugcaggugcccaccucccaggg

SEQ ID NO: 254500 - RNA, 64 nt, Homo Sapiens
ggcaugcaggugcccaccucccaggguaggcaccugggggcaugcagguacccaccucuuucuc

SEQ ID NO: 254501 - RNA, 64 nt, Homo Sapiens
uaucugggagggaagaugggugcugggagaggguugggggcagggggcaaggaaaauugcuacc

SEQ ID NO: 254502 - RNA, 64 nt, Homo Sapiens
cugcuagcugagcacuuccacaagggcauaccccugggggcaggggcuggggcugagaacugca

SEQ ID NO: 254503 - RNA, 64 nt, Homo Sapiens
cuggcuggugcuguaacaaagacccaugugaugcugggggcagagacagaggagaagcuguuug

SEQ ID NO: 254504 - RNA, 64 nt, Homo Sapiens
gccgggccacucugcuagaguccauccgccaagcugggggcaucggcaaggccaagcugcgcag

SEQ ID NO: 254505 - RNA, 64 nt, Homo Sapiens
uucucacagacccuagguauccacagcugugacaugggggcaagcggcuuuguuucagccuaac

SEQ ID NO: 254506 - RNA, 64 nt, Homo Sapiens
ccaucuggaccaguagcccaucccgcaguuuucuugggggcagaggaaaacgcuucuuucuccu

SEQ ID NO: 254507 - RNA, 64 nt, Homo Sapiens
cacccuccccaccucaccaacuuuggucccucucugggggcaugaaugguuaacaaacaccaga

SEQ ID NO: 254508 - RNA, 64 nt, Homo Sapiens
acaccagagcaguacuccaauauuggagagucgcugggggcacagggcuuugaaucaggguagu

SEQ ID NO: 254509 - RNA, 64 nt, Homo Sapiens
caggccugaugcuccuguuuggguccagggccccugggggcagaccggugauccuuaccagugg

SEQ ID NO: 254510 - RNA, 64 nt, Homo Sapiens
ucuccugccggaaagcccugcaacauucuaggguugggggcagggccauccacgguuucugggc

SEQ ID NO: 254511 - RNA, 64 nt, Homo Sapiens
cguggggccugaggaggucauaaucucuucugagugggggcaggucgauucuugcacaaggugg

SEQ ID NO: 254512 - RNA, 64 nt, Homo Sapiens
cccccgccgccagguggcccacaugggaccagcaugggggcagguuaucuguuggccugaagag

SEQ ID NO: 254513 - RNA, 64 nt, Homo Sapiens
ggcaaagcagcucugaccgaauucuaggcaggggugggggcaccugccugggcccuggguccag

SEQ ID NO: 254514 - RNA, 64 nt, Homo Sapiens
gugccuguggcggaaggaacugcccaguccucccugggggcagguagaccuguggggauggcuc

SEQ ID NO: 254515 - RNA, 64 nt, Homo Sapiens
ccuuaauaauauggaagggacuuuggacccacaaugggggcaagcucaaaucuaggggcgucuu

SEQ ID NO: 254516 - RNA, 64 nt, Homo Sapiens
gguuaguucuucaggucggcauugggauguguuuugggggcagguuuuguuauuccuuuugcag

SEQ ID NO: 254517 - RNA, 64 nt, Homo Sapiens
ggucagggcaaugggggacaaccagccaaggaggugggggcaagccucccaggcuccuggcucc

SEQ ID NO: 254518 - RNA, 64 nt, Homo Sapiens
gagcagagagggcuuggguagguggucagcaggcugggggcaugggcccaggacauggcugaga

SEQ ID NO: 254519 - RNA, 64 nt, Homo Sapiens
caggaggaagcuggccauccaacacagccgggcuugggggcaguuauaucgacgcgaagugcuu

SEQ ID NO: 254520 - RNA, 64 nt, Homo Sapiens
ggccucuuagguuuuaacgaugcagcugcucacuugggggcacucgccgcuuacucucagcgga

SEQ ID NO: 254521 - RNA, 64 nt, Homo Sapiens
uuggugucaggugcagcaggcguuaccgcuguguugggggcagccgcugccuggggagcugagg

SEQ ID NO: 254522 - RNA, 64 nt, Homo Sapiens
gcugccuggggagcugaggcagaggccugcggggugggggcauccaggaugaacggacgcccac

SEQ ID NO: 254523 - RNA, 64 nt, Homo Sapiens
ccaacugucaaccuagguacuuccuggcugggaacaacuucaguccuucacugacagccgcugc

SEQ ID NO: 254524 - RNA, 64 nt, Homo Sapiens
cucagagacagcugcaccgaaaugcugaggaugccaacuucacgcgcugauucaguacaccagc

SEQ ID NO: 254525 - RNA, 64 nt, Homo Sapiens
ccuguuuucuacucacaacugaccagcugccuuccaacuucaccgccuccuuggcaagaggaau

SEQ ID NO: 254526 - RNA, 64 nt, Homo Sapiens
gccuuugcggcucaguaccgucagcccaggccaccaacuucaucgccgcaccgcccagacuggc

SEQ ID NO: 254527 - RNA, 64 nt, Homo Sapiens
ugauuaccuaaaauaagcuuggauaaaauugaaccaacuucaagaaugcagcacuucuuaaucu

SEQ ID NO: 254528 - RNA, 64 nt, Homo Sapiens
gagaagcuagacuuuauucauuauauugcuaugacaacuucacucuuucauaauauauaggaua

SEQ ID NO: 254529 - RNA, 64 nt, Homo Sapiens
aagcaaguuuuuucuggucuagaaacaagguguacaacuucacacagcagacaauguguuugga

SEQ ID NO: 254530 - RNA, 64 nt, Homo Sapiens
gauggaaucuuguuuaaggcaggauggcucuguacaacuucacagaacaaugacauggcaacaa

SEQ ID NO: 254531 - RNA, 64 nt, Homo Sapiens
acugaggcuggguuucagaauuccuggacucuagcaacuucaaaaaaccugggugagaagacua

SEQ ID NO: 254532 - RNA, 64 nt, Homo Sapiens
cacggagaguacauggagaauauccacacuuuuccaacuucacacaaaugcuuacacaagacaa

SEQ ID NO: 254533 - RNA, 64 nt, Homo Sapiens
ugaaaauauggucagguaguauaauaagcagcagcaacuucaugauugacgugaacuuugaugu

SEQ ID NO: 254534 - RNA, 64 nt, Homo Sapiens
agcucuuccacgcuuagaucagaagaucaguggucaacuucagauccagaugugacuugcacuc

SEQ ID NO: 254535 - RNA, 64 nt, Homo Sapiens
ugaucuuggcccaaaagcuccuagaucugauaaacaacuucagcuaacuuucaggagacaaaau

SEQ ID NO: 254536 - RNA, 64 nt, Homo Sapiens
gcaaaaagaacaaagcuggaggcaucgcauuacccaacuucaaacuauacuacagggcuacagu

SEQ ID NO: 254537 - RNA, 64 nt, Homo Sapiens
acccuggccucggcccugcccugucccugccaugcaacuucacaacucagcuggccuagacccc

SEQ ID NO: 254538 - RNA, 64 nt, Homo Sapiens
ccuaggaugguagucaggggaaggagcgagauuccaacuucaacaucugugaccucaaggggga

SEQ ID NO: 254539 - RNA, 63 nt, Homo Sapiens
gcgggucagcuggugguucuuagguuuccuucuguuuguuaaaagggacaauguggccacuuc

SEQ ID NO: 254540 - RNA, 63 nt, Homo Sapiens
gguugauaauagucaguaaccuaauaaaggaacguuuguuaaaauaucaaaccauuuuugaau

SEQ ID NO: 254541 - RNA, 63 nt, Homo Sapiens
uuccucuccuccuucccaagucauuugaaaaguguuuguuauuuaaauuccaauaaugcccaa

SEQ ID NO: 254542 - RNA, 63 nt, Homo Sapiens
cguuucugaacagggucugugcuauguguaaagguuuguuaacuguaaaguaauauaaaguua

SEQ ID NO: 254543 - RNA, 58 nt, Homo Sapiens
aaguguccccacagucuuagggggaaauguuuguuaugauguaaauuuuauuugguuu

SEQ ID NO: 254544 - RNA, 63 nt, Homo Sapiens
aacugaugggcaccugauacucugucuaaauacguuuguuauauguguuuugcccugugccau

SEQ ID NO: 254545 - RNA, 63 nt, Homo Sapiens
cccaccacccuuuuuuuucauuuccccuguuuuguuuguuaguuuggcguuagggguggaggu

SEQ ID NO: 254546 - RNA, 63 nt, Homo Sapiens
uuuucaaaagugcccauuuuaugcugcugugugguuuguuaaaucuaaaugauuuuuaaacuu

SEQ ID NO: 254547 - RNA, 63 nt, Homo Sapiens
aaauauuucuccuuuuguuuuucuuuuuuuuuuguuuguuacugccacuucuuuuuaggagca

SEQ ID NO: 254548 - RNA, 63 nt, Homo Sapiens
uagaucucuuucucucuuuuguuuuguuuguuuguuuguuaaaguucauuauuuauuuuaccu

SEQ ID NO: 254549 - RNA, 63 nt, Homo Sapiens
uauugacucuauuuucugaaggcaaaaaugcauguuuguuagaauggaaacagaaaaacauua

SEQ ID NO: 254550 - RNA, 63 nt, Homo Sapiens
caugcauggucaugacacccagaauucaugaugguuuguuauaacaaccucugcauauuccag

SEQ ID NO: 254551 - RNA, 63 nt, Homo Sapiens
uaaaaaaggcauuugaaugaauguuugacucagguuuguuaaauuaaccuucaguaacugcag

SEQ ID NO: 254552 - RNA, 63 nt, Homo Sapiens
gucauaauuguugacguucuucaguauaaucauguuuguuaaauuguuuguaccuugcaaacu

SEQ ID NO: 254553 - RNA, 63 nt, Homo Sapiens
uguuacuauugagauucucucaauugcuccuguguuuguuauaaaguaguguuuaaaaggcag

SEQ ID NO: 254554 - RNA, 63 nt, Homo Sapiens
ugggucauuauuacuuuuauuuugcagcauuugguuuguuauuaguguaagagcaaguauagg

SEQ ID NO: 254555 - RNA, 63 nt, Homo Sapiens
ccuuuuaggcuugaauaugaugcugaacaguaaguuuguuaaaucuuggaacuuaaaacaauc

SEQ ID NO: 254556 - RNA, 63 nt, Homo Sapiens
uugcagcaccucuaucucgcagguaauggaguaguuuguuauugguagucuacuccaggccag

SEQ ID NO: 254557 - RNA, 63 nt, Homo Sapiens
gcagcuuauucuugccaugcuuaggugacagaaguuuguuaaguaccauccuugugcccugcc

SEQ ID NO: 254558 - RNA, 63 nt, Homo Sapiens
guuuaaauuguuaaaaugcugauuuucuuauuaguuuguuaauugccuguuacuaguacuuga

SEQ ID NO: 254559 - RNA, 63 nt, Homo Sapiens
aucauggaguacugcucucauaauugaagacguguuuguuauuggcagagaaccuuaaaaaag

SEQ ID NO: 254560 - RNA, 63 nt, Homo Sapiens
cgccuuccucucuggauacugcaaaggcuugugguuuguuagaggguauuuguggaaacuguc

SEQ ID NO: 254561 - RNA, 63 nt, Homo Sapiens
uacuaguucagacacuuuggaaguuuguguucuguuuguuaaaacuggcaucugacacaaaaa

SEQ ID NO: 254562 - RNA, 63 nt, Homo Sapiens
uuauaauuuauaaauacagcauacuucaaaacuguuuguuaucucuuguuaccauguauguau

SEQ ID NO: 254563 - RNA, 63 nt, Homo Sapiens
cuucauuuugagaaaacuguacauuaguuuaauguuuguuacuguauuucuuuugaguugagg

SEQ ID NO: 254564 - RNA, 63 nt, Homo Sapiens
gaaaucaguugagcugaauuuaaguuguuuuuuguuuguuagcagguguggaugugggguuau

SEQ ID NO: 254565 - RNA, 63 nt, Homo Sapiens
cuuuuucuguggcaccuugguacacugacuaauguuuguuaaaagauuguguuaccauuugaa

SEQ ID NO: 254566 - RNA, 63 nt, Homo Sapiens
ccuuuuuccuuucuuugggugcacuauauucuuguuuguuaguaaagauuuguaaaugguaaa

SEQ ID NO: 254567 - RNA, 63 nt, Homo Sapiens
ugggccuauguaguagccucgaggagaagaggaguuuguuaacacuuguaucauggccuaccc

SEQ ID NO: 254568 - RNA, 63 nt, Homo Sapiens
uuuuccaacuaccacuguaaacaaauacccaguguuuguuacuuugguuuauguuaaugauag

SEQ ID NO: 254569 - RNA, 63 nt, Homo Sapiens
aauaaacuagagauuuuuaaagcaucaagugguguuuguuagauaaauaaagccugugaguca

SEQ ID NO: 254570 - RNA, 63 nt, Homo Sapiens
agcagcgugggauauaaucaccaaucugguacaguuuguuaaagaaagugcugauggcuggau

SEQ ID NO: 254571 - RNA, 63 nt, Homo Sapiens
uagguaaacugcaugucauggguauaugugcagguuuguuacaacuuuuauuuuagauucagg

SEQ ID NO: 254572 - RNA, 63 nt, Homo Sapiens
acauauuuauuagagugaugugguaagcauuauguuuguuaauguaaauguuuuuagaucuuc

SEQ ID NO: 254573 - RNA, 63 nt, Homo Sapiens
agaaaagagaugagaugagagaacacaucggguguuuguuauccuuaaauaugaaagcaaauu

SEQ ID NO: 254574 - RNA, 63 nt, Homo Sapiens
uuucuugucaacaguauugaguuauuacaugaaguuuguuauauaggaagauucaaaaucuug

SEQ ID NO: 254575 - RNA, 63 nt, Homo Sapiens
uauuaauaugcaugcuucuuuguuaaaagauaaguuuguuauaucgaaauacaguuauuaaaa

SEQ ID NO: 254576 - RNA, 63 nt, Homo Sapiens
auguauaaaagucuuuuucuauucuuaccugcaguuuguuacuuggaaaaugaguaaugucuc

SEQ ID NO: 254577 - RNA, 63 nt, Homo Sapiens
uugaagaugcuggucuugacgaaaacaauuacaguuuguuaauugaaaaaaauguaucuuugg

SEQ ID NO: 254578 - RNA, 63 nt, Homo Sapiens
auuuuuuaaaaauguuuuaagaauaccugggaaguuuguuaaaucccaaaucuggcuggucgg

SEQ ID NO: 254579 - RNA, 63 nt, Homo Sapiens
uuuuuuugcucugcagugcuauggauaaaaaugguuuguuaugucagcucugguccacagagg

SEQ ID NO: 254580 - RNA, 63 nt, Homo Sapiens
auggaugcagaauaaugcagauagugaucccauguuuguuaauugccaucauggaagucagag

SEQ ID NO: 254581 - RNA, 63 nt, Homo Sapiens
cguaauuuuaggacuccuauaaaauucuuccuuguuuguuaaugcuauuaaaacucagauuca

SEQ ID NO: 254582 - RNA, 63 nt, Homo Sapiens
acucuguuuuauccuagaacuaagagagcauugguuuguuaaagagcuuucaauguauauuaa

SEQ ID NO: 254583 - RNA, 63 nt, Homo Sapiens
ugcgugggacgaagacaucuuugaaggucaugaguuuguuaguuuaacaucauauauuuguaa

SEQ ID NO: 254584 - RNA, 63 nt, Homo Sapiens
cgucucaaaaguaaauaaaaauaaucaccuggaguuuguuaaaccauauggauucucaagcuc

SEQ ID NO: 254585 - RNA, 63 nt, Homo Sapiens
ucaucccuggagcacucugccgcucaagagcugguuuguuaauuauuguuagacuuugccauu

SEQ ID NO: 254586 - RNA, 63 nt, Homo Sapiens
aucuugaaguaaauugaucccaccaggucccacguuuguuaucucugccuaaauguuagcuuc

SEQ ID NO: 254587 - RNA, 63 nt, Homo Sapiens
caccuacccucaaaguagguauacaaaagacuaguuuguuauuaauccacaaauaugcuaaau

SEQ ID NO: 254588 - RNA, 63 nt, Homo Sapiens
cuuuaaaauuuaacccacaagcauauuaaaucuguuuguuauaagauuggaaacaauuuuuga

SEQ ID NO: 254589 - RNA, 63 nt, Homo Sapiens
gugaggcaucacuuuguuugcauaaaguauacgguuuguuaaggccuuuguucuugugagaug

SEQ ID NO: 254590 - RNA, 63 nt, Homo Sapiens
uaauucauguuuguugggacugagguuuaggaaguuuguuacugguuaaaaaccucaaaugaa

SEQ ID NO: 254591 - RNA, 63 nt, Homo Sapiens
auaagugccuuuuuggagauguaacuuuuagcaguuuguuaaccugacaucucugccagucua

SEQ ID NO: 254592 - RNA, 63 nt, Homo Sapiens
cccuaaugucuucauaaaguacuugaguguaauguuuguuaccuccaacagaacuaaauguuc

SEQ ID NO: 254593 - RNA, 63 nt, Homo Sapiens
cagagagugucuucgaggguaucaucauuuccgguuuguuaaucuuauucaccaaauguucua

SEQ ID NO: 254594 - RNA, 63 nt, Homo Sapiens
caauuuugacuuggccaggggacaccuugguguguuuguuaucuuuaucuguggguaggcuag

SEQ ID NO: 254595 - RNA, 63 nt, Homo Sapiens
gaggaacaaauagaccauuuccauacuaaaccaguuuguuaacuuuagauuuuuuccaauagu

SEQ ID NO: 254596 - RNA, 63 nt, Homo Sapiens
auugccccauuuagauuccugauauuuugccugguuuguuaaaccuuauauucagguauaugu

SEQ ID NO: 254597 - RNA, 63 nt, Homo Sapiens
caggugguugaggggacaugcagaaacccuacuguuuguuagaccaccaccacccucaucacu

SEQ ID NO: 254598 - RNA, 63 nt, Homo Sapiens
cgugaguuauccaaguauuucauauauaguuuaguuuguuagagcuuuccuauggaaaaaaua

SEQ ID NO: 254599 - RNA, 63 nt, Homo Sapiens
uagugugcuuuuugucccuugcuaauaacguugguuuguuauguacuguaugcaguacugcaa

SEQ ID NO: 254600 - RNA, 63 nt, Homo Sapiens
aagaaaaucuggaugccugugaccaugggauguguuuguuauggaaaacuggguaguucaucu

SEQ ID NO: 254601 - RNA, 63 nt, Homo Sapiens
gauaauggccuccagccccauguuccuauguuaguuuguuaagacauggaauauuugguuucc

SEQ ID NO: 254602 - RNA, 63 nt, Homo Sapiens
cagauuauuuagugacccagucgugacaaggggguuuguuauaggguacaugugcagguaaac

SEQ ID NO: 254603 - RNA, 63 nt, Homo Sapiens
aauaaaucccauggaauauuuguuuauguaaauguuuguuaaaccuguuuuuuuuucauuuau

SEQ ID NO: 254604 - RNA, 63 nt, Homo Sapiens
uauguauacaugugccauaugcacaaugugcagguuuguuacauuaaguuuuaggguacaugu

SEQ ID NO: 254605 - RNA, 63 nt, Homo Sapiens
guuguucugaccauauugaaauuaaagaauuuuguuuguuauuaagaaaauucugucucaaaa

SEQ ID NO: 254606 - RNA, 63 nt, Homo Sapiens
agccaaacacugccugucuuauagggcuuuucuguuuguuacauuagcgcugcuucguuuugu

SEQ ID NO: 254607 - RNA, 63 nt, Homo Sapiens
gcuuaaugacacuagcuaauuauuagcuuuacuguuuguuaugucuguuucuugagaagagaa

SEQ ID NO: 254608 - RNA, 63 nt, Homo Sapiens
accuauauuuuuaaacugguaugaaagaauucaguuuguuaguauguauuacuuuguucuccc

SEQ ID NO: 254609 - RNA, 63 nt, Homo Sapiens
aaguaauaucugaaaugaauaacuuaaaucacaguuuguuauuaaauagaagaaaugaacaaa

SEQ ID NO: 254610 - RNA, 63 nt, Homo Sapiens
ugcugaaaucaauguaacucucuacauuacaaaguuuguuaccacauucuggaaacauaacac

SEQ ID NO: 254611 - RNA, 63 nt, Homo Sapiens
guaacaauguuaaauuaauuauaaugggauuggguuuguuaucugugguaguauauauccuag

SEQ ID NO: 254612 - RNA, 63 nt, Homo Sapiens
acuagaaugugugacucuguggggacugcauagguuuguuaauugaccuauagcuaaaccuua

SEQ ID NO: 254613 - RNA, 63 nt, Homo Sapiens
cugaagcaucuguccagcugguauccugugaaaguuuguuauuuucugaguagacauucuuau

SEQ ID NO: 254614 - RNA, 63 nt, Homo Sapiens
uuuuuauauucuuaaauuugcucacaaauugugguuuguuacaauuaaacuggauacuuauuu

SEQ ID NO: 254615 - RNA, 63 nt, Homo Sapiens
uuaagcucuuuccuauuguguuuauacaguuuuguuuguuauacucuuugcaccuuaaacccc

SEQ ID NO: 254616 - RNA, 63 nt, Homo Sapiens
guagagcccccuccugugcccucaguggcugucguuuguuaacaucaucaggaagaugggaaa

SEQ ID NO: 254617 - RNA, 63 nt, Homo Sapiens
gggggaaaucacaagucacugagguguuuguuuguuuguuaggcagugcuagagcuugaagcc

SEQ ID NO: 254618 - RNA, 63 nt, Homo Sapiens
uaggcaaacuaucaauuuuuuguccauuuuccuguuuguuaaaauaacauaccucuccuacgu

SEQ ID NO: 254619 - RNA, 63 nt, Homo Sapiens
aacuuacauuuuguuuccaauuuuucauuuuuuguuuguuauuuguuuuuuguagacagcacu

SEQ ID NO: 254620 - RNA, 63 nt, Homo Sapiens
uucauucuuaagcuugcuuuuuuugagacugguguuuguuagacagccacaguccugucuggg

SEQ ID NO: 254621 - RNA, 63 nt, Homo Sapiens
caaggaggaggguugagcaaucuagagcauggaguuuguuaagugcucucuggauuugaguug

SEQ ID NO: 254622 - RNA, 63 nt, Homo Sapiens
caucuaagaugaaacucauaaaaauuauuuaauguuuguuaugaauuuaaaagcuccagaaau

SEQ ID NO: 254623 - RNA, 63 nt, Homo Sapiens
guuuuuaaauauucaauauuggucuguguuuaaguuuguuauuugaauguaauuuacauagag

SEQ ID NO: 254624 - RNA, 63 nt, Homo Sapiens
acucugggaagucugaccaaguuggagcagaugguuuguuacuugaaucuccaaacacuuagu

SEQ ID NO: 254625 - RNA, 63 nt, Homo Sapiens
ccugugucuuacacauuucugguuaauguaguuguuuguuagaccaugaugguuguugcccga

SEQ ID NO: 254626 - RNA, 63 nt, Homo Sapiens
gcuacaggcuacugagcgucuucauagccacgaguuuguuauuaugagaacacugcaucugca

SEQ ID NO: 254627 - RNA, 63 nt, Homo Sapiens
cuagagcugagguuggaggaucugaacacugcaguuuguuagaaucacgggcauuuuaucuuc

SEQ ID NO: 254628 - RNA, 63 nt, Homo Sapiens
cuauuguauguuacaaaagaaagaaaaaaaagaguuuguuacuccccuuauuuaaaaaaaaaa

SEQ ID NO: 254629 - RNA, 63 nt, Homo Sapiens
aaguucugucuugucaugggauaaauugguacuguuuguuacaagcaaaaacccacggccaaa

SEQ ID NO: 254630 - RNA, 63 nt, Homo Sapiens
aaaaugugcacaccugacuucacauugauauauguuuguuaguucuggagaaggcccugaaau

SEQ ID NO: 254631 - RNA, 63 nt, Homo Sapiens
caauauuauaucaccaacccauuugguacugcaguuuguuauguguuaauuucaaauaugcaa

SEQ ID NO: 254632 - RNA, 63 nt, Homo Sapiens
guugggauucucugcacuuuuuguggaaccauuguuuguuaaucuaaguuguaauuuugauuu

SEQ ID NO: 254633 - RNA, 63 nt, Homo Sapiens
uuaaaaaucaguuuugaugauuuugcuaaccuaguuuguuacuuccuucugaaaauauuuaca

SEQ ID NO: 254634 - RNA, 63 nt, Homo Sapiens
aaaaaccucuauuuagauuuuauuuuccuuuuuguuuguuagcucguguccuugcugucuuuu

SEQ ID NO: 254635 - RNA, 63 nt, Homo Sapiens
ccuuaaacaacauucacuguuuugcugaccacuguuuguuaggagcuuaaaaguaauguaugc

SEQ ID NO: 254636 - RNA, 63 nt, Homo Sapiens
aaaacaaacacauguuuugaaauuaacuugcauguuuguuaaagaaagauguuuggcaugcca

SEQ ID NO: 254637 - RNA, 63 nt, Homo Sapiens
uguaaacccugugacuauagcaacacugcaauuguuuguuagaguucauagacgagauuuguu

SEQ ID NO: 254638 - RNA, 63 nt, Homo Sapiens
uuccaaauguucuuccuggggucuuugauauuuguuuguuacauccugcugaaguucgacugu

SEQ ID NO: 254639 - RNA, 63 nt, Homo Sapiens
gcuuauugaaugucuaaaaaauaaguuuaaaguguuuguuacccuaaguuuuuuacauuuuua

SEQ ID NO: 254640 - RNA, 63 nt, Homo Sapiens
aauguuuaagaaauuuaccuuaaaucuuguucuguuuguuaguaugaaaaguuaacuuuuuuu

SEQ ID NO: 254641 - RNA, 63 nt, Homo Sapiens
uuggaacuguucuagagcauaccaugaaaagcaguuuguuauuaugcaggaaaaucaguuuca

SEQ ID NO: 254642 - RNA, 63 nt, Homo Sapiens
cuuuuuucugccacugcucccuagcccuguuuaguuuguuauugcugcuuuucuuuuuucuuu

SEQ ID NO: 254643 - RNA, 63 nt, Homo Sapiens
acuuuuucaugaaaauggaguuaucaguuaucuguuuguuacugcaucaucuguuuguaauca

SEQ ID NO: 254644 - RNA, 63 nt, Homo Sapiens
acucacuuacgacaucacuuccauugugugcauguuuguuauagaggagguuuuaggcuacaa

SEQ ID NO: 254645 - RNA, 63 nt, Homo Sapiens
gucagaauaguuauucucuaagaggaaacuaguguuuguuaaaaacaaaaauaaaaacaaaac

SEQ ID NO: 254646 - RNA, 63 nt, Homo Sapiens
gaaaauacauaccacauuuguuauaaagcauuuguuuguuaguaucaaucacauagguagaaa

SEQ ID NO: 254647 - RNA, 63 nt, Homo Sapiens
uaugcuuugaaaaauaauuauggggaaauacauguuuguuauuaaauuuauuauuaaagauag

SEQ ID NO: 254648 - RNA, 63 nt, Homo Sapiens
gugucgaucuguuauuuuuaauaauaaauagguguuuguuauuauuucaggcuuguauuuaau

SEQ ID NO: 254649 - RNA, 63 nt, Homo Sapiens
cucaaaacugugaagugacauagaccuaaggguguuuguuaguuggcuuuuuuugguuugggg

SEQ ID NO: 254650 - RNA, 63 nt, Homo Sapiens
ugauuaaacuguaugucuuauauaagcuguuuaguuuguuaauucuguaauauauugccagua

SEQ ID NO: 254651 - RNA, 63 nt, Homo Sapiens
uuuauuuucggggagaggauugguuacuaauauguuuguuauauuacaguguuuguuuagcua

SEQ ID NO: 254652 - RNA, 63 nt, Homo Sapiens
guauuuuuuauaaacagcuuaaguagaagauaaguuuguuaaacaagugacuguccccguaaa

SEQ ID NO: 254653 - RNA, 63 nt, Homo Sapiens
cugauuauauucaucugcuauguggccaaaccaguuuguuaaugaaauguuuuuucuuuuccu

SEQ ID NO: 254654 - RNA, 63 nt, Homo Sapiens
auauuaaagugugauuauuauaauguauuguauguuuguuauuucaaaguaguguucuaacuu

SEQ ID NO: 254655 - RNA, 63 nt, Homo Sapiens
cuaguacgacuucauuccuuccacuaacucauaguuuguuauauccuagacuagacaugcgaa

SEQ ID NO: 254656 - RNA, 63 nt, Homo Sapiens
cagccuuagaaaagcccucaauguaaaccuuauguuuguuacuaggguggccucucucccauu

SEQ ID NO: 254657 - RNA, 63 nt, Homo Sapiens
aguuaauaugcuuuucugaugaauuacacaacaguuuguuaauucuucauucuuguaguauuu

SEQ ID NO: 254658 - RNA, 63 nt, Homo Sapiens
cucagccucaccuuacgaauccaaagaacugggguuuguuagguucuuucucuaauguagagg

SEQ ID NO: 254659 - RNA, 63 nt, Homo Sapiens
gguuagaacucuuacagccuuauuuauuuuuaaguuuguuacagccaaaggguuggagugugc

SEQ ID NO: 254660 - RNA, 63 nt, Homo Sapiens
aacauuuuugccaaaagaugacugggguuuuccguuuguuaauauuaagcacaucagaacgug

SEQ ID NO: 254661 - RNA, 63 nt, Homo Sapiens
agacgaaugccauuggaaccuguuaaaugaguaguuuguuaugugucuggaagaagcagcguu

SEQ ID NO: 254662 - RNA, 63 nt, Homo Sapiens
gaggggcggggggagggagggauuucuuaucccguuuguuacauuuugaggauaauaaaggug

SEQ ID NO: 254663 - RNA, 63 nt, Homo Sapiens
cuuaguuacugauuucauuuucaauaaauguagguuuguuacaugaguuucccaauaaaaaaa

SEQ ID NO: 254664 - RNA, 63 nt, Homo Sapiens
auagauauauaagaaaaaauucuuucacuugauguuuguuagaccagaaaguguguguguucu

SEQ ID NO: 254665 - RNA, 63 nt, Homo Sapiens
gccuguuccauaggaaggcuuccugcaaauuuaguuuguuaaacuuucuguuuuguuuuuuuc

SEQ ID NO: 254666 - RNA, 63 nt, Homo Sapiens
uaacuuguggaaagcaggaaauacagaugccuuguuuguuaacaaugauuuuuaggguaaaua

SEQ ID NO: 254667 - RNA, 63 nt, Homo Sapiens
uauucgaaugcauguagauuaacacuuguauguguuuguuaaaccauaacauccauaugacug

SEQ ID NO: 254668 - RNA, 63 nt, Homo Sapiens
gauuuagcuauuuauuguucuggcuguuaagaaguuuguuauaagugacuuuaaacuuucccu

SEQ ID NO: 254669 - RNA, 63 nt, Homo Sapiens
guguagguaauauuuucaauacuauauauuguuguuuguuauugagugcuucaguaaaaagcu

SEQ ID NO: 254670 - RNA, 63 nt, Homo Sapiens
agaaaugauuuuuuagauaucucaaaaacuuguguuuguuauuuuucaaaucaguuuuuuuuc

SEQ ID NO: 254671 - RNA, 63 nt, Homo Sapiens
agaaauaauuuuuuuagguaccccaagacuuguguuuguuaaugguccuccccaccaccccac

SEQ ID NO: 254672 - RNA, 63 nt, Homo Sapiens
aacuuaauuuuuugaaaguaacuguuuucuuauguuuguuacaggucaacuucaacucaaaac

SEQ ID NO: 254673 - RNA, 63 nt, Homo Sapiens
ucuaguuucauuuaauaaccaacauuuuggcauguuuguuaaugugucuacuauuaaaaguga

SEQ ID NO: 254674 - RNA, 63 nt, Homo Sapiens
auggcugcugccuucuggaccugggccaaccacguuuguuaucgccagggggcaggucugggc

SEQ ID NO: 254675 - RNA, 63 nt, Homo Sapiens
uuaguuuuagcuguagaucaagcuauuugggguguuuguuaguaaauagggaaaauaaucuca

SEQ ID NO: 254676 - RNA, 63 nt, Homo Sapiens
ucccccuuccccugguccccugucccuggggcuguuuguuaaaaaagaguaauaaaaggauuu

SEQ ID NO: 254677 - RNA, 63 nt, Homo Sapiens
gggcuuguuccccugcaguaucuguucugugaaguuuguuaaauguaaggaaagcuuaaauuc

SEQ ID NO: 254678 - RNA, 63 nt, Homo Sapiens
ggguugcaguuugguuaggaguggaaauauuuuguuuguuaaugaugucuucaguucugguac

SEQ ID NO: 254679 - RNA, 63 nt, Homo Sapiens
ccauuuuuucucagacaccuggccguaaaaucaguuuguuacagcauucuucucuaggcugcu

SEQ ID NO: 254680 - RNA, 63 nt, Homo Sapiens
acacuggguaaaucaccuauacuuagaguaacaguuuguuaucaaaaugccugauaaaauaua

SEQ ID NO: 254681 - RNA, 63 nt, Homo Sapiens
ucaucaguaucauuagugaaaaagaaacaaauuguuuguuaucaucucuuuagacagauaagc

SEQ ID NO: 254682 - RNA, 63 nt, Homo Sapiens
aaauuguaauaccuagguaguugguugaucacaguuuguuaauuguauaaaaaaaaauuaccu

SEQ ID NO: 254683 - RNA, 63 nt, Homo Sapiens
caacuuuauuuuguauuuccuuccauuuggaagguuuguuagaccauuaagguuauauuaaag

SEQ ID NO: 254684 - RNA, 63 nt, Homo Sapiens
aagcuuuagaggaggaaugaaacacgagugacaguuuguuaaaagacauuuguuuguuuuuag

SEQ ID NO: 254685 - RNA, 63 nt, Homo Sapiens
aacugauaaauugugccaaggauauuuaugguaguuuguuaagaaauucauuuuccccuuaug

SEQ ID NO: 254686 - RNA, 63 nt, Homo Sapiens
uuucauggaaaauuuuaggggcuacagcuccuuguuuguuaguugcuaaucuuauuuuaauua

SEQ ID NO: 254687 - RNA, 63 nt, Homo Sapiens
uagguaaacuugugucaugggguacaugugcagguuuguuacaacuuuuauuuuaaguucaag

SEQ ID NO: 254688 - RNA, 63 nt, Homo Sapiens
gucuaugugauucuggaagcuguuuaauguaaaguuuguuauacccaacucaggacagaacag

SEQ ID NO: 254689 - RNA, 63 nt, Homo Sapiens
agaugucugcuuuuccaugauaaaugucacucuguuuguuaggagaagcccucuuuauuuugg

SEQ ID NO: 254690 - RNA, 63 nt, Homo Sapiens
ucaucuggaaccuacaccaaugauccaagacuaguuuguuauccuagaaaucagaugcccaga

SEQ ID NO: 254691 - RNA, 63 nt, Homo Sapiens
ugcauccaguuuaccacacuuacgaccucccauguuuguuacagccauauccuggaaacauau

SEQ ID NO: 254692 - RNA, 63 nt, Homo Sapiens
uaaaaauaccccggccaggcauguuuacuaggcguuuguuauacaucuguguauuuucuauag

SEQ ID NO: 254693 - RNA, 63 nt, Homo Sapiens
uauccuagugggccauuaaauuaucucaauuuaguuuguuauuaacucauagauuauuaucua

SEQ ID NO: 254694 - RNA, 63 nt, Homo Sapiens
uaaauauauuuauagaaguuugugaauagcuauguuuguuauuuauaugucacuugugugcua

SEQ ID NO: 254695 - RNA, 63 nt, Homo Sapiens
gcuugucagguuuggauagaauauaauugauugguuuguuacuuggacuaacaaggcaguaga

SEQ ID NO: 254696 - RNA, 63 nt, Homo Sapiens
guuuuaaaugcaaaauagccuuauuuucauuuaguuuguuagcacuauagugagcuuuucaaa

SEQ ID NO: 254697 - RNA, 63 nt, Homo Sapiens
cauuauucauauguguaucuauaucugcauaauguuuguuaaugucuacuaaaauugcuacuu

SEQ ID NO: 254698 - RNA, 63 nt, Homo Sapiens
cccugcucagggacccuggccguguguccccagguuuguuaccugcagcggcccaucacccug

SEQ ID NO: 254699 - RNA, 63 nt, Homo Sapiens
uaauauuuuugcugacuacccaguugaagaaaaguuuguuaauuggaugggauuuuuuuuuuu

SEQ ID NO: 254700 - RNA, 63 nt, Homo Sapiens
aaauuuuuuuuuuagcucuugcuuuaaguguuuguuuguuaucucaguccagaaccaauauua

SEQ ID NO: 254701 - RNA, 63 nt, Homo Sapiens
cugauggcccggcugaauaaaauggaaauucuaguuuguuagaauuaugcauucuuuuucaag

SEQ ID NO: 254702 - RNA, 63 nt, Homo Sapiens
auguauuucaaucuuagugagccaaaauuguuuguuuguuacuacagaauagagaugacuguu

SEQ ID NO: 254703 - RNA, 63 nt, Homo Sapiens
aauuaaaaucuccguucuuuaauuuaauuuguuguuuguuaaagaaagaguuuaagggcuaau

SEQ ID NO: 254704 - RNA, 63 nt, Homo Sapiens
ugaguaaaccucuauauucaggaugacaguucuguuuguuagaaauuuucagacauuuugaaa

SEQ ID NO: 254705 - RNA, 63 nt, Homo Sapiens
acaauguauaauuguguuuuauuaacuguacagguuuguuaucuuguuuuguauuauucagaa

SEQ ID NO: 254706 - RNA, 63 nt, Homo Sapiens
aaccaaauauuuuuaaaaauagauaucuuaccuguuuguuauugcuguccaaguuuuauacua

SEQ ID NO: 254707 - RNA, 63 nt, Homo Sapiens
acucauauugauuaaaacaguccaauuagggauguuuguuacuucccugcuuccucucuagaa

SEQ ID NO: 254708 - RNA, 63 nt, Homo Sapiens
uugacuuauaaauacaauuuuuuuuaaaaagugguuuguuacuuuuugacaauguggaguuuu

SEQ ID NO: 254709 - RNA, 63 nt, Homo Sapiens
cugugaagacucaacggauguguguguuuguauguuuguuaacaguuacauauguuuguauga

SEQ ID NO: 254710 - RNA, 63 nt, Homo Sapiens
gguguccuauuuucuuguuuauacguucauucuguuuguuauugcuacuauguaaaacuuuca

SEQ ID NO: 254711 - RNA, 63 nt, Homo Sapiens
ggacugcguccauguacuaguauaacagcuuggguuuguuagaauuugggcaacauuuugauu

SEQ ID NO: 254712 - RNA, 63 nt, Homo Sapiens
cacuuuaaauggaauaauuaaacaggaaguuuaguuuguuaugguggaucaaaaaugccacuu

SEQ ID NO: 254713 - RNA, 63 nt, Homo Sapiens
uacgguucugagaggaggggcauggaaaggagaguuuguuacuuuggaugaggaggggacugc

SEQ ID NO: 254714 - RNA, 63 nt, Homo Sapiens
uuagagcaaguuugcccauauccuuucuuccucguuuguuacuacuucuaaaugguuccuggu

SEQ ID NO: 254715 - RNA, 63 nt, Homo Sapiens
aagaaaaaaaugaauaaugcuguacaaagaauuguuuguuaaccaugauuaguaccaaaccac

SEQ ID NO: 254716 - RNA, 63 nt, Homo Sapiens
uauuuuauuuaauuuaaaagaauauuuuaacaaguuuguuauagacaaacguuuaauuugcua

SEQ ID NO: 254717 - RNA, 63 nt, Homo Sapiens
uacaccauaauuucagaucagaagauaauaaauguuuguuagagaauuaagaguccaguuucg

SEQ ID NO: 254718 - RNA, 63 nt, Homo Sapiens
agaaaaagcauccauuuucuagggcauagccuaguuuguuauaaauagaaaacaguaaaaaac

SEQ ID NO: 254719 - RNA, 63 nt, Homo Sapiens
auuuugacagauuaagguguuuaacaugauucuguuuguuaauccaaaccacuaugcuuaaug

SEQ ID NO: 254720 - RNA, 63 nt, Homo Sapiens
gggccaugcauugguaacuuuguuuuauacgauguuuguuauaaguuuccaugaaggugugua

SEQ ID NO: 254721 - RNA, 63 nt, Homo Sapiens
ugguauucuaucucuuuuucuuuuaaugcacugguuuguuauuuuaauacugacauacuggau

SEQ ID NO: 254722 - RNA, 63 nt, Homo Sapiens
acacccuucaguugcaauaugacuggaauuuuuguuuguuagauaccauagaauuauuaucca

SEQ ID NO: 254723 - RNA, 63 nt, Homo Sapiens
agggagaagauuauggaggcgaacggacugcacguuuguuacaggcuuguuuuuacagcuugu

SEQ ID NO: 254724 - RNA, 63 nt, Homo Sapiens
uuggaguaacaggcuuauuccacuuuccaugggguuuguuaauauuuugcauugacucauacu

SEQ ID NO: 254725 - RNA, 63 nt, Homo Sapiens
uucaauuagaaaccuuuacuauuuccaauguauguuuguuaaaaauaauaauaauaaaaccaa

SEQ ID NO: 254726 - RNA, 63 nt, Homo Sapiens
auauaugugacagauacaaauucucugugaucaguuuguuauuuuuuuucuccuuaaggcaca

SEQ ID NO: 254727 - RNA, 63 nt, Homo Sapiens
uggagaccuuaaugcuaaguguagauuauugagguuuguuagugaggaaaagaauaagaguuc

SEQ ID NO: 254728 - RNA, 63 nt, Homo Sapiens
ccccgguaaguaauuaacagagaauaaaaauguguuuguuaaaugacaaagcagcaguuuuuc

SEQ ID NO: 254729 - RNA, 63 nt, Homo Sapiens
uguucauuacuaaaacaaacagcaaaacuauugguuuguuauucuguguuuuccucaagucag

SEQ ID NO: 254730 - RNA, 63 nt, Homo Sapiens
aaaauguaaaaaacaaaaaaaacaacaaaaaaaguuuguuacuuugaauaguccuaaaaagaa

SEQ ID NO: 254731 - RNA, 63 nt, Homo Sapiens
ggcagaauuggauagauacaaggauguuuggguguuuguuacaugucuuauaauugauauuuu

SEQ ID NO: 254732 - RNA, 63 nt, Homo Sapiens
aguugcuguacuuuguauauuauuaaaacugggguuuguuaccgguacaucguauauaaaaug

SEQ ID NO: 254733 - RNA, 63 nt, Homo Sapiens
cgugccacaauauagcauauaugugguguaaagguuuguuauauuucuuuagcaaaccagguu

SEQ ID NO: 254734 - RNA, 63 nt, Homo Sapiens
cugguaaaugccacacguuacacccaaugagauguuuguuacugcuccacaugggaccugugu

SEQ ID NO: 254735 - RNA, 63 nt, Homo Sapiens
gagucauuuuuaaugaaagaccgagcuuugacuguuuguuaaauuguaugauugaaacuugca

SEQ ID NO: 254736 - RNA, 63 nt, Homo Sapiens
ucuauacucacucugucaugaagcguugggcauguuuguuauuacguucuagcaacuguauaa

SEQ ID NO: 254737 - RNA, 63 nt, Homo Sapiens
uacacuggucuaauguuugugacaccaauaaauguuuguuauuaaguuuuuucuaccauaagu

SEQ ID NO: 254738 - RNA, 63 nt, Homo Sapiens
cggcacucauuuugcggagggggcauuggggccguuuguuaagaaaggcccagccggacugcc

SEQ ID NO: 254739 - RNA, 63 nt, Homo Sapiens
aaaaaaaaaaacaaaacaaaaaaagguuacaaaguuuguuaacuugcuauccuguggucuugu

SEQ ID NO: 254740 - RNA, 63 nt, Homo Sapiens
uauccuguggucuuguugccugaaauuguuauuguuuguuauuucucucugauguuuuuugua

SEQ ID NO: 254741 - RNA, 63 nt, Homo Sapiens
guacucugcaguggacauaagcauugggccauaguuuguuaaucucaacuaacgccuacauua

SEQ ID NO: 254742 - RNA, 63 nt, Homo Sapiens
aagcauuuuugugagugaccaccuuugcaauauguuuguuaauuuacuucauguuggguucuu

SEQ ID NO: 254743 - RNA, 63 nt, Homo Sapiens
ccgcaugucuuauucuugcccuucccccaaccaguuuguuaaucaaacaauaaaaacauguuu

SEQ ID NO: 254744 - RNA, 63 nt, Homo Sapiens
cuaugcaauauuuuuuacuuuucuaauaaacauguuuguuaaaacaguugguugagucucuca

SEQ ID NO: 254745 - RNA, 63 nt, Homo Sapiens
cugccucuuccacauaauguccuuugcuuucauguuuguuaucuucuuuuucuguucacucag

SEQ ID NO: 254746 - RNA, 63 nt, Homo Sapiens
aucacaaauauauaugcuuccagacaaagaaaaguuuguuaguccugauuuucuaaucguagc

SEQ ID NO: 254747 - RNA, 63 nt, Homo Sapiens
uuacaugguuacacagugaguaauucagugaaaguuuguuaggagagcugaaaguguaacugu

SEQ ID NO: 254748 - RNA, 63 nt, Homo Sapiens
aaguggcuagaacaucaauuaaaacauccaacuguuuguuauagcuaaauacuguaauguuuc

SEQ ID NO: 254749 - RNA, 63 nt, Homo Sapiens
aaaaaaaugaaaaaaaaaguaauuuacaugcauguuuguuacauaaugucugauugaaacaca

SEQ ID NO: 254750 - RNA, 63 nt, Homo Sapiens
aucaaauuugacuuccuagcaccacuuaagagaguuuguuauauugcuuccuucuuaaccucu

SEQ ID NO: 254751 - RNA, 63 nt, Homo Sapiens
caaauuaauccacaguuucugaauacaaugaauguuuguuaaacagggccuggcauuugguag

SEQ ID NO: 254752 - RNA, 63 nt, Homo Sapiens
gagaagcugcuucaaaucacuccuacugucaugguuuguuauagaugcaagacaagucauccu

SEQ ID NO: 254753 - RNA, 63 nt, Homo Sapiens
ggguauguuuaaucuguuauguacuaguguucuguuuguuauuguuuuguuaauuacaccaua

SEQ ID NO: 254754 - RNA, 63 nt, Homo Sapiens
uauggagaauguuauggaagaaauaguuuauaaguuuguuaaguacuuauaacaugguuuauc

SEQ ID NO: 254755 - RNA, 63 nt, Homo Sapiens
aaaaauacaacugagaagggugaagagaaguauguuuguuaaacaguaaaaaugaauaguaua

SEQ ID NO: 254756 - RNA, 63 nt, Homo Sapiens
ugagaaagcauguuuaaaaauacaaaaauacguguuuguuauucccccuuugccuuuaaaacu

SEQ ID NO: 254757 - RNA, 63 nt, Homo Sapiens
auguauguuuuuuuccaauggucuaaauucacuguuuguuacuaacaauuuaugcgaaccuau

SEQ ID NO: 254758 - RNA, 63 nt, Homo Sapiens
ucuuauuuuagaaauuauaaauacuuaaauuugguuuguuaauguuucaaucucugacuaaaa

SEQ ID NO: 254759 - RNA, 63 nt, Homo Sapiens
auugcuguaaaguauuauaucuuaaugugaauaguuuguuaauccuuagauacuccuguaauu

SEQ ID NO: 254760 - RNA, 63 nt, Homo Sapiens
gaacuguggacucgcuuuccuggaugguauuguguuuguuaguucuuuguggcuacuuguuug

SEQ ID NO: 254761 - RNA, 63 nt, Homo Sapiens
aaucagaaauggguccaugauuauugggaaugaguuuguuauaguggacugcagccuucaucu

SEQ ID NO: 254762 - RNA, 63 nt, Homo Sapiens
uaggauuccauuugaugauucuggauuuuugcuguuuguuauugcccuuagaggggcucugag

SEQ ID NO: 254763 - RNA, 63 nt, Homo Sapiens
aaauauuuauuguuucagagacuguacuauuuuguuuguuagaagauuuauaaggcaguaucu

SEQ ID NO: 254764 - RNA, 63 nt, Homo Sapiens
ugggagaucuggugaucucccaagcuaucuaaaguuuguuagauagcugcauguggcuuuuuu

SEQ ID NO: 254765 - RNA, 63 nt, Homo Sapiens
aaugagcuuuuuaaggaagaaauauuauauauuguuuguuaaaguuuauugaaauaaagaauc

SEQ ID NO: 254766 - RNA, 63 nt, Homo Sapiens
cuguguuauuagugaggaaacuuuaaaacucauguuuguuauuacuuacuacccaauuucauu

SEQ ID NO: 254767 - RNA, 63 nt, Homo Sapiens
uuccccuaaacuugcccuguuuuuguuuuuuuaguuuguuauccccuuacugagcggccucua

SEQ ID NO: 254768 - RNA, 63 nt, Homo Sapiens
gccaggacccacacagcuucgauggaucucaguguuuguuaacaaaauacaaagaucucaaac

SEQ ID NO: 254769 - RNA, 63 nt, Homo Sapiens
uugccauucugccguagcuagauguucugugggguuuguuaacauggaacuacucagcuuucu

SEQ ID NO: 254770 - RNA, 63 nt, Homo Sapiens
ucguccccagcguccguccuguaacgugcuucuguuuguuaugguagaacagcccuguguuaa

SEQ ID NO: 254771 - RNA, 63 nt, Homo Sapiens
uuuuuaggaaaauucugaagccagcuaucacagguuuguuagcuaauaauaguauuuucuuuu

SEQ ID NO: 254772 - RNA, 63 nt, Homo Sapiens
auugagcaguagcauuugccuuuuggguuuuuuguuuguuauuauagaagagaugacuucugc

SEQ ID NO: 254773 - RNA, 63 nt, Homo Sapiens
uaauuuuaaagauucuuuaucugcaucauugcuguuuguuacuauaaauuaaaugaaccucau

SEQ ID NO: 254774 - RNA, 63 nt, Homo Sapiens
ucaguucuaaugaaauuuuguaaaagauggcaaguuuguuaccucacuugagugggguuuucc

SEQ ID NO: 254775 - RNA, 63 nt, Homo Sapiens
cauuuuucugucagauuuguaguaauuugugagguuuguuagagauuaauauagguuuucuuu

SEQ ID NO: 254776 - RNA, 63 nt, Homo Sapiens
gaguuuucucuguauucucagaagauguuaauaguuuguuacuagccagagaguaugacuaug

SEQ ID NO: 254777 - RNA, 63 nt, Homo Sapiens
cuguuagucggguuagaguuggcucuacgcgagguuuguuaauaaaaguuuguuaaaaguuug

SEQ ID NO: 254778 - RNA, 63 nt, Homo Sapiens
agaguuggcucuacgcgagguuuguuaauaaaaguuuguuaaaaguuuguuuugugcaagugu

SEQ ID NO: 254779 - RNA, 63 nt, Homo Sapiens
agcccaugguaaacacaggcuucaccuguucuuguuuguuagccuugacugugaggcaggacu

SEQ ID NO: 254780 - RNA, 63 nt, Homo Sapiens
aaggaggaggacuggcugccuccauuuugccuuguuuguuaguuugccugggucugucugagg

SEQ ID NO: 254781 - RNA, 63 nt, Homo Sapiens
cagucacaucacaauauucaguggugaaaucuuguuuguuacugucauucccauuccuuuucg

SEQ ID NO: 254782 - RNA, 63 nt, Homo Sapiens
uagguauauauaugccaugagccgaaugugcagguuuguuacauuaaguuucaggauacaugu

SEQ ID NO: 254783 - RNA, 63 nt, Homo Sapiens
acguuuaauuagaagguggaacagguaaauucuguuuguuacucccuuuuaucugauucugag

SEQ ID NO: 254784 - RNA, 63 nt, Homo Sapiens
uaucucauuagagaacugcuaaaauaaaauaucguuuguuauuacugcauguuuuauaaaaua

SEQ ID NO: 254785 - RNA, 63 nt, Homo Sapiens
uuuuuaaaaauugcucuuaacagauauuuagauguuuguuacaagcauuucagauuuuauugu

SEQ ID NO: 254786 - RNA, 63 nt, Homo Sapiens
auuuuuaaaggacgcucuaguucuagguagcuuguuuguuauuuuaaaaagacauuaagugaa

SEQ ID NO: 254787 - RNA, 63 nt, Homo Sapiens
gagccuucucuuguguguuauaucagaaaagguguuuguuaaauaaggaaucccuaacccuac

SEQ ID NO: 254788 - RNA, 63 nt, Homo Sapiens
auaugcuugacuagaguuuccauuuuuuuaaaaguuuguuaaacuuauucuuagcuguauaua

SEQ ID NO: 254789 - RNA, 63 nt, Homo Sapiens
ugaaagagucuggccaaaacgugcuauuuuguaguuuguuauacucuguuuuuuaguauaaug

SEQ ID NO: 254790 - RNA, 63 nt, Homo Sapiens
caccuaggaucauauugcauauguguuucugcaguuuguuacaauaaucuaacccaaacuagc

SEQ ID NO: 254791 - RNA, 63 nt, Homo Sapiens
uaauguggccucugucaguuaaaaaaaaaaaagguuuguuaaugcuguuuuuaucuccaauaa

SEQ ID NO: 254792 - RNA, 63 nt, Homo Sapiens
guuuauacuauuuuuggauuugguuuagagaggguuuguuaagggggagaugugaauaugacc

SEQ ID NO: 254793 - RNA, 63 nt, Homo Sapiens
acuuuuucuguauuuguugccuggggcuucuccguuuguuaauuauuguuacuguacguguau

SEQ ID NO: 254794 - RNA, 63 nt, Homo Sapiens
aacaguacgacaguguauuguaaauucccuuuaguuuguuacaguagccaauugaaaauguau

SEQ ID NO: 254795 - RNA, 63 nt, Homo Sapiens
caggaaacacauuucuguggccuuagccaagcaguuuguuaguuacauauucccucgcaaacc

SEQ ID NO: 254796 - RNA, 63 nt, Homo Sapiens
accacaggaauguaucacaacuuaaccguucccguuuguuagacuaguuucuuauuaauguug

SEQ ID NO: 254797 - RNA, 63 nt, Homo Sapiens
ggcaagccucccauugccuuucugcaucaauguguuuguuaccaaauagcagaaauuucgcuu

SEQ ID NO: 254798 - RNA, 63 nt, Homo Sapiens
cuuauuuguaguuguuaguugcccugcuaccuaguuuguuagugcauuugagcacacauuuua

SEQ ID NO: 254799 - RNA, 63 nt, Homo Sapiens
gacaauuuucauaacuugauaaauuauaguuuuguuuguuagaaaaguugcucuuaaaagaug

SEQ ID NO: 254800 - RNA, 63 nt, Homo Sapiens
ucuaaaagagcucgcuggcaagcugccucuugaguuuguuauaaaagcgaacuguucacaaaa

SEQ ID NO: 254801 - RNA, 63 nt, Homo Sapiens
guuuuuuguaguuguuaccgcucuuuuggguugguuuguuaauuuauacaaagagauuaccac

SEQ ID NO: 254802 - RNA, 63 nt, Homo Sapiens
cugagccauggugucgagugaagaguaguucuuguuuguuacaaccuuugugagucagccaug

SEQ ID NO: 254803 - RNA, 63 nt, Homo Sapiens
uaagagucuauguaugucucccaaagcuuagcaguuuguuagauugaacugcacuuuauauaa

SEQ ID NO: 254804 - RNA, 63 nt, Homo Sapiens
aaauggaauggucucuuugauuguaacuuaccuguuuguuaggaaaaguaaaauggacuacuu

SEQ ID NO: 254805 - RNA, 63 nt, Homo Sapiens
ugaacauuuucaauuauaugcuuaugaauaauuguuuguuaauuuuuaguuaauauaccaaag

SEQ ID NO: 254806 - RNA, 63 nt, Homo Sapiens
guugaagauuaacuuuuccuuuguaaaaaauuaguuuguuauaacagcuaaaagggacuaaau

SEQ ID NO: 254807 - RNA, 63 nt, Homo Sapiens
auaguuggucaaugccuggcuugcuguuuaacuguuuguuaucaagggauaaaucucuaauua

SEQ ID NO: 254808 - RNA, 63 nt, Homo Sapiens
uggauuaaauaguuuuaaaacauagagucaccuguuuguuaugagccauugcucugcuccugg

SEQ ID NO: 254809 - RNA, 63 nt, Homo Sapiens
uuuaaguacauuuuaauaauagugugugauacaguuuguuacuaaagaacacuucuaagccua

SEQ ID NO: 254810 - RNA, 63 nt, Homo Sapiens
cacagugaaaauguauuauauucuucaaagggaguuuguuauaauggauuaucugggguaauu

SEQ ID NO: 254811 - RNA, 63 nt, Homo Sapiens
auccuuuaaucauaacuaaaucucguagagaugguuuguuaccuacaagauacucuuuggauc

SEQ ID NO: 254812 - RNA, 63 nt, Homo Sapiens
acgauagcuauauucaaaauugaucauaaugagguuuguuaaaggugacugaaauugcaucag

SEQ ID NO: 254813 - RNA, 63 nt, Homo Sapiens
auugcuucacugguuuaauaauuuaaaaguuauguuuguuaaacacccugucagaacagucau

SEQ ID NO: 254814 - RNA, 63 nt, Homo Sapiens
uuuaauggaaucuuuguuuuuguucuccaucuuguuuguuagagucucucggccuuuauuuac

SEQ ID NO: 254815 - RNA, 63 nt, Homo Sapiens
auucaacuuuuaagauacagaagaaauuuguauguuuguuaaaguugcauuuauugcagcaag

SEQ ID NO: 254816 - RNA, 63 nt, Homo Sapiens
gcaguaauaaaccauuuguuuuacugcuguuaaguuuguuauuuggguauaaaaccagauguu

SEQ ID NO: 254817 - RNA, 63 nt, Homo Sapiens
uaacagcugcuggacagacacauuagagcagcuguuuguuauugauaauaaaauauuauaaaa

SEQ ID NO: 254818 - RNA, 63 nt, Homo Sapiens
ucuuuuucaugggcgggucggggucaguauccuguuuguuauuguuaaauuuguaugaaccuu

SEQ ID NO: 254819 - RNA, 63 nt, Homo Sapiens
ucgaugugauacaguauaaauaugcuaugguuuguuuguuaugaacagauagccaccaguuac

SEQ ID NO: 254820 - RNA, 63 nt, Homo Sapiens
agagaaacauuuuugcaugaguucuuacaaacuguuuguuauauuuucuggaaugauaaguga

SEQ ID NO: 254821 - RNA, 63 nt, Homo Sapiens
agccggcgaugcccaauaaauguguguuuugcuguuuguuaagugauuucagcaacaagugug

SEQ ID NO: 254822 - RNA, 63 nt, Homo Sapiens
cauucauaugccuacccaucuucaaauaaguugguuuguuagagugugugugaaaaagcuggg

SEQ ID NO: 254823 - RNA, 63 nt, Homo Sapiens
ugcugcuuaauaaaguaagcaacuuuaaaagcuguuuguuauaccacggccauaacaauauuu

SEQ ID NO: 254824 - RNA, 63 nt, Homo Sapiens
uucaaauacccauccaacaagcagauaucaagaguuuguuauuauguuuuccacuugauugcu

SEQ ID NO: 254825 - RNA, 63 nt, Homo Sapiens
uuucuuuucuuuuuucuuuuauguuuuuaaaauguuuguuauauguuaacugaacucuuaauu

SEQ ID NO: 254826 - RNA, 63 nt, Homo Sapiens
agagguugugcacuguuuacaccaaaucguagcguuuguuacccaaagggugucugcgucguc

SEQ ID NO: 254827 - RNA, 63 nt, Homo Sapiens
uaccauaaugcuaaauaaaauugagacagaacuguuuguuauguuaauuaauuuuuuucauaa

SEQ ID NO: 254828 - RNA, 63 nt, Homo Sapiens
augaggcauuuguuugaacuaguugauacuacaguuuguuaguaaguauuauaccuuuuuuag

SEQ ID NO: 254829 - RNA, 63 nt, Homo Sapiens
agcauuuaaacuguuucauuuuuuggauaacacguuuguuacaagcaucaucauauugugcug

SEQ ID NO: 254830 - RNA, 63 nt, Homo Sapiens
aauagaaauaaacgacaaaaccucaacacaagaguuuguuauaugcugccguccaucaagagc

SEQ ID NO: 254831 - RNA, 63 nt, Homo Sapiens
auugccacuaguuccaucuagaacuccuuucuaguuuguuauuuuuaaaauguuuauacauaa

SEQ ID NO: 254832 - RNA, 63 nt, Homo Sapiens
ggccugugggaaugggauuuguuacaaaucuagguuuguuacuggcuucagaaagcuaauuaa

SEQ ID NO: 254833 - RNA, 63 nt, Homo Sapiens
aucaaaguauuauaugcugugugcuuuuuagguguuuguuaguacugugaaggcaaaaaugcu

SEQ ID NO: 254834 - RNA, 63 nt, Homo Sapiens
uggacugugaagcaucugccauggggaagugcuguuuguuauccuuucucuguggcagugaag

SEQ ID NO: 254835 - RNA, 63 nt, Homo Sapiens
acguggcgucugauaacagugagggggggugggguuuguuaugucuuuauugaguauuuaagu

SEQ ID NO: 254836 - RNA, 63 nt, Homo Sapiens
agaaaauaacagaauagccuucuguaaugaggcguuuguuagaguuuugcaugagauucuaau

SEQ ID NO: 254837 - RNA, 63 nt, Homo Sapiens
acuugugaaaacaagguuguuuuugucuuuaucguuuguuagaguuauagauuuaugauuuca

SEQ ID NO: 254838 - RNA, 63 nt, Homo Sapiens
ggcggaaucccgagggugguaugcaaacgcgggguuuguuaggcuagggacagaggcaucugg

SEQ ID NO: 254839 - RNA, 63 nt, Homo Sapiens
cuauucauaacauuguagagcuuucugaaagcaguuuguuauaauucuuuuccuuucauuuug

SEQ ID NO: 254840 - RNA, 63 nt, Homo Sapiens
aagaacuggucagaccuugccacacacauguauguuuguuacccauugcuguauacacacaga

SEQ ID NO: 254841 - RNA, 63 nt, Homo Sapiens
acaggcagccaacaucacuccuggcgaaaaacaguuuguuaacacaggcaugagccacuguac

SEQ ID NO: 254842 - RNA, 63 nt, Homo Sapiens
gucuguucuacaugggccuguuuccagcugcagguuuguuagacugguuuaaaagggauccag

SEQ ID NO: 254843 - RNA, 63 nt, Homo Sapiens
cccccuccucaauguaguggccuuggauauccuguuuguuaauaaagacaauucaaccagcuc

SEQ ID NO: 254844 - RNA, 63 nt, Homo Sapiens
cugugagucuggcucaagaccgacauugccuugguuuguuacaugacuaucgugauggggaaa

SEQ ID NO: 254845 - RNA, 63 nt, Homo Sapiens
ugggcuuucuguuuaugaggggugagaagugauguuuguuacuauguucuccagcaaguaaac

SEQ ID NO: 254846 - RNA, 63 nt, Homo Sapiens
ucuaauaacaaaaaauguaaaccuaauuuggcaguuuguuagguuagacaacugacagccuca

SEQ ID NO: 254847 - RNA, 63 nt, Homo Sapiens
cuuaaauuaguaugugccccuaaaauauucuauguuuguuaugagauucaaauaaaaaaauuu

SEQ ID NO: 254848 - RNA, 63 nt, Homo Sapiens
cacaucccuguaaggcccauaagagaaagaggaguuuguuacauuuaaucaacacugugaagu

SEQ ID NO: 254849 - RNA, 63 nt, Homo Sapiens
agcauagugcuuugcacauaguagucacucaguguuuguuaaauaaagcuauuagugucauua

SEQ ID NO: 254850 - RNA, 63 nt, Homo Sapiens
uucagcagcaaacuugcaacagacuggccuucuguuuguuacuuucaaaaggcccacaugaua

SEQ ID NO: 254851 - RNA, 63 nt, Homo Sapiens
uguuucucuacuaagaacucuuucuuaaaugugguuuguuacuguagcacuuuuuacacugaa

SEQ ID NO: 254852 - RNA, 63 nt, Homo Sapiens
cugguuguaauuaauuuuuuuuguuugaucuguguuuguuauagguagcacaaucuacuaaug

SEQ ID NO: 254853 - RNA, 63 nt, Homo Sapiens
uugagagauaaacaaugacaaggcuucagcuugguuuguuaaaacaagguuguagcugugcuc

SEQ ID NO: 254854 - RNA, 63 nt, Homo Sapiens
cauguucacuucccccaggacucucgugauucuguuuguuaccuguugcugcucuguauuugc

SEQ ID NO: 254855 - RNA, 63 nt, Homo Sapiens
ucaaauuagcuggucucugaucuguggaauucuguuuguuaaaugccucagcugaucagaguu

SEQ ID NO: 254856 - RNA, 63 nt, Homo Sapiens
auguccauguaaacaugcccuuuuaauguauauguuuguuauaaaggcaacacauuccuacac

SEQ ID NO: 254857 - RNA, 63 nt, Homo Sapiens
cugguuguaauuaauuuuuuuuguuugaucuguguuuguuauagguagcucaaucuacuaaug

SEQ ID NO: 254858 - RNA, 63 nt, Homo Sapiens
cugauugggagaguuccauggggaaucgaaacaguuuguuaauuguguccuccagguuuauau

SEQ ID NO: 254859 - RNA, 63 nt, Homo Sapiens
aggcuacacgagcucucuagaaaaaaaaaaaaaguuuguuaaauguuucuaugugcaaaaaaa

SEQ ID NO: 254860 - RNA, 63 nt, Homo Sapiens
guuuccuaaacuauaaaagcagauuuugcuuuuguuuguuaaucauaggcauggccgagcauu

SEQ ID NO: 254861 - RNA, 63 nt, Homo Sapiens
uuuauuuuaucucaaguauguccaguguguucgguuuguuacauauuccaugaaauaucugag

SEQ ID NO: 254862 - RNA, 63 nt, Homo Sapiens
agcagauuagcaccauaacuaacuuaaaacuaaguuuguuaccugcuuuuuauacugucacaa

SEQ ID NO: 254863 - RNA, 63 nt, Homo Sapiens
uuaaaauuaccagacaaaaaaauuuaaaauuacguuuguuauuccuaguggaugacuguugau

SEQ ID NO: 254864 - RNA, 63 nt, Homo Sapiens
auaggacaaaaaaguugugguuuggggaggucuguuuguuacauaaaaaggaccuuucggugu

SEQ ID NO: 254865 - RNA, 63 nt, Homo Sapiens
aagauuaugaaaccacaugagaagugauaaaauguuuguuaaagcuagauagagguuaagaau

SEQ ID NO: 254866 - RNA, 63 nt, Homo Sapiens
uuuauaucacuguuuuucacagauuuauauuugguuuguuaauuggaaaugcagaauggcguu

SEQ ID NO: 254867 - RNA, 63 nt, Homo Sapiens
aacugguaaauuuugcaacuuaaagacauucauguuuguuaaacuguaaauggcugucuaaaa

SEQ ID NO: 254868 - RNA, 63 nt, Homo Sapiens
ucucuuuuauaugcauguauaaaucaagguuuuguuuguuaauauaacuuccauguucucuag

SEQ ID NO: 254869 - RNA, 63 nt, Homo Sapiens
accagagaugccugaacucauucaucauauuuuguuuguuaucuacgaucguuauucccccaa

SEQ ID NO: 254870 - RNA, 63 nt, Homo Sapiens
uuuuuguuuuuguauuuuuuuucuuuugaaaggguuuguuaauuuuucuaauuuuaccaaagu

SEQ ID NO: 254871 - RNA, 63 nt, Homo Sapiens
uuuagccguguuugggacuccgugucuucaaugguuuguuaguugccauuacaacuuugucug

SEQ ID NO: 254872 - RNA, 63 nt, Homo Sapiens
gugcugggauuacaggcccgguccaguuugauaguuuguuaucauguuauacguacacuuaga

SEQ ID NO: 254873 - RNA, 63 nt, Homo Sapiens
uuagcagagaauuuguaauuuaagaaauuuucuguuuguuacggaacaugugggaaucccuuu

SEQ ID NO: 254874 - RNA, 63 nt, Homo Sapiens
uucaacucuugcaccuggaguucugcugguuaaguuuguuaaacuuaguugaaacugggaacc

SEQ ID NO: 254875 - RNA, 63 nt, Homo Sapiens
aaauaaagagcuaucaugcugugguuuauuaugguuuguuacauugauaggauacauacugaa

SEQ ID NO: 254876 - RNA, 63 nt, Homo Sapiens
agcccgcucguaucuaugguuucgcuuuccacaguuuguuaccugcagucaacugcaguucaa

SEQ ID NO: 254877 - RNA, 63 nt, Homo Sapiens
cccuuccuccagauccgucugguuuuuuacaccguuuguuaauaaagccugaaaccgcugugu

SEQ ID NO: 254878 - RNA, 63 nt, Homo Sapiens
aaaaauaagaaauagcuacaaggaugucuaaauguuuguuaauuaauguacguacuaccuaaa

SEQ ID NO: 254879 - RNA, 63 nt, Homo Sapiens
ucuuuucuauucuacuguuaccucagucagccaguuuguuaugauuaauauguuaggauuuau

SEQ ID NO: 254880 - RNA, 63 nt, Homo Sapiens
uccaguugcauuuuggcugaauaaacugaauguguuuguuagugcuguuauucuauucugcaa

SEQ ID NO: 254881 - RNA, 63 nt, Homo Sapiens
aggauuuacauuaacugcugaccagaaucccauguuuguuacuuaagaaguuuaaucaaagua

SEQ ID NO: 254882 - RNA, 63 nt, Homo Sapiens
auuuacgauuucguuuguuuggauucaagcuuaguuuguuaauauguauaauuuagcaucuau

SEQ ID NO: 254883 - RNA, 63 nt, Homo Sapiens
cauuuuaagaaaacccgacaacauuucugccagguuuguuaggaggccacaugauacuuauuc

SEQ ID NO: 254884 - RNA, 63 nt, Homo Sapiens
ggcugacucuuacuaaccaccauuuccccugugguuuguuaucaguacaauucuuuguugcuu

SEQ ID NO: 254885 - RNA, 63 nt, Homo Sapiens
aauacauuauugacucuaugaauguuuucugaaguuuguuagucauuuguaaaacuaaaucag

SEQ ID NO: 254886 - RNA, 63 nt, Homo Sapiens
ggcuuugggugaauucuggauggcuugccucauguuuguuagccagcacuucugcucugucgu

SEQ ID NO: 254887 - RNA, 63 nt, Homo Sapiens
cucaugguaccuuggccaaguuggaaggaagcaguuuguuaaugaggcacaguaauccuggcu

SEQ ID NO: 254888 - RNA, 63 nt, Homo Sapiens
aauauuuacaauaaagaguauuuacaauaaagaguuuguuauuauuuguaaauugugugcaac

SEQ ID NO: 254889 - RNA, 63 nt, Homo Sapiens
cagacugggaaccccuccuggccugggggaagaguuuguuaccuaccuuacuauuuaaagagc

SEQ ID NO: 254890 - RNA, 63 nt, Homo Sapiens
ggaggggaccgggaagcgcuggggcuuguuucuguuuguuacuuacaggacugagacaucuuc

SEQ ID NO: 254891 - RNA, 63 nt, Homo Sapiens
ggugggagggguggguuuugauuuuccauuuugguuuguuagauaacagcugccugaauuguc

SEQ ID NO: 254892 - RNA, 63 nt, Homo Sapiens
cuauuuugcauguguuugagcagcuuuggacuuguuuguuaucaggacucuucaguggcugag

SEQ ID NO: 254893 - RNA, 63 nt, Homo Sapiens
ucagggaaaaggaguagggaggcuuaggacuugguuuguuauuccuccuugcccagacuacag

SEQ ID NO: 254894 - RNA, 63 nt, Homo Sapiens
ucccucacuucaccuccauauuaucccauaaagguuuguuacuuauugugacuuguaaguuuc

SEQ ID NO: 254895 - RNA, 63 nt, Homo Sapiens
uagguaagccugugccaugggcaggaccugcagguuuguuacauuacguuccgggauacaugu

SEQ ID NO: 254896 - RNA, 63 nt, Homo Sapiens
auuaggguuguaaggugucggucauuguuuccuguuuguuaauuuauugaaaaauuaaaaaau

SEQ ID NO: 254897 - RNA, 63 nt, Homo Sapiens
gguauuuuuuucacgugccuaacuaaaugugagguuuguuacuuucuccugcauuuuuacaua

SEQ ID NO: 254898 - RNA, 63 nt, Homo Sapiens
gugcacaucccuacgugcccgagcucccgcaguguuuguuagacagugccaccuuauggcaaa

SEQ ID NO: 254899 - RNA, 63 nt, Homo Sapiens
uccagcaguguuagcagggguggcaguccuuguguuuguuauaccaauaaaugcuuuagcugc

SEQ ID NO: 254900 - RNA, 63 nt, Homo Sapiens
uauaccucaacccaaaaauaaagguuuguuuugguuuguuauggcuuccuuuuuuaaaaaauu

SEQ ID NO: 254901 - RNA, 63 nt, Homo Sapiens
caauuuuguacaauuagguaucugacuuuacaaguuuguuauccuuucuaauuuuuacugaac

SEQ ID NO: 254902 - RNA, 63 nt, Homo Sapiens
uugacuauguucuucaaauuagcuuauacaagaguuuguuacgguuuucagauaaaccagaaa

SEQ ID NO: 254903 - RNA, 63 nt, Homo Sapiens
acuaaaugccacugaauuuguauacuucagaauguuuguuauguaaauuuuaccucaacuaaa

SEQ ID NO: 254904 - RNA, 62 nt, Homo Sapiens
auggaucuccguguacacuaucaauaaaaguggguuuguuacaaagccguguccuugcccau

SEQ ID NO: 254905 - RNA, 63 nt, Homo Sapiens
uuuuuggugggaggcugugaaaaucucuguacuguuuguuagggcugggccucccugacugua

SEQ ID NO: 254906 - RNA, 63 nt, Homo Sapiens
guuaaaaugucaaauaccaaaaagcacuggcaaguuuguuacuucuggaagcuggcagugugu

SEQ ID NO: 254907 - RNA, 63 nt, Homo Sapiens
ugauugaaauggcaggauucuaaagagagccugguuuguuaaaagaaaacacugucaugcugu

SEQ ID NO: 254908 - RNA, 63 nt, Homo Sapiens
cugcauuuauaauuuugugacugaggaucauuuguuuguuaauguacugugccuuuaacuuua

SEQ ID NO: 254909 - RNA, 63 nt, Homo Sapiens
ugaaguaagauuuugccuguaugguacuguuuuguuuguuaauaaagugcacugccaccccca

SEQ ID NO: 254910 - RNA, 63 nt, Homo Sapiens
uccuuguuccuguuacaauauuuagcauuauuaguuuguuauguguguauguuuauguuaauu

SEQ ID NO: 254911 - RNA, 63 nt, Homo Sapiens
gugucuacgauucaaagugaaaacauuuggcauguuuguuaauucuagcuuuuugguuuaaua

SEQ ID NO: 254912 - RNA, 63 nt, Homo Sapiens
gucucccuuucacuguuuucuuauucuguaauuguuuguuauauuucccaaaaacgucuugau

SEQ ID NO: 254913 - RNA, 63 nt, Homo Sapiens
guagaguauugagaccuuuuuuauuagggugcuguuuguuauugagagcccaaucucugcaug

SEQ ID NO: 254914 - RNA, 63 nt, Homo Sapiens
uuauuuguuuccugauagguuauguuuguaauuguuuguuaagcacagccuguuucuuggaag

SEQ ID NO: 254915 - RNA, 63 nt, Homo Sapiens
ugccagaccacguuucuaugcuauuauuagucuguuuguuaaauauaaauuaguauaucucuu

SEQ ID NO: 254916 - RNA, 63 nt, Homo Sapiens
uguguucuuaagcauaauuuuuugcagcuuuagguuuguuagaaccuacauuaacauuauguc

SEQ ID NO: 254917 - RNA, 63 nt, Homo Sapiens
ccagcccagucugucugcgguuguuuaguuuugguuuguuacguuuucauuggguuuuuauug

SEQ ID NO: 254918 - RNA, 63 nt, Homo Sapiens
acagaaaauaaaacugcgcucugguucuuaaauguuuguuacugggagggccucauguuuuau

SEQ ID NO: 254919 - RNA, 63 nt, Homo Sapiens
gaaaugaucccagagaccuaccaagggccuaauguuuguuacaagagagagcuauguuucuaa

SEQ ID NO: 254920 - RNA, 63 nt, Homo Sapiens
cugcauuuauaauuuugugacugaggaucguuuguuuguuaacguacugugacuuuaacuuua

SEQ ID NO: 254921 - RNA, 63 nt, Homo Sapiens
guagccuuaaaaaggcuuuuguuuauuucuuugguuuguuaacuagugucaucuauuuagaga

SEQ ID NO: 254922 - RNA, 64 nt, Homo Sapiens
ggcgggucagcuggugguucuuagguuuccuucuguuuguuaaaagggacaauguggccacuuc

SEQ ID NO: 254923 - RNA, 64 nt, Homo Sapiens
ugguugauaauagucaguaaccuaauaaaggaacguuuguuaaaauaucaaaccauuuuugaau

SEQ ID NO: 254924 - RNA, 64 nt, Homo Sapiens
uuuccucuccuccuucccaagucauuugaaaaguguuuguuauuuaaauuccaauaaugcccaa

SEQ ID NO: 254925 - RNA, 64 nt, Homo Sapiens
acguuucugaacagggucugugcuauguguaaagguuuguuaacuguaaaguaauauaaaguua

SEQ ID NO: 254926 - RNA, 58 nt, Homo Sapiens; identical to SEQ ID NO: 254543

SEQ ID NO: 254927 - RNA, 64 nt, Homo Sapiens
aaacugaugggcaccugauacucugucuaaauacguuuguuauauguguuuugcccugugccau

SEQ ID NO: 254928 - RNA, 64 nt, Homo Sapiens
ccccaccacccuuuuuuuucauuuccccuguuuuguuuguuaguuuggcguuagggguggaggu

SEQ ID NO: 254929 - RNA, 64 nt, Homo Sapiens
guuuucaaaagugcccauuuuaugcugcugugugguuuguuaaaucuaaaugauuuuuaaacuu

SEQ ID NO: 254930 - RNA, 64 nt, Homo Sapiens
gaaauauuucuccuuuuguuuuucuuuuuuuuuuguuuguuacugccacuucuuuuuaggagca

SEQ ID NO: 254931 - RNA, 64 nt, Homo Sapiens
auagaucucuuucucucuuuuguuuuguuuguuuguuuguuaaaguucauuauuuauuuuaccu

SEQ ID NO: 254932 - RNA, 64 nt, Homo Sapiens
cuauugacucuauuuucugaaggcaaaaaugcauguuuguuagaauggaaacagaaaaacauua

SEQ ID NO: 254933 - RNA, 64 nt, Homo Sapiens
acaugcauggucaugacacccagaauucaugaugguuuguuauaacaaccucugcauauuccag

SEQ ID NO: 254934 - RNA, 64 nt, Homo Sapiens
uuaaaaaaggcauuugaaugaauguuugacucagguuuguuaaauuaaccuucaguaacugcag

SEQ ID NO: 254935 - RNA, 64 nt, Homo Sapiens
ugucauaauuguugacguucuucaguauaaucauguuuguuaaauuguuuguaccuugcaaacu

SEQ ID NO: 254936 - RNA, 64 nt, Homo Sapiens
guguuacuauugagauucucucaauugcuccuguguuuguuauaaaguaguguuuaaaaggcag

SEQ ID NO: 254937 - RNA, 64 nt, Homo Sapiens
uugggucauuauuacuuuuauuuugcagcauuugguuuguuauuaguguaagagcaaguauagg

SEQ ID NO: 254938 - RNA, 64 nt, Homo Sapiens
uccuuuuaggcuugaauaugaugcugaacaguaaguuuguuaaaucuuggaacuuaaaacaauc

SEQ ID NO: 254939 - RNA, 64 nt, Homo Sapiens
auugcagcaccucuaucucgcagguaauggaguaguuuguuauugguagucuacuccaggccag

SEQ ID NO: 254940 - RNA, 64 nt, Homo Sapiens
ugcagcuuauucuugccaugcuuaggugacagaaguuuguuaaguaccauccuugugcccugcc

SEQ ID NO: 254941 - RNA, 64 nt, Homo Sapiens
cguuuaaauuguuaaaaugcugauuuucuuauuaguuuguuaauugccuguuacuaguacuuga

SEQ ID NO: 254942 - RNA, 64 nt, Homo Sapiens
gaucauggaguacugcucucauaauugaagacguguuuguuauuggcagagaaccuuaaaaaag

SEQ ID NO: 254943 - RNA, 64 nt, Homo Sapiens
acgccuuccucucuggauacugcaaaggcuugugguuuguuagaggguauuuguggaaacuguc

SEQ ID NO: 254944 - RNA, 64 nt, Homo Sapiens
guacuaguucagacacuuuggaaguuuguguucuguuuguuaaaacuggcaucugacacaaaaa

SEQ ID NO: 254945 - RNA, 64 nt, Homo Sapiens
auuauaauuuauaaauacagcauacuucaaaacuguuuguuaucucuuguuaccauguauguau

SEQ ID NO: 254946 - RNA, 64 nt, Homo Sapiens
ucuucauuuugagaaaacuguacauuaguuuaauguuuguuacuguauuucuuuugaguugagg

SEQ ID NO: 254947 - RNA, 64 nt, Homo Sapiens
ggaaaucaguugagcugaauuuaaguuguuuuuuguuuguuagcagguguggaugugggguuau

SEQ ID NO: 254948 - RNA, 64 nt, Homo Sapiens
cuuuuucuguggcaccuuggauacacugacuaauguuuguuaaacagauuguguuaccauuuga

SEQ ID NO: 254949 - RNA, 64 nt, Homo Sapiens
ccuuuuuccuuucuuuggguagcacuauauucuuguuuguuagugaaagauuuguaaaugguaa

SEQ ID NO: 254950 - RNA, 64 nt, Homo Sapiens
ugggccuauguaguagccuccgaggagaagaggaguuuguuaaccacuuguaucauggccuacc

SEQ ID NO: 254951 - RNA, 64 nt, Homo Sapiens
uuuuccaacuaccacuguaagacaaauacccaguguuuguuacuguugguuuauguuaaugaua

SEQ ID NO: 254952 - RNA, 64 nt, Homo Sapiens
aauaaacuagagauuuuuaaaagcaucaagugguguuuguuagaguaaauaaagccugugaguc

SEQ ID NO: 254953 - RNA, 64 nt, Homo Sapiens
agcagcgugggauauaaucauccaaucugguacaguuuguuaaaugaaagugcugauggcugga

SEQ ID NO: 254954 - RNA, 64 nt, Homo Sapiens
uagguaaacugcaugucaugggguauaugugcagguuuguuacaaacuuuuauuuuagauucag

SEQ ID NO: 254955 - RNA, 64 nt, Homo Sapiens
acauauuuauuagagugaugcugguaagcauuauguuuguuaaugguaaauguuuuuagaucuu

SEQ ID NO: 254956 - RNA, 64 nt, Homo Sapiens
agaaaagagaugagaugagaugaacacaucggguguuuguuaucacuuaaauaugaaagcaaau

SEQ ID NO: 254957 - RNA, 64 nt, Homo Sapiens
uuucuugucaacaguauugagguuauuacaugaaguuuguuauauuaggaagauucaaaaucuu

SEQ ID NO: 254958 - RNA, 64 nt, Homo Sapiens
uauuaauaugcaugcuucuuauguuaaaagauaaguuuguuauaaucgaaauacaguuauuaaa

SEQ ID NO: 254959 - RNA, 64 nt, Homo Sapiens
auguauaaaagucuuuuucucauucuuaccugcaguuuguuacucuggaaaaugaguaaugucu

SEQ ID NO: 254960 - RNA, 64 nt, Homo Sapiens
uugaagaugcuggucuugacggaaaacaauuacaguuuguuaauaugaaaaaaauguaucuuug

SEQ ID NO: 254961 - RNA, 64 nt, Homo Sapiens
auuuuuuaaaaauguuuuaaggaauaccugggaaguuuguuaaauucccaaaucuggcuggucg

SEQ ID NO: 254962 - RNA, 64 nt, Homo Sapiens
uuuuuuugcucugcagugcugauggauaaaaaugguuuguuauguucagcucugguccacagag

SEQ ID NO: 254963 - RNA, 64 nt, Homo Sapiens
aauggaugcagaauaaugcagauagugaucccauguuuguuaauugccaucauggaagucagag

SEQ ID NO: 254964 - RNA, 64 nt, Homo Sapiens
ccguaauuuuaggacuccuauaaaauucuuccuuguuuguuaaugcuauuaaaacucagauuca

SEQ ID NO: 254965 - RNA, 64 nt, Homo Sapiens
aacucuguuuuauccuagaacuaagagagcauugguuuguuaaagagcuuucaauguauauuaa

SEQ ID NO: 254966 - RNA, 64 nt, Homo Sapiens
gugcgugggacgaagacaucuuugaaggucaugaguuuguuaguuuaacaucauauauuuguaa

SEQ ID NO: 254967 - RNA, 64 nt, Homo Sapiens
ccgucucaaaaguaaauaaaaauaaucaccuggaguuuguuaaaccauauggauucucaagcuc

SEQ ID NO: 254968 - RNA, 64 nt, Homo Sapiens
cucaucccuggagcacucugccgcucaagagcugguuuguuaauuauuguuagacuuugccauu

SEQ ID NO: 254969 - RNA, 64 nt, Homo Sapiens
caucuugaaguaaauugaucccaccaggucccacguuuguuaucucugccuaaauguuagcuuc

SEQ ID NO: 254970 - RNA, 64 nt, Homo Sapiens
ucaccuacccucaaaguagguauacaaaagacuaguuuguuauuaauccacaaauaugcuaaau

SEQ ID NO: 254971 - RNA, 64 nt, Homo Sapiens
acuuuaaaauuuaacccacaagcauauuaaaucuguuuguuauaagauuggaaacaauuuuuga

SEQ ID NO: 254972 - RNA, 64 nt, Homo Sapiens
agugaggcaucacuuuguuugcauaaaguauacgguuuguuaaggccuuuguucuugugagaug

SEQ ID NO: 254973 - RNA, 64 nt, Homo Sapiens
uuaauucauguuuguugggacugagguuuaggaaguuuguuacugguuaaaaaccucaaaugaa

SEQ ID NO: 254974 - RNA, 64 nt, Homo Sapiens
gauaagugccuuuuuggagauguaacuuuuagcaguuuguuaaccugacaucucugccagucua

SEQ ID NO: 254975 - RNA, 64 nt, Homo Sapiens
acccuaaugucuucauaaaguacuugaguguaauguuuguuaccuccaacagaacuaaauguuc

SEQ ID NO: 254976 - RNA, 64 nt, Homo Sapiens
ccagagagugucuucgaggguaucaucauuuccgguuuguuaaucuuauucaccaaauguucua

SEQ ID NO: 254977 - RNA, 64 nt, Homo Sapiens
ccaauuuugacuuggccaggggacaccuugguguguuuguuaucuuuaucuguggguaggcuag

SEQ ID NO: 254978 - RNA, 64 nt, Homo Sapiens
ugaggaacaaauagaccauuuccauacuaaaccaguuuguuaacuuuagauuuuuuccaauagu

SEQ ID NO: 254979 - RNA, 64 nt, Homo Sapiens
auugccccauuuagauuccuugauauuuugccugguuuguuaaaaccuuauauucagguauaug

SEQ ID NO: 254980 - RNA, 64 nt, Homo Sapiens
caggugguugaggggacaugucagaaacccuacuguuuguuagaaccaccaccacccucaucac

SEQ ID NO: 254981 - RNA, 64 nt, Homo Sapiens
cgugaguuauccaaguauuuacauauauaguuuaguuuguuagaugcuuuccuauggaaaaaau

SEQ ID NO: 254982 - RNA, 64 nt, Homo Sapiens
uagugugcuuuuugucccuuagcuaauaacguugguuuguuaugauacuguaugcaguacugca

SEQ ID NO: 254983 - RNA, 64 nt, Homo Sapiens
aagaaaaucuggaugccuguugaccaugggauguguuuguuaugggaaaacuggguaguucauc

SEQ ID NO: 254984 - RNA, 64 nt, Homo Sapiens
gauaauggccuccagccccacuguuccuauguuaguuuguuaagaacauggaauauuugguuuc

SEQ ID NO: 254985 - RNA, 64 nt, Homo Sapiens
cagauuauuuagugacccagcucgugacaaggggguuuguuauagggguacaugugcagguaaa

SEQ ID NO: 254986 - RNA, 64 nt, Homo Sapiens
aauaaaucccauggaauauuuuguuuauguaaauguuuguuaaaaccuguuuuuuuuucauuua

SEQ ID NO: 254987 - RNA, 64 nt, Homo Sapiens
uauguauacaugugccauauugcacaaugugcagguuuguuacauuuaaguuuuaggguacaug

SEQ ID NO: 254988 - RNA, 64 nt, Homo Sapiens
guuguucugaccauauugaaaauuaaagaauuuuguuuguuauugaagaaaauucugucucaaa

SEQ ID NO: 254989 - RNA, 64 nt, Homo Sapiens
agccaaacacugccugucuuuauagggcuuuucuguuuguuacaauuagcgcugcuucguuuug

SEQ ID NO: 254990 - RNA, 64 nt, Homo Sapiens
gcuuaaugacacuagcuaauauauuagcuuuacuguuuguuauguucuguuucuugagaagaga

SEQ ID NO: 254991 - RNA, 64 nt, Homo Sapiens
accuauauuuuuaaacuggucaugaaagaauucaguuuguuaguaauguauuacuuuguucucc

SEQ ID NO: 254992 - RNA, 64 nt, Homo Sapiens
aaguaauaucugaaaugaauaaacuuaaaucacaguuuguuauuaaaauagaagaaaugaacaa

SEQ ID NO: 254993 - RNA, 64 nt, Homo Sapiens
ugcugaaaucaauguaacuccucuacauuacaaaguuuguuacccacauucuggaaacauaaca

SEQ ID NO: 254994 - RNA, 64 nt, Homo Sapiens
uguaacaauguuaaauuaauuauaaugggauuggguuuguuaucugugguaguauauauccuag

SEQ ID NO: 254995 - RNA, 64 nt, Homo Sapiens
aacuagaaugugugacucuguggggacugcauagguuuguuaauugaccuauagcuaaaccuua

SEQ ID NO: 254996 - RNA, 64 nt, Homo Sapiens
gcugaagcaucuguccagcugguauccugugaaaguuuguuauuuucugaguagacauucuuau

SEQ ID NO: 254997 - RNA, 64 nt, Homo Sapiens
uuuuuuauauucuuaaauuugcucacaaauugugguuuguuacaauuaaacuggauacuuauuu

SEQ ID NO: 254998 - RNA, 64 nt, Homo Sapiens
guuaagcucuuuccuauuguguuuauacaguuuuguuuguuauacucuuugcaccuuaaacccc

SEQ ID NO: 254999 - RNA, 64 nt, Homo Sapiens
uguagagcccccuccugugcccucaguggcugucguuuguuaacaucaucaggaagaugggaaa

SEQ ID NO: 255000 - RNA, 64 nt, Homo Sapiens
ggggggaaaucacaagucacugagguguuuguuuguuuguuaggcagugcuagagcuugaagcc

SEQ ID NO: 255001 - RNA, 64 nt, Homo Sapiens
guaggcaaacuaucaauuuuuuguccauuuuccuguuuguuaaaauaacauaccucuccuacgu

SEQ ID NO: 255002 - RNA, 64 nt, Homo Sapiens
aaacuuacauuuuguuuccaauuuuucauuuuuuguuuguuauuuguuuuuuguagacagcacu

SEQ ID NO: 255003 - RNA, 64 nt, Homo Sapiens
guucauucuuaagcuugcuuuuuuugagacugguguuuguuagacagccacaguccugucuggg

SEQ ID NO: 255004 - RNA, 64 nt, Homo Sapiens
gcaaggaggaggguugagcaaucuagagcauggaguuuguuaagugcucucuggauuugaguug

SEQ ID NO: 255005 - RNA, 64 nt, Homo Sapiens
ucaucuaagaugaaacucauaaaaauuauuuaauguuuguuaugaauuuaaaagcuccagaaau

SEQ ID NO: 255006 - RNA, 64 nt, Homo Sapiens
gguuuuuaaauauucaauauuggucuguguuuaaguuuguuauuugaauguaauuuacauagag

SEQ ID NO: 255007 - RNA, 64 nt, Homo Sapiens
gacucugggaagucugaccaaguuggagcagaugguuuguuacuugaaucuccaaacacuuagu

SEQ ID NO: 255008 - RNA, 64 nt, Homo Sapiens
ccugugucuuacacauuucuagguuaauguaguuguuuguuagauccaugaugguuguugcccg

SEQ ID NO: 255009 - RNA, 64 nt, Homo Sapiens
gcuacaggcuacugagcgucauucauagccacgaguuuguuauuuaugagaacacugcaucugc

SEQ ID NO: 255010 - RNA, 64 nt, Homo Sapiens
cuagagcugagguuggaggacucugaacacugcaguuuguuagaaaucacgggcauuuuaucuu

SEQ ID NO: 255011 - RNA, 64 nt, Homo Sapiens
cuauuguauguuacaaaagaaaagaaaaaaaagaguuuguuacugccccuuauuuaaaaaaaaa

SEQ ID NO: 255012 - RNA, 64 nt, Homo Sapiens
aaguucugucuugucaugggaauaaauugguacuguuuguuacaaagcaaaaacccacggccaa

SEQ ID NO: 255013 - RNA, 64 nt, Homo Sapiens
aaaaugugcacaccugacuuucacauugauauauguuuguuaguuucuggagaaggcccugaaa

SEQ ID NO: 255014 - RNA, 64 nt, Homo Sapiens
caauauuauaucaccaacccaauuugguacugcaguuuguuaugguguuaauuucaaauaugca

SEQ ID NO: 255015 - RNA, 64 nt, Homo Sapiens
guugggauucucugcacuuuuuuguggaaccauuguuuguuaauucuaaguuguaauuuugauu

SEQ ID NO: 255016 - RNA, 64 nt, Homo Sapiens
uuaaaaaucaguuuugaugaauuuugcuaaccuaguuuguuacuuuccuucugaaaauauuuac

SEQ ID NO: 255017 - RNA, 64 nt, Homo Sapiens
aaaaaccucuauuuagauuuuuauuuuccuuuuuguuuguuagcaucguguccuugcugucuuu

SEQ ID NO: 255018 - RNA, 64 nt, Homo Sapiens
ccuuaaacaacauucacugucuuugcugaccacuguuuguuaggaagcuuaaaaguaauguaug

SEQ ID NO: 255019 - RNA, 64 nt, Homo Sapiens
aaaacaaacacauguuuugaaaauuaacuugcauguuuguuaaaagaaagauguuuggcaugcc

SEQ ID NO: 255020 - RNA, 64 nt, Homo Sapiens
uguaaacccugugacuauagucaacacugcaauuguuuguuagaaguucauagacgagauuugu

SEQ ID NO: 255021 - RNA, 64 nt, Homo Sapiens
cuuccaaauguucuuccuggggucuuugauauuuguuuguuacauccugcugaaguucgacugu

SEQ ID NO: 255022 - RNA, 64 nt, Homo Sapiens
ggcuuauugaaugucuaaaaaauaaguuuaaaguguuuguuacccuaaguuuuuuacauuuuua

SEQ ID NO: 255023 - RNA, 64 nt, Homo Sapiens
uaauguuuaagaaauuuaccuuaaaucuuguucuguuuguuaguaugaaaaguuaacuuuuuuu

SEQ ID NO: 255024 - RNA, 64 nt, Homo Sapiens
uuuggaacuguucuagagcauaccaugaaaagcaguuuguuauuaugcaggaaaaucaguuuca

SEQ ID NO: 255025 - RNA, 64 nt, Homo Sapiens
acuuuuuucugccacugcucccuagcccuguuuaguuuguuauugcugcuuuucuuuuuucuuu

SEQ ID NO: 255026 - RNA, 64 nt, Homo Sapiens
uacuuuuucaugaaaauggaguuaucaguuaucuguuuguuacugcaucaucuguuuguaauca

SEQ ID NO: 255027 - RNA, 64 nt, Homo Sapiens
cacucacuuacgacaucacuuccauugugugcauguuuguuauagaggagguuuuaggcuacaa

SEQ ID NO: 255028 - RNA, 64 nt, Homo Sapiens
agucagaauaguuauucucuaagaggaaacuaguguuuguuaaaaacaaaaauaaaaacaaaac

SEQ ID NO: 255029 - RNA, 64 nt, Homo Sapiens
ugaaaauacauaccacauuuguuauaaagcauuuguuuguuaguaucaaucacauagguagaaa

SEQ ID NO: 255030 - RNA, 64 nt, Homo Sapiens
uuaugcuuugaaaaauaauuauggggaaauacauguuuguuauuaaauuuauuauuaaagauag

SEQ ID NO: 255031 - RNA, 64 nt, Homo Sapiens
gugucgaucuguuauuuuuauauaauaaauagguguuuguuauuuauuucaggcuuguauuuaa

SEQ ID NO: 255032 - RNA, 64 nt, Homo Sapiens
cucaaaacugugaagugacaguagaccuaaggguguuuguuagucuggcuuuuuuugguuuggg

SEQ ID NO: 255033 - RNA, 64 nt, Homo Sapiens
ugauuaaacuguaugucuuaauauaagcuguuuaguuuguuaauaucuguaauauauugccagu

SEQ ID NO: 255034 - RNA, 64 nt, Homo Sapiens
uuuauuuucggggagaggauaugguuacuaauauguuuguuauaauuacaguguuuguuuagcu

SEQ ID NO: 255035 - RNA, 64 nt, Homo Sapiens
guauuuuuuauaaacagcuuaaaguagaagauaaguuuguuaaaucaagugacuguccccguaa

SEQ ID NO: 255036 - RNA, 64 nt, Homo Sapiens
cugauuauauucaucugcuauuguggccaaaccaguuuguuaauagaaauguuuuuucuuuucc

SEQ ID NO: 255037 - RNA, 64 nt, Homo Sapiens
auauuaaagugugauuauuauuaauguauuguauguuuguuauuaucaaaguaguguucuaacu

SEQ ID NO: 255038 - RNA, 64 nt, Homo Sapiens
ccuaguacgacuucauuccuuccacuaacucauaguuuguuauauccuagacuagacaugcgaa

SEQ ID NO: 255039 - RNA, 64 nt, Homo Sapiens
ucagccuuagaaaagcccucaauguaaaccuuauguuuguuacuaggguggccucucucccauu

SEQ ID NO: 255040 - RNA, 64 nt, Homo Sapiens
gaguuaauaugcuuuucugaugaauuacacaacaguuuguuaauucuucauucuuguaguauuu

SEQ ID NO: 255041 - RNA, 64 nt, Homo Sapiens
ccucagccucaccuuacgaauccaaagaacugggguuuguuagguucuuucucuaauguagagg

SEQ ID NO: 255042 - RNA, 64 nt, Homo Sapiens
ugguuagaacucuuacagccuuauuuauuuuuaaguuuguuacagccaaaggguuggagugugc

SEQ ID NO: 255043 - RNA, 64 nt, Homo Sapiens
uaacauuuuugccaaaagaugacugggguuuuccguuuguuaauauuaagcacaucagaacgug

SEQ ID NO: 255044 - RNA, 64 nt, Homo Sapiens
gagacgaaugccauuggaaccuguuaaaugaguaguuuguuaugugucuggaagaagcagcguu

SEQ ID NO: 255045 - RNA, 64 nt, Homo Sapiens
ggaggggcggggggagggagggauuucuuaucccguuuguuacauuuugaggauaauaaaggug

SEQ ID NO: 255046 - RNA, 64 nt, Homo Sapiens
ucuuaguuacugauuucauuuucaauaaauguagguuuguuacaugaguuucccaauaaaaaaa

SEQ ID NO: 255047 - RNA, 64 nt, Homo Sapiens
aauagauauauaagaaaaaauucuuucacuugauguuuguuagaccagaaaguguguguguucu

SEQ ID NO: 255048 - RNA, 64 nt, Homo Sapiens
gccuguuccauaggaaggcucuccugcaaauuuaguuuguuaaaucuuucuguuuuguuuuuuu

SEQ ID NO: 255049 - RNA, 64 nt, Homo Sapiens
uaacuuguggaaagcaggaaaauacagaugccuuguuuguuaacgaaugauuuuuaggguaaau

SEQ ID NO: 255050 - RNA, 64 nt, Homo Sapiens
uauucgaaugcauguagauugaacacuuguauguguuuguuaaauccauaacauccauaugacu

SEQ ID NO: 255051 - RNA, 64 nt, Homo Sapiens
gauuuagcuauuuauuguucuuggcuguuaagaaguuuguuauaaagugacuuuaaacuuuccc

SEQ ID NO: 255052 - RNA, 64 nt, Homo Sapiens
guguagguaauauuuucaauuacuauauauuguuguuuguuauuagagugcuucaguaaaaagc

SEQ ID NO: 255053 - RNA, 64 nt, Homo Sapiens
agaaaugauuuuuuagauauccucaaaaacuuguguuuguuauuauuucaaaucaguuuuuuuu

SEQ ID NO: 255054 - RNA, 64 nt, Homo Sapiens
agaaauaauuuuuuuagguacccccaagacuuguguuuguuaauugguccuccccaccacccca

SEQ ID NO: 255055 - RNA, 64 nt, Homo Sapiens
aacuuaauuuuuugaaaguacacuguuuucuuauguuuguuacauggucaacuucaacucaaaa

SEQ ID NO: 255056 - RNA, 64 nt, Homo Sapiens
ucuaguuucauuuaauaaccaaacauuuuggcauguuuguuaauugugucuacuauuaaaagug

SEQ ID NO: 255057 - RNA, 64 nt, Homo Sapiens
auggcugcugccuucuggacccugggccaaccacguuuguuaucugccagggggcaggucuggg

SEQ ID NO: 255058 - RNA, 64 nt, Homo Sapiens
auuaguuuuagcuguagaucaagcuauuugggguguuuguuaguaaauagggaaaauaaucuca

SEQ ID NO: 255059 - RNA, 64 nt, Homo Sapiens
cucccccuuccccugguccccugucccuggggcuguuuguuaaaaaagaguaauaaaaggauuu

SEQ ID NO: 255060 - RNA, 64 nt, Homo Sapiens
ggggcuuguuccccugcaguaucuguucugugaaguuuguuaaauguaaggaaagcuuaaauuc

SEQ ID NO: 255061 - RNA, 64 nt, Homo Sapiens
aggguugcaguuugguuaggaguggaaauauuuuguuuguuaaugaugucuucaguucugguac

SEQ ID NO: 255062 - RNA, 64 nt, Homo Sapiens
gccauuuuuucucagacaccuggccguaaaaucaguuuguuacagcauucuucucuaggcugcu

SEQ ID NO: 255063 - RNA, 64 nt, Homo Sapiens
uacacuggguaaaucaccuauacuuagaguaacaguuuguuaucaaaaugccugauaaaauaua

SEQ ID NO: 255064 - RNA, 64 nt, Homo Sapiens
gucaucaguaucauuagugaaaaagaaacaaauuguuuguuaucaucucuuuagacagauaagc

SEQ ID NO: 255065 - RNA, 64 nt, Homo Sapiens
aaaauuguaauaccuagguaguugguugaucacaguuuguuaauuguauaaaaaaaaauuaccu

SEQ ID NO: 255066 - RNA, 64 nt, Homo Sapiens
ucaacuuuauuuuguauuuccuuccauuuggaagguuuguuagaccauuaagguuauauuaaag

SEQ ID NO: 255067 - RNA, 64 nt, Homo Sapiens
aagcuuuagaggaggaaugagaacacgagugacaguuuguuaaaaagacauuuguuuguuuuua

SEQ ID NO: 255068 - RNA, 64 nt, Homo Sapiens
aacugauaaauugugccaagggauauuuaugguaguuuguuaagaaaauucauuuuccccuuau

SEQ ID NO: 255069 - RNA, 64 nt, Homo Sapiens
uuucauggaaaauuuuagggagcuacagcuccuuguuuguuaguuugcuaaucuuauuuuaauu

SEQ ID NO: 255070 - RNA, 64 nt, Homo Sapiens
uagguaaacuugugucauggggguacaugugcagguuuguuacaaacuuuuauuuuaaguucaa

SEQ ID NO: 255071 - RNA, 64 nt, Homo Sapiens
gucuaugugauucuggaagcguguuuaauguaaaguuuguuauaccccaacucaggacagaaca

SEQ ID NO: 255072 - RNA, 64 nt, Homo Sapiens
agaugucugcuuuuccaugaguaaaugucacucuguuuguuagggagaagcccucuuuauuuug

SEQ ID NO: 255073 - RNA, 64 nt, Homo Sapiens
ucaucuggaaccuacaccaaaugauccaagacuaguuuguuaucucuagaaaucagaugcccag

SEQ ID NO: 255074 - RNA, 64 nt, Homo Sapiens
ugcauccaguuuaccacacuuuacgaccucccauguuuguuacaugccauauccuggaaacaua

SEQ ID NO: 255075 - RNA, 64 nt, Homo Sapiens
uaaaaauaccccggccaggcgauguuuacuaggcguuuguuauaucaucuguguauuuucuaua

SEQ ID NO: 255076 - RNA, 64 nt, Homo Sapiens
uauccuagugggccauuaaaauuaucucaauuuaguuuguuauugaacucauagauuauuaucu

SEQ ID NO: 255077 - RNA, 64 nt, Homo Sapiens
uaaauauauuuauagaaguuaugugaauagcuauguuuguuauuuuauaugucacuugugugcu

SEQ ID NO: 255078 - RNA, 64 nt, Homo Sapiens
ugcuugucagguuuggauagaauauaauugauugguuuguuacuuggacuaacaaggcaguaga

SEQ ID NO: 255079 - RNA, 64 nt, Homo Sapiens
aguuuuaaaugcaaaauagccuuauuuucauuuaguuuguuagcacuauagugagcuuuucaaa

SEQ ID NO: 255080 - RNA, 64 nt, Homo Sapiens
gcauuauucauauguguaucuauaucugcauaauguuuguuaaugucuacuaaaauugcuacuu

SEQ ID NO: 255081 - RNA, 64 nt, Homo Sapiens
ucccugcucagggacccuggccguguguccccagguuuguuaccugcagcggcccaucacccug

SEQ ID NO: 255082 - RNA, 64 nt, Homo Sapiens
auaauauuuuugcugacuacccaguugaagaaaaguuuguuaauuggaugggauuuuuuuuuuu

SEQ ID NO: 255083 - RNA, 64 nt, Homo Sapiens
gaaauuuuuuuuuuagcucuugcuuuaaguguuuguuuguuaucucaguccagaaccaauauua

SEQ ID NO: 255084 - RNA, 64 nt, Homo Sapiens
ucugauggcccggcugaauaaaauggaaauucuaguuuguuagaauuaugcauucuuuuucaag

SEQ ID NO: 255085 - RNA, 64 nt, Homo Sapiens
cauguauuucaaucuuagugagccaaaauuguuuguuuguuacuacagaauagagaugacuguu

SEQ ID NO: 255086 - RNA, 64 nt, Homo Sapiens
aauuaaaaucuccguucuuuuaauuuaauuuguuguuuguuaaaugaaagaguuuaagggcuaa

SEQ ID NO: 255087 - RNA, 64 nt, Homo Sapiens
ugaguaaaccucuauauucaaggaugacaguucuguuuguuagacaauuuucagacauuuugaa

SEQ ID NO: 255088 - RNA, 64 nt, Homo Sapiens
acaauguauaauuguguuuuaauuaacuguacagguuuguuauccuuguuuuguauuauucaga

SEQ ID NO: 255089 - RNA, 64 nt, Homo Sapiens
aaccaaauauuuuuaaaaauaagauaucuuaccuguuuguuauuugcuguccaaguuuuauacu

SEQ ID NO: 255090 - RNA, 64 nt, Homo Sapiens
acucauauugauuaaaacagauccaauuagggauguuuguuacuuucccugcuuccucucuaga

SEQ ID NO: 255091 - RNA, 64 nt, Homo Sapiens
uugacuuauaaauacaauuuuuuuuuaaaaagugguuuguuacuauuuugacaauguggaguuu

SEQ ID NO: 255092 - RNA, 64 nt, Homo Sapiens
ucugugaagacucaacggauguguguguuuguauguuuguuaacaguuacauauguuuguauga

SEQ ID NO: 255093 - RNA, 64 nt, Homo Sapiens
ugguguccuauuuucuuguuuauacguucauucuguuuguuauugcuacuauguaaaacuuuca

SEQ ID NO: 255094 - RNA, 64 nt, Homo Sapiens
gggacugcguccauguacuaguauaacagcuuggguuuguuagaauuugggcaacauuuugauu

SEQ ID NO: 255095 - RNA, 64 nt, Homo Sapiens
cacuuuaaauggaauaauuauaacaggaaguuuaguuuguuauggguggaucaaaaaugccacu

SEQ ID NO: 255096 - RNA, 64 nt, Homo Sapiens
uacgguucugagaggaggggccauggaaaggagaguuuguuacuauuggaugaggaggggacug

SEQ ID NO: 255097 - RNA, 64 nt, Homo Sapiens
uuagagcaaguuugcccauauuccuuucuuccucguuuguuacucacuucuaaaugguuccugg

SEQ ID NO: 255098 - RNA, 64 nt, Homo Sapiens
aagaaaaaaaugaauaaugccuguacaaagaauuguuuguuaacucaugauuaguaccaaacca

SEQ ID NO: 255099 - RNA, 64 nt, Homo Sapiens
uauuuuauuuaauuuaaaagaaauauuuuaacaaguuuguuauaagacaaacguuuaauuugcu

SEQ ID NO: 255100 - RNA, 64 nt, Homo Sapiens
uacaccauaauuucagaucaggaagauaauaaauguuuguuagaugaauuaagaguccaguuuc

SEQ ID NO: 255101 - RNA, 64 nt, Homo Sapiens
agaaaaagcauccauuuucucagggcauagccuaguuuguuauacaauagaaaacaguaaaaaa

SEQ ID NO: 255102 - RNA, 64 nt, Homo Sapiens
auuuugacagauuaagguguguuaacaugauucuguuuguuaauuccaaaccacuaugcuuaau

SEQ ID NO: 255103 - RNA, 64 nt, Homo Sapiens
gggccaugcauugguaacuuauguuuuauacgauguuuguuauauaguuuccaugaaggugugu

SEQ ID NO: 255104 - RNA, 64 nt, Homo Sapiens
ugguauucuaucucuuuuucuuuuuaaugcacugguuuguuauucuuaauacugacauacugga

SEQ ID NO: 255105 - RNA, 64 nt, Homo Sapiens
acacccuucaguugcaauauagacuggaauuuuuguuuguuagacuaccauagaauuauuaucc

SEQ ID NO: 255106 - RNA, 64 nt, Homo Sapiens
agggagaagauuauggaggcugaacggacugcacguuuguuacagggcuuguuuuuacagcuug

SEQ ID NO: 255107 - RNA, 64 nt, Homo Sapiens
cuuggaguaacaggcuuauuccacuuuccaugggguuuguuaauauuuugcauugacucauacu

SEQ ID NO: 255108 - RNA, 64 nt, Homo Sapiens
uuucaauuagaaaccuuuacuauuuccaauguauguuuguuaaaaauaauaauaauaaaaccaa

SEQ ID NO: 255109 - RNA, 64 nt, Homo Sapiens
uauauaugugacagauacaaauucucugugaucaguuuguuauuuuuuuucuccuuaaggcaca

SEQ ID NO: 255110 - RNA, 64 nt, Homo Sapiens
uuggagaccuuaaugcuaaguguagauuauugagguuuguuagugaggaaaagaauaagaguuc

SEQ ID NO: 255111 - RNA, 64 nt, Homo Sapiens
accccgguaaguaauuaacagagaauaaaaauguguuuguuaaaugacaaagcagcaguuuuuc

SEQ ID NO: 255112 - RNA, 64 nt, Homo Sapiens
auguucauuacuaaaacaaacagcaaaacuauugguuuguuauucuguguuuuccucaagucag

SEQ ID NO: 255113 - RNA, 64 nt, Homo Sapiens
aaaaauguaaaaaacaaaaaaaacaacaaaaaaaguuuguuacuuugaauaguccuaaaaagaa

SEQ ID NO: 255114 - RNA, 64 nt, Homo Sapiens
ggcagaauuggauagauacauaggauguuuggguguuuguuacacugucuuauaauugauauuu

SEQ ID NO: 255115 - RNA, 64 nt, Homo Sapiens
aguugcuguacuuuguauauguauuaaaacugggguuuguuaccugguacaucguauauaaaau

SEQ ID NO: 255116 - RNA, 64 nt, Homo Sapiens
cgugccacaauauagcauauuaugugguguaaagguuuguuauauuuucuuuagcaaaccaggu

SEQ ID NO: 255117 - RNA, 64 nt, Homo Sapiens
cugguaaaugccacacguuaucacccaaugagauguuuguuacuugcuccacaugggaccugug

SEQ ID NO: 255118 - RNA, 64 nt, Homo Sapiens
gagucauuuuuaaugaaagaaccgagcuuugacuguuuguuaaauuuguaugauugaaacuugc

SEQ ID NO: 255119 - RNA, 64 nt, Homo Sapiens
ucuauacucacucugucaugaaagcguugggcauguuuguuauuaacguucuagcaacuguaua

SEQ ID NO: 255120 - RNA, 64 nt, Homo Sapiens
uacacuggucuaauguuuguugacaccaauaaauguuuguuauugaaguuuuuucuaccauaag

SEQ ID NO: 255121 - RNA, 64 nt, Homo Sapiens
cggcacucauuuugcggaggcgggcauuggggccguuuguuaaggaaaggcccagccggacugc

SEQ ID NO: 255122 - RNA, 64 nt, Homo Sapiens
uaaaaaaaaaaacaaaacaaaaaaagguuacaaaguuuguuaacuugcuauccuguggucuugu

SEQ ID NO: 255123 - RNA, 64 nt, Homo Sapiens
cuauccuguggucuuguugccugaaauuguuauuguuuguuauuucucucugauguuuuuugua

SEQ ID NO: 255124 - RNA, 64 nt, Homo Sapiens
aguacucugcaguggacauaagcauugggccauaguuuguuaaucucaacuaacgccuacauua

SEQ ID NO: 255125 - RNA, 64 nt, Homo Sapiens
uaagcauuuuugugagugaccaccuuugcaauauguuuguuaauuuacuucauguuggguucuu

SEQ ID NO: 255126 - RNA, 64 nt, Homo Sapiens
cccgcaugucuuauucuugcccuucccccaaccaguuuguuaaucaaacaauaaaaacauguuu

SEQ ID NO: 255127 - RNA, 64 nt, Homo Sapiens
ccuaugcaauauuuuuuacuuuucuaauaaacauguuuguuaaaacaguugguugagucucuca

SEQ ID NO: 255128 - RNA, 64 nt, Homo Sapiens
ucugccucuuccacauaauguccuuugcuuucauguuuguuaucuucuuuuucuguucacucag

SEQ ID NO: 255129 - RNA, 64 nt, Homo Sapiens
uaucacaaauauauaugcuuccagacaaagaaaaguuuguuaguccugauuuucuaaucguagc

SEQ ID NO: 255130 - RNA, 64 nt, Homo Sapiens
uuacaugguuacacagugaguuaauucagugaaaguuuguuaggcagagcugaaaguguaacug

SEQ ID NO: 255131 - RNA, 64 nt, Homo Sapiens
aaguggcuagaacaucaauucaaaacauccaacuguuuguuauaugcuaaauacuguaauguuu

SEQ ID NO: 255132 - RNA, 64 nt, Homo Sapiens
aaaaaaaugaaaaaaaaaguaaauuuacaugcauguuuguuacauuaaugucugauugaaacac

SEQ ID NO: 255133 - RNA, 64 nt, Homo Sapiens
aucaaauuugacuuccuagcuaccacuuaagagaguuuguuauacuugcuuccuucuuaaccuc

SEQ ID NO: 255134 - RNA, 64 nt, Homo Sapiens
caaauuaauccacaguuucuggaauacaaugaauguuuguuaaaccagggccuggcauuuggua

SEQ ID NO: 255135 - RNA, 64 nt, Homo Sapiens
gagaagcugcuucaaaucacuuccuacugucaugguuuguuauaugaugcaagacaagucaucc

SEQ ID NO: 255136 - RNA, 64 nt, Homo Sapiens
uggguauguuuaaucuguuauguacuaguguucuguuuguuauuguuuuguuaauuacaccaua

SEQ ID NO: 255137 - RNA, 64 nt, Homo Sapiens
auauggagaauguuauggaagaaauaguuuauaaguuuguuaaguacuuauaacaugguuuauc

SEQ ID NO: 255138 - RNA, 64 nt, Homo Sapiens
aaaaaauacaacugagaagggugaagagaaguauguuuguuaaacaguaaaaaugaauaguaua

SEQ ID NO: 255139 - RNA, 64 nt, Homo Sapiens
ugagaaagcauguuuaaaaauuacaaaaauacguguuuguuauugcccccuuugccuuuaaaac

SEQ ID NO: 255140 - RNA, 64 nt, Homo Sapiens
auguauguuuuuuuccaaugugucuaaauucacuguuuguuacuaaacaauuuaugcgaaccua

SEQ ID NO: 255141 - RNA, 64 nt, Homo Sapiens
ucuuauuuuagaaauuauaaaauacuuaaauuugguuuguuaauuguuucaaucucugacuaaa

SEQ ID NO: 255142 - RNA, 64 nt, Homo Sapiens
auugcuguaaaguauuauauucuuaaugugaauaguuuguuaaucccuuagauacuccuguaau

SEQ ID NO: 255143 - RNA, 64 nt, Homo Sapiens
gaacuguggacucgcuuuccguggaugguauuguguuuguuagugucuuuguggcuacuuguuu

SEQ ID NO: 255144 - RNA, 64 nt, Homo Sapiens
aaucagaaauggguccaugauuuauugggaaugaguuuguuauagguggacugcagccuucauc

SEQ ID NO: 255145 - RNA, 64 nt, Homo Sapiens
guaggauuccauuugaugauucuggauuuuugcuguuuguuauugcccuuagaggggcucugag

SEQ ID NO: 255146 - RNA, 64 nt, Homo Sapiens
caaauauuuauuguuucagagacuguacuauuuuguuuguuagaagauuuauaaggcaguaucu

SEQ ID NO: 255147 - RNA, 64 nt, Homo Sapiens
uugggagaucuggugaucucccaagcuaucuaaaguuuguuagauagcugcauguggcuuuuuu

SEQ ID NO: 255148 - RNA, 64 nt, Homo Sapiens
gaaugagcuuuuuaaggaagaaauauuauauauuguuuguuaaaguuuauugaaauaaagaauc

SEQ ID NO: 255149 - RNA, 64 nt, Homo Sapiens
ucuguguuauuagugaggaaacuuuaaaacucauguuuguuauuacuuacuacccaauuucauu

SEQ ID NO: 255150 - RNA, 64 nt, Homo Sapiens
guuccccuaaacuugcccuguuuuuguuuuuuuaguuuguuauccccuuacugagcggccucua

SEQ ID NO: 255151 - RNA, 64 nt, Homo Sapiens
ugccaggacccacacagcuucgauggaucucaguguuuguuaacaaaauacaaagaucucaaac

SEQ ID NO: 255152 - RNA, 64 nt, Homo Sapiens
uuugccauucugccguagcuagauguucugugggguuuguuaacauggaacuacucagcuuucu

SEQ ID NO: 255153 - RNA, 64 nt, Homo Sapiens
uucguccccagcguccguccuguaacgugcuucuguuuguuaugguagaacagcccuguguuaa

SEQ ID NO: 255154 - RNA, 64 nt, Homo Sapiens
auuuuuaggaaaauucugaagccagcuaucacagguuuguuagcuaauaauaguauuuucuuuu

SEQ ID NO: 255155 - RNA, 64 nt, Homo Sapiens
gauugagcaguagcauuugccuuuuggguuuuuuguuuguuauuauagaagagaugacuucugc

SEQ ID NO: 255156 - RNA, 64 nt, Homo Sapiens
auaauuuuaaagauucuuuaucugcaucauugcuguuuguuacuauaaauuaaaugaaccucau

SEQ ID NO: 255157 - RNA, 64 nt, Homo Sapiens
gucaguucuaaugaaauuuuguaaaagauggcaaguuuguuaccucacuugagugggguuuucc

SEQ ID NO: 255158 - RNA, 64 nt, Homo Sapiens
gcauuuuucugucagauuuguaguaauuugugagguuuguuagagauuaauauagguuuucuuu

SEQ ID NO: 255159 - RNA, 64 nt, Homo Sapiens
agaguuuucucuguauucucagaagauguuaauaguuuguuacuagccagagaguaugacuaug

SEQ ID NO: 255160 - RNA, 64 nt, Homo Sapiens
gcuguuagucggguuagaguuggcucuacgcgagguuuguuaauaaaaguuuguuaaaaguuug

SEQ ID NO: 255161 - RNA, 64 nt, Homo Sapiens
uagaguuggcucuacgcgagguuuguuaauaaaaguuuguuaaaaguuuguuuugugcaagugu

SEQ ID NO: 255162 - RNA, 64 nt, Homo Sapiens
cagcccaugguaaacacaggcuucaccuguucuuguuuguuagccuugacugugaggcaggacu

SEQ ID NO: 255163 - RNA, 64 nt, Homo Sapiens
gaaggaggaggacuggcugccuccauuuugccuuguuuguuaguuugccugggucugucugagg

SEQ ID NO: 255164 - RNA, 64 nt, Homo Sapiens
gcagucacaucacaauauucaguggugaaaucuuguuuguuacugucauucccauuccuuuucg

SEQ ID NO: 255165 - RNA, 64 nt, Homo Sapiens
uagguauauauaugccaugaugccgaaugugcagguuuguuacauuuaaguuucaggauacaug

SEQ ID NO: 255166 - RNA, 64 nt, Homo Sapiens
acguuuaauuagaagguggagacagguaaauucuguuuguuacuccccuuuuaucugauucuga

SEQ ID NO: 255167 - RNA, 64 nt, Homo Sapiens
uaucucauuagagaacugcuaaaaauaaaauaucguuuguuauuaacugcauguuuuauaaaau

SEQ ID NO: 255168 - RNA, 64 nt, Homo Sapiens
uuuuuaaaaauugcucuuaaucagauauuuagauguuuguuacacagcauuucagauuuuauug

SEQ ID NO: 255169 - RNA, 64 nt, Homo Sapiens
auuuuuaaaggacgcucuagauucuagguagcuuguuuguuauuuuuaaaaagacauuaaguga

SEQ ID NO: 255170 - RNA, 64 nt, Homo Sapiens
gagccuucucuuguguguuacuaucagaaaagguguuuguuaaauuaaggaaucccuaacccua

SEQ ID NO: 255171 - RNA, 64 nt, Homo Sapiens
auaugcuugacuagaguuucacauuuuuuuaaaaguuuguuaaaucuuauucuuagcuguauau

SEQ ID NO: 255172 - RNA, 64 nt, Homo Sapiens
ugaaagagucuggccaaaacggugcuauuuuguaguuuguuauaacucuguuuuuuaguauaau

SEQ ID NO: 255173 - RNA, 64 nt, Homo Sapiens
caccuaggaucauauugcaucauguguuucugcaguuuguuacauauaaucuaacccaaacuag

SEQ ID NO: 255174 - RNA, 64 nt, Homo Sapiens
uaauguggccucugucaguuaaaaaaaaaaaaagguuuguuaaucgcuguuuuuaucuccaaua

SEQ ID NO: 255175 - RNA, 64 nt, Homo Sapiens
guuuauacuauuuuuggauucugguuuagagaggguuuguuaaggggggagaugugaauaugac

SEQ ID NO: 255176 - RNA, 64 nt, Homo Sapiens
acuuuuucuguauuuguugcucuggggcuucuccguuuguuaauguauuguuacuguacgugua

SEQ ID NO: 255177 - RNA, 64 nt, Homo Sapiens
gaacaguacgacaguguauuguaaauucccuuuaguuuguuacaguagccaauugaaaauguau

SEQ ID NO: 255178 - RNA, 64 nt, Homo Sapiens
ccaggaaacacauuucuguggccuuagccaagcaguuuguuaguuacauauucccucgcaaacc

SEQ ID NO: 255179 - RNA, 64 nt, Homo Sapiens
caccacaggaauguaucacaacuuaaccguucccguuuguuagacuaguuucuuauuaauguug

SEQ ID NO: 255180 - RNA, 64 nt, Homo Sapiens
uggcaagccucccauugccuuucugcaucaauguguuuguuaccaaauagcagaaauuucgcuu

SEQ ID NO: 255181 - RNA, 64 nt, Homo Sapiens
acuuauuuguaguuguuaguugcccugcuaccuaguuuguuagugcauuugagcacacauuuua

SEQ ID NO: 255182 - RNA, 64 nt, Homo Sapiens
agacaauuuucauaacuugauaaauuauaguuuuguuuguuagaaaaguugcucuuaaaagaug

SEQ ID NO: 255183 - RNA, 64 nt, Homo Sapiens
gucuaaaagagcucgcuggcaagcugccucuugaguuuguuauaaaagcgaacuguucacaaaa

SEQ ID NO: 255184 - RNA, 64 nt, Homo Sapiens
aguuuuuuguaguuguuaccgcucuuuuggguugguuuguuaauuuauacaaagagauuaccac

SEQ ID NO: 255185 - RNA, 64 nt, Homo Sapiens
ucugagccauggugucgagugaagaguaguucuuguuuguuacaaccuuugugagucagccaug

SEQ ID NO: 255186 - RNA, 64 nt, Homo Sapiens
uaagagucuauguaugucucaccaaagcuuagcaguuuguuagaauugaacugcacuuuauaua

SEQ ID NO: 255187 - RNA, 64 nt, Homo Sapiens
aaauggaauggucucuuugauuuguaacuuaccuguuuguuagggaaaaguaaaauggacuacu

SEQ ID NO: 255188 - RNA, 64 nt, Homo Sapiens
ugaacauuuucaauuauauggcuuaugaauaauuguuuguuaauuuuuuaguuaauauaccaaa

SEQ ID NO: 255189 - RNA, 64 nt, Homo Sapiens
guugaagauuaacuuuuccuuuuguaaaaaauuaguuuguuauauacagcuaaaagggacuaaa

SEQ ID NO: 255190 - RNA, 64 nt, Homo Sapiens
auaguuggucaaugccuggcauugcuguuuaacuguuuguuaucaaagggauaaaucucuaauu

SEQ ID NO: 255191 - RNA, 64 nt, Homo Sapiens
uggauuaaauaguuuuaaaagcauagagucaccuguuuguuaugcagccauugcucugcuccug

SEQ ID NO: 255192 - RNA, 64 nt, Homo Sapiens
uuuaaguacauuuuaauaauaagugugugauacaguuuguuacugaaagaacacuucuaagccu

SEQ ID NO: 255193 - RNA, 64 nt, Homo Sapiens
cacagugaaaauguauuauauuucuucaaagggaguuuguuauagauggauuaucugggguaau

SEQ ID NO: 255194 - RNA, 64 nt, Homo Sapiens
auccuuuaaucauaacuaaacucucguagagaugguuuguuaccguacaagauacucuuuggau

SEQ ID NO: 255195 - RNA, 64 nt, Homo Sapiens
acgauagcuauauucaaaaugugaucauaaugagguuuguuaaaaggugacugaaauugcauca

SEQ ID NO: 255196 - RNA, 64 nt, Homo Sapiens
gauugcuucacugguuuaauaauuuaaaaguuauguuuguuaaacacccugucagaacagucau

SEQ ID NO: 255197 - RNA, 64 nt, Homo Sapiens
uuuuaauggaaucuuuguuuuuguucuccaucuuguuuguuagagucucucggccuuuauuuac

SEQ ID NO: 255198 - RNA, 64 nt, Homo Sapiens
aauucaacuuuuaagauacagaagaaauuuguauguuuguuaaaguugcauuuauugcagcaag

SEQ ID NO: 255199 - RNA, 64 nt, Homo Sapiens
ugcaguaauaaaccauuuguuuuacugcuguuaaguuuguuauuuggguauaaaaccagauguu

SEQ ID NO: 255200 - RNA, 64 nt, Homo Sapiens
uuaacagcugcuggacagacacauuagagcagcuguuuguuauugauaauaaaauauuauaaaa

SEQ ID NO: 255201 - RNA, 64 nt, Homo Sapiens
uucuuuuucaugggcgggucggggucaguauccuguuuguuauuguuaaauuuguaugaaccuu

SEQ ID NO: 255202 - RNA, 64 nt, Homo Sapiens
cucgaugugauacaguauaaauaugcuaugguuuguuuguuaugaacagauagccaccaguuac

SEQ ID NO: 255203 - RNA, 64 nt, Homo Sapiens
uagagaaacauuuuugcaugaguucuuacaaacuguuuguuauauuuucuggaaugauaaguga

SEQ ID NO: 255204 - RNA, 64 nt, Homo Sapiens
cagccggcgaugcccaauaaauguguguuuugcuguuuguuaagugauuucagcaacaagugug

SEQ ID NO: 255205 - RNA, 64 nt, Homo Sapiens
cauucauaugccuacccaucguucaaauaaguugguuuguuagaugugugugugaaaaagcugg

SEQ ID NO: 255206 - RNA, 64 nt, Homo Sapiens
ugcugcuuaauaaaguaagcuaacuuuaaaagcuguuuguuauauccacggccauaacaauauu

SEQ ID NO: 255207 - RNA, 64 nt, Homo Sapiens
uucaaauacccauccaacaaugcagauaucaagaguuuguuauugauguuuuccacuugauugc

SEQ ID NO: 255208 - RNA, 64 nt, Homo Sapiens
uuucuuuucuuuuuucuuuuuauguuuuuaaaauguuuguuauauuguuaacugaacucuuaau

SEQ ID NO: 255209 - RNA, 64 nt, Homo Sapiens
agagguugugcacuguuuaccaccaaaucguagcguuuguuaccgcaaagggugucugcgucgu

SEQ ID NO: 255210 - RNA, 64 nt, Homo Sapiens
uaccauaaugcuaaauaaaaauugagacagaacuguuuguuauguuuaauuaauuuuuuucaua

SEQ ID NO: 255211 - RNA, 64 nt, Homo Sapiens
augaggcauuuguuugaacugaguugauacuacaguuuguuagucaaguauuauaccuuuuuua

SEQ ID NO: 255212 - RNA, 64 nt, Homo Sapiens
agcauuuaaacuguuucauuguuuuggauaacacguuuguuacauagcaucaucauauugugcu

SEQ ID NO: 255213 - RNA, 64 nt, Homo Sapiens
aauagaaauaaacgacaaaacccucaacacaagaguuuguuauauugcugccguccaucaagag

SEQ ID NO: 255214 - RNA, 64 nt, Homo Sapiens
cauugccacuaguuccaucuagaacuccuuucuaguuuguuauuuuuaaaauguuuauacauaa

SEQ ID NO: 255215 - RNA, 64 nt, Homo Sapiens
aggccugugggaaugggauuuguuacaaaucuagguuuguuacuggcuucagaaagcuaauuaa

SEQ ID NO: 255216 - RNA, 64 nt, Homo Sapiens
gaucaaaguauuauaugcugugugcuuuuuagguguuuguuaguacugugaaggcaaaaaugcu

SEQ ID NO: 255217 - RNA, 64 nt, Homo Sapiens
uuggacugugaagcaucugccauggggaagugcuguuuguuauccuuucucuguggcagugaag

SEQ ID NO: 255218 - RNA, 64 nt, Homo Sapiens
aacguggcgucugauaacagugagggggggugggguuuguuaugucuuuauugaguauuuaagu

SEQ ID NO: 255219 - RNA, 64 nt, Homo Sapiens
cagaaaauaacagaauagccuucuguaaugaggcguuuguuagaguuuugcaugagauucuaau

SEQ ID NO: 255220 - RNA, 64 nt, Homo Sapiens
aacuugugaaaacaagguuguuuuugucuuuaucguuuguuagaguuauagauuuaugauuuca

SEQ ID NO: 255221 - RNA, 64 nt, Homo Sapiens
ggcggaaucccgaggguggugaugcaaacgcgggguuuguuaggucuagggacagaggcaucug

SEQ ID NO: 255222 - RNA, 64 nt, Homo Sapiens
cuauucauaacauuguagaggcuuucugaaagcaguuuguuauaaauucuuuuccuuucauuuu

SEQ ID NO: 255223 - RNA, 64 nt, Homo Sapiens
aagaacuggucagaccuugcacacacacauguauguuuguuaccgcauugcuguauacacacag

SEQ ID NO: 255224 - RNA, 64 nt, Homo Sapiens
acaggcagccaacaucacucccuggcgaaaaacaguuuguuaacuacaggcaugagccacugua

SEQ ID NO: 255225 - RNA, 64 nt, Homo Sapiens
gucuguucuacaugggccugguuuccagcugcagguuuguuagagcugguuuaaaagggaucca

SEQ ID NO: 255226 - RNA, 64 nt, Homo Sapiens
ccccccuccucaauguaguggccuuggauauccuguuuguuaauaaagacaauucaaccagcuc

SEQ ID NO: 255227 - RNA, 64 nt, Homo Sapiens
ucugugagucuggcucaagaccgacauugccuugguuuguuacaugacuaucgugauggggaaa

SEQ ID NO: 255228 - RNA, 64 nt, Homo Sapiens
augggcuuucuguuuaugaggggugagaagugauguuuguuacuauguucuccagcaaguaaac

SEQ ID NO: 255229 - RNA, 64 nt, Homo Sapiens
gucuaauaacaaaaaauguaaaccuaauuuggcaguuuguuagguuagacaacugacagccuca

SEQ ID NO: 255230 - RNA, 64 nt, Homo Sapiens
gcuuaaauuaguaugugccccuaaaauauucuauguuuguuaugagauucaaauaaaaaaauuu

SEQ ID NO: 255231 - RNA, 64 nt, Homo Sapiens
gcacaucccuguaaggcccauaagagaaagaggaguuuguuacauuuaaucaacacugugaagu

SEQ ID NO: 255232 - RNA, 64 nt, Homo Sapiens
uagcauagugcuuugcacauaguagucacucaguguuuguuaaauaaagcuauuagugucauua

SEQ ID NO: 255233 - RNA, 64 nt, Homo Sapiens
guucagcagcaaacuugcaacagacuggccuucuguuuguuacuuucaaaaggcccacaugaua

SEQ ID NO: 255234 - RNA, 64 nt, Homo Sapiens
uuguuucucuacuaagaacucuuucuuaaaugugguuuguuacuguagcacuuuuuacacugaa

SEQ ID NO: 255235 - RNA, 64 nt, Homo Sapiens
cugguuguaauuaauuuuuuguuguuugaucuguguuuguuauaagguagcacaaucuacuaau

SEQ ID NO: 255236 - RNA, 64 nt, Homo Sapiens
uugagagauaaacaaugacacaggcuucagcuugguuuguuaaagacaagguuguagcugugcu

SEQ ID NO: 255237 - RNA, 64 nt, Homo Sapiens
cauguucacuucccccaggaccucucgugauucuguuuguuacccuguugcugcucuguauuug

SEQ ID NO: 255238 - RNA, 64 nt, Homo Sapiens
ucaaauuagcuggucucugauucuguggaauucuguuuguuaaauugccucagcugaucagagu

SEQ ID NO: 255239 - RNA, 64 nt, Homo Sapiens
auguccauguaaacaugccccuuuuaauguauauguuuguuauagaaggcaacacauuccuaca

SEQ ID NO: 255240 - RNA, 64 nt, Homo Sapiens
cugguuguaauuaauuuuuuguuguuugaucuguguuuguuauaagguagcucaaucuacuaau

SEQ ID NO: 255241 - RNA, 64 nt, Homo Sapiens
cugauugggagaguuccaugugggaaucgaaacaguuuguuaaucuguguccuccagguuuaua

SEQ ID NO: 255242 - RNA, 64 nt, Homo Sapiens
aggcuacacgagcucucuagaaaaaaaaaaaaaaguuuguuaaauuguuucuaugugcaaaaaa

SEQ ID NO: 255243 - RNA, 64 nt, Homo Sapiens
gguuuccuaaacuauaaaagcagauuuugcuuuuguuuguuaaucauaggcauggccgagcauu

SEQ ID NO: 255244 - RNA, 64 nt, Homo Sapiens
uuuuauuuuaucucaaguauguccaguguguucgguuuguuacauauuccaugaaauaucugag

SEQ ID NO: 255245 - RNA, 64 nt, Homo Sapiens
uagcagauuagcaccauaacuaacuuaaaacuaaguuuguuaccugcuuuuuauacugucacaa

SEQ ID NO: 255246 - RNA, 64 nt, Homo Sapiens
cuuaaaauuaccagacaaaaaaauuuaaaauuacguuuguuauuccuaguggaugacuguugau

SEQ ID NO: 255247 - RNA, 64 nt, Homo Sapiens
aauaggacaaaaaaguugugguuuggggaggucuguuuguuacauaaaaaggaccuuucggugu

SEQ ID NO: 255248 - RNA, 64 nt, Homo Sapiens
uaagauuaugaaaccacaugagaagugauaaaauguuuguuaaagcuagauagagguuaagaau

SEQ ID NO: 255249 - RNA, 64 nt, Homo Sapiens
uuuauaucacuguuuuucacuagauuuauauuugguuuguuaaucuggaaaugcagaauggcgu

SEQ ID NO: 255250 - RNA, 64 nt, Homo Sapiens
aacugguaaauuuugcaacuauaaagacauucauguuuguuaaaacuguaaauggcugucuaaa

SEQ ID NO: 255251 - RNA, 64 nt, Homo Sapiens
ucucuuuuauaugcauguaugaaaucaagguuuuguuuguuaauuauaacuuccauguucucua

SEQ ID NO: 255252 - RNA, 64 nt, Homo Sapiens
accagagaugccugaacucaauucaucauauuuuguuuguuaucuuacgaucguuauuccccca

SEQ ID NO: 255253 - RNA, 64 nt, Homo Sapiens
guuuuuguuuuuguauuuuuuuucuuuugaaaggguuuguuaauuuuucuaauuuuaccaaagu

SEQ ID NO: 255254 - RNA, 64 nt, Homo Sapiens
auuuagccguguuugggacuccgugucuucaaugguuuguuaguugccauuacaacuuugucug

SEQ ID NO: 255255 - RNA, 64 nt, Homo Sapiens
agugcugggauuacaggcccgguccaguuugauaguuuguuaucauguuauacguacacuuaga

SEQ ID NO: 255256 - RNA, 64 nt, Homo Sapiens
uuuagcagagaauuuguaauuuaagaaauuuucuguuuguuacggaacaugugggaaucccuuu

SEQ ID NO: 255257 - RNA, 64 nt, Homo Sapiens
uuucaacucuugcaccuggaguucugcugguuaaguuuguuaaacuuaguugaaacugggaacc

SEQ ID NO: 255258 - RNA, 64 nt, Homo Sapiens
gaaauaaagagcuaucaugcugugguuuauuaugguuuguuacauugauaggauacauacugaa

SEQ ID NO: 255259 - RNA, 64 nt, Homo Sapiens
uagcccgcucguaucuaugguuucgcuuuccacaguuuguuaccugcagucaacugcaguucaa

SEQ ID NO: 255260 - RNA, 64 nt, Homo Sapiens
ucccuuccuccagauccgucugguuuuuuacaccguuuguuaauaaagccugaaaccgcugugu

SEQ ID NO: 255261 - RNA, 64 nt, Homo Sapiens
aaaaauaagaaauagcuacaaaggaugucuaaauguuuguuaauauaauguacguacuaccuaa

SEQ ID NO: 255262 - RNA, 64 nt, Homo Sapiens
ucuuuucuauucuacuguuauccucagucagccaguuuguuauguauuaauauguuaggauuua

SEQ ID NO: 255263 - RNA, 64 nt, Homo Sapiens
uccaguugcauuuuggcugaaauaaacugaauguguuuguuaguugcuguuauucuauucugca

SEQ ID NO: 255264 - RNA, 64 nt, Homo Sapiens
aggauuuacauuaacugcugaaccagaaucccauguuuguuacuauaagaaguuuaaucaaagu

SEQ ID NO: 255265 - RNA, 64 nt, Homo Sapiens
uauuuacgauuucguuuguuuggauucaagcuuaguuuguuaauauguauaauuuagcaucuau

SEQ ID NO: 255266 - RNA, 64 nt, Homo Sapiens
ccauuuuaagaaaacccgacaacauuucugccagguuuguuaggaggccacaugauacuuauuc

SEQ ID NO: 255267 - RNA, 64 nt, Homo Sapiens
aggcugacucuuacuaaccaccauuuccccugugguuuguuaucaguacaauucuuuguugcuu

SEQ ID NO: 255268 - RNA, 64 nt, Homo Sapiens
uaauacauuauugacucuaugaauguuuucugaaguuuguuagucauuuguaaaacuaaaucag

SEQ ID NO: 255269 - RNA, 64 nt, Homo Sapiens
aggcuuugggugaauucuggauggcuugccucauguuuguuagccagcacuucugcucugucgu

SEQ ID NO: 255270 - RNA, 64 nt, Homo Sapiens
acucaugguaccuuggccaaguuggaaggaagcaguuuguuaaugaggcacaguaauccuggcu

SEQ ID NO: 255271 - RNA, 64 nt, Homo Sapiens
gaauauuuacaauaaagaguauuuacaauaaagaguuuguuauuauuuguaaauugugugcaac

SEQ ID NO: 255272 - RNA, 64 nt, Homo Sapiens
acagacugggaaccccuccuggccugggggaagaguuuguuaccuaccuuacuauuuaaagagc

SEQ ID NO: 255273 - RNA, 64 nt, Homo Sapiens
gggaggggaccgggaagcgcuggggcuuguuucuguuuguuacuuacaggacugagacaucuuc

SEQ ID NO: 255274 - RNA, 64 nt, Homo Sapiens
ggugggagggguggguuuugcauuuuccauuuugguuuguuagauuaacagcugccugaauugu

SEQ ID NO: 255275 - RNA, 64 nt, Homo Sapiens
cuauuuugcauguguuugaggcagcuuuggacuuguuuguuaucgaggacucuucaguggcuga

SEQ ID NO: 255276 - RNA, 64 nt, Homo Sapiens
ucagggaaaaggaguagggagggcuuaggacuugguuuguuauucccuccuugcccagacuaca

SEQ ID NO: 255277 - RNA, 64 nt, Homo Sapiens
ucccucacuucaccuccauacuuaucccauaaagguuuguuacuuuauugugacuuguaaguuu

SEQ ID NO: 255278 - RNA, 64 nt, Homo Sapiens
uagguaagccugugccauggugcaggaccugcagguuuguuacauuuacguuccgggauacaug

SEQ ID NO: 255279 - RNA, 64 nt, Homo Sapiens
auuaggguuguaaggugucgugucauuguuuccuguuuguuaauauuauugaaaaauuaaaaaa

SEQ ID NO: 255280 - RNA, 64 nt, Homo Sapiens
gguauuuuuuucacgugccuaaacuaaaugugagguuuguuacuauucuccugcauuuuuacau

SEQ ID NO: 255281 - RNA, 64 nt, Homo Sapiens
gugcacaucccuacgugcccagagcucccgcaguguuuguuagaccagugccaccuuauggcaa

SEQ ID NO: 255282 - RNA, 64 nt, Homo Sapiens
guccagcaguguuagcagggguggcaguccuuguguuuguuauaccaauaaaugcuuuagcugc

SEQ ID NO: 255283 - RNA, 64 nt, Homo Sapiens
guauaccucaacccaaaaauaaagguuuguuuugguuuguuauggcuuccuuuuuuaaaaaauu

SEQ ID NO: 255284 - RNA, 64 nt, Homo Sapiens
ucaauuuuguacaauuagguaucugacuuuacaaguuuguuauccuuucuaauuuuuacugaac

SEQ ID NO: 255285 - RNA, 64 nt, Homo Sapiens
uugacuauguucuucaaauuaagcuuauacaagaguuuguuacgaguuuucagauaaaccagaa

SEQ ID NO: 255286 - RNA, 64 nt, Homo Sapiens
uacuaaaugccacugaauuuguauacuucagaauguuuguuauguaaauuuuaccucaacuaaa

SEQ ID NO: 255287 - RNA, 63 nt, Homo Sapiens
cauggaucuccguguacacuaucaauaaaaguggguuuguuacaaagccguguccuugcccau

SEQ ID NO: 255288 - RNA, 64 nt, Homo Sapiens
uuuuuggugggaggcugugaaaaaucucuguacuguuuguuaggugcugggccucccugacugu

SEQ ID NO: 255289 - RNA, 64 nt, Homo Sapiens
guuaaaaugucaaauaccaauaaagcacuggcaaguuuguuacucucuggaagcuggcagugug

SEQ ID NO: 255290 - RNA, 64 nt, Homo Sapiens
uugauugaaauggcaggauucuaaagagagccugguuuguuaaaagaaaacacugucaugcugu

SEQ ID NO: 255291 - RNA, 64 nt, Homo Sapiens
acugcauuuauaauuuugugacugaggaucauuuguuuguuaauguacugugccuuuaacuuua

SEQ ID NO: 255292 - RNA, 64 nt, Homo Sapiens
cugaaguaagauuuugccuguaugguacuguuuuguuuguuaauaaagugcacugccaccccca

SEQ ID NO: 255293 - RNA, 64 nt, Homo Sapiens
auccuuguuccuguuacaauauuuagcauuauuaguuuguuauguguguauguuuauguuaauu

SEQ ID NO: 255294 - RNA, 64 nt, Homo Sapiens
ugugucuacgauucaaagugaaaacauuuggcauguuuguuaauucuagcuuuuugguuuaaua

SEQ ID NO: 255295 - RNA, 64 nt, Homo Sapiens
agucucccuuucacuguuuucuuauucuguaauuguuuguuauauuucccaaaaacgucuugau

SEQ ID NO: 255296 - RNA, 64 nt, Homo Sapiens
gguagaguauugagaccuuuuuuauuagggugcuguuuguuauugagagcccaaucucugcaug

SEQ ID NO: 255297 - RNA, 64 nt, Homo Sapiens
cuuauuuguuuccugauagguuauguuuguaauuguuuguuaagcacagccuguuucuuggaag

SEQ ID NO: 255298 - RNA, 64 nt, Homo Sapiens
ugccagaccacguuucuaugucuauuauuagucuguuuguuaaaguauaaauuaguauaucucu

SEQ ID NO: 255299 - RNA, 64 nt, Homo Sapiens
uguguucuuaagcauaauuucuuugcagcuuuagguuuguuagacaccuacauuaacauuaugu

SEQ ID NO: 255300 - RNA, 64 nt, Homo Sapiens
ccagcccagucugucugcggguuguuuaguuuugguuuguuacguuuuucauuggguuuuuauu

SEQ ID NO: 255301 - RNA, 64 nt, Homo Sapiens
acagaaaauaaaacugcgcuucugguucuuaaauguuuguuacuugggagggccucauguuuua

SEQ ID NO: 255302 - RNA, 64 nt, Homo Sapiens
gaaaugaucccagagaccuaaccaagggccuaauguuuguuacagagagagagcuauguuucua

SEQ ID NO: 255303 - RNA, 64 nt, Homo Sapiens
acugcauuuauaauuuugugacugaggaucguuuguuuguuaacguacugugacuuuaacuuua

SEQ ID NO: 255304 - RNA, 64 nt, Homo Sapiens
aguagccuuaaaaaggcuuuuguuuauuucuuugguuuguuaacuagugucaucuauuuagaga

SEQ ID NO: 255305 - RNA, 65 nt, Homo Sapiens
uggcgggucagcuggugguucuuagguuuccuucuguuuguuaaaagggacaauguggccacuuc

SEQ ID NO: 255306 - RNA, 65 nt, Homo Sapiens
augguugauaauagucaguaaccuaauaaaggaacguuuguuaaaauaucaaaccauuuuugaau

SEQ ID NO: 255307 - RNA, 65 nt, Homo Sapiens
cuuuccucuccuccuucccaagucauuugaaaaguguuuguuauuuaaauuccaauaaugcccaa

SEQ ID NO: 255308 - RNA, 65 nt, Homo Sapiens
aacguuucugaacagggucugugcuauguguaaagguuuguuaacuguaaaguaauauaaaguua

SEQ ID NO: 255309 - RNA, 58 nt, Homo Sapiens; identical to SEQ ID NO: 254543

SEQ ID NO: 255310 - RNA, 65 nt, Homo Sapiens
gaaacugaugggcaccugauacucugucuaaauacguuuguuauauguguuuugcccugugccau

SEQ ID NO: 255311 - RNA, 65 nt, Homo Sapiens
uccccaccacccuuuuuuuucauuuccccuguuuuguuuguuaguuuggcguuagggguggaggu

SEQ ID NO: 255312 - RNA, 65 nt, Homo Sapiens
aguuuucaaaagugcccauuuuaugcugcugugugguuuguuaaaucuaaaugauuuuuaaacuu

SEQ ID NO: 255313 - RNA, 65 nt, Homo Sapiens
agaaauauuucuccuuuuguuuuucuuuuuuuuuuguuuguuacugccacuucuuuuuaggagca

SEQ ID NO: 255314 - RNA, 65 nt, Homo Sapiens
cauagaucucuuucucucuuuuguuuuguuuguuuguuuguuaaaguucauuauuuauuuuaccu

SEQ ID NO: 255315 - RNA, 64 nt, Homo Sapiens; identical to SEQ ID NO: 254932

SEQ ID NO: 255316 - RNA, 65 nt, Homo Sapiens
cacaugcauggucaugacacccagaauucaugaugguuuguuauaacaaccucugcauauuccag

SEQ ID NO: 255317 - RNA, 65 nt, Homo Sapiens
uuuaaaaaaggcauuugaaugaauguuugacucagguuuguuaaauuaaccuucaguaacugcag

SEQ ID NO: 255318 - RNA, 65 nt, Homo Sapiens
augucauaauuguugacguucuucaguauaaucauguuuguuaaauuguuuguaccuugcaaacu

SEQ ID NO: 255319 - RNA, 65 nt, Homo Sapiens
uguguuacuauugagauucucucaauugcuccuguguuuguuauaaaguaguguuuaaaaggcag

SEQ ID NO: 255320 - RNA, 65 nt, Homo Sapiens
uuugggucauuauuacuuuuauuuugcagcauuugguuuguuauuaguguaagagcaaguauagg

SEQ ID NO: 255321 - RNA, 65 nt, Homo Sapiens
uuccuuuuaggcuugaauaugaugcugaacaguaaguuuguuaaaucuuggaacuuaaaacaauc

SEQ ID NO: 255322 - RNA, 65 nt, Homo Sapiens
aauugcagcaccucuaucucgcagguaauggaguaguuuguuauugguagucuacuccaggccag

SEQ ID NO: 255323 - RNA, 65 nt, Homo Sapiens
cugcagcuuauucuugccaugcuuaggugacagaaguuuguuaaguaccauccuugugcccugcc

SEQ ID NO: 255324 - RNA, 65 nt, Homo Sapiens
gcguuuaaauuguuaaaaugcugauuuucuuauuaguuuguuaauugccuguuacuaguacuuga

SEQ ID NO: 255325 - RNA, 65 nt, Homo Sapiens
ggaucauggaguacugcucucauaauugaagacguguuuguuauuggcagagaaccuuaaaaaag

SEQ ID NO: 255326 - RNA, 65 nt, Homo Sapiens
gacgccuuccucucuggauacugcaaaggcuugugguuuguuagaggguauuuguggaaacuguc

SEQ ID NO: 255327 - RNA, 65 nt, Homo Sapiens
gguacuaguucagacacuuuggaaguuuguguucuguuuguuaaaacuggcaucugacacaaaaa

SEQ ID NO: 255328 - RNA, 65 nt, Homo Sapiens
cauuauaauuuauaaauacagcauacuucaaaacuguuuguuaucucuuguuaccauguauguau

SEQ ID NO: 255329 - RNA, 65 nt, Homo Sapiens
uucuucauuuugagaaaacuguacauuaguuuaauguuuguuacuguauuucuuuugaguugagg

SEQ ID NO: 255330 - RNA, 65 nt, Homo Sapiens
aggaaaucaguugagcugaauuuaaguuguuuuuuguuuguuagcagguguggaugugggguuau

SEQ ID NO: 255331 - RNA, 65 nt, Homo Sapiens
cuuuuucuguggcaccuuggaauacacugacuaauguuuguuaaaccagauuguguuaccauuug

SEQ ID NO: 255332 - RNA, 65 nt, Homo Sapiens
ccuuuuuccuuucuuuggguaagcacuauauucuuguuuguuaguugaaagauuuguaaauggua

SEQ ID NO: 255333 - RNA, 65 nt, Homo Sapiens
ugggccuauguaguagccucccgaggagaagaggaguuuguuaacccacuuguaucauggccuac

SEQ ID NO: 255334 - RNA, 65 nt, Homo Sapiens
uuuuccaacuaccacuguaaagacaaauacccaguguuuguuacuaguugguuuauguuaaugau

SEQ ID NO: 255335 - RNA, 65 nt, Homo Sapiens
aauaaacuagagauuuuuaacaagcaucaagugguguuuguuagauguaaauaaagccugugagu

SEQ ID NO: 255336 - RNA, 65 nt, Homo Sapiens
agcagcgugggauauaaucaauccaaucugguacaguuuguuaaacugaaagugcugauggcugg

SEQ ID NO: 255337 - RNA, 65 nt, Homo Sapiens
uagguaaacugcaugucauggggguauaugugcagguuuguuacauaacuuuuauuuuagauuca

SEQ ID NO: 255338 - RNA, 65 nt, Homo Sapiens
acauauuuauuagagugaugucugguaagcauuauguuuguuaauugguaaauguuuuuagaucu

SEQ ID NO: 255339 - RNA, 65 nt, Homo Sapiens
agaaaagagaugagaugagauugaacacaucggguguuuguuaucgacuuaaauaugaaagcaaa

SEQ ID NO: 255340 - RNA, 65 nt, Homo Sapiens
uuucuugucaacaguauugaugguuauuacaugaaguuuguuauacuuaggaagauucaaaaucu

SEQ ID NO: 255341 - RNA, 65 nt, Homo Sapiens
uauuaauaugcaugcuucuuaauguuaaaagauaaguuuguuauauaucgaaauacaguuauuaa

SEQ ID NO: 255342 - RNA, 65 nt, Homo Sapiens
auguauaaaagucuuuuucuucauucuuaccugcaguuuguuacuccuggaaaaugaguaauguc

SEQ ID NO: 255343 - RNA, 65 nt, Homo Sapiens
uugaagaugcuggucuugacgggaaaacaauuacaguuuguuaauuaugaaaaaaauguaucuuu

SEQ ID NO: 255344 - RNA, 65 nt, Homo Sapiens
auuuuuuaaaaauguuuuaagggaauaccugggaaguuuguuaaaguucccaaaucuggcugguc

SEQ ID NO: 255345 - RNA, 65 nt, Homo Sapiens
uuuuuuugcucugcagugcuggauggauaaaaaugguuuguuaugguucagcucugguccacaga

SEQ ID NO: 255346 - RNA, 65 nt, Homo Sapiens
aaauggaugcagaauaaugcagauagugaucccauguuuguuaauugccaucauggaagucagag

SEQ ID NO: 255347 - RNA, 65 nt, Homo Sapiens
cccguaauuuuaggacuccuauaaaauucuuccuuguuuguuaaugcuauuaaaacucagauuca

SEQ ID NO: 255348 - RNA, 65 nt, Homo Sapiens
caacucuguuuuauccuagaacuaagagagcauugguuuguuaaagagcuuucaauguauauuaa

SEQ ID NO: 255349 - RNA, 65 nt, Homo Sapiens
ugugcgugggacgaagacaucuuugaaggucaugaguuuguuaguuuaacaucauauauuuguaa

SEQ ID NO: 255350 - RNA, 65 nt, Homo Sapiens
uccgucucaaaaguaaauaaaaauaaucaccuggaguuuguuaaaccauauggauucucaagcuc

SEQ ID NO: 255351 - RNA, 65 nt, Homo Sapiens
ucucaucccuggagcacucugccgcucaagagcugguuuguuaauuauuguuagacuuugccauu

SEQ ID NO: 255352 - RNA, 65 nt, Homo Sapiens
acaucuugaaguaaauugaucccaccaggucccacguuuguuaucucugccuaaauguuagcuuc

SEQ ID NO: 255353 - RNA, 65 nt, Homo Sapiens
cucaccuacccucaaaguagguauacaaaagacuaguuuguuauuaauccacaaauaugcuaaau

SEQ ID NO: 255354 - RNA, 65 nt, Homo Sapiens
uacuuuaaaauuuaacccacaagcauauuaaaucuguuuguuauaagauuggaaacaauuuuuga

SEQ ID NO: 255355 - RNA, 65 nt, Homo Sapiens
cagugaggcaucacuuuguuugcauaaaguauacgguuuguuaaggccuuuguucuugugagaug

SEQ ID NO: 255356 - RNA, 65 nt, Homo Sapiens
uuuaauucauguuuguugggacugagguuuaggaaguuuguuacugguuaaaaaccucaaaugaa

SEQ ID NO: 255357 - RNA, 65 nt, Homo Sapiens
ugauaagugccuuuuuggagauguaacuuuuagcaguuuguuaaccugacaucucugccagucua

SEQ ID NO: 255358 - RNA, 65 nt, Homo Sapiens
uacccuaaugucuucauaaaguacuugaguguaauguuuguuaccuccaacagaacuaaauguuc

SEQ ID NO: 255359 - RNA, 65 nt, Homo Sapiens
uccagagagugucuucgaggguaucaucauuuccgguuuguuaaucuuauucaccaaauguucua

SEQ ID NO: 255360 - RNA, 65 nt, Homo Sapiens
cccaauuuugacuuggccaggggacaccuugguguguuuguuaucuuuaucuguggguaggcuag

SEQ ID NO: 255361 - RNA, 65 nt, Homo Sapiens
cugaggaacaaauagaccauuuccauacuaaaccaguuuguuaacuuuagauuuuuuccaauagu

SEQ ID NO: 255362 - RNA, 65 nt, Homo Sapiens
auugccccauuuagauuccugugauauuuugccugguuuguuaaauaccuuauauucagguauau

SEQ ID NO: 255363 - RNA, 65 nt, Homo Sapiens
caggugguugaggggacaugcucagaaacccuacuguuuguuagauaccaccaccacccucauca

SEQ ID NO: 255364 - RNA, 65 nt, Homo Sapiens
cgugaguuauccaaguauuuuacauauauaguuuaguuuguuagagugcuuuccuauggaaaaaa

SEQ ID NO: 255365 - RNA, 65 nt, Homo Sapiens
uagugugcuuuuugucccuuaagcuaauaacguugguuuguuaugcauacuguaugcaguacugc

SEQ ID NO: 255366 - RNA, 65 nt, Homo Sapiens
aagaaaaucuggaugccugucugaccaugggauguguuuguuauguggaaaacuggguaguucau

SEQ ID NO: 255367 - RNA, 65 nt, Homo Sapiens
gauaauggccuccagccccaccuguuccuauguuaguuuguuaaggaacauggaauauuugguuu

SEQ ID NO: 255368 - RNA, 65 nt, Homo Sapiens
cagauuauuuagugacccagacucgugacaaggggguuuguuauaggggguacaugugcagguaa

SEQ ID NO: 255369 - RNA, 65 nt, Homo Sapiens
aauaaaucccauggaauauuauuguuuauguaaauguuuguuaaaaaccuguuuuuuuuucauuu

SEQ ID NO: 255370 - RNA, 65 nt, Homo Sapiens
uauguauacaugugccauaugugcacaaugugcagguuuguuacacuuuaaguuuuaggguacau

SEQ ID NO: 255371 - RNA, 65 nt, Homo Sapiens
guuguucugaccauauugaaaaauuaaagaauuuuguuuguuauuagaagaaaauucugucucaa

SEQ ID NO: 255372 - RNA, 65 nt, Homo Sapiens
agccaaacacugccugucuuguauagggcuuuucuguuuguuacacauuagcgcugcuucguuuu

SEQ ID NO: 255373 - RNA, 65 nt, Homo Sapiens
gcuuaaugacacuagcuaauaauauuagcuuuacuguuuguuaugauucuguuucuugagaagag

SEQ ID NO: 255374 - RNA, 65 nt, Homo Sapiens
accuauauuuuuaaacugguccaugaaagaauucaguuuguuagugaauguauuacuuuguucuc

SEQ ID NO: 255375 - RNA, 65 nt, Homo Sapiens
aaguaauaucugaaaugaauaaaacuuaaaucacaguuuguuauuaaaaauagaagaaaugaaca

SEQ ID NO: 255376 - RNA, 65 nt, Homo Sapiens
ugcugaaaucaauguaacucacucuacauuacaaaguuuguuaccacacauucuggaaacauaac

SEQ ID NO: 255377 - RNA, 65 nt, Homo Sapiens
auguaacaauguuaaauuaauuauaaugggauuggguuuguuaucugugguaguauauauccuag

SEQ ID NO: 255378 - RNA, 65 nt, Homo Sapiens
gaacuagaaugugugacucuguggggacugcauagguuuguuaauugaccuauagcuaaaccuua

SEQ ID NO: 255379 - RNA, 65 nt, Homo Sapiens
ugcugaagcaucuguccagcugguauccugugaaaguuuguuauuuucugaguagacauucuuau

SEQ ID NO: 255380 - RNA, 65 nt, Homo Sapiens
guuuuuuauauucuuaaauuugcucacaaauugugguuuguuacaauuaaacuggauacuuauuu

SEQ ID NO: 255381 - RNA, 65 nt, Homo Sapiens
aguuaagcucuuuccuauuguguuuauacaguuuuguuuguuauacucuuugcaccuuaaacccc

SEQ ID NO: 255382 - RNA, 65 nt, Homo Sapiens
guguagagcccccuccugugcccucaguggcugucguuuguuaacaucaucaggaagaugggaaa

SEQ ID NO: 255383 - RNA, 65 nt, Homo Sapiens
uggggggaaaucacaagucacugagguguuuguuuguuuguuaggcagugcuagagcuugaagcc

SEQ ID NO: 255384 - RNA, 65 nt, Homo Sapiens
uguaggcaaacuaucaauuuuuuguccauuuuccuguuuguuaaaauaacauaccucuccuacgu

SEQ ID NO: 255385 - RNA, 65 nt, Homo Sapiens
uaaacuuacauuuuguuuccaauuuuucauuuuuuguuuguuauuuguuuuuuguagacagcacu

SEQ ID NO: 255386 - RNA, 65 nt, Homo Sapiens
aguucauucuuaagcuugcuuuuuuugagacugguguuuguuagacagccacaguccugucuggg

SEQ ID NO: 255387 - RNA, 65 nt, Homo Sapiens
agcaaggaggaggguugagcaaucuagagcauggaguuuguuaagugcucucuggauuugaguug

SEQ ID NO: 255388 - RNA, 65 nt, Homo Sapiens
cucaucuaagaugaaacucauaaaaauuauuuaauguuuguuaugaauuuaaaagcuccagaaau

SEQ ID NO: 255389 - RNA, 65 nt, Homo Sapiens
ugguuuuuaaauauucaauauuggucuguguuuaaguuuguuauuugaauguaauuuacauagag

SEQ ID NO: 255390 - RNA, 65 nt, Homo Sapiens
ggacucugggaagucugaccaaguuggagcagaugguuuguuacuugaaucuccaaacacuuagu

SEQ ID NO: 255391 - RNA, 65 nt, Homo Sapiens
ccugugucuuacacauuucugagguuaauguaguuguuuguuagacuccaugaugguuguugccc

SEQ ID NO: 255392 - RNA, 65 nt, Homo Sapiens
gcuacaggcuacugagcguccauucauagccacgaguuuguuauucuaugagaacacugcaucug

SEQ ID NO: 255393 - RNA, 65 nt, Homo Sapiens
cuagagcugagguuggaggaucucugaacacugcaguuuguuagacaaucacgggcauuuuaucu

SEQ ID NO: 255394 - RNA, 65 nt, Homo Sapiens
cuauuguauguuacaaaagaaaaagaaaaaaaagaguuuguuacuugccccuuauuuaaaaaaaa

SEQ ID NO: 255395 - RNA, 65 nt, Homo Sapiens
aaguucugucuugucaugggaaauaaauugguacuguuuguuacaaaagcaaaaacccacggcca

SEQ ID NO: 255396 - RNA, 65 nt, Homo Sapiens
aaaaugugcacaccugacuuaucacauugauauauguuuguuagucuucuggagaaggcccugaa

SEQ ID NO: 255397 - RNA, 65 nt, Homo Sapiens
caauauuauaucaccaacccaaauuugguacugcaguuuguuaugaguguuaauuucaaauaugc

SEQ ID NO: 255398 - RNA, 65 nt, Homo Sapiens
guugggauucucugcacuuuuuuuguggaaccauuguuuguuaaugucuaaguuguaauuuugau

SEQ ID NO: 255399 - RNA, 65 nt, Homo Sapiens
uuaaaaaucaguuuugaugacauuuugcuaaccuaguuuguuacuuuuccuucugaaaauauuua

SEQ ID NO: 255400 - RNA, 65 nt, Homo Sapiens
aaaaaccucuauuuagauuuuuuauuuuccuuuuuguuuguuagcaaucguguccuugcugucuu

SEQ ID NO: 255401 - RNA, 65 nt, Homo Sapiens
ccuuaaacaacauucacugugcuuugcugaccacuguuuguuaggaaagcuuaaaaguaauguau

SEQ ID NO: 255402 - RNA, 65 nt, Homo Sapiens
aaaacaaacacauguuuugacaaauuaacuugcauguuuguuaaagagaaagauguuuggcaugc

SEQ ID NO: 255403 - RNA, 65 nt, Homo Sapiens
uguaaacccugugacuauaguucaacacugcaauuguuuguuagaaaguucauagacgagauuug

SEQ ID NO: 255404 - RNA, 65 nt, Homo Sapiens
ucuuccaaauguucuuccuggggucuuugauauuuguuuguuacauccugcugaaguucgacugu

SEQ ID NO: 255405 - RNA, 65 nt, Homo Sapiens
gggcuuauugaaugucuaaaaaauaaguuuaaaguguuuguuacccuaaguuuuuuacauuuuua

SEQ ID NO: 255406 - RNA, 65 nt, Homo Sapiens
auaauguuuaagaaauuuaccuuaaaucuuguucuguuuguuaguaugaaaaguuaacuuuuuuu

SEQ ID NO: 255407 - RNA, 65 nt, Homo Sapiens
uuuuggaacuguucuagagcauaccaugaaaagcaguuuguuauuaugcaggaaaaucaguuuca

SEQ ID NO: 255408 - RNA, 65 nt, Homo Sapiens
aacuuuuuucugccacugcucccuagcccuguuuaguuuguuauugcugcuuuucuuuuuucuuu

SEQ ID NO: 255409 - RNA, 65 nt, Homo Sapiens
auacuuuuucaugaaaauggaguuaucaguuaucuguuuguuacugcaucaucuguuuguaauca

SEQ ID NO: 255410 - RNA, 65 nt, Homo Sapiens
ucacucacuuacgacaucacuuccauugugugcauguuuguuauagaggagguuuuaggcuacaa

SEQ ID NO: 255411 - RNA, 65 nt, Homo Sapiens
cagucagaauaguuauucucuaagaggaaacuaguguuuguuaaaaacaaaaauaaaaacaaaac

SEQ ID NO: 255412 - RNA, 65 nt, Homo Sapiens
uugaaaauacauaccacauuuguuauaaagcauuuguuuguuaguaucaaucacauagguagaaa

SEQ ID NO: 255413 - RNA, 65 nt, Homo Sapiens
auuaugcuuugaaaaauaauuauggggaaauacauguuuguuauuaaauuuauuauuaaagauag

SEQ ID NO: 255414 - RNA, 65 nt, Homo Sapiens
gugucgaucuguuauuuuuaauauaauaaauagguguuuguuauuauauuucaggcuuguauuua

SEQ ID NO: 255415 - RNA, 65 nt, Homo Sapiens
cucaaaacugugaagugacagguagaccuaaggguguuuguuaguccuggcuuuuuuugguuugg

SEQ ID NO: 255416 - RNA, 65 nt, Homo Sapiens
ugauuaaacuguaugucuuauauauaagcuguuuaguuuguuaaucaucuguaauauauugccag

SEQ ID NO: 255417 - RNA, 65 nt, Homo Sapiens
uuuauuuucggggagaggauuaugguuacuaauauguuuguuauauauuacaguguuuguuuagc

SEQ ID NO: 255418 - RNA, 65 nt, Homo Sapiens
guauuuuuuauaaacagcuuaaaaguagaagauaaguuuguuaaaaucaagugacuguccccgua

SEQ ID NO: 255419 - RNA, 65 nt, Homo Sapiens
cugauuauauucaucugcuacuuguggccaaaccaguuuguuaaucagaaauguuuuuucuuuuc

SEQ ID NO: 255420 - RNA, 65 nt, Homo Sapiens
auauuaaagugugauuauuauuuaauguauuguauguuuguuauuuaucaaaguaguguucuaac

SEQ ID NO: 255421 - RNA, 65 nt, Homo Sapiens
accuaguacgacuucauuccuuccacuaacucauaguuuguuauauccuagacuagacaugcgaa

SEQ ID NO: 255422 - RNA, 65 nt, Homo Sapiens
uucagccuuagaaaagcccucaauguaaaccuuauguuuguuacuaggguggccucucucccauu

SEQ ID NO: 255423 - RNA, 65 nt, Homo Sapiens
agaguuaauaugcuuuucugaugaauuacacaacaguuuguuaauucuucauucuuguaguauuu

SEQ ID NO: 255424 - RNA, 65 nt, Homo Sapiens
uccucagccucaccuuacgaauccaaagaacugggguuuguuagguucuuucucuaauguagagg

SEQ ID NO: 255425 - RNA, 65 nt, Homo Sapiens
augguuagaacucuuacagccuuauuuauuuuuaaguuuguuacagccaaaggguuggagugugc

SEQ ID NO: 255426 - RNA, 65 nt, Homo Sapiens
guaacauuuuugccaaaagaugacugggguuuuccguuuguuaauauuaagcacaucagaacgug

SEQ ID NO: 255427 - RNA, 65 nt, Homo Sapiens
ugagacgaaugccauuggaaccuguuaaaugaguaguuuguuaugugucuggaagaagcagcguu

SEQ ID NO: 255428 - RNA, 65 nt, Homo Sapiens
gggaggggcggggggagggagggauuucuuaucccguuuguuacauuuugaggauaauaaaggug

SEQ ID NO: 255429 - RNA, 65 nt, Homo Sapiens
gucuuaguuacugauuucauuuucaauaaauguagguuuguuacaugaguuucccaauaaaaaaa

SEQ ID NO: 255430 - RNA, 65 nt, Homo Sapiens
aaauagauauauaagaaaaaauucuuucacuugauguuuguuagaccagaaaguguguguguucu

SEQ ID NO: 255431 - RNA, 65 nt, Homo Sapiens
gccuguuccauaggaaggcuucuccugcaaauuuaguuuguuaaauucuuucuguuuuguuuuuu

SEQ ID NO: 255432 - RNA, 65 nt, Homo Sapiens
uaacuuguggaaagcaggaauaauacagaugccuuguuuguuaacugaaugauuuuuaggguaaa

SEQ ID NO: 255433 - RNA, 65 nt, Homo Sapiens
uauucgaaugcauguagauuugaacacuuguauguguuuguuaaaauccauaacauccauaugac

SEQ ID NO: 255434 - RNA, 65 nt, Homo Sapiens
gauuuagcuauuuauuguuccuuggcuguuaagaaguuuguuauauaagugacuuuaaacuuucc

SEQ ID NO: 255435 - RNA, 65 nt, Homo Sapiens
guguagguaauauuuucaaucuacuauauauuguuguuuguuauucagagugcuucaguaaaaag

SEQ ID NO: 255436 - RNA, 65 nt, Homo Sapiens
agaaaugauuuuuuagauauuccucaaaaacuuguguuuguuauuuauuucaaaucaguuuuuuu

SEQ ID NO: 255437 - RNA, 65 nt, Homo Sapiens
agaaauaauuuuuuuagguaacccccaagacuuguguuuguuaaucugguccuccccaccacccc

SEQ ID NO: 255438 - RNA, 65 nt, Homo Sapiens
aacuuaauuuuuugaaaguaacacuguuuucuuauguuuguuacauuggucaacuucaacucaaa

SEQ ID NO: 255439 - RNA, 65 nt, Homo Sapiens
ucuaguuucauuuaauaaccgaaacauuuuggcauguuuguuaaucugugucuacuauuaaaagu

SEQ ID NO: 255440 - RNA, 65 nt, Homo Sapiens
auggcugcugccuucuggacgccugggccaaccacguuuguuaucuugccagggggcaggucugg

SEQ ID NO: 255441 - RNA, 65 nt, Homo Sapiens
aauuaguuuuagcuguagaucaagcuauuugggguguuuguuaguaaauagggaaaauaaucuca

SEQ ID NO: 255442 - RNA, 65 nt, Homo Sapiens
ccucccccuuccccugguccccugucccuggggcuguuuguuaaaaaagaguaauaaaaggauuu

SEQ ID NO: 255443 - RNA, 65 nt, Homo Sapiens
uggggcuuguuccccugcaguaucuguucugugaaguuuguuaaauguaaggaaagcuuaaauuc

SEQ ID NO: 255444 - RNA, 65 nt, Homo Sapiens
aaggguugcaguuugguuaggaguggaaauauuuuguuuguuaaugaugucuucaguucugguac

SEQ ID NO: 255445 - RNA, 65 nt, Homo Sapiens
ugccauuuuuucucagacaccuggccguaaaaucaguuuguuacagcauucuucucuaggcugcu

SEQ ID NO: 255446 - RNA, 65 nt, Homo Sapiens
auacacuggguaaaucaccuauacuuagaguaacaguuuguuaucaaaaugccugauaaaauaua

SEQ ID NO: 255447 - RNA, 65 nt, Homo Sapiens
ggucaucaguaucauuagugaaaaagaaacaaauuguuuguuaucaucucuuuagacagauaagc

SEQ ID NO: 255448 - RNA, 65 nt, Homo Sapiens
uaaaauuguaauaccuagguaguugguugaucacaguuuguuaauuguauaaaaaaaaauuaccu

SEQ ID NO: 255449 - RNA, 65 nt, Homo Sapiens
gucaacuuuauuuuguauuuccuuccauuuggaagguuuguuagaccauuaagguuauauuaaag

SEQ ID NO: 255450 - RNA, 65 nt, Homo Sapiens
aagcuuuagaggaggaaugaagaacacgagugacaguuuguuaaaaaagacauuuguuuguuuuu

SEQ ID NO: 255451 - RNA, 65 nt, Homo Sapiens
aacugauaaauugugccaaguggauauuuaugguaguuuguuaaguaaaauucauuuuccccuua

SEQ ID NO: 255452 - RNA, 65 nt, Homo Sapiens
uuucauggaaaauuuuaggguagcuacagcuccuuguuuguuaguuuugcuaaucuuauuuuaau

SEQ ID NO: 255453 - RNA, 65 nt, Homo Sapiens
uagguaaacuugugucauggaggguacaugugcagguuuguuacauaacuuuuauuuuaaguuca

SEQ ID NO: 255454 - RNA, 65 nt, Homo Sapiens
gucuaugugauucuggaagcaguguuuaauguaaaguuuguuauacccccaacucaggacagaac

SEQ ID NO: 255455 - RNA, 65 nt, Homo Sapiens
agaugucugcuuuuccaugagguaaaugucacucuguuuguuaggugagaagcccucuuuauuuu

SEQ ID NO: 255456 - RNA, 65 nt, Homo Sapiens
ucaucuggaaccuacaccaagaugauccaagacuaguuuguuaucuucuagaaaucagaugccca

SEQ ID NO: 255457 - RNA, 65 nt, Homo Sapiens
ugcauccaguuuaccacacuauuacgaccucccauguuuguuacaaugccauauccuggaaacau

SEQ ID NO: 255458 - RNA, 65 nt, Homo Sapiens
uaaaaauaccccggccaggcagauguuuacuaggcguuuguuauacucaucuguguauuuucuau

SEQ ID NO: 255459 - RNA, 65 nt, Homo Sapiens
uauccuagugggccauuaaauauuaucucaauuuaguuuguuauuugaacucauagauuauuauc

SEQ ID NO: 255460 - RNA, 65 nt, Homo Sapiens
uaaauauauuuauagaaguuuaugugaauagcuauguuuguuauuuuuauaugucacuugugugc

SEQ ID NO: 255461 - RNA, 65 nt, Homo Sapiens
uugcuugucagguuuggauagaauauaauugauugguuuguuacuuggacuaacaaggcaguaga

SEQ ID NO: 255462 - RNA, 65 nt, Homo Sapiens
caguuuuaaaugcaaaauagccuuauuuucauuuaguuuguuagcacuauagugagcuuuucaaa

SEQ ID NO: 255463 - RNA, 65 nt, Homo Sapiens
ugcauuauucauauguguaucuauaucugcauaauguuuguuaaugucuacuaaaauugcuacuu

SEQ ID NO: 255464 - RNA, 65 nt, Homo Sapiens
cucccugcucagggacccuggccguguguccccagguuuguuaccugcagcggcccaucacccug

SEQ ID NO: 255465 - RNA, 65 nt, Homo Sapiens
uauaauauuuuugcugacuacccaguugaagaaaaguuuguuaauuggaugggauuuuuuuuuuu

SEQ ID NO: 255466 - RNA, 65 nt, Homo Sapiens
ggaaauuuuuuuuuuagcucuugcuuuaaguguuuguuuguuaucucaguccagaaccaauauua

SEQ ID NO: 255467 - RNA, 65 nt, Homo Sapiens
uucugauggcccggcugaauaaaauggaaauucuaguuuguuagaauuaugcauucuuuuucaag

SEQ ID NO: 255468 - RNA, 65 nt, Homo Sapiens
ccauguauuucaaucuuagugagccaaaauuguuuguuuguuacuacagaauagagaugacuguu

SEQ ID NO: 255469 - RNA, 65 nt, Homo Sapiens
aauuaaaaucuccguucuuuauaauuuaauuuguuguuuguuaaauugaaagaguuuaagggcua

SEQ ID NO: 255470 - RNA, 65 nt, Homo Sapiens
ugaguaaaccucuauauucaaaggaugacaguucuguuuguuagaucaauuuucagacauuuuga

SEQ ID NO: 255471 - RNA, 65 nt, Homo Sapiens
acaauguauaauuguguuuuaaauuaacuguacagguuuguuaucacuuguuuuguauuauucag

SEQ ID NO: 255472 - RNA, 65 nt, Homo Sapiens
aaccaaauauuuuuaaaaauuaagauaucuuaccuguuuguuauuaugcuguccaaguuuuauac

SEQ ID NO: 255473 - RNA, 65 nt, Homo Sapiens
acucauauugauuaaaacagaauccaauuagggauguuuguuacucuucccugcuuccucucuag

SEQ ID NO: 255474 - RNA, 65 nt, Homo Sapiens
uugacuuauaaauacaauuuuuuuuuuaaaaagugguuuguuacuaauuuugacaauguggaguu

SEQ ID NO: 255475 - RNA, 65 nt, Homo Sapiens
uucugugaagacucaacggauguguguguuuguauguuuguuaacaguuacauauguuuguauga

SEQ ID NO: 255476 - RNA, 65 nt, Homo Sapiens
augguguccuauuuucuuguuuauacguucauucuguuuguuauugcuacuauguaaaacuuuca

SEQ ID NO: 255477 - RNA, 65 nt, Homo Sapiens
agggacugcguccauguacuaguauaacagcuuggguuuguuagaauuugggcaacauuuugauu

SEQ ID NO: 255478 - RNA, 65 nt, Homo Sapiens
cacuuuaaauggaauaauuauuaacaggaaguuuaguuuguuaugugguggaucaaaaaugccac

SEQ ID NO: 255479 - RNA, 65 nt, Homo Sapiens
uacgguucugagaggagggggccauggaaaggagaguuuguuacucauuggaugaggaggggacu

SEQ ID NO: 255480 - RNA, 65 nt, Homo Sapiens
uuagagcaaguuugcccauaguuccuuucuuccucguuuguuacuccacuucuaaaugguuccug

SEQ ID NO: 255481 - RNA, 65 nt, Homo Sapiens
aagaaaaaaaugaauaaugcacuguacaaagaauuguuuguuaacuucaugauuaguaccaaacc

SEQ ID NO: 255482 - RNA, 65 nt, Homo Sapiens
uauuuuauuuaauuuaaaaguaaauauuuuaacaaguuuguuauaaagacaaacguuuaauuugc

SEQ ID NO: 255483 - RNA, 65 nt, Homo Sapiens
uacaccauaauuucagaucacggaagauaauaaauguuuguuagaaugaauuaagaguccaguuu

SEQ ID NO: 255484 - RNA, 65 nt, Homo Sapiens
agaaaaagcauccauuuucuacagggcauagccuaguuuguuauagcaauagaaaacaguaaaaa

SEQ ID NO: 255485 - RNA, 65 nt, Homo Sapiens
auuuugacagauuaagguguuguuaacaugauucuguuuguuaauuuccaaaccacuaugcuuaa

SEQ ID NO: 255486 - RNA, 65 nt, Homo Sapiens
gggccaugcauugguaacuuuauguuuuauacgauguuuguuauaauaguuuccaugaaggugug

SEQ ID NO: 255487 - RNA, 65 nt, Homo Sapiens
ugguauucuaucucuuuuucauuuuuaaugcacugguuuguuauuucuuaauacugacauacugg

SEQ ID NO: 255488 - RNA, 65 nt, Homo Sapiens
acacccuucaguugcaauaucagacuggaauuuuuguuuguuagaucuaccauagaauuauuauc

SEQ ID NO: 255489 - RNA, 65 nt, Homo Sapiens
agggagaagauuauggaggcgugaacggacugcacguuuguuacaugggcuuguuuuuacagcuu

SEQ ID NO: 255490 - RNA, 65 nt, Homo Sapiens
acuuggaguaacaggcuuauuccacuuuccaugggguuuguuaauauuuugcauugacucauacu

SEQ ID NO: 255491 - RNA, 65 nt, Homo Sapiens
uuuucaauuagaaaccuuuacuauuuccaauguauguuuguuaaaaauaauaauaauaaaaccaa

SEQ ID NO: 255492 - RNA, 65 nt, Homo Sapiens
uuauauaugugacagauacaaauucucugugaucaguuuguuauuuuuuuucuccuuaaggcaca

SEQ ID NO: 255493 - RNA, 65 nt, Homo Sapiens
auuggagaccuuaaugcuaaguguagauuauugagguuuguuagugaggaaaagaauaagaguuc

SEQ ID NO: 255494 - RNA, 65 nt, Homo Sapiens
aaccccgguaaguaauuaacagagaauaaaaauguguuuguuaaaugacaaagcagcaguuuuuc

SEQ ID NO: 255495 - RNA, 65 nt, Homo Sapiens
cauguucauuacuaaaacaaacagcaaaacuauugguuuguuauucuguguuuuccucaagucag

SEQ ID NO: 255496 - RNA, 65 nt, Homo Sapiens
caaaaauguaaaaaacaaaaaaaacaacaaaaaaaguuuguuacuuugaauaguccuaaaaagaa

SEQ ID NO: 255497 - RNA, 65 nt, Homo Sapiens
ggcagaauuggauagauacauuaggauguuuggguguuuguuacaucugucuuauaauugauauu

SEQ ID NO: 255498 - RNA, 65 nt, Homo Sapiens
aguugcuguacuuuguauauuguauuaaaacugggguuuguuacccugguacaucguauauaaaa

SEQ ID NO: 255499 - RNA, 65 nt, Homo Sapiens
cgugccacaauauagcauauuuaugugguguaaagguuuguuauauuuuucuuuagcaaaccagg

SEQ ID NO: 255500 - RNA, 65 nt, Homo Sapiens
cugguaaaugccacacguuagucacccaaugagauguuuguuacuaugcuccacaugggaccugu

SEQ ID NO: 255501 - RNA, 65 nt, Homo Sapiens
gagucauuuuuaaugaaagacaccgagcuuugacuguuuguuaaauuuuguaugauugaaacuug

SEQ ID NO: 255502 - RNA, 65 nt, Homo Sapiens
ucuauacucacucugucaugaaaagcguugggcauguuuguuauuaaacguucuagcaacuguau

SEQ ID NO: 255503 - RNA, 65 nt, Homo Sapiens
uacacuggucuaauguuugugugacaccaauaaauguuuguuauuggaaguuuuuucuaccauaa

SEQ ID NO: 255504 - RNA, 65 nt, Homo Sapiens
cggcacucauuuugcggaggccgggcauuggggccguuuguuaagugaaaggcccagccggacug

SEQ ID NO: 255505 - RNA, 65 nt, Homo Sapiens
uuaaaaaaaaaaacaaaacaaaaaaagguuacaaaguuuguuaacuugcuauccuguggucuugu

SEQ ID NO: 255506 - RNA, 65 nt, Homo Sapiens
gcuauccuguggucuuguugccugaaauuguuauuguuuguuauuucucucugauguuuuuugua

SEQ ID NO: 255507 - RNA, 65 nt, Homo Sapiens
aaguacucugcaguggacauaagcauugggccauaguuuguuaaucucaacuaacgccuacauua

SEQ ID NO: 255508 - RNA, 65 nt, Homo Sapiens
auaagcauuuuugugagugaccaccuuugcaauauguuuguuaauuuacuucauguuggguucuu

SEQ ID NO: 255509 - RNA, 65 nt, Homo Sapiens
ccccgcaugucuuauucuugcccuucccccaaccaguuuguuaaucaaacaauaaaaacauguuu

SEQ ID NO: 255510 - RNA, 65 nt, Homo Sapiens
accuaugcaauauuuuuuacuuuucuaauaaacauguuuguuaaaacaguugguugagucucuca

SEQ ID NO: 255511 - RNA, 65 nt, Homo Sapiens
gucugccucuuccacauaauguccuuugcuuucauguuuguuaucuucuuuuucuguucacucag

SEQ ID NO: 255512 - RNA, 65 nt, Homo Sapiens
auaucacaaauauauaugcuuccagacaaagaaaaguuuguuaguccugauuuucuaaucguagc

SEQ ID NO: 255513 - RNA, 65 nt, Homo Sapiens
uuacaugguuacacagugagguuaauucagugaaaguuuguuaggucagagcugaaaguguaacu

SEQ ID NO: 255514 - RNA, 65 nt, Homo Sapiens
aaguggcuagaacaucaauuucaaaacauccaacuguuuguuauacugcuaaauacuguaauguu

SEQ ID NO: 255515 - RNA, 65 nt, Homo Sapiens
aaaaaaaugaaaaaaaaagucaaauuuacaugcauguuuguuacauuuaaugucugauugaaaca

SEQ ID NO: 255516 - RNA, 65 nt, Homo Sapiens
aucaaauuugacuuccuagccuaccacuuaagagaguuuguuauaucuugcuuccuucuuaaccu

SEQ ID NO: 255517 - RNA, 65 nt, Homo Sapiens
caaauuaauccacaguuucuaggaauacaaugaauguuuguuaaacccagggccuggcauuuggu

SEQ ID NO: 255518 - RNA, 65 nt, Homo Sapiens
gagaagcugcuucaaaucaccuuccuacugucaugguuuguuauauugaugcaagacaagucauc

SEQ ID NO: 255519 - RNA, 65 nt, Homo Sapiens
uuggguauguuuaaucuguuauguacuaguguucuguuuguuauuguuuuguuaauuacaccaua

SEQ ID NO: 255520 - RNA, 65 nt, Homo Sapiens
aauauggagaauguuauggaagaaauaguuuauaaguuuguuaaguacuuauaacaugguuuauc

SEQ ID NO: 255521 - RNA, 65 nt, Homo Sapiens
aaaaaaauacaacugagaagggugaagagaaguauguuuguuaaacaguaaaaaugaauaguaua

SEQ ID NO: 255522 - RNA, 65 nt, Homo Sapiens
ugagaaagcauguuuaaaaacuuacaaaaauacguguuuguuauuugcccccuuugccuuuaaaa

SEQ ID NO: 255523 - RNA, 65 nt, Homo Sapiens
auguauguuuuuuuccaaugaugucuaaauucacuguuuguuacuaaaacaauuuaugcgaaccu

SEQ ID NO: 255524 - RNA, 65 nt, Homo Sapiens
ucuuauuuuagaaauuauaaaaauacuuaaauuugguuuguuaauuuguuucaaucucugacuaa

SEQ ID NO: 255525 - RNA, 65 nt, Homo Sapiens
auugcuguaaaguauuauauuucuuaaugugaauaguuuguuaauucccuuagauacuccuguaa

SEQ ID NO: 255526 - RNA, 65 nt, Homo Sapiens
gaacuguggacucgcuuuccuguggaugguauuguguuuguuaguggucuuuguggcuacuuguu

SEQ ID NO: 255527 - RNA, 65 nt, Homo Sapiens
aaucagaaauggguccaugacuuuauugggaaugaguuuguuauaugguggacugcagccuucau

SEQ ID NO: 255528 - RNA, 65 nt, Homo Sapiens
uguaggauuccauuugaugauucuggauuuuugcuguuuguuauugcccuuagaggggcucugag

SEQ ID NO: 255529 - RNA, 65 nt, Homo Sapiens
acaaauauuuauuguuucagagacuguacuauuuuguuuguuagaagauuuauaaggcaguaucu

SEQ ID NO: 255530 - RNA, 65 nt, Homo Sapiens
uuugggagaucuggugaucucccaagcuaucuaaaguuuguuagauagcugcauguggcuuuuuu

SEQ ID NO: 255531 - RNA, 65 nt, Homo Sapiens
ugaaugagcuuuuuaaggaagaaauauuauauauuguuuguuaaaguuuauugaaauaaagaauc

SEQ ID NO: 255532 - RNA, 65 nt, Homo Sapiens
uucuguguuauuagugaggaaacuuuaaaacucauguuuguuauuacuuacuacccaauuucauu

SEQ ID NO: 255533 - RNA, 65 nt, Homo Sapiens
gguuccccuaaacuugcccuguuuuuguuuuuuuaguuuguuauccccuuacugagcggccucua

SEQ ID NO: 255534 - RNA, 65 nt, Homo Sapiens
cugccaggacccacacagcuucgauggaucucaguguuuguuaacaaaauacaaagaucucaaac

SEQ ID NO: 255535 - RNA, 65 nt, Homo Sapiens
uuuugccauucugccguagcuagauguucugugggguuuguuaacauggaacuacucagcuuucu

SEQ ID NO: 255536 - RNA, 65 nt, Homo Sapiens
guucguccccagcguccguccuguaacgugcuucuguuuguuaugguagaacagcccuguguuaa

SEQ ID NO: 255537 - RNA, 65 nt, Homo Sapiens
uauuuuuaggaaaauucugaagccagcuaucacagguuuguuagcuaauaauaguauuuucuuuu

SEQ ID NO: 255538 - RNA, 65 nt, Homo Sapiens
ugauugagcaguagcauuugccuuuuggguuuuuuguuuguuauuauagaagagaugacuucugc

SEQ ID NO: 255539 - RNA, 65 nt, Homo Sapiens
aauaauuuuaaagauucuuuaucugcaucauugcuguuuguuacuauaaauuaaaugaaccucau

SEQ ID NO: 255540 - RNA, 65 nt, Homo Sapiens
ugucaguucuaaugaaauuuuguaaaagauggcaaguuuguuaccucacuugagugggguuuucc

SEQ ID NO: 255541 - RNA, 65 nt, Homo Sapiens
ggcauuuuucugucagauuuguaguaauuugugagguuuguuagagauuaauauagguuuucuuu

SEQ ID NO: 255542 - RNA, 65 nt, Homo Sapiens
cagaguuuucucuguauucucagaagauguuaauaguuuguuacuagccagagaguaugacuaug

SEQ ID NO: 255543 - RNA, 65 nt, Homo Sapiens
ugcuguuagucggguuagaguuggcucuacgcgagguuuguuaauaaaaguuuguuaaaaguuug

SEQ ID NO: 255544 - RNA, 65 nt, Homo Sapiens
uuagaguuggcucuacgcgagguuuguuaauaaaaguuuguuaaaaguuuguuuugugcaagugu

SEQ ID NO: 255545 - RNA, 65 nt, Homo Sapiens
ccagcccaugguaaacacaggcuucaccuguucuuguuuguuagccuugacugugaggcaggacu

SEQ ID NO: 255546 - RNA, 65 nt, Homo Sapiens
ugaaggaggaggacuggcugccuccauuuugccuuguuuguuaguuugccugggucugucugagg

SEQ ID NO: 255547 - RNA, 65 nt, Homo Sapiens
ugcagucacaucacaauauucaguggugaaaucuuguuuguuacugucauucccauuccuuuucg

SEQ ID NO: 255548 - RNA, 65 nt, Homo Sapiens
uagguauauauaugccaugagugccgaaugugcagguuuguuacacuuuaaguuucaggauacau

SEQ ID NO: 255549 - RNA, 65 nt, Homo Sapiens
acguuuaauuagaagguggaagacagguaaauucuguuuguuacuuccccuuuuaucugauucug

SEQ ID NO: 255550 - RNA, 65 nt, Homo Sapiens
uaucucauuagagaacugcuuaaaaauaaaauaucguuuguuauuaaacugcauguuuuauaaaa

SEQ ID NO: 255551 - RNA, 65 nt, Homo Sapiens
uuuuuaaaaauugcucuuaagucagauauuuagauguuuguuacaacagcauuucagauuuuauu

SEQ ID NO: 255552 - RNA, 65 nt, Homo Sapiens
auuuuuaaaggacgcucuagaauucuagguagcuuguuuguuauuguuuaaaaagacauuaagug

SEQ ID NO: 255553 - RNA, 65 nt, Homo Sapiens
gagccuucucuuguguguuaacuaucagaaaagguguuuguuaaauuuaaggaaucccuaacccu

SEQ ID NO: 255554 - RNA, 65 nt, Homo Sapiens
auaugcuugacuagaguuucuacauuuuuuuaaaaguuuguuaaacucuuauucuuagcuguaua

SEQ ID NO: 255555 - RNA, 65 nt, Homo Sapiens
ugaaagagucuggccaaaacuggugcuauuuuguaguuuguuauaaacucuguuuuuuaguauaa

SEQ ID NO: 255556 - RNA, 65 nt, Homo Sapiens
caccuaggaucauauugcaugcauguguuucugcaguuuguuacauuauaaucuaacccaaacua

SEQ ID NO: 255557 - RNA, 65 nt, Homo Sapiens
uaauguggccucugucaguuaaaaaaaaaaaaaagguuuguuaauucgcuguuuuuaucuccaau

SEQ ID NO: 255558 - RNA, 65 nt, Homo Sapiens
guuuauacuauuuuuggauuccugguuuagagaggguuuguuaagggggggagaugugaauauga

SEQ ID NO: 255559 - RNA, 65 nt, Homo Sapiens
acuuuuucuguauuuguugcaucuggggcuucuccguuuguuaauuguauuguuacuguacgugu

SEQ ID NO: 255560 - RNA, 65 nt, Homo Sapiens
ugaacaguacgacaguguauuguaaauucccuuuaguuuguuacaguagccaauugaaaauguau

SEQ ID NO: 255561 - RNA, 65 nt, Homo Sapiens
accaggaaacacauuucuguggccuuagccaagcaguuuguuaguuacauauucccucgcaaacc

SEQ ID NO: 255562 - RNA, 65 nt, Homo Sapiens
ccaccacaggaauguaucacaacuuaaccguucccguuuguuagacuaguuucuuauuaauguug

SEQ ID NO: 255563 - RNA, 65 nt, Homo Sapiens
uuggcaagccucccauugccuuucugcaucaauguguuuguuaccaaauagcagaaauuucgcuu

SEQ ID NO: 255564 - RNA, 65 nt, Homo Sapiens
gacuuauuuguaguuguuaguugcccugcuaccuaguuuguuagugcauuugagcacacauuuua

SEQ ID NO: 255565 - RNA, 65 nt, Homo Sapiens
aagacaauuuucauaacuugauaaauuauaguuuuguuuguuagaaaaguugcucuuaaaagaug

SEQ ID NO: 255566 - RNA, 65 nt, Homo Sapiens
ugucuaaaagagcucgcuggcaagcugccucuugaguuuguuauaaaagcgaacuguucacaaaa

SEQ ID NO: 255567 - RNA, 65 nt, Homo Sapiens
aaguuuuuuguaguuguuaccgcucuuuuggguugguuuguuaauuuauacaaagagauuaccac

SEQ ID NO: 255568 - RNA, 65 nt, Homo Sapiens
cucugagccauggugucgagugaagaguaguucuuguuuguuacaaccuuugugagucagccaug

SEQ ID NO: 255569 - RNA, 65 nt, Homo Sapiens
uaagagucuauguaugucucaaccaaagcuuagcaguuuguuagacauugaacugcacuuuauau

SEQ ID NO: 255570 - RNA, 65 nt, Homo Sapiens
aaauggaauggucucuuugauuuuguaacuuaccuguuuguuaggugaaaaguaaaauggacuac

SEQ ID NO: 255571 - RNA, 65 nt, Homo Sapiens
ugaacauuuucaauuauaugagcuuaugaauaauuguuuguuaaucuuuuuaguuaauauaccaa

SEQ ID NO: 255572 - RNA, 65 nt, Homo Sapiens
guugaagauuaacuuuuccuauuuguaaaaaauuaguuuguuauaauacagcuaaaagggacuaa

SEQ ID NO: 255573 - RNA, 65 nt, Homo Sapiens
auaguuggucaaugccuggcuauugcuguuuaacuguuuguuaucuaaagggauaaaucucuaau

SEQ ID NO: 255574 - RNA, 65 nt, Homo Sapiens
uggauuaaauaguuuuaaaaggcauagagucaccuguuuguuaugucagccauugcucugcuccu

SEQ ID NO: 255575 - RNA, 65 nt, Homo Sapiens
uuuaaguacauuuuaauaauuaagugugugauacaguuuguuacuugaaagaacacuucuaagcc

SEQ ID NO: 255576 - RNA, 65 nt, Homo Sapiens
cacagugaaaauguauuauauuuucuucaaagggaguuuguuauaagauggauuaucugggguaa

SEQ ID NO: 255577 - RNA, 65 nt, Homo Sapiens
auccuuuaaucauaacuaaaucucucguagagaugguuuguuaccuguacaagauacucuuugga

SEQ ID NO: 255578 - RNA, 65 nt, Homo Sapiens
acgauagcuauauucaaaauagugaucauaaugagguuuguuaaauaggugacugaaauugcauc

SEQ ID NO: 255579 - RNA, 65 nt, Homo Sapiens
ggauugcuucacugguuuaauaauuuaaaaguuauguuuguuaaacacccugucagaacagucau

SEQ ID NO: 255580 - RNA, 65 nt, Homo Sapiens
uuuuuaauggaaucuuuguuuuuguucuccaucuuguuuguuagagucucucggccuuuauuuac

SEQ ID NO: 255581 - RNA, 65 nt, Homo Sapiens
uaauucaacuuuuaagauacagaagaaauuuguauguuuguuaaaguugcauuuauugcagcaag

SEQ ID NO: 255582 - RNA, 65 nt, Homo Sapiens
augcaguaauaaaccauuuguuuuacugcuguuaaguuuguuauuuggguauaaaaccagauguu

SEQ ID NO: 255583 - RNA, 65 nt, Homo Sapiens
uuuaacagcugcuggacagacacauuagagcagcuguuuguuauugauaauaaaauauuauaaaa

SEQ ID NO: 255584 - RNA, 65 nt, Homo Sapiens
guucuuuuucaugggcgggucggggucaguauccuguuuguuauuguuaaauuuguaugaaccuu

SEQ ID NO: 255585 - RNA, 65 nt, Homo Sapiens
acucgaugugauacaguauaaauaugcuaugguuuguuuguuaugaacagauagccaccaguuac

SEQ ID NO: 255586 - RNA, 65 nt, Homo Sapiens
uuagagaaacauuuuugcaugaguucuuacaaacuguuuguuauauuuucuggaaugauaaguga

SEQ ID NO: 255587 - RNA, 65 nt, Homo Sapiens
gcagccggcgaugcccaauaaauguguguuuugcuguuuguuaagugauuucagcaacaagugug

SEQ ID NO: 255588 - RNA, 65 nt, Homo Sapiens
cauucauaugccuacccaucgguucaaauaaguugguuuguuagauugugugugugaaaaagcug

SEQ ID NO: 255589 - RNA, 65 nt, Homo Sapiens
ugcugcuuaauaaaguaagcuuaacuuuaaaagcuguuuguuauacuccacggccauaacaauau

SEQ ID NO: 255590 - RNA, 65 nt, Homo Sapiens
uucaaauacccauccaacaacugcagauaucaagaguuuguuauuugauguuuuccacuugauug

SEQ ID NO: 255591 - RNA, 65 nt, Homo Sapiens
uuucuuuucuuuuuucuuuuuuauguuuuuaaaauguuuguuauauuuguuaacugaacucuuaa

SEQ ID NO: 255592 - RNA, 65 nt, Homo Sapiens
agagguugugcacuguuuacucaccaaaucguagcguuuguuaccagcaaagggugucugcgucg

SEQ ID NO: 255593 - RNA, 65 nt, Homo Sapiens
uaccauaaugcuaaauaaaaaauugagacagaacuguuuguuauguuuuaauuaauuuuuuucau

SEQ ID NO: 255594 - RNA, 65 nt, Homo Sapiens
augaggcauuuguuugaacuagaguugauacuacaguuuguuaguucaaguauuauaccuuuuuu

SEQ ID NO: 255595 - RNA, 65 nt, Homo Sapiens
agcauuuaaacuguuucauuuguuuuggauaacacguuuguuacauuagcaucaucauauugugc

SEQ ID NO: 255596 - RNA, 65 nt, Homo Sapiens
aauagaaauaaacgacaaaagcccucaacacaagaguuuguuauacuugcugccguccaucaaga

SEQ ID NO: 255597 - RNA, 65 nt, Homo Sapiens
ucauugccacuaguuccaucuagaacuccuuucuaguuuguuauuuuuaaaauguuuauacauaa

SEQ ID NO: 255598 - RNA, 65 nt, Homo Sapiens
caggccugugggaaugggauuuguuacaaaucuagguuuguuacuggcuucagaaagcuaauuaa

SEQ ID NO: 255599 - RNA, 65 nt, Homo Sapiens
agaucaaaguauuauaugcugugugcuuuuuagguguuuguuaguacugugaaggcaaaaaugcu

SEQ ID NO: 255600 - RNA, 65 nt, Homo Sapiens
cuuggacugugaagcaucugccauggggaagugcuguuuguuauccuuucucuguggcagugaag

SEQ ID NO: 255601 - RNA, 65 nt, Homo Sapiens
caacguggcgucugauaacagugagggggggugggguuuguuaugucuuuauugaguauuuaagu

SEQ ID NO: 255602 - RNA, 65 nt, Homo Sapiens
acagaaaauaacagaauagccuucuguaaugaggcguuuguuagaguuuugcaugagauucuaau

SEQ ID NO: 255603 - RNA, 65 nt, Homo Sapiens
caacuugugaaaacaagguuguuuuugucuuuaucguuuguuagaguuauagauuuaugauuuca

SEQ ID NO: 255604 - RNA, 65 nt, Homo Sapiens
ggcggaaucccgagggugguggaugcaaacgcgggguuuguuaggaucuagggacagaggcaucu

SEQ ID NO: 255605 - RNA, 65 nt, Homo Sapiens
cuauucauaacauuguagagugcuuucugaaagcaguuuguuauauaauucuuuuccuuucauuu

SEQ ID NO: 255606 - RNA, 65 nt, Homo Sapiens
aagaacuggucagaccuugcgacacacacauguauguuuguuaccugcauugcuguauacacaca

SEQ ID NO: 255607 - RNA, 65 nt, Homo Sapiens
acaggcagccaacaucacucaccuggcgaaaaacaguuuguuaacuuacaggcaugagccacugu

SEQ ID NO: 255608 - RNA, 65 nt, Homo Sapiens
gucuguucuacaugggccugaguuuccagcugcagguuuguuagaggcugguuuaaaagggaucc

SEQ ID NO: 255609 - RNA, 65 nt, Homo Sapiens
uccccccuccucaauguaguggccuuggauauccuguuuguuaauaaagacaauucaaccagcuc

SEQ ID NO: 255610 - RNA, 65 nt, Homo Sapiens
cucugugagucuggcucaagaccgacauugccuugguuuguuacaugacuaucgugauggggaaa

SEQ ID NO: 255611 - RNA, 65 nt, Homo Sapiens
aaugggcuuucuguuuaugaggggugagaagugauguuuguuacuauguucuccagcaaguaaac

SEQ ID NO: 255612 - RNA, 65 nt, Homo Sapiens
agucuaauaacaaaaaauguaaaccuaauuuggcaguuuguuagguuagacaacugacagccuca

SEQ ID NO: 255613 - RNA, 65 nt, Homo Sapiens
ugcuuaaauuaguaugugccccuaaaauauucuauguuuguuaugagauucaaauaaaaaaauuu

SEQ ID NO: 255614 - RNA, 65 nt, Homo Sapiens
agcacaucccuguaaggcccauaagagaaagaggaguuuguuacauuuaaucaacacugugaagu

SEQ ID NO: 255615 - RNA, 65 nt, Homo Sapiens
cuagcauagugcuuugcacauaguagucacucaguguuuguuaaauaaagcuauuagugucauua

SEQ ID NO: 255616 - RNA, 65 nt, Homo Sapiens
uguucagcagcaaacuugcaacagacuggccuucuguuuguuacuuucaaaaggcccacaugaua

SEQ ID NO: 255617 - RNA, 65 nt, Homo Sapiens
auuguuucucuacuaagaacucuuucuuaaaugugguuuguuacuguagcacuuuuuacacugaa

SEQ ID NO: 255618 - RNA, 65 nt, Homo Sapiens
cugguuguaauuaauuuuuuuguuguuugaucuguguuuguuauacagguagcacaaucuacuaa

SEQ ID NO: 255619 - RNA, 65 nt, Homo Sapiens
uugagagauaaacaaugacaucaggcuucagcuugguuuguuaaaggacaagguuguagcugugc

SEQ ID NO: 255620 - RNA, 65 nt, Homo Sapiens
cauguucacuucccccaggagccucucgugauucuguuuguuaccgcuguugcugcucuguauuu

SEQ ID NO: 255621 - RNA, 65 nt, Homo Sapiens
ucaaauuagcuggucucugauuucuguggaauucuguuuguuaaacuugccucagcugaucagag

SEQ ID NO: 255622 - RNA, 65 nt, Homo Sapiens
auguccauguaaacaugcccacuuuuaauguauauguuuguuauaggaaggcaacacauuccuac

SEQ ID NO: 255623 - RNA, 65 nt, Homo Sapiens
cugguuguaauuaauuuuuuuguuguuugaucuguguuuguuauacagguagcucaaucuacuaa

SEQ ID NO: 255624 - RNA, 65 nt, Homo Sapiens
cugauugggagaguuccaugaugggaaucgaaacaguuuguuaauccuguguccuccagguuuau

SEQ ID NO: 255625 - RNA, 65 nt, Homo Sapiens
aggcuacacgagcucucuagaaaaaaaaaaaaaaaguuuguuaaacuuguuucuaugugcaaaaa

SEQ ID NO: 255626 - RNA, 65 nt, Homo Sapiens
agguuuccuaaacuauaaaagcagauuuugcuuuuguuuguuaaucauaggcauggccgagcauu

SEQ ID NO: 255627 - RNA, 65 nt, Homo Sapiens
uuuuuauuuuaucucaaguauguccaguguguucgguuuguuacauauuccaugaaauaucugag

SEQ ID NO: 255628 - RNA, 65 nt, Homo Sapiens
uuagcagauuagcaccauaacuaacuuaaaacuaaguuuguuaccugcuuuuuauacugucacaa

SEQ ID NO: 255629 - RNA, 65 nt, Homo Sapiens
ccuuaaaauuaccagacaaaaaaauuuaaaauuacguuuguuauuccuaguggaugacuguugau

SEQ ID NO: 255630 - RNA, 65 nt, Homo Sapiens
caauaggacaaaaaaguugugguuuggggaggucuguuuguuacauaaaaaggaccuuucggugu

SEQ ID NO: 255631 - RNA, 65 nt, Homo Sapiens
auaagauuaugaaaccacaugagaagugauaaaauguuuguuaaagcuagauagagguuaagaau

SEQ ID NO: 255632 - RNA, 65 nt, Homo Sapiens
uuuauaucacuguuuuucacuuagauuuauauuugguuuguuaauucuggaaaugcagaauggcg

SEQ ID NO: 255633 - RNA, 65 nt, Homo Sapiens
aacugguaaauuuugcaacuaauaaagacauucauguuuguuaaaaacuguaaauggcugucuaa

SEQ ID NO: 255634 - RNA, 65 nt, Homo Sapiens
ucucuuuuauaugcauguauagaaaucaagguuuuguuuguuaauguauaacuuccauguucucu

SEQ ID NO: 255635 - RNA, 65 nt, Homo Sapiens
accagagaugccugaacucaaauucaucauauuuuguuuguuauccuuacgaucguuauuccccc

SEQ ID NO: 255636 - RNA, 65 nt, Homo Sapiens
uguuuuuguuuuuguauuuuuuuucuuuugaaaggguuuguuaauuuuucuaauuuuaccaaagu

SEQ ID NO: 255637 - RNA, 65 nt, Homo Sapiens
uauuuagccguguuugggacuccgugucuucaaugguuuguuaguugccauuacaacuuugucug

SEQ ID NO: 255638 - RNA, 65 nt, Homo Sapiens
aagugcugggauuacaggcccgguccaguuugauaguuuguuaucauguuauacguacacuuaga

SEQ ID NO: 255639 - RNA, 65 nt, Homo Sapiens
cuuuagcagagaauuuguaauuuaagaaauuuucuguuuguuacggaacaugugggaaucccuuu

SEQ ID NO: 255640 - RNA, 65 nt, Homo Sapiens
uuuucaacucuugcaccuggaguucugcugguuaaguuuguuaaacuuaguugaaacugggaacc

SEQ ID NO: 255641 - RNA, 65 nt, Homo Sapiens
agaaauaaagagcuaucaugcugugguuuauuaugguuuguuacauugauaggauacauacugaa

SEQ ID NO: 255642 - RNA, 65 nt, Homo Sapiens
guagcccgcucguaucuaugguuucgcuuuccacaguuuguuaccugcagucaacugcaguucaa

SEQ ID NO: 255643 - RNA, 65 nt, Homo Sapiens
gucccuuccuccagauccgucugguuuuuuacaccguuuguuaauaaagccugaaaccgcugugu

SEQ ID NO: 255644 - RNA, 65 nt, Homo Sapiens
aaaaauaagaaauagcuacaaaaggaugucuaaauguuuguuaauaauaauguacguacuaccua

SEQ ID NO: 255645 - RNA, 65 nt, Homo Sapiens
ucuuuucuauucuacuguuaauccucagucagccaguuuguuauguuauuaauauguuaggauuu

SEQ ID NO: 255646 - RNA, 65 nt, Homo Sapiens
uccaguugcauuuuggcugaaaauaaacugaauguguuuguuagugugcuguuauucuauucugc

SEQ ID NO: 255647 - RNA, 65 nt, Homo Sapiens
aggauuuacauuaacugcuguaaccagaaucccauguuuguuacucauaagaaguuuaaucaaag

SEQ ID NO: 255648 - RNA, 65 nt, Homo Sapiens
uuauuuacgauuucguuuguuuggauucaagcuuaguuuguuaauauguauaauuuagcaucuau

SEQ ID NO: 255649 - RNA, 65 nt, Homo Sapiens
uccauuuuaagaaaacccgacaacauuucugccagguuuguuaggaggccacaugauacuuauuc

SEQ ID NO: 255650 - RNA, 65 nt, Homo Sapiens
aaggcugacucuuacuaaccaccauuuccccugugguuuguuaucaguacaauucuuuguugcuu

SEQ ID NO: 255651 - RNA, 65 nt, Homo Sapiens
auaauacauuauugacucuaugaauguuuucugaaguuuguuagucauuuguaaaacuaaaucag

SEQ ID NO: 255652 - RNA, 65 nt, Homo Sapiens
caggcuuugggugaauucuggauggcuugccucauguuuguuagccagcacuucugcucugucgu

SEQ ID NO: 255653 - RNA, 65 nt, Homo Sapiens
aacucaugguaccuuggccaaguuggaaggaagcaguuuguuaaugaggcacaguaauccuggcu

SEQ ID NO: 255654 - RNA, 65 nt, Homo Sapiens
agaauauuuacaauaaagaguauuuacaauaaagaguuuguuauuauuuguaaauugugugcaac

SEQ ID NO: 255655 - RNA, 65 nt, Homo Sapiens
cacagacugggaaccccuccuggccugggggaagaguuuguuaccuaccuuacuauuuaaagagc

SEQ ID NO: 255656 - RNA, 65 nt, Homo Sapiens
ggggaggggaccgggaagcgcuggggcuuguuucuguuuguuacuuacaggacugagacaucuuc

SEQ ID NO: 255657 - RNA, 65 nt, Homo Sapiens
ggugggagggguggguuuugucauuuuccauuuugguuuguuagaauuaacagcugccugaauug

SEQ ID NO: 255658 - RNA, 65 nt, Homo Sapiens
cuauuuugcauguguuugagagcagcuuuggacuuguuuguuaucugaggacucuucaguggcug

SEQ ID NO: 255659 - RNA, 65 nt, Homo Sapiens
ucagggaaaaggaguagggaagggcuuaggacuugguuuguuauuccccuccuugcccagacuac

SEQ ID NO: 255660 - RNA, 65 nt, Homo Sapiens
ucccucacuucaccuccauaucuuaucccauaaagguuuguuacuauuauugugacuuguaaguu

SEQ ID NO: 255661 - RNA, 65 nt, Homo Sapiens
uagguaagccugugccaugggugcaggaccugcagguuuguuacauuuuacguuccgggauacau

SEQ ID NO: 255662 - RNA, 65 nt, Homo Sapiens
auuaggguuguaaggugucgaugucauuguuuccuguuuguuaauaauuauugaaaaauuaaaaa

SEQ ID NO: 255663 - RNA, 65 nt, Homo Sapiens
gguauuuuuuucacgugccuuaaacuaaaugugagguuuguuacuaauucuccugcauuuuuaca

SEQ ID NO: 255664 - RNA, 65 nt, Homo Sapiens
gugcacaucccuacgugcccaagagcucccgcaguguuuguuagaaccagugccaccuuauggca

SEQ ID NO: 255665 - RNA, 65 nt, Homo Sapiens
gguccagcaguguuagcagggguggcaguccuuguguuuguuauaccaauaaaugcuuuagcugc

SEQ ID NO: 255666 - RNA, 65 nt, Homo Sapiens
gguauaccucaacccaaaaauaaagguuuguuuugguuuguuauggcuuccuuuuuuaaaaaauu

SEQ ID NO: 255667 - RNA, 65 nt, Homo Sapiens
gucaauuuuguacaauuagguaucugacuuuacaaguuuguuauccuuucuaauuuuuacugaac

SEQ ID NO: 255668 - RNA, 65 nt, Homo Sapiens
uugacuauguucuucaaauuaaagcuuauacaagaguuuguuacgcaguuuucagauaaaccaga

SEQ ID NO: 255669 - RNA, 65 nt, Homo Sapiens
guacuaaaugccacugaauuuguauacuucagaauguuuguuauguaaauuuuaccucaacuaaa

SEQ ID NO: 255670 - RNA, 64 nt, Homo Sapiens
ccauggaucuccguguacacuaucaauaaaaguggguuuguuacaaagccguguccuugcccau

SEQ ID NO: 255671 - RNA, 65 nt, Homo Sapiens
uuuuuggugggaggcugugauaaaaucucuguacuguuuguuaggcugcugggccucccugacug

SEQ ID NO: 255672 - RNA, 65 nt, Homo Sapiens
guuaaaaugucaaauaccaaguaaagcacuggcaaguuuguuacugcucuggaagcuggcagugu

SEQ ID NO: 255673 - RNA, 65 nt, Homo Sapiens
cuugauugaaauggcaggauucuaaagagagccugguuuguuaaaagaaaacacugucaugcugu

SEQ ID NO: 255674 - RNA, 65 nt, Homo Sapiens
aacugcauuuauaauuuugugacugaggaucauuuguuuguuaauguacugugccuuuaacuuua

SEQ ID NO: 255675 - RNA, 65 nt, Homo Sapiens
acugaaguaagauuuugccuguaugguacuguuuuguuuguuaauaaagugcacugccaccccca

SEQ ID NO: 255676 - RNA, 65 nt, Homo Sapiens
uauccuuguuccuguuacaauauuuagcauuauuaguuuguuauguguguauguuuauguuaauu

SEQ ID NO: 255677 - RNA, 65 nt, Homo Sapiens
cugugucuacgauucaaagugaaaacauuuggcauguuuguuaauucuagcuuuuugguuuaaua

SEQ ID NO: 255678 - RNA, 65 nt, Homo Sapiens
uagucucccuuucacuguuuucuuauucuguaauuguuuguuauauuucccaaaaacgucuugau

SEQ ID NO: 255679 - RNA, 65 nt, Homo Sapiens
ggguagaguauugagaccuuuuuuauuagggugcuguuuguuauugagagcccaaucucugcaug

SEQ ID NO: 255680 - RNA, 65 nt, Homo Sapiens
acuuauuuguuuccugauagguuauguuuguaauuguuuguuaagcacagccuguuucuuggaag

SEQ ID NO: 255681 - RNA, 65 nt, Homo Sapiens
ugccagaccacguuucuauguucuauuauuagucuguuuguuaaauguauaaauuaguauaucuc

SEQ ID NO: 255682 - RNA, 65 nt, Homo Sapiens
uguguucuuaagcauaauuuucuuugcagcuuuagguuuguuagaucaccuacauuaacauuaug

SEQ ID NO: 255683 - RNA, 65 nt, Homo Sapiens
ccagcccagucugucugcgguguuguuuaguuuugguuuguuacgauuuuucauuggguuuuuau

SEQ ID NO: 255684 - RNA, 65 nt, Homo Sapiens
acagaaaauaaaacugcgcuaucugguucuuaaauguuuguuacucugggagggccucauguuuu

SEQ ID NO: 255685 - RNA, 65 nt, Homo Sapiens
gaaaugaucccagagaccuaaaccaagggccuaauguuuguuacaugagagagagcuauguuucu

SEQ ID NO: 255686 - RNA, 65 nt, Homo Sapiens
aacugcauuuauaauuuugugacugaggaucguuuguuuguuaacguacugugacuuuaacuuua

SEQ ID NO: 255687 - RNA, 65 nt, Homo Sapiens
caguagccuuaaaaaggcuuuuguuuauuucuuugguuuguuaacuagugucaucuauuuagaga

SEQ ID NO: 255688 - RNA, 64 nt, Homo Sapiens
uuaguccauaugaacuauugcauacgugcuacccagagauuaauuauaauuuuauauuuacaca

SEQ ID NO: 255689 - RNA, 64 nt, Homo Sapiens
cauucuucaugaauacuuuuuuuucauaauuuucagagauuaugauguauugguagcagggaug

SEQ ID NO: 255690 - RNA, 64 nt, Homo Sapiens
ccaauuauaacuuauuagcaaauauggauuucuuagagauuaaaucuaaacaagaaccauuugc

SEQ ID NO: 255691 - RNA, 64 nt, Homo Sapiens
acauuuaauaauguauguaccuaugaaucaggaaagagauuagagaucaucauguagaauaugg

SEQ ID NO: 255692 - RNA, 64 nt, Homo Sapiens
ccgggacccccgucuccaggggugccccagacccagagauuagccucccacuucggcgcagaaa

SEQ ID NO: 255693 - RNA, 64 nt, Homo Sapiens
ucuaaauuucuaggccaguacuacugcucucaaaagagauuaacugggauuaagugagaugacg

SEQ ID NO: 255694 - RNA, 64 nt, Homo Sapiens
cguaggugggccagagaacauuggaagaaucaagagagauuagaauaucugguuucucuaguug

SEQ ID NO: 255695 - RNA, 64 nt, Homo Sapiens
cucuuuucaaucucuuaaucuaaaugcuuuuuaaagagauuauuuguuuagauguaggcauuuu

SEQ ID NO: 255696 - RNA, 64 nt, Homo Sapiens
augguggggaaguggauucaggaaucuggggaauggcaaauauauuaagaagaguauugaaagu

SEQ ID NO: 255697 - RNA, 64 nt, Homo Sapiens
ggcagaucugcuuggggaagcuaguuaugugaaaggcaaauagagucauacaguagcucaaaag

SEQ ID NO: 255698 - RNA, 64 nt, Homo Sapiens
ugauugagagggcacaauuuaaaguagagcuuagggcaaauauuugaccaaauacaaacauccu

SEQ ID NO: 255699 - RNA, 64 nt, Homo Sapiens
uaauguggaaaucugaagaacaaaauuuucaguaggcaaauaggcagguuguuagaugauaacu

SEQ ID NO: 255700 - RNA, 64 nt, Homo Sapiens
gcuuuggcucuauugauuuguccauuauguguuaggcaaauauaacuuaaguggagggggaagu

SEQ ID NO: 255701 - RNA, 64 nt, Homo Sapiens
aaaucuauggccacacugagaagccuuugaaaauggcaaauacuuuucaucaccaauugcccaa

SEQ ID NO: 255702 - RNA, 64 nt, Homo Sapiens
ggaacauaaacuuuaaacagaaaagaaauggaauggcaaauaaucauguacccauaaaaauuua

SEQ ID NO: 255703 - RNA, 64 nt, Homo Sapiens
aaacuauauauuugcuuaaagcugucuuucagaaggcaaauaggauugaacuauuuuuauaucu

SEQ ID NO: 255704 - RNA, 64 nt, Homo Sapiens
cacuucaccucuggugccuuuuuguauauuuuaaggcaaauaauuuuuucaaaguaggcaauuc

SEQ ID NO: 255705 - RNA, 64 nt, Homo Sapiens
caggguuugaagggagaccugcagaagugaggaaggcaaauacuaagauucuguuccccucuuc

SEQ ID NO: 255706 - RNA, 64 nt, Homo Sapiens
uaguuccuucauuccaacgacugagugaggucuuuauugccaucaucccgugugcgcacucugc

SEQ ID NO: 255707 - RNA, 64 nt, Homo Sapiens
uuugaagggaaggauaaguguugcuuucaguaguuauugccaauauuguuguuggucaauggcu

SEQ ID NO: 255708 - RNA, 64 nt, Homo Sapiens
gucaauuuagaacaguuacuaggauaaacuccauuauugccauggcugucaugguacccaagug

SEQ ID NO: 255709 - RNA, 64 nt, Homo Sapiens
ugagagcagcacaugcauccagguauuuauagauuauugccagugucuuuucuguaugcuauaa

SEQ ID NO: 255710 - RNA, 64 nt, Homo Sapiens
gaugaauucagguuguuuuuugauuguuauguaauauugccaauucauuaguaugugagggccu

SEQ ID NO: 255711 - RNA, 64 nt, Homo Sapiens
ggccgccacuuugacuuauuuuguguauuguacuuauugccacugcucccagacuugcccagau

SEQ ID NO: 255712 - RNA, 64 nt, Homo Sapiens
auuuuguauuugguaaagguagcaaaacacauuguauugccauuguaaaaaaacaaaaaauaga

SEQ ID NO: 255713 - RNA, 64 nt, Homo Sapiens
acuagggucaaaaaugaauuaaauagcaaagggcuauugccaauaagaaaaguuuuaauuauau

SEQ ID NO: 255714 - RNA, 64 nt, Homo Sapiens
augaaauaaguguaugugcauugcugucugucucuauugccaaaaucaaauaaauggcuucuca

SEQ ID NO: 255715 - RNA, 64 nt, Homo Sapiens
augcuguaucuuguacacagguuguagguugguuuauugccauuuuguuuuauuucugcuguau

SEQ ID NO: 255716 - RNA, 64 nt, Homo Sapiens
gcccuuugccuguagagccagccuugguuggaccuauugccaggaauguuucagcugcaguuga

SEQ ID NO: 255717 - RNA, 64 nt, Homo Sapiens
agagaaccuuuccacucccacugccaggauuuuguauugccaucgggugccaaauaaaugcuca

SEQ ID NO: 255718 - RNA, 64 nt, Homo Sapiens
uuuuauuugugcaugaauuguuuucugcuuuuucuauugccauuucauuuagaaacauccauau

SEQ ID NO: 255719 - RNA, 64 nt, Homo Sapiens
caaaaacuuaacauuuaaaauaaagauauuuauauauugccauacuguauucagguaauauguu

SEQ ID NO: 255720 - RNA, 64 nt, Homo Sapiens
uuuagcucuggaauguuuagauuaaaaacauaacuauugccagaaaaaugauucuucuucagaa

SEQ ID NO: 255721 - RNA, 64 nt, Homo Sapiens
guuguuauuuaauugcuugaggugcuguugguauuauugccauaguggcuuauuugagguuguu

SEQ ID NO: 255722 - RNA, 64 nt, Homo Sapiens
uugaaucaugugggcugauguuuaccauuuucuauauugccaagaguauuuuucugaacccugc

SEQ ID NO: 255723 - RNA, 64 nt, Homo Sapiens
uaaauuacacacugagagcacaauuaauuuaaaguauugccauuuaacugacauuauauauaac

SEQ ID NO: 255724 - RNA, 64 nt, Homo Sapiens
uccauuagcucacuuuuaaaagaaagcauugucauauugccaucauuuucccuggagggauccu

SEQ ID NO: 255725 - RNA, 64 nt, Homo Sapiens
aagggagaagacacugcagugaccacuuauucuguauugccauggucuuuccacuuucaucugg

SEQ ID NO: 255726 - RNA, 64 nt, Homo Sapiens
guucauuuuucaaaaagggaaguaagcaaacaaauauugccaacucuucuauuuauggauauca

SEQ ID NO: 255727 - RNA, 71 nt, Homo Sapiens
uugauaaaucuggaagcaugaaugcagaagaccgucucuuucgaaugaaucaagcagcagaauuguacuug

SEQ ID NO: 255728 - RNA, 71 nt, Homo Sapiens
gcuuuucuggucuucggcugcucaggguucaucugaagauucgaaugaaaagaaaugcauguuuccugcuc

SEQ ID NO: 255729 - RNA, 71 nt, Homo Sapiens
cagugguggaauuucugaaguauuuuucuuucagcugaauacgaaugaacaaaguauaggguuuauguccu

SEQ ID NO: 255730 - RNA, 71 nt, Homo Sapiens
guguuuccggaggagcaagugugcucucagcucugccaaagcgaaugaaugcugcuuguucacaugcacag

SEQ ID NO: 255731 - RNA, 71 nt, Homo Sapiens
ugucuaauaguuauucccuaagucaucugguagauuuuuaacgaaugaagaagaaacucaccauguaaaag

SEQ ID NO: 255732 - RNA, 53 nt, Homo Sapiens
ucacguucuccaaagcacuuaugcgaaugaacugcagcuaugcagccggguga

SEQ ID NO: 255733 - RNA, 71 nt, Homo Sapiens
caaaacaaaacacaaauacucucacagggcauggagguuuucgaaugaacuuggccauaagaauaaauuca

SEQ ID NO: 255734 - RNA, 71 nt, Homo Sapiens
gcagggccaagcaccuagccucgcucuuggcagguacucagcgaaugaaugcuguauauguugggugcaaa

SEQ ID NO: 255735 - RNA, 71 nt, Homo Sapiens
uucuaauacccagaaauaacgcuauuuagcuuuauaauuuucgaaugaacaagguaaaccucgguugccau

SEQ ID NO: 255736 - RNA, 71 nt, Homo Sapiens
uaacugaauuuggaggcuggaaaggaaaagaaaacaaaaaacgaaugaaaaugcuuauaaccuaguuaaag

SEQ ID NO: 255737 - RNA, 71 nt, Homo Sapiens
uagccuuugccuuauucuguuuaaauuuacuauuccuaacccgaaugaaauuuuuguggaaaagaaacuag

SEQ ID NO: 255738 - RNA, 71 nt, Homo Sapiens
aaagucaaaucaauaaauuucugguuaaauuuuaagguauucgaaugaaauaaugaaaacaauccagcacu

SEQ ID NO: 255739 - RNA, 71 nt, Homo Sapiens
cauaaaugaagccucuuuggggugaagccuggacaucccaucgaaugaaaggacacuaguacagcgguucc

SEQ ID NO: 255740 - RNA, 71 nt, Homo Sapiens
acuguuguuuucauugaguuuggauuuauauuuuaaauguucgaaugaaaguaugauuguaaaagggagug

SEQ ID NO: 255741 - RNA, 71 nt, Homo Sapiens
aauauaccacuaaccugcagcuuaaaggcccauaguaacugcgaaugaagccagggacuuuucugggagaa

SEQ ID NO: 255742 - RNA, 71 nt, Homo Sapiens
uuaugauguguauauugagauuucucugcacuauuuagauccgaaugaaccuuuugaagaagaauagccuu

SEQ ID NO: 255743 - RNA, 71 nt, Homo Sapiens
ugcacccuuucaccaccucgaggagauuugcuccccauuagcgaaugaaauugaugcaguccuaccuaacu

SEQ ID NO: 255744 - RNA, 71 nt, Homo Sapiens
aauacaugcauaauauuuucaguauuuaaguaaauguauaacgaaugaauaguagauugaaauaaauaacc

SEQ ID NO: 255745 - RNA, 71 nt, Homo Sapiens
gggaauaagguacaagaagcauuuuguaaguugaagcaaaucgaaugaaauuaacuggguaaugaaacaaa

SEQ ID NO: 255746 - RNA, 71 nt, Homo Sapiens
agaaagagagaaagaaagaaacagaaaaaccuaaaagaaagcgaaugaauuugacaccuguugguuggaug

SEQ ID NO: 255747 - RNA, 71 nt, Homo Sapiens
gcuccguaugauuugcacaacagcucagcgcaccuccacaacgaaugaaauucuuagaauucgcauuuugc

SEQ ID NO: 255748 - RNA, 71 nt, Homo Sapiens
cuccuauguaguucucagaugcguaaagcagaacagccucccgaaugaagcguugccauugaacucaccag

SEQ ID NO: 255749 - RNA, 71 nt, Homo Sapiens
caucagauaauucacaccagagagaaacccucugaaugugacgaaugaagaaaagguauuaguguuaaacu

SEQ ID NO: 255750 - RNA, 71 nt, Homo Sapiens
agggaccuaaacuuuggcaaaaagugaacacaauucaaauacgaaugaaggaagagcccucagauggaacg

SEQ ID NO: 255751 - RNA, 71 nt, Homo Sapiens
aaaagaaacgugagaaggagaagaucugguuccagaaccgccgaaugaagcagcucaacgagacccaagug

SEQ ID NO: 255752 - RNA, 71 nt, Homo Sapiens
aggcuucauccuuuccauaugcaauuucuuuuuaauaugcccgaaugaaugaaggcaaaguguuucugaag

SEQ ID NO: 255753 - RNA, 71 nt, Homo Sapiens
uggaagaauauuuuagucaugaguuguuuucaguuuucagacgaaugaauguaauaggaaacuauggaguu

SEQ ID NO: 255754 - RNA, 71 nt, Homo Sapiens
acaguaagaugugaaauucacaaaaaguaaaccaaacaaaacgaaugaaaaacuggaaauaauucguuucc

SEQ ID NO: 255755 - RNA, 71 nt, Homo Sapiens
acagagaggaggaaaaaagaacucaacuaaauuuuaaugaacgaaugaaugccugucugggcaaguauuug

SEQ ID NO: 255756 - RNA, 71 nt, Homo Sapiens
uaaaaaaaugucuuucugauaccaguucgugacuguuguagcgaaugaaguuggauggcagguagaguuca

SEQ ID NO: 255757 - RNA, 71 nt, Homo Sapiens
ggucugccuuuaauuuuacccaggaaggacucacauuggggcgaaugaaccaaguuucgccaugcuggaug

SEQ ID NO: 255758 - RNA, 71 nt, Homo Sapiens
aagcaaguacauaaggacccuccuuuggugaaauccggguucgaaugaauaucucaaggcaggagaugcau

SEQ ID NO: 255759 - RNA, 71 nt, Homo Sapiens
ucaacucaauaaaaaacaaaacucauguggcuaguguuugccgaaugaaacgcauugaggcccaguaagac

SEQ ID NO: 255760 - RNA, 71 nt, Homo Sapiens
ccgaacaguuggggcuguuccucuuguggaccccgccugcccgaaugaaauucccuuuaagccaagagagc

SEQ ID NO: 255761 - RNA, 71 nt, Homo Sapiens
agugaaauguaaugauaaagagggauauuuuaacauauuuccgaaugaaugacucauuauuucauucuuuu

SEQ ID NO: 255762 - RNA, 71 nt, Homo Sapiens
gugaugaggaugugggaguugaaagaaagugguguaucaagcgaaugaacuacagcugugaggguuuagca

SEQ ID NO: 255763 - RNA, 71 nt, Homo Sapiens
uuccugagcuuuaugguccuaaaagcaaaauaaaaacuauucgaaugaaaagacaagaaaaucagguauua

SEQ ID NO: 255764 - RNA, 71 nt, Homo Sapiens
gaugagcgcacggaugaaugugagcaggcacucgguaaacacgaaugaaugauccucgucugucccaacac

SEQ ID NO: 255765 - RNA, 71 nt, Homo Sapiens
agaccaguuucagagaaauacuuucaggcacuaagacuaaucgaaugaacaaaguccacaguuuauuuuua

SEQ ID NO: 255766 - RNA, 71 nt, Homo Sapiens
uuuuguaugauacauaaagucuuucccguggcugccaccagcgaaugaaacaucagugcuacggggccagu

SEQ ID NO: 255767 - RNA, 51 nt, Homo Sapiens
ugucggugaccacuguaugaccgaaugaauggaaugcaugcgacugauuuu

SEQ ID NO: 255768 - RNA, 71 nt, Homo Sapiens
gauauaagcuuuuagaagguaauuugaugguauuucuuucucgaaugaaaagcugcugguuuacccucaac

SEQ ID NO: 255769 - RNA, 71 nt, Homo Sapiens
ggcucuggccaucugcaacccugaacgugcagguuggagaacgaaugaauacaaauuuuauuguaaaauaa

SEQ ID NO: 255770 - RNA, 71 nt, Homo Sapiens
cuauagcuuugaaaggauaaaaagcccugaagugcucaucacgaaugaaacaccaaaaccagagacuauca

SEQ ID NO: 255771 - RNA, 71 nt, Homo Sapiens
agguuaaaaagaccauuguauguuuuucuauuucugaauuacgaaugaaauccgaguaccuauuagaaaug

SEQ ID NO: 255772 - RNA, 71 nt, Homo Sapiens
uguagggggcauagaggauuagcaagaacacuuggaaugaacgaaugaacuaauuauguccuccagaaacc

SEQ ID NO: 255773 - RNA, 71 nt, Homo Sapiens
acugauucccaggcccugcugcucccauccccaccccagaucgaaugaacuuggcagaaagaagagaacuu

SEQ ID NO: 255774 - RNA, 71 nt, Homo Sapiens
ucucacuacugcacuugacuagucuuaaaacaaagaaagaacgaaugaaugaaugaaucuguggcuggaug

SEQ ID NO: 255775 - RNA, 71 nt, Homo Sapiens
uucauaacauuucucugcaaagaauucucuauggagugaagcgaaugaagugaauaauuucuuaccaaaua

SEQ ID NO: 255776 - RNA, 71 nt, Homo Sapiens
aaaaauuuaaaaaaaugugcaauuuauuccuuuucggcagccgaaugaaaaggagcauucugggaagaagu

SEQ ID NO: 255777 - RNA, 71 nt, Homo Sapiens
cccccaccccccuguacauaauuuuuaaaaccuuuuuuuagcgaaugaaauauugaaguauaagauuccuu

SEQ ID NO: 255778 - RNA, 71 nt, Homo Sapiens
auauuacacaucaagcgaugaaacuggaaaacuacaagccacgaaugaaugaauuaggaaagaaaaaaagu

SEQ ID NO: 255779 - RNA, 52 nt, Homo Sapiens
ugaacuucuucaucugugaaaucgaaugaaugccucuccgcaggcucaauga

SEQ ID NO: 255780 - RNA, 71 nt, Homo Sapiens
ccaaugaggucugcugccaggugugaacaagcaugucucuacgaaugaacgaaacauuggggaucucugcc

SEQ ID NO: 255781 - RNA, 71 nt, Homo Sapiens
aggaaggccggagugggaagcacgucuggaugugucuaguccgaaugaagcgguuucuuauaacccuacuc

SEQ ID NO: 255782 - RNA, 71 nt, Homo Sapiens
aaaaugguuaggacguuacaguaauaaaugucacaauaaaacgaaugaaugaaauugacccggaaguuccu

SEQ ID NO: 255783 - RNA, 71 nt, Homo Sapiens
agaaucccugaccccugcccugggccuuaacacacauccgacgaaugaaugaaggguugccucaguaccgg

SEQ ID NO: 255784 - RNA, 71 nt, Homo Sapiens
uucuucagugauaugaaaaaaucauugagcauucauuauugcgaaugaaguggggaugcauuauuucugac

SEQ ID NO: 255785 - RNA, 71 nt, Homo Sapiens
uuuaucuuugaaauuuugcaugaaaaggaaaugaauggauucgaaugaaauuguccuuuagagcaugauua

SEQ ID NO: 255786 - RNA, 71 nt, Homo Sapiens
caguagcgcaaaggcugcgcagcguuaaugcgcauugcgugcgaaugaaccccugugaacgguugacuaga

SEQ ID NO: 255787 - RNA, 71 nt, Homo Sapiens
gcuuucucuagauugucugugauuggacagacuaugaugagcgaaugaagaaguuggucaguauuguggcu

SEQ ID NO: 255788 - RNA, 71 nt, Homo Sapiens
cagauacaaacuugccuuauuuucuaguuugugaacaagaacgaaugaaguacuauuauugauaacuuaua

SEQ ID NO: 255789 - RNA, 71 nt, Homo Sapiens
augagauauauucauccucagagagagagcuccucauuucucgaaugaaagaacugauacugcagucauug

SEQ ID NO: 255790 - RNA, 64 nt, Homo Sapiens
ccccucucagcuguagcugcaccacccccgcucuggcuaccaggcucucccggcugggcacugc

SEQ ID NO: 255791 - RNA, 64 nt, Homo Sapiens
cccucucccgcuggcagcuccucaggggaacaggggcuaccagaggcugauuucuccccucucc

SEQ ID NO: 255792 - RNA, 59 nt, Homo Sapiens
guccuaacgagaagagauaauuacaaucaggcuaccagaggaagccuuugguccuaacg

SEQ ID NO: 255793 - RNA, 64 nt, Homo Sapiens
cuuugguccuaacgagaagagauaauuacaaucaggcuaccaaaggaagcacuaacuuuggugc

SEQ ID NO: 255794 - RNA, 64 nt, Homo Sapiens
ccauucaaagaggacauaugccaguuaccucaguggcuaccaaccauauuucaccaguggaaag

SEQ ID NO: 255795 - RNA, 64 nt, Homo Sapiens
acgauauggaacuaaaguauauuagcacaggaauggcuaccauaccucauccagcucagaucuu

SEQ ID NO: 255796 - RNA, 64 nt, Homo Sapiens
aagguuaucuaacugaaucacuacugaguugaaucauggcuaucauuagccacagguacugcug

SEQ ID NO: 255797 - RNA, 64 nt, Homo Sapiens
uacaaaauuagcagggccucacagucagcuuccucauggcuaguuuuucccccuuauauuacaa

SEQ ID NO: 255798 - RNA, 64 nt, Homo Sapiens
uuuuaauaaaacuuuauggacauaaaugaaugaucauggcuaugugaaaacagcuauagacaau

SEQ ID NO: 255799 - RNA, 64 nt, Homo Sapiens
uuuuaauaaaacuuuacagacauaaaugaaugaucauggcuaugugaaaacagcuauagacaau

SEQ ID NO: 255800 - RNA, 64 nt, Homo Sapiens
gauggcuuauucaaccauagccccuccaacauaucuacuggaaauucugcugguuaacuuuauc

SEQ ID NO: 255801 - RNA, 64 nt, Homo Sapiens
uacuucacucaacaacaauauucucaagagucuucuacuggaagcuagaaagaaauaggaauuu

SEQ ID NO: 255802 - RNA, 64 nt, Homo Sapiens
auuaaaucuuauuaccaacuacaauucaugcaggcuacuggaaauguacaguuuuaugugggga

SEQ ID NO: 255803 - RNA, 64 nt, Homo Sapiens
gucucuagaucuguuuuucuguuuacaaugcagccuacuggauuaagagauuuauaaucauaau

SEQ ID NO: 255804 - RNA, 64 nt, Homo Sapiens
ggaauuguuggggguccuucauguguucccacuccuacuggaagacccaugucgguuuccggaa

SEQ ID NO: 255805 - RNA, 64 nt, Homo Sapiens
agaugcaaagucuuuuggaccgaugaugucucuacuacuggaucuaucuguauuaacagcaaug

SEQ ID NO: 255806 - RNA, 64 nt, Homo Sapiens
aauucauuucuagacucaaaaccuggagaugcagcuacuggaaugguguuuugucagacuucca

SEQ ID NO: 255807 - RNA, 64 nt, Homo Sapiens
ucguaguccaucaccauuucuuggcauuggaauucuacuggaaaaaaauacaaaaagcaaaaca

SEQ ID NO: 255808 - RNA, 64 nt, Homo Sapiens
auaugcuacagaaugaaaguaggaagugguucuccuacuggaaaacacacacacacaccauuuu

SEQ ID NO: 255809 - RNA, 64 nt, Homo Sapiens
ggagcccagaaaccauggguuuuaucaaaacugacuacuggaccauacuguaaugccuaaucua

SEQ ID NO: 255810 - RNA, 64 nt, Homo Sapiens
caggcucugagugggccugcucucuguagacugaauucagcaccagugaaaggcuuugagaagg

SEQ ID NO: 255811 - RNA, 64 nt, Homo Sapiens
cagcagccagucucagagaccagcacucagccucauucagcauggguccuugaugccagagggc

SEQ ID NO: 255812 - RNA, 64 nt, Homo Sapiens
uccccuuccacccucaccccaaagagaagccuaaauucagcaucuagaugugaggcuuuuugug

SEQ ID NO: 255813 - RNA, 64 nt, Homo Sapiens
gguaccuuauuauugaguaaguuuaaaugaguaaauucagcacuugcaggcaguauuuagggua

SEQ ID NO: 255814 - RNA, 64 nt, Homo Sapiens
acauuauuuccauucuaacaguuuuuauuuuguuauucagcaugggacuuugaaagucaugggg

SEQ ID NO: 255815 - RNA, 64 nt, Homo Sapiens
augccauauuuaauuugaagaucuucauauaucuauucagcaguuugggcuaguuauuuuuuua

SEQ ID NO: 255816 - RNA, 64 nt, Homo Sapiens
aaaauccuugagaucacuucaauuuuaguugaggauucagcacuuauucagcacaaggaaauaa

SEQ ID NO: 255817 - RNA, 64 nt, Homo Sapiens
aggaaauaaaauuuuaguugucuguauguguucuauucagcacaaugacuguuuuuaauaugga

SEQ ID NO: 255818 - RNA, 64 nt, Homo Sapiens
ccaagguuacuuaauucaacuuaacuaucaucuuauucagcaccaagcaugucccaggcacugu

SEQ ID NO: 255819 - RNA, 64 nt, Homo Sapiens
uuccuuuucacugcuguuauauuucaucaugauaauucagcaggcccaaguaaagguuaaaaau

SEQ ID NO: 255820 - RNA, 64 nt, Homo Sapiens
cuuaaucuccaauaaacaucuauguuaaauccaaauucagcauuugcuguuagcuauucagcau

SEQ ID NO: 255821 - RNA, 64 nt, Homo Sapiens
auguuaaauccaaauucagcauuugcuguuagcuauucagcaucaggcacucuuauugauucau

SEQ ID NO: 255822 - RNA, 64 nt, Homo Sapiens
cuaacaacugacaaaucagaguuugccaguucaaauucagcauggcugcagcugauuaagaaau

SEQ ID NO: 255823 - RNA, 64 nt, Homo Sapiens
cguuugucaaaguuccguaggaucagugauggucauucagcaugacugguucugggagaaggug

SEQ ID NO: 255824 - RNA, 64 nt, Homo Sapiens
ugauauuuuuagugggugcauucuuccagaaagaauucagcaauguuaucagaauuaauucuuu

SEQ ID NO: 255825 - RNA, 64 nt, Homo Sapiens
cuuaaacacugaucuuggcagggacggaacuccuauucagcaguuuuuguggaaagcaguaaug

SEQ ID NO: 255826 - RNA, 64 nt, Homo Sapiens
uggaaagcaguaaugcuugcaaaacgugugugucauucagcauuuuaaguggagacuaugcauu

SEQ ID NO: 255827 - RNA, 64 nt, Homo Sapiens
gucugauaaauccuguaguccaagcucaggcauaauucagcauaagaaaauucacaccagagcc

SEQ ID NO: 255828 - RNA, 64 nt, Homo Sapiens
auguggaaaagacuucagauugaauucacaucuuauucagcaucaaagaauucacacaggagag

SEQ ID NO: 255829 - RNA, 64 nt, Homo Sapiens
auguggaaaagcuuucagucaaaccucaugccuuauucagcaucacaaaaugcauaggaaagag

SEQ ID NO: 255830 - RNA, 64 nt, Homo Sapiens
gaagaugggaagauauuuaucaaauucaggcuucauucagcaucugagaguucacaccagggag

SEQ ID NO: 255831 - RNA, 64 nt, Homo Sapiens
uuuuuuaauugggggaaauaagcacuauuaacagauucagcacuacaaguauuuugaauguugu

SEQ ID NO: 255832 - RNA, 64 nt, Homo Sapiens
ucuguaccuuuacuugugaaagguaugcuauauaauucagcaaguaccaacuuguguagcugca

SEQ ID NO: 255833 - RNA, 64 nt, Homo Sapiens
caauugcugcuaguucaguuacauuucugcugauauucagcaaauuucuaaguuuauggugaac

SEQ ID NO: 255834 - RNA, 64 nt, Homo Sapiens
cuuuuaacucaauguguaaauagaucuggagaauauucagcauaaugcuggcucuuguuucacu

SEQ ID NO: 255835 - RNA, 64 nt, Homo Sapiens
cacaaaaggguaacagggcccaugcaaguccaaaauucagcagggcagucaaauuuuaaaccuc

SEQ ID NO: 255836 - RNA, 64 nt, Homo Sapiens
ugucaauauugcuaucagcauuuugggcaaagccauucagcaaguaucuaggaaguuccaaacu

SEQ ID NO: 255837 - RNA, 64 nt, Homo Sapiens
aacucugcuucuaugguagggcaugaggacaacuauucagcaugguuuuagcuucuuggagaug

SEQ ID NO: 255838 - RNA, 64 nt, Homo Sapiens
gcauuuacgaaugaucuucccaucccuuuuucccauucagcaaauauuaguuuguccuccuuua

SEQ ID NO: 255839 - RNA, 64 nt, Homo Sapiens
gccuugauuuccucccaaaguagguaccauggccauucagcacauucucagcugcugcgggagg

SEQ ID NO: 255840 - RNA, 64 nt, Homo Sapiens
uguucauucugcauugagaaaggaagaaacgcuaauucagcauggaaaagaucccaagauggag

SEQ ID NO: 255841 - RNA, 64 nt, Homo Sapiens
uuuucucaucauugggguuagcgggugcagacaaauucagcaauaguaugcagaucagccccuc

SEQ ID NO: 255842 - RNA, 64 nt, Homo Sapiens
cauuugguauguaucugaauuaauucucacuaaaauucagcaaaggacuugauagccccucccc

SEQ ID NO: 255843 - RNA, 64 nt, Homo Sapiens
gggaucaauuugugaguuuuacuuuucuuccccauggaacaaauaaguuauuuccuuuuauaau

SEQ ID NO: 255844 - RNA, 64 nt, Homo Sapiens
agaaaugacugugguguggagggaccacuccagguggaacaaacgguucacugagggguggcac

SEQ ID NO: 255845 - RNA, 64 nt, Homo Sapiens
caaaauauagcagauguaaugaaccguaacucuuuggaacaaacuacuuucuccaguaaaugag

SEQ ID NO: 255846 - RNA, 64 nt, Homo Sapiens
aaacaaaauuaaaaggacaguuauaauccagguuuggaacaaggugcauuuuauuugauauauu

SEQ ID NO: 255847 - RNA, 64 nt, Homo Sapiens
auaauggaaccuccauuuucaaaacccaaauuuuuggaacaaagccccccccaacacaccuaua

SEQ ID NO: 255848 - RNA, 64 nt, Homo Sapiens
gauacuucacuacuuuaauagaucauuauaucauuggaacaacuuuuaauuuccaggguugcuu

SEQ ID NO: 255849 - RNA, 64 nt, Homo Sapiens
gucugugcaaacuggaggacuccuuccaacuuccuggaacaaagcgacaucgccagcagcaggc

SEQ ID NO: 255850 - RNA, 64 nt, Homo Sapiens
gacagugugcucacucucagagccauggauuaccuggaacaaagugcagauuagugcccacggu

SEQ ID NO: 255851 - RNA, 64 nt, Homo Sapiens
uuucaugcuagaaacaggaagauuggaaucugccuggaacaaagaacugcaccuaagcagacca

SEQ ID NO: 255852 - RNA, 64 nt, Homo Sapiens
auagagguuaauuuaaucaaaaugagcuaaaacauggaacaaucacugaauaauuuaaaaagag

SEQ ID NO: 255853 - RNA, 64 nt, Homo Sapiens
agauuuucccuccuggaauuacacauaaaggacacuaagcaauuuucaagguaaauguugccuu

SEQ ID NO: 255854 - RNA, 64 nt, Homo Sapiens
cuccccugcuguuaguaacagucaccaaaauguucuaagcaacuacuuuccuagaguaucauuu

SEQ ID NO: 255855 - RNA, 64 nt, Homo Sapiens
ucuguuaccccuacaggguuguucuauuugauuacuaagcaaaaugugggugacaugaucugag

SEQ ID NO: 255856 - RNA, 64 nt, Homo Sapiens
ggcaauaguauuccugaaauggggagaauauucccuaagcaacuuauuccugaaaauaaaauga

SEQ ID NO: 255857 - RNA, 64 nt, Homo Sapiens
aaugcagcguuauguggaucugauguaggcuaaacuaagcaaaucaucuaugaauagcacuuua

SEQ ID NO: 255858 - RNA, 64 nt, Homo Sapiens
ugucuugcauuuguuuucaagauaggaauuaguacuaagcaauguauuuuuuaaaugccuuaug

SEQ ID NO: 255859 - RNA, 64 nt, Homo Sapiens; identical to SEQ ID NO: 45886

SEQ ID NO: 255860 - RNA, 64 nt, Homo Sapiens; identical to SEQ ID NO: 45887

SEQ ID NO: 255861 - RNA, 64 nt, Homo Sapiens; identical to SEQ ID NO: 45888

SEQ ID NO: 255862 - RNA, 64 nt, Homo Sapiens; identical to SEQ ID NO: 45889

SEQ ID NO: 255863 - RNA, 64 nt, Homo Sapiens; identical to SEQ ID NO: 45890

SEQ ID NO: 255864 - RNA, 64 nt, Homo Sapiens; identical to SEQ ID NO: 45891

SEQ ID NO: 255865 - RNA, 64 nt, Homo Sapiens; identical to SEQ ID NO: 45892

SEQ ID NO: 255866 - RNA, 64 nt, Homo Sapiens; identical to SEQ ID NO: 45893

SEQ ID NO: 255867 - RNA, 64 nt, Homo Sapiens; identical to SEQ ID NO: 45894

SEQ ID NO: 255868 - RNA, 64 nt, Homo Sapiens; identical to SEQ ID NO: 45895

SEQ ID NO: 255869 - RNA, 64 nt, Homo Sapiens; identical to SEQ ID NO: 45896

SEQ ID NO: 255870 - RNA, 64 nt, Homo Sapiens; identical to SEQ ID NO: 45897

SEQ ID NO: 255871 - RNA, 64 nt, Homo Sapiens; identical to SEQ ID NO: 45898

SEQ ID NO: 255872 - RNA, 64 nt, Homo Sapiens; identical to SEQ ID NO: 45899

SEQ ID NO: 255873 - RNA, 64 nt, Homo Sapiens; identical to SEQ ID NO: 45900

SEQ ID NO: 255874 - RNA, 64 nt, Homo Sapiens; identical to SEQ ID NO: 45901

SEQ ID NO: 255875 - RNA, 64 nt, Homo Sapiens; identical to SEQ ID NO: 45902

SEQ ID NO: 255876 - RNA, 64 nt, Homo Sapiens; identical to SEQ ID NO: 45903

SEQ ID NO: 255877 - RNA, 64 nt, Homo Sapiens; identical to SEQ ID NO: 45904

SEQ ID NO: 255878 - RNA, 64 nt, Homo Sapiens; identical to SEQ ID NO: 45905

SEQ ID NO: 255879 - RNA, 64 nt, Homo Sapiens; identical to SEQ ID NO: 45906

SEQ ID NO: 255880 - RNA, 64 nt, Homo Sapiens; identical to SEQ ID NO: 45907

SEQ ID NO: 255881 - RNA, 64 nt, Homo Sapiens; identical to SEQ ID NO: 45908

SEQ ID NO: 255882 - RNA, 64 nt, Homo Sapiens; identical to SEQ ID NO: 45909

SEQ ID NO: 255883 - RNA, 64 nt, Homo Sapiens; identical to SEQ ID NO: 45910

SEQ ID NO: 255884 - RNA, 64 nt, Homo Sapiens; identical to SEQ ID NO: 45911

SEQ ID NO: 255885 - RNA, 64 nt, Homo Sapiens; identical to SEQ ID NO: 45912

SEQ ID NO: 255886 - RNA, 64 nt, Homo Sapiens; identical to SEQ ID NO: 45913

SEQ ID NO: 255887 - RNA, 64 nt, Homo Sapiens; identical to SEQ ID NO: 45914

SEQ ID NO: 255888 - RNA, 64 nt, Homo Sapiens; identical to SEQ ID NO: 45915

SEQ ID NO: 255889 - RNA, 64 nt, Homo Sapiens; identical to SEQ ID NO: 45916

SEQ ID NO: 255890 - RNA, 64 nt, Homo Sapiens; identical to SEQ ID NO: 45917

SEQ ID NO: 255891 - RNA, 64 nt, Homo Sapiens; identical to SEQ ID NO: 45918

SEQ ID NO: 255892 - RNA, 64 nt, Homo Sapiens; identical to SEQ ID NO: 45919

SEQ ID NO: 255893 - RNA, 64 nt, Homo Sapiens; identical to SEQ ID NO: 45920

SEQ ID NO: 255894 - RNA, 64 nt, Homo Sapiens; identical to SEQ ID NO: 45921

SEQ ID NO: 255895 - RNA, 64 nt, Homo Sapiens; identical to SEQ ID NO: 45922

SEQ ID NO: 255896 - RNA, 64 nt, Homo Sapiens; identical to SEQ ID NO: 45923

SEQ ID NO: 255897 - RNA, 64 nt, Homo Sapiens; identical to SEQ ID NO: 45924

SEQ ID NO: 255898 - RNA, 64 nt, Homo Sapiens; identical to SEQ ID NO: 45925

SEQ ID NO: 255899 - RNA, 64 nt, Homo Sapiens; identical to SEQ ID NO: 45926

SEQ ID NO: 255900 - RNA, 64 nt, Homo Sapiens; identical to SEQ ID NO: 45927

SEQ ID NO: 255901 - RNA, 64 nt, Homo Sapiens; identical to SEQ ID NO: 45928

SEQ ID NO: 255902 - RNA, 64 nt, Homo Sapiens; identical to SEQ ID NO: 45929

SEQ ID NO: 255903 - RNA, 64 nt, Homo Sapiens; identical to SEQ ID NO: 45930

SEQ ID NO: 255904 - RNA, 64 nt, Homo Sapiens; identical to SEQ ID NO: 45931

SEQ ID NO: 255905 - RNA, 64 nt, Homo Sapiens; identical to SEQ ID NO: 45932

SEQ ID NO: 255906 - RNA, 64 nt, Homo Sapiens; identical to SEQ ID NO: 45933

SEQ ID NO: 255907 - RNA, 64 nt, Homo Sapiens; identical to SEQ ID NO: 45934

SEQ ID NO: 255908 - RNA, 64 nt, Homo Sapiens; identical to SEQ ID NO: 45935

SEQ ID NO: 255909 - RNA, 64 nt, Homo Sapiens; identical to SEQ ID NO: 45936

SEQ ID NO: 255910 - RNA, 64 nt, Homo Sapiens; identical to SEQ ID NO: 45937

SEQ ID NO: 255911 - RNA, 64 nt, Homo Sapiens; identical to SEQ ID NO: 45938

SEQ ID NO: 255912 - RNA, 64 nt, Homo Sapiens; identical to SEQ ID NO: 45939

SEQ ID NO: 255913 - RNA, 64 nt, Homo Sapiens; identical to SEQ ID NO: 45940

SEQ ID NO: 255914 - RNA, 64 nt, Homo Sapiens; identical to SEQ ID NO: 45941

SEQ ID NO: 255915 - RNA, 64 nt, Homo Sapiens; identical to SEQ ID NO: 45942

SEQ ID NO: 255916 - RNA, 64 nt, Homo Sapiens; identical to SEQ ID NO: 45943

SEQ ID NO: 255917 - RNA, 64 nt, Homo Sapiens; identical to SEQ ID NO: 45944

SEQ ID NO: 255918 - RNA, 64 nt, Homo Sapiens; identical to SEQ ID NO: 45945

SEQ ID NO: 255919 - RNA, 64 nt, Homo Sapiens; identical to SEQ ID NO: 45946

SEQ ID NO: 255920 - RNA, 64 nt, Homo Sapiens; identical to SEQ ID NO: 45947

SEQ ID NO: 255921 - RNA, 64 nt, Homo Sapiens; identical to SEQ ID NO: 45948

SEQ ID NO: 255922 - RNA, 64 nt, Homo Sapiens; identical to SEQ ID NO: 45949

SEQ ID NO: 255923 - RNA, 64 nt, Homo Sapiens; identical to SEQ ID NO: 45950

SEQ ID NO: 255924 - RNA, 64 nt, Homo Sapiens; identical to SEQ ID NO: 45951

SEQ ID NO: 255925 - RNA, 64 nt, Homo Sapiens; identical to SEQ ID NO: 45952

SEQ ID NO: 255926 - RNA, 64 nt, Homo Sapiens; identical to SEQ ID NO: 45953

SEQ ID NO: 255927 - RNA, 64 nt, Homo Sapiens; identical to SEQ ID NO: 45954

SEQ ID NO: 255928 - RNA, 64 nt, Homo Sapiens; identical to SEQ ID NO: 45955

SEQ ID NO: 255929 - RNA, 64 nt, Homo Sapiens; identical to SEQ ID NO: 45956

SEQ ID NO: 255930 - RNA, 64 nt, Homo Sapiens; identical to SEQ ID NO: 45957

SEQ ID NO: 255931 - RNA, 64 nt, Homo Sapiens; identical to SEQ ID NO: 45958

SEQ ID NO: 255932 - RNA, 64 nt, Homo Sapiens; identical to SEQ ID NO: 45959

SEQ ID NO: 255933 - RNA, 64 nt, Homo Sapiens; identical to SEQ ID NO: 45960

SEQ ID NO: 255934 - RNA, 64 nt, Homo Sapiens; identical to SEQ ID NO: 45961

SEQ ID NO: 255935 - RNA, 64 nt, Homo Sapiens; identical to SEQ ID NO: 45962

SEQ ID NO: 255936 - RNA, 64 nt, Homo Sapiens; identical to SEQ ID NO: 45963

SEQ ID NO: 255937 - RNA, 64 nt, Homo Sapiens; identical to SEQ ID NO: 45964

SEQ ID NO: 255938 - RNA, 64 nt, Homo Sapiens; identical to SEQ ID NO: 45965

SEQ ID NO: 255939 - RNA, 64 nt, Homo Sapiens; identical to SEQ ID NO: 45966

SEQ ID NO: 255940 - RNA, 64 nt, Homo Sapiens; identical to SEQ ID NO: 45967

SEQ ID NO: 255941 - RNA, 64 nt, Homo Sapiens; identical to SEQ ID NO: 45968

SEQ ID NO: 255942 - RNA, 64 nt, Homo Sapiens; identical to SEQ ID NO: 45969

SEQ ID NO: 255943 - RNA, 64 nt, Homo Sapiens; identical to SEQ ID NO: 45970

SEQ ID NO: 255944 - RNA, 64 nt, Homo Sapiens; identical to SEQ ID NO: 45971

SEQ ID NO: 255945 - RNA, 64 nt, Homo Sapiens; identical to SEQ ID NO: 45972

SEQ ID NO: 255946 - RNA, 64 nt, Homo Sapiens; identical to SEQ ID NO: 45973

SEQ ID NO: 255947 - RNA, 64 nt, Homo Sapiens; identical to SEQ ID NO: 45974

SEQ ID NO: 255948 - RNA, 64 nt, Homo Sapiens; identical to SEQ ID NO: 45975

SEQ ID NO: 255949 - RNA, 64 nt, Homo Sapiens; identical to SEQ ID NO: 45976

SEQ ID NO: 255950 - RNA, 64 nt, Homo Sapiens; identical to SEQ ID NO: 45977

SEQ ID NO: 255951 - RNA, 64 nt, Homo Sapiens; identical to SEQ ID NO: 45978

SEQ ID NO: 255952 - RNA, 64 nt, Homo Sapiens; identical to SEQ ID NO: 45979

SEQ ID NO: 255953 - RNA, 64 nt, Homo Sapiens; identical to SEQ ID NO: 45980

SEQ ID NO: 255954 - RNA, 64 nt, Homo Sapiens; identical to SEQ ID NO: 45981

SEQ ID NO: 255955 - RNA, 64 nt, Homo Sapiens; identical to SEQ ID NO: 45982

SEQ ID NO: 255956 - RNA, 64 nt, Homo Sapiens; identical to SEQ ID NO: 45983

SEQ ID NO: 255957 - RNA, 64 nt, Homo Sapiens; identical to SEQ ID NO: 45984

SEQ ID NO: 255958 - RNA, 64 nt, Homo Sapiens; identical to SEQ ID NO: 45985

SEQ ID NO: 255959 - RNA, 64 nt, Homo Sapiens; identical to SEQ ID NO: 45986

SEQ ID NO: 255960 - RNA, 64 nt, Homo Sapiens; identical to SEQ ID NO: 45987

SEQ ID NO: 255961 - RNA, 64 nt, Homo Sapiens; identical to SEQ ID NO: 45988

SEQ ID NO: 255962 - RNA, 64 nt, Homo Sapiens; identical to SEQ ID NO: 45989

SEQ ID NO: 255963 - RNA, 64 nt, Homo Sapiens; identical to SEQ ID NO: 45990

SEQ ID NO: 255964 - RNA, 64 nt, Homo Sapiens; identical to SEQ ID NO: 45991

SEQ ID NO: 255965 - RNA, 64 nt, Homo Sapiens; identical to SEQ ID NO: 45992

SEQ ID NO: 255966 - RNA, 64 nt, Homo Sapiens; identical to SEQ ID NO: 45993

SEQ ID NO: 255967 - RNA, 64 nt, Homo Sapiens; identical to SEQ ID NO: 45994

SEQ ID NO: 255968 - RNA, 64 nt, Homo Sapiens; identical to SEQ ID NO: 45995

SEQ ID NO: 255969 - RNA, 64 nt, Homo Sapiens; identical to SEQ ID NO: 45996

SEQ ID NO: 255970 - RNA, 64 nt, Homo Sapiens; identical to SEQ ID NO: 45997

SEQ ID NO: 255971 - RNA, 64 nt, Homo Sapiens; identical to SEQ ID NO: 45998

SEQ ID NO: 255972 - RNA, 64 nt, Homo Sapiens; identical to SEQ ID NO: 45999

SEQ ID NO: 255973 - RNA, 64 nt, Homo Sapiens; identical to SEQ ID NO: 46000

SEQ ID NO: 255974 - RNA, 64 nt, Homo Sapiens; identical to SEQ ID NO: 46001

SEQ ID NO: 255975 - RNA, 64 nt, Homo Sapiens; identical to SEQ ID NO: 46002

SEQ ID NO: 255976 - RNA, 64 nt, Homo Sapiens; identical to SEQ ID NO: 46003

SEQ ID NO: 255977 - RNA, 64 nt, Homo Sapiens; identical to SEQ ID NO: 46004

SEQ ID NO: 255978 - RNA, 64 nt, Homo Sapiens; identical to SEQ ID NO: 46005

SEQ ID NO: 255979 - RNA, 62 nt, Homo Sapiens; identical to SEQ ID NO: 46006

SEQ ID NO: 255980 - RNA, 64 nt, Homo Sapiens; identical to SEQ ID NO: 46007

SEQ ID NO: 255981 - RNA, 64 nt, Homo Sapiens; identical to SEQ ID NO: 46008

SEQ ID NO: 255982 - RNA, 64 nt, Homo Sapiens; identical to SEQ ID NO: 46009

SEQ ID NO: 255983 - RNA, 64 nt, Homo Sapiens; identical to SEQ ID NO: 46010

SEQ ID NO: 255984 - RNA, 64 nt, Homo Sapiens; identical to SEQ ID NO: 46011

SEQ ID NO: 255985 - RNA, 64 nt, Homo Sapiens; identical to SEQ ID NO: 46012

SEQ ID NO: 255986 - RNA, 64 nt, Homo Sapiens
caaagcuguaaagaccauugucuuaaauacuacaacaacuuaacacccuuuugugaagaucaca

SEQ ID NO: 255987 - RNA, 64 nt, Homo Sapiens
acuucucaguugccaaucuuugcucauauuaaaaacaacuuacaaauacuuaguuuuuguaucu

SEQ ID NO: 255988 - RNA, 64 nt, Homo Sapiens
agaaauauaaagaaauggccucaacacagagaucacaacuuagacauauuuaguaugguuauag

SEQ ID NO: 255989 - RNA, 64 nt, Homo Sapiens
ggauuagcuuuuggguuuaacugaagaaaauaguacaacuuaauuaucacugaauuacauuuau

SEQ ID NO: 255990 - RNA, 64 nt, Homo Sapiens
aaggcaucauugaggaugauacaaaaucaagaugacaacuuauaaaaaauuaagaagacaacuu

SEQ ID NO: 255991 - RNA, 64 nt, Homo Sapiens
aaaucaagaugacaacuuaugaaaaauuaagaagacaacuuacaaaggcuucuauuuggaggaa

SEQ ID NO: 255992 - RNA, 64 nt, Homo Sapiens
aagugcacggucgaauuauucuucguucaucuucacaacuuaacgacguuuccuugaguugcua

SEQ ID NO: 255993 - RNA, 64 nt, Homo Sapiens
gugaaaucauaccauugguuacaaagcaaauuagacaacuuaauaccgggaugaacccaccacc

SEQ ID NO: 255994 - RNA, 64 nt, Homo Sapiens
auuauaagggagagcugagccaguuguccuauggacaacuuauuuaaaaauauuucagauauca

SEQ ID NO: 255995 - RNA, 64 nt, Homo Sapiens
uuaaucaacuguagguuauuuaaaauaaauuccuacaacuuaauggaaacuuaagugucugccu

SEQ ID NO: 255996 - RNA, 63 nt, Homo Sapiens
acaccauccacucacuccaacaaagaacacuuagaaugauaaaaaaaaaaaaaaaaaaccuga

SEQ ID NO: 255997 - RNA, 63 nt, Homo Sapiens
uuuagagaagucccugauuccuucuuaaacuuggaaugauagaugaaauucacaccccugcag

SEQ ID NO: 255998 - RNA, 60 nt, Homo Sapiens
gaagaaaauuccauuuauaaaguacugagagaaugauauuggauuuugcugaacaggccu

SEQ ID NO: 255999 - RNA, 63 nt, Homo Sapiens
cucacugcauuuaauaaauauuuaauaaaugaugaaugauagaaguuuccaucuacaauauau

SEQ ID NO: 256000 - RNA, 63 nt, Homo Sapiens
ggaaagggacuauaaaaguguacaauguuaauggaaugauacgguaccugaaagccuuguuuu

SEQ ID NO: 256001 - RNA, 63 nt, Homo Sapiens
ugagccucucccagcuccacuucuaaugcuagagaaugauaacuaagacuucugugcauuuga

SEQ ID NO: 256002 - RNA, 63 nt, Homo Sapiens
guuuucucauuauuuaugaaacuuaaccauacagaaugauauaacuccugugcaaugaaggug

SEQ ID NO: 256003 - RNA, 63 nt, Homo Sapiens
gcugcaccaacaauaucccguucugccaauuuugaaugauauaagccccaccagcuucaggac

SEQ ID NO: 256004 - RNA, 63 nt, Homo Sapiens
aaagugaaguaguagccacaugcuaauaagauagaaugauacaguuaaccuagaaauguagcu

SEQ ID NO: 256005 - RNA, 63 nt, Homo Sapiens
agcauugguccccaagccaguauuuguugaaaugaaugauaagcaagccugguacucaguaaa

SEQ ID NO: 256006 - RNA, 63 nt, Homo Sapiens
ccaaaucugcccaagugacaucuucaaaaggaggaaugauaacaagcaggcuguuugcucacu

SEQ ID NO: 256007 - RNA, 63 nt, Homo Sapiens
gaauuaaauuagaucucucuugucucucuacuugaaugauaaagguuugcuuuggaaaaugcc

SEQ ID NO: 256008 - RNA, 63 nt, Homo Sapiens
gaauagaccaugggcuacuauuuuuauaaacuugaaugauaaagacugaaguuccagcuuuac

SEQ ID NO: 256009 - RNA, 63 nt, Homo Sapiens
uaguguauauauauuuuguaucaugaucaucuggaaugauacuugccauacuguuuuuaaagu

SEQ ID NO: 256010 - RNA, 63 nt, Homo Sapiens
agaaaauguuuuccuuguuuugguuguaaaacagaaugauauuugauucuucuggguuuauac

SEQ ID NO: 256011 - RNA, 63 nt, Homo Sapiens
aauuuugccuuuuuuuuuuuccgcccgcccccagaaugauauuuaguugcuucccacugcccc

SEQ ID NO: 256012 - RNA, 63 nt, Homo Sapiens
ugcucaauaaaugaaugaauugggugaauaguugaaugauaggggcacucaauaaaugcugaa

SEQ ID NO: 256013 - RNA, 63 nt, Homo Sapiens
ugcacaguggcagaacaaacuacccccaucccagaaugauaacuucucauugggagaguaagg

SEQ ID NO: 256014 - RNA, 63 nt, Homo Sapiens
ggugacucaggggaagaagaaagcaagaggaaggaaugauaaucggcccaggcccaucuucca

SEQ ID NO: 256015 - RNA, 63 nt, Homo Sapiens
uagguuccccaccaaaagcagcuaagccuguuugaaugauacgugcagugaagguucucuaca

SEQ ID NO: 256016 - RNA, 63 nt, Homo Sapiens
uaugaauggcuuuucaauucagaucaaaaaauugaaugauaaaggagaauucauaacauuuga

SEQ ID NO: 256017 - RNA, 63 nt, Homo Sapiens
agguuuuuuuuucucacagacaucugaaauaaggaaugauauaauaacucaccuggcaucuua

SEQ ID NO: 256018 - RNA, 63 nt, Homo Sapiens
uuuaauaaaagaaggaaaaaugaucaaagccuggaaugauagcaacaaauauucuuggaucuu

SEQ ID NO: 256019 - RNA, 63 nt, Homo Sapiens
caaauagugcaaauuugccaagagcuggcagcugaaugauagauuuaagugugcaaacaaguu

SEQ ID NO: 256020 - RNA, 63 nt, Homo Sapiens
uuuuuggaaaauuuaagaaaauccuacauguuggaaugauagcaagguuaaaauaggggagaa

SEQ ID NO: 256021 - RNA, 63 nt, Homo Sapiens
aaguuucucgaguuagccuuuugagaaauuuuagaaugauaggccgaaaaauguuucuucagc

SEQ ID NO: 256022 - RNA, 63 nt, Homo Sapiens
ucugaaaucaaaauuccucaugcugagucuguggaaugauacuaaauauguauaaauauauga

SEQ ID NO: 256023 - RNA, 63 nt, Homo Sapiens
aucuuuugugacuuugagccuuuuaaguaguuugaaugauaagacuuaaaauguuucauaauu

SEQ ID NO: 256024 - RNA, 63 nt, Homo Sapiens
acgugggaucucaguaugguacuuggacagcaggaaugauacauauaaucugaacuugggaaa

SEQ ID NO: 256025 - RNA, 63 nt, Homo Sapiens
agaaacuggaggcugcaacaggagggaaaggcagaaugauaucacagcaguacuauuuuuuuu

SEQ ID NO: 256026 - RNA, 63 nt, Homo Sapiens
uuccugggacucaaauguaugcaguacuauucagaaugauauacacacauauguguauaugua

SEQ ID NO: 256027 - RNA, 63 nt, Homo Sapiens
auauuuggaggauauugaaagugugaaaaaaaagaaugauaaucuuuuaaaggcucuacaauu

SEQ ID NO: 256028 - RNA, 63 nt, Homo Sapiens
cauuucaccccacaugacuaggaauccacaucagaaugauacagaguuagcagguuuuucuaa

SEQ ID NO: 256029 - RNA, 63 nt, Homo Sapiens
ucuguaagcuucauccaugcugguuauugcacugaaugauauauuauuagggcauguuaacag

SEQ ID NO: 256030 - RNA, 63 nt, Homo Sapiens
uuuuaaaugaguuaaugaaucugccagaucugugaaugauagagauuaugcuaaauuaaugcu

SEQ ID NO: 256031 - RNA, 63 nt, Homo Sapiens
ggagauaaacagccaaauagcaaauaggucacugaaugauaagauuugcaccuuagaacaaua

SEQ ID NO: 256032 - RNA, 52 nt, Homo Sapiens
cuguauauaacuguaaaauaaggaaugauaaagccauaguccagugggauaa

SEQ ID NO: 256033 - RNA, 63 nt, Homo Sapiens
ucagucuugccuuugaagggguaucugaguauugaaugauaaucuaaaacacaaugugaaaau

SEQ ID NO: 256034 - RNA, 63 nt, Homo Sapiens
uaaauauugcauguuugcuuuaugcucuucagagaaugauauagaacuugaagauuaauaaaa

SEQ ID NO: 256035 - RNA, 63 nt, Homo Sapiens
acaaguugagcaucucuaaucauaagccagagugaaugauacuuuucaaguacaaggucaaua

SEQ ID NO: 256036 - RNA, 63 nt, Homo Sapiens
ggaaacugucaagagggggcuucaaaggaacuggaaugauaauuaagaccuccucccaagcac

SEQ ID NO: 256037 - RNA, 63 nt, Homo Sapiens
auuuuuaaaggcuucauuccaaaaguaucagaagaaugauaccuuuuuccuuaaguauaaaaa

SEQ ID NO: 256038 - RNA, 63 nt, Homo Sapiens
ugaggccagcagucagaauacauguuuaacucagaaugauaugucauuugugauauuauaaaa

SEQ ID NO: 256039 - RNA, 63 nt, Homo Sapiens
agauuaggauugacaaguaaagauacugcuauggaaugauacauuguauuuucugcauugugu

SEQ ID NO: 256040 - RNA, 63 nt, Homo Sapiens
ccugccucagaaaaagcuuuuccauuacacugugaaugauaccuguuuuguuguuucugaauu

SEQ ID NO: 256041 - RNA, 63 nt, Homo Sapiens
uuuaaaggaagauacagaggugauuguacuucagaaugauaaacccauauaccaccuaaaauc

SEQ ID NO: 256042 - RNA, 63 nt, Homo Sapiens
ugaaggaacucaugaaaauccugaguuaauuuggaaugauaauuccagagauaaaguguccac

SEQ ID NO: 256043 - RNA, 63 nt, Homo Sapiens
ugguuugaauuggaugcagugugggccauccuggaaugauacugacugauuaauuauuccuga

SEQ ID NO: 256044 - RNA, 63 nt, Homo Sapiens
aaacaaauuucaauugcuugaagcaauuguucugaaugauacuuuuucauucacauucaagaa

SEQ ID NO: 256045 - RNA, 63 nt, Homo Sapiens
aaaauagccaaagauaggagacgucugaauuuugaaugauaaacagugauguuuuaaaaaagc

SEQ ID NO: 256046 - RNA, 63 nt, Homo Sapiens
uuucugcaaauuauucagccuccaaaugcaaaugaaugauauaaaaauaaguagggaacaugg

SEQ ID NO: 256047 - RNA, 63 nt, Homo Sapiens
gaucuuauaucuguuaaaaguuugugugaaugugaaugauacucuuucuaaaguguguguaug

SEQ ID NO: 256048 - RNA, 63 nt, Homo Sapiens
aauaaccaggggcacaugggggaacguggaugggaaugauaguguaucucagcgggggguggg

SEQ ID NO: 256049 - RNA, 63 nt, Homo Sapiens
caggcauccugguguccugagaggcucuugcaggaaugauacguggcagugccugcagcgagg

SEQ ID NO: 256050 - RNA, 55 nt, Homo Sapiens
uguuauuacuuuuacagugaaauuagaaugauauuuucaucuccugcuugucuga

SEQ ID NO: 256051 - RNA, 63 nt, Homo Sapiens
cauugcaagcuggcaaauuuauguagcuauguggaaugauaugucauaauguaaaauuagaua

SEQ ID NO: 256052 - RNA, 63 nt, Homo Sapiens
caguaagcacauguuuauucgaggcaagagacagaaugauaucacaugaacacagcugcugaa

SEQ ID NO: 256053 - RNA, 63 nt, Homo Sapiens
ugaagaauuauuaguaauagaguacaacuuuuggaaugauaccuaacuguuguauugugacua

SEQ ID NO: 256054 - RNA, 63 nt, Homo Sapiens
ugcaauaguuguaaaucuacccuucugucagcagaaugauaagaucucaaucuucaguuuugg

SEQ ID NO: 256055 - RNA, 63 nt, Homo Sapiens
cugacauuauacucuaaaagcacagcuguuaacgaaugauaaaaaagcagagccacugucuaa

SEQ ID NO: 256056 - RNA, 63 nt, Homo Sapiens
ccucacucauuuagccauuccaugggggcggaugaaugauaucacacuugaaaaagauaaggu

SEQ ID NO: 256057 - RNA, 63 nt, Homo Sapiens
uuuaucaaaucucacagacaauauaaacagguugaaugauauaaaaguaauaaaacuuaguuu

SEQ ID NO: 256058 - RNA, 63 nt, Homo Sapiens
aguauaacuggcuuaguaaguauauccuacucugaaugauaaaaauauagucaagcuaaaaua

SEQ ID NO: 256059 - RNA, 63 nt, Homo Sapiens
caguugagaaaauuugaauguggauuagauuuugaaugauauuggauaauuauugguaauuuu

SEQ ID NO: 256060 - RNA, 63 nt, Homo Sapiens; identical to SEQ ID NO: 256059

SEQ ID NO: 256061 - RNA, 63 nt, Homo Sapiens
ucuaccaaguuuucaccuuguuucaggucagaggaaugauagaauuugucauuuuucuuacaa

SEQ ID NO: 256062 - RNA, 63 nt, Homo Sapiens
guuuugaaagucuuuaacuaaauuaagauugcagaaugauagugauuauucaauuagauuuua

SEQ ID NO: 256063 - RNA, 63 nt, Homo Sapiens
cauuuuuuagugucacacugacuuuuaaaauuugaaugauauauagacuuuguuuuuuuaaug

SEQ ID NO: 256064 - RNA, 63 nt, Homo Sapiens
guugcuaaauucuccauggacauagagagaaaggaaugauauucucaucaucaucuucaucau

SEQ ID NO: 256065 - RNA, 63 nt, Homo Sapiens
ucuguaaaagauuuguccaauaaacgacuuaaugaaugauacaucagucagauuuuaggaagg

SEQ ID NO: 256066 - RNA, 63 nt, Homo Sapiens
ccugaccuuuagucuuucacuuccaauuuuguggaaugauauuuuaggaauaacggacuuuua

SEQ ID NO: 256067 - RNA, 63 nt, Homo Sapiens
uucuucagccacugacugcuuggguugggcugugaaugauaauggaauggcuggagucugcug

SEQ ID NO: 256068 - RNA, 63 nt, Homo Sapiens
gugaugcugucagccacagcuuccugccguagagaaugauagagcagcugcucacacaggagg

SEQ ID NO: 256069 - RNA, 63 nt, Homo Sapiens
uuuuuuuuuuuuaacaucuuuguuuuuaaaauagaaugauagaacuuugccagucuuuaagau

SEQ ID NO: 256070 - RNA, 63 nt, Homo Sapiens
gacuuagugaauucuaaggauuuuguaaccucugaaugauauguagcuuuggugaaacugggg

SEQ ID NO: 256071 - RNA, 63 nt, Homo Sapiens
auuucacucugcguucuccuaacugacaugguugaaugauagcgaaaugccccgggggcagca

SEQ ID NO: 256072 - RNA, 63 nt, Homo Sapiens
gauuuuuaaaaaaguaauaaugugaaugaauacgaaugauacauugcuuaaucaguaagucuu

SEQ ID NO: 256073 - RNA, 63 nt, Homo Sapiens
uucuugaagacaucgauauaucuagugaaaaaggaaugauauagacuuauauuuugaaugggu

SEQ ID NO: 256074 - RNA, 63 nt, Homo Sapiens
agugaauauaaauggggcugagugguaaagagugaaugauaguuagacagcagggaagauauu

SEQ ID NO: 256075 - RNA, 63 nt, Homo Sapiens
aauaaauuuaauuuaccaaaaaauuaaaagaaggaaugauaagacuaaaaauauauauagaca

SEQ ID NO: 256076 - RNA, 63 nt, Homo Sapiens
aauaggauacaauguauaagauucaggcacugagaaugauaguaagcaguuaaacugauuagu

SEQ ID NO: 256077 - RNA, 63 nt, Homo Sapiens
uugaucagauucaguaaaguuguacaaaaaauggaaugauaggaaagcuacauguaaaguucu

SEQ ID NO: 256078 - RNA, 63 nt, Homo Sapiens
acucuagccaagaaaaagcuaauucuggggauagaaugauaaaagacucaagcacuaaaaaua

SEQ ID NO: 256079 - RNA, 63 nt, Homo Sapiens
gucacauaaaggaagucuuaaguggaguucacagaaugauaauguaucuauuugucauuugug

SEQ ID NO: 256080 - RNA, 63 nt, Homo Sapiens
gagaauacuuuaaagggaaguggaaguauaagugaaugauauuuuucuuuuacauguaaacaa

SEQ ID NO: 256081 - RNA, 55 nt, Homo Sapiens
uaagugaauggaaugaaugauguuugaaugauauauaacaaaccaaaggauauua

SEQ ID NO: 256082 - RNA, 63 nt, Homo Sapiens
uuuccuuuuucugaaauguaaucauugaugcuugaaugauagaauuuuaguacuguaaacagg

SEQ ID NO: 256083 - RNA, 63 nt, Homo Sapiens
ucccaucucugcaagcagggauaacgguaaugagaaugauaauaaucauuauaugcagaccuu

SEQ ID NO: 256084 - RNA, 63 nt, Homo Sapiens
gucacuacugaauuuugacaggaggaaggaauagaaugauagcuuguuuuauuuguaaagcuu

SEQ ID NO: 256085 - RNA, 63 nt, Homo Sapiens
ugcaggggauauuuuuugagacucugagaagcugaaugauacaauuuuccuguuuuuauggaa

SEQ ID NO: 256086 - RNA, 63 nt, Homo Sapiens
gcugaagaaucuacuuaaccuuuuuccaguaaggaaugauauuccaugggugcuuguugggcc

SEQ ID NO: 256087 - RNA, 63 nt, Homo Sapiens
ugucaugguggucuauaacugaaaacucugcuagaaugauaaaucauucaguaguuacugaaa

SEQ ID NO: 256088 - RNA, 63 nt, Homo Sapiens
uaggacauucaguccagugguaagauaugucuugaaugauaauguaaaugcuugauaaaucuu

SEQ ID NO: 256089 - RNA, 63 nt, Homo Sapiens
cuagaauagaagaaagagaaaggauuggaccaugaaugauaugcauucaaccaacuguaaugc

SEQ ID NO: 256090 - RNA, 63 nt, Homo Sapiens
uuuuucucuuugcaaagacauagcuaggaaagcgaaugauaagggaaaaguucucagggaauu

SEQ ID NO: 256091 - RNA, 63 nt, Homo Sapiens
uucuuagaauaagaagugcauucaauccuaggagaaugauaauccuggacaugggugaacaug

SEQ ID NO: 256092 - RNA, 63 nt, Homo Sapiens
uggugacaaccuacuuugcuuggcugagugaaggaaugauauucauauauucauuuauuccau

SEQ ID NO: 256093 - RNA, 63 nt, Homo Sapiens
uuggaaagcugaucuuuucugauauaaaauguugaaugauauuaucugguuuucugauauuuu

SEQ ID NO: 256094 - RNA, 63 nt, Homo Sapiens
gcaguauuguuuucuuauaugugcaaugaaguggaaugauaaacaguaugccuuuaauuuaua

SEQ ID NO: 256095 - RNA, 63 nt, Homo Sapiens
gaaaaaugcuuauguauugacagaacacuucuagaaugauacccaaacuccuggagugggagu

SEQ ID NO: 256096 - RNA, 63 nt, Homo Sapiens
acauagcuaugcacuaugaaaauuaaauggaaugaaugauauguauauuacucaaaauaaagu

SEQ ID NO: 256097 - RNA, 63 nt, Homo Sapiens
uuguaaauaaagacauucagcauauucacuauagaaugauaucaccagcacauucguuuuguu

SEQ ID NO: 256098 - RNA, 63 nt, Homo Sapiens
uccauuucucuaugaaauaugcguggugaguuggaaugauacgugagccacaggaaguuuggg

SEQ ID NO: 256099 - RNA, 63 nt, Homo Sapiens
caacauaaugcugauaaacuacuggaaauguaugaaugauaauuuguagcuacuacauuccag

SEQ ID NO: 256100 - RNA, 63 nt, Homo Sapiens
uuuuuuuuuuuuaaagauaaggaacagauaacugaaugauagagucccaaugucagaguucuu

SEQ ID NO: 256101 - RNA, 63 nt, Homo Sapiens
agaaagcacccuaauugacuucuaaacuuuguugaaugauaaugcacucuaacaauguuuacu

SEQ ID NO: 256102 - RNA, 63 nt, Homo Sapiens
gauuagacuuugagccaagggauuuauguuauagaaugauacuaagcaaaaagcguaguuucu

SEQ ID NO: 256103 - RNA, 63 nt, Homo Sapiens
gucaugagauccuacuuaguaugauccuggcuagaaugauaauuaaaaguauuuaauuugaag

SEQ ID NO: 256104 - RNA, 63 nt, Homo Sapiens
uuuauacaaaaggguuuuuguuuauagcuuaaggaaugauacugugcucugcuuggugcaugg

SEQ ID NO: 256105 - RNA, 63 nt, Homo Sapiens
auaucuggaguacauuaaaagugugaaagaaaagaaugauaaucuucuaaaggcuauacaauu

SEQ ID NO: 256106 - RNA, 63 nt, Homo Sapiens
gauggaucuguuggcggguuuuggauguguaaagaaugauauauauauuaaauaggucaauca

SEQ ID NO: 256107 - RNA, 63 nt, Homo Sapiens
aucuucuccuuuuccugguugaacucccuaaaugaaugauauucauuccaacugcugccccuc

SEQ ID NO: 256108 - RNA, 63 nt, Homo Sapiens
auacuacuuaauuacuuaagauguuuauuaauagaaugauaaauguacagaguaaccuauaag

SEQ ID NO: 256109 - RNA, 63 nt, Homo Sapiens
cuucuagcuuugugucuuguuucagaccauguggaaugauaaauacucuuuuugugcuucuga

SEQ ID NO: 256110 - RNA, 63 nt, Homo Sapiens
caagacaaacuuacccugauacccuguuguaaagaaugauacacucuacuguccuagaguaua

SEQ ID NO: 256111 - RNA, 63 nt, Homo Sapiens
uuuugaaagacuuuuguauagaaaaccuauggggaaugauauuaaaaaucagguuuuaaacag

SEQ ID NO: 256112 - RNA, 63 nt, Homo Sapiens
gaacagcauuucccugcagcaccaaccaguucagaaugauacgaagagggagggugucucaca

SEQ ID NO: 256113 - RNA, 63 nt, Homo Sapiens
gagcaucuuuucaugagcuuuuucccugauggcgaaugauauucauugugauuuugguuugca

SEQ ID NO: 256114 - RNA, 63 nt, Homo Sapiens
uaaauauauuuauagccugacuaaaaacugauugaaugauauauacuaugguuuucauuuacu

SEQ ID NO: 256115 - RNA, 63 nt, Homo Sapiens
gaagaguguuuuuucauaaaaccuuuuccugaggaaugauacauuuucaggacuugcuggguc

SEQ ID NO: 256116 - RNA, 63 nt, Homo Sapiens
ccaaaaaaauuuauaaacuaauuuuguacguaugaaugauaucuuugaccucaauggagguuu

SEQ ID NO: 256117 - RNA, 63 nt, Homo Sapiens
ugcuguuuaccccaucucucucuuauaucacuugaaugauauauuguaagugagagguaaagg

SEQ ID NO: 256118 - RNA, 63 nt, Homo Sapiens
cuugucagagccuauagccaccugguaagaaaagaaugauagguagcagaugauuucuguuca

SEQ ID NO: 256119 - RNA, 63 nt, Homo Sapiens
caugaagauaacuuuuuuuaccuccaaaaucaugaaugauacauucccauugcaccagcuugu

SEQ ID NO: 256120 - RNA, 63 nt, Homo Sapiens
uuugauuuguaagaggccaucacauagcacauagaaugauauucauccaucccccuagcucac

SEQ ID NO: 256121 - RNA, 63 nt, Homo Sapiens
gauauuuucuguuguguugguaaugugaaggcugaaugauagagugucuuugaaacuugaaca

SEQ ID NO: 256122 - RNA, 63 nt, Homo Sapiens
gugccuuaauugguuuucaugucuauaaauuuugaaugauacucucgggauuauugcucuucu

SEQ ID NO: 256123 - RNA, 63 nt, Homo Sapiens
auagauccauccaaaugauuucucuguacaaaugaaugauacuauuaaaaaaaaaaaaagcac

SEQ ID NO: 256124 - RNA, 63 nt, Homo Sapiens
uuucaaugacuuucaauacuuccccugaaggaagaaugauaaggagaaaugucuguuuugagg

SEQ ID NO: 256125 - RNA, 63 nt, Homo Sapiens
ucuacucauaaguauuuuuuucuauuuagacuugaaugauaaucuguuuuuugaucaguauau

SEQ ID NO: 256126 - RNA, 63 nt, Homo Sapiens
uccauugcuuugaaaaaguuaaugcuuaagagggaaugauaugcauuugacuuguuaaacagc

SEQ ID NO: 256127 - RNA, 63 nt, Homo Sapiens
caucauagaacauggcagucguuuuuguuccaagaaugauaugaaaggugaagaagaggccca

SEQ ID NO: 256128 - RNA, 63 nt, Homo Sapiens
cugaauuuggccugcacuaauugggauugcuaugaaugauacccucuuuaagaguuaguuucu

SEQ ID NO: 256129 - RNA, 63 nt, Homo Sapiens
uuagauccauuucuuuugugaaaagugauuaaugaaugauaauguuaucacuguaaaacacag

SEQ ID NO: 256130 - RNA, 63 nt, Homo Sapiens
aagaaaggucagagaaaugcggagcaaaaacuagaaugauacaucucauuaaagugauugcug

SEQ ID NO: 256131 - RNA, 63 nt, Homo Sapiens
guauuuuaacaaaucuuaauaaaggagaauucagaaugauacaauuugaccugcaguauugaa

SEQ ID NO: 256132 - RNA, 63 nt, Homo Sapiens
gaaauauguauauaaauaucucuauauucuuuggaaugauacuaaagucucuggucuaggacc

SEQ ID NO: 256133 - RNA, 63 nt, Homo Sapiens
ugucauuggguuccagcugcucuccuccacauugaaugauaucuuguuaauuuauaggcacau

SEQ ID NO: 256134 - RNA, 63 nt, Homo Sapiens
uggaagccaaaaguucucuucccaaacugccaagaaugauacaggccauaauugaaaugggaa

SEQ ID NO: 256135 - RNA, 63 nt, Homo Sapiens
cauguguauggggaaaauaguucugaaaggcuagaaugauacaagugagcaaaaguuggucag

SEQ ID NO: 256136 - RNA, 63 nt, Homo Sapiens
uaauagaaaggaauacuauuauagcaaaucacagaaugauagacucaagcauaaaacuuggca

SEQ ID NO: 256137 - RNA, 63 nt, Homo Sapiens
uaagaugaaaggagaacacugguuauguugauagaaugauaaaaagggucgggcgcggaggcu

SEQ ID NO: 256138 - RNA, 63 nt, Homo Sapiens
uguuuaguucacaaguagauguaauuuacuaaagaaugauacacccauaugcuauauacagcu

SEQ ID NO: 256139 - RNA, 63 nt, Homo Sapiens
accauaugaacauauauuuuuuagaaacuaagagaaugauaggcuuuuguucuuaugaacgaa

SEQ ID NO: 256140 - RNA, 63 nt, Homo Sapiens
cuagaugaaauaguguucaaagccuaccccaaugaaugauauagauaggacuaaugacuagga

SEQ ID NO: 256141 - RNA, 63 nt, Homo Sapiens
uuuuuguacaucuagcuguauuuucaugacuuugaaugauauaucacaccaauaugaugaugg

SEQ ID NO: 256142 - RNA, 63 nt, Homo Sapiens
caggaaggauggcaagcacgcugguuagauaaugaaugauaaggacguguauccccgugaaau

SEQ ID NO: 256143 - RNA, 63 nt, Homo Sapiens
gaaggugguuucgaaggaggagcugucuauaaugaaugauauacagucagguuuguauuucug

SEQ ID NO: 256144 - RNA, 63 nt, Homo Sapiens
gccuuuaaaaauuuuuuuauacuugcauucucagaaugauaguuaaaacuauggucaacuuca

SEQ ID NO: 256145 - RNA, 63 nt, Homo Sapiens
agcuuccaucucacagauucugucuguaaaauggaaugauaauugccugagucucaguguagg

SEQ ID NO: 256146 - RNA, 63 nt, Homo Sapiens
auguucaauauuaucacugcacuuauaaaaaaagaaugauaugugagaagauggccaauccag

SEQ ID NO: 256147 - RNA, 63 nt, Homo Sapiens
uuccaguucacgagggcaggggguuuaaaacaagaaugauaggccaggaaggcaguggggauc

SEQ ID NO: 256148 - RNA, 63 nt, Homo Sapiens
guuccuaagggaaagggaagcacaugaucaugggaaugauagcccagaacaaaaagaaaucuu

SEQ ID NO: 256149 - RNA, 63 nt, Homo Sapiens
uucuuaucaaagaaauaacccagacuuaaucuugaaugauacgauuaugcccaauauuaagua

SEQ ID NO: 256150 - RNA, 63 nt, Homo Sapiens
uuguaucaaaaguauucaugaugacucuauuuggaaugauauucagggaaaucacaauaauau

SEQ ID NO: 256151 - RNA, 63 nt, Homo Sapiens
gcauaaauauuagcugcucaaugauugauuguugaaugauagaugaaguauugcugaagccaa

SEQ ID NO: 256152 - RNA, 63 nt, Homo Sapiens
gcugcgaaccguggcacacguugugacaaaacagaaugauaaaauauuaacuauauaagagag

SEQ ID NO: 256153 - RNA, 63 nt, Homo Sapiens
uauuuuuccaaaugcuucauuucugugaaaagugaaugauaugucuuauuuuuaagaaaaugg

SEQ ID NO: 256154 - RNA, 63 nt, Homo Sapiens
aauaucuuuuagggggcuuuauaagaugaaaaggaaugauaaauaaaaugaaaauugagaaau

SEQ ID NO: 256155 - RNA, 63 nt, Homo Sapiens
aucugucccauuuucgaggcuauaugccuucaggaaugauauaaucucucucucaacaaaagg

SEQ ID NO: 256156 - RNA, 63 nt, Homo Sapiens
guuuaugaugaauccauaguuucuuccugagaagaaugauacuauauaguucuaaaaauaagu

SEQ ID NO: 256157 - RNA, 63 nt, Homo Sapiens
uucugaagguauguuuauaagaauuuucaaaaagaaugauacaagggcuaaaacugggcuaca

SEQ ID NO: 256158 - RNA, 63 nt, Homo Sapiens
cugguuuauuuuuucuguaauauacaguugggggaaugauaauuuauuaagcaucugugggaa

SEQ ID NO: 256159 - RNA, 63 nt, Homo Sapiens
aaacguuucuuucuaacauuaugggaucuggacgaaugauaccuguaguuucuuuucuguaaa

SEQ ID NO: 256160 - RNA, 63 nt, Homo Sapiens
gagugaagcagaaacaggaguugagacugaggagaaugauagaagggugcgauugaaugagua

SEQ ID NO: 256161 - RNA, 63 nt, Homo Sapiens
uaauuugguauuacauguauucuauuuuuuucugaaugauagcaugaaaagugucaaaguggu

SEQ ID NO: 256162 - RNA, 63 nt, Homo Sapiens
acuuuaccaauuguuacuuucaaugugaggaaugaaugauaaauuaagagaaaaaaauaucag

SEQ ID NO: 256163 - RNA, 63 nt, Homo Sapiens
uuuugauuauugcauuguauuuuaauuugugcagaaugauaaagaauguuccuuuuagaagug

SEQ ID NO: 256164 - RNA, 63 nt, Homo Sapiens
uuguuuguccuuuucuguggagaaggacauuuagaaugauaucgaugcugaaauguccagaaa

SEQ ID NO: 256165 - RNA, 63 nt, Homo Sapiens
uauauccauugcauguugaaagcuagugauucugaaugauauagaguucaguguaagcaugga

SEQ ID NO: 256166 - RNA, 63 nt, Homo Sapiens
auuuauauggauaaagaugcaaucaguucauuagaaugauaacaacauaauucugcacuuugg

SEQ ID NO: 256167 - RNA, 63 nt, Homo Sapiens
auauuuggaggaaauugaaaguguggaaaaaaagaaugauaaucuuuuaaagggucuacaacu

SEQ ID NO: 256168 - RNA, 63 nt, Homo Sapiens
ucuccuccaccuucaccccaagacuaggggcaggaaugauaagaaggcugggugguagcuggg

SEQ ID NO: 256169 - RNA, 63 nt, Homo Sapiens
aacagcaaugcuaguaacaggaugggaacaugggaaugauaauauauauuuuuucuuuuaaua

SEQ ID NO: 256170 - RNA, 63 nt, Homo Sapiens
ugaguucuuacaaacuguuuguuauauuuucuggaaugauaagugagaauuauuuagaaaaga

SEQ ID NO: 256171 - RNA, 63 nt, Homo Sapiens
caaaagcaauuguuuuuaaauuaacaauggagagaaugauaagaugagggaaggaaaaggcau

SEQ ID NO: 256172 - RNA, 63 nt, Homo Sapiens
cuuuuaaagggucuacaacuguguggaaaaaaagaaugauaauauauuuggaggaaauugaaa

SEQ ID NO: 256173 - RNA, 63 nt, Homo Sapiens
cuuguuuaaaugaaagagaaugauuuuaaaagggaaugauaugcuaaauauuuauuuagagaa

SEQ ID NO: 256174 - RNA, 63 nt, Homo Sapiens
auuauacaaguaaugccaaauagugacucauuggaaugauauauguuuugaauggauuaccug

SEQ ID NO: 256175 - RNA, 63 nt, Homo Sapiens
aacacugaaagagcgugggacucuugcugauaggaaugauagcucaccugguugcucuggaag

SEQ ID NO: 256176 - RNA, 63 nt, Homo Sapiens
aauguaucaauguauuagauaaacccaguuucagaaugauaaagaaaaaauguuagaccaaau

SEQ ID NO: 256177 - RNA, 63 nt, Homo Sapiens
ccugaaucugugcauuuugugccuuauucaugagaaugauagaaguacuaaaaucugucaagu

SEQ ID NO: 256178 - RNA, 63 nt, Homo Sapiens
gauccuagcugcagaucgcaucccacaaugcgagaaugauaaaauaaaauuggauauuugaga

SEQ ID NO: 256179 - RNA, 63 nt, Homo Sapiens
gaaaaaauguuagaccaaauaaacccaguuucagaaugauaaaaauguaucaauguauuagau

SEQ ID NO: 256180 - RNA, 63 nt, Homo Sapiens
aaauguuagaccaaauaaugaaauccaguuucagaaugauaaaaauuuaucaauguauuacac

SEQ ID NO: 256181 - RNA, 63 nt, Homo Sapiens
gaaaucuacauaaaauccaggccagaugcuuuugaaugauaggaguugauuccuccaauaugg

SEQ ID NO: 256182 - RNA, 63 nt, Homo Sapiens
agagacuacagauggauaauccaugggaauacagaaugauagauguacacaacaaagguacag

SEQ ID NO: 256183 - RNA, 63 nt, Homo Sapiens
ggagcaaguggccaaacaucguaaagaugagaagaaugauaauggauacuaagaaaauagaag

SEQ ID NO: 256184 - RNA, 63 nt, Homo Sapiens
ggacacagccauccagcggcaucuuuccuugucgaaugauacuguaaugaccuuccaaaguga

SEQ ID NO: 256185 - RNA, 63 nt, Homo Sapiens
cauguuucaucuucauuuuuaauauccugaacugaaugauaguguuuuuuuagaugaagaacu

SEQ ID NO: 256186 - RNA, 63 nt, Homo Sapiens
guuugcuauauuccuuuuucuaugaaauaaugugaaugauaauaaaacagcuuugacuugauu

SEQ ID NO: 256187 - RNA, 63 nt, Homo Sapiens
cccauuuacuguauuuuuuuuaaugaaauaugugaaugauaauaaaaguugcugacuuaaugc

SEQ ID NO: 256188 - RNA, 63 nt, Homo Sapiens
cuccaggaaacuuguccuucuggaaaucauauugaaugauauuucuauaucgaagugagguag

SEQ ID NO: 256189 - RNA, 63 nt, Homo Sapiens
gcaaguuucuccaguugggaucggcauccucuugaaugauaguguaggaaacuguacuuuauc

SEQ ID NO: 256190 - RNA, 63 nt, Homo Sapiens
ugugguauagugaccaauaguaaacugacuguagaaugauaaugguugucuagguaaugacag

SEQ ID NO: 256191 - RNA, 63 nt, Homo Sapiens
ggcaaaacucaacagccccucagggacuacuuggaaugauaaauggugggacuuggucuggag

SEQ ID NO: 256192 - RNA, 63 nt, Homo Sapiens
acuuccuacauuauauuuguguugguuugccaugaaugauauuagccuaccaaauuucaugcu

SEQ ID NO: 256193 - RNA, 63 nt, Homo Sapiens
ucaagcccugcuuaaaguuaaauaaaauagaaugaaugauaccccggcuccauuucccccacu

SEQ ID NO: 256194 - RNA, 63 nt, Homo Sapiens
acuucugaaaaguucugcucuaucucaaagacugaaugauacuacacaguccucucccuauua

SEQ ID NO: 256195 - RNA, 63 nt, Homo Sapiens
cauuccacuuagugucuuuucaaugauaggcaagaaugauaucugaguugaacuucggugcuu

SEQ ID NO: 256196 - RNA, 63 nt, Homo Sapiens
cagagaacgguguuugagucagcuugucugauugaaugauaaugugcuaaauugauuaccucc

SEQ ID NO: 256197 - RNA, 63 nt, Homo Sapiens
ugggagcugcgcuaugaagauacaaaggcacaagaaugauacaauggauuuuggggacuuagg

SEQ ID NO: 256198 - RNA, 63 nt, Homo Sapiens
accaaaagguauauaauuugguccuuuauguaagaaugauauagaagaaagggccuucacagu

SEQ ID NO: 256199 - RNA, 63 nt, Homo Sapiens
gccugguuuacauucauuuauucuggaggagacgaaugauaggagaaaugucuuuucaucuuu

SEQ ID NO: 256200 - RNA, 63 nt, Homo Sapiens
ugggaucacaaagccaacugaguucaucuauuagaaugauaucgacccaauggugcuggaaaa

SEQ ID NO: 256201 - RNA, 63 nt, Homo Sapiens
gcuaccuuacauuucugcguauauaugaaaacugaaugauauuucucaguguauuuccuugca

SEQ ID NO: 256202 - RNA, 63 nt, Homo Sapiens
agauugagcaauagaaaaaaauuccuuuccuuugaaugauagcugugauucaccccaccccau

SEQ ID NO: 256203 - RNA, 63 nt, Homo Sapiens
auacacaaugaagaauucuauuuggcuaauuaagaaugauauacuauguacacccaauaagcu

SEQ ID NO: 256204 - RNA, 63 nt, Homo Sapiens
caaaaacuacuuuuuagagagugaagagguccagaaugauauggcaaauaagccagcagaugg

SEQ ID NO: 256205 - RNA, 63 nt, Homo Sapiens
uuaucaauauaguuuaguauaaccacaaacuaagaaugauaaagugcguguacuguuucuaaa

SEQ ID NO: 256206 - RNA, 63 nt, Homo Sapiens
aucccagaauuguugaggggggaucaaguugcagaaugauacagauaguacaaugacuuuuuu

SEQ ID NO: 256207 - RNA, 63 nt, Homo Sapiens
ucaagagaacacacaacagagaaacccuauaaagaaugauacaauauguuucaaucagaaccu

SEQ ID NO: 256208 - RNA, 63 nt, Homo Sapiens
uauguugugaauuuuccuugguucuuuuuaaaggaaugauaauaaaguuacuugcuuuaggau

SEQ ID NO: 256209 - RNA, 63 nt, Homo Sapiens
caaagaagaauccagaaauaggggcacauugaggaaugauacugagcccaaagagcauucaau

SEQ ID NO: 256210 - RNA, 63 nt, Homo Sapiens
agucuuuuuaaauaugcucuguuaguuuguauggaaugauauuucauugcacuuuuaauuuaa

SEQ ID NO: 256211 - RNA, 63 nt, Homo Sapiens
acaacauaauacguaguuaugugccaacaaauugaaugauaaauuuacuguggauuagguaua

SEQ ID NO: 256212 - RNA, 63 nt, Homo Sapiens
ccuguuuacuguggauuagggaucauauuaugggaaugauaauaccaaauucuucauaagaaa

SEQ ID NO: 256213 - RNA, 63 nt, Homo Sapiens
uuaacggagugucuaaucuagagaaaauacagagaaugauagauugauugggauguuauauuu

SEQ ID NO: 256214 - RNA, 63 nt, Homo Sapiens
uuucaucaauguuaucagauaccaagaagaagugaaugauauuauccggucuaugccuucugc

SEQ ID NO: 256215 - RNA, 63 nt, Homo Sapiens
uauaaauaaaauauauauauuuuauaaagaucagaaugauauaaaggagauacauguuucuuc

SEQ ID NO: 256216 - RNA, 63 nt, Homo Sapiens
uuauuuaaagaagaaacgucuauguguacagaugaaugauaaacucucugcuucucccucugc

SEQ ID NO: 256217 - RNA, 63 nt, Homo Sapiens
auuggugguuuuccuauuacugauguggcuguggaaugauaagguccuagaggggcccuggca

SEQ ID NO: 256218 - RNA, 63 nt, Homo Sapiens
cacuccaaaacccacucugcacugcagcacagugaaugauaugcacucaccauuagcuucgac

SEQ ID NO: 256219 - RNA, 63 nt, Homo Sapiens
auuuucaugacaaugucauguuuuccagggagggaaugauauaacccaggauaauagucacag

SEQ ID NO: 256220 - RNA, 63 nt, Homo Sapiens
gaagcucuggccugagaguuaaacacccaugcugaaugauacagugugcauucucuccagcug

SEQ ID NO: 256221 - RNA, 63 nt, Homo Sapiens
ugacuuucaugucgucaugcaucugucaugaaugaaugauacuuugcacugggcuguacgaca

SEQ ID NO: 256222 - RNA, 63 nt, Homo Sapiens
ucugcccuuuugucugaaacucaaggccaaggagaaugauaggagacuuaggacagagcugac

SEQ ID NO: 256223 - RNA, 63 nt, Homo Sapiens
cucuuucacccugcuggucccagcucucaucaugaaugauagaugugugcuuagcgcaaaugg

SEQ ID NO: 256224 - RNA, 63 nt, Homo Sapiens
uucaagaaguugauuccaaaacugaguuaugaagaaugauauaacaguuccuucaaaauuggc

SEQ ID NO: 256225 - RNA, 63 nt, Homo Sapiens
cuuaauucugagccauuaauccugcuacacuuugaaugauacauuaauucagacuaaucuuug

SEQ ID NO: 256226 - RNA, 63 nt, Homo Sapiens
ggacuagauucuaaaauuuauuugggaccaugggaaugauaguugggaagaaaacuauuugca

SEQ ID NO: 256227 - RNA, 63 nt, Homo Sapiens
ucuugaaguauuguucauauuugucaccucuuggaaugauagcagauccuguaaguugaugua

SEQ ID NO: 256228 - RNA, 63 nt, Homo Sapiens
acaaguuccuuguuuaacuacacagcuaugauggaaugauauauccaaguuccuugccucagu

SEQ ID NO: 256229 - RNA, 63 nt, Homo Sapiens
aucacagauuuccaaaaguacuagcaauaaguugaaugauaauagcucacagcacauuuguua

SEQ ID NO: 256230 - RNA, 63 nt, Homo Sapiens
ucaccaguuagacauaauuacuucuaccgaugugaaugauacggaugccggcagagcuuccag

SEQ ID NO: 256231 - RNA, 63 nt, Homo Sapiens
gcaaugugccuaacgauuuuaugauuuuauggagaaugauauggugugguuuugaggagggau

SEQ ID NO: 256232 - RNA, 63 nt, Homo Sapiens
cuguuucugagggaugccaggucugugcaucaugaaugauaaguaccucuggccgcaauucca

SEQ ID NO: 256233 - RNA, 63 nt, Homo Sapiens
cuuaccgaauucuucuugugagccuagagucuugaaugauagcuaaaccugaauauuauuacc

SEQ ID NO: 256234 - RNA, 63 nt, Homo Sapiens
uuauccuagcaaaggggccuugugcuucaaugagaaugauaaaugaaauucugacuucucucc

SEQ ID NO: 256235 - RNA, 63 nt, Homo Sapiens
cuuuuauuuauucacagaaggugcguuuguacggaaugauaaaaaaacuguuguggaaaauga

SEQ ID NO: 256236 - RNA, 63 nt, Homo Sapiens
caugagguggaagacgagguucaaagacaaacugaaugauaacguucccgccaguuccacaga

SEQ ID NO: 256237 - RNA, 63 nt, Homo Sapiens
cucuuuuagagaacaaauaagaaaagagauucagaaugauaacauaauuaagaguuucuuaug

SEQ ID NO: 256238 - RNA, 64 nt, Homo Sapiens
aacaccauccacucacuccaacaaagaacacuuagaaugauaaaaaaaaaaaaaaaaaaccuga

SEQ ID NO: 256239 - RNA, 64 nt, Homo Sapiens
uuuuagagaagucccugauuccuucuuaaacuuggaaugauagaugaaauucacaccccugcag

SEQ ID NO: 256240 - RNA, 60 nt, Homo Sapiens; identical to SEQ ID NO: 255998

SEQ ID NO: 256241 - RNA, 64 nt, Homo Sapiens
gcucacugcauuuaauaaauauuuaauaaaugaugaaugauagaaguuuccaucuacaauauau

SEQ ID NO: 256242 - RNA, 64 nt, Homo Sapiens
aggaaagggacuauaaaaguguacaauguuaauggaaugauacgguaccugaaagccuuguuuu

SEQ ID NO: 256243 - RNA, 64 nt, Homo Sapiens
cugagccucucccagcuccacuucuaaugcuagagaaugauaacuaagacuucugugcauuuga

SEQ ID NO: 256244 - RNA, 64 nt, Homo Sapiens
aguuuucucauuauuuaugaaacuuaaccauacagaaugauauaacuccugugcaaugaaggug

SEQ ID NO: 256245 - RNA, 64 nt, Homo Sapiens
gcugcaccaacaauaucccgcuucugccaauuuugaaugauauauagccccaccagcuucagga

SEQ ID NO: 256246 - RNA, 64 nt, Homo Sapiens
aaagugaaguaguagccacauugcuaauaagauagaaugauacauguuaaccuagaaauguagc

SEQ ID NO: 256247 - RNA, 64 nt, Homo Sapiens
agcauugguccccaagccagauauuuguugaaaugaaugauaaggcaagccugguacucaguaa

SEQ ID NO: 256248 - RNA, 64 nt, Homo Sapiens
ccaaaucugcccaagugacauucuucaaaaggaggaaugauaacaaagcaggcuguuugcucac

SEQ ID NO: 256249 - RNA, 64 nt, Homo Sapiens
gaauuaaauuagaucucucucugucucucuacuugaaugauaaaggguuugcuuuggaaaaugc

SEQ ID NO: 256250 - RNA, 64 nt, Homo Sapiens
gaauagaccaugggcuacuacuuuuuauaaacuugaaugauaaaugacugaaguuccagcuuua

SEQ ID NO: 256251 - RNA, 64 nt, Homo Sapiens
uaguguauauauauuuuguauucaugaucaucuggaaugauacugugccauacuguuuuuaaag

SEQ ID NO: 256252 - RNA, 64 nt, Homo Sapiens
agaaaauguuuuccuuguuucugguuguaaaacagaaugauauuuugauucuucuggguuuaua

SEQ ID NO: 256253 - RNA, 64 nt, Homo Sapiens
aauuuugccuuuuuuuuuuucccgcccgcccccagaaugauauuauaguugcuucccacugccc

SEQ ID NO: 256254 - RNA, 64 nt, Homo Sapiens
ugcucaauaaaugaaugaauaugggugaauaguugaaugauaggaggcacucaauaaaugcuga

SEQ ID NO: 256255 - RNA, 64 nt, Homo Sapiens
ugcacaguggcagaacaaacguacccccaucccagaaugauaacuuucucauugggagaguaag

SEQ ID NO: 256256 - RNA, 64 nt, Homo Sapiens
ggugacucaggggaagaagaaaagcaagaggaaggaaugauaauccggcccaggcccaucuucc

SEQ ID NO: 256257 - RNA, 64 nt, Homo Sapiens
uagguuccccaccaaaagcaagcuaagccuguuugaaugauacggugcagugaagguucucuac

SEQ ID NO: 256258 - RNA, 64 nt, Homo Sapiens
uaugaauggcuuuucaauucaagaucaaaaaauugaaugauaaauggagaauucauaacauuug

SEQ ID NO: 256259 - RNA, 64 nt, Homo Sapiens
agguuuuuuuuucucacagaacaucugaaauaaggaaugauauaaauaacucaccuggcaucuu

SEQ ID NO: 256260 - RNA, 64 nt, Homo Sapiens
uuuaauaaaagaaggaaaaauugaucaaagccuggaaugauagcgaacaaauauucuuggaucu

SEQ ID NO: 256261 - RNA, 64 nt, Homo Sapiens
caaauagugcaaauuugccauagagcuggcagcugaaugauagauuuuaagugugcaaacaagu

SEQ ID NO: 256262 - RNA, 64 nt, Homo Sapiens
uuuuuggaaaauuuaagaaaaauccuacauguuggaaugauagcuaagguuaaaauaggggaga

SEQ ID NO: 256263 - RNA, 64 nt, Homo Sapiens
aaguuucucgaguuagccuucuugagaaauuuuagaaugauagguccgaaaaauguuucuucag

SEQ ID NO: 256264 - RNA, 64 nt, Homo Sapiens
ucugaaaucaaaauuccucaaugcugagucuguggaaugauacugaaauauguauaaauauaug

SEQ ID NO: 256265 - RNA, 64 nt, Homo Sapiens
gaucuuuugugacuuugagccuuuuaaguaguuugaaugauaagacuuaaaauguuucauaauu

SEQ ID NO: 256266 - RNA, 64 nt, Homo Sapiens
gacgugggaucucaguaugguacuuggacagcaggaaugauacauauaaucugaacuugggaaa

SEQ ID NO: 256267 - RNA, 64 nt, Homo Sapiens
aagaaacuggaggcugcaacaggagggaaaggcagaaugauaucacagcaguacuauuuuuuuu

SEQ ID NO: 256268 - RNA, 64 nt, Homo Sapiens
auuccugggacucaaauguaugcaguacuauucagaaugauauacacacauauguguauaugua

SEQ ID NO: 256269 - RNA, 64 nt, Homo Sapiens
aauauuuggaggauauugaaagugugaaaaaaaagaaugauaaucuuuuaaaggcucuacaauu

SEQ ID NO: 256270 - RNA, 64 nt, Homo Sapiens
gcauuucaccccacaugacuaggaauccacaucagaaugauacagaguuagcagguuuuucuaa

SEQ ID NO: 256271 - RNA, 64 nt, Homo Sapiens
cucuguaagcuucauccaugcugguuauugcacugaaugauauauuauuagggcauguuaacag

SEQ ID NO: 256272 - RNA, 64 nt, Homo Sapiens
auuuuaaaugaguuaaugaaucugccagaucugugaaugauagagauuaugcuaaauuaaugcu

SEQ ID NO: 256273 - RNA, 64 nt, Homo Sapiens
aggagauaaacagccaaauagcaaauaggucacugaaugauaagauuugcaccuuagaacaaua

SEQ ID NO: 256274 - RNA, 52 nt, Homo Sapiens; identical to SEQ ID NO: 256032

SEQ ID NO: 256275 - RNA, 64 nt, Homo Sapiens
ucagucuugccuuugaaggguguaucugaguauugaaugauaauacuaaaacacaaugugaaaa

SEQ ID NO: 256276 - RNA, 64 nt, Homo Sapiens
uaaauauugcauguuugcuuauaugcucuucagagaaugauauaggaacuugaagauuaauaaa

SEQ ID NO: 256277 - RNA, 64 nt, Homo Sapiens
acaaguugagcaucucuaauacauaagccagagugaaugauacucuuucaaguacaaggucaau

SEQ ID NO: 256278 - RNA, 64 nt, Homo Sapiens
ggaaacugucaagagggggccuucaaaggaacuggaaugauaaucuaagaccuccucccaagca

SEQ ID NO: 256279 - RNA, 64 nt, Homo Sapiens
auuuuuaaaggcuucauuccaaaaaguaucagaagaaugauacccuuuuuccuuaaguauaaaa

SEQ ID NO: 256280 - RNA, 64 nt, Homo Sapiens
ugaggccagcagucagaauaacauguuuaacucagaaugauaugcucauuugugauauuauaaa

SEQ ID NO: 256281 - RNA, 64 nt, Homo Sapiens
uagauuaggauugacaaguaaagauacugcuauggaaugauacauuguauuuucugcauugugu

SEQ ID NO: 256282 - RNA, 64 nt, Homo Sapiens
uccugccucagaaaaagcuuuuccauuacacugugaaugauaccuguuuuguuguuucugaauu

SEQ ID NO: 256283 - RNA, 64 nt, Homo Sapiens
uuuuaaaggaagauacagaggugauuguacuucagaaugauaaacccauauaccaccuaaaauc

SEQ ID NO: 256284 - RNA, 64 nt, Homo Sapiens
uugaaggaacucaugaaaauccugaguuaauuuggaaugauaauuccagagauaaaguguccac

SEQ ID NO: 256285 - RNA, 64 nt, Homo Sapiens
gugguuugaauuggaugcagugugggccauccuggaaugauacugacugauuaauuauuccuga

SEQ ID NO: 256286 - RNA, 64 nt, Homo Sapiens
aaaacaaauuucaauugcuugaagcaauuguucugaaugauacuuuuucauucacauucaagaa

SEQ ID NO: 256287 - RNA, 64 nt, Homo Sapiens
aaaaauagccaaagauaggagacgucugaauuuugaaugauaaacagugauguuuuaaaaaagc

SEQ ID NO: 256288 - RNA, 64 nt, Homo Sapiens
cuuucugcaaauuauucagccuccaaaugcaaaugaaugauauaaaaauaaguagggaacaugg

SEQ ID NO: 256289 - RNA, 64 nt, Homo Sapiens
gaucuuauaucuguuaaaagguuugugugaaugugaaugauacuucuuucuaaaguguguguau

SEQ ID NO: 256290 - RNA, 64 nt, Homo Sapiens
gaauaaccaggggcacaugggggaacguggaugggaaugauaguguaucucagcgggggguggg

SEQ ID NO: 256291 - RNA, 64 nt, Homo Sapiens
gcaggcauccugguguccugagaggcucuugcaggaaugauacguggcagugccugcagcgagg

SEQ ID NO: 256292 - RNA, 55 nt, Homo Sapiens; identical to SEQ ID NO: 256050

SEQ ID NO: 256293 - RNA, 64 nt, Homo Sapiens
ucauugcaagcuggcaaauuuauguagcuauguggaaugauaugucauaauguaaaauuagaua

SEQ ID NO: 256294 - RNA, 64 nt, Homo Sapiens
caguaagcacauguuuauucagaggcaagagacagaaugauaucuacaugaacacagcugcuga

SEQ ID NO: 256295 - RNA, 64 nt, Homo Sapiens
ugaagaauuauuaguaauagaaguacaacuuuuggaaugauaccuuaacuguuguauugugacu

SEQ ID NO: 256296 - RNA, 64 nt, Homo Sapiens
ugcaauaguuguaaaucuacgccuucugucagcagaaugauaagaaucucaaucuucaguuuug

SEQ ID NO: 256297 - RNA, 64 nt, Homo Sapiens
cugacauuauacucuaaaagacacagcuguuaacgaaugauaaacaaagcagagccacugucua

SEQ ID NO: 256298 - RNA, 64 nt, Homo Sapiens
ccucacucauuuagccauucucaugggggcggaugaaugauauccacacuugaaaaagauaagg

SEQ ID NO: 256299 - RNA, 64 nt, Homo Sapiens
uuuaucaaaucucacagacauauauaaacagguugaaugauauacaaaguaauaaaacuuaguu

SEQ ID NO: 256300 - RNA, 64 nt, Homo Sapiens
gaguauaacuggcuuaguaaguauauccuacucugaaugauaaaaauauagucaagcuaaaaua

SEQ ID NO: 256301 - RNA, 64 nt, Homo Sapiens
gcaguugagaaaauuugaauguggauuagauuuugaaugauauuggauaauuauugguaauuuu

SEQ ID NO: 256302 - RNA, 64 nt, Homo Sapiens; identical to SEQ ID NO: 256301

SEQ ID NO: 256303 - RNA, 64 nt, Homo Sapiens
uucuaccaaguuuucaccuuguuucaggucagaggaaugauagaauuugucauuuuucuuacaa

SEQ ID NO: 256304 - RNA, 64 nt, Homo Sapiens
uguuuugaaagucuuuaacuaaauuaagauugcagaaugauagugauuauucaauuagauuuua

SEQ ID NO: 256305 - RNA, 64 nt, Homo Sapiens
acauuuuuuagugucacacugacuuuuaaaauuugaaugauauauagacuuuguuuuuuuaaug

SEQ ID NO: 256306 - RNA, 64 nt, Homo Sapiens
aguugcuaaauucuccauggacauagagagaaaggaaugauauucucaucaucaucuucaucau

SEQ ID NO: 256307 - RNA, 64 nt, Homo Sapiens
uucuguaaaagauuuguccaauaaacgacuuaaugaaugauacaucagucagauuuuaggaagg

SEQ ID NO: 256308 - RNA, 64 nt, Homo Sapiens
uccugaccuuuagucuuucacuuccaauuuuguggaaugauauuuuaggaauaacggacuuuua

SEQ ID NO: 256309 - RNA, 64 nt, Homo Sapiens
uuucuucagccacugacugcuuggguugggcugugaaugauaauggaauggcuggagucugcug

SEQ ID NO: 256310 - RNA, 64 nt, Homo Sapiens
ugugaugcugucagccacagcuuccugccguagagaaugauagagcagcugcucacacaggagg

SEQ ID NO: 256311 - RNA, 64 nt, Homo Sapiens
cuuuuuuuuuuuuaacaucuuuguuuuuaaaauagaaugauagaacuuugccagucuuuaagau

SEQ ID NO: 256312 - RNA, 64 nt, Homo Sapiens
gacuuagugaauucuaaggaguuuuguaaccucugaaugauaugguagcuuuggugaaacuggg

SEQ ID NO: 256313 - RNA, 64 nt, Homo Sapiens
auuucacucugcguucuccuaaacugacaugguugaaugauagcugaaaugccccgggggcagc

SEQ ID NO: 256314 - RNA, 64 nt, Homo Sapiens
gauuuuuaaaaaaguaauaauugugaaugaauacgaaugauacauuugcuuaaucaguaagucu

SEQ ID NO: 256315 - RNA, 64 nt, Homo Sapiens
uucuugaagacaucgauauauucuagugaaaaaggaaugauauaugacuuauauuuugaauggg

SEQ ID NO: 256316 - RNA, 64 nt, Homo Sapiens
agugaauauaaauggggcuguagugguaaagagugaaugauaguuuagacagcagggaagauau

SEQ ID NO: 256317 - RNA, 64 nt, Homo Sapiens
aauaaauuuaauuuaccaaaaaaauuaaaagaaggaaugauaaguacuaaaaauauauauagac

SEQ ID NO: 256318 - RNA, 64 nt, Homo Sapiens
aauaggauacaauguauaaguauucaggcacugagaaugauaguaaagcaguuaaacugauuag

SEQ ID NO: 256319 - RNA, 64 nt, Homo Sapiens
uugaucagauucaguaaaguuuguacaaaaaauggaaugauagguaaagcuacauguaaaguuc

SEQ ID NO: 256320 - RNA, 64 nt, Homo Sapiens
gacucuagccaagaaaaagcuaauucuggggauagaaugauaaaagacucaagcacuaaaaaua

SEQ ID NO: 256321 - RNA, 64 nt, Homo Sapiens
ugucacauaaaggaagucuuaaguggaguucacagaaugauaauguaucuauuugucauuugug

SEQ ID NO: 256322 - RNA, 64 nt, Homo Sapiens
ugagaauacuuuaaagggaaguggaaguauaagugaaugauauuuuucuuuuacauguaaacaa

SEQ ID NO: 256323 - RNA, 55 nt, Homo Sapiens; identical to SEQ ID NO: 256081

SEQ ID NO: 256324 - RNA, 64 nt, Homo Sapiens
auuuccuuuuucugaaauguaaucauugaugcuugaaugauagaauuuuaguacuguaaacagg

SEQ ID NO: 256325 - RNA, 64 nt, Homo Sapiens
uucccaucucugcaagcagggauaacgguaaugagaaugauaauaaucauuauaugcagaccuu

SEQ ID NO: 256326 - RNA, 64 nt, Homo Sapiens
ugucacuacugaauuuugacaggaggaaggaauagaaugauagcuuguuuuauuuguaaagcuu

SEQ ID NO: 256327 - RNA, 64 nt, Homo Sapiens
ugcaggggauauuuuuugagaacucugagaagcugaaugauacacauuuuccuguuuuuaugga

SEQ ID NO: 256328 - RNA, 64 nt, Homo Sapiens
gcugaagaaucuacuuaacccuuuuuccaguaaggaaugauauugccaugggugcuuguugggc

SEQ ID NO: 256329 - RNA, 64 nt, Homo Sapiens
ugucaugguggucuauaacuagaaaacucugcuagaaugauaaacucauucaguaguuacugaa

SEQ ID NO: 256330 - RNA, 64 nt, Homo Sapiens
uaggacauucaguccagugguuaagauaugucuugaaugauaauaguaaaugcuugauaaaucu

SEQ ID NO: 256331 - RNA, 64 nt, Homo Sapiens
cuagaauagaagaaagagaacaggauuggaccaugaaugauauggcauucaaccaacuguaaug

SEQ ID NO: 256332 - RNA, 64 nt, Homo Sapiens
guuuuucucuuugcaaagacauagcuaggaaagcgaaugauaagggaaaaguucucagggaauu

SEQ ID NO: 256333 - RNA, 64 nt, Homo Sapiens
auucuuagaauaagaagugcauucaauccuaggagaaugauaauccuggacaugggugaacaug

SEQ ID NO: 256334 - RNA, 64 nt, Homo Sapiens
uuggugacaaccuacuuugcuuggcugagugaaggaaugauauucauauauucauuuauuccau

SEQ ID NO: 256335 - RNA, 64 nt, Homo Sapiens
guuggaaagcugaucuuuucugauauaaaauguugaaugauauuaucugguuuucugauauuuu

SEQ ID NO: 256336 - RNA, 64 nt, Homo Sapiens
ggcaguauuguuuucuuauaugugcaaugaaguggaaugauaaacaguaugccuuuaauuuaua

SEQ ID NO: 256337 - RNA, 64 nt, Homo Sapiens
ugaaaaaugcuuauguauugacagaacacuucuagaaugauacccaaacuccuggagugggagu

SEQ ID NO: 256338 - RNA, 64 nt, Homo Sapiens
cacauagcuaugcacuaugaaaauuaaauggaaugaaugauauguauauuacucaaaauaaagu

SEQ ID NO: 256339 - RNA, 64 nt, Homo Sapiens
uuguaaauaaagacauucagucauauucacuauagaaugauaucaaccagcacauucguuuugu

SEQ ID NO: 256340 - RNA, 64 nt, Homo Sapiens
uccauuucucuaugaaauauggcguggugaguuggaaugauacggugagccacaggaaguuugg

SEQ ID NO: 256341 - RNA, 64 nt, Homo Sapiens
caacauaaugcugauaaacugacuggaaauguaugaaugauaaucuuguagcuacuacauucca

SEQ ID NO: 256342 - RNA, 64 nt, Homo Sapiens
uuuuuuuuuuuuaaagauaauggaacagauaacugaaugauagaggucccaaugucagaguucu

SEQ ID NO: 256343 - RNA, 64 nt, Homo Sapiens
agaaagcacccuaauugacuuucuaaacuuuguugaaugauaauagcacucuaacaauguuuac

SEQ ID NO: 256344 - RNA, 64 nt, Homo Sapiens
gauuagacuuugagccaaggugauuuauguuauagaaugauacuaaagcaaaaagcguaguuuc

SEQ ID NO: 256345 - RNA, 64 nt, Homo Sapiens
ugucaugagauccuacuuaguaugauccuggcuagaaugauaauuaaaaguauuuaauuugaag

SEQ ID NO: 256346 - RNA, 64 nt, Homo Sapiens
auuuauacaaaaggguuuuuguuuauagcuuaaggaaugauacugugcucugcuuggugcaugg

SEQ ID NO: 256347 - RNA, 64 nt, Homo Sapiens
aauaucuggaguacauuaaaagugugaaagaaaagaaugauaaucuucuaaaggcuauacaauu

SEQ ID NO: 256348 - RNA, 64 nt, Homo Sapiens
ugauggaucuguuggcggguuuuggauguguaaagaaugauauauauauuaaauaggucaauca

SEQ ID NO: 256349 - RNA, 64 nt, Homo Sapiens
uaucuucuccuuuuccugguugaacucccuaaaugaaugauauucauuccaacugcugccccuc

SEQ ID NO: 256350 - RNA, 64 nt, Homo Sapiens
uauacuacuuaauuacuuaagauguuuauuaauagaaugauaaauguacagaguaaccuauaag

SEQ ID NO: 256351 - RNA, 64 nt, Homo Sapiens
acuucuagcuuugugucuuguuucagaccauguggaaugauaaauacucuuuuugugcuucuga

SEQ ID NO: 256352 - RNA, 64 nt, Homo Sapiens
caagacaaacuuacccugauaacccuguuguaaagaaugauacaacucuacuguccuagaguau

SEQ ID NO: 256353 - RNA, 64 nt, Homo Sapiens
uuuugaaagacuuuuguauaggaaaaccuauggggaaugauauuaaaaaaucagguuuuaaaca

SEQ ID NO: 256354 - RNA, 64 nt, Homo Sapiens
gaacagcauuucccugcagcaaccaaccaguucagaaugauacggaagagggagggugucucac

SEQ ID NO: 256355 - RNA, 64 nt, Homo Sapiens
gagcaucuuuucaugagcuuauuucccugauggcgaaugauauuucauugugauuuugguuugc

SEQ ID NO: 256356 - RNA, 64 nt, Homo Sapiens
uaaauauauuuauagccugaucuaaaaacugauugaaugauauaauacuaugguuuucauuuac

SEQ ID NO: 256357 - RNA, 64 nt, Homo Sapiens
gaagaguguuuuuucauaaacaccuuuuccugaggaaugauacacuuuucaggacuugcugggu

SEQ ID NO: 256358 - RNA, 64 nt, Homo Sapiens
gccaaaaaaauuuauaaacuaauuuuguacguaugaaugauaucuuugaccucaauggagguuu

SEQ ID NO: 256359 - RNA, 64 nt, Homo Sapiens
augcuguuuaccccaucucucucuuauaucacuugaaugauauauuguaagugagagguaaagg

SEQ ID NO: 256360 - RNA, 64 nt, Homo Sapiens
cuugucagagccuauagccaaccugguaagaaaagaaugauagguuagcagaugauuucuguuc

SEQ ID NO: 256361 - RNA, 64 nt, Homo Sapiens
caugaagauaacuuuuuuuauccuccaaaaucaugaaugauacacuucccauugcaccagcuug

SEQ ID NO: 256362 - RNA, 64 nt, Homo Sapiens
uuugauuuguaagaggccauccacauagcacauagaaugauauuacauccaucccccuagcuca

SEQ ID NO: 256363 - RNA, 64 nt, Homo Sapiens
gauauuuucuguuguguuggauaaugugaaggcugaaugauagaagugucuuugaaacuugaac

SEQ ID NO: 256364 - RNA, 64 nt, Homo Sapiens
gugccuuaauugguuuucauugucuauaaauuuugaaugauacuucucgggauuauugcucuuc

SEQ ID NO: 256365 - RNA, 64 nt, Homo Sapiens
aauagauccauccaaaugauuucucuguacaaaugaaugauacuauuaaaaaaaaaaaaagcac

SEQ ID NO: 256366 - RNA, 64 nt, Homo Sapiens
cuuucaaugacuuucaauacuuccccugaaggaagaaugauaaggagaaaugucuguuuugagg

SEQ ID NO: 256367 - RNA, 64 nt, Homo Sapiens
cucuacucauaaguauuuuuuucuauuuagacuugaaugauaaucuguuuuuugaucaguauau

SEQ ID NO: 256368 - RNA, 64 nt, Homo Sapiens
uuccauugcuuugaaaaaguuaaugcuuaagagggaaugauaugcauuugacuuguuaaacagc

SEQ ID NO: 256369 - RNA, 64 nt, Homo Sapiens
acaucauagaacauggcagucguuuuuguuccaagaaugauaugaaaggugaagaagaggccca

SEQ ID NO: 256370 - RNA, 64 nt, Homo Sapiens
cugaauuuggccugcacuaauuugggauugcuaugaaugauaccccucuuuaagaguuaguuuc

SEQ ID NO: 256371 - RNA, 64 nt, Homo Sapiens
uuagauccauuucuuuuguggaaaagugauuaaugaaugauaauuguuaucacuguaaaacaca

SEQ ID NO: 256372 - RNA, 64 nt, Homo Sapiens
aagaaaggucagagaaaugcgggagcaaaaacuagaaugauacagucucauuaaagugauugcu

SEQ ID NO: 256373 - RNA, 64 nt, Homo Sapiens
guauuuuaacaaaucuuaauaaaaggagaauucagaaugauacauauuugaccugcaguauuga

SEQ ID NO: 256374 - RNA, 64 nt, Homo Sapiens
agaaauauguauauaaauaucucuauauucuuuggaaugauacuaaagucucuggucuaggacc

SEQ ID NO: 256375 - RNA, 64 nt, Homo Sapiens
gugucauuggguuccagcugcucuccuccacauugaaugauaucuuguuaauuuauaggcacau

SEQ ID NO: 256376 - RNA, 64 nt, Homo Sapiens
auggaagccaaaaguucucuucccaaacugccaagaaugauacaggccauaauugaaaugggaa

SEQ ID NO: 256377 - RNA, 64 nt, Homo Sapiens
acauguguauggggaaaauaguucugaaaggcuagaaugauacaagugagcaaaaguuggucag

SEQ ID NO: 256378 - RNA, 64 nt, Homo Sapiens
cuaauagaaaggaauacuauuauagcaaaucacagaaugauagacucaagcauaaaacuuggca

SEQ ID NO: 256379 - RNA, 64 nt, Homo Sapiens
cuaagaugaaaggagaacacugguuauguugauagaaugauaaaaagggucgggcgcggaggcu

SEQ ID NO: 256380 - RNA, 64 nt, Homo Sapiens
auguuuaguucacaaguagauguaauuuacuaaagaaugauacacccauaugcuauauacagcu

SEQ ID NO: 256381 - RNA, 64 nt, Homo Sapiens
aaccauaugaacauauauuuuuuagaaacuaagagaaugauaggcuuuuguucuuaugaacgaa

SEQ ID NO: 256382 - RNA, 64 nt, Homo Sapiens
cuagaugaaauaguguucaaaagccuaccccaaugaaugauauaagauaggacuaaugacuagg

SEQ ID NO: 256383 - RNA, 64 nt, Homo Sapiens
uuuuuguacaucuagcuguaguuuucaugacuuugaaugauauagucacaccaauaugaugaug

SEQ ID NO: 256384 - RNA, 64 nt, Homo Sapiens
caggaaggauggcaagcacgucugguuagauaaugaaugauaagagacguguauccccgugaaa

SEQ ID NO: 256385 - RNA, 64 nt, Homo Sapiens
gaaggugguuucgaaggagggagcugucuauaaugaaugauauaacagucagguuuguauuucu

SEQ ID NO: 256386 - RNA, 64 nt, Homo Sapiens
gccuuuaaaaauuuuuuuauaacuugcauucucagaaugauaguuuaaaacuauggucaacuuc

SEQ ID NO: 256387 - RNA, 64 nt, Homo Sapiens
agcuuccaucucacagauucgugucuguaaaauggaaugauaaucugccugagucucaguguag

SEQ ID NO: 256388 - RNA, 64 nt, Homo Sapiens
uauguucaauauuaucacugcacuuauaaaaaaagaaugauaugugagaagauggccaauccag

SEQ ID NO: 256389 - RNA, 64 nt, Homo Sapiens
cuuccaguucacgagggcaggggguuuaaaacaagaaugauaggccaggaaggcaguggggauc

SEQ ID NO: 256390 - RNA, 64 nt, Homo Sapiens
gguuccuaagggaaagggaagcacaugaucaugggaaugauagcccagaacaaaaagaaaucuu

SEQ ID NO: 256391 - RNA, 64 nt, Homo Sapiens
guucuuaucaaagaaauaacccagacuuaaucuugaaugauacgauuaugcccaauauuaagua

SEQ ID NO: 256392 - RNA, 64 nt, Homo Sapiens
uuuguaucaaaaguauucaugaugacucuauuuggaaugauauucagggaaaucacaauaauau

SEQ ID NO: 256393 - RNA, 64 nt, Homo Sapiens
ggcauaaauauuagcugcucaaugauugauuguugaaugauagaugaaguauugcugaagccaa

SEQ ID NO: 256394 - RNA, 64 nt, Homo Sapiens
gcugcgaaccguggcacacgguugugacaaaacagaaugauaaauauauuaacuauauaagaga

SEQ ID NO: 256395 - RNA, 64 nt, Homo Sapiens
uauuuuuccaaaugcuucauguucugugaaaagugaaugauaugcucuuauuuuuaagaaaaug

SEQ ID NO: 256396 - RNA, 64 nt, Homo Sapiens
aauaucuuuuagggggcuuuuauaagaugaaaaggaaugauaaaguaaaaugaaaauugagaaa

SEQ ID NO: 256397 - RNA, 64 nt, Homo Sapiens
aucugucccauuuucgaggcguauaugccuucaggaaugauauaaaucucucucucaacaaaag

SEQ ID NO: 256398 - RNA, 64 nt, Homo Sapiens
guuuaugaugaauccauaguuuucuuccugagaagaaugauacuaauauaguucuaaaaauaag

SEQ ID NO: 256399 - RNA, 64 nt, Homo Sapiens
uucugaagguauguuuauaaagaauuuucaaaaagaaugauacacagggcuaaaacugggcuac

SEQ ID NO: 256400 - RNA, 64 nt, Homo Sapiens
cugguuuauuuuuucuguaaauauacaguugggggaaugauaauuuuauuaagcaucuguggga

SEQ ID NO: 256401 - RNA, 64 nt, Homo Sapiens
aaacguuucuuucuaacauuaaugggaucuggacgaaugauacccuguaguuucuuuucuguaa

SEQ ID NO: 256402 - RNA, 64 nt, Homo Sapiens
gagugaagcagaaacaggagauugagacugaggagaaugauagagagggugcgauugaaugagu

SEQ ID NO: 256403 - RNA, 64 nt, Homo Sapiens
cuaauuugguauuacauguauucuauuuuuuucugaaugauagcaugaaaagugucaaaguggu

SEQ ID NO: 256404 - RNA, 64 nt, Homo Sapiens
cacuuuaccaauuguuacuuucaaugugaggaaugaaugauaaauuaagagaaaaaaauaucag

SEQ ID NO: 256405 - RNA, 64 nt, Homo Sapiens
uuuuugauuauugcauuguauuuuaauuugugcagaaugauaaagaauguuccuuuuagaagug

SEQ ID NO: 256406 - RNA, 64 nt, Homo Sapiens
uuguuuguccuuuucuguggaagaaggacauuuagaaugauaucagaugcugaaauguccagaa

SEQ ID NO: 256407 - RNA, 64 nt, Homo Sapiens
uauauccauugcauguugaaaagcuagugauucugaaugauauaugaguucaguguaagcaugg

SEQ ID NO: 256408 - RNA, 64 nt, Homo Sapiens
auuuauauggauaaagaugcgaaucaguucauuagaaugauaacaaacauaauucugcacuuug

SEQ ID NO: 256409 - RNA, 64 nt, Homo Sapiens
aauauuuggaggaaauugaaaguguggaaaaaaagaaugauaaucuuuuaaagggucuacaacu

SEQ ID NO: 256410 - RNA, 64 nt, Homo Sapiens
cucuccuccaccuucaccccaagacuaggggcaggaaugauaagaaggcugggugguagcuggg

SEQ ID NO: 256411 - RNA, 64 nt, Homo Sapiens
gaacagcaaugcuaguaacaggaugggaacaugggaaugauaauauauauuuuuucuuuuaaua

SEQ ID NO: 256412 - RNA, 64 nt, Homo Sapiens
augaguucuuacaaacuguuuguuauauuuucuggaaugauaagugagaauuauuuagaaaaga

SEQ ID NO: 256413 - RNA, 64 nt, Homo Sapiens
gcaaaagcaauuguuuuuaaauuaacaauggagagaaugauaagaugagggaaggaaaaggcau

SEQ ID NO: 256414 - RNA, 64 nt, Homo Sapiens
cuuuuaaagggucuacaacuaguguggaaaaaaagaaugauaauaauauuuggaggaaauugaa

SEQ ID NO: 256415 - RNA, 64 nt, Homo Sapiens
cuuguuuaaaugaaagagaaaugauuuuaaaagggaaugauaugucuaaauauuuauuuagaga

SEQ ID NO: 256416 - RNA, 64 nt, Homo Sapiens
auuauacaaguaaugccaaaguagugacucauuggaaugauauaauguuuugaauggauuaccu

SEQ ID NO: 256417 - RNA, 64 nt, Homo Sapiens
aacacugaaagagcgugggagcucuugcugauaggaaugauagccucaccugguugcucuggaa

SEQ ID NO: 256418 - RNA, 64 nt, Homo Sapiens
gaauguaucaauguauuagauaaacccaguuucagaaugauaaagaaaaaauguuagaccaaau

SEQ ID NO: 256419 - RNA, 64 nt, Homo Sapiens
accugaaucugugcauuuugugccuuauucaugagaaugauagaaguacuaaaaucugucaagu

SEQ ID NO: 256420 - RNA, 64 nt, Homo Sapiens
cgauccuagcugcagaucgcaucccacaaugcgagaaugauaaaauaaaauuggauauuugaga

SEQ ID NO: 256421 - RNA, 64 nt, Homo Sapiens
gaaaaaauguuagaccaaauuaaacccaguuucagaaugauaaagaauguaucaauguauuaga

SEQ ID NO: 256422 - RNA, 64 nt, Homo Sapiens
aaauguuagaccaaauaaugcaaauccaguuucagaaugauaaagaauuuaucaauguauuaca

SEQ ID NO: 256423 - RNA, 64 nt, Homo Sapiens
gaaaucuacauaaaauccagggccagaugcuuuugaaugauagggaguugauuccuccaauaug

SEQ ID NO: 256424 - RNA, 64 nt, Homo Sapiens
agagacuacagauggauaaugccaugggaauacagaaugauagacuguacacaacaaagguaca

SEQ ID NO: 256425 - RNA, 64 nt, Homo Sapiens
ggagcaaguggccaaacaucgguaaagaugagaagaaugauaauaggauacuaagaaaauagaa

SEQ ID NO: 256426 - RNA, 64 nt, Homo Sapiens
aggacacagccauccagcggcaucuuuccuugucgaaugauacuguaaugaccuuccaaaguga

SEQ ID NO: 256427 - RNA, 64 nt, Homo Sapiens
gcauguuucaucuucauuuuuaauauccugaacugaaugauaguguuuuuuuagaugaagaacu

SEQ ID NO: 256428 - RNA, 64 nt, Homo Sapiens
cguuugcuauauuccuuuuucuaugaaauaaugugaaugauaauaaaacagcuuugacuugauu

SEQ ID NO: 256429 - RNA, 64 nt, Homo Sapiens
acccauuuacuguauuuuuuuuaaugaaauaugugaaugauaauaaaaguugcugacuuaaugc

SEQ ID NO: 256430 - RNA, 64 nt, Homo Sapiens
ucuccaggaaacuuguccuucuggaaaucauauugaaugauauuucuauaucgaagugagguag

SEQ ID NO: 256431 - RNA, 64 nt, Homo Sapiens
gcaaguuucuccaguugggacucggcauccucuugaaugauaguaguaggaaacuguacuuuau

SEQ ID NO: 256432 - RNA, 64 nt, Homo Sapiens
ugugguauagugaccaauagguaaacugacuguagaaugauaauagguugucuagguaaugaca

SEQ ID NO: 256433 - RNA, 64 nt, Homo Sapiens
ggcaaaacucaacagccccugcagggacuacuuggaaugauaaaauggugggacuuggucugga

SEQ ID NO: 256434 - RNA, 64 nt, Homo Sapiens
acuuccuacauuauauuuguuguugguuugccaugaaugauauuaagccuaccaaauuucaugc

SEQ ID NO: 256435 - RNA, 64 nt, Homo Sapiens
aucaagcccugcuuaaaguuaaauaaaauagaaugaaugauaccccggcuccauuucccccacu

SEQ ID NO: 256436 - RNA, 64 nt, Homo Sapiens
uacuucugaaaaguucugcucuaucucaaagacugaaugauacuacacaguccucucccuauua

SEQ ID NO: 256437 - RNA, 64 nt, Homo Sapiens
ccauuccacuuagugucuuuucaaugauaggcaagaaugauaucugaguugaacuucggugcuu

SEQ ID NO: 256438 - RNA, 64 nt, Homo Sapiens
ucagagaacgguguuugagucagcuugucugauugaaugauaaugugcuaaauugauuaccucc

SEQ ID NO: 256439 - RNA, 64 nt, Homo Sapiens
gugggagcugcgcuaugaagauacaaaggcacaagaaugauacaauggauuuuggggacuuagg

SEQ ID NO: 256440 - RNA, 64 nt, Homo Sapiens
accaaaagguauauaauuuguguccuuuauguaagaaugauauaagaagaaagggccuucacag

SEQ ID NO: 256441 - RNA, 64 nt, Homo Sapiens
gccugguuuacauucauuuauuucuggaggagacgaaugauaggcagaaaugucuuuucaucuu

SEQ ID NO: 256442 - RNA, 64 nt, Homo Sapiens
ugggaucacaaagccaacugaaguucaucuauuagaaugauaucggacccaauggugcuggaaa

SEQ ID NO: 256443 - RNA, 64 nt, Homo Sapiens
agcuaccuuacauuucugcguauauaugaaaacugaaugauauuucucaguguauuuccuugca

SEQ ID NO: 256444 - RNA, 64 nt, Homo Sapiens
aagauugagcaauagaaaaaaauuccuuuccuuugaaugauagcugugauucaccccaccccau

SEQ ID NO: 256445 - RNA, 64 nt, Homo Sapiens
gauacacaaugaagaauucuauuuggcuaauuaagaaugauauacuauguacacccaauaagcu

SEQ ID NO: 256446 - RNA, 64 nt, Homo Sapiens
caaaaacuacuuuuuagagaggugaagagguccagaaugauaugagcaaauaagccagcagaug

SEQ ID NO: 256447 - RNA, 64 nt, Homo Sapiens
uuaucaauauaguuuaguauaaaccacaaacuaagaaugauaaaggugcguguacuguuucuaa

SEQ ID NO: 256448 - RNA, 64 nt, Homo Sapiens
gaucccagaauuguugaggggggaucaaguugcagaaugauacagauaguacaaugacuuuuuu

SEQ ID NO: 256449 - RNA, 64 nt, Homo Sapiens
gucaagagaacacacaacagagaaacccuauaaagaaugauacaauauguuucaaucagaaccu

SEQ ID NO: 256450 - RNA, 64 nt, Homo Sapiens
auauguugugaauuuuccuugguucuuuuuaaaggaaugauaauaaaguuacuugcuuuaggau

SEQ ID NO: 256451 - RNA, 64 nt, Homo Sapiens
acaaagaagaauccagaaauaggggcacauugaggaaugauacugagcccaaagagcauucaau

SEQ ID NO: 256452 - RNA, 64 nt, Homo Sapiens
gagucuuuuuaaauaugcucuguuaguuuguauggaaugauauuucauugcacuuuuaauuuaa

SEQ ID NO: 256453 - RNA, 64 nt, Homo Sapiens
acaacauaauacguaguuauagugccaacaaauugaaugauaaaguuuacuguggauuagguau

SEQ ID NO: 256454 - RNA, 64 nt, Homo Sapiens
ccuguuuacuguggauuaggagaucauauuaugggaaugauaauuaccaaauucuucauaagaa

SEQ ID NO: 256455 - RNA, 64 nt, Homo Sapiens
uuaacggagugucuaaucuaugagaaaauacagagaaugauagauuugauugggauguuauauu

SEQ ID NO: 256456 - RNA, 64 nt, Homo Sapiens
uuucaucaauguuaucagaucaccaagaagaagugaaugauauuaauccggucuaugccuucug

SEQ ID NO: 256457 - RNA, 64 nt, Homo Sapiens
auauaaauaaaauauauauauuuuauaaagaucagaaugauauaaaggagauacauguuucuuc

SEQ ID NO: 256458 - RNA, 64 nt, Homo Sapiens
guuauuuaaagaagaaacgucuauguguacagaugaaugauaaacucucugcuucucccucugc

SEQ ID NO: 256459 - RNA, 64 nt, Homo Sapiens
cauuggugguuuuccuauuacugauguggcuguggaaugauaagguccuagaggggcccuggca

SEQ ID NO: 256460 - RNA, 64 nt, Homo Sapiens
gcacuccaaaacccacucugcacugcagcacagugaaugauaugcacucaccauuagcuucgac

SEQ ID NO: 256461 - RNA, 64 nt, Homo Sapiens
auuuucaugacaaugucaugguuuuccagggagggaaugauauauacccaggauaauagucaca

SEQ ID NO: 256462 - RNA, 64 nt, Homo Sapiens
ggaagcucuggccugagaguuaaacacccaugcugaaugauacagugugcauucucuccagcug

SEQ ID NO: 256463 - RNA, 64 nt, Homo Sapiens
uugacuuucaugucgucaugcaucugucaugaaugaaugauacuuugcacugggcuguacgaca

SEQ ID NO: 256464 - RNA, 64 nt, Homo Sapiens
cucugcccuuuugucugaaacucaaggccaaggagaaugauaggagacuuaggacagagcugac

SEQ ID NO: 256465 - RNA, 64 nt, Homo Sapiens
cucuuucacccugcugguccgcagcucucaucaugaaugauagagugugugcuuagcgcaaaug

SEQ ID NO: 256466 - RNA, 64 nt, Homo Sapiens
cuucaagaaguugauuccaaaacugaguuaugaagaaugauauaacaguuccuucaaaauuggc

SEQ ID NO: 256467 - RNA, 64 nt, Homo Sapiens
gcuuaauucugagccauuaauccugcuacacuuugaaugauacauuaauucagacuaaucuuug

SEQ ID NO: 256468 - RNA, 64 nt, Homo Sapiens
gggacuagauucuaaaauuuauuugggaccaugggaaugauaguugggaagaaaacuauuugca

SEQ ID NO: 256469 - RNA, 64 nt, Homo Sapiens
aucuugaaguauuguucauauuugucaccucuuggaaugauagcagauccuguaaguugaugua

SEQ ID NO: 256470 - RNA, 64 nt, Homo Sapiens
gacaaguuccuuguuuaacuacacagcuaugauggaaugauauauccaaguuccuugccucagu

SEQ ID NO: 256471 - RNA, 64 nt, Homo Sapiens
aaucacagauuuccaaaaguacuagcaauaaguugaaugauaauagcucacagcacauuuguua

SEQ ID NO: 256472 - RNA, 64 nt, Homo Sapiens
uucaccaguuagacauaauuacuucuaccgaugugaaugauacggaugccggcagagcuuccag

SEQ ID NO: 256473 - RNA, 64 nt, Homo Sapiens
gcaaugugccuaacgauuuuuaugauuuuauggagaaugauaugggugugguuuugaggaggga

SEQ ID NO: 256474 - RNA, 64 nt, Homo Sapiens
cuguuucugagggaugccagagucugugcaucaugaaugauaagcuaccucuggccgcaauucc

SEQ ID NO: 256475 - RNA, 64 nt, Homo Sapiens
cuuaccgaauucuucuugugcagccuagagucuugaaugauagcauaaaccugaauauuauuac

SEQ ID NO: 256476 - RNA, 64 nt, Homo Sapiens
uuauccuagcaaaggggccucugugcuucaaugagaaugauaaacugaaauucugacuucucuc

SEQ ID NO: 256477 - RNA, 64 nt, Homo Sapiens
cuuuuauuuauucacagaagagugcguuuguacggaaugauaaaaaaaacuguuguggaaaaug

SEQ ID NO: 256478 - RNA, 64 nt, Homo Sapiens
caugagguggaagacgagguaucaaagacaaacugaaugauaacuguucccgccaguuccacag

SEQ ID NO: 256479 - RNA, 64 nt, Homo Sapiens
cucuuuuagagaacaaauaaggaaaagagauucagaaugauaacuauaauuaagaguuucuuau

SEQ ID NO: 256480 - RNA, 64 nt, Homo Sapiens; identical to SEQ ID NO: 115576

SEQ ID NO: 256481 - RNA, 64 nt, Homo Sapiens; identical to SEQ ID NO: 115577

SEQ ID NO: 256482 - RNA, 64 nt, Homo Sapiens; identical to SEQ ID NO: 115578

SEQ ID NO: 256483 - RNA, 64 nt, Homo Sapiens; identical to SEQ ID NO: 115579

SEQ ID NO: 256484 - RNA, 64 nt, Homo Sapiens; identical to SEQ ID NO: 115580

SEQ ID NO: 256485 - RNA, 64 nt, Homo Sapiens; identical to SEQ ID NO: 115581

SEQ ID NO: 256486 - RNA, 64 nt, Homo Sapiens; identical to SEQ ID NO: 115582

SEQ ID NO: 256487 - RNA, 64 nt, Homo Sapiens; identical to SEQ ID NO: 115583

SEQ ID NO: 256488 - RNA, 64 nt, Homo Sapiens; identical to SEQ ID NO: 115584

SEQ ID NO: 256489 - RNA, 64 nt, Homo Sapiens; identical to SEQ ID NO: 115585

SEQ ID NO: 256490 - RNA, 64 nt, Homo Sapiens; identical to SEQ ID NO: 115586

SEQ ID NO: 256491 - RNA, 64 nt, Homo Sapiens; identical to SEQ ID NO: 115587

SEQ ID NO: 256492 - RNA, 64 nt, Homo Sapiens; identical to SEQ ID NO: 115588

SEQ ID NO: 256493 - RNA, 64 nt, Homo Sapiens; identical to SEQ ID NO: 115589

SEQ ID NO: 256494 - RNA, 64 nt, Homo Sapiens; identical to SEQ ID NO: 115590

SEQ ID NO: 256495 - RNA, 64 nt, Homo Sapiens; identical to SEQ ID NO: 115591

SEQ ID NO: 256496 - RNA, 63 nt, Homo Sapiens
guccuuucugcagcuucuaaccuuaguugagggagucagcacagagcaagcgguaguaccacc

SEQ ID NO: 256497 - RNA, 63 nt, Homo Sapiens
guccagaaagccaaaaagaaaggaaagagcuggagucagcacugaggcagcagcaucccaaga

SEQ ID NO: 256498 - RNA, 63 nt, Homo Sapiens
uuccaagccaaucaaucagccaguuccuagcagagucagcacaugaacaagaucuaagucauu

SEQ ID NO: 256499 - RNA, 63 nt, Homo Sapiens
gugugugugugcgcgcgcacgcacgccuugagcagucagcauugcaccugcuauggagaaggg

SEQ ID NO: 256500 - RNA, 63 nt, Homo Sapiens
cgagcacuuuauaucccuuuggcacuggcugggagucagcaaguccuuugcaaaggccuuggg

SEQ ID NO: 256501 - RNA, 63 nt, Homo Sapiens
aaugaaacucauguuuaaacagaugccgggggcagucagcauugccacccugggaggcuugcc

SEQ ID NO: 256502 - RNA, 63 nt, Homo Sapiens
gagagcggcuuccccaucgcuucuggcugcugcagucagcacaaggacagcuuccccaucgcc

SEQ ID NO: 256503 - RNA, 63 nt, Homo Sapiens
gagagcggcuuccccauugcuucuggccgcugcagucagcacaaggacggcuuccccaucgcc

SEQ ID NO: 256504 - RNA, 63 nt, Homo Sapiens
augggagaaugaggaguaaaaugcucacggcaaagucagcagcacugguaagccaagacugag

SEQ ID NO: 256505 - RNA, 63 nt, Homo Sapiens
cugguccaggauucgcccucucccaugccuucaagucagcaucaggcuuagggcaaagaccag

SEQ ID NO: 256506 - RNA, 63 nt, Homo Sapiens
uuucuugccagcuugggccauucuugcuuagacagucagcauuugucuccuccuuuaacugag

SEQ ID NO: 256507 - RNA, 63 nt, Homo Sapiens
ggaugggacuggucguguuugugcuuuucuccaagucagcacccaaaggucaaugcacagaga

SEQ ID NO: 256508 - RNA, 63 nt, Homo Sapiens; identical to SEQ ID NO: 57033

SEQ ID NO: 256509 - RNA, 63 nt, Homo Sapiens; identical to SEQ ID NO: 57034

SEQ ID NO: 256510 - RNA, 63 nt, Homo Sapiens; identical to SEQ ID NO: 57035

SEQ ID NO: 256511 - RNA, 63 nt, Homo Sapiens; identical to SEQ ID NO: 57036

SEQ ID NO: 256512 - RNA, 63 nt, Homo Sapiens; identical to SEQ ID NO: 57037

SEQ ID NO: 256513 - RNA, 63 nt, Homo Sapiens; identical to SEQ ID NO: 57038

SEQ ID NO: 256514 - RNA, 63 nt, Homo Sapiens; identical to SEQ ID NO: 57039

SEQ ID NO: 256515 - RNA, 63 nt, Homo Sapiens; identical to SEQ ID NO: 57040

SEQ ID NO: 256516 - RNA, 63 nt, Homo Sapiens; identical to SEQ ID NO: 57041

SEQ ID NO: 256517 - RNA, 63 nt, Homo Sapiens; identical to SEQ ID NO: 57042

SEQ ID NO: 256518 - RNA, 63 nt, Homo Sapiens; identical to SEQ ID NO: 57043

SEQ ID NO: 256519 - RNA, 63 nt, Homo Sapiens; identical to SEQ ID NO: 57044

SEQ ID NO: 256520 - RNA, 63 nt, Homo Sapiens; identical to SEQ ID NO: 57045

SEQ ID NO: 256521 - RNA, 63 nt, Homo Sapiens; identical to SEQ ID NO: 57046

SEQ ID NO: 256522 - RNA, 63 nt, Homo Sapiens; identical to SEQ ID NO: 57047

SEQ ID NO: 256523 - RNA, 63 nt, Homo Sapiens; identical to SEQ ID NO: 57048

SEQ ID NO: 256524 - RNA, 63 nt, Homo Sapiens; identical to SEQ ID NO: 57049

SEQ ID NO: 256525 - RNA, 63 nt, Homo Sapiens; identical to SEQ ID NO: 57050

SEQ ID NO: 256526 - RNA, 63 nt, Homo Sapiens; identical to SEQ ID NO: 57051

SEQ ID NO: 256527 - RNA, 63 nt, Homo Sapiens; identical to SEQ ID NO: 57052

SEQ ID NO: 256528 - RNA, 63 nt, Homo Sapiens; identical to SEQ ID NO: 57053

SEQ ID NO: 256529 - RNA, 63 nt, Homo Sapiens; identical to SEQ ID NO: 57054

SEQ ID NO: 256530 - RNA, 63 nt, Homo Sapiens; identical to SEQ ID NO: 57055

SEQ ID NO: 256531 - RNA, 63 nt, Homo Sapiens; identical to SEQ ID NO: 57056

SEQ ID NO: 256532 - RNA, 63 nt, Homo Sapiens; identical to SEQ ID NO: 57057

SEQ ID NO: 256533 - RNA, 63 nt, Homo Sapiens; identical to SEQ ID NO: 57058

SEQ ID NO: 256534 - RNA, 63 nt, Homo Sapiens; identical to SEQ ID NO: 57059

SEQ ID NO: 256535 - RNA, 63 nt, Homo Sapiens; identical to SEQ ID NO: 57060

SEQ ID NO: 256536 - RNA, 63 nt, Homo Sapiens; identical to SEQ ID NO: 57061

SEQ ID NO: 256537 - RNA, 63 nt, Homo Sapiens; identical to SEQ ID NO: 57062

SEQ ID NO: 256538 - RNA, 63 nt, Homo Sapiens; identical to SEQ ID NO: 57063

SEQ ID NO: 256539 - RNA, 63 nt, Homo Sapiens; identical to SEQ ID NO: 57064

SEQ ID NO: 256540 - RNA, 63 nt, Homo Sapiens; identical to SEQ ID NO: 57065

SEQ ID NO: 256541 - RNA, 63 nt, Homo Sapiens; identical to SEQ ID NO: 57066

SEQ ID NO: 256542 - RNA, 63 nt, Homo Sapiens; identical to SEQ ID NO: 57067

SEQ ID NO: 256543 - RNA, 63 nt, Homo Sapiens; identical to SEQ ID NO: 57068

SEQ ID NO: 256544 - RNA, 63 nt, Homo Sapiens; identical to SEQ ID NO: 57069

SEQ ID NO: 256545 - RNA, 63 nt, Homo Sapiens; identical to SEQ ID NO: 57070

SEQ ID NO: 256546 - RNA, 63 nt, Homo Sapiens; identical to SEQ ID NO: 57071

SEQ ID NO: 256547 - RNA, 63 nt, Homo Sapiens; identical to SEQ ID NO: 57072

SEQ ID NO: 256548 - RNA, 63 nt, Homo Sapiens; identical to SEQ ID NO: 57073

SEQ ID NO: 256549 - RNA, 63 nt, Homo Sapiens; identical to SEQ ID NO: 57074

SEQ ID NO: 256550 - RNA, 63 nt, Homo Sapiens; identical to SEQ ID NO: 57075

SEQ ID NO: 256551 - RNA, 63 nt, Homo Sapiens; identical to SEQ ID NO: 57076

SEQ ID NO: 256552 - RNA, 63 nt, Homo Sapiens; identical to SEQ ID NO: 57077

SEQ ID NO: 256553 - RNA, 63 nt, Homo Sapiens; identical to SEQ ID NO: 57078

SEQ ID NO: 256554 - RNA, 63 nt, Homo Sapiens; identical to SEQ ID NO: 57079

SEQ ID NO: 256555 - RNA, 63 nt, Homo Sapiens; identical to SEQ ID NO: 57080

SEQ ID NO: 256556 - RNA, 63 nt, Homo Sapiens; identical to SEQ ID NO: 57081

SEQ ID NO: 256557 - RNA, 63 nt, Homo Sapiens; identical to SEQ ID NO: 57082

SEQ ID NO: 256558 - RNA, 63 nt, Homo Sapiens; identical to SEQ ID NO: 57083

SEQ ID NO: 256559 - RNA, 63 nt, Homo Sapiens; identical to SEQ ID NO: 57084

SEQ ID NO: 256560 - RNA, 63 nt, Homo Sapiens; identical to SEQ ID NO: 57085

SEQ ID NO: 256561 - RNA, 63 nt, Homo Sapiens; identical to SEQ ID NO: 57086

SEQ ID NO: 256562 - RNA, 63 nt, Homo Sapiens; identical to SEQ ID NO: 57087

SEQ ID NO: 256563 - RNA, 63 nt, Homo Sapiens; identical to SEQ ID NO: 57088

SEQ ID NO: 256564 - RNA, 63 nt, Homo Sapiens; identical to SEQ ID NO: 57089

SEQ ID NO: 256565 - RNA, 64 nt, Homo Sapiens; identical to SEQ ID NO: 134242

SEQ ID NO: 256566 - RNA, 64 nt, Homo Sapiens; identical to SEQ ID NO: 134243

SEQ ID NO: 256567 - RNA, 64 nt, Homo Sapiens; identical to SEQ ID NO: 134244

SEQ ID NO: 256568 - RNA, 64 nt, Homo Sapiens; identical to SEQ ID NO: 134245

SEQ ID NO: 256569 - RNA, 52 nt, Homo Sapiens; identical to SEQ ID NO: 134246

SEQ ID NO: 256570 - RNA, 64 nt, Homo Sapiens; identical to SEQ ID NO: 134247

SEQ ID NO: 256571 - RNA, 64 nt, Homo Sapiens; identical to SEQ ID NO: 134248

SEQ ID NO: 256572 - RNA, 64 nt, Homo Sapiens; identical to SEQ ID NO: 134249

SEQ ID NO: 256573 - RNA, 64 nt, Homo Sapiens; identical to SEQ ID NO: 134250

SEQ ID NO: 256574 - RNA, 64 nt, Homo Sapiens; identical to SEQ ID NO: 134251

SEQ ID NO: 256575 - RNA, 64 nt, Homo Sapiens; identical to SEQ ID NO: 134252

SEQ ID NO: 256576 - RNA, 64 nt, Homo Sapiens; identical to SEQ ID NO: 134253

SEQ ID NO: 256577 - RNA, 64 nt, Homo Sapiens; identical to SEQ ID NO: 134254

SEQ ID NO: 256578 - RNA, 64 nt, Homo Sapiens; identical to SEQ ID NO: 134255

SEQ ID NO: 256579 - RNA, 64 nt, Homo Sapiens; identical to SEQ ID NO: 134256

SEQ ID NO: 256580 - RNA, 64 nt, Homo Sapiens; identical to SEQ ID NO: 134257

SEQ ID NO: 256581 - RNA, 64 nt, Homo Sapiens; identical to SEQ ID NO: 134258

SEQ ID NO: 256582 - RNA, 64 nt, Homo Sapiens; identical to SEQ ID NO: 134259

SEQ ID NO: 256583 - RNA, 64 nt, Homo Sapiens; identical to SEQ ID NO: 134260

SEQ ID NO: 256584 - RNA, 64 nt, Homo Sapiens; identical to SEQ ID NO: 134261

SEQ ID NO: 256585 - RNA, 64 nt, Homo Sapiens; identical to SEQ ID NO: 134262

SEQ ID NO: 256586 - RNA, 64 nt, Homo Sapiens; identical to SEQ ID NO: 134263

SEQ ID NO: 256587 - RNA, 64 nt, Homo Sapiens; identical to SEQ ID NO: 134264

SEQ ID NO: 256588 - RNA, 64 nt, Homo Sapiens; identical to SEQ ID NO: 134265

SEQ ID NO: 256589 - RNA, 64 nt, Homo Sapiens; identical to SEQ ID NO: 134266

SEQ ID NO: 256590 - RNA, 64 nt, Homo Sapiens; identical to SEQ ID NO: 134267

SEQ ID NO: 256591 - RNA, 64 nt, Homo Sapiens; identical to SEQ ID NO: 134268

SEQ ID NO: 256592 - RNA, 64 nt, Homo Sapiens; identical to SEQ ID NO: 134269

SEQ ID NO: 256593 - RNA, 64 nt, Homo Sapiens; identical to SEQ ID NO: 97841

SEQ ID NO: 256594 - RNA, 64 nt, Homo Sapiens; identical to SEQ ID NO: 97842

SEQ ID NO: 256595 - RNA, 64 nt, Homo Sapiens; identical to SEQ ID NO: 97843

SEQ ID NO: 256596 - RNA, 64 nt, Homo Sapiens; identical to SEQ ID NO: 97844

SEQ ID NO: 256597 - RNA, 64 nt, Homo Sapiens; identical to SEQ ID NO: 97845

SEQ ID NO: 256598 - RNA, 64 nt, Homo Sapiens; identical to SEQ ID NO: 97846

SEQ ID NO: 256599 - RNA, 64 nt, Homo Sapiens; identical to SEQ ID NO: 97847

SEQ ID NO: 256600 - RNA, 64 nt, Homo Sapiens; identical to SEQ ID NO: 97848

SEQ ID NO: 256601 - RNA, 64 nt, Homo Sapiens
ggugguggccuggggcaccggccaggugggccucgguggcgagguggucguucuggcaaaggcg

SEQ ID NO: 256602 - RNA, 64 nt, Homo Sapiens
accacggcugggcgucugugccaggccucccgaagguggcgauggugagcagcagggguccugg

SEQ ID NO: 256603 - RNA, 64 nt, Homo Sapiens
cuuagagaaaucuggagaacuauaccugcuucagugaaauaauuacagaauauacuuagaaagg

SEQ ID NO: 256604 - RNA, 64 nt, Homo Sapiens
uuaaacuccaaaugagccauaggaaggcacuacaugaaauaaugcacugaguaugcaaugcuau

SEQ ID NO: 256605 - RNA, 64 nt, Homo Sapiens
uucaaguuggagcaauugucuguguuugaaaagaugaaauaaaaauaauaaucaagggcaaagc

SEQ ID NO: 256606 - RNA, 64 nt, Homo Sapiens
uauccccauuccaagaaauauaagugagugaaguugaaauaaaaucuuuaaaauuuacuauauu

SEQ ID NO: 256607 - RNA, 64 nt, Homo Sapiens
agaagagagggaggaagaaaaaaugggaaaaaaaugaaauaaaaaccuggcuucuauaacaaau

SEQ ID NO: 256608 - RNA, 64 nt, Homo Sapiens
accaaccccuuagcaauaagcuacgucuguucacugaaauaauuuaaaaaaagauaaauauuuc

SEQ ID NO: 256609 - RNA, 64 nt, Homo Sapiens
aacugaaaaaaacuuuagaguugacuagggaucaugaaauaauacuauuuugggguaucagugu

SEQ ID NO: 256610 - RNA, 64 nt, Homo Sapiens
uucagaggaaggaaggaaaaccucuuggauuuuuugaaauaauccauccagaaagucuguuauu

SEQ ID NO: 256611 - RNA, 64 nt, Homo Sapiens
auuggcauguagccaauguugcaacauuacucuuugaaauaaaacaaugauaacuauuauuugu

SEQ ID NO: 256612 - RNA, 64 nt, Homo Sapiens
aauaacucuuuuacuagugagauaagacuucauuugaaauaagauacagccuaauuaauaccua

SEQ ID NO: 256613 - RNA, 64 nt, Homo Sapiens
guuggguguucccucuucuugucuacuuuuuguuugaaauaacuaaagaaauaugugaugaugu

SEQ ID NO: 256614 - RNA, 64 nt, Homo Sapiens
uguuuuaaaguaaguuauaucuuagauaaucuucugaaauaauuuauguugcuuguuugugaca

SEQ ID NO: 256615 - RNA, 64 nt, Homo Sapiens
uugcaguauauauauguugcuucguuugugcgauugaaauaaaauaaguuuccuacacgcuaac

SEQ ID NO: 256616 - RNA, 64 nt, Homo Sapiens
cacuuucaucugcuuucuaguuuuacuaaaacuuugaaauaauuugaacucugauuaucagaag

SEQ ID NO: 256617 - RNA, 64 nt, Homo Sapiens
ucgauacuguguacauagcagggagugaucggggugaaauaacuugggccagaauauuauuaaa

SEQ ID NO: 256618 - RNA, 64 nt, Homo Sapiens
uuagguaacaaguucuuacaccaaacuuccuugaugaaauaagccaaaauaauccuaaaauuca

SEQ ID NO: 256619 - RNA, 64 nt, Homo Sapiens
aaaagauggguuuuguaaaauuaaauuuuuguuaugaaauaaaagcaggaaguacagacguacu

SEQ ID NO: 256620 - RNA, 64 nt, Homo Sapiens
aauuuauuguaagacaacauuuaacuguaagaaaugaaauaaguccaaggaaauggcauaugga

SEQ ID NO: 256621 - RNA, 64 nt, Homo Sapiens
cuggucuuguguuuuucucuugaauaacauuguaugaaauaaacauuagaaaaugaaaaaugug

SEQ ID NO: 256622 - RNA, 64 nt, Homo Sapiens
uuaacuucacuucuuuguaucuuauugguucauaugaaauaaugaguuugucuaaguccuggcu

SEQ ID NO: 256623 - RNA, 64 nt, Homo Sapiens
gaaaauguuaaaucuaccaguauuuucuuucuguugaaauaacucucuuacaagguaauuuaca

SEQ ID NO: 256624 - RNA, 64 nt, Homo Sapiens
aacguggaguuuuccuucccacuuucccuagaggugaaauaaccugggacucaaaugcaaacag

SEQ ID NO: 256625 - RNA, 64 nt, Homo Sapiens
cuugaucaacaaugaauucaaaauaguuaaccuaugaaauaacauccucucaaauguuugcuga

SEQ ID NO: 256626 - RNA, 64 nt, Homo Sapiens
cacccaaguaaugaagacuuaagagaaccuugguugaaauaaauuuccaauaguuuggagacuc

SEQ ID NO: 256627 - RNA, 64 nt, Homo Sapiens
ucauucuguguuaaaucauuucaggguuuaauuuugaaauaaaagauuaauauaaaaugcaaca

SEQ ID NO: 256628 - RNA, 64 nt, Homo Sapiens
ucccauagggcauuaguucucagauuuuggaaugugaaauaaucaccuaggaaguugguuuaaa

SEQ ID NO: 256629 - RNA, 64 nt, Homo Sapiens
auuuugacugaaauguaaaaagugguuucaccugugaaauaacuagguaggaaguaagcuacuu

SEQ ID NO: 256630 - RNA, 64 nt, Homo Sapiens
uauucuuauucucauuguuuauuauugccugauaugaaauaauaaaaguauuugggcuaagguu

SEQ ID NO: 256631 - RNA, 64 nt, Homo Sapiens
uaauguuuuaaauuuauuuauaaaaauguuuauaugaaauaacucauugauauaacgcuguaau

SEQ ID NO: 256632 - RNA, 64 nt, Homo Sapiens
guuguuaagccuguaggacucuuuuaguuccacaugaaauaaauuuuuagucaucuuuuauaua

SEQ ID NO: 256633 - RNA, 64 nt, Homo Sapiens
cugggugcuauauugaugggcagaaggguccugcugaaauaacaaaccuuaccuuagaugcuaa

SEQ ID NO: 256634 - RNA, 64 nt, Homo Sapiens
auauauuuuuaacauauauuaagcaucuaaaaauugaaauaaauaugauggccuguaacaguug

SEQ ID NO: 256635 - RNA, 64 nt, Homo Sapiens
gauucaucuguaauugggauauacccagcacccaugaaauaaaauuuugucuuaaaaagaccac

SEQ ID NO: 256636 - RNA, 64 nt, Homo Sapiens
caaaauuaaaaacaugauuuuugaauuugugaucugaaauaacaagcuuaauguuuacaagugu

SEQ ID NO: 256637 - RNA, 64 nt, Homo Sapiens
ugaagaauuuaauuuuagaauaaauaauccaaucugaaauaauuauaccuucuuuccuuguuag

SEQ ID NO: 256638 - RNA, 64 nt, Homo Sapiens
cccugcaucuuggagggaggcaggaaauuucuuuugaaauaaagugcuggagcugaauucugca

SEQ ID NO: 256639 - RNA, 64 nt, Homo Sapiens
agcuuuauaucuguuccuaaaacaguuaauccugugaaauaaauauugaacauaauccagaaga

SEQ ID NO: 256640 - RNA, 64 nt, Homo Sapiens
auuuuuuauuauuuuaauauacuguaagccaaacugaaauaacauuugcuguuuuauagguuug

SEQ ID NO: 256641 - RNA, 64 nt, Homo Sapiens
uucuauuuuguuauauuuaauaauagaauuagauugaaauaaaauauaaugggaaauaaucugc

SEQ ID NO: 256642 - RNA, 64 nt, Homo Sapiens
agccagacuucuaaggaguagugaaagaaaacccugaaauaaucgaacaggaaaaaguugcccu

SEQ ID NO: 256643 - RNA, 64 nt, Homo Sapiens
auguaaagaauguuuugagcaaugguagcauuauugaaauaaauguuuaacuauccaaagugau

SEQ ID NO: 256644 - RNA, 64 nt, Homo Sapiens
uuuaaauggacaauggacuguacaauaaguuacuugaaauaaguuguuucagauaaauuucaau

SEQ ID NO: 256645 - RNA, 64 nt, Homo Sapiens
uuaaaauaaacauuuuguccaccuuuuaaguuaaugaaauaaaauuugaaacugacuuuugcag

SEQ ID NO: 256646 - RNA, 64 nt, Homo Sapiens
gccugauaucaucuuaaaaaaaaaucucagaaucugaaauaagcccuaaauuucuccccaaaau

SEQ ID NO: 256647 - RNA, 64 nt, Homo Sapiens
uuaacuucucaauuaugccaaaguugcacuugcaugaaauaaauauuauuuuguccuuguauag

SEQ ID NO: 256648 - RNA, 64 nt, Homo Sapiens
gugugcacccacauccaauggugcuacaagugacugaaauaauauuugagucuuucugcucaaa

SEQ ID NO: 256649 - RNA, 64 nt, Homo Sapiens
uuuauauaaaaacaaugauaaagaugugaaacugugaaauaaauauaccauauuagcuacccac

SEQ ID NO: 256650 - RNA, 64 nt, Homo Sapiens
gcagauauuuauuuaacccuacuguucccccuuuugaaauaaguuuguaaacucuuuaugauca

SEQ ID NO: 256651 - RNA, 64 nt, Homo Sapiens
ugaccguuaacgcaaguaaccuccucucuuuuaaugaaauaacguaugucauagauuucugcuc

SEQ ID NO: 256652 - RNA, 64 nt, Homo Sapiens
auguucugguauuauaucuauuugauuucucaucugaaauaaucauacuuaaaaauggguuuau

SEQ ID NO: 256653 - RNA, 64 nt, Homo Sapiens
cacgucccuuaacugcauugcuugcagaaagcuaugaaauaaaauuuguaucagagcaauuuug

SEQ ID NO: 256654 - RNA, 57 nt, Homo Sapiens
auuuuaauguacaaaacugaaaccagaugaaauaauguucugucacgugaaauauuu

SEQ ID NO: 256655 - RNA, 64 nt, Homo Sapiens
gagcauggaaaaauacugccuagaaaaugcaaaaugaaauaagagagaguaguuuuucagcuag

SEQ ID NO: 256656 - RNA, 64 nt, Homo Sapiens
cugaucaccauguaaggucacauuuaguaaaugcugaaauaaaaugauuaaugcauuuaucaau

SEQ ID NO: 256657 - RNA, 64 nt, Homo Sapiens
ggccaauauauuuugaaauauugaugcagacaaaugaaauaauaaagagauuuucaugguuuau

SEQ ID NO: 256658 - RNA, 64 nt, Homo Sapiens
auuuuuaaauauauauauauauauacacacauugugaaauaaugaaauaaagguaauuaacaca

SEQ ID NO: 256659 - RNA, 64 nt, Homo Sapiens
auauauauauauauauacacacauugugaaauaaugaaauaaagguaauuaacacaucuagcac

SEQ ID NO: 256660 - RNA, 64 nt, Homo Sapiens
uauccuauuaccuacugauacuucuucacuguuuugaaauaaaaacaaauuuuaugcuuagcag

SEQ ID NO: 256661 - RNA, 64 nt, Homo Sapiens
uuagccaaaugguggaacuaaauucagucuuuaaugaaauaauaauuuuauuuccuaaaaucua

SEQ ID NO: 256662 - RNA, 64 nt, Homo Sapiens
uuuacauuuuuggcacauaaccuguuaauuuucuugaaauaagugccaaaauuuacccguguag

SEQ ID NO: 256663 - RNA, 64 nt, Homo Sapiens
agauuuucuucuacggugugaaagugcacaucacugaaauaaugucucacaugguuugaaacuu

SEQ ID NO: 256664 - RNA, 64 nt, Homo Sapiens
gagaagccaagcucuucaagucugcaacaagaucugaaauaaaugaaauaagauugacuuugaa

SEQ ID NO: 256665 - RNA, 64 nt, Homo Sapiens
uaggaaccuaugaaacuauuauuacucaugaccuugaaauaaaaauucaacugcaucuccaaac

SEQ ID NO: 256666 - RNA, 64 nt, Homo Sapiens
guauuucucugaauucagugaauuuuaaaagauuugaaauaauuauuuuuaauaugacaaaaca

SEQ ID NO: 256667 - RNA, 64 nt, Homo Sapiens
uuuuuuaaaaagaggaucccaaacuguaaaagauugaaauaaucuuucucaggauuuuuuaaau

SEQ ID NO: 256668 - RNA, 64 nt, Homo Sapiens
cuuuuuucagguaauagaagugaauaauuuauugugaaauaauucauuuuauaaauguauaauu

SEQ ID NO: 256669 - RNA, 64 nt, Homo Sapiens
uuagcaguuuaacuaaauacuuucuuggaauaugugaaauaaauaagagaauggcugaugucuc

SEQ ID NO: 256670 - RNA, 64 nt, Homo Sapiens
aauauagguguuuguaaguaguugcgccuauuuaugaaauaauaaaucuuuuuuuauggaaccu

SEQ ID NO: 256671 - RNA, 64 nt, Homo Sapiens
uaugguaucuucaucauuuuuuggcuuaguauguugaaauaaacuuaguuguuuucuuauuuuu

SEQ ID NO: 256672 - RNA, 64 nt, Homo Sapiens
gauggcauuaugugguuaaguuuugucuugucacugaaauaaaacaagagugugaccuaaaugc

SEQ ID NO: 256673 - RNA, 64 nt, Homo Sapiens
ggcaucaagugcauguguguggcggcucugucucugaaauaaauugggaaauuuguaucuccaa

SEQ ID NO: 256674 - RNA, 64 nt, Homo Sapiens
ucuguggguuggcaauggcuuaagcucacagaagugaaauaaugcuccagccaccucagugcuc

SEQ ID NO: 256675 - RNA, 64 nt, Homo Sapiens
cuuuguuuuuugaaaucgauugggaucgaaagccugaaauaaauauucauacuuuccauagaac

SEQ ID NO: 256676 - RNA, 64 nt, Homo Sapiens
gucuuuuucugcccaucugucuacuaauaaaaugugaaauaaaauaccuguauugcuacuuccc

SEQ ID NO: 256677 - RNA, 64 nt, Homo Sapiens
accaauugcugcuacuuauauaauugccaaaaagugaaauaauguguaguucauguaaauaaua

SEQ ID NO: 256678 - RNA, 64 nt, Homo Sapiens
aagaaauugaauacuuugaauguguuucacaguuugaaauaagcuauuugauguaauacuucuu

SEQ ID NO: 256679 - RNA, 64 nt, Homo Sapiens
ucaucuaccuucaggauugcugacagacagaauuugaaauaaaauaugcaaguuagcuaauaca

SEQ ID NO: 256680 - RNA, 64 nt, Homo Sapiens
uaugcagccuuuccucuguacuuuucuccaugguugaaauaaaacagggugacugggaguuacu

SEQ ID NO: 256681 - RNA, 64 nt, Homo Sapiens
gaguaaguucuucucagagacuuguagcauauucugaaauaauacuuucagaaauuguaaauau

SEQ ID NO: 256682 - RNA, 64 nt, Homo Sapiens
guacauaauuuauuuuaguaggcagugauuaggaugaaauaauuuuuuguuauuaaacucaaaa

SEQ ID NO: 256683 - RNA, 64 nt, Homo Sapiens
uuucugguauuuucuucauuaauauauugaugggugaaauaauaguauaucucugaaauaauga

SEQ ID NO: 256684 - RNA, 64 nt, Homo Sapiens
aaauauauugaugggugaaaaauauguauaucucugaaauaaugaagaauuuacaucuuuuaca

SEQ ID NO: 256685 - RNA, 64 nt, Homo Sapiens
guccuguuauauguauaucaggaauacaaggaugugaaauaaaacuguaaauuugcauaacugg

SEQ ID NO: 256686 - RNA, 64 nt, Homo Sapiens
guaaauuugcauaacuggauguacuuagauaaugugaaauaaacauuaaagacaaggucuauuu

SEQ ID NO: 256687 - RNA, 64 nt, Homo Sapiens
uguacauuuguaauuagugccuuuauucauauuuugaaauaaguucuuaguuuuauauuauacc

SEQ ID NO: 256688 - RNA, 64 nt, Homo Sapiens
uagaagucauguuagcagcuaauuauuucagugaugaaauaauuuguguuuuauaucccccuuc

SEQ ID NO: 256689 - RNA, 64 nt, Homo Sapiens
uguucaaauaaacaaaaaauccaagauugauucaugaaauaaagaagacaugaauuguuuuaag

SEQ ID NO: 256690 - RNA, 64 nt, Homo Sapiens
aaaucaaauuaagaaaaccugagucuuuagaagcugaaauaaucaacuuguuugugcuguuugc

SEQ ID NO: 256691 - RNA, 64 nt, Homo Sapiens
uuccaaucauugcuagaaaauuggcauauuccuuugaaauaaacuuaugaaauguuuucucucu

SEQ ID NO: 256692 - RNA, 64 nt, Homo Sapiens
auuuuaaaagcacuuucuauuuuuaaaaguaacuugaaauaauauaguauaagaauccuauugu

SEQ ID NO: 256693 - RNA, 64 nt, Homo Sapiens
cacccuguggggauggagaauacauuaugcgaagugaaauaagcugacauggaugaaccuugag

SEQ ID NO: 256694 - RNA, 64 nt, Homo Sapiens
cugaaagauggucauaugauuauaugaauaauuuugaaauaacuagcuaaacuaaucaaaaucu

SEQ ID NO: 256695 - RNA, 64 nt, Homo Sapiens
caacguaaguaacaauuuuuaguuuauuuguagcugaaauaaaguauuacauuacaucaaauaa

SEQ ID NO: 256696 - RNA, 64 nt, Homo Sapiens
aaggcaaaauagagguggaacagaacaauggagaugaaauaaacucaugauucaugauugaaag

SEQ ID NO: 256697 - RNA, 64 nt, Homo Sapiens
ugcauuuucaaagauaaauuggaauugcuguuggugaaauaacaaccaaaauacugaaucugau

SEQ ID NO: 256698 - RNA, 64 nt, Homo Sapiens
aucuuguuuaaauguaaauguccccuuaugcuuuugaaauaaauuuccuuuuguaauuuuguuu

SEQ ID NO: 256699 - RNA, 64 nt, Homo Sapiens
uugugaaaaaagaagacuaaauuaagaccugagcugaaauaaagugaguggaaauggaaauaau

SEQ ID NO: 256700 - RNA, 64 nt, Homo Sapiens
aaaaaaucagucugagaguauuagucacaauuaaugaaauaauuacauuuuauguauugaggau

SEQ ID NO: 256701 - RNA, 64 nt, Homo Sapiens
caauggucuauauaagcaaaaggagauagagaucugaaauaauuuuccgaauaauucaggugga

SEQ ID NO: 256702 - RNA, 64 nt, Homo Sapiens
acagaggaauuuuguuuuaauguagaaaguuauuugaaauaaacuaggugaaaugaaauuaacu

SEQ ID NO: 256703 - RNA, 64 nt, Homo Sapiens
gcuucuaccauagaaauaaauauuuuucuauaucugaaauaaaucucugacuuugaaauagugu

SEQ ID NO: 256704 - RNA, 64 nt, Homo Sapiens
auaguagguauguauuauggaauaauaaugauguugaaauaaugggaagauguacuccguauca

SEQ ID NO: 256705 - RNA, 64 nt, Homo Sapiens
aagaccucuggcuaagagcaggcuucaaacgaugugaaauaagcugagauggcuacaugauauu

SEQ ID NO: 256706 - RNA, 64 nt, Homo Sapiens
accggggaagucugacauaugcaggaaacucuuuugaaauaacuuuggugcccaggccaaguag

SEQ ID NO: 256707 - RNA, 64 nt, Homo Sapiens
guagaauaaacacaaugguuuguuuuuauauaugugaaauaaaauguucaguacaauuauaagc

SEQ ID NO: 256708 - RNA, 64 nt, Homo Sapiens
aggcguggacuuacuauuuagaauccagaaauaaugaaauaacugaugcacuuuauauuauuuu

SEQ ID NO: 256709 - RNA, 64 nt, Homo Sapiens
guccuaagaacuccuaaaguguaauaaauagcucugaaauaacaacaagagcucuguaauaaca

SEQ ID NO: 256710 - RNA, 64 nt, Homo Sapiens
agagcucuguaauaacaguaggcuacaguagcucugaaauaacauucuguugguugugcccaag

SEQ ID NO: 256711 - RNA, 64 nt, Homo Sapiens
aaauaguucugaacauuuuucuauucauucauuuugaaauaauuaugcagacacaucagcuguu

SEQ ID NO: 256712 - RNA, 64 nt, Homo Sapiens
augaaugacaugaccuuucccuagagaauaaggaugaaauaaucacucauucuaugaacaguga

SEQ ID NO: 256713 - RNA, 64 nt, Homo Sapiens
aggccuuugcaaauggccuaaaugguguucccuuugaaauaacgcuugccacaaguauauaaua

SEQ ID NO: 256714 - RNA, 64 nt, Homo Sapiens
uguuuuauauuaaaaaaaaccuguuauguacaguugaaauaaauuuugcauuugcuagcccgug

SEQ ID NO: 256715 - RNA, 64 nt, Homo Sapiens
uuuuguacuucgguaagaugagaaggccuagauuugaaauaaugaauagauauuggauucuguc

SEQ ID NO: 256716 - RNA, 64 nt, Homo Sapiens
augucuuguacuugcuuucuauugauauucugugugaaauaagcauuuaucuucuuaagucuuc

SEQ ID NO: 256717 - RNA, 64 nt, Homo Sapiens
ggaaauuuuagcaaggauuauuuaguguuugauuugaaauaaaauugaagaccuuugagaaugc

SEQ ID NO: 256718 - RNA, 64 nt, Homo Sapiens
uuuugcauaucugaaaagaaugacaacaacccaaugaaauaacaaaagaccaacaaauggaugu

SEQ ID NO: 256719 - RNA, 64 nt, Homo Sapiens
gaauugacuucuuuuccuugaauggaaaacacuuugaaauaauaauaaacauuguuauaaacua

SEQ ID NO: 256720 - RNA, 64 nt, Homo Sapiens
acuauuaaacaauguaacugcuaucuuaauguucugaaauaaguuaaaacauuuuaaaauauga

SEQ ID NO: 256721 - RNA, 64 nt, Homo Sapiens
uaaaacauuuuaaaauaugacuaucuuaauguucugaaauaaguacuauuaaacaauguaacug

SEQ ID NO: 256722 - RNA, 64 nt, Homo Sapiens
auaaacauuguuauaaacuaaauggaaaacacuuugaaauaauagaauugacuucuuuuccuug

SEQ ID NO: 256723 - RNA, 64 nt, Homo Sapiens
uguguuugugccuccaaacauaguaccuuuacauugaaauaaauauuuaaacuguuucauuugg

SEQ ID NO: 256724 - RNA, 64 nt, Homo Sapiens
uauguguccaggguauugcuuuuguucacuaaugugaaauaagcaacuuuauaaaaaucuugag

SEQ ID NO: 256725 - RNA, 64 nt, Homo Sapiens
ucaaauauucaugcauugaaaaauaauugucuuuugaaauaaaaugauagagggucaguguuau

SEQ ID NO: 256726 - RNA, 64 nt, Homo Sapiens
gcuuaaagaugucuuucagaaagcgagguuaggcugaaauaauucaucugagugaguccauaug

SEQ ID NO: 256727 - RNA, 64 nt, Homo Sapiens
uccggccacuccugggagacagacccuuuggugaugaaauaaaccagugacuucagagccuaug

SEQ ID NO: 256728 - RNA, 64 nt, Homo Sapiens
uguucagcaugcaauggaaucaugcuuguccaugugaaauaaauauggcucucucguguccuua

SEQ ID NO: 256729 - RNA, 64 nt, Homo Sapiens
caaccuggauggaguuggagaucauuauucuaagugaaauaacucaggaauggagaaccaaaua

SEQ ID NO: 256730 - RNA, 64 nt, Homo Sapiens
uguaaccaaaagccaucugcuccccaaaaacuauugaaauaaaauaaaauauaaaaagaaagag

SEQ ID NO: 256731 - RNA, 64 nt, Homo Sapiens
gaagauacuaguuuugcugacuguuagaugauggugaaauaaagguucugagacaccugaugac

SEQ ID NO: 256732 - RNA, 64 nt, Homo Sapiens
aagcaagaauaugaagaaguaauuguaagcauccugaaauaaaaaacaaagucuuccuggaagu

SEQ ID NO: 256733 - RNA, 64 nt, Homo Sapiens
ggacccuuucuggcucugcgugaaauaguaaaaaugaaauaacucgauuuguuugcugaaaaug

SEQ ID NO: 256734 - RNA, 64 nt, Homo Sapiens
ccuguuugcaccucgauuuguuaauauauuaaugugaaauaaacuuauuugacaaaaaauccag

SEQ ID NO: 256735 - RNA, 64 nt, Homo Sapiens
aggccauauucagaguugaaagauuuacucaagaugaaauaaaauuuaaauuuucaaacaacau

SEQ ID NO: 256736 - RNA, 64 nt, Homo Sapiens
aaaagagggauuaucacuauuuauuuuuguucuuugaaauaauuauuuuaaauagcuucuacuc

SEQ ID NO: 256737 - RNA, 64 nt, Homo Sapiens
uguauaaugugucagaauauccuuccuuuuuaggugaaauaauauucuaugguauuuauauacc

SEQ ID NO: 256738 - RNA, 64 nt, Homo Sapiens
guggauacuugggcuacuuccaccuuuugccuauugaaauaaugcugcuaugaagaugagugua

SEQ ID NO: 256739 - RNA, 64 nt, Homo Sapiens
uuuuagauauauugguucaauauugaguacauauugaaauaauauuaaguaucucaauuuuuca

SEQ ID NO: 256740 - RNA, 64 nt, Homo Sapiens
gaucuaggcaugauucucuguguguaacacauaaugaaauaaugaauuauauuagaaaaacuau

SEQ ID NO: 256741 - RNA, 64 nt, Homo Sapiens
aaauaaauaaaacagcagcagcaaacaaauaaaaugaaauaaaagaaacaaaugaaauaaauau

SEQ ID NO: 256742 - RNA, 64 nt, Homo Sapiens
cagcaaacaaauaaaaugaaauaaaagaaacaaaugaaauaaauauuguguugugcagcauuaa

SEQ ID NO: 256743 - RNA, 64 nt, Homo Sapiens
acuaagucacaugcaaaucagaaucugguuaauaugaaauaaguacagauuuaugaaagcaagu

SEQ ID NO: 256744 - RNA, 64 nt, Homo Sapiens
aaaguuagggcacuccacuucaauuugcugaguaugaaauaagaaugauuaugaauguuagaau

SEQ ID NO: 256745 - RNA, 64 nt, Homo Sapiens
agcuccauucuuuucaugaaugcccuuuuaaagcugaaauaaccagaaaauggucuuuuugcuu

SEQ ID NO: 256746 - RNA, 64 nt, Homo Sapiens
cugagagauaauggagaaaaagcuucucaaguuaugaaauaaaaaaagcauagccgacaauggu

SEQ ID NO: 256747 - RNA, 64 nt, Homo Sapiens
uucuguguuuucccugcccuaaccuaaugacuguugaaauaaaggugucccuguuguguggugg

SEQ ID NO: 256748 - RNA, 64 nt, Homo Sapiens
gauggucuaugaggcauacaggaauuucuauuuuugaaauaaggacacgggcggcauuuaaaua

SEQ ID NO: 256749 - RNA, 64 nt, Homo Sapiens
uguuuucuuggcuaguaauaguaguagauacuucugaaauaaauguucucucaagauccuuaaa

SEQ ID NO: 256750 - RNA, 64 nt, Homo Sapiens
augggauguauauauaucauugcuguuagagaaaugaaauaaaauggggcugggcucaguggcu

SEQ ID NO: 256751 - RNA, 64 nt, Homo Sapiens
cuuggaccacuuuguauacauggaaaucagaguuugaaauaaaauaauacuuagaaggguuaau

SEQ ID NO: 256752 - RNA, 64 nt, Homo Sapiens
ccucugaaagauaagaaucauacuaucaguauugugaaauaauuguacuuuuaacaauucccag

SEQ ID NO: 256753 - RNA, 64 nt, Homo Sapiens
acugguaaaauuucaggguuucaguuauaugugcugaaauaauuccuucugccauuuuuuauuu

SEQ ID NO: 256754 - RNA, 64 nt, Homo Sapiens
aguagcuugagcuuucuuuuuaacagucuuuuuuugaaauaaaaacuugauaugaaacuccuau

SEQ ID NO: 256755 - RNA, 64 nt, Homo Sapiens
uguuuuguuugucaaauucuucuggugacuacuuugaaauaacucagguugaaugcuuugaauu

SEQ ID NO: 256756 - RNA, 64 nt, Homo Sapiens; identical to SEQ ID NO: 125921

SEQ ID NO: 256757 - RNA, 64 nt, Homo Sapiens; identical to SEQ ID NO: 125922

SEQ ID NO: 256758 - RNA, 64 nt, Homo Sapiens; identical to SEQ ID NO: 125923

SEQ ID NO: 256759 - RNA, 64 nt, Homo Sapiens; identical to SEQ ID NO: 125924

SEQ ID NO: 256760 - RNA, 64 nt, Homo Sapiens; identical to SEQ ID NO: 125925

SEQ ID NO: 256761 - RNA, 64 nt, Homo Sapiens; identical to SEQ ID NO: 125926

SEQ ID NO: 256762 - RNA, 64 nt, Homo Sapiens; identical to SEQ ID NO: 125927

SEQ ID NO: 256763 - RNA, 64 nt, Homo Sapiens; identical to SEQ ID NO: 125928

SEQ ID NO: 256764 - RNA, 64 nt, Homo Sapiens; identical to SEQ ID NO: 125929

SEQ ID NO: 256765 - RNA, 64 nt, Homo Sapiens; identical to SEQ ID NO: 125930

SEQ ID NO: 256766 - RNA, 64 nt, Homo Sapiens; identical to SEQ ID NO: 125931

SEQ ID NO: 256767 - RNA, 64 nt, Homo Sapiens; identical to SEQ ID NO: 125932

SEQ ID NO: 256768 - RNA, 64 nt, Homo Sapiens
ccacagagaaaucaccucucuuccuuugucuuuuaagaacuauuugguauuaacuaguuucaga

SEQ ID NO: 256769 - RNA, 64 nt, Homo Sapiens
gauggcuucaugauccagcacagugccucacacaaagaacuauuggguggguggauggauggau

SEQ ID NO: 256770 - RNA, 64 nt, Homo Sapiens
uaaaucagugaauauguuaaaaaguuugguuuaaaagaacuauaucuauauguauauuuucaua

SEQ ID NO: 256771 - RNA, 64 nt, Homo Sapiens
uaacuaccauauauaacguguuauugccaucuagaagaacuaugaugagaaagauacauuuaua

SEQ ID NO: 256772 - RNA, 64 nt, Homo Sapiens
ugguuuuggguuuuuuuuuuuuuuuuuuugguauaagaacuaacaucaaaaggccuguuuaaag

SEQ ID NO: 256773 - RNA, 64 nt, Homo Sapiens
aggcugccacaguggaauauuaucuuacaagaauaagaacuacauaaaacagauuuguaaaaaa

SEQ ID NO: 256774 - RNA, 64 nt, Homo Sapiens
aacauauauuguguaaagaaucaaaucagaagagaagaacuauauuuaaugaaacauguauaug

SEQ ID NO: 256775 - RNA, 64 nt, Homo Sapiens
cuguagccaggacuacaacuggagaucaaaagcuaagaacuaccauuguuuacaccagugagag

SEQ ID NO: 256776 - RNA, 64 nt, Homo Sapiens
aaccuugcacgcauuuggauaccuugugauuuccaagaacuacgugaagauuaagcuuugcuua

SEQ ID NO: 256777 - RNA, 64 nt, Homo Sapiens
gagugaggaacagaauguuuuaaaucuggugcaaaagaacuauaucugcuggaugagccuugaa

SEQ ID NO: 256778 - RNA, 64 nt, Homo Sapiens
uaccauggagccauagaaaggcuauggauuguuuaagaacuauuuuaaaguguuccagacccaa

SEQ ID NO: 256779 - RNA, 64 nt, Homo Sapiens
cuagguuuucuuuccagaaauagguagcaaggacaagaacuaaacaaucccagccccacccagc

SEQ ID NO: 256780 - RNA, 64 nt, Homo Sapiens
cauaggaauucaugaaggcgacccaaccuggaaaaagaacuauucacuuuggccaugggggucu

SEQ ID NO: 256781 - RNA, 64 nt, Homo Sapiens
cuauuuacaaaaggagcacccagugaauuggcacaagaacuaugccaucgccugugagcggaug

SEQ ID NO: 256782 - RNA, 64 nt, Homo Sapiens
uaauaaaaacuucagaaaaaugaugacauugcuucugcuaaauucgugaccaugguguuguucu

SEQ ID NO: 256783 - RNA, 64 nt, Homo Sapiens
uuucuuaaucaagaauauucccuucuuuucaaaacugcuaaauugcuaugcacuguaaaugcag

SEQ ID NO: 256784 - RNA, 53 nt, Homo Sapiens
auaagaagauagaaucauagugucugcuaaauaagacauauaagaacucugaa

SEQ ID NO: 256785 - RNA, 64 nt, Homo Sapiens
ugaauccucucuggagaggguccaacugggaauccugcuaaaggagcaaagccuuguauuaccu

SEQ ID NO: 256786 - RNA, 64 nt, Homo Sapiens
ccuugcaauugcugcuuuacagagaccucaaacacugcuaaaggguaacugugcuaaucuaucu

SEQ ID NO: 256787 - RNA, 64 nt, Homo Sapiens
guuucugcuacagagugguaucugaaaauuuugucugcuaaaaaucaccucccuugccuuuguu

SEQ ID NO: 256788 - RNA, 64 nt, Homo Sapiens
ugcuaaguacagaauuuuaugaugcguuguaacacugcuaaauauaggacuuaaaggugauuug

SEQ ID NO: 256789 - RNA, 64 nt, Homo Sapiens
ucaggcuaaaaaucaggccaagucgggaagaguccugcuaaaaaguugaaaucuuugccuccuc

SEQ ID NO: 256790 - RNA, 64 nt, Homo Sapiens
gaggggauaggaaguagguuuaaagccuaccaguguaaccuaccaguacaacugugaauccuag

SEQ ID NO: 256791 - RNA, 64 nt, Homo Sapiens
ucccguucuauuuuaugaugguugauaauagucaguaaccuaauaaaggaacguuuguuaaaau

SEQ ID NO: 256792 - RNA, 64 nt, Homo Sapiens
cccccacagguuuggcuugugguuuuugucaucaguaaccuacugccugagaucaugaucucuu

SEQ ID NO: 256793 - RNA, 64 nt, Homo Sapiens
cgucauggcuaagagaacaaaucugauaaauuguguaaccuagucucuucucuacauggugaug

SEQ ID NO: 256794 - RNA, 64 nt, Homo Sapiens
augaaauaauguaugugaaagcaccuuguaaacuguaaccuaucaauguaaaauguuaaggugu

SEQ ID NO: 256795 - RNA, 53 nt, Homo Sapiens
uguaucaaaccuugcuuuaaucaguaaccuaaggacuguuuccuuuuucuccu

SEQ ID NO: 256796 - RNA, 64 nt, Homo Sapiens
uuccuuaugucccauggaucgggagcuaugcgcaguaaccuaacaauggaggggacaaucuccu

SEQ ID NO: 256797 - RNA, 64 nt, Homo Sapiens
acuagaguucaccucuaucacuucuaucaauagaguaaccuaucucuuuccagauguuaaagaa

SEQ ID NO: 256798 - RNA, 64 nt, Homo Sapiens
cugccuuaacuaacuccucugcgcuuguucacuaguaaccuaaagaggcuauauucauucuuua

SEQ ID NO: 256799 - RNA, 64 nt, Homo Sapiens
agaacaaauguuuuauuauuacuugagcacaaguguaaccuaaauauuucuauauuaaagcuua

SEQ ID NO: 256800 - RNA, 64 nt, Homo Sapiens
gcuuugccacuaguaaaugugugaucuucggcaaguaaccuaaccuagggacaucaguuuacuc

SEQ ID NO: 256801 - RNA, 64 nt, Homo Sapiens
auaauuucacauaguuucucuuuuucauguaacuguaaccuaaauguauuacuucugauaaaac

SEQ ID NO: 256802 - RNA, 64 nt, Homo Sapiens
aaagauaauucaaccaucuagaugucuguaaaguguaaccuaggcauuauuauaagggauuugu

SEQ ID NO: 256803 - RNA, 64 nt, Homo Sapiens
aaagacaaaggucugauucaccauuugagucuuuguaaccuaggaacauaauggugaugguugg

SEQ ID NO: 256804 - RNA, 64 nt, Homo Sapiens
caggccagcauggaacagcaacagaacgagcaaaguaaccuauauuagggaugggggacagaua

SEQ ID NO: 256805 - RNA, 64 nt, Homo Sapiens
uuuuacuuuucugauuauauuuuaagaguauuccguaaccuauaacucaguggucaaaauaauu

SEQ ID NO: 256806 - RNA, 64 nt, Homo Sapiens
uagguguccuggugggaugguugaguuuauuucaguaaccuacacacuggauugacgcaaaguu

SEQ ID NO: 256807 - RNA, 64 nt, Homo Sapiens
aguagacuggguauggggaaccuaagucauaguuguaaccuacagcugauugguaagaacuaug

SEQ ID NO: 256808 - RNA, 64 nt, Homo Sapiens
uauuacagccauggggaagagugaaagauauaaaguaaccuaauuaaauguauggaauugcuau

SEQ ID NO: 256809 - RNA, 64 nt, Homo Sapiens
uacaugaacagaaacugcccagguggaacagcacguaaccuagugagugacuguacuccuuucu

SEQ ID NO: 256810 - RNA, 64 nt, Homo Sapiens
guucuuugacagagcauauugcuugguuaauuaaguaaccuaaaguaugcauuaggauugugaa

SEQ ID NO: 256811 - RNA, 64 nt, Homo Sapiens
ugccucucugauacgaauacacugacacgucaaaguaaccuaauguggacaccauccagaaaac

SEQ ID NO: 256812 - RNA, 64 nt, Homo Sapiens
uaguagucuucaauauaaccgugggggaaauguaguaaccuaguuaccuaacuguacagugagu

SEQ ID NO: 256813 - RNA, 64 nt, Homo Sapiens
acgaaggaguggaagaggaguacuuucagaucauguaaccuauuuagguacuaaaggagggaug

SEQ ID NO: 256814 - RNA, 64 nt, Homo Sapiens
aauagugcccaggcauaugagggcagccaagguaguaaccuaaacuuuuuuuuuucuuaaagaa

SEQ ID NO: 256815 - RNA, 64 nt, Homo Sapiens
uuucauacacauaauauauguugauguguuuuugguaaccuagcuucagaaauaggugugugug

SEQ ID NO: 256816 - RNA, 64 nt, Homo Sapiens
uuucuuacacacucuauccucugcacuguuaauaguaaccuaugacauaauuguaaauauucag

SEQ ID NO: 256817 - RNA, 64 nt, Homo Sapiens
cuuuaaaauacauagaaauaaaguuaguaauuagguaaccuaugauaacauaauaauguggacg

SEQ ID NO: 256818 - RNA, 64 nt, Homo Sapiens
gagcacuacaaauuuagaauauauaaaaauaucaguaaccuaugaauucaucaacauaacucac

SEQ ID NO: 256819 - RNA, 64 nt, Homo Sapiens
uaugagaaagggauuuucugauugauuuggaauuguaaccuauguucugggcugcauuuuucuu

SEQ ID NO: 256820 - RNA, 64 nt, Homo Sapiens
aguucucuucuaggauuuguuuggcugacuggcaguaaccuagugaauuucugaaagaugagua

SEQ ID NO: 256821 - RNA, 64 nt, Homo Sapiens
cccgaguaaggugguugggguguugaaguaccaaguaaccuacaagccuccuaguucugaaaag

SEQ ID NO: 256822 - RNA, 64 nt, Homo Sapiens
uauauacugcuauaaaguauaaugaaauguguagguaaccuauuguuuugggacaaaauuauaa

SEQ ID NO: 256823 - RNA, 64 nt, Homo Sapiens
agauuuuauaguuuuauuuugugucugacuuaguguaaccuagguaagcacuguguuccagacc

SEQ ID NO: 256824 - RNA, 64 nt, Homo Sapiens
uuacauaguagaggcuaaauaucacaucagauaaguaaccuauuauaucuacccaucaucaaaa

SEQ ID NO: 256825 - RNA, 64 nt, Homo Sapiens
cugcaaagagucuuuaaaugggggcugauuucaaguaaccuaaaagacuguguuaucagaggaa

SEQ ID NO: 256826 - RNA, 64 nt, Homo Sapiens
aaaugagcucauuaaugucaucgaaacauuuauuguaaccuaacagaccaucacagauuggaaa

SEQ ID NO: 256827 - RNA, 64 nt, Homo Sapiens
cauauuuuaugggggcaguacaagauaaacuucuguaaccuaugugaggagcaggaggacuauu

SEQ ID NO: 256828 - RNA, 64 nt, Homo Sapiens
aucucuggauuucaugaaggguuuauguuuuuaaguaaccuauuaguguauccaccaguuuuuu

SEQ ID NO: 256829 - RNA, 64 nt, Homo Sapiens
uucacuuaugaucuggauuucaacuuccauuuuuguaaccuacguacaagaauaacaauacuua

SEQ ID NO: 256830 - RNA, 64 nt, Homo Sapiens
ggaccugcugucauaaaugugugaacaaccuuuuguaaccuaaccuauugaccugcauguuuuu

SEQ ID NO: 256831 - RNA, 64 nt, Homo Sapiens
ggaagugcugaaugguguuguaacacuaacaugaguaaccuaaguucucaguuuuauuuuuacc

SEQ ID NO: 256832 - RNA, 64 nt, Homo Sapiens
ccaugaagauauuugguggggaagauaaaaaucaguaaccuaccaccuuuguuuccuuauucag

SEQ ID NO: 256833 - RNA, 64 nt, Homo Sapiens
cuugaccugcuuaauacauugaagaaguguugaaguaaccuaaauggagacuucauagcaucca

SEQ ID NO: 256834 - RNA, 64 nt, Homo Sapiens
agcaggaaacuucagcuuaaugaaaguguuguguguaaccuaggaacugaaacucaacucagag

SEQ ID NO: 256835 - RNA, 64 nt, Homo Sapiens
gcuggugcuuuaacuauauugaccaagguguauaguaaccuauuuaucacauuuuacgaagcaa

SEQ ID NO: 256836 - RNA, 64 nt, Homo Sapiens
auacuuaauuuuggcauuugacucuuaagauuauguaaccuagcuacuuugggauggucuuaga

SEQ ID NO: 256837 - RNA, 64 nt, Homo Sapiens
cuuagaaaaagcacaggaaacagaccuuaaaauuguaaccuaccaacuaacuuacaugcuuaua

SEQ ID NO: 256838 - RNA, 64 nt, Homo Sapiens
aagauguuuauuaauagaaugauaaauguacagaguaaccuauaagcaugacauacuuuugcuu

SEQ ID NO: 256839 - RNA, 64 nt, Homo Sapiens
aaaguuaguauauaggcaucaaacaaccuuggcuguaaccuauagaaucucuauccacguauca

SEQ ID NO: 256840 - RNA, 64 nt, Homo Sapiens
uuuuguucuagccaugaauuugccugagaaacuuguaaccuaugugccucaauauauuccauag

SEQ ID NO: 256841 - RNA, 64 nt, Homo Sapiens
cuucagagagaaugagcagagguccccaaaauggguaaccuagauguguuuauugccuauaaug

SEQ ID NO: 256842 - RNA, 64 nt, Homo Sapiens
ugacaguggcugcucugggaaggggcuuuuagauguaaccuacaauucaguuaggcuagagaca

SEQ ID NO: 256843 - RNA, 64 nt, Homo Sapiens
cugacuguagccacaucucucccgcucccuaaggguaaccuagccaauggaagcugcccuuugg

SEQ ID NO: 256844 - RNA, 64 nt, Homo Sapiens
augaauucagaccaauaaaaauuaaaauguuaaaguaaccuaaacucauguacaguuacaggaa

SEQ ID NO: 256845 - RNA, 64 nt, Homo Sapiens
ucaucauuagacaacuggaguuuuugcugguuuuguaaccuaccaaaauggauaggcuguugaa

SEQ ID NO: 256846 - RNA, 64 nt, Homo Sapiens
uuccccaggagaugauccuguuaaguguucggcaguaaccuacuuuguuccuucgccucagcag

SEQ ID NO: 256847 - RNA, 64 nt, Homo Sapiens
cugguauuuuucuguaaagaccauuugcaaaauuguaaccuaauacaaaguguagccuucuucc

SEQ ID NO: 256848 - RNA, 64 nt, Homo Sapiens
cauggggcagugggaaagaguucagguuuugaagguaaccuaguuuagauuugaauuccagcua

SEQ ID NO: 256849 - RNA, 64 nt, Homo Sapiens
gugaugacuguuuugguuugaaaugaacagauugguaaccuaauuuguggccuccugacuuuua

SEQ ID NO: 256850 - RNA, 64 nt, Homo Sapiens
cagagguaacaguguccaaauauaauuggccuaaguaaccuaggaaauuguuugacauaacaca

SEQ ID NO: 256851 - RNA, 64 nt, Homo Sapiens
gcuucccuaugugguaaaagaaaggcauuccuccguaaccuaggcacucugcaaguccaguguu

SEQ ID NO: 256852 - RNA, 64 nt, Homo Sapiens
ccaacuaguccuugugauuugguaaaauguggcuguaaccuaaauuggauguaaaggaguccug

SEQ ID NO: 256853 - RNA, 64 nt, Homo Sapiens
aaaaaaguuugucuuugagagcuuuuguucugugguaaccuauaaaauaaaaacaugagucaca

SEQ ID NO: 256854 - RNA, 64 nt, Homo Sapiens
aagaaaagcccuuauuuggaaauacccauaaucaguaaccuauccaauucuuucaacuccuguu

SEQ ID NO: 256855 - RNA, 64 nt, Homo Sapiens
guaaauuuguuaaccaaaaucgaguccaguucuaguaaccuaaaugugcuugaacauucuaaaa

SEQ ID NO: 256856 - RNA, 64 nt, Homo Sapiens
ccccgugacuauccugugcuggaaacuaacaucaguaaccuaacaauacccaaaaggguuuuau

SEQ ID NO: 256857 - RNA, 64 nt, Homo Sapiens
uaugcccaauaauuuguuaucauuuccuuagguaguaaccuauuuuuguucugguuugguucgg

SEQ ID NO: 256858 - RNA, 64 nt, Homo Sapiens
cugcuggcuacugcagagacccuuggcuauuugaguaaccuaggauuagugagaaggggcagaa

SEQ ID NO: 256859 - RNA, 64 nt, Homo Sapiens
accaguuuuaucuaacagcuuaaaacuaccuguuguaaccuaaauucucuacaaaccuaguugc

SEQ ID NO: 256860 - RNA, 64 nt, Homo Sapiens
aaguuuauuuucuauuuuaggcuuaauauaaaucguaaccuaugcauuagaauugaauuauugg

SEQ ID NO: 256861 - RNA, 64 nt, Homo Sapiens
acuccgagcagaaaucacaucuugcccacaugcuguaaccuaagaaacugcuaugcaaggcugg

SEQ ID NO: 256862 - RNA, 64 nt, Homo Sapiens
uauguucccuugguaccaagagguacuaugcaaaguaaccuauuacaccaaguuacuugcuuug

SEQ ID NO: 256863 - RNA, 64 nt, Homo Sapiens
aguuccaucugcaacuuuaguucccacuggcuguguaaccuaacauagucacaggcucugggga

SEQ ID NO: 256864 - RNA, 64 nt, Homo Sapiens
aaacgaagaaaaauucuuaugcgacucuguguaaguaaccuaagaguacguuacuuauuaaagg

SEQ ID NO: 256865 - RNA, 64 nt, Homo Sapiens
uaucgcaacaugaauuuuuaaagccuguaauuauguaaccuauugucuugguguuaucaggguu

SEQ ID NO: 256866 - RNA, 64 nt, Homo Sapiens
aagugcuuugaaauauugaugaaaugucauuauuguaaccuagaauguaugcguauauggaauu

SEQ ID NO: 256867 - RNA, 64 nt, Homo Sapiens
uuugcagaagguacuguuacuuucugaguauuauguaaccuauugaauaagauuguucauugca

SEQ ID NO: 256868 - RNA, 64 nt, Homo Sapiens
cucaugcaugucuaaccugauuuaccucuuaccuguaaccuaccuuaucauguggcuuuuaauu

SEQ ID NO: 256869 - RNA, 64 nt, Homo Sapiens
ucuguguucacguggcccccugucauacagacagguaaccuagucagucgcucugcaugcucuc

SEQ ID NO: 256870 - RNA, 64 nt, Homo Sapiens
aauucaaaagcuggauagaauuuuuaucaucuaaguaaccuaagaaaaauagcauccaugggac

SEQ ID NO: 256871 - RNA, 64 nt, Homo Sapiens
augucccccuucuugcuucuaacugugaauugacguaaccuagaccaccucagugaaaugcuac

SEQ ID NO: 256872 - RNA, 64 nt, Homo Sapiens
aaguuuuggcauauuuagguuacuugccauagauguaaccuaaaacgcaucugugguucuuuug

SEQ ID NO: 256873 - RNA, 64 nt, Homo Sapiens
uuguggccuccugacuuuuaaauuaaacagauugguaaccuaauugcugacuuuuuuuguuuga

SEQ ID NO: 256874 - RNA, 59 nt, Homo Sapiens
ggccacuggcuagcagcacacgucccuggguaaccuaaucaggcgaaaagaaaaccuaa

SEQ ID NO: 256875 - RNA, 64 nt, Homo Sapiens
cauuccauuugugauuccaugauacaauucaccaguaaccuaucuuacaugagauucggaagua

SEQ ID NO: 256876 - RNA, 64 nt, Homo Sapiens
uaauauccaacaguuuaagguacuauaccacaugguaaccuacuguuugccagccuguaaaaca

SEQ ID NO: 256877 - RNA, 64 nt, Homo Sapiens
gaguucaccagauuuuggaaauauuuucuauucuguaaccuaccuuuucauuuacauaacagug

SEQ ID NO: 256878 - RNA, 64 nt, Homo Sapiens
cacauccuccugcaucccauaaggacauuugcauguaaccuaucaugcuguguuccuuuuauaa

SEQ ID NO: 256879 - RNA, 64 nt, Homo Sapiens
ucagacacuacaugaugacugauccucuggacacguaaccuauguagcuagcgugugccaggca

SEQ ID NO: 256880 - RNA, 64 nt, Homo Sapiens
aaagaugcuagagcaccaauggcugcauaauuugguaaccuauguugauaguuuacuugauugu

SEQ ID NO: 256881 - RNA, 64 nt, Homo Sapiens
ucuuggauacaugguuuuuauuggcaaaaugaugguaaccuaagaaugaggaugaauaacaagu

SEQ ID NO: 256882 - RNA, 64 nt, Homo Sapiens
gguuccauuuaccuuuguuuuaucucauaagucuguaaccuacauuaauagcuuucaguaguug

SEQ ID NO: 256883 - RNA, 64 nt, Homo Sapiens
aaaaacucauuuuuuccaccaaaaccuuggccagguaaccuaccuuaggcaccugcaaagaaca

SEQ ID NO: 256884 - RNA, 64 nt, Homo Sapiens
uuaaucaucccugcccuacauauauaaacauaagguaaccuacugaauuuuaugucccuuaguu

SEQ ID NO: 256885 - RNA, 64 nt, Homo Sapiens
agugaaucaauauuuucuauauguauaaauuuuuguaaccuaacaaagagcauuaaauuuugcu

SEQ ID NO: 256886 - RNA, 64 nt, Homo Sapiens
aucauggaucuaauguacuggcaaauaaaauaauguaaccuauuaaucacugcaguagggcucu

SEQ ID NO: 256887 - RNA, 64 nt, Homo Sapiens
uuuggggggaacuaggagagcaggaguagaagugagauguuaagaucuuauggcacuaaagacu

SEQ ID NO: 256888 - RNA, 64 nt, Homo Sapiens
uauucuguuccuacauacucuguuaggaucagauagauguuauagaaaugccuuuuguuucucc

SEQ ID NO: 256889 - RNA, 64 nt, Homo Sapiens
ccagagaacauugacagacaauuaugaauaauaaagauguuaacaauccaucuguauuuaaaac

SEQ ID NO: 256890 - RNA, 64 nt, Homo Sapiens
gaaacugaaacaaacagaugcucagaugaaaaacagauguuauccucagcacaaauucaguaaa

SEQ ID NO: 256891 - RNA, 64 nt, Homo Sapiens
cgacuccuucagguuaucuuaggacucacuggauagauguuauugaaagagccugaagucuugc

SEQ ID NO: 256892 - RNA, 64 nt, Homo Sapiens
caacuccuucaguuuaucuuaggacucacuggauagauguuauugaaagagccugaagucuugc

SEQ ID NO: 256893 - RNA, 64 nt, Homo Sapiens
aaaauaugugaacucaaauauugcacuucuuucaagauguuaucaauugguuauuguacuguau

SEQ ID NO: 256894 - RNA, 64 nt, Homo Sapiens
ucugcacauuacauugaaguauuauaaaugcaacagauguuauaugcacuggcauuuuauccua

SEQ ID NO: 256895 - RNA, 64 nt, Homo Sapiens
uuugaauuaacaccaagggugauauuucuuuuagagauguuaguuaaucuguuuugugucuuac

SEQ ID NO: 256896 - RNA, 64 nt, Homo Sapiens
gguaagcuaaaccaucaacaucucugguguuuuaagauguuauuuuauuggaacaacugacaaa

SEQ ID NO: 256897 - RNA, 64 nt, Homo Sapiens
gagggcucauagaaguguuagguacggcucucaaagauguuacaguuuuuucuaggguugggag

SEQ ID NO: 256898 - RNA, 64 nt, Homo Sapiens
cucccagcccaccucaacccaaggaccccagguaagauguuaauaaaaccaacagguuuaucug

SEQ ID NO: 256899 - RNA, 64 nt, Homo Sapiens
uggaauucguguuaugaaucuuaaaugcucauaaagauguuaaaacuuuauuuaaaugcauguc

SEQ ID NO: 256900 - RNA, 64 nt, Homo Sapiens
uuuuuguguacuuuaaaaucaacuuauaacugugagauguuauugcuuccauuuuauuagaaga

SEQ ID NO: 256901 - RNA, 64 nt, Homo Sapiens
aaaaaaaauuuuuuuuuuuuggacagcuucaaggagauguuagcaauuucagauauacuagcca

SEQ ID NO: 256902 - RNA, 64 nt, Homo Sapiens
acccagggggccacaagccagauaggauuccuuaagauguuaccuagcauauauaaacaaacau

SEQ ID NO: 256903 - RNA, 64 nt, Homo Sapiens
aguacaguacugcauauucauuuucuacagaauuagauguuaguagucacuaacaaaugcauua

SEQ ID NO: 256904 - RNA, 64 nt, Homo Sapiens
ggaagcauaaaagucaagaccuguucaaucauucagauguuagugcagccuagaagcaaugguu

SEQ ID NO: 256905 - RNA, 64 nt, Homo Sapiens
agaaauuuuaguuuauuguguguauagguuaccuagauguuauguaugauguacagguacgaca

SEQ ID NO: 256906 - RNA, 64 nt, Homo Sapiens
uauauuucuugcuauugugaguuucuggauaucaagauguuaaauuucuuuuuggguacguauu

SEQ ID NO: 256907 - RNA, 64 nt, Homo Sapiens
uaaaacugcugaacuugaccguggcaguucucgcagauguuaccuauucugaaaauaccagugu

SEQ ID NO: 256908 - RNA, 64 nt, Homo Sapiens
uuuccuagaugaaaauaaaaaauguggugacaucagauguuauuauuaagcaggaaggcauuuu

SEQ ID NO: 256909 - RNA, 64 nt, Homo Sapiens
gugaaagaaaggguguugcauguuuuuucuuuucagauguuaauuggacacuuagagugguuuu

SEQ ID NO: 256910 - RNA, 64 nt, Homo Sapiens
accaugcggaugcgggucacacugaaugcuggagagauguuauguaauaugcugagguggcgac

SEQ ID NO: 256911 - RNA, 64 nt, Homo Sapiens
uugccuggauaauagaggauguguuucagcccugagauguuacaguugaagagcuugguuuuca

SEQ ID NO: 256912 - RNA, 64 nt, Homo Sapiens
uccacaucaggugugugcgaguguguguguguggagauguuaagagccucacaaggaaacuggg

SEQ ID NO: 256913 - RNA, 64 nt, Homo Sapiens
aagguccuccuauuucccagaaccccguuggggcagauguuacugaaccugugaaucagacgcc

SEQ ID NO: 256914 - RNA, 64 nt, Homo Sapiens; identical to SEQ ID NO: 256790

SEQ ID NO: 256915 - RNA, 64 nt, Homo Sapiens; identical to SEQ ID NO: 256791

SEQ ID NO: 256916 - RNA, 64 nt, Homo Sapiens; identical to SEQ ID NO: 256792

SEQ ID NO: 256917 - RNA, 64 nt, Homo Sapiens; identical to SEQ ID NO: 256793

SEQ ID NO: 256918 - RNA, 64 nt, Homo Sapiens; identical to SEQ ID NO: 256794

SEQ ID NO: 256919 - RNA, 53 nt, Homo Sapiens; identical to SEQ ID NO: 256795

SEQ ID NO: 256920 - RNA, 64 nt, Homo Sapiens; identical to SEQ ID NO: 256796

SEQ ID NO: 256921 - RNA, 64 nt, Homo Sapiens; identical to SEQ ID NO: 256797

SEQ ID NO: 256922 - RNA, 64 nt, Homo Sapiens; identical to SEQ ID NO: 256798

SEQ ID NO: 256923 - RNA, 64 nt, Homo Sapiens; identical to SEQ ID NO: 256799

SEQ ID NO: 256924 - RNA, 64 nt, Homo Sapiens; identical to SEQ ID NO: 256800

SEQ ID NO: 256925 - RNA, 64 nt, Homo Sapiens; identical to SEQ ID NO: 256801

SEQ ID NO: 256926 - RNA, 64 nt, Homo Sapiens; identical to SEQ ID NO: 256802

SEQ ID NO: 256927 - RNA, 64 nt, Homo Sapiens; identical to SEQ ID NO: 256803

SEQ ID NO: 256928 - RNA, 64 nt, Homo Sapiens; identical to SEQ ID NO: 256804

SEQ ID NO: 256929 - RNA, 64 nt, Homo Sapiens; identical to SEQ ID NO: 256805

SEQ ID NO: 256930 - RNA, 64 nt, Homo Sapiens; identical to SEQ ID NO: 256806

SEQ ID NO: 256931 - RNA, 64 nt, Homo Sapiens; identical to SEQ ID NO: 256807

SEQ ID NO: 256932 - RNA, 64 nt, Homo Sapiens; identical to SEQ ID NO: 256808

SEQ ID NO: 256933 - RNA, 64 nt, Homo Sapiens; identical to SEQ ID NO: 256809

SEQ ID NO: 256934 - RNA, 64 nt, Homo Sapiens; identical to SEQ ID NO: 256810

SEQ ID NO: 256935 - RNA, 64 nt, Homo Sapiens; identical to SEQ ID NO: 256811

SEQ ID NO: 256936 - RNA, 64 nt, Homo Sapiens; identical to SEQ ID NO: 256812

SEQ ID NO: 256937 - RNA, 64 nt, Homo Sapiens; identical to SEQ ID NO: 256813

SEQ ID NO: 256938 - RNA, 64 nt, Homo Sapiens; identical to SEQ ID NO: 256814

SEQ ID NO: 256939 - RNA, 64 nt, Homo Sapiens; identical to SEQ ID NO: 256815

SEQ ID NO: 256940 - RNA, 64 nt, Homo Sapiens; identical to SEQ ID NO: 256816

SEQ ID NO: 256941 - RNA, 64 nt, Homo Sapiens; identical to SEQ ID NO: 256817

SEQ ID NO: 256942 - RNA, 64 nt, Homo Sapiens; identical to SEQ ID NO: 256818

SEQ ID NO: 256943 - RNA, 64 nt, Homo Sapiens; identical to SEQ ID NO: 256819

SEQ ID NO: 256944 - RNA, 64 nt, Homo Sapiens; identical to SEQ ID NO: 256820

SEQ ID NO: 256945 - RNA, 64 nt, Homo Sapiens; identical to SEQ ID NO: 256821

SEQ ID NO: 256946 - RNA, 64 nt, Homo Sapiens; identical to SEQ ID NO: 256822

SEQ ID NO: 256947 - RNA, 64 nt, Homo Sapiens; identical to SEQ ID NO: 256823

SEQ ID NO: 256948 - RNA, 64 nt, Homo Sapiens; identical to SEQ ID NO: 256824

SEQ ID NO: 256949 - RNA, 64 nt, Homo Sapiens; identical to SEQ ID NO: 256825

SEQ ID NO: 256950 - RNA, 64 nt, Homo Sapiens; identical to SEQ ID NO: 256826

SEQ ID NO: 256951 - RNA, 64 nt, Homo Sapiens; identical to SEQ ID NO: 256827

SEQ ID NO: 256952 - RNA, 64 nt, Homo Sapiens; identical to SEQ ID NO: 256828

SEQ ID NO: 256953 - RNA, 64 nt, Homo Sapiens; identical to SEQ ID NO: 256829

SEQ ID NO: 256954 - RNA, 64 nt, Homo Sapiens; identical to SEQ ID NO: 256830

SEQ ID NO: 256955 - RNA, 64 nt, Homo Sapiens; identical to SEQ ID NO: 256831

SEQ ID NO: 256956 - RNA, 64 nt, Homo Sapiens; identical to SEQ ID NO: 256832

SEQ ID NO: 256957 - RNA, 64 nt, Homo Sapiens; identical to SEQ ID NO: 256833

SEQ ID NO: 256958 - RNA, 64 nt, Homo Sapiens; identical to SEQ ID NO: 256834

SEQ ID NO: 256959 - RNA, 64 nt, Homo Sapiens; identical to SEQ ID NO: 256835

SEQ ID NO: 256960 - RNA, 64 nt, Homo Sapiens; identical to SEQ ID NO: 256836

SEQ ID NO: 256961 - RNA, 64 nt, Homo Sapiens; identical to SEQ ID NO: 256837

SEQ ID NO: 256962 - RNA, 64 nt, Homo Sapiens; identical to SEQ ID NO: 256838

SEQ ID NO: 256963 - RNA, 64 nt, Homo Sapiens; identical to SEQ ID NO: 256839

SEQ ID NO: 256964 - RNA, 64 nt, Homo Sapiens; identical to SEQ ID NO: 256840

SEQ ID NO: 256965 - RNA, 64 nt, Homo Sapiens; identical to SEQ ID NO: 256841

SEQ ID NO: 256966 - RNA, 64 nt, Homo Sapiens; identical to SEQ ID NO: 256842

SEQ ID NO: 256967 - RNA, 64 nt, Homo Sapiens; identical to SEQ ID NO: 256843

SEQ ID NO: 256968 - RNA, 64 nt, Homo Sapiens; identical to SEQ ID NO: 256844

SEQ ID NO: 256969 - RNA, 64 nt, Homo Sapiens; identical to SEQ ID NO: 256845

SEQ ID NO: 256970 - RNA, 64 nt, Homo Sapiens; identical to SEQ ID NO: 256846

SEQ ID NO: 256971 - RNA, 64 nt, Homo Sapiens; identical to SEQ ID NO: 256847

SEQ ID NO: 256972 - RNA, 64 nt, Homo Sapiens; identical to SEQ ID NO: 256848

SEQ ID NO: 256973 - RNA, 64 nt, Homo Sapiens; identical to SEQ ID NO: 256849

SEQ ID NO: 256974 - RNA, 64 nt, Homo Sapiens; identical to SEQ ID NO: 256850

SEQ ID NO: 256975 - RNA, 64 nt, Homo Sapiens; identical to SEQ ID NO: 256851

SEQ ID NO: 256976 - RNA, 64 nt, Homo Sapiens; identical to SEQ ID NO: 256852

SEQ ID NO: 256977 - RNA, 64 nt, Homo Sapiens; identical to SEQ ID NO: 256853

SEQ ID NO: 256978 - RNA, 64 nt, Homo Sapiens; identical to SEQ ID NO: 256854

SEQ ID NO: 256979 - RNA, 64 nt, Homo Sapiens; identical to SEQ ID NO: 256855

SEQ ID NO: 256980 - RNA, 64 nt, Homo Sapiens; identical to SEQ ID NO: 256856

SEQ ID NO: 256981 - RNA, 64 nt, Homo Sapiens; identical to SEQ ID NO: 256857

SEQ ID NO: 256982 - RNA, 64 nt, Homo Sapiens; identical to SEQ ID NO: 256858

SEQ ID NO: 256983 - RNA, 64 nt, Homo Sapiens; identical to SEQ ID NO: 256859

SEQ ID NO: 256984 - RNA, 64 nt, Homo Sapiens; identical to SEQ ID NO: 256860

SEQ ID NO: 256985 - RNA, 64 nt, Homo Sapiens; identical to SEQ ID NO: 256861

SEQ ID NO: 256986 - RNA, 64 nt, Homo Sapiens; identical to SEQ ID NO: 256862

SEQ ID NO: 256987 - RNA, 64 nt, Homo Sapiens; identical to SEQ ID NO: 256863

SEQ ID NO: 256988 - RNA, 64 nt, Homo Sapiens; identical to SEQ ID NO: 256864

SEQ ID NO: 256989 - RNA, 64 nt, Homo Sapiens; identical to SEQ ID NO: 256865

SEQ ID NO: 256990 - RNA, 64 nt, Homo Sapiens; identical to SEQ ID NO: 256866

SEQ ID NO: 256991 - RNA, 64 nt, Homo Sapiens; identical to SEQ ID NO: 256867

SEQ ID NO: 256992 - RNA, 64 nt, Homo Sapiens; identical to SEQ ID NO: 256868

SEQ ID NO: 256993 - RNA, 64 nt, Homo Sapiens; identical to SEQ ID NO: 256869

SEQ ID NO: 256994 - RNA, 64 nt, Homo Sapiens; identical to SEQ ID NO: 256870

SEQ ID NO: 256995 - RNA, 64 nt, Homo Sapiens; identical to SEQ ID NO: 256871

SEQ ID NO: 256996 - RNA, 64 nt, Homo Sapiens; identical to SEQ ID NO: 256872

SEQ ID NO: 256997 - RNA, 64 nt, Homo Sapiens; identical to SEQ ID NO: 256873

SEQ ID NO: 256998 - RNA, 59 nt, Homo Sapiens; identical to SEQ ID NO: 256874

SEQ ID NO: 256999 - RNA, 64 nt, Homo Sapiens; identical to SEQ ID NO: 256875

SEQ ID NO: 257000 - RNA, 64 nt, Homo Sapiens; identical to SEQ ID NO: 256876

SEQ ID NO: 257001 - RNA, 64 nt, Homo Sapiens; identical to SEQ ID NO: 256877

SEQ ID NO: 257002 - RNA, 64 nt, Homo Sapiens; identical to SEQ ID NO: 256878

SEQ ID NO: 257003 - RNA, 64 nt, Homo Sapiens; identical to SEQ ID NO: 256879

SEQ ID NO: 257004 - RNA, 64 nt, Homo Sapiens; identical to SEQ ID NO: 256880

SEQ ID NO: 257005 - RNA, 64 nt, Homo Sapiens; identical to SEQ ID NO: 256881

SEQ ID NO: 257006 - RNA, 64 nt, Homo Sapiens; identical to SEQ ID NO: 256882

SEQ ID NO: 257007 - RNA, 64 nt, Homo Sapiens; identical to SEQ ID NO: 256883

SEQ ID NO: 257008 - RNA, 64 nt, Homo Sapiens; identical to SEQ ID NO: 256884

SEQ ID NO: 257009 - RNA, 64 nt, Homo Sapiens; identical to SEQ ID NO: 256885

SEQ ID NO: 257010 - RNA, 64 nt, Homo Sapiens; identical to SEQ ID NO: 256886

SEQ ID NO: 257011 - RNA, 64 nt, Homo Sapiens; identical to SEQ ID NO: 256887

SEQ ID NO: 257012 - RNA, 64 nt, Homo Sapiens; identical to SEQ ID NO: 256888

SEQ ID NO: 257013 - RNA, 64 nt, Homo Sapiens; identical to SEQ ID NO: 256889

SEQ ID NO: 257014 - RNA, 64 nt, Homo Sapiens; identical to SEQ ID NO: 256890

SEQ ID NO: 257015 - RNA, 64 nt, Homo Sapiens; identical to SEQ ID NO: 256891

SEQ ID NO: 257016 - RNA, 64 nt, Homo Sapiens; identical to SEQ ID NO: 256892

SEQ ID NO: 257017 - RNA, 64 nt, Homo Sapiens; identical to SEQ ID NO: 256893

SEQ ID NO: 257018 - RNA, 64 nt, Homo Sapiens; identical to SEQ ID NO: 256894

SEQ ID NO: 257019 - RNA, 64 nt, Homo Sapiens; identical to SEQ ID NO: 256895

SEQ ID NO: 257020 - RNA, 64 nt, Homo Sapiens; identical to SEQ ID NO: 256896

SEQ ID NO: 257021 - RNA, 64 nt, Homo Sapiens; identical to SEQ ID NO: 256897

SEQ ID NO: 257022 - RNA, 64 nt, Homo Sapiens; identical to SEQ ID NO: 256898

SEQ ID NO: 257023 - RNA, 64 nt, Homo Sapiens; identical to SEQ ID NO: 256899

SEQ ID NO: 257024 - RNA, 64 nt, Homo Sapiens; identical to SEQ ID NO: 256900

SEQ ID NO: 257025 - RNA, 64 nt, Homo Sapiens; identical to SEQ ID NO: 256901

SEQ ID NO: 257026 - RNA, 64 nt, Homo Sapiens; identical to SEQ ID NO: 256902

SEQ ID NO: 257027 - RNA, 64 nt, Homo Sapiens; identical to SEQ ID NO: 256903

SEQ ID NO: 257028 - RNA, 64 nt, Homo Sapiens; identical to SEQ ID NO: 256904

SEQ ID NO: 257029 - RNA, 64 nt, Homo Sapiens; identical to SEQ ID NO: 256905

SEQ ID NO: 257030 - RNA, 64 nt, Homo Sapiens; identical to SEQ ID NO: 256906

SEQ ID NO: 257031 - RNA, 64 nt, Homo Sapiens; identical to SEQ ID NO: 256907

SEQ ID NO: 257032 - RNA, 64 nt, Homo Sapiens; identical to SEQ ID NO: 256908

SEQ ID NO: 257033 - RNA, 64 nt, Homo Sapiens; identical to SEQ ID NO: 256909

SEQ ID NO: 257034 - RNA, 64 nt, Homo Sapiens; identical to SEQ ID NO: 256910

SEQ ID NO: 257035 - RNA, 64 nt, Homo Sapiens; identical to SEQ ID NO: 256911

SEQ ID NO: 257036 - RNA, 64 nt, Homo Sapiens; identical to SEQ ID NO: 256912

SEQ ID NO: 257037 - RNA, 64 nt, Homo Sapiens; identical to SEQ ID NO: 256913

SEQ ID NO: 257038 - RNA, 64 nt, Homo Sapiens; identical to SEQ ID NO: 256790

SEQ ID NO: 257039 - RNA, 64 nt, Homo Sapiens; identical to SEQ ID NO: 256791

SEQ ID NO: 257040 - RNA, 64 nt, Homo Sapiens; identical to SEQ ID NO: 256792

SEQ ID NO: 257041 - RNA, 64 nt, Homo Sapiens; identical to SEQ ID NO: 256793

SEQ ID NO: 257042 - RNA, 64 nt, Homo Sapiens; identical to SEQ ID NO: 256794

SEQ ID NO: 257043 - RNA, 53 nt, Homo Sapiens; identical to SEQ ID NO: 256795

SEQ ID NO: 257044 - RNA, 64 nt, Homo Sapiens; identical to SEQ ID NO: 256796

SEQ ID NO: 257045 - RNA, 64 nt, Homo Sapiens; identical to SEQ ID NO: 256797

SEQ ID NO: 257046 - RNA, 64 nt, Homo Sapiens; identical to SEQ ID NO: 256798

SEQ ID NO: 257047 - RNA, 64 nt, Homo Sapiens; identical to SEQ ID NO: 256799

SEQ ID NO: 257048 - RNA, 64 nt, Homo Sapiens; identical to SEQ ID NO: 256800

SEQ ID NO: 257049 - RNA, 64 nt, Homo Sapiens; identical to SEQ ID NO: 256801

SEQ ID NO: 257050 - RNA, 64 nt, Homo Sapiens; identical to SEQ ID NO: 256802

SEQ ID NO: 257051 - RNA, 64 nt, Homo Sapiens; identical to SEQ ID NO: 256803

SEQ ID NO: 257052 - RNA, 64 nt, Homo Sapiens; identical to SEQ ID NO: 256804

SEQ ID NO: 257053 - RNA, 64 nt, Homo Sapiens; identical to SEQ ID NO: 256805

SEQ ID NO: 257054 - RNA, 64 nt, Homo Sapiens; identical to SEQ ID NO: 256806

SEQ ID NO: 257055 - RNA, 64 nt, Homo Sapiens; identical to SEQ ID NO: 256807

SEQ ID NO: 257056 - RNA, 64 nt, Homo Sapiens; identical to SEQ ID NO: 256808

SEQ ID NO: 257057 - RNA, 64 nt, Homo Sapiens; identical to SEQ ID NO: 256809

SEQ ID NO: 257058 - RNA, 64 nt, Homo Sapiens; identical to SEQ ID NO: 256810

SEQ ID NO: 257059 - RNA, 64 nt, Homo Sapiens; identical to SEQ ID NO: 256811

SEQ ID NO: 257060 - RNA, 64 nt, Homo Sapiens; identical to SEQ ID NO: 256812

SEQ ID NO: 257061 - RNA, 64 nt, Homo Sapiens; identical to SEQ ID NO: 256813

SEQ ID NO: 257062 - RNA, 64 nt, Homo Sapiens; identical to SEQ ID NO: 256814

SEQ ID NO: 257063 - RNA, 64 nt, Homo Sapiens; identical to SEQ ID NO: 256815

SEQ ID NO: 257064 - RNA, 64 nt, Homo Sapiens; identical to SEQ ID NO: 256816

SEQ ID NO: 257065 - RNA, 64 nt, Homo Sapiens; identical to SEQ ID NO: 256817

SEQ ID NO: 257066 - RNA, 64 nt, Homo Sapiens; identical to SEQ ID NO: 256818

SEQ ID NO: 257067 - RNA, 64 nt, Homo Sapiens; identical to SEQ ID NO: 256819

SEQ ID NO: 257068 - RNA, 64 nt, Homo Sapiens; identical to SEQ ID NO: 256820

SEQ ID NO: 257069 - RNA, 64 nt, Homo Sapiens; identical to SEQ ID NO: 256821

SEQ ID NO: 257070 - RNA, 64 nt, Homo Sapiens; identical to SEQ ID NO: 256822

SEQ ID NO: 257071 - RNA, 64 nt, Homo Sapiens; identical to SEQ ID NO: 256823

SEQ ID NO: 257072 - RNA, 64 nt, Homo Sapiens; identical to SEQ ID NO: 256824

SEQ ID NO: 257073 - RNA, 64 nt, Homo Sapiens; identical to SEQ ID NO: 256825

SEQ ID NO: 257074 - RNA, 64 nt, Homo Sapiens; identical to SEQ ID NO: 256826

SEQ ID NO: 257075 - RNA, 64 nt, Homo Sapiens; identical to SEQ ID NO: 256827

SEQ ID NO: 257076 - RNA, 64 nt, Homo Sapiens; identical to SEQ ID NO: 256828

SEQ ID NO: 257077 - RNA, 64 nt, Homo Sapiens; identical to SEQ ID NO: 256829

SEQ ID NO: 257078 - RNA, 64 nt, Homo Sapiens; identical to SEQ ID NO: 256830

SEQ ID NO: 257079 - RNA, 64 nt, Homo Sapiens; identical to SEQ ID NO: 256831

SEQ ID NO: 257080 - RNA, 64 nt, Homo Sapiens; identical to SEQ ID NO: 256832

SEQ ID NO: 257081 - RNA, 64 nt, Homo Sapiens; identical to SEQ ID NO: 256833

SEQ ID NO: 257082 - RNA, 64 nt, Homo Sapiens; identical to SEQ ID NO: 256834

SEQ ID NO: 257083 - RNA, 64 nt, Homo Sapiens; identical to SEQ ID NO: 256835

SEQ ID NO: 257084 - RNA, 64 nt, Homo Sapiens; identical to SEQ ID NO: 256836

SEQ ID NO: 257085 - RNA, 64 nt, Homo Sapiens; identical to SEQ ID NO: 256837

SEQ ID NO: 257086 - RNA, 64 nt, Homo Sapiens; identical to SEQ ID NO: 256838

SEQ ID NO: 257087 - RNA, 64 nt, Homo Sapiens; identical to SEQ ID NO: 256839

SEQ ID NO: 257088 - RNA, 64 nt, Homo Sapiens; identical to SEQ ID NO: 256840

SEQ ID NO: 257089 - RNA, 64 nt, Homo Sapiens; identical to SEQ ID NO: 256841

SEQ ID NO: 257090 - RNA, 64 nt, Homo Sapiens; identical to SEQ ID NO: 256842

SEQ ID NO: 257091 - RNA, 64 nt, Homo Sapiens; identical to SEQ ID NO: 256843

SEQ ID NO: 257092 - RNA, 64 nt, Homo Sapiens; identical to SEQ ID NO: 256844

SEQ ID NO: 257093 - RNA, 64 nt, Homo Sapiens; identical to SEQ ID NO: 256845

SEQ ID NO: 257094 - RNA, 64 nt, Homo Sapiens; identical to SEQ ID NO: 256846

SEQ ID NO: 257095 - RNA, 64 nt, Homo Sapiens; identical to SEQ ID NO: 256847

SEQ ID NO: 257096 - RNA, 64 nt, Homo Sapiens; identical to SEQ ID NO: 256848

SEQ ID NO: 257097 - RNA, 64 nt, Homo Sapiens; identical to SEQ ID NO: 256849

SEQ ID NO: 257098 - RNA, 64 nt, Homo Sapiens; identical to SEQ ID NO: 256850

SEQ ID NO: 257099 - RNA, 64 nt, Homo Sapiens; identical to SEQ ID NO: 256851

SEQ ID NO: 257100 - RNA, 64 nt, Homo Sapiens; identical to SEQ ID NO: 256852

SEQ ID NO: 257101 - RNA, 64 nt, Homo Sapiens; identical to SEQ ID NO: 256853

SEQ ID NO: 257102 - RNA, 64 nt, Homo Sapiens; identical to SEQ ID NO: 256854

SEQ ID NO: 257103 - RNA, 64 nt, Homo Sapiens; identical to SEQ ID NO: 256855

SEQ ID NO: 257104 - RNA, 64 nt, Homo Sapiens; identical to SEQ ID NO: 256856

SEQ ID NO: 257105 - RNA, 64 nt, Homo Sapiens; identical to SEQ ID NO: 256857

SEQ ID NO: 257106 - RNA, 64 nt, Homo Sapiens; identical to SEQ ID NO: 256858

SEQ ID NO: 257107 - RNA, 64 nt, Homo Sapiens; identical to SEQ ID NO: 256859

SEQ ID NO: 257108 - RNA, 64 nt, Homo Sapiens; identical to SEQ ID NO: 256860

SEQ ID NO: 257109 - RNA, 64 nt, Homo Sapiens; identical to SEQ ID NO: 256861

SEQ ID NO: 257110 - RNA, 64 nt, Homo Sapiens; identical to SEQ ID NO: 256862

SEQ ID NO: 257111 - RNA, 64 nt, Homo Sapiens; identical to SEQ ID NO: 256863

SEQ ID NO: 257112 - RNA, 64 nt, Homo Sapiens; identical to SEQ ID NO: 256864

SEQ ID NO: 257113 - RNA, 64 nt, Homo Sapiens; identical to SEQ ID NO: 256865

SEQ ID NO: 257114 - RNA, 64 nt, Homo Sapiens; identical to SEQ ID NO: 256866

SEQ ID NO: 257115 - RNA, 64 nt, Homo Sapiens; identical to SEQ ID NO: 256867

SEQ ID NO: 257116 - RNA, 64 nt, Homo Sapiens; identical to SEQ ID NO: 256868

SEQ ID NO: 257117 - RNA, 64 nt, Homo Sapiens; identical to SEQ ID NO: 256869

SEQ ID NO: 257118 - RNA, 64 nt, Homo Sapiens; identical to SEQ ID NO: 256870

SEQ ID NO: 257119 - RNA, 64 nt, Homo Sapiens; identical to SEQ ID NO: 256871

SEQ ID NO: 257120 - RNA, 64 nt, Homo Sapiens; identical to SEQ ID NO: 256872

SEQ ID NO: 257121 - RNA, 64 nt, Homo Sapiens; identical to SEQ ID NO: 256873

SEQ ID NO: 257122 - RNA, 59 nt, Homo Sapiens; identical to SEQ ID NO: 256874

SEQ ID NO: 257123 - RNA, 64 nt, Homo Sapiens; identical to SEQ ID NO: 256875

SEQ ID NO: 257124 - RNA, 64 nt, Homo Sapiens; identical to SEQ ID NO: 256876

SEQ ID NO: 257125 - RNA, 64 nt, Homo Sapiens; identical to SEQ ID NO: 256877

SEQ ID NO: 257126 - RNA, 64 nt, Homo Sapiens; identical to SEQ ID NO: 256878

SEQ ID NO: 257127 - RNA, 64 nt, Homo Sapiens; identical to SEQ ID NO: 256879

SEQ ID NO: 257128 - RNA, 64 nt, Homo Sapiens; identical to SEQ ID NO: 256880

SEQ ID NO: 257129 - RNA, 64 nt, Homo Sapiens; identical to SEQ ID NO: 256881

SEQ ID NO: 257130 - RNA, 64 nt, Homo Sapiens; identical to SEQ ID NO: 256882

SEQ ID NO: 257131 - RNA, 64 nt, Homo Sapiens; identical to SEQ ID NO: 256883

SEQ ID NO: 257132 - RNA, 64 nt, Homo Sapiens; identical to SEQ ID NO: 256884

SEQ ID NO: 257133 - RNA, 64 nt, Homo Sapiens; identical to SEQ ID NO: 256885

SEQ ID NO: 257134 - RNA, 64 nt, Homo Sapiens; identical to SEQ ID NO: 256886

SEQ ID NO: 257135 - RNA, 64 nt, Homo Sapiens; identical to SEQ ID NO: 256887

SEQ ID NO: 257136 - RNA, 64 nt, Homo Sapiens; identical to SEQ ID NO: 256888

SEQ ID NO: 257137 - RNA, 64 nt, Homo Sapiens; identical to SEQ ID NO: 256889

SEQ ID NO: 257138 - RNA, 64 nt, Homo Sapiens; identical to SEQ ID NO: 256890

SEQ ID NO: 257139 - RNA, 64 nt, Homo Sapiens; identical to SEQ ID NO: 256891

SEQ ID NO: 257140 - RNA, 64 nt, Homo Sapiens; identical to SEQ ID NO: 256892

SEQ ID NO: 257141 - RNA, 64 nt, Homo Sapiens; identical to SEQ ID NO: 256893

SEQ ID NO: 257142 - RNA, 64 nt, Homo Sapiens; identical to SEQ ID NO: 256894

SEQ ID NO: 257143 - RNA, 64 nt, Homo Sapiens; identical to SEQ ID NO: 256895

SEQ ID NO: 257144 - RNA, 64 nt, Homo Sapiens; identical to SEQ ID NO: 256896

SEQ ID NO: 257145 - RNA, 64 nt, Homo Sapiens; identical to SEQ ID NO: 256897

SEQ ID NO: 257146 - RNA, 64 nt, Homo Sapiens; identical to SEQ ID NO: 256898

SEQ ID NO: 257147 - RNA, 64 nt, Homo Sapiens; identical to SEQ ID NO: 256899

SEQ ID NO: 257148 - RNA, 64 nt, Homo Sapiens; identical to SEQ ID NO: 256900

SEQ ID NO: 257149 - RNA, 64 nt, Homo Sapiens; identical to SEQ ID NO: 256901

SEQ ID NO: 257150 - RNA, 64 nt, Homo Sapiens; identical to SEQ ID NO: 256902

SEQ ID NO: 257151 - RNA, 64 nt, Homo Sapiens; identical to SEQ ID NO: 256903

SEQ ID NO: 257152 - RNA, 64 nt, Homo Sapiens; identical to SEQ ID NO: 256904

SEQ ID NO: 257153 - RNA, 64 nt, Homo Sapiens; identical to SEQ ID NO: 256905

SEQ ID NO: 257154 - RNA, 64 nt, Homo Sapiens; identical to SEQ ID NO: 256906

SEQ ID NO: 257155 - RNA, 64 nt, Homo Sapiens; identical to SEQ ID NO: 256907

SEQ ID NO: 257156 - RNA, 64 nt, Homo Sapiens; identical to SEQ ID NO: 256908

SEQ ID NO: 257157 - RNA, 64 nt, Homo Sapiens; identical to SEQ ID NO: 256909

SEQ ID NO: 257158 - RNA, 64 nt, Homo Sapiens; identical to SEQ ID NO: 256910

SEQ ID NO: 257159 - RNA, 64 nt, Homo Sapiens; identical to SEQ ID NO: 256911

SEQ ID NO: 257160 - RNA, 64 nt, Homo Sapiens; identical to SEQ ID NO: 256912

SEQ ID NO: 257161 - RNA, 64 nt, Homo Sapiens; identical to SEQ ID NO: 256913

SEQ ID NO: 257162 - RNA, 64 nt, Homo Sapiens; identical to SEQ ID NO: 256790

SEQ ID NO: 257163 - RNA, 64 nt, Homo Sapiens; identical to SEQ ID NO: 256791

SEQ ID NO: 257164 - RNA, 64 nt, Homo Sapiens; identical to SEQ ID NO: 256792

SEQ ID NO: 257165 - RNA, 64 nt, Homo Sapiens; identical to SEQ ID NO: 256793

SEQ ID NO: 257166 - RNA, 64 nt, Homo Sapiens; identical to SEQ ID NO: 256794

SEQ ID NO: 257167 - RNA, 53 nt, Homo Sapiens; identical to SEQ ID NO: 256795

SEQ ID NO: 257168 - RNA, 64 nt, Homo Sapiens; identical to SEQ ID NO: 256796

SEQ ID NO: 257169 - RNA, 64 nt, Homo Sapiens; identical to SEQ ID NO: 256797

SEQ ID NO: 257170 - RNA, 64 nt, Homo Sapiens; identical to SEQ ID NO: 256798

SEQ ID NO: 257171 - RNA, 64 nt, Homo Sapiens; identical to SEQ ID NO: 256799

SEQ ID NO: 257172 - RNA, 64 nt, Homo Sapiens; identical to SEQ ID NO: 256800

SEQ ID NO: 257173 - RNA, 64 nt, Homo Sapiens; identical to SEQ ID NO: 256801

SEQ ID NO: 257174 - RNA, 64 nt, Homo Sapiens; identical to SEQ ID NO: 256802

SEQ ID NO: 257175 - RNA, 64 nt, Homo Sapiens; identical to SEQ ID NO: 256803

SEQ ID NO: 257176 - RNA, 64 nt, Homo Sapiens; identical to SEQ ID NO: 256804

SEQ ID NO: 257177 - RNA, 64 nt, Homo Sapiens; identical to SEQ ID NO: 256805

SEQ ID NO: 257178 - RNA, 64 nt, Homo Sapiens; identical to SEQ ID NO: 256806

SEQ ID NO: 257179 - RNA, 64 nt, Homo Sapiens; identical to SEQ ID NO: 256807

SEQ ID NO: 257180 - RNA, 64 nt, Homo Sapiens; identical to SEQ ID NO: 256808

SEQ ID NO: 257181 - RNA, 64 nt, Homo Sapiens; identical to SEQ ID NO: 256809

SEQ ID NO: 257182 - RNA, 64 nt, Homo Sapiens; identical to SEQ ID NO: 256810

SEQ ID NO: 257183 - RNA, 64 nt, Homo Sapiens; identical to SEQ ID NO: 256811

SEQ ID NO: 257184 - RNA, 64 nt, Homo Sapiens; identical to SEQ ID NO: 256812

SEQ ID NO: 257185 - RNA, 64 nt, Homo Sapiens; identical to SEQ ID NO: 256813

SEQ ID NO: 257186 - RNA, 64 nt, Homo Sapiens; identical to SEQ ID NO: 256814

SEQ ID NO: 257187 - RNA, 64 nt, Homo Sapiens; identical to SEQ ID NO: 256815

SEQ ID NO: 257188 - RNA, 64 nt, Homo Sapiens; identical to SEQ ID NO: 256816

SEQ ID NO: 257189 - RNA, 64 nt, Homo Sapiens; identical to SEQ ID NO: 256817

SEQ ID NO: 257190 - RNA, 64 nt, Homo Sapiens; identical to SEQ ID NO: 256818

SEQ ID NO: 257191 - RNA, 64 nt, Homo Sapiens; identical to SEQ ID NO: 256819

SEQ ID NO: 257192 - RNA, 64 nt, Homo Sapiens; identical to SEQ ID NO: 256820

SEQ ID NO: 257193 - RNA, 64 nt, Homo Sapiens; identical to SEQ ID NO: 256821

SEQ ID NO: 257194 - RNA, 64 nt, Homo Sapiens; identical to SEQ ID NO: 256822

SEQ ID NO: 257195 - RNA, 64 nt, Homo Sapiens; identical to SEQ ID NO: 256823

SEQ ID NO: 257196 - RNA, 64 nt, Homo Sapiens; identical to SEQ ID NO: 256824

SEQ ID NO: 257197 - RNA, 64 nt, Homo Sapiens; identical to SEQ ID NO: 256825

SEQ ID NO: 257198 - RNA, 64 nt, Homo Sapiens; identical to SEQ ID NO: 256826

SEQ ID NO: 257199 - RNA, 64 nt, Homo Sapiens; identical to SEQ ID NO: 256827

SEQ ID NO: 257200 - RNA, 64 nt, Homo Sapiens; identical to SEQ ID NO: 256828

SEQ ID NO: 257201 - RNA, 64 nt, Homo Sapiens; identical to SEQ ID NO: 256829

SEQ ID NO: 257202 - RNA, 64 nt, Homo Sapiens; identical to SEQ ID NO: 256830

SEQ ID NO: 257203 - RNA, 64 nt, Homo Sapiens; identical to SEQ ID NO: 256831

SEQ ID NO: 257204 - RNA, 64 nt, Homo Sapiens; identical to SEQ ID NO: 256832

SEQ ID NO: 257205 - RNA, 64 nt, Homo Sapiens; identical to SEQ ID NO: 256833

SEQ ID NO: 257206 - RNA, 64 nt, Homo Sapiens; identical to SEQ ID NO: 256834

SEQ ID NO: 257207 - RNA, 64 nt, Homo Sapiens; identical to SEQ ID NO: 256835

SEQ ID NO: 257208 - RNA, 64 nt, Homo Sapiens; identical to SEQ ID NO: 256836

SEQ ID NO: 257209 - RNA, 64 nt, Homo Sapiens; identical to SEQ ID NO: 256837

SEQ ID NO: 257210 - RNA, 64 nt, Homo Sapiens; identical to SEQ ID NO: 256838

SEQ ID NO: 257211 - RNA, 64 nt, Homo Sapiens; identical to SEQ ID NO: 256839

SEQ ID NO: 257212 - RNA, 64 nt, Homo Sapiens; identical to SEQ ID NO: 256840

SEQ ID NO: 257213 - RNA, 64 nt, Homo Sapiens; identical to SEQ ID NO: 256841

SEQ ID NO: 257214 - RNA, 64 nt, Homo Sapiens; identical to SEQ ID NO: 256842

SEQ ID NO: 257215 - RNA, 64 nt, Homo Sapiens; identical to SEQ ID NO: 256843

SEQ ID NO: 257216 - RNA, 64 nt, Homo Sapiens; identical to SEQ ID NO: 256844

SEQ ID NO: 257217 - RNA, 64 nt, Homo Sapiens; identical to SEQ ID NO: 256845

SEQ ID NO: 257218 - RNA, 64 nt, Homo Sapiens; identical to SEQ ID NO: 256846

SEQ ID NO: 257219 - RNA, 64 nt, Homo Sapiens; identical to SEQ ID NO: 256847

SEQ ID NO: 257220 - RNA, 64 nt, Homo Sapiens; identical to SEQ ID NO: 256848

SEQ ID NO: 257221 - RNA, 64 nt, Homo Sapiens; identical to SEQ ID NO: 256849

SEQ ID NO: 257222 - RNA, 64 nt, Homo Sapiens; identical to SEQ ID NO: 256850

SEQ ID NO: 257223 - RNA, 64 nt, Homo Sapiens; identical to SEQ ID NO: 256851

SEQ ID NO: 257224 - RNA, 64 nt, Homo Sapiens; identical to SEQ ID NO: 256852

SEQ ID NO: 257225 - RNA, 64 nt, Homo Sapiens; identical to SEQ ID NO: 256853

SEQ ID NO: 257226 - RNA, 64 nt, Homo Sapiens; identical to SEQ ID NO: 256854

SEQ ID NO: 257227 - RNA, 64 nt, Homo Sapiens; identical to SEQ ID NO: 256855

SEQ ID NO: 257228 - RNA, 64 nt, Homo Sapiens; identical to SEQ ID NO: 256856

SEQ ID NO: 257229 - RNA, 64 nt, Homo Sapiens; identical to SEQ ID NO: 256857

SEQ ID NO: 257230 - RNA, 64 nt, Homo Sapiens; identical to SEQ ID NO: 256858

SEQ ID NO: 257231 - RNA, 64 nt, Homo Sapiens; identical to SEQ ID NO: 256859

SEQ ID NO: 257232 - RNA, 64 nt, Homo Sapiens; identical to SEQ ID NO: 256860

SEQ ID NO: 257233 - RNA, 64 nt, Homo Sapiens; identical to SEQ ID NO: 256861

SEQ ID NO: 257234 - RNA, 64 nt, Homo Sapiens; identical to SEQ ID NO: 256862

SEQ ID NO: 257235 - RNA, 64 nt, Homo Sapiens; identical to SEQ ID NO: 256863

SEQ ID NO: 257236 - RNA, 64 nt, Homo Sapiens; identical to SEQ ID NO: 256864

SEQ ID NO: 257237 - RNA, 64 nt, Homo Sapiens; identical to SEQ ID NO: 256865

SEQ ID NO: 257238 - RNA, 64 nt, Homo Sapiens; identical to SEQ ID NO: 256866

SEQ ID NO: 257239 - RNA, 64 nt, Homo Sapiens; identical to SEQ ID NO: 256867

SEQ ID NO: 257240 - RNA, 64 nt, Homo Sapiens; identical to SEQ ID NO: 256868

SEQ ID NO: 257241 - RNA, 64 nt, Homo Sapiens; identical to SEQ ID NO: 256869

SEQ ID NO: 257242 - RNA, 64 nt, Homo Sapiens; identical to SEQ ID NO: 256870

SEQ ID NO: 257243 - RNA, 64 nt, Homo Sapiens; identical to SEQ ID NO: 256871

SEQ ID NO: 257244 - RNA, 64 nt, Homo Sapiens; identical to SEQ ID NO: 256872

SEQ ID NO: 257245 - RNA, 64 nt, Homo Sapiens; identical to SEQ ID NO: 256873

SEQ ID NO: 257246 - RNA, 59 nt, Homo Sapiens; identical to SEQ ID NO: 256874

SEQ ID NO: 257247 - RNA, 64 nt, Homo Sapiens; identical to SEQ ID NO: 256875

SEQ ID NO: 257248 - RNA, 64 nt, Homo Sapiens; identical to SEQ ID NO: 256876

SEQ ID NO: 257249 - RNA, 64 nt, Homo Sapiens; identical to SEQ ID NO: 256877

SEQ ID NO: 257250 - RNA, 64 nt, Homo Sapiens; identical to SEQ ID NO: 256878

SEQ ID NO: 257251 - RNA, 64 nt, Homo Sapiens; identical to SEQ ID NO: 256879

SEQ ID NO: 257252 - RNA, 64 nt, Homo Sapiens; identical to SEQ ID NO: 256880

SEQ ID NO: 257253 - RNA, 64 nt, Homo Sapiens; identical to SEQ ID NO: 256881

SEQ ID NO: 257254 - RNA, 64 nt, Homo Sapiens; identical to SEQ ID NO: 256882

SEQ ID NO: 257255 - RNA, 64 nt, Homo Sapiens; identical to SEQ ID NO: 256883

SEQ ID NO: 257256 - RNA, 64 nt, Homo Sapiens; identical to SEQ ID NO: 256884

SEQ ID NO: 257257 - RNA, 64 nt, Homo Sapiens; identical to SEQ ID NO: 256885

SEQ ID NO: 257258 - RNA, 64 nt, Homo Sapiens; identical to SEQ ID NO: 256886

SEQ ID NO: 257259 - RNA, 64 nt, Homo Sapiens; identical to SEQ ID NO: 256887

SEQ ID NO: 257260 - RNA, 64 nt, Homo Sapiens; identical to SEQ ID NO: 256888

SEQ ID NO: 257261 - RNA, 64 nt, Homo Sapiens; identical to SEQ ID NO: 256889

SEQ ID NO: 257262 - RNA, 64 nt, Homo Sapiens; identical to SEQ ID NO: 256890

SEQ ID NO: 257263 - RNA, 64 nt, Homo Sapiens; identical to SEQ ID NO: 256891

SEQ ID NO: 257264 - RNA, 64 nt, Homo Sapiens; identical to SEQ ID NO: 256892

SEQ ID NO: 257265 - RNA, 64 nt, Homo Sapiens; identical to SEQ ID NO: 256893

SEQ ID NO: 257266 - RNA, 64 nt, Homo Sapiens; identical to SEQ ID NO: 256894

SEQ ID NO: 257267 - RNA, 64 nt, Homo Sapiens; identical to SEQ ID NO: 256895

SEQ ID NO: 257268 - RNA, 64 nt, Homo Sapiens; identical to SEQ ID NO: 256896

SEQ ID NO: 257269 - RNA, 64 nt, Homo Sapiens; identical to SEQ ID NO: 256897

SEQ ID NO: 257270 - RNA, 64 nt, Homo Sapiens; identical to SEQ ID NO: 256898

SEQ ID NO: 257271 - RNA, 64 nt, Homo Sapiens; identical to SEQ ID NO: 256899

SEQ ID NO: 257272 - RNA, 64 nt, Homo Sapiens; identical to SEQ ID NO: 256900

SEQ ID NO: 257273 - RNA, 64 nt, Homo Sapiens; identical to SEQ ID NO: 256901

SEQ ID NO: 257274 - RNA, 64 nt, Homo Sapiens; identical to SEQ ID NO: 256902

SEQ ID NO: 257275 - RNA, 64 nt, Homo Sapiens; identical to SEQ ID NO: 256903

SEQ ID NO: 257276 - RNA, 64 nt, Homo Sapiens; identical to SEQ ID NO: 256904

SEQ ID NO: 257277 - RNA, 64 nt, Homo Sapiens; identical to SEQ ID NO: 256905

SEQ ID NO: 257278 - RNA, 64 nt, Homo Sapiens; identical to SEQ ID NO: 256906

SEQ ID NO: 257279 - RNA, 64 nt, Homo Sapiens; identical to SEQ ID NO: 256907

SEQ ID NO: 257280 - RNA, 64 nt, Homo Sapiens; identical to SEQ ID NO: 256908

SEQ ID NO: 257281 - RNA, 64 nt, Homo Sapiens; identical to SEQ ID NO: 256909

SEQ ID NO: 257282 - RNA, 64 nt, Homo Sapiens; identical to SEQ ID NO: 256910

SEQ ID NO: 257283 - RNA, 64 nt, Homo Sapiens; identical to SEQ ID NO: 256911

SEQ ID NO: 257284 - RNA, 64 nt, Homo Sapiens; identical to SEQ ID NO: 256912

SEQ ID NO: 257285 - RNA, 64 nt, Homo Sapiens; identical to SEQ ID NO: 256913

SEQ ID NO: 257286 - RNA, 64 nt, Homo Sapiens
gccuuugcauugucuugucaccucauucaucacuuggacacaucggacaaagcagcacguauca

SEQ ID NO: 257287 - RNA, 64 nt, Homo Sapiens
cccacucuccacuuucugaggcaucugcuccccguggacacagcagacauccugacaguguugg

SEQ ID NO: 257288 - RNA, 64 nt, Homo Sapiens
uggaaccaagccagggaugggacagggccccggcuggacacacgcagccaacccugaucuggaa

SEQ ID NO: 257289 - RNA, 64 nt, Homo Sapiens
acauugaagaccaucccaagcccaacaucuuccauggacacaugaccacgagacccucaaccag

SEQ ID NO: 257290 - RNA, 64 nt, Homo Sapiens
gaacuaagccucccaaauggaagcugggccuucauggacacaugcagcuggucacuccccagag

SEQ ID NO: 257291 - RNA, 64 nt, Homo Sapiens
ucucuucacucuuugcucauaccccuucgugcuguggacacagccuuggacacuggccaaggag

SEQ ID NO: 257292 - RNA, 64 nt, Homo Sapiens
caccccaggcagucugugugugaggcauagccccuggacacacacacacagacacacacacugc

SEQ ID NO: 257293 - RNA, 64 nt, Homo Sapiens
auacacacgcacacccaugcgcagaugugcugccuggacacacacacacacacggauaugcugu

SEQ ID NO: 257294 - RNA, 64 nt, Homo Sapiens
guauccggacacacacgugcacagauaugcugccuggacacacagauaaugcugccuugacaca

SEQ ID NO: 257295 - RNA, 64 nt, Homo Sapiens
ugcugccuugacacacacaugcacggauauugccuggacacacacacacacacgugugcacaga

SEQ ID NO: 257296 - RNA, 64 nt, Homo Sapiens
gucuggacacgcacacacaugcagauaugcugccuggacacacacuuccagacacacgugcaca

SEQ ID NO: 257297 - RNA, 64 nt, Homo Sapiens
ccagacacacgugcacaggcgcagauaugcugccuggacacacgcagauaugcugucuagucac

SEQ ID NO: 257298 - RNA, 64 nt, Homo Sapiens
guccggacacacacacgcacgcagauaugcugccuggacacacacacagauaaugcugccucaa

SEQ ID NO: 257299 - RNA, 64 nt, Homo Sapiens
cugccucaacacucacacacgugcagauauugccuggacacacacaugugcacagauaugcugu

SEQ ID NO: 257300 - RNA, 64 nt, Homo Sapiens
acacacaugcacacacaggugcagauaugcugccuggacacacgcagacugacgugcuuuuggg

SEQ ID NO: 257301 - RNA, 64 nt, Homo Sapiens
ugguccauacgcugagccacaacagccuuuucccuggacacagaguaacugcuaacuccuagga

SEQ ID NO: 257302 - RNA, 64 nt, Homo Sapiens
uauauacugugcacugaaaaauaaaguuaacuccuggacacaagguauuuuuagaauggcagcu

SEQ ID NO: 257303 - RNA, 64 nt, Homo Sapiens
ccuggcccguuuugaggcugacacauucggcggcuggacacagacuuuccacccagguggacaa

SEQ ID NO: 257304 - RNA, 64 nt, Homo Sapiens
ucccugagaacugccugccgaucaucaaaaacccuggacacaguuuacacaugaaaaggugaac

SEQ ID NO: 257305 - RNA, 64 nt, Homo Sapiens
auuuauagcauguuucuuuuugaaaaacuagugguggacacauuuggaucacauuuauacaguu

SEQ ID NO: 257306 - RNA, 64 nt, Homo Sapiens
cucuugcaguuuguucuguaaugccuuuuacauuuggacacauaguuuaugcuuuuuagauuuu

SEQ ID NO: 257307 - RNA, 64 nt, Homo Sapiens
aggaccugacagagcccaugcagggcuuuagauuuggacacacaagaguugauaacuuccucau

SEQ ID NO: 257308 - RNA, 64 nt, Homo Sapiens
cucacccuggugcugccucccgcacaaggagaccuggacacaacagacacacaucacaaggcga

SEQ ID NO: 257309 - RNA, 64 nt, Homo Sapiens
acacaacagacacacaucacaaggcgaacacaaauggacacacauaccuggccacgaacccaca

SEQ ID NO: 257310 - RNA, 54 nt, Homo Sapiens
augacugggucuaugaauaagagguggacacaacagcagucuccuucagcacgg

SEQ ID NO: 257311 - RNA, 64 nt, Homo Sapiens
cagcagucuccuucagcacggcguggugugucccuggacacagcucuucauuccauugacuuag

SEQ ID NO: 257312 - RNA, 64 nt, Homo Sapiens
ugucucaugucuuauuuuugaaccaugcauaugauggacacacaauggauggacacauuauauc

SEQ ID NO: 257313 - RNA, 64 nt, Homo Sapiens
uuuugaaccaugcauaugauggacacacaauggauggacacauuauaucuccaacaaggugugg

SEQ ID NO: 257314 - RNA, 64 nt, Homo Sapiens
gcccugggaaaaagagggggcugcucccuuguucuggacacagaagccccuuugcuggcuuuau

SEQ ID NO: 257315 - RNA, 64 nt, Homo Sapiens
gaaacccaacugagaacaaaacccaagagcugccuggacacacgaaagaaagaaagaaaaggaa

SEQ ID NO: 257316 - RNA, 64 nt, Homo Sapiens
ccccgaucucgagccccggcuuuccagauugcaguggacacagcgguuuguuggguuuuucguc

SEQ ID NO: 257317 - RNA, 64 nt, Homo Sapiens
ccacagaugugggcacacgagggcuacguccauguggacacagaacagaaagagacagaagcug

SEQ ID NO: 257318 - RNA, 64 nt, Homo Sapiens
gcuguuugagauucucaaaggagcgagcaugucguggacacacacagacuauuuuuagauuuuc

SEQ ID NO: 257319 - RNA, 64 nt, Homo Sapiens
uguccacagcaagaugacgugauucuuauuuucuuggacacagacuauucugaggcacagagcg

SEQ ID NO: 257320 - RNA, 64 nt, Homo Sapiens
ugacuuuauuaaagcaacauuugccacauguuuaagccgcaaagguauuagcaaugcuugcauc

SEQ ID NO: 257321 - RNA, 64 nt, Homo Sapiens
uguguuuuucccaucaugacggaagaagagagugagccgcaauuguucugaaaaugucaaacga

SEQ ID NO: 257322 - RNA, 64 nt, Homo Sapiens
ccaugggcguccuuugggugacucgccauaaaucagccgcaaggauccuucccuguaaauuuga

SEQ ID NO: 257323 - RNA, 64 nt, Homo Sapiens
cacaaccccugaggagguguagacccagucugagagccgcaagcacugaggcagggccugagac

SEQ ID NO: 257324 - RNA, 64 nt, Homo Sapiens
cuacaggccucaguuccuugcuguagccagugacagccgcaaccuuuuuacagaaagaugccgc

SEQ ID NO: 257325 - RNA, 64 nt, Homo Sapiens
gcucugaggucucggccagcccggaguccuccugagccgcaacgccaggagacguucaacgcca

SEQ ID NO: 257326 - RNA, 64 nt, Homo Sapiens
agacaaagaccaccccuucacccacuggaccccaagccgcaaaagcuggggagguaggaagggu

SEQ ID NO: 257327 - RNA, 64 nt, Homo Sapiens
ugaaaccacaggcccuugggguucccccagacagagccgcaaaucaaccccagacucaaacuca

SEQ ID NO: 257328 - RNA, 64 nt, Homo Sapiens
ggcagccccugggcaggagacguggcugcugaacagccgcaaaccaucuucaccugggggcauu

SEQ ID NO: 257329 - RNA, 64 nt, Homo Sapiens
cauggagagcacccugaggaccuuuaaaaggcaaagccgcaaggcagaaggaggcugggucccu

SEQ ID NO: 257330 - RNA, 64 nt, Homo Sapiens
aagaaaaaaugaugaaguuguuccuauuaaguacagccgcaagaauuuauuuucacacauuuaa

SEQ ID NO: 257331 - RNA, 64 nt, Homo Sapiens
aacagaagccagaagcccucgcaggugucgugucagccgcaauaguggaaggaccgcggguguc

SEQ ID NO: 257332 - RNA, 64 nt, Homo Sapiens
gucgucugccugugugggggcgaaaucauuugcgagccgcaaucauauuuauuuuuucaaaauc

SEQ ID NO: 257333 - RNA, 64 nt, Homo Sapiens
ggggugccaggagccccaggcaccucucuuccccagccgcaacgcccuuucucuggggauucca

SEQ ID NO: 257334 - RNA, 64 nt, Homo Sapiens
aggccccgccccaccgcuccgggagcugcucaucagccgcaacuuccugccgacccugaugcgg

SEQ ID NO: 257335 - RNA, 64 nt, Homo Sapiens
gugagggcagaugucuccagccaggacugcccugagccgcaaaaugucaaagcuggagcuauag

SEQ ID NO: 257336 - RNA, 64 nt, Homo Sapiens
ccauacccccugccccagagugugccugcuauccagccgcaaauuccugggagugggagucaag

SEQ ID NO: 257337 - RNA, 64 nt, Homo Sapiens
cuuugagagggcugaagggagggccuugauuuccagccgcaaucuggcuccuccuggaaaauuu

SEQ ID NO: 257338 - RNA, 64 nt, Homo Sapiens
ccugcccguguugagugagauccuccgaggccugagccgcaaugaucccccgaccccuugacac

SEQ ID NO: 257339 - RNA, 64 nt, Homo Sapiens
ccucugggcugcuucgucuuacuacagaaccugcagccgcaaauuguccgcccaccuucccucc

SEQ ID NO: 257340 - RNA, 64 nt, Homo Sapiens
agugcugggauuacaggcaugagccaccgugcucagccgcaaaauucuuuaugaauuuuacacu

SEQ ID NO: 257341 - RNA, 64 nt, Homo Sapiens
uggccugaccccugaggagcgguccuuccacaccagccgcaacccaagcagaugacaggcacag

SEQ ID NO: 257342 - RNA, 64 nt, Homo Sapiens
guggggagaacccggacagcucaguccugccagcagccgcaaagagccgaggcugccaggccca

SEQ ID NO: 257343 - RNA, 64 nt, Homo Sapiens
aggcucauagccaagcugugccacaguccacagaagccgcaaaccuuuccuggcccaguccuca

SEQ ID NO: 257344 - RNA, 64 nt, Homo Sapiens
cacuggauucuggcagcaccacccucagacccacagccgcaaggacagccggcagggaaucgga

SEQ ID NO: 257345 - RNA, 64 nt, Homo Sapiens
ggaaaugaagaaaacugagcuggccacagguagcagccgcaaggcacaggacugcuucaggccg

SEQ ID NO: 257346 - RNA, 64 nt, Homo Sapiens
ucucagcaagugcccaguggccagcggcugcucaagccgcaagcgccggacacggcuucacuga

SEQ ID NO: 257347 - RNA, 64 nt, Homo Sapiens
gauugccaagugccagcagcugcagcaagaauacagccgcaaggaggaggagugccaggcaggg

SEQ ID NO: 257348 - RNA, 64 nt, Homo Sapiens
cgugucauuccagaguggaucugcggugaagccaagccgcaagguuacaaggcauccucaccag

SEQ ID NO: 257349 - RNA, 64 nt, Homo Sapiens
cuaauccacguaguucccauaaggucgaugacacagccgcaaaugcacuuugcuggccccgaga

SEQ ID NO: 257350 - RNA, 64 nt, Homo Sapiens
gauugucucagaugcagggcgcugugcgggacgaagccgcaaggacucucguaucgggcccuug

SEQ ID NO: 257351 - RNA, 64 nt, Homo Sapiens
aaugcugggauuacagauaugagccaucaugcccagccgcaacccuaauuuuucauucagucau

SEQ ID NO: 257352 - RNA, 64 nt, Homo Sapiens
cccagaauggaggguguucugacaccccacccugagccgcaagagcaguccuggggcccuggac

SEQ ID NO: 257353 - RNA, 64 nt, Homo Sapiens
ccuagaggagcccuccugugaccauaaggguaaaagccgcaagcuaagaagaggguggccggaa

SEQ ID NO: 257354 - RNA, 64 nt, Homo Sapiens
uugaucaugugcaauauuucuuacugugccgagaagccgcaaugagcgagauuaaagcuguuua

SEQ ID NO: 257355 - RNA, 64 nt, Homo Sapiens
accagcaaguuuuuauuaggcgugaugccccacaagccgcaaaacaucacaugucgguagguuc

SEQ ID NO: 257356 - RNA, 64 nt, Homo Sapiens
cuauacccuugacgcccauagagcccccaaugaaagccgcaaaccucugaccauuccucuacug

SEQ ID NO: 257357 - RNA, 64 nt, Homo Sapiens; identical to SEQ ID NO: 237127

SEQ ID NO: 257358 - RNA, 64 nt, Homo Sapiens; identical to SEQ ID NO: 237128

SEQ ID NO: 257359 - RNA, 64 nt, Homo Sapiens; identical to SEQ ID NO: 237129

SEQ ID NO: 257360 - RNA, 64 nt, Homo Sapiens; identical to SEQ ID NO: 237130

SEQ ID NO: 257361 - RNA, 64 nt, Homo Sapiens; identical to SEQ ID NO: 237131

SEQ ID NO: 257362 - RNA, 64 nt, Homo Sapiens; identical to SEQ ID NO: 237132

SEQ ID NO: 257363 - RNA, 64 nt, Homo Sapiens; identical to SEQ ID NO: 237133

SEQ ID NO: 257364 - RNA, 64 nt, Homo Sapiens; identical to SEQ ID NO: 237134

SEQ ID NO: 257365 - RNA, 64 nt, Homo Sapiens
uguuuguuuguuuguuuguuuuaaucucuacagcacauuuaaugcaacuuuugaaaucugcagg

SEQ ID NO: 257366 - RNA, 64 nt, Homo Sapiens
gaguaacauuacuuaaaaaaaaaaggauauguuuacauuuaauuuuggcuaccaggaguuuagu

SEQ ID NO: 257367 - RNA, 64 nt, Homo Sapiens
gcuaagaagaauaaguccuucuguuuucucuuuaacauuuaaaauaucucaaugcacaugauau

SEQ ID NO: 257368 - RNA, 64 nt, Homo Sapiens
cacuguuuuuauguaguucauauauauuaccaugacauuuaacaucaauaucguauauguugaa

SEQ ID NO: 257369 - RNA, 64 nt, Homo Sapiens
uuaaaacacuggacuagaagagauaaugauugaaacauuuaaaaaaaaaaagugcuccauucgc

SEQ ID NO: 257370 - RNA, 64 nt, Homo Sapiens
auacacuccugcugaaaaauguuaauccaaauacacauuuaaacuuagggucgguccuuauucu

SEQ ID NO: 257371 - RNA, 64 nt, Homo Sapiens
aagcucagaauaucacauugaaauuacuauaaauacauuuaaaauuaucuauuuuagaucuaag

SEQ ID NO: 257372 - RNA, 64 nt, Homo Sapiens
uaacguuuuccugaagcuguuucuggagagccacacauuuaaauacagacagcuuuccugauca

SEQ ID NO: 257373 - RNA, 64 nt, Homo Sapiens
auuagacucccuacaguccuucaauggaaaaguaacauuuaaaaauccuuuggguaauucgaau

SEQ ID NO: 257374 - RNA, 64 nt, Homo Sapiens
auacauuuaguaaaguccccaagacauuagucuuacauuuaaacuuuuuucuuuaaaacauggu

SEQ ID NO: 257375 - RNA, 64 nt, Homo Sapiens
gauauugaauucauggagccuuuacagaagcaucacauuuaaaccaaugugaauucaaaaaaga

SEQ ID NO: 257376 - RNA, 64 nt, Homo Sapiens
uuacaaaacauccaacacuagaaagcaaugacuaacauuuaauuuguuuacaaaaauguuuauu

SEQ ID NO: 257377 - RNA, 64 nt, Homo Sapiens
caccagagagugcguauccugcucagaaccauucacauuuaauucaauucuuggaaaaaauuaa

SEQ ID NO: 257378 - RNA, 64 nt, Homo Sapiens
guagauaaauaauaauagcccugagauguuucuaacauuuaaauaagaaaaaaaucaaaucgaa

SEQ ID NO: 257379 - RNA, 64 nt, Homo Sapiens
gaaauacuucagaucacaugaaaaugcugauuuaacauuuaaguaucacagcauuaaaagaaaa

SEQ ID NO: 257380 - RNA, 64 nt, Homo Sapiens
cguggguuuuguuuuuaagcaaaacaaugugaaaacauuuaaguuugaaauguugcauuugaag

SEQ ID NO: 257381 - RNA, 64 nt, Homo Sapiens
aaaauccaaagcugcucucgauaauuuuuaaaaaacauuuaaaacuucuguuauuuacaaaaua

SEQ ID NO: 257382 - RNA, 64 nt, Homo Sapiens
ggaaaaauuagcaguauuugaugguacuugaucuacauuuaaguucuagaacaaaauagucuau

SEQ ID NO: 257383 - RNA, 64 nt, Homo Sapiens
gcuuaucauaugccagauacaauuagaaauguuaacauuuaagucuaguccucaaagcagaaau

SEQ ID NO: 257384 - RNA, 64 nt, Homo Sapiens
uugcuuucuuuuuagcaagagguuauaacaaaauacauuuaacaguauuauuuuaggucauaaa

SEQ ID NO: 257385 - RNA, 64 nt, Homo Sapiens
ugauggcaccuugaaagugaacuucuagaaaucuacauuuaaaaggcaaagcuuuaaaagcaga

SEQ ID NO: 257386 - RNA, 64 nt, Homo Sapiens
acuaaaggaaacccaggaauauuuaccugguguuacauuuaauauuuaauguaacuggucuagc

SEQ ID NO: 257387 - RNA, 64 nt, Homo Sapiens
agugagcucagaggcccuucucacugagacagcaacauuuaaaccaaaccagaggaaguauuug

SEQ ID NO: 257388 - RNA, 64 nt, Homo Sapiens
cagcuggguuuuuaauuagcgcauucucuauccaacauuuaauuguuugaaagccuccauauag

SEQ ID NO: 257389 - RNA, 64 nt, Homo Sapiens
acuauaaaaugcaguaacauucuacuugcuuauuacauuuaaauccuuguguaacugaauguuu

SEQ ID NO: 257390 - RNA, 64 nt, Homo Sapiens
uguuuauggugagguuuaaaggauaugaaacucuacauuuaaacaaguauuuuauauuugggua

SEQ ID NO: 257391 - RNA, 64 nt, Homo Sapiens
uguagaacugauauuuuucaaaaauccaaaguaaacauuuaaauaugauauuuucuucuauaau

SEQ ID NO: 257392 - RNA, 64 nt, Homo Sapiens
gcuuguuaccugugauuuuacacuuuuguagauuacauuuaauauucucuuuauguuauucuuu

SEQ ID NO: 257393 - RNA, 64 nt, Homo Sapiens
ccagccuuggguuugaccugaaauuuaaauagccacauuuaacuacccaucuuucaauucaauu

SEQ ID NO: 257394 - RNA, 64 nt, Homo Sapiens
uguuuuaaaaugucuuauuuuuuccaaauaaugcacauuuaauagguucauuugcauauacuuu

SEQ ID NO: 257395 - RNA, 64 nt, Homo Sapiens
ugcagacaguguuuugcacaaauuccaucacaucacauuuaaaucagauuuguaauggcuccca

SEQ ID NO: 257396 - RNA, 64 nt, Homo Sapiens
acaaaguucuuuauugggugugcuuuuaguaaaaacauuuaaaugagagcaaagguuaauuuug

SEQ ID NO: 257397 - RNA, 64 nt, Homo Sapiens
uucauuugugaaacuguauaacaaaaacaguaaaacauuuaauaagaaaugucugaaacuuuag

SEQ ID NO: 257398 - RNA, 64 nt, Homo Sapiens
gcagauuuuuucaaaaucgaguuauuccuuaaaaacauuuaaaaaagauuguuauuguaauuuu

SEQ ID NO: 257399 - RNA, 64 nt, Homo Sapiens
caguuucucuucccuaagaggggguuccuaauacacauuuaauucgcuggcuuaaggagcugga

SEQ ID NO: 257400 - RNA, 64 nt, Homo Sapiens
uccaaguagaagcuugcaucagaugagaaaguggacauuuaagggucuggcaggugggggaaug

SEQ ID NO: 257401 - RNA, 64 nt, Homo Sapiens
aguuuggggcacucaucccauucauaauuauuuuacauuuaaauuacuguuccuacuuaagugg

SEQ ID NO: 257402 - RNA, 64 nt, Homo Sapiens
acauguuuuauuuuuacuuuuguuaaaauaaauaacauuuaauuugacggaaaauucuaaaaau

SEQ ID NO: 257403 - RNA, 64 nt, Homo Sapiens
auuaguuuauuaucagauauuuaaaaauuauuaaacauuuaaaauaucuggcauuuuuaaacau

SEQ ID NO: 257404 - RNA, 64 nt, Homo Sapiens
auuauuaaacauuuaaaaauucuggcauuuuuaaacauuuaaaaucuguuagaaauuaguuuua

SEQ ID NO: 257405 - RNA, 64 nt, Homo Sapiens
aauuaagaguauuuugcauuaaacgagaaauacaacauuuaaaaagugaacuauuaauauuuaa

SEQ ID NO: 257406 - RNA, 64 nt, Homo Sapiens
uacacaauucagugguuuuauaccauauaaucacacauuuaaaauucaugagauacaauucaca

SEQ ID NO: 257407 - RNA, 64 nt, Homo Sapiens
aaaaauauugaacucaaugauagcaccuaaacuuacauuuaaaagacagacauuccuucuacau

SEQ ID NO: 257408 - RNA, 64 nt, Homo Sapiens
agguaagaggaagcuuacauuacauguccaguccacauuuaaagagcacuuacuguggaacaag

SEQ ID NO: 257409 - RNA, 64 nt, Homo Sapiens
acugcagaagacuaucuuaaaauacaggauuuuaacauuuaagucaugcacauuuaacaauuac

SEQ ID NO: 257410 - RNA, 64 nt, Homo Sapiens
cuuaaaauacaggauuuuaacauuuaagucaugcacauuuaacaauuacagguuauaaauuagu

SEQ ID NO: 257411 - RNA, 64 nt, Homo Sapiens
aauguauguguggggcugaguugagaagaaaagaacauuuaauaacuagaguuaccauucauau

SEQ ID NO: 257412 - RNA, 64 nt, Homo Sapiens
ucuuugaaaguggcucccaguuggcuuuagucuuacauuuaaauguuuucaugaggaagcuggc

SEQ ID NO: 257413 - RNA, 64 nt, Homo Sapiens
uuacaggcaugagccacugcaccuggcuauauuuacauuuaauagaaacauaucuagcauaugu

SEQ ID NO: 257414 - RNA, 64 nt, Homo Sapiens
uuagauuauguauuccuuuugaaacauaagaaaaacauuuaaaccuaugcugaaaauacgauaa

SEQ ID NO: 257415 - RNA, 64 nt, Homo Sapiens
guuugcagauucugcaaacuauacuucugacacuacauuuaaauauauuguuaacuguuaauaa

SEQ ID NO: 257416 - RNA, 64 nt, Homo Sapiens
uaauggagcauguacuuauuauaaauguuggaugacauuuaauucuguaacuaagacaauauug

SEQ ID NO: 257417 - RNA, 64 nt, Homo Sapiens
uacuucccucaauucuguaagcauguguauuuugacauuuaaaauauaugcuaaaucacauuca

SEQ ID NO: 257418 - RNA, 64 nt, Homo Sapiens
aauaauuguguuugaccccaugggcggacugauaacauuuaaaauuuacaaaaguucuuauuac

SEQ ID NO: 257419 - RNA, 64 nt, Homo Sapiens
aaaaaugggauaagaauaguaaagaaaaaacuaaacauuuaaacaugauuuaaaaucaaaucaa

SEQ ID NO: 257420 - RNA, 64 nt, Homo Sapiens
caguuaugguguagcugcugauaacuaaugacacacauuuaaauacuguaaaauguggcucuaa

SEQ ID NO: 257421 - RNA, 64 nt, Homo Sapiens
guguucaucauauuuaaaaaauauauaaaugaaaacauuuaauuuuuggagggaguguugcaau

SEQ ID NO: 257422 - RNA, 64 nt, Homo Sapiens
gagagucccuccccuaucuuuuuuguuacacugcacauuuaaggaguucugaaaagaauuuuug

SEQ ID NO: 257423 - RNA, 64 nt, Homo Sapiens
augcuaacaucacugucauaucauuuugcauuuuacauuuaaauuuugcauauuuaaaaauuaa

SEQ ID NO: 257424 - RNA, 64 nt, Homo Sapiens
cugauaauaucuguaaugaccauacaaaaacuuaacauuuaaaauaaagauauuuauauauugc

SEQ ID NO: 257425 - RNA, 64 nt, Homo Sapiens
ucuuguuuaaacaauguuucauguuaaggcuaauacauuuaagauaacaaugauucauucauua

SEQ ID NO: 257426 - RNA, 64 nt, Homo Sapiens
aauuucuuguaaaccacuuugcucuaucucuacaacauuuaauggcaccugggagcgcugcuug

SEQ ID NO: 257427 - RNA, 64 nt, Homo Sapiens
augauaauagcagggaauucuuaaaaaugugaaaacauuuaaaauccaaaaggguaaggcaguu

SEQ ID NO: 257428 - RNA, 64 nt, Homo Sapiens
guagccucguagguugaauuuagccgauccuguuacauuuaagaggagggguacaucgucaaca

SEQ ID NO: 257429 - RNA, 64 nt, Homo Sapiens
ugcuuacuuucugccauuggguugguuugauaccacauuuaacauugacauuuaaguggaaaac

SEQ ID NO: 257430 - RNA, 64 nt, Homo Sapiens
ccauuggguugguuugauaccacauuuaacauugacauuuaaguggaaaaccaaguuaucauug

SEQ ID NO: 257431 - RNA, 64 nt, Homo Sapiens
gauuuugugagcagugaaguuuaacagagcagugacauuuaacaaagcagugaaguuuaacaga

SEQ ID NO: 257432 - RNA, 64 nt, Homo Sapiens
gauuucggaaggcgacagaaaauuuaguucuuagacauuuaaauagaaaguugugugccccuau

SEQ ID NO: 257433 - RNA, 64 nt, Homo Sapiens
cacauaaaagccacugcuuuuaacaucccauuguacauuuaacacauaaaugguguuaacaucc

SEQ ID NO: 257434 - RNA, 64 nt, Homo Sapiens
auuuaacacauaaaugguguuaacaucccauuguacauuuaacacauaaauggccauugucuuu

SEQ ID NO: 257435 - RNA, 64 nt, Homo Sapiens
gacuguauaacuuucccagguucuguuuauggccacauuuaauaucuucagcucuuuuugugga

SEQ ID NO: 257436 - RNA, 64 nt, Homo Sapiens
ugcuuuauugcuuuuuuguauugguuaaaacuguacauuuaaaauugcuauguuacuauuuucu

SEQ ID NO: 257437 - RNA, 64 nt, Homo Sapiens
aagauacuaagaagguuuuuauacagcuuuuuggacauuuaacccugguuuaaaacuaaaaaua

SEQ ID NO: 257438 - RNA, 64 nt, Homo Sapiens
uggaaaggugggaagaauauugcuggugcuucuuacauuuaauaucucugucuuuaguauuuuu

SEQ ID NO: 257439 - RNA, 64 nt, Homo Sapiens
gcuaccuguaaagcuuauuaucauacagauuaguacauuuaacauaaaauacuauuuuucaaaa

SEQ ID NO: 257440 - RNA, 64 nt, Homo Sapiens
gaucaggagggaguaacagauucggacacuggaaacauuuaaaugcaguuuaguuguugcauuu

SEQ ID NO: 257441 - RNA, 64 nt, Homo Sapiens
cucugugccuugauaagaauauacagggauuuagacauuuaacugaguguauucucgugucaac

SEQ ID NO: 257442 - RNA, 64 nt, Homo Sapiens
auauauuuuuagcagucguauuaaaccaccagugacauuuaaaacuucacuuuggucauguuua

SEQ ID NO: 257443 - RNA, 64 nt, Homo Sapiens
cuucuuauagaauucuuuauucagugaauucuugacauuuaaauccguuaggcuuugaggcuuu

SEQ ID NO: 257444 - RNA, 64 nt, Homo Sapiens
gacuguauuuucauacuuuuuaaacuuuauugccacauuuaaaguugauuuuauaucaguaugu

SEQ ID NO: 257445 - RNA, 64 nt, Homo Sapiens
uucagagcucggcauugugaaugacaauaugugcacauuuaaaacucuaagucacuauaugaau

SEQ ID NO: 257446 - RNA, 64 nt, Homo Sapiens
uaucuccuguguuucauugcacauuuggaaaaacacauuuaauucugggaaccucgauauucug

SEQ ID NO: 257447 - RNA, 64 nt, Homo Sapiens
aggagagauugucuuaggauaaaccuccaagcucacauuuaauauaacagacugaaguaaacau

SEQ ID NO: 257448 - RNA, 64 nt, Homo Sapiens
ccuuuauuuuauguuuaggcuuauuuuuaaauuaacauuuaacagaaacauuugaaauagaauu

SEQ ID NO: 257449 - RNA, 64 nt, Homo Sapiens
auagguauguaggaauagucacucacuggcugauacauuuaaagcagcagugugaauagcaagg

SEQ ID NO: 257450 - RNA, 64 nt, Homo Sapiens
gaagaauacugagaacggcauaaagugaagaucgacauuuaaaaaaugaggugaaagaaagcua

SEQ ID NO: 257451 - RNA, 64 nt, Homo Sapiens
uuuuguuuuuucuucuucuucuucuuccuuaaagacauuuaagcuaaaggcaacucguacccaa

SEQ ID NO: 257452 - RNA, 64 nt, Homo Sapiens
cuuacaaaaagaaaaaaaaaauccuguuguauuaacauuuaaaaacagaauuguguuaugugau

SEQ ID NO: 257453 - RNA, 64 nt, Homo Sapiens
accacuacauuuuuuugcauacugauucuuucagacauuuaauauaacaaucucaaucauacau

SEQ ID NO: 257454 - RNA, 64 nt, Homo Sapiens
agaagcaucuaccacggcuuuuucuaaaaaaugcacauuuaaagucuuuugaagguuuggccag

SEQ ID NO: 257455 - RNA, 64 nt, Homo Sapiens
uggaaaugcagaaagcugugguuguaacauacauacauuuaaaaguaguaacuuaauauguaaa

SEQ ID NO: 257456 - RNA, 64 nt, Homo Sapiens
caccccaaugucucucuuuuccucaagauacuauacauuuaaagagggaaugaaacauuuaugg

SEQ ID NO: 257457 - RNA, 64 nt, Homo Sapiens
auaaugacauucugauuauaaauggcacagcauaacauuuaauuaaggucugauaaacugauga

SEQ ID NO: 257458 - RNA, 64 nt, Homo Sapiens
aacauucaauaaugauuacaguuaacaaaagaaaacauuuaauagaauguuuccuuuuacuuca

SEQ ID NO: 257459 - RNA, 64 nt, Homo Sapiens
uuauugugucucucucugauguacuguggauuguacauuuaacuuuggaauggcuuuguaauaa

SEQ ID NO: 257460 - RNA, 64 nt, Homo Sapiens
acaagcucugguugcuuauuuuuagaaaaugaggacauuuaauaauaauaaaaaaaaagggauu

SEQ ID NO: 257461 - RNA, 64 nt, Homo Sapiens
gccaaguaucugggggauugcugauuuagaaauaacauuuaaauacauaguugcuuccugguau

SEQ ID NO: 257462 - RNA, 64 nt, Homo Sapiens
augaucuuuacagaaaagaauuuauugaauuuagacauuuaaucucaaauuauuaaagagucua

SEQ ID NO: 257463 - RNA, 64 nt, Homo Sapiens
uuuguuaaaauuaaaaaauugcauuauaguaagaacauuuaaguguuuagaguaauauucuuuu

SEQ ID NO: 257464 - RNA, 64 nt, Homo Sapiens
caaaauaagucuauguaaauaguauauauuuaaaacauuuaaucagauauauuuuugcagaugc

SEQ ID NO: 257465 - RNA, 64 nt, Homo Sapiens
uuucguuucccuuuccccaaaaguagcguaaccaacauuuaagcuugcuuaaaaacgaaaacca

SEQ ID NO: 257466 - RNA, 64 nt, Homo Sapiens
guuuccugacgguguacagaaucaacaaaauaaaacauuuaaagucugauuuuuuacauuuuuu

SEQ ID NO: 257467 - RNA, 64 nt, Homo Sapiens
augucauuucaugagucaaauucuugguaaaauuacauuuaaggauacaguccuaguguuugcc

SEQ ID NO: 257468 - RNA, 64 nt, Homo Sapiens
aagcaaaaagugaaaaaaaaguuuguggaggauuacauuuaaaauuauaauauaaauuaccauu

SEQ ID NO: 257469 - RNA, 64 nt, Homo Sapiens; identical to SEQ ID NO: 215446

SEQ ID NO: 257470 - RNA, 64 nt, Homo Sapiens; identical to SEQ ID NO: 215447

SEQ ID NO: 257471 - RNA, 64 nt, Homo Sapiens; identical to SEQ ID NO: 215448

SEQ ID NO: 257472 - RNA, 64 nt, Homo Sapiens; identical to SEQ ID NO: 215449

SEQ ID NO: 257473 - RNA, 64 nt, Homo Sapiens; identical to SEQ ID NO: 215450

SEQ ID NO: 257474 - RNA, 64 nt, Homo Sapiens; identical to SEQ ID NO: 215451

SEQ ID NO: 257475 - RNA, 64 nt, Homo Sapiens; identical to SEQ ID NO: 215452

SEQ ID NO: 257476 - RNA, 64 nt, Homo Sapiens; identical to SEQ ID NO: 215453

SEQ ID NO: 257477 - RNA, 64 nt, Homo Sapiens; identical to SEQ ID NO: 215454

SEQ ID NO: 257478 - RNA, 64 nt, Homo Sapiens; identical to SEQ ID NO: 215455

SEQ ID NO: 257479 - RNA, 64 nt, Homo Sapiens; identical to SEQ ID NO: 215456

SEQ ID NO: 257480 - RNA, 64 nt, Homo Sapiens; identical to SEQ ID NO: 215457

SEQ ID NO: 257481 - RNA, 59 nt, Homo Sapiens
ccuaauacccaguuuaagacaccaaauauaacaaguauaauuacauccuccaauguacc

SEQ ID NO: 257482 - RNA, 59 nt, Homo Sapiens
gguuuaaaggauaugaaacucuacauuuaaacaaguauuuuauauuuggguacagagga

SEQ ID NO: 257483 - RNA, 59 nt, Homo Sapiens
uuaugucauaagcucuauuauguuauucuaacaaguagcaauuucacaaaauuuguaug

SEQ ID NO: 257484 - RNA, 59 nt, Homo Sapiens
acaaaaugugcuagccacuggggacgcaaaacaaguaagaucccuguugcaagaaauuc

SEQ ID NO: 257485 - RNA, 59 nt, Homo Sapiens
uuaucaaucucuuuugauacaacauuuaaaacaaguagcuucaagaaaccacugguguu

SEQ ID NO: 257486 - RNA, 59 nt, Homo Sapiens
cauuguaaguuccuaaaaacauuuuauuaaacaaguagacauuuuguuauuaaaaaaau

SEQ ID NO: 257487 - RNA, 59 nt, Homo Sapiens
augugaugaaaacauuucaucauacagaaaacaaguacuuugcucaaaaguucugaauu

SEQ ID NO: 257488 - RNA, 59 nt, Homo Sapiens
auggggcauguugugucauguuuguaugcaacaaguagauccucacauuccucuucuac

SEQ ID NO: 257489 - RNA, 64 nt, Homo Sapiens
uucaaaaccagaggaaggagguucuuagccguuacucagauaccagugcuggggagggaggccu

SEQ ID NO: 257490 - RNA, 64 nt, Homo Sapiens
gaaaaaagacgacuaauuuccaaacccguuuguucucagauaaaaagcaguuuuauaaacccgc

SEQ ID NO: 257491 - RNA, 64 nt, Homo Sapiens
agugagaggauagauuuagaaaacaucagugaugcucagauaaacuuuuaggaccucauauuaa

SEQ ID NO: 257492 - RNA, 64 nt, Homo Sapiens
caaauaaauuucuguuuauuauaaauaacccagucucagauauucuguuacagaaacacaaaau

SEQ ID NO: 257493 - RNA, 64 nt, Homo Sapiens
uuauauccaaaauuuguguuccuacagcuuuguacucagauaaugaagugaaagauaagaauua

SEQ ID NO: 257494 - RNA, 64 nt, Homo Sapiens
aauauuuucauacguucuauacaaugagggagaacucagauaaagcaaacuaagcugccucuca

SEQ ID NO: 257495 - RNA, 64 nt, Homo Sapiens
aaaaaaagacaggcugccacauguaccuuuuuugguaguggaaauguucucuuaaaagguauca

SEQ ID NO: 257496 - RNA, 64 nt, Homo Sapiens
uucuaugccuuggauacacauccauuuaaaaaugguaguggaaaugguguuacaagacuuguua

SEQ ID NO: 257497 - RNA, 64 nt, Homo Sapiens
guuucacuaaguaaaacucuuugacuuuucauaaguaguggaagggaugaguuauacaugauau

SEQ ID NO: 257498 - RNA, 64 nt, Homo Sapiens
guuucacuaaguaaagaucuuugacuuuucauaaguaguggaagagaugaguuauaaaugguau

SEQ ID NO: 257499 - RNA, 64 nt, Homo Sapiens
ugcucacauuaacaaauuaagccuccccgaccccccaagcuauuaaaagauuuucuguccagaa

SEQ ID NO: 257500 - RNA, 64 nt, Homo Sapiens
ugucucauccauguguugauuuaacaaucuguaaccaagcuaaccgccacagacuccuguacua

SEQ ID NO: 257501 - RNA, 64 nt, Homo Sapiens
gagggcagaguccccaucaccaagaugaccaugcccaagcuagggaauuuggcuucaagaugcc

SEQ ID NO: 257502 - RNA, 64 nt, Homo Sapiens
uccacccucugccccuuccugucuugucacuaacccaagcuaaugugggccagccuugcccucu

SEQ ID NO: 257503 - RNA, 64 nt, Homo Sapiens; identical to SEQ ID NO: 84132

SEQ ID NO: 257504 - RNA, 64 nt, Homo Sapiens; identical to SEQ ID NO: 84133

SEQ ID NO: 257505 - RNA, 64 nt, Homo Sapiens; identical to SEQ ID NO: 84134

SEQ ID NO: 257506 - RNA, 64 nt, Homo Sapiens; identical to SEQ ID NO: 84135

SEQ ID NO: 257507 - RNA, 64 nt, Homo Sapiens; identical to SEQ ID NO: 84136

SEQ ID NO: 257508 - RNA, 64 nt, Homo Sapiens; identical to SEQ ID NO: 84137

SEQ ID NO: 257509 - RNA, 64 nt, Homo Sapiens; identical to SEQ ID NO: 84138

SEQ ID NO: 257510 - RNA, 64 nt, Homo Sapiens; identical to SEQ ID NO: 84139

SEQ ID NO: 257511 - RNA, 64 nt, Homo Sapiens; identical to SEQ ID NO: 84140

SEQ ID NO: 257512 - RNA, 64 nt, Homo Sapiens; identical to SEQ ID NO: 84141

SEQ ID NO: 257513 - RNA, 64 nt, Homo Sapiens; identical to SEQ ID NO: 84142

SEQ ID NO: 257514 - RNA, 64 nt, Homo Sapiens; identical to SEQ ID NO: 84143

SEQ ID NO: 257515 - RNA, 64 nt, Homo Sapiens; identical to SEQ ID NO: 84144

SEQ ID NO: 257516 - RNA, 64 nt, Homo Sapiens; identical to SEQ ID NO: 84145

SEQ ID NO: 257517 - RNA, 64 nt, Homo Sapiens; identical to SEQ ID NO: 84146

SEQ ID NO: 257518 - RNA, 64 nt, Homo Sapiens; identical to SEQ ID NO: 84147

SEQ ID NO: 257519 - RNA, 64 nt, Homo Sapiens; identical to SEQ ID NO: 84148

SEQ ID NO: 257520 - RNA, 64 nt, Homo Sapiens; identical to SEQ ID NO: 84149

SEQ ID NO: 257521 - RNA, 64 nt, Homo Sapiens
uuuuuaaagaaaugguagaaaauuugauaaucugaaucaccagcauucaaacaaauauuucggc

SEQ ID NO: 257522 - RNA, 64 nt, Homo Sapiens
guuuuuagaaaaauauuuauauuguuggugcucaaaucaccaauuucuagcuagaucauuuugc

SEQ ID NO: 257523 - RNA, 64 nt, Homo Sapiens
cugagacuucucuuugauuucauuagagaccugcaaucaccaaggacagagacagagaaauaag

SEQ ID NO: 257524 - RNA, 64 nt, Homo Sapiens
uguuuuccuuugagcagucucagccuguucuaucaaucaccagcucuggggcccaacaaugcca

SEQ ID NO: 257525 - RNA, 64 nt, Homo Sapiens
cgcuuaugauuucaauagucaaauauaaccuuuucaagauaaauauauacuugcauccaccuac

SEQ ID NO: 257526 - RNA, 64 nt, Homo Sapiens
agcuguaauucggacaaacauaaucuuaaaguugcaagauaaacgaguuacauuugcauuuaau

SEQ ID NO: 257527 - RNA, 64 nt, Homo Sapiens
uauauugauaaaaagugacugcauuuuugcaaaacaagauaacauuuggaaaccuuuuaaaaau

SEQ ID NO: 257528 - RNA, 64 nt, Homo Sapiens
aaugaaaaaucaaucuuucuugcagcauguaucacaagauaagagagauagugguguuuacugc

SEQ ID NO: 257529 - RNA, 64 nt, Homo Sapiens
uguuauuaauaaaaauagaagaacucugguuaaacaagauaauauauucaauagcucagagguu

SEQ ID NO: 257530 - RNA, 64 nt, Homo Sapiens
aacagcuguuaauauuuuuuuuguguauuaagcacaagauaaagagaagcaaauuuauaccuau

SEQ ID NO: 257531 - RNA, 64 nt, Homo Sapiens
auuuggugucuguaaguaucaaccauuucuugaucaagauaaggaagcaacacugauacugaga

SEQ ID NO: 257532 - RNA, 64 nt, Homo Sapiens
cagaaaguacuguguagcccaggaguuuauuuagcaagauaaauagugguaauuucuuaaucau

SEQ ID NO: 257533 - RNA, 64 nt, Homo Sapiens
uaaaguuauuauaacagugaacuucuguaaaaugcaagauaaauuuuuuuaaaaucguucauag

SEQ ID NO: 257534 - RNA, 64 nt, Homo Sapiens
aagcugccaagauuuuuggccguuguauuaaaaacaagauaaaaugccaucagaguggauauac

SEQ ID NO: 257535 - RNA, 64 nt, Homo Sapiens
aaagacacuugauacuuguuuucaaaccaguauacaagauaagcuuccaggcugcauagaagga

SEQ ID NO: 257536 - RNA, 64 nt, Homo Sapiens
ggaggagagggaaaauguuuuguaagaaaccaaucaagauaaaggacagugaaguaauccguac

SEQ ID NO: 257537 - RNA, 64 nt, Homo Sapiens
agcauucccgccgccuccagccucuccccucuggcaggcgcacccaggagauggaauccccugc

SEQ ID NO: 257538 - RNA, 64 nt, Homo Sapiens
ucucuugccucagccucccaaguagcugggaugacaggcgcacaccaccacgcccagcaaauuu

SEQ ID NO: 257539 - RNA, 64 nt, Homo Sapiens
ucuugugccucggccucccuaguagcugggauuacaggcgcacaccaccacacacagcuaauuu

SEQ ID NO: 257540 - RNA, 64 nt, Homo Sapiens
cccucggcucaccuaagugcccugugcugguugccaggcgcagaggggaggccagcccugcccu

SEQ ID NO: 257541 - RNA, 64 nt, Homo Sapiens
cugauaucaaaacauuccaauaacuuuuuuuuuucaggcgcagucucacucugucgcccgggcu

SEQ ID NO: 257542 - RNA, 64 nt, Homo Sapiens
aaaugacucagaauggauuaacaugaaaguuauccaggcgcagaguugaagaagcauaagcaag

SEQ ID NO: 257543 - RNA, 64 nt, Homo Sapiens
ugcaggcacagggccacugucgccagugugggugcaggcgcaggggacugaggacagguguggg

SEQ ID NO: 257544 - RNA, 64 nt, Homo Sapiens
ggcucacgccuguaaucccauggcagugauuggccaggcgcaguguucucuguucaaaaguaau

SEQ ID NO: 257545 - RNA, 64 nt, Homo Sapiens
cuugauaaaugguuaauucauuuucuacucuuuucaggcgcacuuuugaugggcuccuuuauuu

SEQ ID NO: 257546 - RNA, 64 nt, Homo Sapiens
ggcucacgccuguaaucccacuagagauuggggccaggcgcagugaaaagaaggguaguaaaaa

SEQ ID NO: 257547 - RNA, 64 nt, Homo Sapiens
acagagcguuacuugauaaccugugcaguggcugcaggcgcagacuucccaagaauuuagcuug

SEQ ID NO: 257548 - RNA, 64 nt, Homo Sapiens
auuggaagcugucauaaaaagacaacucagaggccaggcgcaggggcucacaccuguaauccua

SEQ ID NO: 257549 - RNA, 64 nt, Homo Sapiens
cuugcacaaaaagcacaagcauuccuuagcagcucaggcgcagcccuagugggagcccagcaca

SEQ ID NO: 257550 - RNA, 64 nt, Homo Sapiens
ggccccagcagcagguccuggugcuggcggagcccaggcgcaagccaucuaccuucuggcacag

SEQ ID NO: 257551 - RNA, 64 nt, Homo Sapiens
aaugcagcgaguccucugggugguuaugagccuccaggcgcaugcuguccaguggacagaacau

SEQ ID NO: 257552 - RNA, 64 nt, Homo Sapiens
ugggacagggagggccggcggcucugagcaggggcaggcgcagaggucccagccccaggccugg

SEQ ID NO: 257553 - RNA, 64 nt, Homo Sapiens
agguccagggaggcccuuuuugaggggaggaaggcaggcgcacggccuggggacacuggcccca

SEQ ID NO: 257554 - RNA, 64 nt, Homo Sapiens
gcugcuuugugggcuccaggccuguacucaucggcaggcgcaugaguaucugugggaguccucu

SEQ ID NO: 257555 - RNA, 64 nt, Homo Sapiens
uuaaaaaaggacauagaaaauguuuugaauaggccaggcgcaguggcucacaccuguaauccca

SEQ ID NO: 257556 - RNA, 64 nt, Homo Sapiens
gccccagacagcuucccagcucauggcagcucaucaggcgcaggagugugagaggcggccacuu

SEQ ID NO: 257557 - RNA, 64 nt, Homo Sapiens
gggcuggaggcaggccuucgugggggcugggccccaggcgcacggagccucgaacccgcguccc

SEQ ID NO: 257558 - RNA, 64 nt, Homo Sapiens
ggcucaaaucccagcacuucuuuuauuuuccagccaggcgcaguacagauaggcagugaaagag

SEQ ID NO: 257559 - RNA, 64 nt, Homo Sapiens
uugguuucuuggucguccuuuuggcagggcucagcaggcgcacgcggcucucagagcauaaucc

SEQ ID NO: 257560 - RNA, 64 nt, Homo Sapiens
gcugccuggacacacacuuccagacacacgugcacaggcgcagauaugcugccuggacacacgc

SEQ ID NO: 257561 - RNA, 64 nt, Homo Sapiens
gggugguccaguucuagagugggagaaagggagucaggcgcauugggaaucgugguuccagucu

SEQ ID NO: 257562 - RNA, 64 nt, Homo Sapiens
ccuccugccucagccuccugagcagcugggacuacaggcgcaugccaccaugcccagcuaauuu

SEQ ID NO: 257563 - RNA, 64 nt, Homo Sapiens
uacucugcaacucuuaaaaauaaauguaaugugccaggcgcaaugggauaugccugcaggccca

SEQ ID NO: 257564 - RNA, 64 nt, Homo Sapiens
cgugggcaucacguaagcagcacacuaggaggcccaggcgcaggcaaagagaagauggugcugu

SEQ ID NO: 257565 - RNA, 64 nt, Homo Sapiens
gccucccccuaacaauccuagacugagacgcagucaggcgcacgcccgcaagaggcggcgaggu

SEQ ID NO: 257566 - RNA, 64 nt, Homo Sapiens
cccacaagcuugucagaucgcccaggugacgggccaggcgcagccaucgggaaggucauucagc

SEQ ID NO: 257567 - RNA, 64 nt, Homo Sapiens
gaauaaguaaccaucaaaguuacuaaaacauggccaggcgcaguggcucaugccuguaauccca

SEQ ID NO: 257568 - RNA, 64 nt, Homo Sapiens
ccaccacgcacggcugauuuaguagcugggauuacaggcgcacggauucuccugcagccucccg

SEQ ID NO: 257569 - RNA, 64 nt, Homo Sapiens
agggagacaacggguggcugcauccagccagagacaggcgcagguggguguccucagcgugcga

SEQ ID NO: 257570 - RNA, 64 nt, Homo Sapiens
uaagauuaaguauuaaaaaaaaaccaggcucugccaggcgcaguggcucaugccuauaaucccg

SEQ ID NO: 257571 - RNA, 64 nt, Homo Sapiens
ucccaggcucaagccucccgaauagcugggacuacaggcgcacaccaccauccccggcuaauuu

SEQ ID NO: 257572 - RNA, 64 nt, Homo Sapiens
gauucuccugccucagccucuuuagcugggacuacaggcgcacgccaccacgcccggcuaauuu

SEQ ID NO: 257573 - RNA, 64 nt, Homo Sapiens
ccgaauaagauccgaauaagaauauguaauggaccaggcgcagugccucacgccugucauccca

SEQ ID NO: 257574 - RNA, 64 nt, Homo Sapiens
ccguggacuggcccaggaggacgcccaguguguacaggcgcaccucaugcccuuguauccgcac

SEQ ID NO: 257575 - RNA, 64 nt, Homo Sapiens
accuuaaucagcaguaaauucuucucuacucggccaggcgcaguggcucaugccuguaauccca

SEQ ID NO: 257576 - RNA, 64 nt, Homo Sapiens
agcucugcuaggacuuaccccagccacugaguggcaggcgcaugagauuuguggcuguuccuga

SEQ ID NO: 257577 - RNA, 64 nt, Homo Sapiens
uccccugccucagccucgcgaguagcuaggacuacaggcgcaugucaccaagcccggcuaauuu

SEQ ID NO: 257578 - RNA, 64 nt, Homo Sapiens
ggcucacgccuguaauuccagaaaccagucucaccaggcgcaguuugcuugaggucgggaguuu

SEQ ID NO: 257579 - RNA, 64 nt, Homo Sapiens
ggcucacaccuguaaucccacuccaagucuuggccaggcgcagucaacauacucuaaagaauaa

SEQ ID NO: 257580 - RNA, 64 nt, Homo Sapiens
gcuugcuuggcccgguccccuccgugccaguucccaggcgcacucuacuccagcccuucucccu

SEQ ID NO: 257581 - RNA, 64 nt, Homo Sapiens
cuccaccccgcaagcaccauccccuccggcuaagcaggcgcaagggaggcccagcgcggacauc

SEQ ID NO: 257582 - RNA, 64 nt, Homo Sapiens
acccaggagccucgggucugaucaagggagaggccaggcgcagcucacugcggcggcucccuaa

SEQ ID NO: 257583 - RNA, 64 nt, Homo Sapiens
aggaaggcagagugugacagagcagagccagggccaggcgcaccaggagaggcguuucuggggc

SEQ ID NO: 257584 - RNA, 64 nt, Homo Sapiens
gccugugcggaagaaacgccgugccacuuccuagcaggcgcaagggugcccugagcaggaagau

SEQ ID NO: 257585 - RNA, 64 nt, Homo Sapiens
agggacccggggccacaaggugugacggggaguccaggcgcaggggcccggcaagcacagccac

SEQ ID NO: 257586 - RNA, 64 nt, Homo Sapiens
ccaccaugcccggcuaauuuaguagcugggauuacaggcgcaggaauucugacucagccuccca

SEQ ID NO: 257587 - RNA, 64 nt, Homo Sapiens
aucagaauuaaaggucgcacgggaugaucaugagcaggcgcaaaugcauugauucccaguucca

SEQ ID NO: 257588 - RNA, 64 nt, Homo Sapiens
cugacagccuccugcugcccuacccuggcaggcacaggcgcagcuggcuggggggcccacucca

SEQ ID NO: 257589 - RNA, 64 nt, Homo Sapiens
gucucugaucagagccgacaccagacgugauuagcaggcgcagcaaauucaauuuguuaaauga

SEQ ID NO: 257590 - RNA, 64 nt, Homo Sapiens
cagccccuucagucugcguucccaguucauuuugcaggcgcauucgcccuuccuaguuugcagc

SEQ ID NO: 257591 - RNA, 64 nt, Homo Sapiens
ggcucaugccuguaaucccaguaaagaaagaggccaggcgcaauucucaaaucauggauuagga

SEQ ID NO: 257592 - RNA, 64 nt, Homo Sapiens
accguagaucucaggccucuugcaggugcuguagcaggcgcaagcugucugcucaguagaaccu

SEQ ID NO: 257593 - RNA, 64 nt, Homo Sapiens
ggguagaaccaaaugauagggauucgaggacuuccaggcgcauaccuacccaugcagggacugg

SEQ ID NO: 257594 - RNA, 64 nt, Homo Sapiens
ggcucacaccuguaauccuauuacuuaaauaggccaggcgcaguauccauggucucuagauggu

SEQ ID NO: 257595 - RNA, 64 nt, Homo Sapiens
cugccaccuccccauccacugccaggugugggcccaggcgcagcggaucuccaaguguccuggu

SEQ ID NO: 257596 - RNA, 64 nt, Homo Sapiens
cccaccuuagaccgaaggggaaaacccgcucucucaggcgcaugugccaguuggggccccgcgg

SEQ ID NO: 257597 - RNA, 64 nt, Homo Sapiens
uuuggugaguucucuugggaaucaucugccucuucaggcgcauuuugcaauaaagucugucuag

SEQ ID NO: 257598 - RNA, 64 nt, Homo Sapiens
ugugaggcccucccggggcgccuccccucacccccaggcgcacgucuggccccgccucuggcug

SEQ ID NO: 257599 - RNA, 64 nt, Homo Sapiens
cccaccagaagccaucucccccgcuguguguccccaggcgcaucauugcuccacucuccccugc

SEQ ID NO: 257600 - RNA, 64 nt, Homo Sapiens
uccuccauuuuccucccgcacagacaguuucugacaggcgcaacauauucuuccccgaaucaca

SEQ ID NO: 257601 - RNA, 64 nt, Homo Sapiens
uugucguguuuccaaaccagugcuucuguaaaugcaggcgcaguggacguucuucugugugcau

SEQ ID NO: 257602 - RNA, 64 nt, Homo Sapiens
ugccugcaccugcugccuuaacaguggaguuggccaggcgcaguggcucacaccuguaauccca

SEQ ID NO: 257603 - RNA, 64 nt, Homo Sapiens
acacuguuuccuggccccagagcucauuuggguucaggcgcacuucaaaacccucccuggggga

SEQ ID NO: 257604 - RNA, 64 nt, Homo Sapiens
gcucucccuccucuccccuuacucaggacagggccaggcgcaggaucaccaugggaaucuuugg

SEQ ID NO: 257605 - RNA, 64 nt, Homo Sapiens
uggcucauggggcagaauuguggcccaugcagaccaggcgcacgcaccaggaaaucccgcgggg

SEQ ID NO: 257606 - RNA, 64 nt, Homo Sapiens
aagccaaaaaggauggcuaaaugcuccugggagucaggcgcagccucacaccagcugccuccuc

SEQ ID NO: 257607 - RNA, 64 nt, Homo Sapiens
gugugauugagguuaugcuggcaccacucgcacacaggcgcacaaugguguuagcugggcagaa

SEQ ID NO: 257608 - RNA, 64 nt, Homo Sapiens
gccccccucccaugggcuggucagcucugggaggcaggcgcagucccacccucucccucucccu

SEQ ID NO: 257609 - RNA, 64 nt, Homo Sapiens
gaggaauaggagggacauggcuccggaucccauccaggcgcaaacagcagccaagccuagagcc

SEQ ID NO: 257610 - RNA, 64 nt, Homo Sapiens
aucucugaagcuuggaaagcgaucugcuccucgucaggcgcagcuaaugaagaauggaaguuug

SEQ ID NO: 257611 - RNA, 64 nt, Homo Sapiens
ccacccagcccagcuucuuuaagugcugggauuacaggcgcaagccaccugcuucggccuccca

SEQ ID NO: 257612 - RNA, 64 nt, Homo Sapiens
ggcucacgcuuguaaucccaugucugcuuuuggccaggcgcagucugggaggugguuccaaggg

SEQ ID NO: 257613 - RNA, 64 nt, Homo Sapiens
aaauccuccucucagccugacagccuugaccucccaggcgcacaggugccaucaugacucacug

SEQ ID NO: 257614 - RNA, 64 nt, Homo Sapiens
cagagucucgugugugccgauguuccacacccagcaggcgcaacaggcauggcgauggugcgcc

SEQ ID NO: 257615 - RNA, 64 nt, Homo Sapiens
uucugggaggcugggcccuggaggcaacgugcugcaggcgcacucugucagagugaacagcacc

SEQ ID NO: 257616 - RNA, 64 nt, Homo Sapiens
ucuccugccucagccucuugaguagcugggacuacaggcgcacaccaccacgccaggcuaauuu

SEQ ID NO: 257617 - RNA, 64 nt, Homo Sapiens
uucuccagcuuuguagcagcagccuugacaaacccaggcgcacuguaccaaggcaauguaacuu

SEQ ID NO: 257618 - RNA, 64 nt, Homo Sapiens
uuuuaacugcuucagacaccuagaucccagaacucaggcgcauaugcauauuuucccugcaaga

SEQ ID NO: 257619 - RNA, 64 nt, Homo Sapiens
aaaccccauagcuuuaagaaguaccugcaagggucaggcgcaguggcucacaccuguaauccca

SEQ ID NO: 257620 - RNA, 64 nt, Homo Sapiens
cugcuucccgcuguuggccaccaucaucaggcaccaggcgcaaauccaucugucacgugguuca

SEQ ID NO: 257621 - RNA, 64 nt, Homo Sapiens
ggcucaugucuguaaucccacaaaaaaaauuagccaggcgcauuucuacuaaaaauacaaaaac

SEQ ID NO: 257622 - RNA, 64 nt, Homo Sapiens
ccucccgccucagccuccugagcagcugggauuacaggcgcacaucaccaugcccaaccuccaa

SEQ ID NO: 257623 - RNA, 64 nt, Homo Sapiens
ucuugugccucagccuccuaagcagcugggacuacaggcgcaugcaaccauacccagcuaauuu

SEQ ID NO: 257624 - RNA, 64 nt, Homo Sapiens
ucuccugccucagccuccugaguagcugggauuacaggcgcacgccaccacgccuggcuaauuu

SEQ ID NO: 257625 - RNA, 64 nt, Homo Sapiens
acgugggcggcuuccucaagcccggaggagcucccaggcgcacaggggccgccgguaacagggg

SEQ ID NO: 257626 - RNA, 64 nt, Homo Sapiens
cucggcucacugcaaccucuuugcucuuauugcccaggcgcaauuuuuuuugugagacggaguu

SEQ ID NO: 257627 - RNA, 64 nt, Homo Sapiens
ccaccacgcccaacugauuuaguagcugagauuacaggcgcacagcuucugccucagcuuccca

SEQ ID NO: 257628 - RNA, 64 nt, Homo Sapiens
ucugcaccuccgcuugccagccccgcacccccgccaggcgcaugccccgcgcgccgguccggcg

SEQ ID NO: 257629 - RNA, 64 nt, Homo Sapiens
gggcagccccuagguuagaguggagacggaggcccaggcgcaggggucacaccucaucugguuu

SEQ ID NO: 257630 - RNA, 64 nt, Homo Sapiens
acucgggggccuccauccgauggcaggugguggacaggcgcaucccacucuaugcgaaccacaa

SEQ ID NO: 257631 - RNA, 64 nt, Homo Sapiens
ccuggcaacacgguccccagacgcccauguccagcaggcgcaggacagcccagcagggcuggag

SEQ ID NO: 257632 - RNA, 64 nt, Homo Sapiens
gagugaugggcagguucggcagccuaacauuguucaggcgcauggccccugcgguguguacacg

SEQ ID NO: 257633 - RNA, 64 nt, Homo Sapiens
aucuucuccccaccaccgccccggugugcguacccaggcgcacgugcugcagcccccggaggcc

SEQ ID NO: 257634 - RNA, 64 nt, Homo Sapiens
guacacacuuucacucuauuguaaccacacagggcaggcgcauccagcaugucaguguccugcc

SEQ ID NO: 257635 - RNA, 64 nt, Homo Sapiens
ccugcccaccgcucugucuccuggccgucugcuccaggcgcagcuggggcugaggaugucucaa

SEQ ID NO: 257636 - RNA, 64 nt, Homo Sapiens
caccacacccagcuaguuuuaguagcuaggacuacaggcgcagccuccgccucagccuuuggag

SEQ ID NO: 257637 - RNA, 64 nt, Homo Sapiens
aguagagcugucaagaugggcagggcagcacuaacaggcgcaaacagcucuuccugucagggau

SEQ ID NO: 257638 - RNA, 64 nt, Homo Sapiens
gaacauggugguuugcacuuggguucugguggcgcaggcgcaggagcagccagcuguggcagcg

SEQ ID NO: 257639 - RNA, 64 nt, Homo Sapiens
gacuuacgccuguaaucucaaaggacucccuggccaggcgcaguaaaaauaggcucaguuagaa

SEQ ID NO: 257640 - RNA, 64 nt, Homo Sapiens
uauuaguuucucuccacucuaacgagugccugaacugcaugauuuucaaacaugccauaaggaa

SEQ ID NO: 257641 - RNA, 64 nt, Homo Sapiens
aucuaggagagaauucauaaagccuuguuccuuucugcaugagaucaagugugguaauauggca

SEQ ID NO: 257642 - RNA, 64 nt, Homo Sapiens
ccacagaccgucucagacacgcacagugggccugcugcaugauucacacccagucccugccaca

SEQ ID NO: 257643 - RNA, 64 nt, Homo Sapiens; identical to SEQ ID NO: 257642

SEQ ID NO: 257644 - RNA, 64 nt, Homo Sapiens
ucagcucaccgcaaccucugaggcuggagugcagcugcaugauugaguuucauucuuguuaccc

SEQ ID NO: 257645 - RNA, 64 nt, Homo Sapiens
uuagccauggguccuuucugcaagugugacuccccugcaugaugcuucgucuaugaaaaguugc

SEQ ID NO: 257646 - RNA, 64 nt, Homo Sapiens
uucauagacuuugauuuuauuuauaagccacuugcugcaugacccuccaaguagaccuguggcu

SEQ ID NO: 257647 - RNA, 64 nt, Homo Sapiens
auacucaaacacuuuuggaccaggauuugagucucugcaugacauauacuugauuaaaagguua

SEQ ID NO: 257648 - RNA, 64 nt, Homo Sapiens; identical to SEQ ID NO: 97683

SEQ ID NO: 257649 - RNA, 64 nt, Homo Sapiens; identical to SEQ ID NO: 97684

SEQ ID NO: 257650 - RNA, 64 nt, Homo Sapiens; identical to SEQ ID NO: 97685

SEQ ID NO: 257651 - RNA, 64 nt, Homo Sapiens; identical to SEQ ID NO: 97686

SEQ ID NO: 257652 - RNA, 64 nt, Homo Sapiens; identical to SEQ ID NO: 97687

SEQ ID NO: 257653 - RNA, 64 nt, Homo Sapiens; identical to SEQ ID NO: 97688

SEQ ID NO: 257654 - RNA, 64 nt, Homo Sapiens; identical to SEQ ID NO: 97689

SEQ ID NO: 257655 - RNA, 64 nt, Homo Sapiens; identical to SEQ ID NO: 97690

SEQ ID NO: 257656 - RNA, 64 nt, Homo Sapiens; identical to SEQ ID NO: 97691

SEQ ID NO: 257657 - RNA, 64 nt, Homo Sapiens; identical to SEQ ID NO: 97692

SEQ ID NO: 257658 - RNA, 56 nt, Homo Sapiens; identical to SEQ ID NO: 97693

SEQ ID NO: 257659 - RNA, 64 nt, Homo Sapiens; identical to SEQ ID NO: 97694

SEQ ID NO: 257660 - RNA, 64 nt, Homo Sapiens; identical to SEQ ID NO: 97695

SEQ ID NO: 257661 - RNA, 64 nt, Homo Sapiens; identical to SEQ ID NO: 97696

SEQ ID NO: 257662 - RNA, 64 nt, Homo Sapiens; identical to SEQ ID NO: 97697

SEQ ID NO: 257663 - RNA, 64 nt, Homo Sapiens; identical to SEQ ID NO: 97698

SEQ ID NO: 257664 - RNA, 64 nt, Homo Sapiens; identical to SEQ ID NO: 97699

SEQ ID NO: 257665 - RNA, 64 nt, Homo Sapiens; identical to SEQ ID NO: 97700

SEQ ID NO: 257666 - RNA, 64 nt, Homo Sapiens; identical to SEQ ID NO: 97701

SEQ ID NO: 257667 - RNA, 64 nt, Homo Sapiens; identical to SEQ ID NO: 97702

SEQ ID NO: 257668 - RNA, 64 nt, Homo Sapiens; identical to SEQ ID NO: 97703

SEQ ID NO: 257669 - RNA, 64 nt, Homo Sapiens; identical to SEQ ID NO: 97704

SEQ ID NO: 257670 - RNA, 64 nt, Homo Sapiens; identical to SEQ ID NO: 97705

SEQ ID NO: 257671 - RNA, 64 nt, Homo Sapiens; identical to SEQ ID NO: 97706

SEQ ID NO: 257672 - RNA, 64 nt, Homo Sapiens; identical to SEQ ID NO: 97707

SEQ ID NO: 257673 - RNA, 64 nt, Homo Sapiens; identical to SEQ ID NO: 97708

SEQ ID NO: 257674 - RNA, 64 nt, Homo Sapiens; identical to SEQ ID NO: 97709

SEQ ID NO: 257675 - RNA, 64 nt, Homo Sapiens; identical to SEQ ID NO: 97710

SEQ ID NO: 257676 - RNA, 64 nt, Homo Sapiens; identical to SEQ ID NO: 97711

SEQ ID NO: 257677 - RNA, 64 nt, Homo Sapiens; identical to SEQ ID NO: 97712

SEQ ID NO: 257678 - RNA, 64 nt, Homo Sapiens; identical to SEQ ID NO: 97713

SEQ ID NO: 257679 - RNA, 64 nt, Homo Sapiens; identical to SEQ ID NO: 97714

SEQ ID NO: 257680 - RNA, 64 nt, Homo Sapiens; identical to SEQ ID NO: 97715

SEQ ID NO: 257681 - RNA, 64 nt, Homo Sapiens; identical to SEQ ID NO: 97716

SEQ ID NO: 257682 - RNA, 64 nt, Homo Sapiens; identical to SEQ ID NO: 97717

SEQ ID NO: 257683 - RNA, 64 nt, Homo Sapiens; identical to SEQ ID NO: 97718

SEQ ID NO: 257684 - RNA, 64 nt, Homo Sapiens; identical to SEQ ID NO: 97719

SEQ ID NO: 257685 - RNA, 64 nt, Homo Sapiens; identical to SEQ ID NO: 97720

SEQ ID NO: 257686 - RNA, 64 nt, Homo Sapiens; identical to SEQ ID NO: 97721

SEQ ID NO: 257687 - RNA, 64 nt, Homo Sapiens; identical to SEQ ID NO: 97722

SEQ ID NO: 257688 - RNA, 64 nt, Homo Sapiens; identical to SEQ ID NO: 97723

SEQ ID NO: 257689 - RNA, 64 nt, Homo Sapiens; identical to SEQ ID NO: 97724

SEQ ID NO: 257690 - RNA, 64 nt, Homo Sapiens; identical to SEQ ID NO: 97725

SEQ ID NO: 257691 - RNA, 64 nt, Homo Sapiens; identical to SEQ ID NO: 97726

SEQ ID NO: 257692 - RNA, 64 nt, Homo Sapiens; identical to SEQ ID NO: 97727

SEQ ID NO: 257693 - RNA, 64 nt, Homo Sapiens; identical to SEQ ID NO: 97728

SEQ ID NO: 257694 - RNA, 64 nt, Homo Sapiens; identical to SEQ ID NO: 97729

SEQ ID NO: 257695 - RNA, 64 nt, Homo Sapiens; identical to SEQ ID NO: 97730

SEQ ID NO: 257696 - RNA, 64 nt, Homo Sapiens; identical to SEQ ID NO: 97731

SEQ ID NO: 257697 - RNA, 64 nt, Homo Sapiens; identical to SEQ ID NO: 97732

SEQ ID NO: 257698 - RNA, 64 nt, Homo Sapiens; identical to SEQ ID NO: 97733

SEQ ID NO: 257699 - RNA, 64 nt, Homo Sapiens; identical to SEQ ID NO: 97734

SEQ ID NO: 257700 - RNA, 64 nt, Homo Sapiens
auauaaaaccacaaagaauguacugaaccuacuaacccuuuaacauacaguuuaggguccuagc

SEQ ID NO: 257701 - RNA, 64 nt, Homo Sapiens
agacacagugguuauggaagcauuucuuuacaguacccuuuacauguuugguuucugaacuuaa

SEQ ID NO: 257702 - RNA, 64 nt, Homo Sapiens
uauguuucauaauuucuuacaacaugagccaguaacccuuuaggaacucucuauggagaacagg

SEQ ID NO: 257703 - RNA, 64 nt, Homo Sapiens
uuuaucgaggagagaaauaauaacuaaaaaauauacccuuuaaaaaaaccuauauuucucuguc

SEQ ID NO: 257704 - RNA, 64 nt, Homo Sapiens
cucaauaauaacugaacuacguucaaauuaaguagaaagugagaaaagaauuaaagaacuugcu

SEQ ID NO: 257705 - RNA, 64 nt, Homo Sapiens
cuucuuuuggauagaaucauauuuaauauaaaaagaaagugaauguacuaaaaacagguuuccu

SEQ ID NO: 257706 - RNA, 64 nt, Homo Sapiens
ugaauuaagacaaagaacagugggaguggggagggaaagugagagcaugcaguccgaaagcaug

SEQ ID NO: 257707 - RNA, 64 nt, Homo Sapiens
accaagcugucucaucaccagcucagagucuagagaaagugauccauuaagguugaacagcaug

SEQ ID NO: 257708 - RNA, 64 nt, Homo Sapiens
accgagcugucacaucagcaagucuuguucaagagaaagugaucgguugaacaacauggcucag

SEQ ID NO: 257709 - RNA, 64 nt, Homo Sapiens
gacuccaagugcugcgguugauuccagugagggagaaagugaucugcagggagguggacaccga

SEQ ID NO: 257710 - RNA, 64 nt, Homo Sapiens
ccgaggcgcugucuucugucccccacacguaccagaaagugaaaaaugcagcgaguccucuggg

SEQ ID NO: 257711 - RNA, 64 nt, Homo Sapiens
uuucugcuuuaccuuuuucccaguuuggauugaugaaagugauuccaugcuaaaugucaguuac

SEQ ID NO: 257712 - RNA, 64 nt, Homo Sapiens
gaauggucuaaagaaaugacgaagcuaggaaaaggaaagugaagucccuucugacauuuccuag

SEQ ID NO: 257713 - RNA, 64 nt, Homo Sapiens
uuccaauuccuccucuucuucagaaucaucuucagaaagugaacuugaacaugagagaagcaga

SEQ ID NO: 257714 - RNA, 64 nt, Homo Sapiens
cucaucauccuaccauaaaagagaaaaaaauucggaaagugaucagagcacuuauucaaaauac

SEQ ID NO: 257715 - RNA, 64 nt, Homo Sapiens
auuucugaacuaauggugcuaauucagagaaauggaaagugaaagugagauucucuguugucau

SEQ ID NO: 257716 - RNA, 64 nt, Homo Sapiens
gaacuaauggugcuaauucagagaaauggaaagugaaagugagauucucuguugucaucggcau

SEQ ID NO: 257717 - RNA, 64 nt, Homo Sapiens
ucugacugagagaaagauggucgucuccagcagagaaagugaacagcauuuguuggaaggugau

SEQ ID NO: 257718 - RNA, 64 nt, Homo Sapiens
ucccuggggggaaauaucauucuuacuaugguuagaaagugaauuagaaauuucagcucaguuu

SEQ ID NO: 257719 - RNA, 64 nt, Homo Sapiens
aaguaaacaccagcagcucauagauuacaaccaagaaagugacuguaucagaugauagacuuca

SEQ ID NO: 257720 - RNA, 64 nt, Homo Sapiens
accacaucccucucaaguguuccacaacaucuaggaaagugagcucuuaaagacagacuaaaaa

SEQ ID NO: 257721 - RNA, 64 nt, Homo Sapiens
agugcagggaggaaaagugcuaaggucaagcccagaaagugauaacucauaccacacuuacaau

SEQ ID NO: 257722 - RNA, 64 nt, Homo Sapiens
gccagcagcaaaaacuacauagggggauugggcggaaagugagaacagccacuaaaacacaaaa

SEQ ID NO: 257723 - RNA, 64 nt, Homo Sapiens
ucucaguuuacauuuuguauauuuguauuuaaaugaaagugagacuuugaggguguauauuuuc

SEQ ID NO: 257724 - RNA, 64 nt, Homo Sapiens
agccucaaaugagaaaaugucuuuauuaaauguagaaagugauccauacuucaccuuugaagga

SEQ ID NO: 257725 - RNA, 64 nt, Homo Sapiens
aagccuaaauaaaaaguauagaaagugacuaccagaaagugagggguaaaacuggagacugggu

SEQ ID NO: 257726 - RNA, 64 nt, Homo Sapiens
accagaaagugaggaagccuacuggagacugggugaaagugacuggacucuaagucaggguaaa

SEQ ID NO: 257727 - RNA, 64 nt, Homo Sapiens
cuuucugugugcuuaaggucccguucaaaggugagaaagugaagcuggugcggcugcggaaucc

SEQ ID NO: 257728 - RNA, 64 nt, Homo Sapiens
gccuccacagccacagccuggcagcucugaucaggaaagugaggaacagcaacaauuccggaac

SEQ ID NO: 257729 - RNA, 64 nt, Homo Sapiens
guuuuacaaguuagagggaugaaauacgagaaaagaaagugaaaagaggaaaauguauuuaaaa

SEQ ID NO: 257730 - RNA, 64 nt, Homo Sapiens
uaaucuuguaugagguugcaaaugaagguaacuagaaagugaguugaagaguuugacuuagaau

SEQ ID NO: 257731 - RNA, 64 nt, Homo Sapiens
ccagauuagauuuuugagauaauucagguauuaggaaagugaucaaauaaauucuaaaacauau

SEQ ID NO: 257732 - RNA, 64 nt, Homo Sapiens
uauagauauuuuaaggaaaacacauuuuaagacugaaagugaaagaaagccuacucaaugaaaa

SEQ ID NO: 257733 - RNA, 64 nt, Homo Sapiens
cacagaguggcaggcagaccaaaaaaaaaaaaaagaaagugauguccaucucaaaaaaaaaaaa

SEQ ID NO: 257734 - RNA, 64 nt, Homo Sapiens
cacaggacaggugugguggcgacaagaugauguugaaagugauggaaaacuuauuuuaaguugg

SEQ ID NO: 257735 - RNA, 64 nt, Homo Sapiens
cuugaauauauuccuauaacuguagaacaguguggaaagugaugguaacuuugaaguuguucau

SEQ ID NO: 257736 - RNA, 64 nt, Homo Sapiens
uuuuuaaagugcugagccuuacaaaccccugaaggaaagugacccuuuaagagaggaucaucuu

SEQ ID NO: 257737 - RNA, 64 nt, Homo Sapiens
cugagaacauccagaggugagacucagacacauugaaagugacugcauuuagggagguuuaacg

SEQ ID NO: 257738 - RNA, 64 nt, Homo Sapiens
aucucuaauaaagauggccaccacuuaauguguggaaagugauggccuucucgugggccacgcg

SEQ ID NO: 257739 - RNA, 64 nt, Homo Sapiens
gcuuuucauuaagccucaaaaucuccucuguucuacuuggcaccacaagcuauguccuauauau

SEQ ID NO: 257740 - RNA, 64 nt, Homo Sapiens
gcaccacaagcuauguccuauauauguauuucugacuuggcaggauaguucaggggucuggcag

SEQ ID NO: 257741 - RNA, 64 nt, Homo Sapiens
cgugcucagccgcaaaauucuuuaugaauuuuacacuuggcaaauguuaaugacggaagccaua

SEQ ID NO: 257742 - RNA, 64 nt, Homo Sapiens
auuccuaccaaauaguuucuaaugugggagaaaaacuuggcacaaaauuucuucaguuuauuau

SEQ ID NO: 257743 - RNA, 64 nt, Homo Sapiens
uuuuuacgucaguuuauauuuuaauucuuacuguacuuggcaugcgcaauaaagcagcacaugu

SEQ ID NO: 257744 - RNA, 64 nt, Homo Sapiens
uuggccuuucuuggggagaaggcgggguauucccacucaccagcccuagcugucccauggggaa

SEQ ID NO: 257745 - RNA, 64 nt, Homo Sapiens
cugcagcugauccauaggacuaccgcaggcccggacucaccaacuugccacauguucuagguuu

SEQ ID NO: 257746 - RNA, 64 nt, Homo Sapiens
aguacuagaucuauguaaguaaaauuuuaagaggacucaccaaaucagauugguaaugccagaa

SEQ ID NO: 257747 - RNA, 64 nt, Homo Sapiens
ucaaaucaucaguccucauauacuuccauaacuaacucaccaaagaaauaagagaugccagaac

SEQ ID NO: 257748 - RNA, 64 nt, Homo Sapiens
uuuacugggccugaacucauacagauguaaauuaacucaccagaaugggaaaaacggcaguauc

SEQ ID NO: 257749 - RNA, 64 nt, Homo Sapiens
uuuuaaugggauuucaugggaucgcuuuucucagacucaccaacgagguagagaaaccguggag

SEQ ID NO: 257750 - RNA, 64 nt, Homo Sapiens
cugucaggccucugggaaucucccaaaucccagaacucaccacucaccaugggccuuuaaaugc

SEQ ID NO: 257751 - RNA, 64 nt, Homo Sapiens
gccucugggaaucucccaaaucccagaacucaccacucaccaugggccuuuaaaugcaguaaac

SEQ ID NO: 257752 - RNA, 64 nt, Homo Sapiens
cgugauguggagggcacauuccuugccugcacaaacucaccaucugugcacgcaguggccuucc

SEQ ID NO: 257753 - RNA, 64 nt, Homo Sapiens
aggcaucacagcuaacaauugugaagucgucuuaacucaccauaaaaaggaauccacucccagg

SEQ ID NO: 257754 - RNA, 51 nt, Homo Sapiens
ucuuacagagugcaguaugaaacucaccagcgagaacaaacaccuccccag

SEQ ID NO: 257755 - RNA, 64 nt, Homo Sapiens
uuccauccagggugccaucaguaaucaugccacuacucaccaguguuguucaccaacacccacc

SEQ ID NO: 257756 - RNA, 59 nt, Homo Sapiens
uaaucauccaaagaucauuugaaaacauaguuggaaaugacauuaaaugucaauuauag

SEQ ID NO: 257757 - RNA, 59 nt, Homo Sapiens
uagcugcuuuucuuuagaaaggaugagagguuggaaaugauggauucaacuucugccuc

SEQ ID NO: 257758 - RNA, 59 nt, Homo Sapiens
augaaacuucaccauauuauuauuuuugaguuggaaauuauagaacugaggaucauuug

SEQ ID NO: 257759 - RNA, 59 nt, Homo Sapiens
ugugcuuuauaguguuuacuauuucagauguuggaaaugcuuauaaguuuauaaguuug

SEQ ID NO: 257760 - RNA, 59 nt, Homo Sapiens
uccuugaaagcccuuuagaagggugccauguuggaaaccuguacauccacaacaaguag

SEQ ID NO: 257761 - RNA, 59 nt, Homo Sapiens
cauccacaacaaguagcuuuuccuccuauguuggaaaaaaagacuguuucuuuguuuga

SEQ ID NO: 257762 - RNA, 59 nt, Homo Sapiens
uuuauuuuaucucacagguuuguguaauuguuggaaaauuuuuaaacuucuaagugaaa

SEQ ID NO: 257763 - RNA, 59 nt, Homo Sapiens
cucauuguaaagcuucaugucuuuuguuuguuggaaaauuuuuacuuauagaaacuuaa

SEQ ID NO: 257764 - RNA, 59 nt, Homo Sapiens
uucauugucucuagagauugaggugauucguuggaaaaaacaggagaagaaguucauac

SEQ ID NO: 257765 - RNA, 59 nt, Homo Sapiens
aguccccaucuaauauguauucaaggguuguuggaaaaucagguugucagguucugccu

SEQ ID NO: 257766 - RNA, 59 nt, Homo Sapiens
auaaaaggaucauuuguuuuuuaaaagggguuggaaaaacugguuuuccaguuggaaac

SEQ ID NO: 257767 - RNA, 59 nt, Homo Sapiens
uaaaagggguuggaaaaacugguuuuccaguuggaaacaguaaagguuguaagcuuugu

SEQ ID NO: 257768 - RNA, 59 nt, Homo Sapiens
ugcaaagacucuccagaccuggaaaugucguuggaaacucuggucucucccaccugguu

SEQ ID NO: 257769 - RNA, 59 nt, Homo Sapiens
ucguuggaaacuugcaaagaucccaccugguuggaaaugacucgucaacugcuggucuc

SEQ ID NO: 257770 - RNA, 64 nt, Homo Sapiens
aagagcgcaccagcuaacaaaccagaauaagagcgcaccagaaugaaaggaagaauaagagugc

SEQ ID NO: 257771 - RNA, 64 nt, Homo Sapiens
aagagcgcaccagaauaagaggaagaauaagagugcaccagaauuuuaaaaucuucucuugaaa

SEQ ID NO: 257772 - RNA, 61 nt, Homo Sapiens
agcugcgggacgaguucugauucuggccggagcaccagacccucugauccuggagggacca

SEQ ID NO: 257773 - RNA, 64 nt, Homo Sapiens
agcaguaauaaucacuuguguucugaaagaaagggcaccagaaguucuagcaaaauucaguugu

SEQ ID NO: 257774 - RNA, 64 nt, Homo Sapiens
ugcuugaacccaggaggugguucaggaggcugaggcaccagaaucgugccuguaaucccagcua

SEQ ID NO: 257775 - RNA, 64 nt, Homo Sapiens
ggaugggcuuucucagugucuucuagagugacaggcaccagaugcugaggaguggaguucucug

SEQ ID NO: 257776 - RNA, 64 nt, Homo Sapiens
gucuggacacugccacauggcgcugccacaucugggcauacagucugggcauacagugucugga

SEQ ID NO: 257777 - RNA, 64 nt, Homo Sapiens
gucuggacgcugccacaucuugcugccacaucugggcauacagucagccacacagcuggacgga

SEQ ID NO: 257778 - RNA, 64 nt, Homo Sapiens; identical to SEQ ID NO: 80419

SEQ ID NO: 257779 - RNA, 64 nt, Homo Sapiens; identical to SEQ ID NO: 80420

SEQ ID NO: 257780 - RNA, 64 nt, Homo Sapiens; identical to SEQ ID NO: 80421

SEQ ID NO: 257781 - RNA, 64 nt, Homo Sapiens; identical to SEQ ID NO: 80422

SEQ ID NO: 257782 - RNA, 64 nt, Homo Sapiens; identical to SEQ ID NO: 80423

SEQ ID NO: 257783 - RNA, 64 nt, Homo Sapiens; identical to SEQ ID NO: 80424

SEQ ID NO: 257784 - RNA, 64 nt, Homo Sapiens; identical to SEQ ID NO: 80425

SEQ ID NO: 257785 - RNA, 64 nt, Homo Sapiens; identical to SEQ ID NO: 80426

SEQ ID NO: 257786 - RNA, 64 nt, Homo Sapiens; identical to SEQ ID NO: 80427

SEQ ID NO: 257787 - RNA, 64 nt, Homo Sapiens; identical to SEQ ID NO: 80428

SEQ ID NO: 257788 - RNA, 64 nt, Homo Sapiens; identical to SEQ ID NO: 80429

SEQ ID NO: 257789 - RNA, 64 nt, Homo Sapiens; identical to SEQ ID NO: 80430

SEQ ID NO: 257790 - RNA, 64 nt, Homo Sapiens; identical to SEQ ID NO: 80431

SEQ ID NO: 257791 - RNA, 64 nt, Homo Sapiens; identical to SEQ ID NO: 80432

SEQ ID NO: 257792 - RNA, 64 nt, Homo Sapiens
ggauaacuaccagaaagguauaccuguugagacugauucagaggagcaacccuauuuagaaaug

SEQ ID NO: 257793 - RNA, 64 nt, Homo Sapiens
guacaaaauccagcuaugaauauagagggcuuaugauucagauuguuaucuaucaacuauaagc

SEQ ID NO: 257794 - RNA, 64 nt, Homo Sapiens
cacaguucccuggccggguuuggacugaacaguggauucagaacugcagcguucaaagccccug

SEQ ID NO: 257795 - RNA, 64 nt, Homo Sapiens
cacacacuccguucaugcauggacaccagaagacgauucagaacacaagaggagaaugagcugg

SEQ ID NO: 257796 - RNA, 64 nt, Homo Sapiens
acuauauuaaauuuuuaucauuuacuuuuuuuaagauucagaccucaguuauauaaauuucagu

SEQ ID NO: 257797 - RNA, 64 nt, Homo Sapiens
caaaucuugaaagacgaaaucaaagcccauuaaugauucagaaucagugcuugaccuccuguau

SEQ ID NO: 257798 - RNA, 64 nt, Homo Sapiens
uugguuuguaaguuuuaguuccuuguauuauugagauucagagcuucauuuuauguuggucauu

SEQ ID NO: 257799 - RNA, 64 nt, Homo Sapiens
cauauuuucaagucacaugucucucagaccccuggauucagaacccaaggccacaaaucauagg

SEQ ID NO: 257800 - RNA, 64 nt, Homo Sapiens
gggccacugcuggggguucaugggaucccgaaggagcaagcagucggcagcacccaggccacag

SEQ ID NO: 257801 - RNA, 64 nt, Homo Sapiens
cuuccacuuccaucagggcuauuccgcagcuugcagcaagcacagagugugaccucccaggauu

SEQ ID NO: 257802 - RNA, 64 nt, Homo Sapiens
caaaaguuaaacguucuaaaaagaggcgaaaggaagcaagcaguucagaagagccaaggaauaa

SEQ ID NO: 257803 - RNA, 64 nt, Homo Sapiens
aaaaaagacaaaaagcauaaggcuccaaaacgaaagcaagcauuucacuggcagccuccacuag

SEQ ID NO: 257804 - RNA, 64 nt, Homo Sapiens
agccugugaagauuuugcucuaauuaaaagcaacagcaagcagcauuucaaaguuuaauuaaua

SEQ ID NO: 257805 - RNA, 64 nt, Homo Sapiens
auuuugcccuuuaguuuucgcucaagguauugguagcaagcaagacaaaauguagacaagaugc

SEQ ID NO: 257806 - RNA, 64 nt, Homo Sapiens
gccaaaaucggaccucagcuccaaucagugagcaagcaagcacaguuuuauuugccaaauguua

SEQ ID NO: 257807 - RNA, 64 nt, Homo Sapiens
cacagccaaaaucggaccucguuaccaaucagugagcaagcaaguuguguuuuauuugccaaau

SEQ ID NO: 257808 - RNA, 64 nt, Homo Sapiens
aaaguagacaaaaguauuaagaucucuaccgagaagcaagcacauucccugcucagguauaugc

SEQ ID NO: 257809 - RNA, 64 nt, Homo Sapiens
ggaguccacuccgaccuuuuccguuuacuuucugagcaagcacucaguguacaaaucuggcugc

SEQ ID NO: 257810 - RNA, 64 nt, Homo Sapiens
cacuugaaugaagagaaugguggcagaaugagugagcaagcagauugccccagaggggccggua

SEQ ID NO: 257811 - RNA, 64 nt, Homo Sapiens
aauuuuuuauuuugauuuuauuaaaugggaagaaagcaagcagaaauaguaaaauucaguaggu

SEQ ID NO: 257812 - RNA, 64 nt, Homo Sapiens
guauucacuagcuaaauaaacauaguucuuguuuagcaagcauauguuguuccucagcucuuuu

SEQ ID NO: 257813 - RNA, 64 nt, Homo Sapiens
uagguuuuuauguaagagugucauggaagcacucagcaagcaggcugauugcaauagacucaga

SEQ ID NO: 257814 - RNA, 64 nt, Homo Sapiens
auuaaaauuuuaaucaauaaaguaugucuguugaagcaagcaagcaaacaaauccauaacaacc

SEQ ID NO: 257815 - RNA, 64 nt, Homo Sapiens
aaauuuuaaucaauaaaguaugucuguugaagcaagcaagcaaacaaauccauaacaaccacaa

SEQ ID NO: 257816 - RNA, 64 nt, Homo Sapiens
aagccucaacuuacccaggaggagcuagaagcaaagcaagcaaagcaaaagcuggaagaucgcc

SEQ ID NO: 257817 - RNA, 64 nt, Homo Sapiens
caaguccaaggccaggucucagucggugucacccagcaagcaggcagcgccccggcccgcggcc

SEQ ID NO: 257818 - RNA, 64 nt, Homo Sapiens
aacucucuuggagcuuuugcauuuaaaacaaacaagcaagcagacacacacagugaacacauuu

SEQ ID NO: 257819 - RNA, 64 nt, Homo Sapiens
caagucucuauacaaugucuuuaucccugugggcagcaagcaaugaugauaaugacaaacagga

SEQ ID NO: 257820 - RNA, 64 nt, Homo Sapiens
gcaagggagaucuggcauuucauccucccugcaaagcaagcagggaaccuggauuguggaguca

SEQ ID NO: 257821 - RNA, 64 nt, Homo Sapiens
gucaugaccagggacacagcuugcuuuagggaagagcaagcagagucagauuuuccuauuuuaa

SEQ ID NO: 257822 - RNA, 64 nt, Homo Sapiens
uaauuggagaugcauuaggucacuugaauguauaagcaagcaccuaugguaggcgcuacagaca

SEQ ID NO: 257823 - RNA, 64 nt, Homo Sapiens
uccuauuagccauggaaaugcaaaguuuagcagaagcaagcaauuaggcagagaacaaaaaugu

SEQ ID NO: 257824 - RNA, 64 nt, Homo Sapiens
auuucuauuauaccuuggugcaccaugccuagccagcaagcauccugggauuacaggcaugagc

SEQ ID NO: 257825 - RNA, 64 nt, Homo Sapiens
guuucuuuucauuuguuuaugggcuaauacacggagcaagcauucuuuauagcagugugagaau

SEQ ID NO: 257826 - RNA, 64 nt, Homo Sapiens
augggguucucaucaguucuaccaccaagcaagcagcaagcaagccgcuacccucggccugccc

SEQ ID NO: 257827 - RNA, 64 nt, Homo Sapiens
aagcaagaugggguucucauccugcccaccaccaagcaagcagcgagccugccgcuacccucgg

SEQ ID NO: 257828 - RNA, 64 nt, Homo Sapiens
cccucuugccggcagaguggaauacauggaaaagagcaagcaucugcaggagcagcucaaugaa

SEQ ID NO: 257829 - RNA, 64 nt, Homo Sapiens
ucugcacaaugagaacuccgacagggguggcagcagcaagcacaauaccauuaaaaagguaccc

SEQ ID NO: 257830 - RNA, 64 nt, Homo Sapiens
ugaaaggccaaccauuucaggaucagucaaaggcagcaagcagauagacucaaggugugugaaa

SEQ ID NO: 257831 - RNA, 64 nt, Homo Sapiens
gaugcuuguguugaccagauguuccugagucuggagcaagcacccaggccagaauaacagagcu

SEQ ID NO: 257832 - RNA, 62 nt, Homo Sapiens
aauuuuaacuuuuaauuuuuauuuuggcaaaacugucaaaugagaaaaaugauuuuaaaaac

SEQ ID NO: 257833 - RNA, 62 nt, Homo Sapiens
uuaaccuggauagccacauuaaugaauuggugcugucaaaauauaguaauuuuuaaauuugu

SEQ ID NO: 257834 - RNA, 62 nt, Homo Sapiens
uucagucuaauaaccuugaagugguuuuugaacugucaaacuuugaccuguagaugcuguag

SEQ ID NO: 257835 - RNA, 62 nt, Homo Sapiens
auugcuacauacacuucucugaggaucaccugcugucaaauugccaucuacaguauuacagc

SEQ ID NO: 257836 - RNA, 62 nt, Homo Sapiens
ucaacuuagacuugacuuccaggguacuuucucugucaaaucuuucuuuuggucacagagaa

SEQ ID NO: 257837 - RNA, 62 nt, Homo Sapiens
gggaguaggagaggggacaaaaggcuccgugacugucaaacuucucuuccaucucuuucccc

SEQ ID NO: 257838 - RNA, 62 nt, Homo Sapiens
gccuuuacuuccgccucccucagagcagcagccugucaaaacaccagauuacaacaaauuua

SEQ ID NO: 257839 - RNA, 62 nt, Homo Sapiens
uagaagagguuaguuuuauagacaggaaggggcugucaaaggcagaaagaaaugaagaacaa

SEQ ID NO: 257840 - RNA, 62 nt, Homo Sapiens
gccacgaucucacuaaaggauuaauuauaauacugucaaauucccauguaccuuuauugagc

SEQ ID NO: 257841 - RNA, 62 nt, Homo Sapiens
ccuuucauccuuuaauaguucuguucaaagcacugucaaauuauuuggguaccauuuuauca

SEQ ID NO: 257842 - RNA, 62 nt, Homo Sapiens
cuuuuccuuaaggugcacagaaguacagcacacugucaaauuaaauauguuaccugcagugu

SEQ ID NO: 257843 - RNA, 62 nt, Homo Sapiens
uuaagaaaacaaauguauaaucugaagaauaucugucaaaauguggaaggcaguuuuaacuu

SEQ ID NO: 257844 - RNA, 62 nt, Homo Sapiens
uuaauccagcaaauauaugaucguguuuuuuccugucaaacacgaucagcuguucauccauu

SEQ ID NO: 257845 - RNA, 62 nt, Homo Sapiens
aacaccugagaugaauugguaaaaguagcuugcugucaaagauaaaauauuuucacggaauu

SEQ ID NO: 257846 - RNA, 62 nt, Homo Sapiens
ucuuauacccagaaaagaacauauuucagaaucugucaaacuuuuguguaucccacagauuc

SEQ ID NO: 257847 - RNA, 62 nt, Homo Sapiens
agcuauuugagggacuaagggauggagauauucugucaaaugaaucucuucaguauaccagu

SEQ ID NO: 257848 - RNA, 62 nt, Homo Sapiens
ugaagcugcuggggaagcuggggugaagaaaacugucaaauaaguaauugcagaagcaguug

SEQ ID NO: 257849 - RNA, 62 nt, Homo Sapiens
uucacaaugccauacaggcuccacuuauccaucugucaaaagaauucuucaaaaaacacagc

SEQ ID NO: 257850 - RNA, 64 nt, Homo Sapiens
aauaaacauccuugaauuagaaguaugaagguuuguagguuaaaauuacuuuuauuugcaguaa

SEQ ID NO: 257851 - RNA, 64 nt, Homo Sapiens
uuuuauuuuugaggcauguaauuuuaaaacugcaguagguuaaaauucuauuaaacaaauauag

SEQ ID NO: 257852 - RNA, 64 nt, Homo Sapiens
uuugaucgauugcuaauuuucaaaggcuucuuagguagguuacuacaguaaacuguaacucagu

SEQ ID NO: 257853 - RNA, 64 nt, Homo Sapiens
gacuaccauaacaaugcuuaugcuguuuccaaggguagguuauuuuucauuaaaagaagaauga

SEQ ID NO: 257854 - RNA, 64 nt, Homo Sapiens
uccagccuuggguuugaccuuaaauuuaaauagccacauuuaacaacccaucuuucaauucaau

SEQ ID NO: 257855 - RNA, 64 nt, Homo Sapiens
auguuuuaaaaugucuuauuuuuuccaaauaaugcacauuuaauagguucauuugcauauacuu

SEQ ID NO: 257856 - RNA, 64 nt, Homo Sapiens
ggaguagacugguaugagaaaacuaugauuaguucacauuuacuggugcauccuugauccucuc

SEQ ID NO: 257857 - RNA, 64 nt, Homo Sapiens
uguuuaaaaaaaagacuaaauauauuuaaaaggccacauuuauauuuuuuucacaagaaccaca

SEQ ID NO: 257858 - RNA, 64 nt, Homo Sapiens
aaagugggggaagaaaguuuauagacuuuccaagcacauuuaugguuuuuuauuacuauuauua

SEQ ID NO: 257859 - RNA, 64 nt, Homo Sapiens
aacaacuaauuacuaauuuuuaaagaacaaaucacacauuuaaaaaaucuguagaauuuauuuu

SEQ ID NO: 257860 - RNA, 64 nt, Homo Sapiens
ccuagaaggaacggacuuuuugaaauuuuaaauacacauuuauguuacaaguauuuguuuacua

SEQ ID NO: 257861 - RNA, 64 nt, Homo Sapiens
aaaaaaagagaucaaauauaucaauuuucacaaccacauuuaccugaaaagaggaauauauaac

SEQ ID NO: 257862 - RNA, 64 nt, Homo Sapiens
auauccaugagcugcacugaucaccauguaaggucacauuuaguaaaugcugaaauaaaaugau

SEQ ID NO: 257863 - RNA, 64 nt, Homo Sapiens
aaaaucaaaucauguacauuugaaaauauuugcacacauuuaaaaauaaauguaaaguugucuu

SEQ ID NO: 257864 - RNA, 64 nt, Homo Sapiens
uguugcuccguccagauguuggggucuuccauggcacauuuaccgauguggagucauguuuugu

SEQ ID NO: 257865 - RNA, 64 nt, Homo Sapiens
aauuuaaaaauugaagugcagauauuaaaaguggcacauuuaaaucagaaaguaguuuguaauu

SEQ ID NO: 257866 - RNA, 64 nt, Homo Sapiens
cccaaaucggaaugcuuuguuggguuaaaagaaucacauuuauugaaagaucuaacuggauauu

SEQ ID NO: 257867 - RNA, 64 nt, Homo Sapiens
aaagagaggaaauguguuucuuggauuacaugcucacauuuaacgaccaagggcuugaaacaua

SEQ ID NO: 257868 - RNA, 64 nt, Homo Sapiens
guauacauauacacaaaugcacauauagaguuaacacauuuagugaacacuuguuuagugucac

SEQ ID NO: 257869 - RNA, 64 nt, Homo Sapiens
aaggauugccccagguguccccuuucacgguugucacauuuacagugacuucuguugaacaccc

SEQ ID NO: 257870 - RNA, 64 nt, Homo Sapiens
auucagagcucggcauuguguaugacaauaugugcacauuuaaaacucuaagucacuauaugaa

SEQ ID NO: 257871 - RNA, 64 nt, Homo Sapiens
uuaucuccuguguuucauuggacauuuggaaaaacacauuuaauccugggaaccucgauauucu

SEQ ID NO: 257872 - RNA, 64 nt, Homo Sapiens
auuaauguuuccaguuaucaagauugugauuagacacauuuaccuuucuucauugaacaaaugg

SEQ ID NO: 257873 - RNA, 64 nt, Homo Sapiens
guacaggaaaaacaucaucauuauuuccucuguucacauuuacuggucuuaauuaacagguaau

SEQ ID NO: 257874 - RNA, 64 nt, Homo Sapiens
guucuguaaugcaaggaugcuuacuguaugacaacacauuuacauagaauugggauguggauau

SEQ ID NO: 257875 - RNA, 64 nt, Homo Sapiens
gagagacacuauaaacaaguucuuuggucaaaugcacauuuacacucauuauuuggauggaauc

SEQ ID NO: 257876 - RNA, 64 nt, Homo Sapiens
cacacacacacacacacacacgugcacacacacacacauuuaaaugauauaaaaagaagagguu

SEQ ID NO: 257877 - RNA, 64 nt, Homo Sapiens
augguauuacugaagguguguauacucccuaauacacauuuaugaaaaucuacuuguuuaggcu

SEQ ID NO: 257878 - RNA, 64 nt, Homo Sapiens
acgagauacagaauuuuaugcggcauuuucuucucacauuuauauuuuugugauuuugugauug

SEQ ID NO: 257879 - RNA, 64 nt, Homo Sapiens
ugaaaaaaagcuuuuuuugaaucaucaagucuuucacauuuaaauaaaguguuugaaagcuuua

SEQ ID NO: 257880 - RNA, 64 nt, Homo Sapiens
gguagugauauuuucuuccacuuaccugcugaagcacauuuaugcauuucuuuauggcaaaacc

SEQ ID NO: 257881 - RNA, 64 nt, Homo Sapiens
ucccuuaagaucacguuugucaaguguguauucacacauuuacuuaaaucaagggacucaaugc

SEQ ID NO: 257882 - RNA, 64 nt, Homo Sapiens
cauacacacacacacacacacacgugcacacacacacauuuaaaggauauaaaaagaagagguu

SEQ ID NO: 257883 - RNA, 64 nt, Homo Sapiens
augguauuacugaagguguguauacucccuaauacacauuuaugaaaaucuacuuguuuagacu

SEQ ID NO: 257884 - RNA, 64 nt, Homo Sapiens
cuacuucauucccccuccauaaaguuucagccauuaugggcacugguuuuaaaaaauuuauuag

SEQ ID NO: 257885 - RNA, 64 nt, Homo Sapiens
guggugggcggggguguuggccacuaggcaaugguaugggcagggcuucaccugacauuaugga

SEQ ID NO: 257886 - RNA, 64 nt, Homo Sapiens
gacaauuuauucaacaccaacgagggacucaucauaugggcacaacucugguguccuucuaugg

SEQ ID NO: 257887 - RNA, 64 nt, Homo Sapiens
aucucgaagaaaaaagaaaaaagagugguauuauuaugggcaaauaaucauauucccacuuaaa

SEQ ID NO: 257888 - RNA, 64 nt, Homo Sapiens
cugcagcaacccauggagggcccagggugccugguaugggcaucaguuggugggggugcggggg

SEQ ID NO: 257889 - RNA, 64 nt, Homo Sapiens
gaagaggcaagaugcauucaauuugaaagauauuuaugggcaacaaaguaaggucaggauuaga

SEQ ID NO: 257890 - RNA, 64 nt, Homo Sapiens
uuuuuguucaaccucuuccugaggcccaagagcauaugggcaauucggauuuccugcuggacca

SEQ ID NO: 257891 - RNA, 64 nt, Homo Sapiens
cucugcaggacagacagacaggaccagcaggacauaugggcaagcacugugggucaggggaaug

SEQ ID NO: 257892 - RNA, 64 nt, Homo Sapiens
uaccaauuuguggugucucuaguuuguuuaauguuaugggcagcgaagccacucuuaagagucc

SEQ ID NO: 257893 - RNA, 64 nt, Homo Sapiens
gaugagacccaggcccguguaccagucugugcuuuaugggcagaggacuugucucuuacugcug

SEQ ID NO: 257894 - RNA, 64 nt, Homo Sapiens
acaaaggugagagauacauacuugcuguuuucaauaugggcagccacuguugaauaucuuugaa

SEQ ID NO: 257895 - RNA, 64 nt, Homo Sapiens
auauuucucaguaaagcuucaaagucugaaggaauaugggcaaaaaucacauuaugaaacuggg

SEQ ID NO: 257896 - RNA, 64 nt, Homo Sapiens
guaucuaugaaauaccucauggaaagagaauuuguaugggcacuucuggcaguugaaaauugug

SEQ ID NO: 257897 - RNA, 64 nt, Homo Sapiens
gccauuagaaaugcauaaaacuggguaucucuccuaugggcaaacuuagccucuguuugccacu

SEQ ID NO: 257898 - RNA, 64 nt, Homo Sapiens
gcuaugcuaacuugacaaaauagugaacacagaguaugggcacgugguaguaucuauauugcuu

SEQ ID NO: 257899 - RNA, 64 nt, Homo Sapiens
auccagccuagaugauuggauauagccuacuagauaugggcaauuugcaaagaacuaaggugag

SEQ ID NO: 257900 - RNA, 64 nt, Homo Sapiens
ugguggaugauaaugagcagcuguccuagagaucuaugggcauucuuuuucaucaaaaccuacc

SEQ ID NO: 257901 - RNA, 64 nt, Homo Sapiens
ccgcuucagaugacagauguuguaagagaagguuuaugggcauccucucuggucuuuuggauua

SEQ ID NO: 257902 - RNA, 64 nt, Homo Sapiens
uuuagaaggagaaacuuaaguguggaaugcauuauaugggcaaagaagcuaugaagauacauga

SEQ ID NO: 257903 - RNA, 64 nt, Homo Sapiens
auuuugaauucuagagauggagaaccaacggaaauaugggcacuacacuaauucuuuauauuau

SEQ ID NO: 257904 - RNA, 64 nt, Homo Sapiens
uuuuuaauucauuugaauaaugugcagguuuuucuaugggcaugaaagcuguuguaaacaucuu

SEQ ID NO: 257905 - RNA, 64 nt, Homo Sapiens
aggaaaggugggagggggagccuugugccucauguaugggcaggacccuccucccugcuucuuc

SEQ ID NO: 257906 - RNA, 64 nt, Homo Sapiens
uugaauuucugguuuucaauuuuauaugauugucuaugggcagucauuucucauuuucccaacu

SEQ ID NO: 257907 - RNA, 64 nt, Homo Sapiens
gauacauauauaaauauauagggcccacguguuuuaugggcauuuucuucuuuuuguagacuuu

SEQ ID NO: 257908 - RNA, 64 nt, Homo Sapiens
guagauauuaauuuuuuccucggcuguaaaaugcuaugggcaacacaaucaugcaauuauaauu

SEQ ID NO: 257909 - RNA, 64 nt, Homo Sapiens
gagggagcacagaagucguggccugaggcuguucuaugggcacuuggggcuaaaucgccuccug

SEQ ID NO: 257910 - RNA, 64 nt, Homo Sapiens
cgaagccacagagucucucccuggagcagcagacuaugggcagcccagugcugccaccugcuga

SEQ ID NO: 257911 - RNA, 64 nt, Homo Sapiens
ggcccacuuuauucugaggaauacagugagcagauaugggcagcagccagguagggcaaagggg

SEQ ID NO: 257912 - RNA, 64 nt, Homo Sapiens
aaaguaaauuuagauaaaauacagcuuuuuuccuuaugggcauuuguuuuguuucaagucauca

SEQ ID NO: 257913 - RNA, 64 nt, Homo Sapiens
cugguucaaaguacaauucaagaaacugaguauuuaugggcauugaagaaaaaauguugagaua

SEQ ID NO: 257914 - RNA, 64 nt, Homo Sapiens
uaacaggauuggcguccguuacaucuagaacuucuaugggcaucauuauuguuggaggaguggu

SEQ ID NO: 257915 - RNA, 64 nt, Homo Sapiens
uagaaaacuugaaagucagcgccauugcugugguuaugggcauucugccguugccgccacugcu

SEQ ID NO: 257916 - RNA, 64 nt, Homo Sapiens
cucagcccugguuuuucaauggccaccugaacuguaugggcacuuccacucgcuugccugcccu

SEQ ID NO: 257917 - RNA, 64 nt, Homo Sapiens
agccccugcgccugaccuuccaaaaugcugggacuaugggcauggaucacccuccucagccucc

SEQ ID NO: 257918 - RNA, 64 nt, Homo Sapiens
gcccuagaagagcgagcccacugcaacacuacuuuaugggcaggaugcccaagcucaagaacga

SEQ ID NO: 257919 - RNA, 64 nt, Homo Sapiens
gcccagugcucuuccugcccggcugggccuuuccuaugggcaagcagcccccgagaggggacuu

SEQ ID NO: 257920 - RNA, 64 nt, Homo Sapiens
cacacaccuucugaauagaaauuugcguauuaauuaugggcaagaucagauuauaguuuagaau

SEQ ID NO: 257921 - RNA, 64 nt, Homo Sapiens
agacaaacauuuguccuaauagcuuucucauaaauaugggcaccacuuuacauugugguaagac

SEQ ID NO: 257922 - RNA, 64 nt, Homo Sapiens
gaguugccgcaagucugaauggcgccaucaaacuuaugggcagggauaacagugugccugguua

SEQ ID NO: 257923 - RNA, 64 nt, Homo Sapiens
cuucuaaugacaaaacugugagagcuagauguccuaugggcaauuagguaguauaauaaaggua

SEQ ID NO: 257924 - RNA, 64 nt, Homo Sapiens
aggcaagcuccuggggucugaugggccucucugguaugggcaauaccagaugguguauuuccaa

SEQ ID NO: 257925 - RNA, 64 nt, Homo Sapiens
auuuuguuuuacuuauguggacuacaucuauauuuaugggcaauggcugauugagacugcaaca

SEQ ID NO: 257926 - RNA, 64 nt, Homo Sapiens
auggcaaccagaccauugucuuaauugauguuguuaugggcaggaacuagguuuuaauaauuuu

SEQ ID NO: 257927 - RNA, 64 nt, Homo Sapiens
uucauaagucauugcuggauuauuuuuuucuaccuaugggcaagcagauauaaauccaguaagc

SEQ ID NO: 257928 - RNA, 64 nt, Homo Sapiens
guaguccucuuccaaaguccuguaguuuauuucauaugggcaaaaaauuuggauagaaaggaga

SEQ ID NO: 257929 - RNA, 64 nt, Homo Sapiens
gaaauauauaauaauagcauuuuauguaauaaaauaugggcaacgauuaucuuggaaauuaaag

SEQ ID NO: 257930 - RNA, 64 nt, Homo Sapiens
guguccguaugcaggcaugccuguguauacuguguaugggcacacugggacuagcugggacaau

SEQ ID NO: 257931 - RNA, 64 nt, Homo Sapiens
ggacugacccacauggacugggaugugugucgguuaugggcaugacugcacguucacucucagu

SEQ ID NO: 257932 - RNA, 64 nt, Homo Sapiens
auguaaauaaauaaauguaaaagccuaucaguauuaugggcaauaaaacaaagcauuaaaaaaa

SEQ ID NO: 257933 - RNA, 64 nt, Homo Sapiens
agaaauguguguagugcuuuuguuaaagccccuauaugggcagcauggaggaucauaagauagc

SEQ ID NO: 257934 - RNA, 64 nt, Homo Sapiens
acccuuaaagauacaguguucaguauuauugaaauaugggcaucugcaacacauacccccuauu

SEQ ID NO: 257935 - RNA, 64 nt, Homo Sapiens
uugugaauagucuuuuacauuuuuguaugcugaauaugggcaccaaagaaccuguaaaaguuau

SEQ ID NO: 257936 - RNA, 64 nt, Homo Sapiens
auauuuucccaguaauugaaauuggaaaggaacuuaugggcauauuacuggagcaucugcagug

SEQ ID NO: 257937 - RNA, 64 nt, Homo Sapiens
uucaccuuccaugaaggcuuauaaguggucuuucuaugggcaguuuuagugcgcugugcuuugu

SEQ ID NO: 257938 - RNA, 64 nt, Homo Sapiens
ugugugccauccccagccgagucuccauugucauuaugggcagaugacucuggagcacuggguu

SEQ ID NO: 257939 - RNA, 64 nt, Homo Sapiens
uugcccuuuucugcaucaaaaggggguggauaacuaugggcaguucucauuguuauaauugggg

SEQ ID NO: 257940 - RNA, 64 nt, Homo Sapiens
uauaaaaguagacacauuucuuaagugucugcuuuaugggcauauaaaauaguaaauuucaaug

SEQ ID NO: 257941 - RNA, 64 nt, Homo Sapiens
aagaaccuaaaaugauugacucauucauaguaaauaugggcauguaaacuaauaaauaugcacu

SEQ ID NO: 257942 - RNA, 64 nt, Homo Sapiens
cuugguaggaauucaguugggcaaugauaacuuuuaugggcaaaaacauucuauuauagugaac

SEQ ID NO: 257943 - RNA, 64 nt, Homo Sapiens
auugacggggagauagcgccugaaauaaacaaaauaugggcaugcaugcuaaagggaaaaugug

SEQ ID NO: 257944 - RNA, 64 nt, Homo Sapiens
gaaggggggcuccuucccucuccucgaaugacguuaugggcacaugccuuuuaaaaguucuuua

SEQ ID NO: 257945 - RNA, 64 nt, Homo Sapiens
guaaaaagaaucaugccuuacacuuaauuauauuuaugggcaaaaugcuggagcccagcacuca

SEQ ID NO: 257946 - RNA, 64 nt, Homo Sapiens
augcaugaccuaaugucuugaagaguuuccuuguuaugggcaacagccuugugguuucacacua

SEQ ID NO: 257947 - RNA, 64 nt, Homo Sapiens
caucaauggcugccaaaaccaauaaaauuauggauaugggcaguucaaaauguaauuuuccccu

SEQ ID NO: 257948 - RNA, 64 nt, Homo Sapiens
acucuuagugauauuuguuugauaucuuuauauguaugggcauuaguagaacguggcucaacua

SEQ ID NO: 257949 - RNA, 64 nt, Homo Sapiens
gaauagauuagauuagaacaaauaggaggcuauguaugggcaggauaccucagccagucuuaug

SEQ ID NO: 257950 - RNA, 64 nt, Homo Sapiens
auuagauaaccuuuugguuaagauuugacaccaauaugggcaaauuuggcagggaguggggaug

SEQ ID NO: 257951 - RNA, 64 nt, Homo Sapiens
auaagcauauuuccauuuuuauuacugaaagaaauaugggcauuuucauucuuuaaagaaauaa

SEQ ID NO: 257952 - RNA, 64 nt, Homo Sapiens
ugacaaaagaaaauguaaugaguccaaaagcagcuaugggcagugauguaauuuuuuuuaaaaa

SEQ ID NO: 257953 - RNA, 64 nt, Homo Sapiens
ugaugaucuaggugaaaaauugugcauacgauuuuaugggcagcgcagacugauucauuaaaau

SEQ ID NO: 257954 - RNA, 64 nt, Homo Sapiens
ccugagagggagaggaaacaggagagaacuucuguaugggcaagaguuacacuccaaggucauu

SEQ ID NO: 257955 - RNA, 64 nt, Homo Sapiens
uuucaggaguguuaagcaacauccuguucagcuguaugggcacuagucccuuacagaugaccau

SEQ ID NO: 257956 - RNA, 64 nt, Homo Sapiens
ucuuaauaggugucuaagaaugucagggcaaaaguaugggcauuuuucuugcuauguucagaaa

SEQ ID NO: 257957 - RNA, 64 nt, Homo Sapiens
uuuuggggagugauauuuuaaaaaauaaguugucuaugggcacaaaguuuucuucauuugugua

SEQ ID NO: 257958 - RNA, 64 nt, Homo Sapiens
gcuuuuuuccuuaagcaucaaggccacagugaguuaugggcaaauaaguuggugucguaacucc

SEQ ID NO: 257959 - RNA, 64 nt, Homo Sapiens
gcaguuuuugacccaggcagcauccuacauugcauaugggcauaagcugugguucuugaaaaca

SEQ ID NO: 257960 - RNA, 64 nt, Homo Sapiens
uggcacugggagucgggggaccugagguguggcauaugggcaccucacccgaacagaggacaac

SEQ ID NO: 257961 - RNA, 64 nt, Homo Sapiens
acagggaacauccuggacuugcccucacaagucuuaugggcaccugcaaggaagacccggcuuu

SEQ ID NO: 257962 - RNA, 64 nt, Homo Sapiens
ggcgauuugugucuaaggauacgauuuugaaccauaugggcaguguacaaaauaugaaacaacu

SEQ ID NO: 257963 - RNA, 64 nt, Homo Sapiens
ggguaucacacauuucucaccaggccuccuuuccuaugggcauuggugccucccagagguuucu

SEQ ID NO: 257964 - RNA, 64 nt, Homo Sapiens
uuuguaagugacaaaacuccauuucuagguuacuuaugggcagacugcgggugacccccagcau

SEQ ID NO: 257965 - RNA, 64 nt, Homo Sapiens
augagcuaaaagcugugguauucauuaaggcaucuaugggcauugagguaguuuugaauggcau

SEQ ID NO: 257966 - RNA, 64 nt, Homo Sapiens
ggggggacccggcuggccccgccauuguccccacuaugggcagaguaugaagcauggagaagca

SEQ ID NO: 257967 - RNA, 64 nt, Homo Sapiens
aguguuugcuuucaaaugccauggguuacacuuuuaugggcaugacuauaaccauuuuuguaaa

SEQ ID NO: 257968 - RNA, 64 nt, Homo Sapiens
ggcacggggugucaggagggagagacagccuggguaugggcaagaaaugacuguaaauauuuca

SEQ ID NO: 257969 - RNA, 64 nt, Homo Sapiens
cacccagcaaaucccucucuaccucccaaggugauaugggcagcugcccaccacuccagaggua

SEQ ID NO: 257970 - RNA, 64 nt, Homo Sapiens
ugggaaaccuccagccucaaaucagcccagcagguaugggcaucggcugagagaagaaggaaga

SEQ ID NO: 257971 - RNA, 64 nt, Homo Sapiens
ucccaggccagcagcagcagccagaccacccagguaugggcagcucccccagaaucgacauagu

SEQ ID NO: 257972 - RNA, 64 nt, Homo Sapiens
gagauuucaaaaccugagcaugcucuccaucuuuuaugggcagaguugauguggauggcacucc

SEQ ID NO: 257973 - RNA, 64 nt, Homo Sapiens
accaugacuuucauugggcaaaaacucacugaauuaugggcaaauuucaagacacaagauuuug

SEQ ID NO: 257974 - RNA, 64 nt, Homo Sapiens
uuuaugcgaaauccaaaucauagaaaaguuuuuauaugggcaacaucagaauuucaauccacau

SEQ ID NO: 257975 - RNA, 64 nt, Homo Sapiens
uuaaaugaagcuaauaauucuguagaaggcacaauaugggcacucuuaauuguugaaagagaua

SEQ ID NO: 257976 - RNA, 64 nt, Homo Sapiens
gcuaucuuccccaaguggaaugcacuaggauguauaugggcaaagagaaacacuggcauggauu

SEQ ID NO: 257977 - RNA, 64 nt, Homo Sapiens
auuccaugccccucuccuaguggucaugguuucauaugggcauacaacugcuacugaaguuaua

SEQ ID NO: 257978 - RNA, 64 nt, Homo Sapiens
cacauuggauggcagcauggguuucuucccauuuuaugggcaugaaauaugugguuuagaauaa

SEQ ID NO: 257979 - RNA, 64 nt, Homo Sapiens
caaagaagacauguuuuagacaaauacucauguguaugggcaaaaaacucgaggacuguauuug

SEQ ID NO: 257980 - RNA, 64 nt, Homo Sapiens
agagauucucaaaugagaaaaagggcuccggcuauaugggcaacaaagagggaagauacagguu

SEQ ID NO: 257981 - RNA, 61 nt, Homo Sapiens
aggccugugggugcaguuagucuaugugugguaugggcagcccaagguugcaugggaaaac

SEQ ID NO: 257982 - RNA, 64 nt, Homo Sapiens
cauagaccauucuugaccaagcaagcaugcacauuaugggcaguuacauucucaaguuuuuaaa

SEQ ID NO: 257983 - RNA, 64 nt, Homo Sapiens
agguuucaaagauguagcuagcauuuugaaaccauaugggcaaaacccggcaaccagaagggga

SEQ ID NO: 257984 - RNA, 64 nt, Homo Sapiens
aucuuucaucacuaaaaauuuguuccuuuuucacuaugggcaguucacacaaggcaaaaacuau

SEQ ID NO: 257985 - RNA, 64 nt, Homo Sapiens
uuuugugaagcaacuauuuauuugaagaccaggguaugggcacuuuugccuucucuccucucug

SEQ ID NO: 257986 - RNA, 64 nt, Homo Sapiens
guaguuaaugaugguugaugggauuauuaacuaauaugggcauuguaguaguacuugaaaucua

SEQ ID NO: 257987 - RNA, 64 nt, Homo Sapiens
augguguagcaggcucacugaguuacaauaggcauaugggcaaacauugucucuugacaucaga

SEQ ID NO: 257988 - RNA, 64 nt, Homo Sapiens
uuguguucuuuaucacuucccaaaaccauacauuuaugggcaaaucaggauugacuuuuuucuc

SEQ ID NO: 257989 - RNA, 64 nt, Homo Sapiens
aggucuguaggucccuggugucuacuugugccacuaugggcacuagcucuugaggcuggaucuu

SEQ ID NO: 257990 - RNA, 64 nt, Homo Sapiens; identical to SEQ ID NO: 257979

SEQ ID NO: 257991 - RNA, 64 nt, Homo Sapiens
gugugcguuuuuacagcccuuuuuaggaacccaauaugggcauaaauguaacaccuguagcggg

SEQ ID NO: 257992 - RNA, 64 nt, Homo Sapiens
acgaaauacauaugcagugcuaugugcaaacagauaugggcaccuuucaaaaugaaauuccaua

SEQ ID NO: 257993 - RNA, 64 nt, Homo Sapiens
gacaaaucuguguauauuaucccuucacauuuuuuaugggcauuaaaccacucccaguccccag

SEQ ID NO: 257994 - RNA, 64 nt, Homo Sapiens
aacacaagagaaagcaaacuaucaagcacugcuuuaugggcagguacaaaaggugaacagcaaa

SEQ ID NO: 257995 - RNA, 64 nt, Homo Sapiens
agagagggaagccacugcaauugcuucuuccagguaugggcaccgauacgaagcaaaccuggga

SEQ ID NO: 257996 - RNA, 64 nt, Homo Sapiens
cgguaacagaaaccuccaucguuucaggccccuuuaugggcauauucuauucaaaucauauuug

SEQ ID NO: 257997 - RNA, 64 nt, Homo Sapiens
uguuguuugaagcauugcuaaggauuuguaggguuaugggcaguugaguaacuguuguuuugca

SEQ ID NO: 257998 - RNA, 64 nt, Homo Sapiens
gcauuguggguaauuggugcuuauuucuaucucuuaugggcaaaguuucuuccugugaguucca

SEQ ID NO: 257999 - RNA, 64 nt, Homo Sapiens
gaugggcaauggcacuacauggaaugggcaugaauaugggcaugccuuucuaggaccuaugagu

SEQ ID NO: 258000 - RNA, 64 nt, Homo Sapiens
aucaugugguuuugucgugugauuuuucugugucuaugggcauggguguuagguuuugucaagu

SEQ ID NO: 258001 - RNA, 64 nt, Homo Sapiens
gugcaaagacuccauagcugauuaauuuuuaggguaugggcacucuugagguuugguuuucauu

SEQ ID NO: 258002 - RNA, 64 nt, Homo Sapiens
uauuuucaacauuuccaauuuauuccacauagucuaugggcaaaauuucacacuuuaaugauaa

SEQ ID NO: 258003 - RNA, 64 nt, Homo Sapiens
auauauauagccuucuguaucagaguauguggaauaugggcaacuaaaaguaccaaacauaacc

SEQ ID NO: 258004 - RNA, 64 nt, Homo Sapiens
uuaccaaaauacuuccauauuuuuaaacucucacuaugggcacuuauagaaaacaggggcugcu

SEQ ID NO: 258005 - RNA, 64 nt, Homo Sapiens
aaccacuguaccugccucagucaggccugcccacuaugggcagaccucucgcucagccugcaga

SEQ ID NO: 258006 - RNA, 64 nt, Homo Sapiens
cugcuuucucugucuagaacagacgggugacaaguaugggcaggaggcauggggcaggguggcc

SEQ ID NO: 258007 - RNA, 64 nt, Homo Sapiens
gccccccaccaagcugagcccuggcucagucuacuaugggcaggccagcugccugcaggaagau

SEQ ID NO: 258008 - RNA, 64 nt, Homo Sapiens
ugacuacucuuaugauagcugaugccacagagccuaugggcaaaugccagacccaggguuagac

SEQ ID NO: 258009 - RNA, 64 nt, Homo Sapiens
uccagagaauugcuuuuguaaaugcuccacaacguaugggcaaaaguuuaaggacuacugccug

SEQ ID NO: 258010 - RNA, 64 nt, Homo Sapiens
cagcacccugcgggcccggggucuggcagagugguaugggcaccccaccccugggcuggggcca

SEQ ID NO: 258011 - RNA, 64 nt, Homo Sapiens
acugaaugauacuacacaguccucucccuauuaauaugggcacauucuugccaauuucacacuu

SEQ ID NO: 258012 - RNA, 64 nt, Homo Sapiens
ugcuucuggaaaacccuuccuacuucauucagaguaugggcaaagguuuggcuuggcaugaaaa

SEQ ID NO: 258013 - RNA, 64 nt, Homo Sapiens
gauggcgcucugggggccacgaucacacuccaaguaugggcaguugccauccccaaauagcuag

SEQ ID NO: 258014 - RNA, 51 nt, Homo Sapiens
agcuuaucauuaucaacaaaauaugggcaaaugguaaauaauuccacagaa

SEQ ID NO: 258015 - RNA, 64 nt, Homo Sapiens
agaaagagcagauuccuuuuauacuugacugaauuaugggcaggccauuguuugugggagaauu

SEQ ID NO: 258016 - RNA, 64 nt, Homo Sapiens
aacuggcuucugaaucccuuugucuagaauuaaguaugggcauauuaccagggcuuaaauguug

SEQ ID NO: 258017 - RNA, 64 nt, Homo Sapiens
cccaggagcccagccccggcugugccaucuuguguaugggcagauaugaccugacagcccccuc

SEQ ID NO: 258018 - RNA, 64 nt, Homo Sapiens
uucucauggccuguuuaugugcagagauuuuguuuaugggcagucacgagcaugucacagugcc

SEQ ID NO: 258019 - RNA, 64 nt, Homo Sapiens
ugcuugaggcuccagacauacuggucccagcagguaugggcaguuacucccugggcaccucggc

SEQ ID NO: 258020 - RNA, 64 nt, Homo Sapiens
gcucaucauaaauuauccaagagaagcacaaaguuaugggcacaaagguuuuccauauaauauu

SEQ ID NO: 258021 - RNA, 64 nt, Homo Sapiens
gccaguacugucugcccauuggcuccaggggcuguaugggcagauucagucuccagaggguauu

SEQ ID NO: 258022 - RNA, 64 nt, Homo Sapiens
uuuaucugucuuuuguucacuuuuuaaugcuauauaugggcaggggugagagacauuacugagc

SEQ ID NO: 258023 - RNA, 64 nt, Homo Sapiens
auccacccaccuuggccuuccaaaguggugggauuaugggcaggagccuccgugcccaggcugc

SEQ ID NO: 258024 - RNA, 64 nt, Homo Sapiens
gcuuuugugaucacacaccauuguuuguaggauguaugggcaaaggcccucaggaaggaggucu

SEQ ID NO: 258025 - RNA, 64 nt, Homo Sapiens
aucugcucucugugaccaaaaacaggaguccaauuaugggcagacaugcuucagugacauuguc

SEQ ID NO: 258026 - RNA, 64 nt, Homo Sapiens
ugccccuccuucuuacuuccgucugccccggggcuaugggcaaaccuggcccucgggacacauu

SEQ ID NO: 258027 - RNA, 64 nt, Homo Sapiens
gggacccugaucugggccuuccugucccagggccuaugggcaacugcguugaaaggacguucgc

SEQ ID NO: 258028 - RNA, 64 nt, Homo Sapiens
cuguauggagaccuuggaccagcaggggaagaucuaugggcaugggaggugggcguuggaaagg

SEQ ID NO: 258029 - RNA, 64 nt, Homo Sapiens
caggugugggccgaaccugaagcccugcccagaguaugggcacuggugaggucaggugccuccc

SEQ ID NO: 258030 - RNA, 64 nt, Homo Sapiens
caauccaagcagcugcuccaccgggcccucugccuaugggcacccucccuguccacaacugcag

SEQ ID NO: 258031 - RNA, 64 nt, Homo Sapiens
cuuguaggaguauaggccggucuaaagugagcucuaugggcagaucuaccccuuacuuauuauu

SEQ ID NO: 258032 - RNA, 64 nt, Homo Sapiens
ugucucugcuaagcaccauauaucagaugccuauuaugggcauauuccauguggaacaaacauu

SEQ ID NO: 258033 - RNA, 64 nt, Homo Sapiens
auaauauugugucaaacucucuaccagaauuucauaugggcagagaauacaccuggcacccugg

SEQ ID NO: 258034 - RNA, 62 nt, Homo Sapiens
cagaggugccuuugaugguggucucaccugcggagccgcacucuuuagccccggagcuccag

SEQ ID NO: 258035 - RNA, 62 nt, Homo Sapiens
uccggacgcugaagcugccguugccgcguguggagccgcagccuuucccccuggacuggccu

SEQ ID NO: 258036 - RNA, 62 nt, Homo Sapiens
cagccacaucuuccuagaccggugaaaaucaggagccgcacacugcgcugcagugagaccug

SEQ ID NO: 258037 - RNA, 62 nt, Homo Sapiens
ugcaucaaccuccuuuuaccguagaggacggugagccgcagcgucucuuugugucccccacu

SEQ ID NO: 258038 - RNA, 64 nt, Homo Sapiens
cccuaccacacucccaguaauugcaacugcucacaugagucaaaauacagcucauuacccuagc

SEQ ID NO: 258039 - RNA, 64 nt, Homo Sapiens
cagcucauuacccuagcccagugauuguuuaugcaugagucagucaaggguuucuuccuguucu

SEQ ID NO: 258040 - RNA, 64 nt, Homo Sapiens
cuuuuuggcagaauucagaagauuuuggaauucuaugagucaauacaaaauuauccaguugucu

SEQ ID NO: 258041 - RNA, 64 nt, Homo Sapiens
caccaggguauucugcauagagacuuccaucugaaugagucaguggagauucuuuuucccuuuu

SEQ ID NO: 258042 - RNA, 64 nt, Homo Sapiens; identical to SEQ ID NO: 184076

SEQ ID NO: 258043 - RNA, 64 nt, Homo Sapiens; identical to SEQ ID NO: 184077

SEQ ID NO: 258044 - RNA, 64 nt, Homo Sapiens; identical to SEQ ID NO: 184078

SEQ ID NO: 258045 - RNA, 64 nt, Homo Sapiens; identical to SEQ ID NO: 184079

SEQ ID NO: 258046 - RNA, 64 nt, Homo Sapiens; identical to SEQ ID NO: 184080

SEQ ID NO: 258047 - RNA, 64 nt, Homo Sapiens; identical to SEQ ID NO: 184081

SEQ ID NO: 258048 - RNA, 64 nt, Homo Sapiens; identical to SEQ ID NO: 184082

SEQ ID NO: 258049 - RNA, 64 nt, Homo Sapiens; identical to SEQ ID NO: 184083

SEQ ID NO: 258050 - RNA, 64 nt, Homo Sapiens; identical to SEQ ID NO: 184084

SEQ ID NO: 258051 - RNA, 64 nt, Homo Sapiens; identical to SEQ ID NO: 184085

SEQ ID NO: 258052 - RNA, 64 nt, Homo Sapiens; identical to SEQ ID NO: 184086

SEQ ID NO: 258053 - RNA, 64 nt, Homo Sapiens; identical to SEQ ID NO: 184087

SEQ ID NO: 258054 - RNA, 64 nt, Homo Sapiens; identical to SEQ ID NO: 184088

SEQ ID NO: 258055 - RNA, 64 nt, Homo Sapiens; identical to SEQ ID NO: 184089

SEQ ID NO: 258056 - RNA, 64 nt, Homo Sapiens; identical to SEQ ID NO: 184090

SEQ ID NO: 258057 - RNA, 64 nt, Homo Sapiens; identical to SEQ ID NO: 184091

SEQ ID NO: 258058 - RNA, 63 nt, Homo Sapiens; identical to SEQ ID NO: 57603

SEQ ID NO: 258059 - RNA, 64 nt, Homo Sapiens; identical to SEQ ID NO: 57604

SEQ ID NO: 258060 - RNA, 64 nt, Homo Sapiens; identical to SEQ ID NO: 57605

SEQ ID NO: 258061 - RNA, 64 nt, Homo Sapiens; identical to SEQ ID NO: 57606

SEQ ID NO: 258062 - RNA, 64 nt, Homo Sapiens; identical to SEQ ID NO: 57607

SEQ ID NO: 258063 - RNA, 64 nt, Homo Sapiens; identical to SEQ ID NO: 57608

SEQ ID NO: 258064 - RNA, 64 nt, Homo Sapiens; identical to SEQ ID NO: 57609

SEQ ID NO: 258065 - RNA, 64 nt, Homo Sapiens; identical to SEQ ID NO: 57610

SEQ ID NO: 258066 - RNA, 64 nt, Homo Sapiens; identical to SEQ ID NO: 57611

SEQ ID NO: 258067 - RNA, 64 nt, Homo Sapiens; identical to SEQ ID NO: 57612

SEQ ID NO: 258068 - RNA, 64 nt, Homo Sapiens; identical to SEQ ID NO: 57613

SEQ ID NO: 258069 - RNA, 64 nt, Homo Sapiens; identical to SEQ ID NO: 57614

SEQ ID NO: 258070 - RNA, 64 nt, Homo Sapiens
ugugaaauguuaacccucuaaaaguuguuaaacaacaugcuaaaaagucaggguuggcuuguga

SEQ ID NO: 258071 - RNA, 64 nt, Homo Sapiens
aggcaaauuucaagggaagaugauuaaaauaaugacaugcuaaaaccuaauuuucaguaagaag

SEQ ID NO: 258072 - RNA, 64 nt, Homo Sapiens
aagagaaccuucuuuuucucuugacuuugacagcacaugcuaaaaaucucuuccaagaaguaug

SEQ ID NO: 258073 - RNA, 64 nt, Homo Sapiens
guuuuagaauuucagauaguacuugcucagaaguacaugcuacucaagauauuaagagauaaca

SEQ ID NO: 258074 - RNA, 64 nt, Homo Sapiens
aucuuuuauuaaguucaguuacagugaaaaugagauccaccaacuuuuaggacauguacaugaa

SEQ ID NO: 258075 - RNA, 64 nt, Homo Sapiens
aucaacucagccucaggcauaagcgaggucagacauccaccagagacaguagaugagucugguu

SEQ ID NO: 258076 - RNA, 64 nt, Homo Sapiens
agagauaagaggacagaagaauggagaugggaaaauccaccaaauuccaacccaaacccaacuu

SEQ ID NO: 258077 - RNA, 64 nt, Homo Sapiens
ggagaagaggcagggucaggccucagcaucucacauccaccaccuccaggaggggagaccacug

SEQ ID NO: 258078 - RNA, 64 nt, Homo Sapiens
ccagccaccagcuaaaugccgagugaaauuuuggauccaccagacaccaagauaccagacauuu

SEQ ID NO: 258079 - RNA, 64 nt, Homo Sapiens
auaccagacauuugagugaaccugucuucuugacauccaccaaggggagaggcaccugcugaac

SEQ ID NO: 258080 - RNA, 62 nt, Homo Sapiens
auaaagcaaauuuggaggaaacaacugaaguugugcaauauuuucugauaauugcuuuuuuu

SEQ ID NO: 258081 - RNA, 62 nt, Homo Sapiens
uagaccccucuuccucucucccccaccauagugugcaauaaagugucuguucuuaccaaacc

SEQ ID NO: 258082 - RNA, 62 nt, Homo Sapiens
ugccguguaugaggagugcuagaaaaugcaaagugcaauauuuucccuaaccuucaaaugug

SEQ ID NO: 258083 - RNA, 62 nt, Homo Sapiens
gaccaagcaucuaucugauagaagcacauggagugcaauaggacauugugagaaggaauuuu

SEQ ID NO: 258084 - RNA, 62 nt, Homo Sapiens
cguauuuucuaggacaagaguucucagucacugugcaauaugcccccugggucccaggaggg

SEQ ID NO: 258085 - RNA, 62 nt, Homo Sapiens
gucucaguacaauccaaauuugucguagacuugugcaauauauacuguuguggguuggagaa

SEQ ID NO: 258086 - RNA, 62 nt, Homo Sapiens
uugugaugccuucccuccccuagaaagauuuugugcaauauauuaaauggggacagaauucu

SEQ ID NO: 258087 - RNA, 62 nt, Homo Sapiens
cucaguaagacagugcagugcucaguaaggcagugcaauacucaguaacaguguaguacuca

SEQ ID NO: 258088 - RNA, 62 nt, Homo Sapiens
aguacucaggaaugcagcacaguacucaggcagugcaauacucagugcgguacucaguaaca

SEQ ID NO: 258089 - RNA, 62 nt, Homo Sapiens
gaaauaauagggcauuuaacaaagaucgcuaugugcaauacuguauuuaguguuucuauuuc

SEQ ID NO: 258090 - RNA, 62 nt, Homo Sapiens
auuugcuuguaacaguuauucuugaaaucugagugcaauaggccuuuugcuggggcugccau

SEQ ID NO: 258091 - RNA, 62 nt, Homo Sapiens
cagagugucccuuuuugcagucccccaggauugugcaauaguuccccuugucccuggggcac

SEQ ID NO: 258092 - RNA, 62 nt, Homo Sapiens
acagcgauaauaaaauucucuacugggcauuagugcaauauaaagaauagaccaugggcuac

SEQ ID NO: 258093 - RNA, 62 nt, Homo Sapiens
uuaugcucagugagcaaauuaaaacugcucuugugcaauauuaaauugaauuuucuucagac

SEQ ID NO: 258094 - RNA, 62 nt, Homo Sapiens
guuguguaguuaaaugcauaaaauauuacuuugugcaauauuaaauagguuaaaucuuauau

SEQ ID NO: 258095 - RNA, 62 nt, Homo Sapiens
gugaucacaucuuuguuucuauguuucugggugugcaauagauucuaagaccagauucucua

SEQ ID NO: 258096 - RNA, 61 nt, Homo Sapiens
ugacuuuuaaccaaccaccaccuuacuguaagugcaauaguuggcauaucuaauaagauag

SEQ ID NO: 258097 - RNA, 62 nt, Homo Sapiens
gucuggcugggggcugucccggaacagagaaugugcaauaccucaguugagauuaaaaguaa

SEQ ID NO: 258098 - RNA, 62 nt, Homo Sapiens
caccaguuuugcccucugcccugcaauucacggugcaauauucggggugggggugagggccc

SEQ ID NO: 258099 - RNA, 62 nt, Homo Sapiens
uccccaccccucaguugacgcuaagauauacagugcaauagccucccuuccccaguuuuucu

SEQ ID NO: 258100 - RNA, 62 nt, Homo Sapiens
augauguuuuaagugugcaacacuggcuucuugugcaauaauaacugaccauuauaugccuu

SEQ ID NO: 258101 - RNA, 62 nt, Homo Sapiens
auauuuuuauguaaaaauaagucuuguuaagagugcaauauugaaaauaugcagaauaacug

SEQ ID NO: 258102 - RNA, 62 nt, Homo Sapiens
aaaggcacauaguuuaaaaaguuucucauuuugugcaauauaaucuaaauaaaguacagacc

SEQ ID NO: 258103 - RNA, 62 nt, Homo Sapiens
aaucaguuaagauaaagcugcauuguauauaagugcaauauauuuuugaaggucuguaaaug

SEQ ID NO: 258104 - RNA, 62 nt, Homo Sapiens
ugcuggggcugacuuguccagaaggggacaaagugcaauacagagccuucccuacccugacg

SEQ ID NO: 258105 - RNA, 62 nt, Homo Sapiens
gucuaugaaagaauaauuauaauaauguccaggugcaauacucuguaagucuauugguucaa

SEQ ID NO: 258106 - RNA, 62 nt, Homo Sapiens
guuucuugaauauauauuuuugaaguuuuuuugugcaauauauuacuaaaucaguuauuauu

SEQ ID NO: 258107 - RNA, 62 nt, Homo Sapiens
gaagagaaucccaaaaguuaguucaucuuaaagugcaauauuguuuaaucuuaaaacugggc

SEQ ID NO: 258108 - RNA, 62 nt, Homo Sapiens
ugcuauguugauguguaagugaaaucaguugugugcaauagacaggggcguauucaugggag

SEQ ID NO: 258109 - RNA, 62 nt, Homo Sapiens
gggacaucaucucuuccaucuuuggguccuuagugcaauaccuggcagcuagccagugcuca

SEQ ID NO: 258110 - RNA, 62 nt, Homo Sapiens
ccugguuacaacuugcugguggguuuuauguugugcaauacuaggaggaggaggcaggugau

SEQ ID NO: 258111 - RNA, 62 nt, Homo Sapiens
gucuugaugugcauagcuucugauaacccugugugcaauaauaugauuugcagggcauuucu

SEQ ID NO: 258112 - RNA, 62 nt, Homo Sapiens
acucaacagauguagugugacaaguauaauaugugcaauaaucauuguuucucuuaugauuu

SEQ ID NO: 258113 - RNA, 62 nt, Homo Sapiens
cucaacccaaauccaccuucauacuguaaguagugcaauacuuguuucauuucuguguuuaa

SEQ ID NO: 258114 - RNA, 62 nt, Homo Sapiens
guuucaacggaaagugcugucuuaaacuaaaugugcaauagaaggugauguugccauccuac

SEQ ID NO: 258115 - RNA, 62 nt, Homo Sapiens
cuuaaaacacugaccucuaugagguauuuacugugcaauaacugauucauuuuuuucagagc

SEQ ID NO: 258116 - RNA, 62 nt, Homo Sapiens
gaaucuuugauguuuuuugucauuguucucaagugcaauauaacaauguaaccaaaucuaga

SEQ ID NO: 258117 - RNA, 62 nt, Homo Sapiens
cauucagauagcaguaaaacauucuguaugaugugcaauaaaacauccaagaucuuuuuuga

SEQ ID NO: 258118 - RNA, 62 nt, Homo Sapiens
uggacaucuuuucucuuguguuuuguuugaaugugcaauaguuuauaggccacaaauaagcu

SEQ ID NO: 258119 - RNA, 62 nt, Homo Sapiens
uccuuucaccuggcaggggaugagaacagaaagugcaauauuaacuccuguccccuuaguca

SEQ ID NO: 258120 - RNA, 62 nt, Homo Sapiens
ggcccuguuggcaagaugagcaauauuaggcggugcaauagaauggugucuaacgagcagug

SEQ ID NO: 258121 - RNA, 62 nt, Homo Sapiens
aggcggugcaauagaggcccgucuaacgagcagugcaauauuacauggauaagugagauggu

SEQ ID NO: 258122 - RNA, 62 nt, Homo Sapiens
gguaacuugacucuuccaucuagccuccagaugugcaauaacggaauccaagugccuuucug

SEQ ID NO: 258123 - RNA, 62 nt, Homo Sapiens
uuacauguuguguauguuuuagccuuucucuugugcaauaauugcauuuuacgcaaacuuug

SEQ ID NO: 258124 - RNA, 62 nt, Homo Sapiens
agcuuauuguccauuaacauaaugaccuuucugugcaauaaaaauccccaaccucugacugc

SEQ ID NO: 258125 - RNA, 62 nt, Homo Sapiens
aauuaaaauauaucaaaucgaaggguguuauagugcaauagccccaaagaauuuucaaagga

SEQ ID NO: 258126 - RNA, 62 nt, Homo Sapiens
ugugcagaagaugagguauugucauaaugacugugcaauacauuuuucuugcuuugaacccu

SEQ ID NO: 258127 - RNA, 62 nt, Homo Sapiens
guaagcugaaucuuuuuugguauuucauccaagugcaauaauuuauacuacucuaaauagca

SEQ ID NO: 258128 - RNA, 62 nt, Homo Sapiens
ggcugaaccuggcccaacagcucaacaacaaagugcaauacaacaaugaaaaccaacaccaa

SEQ ID NO: 258129 - RNA, 62 nt, Homo Sapiens
guguaccucauggaugcuuucugcuuaucagugugcaauacuagugacaugcauucacauau

SEQ ID NO: 258130 - RNA, 62 nt, Homo Sapiens
uuuguuugacugcuugugucuuucuuuacccagugcaauagauguuugugugcaaaccaaac

SEQ ID NO: 258131 - RNA, 62 nt, Homo Sapiens
aaaagcucaauguacugcccaagaggcaccuugugcaauauucccaucccugaauuuagcau

SEQ ID NO: 258132 - RNA, 62 nt, Homo Sapiens
gaauagccaguauuuauguuuuuuauaaaacugugcaauacgaauuaugcaaucacaauaca

SEQ ID NO: 258133 - RNA, 62 nt, Homo Sapiens
cuuacggaaauacacaaaugcuucucuguaaugugcaauaugcuuugcaacuguagaugaua

SEQ ID NO: 258134 - RNA, 62 nt, Homo Sapiens
cuaugagauuuuuaaaaaauggggccgcugaugugcaauaucaaagugaacuugugaguauu

SEQ ID NO: 258135 - RNA, 62 nt, Homo Sapiens
accucucuuuugugacucuuguacagcuuaaugugcaauaaaggaaaaguuauaucugucuu

SEQ ID NO: 258136 - RNA, 62 nt, Homo Sapiens
ugagggaccaucagauaacuguauuuugucaggugcaauaaaaacaaaauuaaaacccaaau

SEQ ID NO: 258137 - RNA, 62 nt, Homo Sapiens
aauuuaaaaauuaauauuuucuuauagauauugugcaauaaagcugaaguagaauguguggu

SEQ ID NO: 258138 - RNA, 62 nt, Homo Sapiens
cuugaaugcuuugucaaauuaagaaaguuaaagugcaauaauguuugaagacaauaaguggu

SEQ ID NO: 258139 - RNA, 62 nt, Homo Sapiens
uuuauuuuuagggugauuuuuuaaaaagacuugugcaauacauuuugaggugaaacuuagug

SEQ ID NO: 258140 - RNA, 62 nt, Homo Sapiens
acaaguuugcaaauauuuuaacaauauuaaaugugcaauagaacuuuuauaaaauaauuaga

SEQ ID NO: 258141 - RNA, 62 nt, Homo Sapiens
gcacaucguccuguuuuauugcuuucuacccugugcaauauuagcaugcaagcuuggcuuac

SEQ ID NO: 258142 - RNA, 62 nt, Homo Sapiens
uggcauauuuuggaauucugcacauucauggagugcaauaauacuguauagcuuuccccacc

SEQ ID NO: 258143 - RNA, 62 nt, Homo Sapiens
ugauggugcauuuuauucuugaagugaaaucugugcaauaaaauaacagacugucugcaaaa

SEQ ID NO: 258144 - RNA, 62 nt, Homo Sapiens
ucaauucauagcaguaacuuuaagagggcauugugcaauaguuaguuguuuucuuguucagc

SEQ ID NO: 258145 - RNA, 62 nt, Homo Sapiens
ccuuuuuuuuuuuuuuauuucgguuguuugaugugcaauauguuuuuguaugcagguaguaa

SEQ ID NO: 258146 - RNA, 62 nt, Homo Sapiens
ggcauugauaaguucuguuauuggcuaguaaagugcaauaaacuaauuccaaccuucuaaau

SEQ ID NO: 258147 - RNA, 62 nt, Homo Sapiens
ggcgggcagucgcugcaggguguagugaccaagugcaauaugcaggaggaggauugugcuga

SEQ ID NO: 258148 - RNA, 62 nt, Homo Sapiens
uauaguguuauuuguuucacaagauuuuagaagugcaauauuuugugugaagaugucaaaaa

SEQ ID NO: 258149 - RNA, 62 nt, Homo Sapiens
uuuaaaaugugcucccaggauuaaaaaaaucugugcaauaauuuaaaaaaaauaaauaaaaa

SEQ ID NO: 258150 - RNA, 62 nt, Homo Sapiens
uuauguggaugaagagcauuuuuuaugcuuuugugcaauagguuccaauaugcauuuauuag

SEQ ID NO: 258151 - RNA, 62 nt, Homo Sapiens
agggcacuccccuguuuccuaagaacgaaaaagugcaauaaaggccauucguuaccuacuuu

SEQ ID NO: 258152 - RNA, 62 nt, Homo Sapiens
ccauggaguugugcaaagcuauggcuuccuuggugcaauauucuuaaaaccugcuuugcaua

SEQ ID NO: 258153 - RNA, 62 nt, Homo Sapiens
aaggcugacuaaccucgauucuguguugugaugugcaauacuguuucuaauguuuguauaaa

SEQ ID NO: 258154 - RNA, 62 nt, Homo Sapiens
uaaaagcaacaaaagggauaccauguagaauugugcaauagucuagccagcuagccuuaaca

SEQ ID NO: 258155 - RNA, 62 nt, Homo Sapiens
uccuuaauaagaaaaguaauuuuuacucugaugugcaauacauuuguuauuaaauuuauuau

SEQ ID NO: 258156 - RNA, 62 nt, Homo Sapiens
cacaguguauucagacagauacagugaaccaagugcaauauguaaggaugaaagaagaagag

SEQ ID NO: 258157 - RNA, 62 nt, Homo Sapiens
gauggaguuucgcuguuguugcccaggcuggagugcaauagcacgaucuuggcucaccgcaa

SEQ ID NO: 258158 - RNA, 62 nt, Homo Sapiens
ucuuggagaauuuggaugccugcuugccuucugugcaauauuggccucuuucccagcuuucu

SEQ ID NO: 258159 - RNA, 62 nt, Homo Sapiens
uauuuguguuauuaacuacauauggaggagaugugcaauaaauuaguuaauauaugugaaag

SEQ ID NO: 258160 - RNA, 62 nt, Homo Sapiens
guuccuuucuaaccauuucuaugauugacuuggugcaauaaaugugaacugcaaacuugcuu

SEQ ID NO: 258161 - RNA, 62 nt, Homo Sapiens
uguaaaucuacuugacacuggcagaaugauaagugcaauaguucaguuuuggccuucuguca

SEQ ID NO: 258162 - RNA, 62 nt, Homo Sapiens
auguguuuuuucauguuagucuuauaacuuaagugcaauaaaucacuuagaaauuuuauuuu

SEQ ID NO: 258163 - RNA, 62 nt, Homo Sapiens
gcauagauucuauaaauucuaguuucuauauagugcaauagaaucaguauaacugcauuucu

SEQ ID NO: 258164 - RNA, 62 nt, Homo Sapiens
aaacuuaauaaaauuuuaugaacuauacuugagugcaauaaacguuuauucucuucagcuuu

SEQ ID NO: 258165 - RNA, 62 nt, Homo Sapiens
uugcugggauguuucugcccacgguuuuguuugugcaauaacguuaucacauuucuaaugag

SEQ ID NO: 258166 - RNA, 62 nt, Homo Sapiens
uuuucuauguaaauauugaaaacuuaugauuugugcaauaacucagauauuuuuuauuuaau

SEQ ID NO: 258167 - RNA, 62 nt, Homo Sapiens
uaaaguaaaaugccuuauauauuaaagaguaagugcaauaauaugaaauagccuguacauuu

SEQ ID NO: 258168 - RNA, 62 nt, Homo Sapiens
acaguacuguuucuggacccuuauaaaauccugugcaauagacacauacaugucacauuuag

SEQ ID NO: 258169 - RNA, 62 nt, Homo Sapiens
auuugccuuauuuuugcaucucacaaacauaagugcaauagaucuuuucauugaacagcaaa

SEQ ID NO: 258170 - RNA, 62 nt, Homo Sapiens
uuuaaguuugcagauuuauuuagugaaggcaagugcaauaauccuuccucagaugauguuug

SEQ ID NO: 258171 - RNA, 62 nt, Homo Sapiens
accugaaacugguaagacaagcacaaagcaacgugcaauacaaaaaucguaucucaagggaa

SEQ ID NO: 258172 - RNA, 62 nt, Homo Sapiens
gcaagaauuucuuuuaaauaaaaaguuugggggugcaauauaagaaguuuauauaauaugca

SEQ ID NO: 258173 - RNA, 62 nt, Homo Sapiens
aucauuggcuuuuauaccuuucuugguuugacgugcaauaaagaagcacauuauuuuagcuu

SEQ ID NO: 258174 - RNA, 62 nt, Homo Sapiens
uauaugcacauaauaaccuguaccuauaaaucgugcaauaaccauaugcgacuauuuugcca

SEQ ID NO: 258175 - RNA, 62 nt, Homo Sapiens
ugaugaauuguggcaaguuaacuucaaguuaugugcaauacuuauuucaaacuuuugaaaga

SEQ ID NO: 258176 - RNA, 62 nt, Homo Sapiens
ccuauuuguaggugaguugucuccgcucuguggugcaauaucagucucacaguuggugauuu

SEQ ID NO: 258177 - RNA, 62 nt, Homo Sapiens
uuguggccacuggaaaucccacagaccucucugugcaauaaccuguaagagucuggcuuaga

SEQ ID NO: 258178 - RNA, 62 nt, Homo Sapiens
aaagguguauguauguuuugugugugaaagaugugcaauaacauauuauacauacacaaguu

SEQ ID NO: 258179 - RNA, 62 nt, Homo Sapiens
aaauguuugcuuuauagauuuagcaaaacaaagugcaauauuaaaaguaaaauccaaaaugu

SEQ ID NO: 258180 - RNA, 62 nt, Homo Sapiens
uacacaugucaacuugaugguaggggauauuugugcaauaaauuauaauaaccucccaguuc

SEQ ID NO: 258181 - RNA, 62 nt, Homo Sapiens
aacauacuaguacagauuuuugaaaauguuaagugcaauaaaauaugucuuaauuuugaguu

SEQ ID NO: 258182 - RNA, 62 nt, Homo Sapiens
uagcuacaaacuucugugcauugguguuuucagugcaauaaaaaggggcguuuguuuuauuc

SEQ ID NO: 258183 - RNA, 62 nt, Homo Sapiens
cagccccagguagggaggggagguguuguuuugugcaauauaacuaugaucugauggccucu

SEQ ID NO: 258184 - RNA, 62 nt, Homo Sapiens
cuaggaauugagccaggagauccagcuaaauggugcaauagggauaccuaagcacuagaaua

SEQ ID NO: 258185 - RNA, 62 nt, Homo Sapiens
gauacagcucucuucagaguuucuccacuacugugcaauagaacauggggaucagagcagac

SEQ ID NO: 258186 - RNA, 62 nt, Homo Sapiens
auugccugagcccaggaguucaagaccagcuugugcaauauagggagacuccggcucuacaa

SEQ ID NO: 258187 - RNA, 62 nt, Homo Sapiens
gggaugucgggagaccuagaugaccuuaucgggugcaauacuagcuaagguaaagcuagaaa

SEQ ID NO: 258188 - RNA, 62 nt, Homo Sapiens
uuguuuuuaaacuuuuuuuugccauccauccugugcaauaugccguguagaauauuugucuu

SEQ ID NO: 258189 - RNA, 62 nt, Homo Sapiens
acauugauuuuuuuuuuuucguuuucuuucuugugcaauaccuacaauggugcuguguuuua

SEQ ID NO: 258190 - RNA, 62 nt, Homo Sapiens
gaaaaaaacugcaucccaucacccaaaguucugugcaauagaaauuucuacagauacaggua

SEQ ID NO: 258191 - RNA, 62 nt, Homo Sapiens
agcuugauaugguguuucagugcuuauugguugugcaauaaugguuauagccuguuagauaa

SEQ ID NO: 258192 - RNA, 62 nt, Homo Sapiens
uucugugccaauagagucugcuuuuuuagcaugugcaauacuugucccauuucauucucuug

SEQ ID NO: 258193 - RNA, 62 nt, Homo Sapiens
uguguaauguagaauguggggcauugaaacuugugcaauauccagacugcauuaguauuuug

SEQ ID NO: 258194 - RNA, 62 nt, Homo Sapiens
cuugacuccuuggugcuaaaaaacccauuuuggugcaauauuauuaacuagguaugaaguau

SEQ ID NO: 258195 - RNA, 62 nt, Homo Sapiens
aaaugaucuugauccauuucauguaagcagaugugcaauaaaucugcccaaaagcagcagac

SEQ ID NO: 258196 - RNA, 62 nt, Homo Sapiens
uauagcauacuuugacauuuccuagcagaaaagugcaauaugcauggaagauacuagcccag

SEQ ID NO: 258197 - RNA, 62 nt, Homo Sapiens
guagaauucuauauugauaaaaacuggacauugugcaauaaacagcauagcugaaaguugcc

SEQ ID NO: 258198 - RNA, 62 nt, Homo Sapiens
gucuuaagaaauaauugccauuaaggacuuuugugcaauaugagcauaacuuauaucuguau

SEQ ID NO: 258199 - RNA, 62 nt, Homo Sapiens
uaaaaauguaucaaauguauguaccuggauuugugcaauauggcgcaucagauagucucugu

SEQ ID NO: 258200 - RNA, 62 nt, Homo Sapiens
uuugggaugucagcaguggccugaagugaguugugcaauaaauguuaaguugaaaccuccuu

SEQ ID NO: 258201 - RNA, 62 nt, Homo Sapiens
aaaagagaaaaagaaggauugaucagagcauugugcaauacaguuucauuaacuccuucccc

SEQ ID NO: 258202 - RNA, 62 nt, Homo Sapiens
accagccaguaauuucugugcaaccuuacuaugugcaauauuuuuaaauccugagaaaugug

SEQ ID NO: 258203 - RNA, 62 nt, Homo Sapiens
caaagaaggguugauaaaaguucacuugcauugugcaauaagggagggauauccccuuggau

SEQ ID NO: 258204 - RNA, 62 nt, Homo Sapiens
ucauuuaaucuguaaagguuuuuuuuuaaucugugcaauaccuuuuuguugccuuuuuugcu

SEQ ID NO: 258205 - RNA, 62 nt, Homo Sapiens
uggaauguuaccuguccguguuacauaaucaagugcaauauacucaguucucaugcagguga

SEQ ID NO: 258206 - RNA, 62 nt, Homo Sapiens
aauaaauuaaaaacaguauuugggggagaaacgugcaauagcguaaugguggugucccugcc

SEQ ID NO: 258207 - RNA, 62 nt, Homo Sapiens
uaaauuuauuuuaacguagacacuaaaaguaugugcaauauacaauuaaaguaggaauuugu

SEQ ID NO: 258208 - RNA, 62 nt, Homo Sapiens
cuguuggucucucuguguucuuuguuacuugggugcaauagcaacuucccuaccccgugcau

SEQ ID NO: 258209 - RNA, 62 nt, Homo Sapiens
ccaugggggcuccagacauuguauuuuacuuugugcaauaugaggggacugcaugcaagcuc

SEQ ID NO: 258210 - RNA, 62 nt, Homo Sapiens
aucugcuaccugauuuuauccuggagaauacagugcaauauuucucuuugauuauuuauucc

SEQ ID NO: 258211 - RNA, 62 nt, Homo Sapiens
cauucauuccuguuaagcugccaaaaauuaaagugcaauauuguauauuuuuaagaacaaau

SEQ ID NO: 258212 - RNA, 62 nt, Homo Sapiens
accuguagguggagcaaguaauaagccaugcugugcaauauauacauaaagcuucugcuucu

SEQ ID NO: 258213 - RNA, 62 nt, Homo Sapiens
uuguguauuagauaucaaugagauaucucaaugugcaauaacagaauguuauccaacuauua

SEQ ID NO: 258214 - RNA, 62 nt, Homo Sapiens
auacagaagaauucucuauaauuaaauguugagugcaauaaaaaauaauguaaaugucuucu

SEQ ID NO: 258215 - RNA, 62 nt, Homo Sapiens
aaugacuuccuuggcgguuuuccucauguauugugcaauaacgcuuuuggaaaagcuccagg

SEQ ID NO: 258216 - RNA, 62 nt, Homo Sapiens
aagaaaauagcucuuuaaaaaaauuaaccuuugugcaauaccuacuugccuggauugcuuua

SEQ ID NO: 258217 - RNA, 62 nt, Homo Sapiens
ggugcauguaauaauguugacagaacagaugugugcaauauuagaagaugauuuuaacaguu

SEQ ID NO: 258218 - RNA, 62 nt, Homo Sapiens
acccuugccucaucaguuuuccugauuuacaagugcaauauuuuagccaaugccuugggaga

SEQ ID NO: 258219 - RNA, 62 nt, Homo Sapiens
auauaucaucaguuagcaauuccaaaaagaaggugcaauaucuaaaucuccaacuugcuguu

SEQ ID NO: 258220 - RNA, 62 nt, Homo Sapiens
uuguacaaugguuuauucccgugguuucagaugugcaauaaucagacagucuguuaugcacu

SEQ ID NO: 258221 - RNA, 62 nt, Homo Sapiens
uacaauaaaauuugucauaauuuuucaauguggugcaauauacucauucaugauguugauuu

SEQ ID NO: 258222 - RNA, 62 nt, Homo Sapiens
cugacucccaaaguuaguuacggcuuguugaggugcaauacccaaucacaaacuaaagacug

SEQ ID NO: 258223 - RNA, 62 nt, Homo Sapiens
augaucucggcucacugcaagcccaggcuggagugcaauagcgauggaguuucacucuuguu

SEQ ID NO: 258224 - RNA, 62 nt, Homo Sapiens
cuuuuugauuaaagcucuucaauucaucuguggugcaauacaucuugaaaacugcuguagca

SEQ ID NO: 258225 - RNA, 62 nt, Homo Sapiens
aggccaaauuuaaucuuugauccuuugaaccugugcaauauguucccccccaaaugguugcg

SEQ ID NO: 258226 - RNA, 62 nt, Homo Sapiens
gcugccacacacuacaggagucaauaaacaaggugcaauauuuucaaaucguuggccggcua

SEQ ID NO: 258227 - RNA, 62 nt, Homo Sapiens
uuguuuuuaagacucauggacauuucauaccugugcaauacugaagaccucauucugucaug

SEQ ID NO: 258228 - RNA, 62 nt, Homo Sapiens
ucugaaccgaauguuuuggacuuaacuguugcgugcaauaugaccgucggcacacugcuguu

SEQ ID NO: 258229 - RNA, 62 nt, Homo Sapiens
agagauaccagaaugcugguauucuacuacuugugcaauauauauguuuuaaaaaacaaauu

SEQ ID NO: 258230 - RNA, 62 nt, Homo Sapiens
aagacguagaaauguaaaauaaaauaauuuuagugcaauaugaucaacuaguucuuccaugu

SEQ ID NO: 258231 - RNA, 62 nt, Homo Sapiens
ugagcuuagaguuaggaauuaaacugugugaugugcaauaacuuccagccugaagccugcuu

SEQ ID NO: 258232 - RNA, 62 nt, Homo Sapiens
aacauagauccuaaaggaucgggcugagccaugugcaauaagcuugguagaugucccuagac

SEQ ID NO: 258233 - RNA, 62 nt, Homo Sapiens
guuuguacuguuuguauaaaauuuguuguuaugugcaauacugcuauaaccuaaccucgacu

SEQ ID NO: 258234 - RNA, 62 nt, Homo Sapiens
ugaauauuuuguugcauuguacaucacuguuugugcaauauauuguuagcaucuuuguaugc

SEQ ID NO: 258235 - RNA, 62 nt, Homo Sapiens
gcugcuucgauuugguuuccauguacuuaauggugcaauaaagcacugucuuugaugcagug

SEQ ID NO: 258236 - RNA, 62 nt, Homo Sapiens
acagccugucauugaaucuauguuuuuguauggugcaauaugcugaaagcuuugaugaaauu

SEQ ID NO: 258237 - RNA, 62 nt, Homo Sapiens
guugagugagcugcuaugacuuugguagagaggugcaauauguuuuuugaaccagcuauaaa

SEQ ID NO: 258238 - RNA, 62 nt, Homo Sapiens
aaaauugucugaaauguuuauuuugcaaaacagugcaauagaaucuaguuaugccuucauca

SEQ ID NO: 258239 - RNA, 62 nt, Homo Sapiens
accuccuuauguauucucaauuaccuguauuugugcaauaaauuggaauaauguaacuugau

SEQ ID NO: 258240 - RNA, 62 nt, Homo Sapiens
ggucuggaccccacggggcuggggagggccaugugcaauauuuggaggguuuucuggagggc

SEQ ID NO: 258241 - RNA, 62 nt, Homo Sapiens
accuuuggugggggcagggccugguggcaccugugcaauaaugucuguguuucucucccacc

SEQ ID NO: 258242 - RNA, 62 nt, Homo Sapiens
agauauauuauuugcagcaagaaguucauucugugcaauauggacauguuugcaaaccauac

SEQ ID NO: 258243 - RNA, 62 nt, Homo Sapiens
uaaucuuucgcaagugauuucacugauaaauugugcaauaaaucuguguuauucuuaguacc

SEQ ID NO: 258244 - RNA, 62 nt, Homo Sapiens
aauagcuaauuuauuucccccuguggguagaugugcaauagaagauuuagaucuggaccagg

SEQ ID NO: 258245 - RNA, 62 nt, Homo Sapiens
uucccauggaaugcagcagucuucggccaccugugcaauauuuacuuuugucagaaucaagg

SEQ ID NO: 258246 - RNA, 62 nt, Homo Sapiens
cucugugugugauugcaggaguaaauaaaagagugcaauaauaugcuuuaucuguguuuucu

SEQ ID NO: 258247 - RNA, 62 nt, Homo Sapiens
gcaacaucucugaauccuuuagcagaaauauagugcaauaguacucagaaacgagaucggga

SEQ ID NO: 258248 - RNA, 62 nt, Homo Sapiens
ugagagaauguauuuucauaagaaauacucaugugcaauaggaauugcacugaacagaauua

SEQ ID NO: 258249 - RNA, 62 nt, Homo Sapiens
aguauuuguuuuaccuuugggauuuuauaaaugugcaauaaaaaaauugauacaacuaugca

SEQ ID NO: 258250 - RNA, 62 nt, Homo Sapiens
gguuauguuucuauguggugacccagcgccgugugcaauaaaaccuuuuucuaugaaaaaag

SEQ ID NO: 258251 - RNA, 62 nt, Homo Sapiens
gugaaggcugucugcccagagaugugcuauuagugcaauaaguccuguagcuugauauuaca

SEQ ID NO: 258252 - RNA, 62 nt, Homo Sapiens
ggagguauaacccugcuccucucucccagucugugcaauaaaggucgugaagaucucucagc

SEQ ID NO: 258253 - RNA, 62 nt, Homo Sapiens
agauauauguauauaaaguguaugcuguauuggugcaauaaugguaauuaaaaauaugaaaa

SEQ ID NO: 258254 - RNA, 62 nt, Homo Sapiens
ugaguuuuuuauuuuuaaguguuuguuuuucagugcaauaauuuuugugugugugugauucu

SEQ ID NO: 258255 - RNA, 62 nt, Homo Sapiens
gggcugccagcaguacgugggaaagguggaaugugcaauaggaacagaucugugcauuuugu

SEQ ID NO: 258256 - RNA, 62 nt, Homo Sapiens
gcgaacaucacaccguuccccgaccaagccgugugcaauacaacagagggaggcagguggga

SEQ ID NO: 258257 - RNA, 62 nt, Homo Sapiens
augggguggaacacagcauuuugucaagcacugugcaauauuccauauuuuuccccacuaug

SEQ ID NO: 258258 - RNA, 62 nt, Homo Sapiens
uaaucuuuuacgggugggaggugagauugauagugcaauaaucagugaucuauagacccuca

SEQ ID NO: 258259 - RNA, 62 nt, Homo Sapiens
caucaaaccucacauuugugaacucaaacgaugugcaauacauuuuuuucucuuuccuugaa

SEQ ID NO: 258260 - RNA, 62 nt, Homo Sapiens
aauuuagggagaaauguuguggagagguuaaggugcaauaagagaguagaagauuugaugcu

SEQ ID NO: 258261 - RNA, 62 nt, Homo Sapiens
auguauuuguuuguauuuugaaauauuuuuaugugcaauaaaauacuucaauacuucauuua

SEQ ID NO: 258262 - RNA, 62 nt, Homo Sapiens
ucaauacuucauuuaaaauacaauucuauuacgugcaauacugguuugugacuuuccuaaau

SEQ ID NO: 258263 - RNA, 62 nt, Homo Sapiens
ugauguggcaaaucucuauuguguuggaaaaugugcaauauguauuugcaagacauagaaua

SEQ ID NO: 258264 - RNA, 62 nt, Homo Sapiens
uucaaagaaaagaaaacacauaauaaaauauugugcaauauagacauaaaaccuuuuuuuaa

SEQ ID NO: 258265 - RNA, 62 nt, Homo Sapiens
gaggucuccacaccagaugucugggacguugugugcaauagauggguggagaguggagugcg

SEQ ID NO: 258266 - RNA, 62 nt, Homo Sapiens
gugggguaggggcagggaaaacaugauuugaugugcaauaggccauccccauagccauguuu

SEQ ID NO: 258267 - RNA, 62 nt, Homo Sapiens
uaauauguagaaauuuaaguccaguacucugggugcaauaaaucacagaaagugcauuuuaa

SEQ ID NO: 258268 - RNA, 62 nt, Homo Sapiens
ucugacccagugcccccacuacucuguugcaagugcaauaaagacacccaggacuuauuuaa

SEQ ID NO: 258269 - RNA, 62 nt, Homo Sapiens
cauuuauuucuuauaugaaucuuucacuguuugugcaauaugauugcuugguggaacauaug

SEQ ID NO: 258270 - RNA, 62 nt, Homo Sapiens
uugcaaacagcucuucuuaggauucaaauuaagugcaauauuggagacaucaggucccccug

SEQ ID NO: 258271 - RNA, 62 nt, Homo Sapiens
ugaauuuccuggccuacuuccugccaagcaucgugcaauaagaaaucagcgucauuuguucc

SEQ ID NO: 258272 - RNA, 62 nt, Homo Sapiens
cuauuuuuugguaaagauuuuccuuaaauuuugugcaauaaaauguaagugugcuugggaau

SEQ ID NO: 258273 - RNA, 62 nt, Homo Sapiens
uucuuuuuuuuuuuuuuuguguagaaaaauaggugcaauaaugaucaaaguuuugaugucuu

SEQ ID NO: 258274 - RNA, 62 nt, Homo Sapiens
gacaugcagugaaaugguucuuuguuaaaaaugugcaauaaaaauagauuacaauaaguagu

SEQ ID NO: 258275 - RNA, 62 nt, Homo Sapiens
uuguugagaggaaaagugaauugguuaaaagagugcaauaaggauccaaauacagugacuuu

SEQ ID NO: 258276 - RNA, 62 nt, Homo Sapiens
gguuguuuucuguuaagcaaagccgagauccagugcaauaccuggacugucaccguccugug

SEQ ID NO: 258277 - RNA, 61 nt, Homo Sapiens
uguaaaaaaaaaaaaagauaugagaaaucucugugcaauaauaaaaacugaagaacauuga

SEQ ID NO: 258278 - RNA, 62 nt, Homo Sapiens
gagugugccucauuaucuugaauuuuaaugaagugcaauacuuagguuaaguuugagccuga

SEQ ID NO: 258279 - RNA, 62 nt, Homo Sapiens
gagauguauacagucuuuacguacauaaaaaugugcaauaugcacuuuaauguuuuauucuu

SEQ ID NO: 258280 - RNA, 62 nt, Homo Sapiens
uuguauauuuauucuauuuuguauauuguuaagugcaauaaaguuuuugccuugcuuuauuu

SEQ ID NO: 258281 - RNA, 62 nt, Homo Sapiens
cugauguacacacauuucauuauuugccaauggugcaauaaccacugcugaccaacccacua

SEQ ID NO: 258282 - RNA, 62 nt, Homo Sapiens
cugguuuuaauuuuuaguugugcuuugagucagugcaauaaacuagacuuuuuccaaaccug

SEQ ID NO: 258283 - RNA, 62 nt, Homo Sapiens
uauuuggagaaacaggaguguucacuuaucuagugcaauauguucacaguuuauuaaugcuu

SEQ ID NO: 258284 - RNA, 62 nt, Homo Sapiens
uuauucuccauaauuaaacuuugaauaauaaagugcaauacuguuggcuacaucauuuugug

SEQ ID NO: 258285 - RNA, 62 nt, Homo Sapiens
auaaaacucugaaauuaagagcuguuccuuuagugcaauacagaaaauuguauaaccauccu

SEQ ID NO: 258286 - RNA, 62 nt, Homo Sapiens
uucuauuauguccguugauauguuugaguucugugcaauauuuauuuuguuuauuauuuuca

SEQ ID NO: 258287 - RNA, 62 nt, Homo Sapiens
uguaugauuauccagaacuauuacugauuuuagugcaauaucaauaaauaccagguaugaaa

SEQ ID NO: 258288 - RNA, 62 nt, Homo Sapiens
uaacaugucuaaaguuagggucuuuuuugagugugcaauaugguuuucuaaauguuucuuuu

SEQ ID NO: 258289 - RNA, 62 nt, Homo Sapiens
uucuguauuuauuggguuuuagccuuuuaacugugcaauaauuaaggcaguacaaauugugg

SEQ ID NO: 258290 - RNA, 62 nt, Homo Sapiens
cuguaggaagaaucaaaucaccgauuuaaagagugcaauauauaauaaucauuuuuaaagua

SEQ ID NO: 258291 - RNA, 62 nt, Homo Sapiens
ccuuuuccuguggaaaccugucauagaauuuugugcaauauguaugugucuaugaagcuguc

SEQ ID NO: 258292 - RNA, 62 nt, Homo Sapiens
agucagagucucgcucucuuguccaggcuggagugcaauagcgcgaucugggcucacugcaa

SEQ ID NO: 258293 - RNA, 62 nt, Homo Sapiens
cauacucuuuguauauauuuauuauaugaaaggugcaauauuuuauuuuguacaguauguaa

SEQ ID NO: 258294 - RNA, 62 nt, Homo Sapiens
cuguuuaaacugugauuuucuuuauuguguuggugcaauauuuuauuaucauuuaaccucag

SEQ ID NO: 258295 - RNA, 62 nt, Homo Sapiens
caguguauucuguuuuuaaaacugugccugcagugcaauacuccuucugguguauuuuaucc

SEQ ID NO: 258296 - RNA, 62 nt, Homo Sapiens
ucugugauugugccuaugcagggacauacuuugugcaauauuguaccucucauuuucaguca

SEQ ID NO: 258297 - RNA, 62 nt, Homo Sapiens
ccaagauuacccucggucauucaucacagcaugugcaauauggaggaucaccagugcauccu

SEQ ID NO: 258298 - RNA, 62 nt, Homo Sapiens
gcuacuguauuugucucaaagcuaccaaguuugugcaauaaguggaagggaugucauccuuc

SEQ ID NO: 258299 - RNA, 62 nt, Homo Sapiens
gaauaugugcuuuuacuguacauagugcuauugugcaauaggucuuaugcuguuuucacuca

SEQ ID NO: 258300 - RNA, 62 nt, Homo Sapiens
cccgccccuugccucgauauugccaguuucuugugcaauaaacaaucagcagcugugggugg

SEQ ID NO: 258301 - RNA, 62 nt, Homo Sapiens
ugcugggccuccugcccgcgcugcugcuccccgugcaauacccgcccgcggguccuccccac

SEQ ID NO: 258302 - RNA, 62 nt, Homo Sapiens
ggagugacccagcuacugaaucuaggaacucagugcaauacgugugcguggcuaucaggagu

SEQ ID NO: 258303 - RNA, 62 nt, Homo Sapiens
cacaguguuuuuauugcucgcccagacaccaugugcaauaagauugguguucguuuccauca

SEQ ID NO: 258304 - RNA, 62 nt, Homo Sapiens
gagacaaaggaggaauuuacuuucuucaccaagugcaauagauuacugaugugauauucugu

SEQ ID NO: 258305 - RNA, 62 nt, Homo Sapiens
cuucucagugguuuacaugccucugaaacuaugugcaauauuuuugguugacacuuguaucc

SEQ ID NO: 258306 - RNA, 62 nt, Homo Sapiens
agaaacaaacauugaauuacuaaacaaagauggugcaauaucuuuguuuuuuuuuuaugagg

SEQ ID NO: 258307 - RNA, 62 nt, Homo Sapiens
uaccuucaacaugugcucgcucugcaugauuagugcaauaaaacucccuuccuuaugcauac

SEQ ID NO: 258308 - RNA, 62 nt, Homo Sapiens
gggugguugggagagaaacuagaacagaagaugugcaauagggcucagagcagccccaggaa

SEQ ID NO: 258309 - RNA, 62 nt, Homo Sapiens
guugcguugaggccgcaucuuucuucagcagcgugcaauagcuggcuccucuauaggagaug

SEQ ID NO: 258310 - RNA, 62 nt, Homo Sapiens
cugugacucucuuggaaaugccuugacugaaugugcaauauuugugucucuugguuucuaac

SEQ ID NO: 258311 - RNA, 62 nt, Homo Sapiens
ggagugucucacaggauugcacucauuucuaagugcaauaaguuugucaguuuguuugccuu

SEQ ID NO: 258312 - RNA, 62 nt, Homo Sapiens
guguuuuuauuuaaaaccaauuugugggauuugugcaauaaauggacccagggccugagacc

SEQ ID NO: 258313 - RNA, 62 nt, Homo Sapiens
uuagauacucagcagaaguaaagucugaagaagugcaauaugugugucagaacauucagaag

SEQ ID NO: 258314 - RNA, 62 nt, Homo Sapiens
guccucgugccugcugcucaaccuaaccacacgugcaauaaaugcagcuguaggucgucauc

SEQ ID NO: 258315 - RNA, 62 nt, Homo Sapiens
uagcugcuaacaagacuggcgaaugaaaggcagugcaauauuuuggacccugacuguauaca

SEQ ID NO: 258316 - RNA, 62 nt, Homo Sapiens
ugaaaaaaacgguauaaaaguguaccuauauugugcaauacuguaaucguaaauauuaauuu

SEQ ID NO: 258317 - RNA, 62 nt, Homo Sapiens
aaaccuuccuuuuuaagaaguuguaaaagucagugcaauaacuucuaaauuacuaugucagg

SEQ ID NO: 258318 - RNA, 62 nt, Homo Sapiens
uaaaggcuaaggacuagauguuuauaauuguugugcaauaacacguguccuggucacugguc

SEQ ID NO: 258319 - RNA, 62 nt, Homo Sapiens
ccccuucccuuuuuuuguuauuuuuucagacugugcaauacuuagagaaccuauagcaucuu

SEQ ID NO: 258320 - RNA, 62 nt, Homo Sapiens
gaugauuucuuuucccugcacacaucuuuccggugcaauaucuaucaauugugaaucuggcu

SEQ ID NO: 258321 - RNA, 62 nt, Homo Sapiens
cugcuugcagcaacuugauuuccccaaguccugugcaauagccccaggauuggauuccuuca

SEQ ID NO: 258322 - RNA, 62 nt, Homo Sapiens
aaguguuuuggaauuugaaguguucaaggagggugcaauauuaaaccaauuuuuuuaguuau

SEQ ID NO: 258323 - RNA, 62 nt, Homo Sapiens
auguaauuaauucaaguccuagccaauuuauagugcaauaaacauuuggguauaaugacaac

SEQ ID NO: 258324 - RNA, 62 nt, Homo Sapiens
guggcccccguccgaggaggaucguuuucuaagugcaauacuuggcccgccggcuucccgcu

SEQ ID NO: 258325 - RNA, 62 nt, Homo Sapiens
auccuccuugacgaguuuuguuuuucaaaauggugcaauaauuuaaguggcaucuucucucc

SEQ ID NO: 258326 - RNA, 62 nt, Homo Sapiens
cccccuuccccagaacaaaacauguugaucaugugcaauauuucuuacugugccgagaagcc

SEQ ID NO: 258327 - RNA, 60 nt, Homo Sapiens
auguuggagaaaaaccuuagugaugugauggugcaauaaagucuucacucagucuucaug

SEQ ID NO: 258328 - RNA, 62 nt, Homo Sapiens
ucuccgguaacccguccaccucuuccaaaacagugcaauaaacugguccuuagccccaugcc

SEQ ID NO: 258329 - RNA, 62 nt, Homo Sapiens
cccauugccaugggguccuuaaaccuggcucagugcaauacugacacguccccguucccccg

SEQ ID NO: 258330 - RNA, 62 nt, Homo Sapiens
uuaaaggaagcaaccaccuuuuauuuucuauugugcaauaucuuuuaaggauugacaagagu

SEQ ID NO: 258331 - RNA, 62 nt, Homo Sapiens
guggaaaccaaacugcuccaaggccggaccacgugcaauaggagccuccugauuucauaacc

SEQ ID NO: 258332 - RNA, 62 nt, Homo Sapiens
aaauaaaaggccagcgggcggacucaccugaagugcaauacggcacucgccucccuaccaau

SEQ ID NO: 258333 - RNA, 62 nt, Homo Sapiens
cuggaauaaauauaaaugaaggugagagaagugugcaauagucuucuaagacccacgagcgg

SEQ ID NO: 258334 - RNA, 62 nt, Homo Sapiens
gagggacgucuucuauuuuuuauaggguccaugugcaauaggcucagccaggugggccugua

SEQ ID NO: 258335 - RNA, 62 nt, Homo Sapiens
uugacuuaaacuuguuuagcacaugagaacaggugcaauauacugucuaauauaggaaaaac

SEQ ID NO: 258336 - RNA, 62 nt, Homo Sapiens
ggugcccacagaggcucagcuccuucuuuucugugcaauacgagacccggccgcaccccgag

SEQ ID NO: 258337 - RNA, 62 nt, Homo Sapiens
cacaacaaaaacccaaguuuucugugcuacaugugcaauauuuguuaugaauguuaucacaa

SEQ ID NO: 258338 - RNA, 62 nt, Homo Sapiens
uuucauguccauucaagugacuuuuauucugagugcaauauuucaauagccuuguagugaua

SEQ ID NO: 258339 - RNA, 62 nt, Homo Sapiens
aaacccgcaucugcucacggaugcugcagucugugcaauaaugguuggguuugggguucagg

SEQ ID NO: 258340 - RNA, 62 nt, Homo Sapiens
uugucuuuuguauaggucauuaucuaaauuuagugcaauaucuauuaaauucaaauauccca

SEQ ID NO: 258341 - RNA, 62 nt, Homo Sapiens
cuuccuaguaccugagugagaguuaaggagcugugcaauaacacucugcccugaccccgauc

SEQ ID NO: 258342 - RNA, 62 nt, Homo Sapiens
aagucacccucaauaaauaccaauagacguuagugcaauacaucaaucacaacagguaauag

SEQ ID NO: 258343 - RNA, 62 nt, Homo Sapiens
uugcugucagccacauauugagaugacacuaggugcaauagcagggauagauuuuguuggug

SEQ ID NO: 258344 - RNA, 62 nt, Homo Sapiens
cuacaaauagugcuaauaaaguuaaauugcacgugcaauacggaacacugucaauggacugc

SEQ ID NO: 258345 - RNA, 62 nt, Homo Sapiens
ucauuguaagugcacugauaguauuucauuaugugcaauaaggcuaagagaauugggcauua

SEQ ID NO: 258346 - RNA, 62 nt, Homo Sapiens
ggaggcugacuguagggcuguugggugaaguugugcaauauuguccaacaagaacaccugac

SEQ ID NO: 258347 - RNA, 62 nt, Homo Sapiens
cuuuccacuggaguucacuuucaauugcuucugugcaauaaaaccaagugcuuauaaaauga

SEQ ID NO: 258348 - RNA, 62 nt, Homo Sapiens
uagcccagauacacauacucuuuuuugucuuugugcaauaaucaguguuccuggcagagccu

SEQ ID NO: 258349 - RNA, 62 nt, Homo Sapiens
acuccagagcuccuuuaacaucugcuaauuaagugcaauaaauuuuucuagaaaauggcaaa

SEQ ID NO: 258350 - RNA, 62 nt, Homo Sapiens
uuggaaugggacauugguguauucagaauguugugcaauauuaauacaaucaaggguuuugu

SEQ ID NO: 258351 - RNA, 62 nt, Homo Sapiens
cucucuguugugagaucuucagcuaccucauggugcaauaacacacacacgcuuaaccaugu

SEQ ID NO: 258352 - RNA, 62 nt, Homo Sapiens
guggcauaggaagacggcaaaaauuuccuaaagugcaauagauuuucaaguguauugugccu

SEQ ID NO: 258353 - RNA, 62 nt, Homo Sapiens
uguacaguauuuuuuguuguuuuuaucaucaugugcaauauuacugauuuguuuccaugcug

SEQ ID NO: 258354 - RNA, 62 nt, Homo Sapiens
cucuacucuuuaguagaguucgagacacagaagugcaauaacugcccuaauuaagcaacuau

SEQ ID NO: 258355 - RNA, 62 nt, Homo Sapiens
acgcuugguuuuucucagaacccccaaaagaugugcaauagcuguuguuacaaaccaccaaa

SEQ ID NO: 258356 - RNA, 62 nt, Homo Sapiens
uuggauuuuauguugacauuuguuugguuauagugcaauauauuuuguaugcaagcaguuuc

SEQ ID NO: 258357 - RNA, 62 nt, Homo Sapiens
ucgaucucggcucacugcaagcccaggcuggagugcaauagcgauggaguuucacucuuguu

SEQ ID NO: 258358 - RNA, 62 nt, Homo Sapiens
cuuuaaagcuaucaacaaaauagaugaaaagcgugcaauaugauaguuguuuacuagugugc

SEQ ID NO: 258359 - RNA, 62 nt, Homo Sapiens
cuuaaauacuacugcucuaaacacagaauugugugcaauauugaaacugaggguuaucuuug

SEQ ID NO: 258360 - RNA, 62 nt, Homo Sapiens
ucagcaguuaaauaguggaauuuuuuuacaaugugcaauaacuuguaauaggcauuuuuuuu

SEQ ID NO: 258361 - RNA, 62 nt, Homo Sapiens
augaugucugcucuagggaaaaugacacaucugugcaauagagcaacuuucuauaaugccaa

SEQ ID NO: 258362 - RNA, 62 nt, Homo Sapiens
augcagcauuaacuuuacugacauggagugaagugcaauauuauaaauauuauagauuaaaa

SEQ ID NO: 258363 - RNA, 62 nt, Homo Sapiens; identical to SEQ ID NO: 258353

SEQ ID NO: 258364 - RNA, 62 nt, Homo Sapiens; identical to SEQ ID NO: 258354

SEQ ID NO: 258365 - RNA, 62 nt, Homo Sapiens
auggcauaagaaguugacaaaaauuucuuaaagugcaauagauuuucaaguguauugugccu

SEQ ID NO: 258366 - RNA, 62 nt, Homo Sapiens
aagggacuuaauuacaaacuuaagacguaagugugcaauaaaguaagcuaagaagaaaauau

SEQ ID NO: 258367 - RNA, 63 nt, Homo Sapiens
cauaaagcaaauuuggaggaaacaacugaaguugugcaauauuuucugauaauugcuuuuuuu

SEQ ID NO: 258368 - RNA, 63 nt, Homo Sapiens
cuagaccccucuuccucucucccccaccauagugugcaauaaagugucuguucuuaccaaacc

SEQ ID NO: 258369 - RNA, 63 nt, Homo Sapiens
uugccguguaugaggagugcuagaaaaugcaaagugcaauauuuucccuaaccuucaaaugug

SEQ ID NO: 258370 - RNA, 63 nt, Homo Sapiens
agaccaagcaucuaucugauagaagcacauggagugcaauaggacauugugagaaggaauuuu

SEQ ID NO: 258371 - RNA, 63 nt, Homo Sapiens; identical to SEQ ID NO: 87681

SEQ ID NO: 258372 - RNA, 63 nt, Homo Sapiens; identical to SEQ ID NO: 87682

SEQ ID NO: 258373 - RNA, 63 nt, Homo Sapiens
uuugugaugccuucccuccccuagaaagauuuugugcaauauauuaaauggggacagaauucu

SEQ ID NO: 258374 - RNA, 63 nt, Homo Sapiens; identical to SEQ ID NO: 87683

SEQ ID NO: 258375 - RNA, 63 nt, Homo Sapiens; identical to SEQ ID NO: 87684

SEQ ID NO: 258376 - RNA, 63 nt, Homo Sapiens
ugaaauaauagggcauuuaacaaagaucgcuaugugcaauacuguauuuaguguuucuauuuc

SEQ ID NO: 258377 - RNA, 63 nt, Homo Sapiens
auuugcuuguaacaguuauuucuugaaaucugagugcaauaggcccuuuugcuggggcugcca

SEQ ID NO: 258378 - RNA, 63 nt, Homo Sapiens
cagagugucccuuuuugcagcucccccaggauugugcaauaguuuccccuugucccuggggca

SEQ ID NO: 258379 - RNA, 63 nt, Homo Sapiens
acagcgauaauaaaauucuccuacugggcauuagugcaauauaaaagaauagaccaugggcua

SEQ ID NO: 258380 - RNA, 63 nt, Homo Sapiens
uuaugcucagugagcaaauucaaaacugcucuugugcaauauuaaaauugaauuuucuucaga

SEQ ID NO: 258381 - RNA, 63 nt, Homo Sapiens
guuguguaguuaaaugcauauaaauauuacuuugugcaauauugaaauagguuaaaucuuaua

SEQ ID NO: 258382 - RNA, 63 nt, Homo Sapiens
gugaucacaucuuuguuucuaauguuucugggugugcaauagaauucuaagaccagauucucu

SEQ ID NO: 258383 - RNA, 61 nt, Homo Sapiens; identical to SEQ ID NO: 258096

SEQ ID NO: 258384 - RNA, 63 nt, Homo Sapiens
gucuggcugggggcugucccaggaacagagaaugugcaauaccgucaguugagauuaaaagua

SEQ ID NO: 258385 - RNA, 63 nt, Homo Sapiens; identical to SEQ ID NO: 87685

SEQ ID NO: 258386 - RNA, 63 nt, Homo Sapiens; identical to SEQ ID NO: 87686

SEQ ID NO: 258387 - RNA, 63 nt, Homo Sapiens
augauguuuuaagugugcaaucacuggcuucuugugcaauaaugaacugaccauuauaugccu

SEQ ID NO: 258388 - RNA, 63 nt, Homo Sapiens
auauuuuuauguaaaaauaaggucuuguuaagagugcaauauuagaaaauaugcagaauaacu

SEQ ID NO: 258389 - RNA, 63 nt, Homo Sapiens
aaaaggcacauaguuuaaaaaguuucucauuuugugcaauauaaucuaaauaaaguacagacc

SEQ ID NO: 258390 - RNA, 63 nt, Homo Sapiens
aaaucaguuaagauaaagcugcauuguauauaagugcaauauauuuuugaaggucuguaaaug

SEQ ID NO: 258391 - RNA, 63 nt, Homo Sapiens
cugcuggggcugacuuguccagaaggggacaaagugcaauacagagccuucccuacccugacg

SEQ ID NO: 258392 - RNA, 63 nt, Homo Sapiens
agucuaugaaagaauaauuauaauaauguccaggugcaauacucuguaagucuauugguucaa

SEQ ID NO: 258393 - RNA, 63 nt, Homo Sapiens
uguuucuugaauauauauuuuugaaguuuuuuugugcaauauauuacuaaaucaguuauuauu

SEQ ID NO: 258394 - RNA, 63 nt, Homo Sapiens
ugaagagaaucccaaaaguuaguucaucuuaaagugcaauauuguuuaaucuuaaaacugggc

SEQ ID NO: 258395 - RNA, 63 nt, Homo Sapiens
uugcuauguugauguguaagugaaaucaguugugugcaauagacaggggcguauucaugggag

SEQ ID NO: 258396 - RNA, 63 nt, Homo Sapiens
agggacaucaucucuuccaucuuuggguccuuagugcaauaccuggcagcuagccagugcuca

SEQ ID NO: 258397 - RNA, 63 nt, Homo Sapiens
accugguuacaacuugcugguggguuuuauguugugcaauacuaggaggaggaggcaggugau

SEQ ID NO: 258398 - RNA, 63 nt, Homo Sapiens
ggucuugaugugcauagcuucugauaacccugugugcaauaauaugauuugcagggcauuucu

SEQ ID NO: 258399 - RNA, 63 nt, Homo Sapiens
cacucaacagauguagugugacaaguauaauaugugcaauaaucauuguuucucuuaugauuu

SEQ ID NO: 258400 - RNA, 63 nt, Homo Sapiens
ccucaacccaaauccaccuucauacuguaaguagugcaauacuuguuucauuucuguguuuaa

SEQ ID NO: 258401 - RNA, 63 nt, Homo Sapiens
uguuucaacggaaagugcugucuuaaacuaaaugugcaauagaaggugauguugccauccuac

SEQ ID NO: 258402 - RNA, 63 nt, Homo Sapiens
ucuuaaaacacugaccucuaugagguauuuacugugcaauaacugauucauuuuuuucagagc

SEQ ID NO: 258403 - RNA, 63 nt, Homo Sapiens
ugaaucuuugauguuuuuugucauuguucucaagugcaauauaacaauguaaccaaaucuaga

SEQ ID NO: 258404 - RNA, 63 nt, Homo Sapiens
ccauucagauagcaguaaaacauucuguaugaugugcaauaaaacauccaagaucuuuuuuga

SEQ ID NO: 258405 - RNA, 63 nt, Homo Sapiens
uuggacaucuuuucucuuguguuuuguuugaaugugcaauaguuuauaggccacaaauaagcu

SEQ ID NO: 258406 - RNA, 63 nt, Homo Sapiens
uccuuucaccuggcaggggaaugagaacagaaagugcaauauugaacuccuguccccuuaguc

SEQ ID NO: 258407 - RNA, 63 nt, Homo Sapiens; identical to SEQ ID NO: 87687

SEQ ID NO: 258408 - RNA, 63 nt, Homo Sapiens; identical to SEQ ID NO: 87688

SEQ ID NO: 258409 - RNA, 63 nt, Homo Sapiens
gguaacuugacucuuccaucguagccuccagaugugcaauaacaggaauccaagugccuuucu

SEQ ID NO: 258410 - RNA, 63 nt, Homo Sapiens
uuacauguuguguauguuuugagccuuucucuugugcaauaauuugcauuuuacgcaaacuuu

SEQ ID NO: 258411 - RNA, 63 nt, Homo Sapiens
agcuuauuguccauuaacaucaaugaccuuucugugcaauaaacaauccccaaccucugacug

SEQ ID NO: 258412 - RNA, 63 nt, Homo Sapiens
aauuaaaauauaucaaaucgaaaggguguuauagugcaauagcacccaaagaauuuucaaagg

SEQ ID NO: 258413 - RNA, 63 nt, Homo Sapiens
ugugcagaagaugagguauuugucauaaugacugugcaauacaauuuuucuugcuuugaaccc

SEQ ID NO: 258414 - RNA, 63 nt, Homo Sapiens
guaagcugaaucuuuuuuggauauuucauccaagugcaauaauauuauacuacucuaaauagc

SEQ ID NO: 258415 - RNA, 63 nt, Homo Sapiens
ggcugaaccuggcccaacagacucaacaacaaagugcaauacaaacaaugaaaaccaacacca

SEQ ID NO: 258416 - RNA, 63 nt, Homo Sapiens
guguaccucauggaugcuuuucugcuuaucagugugcaauacuaagugacaugcauucacaua

SEQ ID NO: 258417 - RNA, 63 nt, Homo Sapiens
uuuguuugacugcuuguguccuuucuuuacccagugcaauagauuguuugugugcaaaccaaa

SEQ ID NO: 258418 - RNA, 63 nt, Homo Sapiens
caaaagcucaauguacugcccaagaggcaccuugugcaauauucccaucccugaauuuagcau

SEQ ID NO: 258419 - RNA, 63 nt, Homo Sapiens
agaauagccaguauuuauguuuuuuauaaaacugugcaauacgaauuaugcaaucacaauaca

SEQ ID NO: 258420 - RNA, 63 nt, Homo Sapiens
acuuacggaaauacacaaaugcuucucuguaaugugcaauaugcuuugcaacuguagaugaua

SEQ ID NO: 258421 - RNA, 63 nt, Homo Sapiens; identical to SEQ ID NO: 87689

SEQ ID NO: 258422 - RNA, 63 nt, Homo Sapiens; identical to SEQ ID NO: 87690

SEQ ID NO: 258423 - RNA, 63 nt, Homo Sapiens
uugagggaccaucagauaacuguauuuugucaggugcaauaaaaacaaaauuaaaacccaaau

SEQ ID NO: 258424 - RNA, 63 nt, Homo Sapiens
uaauuuaaaaauuaauauuuucuuauagauauugugcaauaaagcugaaguagaauguguggu

SEQ ID NO: 258425 - RNA, 63 nt, Homo Sapiens
ucuugaaugcuuugucaaauuaagaaaguuaaagugcaauaauguuugaagacaauaaguggu

SEQ ID NO: 258426 - RNA, 63 nt, Homo Sapiens
auuuauuuuuagggugauuuuuuaaaaagacuugugcaauacauuuugaggugaaacuuagug

SEQ ID NO: 258427 - RNA, 63 nt, Homo Sapiens
uacaaguuugcaaauauuuuaacaauauuaaaugugcaauagaacuuuuauaaaauaauuaga

SEQ ID NO: 258428 - RNA, 63 nt, Homo Sapiens
agcacaucguccuguuuuauugcuuucuacccugugcaauauuagcaugcaagcuuggcuuac

SEQ ID NO: 258429 - RNA, 63 nt, Homo Sapiens
cuggcauauuuuggaauucugcacauucauggagugcaauaauacuguauagcuuuccccacc

SEQ ID NO: 258430 - RNA, 63 nt, Homo Sapiens
cugauggugcauuuuauucuugaagugaaaucugugcaauaaaauaacagacugucugcaaaa

SEQ ID NO: 258431 - RNA, 63 nt, Homo Sapiens
aucaauucauagcaguaacuuuaagagggcauugugcaauaguuaguuguuuucuuguucagc

SEQ ID NO: 258432 - RNA, 63 nt, Homo Sapiens
uccuuuuuuuuuuuuuuauuucgguuguuugaugugcaauauguuuuuguaugcagguaguaa

SEQ ID NO: 258433 - RNA, 63 nt, Homo Sapiens
ggcauugauaaguucuguuauuuggcuaguaaagugcaauaaaacuaauuccaaccuucuaaa

SEQ ID NO: 258434 - RNA, 63 nt, Homo Sapiens
ggcgggcagucgcugcagggauguagugaccaagugcaauaugccaggaggaggauugugcug

SEQ ID NO: 258435 - RNA, 63 nt, Homo Sapiens
uauaguguuauuuguuucacaaagauuuuagaagugcaauauuguugugugaagaugucaaaa

SEQ ID NO: 258436 - RNA, 63 nt, Homo Sapiens
uuuaaaaugugcucccaggaauuaaaaaaaucugugcaauaauuuuaaaaaaaauaaauaaaa

SEQ ID NO: 258437 - RNA, 63 nt, Homo Sapiens
uuuauguggaugaagagcauuuuuuaugcuuuugugcaauagguuccaauaugcauuuauuag

SEQ ID NO: 258438 - RNA, 63 nt, Homo Sapiens
cagggcacuccccuguuuccuaagaacgaaaaagugcaauaaaggccauucguuaccuacuuu

SEQ ID NO: 258439 - RNA, 63 nt, Homo Sapiens
uccauggaguugugcaaagcuauggcuuccuuggugcaauauucuuaaaaccugcuuugcaua

SEQ ID NO: 258440 - RNA, 63 nt, Homo Sapiens
gaaggcugacuaaccucgauucuguguugugaugugcaauacuguuucuaauguuuguauaaa

SEQ ID NO: 258441 - RNA, 63 nt, Homo Sapiens
uuaaaagcaacaaaagggauaccauguagaauugugcaauagucuagccagcuagccuuaaca

SEQ ID NO: 258442 - RNA, 63 nt, Homo Sapiens
uuccuuaauaagaaaaguaauuuuuacucugaugugcaauacauuuguuauuaaauuuauuau

SEQ ID NO: 258443 - RNA, 63 nt, Homo Sapiens
gcacaguguauucagacagauacagugaaccaagugcaauauguaaggaugaaagaagaagag

SEQ ID NO: 258444 - RNA, 63 nt, Homo Sapiens
ggauggaguuucgcuguuguugcccaggcuggagugcaauagcacgaucuuggcucaccgcaa

SEQ ID NO: 258445 - RNA, 63 nt, Homo Sapiens
ucuuggagaauuuggaugccuugcuugccuucugugcaauauugggccucuuucccagcuuuc

SEQ ID NO: 258446 - RNA, 63 nt, Homo Sapiens
uauuuguguuauuaacuacaguauggaggagaugugcaauaaaauuaguuaauauaugugaaa

SEQ ID NO: 258447 - RNA, 63 nt, Homo Sapiens
guuccuuucuaaccauuucuuaugauugacuuggugcaauaaacugugaacugcaaacuugcu

SEQ ID NO: 258448 - RNA, 63 nt, Homo Sapiens
uguaaaucuacuugacacugagcagaaugauaagugcaauaguuucaguuuuggccuucuguc

SEQ ID NO: 258449 - RNA, 63 nt, Homo Sapiens
auguguuuuuucauguuaguucuuauaacuuaagugcaauaaauucacuuagaaauuuuauuu

SEQ ID NO: 258450 - RNA, 63 nt, Homo Sapiens
gcauagauucuauaaauucuuaguuucuauauagugcaauagacaucaguauaacugcauuuc

SEQ ID NO: 258451 - RNA, 63 nt, Homo Sapiens
aaacuuaauaaaauuuuauguaacuauacuugagugcaauaaaacguuuauucucuucagcuu

SEQ ID NO: 258452 - RNA, 63 nt, Homo Sapiens
auugcugggauguuucugcccacgguuuuguuugugcaauaacguuaucacauuucuaaugag

SEQ ID NO: 258453 - RNA, 63 nt, Homo Sapiens
uuuuucuauguaaauauugaaaacuuaugauuugugcaauaacucagauauuuuuuauuuaau

SEQ ID NO: 258454 - RNA, 63 nt, Homo Sapiens
guaaaguaaaaugccuuauauauuaaagaguaagugcaauaauaugaaauagccuguacauuu

SEQ ID NO: 258455 - RNA, 63 nt, Homo Sapiens
uacaguacuguuucuggacccuuauaaaauccugugcaauagacacauacaugucacauuuag

SEQ ID NO: 258456 - RNA, 63 nt, Homo Sapiens
cauuugccuuauuuuugcaucucacaaacauaagugcaauagaucuuuucauugaacagcaaa

SEQ ID NO: 258457 - RNA, 63 nt, Homo Sapiens
uuuuaaguuugcagauuuauuuagugaaggcaagugcaauaauccuuccucagaugauguuug

SEQ ID NO: 258458 - RNA, 63 nt, Homo Sapiens
aaccugaaacugguaagacaagcacaaagcaacgugcaauacaaaaaucguaucucaagggaa

SEQ ID NO: 258459 - RNA, 63 nt, Homo Sapiens
ugcaagaauuucuuuuaaauaaaaaguuugggggugcaauauaagaaguuuauauaauaugca

SEQ ID NO: 258460 - RNA, 63 nt, Homo Sapiens
aaucauuggcuuuuauaccuuucuugguuugacgugcaauaaagaagcacauuauuuuagcuu

SEQ ID NO: 258461 - RNA, 63 nt, Homo Sapiens
uuauaugcacauaauaaccuguaccuauaaaucgugcaauaaccauaugcgacuauuuugcca

SEQ ID NO: 258462 - RNA, 63 nt, Homo Sapiens
gugaugaauuguggcaaguuaacuucaaguuaugugcaauacuuauuucaaacuuuugaaaga

SEQ ID NO: 258463 - RNA, 63 nt, Homo Sapiens
ccuauuuguaggugaguuguucuccgcucuguggugcaauaucaagucucacaguuggugauu

SEQ ID NO: 258464 - RNA, 63 nt, Homo Sapiens; identical to SEQ ID NO: 87691

SEQ ID NO: 258465 - RNA, 63 nt, Homo Sapiens; identical to SEQ ID NO: 87692

SEQ ID NO: 258466 - RNA, 63 nt, Homo Sapiens
aaauguuugcuuuauagauuuuagcaaaacaaagugcaauauugaaaaguaaaauccaaaaug

SEQ ID NO: 258467 - RNA, 63 nt, Homo Sapiens; identical to SEQ ID NO: 87693

SEQ ID NO: 258468 - RNA, 63 nt, Homo Sapiens; identical to SEQ ID NO: 87694

SEQ ID NO: 258469 - RNA, 63 nt, Homo Sapiens
uagcuacaaacuucugugcacuugguguuuucagugcaauaaagaaggggcguuuguuuuauu

SEQ ID NO: 258470 - RNA, 63 nt, Homo Sapiens
cagccccagguagggagggguagguguuguuuugugcaauauagacuaugaucugauggccuc

SEQ ID NO: 258471 - RNA, 63 nt, Homo Sapiens
cuaggaauugagccaggagaauccagcuaaauggugcaauaggagauaccuaagcacuagaau

SEQ ID NO: 258472 - RNA, 63 nt, Homo Sapiens
gauacagcucucuucagagucuucuccacuacugugcaauagacacauggggaucagagcaga

SEQ ID NO: 258473 - RNA, 63 nt, Homo Sapiens
aauugccugagcccaggaguucaagaccagcuugugcaauauagggagacuccggcucuacaa

SEQ ID NO: 258474 - RNA, 63 nt, Homo Sapiens
ugggaugucgggagaccuagaugaccuuaucgggugcaauacuagcuaagguaaagcuagaaa

SEQ ID NO: 258475 - RNA, 63 nt, Homo Sapiens
uuuguuuuuaaacuuuuuuuugccauccauccugugcaauaugccguguagaauauuugucuu

SEQ ID NO: 258476 - RNA, 63 nt, Homo Sapiens
gacauugauuuuuuuuuuuucguuuucuuucuugugcaauaccuacaauggugcuguguuuua

SEQ ID NO: 258477 - RNA, 63 nt, Homo Sapiens
ugaaaaaaacugcaucccaucacccaaaguucugugcaauagaaauuucuacagauacaggua

SEQ ID NO: 258478 - RNA, 63 nt, Homo Sapiens
uagcuugauaugguguuucagugcuuauugguugugcaauaaugguuauagccuguuagauaa

SEQ ID NO: 258479 - RNA, 63 nt, Homo Sapiens
uucugugccaauagagucuggcuuuuuuagcaugugcaauacuuugucccauuucauucucuu

SEQ ID NO: 258480 - RNA, 63 nt, Homo Sapiens
uguguaauguagaaugugggggcauugaaacuugugcaauaucccagacugcauuaguauuuu

SEQ ID NO: 258481 - RNA, 63 nt, Homo Sapiens
cuugacuccuuggugcuaaauaaacccauuuuggugcaauauuuauuaacuagguaugaagua

SEQ ID NO: 258482 - RNA, 63 nt, Homo Sapiens
aaaugaucuugauccauuuccauguaagcagaugugcaauaaacucugcccaaaagcagcaga

SEQ ID NO: 258483 - RNA, 63 nt, Homo Sapiens
uauagcauacuuugacauuugccuagcagaaaagugcaauaugccauggaagauacuagccca

SEQ ID NO: 258484 - RNA, 63 nt, Homo Sapiens
guagaauucuauauugauaacaaacuggacauugugcaauaaaacagcauagcugaaaguugc

SEQ ID NO: 258485 - RNA, 63 nt, Homo Sapiens
gucuuaagaaauaauugccauuuaaggacuuuugugcaauauguagcauaacuuauaucugua

SEQ ID NO: 258486 - RNA, 63 nt, Homo Sapiens
uaaaaauguaucaaauguauuguaccuggauuugugcaauaugggcgcaucagauagucucug

SEQ ID NO: 258487 - RNA, 63 nt, Homo Sapiens
uuuugggaugucagcaguggccugaagugaguugugcaauaaauguuaaguugaaaccuccuu

SEQ ID NO: 258488 - RNA, 63 nt, Homo Sapiens
caaaagagaaaaagaaggauugaucagagcauugugcaauacaguuucauuaacuccuucccc

SEQ ID NO: 258489 - RNA, 63 nt, Homo Sapiens
aaccagccaguaauuucugugcaaccuuacuaugugcaauauuuuuaaauccugagaaaugug

SEQ ID NO: 258490 - RNA, 63 nt, Homo Sapiens
caaagaaggguugauaaaaguuucacuugcauugugcaauaaguggagggauauccccuugga

SEQ ID NO: 258491 - RNA, 63 nt, Homo Sapiens
ucauuuaaucuguaaagguuuuuuuuuuaaucugugcaauaccauuuuuguugccuuuuuugc

SEQ ID NO: 258492 - RNA, 63 nt, Homo Sapiens
auggaauguuaccuguccguguuacauaaucaagugcaauauacucaguucucaugcagguga

SEQ ID NO: 258493 - RNA, 63 nt, Homo Sapiens
gaauaaauuaaaaacaguauuugggggagaaacgugcaauagcguaaugguggugucccugcc

SEQ ID NO: 258494 - RNA, 63 nt, Homo Sapiens
uuaaauuuauuuuaacguagacacuaaaaguaugugcaauauacaauuaaaguaggaauuugu

SEQ ID NO: 258495 - RNA, 63 nt, Homo Sapiens
ccuguuggucucucuguguucuuuguuacuugggugcaauagcaacuucccuaccccgugcau

SEQ ID NO: 258496 - RNA, 63 nt, Homo Sapiens
cccaugggggcuccagacauuguauuuuacuuugugcaauaugaggggacugcaugcaagcuc

SEQ ID NO: 258497 - RNA, 63 nt, Homo Sapiens
caucugcuaccugauuuuauccuggagaauacagugcaauauuucucuuugauuauuuauucc

SEQ ID NO: 258498 - RNA, 63 nt, Homo Sapiens
ucauucauuccuguuaagcugccaaaaauuaaagugcaauauuguauauuuuuaagaacaaau

SEQ ID NO: 258499 - RNA, 63 nt, Homo Sapiens
uaccuguagguggagcaaguaauaagccaugcugugcaauauauacauaaagcuucugcuucu

SEQ ID NO: 258500 - RNA, 63 nt, Homo Sapiens
uuguguauuagauaucaaugaagauaucucaaugugcaauaacaagaauguuauccaacuauu

SEQ ID NO: 258501 - RNA, 63 nt, Homo Sapiens
auacagaagaauucucuauauauuaaauguugagugcaauaaaaaaauaauguaaaugucuuc

SEQ ID NO: 258502 - RNA, 63 nt, Homo Sapiens
aaugacuuccuuggcgguuuguccucauguauugugcaauaacagcuuuuggaaaagcuccag

SEQ ID NO: 258503 - RNA, 63 nt, Homo Sapiens
aagaaaauagcucuuuaaaaaaaauuaaccuuugugcaauaccuuacuugccuggauugcuuu

SEQ ID NO: 258504 - RNA, 63 nt, Homo Sapiens
ggugcauguaauaauguugaucagaacagaugugugcaauauucagaagaugauuuuaacagu

SEQ ID NO: 258505 - RNA, 63 nt, Homo Sapiens
aacccuugccucaucaguuuuccugauuuacaagugcaauauuuuagccaaugccuugggaga

SEQ ID NO: 258506 - RNA, 63 nt, Homo Sapiens
auauaucaucaguuagcaauuuccaaaaagaaggugcaauaucuuaaaucuccaacuugcugu

SEQ ID NO: 258507 - RNA, 63 nt, Homo Sapiens
uuguacaaugguuuauucccugugguuucagaugugcaauaaugcagacagucuguuaugcac

SEQ ID NO: 258508 - RNA, 63 nt, Homo Sapiens
uacaauaaaauuugucauaauuuuuucaauguggugcaauauaucucauucaugauguugauu

SEQ ID NO: 258509 - RNA, 63 nt, Homo Sapiens
cugacucccaaaguuaguuagcggcuuguugaggugcaauaccgcaaucacaaacuaaagacu

SEQ ID NO: 258510 - RNA, 63 nt, Homo Sapiens
augaucucggcucacugcaaugcccaggcuggagugcaauagcagauggaguuucacucuugu

SEQ ID NO: 258511 - RNA, 63 nt, Homo Sapiens
cuuuuugauuaaagcucuucaaauucaucuguggugcaauacauucuugaaaacugcuguagc

SEQ ID NO: 258512 - RNA, 63 nt, Homo Sapiens
aggccaaauuuaaucuuugaguccuuugaaccugugcaauauguuucccccccaaaugguugc

SEQ ID NO: 258513 - RNA, 63 nt, Homo Sapiens
cgcugccacacacuacaggagucaauaaacaaggugcaauauuuucaaaucguuggccggcua

SEQ ID NO: 258514 - RNA, 63 nt, Homo Sapiens
uuuguuuuuaagacucauggacauuucauaccugugcaauacugaagaccucauucugucaug

SEQ ID NO: 258515 - RNA, 63 nt, Homo Sapiens
cucugaaccgaauguuuuggacuuaacuguugcgugcaauaugaccgucggcacacugcuguu

SEQ ID NO: 258516 - RNA, 63 nt, Homo Sapiens
uagagauaccagaaugcugguauucuacuacuugugcaauauauauguuuuaaaaaacaaauu

SEQ ID NO: 258517 - RNA, 63 nt, Homo Sapiens
aagacguagaaauguaaaauuaaaauaauuuuagugcaauaugcaucaacuaguucuuccaug

SEQ ID NO: 258518 - RNA, 63 nt, Homo Sapiens
ugagcuuagaguuaggaauuuaaacugugugaugugcaauaacuuuccagccugaagccugcu

SEQ ID NO: 258519 - RNA, 63 nt, Homo Sapiens
aacauagauccuaaaggauccgggcugagccaugugcaauaagucuugguagaugucccuaga

SEQ ID NO: 258520 - RNA, 63 nt, Homo Sapiens
guuuguacuguuuguauaaauauuuguuguuaugugcaauacuggcuauaaccuaaccucgac

SEQ ID NO: 258521 - RNA, 63 nt, Homo Sapiens
ugaauauuuuguugcauugucacaucacuguuugugcaauauaguuguuagcaucuuuguaug

SEQ ID NO: 258522 - RNA, 63 nt, Homo Sapiens
gcugcuucgauuugguuuccgauguacuuaauggugcaauaaaggcacugucuuugaugcagu

SEQ ID NO: 258523 - RNA, 63 nt, Homo Sapiens
acagccugucauugaaucuauuguuuuuguauggugcaauaugacugaaagcuuugaugaaau

SEQ ID NO: 258524 - RNA, 63 nt, Homo Sapiens
uguugagugagcugcuaugacuuugguagagaggugcaauauguuuuuugaaccagcuauaaa

SEQ ID NO: 258525 - RNA, 63 nt, Homo Sapiens
aaaaauugucugaaauguuuauuuugcaaaacagugcaauagaaucuaguuaugccuucauca

SEQ ID NO: 258526 - RNA, 63 nt, Homo Sapiens
gaccuccuuauguauucucaauuaccuguauuugugcaauaaauuggaauaauguaacuugau

SEQ ID NO: 258527 - RNA, 63 nt, Homo Sapiens
gggucuggaccccacggggcuggggagggccaugugcaauauuuggaggguuuucuggagggc

SEQ ID NO: 258528 - RNA, 63 nt, Homo Sapiens
caccuuuggugggggcagggccugguggcaccugugcaauaaugucuguguuucucucccacc

SEQ ID NO: 258529 - RNA, 63 nt, Homo Sapiens
uagauauauuauuugcagcaagaaguucauucugugcaauauggacauguuugcaaaccauac

SEQ ID NO: 258530 - RNA, 63 nt, Homo Sapiens
uaaucuuucgcaagugauuuccacugauaaauugugcaauaaaaucuguguuauucuuaguac

SEQ ID NO: 258531 - RNA, 63 nt, Homo Sapiens
aauagcuaauuuauuuccccgcuguggguagaugugcaauagagagauuuagaucuggaccag

SEQ ID NO: 258532 - RNA, 63 nt, Homo Sapiens
uucccauggaaugcagcagugcuucggccaccugugcaauauuuuacuuuugucagaaucaag

SEQ ID NO: 258533 - RNA, 63 nt, Homo Sapiens
cucugugugugauugcaggauguaaauaaaagagugcaauaauaaugcuuuaucuguguuuuc

SEQ ID NO: 258534 - RNA, 63 nt, Homo Sapiens
gcaacaucucugaauccuuuaagcagaaauauagugcaauagugacucagaaacgagaucggg

SEQ ID NO: 258535 - RNA, 63 nt, Homo Sapiens
ugagagaauguauuuucauaaagaaauacucaugugcaauagggaauugcacugaacagaauu

SEQ ID NO: 258536 - RNA, 63 nt, Homo Sapiens
aguauuuguuuuaccuuuggagauuuuauaaaugugcaauaaaaaaaauugauacaacuaugc

SEQ ID NO: 258537 - RNA, 63 nt, Homo Sapiens
gguuauguuucuaugugguggacccagcgccgugugcaauaaauaccuuuuucuaugaaaaaa

SEQ ID NO: 258538 - RNA, 63 nt, Homo Sapiens
gugaaggcugucugcccagaagaugugcuauuagugcaauaagguccuguagcuugauauuac

SEQ ID NO: 258539 - RNA, 63 nt, Homo Sapiens
gggagguauaacccugcuccucucucccagucugugcaauaaaggucgugaagaucucucagc

SEQ ID NO: 258540 - RNA, 63 nt, Homo Sapiens
aagauauauguauauaaaguguaugcuguauuggugcaauaaugguaauuaaaaauaugaaaa

SEQ ID NO: 258541 - RNA, 63 nt, Homo Sapiens
cugaguuuuuuauuuuuaaguguuuguuuuucagugcaauaauuuuugugugugugugauucu

SEQ ID NO: 258542 - RNA, 63 nt, Homo Sapiens
ugggcugccagcaguacgugggaaagguggaaugugcaauaggaacagaucugugcauuuugu

SEQ ID NO: 258543 - RNA, 63 nt, Homo Sapiens
cgcgaacaucacaccguuccccgaccaagccgugugcaauacaacagagggaggcagguggga

SEQ ID NO: 258544 - RNA, 63 nt, Homo Sapiens
aaugggguggaacacagcauuuugucaagcacugugcaauauuccauauuuuuccccacuaug

SEQ ID NO: 258545 - RNA, 63 nt, Homo Sapiens
guaaucuuuuacgggugggaggugagauugauagugcaauaaucagugaucuauagacccuca

SEQ ID NO: 258546 - RNA, 63 nt, Homo Sapiens
ccaucaaaccucacauuugugaacucaaacgaugugcaauacauuuuuuucucuuuccuugaa

SEQ ID NO: 258547 - RNA, 63 nt, Homo Sapiens
aauuuagggagaaauguuguuggagagguuaaggugcaauaaguagaguagaagauuugaugc

SEQ ID NO: 258548 - RNA, 63 nt, Homo Sapiens; identical to SEQ ID NO: 87695

SEQ ID NO: 258549 - RNA, 63 nt, Homo Sapiens; identical to SEQ ID NO: 87696

SEQ ID NO: 258550 - RNA, 63 nt, Homo Sapiens; identical to SEQ ID NO: 87697

SEQ ID NO: 258551 - RNA, 63 nt, Homo Sapiens
uucaaagaaaagaaaacacaauaauaaaauauugugcaauauaagacauaaaaccuuuuuuua

SEQ ID NO: 258552 - RNA, 63 nt, Homo Sapiens
gaggucuccacaccagaugugcugggacguugugugcaauagaguggguggagaguggagugc

SEQ ID NO: 258553 - RNA, 63 nt, Homo Sapiens
gugggguaggggcagggaaauacaugauuugaugugcaauagggccauccccauagccauguu

SEQ ID NO: 258554 - RNA, 63 nt, Homo Sapiens
uaauauguagaaauuuaaguaccaguacucugggugcaauaaauucacagaaagugcauuuua

SEQ ID NO: 258555 - RNA, 63 nt, Homo Sapiens
ucugacccagugcccccacuaacucuguugcaagugcaauaaaagacacccaggacuuauuua

SEQ ID NO: 258556 - RNA, 63 nt, Homo Sapiens
cauuuauuucuuauaugaaugcuuucacuguuugugcaauaugaauugcuugguggaacauau

SEQ ID NO: 258557 - RNA, 63 nt, Homo Sapiens
uugcaaacagcucuucuuagggauucaaauuaagugcaauauuaggagacaucaggucccccu

SEQ ID NO: 258558 - RNA, 63 nt, Homo Sapiens
ugaauuuccuggccuacuucccugccaagcaucgugcaauaagaaaaucagcgucauuuguuc

SEQ ID NO: 258559 - RNA, 63 nt, Homo Sapiens
cuauuuuuugguaaagauuuuuccuuaaauuuugugcaauaaaaauguaagugugcuugggaa

SEQ ID NO: 258560 - RNA, 63 nt, Homo Sapiens
uuucuuuuuuuuuuuuuuuguguagaaaaauaggugcaauaaugaucaaaguuuugaugucuu

SEQ ID NO: 258561 - RNA, 63 nt, Homo Sapiens
agacaugcagugaaaugguucuuuguuaaaaaugugcaauaaaaauagauuacaauaaguagu

SEQ ID NO: 258562 - RNA, 63 nt, Homo Sapiens
uuuguugagaggaaaagugaauugguuaaaagagugcaauaaggauccaaauacagugacuuu

SEQ ID NO: 258563 - RNA, 63 nt, Homo Sapiens
ggguuguuuucuguuaagcaaagccgagauccagugcaauaccuggacugucaccguccugug

SEQ ID NO: 258564 - RNA, 62 nt, Homo Sapiens
uguaaaaaaaaaaaaagauaaugagaaaucucugugcaauaaauaaaaacugaagaacauug

SEQ ID NO: 258565 - RNA, 63 nt, Homo Sapiens
gagugugccucauuaucuugaaauuuuaaugaagugcaauacucuagguuaaguuugagccug

SEQ ID NO: 258566 - RNA, 63 nt, Homo Sapiens
gagauguauacagucuuuacuguacauaaaaaugugcaauaugacacuuuaauguuuuauucu

SEQ ID NO: 258567 - RNA, 63 nt, Homo Sapiens
uuuguauauuuauucuauuuuguauauuguuaagugcaauaaaguuuuugccuugcuuuauuu

SEQ ID NO: 258568 - RNA, 63 nt, Homo Sapiens
gcugauguacacacauuucauuauuugccaauggugcaauaaccacugcugaccaacccacua

SEQ ID NO: 258569 - RNA, 63 nt, Homo Sapiens
ucugguuuuaauuuuuaguugugcuuugagucagugcaauaaacuagacuuuuuccaaaccug

SEQ ID NO: 258570 - RNA, 63 nt, Homo Sapiens
guauuuggagaaacaggaguguucacuuaucuagugcaauauguucacaguuuauuaaugcuu

SEQ ID NO: 258571 - RNA, 63 nt, Homo Sapiens
uuauucuccauaauuaaacuguugaauaauaaagugcaauacuuguuggcuacaucauuuugu

SEQ ID NO: 258572 - RNA, 63 nt, Homo Sapiens
auaaaacucugaaauuaagaugcuguuccuuuagugcaauacaagaaaauuguauaaccaucc

SEQ ID NO: 258573 - RNA, 63 nt, Homo Sapiens
uucuauuauguccguugauaauguuugaguucugugcaauauuuuauuuuguuuauuauuuuc

SEQ ID NO: 258574 - RNA, 63 nt, Homo Sapiens
uguaugauuauccagaacuaauuacugauuuuagugcaauaucaaauaaauaccagguaugaa

SEQ ID NO: 258575 - RNA, 63 nt, Homo Sapiens
uaacaugucuaaaguuaggguucuuuuuugagugugcaauaugaguuuucuaaauguuucuuu

SEQ ID NO: 258576 - RNA, 63 nt, Homo Sapiens
uucuguauuuauuggguuuugagccuuuuaacugugcaauaauuuaaggcaguacaaauugug

SEQ ID NO: 258577 - RNA, 63 nt, Homo Sapiens
ucuguaggaagaaucaaaucaccgauuuaaagagugcaauauauaauaaucauuuuuaaagua

SEQ ID NO: 258578 - RNA, 63 nt, Homo Sapiens
accuuuuccuguggaaaccugucauagaauuuugugcaauauguaugugucuaugaagcuguc

SEQ ID NO: 258579 - RNA, 63 nt, Homo Sapiens
gagucagagucucgcucucuuguccaggcuggagugcaauagcgcgaucugggcucacugcaa

SEQ ID NO: 258580 - RNA, 63 nt, Homo Sapiens
acauacucuuuguauauauuuauuauaugaaaggugcaauauuuuauuuuguacaguauguaa

SEQ ID NO: 258581 - RNA, 63 nt, Homo Sapiens
ucuguuuaaacugugauuuucuuuauuguguuggugcaauauuuuauuaucauuuaaccucag

SEQ ID NO: 258582 - RNA, 63 nt, Homo Sapiens
ccaguguauucuguuuuuaaaacugugccugcagugcaauacuccuucugguguauuuuaucc

SEQ ID NO: 258583 - RNA, 63 nt, Homo Sapiens
ucugugauugugccuaugcaagggacauacuuugugcaauauuuguaccucucauuuucaguc

SEQ ID NO: 258584 - RNA, 63 nt, Homo Sapiens
ccaagauuacccucggucauuucaucacagcaugugcaauaugagaggaucaccagugcaucc

SEQ ID NO: 258585 - RNA, 63 nt, Homo Sapiens
ugcuacuguauuugucucaaagcuaccaaguuugugcaauaaguggaagggaugucauccuuc

SEQ ID NO: 258586 - RNA, 63 nt, Homo Sapiens
ugaauaugugcuuuuacuguacauagugcuauugugcaauaggucuuaugcuguuuucacuca

SEQ ID NO: 258587 - RNA, 63 nt, Homo Sapiens
gcccgccccuugccucgauauugccaguuucuugugcaauaaacaaucagcagcugugggugg

SEQ ID NO: 258588 - RNA, 63 nt, Homo Sapiens
ugcugggccuccugcccgcgccugcugcuccccgugcaauaccgcgcccgcggguccucccca

SEQ ID NO: 258589 - RNA, 63 nt, Homo Sapiens
ggagugacccagcuacugaauucuaggaacucagugcaauacggugugcguggcuaucaggag

SEQ ID NO: 258590 - RNA, 63 nt, Homo Sapiens; identical to SEQ ID NO: 87698

SEQ ID NO: 258591 - RNA, 63 nt, Homo Sapiens; identical to SEQ ID NO: 87699

SEQ ID NO: 258592 - RNA, 63 nt, Homo Sapiens
ccuucucagugguuuacaugccucugaaacuaugugcaauauuuuugguugacacuuguaucc

SEQ ID NO: 258593 - RNA, 63 nt, Homo Sapiens
aagaaacaaacauugaauuacuaaacaaagauggugcaauaucuuuguuuuuuuuuuaugagg

SEQ ID NO: 258594 - RNA, 63 nt, Homo Sapiens
cuaccuucaacaugugcucgcucugcaugauuagugcaauaaaacucccuuccuuaugcauac

SEQ ID NO: 258595 - RNA, 63 nt, Homo Sapiens
ugggugguugggagagaaacuagaacagaagaugugcaauagggcucagagcagccccaggaa

SEQ ID NO: 258596 - RNA, 63 nt, Homo Sapiens
aguugcguugaggccgcaucuuucuucagcagcgugcaauagcuggcuccucuauaggagaug

SEQ ID NO: 258597 - RNA, 63 nt, Homo Sapiens
ucugugacucucuuggaaaugccuugacugaaugugcaauauuugugucucuugguuucuaac

SEQ ID NO: 258598 - RNA, 63 nt, Homo Sapiens
ggagugucucacaggauugcuacucauuucuaagugcaauaaguuuugucaguuuguuugccu

SEQ ID NO: 258599 - RNA, 63 nt, Homo Sapiens
guguuuuuauuuaaaaccaacuuugugggauuugugcaauaaauuggacccagggccugagac

SEQ ID NO: 258600 - RNA, 63 nt, Homo Sapiens
uuagauacucagcagaaguagaagucugaagaagugcaauaugaugugucagaacauucagaa

SEQ ID NO: 258601 - RNA, 63 nt, Homo Sapiens
guccucgugccugcugcucacaccuaaccacacgugcaauaaagugcagcuguaggucgucau

SEQ ID NO: 258602 - RNA, 63 nt, Homo Sapiens
uagcugcuaacaagacuggcagaaugaaaggcagugcaauauuauuggacccugacuguauac

SEQ ID NO: 258603 - RNA, 63 nt, Homo Sapiens
ugaaaaaaacgguauaaaaguuguaccuauauugugcaauacuuguaaucguaaauauuaauu

SEQ ID NO: 258604 - RNA, 63 nt, Homo Sapiens
aaaccuuccuuuuuaagaagguuguaaaagucagugcaauaacuuucuaaauuacuaugucag

SEQ ID NO: 258605 - RNA, 63 nt, Homo Sapiens
uaaaggcuaaggacuagaugcuuuauaauuguugugcaauaaccacguguccuggucacuggu

SEQ ID NO: 258606 - RNA, 63 nt, Homo Sapiens
uccccuucccuuuuuuuguuauuuuuucagacugugcaauacuuagagaaccuauagcaucuu

SEQ ID NO: 258607 - RNA, 63 nt, Homo Sapiens
ugaugauuucuuuucccugcacacaucuuuccggugcaauaucuaucaauugugaaucuggcu

SEQ ID NO: 258608 - RNA, 63 nt, Homo Sapiens
gcugcuugcagcaacuugauuuccccaaguccugugcaauagccccaggauuggauuccuuca

SEQ ID NO: 258609 - RNA, 63 nt, Homo Sapiens
aaguguuuuggaauuugaaguuguucaaggagggugcaauauugaaaccaauuuuuuuaguua

SEQ ID NO: 258610 - RNA, 63 nt, Homo Sapiens
auguaauuaauucaaguccucagccaauuuauagugcaauaaaacauuuggguauaaugacaa

SEQ ID NO: 258611 - RNA, 63 nt, Homo Sapiens
gguggcccccguccgaggaggaucguuuucuaagugcaauacuuggcccgccggcuucccgcu

SEQ ID NO: 258612 - RNA, 63 nt, Homo Sapiens
gauccuccuugacgaguuuuguuuuucaaaauggugcaauaauuuaaguggcaucuucucucc

SEQ ID NO: 258613 - RNA, 63 nt, Homo Sapiens
gcccccuuccccagaacaaaacauguugaucaugugcaauauuucuuacugugccgagaagcc

SEQ ID NO: 258614 - RNA, 60 nt, Homo Sapiens; identical to SEQ ID NO: 258327

SEQ ID NO: 258615 - RNA, 63 nt, Homo Sapiens
ucuccgguaacccguccacccucuuccaaaacagugcaauaaagcugguccuuagccccaugc

SEQ ID NO: 258616 - RNA, 63 nt, Homo Sapiens
cccauugccaugggguccuugaaaccuggcucagugcaauacucgacacguccccguuccccc

SEQ ID NO: 258617 - RNA, 63 nt, Homo Sapiens
uuaaaggaagcaaccaccuuuuuauuuucuauugugcaauaucauuuuaaggauugacaagag

SEQ ID NO: 258618 - RNA, 63 nt, Homo Sapiens
guggaaaccaaacugcuccacaggccggaccacgugcaauaggcagccuccugauuucauaac

SEQ ID NO: 258619 - RNA, 63 nt, Homo Sapiens
aaauaaaaggccagcgggcgugacucaccugaagugcaauacgagcacucgccucccuaccaa

SEQ ID NO: 258620 - RNA, 63 nt, Homo Sapiens
cuggaauaaauauaaaugaagggugagagaagugugcaauaguccuucuaagacccacgagcg

SEQ ID NO: 258621 - RNA, 63 nt, Homo Sapiens
gagggacgucuucuauuuuuauauaggguccaugugcaauaggccucagccaggugggccugu

SEQ ID NO: 258622 - RNA, 63 nt, Homo Sapiens
uugacuuaaacuuguuuagccacaugagaacaggugcaauauaacugucuaauauaggaaaaa

SEQ ID NO: 258623 - RNA, 63 nt, Homo Sapiens
gggugcccacagaggcucagcuccuucuuuucugugcaauacgagacccggccgcaccccgag

SEQ ID NO: 258624 - RNA, 63 nt, Homo Sapiens; identical to SEQ ID NO: 87700

SEQ ID NO: 258625 - RNA, 63 nt, Homo Sapiens; identical to SEQ ID NO: 87701

SEQ ID NO: 258626 - RNA, 63 nt, Homo Sapiens
aaacccgcaucugcucacgggaugcugcagucugugcaauaauggguuggguuugggguucag

SEQ ID NO: 258627 - RNA, 63 nt, Homo Sapiens
uugucuuuuguauaggucauauaucuaaauuuagugcaauaucauauuaaauucaaauauccc

SEQ ID NO: 258628 - RNA, 63 nt, Homo Sapiens
cuuccuaguaccugagugagcaguuaaggagcugugcaauaaccacucugcccugaccccgau

SEQ ID NO: 258629 - RNA, 63 nt, Homo Sapiens
aagucacccucaauaaauacgcaauagacguuagugcaauacaaucaaucacaacagguaaua

SEQ ID NO: 258630 - RNA, 63 nt, Homo Sapiens
uuugcugucagccacauauugagaugacacuaggugcaauagcagggauagauuuuguuggug

SEQ ID NO: 258631 - RNA, 63 nt, Homo Sapiens
gcuacaaauagugcuaauaaaguuaaauugcacgugcaauacggaacacugucaauggacugc

SEQ ID NO: 258632 - RNA, 63 nt, Homo Sapiens
ucauuguaagugcacugauaaguauuucauuaugugcaauaagagcuaagagaauugggcauu

SEQ ID NO: 258633 - RNA, 63 nt, Homo Sapiens
ggaggcugacuguagggcugcuugggugaaguugugcaauauugguccaacaagaacaccuga

SEQ ID NO: 258634 - RNA, 63 nt, Homo Sapiens
acuuuccacuggaguucacuuucaauugcuucugugcaauaaaaccaagugcuuauaaaauga

SEQ ID NO: 258635 - RNA, 63 nt, Homo Sapiens
uuagcccagauacacauacucuuuuuugucuuugugcaauaaucaguguuccuggcagagccu

SEQ ID NO: 258636 - RNA, 63 nt, Homo Sapiens
uacuccagagcuccuuuaacaucugcuaauuaagugcaauaaauuuuucuagaaaauggcaaa

SEQ ID NO: 258637 - RNA, 63 nt, Homo Sapiens
uuggaaugggacauugguguuauucagaauguugugcaauauugaauacaaucaaggguuuug

SEQ ID NO: 258638 - RNA, 63 nt, Homo Sapiens
gcucucuguugugagaucuucagcuaccucauggugcaauaacacacacacgcuuaaccaugu

SEQ ID NO: 258639 - RNA, 63 nt, Homo Sapiens
aguggcauaggaagacggcaaaaauuuccuaaagugcaauagauuuucaaguguauugugccu

SEQ ID NO: 258640 - RNA, 63 nt, Homo Sapiens; identical to SEQ ID NO: 87702

SEQ ID NO: 258641 - RNA, 63 nt, Homo Sapiens; identical to SEQ ID NO: 87703

SEQ ID NO: 258642 - RNA, 63 nt, Homo Sapiens
gacgcuugguuuuucucagaacccccaaaagaugugcaauagcuguuguuacaaaccaccaaa

SEQ ID NO: 258643 - RNA, 63 nt, Homo Sapiens
auuggauuuuauguugacauuuguuugguuauagugcaauauauuuuguaugcaagcaguuuc

SEQ ID NO: 258644 - RNA, 63 nt, Homo Sapiens
ucgaucucggcucacugcaaugcccaggcuggagugcaauagcagauggaguuucacucuugu

SEQ ID NO: 258645 - RNA, 63 nt, Homo Sapiens
cuuuaaagcuaucaacaaaacuagaugaaaagcgugcaauaugaauaguuguuuacuagugug

SEQ ID NO: 258646 - RNA, 63 nt, Homo Sapiens
cuuaaauacuacugcucuaagacacagaauugugugcaauauuagaaacugaggguuaucuuu

SEQ ID NO: 258647 - RNA, 63 nt, Homo Sapiens
ucagcaguuaaauaguggaauuuuuuuuacaaugugcaauaacauuguaauaggcauuuuuuu

SEQ ID NO: 258648 - RNA, 63 nt, Homo Sapiens
augaugucugcucuagggaaaaaugacacaucugugcaauagaugcaacuuucuauaaugcca

SEQ ID NO: 258649 - RNA, 63 nt, Homo Sapiens
uaugcagcauuaacuuuacugacauggagugaagugcaauauuauaaauauuauagauuaaaa

SEQ ID NO: 258650 - RNA, 63 nt, Homo Sapiens; identical to SEQ ID NO: 87702

SEQ ID NO: 258651 - RNA, 63 nt, Homo Sapiens; identical to SEQ ID NO: 87703

SEQ ID NO: 258652 - RNA, 63 nt, Homo Sapiens
aauggcauaagaaguugacaaaaauuucuuaaagugcaauagauuuucaaguguauugugccu

SEQ ID NO: 258653 - RNA, 63 nt, Homo Sapiens
gaagggacuuaauuacaaacuuaagacguaagugugcaauaaaguaagcuaagaagaaaauau

SEQ ID NO: 258654 - RNA, 64 nt, Homo Sapiens
acauaaagcaaauuuggaggaaacaacugaaguugugcaauauuuucugauaauugcuuuuuuu

SEQ ID NO: 258655 - RNA, 64 nt, Homo Sapiens
ccuagaccccucuuccucucucccccaccauagugugcaauaaagugucuguucuuaccaaacc

SEQ ID NO: 258656 - RNA, 64 nt, Homo Sapiens
uuugccguguaugaggagugcuagaaaaugcaaagugcaauauuuucccuaaccuucaaaugug

SEQ ID NO: 258657 - RNA, 64 nt, Homo Sapiens
gagaccaagcaucuaucugauagaagcacauggagugcaauaggacauugugagaaggaauuuu

SEQ ID NO: 258658 - RNA, 64 nt, Homo Sapiens; identical to SEQ ID NO: 169421

SEQ ID NO: 258659 - RNA, 64 nt, Homo Sapiens; identical to SEQ ID NO: 169422

SEQ ID NO: 258660 - RNA, 64 nt, Homo Sapiens
auuugugaugccuucccuccccuagaaagauuuugugcaauauauuaaauggggacagaauucu

SEQ ID NO: 258661 - RNA, 64 nt, Homo Sapiens; identical to SEQ ID NO: 169423

SEQ ID NO: 258662 - RNA, 64 nt, Homo Sapiens; identical to SEQ ID NO: 169424

SEQ ID NO: 258663 - RNA, 64 nt, Homo Sapiens
augaaauaauagggcauuuaacaaagaucgcuaugugcaauacuguauuuaguguuucuauuuc

SEQ ID NO: 258664 - RNA, 64 nt, Homo Sapiens
auuugcuuguaacaguuauuaucuugaaaucugagugcaauagggcccuuuugcuggggcugcc

SEQ ID NO: 258665 - RNA, 64 nt, Homo Sapiens
cagagugucccuuuuugcagacucccccaggauugugcaauagucuuccccuugucccuggggc

SEQ ID NO: 258666 - RNA, 64 nt, Homo Sapiens
acagcgauaauaaaauucucacuacugggcauuagugcaauauauaaagaauagaccaugggcu

SEQ ID NO: 258667 - RNA, 64 nt, Homo Sapiens
uuaugcucagugagcaaauuacaaaacugcucuugugcaauauugaaaauugaauuuucuucag

SEQ ID NO: 258668 - RNA, 64 nt, Homo Sapiens
guuguguaguuaaaugcauaauaaauauuacuuugugcaauauuugaaauagguuaaaucuuau

SEQ ID NO: 258669 - RNA, 64 nt, Homo Sapiens
gugaucacaucuuuguuucuuaauguuucugggugugcaauagacauucuaagaccagauucuc

SEQ ID NO: 258670 - RNA, 61 nt, Homo Sapiens; identical to SEQ ID NO: 258096

SEQ ID NO: 258671 - RNA, 64 nt, Homo Sapiens
gucuggcugggggcugucccaaggaacagagaaugugcaauaccugucaguugagauuaaaagu

SEQ ID NO: 258672 - RNA, 64 nt, Homo Sapiens; identical to SEQ ID NO: 169425

SEQ ID NO: 258673 - RNA, 64 nt, Homo Sapiens; identical to SEQ ID NO: 169426

SEQ ID NO: 258674 - RNA, 64 nt, Homo Sapiens
augauguuuuaagugugcaauucacuggcuucuugugcaauaauggaacugaccauuauaugcc

SEQ ID NO: 258675 - RNA, 64 nt, Homo Sapiens
auauuuuuauguaaaaauaauggucuuguuaagagugcaauauugagaaaauaugcagaauaac

SEQ ID NO: 258676 - RNA, 64 nt, Homo Sapiens
aaaaaggcacauaguuuaaaaaguuucucauuuugugcaauauaaucuaaauaaaguacagacc

SEQ ID NO: 258677 - RNA, 64 nt, Homo Sapiens
gaaaucaguuaagauaaagcugcauuguauauaagugcaauauauuuuugaaggucuguaaaug

SEQ ID NO: 258678 - RNA, 64 nt, Homo Sapiens
ucugcuggggcugacuuguccagaaggggacaaagugcaauacagagccuucccuacccugacg

SEQ ID NO: 258679 - RNA, 64 nt, Homo Sapiens
uagucuaugaaagaauaauuauaauaauguccaggugcaauacucuguaagucuauugguucaa

SEQ ID NO: 258680 - RNA, 64 nt, Homo Sapiens
cuguuucuugaauauauauuuuugaaguuuuuuugugcaauauauuacuaaaucaguuauuauu

SEQ ID NO: 258681 - RNA, 64 nt, Homo Sapiens
uugaagagaaucccaaaaguuaguucaucuuaaagugcaauauuguuuaaucuuaaaacugggc

SEQ ID NO: 258682 - RNA, 64 nt, Homo Sapiens
guugcuauguugauguguaagugaaaucaguugugugcaauagacaggggcguauucaugggag

SEQ ID NO: 258683 - RNA, 64 nt, Homo Sapiens
cagggacaucaucucuuccaucuuuggguccuuagugcaauaccuggcagcuagccagugcuca

SEQ ID NO: 258684 - RNA, 64 nt, Homo Sapiens
caccugguuacaacuugcugguggguuuuauguugugcaauacuaggaggaggaggcaggugau

SEQ ID NO: 258685 - RNA, 64 nt, Homo Sapiens
aggucuugaugugcauagcuucugauaacccugugugcaauaauaugauuugcagggcauuucu

SEQ ID NO: 258686 - RNA, 64 nt, Homo Sapiens
ccacucaacagauguagugugacaaguauaauaugugcaauaaucauuguuucucuuaugauuu

SEQ ID NO: 258687 - RNA, 64 nt, Homo Sapiens
cccucaacccaaauccaccuucauacuguaaguagugcaauacuuguuucauuucuguguuuaa

SEQ ID NO: 258688 - RNA, 64 nt, Homo Sapiens
guguuucaacggaaagugcugucuuaaacuaaaugugcaauagaaggugauguugccauccuac

SEQ ID NO: 258689 - RNA, 64 nt, Homo Sapiens
aucuuaaaacacugaccucuaugagguauuuacugugcaauaacugauucauuuuuuucagagc

SEQ ID NO: 258690 - RNA, 64 nt, Homo Sapiens
cugaaucuuugauguuuuuugucauuguucucaagugcaauauaacaauguaaccaaaucuaga

SEQ ID NO: 258691 - RNA, 64 nt, Homo Sapiens
gccauucagauagcaguaaaacauucuguaugaugugcaauaaaacauccaagaucuuuuuuga

SEQ ID NO: 258692 - RNA, 64 nt, Homo Sapiens
guuggacaucuuuucucuuguguuuuguuugaaugugcaauaguuuauaggccacaaauaagcu

SEQ ID NO: 258693 - RNA, 64 nt, Homo Sapiens
uccuuucaccuggcaggggacaugagaacagaaagugcaauauuggaacuccuguccccuuagu

SEQ ID NO: 258694 - RNA, 64 nt, Homo Sapiens; identical to SEQ ID NO: 169427

SEQ ID NO: 258695 - RNA, 64 nt, Homo Sapiens; identical to SEQ ID NO: 169428

SEQ ID NO: 258696 - RNA, 64 nt, Homo Sapiens
gguaacuugacucuuccaucuguagccuccagaugugcaauaacaaggaauccaagugccuuuc

SEQ ID NO: 258697 - RNA, 64 nt, Homo Sapiens
uuacauguuguguauguuuuugagccuuucucuugugcaauaauauugcauuuuacgcaaacuu

SEQ ID NO: 258698 - RNA, 64 nt, Homo Sapiens
agcuuauuguccauuaacaugcaaugaccuuucugugcaauaaagcaauccccaaccucugacu

SEQ ID NO: 258699 - RNA, 64 nt, Homo Sapiens
aauuaaaauauaucaaaucggaaaggguguuauagugcaauagccacccaaagaauuuucaaag

SEQ ID NO: 258700 - RNA, 64 nt, Homo Sapiens
ugugcagaagaugagguauucugucauaaugacugugcaauacaaauuuuucuugcuuugaacc

SEQ ID NO: 258701 - RNA, 64 nt, Homo Sapiens
guaagcugaaucuuuuuuggcauauuucauccaagugcaauaauuauuauacuacucuaaauag

SEQ ID NO: 258702 - RNA, 64 nt, Homo Sapiens
ggcugaaccuggcccaacagaacucaacaacaaagugcaauacacaacaaugaaaaccaacacc

SEQ ID NO: 258703 - RNA, 64 nt, Homo Sapiens
guguaccucauggaugcuuuaucugcuuaucagugugcaauacuaaagugacaugcauucacau

SEQ ID NO: 258704 - RNA, 64 nt, Homo Sapiens
uuuguuugacugcuugugucacuuucuuuacccagugcaauagauuuguuugugugcaaaccaa

SEQ ID NO: 258705 - RNA, 64 nt, Homo Sapiens
ucaaaagcucaauguacugcccaagaggcaccuugugcaauauucccaucccugaauuuagcau

SEQ ID NO: 258706 - RNA, 64 nt, Homo Sapiens
uagaauagccaguauuuauguuuuuuauaaaacugugcaauacgaauuaugcaaucacaauaca

SEQ ID NO: 258707 - RNA, 64 nt, Homo Sapiens
aacuuacggaaauacacaaaugcuucucuguaaugugcaauaugcuuugcaacuguagaugaua

SEQ ID NO: 258708 - RNA, 64 nt, Homo Sapiens; identical to SEQ ID NO: 169429

SEQ ID NO: 258709 - RNA, 64 nt, Homo Sapiens; identical to SEQ ID NO: 169430

SEQ ID NO: 258710 - RNA, 64 nt, Homo Sapiens
auugagggaccaucagauaacuguauuuugucaggugcaauaaaaacaaaauuaaaacccaaau

SEQ ID NO: 258711 - RNA, 64 nt, Homo Sapiens
cuaauuuaaaaauuaauauuuucuuauagauauugugcaauaaagcugaaguagaauguguggu

SEQ ID NO: 258712 - RNA, 64 nt, Homo Sapiens
uucuugaaugcuuugucaaauuaagaaaguuaaagugcaauaauguuugaagacaauaaguggu

SEQ ID NO: 258713 - RNA, 64 nt, Homo Sapiens
uauuuauuuuuagggugauuuuuuaaaaagacuugugcaauacauuuugaggugaaacuuagug

SEQ ID NO: 258714 - RNA, 64 nt, Homo Sapiens
cuacaaguuugcaaauauuuuaacaauauuaaaugugcaauagaacuuuuauaaaauaauuaga

SEQ ID NO: 258715 - RNA, 64 nt, Homo Sapiens
aagcacaucguccuguuuuauugcuuucuacccugugcaauauuagcaugcaagcuuggcuuac

SEQ ID NO: 258716 - RNA, 64 nt, Homo Sapiens
gcuggcauauuuuggaauucugcacauucauggagugcaauaauacuguauagcuuuccccacc

SEQ ID NO: 258717 - RNA, 64 nt, Homo Sapiens
acugauggugcauuuuauucuugaagugaaaucugugcaauaaaauaacagacugucugcaaaa

SEQ ID NO: 258718 - RNA, 64 nt, Homo Sapiens
caucaauucauagcaguaacuuuaagagggcauugugcaauaguuaguuguuuucuuguucagc

SEQ ID NO: 258719 - RNA, 64 nt, Homo Sapiens
uuccuuuuuuuuuuuuuuauuucgguuguuugaugugcaauauguuuuuguaugcagguaguaa

SEQ ID NO: 258720 - RNA, 64 nt, Homo Sapiens
ggcauugauaaguucuguuaauuuggcuaguaaagugcaauaaagacuaauuccaaccuucuaa

SEQ ID NO: 258721 - RNA, 64 nt, Homo Sapiens
ggcgggcagucgcugcaggggauguagugaccaagugcaauaugcccaggaggaggauugugcu

SEQ ID NO: 258722 - RNA, 64 nt, Homo Sapiens
uauaguguuauuuguuucacaaaagauuuuagaagugcaauauuaguugugugaagaugucaaa

SEQ ID NO: 258723 - RNA, 64 nt, Homo Sapiens
uuuaaaaugugcucccaggaaauuaaaaaaaucugugcaauaauguuuaaaaaaaauaaauaaa

SEQ ID NO: 258724 - RNA, 64 nt, Homo Sapiens
uuuuauguggaugaagagcauuuuuuaugcuuuugugcaauagguuccaauaugcauuuauuag

SEQ ID NO: 258725 - RNA, 64 nt, Homo Sapiens
gcagggcacuccccuguuuccuaagaacgaaaaagugcaauaaaggccauucguuaccuacuuu

SEQ ID NO: 258726 - RNA, 64 nt, Homo Sapiens
uuccauggaguugugcaaagcuauggcuuccuuggugcaauauucuuaaaaccugcuuugcaua

SEQ ID NO: 258727 - RNA, 64 nt, Homo Sapiens
ggaaggcugacuaaccucgauucuguguugugaugugcaauacuguuucuaauguuuguauaaa

SEQ ID NO: 258728 - RNA, 64 nt, Homo Sapiens
uuuaaaagcaacaaaagggauaccauguagaauugugcaauagucuagccagcuagccuuaaca

SEQ ID NO: 258729 - RNA, 64 nt, Homo Sapiens
uuuccuuaauaagaaaaguaauuuuuacucugaugugcaauacauuuguuauuaaauuuauuau

SEQ ID NO: 258730 - RNA, 64 nt, Homo Sapiens
agcacaguguauucagacagauacagugaaccaagugcaauauguaaggaugaaagaagaagag

SEQ ID NO: 258731 - RNA, 64 nt, Homo Sapiens
gggauggaguuucgcuguuguugcccaggcuggagugcaauagcacgaucuuggcucaccgcaa

SEQ ID NO: 258732 - RNA, 64 nt, Homo Sapiens
ucuuggagaauuuggaugcccuugcuugccuucugugcaauauuagggccucuuucccagcuuu

SEQ ID NO: 258733 - RNA, 64 nt, Homo Sapiens
uauuuguguuauuaacuacaaguauggaggagaugugcaauaaacauuaguuaauauaugugaa

SEQ ID NO: 258734 - RNA, 64 nt, Homo Sapiens
guuccuuucuaaccauuucuuuaugauugacuuggugcaauaaaccugugaacugcaaacuugc

SEQ ID NO: 258735 - RNA, 64 nt, Homo Sapiens
uguaaaucuacuugacacugcagcagaaugauaagugcaauagucuucaguuuuggccuucugu

SEQ ID NO: 258736 - RNA, 64 nt, Homo Sapiens
auguguuuuuucauguuaguuucuuauaacuuaagugcaauaaaauucacuuagaaauuuuauu

SEQ ID NO: 258737 - RNA, 64 nt, Homo Sapiens
gcauagauucuauaaauucucuaguuucuauauagugcaauagaacaucaguauaacugcauuu

SEQ ID NO: 258738 - RNA, 64 nt, Homo Sapiens
aaacuuaauaaaauuuuauguuaacuauacuugagugcaauaaauacguuuauucucuucagcu

SEQ ID NO: 258739 - RNA, 64 nt, Homo Sapiens
cauugcugggauguuucugcccacgguuuuguuugugcaauaacguuaucacauuucuaaugag

SEQ ID NO: 258740 - RNA, 64 nt, Homo Sapiens
guuuuucuauguaaauauugaaaacuuaugauuugugcaauaacucagauauuuuuuauuuaau

SEQ ID NO: 258741 - RNA, 64 nt, Homo Sapiens
uguaaaguaaaaugccuuauauauuaaagaguaagugcaauaauaugaaauagccuguacauuu

SEQ ID NO: 258742 - RNA, 64 nt, Homo Sapiens
auacaguacuguuucuggacccuuauaaaauccugugcaauagacacauacaugucacauuuag

SEQ ID NO: 258743 - RNA, 64 nt, Homo Sapiens
gcauuugccuuauuuuugcaucucacaaacauaagugcaauagaucuuuucauugaacagcaaa

SEQ ID NO: 258744 - RNA, 64 nt, Homo Sapiens
auuuuaaguuugcagauuuauuuagugaaggcaagugcaauaauccuuccucagaugauguuug

SEQ ID NO: 258745 - RNA, 64 nt, Homo Sapiens
aaaccugaaacugguaagacaagcacaaagcaacgugcaauacaaaaaucguaucucaagggaa

SEQ ID NO: 258746 - RNA, 64 nt, Homo Sapiens
cugcaagaauuucuuuuaaauaaaaaguuugggggugcaauauaagaaguuuauauaauaugca

SEQ ID NO: 258747 - RNA, 64 nt, Homo Sapiens
gaaucauuggcuuuuauaccuuucuugguuugacgugcaauaaagaagcacauuauuuuagcuu

SEQ ID NO: 258748 - RNA, 64 nt, Homo Sapiens
uuuauaugcacauaauaaccuguaccuauaaaucgugcaauaaccauaugcgacuauuuugcca

SEQ ID NO: 258749 - RNA, 64 nt, Homo Sapiens
ugugaugaauuguggcaaguuaacuucaaguuaugugcaauacuuauuucaaacuuuugaaaga

SEQ ID NO: 258750 - RNA, 64 nt, Homo Sapiens
ccuauuuguaggugaguuguuucuccgcucuguggugcaauaucgaagucucacaguuggugau

SEQ ID NO: 258751 - RNA, 64 nt, Homo Sapiens; identical to SEQ ID NO: 169431

SEQ ID NO: 258752 - RNA, 64 nt, Homo Sapiens; identical to SEQ ID NO: 169432

SEQ ID NO: 258753 - RNA, 64 nt, Homo Sapiens
aaauguuugcuuuauagauuguuagcaaaacaaagugcaauauuggaaaaguaaaauccaaaau

SEQ ID NO: 258754 - RNA, 64 nt, Homo Sapiens; identical to SEQ ID NO: 169433

SEQ ID NO: 258755 - RNA, 64 nt, Homo Sapiens; identical to SEQ ID NO: 169434

SEQ ID NO: 258756 - RNA, 64 nt, Homo Sapiens
uagcuacaaacuucugugcaucuugguguuuucagugcaauaaaagaaggggcguuuguuuuau

SEQ ID NO: 258757 - RNA, 64 nt, Homo Sapiens
cagccccagguagggaggggcuagguguuguuuugugcaauauaggacuaugaucugauggccu

SEQ ID NO: 258758 - RNA, 64 nt, Homo Sapiens
cuaggaauugagccaggagauauccagcuaaauggugcaauaggaagauaccuaagcacuagaa

SEQ ID NO: 258759 - RNA, 64 nt, Homo Sapiens
gauacagcucucuucagaguacuucuccacuacugugcaauagaacacauggggaucagagcag

SEQ ID NO: 258760 - RNA, 64 nt, Homo Sapiens
gaauugccugagcccaggaguucaagaccagcuugugcaauauagggagacuccggcucuacaa

SEQ ID NO: 258761 - RNA, 64 nt, Homo Sapiens
cugggaugucgggagaccuagaugaccuuaucgggugcaauacuagcuaagguaaagcuagaaa

SEQ ID NO: 258762 - RNA, 64 nt, Homo Sapiens
uuuuguuuuuaaacuuuuuuuugccauccauccugugcaauaugccguguagaauauuugucuu

SEQ ID NO: 258763 - RNA, 64 nt, Homo Sapiens
ugacauugauuuuuuuuuuuucguuuucuuucuugugcaauaccuacaauggugcuguguuuua

SEQ ID NO: 258764 - RNA, 64 nt, Homo Sapiens
augaaaaaaacugcaucccaucacccaaaguucugugcaauagaaauuucuacagauacaggua

SEQ ID NO: 258765 - RNA, 64 nt, Homo Sapiens
guagcuugauaugguguuucagugcuuauugguugugcaauaaugguuauagccuguuagauaa

SEQ ID NO: 258766 - RNA, 64 nt, Homo Sapiens
uucugugccaauagagucugugcuuuuuuagcaugugcaauacucuugucccauuucauucucu

SEQ ID NO: 258767 - RNA, 64 nt, Homo Sapiens
uguguaauguagaauguggguggcauugaaacuugugcaauaucgccagacugcauuaguauuu

SEQ ID NO: 258768 - RNA, 64 nt, Homo Sapiens
cuugacuccuuggugcuaaaauaaacccauuuuggugcaauauuuuauuaacuagguaugaagu

SEQ ID NO: 258769 - RNA, 64 nt, Homo Sapiens
aaaugaucuugauccauuucacauguaagcagaugugcaauaaaacucugcccaaaagcagcag

SEQ ID NO: 258770 - RNA, 64 nt, Homo Sapiens
uauagcauacuuugacauuuagccuagcagaaaagugcaauauggccauggaagauacuagccc

SEQ ID NO: 258771 - RNA, 64 nt, Homo Sapiens
guagaauucuauauugauaaccaaacuggacauugugcaauaaacacagcauagcugaaaguug

SEQ ID NO: 258772 - RNA, 64 nt, Homo Sapiens
gucuuaagaaauaauugccaauuuaaggacuuuugugcaauaugguagcauaacuuauaucugu

SEQ ID NO: 258773 - RNA, 64 nt, Homo Sapiens
uaaaaauguaucaaauguauguguaccuggauuugugcaauauguggcgcaucagauagucucu

SEQ ID NO: 258774 - RNA, 64 nt, Homo Sapiens
guuuugggaugucagcaguggccugaagugaguugugcaauaaauguuaaguugaaaccuccuu

SEQ ID NO: 258775 - RNA, 64 nt, Homo Sapiens
gcaaaagagaaaaagaaggauugaucagagcauugugcaauacaguuucauuaacuccuucccc

SEQ ID NO: 258776 - RNA, 64 nt, Homo Sapiens
aaaccagccaguaauuucugugcaaccuuacuaugugcaauauuuuuaaauccugagaaaugug

SEQ ID NO: 258777 - RNA, 64 nt, Homo Sapiens
caaagaaggguugauaaaagauuucacuugcauugugcaauaagauggagggauauccccuugg

SEQ ID NO: 258778 - RNA, 64 nt, Homo Sapiens
ucauuuaaucuguaaagguucuuuuuuuuaaucugugcaauaccuauuuuuguugccuuuuuug

SEQ ID NO: 258779 - RNA, 64 nt, Homo Sapiens
gauggaauguuaccuguccguguuacauaaucaagugcaauauacucaguucucaugcagguga

SEQ ID NO: 258780 - RNA, 64 nt, Homo Sapiens
ggaauaaauuaaaaacaguauuugggggagaaacgugcaauagcguaaugguggugucccugcc

SEQ ID NO: 258781 - RNA, 64 nt, Homo Sapiens
guuaaauuuauuuuaacguagacacuaaaaguaugugcaauauacaauuaaaguaggaauuugu

SEQ ID NO: 258782 - RNA, 64 nt, Homo Sapiens
uccuguuggucucucuguguucuuuguuacuugggugcaauagcaacuucccuaccccgugcau

SEQ ID NO: 258783 - RNA, 64 nt, Homo Sapiens
ucccaugggggcuccagacauuguauuuuacuuugugcaauaugaggggacugcaugcaagcuc

SEQ ID NO: 258784 - RNA, 64 nt, Homo Sapiens
gcaucugcuaccugauuuuauccuggagaauacagugcaauauuucucuuugauuauuuauucc

SEQ ID NO: 258785 - RNA, 64 nt, Homo Sapiens
cucauucauuccuguuaagcugccaaaaauuaaagugcaauauuguauauuuuuaagaacaaau

SEQ ID NO: 258786 - RNA, 64 nt, Homo Sapiens
uuaccuguagguggagcaaguaauaagccaugcugugcaauauauacauaaagcuucugcuucu

SEQ ID NO: 258787 - RNA, 64 nt, Homo Sapiens
uuguguauuagauaucaauguaagauaucucaaugugcaauaacuaagaauguuauccaacuau

SEQ ID NO: 258788 - RNA, 64 nt, Homo Sapiens
auacagaagaauucucuauacuauuaaauguugagugcaauaaaaaaaauaauguaaaugucuu

SEQ ID NO: 258789 - RNA, 64 nt, Homo Sapiens
aaugacuuccuuggcgguuugguccucauguauugugcaauaacaagcuuuuggaaaagcucca

SEQ ID NO: 258790 - RNA, 64 nt, Homo Sapiens
aagaaaauagcucuuuaaaauaaaauuaaccuuugugcaauacccuuacuugccuggauugcuu

SEQ ID NO: 258791 - RNA, 64 nt, Homo Sapiens
ggugcauguaauaauguugauucagaacagaugugugcaauauuucagaagaugauuuuaacag

SEQ ID NO: 258792 - RNA, 64 nt, Homo Sapiens
aaacccuugccucaucaguuuuccugauuuacaagugcaauauuuuagccaaugccuugggaga

SEQ ID NO: 258793 - RNA, 64 nt, Homo Sapiens
auauaucaucaguuagcaauuuuccaaaaagaaggugcaauaucuuuaaaucuccaacuugcug

SEQ ID NO: 258794 - RNA, 64 nt, Homo Sapiens
uuguacaaugguuuauuccccugugguuucagaugugcaauaauugcagacagucuguuaugca

SEQ ID NO: 258795 - RNA, 64 nt, Homo Sapiens
uacaauaaaauuugucauaauuuuuuucaauguggugcaauauaaucucauucaugauguugau

SEQ ID NO: 258796 - RNA, 64 nt, Homo Sapiens
cugacucccaaaguuaguuaugcggcuuguugaggugcaauaccagcaaucacaaacuaaagac

SEQ ID NO: 258797 - RNA, 64 nt, Homo Sapiens
augaucucggcucacugcaauugcccaggcuggagugcaauagcgagauggaguuucacucuug

SEQ ID NO: 258798 - RNA, 64 nt, Homo Sapiens
cuuuuugauuaaagcucuuccaaauucaucuguggugcaauacaauucuugaaaacugcuguag

SEQ ID NO: 258799 - RNA, 64 nt, Homo Sapiens
aggccaaauuuaaucuuugacguccuuugaaccugugcaauaugcuuucccccccaaaugguug

SEQ ID NO: 258800 - RNA, 64 nt, Homo Sapiens
ccgcugccacacacuacaggagucaauaaacaaggugcaauauuuucaaaucguuggccggcua

SEQ ID NO: 258801 - RNA, 64 nt, Homo Sapiens
uuuuguuuuuaagacucauggacauuucauaccugugcaauacugaagaccucauucugucaug

SEQ ID NO: 258802 - RNA, 64 nt, Homo Sapiens
acucugaaccgaauguuuuggacuuaacuguugcgugcaauaugaccgucggcacacugcuguu

SEQ ID NO: 258803 - RNA, 64 nt, Homo Sapiens
uuagagauaccagaaugcugguauucuacuacuugugcaauauauauguuuuaaaaaacaaauu

SEQ ID NO: 258804 - RNA, 64 nt, Homo Sapiens
aagacguagaaauguaaaauguaaaauaauuuuagugcaauauggcaucaacuaguucuuccau

SEQ ID NO: 258805 - RNA, 64 nt, Homo Sapiens
ugagcuuagaguuaggaauuuuaaacugugugaugugcaauaaccuuuccagccugaagccugc

SEQ ID NO: 258806 - RNA, 64 nt, Homo Sapiens
aacauagauccuaaaggaucacgggcugagccaugugcaauaaggucuugguagaugucccuag

SEQ ID NO: 258807 - RNA, 64 nt, Homo Sapiens
guuuguacuguuuguauaaacuauuuguuguuaugugcaauacuaggcuauaaccuaaccucga

SEQ ID NO: 258808 - RNA, 64 nt, Homo Sapiens
ugaauauuuuguugcauugugcacaucacuguuugugcaauauauguuguuagcaucuuuguau

SEQ ID NO: 258809 - RNA, 64 nt, Homo Sapiens
gcugcuucgauuugguuuccugauguacuuaauggugcaauaaauggcacugucuuugaugcag

SEQ ID NO: 258810 - RNA, 64 nt, Homo Sapiens
acagccugucauugaaucuauuuguuuuuguauggugcaauauggacugaaagcuuugaugaaa

SEQ ID NO: 258811 - RNA, 64 nt, Homo Sapiens
cuguugagugagcugcuaugacuuugguagagaggugcaauauguuuuuugaaccagcuauaaa

SEQ ID NO: 258812 - RNA, 64 nt, Homo Sapiens
aaaaaauugucugaaauguuuauuuugcaaaacagugcaauagaaucuaguuaugccuucauca

SEQ ID NO: 258813 - RNA, 64 nt, Homo Sapiens
ugaccuccuuauguauucucaauuaccuguauuugugcaauaaauuggaauaauguaacuugau

SEQ ID NO: 258814 - RNA, 64 nt, Homo Sapiens
ugggucuggaccccacggggcuggggagggccaugugcaauauuuggaggguuuucuggagggc

SEQ ID NO: 258815 - RNA, 64 nt, Homo Sapiens
ucaccuuuggugggggcagggccugguggcaccugugcaauaaugucuguguuucucucccacc

SEQ ID NO: 258816 - RNA, 64 nt, Homo Sapiens
uuagauauauuauuugcagcaagaaguucauucugugcaauauggacauguuugcaaaccauac

SEQ ID NO: 258817 - RNA, 64 nt, Homo Sapiens
uaaucuuucgcaagugauuucccacugauaaauugugcaauaaagaucuguguuauucuuagua

SEQ ID NO: 258818 - RNA, 64 nt, Homo Sapiens
aauagcuaauuuauuuccccggcuguggguagaugugcaauagaagagauuuagaucuggacca

SEQ ID NO: 258819 - RNA, 64 nt, Homo Sapiens
uucccauggaaugcagcaguggcuucggccaccugugcaauauuuuuacuuuugucagaaucaa

SEQ ID NO: 258820 - RNA, 64 nt, Homo Sapiens
cucugugugugauugcaggacuguaaauaaaagagugcaauaauaaaugcuuuaucuguguuuu

SEQ ID NO: 258821 - RNA, 64 nt, Homo Sapiens
gcaacaucucugaauccuuugaagcagaaauauagugcaauaguggacucagaaacgagaucgg

SEQ ID NO: 258822 - RNA, 64 nt, Homo Sapiens
ugagagaauguauuuucauauaagaaauacucaugugcaauaggugaauugcacugaacagaau

SEQ ID NO: 258823 - RNA, 64 nt, Homo Sapiens
aguauuuguuuuaccuuuggcagauuuuauaaaugugcaauaaaaaaaaauugauacaacuaug

SEQ ID NO: 258824 - RNA, 64 nt, Homo Sapiens
gguuauguuucuauguggugagacccagcgccgugugcaauaaaauaccuuuuucuaugaaaaa

SEQ ID NO: 258825 - RNA, 64 nt, Homo Sapiens
gugaaggcugucugcccagacagaugugcuauuagugcaauaaguguccuguagcuugauauua

SEQ ID NO: 258826 - RNA, 64 nt, Homo Sapiens
ugggagguauaacccugcuccucucucccagucugugcaauaaaggucgugaagaucucucagc

SEQ ID NO: 258827 - RNA, 64 nt, Homo Sapiens
uaagauauauguauauaaaguguaugcuguauuggugcaauaaugguaauuaaaaauaugaaaa

SEQ ID NO: 258828 - RNA, 64 nt, Homo Sapiens
gcugaguuuuuuauuuuuaaguguuuguuuuucagugcaauaauuuuugugugugugugauucu

SEQ ID NO: 258829 - RNA, 64 nt, Homo Sapiens
cugggcugccagcaguacgugggaaagguggaaugugcaauaggaacagaucugugcauuuugu

SEQ ID NO: 258830 - RNA, 64 nt, Homo Sapiens
ccgcgaacaucacaccguuccccgaccaagccgugugcaauacaacagagggaggcagguggga

SEQ ID NO: 258831 - RNA, 64 nt, Homo Sapiens
gaaugggguggaacacagcauuuugucaagcacugugcaauauuccauauuuuuccccacuaug

SEQ ID NO: 258832 - RNA, 64 nt, Homo Sapiens
gguaaucuuuuacgggugggaggugagauugauagugcaauaaucagugaucuauagacccuca

SEQ ID NO: 258833 - RNA, 64 nt, Homo Sapiens
uccaucaaaccucacauuugugaacucaaacgaugugcaauacauuuuuuucucuuuccuugaa

SEQ ID NO: 258834 - RNA, 64 nt, Homo Sapiens
aauuuagggagaaauguugucuggagagguuaaggugcaauaagauagaguagaagauuugaug

SEQ ID NO: 258835 - RNA, 64 nt, Homo Sapiens; identical to SEQ ID NO: 169435

SEQ ID NO: 258836 - RNA, 64 nt, Homo Sapiens; identical to SEQ ID NO: 169436

SEQ ID NO: 258837 - RNA, 64 nt, Homo Sapiens; identical to SEQ ID NO: 169437

SEQ ID NO: 258838 - RNA, 64 nt, Homo Sapiens
uucaaagaaaagaaaacacaaauaauaaaauauugugcaauauagagacauaaaaccuuuuuuu

SEQ ID NO: 258839 - RNA, 64 nt, Homo Sapiens
gaggucuccacaccagaugucgcugggacguugugugcaauagaaguggguggagaguggagug

SEQ ID NO: 258840 - RNA, 64 nt, Homo Sapiens
gugggguaggggcagggaaauuacaugauuugaugugcaauaggggccauccccauagccaugu

SEQ ID NO: 258841 - RNA, 64 nt, Homo Sapiens
uaauauguagaaauuuaaguaaccaguacucugggugcaauaaacuucacagaaagugcauuuu

SEQ ID NO: 258842 - RNA, 64 nt, Homo Sapiens
ucugacccagugcccccacuaaacucuguugcaagugcaauaaacagacacccaggacuuauuu

SEQ ID NO: 258843 - RNA, 64 nt, Homo Sapiens
cauuuauuucuuauaugaauugcuuucacuguuugugcaauauggaauugcuugguggaacaua

SEQ ID NO: 258844 - RNA, 64 nt, Homo Sapiens
uugcaaacagcucuucuuaguggauucaaauuaagugcaauauucaggagacaucagguccccc

SEQ ID NO: 258845 - RNA, 64 nt, Homo Sapiens
ugaauuuccuggccuacuuccccugccaagcaucgugcaauaagaaaaaucagcgucauuuguu

SEQ ID NO: 258846 - RNA, 64 nt, Homo Sapiens
cuauuuuuugguaaagauuuauuccuuaaauuuugugcaauaaaaaauguaagugugcuuggga

SEQ ID NO: 258847 - RNA, 64 nt, Homo Sapiens
cuuucuuuuuuuuuuuuuuuguguagaaaaauaggugcaauaaugaucaaaguuuugaugucuu

SEQ ID NO: 258848 - RNA, 64 nt, Homo Sapiens
cagacaugcagugaaaugguucuuuguuaaaaaugugcaauaaaaauagauuacaauaaguagu

SEQ ID NO: 258849 - RNA, 64 nt, Homo Sapiens
uuuuguugagaggaaaagugaauugguuaaaagagugcaauaaggauccaaauacagugacuuu

SEQ ID NO: 258850 - RNA, 64 nt, Homo Sapiens
aggguuguuuucuguuaagcaaagccgagauccagugcaauaccuggacugucaccguccugug

SEQ ID NO: 258851 - RNA, 63 nt, Homo Sapiens
uguaaaaaaaaaaaaagauagaugagaaaucucugugcaauaacauaaaaacugaagaacauu

SEQ ID NO: 258852 - RNA, 64 nt, Homo Sapiens
gagugugccucauuaucuuggaaauuuuaaugaagugcaauacuucuagguuaaguuugagccu

SEQ ID NO: 258853 - RNA, 64 nt, Homo Sapiens
gagauguauacagucuuuacuuguacauaaaaaugugcaauauguacacuuuaauguuuuauuc

SEQ ID NO: 258854 - RNA, 64 nt, Homo Sapiens
uuuuguauauuuauucuauuuuguauauuguuaagugcaauaaaguuuuugccuugcuuuauuu

SEQ ID NO: 258855 - RNA, 64 nt, Homo Sapiens
cgcugauguacacacauuucauuauuugccaauggugcaauaaccacugcugaccaacccacua

SEQ ID NO: 258856 - RNA, 64 nt, Homo Sapiens
uucugguuuuaauuuuuaguugugcuuugagucagugcaauaaacuagacuuuuuccaaaccug

SEQ ID NO: 258857 - RNA, 64 nt, Homo Sapiens
uguauuuggagaaacaggaguguucacuuaucuagugcaauauguucacaguuuauuaaugcuu

SEQ ID NO: 258858 - RNA, 64 nt, Homo Sapiens
uuauucuccauaauuaaacuuguugaauaauaaagugcaauacucuguuggcuacaucauuuug

SEQ ID NO: 258859 - RNA, 64 nt, Homo Sapiens
auaaaacucugaaauuaagacugcuguuccuuuagugcaauacagagaaaauuguauaaccauc

SEQ ID NO: 258860 - RNA, 64 nt, Homo Sapiens
uucuauuauguccguugauacauguuugaguucugugcaauauuguuauuuuguuuauuauuuu

SEQ ID NO: 258861 - RNA, 64 nt, Homo Sapiens
uguaugauuauccagaacuaaauuacugauuuuagugcaauaucuaaauaaauaccagguauga

SEQ ID NO: 258862 - RNA, 64 nt, Homo Sapiens
uaacaugucuaaaguuaggguuucuuuuuugagugugcaauauguaguuuucuaaauguuucuu

SEQ ID NO: 258863 - RNA, 64 nt, Homo Sapiens
uucuguauuuauuggguuuuggagccuuuuaacugugcaauaauauuaaggcaguacaaauugu

SEQ ID NO: 258864 - RNA, 64 nt, Homo Sapiens
uucuguaggaagaaucaaaucaccgauuuaaagagugcaauauauaauaaucauuuuuaaagua

SEQ ID NO: 258865 - RNA, 64 nt, Homo Sapiens
aaccuuuuccuguggaaaccugucauagaauuuugugcaauauguaugugucuaugaagcuguc

SEQ ID NO: 258866 - RNA, 64 nt, Homo Sapiens
ggagucagagucucgcucucuuguccaggcuggagugcaauagcgcgaucugggcucacugcaa

SEQ ID NO: 258867 - RNA, 64 nt, Homo Sapiens
aacauacucuuuguauauauuuauuauaugaaaggugcaauauuuuauuuuguacaguauguaa

SEQ ID NO: 258868 - RNA, 64 nt, Homo Sapiens
uucuguuuaaacugugauuuucuuuauuguguuggugcaauauuuuauuaucauuuaaccucag

SEQ ID NO: 258869 - RNA, 64 nt, Homo Sapiens
gccaguguauucuguuuuuaaaacugugccugcagugcaauacuccuucugguguauuuuaucc

SEQ ID NO: 258870 - RNA, 64 nt, Homo Sapiens
ucugugauugugccuaugcacagggacauacuuugugcaauauuuuguaccucucauuuucagu

SEQ ID NO: 258871 - RNA, 64 nt, Homo Sapiens
ccaagauuacccucggucaucuucaucacagcaugugcaauaugcagaggaucaccagugcauc

SEQ ID NO: 258872 - RNA, 64 nt, Homo Sapiens
gugcuacuguauuugucucaaagcuaccaaguuugugcaauaaguggaagggaugucauccuuc

SEQ ID NO: 258873 - RNA, 64 nt, Homo Sapiens
gugaauaugugcuuuuacuguacauagugcuauugugcaauaggucuuaugcuguuuucacuca

SEQ ID NO: 258874 - RNA, 64 nt, Homo Sapiens
ugcccgccccuugccucgauauugccaguuucuugugcaauaaacaaucagcagcugugggugg

SEQ ID NO: 258875 - RNA, 64 nt, Homo Sapiens
ugcugggccuccugcccgcgaccugcugcuccccgugcaauaccugcgcccgcggguccucccc

SEQ ID NO: 258876 - RNA, 64 nt, Homo Sapiens
ggagugacccagcuacugaaguucuaggaacucagugcaauacgugugugcguggcuaucagga

SEQ ID NO: 258877 - RNA, 64 nt, Homo Sapiens; identical to SEQ ID NO: 169438

SEQ ID NO: 258878 - RNA, 64 nt, Homo Sapiens; identical to SEQ ID NO: 169439

SEQ ID NO: 258879 - RNA, 64 nt, Homo Sapiens
accuucucagugguuuacaugccucugaaacuaugugcaauauuuuugguugacacuuguaucc

SEQ ID NO: 258880 - RNA, 64 nt, Homo Sapiens
aaagaaacaaacauugaauuacuaaacaaagauggugcaauaucuuuguuuuuuuuuuaugagg

SEQ ID NO: 258881 - RNA, 64 nt, Homo Sapiens
ucuaccuucaacaugugcucgcucugcaugauuagugcaauaaaacucccuuccuuaugcauac

SEQ ID NO: 258882 - RNA, 64 nt, Homo Sapiens
augggugguugggagagaaacuagaacagaagaugugcaauagggcucagagcagccccaggaa

SEQ ID NO: 258883 - RNA, 64 nt, Homo Sapiens
aaguugcguugaggccgcaucuuucuucagcagcgugcaauagcuggcuccucuauaggagaug

SEQ ID NO: 258884 - RNA, 64 nt, Homo Sapiens
uucugugacucucuuggaaaugccuugacugaaugugcaauauuugugucucuugguuucuaac

SEQ ID NO: 258885 - RNA, 64 nt, Homo Sapiens
ggagugucucacaggauugcuuacucauuucuaagugcaauaaguuuuugucaguuuguuugcc

SEQ ID NO: 258886 - RNA, 64 nt, Homo Sapiens
guguuuuuauuuaaaaccaaccuuugugggauuugugcaauaaacuuggacccagggccugaga

SEQ ID NO: 258887 - RNA, 64 nt, Homo Sapiens
uuagauacucagcagaaguaagaagucugaagaagugcaauauguaugugucagaacauucaga

SEQ ID NO: 258888 - RNA, 64 nt, Homo Sapiens
guccucgugccugcugcucaucaccuaaccacacgugcaauaaaagugcagcuguaggucguca

SEQ ID NO: 258889 - RNA, 64 nt, Homo Sapiens
uagcugcuaacaagacuggccagaaugaaaggcagugcaauauucauuggacccugacuguaua

SEQ ID NO: 258890 - RNA, 64 nt, Homo Sapiens
ugaaaaaaacgguauaaaaguuuguaccuauauugugcaauacuauguaaucguaaauauuaau

SEQ ID NO: 258891 - RNA, 64 nt, Homo Sapiens
aaaccuuccuuuuuaagaaggguuguaaaagucagugcaauaacuuuucuaaauuacuauguca

SEQ ID NO: 258892 - RNA, 64 nt, Homo Sapiens
uaaaggcuaaggacuagaugucuuuauaauuguugugcaauaacccacguguccuggucacugg

SEQ ID NO: 258893 - RNA, 64 nt, Homo Sapiens
cuccccuucccuuuuuuuguuauuuuuucagacugugcaauacuuagagaaccuauagcaucuu

SEQ ID NO: 258894 - RNA, 64 nt, Homo Sapiens
augaugauuucuuuucccugcacacaucuuuccggugcaauaucuaucaauugugaaucuggcu

SEQ ID NO: 258895 - RNA, 64 nt, Homo Sapiens
agcugcuugcagcaacuugauuuccccaaguccugugcaauagccccaggauuggauuccuuca

SEQ ID NO: 258896 - RNA, 64 nt, Homo Sapiens
aaguguuuuggaauuugaagauuguucaaggagggugcaauauuggaaaccaauuuuuuuaguu

SEQ ID NO: 258897 - RNA, 64 nt, Homo Sapiens
auguaauuaauucaaguccuacagccaauuuauagugcaauaaauacauuuggguauaaugaca

SEQ ID NO: 258898 - RNA, 64 nt, Homo Sapiens
agguggcccccguccgaggaggaucguuuucuaagugcaauacuuggcccgccggcuucccgcu

SEQ ID NO: 258899 - RNA, 64 nt, Homo Sapiens
cgauccuccuugacgaguuuuguuuuucaaaauggugcaauaauuuaaguggcaucuucucucc

SEQ ID NO: 258900 - RNA, 64 nt, Homo Sapiens
ugcccccuuccccagaacaaaacauguugaucaugugcaauauuucuuacugugccgagaagcc

SEQ ID NO: 258901 - RNA, 60 nt, Homo Sapiens; identical to SEQ ID NO: 258327

SEQ ID NO: 258902 - RNA, 64 nt, Homo Sapiens
ucuccgguaacccguccaccccucuuccaaaacagugcaauaaacgcugguccuuagccccaug

SEQ ID NO: 258903 - RNA, 64 nt, Homo Sapiens
cccauugccaugggguccuucgaaaccuggcucagugcaauacuccgacacguccccguucccc

SEQ ID NO: 258904 - RNA, 64 nt, Homo Sapiens
uuaaaggaagcaaccaccuuguuuauuuucuauugugcaauaucaauuuuaaggauugacaaga

SEQ ID NO: 258905 - RNA, 64 nt, Homo Sapiens
guggaaaccaaacugcuccaccaggccggaccacgugcaauagggcagccuccugauuucauaa

SEQ ID NO: 258906 - RNA, 64 nt, Homo Sapiens
aaauaaaaggccagcgggcgaugacucaccugaagugcaauacgcagcacucgccucccuacca

SEQ ID NO: 258907 - RNA, 64 nt, Homo Sapiens
cuggaauaaauauaaaugaaggggugagagaagugugcaauagucccuucuaagacccacgagc

SEQ ID NO: 258908 - RNA, 64 nt, Homo Sapiens
gagggacgucuucuauuuuuuauauaggguccaugugcaauagggccucagccaggugggccug

SEQ ID NO: 258909 - RNA, 64 nt, Homo Sapiens
uugacuuaaacuuguuuagcacacaugagaacaggugcaauauauacugucuaauauaggaaaa

SEQ ID NO: 258910 - RNA, 64 nt, Homo Sapiens
cgggugcccacagaggcucagcuccuucuuuucugugcaauacgagacccggccgcaccccgag

SEQ ID NO: 258911 - RNA, 64 nt, Homo Sapiens; identical to SEQ ID NO: 169440

SEQ ID NO: 258912 - RNA, 64 nt, Homo Sapiens; identical to SEQ ID NO: 169441

SEQ ID NO: 258913 - RNA, 64 nt, Homo Sapiens
aaacccgcaucugcucacggggaugcugcagucugugcaauaaugggguuggguuugggguuca

SEQ ID NO: 258914 - RNA, 64 nt, Homo Sapiens
uugucuuuuguauaggucaucauaucuaaauuuagugcaauaucaauauuaaauucaaauaucc

SEQ ID NO: 258915 - RNA, 64 nt, Homo Sapiens
cuuccuaguaccugagugagucaguuaaggagcugugcaauaacccacucugcccugaccccga

SEQ ID NO: 258916 - RNA, 64 nt, Homo Sapiens
aagucacccucaauaaauacagcaauagacguuagugcaauacauaucaaucacaacagguaau

SEQ ID NO: 258917 - RNA, 64 nt, Homo Sapiens
auuugcugucagccacauauugagaugacacuaggugcaauagcagggauagauuuuguuggug

SEQ ID NO: 258918 - RNA, 64 nt, Homo Sapiens
ugcuacaaauagugcuaauaaaguuaaauugcacgugcaauacggaacacugucaauggacugc

SEQ ID NO: 258919 - RNA, 64 nt, Homo Sapiens
ucauuguaagugcacugauauaguauuucauuaugugcaauaaggagcuaagagaauugggcau

SEQ ID NO: 258920 - RNA, 64 nt, Homo Sapiens
ggaggcugacuguagggcugacuugggugaaguugugcaauauuggguccaacaagaacaccug

SEQ ID NO: 258921 - RNA, 64 nt, Homo Sapiens
cacuuuccacuggaguucacuuucaauugcuucugugcaauaaaaccaagugcuuauaaaauga

SEQ ID NO: 258922 - RNA, 64 nt, Homo Sapiens
uuuagcccagauacacauacucuuuuuugucuuugugcaauaaucaguguuccuggcagagccu

SEQ ID NO: 258923 - RNA, 64 nt, Homo Sapiens
cuacuccagagcuccuuuaacaucugcuaauuaagugcaauaaauuuuucuagaaaauggcaaa

SEQ ID NO: 258924 - RNA, 64 nt, Homo Sapiens
uuggaaugggacauugguguguauucagaauguugugcaauauuggaauacaaucaaggguuuu

SEQ ID NO: 258925 - RNA, 64 nt, Homo Sapiens
ggcucucuguugugagaucuucagcuaccucauggugcaauaacacacacacgcuuaaccaugu

SEQ ID NO: 258926 - RNA, 64 nt, Homo Sapiens
caguggcauaggaagacggcaaaaauuuccuaaagugcaauagauuuucaaguguauugugccu

SEQ ID NO: 258927 - RNA, 64 nt, Homo Sapiens; identical to SEQ ID NO: 169442

SEQ ID NO: 258928 - RNA, 64 nt, Homo Sapiens; identical to SEQ ID NO: 169443

SEQ ID NO: 258929 - RNA, 64 nt, Homo Sapiens
agacgcuugguuuuucucagaacccccaaaagaugugcaauagcuguuguuacaaaccaccaaa

SEQ ID NO: 258930 - RNA, 64 nt, Homo Sapiens
gauuggauuuuauguugacauuuguuugguuauagugcaauauauuuuguaugcaagcaguuuc

SEQ ID NO: 258931 - RNA, 64 nt, Homo Sapiens
ucgaucucggcucacugcaauugcccaggcuggagugcaauagcgagauggaguuucacucuug

SEQ ID NO: 258932 - RNA, 64 nt, Homo Sapiens
cuuuaaagcuaucaacaaaagcuagaugaaaagcgugcaauauguaauaguuguuuacuagugu

SEQ ID NO: 258933 - RNA, 64 nt, Homo Sapiens
cuuaaauacuacugcucuaaugacacagaauugugugcaauauuuagaaacugaggguuaucuu

SEQ ID NO: 258934 - RNA, 64 nt, Homo Sapiens
ucagcaguuaaauaguggaauuuuuuuuuacaaugugcaauaacuauuguaauaggcauuuuuu

SEQ ID NO: 258935 - RNA, 64 nt, Homo Sapiens
augaugucugcucuagggaaaaaaugacacaucugugcaauagacugcaacuuucuauaaugcc

SEQ ID NO: 258936 - RNA, 64 nt, Homo Sapiens
auaugcagcauuaacuuuacugacauggagugaagugcaauauuauaaauauuauagauuaaaa

SEQ ID NO: 258937 - RNA, 64 nt, Homo Sapiens; identical to SEQ ID NO: 169442

SEQ ID NO: 258938 - RNA, 64 nt, Homo Sapiens; identical to SEQ ID NO: 169443

SEQ ID NO: 258939 - RNA, 64 nt, Homo Sapiens
caauggcauaagaaguugacaaaaauuucuuaaagugcaauagauuuucaaguguauugugccu

SEQ ID NO: 258940 - RNA, 64 nt, Homo Sapiens
agaagggacuuaauuacaaacuuaagacguaagugugcaauaaaguaagcuaagaagaaaauau

SEQ ID NO: 258941 - RNA, 64 nt, Homo Sapiens; identical to SEQ ID NO: 132477

SEQ ID NO: 258942 - RNA, 64 nt, Homo Sapiens; identical to SEQ ID NO: 132478

SEQ ID NO: 258943 - RNA, 64 nt, Homo Sapiens; identical to SEQ ID NO: 132479

SEQ ID NO: 258944 - RNA, 64 nt, Homo Sapiens; identical to SEQ ID NO: 132480

SEQ ID NO: 258945 - RNA, 64 nt, Homo Sapiens; identical to SEQ ID NO: 132481

SEQ ID NO: 258946 - RNA, 64 nt, Homo Sapiens; identical to SEQ ID NO: 132482

SEQ ID NO: 258947 - RNA, 64 nt, Homo Sapiens; identical to SEQ ID NO: 132483

SEQ ID NO: 258948 - RNA, 64 nt, Homo Sapiens; identical to SEQ ID NO: 132484

SEQ ID NO: 258949 - RNA, 64 nt, Homo Sapiens; identical to SEQ ID NO: 132485

SEQ ID NO: 258950 - RNA, 64 nt, Homo Sapiens; identical to SEQ ID NO: 132486

SEQ ID NO: 258951 - RNA, 64 nt, Homo Sapiens; identical to SEQ ID NO: 132487

SEQ ID NO: 258952 - RNA, 64 nt, Homo Sapiens; identical to SEQ ID NO: 132488

SEQ ID NO: 258953 - RNA, 64 nt, Homo Sapiens; identical to SEQ ID NO: 132489

SEQ ID NO: 258954 - RNA, 64 nt, Homo Sapiens; identical to SEQ ID NO: 132490

SEQ ID NO: 258955 - RNA, 64 nt, Homo Sapiens; identical to SEQ ID NO: 132491

SEQ ID NO: 258956 - RNA, 64 nt, Homo Sapiens; identical to SEQ ID NO: 132492

SEQ ID NO: 258957 - RNA, 64 nt, Homo Sapiens; identical to SEQ ID NO: 132493

SEQ ID NO: 258958 - RNA, 64 nt, Homo Sapiens; identical to SEQ ID NO: 132494

SEQ ID NO: 258959 - RNA, 64 nt, Homo Sapiens; identical to SEQ ID NO: 132495

SEQ ID NO: 258960 - RNA, 64 nt, Homo Sapiens; identical to SEQ ID NO: 132496

SEQ ID NO: 258961 - RNA, 64 nt, Homo Sapiens; identical to SEQ ID NO: 132497

SEQ ID NO: 258962 - RNA, 64 nt, Homo Sapiens; identical to SEQ ID NO: 132498

SEQ ID NO: 258963 - RNA, 64 nt, Homo Sapiens; identical to SEQ ID NO: 132499

SEQ ID NO: 258964 - RNA, 64 nt, Homo Sapiens; identical to SEQ ID NO: 132500

SEQ ID NO: 258965 - RNA, 64 nt, Homo Sapiens; identical to SEQ ID NO: 132501

SEQ ID NO: 258966 - RNA, 64 nt, Homo Sapiens; identical to SEQ ID NO: 132502

SEQ ID NO: 258967 - RNA, 64 nt, Homo Sapiens; identical to SEQ ID NO: 132503

SEQ ID NO: 258968 - RNA, 64 nt, Homo Sapiens; identical to SEQ ID NO: 132504

SEQ ID NO: 258969 - RNA, 64 nt, Homo Sapiens; identical to SEQ ID NO: 132505

SEQ ID NO: 258970 - RNA, 64 nt, Homo Sapiens; identical to SEQ ID NO: 132506

SEQ ID NO: 258971 - RNA, 64 nt, Homo Sapiens; identical to SEQ ID NO: 132507

SEQ ID NO: 258972 - RNA, 64 nt, Homo Sapiens; identical to SEQ ID NO: 132508

SEQ ID NO: 258973 - RNA, 64 nt, Homo Sapiens; identical to SEQ ID NO: 132509

SEQ ID NO: 258974 - RNA, 64 nt, Homo Sapiens; identical to SEQ ID NO: 132510

SEQ ID NO: 258975 - RNA, 64 nt, Homo Sapiens; identical to SEQ ID NO: 132511

SEQ ID NO: 258976 - RNA, 64 nt, Homo Sapiens; identical to SEQ ID NO: 132512

SEQ ID NO: 258977 - RNA, 64 nt, Homo Sapiens; identical to SEQ ID NO: 132513

SEQ ID NO: 258978 - RNA, 64 nt, Homo Sapiens; identical to SEQ ID NO: 132514

SEQ ID NO: 258979 - RNA, 64 nt, Homo Sapiens; identical to SEQ ID NO: 132515

SEQ ID NO: 258980 - RNA, 64 nt, Homo Sapiens; identical to SEQ ID NO: 132516

SEQ ID NO: 258981 - RNA, 64 nt, Homo Sapiens; identical to SEQ ID NO: 132517

SEQ ID NO: 258982 - RNA, 64 nt, Homo Sapiens; identical to SEQ ID NO: 132518

SEQ ID NO: 258983 - RNA, 64 nt, Homo Sapiens; identical to SEQ ID NO: 132519

SEQ ID NO: 258984 - RNA, 64 nt, Homo Sapiens; identical to SEQ ID NO: 132520

SEQ ID NO: 258985 - RNA, 64 nt, Homo Sapiens; identical to SEQ ID NO: 132521

SEQ ID NO: 258986 - RNA, 64 nt, Homo Sapiens; identical to SEQ ID NO: 132522

SEQ ID NO: 258987 - RNA, 64 nt, Homo Sapiens; identical to SEQ ID NO: 132523

SEQ ID NO: 258988 - RNA, 64 nt, Homo Sapiens; identical to SEQ ID NO: 132524

SEQ ID NO: 258989 - RNA, 64 nt, Homo Sapiens; identical to SEQ ID NO: 132525

SEQ ID NO: 258990 - RNA, 64 nt, Homo Sapiens; identical to SEQ ID NO: 132526

SEQ ID NO: 258991 - RNA, 64 nt, Homo Sapiens; identical to SEQ ID NO: 132527

SEQ ID NO: 258992 - RNA, 63 nt, Homo Sapiens; identical to SEQ ID NO: 132528

SEQ ID NO: 258993 - RNA, 54 nt, Homo Sapiens; identical to SEQ ID NO: 132529

SEQ ID NO: 258994 - RNA, 64 nt, Homo Sapiens; identical to SEQ ID NO: 132530

SEQ ID NO: 258995 - RNA, 64 nt, Homo Sapiens; identical to SEQ ID NO: 132531

SEQ ID NO: 258996 - RNA, 64 nt, Homo Sapiens; identical to SEQ ID NO: 132532

SEQ ID NO: 258997 - RNA, 64 nt, Homo Sapiens; identical to SEQ ID NO: 132533

SEQ ID NO: 258998 - RNA, 64 nt, Homo Sapiens; identical to SEQ ID NO: 132534

SEQ ID NO: 258999 - RNA, 64 nt, Homo Sapiens; identical to SEQ ID NO: 132535

SEQ ID NO: 259000 - RNA, 64 nt, Homo Sapiens; identical to SEQ ID NO: 132536

SEQ ID NO: 259001 - RNA, 64 nt, Homo Sapiens; identical to SEQ ID NO: 132537

SEQ ID NO: 259002 - RNA, 64 nt, Homo Sapiens; identical to SEQ ID NO: 132538

SEQ ID NO: 259003 - RNA, 64 nt, Homo Sapiens; identical to SEQ ID NO: 132539

SEQ ID NO: 259004 - RNA, 64 nt, Homo Sapiens; identical to SEQ ID NO: 132540

SEQ ID NO: 259005 - RNA, 64 nt, Homo Sapiens; identical to SEQ ID NO: 132541

SEQ ID NO: 259006 - RNA, 64 nt, Homo Sapiens; identical to SEQ ID NO: 132542

SEQ ID NO: 259007 - RNA, 64 nt, Homo Sapiens; identical to SEQ ID NO: 132543

SEQ ID NO: 259008 - RNA, 64 nt, Homo Sapiens; identical to SEQ ID NO: 132544

SEQ ID NO: 259009 - RNA, 64 nt, Homo Sapiens; identical to SEQ ID NO: 132545

SEQ ID NO: 259010 - RNA, 64 nt, Homo Sapiens; identical to SEQ ID NO: 132546

SEQ ID NO: 259011 - RNA, 64 nt, Homo Sapiens; identical to SEQ ID NO: 132547

SEQ ID NO: 259012 - RNA, 64 nt, Homo Sapiens; identical to SEQ ID NO: 132548

SEQ ID NO: 259013 - RNA, 64 nt, Homo Sapiens; identical to SEQ ID NO: 132549

SEQ ID NO: 259014 - RNA, 64 nt, Homo Sapiens; identical to SEQ ID NO: 132550

SEQ ID NO: 259015 - RNA, 64 nt, Homo Sapiens; identical to SEQ ID NO: 132551

SEQ ID NO: 259016 - RNA, 64 nt, Homo Sapiens; identical to SEQ ID NO: 132552

SEQ ID NO: 259017 - RNA, 64 nt, Homo Sapiens; identical to SEQ ID NO: 132553

SEQ ID NO: 259018 - RNA, 64 nt, Homo Sapiens; identical to SEQ ID NO: 132554

SEQ ID NO: 259019 - RNA, 64 nt, Homo Sapiens; identical to SEQ ID NO: 132555

SEQ ID NO: 259020 - RNA, 64 nt, Homo Sapiens; identical to SEQ ID NO: 132556

SEQ ID NO: 259021 - RNA, 64 nt, Homo Sapiens; identical to SEQ ID NO: 132557

SEQ ID NO: 259022 - RNA, 64 nt, Homo Sapiens; identical to SEQ ID NO: 132558

SEQ ID NO: 259023 - RNA, 64 nt, Homo Sapiens; identical to SEQ ID NO: 132559

SEQ ID NO: 259024 - RNA, 64 nt, Homo Sapiens; identical to SEQ ID NO: 132560

SEQ ID NO: 259025 - RNA, 64 nt, Homo Sapiens; identical to SEQ ID NO: 132561

SEQ ID NO: 259026 - RNA, 64 nt, Homo Sapiens; identical to SEQ ID NO: 132562

SEQ ID NO: 259027 - RNA, 64 nt, Homo Sapiens; identical to SEQ ID NO: 132563

SEQ ID NO: 259028 - RNA, 64 nt, Homo Sapiens; identical to SEQ ID NO: 132564

SEQ ID NO: 259029 - RNA, 64 nt, Homo Sapiens; identical to SEQ ID NO: 132565

SEQ ID NO: 259030 - RNA, 64 nt, Homo Sapiens; identical to SEQ ID NO: 132566

SEQ ID NO: 259031 - RNA, 64 nt, Homo Sapiens; identical to SEQ ID NO: 132567

SEQ ID NO: 259032 - RNA, 64 nt, Homo Sapiens; identical to SEQ ID NO: 132568

SEQ ID NO: 259033 - RNA, 64 nt, Homo Sapiens; identical to SEQ ID NO: 132569

SEQ ID NO: 259034 - RNA, 64 nt, Homo Sapiens; identical to SEQ ID NO: 132570

SEQ ID NO: 259035 - RNA, 64 nt, Homo Sapiens; identical to SEQ ID NO: 132571

SEQ ID NO: 259036 - RNA, 64 nt, Homo Sapiens; identical to SEQ ID NO: 132572

SEQ ID NO: 259037 - RNA, 64 nt, Homo Sapiens; identical to SEQ ID NO: 132573

SEQ ID NO: 259038 - RNA, 64 nt, Homo Sapiens; identical to SEQ ID NO: 132574

SEQ ID NO: 259039 - RNA, 64 nt, Homo Sapiens; identical to SEQ ID NO: 132575

SEQ ID NO: 259040 - RNA, 64 nt, Homo Sapiens; identical to SEQ ID NO: 132576

SEQ ID NO: 259041 - RNA, 64 nt, Homo Sapiens; identical to SEQ ID NO: 132577

SEQ ID NO: 259042 - RNA, 64 nt, Homo Sapiens; identical to SEQ ID NO: 132578

SEQ ID NO: 259043 - RNA, 64 nt, Homo Sapiens; identical to SEQ ID NO: 132579

SEQ ID NO: 259044 - RNA, 64 nt, Homo Sapiens; identical to SEQ ID NO: 132580

SEQ ID NO: 259045 - RNA, 64 nt, Homo Sapiens; identical to SEQ ID NO: 132581

SEQ ID NO: 259046 - RNA, 64 nt, Homo Sapiens; identical to SEQ ID NO: 132582

SEQ ID NO: 259047 - RNA, 64 nt, Homo Sapiens; identical to SEQ ID NO: 132583

SEQ ID NO: 259048 - RNA, 64 nt, Homo Sapiens; identical to SEQ ID NO: 132584

SEQ ID NO: 259049 - RNA, 64 nt, Homo Sapiens; identical to SEQ ID NO: 132585

SEQ ID NO: 259050 - RNA, 64 nt, Homo Sapiens; identical to SEQ ID NO: 132586

SEQ ID NO: 259051 - RNA, 64 nt, Homo Sapiens; identical to SEQ ID NO: 132587

SEQ ID NO: 259052 - RNA, 64 nt, Homo Sapiens; identical to SEQ ID NO: 132588

SEQ ID NO: 259053 - RNA, 64 nt, Homo Sapiens; identical to SEQ ID NO: 132589

SEQ ID NO: 259054 - RNA, 64 nt, Homo Sapiens; identical to SEQ ID NO: 132590

SEQ ID NO: 259055 - RNA, 64 nt, Homo Sapiens; identical to SEQ ID NO: 132591

SEQ ID NO: 259056 - RNA, 64 nt, Homo Sapiens; identical to SEQ ID NO: 132592

SEQ ID NO: 259057 - RNA, 64 nt, Homo Sapiens; identical to SEQ ID NO: 132593

SEQ ID NO: 259058 - RNA, 64 nt, Homo Sapiens; identical to SEQ ID NO: 132594

SEQ ID NO: 259059 - RNA, 64 nt, Homo Sapiens; identical to SEQ ID NO: 132595

SEQ ID NO: 259060 - RNA, 64 nt, Homo Sapiens; identical to SEQ ID NO: 132596

SEQ ID NO: 259061 - RNA, 64 nt, Homo Sapiens; identical to SEQ ID NO: 132597

SEQ ID NO: 259062 - RNA, 64 nt, Homo Sapiens; identical to SEQ ID NO: 132598

SEQ ID NO: 259063 - RNA, 64 nt, Homo Sapiens; identical to SEQ ID NO: 132599

SEQ ID NO: 259064 - RNA, 64 nt, Homo Sapiens; identical to SEQ ID NO: 132600

SEQ ID NO: 259065 - RNA, 64 nt, Homo Sapiens; identical to SEQ ID NO: 132601

SEQ ID NO: 259066 - RNA, 64 nt, Homo Sapiens; identical to SEQ ID NO: 132602

SEQ ID NO: 259067 - RNA, 64 nt, Homo Sapiens; identical to SEQ ID NO: 132603

SEQ ID NO: 259068 - RNA, 64 nt, Homo Sapiens; identical to SEQ ID NO: 132604

SEQ ID NO: 259069 - RNA, 64 nt, Homo Sapiens; identical to SEQ ID NO: 132605

SEQ ID NO: 259070 - RNA, 64 nt, Homo Sapiens; identical to SEQ ID NO: 132606

SEQ ID NO: 259071 - RNA, 64 nt, Homo Sapiens; identical to SEQ ID NO: 132607

SEQ ID NO: 259072 - RNA, 64 nt, Homo Sapiens; identical to SEQ ID NO: 132608

SEQ ID NO: 259073 - RNA, 64 nt, Homo Sapiens; identical to SEQ ID NO: 132609

SEQ ID NO: 259074 - RNA, 64 nt, Homo Sapiens; identical to SEQ ID NO: 132610

SEQ ID NO: 259075 - RNA, 64 nt, Homo Sapiens; identical to SEQ ID NO: 132611

SEQ ID NO: 259076 - RNA, 64 nt, Homo Sapiens; identical to SEQ ID NO: 132612

SEQ ID NO: 259077 - RNA, 64 nt, Homo Sapiens; identical to SEQ ID NO: 132613

SEQ ID NO: 259078 - RNA, 64 nt, Homo Sapiens; identical to SEQ ID NO: 132614

SEQ ID NO: 259079 - RNA, 64 nt, Homo Sapiens; identical to SEQ ID NO: 132615

SEQ ID NO: 259080 - RNA, 64 nt, Homo Sapiens; identical to SEQ ID NO: 132616

SEQ ID NO: 259081 - RNA, 58 nt, Homo Sapiens
aacccuuggugugggucugaggucuugacucaacgagagcacuugaaaaugaaaugac

SEQ ID NO: 259082 - RNA, 64 nt, Homo Sapiens
ucaccucgccaucccugccgucccaaggcucucucucaacgaugguagggaaagccccgccucc

SEQ ID NO: 259083 - RNA, 64 nt, Homo Sapiens
gguaaauuccaugugccucuggguacaaaagugccucaacgacaugcucuggaaaucccaaaug

SEQ ID NO: 259084 - RNA, 64 nt, Homo Sapiens
aggggcuugugauggcuacaauggcuccuagacacucaacgacuucaucuguggcagggagaga

SEQ ID NO: 259085 - RNA, 64 nt, Homo Sapiens
gaagaucugguugaaaauuguauuucuauguaaacucaacgauauguuugguuuuccugaaaau

SEQ ID NO: 259086 - RNA, 64 nt, Homo Sapiens
cucugccaaacaacacccaguccuauuccaaacucucaacgauucuaucuuguuccuguuuuuc

SEQ ID NO: 259087 - RNA, 64 nt, Homo Sapiens
cugacucugucuuguccgacucucuugagaauuucucaacgauugcucaugccugucaguauca

SEQ ID NO: 259088 - RNA, 64 nt, Homo Sapiens
aaacaaaaaagaggcacuagucuaucugcaauuacucaacgaggcauuuucauaggaaacagac

SEQ ID NO: 259089 - RNA, 64 nt, Homo Sapiens
acaucuucugaugauuuccccuuuuaaucucuuacucaacgaacaggggucaaaaagcuuauuu

SEQ ID NO: 259090 - RNA, 64 nt, Homo Sapiens
gggaacaaauaccuggauaauuuuaaaaugcuuccucaacgaaguauucaguucccuuuuuccc

SEQ ID NO: 259091 - RNA, 64 nt, Homo Sapiens
cccaagugaagaucugguuccugcaucccugcagcucaacgagacgcccgcaggguggagaucg

SEQ ID NO: 259092 - RNA, 64 nt, Homo Sapiens
auugaaaguuguuauuguccaaaucaggucaaaccucaacgacaauauauagugugugaugugu

SEQ ID NO: 259093 - RNA, 64 nt, Homo Sapiens
acucuccccucaaagaaaagacauucagguguuucucaacgacaucuucuguccagcaagcucg

SEQ ID NO: 259094 - RNA, 64 nt, Homo Sapiens
agggcugggcacucccugagacccaaagacccaccucaacgacgaguggcguugagccacuucc

SEQ ID NO: 259095 - RNA, 64 nt, Homo Sapiens
uggcccagcugggccuggaguccggcacugcgugcucaacgagccccgcuccagcggcaccacg

SEQ ID NO: 259096 - RNA, 64 nt, Homo Sapiens
aggaggcccagcaaguguauaguacuggcucaugcucaacgagaggugaccgaguucggcaaua

SEQ ID NO: 259097 - RNA, 64 nt, Homo Sapiens
uuucauucugaaacuucuuaucaauuaccuaaaucucaacgaaaaacaauuuacugaagccgac

SEQ ID NO: 259098 - RNA, 64 nt, Homo Sapiens
aagucuaccaaagaacacacauucuguaauuucacucaacgauuuacauuuuuuuccuuugcaa

SEQ ID NO: 259099 - RNA, 64 nt, Homo Sapiens
gcucuauuuuguuguacgguugucaccauuaauucucaacgacugaaaauuuccagauaagaca

SEQ ID NO: 259100 - RNA, 64 nt, Homo Sapiens
gugggaaggaccuggcuuuaccuacagaccuuuucucaacgaauggagaaagagaucuccgugc

SEQ ID NO: 259101 - RNA, 64 nt, Homo Sapiens
uuucuauaggcaaaguagaaaauucgaaaagguccucaacgaguuuguacagcugcucccacuc

SEQ ID NO: 259102 - RNA, 64 nt, Homo Sapiens
cuguguggcuucagacccaaguuagugcaacugucucaacgaugcagggaacaagaguuguagu

SEQ ID NO: 259103 - RNA, 64 nt, Homo Sapiens
ucaaaucaguuguccuuuuucucugguucucaaccucaacgagugcugccuacccuuuucucuc

SEQ ID NO: 259104 - RNA, 64 nt, Homo Sapiens
uuucacuguggcuucuccagaaagaaaauagauucucaacgagaguaaagcagggccgagacag

SEQ ID NO: 259105 - RNA, 64 nt, Homo Sapiens
gcuugggggaggacucaguucacaaaaugcaaaacucaacgaucagauucacggacccagagcu

SEQ ID NO: 259106 - RNA, 64 nt, Homo Sapiens
ggccgacgagauggccaaggcgcuggaggcggagcucaacgaccucaugugagcgcgggcagcg

SEQ ID NO: 259107 - RNA, 64 nt, Homo Sapiens
gccacagucaccacuccaugacaucccugucuuccucaacgacuucuuccucgacaucuuccuc

SEQ ID NO: 259108 - RNA, 64 nt, Homo Sapiens
cagaacuucagggacugggagcagaggccccucacucaacgacguuugugcgacauaguauugu

SEQ ID NO: 259109 - RNA, 64 nt, Homo Sapiens
ccagccccuccaaaggucugccuccuuuuugggggaaggucagcuggggucuccgaagaggguc

SEQ ID NO: 259110 - RNA, 64 nt, Homo Sapiens
agggagcaugauaggauuugagggggucuggaaagaaggucauacacaggugggaucggcacuc

SEQ ID NO: 259111 - RNA, 64 nt, Homo Sapiens
caaucaaaauauguugucacagaaagaauagguggaaggucauagccuggaacccaaguuugaa

SEQ ID NO: 259112 - RNA, 64 nt, Homo Sapiens
gaauuagcccaaaauuaucaaagaacauuaacuggaaggucagguuuuucaaggaacauagcuu

SEQ ID NO: 259113 - RNA, 64 nt, Homo Sapiens
cuuaggagugggguuuuaugguggaugaggcuucuuccuggauggggcagagcuucuccugacc

SEQ ID NO: 259114 - RNA, 64 nt, Homo Sapiens
gccccucauggcgggacuggagaaaugguccgcuuuccuggagccaauggcccggccccuccug

SEQ ID NO: 259115 - RNA, 64 nt, Homo Sapiens
aggacacucccaucagaacuggggcugggagauguuccuggaggcuccagggcucugcucgucg

SEQ ID NO: 259116 - RNA, 64 nt, Homo Sapiens
acacucccaucagaaccuggggggccugaagacauuccuggaggcuucugggcucugcccgcug

SEQ ID NO: 259117 - RNA, 64 nt, Homo Sapiens
uuggccugggcguaugcagacggcuggucccgcuuuccuggaauggggcucaccccccuuccag

SEQ ID NO: 259118 - RNA, 64 nt, Homo Sapiens
gucgauguaauuaacugaugucuccauagucuguuuccuggaaaggcagucugauuccucucau

SEQ ID NO: 259119 - RNA, 64 nt, Homo Sapiens
gcucucuccagaaacagcacuuuccuacaccccuuuccuggacuuguucguucuaacacugcau

SEQ ID NO: 259120 - RNA, 64 nt, Homo Sapiens
gagccauggacaguaaaguuagcaucucucuucauuccuggaauugugugugugugucucuuug

SEQ ID NO: 259121 - RNA, 64 nt, Homo Sapiens
gugugugugugugugucucuagcauuucucuucauuccuggaauugugugugugugugucuuug

SEQ ID NO: 259122 - RNA, 64 nt, Homo Sapiens
gggaauuacaacccaucacucccaaugccucccuuuccuggaggagccugcugcauucuccugc

SEQ ID NO: 259123 - RNA, 64 nt, Homo Sapiens
cccagagagggcaggugcccaccccacaggcccuuuccuggaccauggagccaggugaaaccug

SEQ ID NO: 259124 - RNA, 64 nt, Homo Sapiens
ucacgcaucccauccucuggccuuccuggaagccuuccuggauuccaucccagugccagcuacu

SEQ ID NO: 259125 - RNA, 64 nt, Homo Sapiens
ccuuccuggauuucacgcaugugccagcuacuccuuccuggaagugcuguuccugcccauccca

SEQ ID NO: 259126 - RNA, 64 nt, Homo Sapiens
ugugccucagugaaggggccccugagaccaguauuuccuggagcuccuggacaaguugcuggcu

SEQ ID NO: 259127 - RNA, 64 nt, Homo Sapiens
ccgccaacuucacauugcucaacagcaggagguuuuccuggacaaagaggaauuauacagaagg

SEQ ID NO: 259128 - RNA, 64 nt, Homo Sapiens
gacugaagagcugagcagggugguagccuggccuuuccuggacaacuggcacuccagggagcuc

SEQ ID NO: 259129 - RNA, 64 nt, Homo Sapiens
ugcagaaguaagccuucccucccaacugcucgaguuccuggaugcuugagccucuuuccugaua

SEQ ID NO: 259130 - RNA, 64 nt, Homo Sapiens
ucugccaccucauuucacaaggauugauuugcauuuccuggaaccaacaugucauuuugaaacu

SEQ ID NO: 259131 - RNA, 64 nt, Homo Sapiens
gaaaggauaggcuguugcucagugaugauggcuuuuccuggaggaaaggaacacaugccaucca

SEQ ID NO: 259132 - RNA, 64 nt, Homo Sapiens
cugagcuugacguuuguaaagugucccccgcccguuccuggaaagcccgcaaccccuccucucu

SEQ ID NO: 259133 - RNA, 64 nt, Homo Sapiens
uugguugggggcuccuguuucucauccuagcuuuuuccuggaaagcccgcuagaagguuuggga

SEQ ID NO: 259134 - RNA, 64 nt, Homo Sapiens
gaugcauggccucuaagagugcccgugucgguucuuccuggaaguugacuuuccuuagacccgc

SEQ ID NO: 259135 - RNA, 64 nt, Homo Sapiens
gaaguggaucuaaauggaagcaucugcuguuuaauuccuggaaaacuggcugggcagagccugu

SEQ ID NO: 259136 - RNA, 64 nt, Homo Sapiens
ugaguaaaagcagagagaaguacuuuugauuauuuuccuggagugaagaaaacuugaacaagaa

SEQ ID NO: 259137 - RNA, 64 nt, Homo Sapiens
gggcccacccagggagcugaugccccuucuccccuuccuggacacacucucauguccccuuccu

SEQ ID NO: 259138 - RNA, 64 nt, Homo Sapiens
auuggagcaccugggccccacuggacaacacugauuccuggagagguggcugcgcccccagcuu

SEQ ID NO: 259139 - RNA, 64 nt, Homo Sapiens
cgggaauacagaaagauacagcacuccucaugccuuccuggagguagaaggccaguggcagcga

SEQ ID NO: 259140 - RNA, 64 nt, Homo Sapiens
auuccacacaucuucuuggucuugcauaaggcaguuccuggagacccagcacucugguucucuc

SEQ ID NO: 259141 - RNA, 64 nt, Homo Sapiens
ugaagaaucuuaaugcuuguaauuuaaacauuuguuccuggaguuuugauuugguggaugugau

SEQ ID NO: 259142 - RNA, 64 nt, Homo Sapiens
uuaguugaaaggccucaagaacaaacacugcaguuuccuggaaaagaagaaacuuugccucaag

SEQ ID NO: 259143 - RNA, 64 nt, Homo Sapiens
gguuugccgagggcugcccagcucugcuucugguuuccuggacaauuucucugucagauacggc

SEQ ID NO: 259144 - RNA, 64 nt, Homo Sapiens
ggguguuugagacaggucacaagcgcguggauguuuccuggaaguguauuccccuggggcucag

SEQ ID NO: 259145 - RNA, 64 nt, Homo Sapiens
cuucucuaguggaguuacugcagcuuagggaugguuccuggaaguggacacauuuuacaaaaac

SEQ ID NO: 259146 - RNA, 64 nt, Homo Sapiens
uuucauuucuuaggcauuuucucucuuauaaaguuuccuggauuuauaaauuuucauugauuuu

SEQ ID NO: 259147 - RNA, 64 nt, Homo Sapiens
uuuuuggccacugcccuggaucuauguaaugccuuuccuggacuucucuucuaaacgauggcau

SEQ ID NO: 259148 - RNA, 64 nt, Homo Sapiens
caaaaugugaauucaugugguuaugguacauggcuuccuggaauguggucuuuguuauuagggc

SEQ ID NO: 259149 - RNA, 64 nt, Homo Sapiens
aagcccaggcaucauuaaacagggaauuguguuguuccuggaggauaaggagagcugagauugg

SEQ ID NO: 259150 - RNA, 64 nt, Homo Sapiens
uuccagauucagagaaucugacucggccuaagauuuccuggaacgcaucgaguaaugucacugg

SEQ ID NO: 259151 - RNA, 64 nt, Homo Sapiens
agucauaaugaauuacagucggccccauuagcccuuccuggagcaugacaggcaauaauauauu

SEQ ID NO: 259152 - RNA, 64 nt, Homo Sapiens
acauuugucacauucagcuuauguuaaauacauuuuccuggaguuuagaauauagcuaggucca

SEQ ID NO: 259153 - RNA, 64 nt, Homo Sapiens
gaguuuggcaggcaggugccaggaacuccccuucuuccuggagugccuucauugaggaaggaaa

SEQ ID NO: 259154 - RNA, 64 nt, Homo Sapiens
ugaugauaaaaggagaauaagaaaaggcaucacuuuccuggauccaggauaauuuuuaaaccaa

SEQ ID NO: 259155 - RNA, 64 nt, Homo Sapiens
gcgugucugugcaaacuggaggacuccuuccaacuuccuggaacaaagcgacaucgccagcagc

SEQ ID NO: 259156 - RNA, 64 nt, Homo Sapiens
acauucuccuugcagcuaccuccaugugagugaauuccuggauaaagcaagauuuccuuucaau

SEQ ID NO: 259157 - RNA, 64 nt, Homo Sapiens
ccagagcuggacgggccagaacugcgcugcacacuuccuggacugaggcggggacuuugggucc

SEQ ID NO: 259158 - RNA, 64 nt, Homo Sapiens
ucccuccccuagaccacggggcgggcagcucggguuccuggagggcuguuucccccacgcuguc

SEQ ID NO: 259159 - RNA, 64 nt, Homo Sapiens
uuuguguguuguaaaguguuacucaguuuugugauuccuggauaaauguucaaguaucucaucc

SEQ ID NO: 259160 - RNA, 64 nt, Homo Sapiens
guuugucauuucucuaaaguacuuuuuuuuccuuuuccuggaaguugguauuaucacuguuaac

SEQ ID NO: 259161 - RNA, 64 nt, Homo Sapiens
gagaggacuuggggcauggccucuggggccacccuuccuggaacucagagaggaagguccgggc

SEQ ID NO: 259162 - RNA, 64 nt, Homo Sapiens
gggccagcauuuuggagggagcuuccuuccuuccuuccuggacaggucgucaugauggaugcac

SEQ ID NO: 259163 - RNA, 64 nt, Homo Sapiens
aggaugagggggcucagcggggggagcuggcaccuuccuggagccuccagccaguccuguccuc

SEQ ID NO: 259164 - RNA, 64 nt, Homo Sapiens
uccagaggugaugccugccucagccagggagggcuuccuggaggagaaggagccagcuagacau

SEQ ID NO: 259165 - RNA, 64 nt, Homo Sapiens
caggaguugaagccuccaucgccccagccccuucuuccuggaccuuccugauccagcaguccag

SEQ ID NO: 259166 - RNA, 64 nt, Homo Sapiens
caggacuccaggcccccagccccccagccccuccuuccuggacccucagacccaggacuccagg

SEQ ID NO: 259167 - RNA, 64 nt, Homo Sapiens
uuauaacauacaugugcagaugugguuuggcuguuuccuggauuuucauuguuaagaguuaacu

SEQ ID NO: 259168 - RNA, 64 nt, Homo Sapiens
aauaaaguuugauguucagcaucuaaaucuuaguuuccuggaauugguauuucauuuuuuucuu

SEQ ID NO: 259169 - RNA, 64 nt, Homo Sapiens
aucuggauuugguggaagacggaagacguggauuuuccuggaaguuggaagacauggauuuccu

SEQ ID NO: 259170 - RNA, 64 nt, Homo Sapiens
acguggauuuuccuggaagauggaagacauggauuuccuggaagauggaagaccuugaaauuau

SEQ ID NO: 259171 - RNA, 64 nt, Homo Sapiens
ucugcggaggcggccagggaaaagaccaucugaggaaugagaagagccagaucgggagcaaacc

SEQ ID NO: 259172 - RNA, 64 nt, Homo Sapiens
aaacgcagccagccagaucguccaacaccugacagaaugagacccaacggaugaauguagcccu

SEQ ID NO: 259173 - RNA, 64 nt, Homo Sapiens
gucauggugcuaaaccugacguguuuuuuuaagggaaugagaauuucuaccuagauuugaauga

SEQ ID NO: 259174 - RNA, 64 nt, Homo Sapiens
uauaaccacuugaguguuauuuuuuaaaugaaaagaaugagauucuaccuaacacugagcgcug

SEQ ID NO: 259175 - RNA, 64 nt, Homo Sapiens
acagaaaauuuacgaaaaucuuagauuuuguuuagaaugagaaaauauacaauuagaauuauuu

SEQ ID NO: 259176 - RNA, 64 nt, Homo Sapiens
aucaauuuggguaaagaaaggaauacuuuuguuagaaugagaauuaaagagaaaacaaaagaau

SEQ ID NO: 259177 - RNA, 64 nt, Homo Sapiens
ucugguaccuccugucuuuauuuaugaauauaaugaaugagagugcaguuuuuauauuugucaa

SEQ ID NO: 259178 - RNA, 64 nt, Homo Sapiens
uggaacagugaggaauggagauuaguuguuuagagaaugagaaagucaagagucacuacaacug

SEQ ID NO: 259179 - RNA, 64 nt, Homo Sapiens
uaccgacucacuugugagaacuuagaauaauuuugaaugagaucagauucuuaaauuugggccu

SEQ ID NO: 259180 - RNA, 64 nt, Homo Sapiens
aguuuaauacaacaggugucuuuaauuuuuguuugaaugagaaagauauuuuacugccuuuccu

SEQ ID NO: 259181 - RNA, 64 nt, Homo Sapiens
agccuucuuccuuugcuucaccucccagugaauggaaugagaaauugaauacuccauccccuuc

SEQ ID NO: 259182 - RNA, 64 nt, Homo Sapiens
caccuuauucuucugaaaaaggcacugagaaaaagaaugagaacccuuuugacuggaaccagau

SEQ ID NO: 259183 - RNA, 64 nt, Homo Sapiens
uucuguauaacauaacugguaaaaauucuaagcugaaugagaguaccucauuuacuguuugggu

SEQ ID NO: 259184 - RNA, 64 nt, Homo Sapiens
aaauuguauaaccauccugcagauuuucaaaacugaaugagagauaagaauuugcagguacuac

SEQ ID NO: 259185 - RNA, 64 nt, Homo Sapiens
uuucccauauuuccaucagaccuguauauugcaugaaugagagacccuucgcuugaauauuauc

SEQ ID NO: 259186 - RNA, 64 nt, Homo Sapiens
aagaguagcaagaugcugcagcacauugacuauagaaugagauguauccugcaagauggccgaa

SEQ ID NO: 259187 - RNA, 64 nt, Homo Sapiens
gcucgagggacgccaauaggcaugccgccuccgggaaugagacccccuccaccaggcauuagag

SEQ ID NO: 259188 - RNA, 64 nt, Homo Sapiens; identical to SEQ ID NO: 206424

SEQ ID NO: 259189 - RNA, 64 nt, Homo Sapiens; identical to SEQ ID NO: 206425

SEQ ID NO: 259190 - RNA, 64 nt, Homo Sapiens; identical to SEQ ID NO: 206426

SEQ ID NO: 259191 - RNA, 64 nt, Homo Sapiens; identical to SEQ ID NO: 206427

SEQ ID NO: 259192 - RNA, 64 nt, Homo Sapiens; identical to SEQ ID NO: 206428

SEQ ID NO: 259193 - RNA, 64 nt, Homo Sapiens; identical to SEQ ID NO: 206429

SEQ ID NO: 259194 - RNA, 64 nt, Homo Sapiens
cgaagcuauagaacuuuguuuuuuauccucuuagaucuaagagcauggauucuuguaccuaaca

SEQ ID NO: 259195 - RNA, 64 nt, Homo Sapiens
uauucuuaagaguuucaguguugauuaguuuacaaucuaagaguaacuuuuauuucagagauau

SEQ ID NO: 259196 - RNA, 64 nt, Homo Sapiens
auuauguauuuuugucauauacuguaacuucuuaaucuaagaaaauccacaucuaagaaaauuu

SEQ ID NO: 259197 - RNA, 64 nt, Homo Sapiens
auuuacuguaacuucuuaauaauaauauauccacaucuaagaaaaacuugucuuacauaaucac

SEQ ID NO: 259198 - RNA, 64 nt, Homo Sapiens
caaaguaaucuacuguaaagucuaccuauacuuaaucuaagaaagagaaucacuuuucuagaca

SEQ ID NO: 259199 - RNA, 64 nt, Homo Sapiens
cuacagauugucauaguugucauucacuauaaugaucuaagaagacacuuauaguaaaugggga

SEQ ID NO: 259200 - RNA, 63 nt, Homo Sapiens
uaaguuaauaagcaaaauccugacuauuauguuguuagagaaaaaugcuuugcuuugucugga

SEQ ID NO: 259201 - RNA, 63 nt, Homo Sapiens
auuacuuuuuuccaauuuuagaaaaucaagcagguuagagaaaauagagaugaauuaggggac

SEQ ID NO: 259202 - RNA, 63 nt, Homo Sapiens
aaagccugaucucauggagaccugcauggcccuguuagagauggcguagaagugaaagucuua

SEQ ID NO: 259203 - RNA, 63 nt, Homo Sapiens
ccucucacaacuacauguauguguggcauuuuuguuagagaugagaaaaggauugagaaggau

SEQ ID NO: 259204 - RNA, 63 nt, Homo Sapiens
uuaguuucagagugcuccaaaaaauuagcucugguuagagagguccuuaaguuauaucaucag

SEQ ID NO: 259205 - RNA, 63 nt, Homo Sapiens
aaaguagcccacuuuauguuuaauuuuaucuuuguuagagaugggaagauacuauugguguau

SEQ ID NO: 259206 - RNA, 63 nt, Homo Sapiens
agaguuuugauauuuucugaaagaggaacauguguuagagaugaagaaucuuccaaggcucau

SEQ ID NO: 259207 - RNA, 63 nt, Homo Sapiens
cacuggauuccacccaacugccaaguuaguauuguuagagauuucauuuuacaacacaaaaau

SEQ ID NO: 259208 - RNA, 63 nt, Homo Sapiens
ucccuuauuucaugucuugaagaagaguuaaggguuagagaaagagguaccaaguaagccggc

SEQ ID NO: 259209 - RNA, 63 nt, Homo Sapiens
auuauguuuguaucauuucuguccauugugaaaguuagagaacaauuuauuguggcgagacuu

SEQ ID NO: 259210 - RNA, 63 nt, Homo Sapiens
guauguaugccuucgggaaauucuagagggcagguuagagacaugcugccuugcugcauaaaa

SEQ ID NO: 259211 - RNA, 63 nt, Homo Sapiens
auucugaucaaucauuuuggagaagaagaggaaguuagagauagcuuacuuccauugcaaaau

SEQ ID NO: 259212 - RNA, 64 nt, Homo Sapiens
cuuccucuguaaauauccaaguauaaagcccaggaacuucuagaauaacccagaugcgcuuuaa

SEQ ID NO: 259213 - RNA, 64 nt, Homo Sapiens
cgcuuuaauuuuuuuuaauauguuuugaucacagaacuucuagaauaacccagaugcucuuuca

SEQ ID NO: 259214 - RNA, 64 nt, Homo Sapiens
aauaaaacuuaaaauuuauauuuaaaauauguguaacuucuaaagaauaaaaagaaauuguucu

SEQ ID NO: 259215 - RNA, 64 nt, Homo Sapiens
caugccuuuuuugcaguccuacugaagcuuugccaacuucuacaauaagacacuuguacggaac

SEQ ID NO: 259216 - RNA, 64 nt, Homo Sapiens
ugcuugagauauuucaacauguuauguauauuggaacuucuacagcuugaugccuccugcuuuu

SEQ ID NO: 259217 - RNA, 64 nt, Homo Sapiens
uuguauuuacuucuuuuuuuaaauguaaggaccaaacuucuaaacuaauuguucuuuuguugcu

SEQ ID NO: 259218 - RNA, 64 nt, Homo Sapiens
gcagcucugcaaaggaacaguuuuuaaaaaugggaacuucuacauugaaaaguccccauuuuug

SEQ ID NO: 259219 - RNA, 64 nt, Homo Sapiens
gguauauguguauuagugaaacauuguaaaggugaacuucuaccucuguaucuaaauguauacc

SEQ ID NO: 259220 - RNA, 64 nt, Homo Sapiens
auccauugagaaauagcaauauucuagcuauuguaacuucuaaaaaugguauggccauuagauc

SEQ ID NO: 259221 - RNA, 64 nt, Homo Sapiens
caaagcaggccauuucucccaccugaaaguacauaacuucuaucacuugccacauaauuaaaag

SEQ ID NO: 259222 - RNA, 64 nt, Homo Sapiens
auucggaauucuagauccuugaaguucucuuuauaacuucuaaaccuucucuuuuaauugcagu

SEQ ID NO: 259223 - RNA, 64 nt, Homo Sapiens
cuagaauacguacguaugcagugaacuuuaugguaacuucuacuuauuuuuauguuucuggugu

SEQ ID NO: 259224 - RNA, 64 nt, Homo Sapiens
ugucaccuuccuguauuuccacagagcaugcaagaacuucuacaaaacuucuauaccacacaga

SEQ ID NO: 259225 - RNA, 64 nt, Homo Sapiens
uguauuuccacagagcaugcaagaacuucuacaaaacuucuauaccacacagaagcugaaagag

SEQ ID NO: 259226 - RNA, 64 nt, Homo Sapiens
cucaugguagguuauauugaaggcugacauggagaauguuuacuuuucuauuuggcauagcuaa

SEQ ID NO: 259227 - RNA, 64 nt, Homo Sapiens
ucaguguuuuuaggauuugggaaaauaaacuguaaauguuuauuugauagguaaauauaguuuu

SEQ ID NO: 259228 - RNA, 64 nt, Homo Sapiens
uauucacacuugaauugcauuugugaucaaaauaaauguuuaaaucgcuaaaggaaaauacagu

SEQ ID NO: 259229 - RNA, 64 nt, Homo Sapiens
agugagaugcuuuauggauugaaggauaugguaaaauguuuauaguuuacuuugaaaguaaaau

SEQ ID NO: 259230 - RNA, 64 nt, Homo Sapiens
ucacugcuauauaagggaaacuaccuuaggaaagaauguuuacugaauguuuauuuuauuuuau

SEQ ID NO: 259231 - RNA, 64 nt, Homo Sapiens
uaagggaaacuaccuuaggaaagaauguuuacugaauguuuauuuuauuuuauuuuuuuuuuac

SEQ ID NO: 259232 - RNA, 64 nt, Homo Sapiens
cucuuccuuuuuauucacucuucccacgaauuuaaauguuuaaguuauauucaucacuagcaag

SEQ ID NO: 259233 - RNA, 64 nt, Homo Sapiens
uacuuaguuuuuguaucuaaucucugauuauuaaaauguuuauaaaguuuauuuuuaccaaaga

SEQ ID NO: 259234 - RNA, 64 nt, Homo Sapiens
ugauuuaguuuauauguuuuuggaagaaaccauuaauguuuaauuuaaucuuaauaccaaaacg

SEQ ID NO: 259235 - RNA, 64 nt, Homo Sapiens
ugaaguuucuccguuaaagauugggagucgucgaaauguuuagauucuuuuaggaaaggaauua

SEQ ID NO: 259236 - RNA, 64 nt, Homo Sapiens
uacucuuuucucaugcacauguuacguuggagaaaauguuuacaaaaaugguuuuguuacacua

SEQ ID NO: 259237 - RNA, 64 nt, Homo Sapiens
aacuuguaaaacaaauuguguuugcuuuaagaaaaauguuuauugcacucaugucauaggguua

SEQ ID NO: 259238 - RNA, 64 nt, Homo Sapiens
gaaagcaaugacuaacauuuaauuuguuuacaaaaauguuuauugucuucaguacaaaaaguua

SEQ ID NO: 259239 - RNA, 64 nt, Homo Sapiens
gucguagguauuaacuagaaaugagguauuaaguaauguuuagaagaaaaagaaaucagcuuaa

SEQ ID NO: 259240 - RNA, 64 nt, Homo Sapiens
auaaauuuuaaaaaacuucuuuuacuaguuaagcaauguuuaauuuauuucuacacugacagga

SEQ ID NO: 259241 - RNA, 64 nt, Homo Sapiens
cgucuauuuguguauuguaguauuauuaaaauacaauguuuauauaaauugaagugacaaagag

SEQ ID NO: 259242 - RNA, 64 nt, Homo Sapiens
uuaugcaacaagcauguuuguuaaccacacaaaaaauguuuaauguuuuguagaauauugcaaa

SEQ ID NO: 259243 - RNA, 64 nt, Homo Sapiens
acauuuucuugaguaacagucugaguuugcuguuaauguuuaacuucuuguggcuagaaguagc

SEQ ID NO: 259244 - RNA, 64 nt, Homo Sapiens
agagaaccugugacuguugaugaauaucugcagaaauguuuacuuauauauuguuacugaauug

SEQ ID NO: 259245 - RNA, 64 nt, Homo Sapiens
uuucuaaauuguauaauaauuaauacuuuuucuaaauguuuaguuaaaguauauaugaugucau

SEQ ID NO: 259246 - RNA, 64 nt, Homo Sapiens
guaacuaccaccuaacccaauacuuguagcucuaaauguuuaaaucuguguuauacuguauagg

SEQ ID NO: 259247 - RNA, 64 nt, Homo Sapiens
guuuaagauacucauuuucauggaaagcaguuuuaauguuuacauauuauuuaauuccuuaauu

SEQ ID NO: 259248 - RNA, 64 nt, Homo Sapiens
uguuugacugcauaaguauuaacuggucacacaaaauguuuauaaugugaugcugcacugaaaa

SEQ ID NO: 259249 - RNA, 64 nt, Homo Sapiens
uuacuuguuuaugauggcauaaccauugcuuuaaaauguuuagacaguagaauauugaauuuau

SEQ ID NO: 259250 - RNA, 64 nt, Homo Sapiens
uuaaagaauuuuuauucuuucugaagaacuaauuaauguuuaaagcaacuguuuaauaugaugg

SEQ ID NO: 259251 - RNA, 64 nt, Homo Sapiens
cugaguucuuugauuuacucaugcugcaugacaaaauguuuacuaauaacaauucauuauaaag

SEQ ID NO: 259252 - RNA, 64 nt, Homo Sapiens
uaagaaacaugaucuuugcucauuaaagagcuaaaauguuuauugcuguuuugucuuucuuuuu

SEQ ID NO: 259253 - RNA, 64 nt, Homo Sapiens
aagcauuugggaaagaaaaaauguuuaagaagcuaauguuuaaguauuagaacuuggguuaaaa

SEQ ID NO: 259254 - RNA, 64 nt, Homo Sapiens
aagcuaauguuuaagaagcagaacuuggguuaaaaauguuuaagcuggcgcaguggaccuauua

SEQ ID NO: 259255 - RNA, 64 nt, Homo Sapiens
uacguuuaaauaaauaaaaaggagauugucuuccaauguuuaacuuuuuuuucuuccccauggg

SEQ ID NO: 259256 - RNA, 64 nt, Homo Sapiens
ugaaauaacuuaauguuuuaacgcuguaauuaaaaauguuuauacuguguaagccauugauaua

SEQ ID NO: 259257 - RNA, 64 nt, Homo Sapiens
auauuucaauaaagauagcauuguuuuugcaauaaauguuuaaaugaaaaauaaaaagcauuua

SEQ ID NO: 259258 - RNA, 64 nt, Homo Sapiens
aguuggaaguaaguuaugguuugagaacaaucuaaauguuuaucuuguuuuuaugugugaaacg

SEQ ID NO: 259259 - RNA, 64 nt, Homo Sapiens
uguuacucauuucuagggaaucugucagacuacaaauguuuagcaucuuuuuaaaaaguaaaau

SEQ ID NO: 259260 - RNA, 64 nt, Homo Sapiens
aaaucuuuuuaaaaaguaaauucccccucauuagaauguuuaagagcaguauuaugaaaaaaaa

SEQ ID NO: 259261 - RNA, 64 nt, Homo Sapiens
cugcuguuuuauugugguugugguucaaguuuuuaauguuuaaaguugaugcuguuuucagaag

SEQ ID NO: 259262 - RNA, 64 nt, Homo Sapiens
agauuuuuaaacuuuauuuucauaauuucugcuuaauguuuaaaauugaagagccuuuucaugu

SEQ ID NO: 259263 - RNA, 64 nt, Homo Sapiens
gaggacuuuguucuacaucagauuuuacuauuugaauguuuaagaucacuuuauugaauuugaa

SEQ ID NO: 259264 - RNA, 64 nt, Homo Sapiens
gaggacuuuguucugcaucagaucuuacuauuugaauguuuacuguuggauuuugggcaucuua

SEQ ID NO: 259265 - RNA, 64 nt, Homo Sapiens
ccuuaccuaguuaucuacaaauguucauuccagaaauguuuaguuacugaauugaaugaagaca

SEQ ID NO: 259266 - RNA, 64 nt, Homo Sapiens
ugaugacuuuuuuuuaaaugagguucaguaccauaauguuuauuuacuggaagauaaugcauuu

SEQ ID NO: 259267 - RNA, 64 nt, Homo Sapiens
uaccucagauaauauguuuaguuuuacauuuuaaaauguuuaaauucucuuucacagcaccaaa

SEQ ID NO: 259268 - RNA, 64 nt, Homo Sapiens
uuaucugauuaagcauucuuuccacugaaugcauaauguuuaaauagcauaaaaugaaaugcua

SEQ ID NO: 259269 - RNA, 64 nt, Homo Sapiens
aaugacaguaauauuggcauagaaaaaaguagcaaauguuuacuguaucaauuucuaauguuua

SEQ ID NO: 259270 - RNA, 64 nt, Homo Sapiens
aaaaaaguagcaaauguuuacuguaucaauuucuaauguuuacuauauagaauuuccuguaaua

SEQ ID NO: 259271 - RNA, 64 nt, Homo Sapiens
uuccuacuuucugaaaacaaaggauuaaagcccuaauguuuauuauuuaaaauuuuuauuuaag

SEQ ID NO: 259272 - RNA, 64 nt, Homo Sapiens
uuaaaauuuuuauuuaagagguacuuuaaauguuaauguuuaauaauaggacugcacgcuuggu

SEQ ID NO: 259273 - RNA, 64 nt, Homo Sapiens
agucuugcaaucaauuuuguaagaauuaauauccaauguuuauguagccucacucuuauuccuc

SEQ ID NO: 259274 - RNA, 64 nt, Homo Sapiens
auguuuuuguaacaauaauuuacuagauaaaauuaauguuuaaaaaauaguaauaguaugaaaa

SEQ ID NO: 259275 - RNA, 64 nt, Homo Sapiens
aaaacuaaauaaaaugcacuguauucuuacaguuaauguuuauaacuauaguaaaaaauuaaua

SEQ ID NO: 259276 - RNA, 64 nt, Homo Sapiens
uuugacacaaauuauguuauugaaaagcauuauuaauguuuaauuuauuuaaaauuuuggaauu

SEQ ID NO: 259277 - RNA, 64 nt, Homo Sapiens
aaaauggaagccaacacaucacucauuuuaggcaaauguuuaaacauuuuuaucuaucagaaug

SEQ ID NO: 259278 - RNA, 64 nt, Homo Sapiens
uuuaggcaaauguuuaaacauuuuuaucuaucagaauguuuauuguugcugguuauaagcagca

SEQ ID NO: 259279 - RNA, 64 nt, Homo Sapiens
uuuuuccauucaggcaccgaauugucucugagcuaauguuuauaggauuccaaacagguaccac

SEQ ID NO: 259280 - RNA, 64 nt, Homo Sapiens
uaaacgaacacauuccugcacaacauuaaagauuaauguuuauuaugguuguguuuucagaauu

SEQ ID NO: 259281 - RNA, 64 nt, Homo Sapiens
agacugguggacaaguguaaaggaaaccaggggcaauguuuacacagaagaaccuggaggacgg

SEQ ID NO: 259282 - RNA, 64 nt, Homo Sapiens
cguugccaugcugcaguccguauuugcaucuaaaaauguuuacugcauugcugacauucuggaa

SEQ ID NO: 259283 - RNA, 64 nt, Homo Sapiens
uguaaauaaguuucagauaaaaaucaggacccuaaauguuuaauugaaaggcacugaguuuugu

SEQ ID NO: 259284 - RNA, 64 nt, Homo Sapiens
guaaauuuuuguucuuuuaacauuccagaguuaaaauguuuacuugguaauuguacaauacuug

SEQ ID NO: 259285 - RNA, 64 nt, Homo Sapiens
guaauuguaaccuuucaaauuuuaauggaguuaaaauguuuauggcaagcuuuugccaaugauc

SEQ ID NO: 259286 - RNA, 64 nt, Homo Sapiens
gauagauaauggauuuaaagcaucugaauuuuaaaauguuuacucggauguuauuucuguuaua

SEQ ID NO: 259287 - RNA, 64 nt, Homo Sapiens
ucaaguaauuuaauaguauagcuuaauucuagacaauguuuaaguuggucuaccuuuauuaaaa

SEQ ID NO: 259288 - RNA, 64 nt, Homo Sapiens
guuaaauauuccugcacuagugauggucacuuagaauguuuauagaaauguggauaauaacuac

SEQ ID NO: 259289 - RNA, 64 nt, Homo Sapiens
uuuucccuuuagcauugcaugugaauaagaaaauaauguuuaaagaaaaaaaaaaaaaagcaaa

SEQ ID NO: 259290 - RNA, 64 nt, Homo Sapiens
agcugaaugguuuaaucugacuggcuuccuaagaaauguuuaagacucagcuuuaaaaagaagu

SEQ ID NO: 259291 - RNA, 64 nt, Homo Sapiens
cuccccuccacaaaaaggagaaagagugcauuaaaauguuuaguuggguuuuuuaauuuuuaau

SEQ ID NO: 259292 - RNA, 64 nt, Homo Sapiens
ccuccaaaacuggaagcccaucauaaggcaugagaauguuuaacuauaaagccuuuuauuaguu

SEQ ID NO: 259293 - RNA, 64 nt, Homo Sapiens
cugcuucuuccugaggucuagaacaaggucuggaaauguuuagacaggauauuuucuugaugaa

SEQ ID NO: 259294 - RNA, 64 nt, Homo Sapiens
uguugccaauucuugcaaccauugccaacaauuuaauguuuaugaaagcacuuuguaguucucu

SEQ ID NO: 259295 - RNA, 64 nt, Homo Sapiens
auaauaugcuaaaaauauuuuauaaauaagaaagaauguuuaacaagacuuuagguaauggaaa

SEQ ID NO: 259296 - RNA, 64 nt, Homo Sapiens
uuggaugaauggaauucuagauggaaauauuaacaauguuuauugaaaaagacuaagggaauau

SEQ ID NO: 259297 - RNA, 64 nt, Homo Sapiens
ucacauuauuuauuuuucauauuuaaguaugcaaaauguuuaagcuugcuaaaacucuauguaa

SEQ ID NO: 259298 - RNA, 64 nt, Homo Sapiens
uuguacuguauaagagguaaacaaauaaacaugcaauguuuauguaugcuuauagguguuacau

SEQ ID NO: 259299 - RNA, 64 nt, Homo Sapiens
cuaagcacuuguuugucagcuuccauuucucuagaauguuuaucuuuuaagcucuuugccaaua

SEQ ID NO: 259300 - RNA, 64 nt, Homo Sapiens
augaaaacauacaucggauaccaagaaacugaggaauguuuaauaugaucuuuuucuuuccuuc

SEQ ID NO: 259301 - RNA, 64 nt, Homo Sapiens
cugcuaugguaauacauauuuucccuaaaaguacaauguuuagaugaaccaugucuccgcacau

SEQ ID NO: 259302 - RNA, 64 nt, Homo Sapiens
augccauuuguuuccuucugaucucucacugaauaauguuuacuguacagucuucccaagguga

SEQ ID NO: 259303 - RNA, 64 nt, Homo Sapiens
gaauucaacaauuaauaguugaaauugugagguuaauguuuaaaaagcuuuacaccuguuuaca

SEQ ID NO: 259304 - RNA, 64 nt, Homo Sapiens
ugaauaucauuuaaucuuuaaaaaaucaaguaaaaauguuuaucugauaauguuuaaauaauuu

SEQ ID NO: 259305 - RNA, 64 nt, Homo Sapiens
ucuuuaaaaaaucaaguaaaaauguuuaucugauaauguuuaaauaauuuacaauauaaacugu

SEQ ID NO: 259306 - RNA, 64 nt, Homo Sapiens
cuuaugcaguuagucuuuauaaauaauagagaauaauguuuauguauuuuaaugauuuucuagc

SEQ ID NO: 259307 - RNA, 64 nt, Homo Sapiens
uuggaagcaauuguaguuaaguagagauguuuuaaauguuuauguaaucucaguguuuccuuga

SEQ ID NO: 259308 - RNA, 64 nt, Homo Sapiens
uuacuuucucauucuuuuaggucauuuuuccagcaauguuuaaaugagcauaauucacuuuaaa

SEQ ID NO: 259309 - RNA, 64 nt, Homo Sapiens
uuuguagucuagucuauucucugugauuuuuuuuaauguuuagaaaguuucuuacagaaaguac

SEQ ID NO: 259310 - RNA, 64 nt, Homo Sapiens
aguuuuguaggguggugggaaaugggggaucuucaauguuuauuuuaaaauaaaauaaaauaag

SEQ ID NO: 259311 - RNA, 64 nt, Homo Sapiens
uugaauccuacaaaaauacugcaaaagacuagugaauguuuaaaauuacacuagauuaaauaau

SEQ ID NO: 259312 - RNA, 64 nt, Homo Sapiens
ugccugggucugugucaccuggggcaguguggauaauguuuaguucugugacacuguuuuuugg

SEQ ID NO: 259313 - RNA, 64 nt, Homo Sapiens
aauucccuuuuuauuuugcugguugguaucuguaaauguuuaauaaauaucugagcauguaucu

SEQ ID NO: 259314 - RNA, 64 nt, Homo Sapiens
cuguuaaaccugcugcaagagagcuagaacacuuaauguuuaauuuugauacuugaaauagagg

SEQ ID NO: 259315 - RNA, 64 nt, Homo Sapiens
uuugucacacuguuuucauaaaaggguucaacauaauguuuaauauuuuugaguuaaagcuaga

SEQ ID NO: 259316 - RNA, 64 nt, Homo Sapiens
auuaagcuuuauauaauacuuauguauuuuucauaauguuuaauuuuguaguuucuucuguaaa

SEQ ID NO: 259317 - RNA, 64 nt, Homo Sapiens
auuuuauauaauuuaaagguuuauuaaucuggagaauguuuaaacuguugauacuauguauaau

SEQ ID NO: 259318 - RNA, 64 nt, Homo Sapiens
aagcauuguaaauuuauuuaauuugugauccugaaauguuuacuuaauccaugcuaaaauggau

SEQ ID NO: 259319 - RNA, 64 nt, Homo Sapiens
acucaguagugucagccacuagggaucuggaaaaaauguuuaaaaggguaacaauuuuucucaa

SEQ ID NO: 259320 - RNA, 64 nt, Homo Sapiens
auuuauauuuuggguuuauguuauacugaaauuaaauguuuauauagugcuguuuuugucuacg

SEQ ID NO: 259321 - RNA, 64 nt, Homo Sapiens
ccuuuuacguuaaaauuacuauauuggcaaaauaaauguuuaaagccuauaugaaaugaaaaau

SEQ ID NO: 259322 - RNA, 64 nt, Homo Sapiens
aggauuuuugagcacaaaauuaugcaaauauuuuaauguuuauuaauguuuacaguggaauugu

SEQ ID NO: 259323 - RNA, 64 nt, Homo Sapiens
agcacaaaauuaugcaaauauuuuaauguuuauuaauguuuacaguggaauugugaauaaguuu

SEQ ID NO: 259324 - RNA, 64 nt, Homo Sapiens
ggguauuuagaaauguagguggcauuuagaacacaauguuuaaucaaugggcugaacaaagaug

SEQ ID NO: 259325 - RNA, 64 nt, Homo Sapiens
acuacagaauuuucuaggguuuuaaauuauguaaaauguuuacuuauucugagcuuagagagaa

SEQ ID NO: 259326 - RNA, 64 nt, Homo Sapiens
caucggcaguauggggggcagcugucccagugucaauguuuacucaaggguguucuuaggaggc

SEQ ID NO: 259327 - RNA, 64 nt, Homo Sapiens
uacagauuuuuuuguuuguuuuuugagaaaaaaaaauguuuacucuuccaucauuuaaaaaaaa

SEQ ID NO: 259328 - RNA, 64 nt, Homo Sapiens
guugucacaaacugugguuaauccaaucaauuuaaauguuuacuauagaccaaaaggagagauu

SEQ ID NO: 259329 - RNA, 64 nt, Homo Sapiens
cuauagaccaaaaggagagauuauuaaaucguuuaauguuuauacagaguaauuauaggaaguu

SEQ ID NO: 259330 - RNA, 64 nt, Homo Sapiens
agaaaaacucugcuagucuucauauuucauacagaauguuuaaaucccccgucccccagucuga

SEQ ID NO: 259331 - RNA, 64 nt, Homo Sapiens
agaaaaacaaugaauuagaaauaagcuugugcacaauguuuaaauauaugcuuucuaugugaau

SEQ ID NO: 259332 - RNA, 64 nt, Homo Sapiens
ucaaaugcauauuuagauuagauuauugaauuguaauguuuaucugcugcuuuuuuuaaauaaa

SEQ ID NO: 259333 - RNA, 64 nt, Homo Sapiens
aucugcugcuuuuuuuaaauaaaauuugacugaaaauguuuaauuggcauuuuuuaaugacuua

SEQ ID NO: 259334 - RNA, 64 nt, Homo Sapiens
cugcugcccaacuccugugagagaaaaaccaaucaauguuuacaaaauggaaaaggacacagca

SEQ ID NO: 259335 - RNA, 64 nt, Homo Sapiens
auccucagcucagaguguauuuugaauaugagcaaauguuuauguacguaugagauuucaaguu

SEQ ID NO: 259336 - RNA, 64 nt, Homo Sapiens
caucugguuaugucuuauuuuuuuccuaaaagauaauguuuauuuuuaaaaaggaaggaaggag

SEQ ID NO: 259337 - RNA, 64 nt, Homo Sapiens
ccuggccucagggcaugcccugccuaccuucugaaauguuuaccccauugaccaaacuuggcuc

SEQ ID NO: 259338 - RNA, 64 nt, Homo Sapiens
uaucaauaucagagauuuggguaaaagaauggguaauguuuaaacauguggaggcauguggagc

SEQ ID NO: 259339 - RNA, 64 nt, Homo Sapiens
gaacguuuuagaaaccaagagaugugcagaaagaaauguuuaguguuuuuucguuuuaaauuuu

SEQ ID NO: 259340 - RNA, 64 nt, Homo Sapiens
uuuauuauuuuuaaaaauacagacuaacugauguaauguuuauguauaaguugcaccaaaaauc

SEQ ID NO: 259341 - RNA, 64 nt, Homo Sapiens
auauuuagaggaagaaagugaaggggaaauuuaaaauguuuacggcgcuuaauugccuggaaau

SEQ ID NO: 259342 - RNA, 64 nt, Homo Sapiens
gucaguuuguaguauucuugcacagguguacuuuaauguuuaggaaaugcccagggauuuaaug

SEQ ID NO: 259343 - RNA, 64 nt, Homo Sapiens
uugagcacuagaacauguuuucauuaauaguuaaaauguuuacacuuuaaggaaaauuaauaaa

SEQ ID NO: 259344 - RNA, 64 nt, Homo Sapiens
aaggcacuauuauaaauuuauccuauaagaugacaauguuuacucaaagucuaacauauucaau

SEQ ID NO: 259345 - RNA, 64 nt, Homo Sapiens
gcuuucuaucgugacucaauucaacaauguggggaauguuuacuacauuuccaacuugauguca

SEQ ID NO: 259346 - RNA, 64 nt, Homo Sapiens
cucuuuccucagaggcuuuuagucgggaagguuuaauguuuagaacauuuuugcugugaaccac

SEQ ID NO: 259347 - RNA, 64 nt, Homo Sapiens
uaucauccaaguguucuugauuacauuuuaccuuaauguuuauuccccccaaaagaagugccua

SEQ ID NO: 259348 - RNA, 64 nt, Homo Sapiens
uuaaaguguuuuaauuucuagucuauauucuggaaauguuuauaaaaguacugauauaagguca

SEQ ID NO: 259349 - RNA, 64 nt, Homo Sapiens
uuuguuuacccaagguugaaauucuuggauuuugaauguuuaguaaaugcuuugggaugagucu

SEQ ID NO: 259350 - RNA, 64 nt, Homo Sapiens
ccacuaguugauguaugguaauguuuuuucuucaaauguuuaaagguccauguaaauacuuucc

SEQ ID NO: 259351 - RNA, 64 nt, Homo Sapiens
ggagaaagcaaaauacaucaaccguguaccaccuaauguuuauagauguaccaauugucaaauu

SEQ ID NO: 259352 - RNA, 64 nt, Homo Sapiens
uaugauuuuuuucuaaauucauauauuuuguguuaauguuuaggggcacauuugauucuuccac

SEQ ID NO: 259353 - RNA, 64 nt, Homo Sapiens
uuguaccuugauuuggaaaaccuguacuauuauuaauguuuauauuuuuugucuuucuggcaug

SEQ ID NO: 259354 - RNA, 64 nt, Homo Sapiens; identical to SEQ ID NO: 101831

SEQ ID NO: 259355 - RNA, 64 nt, Homo Sapiens; identical to SEQ ID NO: 101832

SEQ ID NO: 259356 - RNA, 64 nt, Homo Sapiens; identical to SEQ ID NO: 101833

SEQ ID NO: 259357 - RNA, 64 nt, Homo Sapiens; identical to SEQ ID NO: 101834

SEQ ID NO: 259358 - RNA, 61 nt, Homo Sapiens; identical to SEQ ID NO: 101835

SEQ ID NO: 259359 - RNA, 64 nt, Homo Sapiens; identical to SEQ ID NO: 101836

SEQ ID NO: 259360 - RNA, 64 nt, Homo Sapiens; identical to SEQ ID NO: 101837

SEQ ID NO: 259361 - RNA, 64 nt, Homo Sapiens; identical to SEQ ID NO: 101838

SEQ ID NO: 259362 - RNA, 64 nt, Homo Sapiens; identical to SEQ ID NO: 101839

SEQ ID NO: 259363 - RNA, 64 nt, Homo Sapiens; identical to SEQ ID NO: 101840

SEQ ID NO: 259364 - RNA, 64 nt, Homo Sapiens; identical to SEQ ID NO: 101841

SEQ ID NO: 259365 - RNA, 64 nt, Homo Sapiens; identical to SEQ ID NO: 101842

SEQ ID NO: 259366 - RNA, 64 nt, Homo Sapiens; identical to SEQ ID NO: 101843

SEQ ID NO: 259367 - RNA, 64 nt, Homo Sapiens; identical to SEQ ID NO: 101844

SEQ ID NO: 259368 - RNA, 64 nt, Homo Sapiens; identical to SEQ ID NO: 101845

SEQ ID NO: 259369 - RNA, 64 nt, Homo Sapiens; identical to SEQ ID NO: 101846

SEQ ID NO: 259370 - RNA, 64 nt, Homo Sapiens; identical to SEQ ID NO: 101847

SEQ ID NO: 259371 - RNA, 64 nt, Homo Sapiens; identical to SEQ ID NO: 101848

SEQ ID NO: 259372 - RNA, 64 nt, Homo Sapiens; identical to SEQ ID NO: 101849

SEQ ID NO: 259373 - RNA, 64 nt, Homo Sapiens; identical to SEQ ID NO: 101850

SEQ ID NO: 259374 - RNA, 64 nt, Homo Sapiens; identical to SEQ ID NO: 101851

SEQ ID NO: 259375 - RNA, 64 nt, Homo Sapiens; identical to SEQ ID NO: 101852

SEQ ID NO: 259376 - RNA, 64 nt, Homo Sapiens; identical to SEQ ID NO: 101853

SEQ ID NO: 259377 - RNA, 64 nt, Homo Sapiens; identical to SEQ ID NO: 101854

SEQ ID NO: 259378 - RNA, 64 nt, Homo Sapiens
auugcucaaaaggguaaauguaauuauaaaugaccaaaaucaagugucacuuuuucucauguuc

SEQ ID NO: 259379 - RNA, 64 nt, Homo Sapiens
uuuguaauuuguuuagaagccucaaggauaaaggcaaaaucaauuuacauuuuucuguguuaca

SEQ ID NO: 259380 - RNA, 64 nt, Homo Sapiens
gaugugcgaguuauugacuguggaguacuugccacaaaaucaauaaaagaugguaagaacuuuu

SEQ ID NO: 259381 - RNA, 64 nt, Homo Sapiens
ucuaguuccaagucugggcaccgaaagagagcaucaaaaucaccaagaaaaacagcuucucagu

SEQ ID NO: 259382 - RNA, 64 nt, Homo Sapiens
guuuaggauaaauagguaagcacaaagagcucuucaaaaucagaaaaaacaauaggaguccuuc

SEQ ID NO: 259383 - RNA, 64 nt, Homo Sapiens
aucuuaaaaaaaaaaaaaguaaacugcaaaaguacaaaaucauuuuucaaucuguucccaguuu

SEQ ID NO: 259384 - RNA, 64 nt, Homo Sapiens
uuucuuaaugcauugauuaaaguuuaauaguuaucaaaaucaccuaauuuuuaaaaauagcuuu

SEQ ID NO: 259385 - RNA, 64 nt, Homo Sapiens
uagcuuucguuuugaguucuggaaagaaaacugucaaaaucaguauauacuauuaguuauauuu

SEQ ID NO: 259386 - RNA, 64 nt, Homo Sapiens
aacucuacaauaaugaggaaauucuuaagaauaacaaaaucacuguaccuuccucucaauuuug

SEQ ID NO: 259387 - RNA, 64 nt, Homo Sapiens
uguagcauuccucuaauuauaaacagugaaaaaucaaaaucaguccagaguucuuuuguugacu

SEQ ID NO: 259388 - RNA, 64 nt, Homo Sapiens
gguugauagcagcuuggagugcuaacuggaagaucaaaaucaugucucuugcugauaaccuaag

SEQ ID NO: 259389 - RNA, 64 nt, Homo Sapiens
ucgagauuuaauguuugguauuuuuuuuucuauucaaaaucaaaauguuauuuucagaauggcu

SEQ ID NO: 259390 - RNA, 64 nt, Homo Sapiens
aucaggaacccagcuucagggggguucccacgugcaaaaucaacguucagagcaguguccuccu

SEQ ID NO: 259391 - RNA, 64 nt, Homo Sapiens
caaaacuuuuggcaaauaaaugucuaauguauuucaaaaucaccuuuuuccucaaugaauggga

SEQ ID NO: 259392 - RNA, 64 nt, Homo Sapiens
uuaggacuauuaaagaauguuuugcucugauagacaaaaucaguggauuuuuaccuuuguuccu

SEQ ID NO: 259393 - RNA, 64 nt, Homo Sapiens
gcuuaggaucgacaagaaguagaugggacagcaacaaaaucaugagcguaaaugggucaugaca

SEQ ID NO: 259394 - RNA, 64 nt, Homo Sapiens
uuguccuauugugacucuucccccauucucuagacaaaaucaaaagcucagauuagaauggcua

SEQ ID NO: 259395 - RNA, 64 nt, Homo Sapiens
aguauuuaaugaaauacuagcuaauguucuaugucaaaaucaaauauuuugugaaaguuguaca

SEQ ID NO: 259396 - RNA, 64 nt, Homo Sapiens
ccuagagccaaccagucaguaggaaagagcagaccaaaaucagcaacaccaugucauggagugu

SEQ ID NO: 259397 - RNA, 64 nt, Homo Sapiens
guggcguugagccacuucccuuugaaaagacacucaaaaucacugccaugguucaauguuccca

SEQ ID NO: 259398 - RNA, 64 nt, Homo Sapiens
aagguuccagggagguuguggggcagcuagaggacaaaaucaugaaaacagagucccugucuuc

SEQ ID NO: 259399 - RNA, 64 nt, Homo Sapiens
guuaugguuuccucauuuuacauuuaauauuuuucaaaaucaaauuuauagaauaauuucuccu

SEQ ID NO: 259400 - RNA, 64 nt, Homo Sapiens
agguaaugcacauccucauucagcgauuauugaucaaaaucaaaauucaucaaguaaucauggc

SEQ ID NO: 259401 - RNA, 64 nt, Homo Sapiens
cacacacccuccccgccacagaaagacacagacacaaaaucacauacauacacagacacacaca

SEQ ID NO: 259402 - RNA, 64 nt, Homo Sapiens
cacacacccuccccgccacagacacacacagacacaaaaucacauacacagacacacacagaaa

SEQ ID NO: 259403 - RNA, 64 nt, Homo Sapiens
caacaaguucugaguuacuuaaaaagucaaaaaucaaaaucaaaaggacccacuggggcauaua

SEQ ID NO: 259404 - RNA, 64 nt, Homo Sapiens
uuauccaauuuuauugguuauuacuuuucucccccaaaaucaucgggguauaacacauuuucau

SEQ ID NO: 259405 - RNA, 64 nt, Homo Sapiens
agcaaugcaaaaauauucugauuuuuaaauaauucaaaaucaguaaugauugcuauacauacuc

SEQ ID NO: 259406 - RNA, 64 nt, Homo Sapiens
augacaacuuauaaaggcauaagaagacaacuuacaaaaucaaguauuuggaggaagaaaaauu

SEQ ID NO: 259407 - RNA, 64 nt, Homo Sapiens
uaguuuguauaaaauguggggaaucuuuguauaucaaaaucauguugucaguguaauaaaaaca

SEQ ID NO: 259408 - RNA, 64 nt, Homo Sapiens
guuuauagagugaacccuauuuucccccgucaaccaaaaucaguaacuacuguguguguaaccg

SEQ ID NO: 259409 - RNA, 64 nt, Homo Sapiens
uaaagacuaacaaaacacaauuaucuaucagacucaaaaucauuuuuuuaaaaucagaauuuag

SEQ ID NO: 259410 - RNA, 64 nt, Homo Sapiens
cauguuaauaaauauaaacauuauucuacaugcacaaaaucauaaggccauuucuaugccaagc

SEQ ID NO: 259411 - RNA, 64 nt, Homo Sapiens
augcugcucaaaugaauuuauuagaaucucuauucaaaaucaaacuggaaaguuuagacuacau

SEQ ID NO: 259412 - RNA, 64 nt, Homo Sapiens
cacugcuuuaugggcaggaacaaaaggugaacagcaaaaucaaggggccaagcccaucuauuua

SEQ ID NO: 259413 - RNA, 64 nt, Homo Sapiens
aucccucagauaacugcuuuccugagacgggagucaaaaucagcauagcuauaauaaagauuuc

SEQ ID NO: 259414 - RNA, 64 nt, Homo Sapiens
aaauuugacuucuuaguagccaaagugaaaagcccaaaaucagccggaugacuuuggagaguuu

SEQ ID NO: 259415 - RNA, 64 nt, Homo Sapiens
uuagggauacagcaggggcuugcugcuucaaaaucaaaaucaauaaugaacccaugacagcacc

SEQ ID NO: 259416 - RNA, 64 nt, Homo Sapiens
aucaauuuagggauacagcaagcaccugcugcuucaaaaucaaagacaagaaugaacccaugac

SEQ ID NO: 259417 - RNA, 64 nt, Homo Sapiens
uuuuuuuugugagucuuacuuuaacaacaacaaccaaaaucagaguagauucuugaccuuaaau

SEQ ID NO: 259418 - RNA, 64 nt, Homo Sapiens
uuacaagauagacauauucuaauuuaugauuuuucaaaaucaugucauguauucaauggacugu

SEQ ID NO: 259419 - RNA, 64 nt, Homo Sapiens
agauggcuuacaaaaagaaauucuguggugauagcaaaaucaagggucaaaucucuacaaauuu

SEQ ID NO: 259420 - RNA, 64 nt, Homo Sapiens
uagucuaacaacugcccaguuuggaagggcuuuucaaaaucauucaauccauauaagcccuuga

SEQ ID NO: 259421 - RNA, 64 nt, Homo Sapiens
gagaugcaaaaguucacuguugcaguguuuucaaaugaccaaucaaguacuacuucuugguuaa

SEQ ID NO: 259422 - RNA, 64 nt, Homo Sapiens
agccacgcccaaaagagagcucccuuagggaaaaaugaccaaaacacacacacacauuuacaau

SEQ ID NO: 259423 - RNA, 64 nt, Homo Sapiens
aaauuguuacaauagaauuuuuuuauggcccaaaaugaccaacguaccaaacauuacaaaaaaa

SEQ ID NO: 259424 - RNA, 64 nt, Homo Sapiens
ugauaaauuccuguugaccugcaaaucuuucugcaugaccaaaguacaaaucagaacuuuggag

SEQ ID NO: 259425 - RNA, 64 nt, Homo Sapiens
ucuuguuaaauaaauuaaaucuuacuuucuuuuaaugaccaaccuuagguaaaacaaaaauauu

SEQ ID NO: 259426 - RNA, 64 nt, Homo Sapiens
uaauguaaaggccuuguuuugcuguagcaauaaaaugaccaagugcaaugacuugauuuaauaa

SEQ ID NO: 259427 - RNA, 64 nt, Homo Sapiens; identical to SEQ ID NO: 233051

SEQ ID NO: 259428 - RNA, 64 nt, Homo Sapiens; identical to SEQ ID NO: 233052

SEQ ID NO: 259429 - RNA, 64 nt, Homo Sapiens; identical to SEQ ID NO: 233053

SEQ ID NO: 259430 - RNA, 64 nt, Homo Sapiens; identical to SEQ ID NO: 233054

SEQ ID NO: 259431 - RNA, 64 nt, Homo Sapiens; identical to SEQ ID NO: 233055

SEQ ID NO: 259432 - RNA, 64 nt, Homo Sapiens; identical to SEQ ID NO: 233055

SEQ ID NO: 259433 - RNA, 64 nt, Homo Sapiens; identical to SEQ ID NO: 233057

SEQ ID NO: 259434 - RNA, 64 nt, Homo Sapiens
ccucagggacguagaacaauggaaugucagucagucucuguaguuaaaacuuuuucuuuaaaau

SEQ ID NO: 259435 - RNA, 64 nt, Homo Sapiens; identical to SEQ ID NO: 259434

SEQ ID NO: 259436 - RNA, 64 nt, Homo Sapiens
uagaagccugcacagauccaccuaacccugcuugucucuguacaucaucaaaaagcuuuaagug

SEQ ID NO: 259437 - RNA, 64 nt, Homo Sapiens
guuucugauugcauguuucuuaagcucucuucagucucuguaauuuucauuuucagaaaacucu

SEQ ID NO: 259438 - RNA, 64 nt, Homo Sapiens
cagccccgugaacccugagggucagcagagagagucucuguacagaagggcguguggccaucgu

SEQ ID NO: 259439 - RNA, 64 nt, Homo Sapiens
cagccccgugaacccugagggucagcagagagagucucuguacagaaggccauauggccaucgu

SEQ ID NO: 259440 - RNA, 64 nt, Homo Sapiens
uacauuuaggauaaucuuuacccugcacgcauuuucucuguaguuguguacuuuacugggcucu

SEQ ID NO: 259441 - RNA, 64 nt, Homo Sapiens
uuccuacuggagcuugaugugaaacuuccugcccucucuguacccaccuaaaccagacuggaug

SEQ ID NO: 259442 - RNA, 64 nt, Homo Sapiens
uuaaacauuucgcuauacucccgugcccggccacucucuguacucaaauugcugggauuacucc

SEQ ID NO: 259443 - RNA, 64 nt, Homo Sapiens
uuauuuaauuuauuauuauugaugaauuuuuuucucucuguacuuguaguuuauaauucuaguu

SEQ ID NO: 259444 - RNA, 64 nt, Homo Sapiens
ucaucguguuuguaagagaagauggucauuuuauucucuguauaaaacuuagcucuaaagcaga

SEQ ID NO: 259445 - RNA, 64 nt, Homo Sapiens
guguuugaaaguacugaagcacaaacauauaucaucucuguaccauucuguacuaaagcacuug

SEQ ID NO: 259446 - RNA, 64 nt, Homo Sapiens
ugaaucugauaucuccaccaaagccuugauguuuucucuguacagcuaaguuuucugauggaau

SEQ ID NO: 259447 - RNA, 64 nt, Homo Sapiens
aaaauguuuaacucaggugugauuuuugaaaaugucucuguaauauuuuaucuucuuuaaaaaa

SEQ ID NO: 259448 - RNA, 64 nt, Homo Sapiens
ucauuugcccuggguguccuugguccugccuggcucucuguaguggaggcuccccuuggccuca

SEQ ID NO: 259449 - RNA, 64 nt, Homo Sapiens
auuaacucucugacuugaugcaaguuacuuaaccucucuguauagaauuuucacaucuuuaaaa

SEQ ID NO: 259450 - RNA, 64 nt, Homo Sapiens
ccaaauuucauuucagccacacuguagaacuuauucucuguaggaaauaggcagaaacaaaaug

SEQ ID NO: 259451 - RNA, 64 nt, Homo Sapiens
ucaaucugcaaacaugccagacaccucaagguguucucuguagccggcucucuggacacuugcg

SEQ ID NO: 259452 - RNA, 64 nt, Homo Sapiens
gcucucugugugaccuugggcagcuccgugccucucucuguacucccucaguuuccuucucugu

SEQ ID NO: 259453 - RNA, 64 nt, Homo Sapiens
cuccgugccucucucuguacucccucaguuuccuucucuguacaauguggcuggggagggagag

SEQ ID NO: 259454 - RNA, 64 nt, Homo Sapiens
aucuucaggacucuucagagcuaauccucuaaguucucuguacucaguugguucucaguuagcu

SEQ ID NO: 259455 - RNA, 64 nt, Homo Sapiens
gcaguuccucccccugccuuaaaacaccccacuaucucuguaaagucucucucucucuuuuuuu

SEQ ID NO: 259456 - RNA, 64 nt, Homo Sapiens
cauauaaaccacaggcgaaauuccuuggccucacucucuguaaggccagaagagacaucuuggg

SEQ ID NO: 259457 - RNA, 64 nt, Homo Sapiens
gcagcaaauguggcccauggaaaacucagguaugucucuguauguaggaggcccagguagcggc

SEQ ID NO: 259458 - RNA, 64 nt, Homo Sapiens
aucauagucugguuuaaauaccaccucagucucuucucuguauuacaaagauucugggcagcug

SEQ ID NO: 259459 - RNA, 64 nt, Homo Sapiens
uaugcagcugauuugucugucuugugucuuauguucucuguauuugcagaaagcugugaaaugu

SEQ ID NO: 259460 - RNA, 64 nt, Homo Sapiens
uguuugaucauuaucaggccugauuucauguauuucucuguacauuucucugcauucacaauuc

SEQ ID NO: 259461 - RNA, 64 nt, Homo Sapiens
cauagcuguuauuuauuauuguguccugaaugugucucuguaaagcuaggaaaagcuuuugcau

SEQ ID NO: 259462 - RNA, 64 nt, Homo Sapiens
cccucagaaucgcuccaccuugcagcucuccccuucucuguauuccuagaaacugacacaugcu

SEQ ID NO: 259463 - RNA, 64 nt, Homo Sapiens
gugugugugcguccugucggagcccugucuccucucucuguaauaaacucauuucuagcagaca

SEQ ID NO: 259464 - RNA, 64 nt, Homo Sapiens
ucccuaaugauuguuuucuauuggaggugauuauucucuguaacagaauaugcauaucaaugag

SEQ ID NO: 259465 - RNA, 64 nt, Homo Sapiens
uuugcuuauucuggucauuucuaaucuauuucucucucuguagaccccgagccccuggcaacca

SEQ ID NO: 259466 - RNA, 64 nt, Homo Sapiens
gaauguucccugcacccuggcagagcuggaaggcagggcagaggucuguccaggccacuguggc

SEQ ID NO: 259467 - RNA, 64 nt, Homo Sapiens
caugggccugggccugcuuuucagggccagaaggagggcagagcgccaagagcaucgugacccu

SEQ ID NO: 259468 - RNA, 64 nt, Homo Sapiens
ucagcaauacuaagggcuucgagagacaggauaaagggcagaugagugugacagcacuggggag

SEQ ID NO: 259469 - RNA, 64 nt, Homo Sapiens
aauucccccgaagacugagcaggcugcauucuagagggcagagauuuggaaaacaaaaaucaga

SEQ ID NO: 259470 - RNA, 64 nt, Homo Sapiens
cccccaugcucuguggccuucuuacacuucucagagggcagaguggcagccgggcacccuacag

SEQ ID NO: 259471 - RNA, 64 nt, Homo Sapiens
cagaguggcagccgggcacccuacagaaacucagagggcagaguggcagccaggcccacauguc

SEQ ID NO: 259472 - RNA, 64 nt, Homo Sapiens
cuuagcuguuuucuuuaagccacugaauuuucugagggcagagucugaaaauggaccugccuuu

SEQ ID NO: 259473 - RNA, 64 nt, Homo Sapiens
uccgucugggagggugugucgacccuggccuuggagggcagagggcuuccacgugcuucccagu

SEQ ID NO: 259474 - RNA, 64 nt, Homo Sapiens
acaagcccagcacccagugucaaugagaccuggcagggcagagugaggaacaauuaggacgugg

SEQ ID NO: 259475 - RNA, 64 nt, Homo Sapiens
cuuccauuuuuguccuuccuagagaaugaguaggagggcagaagguggagguccucaggagugg

SEQ ID NO: 259476 - RNA, 64 nt, Homo Sapiens
cacgugccccucugaggcucggggccagcuccccagggcagacuaggugguugcugucuccaua

SEQ ID NO: 259477 - RNA, 64 nt, Homo Sapiens
uggcuucucagauauggcuuaugcaggcaggggaagggcagagacccggcucauggucuggggg

SEQ ID NO: 259478 - RNA, 64 nt, Homo Sapiens
gcugcccagggccaggcucagucaggcucuggccagggcagaggccuguuagcccguggcuacg

SEQ ID NO: 259479 - RNA, 64 nt, Homo Sapiens
gaggccaccuggcggggguggcuuuccugggcagagggcagaguggacaccacggggccuuccu

SEQ ID NO: 259480 - RNA, 64 nt, Homo Sapiens
ggaggagggaggcugucaggaggaacagcaagucagggcagagaucagaugccagcacugacuc

SEQ ID NO: 259481 - RNA, 64 nt, Homo Sapiens
acacucccuucccccuaagcaguguccccggggaagggcagaugucccagaccucuccucuucc

SEQ ID NO: 259482 - RNA, 64 nt, Homo Sapiens
cggacucacaauuucuauuuccgggacuacaggaagggcagagaauacugacgguuaccaguau

SEQ ID NO: 259483 - RNA, 64 nt, Homo Sapiens
ugugagugggguuuauggggaaagggagggacugagggcagagucucuggguuucaggacagca

SEQ ID NO: 259484 - RNA, 64 nt, Homo Sapiens
uaguguacgauguuugcugugcuucccgccguggagggcagagccaccccacaucaggaucgga

SEQ ID NO: 259485 - RNA, 64 nt, Homo Sapiens
gcuggugucugggaccaaaaagggggaauaugggagggcagaguggggaggggaguccaugggc

SEQ ID NO: 259486 - RNA, 64 nt, Homo Sapiens
guaggcugaccccauggacccacuggagacuuugagggcagagcucgggcaccuuucaucuucc

SEQ ID NO: 259487 - RNA, 64 nt, Homo Sapiens
ugugccggugggggcugggcucccgugagguccuagggcagaaggaggugcuugcagggccucu

SEQ ID NO: 259488 - RNA, 64 nt, Homo Sapiens
uacgugaauggggagguggcagccacagaagccuagggcagaccaagaagaaagguacagcccc

SEQ ID NO: 259489 - RNA, 64 nt, Homo Sapiens
gugcaugagagucuagagaaguagugaccagaacagggcagaguagguccccuccauggcccug

SEQ ID NO: 259490 - RNA, 64 nt, Homo Sapiens
uuccugagcugcguuuuaggcugggaugccuuuuagggcagagaguggucugugaacugagucc

SEQ ID NO: 259491 - RNA, 64 nt, Homo Sapiens
agguguuuaucugccccggcccucauuugggcucagggcagagcgaacguuagugaaucuugag

SEQ ID NO: 259492 - RNA, 64 nt, Homo Sapiens
cucucaagaccagagacccaacagcagugaucucagggcagacagcccuccacuccagcucuga

SEQ ID NO: 259493 - RNA, 64 nt, Homo Sapiens
uuuggaaagagcacccucgagaaggguggaugacagggcagagcaggaaggacaggaagcuggc

SEQ ID NO: 259494 - RNA, 64 nt, Homo Sapiens
caccggcucccuccgcucccuccugucaccuaccagggcagaccccacuaagccguugagucuc

SEQ ID NO: 259495 - RNA, 64 nt, Homo Sapiens
gcaagggugacuccuggcaggugggggcagcaggagggcagagggcagagcucuggccacuucu

SEQ ID NO: 259496 - RNA, 64 nt, Homo Sapiens
ugacuccuggcaggugggggcagcaggagggcagagggcagagcucuggccacuucugcccacu

SEQ ID NO: 259497 - RNA, 64 nt, Homo Sapiens
augugacucuuugcgggguggagguguuuaaggaagggcagauagccuggccugccagccauug

SEQ ID NO: 259498 - RNA, 64 nt, Homo Sapiens
gcugggcucugguggccaguagagcucucagagcagggcagauuggucaugacgcgugccauuu

SEQ ID NO: 259499 - RNA, 64 nt, Homo Sapiens
aaguacuuagggagguugguucaaaugcugauggagggcagaggauggccaucagacagagacu

SEQ ID NO: 259500 - RNA, 64 nt, Homo Sapiens
gaugccuagaggaccacaucgacaaggagaaagcagggcagaauugggacagugggucaggcag

SEQ ID NO: 259501 - RNA, 64 nt, Homo Sapiens
ugcacuuuaugaaacuggcacccccaaagcugauagggcagaggccuccccauaugccacccuu

SEQ ID NO: 259502 - RNA, 64 nt, Homo Sapiens
agacuauggggagcccaccgagguacacggcagcagggcagaggguggaugagugaagggagcc

SEQ ID NO: 259503 - RNA, 64 nt, Homo Sapiens
aggccaggggaucugggugugugagugggaggagagggcagagguccccugaggucaugcauug

SEQ ID NO: 259504 - RNA, 64 nt, Homo Sapiens
guauuuaaagaaacugauuuuaaaugcaaauuaaagggcagauauucucaaacaggguuccugu

SEQ ID NO: 259505 - RNA, 64 nt, Homo Sapiens
auccagucuccaucgugcugcagcagcuggacugagggcagagccuguaggugcagaggcccug

SEQ ID NO: 259506 - RNA, 64 nt, Homo Sapiens
cugugucaaguagcuaacugcagcagcuggacugagggcagagucugugggugcagagacccug

SEQ ID NO: 259507 - RNA, 64 nt, Homo Sapiens
gggccuggccuucucucccagcagccuggggggcagggcagagccuccagucggaccccuuccu

SEQ ID NO: 259508 - RNA, 64 nt, Homo Sapiens
ucggaccccuuccucacacuggccccuaugcagaagggcagacaguucuucugggguuggcagc

SEQ ID NO: 259509 - RNA, 64 nt, Homo Sapiens
caggaguuuccacacugcuguggacgggauagccagggcagaccugcaucccagagcaagccua

SEQ ID NO: 259510 - RNA, 64 nt, Homo Sapiens
caaccagccaaggaauaaaagcugaucuguauguagggcagaaguguggcaaaugcaucaggaa

SEQ ID NO: 259511 - RNA, 64 nt, Homo Sapiens
ggguaagggagcagggcuuagaccggggagaaacagggcagacucgagcugagcaccagugggu

SEQ ID NO: 259512 - RNA, 64 nt, Homo Sapiens
ggcccucccuccagccuaggguaccaagagcagcagggcagaagugcccacugcugcuccaugu

SEQ ID NO: 259513 - RNA, 64 nt, Homo Sapiens
cccaguggagccucagacggggucgaggacgcagagggcagaggugggcgagauggacagguga

SEQ ID NO: 259514 - RNA, 64 nt, Homo Sapiens
ucuugucggcagggcagccuccuuccucucucacagggcagagcguccagcaugggcuccagag

SEQ ID NO: 259515 - RNA, 64 nt, Homo Sapiens
gggcuguggccgucaguggacccaggaggaagggagggcagaggggagcuggucacgcugggcg

SEQ ID NO: 259516 - RNA, 64 nt, Homo Sapiens
ccccaucacguggcaagccaugcccaagcuagggagggcagagucaagaugcccaagaugacca

SEQ ID NO: 259517 - RNA, 64 nt, Homo Sapiens
cuggcugucccaaccaggggagcuuuucaaaaacagggcagagccgcugugguuguucaggggu

SEQ ID NO: 259518 - RNA, 64 nt, Homo Sapiens
ccacugccccggccucaauuaacauccuauacuaagggcagaacauuuuagucuuuuuaaaaaa

SEQ ID NO: 259519 - RNA, 64 nt, Homo Sapiens
aggugccuugccgcagagaagaaaggcuguccggagggcagaccggcuguuucaaagacugggc

SEQ ID NO: 259520 - RNA, 64 nt, Homo Sapiens
ugacuucaaagugcuggggagaagaaccucagagagggcagaggacucugcggaggaacggcag

SEQ ID NO: 259521 - RNA, 64 nt, Homo Sapiens
ccccucccccugggggcaaaucaggacacaacagagggcagaggccccauuagcuuuaaaaugu

SEQ ID NO: 259522 - RNA, 64 nt, Homo Sapiens
accccccuccucuccacccuaccuuccaucaaccagggcagauccaccgugcccugguucccca

SEQ ID NO: 259523 - RNA, 64 nt, Homo Sapiens
ugcuaccuggccuuccugccuuaucagugccaugagggcagaggcugcccugcuuccuggcucc

SEQ ID NO: 259524 - RNA, 64 nt, Homo Sapiens
agagcagcugucaagaagcaguucagugccacgcagggcagaggcagagaagcccuuacuccug

SEQ ID NO: 259525 - RNA, 63 nt, Homo Sapiens
aguuuauuacagauauuaaguaugcaauuacuuguauuauaggaugcaaggucaucauaugua

SEQ ID NO: 259526 - RNA, 63 nt, Homo Sapiens
caguuuuguaaaauuaguauugaguucuauugaguauuauaagauagcuuacauuuucaaaau

SEQ ID NO: 259527 - RNA, 63 nt, Homo Sapiens
uacucugcacuguguaaaggaaaagggagaaauguauuauacuugagacauugcaccuacccc

SEQ ID NO: 259528 - RNA, 63 nt, Homo Sapiens
augaaaaagucuucgauacaauauuguuaagcuguauuauaaguauuguuacacaggguuaug

SEQ ID NO: 259529 - RNA, 63 nt, Homo Sapiens
caaauggacugaaagaaacuuuucaaggacaguguauuauaacaaucccuuucccagaauuag

SEQ ID NO: 259530 - RNA, 63 nt, Homo Sapiens
ucaacaacauuuuaaauguauuuuguuauguuuguauuauauaggauaaagcaaaugucaagu

SEQ ID NO: 259531 - RNA, 63 nt, Homo Sapiens
accuuaacuucauugucugcacauuacauugaaguauuauaaaugcaacagauguuauaugca

SEQ ID NO: 259532 - RNA, 63 nt, Homo Sapiens
cauaaaguugcguaagaaacuuuaccaagaggaguauuauagccaaguuuucuuugaaaguau

SEQ ID NO: 259533 - RNA, 63 nt, Homo Sapiens
ugaaaaguaaauuaaugugaauuuucauuuucuguauuauauauuacuauaagguuaauauuu

SEQ ID NO: 259534 - RNA, 63 nt, Homo Sapiens
cucaacucguuaucuaaagcugaauucauuucuguauuauauuaugcaagcacaacuugaagc

SEQ ID NO: 259535 - RNA, 63 nt, Homo Sapiens
ccuuuuuuaauguuucaugaccacccauugauuguauuauaaccacuuacaguugcuuauauu

SEQ ID NO: 259536 - RNA, 63 nt, Homo Sapiens
uuuuguuuuuuaacauuuagaauauuacauuuuguauuauacaguaccuuucucagacauuuu

SEQ ID NO: 259537 - RNA, 63 nt, Homo Sapiens
ugcauacacaugccuccauguguacguuuauauguauuauaauuaauuucuaaaccauguaua

SEQ ID NO: 259538 - RNA, 63 nt, Homo Sapiens
auugagcaaaugagaaaacaaacuauuucagauguauuauauguugugcccaaguaauaauaa

SEQ ID NO: 259539 - RNA, 63 nt, Homo Sapiens
auuuuucuauucuugguggcgugauauuugcagguauuauaccuaccccuuuuugccuuacaa

SEQ ID NO: 259540 - RNA, 63 nt, Homo Sapiens
agugaaaagguguuauaucucuuuggaaaagauguauuauaccgaaacaagccugccauaauc

SEQ ID NO: 259541 - RNA, 63 nt, Homo Sapiens
augaacuuagauuuuacaugaaguauuuuuucaguauuauauguacccucugaaauacauagg

SEQ ID NO: 259542 - RNA, 63 nt, Homo Sapiens
uauauguacccucugaaauacauagggauaugcguauuauaccaaaauguugcugaaaaaugg

SEQ ID NO: 259543 - RNA, 63 nt, Homo Sapiens
gcauacuuaacagugaaaagaaucuuuaauuauguauuauaucuguaauauauuuauuuuguu

SEQ ID NO: 259544 - RNA, 63 nt, Homo Sapiens
uuuguaauauguuuuuaguucccuuuuuuuguuguauuauaggcagaugaacaaauuaaauuu

SEQ ID NO: 259545 - RNA, 63 nt, Homo Sapiens
cgggcugcaugcugaggacgaccagcugaggguguauuauaugcagaauuacauaaacgaagc

SEQ ID NO: 259546 - RNA, 63 nt, Homo Sapiens
cuguaaagagaaguaauuuugcuccuugauaaaguauuauauuaauaauaaaucugccugcaa

SEQ ID NO: 259547 - RNA, 63 nt, Homo Sapiens
aggauaauacagagccaagaaugucacacagugguauuauagaaacacuuagaagacugauag

SEQ ID NO: 259548 - RNA, 63 nt, Homo Sapiens
uaaaguuuuauuugcuguagauuucaagcaaauguauuauaaugcaugaugaauagcaccuua

SEQ ID NO: 259549 - RNA, 63 nt, Homo Sapiens
ucaaaugagcuuguauauuuauaauacaauauaguauuauaguaacaguuaucauacacugag

SEQ ID NO: 259550 - RNA, 63 nt, Homo Sapiens
agucacuaguauagacuaucuaucuagugaguuguauuauaagcgaugaaauacuuuaaaagc

SEQ ID NO: 259551 - RNA, 63 nt, Homo Sapiens
acugcuuuacuguguaucucaugccuuacuauuguauuauaguuaucagacuucaccaaauau

SEQ ID NO: 259552 - RNA, 63 nt, Homo Sapiens
guagauuucaguaguuucuagugaaggguagugguauuauacuagaaauaaaucuauauuuuu

SEQ ID NO: 259553 - RNA, 64 nt, Homo Sapiens
ggguaaggagcaccaaagcugaggcuggcucagagaucuccagagaagcugcagccugcccugg

SEQ ID NO: 259554 - RNA, 64 nt, Homo Sapiens
cagcacugccucccuccucccacugcgacucugggaucuccaggugcugcccaaggaguugccu

SEQ ID NO: 259555 - RNA, 64 nt, Homo Sapiens
auggucucgaucuccugacguccaggauggucucgaucuccagguagccaggauggucucgauc

SEQ ID NO: 259556 - RNA, 64 nt, Homo Sapiens
auggucucgaucuccaggaugccaggauggucucgaucuccagggacgggguuucacuguguua

SEQ ID NO: 259557 - RNA, 64 nt, Homo Sapiens
cucuccuggauccguaccuaaccuggauccccaggaucuccaggcugccugguucuccgggauc

SEQ ID NO: 259558 - RNA, 64 nt, Homo Sapiens
gaaaccaaaauacaaacacacgagccacuuccaugaucuccaaaauagcaaauuggcaauuuaa

SEQ ID NO: 259559 - RNA, 64 nt, Homo Sapiens
uucucuagauaauuuuauauuuuugaguauaccccacuuccaaguguuuuuuguuuuguuuugc

SEQ ID NO: 259560 - RNA, 64 nt, Homo Sapiens
uugggauuacaggcgugagugaccaugccuagcucacuuccagguuuaacagacaaaauaaacu

SEQ ID NO: 259561 - RNA, 64 nt, Homo Sapiens
aauguucagcaugaaaaaaacuaaauacauugcccacuuccaaacaccauauccuuuguguucu

SEQ ID NO: 259562 - RNA, 64 nt, Homo Sapiens
aagaauacaguuugaauguaguccuaguaagugccacuuccacuuaaauauuuugacuuuaagg

SEQ ID NO: 259563 - RNA, 64 nt, Homo Sapiens
uggcaucccacgcguugucccuuccauccucucccacuuccaucugaccuuucuggucuuugca

SEQ ID NO: 259564 - RNA, 64 nt, Homo Sapiens
cucucccacuuccaucuggccuuucuggucuuugcacuuccaucuuuuaggaguggggggugac

SEQ ID NO: 259565 - RNA, 64 nt, Homo Sapiens
uggcgucccacaccuugucccuuccauccucucccacuuccaucuggccuuuccggucuucgca

SEQ ID NO: 259566 - RNA, 64 nt, Homo Sapiens
cucucccacuuccaucuggccuuuccggucuucgcacuuccaucgaguuuuaggaggggauggc

SEQ ID NO: 259567 - RNA, 64 nt, Homo Sapiens
ccacugagaagagagacgccaacugcacccuugccacuuccaaagcaauagaggcagagugguc

SEQ ID NO: 259568 - RNA, 64 nt, Homo Sapiens
uacaaacagcagucugcucccaugacccucugcccacuuccauuggucuccaggccccaauaau

SEQ ID NO: 259569 - RNA, 64 nt, Homo Sapiens
uguuuacagacagaagagaaggaagccauagugucacuuccacacaauuauuuauuucaugucu

SEQ ID NO: 259570 - RNA, 64 nt, Homo Sapiens
caaaguccuucucuuuagggcucuuacaaucuaucacuuccaaaaaguaaauggugacugauaa

SEQ ID NO: 259571 - RNA, 64 nt, Homo Sapiens
cugggggcugggcagggcagggcagggccggguccacuuccauuguuagcaguuguuugcagaa

SEQ ID NO: 259572 - RNA, 64 nt, Homo Sapiens
cuccagccagaccccugaaaggaaggugcucccccacuuccaggccuuaguugggguggggggg

SEQ ID NO: 259573 - RNA, 64 nt, Homo Sapiens
ccuggcggcgcaucccuccucucccaccuccuggcacuuccagcugggugucccacauguugga

SEQ ID NO: 259574 - RNA, 64 nt, Homo Sapiens
ugggugucccacauguuggauuccguccccaccacacuuccagagaccggagaacugugcaggg

SEQ ID NO: 259575 - RNA, 64 nt, Homo Sapiens
auagggauuuuuuuuuugguugaccacucccccacacuuccaaaauuaaacaguguuuucuuag

SEQ ID NO: 259576 - RNA, 64 nt, Homo Sapiens
aauucauuaggucaguuaagggaaauauuuguaccacuuccaaacuuuucagcguuggauaaaa

SEQ ID NO: 259577 - RNA, 64 nt, Homo Sapiens
ugucuuuuugccugcuggagagggccuggccacacacuuccauguuggcccucucucugaccuc

SEQ ID NO: 259578 - RNA, 64 nt, Homo Sapiens
cccauggcccagucccaggguggggccacaucgccacuuccacgucccgccucagccccaccug

SEQ ID NO: 259579 - RNA, 64 nt, Homo Sapiens
aacuguguguuuccaacaucaugguagcagcacacacuuccaaagcucagccagggacacuuaa

SEQ ID NO: 259580 - RNA, 64 nt, Homo Sapiens
aaaaaagaaaacuguuuuuagaaauacauaaaaucacuuccaaauccuguugcuuauguugggu

SEQ ID NO: 259581 - RNA, 64 nt, Homo Sapiens
augaacacugacauacuugucagugaagccaacuaucccauaaaucggacaaacaugacaaaca

SEQ ID NO: 259582 - RNA, 64 nt, Homo Sapiens
uggugccacauugaauuuccaaccgcacucauguaucccauaugaaauauguggccuguuguau

SEQ ID NO: 259583 - RNA, 64 nt, Homo Sapiens
ugggccaaucuucucauuucuuagugccucagacaucccauauguaaaaugagaguaauaaaac

SEQ ID NO: 259584 - RNA, 64 nt, Homo Sapiens
uuucagaaccacuucuugauucugccaccacuugaucccauaacaggcuaccccuuggccucau

SEQ ID NO: 259585 - RNA, 64 nt, Homo Sapiens
ucuguuuauuguuuuccauauuuaaggaaacaacaucccauaauagaaaugagcaugcagggcu

SEQ ID NO: 259586 - RNA, 64 nt, Homo Sapiens
uuucugcaggacuuuaaagcuuugaaaggccaauaucccauaggcuaacuuuaaacauguauuu

SEQ ID NO: 259587 - RNA, 64 nt, Homo Sapiens
aggccuauguggagcauuaagcuggggcucacccaucccauagggcacugucaggcagcuuucg

SEQ ID NO: 259588 - RNA, 64 nt, Homo Sapiens
ugguaaauaaguuaauauuuccugccuuccuucaaucccauauucaggauuuacaaaaauguaa

SEQ ID NO: 259589 - RNA, 64 nt, Homo Sapiens
ucagucucaguagccaucagccuggcagcugcccaucccauaaccaaagagcucaaugggcugg

SEQ ID NO: 259590 - RNA, 64 nt, Homo Sapiens
aaaguucaccucugagaguaaccaaaucgguuucaucccauaucaaaaagccuuuggagugugg

SEQ ID NO: 259591 - RNA, 64 nt, Homo Sapiens; identical to SEQ ID NO: 83734

SEQ ID NO: 259592 - RNA, 64 nt, Homo Sapiens; identical to SEQ ID NO: 83735

SEQ ID NO: 259593 - RNA, 64 nt, Homo Sapiens; identical to SEQ ID NO: 83736

SEQ ID NO: 259594 - RNA, 64 nt, Homo Sapiens; identical to SEQ ID NO: 83737

SEQ ID NO: 259595 - RNA, 64 nt, Homo Sapiens; identical to SEQ ID NO: 83738

SEQ ID NO: 259596 - RNA, 64 nt, Homo Sapiens; identical to SEQ ID NO: 83739

SEQ ID NO: 259597 - RNA, 64 nt, Homo Sapiens; identical to SEQ ID NO: 83740

SEQ ID NO: 259598 - RNA, 64 nt, Homo Sapiens; identical to SEQ ID NO: 83741

SEQ ID NO: 259599 - RNA, 64 nt, Homo Sapiens; identical to SEQ ID NO: 83742

SEQ ID NO: 259600 - RNA, 64 nt, Homo Sapiens; identical to SEQ ID NO: 83743

SEQ ID NO: 259601 - RNA, 64 nt, Homo Sapiens; identical to SEQ ID NO: 83744

SEQ ID NO: 259602 - RNA, 64 nt, Homo Sapiens; identical to SEQ ID NO: 83745

SEQ ID NO: 259603 - RNA, 64 nt, Homo Sapiens; identical to SEQ ID NO: 83746

SEQ ID NO: 259604 - RNA, 64 nt, Homo Sapiens; identical to SEQ ID NO: 83747

SEQ ID NO: 259605 - RNA, 64 nt, Homo Sapiens; identical to SEQ ID NO: 83741

SEQ ID NO: 259606 - RNA, 64 nt, Homo Sapiens; identical to SEQ ID NO: 83749

SEQ ID NO: 259607 - RNA, 64 nt, Homo Sapiens; identical to SEQ ID NO: 83750

SEQ ID NO: 259608 - RNA, 64 nt, Homo Sapiens; identical to SEQ ID NO: 83751

SEQ ID NO: 259609 - RNA, 64 nt, Homo Sapiens; identical to SEQ ID NO: 83752

SEQ ID NO: 259610 - RNA, 64 nt, Homo Sapiens; identical to SEQ ID NO: 83753

SEQ ID NO: 259611 - RNA, 64 nt, Homo Sapiens; identical to SEQ ID NO: 83754

SEQ ID NO: 259612 - RNA, 64 nt, Homo Sapiens; identical to SEQ ID NO: 83755

SEQ ID NO: 259613 - RNA, 64 nt, Homo Sapiens; identical to SEQ ID NO: 83756

SEQ ID NO: 259614 - RNA, 64 nt, Homo Sapiens; identical to SEQ ID NO: 83757

SEQ ID NO: 259615 - RNA, 64 nt, Homo Sapiens; identical to SEQ ID NO: 83742

SEQ ID NO: 259616 - RNA, 64 nt, Homo Sapiens; identical to SEQ ID NO: 83743

SEQ ID NO: 259617 - RNA, 64 nt, Homo Sapiens; identical to SEQ ID NO: 83760

SEQ ID NO: 259618 - RNA, 64 nt, Homo Sapiens; identical to SEQ ID NO: 83761

SEQ ID NO: 259619 - RNA, 64 nt, Homo Sapiens; identical to SEQ ID NO: 83762

SEQ ID NO: 259620 - RNA, 64 nt, Homo Sapiens; identical to SEQ ID NO: 83763

SEQ ID NO: 259621 - RNA, 64 nt, Homo Sapiens; identical to SEQ ID NO: 83764

SEQ ID NO: 259622 - RNA, 64 nt, Homo Sapiens; identical to SEQ ID NO: 83765

SEQ ID NO: 259623 - RNA, 64 nt, Homo Sapiens; identical to SEQ ID NO: 83766

SEQ ID NO: 259624 - RNA, 64 nt, Homo Sapiens; identical to SEQ ID NO: 83767

SEQ ID NO: 259625 - RNA, 64 nt, Homo Sapiens; identical to SEQ ID NO: 83768

SEQ ID NO: 259626 - RNA, 64 nt, Homo Sapiens; identical to SEQ ID NO: 83769

SEQ ID NO: 259627 - RNA, 64 nt, Homo Sapiens; identical to SEQ ID NO: 83770

SEQ ID NO: 259628 - RNA, 64 nt, Homo Sapiens; identical to SEQ ID NO: 83771

SEQ ID NO: 259629 - RNA, 64 nt, Homo Sapiens; identical to SEQ ID NO: 83772

SEQ ID NO: 259630 - RNA, 64 nt, Homo Sapiens; identical to SEQ ID NO: 83773

SEQ ID NO: 259631 - RNA, 64 nt, Homo Sapiens; identical to SEQ ID NO: 83774

SEQ ID NO: 259632 - RNA, 64 nt, Homo Sapiens; identical to SEQ ID NO: 83775

SEQ ID NO: 259633 - RNA, 64 nt, Homo Sapiens; identical to SEQ ID NO: 83776

SEQ ID NO: 259634 - RNA, 64 nt, Homo Sapiens; identical to SEQ ID NO: 83777

SEQ ID NO: 259635 - RNA, 64 nt, Homo Sapiens; identical to SEQ ID NO: 83778

SEQ ID NO: 259636 - RNA, 64 nt, Homo Sapiens; identical to SEQ ID NO: 83779

SEQ ID NO: 259637 - RNA, 64 nt, Homo Sapiens; identical to SEQ ID NO: 83780

SEQ ID NO: 259638 - RNA, 64 nt, Homo Sapiens; identical to SEQ ID NO: 83781

SEQ ID NO: 259639 - RNA, 61 nt, Homo Sapiens
cagggacguagaacaauggaaugucagucagucucuguaguuaaaacuuuuucuuuaaaau

SEQ ID NO: 259640 - RNA, 61 nt, Homo Sapiens; identical to SEQ ID NO: 259639

SEQ ID NO: 259641 - RNA, 61 nt, Homo Sapiens
uagaagccugcacagauccaaacccugcuugucucuguacaucaaaaagcuuuaagugccu

SEQ ID NO: 259642 - RNA, 61 nt, Homo Sapiens
guuucugauugcauguuucugcucucuucagucucuguaaucauuuucagaaaacucuuaa

SEQ ID NO: 259643 - RNA, 61 nt, Homo Sapiens
cagccccgugaacccugaggagcagagagagucucuguacagggcguguggccaucguguc

SEQ ID NO: 259644 - RNA, 61 nt, Homo Sapiens
cagccccgugaacccugaggagcagagagagucucuguacaggccauauggccaucguguc

SEQ ID NO: 259645 - RNA, 61 nt, Homo Sapiens
uacauuuaggauaaucuuuaugcacgcauuuucucuguaguguacuuuacugggcucuccc

SEQ ID NO: 259646 - RNA, 61 nt, Homo Sapiens
uuccuacuggagcuugauguacuuccugcccucucuguacccuaaaccagacuggauggaa

SEQ ID NO: 259647 - RNA, 61 nt, Homo Sapiens
uuaaacauuucgcuauacucugcccggccacucucuguacuauugcugggauuacuccccg

SEQ ID NO: 259648 - RNA, 61 nt, Homo Sapiens
uuauuuaauuuauuauuauugaauuuuuuucucucuguacuaguuuauaauucuaguugau

SEQ ID NO: 259649 - RNA, 61 nt, Homo Sapiens
ucguguuuguaagagaagauggucauuuuauucucuguauaaaacuuagcucuaaagcaga

SEQ ID NO: 259650 - RNA, 61 nt, Homo Sapiens
uuugaaaguacugaagcacaaacauauaucaucucuguaccauucuguacuaaagcacuug

SEQ ID NO: 259651 - RNA, 61 nt, Homo Sapiens
aucugauaucuccaccaaagccuugauguuuucucuguacagcuaaguuuucugauggaau

SEQ ID NO: 259652 - RNA, 61 nt, Homo Sapiens
auguuuaacucaggugugauuuuugaaaaugucucuguaauauuuuaucuucuuuaaaaaa

SEQ ID NO: 259653 - RNA, 61 nt, Homo Sapiens
uuugcccuggguguccuugguccugccuggcucucuguaguggaggcuccccuuggccuca

SEQ ID NO: 259654 - RNA, 61 nt, Homo Sapiens
aacucucugacuugaugcaaguuacuuaaccucucuguauagaauuuucacaucuuuaaaa

SEQ ID NO: 259655 - RNA, 61 nt, Homo Sapiens
ccaaauuucauuucagccacguagaacuuauucucuguagguaggcagaaacaaaaugacu

SEQ ID NO: 259656 - RNA, 61 nt, Homo Sapiens
ucaaucugcaaacaugccagccucaagguguucucuguagccucucuggacacuugcgaca

SEQ ID NO: 259657 - RNA, 61 nt, Homo Sapiens
cucugugugaccuugggcagcuccgugccucucucuguacucccucaguuuccuucucugu

SEQ ID NO: 259658 - RNA, 61 nt, Homo Sapiens
cgugccucucucuguacucccucaguuuccuucucuguacaauguggcuggggagggagag

SEQ ID NO: 259659 - RNA, 61 nt, Homo Sapiens
uucaggacucuucagagcuaauccucuaaguucucuguacucaguugguucucaguuagcu

SEQ ID NO: 259660 - RNA, 61 nt, Homo Sapiens
guuccucccccugccuuaaaacaccccacuaucucuguaaagucucucucucucuuuuuuu

SEQ ID NO: 259661 - RNA, 61 nt, Homo Sapiens
cauauaaaccacaggcgaaacuuggccucacucucuguaagagaagagacaucuuggguuc

SEQ ID NO: 259662 - RNA, 61 nt, Homo Sapiens
gcagcaaauguggcccauggacucagguaugucucuguauggaggcccagguagcggcaaa

SEQ ID NO: 259663 - RNA, 61 nt, Homo Sapiens
aucauagucugguuuaaauaccucagucucuucucuguauuaagauucugggcagcugcca

SEQ ID NO: 259664 - RNA, 61 nt, Homo Sapiens
uaugcagcugauuugucugugugucuuauguucucuguauuagaaagcugugaaaugucuu

SEQ ID NO: 259665 - RNA, 61 nt, Homo Sapiens
uguuugaucauuaucaggccuuucauguauuucucuguacacucugcauucacaauucuga

SEQ ID NO: 259666 - RNA, 61 nt, Homo Sapiens
cauagcuguuauuuauuauuuccugaaugugucucuguaaaaggaaaagcuuuugcaugug

SEQ ID NO: 259667 - RNA, 61 nt, Homo Sapiens
ucagaaucgcuccaccuugcagcucuccccuucucuguauuccuagaaacugacacaugcu

SEQ ID NO: 259668 - RNA, 61 nt, Homo Sapiens
ugugugcguccugucggagcccugucuccucucucuguaauaaacucauuucuagcagaca

SEQ ID NO: 259669 - RNA, 61 nt, Homo Sapiens
ucccuaaugauuguuuucuagaggugauuauucucuguaacauaugcauaucaaugaguug

SEQ ID NO: 259670 - RNA, 61 nt, Homo Sapiens
uuugcuuauucuggucauuuaucuauuucucucucuguagacgagccccuggcaaccacua

SEQ ID NO: 259671 - RNA, 64 nt, Homo Sapiens; identical to SEQ ID NO: 91879

SEQ ID NO: 259672 - RNA, 64 nt, Homo Sapiens; identical to SEQ ID NO: 91880

SEQ ID NO: 259673 - RNA, 64 nt, Homo Sapiens; identical to SEQ ID NO: 91881

SEQ ID NO: 259674 - RNA, 64 nt, Homo Sapiens; identical to SEQ ID NO: 91882

SEQ ID NO: 259675 - RNA, 64 nt, Homo Sapiens; identical to SEQ ID NO: 91883

SEQ ID NO: 259676 - RNA, 64 nt, Homo Sapiens; identical to SEQ ID NO: 91884

SEQ ID NO: 259677 - RNA, 64 nt, Homo Sapiens; identical to SEQ ID NO: 91885

SEQ ID NO: 259678 - RNA, 64 nt, Homo Sapiens; identical to SEQ ID NO: 91886

SEQ ID NO: 259679 - RNA, 64 nt, Homo Sapiens; identical to SEQ ID NO: 91887

SEQ ID NO: 259680 - RNA, 64 nt, Homo Sapiens; identical to SEQ ID NO: 91888

SEQ ID NO: 259681 - RNA, 64 nt, Homo Sapiens; identical to SEQ ID NO: 91889

SEQ ID NO: 259682 - RNA, 64 nt, Homo Sapiens; identical to SEQ ID NO: 91890

SEQ ID NO: 259683 - RNA, 64 nt, Homo Sapiens; identical to SEQ ID NO: 91891

SEQ ID NO: 259684 - RNA, 64 nt, Homo Sapiens; identical to SEQ ID NO: 91892

SEQ ID NO: 259685 - RNA, 64 nt, Homo Sapiens; identical to SEQ ID NO: 91893

SEQ ID NO: 259686 - RNA, 64 nt, Homo Sapiens; identical to SEQ ID NO: 91894

SEQ ID NO: 259687 - RNA, 64 nt, Homo Sapiens; identical to SEQ ID NO: 91895

SEQ ID NO: 259688 - RNA, 64 nt, Homo Sapiens; identical to SEQ ID NO: 91896

SEQ ID NO: 259689 - RNA, 64 nt, Homo Sapiens
uuaaggcuggcauucuuacuuuagcuuuuaucugcagggcuaggagggcugguauuaauaaaag

SEQ ID NO: 259690 - RNA, 64 nt, Homo Sapiens
uacaggggcuguugggguugccuuucuguuuggccagggcuacuuuuuucuucauucagcuuag

SEQ ID NO: 259691 - RNA, 64 nt, Homo Sapiens
gcacucgcucagucccuagggaugacacuaggaacagggcuagggcaagaagggacccuuccag

SEQ ID NO: 259692 - RNA, 64 nt, Homo Sapiens
gacucucggcucccauuuucggcagccucagcuccagggcuaagagccagcgggucagcccaga

SEQ ID NO: 259693 - RNA, 64 nt, Homo Sapiens
agagcuugucuuucaaggcagguuccuggggcuucagggcuaggagggaggagccugcccuuuu

SEQ ID NO: 259694 - RNA, 64 nt, Homo Sapiens
augcggcucaagucacucagaggcuguugcauuucagggcuauguugguccuuuguuuaccucc

SEQ ID NO: 259695 - RNA, 64 nt, Homo Sapiens
cuguaauauuguucagggaacaagagaaaguacacagggcuauuauucuuuacaccuccccccc

SEQ ID NO: 259696 - RNA, 64 nt, Homo Sapiens
cacaucuuaguuuccaaaagcacuuagccuacuacagggcuaugacuacugccuuuguaacuuc

SEQ ID NO: 259697 - RNA, 64 nt, Homo Sapiens
cuucaaggcuccugcuuaaaguccacacguuauuauggccgaaagcaaccuggugcuucggccu

SEQ ID NO: 259698 - RNA, 64 nt, Homo Sapiens
uuucaagggagcugauaaagaacuucuucccaaaauggccgaagcuggacuguacugcugccau

SEQ ID NO: 259699 - RNA, 64 nt, Homo Sapiens
cucucugaguguguucacugguuugccaaggaagauggccgacaccccagagccugccauucac

SEQ ID NO: 259700 - RNA, 64 nt, Homo Sapiens
ccgcgccugcccaccgggcggccccuaggcgccgauggccgaggggccgucgucaugguuacug

SEQ ID NO: 259701 - RNA, 64 nt, Homo Sapiens
guggucugcaggguaggcccgcaggaaaugaggaauggccgagcuggagagaagagcugauuuu

SEQ ID NO: 259702 - RNA, 64 nt, Homo Sapiens
gcaugaaauagcugagcccaccacuuggaaguguauggccgacagaccaaacugccaucaccuc

SEQ ID NO: 259703 - RNA, 64 nt, Homo Sapiens
agggcggggauagcaugcccucauuguuucccucauggccgaccgugggcagcguacuucuaac

SEQ ID NO: 259704 - RNA, 64 nt, Homo Sapiens
uuacuccauuguaugauaugcuucauuucuuuuuauggccgaaauauagcauguaucaguacua

SEQ ID NO: 259705 - RNA, 64 nt, Homo Sapiens
guguguaugauugucuuaaaauuuuuuaauagauauggccgagcgugauggcucaccccuguaa

SEQ ID NO: 259706 - RNA, 64 nt, Homo Sapiens
caggacacugcagaggaagaugcaggcacagcagauggccgaggcggcuagggcuuggggguga

SEQ ID NO: 259707 - RNA, 64 nt, Homo Sapiens
agacaaggcagaagcaacuuccauucuggaugccauggccgaggcuugagaguggaggagcagg

SEQ ID NO: 259708 - RNA, 64 nt, Homo Sapiens
caccauuaggcuaauagagaaacagaucagccaaauggccgaugacacaguggcagaacuggac

SEQ ID NO: 259709 - RNA, 64 nt, Homo Sapiens
ucuugauagugacaaaucaguagcagaauauuucauggccgaacggcugaaauauuucucguaa

SEQ ID NO: 259710 - RNA, 64 nt, Homo Sapiens
gacauggacaaggagcuguggagcuucaaugaguauggccgacacugagccaggcuuuucucag

SEQ ID NO: 259711 - RNA, 64 nt, Homo Sapiens
ccaggguggugacauuuagaaugaagaaaaauacauggccgacugaaagacacacugagcugug

SEQ ID NO: 259712 - RNA, 64 nt, Homo Sapiens
aggauaugcaguaugcuuaagggugaaugugguuauggccgaaagaaaaugaaauauaacaagu

SEQ ID NO: 259713 - RNA, 64 nt, Homo Sapiens
uauaaucaaugccaauguaaugccagcgggugagauggccgauggagguuucaaagauguagcu

SEQ ID NO: 259714 - RNA, 64 nt, Homo Sapiens
ucaccuuguggggcauguuuguauuuauugcuucauggccgacuggaauccugaguccugggaa

SEQ ID NO: 259715 - RNA, 64 nt, Homo Sapiens
cuacuucuucaagggcaaaguaugaguuggcaagauggccgaguccaaaccagcccucggcugc

SEQ ID NO: 259716 - RNA, 64 nt, Homo Sapiens
cacauugacuauagaaugagauguauccugcaagauggccgaaucuucauuggcaccuuuaagg

SEQ ID NO: 259717 - RNA, 64 nt, Homo Sapiens
ucgaccuugaggaggccucccacgaagggcgaagauggccgagaugauccuaaaaauaaccgaa

SEQ ID NO: 259718 - RNA, 64 nt, Homo Sapiens
gggcccacauuaggggguuuuuuucuggcuggggauggccgauguccacaaaggguagccuggc

SEQ ID NO: 259719 - RNA, 64 nt, Homo Sapiens
aagcagauuuugcuuuuguuuguuaaucauaggcauggccgagcauuguggauuagccugaggc

SEQ ID NO: 259720 - RNA, 64 nt, Homo Sapiens
aauuucaagcagugaggauuuuguggugccugagauggccgagggcacagggagugagcuguau

SEQ ID NO: 259721 - RNA, 64 nt, Homo Sapiens
ggcccgcccccgugacugacugacagaugcagggauggccgaggcagcccucgcuccagcugaa

SEQ ID NO: 259722 - RNA, 64 nt, Homo Sapiens
auguagaaaaaccuucagccaggaggcuggcaagauggccgaauaggaacagcucugaucugca

SEQ ID NO: 259723 - RNA, 64 nt, Homo Sapiens
aggaaggggcuccgugcacuaaucuaaacugggaauggccgaggcaucugaugcuuccccuggg

SEQ ID NO: 259724 - RNA, 64 nt, Homo Sapiens
gagauggauccuuccaucuuguggggccaggaccauggccgaagccccuuggagagagaggcug

SEQ ID NO: 259725 - RNA, 64 nt, Homo Sapiens
gcccccgacccaucacugccacauucuccgggucauggccgagcuugaccucugcauccauggu

SEQ ID NO: 259726 - RNA, 64 nt, Homo Sapiens
ggagaggagaaauguggacagagggcuugaagacauggccgaauaggcuacugccacccggcuu

SEQ ID NO: 259727 - RNA, 64 nt, Homo Sapiens
auuuuugccugucauaagaaaacucuuagcugaaauggccgaaaacugugagacaugcuaugga

SEQ ID NO: 259728 - RNA, 64 nt, Homo Sapiens
uuuaaugccugcuauaaaaauuugaaauauuagaauggccgaccauggcagugaccaggccuca

SEQ ID NO: 259729 - RNA, 64 nt, Homo Sapiens
cccuuagccaagcaguuucuuucaaagaagccagcaggcgaaaagcagggacugccacugcauu

SEQ ID NO: 259730 - RNA, 64 nt, Homo Sapiens
gcaggaggagcugcuuggcacuccuggcagaaagcaggcgaaggccagcucuacacagaggucu

SEQ ID NO: 259731 - RNA, 64 nt, Homo Sapiens
gccccuuuauauauccaaaaucugauuacuuuugcaggcgaaguuuuaaauggaaacuuuaaua

SEQ ID NO: 259732 - RNA, 64 nt, Homo Sapiens
uugggaucuggccaaguuggccagggacaugaugcaggcgaagcuggggguacccguugcagag

SEQ ID NO: 259733 - RNA, 64 nt, Homo Sapiens
ccacccucaguaaguggcccguaaaaacuacgagcaggcgaacgacuucacacgagggaaguca

SEQ ID NO: 259734 - RNA, 64 nt, Homo Sapiens
acgccuguaaucccagcacuuugggaggccgaaacaggcgaaucacuugagcccaggaguucaa

SEQ ID NO: 259735 - RNA, 64 nt, Homo Sapiens
gacaucuuucuaaccagauaugaaaggaugcuaucaggcgaaguaaaagugauggaaagguguu

SEQ ID NO: 259736 - RNA, 64 nt, Homo Sapiens
aagaugauuuuuacuuaaagauauuaggucuggccaggcgaagugacucacaccugcaauccca

SEQ ID NO: 259737 - RNA, 64 nt, Homo Sapiens
ccggcucuacaaaaaagaguuuuucaaaauuagccaggcgaaguggcacacaucugugguccca

SEQ ID NO: 259738 - RNA, 64 nt, Homo Sapiens
uuuugggggaacgccgggacugagagacuccacgcaggcgaauucccguuuggggcuuuuuuuu

SEQ ID NO: 259739 - RNA, 64 nt, Homo Sapiens
augccuguaaucccagcacuuugggaggccgaggcaggcgaaucacgaggucaggaguucgaga

SEQ ID NO: 259740 - RNA, 64 nt, Homo Sapiens
gagcggccaccauaugcaggcugagagcugggcacaggcgaagccauuggaagcacuucaggaa

SEQ ID NO: 259741 - RNA, 64 nt, Homo Sapiens
ugaagucauugaaguguguguguugcuggacucucaggcgaagcuucugguugggauguggagu

SEQ ID NO: 259742 - RNA, 64 nt, Homo Sapiens
gugguuugcagauguggggaagcggcugcuccuucaggcgaaggagcuggcgcucagcagcccu

SEQ ID NO: 259743 - RNA, 64 nt, Homo Sapiens
aacauugaccauuggaggagugguuuaagagugccaggcgaagggcaaacuguagaucgaucuu

SEQ ID NO: 259744 - RNA, 64 nt, Homo Sapiens
uagaggauguguuccagaaaaucagaggagccggcaggcgaagguaccaaaaggcccuugggac

SEQ ID NO: 259745 - RNA, 64 nt, Homo Sapiens
caaccggaaaagggacgugggccucccugucagucaggcgaauugugcagaccagcccuguccc

SEQ ID NO: 259746 - RNA, 64 nt, Homo Sapiens
uccagucccaacaccugcucuugccugguaggaacaggcgaagugucagcccucaauguugggu

SEQ ID NO: 259747 - RNA, 64 nt, Homo Sapiens
auuauaggcgugagccaccgcccccagcugauuccaggcgaauucuucucugaugggcgggcga

SEQ ID NO: 259748 - RNA, 64 nt, Homo Sapiens
cccagaaggugguggugggcuuggcgcgcagcagcaggcgaacuauccagucccagcguggccc

SEQ ID NO: 259749 - RNA, 64 nt, Homo Sapiens
cacagauccagugggguccggacacugggccccgcaggcgaaagcacguuccagccaccaggag

SEQ ID NO: 259750 - RNA, 64 nt, Homo Sapiens
gcagccacaccccucugccaaagcacgcgagaugcaggcgaaaaacuccagacugaucugccua

SEQ ID NO: 259751 - RNA, 64 nt, Homo Sapiens
agcguccggcagcgucccgccguagcucgcgcgucaggcgaaccugggaccgcagagcaugcug

SEQ ID NO: 259752 - RNA, 54 nt, Homo Sapiens
agcuguggaggagugugugaggaccaggcgaaggaagguaucagcugugcugga

SEQ ID NO: 259753 - RNA, 64 nt, Homo Sapiens
auugguggccugagccgauggggccccccaggcccaggcgaaagggcagcagcauguggcccau

SEQ ID NO: 259754 - RNA, 64 nt, Homo Sapiens
ucugaagcuaggacagcuggcugagaaguggguucaggcgaagggugaagccauguguagcagu

SEQ ID NO: 259755 - RNA, 64 nt, Homo Sapiens
cugagggaaggaagaaacuccaguucuaggcuuccaggcgaaaggaggggcuagggcuggaagc

SEQ ID NO: 259756 - RNA, 64 nt, Homo Sapiens
augccuguaguuccagcuacuugggaggcugagacaggcgaauugcuugaaccugggaggcaga

SEQ ID NO: 259757 - RNA, 64 nt, Homo Sapiens
gacccagagguccuuuacguguggauggaguucacaggcgaauagaggagaggaccaggggacg

SEQ ID NO: 259758 - RNA, 64 nt, Homo Sapiens
ucuuucuuugcagaccgaacgaguggagcaggggcaggcgaaccuccaccacuuccacccuggc

SEQ ID NO: 259759 - RNA, 64 nt, Homo Sapiens
ggccguccuuuccacacaggccagaagaggucuucaggcgaaccgaccuucccccuucuggcau

SEQ ID NO: 259760 - RNA, 64 nt, Homo Sapiens
cucagcuacaucaugguguauagaugcuguuauucaggcgaacuugcucauggguggacuaaca

SEQ ID NO: 259761 - RNA, 64 nt, Homo Sapiens
acaagaagcuguggugauuggcccuguggucuaucaggcgaaaaccacagauucuccuucuagu

SEQ ID NO: 259762 - RNA, 64 nt, Homo Sapiens
aggaugcugcauugcgaggaaagcauauaaaccacaggcgaaaguccuuggccucacucucugu

SEQ ID NO: 259763 - RNA, 64 nt, Homo Sapiens
caauacugugcuggagagugagaaugggggugagcaggcgaacagagcucucucuggaucagcu

SEQ ID NO: 259764 - RNA, 64 nt, Homo Sapiens
aggggaggaggucagcgaccuggggccguagcggcaggcgaacggugccugcuacccagcugga

SEQ ID NO: 259765 - RNA, 64 nt, Homo Sapiens
gcuugaaccugggaggcagaucaggcugcugaggcaggcgaauugugccuguagucccagcucc

SEQ ID NO: 259766 - RNA, 64 nt, Homo Sapiens
acugggaggccugagagugggccagcucgcugcucaggcgaauuucucauuucaagccacuggg

SEQ ID NO: 259767 - RNA, 64 nt, Homo Sapiens
aggaauggggauagaugggagguucuugaagccccaggcgaagcugguaccucuggcuacagcu

SEQ ID NO: 259768 - RNA, 64 nt, Homo Sapiens
uuugaagcucaggugucucacgucugggcugcaccaggcgaagagagaaauuaaagauuugagg

SEQ ID NO: 259769 - RNA, 64 nt, Homo Sapiens
uggggugauucacagcacaauuagaaacccuggccaggcgaacgaugggccuugcgaaccuggg

SEQ ID NO: 259770 - RNA, 64 nt, Homo Sapiens
aaaacucuauuuagaugcaugugaaaauaauugacaggcgaaaguauuuuuuaaugcuaaucuu

SEQ ID NO: 259771 - RNA, 64 nt, Homo Sapiens; identical to SEQ ID NO: 106637

SEQ ID NO: 259772 - RNA, 64 nt, Homo Sapiens; identical to SEQ ID NO: 106638

SEQ ID NO: 259773 - RNA, 64 nt, Homo Sapiens; identical to SEQ ID NO: 106639

SEQ ID NO: 259774 - RNA, 64 nt, Homo Sapiens; identical to SEQ ID NO: 106640

SEQ ID NO: 259775 - RNA, 64 nt, Homo Sapiens; identical to SEQ ID NO: 106641

SEQ ID NO: 259776 - RNA, 64 nt, Homo Sapiens; identical to SEQ ID NO: 106642

SEQ ID NO: 259777 - RNA, 64 nt, Homo Sapiens; identical to SEQ ID NO: 106643

SEQ ID NO: 259778 - RNA, 64 nt, Homo Sapiens; identical to SEQ ID NO: 106644

SEQ ID NO: 259779 - RNA, 64 nt, Homo Sapiens; identical to SEQ ID NO: 106645

SEQ ID NO: 259780 - RNA, 64 nt, Homo Sapiens; identical to SEQ ID NO: 106646

SEQ ID NO: 259781 - RNA, 64 nt, Homo Sapiens; identical to SEQ ID NO: 106647

SEQ ID NO: 259782 - RNA, 64 nt, Homo Sapiens; identical to SEQ ID NO: 106648

SEQ ID NO: 259783 - RNA, 64 nt, Homo Sapiens; identical to SEQ ID NO: 106649

SEQ ID NO: 259784 - RNA, 64 nt, Homo Sapiens; identical to SEQ ID NO: 106650

SEQ ID NO: 259785 - RNA, 61 nt, Homo Sapiens; identical to SEQ ID NO: 106651

SEQ ID NO: 259786 - RNA, 64 nt, Homo Sapiens; identical to SEQ ID NO: 106652

SEQ ID NO: 259787 - RNA, 64 nt, Homo Sapiens; identical to SEQ ID NO: 106653

SEQ ID NO: 259788 - RNA, 64 nt, Homo Sapiens; identical to SEQ ID NO: 106654

SEQ ID NO: 259789 - RNA, 64 nt, Homo Sapiens; identical to SEQ ID NO: 106655

SEQ ID NO: 259790 - RNA, 64 nt, Homo Sapiens; identical to SEQ ID NO: 106656

SEQ ID NO: 259791 - RNA, 64 nt, Homo Sapiens; identical to SEQ ID NO: 106657

SEQ ID NO: 259792 - RNA, 64 nt, Homo Sapiens; identical to SEQ ID NO: 106658

SEQ ID NO: 259793 - RNA, 64 nt, Homo Sapiens; identical to SEQ ID NO: 106659

SEQ ID NO: 259794 - RNA, 64 nt, Homo Sapiens; identical to SEQ ID NO: 106660

SEQ ID NO: 259795 - RNA, 64 nt, Homo Sapiens; identical to SEQ ID NO: 106661

SEQ ID NO: 259796 - RNA, 64 nt, Homo Sapiens; identical to SEQ ID NO: 106662

SEQ ID NO: 259797 - RNA, 64 nt, Homo Sapiens; identical to SEQ ID NO: 106663

SEQ ID NO: 259798 - RNA, 64 nt, Homo Sapiens; identical to SEQ ID NO: 106664

SEQ ID NO: 259799 - RNA, 64 nt, Homo Sapiens; identical to SEQ ID NO: 106665

SEQ ID NO: 259800 - RNA, 64 nt, Homo Sapiens; identical to SEQ ID NO: 106666

SEQ ID NO: 259801 - RNA, 64 nt, Homo Sapiens; identical to SEQ ID NO: 106667

SEQ ID NO: 259802 - RNA, 64 nt, Homo Sapiens; identical to SEQ ID NO: 106668

SEQ ID NO: 259803 - RNA, 64 nt, Homo Sapiens; identical to SEQ ID NO: 106669

SEQ ID NO: 259804 - RNA, 64 nt, Homo Sapiens; identical to SEQ ID NO: 106670

SEQ ID NO: 259805 - RNA, 64 nt, Homo Sapiens; identical to SEQ ID NO: 106671

SEQ ID NO: 259806 - RNA, 64 nt, Homo Sapiens; identical to SEQ ID NO: 106672

SEQ ID NO: 259807 - RNA, 64 nt, Homo Sapiens; identical to SEQ ID NO: 106673

SEQ ID NO: 259808 - RNA, 64 nt, Homo Sapiens; identical to SEQ ID NO: 106674

SEQ ID NO: 259809 - RNA, 64 nt, Homo Sapiens; identical to SEQ ID NO: 106675

SEQ ID NO: 259810 - RNA, 64 nt, Homo Sapiens; identical to SEQ ID NO: 106676

SEQ ID NO: 259811 - RNA, 64 nt, Homo Sapiens; identical to SEQ ID NO: 106677

SEQ ID NO: 259812 - RNA, 64 nt, Homo Sapiens; identical to SEQ ID NO: 106678

SEQ ID NO: 259813 - RNA, 64 nt, Homo Sapiens; identical to SEQ ID NO: 106679

SEQ ID NO: 259814 - RNA, 64 nt, Homo Sapiens; identical to SEQ ID NO: 106680

SEQ ID NO: 259815 - RNA, 64 nt, Homo Sapiens; identical to SEQ ID NO: 106681

SEQ ID NO: 259816 - RNA, 64 nt, Homo Sapiens; identical to SEQ ID NO: 106682

SEQ ID NO: 259817 - RNA, 64 nt, Homo Sapiens; identical to SEQ ID NO: 106683

SEQ ID NO: 259818 - RNA, 64 nt, Homo Sapiens; identical to SEQ ID NO: 106684

SEQ ID NO: 259819 - RNA, 64 nt, Homo Sapiens; identical to SEQ ID NO: 106685

SEQ ID NO: 259820 - RNA, 64 nt, Homo Sapiens; identical to SEQ ID NO: 106686

SEQ ID NO: 259821 - RNA, 64 nt, Homo Sapiens; identical to SEQ ID NO: 106687

SEQ ID NO: 259822 - RNA, 64 nt, Homo Sapiens; identical to SEQ ID NO: 106688

SEQ ID NO: 259823 - RNA, 64 nt, Homo Sapiens; identical to SEQ ID NO: 106689

SEQ ID NO: 259824 - RNA, 64 nt, Homo Sapiens; identical to SEQ ID NO: 106690

SEQ ID NO: 259825 - RNA, 64 nt, Homo Sapiens; identical to SEQ ID NO: 106691

SEQ ID NO: 259826 - RNA, 64 nt, Homo Sapiens; identical to SEQ ID NO: 106692

SEQ ID NO: 259827 - RNA, 64 nt, Homo Sapiens; identical to SEQ ID NO: 106693

SEQ ID NO: 259828 - RNA, 64 nt, Homo Sapiens; identical to SEQ ID NO: 106694

SEQ ID NO: 259829 - RNA, 64 nt, Homo Sapiens; identical to SEQ ID NO: 106695

SEQ ID NO: 259830 - RNA, 64 nt, Homo Sapiens; identical to SEQ ID NO: 106696

SEQ ID NO: 259831 - RNA, 64 nt, Homo Sapiens; identical to SEQ ID NO: 106697

SEQ ID NO: 259832 - RNA, 64 nt, Homo Sapiens; identical to SEQ ID NO: 106698

SEQ ID NO: 259833 - RNA, 64 nt, Homo Sapiens; identical to SEQ ID NO: 106699

SEQ ID NO: 259834 - RNA, 64 nt, Homo Sapiens; identical to SEQ ID NO: 106700

SEQ ID NO: 259835 - RNA, 64 nt, Homo Sapiens; identical to SEQ ID NO: 106701

SEQ ID NO: 259836 - RNA, 64 nt, Homo Sapiens; identical to SEQ ID NO: 106702

SEQ ID NO: 259837 - RNA, 64 nt, Homo Sapiens; identical to SEQ ID NO: 106703

SEQ ID NO: 259838 - RNA, 64 nt, Homo Sapiens; identical to SEQ ID NO: 106704

SEQ ID NO: 259839 - RNA, 64 nt, Homo Sapiens; identical to SEQ ID NO: 106705

SEQ ID NO: 259840 - RNA, 64 nt, Homo Sapiens; identical to SEQ ID NO: 106706

SEQ ID NO: 259841 - RNA, 64 nt, Homo Sapiens; identical to SEQ ID NO: 106707

SEQ ID NO: 259842 - RNA, 64 nt, Homo Sapiens; identical to SEQ ID NO: 106708

SEQ ID NO: 259843 - RNA, 64 nt, Homo Sapiens; identical to SEQ ID NO: 106709

SEQ ID NO: 259844 - RNA, 64 nt, Homo Sapiens; identical to SEQ ID NO: 106710

SEQ ID NO: 259845 - RNA, 64 nt, Homo Sapiens; identical to SEQ ID NO: 106711

SEQ ID NO: 259846 - RNA, 64 nt, Homo Sapiens; identical to SEQ ID NO: 106712

SEQ ID NO: 259847 - RNA, 64 nt, Homo Sapiens; identical to SEQ ID NO: 106713

SEQ ID NO: 259848 - RNA, 64 nt, Homo Sapiens; identical to SEQ ID NO: 106714

SEQ ID NO: 259849 - RNA, 64 nt, Homo Sapiens; identical to SEQ ID NO: 106715

SEQ ID NO: 259850 - RNA, 64 nt, Homo Sapiens; identical to SEQ ID NO: 106716

SEQ ID NO: 259851 - RNA, 64 nt, Homo Sapiens; identical to SEQ ID NO: 106717

SEQ ID NO: 259852 - RNA, 64 nt, Homo Sapiens; identical to SEQ ID NO: 106718

SEQ ID NO: 259853 - RNA, 64 nt, Homo Sapiens; identical to SEQ ID NO: 106719

SEQ ID NO: 259854 - RNA, 64 nt, Homo Sapiens; identical to SEQ ID NO: 106720

SEQ ID NO: 259855 - RNA, 64 nt, Homo Sapiens; identical to SEQ ID NO: 106721

SEQ ID NO: 259856 - RNA, 64 nt, Homo Sapiens; identical to SEQ ID NO: 106722

SEQ ID NO: 259857 - RNA, 64 nt, Homo Sapiens; identical to SEQ ID NO: 106723

SEQ ID NO: 259858 - RNA, 64 nt, Homo Sapiens; identical to SEQ ID NO: 106724

SEQ ID NO: 259859 - RNA, 64 nt, Homo Sapiens; identical to SEQ ID NO: 106725

SEQ ID NO: 259860 - RNA, 64 nt, Homo Sapiens; identical to SEQ ID NO: 106726

SEQ ID NO: 259861 - RNA, 64 nt, Homo Sapiens; identical to SEQ ID NO: 106727

SEQ ID NO: 259862 - RNA, 64 nt, Homo Sapiens; identical to SEQ ID NO: 106728

SEQ ID NO: 259863 - RNA, 64 nt, Homo Sapiens
uucuucccaucuggccagccccaagcugaagcugaagcugaagauuauuuucaaaugaaugagg

SEQ ID NO: 259864 - RNA, 64 nt, Homo Sapiens
ugaagauucuucccaucuggaugaggccaagcugaagcugaagcaacauuuuauuuucaaauga

SEQ ID NO: 259865 - RNA, 64 nt, Homo Sapiens
ugaagcugaagauucuucccaaaugaaugaggccaagcugaagccauguaaacauuuuauuuuc

SEQ ID NO: 259866 - RNA, 64 nt, Homo Sapiens
cuauuuggacauagacuucauuuccuuucaguauaagcugaauaaauuuagagcuuucaaacug

SEQ ID NO: 259867 - RNA, 64 nt, Homo Sapiens
uugccaguucuuaauuauaggacauauuuucucaaagcugaaggugacaccuagaaccaggggc

SEQ ID NO: 259868 - RNA, 64 nt, Homo Sapiens
gaaacuggcuuuucaaaaugggcuaugggagcacaagcugaagcuuuagugccuucuacaaugu

SEQ ID NO: 259869 - RNA, 64 nt, Homo Sapiens
accucaugggaagaguuacuuuuuuagaucuaaaaagcugaauagcauguuaguuacuugguuu

SEQ ID NO: 259870 - RNA, 64 nt, Homo Sapiens
caauucggugggcaauuuuuggacaugaaccagaaagcugaaagcugaggcugacacggacugu

SEQ ID NO: 259871 - RNA, 64 nt, Homo Sapiens
uuuucuaucucuaggcaacaugucuuuauuauucaagcugaauguuuaagagagauuuuggucu

SEQ ID NO: 259872 - RNA, 64 nt, Homo Sapiens
ugugucaccgaggugcgggaggggaggagcauuaaagcugaaagaucgcucugcucggggagcc

SEQ ID NO: 259873 - RNA, 64 nt, Homo Sapiens
uauuuggggagcaggggaggggaggguguugagaaagcugaacuggagucaaucacccuuccca

SEQ ID NO: 259874 - RNA, 64 nt, Homo Sapiens
ggccagaaugaggaagcccugaagagcuuaaaagaagcugaaaacuuaaugcaggaagaacaug

SEQ ID NO: 259875 - RNA, 64 nt, Homo Sapiens
cuccuugcccugaagcuucaggaugaaggacaggaagcugaaggagaaaaguacauugaagaag

SEQ ID NO: 259876 - RNA, 64 nt, Homo Sapiens
gcaagaauguauauagaagcaggcaaucacagaaaagcugaagagaauuuucaaaaauuguuau

SEQ ID NO: 259877 - RNA, 64 nt, Homo Sapiens
ggcagcucugcgccaucuacuccaggcaugugggaagcugaagccucucucgugcucaggcugc

SEQ ID NO: 259878 - RNA, 64 nt, Homo Sapiens
aagggccggagcccggggccccaugcuggagaagaagcugaaggccagcugauggauggcuucu

SEQ ID NO: 259879 - RNA, 64 nt, Homo Sapiens
uuacuuggguauucucugauugcaauggacauggaagcugaaaacagguccagagaaccuggca

SEQ ID NO: 259880 - RNA, 64 nt, Homo Sapiens
uggaggcauccaaaauaaggguguacugugccugaagcugaaguaggccuuacugccccuacuc

SEQ ID NO: 259881 - RNA, 64 nt, Homo Sapiens
ccauggauuucauggugauuuggcugaaaaugcaaagcugaagagauaacucaauauaacuaug

SEQ ID NO: 259882 - RNA, 64 nt, Homo Sapiens
gaugauccuggggaagguggcccaggaauuagagaagcugaaagagaguuaaauaugcaucugg

SEQ ID NO: 259883 - RNA, 64 nt, Homo Sapiens
aaucaucacuucagcuccugauuggucccaggccaagcugaauagcccuuaggaauaaucacuu

SEQ ID NO: 259884 - RNA, 64 nt, Homo Sapiens
aauaaucacuucaacuccugauuggucccgggccaagcugaauagcccuuaugaaucaucacuu

SEQ ID NO: 259885 - RNA, 64 nt, Homo Sapiens
guuccugauuggucccgggccaaggucccagaccaagcugaaucacgcuuucuccaagacagcc

SEQ ID NO: 259886 - RNA, 64 nt, Homo Sapiens
ugccuuccuuugggcuggcugggugaagaugcccaagcugaagagggcuggggcugggauggga

SEQ ID NO: 259887 - RNA, 64 nt, Homo Sapiens
uauccaaauuugccaucucacugggcgagcuaccaagcugaagguaaggcagaggcugaggggg

SEQ ID NO: 259888 - RNA, 64 nt, Homo Sapiens
ugcccaccaucaagaugcccaaguuguagagagcaagcugaagcgccccggcccgcugcuccug

SEQ ID NO: 259889 - RNA, 64 nt, Homo Sapiens
gaaugccacugaagagcugugauagcauguuucaaagcugaacucuacagagcgagugcugaga

SEQ ID NO: 259890 - RNA, 64 nt, Homo Sapiens
cucaugggaacacuguuaaugacccacacaggauaagcugaaugcaaaguuauuugcagguuga

SEQ ID NO: 259891 - RNA, 64 nt, Homo Sapiens
aaaaggauuuuguuugauuugaaauuaaaacuucaagcugaaugacuuauaugagaauaauacg

SEQ ID NO: 259892 - RNA, 64 nt, Homo Sapiens
ggcucaauuggccgggaaaacaugggagcaagagaagcugaaauauauuucugcaagaaccuuu

SEQ ID NO: 259893 - RNA, 64 nt, Homo Sapiens
cagugaccuggagugaaacagaaucuacauaaccuaagcccauauacucugcacuguguaaagg

SEQ ID NO: 259894 - RNA, 64 nt, Homo Sapiens
uuauaagcuuacguuaguauuguaauauguaaaguaagcccaacaaaaauuuuuaaaaauuuga

SEQ ID NO: 259895 - RNA, 64 nt, Homo Sapiens
ugcaagaaaaugagggcuugugacaggacagcuuuaagcccauggcggaaggagcuggagaauc

SEQ ID NO: 259896 - RNA, 64 nt, Homo Sapiens
uggaagaaaaugagggcuuguggcaggacagcuuuaagcccaaggcggaaggagcuggagaauc

SEQ ID NO: 259897 - RNA, 64 nt, Homo Sapiens
ucucugugucugugugcccuccugggagucagucagcgcucaggccaggacugugcagggccag

SEQ ID NO: 259898 - RNA, 64 nt, Homo Sapiens
gaccaggguaccccaggaggcaugaugugccgacagcgcucagugggcagaauggcaguuagau

SEQ ID NO: 259899 - RNA, 64 nt, Homo Sapiens
gugaagguuuauacguuauacacaaggccagguaagcgcucauaauucacacauaauaaaacau

SEQ ID NO: 259900 - RNA, 64 nt, Homo Sapiens
uccagcugaggugagggcugcuucccuguguugcagcgcucauuauaucuagccguccucgaga

SEQ ID NO: 259901 - RNA, 64 nt, Homo Sapiens
aggaccaggauccagccucauugguggaaucuuuagcgcucaauuuuuugcuugacuucaguua

SEQ ID NO: 259902 - RNA, 64 nt, Homo Sapiens
auuaauuuuauuuuguggcauacaagaguugguaagcgcucaucaaaguccuaucaccuaauau

SEQ ID NO: 259903 - RNA, 64 nt, Homo Sapiens
cuugugacuggcaggcugccgaccucuggcugggagcgcucauuaccucuccugcuggucccug

SEQ ID NO: 259904 - RNA, 64 nt, Homo Sapiens
ccaaaggagacugacccggcgcggugcuggcgggagcgcucaagggcagcggauuuguuguugu

SEQ ID NO: 259905 - RNA, 64 nt, Homo Sapiens
uggcuuuucgcuugcuucugucucuaaguuuagaagcgcucaucccacaagccuuacucaccuc

SEQ ID NO: 259906 - RNA, 64 nt, Homo Sapiens
uuuggucauuggacacggauugcaggcuuugagaagcgcucagaggcccagggcggcgggcuca

SEQ ID NO: 259907 - RNA, 64 nt, Homo Sapiens
auuugauagauuaaccuuucauccauaucauugaagcgcucaugaauaccccucacagcuaguc

SEQ ID NO: 259908 - RNA, 64 nt, Homo Sapiens
ggaagugccaaguuuguuuuuggguuccuggaacagcgcucaccuuuguuuagaacacugguuu

SEQ ID NO: 259909 - RNA, 64 nt, Homo Sapiens
aauaucguaaccaguuuuuuugacuacucaguccagcgcucagguuguugaacaaaacugaccu

SEQ ID NO: 259910 - RNA, 64 nt, Homo Sapiens
aagcagaggagcccacuuugcuggggagagauuaagcgcucauuuuuucucuucuccugcuuuc

SEQ ID NO: 259911 - RNA, 64 nt, Homo Sapiens
ggcucagggcuugcggccugcaggcacuccagccagcgcucaccuggccuuuccucaaggcaug

SEQ ID NO: 259912 - RNA, 64 nt, Homo Sapiens
ucuuuuuugcaccccaaguucucccgagaagaggagcgcucaugcuggcaccugugucuacuug

SEQ ID NO: 259913 - RNA, 64 nt, Homo Sapiens
cuauggguuuaagcagagggauaaucccaaagugagcgcucagcccccuucuccacuaaaaaca

SEQ ID NO: 259914 - RNA, 64 nt, Homo Sapiens
uuucaguuacccuuuaaggacagucugggaggauagcgcucauucaguacuugauagaagaaaa

SEQ ID NO: 259915 - RNA, 64 nt, Homo Sapiens
cuccuauuauaucugacacuaauuucuuuucaacagcgcucaugucucuuggcccagucaggug

SEQ ID NO: 259916 - RNA, 64 nt, Homo Sapiens
gcaaucugaauuaaaaauacaucaaaaaaguaauagcgcucauuugcuaaaugcaaaaaauaau

SEQ ID NO: 259917 - RNA, 64 nt, Homo Sapiens
ccaccuggagggaugugggggcugugcagggugcagcgcucagguggauccugggaagcagccu

SEQ ID NO: 259918 - RNA, 64 nt, Homo Sapiens
gggccuggggcccucacuccccccagcuggggugagcgcucagacugaaaaccacggggccugu

SEQ ID NO: 259919 - RNA, 64 nt, Homo Sapiens
ucacgcagaggaugccaggcaaaaccccucucucagcgcucaucagguuucuagacagcagaag

SEQ ID NO: 259920 - RNA, 64 nt, Homo Sapiens
ccagcuccuugaaccccucccugggugggcaaagagcgcucaauacucugguacccacaggagc

SEQ ID NO: 259921 - RNA, 64 nt, Homo Sapiens
cucccucccucucucaugaggcacagccaagccaagcgcucauguugagccagugggccagcca

SEQ ID NO: 259922 - RNA, 64 nt, Homo Sapiens
acccacagcauccgccgccaccccuucgggugugagcgcucaauaaaaacaacacacuauaaag

SEQ ID NO: 259923 - RNA, 64 nt, Homo Sapiens
cuguaaaaacuguuaaauauauucaggucuucacagcgcucauaucgcuaacugacauuagccc

SEQ ID NO: 259924 - RNA, 64 nt, Homo Sapiens
aucucaagagacucuguucauugggccaucacugagcgcucaguacugauaggucgggccauug

SEQ ID NO: 259925 - RNA, 64 nt, Homo Sapiens
ggguaggugggggcggugagggcuccacguugucagcgcucaggaaugugcuccggcagagugc

SEQ ID NO: 259926 - RNA, 64 nt, Homo Sapiens
gucccuguugcuggccagagacugccuggucgccagcgcucaccaugggugccaggaugcuucg

SEQ ID NO: 259927 - RNA, 64 nt, Homo Sapiens
caugccugagagacauggcuuucagaaaacgggaagcgcucagaacaguaucuuugcacuccaa

SEQ ID NO: 259928 - RNA, 64 nt, Homo Sapiens
ccaaaccuguggagaacuuuguugucaggcccugagcgcucacagcuucauuuggcccagguug

SEQ ID NO: 259929 - RNA, 64 nt, Homo Sapiens
ucuacucagguuuucuccuuuuugcaucuugggaagcgcucaaagguauuuucauaccagacua

SEQ ID NO: 259930 - RNA, 64 nt, Homo Sapiens
cuauuuuauaaaacaaauaagauuaucuaaacuaagcgcucauuaccugaagcugucaccucuu

SEQ ID NO: 259931 - RNA, 64 nt, Homo Sapiens
acaaaaguuugaaaaaugcauucuuagauuguucagcgcucagauucuuagauugcgcuaaaau

SEQ ID NO: 259932 - RNA, 64 nt, Homo Sapiens
gcuugaauggcagaacugaacaucugaucuaucuagcgcucaauaaauuuguguaaaacaguuu

SEQ ID NO: 259933 - RNA, 64 nt, Homo Sapiens
caccgcagagcuguccaggcacagcuccguccccagcgcucaugguguugaaacugucugucau

SEQ ID NO: 259934 - RNA, 64 nt, Homo Sapiens
uugcccucuaccuccugauaggccuuuaagacaaagcgcucauccgcuuggugcuguucucuuu

SEQ ID NO: 259935 - RNA, 64 nt, Homo Sapiens
cucgccugcccugcuuggcucugaggaccugcccagcgcucaaagggaacggaagccuuccccu

SEQ ID NO: 259936 - RNA, 64 nt, Homo Sapiens
acgugaugagguacucguggugcugggggaugugagcgcucaggaaggccuggugcaggcggcu

SEQ ID NO: 259937 - RNA, 64 nt, Homo Sapiens
cccuguccuuucucccugacccaaggccccagccagcgcucauacuguccuuccccucauccac

SEQ ID NO: 259938 - RNA, 64 nt, Homo Sapiens
uucaagaaauuacuggaagggcccuacucaccugagcgcucagcacaaccggccaccagauguc

SEQ ID NO: 259939 - RNA, 64 nt, Homo Sapiens
ccauucuauuuaauugcagugaggaaugcggaggagcgcucauuggccaaaccagucacucggg

SEQ ID NO: 259940 - RNA, 64 nt, Homo Sapiens
guuuuuuccuuucguccgaaaacacgacuuuuccagcgcucagcuuuaaaaaagcaaaacaaaa

SEQ ID NO: 259941 - RNA, 64 nt, Homo Sapiens
gggcuuuugguaagugauaggucaggagaguaacagcgcucaugaaugggauuagugcccuuau

SEQ ID NO: 259942 - RNA, 64 nt, Homo Sapiens
cucaucccagcaagucaaagaauuucucccugcaagcgcucagucagauaucagagcagacgga

SEQ ID NO: 259943 - RNA, 64 nt, Homo Sapiens
gcgaaagccuacuguaauauuuccucaugguggcagcgcucauacagaacugagggcugggaua

SEQ ID NO: 259944 - RNA, 64 nt, Homo Sapiens
gggaucugguucggcugcugucggaugaggacguagcgcucauggugcggcaggcucguggccu

SEQ ID NO: 259945 - RNA, 64 nt, Homo Sapiens
aucccgggaauacuucucuuuggagacagaaugaagcgcucagcggaccuaccugccugagucc

SEQ ID NO: 259946 - RNA, 64 nt, Homo Sapiens
cuacucgaguggcuuuuugaucugcugugucgccagcgcucacucauggaagcagggugggaac

SEQ ID NO: 259947 - RNA, 64 nt, Homo Sapiens
aaagauuuucacuuuaaauuaauuaguaauauugagcgcucacccugugcguggccuugugcua

SEQ ID NO: 259948 - RNA, 64 nt, Homo Sapiens
aauaagauguguauguaaaaauuaaccgauucuccauaaauaaaauugaauuuaaaauguguuu

SEQ ID NO: 259949 - RNA, 64 nt, Homo Sapiens
uaauauauugaauuuaaaaugguugcuucccgcucauaaauacacuggaguuuaaaauguuuaa

SEQ ID NO: 259950 - RNA, 64 nt, Homo Sapiens
uucauuuuaaguaauauaugaaacgcuauuuaugcauaaauauuaucuucauacuuugaauggc

SEQ ID NO: 259951 - RNA, 64 nt, Homo Sapiens
uuuucaauuguguacaaauucuuguaaaauuucacauaaauauacaugccccuguucuuccuaa

SEQ ID NO: 259952 - RNA, 64 nt, Homo Sapiens
agccccagauauaaauucucuugaaagcaauguucauaaauauuuaagcaaauuaaagacaaug

SEQ ID NO: 259953 - RNA, 64 nt, Homo Sapiens
uucccaagacaaacauuuguccuaauagcuuucucauaaauaugggcaccacuuuacauugugg

SEQ ID NO: 259954 - RNA, 64 nt, Homo Sapiens
uauagagacaaaauaauaguaaaugacauuuuaucauaaauaaaguagcugauaucucauggaa

SEQ ID NO: 259955 - RNA, 64 nt, Homo Sapiens
uggcuuauuacauauaaacuauucuuaaaaagcucauaaauaauagccuuuugagacauccuuu

SEQ ID NO: 259956 - RNA, 64 nt, Homo Sapiens
uauauuuacuaaacuaauagauuuugaaagcccucauaaauauuauguauaugucauuuaaaau

SEQ ID NO: 259957 - RNA, 64 nt, Homo Sapiens
uagauaaaaacauguuugcuaucuuuguauaaugcauaaauacauuauacaaaugaauaagugu

SEQ ID NO: 259958 - RNA, 64 nt, Homo Sapiens
gaaaugagaguuagaccauaugggcugacaacaccauaaauaacaagaaaagggagugcugaaa

SEQ ID NO: 259959 - RNA, 64 nt, Homo Sapiens
ccuuaauaauggugguguuuagcaaauuguauuacauaaauaaauauuuauuucauggauugag

SEQ ID NO: 259960 - RNA, 64 nt, Homo Sapiens
uaucauuuuaauugcaauaaaaaggcagauaagacauaaauaguuaucugaauuuuaaaauuaa

SEQ ID NO: 259961 - RNA, 64 nt, Homo Sapiens
uuaagaaaaauuuaaguuuaaaaaugaacaaauacauaaauauuaucacuugcaauuucauugu

SEQ ID NO: 259962 - RNA, 64 nt, Homo Sapiens
acucauuuaaaaguaugguuggggauauguuuuacauaaauagacaagaugucaguuuuguauu

SEQ ID NO: 259963 - RNA, 64 nt, Homo Sapiens
agagcagaugguugccuuuguugguuucagguuacauaaauaauccaggaaugaagaauuaggc

SEQ ID NO: 259964 - RNA, 64 nt, Homo Sapiens
uugacuaguuauuauguacauuucagaauguacacauaaauacugugaugaaaaucaugugauu

SEQ ID NO: 259965 - RNA, 64 nt, Homo Sapiens
cauaccuucaugguggacuacuagucacugcuuccauaaauauuguuuacagggugagauuugg

SEQ ID NO: 259966 - RNA, 64 nt, Homo Sapiens
guuuuauuggagcauagcuguguccaccuguuuucauaaauaaccuccaugggcuaaauccaga

SEQ ID NO: 259967 - RNA, 64 nt, Homo Sapiens
uacaccuaccauguacccauuaucucauguaucccauaaauauaaucgcauaccuguaucaaaa

SEQ ID NO: 259968 - RNA, 64 nt, Homo Sapiens
uauggaauacauucauaaguguaccaaaaaaauccauaaauaaauuaccaucauuugcaaaaag

SEQ ID NO: 259969 - RNA, 64 nt, Homo Sapiens
ugcauacugacacuauaaucguuuacagauucuucauaaauacaacaacaauuucacaaccuau

SEQ ID NO: 259970 - RNA, 64 nt, Homo Sapiens
aaaccuuaacuaugacuaagaaauuaaagaagaaaaccagcaaacuaaaacuucugggcagcaa

SEQ ID NO: 259971 - RNA, 64 nt, Homo Sapiens
uuugauauucagggagguaggaaagguaacagaaaaccagcauauuuaaucaaagcaagaagua

SEQ ID NO: 259972 - RNA, 64 nt, Homo Sapiens
ggauggugaucauugguaagggaaaguggcuucuaaccagcacuuguucauugguuccucuccu

SEQ ID NO: 259973 - RNA, 64 nt, Homo Sapiens
ugcccccuuggaaugcagagaaggccucuggagcaaccagcacucugccccuagauuucuccuc

SEQ ID NO: 259974 - RNA, 64 nt, Homo Sapiens
acauaaacugagaaaaaguucauuaugggauugcaaccagcaaaaaaggaauuuguuuaaauaa

SEQ ID NO: 259975 - RNA, 64 nt, Homo Sapiens
caaauauuagaggucuccugaaauaauugacaaaaaccagcagcucaugauacaccuacugguu

SEQ ID NO: 259976 - RNA, 64 nt, Homo Sapiens
cuccugccuuguucccucccguggccaaaaccagaaccagcagugggacguggccaagggugag

SEQ ID NO: 259977 - RNA, 64 nt, Homo Sapiens
acaccaacucugacacauggggugcugagcuccaaaccagcaucccugcaugccccauguggga

SEQ ID NO: 259978 - RNA, 64 nt, Homo Sapiens
aaagugcuuagaaaguuauuauuuaacuaauuuaaaccagcagauaucuaauuuauacaaaaua

SEQ ID NO: 259979 - RNA, 64 nt, Homo Sapiens
uuacuacuuguuaccuuuccaauauauauuuuucaaccagcauuggccaauuaaaauauauaua

SEQ ID NO: 259980 - RNA, 64 nt, Homo Sapiens
ucagagaucugccuuauaaauggcuaucggcuggaaccagcaguagggaaauugagccauauuu

SEQ ID NO: 259981 - RNA, 64 nt, Homo Sapiens
uuguucauuuaaaacugacccuauucuaggaaugaaccagcaagauguguaaccgacguucagu

SEQ ID NO: 259982 - RNA, 64 nt, Homo Sapiens
aagucuccagaaacauggcaaagagauaguguugaaccagcaucucaaacuucuccaauacagu

SEQ ID NO: 259983 - RNA, 64 nt, Homo Sapiens
aguaauuucuaguaaaauuguuagguuacucaagaaccagcauuauuugaguaaauacaauuuu

SEQ ID NO: 259984 - RNA, 64 nt, Homo Sapiens
gaaaacucugaaguuauauuugcaauaauaaugaaaccagcauuuaguaccagcauaugguuca

SEQ ID NO: 259985 - RNA, 64 nt, Homo Sapiens
gcuaggcuauuuucuugcuaugcuuccugcacccaaccagcagaauucuuccaggguggaggaa

SEQ ID NO: 259986 - RNA, 64 nt, Homo Sapiens
ucccaccaaccaaccacaccccccccgguaugggaaccagcacccaggaaccucucagccgaug

SEQ ID NO: 259987 - RNA, 64 nt, Homo Sapiens
ucccaccaaccagccacaccccccccaguaugggaaccagcacccaggaaccucucagccgaug

SEQ ID NO: 259988 - RNA, 64 nt, Homo Sapiens
ucccaccaaccagccacaccccccccggugugggaaccagcacccaggaaccucucagccgaug

SEQ ID NO: 259989 - RNA, 64 nt, Homo Sapiens
agagcuuuauauacuuucucguuugaauaaaugaaaccagcauuauaugguagauacuuguagu

SEQ ID NO: 259990 - RNA, 64 nt, Homo Sapiens
uucuuuuuccuuguggucugaaaucuugagugaaaaccagcaaugucaguacacuuuucuagau

SEQ ID NO: 259991 - RNA, 64 nt, Homo Sapiens
cugguuucucgcagccauugccugccugacccugaaccagcaccuucuuuuccgagucauaccc

SEQ ID NO: 259992 - RNA, 64 nt, Homo Sapiens
accuucacgcugucccaccaugggccaggaaccaaaccagcacuggguucuacugcuguggggu

SEQ ID NO: 259993 - RNA, 64 nt, Homo Sapiens
ccccacuccacaucaacauuccagggaugagccaaaccagcagggaguuagcacugaacugcuu

SEQ ID NO: 259994 - RNA, 64 nt, Homo Sapiens
guccuuucucagaggggccagcuaacccgugcagaaccagcacuaagguggacagcagacaaga

SEQ ID NO: 259995 - RNA, 64 nt, Homo Sapiens
uuuuuauuagggauuuucaaccacaagccgcaaaaaccagcaagucgguagguuccgugaugcc

SEQ ID NO: 259996 - RNA, 64 nt, Homo Sapiens
cuccagcaugggcgucauagcccucauucugguaaaccagcagcggugggccagguguugcuug

SEQ ID NO: 259997 - RNA, 64 nt, Homo Sapiens
caaaaaauauuaaaaaaaaacuccaucucaaagaaaccagcaaagccugggcaguagagucagu

SEQ ID NO: 259998 - RNA, 64 nt, Homo Sapiens
gccaacagaugucagccacuggucagaaguuugaaaccagcaugaaggcacauaggucacuuga

SEQ ID NO: 259999 - RNA, 64 nt, Homo Sapiens
guuuuuaaaauuuauuauuauauuuaucugccauuugcaucaugacuccaggcucuguuuugug

SEQ ID NO: 260000 - RNA, 64 nt, Homo Sapiens
cacucucaaacguaguucauaaauguuguguucuuugcaucauuuuuuauuguccaugauaaug

SEQ ID NO: 260001 - RNA, 64 nt, Homo Sapiens
gcagcaccuccagacuggaaaaauauguuaaucuuugcaucauauuggacucuugaaggcaauc

SEQ ID NO: 260002 - RNA, 64 nt, Homo Sapiens
gcauguccuaaauuuugaauuuagauauuccaauuugcaucagucuuucuguggcucaaauaau

SEQ ID NO: 260003 - RNA, 64 nt, Homo Sapiens
cucagccuaagggagugggagauucagcucugccuugcaucaccagucaguguccuuucauccu

SEQ ID NO: 260004 - RNA, 64 nt, Homo Sapiens
gcugcuggguuggaggggcuuccagguagcccacuugcaucaggugguuuucugucuagccagg

SEQ ID NO: 260005 - RNA, 64 nt, Homo Sapiens
uggaaauucaggugaaaauguucaucaauucccauugcaucaccucuguaauuuuucagcucuc

SEQ ID NO: 260006 - RNA, 64 nt, Homo Sapiens
uauauauauaaauauuuggucucuauuucauuuuuugcaucaguauuaauacuaaaauaugucu

SEQ ID NO: 260007 - RNA, 64 nt, Homo Sapiens; identical to SEQ ID NO: 237576

SEQ ID NO: 260008 - RNA, 64 nt, Homo Sapiens; identical to SEQ ID NO: 237577

SEQ ID NO: 260009 - RNA, 64 nt, Homo Sapiens; identical to SEQ ID NO: 237578

SEQ ID NO: 260010 - RNA, 64 nt, Homo Sapiens; identical to SEQ ID NO: 237579

SEQ ID NO: 260011 - RNA, 64 nt, Homo Sapiens; identical to SEQ ID NO: 237580

SEQ ID NO: 260012 - RNA, 64 nt, Homo Sapiens; identical to SEQ ID NO: 237581

SEQ ID NO: 260013 - RNA, 64 nt, Homo Sapiens; identical to SEQ ID NO: 237582

SEQ ID NO: 260014 - RNA, 64 nt, Homo Sapiens; identical to SEQ ID NO: 237583

SEQ ID NO: 260015 - RNA, 64 nt, Homo Sapiens; identical to SEQ ID NO: 237584

SEQ ID NO: 260016 - RNA, 64 nt, Homo Sapiens; identical to SEQ ID NO: 237585

SEQ ID NO: 260017 - RNA, 64 nt, Homo Sapiens; identical to SEQ ID NO: 237586

SEQ ID NO: 260018 - RNA, 64 nt, Homo Sapiens; identical to SEQ ID NO: 237587

SEQ ID NO: 260019 - RNA, 64 nt, Homo Sapiens; identical to SEQ ID NO: 237588

SEQ ID NO: 260020 - RNA, 64 nt, Homo Sapiens; identical to SEQ ID NO: 237589

SEQ ID NO: 260021 - RNA, 64 nt, Homo Sapiens; identical to SEQ ID NO: 237590

SEQ ID NO: 260022 - RNA, 64 nt, Homo Sapiens; identical to SEQ ID NO: 237591

SEQ ID NO: 260023 - RNA, 64 nt, Homo Sapiens; identical to SEQ ID NO: 237592

SEQ ID NO: 260024 - RNA, 64 nt, Homo Sapiens; identical to SEQ ID NO: 237593

SEQ ID NO: 260025 - RNA, 64 nt, Homo Sapiens; identical to SEQ ID NO: 237594

SEQ ID NO: 260026 - RNA, 64 nt, Homo Sapiens; identical to SEQ ID NO: 237595

SEQ ID NO: 260027 - RNA, 64 nt, Homo Sapiens; identical to SEQ ID NO: 237596

SEQ ID NO: 260028 - RNA, 64 nt, Homo Sapiens; identical to SEQ ID NO: 237597

SEQ ID NO: 260029 - RNA, 64 nt, Homo Sapiens; identical to SEQ ID NO: 237598

SEQ ID NO: 260030 - RNA, 64 nt, Homo Sapiens; identical to SEQ ID NO: 237599

SEQ ID NO: 260031 - RNA, 64 nt, Homo Sapiens; identical to SEQ ID NO: 237600

SEQ ID NO: 260032 - RNA, 64 nt, Homo Sapiens; identical to SEQ ID NO: 237601

SEQ ID NO: 260033 - RNA, 64 nt, Homo Sapiens; identical to SEQ ID NO: 237602

SEQ ID NO: 260034 - RNA, 64 nt, Homo Sapiens; identical to SEQ ID NO: 237603

SEQ ID NO: 260035 - RNA, 64 nt, Homo Sapiens; identical to SEQ ID NO: 237604

SEQ ID NO: 260036 - RNA, 64 nt, Homo Sapiens; identical to SEQ ID NO: 237605

SEQ ID NO: 260037 - RNA, 64 nt, Homo Sapiens; identical to SEQ ID NO: 237606

SEQ ID NO: 260038 - RNA, 64 nt, Homo Sapiens; identical to SEQ ID NO: 237607

SEQ ID NO: 260039 - RNA, 64 nt, Homo Sapiens; identical to SEQ ID NO: 237608

SEQ ID NO: 260040 - RNA, 64 nt, Homo Sapiens; identical to SEQ ID NO: 237609

SEQ ID NO: 260041 - RNA, 64 nt, Homo Sapiens; identical to SEQ ID NO: 237610

SEQ ID NO: 260042 - RNA, 64 nt, Homo Sapiens; identical to SEQ ID NO: 237611

SEQ ID NO: 260043 - RNA, 64 nt, Homo Sapiens; identical to SEQ ID NO: 237612

SEQ ID NO: 260044 - RNA, 64 nt, Homo Sapiens; identical to SEQ ID NO: 237613

SEQ ID NO: 260045 - RNA, 64 nt, Homo Sapiens; identical to SEQ ID NO: 237614

SEQ ID NO: 260046 - RNA, 64 nt, Homo Sapiens; identical to SEQ ID NO: 237615

SEQ ID NO: 260047 - RNA, 64 nt, Homo Sapiens; identical to SEQ ID NO: 237616

SEQ ID NO: 260048 - RNA, 64 nt, Homo Sapiens; identical to SEQ ID NO: 237617

SEQ ID NO: 260049 - RNA, 64 nt, Homo Sapiens; identical to SEQ ID NO: 237618

SEQ ID NO: 260050 - RNA, 64 nt, Homo Sapiens; identical to SEQ ID NO: 237619

SEQ ID NO: 260051 - RNA, 64 nt, Homo Sapiens; identical to SEQ ID NO: 237620

SEQ ID NO: 260052 - RNA, 64 nt, Homo Sapiens; identical to SEQ ID NO: 237621

SEQ ID NO: 260053 - RNA, 64 nt, Homo Sapiens; identical to SEQ ID NO: 237622

SEQ ID NO: 260054 - RNA, 64 nt, Homo Sapiens; identical to SEQ ID NO: 237623

SEQ ID NO: 260055 - RNA, 64 nt, Homo Sapiens; identical to SEQ ID NO: 237624

SEQ ID NO: 260056 - RNA, 64 nt, Homo Sapiens; identical to SEQ ID NO: 237625

SEQ ID NO: 260057 - RNA, 64 nt, Homo Sapiens; identical to SEQ ID NO: 237626

SEQ ID NO: 260058 - RNA, 64 nt, Homo Sapiens; identical to SEQ ID NO: 237627

SEQ ID NO: 260059 - RNA, 64 nt, Homo Sapiens; identical to SEQ ID NO: 237628

SEQ ID NO: 260060 - RNA, 64 nt, Homo Sapiens; identical to SEQ ID NO: 237629

SEQ ID NO: 260061 - RNA, 64 nt, Homo Sapiens; identical to SEQ ID NO: 237630

SEQ ID NO: 260062 - RNA, 64 nt, Homo Sapiens; identical to SEQ ID NO: 237631

SEQ ID NO: 260063 - RNA, 64 nt, Homo Sapiens; identical to SEQ ID NO: 237632

SEQ ID NO: 260064 - RNA, 64 nt, Homo Sapiens; identical to SEQ ID NO: 237633

SEQ ID NO: 260065 - RNA, 64 nt, Homo Sapiens; identical to SEQ ID NO: 237634

SEQ ID NO: 260066 - RNA, 64 nt, Homo Sapiens; identical to SEQ ID NO: 237635

SEQ ID NO: 260067 - RNA, 64 nt, Homo Sapiens; identical to SEQ ID NO: 237636

SEQ ID NO: 260068 - RNA, 64 nt, Homo Sapiens; identical to SEQ ID NO: 237637

SEQ ID NO: 260069 - RNA, 64 nt, Homo Sapiens; identical to SEQ ID NO: 237638

SEQ ID NO: 260070 - RNA, 64 nt, Homo Sapiens; identical to SEQ ID NO: 237639

SEQ ID NO: 260071 - RNA, 64 nt, Homo Sapiens; identical to SEQ ID NO: 237640

SEQ ID NO: 260072 - RNA, 64 nt, Homo Sapiens; identical to SEQ ID NO: 237641

SEQ ID NO: 260073 - RNA, 64 nt, Homo Sapiens; identical to SEQ ID NO: 237642

SEQ ID NO: 260074 - RNA, 64 nt, Homo Sapiens; identical to SEQ ID NO: 237643

SEQ ID NO: 260075 - RNA, 64 nt, Homo Sapiens; identical to SEQ ID NO: 237644

SEQ ID NO: 260076 - RNA, 64 nt, Homo Sapiens; identical to SEQ ID NO: 237645

SEQ ID NO: 260077 - RNA, 64 nt, Homo Sapiens; identical to SEQ ID NO: 237646

SEQ ID NO: 260078 - RNA, 64 nt, Homo Sapiens; identical to SEQ ID NO: 237647

SEQ ID NO: 260079 - RNA, 64 nt, Homo Sapiens; identical to SEQ ID NO: 237648

SEQ ID NO: 260080 - RNA, 64 nt, Homo Sapiens; identical to SEQ ID NO: 237649

SEQ ID NO: 260081 - RNA, 64 nt, Homo Sapiens; identical to SEQ ID NO: 237650

SEQ ID NO: 260082 - RNA, 64 nt, Homo Sapiens; identical to SEQ ID NO: 237651

SEQ ID NO: 260083 - RNA, 64 nt, Homo Sapiens; identical to SEQ ID NO: 237652

SEQ ID NO: 260084 - RNA, 64 nt, Homo Sapiens; identical to SEQ ID NO: 237653

SEQ ID NO: 260085 - RNA, 64 nt, Homo Sapiens; identical to SEQ ID NO: 237654

SEQ ID NO: 260086 - RNA, 64 nt, Homo Sapiens; identical to SEQ ID NO: 237655

SEQ ID NO: 260087 - RNA, 64 nt, Homo Sapiens; identical to SEQ ID NO: 237656

SEQ ID NO: 260088 - RNA, 64 nt, Homo Sapiens; identical to SEQ ID NO: 237657

SEQ ID NO: 260089 - RNA, 64 nt, Homo Sapiens; identical to SEQ ID NO: 237658

SEQ ID NO: 260090 - RNA, 64 nt, Homo Sapiens; identical to SEQ ID NO: 237659

SEQ ID NO: 260091 - RNA, 64 nt, Homo Sapiens; identical to SEQ ID NO: 237660

SEQ ID NO: 260092 - RNA, 64 nt, Homo Sapiens; identical to SEQ ID NO: 237661

SEQ ID NO: 260093 - RNA, 64 nt, Homo Sapiens; identical to SEQ ID NO: 237662

SEQ ID NO: 260094 - RNA, 64 nt, Homo Sapiens; identical to SEQ ID NO: 237663

SEQ ID NO: 260095 - RNA, 64 nt, Homo Sapiens; identical to SEQ ID NO: 237664

SEQ ID NO: 260096 - RNA, 64 nt, Homo Sapiens; identical to SEQ ID NO: 237665

SEQ ID NO: 260097 - RNA, 64 nt, Homo Sapiens; identical to SEQ ID NO: 237666

SEQ ID NO: 260098 - RNA, 64 nt, Homo Sapiens; identical to SEQ ID NO: 237667

SEQ ID NO: 260099 - RNA, 64 nt, Homo Sapiens; identical to SEQ ID NO: 237668

SEQ ID NO: 260100 - RNA, 64 nt, Homo Sapiens; identical to SEQ ID NO: 237669

SEQ ID NO: 260101 - RNA, 64 nt, Homo Sapiens; identical to SEQ ID NO: 237670

SEQ ID NO: 260102 - RNA, 64 nt, Homo Sapiens; identical to SEQ ID NO: 237671

SEQ ID NO: 260103 - RNA, 64 nt, Homo Sapiens; identical to SEQ ID NO: 237672

SEQ ID NO: 260104 - RNA, 64 nt, Homo Sapiens; identical to SEQ ID NO: 237673

SEQ ID NO: 260105 - RNA, 64 nt, Homo Sapiens; identical to SEQ ID NO: 237674

SEQ ID NO: 260106 - RNA, 64 nt, Homo Sapiens; identical to SEQ ID NO: 237675

SEQ ID NO: 260107 - RNA, 64 nt, Homo Sapiens; identical to SEQ ID NO: 237676

SEQ ID NO: 260108 - RNA, 64 nt, Homo Sapiens; identical to SEQ ID NO: 237677

SEQ ID NO: 260109 - RNA, 64 nt, Homo Sapiens; identical to SEQ ID NO: 237678

SEQ ID NO: 260110 - RNA, 64 nt, Homo Sapiens; identical to SEQ ID NO: 237679

SEQ ID NO: 260111 - RNA, 64 nt, Homo Sapiens; identical to SEQ ID NO: 237680

SEQ ID NO: 260112 - RNA, 64 nt, Homo Sapiens; identical to SEQ ID NO: 237681

SEQ ID NO: 260113 - RNA, 64 nt, Homo Sapiens; identical to SEQ ID NO: 237682

SEQ ID NO: 260114 - RNA, 64 nt, Homo Sapiens; identical to SEQ ID NO: 237683

SEQ ID NO: 260115 - RNA, 64 nt, Homo Sapiens; identical to SEQ ID NO: 237684

SEQ ID NO: 260116 - RNA, 64 nt, Homo Sapiens; identical to SEQ ID NO: 237685

SEQ ID NO: 260117 - RNA, 64 nt, Homo Sapiens; identical to SEQ ID NO: 237686

SEQ ID NO: 260118 - RNA, 64 nt, Homo Sapiens; identical to SEQ ID NO: 237687

SEQ ID NO: 260119 - RNA, 64 nt, Homo Sapiens; identical to SEQ ID NO: 237688

SEQ ID NO: 260120 - RNA, 64 nt, Homo Sapiens; identical to SEQ ID NO: 237689

SEQ ID NO: 260121 - RNA, 64 nt, Homo Sapiens; identical to SEQ ID NO: 237690

SEQ ID NO: 260122 - RNA, 64 nt, Homo Sapiens; identical to SEQ ID NO: 237691

SEQ ID NO: 260123 - RNA, 64 nt, Homo Sapiens; identical to SEQ ID NO: 237692

SEQ ID NO: 260124 - RNA, 64 nt, Homo Sapiens; identical to SEQ ID NO: 237693

SEQ ID NO: 260125 - RNA, 64 nt, Homo Sapiens; identical to SEQ ID NO: 237694

SEQ ID NO: 260126 - RNA, 64 nt, Homo Sapiens; identical to SEQ ID NO: 237695

SEQ ID NO: 260127 - RNA, 64 nt, Homo Sapiens; identical to SEQ ID NO: 237696

SEQ ID NO: 260128 - RNA, 64 nt, Homo Sapiens; identical to SEQ ID NO: 237697

SEQ ID NO: 260129 - RNA, 64 nt, Homo Sapiens; identical to SEQ ID NO: 237698

SEQ ID NO: 260130 - RNA, 64 nt, Homo Sapiens; identical to SEQ ID NO: 237699

SEQ ID NO: 260131 - RNA, 64 nt, Homo Sapiens; identical to SEQ ID NO: 237700

SEQ ID NO: 260132 - RNA, 64 nt, Homo Sapiens; identical to SEQ ID NO: 237701

SEQ ID NO: 260133 - RNA, 64 nt, Homo Sapiens; identical to SEQ ID NO: 237702

SEQ ID NO: 260134 - RNA, 64 nt, Homo Sapiens; identical to SEQ ID NO: 237703

SEQ ID NO: 260135 - RNA, 64 nt, Homo Sapiens; identical to SEQ ID NO: 237704

SEQ ID NO: 260136 - RNA, 64 nt, Homo Sapiens; identical to SEQ ID NO: 237705

SEQ ID NO: 260137 - RNA, 64 nt, Homo Sapiens; identical to SEQ ID NO: 237706

SEQ ID NO: 260138 - RNA, 64 nt, Homo Sapiens; identical to SEQ ID NO: 237707

SEQ ID NO: 260139 - RNA, 64 nt, Homo Sapiens; identical to SEQ ID NO: 237708

SEQ ID NO: 260140 - RNA, 64 nt, Homo Sapiens; identical to SEQ ID NO: 237709

SEQ ID NO: 260141 - RNA, 64 nt, Homo Sapiens; identical to SEQ ID NO: 237710

SEQ ID NO: 260142 - RNA, 64 nt, Homo Sapiens; identical to SEQ ID NO: 237711

SEQ ID NO: 260143 - RNA, 64 nt, Homo Sapiens; identical to SEQ ID NO: 237712

SEQ ID NO: 260144 - RNA, 64 nt, Homo Sapiens; identical to SEQ ID NO: 237713

SEQ ID NO: 260145 - RNA, 64 nt, Homo Sapiens; identical to SEQ ID NO: 237714

SEQ ID NO: 260146 - RNA, 64 nt, Homo Sapiens; identical to SEQ ID NO: 237715

SEQ ID NO: 260147 - RNA, 64 nt, Homo Sapiens; identical to SEQ ID NO: 237716

SEQ ID NO: 260148 - RNA, 64 nt, Homo Sapiens; identical to SEQ ID NO: 237717

SEQ ID NO: 260149 - RNA, 64 nt, Homo Sapiens; identical to SEQ ID NO: 237718

SEQ ID NO: 260150 - RNA, 64 nt, Homo Sapiens; identical to SEQ ID NO: 237719

SEQ ID NO: 260151 - RNA, 64 nt, Homo Sapiens; identical to SEQ ID NO: 237720

SEQ ID NO: 260152 - RNA, 64 nt, Homo Sapiens; identical to SEQ ID NO: 237721

SEQ ID NO: 260153 - RNA, 64 nt, Homo Sapiens; identical to SEQ ID NO: 237722

SEQ ID NO: 260154 - RNA, 64 nt, Homo Sapiens; identical to SEQ ID NO: 237723

SEQ ID NO: 260155 - RNA, 64 nt, Homo Sapiens; identical to SEQ ID NO: 237724

SEQ ID NO: 260156 - RNA, 64 nt, Homo Sapiens; identical to SEQ ID NO: 237725

SEQ ID NO: 260157 - RNA, 64 nt, Homo Sapiens; identical to SEQ ID NO: 237726

SEQ ID NO: 260158 - RNA, 64 nt, Homo Sapiens; identical to SEQ ID NO: 237727

SEQ ID NO: 260159 - RNA, 64 nt, Homo Sapiens; identical to SEQ ID NO: 237728

SEQ ID NO: 260160 - RNA, 64 nt, Homo Sapiens; identical to SEQ ID NO: 237729

SEQ ID NO: 260161 - RNA, 64 nt, Homo Sapiens; identical to SEQ ID NO: 237730

SEQ ID NO: 260162 - RNA, 64 nt, Homo Sapiens; identical to SEQ ID NO: 237731

SEQ ID NO: 260163 - RNA, 64 nt, Homo Sapiens; identical to SEQ ID NO: 237732

SEQ ID NO: 260164 - RNA, 64 nt, Homo Sapiens; identical to SEQ ID NO: 237733

SEQ ID NO: 260165 - RNA, 64 nt, Homo Sapiens; identical to SEQ ID NO: 117824

SEQ ID NO: 260166 - RNA, 64 nt, Homo Sapiens; identical to SEQ ID NO: 117825

SEQ ID NO: 260167 - RNA, 64 nt, Homo Sapiens; identical to SEQ ID NO: 117826

SEQ ID NO: 260168 - RNA, 64 nt, Homo Sapiens; identical to SEQ ID NO: 117827

SEQ ID NO: 260169 - RNA, 64 nt, Homo Sapiens; identical to SEQ ID NO: 117828

SEQ ID NO: 260170 - RNA, 64 nt, Homo Sapiens; identical to SEQ ID NO: 117829

SEQ ID NO: 260171 - RNA, 64 nt, Homo Sapiens; identical to SEQ ID NO: 117830

SEQ ID NO: 260172 - RNA, 64 nt, Homo Sapiens; identical to SEQ ID NO: 117831

SEQ ID NO: 260173 - RNA, 64 nt, Homo Sapiens; identical to SEQ ID NO: 117832

SEQ ID NO: 260174 - RNA, 64 nt, Homo Sapiens; identical to SEQ ID NO: 117833

SEQ ID NO: 260175 - RNA, 64 nt, Homo Sapiens; identical to SEQ ID NO: 117834

SEQ ID NO: 260176 - RNA, 64 nt, Homo Sapiens; identical to SEQ ID NO: 117835

SEQ ID NO: 260177 - RNA, 64 nt, Homo Sapiens; identical to SEQ ID NO: 117836

SEQ ID NO: 260178 - RNA, 64 nt, Homo Sapiens; identical to SEQ ID NO: 117837

SEQ ID NO: 260179 - RNA, 64 nt, Homo Sapiens; identical to SEQ ID NO: 117838

SEQ ID NO: 260180 - RNA, 64 nt, Homo Sapiens; identical to SEQ ID NO: 117839

SEQ ID NO: 260181 - RNA, 64 nt, Homo Sapiens; identical to SEQ ID NO: 117840

SEQ ID NO: 260182 - RNA, 64 nt, Homo Sapiens; identical to SEQ ID NO: 117841

SEQ ID NO: 260183 - RNA, 64 nt, Homo Sapiens; identical to SEQ ID NO: 117842

SEQ ID NO: 260184 - RNA, 64 nt, Homo Sapiens; identical to SEQ ID NO: 117843

SEQ ID NO: 260185 - RNA, 64 nt, Homo Sapiens; identical to SEQ ID NO: 117844

SEQ ID NO: 260186 - RNA, 64 nt, Homo Sapiens; identical to SEQ ID NO: 117845

SEQ ID NO: 260187 - RNA, 64 nt, Homo Sapiens; identical to SEQ ID NO: 117846

SEQ ID NO: 260188 - RNA, 64 nt, Homo Sapiens; identical to SEQ ID NO: 117847

SEQ ID NO: 260189 - RNA, 64 nt, Homo Sapiens; identical to SEQ ID NO: 117848

SEQ ID NO: 260190 - RNA, 64 nt, Homo Sapiens; identical to SEQ ID NO: 117849

SEQ ID NO: 260191 - RNA, 64 nt, Homo Sapiens; identical to SEQ ID NO: 117850

SEQ ID NO: 260192 - RNA, 64 nt, Homo Sapiens; identical to SEQ ID NO: 117851

SEQ ID NO: 260193 - RNA, 64 nt, Homo Sapiens; identical to SEQ ID NO: 117852

SEQ ID NO: 260194 - RNA, 64 nt, Homo Sapiens; identical to SEQ ID NO: 117853

SEQ ID NO: 260195 - RNA, 64 nt, Homo Sapiens; identical to SEQ ID NO: 117854

SEQ ID NO: 260196 - RNA, 64 nt, Homo Sapiens; identical to SEQ ID NO: 117855

SEQ ID NO: 260197 - RNA, 64 nt, Homo Sapiens
cuaguuucacagcuauuugaauuuuuuucuggauuuacuauauaacucuuauuuuuuaaaagau

SEQ ID NO: 260198 - RNA, 64 nt, Homo Sapiens
acuguaauccuuuguauucauguuuacagugcuauuacuauaauucaaaauuauguaugugacu

SEQ ID NO: 260199 - RNA, 64 nt, Homo Sapiens
gacuuuuaacauugguuuaaaccauuaugugauguuacuauaaguaagagguaacugugagguu

SEQ ID NO: 260200 - RNA, 64 nt, Homo Sapiens
gcuuggcuaaauuauacaagaagcuagcauccaguuacuauauauuuuuaaugaaaaacaaguc

SEQ ID NO: 260201 - RNA, 64 nt, Homo Sapiens
guucucaauuaaauucuuuaaauauuuuaauagguuacuauaaggcaaaccggacaugcaggug

SEQ ID NO: 260202 - RNA, 64 nt, Homo Sapiens
uuguucacacuaauaaagcuuauuacaugaaugauuacuauauugcugaacaggcaagauauaa

SEQ ID NO: 260203 - RNA, 64 nt, Homo Sapiens
auuaugaaauguaauguaagaccucuauuuuuuguuacuauacaaaaacaaaaugcuacuuguu

SEQ ID NO: 260204 - RNA, 64 nt, Homo Sapiens
guuaauauuuauuuucauuucagagaugaguccuuuacuauaagagcaucagaacauguguuuu

SEQ ID NO: 260205 - RNA, 64 nt, Homo Sapiens
uugaacaaaagcaugcuaaagaaugugguuuaauuuacuauauauuuguaaacuuguuagcuuu

SEQ ID NO: 260206 - RNA, 64 nt, Homo Sapiens
uguucucuuacuaauguucugucuuguuuuauucuuacuauagaaaaugggauauuaaaauagu

SEQ ID NO: 260207 - RNA, 64 nt, Homo Sapiens
aaagccaucucagagccauugauacaagucaaucuuacuauauguaacuucagacaaaguggaa

SEQ ID NO: 260208 - RNA, 64 nt, Homo Sapiens
cauaaagccguuuauucuuccuuguaagaauccuuuacuauaaauauggguuaaaguauaaugu

SEQ ID NO: 260209 - RNA, 64 nt, Homo Sapiens
gucuugagcaaugaagcuauauugucccuacauauuacuauauauugaacugaaaguucuuaca

SEQ ID NO: 260210 - RNA, 64 nt, Homo Sapiens
aagaauuuuaucuuauaucuaaaaaauauauaacuuacuauauguuucaguugcucucugaaca

SEQ ID NO: 260211 - RNA, 64 nt, Homo Sapiens
uaaaccuaagauaagaaaacucuuaccaaguaccuuacuauaaggaauaggaaacauuuuaucu

SEQ ID NO: 260212 - RNA, 64 nt, Homo Sapiens
augauuuaaaacaaaauaaagucuuaaacucaaauuacuauaugauucugaauggcugaaguua

SEQ ID NO: 260213 - RNA, 64 nt, Homo Sapiens
uucaugacagcuaauuaguauucagugauuccuuuuacuauagauaauauuuuauucuuaaauc

SEQ ID NO: 260214 - RNA, 64 nt, Homo Sapiens
uuccuaaguguacaccaaacucucuaaucuacucuuacuauaauaaaggaaaacaagcaaaucu

SEQ ID NO: 260215 - RNA, 61 nt, Homo Sapiens
caagacagcuggugccuuaagaauuggcccagccucagauccugucuuuagcaaccagcua

SEQ ID NO: 260216 - RNA, 64 nt, Homo Sapiens
uagaguauuucaaaauggaaucaggaucuggugggccucagaaauugucucuuuucugaguuuc

SEQ ID NO: 260217 - RNA, 57 nt, Homo Sapiens
acacucucccuuuucaguaagcgcaaagccucagaagaccuggaacaagauucugcc

SEQ ID NO: 260218 - RNA, 64 nt, Homo Sapiens
cucuccuuccucuuccucaugaaugggccuuagugccucagagaguugaggaccgcagcauccc

SEQ ID NO: 260219 - RNA, 64 nt, Homo Sapiens
aauguguauuuaacuuaugugcgaauguuucagugccucagacaugggaauuuggguuguguau

SEQ ID NO: 260220 - RNA, 64 nt, Homo Sapiens
gaacuguacgggguuugugagcaaagaggcuagugccucagagauaucuguaaccaagauggau

SEQ ID NO: 260221 - RNA, 64 nt, Homo Sapiens
agccuucccauuuugcaguugaggaggcugaguagccucagaaggguuuaggcgaccuucugaa

SEQ ID NO: 260222 - RNA, 64 nt, Homo Sapiens
aagucacgugauggagagaggauucaaagccagggccucagacccucacacacuugucugugcu

SEQ ID NO: 260223 - RNA, 64 nt, Homo Sapiens
cauggugggaggcaaaagacacauggcuggggaggccucagaauuuaauuggacuuaaaguucc

SEQ ID NO: 260224 - RNA, 64 nt, Homo Sapiens
cauggcgggaggugaaaggcacauggcuggggaggccucagaauuuacuuggacuuacaguucc

SEQ ID NO: 260225 - RNA, 64 nt, Homo Sapiens
gcccacaagcuacaaaugcugcccagagggcgaugccucagaauccgccuuguggagaaauccu

SEQ ID NO: 260226 - RNA, 64 nt, Homo Sapiens
cagacucugaagccggagagagcccucccgcucagccucagaagggugaccggagagaaagagg

SEQ ID NO: 260227 - RNA, 64 nt, Homo Sapiens
caggcugcagagcaaggaugaagccucaggaggggccucagacccagccccugcuccacacugu

SEQ ID NO: 260228 - RNA, 64 nt, Homo Sapiens
cuuucccugcucaacccuccauccuaggcucugagccucagaggacccagcccaugagagaacg

SEQ ID NO: 260229 - RNA, 64 nt, Homo Sapiens
cacccacccaggcuuugaagagcauggagggggagccucagagcugacaguccugcuuagagcc

SEQ ID NO: 260230 - RNA, 64 nt, Homo Sapiens
ucagcccugcccauggcugugcagcucccuccgugccucagaucugcuguagccagugcagacc

SEQ ID NO: 260231 - RNA, 64 nt, Homo Sapiens
uaccccuacaguuucuccugcuaccccuuccagggccucagaaccacccccgggggccucagaa

SEQ ID NO: 260232 - RNA, 64 nt, Homo Sapiens
uaccccuuccagggccucagccgcacccccgggggccucagaacuccucccuggaccugcagcu

SEQ ID NO: 260233 - RNA, 64 nt, Homo Sapiens
guaccaacaauucuguuucaggaggguagcaccugccucagauaucauguuuugaacugacuag

SEQ ID NO: 260234 - RNA, 64 nt, Homo Sapiens
cuucaucuguauacaucacaaaaacaauucauuagccucagauuuaaaagcaaaaacaaaaaac

SEQ ID NO: 260235 - RNA, 64 nt, Homo Sapiens
cugccaagucugucaucacugugggguguagccugccucagagggaccugcaaucaccucucug

SEQ ID NO: 260236 - RNA, 64 nt, Homo Sapiens
gcuguguccccugccugagggcucugugccuccugccucagaugcggccugugccagagaggcu

SEQ ID NO: 260237 - RNA, 64 nt, Homo Sapiens
uuaauuggacuuacaguuccacaugacuggggaggccucagaaucauggugggaggcaaaaagc

SEQ ID NO: 260238 - RNA, 64 nt, Homo Sapiens
uuaauuggacuuacaguuccacauggccggggaggccucagaaucauggcgggaggugaaaagc

SEQ ID NO: 260239 - RNA, 64 nt, Homo Sapiens
cugucauuguuccuuccccagaagcuaagagccagccucagagccuacccaggagcugugaagg

SEQ ID NO: 260240 - RNA, 64 nt, Homo Sapiens
cuuuuccuuucuaccuccccugugaccuuuccuagccucagaucuguuaauucuuuuggcccca

SEQ ID NO: 260241 - RNA, 64 nt, Homo Sapiens
gcgcgcuguguguguguguggugugugugugucagccucagagcucagagcgcgcugugugugu

SEQ ID NO: 260242 - RNA, 64 nt, Homo Sapiens
gcgcuguguguguguguguggugugugugugucggccucagagcgugugugugugugugugugu

SEQ ID NO: 260243 - RNA, 64 nt, Homo Sapiens
gagcgcuguguguguguguguagcaauggggccggccucagagaacccuaagauggaggccagg

SEQ ID NO: 260244 - RNA, 64 nt, Homo Sapiens
acaccuggcccagcacaggcccagacuccugccggccucagaggaagcgcaggugcagcggggg

SEQ ID NO: 260245 - RNA, 64 nt, Homo Sapiens
guggaauugcugcccugugggccuuggucccugagccucagagcugggccccacacccagcccu

SEQ ID NO: 260246 - RNA, 64 nt, Homo Sapiens
ucugugaaagaauaaaauuucucuggaccugccugccucagacuuuauugagcuccugcaugaa

SEQ ID NO: 260247 - RNA, 64 nt, Homo Sapiens
agccaagucauugguguucaucuacucccugcaagccucagagcugaccugggaugccuaacug

SEQ ID NO: 260248 - RNA, 64 nt, Homo Sapiens
ucaggacccugccgucucacuccucgcccacggcgccucagacccucagauuucaggacccucc

SEQ ID NO: 260249 - RNA, 64 nt, Homo Sapiens
ucaggacccuccuccucgccuccucgcccacggcgccucagauuuggcgugugcuuggcccucc

SEQ ID NO: 260250 - RNA, 64 nt, Homo Sapiens
uagcguuuuagucguuuuauguuucuuugcaacggccucagaaguuuggccggagagggggcag

SEQ ID NO: 260251 - RNA, 64 nt, Homo Sapiens
gccggagagggggcagccagagcggcagcccccggccucagaggcuaucacaggcucagggcaa

SEQ ID NO: 260252 - RNA, 64 nt, Homo Sapiens
cuauaggucagugaaagggccuuugcucucagaugccucagaugaccagccucauucuauuuaa

SEQ ID NO: 260253 - RNA, 64 nt, Homo Sapiens
cuuugcccgaauugcuucguagaucaagcgacgugccucagaggccaccucucucuucuccccc

SEQ ID NO: 260254 - RNA, 64 nt, Homo Sapiens
ucuguuugauuggauauucugcacagccccuggagccucagaaacccuccugggcccugggcug

SEQ ID NO: 260255 - RNA, 64 nt, Homo Sapiens
ucucccuucucaucuccccaaggagccucauccagccucagagagugagcaccaccagggcucc

SEQ ID NO: 260256 - RNA, 64 nt, Homo Sapiens
aaggguguuucugguuuugcuccaaggccccaaagccucagagaacagaggaaaugugucuccc

SEQ ID NO: 260257 - RNA, 64 nt, Homo Sapiens
cccugccuguggccccgccuuugagccagggcaggccucagacaaauucaaggacaaccugucu

SEQ ID NO: 260258 - RNA, 64 nt, Homo Sapiens
ugaucauuuuccccccacucuuuugauguuuguggccucagaauaggagacuagauugccuuug

SEQ ID NO: 260259 - RNA, 64 nt, Homo Sapiens
ucacaaaauuuccacaaaauccucaguucccuuggccucagaauacuucugugagacccccaca

SEQ ID NO: 260260 - RNA, 64 nt, Homo Sapiens
ccuauguccugagcccugacacucccacaccugagccucagauuccaauagcucacucccuaga

SEQ ID NO: 260261 - RNA, 64 nt, Homo Sapiens
ccuagagccugacgccggggccccugaccccugagccucagauuccaauaccucacuccccaga

SEQ ID NO: 260262 - RNA, 64 nt, Homo Sapiens
gcuuggcugcuguaucuuuauugggaucucugaggccucagagugaggcccuguuacuauuccu

SEQ ID NO: 260263 - RNA, 64 nt, Homo Sapiens
gacccuguugaggguccucacugcucugcgccgagccucagaagggugggaggcaggcagcugc

SEQ ID NO: 260264 - RNA, 64 nt, Homo Sapiens; identical to SEQ ID NO: 126810

SEQ ID NO: 260265 - RNA, 64 nt, Homo Sapiens; identical to SEQ ID NO: 126811

SEQ ID NO: 260266 - RNA, 64 nt, Homo Sapiens; identical to SEQ ID NO: 126812

SEQ ID NO: 260267 - RNA, 64 nt, Homo Sapiens; identical to SEQ ID NO: 126813

SEQ ID NO: 260268 - RNA, 64 nt, Homo Sapiens; identical to SEQ ID NO: 126814

SEQ ID NO: 260269 - RNA, 64 nt, Homo Sapiens; identical to SEQ ID NO: 126815

SEQ ID NO: 260270 - RNA, 64 nt, Homo Sapiens; identical to SEQ ID NO: 126816

SEQ ID NO: 260271 - RNA, 64 nt, Homo Sapiens; identical to SEQ ID NO: 126817

SEQ ID NO: 260272 - RNA, 64 nt, Homo Sapiens; identical to SEQ ID NO: 126818

SEQ ID NO: 260273 - RNA, 64 nt, Homo Sapiens; identical to SEQ ID NO: 126819

SEQ ID NO: 260274 - RNA, 64 nt, Homo Sapiens; identical to SEQ ID NO: 126820

SEQ ID NO: 260275 - RNA, 64 nt, Homo Sapiens; identical to SEQ ID NO: 126821

SEQ ID NO: 260276 - RNA, 64 nt, Homo Sapiens; identical to SEQ ID NO: 126822

SEQ ID NO: 260277 - RNA, 64 nt, Homo Sapiens; identical to SEQ ID NO: 126823

SEQ ID NO: 260278 - RNA, 64 nt, Homo Sapiens; identical to SEQ ID NO: 126824

SEQ ID NO: 260279 - RNA, 64 nt, Homo Sapiens; identical to SEQ ID NO: 126825

SEQ ID NO: 260280 - RNA, 64 nt, Homo Sapiens; identical to SEQ ID NO: 126826

SEQ ID NO: 260281 - RNA, 64 nt, Homo Sapiens; identical to SEQ ID NO: 126827

SEQ ID NO: 260282 - RNA, 64 nt, Homo Sapiens; identical to SEQ ID NO: 126828

SEQ ID NO: 260283 - RNA, 64 nt, Homo Sapiens
agcgcccugacaucccaaaacuugcugccuuguuuccugccaggcccagccgcagcaccaaggg

SEQ ID NO: 260284 - RNA, 64 nt, Homo Sapiens
gcuggaggccgccagguguuacauuuccccuccuuccugccaagcuauggugagacccuggcug

SEQ ID NO: 260285 - RNA, 64 nt, Homo Sapiens
aacuggucccugccugacagcaccugcugggccuuccugccaguggcccccaguuuuucuuccc

SEQ ID NO: 260286 - RNA, 64 nt, Homo Sapiens
gcccaggcagcggguguguggagauggcgcccuguccugccaaggggcgccaggagcagagcca

SEQ ID NO: 260287 - RNA, 64 nt, Homo Sapiens
ccgagucgucauccccggagucccuauacagagguccugccauggaaccuuccccuccccgugc

SEQ ID NO: 260288 - RNA, 64 nt, Homo Sapiens
ucgggaucuucaggacgccuggagaagggugguuuccugccacccugcuggccaaggaggcucc

SEQ ID NO: 260289 - RNA, 64 nt, Homo Sapiens
uggagcugucacccccggagucgccacacagacguccugccauggaaccuuccccucccggugc

SEQ ID NO: 260290 - RNA, 64 nt, Homo Sapiens
ugggugcaucaggacgccuuggagaagcguggcuuccugccacccugcaacccacccucccagc

SEQ ID NO: 260291 - RNA, 64 nt, Homo Sapiens
ggcuugcagauugaagcacuccccacaaaacucuuccugccacguugaccuuaaaaagacaaaa

SEQ ID NO: 260292 - RNA, 64 nt, Homo Sapiens
ggcguuuugaguguuggcaagaaagaggaguagcuccugccacugccagucgggaugacugggu

SEQ ID NO: 260293 - RNA, 64 nt, Homo Sapiens
aguccuugagugucaguuggugaggaccauggaguccugccagcucaaccugucauuuacagac

SEQ ID NO: 260294 - RNA, 64 nt, Homo Sapiens
auuuggcuucacagauggcuucucacagaugcccuccugccagccaaaccggacuuguucuucc

SEQ ID NO: 260295 - RNA, 64 nt, Homo Sapiens
aagagaaugaaugacagaaaacacagacgugacguccugccagacuacacaugaaggcccucuc

SEQ ID NO: 260296 - RNA, 64 nt, Homo Sapiens
guuggacacugaggacgcccacuuugaacugcaguccugccaacugauucacuuuuagcagcag

SEQ ID NO: 260297 - RNA, 64 nt, Homo Sapiens
gccuuaaccccucgcacagccauccccccccccguccugccauccccccccgccguccugccuu

SEQ ID NO: 260298 - RNA, 64 nt, Homo Sapiens
gagucugagaccuuugguuguucuuuaaggcaccuccugccacuuucucccucagaggcacaaa

SEQ ID NO: 260299 - RNA, 64 nt, Homo Sapiens
uuuacaacccaagaauuuuuaagugaaauuaaccuccugccaauauguagguaaaucuuuuuaa

SEQ ID NO: 260300 - RNA, 64 nt, Homo Sapiens
agcaauuguuugcucuugaaggggccuccucccauccugccaugcacuccucugaggcuuuccu

SEQ ID NO: 260301 - RNA, 64 nt, Homo Sapiens
ugagaaaaaggaaaaaaaaacagccaccguuucuuccugccagcaggggugugauguaccaguu

SEQ ID NO: 260302 - RNA, 64 nt, Homo Sapiens
gcugcugguguucuuauucuggcggcagcgccuuuccugccauguuuagugaaugacuuuucuc

SEQ ID NO: 260303 - RNA, 64 nt, Homo Sapiens
cacacacagccccuauagcacucucccagugaacuccugccagggucacgggguucccuccuag

SEQ ID NO: 260304 - RNA, 64 nt, Homo Sapiens
cucaaacgacagaggagcuuuuaaacggugcccauccugccauccuaccuuccugucccugagg

SEQ ID NO: 260305 - RNA, 64 nt, Homo Sapiens
gcuuuugccccuugacagguaugggccagcaguuuccugccagauauugcccagcgugaggagc

SEQ ID NO: 260306 - RNA, 64 nt, Homo Sapiens
uggugaaacuacaucuccaaugugcuuucuaaucuccugccagcucuucucaagcaggggaucc

SEQ ID NO: 260307 - RNA, 64 nt, Homo Sapiens
gaccccuggaggagaccuauacacucugcuuucuuccugccaugucuucuuccuucuuccugcc

SEQ ID NO: 260308 - RNA, 64 nt, Homo Sapiens
cucugcuuucuuccugccaucucuucuuccuucuuccugccacauggagaccaagcggccuuug

SEQ ID NO: 260309 - RNA, 64 nt, Homo Sapiens
ugcuggguggaccuaagguuuuauggauccugccuccugccacgacuccacaaaaacauuuaau

SEQ ID NO: 260310 - RNA, 59 nt, Homo Sapiens
cgccaugccguugcgaggcccuuccgucguccugccagucguccuggaggacugaguag

SEQ ID NO: 260311 - RNA, 64 nt, Homo Sapiens
cucuccgucuguucuguuuuucuccuagucccucuccugccaccucuccaagacuuccguggga

SEQ ID NO: 260312 - RNA, 64 nt, Homo Sapiens
uaccuacauguacuauuuagcuucaguguacuaguccugccaccuguguauuuuuagggugcua

SEQ ID NO: 260313 - RNA, 64 nt, Homo Sapiens
aggagcucagaaggccaggaauugugaauucugcuccugccaugacccuauaagagggcucaag

SEQ ID NO: 260314 - RNA, 64 nt, Homo Sapiens
aggaggcugcaacccuauaacugcccagggaugguccugccaugcauugaagcugcaggaagcc

SEQ ID NO: 260315 - RNA, 64 nt, Homo Sapiens
uggaacugcccuccagacagcccuuccuaugcuuuccugccacucuguuagcaggagcuauguc

SEQ ID NO: 260316 - RNA, 64 nt, Homo Sapiens
agcugagcuggguagccucuuguaaauaccuggcuccugccagcuucuuuacacacauuauggc

SEQ ID NO: 260317 - RNA, 64 nt, Homo Sapiens
ccauauggaauaagggcucguccuaccuaaagcuuccugccaauaaugcaagaagccagcugca

SEQ ID NO: 260318 - RNA, 64 nt, Homo Sapiens
cauccaccucauggaccaagauggcugccacagcuccugccaucacauuuacauuuaagauagu

SEQ ID NO: 260319 - RNA, 64 nt, Homo Sapiens
ggugggcaccccaugggacucaguggcucacauuuccugccagcuacaccacaggcagauggga

SEQ ID NO: 260320 - RNA, 64 nt, Homo Sapiens
agcccucacugcugacaggcaccccucugucaccuccugccaccugucagauacccagccugcc

SEQ ID NO: 260321 - RNA, 64 nt, Homo Sapiens
ccaugaucccgggauuggcugggacaaaggcccuuccugccagcacaagggaccaagggaauca

SEQ ID NO: 260322 - RNA, 64 nt, Homo Sapiens
aucuuuagagccaauaaagagccuacgaggcagcuccugccacuacugugcuccuuuuuucccg

SEQ ID NO: 260323 - RNA, 64 nt, Homo Sapiens
uguguguuugugugucuauuuggcaauucacaaguccugccaagugguuucuaugagcaucucu

SEQ ID NO: 260324 - RNA, 64 nt, Homo Sapiens
agaaaaaaauggugccuucuucugcguuugucccuccugccauguguaaguuguaaggauugcc

SEQ ID NO: 260325 - RNA, 64 nt, Homo Sapiens
ugcugcugcugcugcugcuauucccuccacuccuuccugccaccuccccaagacuugguguccu

SEQ ID NO: 260326 - RNA, 64 nt, Homo Sapiens
uggggcagucaccugcccaggauggguggggacguccugccaccacugacccugaucagucuaa

SEQ ID NO: 260327 - RNA, 64 nt, Homo Sapiens
uccuuucccauuucuuuuugguuggaauuucccauccugccaugucacacucauauuagcucau

SEQ ID NO: 260328 - RNA, 64 nt, Homo Sapiens
guuugcuguggauucagaagaaagggaagcauguuccugccaagucagagcaccucuggguggc

SEQ ID NO: 260329 - RNA, 64 nt, Homo Sapiens
ggagaauuugacauacccuggacuccugugugccuccugccaucccugcacacagccuggggag

SEQ ID NO: 260330 - RNA, 64 nt, Homo Sapiens
gcagaaggaaaguacuggacuacccguggguaaguccugccauucaagacuggagacaccuggg

SEQ ID NO: 260331 - RNA, 64 nt, Homo Sapiens
cagaucccaucucaagagcuugaaaagcaaccucuccugccaccggucccaggcagcuuuccuc

SEQ ID NO: 260332 - RNA, 64 nt, Homo Sapiens
acccccagcaccugcuagcaagccccgcgccuccuccugccagcccugggaggugucccacuga

SEQ ID NO: 260333 - RNA, 64 nt, Homo Sapiens
cagcugcucaugggcagagcagcccuugggcaacuccugccaccacccccuccccagggagccc

SEQ ID NO: 260334 - RNA, 64 nt, Homo Sapiens
gugcccccggcugggagaucagacccgguguugguccugccacccacgugcugugugagaggag

SEQ ID NO: 260335 - RNA, 64 nt, Homo Sapiens
agcccggcccugcccuuaaccgcagcugaccuucuccugccacugauccgcuccugccugcgcc

SEQ ID NO: 260336 - RNA, 64 nt, Homo Sapiens
cacgccugcgaggcguuggacacggccgggccccuccugccagccuacgucugagggcgcuggg

SEQ ID NO: 260337 - RNA, 64 nt, Homo Sapiens
cgacuguaacagaccaggaggguggcggaggaacuccugccacgccacugugucaugaaggaaa

SEQ ID NO: 260338 - RNA, 64 nt, Homo Sapiens
uuuagaagcaguucuggucucaaaaccaucaggauccugccaccaggguucuuuugaaauagua

SEQ ID NO: 260339 - RNA, 64 nt, Homo Sapiens
gugugugccaagcacugugcagaggguacacaguuccugccagguuaacacccucccuucaggc

SEQ ID NO: 260340 - RNA, 64 nt, Homo Sapiens
gagcccuaugcacauuggcuugugggcuuguucuuccugccaaaugaucagagaggaacauucc

SEQ ID NO: 260341 - RNA, 64 nt, Homo Sapiens
uacuucaagcucacuucuucgccccccaccccuauccugccauguuggggugccaggcagcgag

SEQ ID NO: 260342 - RNA, 64 nt, Homo Sapiens
guuuauagaaaccugagaaugcccucuccucucuuccugccaaggggcauacaauccaacccgc

SEQ ID NO: 260343 - RNA, 64 nt, Homo Sapiens
gugguagaucaaggcuuuguuucauuugaaaaaaaagaaagaaagaaagaaagaaagaaauccu

SEQ ID NO: 260344 - RNA, 64 nt, Homo Sapiens
uagaucaaggcuuuguuucauuugaaaaaaaagaaagaaagaaagaaagaaagaaauccuacua

SEQ ID NO: 260345 - RNA, 64 nt, Homo Sapiens
ucaaggcuuuguuucauuugaaaaaaaagaaagaaagaaagaaagaaagaaauccuacuacgag

SEQ ID NO: 260346 - RNA, 64 nt, Homo Sapiens
ggcuuuguuucauuugaaaaaaaagaaagaaagaaagaaagaaagaaauccuacuacgagcgau

SEQ ID NO: 260347 - RNA, 64 nt, Homo Sapiens
uuguuucauuugaaaaaaaagaaagaaagaaagaaagaaagaaauccuacuacgagcgaucaca

SEQ ID NO: 260348 - RNA, 64 nt, Homo Sapiens
gccuggguaacagagcaagacuccaucucaaaaaaagaaagaaagaaaaaagaaaguacaaguu

SEQ ID NO: 260349 - RNA, 64 nt, Homo Sapiens
ggguaacagagcaagacuccaucucaaaaaaagaaagaaagaaaaaagaaaguacaaguuuaua

SEQ ID NO: 260350 - RNA, 64 nt, Homo Sapiens
agaggaauuugacucagagaugaaagugacuuucaagaaagaucucagauguguugggacaaaa

SEQ ID NO: 260351 - RNA, 57 nt, Homo Sapiens
ggggcaaggaaaguaagaaguauuguuaagaaagaaagcgcuguuccucagguguaa

SEQ ID NO: 260352 - RNA, 64 nt, Homo Sapiens
acuguguuuuugccacugauccuugaaagaaagaaagaaagaagacuuaauugcuuuccugccu

SEQ ID NO: 260353 - RNA, 64 nt, Homo Sapiens
gaagacuguguuuuugccacgccuccuugaaagaaagaaagaaagaccacuuaauugcuuuccu

SEQ ID NO: 260354 - RNA, 64 nt, Homo Sapiens
gaaagaagacuguguuuuuguccugccuccuugaaagaaagaaaaggugaccacuuaauugcuu

SEQ ID NO: 260355 - RNA, 64 nt, Homo Sapiens
aaggacucugguuacccuugaugaccccaaucaaaagaaagaacccacacaucggaagggcugg

SEQ ID NO: 260356 - RNA, 64 nt, Homo Sapiens
cccagguguccugguguucuauuuaugacagacaaagaaagaagacuuaaagacaggagcuggc

SEQ ID NO: 260357 - RNA, 64 nt, Homo Sapiens
uauuaauaacugcugguggaaauaagccaauggaaagaaagaaauagaaaguuuaacugaaauu

SEQ ID NO: 260358 - RNA, 64 nt, Homo Sapiens
ccuaaauagaagcaaguuuacauagagauaaauuaagaaagauguaaagaaaguuauauaacua

SEQ ID NO: 260359 - RNA, 64 nt, Homo Sapiens
aaaguagcuggcgagguuaccuuaacuaucacugaagaaagaaauuuucugacacacugauggc

SEQ ID NO: 260360 - RNA, 64 nt, Homo Sapiens
uacauagauaguacuagguauuaauagauauguaaagaaagaaaucacaccauuaauaauggua

SEQ ID NO: 260361 - RNA, 64 nt, Homo Sapiens
aaaaaaggaaaaaaaaaaaauaugcaguaaaagaaagaaagaaaauuccagcaucuuaccuuca

SEQ ID NO: 260362 - RNA, 64 nt, Homo Sapiens
gaaaaaaaaaggaaaaaaaauucauaugcaguaaaagaaagaaacuacauuccagcaucuuacc

SEQ ID NO: 260363 - RNA, 64 nt, Homo Sapiens
guaauagcauuuaguugugugugcccaaagcuugaagaaagauuagagaaacuugagaaggcuu

SEQ ID NO: 260364 - RNA, 64 nt, Homo Sapiens
caaauaucuugcuuuugggugauuucagcaguauaagaaagaauuagauuaguggauuguuagg

SEQ ID NO: 260365 - RNA, 64 nt, Homo Sapiens
agaacaaauugguaauuugggcagaaaauuccaaaagaaagacuaagcacuucuuaacauugua

SEQ ID NO: 260366 - RNA, 64 nt, Homo Sapiens
guaugugacaauuaccugggaagcagaaguagagaagaaagacuaaagugacacaaagagaaug

SEQ ID NO: 260367 - RNA, 64 nt, Homo Sapiens
aacaaguguucagggcauaaauacaaaggaagaaaagaaagaaaguaacaauaaagaaaaaaaa

SEQ ID NO: 260368 - RNA, 64 nt, Homo Sapiens
aauuccuguuguguaaggguaggcuuuguugaaaaagaaagaaagauugaacuacaggugcaua

SEQ ID NO: 260369 - RNA, 64 nt, Homo Sapiens
ccuguuguguaaggguaggcuuuguugaaaaagaaagaaagauugaacuacaggugcauagcaa

SEQ ID NO: 260370 - RNA, 64 nt, Homo Sapiens
gaaagaauguaaagcaaccaaaaagaaaaaaaaaaagaaagaaagaggaaaagaaauccauacu

SEQ ID NO: 260371 - RNA, 64 nt, Homo Sapiens
gaauguaaagcaaccaaaaagaaaaaaaaaaagaaagaaagaggaaaagaaauccauacuaacc

SEQ ID NO: 260372 - RNA, 64 nt, Homo Sapiens
gguuuauuucagcaaacuuguugaauuuauuuuuaagaaagaaauacuguauugggaaguuacu

SEQ ID NO: 260373 - RNA, 64 nt, Homo Sapiens
aaagaccgagacuccgccucaaaaaaaaaaaaaaaagaaagaaagaaagaaagaaagaaaucua

SEQ ID NO: 260374 - RNA, 64 nt, Homo Sapiens
accgagacuccgccucaaaaaaaaaaaaaaaagaaagaaagaaagaaagaaagaaaucuaccug

SEQ ID NO: 260375 - RNA, 64 nt, Homo Sapiens
agacuccgccucaaaaaaaaaaaaaaaagaaagaaagaaagaaagaaagaaaucuaccugucaa

SEQ ID NO: 260376 - RNA, 64 nt, Homo Sapiens
uccgccucaaaaaaaaaaaaaaaagaaagaaagaaagaaagaaagaaaucuaccugucaaggaa

SEQ ID NO: 260377 - RNA, 64 nt, Homo Sapiens
ccucaaaaaaaaaaaaaaaagaaagaaagaaagaaagaaagaaaucuaccugucaaggaacuaa

SEQ ID NO: 260378 - RNA, 64 nt, Homo Sapiens
uaucuauuacucuugagagcuggcuguccuuugaaagaaagaaguaauguucuuugaaagaaag

SEQ ID NO: 260379 - RNA, 64 nt, Homo Sapiens
cuguccuuugaaagaaagaaguaauguucuuugaaagaaagaaaaaucucuugcugugucaaac

SEQ ID NO: 260380 - RNA, 64 nt, Homo Sapiens
uaaauccaguucuacuauggcugaguucuggucaaagaaagaaaguuuagaagcugagacacaa

SEQ ID NO: 260381 - RNA, 64 nt, Homo Sapiens
ucucaaacuaaaagacauuuguuauuuuggaaagaagaaagacucuauucucaaaguuuccuaa

SEQ ID NO: 260382 - RNA, 64 nt, Homo Sapiens
augggugguacauugaggagggccccauuuaaaaaagaaagaacaugugcagccaaaucugaga

SEQ ID NO: 260383 - RNA, 64 nt, Homo Sapiens
agauuguuacugugucugugguccauguggggaaaagaaagaucauaucuaugauaucgcauua

SEQ ID NO: 260384 - RNA, 64 nt, Homo Sapiens
aucuuugucugggacccccagaugacaaguuauaaagaaagaaguuccacccuuuaaaucuuag

SEQ ID NO: 260385 - RNA, 64 nt, Homo Sapiens
uggaugaaaaugugaaagccgaaaaaaaauaagaaagaaagaguacugcaacuguagguaaacu

SEQ ID NO: 260386 - RNA, 64 nt, Homo Sapiens
gaguuggaugaaaaugugaaaacugaaaaaaaauaagaaagaaaugguacugcaacuguaggua

SEQ ID NO: 260387 - RNA, 64 nt, Homo Sapiens
aaguguucacuuuuuuaauaaauguagaagagagaagaaagagguuuaaacaugauucuaguua

SEQ ID NO: 260388 - RNA, 64 nt, Homo Sapiens
agcugccacuuuuaaacaacauuaaaauggaauaaagaaagagcacuugaaucaauacucauug

SEQ ID NO: 260389 - RNA, 64 nt, Homo Sapiens
cucacggugggcggugggcaagaagccagcauggaagaaagaagggagaaaacuuuggugacug

SEQ ID NO: 260390 - RNA, 64 nt, Homo Sapiens
gacuaaguggaaaaauauaaaacauaugaauauaaagaaagaaagagacaagucaaauguagua

SEQ ID NO: 260391 - RNA, 64 nt, Homo Sapiens
aaguggaaaaauauaaaacauaugaauauaaagaaagaaagagacaagucaaauguaguaaaau

SEQ ID NO: 260392 - RNA, 64 nt, Homo Sapiens
cuggguacuguuacugugauguguauacuugaauaagaaagacauuuuaagucuuaaaaauagc

SEQ ID NO: 260393 - RNA, 64 nt, Homo Sapiens
agcauaaaacaaagacuacugacuuuggugguggaagaaagaaaugaauggugguuaggagaaa

SEQ ID NO: 260394 - RNA, 64 nt, Homo Sapiens
gaacuaauucuuuacaaaugaaacucgagcuacaaagaaagaauuaaaauguucuaagauaaaa

SEQ ID NO: 260395 - RNA, 64 nt, Homo Sapiens
gccacguauguugggguaauuuaaaaaaaaaucaaagaaagaagcauguaguccaaauuuguca

SEQ ID NO: 260396 - RNA, 64 nt, Homo Sapiens
aagccgcuaugaccggcguugccucucacuuugaaagaaagacuccguaaucuuaaacagaugc

SEQ ID NO: 260397 - RNA, 64 nt, Homo Sapiens
cuuauuguuuaguaaaauggcccuugguugugggaagaaagagaauuauuuuuaacugaacguu

SEQ ID NO: 260398 - RNA, 64 nt, Homo Sapiens
uagaauggaugauuccaaaaaaaaaaaaaaaaagaagaaagagagaaagaaagaaacagaaaaa

SEQ ID NO: 260399 - RNA, 64 nt, Homo Sapiens
uuccaaaaaaaaaaaaaaaaagaagaaagagagaaagaaagaaacagaaaaaccuaaaagaaag

SEQ ID NO: 260400 - RNA, 64 nt, Homo Sapiens
auauccagcucucuuguguuguaaagaaaggcacaagaaagaaaauauuuuuuauugcucuuua

SEQ ID NO: 260401 - RNA, 64 nt, Homo Sapiens
uuucuacuggcauucugauucacucuuauaucagaagaaagaagcuuagcaauauauucagugg

SEQ ID NO: 260402 - RNA, 64 nt, Homo Sapiens
uccccaccaccucaaccucuuagcgucauaugagaagaaagaaauaguaagaagucaccgacgg

SEQ ID NO: 260403 - RNA, 64 nt, Homo Sapiens
uuucaguggaaaaaucaauaccuagucagagcccaagaaagaauccuuuacuuagaauugucca

SEQ ID NO: 260404 - RNA, 64 nt, Homo Sapiens
acagucuuccauagauuuuucacacaaauuuaaaaagaaagaaacugcccucugcugccauaau

SEQ ID NO: 260405 - RNA, 64 nt, Homo Sapiens
ucccuguugugauugaacaauacaaauaacaaacaagaaagacaaugcauuccauuagucugcu

SEQ ID NO: 260406 - RNA, 64 nt, Homo Sapiens
acaaagauuauugacuauacaaccuaccagcugaaagaaagaucuucaucaacaucuguaucuu

SEQ ID NO: 260407 - RNA, 64 nt, Homo Sapiens
gugacuagcaaaacuccaucucaaaaaaaaaaaaaagaaagaaagaaacugaaaagugaggugu

SEQ ID NO: 260408 - RNA, 64 nt, Homo Sapiens
cuagcaaaacuccaucucaaaaaaaaaaaaaagaaagaaagaaacugaaaagugagguguggaa

SEQ ID NO: 260409 - RNA, 64 nt, Homo Sapiens
ucgagcccuggcugugaaaagaaucucaacauagaagaaagaagaaacaauaaauauucugcag

SEQ ID NO: 260410 - RNA, 64 nt, Homo Sapiens
agaaacaauaaauauucugcagauuaaugcagcaaagaaagaagguugguagugaaacacaaag

SEQ ID NO: 260411 - RNA, 64 nt, Homo Sapiens
aauagaacuccaagccuuuucuccacuacuauacaagaaagaauucagcaagcugcuucuccaa

SEQ ID NO: 260412 - RNA, 64 nt, Homo Sapiens
ucucuguagggacacuguguuaucaaccauuaagaagaaagaaccacaagccucccaaguauuu

SEQ ID NO: 260413 - RNA, 64 nt, Homo Sapiens
cuuaauagcccauuucuguuaaccucuuaucacuaagaaagaaaggaaagaaggagaugaauag

SEQ ID NO: 260414 - RNA, 64 nt, Homo Sapiens
cacuaagaaagaaaggaaagaaggagaugaauagaagaaagaaaauggaaagaaggaaaaaagg

SEQ ID NO: 260415 - RNA, 64 nt, Homo Sapiens
aaagaaggaaaaaaggaggauagaaaaaggauggaagaaagaagcauugaaaacaaagacauuc

SEQ ID NO: 260416 - RNA, 64 nt, Homo Sapiens
caacgaaaacaaaaugcacaagacuggcucaaaaaagaaagaagguuaaauuggccugcuccag

SEQ ID NO: 260417 - RNA, 64 nt, Homo Sapiens
acauuaguguauuucuccuggugaaaaaguaaagaagaaagauacuggaccauccugucuuaug

SEQ ID NO: 260418 - RNA, 64 nt, Homo Sapiens
gaaauuaccuuacuuaaggaucuguauaugggaaaagaaagagcaaaacagacuauguacauaa

SEQ ID NO: 260419 - RNA, 64 nt, Homo Sapiens
gugaaaagcuggggagaaaacauuacagccuuagaagaaagauuugccuauuaaggauguaaga

SEQ ID NO: 260420 - RNA, 64 nt, Homo Sapiens
aaagagaugccuuuuguguuucugcuuggugcauaagaaagagaacaagacaucagcuauauac

SEQ ID NO: 260421 - RNA, 64 nt, Homo Sapiens
aagacaagucuuggaguaccacuggaagaaaggcaagaaagaggcagggaguucauuuggccac

SEQ ID NO: 260422 - RNA, 64 nt, Homo Sapiens
uucuuuguugauuuuuuaagauagaaagauuaaaaagaaagaaagaugggaagaaaaugaaugu

SEQ ID NO: 260423 - RNA, 64 nt, Homo Sapiens
uuguugauuuuuuaagauagaaagauuaaaaagaaagaaagaugggaagaaaaugaaugucagu

SEQ ID NO: 260424 - RNA, 64 nt, Homo Sapiens
gaaaggccacuuaaggaucugcucuaugaaggagaagaaagaggaaaaagaaguaaaggaguua

SEQ ID NO: 260425 - RNA, 64 nt, Homo Sapiens
augccuguacacagaauucuaucgugaugcagagaagaaagaacggagugaagccauuuaugcc

SEQ ID NO: 260426 - RNA, 64 nt, Homo Sapiens
gcuguaguaucaguuuuugaaccacaguaaugggaagaaagacaaauggauucccuuagaagua

SEQ ID NO: 260427 - RNA, 64 nt, Homo Sapiens
gaaaaagagcuggugguuugagaaaaaaaaaagaaagaaagaggucguaaaaaaauagaaaaaa

SEQ ID NO: 260428 - RNA, 64 nt, Homo Sapiens
gagggaaaaagagcugguggaaaaagaaaaaaaaaagaaagaaaaggaucguaaaaaaauagaa

SEQ ID NO: 260429 - RNA, 64 nt, Homo Sapiens
agguacauguauauauuuguucucaaaaaaaagaaagaaagaaagggcaacgggcgagacucug

SEQ ID NO: 260430 - RNA, 64 nt, Homo Sapiens
gaaaagguacauguauauauucugucucaaaaaaaagaaagaaagccugggcaacgggcgagac

SEQ ID NO: 260431 - RNA, 64 nt, Homo Sapiens
aaaguauucugugguguauggugacuaaauaaaaaagaaagaaccucuguuguacugauguguu

SEQ ID NO: 260432 - RNA, 64 nt, Homo Sapiens
acuaguaaauugucugccucgaucagcuuuauccaagaaagaagaaagcguugacaaaucagau

SEQ ID NO: 260433 - RNA, 64 nt, Homo Sapiens
ugucaauuuguuguuauaggucuuaccugugugaaagaaagaaaaagaaagaaagaaagaaaga

SEQ ID NO: 260434 - RNA, 64 nt, Homo Sapiens
uuguuauaggucuuaccugugugaaagaaagaaaaagaaagaaagaaagaaagagaaaggaaau

SEQ ID NO: 260435 - RNA, 64 nt, Homo Sapiens
uauaggucuuaccugugugaaagaaagaaaaagaaagaaagaaagaaagagaaaggaaauuaua

SEQ ID NO: 260436 - RNA, 64 nt, Homo Sapiens
ggucuuaccugugugaaagaaagaaaaagaaagaaagaaagaaagagaaaggaaauuauaaggu

SEQ ID NO: 260437 - RNA, 64 nt, Homo Sapiens
uuaccugugugaaagaaagaaaaagaaagaaagaaagaaagagaaaggaaauuauaaggucaag

SEQ ID NO: 260438 - RNA, 64 nt, Homo Sapiens
acucaaauauuuugccucauuauucuuguuuuaaaagaaagaaaacaggccgggcacaguggcu

SEQ ID NO: 260439 - RNA, 64 nt, Homo Sapiens
ccagccugggugacagagggagacucugucucgaaagaaagaaagaaaaaaaggaaggaaggag

SEQ ID NO: 260440 - RNA, 64 nt, Homo Sapiens
ccugggugacagagggagacucugucucgaaagaaagaaagaaaaaaaggaaggaaggagaagg

SEQ ID NO: 260441 - RNA, 64 nt, Homo Sapiens
guaacucuaaaagauccuuuuuaaauucaguccuaagaaagaggagugcuuguccccuaagagu

SEQ ID NO: 260442 - RNA, 64 nt, Homo Sapiens
gaaucuaugccaaagaucacuuguuguuuuacuaaagaaagauuacuuagaggaaauaagaaaa

SEQ ID NO: 260443 - RNA, 64 nt, Homo Sapiens
agccaugacaaaccaaagagugcccaggucagccaagaaagauacauaaucucaugggacuuca

SEQ ID NO: 260444 - RNA, 64 nt, Homo Sapiens
gagcgagacucugucuccccccgcaaaaaaaaaaaagaaagaaagaaagagaaaagaaaagaaa

SEQ ID NO: 260445 - RNA, 64 nt, Homo Sapiens
gagacucugucuccccccgcaaaaaaaaaaaagaaagaaagaaagagaaaagaaaagaaaagca

SEQ ID NO: 260446 - RNA, 64 nt, Homo Sapiens
cucugucuccccccgcaaaaaaaaaaaagaaagaaagaaagagaaaagaaaagaaaagcaacca

SEQ ID NO: 260447 - RNA, 64 nt, Homo Sapiens
augaugauauucagacgaagcauugauguuauggaagaaagaaagaaacaaacaaaauauauau

SEQ ID NO: 260448 - RNA, 64 nt, Homo Sapiens
ugauauucagacgaagcauugauguuauggaagaaagaaagaaacaaacaaaauauauauauau

SEQ ID NO: 260449 - RNA, 64 nt, Homo Sapiens
aguuguugauuaaauuuucaucuuuugugauuauaagaaagaguuucacccaggcaggccauuu

SEQ ID NO: 260450 - RNA, 64 nt, Homo Sapiens
uuguugccauguuuugauuuagagccuguucucuaagaaagaaagauuuuuuaguacaggccca

SEQ ID NO: 260451 - RNA, 64 nt, Homo Sapiens
uaaaacuauaucugcacaugugauccagaucauaaagaaagaagacaagauaaagaaauaaaag

SEQ ID NO: 260452 - RNA, 64 nt, Homo Sapiens
cccuuuacauuuccauaaaacaaggcaacuccagaagaaagaagguugucucaaauccugucca

SEQ ID NO: 260453 - RNA, 64 nt, Homo Sapiens
cuguuuagugaugacccagcucucagaugcucagaagaaagaucagcccugauuuggaccagaa

SEQ ID NO: 260454 - RNA, 64 nt, Homo Sapiens
gaaagaggguauguuuuucaaaauuuuaaaaagaaagaaagaaggcaaaacuuugccucaaaac

SEQ ID NO: 260455 - RNA, 64 nt, Homo Sapiens
gaaggaaagaggguauguuuaaacaaauuuuaaaaagaaagaaacggagcaaaacuuugccuca

SEQ ID NO: 260456 - RNA, 64 nt, Homo Sapiens
ggguuucagaagugucaggggcagagaugaaagaaagaaagaguucucagucuuaggggacaug

SEQ ID NO: 260457 - RNA, 64 nt, Homo Sapiens
gaguggguuucagaaguguccauggcagagaugaaagaaagaaaugccucucagucuuagggga

SEQ ID NO: 260458 - RNA, 64 nt, Homo Sapiens
agagcaagacuccaucucaaaaauaaaauaaaaaaagaaagaaagaaaagaagaagaaaagaga

SEQ ID NO: 260459 - RNA, 64 nt, Homo Sapiens
caagacuccaucucaaaaauaaaauaaaaaaagaaagaaagaaaagaagaagaaaagagaagaa

SEQ ID NO: 260460 - RNA, 64 nt, Homo Sapiens
ggcagcagagagcuuuuugcacuuuaaaaaaaaaaagaaagaaagaaaggucggaauuucuuuu

SEQ ID NO: 260461 - RNA, 64 nt, Homo Sapiens
gcagagagcuuuuugcacuuuaaaaaaaaaaagaaagaaagaaaggucggaauuucuuuugggu

SEQ ID NO: 260462 - RNA, 64 nt, Homo Sapiens
ugaaauaauuuuccgaauaauucagguggaaaacaagaaagauuguauuucucugcuuucauuu

SEQ ID NO: 260463 - RNA, 64 nt, Homo Sapiens
uauuuguaaaucauguggcaucuauguauaauaaaagaaagagacaacuauauuacucaauuuc

SEQ ID NO: 260464 - RNA, 64 nt, Homo Sapiens
auguuucucaagcaaccugcaucuuuuaugagagaagaaagagugagagaagaauugccucugg

SEQ ID NO: 260465 - RNA, 64 nt, Homo Sapiens
ggcauuucagucugacguggauaaagaagaagauaagaaagagcgucaaaagcaguaccugaga

SEQ ID NO: 260466 - RNA, 64 nt, Homo Sapiens
aacacugaggcgcucgcuccgacugauccugaacaagaaagagucaacacuuguguugcuuucu

SEQ ID NO: 260467 - RNA, 64 nt, Homo Sapiens
cacucugcuggcgggaauacgaaacagaaaagagaagaaagaaguccagggacuguaccuguag

SEQ ID NO: 260468 - RNA, 64 nt, Homo Sapiens
caucuuuuuucuucccucauuuucugggauucucaagaaagaaaaaguaacccauuaucacucu

SEQ ID NO: 260469 - RNA, 64 nt, Homo Sapiens
acuaaagagcacuuuauuucuuugaagccuuucuaagaaagaaaugggggugcgaguggcuuga

SEQ ID NO: 260470 - RNA, 56 nt, Homo Sapiens
aggaagaaaacaaggacuaagcaaaaaagaaagacccccccccccuuagcaacucc

SEQ ID NO: 260471 - RNA, 64 nt, Homo Sapiens
aaaagagaaaaaaauaaaaaucaaaaaaaaaaaaaagaaagaaagaaaccuccagcguauuuua

SEQ ID NO: 260472 - RNA, 64 nt, Homo Sapiens
gagaaaaaaauaaaaaucaaaaaaaaaaaaaagaaagaaagaaaccuccagcguauuuuaucac

SEQ ID NO: 260473 - RNA, 64 nt, Homo Sapiens
acauagcaagacccugucuuaaaagaaaaaugggaagaaagacaagguaacaugaagaaagaag

SEQ ID NO: 260474 - RNA, 64 nt, Homo Sapiens
aaaagaaaaaugggaagaaagacaagguaacaugaagaaagaagagauaccuaguaugauggag

SEQ ID NO: 260475 - RNA, 64 nt, Homo Sapiens
aaaggcagaagcccuggauuaaaaagaaaaaagaaagaaagaaaaaccucugucucaaaaaaaa

SEQ ID NO: 260476 - RNA, 64 nt, Homo Sapiens
gaaaaaaggcagaagcccugaaaaaaaaagaaaaaagaaagaaaagcgaaccucugucucaaaa

SEQ ID NO: 260477 - RNA, 64 nt, Homo Sapiens
agaguuauucaugacuguucaaaaacuauuucuuaagaaagagcggguucuuacccaaagaguc

SEQ ID NO: 260478 - RNA, 64 nt, Homo Sapiens
aaguaugaauggucaaaaugauuaucuucuuagaaagaaagaaauuugcaaagcacucagcuca

SEQ ID NO: 260479 - RNA, 64 nt, Homo Sapiens
ggccuuucaagaaucaaacugugguaagccuucaaagaaagaaauuauggaggagguugugaug

SEQ ID NO: 260480 - RNA, 64 nt, Homo Sapiens
uuaacaggcacugauggggauugggcaauauuugaagaaagaauccucaggaaaagacuaguau

SEQ ID NO: 260481 - RNA, 64 nt, Homo Sapiens
guuacugccuuaauaaaaaaccuccgccuccaggaagaaagaauuagccucagaugauuucccc

SEQ ID NO: 260482 - RNA, 64 nt, Homo Sapiens
uuauuuuccagguacccuucaaaaucuagaggaaaagaaagaaguugauuuauuugcuucuucg

SEQ ID NO: 260483 - RNA, 64 nt, Homo Sapiens
uucuuuucuuuuguugauuuucuuguucccguagaagaaagaagaaagguguuuggagaauucg

SEQ ID NO: 260484 - RNA, 64 nt, Homo Sapiens
uacuuuucgagagaagggaauagggaagacagcaaagaaagauucagauuucuaacccugcaac

SEQ ID NO: 260485 - RNA, 64 nt, Homo Sapiens
caauaucuaauaccacagugggaaaaggaaagggaagaaagacuuuauucucucucuuauugua

SEQ ID NO: 260486 - RNA, 64 nt, Homo Sapiens
ugggggggugggggaggguguuguuggggcugagaagaaagagauuuauaugcuguauauaaau

SEQ ID NO: 260487 - RNA, 64 nt, Homo Sapiens
guauaugcaguauugagcacuguaggcaagagggaagaaagagaaggagccaucuccaucuuga

SEQ ID NO: 260488 - RNA, 64 nt, Homo Sapiens
uacauucuaaaauauaaucaaccaguagaaauuuaagaaagaagauguaaaaaaaaaaaauauu

SEQ ID NO: 260489 - RNA, 64 nt, Homo Sapiens
augaugaaaagaguaguucacuaagaaagaaaugaagaaagaaaucagguaaaaggugaucccu

SEQ ID NO: 260490 - RNA, 64 nt, Homo Sapiens
ugaagaaagaaaaugaugaaaaggugaucccucuaagaaagaaagguucgaaccuuucagguaa

SEQ ID NO: 260491 - RNA, 64 nt, Homo Sapiens
agaaggaguaaugagacaagcagaaaguccaggaaagaaagaccuugggaagcagauuaaguag

SEQ ID NO: 260492 - RNA, 64 nt, Homo Sapiens
gcccacuuucuaacagggugggaagguagagugaaagaaagaggaucugggcuucuuguggagg

SEQ ID NO: 260493 - RNA, 64 nt, Homo Sapiens
gccacaagggacugaggcaagcacaaugguuucaaagaaagacuguaagcuccaugauuagcau

SEQ ID NO: 260494 - RNA, 64 nt, Homo Sapiens
cuugggaaacugagguguuauuuucaaugaaacaaagaaagagauguuaagcaagugguuguuu

SEQ ID NO: 260495 - RNA, 64 nt, Homo Sapiens
gagaaauuugaaaggggguggguauggggggggcaagaaagagggagggaaaucuuucaacuua

SEQ ID NO: 260496 - RNA, 64 nt, Homo Sapiens
gcgaagauggccgagaugauccuaaaaauaaccgaagaaagagaggaccaaccagaauucccuu

SEQ ID NO: 260497 - RNA, 64 nt, Homo Sapiens
uuuccuccugccuuugcuuguucacugcagucuuaagaaagagguaaaaggcaagcaaaggaga

SEQ ID NO: 260498 - RNA, 64 nt, Homo Sapiens
aggaaacccaagagcugccuaaaaaaaaaaaagaaagaaagaaacagagcgagacuccgucuca

SEQ ID NO: 260499 - RNA, 64 nt, Homo Sapiens
gaaaaggaaacccaagagcucucaaaaaaaaaaaaagaaagaaagcaacagagcgagacuccgu

SEQ ID NO: 260500 - RNA, 64 nt, Homo Sapiens
ggcugccuuugcaaaaauccgagagagagaaagaaagaaagaaagaaagaaagaaagaaagaga

SEQ ID NO: 260501 - RNA, 64 nt, Homo Sapiens
gaaaggcugccuuugcaaaagagagagagagagaaagaaagaaauuuggaaagaaagaaagaaa

SEQ ID NO: 260502 - RNA, 64 nt, Homo Sapiens
gagagagagaaagaaagaaauuuggaaagaaagaaagaaagagaccauaaugaggaaaaaguua

SEQ ID NO: 260503 - RNA, 64 nt, Homo Sapiens
gagagagagagagaaagaaaguuauuuggaaagaaagaaagaaaagcaccauaaugaggaaaaa

SEQ ID NO: 260504 - RNA, 64 nt, Homo Sapiens
gaaagagagagagagagaaaaaaaguuauuuggaaagaaagaaacuaaagcaccauaaugagga

SEQ ID NO: 260505 - RNA, 64 nt, Homo Sapiens
aauuuccauuaaguagaauuaauucagggaugaaaagaaagaauaaugggagauuguuuucagg

SEQ ID NO: 260506 - RNA, 64 nt, Homo Sapiens
ccuguucuugaacagauacuauaaguaacuacaaaagaaagagacccuugguuucugaugauuu

SEQ ID NO: 260507 - RNA, 64 nt, Homo Sapiens
uucucucucucaaaaaaaaaaaaaaaaaaaaggaaagaaagaaagaaaagaaaagaaaauccuu

SEQ ID NO: 260508 - RNA, 64 nt, Homo Sapiens
cucucucaaaaaaaaaaaaaaaaaaaaggaaagaaagaaagaaaagaaaagaaaauccuuuuug

SEQ ID NO: 260509 - RNA, 64 nt, Homo Sapiens
uccagccugcgggacagagugagacccugucugaaagaaagagagaaagaaagaaagaaagaga

SEQ ID NO: 260510 - RNA, 64 nt, Homo Sapiens
gacagagugagacccugucugaaagaaagagagaaagaaagaaagaaagagagagaaagaaaga

SEQ ID NO: 260511 - RNA, 64 nt, Homo Sapiens
gagugagacccugucugaaagaaagagagaaagaaagaaagaaagagagagaaagaaagaaaga

SEQ ID NO: 260512 - RNA, 64 nt, Homo Sapiens
gagacccugucugaaagaaagagagaaagaaagaaagaaagagagagaaagaaagaaagaaaga

SEQ ID NO: 260513 - RNA, 64 nt, Homo Sapiens
aagaaagagagaaagaaagaaagaaagagagagaaagaaagaaagaaagaaagggaaagaugga

SEQ ID NO: 260514 - RNA, 64 nt, Homo Sapiens
aagagagaaagaaagaaagaaagagagagaaagaaagaaagaaagaaagggaaagauggaagga

SEQ ID NO: 260515 - RNA, 64 nt, Homo Sapiens
gagaaagaaagaaagaaagagagagaaagaaagaaagaaagaaagggaaagauggaaggaagga

SEQ ID NO: 260516 - RNA, 64 nt, Homo Sapiens
gaaagaaagggaaagauggaaggaaggaaggaaaaagaaagagaaagagagagagagagaaaga

SEQ ID NO: 260517 - RNA, 64 nt, Homo Sapiens
aaaagaaagagaaagagagagagagagaaagaaaaagaaagaaaaguaagaaagaaaaaagaaa

SEQ ID NO: 260518 - RNA, 64 nt, Homo Sapiens
agagagagagagagaaagaaaaagaaagaaaaguaagaaagaaaaaagaaaaagaaagaaaagu

SEQ ID NO: 260519 - RNA, 64 nt, Homo Sapiens
gaaaaagaaagaaaaguaagaaagaaaaaagaaaaagaaagaaaaguaagaaagaaaaaaagaa

SEQ ID NO: 260520 - RNA, 64 nt, Homo Sapiens
aaguguaucugaacucucaguugaagagauggauaagaaagauccaucauaaaugcaacuuuuu

SEQ ID NO: 260521 - RNA, 64 nt, Homo Sapiens
uucaacuugaacguccaaauaauugcucugaagaaagaaagacaaaacucaagcgauuacagac

SEQ ID NO: 260522 - RNA, 64 nt, Homo Sapiens
gacauucaacuugaacguccagacaauugcucugaagaaagaaaauugaaacucaagcgauuac

SEQ ID NO: 260523 - RNA, 64 nt, Homo Sapiens
ugcuacaaaaaaaaaaagaaucaguauuucuaucaagaaagagauggucauauccaacccucau

SEQ ID NO: 260524 - RNA, 64 nt, Homo Sapiens
guauuaaguuaacgauaaucaccaaauucuuccuaagaaagaucaacuacaauagaauacuguu

SEQ ID NO: 260525 - RNA, 64 nt, Homo Sapiens
uuuuccgagaaaaaaagaaaauuccccacuuggaaagaaagaggaggaacacuggauucuuacu

SEQ ID NO: 260526 - RNA, 64 nt, Homo Sapiens
guggggggcccuaauggagagguguggguuuggcaagaaagaagcaacacagaugucgucccca

SEQ ID NO: 260527 - RNA, 64 nt, Homo Sapiens
aacaugcucauccuuugagucaaugugccgaagaaagaaagaaaauggagccgccacacccagc

SEQ ID NO: 260528 - RNA, 64 nt, Homo Sapiens
gaaaaacaugcucauccuuucagccaaugugccgaagaaagaaaaggcauggagccgccacacc

SEQ ID NO: 260529 - RNA, 64 nt, Homo Sapiens
agcagcagagcgggaccucgucucuaagaauagaaagaaagaaagagaaacgguguccuccgca

SEQ ID NO: 260530 - RNA, 64 nt, Homo Sapiens
gcagagcgggaccucgucucuaagaauagaaagaaagaaagagaaacgguguccuccgcacagc

SEQ ID NO: 260531 - RNA, 64 nt, Homo Sapiens
aauuuugcuucucuuucuaaaaaaaaaaaaaaaaaagaaagagaagaaagaagugauuccuacc

SEQ ID NO: 260532 - RNA, 64 nt, Homo Sapiens
ucucuuucuaaaaaaaaaaaaaaaaaagaaagagaagaaagaagugauuccuacccccuaccuc

SEQ ID NO: 260533 - RNA, 64 nt, Homo Sapiens
uaaaauuguauguuaaugcuggaaagaaaaaaagaagaaagaaagaaaccaucccuguccuuca

SEQ ID NO: 260534 - RNA, 64 nt, Homo Sapiens
auuguauguuaaugcuggaaagaaaaaaagaagaaagaaagaaaccaucccuguccuucaguuu

SEQ ID NO: 260535 - RNA, 64 nt, Homo Sapiens
ugaguucucaacugagugagcaucauggagggagaagaaagaaagaaguucagccugggugugu

SEQ ID NO: 260536 - RNA, 64 nt, Homo Sapiens
uucucaacugagugagcaucauggagggagaagaaagaaagaaguucagccugggugugugaag

SEQ ID NO: 260537 - RNA, 64 nt, Homo Sapiens
gcaaauugauucaaauguuaguuuguaaguaaguaagaaagaagcugcgaguaguuccacacag

SEQ ID NO: 260538 - RNA, 64 nt, Homo Sapiens
guaaacuaaagugugcuuuauuauaacaguuauaaagaaagauuauuuuggguuguuuaaaaau

SEQ ID NO: 260539 - RNA, 64 nt, Homo Sapiens
uugauagaauucaaaaaggcaaaaauaauuguugaagaaagaaggaaacugaauccauguaaga

SEQ ID NO: 260540 - RNA, 64 nt, Homo Sapiens
agggaauugcuuaguaggagaguuauucaagugaaagaaagagacccaggguuuuuaucuagaa

SEQ ID NO: 260541 - RNA, 64 nt, Homo Sapiens
aggaguaagggggauuuagauccagccagaaagaaagaaagacaugguugcauguaaaauuccu

SEQ ID NO: 260542 - RNA, 64 nt, Homo Sapiens
gacaaggaguaagggggauuuccuuccagccagaaagaaagaaauaacugguugcauguaaaau

SEQ ID NO: 260543 - RNA, 64 nt, Homo Sapiens; identical to SEQ ID NO: 142269

SEQ ID NO: 260544 - RNA, 64 nt, Homo Sapiens; identical to SEQ ID NO: 142270

SEQ ID NO: 260545 - RNA, 64 nt, Homo Sapiens; identical to SEQ ID NO: 142271

SEQ ID NO: 260546 - RNA, 64 nt, Homo Sapiens; identical to SEQ ID NO: 142272

SEQ ID NO: 260547 - RNA, 64 nt, Homo Sapiens; identical to SEQ ID NO: 142273

SEQ ID NO: 260548 - RNA, 64 nt, Homo Sapiens; identical to SEQ ID NO: 142274

SEQ ID NO: 260549 - RNA, 64 nt, Homo Sapiens; identical to SEQ ID NO: 142275

SEQ ID NO: 260550 - RNA, 64 nt, Homo Sapiens; identical to SEQ ID NO: 142276

SEQ ID NO: 260551 - RNA, 64 nt, Homo Sapiens; identical to SEQ ID NO: 142277

SEQ ID NO: 260552 - RNA, 64 nt, Homo Sapiens; identical to SEQ ID NO: 142278

SEQ ID NO: 260553 - RNA, 64 nt, Homo Sapiens; identical to SEQ ID NO: 142279

SEQ ID NO: 260554 - RNA, 64 nt, Homo Sapiens; identical to SEQ ID NO: 142280

SEQ ID NO: 260555 - RNA, 64 nt, Homo Sapiens; identical to SEQ ID NO: 142281

SEQ ID NO: 260556 - RNA, 64 nt, Homo Sapiens; identical to SEQ ID NO: 142282

SEQ ID NO: 260557 - RNA, 64 nt, Homo Sapiens; identical to SEQ ID NO: 142283

SEQ ID NO: 260558 - RNA, 64 nt, Homo Sapiens; identical to SEQ ID NO: 142284

SEQ ID NO: 260559 - RNA, 64 nt, Homo Sapiens; identical to SEQ ID NO: 142285

SEQ ID NO: 260560 - RNA, 64 nt, Homo Sapiens; identical to SEQ ID NO: 142286

SEQ ID NO: 260561 - RNA, 64 nt, Homo Sapiens; identical to SEQ ID NO: 142287

SEQ ID NO: 260562 - RNA, 64 nt, Homo Sapiens; identical to SEQ ID NO: 142288

SEQ ID NO: 260563 - RNA, 64 nt, Homo Sapiens; identical to SEQ ID NO: 142289

SEQ ID NO: 260564 - RNA, 64 nt, Homo Sapiens; identical to SEQ ID NO: 142290

SEQ ID NO: 260565 - RNA, 64 nt, Homo Sapiens; identical to SEQ ID NO: 142291

SEQ ID NO: 260566 - RNA, 64 nt, Homo Sapiens; identical to SEQ ID NO: 142292

SEQ ID NO: 260567 - RNA, 64 nt, Homo Sapiens; identical to SEQ ID NO: 142293

SEQ ID NO: 260568 - RNA, 64 nt, Homo Sapiens; identical to SEQ ID NO: 142294

SEQ ID NO: 260569 - RNA, 64 nt, Homo Sapiens; identical to SEQ ID NO: 142295

SEQ ID NO: 260570 - RNA, 64 nt, Homo Sapiens; identical to SEQ ID NO: 142296

SEQ ID NO: 260571 - RNA, 64 nt, Homo Sapiens; identical to SEQ ID NO: 142297

SEQ ID NO: 260572 - RNA, 64 nt, Homo Sapiens; identical to SEQ ID NO: 142298

SEQ ID NO: 260573 - RNA, 64 nt, Homo Sapiens; identical to SEQ ID NO: 142299

SEQ ID NO: 260574 - RNA, 64 nt, Homo Sapiens; identical to SEQ ID NO: 142300

SEQ ID NO: 260575 - RNA, 64 nt, Homo Sapiens; identical to SEQ ID NO: 142301

SEQ ID NO: 260576 - RNA, 64 nt, Homo Sapiens; identical to SEQ ID NO: 142302

SEQ ID NO: 260577 - RNA, 64 nt, Homo Sapiens; identical to SEQ ID NO: 142303

SEQ ID NO: 260578 - RNA, 64 nt, Homo Sapiens; identical to SEQ ID NO: 142304

SEQ ID NO: 260579 - RNA, 64 nt, Homo Sapiens; identical to SEQ ID NO: 142305

SEQ ID NO: 260580 - RNA, 64 nt, Homo Sapiens; identical to SEQ ID NO: 142306

SEQ ID NO: 260581 - RNA, 64 nt, Homo Sapiens; identical to SEQ ID NO: 142307

SEQ ID NO: 260582 - RNA, 64 nt, Homo Sapiens; identical to SEQ ID NO: 142308

SEQ ID NO: 260583 - RNA, 64 nt, Homo Sapiens; identical to SEQ ID NO: 142309

SEQ ID NO: 260584 - RNA, 64 nt, Homo Sapiens; identical to SEQ ID NO: 142310

SEQ ID NO: 260585 - RNA, 64 nt, Homo Sapiens; identical to SEQ ID NO: 142311

SEQ ID NO: 260586 - RNA, 64 nt, Homo Sapiens; identical to SEQ ID NO: 142312

SEQ ID NO: 260587 - RNA, 64 nt, Homo Sapiens; identical to SEQ ID NO: 142313

SEQ ID NO: 260588 - RNA, 64 nt, Homo Sapiens; identical to SEQ ID NO: 142314

SEQ ID NO: 260589 - RNA, 64 nt, Homo Sapiens; identical to SEQ ID NO: 142315

SEQ ID NO: 260590 - RNA, 64 nt, Homo Sapiens; identical to SEQ ID NO: 142316

SEQ ID NO: 260591 - RNA, 64 nt, Homo Sapiens; identical to SEQ ID NO: 142317

SEQ ID NO: 260592 - RNA, 64 nt, Homo Sapiens; identical to SEQ ID NO: 142318

SEQ ID NO: 260593 - RNA, 64 nt, Homo Sapiens; identical to SEQ ID NO: 142319

SEQ ID NO: 260594 - RNA, 64 nt, Homo Sapiens; identical to SEQ ID NO: 142320

SEQ ID NO: 260595 - RNA, 64 nt, Homo Sapiens; identical to SEQ ID NO: 142321

SEQ ID NO: 260596 - RNA, 64 nt, Homo Sapiens; identical to SEQ ID NO: 142322

SEQ ID NO: 260597 - RNA, 64 nt, Homo Sapiens; identical to SEQ ID NO: 142323

SEQ ID NO: 260598 - RNA, 64 nt, Homo Sapiens; identical to SEQ ID NO: 142324

SEQ ID NO: 260599 - RNA, 64 nt, Homo Sapiens; identical to SEQ ID NO: 142325

SEQ ID NO: 260600 - RNA, 64 nt, Homo Sapiens; identical to SEQ ID NO: 142326

SEQ ID NO: 260601 - RNA, 64 nt, Homo Sapiens; identical to SEQ ID NO: 142327

SEQ ID NO: 260602 - RNA, 64 nt, Homo Sapiens; identical to SEQ ID NO: 142328

SEQ ID NO: 260603 - RNA, 64 nt, Homo Sapiens; identical to SEQ ID NO: 142329

SEQ ID NO: 260604 - RNA, 64 nt, Homo Sapiens; identical to SEQ ID NO: 142330

SEQ ID NO: 260605 - RNA, 64 nt, Homo Sapiens; identical to SEQ ID NO: 142331

SEQ ID NO: 260606 - RNA, 64 nt, Homo Sapiens; identical to SEQ ID NO: 142332

SEQ ID NO: 260607 - RNA, 64 nt, Homo Sapiens; identical to SEQ ID NO: 142333

SEQ ID NO: 260608 - RNA, 64 nt, Homo Sapiens; identical to SEQ ID NO: 142334

SEQ ID NO: 260609 - RNA, 64 nt, Homo Sapiens; identical to SEQ ID NO: 142335

SEQ ID NO: 260610 - RNA, 64 nt, Homo Sapiens; identical to SEQ ID NO: 142336

SEQ ID NO: 260611 - RNA, 64 nt, Homo Sapiens; identical to SEQ ID NO: 142337

SEQ ID NO: 260612 - RNA, 64 nt, Homo Sapiens; identical to SEQ ID NO: 142338

SEQ ID NO: 260613 - RNA, 64 nt, Homo Sapiens; identical to SEQ ID NO: 142339

SEQ ID NO: 260614 - RNA, 64 nt, Homo Sapiens; identical to SEQ ID NO: 142340

SEQ ID NO: 260615 - RNA, 64 nt, Homo Sapiens; identical to SEQ ID NO: 142341

SEQ ID NO: 260616 - RNA, 64 nt, Homo Sapiens; identical to SEQ ID NO: 142342

SEQ ID NO: 260617 - RNA, 64 nt, Homo Sapiens; identical to SEQ ID NO: 142343

SEQ ID NO: 260618 - RNA, 64 nt, Homo Sapiens; identical to SEQ ID NO: 142344

SEQ ID NO: 260619 - RNA, 64 nt, Homo Sapiens; identical to SEQ ID NO: 142345

SEQ ID NO: 260620 - RNA, 64 nt, Homo Sapiens; identical to SEQ ID NO: 142346

SEQ ID NO: 260621 - RNA, 64 nt, Homo Sapiens; identical to SEQ ID NO: 142347

SEQ ID NO: 260622 - RNA, 64 nt, Homo Sapiens; identical to SEQ ID NO: 142348

SEQ ID NO: 260623 - RNA, 64 nt, Homo Sapiens; identical to SEQ ID NO: 142349

SEQ ID NO: 260624 - RNA, 64 nt, Homo Sapiens; identical to SEQ ID NO: 142350

SEQ ID NO: 260625 - RNA, 64 nt, Homo Sapiens; identical to SEQ ID NO: 142351

SEQ ID NO: 260626 - RNA, 64 nt, Homo Sapiens; identical to SEQ ID NO: 142352

SEQ ID NO: 260627 - RNA, 64 nt, Homo Sapiens; identical to SEQ ID NO: 142353

SEQ ID NO: 260628 - RNA, 64 nt, Homo Sapiens; identical to SEQ ID NO: 142354

SEQ ID NO: 260629 - RNA, 64 nt, Homo Sapiens; identical to SEQ ID NO: 142355

SEQ ID NO: 260630 - RNA, 64 nt, Homo Sapiens; identical to SEQ ID NO: 142356

SEQ ID NO: 260631 - RNA, 64 nt, Homo Sapiens; identical to SEQ ID NO: 142357

SEQ ID NO: 260632 - RNA, 64 nt, Homo Sapiens; identical to SEQ ID NO: 142358

SEQ ID NO: 260633 - RNA, 64 nt, Homo Sapiens; identical to SEQ ID NO: 142359

SEQ ID NO: 260634 - RNA, 64 nt, Homo Sapiens; identical to SEQ ID NO: 142360

SEQ ID NO: 260635 - RNA, 64 nt, Homo Sapiens; identical to SEQ ID NO: 142361

SEQ ID NO: 260636 - RNA, 64 nt, Homo Sapiens; identical to SEQ ID NO: 142362

SEQ ID NO: 260637 - RNA, 64 nt, Homo Sapiens; identical to SEQ ID NO: 142363

SEQ ID NO: 260638 - RNA, 64 nt, Homo Sapiens; identical to SEQ ID NO: 142364

SEQ ID NO: 260639 - RNA, 64 nt, Homo Sapiens; identical to SEQ ID NO: 142365

SEQ ID NO: 260640 - RNA, 64 nt, Homo Sapiens; identical to SEQ ID NO: 142366

SEQ ID NO: 260641 - RNA, 64 nt, Homo Sapiens; identical to SEQ ID NO: 142367

SEQ ID NO: 260642 - RNA, 64 nt, Homo Sapiens; identical to SEQ ID NO: 142368

SEQ ID NO: 260643 - RNA, 64 nt, Homo Sapiens; identical to SEQ ID NO: 142369

SEQ ID NO: 260644 - RNA, 64 nt, Homo Sapiens; identical to SEQ ID NO: 142370

SEQ ID NO: 260645 - RNA, 64 nt, Homo Sapiens; identical to SEQ ID NO: 142371

SEQ ID NO: 260646 - RNA, 64 nt, Homo Sapiens; identical to SEQ ID NO: 142372

SEQ ID NO: 260647 - RNA, 64 nt, Homo Sapiens; identical to SEQ ID NO: 142373

SEQ ID NO: 260648 - RNA, 64 nt, Homo Sapiens; identical to SEQ ID NO: 142374

SEQ ID NO: 260649 - RNA, 64 nt, Homo Sapiens; identical to SEQ ID NO: 142375

SEQ ID NO: 260650 - RNA, 64 nt, Homo Sapiens; identical to SEQ ID NO: 142376

SEQ ID NO: 260651 - RNA, 64 nt, Homo Sapiens; identical to SEQ ID NO: 142377

SEQ ID NO: 260652 - RNA, 64 nt, Homo Sapiens; identical to SEQ ID NO: 142378

SEQ ID NO: 260653 - RNA, 64 nt, Homo Sapiens; identical to SEQ ID NO: 142379

SEQ ID NO: 260654 - RNA, 64 nt, Homo Sapiens; identical to SEQ ID NO: 142380

SEQ ID NO: 260655 - RNA, 64 nt, Homo Sapiens; identical to SEQ ID NO: 142381

SEQ ID NO: 260656 - RNA, 64 nt, Homo Sapiens; identical to SEQ ID NO: 142382

SEQ ID NO: 260657 - RNA, 64 nt, Homo Sapiens; identical to SEQ ID NO: 142383

SEQ ID NO: 260658 - RNA, 64 nt, Homo Sapiens; identical to SEQ ID NO: 142384

SEQ ID NO: 260659 - RNA, 64 nt, Homo Sapiens; identical to SEQ ID NO: 142385

SEQ ID NO: 260660 - RNA, 64 nt, Homo Sapiens; identical to SEQ ID NO: 142386

SEQ ID NO: 260661 - RNA, 64 nt, Homo Sapiens; identical to SEQ ID NO: 142387

SEQ ID NO: 260662 - RNA, 64 nt, Homo Sapiens; identical to SEQ ID NO: 142388

SEQ ID NO: 260663 - RNA, 64 nt, Homo Sapiens; identical to SEQ ID NO: 142389

SEQ ID NO: 260664 - RNA, 64 nt, Homo Sapiens; identical to SEQ ID NO: 142390

SEQ ID NO: 260665 - RNA, 64 nt, Homo Sapiens; identical to SEQ ID NO: 142391

SEQ ID NO: 260666 - RNA, 64 nt, Homo Sapiens; identical to SEQ ID NO: 142392

SEQ ID NO: 260667 - RNA, 64 nt, Homo Sapiens; identical to SEQ ID NO: 142393

SEQ ID NO: 260668 - RNA, 64 nt, Homo Sapiens; identical to SEQ ID NO: 142394

SEQ ID NO: 260669 - RNA, 61 nt, Homo Sapiens; identical to SEQ ID NO: 142395

SEQ ID NO: 260670 - RNA, 64 nt, Homo Sapiens; identical to SEQ ID NO: 142396

SEQ ID NO: 260671 - RNA, 64 nt, Homo Sapiens; identical to SEQ ID NO: 142397

SEQ ID NO: 260672 - RNA, 64 nt, Homo Sapiens; identical to SEQ ID NO: 142398

SEQ ID NO: 260673 - RNA, 64 nt, Homo Sapiens; identical to SEQ ID NO: 142399

SEQ ID NO: 260674 - RNA, 64 nt, Homo Sapiens; identical to SEQ ID NO: 142400

SEQ ID NO: 260675 - RNA, 64 nt, Homo Sapiens; identical to SEQ ID NO: 142401

SEQ ID NO: 260676 - RNA, 64 nt, Homo Sapiens; identical to SEQ ID NO: 142402

SEQ ID NO: 260677 - RNA, 64 nt, Homo Sapiens; identical to SEQ ID NO: 142403

SEQ ID NO: 260678 - RNA, 64 nt, Homo Sapiens; identical to SEQ ID NO: 142404

SEQ ID NO: 260679 - RNA, 64 nt, Homo Sapiens; identical to SEQ ID NO: 142405

SEQ ID NO: 260680 - RNA, 64 nt, Homo Sapiens; identical to SEQ ID NO: 142406

SEQ ID NO: 260681 - RNA, 64 nt, Homo Sapiens; identical to SEQ ID NO: 142407

SEQ ID NO: 260682 - RNA, 64 nt, Homo Sapiens; identical to SEQ ID NO: 142408

SEQ ID NO: 260683 - RNA, 64 nt, Homo Sapiens; identical to SEQ ID NO: 142409

SEQ ID NO: 260684 - RNA, 64 nt, Homo Sapiens; identical to SEQ ID NO: 142410

SEQ ID NO: 260685 - RNA, 64 nt, Homo Sapiens; identical to SEQ ID NO: 142411

SEQ ID NO: 260686 - RNA, 64 nt, Homo Sapiens; identical to SEQ ID NO: 142412

SEQ ID NO: 260687 - RNA, 64 nt, Homo Sapiens; identical to SEQ ID NO: 142413

SEQ ID NO: 260688 - RNA, 64 nt, Homo Sapiens; identical to SEQ ID NO: 142414

SEQ ID NO: 260689 - RNA, 64 nt, Homo Sapiens; identical to SEQ ID NO: 142415

SEQ ID NO: 260690 - RNA, 64 nt, Homo Sapiens; identical to SEQ ID NO: 142416

SEQ ID NO: 260691 - RNA, 64 nt, Homo Sapiens; identical to SEQ ID NO: 142417

SEQ ID NO: 260692 - RNA, 64 nt, Homo Sapiens; identical to SEQ ID NO: 142418

SEQ ID NO: 260693 - RNA, 64 nt, Homo Sapiens; identical to SEQ ID NO: 142419

SEQ ID NO: 260694 - RNA, 64 nt, Homo Sapiens; identical to SEQ ID NO: 142420

SEQ ID NO: 260695 - RNA, 64 nt, Homo Sapiens; identical to SEQ ID NO: 142421

SEQ ID NO: 260696 - RNA, 64 nt, Homo Sapiens; identical to SEQ ID NO: 142422

SEQ ID NO: 260697 - RNA, 64 nt, Homo Sapiens; identical to SEQ ID NO: 142423

SEQ ID NO: 260698 - RNA, 64 nt, Homo Sapiens; identical to SEQ ID NO: 142424

SEQ ID NO: 260699 - RNA, 64 nt, Homo Sapiens; identical to SEQ ID NO: 142425

SEQ ID NO: 260700 - RNA, 64 nt, Homo Sapiens; identical to SEQ ID NO: 142426

SEQ ID NO: 260701 - RNA, 64 nt, Homo Sapiens; identical to SEQ ID NO: 142427

SEQ ID NO: 260702 - RNA, 64 nt, Homo Sapiens; identical to SEQ ID NO: 142428

SEQ ID NO: 260703 - RNA, 64 nt, Homo Sapiens; identical to SEQ ID NO: 142429

SEQ ID NO: 260704 - RNA, 64 nt, Homo Sapiens; identical to SEQ ID NO: 142430

SEQ ID NO: 260705 - RNA, 64 nt, Homo Sapiens; identical to SEQ ID NO: 142431

SEQ ID NO: 260706 - RNA, 64 nt, Homo Sapiens; identical to SEQ ID NO: 142432

SEQ ID NO: 260707 - RNA, 64 nt, Homo Sapiens; identical to SEQ ID NO: 142433

SEQ ID NO: 260708 - RNA, 64 nt, Homo Sapiens; identical to SEQ ID NO: 142434

SEQ ID NO: 260709 - RNA, 64 nt, Homo Sapiens; identical to SEQ ID NO: 142435

SEQ ID NO: 260710 - RNA, 64 nt, Homo Sapiens; identical to SEQ ID NO: 142436

SEQ ID NO: 260711 - RNA, 64 nt, Homo Sapiens; identical to SEQ ID NO: 142437

SEQ ID NO: 260712 - RNA, 64 nt, Homo Sapiens; identical to SEQ ID NO: 142438

SEQ ID NO: 260713 - RNA, 64 nt, Homo Sapiens; identical to SEQ ID NO: 142439

SEQ ID NO: 260714 - RNA, 64 nt, Homo Sapiens; identical to SEQ ID NO: 142440

SEQ ID NO: 260715 - RNA, 64 nt, Homo Sapiens; identical to SEQ ID NO: 142441

SEQ ID NO: 260716 - RNA, 64 nt, Homo Sapiens; identical to SEQ ID NO: 142442

SEQ ID NO: 260717 - RNA, 64 nt, Homo Sapiens; identical to SEQ ID NO: 142443

SEQ ID NO: 260718 - RNA, 64 nt, Homo Sapiens; identical to SEQ ID NO: 142444

SEQ ID NO: 260719 - RNA, 64 nt, Homo Sapiens; identical to SEQ ID NO: 142445

SEQ ID NO: 260720 - RNA, 64 nt, Homo Sapiens; identical to SEQ ID NO: 142446

SEQ ID NO: 260721 - RNA, 56 nt, Homo Sapiens; identical to SEQ ID NO: 142447

SEQ ID NO: 260722 - RNA, 64 nt, Homo Sapiens; identical to SEQ ID NO: 142448

SEQ ID NO: 260723 - RNA, 64 nt, Homo Sapiens; identical to SEQ ID NO: 142449

SEQ ID NO: 260724 - RNA, 64 nt, Homo Sapiens; identical to SEQ ID NO: 142450

SEQ ID NO: 260725 - RNA, 64 nt, Homo Sapiens; identical to SEQ ID NO: 142451

SEQ ID NO: 260726 - RNA, 64 nt, Homo Sapiens; identical to SEQ ID NO: 142452

SEQ ID NO: 260727 - RNA, 64 nt, Homo Sapiens; identical to SEQ ID NO: 142453

SEQ ID NO: 260728 - RNA, 64 nt, Homo Sapiens; identical to SEQ ID NO: 142454

SEQ ID NO: 260729 - RNA, 64 nt, Homo Sapiens; identical to SEQ ID NO: 142455

SEQ ID NO: 260730 - RNA, 64 nt, Homo Sapiens; identical to SEQ ID NO: 142456

SEQ ID NO: 260731 - RNA, 64 nt, Homo Sapiens; identical to SEQ ID NO: 142457

SEQ ID NO: 260732 - RNA, 64 nt, Homo Sapiens; identical to SEQ ID NO: 142458

SEQ ID NO: 260733 - RNA, 64 nt, Homo Sapiens; identical to SEQ ID NO: 142459

SEQ ID NO: 260734 - RNA, 64 nt, Homo Sapiens; identical to SEQ ID NO: 142460

SEQ ID NO: 260735 - RNA, 64 nt, Homo Sapiens; identical to SEQ ID NO: 142461

SEQ ID NO: 260736 - RNA, 64 nt, Homo Sapiens; identical to SEQ ID NO: 142462

SEQ ID NO: 260737 - RNA, 64 nt, Homo Sapiens; identical to SEQ ID NO: 142463

SEQ ID NO: 260738 - RNA, 64 nt, Homo Sapiens; identical to SEQ ID NO: 142464

SEQ ID NO: 260739 - RNA, 64 nt, Homo Sapiens; identical to SEQ ID NO: 142465

SEQ ID NO: 260740 - RNA, 64 nt, Homo Sapiens; identical to SEQ ID NO: 142466

SEQ ID NO: 260741 - RNA, 64 nt, Homo Sapiens; identical to SEQ ID NO: 142467

SEQ ID NO: 260742 - RNA, 64 nt, Homo Sapiens; identical to SEQ ID NO: 142468

SEQ ID NO: 260743 - RNA, 64 nt, Homo Sapiens; identical to SEQ ID NO: 142469

SEQ ID NO: 260744 - RNA, 64 nt, Homo Sapiens; identical to SEQ ID NO: 142470

SEQ ID NO: 260745 - RNA, 64 nt, Homo Sapiens; identical to SEQ ID NO: 142471

SEQ ID NO: 260746 - RNA, 64 nt, Homo Sapiens; identical to SEQ ID NO: 142472

SEQ ID NO: 260747 - RNA, 64 nt, Homo Sapiens; identical to SEQ ID NO: 142473

SEQ ID NO: 260748 - RNA, 64 nt, Homo Sapiens; identical to SEQ ID NO: 142474

SEQ ID NO: 260749 - RNA, 64 nt, Homo Sapiens; identical to SEQ ID NO: 142475

SEQ ID NO: 260750 - RNA, 64 nt, Homo Sapiens; identical to SEQ ID NO: 142476

SEQ ID NO: 260751 - RNA, 64 nt, Homo Sapiens; identical to SEQ ID NO: 142477

SEQ ID NO: 260752 - RNA, 64 nt, Homo Sapiens; identical to SEQ ID NO: 142478

SEQ ID NO: 260753 - RNA, 64 nt, Homo Sapiens; identical to SEQ ID NO: 142479

SEQ ID NO: 260754 - RNA, 64 nt, Homo Sapiens; identical to SEQ ID NO: 142480

SEQ ID NO: 260755 - RNA, 64 nt, Homo Sapiens; identical to SEQ ID NO: 142481

SEQ ID NO: 260756 - RNA, 64 nt, Homo Sapiens; identical to SEQ ID NO: 142482

SEQ ID NO: 260757 - RNA, 64 nt, Homo Sapiens; identical to SEQ ID NO: 142483

SEQ ID NO: 260758 - RNA, 64 nt, Homo Sapiens; identical to SEQ ID NO: 142484

SEQ ID NO: 260759 - RNA, 64 nt, Homo Sapiens; identical to SEQ ID NO: 142485

SEQ ID NO: 260760 - RNA, 64 nt, Homo Sapiens; identical to SEQ ID NO: 142486

SEQ ID NO: 260761 - RNA, 64 nt, Homo Sapiens; identical to SEQ ID NO: 142487

SEQ ID NO: 260762 - RNA, 64 nt, Homo Sapiens; identical to SEQ ID NO: 142488

SEQ ID NO: 260763 - RNA, 64 nt, Homo Sapiens; identical to SEQ ID NO: 142489

SEQ ID NO: 260764 - RNA, 64 nt, Homo Sapiens; identical to SEQ ID NO: 142490

SEQ ID NO: 260765 - RNA, 64 nt, Homo Sapiens; identical to SEQ ID NO: 142491

SEQ ID NO: 260766 - RNA, 64 nt, Homo Sapiens; identical to SEQ ID NO: 142492

SEQ ID NO: 260767 - RNA, 64 nt, Homo Sapiens; identical to SEQ ID NO: 142493

SEQ ID NO: 260768 - RNA, 64 nt, Homo Sapiens; identical to SEQ ID NO: 142494

SEQ ID NO: 260769 - RNA, 64 nt, Homo Sapiens; identical to SEQ ID NO: 142495

SEQ ID NO: 260770 - RNA, 64 nt, Homo Sapiens; identical to SEQ ID NO: 142496

SEQ ID NO: 260771 - RNA, 64 nt, Homo Sapiens; identical to SEQ ID NO: 142497

SEQ ID NO: 260772 - RNA, 64 nt, Homo Sapiens; identical to SEQ ID NO: 142498

SEQ ID NO: 260773 - RNA, 64 nt, Homo Sapiens; identical to SEQ ID NO: 142499

SEQ ID NO: 260774 - RNA, 64 nt, Homo Sapiens; identical to SEQ ID NO: 142500

SEQ ID NO: 260775 - RNA, 64 nt, Homo Sapiens; identical to SEQ ID NO: 142501

SEQ ID NO: 260776 - RNA, 64 nt, Homo Sapiens; identical to SEQ ID NO: 142502

SEQ ID NO: 260777 - RNA, 64 nt, Homo Sapiens; identical to SEQ ID NO: 142503

SEQ ID NO: 260778 - RNA, 64 nt, Homo Sapiens; identical to SEQ ID NO: 142504

SEQ ID NO: 260779 - RNA, 64 nt, Homo Sapiens; identical to SEQ ID NO: 142505

SEQ ID NO: 260780 - RNA, 64 nt, Homo Sapiens; identical to SEQ ID NO: 142506

SEQ ID NO: 260781 - RNA, 64 nt, Homo Sapiens; identical to SEQ ID NO: 142507

SEQ ID NO: 260782 - RNA, 64 nt, Homo Sapiens; identical to SEQ ID NO: 142508

SEQ ID NO: 260783 - RNA, 64 nt, Homo Sapiens; identical to SEQ ID NO: 142509

SEQ ID NO: 260784 - RNA, 64 nt, Homo Sapiens; identical to SEQ ID NO: 142510

SEQ ID NO: 260785 - RNA, 64 nt, Homo Sapiens; identical to SEQ ID NO: 142511

SEQ ID NO: 260786 - RNA, 64 nt, Homo Sapiens; identical to SEQ ID NO: 142512

SEQ ID NO: 260787 - RNA, 64 nt, Homo Sapiens; identical to SEQ ID NO: 142513

SEQ ID NO: 260788 - RNA, 64 nt, Homo Sapiens; identical to SEQ ID NO: 142514

SEQ ID NO: 260789 - RNA, 64 nt, Homo Sapiens; identical to SEQ ID NO: 142515

SEQ ID NO: 260790 - RNA, 64 nt, Homo Sapiens; identical to SEQ ID NO: 142516

SEQ ID NO: 260791 - RNA, 64 nt, Homo Sapiens; identical to SEQ ID NO: 142517

SEQ ID NO: 260792 - RNA, 64 nt, Homo Sapiens; identical to SEQ ID NO: 142518

SEQ ID NO: 260793 - RNA, 64 nt, Homo Sapiens; identical to SEQ ID NO: 142519

SEQ ID NO: 260794 - RNA, 64 nt, Homo Sapiens; identical to SEQ ID NO: 142520

SEQ ID NO: 260795 - RNA, 64 nt, Homo Sapiens; identical to SEQ ID NO: 142521

SEQ ID NO: 260796 - RNA, 64 nt, Homo Sapiens; identical to SEQ ID NO: 142522

SEQ ID NO: 260797 - RNA, 64 nt, Homo Sapiens; identical to SEQ ID NO: 142523

SEQ ID NO: 260798 - RNA, 64 nt, Homo Sapiens; identical to SEQ ID NO: 142524

SEQ ID NO: 260799 - RNA, 64 nt, Homo Sapiens; identical to SEQ ID NO: 142525

SEQ ID NO: 260800 - RNA, 64 nt, Homo Sapiens; identical to SEQ ID NO: 142526

SEQ ID NO: 260801 - RNA, 64 nt, Homo Sapiens; identical to SEQ ID NO: 142527

SEQ ID NO: 260802 - RNA, 64 nt, Homo Sapiens; identical to SEQ ID NO: 142528

SEQ ID NO: 260803 - RNA, 64 nt, Homo Sapiens; identical to SEQ ID NO: 142529

SEQ ID NO: 260804 - RNA, 64 nt, Homo Sapiens; identical to SEQ ID NO: 142530

SEQ ID NO: 260805 - RNA, 64 nt, Homo Sapiens; identical to SEQ ID NO: 142531

SEQ ID NO: 260806 - RNA, 64 nt, Homo Sapiens; identical to SEQ ID NO: 142532

SEQ ID NO: 260807 - RNA, 64 nt, Homo Sapiens; identical to SEQ ID NO: 142533

SEQ ID NO: 260808 - RNA, 64 nt, Homo Sapiens; identical to SEQ ID NO: 142534

SEQ ID NO: 260809 - RNA, 64 nt, Homo Sapiens; identical to SEQ ID NO: 142535

SEQ ID NO: 260810 - RNA, 64 nt, Homo Sapiens; identical to SEQ ID NO: 142536

SEQ ID NO: 260811 - RNA, 64 nt, Homo Sapiens; identical to SEQ ID NO: 142537

SEQ ID NO: 260812 - RNA, 64 nt, Homo Sapiens; identical to SEQ ID NO: 142538

SEQ ID NO: 260813 - RNA, 64 nt, Homo Sapiens; identical to SEQ ID NO: 142539

SEQ ID NO: 260814 - RNA, 64 nt, Homo Sapiens; identical to SEQ ID NO: 142540

SEQ ID NO: 260815 - RNA, 64 nt, Homo Sapiens; identical to SEQ ID NO: 142541

SEQ ID NO: 260816 - RNA, 59 nt, Homo Sapiens; identical to SEQ ID NO: 142542

SEQ ID NO: 260817 - RNA, 64 nt, Homo Sapiens; identical to SEQ ID NO: 142543

SEQ ID NO: 260818 - RNA, 64 nt, Homo Sapiens; identical to SEQ ID NO: 142544

SEQ ID NO: 260819 - RNA, 64 nt, Homo Sapiens; identical to SEQ ID NO: 142545

SEQ ID NO: 260820 - RNA, 64 nt, Homo Sapiens; identical to SEQ ID NO: 142546

SEQ ID NO: 260821 - RNA, 64 nt, Homo Sapiens; identical to SEQ ID NO: 142547

SEQ ID NO: 260822 - RNA, 64 nt, Homo Sapiens; identical to SEQ ID NO: 142548

SEQ ID NO: 260823 - RNA, 64 nt, Homo Sapiens; identical to SEQ ID NO: 142549

SEQ ID NO: 260824 - RNA, 64 nt, Homo Sapiens; identical to SEQ ID NO: 142550

SEQ ID NO: 260825 - RNA, 64 nt, Homo Sapiens; identical to SEQ ID NO: 142551

SEQ ID NO: 260826 - RNA, 64 nt, Homo Sapiens; identical to SEQ ID NO: 142552

SEQ ID NO: 260827 - RNA, 64 nt, Homo Sapiens; identical to SEQ ID NO: 142553

SEQ ID NO: 260828 - RNA, 64 nt, Homo Sapiens; identical to SEQ ID NO: 142554

SEQ ID NO: 260829 - RNA, 64 nt, Homo Sapiens; identical to SEQ ID NO: 142555

SEQ ID NO: 260830 - RNA, 64 nt, Homo Sapiens; identical to SEQ ID NO: 142556

SEQ ID NO: 260831 - RNA, 64 nt, Homo Sapiens; identical to SEQ ID NO: 142557

SEQ ID NO: 260832 - RNA, 64 nt, Homo Sapiens; identical to SEQ ID NO: 142558

SEQ ID NO: 260833 - RNA, 64 nt, Homo Sapiens; identical to SEQ ID NO: 142559

SEQ ID NO: 260834 - RNA, 64 nt, Homo Sapiens; identical to SEQ ID NO: 142560

SEQ ID NO: 260835 - RNA, 64 nt, Homo Sapiens; identical to SEQ ID NO: 142561

SEQ ID NO: 260836 - RNA, 64 nt, Homo Sapiens; identical to SEQ ID NO: 142562

SEQ ID NO: 260837 - RNA, 64 nt, Homo Sapiens; identical to SEQ ID NO: 142563

SEQ ID NO: 260838 - RNA, 64 nt, Homo Sapiens; identical to SEQ ID NO: 142564

SEQ ID NO: 260839 - RNA, 64 nt, Homo Sapiens; identical to SEQ ID NO: 142565

SEQ ID NO: 260840 - RNA, 64 nt, Homo Sapiens; identical to SEQ ID NO: 142566

SEQ ID NO: 260841 - RNA, 64 nt, Homo Sapiens; identical to SEQ ID NO: 142567

SEQ ID NO: 260842 - RNA, 64 nt, Homo Sapiens; identical to SEQ ID NO: 142568

SEQ ID NO: 260843 - RNA, 64 nt, Homo Sapiens; identical to SEQ ID NO: 142569

SEQ ID NO: 260844 - RNA, 64 nt, Homo Sapiens; identical to SEQ ID NO: 142570

SEQ ID NO: 260845 - RNA, 64 nt, Homo Sapiens; identical to SEQ ID NO: 142571

SEQ ID NO: 260846 - RNA, 64 nt, Homo Sapiens; identical to SEQ ID NO: 142572

SEQ ID NO: 260847 - RNA, 64 nt, Homo Sapiens; identical to SEQ ID NO: 142573

SEQ ID NO: 260848 - RNA, 64 nt, Homo Sapiens; identical to SEQ ID NO: 142574

SEQ ID NO: 260849 - RNA, 64 nt, Homo Sapiens; identical to SEQ ID NO: 142575

SEQ ID NO: 260850 - RNA, 64 nt, Homo Sapiens; identical to SEQ ID NO: 142576

SEQ ID NO: 260851 - RNA, 64 nt, Homo Sapiens; identical to SEQ ID NO: 142577

SEQ ID NO: 260852 - RNA, 64 nt, Homo Sapiens; identical to SEQ ID NO: 142578

SEQ ID NO: 260853 - RNA, 64 nt, Homo Sapiens; identical to SEQ ID NO: 142579

SEQ ID NO: 260854 - RNA, 64 nt, Homo Sapiens; identical to SEQ ID NO: 142580

SEQ ID NO: 260855 - RNA, 64 nt, Homo Sapiens; identical to SEQ ID NO: 142581

SEQ ID NO: 260856 - RNA, 64 nt, Homo Sapiens; identical to SEQ ID NO: 142582

SEQ ID NO: 260857 - RNA, 64 nt, Homo Sapiens; identical to SEQ ID NO: 142583

SEQ ID NO: 260858 - RNA, 55 nt, Homo Sapiens; identical to SEQ ID NO: 142584

SEQ ID NO: 260859 - RNA, 64 nt, Homo Sapiens; identical to SEQ ID NO: 142585

SEQ ID NO: 260860 - RNA, 64 nt, Homo Sapiens; identical to SEQ ID NO: 142586

SEQ ID NO: 260861 - RNA, 64 nt, Homo Sapiens; identical to SEQ ID NO: 142587

SEQ ID NO: 260862 - RNA, 64 nt, Homo Sapiens; identical to SEQ ID NO: 142588

SEQ ID NO: 260863 - RNA, 64 nt, Homo Sapiens; identical to SEQ ID NO: 142589

SEQ ID NO: 260864 - RNA, 64 nt, Homo Sapiens; identical to SEQ ID NO: 142590

SEQ ID NO: 260865 - RNA, 64 nt, Homo Sapiens; identical to SEQ ID NO: 142591

SEQ ID NO: 260866 - RNA, 64 nt, Homo Sapiens; identical to SEQ ID NO: 142592

SEQ ID NO: 260867 - RNA, 64 nt, Homo Sapiens; identical to SEQ ID NO: 142593

SEQ ID NO: 260868 - RNA, 64 nt, Homo Sapiens; identical to SEQ ID NO: 142594

SEQ ID NO: 260869 - RNA, 64 nt, Homo Sapiens; identical to SEQ ID NO: 142595

SEQ ID NO: 260870 - RNA, 64 nt, Homo Sapiens; identical to SEQ ID NO: 142596

SEQ ID NO: 260871 - RNA, 64 nt, Homo Sapiens; identical to SEQ ID NO: 142597

SEQ ID NO: 260872 - RNA, 64 nt, Homo Sapiens; identical to SEQ ID NO: 142598

SEQ ID NO: 260873 - RNA, 64 nt, Homo Sapiens; identical to SEQ ID NO: 142599

SEQ ID NO: 260874 - RNA, 64 nt, Homo Sapiens; identical to SEQ ID NO: 142600

SEQ ID NO: 260875 - RNA, 64 nt, Homo Sapiens; identical to SEQ ID NO: 142601

SEQ ID NO: 260876 - RNA, 64 nt, Homo Sapiens; identical to SEQ ID NO: 142602

SEQ ID NO: 260877 - RNA, 64 nt, Homo Sapiens; identical to SEQ ID NO: 142603

SEQ ID NO: 260878 - RNA, 64 nt, Homo Sapiens; identical to SEQ ID NO: 142604

SEQ ID NO: 260879 - RNA, 64 nt, Homo Sapiens; identical to SEQ ID NO: 142605

SEQ ID NO: 260880 - RNA, 64 nt, Homo Sapiens; identical to SEQ ID NO: 142606

SEQ ID NO: 260881 - RNA, 64 nt, Homo Sapiens; identical to SEQ ID NO: 142607

SEQ ID NO: 260882 - RNA, 64 nt, Homo Sapiens; identical to SEQ ID NO: 142608

SEQ ID NO: 260883 - RNA, 64 nt, Homo Sapiens; identical to SEQ ID NO: 142609

SEQ ID NO: 260884 - RNA, 64 nt, Homo Sapiens; identical to SEQ ID NO: 142610

SEQ ID NO: 260885 - RNA, 64 nt, Homo Sapiens; identical to SEQ ID NO: 142611

SEQ ID NO: 260886 - RNA, 64 nt, Homo Sapiens; identical to SEQ ID NO: 142612

SEQ ID NO: 260887 - RNA, 64 nt, Homo Sapiens; identical to SEQ ID NO: 142613

SEQ ID NO: 260888 - RNA, 64 nt, Homo Sapiens; identical to SEQ ID NO: 142614

SEQ ID NO: 260889 - RNA, 64 nt, Homo Sapiens; identical to SEQ ID NO: 142615

SEQ ID NO: 260890 - RNA, 64 nt, Homo Sapiens; identical to SEQ ID NO: 142616

SEQ ID NO: 260891 - RNA, 64 nt, Homo Sapiens; identical to SEQ ID NO: 142617

SEQ ID NO: 260892 - RNA, 64 nt, Homo Sapiens; identical to SEQ ID NO: 142618

SEQ ID NO: 260893 - RNA, 64 nt, Homo Sapiens; identical to SEQ ID NO: 142619

SEQ ID NO: 260894 - RNA, 64 nt, Homo Sapiens; identical to SEQ ID NO: 142620

SEQ ID NO: 260895 - RNA, 64 nt, Homo Sapiens; identical to SEQ ID NO: 142621

SEQ ID NO: 260896 - RNA, 64 nt, Homo Sapiens; identical to SEQ ID NO: 142622

SEQ ID NO: 260897 - RNA, 64 nt, Homo Sapiens; identical to SEQ ID NO: 142623

SEQ ID NO: 260898 - RNA, 64 nt, Homo Sapiens; identical to SEQ ID NO: 142624

SEQ ID NO: 260899 - RNA, 64 nt, Homo Sapiens; identical to SEQ ID NO: 142625

SEQ ID NO: 260900 - RNA, 64 nt, Homo Sapiens; identical to SEQ ID NO: 142626

SEQ ID NO: 260901 - RNA, 64 nt, Homo Sapiens; identical to SEQ ID NO: 142627

SEQ ID NO: 260902 - RNA, 64 nt, Homo Sapiens; identical to SEQ ID NO: 142628

SEQ ID NO: 260903 - RNA, 64 nt, Homo Sapiens; identical to SEQ ID NO: 142629

SEQ ID NO: 260904 - RNA, 64 nt, Homo Sapiens; identical to SEQ ID NO: 142630

SEQ ID NO: 260905 - RNA, 64 nt, Homo Sapiens; identical to SEQ ID NO: 142631

SEQ ID NO: 260906 - RNA, 64 nt, Homo Sapiens; identical to SEQ ID NO: 142632

SEQ ID NO: 260907 - RNA, 64 nt, Homo Sapiens; identical to SEQ ID NO: 142633

SEQ ID NO: 260908 - RNA, 64 nt, Homo Sapiens; identical to SEQ ID NO: 142634

SEQ ID NO: 260909 - RNA, 64 nt, Homo Sapiens; identical to SEQ ID NO: 142635

SEQ ID NO: 260910 - RNA, 64 nt, Homo Sapiens; identical to SEQ ID NO: 142636

SEQ ID NO: 260911 - RNA, 64 nt, Homo Sapiens; identical to SEQ ID NO: 142637

SEQ ID NO: 260912 - RNA, 64 nt, Homo Sapiens; identical to SEQ ID NO: 142638

SEQ ID NO: 260913 - RNA, 64 nt, Homo Sapiens; identical to SEQ ID NO: 142639

SEQ ID NO: 260914 - RNA, 64 nt, Homo Sapiens; identical to SEQ ID NO: 142640

SEQ ID NO: 260915 - RNA, 64 nt, Homo Sapiens; identical to SEQ ID NO: 142641

SEQ ID NO: 260916 - RNA, 64 nt, Homo Sapiens; identical to SEQ ID NO: 142642

SEQ ID NO: 260917 - RNA, 64 nt, Homo Sapiens; identical to SEQ ID NO: 142643

SEQ ID NO: 260918 - RNA, 64 nt, Homo Sapiens; identical to SEQ ID NO: 142644

SEQ ID NO: 260919 - RNA, 64 nt, Homo Sapiens; identical to SEQ ID NO: 142645

SEQ ID NO: 260920 - RNA, 64 nt, Homo Sapiens; identical to SEQ ID NO: 142646

SEQ ID NO: 260921 - RNA, 64 nt, Homo Sapiens; identical to SEQ ID NO: 142647

SEQ ID NO: 260922 - RNA, 64 nt, Homo Sapiens; identical to SEQ ID NO: 142648

SEQ ID NO: 260923 - RNA, 64 nt, Homo Sapiens; identical to SEQ ID NO: 142649

SEQ ID NO: 260924 - RNA, 64 nt, Homo Sapiens; identical to SEQ ID NO: 142650

SEQ ID NO: 260925 - RNA, 64 nt, Homo Sapiens; identical to SEQ ID NO: 142651

SEQ ID NO: 260926 - RNA, 64 nt, Homo Sapiens; identical to SEQ ID NO: 142652

SEQ ID NO: 260927 - RNA, 64 nt, Homo Sapiens; identical to SEQ ID NO: 142653

SEQ ID NO: 260928 - RNA, 64 nt, Homo Sapiens; identical to SEQ ID NO: 142654

SEQ ID NO: 260929 - RNA, 64 nt, Homo Sapiens; identical to SEQ ID NO: 142655

SEQ ID NO: 260930 - RNA, 64 nt, Homo Sapiens; identical to SEQ ID NO: 142656

SEQ ID NO: 260931 - RNA, 64 nt, Homo Sapiens; identical to SEQ ID NO: 142657

SEQ ID NO: 260932 - RNA, 64 nt, Homo Sapiens; identical to SEQ ID NO: 142658

SEQ ID NO: 260933 - RNA, 64 nt, Homo Sapiens; identical to SEQ ID NO: 142659

SEQ ID NO: 260934 - RNA, 64 nt, Homo Sapiens; identical to SEQ ID NO: 142660

SEQ ID NO: 260935 - RNA, 64 nt, Homo Sapiens; identical to SEQ ID NO: 142661

SEQ ID NO: 260936 - RNA, 64 nt, Homo Sapiens; identical to SEQ ID NO: 142662

SEQ ID NO: 260937 - RNA, 64 nt, Homo Sapiens; identical to SEQ ID NO: 142663

SEQ ID NO: 260938 - RNA, 64 nt, Homo Sapiens; identical to SEQ ID NO: 142664

SEQ ID NO: 260939 - RNA, 64 nt, Homo Sapiens; identical to SEQ ID NO: 142665

SEQ ID NO: 260940 - RNA, 64 nt, Homo Sapiens; identical to SEQ ID NO: 142666

SEQ ID NO: 260941 - RNA, 64 nt, Homo Sapiens; identical to SEQ ID NO: 142667

SEQ ID NO: 260942 - RNA, 64 nt, Homo Sapiens; identical to SEQ ID NO: 142668

SEQ ID NO: 260943 - RNA, 64 nt, Homo Sapiens; identical to SEQ ID NO: 142669

SEQ ID NO: 260944 - RNA, 64 nt, Homo Sapiens; identical to SEQ ID NO: 142670

SEQ ID NO: 260945 - RNA, 64 nt, Homo Sapiens; identical to SEQ ID NO: 142671

SEQ ID NO: 260946 - RNA, 64 nt, Homo Sapiens; identical to SEQ ID NO: 142672

SEQ ID NO: 260947 - RNA, 64 nt, Homo Sapiens; identical to SEQ ID NO: 142673

SEQ ID NO: 260948 - RNA, 64 nt, Homo Sapiens; identical to SEQ ID NO: 142674

SEQ ID NO: 260949 - RNA, 64 nt, Homo Sapiens; identical to SEQ ID NO: 142675

SEQ ID NO: 260950 - RNA, 64 nt, Homo Sapiens; identical to SEQ ID NO: 142676

SEQ ID NO: 260951 - RNA, 64 nt, Homo Sapiens; identical to SEQ ID NO: 142677

SEQ ID NO: 260952 - RNA, 64 nt, Homo Sapiens; identical to SEQ ID NO: 142678

SEQ ID NO: 260953 - RNA, 64 nt, Homo Sapiens; identical to SEQ ID NO: 142679

SEQ ID NO: 260954 - RNA, 64 nt, Homo Sapiens; identical to SEQ ID NO: 142680

SEQ ID NO: 260955 - RNA, 64 nt, Homo Sapiens; identical to SEQ ID NO: 142681

SEQ ID NO: 260956 - RNA, 64 nt, Homo Sapiens; identical to SEQ ID NO: 142682

SEQ ID NO: 260957 - RNA, 64 nt, Homo Sapiens; identical to SEQ ID NO: 142683

SEQ ID NO: 260958 - RNA, 64 nt, Homo Sapiens; identical to SEQ ID NO: 142684

SEQ ID NO: 260959 - RNA, 64 nt, Homo Sapiens; identical to SEQ ID NO: 142685

SEQ ID NO: 260960 - RNA, 64 nt, Homo Sapiens; identical to SEQ ID NO: 142686

SEQ ID NO: 260961 - RNA, 64 nt, Homo Sapiens; identical to SEQ ID NO: 142687

SEQ ID NO: 260962 - RNA, 64 nt, Homo Sapiens; identical to SEQ ID NO: 142688

SEQ ID NO: 260963 - RNA, 64 nt, Homo Sapiens; identical to SEQ ID NO: 142689

SEQ ID NO: 260964 - RNA, 64 nt, Homo Sapiens; identical to SEQ ID NO: 142690

SEQ ID NO: 260965 - RNA, 64 nt, Homo Sapiens; identical to SEQ ID NO: 142691

SEQ ID NO: 260966 - RNA, 64 nt, Homo Sapiens; identical to SEQ ID NO: 142692

SEQ ID NO: 260967 - RNA, 64 nt, Homo Sapiens; identical to SEQ ID NO: 142693

SEQ ID NO: 260968 - RNA, 64 nt, Homo Sapiens; identical to SEQ ID NO: 142694

SEQ ID NO: 260969 - RNA, 64 nt, Homo Sapiens; identical to SEQ ID NO: 142695

SEQ ID NO: 260970 - RNA, 64 nt, Homo Sapiens; identical to SEQ ID NO: 142696

SEQ ID NO: 260971 - RNA, 64 nt, Homo Sapiens; identical to SEQ ID NO: 142697

SEQ ID NO: 260972 - RNA, 64 nt, Homo Sapiens; identical to SEQ ID NO: 142698

SEQ ID NO: 260973 - RNA, 64 nt, Homo Sapiens; identical to SEQ ID NO: 142699

SEQ ID NO: 260974 - RNA, 64 nt, Homo Sapiens; identical to SEQ ID NO: 142700

SEQ ID NO: 260975 - RNA, 64 nt, Homo Sapiens; identical to SEQ ID NO: 142701

SEQ ID NO: 260976 - RNA, 64 nt, Homo Sapiens; identical to SEQ ID NO: 142702

SEQ ID NO: 260977 - RNA, 64 nt, Homo Sapiens; identical to SEQ ID NO: 142703

SEQ ID NO: 260978 - RNA, 64 nt, Homo Sapiens; identical to SEQ ID NO: 142704

SEQ ID NO: 260979 - RNA, 64 nt, Homo Sapiens; identical to SEQ ID NO: 142705

SEQ ID NO: 260980 - RNA, 64 nt, Homo Sapiens; identical to SEQ ID NO: 142706

SEQ ID NO: 260981 - RNA, 64 nt, Homo Sapiens; identical to SEQ ID NO: 142707

SEQ ID NO: 260982 - RNA, 64 nt, Homo Sapiens; identical to SEQ ID NO: 142708

SEQ ID NO: 260983 - RNA, 64 nt, Homo Sapiens; identical to SEQ ID NO: 142709

SEQ ID NO: 260984 - RNA, 64 nt, Homo Sapiens; identical to SEQ ID NO: 142710

SEQ ID NO: 260985 - RNA, 64 nt, Homo Sapiens; identical to SEQ ID NO: 142711

SEQ ID NO: 260986 - RNA, 64 nt, Homo Sapiens; identical to SEQ ID NO: 142712

SEQ ID NO: 260987 - RNA, 64 nt, Homo Sapiens; identical to SEQ ID NO: 142713

SEQ ID NO: 260988 - RNA, 64 nt, Homo Sapiens; identical to SEQ ID NO: 142714

SEQ ID NO: 260989 - RNA, 64 nt, Homo Sapiens; identical to SEQ ID NO: 142715

SEQ ID NO: 260990 - RNA, 64 nt, Homo Sapiens; identical to SEQ ID NO: 142716

SEQ ID NO: 260991 - RNA, 64 nt, Homo Sapiens; identical to SEQ ID NO: 142717

SEQ ID NO: 260992 - RNA, 64 nt, Homo Sapiens; identical to SEQ ID NO: 142718

SEQ ID NO: 260993 - RNA, 64 nt, Homo Sapiens; identical to SEQ ID NO: 142719

SEQ ID NO: 260994 - RNA, 64 nt, Homo Sapiens; identical to SEQ ID NO: 142720

SEQ ID NO: 260995 - RNA, 64 nt, Homo Sapiens; identical to SEQ ID NO: 142721

SEQ ID NO: 260996 - RNA, 64 nt, Homo Sapiens; identical to SEQ ID NO: 142722

SEQ ID NO: 260997 - RNA, 64 nt, Homo Sapiens; identical to SEQ ID NO: 142723

SEQ ID NO: 260998 - RNA, 64 nt, Homo Sapiens; identical to SEQ ID NO: 142724

SEQ ID NO: 260999 - RNA, 64 nt, Homo Sapiens; identical to SEQ ID NO: 142725

SEQ ID NO: 261000 - RNA, 64 nt, Homo Sapiens; identical to SEQ ID NO: 142726

SEQ ID NO: 261001 - RNA, 64 nt, Homo Sapiens; identical to SEQ ID NO: 142727

SEQ ID NO: 261002 - RNA, 64 nt, Homo Sapiens; identical to SEQ ID NO: 142728

SEQ ID NO: 261003 - RNA, 64 nt, Homo Sapiens; identical to SEQ ID NO: 142729

SEQ ID NO: 261004 - RNA, 64 nt, Homo Sapiens; identical to SEQ ID NO: 142730

SEQ ID NO: 261005 - RNA, 64 nt, Homo Sapiens; identical to SEQ ID NO: 142731

SEQ ID NO: 261006 - RNA, 64 nt, Homo Sapiens; identical to SEQ ID NO: 142732

SEQ ID NO: 261007 - RNA, 64 nt, Homo Sapiens; identical to SEQ ID NO: 142733

SEQ ID NO: 261008 - RNA, 64 nt, Homo Sapiens; identical to SEQ ID NO: 142734

SEQ ID NO: 261009 - RNA, 64 nt, Homo Sapiens; identical to SEQ ID NO: 142735

SEQ ID NO: 261010 - RNA, 64 nt, Homo Sapiens; identical to SEQ ID NO: 142736

SEQ ID NO: 261011 - RNA, 64 nt, Homo Sapiens; identical to SEQ ID NO: 142737

SEQ ID NO: 261012 - RNA, 64 nt, Homo Sapiens; identical to SEQ ID NO: 142738

SEQ ID NO: 261013 - RNA, 64 nt, Homo Sapiens; identical to SEQ ID NO: 142739

SEQ ID NO: 261014 - RNA, 64 nt, Homo Sapiens; identical to SEQ ID NO: 142740

SEQ ID NO: 261015 - RNA, 64 nt, Homo Sapiens; identical to SEQ ID NO: 142741

SEQ ID NO: 261016 - RNA, 64 nt, Homo Sapiens; identical to SEQ ID NO: 142742

SEQ ID NO: 261017 - RNA, 64 nt, Homo Sapiens; identical to SEQ ID NO: 142743

SEQ ID NO: 261018 - RNA, 64 nt, Homo Sapiens; identical to SEQ ID NO: 142744

SEQ ID NO: 261019 - RNA, 64 nt, Homo Sapiens; identical to SEQ ID NO: 142745

SEQ ID NO: 261020 - RNA, 64 nt, Homo Sapiens; identical to SEQ ID NO: 142746

SEQ ID NO: 261021 - RNA, 64 nt, Homo Sapiens; identical to SEQ ID NO: 142747

SEQ ID NO: 261022 - RNA, 64 nt, Homo Sapiens; identical to SEQ ID NO: 142748

SEQ ID NO: 261023 - RNA, 64 nt, Homo Sapiens; identical to SEQ ID NO: 142749

SEQ ID NO: 261024 - RNA, 64 nt, Homo Sapiens; identical to SEQ ID NO: 142750

SEQ ID NO: 261025 - RNA, 64 nt, Homo Sapiens; identical to SEQ ID NO: 142751

SEQ ID NO: 261026 - RNA, 64 nt, Homo Sapiens; identical to SEQ ID NO: 142752

SEQ ID NO: 261027 - RNA, 64 nt, Homo Sapiens; identical to SEQ ID NO: 142753

SEQ ID NO: 261028 - RNA, 64 nt, Homo Sapiens; identical to SEQ ID NO: 142754

SEQ ID NO: 261029 - RNA, 64 nt, Homo Sapiens; identical to SEQ ID NO: 142755

SEQ ID NO: 261030 - RNA, 64 nt, Homo Sapiens; identical to SEQ ID NO: 142756

SEQ ID NO: 261031 - RNA, 64 nt, Homo Sapiens; identical to SEQ ID NO: 142757

SEQ ID NO: 261032 - RNA, 64 nt, Homo Sapiens; identical to SEQ ID NO: 142758

SEQ ID NO: 261033 - RNA, 64 nt, Homo Sapiens; identical to SEQ ID NO: 142759

SEQ ID NO: 261034 - RNA, 64 nt, Homo Sapiens; identical to SEQ ID NO: 142760

SEQ ID NO: 261035 - RNA, 64 nt, Homo Sapiens; identical to SEQ ID NO: 142761

SEQ ID NO: 261036 - RNA, 64 nt, Homo Sapiens; identical to SEQ ID NO: 142762

SEQ ID NO: 261037 - RNA, 64 nt, Homo Sapiens; identical to SEQ ID NO: 142763

SEQ ID NO: 261038 - RNA, 64 nt, Homo Sapiens; identical to SEQ ID NO: 142764

SEQ ID NO: 261039 - RNA, 64 nt, Homo Sapiens; identical to SEQ ID NO: 142765

SEQ ID NO: 261040 - RNA, 64 nt, Homo Sapiens; identical to SEQ ID NO: 142766

SEQ ID NO: 261041 - RNA, 64 nt, Homo Sapiens; identical to SEQ ID NO: 142767

SEQ ID NO: 261042 - RNA, 64 nt, Homo Sapiens; identical to SEQ ID NO: 142768

SEQ ID NO: 261043 - RNA, 64 nt, Homo Sapiens; identical to SEQ ID NO: 142769

SEQ ID NO: 261044 - RNA, 64 nt, Homo Sapiens; identical to SEQ ID NO: 142770

SEQ ID NO: 261045 - RNA, 64 nt, Homo Sapiens; identical to SEQ ID NO: 142771

SEQ ID NO: 261046 - RNA, 64 nt, Homo Sapiens; identical to SEQ ID NO: 142772

SEQ ID NO: 261047 - RNA, 64 nt, Homo Sapiens; identical to SEQ ID NO: 142773

SEQ ID NO: 261048 - RNA, 64 nt, Homo Sapiens; identical to SEQ ID NO: 142774

SEQ ID NO: 261049 - RNA, 64 nt, Homo Sapiens; identical to SEQ ID NO: 142775

SEQ ID NO: 261050 - RNA, 64 nt, Homo Sapiens; identical to SEQ ID NO: 142776

SEQ ID NO: 261051 - RNA, 64 nt, Homo Sapiens; identical to SEQ ID NO: 142777

SEQ ID NO: 261052 - RNA, 64 nt, Homo Sapiens; identical to SEQ ID NO: 142778

SEQ ID NO: 261053 - RNA, 64 nt, Homo Sapiens; identical to SEQ ID NO: 142779

SEQ ID NO: 261054 - RNA, 64 nt, Homo Sapiens; identical to SEQ ID NO: 142780

SEQ ID NO: 261055 - RNA, 64 nt, Homo Sapiens; identical to SEQ ID NO: 142781

SEQ ID NO: 261056 - RNA, 64 nt, Homo Sapiens; identical to SEQ ID NO: 142782

SEQ ID NO: 261057 - RNA, 64 nt, Homo Sapiens; identical to SEQ ID NO: 142783

SEQ ID NO: 261058 - RNA, 64 nt, Homo Sapiens; identical to SEQ ID NO: 142784

SEQ ID NO: 261059 - RNA, 64 nt, Homo Sapiens; identical to SEQ ID NO: 142785

SEQ ID NO: 261060 - RNA, 64 nt, Homo Sapiens; identical to SEQ ID NO: 142786

SEQ ID NO: 261061 - RNA, 64 nt, Homo Sapiens; identical to SEQ ID NO: 142787

SEQ ID NO: 261062 - RNA, 64 nt, Homo Sapiens; identical to SEQ ID NO: 142788

SEQ ID NO: 261063 - RNA, 64 nt, Homo Sapiens; identical to SEQ ID NO: 142789

SEQ ID NO: 261064 - RNA, 64 nt, Homo Sapiens; identical to SEQ ID NO: 142790

SEQ ID NO: 261065 - RNA, 64 nt, Homo Sapiens; identical to SEQ ID NO: 142791

SEQ ID NO: 261066 - RNA, 64 nt, Homo Sapiens; identical to SEQ ID NO: 142792

SEQ ID NO: 261067 - RNA, 64 nt, Homo Sapiens; identical to SEQ ID NO: 142793

SEQ ID NO: 261068 - RNA, 64 nt, Homo Sapiens; identical to SEQ ID NO: 142794

SEQ ID NO: 261069 - RNA, 64 nt, Homo Sapiens; identical to SEQ ID NO: 142795

SEQ ID NO: 261070 - RNA, 64 nt, Homo Sapiens; identical to SEQ ID NO: 142796

SEQ ID NO: 261071 - RNA, 64 nt, Homo Sapiens; identical to SEQ ID NO: 142797

SEQ ID NO: 261072 - RNA, 64 nt, Homo Sapiens; identical to SEQ ID NO: 142798

SEQ ID NO: 261073 - RNA, 64 nt, Homo Sapiens; identical to SEQ ID NO: 142799

SEQ ID NO: 261074 - RNA, 64 nt, Homo Sapiens; identical to SEQ ID NO: 142800

SEQ ID NO: 261075 - RNA, 64 nt, Homo Sapiens; identical to SEQ ID NO: 142801

SEQ ID NO: 261076 - RNA, 64 nt, Homo Sapiens; identical to SEQ ID NO: 142802

SEQ ID NO: 261077 - RNA, 64 nt, Homo Sapiens; identical to SEQ ID NO: 142803

SEQ ID NO: 261078 - RNA, 64 nt, Homo Sapiens; identical to SEQ ID NO: 142804

SEQ ID NO: 261079 - RNA, 64 nt, Homo Sapiens; identical to SEQ ID NO: 142805

SEQ ID NO: 261080 - RNA, 64 nt, Homo Sapiens; identical to SEQ ID NO: 142806

SEQ ID NO: 261081 - RNA, 64 nt, Homo Sapiens; identical to SEQ ID NO: 142807

SEQ ID NO: 261082 - RNA, 64 nt, Homo Sapiens; identical to SEQ ID NO: 142808

SEQ ID NO: 261083 - RNA, 64 nt, Homo Sapiens; identical to SEQ ID NO: 142809

SEQ ID NO: 261084 - RNA, 64 nt, Homo Sapiens; identical to SEQ ID NO: 142810

SEQ ID NO: 261085 - RNA, 64 nt, Homo Sapiens; identical to SEQ ID NO: 142811

SEQ ID NO: 261086 - RNA, 64 nt, Homo Sapiens; identical to SEQ ID NO: 142812

SEQ ID NO: 261087 - RNA, 64 nt, Homo Sapiens; identical to SEQ ID NO: 142813

SEQ ID NO: 261088 - RNA, 64 nt, Homo Sapiens; identical to SEQ ID NO: 142814

SEQ ID NO: 261089 - RNA, 64 nt, Homo Sapiens; identical to SEQ ID NO: 142815

SEQ ID NO: 261090 - RNA, 64 nt, Homo Sapiens; identical to SEQ ID NO: 142816

SEQ ID NO: 261091 - RNA, 64 nt, Homo Sapiens; identical to SEQ ID NO: 142817

SEQ ID NO: 261092 - RNA, 64 nt, Homo Sapiens; identical to SEQ ID NO: 142818

SEQ ID NO: 261093 - RNA, 64 nt, Homo Sapiens; identical to SEQ ID NO: 142819

SEQ ID NO: 261094 - RNA, 64 nt, Homo Sapiens; identical to SEQ ID NO: 142820

SEQ ID NO: 261095 - RNA, 64 nt, Homo Sapiens; identical to SEQ ID NO: 142821

SEQ ID NO: 261096 - RNA, 64 nt, Homo Sapiens; identical to SEQ ID NO: 142822

SEQ ID NO: 261097 - RNA, 64 nt, Homo Sapiens; identical to SEQ ID NO: 142823

SEQ ID NO: 261098 - RNA, 64 nt, Homo Sapiens; identical to SEQ ID NO: 142824

SEQ ID NO: 261099 - RNA, 64 nt, Homo Sapiens; identical to SEQ ID NO: 142825

SEQ ID NO: 261100 - RNA, 64 nt, Homo Sapiens; identical to SEQ ID NO: 142826

SEQ ID NO: 261101 - RNA, 64 nt, Homo Sapiens; identical to SEQ ID NO: 142827

SEQ ID NO: 261102 - RNA, 64 nt, Homo Sapiens; identical to SEQ ID NO: 142828

SEQ ID NO: 261103 - RNA, 64 nt, Homo Sapiens; identical to SEQ ID NO: 142829

SEQ ID NO: 261104 - RNA, 64 nt, Homo Sapiens; identical to SEQ ID NO: 142830

SEQ ID NO: 261105 - RNA, 64 nt, Homo Sapiens; identical to SEQ ID NO: 142831

SEQ ID NO: 261106 - RNA, 64 nt, Homo Sapiens; identical to SEQ ID NO: 142832

SEQ ID NO: 261107 - RNA, 64 nt, Homo Sapiens; identical to SEQ ID NO: 142833

SEQ ID NO: 261108 - RNA, 64 nt, Homo Sapiens; identical to SEQ ID NO: 142834

SEQ ID NO: 261109 - RNA, 64 nt, Homo Sapiens; identical to SEQ ID NO: 142835

SEQ ID NO: 261110 - RNA, 64 nt, Homo Sapiens; identical to SEQ ID NO: 142836

SEQ ID NO: 261111 - RNA, 64 nt, Homo Sapiens; identical to SEQ ID NO: 142837

SEQ ID NO: 261112 - RNA, 64 nt, Homo Sapiens; identical to SEQ ID NO: 142838

SEQ ID NO: 261113 - RNA, 64 nt, Homo Sapiens; identical to SEQ ID NO: 142839

SEQ ID NO: 261114 - RNA, 64 nt, Homo Sapiens; identical to SEQ ID NO: 142840

SEQ ID NO: 261115 - RNA, 64 nt, Homo Sapiens; identical to SEQ ID NO: 142841

SEQ ID NO: 261116 - RNA, 64 nt, Homo Sapiens; identical to SEQ ID NO: 142842

SEQ ID NO: 261117 - RNA, 64 nt, Homo Sapiens; identical to SEQ ID NO: 142843

SEQ ID NO: 261118 - RNA, 64 nt, Homo Sapiens; identical to SEQ ID NO: 142844

SEQ ID NO: 261119 - RNA, 64 nt, Homo Sapiens; identical to SEQ ID NO: 142845

SEQ ID NO: 261120 - RNA, 64 nt, Homo Sapiens; identical to SEQ ID NO: 142846

SEQ ID NO: 261121 - RNA, 64 nt, Homo Sapiens; identical to SEQ ID NO: 142847

SEQ ID NO: 261122 - RNA, 64 nt, Homo Sapiens; identical to SEQ ID NO: 142848

SEQ ID NO: 261123 - RNA, 64 nt, Homo Sapiens; identical to SEQ ID NO: 142849

SEQ ID NO: 261124 - RNA, 64 nt, Homo Sapiens; identical to SEQ ID NO: 142850

SEQ ID NO: 261125 - RNA, 64 nt, Homo Sapiens; identical to SEQ ID NO: 142851

SEQ ID NO: 261126 - RNA, 64 nt, Homo Sapiens; identical to SEQ ID NO: 142852

SEQ ID NO: 261127 - RNA, 64 nt, Homo Sapiens; identical to SEQ ID NO: 142853

SEQ ID NO: 261128 - RNA, 64 nt, Homo Sapiens; identical to SEQ ID NO: 142854

SEQ ID NO: 261129 - RNA, 64 nt, Homo Sapiens; identical to SEQ ID NO: 142855

SEQ ID NO: 261130 - RNA, 64 nt, Homo Sapiens; identical to SEQ ID NO: 142856

SEQ ID NO: 261131 - RNA, 64 nt, Homo Sapiens; identical to SEQ ID NO: 142857

SEQ ID NO: 261132 - RNA, 64 nt, Homo Sapiens; identical to SEQ ID NO: 142858

SEQ ID NO: 261133 - RNA, 64 nt, Homo Sapiens; identical to SEQ ID NO: 142859

SEQ ID NO: 261134 - RNA, 64 nt, Homo Sapiens; identical to SEQ ID NO: 142860

SEQ ID NO: 261135 - RNA, 64 nt, Homo Sapiens; identical to SEQ ID NO: 142861

SEQ ID NO: 261136 - RNA, 64 nt, Homo Sapiens; identical to SEQ ID NO: 142862

SEQ ID NO: 261137 - RNA, 64 nt, Homo Sapiens; identical to SEQ ID NO: 142863

SEQ ID NO: 261138 - RNA, 64 nt, Homo Sapiens; identical to SEQ ID NO: 142864

SEQ ID NO: 261139 - RNA, 64 nt, Homo Sapiens; identical to SEQ ID NO: 142865

SEQ ID NO: 261140 - RNA, 64 nt, Homo Sapiens; identical to SEQ ID NO: 142866

SEQ ID NO: 261141 - RNA, 64 nt, Homo Sapiens; identical to SEQ ID NO: 142867

SEQ ID NO: 261142 - RNA, 64 nt, Homo Sapiens; identical to SEQ ID NO: 142868

SEQ ID NO: 261143 - RNA, 64 nt, Homo Sapiens; identical to SEQ ID NO: 142869

SEQ ID NO: 261144 - RNA, 64 nt, Homo Sapiens; identical to SEQ ID NO: 142870

SEQ ID NO: 261145 - RNA, 64 nt, Homo Sapiens; identical to SEQ ID NO: 142871

SEQ ID NO: 261146 - RNA, 64 nt, Homo Sapiens; identical to SEQ ID NO: 142872

SEQ ID NO: 261147 - RNA, 64 nt, Homo Sapiens; identical to SEQ ID NO: 142873

SEQ ID NO: 261148 - RNA, 64 nt, Homo Sapiens; identical to SEQ ID NO: 142874

SEQ ID NO: 261149 - RNA, 64 nt, Homo Sapiens; identical to SEQ ID NO: 142875

SEQ ID NO: 261150 - RNA, 64 nt, Homo Sapiens; identical to SEQ ID NO: 142876

SEQ ID NO: 261151 - RNA, 64 nt, Homo Sapiens; identical to SEQ ID NO: 142877

SEQ ID NO: 261152 - RNA, 64 nt, Homo Sapiens; identical to SEQ ID NO: 142878

SEQ ID NO: 261153 - RNA, 64 nt, Homo Sapiens; identical to SEQ ID NO: 142879

SEQ ID NO: 261154 - RNA, 64 nt, Homo Sapiens; identical to SEQ ID NO: 142880

SEQ ID NO: 261155 - RNA, 64 nt, Homo Sapiens; identical to SEQ ID NO: 142881

SEQ ID NO: 261156 - RNA, 64 nt, Homo Sapiens; identical to SEQ ID NO: 142882

SEQ ID NO: 261157 - RNA, 64 nt, Homo Sapiens; identical to SEQ ID NO: 142883

SEQ ID NO: 261158 - RNA, 64 nt, Homo Sapiens; identical to SEQ ID NO: 142884

SEQ ID NO: 261159 - RNA, 64 nt, Homo Sapiens; identical to SEQ ID NO: 142885

SEQ ID NO: 261160 - RNA, 64 nt, Homo Sapiens; identical to SEQ ID NO: 142886

SEQ ID NO: 261161 - RNA, 64 nt, Homo Sapiens; identical to SEQ ID NO: 142887

SEQ ID NO: 261162 - RNA, 64 nt, Homo Sapiens; identical to SEQ ID NO: 142888

SEQ ID NO: 261163 - RNA, 64 nt, Homo Sapiens; identical to SEQ ID NO: 142889

SEQ ID NO: 261164 - RNA, 64 nt, Homo Sapiens; identical to SEQ ID NO: 142890

SEQ ID NO: 261165 - RNA, 64 nt, Homo Sapiens; identical to SEQ ID NO: 142891

SEQ ID NO: 261166 - RNA, 64 nt, Homo Sapiens; identical to SEQ ID NO: 142892

SEQ ID NO: 261167 - RNA, 64 nt, Homo Sapiens; identical to SEQ ID NO: 142893

SEQ ID NO: 261168 - RNA, 64 nt, Homo Sapiens; identical to SEQ ID NO: 142894

SEQ ID NO: 261169 - RNA, 64 nt, Homo Sapiens; identical to SEQ ID NO: 142895

SEQ ID NO: 261170 - RNA, 64 nt, Homo Sapiens; identical to SEQ ID NO: 142896

SEQ ID NO: 261171 - RNA, 64 nt, Homo Sapiens; identical to SEQ ID NO: 142897

SEQ ID NO: 261172 - RNA, 64 nt, Homo Sapiens; identical to SEQ ID NO: 142898

SEQ ID NO: 261173 - RNA, 64 nt, Homo Sapiens; identical to SEQ ID NO: 142899

SEQ ID NO: 261174 - RNA, 64 nt, Homo Sapiens; identical to SEQ ID NO: 142900

SEQ ID NO: 261175 - RNA, 64 nt, Homo Sapiens; identical to SEQ ID NO: 142901

SEQ ID NO: 261176 - RNA, 64 nt, Homo Sapiens; identical to SEQ ID NO: 142902

SEQ ID NO: 261177 - RNA, 64 nt, Homo Sapiens; identical to SEQ ID NO: 142903

SEQ ID NO: 261178 - RNA, 64 nt, Homo Sapiens; identical to SEQ ID NO: 142904

SEQ ID NO: 261179 - RNA, 64 nt, Homo Sapiens; identical to SEQ ID NO: 142905

SEQ ID NO: 261180 - RNA, 64 nt, Homo Sapiens; identical to SEQ ID NO: 142906

SEQ ID NO: 261181 - RNA, 64 nt, Homo Sapiens; identical to SEQ ID NO: 142907

SEQ ID NO: 261182 - RNA, 64 nt, Homo Sapiens; identical to SEQ ID NO: 142908

SEQ ID NO: 261183 - RNA, 64 nt, Homo Sapiens; identical to SEQ ID NO: 142909

SEQ ID NO: 261184 - RNA, 64 nt, Homo Sapiens; identical to SEQ ID NO: 142910

SEQ ID NO: 261185 - RNA, 64 nt, Homo Sapiens; identical to SEQ ID NO: 142911

SEQ ID NO: 261186 - RNA, 64 nt, Homo Sapiens; identical to SEQ ID NO: 142912

SEQ ID NO: 261187 - RNA, 64 nt, Homo Sapiens; identical to SEQ ID NO: 142913

SEQ ID NO: 261188 - RNA, 64 nt, Homo Sapiens; identical to SEQ ID NO: 142914

SEQ ID NO: 261189 - RNA, 64 nt, Homo Sapiens; identical to SEQ ID NO: 142915

SEQ ID NO: 261190 - RNA, 64 nt, Homo Sapiens; identical to SEQ ID NO: 142916

SEQ ID NO: 261191 - RNA, 64 nt, Homo Sapiens; identical to SEQ ID NO: 142917

SEQ ID NO: 261192 - RNA, 64 nt, Homo Sapiens; identical to SEQ ID NO: 142918

SEQ ID NO: 261193 - RNA, 64 nt, Homo Sapiens; identical to SEQ ID NO: 142919

SEQ ID NO: 261194 - RNA, 64 nt, Homo Sapiens; identical to SEQ ID NO: 142920

SEQ ID NO: 261195 - RNA, 64 nt, Homo Sapiens; identical to SEQ ID NO: 142921

SEQ ID NO: 261196 - RNA, 64 nt, Homo Sapiens; identical to SEQ ID NO: 142922

SEQ ID NO: 261197 - RNA, 64 nt, Homo Sapiens; identical to SEQ ID NO: 142923

SEQ ID NO: 261198 - RNA, 64 nt, Homo Sapiens; identical to SEQ ID NO: 142924

SEQ ID NO: 261199 - RNA, 64 nt, Homo Sapiens; identical to SEQ ID NO: 142925

SEQ ID NO: 261200 - RNA, 64 nt, Homo Sapiens; identical to SEQ ID NO: 142926

SEQ ID NO: 261201 - RNA, 64 nt, Homo Sapiens; identical to SEQ ID NO: 142927

SEQ ID NO: 261202 - RNA, 64 nt, Homo Sapiens; identical to SEQ ID NO: 142928

SEQ ID NO: 261203 - RNA, 64 nt, Homo Sapiens; identical to SEQ ID NO: 142929

SEQ ID NO: 261204 - RNA, 64 nt, Homo Sapiens; identical to SEQ ID NO: 142930

SEQ ID NO: 261205 - RNA, 64 nt, Homo Sapiens; identical to SEQ ID NO: 142931

SEQ ID NO: 261206 - RNA, 64 nt, Homo Sapiens; identical to SEQ ID NO: 142932

SEQ ID NO: 261207 - RNA, 64 nt, Homo Sapiens; identical to SEQ ID NO: 142933

SEQ ID NO: 261208 - RNA, 64 nt, Homo Sapiens; identical to SEQ ID NO: 142934

SEQ ID NO: 261209 - RNA, 64 nt, Homo Sapiens; identical to SEQ ID NO: 142935

SEQ ID NO: 261210 - RNA, 64 nt, Homo Sapiens; identical to SEQ ID NO: 142936

SEQ ID NO: 261211 - RNA, 64 nt, Homo Sapiens; identical to SEQ ID NO: 142937

SEQ ID NO: 261212 - RNA, 64 nt, Homo Sapiens; identical to SEQ ID NO: 142938

SEQ ID NO: 261213 - RNA, 64 nt, Homo Sapiens; identical to SEQ ID NO: 142939

SEQ ID NO: 261214 - RNA, 64 nt, Homo Sapiens; identical to SEQ ID NO: 142940

SEQ ID NO: 261215 - RNA, 64 nt, Homo Sapiens; identical to SEQ ID NO: 142941

SEQ ID NO: 261216 - RNA, 64 nt, Homo Sapiens; identical to SEQ ID NO: 142942

SEQ ID NO: 261217 - RNA, 64 nt, Homo Sapiens; identical to SEQ ID NO: 142943

SEQ ID NO: 261218 - RNA, 64 nt, Homo Sapiens; identical to SEQ ID NO: 142944

SEQ ID NO: 261219 - RNA, 64 nt, Homo Sapiens; identical to SEQ ID NO: 142945

SEQ ID NO: 261220 - RNA, 64 nt, Homo Sapiens; identical to SEQ ID NO: 142946

SEQ ID NO: 261221 - RNA, 64 nt, Homo Sapiens; identical to SEQ ID NO: 142947

SEQ ID NO: 261222 - RNA, 64 nt, Homo Sapiens; identical to SEQ ID NO: 142948

SEQ ID NO: 261223 - RNA, 64 nt, Homo Sapiens; identical to SEQ ID NO: 142949

SEQ ID NO: 261224 - RNA, 64 nt, Homo Sapiens; identical to SEQ ID NO: 142950

SEQ ID NO: 261225 - RNA, 64 nt, Homo Sapiens; identical to SEQ ID NO: 142951

SEQ ID NO: 261226 - RNA, 64 nt, Homo Sapiens; identical to SEQ ID NO: 142952

SEQ ID NO: 261227 - RNA, 64 nt, Homo Sapiens; identical to SEQ ID NO: 142953

SEQ ID NO: 261228 - RNA, 64 nt, Homo Sapiens; identical to SEQ ID NO: 142954

SEQ ID NO: 261229 - RNA, 64 nt, Homo Sapiens; identical to SEQ ID NO: 142955

SEQ ID NO: 261230 - RNA, 64 nt, Homo Sapiens; identical to SEQ ID NO: 142956

SEQ ID NO: 261231 - RNA, 64 nt, Homo Sapiens; identical to SEQ ID NO: 142957

SEQ ID NO: 261232 - RNA, 64 nt, Homo Sapiens; identical to SEQ ID NO: 142958

SEQ ID NO: 261233 - RNA, 64 nt, Homo Sapiens; identical to SEQ ID NO: 142959

SEQ ID NO: 261234 - RNA, 64 nt, Homo Sapiens; identical to SEQ ID NO: 142960

SEQ ID NO: 261235 - RNA, 64 nt, Homo Sapiens; identical to SEQ ID NO: 142961

SEQ ID NO: 261236 - RNA, 64 nt, Homo Sapiens; identical to SEQ ID NO: 142962

SEQ ID NO: 261237 - RNA, 64 nt, Homo Sapiens; identical to SEQ ID NO: 142963

SEQ ID NO: 261238 - RNA, 64 nt, Homo Sapiens; identical to SEQ ID NO: 142964

SEQ ID NO: 261239 - RNA, 64 nt, Homo Sapiens; identical to SEQ ID NO: 142965

SEQ ID NO: 261240 - RNA, 64 nt, Homo Sapiens; identical to SEQ ID NO: 142966

SEQ ID NO: 261241 - RNA, 64 nt, Homo Sapiens; identical to SEQ ID NO: 142967

SEQ ID NO: 261242 - RNA, 64 nt, Homo Sapiens; identical to SEQ ID NO: 142968

SEQ ID NO: 261243 - RNA, 64 nt, Homo Sapiens; identical to SEQ ID NO: 142969

SEQ ID NO: 261244 - RNA, 64 nt, Homo Sapiens; identical to SEQ ID NO: 142970

SEQ ID NO: 261245 - RNA, 64 nt, Homo Sapiens; identical to SEQ ID NO: 142971

SEQ ID NO: 261246 - RNA, 64 nt, Homo Sapiens; identical to SEQ ID NO: 142972

SEQ ID NO: 261247 - RNA, 64 nt, Homo Sapiens; identical to SEQ ID NO: 142973

SEQ ID NO: 261248 - RNA, 64 nt, Homo Sapiens; identical to SEQ ID NO: 142974

SEQ ID NO: 261249 - RNA, 64 nt, Homo Sapiens; identical to SEQ ID NO: 142975

SEQ ID NO: 261250 - RNA, 64 nt, Homo Sapiens; identical to SEQ ID NO: 142976

SEQ ID NO: 261251 - RNA, 64 nt, Homo Sapiens; identical to SEQ ID NO: 142977

SEQ ID NO: 261252 - RNA, 64 nt, Homo Sapiens; identical to SEQ ID NO: 142978

SEQ ID NO: 261253 - RNA, 64 nt, Homo Sapiens; identical to SEQ ID NO: 142979

SEQ ID NO: 261254 - RNA, 64 nt, Homo Sapiens; identical to SEQ ID NO: 142980

SEQ ID NO: 261255 - RNA, 64 nt, Homo Sapiens; identical to SEQ ID NO: 142981

SEQ ID NO: 261256 - RNA, 64 nt, Homo Sapiens; identical to SEQ ID NO: 142982

SEQ ID NO: 261257 - RNA, 64 nt, Homo Sapiens; identical to SEQ ID NO: 142983

SEQ ID NO: 261258 - RNA, 64 nt, Homo Sapiens; identical to SEQ ID NO: 142984

SEQ ID NO: 261259 - RNA, 64 nt, Homo Sapiens; identical to SEQ ID NO: 142985

SEQ ID NO: 261260 - RNA, 64 nt, Homo Sapiens; identical to SEQ ID NO: 142986

SEQ ID NO: 261261 - RNA, 64 nt, Homo Sapiens; identical to SEQ ID NO: 142987

SEQ ID NO: 261262 - RNA, 64 nt, Homo Sapiens; identical to SEQ ID NO: 142988

SEQ ID NO: 261263 - RNA, 64 nt, Homo Sapiens; identical to SEQ ID NO: 142989

SEQ ID NO: 261264 - RNA, 64 nt, Homo Sapiens; identical to SEQ ID NO: 142990

SEQ ID NO: 261265 - RNA, 64 nt, Homo Sapiens; identical to SEQ ID NO: 142991

SEQ ID NO: 261266 - RNA, 64 nt, Homo Sapiens; identical to SEQ ID NO: 142992

SEQ ID NO: 261267 - RNA, 64 nt, Homo Sapiens; identical to SEQ ID NO: 142993

SEQ ID NO: 261268 - RNA, 64 nt, Homo Sapiens; identical to SEQ ID NO: 142994

SEQ ID NO: 261269 - RNA, 64 nt, Homo Sapiens; identical to SEQ ID NO: 142995

SEQ ID NO: 261270 - RNA, 64 nt, Homo Sapiens; identical to SEQ ID NO: 142996

SEQ ID NO: 261271 - RNA, 64 nt, Homo Sapiens; identical to SEQ ID NO: 142997

SEQ ID NO: 261272 - RNA, 64 nt, Homo Sapiens; identical to SEQ ID NO: 142998

SEQ ID NO: 261273 - RNA, 64 nt, Homo Sapiens; identical to SEQ ID NO: 142999

SEQ ID NO: 261274 - RNA, 64 nt, Homo Sapiens; identical to SEQ ID NO: 143000

SEQ ID NO: 261275 - RNA, 64 nt, Homo Sapiens; identical to SEQ ID NO: 143001

SEQ ID NO: 261276 - RNA, 64 nt, Homo Sapiens; identical to SEQ ID NO: 143002

SEQ ID NO: 261277 - RNA, 64 nt, Homo Sapiens; identical to SEQ ID NO: 143003

SEQ ID NO: 261278 - RNA, 64 nt, Homo Sapiens; identical to SEQ ID NO: 143004

SEQ ID NO: 261279 - RNA, 64 nt, Homo Sapiens; identical to SEQ ID NO: 143005

SEQ ID NO: 261280 - RNA, 64 nt, Homo Sapiens; identical to SEQ ID NO: 143006

SEQ ID NO: 261281 - RNA, 64 nt, Homo Sapiens; identical to SEQ ID NO: 143007

SEQ ID NO: 261282 - RNA, 64 nt, Homo Sapiens; identical to SEQ ID NO: 143008

SEQ ID NO: 261283 - RNA, 64 nt, Homo Sapiens; identical to SEQ ID NO: 143009

SEQ ID NO: 261284 - RNA, 64 nt, Homo Sapiens; identical to SEQ ID NO: 143010

SEQ ID NO: 261285 - RNA, 64 nt, Homo Sapiens; identical to SEQ ID NO: 143011

SEQ ID NO: 261286 - RNA, 64 nt, Homo Sapiens; identical to SEQ ID NO: 143012

SEQ ID NO: 261287 - RNA, 64 nt, Homo Sapiens; identical to SEQ ID NO: 143013

SEQ ID NO: 261288 - RNA, 64 nt, Homo Sapiens; identical to SEQ ID NO: 143014

SEQ ID NO: 261289 - RNA, 64 nt, Homo Sapiens; identical to SEQ ID NO: 143015

SEQ ID NO: 261290 - RNA, 64 nt, Homo Sapiens; identical to SEQ ID NO: 143016

SEQ ID NO: 261291 - RNA, 64 nt, Homo Sapiens; identical to SEQ ID NO: 143017

SEQ ID NO: 261292 - RNA, 64 nt, Homo Sapiens; identical to SEQ ID NO: 143018

SEQ ID NO: 261293 - RNA, 64 nt, Homo Sapiens; identical to SEQ ID NO: 143019

SEQ ID NO: 261294 - RNA, 64 nt, Homo Sapiens; identical to SEQ ID NO: 143020

SEQ ID NO: 261295 - RNA, 64 nt, Homo Sapiens; identical to SEQ ID NO: 143021

SEQ ID NO: 261296 - RNA, 64 nt, Homo Sapiens; identical to SEQ ID NO: 143022

SEQ ID NO: 261297 - RNA, 64 nt, Homo Sapiens; identical to SEQ ID NO: 143023

SEQ ID NO: 261298 - RNA, 64 nt, Homo Sapiens; identical to SEQ ID NO: 143024

SEQ ID NO: 261299 - RNA, 64 nt, Homo Sapiens; identical to SEQ ID NO: 143025

SEQ ID NO: 261300 - RNA, 64 nt, Homo Sapiens; identical to SEQ ID NO: 143026

SEQ ID NO: 261301 - RNA, 64 nt, Homo Sapiens; identical to SEQ ID NO: 143027

SEQ ID NO: 261302 - RNA, 64 nt, Homo Sapiens; identical to SEQ ID NO: 143028

SEQ ID NO: 261303 - RNA, 64 nt, Homo Sapiens; identical to SEQ ID NO: 143029

SEQ ID NO: 261304 - RNA, 64 nt, Homo Sapiens; identical to SEQ ID NO: 143030

SEQ ID NO: 261305 - RNA, 64 nt, Homo Sapiens; identical to SEQ ID NO: 143031

SEQ ID NO: 261306 - RNA, 64 nt, Homo Sapiens; identical to SEQ ID NO: 143032

SEQ ID NO: 261307 - RNA, 64 nt, Homo Sapiens; identical to SEQ ID NO: 143033

SEQ ID NO: 261308 - RNA, 64 nt, Homo Sapiens; identical to SEQ ID NO: 143034

SEQ ID NO: 261309 - RNA, 64 nt, Homo Sapiens; identical to SEQ ID NO: 143035

SEQ ID NO: 261310 - RNA, 64 nt, Homo Sapiens; identical to SEQ ID NO: 143036

SEQ ID NO: 261311 - RNA, 64 nt, Homo Sapiens; identical to SEQ ID NO: 143037

SEQ ID NO: 261312 - RNA, 64 nt, Homo Sapiens; identical to SEQ ID NO: 143038

SEQ ID NO: 261313 - RNA, 64 nt, Homo Sapiens; identical to SEQ ID NO: 143039

SEQ ID NO: 261314 - RNA, 64 nt, Homo Sapiens; identical to SEQ ID NO: 143040

SEQ ID NO: 261315 - RNA, 64 nt, Homo Sapiens; identical to SEQ ID NO: 143041

SEQ ID NO: 261316 - RNA, 64 nt, Homo Sapiens; identical to SEQ ID NO: 143042

SEQ ID NO: 261317 - RNA, 64 nt, Homo Sapiens; identical to SEQ ID NO: 143043

SEQ ID NO: 261318 - RNA, 64 nt, Homo Sapiens; identical to SEQ ID NO: 143044

SEQ ID NO: 261319 - RNA, 64 nt, Homo Sapiens; identical to SEQ ID NO: 143045

SEQ ID NO: 261320 - RNA, 64 nt, Homo Sapiens; identical to SEQ ID NO: 143046

SEQ ID NO: 261321 - RNA, 64 nt, Homo Sapiens; identical to SEQ ID NO: 143047

SEQ ID NO: 261322 - RNA, 64 nt, Homo Sapiens; identical to SEQ ID NO: 143048

SEQ ID NO: 261323 - RNA, 64 nt, Homo Sapiens; identical to SEQ ID NO: 143049

SEQ ID NO: 261324 - RNA, 64 nt, Homo Sapiens; identical to SEQ ID NO: 143050

SEQ ID NO: 261325 - RNA, 64 nt, Homo Sapiens; identical to SEQ ID NO: 143051

SEQ ID NO: 261326 - RNA, 64 nt, Homo Sapiens; identical to SEQ ID NO: 143052

SEQ ID NO: 261327 - RNA, 64 nt, Homo Sapiens; identical to SEQ ID NO: 143053

SEQ ID NO: 261328 - RNA, 64 nt, Homo Sapiens; identical to SEQ ID NO: 143054

SEQ ID NO: 261329 - RNA, 64 nt, Homo Sapiens; identical to SEQ ID NO: 143055

SEQ ID NO: 261330 - RNA, 64 nt, Homo Sapiens; identical to SEQ ID NO: 143056

SEQ ID NO: 261331 - RNA, 64 nt, Homo Sapiens; identical to SEQ ID NO: 143057

SEQ ID NO: 261332 - RNA, 64 nt, Homo Sapiens; identical to SEQ ID NO: 143058

SEQ ID NO: 261333 - RNA, 64 nt, Homo Sapiens; identical to SEQ ID NO: 143059

SEQ ID NO: 261334 - RNA, 64 nt, Homo Sapiens; identical to SEQ ID NO: 143060

SEQ ID NO: 261335 - RNA, 64 nt, Homo Sapiens; identical to SEQ ID NO: 143061

SEQ ID NO: 261336 - RNA, 64 nt, Homo Sapiens; identical to SEQ ID NO: 143062

SEQ ID NO: 261337 - RNA, 64 nt, Homo Sapiens; identical to SEQ ID NO: 143063

SEQ ID NO: 261338 - RNA, 64 nt, Homo Sapiens; identical to SEQ ID NO: 143064

SEQ ID NO: 261339 - RNA, 64 nt, Homo Sapiens; identical to SEQ ID NO: 143065

SEQ ID NO: 261340 - RNA, 64 nt, Homo Sapiens; identical to SEQ ID NO: 143066

SEQ ID NO: 261341 - RNA, 64 nt, Homo Sapiens; identical to SEQ ID NO: 143067

SEQ ID NO: 261342 - RNA, 64 nt, Homo Sapiens; identical to SEQ ID NO: 143068

SEQ ID NO: 261343 - RNA, 64 nt, Homo Sapiens; identical to SEQ ID NO: 143069

SEQ ID NO: 261344 - RNA, 64 nt, Homo Sapiens; identical to SEQ ID NO: 143070

SEQ ID NO: 261345 - RNA, 64 nt, Homo Sapiens; identical to SEQ ID NO: 143071

SEQ ID NO: 261346 - RNA, 64 nt, Homo Sapiens; identical to SEQ ID NO: 143072

SEQ ID NO: 261347 - RNA, 64 nt, Homo Sapiens; identical to SEQ ID NO: 143073

SEQ ID NO: 261348 - RNA, 64 nt, Homo Sapiens; identical to SEQ ID NO: 143074

SEQ ID NO: 261349 - RNA, 64 nt, Homo Sapiens; identical to SEQ ID NO: 143075

SEQ ID NO: 261350 - RNA, 64 nt, Homo Sapiens; identical to SEQ ID NO: 143076

SEQ ID NO: 261351 - RNA, 64 nt, Homo Sapiens; identical to SEQ ID NO: 143077

SEQ ID NO: 261352 - RNA, 64 nt, Homo Sapiens; identical to SEQ ID NO: 143078

SEQ ID NO: 261353 - RNA, 64 nt, Homo Sapiens; identical to SEQ ID NO: 143079

SEQ ID NO: 261354 - RNA, 64 nt, Homo Sapiens; identical to SEQ ID NO: 143080

SEQ ID NO: 261355 - RNA, 64 nt, Homo Sapiens; identical to SEQ ID NO: 143081

SEQ ID NO: 261356 - RNA, 64 nt, Homo Sapiens; identical to SEQ ID NO: 143082

SEQ ID NO: 261357 - RNA, 64 nt, Homo Sapiens; identical to SEQ ID NO: 143083

SEQ ID NO: 261358 - RNA, 64 nt, Homo Sapiens; identical to SEQ ID NO: 143084

SEQ ID NO: 261359 - RNA, 64 nt, Homo Sapiens; identical to SEQ ID NO: 143085

SEQ ID NO: 261360 - RNA, 64 nt, Homo Sapiens; identical to SEQ ID NO: 143086

SEQ ID NO: 261361 - RNA, 64 nt, Homo Sapiens; identical to SEQ ID NO: 143087

SEQ ID NO: 261362 - RNA, 64 nt, Homo Sapiens; identical to SEQ ID NO: 143088

SEQ ID NO: 261363 - RNA, 64 nt, Homo Sapiens; identical to SEQ ID NO: 143089

SEQ ID NO: 261364 - RNA, 64 nt, Homo Sapiens; identical to SEQ ID NO: 143090

SEQ ID NO: 261365 - RNA, 64 nt, Homo Sapiens; identical to SEQ ID NO: 143091

SEQ ID NO: 261366 - RNA, 64 nt, Homo Sapiens; identical to SEQ ID NO: 143092

SEQ ID NO: 261367 - RNA, 64 nt, Homo Sapiens; identical to SEQ ID NO: 143093

SEQ ID NO: 261368 - RNA, 64 nt, Homo Sapiens; identical to SEQ ID NO: 143094

SEQ ID NO: 261369 - RNA, 64 nt, Homo Sapiens; identical to SEQ ID NO: 143095

SEQ ID NO: 261370 - RNA, 64 nt, Homo Sapiens; identical to SEQ ID NO: 143096

SEQ ID NO: 261371 - RNA, 64 nt, Homo Sapiens; identical to SEQ ID NO: 143097

SEQ ID NO: 261372 - RNA, 64 nt, Homo Sapiens; identical to SEQ ID NO: 143098

SEQ ID NO: 261373 - RNA, 64 nt, Homo Sapiens; identical to SEQ ID NO: 143099

SEQ ID NO: 261374 - RNA, 64 nt, Homo Sapiens; identical to SEQ ID NO: 143100

SEQ ID NO: 261375 - RNA, 64 nt, Homo Sapiens; identical to SEQ ID NO: 143101

SEQ ID NO: 261376 - RNA, 64 nt, Homo Sapiens; identical to SEQ ID NO: 143102

SEQ ID NO: 261377 - RNA, 64 nt, Homo Sapiens; identical to SEQ ID NO: 143103

SEQ ID NO: 261378 - RNA, 64 nt, Homo Sapiens; identical to SEQ ID NO: 143104

SEQ ID NO: 261379 - RNA, 64 nt, Homo Sapiens; identical to SEQ ID NO: 143105

SEQ ID NO: 261380 - RNA, 64 nt, Homo Sapiens; identical to SEQ ID NO: 143106

SEQ ID NO: 261381 - RNA, 64 nt, Homo Sapiens; identical to SEQ ID NO: 143107

SEQ ID NO: 261382 - RNA, 64 nt, Homo Sapiens; identical to SEQ ID NO: 143108

SEQ ID NO: 261383 - RNA, 64 nt, Homo Sapiens; identical to SEQ ID NO: 143109

SEQ ID NO: 261384 - RNA, 64 nt, Homo Sapiens; identical to SEQ ID NO: 143110

SEQ ID NO: 261385 - RNA, 64 nt, Homo Sapiens; identical to SEQ ID NO: 143111

SEQ ID NO: 261386 - RNA, 64 nt, Homo Sapiens; identical to SEQ ID NO: 143112

SEQ ID NO: 261387 - RNA, 64 nt, Homo Sapiens; identical to SEQ ID NO: 143113

SEQ ID NO: 261388 - RNA, 64 nt, Homo Sapiens; identical to SEQ ID NO: 143114

SEQ ID NO: 261389 - RNA, 64 nt, Homo Sapiens; identical to SEQ ID NO: 143115

SEQ ID NO: 261390 - RNA, 64 nt, Homo Sapiens; identical to SEQ ID NO: 143116

SEQ ID NO: 261391 - RNA, 64 nt, Homo Sapiens; identical to SEQ ID NO: 143117

SEQ ID NO: 261392 - RNA, 64 nt, Homo Sapiens; identical to SEQ ID NO: 143118

SEQ ID NO: 261393 - RNA, 64 nt, Homo Sapiens; identical to SEQ ID NO: 143119

SEQ ID NO: 261394 - RNA, 64 nt, Homo Sapiens; identical to SEQ ID NO: 143120

SEQ ID NO: 261395 - RNA, 64 nt, Homo Sapiens; identical to SEQ ID NO: 143121

SEQ ID NO: 261396 - RNA, 64 nt, Homo Sapiens; identical to SEQ ID NO: 143122

SEQ ID NO: 261397 - RNA, 64 nt, Homo Sapiens; identical to SEQ ID NO: 143123

SEQ ID NO: 261398 - RNA, 64 nt, Homo Sapiens; identical to SEQ ID NO: 143124

SEQ ID NO: 261399 - RNA, 64 nt, Homo Sapiens; identical to SEQ ID NO: 143125

SEQ ID NO: 261400 - RNA, 64 nt, Homo Sapiens; identical to SEQ ID NO: 143126

SEQ ID NO: 261401 - RNA, 64 nt, Homo Sapiens; identical to SEQ ID NO: 143127

SEQ ID NO: 261402 - RNA, 64 nt, Homo Sapiens; identical to SEQ ID NO: 143128

SEQ ID NO: 261403 - RNA, 64 nt, Homo Sapiens; identical to SEQ ID NO: 143129

SEQ ID NO: 261404 - RNA, 64 nt, Homo Sapiens; identical to SEQ ID NO: 143130

SEQ ID NO: 261405 - RNA, 64 nt, Homo Sapiens; identical to SEQ ID NO: 143131

SEQ ID NO: 261406 - RNA, 64 nt, Homo Sapiens; identical to SEQ ID NO: 143132

SEQ ID NO: 261407 - RNA, 64 nt, Homo Sapiens; identical to SEQ ID NO: 143133

SEQ ID NO: 261408 - RNA, 64 nt, Homo Sapiens; identical to SEQ ID NO: 143134

SEQ ID NO: 261409 - RNA, 64 nt, Homo Sapiens; identical to SEQ ID NO: 143135

SEQ ID NO: 261410 - RNA, 64 nt, Homo Sapiens; identical to SEQ ID NO: 143136

SEQ ID NO: 261411 - RNA, 64 nt, Homo Sapiens; identical to SEQ ID NO: 143137

SEQ ID NO: 261412 - RNA, 64 nt, Homo Sapiens; identical to SEQ ID NO: 143138

SEQ ID NO: 261413 - RNA, 64 nt, Homo Sapiens; identical to SEQ ID NO: 143139

SEQ ID NO: 261414 - RNA, 64 nt, Homo Sapiens; identical to SEQ ID NO: 143140

SEQ ID NO: 261415 - RNA, 64 nt, Homo Sapiens; identical to SEQ ID NO: 143141

SEQ ID NO: 261416 - RNA, 64 nt, Homo Sapiens; identical to SEQ ID NO: 143142

SEQ ID NO: 261417 - RNA, 64 nt, Homo Sapiens; identical to SEQ ID NO: 143143

SEQ ID NO: 261418 - RNA, 64 nt, Homo Sapiens; identical to SEQ ID NO: 143144

SEQ ID NO: 261419 - RNA, 64 nt, Homo Sapiens; identical to SEQ ID NO: 143145

SEQ ID NO: 261420 - RNA, 64 nt, Homo Sapiens; identical to SEQ ID NO: 143146

SEQ ID NO: 261421 - RNA, 64 nt, Homo Sapiens; identical to SEQ ID NO: 143147

SEQ ID NO: 261422 - RNA, 64 nt, Homo Sapiens; identical to SEQ ID NO: 143148

SEQ ID NO: 261423 - RNA, 64 nt, Homo Sapiens; identical to SEQ ID NO: 143149

SEQ ID NO: 261424 - RNA, 64 nt, Homo Sapiens; identical to SEQ ID NO: 143150

SEQ ID NO: 261425 - RNA, 64 nt, Homo Sapiens; identical to SEQ ID NO: 143151

SEQ ID NO: 261426 - RNA, 64 nt, Homo Sapiens; identical to SEQ ID NO: 143152

SEQ ID NO: 261427 - RNA, 64 nt, Homo Sapiens; identical to SEQ ID NO: 143153

SEQ ID NO: 261428 - RNA, 64 nt, Homo Sapiens; identical to SEQ ID NO: 143154

SEQ ID NO: 261429 - RNA, 64 nt, Homo Sapiens; identical to SEQ ID NO: 143155

SEQ ID NO: 261430 - RNA, 64 nt, Homo Sapiens; identical to SEQ ID NO: 143156

SEQ ID NO: 261431 - RNA, 64 nt, Homo Sapiens; identical to SEQ ID NO: 143157

SEQ ID NO: 261432 - RNA, 64 nt, Homo Sapiens; identical to SEQ ID NO: 143158

SEQ ID NO: 261433 - RNA, 64 nt, Homo Sapiens; identical to SEQ ID NO: 143159

SEQ ID NO: 261434 - RNA, 64 nt, Homo Sapiens; identical to SEQ ID NO: 143160

SEQ ID NO: 261435 - RNA, 64 nt, Homo Sapiens; identical to SEQ ID NO: 143161

SEQ ID NO: 261436 - RNA, 64 nt, Homo Sapiens; identical to SEQ ID NO: 143162

SEQ ID NO: 261437 - RNA, 64 nt, Homo Sapiens; identical to SEQ ID NO: 143163

SEQ ID NO: 261438 - RNA, 64 nt, Homo Sapiens; identical to SEQ ID NO: 143164

SEQ ID NO: 261439 - RNA, 64 nt, Homo Sapiens; identical to SEQ ID NO: 143165

SEQ ID NO: 261440 - RNA, 64 nt, Homo Sapiens; identical to SEQ ID NO: 143166

SEQ ID NO: 261441 - RNA, 64 nt, Homo Sapiens; identical to SEQ ID NO: 143167

SEQ ID NO: 261442 - RNA, 64 nt, Homo Sapiens; identical to SEQ ID NO: 143168

SEQ ID NO: 261443 - RNA, 64 nt, Homo Sapiens; identical to SEQ ID NO: 143169

SEQ ID NO: 261444 - RNA, 64 nt, Homo Sapiens; identical to SEQ ID NO: 143170

SEQ ID NO: 261445 - RNA, 64 nt, Homo Sapiens; identical to SEQ ID NO: 143171

SEQ ID NO: 261446 - RNA, 64 nt, Homo Sapiens; identical to SEQ ID NO: 143172

SEQ ID NO: 261447 - RNA, 64 nt, Homo Sapiens; identical to SEQ ID NO: 143173

SEQ ID NO: 261448 - RNA, 64 nt, Homo Sapiens; identical to SEQ ID NO: 143174

SEQ ID NO: 261449 - RNA, 64 nt, Homo Sapiens; identical to SEQ ID NO: 143175

SEQ ID NO: 261450 - RNA, 64 nt, Homo Sapiens; identical to SEQ ID NO: 143176

SEQ ID NO: 261451 - RNA, 64 nt, Homo Sapiens; identical to SEQ ID NO: 143177

SEQ ID NO: 261452 - RNA, 64 nt, Homo Sapiens; identical to SEQ ID NO: 143178

SEQ ID NO: 261453 - RNA, 64 nt, Homo Sapiens; identical to SEQ ID NO: 143179

SEQ ID NO: 261454 - RNA, 64 nt, Homo Sapiens; identical to SEQ ID NO: 143180

SEQ ID NO: 261455 - RNA, 64 nt, Homo Sapiens; identical to SEQ ID NO: 143181

SEQ ID NO: 261456 - RNA, 64 nt, Homo Sapiens; identical to SEQ ID NO: 143182

SEQ ID NO: 261457 - RNA, 64 nt, Homo Sapiens; identical to SEQ ID NO: 143183

SEQ ID NO: 261458 - RNA, 64 nt, Homo Sapiens; identical to SEQ ID NO: 143184

SEQ ID NO: 261459 - RNA, 64 nt, Homo Sapiens; identical to SEQ ID NO: 143185

SEQ ID NO: 261460 - RNA, 64 nt, Homo Sapiens; identical to SEQ ID NO: 143186

SEQ ID NO: 261461 - RNA, 64 nt, Homo Sapiens; identical to SEQ ID NO: 143187

SEQ ID NO: 261462 - RNA, 64 nt, Homo Sapiens; identical to SEQ ID NO: 143188

SEQ ID NO: 261463 - RNA, 64 nt, Homo Sapiens; identical to SEQ ID NO: 143189

SEQ ID NO: 261464 - RNA, 64 nt, Homo Sapiens; identical to SEQ ID NO: 143190

SEQ ID NO: 261465 - RNA, 64 nt, Homo Sapiens; identical to SEQ ID NO: 143191

SEQ ID NO: 261466 - RNA, 64 nt, Homo Sapiens; identical to SEQ ID NO: 143192

SEQ ID NO: 261467 - RNA, 64 nt, Homo Sapiens; identical to SEQ ID NO: 143193

SEQ ID NO: 261468 - RNA, 64 nt, Homo Sapiens; identical to SEQ ID NO: 143194

SEQ ID NO: 261469 - RNA, 64 nt, Homo Sapiens; identical to SEQ ID NO: 143195

SEQ ID NO: 261470 - RNA, 64 nt, Homo Sapiens; identical to SEQ ID NO: 143196

SEQ ID NO: 261471 - RNA, 64 nt, Homo Sapiens; identical to SEQ ID NO: 143197

SEQ ID NO: 261472 - RNA, 64 nt, Homo Sapiens; identical to SEQ ID NO: 143198

SEQ ID NO: 261473 - RNA, 64 nt, Homo Sapiens; identical to SEQ ID NO: 143199

SEQ ID NO: 261474 - RNA, 64 nt, Homo Sapiens; identical to SEQ ID NO: 143200

SEQ ID NO: 261475 - RNA, 64 nt, Homo Sapiens; identical to SEQ ID NO: 143201

SEQ ID NO: 261476 - RNA, 64 nt, Homo Sapiens; identical to SEQ ID NO: 143202

SEQ ID NO: 261477 - RNA, 64 nt, Homo Sapiens; identical to SEQ ID NO: 143203

SEQ ID NO: 261478 - RNA, 64 nt, Homo Sapiens; identical to SEQ ID NO: 143204

SEQ ID NO: 261479 - RNA, 64 nt, Homo Sapiens; identical to SEQ ID NO: 143205

SEQ ID NO: 261480 - RNA, 64 nt, Homo Sapiens; identical to SEQ ID NO: 143206

SEQ ID NO: 261481 - RNA, 64 nt, Homo Sapiens; identical to SEQ ID NO: 143207

SEQ ID NO: 261482 - RNA, 64 nt, Homo Sapiens; identical to SEQ ID NO: 143208

SEQ ID NO: 261483 - RNA, 64 nt, Homo Sapiens
ugaaaucauccauuuggggacaaauccacauuggggucuagaaacauccacguaucucaucagc

SEQ ID NO: 261484 - RNA, 64 nt, Homo Sapiens
uucaggaaaugaaaggugaauuaugccccuuauuggucuagaagcauugguuuuuuuuugaucc

SEQ ID NO: 261485 - RNA, 64 nt, Homo Sapiens
aaaacaacauuggccuuuuguaucucacaauucuggucuagauucaguuaugaauguaggcauu

SEQ ID NO: 261486 - RNA, 62 nt, Homo Sapiens
aagagaaguuggagcaaugaauguagaauaagggucuagaaaguccucccuggcagcuucuu

SEQ ID NO: 261487 - RNA, 64 nt, Homo Sapiens
uauugccucuuauaucucugcucuuugaccucaaggucuagaggucugcaguaagccaagaaac

SEQ ID NO: 261488 - RNA, 64 nt, Homo Sapiens
gcuuccugagggccaaggcauugcuguaagaaaaggucuagaaauaggugaaagugagaggugg

SEQ ID NO: 261489 - RNA, 64 nt, Homo Sapiens
gaguuggcauuguacagaaauuaacagccauauuggucuagaaacguuaaacuuaauuuuuuuc

SEQ ID NO: 261490 - RNA, 64 nt, Homo Sapiens
uucaugaucccaccauggucauaucuugaaguauggucuagaaaagucccuuauuauuuuauuu

SEQ ID NO: 261491 - RNA, 64 nt, Homo Sapiens
gugugucuuacccagcuacacagggugacauuuuggucuagaaccuagucucaugagcccuuug

SEQ ID NO: 261492 - RNA, 64 nt, Homo Sapiens
cugaggggguugguggauaugaacagacagggggggucuagauuccgauccuggccgaggugag

SEQ ID NO: 261493 - RNA, 64 nt, Homo Sapiens
cugcugggacacuuuucuuguguucuuucugcagggucuagagaccaaauggaguguuggaaaa

SEQ ID NO: 261494 - RNA, 64 nt, Homo Sapiens
uggagcuuaguccagcugguugaaugagccaggaggucuagaacauuuagguagggaggcaugu

SEQ ID NO: 261495 - RNA, 64 nt, Homo Sapiens
cccaagcaguguucuuuucuuuucucccugcucaggucuagaaugucuccuuuagcccgguuug

SEQ ID NO: 261496 - RNA, 64 nt, Homo Sapiens
gccaggccucuacuaggucugaccugguuguccaggucuagaaguaagcagaagacucuccacu

SEQ ID NO: 261497 - RNA, 64 nt, Homo Sapiens
gaugggaaaguagaaaaacauauuuagauuucagggucuagaugaaaguuuuaacugaaauauu

SEQ ID NO: 261498 - RNA, 64 nt, Homo Sapiens
gcacugggaagcucaucagacccucagggaacuuggucuagaaguuccaucuguuuggcuuuuu

SEQ ID NO: 261499 - RNA, 64 nt, Homo Sapiens
uuaguuguacacuuuuaguagucauagugaagcaggucuagaaaauaagccuuuggcagggaaa

SEQ ID NO: 261500 - RNA, 64 nt, Homo Sapiens
acauucucgauccagaggaaacuugcaaggucacggucuagauccaaagagggucgaccugcaa

SEQ ID NO: 261501 - RNA, 64 nt, Homo Sapiens
uguacggucacggucgccucccuagucaggaagcggucuagaagaguauccguccugaacgggg

SEQ ID NO: 261502 - RNA, 64 nt, Homo Sapiens
uagcacagugauaucaccaugacuucacagacauggucuagaaucuguacccuuacccacauau

SEQ ID NO: 261503 - RNA, 64 nt, Homo Sapiens
gaagcccauuccucugccaggcucuaaagccaaaggucuagaaaagcauccugucuggcauuuu

SEQ ID NO: 261504 - RNA, 64 nt, Homo Sapiens
aacauuugccauguugaagaguguguauaggaaaggucuagaaauaaauaggcuugugcauacc

SEQ ID NO: 261505 - RNA, 64 nt, Homo Sapiens
aaugauaccuuuuuuuuuuuuauuggauagcacaggucuagagauguguggcagguggcugccc

SEQ ID NO: 261506 - RNA, 64 nt, Homo Sapiens
uguuaauaaguuagacagaaguuauggaguuaugggucuagacguuuguguuauuucaguaaaa

SEQ ID NO: 261507 - RNA, 64 nt, Homo Sapiens
aggugcuuuacgcaucagcucugaacuaguuggaggucuagauggaggggcacagauugaacug

SEQ ID NO: 261508 - RNA, 64 nt, Homo Sapiens
uuguuaacccaaauguauaacucugcauagacagggucuagauuaguaugaacaauuagucuaa

SEQ ID NO: 261509 - RNA, 64 nt, Homo Sapiens
uucuuuuauauucaagcuaaauuuugauaacguaggucuagagcgcauacauuuauaugaauau

SEQ ID NO: 261510 - RNA, 64 nt, Homo Sapiens
augacacuuauugugguggauaaaggccuaacuuggucuagaauucucacaaaaacuuguaagg

SEQ ID NO: 261511 - RNA, 64 nt, Homo Sapiens
agaagugcaauuuagcuuaaauggguguaugaauggucuagaaacauuucuauuuuuuuuuuaa

SEQ ID NO: 261512 - RNA, 64 nt, Homo Sapiens
aagccuuguuuuuucccagaugaccaguccagcuggucuagagaccacuuuuuacucucccucc

SEQ ID NO: 261513 - RNA, 64 nt, Homo Sapiens
uucauauaauguauuaaagaauauuaauaacucuggucuagauuacuuuuaaggaguaauuuga

SEQ ID NO: 261514 - RNA, 64 nt, Homo Sapiens
cgaucucugagaaguuauguugcaccacugugaaggucuagaugcaagcuuggcucccucagaa

SEQ ID NO: 261515 - RNA, 64 nt, Homo Sapiens
caauagcauaaauguccuuuuuccccccaaauauggucuagaugaguuauuauaaacauuguuu

SEQ ID NO: 261516 - RNA, 64 nt, Homo Sapiens
caccccuuucucauccccauuugcaggggcuaaaggucuagaugagacuuggaaggcaaggagc

SEQ ID NO: 261517 - RNA, 64 nt, Homo Sapiens
aauucaugagagaugaaugacagaugcucucaugggucuagauauugaggaguuuuucugaggg

SEQ ID NO: 261518 - RNA, 64 nt, Homo Sapiens
cucuaucuuguuuuuuguuuuuucuucuggggggggucuagaacagugccuggcacauaguagg

SEQ ID NO: 261519 - RNA, 64 nt, Homo Sapiens
uaaugagucucuuggcccacuggucccacuugggggucuagaccaggauuauagaggacacagc

SEQ ID NO: 261520 - RNA, 64 nt, Homo Sapiens
uacuaaaagcacuuuccauuauauacuuuuuaaaggucuagauaauuuugaaccaauuuauuau

SEQ ID NO: 261521 - RNA, 64 nt, Homo Sapiens
aguagagacagcguuucaccauguuagcuaggauggucuagaucuccugaccuugugaucugcc

SEQ ID NO: 261522 - RNA, 64 nt, Homo Sapiens
aggcuuugggugguuccaaucuccagagcacuuuggucuagacuuuuuuuguuuuguuuuuuuu

SEQ ID NO: 261523 - RNA, 64 nt, Homo Sapiens
gauuuguauuggaugguaacuaaguggaauuaaaggucuagaguguaaggacaguuucgguagu

SEQ ID NO: 261524 - RNA, 64 nt, Homo Sapiens
uuccagcaugagguaucuaaggauuuagaccagaggucuagauuaauacucuauuuuuacauuu

SEQ ID NO: 261525 - RNA, 64 nt, Homo Sapiens
cuaagugcaaacacagcauggguccagaagacguggucuagaccagggcugcucuuuccacuug

SEQ ID NO: 261526 - RNA, 64 nt, Homo Sapiens
cuucccaccuccccuucaguucagagccaaaaugggucuagaaucuggcacuuuacucauuucc

SEQ ID NO: 261527 - RNA, 64 nt, Homo Sapiens
uucagaugagucuuuucaacauggucuucaacauggucuagagcuuaccagugaucuucugauc

SEQ ID NO: 261528 - RNA, 64 nt, Homo Sapiens
uuccuauacucuuguuuccucugcuucuuccugaggucuagaacaaggucuggaaauguuuaga

SEQ ID NO: 261529 - RNA, 64 nt, Homo Sapiens
cuauuuugagaaccacugucaugcuguuguugcuggucuagagauucuagcaaguuuccaggug

SEQ ID NO: 261530 - RNA, 64 nt, Homo Sapiens
agagggagaauggagcaggaggaaaagcagaguuggucuagagaggaggagggcggggcuggag

SEQ ID NO: 261531 - RNA, 64 nt, Homo Sapiens
agaaauccaucaucucuaucccucacucccacagggucuagacuucagucugcaggaauuguua

SEQ ID NO: 261532 - RNA, 64 nt, Homo Sapiens
ugagauccgcgucgggacaggcuuuaaagacagaggucuagacguuagaacgcgcucuacaucc

SEQ ID NO: 261533 - RNA, 64 nt, Homo Sapiens
cgugauuucaagcuauuuucuuaaaagaugaauaggucuagagcuugucgcauguugaccuacg

SEQ ID NO: 261534 - RNA, 64 nt, Homo Sapiens
ugaaaccuggagcugggaauugcggagaagggaaggucuagacuaguuacaucacauagggauu

SEQ ID NO: 261535 - RNA, 64 nt, Homo Sapiens
gaagccgcuucccagacugucagggccaggccugggucuagaauucuugcugcugcuuugcaga

SEQ ID NO: 261536 - RNA, 64 nt, Homo Sapiens
ugagcucagaaaccuacuguggguuggggguggaggucuagaggacccuucuccagagauuaug

SEQ ID NO: 261537 - RNA, 64 nt, Homo Sapiens
aacaacgguuuauucauacucaucuaaagcagcaggucuagaaguuuuugauucugaaguucag

SEQ ID NO: 261538 - RNA, 64 nt, Homo Sapiens
augaauuaagacguuuuaauuucuuugcagacaaggucuagaugcggagucagagaugggacug

SEQ ID NO: 261539 - RNA, 64 nt, Homo Sapiens
aaaauucaaacuucagaaaugaaauccaaagcuuggucuagagugaaaaacaacaaauucaguu

SEQ ID NO: 261540 - RNA, 64 nt, Homo Sapiens
gauguuucauuuuaugaauggaggcacuuuacuaggucuagaauauuuuuuuaaaagccucuga

SEQ ID NO: 261541 - RNA, 64 nt, Homo Sapiens
guugcgaaucuaaaccugggcaucucagcaggucggucuagagauugaaugagagcaguggaca

SEQ ID NO: 261542 - RNA, 64 nt, Homo Sapiens
ucucucaggaugccuuuucuacaggaccugggucggucuagaacccugacccguauagugugcc

SEQ ID NO: 261543 - RNA, 64 nt, Homo Sapiens
gaaggccugcuagcacuagcgcuagcacuagcguggucuagaaucuugaguagaaugaaggccu

SEQ ID NO: 261544 - RNA, 64 nt, Homo Sapiens
gauauaccucuguuuucacgauagaaauaagggaggucuagagcuucuauuccuuggccauugu

SEQ ID NO: 261545 - RNA, 64 nt, Homo Sapiens
ccagaugaggaaauggcaguucugagaagucacuggucuagaucccgcagguggcacgugacag

SEQ ID NO: 261546 - RNA, 64 nt, Homo Sapiens
ucacuguuucuacggcuagacaaauaugacugguggucuagacuacccauaguucauccuccuc

SEQ ID NO: 261547 - RNA, 64 nt, Homo Sapiens
uggacuauucaggugaacuauuugagggguauggggucuagaaguuaaaagauacgcaugucuu

SEQ ID NO: 261548 - RNA, 64 nt, Homo Sapiens
cuauuccuaggccucaggccgugggucagggaggggucuagagggccccagggaacuaaagggu

SEQ ID NO: 261549 - RNA, 64 nt, Homo Sapiens
gaaaugauucaaauuuuuucguuugaaaugaaauggucuagaggcuagacuaaacaaaguauaa

SEQ ID NO: 261550 - RNA, 64 nt, Homo Sapiens
cuugccacuaaauauugauccaauuuccaggguuggucuagaguuuaauuucacaaacaucagg

SEQ ID NO: 261551 - RNA, 64 nt, Homo Sapiens
caaaauacuccaagaaaaagaaacuguaguaguuggucuagaaaaucaacauuuuuugugcuuu

SEQ ID NO: 261552 - RNA, 64 nt, Homo Sapiens
gacuuucuaggagaagacuaauauccuaguguccggucuagaaaccacaguguaaugauuacaa

SEQ ID NO: 261553 - RNA, 64 nt, Homo Sapiens
acugcaguauugauguuuuacugcaaaucuuaugggucuagauaaucaguaaaagccaucuucc

SEQ ID NO: 261554 - RNA, 64 nt, Homo Sapiens
cguucucccaaguaccauucgucauccaaguccaggucuagaucacacucaaaagcaaagcauu

SEQ ID NO: 261555 - RNA, 64 nt, Homo Sapiens
uaaucuugaccuugacuuugccucccaagugacuggucuagaaacuggggaugaaaucccacau

SEQ ID NO: 261556 - RNA, 64 nt, Homo Sapiens
ggguuugcuauaggguuugcacgccaagguuuaaggucuagauacuuuaaauucucaguuauca

SEQ ID NO: 261557 - RNA, 64 nt, Homo Sapiens
uuuucguuuccacugaggcucauuaaugguaaauggucuagaagcugaaagaauguagccucug

SEQ ID NO: 261558 - RNA, 64 nt, Homo Sapiens
gggaacuggagaggacccugugagaaaaucccugggucuagaaugacaguuaucccagggagcg

SEQ ID NO: 261559 - RNA, 64 nt, Homo Sapiens
uaucuaggcuuagggagcccccauggucagcucuggucuagauguucccuuccuuuuugcaggc

SEQ ID NO: 261560 - RNA, 64 nt, Homo Sapiens
uccugcucuuaauaaaauuaugucauuagaggaaggucuagauugugaggguggauuauuggau

SEQ ID NO: 261561 - RNA, 64 nt, Homo Sapiens
acugauguuucaauuuacccuacauuuccugacuggucuagagaagcuuauaaagcacaaagca

SEQ ID NO: 261562 - RNA, 64 nt, Homo Sapiens
gaacccucuaucagccucagcuuauuuggagccgggucuagaggauuuuggcuugugagcccug

SEQ ID NO: 261563 - RNA, 64 nt, Homo Sapiens
ucuuguugcuuuuguauuaggaguuccccgugugggucuagaacuccccuuugguaaugcuucu

SEQ ID NO: 261564 - RNA, 64 nt, Homo Sapiens
ugcugauugguacauaaaucuuuuacauggccuuggucuagaggaggcaggcuuuuagaaucau

SEQ ID NO: 261565 - RNA, 64 nt, Homo Sapiens
auugaaaaacuauuuuuugauuuuugcauuaaguggucuagaauucuuuugcaaugcauuugca

SEQ ID NO: 261566 - RNA, 64 nt, Homo Sapiens
ugaucaguuggccaccucuagaucuguguuugccggucuagacguuaucggugcacuuccuuga

SEQ ID NO: 261567 - RNA, 64 nt, Homo Sapiens
cugggauauguuuacuauaaggaaaagacacugaggucuagaaauagcuccguggagcagaauc

SEQ ID NO: 261568 - RNA, 64 nt, Homo Sapiens
ugcuuaaacuauugaaaauacauuuuuccuaagaggucuagaaaaaauucauuguauugaucag

SEQ ID NO: 261569 - RNA, 64 nt, Homo Sapiens
cucuaaaaacuaaccaaacuuuaauuugauaauaggucuagagaacauaaguaaccauugaaca

SEQ ID NO: 261570 - RNA, 64 nt, Homo Sapiens
accagcuugcgaauaacagugcuuccagcuaacaggucuagaaaccagaaauggugcucaccau

SEQ ID NO: 261571 - RNA, 64 nt, Homo Sapiens
uauucaucuaguccccugggggaggggaagggugggucuagacauacuauauucagagaacuau

SEQ ID NO: 261572 - RNA, 64 nt, Homo Sapiens
cacuaaccccgcauugcuguacgucagugccaucggucuagaacauuucugcccugagcccucc

SEQ ID NO: 261573 - RNA, 64 nt, Homo Sapiens
ucgcugcuagagaagggggauuggagggaagacaggucuagacuuucucagugggacaaaccag

SEQ ID NO: 261574 - RNA, 64 nt, Homo Sapiens
caugcccagcuggcauuuguuaaucuucauuugaggucuagaucuaggcacuguggacacugaa

SEQ ID NO: 261575 - RNA, 64 nt, Homo Sapiens
uuuuuuuagggcuugugcccuguuucacuuauagggucuagaaugcuuguguugaguaaaaagg

SEQ ID NO: 261576 - RNA, 64 nt, Homo Sapiens
aaaaaggaaagguucuuccaggcgagaaaccuguggucuagaaccacagcaagaagaggaggca

SEQ ID NO: 261577 - RNA, 64 nt, Homo Sapiens
uugacccccuugagggugcucuuuuauuacauggggucuagaacacaucuggccuugaaaccac

SEQ ID NO: 261578 - RNA, 64 nt, Homo Sapiens
cagccaaccauaaucagcaugucugggauagacuggucuagaauaaaaaugaaguuuccauugc

SEQ ID NO: 261579 - RNA, 64 nt, Homo Sapiens
ugguauuucggaaacuaaaguccuuaugggauggggucuagaauugauucuccuuuccugaguu

SEQ ID NO: 261580 - RNA, 64 nt, Homo Sapiens
cccaccccacccuugucccuggccauugccugguggucuagaaacacuuaaaacuugaaguagu

SEQ ID NO: 261581 - RNA, 64 nt, Homo Sapiens
gaagacgggcucccuccucccccaccuggccccuggucuagaaggacccacugcaccacccucc

SEQ ID NO: 261582 - RNA, 64 nt, Homo Sapiens
auguucuaaguuucuaagauucuaaagguccacaggucuagacuauuaggugcaauuucaaggu

SEQ ID NO: 261583 - RNA, 64 nt, Homo Sapiens
ccuuuuauuuucccccuuuucacagagaaauaaaggucuagaaguaguugguccucuggccuua

SEQ ID NO: 261584 - RNA, 64 nt, Homo Sapiens
gcggcuccugaaggucccuuucccagagacccugggucuagaaaagagggugugggaugaggcu

SEQ ID NO: 261585 - RNA, 64 nt, Homo Sapiens
gaagaauacugaccugagagcucuccuugguuuaggucuagaaaaagcaggguuuucauuuuua

SEQ ID NO: 261586 - RNA, 64 nt, Homo Sapiens
ccugugguccccuggagccuggcgcuugaccacuggucuagagcgggaguaggcggacagccag

SEQ ID NO: 261587 - RNA, 64 nt, Homo Sapiens
ccugaaauccugguuccuagaagaggaggaggagggucuagaggaaguuaaagugaggccacug

SEQ ID NO: 261588 - RNA, 64 nt, Homo Sapiens
agggacucuccaaacgggauacaggagagaagcuggucuagacuguuugcugauccccaaccug

SEQ ID NO: 261589 - RNA, 64 nt, Homo Sapiens
agcuuuuuuucuugcuaguauucgcuguguucauggucuagaaaugcggucuggucucgccucg

SEQ ID NO: 261590 - RNA, 64 nt, Homo Sapiens
uuguaagcacugacugggaccaggcaccaggcagggucuagaaggcuguggugagggaagacgc

SEQ ID NO: 261591 - RNA, 64 nt, Homo Sapiens
gaaggaagugauccacagcauucaggccacuuggggucuagaccaugguggugccagccugggg

SEQ ID NO: 261592 - RNA, 64 nt, Homo Sapiens
uugaugccuggguggagggcgguacacaggauugggucuagaccggcuggcccagcugacugag

SEQ ID NO: 261593 - RNA, 64 nt, Homo Sapiens
uugugggcagcauggacaguugagcaggcugcauggucuagaggcauucucugccagggaccca

SEQ ID NO: 261594 - RNA, 64 nt, Homo Sapiens
uggacggggcucuuuugcuucccccucaaucuggggucuagaguugugcaaggaauucagcucc

SEQ ID NO: 261595 - RNA, 64 nt, Homo Sapiens
agggccgucuccauuuuaugguugaggaaacugaggucuagagaggucaagauuacuugcccag

SEQ ID NO: 261596 - RNA, 64 nt, Homo Sapiens
guauucagguccaagguucugcccuuccuugaguggucuagaaggcacugcguggccccucaga

SEQ ID NO: 261597 - RNA, 64 nt, Homo Sapiens
ccucagagcucacaugauaggaaacuaugcaaauggucuagauuuuuucuguaacuacagcuug

SEQ ID NO: 261598 - RNA, 64 nt, Homo Sapiens
gggauagaauuuuuauuucagacccagucuggaaggucuagaggacugacagcagcuccuucug

SEQ ID NO: 261599 - RNA, 64 nt, Homo Sapiens
guuccauuacaccacagcauuguguggaauuugaggucuagagagaaccaauaaaagugguaau

SEQ ID NO: 261600 - RNA, 62 nt, Homo Sapiens
uaugauucuauggagcuauuuuaaaccaauugcaggucuagauaccuccuucucagcacuau

SEQ ID NO: 261601 - RNA, 64 nt, Homo Sapiens
cauguaaaaucuggugauacugaauaaagucuguggucuagauagcaguauaauauuauuguca

SEQ ID NO: 261602 - RNA, 64 nt, Homo Sapiens
ggauuuuucccggagccggaaggcuuaccugcuuggucuagaauuuacuucuagucagucaucc

SEQ ID NO: 261603 - RNA, 64 nt, Homo Sapiens
ccugacuguugugaaggccaaggggcagccagacuugccagaggggucucuccccauagccaca

SEQ ID NO: 261604 - RNA, 64 nt, Homo Sapiens
acacgcucggcugcccaaacccaaggcgaagaccuugccagaguucaucaaggauggcuccagu

SEQ ID NO: 261605 - RNA, 64 nt, Homo Sapiens
uuaagaugauaagaaagugcuccugagaaggcucuugccagaagccugaugugaguguguggca

SEQ ID NO: 261606 - RNA, 64 nt, Homo Sapiens
uaucuuugagaugauaaagcuaaauuauagucuuuugccagagaaacugagguaacugucauua

SEQ ID NO: 261607 - RNA, 64 nt, Homo Sapiens
ugagacuugaguagcauuugugacgguggggagguugccagauggcagacuggucaauggggga

SEQ ID NO: 261608 - RNA, 64 nt, Homo Sapiens
augggaaggcaaggaagaagcagcccccaggucuuugccagaugcagccuuucuacuugaucuc

SEQ ID NO: 261609 - RNA, 64 nt, Homo Sapiens
ggggguggggggauugggguggacucaggguaucuugccagagauaccuguuuugaugaguacc

SEQ ID NO: 261610 - RNA, 64 nt, Homo Sapiens
cccacccgguguguccagaagaccagccucuuucuugccagaagcaggugcuaagauggacugc

SEQ ID NO: 261611 - RNA, 64 nt, Homo Sapiens
ugcucugcucguggccccaaagaaccaucucuacuugccagaguauguuccaccacccaagcag

SEQ ID NO: 261612 - RNA, 64 nt, Homo Sapiens
agagcccucagccauuuuuucaguuaaaguuagguugccagaacuuucuuuuccuugcccccug

SEQ ID NO: 261613 - RNA, 64 nt, Homo Sapiens
cacucacaguuuccuucauggcgggaaacggggcuugccagagaagcugccuggaacagagccu

SEQ ID NO: 261614 - RNA, 64 nt, Homo Sapiens
ugaaagucacuggaacuugcaaucuuaggauuuguugccagauuuuguugcaggaggggguggg

SEQ ID NO: 261615 - RNA, 64 nt, Homo Sapiens
accagagcugugaucucucgguggggggcccaucucugcugaccuggguguggcggagggagag

SEQ ID NO: 261616 - RNA, 64 nt, Homo Sapiens
gcucagucacguccacgggggacgagccguggguucugcugaguagguggagcucauugcuuuc

SEQ ID NO: 261617 - RNA, 64 nt, Homo Sapiens
ucaaacugcucaaagugacggguucuugguugucucugcugagcacgcugugucaauggagaug

SEQ ID NO: 261618 - RNA, 64 nt, Homo Sapiens
cucugcugagcacgcugugucaauggagauggccucugcugacucagaugaagacccaaggcau

SEQ ID NO: 261619 - RNA, 64 nt, Homo Sapiens
cauaaguggacuuugcuuuuccugcccgcuuaccucugcugaagggaggagguggugccaggag

SEQ ID NO: 261620 - RNA, 64 nt, Homo Sapiens
uggagucauguuuuguggggguguuugucuuuguucugcugauguaggaagucagaaaagacuu

SEQ ID NO: 261621 - RNA, 64 nt, Homo Sapiens
gcacacaugaaaagccaaauuauggcuuggauguucugcugaaacuggucuaugucauacuguc

SEQ ID NO: 261622 - RNA, 64 nt, Homo Sapiens
accucgggauugguaucaaaggcuuccacugccuucugcugaaggcaugauguaugcggcucca

SEQ ID NO: 261623 - RNA, 64 nt, Homo Sapiens
cgucuaucugcuucugugcugaacgccuuucccaucugcugacguaggcccagggcugcccugc

SEQ ID NO: 261624 - RNA, 64 nt, Homo Sapiens
ccucgggccugagggccaggccggagcccaggucucugcugacaauggggguucaaggaagacg

SEQ ID NO: 261625 - RNA, 64 nt, Homo Sapiens
cacuuuccccuggcugcuguuguaaucuacuuguucugcugacgcccgaacugacuucuuuccc

SEQ ID NO: 261626 - RNA, 64 nt, Homo Sapiens
cugcuucuucuauauuaugagccuuccucaagugucugcugauucuugguuauccaaucauagu

SEQ ID NO: 261627 - RNA, 64 nt, Homo Sapiens
gugcccuacucuuugcaccuauccuugugaaauaucugcugauuagaagggaaaagcaaaaauu

SEQ ID NO: 261628 - RNA, 64 nt, Homo Sapiens
uucgguccuggcaaacauuggagcagaggaaaacucugcugaugagggagugagacauuuuugg

SEQ ID NO: 261629 - RNA, 64 nt, Homo Sapiens
ggcccugugggauccuccguguuccucggcggacucugcugaccuccugcagacccaaaccaca

SEQ ID NO: 261630 - RNA, 64 nt, Homo Sapiens
cgggguaguacugggaagcaggaggcagaauggcucugcugagccuccuacccaugacaacacc

SEQ ID NO: 261631 - RNA, 64 nt, Homo Sapiens
ggguaaagcaagaaccugaacauuuuggagccuuucugcugagcuagaccaucuuuauaacacu

SEQ ID NO: 261632 - RNA, 64 nt, Homo Sapiens
aaaggcacuaguuuuaagugcacagcucauaaauucugcugacauuuuggauuaaccuuaugua

SEQ ID NO: 261633 - RNA, 64 nt, Homo Sapiens
acccccccagcuucacuucuucccuuccaccugcucugcugauggcccaaucccugaucccuga

SEQ ID NO: 261634 - RNA, 64 nt, Homo Sapiens
ccgaccuggccugucugugaaggaggccuugggcucugcugaguccacccuguuuugagcccug

SEQ ID NO: 261635 - RNA, 64 nt, Homo Sapiens
accuaauaauauaagucuuacauuacuguucuauacauaugaaaccagugggaacaauacacug

SEQ ID NO: 261636 - RNA, 64 nt, Homo Sapiens
uguguauaugccuaugguaugaauauuuuaauguacauaugacaguuucuuguguauccuuuca

SEQ ID NO: 261637 - RNA, 64 nt, Homo Sapiens
aaucauucuguccaauccagccaagguucccuccacauaugaagauggaccauggcaggauaca

SEQ ID NO: 261638 - RNA, 64 nt, Homo Sapiens
guggcaccauguauuagcagugggaauauguaucacauaugaugcagccuuucauauuucagca

SEQ ID NO: 261639 - RNA, 64 nt, Homo Sapiens
uccuaauaccaucacauugaggauuaggauuuuaacauaugaauuuugggggggaugcaaucau

SEQ ID NO: 261640 - RNA, 64 nt, Homo Sapiens
gauacccuacaccaaccagauuuucaacugcuggacauaugaaugaagcuauccuaggcaugca

SEQ ID NO: 261641 - RNA, 64 nt, Homo Sapiens
aagaaaaaagugauuuaacuauguaauguaaaagacauaugagcgcugccuagcauacaucagu

SEQ ID NO: 261642 - RNA, 64 nt, Homo Sapiens
accaccuaaaaauacacugagagaaaaauaaugaacauaugaaugauauagucacugaaucaau

SEQ ID NO: 261643 - RNA, 64 nt, Homo Sapiens
cuuuccaagaugaacuugaacccauucaaagaggacauaugauuguuaccucaguggcuaccaa

SEQ ID NO: 261644 - RNA, 64 nt, Homo Sapiens
cuuuccaagaugaacuugaacucauucaaagaagacauaugacuagcaauggaaaagcaguuac

SEQ ID NO: 261645 - RNA, 64 nt, Homo Sapiens
ggcccugagcccacggaaaaggccagguagaccuccaaacuagaaaugcuggcugauuugcccu

SEQ ID NO: 261646 - RNA, 64 nt, Homo Sapiens
ggucagauuuauuucagucagugcaagucacacuccaaacuaaaggcugggcagugcguuuagu

SEQ ID NO: 261647 - RNA, 64 nt, Homo Sapiens
ugaguaacaaaauaaaguaguauuggguuauaacccaaacuauauaauaaauauuuacaagccc

SEQ ID NO: 261648 - RNA, 64 nt, Homo Sapiens
uauaacccaaacuauauaauaaauauuuacaagcccaaacuaauauaaaugauugaaugggaac

SEQ ID NO: 261649 - RNA, 64 nt, Homo Sapiens
uauuaacuuguagauucaguguuauucugccauaacagauuaugucuuuggggaaaaauucuug

SEQ ID NO: 261650 - RNA, 64 nt, Homo Sapiens
aacuggggggaccaaauagcuccaguuccaggacacagauuaucuauuuuccaccuuuuguuuu

SEQ ID NO: 261651 - RNA, 64 nt, Homo Sapiens
aggugcaauuaucacauuguuuauuaauuguauaacagauuauuacuagaaagguuuuuguugc

SEQ ID NO: 261652 - RNA, 64 nt, Homo Sapiens
gaaaaauaaggucaggagaaaaagaauaaugccuacagauuauccuucagaugcuggcuagaau

SEQ ID NO: 261653 - RNA, 64 nt, Homo Sapiens
auaaguauuauuaauaaaauacauacuaaagggaacagauuaaaacgaggggaacuguauaaag

SEQ ID NO: 261654 - RNA, 64 nt, Homo Sapiens
uaguggcuuuuaaauuguaguuacaaaauaaaaaacagauuaauaaaugucuauaucuuguuac

SEQ ID NO: 261655 - RNA, 64 nt, Homo Sapiens
guacccugcguuuugucuucaggggaagcaauucacagauuaauccacagcaucagcaugguuu

SEQ ID NO: 261656 - RNA, 64 nt, Homo Sapiens
cuaauuucuguagucgcauugguuuaucauguuuacagauuaaguaguaaauguauguuuacag

SEQ ID NO: 261657 - RNA, 64 nt, Homo Sapiens
guaggaauggaagaugguaucuuuuauaugcuaaacagauuagaaaauuaacauaggauacuuu

SEQ ID NO: 261658 - RNA, 64 nt, Homo Sapiens
uauaaucauucccuuaaaaaguuggaaaaucauuacagauuaaaauuucuuuauaaaguucacc

SEQ ID NO: 261659 - RNA, 61 nt, Homo Sapiens
ggcucuccagaaccuucuaucccacagucaggccccagagagggcaggacaagccuugucc

SEQ ID NO: 261660 - RNA, 61 nt, Homo Sapiens
cugggauuacaggugugagcuacugcgcccagccccagaaaucucagugcuguuuggagcu

SEQ ID NO: 261661 - RNA, 61 nt, Homo Sapiens
ccugcagucagcucggccuccccgaccugcagccccagacucugcucucccagcacugacu

SEQ ID NO: 261662 - RNA, 61 nt, Homo Sapiens
caguucuggguuaucuccucucauacaucaagccccagaggaggcggcaagaggaacagcc

SEQ ID NO: 261663 - RNA, 61 nt, Homo Sapiens
gauuuuacauuugcucuuuucaccaugccccgccccagaugcugggauuacaggcgugagc

SEQ ID NO: 261664 - RNA, 61 nt, Homo Sapiens
gcaagagaggaagacuauuugacguaccuaugccccagaagcaggaagccuugcgagaagg

SEQ ID NO: 261665 - RNA, 61 nt, Homo Sapiens
ccccgacgaggagggguaugcaggcuggcaggccccagagcugguggagggcaucucacuc

SEQ ID NO: 261666 - RNA, 61 nt, Homo Sapiens
uugacaacugcucguguacaggcaccccacagccccagagcauggggcacagcaggcaugc

SEQ ID NO: 261667 - RNA, 61 nt, Homo Sapiens
gccccaccgcagcccaguagggaugcagcacgccccagagggcucaugugggccccagaug

SEQ ID NO: 261668 - RNA, 61 nt, Homo Sapiens
ggaugcagcacgccccagagggcucaugugggccccagauggcaaugccaccauuguugau

SEQ ID NO: 261669 - RNA, 61 nt, Homo Sapiens
auggccucccugaugaucaccaccaaggguagccccagaggggagcuccgagggcagguag

SEQ ID NO: 261670 - RNA, 61 nt, Homo Sapiens
cuguucccgcugcacggcccaccggcggccagccccagagaccagaacugauccagagcug

SEQ ID NO: 261671 - RNA, 61 nt, Homo Sapiens
cuuccaaguaugugacguaguccugaaccacgccccagacuuccgccgggucuaccugccu

SEQ ID NO: 261672 - RNA, 61 nt, Homo Sapiens
cugaagaacaagcugcucauggcaagggcuggccccagaacccugcaagagaggccuucug

SEQ ID NO: 261673 - RNA, 61 nt, Homo Sapiens
gggugggcuuccugcccuucccuggccccaggccccagacaagaagccuccaagcacagag

SEQ ID NO: 261674 - RNA, 61 nt, Homo Sapiens
ggcccaccguggcacuagaacaccagcccccgccccagaguagaugucuucccugggcugc

SEQ ID NO: 261675 - RNA, 61 nt, Homo Sapiens
ggcggaugcuggauccggagccccagguuccgccccagagcgguccuggacaaggccagac

SEQ ID NO: 261676 - RNA, 61 nt, Homo Sapiens
agcauccaucugguggccaaagagaaucguagccccagagcugcccaaguucacugggcuc

SEQ ID NO: 261677 - RNA, 61 nt, Homo Sapiens
ccaggacccgccagccccgcucccaccuagugccccagacugagcucuccaggccaggugg

SEQ ID NO: 261678 - RNA, 61 nt, Homo Sapiens
ggcuaguggggugaacagcuggugccaaauagccccagacugggcccaggcaggucugcaa

SEQ ID NO: 261679 - RNA, 61 nt, Homo Sapiens
caaaggcuggccuguguguacagcugugcgugccccagacaaaguuucugggagaugcccg

SEQ ID NO: 261680 - RNA, 61 nt, Homo Sapiens
gggaagucuccccgcuggagcggcucugccagccccagauuccugcccucccugccggagc

SEQ ID NO: 261681 - RNA, 61 nt, Homo Sapiens
augggggggaggggggcguguuucugggccugccccagacacugcccuuggcugccagccu

SEQ ID NO: 261682 - RNA, 61 nt, Homo Sapiens
uaggaguucuugcuucuugcguugauacuuugccccagaaaggccugggauucauucuggu

SEQ ID NO: 261683 - RNA, 61 nt, Homo Sapiens
aaccaauaagaauccucuauugcccaccccagccccagagaacaaaugaagagaaaagcca

SEQ ID NO: 261684 - RNA, 61 nt, Homo Sapiens
ccugucccccacacccagggccagaucgcuggccccagaacaauucagaacgugccucuuu

SEQ ID NO: 261685 - RNA, 61 nt, Homo Sapiens
uugaggcaaagccaggccguagacaccugaggccccagagcaucuuuguuugcaucuccag

SEQ ID NO: 261686 - RNA, 61 nt, Homo Sapiens
ccaccugaucugcaucuuuggccaacucagugccccagaccucuccucaucuguggagcaa

SEQ ID NO: 261687 - RNA, 61 nt, Homo Sapiens
cuucucucuggaggaagagguacugagcaaggccccagaucagaccacccuccaugucagg

SEQ ID NO: 261688 - RNA, 61 nt, Homo Sapiens
gaucuuccuggaugccaacgugugccuuccggccccagaagacacugguuccccacugccc

SEQ ID NO: 261689 - RNA, 61 nt, Homo Sapiens
aagccaaaccugcugccacagcccucccccggccccagauagcagccccagggaggaugcu

SEQ ID NO: 261690 - RNA, 61 nt, Homo Sapiens
aaccaaggagcuggggcccaaggccaguccugccccagagacacuccaaguccgccagggg

SEQ ID NO: 261691 - RNA, 61 nt, Homo Sapiens
ggccucugggcuugggcaccagcucaugccagccccagagggucaggguuggaggccugug

SEQ ID NO: 261692 - RNA, 61 nt, Homo Sapiens
auggugucaugccaagacaguaucagacacagccccagaagggggcauuaugggcccugcc

SEQ ID NO: 261693 - RNA, 61 nt, Homo Sapiens
gacuccgacucuccgcugggaggcgucacuggccccagaguuugggauucuugucagcggg

SEQ ID NO: 261694 - RNA, 61 nt, Homo Sapiens
uagauuuuaugcuugggccucuccaccgccagccccagaguagcccccucccucaccuucc

SEQ ID NO: 261695 - RNA, 61 nt, Homo Sapiens
gguugaaacccugcacauccucccagggccagccccagaaugggccuuucucugccugccc

SEQ ID NO: 261696 - RNA, 61 nt, Homo Sapiens
auuuucaagacaaacuggaguaagaauuaaagccccagaggauuuaauuauccugguuugc

SEQ ID NO: 261697 - RNA, 61 nt, Homo Sapiens
augccucagggucucugaaaucucccgggaagccccagagcuuuccugaggcugccuggcc

SEQ ID NO: 261698 - RNA, 61 nt, Homo Sapiens
uuccucuccauccgccaccuccccucccgcugccccagaaguuucuaucauuccauggaga

SEQ ID NO: 261699 - RNA, 61 nt, Homo Sapiens
ccggcuaaaggacccugcacgcgucuucccagccccagaaaacacaguguuucauugcucc

SEQ ID NO: 261700 - RNA, 61 nt, Homo Sapiens
ccacauggccaccagccccacuccaaggcuugccccagaggaggcaggggcugggccaggg

SEQ ID NO: 261701 - RNA, 61 nt, Homo Sapiens
cucccucacccucucggcccccccagacccugccccagacgggcccaggcaggagguccca

SEQ ID NO: 261702 - RNA, 61 nt, Homo Sapiens
cguuaagggacugguuggcccacagcgacaugccccagacacacggacagacgcagacgga

SEQ ID NO: 261703 - RNA, 61 nt, Homo Sapiens
cccgagagaaaguguuaacauugagacucuggccccagauugguaucuucuaugaagaugg

SEQ ID NO: 261704 - RNA, 61 nt, Homo Sapiens
cuuuccaaaugugguuaaauguaauugguuagccccagacuugggcuagagcagaaggcau

SEQ ID NO: 261705 - RNA, 64 nt, Homo Sapiens; identical to SEQ ID NO: 261649

SEQ ID NO: 261706 - RNA, 64 nt, Homo Sapiens; identical to SEQ ID NO: 261650

SEQ ID NO: 261707 - RNA, 64 nt, Homo Sapiens; identical to SEQ ID NO: 261651

SEQ ID NO: 261708 - RNA, 64 nt, Homo Sapiens; identical to SEQ ID NO: 261652

SEQ ID NO: 261709 - RNA, 64 nt, Homo Sapiens; identical to SEQ ID NO: 261653

SEQ ID NO: 261710 - RNA, 64 nt, Homo Sapiens; identical to SEQ ID NO: 261654

SEQ ID NO: 261711 - RNA, 64 nt, Homo Sapiens; identical to SEQ ID NO: 261655

SEQ ID NO: 261712 - RNA, 64 nt, Homo Sapiens; identical to SEQ ID NO: 261656

SEQ ID NO: 261713 - RNA, 64 nt, Homo Sapiens; identical to SEQ ID NO: 261657

SEQ ID NO: 261714 - RNA, 64 nt, Homo Sapiens; identical to SEQ ID NO: 261658

SEQ ID NO: 261715 - RNA, 61 nt, Homo Sapiens; identical to SEQ ID NO: 261659

SEQ ID NO: 261716 - RNA, 61 nt, Homo Sapiens; identical to SEQ ID NO: 261660

SEQ ID NO: 261717 - RNA, 61 nt, Homo Sapiens; identical to SEQ ID NO: 261661

SEQ ID NO: 261718 - RNA, 61 nt, Homo Sapiens; identical to SEQ ID NO: 261662

SEQ ID NO: 261719 - RNA, 61 nt, Homo Sapiens; identical to SEQ ID NO: 261663

SEQ ID NO: 261720 - RNA, 61 nt, Homo Sapiens; identical to SEQ ID NO: 261664

SEQ ID NO: 261721 - RNA, 61 nt, Homo Sapiens; identical to SEQ ID NO: 261665

SEQ ID NO: 261722 - RNA, 61 nt, Homo Sapiens; identical to SEQ ID NO: 261666

SEQ ID NO: 261723 - RNA, 61 nt, Homo Sapiens; identical to SEQ ID NO: 261667

SEQ ID NO: 261724 - RNA, 61 nt, Homo Sapiens; identical to SEQ ID NO: 261668

SEQ ID NO: 261725 - RNA, 61 nt, Homo Sapiens; identical to SEQ ID NO: 261669

SEQ ID NO: 261726 - RNA, 61 nt, Homo Sapiens; identical to SEQ ID NO: 261670

SEQ ID NO: 261727 - RNA, 61 nt, Homo Sapiens; identical to SEQ ID NO: 261671

SEQ ID NO: 261728 - RNA, 61 nt, Homo Sapiens; identical to SEQ ID NO: 261672

SEQ ID NO: 261729 - RNA, 61 nt, Homo Sapiens; identical to SEQ ID NO: 261673

SEQ ID NO: 261730 - RNA, 61 nt, Homo Sapiens; identical to SEQ ID NO: 261674

SEQ ID NO: 261731 - RNA, 61 nt, Homo Sapiens; identical to SEQ ID NO: 261675

SEQ ID NO: 261732 - RNA, 61 nt, Homo Sapiens; identical to SEQ ID NO: 261676

SEQ ID NO: 261733 - RNA, 61 nt, Homo Sapiens; identical to SEQ ID NO: 261677

SEQ ID NO: 261734 - RNA, 61 nt, Homo Sapiens; identical to SEQ ID NO: 261678

SEQ ID NO: 261735 - RNA, 61 nt, Homo Sapiens; identical to SEQ ID NO: 261679

SEQ ID NO: 261736 - RNA, 61 nt, Homo Sapiens; identical to SEQ ID NO: 261680

SEQ ID NO: 261737 - RNA, 61 nt, Homo Sapiens; identical to SEQ ID NO: 261681

SEQ ID NO: 261738 - RNA, 61 nt, Homo Sapiens; identical to SEQ ID NO: 261682

SEQ ID NO: 261739 - RNA, 61 nt, Homo Sapiens; identical to SEQ ID NO: 261683

SEQ ID NO: 261740 - RNA, 61 nt, Homo Sapiens; identical to SEQ ID NO: 261684

SEQ ID NO: 261741 - RNA, 61 nt, Homo Sapiens; identical to SEQ ID NO: 261685

SEQ ID NO: 261742 - RNA, 61 nt, Homo Sapiens; identical to SEQ ID NO: 261686

SEQ ID NO: 261743 - RNA, 61 nt, Homo Sapiens; identical to SEQ ID NO: 261687

SEQ ID NO: 261744 - RNA, 61 nt, Homo Sapiens; identical to SEQ ID NO: 261688

SEQ ID NO: 261745 - RNA, 61 nt, Homo Sapiens; identical to SEQ ID NO: 261689

SEQ ID NO: 261746 - RNA, 61 nt, Homo Sapiens; identical to SEQ ID NO: 261690

SEQ ID NO: 261747 - RNA, 61 nt, Homo Sapiens; identical to SEQ ID NO: 261691

SEQ ID NO: 261748 - RNA, 61 nt, Homo Sapiens; identical to SEQ ID NO: 261692

SEQ ID NO: 261749 - RNA, 61 nt, Homo Sapiens; identical to SEQ ID NO: 261693

SEQ ID NO: 261750 - RNA, 61 nt, Homo Sapiens; identical to SEQ ID NO: 261694

SEQ ID NO: 261751 - RNA, 61 nt, Homo Sapiens; identical to SEQ ID NO: 261695

SEQ ID NO: 261752 - RNA, 61 nt, Homo Sapiens; identical to SEQ ID NO: 261696

SEQ ID NO: 261753 - RNA, 61 nt, Homo Sapiens; identical to SEQ ID NO: 261697

SEQ ID NO: 261754 - RNA, 61 nt, Homo Sapiens; identical to SEQ ID NO: 261698

SEQ ID NO: 261755 - RNA, 61 nt, Homo Sapiens; identical to SEQ ID NO: 261699

SEQ ID NO: 261756 - RNA, 61 nt, Homo Sapiens; identical to SEQ ID NO: 261700

SEQ ID NO: 261757 - RNA, 61 nt, Homo Sapiens; identical to SEQ ID NO: 261701

SEQ ID NO: 261758 - RNA, 61 nt, Homo Sapiens; identical to SEQ ID NO: 261702

SEQ ID NO: 261759 - RNA, 61 nt, Homo Sapiens; identical to SEQ ID NO: 261703

SEQ ID NO: 261760 - RNA, 61 nt, Homo Sapiens; identical to SEQ ID NO: 261704

SEQ ID NO: 261761 - RNA, 64 nt, Homo Sapiens; identical to SEQ ID NO: 261649

SEQ ID NO: 261762 - RNA, 64 nt, Homo Sapiens; identical to SEQ ID NO: 261650

SEQ ID NO: 261763 - RNA, 64 nt, Homo Sapiens; identical to SEQ ID NO: 261651

SEQ ID NO: 261764 - RNA, 64 nt, Homo Sapiens; identical to SEQ ID NO: 261652

SEQ ID NO: 261765 - RNA, 64 nt, Homo Sapiens; identical to SEQ ID NO: 261653

SEQ ID NO: 261766 - RNA, 64 nt, Homo Sapiens; identical to SEQ ID NO: 261654

SEQ ID NO: 261767 - RNA, 64 nt, Homo Sapiens; identical to SEQ ID NO: 261655

SEQ ID NO: 261768 - RNA, 64 nt, Homo Sapiens; identical to SEQ ID NO: 261656

SEQ ID NO: 261769 - RNA, 64 nt, Homo Sapiens; identical to SEQ ID NO: 261657

SEQ ID NO: 261770 - RNA, 64 nt, Homo Sapiens; identical to SEQ ID NO: 261658

SEQ ID NO: 261771 - RNA, 61 nt, Homo Sapiens; identical to SEQ ID NO: 261659

SEQ ID NO: 261772 - RNA, 61 nt, Homo Sapiens; identical to SEQ ID NO: 261660

SEQ ID NO: 261773 - RNA, 61 nt, Homo Sapiens; identical to SEQ ID NO: 261661

SEQ ID NO: 261774 - RNA, 61 nt, Homo Sapiens; identical to SEQ ID NO: 261662

SEQ ID NO: 261775 - RNA, 61 nt, Homo Sapiens; identical to SEQ ID NO: 261663

SEQ ID NO: 261776 - RNA, 61 nt, Homo Sapiens; identical to SEQ ID NO: 261664

SEQ ID NO: 261777 - RNA, 61 nt, Homo Sapiens; identical to SEQ ID NO: 261665

SEQ ID NO: 261778 - RNA, 61 nt, Homo Sapiens; identical to SEQ ID NO: 261666

SEQ ID NO: 261779 - RNA, 61 nt, Homo Sapiens; identical to SEQ ID NO: 261667

SEQ ID NO: 261780 - RNA, 61 nt, Homo Sapiens; identical to SEQ ID NO: 261668

SEQ ID NO: 261781 - RNA, 61 nt, Homo Sapiens; identical to SEQ ID NO: 261669

SEQ ID NO: 261782 - RNA, 61 nt, Homo Sapiens; identical to SEQ ID NO: 261670

SEQ ID NO: 261783 - RNA, 61 nt, Homo Sapiens; identical to SEQ ID NO: 261671

SEQ ID NO: 261784 - RNA, 61 nt, Homo Sapiens; identical to SEQ ID NO: 261672

SEQ ID NO: 261785 - RNA, 61 nt, Homo Sapiens; identical to SEQ ID NO: 261673

SEQ ID NO: 261786 - RNA, 61 nt, Homo Sapiens; identical to SEQ ID NO: 261674

SEQ ID NO: 261787 - RNA, 61 nt, Homo Sapiens; identical to SEQ ID NO: 261675

SEQ ID NO: 261788 - RNA, 61 nt, Homo Sapiens; identical to SEQ ID NO: 261676

SEQ ID NO: 261789 - RNA, 61 nt, Homo Sapiens; identical to SEQ ID NO: 261677

SEQ ID NO: 261790 - RNA, 61 nt, Homo Sapiens; identical to SEQ ID NO: 261678

SEQ ID NO: 261791 - RNA, 61 nt, Homo Sapiens; identical to SEQ ID NO: 261679

SEQ ID NO: 261792 - RNA, 61 nt, Homo Sapiens; identical to SEQ ID NO: 261680

SEQ ID NO: 261793 - RNA, 61 nt, Homo Sapiens; identical to SEQ ID NO: 261681

SEQ ID NO: 261794 - RNA, 61 nt, Homo Sapiens; identical to SEQ ID NO: 261682

SEQ ID NO: 261795 - RNA, 61 nt, Homo Sapiens; identical to SEQ ID NO: 261683

SEQ ID NO: 261796 - RNA, 61 nt, Homo Sapiens; identical to SEQ ID NO: 261684

SEQ ID NO: 261797 - RNA, 61 nt, Homo Sapiens; identical to SEQ ID NO: 261685

SEQ ID NO: 261798 - RNA, 61 nt, Homo Sapiens; identical to SEQ ID NO: 261686

SEQ ID NO: 261799 - RNA, 61 nt, Homo Sapiens; identical to SEQ ID NO: 261687

SEQ ID NO: 261800 - RNA, 61 nt, Homo Sapiens; identical to SEQ ID NO: 261688

SEQ ID NO: 261801 - RNA, 61 nt, Homo Sapiens; identical to SEQ ID NO: 261689

SEQ ID NO: 261802 - RNA, 61 nt, Homo Sapiens; identical to SEQ ID NO: 261690

SEQ ID NO: 261803 - RNA, 61 nt, Homo Sapiens; identical to SEQ ID NO: 261691

SEQ ID NO: 261804 - RNA, 61 nt, Homo Sapiens; identical to SEQ ID NO: 261692

SEQ ID NO: 261805 - RNA, 61 nt, Homo Sapiens; identical to SEQ ID NO: 261693

SEQ ID NO: 261806 - RNA, 61 nt, Homo Sapiens; identical to SEQ ID NO: 261694

SEQ ID NO: 261807 - RNA, 61 nt, Homo Sapiens; identical to SEQ ID NO: 261695

SEQ ID NO: 261808 - RNA, 61 nt, Homo Sapiens; identical to SEQ ID NO: 261696

SEQ ID NO: 261809 - RNA, 61 nt, Homo Sapiens; identical to SEQ ID NO: 261697

SEQ ID NO: 261810 - RNA, 61 nt, Homo Sapiens; identical to SEQ ID NO: 261698

SEQ ID NO: 261811 - RNA, 61 nt, Homo Sapiens; identical to SEQ ID NO: 261699

SEQ ID NO: 261812 - RNA, 61 nt, Homo Sapiens; identical to SEQ ID NO: 261700

SEQ ID NO: 261813 - RNA, 61 nt, Homo Sapiens; identical to SEQ ID NO: 261701

SEQ ID NO: 261814 - RNA, 61 nt, Homo Sapiens; identical to SEQ ID NO: 261702

SEQ ID NO: 261815 - RNA, 61 nt, Homo Sapiens; identical to SEQ ID NO: 261703

SEQ ID NO: 261816 - RNA, 61 nt, Homo Sapiens; identical to SEQ ID NO: 261704

SEQ ID NO: 261817 - RNA, 64 nt, Homo Sapiens; identical to SEQ ID NO: 261649

SEQ ID NO: 261818 - RNA, 64 nt, Homo Sapiens; identical to SEQ ID NO: 261650

SEQ ID NO: 261819 - RNA, 64 nt, Homo Sapiens; identical to SEQ ID NO: 261651

SEQ ID NO: 261820 - RNA, 64 nt, Homo Sapiens; identical to SEQ ID NO: 261652

SEQ ID NO: 261821 - RNA, 64 nt, Homo Sapiens; identical to SEQ ID NO: 261653

SEQ ID NO: 261822 - RNA, 64 nt, Homo Sapiens; identical to SEQ ID NO: 261654

SEQ ID NO: 261823 - RNA, 64 nt, Homo Sapiens; identical to SEQ ID NO: 261655

SEQ ID NO: 261824 - RNA, 64 nt, Homo Sapiens; identical to SEQ ID NO: 261656

SEQ ID NO: 261825 - RNA, 64 nt, Homo Sapiens; identical to SEQ ID NO: 261657

SEQ ID NO: 261826 - RNA, 64 nt, Homo Sapiens; identical to SEQ ID NO: 261658

SEQ ID NO: 261827 - RNA, 61 nt, Homo Sapiens; identical to SEQ ID NO: 261659

SEQ ID NO: 261828 - RNA, 61 nt, Homo Sapiens; identical to SEQ ID NO: 261660

SEQ ID NO: 261829 - RNA, 61 nt, Homo Sapiens; identical to SEQ ID NO: 261661

SEQ ID NO: 261830 - RNA, 61 nt, Homo Sapiens; identical to SEQ ID NO: 261662

SEQ ID NO: 261831 - RNA, 61 nt, Homo Sapiens; identical to SEQ ID NO: 261663

SEQ ID NO: 261832 - RNA, 61 nt, Homo Sapiens; identical to SEQ ID NO: 261664

SEQ ID NO: 261833 - RNA, 61 nt, Homo Sapiens; identical to SEQ ID NO: 261665

SEQ ID NO: 261834 - RNA, 61 nt, Homo Sapiens; identical to SEQ ID NO: 261666

SEQ ID NO: 261835 - RNA, 61 nt, Homo Sapiens; identical to SEQ ID NO: 261667

SEQ ID NO: 261836 - RNA, 61 nt, Homo Sapiens; identical to SEQ ID NO: 261668

SEQ ID NO: 261837 - RNA, 61 nt, Homo Sapiens; identical to SEQ ID NO: 261669

SEQ ID NO: 261838 - RNA, 61 nt, Homo Sapiens; identical to SEQ ID NO: 261670

SEQ ID NO: 261839 - RNA, 61 nt, Homo Sapiens; identical to SEQ ID NO: 261671

SEQ ID NO: 261840 - RNA, 61 nt, Homo Sapiens; identical to SEQ ID NO: 261672

SEQ ID NO: 261841 - RNA, 61 nt, Homo Sapiens; identical to SEQ ID NO: 261673

SEQ ID NO: 261842 - RNA, 61 nt, Homo Sapiens; identical to SEQ ID NO: 261674

SEQ ID NO: 261843 - RNA, 61 nt, Homo Sapiens; identical to SEQ ID NO: 261675

SEQ ID NO: 261844 - RNA, 61 nt, Homo Sapiens; identical to SEQ ID NO: 261676

SEQ ID NO: 261845 - RNA, 61 nt, Homo Sapiens; identical to SEQ ID NO: 261677

SEQ ID NO: 261846 - RNA, 61 nt, Homo Sapiens; identical to SEQ ID NO: 261678

SEQ ID NO: 261847 - RNA, 61 nt, Homo Sapiens; identical to SEQ ID NO: 261679

SEQ ID NO: 261848 - RNA, 61 nt, Homo Sapiens; identical to SEQ ID NO: 261680

SEQ ID NO: 261849 - RNA, 61 nt, Homo Sapiens; identical to SEQ ID NO: 261681

SEQ ID NO: 261850 - RNA, 61 nt, Homo Sapiens; identical to SEQ ID NO: 261682

SEQ ID NO: 261851 - RNA, 61 nt, Homo Sapiens; identical to SEQ ID NO: 261683

SEQ ID NO: 261852 - RNA, 61 nt, Homo Sapiens; identical to SEQ ID NO: 261684

SEQ ID NO: 261853 - RNA, 61 nt, Homo Sapiens; identical to SEQ ID NO: 261685

SEQ ID NO: 261854 - RNA, 61 nt, Homo Sapiens; identical to SEQ ID NO: 261686

SEQ ID NO: 261855 - RNA, 61 nt, Homo Sapiens; identical to SEQ ID NO: 261687

SEQ ID NO: 261856 - RNA, 61 nt, Homo Sapiens; identical to SEQ ID NO: 261688

SEQ ID NO: 261857 - RNA, 61 nt, Homo Sapiens; identical to SEQ ID NO: 261689

SEQ ID NO: 261858 - RNA, 61 nt, Homo Sapiens; identical to SEQ ID NO: 261690

SEQ ID NO: 261859 - RNA, 61 nt, Homo Sapiens; identical to SEQ ID NO: 261691

SEQ ID NO: 261860 - RNA, 61 nt, Homo Sapiens; identical to SEQ ID NO: 261692

SEQ ID NO: 261861 - RNA, 61 nt, Homo Sapiens; identical to SEQ ID NO: 261693

SEQ ID NO: 261862 - RNA, 61 nt, Homo Sapiens; identical to SEQ ID NO: 261694

SEQ ID NO: 261863 - RNA, 61 nt, Homo Sapiens; identical to SEQ ID NO: 261695

SEQ ID NO: 261864 - RNA, 61 nt, Homo Sapiens; identical to SEQ ID NO: 261696

SEQ ID NO: 261865 - RNA, 61 nt, Homo Sapiens; identical to SEQ ID NO: 261697

SEQ ID NO: 261866 - RNA, 61 nt, Homo Sapiens; identical to SEQ ID NO: 261698

SEQ ID NO: 261867 - RNA, 61 nt, Homo Sapiens; identical to SEQ ID NO: 261699

SEQ ID NO: 261868 - RNA, 61 nt, Homo Sapiens; identical to SEQ ID NO: 261700

SEQ ID NO: 261869 - RNA, 61 nt, Homo Sapiens; identical to SEQ ID NO: 261701

SEQ ID NO: 261870 - RNA, 61 nt, Homo Sapiens; identical to SEQ ID NO: 261702

SEQ ID NO: 261871 - RNA, 61 nt, Homo Sapiens; identical to SEQ ID NO: 261703

SEQ ID NO: 261872 - RNA, 61 nt, Homo Sapiens; identical to SEQ ID NO: 261704

SEQ ID NO: 261873 - RNA, 64 nt, Homo Sapiens; identical to SEQ ID NO: 261649

SEQ ID NO: 261874 - RNA, 64 nt, Homo Sapiens; identical to SEQ ID NO: 261650

SEQ ID NO: 261875 - RNA, 64 nt, Homo Sapiens; identical to SEQ ID NO: 261651

SEQ ID NO: 261876 - RNA, 64 nt, Homo Sapiens; identical to SEQ ID NO: 261652

SEQ ID NO: 261877 - RNA, 64 nt, Homo Sapiens; identical to SEQ ID NO: 261653

SEQ ID NO: 261878 - RNA, 64 nt, Homo Sapiens; identical to SEQ ID NO: 261654

SEQ ID NO: 261879 - RNA, 64 nt, Homo Sapiens; identical to SEQ ID NO: 261655

SEQ ID NO: 261880 - RNA, 64 nt, Homo Sapiens; identical to SEQ ID NO: 261656

SEQ ID NO: 261881 - RNA, 64 nt, Homo Sapiens; identical to SEQ ID NO: 261657

SEQ ID NO: 261882 - RNA, 64 nt, Homo Sapiens; identical to SEQ ID NO: 261658

SEQ ID NO: 261883 - RNA, 61 nt, Homo Sapiens; identical to SEQ ID NO: 261659

SEQ ID NO: 261884 - RNA, 61 nt, Homo Sapiens; identical to SEQ ID NO: 261660

SEQ ID NO: 261885 - RNA, 61 nt, Homo Sapiens; identical to SEQ ID NO: 261661

SEQ ID NO: 261886 - RNA, 61 nt, Homo Sapiens; identical to SEQ ID NO: 261662

SEQ ID NO: 261887 - RNA, 61 nt, Homo Sapiens; identical to SEQ ID NO: 261663

SEQ ID NO: 261888 - RNA, 61 nt, Homo Sapiens; identical to SEQ ID NO: 261664

SEQ ID NO: 261889 - RNA, 61 nt, Homo Sapiens; identical to SEQ ID NO: 261665

SEQ ID NO: 261890 - RNA, 61 nt, Homo Sapiens; identical to SEQ ID NO: 261666

SEQ ID NO: 261891 - RNA, 61 nt, Homo Sapiens; identical to SEQ ID NO: 261667

SEQ ID NO: 261892 - RNA, 61 nt, Homo Sapiens; identical to SEQ ID NO: 261668

SEQ ID NO: 261893 - RNA, 61 nt, Homo Sapiens; identical to SEQ ID NO: 261669

SEQ ID NO: 261894 - RNA, 61 nt, Homo Sapiens; identical to SEQ ID NO: 261670

SEQ ID NO: 261895 - RNA, 61 nt, Homo Sapiens; identical to SEQ ID NO: 261671

SEQ ID NO: 261896 - RNA, 61 nt, Homo Sapiens; identical to SEQ ID NO: 261672

SEQ ID NO: 261897 - RNA, 61 nt, Homo Sapiens; identical to SEQ ID NO: 261673

SEQ ID NO: 261898 - RNA, 61 nt, Homo Sapiens; identical to SEQ ID NO: 261674

SEQ ID NO: 261899 - RNA, 61 nt, Homo Sapiens; identical to SEQ ID NO: 261675

SEQ ID NO: 261900 - RNA, 61 nt, Homo Sapiens; identical to SEQ ID NO: 261676

SEQ ID NO: 261901 - RNA, 61 nt, Homo Sapiens; identical to SEQ ID NO: 261677

SEQ ID NO: 261902 - RNA, 61 nt, Homo Sapiens; identical to SEQ ID NO: 261678

SEQ ID NO: 261903 - RNA, 61 nt, Homo Sapiens; identical to SEQ ID NO: 261679

SEQ ID NO: 261904 - RNA, 61 nt, Homo Sapiens; identical to SEQ ID NO: 261680

SEQ ID NO: 261905 - RNA, 61 nt, Homo Sapiens; identical to SEQ ID NO: 261681

SEQ ID NO: 261906 - RNA, 61 nt, Homo Sapiens; identical to SEQ ID NO: 261682

SEQ ID NO: 261907 - RNA, 61 nt, Homo Sapiens; identical to SEQ ID NO: 261683

SEQ ID NO: 261908 - RNA, 61 nt, Homo Sapiens; identical to SEQ ID NO: 261684

SEQ ID NO: 261909 - RNA, 61 nt, Homo Sapiens; identical to SEQ ID NO: 261685

SEQ ID NO: 261910 - RNA, 61 nt, Homo Sapiens; identical to SEQ ID NO: 261686

SEQ ID NO: 261911 - RNA, 61 nt, Homo Sapiens; identical to SEQ ID NO: 261687

SEQ ID NO: 261912 - RNA, 61 nt, Homo Sapiens; identical to SEQ ID NO: 261688

SEQ ID NO: 261913 - RNA, 61 nt, Homo Sapiens; identical to SEQ ID NO: 261689

SEQ ID NO: 261914 - RNA, 61 nt, Homo Sapiens; identical to SEQ ID NO: 261690

SEQ ID NO: 261915 - RNA, 61 nt, Homo Sapiens; identical to SEQ ID NO: 261691

SEQ ID NO: 261916 - RNA, 61 nt, Homo Sapiens; identical to SEQ ID NO: 261692

SEQ ID NO: 261917 - RNA, 61 nt, Homo Sapiens; identical to SEQ ID NO: 261693

SEQ ID NO: 261918 - RNA, 61 nt, Homo Sapiens; identical to SEQ ID NO: 261694

SEQ ID NO: 261919 - RNA, 61 nt, Homo Sapiens; identical to SEQ ID NO: 261695

SEQ ID NO: 261920 - RNA, 61 nt, Homo Sapiens; identical to SEQ ID NO: 261696

SEQ ID NO: 261921 - RNA, 61 nt, Homo Sapiens; identical to SEQ ID NO: 261697

SEQ ID NO: 261922 - RNA, 61 nt, Homo Sapiens; identical to SEQ ID NO: 261698

SEQ ID NO: 261923 - RNA, 61 nt, Homo Sapiens; identical to SEQ ID NO: 261699

SEQ ID NO: 261924 - RNA, 61 nt, Homo Sapiens; identical to SEQ ID NO: 261700

SEQ ID NO: 261925 - RNA, 61 nt, Homo Sapiens; identical to SEQ ID NO: 261701

SEQ ID NO: 261926 - RNA, 61 nt, Homo Sapiens; identical to SEQ ID NO: 261702

SEQ ID NO: 261927 - RNA, 61 nt, Homo Sapiens; identical to SEQ ID NO: 261703

SEQ ID NO: 261928 - RNA, 61 nt, Homo Sapiens; identical to SEQ ID NO: 261704

SEQ ID NO: 261929 - RNA, 64 nt, Homo Sapiens; identical to SEQ ID NO: 261649

SEQ ID NO: 261930 - RNA, 64 nt, Homo Sapiens; identical to SEQ ID NO: 261650

SEQ ID NO: 261931 - RNA, 64 nt, Homo Sapiens; identical to SEQ ID NO: 261651

SEQ ID NO: 261932 - RNA, 64 nt, Homo Sapiens; identical to SEQ ID NO: 261652

SEQ ID NO: 261933 - RNA, 64 nt, Homo Sapiens; identical to SEQ ID NO: 261653

SEQ ID NO: 261934 - RNA, 64 nt, Homo Sapiens; identical to SEQ ID NO: 261654

SEQ ID NO: 261935 - RNA, 64 nt, Homo Sapiens; identical to SEQ ID NO: 261655

SEQ ID NO: 261936 - RNA, 64 nt, Homo Sapiens; identical to SEQ ID NO: 261656

SEQ ID NO: 261937 - RNA, 64 nt, Homo Sapiens; identical to SEQ ID NO: 261657

SEQ ID NO: 261938 - RNA, 64 nt, Homo Sapiens; identical to SEQ ID NO: 261658

SEQ ID NO: 261939 - RNA, 61 nt, Homo Sapiens; identical to SEQ ID NO: 261659

SEQ ID NO: 261940 - RNA, 61 nt, Homo Sapiens; identical to SEQ ID NO: 261660

SEQ ID NO: 261941 - RNA, 61 nt, Homo Sapiens; identical to SEQ ID NO: 261661

SEQ ID NO: 261942 - RNA, 61 nt, Homo Sapiens; identical to SEQ ID NO: 261662

SEQ ID NO: 261943 - RNA, 61 nt, Homo Sapiens; identical to SEQ ID NO: 261663

SEQ ID NO: 261944 - RNA, 61 nt, Homo Sapiens; identical to SEQ ID NO: 261664

SEQ ID NO: 261945 - RNA, 61 nt, Homo Sapiens; identical to SEQ ID NO: 261665

SEQ ID NO: 261946 - RNA, 61 nt, Homo Sapiens; identical to SEQ ID NO: 261666

SEQ ID NO: 261947 - RNA, 61 nt, Homo Sapiens; identical to SEQ ID NO: 261667

SEQ ID NO: 261948 - RNA, 61 nt, Homo Sapiens; identical to SEQ ID NO: 261668

SEQ ID NO: 261949 - RNA, 61 nt, Homo Sapiens; identical to SEQ ID NO: 261669

SEQ ID NO: 261950 - RNA, 61 nt, Homo Sapiens; identical to SEQ ID NO: 261670

SEQ ID NO: 261951 - RNA, 61 nt, Homo Sapiens; identical to SEQ ID NO: 261671

SEQ ID NO: 261952 - RNA, 61 nt, Homo Sapiens; identical to SEQ ID NO: 261672

SEQ ID NO: 261953 - RNA, 61 nt, Homo Sapiens; identical to SEQ ID NO: 261673

SEQ ID NO: 261954 - RNA, 61 nt, Homo Sapiens; identical to SEQ ID NO: 261674

SEQ ID NO: 261955 - RNA, 61 nt, Homo Sapiens; identical to SEQ ID NO: 261675

SEQ ID NO: 261956 - RNA, 61 nt, Homo Sapiens; identical to SEQ ID NO: 261676

SEQ ID NO: 261957 - RNA, 61 nt, Homo Sapiens; identical to SEQ ID NO: 261677

SEQ ID NO: 261958 - RNA, 61 nt, Homo Sapiens; identical to SEQ ID NO: 261678

SEQ ID NO: 261959 - RNA, 61 nt, Homo Sapiens; identical to SEQ ID NO: 261679

SEQ ID NO: 261960 - RNA, 61 nt, Homo Sapiens; identical to SEQ ID NO: 261680

SEQ ID NO: 261961 - RNA, 61 nt, Homo Sapiens; identical to SEQ ID NO: 261681

SEQ ID NO: 261962 - RNA, 61 nt, Homo Sapiens; identical to SEQ ID NO: 261682

SEQ ID NO: 261963 - RNA, 61 nt, Homo Sapiens; identical to SEQ ID NO: 261683

SEQ ID NO: 261964 - RNA, 61 nt, Homo Sapiens; identical to SEQ ID NO: 261684

SEQ ID NO: 261965 - RNA, 61 nt, Homo Sapiens; identical to SEQ ID NO: 261685

SEQ ID NO: 261966 - RNA, 61 nt, Homo Sapiens; identical to SEQ ID NO: 261686

SEQ ID NO: 261967 - RNA, 61 nt, Homo Sapiens; identical to SEQ ID NO: 261687

SEQ ID NO: 261968 - RNA, 61 nt, Homo Sapiens; identical to SEQ ID NO: 261688

SEQ ID NO: 261969 - RNA, 61 nt, Homo Sapiens; identical to SEQ ID NO: 261689

SEQ ID NO: 261970 - RNA, 61 nt, Homo Sapiens; identical to SEQ ID NO: 261690

SEQ ID NO: 261971 - RNA, 61 nt, Homo Sapiens; identical to SEQ ID NO: 261691

SEQ ID NO: 261972 - RNA, 61 nt, Homo Sapiens; identical to SEQ ID NO: 261692

SEQ ID NO: 261973 - RNA, 61 nt, Homo Sapiens; identical to SEQ ID NO: 261693

SEQ ID NO: 261974 - RNA, 61 nt, Homo Sapiens; identical to SEQ ID NO: 261694

SEQ ID NO: 261975 - RNA, 61 nt, Homo Sapiens; identical to SEQ ID NO: 261695

SEQ ID NO: 261976 - RNA, 61 nt, Homo Sapiens; identical to SEQ ID NO: 261696

SEQ ID NO: 261977 - RNA, 61 nt, Homo Sapiens; identical to SEQ ID NO: 261697

SEQ ID NO: 261978 - RNA, 61 nt, Homo Sapiens; identical to SEQ ID NO: 261698

SEQ ID NO: 261979 - RNA, 61 nt, Homo Sapiens; identical to SEQ ID NO: 261699

SEQ ID NO: 261980 - RNA, 61 nt, Homo Sapiens; identical to SEQ ID NO: 261700

SEQ ID NO: 261981 - RNA, 61 nt, Homo Sapiens; identical to SEQ ID NO: 261701

SEQ ID NO: 261982 - RNA, 61 nt, Homo Sapiens; identical to SEQ ID NO: 261702

SEQ ID NO: 261983 - RNA, 61 nt, Homo Sapiens; identical to SEQ ID NO: 261703

SEQ ID NO: 261984 - RNA, 61 nt, Homo Sapiens; identical to SEQ ID NO: 261704

SEQ ID NO: 261985 - RNA, 64 nt, Homo Sapiens; identical to SEQ ID NO: 261649

SEQ ID NO: 261986 - RNA, 64 nt, Homo Sapiens; identical to SEQ ID NO: 261650

SEQ ID NO: 261987 - RNA, 64 nt, Homo Sapiens; identical to SEQ ID NO: 261651

SEQ ID NO: 261988 - RNA, 64 nt, Homo Sapiens; identical to SEQ ID NO: 261652

SEQ ID NO: 261989 - RNA, 64 nt, Homo Sapiens; identical to SEQ ID NO: 261653

SEQ ID NO: 261990 - RNA, 64 nt, Homo Sapiens; identical to SEQ ID NO: 261654

SEQ ID NO: 261991 - RNA, 64 nt, Homo Sapiens; identical to SEQ ID NO: 261655

SEQ ID NO: 261992 - RNA, 64 nt, Homo Sapiens; identical to SEQ ID NO: 261656

SEQ ID NO: 261993 - RNA, 64 nt, Homo Sapiens; identical to SEQ ID NO: 261657

SEQ ID NO: 261994 - RNA, 64 nt, Homo Sapiens; identical to SEQ ID NO: 261658

SEQ ID NO: 261995 - RNA, 61 nt, Homo Sapiens; identical to SEQ ID NO: 261659

SEQ ID NO: 261996 - RNA, 61 nt, Homo Sapiens; identical to SEQ ID NO: 261660

SEQ ID NO: 261997 - RNA, 61 nt, Homo Sapiens; identical to SEQ ID NO: 261661

SEQ ID NO: 261998 - RNA, 61 nt, Homo Sapiens; identical to SEQ ID NO: 261662

SEQ ID NO: 261999 - RNA, 61 nt, Homo Sapiens; identical to SEQ ID NO: 261663

SEQ ID NO: 262000 - RNA, 61 nt, Homo Sapiens; identical to SEQ ID NO: 261664

SEQ ID NO: 262001 - RNA, 61 nt, Homo Sapiens; identical to SEQ ID NO: 261665

SEQ ID NO: 262002 - RNA, 61 nt, Homo Sapiens; identical to SEQ ID NO: 261666

SEQ ID NO: 262003 - RNA, 61 nt, Homo Sapiens; identical to SEQ ID NO: 261667

SEQ ID NO: 262004 - RNA, 61 nt, Homo Sapiens; identical to SEQ ID NO: 261668

SEQ ID NO: 262005 - RNA, 61 nt, Homo Sapiens; identical to SEQ ID NO: 261669

SEQ ID NO: 262006 - RNA, 61 nt, Homo Sapiens; identical to SEQ ID NO: 261670

SEQ ID NO: 262007 - RNA, 61 nt, Homo Sapiens; identical to SEQ ID NO: 261671

SEQ ID NO: 262008 - RNA, 61 nt, Homo Sapiens; identical to SEQ ID NO: 261672

SEQ ID NO: 262009 - RNA, 61 nt, Homo Sapiens; identical to SEQ ID NO: 261673

SEQ ID NO: 262010 - RNA, 61 nt, Homo Sapiens; identical to SEQ ID NO: 261674

SEQ ID NO: 262011 - RNA, 61 nt, Homo Sapiens; identical to SEQ ID NO: 261675

SEQ ID NO: 262012 - RNA, 61 nt, Homo Sapiens; identical to SEQ ID NO: 261676

SEQ ID NO: 262013 - RNA, 61 nt, Homo Sapiens; identical to SEQ ID NO: 261677

SEQ ID NO: 262014 - RNA, 61 nt, Homo Sapiens; identical to SEQ ID NO: 261678

SEQ ID NO: 262015 - RNA, 61 nt, Homo Sapiens; identical to SEQ ID NO: 261679

SEQ ID NO: 262016 - RNA, 61 nt, Homo Sapiens; identical to SEQ ID NO: 261680

SEQ ID NO: 262017 - RNA, 61 nt, Homo Sapiens; identical to SEQ ID NO: 261681

SEQ ID NO: 262018 - RNA, 61 nt, Homo Sapiens; identical to SEQ ID NO: 261682

SEQ ID NO: 262019 - RNA, 61 nt, Homo Sapiens; identical to SEQ ID NO: 261683

SEQ ID NO: 262020 - RNA, 61 nt, Homo Sapiens; identical to SEQ ID NO: 261684

SEQ ID NO: 262021 - RNA, 61 nt, Homo Sapiens; identical to SEQ ID NO: 261685

SEQ ID NO: 262022 - RNA, 61 nt, Homo Sapiens; identical to SEQ ID NO: 261686

SEQ ID NO: 262023 - RNA, 61 nt, Homo Sapiens; identical to SEQ ID NO: 261687

SEQ ID NO: 262024 - RNA, 61 nt, Homo Sapiens; identical to SEQ ID NO: 261688

SEQ ID NO: 262025 - RNA, 61 nt, Homo Sapiens; identical to SEQ ID NO: 261689

SEQ ID NO: 262026 - RNA, 61 nt, Homo Sapiens; identical to SEQ ID NO: 261690

SEQ ID NO: 262027 - RNA, 61 nt, Homo Sapiens; identical to SEQ ID NO: 261691

SEQ ID NO: 262028 - RNA, 61 nt, Homo Sapiens; identical to SEQ ID NO: 261692

SEQ ID NO: 262029 - RNA, 61 nt, Homo Sapiens; identical to SEQ ID NO: 261693

SEQ ID NO: 262030 - RNA, 61 nt, Homo Sapiens; identical to SEQ ID NO: 261694

SEQ ID NO: 262031 - RNA, 61 nt, Homo Sapiens; identical to SEQ ID NO: 261695

SEQ ID NO: 262032 - RNA, 61 nt, Homo Sapiens; identical to SEQ ID NO: 261696

SEQ ID NO: 262033 - RNA, 61 nt, Homo Sapiens; identical to SEQ ID NO: 261697

SEQ ID NO: 262034 - RNA, 61 nt, Homo Sapiens; identical to SEQ ID NO: 261698

SEQ ID NO: 262035 - RNA, 61 nt, Homo Sapiens; identical to SEQ ID NO: 261699

SEQ ID NO: 262036 - RNA, 61 nt, Homo Sapiens; identical to SEQ ID NO: 261700

SEQ ID NO: 262037 - RNA, 61 nt, Homo Sapiens; identical to SEQ ID NO: 261701

SEQ ID NO: 262038 - RNA, 61 nt, Homo Sapiens; identical to SEQ ID NO: 261702

SEQ ID NO: 262039 - RNA, 61 nt, Homo Sapiens; identical to SEQ ID NO: 261703

SEQ ID NO: 262040 - RNA, 61 nt, Homo Sapiens; identical to SEQ ID NO: 261704

SEQ ID NO: 262041 - RNA, 64 nt, Homo Sapiens; identical to SEQ ID NO: 261649

SEQ ID NO: 262042 - RNA, 64 nt, Homo Sapiens; identical to SEQ ID NO: 261650

SEQ ID NO: 262043 - RNA, 64 nt, Homo Sapiens; identical to SEQ ID NO: 261651

SEQ ID NO: 262044 - RNA, 64 nt, Homo Sapiens; identical to SEQ ID NO: 261652

SEQ ID NO: 262045 - RNA, 64 nt, Homo Sapiens; identical to SEQ ID NO: 261653

SEQ ID NO: 262046 - RNA, 64 nt, Homo Sapiens; identical to SEQ ID NO: 261654

SEQ ID NO: 262047 - RNA, 64 nt, Homo Sapiens; identical to SEQ ID NO: 261655

SEQ ID NO: 262048 - RNA, 64 nt, Homo Sapiens; identical to SEQ ID NO: 261656

SEQ ID NO: 262049 - RNA, 64 nt, Homo Sapiens; identical to SEQ ID NO: 261657

SEQ ID NO: 262050 - RNA, 64 nt, Homo Sapiens; identical to SEQ ID NO: 261658

SEQ ID NO: 262051 - RNA, 61 nt, Homo Sapiens; identical to SEQ ID NO: 261659

SEQ ID NO: 262052 - RNA, 61 nt, Homo Sapiens; identical to SEQ ID NO: 261660

SEQ ID NO: 262053 - RNA, 61 nt, Homo Sapiens; identical to SEQ ID NO: 261661

SEQ ID NO: 262054 - RNA, 61 nt, Homo Sapiens; identical to SEQ ID NO: 261662

SEQ ID NO: 262055 - RNA, 61 nt, Homo Sapiens; identical to SEQ ID NO: 261663

SEQ ID NO: 262056 - RNA, 61 nt, Homo Sapiens; identical to SEQ ID NO: 261664

SEQ ID NO: 262057 - RNA, 61 nt, Homo Sapiens; identical to SEQ ID NO: 261665

SEQ ID NO: 262058 - RNA, 61 nt, Homo Sapiens; identical to SEQ ID NO: 261666

SEQ ID NO: 262059 - RNA, 61 nt, Homo Sapiens; identical to SEQ ID NO: 261667

SEQ ID NO: 262060 - RNA, 61 nt, Homo Sapiens; identical to SEQ ID NO: 261668

SEQ ID NO: 262061 - RNA, 61 nt, Homo Sapiens; identical to SEQ ID NO: 261669

SEQ ID NO: 262062 - RNA, 61 nt, Homo Sapiens; identical to SEQ ID NO: 261670

SEQ ID NO: 262063 - RNA, 61 nt, Homo Sapiens; identical to SEQ ID NO: 261671

SEQ ID NO: 262064 - RNA, 61 nt, Homo Sapiens; identical to SEQ ID NO: 261672

SEQ ID NO: 262065 - RNA, 61 nt, Homo Sapiens; identical to SEQ ID NO: 261673

SEQ ID NO: 262066 - RNA, 61 nt, Homo Sapiens; identical to SEQ ID NO: 261674

SEQ ID NO: 262067 - RNA, 61 nt, Homo Sapiens; identical to SEQ ID NO: 261675

SEQ ID NO: 262068 - RNA, 61 nt, Homo Sapiens; identical to SEQ ID NO: 261676

SEQ ID NO: 262069 - RNA, 61 nt, Homo Sapiens; identical to SEQ ID NO: 261677

SEQ ID NO: 262070 - RNA, 61 nt, Homo Sapiens; identical to SEQ ID NO: 261678

SEQ ID NO: 262071 - RNA, 61 nt, Homo Sapiens; identical to SEQ ID NO: 261679

SEQ ID NO: 262072 - RNA, 61 nt, Homo Sapiens; identical to SEQ ID NO: 261680

SEQ ID NO: 262073 - RNA, 61 nt, Homo Sapiens; identical to SEQ ID NO: 261681

SEQ ID NO: 262074 - RNA, 61 nt, Homo Sapiens; identical to SEQ ID NO: 261682

SEQ ID NO: 262075 - RNA, 61 nt, Homo Sapiens; identical to SEQ ID NO: 261683

SEQ ID NO: 262076 - RNA, 61 nt, Homo Sapiens; identical to SEQ ID NO: 261684

SEQ ID NO: 262077 - RNA, 61 nt, Homo Sapiens; identical to SEQ ID NO: 261685

SEQ ID NO: 262078 - RNA, 61 nt, Homo Sapiens; identical to SEQ ID NO: 261686

SEQ ID NO: 262079 - RNA, 61 nt, Homo Sapiens; identical to SEQ ID NO: 261687

SEQ ID NO: 262080 - RNA, 61 nt, Homo Sapiens; identical to SEQ ID NO: 261688

SEQ ID NO: 262081 - RNA, 61 nt, Homo Sapiens; identical to SEQ ID NO: 261689

SEQ ID NO: 262082 - RNA, 61 nt, Homo Sapiens; identical to SEQ ID NO: 261690

SEQ ID NO: 262083 - RNA, 61 nt, Homo Sapiens; identical to SEQ ID NO: 261691

SEQ ID NO: 262084 - RNA, 61 nt, Homo Sapiens; identical to SEQ ID NO: 261692

SEQ ID NO: 262085 - RNA, 61 nt, Homo Sapiens; identical to SEQ ID NO: 261693

SEQ ID NO: 262086 - RNA, 61 nt, Homo Sapiens; identical to SEQ ID NO: 261694

SEQ ID NO: 262087 - RNA, 61 nt, Homo Sapiens; identical to SEQ ID NO: 261695

SEQ ID NO: 262088 - RNA, 61 nt, Homo Sapiens; identical to SEQ ID NO: 261696

SEQ ID NO: 262089 - RNA, 61 nt, Homo Sapiens; identical to SEQ ID NO: 261697

SEQ ID NO: 262090 - RNA, 61 nt, Homo Sapiens; identical to SEQ ID NO: 261698

SEQ ID NO: 262091 - RNA, 61 nt, Homo Sapiens; identical to SEQ ID NO: 261699

SEQ ID NO: 262092 - RNA, 61 nt, Homo Sapiens; identical to SEQ ID NO: 261700

SEQ ID NO: 262093 - RNA, 61 nt, Homo Sapiens; identical to SEQ ID NO: 261701

SEQ ID NO: 262094 - RNA, 61 nt, Homo Sapiens; identical to SEQ ID NO: 261702

SEQ ID NO: 262095 - RNA, 61 nt, Homo Sapiens; identical to SEQ ID NO: 261703

SEQ ID NO: 262096 - RNA, 61 nt, Homo Sapiens; identical to SEQ ID NO: 261704

SEQ ID NO: 262097 - RNA, 64 nt, Homo Sapiens; identical to SEQ ID NO: 261649

SEQ ID NO: 262098 - RNA, 64 nt, Homo Sapiens; identical to SEQ ID NO: 261650

SEQ ID NO: 262099 - RNA, 64 nt, Homo Sapiens; identical to SEQ ID NO: 261651

SEQ ID NO: 262100 - RNA, 64 nt, Homo Sapiens; identical to SEQ ID NO: 261652

SEQ ID NO: 262101 - RNA, 64 nt, Homo Sapiens; identical to SEQ ID NO: 261653

SEQ ID NO: 262102 - RNA, 64 nt, Homo Sapiens; identical to SEQ ID NO: 261654

SEQ ID NO: 262103 - RNA, 64 nt, Homo Sapiens; identical to SEQ ID NO: 261655

SEQ ID NO: 262104 - RNA, 64 nt, Homo Sapiens; identical to SEQ ID NO: 261656

SEQ ID NO: 262105 - RNA, 64 nt, Homo Sapiens; identical to SEQ ID NO: 261657

SEQ ID NO: 262106 - RNA, 64 nt, Homo Sapiens; identical to SEQ ID NO: 261658

SEQ ID NO: 262107 - RNA, 61 nt, Homo Sapiens; identical to SEQ ID NO: 261659

SEQ ID NO: 262108 - RNA, 61 nt, Homo Sapiens; identical to SEQ ID NO: 261660

SEQ ID NO: 262109 - RNA, 61 nt, Homo Sapiens; identical to SEQ ID NO: 261661

SEQ ID NO: 262110 - RNA, 61 nt, Homo Sapiens; identical to SEQ ID NO: 261662

SEQ ID NO: 262111 - RNA, 61 nt, Homo Sapiens; identical to SEQ ID NO: 261663

SEQ ID NO: 262112 - RNA, 61 nt, Homo Sapiens; identical to SEQ ID NO: 261664

SEQ ID NO: 262113 - RNA, 61 nt, Homo Sapiens; identical to SEQ ID NO: 261665

SEQ ID NO: 262114 - RNA, 61 nt, Homo Sapiens; identical to SEQ ID NO: 261666

SEQ ID NO: 262115 - RNA, 61 nt, Homo Sapiens; identical to SEQ ID NO: 261667

SEQ ID NO: 262116 - RNA, 61 nt, Homo Sapiens; identical to SEQ ID NO: 261668

SEQ ID NO: 262117 - RNA, 61 nt, Homo Sapiens; identical to SEQ ID NO: 261669

SEQ ID NO: 262118 - RNA, 61 nt, Homo Sapiens; identical to SEQ ID NO: 261670

SEQ ID NO: 262119 - RNA, 61 nt, Homo Sapiens; identical to SEQ ID NO: 261671

SEQ ID NO: 262120 - RNA, 61 nt, Homo Sapiens; identical to SEQ ID NO: 261672

SEQ ID NO: 262121 - RNA, 61 nt, Homo Sapiens; identical to SEQ ID NO: 261673

SEQ ID NO: 262122 - RNA, 61 nt, Homo Sapiens; identical to SEQ ID NO: 261674

SEQ ID NO: 262123 - RNA, 61 nt, Homo Sapiens; identical to SEQ ID NO: 261675

SEQ ID NO: 262124 - RNA, 61 nt, Homo Sapiens; identical to SEQ ID NO: 261676

SEQ ID NO: 262125 - RNA, 61 nt, Homo Sapiens; identical to SEQ ID NO: 261677

SEQ ID NO: 262126 - RNA, 61 nt, Homo Sapiens; identical to SEQ ID NO: 261678

SEQ ID NO: 262127 - RNA, 61 nt, Homo Sapiens; identical to SEQ ID NO: 261679

SEQ ID NO: 262128 - RNA, 61 nt, Homo Sapiens; identical to SEQ ID NO: 261680

SEQ ID NO: 262129 - RNA, 61 nt, Homo Sapiens; identical to SEQ ID NO: 261681

SEQ ID NO: 262130 - RNA, 61 nt, Homo Sapiens; identical to SEQ ID NO: 261682

SEQ ID NO: 262131 - RNA, 61 nt, Homo Sapiens; identical to SEQ ID NO: 261683

SEQ ID NO: 262132 - RNA, 61 nt, Homo Sapiens; identical to SEQ ID NO: 261684

SEQ ID NO: 262133 - RNA, 61 nt, Homo Sapiens; identical to SEQ ID NO: 261685

SEQ ID NO: 262134 - RNA, 61 nt, Homo Sapiens; identical to SEQ ID NO: 261686

SEQ ID NO: 262135 - RNA, 61 nt, Homo Sapiens; identical to SEQ ID NO: 261687

SEQ ID NO: 262136 - RNA, 61 nt, Homo Sapiens; identical to SEQ ID NO: 261688

SEQ ID NO: 262137 - RNA, 61 nt, Homo Sapiens; identical to SEQ ID NO: 261689

SEQ ID NO: 262138 - RNA, 61 nt, Homo Sapiens; identical to SEQ ID NO: 261690

SEQ ID NO: 262139 - RNA, 61 nt, Homo Sapiens; identical to SEQ ID NO: 261691

SEQ ID NO: 262140 - RNA, 61 nt, Homo Sapiens; identical to SEQ ID NO: 261692

SEQ ID NO: 262141 - RNA, 61 nt, Homo Sapiens; identical to SEQ ID NO: 261693

SEQ ID NO: 262142 - RNA, 61 nt, Homo Sapiens; identical to SEQ ID NO: 261694

SEQ ID NO: 262143 - RNA, 61 nt, Homo Sapiens; identical to SEQ ID NO: 261695

SEQ ID NO: 262144 - RNA, 61 nt, Homo Sapiens; identical to SEQ ID NO: 261696

SEQ ID NO: 262145 - RNA, 61 nt, Homo Sapiens; identical to SEQ ID NO: 261697

SEQ ID NO: 262146 - RNA, 61 nt, Homo Sapiens; identical to SEQ ID NO: 261698

SEQ ID NO: 262147 - RNA, 61 nt, Homo Sapiens; identical to SEQ ID NO: 261699

SEQ ID NO: 262148 - RNA, 61 nt, Homo Sapiens; identical to SEQ ID NO: 261700

SEQ ID NO: 262149 - RNA, 61 nt, Homo Sapiens; identical to SEQ ID NO: 261701

SEQ ID NO: 262150 - RNA, 61 nt, Homo Sapiens; identical to SEQ ID NO: 261702

SEQ ID NO: 262151 - RNA, 61 nt, Homo Sapiens; identical to SEQ ID NO: 261703

SEQ ID NO: 262152 - RNA, 61 nt, Homo Sapiens; identical to SEQ ID NO: 261704

SEQ ID NO: 262153 - RNA, 64 nt, Homo Sapiens; identical to SEQ ID NO: 198753

SEQ ID NO: 262154 - RNA, 64 nt, Homo Sapiens; identical to SEQ ID NO: 198754

SEQ ID NO: 262155 - RNA, 64 nt, Homo Sapiens; identical to SEQ ID NO: 198755

SEQ ID NO: 262156 - RNA, 64 nt, Homo Sapiens; identical to SEQ ID NO: 198756

SEQ ID NO: 262157 - RNA, 64 nt, Homo Sapiens; identical to SEQ ID NO: 198757

SEQ ID NO: 262158 - RNA, 64 nt, Homo Sapiens; identical to SEQ ID NO: 198758

SEQ ID NO: 262159 - RNA, 64 nt, Homo Sapiens; identical to SEQ ID NO: 198759

SEQ ID NO: 262160 - RNA, 64 nt, Homo Sapiens; identical to SEQ ID NO: 198760

SEQ ID NO: 262161 - RNA, 64 nt, Homo Sapiens; identical to SEQ ID NO: 198761

SEQ ID NO: 262162 - RNA, 64 nt, Homo Sapiens; identical to SEQ ID NO: 198762

SEQ ID NO: 262163 - RNA, 64 nt, Homo Sapiens; identical to SEQ ID NO: 198763

SEQ ID NO: 262164 - RNA, 64 nt, Homo Sapiens; identical to SEQ ID NO: 198764

SEQ ID NO: 262165 - RNA, 64 nt, Homo Sapiens; identical to SEQ ID NO: 198765

SEQ ID NO: 262166 - RNA, 64 nt, Homo Sapiens; identical to SEQ ID NO: 198766

SEQ ID NO: 262167 - RNA, 64 nt, Homo Sapiens; identical to SEQ ID NO: 198767

SEQ ID NO: 262168 - RNA, 64 nt, Homo Sapiens; identical to SEQ ID NO: 198768

SEQ ID NO: 262169 - RNA, 64 nt, Homo Sapiens; identical to SEQ ID NO: 198769

SEQ ID NO: 262170 - RNA, 64 nt, Homo Sapiens; identical to SEQ ID NO: 198770

SEQ ID NO: 262171 - RNA, 64 nt, Homo Sapiens; identical to SEQ ID NO: 198771

SEQ ID NO: 262172 - RNA, 64 nt, Homo Sapiens; identical to SEQ ID NO: 198772

SEQ ID NO: 262173 - RNA, 64 nt, Homo Sapiens; identical to SEQ ID NO: 198773

SEQ ID NO: 262174 - RNA, 64 nt, Homo Sapiens; identical to SEQ ID NO: 198774

SEQ ID NO: 262175 - RNA, 64 nt, Homo Sapiens; identical to SEQ ID NO: 198775

SEQ ID NO: 262176 - RNA, 64 nt, Homo Sapiens; identical to SEQ ID NO: 198776

SEQ ID NO: 262177 - RNA, 64 nt, Homo Sapiens; identical to SEQ ID NO: 198777

SEQ ID NO: 262178 - RNA, 64 nt, Homo Sapiens; identical to SEQ ID NO: 198778

SEQ ID NO: 262179 - RNA, 64 nt, Homo Sapiens; identical to SEQ ID NO: 198779

SEQ ID NO: 262180 - RNA, 64 nt, Homo Sapiens; identical to SEQ ID NO: 198780

SEQ ID NO: 262181 - RNA, 64 nt, Homo Sapiens; identical to SEQ ID NO: 198781

SEQ ID NO: 262182 - RNA, 64 nt, Homo Sapiens; identical to SEQ ID NO: 198782

SEQ ID NO: 262183 - RNA, 64 nt, Homo Sapiens; identical to SEQ ID NO: 198783

SEQ ID NO: 262184 - RNA, 64 nt, Homo Sapiens; identical to SEQ ID NO: 198784

SEQ ID NO: 262185 - RNA, 64 nt, Homo Sapiens; identical to SEQ ID NO: 198785

SEQ ID NO: 262186 - RNA, 64 nt, Homo Sapiens; identical to SEQ ID NO: 198786

SEQ ID NO: 262187 - RNA, 64 nt, Homo Sapiens; identical to SEQ ID NO: 198787

SEQ ID NO: 262188 - RNA, 64 nt, Homo Sapiens; identical to SEQ ID NO: 198788

SEQ ID NO: 262189 - RNA, 64 nt, Homo Sapiens; identical to SEQ ID NO: 198789

SEQ ID NO: 262190 - RNA, 64 nt, Homo Sapiens; identical to SEQ ID NO: 198790

SEQ ID NO: 262191 - RNA, 64 nt, Homo Sapiens; identical to SEQ ID NO: 198791

SEQ ID NO: 262192 - RNA, 64 nt, Homo Sapiens; identical to SEQ ID NO: 198792

SEQ ID NO: 262193 - RNA, 64 nt, Homo Sapiens; identical to SEQ ID NO: 198793

SEQ ID NO: 262194 - RNA, 64 nt, Homo Sapiens; identical to SEQ ID NO: 198794

SEQ ID NO: 262195 - RNA, 64 nt, Homo Sapiens; identical to SEQ ID NO: 198795

SEQ ID NO: 262196 - RNA, 64 nt, Homo Sapiens; identical to SEQ ID NO: 198796

SEQ ID NO: 262197 - RNA, 64 nt, Homo Sapiens; identical to SEQ ID NO: 198797

SEQ ID NO: 262198 - RNA, 64 nt, Homo Sapiens; identical to SEQ ID NO: 198798

SEQ ID NO: 262199 - RNA, 64 nt, Homo Sapiens; identical to SEQ ID NO: 198799

SEQ ID NO: 262200 - RNA, 64 nt, Homo Sapiens
guaggcaaacugauuuguaaagucauuugcucuaauucucaauugaaguacuccugguauugca

SEQ ID NO: 262201 - RNA, 64 nt, Homo Sapiens
guuucuuuguaguaguaggacugggauacgucauauucucaacauuggggacaugaguaguugu

SEQ ID NO: 262202 - RNA, 64 nt, Homo Sapiens
gcagggcagagggggaucugcugaaauugcuggcauucucaaagacauaccauucucaauccca

SEQ ID NO: 262203 - RNA, 64 nt, Homo Sapiens
ccacugaaauugcuggcauugagauccacauaccauucucaaucugaggaucacuccaagaaaa

SEQ ID NO: 262204 - RNA, 64 nt, Homo Sapiens
gcuuagacucuaucaugggcccccaugaagcuccauucucaauacugaauaauuauuacuuccc

SEQ ID NO: 262205 - RNA, 64 nt, Homo Sapiens
gacccuucauuuaaugaccaccuuagggcugaugauucucaaaucuguauuccccgaucuugca

SEQ ID NO: 262206 - RNA, 64 nt, Homo Sapiens
uuuuucuaaauacagccuuuuucuccauuucauaauucucaagauuguuaucaauuaacuguuu

SEQ ID NO: 262207 - RNA, 64 nt, Homo Sapiens
aaaaagaaguguauccuuaauuuuauguuucuaaauucucaauuugacacggauuauuuguugc

SEQ ID NO: 262208 - RNA, 64 nt, Homo Sapiens
ccccucugggagcuggggccuggccuuucugcccauucucaacaaacacucuugucuggagaca

SEQ ID NO: 262209 - RNA, 64 nt, Homo Sapiens
guguacuauuuacuuucuucacccuugccccuuuauucucaaggucuuuugauugugaagcaag

SEQ ID NO: 262210 - RNA, 64 nt, Homo Sapiens
auuaagggaaaaucuauaaaaacaagguuagcauauucucaacacagauaccaccacuuucuuu

SEQ ID NO: 262211 - RNA, 64 nt, Homo Sapiens
gauaaagcagauucugucuucauugcaaaaaguuauucucaauggaagaauggcaucugaucuc

SEQ ID NO: 262212 - RNA, 64 nt, Homo Sapiens
auguaaaauaauuaaggucuucagcagggaaaauauucucaauaaaauuuaauuuugauuugcu

SEQ ID NO: 262213 - RNA, 64 nt, Homo Sapiens
uuaauuuugauuugcuucaguuacuucaauuaaaauucucaaaugugacacaccuagaugugug

SEQ ID NO: 262214 - RNA, 64 nt, Homo Sapiens
uugcacugcagccucgaccuagugcaauccugcaauucucaaucuguagcacaggcuggauugc

SEQ ID NO: 262215 - RNA, 64 nt, Homo Sapiens
gacagcaggaguauuugacauuagguuuugcuacauucucaaaauuugguuuaaaguagcaggu

SEQ ID NO: 262216 - RNA, 64 nt, Homo Sapiens
aaacuuguucaaaacagggaaacuaaaacuaagaauucucaaaacaguguguaagcuaaacaaa

SEQ ID NO: 262217 - RNA, 64 nt, Homo Sapiens
uuauuuuuuuccaaguguagaaaugugaaguuauauucucaaguauucuugcaucuggccuuag

SEQ ID NO: 262218 - RNA, 64 nt, Homo Sapiens
uuugaauuaaagcuuagacuuucuugaauucgucauucucaacccaauuuauguaugaaagaaa

SEQ ID NO: 262219 - RNA, 64 nt, Homo Sapiens
uguuuuagcuguacaguuuuuaaacauuuacaugauucucaauauaaauuuuuaucuauugccu

SEQ ID NO: 262220 - RNA, 64 nt, Homo Sapiens
uggcuaucaagacugacuguaugaaccaauucacauucucaaugugaguuacagguucccaggg

SEQ ID NO: 262221 - RNA, 64 nt, Homo Sapiens
agauuucacuguggcuucuccagaaagaaaauagauucucaacgcuaguaaagcagggccgaga

SEQ ID NO: 262222 - RNA, 64 nt, Homo Sapiens
aacauuauucucacugcaaaguuuguaaugagccauucucaauaagagauuuuauauauauuuu

SEQ ID NO: 262223 - RNA, 64 nt, Homo Sapiens
cucaucugccuagggaggguugagaaagcugcccauucucaagaucaccuuccugaaagaugaa

SEQ ID NO: 262224 - RNA, 64 nt, Homo Sapiens
ucauuaauucagauaauuuuuaaguuuccuagugauucucaaucucuuugaauuuuacuuacau

SEQ ID NO: 262225 - RNA, 64 nt, Homo Sapiens
ucacuaauucagauaauguauaaguuucccagugauucucaaccucuuugaauuuuacuuauaa

SEQ ID NO: 262226 - RNA, 64 nt, Homo Sapiens
acuuggcccggggucuccuggcguuugcuuagcucggggacagcgacagccgugcccagacugu

SEQ ID NO: 262227 - RNA, 64 nt, Homo Sapiens
cgugcccagacugugcguuuguaaaucaccaccacggggacagcagagcauggacagguggaua

SEQ ID NO: 262228 - RNA, 64 nt, Homo Sapiens
accuaugcaugccaaaacuguucuaggucgacugcggggacagaacaaaaaucaaaacaaagaa

SEQ ID NO: 262229 - RNA, 64 nt, Homo Sapiens
gauuuuacuaaaaaaaaaaaaaaaaaagagagggcggggacaaauaucaaauuaagcaaguaaa

SEQ ID NO: 262230 - RNA, 64 nt, Homo Sapiens
acaaaaagggcgcaucuuuaagaguuuuaaugccagugcuuaauucgaaugaggggauuuuaag

SEQ ID NO: 262231 - RNA, 64 nt, Homo Sapiens
gauugucaguguaagaaugugauuuaauguuuguagugcuuacaauuuuguguaccaacuggau

SEQ ID NO: 262232 - RNA, 64 nt, Homo Sapiens
ccuuugcauaggagaauguuuuuaugaucuguuuagugcuuauuauuuuuuuuaugaucuguuu

SEQ ID NO: 262233 - RNA, 64 nt, Homo Sapiens
guuuagugcuuauuauuuuuuuuaugaucuguuuagugcuuauuauuuuccaguaaauaugcuu

SEQ ID NO: 262234 - RNA, 64 nt, Homo Sapiens
gucucuuguuuuauguccuuguuccuaauguaaaagugcuuaacugcuucuugguuguauuggg

SEQ ID NO: 262235 - RNA, 64 nt, Homo Sapiens
aacucaaacauugcaaaaguggguggcaauauucagugcuuaacacuuuucuagcguugguaca

SEQ ID NO: 262236 - RNA, 64 nt, Homo Sapiens
aacugaagauugugaccagucagaauaaugucaaagugcuuacagugcagguagugauaugugc

SEQ ID NO: 262237 - RNA, 64 nt, Homo Sapiens
ggucuaucugaugugacagcuucuguagcacuaaagugcuuauagugcagguaguguuuaguua

SEQ ID NO: 262238 - RNA, 64 nt, Homo Sapiens
ucucaggauuuuucauuaggcuucuguaagucacagugcuuaaauccucauuaagccaaccugc

SEQ ID NO: 262239 - RNA, 64 nt, Homo Sapiens
agcugccguugaagcuaauaacuuaugugacucuagugcuuaacuauuugcccauucuggugua

SEQ ID NO: 262240 - RNA, 64 nt, Homo Sapiens
gcccagugccacgcacaggugcugaccuauaguaagugcuuaacauuuguugaauaggggaaag

SEQ ID NO: 262241 - RNA, 64 nt, Homo Sapiens
ccugucucuaaaaaaauaaaaauagaaauaaaguagugcuuauuguuugcauguugggucuugu

SEQ ID NO: 262242 - RNA, 64 nt, Homo Sapiens
auucagugggcacggucaaaaguagguaacaccgagugcuuacaauaacuuacgggauaacaau

SEQ ID NO: 262243 - RNA, 64 nt, Homo Sapiens
ucucagcuuuuucuuucuuaguguauauagauucagugcuuauucuuucuuuaaaacauuccaa

SEQ ID NO: 262244 - RNA, 64 nt, Homo Sapiens
uuaaaacucuaguuaaaauacuugauguacauaaagugcuuagcaaaaugaccaacucauacua

SEQ ID NO: 262245 - RNA, 64 nt, Homo Sapiens
auaaagugcuuagcaaaaugaccaacucauacuaagugcuuaguaaauguuagauaaguauucu

SEQ ID NO: 262246 - RNA, 64 nt, Homo Sapiens
agaggggagagaguacuccguucaagcugcucagcuaacccagauggucgggggauuccucuuc

SEQ ID NO: 262247 - RNA, 64 nt, Homo Sapiens
accacaaagccccccuggaguaaggauucuaacccuaacccagcugaucaaagguagggccaau

SEQ ID NO: 262248 - RNA, 64 nt, Homo Sapiens
gcacuaaagucacuuuaaagcuuuuggagaagcaggagggcauuggcuuaaccaagccgaaggc

SEQ ID NO: 262249 - RNA, 64 nt, Homo Sapiens
ggccccagcugucgccuuucugaccagcaggccuggagggcaggggcacagagcagagaggagg

SEQ ID NO: 262250 - RNA, 64 nt, Homo Sapiens
agcaggccuggagggcaggggcacagagcagagaggagggcacugguggucuccugcuuagccu

SEQ ID NO: 262251 - RNA, 64 nt, Homo Sapiens
ucaccaugcuuccccuagaaggguucugaucaccggagggcagccccaaaggccacaguccccu

SEQ ID NO: 262252 - RNA, 64 nt, Homo Sapiens
uuaagggacaggcacagcagaggugagagugggaggagggcacguaccgggugccagcccugga

SEQ ID NO: 262253 - RNA, 64 nt, Homo Sapiens
cccccauggggugccgagccgugccaggccuggaggagggcagugcucuuagcccccuggcuuu

SEQ ID NO: 262254 - RNA, 64 nt, Homo Sapiens
aggcuacgcagggcugaggagacgagcccugggaggagggcagagcgcuggagcugaaggaaug

SEQ ID NO: 262255 - RNA, 64 nt, Homo Sapiens
uuuaguguacgauguuugcugugcuucccgccguggagggcagagccaccccacaucaggaucg

SEQ ID NO: 262256 - RNA, 64 nt, Homo Sapiens
gugcuggugucugggaccaaaaagggggaauaugggagggcagaguggggaggggaguccaugg

SEQ ID NO: 262257 - RNA, 64 nt, Homo Sapiens
aacacaaacauaagaacuggccuagcaaggcuagggagggcaugauuccuuucccaguuguuac

SEQ ID NO: 262258 - RNA, 64 nt, Homo Sapiens
gcuacauccuggcucgguggggcugggcuggaaaggagggcaggggggugaaacuccagcaggu

SEQ ID NO: 262259 - RNA, 64 nt, Homo Sapiens
uacaggagagaguagguggugauaggccccgcugggagggcaguuauccauagacacaugcuag

SEQ ID NO: 262260 - RNA, 64 nt, Homo Sapiens
cuaggcucugggaucccgugagccuucagagcuaggagggcaccagcuagccaaguuuucugcg

SEQ ID NO: 262261 - RNA, 64 nt, Homo Sapiens
gggagaauccaaggguugagcugccacagccagaggagggcagaagcccagcaguguggagacc

SEQ ID NO: 262262 - RNA, 64 nt, Homo Sapiens
auggccuuuccuucccucuccaggacccccgaggggagggcaggcacucccugggacacagacc

SEQ ID NO: 262263 - RNA, 64 nt, Homo Sapiens
ggugaggagggggaagaugugaccagagggagcgggagggcagaguuccuggguacccaggccu

SEQ ID NO: 262264 - RNA, 64 nt, Homo Sapiens
cccccccacccacccaggaucuuuccuccccacuggagggcaagaccauaauuguaaccagugc

SEQ ID NO: 262265 - RNA, 64 nt, Homo Sapiens
ggcaagguuaccagggcaccgugagguggccuggggagggcagaacucggccaggugcugaucg

SEQ ID NO: 262266 - RNA, 64 nt, Homo Sapiens
gccagggcauuugcagaagcauacccucugaauuggagggcagucagggcuuggauugauguuu

SEQ ID NO: 262267 - RNA, 64 nt, Homo Sapiens
guuggcugcagguuucaucaccagaaacccuuguggagggcagucgucuccagcuucagccuuu

SEQ ID NO: 262268 - RNA, 64 nt, Homo Sapiens
ucugggcucagcgggcaguggacggcgggugccuggagggcagcaaguaaaugggggccguugg

SEQ ID NO: 262269 - RNA, 64 nt, Homo Sapiens
gggagggccaugugcaauauuuggaggguuuucuggagggcagcaggaaggcuggggaauuccc

SEQ ID NO: 262270 - RNA, 64 nt, Homo Sapiens
cugugucucaugcacuggcacauauggucaccuuggagggcagaccuaggagccccucugacca

SEQ ID NO: 262271 - RNA, 64 nt, Homo Sapiens
ggagggacggaaggcuggcaauagacccuagcggggagggcaggcacccccuucaagaggcgcc

SEQ ID NO: 262272 - RNA, 64 nt, Homo Sapiens
ugaugagagaggguguucccggccuggccagcagggagggcaguaagcaccuggcuaagggcug

SEQ ID NO: 262273 - RNA, 64 nt, Homo Sapiens
ggagccuugccaccaucccaacuugaggguggggggagggcaccggagagcagagaauggggga

SEQ ID NO: 262274 - RNA, 64 nt, Homo Sapiens
gaccccgaggccucguggacccccagccgggacgggagggcagcuuggcgggcuggggagcggc

SEQ ID NO: 262275 - RNA, 64 nt, Homo Sapiens
cauagccacaccacaggauugguugccaggcuggggagggcaacccuuucccaggguaucugug

SEQ ID NO: 262276 - RNA, 64 nt, Homo Sapiens
gguugaggggccaccaccaccagguggcacaucuggagggcaggccagugcccacccagccccu

SEQ ID NO: 262277 - RNA, 64 nt, Homo Sapiens
gcuuggguccaguggaggaaauuuuuacagaggaggagggcaggcuuagaaggggaugagucag

SEQ ID NO: 262278 - RNA, 64 nt, Homo Sapiens
ggaaguacuuagggagguugcuucaaaugcugauggagggcagaugauggccaucagacagaga

SEQ ID NO: 262279 - RNA, 64 nt, Homo Sapiens
guaggguagggccucugaggugguggcagccauaggagggcaggaucaggcaggagggcaggga

SEQ ID NO: 262280 - RNA, 64 nt, Homo Sapiens
gaugguggcagccauaggagaccaggaucaggcaggagggcagggagcugagcagagaggccua

SEQ ID NO: 262281 - RNA, 64 nt, Homo Sapiens
gcaacaaggagcuggguguggaccaggagucagaggagggcaaaggcaaaacaagcccugauaa

SEQ ID NO: 262282 - RNA, 64 nt, Homo Sapiens
acuuugacaguuucaucugcugcuucguuaggcuggagggcauguucaguaagugggagagggg

SEQ ID NO: 262283 - RNA, 64 nt, Homo Sapiens
uccugacuggcuccuagggaaggggaaggcuccuggagggcagcccuaccucucccaugcccuu

SEQ ID NO: 262284 - RNA, 64 nt, Homo Sapiens
augaaaucuuggauuuggggcugaggggugggagggagggcagagcucugcacacucaaaggcu

SEQ ID NO: 262285 - RNA, 64 nt, Homo Sapiens
guggcagcacagccacacccguucccacgucagaggagggcaaggcuggguacucagcagccac

SEQ ID NO: 262286 - RNA, 64 nt, Homo Sapiens
gcagccuggagccagcccggggacuguccuggguggagggcaggugaacacaagcugcugccgg

SEQ ID NO: 262287 - RNA, 64 nt, Homo Sapiens
ggacaguuccauggcccuucccagacgacucugaggagggcaagugaggccagggacagucuug

SEQ ID NO: 262288 - RNA, 64 nt, Homo Sapiens
gguauggcugaggagggugcggcacugggguuguggagggcauguggcagaaggaaaaugggga

SEQ ID NO: 262289 - RNA, 64 nt, Homo Sapiens
gggggcuguggccgucagugcgcccaggaggaagggagggcagaguggagcuggucacgcuggg

SEQ ID NO: 262290 - RNA, 64 nt, Homo Sapiens
ggcuggggcugggaugggaggggguggcugaguuggagggcaagaggcagcagaacuagugcca

SEQ ID NO: 262291 - RNA, 64 nt, Homo Sapiens
guccccaucacguggcaagccaugcccaagcuagggagggcagauucaagaugcccaagaugac

SEQ ID NO: 262292 - RNA, 64 nt, Homo Sapiens
ggcaugcggcgcugugcaugagggcaggcgggagggagggcauuuccccuuaaagcagagaggg

SEQ ID NO: 262293 - RNA, 64 nt, Homo Sapiens
cgggagggagggcauuggcacuuaaagcagagagggagggcagggcccaaaagccccagauccc

SEQ ID NO: 262294 - RNA, 64 nt, Homo Sapiens
gcuggggggaggggauugggagggagggcaggguggagggcaagacaccucccuagagggaggg

SEQ ID NO: 262295 - RNA, 64 nt, Homo Sapiens
guggagggcaaggcugggggcuagagggagggagggagggcaggcugcaggaccucacaccucc

SEQ ID NO: 262296 - RNA, 64 nt, Homo Sapiens
gcuggaggagagacggggcugggcgcaagguggcggagggcaguguggguucugugucugucug

SEQ ID NO: 262297 - RNA, 64 nt, Homo Sapiens
caugcccugaagaggcaggguacacauggggcugggagggcaaagauggggcggggccuccccc

SEQ ID NO: 262298 - RNA, 64 nt, Homo Sapiens
ggcuacgccacagcuggacacacaugcagccccuggagggcagccucuuccugugccucgaugg

SEQ ID NO: 262299 - RNA, 64 nt, Homo Sapiens
ggcagccucuuccugugccucgauggggugggugggagggcaucuucugugcguugggucaguu

SEQ ID NO: 262300 - RNA, 64 nt, Homo Sapiens
uaccuuguuuugccagugauaagagcaguggguuggagggcacuuggccaguuuucuguucagc

SEQ ID NO: 262301 - RNA, 64 nt, Homo Sapiens
uuccaacagagggaggaaugugugccuuguucaaggagggcacgacccuuaggccuuuuucaac

SEQ ID NO: 262302 - RNA, 64 nt, Homo Sapiens; identical to SEQ ID NO: 89720

SEQ ID NO: 262303 - RNA, 64 nt, Homo Sapiens; identical to SEQ ID NO: 89721

SEQ ID NO: 262304 - RNA, 64 nt, Homo Sapiens; identical to SEQ ID NO: 89722

SEQ ID NO: 262305 - RNA, 64 nt, Homo Sapiens; identical to SEQ ID NO: 89723

SEQ ID NO: 262306 - RNA, 64 nt, Homo Sapiens; identical to SEQ ID NO: 89724

SEQ ID NO: 262307 - RNA, 64 nt, Homo Sapiens; identical to SEQ ID NO: 89725

SEQ ID NO: 262308 - RNA, 64 nt, Homo Sapiens; identical to SEQ ID NO: 89726

SEQ ID NO: 262309 - RNA, 64 nt, Homo Sapiens; identical to SEQ ID NO: 89727

SEQ ID NO: 262310 - RNA, 64 nt, Homo Sapiens; identical to SEQ ID NO: 89728

SEQ ID NO: 262311 - RNA, 64 nt, Homo Sapiens; identical to SEQ ID NO: 89729

SEQ ID NO: 262312 - RNA, 64 nt, Homo Sapiens; identical to SEQ ID NO: 89730

SEQ ID NO: 262313 - RNA, 64 nt, Homo Sapiens; identical to SEQ ID NO: 89731

SEQ ID NO: 262314 - RNA, 64 nt, Homo Sapiens
uuuucuuuauccagucaucuauguauauaaguauauacaccacacauuauccagucaucuggau

SEQ ID NO: 262315 - RNA, 64 nt, Homo Sapiens
uuauccagucaucuggauauauguauauaaguauauacaccacaaugcauauauguguaugugu

SEQ ID NO: 262316 - RNA, 64 nt, Homo Sapiens
gggugaggguaaagcuuuucuauaaucaagcucaauacaccaaggaaacuggauccagaauucc

SEQ ID NO: 262317 - RNA, 64 nt, Homo Sapiens
gaaacuguauauguuacugccuuguacuuuucucauacaccaaaaacacaccaaaaaaaucaau

SEQ ID NO: 262318 - RNA, 64 nt, Homo Sapiens
acaaaaucaauauacaaaauaugguagcauuuuuauacaccaacgacauccaagcugagagcca

SEQ ID NO: 262319 - RNA, 64 nt, Homo Sapiens
gccuuaaaaaaaaaaaaaagaaaauguggcacauauacaccauggaauacuaugcagccauaaa

SEQ ID NO: 262320 - RNA, 64 nt, Homo Sapiens
acaaaaucuguguacaaaaauuaguugcauuucuauacaccaguaauguccaagcuaugaacca

SEQ ID NO: 262321 - RNA, 64 nt, Homo Sapiens
cagcaguagaccagauaaagaaaauuugguacauauacaccauggaauacuaugcagccauaaa

SEQ ID NO: 262322 - RNA, 64 nt, Homo Sapiens; identical to SEQ ID NO: 47675

SEQ ID NO: 262323 - RNA, 64 nt, Homo Sapiens; identical to SEQ ID NO: 47676

SEQ ID NO: 262324 - RNA, 64 nt, Homo Sapiens; identical to SEQ ID NO: 47677

SEQ ID NO: 262325 - RNA, 64 nt, Homo Sapiens; identical to SEQ ID NO: 47678

SEQ ID NO: 262326 - RNA, 64 nt, Homo Sapiens; identical to SEQ ID NO: 47679

SEQ ID NO: 262327 - RNA, 64 nt, Homo Sapiens; identical to SEQ ID NO: 47680

SEQ ID NO: 262328 - RNA, 64 nt, Homo Sapiens; identical to SEQ ID NO: 47681

SEQ ID NO: 262329 - RNA, 64 nt, Homo Sapiens; identical to SEQ ID NO: 47682

SEQ ID NO: 262330 - RNA, 64 nt, Homo Sapiens; identical to SEQ ID NO: 47683

SEQ ID NO: 262331 - RNA, 64 nt, Homo Sapiens; identical to SEQ ID NO: 47684

SEQ ID NO: 262332 - RNA, 64 nt, Homo Sapiens; identical to SEQ ID NO: 47685

SEQ ID NO: 262333 - RNA, 64 nt, Homo Sapiens; identical to SEQ ID NO: 47686

SEQ ID NO: 262334 - RNA, 64 nt, Homo Sapiens; identical to SEQ ID NO: 47687

SEQ ID NO: 262335 - RNA, 64 nt, Homo Sapiens; identical to SEQ ID NO: 47688

SEQ ID NO: 262336 - RNA, 63 nt, Homo Sapiens
acugacgguucccugaggauggggcuguuucuccccuccgacuggggcucccugaggaugggg

SEQ ID NO: 262337 - RNA, 63 nt, Homo Sapiens
gacuggggcucccugaggauggggcuguuucuccccuccgacuggggcucccugaggacaggg

SEQ ID NO: 262338 - RNA, 63 nt, Homo Sapiens
uggagcagcagcuacaagcagcccccagcagggcccuccgagggcugaaccccuacucccgga

SEQ ID NO: 262339 - RNA, 63 nt, Homo Sapiens
uggaacagcagcuacaagcagcccccagcagggcccuccgaggcagcugaaccccuacccgga

SEQ ID NO: 262340 - RNA, 63 nt, Homo Sapiens
aacacaguggccagguguccccaggcuccuggccccuccgacgaccucaacucugcccagccc

SEQ ID NO: 262341 - RNA, 63 nt, Homo Sapiens
ggcacccuccugagccggcgugugccgguccagcccuccgagaugccacaauuccuuggaugg

SEQ ID NO: 262342 - RNA, 64 nt, Homo Sapiens
gugugaaguuccagagcaaggagccauguuccucuaagggaauucaggaauucagacgugcuag

SEQ ID NO: 262343 - RNA, 64 nt, Homo Sapiens
gcucuucuaccucccuaguuaguggaaauuuggauaagggaacuguagggcccagauucuggag

SEQ ID NO: 262344 - RNA, 64 nt, Homo Sapiens
aauuuuugucuuuguuggagaccuuaaggaaaaguaagggaauacuucuaauuauuccaauaug

SEQ ID NO: 262345 - RNA, 64 nt, Homo Sapiens
aguuguaucaguaccauuugauauaauaccuuucuaagggaaaaccuggaacgguagcaauggg

SEQ ID NO: 262346 - RNA, 64 nt, Homo Sapiens
cggcauguacccuucaaggcccaucuaaucaacuuaagggaagcgaaagacgguguuugguuuc

SEQ ID NO: 262347 - RNA, 64 nt, Homo Sapiens
aguuugggcggccccucauagggagaguaagaacuaagggaaugaauaaaaucucaacaccugu

SEQ ID NO: 262348 - RNA, 64 nt, Homo Sapiens
uuuaggagagauaucauuaucgcuguuuuauaaauaagggaaacuuuagcuugaggguuuaagg

SEQ ID NO: 262349 - RNA, 64 nt, Homo Sapiens
aacugauguuuucagcauauuuucaaaauauugauaagggaaguuauuacuuuuauauaguauu

SEQ ID NO: 262350 - RNA, 64 nt, Homo Sapiens
aaaaugaguauuuuguccuucaacuguuuucauuuaagggaaagcucuccuucuaaaaacuucu

SEQ ID NO: 262351 - RNA, 64 nt, Homo Sapiens
auauacaaaaagaaaauuaaaaaacuauuauauguaagggaaauaucaggggagaaaaauuggc

SEQ ID NO: 262352 - RNA, 64 nt, Homo Sapiens
agccuggggaagacaaucaagcuacaggcacugauaagggaacuagcacaggggauugugccug

SEQ ID NO: 262353 - RNA, 64 nt, Homo Sapiens
guaaaaacucgcacaaaccuccggcucacucaguuaagggaacaagaccagacacagaaaugcc

SEQ ID NO: 262354 - RNA, 62 nt, Homo Sapiens
aagcccaguuucuccugagcauucagacccccaggccccagcacuuggcguuuucaggaggc

SEQ ID NO: 262355 - RNA, 62 nt, Homo Sapiens
caaaacacggccccgacacuuaguguggccccaggccccagcgagccucgcccucccaguuu

SEQ ID NO: 262356 - RNA, 62 nt, Homo Sapiens
ccuccccuaaacugacuggacggcugccaaggaggccccaaacccaggccccaugcaaaggc

SEQ ID NO: 262357 - RNA, 62 nt, Homo Sapiens
gacuggacggcugccaaggaggccccaaacccaggccccaugcaaaggcacgugguuuccuu

SEQ ID NO: 262358 - RNA, 62 nt, Homo Sapiens
gggccacuuggguuuugagaagcuuucauuauaggccccagucauacccgaaaggugaaacc

SEQ ID NO: 262359 - RNA, 62 nt, Homo Sapiens
cucaagcauuccucaggaaguaggccugccgcaggccccaccaggugaggccagaaaguugu

SEQ ID NO: 262360 - RNA, 62 nt, Homo Sapiens
uuccucccagagcucagcccaugucacccuccaggccccagaauccagaguggccucauuuc

SEQ ID NO: 262361 - RNA, 62 nt, Homo Sapiens
cuugcucugggaauuaggugaccuuccuggggaggccccaggagagugaaucagggacucuu

SEQ ID NO: 262362 - RNA, 62 nt, Homo Sapiens
agggucucaccucacauugucccuacaaggacaggccccaacugauaaccguugcuuuuuuu

SEQ ID NO: 262363 - RNA, 62 nt, Homo Sapiens
guggguaacacccucaagucucuuugccagugaggccccaccacaucggugugaguuagguu

SEQ ID NO: 262364 - RNA, 62 nt, Homo Sapiens
acucaaaaucacugccaugguucaauguucccaggccccaggccauccacuugccggccccc

SEQ ID NO: 262365 - RNA, 62 nt, Homo Sapiens
aggguauccuugggcccaaugaauuaggggugaggccccagaacccguuaucuaugaguugu

SEQ ID NO: 262366 - RNA, 62 nt, Homo Sapiens
cccagugaucuguauuugaugaggaggagccgaggccccagcuucauccagcuucaaccaau

SEQ ID NO: 262367 - RNA, 62 nt, Homo Sapiens
ugcacacuccagcccaaagggucuguggccggaggccccacgagcaggccccagcagucacc

SEQ ID NO: 262368 - RNA, 62 nt, Homo Sapiens
ccaaagggucuguggccggaggccccacgagcaggccccagcagucaccggcucuggucuug

SEQ ID NO: 262369 - RNA, 62 nt, Homo Sapiens
cguacucaggcuugugccacgggugagcacugaggccccagguguccucccucccccacugu

SEQ ID NO: 262370 - RNA, 62 nt, Homo Sapiens
ugagaacagguucugagagggggcuucuaggaaggccccagcccuaguccuaggcgacuuga

SEQ ID NO: 262371 - RNA, 62 nt, Homo Sapiens
uguaagaaacacacugaggcagggaaguccccaggccccaggaagccgugcccugcccccgu

SEQ ID NO: 262372 - RNA, 62 nt, Homo Sapiens
cccacucaagccaagcagccaagcuccuugggaggccccacuggggaaauaacagcuguggc

SEQ ID NO: 262373 - RNA, 62 nt, Homo Sapiens
ucuccacccugaacuccccagaggccaccaccaggccccagcggacuaugacuggcuacggg

SEQ ID NO: 262374 - RNA, 62 nt, Homo Sapiens
cugagccugcccugggcagcuguccccaacgcaggccccacuccgaccugggaugcgcacag

SEQ ID NO: 262375 - RNA, 62 nt, Homo Sapiens
cccugccucuccauuauuuaccccuccaccucaggccccagccacauaagccaacgccagag

SEQ ID NO: 262376 - RNA, 62 nt, Homo Sapiens
acccugugguccccuggcucgaggugccagggaggccccaggccagaggcgagggaccagug

SEQ ID NO: 262377 - RNA, 62 nt, Homo Sapiens
uuugauggcacauuuaauaccuuuuagaauugaggccccaacagaguaccuuugccuaaacu

SEQ ID NO: 262378 - RNA, 62 nt, Homo Sapiens
agacacacacaugagcaggguuaccgggugauaggccccauacccagcauccuaggcucagc

SEQ ID NO: 262379 - RNA, 62 nt, Homo Sapiens
accacucguaggaggucucacucuucgugggaaggccccagugcccgagagccuccccaggc

SEQ ID NO: 262380 - RNA, 62 nt, Homo Sapiens
gccgagacuccuggugacagaccgcagcaggcaggccccagcgcaucagacgggcuuccagg

SEQ ID NO: 262381 - RNA, 62 nt, Homo Sapiens
gggcaaaggagcacaaggaaaccaagcagcagaggccccaucagcacagagggccucguucc

SEQ ID NO: 262382 - RNA, 62 nt, Homo Sapiens
uucucuauucugacauuacagaccaccggauaaggccccauucuuccuuuacacccuccccu

SEQ ID NO: 262383 - RNA, 62 nt, Homo Sapiens
ccuuuucccauuguuccugcgcugcaaauugcaggccccagcaaucgugacugacguuugcu

SEQ ID NO: 262384 - RNA, 62 nt, Homo Sapiens
cgguugacccaggucauggaauggaaacggugaggccccaguggcuguucuggaagaaacag

SEQ ID NO: 262385 - RNA, 62 nt, Homo Sapiens
ggcuguucuggaagaaacagaucuccuggcaaaggccccagcaucucccucacugaaaccag

SEQ ID NO: 262386 - RNA, 62 nt, Homo Sapiens
acugagcuccucugggcaggaccucagaguccaggccccaaaaccacagcccugucagugca

SEQ ID NO: 262387 - RNA, 62 nt, Homo Sapiens
aacaccagggaugguacuagggggaagugacaaggccccagagacucagagggaggaaucga

SEQ ID NO: 262388 - RNA, 62 nt, Homo Sapiens
augauccugaaaucugcauccccaaaugggccaggccccagccugacagaaagcuccuccca

SEQ ID NO: 262389 - RNA, 57 nt, Homo Sapiens
gcagcacuuaugguagcggccccucccaggccccacggggagaccgacguccuuuag

SEQ ID NO: 262390 - RNA, 62 nt, Homo Sapiens
guccugggucuucccaaccauaccccgagaucaggccccaccugccagcucuacugggcuug

SEQ ID NO: 262391 - RNA, 62 nt, Homo Sapiens
gacaccgucucacacguuggcuuuggacaaccaggccccaacuuggucccugcccuagggac

SEQ ID NO: 262392 - RNA, 62 nt, Homo Sapiens
caggggaggcuguggggguccuggcagccaggaggccccaggugguuuugaggcucgcucuu

SEQ ID NO: 262393 - RNA, 62 nt, Homo Sapiens
ggugccugagaagagggugaaggagcuggggcaggccccauccugggcauuggagaugauga

SEQ ID NO: 262394 - RNA, 62 nt, Homo Sapiens
gcccugaggggaucucaaaucuaauaaauggaaggccccaagaaauccuaaagccuccaucu

SEQ ID NO: 262395 - RNA, 62 nt, Homo Sapiens
cuaggacucuggggaucccacccaaaauuuggaggccccauugacuucccccuuugggggac

SEQ ID NO: 262396 - RNA, 62 nt, Homo Sapiens
auuaacagauacucccauaaccucgaucauugaggccccauuagagaccccuguuagccagc

SEQ ID NO: 262397 - RNA, 62 nt, Homo Sapiens
gcgcugcaggggugucggcgcgccaccucuccaggccccagaagcccuucuugcccaaaggc

SEQ ID NO: 262398 - RNA, 62 nt, Homo Sapiens
cacaaaccucugugguauaggugaggggugugaggccccagccuggagccaggcacugggug

SEQ ID NO: 262399 - RNA, 62 nt, Homo Sapiens
gguaucugagcugcccacacccccaccugccaaggccccacagagcccaaaacagaaggggg

SEQ ID NO: 262400 - RNA, 62 nt, Homo Sapiens
agggccugcaggugcuccccgcccugagacccaggccccaaaucagcaauaaugaacaaacc

SEQ ID NO: 262401 - RNA, 62 nt, Homo Sapiens
gaggguauacugaggggucuauugcuggggccaggccccaugcccaagguugucagcuuugg

SEQ ID NO: 262402 - RNA, 62 nt, Homo Sapiens
ccuucccuauaggaacagccaauggaggagccaggccccaccaacucuccuggccuucuagg

SEQ ID NO: 262403 - RNA, 62 nt, Homo Sapiens
ccuguaaucaggcaaggaggggagaugugaucaggccccaccccagguauccugggggaaga

SEQ ID NO: 262404 - RNA, 64 nt, Homo Sapiens
auuguucaagaaaauuucuuaaaugagaaaucaaacauauuaaaaauacaaauauuccagcccc

SEQ ID NO: 262405 - RNA, 64 nt, Homo Sapiens
aacucuucuaauaaaugaagaauuguauuccuacacauauuagacuauauaaucuuacauuuaa

SEQ ID NO: 262406 - RNA, 64 nt, Homo Sapiens
uuguaucgcuuuugcuucucugauacuggugggcacauauuaauaacacuuugacuccuaaaug

SEQ ID NO: 262407 - RNA, 64 nt, Homo Sapiens
guggcucccuuuuucuuguguuaugggaauauacacauauuaaugauccgcacuuacauuagag

SEQ ID NO: 262408 - RNA, 64 nt, Homo Sapiens
uagacuuguuuuaguaauggaaacucuuaccuccacauauuauccuacagauguuuccagaaau

SEQ ID NO: 262409 - RNA, 64 nt, Homo Sapiens
cucaguuagauauauuuugugaacccuugauuagacauauuaaaauauaccaauguuguaguaa

SEQ ID NO: 262410 - RNA, 64 nt, Homo Sapiens
agauauagcacuuucaaaauaaccucuauacuacacauauuacauuaaaaaauagagcuugguc

SEQ ID NO: 262411 - RNA, 64 nt, Homo Sapiens
ggccaauauuuuuuuaaaaacuagugagcaauacacauauuauaauauuuucaggaucguucau

SEQ ID NO: 262412 - RNA, 64 nt, Homo Sapiens
gccuuuauuccaucucucaaacacuccuuuuuugacauauuaaaaaaauuuauuauaacacuaa

SEQ ID NO: 262413 - RNA, 64 nt, Homo Sapiens
auacuaaagcaguacuggacauuugaaaggguuuacauauuauuagagaccaaaacugucuaga

SEQ ID NO: 262414 - RNA, 64 nt, Homo Sapiens
cugcaggccaccuuccugguugccagagggauacacauauuaaaaauuuggggccuuguguuug

SEQ ID NO: 262415 - RNA, 64 nt, Homo Sapiens
aaauucguuugcguagguuuucauuuguaaaaacacauauuagcuucucuagagcaguuuuaug

SEQ ID NO: 262416 - RNA, 64 nt, Homo Sapiens
gaacaguaaaaugauguguugacuauacugauacacauauuaaacuauaccuuauaguaaacca

SEQ ID NO: 262417 - RNA, 64 nt, Homo Sapiens
uuaauauaauuagugcuuuacauguguuaguuauacauauuagaagcauauuugccuaguaagg

SEQ ID NO: 262418 - RNA, 64 nt, Homo Sapiens
cucaaaaguauaaaaaacuuuaauacaaguacauacauauuauauauacacauacauauauaua

SEQ ID NO: 262419 - RNA, 64 nt, Homo Sapiens
guguaauuguuucaaacauccauuuucuuugugaacauauuagugauugaaguauuuugacuuu

SEQ ID NO: 262420 - RNA, 64 nt, Homo Sapiens
ucuccucuaguagaccugugacuuacuguguuggacauauuauuuagacuuagucauacaaaga

SEQ ID NO: 262421 - RNA, 64 nt, Homo Sapiens
cagcuaaugggagagaauguaaaugugcaaagguacauauuaagcuuagggauuuuugaauuuu

SEQ ID NO: 262422 - RNA, 64 nt, Homo Sapiens
gucauauugggaaagauggcuuuuccauuuauacacauauuaaauugcugaacaccuuucccug

SEQ ID NO: 262423 - RNA, 64 nt, Homo Sapiens
uuuugaucacugcugcuugaccuuuuuaccacauacauauuaugaccacugaagaacaaguguu

SEQ ID NO: 262424 - RNA, 59 nt, Homo Sapiens
guggguugucucuucaugaagaaccagcggaacucaaaacugcuguucaagaaaccucu

SEQ ID NO: 262425 - RNA, 59 nt, Homo Sapiens
gacaguuaaauucagaaacgugccaaauggaacucaaggugccccuucagaauuaaaau

SEQ ID NO: 262426 - RNA, 59 nt, Homo Sapiens
uccuucagacuuuuaaggcaugccucauugaacucaacacuagguggaaccacuucuuc

SEQ ID NO: 262427 - RNA, 59 nt, Homo Sapiens
cuuaauuaacggggcacuaaaggauaaccgaacucaaggcagcccuucagcaccacugc

SEQ ID NO: 262428 - RNA, 59 nt, Homo Sapiens
auauuuugacuauuuuuauauauaaagaagaacucaaaaaauuauguucaaauuuguac

SEQ ID NO: 262429 - RNA, 59 nt, Homo Sapiens
gggcuguuucuacagguaacauuaaaugugaacucaacacuuccagagucuuuaaaggg

SEQ ID NO: 262430 - RNA, 59 nt, Homo Sapiens
guaaguaggcagcacuuuuaaaaauaugugaacucaaauauugcacuucuuucaagaug

SEQ ID NO: 262431 - RNA, 59 nt, Homo Sapiens
aggacauccagcugcucagcgucaaacacgaacucaaaguacagaccacacugcaggaa

SEQ ID NO: 262432 - RNA, 59 nt, Homo Sapiens
ccaacggcggugcugaccaagaugccauggaacucaagccccuuaagcagaacaaccgu

SEQ ID NO: 262433 - RNA, 59 nt, Homo Sapiens
cagaaggcaagaaauaacuaaaaucagcagaacucaaggaaauagagacacaaaaaaac

SEQ ID NO: 262434 - RNA, 59 nt, Homo Sapiens
acaaagggcuaauauccagaaucuacaaugaacucaaacaaauuuacaggaacaaacaa

SEQ ID NO: 262435 - RNA, 59 nt, Homo Sapiens
ccucaaaauugaguuacuguuggugcacagaacucaagacuucuaugauuccaagcauc

SEQ ID NO: 262436 - RNA, 59 nt, Homo Sapiens
ggugggaauauuuuaugauuacuguuagagaacucaaauugccauuaucaucauuacau

SEQ ID NO: 262437 - RNA, 64 nt, Homo Sapiens; identical to SEQ ID NO: 42317

SEQ ID NO: 262438 - RNA, 64 nt, Homo Sapiens; identical to SEQ ID NO: 42318

SEQ ID NO: 262439 - RNA, 64 nt, Homo Sapiens; identical to SEQ ID NO: 42319

SEQ ID NO: 262440 - RNA, 64 nt, Homo Sapiens; identical to SEQ ID NO: 42320

SEQ ID NO: 262441 - RNA, 64 nt, Homo Sapiens; identical to SEQ ID NO: 42321

SEQ ID NO: 262442 - RNA, 64 nt, Homo Sapiens; identical to SEQ ID NO: 42322

SEQ ID NO: 262443 - RNA, 64 nt, Homo Sapiens; identical to SEQ ID NO: 42323

SEQ ID NO: 262444 - RNA, 64 nt, Homo Sapiens; identical to SEQ ID NO: 42324

SEQ ID NO: 262445 - RNA, 64 nt, Homo Sapiens; identical to SEQ ID NO: 42325

SEQ ID NO: 262446 - RNA, 64 nt, Homo Sapiens; identical to SEQ ID NO: 42326

SEQ ID NO: 262447 - RNA, 64 nt, Homo Sapiens; identical to SEQ ID NO: 42327

SEQ ID NO: 262448 - RNA, 64 nt, Homo Sapiens; identical to SEQ ID NO: 42328

SEQ ID NO: 262449 - RNA, 64 nt, Homo Sapiens; identical to SEQ ID NO: 42329

SEQ ID NO: 262450 - RNA, 64 nt, Homo Sapiens; identical to SEQ ID NO: 42330

SEQ ID NO: 262451 - RNA, 64 nt, Homo Sapiens; identical to SEQ ID NO: 42331

SEQ ID NO: 262452 - RNA, 64 nt, Homo Sapiens; identical to SEQ ID NO: 42332

SEQ ID NO: 262453 - RNA, 64 nt, Homo Sapiens
gucauucauucaauaguguguguaguauuggugcuguguccaaauuagaagcuagcugagguag

SEQ ID NO: 262454 - RNA, 64 nt, Homo Sapiens
acucauagugguuguuucucuggucuugagugacuguguccacaguucauuuuuuuccgguagg

SEQ ID NO: 262455 - RNA, 64 nt, Homo Sapiens
auguacuauuuuguuuuuguaaaaaugugauguauguguccaguugggcuaaagccauaggaag

SEQ ID NO: 262456 - RNA, 64 nt, Homo Sapiens
ucaaccuuugugcugacaucuguuggaaagcugauguguccagcgaugucauugauguuucucc

SEQ ID NO: 262457 - RNA, 64 nt, Homo Sapiens
gugccgguggggauguuauauuggcuaacaguccuguguccagggccaaacaacugcagggagu

SEQ ID NO: 262458 - RNA, 64 nt, Homo Sapiens
uuccugagugauguguucgcuguacgucagcguguguguccaccuucguuucuaugaauguccg

SEQ ID NO: 262459 - RNA, 64 nt, Homo Sapiens
acaucaagcacgagcgaugaugacaccaaauccauguguccacccugggacccaggagggcaca

SEQ ID NO: 262460 - RNA, 64 nt, Homo Sapiens
cuuccaggagcucuaaggguacuugggaaucaauuguguccauucugaggucucuccaguggga

SEQ ID NO: 262461 - RNA, 64 nt, Homo Sapiens
gggugggcugucacugcuuggagggcuuucuggguguguccaggacugacccaggaccauccug

SEQ ID NO: 262462 - RNA, 64 nt, Homo Sapiens
gagacuuuccccucucgcgcucgugcugcaucccuguguccacuccucuucgugguuguguuuc

SEQ ID NO: 262463 - RNA, 64 nt, Homo Sapiens
guccugagcgaacuugccugaugcagggcugugcuguguccagauguugcuggggccucacuuu

SEQ ID NO: 262464 - RNA, 64 nt, Homo Sapiens
uuggaagugggaacaguuuuguccuguaugcugauguguccagaauuucauuuaaugauagacg

SEQ ID NO: 262465 - RNA, 64 nt, Homo Sapiens
gcaacagaagugacuucuggagaaagcucauggcuguguccacugcaauuggugguaacagugg

SEQ ID NO: 262466 - RNA, 64 nt, Homo Sapiens
ggcuaugaggauaaugggaagagguuugguuuccuguguccaguagugggaucauccagaggag

SEQ ID NO: 262467 - RNA, 64 nt, Homo Sapiens
guggaggggcuucuucagcacagagaccccccacuguguccagggacccccucugccaggugga

SEQ ID NO: 262468 - RNA, 64 nt, Homo Sapiens
acuguguccagggacccccucugccagguggagguguguccaggggcuggggaagccgagacgg

SEQ ID NO: 262469 - RNA, 64 nt, Homo Sapiens
cagcaggcggcauuggagucuaggagcucagcuguguguccaucaacacacaaauucguaaaaa

SEQ ID NO: 262470 - RNA, 64 nt, Homo Sapiens
ccccauuaaagacaaauugagggaaggaaacuguuguguccaaugacgccuccccaauucccca

SEQ ID NO: 262471 - RNA, 64 nt, Homo Sapiens
auuaggguccacgcccauguauauuaaucccucguguguccauaaagaaacgugucccuggccc

SEQ ID NO: 262472 - RNA, 64 nt, Homo Sapiens
cacgcccaugugugagugugugcaaguaugugaguguguccaagugugugugcguguguccaug

SEQ ID NO: 262473 - RNA, 64 nt, Homo Sapiens
ugcaaguaugugaguguguccaagugugugugcguguguccaugugugugcaagugugugcaug

SEQ ID NO: 262474 - RNA, 64 nt, Homo Sapiens
cuacaugucuguggguaucacacugagugugaguuguguccacacgugcucaagcagaaggacu

SEQ ID NO: 262475 - RNA, 64 nt, Homo Sapiens
guuguguccacacgugcucaagcagaaggacuuuuguguccaugcuugugucuagaaaacagac

SEQ ID NO: 262476 - RNA, 64 nt, Homo Sapiens
uuacccccaaccuggugcucucugaaacaugugcuguguccacucaggguuaaauggauuaagg

SEQ ID NO: 262477 - RNA, 64 nt, Homo Sapiens
gcagaaagaaaccuccagcaagggaagagagguguguguccacaggaaggggcuccguggggau

SEQ ID NO: 262478 - RNA, 64 nt, Homo Sapiens
ugguagaagggaaagcccauaugcuaccaccagcuguguccaaaaccgccagcucuguucuucc

SEQ ID NO: 262479 - RNA, 64 nt, Homo Sapiens
ugugucgcaugcgccaguugggccuggacccuccuguguccaucccuguucccccaggggcucu

SEQ ID NO: 262480 - RNA, 64 nt, Homo Sapiens
cugggggguaagcccacgugugcuuagggacuucuguguccaucaggcuggcccagcugcagac

SEQ ID NO: 262481 - RNA, 64 nt, Homo Sapiens
gugaugaguguggacggggggaagcccccgagguuguguccaggacauccuucccuccuuuagu

SEQ ID NO: 262482 - RNA, 64 nt, Homo Sapiens
ccuggagccagccagugcaugaguucugugccuguguguccagcagcuuugagaagcgguacaa

SEQ ID NO: 262483 - RNA, 64 nt, Homo Sapiens
gccccgcuagacggcuuucuauauagaauaguguuguguccacucccccacauuuaauugucug

SEQ ID NO: 262484 - RNA, 64 nt, Homo Sapiens
uuucuucccuucuugacuucuaauaggugucauugaaauguaaaaucuaaguaugaaauuauga

SEQ ID NO: 262485 - RNA, 64 nt, Homo Sapiens
aagaaaaaagaaaaugagcaagcaaauauuugaagaaauguauaaaaccauagauuucuuucag

SEQ ID NO: 262486 - RNA, 64 nt, Homo Sapiens
uuuccauccacaguguacuuuaagauugucuuaagaaauguaucugcaugaacuccgugggaac

SEQ ID NO: 262487 - RNA, 64 nt, Homo Sapiens
ggaacacucacuaugguuaaauaaggucuuaaaagaaauguaaauauucuguuaauaaaguuaa

SEQ ID NO: 262488 - RNA, 64 nt, Homo Sapiens
agagagguauagauaaaugcaucacaucacuuuugaaauguaauucuggucuauaccauggaag

SEQ ID NO: 262489 - RNA, 64 nt, Homo Sapiens
ucccauuccucuuggguuucaucuugucguuuaagaaauguacugaaauaaucauuggaauauu

SEQ ID NO: 262490 - RNA, 64 nt, Homo Sapiens
acaaucuuagccuacguuacacuucuuuggaaaugaaauguagccaauaaagaccuccaagggu

SEQ ID NO: 262491 - RNA, 64 nt, Homo Sapiens
auccgcugcagcuggccacaccacuguuuucugagaaauguagcucuugacucucccggcucug

SEQ ID NO: 262492 - RNA, 64 nt, Homo Sapiens
acuucuucaucuuuaacuugcauuucugagugaugaaauguaacguacagacagguaaaaguuc

SEQ ID NO: 262493 - RNA, 64 nt, Homo Sapiens
auauaaacuucagucaauaugaauuuucacguuugaaauguaaaaauuggaaaugggcaguucu

SEQ ID NO: 262494 - RNA, 64 nt, Homo Sapiens
uuggaucuaguuuaauuuuuuuuuuuuuuuagaggaaauguaacuggcagcuguccuuugacau

SEQ ID NO: 262495 - RNA, 64 nt, Homo Sapiens
ucagaaaugaccuccucuccuuguauuucuccuggaaauguaucaccagcuccuucucucaaac

SEQ ID NO: 262496 - RNA, 64 nt, Homo Sapiens
cacagauuccugucccuuugggaaacaggagcaggaaauguacagcccugaggauggugguuaa

SEQ ID NO: 262497 - RNA, 64 nt, Homo Sapiens
ugagcccuuaagguaagagagaaauugcuucucugaaauguacaagagaauaaguauagcuaga

SEQ ID NO: 262498 - RNA, 64 nt, Homo Sapiens
gaauguuuugaaaguguuuuguucugaguggcuugaaauguacaauuuguagaaauguaaugcg

SEQ ID NO: 262499 - RNA, 64 nt, Homo Sapiens
gcgguucugaguggcuugaaaaaucacauuuguagaaauguaauucuuggcaccucaucccaac

SEQ ID NO: 262500 - RNA, 64 nt, Homo Sapiens
cauccaaagaucauuuuuaaggaaaacauaguuggaaauguaauaacauuaaaugucaauuaua

SEQ ID NO: 262501 - RNA, 64 nt, Homo Sapiens
uuuuuucugaaugcuguuucgaugcugaccaucugaaauguacucaaagucuguaguaaauccu

SEQ ID NO: 262502 - RNA, 64 nt, Homo Sapiens
ugcuuuucuuuagaaaauaucggaugagagguuggaaauguagcgauggauucaacuucugccu

SEQ ID NO: 262503 - RNA, 64 nt, Homo Sapiens
cauuuaaagacaaagacauuauuucucauagcaggaaauguagagguagaugguuccaguauca

SEQ ID NO: 262504 - RNA, 64 nt, Homo Sapiens
aaaccuuaugaacuacaguggagcuacacucauugaaauguaauuucaguucuaaaaagaugua

SEQ ID NO: 262505 - RNA, 64 nt, Homo Sapiens
augcuucccccccgcuuuuuacucuuaucaucuagaaauguaaugagaaaagaguacagcauuu

SEQ ID NO: 262506 - RNA, 64 nt, Homo Sapiens
auuagcucucacaaaagagggggugaaacuaagagaaauguagcuaaguuugugaagguguggu

SEQ ID NO: 262507 - RNA, 64 nt, Homo Sapiens
ugcuaugcauuuugaaaauagugccuacucgaaagaaauguagagcacugguguaaauaucaug

SEQ ID NO: 262508 - RNA, 64 nt, Homo Sapiens
uuuuauuaugcaaugccuuacguugcaccaaauagaaauguauaacuauagauuccaaacauaa

SEQ ID NO: 262509 - RNA, 64 nt, Homo Sapiens
guugguuuuuuucccucuuucccaacauguuuaagaaauguaacauucuaaguauuggaucucu

SEQ ID NO: 262510 - RNA, 64 nt, Homo Sapiens
gaggagaaacagggugagucaagguaaaggagcagaaauguaguuacaagccaggucgucuuca

SEQ ID NO: 262511 - RNA, 64 nt, Homo Sapiens
aucuauccucagguuugccucaaauaugugacaagaaauguauaauucaugacauagucaugua

SEQ ID NO: 262512 - RNA, 64 nt, Homo Sapiens
agguguguugcaucaauauuuaaauaaaaucccagaaauguauuuuaaagaauuucagguuuga

SEQ ID NO: 262513 - RNA, 64 nt, Homo Sapiens
uaagauguaaauugaagaagccucacacguaaaagaaauguauuaauguauguaggagcugcag

SEQ ID NO: 262514 - RNA, 64 nt, Homo Sapiens
uauugauuuucacagcuuugaggaacaugcauaagaaauguagcugaaguagaggggacgugag

SEQ ID NO: 262515 - RNA, 64 nt, Homo Sapiens
aauaguacaugaaaucaagaugcuuaugagcauggaaauguauuuaaaguuuuugcuugugucc

SEQ ID NO: 262516 - RNA, 64 nt, Homo Sapiens
uguugauaaacauuuuaugcuugcauuuaaacuugaaauguaugagcagaaugagacaaucagu

SEQ ID NO: 262517 - RNA, 64 nt, Homo Sapiens
gcacaaauuuuuaugggacaaagccuagaaaagagaaauguaguuugaaucauaaucuaaauca

SEQ ID NO: 262518 - RNA, 64 nt, Homo Sapiens
uucuccuuucacugguguuggacuuaaaucaguugaaauguauuucuguaccacaauuuacgcu

SEQ ID NO: 262519 - RNA, 64 nt, Homo Sapiens
auuuauuauuugucauuuuuaaauuagugccucggaaauguagacccucccacuucugaaguuc

SEQ ID NO: 262520 - RNA, 64 nt, Homo Sapiens
uggccucuacagaguuuuauauuacagaauuuacgaaauguaaagcaugauacaguaaggugua

SEQ ID NO: 262521 - RNA, 64 nt, Homo Sapiens
gggggguggaggagaauaaguuaaaaaauauucagaaauguauuaguacucagugauaaaugga

SEQ ID NO: 262522 - RNA, 64 nt, Homo Sapiens
gaugaggcagagaauaaaguccccccgaaaaauugaaauguaaaaacuauauuugaacgacauu

SEQ ID NO: 262523 - RNA, 64 nt, Homo Sapiens
cuugaauacauuuugagaauaacuaauguggauugaaauguagagauacacuggagugcuuuau

SEQ ID NO: 262524 - RNA, 64 nt, Homo Sapiens
ugaugacuguguuaagugcaucuguauuguaagugaaauguaauuauuucuguguaccauaugg

SEQ ID NO: 262525 - RNA, 64 nt, Homo Sapiens
ucuuucuucagaauuaaaacaaacuaaaaacaaggaaauguacccugguuauaaccugacgcua

SEQ ID NO: 262526 - RNA, 64 nt, Homo Sapiens
ucauuucuucaguccuucucauaauauaagagcugaaauguaagcacagauuuaauaccuauua

SEQ ID NO: 262527 - RNA, 64 nt, Homo Sapiens
gugguaaguauaucucaguuuaaaugguaaagaagaaauguaguuuacauuuguauuuuuccag

SEQ ID NO: 262528 - RNA, 64 nt, Homo Sapiens
gaaaagcaaagucaguguacacucugagugaaaggaaauguaauguggauaaaggcccgccacc

SEQ ID NO: 262529 - RNA, 64 nt, Homo Sapiens
accauuccugagguuuaaaauucacggcaccauggaaauguagcugaacgucuccaguuuccuu

SEQ ID NO: 262530 - RNA, 64 nt, Homo Sapiens
ucuaaaaacccaaaauguaguucucuauuaaccugaaauguacacuagcccagaacaguuuaau

SEQ ID NO: 262531 - RNA, 64 nt, Homo Sapiens
uuguaauaauguaaauggggguauaauuuguggagaaauguaaaauuuaaaauauuugggagua

SEQ ID NO: 262532 - RNA, 64 nt, Homo Sapiens
uguagcugugcccuagaugaauggauucauuacagaaauguauguuucaguaggauucugggac

SEQ ID NO: 262533 - RNA, 64 nt, Homo Sapiens
aaugcauuuccaaacugccuuuauggacguuguagaaauguacaauucuuauuuucaagagaau

SEQ ID NO: 262534 - RNA, 64 nt, Homo Sapiens
gaauccauuugucaucaggacaccuuuccccccugaaauguauauuaaacucacauccauauua

SEQ ID NO: 262535 - RNA, 64 nt, Homo Sapiens
aucuguugccacccaggugauguuaguguuuuaagaaauguaguugauguauccaacaagccag

SEQ ID NO: 262536 - RNA, 64 nt, Homo Sapiens
aaauacaggcaauuuuacugugaguguuucacuggaaauguacaaucuuuguguguuagaguau

SEQ ID NO: 262537 - RNA, 64 nt, Homo Sapiens
gaaaaacauuggguuucucucuggguuuggacaugaaauguaagaaaagauuuuucacuggagc

SEQ ID NO: 262538 - RNA, 64 nt, Homo Sapiens
acuuggcuucgauuuuuauauuuuccuauuauaugaaauguaucuuuugguuguuugauuuuuc

SEQ ID NO: 262539 - RNA, 64 nt, Homo Sapiens
aguugcucaaguuaucaagcuaaacaaaaucagagaaauguauccuuaccuuuauguauauaau

SEQ ID NO: 262540 - RNA, 64 nt, Homo Sapiens
uaguuuucuuuucgauuaaauuucuuuuguauuugaaauguaaacaaucaagaauaauuuuaau

SEQ ID NO: 262541 - RNA, 64 nt, Homo Sapiens
uacuguguuugugcuguaaguguacaaagaacuugaaauguaaaccaaaauggcauacaucuuu

SEQ ID NO: 262542 - RNA, 64 nt, Homo Sapiens
uauucaaacagaagugccucguaauuauguuuuggaaauguacaguuaguacuacuuaccagau

SEQ ID NO: 262543 - RNA, 64 nt, Homo Sapiens
cauuacaugacuauuggugauuuaaucaguuucugaaauguaagcauuccuaucuuauuguucg

SEQ ID NO: 262544 - RNA, 64 nt, Homo Sapiens
uauuccuuauuuaagacaugaaucagaagguuucgaaauguaaaaaaccagaucaaauuaauac

SEQ ID NO: 262545 - RNA, 64 nt, Homo Sapiens
gaauuugauccaugcgauaccucaugaccauauugaaauguacgaauuuuggaauacagccuau

SEQ ID NO: 262546 - RNA, 64 nt, Homo Sapiens
caaauuuguuuuuuaagguuucccauuuaaauaugaaauguaaauuuacucaggguuuaaaaug

SEQ ID NO: 262547 - RNA, 64 nt, Homo Sapiens
ugggaaaaauaagaugguuaaauuuugauuuauugaaauguaauuguauuauuuucauaaaaua

SEQ ID NO: 262548 - RNA, 64 nt, Homo Sapiens
cucaaaaaaaaaaaaaaauuguguugccucauacgaaauguauuugguuuuguuggagaguguc

SEQ ID NO: 262549 - RNA, 64 nt, Homo Sapiens
aagaauuuauauuuugccuguugaucuaagaauugaaauguaucggggaagauaugcaaauacu

SEQ ID NO: 262550 - RNA, 64 nt, Homo Sapiens
aaucuucacucaccauuaugagaaaauccacugggaaauguaaauuuuuucccuauugacuguc

SEQ ID NO: 262551 - RNA, 64 nt, Homo Sapiens
aaucgagauaacauuuacauuugcaagucaaauagaaauguacaaaauuuaaaggagcaaaaau

SEQ ID NO: 262552 - RNA, 64 nt, Homo Sapiens
caaucagcucacaggcaucacagagauguggggagaaauguaaaaccuacaugcugucauugaa

SEQ ID NO: 262553 - RNA, 64 nt, Homo Sapiens
uguuggcaggagaaggccagaaaaaagaaaaaaagaaauguaccacuccgccucaaaaaaaaaa

SEQ ID NO: 262554 - RNA, 64 nt, Homo Sapiens
uguuggcggccgggugcaguguacagacaauacagaaauguaccguucccuuuauuuuaacauu

SEQ ID NO: 262555 - RNA, 64 nt, Homo Sapiens
uuuuaaguguaauuaaguugaagaucaaaaaauggaaauguauaauuaaaucauacuuagcaaa

SEQ ID NO: 262556 - RNA, 64 nt, Homo Sapiens
uauaauuaaaucauacuuagcaaaucuaacacaugaaauguaacaucugcauauggagaaucgu

SEQ ID NO: 262557 - RNA, 64 nt, Homo Sapiens
gaaguauucuuuaauguuaucucuauaaaugugugaaauguaggaaggacucacuggagagaua

SEQ ID NO: 262558 - RNA, 64 nt, Homo Sapiens
aaagcauugaguucucucagucauaugaauguaagaaauguagaggauucacucuggagagaag

SEQ ID NO: 262559 - RNA, 64 nt, Homo Sapiens
caaauuauggccauauggcuauaguuuuauauuugaaauguaugauguaaaaaaaaaaaaaagu

SEQ ID NO: 262560 - RNA, 64 nt, Homo Sapiens
gucagggcucuguacaguuucuggcugucagagugaaauguaaauccauguggugcuuccgacc

SEQ ID NO: 262561 - RNA, 64 nt, Homo Sapiens
uugccugagaucaaauuaagaauggaggcccagagaaauguaauccucuucuuaaaaaugagua

SEQ ID NO: 262562 - RNA, 64 nt, Homo Sapiens
uuuaucugcaggauaauauuacauguauauacaagaaauguauuuuucuuucauguagaaaucu

SEQ ID NO: 262563 - RNA, 64 nt, Homo Sapiens
ucguaaaaaauguacauuugcccuuucucuuccuucuaaacaugugucucucccacaggucauu

SEQ ID NO: 262564 - RNA, 64 nt, Homo Sapiens
cugaauacgcauucagggacagaucuaggcaguuucuaaacaacacuuagacuggggucuaacg

SEQ ID NO: 262565 - RNA, 64 nt, Homo Sapiens
acauuuaauuuguuuauaaagaauauaaaaugcaucuaaacaugggauaaaaagguguggaagu

SEQ ID NO: 262566 - RNA, 64 nt, Homo Sapiens
ugucaguuuuccacuggauuuuguuuauucaaugucuaaacacacuuuuaauauuuaaaauaac

SEQ ID NO: 262567 - RNA, 64 nt, Homo Sapiens
gaaaauaauguuacaaaagcgugauuuuuuucuuucuaaacagggacuuuucaauacuauugga

SEQ ID NO: 262568 - RNA, 64 nt, Homo Sapiens
ucgcacuuucuccacaggcaucccuaccaguauuucuaaacaugaagcuuuucuuacuccuggu

SEQ ID NO: 262569 - RNA, 64 nt, Homo Sapiens
gaaaagguacaguaaaaauauguaucuaaacauaucuaaacauaaacacagugcuaaguauuug

SEQ ID NO: 262570 - RNA, 64 nt, Homo Sapiens
ucuaaacauagaaaagguacuaaguauuuguguaucuaaacauaaggcgguuguaacacagugc

SEQ ID NO: 262571 - RNA, 64 nt, Homo Sapiens
auuuuucacuuguuuuugccaaugggagguagacacaauaaaauaaugccaugggagucacacu

SEQ ID NO: 262572 - RNA, 64 nt, Homo Sapiens
uuauuuuuucucugaaaauuuugugugugauugcacaauaaauaauuuuuagagaaacaaaggc

SEQ ID NO: 262573 - RNA, 64 nt, Homo Sapiens
uauucaaauaccaauaacagacagcauucuugucacaauaaauguuugcuuaugaauauuuaua

SEQ ID NO: 262574 - RNA, 64 nt, Homo Sapiens
auuggaaaguacuccccuaaauauuuaagaaaauacaauaaacuuucugaaaauuccagaaagg

SEQ ID NO: 262575 - RNA, 64 nt, Homo Sapiens
cuaugaguauaaauacauaacacccuggucagauacaauaaaggccaggagauuucauuuuauu

SEQ ID NO: 262576 - RNA, 64 nt, Homo Sapiens
guaccaaacuaaacugacagggaccucuuaggcuacaauaaacuuccucucuugaaaucuugcu

SEQ ID NO: 262577 - RNA, 64 nt, Homo Sapiens
acacuuuuuuaaagcuuagaguauaaaggucuguacaauaaaucuuuuuccuugagugugcuuu

SEQ ID NO: 262578 - RNA, 64 nt, Homo Sapiens
uagaaagaauuuauaugaauaauuacuugauagcacaauaaacaucaaauuggaugaaauauau

SEQ ID NO: 262579 - RNA, 64 nt, Homo Sapiens
uuguuucuaauuuuugcauuuauuuuaacaauaaacaauaaacgcuuuucucaugagagcucac

SEQ ID NO: 262580 - RNA, 64 nt, Homo Sapiens
auaaacguuguuucuaauuuagcucacuauuuuaacaauaaacaacauacucuuuucucaugag

SEQ ID NO: 262581 - RNA, 64 nt, Homo Sapiens
caaaaaauaaaaagucugugauguauauuuuaccacaauaaaugugguuaaaagguuuuauguu

SEQ ID NO: 262582 - RNA, 64 nt, Homo Sapiens
aaauaccccuuagaaagucuacauaaucuuuuaaacaauaaaacuguaucccaaaguuauuacc

SEQ ID NO: 262583 - RNA, 64 nt, Homo Sapiens
aaaguugauuugaagugaggauuagaagugaaugacaauaaagucugucagccaagcacgaacc

SEQ ID NO: 262584 - RNA, 64 nt, Homo Sapiens
cucugaaaauaaaaacccugacuuuaguuguaaaacaauaaaaguuagcuacuugguauacgga

SEQ ID NO: 262585 - RNA, 64 nt, Homo Sapiens
aaacaaagccuacauuaguugacauuaacuaaugacaauaaauuauucaguuuaguacaggagu

SEQ ID NO: 262586 - RNA, 64 nt, Homo Sapiens
uauaacauaaucuauucaucuaaagaaaucuauuacaauaaaaauaguugacuuuguauauaua

SEQ ID NO: 262587 - RNA, 64 nt, Homo Sapiens
accaccaaguacuaccugacugaacuaguaugugacaauaaaugaaagggaugaaugugaauua

SEQ ID NO: 262588 - RNA, 64 nt, Homo Sapiens
caacuuuuaauuguauagaucuccaacauauuuuacaauaaaagauuuaaaagaacauuuuucu

SEQ ID NO: 262589 - RNA, 64 nt, Homo Sapiens
gugagucaacuuuagaacaaaaguguuucugaagacaauaaauuaauuuguugauuuuguacca

SEQ ID NO: 262590 - RNA, 64 nt, Homo Sapiens
uguaauauaauaaauuuggcauggaaagaaaaagacaauaaaaucuaguuaaucauaauauuug

SEQ ID NO: 262591 - RNA, 64 nt, Homo Sapiens
acaacauagaguacacauauaaauaaaauuucacacaauaaaaauauuaaaaauauuauuagua

SEQ ID NO: 262592 - RNA, 64 nt, Homo Sapiens
agccugcuacauguaaaaagguuuuuguaauuuaacaauaaauaucuguuguaauuguaguauu

SEQ ID NO: 262593 - RNA, 64 nt, Homo Sapiens
agcagaagaacuaguaaaaagcaagcaaagcaaaacaauaaacuguauauaaaugaacaaaaaa

SEQ ID NO: 262594 - RNA, 64 nt, Homo Sapiens
uuccaaauggacuauuuguuuaaggcauuaaaugacaauaaaaagaauuuguaccuauaaagca

SEQ ID NO: 262595 - RNA, 64 nt, Homo Sapiens
acuuuaaaauggaaaauuuauauguauuuuuaccacaauaaacaaaaaacccuaaaaaaacuuu

SEQ ID NO: 262596 - RNA, 64 nt, Homo Sapiens
uuaacuuacaaugugaaaauacaaugugaaauguacaauaaaucauauuuauggacagaugcgu

SEQ ID NO: 262597 - RNA, 64 nt, Homo Sapiens
cuuuuucuguguuucuagguucugaaacuuaaaaacaauaaauuacuauucuguuacuuuuauu

SEQ ID NO: 262598 - RNA, 64 nt, Homo Sapiens
acuguuuaaaaaagaucucauuaccuuaagaaacacaauaaaucuagaauuuguuuuuguuguu

SEQ ID NO: 262599 - RNA, 64 nt, Homo Sapiens
uagcuuguaacuugagaucuuaugggaauucuuuacaauaaacagccagcccuggauagguuuu

SEQ ID NO: 262600 - RNA, 64 nt, Homo Sapiens
cugagacccguucgcccccagaaagaaacacucaacaauaaagaccuuuuucaacuuggaaaaa

SEQ ID NO: 262601 - RNA, 64 nt, Homo Sapiens
uacaugauugaaaccaaguuuaacauuaagaaaaacaauaaagaaauaaaaccaaacaugcuua

SEQ ID NO: 262602 - RNA, 64 nt, Homo Sapiens
caaacaugcuuauaacauuaaugauuuaaagacuacaauaaaacacauacuaaugaaguauuac

SEQ ID NO: 262603 - RNA, 64 nt, Homo Sapiens
cacaaaagauauaaacaggacaaccuuagaaaagacaauaaaugugcaaaauaaagaaaaaugc

SEQ ID NO: 262604 - RNA, 64 nt, Homo Sapiens
gaauuuuuugacuaagcauaauucuugcugaagaacaauaaacauuuuuaaagugguuacaucu

SEQ ID NO: 262605 - RNA, 64 nt, Homo Sapiens
cuggcauuaauacaaaccucagcauuugucuaauacaauaaaaagaagucuucgauucucagag

SEQ ID NO: 262606 - RNA, 64 nt, Homo Sapiens
cgaaugagcugguucuuuccauacauacauacauacaauaaaacgagauucugucucaaaauaa

SEQ ID NO: 262607 - RNA, 64 nt, Homo Sapiens
gaaaaucugccguggaauuaacuaauaaguaguaacaauaaacuucauauuuagaaugcaaagu

SEQ ID NO: 262608 - RNA, 64 nt, Homo Sapiens
uaauauuugaaggagauugccuaccaaggacaaaacaauaaauuuaaaaaucaaacgauuucuc

SEQ ID NO: 262609 - RNA, 64 nt, Homo Sapiens
uauucuuaucacuuccuaucugguauuuaauaauacaauaaaaaagugggggggaaagaugaca

SEQ ID NO: 262610 - RNA, 64 nt, Homo Sapiens
acucaaaauaaauggucuuugauuauuuguuaugacaauaaaacuaauacacagaauguguaca

SEQ ID NO: 262611 - RNA, 64 nt, Homo Sapiens
acugggccaaugcuuaauauuuuaauguaucucaacaauaaaaccaagaagaaacaaagccuuu

SEQ ID NO: 262612 - RNA, 64 nt, Homo Sapiens
augcuauucuguauuuuuacuguauauugcuuuuacaauaaauauaaaaugaaauguuuauguu

SEQ ID NO: 262613 - RNA, 64 nt, Homo Sapiens
guauuaucaaagagaacgugcgcucgguccguggacaauaaacauuguaucauucuugagcaau

SEQ ID NO: 262614 - RNA, 64 nt, Homo Sapiens
guggcaauauauauauaguugcucaaauaccuucacaauaaauaggcagcugacagaggaagcc

SEQ ID NO: 262615 - RNA, 64 nt, Homo Sapiens
guaaacucugcauccagagauucauuuucuagauacaauaaauugcuaauguugcuggaucagg

SEQ ID NO: 262616 - RNA, 64 nt, Homo Sapiens
ugagauucaauauugaauuuuuccuaugcuauugacaauaaaauauuauugaacuacaugucuu

SEQ ID NO: 262617 - RNA, 64 nt, Homo Sapiens
ugucauuuaggauaaacugguuaugacccaaaucacaauaaaauuaaacaauuauuuaucacuu

SEQ ID NO: 262618 - RNA, 64 nt, Homo Sapiens
uuucauaauuuacaaaggagauuacucagucuaaacaauaaauagguuuguuguuucaugucau

SEQ ID NO: 262619 - RNA, 64 nt, Homo Sapiens
uucauguaaucaccccuuagccauaagaaaugguacaauaaaaacacaguuugcuuauuugcca

SEQ ID NO: 262620 - RNA, 64 nt, Homo Sapiens
gacagagaacgcuacuaaugcuugauuucuuuccacaauaaacuucuuuuugagaauuuguuua

SEQ ID NO: 262621 - RNA, 64 nt, Homo Sapiens
uaggaccuugaugugaggaaaagauaaaauuuaaacaauaaauuugccacuuagauuuucuagc

SEQ ID NO: 262622 - RNA, 64 nt, Homo Sapiens
uauauuuuguagaacccaaaagauuggagccuuaacaauaaacaucagcacuaagugaccuguu

SEQ ID NO: 262623 - RNA, 64 nt, Homo Sapiens
auugucuauauggaauuuaggauaaagaauauuuacaauaaagaauauuuacaauaaagaguuu

SEQ ID NO: 262624 - RNA, 64 nt, Homo Sapiens
uuaggauaaagaauauuuacaauaaagaauauuuacaauaaagaguuuauuauuauuuguaagu

SEQ ID NO: 262625 - RNA, 64 nt, Homo Sapiens
uaauuggcuauauggaauuuaggauagaauauuuacaauaaagaguauuuacaauaaagaguuu

SEQ ID NO: 262626 - RNA, 64 nt, Homo Sapiens
auuuaggauagaauauuuacaauaaagaguauuuacaauaaagaguuuguuauuauuuguaaau

SEQ ID NO: 262627 - RNA, 64 nt, Homo Sapiens
uuacugcugaauucucaauuuucuuaacauugagacaauaaauguguguuuugucuuguauaug

SEQ ID NO: 262628 - RNA, 64 nt, Homo Sapiens
uauauaggcuugucaguucccauuuuucuugacaacaauaaauaccacuuuuaaaaaugacaca

SEQ ID NO: 262629 - RNA, 64 nt, Homo Sapiens
uguguuacuguuuaccauggcaguaauggggcaaacaauaaaaugcaaugugaaaugauuugau

SEQ ID NO: 262630 - RNA, 64 nt, Homo Sapiens
aaaaaucauucuggagguggcauguccuugacucacaauaaaaauuuuagaaaacuauugaaag

SEQ ID NO: 262631 - RNA, 64 nt, Homo Sapiens
gugcuguacacguaaaugucuuauagaauguuugacaauaaauuucaucuuugugugaagccag

SEQ ID NO: 262632 - RNA, 64 nt, Homo Sapiens
uccagucuuaauuccagauuaguugauauugacuacaauaaaaacaaucugcaacaauauguaa

SEQ ID NO: 262633 - RNA, 64 nt, Homo Sapiens; identical to SEQ ID NO: 90763

SEQ ID NO: 262634 - RNA, 64 nt, Homo Sapiens; identical to SEQ ID NO: 90764

SEQ ID NO: 262635 - RNA, 64 nt, Homo Sapiens; identical to SEQ ID NO: 90765

SEQ ID NO: 262636 - RNA, 64 nt, Homo Sapiens; identical to SEQ ID NO: 90766

SEQ ID NO: 262637 - RNA, 64 nt, Homo Sapiens; identical to SEQ ID NO: 90767

SEQ ID NO: 262638 - RNA, 64 nt, Homo Sapiens; identical to SEQ ID NO: 90768

SEQ ID NO: 262639 - RNA, 64 nt, Homo Sapiens; identical to SEQ ID NO: 90769

SEQ ID NO: 262640 - RNA, 64 nt, Homo Sapiens; identical to SEQ ID NO: 90770

SEQ ID NO: 262641 - RNA, 64 nt, Homo Sapiens; identical to SEQ ID NO: 90771

SEQ ID NO: 262642 - RNA, 64 nt, Homo Sapiens; identical to SEQ ID NO: 90772

SEQ ID NO: 262643 - RNA, 64 nt, Homo Sapiens; identical to SEQ ID NO: 90773

SEQ ID NO: 262644 - RNA, 64 nt, Homo Sapiens; identical to SEQ ID NO: 90774

SEQ ID NO: 262645 - RNA, 64 nt, Homo Sapiens; identical to SEQ ID NO: 90775

SEQ ID NO: 262646 - RNA, 64 nt, Homo Sapiens; identical to SEQ ID NO: 90776

SEQ ID NO: 262647 - RNA, 64 nt, Homo Sapiens; identical to SEQ ID NO: 90777

SEQ ID NO: 262648 - RNA, 64 nt, Homo Sapiens; identical to SEQ ID NO: 90778

SEQ ID NO: 262649 - RNA, 64 nt, Homo Sapiens; identical to SEQ ID NO: 90779

SEQ ID NO: 262650 - RNA, 64 nt, Homo Sapiens; identical to SEQ ID NO: 90780

SEQ ID NO: 262651 - RNA, 64 nt, Homo Sapiens; identical to SEQ ID NO: 90781

SEQ ID NO: 262652 - RNA, 64 nt, Homo Sapiens; identical to SEQ ID NO: 90782

SEQ ID NO: 262653 - RNA, 64 nt, Homo Sapiens; identical to SEQ ID NO: 90783

SEQ ID NO: 262654 - RNA, 64 nt, Homo Sapiens; identical to SEQ ID NO: 90784

SEQ ID NO: 262655 - RNA, 64 nt, Homo Sapiens; identical to SEQ ID NO: 90785

SEQ ID NO: 262656 - RNA, 64 nt, Homo Sapiens; identical to SEQ ID NO: 90786

SEQ ID NO: 262657 - RNA, 64 nt, Homo Sapiens; identical to SEQ ID NO: 90787

SEQ ID NO: 262658 - RNA, 64 nt, Homo Sapiens; identical to SEQ ID NO: 90788

SEQ ID NO: 262659 - RNA, 64 nt, Homo Sapiens; identical to SEQ ID NO: 90789

SEQ ID NO: 262660 - RNA, 64 nt, Homo Sapiens; identical to SEQ ID NO: 90790

SEQ ID NO: 262661 - RNA, 64 nt, Homo Sapiens; identical to SEQ ID NO: 90791

SEQ ID NO: 262662 - RNA, 64 nt, Homo Sapiens; identical to SEQ ID NO: 90792

SEQ ID NO: 262663 - RNA, 64 nt, Homo Sapiens; identical to SEQ ID NO: 90793

SEQ ID NO: 262664 - RNA, 64 nt, Homo Sapiens; identical to SEQ ID NO: 90794

SEQ ID NO: 262665 - RNA, 64 nt, Homo Sapiens; identical to SEQ ID NO: 90795

SEQ ID NO: 262666 - RNA, 64 nt, Homo Sapiens; identical to SEQ ID NO: 90796

SEQ ID NO: 262667 - RNA, 64 nt, Homo Sapiens; identical to SEQ ID NO: 90797

SEQ ID NO: 262668 - RNA, 64 nt, Homo Sapiens; identical to SEQ ID NO: 90798

SEQ ID NO: 262669 - RNA, 64 nt, Homo Sapiens; identical to SEQ ID NO: 90799

SEQ ID NO: 262670 - RNA, 64 nt, Homo Sapiens; identical to SEQ ID NO: 90800

SEQ ID NO: 262671 - RNA, 64 nt, Homo Sapiens; identical to SEQ ID NO: 90801

SEQ ID NO: 262672 - RNA, 64 nt, Homo Sapiens; identical to SEQ ID NO: 90802

SEQ ID NO: 262673 - RNA, 64 nt, Homo Sapiens; identical to SEQ ID NO: 90803

SEQ ID NO: 262674 - RNA, 64 nt, Homo Sapiens; identical to SEQ ID NO: 90804

SEQ ID NO: 262675 - RNA, 64 nt, Homo Sapiens; identical to SEQ ID NO: 90805

SEQ ID NO: 262676 - RNA, 64 nt, Homo Sapiens; identical to SEQ ID NO: 90806

SEQ ID NO: 262677 - RNA, 64 nt, Homo Sapiens; identical to SEQ ID NO: 90807

SEQ ID NO: 262678 - RNA, 64 nt, Homo Sapiens; identical to SEQ ID NO: 90808

SEQ ID NO: 262679 - RNA, 64 nt, Homo Sapiens; identical to SEQ ID NO: 90809

SEQ ID NO: 262680 - RNA, 64 nt, Homo Sapiens; identical to SEQ ID NO: 90810

SEQ ID NO: 262681 - RNA, 64 nt, Homo Sapiens; identical to SEQ ID NO: 90811

SEQ ID NO: 262682 - RNA, 64 nt, Homo Sapiens; identical to SEQ ID NO: 90812

SEQ ID NO: 262683 - RNA, 64 nt, Homo Sapiens; identical to SEQ ID NO: 90813

SEQ ID NO: 262684 - RNA, 64 nt, Homo Sapiens; identical to SEQ ID NO: 90814

SEQ ID NO: 262685 - RNA, 64 nt, Homo Sapiens; identical to SEQ ID NO: 90815

SEQ ID NO: 262686 - RNA, 64 nt, Homo Sapiens; identical to SEQ ID NO: 90816

SEQ ID NO: 262687 - RNA, 64 nt, Homo Sapiens; identical to SEQ ID NO: 90817

SEQ ID NO: 262688 - RNA, 64 nt, Homo Sapiens; identical to SEQ ID NO: 90818

SEQ ID NO: 262689 - RNA, 64 nt, Homo Sapiens; identical to SEQ ID NO: 90819

SEQ ID NO: 262690 - RNA, 64 nt, Homo Sapiens; identical to SEQ ID NO: 90820

SEQ ID NO: 262691 - RNA, 64 nt, Homo Sapiens; identical to SEQ ID NO: 90821

SEQ ID NO: 262692 - RNA, 64 nt, Homo Sapiens; identical to SEQ ID NO: 90822

SEQ ID NO: 262693 - RNA, 64 nt, Homo Sapiens; identical to SEQ ID NO: 90823

SEQ ID NO: 262694 - RNA, 64 nt, Homo Sapiens; identical to SEQ ID NO: 90824

SEQ ID NO: 262695 - RNA, 64 nt, Homo Sapiens; identical to SEQ ID NO: 90825

SEQ ID NO: 262696 - RNA, 64 nt, Homo Sapiens; identical to SEQ ID NO: 90826

SEQ ID NO: 262697 - RNA, 64 nt, Homo Sapiens; identical to SEQ ID NO: 90827

SEQ ID NO: 262698 - RNA, 64 nt, Homo Sapiens; identical to SEQ ID NO: 90828

SEQ ID NO: 262699 - RNA, 64 nt, Homo Sapiens; identical to SEQ ID NO: 90829

SEQ ID NO: 262700 - RNA, 64 nt, Homo Sapiens; identical to SEQ ID NO: 90830

SEQ ID NO: 262701 - RNA, 64 nt, Homo Sapiens; identical to SEQ ID NO: 90831

SEQ ID NO: 262702 - RNA, 64 nt, Homo Sapiens; identical to SEQ ID NO: 90832

SEQ ID NO: 262703 - RNA, 64 nt, Homo Sapiens; identical to SEQ ID NO: 90833

SEQ ID NO: 262704 - RNA, 64 nt, Homo Sapiens; identical to SEQ ID NO: 90834

SEQ ID NO: 262705 - RNA, 64 nt, Homo Sapiens; identical to SEQ ID NO: 90835

SEQ ID NO: 262706 - RNA, 64 nt, Homo Sapiens; identical to SEQ ID NO: 90836

SEQ ID NO: 262707 - RNA, 64 nt, Homo Sapiens; identical to SEQ ID NO: 90837

SEQ ID NO: 262708 - RNA, 64 nt, Homo Sapiens; identical to SEQ ID NO: 90838

SEQ ID NO: 262709 - RNA, 64 nt, Homo Sapiens; identical to SEQ ID NO: 90839

SEQ ID NO: 262710 - RNA, 64 nt, Homo Sapiens; identical to SEQ ID NO: 90840

SEQ ID NO: 262711 - RNA, 64 nt, Homo Sapiens; identical to SEQ ID NO: 90841

SEQ ID NO: 262712 - RNA, 64 nt, Homo Sapiens; identical to SEQ ID NO: 90842

SEQ ID NO: 262713 - RNA, 64 nt, Homo Sapiens; identical to SEQ ID NO: 90843

SEQ ID NO: 262714 - RNA, 64 nt, Homo Sapiens; identical to SEQ ID NO: 90844

SEQ ID NO: 262715 - RNA, 64 nt, Homo Sapiens; identical to SEQ ID NO: 90845

SEQ ID NO: 262716 - RNA, 64 nt, Homo Sapiens; identical to SEQ ID NO: 90846

SEQ ID NO: 262717 - RNA, 64 nt, Homo Sapiens; identical to SEQ ID NO: 90847

SEQ ID NO: 262718 - RNA, 64 nt, Homo Sapiens; identical to SEQ ID NO: 90848

SEQ ID NO: 262719 - RNA, 64 nt, Homo Sapiens; identical to SEQ ID NO: 90849

SEQ ID NO: 262720 - RNA, 64 nt, Homo Sapiens; identical to SEQ ID NO: 90850

SEQ ID NO: 262721 - RNA, 64 nt, Homo Sapiens; identical to SEQ ID NO: 90851

SEQ ID NO: 262722 - RNA, 64 nt, Homo Sapiens; identical to SEQ ID NO: 90852

SEQ ID NO: 262723 - RNA, 64 nt, Homo Sapiens; identical to SEQ ID NO: 90853

SEQ ID NO: 262724 - RNA, 64 nt, Homo Sapiens; identical to SEQ ID NO: 90854

SEQ ID NO: 262725 - RNA, 64 nt, Homo Sapiens; identical to SEQ ID NO: 90855

SEQ ID NO: 262726 - RNA, 64 nt, Homo Sapiens; identical to SEQ ID NO: 90856

SEQ ID NO: 262727 - RNA, 64 nt, Homo Sapiens; identical to SEQ ID NO: 90857

SEQ ID NO: 262728 - RNA, 64 nt, Homo Sapiens; identical to SEQ ID NO: 90858

SEQ ID NO: 262729 - RNA, 64 nt, Homo Sapiens; identical to SEQ ID NO: 90859

SEQ ID NO: 262730 - RNA, 64 nt, Homo Sapiens; identical to SEQ ID NO: 90860

SEQ ID NO: 262731 - RNA, 64 nt, Homo Sapiens; identical to SEQ ID NO: 90861

SEQ ID NO: 262732 - RNA, 64 nt, Homo Sapiens; identical to SEQ ID NO: 90862

SEQ ID NO: 262733 - RNA, 64 nt, Homo Sapiens; identical to SEQ ID NO: 90863

SEQ ID NO: 262734 - RNA, 64 nt, Homo Sapiens; identical to SEQ ID NO: 90864

SEQ ID NO: 262735 - RNA, 64 nt, Homo Sapiens; identical to SEQ ID NO: 90865

SEQ ID NO: 262736 - RNA, 64 nt, Homo Sapiens; identical to SEQ ID NO: 90866

SEQ ID NO: 262737 - RNA, 64 nt, Homo Sapiens; identical to SEQ ID NO: 90867

SEQ ID NO: 262738 - RNA, 64 nt, Homo Sapiens; identical to SEQ ID NO: 90868

SEQ ID NO: 262739 - RNA, 64 nt, Homo Sapiens; identical to SEQ ID NO: 90869

SEQ ID NO: 262740 - RNA, 64 nt, Homo Sapiens; identical to SEQ ID NO: 90870

SEQ ID NO: 262741 - RNA, 64 nt, Homo Sapiens; identical to SEQ ID NO: 90871

SEQ ID NO: 262742 - RNA, 64 nt, Homo Sapiens; identical to SEQ ID NO: 90872

SEQ ID NO: 262743 - RNA, 64 nt, Homo Sapiens; identical to SEQ ID NO: 90873

SEQ ID NO: 262744 - RNA, 64 nt, Homo Sapiens; identical to SEQ ID NO: 90874

SEQ ID NO: 262745 - RNA, 64 nt, Homo Sapiens; identical to SEQ ID NO: 90875

SEQ ID NO: 262746 - RNA, 64 nt, Homo Sapiens; identical to SEQ ID NO: 90876

SEQ ID NO: 262747 - RNA, 64 nt, Homo Sapiens; identical to SEQ ID NO: 90877

SEQ ID NO: 262748 - RNA, 64 nt, Homo Sapiens; identical to SEQ ID NO: 90878

SEQ ID NO: 262749 - RNA, 64 nt, Homo Sapiens; identical to SEQ ID NO: 90879

SEQ ID NO: 262750 - RNA, 64 nt, Homo Sapiens; identical to SEQ ID NO: 90880

SEQ ID NO: 262751 - RNA, 64 nt, Homo Sapiens; identical to SEQ ID NO: 90881

SEQ ID NO: 262752 - RNA, 64 nt, Homo Sapiens; identical to SEQ ID NO: 90882

SEQ ID NO: 262753 - RNA, 64 nt, Homo Sapiens; identical to SEQ ID NO: 90883

SEQ ID NO: 262754 - RNA, 64 nt, Homo Sapiens; identical to SEQ ID NO: 90884

SEQ ID NO: 262755 - RNA, 64 nt, Homo Sapiens; identical to SEQ ID NO: 90885

SEQ ID NO: 262756 - RNA, 64 nt, Homo Sapiens; identical to SEQ ID NO: 90886

SEQ ID NO: 262757 - RNA, 64 nt, Homo Sapiens; identical to SEQ ID NO: 90887

SEQ ID NO: 262758 - RNA, 64 nt, Homo Sapiens; identical to SEQ ID NO: 90888

SEQ ID NO: 262759 - RNA, 64 nt, Homo Sapiens; identical to SEQ ID NO: 90889

SEQ ID NO: 262760 - RNA, 64 nt, Homo Sapiens; identical to SEQ ID NO: 90890

SEQ ID NO: 262761 - RNA, 64 nt, Homo Sapiens; identical to SEQ ID NO: 90891

SEQ ID NO: 262762 - RNA, 64 nt, Homo Sapiens; identical to SEQ ID NO: 90892

SEQ ID NO: 262763 - RNA, 64 nt, Homo Sapiens; identical to SEQ ID NO: 90893

SEQ ID NO: 262764 - RNA, 64 nt, Homo Sapiens; identical to SEQ ID NO: 90894

SEQ ID NO: 262765 - RNA, 64 nt, Homo Sapiens; identical to SEQ ID NO: 90895

SEQ ID NO: 262766 - RNA, 64 nt, Homo Sapiens; identical to SEQ ID NO: 90896

SEQ ID NO: 262767 - RNA, 64 nt, Homo Sapiens; identical to SEQ ID NO: 90897

SEQ ID NO: 262768 - RNA, 64 nt, Homo Sapiens; identical to SEQ ID NO: 90898

SEQ ID NO: 262769 - RNA, 64 nt, Homo Sapiens; identical to SEQ ID NO: 90899

SEQ ID NO: 262770 - RNA, 54 nt, Homo Sapiens; identical to SEQ ID NO: 90900

SEQ ID NO: 262771 - RNA, 64 nt, Homo Sapiens; identical to SEQ ID NO: 90901

SEQ ID NO: 262772 - RNA, 64 nt, Homo Sapiens; identical to SEQ ID NO: 90902

SEQ ID NO: 262773 - RNA, 64 nt, Homo Sapiens; identical to SEQ ID NO: 90903

SEQ ID NO: 262774 - RNA, 64 nt, Homo Sapiens; identical to SEQ ID NO: 90904

SEQ ID NO: 262775 - RNA, 64 nt, Homo Sapiens; identical to SEQ ID NO: 90905

SEQ ID NO: 262776 - RNA, 64 nt, Homo Sapiens; identical to SEQ ID NO: 90906

SEQ ID NO: 262777 - RNA, 64 nt, Homo Sapiens; identical to SEQ ID NO: 90907

SEQ ID NO: 262778 - RNA, 64 nt, Homo Sapiens; identical to SEQ ID NO: 90908

SEQ ID NO: 262779 - RNA, 64 nt, Homo Sapiens; identical to SEQ ID NO: 90909

SEQ ID NO: 262780 - RNA, 64 nt, Homo Sapiens; identical to SEQ ID NO: 90910

SEQ ID NO: 262781 - RNA, 64 nt, Homo Sapiens; identical to SEQ ID NO: 90911

SEQ ID NO: 262782 - RNA, 64 nt, Homo Sapiens; identical to SEQ ID NO: 90912

SEQ ID NO: 262783 - RNA, 64 nt, Homo Sapiens; identical to SEQ ID NO: 90913

SEQ ID NO: 262784 - RNA, 64 nt, Homo Sapiens; identical to SEQ ID NO: 90914

SEQ ID NO: 262785 - RNA, 64 nt, Homo Sapiens; identical to SEQ ID NO: 90915

SEQ ID NO: 262786 - RNA, 64 nt, Homo Sapiens; identical to SEQ ID NO: 90916

SEQ ID NO: 262787 - RNA, 64 nt, Homo Sapiens; identical to SEQ ID NO: 90917

SEQ ID NO: 262788 - RNA, 64 nt, Homo Sapiens; identical to SEQ ID NO: 90918

SEQ ID NO: 262789 - RNA, 64 nt, Homo Sapiens; identical to SEQ ID NO: 90919

SEQ ID NO: 262790 - RNA, 64 nt, Homo Sapiens; identical to SEQ ID NO: 90920

SEQ ID NO: 262791 - RNA, 64 nt, Homo Sapiens; identical to SEQ ID NO: 90921

SEQ ID NO: 262792 - RNA, 64 nt, Homo Sapiens; identical to SEQ ID NO: 90922

SEQ ID NO: 262793 - RNA, 64 nt, Homo Sapiens; identical to SEQ ID NO: 90923

SEQ ID NO: 262794 - RNA, 64 nt, Homo Sapiens; identical to SEQ ID NO: 90924

SEQ ID NO: 262795 - RNA, 64 nt, Homo Sapiens; identical to SEQ ID NO: 90925

SEQ ID NO: 262796 - RNA, 64 nt, Homo Sapiens; identical to SEQ ID NO: 90926

SEQ ID NO: 262797 - RNA, 64 nt, Homo Sapiens; identical to SEQ ID NO: 90927

SEQ ID NO: 262798 - RNA, 64 nt, Homo Sapiens; identical to SEQ ID NO: 90928

SEQ ID NO: 262799 - RNA, 64 nt, Homo Sapiens; identical to SEQ ID NO: 90929

SEQ ID NO: 262800 - RNA, 64 nt, Homo Sapiens; identical to SEQ ID NO: 90811

SEQ ID NO: 262801 - RNA, 64 nt, Homo Sapiens; identical to SEQ ID NO: 90931

SEQ ID NO: 262802 - RNA, 64 nt, Homo Sapiens; identical to SEQ ID NO: 90932

SEQ ID NO: 262803 - RNA, 64 nt, Homo Sapiens; identical to SEQ ID NO: 90933

SEQ ID NO: 262804 - RNA, 64 nt, Homo Sapiens; identical to SEQ ID NO: 90934

SEQ ID NO: 262805 - RNA, 64 nt, Homo Sapiens; identical to SEQ ID NO: 90935

SEQ ID NO: 262806 - RNA, 64 nt, Homo Sapiens; identical to SEQ ID NO: 90936

SEQ ID NO: 262807 - RNA, 64 nt, Homo Sapiens; identical to SEQ ID NO: 90937

SEQ ID NO: 262808 - RNA, 64 nt, Homo Sapiens; identical to SEQ ID NO: 90938

SEQ ID NO: 262809 - RNA, 64 nt, Homo Sapiens; identical to SEQ ID NO: 90939

SEQ ID NO: 262810 - RNA, 64 nt, Homo Sapiens; identical to SEQ ID NO: 90940

SEQ ID NO: 262811 - RNA, 64 nt, Homo Sapiens; identical to SEQ ID NO: 90941

SEQ ID NO: 262812 - RNA, 64 nt, Homo Sapiens; identical to SEQ ID NO: 90942

SEQ ID NO: 262813 - RNA, 64 nt, Homo Sapiens; identical to SEQ ID NO: 90943

SEQ ID NO: 262814 - RNA, 64 nt, Homo Sapiens; identical to SEQ ID NO: 90944

SEQ ID NO: 262815 - RNA, 64 nt, Homo Sapiens; identical to SEQ ID NO: 90945

SEQ ID NO: 262816 - RNA, 64 nt, Homo Sapiens; identical to SEQ ID NO: 90946

SEQ ID NO: 262817 - RNA, 64 nt, Homo Sapiens; identical to SEQ ID NO: 90947

SEQ ID NO: 262818 - RNA, 64 nt, Homo Sapiens; identical to SEQ ID NO: 90948

SEQ ID NO: 262819 - RNA, 64 nt, Homo Sapiens; identical to SEQ ID NO: 90949

SEQ ID NO: 262820 - RNA, 64 nt, Homo Sapiens; identical to SEQ ID NO: 90950

SEQ ID NO: 262821 - RNA, 64 nt, Homo Sapiens; identical to SEQ ID NO: 90951

SEQ ID NO: 262822 - RNA, 64 nt, Homo Sapiens; identical to SEQ ID NO: 90952

SEQ ID NO: 262823 - RNA, 64 nt, Homo Sapiens; identical to SEQ ID NO: 90953

SEQ ID NO: 262824 - RNA, 64 nt, Homo Sapiens; identical to SEQ ID NO: 90954

SEQ ID NO: 262825 - RNA, 64 nt, Homo Sapiens; identical to SEQ ID NO: 90955

SEQ ID NO: 262826 - RNA, 64 nt, Homo Sapiens; identical to SEQ ID NO: 90956

SEQ ID NO: 262827 - RNA, 64 nt, Homo Sapiens; identical to SEQ ID NO: 90957

SEQ ID NO: 262828 - RNA, 64 nt, Homo Sapiens; identical to SEQ ID NO: 90958

SEQ ID NO: 262829 - RNA, 64 nt, Homo Sapiens; identical to SEQ ID NO: 90959

SEQ ID NO: 262830 - RNA, 64 nt, Homo Sapiens; identical to SEQ ID NO: 90960

SEQ ID NO: 262831 - RNA, 64 nt, Homo Sapiens; identical to SEQ ID NO: 90961

SEQ ID NO: 262832 - RNA, 64 nt, Homo Sapiens; identical to SEQ ID NO: 90962

SEQ ID NO: 262833 - RNA, 64 nt, Homo Sapiens; identical to SEQ ID NO: 90963

SEQ ID NO: 262834 - RNA, 64 nt, Homo Sapiens; identical to SEQ ID NO: 90964

SEQ ID NO: 262835 - RNA, 64 nt, Homo Sapiens; identical to SEQ ID NO: 90965

SEQ ID NO: 262836 - RNA, 64 nt, Homo Sapiens; identical to SEQ ID NO: 90966

SEQ ID NO: 262837 - RNA, 64 nt, Homo Sapiens; identical to SEQ ID NO: 90967

SEQ ID NO: 262838 - RNA, 64 nt, Homo Sapiens; identical to SEQ ID NO: 90968

SEQ ID NO: 262839 - RNA, 64 nt, Homo Sapiens; identical to SEQ ID NO: 90969

SEQ ID NO: 262840 - RNA, 64 nt, Homo Sapiens; identical to SEQ ID NO: 90970

SEQ ID NO: 262841 - RNA, 64 nt, Homo Sapiens; identical to SEQ ID NO: 90971

SEQ ID NO: 262842 - RNA, 64 nt, Homo Sapiens; identical to SEQ ID NO: 90972

SEQ ID NO: 262843 - RNA, 64 nt, Homo Sapiens; identical to SEQ ID NO: 90973

SEQ ID NO: 262844 - RNA, 64 nt, Homo Sapiens; identical to SEQ ID NO: 90974

SEQ ID NO: 262845 - RNA, 64 nt, Homo Sapiens; identical to SEQ ID NO: 90975

SEQ ID NO: 262846 - RNA, 64 nt, Homo Sapiens; identical to SEQ ID NO: 90976

SEQ ID NO: 262847 - RNA, 64 nt, Homo Sapiens; identical to SEQ ID NO: 90977

SEQ ID NO: 262848 - RNA, 64 nt, Homo Sapiens; identical to SEQ ID NO: 90978

SEQ ID NO: 262849 - RNA, 64 nt, Homo Sapiens; identical to SEQ ID NO: 90979

SEQ ID NO: 262850 - RNA, 64 nt, Homo Sapiens; identical to SEQ ID NO: 90980

SEQ ID NO: 262851 - RNA, 64 nt, Homo Sapiens; identical to SEQ ID NO: 90981

SEQ ID NO: 262852 - RNA, 64 nt, Homo Sapiens; identical to SEQ ID NO: 90982

SEQ ID NO: 262853 - RNA, 64 nt, Homo Sapiens; identical to SEQ ID NO: 90983

SEQ ID NO: 262854 - RNA, 64 nt, Homo Sapiens; identical to SEQ ID NO: 90984

SEQ ID NO: 262855 - RNA, 64 nt, Homo Sapiens; identical to SEQ ID NO: 90985

SEQ ID NO: 262856 - RNA, 64 nt, Homo Sapiens; identical to SEQ ID NO: 90986

SEQ ID NO: 262857 - RNA, 64 nt, Homo Sapiens; identical to SEQ ID NO: 90987

SEQ ID NO: 262858 - RNA, 64 nt, Homo Sapiens; identical to SEQ ID NO: 90988

SEQ ID NO: 262859 - RNA, 64 nt, Homo Sapiens; identical to SEQ ID NO: 90989

SEQ ID NO: 262860 - RNA, 64 nt, Homo Sapiens; identical to SEQ ID NO: 90990

SEQ ID NO: 262861 - RNA, 64 nt, Homo Sapiens; identical to SEQ ID NO: 90991

SEQ ID NO: 262862 - RNA, 64 nt, Homo Sapiens; identical to SEQ ID NO: 90992

SEQ ID NO: 262863 - RNA, 64 nt, Homo Sapiens; identical to SEQ ID NO: 90993

SEQ ID NO: 262864 - RNA, 64 nt, Homo Sapiens; identical to SEQ ID NO: 90994

SEQ ID NO: 262865 - RNA, 64 nt, Homo Sapiens; identical to SEQ ID NO: 90995

SEQ ID NO: 262866 - RNA, 64 nt, Homo Sapiens; identical to SEQ ID NO: 90996

SEQ ID NO: 262867 - RNA, 64 nt, Homo Sapiens; identical to SEQ ID NO: 90997

SEQ ID NO: 262868 - RNA, 64 nt, Homo Sapiens; identical to SEQ ID NO: 90998

SEQ ID NO: 262869 - RNA, 64 nt, Homo Sapiens; identical to SEQ ID NO: 90999

SEQ ID NO: 262870 - RNA, 64 nt, Homo Sapiens; identical to SEQ ID NO: 91000

SEQ ID NO: 262871 - RNA, 64 nt, Homo Sapiens; identical to SEQ ID NO: 91001

SEQ ID NO: 262872 - RNA, 64 nt, Homo Sapiens; identical to SEQ ID NO: 91002

SEQ ID NO: 262873 - RNA, 64 nt, Homo Sapiens; identical to SEQ ID NO: 91003

SEQ ID NO: 262874 - RNA, 64 nt, Homo Sapiens; identical to SEQ ID NO: 91004

SEQ ID NO: 262875 - RNA, 64 nt, Homo Sapiens; identical to SEQ ID NO: 91005

SEQ ID NO: 262876 - RNA, 64 nt, Homo Sapiens; identical to SEQ ID NO: 91006

SEQ ID NO: 262877 - RNA, 64 nt, Homo Sapiens; identical to SEQ ID NO: 91007

SEQ ID NO: 262878 - RNA, 64 nt, Homo Sapiens; identical to SEQ ID NO: 91008

SEQ ID NO: 262879 - RNA, 64 nt, Homo Sapiens; identical to SEQ ID NO: 91009

SEQ ID NO: 262880 - RNA, 64 nt, Homo Sapiens; identical to SEQ ID NO: 91010

SEQ ID NO: 262881 - RNA, 64 nt, Homo Sapiens; identical to SEQ ID NO: 91011

SEQ ID NO: 262882 - RNA, 64 nt, Homo Sapiens; identical to SEQ ID NO: 91012

SEQ ID NO: 262883 - RNA, 64 nt, Homo Sapiens; identical to SEQ ID NO: 91013

SEQ ID NO: 262884 - RNA, 64 nt, Homo Sapiens; identical to SEQ ID NO: 91014

SEQ ID NO: 262885 - RNA, 64 nt, Homo Sapiens; identical to SEQ ID NO: 91015

SEQ ID NO: 262886 - RNA, 64 nt, Homo Sapiens; identical to SEQ ID NO: 91016

SEQ ID NO: 262887 - RNA, 64 nt, Homo Sapiens; identical to SEQ ID NO: 91017

SEQ ID NO: 262888 - RNA, 64 nt, Homo Sapiens; identical to SEQ ID NO: 91018

SEQ ID NO: 262889 - RNA, 64 nt, Homo Sapiens; identical to SEQ ID NO: 91019

SEQ ID NO: 262890 - RNA, 64 nt, Homo Sapiens; identical to SEQ ID NO: 91020

SEQ ID NO: 262891 - RNA, 64 nt, Homo Sapiens; identical to SEQ ID NO: 91021

SEQ ID NO: 262892 - RNA, 64 nt, Homo Sapiens; identical to SEQ ID NO: 91022

SEQ ID NO: 262893 - RNA, 64 nt, Homo Sapiens; identical to SEQ ID NO: 91023

SEQ ID NO: 262894 - RNA, 64 nt, Homo Sapiens; identical to SEQ ID NO: 91024

SEQ ID NO: 262895 - RNA, 64 nt, Homo Sapiens; identical to SEQ ID NO: 91025

SEQ ID NO: 262896 - RNA, 64 nt, Homo Sapiens; identical to SEQ ID NO: 91026

SEQ ID NO: 262897 - RNA, 64 nt, Homo Sapiens; identical to SEQ ID NO: 91027

SEQ ID NO: 262898 - RNA, 64 nt, Homo Sapiens; identical to SEQ ID NO: 91028

SEQ ID NO: 262899 - RNA, 64 nt, Homo Sapiens; identical to SEQ ID NO: 91029

SEQ ID NO: 262900 - RNA, 64 nt, Homo Sapiens
gggaaaugggagcauaguacacugggaaaugggagcacaguacucucggaaaugggagcauagu

SEQ ID NO: 262901 - RNA, 64 nt, Homo Sapiens
gggaaaugggagcccacaguacugggaaaugggagcacaguacugagaaaugggagcacacagu

SEQ ID NO: 262902 - RNA, 64 nt, Homo Sapiens
gggaaaugggcauacaguacacugagaaaugggagcacaguacucugagaaaugggaguacacu

SEQ ID NO: 262903 - RNA, 64 nt, Homo Sapiens
gagaaaugggaguacacuacacugagaagugggagcacaguacucugggaagugggagcacagu

SEQ ID NO: 262904 - RNA, 64 nt, Homo Sapiens
gagaagugggagcacaguacacugggaagugggagcacaguacuuugggaaaugggagcacagu

SEQ ID NO: 262905 - RNA, 64 nt, Homo Sapiens
gggaagugggagcacaguacauugggaaaugggagcacaguacucugcaaaaugggagcacagu

SEQ ID NO: 262906 - RNA, 64 nt, Homo Sapiens
gggaaaugggagcacaguacacugcaaaaugggagcacaguauugggaaaugggggcucacagc

SEQ ID NO: 262907 - RNA, 64 nt, Homo Sapiens
gggaaaugggggcucacagcacugggaaaugggagcacaguacucuaggaaaugggagcacagu

SEQ ID NO: 262908 - RNA, 64 nt, Homo Sapiens
gggaaaugggagcacaguacacuaggaaaugggagcacaguacucugggaaaugggagcacagu

SEQ ID NO: 262909 - RNA, 64 nt, Homo Sapiens
aggaaaugggagcacaguacacugggaaaugggagcacaguacucucacaccugugagcacagu

SEQ ID NO: 262910 - RNA, 64 nt, Homo Sapiens
gggaaaugggagcacaguacgcucacaccugugagcacaguacucugaugggccgggcauguug

SEQ ID NO: 262911 - RNA, 64 nt, Homo Sapiens
agacuaacaacagcucacagaguuuauaaguuaggcacaguaagacguacauaugauaaaguuc

SEQ ID NO: 262912 - RNA, 64 nt, Homo Sapiens
uuucagggucugucuaucuuauggaauuucaggagcacaguaaaaagguuuuccuagauacaaa

SEQ ID NO: 262913 - RNA, 64 nt, Homo Sapiens
ggcucuuuugucauugugcuauguuaaaauuauaccauuuaacuuauggauucacuuuuuacuu

SEQ ID NO: 262914 - RNA, 64 nt, Homo Sapiens
ugaaggacccuauauuauaucagaguucuucucaccauuuaaacauuuuuguucugcaggcuug

SEQ ID NO: 262915 - RNA, 64 nt, Homo Sapiens
augguaguggaaauucuaugacaagacuuguuauccauuuaaaauccauugucuuggugguguu

SEQ ID NO: 262916 - RNA, 64 nt, Homo Sapiens
cuagaacagguauauaagcucgugguacuauuugccauuuaaaaaauaugauuuauuagcacaa

SEQ ID NO: 262917 - RNA, 64 nt, Homo Sapiens
aaauaacaaacauuuuuuaaacaaugaaaagcccccauuuaaaauguuuccaauggcucaggag

SEQ ID NO: 262918 - RNA, 64 nt, Homo Sapiens
gcaaugguagucuuugguuaauuggaucccucugccauuuaaugaaaucaaaugacugauaagc

SEQ ID NO: 262919 - RNA, 64 nt, Homo Sapiens
cugucauuuuaucuucaugauuagaacugaucuuccauuuaacuauuacagaaagcaguaacua

SEQ ID NO: 262920 - RNA, 64 nt, Homo Sapiens
ucucuauuauaaaaguacauccaucaauaccauuccauuuaaaaugggcuauuguaauuuaccc

SEQ ID NO: 262921 - RNA, 64 nt, Homo Sapiens
aagaaagaacaugggugguaaaaucugagaggccccauuuaaaaaggugauccgaugugcagcc

SEQ ID NO: 262922 - RNA, 64 nt, Homo Sapiens
aguuuugaagugccuaagauaaauauuuuuagauccauuuaaggacaccaaaauauuagaggac

SEQ ID NO: 262923 - RNA, 64 nt, Homo Sapiens
aauuuuaagaccaagguaagauaacuaaucaaggccauuuaauccgucacauucaucucauaau

SEQ ID NO: 262924 - RNA, 64 nt, Homo Sapiens
uagaaaaaaauaccauuuacaguauuauugugaaccauuuaacccuuuugauccaaggccccgg

SEQ ID NO: 262925 - RNA, 64 nt, Homo Sapiens
aaccaaagccauuuggcaagcccuguagccugggccauuuaagacaggggcggucucagccaaa

SEQ ID NO: 262926 - RNA, 64 nt, Homo Sapiens
auuuaagacaggggcggucucagccaaauugcacccauuuaacuaucccaaagagccacagugc

SEQ ID NO: 262927 - RNA, 64 nt, Homo Sapiens
uuuuuuaaauagguaagauauaaaagaaauuaagccauuuaacaugugaaaaacauaagagucu

SEQ ID NO: 262928 - RNA, 64 nt, Homo Sapiens
ugaaaaacauaagagucuuaugggaguauaauacccauuuaaugauggaaagggaugaaaauaa

SEQ ID NO: 262929 - RNA, 64 nt, Homo Sapiens
acaauuuuuagccagaaaagaacagaguaacauaccauuuaauuuuuuuuguuuguuuaguuau

SEQ ID NO: 262930 - RNA, 64 nt, Homo Sapiens
ggauuaauauucuacaugugcuuagaauuugagcccauuuaaguuuuaguauaguuaauauuuu

SEQ ID NO: 262931 - RNA, 64 nt, Homo Sapiens
guaguuuuugugguuuaaucucagacccuuaaugccauuuaaauaauucuccagaagauagacu

SEQ ID NO: 262932 - RNA, 64 nt, Homo Sapiens
uaaaugacaaaauugcauagaacuaguuuuuuuuccauuuaauugacucauauucagucuuugg

SEQ ID NO: 262933 - RNA, 64 nt, Homo Sapiens
cauaaacauauuacucugagugccguuaugcaauccauuuaacucagugacaaaggaaaagugg

SEQ ID NO: 262934 - RNA, 64 nt, Homo Sapiens
aaaauagaucuugagauucuguuucagagcuuucccauuuaagaaugguagaacggagaucugg

SEQ ID NO: 262935 - RNA, 64 nt, Homo Sapiens
caguguugagugguucucugcugacauucauuggccauuuaauauuagcucacacagguguuug

SEQ ID NO: 262936 - RNA, 64 nt, Homo Sapiens
ucuucucucagucuugcaccuggcaaagcuaucaccauuuaaugaucaaacaaaaaugcccugg

SEQ ID NO: 262937 - RNA, 64 nt, Homo Sapiens
gaugagaaaauggagguuuacaggacuguuaucuccauuuaacacucaaaaagcccuguuaagc

SEQ ID NO: 262938 - RNA, 64 nt, Homo Sapiens
aaguuugccggcuaggugcgcccacccccgccaaccauuuaaaaacauuacucauuugauuucc

SEQ ID NO: 262939 - RNA, 64 nt, Homo Sapiens
auuaagugguucucaucucuaauuaacugugaaaccauuuaauccaaacauguaagcacacacu

SEQ ID NO: 262940 - RNA, 64 nt, Homo Sapiens
agucuauuggacucaaagguuacauuuuguuuuuccauuuaauuuaauaaucaacaaaacgaca

SEQ ID NO: 262941 - RNA, 64 nt, Homo Sapiens
auugcaagaaacucuuuuauuaaacuuggaacaaccauuuaaaugaaggauuuugugagauaga

SEQ ID NO: 262942 - RNA, 64 nt, Homo Sapiens
gauuguuuuuagucuugcuugaggaaugcacacuccauuuaaaaaauugugcgcucuguagauu

SEQ ID NO: 262943 - RNA, 64 nt, Homo Sapiens
uugaguaauuuuuacauuucuaagacauuaaaucccauuuaaauucugugugaacauuaaagac

SEQ ID NO: 262944 - RNA, 64 nt, Homo Sapiens
aaaacuguacaaagaagacgacuguuuuccauuuccauuuaaacauuuuuagccacuucauuuc

SEQ ID NO: 262945 - RNA, 64 nt, Homo Sapiens; identical to SEQ ID NO: 210966

SEQ ID NO: 262946 - RNA, 64 nt, Homo Sapiens; identical to SEQ ID NO: 210967

SEQ ID NO: 262947 - RNA, 64 nt, Homo Sapiens; identical to SEQ ID NO: 210968

SEQ ID NO: 262948 - RNA, 64 nt, Homo Sapiens; identical to SEQ ID NO: 210969

SEQ ID NO: 262949 - RNA, 64 nt, Homo Sapiens; identical to SEQ ID NO: 210970

SEQ ID NO: 262950 - RNA, 64 nt, Homo Sapiens; identical to SEQ ID NO: 210971

SEQ ID NO: 262951 - RNA, 64 nt, Homo Sapiens; identical to SEQ ID NO: 210972

SEQ ID NO: 262952 - RNA, 64 nt, Homo Sapiens; identical to SEQ ID NO: 210973

SEQ ID NO: 262953 - RNA, 64 nt, Homo Sapiens
cccucagacuuuaagacaagaagccaccaucaaaacaaaggaugggauacguauagaauggacu

SEQ ID NO: 262954 - RNA, 64 nt, Homo Sapiens
uuucuccagaagcugcagcaagagguacagcucaacaaaggaaaaccacaggacuggauaugca

SEQ ID NO: 262955 - RNA, 64 nt, Homo Sapiens
aguaggauuuuuguuuuguuuugcauuuugcaguacaaaggagaaaugauuagaacuuaggaag

SEQ ID NO: 262956 - RNA, 64 nt, Homo Sapiens
aaacaaauucauacaucuauggugaccacuuuugacaaaggaaugaagaacauacacuggggaa

SEQ ID NO: 262957 - RNA, 64 nt, Homo Sapiens
aguuacucauuucaaaauggauacuagcaacacuacaaaggagauugaacuuguaccuuuuuuu

SEQ ID NO: 262958 - RNA, 64 nt, Homo Sapiens
cuucugcaggacugcaucucuuaugaggagggaaacaaaggaggacuugaagauucuaggcaca

SEQ ID NO: 262959 - RNA, 64 nt, Homo Sapiens
ucuguggacaccucaugcucuguucaaggccaucacaaaggaaccgccagggagaagcagccgg

SEQ ID NO: 262960 - RNA, 64 nt, Homo Sapiens
gcuggcgacccgauggaagguuuucaggcuccucacaaaggagagagggaagaaaagaucuuuu

SEQ ID NO: 262961 - RNA, 64 nt, Homo Sapiens
aggcuugccuuuucuguggcgguuucuagcuuugacaaaggacccugaguuuucucuacuucag

SEQ ID NO: 262962 - RNA, 64 nt, Homo Sapiens
ugaagaacagacuucacuguuuuuauaguuuaugacaaaggaagcaccaacuuuaacuugaaau

SEQ ID NO: 262963 - RNA, 64 nt, Homo Sapiens
uauuauaaaagcaagguuuauuauaaaagauacuacaaaggauacagaugaagaggcacauagg

SEQ ID NO: 262964 - RNA, 64 nt, Homo Sapiens
cuguuuccugaggcuuaauacacccaacauuauaacaaaggacuguagcaagggcuaugggagu

SEQ ID NO: 262965 - RNA, 64 nt, Homo Sapiens
gcggccaguuuuucagccacaaaaaaguaaccuuacaaaggaguucuccaaaaaaaaaaaaaaa

SEQ ID NO: 262966 - RNA, 57 nt, Homo Sapiens
ccgggcgugguggcucacgcaaaccuuacaaaggacggaagaauucauaguggauag

SEQ ID NO: 262967 - RNA, 64 nt, Homo Sapiens
guguacugaaccacuagccuaauagaccagcacggucaacuagaaugacaaacauuagcuacug

SEQ ID NO: 262968 - RNA, 64 nt, Homo Sapiens
ugcuguggcugcacuggccccaguccauagaggggucaacuaugcuggcuggacuggcugccuu

SEQ ID NO: 262969 - RNA, 64 nt, Homo Sapiens
gcauuauguggacgccucauguauuuuuuauagagucaacuauuuccucuuuauuuucccucau

SEQ ID NO: 262970 - RNA, 64 nt, Homo Sapiens
cucuaauaaaguucccauccuuaaugacucacuugucaacuaguggacuaauuaacccuccacc

SEQ ID NO: 262971 - RNA, 64 nt, Homo Sapiens
uacaacuguccuuagacugaugagcaaaggaggagucaacuaaugaagaaaugaauaauaaauu

SEQ ID NO: 262972 - RNA, 64 nt, Homo Sapiens
gguauuaggaaacuaagucucaaccucugugguggucaacuaaacuugagaguucaaagaaaau

SEQ ID NO: 262973 - RNA, 64 nt, Homo Sapiens
uuuucuuauuugugugauuaaagccauuuuuauagucaacuaucagcauuuuuuuauuuuacua

SEQ ID NO: 262974 - RNA, 64 nt, Homo Sapiens
aaggagcaggauguaauaaacagcuuucuuuccugucaacuagauaucccuccuuuccccacag

SEQ ID NO: 262975 - RNA, 64 nt, Homo Sapiens
auaugguaaaaguuacuuauaacuuguaaaugcugucaacuaugagugugguagggacuuaaaa

SEQ ID NO: 262976 - RNA, 64 nt, Homo Sapiens
aaccuggggcccuggcagauaucccaguuuugcagucaacuauugccccaaguuccagagucaa

SEQ ID NO: 262977 - RNA, 64 nt, Homo Sapiens
aacucaaugaaaaaguugauuauuuauuauaguugucaacuaguuaauuagacauauuuuaaag

SEQ ID NO: 262978 - RNA, 64 nt, Homo Sapiens
guauuuaaaugaaugcuggucagugggacauuuugucaacuauggguauugggugcuuaacugu

SEQ ID NO: 262979 - RNA, 64 nt, Homo Sapiens
ucacuguguccuuuucugaaucccauuguagccugucaacuaaauuugaguguuaacggucuuu

SEQ ID NO: 262980 - RNA, 64 nt, Homo Sapiens
aaugaccauggauauuuuucuaccuacaguuugagucaacuagaauaugccuggggaccuugaa

SEQ ID NO: 262981 - RNA, 64 nt, Homo Sapiens
cccuaauuagugauggccacuuuguauuuauguugucaacuagcuuaauuuguaauuucauuua

SEQ ID NO: 262982 - RNA, 64 nt, Homo Sapiens
caaagcaggcuugcccaguauuaaaggcauuagagucaacuacaaaaaaaucaugccaguauuu

SEQ ID NO: 262983 - RNA, 64 nt, Homo Sapiens
cuuuucuaaagguuaccaguuucggucucugucugucaacuaaacaugacuuuuacuaacucac

SEQ ID NO: 262984 - RNA, 64 nt, Homo Sapiens
aacaggcccaauuaaaaacuagaacuuacugucagucaacuauaauuaguguuauauaccauau

SEQ ID NO: 262985 - RNA, 64 nt, Homo Sapiens
uauuuuguuaaugaaauaaaaacauggacugagugucaacuacaugagcuuuggcauggggaua

SEQ ID NO: 262986 - RNA, 64 nt, Homo Sapiens
acugccucaguuuggguaaaggaugagcagacaagucaacuaaagaaaaaagaaaagcaaggag

SEQ ID NO: 262987 - RNA, 64 nt, Homo Sapiens
aaagaauaaaacaggaccauauuuauuuacuucugucaacuauagaaagaaagaccuucagcug

SEQ ID NO: 262988 - RNA, 64 nt, Homo Sapiens
augcccaugagauguuuaucauuaggaauuuucugucaacuaccuuagucuguuaguuaaaccc

SEQ ID NO: 262989 - RNA, 64 nt, Homo Sapiens
uguagcugcuuuuguguguguaguaguccaaaaugucaacuaucaaacauguauaaaauaguuu

SEQ ID NO: 262990 - RNA, 64 nt, Homo Sapiens
agccugacggcuuagaacuuuugcucaaguucuggucaacuaguaucagaaauaacuuuuuauc

SEQ ID NO: 262991 - RNA, 64 nt, Homo Sapiens
agcuuuuauaugguauguaagugaauuuagccaugucaacuaaucaagguagguuggcucuuag

SEQ ID NO: 262992 - RNA, 64 nt, Homo Sapiens
ccucagcugugggggggaagcgcgugugcaucgugucaacuacuguacauguuggucaugugaa

SEQ ID NO: 262993 - RNA, 64 nt, Homo Sapiens
ucagcaaaagcuaauuaaauuguaauguuucuaugucaacuacugggaaguauguuacagucuu

SEQ ID NO: 262994 - RNA, 64 nt, Homo Sapiens
uuuuuugucacacuacuuuauauaacaauacuaagucaacuaagcuacuuuuagauuuggaaau

SEQ ID NO: 262995 - RNA, 64 nt, Homo Sapiens
uacugaaggaacaauaaugaugagauuuguaacugucaacuauuaaauacauugauuuuugaga

SEQ ID NO: 262996 - RNA, 64 nt, Homo Sapiens
gaagugaagaagguucagaagcuguuaugacuuggucaacuauguuaaaacuguuuaaaaugua

SEQ ID NO: 262997 - RNA, 64 nt, Homo Sapiens
ccauaauuuauuuauucuucuugaaaugaagacugucaacuauccuuuccuuuaaaaacagugu

SEQ ID NO: 262998 - RNA, 64 nt, Homo Sapiens
cauucuaauauuuuuguaaauuaagacugugucagucaacuaaaacuucucuagaagagauuac

SEQ ID NO: 262999 - RNA, 64 nt, Homo Sapiens
gcaaggagagaaaugcaaccauacaugggcuccagucaacuaugggacugaagguccuaauugc

SEQ ID NO: 263000 - RNA, 64 nt, Homo Sapiens
aguuuugcaacugcauaauagcuaugcccaaggagucaacuauuguauauauugcagauuugcc

SEQ ID NO: 263001 - RNA, 64 nt, Homo Sapiens
cauacagcaaguauggaaaaaagaugaucuagaagucaacuaucucaaccuccauuguuaccca

SEQ ID NO: 263002 - RNA, 64 nt, Homo Sapiens
agagacggaucugcaccucccucaagccccauuugucaacuaaacaacagucacaacagguuuc

SEQ ID NO: 263003 - RNA, 64 nt, Homo Sapiens
gccauaaccaauaaaauaaauuauauggaaagaugucaacuauaugaugcugugcaguuuguuu

SEQ ID NO: 263004 - RNA, 64 nt, Homo Sapiens
ugauucuuuccaagccaauauauucuaacaugcugucaacuaugcagugucccagucaaauucc

SEQ ID NO: 263005 - RNA, 64 nt, Homo Sapiens
ucccgccacaaaguuguaggaaaugggaagaggagucaacuagaggcaagggaguugagagagc

SEQ ID NO: 263006 - RNA, 64 nt, Homo Sapiens
gaaaauaaaacauuuucucucugaacaacuaguugucaacuaaugugugaaacuuaccauucaa

SEQ ID NO: 263007 - RNA, 64 nt, Homo Sapiens
cagaauugaaaauguaaauuugaacuauuucagugucaacuauuagggaagacuguaacacagc

SEQ ID NO: 263008 - RNA, 64 nt, Homo Sapiens
ugcaucuggcugagagagaccaaaggcagugagugucaacuaucuaaggagcccccugccauag

SEQ ID NO: 263009 - RNA, 64 nt, Homo Sapiens
ucuuuucuccagggguguggggaaaauggcaaaggucaacuagcugcuuccccagggaauaggg

SEQ ID NO: 263010 - RNA, 50 nt, Homo Sapiens
uuaauaaauugaugaccagugucaacuauuucaccauugcagaugcuuaa

SEQ ID NO: 263011 - RNA, 64 nt, Homo Sapiens
uaugauuaaaaauaaguauuuuguuuguuucuaugucaacuagauuuuuuucccuagaaaaaga

SEQ ID NO: 263012 - RNA, 64 nt, Homo Sapiens
uuuugaaauguuagacuuggaaggggccuggucugucaacuaguccaaccccuuaaaauucaua

SEQ ID NO: 263013 - RNA, 64 nt, Homo Sapiens
ucuccuugacugucaccuguaggacaguuuaucagucaacuaccuuuccuccagacuuuacuuc

SEQ ID NO: 263014 - RNA, 64 nt, Homo Sapiens
acuguacuuccauaaugaauaacugagugauugggucaacuauccuagccuggggaguuugaua

SEQ ID NO: 263015 - RNA, 64 nt, Homo Sapiens
ccucuacuuaaauccguccuguuuagcgacuucagucaacuacagcugaguccauaggccagaa

SEQ ID NO: 263016 - RNA, 64 nt, Homo Sapiens
ucuuuaggccuguuuggcucgggggaggaagugugucaacuauugacuccaggggagaugaccu

SEQ ID NO: 263017 - RNA, 64 nt, Homo Sapiens
uguguaagggagguccauagaauuuagguggucugucaacuauucuacuuaugagagaauuggu

SEQ ID NO: 263018 - RNA, 64 nt, Homo Sapiens
uacaaacuaacagucaccagcaccaaagaauuaagucaacuaaccugccuugaauuuuagacca

SEQ ID NO: 263019 - RNA, 64 nt, Homo Sapiens
caccuggggaugaagcucacgcuggaggaauuuugucaacuaccuuccuuagaguauuaucacu

SEQ ID NO: 263020 - RNA, 64 nt, Homo Sapiens
ugagauuauauguggacuaaucauagaguuuggugucaacuaaagaaauauaauuguaccaacc

SEQ ID NO: 263021 - RNA, 64 nt, Homo Sapiens
cugcauuuuacucugugaauaaccuugguuauaugucaacuauuauauuucuagauacaacaua

SEQ ID NO: 263022 - RNA, 64 nt, Homo Sapiens
aaucaaaagugcugaguuaaucugaaaugcuaaugucaacuacaagacucaaauaugacugugc

SEQ ID NO: 263023 - RNA, 64 nt, Homo Sapiens
auccuuuccccaccccuuucuaauuuauguuugugucaacuauaauaugcuggaauuggauauu

SEQ ID NO: 263024 - RNA, 64 nt, Homo Sapiens
uugcaaucaauuaaagauacuugaacuuuugaaugucaacuaaucuacacuuaaugcuauuaag

SEQ ID NO: 263025 - RNA, 64 nt, Homo Sapiens
ucugugaacauagccaucaggacucuggauuuuugucaacuaacucgcaaguccagaaauugag

SEQ ID NO: 263026 - RNA, 64 nt, Homo Sapiens
gauccaaggagaauuguauagcaagaaaaaaacagucaacuacagaaacucuuaaaaggaauaa

SEQ ID NO: 263027 - RNA, 64 nt, Homo Sapiens
ccccaagcugcuuauguggcccaaccccacugcugucaacuaggcuugaaccccacagcggcug

SEQ ID NO: 263028 - RNA, 64 nt, Homo Sapiens
cucugggcaaagguauucagguuucgccgcuuuugucaacuauccagcaucacucaaguuugaa

SEQ ID NO: 263029 - RNA, 64 nt, Homo Sapiens
caucgcaugaguagaggggcuuugugaaguggcugucaacuacaauuuucuguagcugaaaaug

SEQ ID NO: 263030 - RNA, 64 nt, Homo Sapiens
uucccuuuuuuagaaauugaaguggucuucauaugucaacuacagaaaaggaaaaaaauagaaa

SEQ ID NO: 263031 - RNA, 64 nt, Homo Sapiens
cucaguggaacucucuagccuccugguucggaaugucaacuaugagauccccucacugaagaag

SEQ ID NO: 263032 - RNA, 64 nt, Homo Sapiens
auuucugcaguuucaaguuaguuagaagcauguugucaacuaaagacaacaaacuaucagauuc

SEQ ID NO: 263033 - RNA, 64 nt, Homo Sapiens
aauaggaaaaucagccaggcuggugaaaugcagugucaacuaaacaagaccagccuggccaacc

SEQ ID NO: 263034 - RNA, 64 nt, Homo Sapiens
agguggaucggagauuucauauuucagaaagcaggucaacuaugucucucuuuuauuugaaagg

SEQ ID NO: 263035 - RNA, 64 nt, Homo Sapiens
uuaauugaaauauuugcucuuugcucugaaaucugucaacuaucaaaugaacauaaguuguaau

SEQ ID NO: 263036 - RNA, 64 nt, Homo Sapiens
gaacaagguaaagccauuugaaacuggaaggacagucaacuauccucuaaaugaagucuuuaug

SEQ ID NO: 263037 - RNA, 64 nt, Homo Sapiens
caagcaucaauagacucaugggaaccugacaguggucaacuacugcaccucuuccucacugcac

SEQ ID NO: 263038 - RNA, 64 nt, Homo Sapiens
auguaaccucuauguaaggacagaaaaaauggaugucaacuaaauuuaacaaaaguaugauuga

SEQ ID NO: 263039 - RNA, 64 nt, Homo Sapiens
uaaucagguguucuugagaacaauaaaauugagugucaacuauuccagaggacauuuuuuuuag

SEQ ID NO: 263040 - RNA, 64 nt, Homo Sapiens
uguacuucuagaauuccacuucuacauugccacagucaacuauucugaaguuccugcaucaggg

SEQ ID NO: 263041 - RNA, 64 nt, Homo Sapiens
cucauucuccgaacuuacuccuuuuuauggguaagucaacuagguuuacagucccuuauuuuua

SEQ ID NO: 263042 - RNA, 64 nt, Homo Sapiens
uuuauuaagacguccacuagaaauagcuuguccugucaacuaugaaauauggugacuagauuuu

SEQ ID NO: 263043 - RNA, 64 nt, Homo Sapiens
cuaauaaaaugcccaaugaaagaagaguuccauggucaacuaaguucagggaacccuguuacac

SEQ ID NO: 263044 - RNA, 64 nt, Homo Sapiens
aaaugcuaacuuaacagcacuggcuuucuggcuggucaacuauaugaaaccuuguucauuccuc

SEQ ID NO: 263045 - RNA, 64 nt, Homo Sapiens
aagacuuuucacuagggaaacugauaaagcuugagucaacuaaaucugccuucauacuuuauca

SEQ ID NO: 263046 - RNA, 64 nt, Homo Sapiens
uuccuuuccucuggguuuaagugauuuuauuuaagucaacuaaggggauuuaacaguggacuag

SEQ ID NO: 263047 - RNA, 64 nt, Homo Sapiens
cgugccuuaaaaaggaaaacuaguguugcuauugugcauuuacuagaaaaaaggaauugguugu

SEQ ID NO: 263048 - RNA, 64 nt, Homo Sapiens
uucguagauguuuuugaaguugacaugacuuacgugcauuuaaauauauauugccauccuuagu

SEQ ID NO: 263049 - RNA, 64 nt, Homo Sapiens
gaugaaaucugggcagagacuuauuaauuaauuuugcauuuacuaccucagagcucagaagaaa

SEQ ID NO: 263050 - RNA, 64 nt, Homo Sapiens
cccuauugcccagggaugucauuguaaauauaugugcauuuauaaauaauuuuuguauucauug

SEQ ID NO: 263051 - RNA, 64 nt, Homo Sapiens
ucucuuauuucuuacuuuaauguacuucuaucacugcauuuauuuugccugugcauaggagcaa

SEQ ID NO: 263052 - RNA, 64 nt, Homo Sapiens
uggaaaauuaguuggcuggacauugauaaaauaaugcauuuauaacaauuacauguguuucugg

SEQ ID NO: 263053 - RNA, 64 nt, Homo Sapiens
uacuucuguuuuguaaauugaaugaauauauuucugcauuuauucuuuuauuuuauaauuugau

SEQ ID NO: 263054 - RNA, 64 nt, Homo Sapiens
uaauauguauacaauauuguaaagacugaaacaaugcauuuauaacucuaucaauauuguauaa

SEQ ID NO: 263055 - RNA, 64 nt, Homo Sapiens
aacccgcgcuuuuauuaugggaagcuucuugaacugcauuuacuauugugaaguuucaaguccc

SEQ ID NO: 263056 - RNA, 64 nt, Homo Sapiens
ucuaauaucaagauuaacaaauauaaauuuauggugcauuuagauugcguuguauuaauuuaua

SEQ ID NO: 263057 - RNA, 64 nt, Homo Sapiens
aacacaguccugagagggauuuuguauuauuuuaugcauuuaaauauuuuuuauuuuaguccua

SEQ ID NO: 263058 - RNA, 64 nt, Homo Sapiens
aaacacaaucuuaaggggauuuuguauuauuuugugcauuuaaaauguuuuuauuucagcccua

SEQ ID NO: 263059 - RNA, 64 nt, Homo Sapiens
acucagucuauggguuggggcucagauaacucugugcauuuaagcuacuuguagagacccaggc

SEQ ID NO: 263060 - RNA, 64 nt, Homo Sapiens
aaaugguaguugaaaggagcaggggcccugguguugcauuuagcccuggggcauggagcugaac

SEQ ID NO: 263061 - RNA, 64 nt, Homo Sapiens
cgagguugguuucuuauguuuucuccuuuggccuugcauuuaucacauuaugaugcguuucuuu

SEQ ID NO: 263062 - RNA, 64 nt, Homo Sapiens
gggagaaagcuacuuccagcuuaaaacuggaggaugcauuuagacuuaagauugauuggagauu

SEQ ID NO: 263063 - RNA, 64 nt, Homo Sapiens
ucucaagaauuacuggcuuucuauuuaaucuucuugcauuuauucgccccauggaauauuuaau

SEQ ID NO: 263064 - RNA, 64 nt, Homo Sapiens
uucccccccaccccccgcccagaaggaaaaauaaugcauuuaucaaaauauuaauauguuuguc

SEQ ID NO: 263065 - RNA, 64 nt, Homo Sapiens
uuuuacacuuuaugguaaguagcagggggggaaaugcauuuauagaucauuucuaggcaaaauu

SEQ ID NO: 263066 - RNA, 64 nt, Homo Sapiens
ucauggccucuugaagagaaaaaagucaccauucugcauuuagcuguauucauauauugcauuu

SEQ ID NO: 263067 - RNA, 64 nt, Homo Sapiens
ucacauuuaguaaaugcugaaauaaaaugauuaaugcauuuaucaauaaaagccuuugaaaaua

SEQ ID NO: 263068 - RNA, 64 nt, Homo Sapiens
cuugguauacuccagggauugguuucaggaccccugcauuuaccaaaauuugugcacacucaag

SEQ ID NO: 263069 - RNA, 64 nt, Homo Sapiens
cuuauguggaacuguacaaauggggagaggggagugcauuuagacccuucuggggcacggucuu

SEQ ID NO: 263070 - RNA, 64 nt, Homo Sapiens
uaagacacuguuacagagauuaguuuuucuuacuugcauuuauuugaugguaggugugacaugu

SEQ ID NO: 263071 - RNA, 64 nt, Homo Sapiens
cucagcaucaaauaccuuguguuaaaagucacugugcauuuauucaguguuaagcuauagccau

SEQ ID NO: 263072 - RNA, 64 nt, Homo Sapiens
agcccucuuugugcugcuccaccugaaguucgccugcauuuaucuucaggccugaagcugcacg

SEQ ID NO: 263073 - RNA, 64 nt, Homo Sapiens
ggaagacaaaacaagaaugaauaacuaagacauaugcauuuaugacuugcauaugucaucccau

SEQ ID NO: 263074 - RNA, 64 nt, Homo Sapiens
aaacagucuuuggugauauuauuaucccccaaaaugcauuuagaaauauuuucuaagagaauga

SEQ ID NO: 263075 - RNA, 64 nt, Homo Sapiens
ugaaaagcaacucaaaacaacuucaacguggaggugcauuuauaauucagucugcauuuauucu

SEQ ID NO: 263076 - RNA, 64 nt, Homo Sapiens
aacuucaacguggaggugcauuuauaauucagucugcauuuauucuguaaaaagguggcuguuu

SEQ ID NO: 263077 - RNA, 64 nt, Homo Sapiens
aaaaauguuucauuguaucaguucuaugauagauugcauuuauuuaggaauauaaaaacuugca

SEQ ID NO: 263078 - RNA, 64 nt, Homo Sapiens
uaauuuuccuguuuaacaacuauucuaaacaauuugcauuuauaucaaaaggaaauccaaaacc

SEQ ID NO: 263079 - RNA, 64 nt, Homo Sapiens
ggccucagacauuucuuucaauguauuucuuuuuugcauuuaauuacacaauaauuuaaagaga

SEQ ID NO: 263080 - RNA, 64 nt, Homo Sapiens
uaugcucuguggcuacauauugugugugugugugugcauuuaugguacuuggggugugugugug

SEQ ID NO: 263081 - RNA, 64 nt, Homo Sapiens
uaauaguaaauucucuugcaauguuccuggaaaaugcauuuaaagaucuaucuguauuggaaau

SEQ ID NO: 263082 - RNA, 64 nt, Homo Sapiens
cgagaugcguccuauugucccacguguuaaacauugcauuuaauaggguagcauguauaaugcc

SEQ ID NO: 263083 - RNA, 64 nt, Homo Sapiens
ccacauucugugguuucucauuauacuuacuuccugcauuuagagggaguuuauuuaaaagaaa

SEQ ID NO: 263084 - RNA, 64 nt, Homo Sapiens
ugcacgaacuuagauaaugaggugcaggguuauuugcauuuaaauugcaauccagcacacgugu

SEQ ID NO: 263085 - RNA, 64 nt, Homo Sapiens
cggaaacagaaauugcuuuuuucauggagaggucugcauuuagauaagaacuuccacaaaauau

SEQ ID NO: 263086 - RNA, 64 nt, Homo Sapiens
accaguuagaguuccgacucaaaguaauuaauugugcauuuaauaucaaucaucugauuuccug

SEQ ID NO: 263087 - RNA, 64 nt, Homo Sapiens
guugaaauuuuaaaaauuaauguuaauauggaaaugcauuuagagaagcccaguaguuuuuauu

SEQ ID NO: 263088 - RNA, 64 nt, Homo Sapiens
augcauccauacucaggguguagggagaauacuuugcauuuaaaaacccuguccaccugucacc

SEQ ID NO: 263089 - RNA, 64 nt, Homo Sapiens
gaacagcgaaagcagagcauguuauuuauauaacugcauuuaagcaguaccaagacugaaaaaa

SEQ ID NO: 263090 - RNA, 64 nt, Homo Sapiens
ugcaauuaacauauaugaaauuuauuacucugcuugcauuuaugaaacuaaccaguuuuuuaaa

SEQ ID NO: 263091 - RNA, 64 nt, Homo Sapiens
aauuuuuaaaaauugguuuuuguucugaaaacacugcauuuaagauucucugacuugguaacua

SEQ ID NO: 263092 - RNA, 64 nt, Homo Sapiens
uuuagguguuuuuuuuuuccaaaaaauacuuugaugcauuuauuaguacacguuucuguauuuu

SEQ ID NO: 263093 - RNA, 64 nt, Homo Sapiens
uauuauauuuauaccucaugauaaaguaugauauugcauuuaaauuguuaucuugccaauggaa

SEQ ID NO: 263094 - RNA, 64 nt, Homo Sapiens
uaauguuucuguuaucagcauuuuuugcauuauaugcauuuauggcaaaugaguguuuucaggu

SEQ ID NO: 263095 - RNA, 64 nt, Homo Sapiens
guuaaaggacagucugcaauugguacgaauguugugcauuuaaucaccugaccccaguuuuaag

SEQ ID NO: 263096 - RNA, 64 nt, Homo Sapiens
uaaacacgaauacugaaauuccuuuuaaaaaaaaugcauuuacgagguuagaacauugcuuaau

SEQ ID NO: 263097 - RNA, 64 nt, Homo Sapiens
uuuauauuuuugccagaaaagugcccagagaucaugcauuuagaaaggcugauacuugagcugu

SEQ ID NO: 263098 - RNA, 64 nt, Homo Sapiens
uaaauaggccaaauuuuugcgcugcaaccuccugugcauuuaauauauuuuucuaauaaaugcg

SEQ ID NO: 263099 - RNA, 64 nt, Homo Sapiens
uuccaauggggaggaggaaagaugcaauaugucucuuacacauuucuucaagcugaaaagugcu

SEQ ID NO: 263100 - RNA, 64 nt, Homo Sapiens
uucuucaagcugaaaagugcuuguggugaaccugcuuacacaaauuauguugguggcuuucaug

SEQ ID NO: 263101 - RNA, 64 nt, Homo Sapiens
caggccugugcccacucccuccgccaaucuggcccuuacacacucuccuggcugggccauccuu

SEQ ID NO: 263102 - RNA, 64 nt, Homo Sapiens
gcgagggguuggugggagggggggcuuacaaagccuuacacagguaugggguggggugggugua

SEQ ID NO: 263103 - RNA, 64 nt, Homo Sapiens
uuaucuguuuugaccaaaauauguagcuauuucccuuacacagauuggaccgcacuuaucuccc

SEQ ID NO: 263104 - RNA, 64 nt, Homo Sapiens
cccuuucuggcugaaaacuugccuuauuugguaucuuacacauuaauguuacuagcaucaggag

SEQ ID NO: 263105 - RNA, 64 nt, Homo Sapiens
ugguacauguacuggaaguggauaaccaguaucacuuacacaaacaaaaauaacuuugucaaau

SEQ ID NO: 263106 - RNA, 64 nt, Homo Sapiens
guguaugccgaauaccuuaaaguaacuaauuauccuuacacacaaaaggcucagugcauuaaau

SEQ ID NO: 263107 - RNA, 64 nt, Homo Sapiens
ggauuuagcugugucauuuuuaugaugucuguaacaacccaacaagguaacugaagcuccagag

SEQ ID NO: 263108 - RNA, 64 nt, Homo Sapiens
uacccuuauaagaguaaagaauuaagaugauagucaacccaauauuucuacuacauucuuuaaa

SEQ ID NO: 263109 - RNA, 64 nt, Homo Sapiens
cgcucacacaaccagaaggagcugaguuuggcaacaacccaagugagccugaagcagauucgcc

SEQ ID NO: 263110 - RNA, 64 nt, Homo Sapiens
uguauccugcaggaggacgccccuacagacccagcaacccaaguugccagcccguguuucucag

SEQ ID NO: 263111 - RNA, 64 nt, Homo Sapiens
caacugggguacucacugggcaacaaaguaaauacaacccaaggucaucugucugggguaaaga

SEQ ID NO: 263112 - RNA, 64 nt, Homo Sapiens
aggcuggcuucagggccacuucaucagaaccucucaacccaacaccaugcuccuuuggccaaga

SEQ ID NO: 263113 - RNA, 64 nt, Homo Sapiens
gcugggucccagccugguuugcaaagaccaccuccaacccaacccaaucccucuccacucuucu

SEQ ID NO: 263114 - RNA, 64 nt, Homo Sapiens
gucccagccugguuugcaaagaccaccuccaacccaacccaaucccucuccacucuucucuccu

SEQ ID NO: 263115 - RNA, 64 nt, Homo Sapiens
ggcucaaacuucuaaggggugggaggaaaagucccaacccaaugacuacagcuucagugauugg

SEQ ID NO: 263116 - RNA, 64 nt, Homo Sapiens
ggauuuuuaugucuggggcagagcucuacugccucaacccaaggguaugucugguuccccagua

SEQ ID NO: 263117 - RNA, 64 nt, Homo Sapiens
cagaagaauggagaugggaaaauccaccaaauuccaacccaaacccaacuuucuuucucccuau

SEQ ID NO: 263118 - RNA, 64 nt, Homo Sapiens
ugccgccgcggguccaccgaggacgccaaucaaucaacccaacaccacaagcuugguugggugc

SEQ ID NO: 263119 - RNA, 64 nt, Homo Sapiens
ggauaggacagagggauuuuguucaaguuugcugcaacccaaguggacguuaggccaggccuua

SEQ ID NO: 263120 - RNA, 64 nt, Homo Sapiens
ggccuccguugucugguugcuaaugacagccuugcaacccaaggugaggugaacuccaggcaug

SEQ ID NO: 263121 - RNA, 64 nt, Homo Sapiens; identical to SEQ ID NO: 71859

SEQ ID NO: 263122 - RNA, 64 nt, Homo Sapiens; identical to SEQ ID NO: 71860

SEQ ID NO: 263123 - RNA, 64 nt, Homo Sapiens; identical to SEQ ID NO: 71861

SEQ ID NO: 263124 - RNA, 64 nt, Homo Sapiens; identical to SEQ ID NO: 71862

SEQ ID NO: 263125 - RNA, 64 nt, Homo Sapiens; identical to SEQ ID NO: 71863

SEQ ID NO: 263126 - RNA, 64 nt, Homo Sapiens; identical to SEQ ID NO: 71864

SEQ ID NO: 263127 - RNA, 64 nt, Homo Sapiens; identical to SEQ ID NO: 71865

SEQ ID NO: 263128 - RNA, 64 nt, Homo Sapiens; identical to SEQ ID NO: 71866

SEQ ID NO: 263129 - RNA, 64 nt, Homo Sapiens; identical to SEQ ID NO: 71867

SEQ ID NO: 263130 - RNA, 64 nt, Homo Sapiens; identical to SEQ ID NO: 71868

SEQ ID NO: 263131 - RNA, 64 nt, Homo Sapiens; identical to SEQ ID NO: 71869

SEQ ID NO: 263132 - RNA, 64 nt, Homo Sapiens; identical to SEQ ID NO: 71870

SEQ ID NO: 263133 - RNA, 64 nt, Homo Sapiens; identical to SEQ ID NO: 71871

SEQ ID NO: 263134 - RNA, 64 nt, Homo Sapiens; identical to SEQ ID NO: 71872

SEQ ID NO: 263135 - RNA, 64 nt, Homo Sapiens; identical to SEQ ID NO: 71873

SEQ ID NO: 263136 - RNA, 64 nt, Homo Sapiens; identical to SEQ ID NO: 71874

SEQ ID NO: 263137 - RNA, 64 nt, Homo Sapiens; identical to SEQ ID NO: 71875

SEQ ID NO: 263138 - RNA, 64 nt, Homo Sapiens; identical to SEQ ID NO: 71876

SEQ ID NO: 263139 - RNA, 64 nt, Homo Sapiens; identical to SEQ ID NO: 71877

SEQ ID NO: 263140 - RNA, 64 nt, Homo Sapiens; identical to SEQ ID NO: 71878

SEQ ID NO: 263141 - RNA, 64 nt, Homo Sapiens; identical to SEQ ID NO: 71879

SEQ ID NO: 263142 - RNA, 64 nt, Homo Sapiens
augguuucuucauguuuucccaacucuuucauccaguguccaaaauauauaaguaaauagcugu

SEQ ID NO: 263143 - RNA, 64 nt, Homo Sapiens
cuccccuccugcugcuguagaguuuucccaaagcaguguccaggagagaauuugagagagugaa

SEQ ID NO: 263144 - RNA, 64 nt, Homo Sapiens
acaccugccgucuucacuucccagccaagggcugaguguccagcgcugaggccugagcgagugu

SEQ ID NO: 263145 - RNA, 64 nt, Homo Sapiens
caagggcugaguguccagcacugaggccugagcgaguguccagcgcugaaggcugaguguccgg

SEQ ID NO: 263146 - RNA, 64 nt, Homo Sapiens
agggcucagagcugaccaugcaugaauguauggcaguguccacuuuucuguauaaaauguauaa

SEQ ID NO: 263147 - RNA, 64 nt, Homo Sapiens
ucugcagggggaggccugagcauuucccagccccaguguccacaccucucagaaaagagaaaaa

SEQ ID NO: 263148 - RNA, 64 nt, Homo Sapiens
aggugacacgugucugacagagacgggagcucugaguguccacgggugaagaagugagugucca

SEQ ID NO: 263149 - RNA, 64 nt, Homo Sapiens
acgggagcucugaguguccacgggugaagaagugaguguccacgggugaagaagugaguauguu

SEQ ID NO: 263150 - RNA, 64 nt, Homo Sapiens
gccucuuuucuggcuguguuugcacuguuuggccaguguccacaggggaaauuucuaaaccuag

SEQ ID NO: 263151 - RNA, 64 nt, Homo Sapiens
cugucagugguguguuuacagcauuuaaaaacaaaguguccaagccaaaggaaaaagcccugcu

SEQ ID NO: 263152 - RNA, 64 nt, Homo Sapiens
ccguggucugccuccuaguugaaucucagcccugaguguccagaucuggccaaggugucuaggg

SEQ ID NO: 263153 - RNA, 64 nt, Homo Sapiens
ggcugcugcuaacauuaaugagaagguggccuucaguguccaccuguggaacccaggacacagc

SEQ ID NO: 263154 - RNA, 64 nt, Homo Sapiens; identical to SEQ ID NO: 238026

SEQ ID NO: 263155 - RNA, 64 nt, Homo Sapiens; identical to SEQ ID NO: 238027

SEQ ID NO: 263156 - RNA, 64 nt, Homo Sapiens; identical to SEQ ID NO: 238028

SEQ ID NO: 263157 - RNA, 64 nt, Homo Sapiens; identical to SEQ ID NO: 238029

SEQ ID NO: 263158 - RNA, 64 nt, Homo Sapiens; identical to SEQ ID NO: 238030

SEQ ID NO: 263159 - RNA, 64 nt, Homo Sapiens; identical to SEQ ID NO: 238031

SEQ ID NO: 263160 - RNA, 64 nt, Homo Sapiens; identical to SEQ ID NO: 238032

SEQ ID NO: 263161 - RNA, 64 nt, Homo Sapiens; identical to SEQ ID NO: 238033

SEQ ID NO: 263162 - RNA, 64 nt, Homo Sapiens; identical to SEQ ID NO: 238034

SEQ ID NO: 263163 - RNA, 64 nt, Homo Sapiens; identical to SEQ ID NO: 238035

SEQ ID NO: 263164 - RNA, 64 nt, Homo Sapiens; identical to SEQ ID NO: 238036

SEQ ID NO: 263165 - RNA, 64 nt, Homo Sapiens; identical to SEQ ID NO: 238037

SEQ ID NO: 263166 - RNA, 64 nt, Homo Sapiens; identical to SEQ ID NO: 238038

SEQ ID NO: 263167 - RNA, 64 nt, Homo Sapiens; identical to SEQ ID NO: 238039

SEQ ID NO: 263168 - RNA, 64 nt, Homo Sapiens; identical to SEQ ID NO: 238040

SEQ ID NO: 263169 - RNA, 64 nt, Homo Sapiens; identical to SEQ ID NO: 238041

SEQ ID NO: 263170 - RNA, 64 nt, Homo Sapiens; identical to SEQ ID NO: 238042

SEQ ID NO: 263171 - RNA, 64 nt, Homo Sapiens; identical to SEQ ID NO: 238043

SEQ ID NO: 263172 - RNA, 64 nt, Homo Sapiens; identical to SEQ ID NO: 238044

SEQ ID NO: 263173 - RNA, 64 nt, Homo Sapiens; identical to SEQ ID NO: 238045

SEQ ID NO: 263174 - RNA, 64 nt, Homo Sapiens; identical to SEQ ID NO: 238046

SEQ ID NO: 263175 - RNA, 64 nt, Homo Sapiens; identical to SEQ ID NO: 238047

SEQ ID NO: 263176 - RNA, 64 nt, Homo Sapiens; identical to SEQ ID NO: 238048

SEQ ID NO: 263177 - RNA, 64 nt, Homo Sapiens; identical to SEQ ID NO: 238049

SEQ ID NO: 263178 - RNA, 64 nt, Homo Sapiens; identical to SEQ ID NO: 238050

SEQ ID NO: 263179 - RNA, 64 nt, Homo Sapiens; identical to SEQ ID NO: 238051

SEQ ID NO: 263180 - RNA, 64 nt, Homo Sapiens; identical to SEQ ID NO: 238052

SEQ ID NO: 263181 - RNA, 64 nt, Homo Sapiens; identical to SEQ ID NO: 238053

SEQ ID NO: 263182 - RNA, 64 nt, Homo Sapiens; identical to SEQ ID NO: 238054

SEQ ID NO: 263183 - RNA, 64 nt, Homo Sapiens; identical to SEQ ID NO: 238055

SEQ ID NO: 263184 - RNA, 64 nt, Homo Sapiens; identical to SEQ ID NO: 238056

SEQ ID NO: 263185 - RNA, 64 nt, Homo Sapiens; identical to SEQ ID NO: 238057

SEQ ID NO: 263186 - RNA, 64 nt, Homo Sapiens; identical to SEQ ID NO: 238058

SEQ ID NO: 263187 - RNA, 64 nt, Homo Sapiens; identical to SEQ ID NO: 238059

SEQ ID NO: 263188 - RNA, 64 nt, Homo Sapiens; identical to SEQ ID NO: 238060

SEQ ID NO: 263189 - RNA, 64 nt, Homo Sapiens; identical to SEQ ID NO: 238061

SEQ ID NO: 263190 - RNA, 64 nt, Homo Sapiens; identical to SEQ ID NO: 238062

SEQ ID NO: 263191 - RNA, 64 nt, Homo Sapiens; identical to SEQ ID NO: 238063

SEQ ID NO: 263192 - RNA, 64 nt, Homo Sapiens; identical to SEQ ID NO: 238064

SEQ ID NO: 263193 - RNA, 64 nt, Homo Sapiens; identical to SEQ ID NO: 238065

SEQ ID NO: 263194 - RNA, 64 nt, Homo Sapiens; identical to SEQ ID NO: 238066

SEQ ID NO: 263195 - RNA, 64 nt, Homo Sapiens; identical to SEQ ID NO: 238067

SEQ ID NO: 263196 - RNA, 64 nt, Homo Sapiens; identical to SEQ ID NO: 238068

SEQ ID NO: 263197 - RNA, 64 nt, Homo Sapiens; identical to SEQ ID NO: 238069

SEQ ID NO: 263198 - RNA, 64 nt, Homo Sapiens; identical to SEQ ID NO: 238070

SEQ ID NO: 263199 - RNA, 64 nt, Homo Sapiens; identical to SEQ ID NO: 238071

SEQ ID NO: 263200 - RNA, 64 nt, Homo Sapiens; identical to SEQ ID NO: 238072

SEQ ID NO: 263201 - RNA, 64 nt, Homo Sapiens; identical to SEQ ID NO: 238073

SEQ ID NO: 263202 - RNA, 64 nt, Homo Sapiens; identical to SEQ ID NO: 238074

SEQ ID NO: 263203 - RNA, 64 nt, Homo Sapiens; identical to SEQ ID NO: 238075

SEQ ID NO: 263204 - RNA, 64 nt, Homo Sapiens; identical to SEQ ID NO: 238076

SEQ ID NO: 263205 - RNA, 64 nt, Homo Sapiens
cgcccucagccgcggagccucugcggaggcugagccccgcgaccggagcgccgcucuccgcuuc

SEQ ID NO: 263206 - RNA, 64 nt, Homo Sapiens
ugagucauacuccccacaaguagccacaauggccccccgcgaagggaggggcagaguuaaacau

SEQ ID NO: 263207 - RNA, 64 nt, Homo Sapiens
cccugccggcacggcucccccuccuggaccagucccccgcgagcccggagaaggggagacccgu

SEQ ID NO: 263208 - RNA, 64 nt, Homo Sapiens
caguggaggcgggacgcccuccaucuccucggagccccgcgagguccggcccagcaacuucccg

SEQ ID NO: 263209 - RNA, 64 nt, Homo Sapiens
agguaaauacacccaaagggccucuccucuggucccccgcgaaacccauuggaugaaguggugc

SEQ ID NO: 263210 - RNA, 64 nt, Homo Sapiens
uccugugguaaggcuuucugguaugggcccaguuccccgcgaguccuuccuacggggaaucugu

SEQ ID NO: 263211 - RNA, 64 nt, Homo Sapiens
ugcuggaggguaggauucuggcaggucccccccuccccgcgauaagucacuucuuggcugugca

SEQ ID NO: 263212 - RNA, 64 nt, Homo Sapiens
accccugugcgcgcguucgcccgccgaagggcagccccgcgaccagcagcgcccgaggccaggg

SEQ ID NO: 263213 - RNA, 64 nt, Homo Sapiens
cagccucaaauuccagaaguggaggcuccagccuccccgcgaggguccagccccacagucuucu

SEQ ID NO: 263214 - RNA, 54 nt, Homo Sapiens
cggguuagggaaagcggaggaugcccccgcgagaagggcgaggacgaggcguag

SEQ ID NO: 263215 - RNA, 64 nt, Homo Sapiens
cuucaacgccuucugacuuccucaucaugaagauccccgcgauacaugaugagcccuguuccug

SEQ ID NO: 263216 - RNA, 64 nt, Homo Sapiens
gcggcagcagagcuggcacaccgauucugggaagccccgcgaaugauggcuuuugaauuaauga

SEQ ID NO: 263217 - RNA, 64 nt, Homo Sapiens
caggauccuucugcuccgcucaggacccccggagccccgcgaaaacaucugccucccaggaggg

SEQ ID NO: 263218 - RNA, 64 nt, Homo Sapiens
gcauccagcagcaguagcagugucugggugggacccccgcgaguugaacaccgcgaacagccuc

SEQ ID NO: 263219 - RNA, 64 nt, Homo Sapiens
cugcauuuccucgcagccucucagugcccuccagccccgcgaccauguggccacaauccacgcu

SEQ ID NO: 263220 - RNA, 64 nt, Homo Sapiens
cccugggggccgugcucacuaccgggacccgagcccccgcgaugccagguuuaaccguugcguc

SEQ ID NO: 263221 - RNA, 64 nt, Homo Sapiens
ggagacggcaucucguucacgggacucugcccgcccccgcgacucauggaauccacgcgcucca

SEQ ID NO: 263222 - RNA, 64 nt, Homo Sapiens
aguguuuugguggcagagguggcacucccucugaccccgcgaugcguuucuuuuuaccuuuuuu

SEQ ID NO: 263223 - RNA, 64 nt, Homo Sapiens
guguggccacagcggacaugguaugcccggaugcccccgcgagccccagcgcccuggcagucag

SEQ ID NO: 263224 - RNA, 64 nt, Homo Sapiens
gaaaugauccccucuuugccuuggacuucuucucccccgcgaguuuuccccacuuacuuacccu

SEQ ID NO: 263225 - RNA, 64 nt, Homo Sapiens
agggccgaggucugagcucucguccugccguggcccccgcgauggccuggggugcaagcuuggg

SEQ ID NO: 263226 - RNA, 64 nt, Homo Sapiens
accagaccuuccauguccucgggcagcugcaacuccccgcgagaccccgcagcugggugggaug

SEQ ID NO: 263227 - RNA, 64 nt, Homo Sapiens
aaaucucgagagaacuggcauuccucgcggcagcccccgcgaagccgacaggggcgagggcugc

SEQ ID NO: 263228 - RNA, 50 nt, Homo Sapiens
ucuccaucuucagcuucuucccccgcgaccucccgcacgcacaaucguga

SEQ ID NO: 263229 - RNA, 64 nt, Homo Sapiens
gucaggggugccacggugggucacuccuaccccaccccgcgaucccucaccccgacccccaccc

SEQ ID NO: 263230 - RNA, 64 nt, Homo Sapiens
ccacuccccccgccucgacggcaccacuggccggccccgcgaaagacugcgcgugcguagagca

SEQ ID NO: 263231 - RNA, 50 nt, Homo Sapiens
cggggccugaagccacguagccccgcgaugccagaggaggggcacugggu

SEQ ID NO: 263232 - RNA, 64 nt, Homo Sapiens
cuggcgaaauaaagcgaguggccccuucuggacgccccgcgacuccccgcgccggaguccaggg

SEQ ID NO: 263233 - RNA, 64 nt, Homo Sapiens
gaggcugcuggacccaccccgucucccucagaucccccgcgagguauaauauuuagcgaacucg

SEQ ID NO: 263234 - RNA, 64 nt, Homo Sapiens
cacccgcggaguggggggccggugcucaagucccccccgcgaccgcccggggcaacuccgagug

SEQ ID NO: 263235 - RNA, 64 nt, Homo Sapiens
ccgggagcuggaggcgcaugucggaauccacguuccccgcgaucgaguccgcaguugcccuugu

SEQ ID NO: 263236 - RNA, 64 nt, Homo Sapiens
uccgaggccuggcucuggaguuuugccuuugguuccccgcgaagcggcgccccggacgccgcga

SEQ ID NO: 263237 - RNA, 64 nt, Homo Sapiens
gauccgaccgcgucgcugcccuuccucccgcagcccccgcgaccccgcccgggucccugcagcg

SEQ ID NO: 263238 - RNA, 64 nt, Homo Sapiens
gagggcagggcccacccugcacucaggccgcagcccccgcgacgacacgcagggggcucggagg

SEQ ID NO: 263239 - RNA, 64 nt, Homo Sapiens
agccggguugauucuacaggugugcggguuagauagagaucaucaggucaucagccagguugau

SEQ ID NO: 263240 - RNA, 64 nt, Homo Sapiens
agccugguagauuguguggguguguggguuagauagagaucaucaggucaucagccagguugau

SEQ ID NO: 263241 - RNA, 64 nt, Homo Sapiens
gucaagcuaaaauaggugacuauacuauuaagauagagaucauacaaaagauuccaaagaaagu

SEQ ID NO: 263242 - RNA, 64 nt, Homo Sapiens
ccaaagaaagucaaaaaguguaaaauggaaaauaagagaucaaaaugaauauagcauaggaaua

SEQ ID NO: 263243 - RNA, 64 nt, Homo Sapiens
ucaucaccaucucagcacaauuuggccauucugaagagaucauguuauuucacucuucauguau

SEQ ID NO: 263244 - RNA, 64 nt, Homo Sapiens
cuauucuaacaaauuuuucguccaccaucuuaacagagaucaaguguauacaugaagguaucag

SEQ ID NO: 263245 - RNA, 64 nt, Homo Sapiens
aguacacaggcugcagaagacagagacagaagaaagagaucaagggcagauaacuguugauagg

SEQ ID NO: 263246 - RNA, 64 nt, Homo Sapiens
agucugaccauucacuuucugugugccagagaagagagaucauggguauagaccagccccugga

SEQ ID NO: 263247 - RNA, 64 nt, Homo Sapiens
augaugaguccagaaccccuguguauccagaagaagagaucagagauauugauggccacuaagu

SEQ ID NO: 263248 - RNA, 64 nt, Homo Sapiens
agaacuugggcuuuucuacguuugagagcucuucagagaucauacuccugggacugugacugcu

SEQ ID NO: 263249 - RNA, 64 nt, Homo Sapiens
ccuuaggggugaguccuauuuauaugguaaacucagagaucacugucucaauuuuuuauuuauc

SEQ ID NO: 263250 - RNA, 64 nt, Homo Sapiens
uuaaauugcugauagguccuuuaguaauaaaaccagagaucaauauaucacaugguacacuuga

SEQ ID NO: 263251 - RNA, 64 nt, Homo Sapiens
cucagaaaccuucgcucacguaguuggauggcauagagaucauacaaggauacaguugguauau

SEQ ID NO: 263252 - RNA, 64 nt, Homo Sapiens
gucuuauugugaugagucucgaaugacgaaaaggagagaucaauagaguccacgcugacauaca

SEQ ID NO: 263253 - RNA, 64 nt, Homo Sapiens
ucuugggcccagccagcuggguacuuuggggaaacagauggagccaauggccuagaagcugccu

SEQ ID NO: 263254 - RNA, 64 nt, Homo Sapiens
aucugaacauaggguggcugacuuuuuuggccaucagauggacggccacugagcccaggucugg

SEQ ID NO: 263255 - RNA, 64 nt, Homo Sapiens
uuacauuugcucuuuuguguaccaugccccgccccagauggauuugggauuacaggcgugagcc

SEQ ID NO: 263256 - RNA, 64 nt, Homo Sapiens
uuuuuuuuuuuuuuuggagaucuuuauucccuaccagauggauuacucccuuaucucuucauau

SEQ ID NO: 263257 - RNA, 64 nt, Homo Sapiens
auguaucucauacgcugugauguggauggggccccagauggaagguuugaaacuggauucucga

SEQ ID NO: 263258 - RNA, 64 nt, Homo Sapiens
accccugggaugcgaagccagcaagcuuuugcugcagauggacagguuucuuuucuguggcuuu

SEQ ID NO: 263259 - RNA, 64 nt, Homo Sapiens
gaccgauaaaaagaccuccagauaggcagacagacagauggaccaccaaccuggacagacagcc

SEQ ID NO: 263260 - RNA, 64 nt, Homo Sapiens
acagaccuucuggccagacagacuccuaaccaaccagauggacugccagacaggcagacaucag

SEQ ID NO: 263261 - RNA, 64 nt, Homo Sapiens
cccccaaaugaguacacaucuccagcuauucagacagauggacccccagcaaaucaggaccuau

SEQ ID NO: 263262 - RNA, 64 nt, Homo Sapiens
aaucugaaugugauaugcucaaaaacauaugaaucagauggaacaagaucuuuugaauuuuaga

SEQ ID NO: 263263 - RNA, 64 nt, Homo Sapiens
aaacuacuuacugauuuaagacuuuuaccacauacagauggaugacugauuuuggaccuuugag

SEQ ID NO: 263264 - RNA, 64 nt, Homo Sapiens
ucuuugucuacugugguccugugcacguuggccucagauggacuacaggagauuacaacguaca

SEQ ID NO: 263265 - RNA, 64 nt, Homo Sapiens
ucagauggacuacaggagauuacaacguacaaggcagauggagcauugacguuuucaaaaccau

SEQ ID NO: 263266 - RNA, 64 nt, Homo Sapiens
ccaucggccucuaguucuccaaggaccuagaagacagauggaguucuccccugaacuccuugcu

SEQ ID NO: 263267 - RNA, 64 nt, Homo Sapiens
agcagggccgggccuuccugccauccccaggucucagauggaauuacacuagaggcccuccgcu

SEQ ID NO: 263268 - RNA, 64 nt, Homo Sapiens
auguggaguaauagggaaaguggcaggagaaggccagauggaguaaaaaaagaaauguaccugu

SEQ ID NO: 263269 - RNA, 64 nt, Homo Sapiens
uacagaaugaauauguuuuuucuucugggaaauacagauggaaaccuaucagaacuauaggauu

SEQ ID NO: 263270 - RNA, 64 nt, Homo Sapiens
gguuccuccugcgcuguaaugcagugaggcaggacagauggacagccggcugcacccagaggga

SEQ ID NO: 263271 - RNA, 64 nt, Homo Sapiens
caguggcuggugggccacucgugggagagggagacagauggagggaacccugggcagggcucug

SEQ ID NO: 263272 - RNA, 64 nt, Homo Sapiens
aacaggcucugagauuucacaccugccuguucuccagauggagacagggagcuggcaaugcccu

SEQ ID NO: 263273 - RNA, 59 nt, Homo Sapiens
cacgugcucgccucugcccacacagggagcagauggaucgcuaccgcauccgcccauga

SEQ ID NO: 263274 - RNA, 64 nt, Homo Sapiens; identical to SEQ ID NO: 94944

SEQ ID NO: 263275 - RNA, 64 nt, Homo Sapiens; identical to SEQ ID NO: 94945

SEQ ID NO: 263276 - RNA, 64 nt, Homo Sapiens; identical to SEQ ID NO: 94946

SEQ ID NO: 263277 - RNA, 64 nt, Homo Sapiens; identical to SEQ ID NO: 94947

SEQ ID NO: 263278 - RNA, 64 nt, Homo Sapiens; identical to SEQ ID NO: 94948

SEQ ID NO: 263279 - RNA, 64 nt, Homo Sapiens; identical to SEQ ID NO: 94949

SEQ ID NO: 263280 - RNA, 64 nt, Homo Sapiens; identical to SEQ ID NO: 94950

SEQ ID NO: 263281 - RNA, 59 nt, Homo Sapiens; identical to SEQ ID NO: 94951

SEQ ID NO: 263282 - RNA, 64 nt, Homo Sapiens; identical to SEQ ID NO: 94952

SEQ ID NO: 263283 - RNA, 64 nt, Homo Sapiens; identical to SEQ ID NO: 94953

SEQ ID NO: 263284 - RNA, 62 nt, Homo Sapiens; identical to SEQ ID NO: 94954

SEQ ID NO: 263285 - RNA, 64 nt, Homo Sapiens; identical to SEQ ID NO: 94955

SEQ ID NO: 263286 - RNA, 64 nt, Homo Sapiens
guggucaccauacucaaauggugucauggcugaaguuggccaccuugcuugagggacaaguugu

SEQ ID NO: 263287 - RNA, 64 nt, Homo Sapiens
uuuuguauguuuaguagaaacgggguuucaccauguuggccaggcuguucucgaacuccugacc

SEQ ID NO: 263288 - RNA, 64 nt, Homo Sapiens
uuuugcauuuuuaguagagaugggguuucaccauguuggccaggauggucuugaucucuugacc

SEQ ID NO: 263289 - RNA, 64 nt, Homo Sapiens
uuuuguguuuuuagcagagacaggguuucaccacguuggccaggguggucuuggacuccugacc

SEQ ID NO: 263290 - RNA, 64 nt, Homo Sapiens
cugcucuugaacuccugacccaggguuucaccauguuggccagguuuuguauuuuuaguagaga

SEQ ID NO: 263291 - RNA, 64 nt, Homo Sapiens
cuggucucgaacuccugacccgggguuucaccauguuggccagguuuuguauuuuuaguagaga

SEQ ID NO: 263292 - RNA, 64 nt, Homo Sapiens
acgggaccccugggcggguggacaugagaccacuguuggccagggacgccgugcggaggccuac

SEQ ID NO: 263293 - RNA, 64 nt, Homo Sapiens
gcugccugagcagcagcugaccgcccgucucacuguuggccagggcuuuguggcguggguguuu

SEQ ID NO: 263294 - RNA, 64 nt, Homo Sapiens
uuuuauaauuuuaguagagaugggguuucacugcguuggccaggaugaucucgaucucuugacc

SEQ ID NO: 263295 - RNA, 64 nt, Homo Sapiens
uuuuguguuuuuauuagaaacagaguuucaccauguuggccaggcuggagaauugcuguaauag

SEQ ID NO: 263296 - RNA, 64 nt, Homo Sapiens
uguaugucuucuuugaaaacuuuuguguguguuuguuggccacuauuagugauguugagcauuu

SEQ ID NO: 263297 - RNA, 64 nt, Homo Sapiens
aaacuuggauauuuaaaaagaguaguagagccaaguuggccaaaacuaaucccuuugaaaauca

SEQ ID NO: 263298 - RNA, 64 nt, Homo Sapiens
uuuuguauuuuuaguagagacgggauuuuaucauguuggccaggcuggucucgaacuccugacc

SEQ ID NO: 263299 - RNA, 64 nt, Homo Sapiens
uuuuguauuuuuaguggaaccgggguuucaccauguuggccaggcuggucuugaacuccugacc

SEQ ID NO: 263300 - RNA, 64 nt, Homo Sapiens
uuuuguauuuuuaguagaaacagggugucaccauguuggccagacuggucucaaacuccugacc

SEQ ID NO: 263301 - RNA, 64 nt, Homo Sapiens
uuuuguauuuuuaguagagaugggguuucaccauguuggccaggauggucuugaucucuugacc

SEQ ID NO: 263302 - RNA, 64 nt, Homo Sapiens
cuggucucaaacuccugaccuaggguuucaccauguuggccagguuuuguauuuuucguagaga

SEQ ID NO: 263303 - RNA, 64 nt, Homo Sapiens
gcuucucccugucggugaagugauuaaugguucuguuggccaagcaaaugaagggagcagacag

SEQ ID NO: 263304 - RNA, 64 nt, Homo Sapiens
gcuggucucgaacuccugaccaggguuucaccauguuggccagguuuuguauuaguagagacga

SEQ ID NO: 263305 - RNA, 64 nt, Homo Sapiens
cuggucuugaacugaccucaugggguuucacuguguuggccagguuuuguauuuuuaguagaga

SEQ ID NO: 263306 - RNA, 64 nt, Homo Sapiens
auggucucgaucucuugacccagaguuucaccauguuggccagguuuuguaauuuuaguagaga

SEQ ID NO: 263307 - RNA, 64 nt, Homo Sapiens
cuggucucgaacuccugacccggaguuucuccauguuggccagaucuuguauuuuuaguagaga

SEQ ID NO: 263308 - RNA, 64 nt, Homo Sapiens
uaggggcucccauccccccaguguggcuggcaguguuggccacguuaccccaagcccucuagcu

SEQ ID NO: 263309 - RNA, 64 nt, Homo Sapiens
uuuguauuuuuaguagagacagggguuucaccacguuggccaggcuggucucgaacuccugacc

SEQ ID NO: 263310 - RNA, 64 nt, Homo Sapiens
aauuguauuuuuaguagagacaggauuucaccauguuggccaggccagucucaaacuccugacc

SEQ ID NO: 263311 - RNA, 64 nt, Homo Sapiens
cccugccaaguguuguguagccuucaucacugagguuggccagcgucuuuuggauaauuggaaa

SEQ ID NO: 263312 - RNA, 64 nt, Homo Sapiens
cuggucuucaacuccagaucugggguuucaccauguuggccagguuuuguacuuuuaguagaga

SEQ ID NO: 263313 - RNA, 64 nt, Homo Sapiens
cugauuaacuccugaccucacgggguuucaccauguuggccagguuuuguaauuuuaguagaga

SEQ ID NO: 263314 - RNA, 64 nt, Homo Sapiens
cuggucuugaacuccugacccagaguuucaccauguuggccagguuuuguauuuuuaguagaga

SEQ ID NO: 263315 - RNA, 64 nt, Homo Sapiens
cuggucuugaacuccugaccugggguuucaccauguuggccagguuuuguauuuuuaguagaga

SEQ ID NO: 263316 - RNA, 64 nt, Homo Sapiens
aaaauggaaaagccauuguaaagucgaagugaauguuggccagguuggguugagcuuuuuuaga

SEQ ID NO: 263317 - RNA, 64 nt, Homo Sapiens
uuuuguauuuuuaguggagacaggguuucaccauguuggccaggcuggucucgaacuccugacc

SEQ ID NO: 263318 - RNA, 64 nt, Homo Sapiens
uuuugcauuuuuaguggagagggaguuucaccauguuggccagguuggucuugaacuccugacc

SEQ ID NO: 263319 - RNA, 64 nt, Homo Sapiens
uuuuguaguuuuaguggagaugggguuucaccauguuggccaggcuugucucgaacuccugacc

SEQ ID NO: 263320 - RNA, 64 nt, Homo Sapiens
uuuuguauuuuuaguagagacgagguuucacuguguuggccaggauggucuccaucucuugacc

SEQ ID NO: 263321 - RNA, 64 nt, Homo Sapiens
gaucccucucuuuggaaaguuuagccuggaagcaguuggccacacuguguggagggcaccucuc

SEQ ID NO: 263322 - RNA, 64 nt, Homo Sapiens
uuuuguauuuucgguagagacgggauuucaccauguuggccaggcuagucucgaacucaugacc

SEQ ID NO: 263323 - RNA, 64 nt, Homo Sapiens
uuuuucauuuuuaguagagacaggguuuugccauguuggccaggcuggucucaaacucuugacc

SEQ ID NO: 263324 - RNA, 64 nt, Homo Sapiens
ugcuuuugucuaugggacucaaugcacugacauuguuggccaaagccaaagcuaggccuggcca

SEQ ID NO: 263325 - RNA, 64 nt, Homo Sapiens
aaccaccacacccagcccacuucugccauauucuguuggccagugugacaaggauugcuacugu

SEQ ID NO: 263326 - RNA, 64 nt, Homo Sapiens
uuuuguauuuuuaguagagaugggguuucaccauguuggccaggauugucuccaucucuugacc

SEQ ID NO: 263327 - RNA, 64 nt, Homo Sapiens
agccaccacacccagcgagacgggguuucauuauguuggccaggcuggucuccaacuccugacc

SEQ ID NO: 263328 - RNA, 64 nt, Homo Sapiens
cuggucuugaacuccuggucugggguuucuccauguuggccagguuuuguauuuuuagaagaga

SEQ ID NO: 263329 - RNA, 64 nt, Homo Sapiens
acucaacaaaccaguguuggucaccagacacccuguuggccaugccugaccgguccuugugccc

SEQ ID NO: 263330 - RNA, 64 nt, Homo Sapiens
cuggucucgaacucuugacccgggguuucaccauguuggccagguuuuguauuuuuaauagaga

SEQ ID NO: 263331 - RNA, 64 nt, Homo Sapiens
cuggucucgaacuccugaccugggguuucgccauguuggccagguuguauuuuuuuaauagaua

SEQ ID NO: 263332 - RNA, 64 nt, Homo Sapiens
agcuccuggcugggacacgggugccuuuuucagaguuggccaggaauaugccaagguagggaau

SEQ ID NO: 263333 - RNA, 64 nt, Homo Sapiens
uacagcgugugugcauggauaacagaaggaggaaguuggccaaugucucgguugcuauuccaag

SEQ ID NO: 263334 - RNA, 64 nt, Homo Sapiens
cccaaugcuguggccccaccaggcccagagccugguuggccauucucaugcccaccagcuucug

SEQ ID NO: 263335 - RNA, 64 nt, Homo Sapiens
uuuuguauuuuugaucaagacggaguuucaccauguuggccaggcuggucuccaacuccugccc

SEQ ID NO: 263336 - RNA, 64 nt, Homo Sapiens
ucuuuuuugguguacuuggcacaguaggugccaaguuggccaccauucuguguaacaccuuuuu

SEQ ID NO: 263337 - RNA, 64 nt, Homo Sapiens
ccaccaugugccaugauggcugcugcagccccguguuggccaugucgucaccauucucucuggc

SEQ ID NO: 263338 - RNA, 64 nt, Homo Sapiens
uuuuuguauuuuuaguagagacaguguuuaccauguuggccaggcaggucuccaacuccugacc

SEQ ID NO: 263339 - RNA, 64 nt, Homo Sapiens
uuuuguauuuuuaguagagaugggguuucaccacguuggccacacuggucucaaacuccugacc

SEQ ID NO: 263340 - RNA, 64 nt, Homo Sapiens
gucuugcucuguucacagucacaaaccaucucuaguuggccagcuggaaaaauugagauggaaa

SEQ ID NO: 263341 - RNA, 64 nt, Homo Sapiens
auggucucgaucuccugacccaggguuucaccauguuggccagguuuuguauuuuuaguagaga

SEQ ID NO: 263342 - RNA, 64 nt, Homo Sapiens
uuuuguauuuuuaguagagacaggguuucaccauguuggccaggcuggucuugaacuccugacc

SEQ ID NO: 263343 - RNA, 64 nt, Homo Sapiens
uuuuguauuuuuaguagagacaguguuuugccauguuggccaggcuggucucgaacuccugaca

SEQ ID NO: 263344 - RNA, 64 nt, Homo Sapiens
auggucucgaucucuugacccgggguuucaccauguuggccagguuuuguauuuuuaguacaga

SEQ ID NO: 263345 - RNA, 64 nt, Homo Sapiens
ggauguuugacacccagccgagagauuugauccuguuggccagacagcucuguuacaggaggau

SEQ ID NO: 263346 - RNA, 64 nt, Homo Sapiens
aguggcgcgaucucggcucagccucccgaguagcugggauuacaggcaugugccaccacgcccg

SEQ ID NO: 263347 - RNA, 64 nt, Homo Sapiens
caagugguucuccuuccucagccucccaaguagcugggauuacaggcaccuaccaccagggcca

SEQ ID NO: 263348 - RNA, 64 nt, Homo Sapiens
caggugaucugcccgccucggucucccaaagugcugggauuacaggcaugagccacugcaccug

SEQ ID NO: 263349 - RNA, 64 nt, Homo Sapiens
caagugauucuucugccucagccuccugaguagcugggauuacaggugugcaccaccguaccca

SEQ ID NO: 263350 - RNA, 64 nt, Homo Sapiens
caggugauccacccgccugagccucccaaagugcugggauuacaggcaugagccaccgcgcccg

SEQ ID NO: 263351 - RNA, 64 nt, Homo Sapiens
caagcaaaucuccugccucagccuccaaaguagcugggauuacaggcacccaccacaucuggcu

SEQ ID NO: 263352 - RNA, 64 nt, Homo Sapiens
cucaugaucagccugccucggccucccaaagugcugggauuacaggugugagccaccgugccca

SEQ ID NO: 263353 - RNA, 64 nt, Homo Sapiens
caagcaauucucuugccucagccucccgaguagcugggauuacaggugcaugccaccauggcug

SEQ ID NO: 263354 - RNA, 64 nt, Homo Sapiens
caggugauccaccugccucagccucccaaagugcugggauuacaggcgugagcaaucgugccca

SEQ ID NO: 263355 - RNA, 64 nt, Homo Sapiens
caagcaauucucccaccucagccuccugaguagcugggauuacaggcacaugccaccaugcuca

SEQ ID NO: 263356 - RNA, 64 nt, Homo Sapiens
cucgugauccacccaccuuggccucccaaagugcugggauuacaggcaugagccaccacgccug

SEQ ID NO: 263357 - RNA, 64 nt, Homo Sapiens
caagcgauucuugugccucggccucccuaguagcugggauuacaggcgcacaccaccacacaca

SEQ ID NO: 263358 - RNA, 64 nt, Homo Sapiens
cucgugauccgccugccucugccucccaaagugcugggauuacaggugugacccacugcgcaca

SEQ ID NO: 263359 - RNA, 64 nt, Homo Sapiens
cucgugauccguccaccucagccucccaaagugcugggauuacaggugugagccaccacgcccg

SEQ ID NO: 263360 - RNA, 64 nt, Homo Sapiens
ugccucuccaguguaauauuugccuuucuguaaaugggauuaaauaugauuuguaaauaaagga

SEQ ID NO: 263361 - RNA, 64 nt, Homo Sapiens
caggugauccucuugucucagccucccaaagugcugggauuacaggcaugagccacuguguccu

SEQ ID NO: 263362 - RNA, 64 nt, Homo Sapiens
caagcgauucuccugccucagccucccaaguagcugggauuacaggcauacaccaccacgcccc

SEQ ID NO: 263363 - RNA, 64 nt, Homo Sapiens
caagugauucuccucccucagccucccaaguagcugggauuacaggcacccacgagcaugcccg

SEQ ID NO: 263364 - RNA, 64 nt, Homo Sapiens
caggugauccacccgccucggccucccaaagugcugggauuacaggugcgagccaccgugcccg

SEQ ID NO: 263365 - RNA, 64 nt, Homo Sapiens
ggcaauagagguugagagagauucagcaucuuucugggauuagaauucaagucucuuuacuccu

SEQ ID NO: 263366 - RNA, 64 nt, Homo Sapiens
uugucacuggaaccucccugggccugucucagauugggauuaacauaaaagaguggaacuaucc

SEQ ID NO: 263367 - RNA, 64 nt, Homo Sapiens
cauuuccucuuccuucucuacucaugccagauuuugggauuacaaauagaagcuucuugcuccu

SEQ ID NO: 263368 - RNA, 64 nt, Homo Sapiens
caagcgauucuccugccucagccuccugaguagcugggauuacaggugugcaccaacacacccg

SEQ ID NO: 263369 - RNA, 64 nt, Homo Sapiens
caagugaucugccugccuuggccucccaaagugcugggauuacaggugugagcugccacgccca

SEQ ID NO: 263370 - RNA, 64 nt, Homo Sapiens
ggcgugagccaccaugcucggccucccaaagugcugggauuacacucgugauccaccugccaug

SEQ ID NO: 263371 - RNA, 64 nt, Homo Sapiens
cgcgugugccaccacgcucggccuucugaguagcugggauuacacaagcgauucuucugccuca

SEQ ID NO: 263372 - RNA, 64 nt, Homo Sapiens
ggcaugagccaccgcacccaccuccuuaaagugcugggauuacaaggugauccgcccgccucag

SEQ ID NO: 263373 - RNA, 64 nt, Homo Sapiens
ggugccugccaccacgccuggccuccugaguaccugggauuacacaaucgauucuccugccuca

SEQ ID NO: 263374 - RNA, 64 nt, Homo Sapiens
ggcgugagccaccgcgcccagccucccaaagugcugggauuacacaggugauccgcccgccucg

SEQ ID NO: 263375 - RNA, 64 nt, Homo Sapiens
ggcacccgccaccacaccuggccucccaaguagcugggauuacacaagugauucuccugccuca

SEQ ID NO: 263376 - RNA, 64 nt, Homo Sapiens
ggcgugagccaccgugccuggccuuccagagugcugggauuauacaagugauccaccuaccuag

SEQ ID NO: 263377 - RNA, 64 nt, Homo Sapiens
ggcgugcaccaccaugcccagccuccugaguagcugggauuauacaagcaauucuccugccuca

SEQ ID NO: 263378 - RNA, 64 nt, Homo Sapiens
ggcaugaaccaccacgccuggccucccaaagugcugggauuacacaggugauccaccugccuug

SEQ ID NO: 263379 - RNA, 64 nt, Homo Sapiens
ggcguccgccaccaugccuggccucucgaguagcugggauuauacaagcaauucuccugccuca

SEQ ID NO: 263380 - RNA, 64 nt, Homo Sapiens
ggcgugagccacugcgcccagccuccuaaagugcugggauuacacaggugauccgcccgccucg

SEQ ID NO: 263381 - RNA, 64 nt, Homo Sapiens
ggcaugugccacaacgccugucuucccagguagcugggauuacacaagcgauuuuccugcuuca

SEQ ID NO: 263382 - RNA, 64 nt, Homo Sapiens
ggugugagccaccgcacccggccucccaaagugcugggauuacacucaugauccacccaccuca

SEQ ID NO: 263383 - RNA, 64 nt, Homo Sapiens
ggcacccaccacuaugcccagucuccugaguagcugggauuacacaagcgauucuccuguguca

SEQ ID NO: 263384 - RNA, 64 nt, Homo Sapiens
ggugugagccacagcgccuggccucccaaagugcugggauuacacaggugauccacccaccucg

SEQ ID NO: 263385 - RNA, 64 nt, Homo Sapiens
ggcaccugccaccaugcccggccucucgaguagcugggauuacacaagcgauucuccugccuca

SEQ ID NO: 263386 - RNA, 64 nt, Homo Sapiens
agacguaagccaccacaccuaccucccaaagugcugggauuacucaggugauccacccacuuug

SEQ ID NO: 263387 - RNA, 64 nt, Homo Sapiens
ggugugagccacugcacccagccucccaaagugcugggauuacacaagugauccacccgccuca

SEQ ID NO: 263388 - RNA, 64 nt, Homo Sapiens
gaugugagccaccgugccuagccucccaaagugaugggauuacacucuugauccgccugccuug

SEQ ID NO: 263389 - RNA, 64 nt, Homo Sapiens
ggugcgugccaccaugccuggucuccugaguagcugggauuacgcaagccauucuccugccuca

SEQ ID NO: 263390 - RNA, 64 nt, Homo Sapiens
ggugugagccaccacgcccggccucccaaagugcugggauuacacagguaaucgaccugccucg

SEQ ID NO: 263391 - RNA, 64 nt, Homo Sapiens
ggcgugagccaccgugccugaucucccaaagugcugggauuacauaggugauccacucgccuuc

SEQ ID NO: 263392 - RNA, 64 nt, Homo Sapiens
ggcuccugccaccacgcccggccuccugaguagcugggauuacacaagugauucucaugccuca

SEQ ID NO: 263393 - RNA, 64 nt, Homo Sapiens
ggugugagcgaccacauccggccucccaaaguucugggauuacacucguaaucugcccaccucg

SEQ ID NO: 263394 - RNA, 64 nt, Homo Sapiens
ggugcgugccaccacaccccaccuccugaguagcugggauuacacaagcgauucuccugcuuca

SEQ ID NO: 263395 - RNA, 64 nt, Homo Sapiens
cagauacccaagaggcaggacccuccucuggaacugggauuaaaucuucccuccagccugcaug

SEQ ID NO: 263396 - RNA, 64 nt, Homo Sapiens
ggcgugagccaccaugccccgccucccaaagugcugggauuacacucgugaucugccugccuug

SEQ ID NO: 263397 - RNA, 64 nt, Homo Sapiens
ggcaugugccaccacgccaagccucccgaguagcugggauuacacaagcgauucuccuaccuca

SEQ ID NO: 263398 - RNA, 64 nt, Homo Sapiens
ggcgugagccaccgcgccccgccucccaaagugcugggauuacacaggugauccacccaccucg

SEQ ID NO: 263399 - RNA, 64 nt, Homo Sapiens
ggcgcccgccaccaugcccggccucccuaguagcugggauuacacaagcgauucuccugccuca

SEQ ID NO: 263400 - RNA, 64 nt, Homo Sapiens
uaggcaugagccacugagccgcuucucaaaguacugggauuauaucaagugaucugccgccuca

SEQ ID NO: 263401 - RNA, 64 nt, Homo Sapiens
ggcgugagccaccgcguccggccucccaaagugcugggauuacacucgugauccgccugccucu

SEQ ID NO: 263402 - RNA, 64 nt, Homo Sapiens
ggcaugcaccaccaugcccagccucccaaguagcugggauuacacaagcaauucuccuuccuca

SEQ ID NO: 263403 - RNA, 64 nt, Homo Sapiens
ggcgggagccacugcacaugagcucucaaagugcugggauuacaucaggugauccgcccaccuc

SEQ ID NO: 263404 - RNA, 64 nt, Homo Sapiens
ggcaugcgucaccacucccagccucucgaguagcugggauuacacaagcgauucuccugccuca

SEQ ID NO: 263405 - RNA, 64 nt, Homo Sapiens
cucgugauccgcccgccucggccucccaaagugcugggauuacaggcgugagccaccgugccug

SEQ ID NO: 263406 - RNA, 64 nt, Homo Sapiens
caagugauucuccagccucagccucccgaguagcugggauuaugggcgcccaccaccaugccca

SEQ ID NO: 263407 - RNA, 64 nt, Homo Sapiens
caggugaucugcccaccucauccuccaaaagugcugggauuacaggcaugagccacugcgccug

SEQ ID NO: 263408 - RNA, 64 nt, Homo Sapiens
caagcaauucuccugccucagccucccgaguagcugggauuacaggcaugcgccacuaccccag

SEQ ID NO: 263409 - RNA, 64 nt, Homo Sapiens
caggugauccgccugccucggccucccaaagugcugggauuacaggcauaagccacugcgccca

SEQ ID NO: 263410 - RNA, 64 nt, Homo Sapiens
caaaugauucuccugccucagccucccgaguagcugggauuacaggcaccugccaccacgccca

SEQ ID NO: 263411 - RNA, 64 nt, Homo Sapiens
cucaugauccacccaccuuagccucccaaagugcugggauuaggugugagccaccgcaccuggc

SEQ ID NO: 263412 - RNA, 64 nt, Homo Sapiens
ucaagggauucuccugccucagccuccaacuagcugggauuacaggcacaagccaccaugccug

SEQ ID NO: 263413 - RNA, 64 nt, Homo Sapiens
caggugauccaccagccucggccucccaaaguucugggauuaaaugcgugagccaccaugcccg

SEQ ID NO: 263414 - RNA, 64 nt, Homo Sapiens
caagcgauucuccugccccagccucccauauagcugggauuauaggugccugccaccaugccca

SEQ ID NO: 263415 - RNA, 64 nt, Homo Sapiens
caggugauccacccaccuuggccucucuaaauacugggauuacaggcgugagccacugcauccg

SEQ ID NO: 263416 - RNA, 64 nt, Homo Sapiens
caagcgauucuccuguaucagccucccaaguagcugggauuauaggcaugugccaccaugccca

SEQ ID NO: 263417 - RNA, 64 nt, Homo Sapiens
caagugauccacacgccuuggucucccaaagugcugggauuacgguguuagccacuacaccugg

SEQ ID NO: 263418 - RNA, 64 nt, Homo Sapiens
caagcgauucuccugccucagccuccugaguagcugggauuacaggcacgcaccaccauaccug

SEQ ID NO: 263419 - RNA, 64 nt, Homo Sapiens
caagcgauccaccugccuuggccuuccagagugcugggauuacaggugugagccaccacgccca

SEQ ID NO: 263420 - RNA, 64 nt, Homo Sapiens
caagcgauucucguggcucagccucccuaguagcugggauuacaggcacacaccaccauaccug

SEQ ID NO: 263421 - RNA, 64 nt, Homo Sapiens
caggugauccacccgccuuggccucccaaagugcugggauuacaggugugagccacuauacccg

SEQ ID NO: 263422 - RNA, 64 nt, Homo Sapiens
cucacgauuugcccgccucggcuucccagagugcugggauuacaggcgugagccaccgcgccug

SEQ ID NO: 263423 - RNA, 64 nt, Homo Sapiens
caaaugauccgccugcgucggcuucccagagugcugggauuacaggugucagccacugcgcuca

SEQ ID NO: 263424 - RNA, 64 nt, Homo Sapiens
caagugauucucuugccuuagccucccgagcagcugggauuauaggcguccaccaccacgccca

SEQ ID NO: 263425 - RNA, 64 nt, Homo Sapiens
ggcgugagccacugcaccugggcucccaaagugcugggauuacacaagugaucugcccgccucg

SEQ ID NO: 263426 - RNA, 64 nt, Homo Sapiens
cgcacaugccaccacacccagccaccugaguagcugggauuacacaagcgauucuccugccuca

SEQ ID NO: 263427 - RNA, 64 nt, Homo Sapiens
ggcaugagccaccgcgccuggccucccaaagugcugggauuacacaggugauccucccgccucg

SEQ ID NO: 263428 - RNA, 64 nt, Homo Sapiens
ggcaacugccaccaugcccggccuccugaguagcugggauuacacaagcgauucuccugccuca

SEQ ID NO: 263429 - RNA, 64 nt, Homo Sapiens
ggugugagccaccaggcccagccucccaaagugcugggauuacacaagugauccgcccgccuca

SEQ ID NO: 263430 - RNA, 64 nt, Homo Sapiens
ggcacgugccaccaugacuggccucccaaguagcugggauuaaacaagugauucuugugccuca

SEQ ID NO: 263431 - RNA, 64 nt, Homo Sapiens
ugccuccuggguucacguaauccuccugaguagcugggauuacaggcgccugccaccacgcugg

SEQ ID NO: 263432 - RNA, 64 nt, Homo Sapiens
caggugauccgcccaccucagccucccaaaauggugggauuacaggugugugggccaccgugcc

SEQ ID NO: 263433 - RNA, 64 nt, Homo Sapiens
caagcaauucugcugcaucagccucccgaguaccugggauuacaggcaugugccaccacgcccg

SEQ ID NO: 263434 - RNA, 64 nt, Homo Sapiens
cagaugauccaucugccuuggccucccacagugcugggauuacaggcgugagccaccaugcccg

SEQ ID NO: 263435 - RNA, 64 nt, Homo Sapiens
caagcgauucuccuccuucagacucucgaauagcugggauuacaggcacgccucaccacgccca

SEQ ID NO: 263436 - RNA, 64 nt, Homo Sapiens
caagugauccgccugccuuggccccccaaagugcugggauuacaggagugagccacugugccca

SEQ ID NO: 263437 - RNA, 64 nt, Homo Sapiens
caagugauccacccaccucggucucccaaaguguugggauuacaggcgugagccacugcaccug

SEQ ID NO: 263438 - RNA, 64 nt, Homo Sapiens
cuugggauccacccgccuuggccucccaaagugcugggauuacaggugugagccaccaugccug

SEQ ID NO: 263439 - RNA, 64 nt, Homo Sapiens
caagcaauuugccugccucagccucccaaagugcugggauuacaggcgugagccacugcacagg

SEQ ID NO: 263440 - RNA, 64 nt, Homo Sapiens
uaagcgauucuccugccucagcuucccgaguagcugggauuacaggcgugcgccaacaugucug

SEQ ID NO: 263441 - RNA, 64 nt, Homo Sapiens
caggugauccacccaccucggccucccaaaguguugggauuacaggcgugagccaccgcacccg

SEQ ID NO: 263442 - RNA, 64 nt, Homo Sapiens
caagugauucuccugccucagccucccgaguagcugggauuacaggcaugcuccaccaugccca

SEQ ID NO: 263443 - RNA, 64 nt, Homo Sapiens
caggugauccgcccaccucggccucccaaacugcugggauuacaggcgugagccaccgcgccug

SEQ ID NO: 263444 - RNA, 64 nt, Homo Sapiens
caagugauucuccugugucagccuccugaguagcugggauuacaggcgugugccaccaugccug

SEQ ID NO: 263445 - RNA, 64 nt, Homo Sapiens
ccagugauccgccugccuugaccucccaaagugcugggauuacagacaugagccaccgagccug

SEQ ID NO: 263446 - RNA, 64 nt, Homo Sapiens
cucgugauccgcccgccucagccuuccaaaguguugggauuauaggcgugagccaccgcgccca

SEQ ID NO: 263447 - RNA, 64 nt, Homo Sapiens
caagcgauucuccugccucagccuccugaguagcugggauuacaggugugugccuccacacccg

SEQ ID NO: 263448 - RNA, 64 nt, Homo Sapiens
caagccaucccccaaccuuggccucucgaguagaugggauuauaggcaugugccacggugccug

SEQ ID NO: 263449 - RNA, 64 nt, Homo Sapiens
caagggauccuccugucuugggcucccaaaguguugggauuacaggcgugagugaccaugccua

SEQ ID NO: 263450 - RNA, 64 nt, Homo Sapiens
caagugauucuccugccucagccucccgaguagcugggauuacaggcaugcgcuaacacaccca

SEQ ID NO: 263451 - RNA, 64 nt, Homo Sapiens
ggucucgaacucccaccucagccucccaaacugcugggauuacaggugugagccaccgugacca

SEQ ID NO: 263452 - RNA, 64 nt, Homo Sapiens
caagugauucuccugccucagccucccgaguagcugggauuacaggugugugccaccacacccg

SEQ ID NO: 263453 - RNA, 64 nt, Homo Sapiens
caggugauucgcccaccucagccucccaaagugcugggauuacaggugugggccacugcaccug

SEQ ID NO: 263454 - RNA, 64 nt, Homo Sapiens
uaggugauccacccgccucgaccucccaaagugcugggauuacaggcaugagccaccaugccca

SEQ ID NO: 263455 - RNA, 64 nt, Homo Sapiens
uuugugauccacccgccucggccucccaaagugcugggauuacaggcaugagccaucacaccug

SEQ ID NO: 263456 - RNA, 64 nt, Homo Sapiens
ggcaugagccacugugcccagccucccaaaguucugggauuacacauuuuggccggccuccucg

SEQ ID NO: 263457 - RNA, 64 nt, Homo Sapiens
ggugcgcaccaccacacccgggcuucugaguagcugggauuauacaaguaauucuccugccuca

SEQ ID NO: 263458 - RNA, 64 nt, Homo Sapiens
ggcaccuaccaccuugcccagccuccccaguagcugggauuacauaagcaauucuccugccuca

SEQ ID NO: 263459 - RNA, 64 nt, Homo Sapiens
cugaaccuauuuguccaauaaagcuguuuauauuugggauuauaaaauuauuuuauccugaagu

SEQ ID NO: 263460 - RNA, 64 nt, Homo Sapiens
ggugugagccacugugcccggccucccaaaaugcugggauuacagucgugauccacccgccucg

SEQ ID NO: 263461 - RNA, 64 nt, Homo Sapiens
ggcgugagccacugugccuggccucccaaagugcugggauuacacaagcaauccacccaccucu

SEQ ID NO: 263462 - RNA, 64 nt, Homo Sapiens
gaugugagccaccgcauccagccucccaaagugcugggauuacacaagcaauccuccugccucg

SEQ ID NO: 263463 - RNA, 64 nt, Homo Sapiens
cucuaaucaggugaguagacugaaaaagaaagacugggauuaaugcagguugcauuuauuguaa

SEQ ID NO: 263464 - RNA, 64 nt, Homo Sapiens
ggugugagacacugugccuggccacccaaagugcugggauuacacaagugauccacccgccuug

SEQ ID NO: 263465 - RNA, 64 nt, Homo Sapiens
ggugugcgccaccacaccaggccucccaaguagcugggauuauacaagugguucuccugccuca

SEQ ID NO: 263466 - RNA, 64 nt, Homo Sapiens
ggugugagccaccacgcauggccucccaaagugcugggauuacaucaagaaauccucccaccuu

SEQ ID NO: 263467 - RNA, 64 nt, Homo Sapiens
ggcgugcaccaccacgcccagccucccaaguagcugggauuacacaagugauucuugugccuua

SEQ ID NO: 263468 - RNA, 64 nt, Homo Sapiens
ggcgugagccaccaugccuggccucccaaaguacugggauuacacucgugauccacccgucuca

SEQ ID NO: 263469 - RNA, 64 nt, Homo Sapiens
ggcaugcaccaccacacccagccuccugaguagcugggauuauacaagcaauucuccugccuca

SEQ ID NO: 263470 - RNA, 64 nt, Homo Sapiens
ggcaugagccauugcgcccggccucccaaagugcugggauuacacaggugauccacccaccuca

SEQ ID NO: 263471 - RNA, 64 nt, Homo Sapiens
ggcacacacuaccacgccuggcuucccgaguagcugggauuacacaagugauucuccugcuuca

SEQ ID NO: 263472 - RNA, 64 nt, Homo Sapiens
ggcguaagccacuacaccuggccucccaaagugcugggauuacacaagugaucugcccgccuug

SEQ ID NO: 263473 - RNA, 64 nt, Homo Sapiens
ggcgugugccacuacacccggcguucugaguagcugggauuagacaagugauucucaugccuca

SEQ ID NO: 263474 - RNA, 64 nt, Homo Sapiens
caggugaucugcccaccuuggccucccaaagugcugggauuacaggcaugagccacugugccug

SEQ ID NO: 263475 - RNA, 64 nt, Homo Sapiens
cauaaguguucuaguccacauauaaggguaggguugggauuaccauuuacugaccacaucugug

SEQ ID NO: 263476 - RNA, 64 nt, Homo Sapiens
caaucgauucuccugccucacccucccauguagcugggauuacagcugccugccaaauuuuugu

SEQ ID NO: 263477 - RNA, 64 nt, Homo Sapiens
ucaacugauccgcccaccuuggccucccaagugcugggauuacaggcgcgagccacggcgccca

SEQ ID NO: 263478 - RNA, 64 nt, Homo Sapiens
caagcauuucuccugccucagccucccaaguagcugggauuacaggcagcaccacaccuggcua

SEQ ID NO: 263479 - RNA, 64 nt, Homo Sapiens
caagugauccgcccuccccagccucccaaagugcugggauuacaggugugagccaccacagcca

SEQ ID NO: 263480 - RNA, 64 nt, Homo Sapiens
uaagggauucuccugccucagccucccaaguagcugggauuacagacucaugccaccacgccag

SEQ ID NO: 263481 - RNA, 64 nt, Homo Sapiens
ucaugaucugcccaccucggccuccccaaagugcugggauuacagguacaaugauguauaauua

SEQ ID NO: 263482 - RNA, 64 nt, Homo Sapiens
caagcaauucuccugccucagccuccugaguagcugggauuacaggcaugaaccaccacaccug

SEQ ID NO: 263483 - RNA, 64 nt, Homo Sapiens
cucgugaucugcccgccucagccucccaaagugcugggauuacaggcgugagccaccacaccug

SEQ ID NO: 263484 - RNA, 64 nt, Homo Sapiens
caagugauucuccugccucagccucccgaguagcugggauuacaggcgugcacuaccacaccca

SEQ ID NO: 263485 - RNA, 64 nt, Homo Sapiens
cucaugauccacccgccucagcuucccaaagugcugggauuacaggugugagucacugcaccca

SEQ ID NO: 263486 - RNA, 64 nt, Homo Sapiens
caagcaauucuucugccucagccucccaaguagcugggauuacaggcacccgccaccacgccca

SEQ ID NO: 263487 - RNA, 64 nt, Homo Sapiens
caagugaucugcccaccuuggccucccaaagugcugggauuacagguguaagccacugcgcccg

SEQ ID NO: 263488 - RNA, 64 nt, Homo Sapiens
caagcaauucuucugccucagccucccaaguagcugggauuacaggugccugccaccaugccug

SEQ ID NO: 263489 - RNA, 64 nt, Homo Sapiens
caagugauccaccugccucagccucccaaagugcugggauuauagucgugagccaccacgccug

SEQ ID NO: 263490 - RNA, 64 nt, Homo Sapiens
ggcaugagccaccgcacccagccucccaaagugcugggauuacacaggugauccacccuccuca

SEQ ID NO: 263491 - RNA, 64 nt, Homo Sapiens
ggcaugcaccaccacaccaggccuccugaguagcugggauuacacaggcgauucuccugccuca

SEQ ID NO: 263492 - RNA, 64 nt, Homo Sapiens
ggugugagccaccgugcccggccucccaaagugcugggauuacauugugauccaccccgccuug

SEQ ID NO: 263493 - RNA, 64 nt, Homo Sapiens
ggcacgugccaccacgcccagcuucccaaguagcugggauuacacaagcaauucuccugccuca

SEQ ID NO: 263494 - RNA, 64 nt, Homo Sapiens
ucaagcaauuucuugccucagccucaugaauagcugggauuacaggugcccaccaccaugccug

SEQ ID NO: 263495 - RNA, 64 nt, Homo Sapiens
cucgugauccaccugccucggcuucccaaagugcugggauuacaggcgugcaccacugagucca

SEQ ID NO: 263496 - RNA, 64 nt, Homo Sapiens
aaagugauucuccugccucagccucucgaguagcugggauuacaggcaugcaccaccacaccca

SEQ ID NO: 263497 - RNA, 64 nt, Homo Sapiens
caggugauccgcccaccuaggccucucaaaguguugggauuacguguguaagccacagugccca

SEQ ID NO: 263498 - RNA, 64 nt, Homo Sapiens
caagcgauucuugugccucagcuucccaagcagcugggauuacaggugcccgccaccacgccca

SEQ ID NO: 263499 - RNA, 64 nt, Homo Sapiens
cagguaauccgccugccuuggccucccaaagugcugggauuacagacaugaaccaccacgccug

SEQ ID NO: 263500 - RNA, 64 nt, Homo Sapiens
cucaugauccacccgccucagccucccaaaguguugggauuacaggcgugagucaccgcgccca

SEQ ID NO: 263501 - RNA, 64 nt, Homo Sapiens
caagcgauucuccugccucugccucccaaguagcugggauuacaggcacccaccaccaugccca

SEQ ID NO: 263502 - RNA, 64 nt, Homo Sapiens
caagcaguucucuugccucagccuccuggguagcugggauuacaggcacgcgcugccacaccca

SEQ ID NO: 263503 - RNA, 64 nt, Homo Sapiens
caagcgauucuccagccucagcuuccugaguagaugggauuacaggcgccugccaccacgccca

SEQ ID NO: 263504 - RNA, 64 nt, Homo Sapiens
cucgugauucacccgccucggccucccaaagugcugggauuacaggcgugagucacagcccccg

SEQ ID NO: 263505 - RNA, 64 nt, Homo Sapiens
ucaagcaauucccugccucagccucaugaauagcugggauuacaggugcccaccaccaugccug

SEQ ID NO: 263506 - RNA, 64 nt, Homo Sapiens
ccugugauccaccugccuuggcuucccaaagugcugggauuacaggcgugcaccacugagucca

SEQ ID NO: 263507 - RNA, 64 nt, Homo Sapiens
caagggauucuccugccucagccucccaaguagcugggauuacaggcaugcaccaccacgccca

SEQ ID NO: 263508 - RNA, 64 nt, Homo Sapiens
caggugaucugcccaccucggccucccaaagugcugggauuacaggcgugagccacugcaccug

SEQ ID NO: 263509 - RNA, 64 nt, Homo Sapiens
caggugauucuccugccucagccuccugaguagcugggauuacaagcacgugucaccacgccug

SEQ ID NO: 263510 - RNA, 64 nt, Homo Sapiens
cucgugauccgccugccucagccucccaaagugcugggauuacaggcaugagccaccaugccug

SEQ ID NO: 263511 - RNA, 64 nt, Homo Sapiens
caaaugauccaccugccucugcuucccaaagugcugggauuacaggcacgagccaccacaccug

SEQ ID NO: 263512 - RNA, 64 nt, Homo Sapiens
caagugauccuccugccuuggccucccaaaaugcugggauuacaggcaugagccacugugccug

SEQ ID NO: 263513 - RNA, 64 nt, Homo Sapiens
caagcaauucuccugccucagccucccaaguagcugggauuacaggugucugccaccaugccag

SEQ ID NO: 263514 - RNA, 64 nt, Homo Sapiens
caggugauccacccgccucagccucccaaagugcugggauuacaggcaaaagccaacacacccg

SEQ ID NO: 263515 - RNA, 64 nt, Homo Sapiens
caagcaauucuccugccucagccuccugaguagcugggauuauaggcacaugccaccgcgccca

SEQ ID NO: 263516 - RNA, 64 nt, Homo Sapiens
cuugugaugcucccaccucggccucccaaagugcugggauuaaagcugugagccacugugccaa

SEQ ID NO: 263517 - RNA, 64 nt, Homo Sapiens
cucaugauccucccgccucagccucccaaaaugcugggauuacaggcgugagccaccgcgccug

SEQ ID NO: 263518 - RNA, 64 nt, Homo Sapiens
ggcaugagccacugcaccuggccucccaaagugcugggauuacacaagugauccaucugccuug

SEQ ID NO: 263519 - RNA, 64 nt, Homo Sapiens
ggugugcgccaguacgccuggccuuccaaguagcugggauuacacaagggauucucgugccuca

SEQ ID NO: 263520 - RNA, 64 nt, Homo Sapiens
ggugugagccacugugcccggcuucccaaagcacugggauuacacaagugauccacccacuuca

SEQ ID NO: 263521 - RNA, 64 nt, Homo Sapiens
ggcaugagucaccaugccugggcuccaaaagugcugggauuacaccagcaauuaucccagcuug

SEQ ID NO: 263522 - RNA, 64 nt, Homo Sapiens
ggcaccugccaccacgcccagccucccaauuuacugggauuacacaagcgauucuccugccuca

SEQ ID NO: 263523 - RNA, 64 nt, Homo Sapiens
ggcgugagccacugcgcccggccucccaaagugcugggauuacacaagugauucaccugccucg

SEQ ID NO: 263524 - RNA, 64 nt, Homo Sapiens
ggcaugugccaccaugcccagccucccaaguagcugggauuacacaagcaagucuccugucuca

SEQ ID NO: 263525 - RNA, 64 nt, Homo Sapiens
ggugugagccaccgcagccggccucccaaagugcugggauuacacagguuauccacccaccuca

SEQ ID NO: 263526 - RNA, 64 nt, Homo Sapiens
ggcgugagccaccgugccuggccucccaaagugcugggauuacacucgugauccacccgccuug

SEQ ID NO: 263527 - RNA, 64 nt, Homo Sapiens
ggcgugagccacugugcccaaccucccaaaguacugggauuacacaagugauccaccugccucg

SEQ ID NO: 263528 - RNA, 64 nt, Homo Sapiens
agugugcgccaccacacccaagcccccaaguagcugggauuacaucaagugauucuccugccuc

SEQ ID NO: 263529 - RNA, 64 nt, Homo Sapiens
ggcgugagccaccacauccagccucccaaagcacugggauuacacucaugauuugccugccucg

SEQ ID NO: 263530 - RNA, 64 nt, Homo Sapiens
ggcaugcaccaccaugcccagccuccugaguggcugggauuacacaagcgauucuccugccuca

SEQ ID NO: 263531 - RNA, 64 nt, Homo Sapiens
auaguaauucccagccauacgaguucugacuuucugggauuauaaggggacuuuggcacccaag

SEQ ID NO: 263532 - RNA, 64 nt, Homo Sapiens
cuuccuuucuguaccaauuuuuuaguaauauuuuugggauuauagaaaauuuucucuggauugu

SEQ ID NO: 263533 - RNA, 64 nt, Homo Sapiens
caagcacuucucguaccucagacucccgaauagcugggauuacagacaggcaccaccacaccca

SEQ ID NO: 263534 - RNA, 64 nt, Homo Sapiens
caggugaucugccugccuuggcaucccaaagugcugggauuacaagaaugagccaccgugccug

SEQ ID NO: 263535 - RNA, 64 nt, Homo Sapiens
ucagccaucugcgcccaggccacgugucccgaucugggauuagaaaauauggguccauuccuuu

SEQ ID NO: 263536 - RNA, 64 nt, Homo Sapiens
ccagugauccucccgccucagccucccaaguagcugggauuauaggugugugccacugugccaa

SEQ ID NO: 263537 - RNA, 64 nt, Homo Sapiens
caagcgaugcucccaccuccaccucccaaagugcugggauuacaggcgugagccaccauaccug

SEQ ID NO: 263538 - RNA, 64 nt, Homo Sapiens
caagugauucuccugccucagccucccaaguagcugggauuacaggcgugcaccaccacgccgg

SEQ ID NO: 263539 - RNA, 64 nt, Homo Sapiens
caggugauccgccagccucagccucccaaagugcugggauuacaggcgugagccacugcacccg

SEQ ID NO: 263540 - RNA, 64 nt, Homo Sapiens
caagcgauucuccugccucagccugcugaguaguugggauuacaggcgcccaccaccaugccca

SEQ ID NO: 263541 - RNA, 64 nt, Homo Sapiens
caagugauccaccugccuuagccucccaaagugcugggauuacaggcaugagccacugcaccug

SEQ ID NO: 263542 - RNA, 64 nt, Homo Sapiens
caagugauucuccugccuuagccucccgaguagcugggauuauaggcacccaccaccacgccca

SEQ ID NO: 263543 - RNA, 64 nt, Homo Sapiens
caggugguccacccgccucagccucccaaagugcugggauuacaggugugagccaccgcaccug

SEQ ID NO: 263544 - RNA, 64 nt, Homo Sapiens
caggugauuauuuugccucagccucccaagcagcugggauuauagacacccgccaacacgccag

SEQ ID NO: 263545 - RNA, 64 nt, Homo Sapiens
caggugauccgcccgccucggccucccaaagugcugggauuacagacgugagccaccacucccg

SEQ ID NO: 263546 - RNA, 64 nt, Homo Sapiens
ggcgugagccacugcaccuggccucccaaagugcugggauuacacaggugaucuacccaccucg

SEQ ID NO: 263547 - RNA, 64 nt, Homo Sapiens
ggugugcgccaccacgcccagccuccugaguagcugggauuacacaggugauucuccugccuca

SEQ ID NO: 263548 - RNA, 64 nt, Homo Sapiens
ggcgugagccaccgcgcccggccucccaaagugcugggauuacacuugugaucugcccgccucg

SEQ ID NO: 263549 - RNA, 64 nt, Homo Sapiens
cgcgugagccaccgcgcccggccucccaaaguauugggauuacccuggugauccgcccgccucg

SEQ ID NO: 263550 - RNA, 64 nt, Homo Sapiens
ggcgugagccaccacaccaggccucccaaagugcugggauuacacaggugaucugcccaccuca

SEQ ID NO: 263551 - RNA, 64 nt, Homo Sapiens
ggcacaugccaccacacccagccuccggaguagcugggauuacacaagcaauucuguggcuuca

SEQ ID NO: 263552 - RNA, 64 nt, Homo Sapiens
ggcgugagccauugugcccgccaucccaaagugcugggauuacacaagugaucugcccaccuca

SEQ ID NO: 263553 - RNA, 64 nt, Homo Sapiens
ggcaccugccacugcgccuggccucccgaguagcugggauuacaugagugauucuccugcguca

SEQ ID NO: 263554 - RNA, 64 nt, Homo Sapiens
ggcgugagccacuuaguauugccucccaaagugcugggauuacacagguaaucagcccgccucg

SEQ ID NO: 263555 - RNA, 64 nt, Homo Sapiens
ggcuugagccacugcucccggccucccaaaaugcugggauuacacucaugauccaccugccuca

SEQ ID NO: 263556 - RNA, 64 nt, Homo Sapiens
ggugcucaccaccacacccagccucccgaguagcugggauuacacaagcaauucuccugccuca

SEQ ID NO: 263557 - RNA, 64 nt, Homo Sapiens
ggcgugagccacugcgcccggccucccaaagugcugggauuacacaggugguccuucugccuug

SEQ ID NO: 263558 - RNA, 64 nt, Homo Sapiens
ggagugagccaccgcucccggccucccaaagugcugggauuacacucgugaucugcccgccuca

SEQ ID NO: 263559 - RNA, 64 nt, Homo Sapiens
caagugauucuacugccucagccucccgaguagcugggauuauaggcgagugccaucaugcccg

SEQ ID NO: 263560 - RNA, 64 nt, Homo Sapiens
cgugugauccgcccuccucagccucccaaagugcugggauuacaggcaugagccacagugcccg

SEQ ID NO: 263561 - RNA, 64 nt, Homo Sapiens
caagcaauucuccugccucagccucccuaguagcugggauuacaggcaugugccacaccuggcu

SEQ ID NO: 263562 - RNA, 64 nt, Homo Sapiens
caggugauaugcccgccucggccucccaaaauguugggauuacaggcaugagccacugcacccg

SEQ ID NO: 263563 - RNA, 64 nt, Homo Sapiens
caagcaauucuccugccuccgccucccaaguagcugggauuacaggcaugcaccaccacaccug

SEQ ID NO: 263564 - RNA, 64 nt, Homo Sapiens
caggugauccaccugccugggcuucccaaaguacugggauuauaggcuugagccaccacgcccg

SEQ ID NO: 263565 - RNA, 64 nt, Homo Sapiens
ugagcaauucuccugccucagccucccaaauagcugggauuacaggugcaugccaccacaccca

SEQ ID NO: 263566 - RNA, 64 nt, Homo Sapiens
cagaugauccgccugccuuggccucccaaagugcugggauuacaggugugggagccaccaugcc

SEQ ID NO: 263567 - RNA, 64 nt, Homo Sapiens
ggcgugagccaccacgccuggccucccaaagugcugggauuacacaggugaucuaccugccucg

SEQ ID NO: 263568 - RNA, 64 nt, Homo Sapiens
agcaugcgccaccaugcccagccucucaaguagcugggauuacacaagcgauucuccugacuca

SEQ ID NO: 263569 - RNA, 64 nt, Homo Sapiens
ggcacccgccaccacgccuggccuccugaguagcugggauuacacaagugauucuccugccuca

SEQ ID NO: 263570 - RNA, 64 nt, Homo Sapiens
ggcgugagccaccaggcccugcuccccaaagugcugggauuacacaauccguccacuugccuug

SEQ ID NO: 263571 - RNA, 64 nt, Homo Sapiens
ggcaugagccaccgcaccuggccucccaaagugcugggauuacacucgugauccacccgccuug

SEQ ID NO: 263572 - RNA, 64 nt, Homo Sapiens
ggcaccugccaccaugccuggccucccaaguaguugggauuacaucaagcaauucucugccuca

SEQ ID NO: 263573 - RNA, 64 nt, Homo Sapiens
ccagggauucuccugccucacccuuucaaguagcugggauuacagguaccucuaccaugccugg

SEQ ID NO: 263574 - RNA, 64 nt, Homo Sapiens
aaagugaucugcccaccucggccucccaaaguucugggauuacgggcgugagccacuucacccg

SEQ ID NO: 263575 - RNA, 64 nt, Homo Sapiens
gggauccacagucccccuuggccucccaaaguguugggauuacaugcaugagccacugugcugg

SEQ ID NO: 263576 - RNA, 64 nt, Homo Sapiens
ucaagcaacucucugccucagccucccgaguagcugggauuacaagcacccaccacuacacuca

SEQ ID NO: 263577 - RNA, 64 nt, Homo Sapiens
cucaugauccacccgccucagccucccaaagugcugggauuacaggccccuuguucagccacug

SEQ ID NO: 263578 - RNA, 64 nt, Homo Sapiens
ggugugagccaccaugccuggccucccaaagugcugggauuacacaagugauccacucaccucg

SEQ ID NO: 263579 - RNA, 64 nt, Homo Sapiens
ggcacccaccaccacgcccagccucccgaguagcugggauuacaucaagcgauuucgugccuca

SEQ ID NO: 263580 - RNA, 64 nt, Homo Sapiens
ggcaugaaccgccaugccuggccucccaaagugcugggauuacacaaaugaugugcccaacucg

SEQ ID NO: 263581 - RNA, 64 nt, Homo Sapiens
caagcgauucuccugucucagccuccugaguagcugggauuauagguacaugccaucacaccug

SEQ ID NO: 263582 - RNA, 64 nt, Homo Sapiens
caggugauccacccgccucagccucccaaagugcugggauuacaggugggagccacaacacccg

SEQ ID NO: 263583 - RNA, 64 nt, Homo Sapiens
uaggugauccgcccgccucagccucccaaaguguugggauuacaggcaugagccacugcgccug

SEQ ID NO: 263584 - RNA, 64 nt, Homo Sapiens
caagugauucuccugccuuagccuccugaaaagcugggauuacagggcccugccaccaagccca

SEQ ID NO: 263585 - RNA, 64 nt, Homo Sapiens
caggugauccaccugccucagccucccagacuguugggauuacaggcaugagccaccacgccug

SEQ ID NO: 263586 - RNA, 64 nt, Homo Sapiens
aaggcucaggugacacuauggcuagauuaacaucugggauuaggacuggaaacacaugucauuu

SEQ ID NO: 263587 - RNA, 64 nt, Homo Sapiens
uuaaacaugagcugagcauccauaagcauugaauugggauuaaauaaagauguugggcaggaac

SEQ ID NO: 263588 - RNA, 64 nt, Homo Sapiens
gguguaagccaucacaccuggccucccaaagugcugggauuacacaggugauccgcccgccucu

SEQ ID NO: 263589 - RNA, 64 nt, Homo Sapiens
ggcacaugcaccacgcccgggccucuugaguagcugggauuacacaagugauucuccugccuca

SEQ ID NO: 263590 - RNA, 64 nt, Homo Sapiens
ggugucagccaccgcacccagccucccaaagugcugggauuacacaagugaucugccugccuug

SEQ ID NO: 263591 - RNA, 64 nt, Homo Sapiens
ggcgucugccaccacgcccggccuccugaguagcugggauuauacaagcgacucuccugccuca

SEQ ID NO: 263592 - RNA, 64 nt, Homo Sapiens
ggcaugagcuaccacaccuggccucccaaagugcugggauuacacaggugauccacccaccucu

SEQ ID NO: 263593 - RNA, 64 nt, Homo Sapiens
ggcucaugccaccaugcccagccuccccaguagcugggauuacacaagagauucuccugccuca

SEQ ID NO: 263594 - RNA, 64 nt, Homo Sapiens
gaaagucaggauaaaaauuuuaugaaaaaaguuaugggauuaaagucucaaaaaaaaaaaaaau

SEQ ID NO: 263595 - RNA, 64 nt, Homo Sapiens
aaaaguuaugggauaaaaaaaaaauuaaaaguuaugggauuaaagcuggccacuaaauuaaaaa

SEQ ID NO: 263596 - RNA, 64 nt, Homo Sapiens
ggcgugagccaccgcgcccagccucccaaagugcugggauuacacucgugaucugcccgccucg

SEQ ID NO: 263597 - RNA, 64 nt, Homo Sapiens
gacaugagccacugugcccggccuuucaaagugcugggauuacacaggugauucgccugccucg

SEQ ID NO: 263598 - RNA, 64 nt, Homo Sapiens
caagcgauucuucugccucagccucccgaguagcugggauuaccggcacccaccaccacgccug

SEQ ID NO: 263599 - RNA, 64 nt, Homo Sapiens
auacccgcccccccgccucagccucccaaagugcugggauuacaggcgugagccaccgugccug

SEQ ID NO: 263600 - RNA, 64 nt, Homo Sapiens
caagcaauucuccugccucagccucccaaguagcugggauuacaggcacccgccaccacaccca

SEQ ID NO: 263601 - RNA, 64 nt, Homo Sapiens
caggugauccaccugccucagccucccaaauugcugggauuacaggcgugagccaccuugccca

SEQ ID NO: 263602 - RNA, 64 nt, Homo Sapiens
caagagauccccccaaccuuggccuccaaagugcugggauuacaggcaugagccaccgcgccug

SEQ ID NO: 263603 - RNA, 64 nt, Homo Sapiens
caagccauccucccgcuuuggccuccuaaagugcugggauuacaugagccaccacaugcagcca

SEQ ID NO: 263604 - RNA, 64 nt, Homo Sapiens
cucauauuccacccgccucggccucccaaagugcugggauuacaggcguuagccacugcgcccg

SEQ ID NO: 263605 - RNA, 64 nt, Homo Sapiens
caagcaauuauccugccucagccucccgaguaggugggauuauaggagcgugccaccaugcccg

SEQ ID NO: 263606 - RNA, 64 nt, Homo Sapiens
uaggugaucagcccgccucggccucccagagugcugggauuacaggcgugagccacuguggcca

SEQ ID NO: 263607 - RNA, 64 nt, Homo Sapiens
caagcgauucuccugccucagccucucaaguagcugggauuacagggcaccugccaccacgccu

SEQ ID NO: 263608 - RNA, 64 nt, Homo Sapiens
caggugauccgcccgccucagccucugaaauugcugggauuacaggcaugagccaccacaccca

SEQ ID NO: 263609 - RNA, 64 nt, Homo Sapiens
caagcgauucuccagccucagccucccgaguagcugggauuacagacacccgccaccacgcccg

SEQ ID NO: 263610 - RNA, 64 nt, Homo Sapiens
ccugugauccgcccgccucggccucccaaagugcugggauuacaggcaugagccacugcacccg

SEQ ID NO: 263611 - RNA, 64 nt, Homo Sapiens
ggugugauccaccaugcccggccucccaaagugcugggauuaaacaggugauccgccugucucg

SEQ ID NO: 263612 - RNA, 64 nt, Homo Sapiens
ggcgcgugccaccauguccggccuccugaguagcugggauuacgcaaacgauucugcugccuca

SEQ ID NO: 263613 - RNA, 64 nt, Homo Sapiens
ggcgugagccaccacgcccggccucccaaagugcugggauuacacucaugaucuacccgccucg

SEQ ID NO: 263614 - RNA, 64 nt, Homo Sapiens
ggcaugagucaccgcacccagccucccaaagugcugggauuacacaggugauccaccugccuca

SEQ ID NO: 263615 - RNA, 64 nt, Homo Sapiens
ggcgcccgccaccaugccuggccucccaaguagcugggauuacucaagcgauucuccugccuca

SEQ ID NO: 263616 - RNA, 64 nt, Homo Sapiens
ggcaugagccaccaugcccagccucccaaaguucugggauuacacaggugaucugccugccuca

SEQ ID NO: 263617 - RNA, 64 nt, Homo Sapiens
ggugcacaccaccacaccuggccucccuaguagcugggauuacacaagugguucuccugccuca

SEQ ID NO: 263618 - RNA, 64 nt, Homo Sapiens
caagcgaaccuccugccucagcaucccaaguagcugggauuacaggcacccaccaccaugccca

SEQ ID NO: 263619 - RNA, 64 nt, Homo Sapiens
caagugauccacccgccucggucucccaaagugcugggauuacagaugugagccgccgcgccca

SEQ ID NO: 263620 - RNA, 64 nt, Homo Sapiens
aggauucacaacuaaucacuauagcacaugaccuugggauuacauuuuuauggggcagggguaa

SEQ ID NO: 263621 - RNA, 64 nt, Homo Sapiens
auugaugauuggucagugaggucaaaaggagccuugggauuaauaaacaugcacugagaagcaa

SEQ ID NO: 263622 - RNA, 64 nt, Homo Sapiens
caagcgauucuuaugccucagucuccugagcagcugggauuacaggcaaacgccaccacaccca

SEQ ID NO: 263623 - RNA, 64 nt, Homo Sapiens
cucgugauccaccugccucggccuuccaaagugcugggauuacaaguuugagccacugcaccug

SEQ ID NO: 263624 - RNA, 64 nt, Homo Sapiens
caggugauccaccugccucagccucccaaagugcugggauuacaggcgugagccacugugccca

SEQ ID NO: 263625 - RNA, 64 nt, Homo Sapiens
caagcaauucuccugccucagccucccgaguagcugggauuacaggcgaccgccaccacgccug

SEQ ID NO: 263626 - RNA, 64 nt, Homo Sapiens
caagggauucuccugccucagccucuugaguagcugggauuacaggcgcccaccaccacagccu

SEQ ID NO: 263627 - RNA, 64 nt, Homo Sapiens
gaagugauccgcccaccuuggccucccaaagcguugggauuauaggcaugagccaugugccugg

SEQ ID NO: 263628 - RNA, 64 nt, Homo Sapiens
caagcgauucuccugccucagccuccugaguagcugggauuacaggugcaugccaccaggcccc

SEQ ID NO: 263629 - RNA, 64 nt, Homo Sapiens
cucaugaucugcccgccucaaccucccaaagugcugggauuauaggcgugagccaccgccccca

SEQ ID NO: 263630 - RNA, 64 nt, Homo Sapiens
gagagugugacagaggaucugccugugaaccaccugggauuagucaagucccaaggugcccaga

SEQ ID NO: 263631 - RNA, 64 nt, Homo Sapiens
uuuagucauaagccaaguacaaucuaacucagaaugggauuaaaaauuuuagaagcagaagcua

SEQ ID NO: 263632 - RNA, 64 nt, Homo Sapiens
ggcgugagccacggcgcccagccucccaaagugcugggauuacacaggugauccacccgccucg

SEQ ID NO: 263633 - RNA, 64 nt, Homo Sapiens
ggugcccaccaccaccccuggccucccaaguagcugggauuacacaagcaauucuccugccuca

SEQ ID NO: 263634 - RNA, 64 nt, Homo Sapiens
ggcgugagccaccgcgccuggccucccaaagugcugggauuacacuugugauccguccgccuug

SEQ ID NO: 263635 - RNA, 64 nt, Homo Sapiens
ggcgcaggccaccaugcccggccucccaaguagcugggauuacagaucaagcaauucugacuca

SEQ ID NO: 263636 - RNA, 64 nt, Homo Sapiens
ggccugagccaccgcgcccggccucccaaaguacugggauuacacaggugaucuacccuccucg

SEQ ID NO: 263637 - RNA, 64 nt, Homo Sapiens
ggugcccaccaacaugccuggccuccuggguagcugggauuacacaagcgauucuccucucuca

SEQ ID NO: 263638 - RNA, 64 nt, Homo Sapiens
ggcauaagccacugugcccagucucucaaagugcugggauuacacagguacuccacccgccuug

SEQ ID NO: 263639 - RNA, 64 nt, Homo Sapiens
ggcgcccaccaccaugcccggcauccuaauuaguugggauuacacaagcgauucuccugccuca

SEQ ID NO: 263640 - RNA, 64 nt, Homo Sapiens
ggcgugagccaccaugcccagccuuaaaaagugcugggauuaaacaggugaucugcccaccuug

SEQ ID NO: 263641 - RNA, 64 nt, Homo Sapiens
ggaacgcgccaccacgcccagccucuugaguagcugggauuacacaagcgauucucuuaacuca

SEQ ID NO: 263642 - RNA, 64 nt, Homo Sapiens
ggcuugagccaccgugccuggccucccaaagugcugggauuacacucgugauccacccgccuca

SEQ ID NO: 263643 - RNA, 64 nt, Homo Sapiens
ggcaugagccaccgcgcccaaccucccgcagugcugggauuacacucgugauccgcccaucucc

SEQ ID NO: 263644 - RNA, 64 nt, Homo Sapiens
ggcuugagccaccgugccagaccucccaaagugcugggauuacacaagugaucugccugccccg

SEQ ID NO: 263645 - RNA, 64 nt, Homo Sapiens
aaagcauguggccccacgcccaaguguuaguagcugggauuacauaaccucugccuccuggauu

SEQ ID NO: 263646 - RNA, 64 nt, Homo Sapiens
ggccugagcaacugugccuggccucucaaagugcugggauuacacaagcaaucugccagccuca

SEQ ID NO: 263647 - RNA, 64 nt, Homo Sapiens
ggugugcaccaccacgccuggccucuccaguagcugggauuacacaagcaauucucaugccucg

SEQ ID NO: 263648 - RNA, 64 nt, Homo Sapiens
cuugugaucugcccgccucagccucccaaaguacugggauuauaggcaugagccaccacgccca

SEQ ID NO: 263649 - RNA, 64 nt, Homo Sapiens
cucgugaaucgccccccucggucucccaaagugcugggauuacaggcgugagccaccaugcccg

SEQ ID NO: 263650 - RNA, 64 nt, Homo Sapiens
caagggauucuccugccucagccucccaaguagcugggauuacaggcgccugccaccacgccca

SEQ ID NO: 263651 - RNA, 64 nt, Homo Sapiens
gaggcgaucugcccaccucggccucccaaagugcugggauuacaggcgugagccaccgugcccg

SEQ ID NO: 263652 - RNA, 64 nt, Homo Sapiens
caagcgauccuccugccucagucucccaaguagcugggauuacaggugugcaccaccacgccug

SEQ ID NO: 263653 - RNA, 64 nt, Homo Sapiens
caggugauccacccgcguuggccucccaacgugcugggauuauaggcgugagccaccacgcccc

SEQ ID NO: 263654 - RNA, 64 nt, Homo Sapiens
cacgccauucuccugccucagccucccgaguagcugggauuacgggcgcccgccaccacgcccg

SEQ ID NO: 263655 - RNA, 64 nt, Homo Sapiens
cuugugauccacccaccucggccucccaaagugcugggauuacaggcgugagccacugcgcccg

SEQ ID NO: 263656 - RNA, 64 nt, Homo Sapiens
caagcgauucuccugccucagccucccgaguaguugggauuacaggcgccugccuccaugccug

SEQ ID NO: 263657 - RNA, 64 nt, Homo Sapiens
cucgugauccgccugccucgaccucccaaagugcugggauuacaggcaugagccaccaugccca

SEQ ID NO: 263658 - RNA, 64 nt, Homo Sapiens
aaccuccaucuccugucucagccuccuagauaacugggauuacaggugcccaccaccaugcccg

SEQ ID NO: 263659 - RNA, 64 nt, Homo Sapiens
cagguaauccacccaccuuggccucccaaagugcugggauuacaggcaugagccaccaucuuca

SEQ ID NO: 263660 - RNA, 64 nt, Homo Sapiens
guucaagcgauucugccucgaccucucaaguagcugggauuacaagcaccagccaccaugccug

SEQ ID NO: 263661 - RNA, 64 nt, Homo Sapiens
caggugauccacccgccuuggccucccaaagugcugggauuacaggcgcgagccaccgcgccca

SEQ ID NO: 263662 - RNA, 64 nt, Homo Sapiens
caagcaauucuccugccucagccuccugaguagcugggauuacaggcguccgcuaccacaacug

SEQ ID NO: 263663 - RNA, 64 nt, Homo Sapiens
ucaaaugauugccugccucagccucccaaagugcugggauuacagguguaagucacuguaccca

SEQ ID NO: 263664 - RNA, 64 nt, Homo Sapiens
caggugauucuccugucucagccucccgaguaacugggauuacaggcaugcgccaccgugacca

SEQ ID NO: 263665 - RNA, 64 nt, Homo Sapiens
caagugauccaccugccucggccucccuaagugcugggauuacaggcgugagccaccaugccug

SEQ ID NO: 263666 - RNA, 64 nt, Homo Sapiens
ggcgugagccacugcacccaggccucccaagugcugggauuacaucaagugaucugccugccuc

SEQ ID NO: 263667 - RNA, 64 nt, Homo Sapiens
gucaggcaccaccacacccggccucccaaguagcugggauuacacaagcaauucuccugccuca

SEQ ID NO: 263668 - RNA, 64 nt, Homo Sapiens
gaugugagccaccacaccuggccucccaaagugcugggauuacauaagugaucugcccgccuug

SEQ ID NO: 263669 - RNA, 64 nt, Homo Sapiens
ggcaugagccaccacagcuggccucccaaagugcugggauuacacuagugauccacccuccucg

SEQ ID NO: 263670 - RNA, 64 nt, Homo Sapiens
ggcaugugccaccacaccuggccuccuaaguaucugggauuacacaagcgauucuccugccuca

SEQ ID NO: 263671 - RNA, 64 nt, Homo Sapiens
ggcgugagccacuguucccagccucccagagugcugggauuacacaagugaucuguccaccucg

SEQ ID NO: 263672 - RNA, 64 nt, Homo Sapiens
gaucugcaccaccaugcccagccuccccaguagcugggauuacacaagugacucuccugccuca

SEQ ID NO: 263673 - RNA, 64 nt, Homo Sapiens
ggcaugagccacugugcuuggccucccaaagugcugggauuauacaagugauccucacgccuug

SEQ ID NO: 263674 - RNA, 64 nt, Homo Sapiens
ggugugagccaccgugcccggccucccaaagugcugggauuacgcaggugauccaccuuucucg

SEQ ID NO: 263675 - RNA, 64 nt, Homo Sapiens
ggcaugagccaccacgcuuggccucccagagugcugggauuacacuugugauccacccaccucg

SEQ ID NO: 263676 - RNA, 64 nt, Homo Sapiens
ggcacgcaccaccacgcccagccuccugaguagcugggauuauacaagcgauucuccugccucc

SEQ ID NO: 263677 - RNA, 64 nt, Homo Sapiens
ggcgugagucaccgggcagggccucccaaagugcugggauuacacuugugauccacccaccuca

SEQ ID NO: 263678 - RNA, 64 nt, Homo Sapiens
ggcaugggccaccacacccagccucccgaguagcugggauuacacaagcaauucuccugccuca

SEQ ID NO: 263679 - RNA, 64 nt, Homo Sapiens
caagcaauucuccuaccucagcuucccgaguagcugggauuauaggcacccaccaccacaccug

SEQ ID NO: 263680 - RNA, 64 nt, Homo Sapiens
caagugaucugcccaucucagccucccaaagugcugggauuacagguaugagccacaacgccca

SEQ ID NO: 263681 - RNA, 64 nt, Homo Sapiens
caagugauuauccugccuuagccuccugaguagcugggauuacaggcgcgugccaccacgccca

SEQ ID NO: 263682 - RNA, 64 nt, Homo Sapiens
cucgugauccgccugccucggccucccaaagugcugggauuacaggugugagccaccgugccca

SEQ ID NO: 263683 - RNA, 64 nt, Homo Sapiens
ggcgugagccaccgcccccagccucccaaagugcugggauuacacaagcaaucugccugucuca

SEQ ID NO: 263684 - RNA, 64 nt, Homo Sapiens
ggugccugcccccauggcuagccucccacguggcugggauuacacaggcaacacuccugccuca

SEQ ID NO: 263685 - RNA, 64 nt, Homo Sapiens
ggugugauccaccgcaccuggccucccaaagugcugggauuacacagaugauccgcccacauug

SEQ ID NO: 263686 - RNA, 64 nt, Homo Sapiens
guugccgccacacccggcuugccuccugaguagcugggauuacacaagccauucuccugccucg

SEQ ID NO: 263687 - RNA, 64 nt, Homo Sapiens
ggugcgcaccaccaugccuggccucccaaguagcugggauuacacaagcaauucuccugucuca

SEQ ID NO: 263688 - RNA, 64 nt, Homo Sapiens
ggcgugagccaucgcgcccuuccucccaaagugcugggauuauaucaaaugauccgcugucuug

SEQ ID NO: 263689 - RNA, 64 nt, Homo Sapiens
ggugcccaccaccaugccuggccucccaaguagcugggauuacacaagcgauuuuccugccuca

SEQ ID NO: 263690 - RNA, 64 nt, Homo Sapiens
ggcuugagcuaccgcgcccggccugccaaagugcugggauuacacuggugaucugcccaccucg

SEQ ID NO: 263691 - RNA, 64 nt, Homo Sapiens
ggcaugcaccaccacgcccagccucccgaguggcugggauuagccaaguaauucuccugccuca

SEQ ID NO: 263692 - RNA, 64 nt, Homo Sapiens
caagcaauucuccugccucagccuucggaguggcugggauuacaggugugcgccaccaugcccg

SEQ ID NO: 263693 - RNA, 64 nt, Homo Sapiens
caggugaucugcccacuuuggccucccaaagugcugggauuacaggcaugagccaucgcccagc

SEQ ID NO: 263694 - RNA, 64 nt, Homo Sapiens
cagaugaucugcccgccucagccucccaaagugcugggauuacaggcaugagccaccacgccca

SEQ ID NO: 263695 - RNA, 64 nt, Homo Sapiens
caagcgcuucuccagccucagccuccugaguagcugggauuacagguaugugccaccaugccug

SEQ ID NO: 263696 - RNA, 64 nt, Homo Sapiens
cagguaauccgcccgccucggccucccaaaaugcugggauuagaggugugagccacugugccca

SEQ ID NO: 263697 - RNA, 64 nt, Homo Sapiens
caagcgauccacccaccuaggccucccaaagugcugggauuacaggcaugaaucaccacaacua

SEQ ID NO: 263698 - RNA, 64 nt, Homo Sapiens
caagcgauucuccugccucagcaucucgaguagcugggauuacaggcaugcaccaccacgccca

SEQ ID NO: 263699 - RNA, 64 nt, Homo Sapiens
caggugauccgcccgccugggccucccaaagugcugggauuacaggcgugagccacugcuccug

SEQ ID NO: 263700 - RNA, 64 nt, Homo Sapiens
uaagugauucuccugccucagccucccaaguagcugggauuacaggugugcaccaccaugcccg

SEQ ID NO: 263701 - RNA, 64 nt, Homo Sapiens
cucgugauccgccugccucagccucccaaagugcugggauuacaggugugagccaccacgccug

SEQ ID NO: 263702 - RNA, 64 nt, Homo Sapiens
caagcaauucucccaccucagccucccaaguagcugggauuacagacgugugccaccauaccug

SEQ ID NO: 263703 - RNA, 64 nt, Homo Sapiens
caggugauccuccugccucggccucccaaagugcugggauuacaggcaugagccaccgugcuca

SEQ ID NO: 263704 - RNA, 64 nt, Homo Sapiens
ucaagcaauucuccugccuugccuccugaguagcugggauuacaggcgugugucaccacgcucg

SEQ ID NO: 263705 - RNA, 64 nt, Homo Sapiens
gucgugauccacccgccuuggccucccaaaguacugggauuacaggcgugagccacugugccug

SEQ ID NO: 263706 - RNA, 64 nt, Homo Sapiens
caagcaauucuccugccucagccucucgaguagcugggauuacaggcauccgccaccaugcccg

SEQ ID NO: 263707 - RNA, 64 nt, Homo Sapiens
caggugauccacccgccucggcuucccaaagugcugggauuacgggcgugagccaccgugcucg

SEQ ID NO: 263708 - RNA, 64 nt, Homo Sapiens
caagcaauccucccacuucagccucccaagcaccugggauuacaagcaugagucacuacgccug

SEQ ID NO: 263709 - RNA, 64 nt, Homo Sapiens
caaguuauccaccugccuuggcuucccaaaguccugggauuacaggugugagccaccacaucca

SEQ ID NO: 263710 - RNA, 64 nt, Homo Sapiens
cucgugauccacccgccucagccucccaaagugcugggauuaacagguaugaaccaccgcgccc

SEQ ID NO: 263711 - RNA, 64 nt, Homo Sapiens
ggcaugagccaccgcacccggccucccaaagugcugggauuacacuugugacucacccgcaucg

SEQ ID NO: 263712 - RNA, 64 nt, Homo Sapiens
ggugccugccaucacgccuggccuccugaguagcugggauuacaccagcgauucuccugccuca

SEQ ID NO: 263713 - RNA, 64 nt, Homo Sapiens
ggcgcgagccaccacacccggccucccaaaauccugggauuacacucgugauccacccgccucg

SEQ ID NO: 263714 - RNA, 64 nt, Homo Sapiens
ggcacaugccaccacgcccggccuccugaguagcugggauuacacaaacaauucuccugccuca

SEQ ID NO: 263715 - RNA, 64 nt, Homo Sapiens
ggcaugugccaccaugcccggccucccaaagugcugggauuauacaggugauccacucgccucg

SEQ ID NO: 263716 - RNA, 64 nt, Homo Sapiens
ggcguccgccaccaugcccagccucccaaguagcugggauuacacaagcaguucuccugccuca

SEQ ID NO: 263717 - RNA, 64 nt, Homo Sapiens
ggcaugagccaccacggcccgccucccaaagugcugggauuacacuugugauccgcaugccuca

SEQ ID NO: 263718 - RNA, 64 nt, Homo Sapiens
ggugugugccaccacgccuggccuccugaguagcugggauuacacaagcuguucuacugccuca

SEQ ID NO: 263719 - RNA, 64 nt, Homo Sapiens
ucccggauacuccugccucagccuccuggguagcugggauuacaagcacccaaccacgcccagc

SEQ ID NO: 263720 - RNA, 64 nt, Homo Sapiens
caagugauccgcccacuucggucucccaaagugcugggauuacaggcaugagccacggcgccug

SEQ ID NO: 263721 - RNA, 64 nt, Homo Sapiens
caggugauccacccaccucagccucccaaagugcugggauuacaagcgugagccacugcaccgg

SEQ ID NO: 263722 - RNA, 64 nt, Homo Sapiens
caagugauucuccugccucagccucccaaagugcugggauuacaggugugaaccaccacaccca

SEQ ID NO: 263723 - RNA, 64 nt, Homo Sapiens
caagcaauucuccugccucaggcuccugaguagcugggauuacaggcacgugacaccaggccca

SEQ ID NO: 263724 - RNA, 64 nt, Homo Sapiens
cgcauaauccacccaccucggccucccaaagugcugggauuacaggcgugagccaccacaaccg

SEQ ID NO: 263725 - RNA, 64 nt, Homo Sapiens
caaacgauccuacugccucauccuucggaguagcugggauuacaggcaggugccaccaugccug

SEQ ID NO: 263726 - RNA, 64 nt, Homo Sapiens
ucuuuucaaguacugcuggaucauacucaccccuugggauuauggcuuagaagaagggggcugg

SEQ ID NO: 263727 - RNA, 64 nt, Homo Sapiens
caagugagucucgugccucagccucccaaguagcugggauuacaggcacccgccaccgugcccg

SEQ ID NO: 263728 - RNA, 64 nt, Homo Sapiens
caggugcuccaccugccuuggccucccaaagugcugggauuacaggcgugagccacugugccca

SEQ ID NO: 263729 - RNA, 64 nt, Homo Sapiens
caagcaauccucccaccucagccuccuaaagcacugggauuacaggugugaaccaccguaccca

SEQ ID NO: 263730 - RNA, 64 nt, Homo Sapiens
cgagcacuuuucaugccucagccuccugaguagcugggauuacaggcgugcaccacaacgccug

SEQ ID NO: 263731 - RNA, 64 nt, Homo Sapiens
caggugauccaccugccucggccucccagagugcugggauuacaggcaugagccacugcaccug

SEQ ID NO: 263732 - RNA, 64 nt, Homo Sapiens
caagugauucuccugccucagccucccaaguagcugggauuacuggugcacaccaccacacuca

SEQ ID NO: 263733 - RNA, 64 nt, Homo Sapiens
uaagugagccucccgccucagucucccaaagcgcugggauuacaggcaggagccacugagccca

SEQ ID NO: 263734 - RNA, 64 nt, Homo Sapiens
caagugauucucuugccucagccuccugaguagcugggauuacagguuccugcuaccacgccca

SEQ ID NO: 263735 - RNA, 64 nt, Homo Sapiens
cagguaauccgcccaccucagccucccaaagugcugggauuacaggcgugagccacagugccug

SEQ ID NO: 263736 - RNA, 64 nt, Homo Sapiens
caagcgauucucccaccccagccucccaaguagcugggauuacaggugugugccacuacggcug

SEQ ID NO: 263737 - RNA, 64 nt, Homo Sapiens
caagcgauccuccuggcucagccucccaaagugcugggauuacaggcgugagucacugcgccug

SEQ ID NO: 263738 - RNA, 64 nt, Homo Sapiens
ggcgcccgccaccaugcccggccuccgaaguagcugggauuacacaagagauucuccugccuca

SEQ ID NO: 263739 - RNA, 64 nt, Homo Sapiens
ggcaugagccacugugcccggccucccaaagugcugggauuacacaggugauccacccgccuca

SEQ ID NO: 263740 - RNA, 64 nt, Homo Sapiens
ggugcgugccaccacaccaggccuccugagcagcugggauuacacaagcgauucuccugccuca

SEQ ID NO: 263741 - RNA, 64 nt, Homo Sapiens
gaagugauucucuugccucagccucccgaguagcugggauuacaggugcccaccaccgcgccca

SEQ ID NO: 263742 - RNA, 64 nt, Homo Sapiens
caagugaucugcccaccuuggccucccuaagugcugggauuauaggcgugagccaccaugcuca

SEQ ID NO: 263743 - RNA, 64 nt, Homo Sapiens
cuugugauccacccaccucagccucccaaagugcugggauuacaggcaugagccaccacaccca

SEQ ID NO: 263744 - RNA, 64 nt, Homo Sapiens
aaagugaucugcccgccuuggccucccaaagugcugggauuacagacaugagccaccacgcuug

SEQ ID NO: 263745 - RNA, 64 nt, Homo Sapiens
caagcgauucucaugccuuagccucccaaguagcugggauuacaggugugugccgcaaugccca

SEQ ID NO: 263746 - RNA, 64 nt, Homo Sapiens
cacgugaucuguccacuucagccguccaaagugcugggauuacaagcgugagccacugugcugg

SEQ ID NO: 263747 - RNA, 64 nt, Homo Sapiens
ggugugagccaccgcacccagccucccaaagugcugggauuacacaagugaucugcccgccucg

SEQ ID NO: 263748 - RNA, 64 nt, Homo Sapiens
gaugcccgccaccacacccagccuccugaguaggugggauuacacaagcgauucucucaccuca

SEQ ID NO: 263749 - RNA, 64 nt, Homo Sapiens
ggcgugagccgccgugcccggccucccaaagugcugggauuacacaggugauccacccgccucg

SEQ ID NO: 263750 - RNA, 64 nt, Homo Sapiens
ggcacccgccaccguaccuggccucccgaguagcugggauuacacaagugauucuccugccuca

SEQ ID NO: 263751 - RNA, 64 nt, Homo Sapiens
ggugugagccgcugcgcucggccucccaaagugcugggauuacacaggugaucugcccgccuug

SEQ ID NO: 263752 - RNA, 64 nt, Homo Sapiens
ggugugagccuccacaccuggccucccaaagugcugggauuacacaggugauccgcccaccucg

SEQ ID NO: 263753 - RNA, 64 nt, Homo Sapiens
ggcacgugccaccaugucuggcuucccaaguagcugggauuacaccagcaauucuccugccucg

SEQ ID NO: 263754 - RNA, 64 nt, Homo Sapiens
ugcgugagccacugcgcccugccucccaaagugcugggauuacacucgugaugcacccaccucg

SEQ ID NO: 263755 - RNA, 64 nt, Homo Sapiens
ggugccugccaccacacccagccucccgaguagcugggauuacacaagcaauucuccugccuca

SEQ ID NO: 263756 - RNA, 64 nt, Homo Sapiens
ggcgcaagccacccagcccagccucccaaagugcugggauuacacagguaauccaccugcuucg

SEQ ID NO: 263757 - RNA, 64 nt, Homo Sapiens
ggcaugugcaacucacccagggcucccaaguagcugggauuacacaagcaauuauccugccuca

SEQ ID NO: 263758 - RNA, 64 nt, Homo Sapiens
ggcaugcaccaccauacccagccucccuaguagcugggauuacacaagugauucuccugccuca

SEQ ID NO: 263759 - RNA, 64 nt, Homo Sapiens
cgcgugagccaccaugcccggccucccaaagugcugggauuacacaggugauccgcccaccuug

SEQ ID NO: 263760 - RNA, 64 nt, Homo Sapiens
caagugauucucauggcucagccgccugaguagcugggauuacaggugugagccaacaagcccg

SEQ ID NO: 263761 - RNA, 64 nt, Homo Sapiens
uccugaauccgccugccucggccucccaaagugcugggauuacaggugugagcugccgcaccca

SEQ ID NO: 263762 - RNA, 64 nt, Homo Sapiens
caagcgauucuugugccuaagccaccugagcagcugggauuacaggugcaugccaccaugccug

SEQ ID NO: 263763 - RNA, 64 nt, Homo Sapiens
gaaacaauccucccgccuuggccucccaaagugcugggauuauaggcacaagacaccacaauaa

SEQ ID NO: 263764 - RNA, 64 nt, Homo Sapiens
uggggguauuauaauaccaaauuuucucaagaaaugggauuagucuuccuaaaaggaagacuuc

SEQ ID NO: 263765 - RNA, 64 nt, Homo Sapiens
agacacgugaaaugauacuucaaaaagccgucuaugggauuaaaaacauaauuaaucccuuuaa

SEQ ID NO: 263766 - RNA, 64 nt, Homo Sapiens
ggcgugagccacugcgcccggccucccaaagugcugggauuacacaggugauccaccugccucg

SEQ ID NO: 263767 - RNA, 64 nt, Homo Sapiens
ggcacccaccaccacaccuggccuccugaguagcugggauuacacaagugauucuccugccuca

SEQ ID NO: 263768 - RNA, 64 nt, Homo Sapiens
ggcaugagccaccacaccuggccucccaaaaugcugggauuacacuggugaucugcccaccugg

SEQ ID NO: 263769 - RNA, 64 nt, Homo Sapiens
ggugcacgccaccaugcuuggccuccugaauagcugggauuacacaagugauucuccuacguca

SEQ ID NO: 263770 - RNA, 64 nt, Homo Sapiens
caagugauuguccugucucagccucccaaguagcugggauuacaggcacccaccaccacaucca

SEQ ID NO: 263771 - RNA, 64 nt, Homo Sapiens
caggugauccacccgccucggccucccaaagugcugggauuacaggcccgguccaguuugauag

SEQ ID NO: 263772 - RNA, 64 nt, Homo Sapiens
caagugauccucccaccucagccuccugaguagcugggauuacaggcacccgccaccacgucca

SEQ ID NO: 263773 - RNA, 64 nt, Homo Sapiens
caggugauccgcuggccucggccucccagagugcugggauuauaggcgugagccucuggcccgg

SEQ ID NO: 263774 - RNA, 64 nt, Homo Sapiens
caagcaacucuccugccucagccucccuaguagcugggauuacaggcaugcacuaccacgcuug

SEQ ID NO: 263775 - RNA, 64 nt, Homo Sapiens
caagugauucacccaccuuagccucccaaagugcugggauuacaggcgugagucaccgugccca

SEQ ID NO: 263776 - RNA, 64 nt, Homo Sapiens
ucaagagauucuccagucucagcucccaaguagcugggauuacaggcauguacuaccaugccug

SEQ ID NO: 263777 - RNA, 64 nt, Homo Sapiens
aaagugauucucucagcucagucucccagguagcugggauuacaggcaugugccaccacacccc

SEQ ID NO: 263778 - RNA, 64 nt, Homo Sapiens
gaucuguccgccccggccucccagagugcuggguugggauuacaggcgugagccaccgcguccg

SEQ ID NO: 263779 - RNA, 64 nt, Homo Sapiens
gugacccgauaggaggcaaaagaaaugagacuucugggauuaguuuagccucagauucugcagc

SEQ ID NO: 263780 - RNA, 64 nt, Homo Sapiens
cucaugauccgccuuccucggccucccaaagugcugggauuacagguguuagccacugcgcccg

SEQ ID NO: 263781 - RNA, 64 nt, Homo Sapiens
caagugauauguucaccucagccucccaaagugcugggauuacaggcaugaaccauggugccca

SEQ ID NO: 263782 - RNA, 64 nt, Homo Sapiens
caagcaauucuccugccucagccucccaaguagcugggauuacaggcguguaccaccauaccca

SEQ ID NO: 263783 - RNA, 64 nt, Homo Sapiens
auuaaaguguuuauguuaagaagauugggccaggugggauuacaggcgcgagccaccgcgcccg

SEQ ID NO: 263784 - RNA, 64 nt, Homo Sapiens
caagcgauucuccugccucagcuucccgaguagcugggauuacagguaugaaccacuaugcccg

SEQ ID NO: 263785 - RNA, 64 nt, Homo Sapiens
ggcgugagccacugugcccggccucccaaagugcugggauuacacuugugauccaccagccuca

SEQ ID NO: 263786 - RNA, 64 nt, Homo Sapiens
ggcaugagcuacugcacccggccuccaaaagugcugggauuacacaggugauccgccuaccuug

SEQ ID NO: 263787 - RNA, 64 nt, Homo Sapiens
ggugugcgccaccacgcccagccucccaaguagcugggauuacacaagugauucuccugcuuca

SEQ ID NO: 263788 - RNA, 64 nt, Homo Sapiens
ggccugagccaccgcgcccauccucccaaagugcugggauuacacucgugauucgcccgccgcg

SEQ ID NO: 263789 - RNA, 64 nt, Homo Sapiens
ggugugagccaccgcgccugccucccaaaauugcugggauuacaagaugaucugcccgccucgg

SEQ ID NO: 263790 - RNA, 64 nt, Homo Sapiens
ggccugagccaccguaucuggccucccaaagugcugggauuacauuggugauccaccugccuug

SEQ ID NO: 263791 - RNA, 64 nt, Homo Sapiens
ggcaugcaccacaaaccuuaucacccucaguagcugggauuauuguuccagugauucuccugcc

SEQ ID NO: 263792 - RNA, 64 nt, Homo Sapiens
ggugugagucaccgcgccuggccucccaaagugcugggauuacauuugugaucugcccgccuug

SEQ ID NO: 263793 - RNA, 64 nt, Homo Sapiens
ggcaugcgccaccacacccagccuccaaaguagcugggauuacacaagcgauucuccugccuca

SEQ ID NO: 263794 - RNA, 64 nt, Homo Sapiens
ggcgugagccacucugccugucuccccaaagugcugggauuacauugugauccacccaccucgg

SEQ ID NO: 263795 - RNA, 64 nt, Homo Sapiens
ggcgugagccaccgcgcccggccucccaaagugcugggauuauacucgugauccgcccuccucg

SEQ ID NO: 263796 - RNA, 64 nt, Homo Sapiens
ggcgugagccaccacacccggccucccaaagugcugggauuacacagguaauccaccugccuug

SEQ ID NO: 263797 - RNA, 64 nt, Homo Sapiens
agugcccaccaccaugcccagccuuccaaguagcugggauuacacaagcaauucuucugccuca

SEQ ID NO: 263798 - RNA, 64 nt, Homo Sapiens
ggugugagccacagcacccagccucccaaagugcugggauuacacaggugaucugccugccucg

SEQ ID NO: 263799 - RNA, 64 nt, Homo Sapiens
ggcaugcgccaccacgccuggccucccaagaagcugggauuacacaagcaauucuccugccgca

SEQ ID NO: 263800 - RNA, 64 nt, Homo Sapiens
ggugugagccacuguggccggccucucaaagugcugggauuacacaggugauccacccaccuca

SEQ ID NO: 263801 - RNA, 64 nt, Homo Sapiens
ggcgugagccaccaugcccagccucccaaaguguugggauuauacaagugauccaccugccuug

SEQ ID NO: 263802 - RNA, 64 nt, Homo Sapiens
ggcguggccacugcgcccaggccuccugaagugcugggauuacacaagcgaucugcccgccucg

SEQ ID NO: 263803 - RNA, 64 nt, Homo Sapiens
gcacccgccaccaugccgaggccuccugaguagcugggauuacacaagugauucuccugccuca

SEQ ID NO: 263804 - RNA, 64 nt, Homo Sapiens
ggcaccugccaccacaucuggccucccaaguagcugggauuacacaagcaauuauccugccuca

SEQ ID NO: 263805 - RNA, 64 nt, Homo Sapiens
ggcaugagccaccgugcccagcuucccaaaguucugggauuacauaaaugauuugccugccucg

SEQ ID NO: 263806 - RNA, 64 nt, Homo Sapiens
ggcacccaccaccaugcccagccuccuaaguagcugggauuacacacgcaauucuccugccuca

SEQ ID NO: 263807 - RNA, 64 nt, Homo Sapiens
ggcgugagccaccgugcccggccucccgaagugcugggauuacacaggugauccgcccaccuug

SEQ ID NO: 263808 - RNA, 64 nt, Homo Sapiens
ggcaugcgccaccaugcccggccucuugaguagcugggauuacacaagugguucuccugccuca

SEQ ID NO: 263809 - RNA, 64 nt, Homo Sapiens
ggcaugagccaccacgccuggccucccaaagugcugggauuacacuugugaucccccugccucg

SEQ ID NO: 263810 - RNA, 64 nt, Homo Sapiens
ggcaugcgccaccaugcccagccugccaaguagcugggauuacacaagcgauuccccugccuca

SEQ ID NO: 263811 - RNA, 64 nt, Homo Sapiens
ggcaugagccaccgcacccagccucccaaagugcugggauuacacaggugauccacccgccuca

SEQ ID NO: 263812 - RNA, 64 nt, Homo Sapiens
ggcaugcgccaccaugaccggccuccugauuagcugggauuacaucaggcuauucuccugcuca

SEQ ID NO: 263813 - RNA, 64 nt, Homo Sapiens
ggcgugagccaccaugcccggccucccaaggugcugggauuacacaggugauccaccugccuug

SEQ ID NO: 263814 - RNA, 64 nt, Homo Sapiens
ggcgcccgccaccacaccaggacuuccgaguggcugggauuacacaagccauucuccucccuca

SEQ ID NO: 263815 - RNA, 64 nt, Homo Sapiens
ggcaugagccaccgugccuggccuuccaaagugcugggauuacacucaugauccacccgccucg

SEQ ID NO: 263816 - RNA, 64 nt, Homo Sapiens
ggccacuacaccuggcacaugccucccaaagugcugggauuacacaagugauccacccaccuca

SEQ ID NO: 263817 - RNA, 64 nt, Homo Sapiens
ggcaugcaccaccacagcccgccuccagaguagcugggauuacacaagcgauuauugugccuca

SEQ ID NO: 263818 - RNA, 64 nt, Homo Sapiens
ggcgugagccaccaugccuggccucccacagugcugggauuacccucgugaucugcccaccucg

SEQ ID NO: 263819 - RNA, 64 nt, Homo Sapiens
ggcaugagccacugugcccagccucccaaagugcugggauuacucuugucauccaccugucuug

SEQ ID NO: 263820 - RNA, 64 nt, Homo Sapiens
ggcgugagccacugcacccggccucccaaagugcugggauuacacaggcaaucugcccaccuca

SEQ ID NO: 263821 - RNA, 64 nt, Homo Sapiens
ggcaugcaccaccacgcccagccucccgaguagcugggauuacacaagugauucuccugccuca

SEQ ID NO: 263822 - RNA, 64 nt, Homo Sapiens
ggggugagccaccacgcccagccucccaaagugcugggauuacacaagugauccacccgccuca

SEQ ID NO: 263823 - RNA, 64 nt, Homo Sapiens
ggugugagccacagcaccuggccucccaaaguguugggauuacacaagugauccucccgccuca

SEQ ID NO: 263824 - RNA, 64 nt, Homo Sapiens
caagcacuuuuccugucucagccuuccgaguagcugggauuacaggugugugccaucaugccug

SEQ ID NO: 263825 - RNA, 64 nt, Homo Sapiens
uaagcgauucucaugccucauccucccaaguaggugggauuacaggugcccaccaccaagcccu

SEQ ID NO: 263826 - RNA, 64 nt, Homo Sapiens
caggugauccaccugccucggccucccaaagugcugggauuacaggugugagccaccacgcccu

SEQ ID NO: 263827 - RNA, 64 nt, Homo Sapiens
accuccgccucccggguucaagcgauucuucugcugggauuacagcauaugccaccaugcccag

SEQ ID NO: 263828 - RNA, 64 nt, Homo Sapiens
caggugauccacccgccucagccucccacacugcugggauuacaggcaugagccaccgcuccug

SEQ ID NO: 263829 - RNA, 64 nt, Homo Sapiens
cuugugauccacccgccucggccucccaaagugcugggauuacaggcgugagccaccuugccug

SEQ ID NO: 263830 - RNA, 64 nt, Homo Sapiens
caagcgauucuccugccucagccuccugaguagcugggauuacaggcgcacgccaccacgccug

SEQ ID NO: 263831 - RNA, 64 nt, Homo Sapiens
cucgugauccgccugccucgacuucccagagugcugggauuacaggcgugagccaccacacccu

SEQ ID NO: 263832 - RNA, 64 nt, Homo Sapiens
aguacaucagaacucaugccaacagucuuuaugaugggauuaagguggacaagaucuccuaaga

SEQ ID NO: 263833 - RNA, 64 nt, Homo Sapiens
auuaagguggacaagaucuccuaagaucugugaaugggauuaagguggacaagaucuccuaaga

SEQ ID NO: 263834 - RNA, 64 nt, Homo Sapiens
caagcgauucuccugccucagccucccaaguagcugggauuacaggcacgcgccaccacaccug

SEQ ID NO: 263835 - RNA, 64 nt, Homo Sapiens
caaguagucugccugccucaaccucccaaagugcugggauuacaggcgugagccacugcgccug

SEQ ID NO: 263836 - RNA, 64 nt, Homo Sapiens
ggcaugagccaccaugccuagccucccaaagugcugggauuacacaggugauccaccugucuug

SEQ ID NO: 263837 - RNA, 64 nt, Homo Sapiens
ggcauguaccaccacacccagccuccugaguagcugggauuacacaagugauucuccugccuca

SEQ ID NO: 263838 - RNA, 64 nt, Homo Sapiens
ggugugagccacggcacccagccucccaaagugcugggauuacacaggugauccacccaccuug

SEQ ID NO: 263839 - RNA, 64 nt, Homo Sapiens
ggcguacaccaccaugccuggccuccagaauagcugggauuacacaaacaauucuccugccuca

SEQ ID NO: 263840 - RNA, 64 nt, Homo Sapiens
ugauucuccugccucagccucccucgcaaguagcugggauuacaggcgccugccaccaugccua

SEQ ID NO: 263841 - RNA, 64 nt, Homo Sapiens
caagugaucugcccuccucagccucguaaagugcugggauuacaggggugagccgcugugccug

SEQ ID NO: 263842 - RNA, 64 nt, Homo Sapiens
caagugauucuccugucucagccucccaaguagcugggauuacaggcaugagcuaccacgccug

SEQ ID NO: 263843 - RNA, 64 nt, Homo Sapiens
caggugauccacccgccuuggccucccaaagugcugggauuacaggcgugagccacugagcccg

SEQ ID NO: 263844 - RNA, 64 nt, Homo Sapiens
caagugauucucccaccucagccucccaaguaggugggauuacagguacucaccaccaggucca

SEQ ID NO: 263845 - RNA, 64 nt, Homo Sapiens
cagauggucugcccaccuccgccucccaaagugcugggauuacaggcgugagccacugcgcccg

SEQ ID NO: 263846 - RNA, 64 nt, Homo Sapiens
caagcaauucuccuuccuuagccuccugaguagcugggauuacaggcaugcgccaccacacccg

SEQ ID NO: 263847 - RNA, 64 nt, Homo Sapiens
caggugaucugccugccucagccucccaaagugcugggauuacaggugugagccaccgcgcccg

SEQ ID NO: 263848 - RNA, 64 nt, Homo Sapiens
ggugugagccaccacacccagccucccaaagugcugggauuacacucgugacccacccgccuug

SEQ ID NO: 263849 - RNA, 64 nt, Homo Sapiens
ggugacugccaccgugcccggccucccgaguaguugggauuacacaagcgacucuccugccuca

SEQ ID NO: 263850 - RNA, 64 nt, Homo Sapiens
ggcaugagccaccaggccgggccucccagcgugcugggauuauacaggugauccacccaccuug

SEQ ID NO: 263851 - RNA, 64 nt, Homo Sapiens
ggcacgcgccaccacaccuggccucccaaguagcugggauuacacaagcgauucuccugccuca

SEQ ID NO: 263852 - RNA, 64 nt, Homo Sapiens
gaagcgauucuccugccucagccucccaaguagcugggauuacaggcaugcaccaccaugccug

SEQ ID NO: 263853 - RNA, 64 nt, Homo Sapiens
caggugaccugcccaccucggccucccgaagugcugggauuacaagggugagccaccaugcccg

SEQ ID NO: 263854 - RNA, 64 nt, Homo Sapiens
cucgugaucugcccgccucggccucccaaagugcugggauuacaggccugagccaccgcguccg

SEQ ID NO: 263855 - RNA, 64 nt, Homo Sapiens
ggcgugagccacccggccuggccucccaaagcacugggauuacacucgugguccacccgccucg

SEQ ID NO: 263856 - RNA, 64 nt, Homo Sapiens
ggcaugcaccaccaugcccggccuccugaguagcugggauuacaaagcggauucucgugccuca

SEQ ID NO: 263857 - RNA, 64 nt, Homo Sapiens
gacaugagccaccacacucagucucccgaagugcugggauuacucaagugauccuccugccgca

SEQ ID NO: 263858 - RNA, 64 nt, Homo Sapiens
ggugugagccaccgugccuggccucucaaaaugcugggauuacacaggugacccacccgccucg

SEQ ID NO: 263859 - RNA, 64 nt, Homo Sapiens
ggcgccugcuaccaugccuggccucccuaguggcugggauuacacaagcgauucuucugccuca

SEQ ID NO: 263860 - RNA, 64 nt, Homo Sapiens
caagugauccacucgcuucggccucccaaagugcugggauuauaggcgugagccacugugccca

SEQ ID NO: 263861 - RNA, 64 nt, Homo Sapiens
caagcgguucuccugccucagccucccgaguagcugggauuaugggcgcccgccaccacgccca

SEQ ID NO: 263862 - RNA, 64 nt, Homo Sapiens
caaaagauccacccaccucggccucccaaagugcugggauuauaggcaugaaccaccguguccg

SEQ ID NO: 263863 - RNA, 64 nt, Homo Sapiens
caagugauucuccagccucagccuccugaguagcugggauuacaggcacacaccaccaugccca

SEQ ID NO: 263864 - RNA, 64 nt, Homo Sapiens
caagugauccgccugccucagccucccacagugcugggauuacaggcgugagccaccgcacccg

SEQ ID NO: 263865 - RNA, 64 nt, Homo Sapiens
ggugugagccaccgugcccggccucccaaagugcugggauuacacaagcaauucuccugccuca

SEQ ID NO: 263866 - RNA, 64 nt, Homo Sapiens
ggcaugcaccaccacaccuggccucccgaguagcugggauuacacaagcaauucuccuucuuca

SEQ ID NO: 263867 - RNA, 64 nt, Homo Sapiens
ggcgugugagccaccacgccaccucaggaagugcugggauuacaccugaccucgugauccaccc

SEQ ID NO: 263868 - RNA, 64 nt, Homo Sapiens
ggcgugagccaccgugcccagccucccaaaguacugggauuacacucgugaucugcccgccuug

SEQ ID NO: 263869 - RNA, 64 nt, Homo Sapiens
ggcuugagcccccgcgcccagccucccaaagugcugggauuacacaggugauccaccugccucg

SEQ ID NO: 263870 - RNA, 64 nt, Homo Sapiens
ggcaccugccaccaugcccggccucccaaguagcugggauuacacaagcgauucuccugccuca

SEQ ID NO: 263871 - RNA, 64 nt, Homo Sapiens
auaucuauuauguagauaaauauauauaguggccuuucaggacugucacaguaacacuuuauuu

SEQ ID NO: 263872 - RNA, 64 nt, Homo Sapiens
cacuuuauuuacagagcuaauguuuguccuaaauuuucaggacccuagaggagagcuuuauaca

SEQ ID NO: 263873 - RNA, 64 nt, Homo Sapiens
acccugaagcuuuuguuuugaauuaagaaaugaguuucaggaauugacaaaccauuuguuaacc

SEQ ID NO: 263874 - RNA, 64 nt, Homo Sapiens
ccaaguaauuuaaaaguaauauguuaccuaugucuuucaggaaaaauaauuauagcagcugauc

SEQ ID NO: 263875 - RNA, 64 nt, Homo Sapiens
ggacuucagaccaaggacacgguuuaaccaggcuuuucaggaugaccauguauguuucauuucu

SEQ ID NO: 263876 - RNA, 64 nt, Homo Sapiens
aaccugggauguccugaugcaaggugggugacguuuucaggaggacacuuugucagaacccuua

SEQ ID NO: 263877 - RNA, 64 nt, Homo Sapiens
uaacacaguugggguugggucaauaguuucccaauuucaggauauuucgaugucagaaauaacg

SEQ ID NO: 263878 - RNA, 64 nt, Homo Sapiens
aaaaaaaaaccaaaaaaacuguccagcuguggacuuucaggauucaggacugcuggggaucaag

SEQ ID NO: 263879 - RNA, 64 nt, Homo Sapiens
uugucaguacaagcucugccuccucucauuguaguuucaggacuccgaaguagagcaauguguu

SEQ ID NO: 263880 - RNA, 64 nt, Homo Sapiens
cuuccccuaauuggcucuuugugaagccauacuuuuucaggauuuucuucaaugcugcugcugu

SEQ ID NO: 263881 - RNA, 64 nt, Homo Sapiens
ugagcucaucaauuauguuauggauucuuucauuuuucaggauuuagauaauucugaaauaauu

SEQ ID NO: 263882 - RNA, 64 nt, Homo Sapiens
aacuguuccaccucagaucaggaugggggaaugguuucaggaugauggaagacaauuuuuccgu

SEQ ID NO: 263883 - RNA, 64 nt, Homo Sapiens
cuaccucauaucaguuugcuauugcugaaagaucuuucaggacuacuuaucccaagagaaugaa

SEQ ID NO: 263884 - RNA, 64 nt, Homo Sapiens
auacacuaugaagauguuucagugacuauucaguuuucaggaugagaaaaagcaauaaccucaa

SEQ ID NO: 263885 - RNA, 64 nt, Homo Sapiens
cuuccaggagaacugauucuguggauggaugugauuucaggagauugugcagugccagcaucag

SEQ ID NO: 263886 - RNA, 64 nt, Homo Sapiens
uccucagcucugugacuugugacccuauuugaaguuucaggauuugggugucacaaaggauugu

SEQ ID NO: 263887 - RNA, 64 nt, Homo Sapiens
gacggauugcauuagaaauaaagauaacaagaucuuucaggaaaaaagcaugucucaauaguaa

SEQ ID NO: 263888 - RNA, 64 nt, Homo Sapiens
cucugucagaugggaagacaaggacuuggucugauuucaggauauucccauuuuggaaguuuuc

SEQ ID NO: 263889 - RNA, 64 nt, Homo Sapiens
uggucugauuucaggauacucccauuuuggaaguuuucaggacugugcauuuucccagauacuu

SEQ ID NO: 263890 - RNA, 64 nt, Homo Sapiens
cagacauaugaugugaaugcaaauuaauugagauuuucaggacaggaaaaggaauaggaaggag

SEQ ID NO: 263891 - RNA, 64 nt, Homo Sapiens
cagaacucauuaaaacuccucuaaucacuguuaauuucaggaaaucuucucuugcuugguguaa

SEQ ID NO: 263892 - RNA, 64 nt, Homo Sapiens
agaauagagguaucaucaaacguggcaaauuuucuuucaggaauaauaaagagcaugauuccac

SEQ ID NO: 263893 - RNA, 64 nt, Homo Sapiens
ggcagaaugacaauaagguuuucccccauuuugguuucaggaggacaugaauaguguguuuauu

SEQ ID NO: 263894 - RNA, 64 nt, Homo Sapiens
agaaacauuaacaauaaaaagcuguaucccauaauuucaggaugaagugaggacaaacugcuag

SEQ ID NO: 263895 - RNA, 64 nt, Homo Sapiens
acagaccuagaaaugggccucaccaaagauguauuuucaggagaaggauucaggaucuacccag

SEQ ID NO: 263896 - RNA, 64 nt, Homo Sapiens
gacuagaaagagaaggggguugagaaaaguacucuuucaggaggaguagucaagaaaagggauc

SEQ ID NO: 263897 - RNA, 64 nt, Homo Sapiens
acaguaaauuucagggucuggauacaaaauggaauuucaggagcgaggaaugaagguuuuccua

SEQ ID NO: 263898 - RNA, 64 nt, Homo Sapiens
auuugcugcaaucuguugcuauucagaguuuaaguuucaggagaaaacaggaacaauagaacac

SEQ ID NO: 263899 - RNA, 64 nt, Homo Sapiens
uuuccacaguucuugaaaaguacuauguuucaaauuucaggaacaccagcguuagcuguaaaag

SEQ ID NO: 263900 - RNA, 64 nt, Homo Sapiens
cagcaggaguaauaaauuuacucacagcacuuguuuucaggacaacacuucauuuucaggaaau

SEQ ID NO: 263901 - RNA, 64 nt, Homo Sapiens
acucacagcacuuguuuucaggacaacacuucauuuucaggaaaucuacuuccuacagagccaa

SEQ ID NO: 263902 - RNA, 64 nt, Homo Sapiens
caugugccgaaugugcagguuuuuuaacuuuaaguuucaggauauuuaauuacauaauuuuuuu

SEQ ID NO: 263903 - RNA, 64 nt, Homo Sapiens
gauuggccgcuuggcacaugugaaccuaccuucauuucaggaggucugcuuaggagagaccgag

SEQ ID NO: 263904 - RNA, 64 nt, Homo Sapiens
uguaagaaaccauuauuucagaagccauuuuuuauuucaggaaaaaauaaaauaccaauaucag

SEQ ID NO: 263905 - RNA, 64 nt, Homo Sapiens
gagacuccaucacagccaggcgguacaaauuggauuucaggaagaagugaccugcuguugagac

SEQ ID NO: 263906 - RNA, 64 nt, Homo Sapiens
auauaaacuauuuaaaucaagaauuucucagaaauuucaggagcgucauuuaaaauaaugacuu

SEQ ID NO: 263907 - RNA, 64 nt, Homo Sapiens
uacuaguaguuaucccaaaauacuacccaacagauuucaggaagugcuuucuuuuuacagaaau

SEQ ID NO: 263908 - RNA, 64 nt, Homo Sapiens
gcucugauauagcagcccugguguaguuucuucauuucaggaagacugguagguauaauggccu

SEQ ID NO: 263909 - RNA, 64 nt, Homo Sapiens
uuuugcugauucuuuaaaugucuuguuucccagauuucaggaaacuuuuuuucuuuuaagcuau

SEQ ID NO: 263910 - RNA, 64 nt, Homo Sapiens
uuaugucccagggguauauuuagacccuguuuccuuucaggaggguccccagcugguccagggc

SEQ ID NO: 263911 - RNA, 64 nt, Homo Sapiens
gcuuugccaagcuugugagagcugguugcuacauuuucaggauuuuuacaaguugguaaacaca

SEQ ID NO: 263912 - RNA, 64 nt, Homo Sapiens
agucugcuccucuuguuccugaaauguguuuccuuuucaggagauggggaauaauuuccuucag

SEQ ID NO: 263913 - RNA, 64 nt, Homo Sapiens
caaagaagaaagcugauuuuugucuuuuaauccauuucaggacucucuccaggagggcucgggg

SEQ ID NO: 263914 - RNA, 64 nt, Homo Sapiens
uuuuagccaguuugccuuuccuacuuuugaacacuuucaggacuggugucuucugcuauuuuau

SEQ ID NO: 263915 - RNA, 64 nt, Homo Sapiens
ccgagguagccuucaaucacaaccccagggugguuuucaggaguaggcacugagacuaccgcuc

SEQ ID NO: 263916 - RNA, 64 nt, Homo Sapiens
ucuggugaaguggguggagcagugccagggugguuuucaggagcgggcacauugggggcaugga

SEQ ID NO: 263917 - RNA, 64 nt, Homo Sapiens
cccuuugaauauauuugggaagaguugcuuccuauuucaggacccugccaaaaaagaagaaagc

SEQ ID NO: 263918 - RNA, 64 nt, Homo Sapiens
cucuccaacagcuugugguuuucuuauuacucauuuucaggaaaguuuguaguauuacaaggca

SEQ ID NO: 263919 - RNA, 64 nt, Homo Sapiens; identical to SEQ ID NO: 95106

SEQ ID NO: 263920 - RNA, 64 nt, Homo Sapiens; identical to SEQ ID NO: 95107

SEQ ID NO: 263921 - RNA, 64 nt, Homo Sapiens; identical to SEQ ID NO: 95108

SEQ ID NO: 263922 - RNA, 64 nt, Homo Sapiens; identical to SEQ ID NO: 95109

SEQ ID NO: 263923 - RNA, 64 nt, Homo Sapiens; identical to SEQ ID NO: 95110

SEQ ID NO: 263924 - RNA, 64 nt, Homo Sapiens; identical to SEQ ID NO: 95111

SEQ ID NO: 263925 - RNA, 64 nt, Homo Sapiens; identical to SEQ ID NO: 95112

SEQ ID NO: 263926 - RNA, 64 nt, Homo Sapiens; identical to SEQ ID NO: 95113

SEQ ID NO: 263927 - RNA, 64 nt, Homo Sapiens; identical to SEQ ID NO: 95114

SEQ ID NO: 263928 - RNA, 64 nt, Homo Sapiens; identical to SEQ ID NO: 95115

SEQ ID NO: 263929 - RNA, 64 nt, Homo Sapiens; identical to SEQ ID NO: 95116

SEQ ID NO: 263930 - RNA, 64 nt, Homo Sapiens; identical to SEQ ID NO: 95117

SEQ ID NO: 263931 - RNA, 64 nt, Homo Sapiens; identical to SEQ ID NO: 95118

SEQ ID NO: 263932 - RNA, 64 nt, Homo Sapiens; identical to SEQ ID NO: 95119

SEQ ID NO: 263933 - RNA, 64 nt, Homo Sapiens; identical to SEQ ID NO: 95120

SEQ ID NO: 263934 - RNA, 64 nt, Homo Sapiens; identical to SEQ ID NO: 95121

SEQ ID NO: 263935 - RNA, 64 nt, Homo Sapiens; identical to SEQ ID NO: 95122

SEQ ID NO: 263936 - RNA, 64 nt, Homo Sapiens; identical to SEQ ID NO: 95123

SEQ ID NO: 263937 - RNA, 64 nt, Homo Sapiens; identical to SEQ ID NO: 95124

SEQ ID NO: 263938 - RNA, 64 nt, Homo Sapiens; identical to SEQ ID NO: 95125

SEQ ID NO: 263939 - RNA, 64 nt, Homo Sapiens; identical to SEQ ID NO: 95126

SEQ ID NO: 263940 - RNA, 64 nt, Homo Sapiens; identical to SEQ ID NO: 95127

SEQ ID NO: 263941 - RNA, 64 nt, Homo Sapiens; identical to SEQ ID NO: 95128

SEQ ID NO: 263942 - RNA, 64 nt, Homo Sapiens; identical to SEQ ID NO: 95129

SEQ ID NO: 263943 - RNA, 64 nt, Homo Sapiens; identical to SEQ ID NO: 95130

SEQ ID NO: 263944 - RNA, 64 nt, Homo Sapiens; identical to SEQ ID NO: 95131

SEQ ID NO: 263945 - RNA, 60 nt, Homo Sapiens; identical to SEQ ID NO: 95132

SEQ ID NO: 263946 - RNA, 64 nt, Homo Sapiens; identical to SEQ ID NO: 95133

SEQ ID NO: 263947 - RNA, 64 nt, Homo Sapiens; identical to SEQ ID NO: 95134

SEQ ID NO: 263948 - RNA, 64 nt, Homo Sapiens; identical to SEQ ID NO: 95135

SEQ ID NO: 263949 - RNA, 64 nt, Homo Sapiens; identical to SEQ ID NO: 95136

SEQ ID NO: 263950 - RNA, 64 nt, Homo Sapiens; identical to SEQ ID NO: 95137

SEQ ID NO: 263951 - RNA, 64 nt, Homo Sapiens; identical to SEQ ID NO: 95138

SEQ ID NO: 263952 - RNA, 64 nt, Homo Sapiens; identical to SEQ ID NO: 95139

SEQ ID NO: 263953 - RNA, 62 nt, Homo Sapiens; identical to SEQ ID NO: 95140

SEQ ID NO: 263954 - RNA, 64 nt, Homo Sapiens; identical to SEQ ID NO: 95141

SEQ ID NO: 263955 - RNA, 53 nt, Homo Sapiens; identical to SEQ ID NO: 95142

SEQ ID NO: 263956 - RNA, 52 nt, Homo Sapiens; identical to SEQ ID NO: 95143

SEQ ID NO: 263957 - RNA, 64 nt, Homo Sapiens; identical to SEQ ID NO: 95144

SEQ ID NO: 263958 - RNA, 64 nt, Homo Sapiens; identical to SEQ ID NO: 95145

SEQ ID NO: 263959 - RNA, 64 nt, Homo Sapiens; identical to SEQ ID NO: 95146

SEQ ID NO: 263960 - RNA, 50 nt, Homo Sapiens; identical to SEQ ID NO: 95147

SEQ ID NO: 263961 - RNA, 64 nt, Homo Sapiens; identical to SEQ ID NO: 95148

SEQ ID NO: 263962 - RNA, 64 nt, Homo Sapiens
cuuccagugaugguuggggaugccaggggaagggagugcguagguacugaagggcuaguggcac

SEQ ID NO: 263963 - RNA, 64 nt, Homo Sapiens
acccauuagacagcuggagauauauuuuugacugagugcguaguuggaauucuucaggguaucu

SEQ ID NO: 263964 - RNA, 64 nt, Homo Sapiens
cagaaaugcuaacaagcgugcagaaacaccagagagugcguauccugcucagaaccauucacau

SEQ ID NO: 263965 - RNA, 64 nt, Homo Sapiens
auguguauuucugccauguaccuaaugauuauucagugcguauauaucugaaaagucauguugc

SEQ ID NO: 263966 - RNA, 64 nt, Homo Sapiens
uucugaggcccacugucuaccuugccagauccucagugcguaucgccaaugcaggaugcuccuu

SEQ ID NO: 263967 - RNA, 64 nt, Homo Sapiens
ucuaggaagugggccuggaacuaaaaauguuaauagugcguaccaaauuucuggaaguuuauau

SEQ ID NO: 263968 - RNA, 64 nt, Homo Sapiens
aggccuaagaguacacauggaggguaaauauuaaagugcguauuauguacaucuagaauccaug

SEQ ID NO: 263969 - RNA, 54 nt, Homo Sapiens
augcaguuuggacggauugauggcagugcguacauucuagacuuccaguauccg

SEQ ID NO: 263970 - RNA, 64 nt, Homo Sapiens
guaauaaaacuacugauuuauccaauugugugucagugcguauuaaaugucaggacauuccuuu

SEQ ID NO: 263971 - RNA, 64 nt, Homo Sapiens
ccguuggguuuuuucauaucuguacauaaugccgagugcguaaggaaaccguggcgucgcgcac

SEQ ID NO: 263972 - RNA, 64 nt, Homo Sapiens
agaaguaugacucaugcaaaucaccugcaacagaagugcguaccuugcaaauggcagugugcug

SEQ ID NO: 263973 - RNA, 64 nt, Homo Sapiens
aucaggaauacauuuuuuuacugccuuaaccuguagugcguagaauaugcaucaauuucuugaa

SEQ ID NO: 263974 - RNA, 64 nt, Homo Sapiens
aggccuucaaacugucccagguccugcgcagcucagugcguaucuucuugcuuccaugugucuu

SEQ ID NO: 263975 - RNA, 64 nt, Homo Sapiens
cuagccaaagaugauaaagggggaaaugguuuuuagugcguauauuauacugccucuuaggugu

SEQ ID NO: 263976 - RNA, 64 nt, Homo Sapiens
agagaccugggggugugucuggggguggggugugagugcguaugaaagugugugucugcugggg

SEQ ID NO: 263977 - RNA, 64 nt, Homo Sapiens
cucugccacaucacuuccuucuugaaagccuaagagugcguaugcgugugugugugugugugug

SEQ ID NO: 263978 - RNA, 64 nt, Homo Sapiens
aaugagaaucucaaugccaguaguacuggauaauagugcguauugcuucugguggcauuacccu

SEQ ID NO: 263979 - RNA, 64 nt, Homo Sapiens
uggagucugucccugucuuggaguguuuuucccuagugcguagucuagaaagucuugccucauu

SEQ ID NO: 263980 - RNA, 64 nt, Homo Sapiens
uaugggaaugaacaugaauuagggaacuucaaauagugcguagacuuuucccuacuuaccauug

SEQ ID NO: 263981 - RNA, 64 nt, Homo Sapiens
caguaugggagacacaccaacuacucuucaaaucagugcguaccugcucuacgcgugaagguac

SEQ ID NO: 263982 - RNA, 64 nt, Homo Sapiens
ccuaacgucuaccuuuacaugcucagugugaggcagugcguagaucuguaaauguggauagaaa

SEQ ID NO: 263983 - RNA, 64 nt, Homo Sapiens
ucucacuucaauuaaugcugcgcuucgcuuggugagugcguacuuuuucuaccuguacacauuc

SEQ ID NO: 263984 - RNA, 64 nt, Homo Sapiens
guuagaacguccggcacguaauauguaaauagaaagugcguacagcggaagggagugggcggag

SEQ ID NO: 263985 - RNA, 64 nt, Homo Sapiens
augugaccuucucuaaaugccguuaaacuguacaagugcguacaauagacauauucuacuuaga

SEQ ID NO: 263986 - RNA, 64 nt, Homo Sapiens
ccacgcccacccagcgucgacccuugacccacgaagugcguagcaugcaguauuuaaagcagug

SEQ ID NO: 263987 - RNA, 64 nt, Homo Sapiens
uuuauuuuugcccccaccaccuugaggaagcccaagugcguacccugaauagggacaaacaaau

SEQ ID NO: 263988 - RNA, 64 nt, Homo Sapiens; identical to SEQ ID NO: 124017

SEQ ID NO: 263989 - RNA, 64 nt, Homo Sapiens; identical to SEQ ID NO: 124018

SEQ ID NO: 263990 - RNA, 64 nt, Homo Sapiens; identical to SEQ ID NO: 124019

SEQ ID NO: 263991 - RNA, 64 nt, Homo Sapiens; identical to SEQ ID NO: 124020

SEQ ID NO: 263992 - RNA, 64 nt, Homo Sapiens; identical to SEQ ID NO: 124021

SEQ ID NO: 263993 - RNA, 64 nt, Homo Sapiens; identical to SEQ ID NO: 124022

SEQ ID NO: 263994 - RNA, 64 nt, Homo Sapiens; identical to SEQ ID NO: 124023

SEQ ID NO: 263995 - RNA, 64 nt, Homo Sapiens; identical to SEQ ID NO: 124024

SEQ ID NO: 263996 - RNA, 64 nt, Homo Sapiens; identical to SEQ ID NO: 124025

SEQ ID NO: 263997 - RNA, 64 nt, Homo Sapiens; identical to SEQ ID NO: 124026

SEQ ID NO: 263998 - RNA, 64 nt, Homo Sapiens; identical to SEQ ID NO: 124027

SEQ ID NO: 263999 - RNA, 64 nt, Homo Sapiens; identical to SEQ ID NO: 124028

SEQ ID NO: 264000 - RNA, 64 nt, Homo Sapiens; identical to SEQ ID NO: 144070

SEQ ID NO: 264001 - RNA, 64 nt, Homo Sapiens; identical to SEQ ID NO: 144071

SEQ ID NO: 264002 - RNA, 64 nt, Homo Sapiens; identical to SEQ ID NO: 144072

SEQ ID NO: 264003 - RNA, 64 nt, Homo Sapiens; identical to SEQ ID NO: 144073

SEQ ID NO: 264004 - RNA, 64 nt, Homo Sapiens; identical to SEQ ID NO: 144074

SEQ ID NO: 264005 - RNA, 64 nt, Homo Sapiens; identical to SEQ ID NO: 144075

SEQ ID NO: 264006 - RNA, 64 nt, Homo Sapiens; identical to SEQ ID NO: 144076

SEQ ID NO: 264007 - RNA, 64 nt, Homo Sapiens; identical to SEQ ID NO: 144077

SEQ ID NO: 264008 - RNA, 64 nt, Homo Sapiens; identical to SEQ ID NO: 144078

SEQ ID NO: 264009 - RNA, 64 nt, Homo Sapiens; identical to SEQ ID NO: 144079

SEQ ID NO: 264010 - RNA, 64 nt, Homo Sapiens; identical to SEQ ID NO: 144080

SEQ ID NO: 264011 - RNA, 64 nt, Homo Sapiens; identical to SEQ ID NO: 144081

SEQ ID NO: 264012 - RNA, 64 nt, Homo Sapiens; identical to SEQ ID NO: 144082

SEQ ID NO: 264013 - RNA, 64 nt, Homo Sapiens; identical to SEQ ID NO: 144083

SEQ ID NO: 264014 - RNA, 64 nt, Homo Sapiens; identical to SEQ ID NO: 144084

SEQ ID NO: 264015 - RNA, 64 nt, Homo Sapiens; identical to SEQ ID NO: 144085

SEQ ID NO: 264016 - RNA, 64 nt, Homo Sapiens; identical to SEQ ID NO: 144086

SEQ ID NO: 264017 - RNA, 64 nt, Homo Sapiens; identical to SEQ ID NO: 144087

SEQ ID NO: 264018 - RNA, 64 nt, Homo Sapiens; identical to SEQ ID NO: 144088

SEQ ID NO: 264019 - RNA, 64 nt, Homo Sapiens; identical to SEQ ID NO: 144089

SEQ ID NO: 264020 - RNA, 64 nt, Homo Sapiens; identical to SEQ ID NO: 144090

SEQ ID NO: 264021 - RNA, 64 nt, Homo Sapiens; identical to SEQ ID NO: 144091

SEQ ID NO: 264022 - RNA, 64 nt, Homo Sapiens; identical to SEQ ID NO: 144092

SEQ ID NO: 264023 - RNA, 64 nt, Homo Sapiens; identical to SEQ ID NO: 144093

SEQ ID NO: 264024 - RNA, 64 nt, Homo Sapiens; identical to SEQ ID NO: 144094

SEQ ID NO: 264025 - RNA, 64 nt, Homo Sapiens; identical to SEQ ID NO: 144095

SEQ ID NO: 264026 - RNA, 64 nt, Homo Sapiens; identical to SEQ ID NO: 144096

SEQ ID NO: 264027 - RNA, 64 nt, Homo Sapiens; identical to SEQ ID NO: 144097

SEQ ID NO: 264028 - RNA, 64 nt, Homo Sapiens; identical to SEQ ID NO: 144098

SEQ ID NO: 264029 - RNA, 64 nt, Homo Sapiens; identical to SEQ ID NO: 144099

SEQ ID NO: 264030 - RNA, 64 nt, Homo Sapiens; identical to SEQ ID NO: 144100

SEQ ID NO: 264031 - RNA, 64 nt, Homo Sapiens; identical to SEQ ID NO: 144101

SEQ ID NO: 264032 - RNA, 64 nt, Homo Sapiens; identical to SEQ ID NO: 144102

SEQ ID NO: 264033 - RNA, 64 nt, Homo Sapiens; identical to SEQ ID NO: 144103

SEQ ID NO: 264034 - RNA, 64 nt, Homo Sapiens; identical to SEQ ID NO: 144104

SEQ ID NO: 264035 - RNA, 64 nt, Homo Sapiens; identical to SEQ ID NO: 144105

SEQ ID NO: 264036 - RNA, 64 nt, Homo Sapiens; identical to SEQ ID NO: 144106

SEQ ID NO: 264037 - RNA, 64 nt, Homo Sapiens; identical to SEQ ID NO: 144107

SEQ ID NO: 264038 - RNA, 64 nt, Homo Sapiens; identical to SEQ ID NO: 144108

SEQ ID NO: 264039 - RNA, 64 nt, Homo Sapiens; identical to SEQ ID NO: 144109

SEQ ID NO: 264040 - RNA, 64 nt, Homo Sapiens; identical to SEQ ID NO: 144110

SEQ ID NO: 264041 - RNA, 64 nt, Homo Sapiens; identical to SEQ ID NO: 144111

SEQ ID NO: 264042 - RNA, 64 nt, Homo Sapiens; identical to SEQ ID NO: 144112

SEQ ID NO: 264043 - RNA, 64 nt, Homo Sapiens; identical to SEQ ID NO: 144113

SEQ ID NO: 264044 - RNA, 64 nt, Homo Sapiens; identical to SEQ ID NO: 144114

SEQ ID NO: 264045 - RNA, 64 nt, Homo Sapiens; identical to SEQ ID NO: 144115

SEQ ID NO: 264046 - RNA, 64 nt, Homo Sapiens; identical to SEQ ID NO: 144116

SEQ ID NO: 264047 - RNA, 64 nt, Homo Sapiens; identical to SEQ ID NO: 144117

SEQ ID NO: 264048 - RNA, 64 nt, Homo Sapiens; identical to SEQ ID NO: 144118

SEQ ID NO: 264049 - RNA, 64 nt, Homo Sapiens; identical to SEQ ID NO: 144119

SEQ ID NO: 264050 - RNA, 64 nt, Homo Sapiens; identical to SEQ ID NO: 144120

SEQ ID NO: 264051 - RNA, 64 nt, Homo Sapiens; identical to SEQ ID NO: 144121

SEQ ID NO: 264052 - RNA, 64 nt, Homo Sapiens; identical to SEQ ID NO: 144122

SEQ ID NO: 264053 - RNA, 64 nt, Homo Sapiens; identical to SEQ ID NO: 144123

SEQ ID NO: 264054 - RNA, 64 nt, Homo Sapiens; identical to SEQ ID NO: 144124

SEQ ID NO: 264055 - RNA, 64 nt, Homo Sapiens; identical to SEQ ID NO: 144125

SEQ ID NO: 264056 - RNA, 64 nt, Homo Sapiens; identical to SEQ ID NO: 144126

SEQ ID NO: 264057 - RNA, 64 nt, Homo Sapiens; identical to SEQ ID NO: 144127

SEQ ID NO: 264058 - RNA, 64 nt, Homo Sapiens; identical to SEQ ID NO: 144128

SEQ ID NO: 264059 - RNA, 64 nt, Homo Sapiens; identical to SEQ ID NO: 144129

SEQ ID NO: 264060 - RNA, 64 nt, Homo Sapiens; identical to SEQ ID NO: 144130

SEQ ID NO: 264061 - RNA, 64 nt, Homo Sapiens; identical to SEQ ID NO: 144131

SEQ ID NO: 264062 - RNA, 64 nt, Homo Sapiens; identical to SEQ ID NO: 144132

SEQ ID NO: 264063 - RNA, 64 nt, Homo Sapiens; identical to SEQ ID NO: 144133

SEQ ID NO: 264064 - RNA, 64 nt, Homo Sapiens; identical to SEQ ID NO: 144134

SEQ ID NO: 264065 - RNA, 64 nt, Homo Sapiens; identical to SEQ ID NO: 144135

SEQ ID NO: 264066 - RNA, 64 nt, Homo Sapiens; identical to SEQ ID NO: 144136

SEQ ID NO: 264067 - RNA, 64 nt, Homo Sapiens; identical to SEQ ID NO: 144137

SEQ ID NO: 264068 - RNA, 64 nt, Homo Sapiens; identical to SEQ ID NO: 144138

SEQ ID NO: 264069 - RNA, 64 nt, Homo Sapiens; identical to SEQ ID NO: 144139

SEQ ID NO: 264070 - RNA, 64 nt, Homo Sapiens; identical to SEQ ID NO: 144140

SEQ ID NO: 264071 - RNA, 64 nt, Homo Sapiens; identical to SEQ ID NO: 144141

SEQ ID NO: 264072 - RNA, 64 nt, Homo Sapiens; identical to SEQ ID NO: 144142

SEQ ID NO: 264073 - RNA, 64 nt, Homo Sapiens; identical to SEQ ID NO: 144143

SEQ ID NO: 264074 - RNA, 64 nt, Homo Sapiens; identical to SEQ ID NO: 144144

SEQ ID NO: 264075 - RNA, 64 nt, Homo Sapiens; identical to SEQ ID NO: 144145

SEQ ID NO: 264076 - RNA, 64 nt, Homo Sapiens; identical to SEQ ID NO: 144146

SEQ ID NO: 264077 - RNA, 64 nt, Homo Sapiens; identical to SEQ ID NO: 144147

SEQ ID NO: 264078 - RNA, 64 nt, Homo Sapiens; identical to SEQ ID NO: 144148

SEQ ID NO: 264079 - RNA, 64 nt, Homo Sapiens; identical to SEQ ID NO: 144149

SEQ ID NO: 264080 - RNA, 64 nt, Homo Sapiens; identical to SEQ ID NO: 144150

SEQ ID NO: 264081 - RNA, 64 nt, Homo Sapiens; identical to SEQ ID NO: 144151

SEQ ID NO: 264082 - RNA, 64 nt, Homo Sapiens; identical to SEQ ID NO: 144152

SEQ ID NO: 264083 - RNA, 64 nt, Homo Sapiens; identical to SEQ ID NO: 144153

SEQ ID NO: 264084 - RNA, 64 nt, Homo Sapiens; identical to SEQ ID NO: 144154

SEQ ID NO: 264085 - RNA, 64 nt, Homo Sapiens; identical to SEQ ID NO: 144155

SEQ ID NO: 264086 - RNA, 64 nt, Homo Sapiens
auauccaaguauaaagcccaggaacuucuagaauaacccagaugcgcuuuaauuuuuuuuaaua

SEQ ID NO: 264087 - RNA, 64 nt, Homo Sapiens
uuuuaauauguuuugaucacagaacuucuagaauaacccagaugcucuuucauauucuuuuaau

SEQ ID NO: 264088 - RNA, 64 nt, Homo Sapiens
ggugcacccaccuguuuucugaaacacacgagcaaacccagagguggauguuaugaacagcugu

SEQ ID NO: 264089 - RNA, 64 nt, Homo Sapiens
uugugugagucuucucgaaggaggguugacucagaacccagagacaauacaaaaccccucacuu

SEQ ID NO: 264090 - RNA, 64 nt, Homo Sapiens
ccaccugaauugggcuuuuuaaaaacaaaaaacaaacccagaccgaguauauauuugaaaagga

SEQ ID NO: 264091 - RNA, 64 nt, Homo Sapiens
gauucaacauuuuccccccacacuaaucacggggaacccagaauguucugugacugaagugaua

SEQ ID NO: 264092 - RNA, 64 nt, Homo Sapiens
gggcugugccgcuguuuuccgaccccuccacacaaacccagaugaguucuguguccacaaccca

SEQ ID NO: 264093 - RNA, 64 nt, Homo Sapiens
ccuccacacaaacccagaugaguucuguguccacaacccagaccggcaccaucucucugaugac

SEQ ID NO: 264094 - RNA, 64 nt, Homo Sapiens
gaacagacacauacgucaauggaacagaugagagaacccagaaauaaacccauauaaauaugcu

SEQ ID NO: 264095 - RNA, 64 nt, Homo Sapiens
ggagcuuuauuuguaauagccccaaacuggaaacaacccagauguccuacaacagguacauggu

SEQ ID NO: 264096 - RNA, 64 nt, Homo Sapiens
uugaggggaaauuacugucaccacuaguuuuaauauaguacaaugaaaaaauaauauauauaua

SEQ ID NO: 264097 - RNA, 64 nt, Homo Sapiens
aauauaguacaaugaaaaaauaauauauauauauauaguacaaugguccagacauaauaagagg

SEQ ID NO: 264098 - RNA, 64 nt, Homo Sapiens
uguauauauauauuacacacguacauguauauauauaguacauguauauauauguauauauaua

SEQ ID NO: 264099 - RNA, 64 nt, Homo Sapiens
uauauauauaguacauguguauauauguauauauauaguacauguguguguguguguguaauau

SEQ ID NO: 264100 - RNA, 64 nt, Homo Sapiens
auuucuauccauugagcaugcauggauauacccaauaguacacacaaaauaaauguuuacuuaa

SEQ ID NO: 264101 - RNA, 64 nt, Homo Sapiens
aauucacaaguauauauugauaucugauguguguauaguacaucuguugguuauguacauuuua

SEQ ID NO: 264102 - RNA, 64 nt, Homo Sapiens
gcaaagauguuuuguauuuuagccaaaucuuuuuauaguacaaacuuagaauuauuuuacacac

SEQ ID NO: 264103 - RNA, 64 nt, Homo Sapiens
gucaaguacuuagucaucccuauuaugauaugagauaguacagcuuuucaggaagcuuagaucu

SEQ ID NO: 264104 - RNA, 64 nt, Homo Sapiens; identical to SEQ ID NO: 172267

SEQ ID NO: 264105 - RNA, 64 nt, Homo Sapiens; identical to SEQ ID NO: 172268

SEQ ID NO: 264106 - RNA, 64 nt, Homo Sapiens; identical to SEQ ID NO: 172269

SEQ ID NO: 264107 - RNA, 64 nt, Homo Sapiens; identical to SEQ ID NO: 172270

SEQ ID NO: 264108 - RNA, 64 nt, Homo Sapiens; identical to SEQ ID NO: 172271

SEQ ID NO: 264109 - RNA, 64 nt, Homo Sapiens; identical to SEQ ID NO: 172272

SEQ ID NO: 264110 - RNA, 64 nt, Homo Sapiens; identical to SEQ ID NO: 172273

SEQ ID NO: 264111 - RNA, 64 nt, Homo Sapiens; identical to SEQ ID NO: 172274

SEQ ID NO: 264112 - RNA, 64 nt, Homo Sapiens; identical to SEQ ID NO: 172275

SEQ ID NO: 264113 - RNA, 64 nt, Homo Sapiens; identical to SEQ ID NO: 172276

SEQ ID NO: 264114 - RNA, 64 nt, Homo Sapiens; identical to SEQ ID NO: 172277

SEQ ID NO: 264115 - RNA, 64 nt, Homo Sapiens; identical to SEQ ID NO: 172278

SEQ ID NO: 264116 - RNA, 64 nt, Homo Sapiens; identical to SEQ ID NO: 172279

SEQ ID NO: 264117 - RNA, 64 nt, Homo Sapiens; identical to SEQ ID NO: 172280

SEQ ID NO: 264118 - RNA, 64 nt, Homo Sapiens; identical to SEQ ID NO: 172281

SEQ ID NO: 264119 - RNA, 64 nt, Homo Sapiens; identical to SEQ ID NO: 172282

SEQ ID NO: 264120 - RNA, 64 nt, Homo Sapiens; identical to SEQ ID NO: 172283

SEQ ID NO: 264121 - RNA, 64 nt, Homo Sapiens; identical to SEQ ID NO: 172284

SEQ ID NO: 264122 - RNA, 64 nt, Homo Sapiens; identical to SEQ ID NO: 172285

SEQ ID NO: 264123 - RNA, 64 nt, Homo Sapiens; identical to SEQ ID NO: 172286

SEQ ID NO: 264124 - RNA, 64 nt, Homo Sapiens; identical to SEQ ID NO: 172287

SEQ ID NO: 264125 - RNA, 64 nt, Homo Sapiens; identical to SEQ ID NO: 172288

SEQ ID NO: 264126 - RNA, 64 nt, Homo Sapiens; identical to SEQ ID NO: 172289

SEQ ID NO: 264127 - RNA, 64 nt, Homo Sapiens; identical to SEQ ID NO: 172290

SEQ ID NO: 264128 - RNA, 64 nt, Homo Sapiens; identical to SEQ ID NO: 172291

SEQ ID NO: 264129 - RNA, 64 nt, Homo Sapiens; identical to SEQ ID NO: 172292

SEQ ID NO: 264130 - RNA, 64 nt, Homo Sapiens; identical to SEQ ID NO: 172293

SEQ ID NO: 264131 - RNA, 64 nt, Homo Sapiens; identical to SEQ ID NO: 172294

SEQ ID NO: 264132 - RNA, 64 nt, Homo Sapiens; identical to SEQ ID NO: 172295

SEQ ID NO: 264133 - RNA, 64 nt, Homo Sapiens; identical to SEQ ID NO: 172296

SEQ ID NO: 264134 - RNA, 64 nt, Homo Sapiens; identical to SEQ ID NO: 172297

SEQ ID NO: 264135 - RNA, 64 nt, Homo Sapiens; identical to SEQ ID NO: 172298

SEQ ID NO: 264136 - RNA, 64 nt, Homo Sapiens; identical to SEQ ID NO: 172299

SEQ ID NO: 264137 - RNA, 64 nt, Homo Sapiens; identical to SEQ ID NO: 172300

SEQ ID NO: 264138 - RNA, 64 nt, Homo Sapiens; identical to SEQ ID NO: 172301

SEQ ID NO: 264139 - RNA, 64 nt, Homo Sapiens; identical to SEQ ID NO: 172302

SEQ ID NO: 264140 - RNA, 64 nt, Homo Sapiens; identical to SEQ ID NO: 172303

SEQ ID NO: 264141 - RNA, 64 nt, Homo Sapiens; identical to SEQ ID NO: 172304

SEQ ID NO: 264142 - RNA, 64 nt, Homo Sapiens; identical to SEQ ID NO: 172305

SEQ ID NO: 264143 - RNA, 64 nt, Homo Sapiens; identical to SEQ ID NO: 172306

SEQ ID NO: 264144 - RNA, 64 nt, Homo Sapiens; identical to SEQ ID NO: 172307

SEQ ID NO: 264145 - RNA, 64 nt, Homo Sapiens; identical to SEQ ID NO: 172308

SEQ ID NO: 264146 - RNA, 64 nt, Homo Sapiens; identical to SEQ ID NO: 172309

SEQ ID NO: 264147 - RNA, 64 nt, Homo Sapiens; identical to SEQ ID NO: 172310

SEQ ID NO: 264148 - RNA, 64 nt, Homo Sapiens
uuuuaaguuaugcccauuuaacuucaucaugaaugaacuauaauacucaaguacuaguaauuua

SEQ ID NO: 264149 - RNA, 64 nt, Homo Sapiens
uaaauaucuagaaucugacuaauucacuuaaguagaacuauaaagaaaaccuaauccaaaauaa

SEQ ID NO: 264150 - RNA, 64 nt, Homo Sapiens
uuuuagaugauucagcuuuuguuccauuacuguugaacuauaugaacuauuccauuacugcaga

SEQ ID NO: 264151 - RNA, 64 nt, Homo Sapiens
acauuaacuaguaagacauaaagauuugaaacuggaacuauauuauacuuuuuaaccaaucucu

SEQ ID NO: 264152 - RNA, 64 nt, Homo Sapiens
cucaauccugcagugggguuaagaacuuuuucuuuucccucaauuagacaguuuugagaacgua

SEQ ID NO: 264153 - RNA, 64 nt, Homo Sapiens
cccaaauccuucccaaguaacacggucuucccucuucccucagugguacuuuuugugaagacgg

SEQ ID NO: 264154 - RNA, 64 nt, Homo Sapiens
cauuccugagacuugguauacaaauaaccauggcuucccucagcaugaaauuauaccuucugau

SEQ ID NO: 264155 - RNA, 64 nt, Homo Sapiens
gccucuguucucagagaauucucaggauacccaguucccucauauaguuucucaagugaacacu

SEQ ID NO: 264156 - RNA, 64 nt, Homo Sapiens
guggcugugauacagguuccaaaaugaguuucucuucccucaggggguuuagaaagaucucagg

SEQ ID NO: 264157 - RNA, 64 nt, Homo Sapiens
ggcucucaggagugugaccagucggccacuggauuucccucacuagucagaguccucucucaca

SEQ ID NO: 264158 - RNA, 64 nt, Homo Sapiens
agaacaagauaaccacugcugcugauggauacuuuucccucacugccauggcacaccagucaug

SEQ ID NO: 264159 - RNA, 64 nt, Homo Sapiens
guuucauucuuagaaccuucuuuaauagagggucuucccucaacagccugugccucuggucuac

SEQ ID NO: 264160 - RNA, 64 nt, Homo Sapiens
cgggcacuucucaugggggcuaugggaagcugacuucccucaguauggcaacagcccccucacc

SEQ ID NO: 264161 - RNA, 64 nt, Homo Sapiens
uuccuaucgauuuaguuaccauaauggaaugaucuucccucagcgcacccaaacaagaaagucc

SEQ ID NO: 264162 - RNA, 64 nt, Homo Sapiens
ccaggguucuuucugcagaguguugggggaaauauucccucaccgucuggggacagauagaacc

SEQ ID NO: 264163 - RNA, 64 nt, Homo Sapiens
gcagccuguguuagcaugcacguuucuguucaguuucccucacaucucuccuccugaguaggaa

SEQ ID NO: 264164 - RNA, 64 nt, Homo Sapiens
ucucugcccuccacagagcuagcuccauucuuccuucccucaacuacaugaucccaugcuccca

SEQ ID NO: 264165 - RNA, 64 nt, Homo Sapiens
gcccuacccaggcuuucucuucaccauuuaucacuucccucacuuuucagucuccuuuucuuuc

SEQ ID NO: 264166 - RNA, 64 nt, Homo Sapiens
uuuuauguuggucauuaggugaauauuacucauuuucccucaagagaagcucauaagugugugu

SEQ ID NO: 264167 - RNA, 64 nt, Homo Sapiens
acccuucuuucugaacccagggcccuuuucagccuucccucauauuuucuugagaucaaacuuu

SEQ ID NO: 264168 - RNA, 64 nt, Homo Sapiens
uuuuccccugccucuguuagugguuaacacucuuuucccucagggagccuaaugagguuuuuaa

SEQ ID NO: 264169 - RNA, 64 nt, Homo Sapiens
uaugaagcuuguacuuaugcauuucucgggccucuucccucauuuucaucagucugucuaagaa

SEQ ID NO: 264170 - RNA, 64 nt, Homo Sapiens
cucggcucccacacaggugagggccacccuuuguuucccucauccucaggggccagcccagucu

SEQ ID NO: 264171 - RNA, 64 nt, Homo Sapiens
cagccccuucuuccccaggcuguaugggcuuucuuucccucaugcauggcccuggccauugaug

SEQ ID NO: 264172 - RNA, 64 nt, Homo Sapiens
gcuggaggucacguuucuaaaacucaccuacgaaagauagcauuaaaggaacaggggcucucug

SEQ ID NO: 264173 - RNA, 64 nt, Homo Sapiens
guuccuggugaagcaguuucacaucagucucuccagauagcacuacgauguauuccgcuucuga

SEQ ID NO: 264174 - RNA, 64 nt, Homo Sapiens
ggggcagaauaugcaugcauaaacgguaaugaacagauagcacugauaguucuuuaaggagaca

SEQ ID NO: 264175 - RNA, 64 nt, Homo Sapiens
guuuugcuaaaagauacauuacaaugaagcuuccagauagcaccaaaaaaacgaaagcaucuuc

SEQ ID NO: 264176 - RNA, 64 nt, Homo Sapiens; identical to SEQ ID NO: 133830

SEQ ID NO: 264177 - RNA, 64 nt, Homo Sapiens; identical to SEQ ID NO: 133831

SEQ ID NO: 264178 - RNA, 64 nt, Homo Sapiens; identical to SEQ ID NO: 133832

SEQ ID NO: 264179 - RNA, 64 nt, Homo Sapiens; identical to SEQ ID NO: 133833

SEQ ID NO: 264180 - RNA, 64 nt, Homo Sapiens; identical to SEQ ID NO: 133834

SEQ ID NO: 264181 - RNA, 64 nt, Homo Sapiens; identical to SEQ ID NO: 133835

SEQ ID NO: 264182 - RNA, 64 nt, Homo Sapiens; identical to SEQ ID NO: 133836

SEQ ID NO: 264183 - RNA, 64 nt, Homo Sapiens; identical to SEQ ID NO: 133837

SEQ ID NO: 264184 - RNA, 64 nt, Homo Sapiens; identical to SEQ ID NO: 133838

SEQ ID NO: 264185 - RNA, 64 nt, Homo Sapiens; identical to SEQ ID NO: 133839

SEQ ID NO: 264186 - RNA, 64 nt, Homo Sapiens; identical to SEQ ID NO: 133840

SEQ ID NO: 264187 - RNA, 64 nt, Homo Sapiens; identical to SEQ ID NO: 133841

SEQ ID NO: 264188 - RNA, 64 nt, Homo Sapiens; identical to SEQ ID NO: 133842

SEQ ID NO: 264189 - RNA, 64 nt, Homo Sapiens; identical to SEQ ID NO: 133843

SEQ ID NO: 264190 - RNA, 64 nt, Homo Sapiens; identical to SEQ ID NO: 133844

SEQ ID NO: 264191 - RNA, 64 nt, Homo Sapiens; identical to SEQ ID NO: 133845

SEQ ID NO: 264192 - RNA, 64 nt, Homo Sapiens; identical to SEQ ID NO: 133846

SEQ ID NO: 264193 - RNA, 64 nt, Homo Sapiens; identical to SEQ ID NO: 133847

SEQ ID NO: 264194 - RNA, 64 nt, Homo Sapiens; identical to SEQ ID NO: 133848

SEQ ID NO: 264195 - RNA, 64 nt, Homo Sapiens; identical to SEQ ID NO: 133849

SEQ ID NO: 264196 - RNA, 64 nt, Homo Sapiens; identical to SEQ ID NO: 133850

SEQ ID NO: 264197 - RNA, 64 nt, Homo Sapiens; identical to SEQ ID NO: 133851

SEQ ID NO: 264198 - RNA, 64 nt, Homo Sapiens; identical to SEQ ID NO: 133852

SEQ ID NO: 264199 - RNA, 64 nt, Homo Sapiens; identical to SEQ ID NO: 133853

SEQ ID NO: 264200 - RNA, 64 nt, Homo Sapiens; identical to SEQ ID NO: 133854

SEQ ID NO: 264201 - RNA, 64 nt, Homo Sapiens; identical to SEQ ID NO: 133855

SEQ ID NO: 264202 - RNA, 64 nt, Homo Sapiens; identical to SEQ ID NO: 133856

SEQ ID NO: 264203 - RNA, 64 nt, Homo Sapiens; identical to SEQ ID NO: 133857

SEQ ID NO: 264204 - RNA, 64 nt, Homo Sapiens; identical to SEQ ID NO: 133858

SEQ ID NO: 264205 - RNA, 64 nt, Homo Sapiens; identical to SEQ ID NO: 133859

SEQ ID NO: 264206 - RNA, 64 nt, Homo Sapiens; identical to SEQ ID NO: 133860

SEQ ID NO: 264207 - RNA, 64 nt, Homo Sapiens; identical to SEQ ID NO: 133861

SEQ ID NO: 264208 - RNA, 64 nt, Homo Sapiens; identical to SEQ ID NO: 133862

SEQ ID NO: 264209 - RNA, 64 nt, Homo Sapiens; identical to SEQ ID NO: 133863

SEQ ID NO: 264210 - RNA, 64 nt, Homo Sapiens; identical to SEQ ID NO: 133864

SEQ ID NO: 264211 - RNA, 64 nt, Homo Sapiens; identical to SEQ ID NO: 133865

SEQ ID NO: 264212 - RNA, 64 nt, Homo Sapiens; identical to SEQ ID NO: 133866

SEQ ID NO: 264213 - RNA, 64 nt, Homo Sapiens; identical to SEQ ID NO: 133867

SEQ ID NO: 264214 - RNA, 64 nt, Homo Sapiens; identical to SEQ ID NO: 133868

SEQ ID NO: 264215 - RNA, 64 nt, Homo Sapiens; identical to SEQ ID NO: 133869

SEQ ID NO: 264216 - RNA, 64 nt, Homo Sapiens; identical to SEQ ID NO: 133870

SEQ ID NO: 264217 - RNA, 64 nt, Homo Sapiens; identical to SEQ ID NO: 133871

SEQ ID NO: 264218 - RNA, 64 nt, Homo Sapiens; identical to SEQ ID NO: 133872

SEQ ID NO: 264219 - RNA, 64 nt, Homo Sapiens; identical to SEQ ID NO: 133873

SEQ ID NO: 264220 - RNA, 64 nt, Homo Sapiens; identical to SEQ ID NO: 133874

SEQ ID NO: 264221 - RNA, 64 nt, Homo Sapiens; identical to SEQ ID NO: 133875

SEQ ID NO: 264222 - RNA, 64 nt, Homo Sapiens; identical to SEQ ID NO: 133876

SEQ ID NO: 264223 - RNA, 64 nt, Homo Sapiens; identical to SEQ ID NO: 133877

SEQ ID NO: 264224 - RNA, 64 nt, Homo Sapiens; identical to SEQ ID NO: 133878

SEQ ID NO: 264225 - RNA, 64 nt, Homo Sapiens; identical to SEQ ID NO: 133879

SEQ ID NO: 264226 - RNA, 64 nt, Homo Sapiens; identical to SEQ ID NO: 133880

SEQ ID NO: 264227 - RNA, 64 nt, Homo Sapiens; identical to SEQ ID NO: 133881

SEQ ID NO: 264228 - RNA, 64 nt, Homo Sapiens; identical to SEQ ID NO: 133882

SEQ ID NO: 264229 - RNA, 64 nt, Homo Sapiens; identical to SEQ ID NO: 133883

SEQ ID NO: 264230 - RNA, 64 nt, Homo Sapiens; identical to SEQ ID NO: 133884

SEQ ID NO: 264231 - RNA, 64 nt, Homo Sapiens; identical to SEQ ID NO: 133885

SEQ ID NO: 264232 - RNA, 64 nt, Homo Sapiens; identical to SEQ ID NO: 133886

SEQ ID NO: 264233 - RNA, 64 nt, Homo Sapiens; identical to SEQ ID NO: 133887

SEQ ID NO: 264234 - RNA, 64 nt, Homo Sapiens; identical to SEQ ID NO: 133888

SEQ ID NO: 264235 - RNA, 64 nt, Homo Sapiens; identical to SEQ ID NO: 133889

SEQ ID NO: 264236 - RNA, 64 nt, Homo Sapiens; identical to SEQ ID NO: 133890

SEQ ID NO: 264237 - RNA, 64 nt, Homo Sapiens; identical to SEQ ID NO: 133891

SEQ ID NO: 264238 - RNA, 64 nt, Homo Sapiens; identical to SEQ ID NO: 133892

SEQ ID NO: 264239 - RNA, 64 nt, Homo Sapiens; identical to SEQ ID NO: 133893

SEQ ID NO: 264240 - RNA, 64 nt, Homo Sapiens
uugaaagggauuauauuaauugcuaaauauuuuauucacaaaggucaauaacauggcaagauaa

SEQ ID NO: 264241 - RNA, 64 nt, Homo Sapiens
uaaaacucaaggcuuguugugaagccuaaaaauauucacaaauaagcuuuuaaacuggugucuu

SEQ ID NO: 264242 - RNA, 64 nt, Homo Sapiens
ugcugagagcauuacugugucagcucacuccagcuucacaaauggggaggcacguuucaucugu

SEQ ID NO: 264243 - RNA, 64 nt, Homo Sapiens
gauccugaauaagcauuguuuuuguaugaauuuuuucacaaaaaauauaaauuugcuguugauu

SEQ ID NO: 264244 - RNA, 64 nt, Homo Sapiens
accucucaaugaaaaauguaaaaguaccuagaaauucacaaaaaaauuaauaccucuguggaga

SEQ ID NO: 264245 - RNA, 64 nt, Homo Sapiens
ggaacgaaauuagaaaucaauaaaauuugggaaauucacaaauauguggauauuaaacaacaca

SEQ ID NO: 264246 - RNA, 64 nt, Homo Sapiens
gguguacuuuaaaaaauauauguuucauuuaaucuucacaaaagaucuguagaguaagcaaaga

SEQ ID NO: 264247 - RNA, 64 nt, Homo Sapiens
agauaugaacuuacauuucugugcaaguuguuuuuucacaaaauaucuuccuaagaggcagcau

SEQ ID NO: 264248 - RNA, 64 nt, Homo Sapiens
cagaucaguuucugccaauuucagugguuuauuguucacaaaaaaaucuucaaaacaaguauug

SEQ ID NO: 264249 - RNA, 64 nt, Homo Sapiens
guucacaaaaaaaucuucaaaacaaguauugacuuucacaaaauuuaaaucauaaacaggcaaa

SEQ ID NO: 264250 - RNA, 64 nt, Homo Sapiens
uaacaaccucugagccuugguguacagaccaccuuucacaaaacgaaaugcuaugacuguaucu

SEQ ID NO: 264251 - RNA, 64 nt, Homo Sapiens
uuauuuacuucuguauguguauuuuugugaaguauucacaaagguuaaguuaaaauaaaaccaa

SEQ ID NO: 264252 - RNA, 64 nt, Homo Sapiens
auuuacaagagaagaaagugaaagcaaaugggguuucacaaauaguuguaaauauagugaagca

SEQ ID NO: 264253 - RNA, 64 nt, Homo Sapiens
uuuacugaacuaugaaaauaaauacacauaauuuuucacaaaauuuugggcccaauuccccuaa

SEQ ID NO: 264254 - RNA, 64 nt, Homo Sapiens
auuuaugauguauuuacucucauucauucauucauucacaaaauuuuuauuaaucauggucauu

SEQ ID NO: 264255 - RNA, 64 nt, Homo Sapiens
cuucaaaauaaaaaguaaugaugaugugaagaguuucacaaaucuaaucauacaaacucucacc

SEQ ID NO: 264256 - RNA, 50 nt, Homo Sapiens
caguugccaaccauuuguaguucacaaauuaaaacuggguuuccaggccu

SEQ ID NO: 264257 - RNA, 64 nt, Homo Sapiens
uauagguagcuacacguacauaauuaucucuuuauucacaaaggguauaguaaaauugauugua

SEQ ID NO: 264258 - RNA, 64 nt, Homo Sapiens
ggaucuaauuaaacuaaagaaacagaagcaaaaauucacaaaugaagacgccaaaaacaauugc

SEQ ID NO: 264259 - RNA, 64 nt, Homo Sapiens
aacuuuuaaaagauuaucucaccaccaauauuucuucacaaaggauuaaacuuuguauuaauuu

SEQ ID NO: 264260 - RNA, 64 nt, Homo Sapiens
ucuuuguuuuauguuuuuaaauacagaaauugcuuucacaaauuuguaccacaugguaauucua

SEQ ID NO: 264261 - RNA, 64 nt, Homo Sapiens
cauggaauguaauauuuuugcaaagauggacuacuucacaaaugguuauaaagucauauccacu

SEQ ID NO: 264262 - RNA, 64 nt, Homo Sapiens
uguuacuagacaugaucuugaaagaggccaugauuucacaaaacucauuuuuauuuuauucuca

SEQ ID NO: 264263 - RNA, 64 nt, Homo Sapiens
ccuaagggaccuuucccugguaguaguggucucauucacaaaaaagaauaauagauguaacugg

SEQ ID NO: 264264 - RNA, 64 nt, Homo Sapiens
uaagcucuauuauguuauucuaacaaguagcaauuucacaaaauuuguauguagauguuaacgc

SEQ ID NO: 264265 - RNA, 64 nt, Homo Sapiens
uuagacuaguguugacuuuggggggggacauuuauucacaaaugagaaguaggcacaaaguaaa

SEQ ID NO: 264266 - RNA, 64 nt, Homo Sapiens
uaacuaaucuuuuugccucaccaaggcauacagauucacaaaaugccauccagguacuaaggac

SEQ ID NO: 264267 - RNA, 64 nt, Homo Sapiens
cuauacuuaauauaguaaauuauacacuuacgacuucacaaaacauagcaagaaacuauauagg

SEQ ID NO: 264268 - RNA, 64 nt, Homo Sapiens
cacgcucaccugacagccgacuauccaaagcugauucacaaaccuaaauccaagagaaaugauc

SEQ ID NO: 264269 - RNA, 64 nt, Homo Sapiens
aauucccuguaaaucugaaaauuuuuuuuucuuguucacaaaaaacuugugacuucuauagaca

SEQ ID NO: 264270 - RNA, 64 nt, Homo Sapiens
cuuuuuuugaagcaguggcaauauuuuucuucauuucacaaaggugugggaaccuguguuuguc

SEQ ID NO: 264271 - RNA, 64 nt, Homo Sapiens
cucaguggggcuuuguuuuuugagaacagccaaauucacaaacccagagacucugccuggccac

SEQ ID NO: 264272 - RNA, 64 nt, Homo Sapiens
aaaaugaaauccagugaagauucuuaguagccacuucacaaagcccaaaaucagcaaauuugac

SEQ ID NO: 264273 - RNA, 64 nt, Homo Sapiens
aggaccugccuacggcugaagagacuauaaagauuucacaaaacgcaaaaggaauaugaaaaca

SEQ ID NO: 264274 - RNA, 64 nt, Homo Sapiens
guaaaagugucacaccaccucccucagcacuuccccaucacaacaaccuaugucacugacucag

SEQ ID NO: 264275 - RNA, 64 nt, Homo Sapiens
ucaaugauuagaucgggucucggaagggaaguagccaucacaccauuaaaaagccuguggaccu

SEQ ID NO: 264276 - RNA, 64 nt, Homo Sapiens
ugaggacugcaccagaguucugaagggaucuuaaccaucacaaguuuuuacccucuuccuucau

SEQ ID NO: 264277 - RNA, 64 nt, Homo Sapiens
gccugccuuuucccuuccuauuucacuuugccucccaucacacaacugcguguaaaugguguca

SEQ ID NO: 264278 - RNA, 64 nt, Homo Sapiens
gucucgcccuaccauccuggugagguaaauucacccaucacagguaagggcccuugguaucaag

SEQ ID NO: 264279 - RNA, 64 nt, Homo Sapiens
gaaagugaccguacggguuuugagagggagacagccaucacauagcaaccgcuaugcagucugg

SEQ ID NO: 264280 - RNA, 64 nt, Homo Sapiens
gggaacaagguuggaugccuacuuaugagcuugaccaucacagcuaucgguaaucagaaauaug

SEQ ID NO: 264281 - RNA, 64 nt, Homo Sapiens
cugcauuugaauaucacuuccccucugcauuuucccaucacauagaagacuuugaccugugaag

SEQ ID NO: 264282 - RNA, 64 nt, Homo Sapiens
uccuuuaauucugaaguuggaguuggugccccugccaucacaaacaacacgagagccaauugug

SEQ ID NO: 264283 - RNA, 64 nt, Homo Sapiens
aguguucagcuuauucaccccacccccccaccccccaucacacgugcuccugugaacuuuccau

SEQ ID NO: 264284 - RNA, 64 nt, Homo Sapiens
ccugccacuucagcacaccuugccccaccugggaccaucacacgugaagcaccaggcugggaga

SEQ ID NO: 264285 - RNA, 64 nt, Homo Sapiens
aaucuuccaccaccucuccggcugccccugcccuccaucacagacagcagagccgggcagcuuu

SEQ ID NO: 264286 - RNA, 64 nt, Homo Sapiens
gagagggugaagcagguaucugaugugggaguugacaggccaggccuuccugcccagaagugga

SEQ ID NO: 264287 - RNA, 64 nt, Homo Sapiens
cagacagggcccagagcaucccagagaagaugugacaggccaaugggcaaauauuucaccauug

SEQ ID NO: 264288 - RNA, 64 nt, Homo Sapiens
gacuaugucuuucaagauguacagaagacugacaacaggccagugcagacuuugcuuccuccuu

SEQ ID NO: 264289 - RNA, 64 nt, Homo Sapiens
cccucacugcuagucagcuucuuuuggaaacuggacaggccauugccaccugcacuuugaagaa

SEQ ID NO: 264290 - RNA, 64 nt, Homo Sapiens
auuucaucaaggacagggaauaucccucccacacacaggccagcugcucacccugccaccucca

SEQ ID NO: 264291 - RNA, 64 nt, Homo Sapiens
uuccucauccagcaccaaaucuuugcuuauguccacaggccagggccugugcugcagucgggga

SEQ ID NO: 264292 - RNA, 64 nt, Homo Sapiens
ggcugggcucagcaaaggacucgccuugcaaccgacaggccauucccacccccacacacaaccu

SEQ ID NO: 264293 - RNA, 64 nt, Homo Sapiens
accauggcaucccagagcaaggacacaggagcccacaggccaguugagguugggcaaggagacu

SEQ ID NO: 264294 - RNA, 64 nt, Homo Sapiens
ucugacagagcaucagaaccagaggcuuggucccacaggccacggaccaauggccugcagccgu

SEQ ID NO: 264295 - RNA, 64 nt, Homo Sapiens
uaguaaugcucaggacaggagcggcagccccagaacaggccacucauuuagaauucuaguguuu

SEQ ID NO: 264296 - RNA, 64 nt, Homo Sapiens
ggggucagcauuugagcucacacagugcuuagagacaggccacuaggccuuuccuuccuggagc

SEQ ID NO: 264297 - RNA, 64 nt, Homo Sapiens
ccugggccaggagucugccacuccggaagcagacacaggccaggccagcacaggcagcgcaugg

SEQ ID NO: 264298 - RNA, 64 nt, Homo Sapiens
uggaaggaagagccaucguggucuuugucuggccacaggccaggcugcugggcauccuccuccu

SEQ ID NO: 264299 - RNA, 64 nt, Homo Sapiens
aaggaccaaaaauuauuuuuagcuauggcaaggcacaggccacauggccccugauggcgucccu

SEQ ID NO: 264300 - RNA, 64 nt, Homo Sapiens
cuuagcacucuugguggugggugggaggguggguacaggccagggauauucccuugcucuuuug

SEQ ID NO: 264301 - RNA, 64 nt, Homo Sapiens
ccuggcuucagcuuggaacccaauaccuaggcuuacaggccauccugagccaggggccucugga

SEQ ID NO: 264302 - RNA, 64 nt, Homo Sapiens
aaaagcacaucuuccugaucacaguuauaaaagaaacccugaggccgggcgcgguggcucaagc

SEQ ID NO: 264303 - RNA, 64 nt, Homo Sapiens
aaaaaaaaaaaaaaaaaaaaaaaaaagaagaagaaacccugagccauuaaugugucucguaacu

SEQ ID NO: 264304 - RNA, 64 nt, Homo Sapiens
aguggagucauacgcgaagguacacagccccgugaacccugagggucagcagagagagucucug

SEQ ID NO: 264305 - RNA, 64 nt, Homo Sapiens
aguggagucauacacgaagguacacagccccgugaacccugagggucagcagagagagucucug

SEQ ID NO: 264306 - RNA, 64 nt, Homo Sapiens
aguggagucauacgcgaaggcuccaagccccacgaacccugaggugguaucaugucagcagagu

SEQ ID NO: 264307 - RNA, 64 nt, Homo Sapiens
uuuccuaaauacuggccuggagauucuggacauuaacccugacguucuucccaaacauauugcu

SEQ ID NO: 264308 - RNA, 64 nt, Homo Sapiens
uguuucucuguuccacuuucgcacaggaguuugaaacccugagcuucauaagacacaaagacgu

SEQ ID NO: 264309 - RNA, 64 nt, Homo Sapiens
ugcccacuugauugagaaagauguuccagugaggaacccugaucucucagccccaaacacccac

SEQ ID NO: 264310 - RNA, 64 nt, Homo Sapiens
ggcacuguuaccuugguggugggacuuggaacccaacccugagcucccgauaaagcuaaagucc

SEQ ID NO: 264311 - RNA, 64 nt, Homo Sapiens
ccugggacguuuuuaagaucgcugugugucuguaaacccugaaucucaucuggggugggggccc

SEQ ID NO: 264312 - RNA, 64 nt, Homo Sapiens
ccugaaucucaucuggggugggggcccugcuggcaacccugagcccuguccaagguucccucuu

SEQ ID NO: 264313 - RNA, 64 nt, Homo Sapiens
gggcugccggccuccaaguucuggcuucuucucaaacccugagccagcugcucagagcaguguu

SEQ ID NO: 264314 - RNA, 64 nt, Homo Sapiens
uccaagcgugcugugcgucuucagggucucagggaacccugagcgggaacagcagaacuuaggg

SEQ ID NO: 264315 - RNA, 64 nt, Homo Sapiens
aguuaaaaaccuuuaaagaguguccauuugcuccaccagacagguggcuuucuuauacagaugg

SEQ ID NO: 264316 - RNA, 64 nt, Homo Sapiens
aguuaacuuguauuagaauuuguccauuugcucaaccagacaggugacguuuguauacagaugg

SEQ ID NO: 264317 - RNA, 64 nt, Homo Sapiens
cguuuggggucuuuagaaguuugaugauguugugaccagacauuugccuuaggaacuuaacucu

SEQ ID NO: 264318 - RNA, 64 nt, Homo Sapiens
gagagacguccauagccuuagguauaucauuuauaccagacauuaugaaguuauuaaagucucc

SEQ ID NO: 264319 - RNA, 64 nt, Homo Sapiens
cucuucgucaugaccaacgugauccucaccaugaaccagacacagggccugugccccgagguag

SEQ ID NO: 264320 - RNA, 64 nt, Homo Sapiens
uccucagagaagcgcugugcuaaggugaucgaggaccagacauuaaagcgugauuuucuuaauc

SEQ ID NO: 264321 - RNA, 64 nt, Homo Sapiens
aacugccaaguuggguggaggaaagaggguaauaaccagacacaauugcugugacagugauggc

SEQ ID NO: 264322 - RNA, 64 nt, Homo Sapiens
cuguugaccaggcaccucccugcagauacuacugaccagacaaggcuccuucaacaaggcuugc

SEQ ID NO: 264323 - RNA, 64 nt, Homo Sapiens
cagcugcagaccgccccucaccaacccagagaaccugcuuuacuuugcccagggacuuccuccc

SEQ ID NO: 264324 - RNA, 64 nt, Homo Sapiens
gaugucgagaggcaccacggccucacccaggcaucugcuuuacucuggaccauaggaaacaaga

SEQ ID NO: 264325 - RNA, 64 nt, Homo Sapiens
ugcauacaaacuaugucucugacaugcacauacacugcuuuauaaugaaaaugaggacacuuuc

SEQ ID NO: 264326 - RNA, 64 nt, Homo Sapiens
cuuacuuacccuauuauggcucccaagaaaguuccugcuuuaguguuuuguucccucugcccca

SEQ ID NO: 264327 - RNA, 64 nt, Homo Sapiens
cuggaauagucucagaucuagaaugugccugaggcugcuuuacucuugcaaacuuucacauuaa

SEQ ID NO: 264328 - RNA, 64 nt, Homo Sapiens
cucuagcaauccacaguacacaacacuccgaguucugcuuuauuaaauaauuuuuuaaaacuua

SEQ ID NO: 264329 - RNA, 64 nt, Homo Sapiens
cucccagagugcugggauuacucaggugaucagccugcuuuagcguuggucucgaacuccugac

SEQ ID NO: 264330 - RNA, 64 nt, Homo Sapiens
ucuacuuaauuuugguagauucacaauuuuuuuacugcuuuaauuaauguauacagcuaaaaaa

SEQ ID NO: 264331 - RNA, 64 nt, Homo Sapiens
uguuuuguugggcagugccugauaagcuucaaagcugcuuuauucaauaaaaaaaagaaaugaa

SEQ ID NO: 264332 - RNA, 64 nt, Homo Sapiens
caacugacgauuucccugguuuuagucugcgucucugcuuuaaaguuauugugauauccuucua

SEQ ID NO: 264333 - RNA, 64 nt, Homo Sapiens
auugauacaccuugagggucauucaaguuuucaucugcuuuauaaauuuuacuagauauuuguc

SEQ ID NO: 264334 - RNA, 64 nt, Homo Sapiens
uauauggcuuucucacuuuugcuagaacauuauucugcuuuauucuaacuucauuaccuuaaag

SEQ ID NO: 264335 - RNA, 64 nt, Homo Sapiens
aaagaauaaaagaauauccuuucagaaauauauacugcuuuaaaucucucuugccaaagugugc

SEQ ID NO: 264336 - RNA, 64 nt, Homo Sapiens
auuuagcgugugucugaaccuuuuuccccuugugcugcuuuauacaguuauaguaagaaaaagg

SEQ ID NO: 264337 - RNA, 64 nt, Homo Sapiens
gaucuuuaacccaccuaaaauuuuauagugaaaccugcuuuauauuguuguucugaagcuuaca

SEQ ID NO: 264338 - RNA, 64 nt, Homo Sapiens
uuaagaguuuuauaccuugagcagauacaaugaucugcuuuagugagaggacaauuucugauug

SEQ ID NO: 264339 - RNA, 64 nt, Homo Sapiens
gauaucuuugauccuggcauggucauuuauaaagcugcuuuauauuuuagaaacccauuuucuu

SEQ ID NO: 264340 - RNA, 64 nt, Homo Sapiens
gcauccagacugguggagucgcuuuuagguuauucugcuuuaguaauaccagcacuuuuucaug

SEQ ID NO: 264341 - RNA, 64 nt, Homo Sapiens
aaaacacuuccauuuuguguaauacgacuuuaagcugcuuuaguuugaauuucuguaguuugaa

SEQ ID NO: 264342 - RNA, 64 nt, Homo Sapiens
augaaggucuuccagaagccguuucacuauaacgcugcuuuagauccagauuucuaaaugaaau

SEQ ID NO: 264343 - RNA, 64 nt, Homo Sapiens
uucauuugaugaaaucauuucuuucaauucaugacugcuuuauagacaggacaaauaaucauua

SEQ ID NO: 264344 - RNA, 64 nt, Homo Sapiens
auuacccccucaauaucaugguguuugagagggucugcuuuaccuguaaaacuguuuauaagca

SEQ ID NO: 264345 - RNA, 64 nt, Homo Sapiens
ugaacauacuuugaaaaagcuaaccuacccugcacugcuuuaaguguaaauacagugaccaugu

SEQ ID NO: 264346 - RNA, 64 nt, Homo Sapiens
uucguccaaacuguguuaguugauucagagguuacugcuuuauaaacccggagaggcucugggc

SEQ ID NO: 264347 - RNA, 64 nt, Homo Sapiens
gugagcaagcgugauuaugaugaggaagcccccucugcuuuaauccacacaaggaacguaaccu

SEQ ID NO: 264348 - RNA, 64 nt, Homo Sapiens
ugucuacuaugcuguuuccuuguuccugcuagugcugcuuuacaaaugcagaccauucuaucau

SEQ ID NO: 264349 - RNA, 64 nt, Homo Sapiens
ccucaguuugguuuaaaaacugucuuugcucuuucugcuuuauguguuaagaaggguauucaug

SEQ ID NO: 264350 - RNA, 64 nt, Homo Sapiens
ucauuuugacucuuggaauuaaacuuuaaaauaccugcuuuauuuauuuuugauaacggcucuu

SEQ ID NO: 264351 - RNA, 64 nt, Homo Sapiens
uugaauauuuucuuccacaauguuuuuauguugacugcuuuaugaaaaaugccucagcagaauc

SEQ ID NO: 264352 - RNA, 64 nt, Homo Sapiens
auuuucuauauugccaaguuuauuuuucugaacccugcuuuaccugauuugcaguguucaucag

SEQ ID NO: 264353 - RNA, 64 nt, Homo Sapiens
cacugucacguggcuucaucuuaagaucuuuaaacugcuuuauagccuaugagggccucguuua

SEQ ID NO: 264354 - RNA, 64 nt, Homo Sapiens
ggggaaaggaaucaauuauuacaaaucuccucgacugcuuuaguguugcacuaaaaaguggauu

SEQ ID NO: 264355 - RNA, 64 nt, Homo Sapiens
cucauccugacaggagggguugaguuugccucuucugcuuuaaugccuggucucugaaggcauu

SEQ ID NO: 264356 - RNA, 64 nt, Homo Sapiens
ggcuaaaaacaagcacagcacaucccucagauaacugcuuuauggagacgggagucaaaaucag

SEQ ID NO: 264357 - RNA, 64 nt, Homo Sapiens
uauuugcaguguaguaagaguaggaucaugaguccugcuuuaagaggcacacuuguaggaaaau

SEQ ID NO: 264358 - RNA, 64 nt, Homo Sapiens
uuaaaaaaaaaaaaaaaucuauggaagacagauucugcuuuaaaaaaccaggugccuucucaug

SEQ ID NO: 264359 - RNA, 64 nt, Homo Sapiens
aguaacaaugaagaacgugguaagauccuccaagcugcuuuagauugcaguaugcuccacgugg

SEQ ID NO: 264360 - RNA, 64 nt, Homo Sapiens
aaaauacaugcaucucagcgugauauuucgaaagcugcuuuaaaucaauguuuaaugcuguggu

SEQ ID NO: 264361 - RNA, 64 nt, Homo Sapiens
gaaguugguagcuguggaguuuaagaaaaauaaacugcuuuauggugaccauguaccuuccuuu

SEQ ID NO: 264362 - RNA, 64 nt, Homo Sapiens
agggagcuccuuguacccaucugucuaggaugagcugcuuuaucguuacgcuaacuccaaaagg

SEQ ID NO: 264363 - RNA, 64 nt, Homo Sapiens
acuaaaauaaguuuggcugacaguuuuuguauaccugcuuuaauguuuauaaaauuuuuauuga

SEQ ID NO: 264364 - RNA, 64 nt, Homo Sapiens
uauaguaaaaugcacagagguuaaguauucuuaccugcuuuaauuuugaaacagauuuuuauug

SEQ ID NO: 264365 - RNA, 64 nt, Homo Sapiens
cuggaauaaggcagcaucacggaaauucuguaaggacugacacagagagcucaugcugacugug

SEQ ID NO: 264366 - RNA, 64 nt, Homo Sapiens
gugacgucacuccugucucucuuugcuuucuucugacugacauuuauucagccuucucuacagg

SEQ ID NO: 264367 - RNA, 64 nt, Homo Sapiens
uucucaucuugccucuaccucagauauucccaaugacugacagcagcagugaagacugacaaau

SEQ ID NO: 264368 - RNA, 64 nt, Homo Sapiens
ucagauauucccaaugacugacaauagcagugaagacugacaaagaaauagguucugccagucu

SEQ ID NO: 264369 - RNA, 64 nt, Homo Sapiens
aaaaaaacaacuaccuucuguccuagaagacacagacugacagauggggugaaggccuggggac

SEQ ID NO: 264370 - RNA, 64 nt, Homo Sapiens
gccugaggcucgauuugccucucugguccaaugggacugacacuguuguacaaccugaccugug

SEQ ID NO: 264371 - RNA, 64 nt, Homo Sapiens
guuuuaggcuuuucacuaggugacuuaugucuuagacugacacuuccuuuugucuaccuaacau

SEQ ID NO: 264372 - RNA, 64 nt, Homo Sapiens
guggcaauagucuuagucuuucacaacucgaacugacugacaauauugaguaggggcuucaugc

SEQ ID NO: 264373 - RNA, 64 nt, Homo Sapiens
uuucaugugcuuggaaacuugcaguagaaucagggacugacaucgcaguuccucuccucucuuc

SEQ ID NO: 264374 - RNA, 64 nt, Homo Sapiens
cugaaagcauaaacucuagaggugacucagucaggacugacaguaaugugauaauugccuucau

SEQ ID NO: 264375 - RNA, 64 nt, Homo Sapiens
cucucccccucagccuguggguggcacgagcaaggacugacauccgcacagggaggauugucug

SEQ ID NO: 264376 - RNA, 64 nt, Homo Sapiens
agggugccacaucaguccccuccccaaccucagugacugacagaggauccggaucucagagccu

SEQ ID NO: 264377 - RNA, 64 nt, Homo Sapiens; identical to SEQ ID NO: 73410

SEQ ID NO: 264378 - RNA, 64 nt, Homo Sapiens; identical to SEQ ID NO: 73411

SEQ ID NO: 264379 - RNA, 64 nt, Homo Sapiens; identical to SEQ ID NO: 73412

SEQ ID NO: 264380 - RNA, 64 nt, Homo Sapiens; identical to SEQ ID NO: 73413

SEQ ID NO: 264381 - RNA, 64 nt, Homo Sapiens; identical to SEQ ID NO: 73414

SEQ ID NO: 264382 - RNA, 64 nt, Homo Sapiens; identical to SEQ ID NO: 73415

SEQ ID NO: 264383 - RNA, 64 nt, Homo Sapiens; identical to SEQ ID NO: 73416

SEQ ID NO: 264384 - RNA, 64 nt, Homo Sapiens; identical to SEQ ID NO: 73417

SEQ ID NO: 264385 - RNA, 64 nt, Homo Sapiens; identical to SEQ ID NO: 73418

SEQ ID NO: 264386 - RNA, 64 nt, Homo Sapiens; identical to SEQ ID NO: 73419

SEQ ID NO: 264387 - RNA, 64 nt, Homo Sapiens; identical to SEQ ID NO: 74296

SEQ ID NO: 264388 - RNA, 64 nt, Homo Sapiens; identical to SEQ ID NO: 74297

SEQ ID NO: 264389 - RNA, 64 nt, Homo Sapiens; identical to SEQ ID NO: 74298

SEQ ID NO: 264390 - RNA, 64 nt, Homo Sapiens; identical to SEQ ID NO: 74299

SEQ ID NO: 264391 - RNA, 64 nt, Homo Sapiens; identical to SEQ ID NO: 74300

SEQ ID NO: 264392 - RNA, 64 nt, Homo Sapiens; identical to SEQ ID NO: 74301

SEQ ID NO: 264393 - RNA, 64 nt, Homo Sapiens; identical to SEQ ID NO: 74302

SEQ ID NO: 264394 - RNA, 64 nt, Homo Sapiens; identical to SEQ ID NO: 74303

SEQ ID NO: 264395 - RNA, 64 nt, Homo Sapiens; identical to SEQ ID NO: 74304

SEQ ID NO: 264396 - RNA, 64 nt, Homo Sapiens; identical to SEQ ID NO: 74305

SEQ ID NO: 264397 - RNA, 64 nt, Homo Sapiens; identical to SEQ ID NO: 74306

SEQ ID NO: 264398 - RNA, 64 nt, Homo Sapiens; identical to SEQ ID NO: 74307

SEQ ID NO: 264399 - RNA, 64 nt, Homo Sapiens; identical to SEQ ID NO: 74308

SEQ ID NO: 264400 - RNA, 64 nt, Homo Sapiens; identical to SEQ ID NO: 74309

SEQ ID NO: 264401 - RNA, 64 nt, Homo Sapiens; identical to SEQ ID NO: 74310

SEQ ID NO: 264402 - RNA, 64 nt, Homo Sapiens; identical to SEQ ID NO: 74311

SEQ ID NO: 264403 - RNA, 64 nt, Homo Sapiens; identical to SEQ ID NO: 74312

SEQ ID NO: 264404 - RNA, 64 nt, Homo Sapiens; identical to SEQ ID NO: 74313

SEQ ID NO: 264405 - RNA, 64 nt, Homo Sapiens; identical to SEQ ID NO: 87364

SEQ ID NO: 264406 - RNA, 64 nt, Homo Sapiens; identical to SEQ ID NO: 87365

SEQ ID NO: 264407 - RNA, 64 nt, Homo Sapiens; identical to SEQ ID NO: 87366

SEQ ID NO: 264408 - RNA, 64 nt, Homo Sapiens; identical to SEQ ID NO: 87367

SEQ ID NO: 264409 - RNA, 64 nt, Homo Sapiens; identical to SEQ ID NO: 87368

SEQ ID NO: 264410 - RNA, 64 nt, Homo Sapiens; identical to SEQ ID NO: 87369

SEQ ID NO: 264411 - RNA, 64 nt, Homo Sapiens; identical to SEQ ID NO: 87370

SEQ ID NO: 264412 - RNA, 64 nt, Homo Sapiens; identical to SEQ ID NO: 87371

SEQ ID NO: 264413 - RNA, 64 nt, Homo Sapiens; identical to SEQ ID NO: 87372

SEQ ID NO: 264414 - RNA, 64 nt, Homo Sapiens; identical to SEQ ID NO: 87373

SEQ ID NO: 264415 - RNA, 64 nt, Homo Sapiens; identical to SEQ ID NO: 87374

SEQ ID NO: 264416 - RNA, 64 nt, Homo Sapiens; identical to SEQ ID NO: 87375

SEQ ID NO: 264417 - RNA, 64 nt, Homo Sapiens; identical to SEQ ID NO: 87376

SEQ ID NO: 264418 - RNA, 64 nt, Homo Sapiens; identical to SEQ ID NO: 87377

SEQ ID NO: 264419 - RNA, 64 nt, Homo Sapiens; identical to SEQ ID NO: 87378

SEQ ID NO: 264420 - RNA, 64 nt, Homo Sapiens; identical to SEQ ID NO: 87379

SEQ ID NO: 264421 - RNA, 64 nt, Homo Sapiens; identical to SEQ ID NO: 87380

SEQ ID NO: 264422 - RNA, 64 nt, Homo Sapiens; identical to SEQ ID NO: 87381

SEQ ID NO: 264423 - RNA, 64 nt, Homo Sapiens; identical to SEQ ID NO: 87382

SEQ ID NO: 264424 - RNA, 64 nt, Homo Sapiens; identical to SEQ ID NO: 87383

SEQ ID NO: 264425 - RNA, 64 nt, Homo Sapiens; identical to SEQ ID NO: 87384

SEQ ID NO: 264426 - RNA, 64 nt, Homo Sapiens; identical to SEQ ID NO: 87385

SEQ ID NO: 264427 - RNA, 64 nt, Homo Sapiens; identical to SEQ ID NO: 87386

SEQ ID NO: 264428 - RNA, 64 nt, Homo Sapiens; identical to SEQ ID NO: 87387

SEQ ID NO: 264429 - RNA, 64 nt, Homo Sapiens; identical to SEQ ID NO: 87388

SEQ ID NO: 264430 - RNA, 64 nt, Homo Sapiens; identical to SEQ ID NO: 87389

SEQ ID NO: 264431 - RNA, 64 nt, Homo Sapiens; identical to SEQ ID NO: 87390

SEQ ID NO: 264432 - RNA, 64 nt, Homo Sapiens; identical to SEQ ID NO: 87391

SEQ ID NO: 264433 - RNA, 64 nt, Homo Sapiens; identical to SEQ ID NO: 87392

SEQ ID NO: 264434 - RNA, 64 nt, Homo Sapiens; identical to SEQ ID NO: 87393

SEQ ID NO: 264435 - RNA, 64 nt, Homo Sapiens; identical to SEQ ID NO: 87394

SEQ ID NO: 264436 - RNA, 64 nt, Homo Sapiens; identical to SEQ ID NO: 87395

SEQ ID NO: 264437 - RNA, 64 nt, Homo Sapiens; identical to SEQ ID NO: 87396

SEQ ID NO: 264438 - RNA, 64 nt, Homo Sapiens; identical to SEQ ID NO: 87397

SEQ ID NO: 264439 - RNA, 64 nt, Homo Sapiens; identical to SEQ ID NO: 87398

SEQ ID NO: 264440 - RNA, 64 nt, Homo Sapiens; identical to SEQ ID NO: 87399

SEQ ID NO: 264441 - RNA, 64 nt, Homo Sapiens; identical to SEQ ID NO: 87400

SEQ ID NO: 264442 - RNA, 64 nt, Homo Sapiens; identical to SEQ ID NO: 87401

SEQ ID NO: 264443 - RNA, 64 nt, Homo Sapiens; identical to SEQ ID NO: 87402

SEQ ID NO: 264444 - RNA, 64 nt, Homo Sapiens; identical to SEQ ID NO: 87403

SEQ ID NO: 264445 - RNA, 64 nt, Homo Sapiens; identical to SEQ ID NO: 87404

SEQ ID NO: 264446 - RNA, 64 nt, Homo Sapiens; identical to SEQ ID NO: 87405

SEQ ID NO: 264447 - RNA, 64 nt, Homo Sapiens; identical to SEQ ID NO: 87406

SEQ ID NO: 264448 - RNA, 64 nt, Homo Sapiens
caaccaugcccuucugagcuuuagccagcaguuucaguuauacuaugccaccccaagcguaauu

SEQ ID NO: 264449 - RNA, 64 nt, Homo Sapiens
uggaaucuugagacaaaaccaauucagugcuauccaguuauaaaaggcacuugccauuaauccu

SEQ ID NO: 264450 - RNA, 64 nt, Homo Sapiens
aaauaggcuuuuuaaucaugaauaugaugacaaucaguuauacaguuauaaaauuaaaaguuug

SEQ ID NO: 264451 - RNA, 64 nt, Homo Sapiens
uuuuuaaucaugaauaugaugacaaucaguuauacaguuauaaaauuaaaaguuugaaaagcaa

SEQ ID NO: 264452 - RNA, 64 nt, Homo Sapiens
uuuuuauguuuccuuuaugccaaacauaacaaaacaguuauauagacugcuuuagcaaaguaca

SEQ ID NO: 264453 - RNA, 64 nt, Homo Sapiens
uaauacaauauuuuauuuuaauauaaacaucugucaguuauagacaaagauaauaauucacaaa

SEQ ID NO: 264454 - RNA, 64 nt, Homo Sapiens
gauuauaccuuauaauacacgauuugagcuauaucaguuauaccuaaagaagcuuucaugauua

SEQ ID NO: 264455 - RNA, 64 nt, Homo Sapiens
uguugagcaguuuacuuccuaaacaccuauugagcaguuauaccauugggacucaacucuuuga

SEQ ID NO: 264456 - RNA, 64 nt, Homo Sapiens
uggaagcgguggucagaagguuguuuuauacgagaacaggcagaaagugcccauuguucaggau

SEQ ID NO: 264457 - RNA, 64 nt, Homo Sapiens
auguguuuuauuuugaagugagaaaaugaacauuaacaggcauguuuguacagcuagaauauau

SEQ ID NO: 264458 - RNA, 64 nt, Homo Sapiens
ggaucagaugccccugacacgcucccugggugggaacaggcaagaccuguguccgugccguccg

SEQ ID NO: 264459 - RNA, 64 nt, Homo Sapiens
uuggaaaagcuaugguucgacuguucccauauugaacaggcagauauguuacucucuuuaaaau

SEQ ID NO: 264460 - RNA, 64 nt, Homo Sapiens
augacucagcagggaugacucagcaccgccccucaacaggcaugacucugcagagaugacucag

SEQ ID NO: 264461 - RNA, 64 nt, Homo Sapiens
augacucagcagggaugacucagcaccgccccucaacaggcaugacucugcagagaugacuuag

SEQ ID NO: 264462 - RNA, 64 nt, Homo Sapiens; identical to SEQ ID NO: 264460

SEQ ID NO: 264463 - RNA, 62 nt, Homo Sapiens
gaaauuaaccaggaagauguuuccaccaagccugcugugagucaauugagggaguguuuggg

SEQ ID NO: 264464 - RNA, 62 nt, Homo Sapiens
gcuggggugggcagggaagggaagccgggggcugcugugagggaucuuggagcuucccugua

SEQ ID NO: 264465 - RNA, 62 nt, Homo Sapiens
aacaacaacaaaaaauaaauccaucaacaaaaugcugugaacauacgacaguguuccaaauc

SEQ ID NO: 264466 - RNA, 62 nt, Homo Sapiens
gagaaguuugccccaauuaaggccguggcagaugcugugauuaacacugcucgcuacaagcu

SEQ ID NO: 264467 - RNA, 62 nt, Homo Sapiens
ugagggaaucugaaauguuuugcuuauugaugugcugugauaaagucagucuauguacauac

SEQ ID NO: 264468 - RNA, 62 nt, Homo Sapiens
cauuuugucucuagcuucuaggaaacugugcuugcugugaucagcguuccuuauucuuugag

SEQ ID NO: 264469 - RNA, 62 nt, Homo Sapiens
ccacagaucaaucucugcagaugacagggaggugcugugagaagugcaccaggcagcuuucu

SEQ ID NO: 264470 - RNA, 62 nt, Homo Sapiens
gaaccugggcuguggcucucugucguuuguggugcugugauggugucuacuguuagaauagc

SEQ ID NO: 264471 - RNA, 62 nt, Homo Sapiens
ucaccacucuuuccugaugcgccucccuccuuugcugugacaugugcauguucuuagccacc

SEQ ID NO: 264472 - RNA, 62 nt, Homo Sapiens
auuuucugccaaagaccaugaaguauuuuuugugcugugaacaauauuugguauuucuuuua

SEQ ID NO: 264473 - RNA, 62 nt, Homo Sapiens
auaggccagagccauuguucacccucccaaaaugcugugauucaaacucccgaucucaagcc

SEQ ID NO: 264474 - RNA, 62 nt, Homo Sapiens
gaguguccuuucccaucugucuggagcaaagcugcugugagacgcaguguugggcuugguga

SEQ ID NO: 264475 - RNA, 62 nt, Homo Sapiens
acuacuccacguguuuuuccauccaaucacacugcugugauucagggaucuuucuucuaaga

SEQ ID NO: 264476 - RNA, 62 nt, Homo Sapiens
uuuucagugagcguggugacugcagagguuagugcugugaaaagcugggcuaaauauucuuu

SEQ ID NO: 264477 - RNA, 62 nt, Homo Sapiens
ucugaaaaggccugggagcagaauggcuggccugcugugagcaggagaggagauucuaagaa

SEQ ID NO: 264478 - RNA, 62 nt, Homo Sapiens
uuaccuuugcuccucuccugugauucccaccaugcugugacccucagcugucucccuuugcu

SEQ ID NO: 264479 - RNA, 62 nt, Homo Sapiens
uuagccuccugagcaucugggacuacagccauugcugugaauuacgugagggaaagauauug

SEQ ID NO: 264480 - RNA, 62 nt, Homo Sapiens
ugcauucugcgagucugugcucauuaacaaugugcugugaccaugugacucagcaauccugc

SEQ ID NO: 264481 - RNA, 62 nt, Homo Sapiens
ugucccacuuuuuuaaccacuccgcacaucagugcugugaaggcaaccucaccauguauuuu

SEQ ID NO: 264482 - RNA, 62 nt, Homo Sapiens
aaugucauacaaaaaauguauuuguuuuuuugugcugugagaauugauguuuguagauuaau

SEQ ID NO: 264483 - RNA, 62 nt, Homo Sapiens
aaucuaaaaucaaccaggcucaagcaugauuuugcugugacaucugccaggccucgagcauc

SEQ ID NO: 264484 - RNA, 62 nt, Homo Sapiens
auucuaagaucaaccagguugcaugaugauuuugcugugacagccaggccccaagcaucuga

SEQ ID NO: 264485 - RNA, 62 nt, Homo Sapiens
ucuguuguacuuuaauuauuguuuugccuuguugcugugaccucccuaagacacugaagaua

SEQ ID NO: 264486 - RNA, 62 nt, Homo Sapiens
aaaagucaucuguucauuaggagaacucaaguugcugugacuuuucucauccaaaagacuca

SEQ ID NO: 264487 - RNA, 62 nt, Homo Sapiens
aggauccucaccacccaaaggguggugggcacugcugugaccaccccagcugcagagucagu

SEQ ID NO: 264488 - RNA, 62 nt, Homo Sapiens
cuuuaggcaccaucuguucccaucgcgccugcugcugugacccguuuuggaaaacuggugug

SEQ ID NO: 264489 - RNA, 62 nt, Homo Sapiens
uugaugcuggccagggaagcuucgacucuggaugcugugagcgagggucuugucugcuguga

SEQ ID NO: 264490 - RNA, 62 nt, Homo Sapiens
cgacucuggaugcugugagcgagggucuugucugcugugauuuccccggguugguggccaug

SEQ ID NO: 264491 - RNA, 62 nt, Homo Sapiens
gccccaccuugcagcuaaaugugauccugccuugcugugaaauuucuguaccuucaaccugg

SEQ ID NO: 264492 - RNA, 62 nt, Homo Sapiens
cacuccccacccugcucccuucccagagggauugcugugaaauuuuuuugguggcaaauaaa

SEQ ID NO: 264493 - RNA, 62 nt, Homo Sapiens
uaaaguaugucauuuaugcuuaaugucagugcugcugugaacacauuuuguguagacaauuu

SEQ ID NO: 264494 - RNA, 62 nt, Homo Sapiens
cuguuuuaaguccauaccuucuuucgcagaaaugcugugauuauagauggagaguuugaggg

SEQ ID NO: 264495 - RNA, 62 nt, Homo Sapiens
ugaaaucuuucccacaucucaguuaugaaaaaugcugugacuaaugaccauuguuuauaaac

SEQ ID NO: 264496 - RNA, 62 nt, Homo Sapiens
auucauguacagguuuuuaucccuaauaaagcugcugugaacgaguuguuuucaguuuuuug

SEQ ID NO: 264497 - RNA, 62 nt, Homo Sapiens
uauuaaagaguuagccauauauacuaaacagaugcugugauuucuuagcauucaaacugcag

SEQ ID NO: 264498 - RNA, 62 nt, Homo Sapiens
auuccgagcuguucccuggggggggcuuccaaugcugugagaggccuugcagagcucaagaa

SEQ ID NO: 264499 - RNA, 62 nt, Homo Sapiens
uugugcaaccagggcccacggcgccccuccugugcugugacgugugugucguggcuggcccc

SEQ ID NO: 264500 - RNA, 62 nt, Homo Sapiens
gccuaccgcccuggccgugucugucuggugugugcugugaaccccugcacccaaccccacau

SEQ ID NO: 264501 - RNA, 62 nt, Homo Sapiens
cugcagacgucugguggcagcgucuacuccauugcugugacaaaucaccacauugucugugg

SEQ ID NO: 264502 - RNA, 62 nt, Homo Sapiens
uggccuugagguuggugugcacaggcacuggcugcugugagugggggggcauggggcaguuu

SEQ ID NO: 264503 - RNA, 62 nt, Homo Sapiens
cagggugccugaccugugugccggcugcucacugcugugaccagcagccgagcccuuggccc

SEQ ID NO: 264504 - RNA, 62 nt, Homo Sapiens
cggugccucggucacucugggggcaguuuagaugcugugaaauuaaaccuguucuaagugua

SEQ ID NO: 264505 - RNA, 62 nt, Homo Sapiens
cccaagguuuugauggaguucacacugggagaugcugugagcaacuuagaugugaaaaucua

SEQ ID NO: 264506 - RNA, 62 nt, Homo Sapiens
aaccuuaaggguguguggauauaccgucagagugcugugaaaucauuugcaaaacacacaua

SEQ ID NO: 264507 - RNA, 62 nt, Homo Sapiens
caacucucuaguuacuugauaaaagcuaauauugcugugauuaaagaaguacagauuuuuua

SEQ ID NO: 264508 - RNA, 62 nt, Homo Sapiens
acaggcuuaagccacagcgcggcuucccaaagugcugugauuccucaugcucugcccagcuu

SEQ ID NO: 264509 - RNA, 62 nt, Homo Sapiens
auagaaaucuuggucagggcugguguguucugugcugugacuuacacuuucccacguugagg

SEQ ID NO: 264510 - RNA, 62 nt, Homo Sapiens
ugaaugaaggagaggcuccuccaagucuguguugcugugaaacuguguauuguuuaagcucg

SEQ ID NO: 264511 - RNA, 62 nt, Homo Sapiens
guuuugacagagcacuuuaucagcugaaaaccugcugugagaaaguagccaucuccuuguuc

SEQ ID NO: 264512 - RNA, 62 nt, Homo Sapiens
aguccucuuggacacagguugcuucagaauuuugcugugaacaggacauuccuucuaugagc

SEQ ID NO: 264513 - RNA, 64 nt, Homo Sapiens
agcccuccuacgcagaugcugucacuggcagagcacagcccacggggaucacagcguuucagga

SEQ ID NO: 264514 - RNA, 64 nt, Homo Sapiens
ccuggucgucuaucccaguguguguuuaacauucacagcccagaaccacagaugugucugggag

SEQ ID NO: 264515 - RNA, 64 nt, Homo Sapiens
acgcgcuugcugaaacgacuccaacagcuaguucacagcccagcuuuguacguugguuaccaua

SEQ ID NO: 264516 - RNA, 64 nt, Homo Sapiens
guggagcaggaucuucauucaucucaccagagcaacagcccaguccugaggaugggagggacgu

SEQ ID NO: 264517 - RNA, 64 nt, Homo Sapiens
uuccccagaaacgaucaagaagggcaauggguugacagcccagauauggcaggaccagacugca

SEQ ID NO: 264518 - RNA, 64 nt, Homo Sapiens
auauggcaggaccagacugcaaugggaaucucauacagcccauucagacuaaagggugauggaa

SEQ ID NO: 264519 - RNA, 64 nt, Homo Sapiens
ugguccagagagggucugggauucccaaggucacacagcccagaagagauggggcuggguuaag

SEQ ID NO: 264520 - RNA, 64 nt, Homo Sapiens
agccauuaagggggcucaucuaggaauucugguuacagcccagugcucaucccagcguaugcug

SEQ ID NO: 264521 - RNA, 64 nt, Homo Sapiens
cgugagcucccuccucacccacagcaaggaauccacagcccacaccugcccccagccuggcugg

SEQ ID NO: 264522 - RNA, 64 nt, Homo Sapiens
ucacacguggggucagcagagggcagggacagggacagcccaggcccgggccacaauagggaca

SEQ ID NO: 264523 - RNA, 64 nt, Homo Sapiens
gccaccgucuacagauggcuuaguuaagucauccacagcccaagggcggggcuaugccuugucu

SEQ ID NO: 264524 - RNA, 64 nt, Homo Sapiens
ccuaguggcuuccuccgucugcaaugucccuugcacagcccacacaugaaccauccuucccaug

SEQ ID NO: 264525 - RNA, 64 nt, Homo Sapiens
acaacuccaaagcccuugugggaaucacccgauaacagcccaucaucacagacgaguggccacc

SEQ ID NO: 264526 - RNA, 64 nt, Homo Sapiens
caccuucuucaacucucccagaccucccauugccacagcccaagcugcacccuguuugcucgca

SEQ ID NO: 264527 - RNA, 64 nt, Homo Sapiens
agcccuucgugaauccugcacacagacccaccacacagcccagcucagccacagcagagccaau

SEQ ID NO: 264528 - RNA, 64 nt, Homo Sapiens
cacaucaaacuugcuaagcgucuguccaccagccacagcccaaaccauugaaaauaucucugug

SEQ ID NO: 264529 - RNA, 64 nt, Homo Sapiens
cauagacgagcuggcguuggucugcuucccuggcacagcccagggcacagcccacccacuuucc

SEQ ID NO: 264530 - RNA, 64 nt, Homo Sapiens
cacuuuccucugcuucccugcucaccuccugugcacagcccacccagugccuuuuaagggggac

SEQ ID NO: 264531 - RNA, 64 nt, Homo Sapiens
ugagcaugaggcccagcccacuugaagcccagccacagcccagcgaugcugggaacaaaggccu

SEQ ID NO: 264532 - RNA, 64 nt, Homo Sapiens
uuccgguucucccaacucagcgaaggacaagcccacagcccagaacaccugcuguuccuggagu

SEQ ID NO: 264533 - RNA, 64 nt, Homo Sapiens
cuaggaaugcgccauggcugcuaugacaauuugcacagcccaguggcuuaaacaccauuuauac

SEQ ID NO: 264534 - RNA, 64 nt, Homo Sapiens
ccuggcuguccggaugaaguaccagagugacgccacagcccaucccggugacaugcucaccccc

SEQ ID NO: 264535 - RNA, 64 nt, Homo Sapiens
uggcuuugccauaauucagugucaccaauaaggcacagcccaguuagcagcuuagccccccuag

SEQ ID NO: 264536 - RNA, 64 nt, Homo Sapiens
agcuagugaggcauaauuugcucaaaguauagaaacagcccaccugugcccacuuugaccauug

SEQ ID NO: 264537 - RNA, 64 nt, Homo Sapiens
gggcaccccgacguagcugccccccuggggggccacagcccagagaaccagccuaggaacacuc

SEQ ID NO: 264538 - RNA, 64 nt, Homo Sapiens
accuuccgcaccagagggacacuccacagaagccacagcccaguaagucaggcgcuucugcggc

SEQ ID NO: 264539 - RNA, 64 nt, Homo Sapiens
cccccauacccugcugucuccacggagggaggucacagcccaucacgcaggacacugugauugu

SEQ ID NO: 264540 - RNA, 64 nt, Homo Sapiens
ugcuugagucacugaaaucaaaguacucaggcacacagcccacugacaagagacaccucaucca

SEQ ID NO: 264541 - RNA, 64 nt, Homo Sapiens
uggggaaaucgauuucacaauccaaaaauggcccacagcccaggaagcuacccugaacaugcca

SEQ ID NO: 264542 - RNA, 64 nt, Homo Sapiens
ccuucaggcaugcaauaugccagaacuacagacaacagcccacaggaugcaaaagugcuuugcc

SEQ ID NO: 264543 - RNA, 64 nt, Homo Sapiens; identical to SEQ ID NO: 49894

SEQ ID NO: 264544 - RNA, 64 nt, Homo Sapiens; identical to SEQ ID NO: 49895

SEQ ID NO: 264545 - RNA, 64 nt, Homo Sapiens; identical to SEQ ID NO: 49896

SEQ ID NO: 264546 - RNA, 64 nt, Homo Sapiens; identical to SEQ ID NO: 49897

SEQ ID NO: 264547 - RNA, 64 nt, Homo Sapiens; identical to SEQ ID NO: 49898

SEQ ID NO: 264548 - RNA, 64 nt, Homo Sapiens; identical to SEQ ID NO: 49899

SEQ ID NO: 264549 - RNA, 64 nt, Homo Sapiens; identical to SEQ ID NO: 49900

SEQ ID NO: 264550 - RNA, 64 nt, Homo Sapiens; identical to SEQ ID NO: 49901

SEQ ID NO: 264551 - RNA, 64 nt, Homo Sapiens; identical to SEQ ID NO: 49902

SEQ ID NO: 264552 - RNA, 64 nt, Homo Sapiens; identical to SEQ ID NO: 49903

SEQ ID NO: 264553 - RNA, 64 nt, Homo Sapiens; identical to SEQ ID NO: 49904

SEQ ID NO: 264554 - RNA, 64 nt, Homo Sapiens; identical to SEQ ID NO: 49905

SEQ ID NO: 264555 - RNA, 64 nt, Homo Sapiens; identical to SEQ ID NO: 49906

SEQ ID NO: 264556 - RNA, 64 nt, Homo Sapiens; identical to SEQ ID NO: 49907

SEQ ID NO: 264557 - RNA, 64 nt, Homo Sapiens; identical to SEQ ID NO: 49908

SEQ ID NO: 264558 - RNA, 64 nt, Homo Sapiens; identical to SEQ ID NO: 49909

SEQ ID NO: 264559 - RNA, 64 nt, Homo Sapiens; identical to SEQ ID NO: 49910

SEQ ID NO: 264560 - RNA, 64 nt, Homo Sapiens; identical to SEQ ID NO: 49911

SEQ ID NO: 264561 - RNA, 64 nt, Homo Sapiens; identical to SEQ ID NO: 49912

SEQ ID NO: 264562 - RNA, 64 nt, Homo Sapiens; identical to SEQ ID NO: 49913

SEQ ID NO: 264563 - RNA, 64 nt, Homo Sapiens; identical to SEQ ID NO: 49914

SEQ ID NO: 264564 - RNA, 64 nt, Homo Sapiens; identical to SEQ ID NO: 49915

SEQ ID NO: 264565 - RNA, 64 nt, Homo Sapiens; identical to SEQ ID NO: 49916

SEQ ID NO: 264566 - RNA, 64 nt, Homo Sapiens; identical to SEQ ID NO: 49917

SEQ ID NO: 264567 - RNA, 64 nt, Homo Sapiens; identical to SEQ ID NO: 49918

SEQ ID NO: 264568 - RNA, 64 nt, Homo Sapiens; identical to SEQ ID NO: 49919

SEQ ID NO: 264569 - RNA, 64 nt, Homo Sapiens; identical to SEQ ID NO: 49920

SEQ ID NO: 264570 - RNA, 64 nt, Homo Sapiens; identical to SEQ ID NO: 49921

SEQ ID NO: 264571 - RNA, 52 nt, Homo Sapiens; identical to SEQ ID NO: 49922

SEQ ID NO: 264572 - RNA, 64 nt, Homo Sapiens; identical to SEQ ID NO: 49923

SEQ ID NO: 264573 - RNA, 64 nt, Homo Sapiens; identical to SEQ ID NO: 49924

SEQ ID NO: 264574 - RNA, 64 nt, Homo Sapiens; identical to SEQ ID NO: 49925

SEQ ID NO: 264575 - RNA, 64 nt, Homo Sapiens; identical to SEQ ID NO: 49926

SEQ ID NO: 264576 - RNA, 64 nt, Homo Sapiens; identical to SEQ ID NO: 49927

SEQ ID NO: 264577 - RNA, 64 nt, Homo Sapiens; identical to SEQ ID NO: 49928

SEQ ID NO: 264578 - RNA, 64 nt, Homo Sapiens; identical to SEQ ID NO: 49929

SEQ ID NO: 264579 - RNA, 64 nt, Homo Sapiens; identical to SEQ ID NO: 49930

SEQ ID NO: 264580 - RNA, 64 nt, Homo Sapiens; identical to SEQ ID NO: 49931

SEQ ID NO: 264581 - RNA, 64 nt, Homo Sapiens; identical to SEQ ID NO: 49932

SEQ ID NO: 264582 - RNA, 64 nt, Homo Sapiens; identical to SEQ ID NO: 49933

SEQ ID NO: 264583 - RNA, 64 nt, Homo Sapiens; identical to SEQ ID NO: 49934

SEQ ID NO: 264584 - RNA, 64 nt, Homo Sapiens; identical to SEQ ID NO: 264513

SEQ ID NO: 264585 - RNA, 64 nt, Homo Sapiens; identical to SEQ ID NO: 264514

SEQ ID NO: 264586 - RNA, 64 nt, Homo Sapiens; identical to SEQ ID NO: 264515

SEQ ID NO: 264587 - RNA, 64 nt, Homo Sapiens; identical to SEQ ID NO: 264516

SEQ ID NO: 264588 - RNA, 64 nt, Homo Sapiens; identical to SEQ ID NO: 264517

SEQ ID NO: 264589 - RNA, 64 nt, Homo Sapiens; identical to SEQ ID NO: 264518

SEQ ID NO: 264590 - RNA, 64 nt, Homo Sapiens; identical to SEQ ID NO: 264519

SEQ ID NO: 264591 - RNA, 64 nt, Homo Sapiens; identical to SEQ ID NO: 264520

SEQ ID NO: 264592 - RNA, 64 nt, Homo Sapiens; identical to SEQ ID NO: 264521

SEQ ID NO: 264593 - RNA, 64 nt, Homo Sapiens; identical to SEQ ID NO: 264522

SEQ ID NO: 264594 - RNA, 64 nt, Homo Sapiens; identical to SEQ ID NO: 264523

SEQ ID NO: 264595 - RNA, 64 nt, Homo Sapiens; identical to SEQ ID NO: 264524

SEQ ID NO: 264596 - RNA, 64 nt, Homo Sapiens; identical to SEQ ID NO: 264525

SEQ ID NO: 264597 - RNA, 64 nt, Homo Sapiens; identical to SEQ ID NO: 264526

SEQ ID NO: 264598 - RNA, 64 nt, Homo Sapiens; identical to SEQ ID NO: 264527

SEQ ID NO: 264599 - RNA, 64 nt, Homo Sapiens; identical to SEQ ID NO: 264528

SEQ ID NO: 264600 - RNA, 64 nt, Homo Sapiens; identical to SEQ ID NO: 264529

SEQ ID NO: 264601 - RNA, 64 nt, Homo Sapiens; identical to SEQ ID NO: 264530

SEQ ID NO: 264602 - RNA, 64 nt, Homo Sapiens; identical to SEQ ID NO: 264531

SEQ ID NO: 264603 - RNA, 64 nt, Homo Sapiens; identical to SEQ ID NO: 264532

SEQ ID NO: 264604 - RNA, 64 nt, Homo Sapiens; identical to SEQ ID NO: 264533

SEQ ID NO: 264605 - RNA, 64 nt, Homo Sapiens; identical to SEQ ID NO: 264534

SEQ ID NO: 264606 - RNA, 64 nt, Homo Sapiens; identical to SEQ ID NO: 264535

SEQ ID NO: 264607 - RNA, 64 nt, Homo Sapiens; identical to SEQ ID NO: 264536

SEQ ID NO: 264608 - RNA, 64 nt, Homo Sapiens; identical to SEQ ID NO: 264537

SEQ ID NO: 264609 - RNA, 64 nt, Homo Sapiens; identical to SEQ ID NO: 264538

SEQ ID NO: 264610 - RNA, 64 nt, Homo Sapiens; identical to SEQ ID NO: 264539

SEQ ID NO: 264611 - RNA, 64 nt, Homo Sapiens; identical to SEQ ID NO: 264540

SEQ ID NO: 264612 - RNA, 64 nt, Homo Sapiens; identical to SEQ ID NO: 264541

SEQ ID NO: 264613 - RNA, 64 nt, Homo Sapiens; identical to SEQ ID NO: 264542

SEQ ID NO: 264614 - RNA, 64 nt, Homo Sapiens; identical to SEQ ID NO: 49894

SEQ ID NO: 264615 - RNA, 64 nt, Homo Sapiens; identical to SEQ ID NO: 49895

SEQ ID NO: 264616 - RNA, 64 nt, Homo Sapiens; identical to SEQ ID NO: 49896

SEQ ID NO: 264617 - RNA, 64 nt, Homo Sapiens; identical to SEQ ID NO: 49897

SEQ ID NO: 264618 - RNA, 64 nt, Homo Sapiens; identical to SEQ ID NO: 49898

SEQ ID NO: 264619 - RNA, 64 nt, Homo Sapiens; identical to SEQ ID NO: 49899

SEQ ID NO: 264620 - RNA, 64 nt, Homo Sapiens; identical to SEQ ID NO: 49900

SEQ ID NO: 264621 - RNA, 64 nt, Homo Sapiens; identical to SEQ ID NO: 49901

SEQ ID NO: 264622 - RNA, 64 nt, Homo Sapiens; identical to SEQ ID NO: 49902

SEQ ID NO: 264623 - RNA, 64 nt, Homo Sapiens; identical to SEQ ID NO: 49903

SEQ ID NO: 264624 - RNA, 64 nt, Homo Sapiens; identical to SEQ ID NO: 49904

SEQ ID NO: 264625 - RNA, 64 nt, Homo Sapiens; identical to SEQ ID NO: 49905

SEQ ID NO: 264626 - RNA, 64 nt, Homo Sapiens; identical to SEQ ID NO: 49906

SEQ ID NO: 264627 - RNA, 64 nt, Homo Sapiens; identical to SEQ ID NO: 49907

SEQ ID NO: 264628 - RNA, 64 nt, Homo Sapiens; identical to SEQ ID NO: 49908

SEQ ID NO: 264629 - RNA, 64 nt, Homo Sapiens; identical to SEQ ID NO: 49909

SEQ ID NO: 264630 - RNA, 64 nt, Homo Sapiens; identical to SEQ ID NO: 49910

SEQ ID NO: 264631 - RNA, 64 nt, Homo Sapiens; identical to SEQ ID NO: 49911

SEQ ID NO: 264632 - RNA, 64 nt, Homo Sapiens; identical to SEQ ID NO: 49912

SEQ ID NO: 264633 - RNA, 64 nt, Homo Sapiens; identical to SEQ ID NO: 49913

SEQ ID NO: 264634 - RNA, 64 nt, Homo Sapiens; identical to SEQ ID NO: 49914

SEQ ID NO: 264635 - RNA, 64 nt, Homo Sapiens; identical to SEQ ID NO: 49915

SEQ ID NO: 264636 - RNA, 64 nt, Homo Sapiens; identical to SEQ ID NO: 49916

SEQ ID NO: 264637 - RNA, 64 nt, Homo Sapiens; identical to SEQ ID NO: 49917

SEQ ID NO: 264638 - RNA, 64 nt, Homo Sapiens; identical to SEQ ID NO: 49918

SEQ ID NO: 264639 - RNA, 64 nt, Homo Sapiens; identical to SEQ ID NO: 49919

SEQ ID NO: 264640 - RNA, 64 nt, Homo Sapiens; identical to SEQ ID NO: 49920

SEQ ID NO: 264641 - RNA, 64 nt, Homo Sapiens; identical to SEQ ID NO: 49921

SEQ ID NO: 264642 - RNA, 52 nt, Homo Sapiens; identical to SEQ ID NO: 49922

SEQ ID NO: 264643 - RNA, 64 nt, Homo Sapiens; identical to SEQ ID NO: 49923

SEQ ID NO: 264644 - RNA, 64 nt, Homo Sapiens; identical to SEQ ID NO: 49924

SEQ ID NO: 264645 - RNA, 64 nt, Homo Sapiens; identical to SEQ ID NO: 49925

SEQ ID NO: 264646 - RNA, 64 nt, Homo Sapiens; identical to SEQ ID NO: 49926

SEQ ID NO: 264647 - RNA, 64 nt, Homo Sapiens; identical to SEQ ID NO: 49927

SEQ ID NO: 264648 - RNA, 64 nt, Homo Sapiens; identical to SEQ ID NO: 49928

SEQ ID NO: 264649 - RNA, 64 nt, Homo Sapiens; identical to SEQ ID NO: 49929

SEQ ID NO: 264650 - RNA, 64 nt, Homo Sapiens; identical to SEQ ID NO: 49930

SEQ ID NO: 264651 - RNA, 64 nt, Homo Sapiens; identical to SEQ ID NO: 49931

SEQ ID NO: 264652 - RNA, 64 nt, Homo Sapiens; identical to SEQ ID NO: 49932

SEQ ID NO: 264653 - RNA, 64 nt, Homo Sapiens; identical to SEQ ID NO: 49933

SEQ ID NO: 264654 - RNA, 64 nt, Homo Sapiens; identical to SEQ ID NO: 49934

SEQ ID NO: 264655 - RNA, 64 nt, Homo Sapiens; identical to SEQ ID NO: 108766

SEQ ID NO: 264656 - RNA, 64 nt, Homo Sapiens; identical to SEQ ID NO: 108767

SEQ ID NO: 264657 - RNA, 64 nt, Homo Sapiens; identical to SEQ ID NO: 108768

SEQ ID NO: 264658 - RNA, 64 nt, Homo Sapiens; identical to SEQ ID NO: 108769

SEQ ID NO: 264659 - RNA, 64 nt, Homo Sapiens; identical to SEQ ID NO: 108770

SEQ ID NO: 264660 - RNA, 64 nt, Homo Sapiens; identical to SEQ ID NO: 108771

SEQ ID NO: 264661 - RNA, 64 nt, Homo Sapiens; identical to SEQ ID NO: 108772

SEQ ID NO: 264662 - RNA, 64 nt, Homo Sapiens; identical to SEQ ID NO: 108773

SEQ ID NO: 264663 - RNA, 64 nt, Homo Sapiens; identical to SEQ ID NO: 108774

SEQ ID NO: 264664 - RNA, 64 nt, Homo Sapiens; identical to SEQ ID NO: 108775

SEQ ID NO: 264665 - RNA, 64 nt, Homo Sapiens; identical to SEQ ID NO: 108776

SEQ ID NO: 264666 - RNA, 64 nt, Homo Sapiens; identical to SEQ ID NO: 108777

SEQ ID NO: 264667 - RNA, 64 nt, Homo Sapiens; identical to SEQ ID NO: 108778

SEQ ID NO: 264668 - RNA, 64 nt, Homo Sapiens; identical to SEQ ID NO: 108779

SEQ ID NO: 264669 - RNA, 64 nt, Homo Sapiens; identical to SEQ ID NO: 108780

SEQ ID NO: 264670 - RNA, 64 nt, Homo Sapiens; identical to SEQ ID NO: 108781

SEQ ID NO: 264671 - RNA, 64 nt, Homo Sapiens; identical to SEQ ID NO: 108782

SEQ ID NO: 264672 - RNA, 64 nt, Homo Sapiens; identical to SEQ ID NO: 108783

SEQ ID NO: 264673 - RNA, 64 nt, Homo Sapiens; identical to SEQ ID NO: 108784

SEQ ID NO: 264674 - RNA, 64 nt, Homo Sapiens; identical to SEQ ID NO: 108785

SEQ ID NO: 264675 - RNA, 64 nt, Homo Sapiens; identical to SEQ ID NO: 108786

SEQ ID NO: 264676 - RNA, 64 nt, Homo Sapiens; identical to SEQ ID NO: 108787

SEQ ID NO: 264677 - RNA, 64 nt, Homo Sapiens; identical to SEQ ID NO: 108788

SEQ ID NO: 264678 - RNA, 64 nt, Homo Sapiens; identical to SEQ ID NO: 108789

SEQ ID NO: 264679 - RNA, 64 nt, Homo Sapiens; identical to SEQ ID NO: 108790

SEQ ID NO: 264680 - RNA, 64 nt, Homo Sapiens; identical to SEQ ID NO: 108791

SEQ ID NO: 264681 - RNA, 64 nt, Homo Sapiens; identical to SEQ ID NO: 108792

SEQ ID NO: 264682 - RNA, 64 nt, Homo Sapiens; identical to SEQ ID NO: 108793

SEQ ID NO: 264683 - RNA, 64 nt, Homo Sapiens; identical to SEQ ID NO: 108794

SEQ ID NO: 264684 - RNA, 64 nt, Homo Sapiens; identical to SEQ ID NO: 108795

SEQ ID NO: 264685 - RNA, 64 nt, Homo Sapiens; identical to SEQ ID NO: 108796

SEQ ID NO: 264686 - RNA, 64 nt, Homo Sapiens; identical to SEQ ID NO: 108797

SEQ ID NO: 264687 - RNA, 64 nt, Homo Sapiens; identical to SEQ ID NO: 108798

SEQ ID NO: 264688 - RNA, 64 nt, Homo Sapiens; identical to SEQ ID NO: 108799

SEQ ID NO: 264689 - RNA, 64 nt, Homo Sapiens; identical to SEQ ID NO: 108800

SEQ ID NO: 264690 - RNA, 64 nt, Homo Sapiens; identical to SEQ ID NO: 108801

SEQ ID NO: 264691 - RNA, 64 nt, Homo Sapiens; identical to SEQ ID NO: 108802

SEQ ID NO: 264692 - RNA, 64 nt, Homo Sapiens; identical to SEQ ID NO: 108803

SEQ ID NO: 264693 - RNA, 64 nt, Homo Sapiens; identical to SEQ ID NO: 108804

SEQ ID NO: 264694 - RNA, 64 nt, Homo Sapiens; identical to SEQ ID NO: 108805

SEQ ID NO: 264695 - RNA, 64 nt, Homo Sapiens; identical to SEQ ID NO: 108806

SEQ ID NO: 264696 - RNA, 64 nt, Homo Sapiens; identical to SEQ ID NO: 108807

SEQ ID NO: 264697 - RNA, 64 nt, Homo Sapiens; identical to SEQ ID NO: 108808

SEQ ID NO: 264698 - RNA, 64 nt, Homo Sapiens; identical to SEQ ID NO: 108809

SEQ ID NO: 264699 - RNA, 64 nt, Homo Sapiens; identical to SEQ ID NO: 108810

SEQ ID NO: 264700 - RNA, 64 nt, Homo Sapiens; identical to SEQ ID NO: 108811

SEQ ID NO: 264701 - RNA, 64 nt, Homo Sapiens; identical to SEQ ID NO: 108812

SEQ ID NO: 264702 - RNA, 64 nt, Homo Sapiens; identical to SEQ ID NO: 108813

SEQ ID NO: 264703 - RNA, 64 nt, Homo Sapiens; identical to SEQ ID NO: 108814

SEQ ID NO: 264704 - RNA, 64 nt, Homo Sapiens; identical to SEQ ID NO: 108815

SEQ ID NO: 264705 - RNA, 64 nt, Homo Sapiens; identical to SEQ ID NO: 108816

SEQ ID NO: 264706 - RNA, 64 nt, Homo Sapiens; identical to SEQ ID NO: 108817

SEQ ID NO: 264707 - RNA, 64 nt, Homo Sapiens; identical to SEQ ID NO: 108818

SEQ ID NO: 264708 - RNA, 64 nt, Homo Sapiens; identical to SEQ ID NO: 108819

SEQ ID NO: 264709 - RNA, 64 nt, Homo Sapiens; identical to SEQ ID NO: 108820

SEQ ID NO: 264710 - RNA, 64 nt, Homo Sapiens; identical to SEQ ID NO: 108821

SEQ ID NO: 264711 - RNA, 64 nt, Homo Sapiens; identical to SEQ ID NO: 108822

SEQ ID NO: 264712 - RNA, 64 nt, Homo Sapiens; identical to SEQ ID NO: 108823

SEQ ID NO: 264713 - RNA, 64 nt, Homo Sapiens; identical to SEQ ID NO: 108824

SEQ ID NO: 264714 - RNA, 64 nt, Homo Sapiens; identical to SEQ ID NO: 108825

SEQ ID NO: 264715 - RNA, 63 nt, Homo Sapiens
ugugccuguggcagaaaagauccaaaggggcugcuggggcaugacccuauagagagggggcuc

SEQ ID NO: 264716 - RNA, 63 nt, Homo Sapiens
ggggcagccgcuaggagagacuggccucacuggcuggggcagaauguccucuuuacucccuuc

SEQ ID NO: 264717 - RNA, 63 nt, Homo Sapiens
cacacacacaugcauacacagccuucaccgcugcuggggcacaggauuucuaagggucaggag

SEQ ID NO: 264718 - RNA, 63 nt, Homo Sapiens
uuaccaccggagccgaaucuccuccugggccaccuggggcaccgcucccagaagauaaccucu

SEQ ID NO: 264719 - RNA, 63 nt, Homo Sapiens
agcaccaggcuccagggcacaccaccuucuuuccuggggcaagagcuuccagcccuacauuga

SEQ ID NO: 264720 - RNA, 63 nt, Homo Sapiens
uacugacacccugucgccagccuggccucccaccuggggcauucuccuggccagcguuugaag

SEQ ID NO: 264721 - RNA, 63 nt, Homo Sapiens
gaacuaagccagcucagccucagcaggcugccacuggggcaccaaacccccgggacuuuaccc

SEQ ID NO: 264722 - RNA, 63 nt, Homo Sapiens
ugagaucuuuacgccuuuuaucacugcuuccagcuggggcaggccgaaucuggggcaauggaa

SEQ ID NO: 264723 - RNA, 63 nt, Homo Sapiens
ggaaucacugcuuccagcugcacaauuccgaaucuggggcaauaagagaggccuaguuuaaau

SEQ ID NO: 264724 - RNA, 63 nt, Homo Sapiens
ucccuugacuuacccauaauauuugcccaauggcuggggcaucaucagggaggagucagagga

SEQ ID NO: 264725 - RNA, 63 nt, Homo Sapiens
gguggguuuguguuuaguucagaagcggagagccuggggcacuccuccuacucuguggaugau

SEQ ID NO: 264726 - RNA, 63 nt, Homo Sapiens
aacgucucagcccuucaguuuggucugcuccgccuggggcagaaagccacaaacuccauccag

SEQ ID NO: 264727 - RNA, 63 nt, Homo Sapiens
uaucaauggcacgcuccugccuacccaguuccacuggggcaaggugagugagcccacagcauc

SEQ ID NO: 264728 - RNA, 63 nt, Homo Sapiens
gggugaagaacccucuguccacagugccaaaugcuggggcagguuucuaaagcugaaugucaa

SEQ ID NO: 264729 - RNA, 63 nt, Homo Sapiens
ccccaugggcuccugccccucaggagagaggcucuggggcagcccucccagcuuaaauccuag

SEQ ID NO: 264730 - RNA, 63 nt, Homo Sapiens
cccuugccgcccagcuguugugcugggcacagucuggggcacaggccuccaugaugaagacgc

SEQ ID NO: 264731 - RNA, 63 nt, Homo Sapiens
ccgguggcuuucuauaaucaaaucaauauuguucuggggcaucacaaagaggaaggggguccc

SEQ ID NO: 264732 - RNA, 63 nt, Homo Sapiens
acaaggcuggugcuuccuucgcagacccucuagcuggggcagagacccucuggcuggggcagc

SEQ ID NO: 264733 - RNA, 63 nt, Homo Sapiens
gcagacccucuagcuggggcacagacccucuggcuggggcagcuaggccucagcagggacagc

SEQ ID NO: 264734 - RNA, 63 nt, Homo Sapiens
cggaaacaggcucacagauuccccuuacaguuccuggggcaggcccaacaaaacguuuucaaa

SEQ ID NO: 264735 - RNA, 63 nt, Homo Sapiens
cguauccugaggggcuuggggccuaaucccgagcuggggcacaucaggcuggagggcguccca

SEQ ID NO: 264736 - RNA, 63 nt, Homo Sapiens
cggggagcuggaagaaaagucucuuggggaccucuggggcaaggagcugagaaguccugcagc

SEQ ID NO: 264737 - RNA, 63 nt, Homo Sapiens
acagaggguccugacacucuggcagggccugagcuggggcaggccucccucagggccaggggc

SEQ ID NO: 264738 - RNA, 63 nt, Homo Sapiens
aaaggagcaggggcccugguguugcauuuagcccuggggcauggagcugaacaguacuugugc

SEQ ID NO: 264739 - RNA, 63 nt, Homo Sapiens
agacagcuguguuccuacaauuggcccagcacccuggggcacgggagaaggguggggaccguu

SEQ ID NO: 264740 - RNA, 63 nt, Homo Sapiens
gcucgcugcucccaggaaggcuccaacucgggccuggggcacuccuuccccauagagaccgug

SEQ ID NO: 264741 - RNA, 63 nt, Homo Sapiens
uggucccuggggccugggcccaccacaagggggcuggggcaucccuuugugugucaccucaca

SEQ ID NO: 264742 - RNA, 63 nt, Homo Sapiens
cccuccacuuccaagcaagcgugagaggaucaucuggggcaggcucuccagggagccggggcu

SEQ ID NO: 264743 - RNA, 63 nt, Homo Sapiens
ugccuaauuucgcacaaugcggaggugcuggggcuggggcagacuuagcaggcagcugggcau

SEQ ID NO: 264744 - RNA, 63 nt, Homo Sapiens
gucugcggccaugaggccagugccaggcccgggcuggggcacguuuaucaguggccagcuacc

SEQ ID NO: 264745 - RNA, 63 nt, Homo Sapiens
caucacugggaagggcauaggugaccagucacucuggggcaagagcaaaccugucccccaccu

SEQ ID NO: 264746 - RNA, 63 nt, Homo Sapiens
agaccaggcaccaccuggacggggucggggggacuggggcaccgaccaccucaccgggcaaau

SEQ ID NO: 264747 - RNA, 63 nt, Homo Sapiens
uggggcugccaucccauuucgccguccuccuaccuggggcagccaucccccacccagcucccg

SEQ ID NO: 264748 - RNA, 63 nt, Homo Sapiens
agagcccaagcacuggcuucgccccucagugcccuggggcauguucagggcaggguugagggg

SEQ ID NO: 264749 - RNA, 63 nt, Homo Sapiens
gugccaccugcaucgugccauaacccugaccgccuggggcaggaaguauucagguuggcugug

SEQ ID NO: 264750 - RNA, 63 nt, Homo Sapiens
uaaaaaagucaaaaaucaaaagaccaggacccacuggggcauagcuucccaguugagcuccca

SEQ ID NO: 264751 - RNA, 63 nt, Homo Sapiens
uaaaaucucugcuguauccuagaccaggacccacuggggcauagcuucccaguugagcuccca

SEQ ID NO: 264752 - RNA, 63 nt, Homo Sapiens
aggcuccuggagcgcuggauggagcacuaggggcuggggcaggggcgccuccagggggcggga

SEQ ID NO: 264753 - RNA, 63 nt, Homo Sapiens
ugcauuugagccagggcuggguuguggcugggucuggggcaggcagcugggggacagugggcu

SEQ ID NO: 264754 - RNA, 63 nt, Homo Sapiens
uuuuuggaaaagggugugggggugggggcgccgcuggggcagggccagguuuuguguuuuagu

SEQ ID NO: 264755 - RNA, 63 nt, Homo Sapiens
agcgggcggcagcgccagcgccccucugucaggcuggggcaaucuugguuuuguguccaaagg

SEQ ID NO: 264756 - RNA, 63 nt, Homo Sapiens
ccugcuccucugccuggaccaggaggagggccccuggggcagaaguuaggcacgaggcagucu

SEQ ID NO: 264757 - RNA, 63 nt, Homo Sapiens
cccagccaggcccugcagggcuggucagggugucuggggcaggaggaggccaacucacugaac

SEQ ID NO: 264758 - RNA, 63 nt, Homo Sapiens
uggucacauggggaaccuccccucaucgggccucuggggcaggaagcuugucacuggaagauc

SEQ ID NO: 264759 - RNA, 63 nt, Homo Sapiens
cucccucucuccaacaaauggaguagcaucccccuggggcacuugcugaggccaagccacuca

SEQ ID NO: 264760 - RNA, 63 nt, Homo Sapiens
aacucugggcuuggguaauguuggcaguugaagcuggggcaagucggggugaagggugguauc

SEQ ID NO: 264761 - RNA, 63 nt, Homo Sapiens
gccccugcuucccugcacccagagggcacugggcuggggcacacuggguaccucagggugagc

SEQ ID NO: 264762 - RNA, 63 nt, Homo Sapiens
cgaugcaauuucugggccugaaugucaugcucccuggggcaggaccuugagccugcagcacac

SEQ ID NO: 264763 - RNA, 63 nt, Homo Sapiens
ggagggccugguggaugcccuccucccucagagcuggggcagcugccucccaggggugggacu

SEQ ID NO: 264764 - RNA, 63 nt, Homo Sapiens
uggaagguggucugacugcacucaacaucaagccuggggcaggccagacuuugacaaacccac

SEQ ID NO: 264765 - RNA, 63 nt, Homo Sapiens
gccaucagcuucagagaccuuuagaucuuggugcuggggcaagucagugagagagaaaaugau

SEQ ID NO: 264766 - RNA, 63 nt, Homo Sapiens
aggaccucugaggccaggccugaaccuucuuggcuggggcaaaccacucuucaagugguggca

SEQ ID NO: 264767 - RNA, 63 nt, Homo Sapiens
ucuuuugaaaugucacaaggccgccucccaccucuggggcauuguacaaguucuucccucucc

SEQ ID NO: 264768 - RNA, 63 nt, Homo Sapiens
caacgcugcagagcccaggggccuggcccugugcuggggcagaggccacgcagccagccagau

SEQ ID NO: 264769 - RNA, 63 nt, Homo Sapiens
aaggcugacaguugcugcauaccagugcgcaagcuggggcagccagagagcagccuggcccuc

SEQ ID NO: 264770 - RNA, 63 nt, Homo Sapiens
cccucggcaaccguggggaggccauuugcugcccuggggcaucaugggcaacucgugacagcc

SEQ ID NO: 264771 - RNA, 63 nt, Homo Sapiens
gagcaagagccaggggugucccagucccagccucuggggcagagcuuguagcccuggauggcc

SEQ ID NO: 264772 - RNA, 63 nt, Homo Sapiens
cucuggggcagagcuuguagcccuggauggccucuggggcaggaccacuagcuaagcaagcca

SEQ ID NO: 264773 - RNA, 63 nt, Homo Sapiens
gcucuucaccaccacaaaggaugugugugcauccuggggcaugccugccucaugugggggugu

SEQ ID NO: 264774 - RNA, 63 nt, Homo Sapiens
cucuggcaucucugccgaggcugcuggaaucgacuggggcaucuucccggaaucagauucaaa

SEQ ID NO: 264775 - RNA, 63 nt, Homo Sapiens
cgagcccggacagggaagagucagaagcagggacuggggcaggcgggaggccggacucagggg

SEQ ID NO: 264776 - RNA, 63 nt, Homo Sapiens
gugucggcgggacggugaggccuugccaagggccuggggcaagauagucuccaagggaccugg

SEQ ID NO: 264777 - RNA, 63 nt, Homo Sapiens
guggaagguaaagcacugaggucgacucuaccccuggggcauccagagggcggcgaguucggg

SEQ ID NO: 264778 - RNA, 52 nt, Homo Sapiens
ggccugaaagggagagaagaggcuggggcaaagucuggcacugcuuuuuuaa

SEQ ID NO: 264779 - RNA, 63 nt, Homo Sapiens
ggcuuugcggggcacgggggccacucagcagcgcuggggcaggugccucugcugucagcucca

SEQ ID NO: 264780 - RNA, 63 nt, Homo Sapiens
ucuugcgcggugccugagaagagggugaaggagcuggggcaggccccauccugggcauuggag

SEQ ID NO: 264781 - RNA, 63 nt, Homo Sapiens
gugagaggcaaagggcacagccaugcaaaggcccuggggcaggacggcaccugguaugcggga

SEQ ID NO: 264782 - RNA, 63 nt, Homo Sapiens
cugcauuuucgaucaugggcuacaugccgagugcuggggcacagagaugaacaagaucgguuc

SEQ ID NO: 264783 - RNA, 63 nt, Homo Sapiens
uguguuugggggcuuuuaggggacccagcugcacuggggcacugcccguggccuggguaggac

SEQ ID NO: 264784 - RNA, 63 nt, Homo Sapiens
uagucucguagcugagggguggggucccucugucuggggcacuggcacccacagcaggacucc

SEQ ID NO: 264785 - RNA, 63 nt, Homo Sapiens
cagagagccacuucaccugagaccacgcccuuccuggggcagccuguaucuggugucugagug

SEQ ID NO: 264786 - RNA, 63 nt, Homo Sapiens
uagagcaccagcuuugugcagucccuuugguuucuggggcaaagaugggugagccugaagaug

SEQ ID NO: 264787 - RNA, 63 nt, Homo Sapiens
gcuugggcugaccuguaggaagggaccaccucccuggggcagguccuccuugucuuuguaaaa

SEQ ID NO: 264788 - RNA, 63 nt, Homo Sapiens
caucucagggagcagccagcccaggccaggguccuggggcaggaagaccaggcugaggccccu

SEQ ID NO: 264789 - RNA, 63 nt, Homo Sapiens
ggcauaaacagaaccagucauagggcuucaguccuggggcagaagauccaugagguguguccc

SEQ ID NO: 264790 - RNA, 63 nt, Homo Sapiens
gagaggugaugucaucugccacaggugaggaaacuggggcacagacguucuuggcuccguuag

SEQ ID NO: 264791 - RNA, 63 nt, Homo Sapiens
aaggaagaagcucagaggguccugugcaugguccuggggcagcggcagagccacauuaccuac

SEQ ID NO: 264792 - RNA, 63 nt, Homo Sapiens
ccgucgccuuugcagaaccaugggcgggcgggccuggggcacuccuaggaggucccccugggg

SEQ ID NO: 264793 - RNA, 63 nt, Homo Sapiens
cagucuccccccggccaccugggguacgacaggcuggggcacagggguaccuaggagccaggu

SEQ ID NO: 264794 - RNA, 63 nt, Homo Sapiens
gugucuugcaguuaauugcagaaauaguaaaaucuggggcagacuuuugaagcaauuuuuuga

SEQ ID NO: 264795 - RNA, 63 nt, Homo Sapiens
cagaaagaaaucugcaugagaucucuguuuuuccuggggcaaaagacuggggaaaaauugagg

SEQ ID NO: 264796 - RNA, 64 nt, Homo Sapiens
cccaagccccuggccacucuaagcugggcagacggagcacgagcaccuauucaaggcacugcag

SEQ ID NO: 264797 - RNA, 64 nt, Homo Sapiens
gaccucguggcagcaugugaacacgcgcccgguggagcacgagagccgacuugcuaaaggucac

SEQ ID NO: 264798 - RNA, 64 nt, Homo Sapiens
uggaaaaaugagagaagggacaucggucaguaacgagcacgauggguguccugcuacaaaaaga

SEQ ID NO: 264799 - RNA, 64 nt, Homo Sapiens
uuggaagaugggcccaauuucuuaagugaugagagagcacgaaauuccauaaccaguacaggcc

SEQ ID NO: 264800 - RNA, 64 nt, Homo Sapiens
ugagagacggcagacugagcagaauuccuuuuuugagcacgagagcauuacuagaaccauuguc

SEQ ID NO: 264801 - RNA, 64 nt, Homo Sapiens
aagcaaccuuguuucugaggugugaucauaccuugagcacgacgagcuugggcuguggcccugc

SEQ ID NO: 264802 - RNA, 64 nt, Homo Sapiens
cuguuuccccucagaacacccuguaccauccauggagcacgaggccuucagaaaagacacuuca

SEQ ID NO: 264803 - RNA, 64 nt, Homo Sapiens
agagccuccgcccggcccggcagaaaccggcccugagcacgagacaagcgcaucgggagcacac

SEQ ID NO: 264804 - RNA, 64 nt, Homo Sapiens
agagagagagcauguauacccguauguuaucauagagcacgauucuccaguggauggauaccug

SEQ ID NO: 264805 - RNA, 64 nt, Homo Sapiens
caagggcgcuguggcccccgggaaagggaauaaggagcacgaugcuggggugggguagcuuucg

SEQ ID NO: 264806 - RNA, 64 nt, Homo Sapiens
caggccccagagcagcccaggccaugacccugccgagcacgaguccccccgugcagccaagaac

SEQ ID NO: 264807 - RNA, 64 nt, Homo Sapiens
gcccugaagccuggggccagcugggacuugaagggagcacgaguccaggauggacucagugcag

SEQ ID NO: 264808 - RNA, 64 nt, Homo Sapiens
gaagggaaaguucacaaccugugaacagggacuugagcacgagacacuuuucaucuggagcagg

SEQ ID NO: 264809 - RNA, 64 nt, Homo Sapiens
auguucucagcucuggccaaccucucaguggaaagagcacgaggcccaaagugaagcggucacu

SEQ ID NO: 264810 - RNA, 64 nt, Homo Sapiens
agaguccugucugguuaucuagaauguugaauaagagcacgauuccagucuaggcagagacaga

SEQ ID NO: 264811 - RNA, 62 nt, Homo Sapiens
auuuggcagaacaaguuugauuuuaagaacuagagcacgagucaucuccggugauccuuaaa

SEQ ID NO: 264812 - RNA, 64 nt, Homo Sapiens
uugaagcaggcacuugcguggauguuucucacuugagcacgauauuuaggcucucuuccaacuc

SEQ ID NO: 264813 - RNA, 64 nt, Homo Sapiens
aaguugccucuuuuaggaaucucuuuggaauugggagcacgaugacucugaguuugagcuauua

SEQ ID NO: 264814 - RNA, 64 nt, Homo Sapiens
gggccuggaggaggagcugcggaggcuucagagcgagcacgacaggugccgccccugccacagc

SEQ ID NO: 264815 - RNA, 64 nt, Homo Sapiens
aaggggccuccuggauucaguccccacuggcccugagcacgacagcccuucuuacccucccagg

SEQ ID NO: 264816 - RNA, 64 nt, Homo Sapiens
uuggaccucuccuggcugagcucugauucccugugagcacgaugcugaugcaauaguccugugu

SEQ ID NO: 264817 - RNA, 64 nt, Homo Sapiens
cgcaauaacuguuugguauuugaugcagaugagagagcacgagcuaaaguaaaauaucuaacag

SEQ ID NO: 264818 - RNA, 64 nt, Homo Sapiens
ggcccuggaggccccugaccccaccccacccacagagcacgagggccccgucagcucagucugu

SEQ ID NO: 264819 - RNA, 64 nt, Homo Sapiens
ccauugccgccacuaucuguguaauaaaauccgugagcacgaggugggacgugcugguguguga

SEQ ID NO: 264820 - RNA, 64 nt, Homo Sapiens
ucccagucccagcaggcagaaugcccaaaaccaggagcacgaaggccugucauccauggggcca

SEQ ID NO: 264821 - RNA, 64 nt, Homo Sapiens
gaccccuuucguuugaguccugcuguuggugucggagcacgaggggaggcacggugcggagagc

SEQ ID NO: 264822 - RNA, 64 nt, Homo Sapiens
uagaccaagcgaagggcagcguggcagguuuggcgagcacgaacccgugagcagacacaaaacg

SEQ ID NO: 264823 - RNA, 64 nt, Homo Sapiens
aaacagcagcagggaugucucuaugccuuguuccgagcacgaagguccuucccuccacagaccc

SEQ ID NO: 264824 - RNA, 64 nt, Homo Sapiens
cuauauaaaaguguuuuauaaaaacccagaauaggagcacgacgcaugauugguguuugaggcg

SEQ ID NO: 264825 - RNA, 64 nt, Homo Sapiens
uggaacccacgaggauggccacaguggagcccacgagcacgagcaagugugggagaccgaggac

SEQ ID NO: 264826 - RNA, 64 nt, Homo Sapiens
ccaccagcgggcgccuccucccagaggcuuccaggagcacgagggccuugcggcacaggacugu

SEQ ID NO: 264827 - RNA, 64 nt, Homo Sapiens
ccggagcccccgccgcuccacagucccuggggccgagcacgagugaguggacacugccccgccg

SEQ ID NO: 264828 - RNA, 64 nt, Homo Sapiens
uugaucgugccacugcacuccagccugggggacagagcacgacccugucuccaaaaauaaaaua

SEQ ID NO: 264829 - RNA, 64 nt, Homo Sapiens
gaauucccacuggugagaaauuccaguuucuuuugagcacgaaauguucuaaagcccuuaauug

SEQ ID NO: 264830 - RNA, 64 nt, Homo Sapiens
ucuggccaagguggacggggucagauccaggcaggagcacgaggggcagacccuggacccagcc

SEQ ID NO: 264831 - RNA, 64 nt, Homo Sapiens
gcgggcagugaugagcccuguucuggaguggaaagagcacgauagagcaccaggcuaagaggca

SEQ ID NO: 264832 - RNA, 64 nt, Homo Sapiens
cucaagagaagcucauaagugugugugggugugagagcacgauggugccuguguucugugaaug

SEQ ID NO: 264833 - RNA, 64 nt, Homo Sapiens
acaacauaaugaugguuaaauuaaaaaaaaaaaagagcacgacaaaccuuggaaaucaagaaag

SEQ ID NO: 264834 - RNA, 64 nt, Homo Sapiens
uaaacagguaacugacuguuagugccaauuuacugagcacgagagugccccuuaucucauggaa

SEQ ID NO: 264835 - RNA, 64 nt, Homo Sapiens
uaaccuuggcccaagaccccuuugauucucuaaggagcacgaaagggggaaugccccucccagg

SEQ ID NO: 264836 - RNA, 64 nt, Homo Sapiens
cugucucaaaaaaagaaaagcaacuugggugacagagcacgacuaagauugugccacuguauuc

SEQ ID NO: 264837 - RNA, 54 nt, Homo Sapiens
ugagagagggggaagagugagucugagcacgaguugcagccagggccaguggga

SEQ ID NO: 264838 - RNA, 64 nt, Homo Sapiens
ugggcagagcugguuccuacguugugcagggagggagcacgagagcuaaggcuggguaagaaua

SEQ ID NO: 264839 - RNA, 54 nt, Homo Sapiens
ugcagccagggccagugggagucugagcacgaguuuagagagggggaagaguga

SEQ ID NO: 264840 - RNA, 54 nt, Homo Sapiens
ugcagccagggccagugggagucugagcacgaguugagagagggggaagaguga

SEQ ID NO: 264841 - RNA, 64 nt, Homo Sapiens
uaguuguaguccggcuugcgcgccugagcguggagagcacgaguuggcacagccuuggcuucca

SEQ ID NO: 264842 - RNA, 64 nt, Homo Sapiens; identical to SEQ ID NO: 83098

SEQ ID NO: 264843 - RNA, 64 nt, Homo Sapiens; identical to SEQ ID NO: 83099

SEQ ID NO: 264844 - RNA, 64 nt, Homo Sapiens; identical to SEQ ID NO: 83100

SEQ ID NO: 264845 - RNA, 64 nt, Homo Sapiens; identical to SEQ ID NO: 83101

SEQ ID NO: 264846 - RNA, 64 nt, Homo Sapiens; identical to SEQ ID NO: 83102

SEQ ID NO: 264847 - RNA, 64 nt, Homo Sapiens; identical to SEQ ID NO: 83103

SEQ ID NO: 264848 - RNA, 64 nt, Homo Sapiens; identical to SEQ ID NO: 83104

SEQ ID NO: 264849 - RNA, 64 nt, Homo Sapiens; identical to SEQ ID NO: 83105

SEQ ID NO: 264850 - RNA, 64 nt, Homo Sapiens; identical to SEQ ID NO: 83106

SEQ ID NO: 264851 - RNA, 64 nt, Homo Sapiens; identical to SEQ ID NO: 83107

SEQ ID NO: 264852 - RNA, 64 nt, Homo Sapiens; identical to SEQ ID NO: 83108

SEQ ID NO: 264853 - RNA, 64 nt, Homo Sapiens; identical to SEQ ID NO: 83109

SEQ ID NO: 264854 - RNA, 64 nt, Homo Sapiens; identical to SEQ ID NO: 83110

SEQ ID NO: 264855 - RNA, 64 nt, Homo Sapiens; identical to SEQ ID NO: 83111

SEQ ID NO: 264856 - RNA, 64 nt, Homo Sapiens; identical to SEQ ID NO: 83112

SEQ ID NO: 264857 - RNA, 64 nt, Homo Sapiens; identical to SEQ ID NO: 83113

SEQ ID NO: 264858 - RNA, 64 nt, Homo Sapiens; identical to SEQ ID NO: 83114

SEQ ID NO: 264859 - RNA, 64 nt, Homo Sapiens; identical to SEQ ID NO: 83115

SEQ ID NO: 264860 - RNA, 64 nt, Homo Sapiens; identical to SEQ ID NO: 83116

SEQ ID NO: 264861 - RNA, 64 nt, Homo Sapiens; identical to SEQ ID NO: 83117

SEQ ID NO: 264862 - RNA, 64 nt, Homo Sapiens; identical to SEQ ID NO: 83118

SEQ ID NO: 264863 - RNA, 64 nt, Homo Sapiens; identical to SEQ ID NO: 83119

SEQ ID NO: 264864 - RNA, 64 nt, Homo Sapiens; identical to SEQ ID NO: 83120

SEQ ID NO: 264865 - RNA, 64 nt, Homo Sapiens; identical to SEQ ID NO: 83121

SEQ ID NO: 264866 - RNA, 64 nt, Homo Sapiens; identical to SEQ ID NO: 52330

SEQ ID NO: 264867 - RNA, 64 nt, Homo Sapiens; identical to SEQ ID NO: 52331

SEQ ID NO: 264868 - RNA, 64 nt, Homo Sapiens; identical to SEQ ID NO: 52332

SEQ ID NO: 264869 - RNA, 64 nt, Homo Sapiens; identical to SEQ ID NO: 52333

SEQ ID NO: 264870 - RNA, 64 nt, Homo Sapiens; identical to SEQ ID NO: 52334

SEQ ID NO: 264871 - RNA, 64 nt, Homo Sapiens; identical to SEQ ID NO: 52335

SEQ ID NO: 264872 - RNA, 64 nt, Homo Sapiens; identical to SEQ ID NO: 52336

SEQ ID NO: 264873 - RNA, 63 nt, Homo Sapiens; identical to SEQ ID NO: 52337

SEQ ID NO: 264874 - RNA, 64 nt, Homo Sapiens; identical to SEQ ID NO: 52338

SEQ ID NO: 264875 - RNA, 64 nt, Homo Sapiens; identical to SEQ ID NO: 52339

SEQ ID NO: 264876 - RNA, 64 nt, Homo Sapiens; identical to SEQ ID NO: 52340

SEQ ID NO: 264877 - RNA, 64 nt, Homo Sapiens; identical to SEQ ID NO: 52341

SEQ ID NO: 264878 - RNA, 64 nt, Homo Sapiens; identical to SEQ ID NO: 52342

SEQ ID NO: 264879 - RNA, 64 nt, Homo Sapiens; identical to SEQ ID NO: 52343

SEQ ID NO: 264880 - RNA, 64 nt, Homo Sapiens; identical to SEQ ID NO: 52344

SEQ ID NO: 264881 - RNA, 64 nt, Homo Sapiens; identical to SEQ ID NO: 52345

SEQ ID NO: 264882 - RNA, 64 nt, Homo Sapiens; identical to SEQ ID NO: 52346

SEQ ID NO: 264883 - RNA, 64 nt, Homo Sapiens; identical to SEQ ID NO: 52347

SEQ ID NO: 264884 - RNA, 64 nt, Homo Sapiens; identical to SEQ ID NO: 52348

SEQ ID NO: 264885 - RNA, 64 nt, Homo Sapiens; identical to SEQ ID NO: 52349

SEQ ID NO: 264886 - RNA, 64 nt, Homo Sapiens; identical to SEQ ID NO: 52350

SEQ ID NO: 264887 - RNA, 64 nt, Homo Sapiens; identical to SEQ ID NO: 52351

SEQ ID NO: 264888 - RNA, 64 nt, Homo Sapiens; identical to SEQ ID NO: 52352

SEQ ID NO: 264889 - RNA, 64 nt, Homo Sapiens; identical to SEQ ID NO: 52353

SEQ ID NO: 264890 - RNA, 64 nt, Homo Sapiens; identical to SEQ ID NO: 52354

SEQ ID NO: 264891 - RNA, 64 nt, Homo Sapiens; identical to SEQ ID NO: 52355

SEQ ID NO: 264892 - RNA, 64 nt, Homo Sapiens; identical to SEQ ID NO: 52356

SEQ ID NO: 264893 - RNA, 64 nt, Homo Sapiens; identical to SEQ ID NO: 52357

SEQ ID NO: 264894 - RNA, 64 nt, Homo Sapiens; identical to SEQ ID NO: 52358

SEQ ID NO: 264895 - RNA, 64 nt, Homo Sapiens; identical to SEQ ID NO: 52359

SEQ ID NO: 264896 - RNA, 64 nt, Homo Sapiens; identical to SEQ ID NO: 52360

SEQ ID NO: 264897 - RNA, 59 nt, Homo Sapiens; identical to SEQ ID NO: 52361

SEQ ID NO: 264898 - RNA, 64 nt, Homo Sapiens; identical to SEQ ID NO: 52362

SEQ ID NO: 264899 - RNA, 64 nt, Homo Sapiens; identical to SEQ ID NO: 52363

SEQ ID NO: 264900 - RNA, 64 nt, Homo Sapiens; identical to SEQ ID NO: 52364

SEQ ID NO: 264901 - RNA, 64 nt, Homo Sapiens; identical to SEQ ID NO: 52365

SEQ ID NO: 264902 - RNA, 64 nt, Homo Sapiens; identical to SEQ ID NO: 52366

SEQ ID NO: 264903 - RNA, 64 nt, Homo Sapiens; identical to SEQ ID NO: 52367

SEQ ID NO: 264904 - RNA, 64 nt, Homo Sapiens; identical to SEQ ID NO: 52368

SEQ ID NO: 264905 - RNA, 64 nt, Homo Sapiens; identical to SEQ ID NO: 52369

SEQ ID NO: 264906 - RNA, 64 nt, Homo Sapiens; identical to SEQ ID NO: 52370

SEQ ID NO: 264907 - RNA, 64 nt, Homo Sapiens; identical to SEQ ID NO: 52371

SEQ ID NO: 264908 - RNA, 64 nt, Homo Sapiens; identical to SEQ ID NO: 52372

SEQ ID NO: 264909 - RNA, 64 nt, Homo Sapiens; identical to SEQ ID NO: 52373

SEQ ID NO: 264910 - RNA, 64 nt, Homo Sapiens; identical to SEQ ID NO: 52374

SEQ ID NO: 264911 - RNA, 64 nt, Homo Sapiens; identical to SEQ ID NO: 52375

SEQ ID NO: 264912 - RNA, 64 nt, Homo Sapiens
auccgcuacucuuuauuucauggagucguaucaacgcuaugaacgcaaggcugugauauggaac

SEQ ID NO: 264913 - RNA, 64 nt, Homo Sapiens
aauugcagaacuucuucagcuaagguuaauuugacgcuaugauaaaacugagagaugucaaaaa

SEQ ID NO: 264914 - RNA, 64 nt, Homo Sapiens
aaggcaaauugaaaaucacuggcaacaugggucucgcuaugaaguuacaaaaucuucagcuuca

SEQ ID NO: 264915 - RNA, 64 nt, Homo Sapiens
ucaaggaaaucaauaccuaccaauuuaaccuaaacgcuaugauauauaacagcucuagcuagug

SEQ ID NO: 264916 - RNA, 64 nt, Homo Sapiens
gucagaggcucucacuacacuggguccguguucccgcuaugacaaugaccuggcaccaaugggc

SEQ ID NO: 264917 - RNA, 64 nt, Homo Sapiens
cucaucauucaaauaacgcacaaaaaacaaaagccgcuaugaccggcguugccucucacuuuga

SEQ ID NO: 264918 - RNA, 64 nt, Homo Sapiens
ugguguucauaauguuccagggauucagaagcaacgcuaugaacuucagcugacuuguuacuua

SEQ ID NO: 264919 - RNA, 64 nt, Homo Sapiens
uguaugucagcauucucaagaguuugagaaaacccgcuaugaaaacugaaagaccacuaucugg

SEQ ID NO: 264920 - RNA, 64 nt, Homo Sapiens
gcuccccugugcuccugaccuaugcuccuggauacgcuaugaacucucaccggcuccccagccc

SEQ ID NO: 264921 - RNA, 64 nt, Homo Sapiens
cccccaaaugccccaaaauccaaaccuuccugaacgcuaugacaccaugaguggaaaauuccac

SEQ ID NO: 264922 - RNA, 64 nt, Homo Sapiens
cuccgaguucuauaaaaaccucaccuccaucaagcgcuaugauggggacaucacugaccugggc

SEQ ID NO: 264923 - RNA, 64 nt, Homo Sapiens
uagagucuaucaguguucuuccacuacuuauugccgcuaugaguacagagcauuuuagugacau

SEQ ID NO: 264924 - RNA, 64 nt, Homo Sapiens
aaaaccauucauauagaguuuguuguuuuaacugcgcuaugauucgaaaugaaucuacauuaaa

SEQ ID NO: 264925 - RNA, 64 nt, Homo Sapiens
uugaaacuugcaggauuuacuuaauaaaaauacacgcuaugagucauaauugugccaaguuguu

SEQ ID NO: 264926 - RNA, 64 nt, Homo Sapiens
ugaaaaauauguuuucuuacuguuucucuucaggcgcuaugaacaauuuuauuuuuaauguaua

SEQ ID NO: 264927 - RNA, 64 nt, Homo Sapiens
ugccacacauucucucucaauuucagcuucggaacgcuaugaaaauaauacaugauuaaaguuu

SEQ ID NO: 264928 - RNA, 64 nt, Homo Sapiens
cuuccacguuuucugcuucgagugcgugcggggccgcuaugaggcccgccagaggaagugcccc

SEQ ID NO: 264929 - RNA, 64 nt, Homo Sapiens
uuccuagccugaugauggggaacccagagccacccgcuaugagcacaggccggggguggaaggc

SEQ ID NO: 264930 - RNA, 64 nt, Homo Sapiens
aauauuguacauccucacuuauaagugggagcugcgcuaugaagauacaaaggcacaagaauga

SEQ ID NO: 264931 - RNA, 64 nt, Homo Sapiens
accauuccaggaaaacugggacauaggaucgucccgcuaugauggaaguguucagacaguuuau

SEQ ID NO: 264932 - RNA, 64 nt, Homo Sapiens
guaaacaauguggaaaaaccacacuguacagaaacgcuaugaauucgagcacaugaaaggaauc

SEQ ID NO: 264933 - RNA, 64 nt, Homo Sapiens
ugaauugucuguucuaggacuaauuuuaugguaacgcuaugaauucaguucguuuuuuugacag

SEQ ID NO: 264934 - RNA, 64 nt, Homo Sapiens
caauuccuuuucaugcccuccugcauugcugcugcguggguauuugucuccuuagccaucaggu

SEQ ID NO: 264935 - RNA, 64 nt, Homo Sapiens
ucugcugcucccaucugcacuaauugacccaaaacguggguauuuccugcuacacaaaagccaa

SEQ ID NO: 264936 - RNA, 64 nt, Homo Sapiens
uaucaagaugccucugugcagaaaguaugccucccguggguauacguuuuuaccuuuuuuaaaa

SEQ ID NO: 264937 - RNA, 64 nt, Homo Sapiens
uuaguacuuuuuuuuauauuacacagcagaaccacguggguauucacuuccuuuagggcaaaua

SEQ ID NO: 264938 - RNA, 64 nt, Homo Sapiens
acauggcuggacuccagccaggaggacacacggccguggguaucugcccugggcugggugcccg

SEQ ID NO: 264939 - RNA, 64 nt, Homo Sapiens
gcugcuuuauuuuaaaaaauuuuugucuuaucugcguggguauuggugugagauauuuuagcuu

SEQ ID NO: 264940 - RNA, 64 nt, Homo Sapiens
ucuaguugaggaagugugggaugcucagauggugcguggguagagcccaugcuuugggcaugag

SEQ ID NO: 264941 - RNA, 64 nt, Homo Sapiens
uugugugcauggaugugugcguggggagaaagaacguggguaagaugucccuucccagcccuga

SEQ ID NO: 264942 - RNA, 64 nt, Homo Sapiens
cagagugacgcacugacucaccuagaggcuggaacguggguagggauuuagcaugcuggaaaua

SEQ ID NO: 264943 - RNA, 64 nt, Homo Sapiens
uuguugggcaggagugugugugucuagguaccaccguggguacauauguguuugugcccgucug

SEQ ID NO: 264944 - RNA, 64 nt, Homo Sapiens
gauuuagcaugcuggaaauacuuagaagcugaaacguggguaagcagagugaagcaucaaccua

SEQ ID NO: 264945 - RNA, 64 nt, Homo Sapiens
ggcaaguuuucuacguuuuuaagagcccuuagaacguggguauuuuuuuucuugagaaaagcua

SEQ ID NO: 264946 - RNA, 64 nt, Homo Sapiens
ucccuggcucccagcuggagggucaggccaggcccguggguaggcaugaggggagggggagaga

SEQ ID NO: 264947 - RNA, 64 nt, Homo Sapiens
aucugcuuugggucauccacaucugugggugggccguggguagagggacccacaggcguggaca

SEQ ID NO: 264948 - RNA, 64 nt, Homo Sapiens
acaguucgaugcaaaaucaaugauccagaaugaucguggguaaaaauaacucaaaguguuucuu

SEQ ID NO: 264949 - RNA, 64 nt, Homo Sapiens
acaaauucguaaaaaacacacauggccucgccaucguggguaaaaucggccccacagcacgucu

SEQ ID NO: 264950 - RNA, 64 nt, Homo Sapiens
uggggguggggccacaaaucuggaggccucuccgcguggguacuugcccuuugugcuguaugac

SEQ ID NO: 264951 - RNA, 64 nt, Homo Sapiens
cuuucucuccuaacuauaaauccuauuugugugucguggguauggaaggacagauauauuucuu

SEQ ID NO: 264952 - RNA, 64 nt, Homo Sapiens
caggcugguucuugggcuagcgcuccuaaugguacguggguaccuauccuguucuuccccuccc

SEQ ID NO: 264953 - RNA, 64 nt, Homo Sapiens
augccuaggguagggacauccuuuccagcucaaacguggguagggaugugggagaauaagaaug

SEQ ID NO: 264954 - RNA, 64 nt, Homo Sapiens
aggaaagccuguauucuuucgucauagugcacgucguggguauucagugacuguagggagcugg

SEQ ID NO: 264955 - RNA, 64 nt, Homo Sapiens
ucccuacagcugugcacuucagugcagaaugguucguggguacagugaacaccaacacauccua

SEQ ID NO: 264956 - RNA, 64 nt, Homo Sapiens
ccgcggggcagccucacggaagggcccggugggacguggguagugugugaagccccucagccug

SEQ ID NO: 264957 - RNA, 64 nt, Homo Sapiens
ugacaaacgggaccaauggggcgucucuggcccucguggguaaauuugcuagugucuuugucau

SEQ ID NO: 264958 - RNA, 64 nt, Homo Sapiens
agccuuggggagggugcagaguccuucuguccaucguggguaacaacccugguguugagagaac

SEQ ID NO: 264959 - RNA, 64 nt, Homo Sapiens
aucaguucauaaaauucuaugguacuggccccuucguggguauugugugaaaugagaugguggc

SEQ ID NO: 264960 - RNA, 64 nt, Homo Sapiens
cuagcaaguugacuaaacagcaaaaguucuuucucguggguaaauauacccacagguucuauga

SEQ ID NO: 264961 - RNA, 64 nt, Homo Sapiens
ugcuggugcuucccggcauguucaauaaugcaggcguggguaaggggccccccugggaugggga

SEQ ID NO: 264962 - RNA, 64 nt, Homo Sapiens
ggggcccagaggagcaauagcccugggccacaagcguggguaggccuuucacguauuccgucug

SEQ ID NO: 264963 - RNA, 64 nt, Homo Sapiens
ccugagcauguagagguggguccugcaguggucucguggguauuacugcuugugucugauuguc

SEQ ID NO: 264964 - RNA, 64 nt, Homo Sapiens
caguacacacuggagaaagacugaaugccgugaacguggguaauuauguagguacagcucucca

SEQ ID NO: 264965 - RNA, 64 nt, Homo Sapiens
ccucggccggggagugaggcaggcgacuguccugcguggguagcuguccauggcauccggagcg

SEQ ID NO: 264966 - RNA, 64 nt, Homo Sapiens
aagacugucagcagaaggaaaguacuggacuacccguggguaaguccugccauucaagacugga

SEQ ID NO: 264967 - RNA, 64 nt, Homo Sapiens
gaagauagaacaaugcuauaauauauaaugaacacguggguauuuaauaagaaacaugauguga

SEQ ID NO: 264968 - RNA, 64 nt, Homo Sapiens
augccacacgcccugcccugccagugugggugagcguggguacgggccucgggaggcugcuggg

SEQ ID NO: 264969 - RNA, 64 nt, Homo Sapiens
caaauuuuuaaguagucagacuuacaccuccccgcguggguaacuuccuaacugcagugugcug

SEQ ID NO: 264970 - RNA, 64 nt, Homo Sapiens
gggucaagaucacaacccugcauccauguguguccguggguaccguaagggcuacugggggaag

SEQ ID NO: 264971 - RNA, 64 nt, Homo Sapiens
gcuuagcgaguauaugcugauauucuucgacacacguggguaaguugaugccauuuauaaaugu

SEQ ID NO: 264972 - RNA, 64 nt, Homo Sapiens; identical to SEQ ID NO: 159069

SEQ ID NO: 264973 - RNA, 64 nt, Homo Sapiens; identical to SEQ ID NO: 159070

SEQ ID NO: 264974 - RNA, 64 nt, Homo Sapiens; identical to SEQ ID NO: 159071

SEQ ID NO: 264975 - RNA, 64 nt, Homo Sapiens; identical to SEQ ID NO: 159072

SEQ ID NO: 264976 - RNA, 64 nt, Homo Sapiens; identical to SEQ ID NO: 159073

SEQ ID NO: 264977 - RNA, 56 nt, Homo Sapiens; identical to SEQ ID NO: 159074

SEQ ID NO: 264978 - RNA, 64 nt, Homo Sapiens; identical to SEQ ID NO: 159075

SEQ ID NO: 264979 - RNA, 64 nt, Homo Sapiens; identical to SEQ ID NO: 159076

SEQ ID NO: 264980 - RNA, 64 nt, Homo Sapiens
ggaaggggagaaaaaccgauucaaaucaacuuguacauggaaacagcaagcauuauggucaaac

SEQ ID NO: 264981 - RNA, 64 nt, Homo Sapiens
uuuuucaacaauuucaacaaugacacaaaaauucacauggaaauggggaagauggucuguuuug

SEQ ID NO: 264982 - RNA, 64 nt, Homo Sapiens
auuuauccaauguugggucaagaacauugcuucgacauggaaauuaacauggaacauugcuuuu

SEQ ID NO: 264983 - RNA, 64 nt, Homo Sapiens
uugggucaagaacauugcuucgacauggaaauuaacauggaacauugcuuuucgugauacuguu

SEQ ID NO: 264984 - RNA, 64 nt, Homo Sapiens
ccccuaaaaauccccaaaacggcucuaugaauguacauggaaaagaauguacauggaaugacca

SEQ ID NO: 264985 - RNA, 64 nt, Homo Sapiens
accaggcucuaugaauguacggcucuaugaauguacauggaaugggacuccucgcugcugacca

SEQ ID NO: 264986 - RNA, 64 nt, Homo Sapiens
ucaacagccguuuuucuaguuccaaguuuuaaauacauggaaggaaguccgggagaaccauaug

SEQ ID NO: 264987 - RNA, 64 nt, Homo Sapiens
uuagaagaugaacagguauuuugaaucugaucugacauggaacaguuuaccucauuguagguag

SEQ ID NO: 264988 - RNA, 64 nt, Homo Sapiens
cguaugacccuggccucucgugaagagcagcacaacauggaaagagccaaaaugucacaguucc

SEQ ID NO: 264989 - RNA, 64 nt, Homo Sapiens
aaugcuuuuauuagccaauaggaauuuuaaaauaacauggaacuuacacaaaaggcuuuucaug

SEQ ID NO: 264990 - RNA, 64 nt, Homo Sapiens
gugauaccaaaucuucagcugucuacuuggaagaacauggaauaagcauacuuaacagugaaaa

SEQ ID NO: 264991 - RNA, 64 nt, Homo Sapiens
gaugacuguauagagaugugaaauguauaauuacacauggaagcaauauguugcuguguuguua

SEQ ID NO: 264992 - RNA, 64 nt, Homo Sapiens
uuagagguuugucaacacaauugucaacacaaagacauggaagaaaagacauggaagguuaggu

SEQ ID NO: 264993 - RNA, 64 nt, Homo Sapiens
uuagguuugucaacacaaaguugucaacaaaaagacauggaaggagacauggaagguuagaggu

SEQ ID NO: 264994 - RNA, 64 nt, Homo Sapiens
uuagagguuugucaacaaaauugucaacacaaagacauggaaggugcaccacccauggagaggu

SEQ ID NO: 264995 - RNA, 64 nt, Homo Sapiens
ugaucagaauucaguaccauccacauuggaauauacauggaauauuguaaaaccuacaugagca

SEQ ID NO: 264996 - RNA, 64 nt, Homo Sapiens
acagaauuuuuuguauuuguaaauugguuuaaauacauggaauuuuauacagguuuucuccugu

SEQ ID NO: 264997 - RNA, 64 nt, Homo Sapiens
ucugccguagcuagauguucugugggguuuguuaacauggaacuacucagcuuucuuucaguca

SEQ ID NO: 264998 - RNA, 64 nt, Homo Sapiens
ugauaggccaggaaggcaguggggauccaccaucacauggaacuguaaggccauauaacuacac

SEQ ID NO: 264999 - RNA, 64 nt, Homo Sapiens
cuaaaugaauaaaaacucggaauuaggccaggagacauggaauaccauucaugggaugguuauc

SEQ ID NO: 265000 - RNA, 64 nt, Homo Sapiens
cuguuuuaacacagaaauucaaaauagugacuuaacauggaagcuauuucucucuuacuuaaag

SEQ ID NO: 265001 - RNA, 64 nt, Homo Sapiens
ucccaauuauccacucuaauggagcagaacacuuacauggaaaauccuaaacauggaagaugau

SEQ ID NO: 265002 - RNA, 64 nt, Homo Sapiens
uaauggagcagaacacuuacauggaaaauccuaaacauggaagaugauuuaaaaaugauucacc

SEQ ID NO: 265003 - RNA, 64 nt, Homo Sapiens
acaaauggaccgaugcagauuuuagagagugacgacauggaaaaugaauuuaaccacuuucuua

SEQ ID NO: 265004 - RNA, 64 nt, Homo Sapiens
uaauuaauauauuauucuauuuagcuuguaaaacacauggaaucuguuuaagauagcccuugua

SEQ ID NO: 265005 - RNA, 64 nt, Homo Sapiens
ccgccuugguguggguuugugucacguguggacaucuccucaggcuuugugucacgcguggaca

SEQ ID NO: 265006 - RNA, 64 nt, Homo Sapiens
gacaucuccucaggcuuugugucacgcguggacaucuccucaggcuguccccagcggugacggg

SEQ ID NO: 265007 - RNA, 64 nt, Homo Sapiens
aagaggauaggaccucccaggaugcuucccagccucuccucaguuucccaucugcugugccucu

SEQ ID NO: 265008 - RNA, 64 nt, Homo Sapiens
gccccaggccaucaucuccccaccucuccuccccucuccucaguuuugccgacugcuuuucauc

SEQ ID NO: 265009 - RNA, 64 nt, Homo Sapiens
aaggaaaagucugcacuguuugcucuaaagagcuucuccucauuccaauguguuuugcuucaug

SEQ ID NO: 265010 - RNA, 64 nt, Homo Sapiens
ggcaaauggcauaauuauuugaaagugacaggaaucuccucagaaugaagaauaaagccuacua

SEQ ID NO: 265011 - RNA, 64 nt, Homo Sapiens
gccucacaaccauaggaucaguggggagcaggguucuccucaaauuauuuuuugaauaccccga

SEQ ID NO: 265012 - RNA, 64 nt, Homo Sapiens
auauccacuucacuccucauuucugguuucucagucuccucacucucugucugugugguuaaug

SEQ ID NO: 265013 - RNA, 64 nt, Homo Sapiens
ggcacauugccugcuuccccccagcgccggcuucucuccucagagcgccugucacuccaucccc

SEQ ID NO: 265014 - RNA, 64 nt, Homo Sapiens
ucgguggccuccccaggccccuggacacgacaguucuccucaggcaggugggcuuugugguccu

SEQ ID NO: 265015 - RNA, 64 nt, Homo Sapiens
ucugggagaugcugcucugagcugcucucaguacucuccucaucauggcaguuaacacauuacc

SEQ ID NO: 265016 - RNA, 64 nt, Homo Sapiens
aaccugcuuugauuguucaggcacuuggccaccuucuccucacuccucccacagccuucugucu

SEQ ID NO: 265017 - RNA, 64 nt, Homo Sapiens
ucuuauuguucagaaaugggaaccucuccucaugucuccucauguuucagagcuucucacagca

SEQ ID NO: 265018 - RNA, 64 nt, Homo Sapiens
ucuccucaugucuuauuguuucucacagcaaaccucuccucaugaauaacucuuuuucagagcu

SEQ ID NO: 265019 - RNA, 64 nt, Homo Sapiens
ccaggaucagagaccuguugaauuugagugggugucuccucaagccuuaccuuucucagguguu

SEQ ID NO: 265020 - RNA, 64 nt, Homo Sapiens
uggggugugauuaugauaacuucaggcuuuuagcucuccucaaaguuugagguuaaaaaaaugu

SEQ ID NO: 265021 - RNA, 64 nt, Homo Sapiens
accuccuugccaccuuccuuccuccaagauaccaucuccucauccuaacccaggucuucggcac

SEQ ID NO: 265022 - RNA, 64 nt, Homo Sapiens
uugccugauggaaaaaaaacaaaggaauuaaaacucuccucaggcauucggaagucuuuuugcu

SEQ ID NO: 265023 - RNA, 64 nt, Homo Sapiens
uccugagcucuuggaggugcccaggaacccugcuucuccucacagggccuggccauauagccag

SEQ ID NO: 265024 - RNA, 64 nt, Homo Sapiens
ugcacagugccucacccacucccuucuccuggucucuccucaaaagaauuuuacaugauuuuaa

SEQ ID NO: 265025 - RNA, 64 nt, Homo Sapiens
aguagggaccgcuuucuuaccagaaaccacauuuucuccucagaaucgugauguaccuaaaagu

SEQ ID NO: 265026 - RNA, 64 nt, Homo Sapiens
ugaaugagccuaucagcaggaaggcaagcauauuucuccucauauaaaaaauucauuagcauga

SEQ ID NO: 265027 - RNA, 64 nt, Homo Sapiens
ucaggguguguccuauacaaaacuucccaucaguucuccucaauauuccccauuuguaaaugau

SEQ ID NO: 265028 - RNA, 64 nt, Homo Sapiens
uuauuugguauagauccacccaucccaaccuuucucuccucagucccugcuccucauguuucug

SEQ ID NO: 265029 - RNA, 64 nt, Homo Sapiens
ccuccccagaccugucuucugaucuggcccgagcucuccucagauggcuggagguugggggcag

SEQ ID NO: 265030 - RNA, 64 nt, Homo Sapiens
ucuggccucaguuccagagggccccucaguuuccucuccucauccuccaccuccucuccuccgg

SEQ ID NO: 265031 - RNA, 64 nt, Homo Sapiens
uguggcaggugagggggcucccgccugugccccuucuccucaccaugucucccccacccugccu

SEQ ID NO: 265032 - RNA, 64 nt, Homo Sapiens
ugaagcuguccccaucucagugucagaccagccuucuccucagcugaccacccuccucugaccc

SEQ ID NO: 265033 - RNA, 64 nt, Homo Sapiens
cuugcccgcagcccaggcuccugggccagugcucucuccucaaauggaggcagccauggccuga

SEQ ID NO: 265034 - RNA, 64 nt, Homo Sapiens
gccuccugugccgcgcacucacggagcugcguagucuccucagacauagucaaagcuuugccga

SEQ ID NO: 265035 - RNA, 64 nt, Homo Sapiens; identical to SEQ ID NO: 38453

SEQ ID NO: 265036 - RNA, 64 nt, Homo Sapiens; identical to SEQ ID NO: 38454

SEQ ID NO: 265037 - RNA, 64 nt, Homo Sapiens; identical to SEQ ID NO: 38455

SEQ ID NO: 265038 - RNA, 64 nt, Homo Sapiens; identical to SEQ ID NO: 38456

SEQ ID NO: 265039 - RNA, 64 nt, Homo Sapiens; identical to SEQ ID NO: 38457

SEQ ID NO: 265040 - RNA, 64 nt, Homo Sapiens; identical to SEQ ID NO: 38458

SEQ ID NO: 265041 - RNA, 64 nt, Homo Sapiens; identical to SEQ ID NO: 38459

SEQ ID NO: 265042 - RNA, 64 nt, Homo Sapiens; identical to SEQ ID NO: 38460

SEQ ID NO: 265043 - RNA, 64 nt, Homo Sapiens; identical to SEQ ID NO: 38461

SEQ ID NO: 265044 - RNA, 64 nt, Homo Sapiens; identical to SEQ ID NO: 38462

SEQ ID NO: 265045 - RNA, 64 nt, Homo Sapiens; identical to SEQ ID NO: 38463

SEQ ID NO: 265046 - RNA, 64 nt, Homo Sapiens; identical to SEQ ID NO: 38464

SEQ ID NO: 265047 - RNA, 64 nt, Homo Sapiens; identical to SEQ ID NO: 38465

SEQ ID NO: 265048 - RNA, 64 nt, Homo Sapiens; identical to SEQ ID NO: 38466

SEQ ID NO: 265049 - RNA, 64 nt, Homo Sapiens; identical to SEQ ID NO: 38467

SEQ ID NO: 265050 - RNA, 64 nt, Homo Sapiens; identical to SEQ ID NO: 38468

SEQ ID NO: 265051 - RNA, 64 nt, Homo Sapiens; identical to SEQ ID NO: 38469

SEQ ID NO: 265052 - RNA, 64 nt, Homo Sapiens; identical to SEQ ID NO: 38470

SEQ ID NO: 265053 - RNA, 64 nt, Homo Sapiens; identical to SEQ ID NO: 38471

SEQ ID NO: 265054 - RNA, 64 nt, Homo Sapiens; identical to SEQ ID NO: 38472

SEQ ID NO: 265055 - RNA, 64 nt, Homo Sapiens; identical to SEQ ID NO: 38473

SEQ ID NO: 265056 - RNA, 64 nt, Homo Sapiens; identical to SEQ ID NO: 38474

SEQ ID NO: 265057 - RNA, 64 nt, Homo Sapiens; identical to SEQ ID NO: 38475

SEQ ID NO: 265058 - RNA, 64 nt, Homo Sapiens; identical to SEQ ID NO: 38476

SEQ ID NO: 265059 - RNA, 64 nt, Homo Sapiens; identical to SEQ ID NO: 38477

SEQ ID NO: 265060 - RNA, 64 nt, Homo Sapiens; identical to SEQ ID NO: 38478

SEQ ID NO: 265061 - RNA, 64 nt, Homo Sapiens; identical to SEQ ID NO: 38479

SEQ ID NO: 265062 - RNA, 64 nt, Homo Sapiens; identical to SEQ ID NO: 38480

SEQ ID NO: 265063 - RNA, 64 nt, Homo Sapiens; identical to SEQ ID NO: 38481

SEQ ID NO: 265064 - RNA, 64 nt, Homo Sapiens; identical to SEQ ID NO: 38482

SEQ ID NO: 265065 - RNA, 64 nt, Homo Sapiens; identical to SEQ ID NO: 38483

SEQ ID NO: 265066 - RNA, 64 nt, Homo Sapiens; identical to SEQ ID NO: 38484

SEQ ID NO: 265067 - RNA, 64 nt, Homo Sapiens; identical to SEQ ID NO: 38485

SEQ ID NO: 265068 - RNA, 64 nt, Homo Sapiens; identical to SEQ ID NO: 38486

SEQ ID NO: 265069 - RNA, 64 nt, Homo Sapiens
uuagaacacugguuuaaagggauaaucaucucugucacauuagacuauccaucaugaccagcaa

SEQ ID NO: 265070 - RNA, 64 nt, Homo Sapiens
ugugauugggcguagaagugggagcauugggaccucacauuacacacacgagagaucauaacca

SEQ ID NO: 265071 - RNA, 64 nt, Homo Sapiens
gggaauauucccaauaaaggucuuaagagaaaagucacauuacaaguaauguaauggcucuacc

SEQ ID NO: 265072 - RNA, 64 nt, Homo Sapiens
aauugcuugucaaaauggcccaaaagaucugaauucacauuaaguuccccuugcacacuuaccu

SEQ ID NO: 265073 - RNA, 64 nt, Homo Sapiens
uuagcacuauagauaguauucaaugauagucaguucacauuaguauaaggaaaaacuuuuaucg

SEQ ID NO: 265074 - RNA, 64 nt, Homo Sapiens
ucugcucucucaagauuaaagcaaauuacauucaucacauuaccauuuucuagaggcucuggga

SEQ ID NO: 265075 - RNA, 64 nt, Homo Sapiens
aacaauacagaaggagagaugcucugaaaaugugucacauuauagguuacuuucccuagucaau

SEQ ID NO: 265076 - RNA, 64 nt, Homo Sapiens
uuauaaacaauacggaaggggcucugaagaugugucacauuauauuaugauuucccuagucagu

SEQ ID NO: 265077 - RNA, 64 nt, Homo Sapiens; identical to SEQ ID NO: 183750

SEQ ID NO: 265078 - RNA, 64 nt, Homo Sapiens; identical to SEQ ID NO: 183751

SEQ ID NO: 265079 - RNA, 64 nt, Homo Sapiens; identical to SEQ ID NO: 183752

SEQ ID NO: 265080 - RNA, 64 nt, Homo Sapiens; identical to SEQ ID NO: 183753

SEQ ID NO: 265081 - RNA, 64 nt, Homo Sapiens; identical to SEQ ID NO: 183754

SEQ ID NO: 265082 - RNA, 64 nt, Homo Sapiens; identical to SEQ ID NO: 183755

SEQ ID NO: 265083 - RNA, 64 nt, Homo Sapiens; identical to SEQ ID NO: 183756

SEQ ID NO: 265084 - RNA, 64 nt, Homo Sapiens; identical to SEQ ID NO: 183757

SEQ ID NO: 265085 - RNA, 64 nt, Homo Sapiens; identical to SEQ ID NO: 183758

SEQ ID NO: 265086 - RNA, 64 nt, Homo Sapiens; identical to SEQ ID NO: 183759

SEQ ID NO: 265087 - RNA, 64 nt, Homo Sapiens
gucacugcuguguucagcccgggcaggcgaccugcugacccacgccucuccuggggggccugcu

SEQ ID NO: 265088 - RNA, 64 nt, Homo Sapiens
cgcacucacgagccagguccagagaggucucuuccugacccagacaucucagccugagacgcac

SEQ ID NO: 265089 - RNA, 64 nt, Homo Sapiens
ggcuggacccuccguaaauuugguuugucucaaucugacccagcacccaaacccaaccacacaa

SEQ ID NO: 265090 - RNA, 64 nt, Homo Sapiens
cccaaccacacaaugguuugcccucuccagccugcugacccaaaaaugaucaaaaagaacagaa

SEQ ID NO: 265091 - RNA, 64 nt, Homo Sapiens
cuugccccaagcagaggcuauacugagaacccaccugacccaggaagacuuaacugugaaaaag

SEQ ID NO: 265092 - RNA, 64 nt, Homo Sapiens
ccguggacuuggcugagcaccuucuggaauguugcugacccaggccggcuacaaugcucuuccu

SEQ ID NO: 265093 - RNA, 64 nt, Homo Sapiens
cuuaguacauaugaccuuuauccauucuauuccucugacccauguuuaggguaaaauuaacaaa

SEQ ID NO: 265094 - RNA, 61 nt, Homo Sapiens
ugaggagagcucugauucucgccagccaccccugacccaaagguuggaccaaaccucguga

SEQ ID NO: 265095 - RNA, 64 nt, Homo Sapiens
cuuagagcuguggauuucugcauccccccugagucugacccauggacaccuguuucauucacuu

SEQ ID NO: 265096 - RNA, 64 nt, Homo Sapiens
ucucccagucucccagcagggacugauuucauuucugacccacuagguuuucuuuccagaaaua

SEQ ID NO: 265097 - RNA, 64 nt, Homo Sapiens
ucuggcggcugcugucguuguguucuaccccguacugacccaacaccacaagggcuuucucugg

SEQ ID NO: 265098 - RNA, 64 nt, Homo Sapiens
cccucugugugcucugaauauguccuuguccuuccugacccaucucugaccagcugggaaccug

SEQ ID NO: 265099 - RNA, 64 nt, Homo Sapiens
auuucccuauuuccagugcuuuccagccggguuucugacccagaggguggaaccggccuggacu

SEQ ID NO: 265100 - RNA, 64 nt, Homo Sapiens
ucgccaucuuaauaacaaaauaaacuacaaauuccugacccaaggacacuguguuauaagaggc

SEQ ID NO: 265101 - RNA, 64 nt, Homo Sapiens
ccucccgccuccuggccgacuuccugcagugucucugacccacgaccuccuuguccucacccag

SEQ ID NO: 265102 - RNA, 64 nt, Homo Sapiens
auuucuccucugcuucagagguccagcagccuggcugacccacugccuucuggcucaugguuca

SEQ ID NO: 265103 - RNA, 64 nt, Homo Sapiens
gaaaguugcaggaaaaccuuagucuuccauccuucugacccaugguggaaauucacaccaugga

SEQ ID NO: 265104 - RNA, 64 nt, Homo Sapiens
aguuucaugcugcacauaaugggguugcacuggucugacccaggacuuuggagccacccacacu

SEQ ID NO: 265105 - RNA, 64 nt, Homo Sapiens
cccaccccauugccaacaggucugaugggugaggcugacccaagugcccugguggagcuugugg

SEQ ID NO: 265106 - RNA, 64 nt, Homo Sapiens
cuucagugugggcugcugaacuguggaaacaggacugacccagccagcucugaucacuucccca

SEQ ID NO: 265107 - RNA, 64 nt, Homo Sapiens
cuaaguguugguuuaguggauguucguggaauugcugacccauccaagggcguccuuuggagcc

SEQ ID NO: 265108 - RNA, 64 nt, Homo Sapiens
cugcgguuguuacagaagcauggcggccuccagacugacccauugguugcccuuuagauuuugu

SEQ ID NO: 265109 - RNA, 64 nt, Homo Sapiens
auggaaccguacaaagccuaugaaaauucuuccacugacccaaauuauaaugucauuuguguug

SEQ ID NO: 265110 - RNA, 64 nt, Homo Sapiens
auggagcccaagagcagcuccugcuccugagaugcugacccagccagcagcuugcgcccucccu

SEQ ID NO: 265111 - RNA, 64 nt, Homo Sapiens
ggacaccaacgccgcauaggacugcccacaugggaccgcccacauaggaccgcccacauaggac

SEQ ID NO: 265112 - RNA, 64 nt, Homo Sapiens
cauaggacugcccacaugggaccgcccacauaggaccgcccacauaggaccgcccacaugggac

SEQ ID NO: 265113 - RNA, 64 nt, Homo Sapiens
caugggaccgcccacauaggaccgcccacauaggaccgcccacaugggaccgcccacaugggac

SEQ ID NO: 265114 - RNA, 64 nt, Homo Sapiens
cauaggaccgcccacauaggaccgcccacaugggaccgcccacaugggaccgcccacaugggac

SEQ ID NO: 265115 - RNA, 64 nt, Homo Sapiens
cauaggaccgcccacaugggaccgcccacaugggaccgcccacaugggaccgcccacauagaac

SEQ ID NO: 265116 - RNA, 64 nt, Homo Sapiens
caugggaccgcccacaugggaccgcccacaugggaccgcccacauagaaccguccuccaguggu

SEQ ID NO: 265117 - RNA, 64 nt, Homo Sapiens
ccagccucggccaggccugcucugcucagcgcccaccgcccaccaccccuccugcuuccccgag

SEQ ID NO: 265118 - RNA, 64 nt, Homo Sapiens
cagccugagcuccacccuccccucuucuugcggcaccgcccacccacaccccgucugccccuug

SEQ ID NO: 265119 - RNA, 64 nt, Homo Sapiens
gcucugccccuccguccccagggugcaggcgcgcaccgcccaacccccaccucccgguguaugc

SEQ ID NO: 265120 - RNA, 64 nt, Homo Sapiens
uacccgggccuccccucgucccucuucuagugguaccgcccaggccuuaaucacccccauuccg

SEQ ID NO: 265121 - RNA, 64 nt, Homo Sapiens
gccccgcccaggcacggccgaccccgccccgggcaccgcccaccgagccauccugccucgccuc

SEQ ID NO: 265122 - RNA, 64 nt, Homo Sapiens
uucucccugagggcccaccaugugcugcauacccaccgcccagcucccugagggcccaccagcc

SEQ ID NO: 265123 - RNA, 64 nt, Homo Sapiens
uucucccugagggcccaccaugugcugcauacccaccgcccagcccucugagggcccaccagcc

SEQ ID NO: 265124 - RNA, 61 nt, Homo Sapiens
aggucaagccggugggcugaggcccgugggccgcgcggauccgggaucugcgcuggggggu

SEQ ID NO: 265125 - RNA, 61 nt, Homo Sapiens
gaucugcgcugggggguccccgcgugcggggcgcgcggagccuucccuucgcccuggugag

SEQ ID NO: 265126 - RNA, 64 nt, Homo Sapiens
uuuauuuggcucacaguucuacuggguaacgugaugaacaaaaagcuauaacagaauaccacag

SEQ ID NO: 265127 - RNA, 64 nt, Homo Sapiens
auuuuuaucauuuaaaaaucaguuuauuaacaacugaacaaaacaauguuucuaaguugcacac

SEQ ID NO: 265128 - RNA, 64 nt, Homo Sapiens
uucaaaaagaugcacuuaguauuaaguugaaacuugaacaaauagauggucacauugcugaaca

SEQ ID NO: 265129 - RNA, 64 nt, Homo Sapiens
uuaaaaauguguccauuguugcauuuuauauauaugaacaaacaaaaaaugcacaguucauaau

SEQ ID NO: 265130 - RNA, 64 nt, Homo Sapiens
gaaauaaagcagggacuguguuuuaaagcgugugugaacaaauggcauguguuuuuuuuuuuuu

SEQ ID NO: 265131 - RNA, 64 nt, Homo Sapiens
aauuuucaauauuugauuggacaucuuuguguuuugaacaaaggaaacucccauuaaaaacaaa

SEQ ID NO: 265132 - RNA, 64 nt, Homo Sapiens
cuggaaauggauagcgaugaguuucuguuugggaugaacaaauuuauuguuuaacgaguacaua

SEQ ID NO: 265133 - RNA, 64 nt, Homo Sapiens
uuaaugucgauaauaaaacacuaaaucuucagcaugaacaaauauuuugcccauuacuucaucc

SEQ ID NO: 265134 - RNA, 64 nt, Homo Sapiens
cuacgcacauaccuucaugucagucuauuuccacugaacaaaaccagugccuuccucucucuac

SEQ ID NO: 265135 - RNA, 64 nt, Homo Sapiens
cuacacacauaccuucaugucagucuauuuccacugaacaaaaccacugccuuccucucucuac

SEQ ID NO: 265136 - RNA, 64 nt, Homo Sapiens
cuacacacguaccuucauguacugaagaagucacugaacaaaacuuugcucagcuggcugagac

SEQ ID NO: 265137 - RNA, 64 nt, Homo Sapiens
gcuagacuuucuggagugauguggucuguuugucugaacaaaguuuauaucuuccuaauaaggu

SEQ ID NO: 265138 - RNA, 64 nt, Homo Sapiens
agacauaggccaugaaaaaaaugauccccaagugugaacaaaagaugcucuucuguggaccacu

SEQ ID NO: 265139 - RNA, 64 nt, Homo Sapiens
uuuuaaggaaacaauauaaccacaaagcacaguuugaacaaaaucuccucuuuuagcugaugaa

SEQ ID NO: 265140 - RNA, 64 nt, Homo Sapiens
uggggagggcggggccaaucagucaaugauaaucugaacaaauuuuaagagcagauuuuagauu

SEQ ID NO: 265141 - RNA, 64 nt, Homo Sapiens
uuugggcaggacauuccaugcacuggaaauagcaugaacaaaugcaugaaaauugccuacaaca

SEQ ID NO: 265142 - RNA, 64 nt, Homo Sapiens
uaguuucuggcacuauuuuucuuuucaauauauuugaacaaauaaucuauuuguauucuuauac

SEQ ID NO: 265143 - RNA, 64 nt, Homo Sapiens
gaauauauuuauucagcuucugaguuuccaugacugaacaaagaccacaugucauuucuaaugu

SEQ ID NO: 265144 - RNA, 64 nt, Homo Sapiens
uaucagaaaggguaacucgaagaauuaacauucuugaacaaaggugugccauggauuucugaua

SEQ ID NO: 265145 - RNA, 64 nt, Homo Sapiens
accaucaaucauccaucagaaugaagaucuuccaugaacaaacuaacuagauaauucccauaag

SEQ ID NO: 265146 - RNA, 64 nt, Homo Sapiens
uguguuuugaguuuagcugauuugguuugaaccgugaacaaaaccucuggaacgugaagagcug

SEQ ID NO: 265147 - RNA, 64 nt, Homo Sapiens
ggacgcagguuauuugggguggacgucagggaaaugaacaaaagacaaggggacagacaagcug

SEQ ID NO: 265148 - RNA, 64 nt, Homo Sapiens
aauuaaaaucauaauauaaacgcuugguuuuacaugaacaaaaaguggugugcucgaaaaagac

SEQ ID NO: 265149 - RNA, 64 nt, Homo Sapiens
ugugugugcaugcacucaggugcccuuuguuucaugaacaaauacauuucauuguacauguuuu

SEQ ID NO: 265150 - RNA, 63 nt, Homo Sapiens
aaaugcaaacauaacguuucugcaauaaacaccuugaacaaagugcauguacgcccucugaga

SEQ ID NO: 265151 - RNA, 64 nt, Homo Sapiens
ccaaacucuucccauaaauuguacauauaacuuuugaacaaaccguguuuuugaagguuucaau

SEQ ID NO: 265152 - RNA, 64 nt, Homo Sapiens
gggaccaucaacauuguagauauuaaaacuugacugaacaaaagcuguagaacaguuuuauuuu

SEQ ID NO: 265153 - RNA, 64 nt, Homo Sapiens
gcaauuaacuguagaacaguuuggaaauuuacacugaacaaaguguuuaaccugcucuugguca

SEQ ID NO: 265154 - RNA, 64 nt, Homo Sapiens
agucaauuaaguacacuuuaacaaaguuuaugucugaacaaauaacacagaucacaggggccuu

SEQ ID NO: 265155 - RNA, 64 nt, Homo Sapiens
cauaaauauuuuaagaaaaaauuucauuguaaaaugaacaaauaagugcucauaaucacuugca

SEQ ID NO: 265156 - RNA, 64 nt, Homo Sapiens
caaccagcgauacguaaucauacaaccuauguuuugaacaaaaaaauguacuggcagauuaaca

SEQ ID NO: 265157 - RNA, 64 nt, Homo Sapiens
ggacucuugugagaagacuaauuccacaagcuaaugaacaaaagaaaaacauacagacacucaa

SEQ ID NO: 265158 - RNA, 64 nt, Homo Sapiens
cuccugcaggccaggaaguauaauagcaaaaaguugaacaaagaugaacuaauguauuacauua

SEQ ID NO: 265159 - RNA, 64 nt, Homo Sapiens
gccuauuuugauuuagaaaucacuuuaagauaaaugaacaaaauuauuguaagucuucuaaacu

SEQ ID NO: 265160 - RNA, 64 nt, Homo Sapiens
acuuaaugcuuuuuaagcacguacacgguuguuaugaacaaaugugaaaaauaagaagaugaga

SEQ ID NO: 265161 - RNA, 64 nt, Homo Sapiens
auuaaacuccaaauauuaaaauguagauuauuaaugaacaaaagcuaggaguuucuuagacccu

SEQ ID NO: 265162 - RNA, 64 nt, Homo Sapiens
gccgaaaucaaagccaucugaagccugucucuggugaacaaacuuccucucuggccucucagga

SEQ ID NO: 265163 - RNA, 64 nt, Homo Sapiens
gccaaucucucauuuagaccuggcuucuuucuucugaacaaaguaggguucaaaaugcagacug

SEQ ID NO: 265164 - RNA, 64 nt, Homo Sapiens
aaaguacuguacucacacacauaaaacaguuauuugaacaaacaaaucuuucagugccuuuguc

SEQ ID NO: 265165 - RNA, 64 nt, Homo Sapiens
agcaacaauuaagugaccccagugaaucucaguuugaacaaacuuucuacuaaaaguuuuaugc

SEQ ID NO: 265166 - RNA, 64 nt, Homo Sapiens
uaaaaauucauugaagcugaaacaaaugcaagauugaacaaaaucuuuaaauuguuuuugguug

SEQ ID NO: 265167 - RNA, 64 nt, Homo Sapiens
caagauugaacaaaauuaaaaaauuguuuuugguugaacaaaugugauugucguguuccucuuu

SEQ ID NO: 265168 - RNA, 64 nt, Homo Sapiens
aaaauucccagaccacagaaaugccuugaaagaaugaacaaauagaaauuauccuuucuuacua

SEQ ID NO: 265169 - RNA, 64 nt, Homo Sapiens
uacauacacucaggaagguaagaggcccaauaaaugaacaaauguucauuuucauuuguugggc

SEQ ID NO: 265170 - RNA, 64 nt, Homo Sapiens
uccuuuguuccucaaaccccaucugucagaccacugaacaaauacacauacuaggccucaagug

SEQ ID NO: 265171 - RNA, 64 nt, Homo Sapiens
auaaagagcugauaacaguacucagaagaaucugugaacaaauacuugaaaauggguucaaugu

SEQ ID NO: 265172 - RNA, 64 nt, Homo Sapiens
uaucagugaugaaaauuugcagugcaccacccuuugaacaaaugaauugguccaacccagccug

SEQ ID NO: 265173 - RNA, 64 nt, Homo Sapiens
aaagacauugaaagcucuauaaaagcuaagagggugaacaaagaaggcuggguccaggggaggg

SEQ ID NO: 265174 - RNA, 64 nt, Homo Sapiens
agcagacgaaacgaaguaagcuauauuucuggacugaacaaagcucugcuguuuagagcauuua

SEQ ID NO: 265175 - RNA, 64 nt, Homo Sapiens
uguagaucugcuauugaaucagaaucuguguacuugaacaaaugugugaaucucaaauaucuca

SEQ ID NO: 265176 - RNA, 64 nt, Homo Sapiens
gaaagaauauaaauauccuguacacggcagauugugaacaaacuauauuccuuuaaguuuuccu

SEQ ID NO: 265177 - RNA, 64 nt, Homo Sapiens
ugauguucagauuuuccagugaaaaauacccuucugaacaaaacauguacuuacucuccgaaag

SEQ ID NO: 265178 - RNA, 64 nt, Homo Sapiens
caagugccaaaggcagacgugcuuuauagcuaaaugaacaaagcaaaggauacagagguauguu

SEQ ID NO: 265179 - RNA, 64 nt, Homo Sapiens
uuauuggccagggaaaacuaauucaauuuuuuuuugaacaaaguauaacugagacuauuuuugg

SEQ ID NO: 265180 - RNA, 64 nt, Homo Sapiens; identical to SEQ ID NO: 168843

SEQ ID NO: 265181 - RNA, 64 nt, Homo Sapiens; identical to SEQ ID NO: 168844

SEQ ID NO: 265182 - RNA, 56 nt, Homo Sapiens; identical to SEQ ID NO: 168845

SEQ ID NO: 265183 - RNA, 64 nt, Homo Sapiens; identical to SEQ ID NO: 168846

SEQ ID NO: 265184 - RNA, 64 nt, Homo Sapiens; identical to SEQ ID NO: 168847

SEQ ID NO: 265185 - RNA, 64 nt, Homo Sapiens; identical to SEQ ID NO: 168848

SEQ ID NO: 265186 - RNA, 64 nt, Homo Sapiens; identical to SEQ ID NO: 168849

SEQ ID NO: 265187 - RNA, 64 nt, Homo Sapiens; identical to SEQ ID NO: 168850

SEQ ID NO: 265188 - RNA, 64 nt, Homo Sapiens; identical to SEQ ID NO: 168851

SEQ ID NO: 265189 - RNA, 64 nt, Homo Sapiens; identical to SEQ ID NO: 168852

SEQ ID NO: 265190 - RNA, 64 nt, Homo Sapiens; identical to SEQ ID NO: 168853

SEQ ID NO: 265191 - RNA, 64 nt, Homo Sapiens; identical to SEQ ID NO: 168854

SEQ ID NO: 265192 - RNA, 64 nt, Homo Sapiens; identical to SEQ ID NO: 168855

SEQ ID NO: 265193 - RNA, 64 nt, Homo Sapiens; identical to SEQ ID NO: 168856

SEQ ID NO: 265194 - RNA, 64 nt, Homo Sapiens; identical to SEQ ID NO: 168857

SEQ ID NO: 265195 - RNA, 64 nt, Homo Sapiens; identical to SEQ ID NO: 168858

SEQ ID NO: 265196 - RNA, 64 nt, Homo Sapiens; identical to SEQ ID NO: 168859

SEQ ID NO: 265197 - RNA, 64 nt, Homo Sapiens; identical to SEQ ID NO: 168860

SEQ ID NO: 265198 - RNA, 64 nt, Homo Sapiens
accuaaaucucccauccaguucaggaggugacaacauccuuauuuuaaacuuccuaaaauuagg

SEQ ID NO: 265199 - RNA, 64 nt, Homo Sapiens
gucacuuggaggcagccaacacuucuggacauugcauccuuauucacacauguggcagcugaac

SEQ ID NO: 265200 - RNA, 64 nt, Homo Sapiens
cagccuuauccagguugguuuguuugggcuuuaacauccuuauuuguacuuuuccuuugcuagu

SEQ ID NO: 265201 - RNA, 64 nt, Homo Sapiens
guuuaggccuugccaguuuuccugaggucucauucauccuuaugccagacugacagacuuagaa

SEQ ID NO: 265202 - RNA, 64 nt, Homo Sapiens
cacagucccucagguucuacugggaucucaucaucauccuuagucaagcagcagggcccuggcc

SEQ ID NO: 265203 - RNA, 64 nt, Homo Sapiens
gcuggaucaugcuugcccuccacagggaauacagcauccuuacagcuugcaugcaaucaaccuc

SEQ ID NO: 265204 - RNA, 64 nt, Homo Sapiens
cuuuucucugauguuuuaccuuuaaaagauccaacauccuuaccguugguauuuuuaguaaggu

SEQ ID NO: 265205 - RNA, 64 nt, Homo Sapiens
agagauagccauuauuauuaauauuugguauguacauccuuauauuauuuuuuucuuaugcaug

SEQ ID NO: 265206 - RNA, 62 nt, Homo Sapiens
ugggggaggcacuggcgggaggccucgggcuccccuggaagggcgcugggcuggcgggucag

SEQ ID NO: 265207 - RNA, 62 nt, Homo Sapiens
gcuguggaagaacucugcucgagggcagggugcccuggaacacugguaguucuggggcuggg

SEQ ID NO: 265208 - RNA, 62 nt, Homo Sapiens
auuuguuuucugugagagcacugaaauggcagcccuggaaucuacaauuuggcucuccacug

SEQ ID NO: 265209 - RNA, 62 nt, Homo Sapiens
cacagccgguucugcacuuaucaccgagucgccccuggaagcagauucccauugaguuuucc

SEQ ID NO: 265210 - RNA, 62 nt, Homo Sapiens
cagcacccugggugccauucgaaaagaggagacccuggaauugggcaugugugccuguggca

SEQ ID NO: 265211 - RNA, 62 nt, Homo Sapiens
gggaguugagucacaagaggauguucccugcacccuggaaaguggaaggcagggcagaggga

SEQ ID NO: 265212 - RNA, 62 nt, Homo Sapiens
aguauuuuucccacauuuuuaacucccucucucccuggaauauaauuugaccacagcaucug

SEQ ID NO: 265213 - RNA, 62 nt, Homo Sapiens
cugaaauggguggaauagcguggugucuuacucccuggaagcuaaaagcaguauuuuaaggu

SEQ ID NO: 265214 - RNA, 57 nt, Homo Sapiens
cccagcucagcaucagcuaaaccacaacccuggaagaggcggccuaaggagauucca

SEQ ID NO: 265215 - RNA, 62 nt, Homo Sapiens
cuuaaaaagauacacaaagaugggcugugggucccuggaaagggggagaguugcccuuuaca

SEQ ID NO: 265216 - RNA, 62 nt, Homo Sapiens
augaacaugagaaaauuuauacuguagagaaacccuggaaaugugaagaacguggcaaaguu

SEQ ID NO: 265217 - RNA, 62 nt, Homo Sapiens
acuguauauauauaauuccuacugaagaaauccccuggaaaugcaaaaaauguggcaggauu

SEQ ID NO: 265218 - RNA, 62 nt, Homo Sapiens
agcacuggacauagaccuagagcaaccuguuacccuggaaagaguccuuuaaaaugaguaga

SEQ ID NO: 265219 - RNA, 62 nt, Homo Sapiens
gggucagggcccuugguggugaggccuugcagcccuggaaguucuggaacagcggcaaccaa

SEQ ID NO: 265220 - RNA, 62 nt, Homo Sapiens
aacaucuuccgaguccuucuccccucacucugcccuggaaucgaagagccucauccugucug

SEQ ID NO: 265221 - RNA, 62 nt, Homo Sapiens
gccugucccuuuucucugggcugaauccuagacccuggaauagguguugagauggggcagcu

SEQ ID NO: 265222 - RNA, 62 nt, Homo Sapiens
ugaagcccuuggugaugaggacauagcaucugcccuggaaaucguuauuccaacauaauauu

SEQ ID NO: 265223 - RNA, 62 nt, Homo Sapiens
guuauuccaacauaauauuauuuucuagaaugcccuggaaggacagaauauuuaaaaauaua

SEQ ID NO: 265224 - RNA, 62 nt, Homo Sapiens
ccccaagagaauaccaagacaagcaggcuguucccuggaaaaaaucuaaugcaaggagggcu

SEQ ID NO: 265225 - RNA, 62 nt, Homo Sapiens
ccacacagggggcgugggagcaucccaguuaucccuggaaagcuagaaggggacagaggugu

SEQ ID NO: 265226 - RNA, 62 nt, Homo Sapiens
gguuucaagaagucuuagggcuuccagggguccccuggaagcuuuagaauauuuauggguuu

SEQ ID NO: 265227 - RNA, 62 nt, Homo Sapiens
ggacaggaagccuggcacccacuucugucuuccccuggaacugggcacuggcguacacuggu

SEQ ID NO: 265228 - RNA, 62 nt, Homo Sapiens
ccauggauggucuuccuaguugccuggggaaacccuggaaugggcaucaggagaaagcaaca

SEQ ID NO: 265229 - RNA, 62 nt, Homo Sapiens
ccguuuucugauuugcuuugaugggcucaggacccuggaauuccaccccacugggcccaacc

SEQ ID NO: 265230 - RNA, 62 nt, Homo Sapiens
aucccguccuguaucauauggccaggccgagccccuggaaccgagggcagggcugcggggag

SEQ ID NO: 265231 - RNA, 62 nt, Homo Sapiens
auguaaaggucuguuguugaauuguacucugccccuggaagcagauacagauggcugccugc

SEQ ID NO: 265232 - RNA, 62 nt, Homo Sapiens
gcccucugaggccccguacaccagaagggaggcccuggaaaauuuugugcuuccaacguggc

SEQ ID NO: 265233 - RNA, 62 nt, Homo Sapiens
ugaacuaacaaaccugugaacuguaaauaggccccuggaagcacgugcuuaagcccuuuugc

SEQ ID NO: 265234 - RNA, 62 nt, Homo Sapiens
uaggaucugcauuuucagguuccgagccugaccccuggaacugaccagcgcucgauugucag

SEQ ID NO: 265235 - RNA, 62 nt, Homo Sapiens
cugggaaauugaggggacggcaggcccggcugcccuggaacugggagacagggagaaucccc

SEQ ID NO: 265236 - RNA, 62 nt, Homo Sapiens
acugggagacagggagaauccccugccggggucccuggaaacagugcccaccccacaucacu

SEQ ID NO: 265237 - RNA, 62 nt, Homo Sapiens
ccaucuuucuucaucuuucccgggagcccaugcccuggaaauagcgaggggcagauucuagu

SEQ ID NO: 265238 - RNA, 62 nt, Homo Sapiens
gucuggucugagugugacuuccaucuuccaaucccuggaaaaugcaccuccuuucccucucu

SEQ ID NO: 265239 - RNA, 62 nt, Homo Sapiens
cccaaggcucuuccuccagccacaugcuugugcccuggaagcaguuuuguaggggucacugu

SEQ ID NO: 265240 - RNA, 64 nt, Homo Sapiens
gcaggugugccagggcucagggcucagacuugggagggccuaggcagaagccccaaguucuguu

SEQ ID NO: 265241 - RNA, 64 nt, Homo Sapiens
gccuuuugcugugucuucgcuguguguuagacguagggccuagagcucggggugugugugugcg

SEQ ID NO: 265242 - RNA, 64 nt, Homo Sapiens
ggugccuaaugcuacuggaaguggaacuugagauagggccuaauuuguuauacauauuagccaa

SEQ ID NO: 265243 - RNA, 64 nt, Homo Sapiens
guuuauuccuucaaucauuucaaacauugaaaguagggccuacaugguuauuugccugcucacu

SEQ ID NO: 265244 - RNA, 60 nt, Homo Sapiens
uuuuggugcggggugggaagccacauuuguucacaggaguggaauuuauagaggcuacaa

SEQ ID NO: 265245 - RNA, 60 nt, Homo Sapiens
uggaucugaagcacaguaaauaucagucgcucacaggacuguuguaacucccauguggag

SEQ ID NO: 265246 - RNA, 60 nt, Homo Sapiens
gacaugucaaucuuggucauuccaccacugucacaggaagagaguuaucaaggcacauuc

SEQ ID NO: 265247 - RNA, 60 nt, Homo Sapiens
aaccugccaagcuuggucauuucaccacugucacaggaagagaguuaucgaggcacauac

SEQ ID NO: 265248 - RNA, 60 nt, Homo Sapiens
cacuugccaagcuuggucauuucaccaccgucacaggaagagaguuaucgaggcacauac

SEQ ID NO: 265249 - RNA, 60 nt, Homo Sapiens
gcucccgcaccugucgguggcugccuuugaucacaggagcaaucacaggaaaauguaucc

SEQ ID NO: 265250 - RNA, 60 nt, Homo Sapiens
gucgguggcugccuuugaucacaggagcaaucacaggaaaauguauccagaggaauugau

SEQ ID NO: 265251 - RNA, 60 nt, Homo Sapiens
acggugauucuugcccuuaagggaauguauucacaggaaguaguggaauucuuaaauuau

SEQ ID NO: 265252 - RNA, 60 nt, Homo Sapiens
aaucaacaagauagugaucucagaagaaauucacaggaaaucuuuuuaagcuugaaacug

SEQ ID NO: 265253 - RNA, 60 nt, Homo Sapiens
gagggggccccacaggcuccgacgagagccucacaggaggucagaaaugcagacacccca

SEQ ID NO: 265254 - RNA, 60 nt, Homo Sapiens
aguuugugggcugguuucccccccacagccucacaggagcugcauggagaaaugggcugg

SEQ ID NO: 265255 - RNA, 60 nt, Homo Sapiens
gagcgggagcaggauguggcagcucagacgucacaggaggaaagaaaaccauuuucaggg

SEQ ID NO: 265256 - RNA, 60 nt, Homo Sapiens
aaucuuuacuccuguaagcaagagccaaccucacaggauuaggagcugggguagaacugg

SEQ ID NO: 265257 - RNA, 60 nt, Homo Sapiens
uuaaagauauggcugcuucaaaggccagagucacaggaaggacuucuuccagggagauua

SEQ ID NO: 265258 - RNA, 60 nt, Homo Sapiens
gaugaagaccuagacuuaccugaaggaucuucacaggaggauaaagacguagaauuaccu

SEQ ID NO: 265259 - RNA, 60 nt, Homo Sapiens
gauaaagacguagaauuaccugaaggaucuucacaggaggaugaagaccuagagaaaaag

SEQ ID NO: 265260 - RNA, 60 nt, Homo Sapiens
augaagaccuaggguuaucuugaaggaucuucacaggagggaugaagaccuacaauuacc

SEQ ID NO: 265261 - RNA, 60 nt, Homo Sapiens
augaagaccuagacucaucucgaaggauccucacaggaggccaguccaagaggaggagga

SEQ ID NO: 265262 - RNA, 64 nt, Homo Sapiens
gacuggagagagaagccuggucaaaggagaugccacgcaggacacucccuggcuucucugaccc

SEQ ID NO: 265263 - RNA, 64 nt, Homo Sapiens
acacccagcccccacauccuucagcuuccccaacacgcaggagcgccacccugggccuggcagc

SEQ ID NO: 265264 - RNA, 64 nt, Homo Sapiens
uggggagacuccccucuugcuguguguacuggacacgcaggaagcaugcugucuugcugccucu

SEQ ID NO: 265265 - RNA, 64 nt, Homo Sapiens
guggcgaggggugcgcuguggaacugccgcagccacgcaggaggucccugggggaugcuuuggg

SEQ ID NO: 265266 - RNA, 64 nt, Homo Sapiens
ugaaaaccucggaaguuuuaauuugagguuaucugcuacgaaacaguauuucuaaaaggcuaaa

SEQ ID NO: 265267 - RNA, 64 nt, Homo Sapiens
gaugagcagagcccggagcugucaucgagauggagcuacgaaagccaaaggcccaaaggugaug

SEQ ID NO: 265268 - RNA, 64 nt, Homo Sapiens
cuccaccucagcauugcaucguaucaucauuuucgcuacgaauuuauuuuucaacaauaagcuu

SEQ ID NO: 265269 - RNA, 64 nt, Homo Sapiens
ggaauagcgaaaaagcaaauacaacgaauuuggggcuacgaagacacagcggagaccgccucca

SEQ ID NO: 265270 - RNA, 64 nt, Homo Sapiens
aagacuccuuuccugcaucugcaacgacuacuuugcuacgaagauacaaaagaaaccaugcaaa

SEQ ID NO: 265271 - RNA, 64 nt, Homo Sapiens
agccugcaacaggcuggccacgcagccgacgcccgcuacgaagccagacccgggaagggaaguc

SEQ ID NO: 265272 - RNA, 64 nt, Homo Sapiens
ggaauggaccuuguauagaucuggaggaaagaaagcuacgaaaaacuuuuuaaaaguucuagug

SEQ ID NO: 265273 - RNA, 64 nt, Homo Sapiens
gaugcuucugagagaauguagucaaaaugaucaugcuacgaaaaaguuaacuguuuuuuuuuua

SEQ ID NO: 265274 - RNA, 64 nt, Homo Sapiens
ucagaagaacugagcaaacuaacagaaauacaaggcuacgaacaguuuaguggacaacuaaauc

SEQ ID NO: 265275 - RNA, 64 nt, Homo Sapiens
cagcaggcgugaggcacugugcgucugcagaggggcuacgaaccaggugcagggucccagcugg

SEQ ID NO: 265276 - RNA, 64 nt, Homo Sapiens
ggcccgggauagaagaggggagguaagucugggggcuacgaagccgggcccccacacccuggcu

SEQ ID NO: 265277 - RNA, 64 nt, Homo Sapiens
agcugacagccuuggaguucagugcuuccccagggcuacgaaggaagcugaacacgcguccagu

SEQ ID NO: 265278 - RNA, 64 nt, Homo Sapiens
cugcgcucugccacuguccggaaauucaugguuggcuacgaaaugcuugcucaggcucagaggg

SEQ ID NO: 265279 - RNA, 64 nt, Homo Sapiens
uuccgauggaugaaucucccgacuggaccugguggcuacgaaucaaagugcauaugaaauccuu

SEQ ID NO: 265280 - RNA, 64 nt, Homo Sapiens
auguauguguuauaauacaacuuaguacauuaaagcuacgaaaacucauccuggcuguaggaua

SEQ ID NO: 265281 - RNA, 64 nt, Homo Sapiens
uccucaucugccucccucgaaucccaggcugccugcuacgaagcagugggcuggcugagauuuc

SEQ ID NO: 265282 - RNA, 64 nt, Homo Sapiens
cauuucucuugauuuuuaguauugcaguaauggugcuacgaagcacaacguauguaauuguaac

SEQ ID NO: 265283 - RNA, 64 nt, Homo Sapiens
aggcuaugaauaaggguuaucaugguuuuuagaggcuacgaauagccaacauccgucucuugag

SEQ ID NO: 265284 - RNA, 64 nt, Homo Sapiens
aauaccccaaacuggguaauucuguucucacacugcuacgaagagagaaaauggagguuuaugg

SEQ ID NO: 265285 - RNA, 64 nt, Homo Sapiens
ggucuccuuugugugugaagcuggggcagaguaugcuacgaagggaccaggccaggccacaggg

SEQ ID NO: 265286 - RNA, 64 nt, Homo Sapiens
aauguuaaguacaacauucugaaaauacaauuuggcuacgaagaguauucaucuucuuugaagc

SEQ ID NO: 265287 - RNA, 64 nt, Homo Sapiens
aaaccccaagacccagagagcccagaucucaugugcuacgaaggaaucuugucccucuguugag

SEQ ID NO: 265288 - RNA, 64 nt, Homo Sapiens
uuugcccagaugaagccaggauccugccagaggcgcuacgaagcccucgggggacuggacacac

SEQ ID NO: 265289 - RNA, 64 nt, Homo Sapiens
ccuagggauaagcaauguucuuuauguagccaaugcuacgaaacaaaagaggugaaagagaccc

SEQ ID NO: 265290 - RNA, 64 nt, Homo Sapiens
uauggaguguaggaaagccuccauggacagaaaagcuacgaaugugcagauaugugaauggacu

SEQ ID NO: 265291 - RNA, 64 nt, Homo Sapiens
accaaagguuuacauuugcaccuuagccucaauagcuacgaacccuagagaagcagcuagcugg

SEQ ID NO: 265292 - RNA, 64 nt, Homo Sapiens
aaggcucugugggaggaugaaggagugcgugccugcuacgaacgcuccaacgaguaccagcuga

SEQ ID NO: 265293 - RNA, 64 nt, Homo Sapiens
uguagaauguuaaaagcacaaaauagcguucauggcuacgaauauacauugagggaauaucaaa

SEQ ID NO: 265294 - RNA, 64 nt, Homo Sapiens
auaauccugaaaugaagagaauucccuuccagaagcuacgaaaaagggagcuguuuaaauuuaa

SEQ ID NO: 265295 - RNA, 64 nt, Homo Sapiens
guaacuguggaguggaugggcaggcagugugggugcauggcagcuuguguggagugugcgugug

SEQ ID NO: 265296 - RNA, 64 nt, Homo Sapiens
accaucgccacucugggcaccagccccuccccuggcauggcaggcccauugcugccaaugcugg

SEQ ID NO: 265297 - RNA, 64 nt, Homo Sapiens
ucagauuuauacaggagucuauaagcuuggccuagcauggcaaaugcagaauguauguaauaaa

SEQ ID NO: 265298 - RNA, 64 nt, Homo Sapiens
ugcuguuuugguugaaaucaguugauaugcaacugcauggcaugacuguggcccaucaacagac

SEQ ID NO: 265299 - RNA, 64 nt, Homo Sapiens; identical to SEQ ID NO: 112230

SEQ ID NO: 265300 - RNA, 64 nt, Homo Sapiens; identical to SEQ ID NO: 112231

SEQ ID NO: 265301 - RNA, 64 nt, Homo Sapiens; identical to SEQ ID NO: 112232

SEQ ID NO: 265302 - RNA, 64 nt, Homo Sapiens; identical to SEQ ID NO: 112233

SEQ ID NO: 265303 - RNA, 64 nt, Homo Sapiens; identical to SEQ ID NO: 112234

SEQ ID NO: 265304 - RNA, 64 nt, Homo Sapiens; identical to SEQ ID NO: 112235

SEQ ID NO: 265305 - RNA, 64 nt, Homo Sapiens; identical to SEQ ID NO: 112236

SEQ ID NO: 265306 - RNA, 64 nt, Homo Sapiens; identical to SEQ ID NO: 112237

SEQ ID NO: 265307 - RNA, 64 nt, Homo Sapiens; identical to SEQ ID NO: 112238

SEQ ID NO: 265308 - RNA, 64 nt, Homo Sapiens; identical to SEQ ID NO: 112239

SEQ ID NO: 265309 - RNA, 64 nt, Homo Sapiens; identical to SEQ ID NO: 112240

SEQ ID NO: 265310 - RNA, 64 nt, Homo Sapiens; identical to SEQ ID NO: 112241

SEQ ID NO: 265311 - RNA, 64 nt, Homo Sapiens; identical to SEQ ID NO: 112242

SEQ ID NO: 265312 - RNA, 64 nt, Homo Sapiens; identical to SEQ ID NO: 112243

SEQ ID NO: 265313 - RNA, 64 nt, Homo Sapiens; identical to SEQ ID NO: 112244

SEQ ID NO: 265314 - RNA, 64 nt, Homo Sapiens; identical to SEQ ID NO: 112245

SEQ ID NO: 265315 - RNA, 64 nt, Homo Sapiens; identical to SEQ ID NO: 112246

SEQ ID NO: 265316 - RNA, 64 nt, Homo Sapiens; identical to SEQ ID NO: 112247

SEQ ID NO: 265317 - RNA, 64 nt, Homo Sapiens; identical to SEQ ID NO: 112248

SEQ ID NO: 265318 - RNA, 64 nt, Homo Sapiens; identical to SEQ ID NO: 112249

SEQ ID NO: 265319 - RNA, 64 nt, Homo Sapiens; identical to SEQ ID NO: 112250

SEQ ID NO: 265320 - RNA, 64 nt, Homo Sapiens; identical to SEQ ID NO: 112251

SEQ ID NO: 265321 - RNA, 64 nt, Homo Sapiens; identical to SEQ ID NO: 112252

SEQ ID NO: 265322 - RNA, 64 nt, Homo Sapiens; identical to SEQ ID NO: 112253

SEQ ID NO: 265323 - RNA, 64 nt, Homo Sapiens; identical to SEQ ID NO: 112254

SEQ ID NO: 265324 - RNA, 64 nt, Homo Sapiens; identical to SEQ ID NO: 112255

SEQ ID NO: 265325 - RNA, 64 nt, Homo Sapiens; identical to SEQ ID NO: 112256

SEQ ID NO: 265326 - RNA, 64 nt, Homo Sapiens; identical to SEQ ID NO: 112257

SEQ ID NO: 265327 - RNA, 64 nt, Homo Sapiens; identical to SEQ ID NO: 112258

SEQ ID NO: 265328 - RNA, 64 nt, Homo Sapiens
cuagcuguauuccuaaacaaauuguuuccuaaacaaaugugaaaaugugaacagugcugaaagg

SEQ ID NO: 265329 - RNA, 64 nt, Homo Sapiens
auuccuaaacaaauuguuuccuaaacaaaugugaaaaugugaacagugcugaaagguuuuguga

SEQ ID NO: 265330 - RNA, 64 nt, Homo Sapiens
aacccauauauacaacaaagaguuuuaaacaccuaaaugugaauauuagaaacauagacuccca

SEQ ID NO: 265331 - RNA, 64 nt, Homo Sapiens
uaaaauaaguuuauuuuuaaaggauuuuaaaauuaaaugugaggcuaacccuuaacuaaagugu

SEQ ID NO: 265332 - RNA, 64 nt, Homo Sapiens
aauaaaccuuuugggagaaaugauuuuguacuuuaaaugugacacauaucuggaucuguguauu

SEQ ID NO: 265333 - RNA, 64 nt, Homo Sapiens
uugaguacauuuuguguugcaaccuuuccuauggaaaugugacagaaguguauaguguauauau

SEQ ID NO: 265334 - RNA, 64 nt, Homo Sapiens
ucuuuguauauaucuguauaguacacacgaauuuaaaugugaugcuguuguacauugcauagau

SEQ ID NO: 265335 - RNA, 64 nt, Homo Sapiens
uuguggagguucugaguaagguggucuuuaaacuaaaugugacauguuccugaaguaaccgcca

SEQ ID NO: 265336 - RNA, 64 nt, Homo Sapiens
ucugcgcacaaaagccaaacgcauccgacucucuaaaugugauuuauuucuugcuuugagauug

SEQ ID NO: 265337 - RNA, 64 nt, Homo Sapiens
acuagcuuuuaaaaauacaguacaaagacuuuguaaaugugauucagggcccccagcaccccug

SEQ ID NO: 265338 - RNA, 64 nt, Homo Sapiens
agugaaguggcuauccuaaagucagcacugauuaaaaugugaauagaaauugcuuuagcuucug

SEQ ID NO: 265339 - RNA, 64 nt, Homo Sapiens
uguuuuccucauguucaguuuaaaucacuuaucaaaaugugaacaaauaagccugccgccaaaa

SEQ ID NO: 265340 - RNA, 64 nt, Homo Sapiens
uaaauuaauuuguacaaaaaaugcacacuaaauuaaaugugacaaauaccucaguuuugagguu

SEQ ID NO: 265341 - RNA, 64 nt, Homo Sapiens
auuucauuuggaaucacagauaaaucgggaaagaaaaugugaagcaugggaucugcugcugcau

SEQ ID NO: 265342 - RNA, 64 nt, Homo Sapiens
acaugagaaaauuuauacuguagagaaacccuggaaaugugaagaacguggcaaaguucuuuac

SEQ ID NO: 265343 - RNA, 64 nt, Homo Sapiens
acauaagagaauucauaccggagagaaacuguacaaaugugaagaauauggcaaagccugugaa

SEQ ID NO: 265344 - RNA, 64 nt, Homo Sapiens
acaagauaauucauucuggggaaaaaaaugcuacaaaugugaaaaacguggcagagccuucaga

SEQ ID NO: 265345 - RNA, 64 nt, Homo Sapiens
cauaaugagaacucauacuggaggaaagucuuacaaaugugaagaauguggcagucuuuaaauc

SEQ ID NO: 265346 - RNA, 64 nt, Homo Sapiens
gcaagcacccaucguauuauccaaauuuuguugcaaaugugauuaauuugguugucaaguuuug

SEQ ID NO: 265347 - RNA, 64 nt, Homo Sapiens
cauuucugccagcgcauguguccuuucaaggggaaaaugugaagcugaacccccuccagacacc

SEQ ID NO: 265348 - RNA, 64 nt, Homo Sapiens
uagcuuauaagucucaaauuuuugccuuuuacuaaaaugugauuguuucuauucauuguguaug

SEQ ID NO: 265349 - RNA, 64 nt, Homo Sapiens
gugguuuucucucaauaauaagugaaccaauuucaaaugugaucacaaaguuuggaaagcuuuu

SEQ ID NO: 265350 - RNA, 64 nt, Homo Sapiens
auagagcaucaaucaauauaagcauuauugagaaaaaugugacccguaacacuguguucuggau

SEQ ID NO: 265351 - RNA, 64 nt, Homo Sapiens
aaaaaugugacccguaacacuguguucuggauaaaaaugugauuaggaaucacgcaaagugcuu

SEQ ID NO: 265352 - RNA, 64 nt, Homo Sapiens
uuauauuccaggucaaaauuggccccauaguuauaaaugugaaauacaguucucucacaccaag

SEQ ID NO: 265353 - RNA, 64 nt, Homo Sapiens
uuggauuuacaaugacagggauucugagaggggaaaaugugauuuaugugacaaggaucuagaa

SEQ ID NO: 265354 - RNA, 64 nt, Homo Sapiens
aguauuguaacuauuuuaaggagaccaaugguuaaaaugugaauguuuaaauuuaaaaugcaga

SEQ ID NO: 265355 - RNA, 64 nt, Homo Sapiens
ucaagcuccauuguuucggaaaagcaagauagccaaaugugacaucuuuccagaagaggagaca

SEQ ID NO: 265356 - RNA, 64 nt, Homo Sapiens
aagugaaaaagacuucgcagauauuucacaucccaaaugugaagcacucuuauuuuucuguaaa

SEQ ID NO: 265357 - RNA, 64 nt, Homo Sapiens
gagucauuacaguggacccugacuaagucauuacaaaugugacugacaaagucauuacaaaugu

SEQ ID NO: 265358 - RNA, 64 nt, Homo Sapiens
aagucauuacaaaugugacugacaaagucauuacaaaugugacuggaaaagguaucuugguuau

SEQ ID NO: 265359 - RNA, 64 nt, Homo Sapiens
uacauaaguuaaaaacuuaccaaguagaauugaaaaaugugaguagacauuuaaaaucaaauau

SEQ ID NO: 265360 - RNA, 64 nt, Homo Sapiens
uggaccaaaggcuagguuguuuaugaacuauuaaaaaugugauguuaaguauauggauaaaaag

SEQ ID NO: 265361 - RNA, 64 nt, Homo Sapiens
uuacaucuugugguuauucuggguuguggaaggaaaaugugaaugaaaguagugcuggaugcaa

SEQ ID NO: 265362 - RNA, 64 nt, Homo Sapiens
cuaaagagagacagcagaaauaaagaucagaagcaaaugugagcaaaucuguuuuacuguuaac

SEQ ID NO: 265363 - RNA, 64 nt, Homo Sapiens
gaccuuuucuuuagucccaaccacuaguuuuaacaaaugugaauuauugaaaugugaagggaca

SEQ ID NO: 265364 - RNA, 64 nt, Homo Sapiens
cccaaccacuaguuuuaacaaaugugaauuauugaaaugugaagggacaaaaagaaucauacau

SEQ ID NO: 265365 - RNA, 64 nt, Homo Sapiens
aguucaaugaucguuuucacuuacugcuuuuaguaaaugugacucgcuguaauucaccauaacu

SEQ ID NO: 265366 - RNA, 64 nt, Homo Sapiens
uggaggccuaggccuuguugaaggcuucaucaggaaaugugacgcagagauugugcugcugugc

SEQ ID NO: 265367 - RNA, 64 nt, Homo Sapiens
acugugcauugaacccuggguagcaccuggggauaaaugugacacugaccuggagugacuggaa

SEQ ID NO: 265368 - RNA, 64 nt, Homo Sapiens
agugguuucugcucggagcuagaaagucccgaggaaaugugacccagagcaaagggcaucaggg

SEQ ID NO: 265369 - RNA, 64 nt, Homo Sapiens
acacauaggaaaauucauacuggagagaaacuacaaaugugaagaauguguuaaagccuuuaac

SEQ ID NO: 265370 - RNA, 64 nt, Homo Sapiens
aaguugagaaaauucguacuggagagaauccuacaaaugugaaaaauguggcaaauccuuuaac

SEQ ID NO: 265371 - RNA, 64 nt, Homo Sapiens
agauaagaaaauucauacuggaaagaaacccuacaaaugugaagucuguggcaaagcuuuuaac

SEQ ID NO: 265372 - RNA, 64 nt, Homo Sapiens
uauaagacaguuuauacuuugagagaaacccugcaaaugugaauaauguggcaauacuuuaaac

SEQ ID NO: 265373 - RNA, 64 nt, Homo Sapiens
uucuaacauaaaucauacuggugaaaaauccuagaaaugugaaaaauaucacaaagccuuuaaa

SEQ ID NO: 265374 - RNA, 64 nt, Homo Sapiens
acauaagaaaauuuacacuagagagaaagccuacaaaugugaagaauguggcaaagccuuuaac

SEQ ID NO: 265375 - RNA, 64 nt, Homo Sapiens
acauaagauaauucauagcggagagaaaccccacaaaugugaagaauguggcagagcuuuuaac

SEQ ID NO: 265376 - RNA, 64 nt, Homo Sapiens
acauaagauaauucacaguggagaaaaacccuacaaaugugaagaauguggcaaagcuuuuaac

SEQ ID NO: 265377 - RNA, 64 nt, Homo Sapiens
acauaagaaaauucauaguaaagagaaacccuacaaaugugaacaguguggcaaggucuuuaag

SEQ ID NO: 265378 - RNA, 64 nt, Homo Sapiens
acauaagaucauucauacuggagagaaaccuuacaaaugugaggaauguggcaaagguuuuagc

SEQ ID NO: 265379 - RNA, 64 nt, Homo Sapiens
acacaagaagauucauacuagagagaaacccuacaaaugugaagaauguggcauaucuuuuaac

SEQ ID NO: 265380 - RNA, 64 nt, Homo Sapiens
acauaagaugauucacacuugaaugaaacccuacaaaugugaacgauguggcaguuguuuuaac

SEQ ID NO: 265381 - RNA, 64 nt, Homo Sapiens
gcauaagaaaauucaaacuggagagaaacucuacaaaugugaagaauguggcaaagcuuuuaac

SEQ ID NO: 265382 - RNA, 64 nt, Homo Sapiens
uacaccuaaaauucaugcaggagagaaacaccacaaaugugaaaaauuugguaaauucuuuaac

SEQ ID NO: 265383 - RNA, 64 nt, Homo Sapiens
augggagagcaucccuaacacugagaaauccuauaaaugugauguaugugggaaaauuuuccau

SEQ ID NO: 265384 - RNA, 64 nt, Homo Sapiens
acauaaaagaauacacacuagagaaaaaccuuacaaaugugaagcaucugauaaauccugugaa

SEQ ID NO: 265385 - RNA, 64 nt, Homo Sapiens
acaagagcuaaaauugacauaacuuaauauuuuaaaaugugauuuaaaaaaaauguugaaaugu

SEQ ID NO: 265386 - RNA, 64 nt, Homo Sapiens
uaauauuuuaaaaugugauuuaaaaaaaauguugaaaugugauucccucagauaauuucuugua

SEQ ID NO: 265387 - RNA, 64 nt, Homo Sapiens
aauguggcaaagcuucuaccaagagaaacaguacaaaugugaugacauaagauaauucauacug

SEQ ID NO: 265388 - RNA, 64 nt, Homo Sapiens
aauguggcaaagcuuuuaacgagagaaacccuacaaaugugaagacauaagagaauucauacug

SEQ ID NO: 265389 - RNA, 64 nt, Homo Sapiens
cuagaaaacacugacuuuguuuuuauaaguuauuaaaugugaaauugaucugcaucagcuuauu

SEQ ID NO: 265390 - RNA, 64 nt, Homo Sapiens
augaaaacauuuguaaggcugcaacauaauauuaaaaugugaauaaauaaauguucugauaaaa

SEQ ID NO: 265391 - RNA, 64 nt, Homo Sapiens
gugaaaauguguuuacuucagaacggcacuacauaaaugugaaaaguuguugaucuugaaauau

SEQ ID NO: 265392 - RNA, 64 nt, Homo Sapiens
aguugacuuuaaugaaucuuugguguggaaugaaaaaugugaacuucuuacucauagugugguu

SEQ ID NO: 265393 - RNA, 64 nt, Homo Sapiens
uaaaguaacacuuuguacauaacaaauacucagcaaaugugaaacuuuauuugcucuuacuuca

SEQ ID NO: 265394 - RNA, 64 nt, Homo Sapiens
agcuuauaaugaaaaccuugccugccuuuauaaaaaaugugauuaucuucuucuguuaauguca

SEQ ID NO: 265395 - RNA, 64 nt, Homo Sapiens
cacugagaaggaaacaacaucaacaugugccuucaaaugugaccaccaauaaaggguggauguu

SEQ ID NO: 265396 - RNA, 64 nt, Homo Sapiens
ggaaggaguucuggaauuggcauggaccaguguuaaaugugaguucucuuuugcaauagaacgu

SEQ ID NO: 265397 - RNA, 64 nt, Homo Sapiens
uaaauauaacucacaucccaauuuauagacagguaaaugugaguggauaauuuauagacagaua

SEQ ID NO: 265398 - RNA, 64 nt, Homo Sapiens
uguuaagauucuuaaauuuguuauauacuaucugaaaugugauuugugaaagcauauuuagauu

SEQ ID NO: 265399 - RNA, 64 nt, Homo Sapiens
gcauauuuagauuuuauauagagcaaaaucuggaaaaugugaaauuuucuguccuuaauuuuuu

SEQ ID NO: 265400 - RNA, 64 nt, Homo Sapiens
uuuauucugcuuguauuuaacuguugccugagaaaaaugugauuacuuaccuacugaacugcua

SEQ ID NO: 265401 - RNA, 64 nt, Homo Sapiens
aagccacuuaccuacugaacuuacuaauacaaacaaaugugaucacuagagcugcuugcaugcg

SEQ ID NO: 265402 - RNA, 64 nt, Homo Sapiens
auuuauuguacauucagugacuauccuguuauuuaaaugugaacacugguugaaaauguugacc

SEQ ID NO: 265403 - RNA, 64 nt, Homo Sapiens
gccacuucuaauaauucagguagggaaaaaauuaaaaugugaugaagacggucaacuucacacu

SEQ ID NO: 265404 - RNA, 64 nt, Homo Sapiens
caucauuaacaguuuguccuuaggaugcaaaugaaaaugugaauacauaccuuguuguacuguu

SEQ ID NO: 265405 - RNA, 64 nt, Homo Sapiens
uuuuaaucauaagccuuaauaagauuuuucuaagaaaugugaaauagaacaauuuucaucuaau

SEQ ID NO: 265406 - RNA, 64 nt, Homo Sapiens
aggagcuaguuuacaggcuuacugugauuuaagcaaaugugaaaagugaaaccuuaauuuuauc

SEQ ID NO: 265407 - RNA, 64 nt, Homo Sapiens
caggguuuccugaaacuggguuaauucuuuauagaaaugugaacacugaauuuauuuuaaaaaa

SEQ ID NO: 265408 - RNA, 64 nt, Homo Sapiens
gaccuggugucuccugcccacccuggucccagguaaaugugaauggagacagguaugagaggcu

SEQ ID NO: 265409 - RNA, 64 nt, Homo Sapiens
gucagcaaauuggaagaggauccgaugggaguguaaaugugagacacaaugucuugauuauacc

SEQ ID NO: 265410 - RNA, 64 nt, Homo Sapiens
uaguguaauggaagaccuuuaguguaaugaaauaaaaugugauccaguaaucaaaaugugaucu

SEQ ID NO: 265411 - RNA, 64 nt, Homo Sapiens
uaguguaaugaaauaaaaugaaaugcaguaaucaaaaugugaucaaauaaggaauacauuuuca

SEQ ID NO: 265412 - RNA, 64 nt, Homo Sapiens
uugguaguuguuuaugaaauuaccagauauucauaaaugugacaaaugaacagcaggauuauga

SEQ ID NO: 265413 - RNA, 64 nt, Homo Sapiens
uuuuauuaaacaaguagacauuuuguuauuaaaaaaaugugaucuguaauuucuuugugcagaa

SEQ ID NO: 265414 - RNA, 64 nt, Homo Sapiens
uuggugauaacugccucguuuaaauggucacaagaaaugugaagagagagcuagggcagacaug

SEQ ID NO: 265415 - RNA, 64 nt, Homo Sapiens
uuauauuauuuggcuagaaauugcuguuuuuaauaaaugugaauuuuuuaaaaauaaagauuuu

SEQ ID NO: 265416 - RNA, 64 nt, Homo Sapiens
uucaguauguuuacuauugcuuaugaucugagcaaaaugugaacacaaucacuguucuauaggc

SEQ ID NO: 265417 - RNA, 64 nt, Homo Sapiens
uuucguaaauuugggcuggagauaaguguauuuuaaaugugaccuuaaacaacccuuguuucca

SEQ ID NO: 265418 - RNA, 64 nt, Homo Sapiens
uuuccacaaaauauccaacuccgcagcugacaaaaaaugugaaagguuuuuuuggguaacaauc

SEQ ID NO: 265419 - RNA, 64 nt, Homo Sapiens
auuuuugcuuauucauugaaacaauaguaaugauaaaugugaacuuuagccagaaagcaaaaaa

SEQ ID NO: 265420 - RNA, 63 nt, Homo Sapiens
aauacuuucgugauuuuguguaaaguacuaaagaaaaugugauaagguucacuuguaaaacaa

SEQ ID NO: 265421 - RNA, 64 nt, Homo Sapiens
ucagugacucuagggccaaaauauagauuaguuuaaaugugaauauuaauguaaucaaaaugaa

SEQ ID NO: 265422 - RNA, 64 nt, Homo Sapiens
aaaacauccuuuuggaccaucagagauguuuuagaaaugugagaauaucauugaacacacauac

SEQ ID NO: 265423 - RNA, 64 nt, Homo Sapiens
aaucuuaaauuuagcuugucaugauacaauuuucaaaugugaacauuuaucacuagcagagagu

SEQ ID NO: 265424 - RNA, 64 nt, Homo Sapiens
uagaauaagagcuuuuuuguuucuuggguuuuuaaaaugugaaucugcaaugaucauaaaaauu

SEQ ID NO: 265425 - RNA, 64 nt, Homo Sapiens
uuaaaaugugaaucugcaaugaucauaaaaauuaaaaugugaaugucaacaauaaaaagcaaga

SEQ ID NO: 265426 - RNA, 64 nt, Homo Sapiens
gaaguuaguauugccaaucuuucacugcaugugaaaaugugaccaauuuagcacaaauucucuc

SEQ ID NO: 265427 - RNA, 64 nt, Homo Sapiens
ugauccauccagacauuugcaaacgucaggagaaaaaugugaauuauuuauccagaugcauguc

SEQ ID NO: 265428 - RNA, 64 nt, Homo Sapiens
cacuggaguccagucucuucugcuggcagaaagcaaaugugaccugugucacuacgugacugug

SEQ ID NO: 265429 - RNA, 64 nt, Homo Sapiens
ugccaagcacagugccugcauguauuuauccaauaaaugugaaauucuguccaguuuuguggug

SEQ ID NO: 265430 - RNA, 64 nt, Homo Sapiens
gauaauccauacuagagaaacacuauagauguaaaaaugugaaaaguuuuauucaaaauaucaa

SEQ ID NO: 265431 - RNA, 64 nt, Homo Sapiens
ggguucauagaaaaaggaaguuugcagaugcaauaaaugugaggaaguauuuaauaaaaaauga

SEQ ID NO: 265432 - RNA, 64 nt, Homo Sapiens
uucuuugucacuguccuguacaaagaaaugcacgaaaugugaagcuaaugaaagaaaaugugac

SEQ ID NO: 265433 - RNA, 64 nt, Homo Sapiens
aaagaaaugcacgaaaugugauucuaaugaaagaaaaugugaccucauaagugaagaguaauuc

SEQ ID NO: 265434 - RNA, 64 nt, Homo Sapiens
agacucuguuucuguuauuuuuaauugcuguaugaaaugugaucagauuauuuuacuaccaaca

SEQ ID NO: 265435 - RNA, 64 nt, Homo Sapiens
aagggaaauuaaaccauucaugaauaaacuuuaaaaaugugaaguguccuuuuccuuuucacaa

SEQ ID NO: 265436 - RNA, 64 nt, Homo Sapiens
acauaagauaauuaaugcuggagagaaacccuacaaaugugaagaauguggcaaagauuucuau

SEQ ID NO: 265437 - RNA, 64 nt, Homo Sapiens
acauaaaauaauucauaaaggagauaaauuauacaaaugugaagaauguggcaaagcuuuuaac

SEQ ID NO: 265438 - RNA, 64 nt, Homo Sapiens
acauaagauaauucauacuggagagaaaaccuacaaaugugaggaauguggcaaagccuuuagc

SEQ ID NO: 265439 - RNA, 64 nt, Homo Sapiens
acauaagauaauuuauacuggagagaagcccuacaaaugugaaaaauguggcaaaccuuuuaac

SEQ ID NO: 265440 - RNA, 64 nt, Homo Sapiens
acauuagauaauucaugcuggagagaaacccuacaaaugugaaaaauguggcaaagcuuuuaac

SEQ ID NO: 265441 - RNA, 64 nt, Homo Sapiens
acauaagauaacucauacuggagaaaaaucuuacaaaugugaagaauguggcaaagccuuuauc

SEQ ID NO: 265442 - RNA, 64 nt, Homo Sapiens
gaacaaaauaauucauacaggagagaaacccuacaaaugugaagaaugugacaaagccuuuaac

SEQ ID NO: 265443 - RNA, 64 nt, Homo Sapiens
acuaaacauaauucauaauggagaaaaacccuacaaaugugaagaaugugucaaagcuuuuaac

SEQ ID NO: 265444 - RNA, 64 nt, Homo Sapiens
aaacauaagggaauucauaauagagaaacccuacaaaugugaagaacguggccuggcuuuuaac

SEQ ID NO: 265445 - RNA, 64 nt, Homo Sapiens
gcauaaaauaauucaugcuggagagaaacucuugaaaugugaugaauguggcauagccucuucc

SEQ ID NO: 265446 - RNA, 64 nt, Homo Sapiens
aaaucuuuaaaugauugucauuuaaaaaugcgaaaaaugugacaaaaucauacuggugaggaac

SEQ ID NO: 265447 - RNA, 64 nt, Homo Sapiens
aauguggcaaagccuuuaacgagagaaauccuacaaaugugauaacacaagauaauucauacug

SEQ ID NO: 265448 - RNA, 64 nt, Homo Sapiens
aaugugacaaagccuuuaaaaugagaaauccuagaaaugugaagauauaaaagaaaucauauga

SEQ ID NO: 265449 - RNA, 64 nt, Homo Sapiens
aauguggcaagccuuuuagcgagggaaacccuacaaaugugaagacauaagggaauuuauacag

SEQ ID NO: 265450 - RNA, 64 nt, Homo Sapiens
aacguggcaaagcuuuucauaggaaaagcccuacaaaugugaaacauaaaagaauucauacugg

SEQ ID NO: 265451 - RNA, 50 nt, Homo Sapiens
aaugugguaaauccuucagcaaaugugaagauacuggagagaaucccuaa

SEQ ID NO: 265452 - RNA, 64 nt, Homo Sapiens
guuaucuuaugagacucugugauauguacccucgaaaugugaaucuuguauucucaguaguucc

SEQ ID NO: 265453 - RNA, 64 nt, Homo Sapiens
auugauuucaguguucaagaaaauggauaaacagaaaugugaucgaauccagcguucucauugg

SEQ ID NO: 265454 - RNA, 64 nt, Homo Sapiens
gauuuuucagauaucguucacuuacaaguguaauaaaugugacagagaauccauaaugagagau

SEQ ID NO: 265455 - RNA, 64 nt, Homo Sapiens
acugugacaaaguugucagucagagaaaucuuacaaaugugaagucaucauagucuucauacug

SEQ ID NO: 265456 - RNA, 64 nt, Homo Sapiens
aguguggcaacaccuuuggugagagaaaccuuacaaaugugaugacauauuagaauucaaacug

SEQ ID NO: 265457 - RNA, 64 nt, Homo Sapiens
uugugcauauauugguagcuaaaaaacaggaaccaaaugugaccugaaauugucauguuaaaaa

SEQ ID NO: 265458 - RNA, 64 nt, Homo Sapiens
gcacacgcacaaacgccuucagaguucagggggaaaaugugacaugugucucaugaaggaucac

SEQ ID NO: 265459 - RNA, 64 nt, Homo Sapiens
uaucugcugcaacuuggagaaccucccugcccugaaaugugaaccaagcacacuuugguuccuu

SEQ ID NO: 265460 - RNA, 64 nt, Homo Sapiens
ugagugcuggccuuaacccuaggcguggaagagaaaaugugagguuguuuagauacucaucagg

SEQ ID NO: 265461 - RNA, 64 nt, Homo Sapiens
ucuuacuuacuuuuuguacauagaauuuaaccuaaaaugugaacugaaguuauucuugaucaga

SEQ ID NO: 265462 - RNA, 64 nt, Homo Sapiens
auuuaacuuauggcuaagaaaaagugaaaacauaaaaugugacccuuaaauuaguuauggagac

SEQ ID NO: 265463 - RNA, 64 nt, Homo Sapiens
ugucccggcucugucuucauccucacucacguggaaaugugaacucuaacaauccuucgcuuuu

SEQ ID NO: 265464 - RNA, 64 nt, Homo Sapiens
gaugaguacaaaaaugcagauaauguucgguuaaaaaugugacaaaaagagagaccuuuuuuuu

SEQ ID NO: 265465 - RNA, 62 nt, Homo Sapiens
aucccacucaagguugaagaagaaaugaagaagcaugaaaguaauaaugugggauuacuaga

SEQ ID NO: 265466 - RNA, 62 nt, Homo Sapiens
ucucuuaguuguaagaaagaaaaagacgucuugcaugaaaauaguacguugcgggaagaaau

SEQ ID NO: 265467 - RNA, 62 nt, Homo Sapiens
gucacuucuguaauagugcaaaauuuaucugugcaugaaaggcuuccauacugguagaugcg

SEQ ID NO: 265468 - RNA, 62 nt, Homo Sapiens
ugcuccacauuuaaaggacaguucaauaugaugcaugaaaaauauuuccucugcaggauaca

SEQ ID NO: 265469 - RNA, 62 nt, Homo Sapiens
auggagaaacagguacuggacuuuucccuccugcaugaaacaagcaaacaauggacaaaaua

SEQ ID NO: 265470 - RNA, 62 nt, Homo Sapiens
aaaauguacaaugucuagcauccaguagagaggcaugaaaagcaggaaaauacauugcauaa

SEQ ID NO: 265471 - RNA, 62 nt, Homo Sapiens
ucauauauuugugacaauuuuugaguaauauugcaugaaaaugucccuauguuacauccauu

SEQ ID NO: 265472 - RNA, 62 nt, Homo Sapiens
ucgcuuucuccuguuuuuuuuuuaaaaaaaaagcaugaaaaaggaagagaaaaaguuugaua

SEQ ID NO: 265473 - RNA, 64 nt, Homo Sapiens
acaugcaacucaaacgacggaaaaaaaaagggaaugggaaaaaagaaaacagauccugggaggg

SEQ ID NO: 265474 - RNA, 64 nt, Homo Sapiens
acagauggacagacagccacccugagaaccccucugggaaaaucuauuccugccaccacugggc

SEQ ID NO: 265475 - RNA, 64 nt, Homo Sapiens
aggaagaagcaaaauaucacaucucuagaaguguugggaaaaauauaauuucuuucuuuacuua

SEQ ID NO: 265476 - RNA, 64 nt, Homo Sapiens
uagcauaauuuaaaaaaucaguguuuuuaggauuugggaaaauaaacuguaaauguuuauuuga

SEQ ID NO: 265477 - RNA, 64 nt, Homo Sapiens
augcaauuguugcugugaguggggcuaccaaggcugggaaaaaacagaggcuagacaacugaaa

SEQ ID NO: 265478 - RNA, 64 nt, Homo Sapiens
acugucaauaaaaugcggguucuaagauucucugugggaaaaugaaaagaaaacgcgacaucuu

SEQ ID NO: 265479 - RNA, 64 nt, Homo Sapiens
gguuuuaagguaaguuuuagaaaaggaaaagaguugggaaaauuaaaacguuggacuauuuggg

SEQ ID NO: 265480 - RNA, 64 nt, Homo Sapiens
aaaagaguugggaaaauuggaacguuggacuauuugggaaaaggccucauauauuucuccucaa

SEQ ID NO: 265481 - RNA, 64 nt, Homo Sapiens
aaagaaaagagguauuccguuauguuaucgauucugggaaaauguaaccaucgaugauguuguc

SEQ ID NO: 265482 - RNA, 60 nt, Homo Sapiens
acacaaauuccgcaguuuauuguacagaugugggaaaaccuuaggacuuauuuguuuuaa

SEQ ID NO: 265483 - RNA, 64 nt, Homo Sapiens
cugggcaaacaggugggacuguuagugacccauuugggaaaauagagcaucucagagaaggagg

SEQ ID NO: 265484 - RNA, 64 nt, Homo Sapiens
cuuuuuacaaaaaaaaguauagaguuggaaacucugggaaaacuuacggaaauacacaaaugcu

SEQ ID NO: 265485 - RNA, 64 nt, Homo Sapiens
uaauaacuacuuccaucccugcuuauuuuuaauuugggaaaauaaauacauucgaaggaaccug

SEQ ID NO: 265486 - RNA, 64 nt, Homo Sapiens
guugaucucaguauugucaggggaacagagaaguugggaaaagauuacugaaauauaccuuuug

SEQ ID NO: 265487 - RNA, 64 nt, Homo Sapiens
uuuaauaccagauaccuuaucuuacaauauugauugggaaaacauuugcugccauuacagaggu

SEQ ID NO: 265488 - RNA, 64 nt, Homo Sapiens
uaaaccacuuaaacgaagaguucccuugaaacuuugggaaaacauguuaaugacaauauuccag

SEQ ID NO: 265489 - RNA, 64 nt, Homo Sapiens
acacacccacaccguagaacaaaaauaagaugacugggaaaaagccccuguucaauaguauggg

SEQ ID NO: 265490 - RNA, 64 nt, Homo Sapiens
aagaugacugggaaaaagacccuguucaauaguaugggaaaaauauacguuaucagcaacuucc

SEQ ID NO: 265491 - RNA, 64 nt, Homo Sapiens
aaauugguauuaucaaagcauugcugagagacggugggaaaauaaguugacuuucaaaucacgu

SEQ ID NO: 265492 - RNA, 64 nt, Homo Sapiens
uuuauguagaggcuuuauguugcaauuaaaaaguugggaaaaugagagaaauuguguggaauuu

SEQ ID NO: 265493 - RNA, 64 nt, Homo Sapiens
uuuucguuuguucagguuuuguaagcaagaaaauugggaaaacuuggaucuguacugcacugga

SEQ ID NO: 265494 - RNA, 64 nt, Homo Sapiens
gcuaacagagagaucauuauauguccaauauaugugggaaaagagauggcaaaaaaauuuaaag

SEQ ID NO: 265495 - RNA, 64 nt, Homo Sapiens
ccuuguguugaugagagaauaaucuugggcagucugggaaaauaaggaaggcaucuccuucuua

SEQ ID NO: 265496 - RNA, 64 nt, Homo Sapiens
uucagggaaaauaacaaccacccuuacugauaguugggaaaagaagauuggguuauuuugccau

SEQ ID NO: 265497 - RNA, 64 nt, Homo Sapiens
uacuuuucauggagugccacacuuucagccauacugggaaaacuauaugaugaccucaauauug

SEQ ID NO: 265498 - RNA, 64 nt, Homo Sapiens
ggaaaaacuguuucuucagugggcugguagugggugggaaaaggcugagucucugaagggaaua

SEQ ID NO: 265499 - RNA, 64 nt, Homo Sapiens
agcucuuuaaaaaucauauuuuguuuagguuauaugggaaaaguucuacuauuauuugggaaaa

SEQ ID NO: 265500 - RNA, 64 nt, Homo Sapiens
guuuagguuauaugggaaaaagucuacuauuauuugggaaaauuuuaauguguauagagacccc

SEQ ID NO: 265501 - RNA, 64 nt, Homo Sapiens
ugaugaaauauuugaacuguacuaucucucacugugggaaaauucuuuuugaugaagagguuuu

SEQ ID NO: 265502 - RNA, 64 nt, Homo Sapiens
ucacuuuguauucucuguccaguuuuauguuucuugggaaaauaugucccccaccucuuuuccu

SEQ ID NO: 265503 - RNA, 64 nt, Homo Sapiens
ucccccaccucuuuuccuagggggggagcucuggugggaaaaugcccugcuuggggccuggcgu

SEQ ID NO: 265504 - RNA, 64 nt, Homo Sapiens
gacuucguauuuccccaaguuuuaauuuaguagaugggaaaauuugcucucauagaaauaacuu

SEQ ID NO: 265505 - RNA, 64 nt, Homo Sapiens
gagauccuuuucaaaaagauguaauggacaagagugggaaaaaaaacuugcucugauaugugaa

SEQ ID NO: 265506 - RNA, 64 nt, Homo Sapiens
ggauuacuuucaguauauuugguccaaagaauauugggaaaacuuggccucaagccacuuuucu

SEQ ID NO: 265507 - RNA, 64 nt, Homo Sapiens
auggggcaugcauucauaaucucaggaaaucuugugggaaaaaaugcacugugucugaggaaug

SEQ ID NO: 265508 - RNA, 64 nt, Homo Sapiens
cuaacacugagaaauccuauaaaugugauguaugugggaaaauuuuccaucagagcucagcccu

SEQ ID NO: 265509 - RNA, 64 nt, Homo Sapiens
ccucaccagacagaaagccuuugauugugauguaugggaaaagaacuccagucagagagcacau

SEQ ID NO: 265510 - RNA, 64 nt, Homo Sapiens
ugcaaaacgccugaagaauacaaaggauggucugugggaaaauauauuagaaguuacuaugaag

SEQ ID NO: 265511 - RNA, 64 nt, Homo Sapiens
ugagucauuugaccaagacacagaagaugaugaaugggaaaaaaaacauagagaucacaccgca

SEQ ID NO: 265512 - RNA, 64 nt, Homo Sapiens
auuaguuuauuaaacauuacuuuuguuuacacauugggaaaaaagcacaaauuuagucugguca

SEQ ID NO: 265513 - RNA, 64 nt, Homo Sapiens
ugcaauacaaacugguaucagcuugaugcauuguugggaaaauagacaucuggacuggauuuau

SEQ ID NO: 265514 - RNA, 64 nt, Homo Sapiens
gauaaagaacacgaauugcuaauccugaugcuguugggaaaacccugaccucgacccacucuca

SEQ ID NO: 265515 - RNA, 64 nt, Homo Sapiens
ucuucgaucccaagguuuccagaagaaaacgaacugggaaaauuucuucaucagucuugucuca

SEQ ID NO: 265516 - RNA, 64 nt, Homo Sapiens
aaaggggcccccugugaccggagcaggauggggaugggaaaacuagauaaaccaagcuuuacac

SEQ ID NO: 265517 - RNA, 64 nt, Homo Sapiens
cacacucacaccccaccccgagacggccccugccugggaaaaacgauagcugggggacaagggc

SEQ ID NO: 265518 - RNA, 64 nt, Homo Sapiens
aagagcgaaauuaccuuacuacauaaucuguauaugggaaaagaaaagacaaaacagacuaugu

SEQ ID NO: 265519 - RNA, 64 nt, Homo Sapiens
uaaaagcagggauaucaguggaucagaucauaugugggaaaauguuugaacuuagaagguagga

SEQ ID NO: 265520 - RNA, 64 nt, Homo Sapiens
uguuucucuuacuacguacucacagguuugcaaaugggaaaaaaguuuacauuucaguuuaggg

SEQ ID NO: 265521 - RNA, 64 nt, Homo Sapiens
gaacacagguaguuccuuuucacuguguuuaauuugggaaaauccagauccacaucauuguaga

SEQ ID NO: 265522 - RNA, 64 nt, Homo Sapiens
uuaagaguuuccacauauuauuuaaauagauuagugggaaaacucuagaagacagauauuuaca

SEQ ID NO: 265523 - RNA, 64 nt, Homo Sapiens
gauaggcuuuauauuuccacuuucucucugcccaugggaaaagaggcacucaagugacuucaua

SEQ ID NO: 265524 - RNA, 64 nt, Homo Sapiens
uauguugaagaggcagcccugucuuggccaaagaugggaaaaccauggcuuugugggaucauau

SEQ ID NO: 265525 - RNA, 64 nt, Homo Sapiens
ugauucguggggcaggagaucacuccuuuaaaguugggaaaacuaugcuuugugaguucuuuuc

SEQ ID NO: 265526 - RNA, 64 nt, Homo Sapiens
uuauuuggggggaaauaccuugagcagaauacaaugggaaaagagucucuaccccuuucuguuc

SEQ ID NO: 265527 - RNA, 64 nt, Homo Sapiens
aaaaacuguauggaaucaacaccaccgagcucugugggaaaaaagaaaaaccugcucccuucgc

SEQ ID NO: 265528 - RNA, 64 nt, Homo Sapiens
ggauuccuuuucagaaguacuaggaaaagaaagaugggaaaacggagacaggauuugauaaguc

SEQ ID NO: 265529 - RNA, 64 nt, Homo Sapiens
uauuuuaugucuccuaagcauggcuugacuuuuaugggaaaagugguuaguugaagccaauuuc

SEQ ID NO: 265530 - RNA, 64 nt, Homo Sapiens
cacacuuggagaaaccuuuuggguguaaugaaugugggaaaaccuuucaucagaagucagcucu

SEQ ID NO: 265531 - RNA, 64 nt, Homo Sapiens
cuggggaaaagauaaugucuuuaauaaauggugcugggaaaacuggauauccauaugcagaaga

SEQ ID NO: 265532 - RNA, 64 nt, Homo Sapiens
ugccauguuuauccuguggcaaguaaagaugaucugggaaaauguuuucucccaaaaaaucuuu

SEQ ID NO: 265533 - RNA, 64 nt, Homo Sapiens
cagguguuuggugucugccuuaaucauuuaaucuugggaaaauuaguguggcgcgcuuuuuuaa

SEQ ID NO: 265534 - RNA, 64 nt, Homo Sapiens
auaaguaauucagaaccaucaaugaauucagauaugggaaaagucaguaaaaaugauacugaag

SEQ ID NO: 265535 - RNA, 64 nt, Homo Sapiens
cauuucuugccagaauuugcuaccuuaaggugauugggaaaauucuguugcaagaacauuaaca

SEQ ID NO: 265536 - RNA, 64 nt, Homo Sapiens
uccucauuguuggggaugaugagaagaaaugauuugggaaaauuaaguaacaacgaccuagaaa

SEQ ID NO: 265537 - RNA, 64 nt, Homo Sapiens
auuauaguucggcuguugacugagaaguuuguggugggaaaacguuugccauauuuucuuugca

SEQ ID NO: 265538 - RNA, 64 nt, Homo Sapiens
accuaauugugauucuuuuauuaauaaaagcuaaugggaaaaggaucccugauuaagcugauga

SEQ ID NO: 265539 - RNA, 64 nt, Homo Sapiens
caccgaagaaaaauaucuaaacaucgagaaacuaugggaaaaaaaauugcaaaaucuaaaauaa

SEQ ID NO: 265540 - RNA, 64 nt, Homo Sapiens
aaaauacaaaaaccaguuaauguuuuguagacccugggaaaagaauuuucagcaaaguacaaaa

SEQ ID NO: 265541 - RNA, 64 nt, Homo Sapiens
caaacauguuacaguguuuugaggauguagccucugggaaaaaauauaaaguauuccagcaaaa

SEQ ID NO: 265542 - RNA, 64 nt, Homo Sapiens
guugagcaaacagcuuggacauugcaaaucuaauugggaaaagaccaugaaauugaucaccggg

SEQ ID NO: 265543 - RNA, 64 nt, Homo Sapiens
acaccacuuuguaaaaggacucuuccaucagagaugggaaaaccauuggggaggacuaggaccc

SEQ ID NO: 265544 - RNA, 64 nt, Homo Sapiens
uggaaauaccaggaccaguuuauguuugugguuuugggaaaaauuauuuguguugggggaaaug

SEQ ID NO: 265545 - RNA, 64 nt, Homo Sapiens
gauuuucuuugccuuuguguuugaugccgucgugugggaaaagucaacuccgaugccaccauug

SEQ ID NO: 265546 - RNA, 64 nt, Homo Sapiens
gccccaugcaugcccgccucucugcauggucucuugggaaaagagagaugugucgccuccgcca

SEQ ID NO: 265547 - RNA, 64 nt, Homo Sapiens
cccucacccauuccuagugcucuugguauacacuugggaaaauaauguccuccaggagaaagug

SEQ ID NO: 265548 - RNA, 64 nt, Homo Sapiens
ucuauacaguauaaacuaccucacuugccuuucuugggaaaaaaaaaaugaauggacuuuaaca

SEQ ID NO: 265549 - RNA, 64 nt, Homo Sapiens
uaggaagugauuauaaaucguagcucuggcccagugggaaaaauaugcuuaucaucuaaagaug

SEQ ID NO: 265550 - RNA, 64 nt, Homo Sapiens
gcccuuaaaucauaggaaagccgaaggacagcgaugggaaaaauuacccacugagauuuccacg

SEQ ID NO: 265551 - RNA, 64 nt, Homo Sapiens
cugguacuauuccuucugaaacuauuccaaucaaugggaaaagagggaauccucccuaacucau

SEQ ID NO: 265552 - RNA, 64 nt, Homo Sapiens
auggggaaaggauucccuauuuaauaaauggugcugggaaaacugucuagccauaaguagaaag

SEQ ID NO: 265553 - RNA, 64 nt, Homo Sapiens
uacauuacucuugcagguuugaauguaaaaaaugugggaaaacaacacugcaaagaaacaguau

SEQ ID NO: 265554 - RNA, 64 nt, Homo Sapiens
uacuugucuccuuuagguuugaauguaaacugugugggaaaacuacacugcacagaaacacuau

SEQ ID NO: 265555 - RNA, 64 nt, Homo Sapiens
auauagaaauaauauucacuuauagugaaaagugugggaaaagauuaggaaagugucuaugaua

SEQ ID NO: 265556 - RNA, 64 nt, Homo Sapiens
uccagcccucuguuaauuguaaaaacaauauaugugggaaaacuguaguuggaagaacuacuau

SEQ ID NO: 265557 - RNA, 64 nt, Homo Sapiens
gcuggcgguggagcagccaucccugccuuucuguugggaaaaacuguugugccaaacucuugug

SEQ ID NO: 265558 - RNA, 64 nt, Homo Sapiens
guuaggugccugcccucaguauagacguauccaaugggaaaacagcggaccugcccagagcagg

SEQ ID NO: 265559 - RNA, 64 nt, Homo Sapiens
uguuaucauuuaauuuccuuuggacacucugcuuugggaaaaaauuuaagcugaaguccuauuc

SEQ ID NO: 265560 - RNA, 64 nt, Homo Sapiens
cagauauuuucuuaguagugcauggaaaugacaaugggaaaauuauugucaaggggaguuuuua

SEQ ID NO: 265561 - RNA, 64 nt, Homo Sapiens
ugaguccaacuagauuagcaaaaauagagcauugugggaaaaacauuugucaaaacuaggugag

SEQ ID NO: 265562 - RNA, 64 nt, Homo Sapiens
auuuuauaauccauuuaaagacugucauguuuugugggaaaauauucuaguccaaauauaagaa

SEQ ID NO: 265563 - RNA, 64 nt, Homo Sapiens
caccuggaagguuuccaugugguacaguggcaccugggaaaagggaggugcccccaagugaagg

SEQ ID NO: 265564 - RNA, 64 nt, Homo Sapiens
gacugcgauucugaagaaccaguuuugaugaugcugggaaaagucuugggccuggcuucuuaag

SEQ ID NO: 265565 - RNA, 64 nt, Homo Sapiens
auuuuuuccuccaagauucugacaggagggagccugggaaaauauauaccuugacuuggauuuu

SEQ ID NO: 265566 - RNA, 64 nt, Homo Sapiens
caaaaaggucccauuguacuuuacuaaaaggacuugggaaaaagggggcaaccaauugaucaga

SEQ ID NO: 265567 - RNA, 64 nt, Homo Sapiens
ugauacuuggauuaggggguauuuuguaguuaauugggaaaaaguucuuagugccucccagaac

SEQ ID NO: 265568 - RNA, 64 nt, Homo Sapiens
aaaacucauuggcagauccauuaaaauguuugugugggaaaaaagcuguuuacauauacagcac

SEQ ID NO: 265569 - RNA, 64 nt, Homo Sapiens
cccaaacuaauauuuaucacacauggucauuaaaugggaaaaaaauagacuaaacaaaucacaa

SEQ ID NO: 265570 - RNA, 64 nt, Homo Sapiens
acuauuuugaauguuuccaacuggcucaauuggcugggaaaacaugggaacaagagaagcugaa

SEQ ID NO: 265571 - RNA, 64 nt, Homo Sapiens
cuauuaaucuaguucaaugcccuuauuuuacagaugggaaaacugaggccuggagguaggaagg

SEQ ID NO: 265572 - RNA, 64 nt, Homo Sapiens
aguacagagagccugugcugugaacccccuucaaugggaaaaagcugcaguggugauggcaggc

SEQ ID NO: 265573 - RNA, 64 nt, Homo Sapiens
ugcuagcauuuuagcugugcaaagggagguagugugggaaaaguguuuccauucugggaaaagc

SEQ ID NO: 265574 - RNA, 64 nt, Homo Sapiens
aaagggagguagugugggaaaaguguuuccauucugggaaaagcccaaaccgaauacggucagc

SEQ ID NO: 265575 - RNA, 64 nt, Homo Sapiens; identical to SEQ ID NO: 126055

SEQ ID NO: 265576 - RNA, 64 nt, Homo Sapiens; identical to SEQ ID NO: 126056

SEQ ID NO: 265577 - RNA, 64 nt, Homo Sapiens; identical to SEQ ID NO: 126057

SEQ ID NO: 265578 - RNA, 64 nt, Homo Sapiens; identical to SEQ ID NO: 126058

SEQ ID NO: 265579 - RNA, 64 nt, Homo Sapiens; identical to SEQ ID NO: 126059

SEQ ID NO: 265580 - RNA, 64 nt, Homo Sapiens; identical to SEQ ID NO: 126060

SEQ ID NO: 265581 - RNA, 64 nt, Homo Sapiens; identical to SEQ ID NO: 126061

SEQ ID NO: 265582 - RNA, 64 nt, Homo Sapiens; identical to SEQ ID NO: 126062

SEQ ID NO: 265583 - RNA, 64 nt, Homo Sapiens; identical to SEQ ID NO: 126063

SEQ ID NO: 265584 - RNA, 64 nt, Homo Sapiens; identical to SEQ ID NO: 126064

SEQ ID NO: 265585 - RNA, 64 nt, Homo Sapiens; identical to SEQ ID NO: 126065

SEQ ID NO: 265586 - RNA, 64 nt, Homo Sapiens; identical to SEQ ID NO: 126066

SEQ ID NO: 265587 - RNA, 64 nt, Homo Sapiens; identical to SEQ ID NO: 126067

SEQ ID NO: 265588 - RNA, 64 nt, Homo Sapiens; identical to SEQ ID NO: 126068

SEQ ID NO: 265589 - RNA, 64 nt, Homo Sapiens; identical to SEQ ID NO: 126069

SEQ ID NO: 265590 - RNA, 64 nt, Homo Sapiens; identical to SEQ ID NO: 126070

SEQ ID NO: 265591 - RNA, 64 nt, Homo Sapiens; identical to SEQ ID NO: 126071

SEQ ID NO: 265592 - RNA, 64 nt, Homo Sapiens; identical to SEQ ID NO: 126072

SEQ ID NO: 265593 - RNA, 64 nt, Homo Sapiens; identical to SEQ ID NO: 126073

SEQ ID NO: 265594 - RNA, 64 nt, Homo Sapiens; identical to SEQ ID NO: 126074

SEQ ID NO: 265595 - RNA, 64 nt, Homo Sapiens; identical to SEQ ID NO: 126075

SEQ ID NO: 265596 - RNA, 64 nt, Homo Sapiens; identical to SEQ ID NO: 126076

SEQ ID NO: 265597 - RNA, 64 nt, Homo Sapiens; identical to SEQ ID NO: 126077

SEQ ID NO: 265598 - RNA, 64 nt, Homo Sapiens; identical to SEQ ID NO: 126078

SEQ ID NO: 265599 - RNA, 64 nt, Homo Sapiens; identical to SEQ ID NO: 126079

SEQ ID NO: 265600 - RNA, 64 nt, Homo Sapiens; identical to SEQ ID NO: 126080

SEQ ID NO: 265601 - RNA, 64 nt, Homo Sapiens; identical to SEQ ID NO: 126081

SEQ ID NO: 265602 - RNA, 64 nt, Homo Sapiens; identical to SEQ ID NO: 126082

SEQ ID NO: 265603 - RNA, 64 nt, Homo Sapiens; identical to SEQ ID NO: 126083

SEQ ID NO: 265604 - RNA, 64 nt, Homo Sapiens; identical to SEQ ID NO: 126084

SEQ ID NO: 265605 - RNA, 64 nt, Homo Sapiens; identical to SEQ ID NO: 126085

SEQ ID NO: 265606 - RNA, 64 nt, Homo Sapiens; identical to SEQ ID NO: 126086

SEQ ID NO: 265607 - RNA, 64 nt, Homo Sapiens; identical to SEQ ID NO: 126087

SEQ ID NO: 265608 - RNA, 64 nt, Homo Sapiens; identical to SEQ ID NO: 126088

SEQ ID NO: 265609 - RNA, 64 nt, Homo Sapiens; identical to SEQ ID NO: 126089

SEQ ID NO: 265610 - RNA, 64 nt, Homo Sapiens; identical to SEQ ID NO: 126090

SEQ ID NO: 265611 - RNA, 64 nt, Homo Sapiens; identical to SEQ ID NO: 126091

SEQ ID NO: 265612 - RNA, 64 nt, Homo Sapiens; identical to SEQ ID NO: 126092

SEQ ID NO: 265613 - RNA, 64 nt, Homo Sapiens; identical to SEQ ID NO: 126093

SEQ ID NO: 265614 - RNA, 64 nt, Homo Sapiens; identical to SEQ ID NO: 126094

SEQ ID NO: 265615 - RNA, 64 nt, Homo Sapiens; identical to SEQ ID NO: 126095

SEQ ID NO: 265616 - RNA, 64 nt, Homo Sapiens; identical to SEQ ID NO: 126096

SEQ ID NO: 265617 - RNA, 64 nt, Homo Sapiens; identical to SEQ ID NO: 126097

SEQ ID NO: 265618 - RNA, 64 nt, Homo Sapiens; identical to SEQ ID NO: 126098

SEQ ID NO: 265619 - RNA, 64 nt, Homo Sapiens; identical to SEQ ID NO: 126099

SEQ ID NO: 265620 - RNA, 64 nt, Homo Sapiens; identical to SEQ ID NO: 126100

SEQ ID NO: 265621 - RNA, 64 nt, Homo Sapiens; identical to SEQ ID NO: 126101

SEQ ID NO: 265622 - RNA, 64 nt, Homo Sapiens; identical to SEQ ID NO: 126102

SEQ ID NO: 265623 - RNA, 64 nt, Homo Sapiens; identical to SEQ ID NO: 126103

SEQ ID NO: 265624 - RNA, 64 nt, Homo Sapiens; identical to SEQ ID NO: 126104

SEQ ID NO: 265625 - RNA, 64 nt, Homo Sapiens; identical to SEQ ID NO: 126105

SEQ ID NO: 265626 - RNA, 64 nt, Homo Sapiens; identical to SEQ ID NO: 126106

SEQ ID NO: 265627 - RNA, 64 nt, Homo Sapiens; identical to SEQ ID NO: 126107

SEQ ID NO: 265628 - RNA, 64 nt, Homo Sapiens; identical to SEQ ID NO: 126108

SEQ ID NO: 265629 - RNA, 64 nt, Homo Sapiens; identical to SEQ ID NO: 126109

SEQ ID NO: 265630 - RNA, 64 nt, Homo Sapiens; identical to SEQ ID NO: 126110

SEQ ID NO: 265631 - RNA, 64 nt, Homo Sapiens; identical to SEQ ID NO: 126111

SEQ ID NO: 265632 - RNA, 64 nt, Homo Sapiens; identical to SEQ ID NO: 126112

SEQ ID NO: 265633 - RNA, 64 nt, Homo Sapiens; identical to SEQ ID NO: 126113

SEQ ID NO: 265634 - RNA, 64 nt, Homo Sapiens; identical to SEQ ID NO: 126114

SEQ ID NO: 265635 - RNA, 64 nt, Homo Sapiens; identical to SEQ ID NO: 126115

SEQ ID NO: 265636 - RNA, 64 nt, Homo Sapiens; identical to SEQ ID NO: 126116

SEQ ID NO: 265637 - RNA, 64 nt, Homo Sapiens; identical to SEQ ID NO: 126117

SEQ ID NO: 265638 - RNA, 64 nt, Homo Sapiens; identical to SEQ ID NO: 126117

SEQ ID NO: 265639 - RNA, 64 nt, Homo Sapiens; identical to SEQ ID NO: 126119

SEQ ID NO: 265640 - RNA, 64 nt, Homo Sapiens; identical to SEQ ID NO: 126120

SEQ ID NO: 265641 - RNA, 64 nt, Homo Sapiens; identical to SEQ ID NO: 126121

SEQ ID NO: 265642 - RNA, 64 nt, Homo Sapiens; identical to SEQ ID NO: 126122

SEQ ID NO: 265643 - RNA, 64 nt, Homo Sapiens; identical to SEQ ID NO: 126123

SEQ ID NO: 265644 - RNA, 64 nt, Homo Sapiens; identical to SEQ ID NO: 126124

SEQ ID NO: 265645 - RNA, 64 nt, Homo Sapiens; identical to SEQ ID NO: 126125

SEQ ID NO: 265646 - RNA, 64 nt, Homo Sapiens; identical to SEQ ID NO: 126126

SEQ ID NO: 265647 - RNA, 64 nt, Homo Sapiens; identical to SEQ ID NO: 126127

SEQ ID NO: 265648 - RNA, 64 nt, Homo Sapiens; identical to SEQ ID NO: 126128

SEQ ID NO: 265649 - RNA, 64 nt, Homo Sapiens; identical to SEQ ID NO: 126129

SEQ ID NO: 265650 - RNA, 64 nt, Homo Sapiens; identical to SEQ ID NO: 126130

SEQ ID NO: 265651 - RNA, 64 nt, Homo Sapiens; identical to SEQ ID NO: 126131

SEQ ID NO: 265652 - RNA, 64 nt, Homo Sapiens; identical to SEQ ID NO: 217042

SEQ ID NO: 265653 - RNA, 64 nt, Homo Sapiens; identical to SEQ ID NO: 217043

SEQ ID NO: 265654 - RNA, 64 nt, Homo Sapiens; identical to SEQ ID NO: 217044

SEQ ID NO: 265655 - RNA, 64 nt, Homo Sapiens; identical to SEQ ID NO: 217045

SEQ ID NO: 265656 - RNA, 64 nt, Homo Sapiens; identical to SEQ ID NO: 217046

SEQ ID NO: 265657 - RNA, 64 nt, Homo Sapiens; identical to SEQ ID NO: 217047

SEQ ID NO: 265658 - RNA, 64 nt, Homo Sapiens; identical to SEQ ID NO: 217048

SEQ ID NO: 265659 - RNA, 64 nt, Homo Sapiens; identical to SEQ ID NO: 217049

SEQ ID NO: 265660 - RNA, 64 nt, Homo Sapiens; identical to SEQ ID NO: 217050

SEQ ID NO: 265661 - RNA, 64 nt, Homo Sapiens; identical to SEQ ID NO: 217051

SEQ ID NO: 265662 - RNA, 64 nt, Homo Sapiens; identical to SEQ ID NO: 217052

SEQ ID NO: 265663 - RNA, 64 nt, Homo Sapiens; identical to SEQ ID NO: 217053

SEQ ID NO: 265664 - RNA, 64 nt, Homo Sapiens; identical to SEQ ID NO: 217054

SEQ ID NO: 265665 - RNA, 64 nt, Homo Sapiens; identical to SEQ ID NO: 217055

SEQ ID NO: 265666 - RNA, 64 nt, Homo Sapiens; identical to SEQ ID NO: 217056

SEQ ID NO: 265667 - RNA, 64 nt, Homo Sapiens; identical to SEQ ID NO: 217057

SEQ ID NO: 265668 - RNA, 64 nt, Homo Sapiens; identical to SEQ ID NO: 217058

SEQ ID NO: 265669 - RNA, 63 nt, Homo Sapiens
uuuuauagaauccuaaaaaauaacgccugauguauagauuaguuagcaaauucucagaaaucc

SEQ ID NO: 265670 - RNA, 63 nt, Homo Sapiens
uuucuauuuuaaaaaauuguguucucuuguuaaauagauuaacauuuccacuucuguuuauca

SEQ ID NO: 265671 - RNA, 63 nt, Homo Sapiens
uucuauggcuguuuguaauuaaauguuugcuuuauagauuauagcaaaacaaagugcaauauu

SEQ ID NO: 265672 - RNA, 63 nt, Homo Sapiens
uaggaagaacaaucacaucaacuuugauuauguauagauuacacuaaacaugagaaaucacuc

SEQ ID NO: 265673 - RNA, 63 nt, Homo Sapiens
gaguguugaaacggaugauuauuagaauucuguauagauuagaaucugaggaauucuguauag

SEQ ID NO: 265674 - RNA, 63 nt, Homo Sapiens
auucuguauagauuagagagugaggaauucuguauagauuagaguugaaauuguaauuauauc

SEQ ID NO: 265675 - RNA, 63 nt, Homo Sapiens
caaaggaggaauuuacuuucuucaccaagugcaauagauuacugaugugauauucuguugcuu

SEQ ID NO: 265676 - RNA, 63 nt, Homo Sapiens
accacauaagaaggcaauuuuaguguauuaaucauagauuauuauaaacuauaaacuuaaggg

SEQ ID NO: 265677 - RNA, 63 nt, Homo Sapiens
gcuuucccucccugcacaugggcacuguaucagauagauuacuuuuuaaauguagauaaaauu

SEQ ID NO: 265678 - RNA, 63 nt, Homo Sapiens
uaaaauuucaaaaaugaauggcuaguuuacgugauagauuaggcucuuacuacauaugugugu

SEQ ID NO: 265679 - RNA, 63 nt, Homo Sapiens
gagcaagacucugucucuuaaauaaauaaauaaauagauuaccagaaaaaugaaaagaaaaaa

SEQ ID NO: 265680 - RNA, 63 nt, Homo Sapiens
uggaauaauuaacuggagauaauauccaguaaaauagauuaaacuuccauuuauaaagucaga

SEQ ID NO: 265681 - RNA, 63 nt, Homo Sapiens
uaaaaguauuccuuacaagaauuucuauagauuauagauuagcguaagccugugauaaacauu

SEQ ID NO: 265682 - RNA, 63 nt, Homo Sapiens
gauuagcuaaaaguauuccuaaacauuauuucuauagauuauaauugacaguaagccugugau

SEQ ID NO: 265683 - RNA, 63 nt, Homo Sapiens
augcugcaggauuaaauaacuugaagagccuuuauagauuauaugaaugccuauuugugucua

SEQ ID NO: 265684 - RNA, 63 nt, Homo Sapiens
uucuagcauuacuagauauuaaaaguuaagcaaauagauuaaugacguauacauaggcaucau

SEQ ID NO: 265685 - RNA, 63 nt, Homo Sapiens
agagaugagcacuucuaaguugaguauauuauaauagauuaguacuggauuauucaggcuuua

SEQ ID NO: 265686 - RNA, 63 nt, Homo Sapiens
aucuauaacuacauauugaauagggcuaggaauauagauuaaaucauacuccuaugcuuuagc

SEQ ID NO: 265687 - RNA, 64 nt, Homo Sapiens
accuuccuccagccugugcgcaccugcccuccuugcagcccagcacaccugcagguguaaggga

SEQ ID NO: 265688 - RNA, 64 nt, Homo Sapiens
gcuuccuagaaauaagcaacaccucucccaaaaagcagcccacaaggcaggggcccagcagccc

SEQ ID NO: 265689 - RNA, 64 nt, Homo Sapiens
ucucccaaaaagcagcccacaaggcaggggcccagcagcccagccaucacucaucuuugaggaa

SEQ ID NO: 265690 - RNA, 64 nt, Homo Sapiens
ugauacuuggaugcagcucuugggaccguguucugcagcccagccuuccuguugggguggggcc

SEQ ID NO: 265691 - RNA, 64 nt, Homo Sapiens
aaagcucacgaaccccaaaccuggcaagucaccugcagcccauggugagcucugggaagugugg

SEQ ID NO: 265692 - RNA, 64 nt, Homo Sapiens
gagccugguguugggucaugcugggaagggagcggcagcccagccaggccuggcccauaaaagg

SEQ ID NO: 265693 - RNA, 64 nt, Homo Sapiens
gccaggccuggcccauaaaaggcucccaugcugagcagcccauugcugaagccaggauguucug

SEQ ID NO: 265694 - RNA, 64 nt, Homo Sapiens
ucuggcuccagaggaccugagacucacacucucugcagcccagccuagucagggcacagcugcc

SEQ ID NO: 265695 - RNA, 64 nt, Homo Sapiens
ccucucuucguccugaucccuccacccccauguggcagcccauggguaugacauaggccaaggc

SEQ ID NO: 265696 - RNA, 64 nt, Homo Sapiens
aacugucaucuccugguuccaaguucgggcucuggcagcccagccgcuaucuuagcugucuuuc

SEQ ID NO: 265697 - RNA, 64 nt, Homo Sapiens
gcaagcagcucgcagccagcccagaaucucuuaugcagcccaaagggcuucuugagguagagag

SEQ ID NO: 265698 - RNA, 64 nt, Homo Sapiens
aggacaagcacugauccugaggggauacuguggagcagcccaguccacaccagagccccacgcg

SEQ ID NO: 265699 - RNA, 64 nt, Homo Sapiens
uacagguagguggcgcucacguuccugcccaaaugcagcccaucggggagucacagucaguccc

SEQ ID NO: 265700 - RNA, 64 nt, Homo Sapiens
guuuugggcugaaaccaccacgucgcccagccuggcagcccagcggggccuccccacaggccac

SEQ ID NO: 265701 - RNA, 64 nt, Homo Sapiens
cuggcuggaaaccauguuuuaacugcacgggggagcagcccagauucucgaucacgagccugag

SEQ ID NO: 265702 - RNA, 64 nt, Homo Sapiens
cucuacaggcugcucggccucccugcagcucagcgcagcccagggcuccaagugaggcccagaa

SEQ ID NO: 265703 - RNA, 64 nt, Homo Sapiens
uuccccgagagcugucggaaccagaugcaacccggcagcccagagaacucuccugggaggcugu

SEQ ID NO: 265704 - RNA, 64 nt, Homo Sapiens
cacuguguuccgugcccuggggacccccggaaaagcagcccagucagaugugggaacgugccag

SEQ ID NO: 265705 - RNA, 64 nt, Homo Sapiens
gagcacccagcaggagaggcuccugguguagugggcagcccagcacuucccgcugcugccugcc

SEQ ID NO: 265706 - RNA, 64 nt, Homo Sapiens
gggcccuugggucgggcccuggagacgacacacggcagcccacaggccacgacagacgcuggau

SEQ ID NO: 265707 - RNA, 64 nt, Homo Sapiens
acaccugugcagggucccagacccaggccccagagcagcccaggccaugacccugccgagcacg

SEQ ID NO: 265708 - RNA, 64 nt, Homo Sapiens
ccuucagcaguugaggcuggggcuaguggucccagcagcccagcccccacccuccuggcagcag

SEQ ID NO: 265709 - RNA, 64 nt, Homo Sapiens
ugcccacugucuugcccgggcugaggucagcacugcagcccaaacagugccaacagcccugucc

SEQ ID NO: 265710 - RNA, 64 nt, Homo Sapiens
aguguggagacccugccacagaggggagagacaggcagcccagcccccggcaagccacaggaag

SEQ ID NO: 265711 - RNA, 64 nt, Homo Sapiens
agacgucaggcccugacuccugcucaccagcccugcagcccaccuucccucucugaugucccag

SEQ ID NO: 265712 - RNA, 64 nt, Homo Sapiens
uguguucaggacccucccugggcccagcagcccagcagcccacaaguuacaguguaggcacccc

SEQ ID NO: 265713 - RNA, 64 nt, Homo Sapiens
agcccacauguguucaggacggcaccccggcccagcagcccagcaugcugcuaguuacagugua

SEQ ID NO: 265714 - RNA, 64 nt, Homo Sapiens
cccucugucccugugcuccaagcugcccccggcugcagcccaggccauggacaugugcaccagu

SEQ ID NO: 265715 - RNA, 64 nt, Homo Sapiens
cggcuuuccagugcggagagucgagaugcucccugcagcccaggccccgggcaccuccugcaac

SEQ ID NO: 265716 - RNA, 64 nt, Homo Sapiens
gucuggaguaucuauaugagggaagcuggaagaggcagcccagcuucccugcagaagacaaaaa

SEQ ID NO: 265717 - RNA, 64 nt, Homo Sapiens
gcagccuggccacugccaugaugccaaccuccuggcagcccaggaaccuacagggucacucagu

SEQ ID NO: 265718 - RNA, 63 nt, Homo Sapiens
cccuaccccacggaggaugagaagaggcagaucgcagcccagaccaaccucacccuccugcaa

SEQ ID NO: 265719 - RNA, 64 nt, Homo Sapiens
ugggcagguucaucaaugcccggaggcgcauccugcagcccaugcuugaugccagcaacccaga

SEQ ID NO: 265720 - RNA, 64 nt, Homo Sapiens
ggcuuggaacacagugacucccuggaguagucgggcagcccagauggcacugaucacugagcag

SEQ ID NO: 265721 - RNA, 64 nt, Homo Sapiens
cugucccuauuacgggagccgccuugccaucccugcagcccagcugguggugcugcccuaucag

SEQ ID NO: 265722 - RNA, 64 nt, Homo Sapiens
cugaacgguacggagcaguguucucaucccgggagcagcccaaacuggcuggguuucagcaauu

SEQ ID NO: 265723 - RNA, 64 nt, Homo Sapiens
aacuggcuggguuucagcaauuccugcagagccugcagcccaggacgacugaaggugaggcagg

SEQ ID NO: 265724 - RNA, 64 nt, Homo Sapiens
agaacagucugaggugaugcuggcuacagcccuggcagcccauggcaacucaaagugccuucca

SEQ ID NO: 265725 - RNA, 64 nt, Homo Sapiens
cucauuagcucccugcuccugggaugcuucccaagcagcccaggccucuagccuccauggcuga

SEQ ID NO: 265726 - RNA, 64 nt, Homo Sapiens
gaggucacucugggccuggggacccaaacccccugcagcccaggccagucagacgccaggcacc

SEQ ID NO: 265727 - RNA, 64 nt, Homo Sapiens
ccuggacagcuugacuuguggggcaggauucucugcagcccauucccaagggagacugaccauc

SEQ ID NO: 265728 - RNA, 64 nt, Homo Sapiens
uggggcagucggaagaugugggcccugggugggagcagcccacuucagcagcacugccacugcc

SEQ ID NO: 265729 - RNA, 64 nt, Homo Sapiens
cagccuccccucagagacaggccucaguucgagggcagcccauuaucugucgcagacaucugcc

SEQ ID NO: 265730 - RNA, 64 nt, Homo Sapiens
aaaagcccauccucacucagcgcuaacaucagcagcagcccaaaaggugaggccugggggccuu

SEQ ID NO: 265731 - RNA, 64 nt, Homo Sapiens
agcugucccuccagcaaaaacagcagcccuaauagcagcccacggacuuuggggaggagcaaag

SEQ ID NO: 265732 - RNA, 64 nt, Homo Sapiens
cagcagcacagucucuauggguugccccgggccagcagcccagcgggccgcucuuggccccaag

SEQ ID NO: 265733 - RNA, 64 nt, Homo Sapiens
cccugccccuuuacagucuaucauccuaaggugugcagcccaggcagccaugggaaagcaaacu

SEQ ID NO: 265734 - RNA, 64 nt, Homo Sapiens
uuuuaagcugccuggcauguggcacuuugucagggcagcccaggaaucugaaacaggaucaaac

SEQ ID NO: 265735 - RNA, 64 nt, Homo Sapiens
gccagcaucucuggcucggcuuucugggcuggaugcagcccacgacgcacuggugucugagaug

SEQ ID NO: 265736 - RNA, 64 nt, Homo Sapiens
gcccugggccgucccugugugaacgcaggcaaaagcagcccagucccccucacugcuugagcua

SEQ ID NO: 265737 - RNA, 64 nt, Homo Sapiens
caggccggccuucagcguccggucagggaagcgugcagcccaaaugggcacuugcaugggagcc

SEQ ID NO: 265738 - RNA, 64 nt, Homo Sapiens
cuguggcugcccccgacaccgccugucccgggaagcagcccagccaugagcaggcgaggagcug

SEQ ID NO: 265739 - RNA, 64 nt, Homo Sapiens
uccagacucuccccucucccgaacuuggaagggugcagcccacucccaggggagugaggaggga

SEQ ID NO: 265740 - RNA, 64 nt, Homo Sapiens
gcaccgccucaggguuuugggagcugggggguuggcagcccacuaggcagccuuggggaacccc

SEQ ID NO: 265741 - RNA, 64 nt, Homo Sapiens
gcugcaggugccagggcccagcagacacacaugggcagcccaaaggaccauagucgggauguca

SEQ ID NO: 265742 - RNA, 64 nt, Homo Sapiens
agaccacagaugacucaagccaugccagaaccaagcagcccaugccuggcuguggcgauucaga

SEQ ID NO: 265743 - RNA, 64 nt, Homo Sapiens
ggagagcacauaugcaaugccugauggguuccuugcagcccaaaaugaugccaaugagcugcuc

SEQ ID NO: 265744 - RNA, 64 nt, Homo Sapiens
ccuccgugggcuccauucuggccggggacgcagggcagcccacggcucccuguucugccccgag

SEQ ID NO: 265745 - RNA, 64 nt, Homo Sapiens
ggaugcuuugcuguaaauacaagucauccccgcagcagcccauugaggaagcguguugucuuac

SEQ ID NO: 265746 - RNA, 64 nt, Homo Sapiens; identical to SEQ ID NO: 53544

SEQ ID NO: 265747 - RNA, 64 nt, Homo Sapiens; identical to SEQ ID NO: 53545

SEQ ID NO: 265748 - RNA, 64 nt, Homo Sapiens; identical to SEQ ID NO: 53546

SEQ ID NO: 265749 - RNA, 64 nt, Homo Sapiens; identical to SEQ ID NO: 53547

SEQ ID NO: 265750 - RNA, 64 nt, Homo Sapiens; identical to SEQ ID NO: 53548

SEQ ID NO: 265751 - RNA, 64 nt, Homo Sapiens; identical to SEQ ID NO: 53549

SEQ ID NO: 265752 - RNA, 64 nt, Homo Sapiens; identical to SEQ ID NO: 53550

SEQ ID NO: 265753 - RNA, 64 nt, Homo Sapiens; identical to SEQ ID NO: 53551

SEQ ID NO: 265754 - RNA, 64 nt, Homo Sapiens; identical to SEQ ID NO: 53552

SEQ ID NO: 265755 - RNA, 64 nt, Homo Sapiens; identical to SEQ ID NO: 53553

SEQ ID NO: 265756 - RNA, 64 nt, Homo Sapiens; identical to SEQ ID NO: 53554

SEQ ID NO: 265757 - RNA, 64 nt, Homo Sapiens; identical to SEQ ID NO: 53555

SEQ ID NO: 265758 - RNA, 64 nt, Homo Sapiens; identical to SEQ ID NO: 53556

SEQ ID NO: 265759 - RNA, 64 nt, Homo Sapiens; identical to SEQ ID NO: 53557

SEQ ID NO: 265760 - RNA, 64 nt, Homo Sapiens; identical to SEQ ID NO: 53558

SEQ ID NO: 265761 - RNA, 64 nt, Homo Sapiens; identical to SEQ ID NO: 53559

SEQ ID NO: 265762 - RNA, 64 nt, Homo Sapiens; identical to SEQ ID NO: 53560

SEQ ID NO: 265763 - RNA, 64 nt, Homo Sapiens; identical to SEQ ID NO: 53561

SEQ ID NO: 265764 - RNA, 64 nt, Homo Sapiens; identical to SEQ ID NO: 53562

SEQ ID NO: 265765 - RNA, 64 nt, Homo Sapiens; identical to SEQ ID NO: 53563

SEQ ID NO: 265766 - RNA, 64 nt, Homo Sapiens; identical to SEQ ID NO: 53564

SEQ ID NO: 265767 - RNA, 64 nt, Homo Sapiens; identical to SEQ ID NO: 53565

SEQ ID NO: 265768 - RNA, 64 nt, Homo Sapiens; identical to SEQ ID NO: 53566

SEQ ID NO: 265769 - RNA, 64 nt, Homo Sapiens; identical to SEQ ID NO: 53567

SEQ ID NO: 265770 - RNA, 64 nt, Homo Sapiens; identical to SEQ ID NO: 53568

SEQ ID NO: 265771 - RNA, 64 nt, Homo Sapiens; identical to SEQ ID NO: 53569

SEQ ID NO: 265772 - RNA, 64 nt, Homo Sapiens; identical to SEQ ID NO: 53570

SEQ ID NO: 265773 - RNA, 64 nt, Homo Sapiens; identical to SEQ ID NO: 53571

SEQ ID NO: 265774 - RNA, 64 nt, Homo Sapiens; identical to SEQ ID NO: 53572

SEQ ID NO: 265775 - RNA, 64 nt, Homo Sapiens; identical to SEQ ID NO: 53573

SEQ ID NO: 265776 - RNA, 64 nt, Homo Sapiens; identical to SEQ ID NO: 53574

SEQ ID NO: 265777 - RNA, 64 nt, Homo Sapiens; identical to SEQ ID NO: 53575

SEQ ID NO: 265778 - RNA, 64 nt, Homo Sapiens; identical to SEQ ID NO: 53576

SEQ ID NO: 265779 - RNA, 64 nt, Homo Sapiens; identical to SEQ ID NO: 53577

SEQ ID NO: 265780 - RNA, 64 nt, Homo Sapiens; identical to SEQ ID NO: 53578

SEQ ID NO: 265781 - RNA, 64 nt, Homo Sapiens; identical to SEQ ID NO: 53579

SEQ ID NO: 265782 - RNA, 64 nt, Homo Sapiens; identical to SEQ ID NO: 53580

SEQ ID NO: 265783 - RNA, 64 nt, Homo Sapiens; identical to SEQ ID NO: 53580

SEQ ID NO: 265784 - RNA, 64 nt, Homo Sapiens; identical to SEQ ID NO: 53582

SEQ ID NO: 265785 - RNA, 64 nt, Homo Sapiens; identical to SEQ ID NO: 53583

SEQ ID NO: 265786 - RNA, 64 nt, Homo Sapiens; identical to SEQ ID NO: 53584

SEQ ID NO: 265787 - RNA, 64 nt, Homo Sapiens; identical to SEQ ID NO: 53585

SEQ ID NO: 265788 - RNA, 64 nt, Homo Sapiens; identical to SEQ ID NO: 53586

SEQ ID NO: 265789 - RNA, 64 nt, Homo Sapiens
cugauaaagacauaccugagaccaggaagaaaaagagguuuaauuggacuuacaguuccacaug

SEQ ID NO: 265790 - RNA, 64 nt, Homo Sapiens
ugauaaagacauuccucaagauugugaagaaaaagagguuuaauuggacuuacaguuccacaug

SEQ ID NO: 265791 - RNA, 64 nt, Homo Sapiens
ggacucaguuccgcauugcuuauuauaaaggaaagagguuuaauaauaccccaaacuggguaau

SEQ ID NO: 265792 - RNA, 64 nt, Homo Sapiens
gucuguucucacacugcuaccagaugagaaaauggagguuuaugggacuguuaucuccauuuaa

SEQ ID NO: 265793 - RNA, 64 nt, Homo Sapiens; identical to SEQ ID NO: 132617

SEQ ID NO: 265794 - RNA, 64 nt, Homo Sapiens; identical to SEQ ID NO: 132618

SEQ ID NO: 265795 - RNA, 64 nt, Homo Sapiens; identical to SEQ ID NO: 132619

SEQ ID NO: 265796 - RNA, 64 nt, Homo Sapiens; identical to SEQ ID NO: 132620

SEQ ID NO: 265797 - RNA, 64 nt, Homo Sapiens; identical to SEQ ID NO: 132621

SEQ ID NO: 265798 - RNA, 64 nt, Homo Sapiens; identical to SEQ ID NO: 132622

SEQ ID NO: 265799 - RNA, 64 nt, Homo Sapiens; identical to SEQ ID NO: 132623

SEQ ID NO: 265800 - RNA, 64 nt, Homo Sapiens; identical to SEQ ID NO: 132624

SEQ ID NO: 265801 - RNA, 64 nt, Homo Sapiens; identical to SEQ ID NO: 132625

SEQ ID NO: 265802 - RNA, 64 nt, Homo Sapiens; identical to SEQ ID NO: 132626

SEQ ID NO: 265803 - RNA, 64 nt, Homo Sapiens; identical to SEQ ID NO: 132627

SEQ ID NO: 265804 - RNA, 64 nt, Homo Sapiens; identical to SEQ ID NO: 132628

SEQ ID NO: 265805 - RNA, 64 nt, Homo Sapiens; identical to SEQ ID NO: 132629

SEQ ID NO: 265806 - RNA, 64 nt, Homo Sapiens; identical to SEQ ID NO: 132630

SEQ ID NO: 265807 - RNA, 64 nt, Homo Sapiens; identical to SEQ ID NO: 132631

SEQ ID NO: 265808 - RNA, 64 nt, Homo Sapiens; identical to SEQ ID NO: 132632

SEQ ID NO: 265809 - RNA, 64 nt, Homo Sapiens; identical to SEQ ID NO: 132633

SEQ ID NO: 265810 - RNA, 64 nt, Homo Sapiens; identical to SEQ ID NO: 132634

SEQ ID NO: 265811 - RNA, 64 nt, Homo Sapiens; identical to SEQ ID NO: 132635

SEQ ID NO: 265812 - RNA, 64 nt, Homo Sapiens; identical to SEQ ID NO: 132636

SEQ ID NO: 265813 - RNA, 64 nt, Homo Sapiens; identical to SEQ ID NO: 132637

SEQ ID NO: 265814 - RNA, 64 nt, Homo Sapiens; identical to SEQ ID NO: 132638

SEQ ID NO: 265815 - RNA, 64 nt, Homo Sapiens; identical to SEQ ID NO: 132639

SEQ ID NO: 265816 - RNA, 64 nt, Homo Sapiens; identical to SEQ ID NO: 132640

SEQ ID NO: 265817 - RNA, 64 nt, Homo Sapiens; identical to SEQ ID NO: 132641

SEQ ID NO: 265818 - RNA, 64 nt, Homo Sapiens; identical to SEQ ID NO: 132642

SEQ ID NO: 265819 - RNA, 64 nt, Homo Sapiens; identical to SEQ ID NO: 132643

SEQ ID NO: 265820 - RNA, 64 nt, Homo Sapiens; identical to SEQ ID NO: 132644

SEQ ID NO: 265821 - RNA, 64 nt, Homo Sapiens; identical to SEQ ID NO: 132645

SEQ ID NO: 265822 - RNA, 64 nt, Homo Sapiens; identical to SEQ ID NO: 132646

SEQ ID NO: 265823 - RNA, 64 nt, Homo Sapiens; identical to SEQ ID NO: 132647

SEQ ID NO: 265824 - RNA, 64 nt, Homo Sapiens; identical to SEQ ID NO: 132648

SEQ ID NO: 265825 - RNA, 64 nt, Homo Sapiens; identical to SEQ ID NO: 132649

SEQ ID NO: 265826 - RNA, 64 nt, Homo Sapiens; identical to SEQ ID NO: 132650

SEQ ID NO: 265827 - RNA, 64 nt, Homo Sapiens; identical to SEQ ID NO: 132651

SEQ ID NO: 265828 - RNA, 64 nt, Homo Sapiens; identical to SEQ ID NO: 132652

SEQ ID NO: 265829 - RNA, 64 nt, Homo Sapiens; identical to SEQ ID NO: 132653

SEQ ID NO: 265830 - RNA, 64 nt, Homo Sapiens; identical to SEQ ID NO: 132654

SEQ ID NO: 265831 - RNA, 64 nt, Homo Sapiens; identical to SEQ ID NO: 132655

SEQ ID NO: 265832 - RNA, 64 nt, Homo Sapiens; identical to SEQ ID NO: 132656

SEQ ID NO: 265833 - RNA, 64 nt, Homo Sapiens; identical to SEQ ID NO: 132657

SEQ ID NO: 265834 - RNA, 64 nt, Homo Sapiens; identical to SEQ ID NO: 132658

SEQ ID NO: 265835 - RNA, 64 nt, Homo Sapiens; identical to SEQ ID NO: 132659

SEQ ID NO: 265836 - RNA, 64 nt, Homo Sapiens; identical to SEQ ID NO: 132660

SEQ ID NO: 265837 - RNA, 64 nt, Homo Sapiens; identical to SEQ ID NO: 132661

SEQ ID NO: 265838 - RNA, 64 nt, Homo Sapiens; identical to SEQ ID NO: 132662

SEQ ID NO: 265839 - RNA, 64 nt, Homo Sapiens; identical to SEQ ID NO: 132663

SEQ ID NO: 265840 - RNA, 64 nt, Homo Sapiens; identical to SEQ ID NO: 132664

SEQ ID NO: 265841 - RNA, 64 nt, Homo Sapiens; identical to SEQ ID NO: 132665

SEQ ID NO: 265842 - RNA, 64 nt, Homo Sapiens; identical to SEQ ID NO: 132666

SEQ ID NO: 265843 - RNA, 64 nt, Homo Sapiens; identical to SEQ ID NO: 132667

SEQ ID NO: 265844 - RNA, 64 nt, Homo Sapiens; identical to SEQ ID NO: 132668

SEQ ID NO: 265845 - RNA, 64 nt, Homo Sapiens; identical to SEQ ID NO: 132669

SEQ ID NO: 265846 - RNA, 64 nt, Homo Sapiens; identical to SEQ ID NO: 132670

SEQ ID NO: 265847 - RNA, 64 nt, Homo Sapiens; identical to SEQ ID NO: 132671

SEQ ID NO: 265848 - RNA, 64 nt, Homo Sapiens; identical to SEQ ID NO: 132672

SEQ ID NO: 265849 - RNA, 64 nt, Homo Sapiens; identical to SEQ ID NO: 132673

SEQ ID NO: 265850 - RNA, 64 nt, Homo Sapiens; identical to SEQ ID NO: 132674

SEQ ID NO: 265851 - RNA, 64 nt, Homo Sapiens; identical to SEQ ID NO: 132675

SEQ ID NO: 265852 - RNA, 64 nt, Homo Sapiens; identical to SEQ ID NO: 132676

SEQ ID NO: 265853 - RNA, 64 nt, Homo Sapiens; identical to SEQ ID NO: 132677

SEQ ID NO: 265854 - RNA, 57 nt, Homo Sapiens; identical to SEQ ID NO: 132678

SEQ ID NO: 265855 - RNA, 64 nt, Homo Sapiens; identical to SEQ ID NO: 132679

SEQ ID NO: 265856 - RNA, 64 nt, Homo Sapiens; identical to SEQ ID NO: 132680

SEQ ID NO: 265857 - RNA, 64 nt, Homo Sapiens; identical to SEQ ID NO: 132681

SEQ ID NO: 265858 - RNA, 64 nt, Homo Sapiens; identical to SEQ ID NO: 132682

SEQ ID NO: 265859 - RNA, 64 nt, Homo Sapiens; identical to SEQ ID NO: 132683

SEQ ID NO: 265860 - RNA, 64 nt, Homo Sapiens; identical to SEQ ID NO: 132684

SEQ ID NO: 265861 - RNA, 64 nt, Homo Sapiens; identical to SEQ ID NO: 132685

SEQ ID NO: 265862 - RNA, 64 nt, Homo Sapiens; identical to SEQ ID NO: 132686

SEQ ID NO: 265863 - RNA, 64 nt, Homo Sapiens; identical to SEQ ID NO: 132687

SEQ ID NO: 265864 - RNA, 64 nt, Homo Sapiens; identical to SEQ ID NO: 132688

SEQ ID NO: 265865 - RNA, 64 nt, Homo Sapiens; identical to SEQ ID NO: 132689

SEQ ID NO: 265866 - RNA, 64 nt, Homo Sapiens; identical to SEQ ID NO: 132690

SEQ ID NO: 265867 - RNA, 55 nt, Homo Sapiens; identical to SEQ ID NO: 132691

SEQ ID NO: 265868 - RNA, 64 nt, Homo Sapiens; identical to SEQ ID NO: 132692

SEQ ID NO: 265869 - RNA, 64 nt, Homo Sapiens; identical to SEQ ID NO: 132693

SEQ ID NO: 265870 - RNA, 64 nt, Homo Sapiens; identical to SEQ ID NO: 132694

SEQ ID NO: 265871 - RNA, 64 nt, Homo Sapiens; identical to SEQ ID NO: 132695

SEQ ID NO: 265872 - RNA, 64 nt, Homo Sapiens; identical to SEQ ID NO: 132696

SEQ ID NO: 265873 - RNA, 64 nt, Homo Sapiens; identical to SEQ ID NO: 132697

SEQ ID NO: 265874 - RNA, 64 nt, Homo Sapiens; identical to SEQ ID NO: 132698

SEQ ID NO: 265875 - RNA, 64 nt, Homo Sapiens; identical to SEQ ID NO: 132699

SEQ ID NO: 265876 - RNA, 64 nt, Homo Sapiens; identical to SEQ ID NO: 132700

SEQ ID NO: 265877 - RNA, 64 nt, Homo Sapiens; identical to SEQ ID NO: 132701

SEQ ID NO: 265878 - RNA, 64 nt, Homo Sapiens; identical to SEQ ID NO: 132702

SEQ ID NO: 265879 - RNA, 64 nt, Homo Sapiens; identical to SEQ ID NO: 132703

SEQ ID NO: 265880 - RNA, 64 nt, Homo Sapiens; identical to SEQ ID NO: 132704

SEQ ID NO: 265881 - RNA, 64 nt, Homo Sapiens; identical to SEQ ID NO: 132705

SEQ ID NO: 265882 - RNA, 64 nt, Homo Sapiens; identical to SEQ ID NO: 132706

SEQ ID NO: 265883 - RNA, 64 nt, Homo Sapiens; identical to SEQ ID NO: 132707

SEQ ID NO: 265884 - RNA, 64 nt, Homo Sapiens; identical to SEQ ID NO: 132708

SEQ ID NO: 265885 - RNA, 64 nt, Homo Sapiens; identical to SEQ ID NO: 132709

SEQ ID NO: 265886 - RNA, 64 nt, Homo Sapiens; identical to SEQ ID NO: 132710

SEQ ID NO: 265887 - RNA, 64 nt, Homo Sapiens; identical to SEQ ID NO: 132711

SEQ ID NO: 265888 - RNA, 64 nt, Homo Sapiens; identical to SEQ ID NO: 132712

SEQ ID NO: 265889 - RNA, 64 nt, Homo Sapiens
accagaaccaagaaggagcuugcaucccuggugcccaaagcaacaugccugucuuaaacucagu

SEQ ID NO: 265890 - RNA, 64 nt, Homo Sapiens
ggggugggggaggggucugcaggugguguuuggaccaaagcaucccaagcaagggagcccucag

SEQ ID NO: 265891 - RNA, 64 nt, Homo Sapiens
ccaaggaacugguagggaaggccuuugcagaacaccaaagcaucucuaaaaauagacuaaggau

SEQ ID NO: 265892 - RNA, 64 nt, Homo Sapiens
cauagucacugagcaccugcucuuuucuuucuacccaaagcauaggcagaaaccuaagaaguua

SEQ ID NO: 265893 - RNA, 64 nt, Homo Sapiens
cugguuggcauaauauguaauugaaccucugaguccaaagcaggucguaauaaaagcaaaguuu

SEQ ID NO: 265894 - RNA, 64 nt, Homo Sapiens
ggaaacauugacccagaaccauuaaaucauccaaccaaagcauaucucauaaaauauauacuuu

SEQ ID NO: 265895 - RNA, 64 nt, Homo Sapiens
ugcaggcuccugguuguucccauaugugaaauggccaaagcacacuggaccagugaccaaaccu

SEQ ID NO: 265896 - RNA, 64 nt, Homo Sapiens
ucauuugugacaacauuucaaacguagaucgaagccaaagcagcaaugucauuagauccuuuau

SEQ ID NO: 265897 - RNA, 64 nt, Homo Sapiens
ggaucuggaccaguuucccuccugggaaaggccuccaaagcaaaucccaccuuuaccccaccuu

SEQ ID NO: 265898 - RNA, 64 nt, Homo Sapiens
guccauguuugcugccuuaauggcuguuguauuaccaaagcagggagcccgacuuagccagccc

SEQ ID NO: 265899 - RNA, 64 nt, Homo Sapiens
aaugccauguuuuaaaaccacugcgaaaauuuccccaaagcauagguggcuuugugugugugcg

SEQ ID NO: 265900 - RNA, 64 nt, Homo Sapiens
uguuugauaaacacaguccuuaacugaagguaaaccaaagcaucacguugacauuagaccaaau

SEQ ID NO: 265901 - RNA, 64 nt, Homo Sapiens
ugauugacagugucuccuuacuuugaaguuuucaccaaagcaaaaagguccauauccaauagua

SEQ ID NO: 265902 - RNA, 64 nt, Homo Sapiens
cagaagaaauuaaucuuuuaguuaguugaacauaccaaagcagaggacuggaaucuguuuguuc

SEQ ID NO: 265903 - RNA, 64 nt, Homo Sapiens
ggaagaaucaauauuguuaaaauggccauacuacccaaagcaauuuauagauucaaugcuauuc

SEQ ID NO: 265904 - RNA, 64 nt, Homo Sapiens
aaauuuauuugaaaccaaaaaagagcccaaaaagccaaagcaauccuaagcaaaaagaacaaag

SEQ ID NO: 265905 - RNA, 64 nt, Homo Sapiens
uggauaggaagaaucaguauuguuaaaauacugcccaaagcaauuuacagagccaaugcuauuu

SEQ ID NO: 265906 - RNA, 64 nt, Homo Sapiens
cauaagugcuggaaaagacuuaaugaugaacaccccaaagcaauugcaacaaaaacaaaaauug

SEQ ID NO: 265907 - RNA, 64 nt, Homo Sapiens
ugcucccacauggucaggucucacccugcuugaagcgcagaaggcacagccuuacugaccagca

SEQ ID NO: 265908 - RNA, 64 nt, Homo Sapiens
caguagacacagugcacaggggagaagagggguggcgcagaaggguugggggccuguaugccuu

SEQ ID NO: 265909 - RNA, 64 nt, Homo Sapiens
ucccuggcugaagggaauuaacagauaguaucaagcgcagaaggaaugugccaguauggcuccc

SEQ ID NO: 265910 - RNA, 64 nt, Homo Sapiens
gagcguuacuugauaacagcugcaguggcugcaggcgcagaacacccaagaauuuagcuugcug

SEQ ID NO: 265911 - RNA, 64 nt, Homo Sapiens
gcccagaaaaggcggugcuccagccaggagagcagcgcagaacaaacaaugccccgaguggugg

SEQ ID NO: 265912 - RNA, 64 nt, Homo Sapiens
ggacugcugaugccccggugcugcugagcgccgugcgcagaauggaaacagugggccuggauca

SEQ ID NO: 265913 - RNA, 64 nt, Homo Sapiens
uuggaagcugcuacuuacuuagagggcgauuagggcgcagaacucucagcagaaaguggcaaga

SEQ ID NO: 265914 - RNA, 64 nt, Homo Sapiens
uucugugguuguaaaaaugcuguugcuaaagguggcgcagaaacaaauaucaguguuagucauu

SEQ ID NO: 265915 - RNA, 64 nt, Homo Sapiens
gaaacucugugacuaauuuagaacaggugcuguugcgcagaaagugguaaggugcuguucacuu

SEQ ID NO: 265916 - RNA, 64 nt, Homo Sapiens
gugcucuggugacccgaggaggucgugcagcacagcgcagaagccccugcccacgggauccggc

SEQ ID NO: 265917 - RNA, 64 nt, Homo Sapiens
caagaugagauuggcauggcacaaaaccuaacuugcgcagaaaauugcguuacacccuuucuug

SEQ ID NO: 265918 - RNA, 64 nt, Homo Sapiens
ggcgccagagcugggcucuucaacacggcauuuagcgcagaaagucgugguucaggcaguaugg

SEQ ID NO: 265919 - RNA, 64 nt, Homo Sapiens
acgcuggaagcccacccaagccggcggggcccuagcgcagaaauucagaacccccuguccugaa

SEQ ID NO: 265920 - RNA, 64 nt, Homo Sapiens
aagggccaggcuuacugagcagaggaagaacacagcgcagaaugaagagguauuggauuuucac

SEQ ID NO: 265921 - RNA, 64 nt, Homo Sapiens
auauuaagaauugcuaugcuuuaccccuucugcugcgcagaauagauuagugagauguuaccac

SEQ ID NO: 265922 - RNA, 64 nt, Homo Sapiens
agguccccacggcuguugcucaguagagcacuuagcgcagaaucugacaaccugugaugucuca

SEQ ID NO: 265923 - RNA, 64 nt, Homo Sapiens
gugccccagacccagagauuagccucccacuucggcgcagaaaacaaaagcccuuugugggacc

SEQ ID NO: 265924 - RNA, 64 nt, Homo Sapiens
aggacuuccccggagggcugcggcguacaggcuggcgcagaacgaaccuuggccugggccguau

SEQ ID NO: 265925 - RNA, 64 nt, Homo Sapiens
gucaguuuuguugagaacuguguccugcauccuggcgcagaaccuaccugaugcgguuccucuc

SEQ ID NO: 265926 - RNA, 64 nt, Homo Sapiens
ugguuggugagaguucuucucagucuguucauaggcgcagaaauugugggugaguguguggugc

SEQ ID NO: 265927 - RNA, 64 nt, Homo Sapiens
agccgagugcccgccgccgcgccagccucagcccgcgcagaaugugcucgcugccccgcggcuu

SEQ ID NO: 265928 - RNA, 64 nt, Homo Sapiens
accagcagccgagcccuuggcccuagcccuugcugcgcagaacagcuugcuggcagcuggcauc

SEQ ID NO: 265929 - RNA, 64 nt, Homo Sapiens
ggagccggggccgagccuccaggagccugcacccgcgcagaaggcaccggacugagcucacagg

SEQ ID NO: 265930 - RNA, 64 nt, Homo Sapiens
uaugcacuuuacagaugaggggaggggccgcagugcgcagaacccaccccaccccccagugcag

SEQ ID NO: 265931 - RNA, 64 nt, Homo Sapiens
cccguaaaaucacaaagaaaauccaacaccaaaggcgcagaagccggcuggccguggugggggc

SEQ ID NO: 265932 - RNA, 64 nt, Homo Sapiens
uaaguugacaaaaggaauggggaacuggcaggccgcgcagaagguucuugguuuuaauggauag

SEQ ID NO: 265933 - RNA, 64 nt, Homo Sapiens
ugcuguggccguguccgugccccggggguagggggcgcagaauggcgcuuccccuucuccucug

SEQ ID NO: 265934 - RNA, 64 nt, Homo Sapiens
cacuuuaggagccccagacaggaggaucacuuaagcgcagaagaucaagaccagccugggaaau

SEQ ID NO: 265935 - RNA, 64 nt, Homo Sapiens
cugugaggucagagccuagacgcggagggcagaggcgcagaaucaacaccauggugugugcagg

SEQ ID NO: 265936 - RNA, 64 nt, Homo Sapiens
cuuucgauuuuuuaaauaagcccaacagcgccgggcgcagaaagucagcuauucggcgcgguuc

SEQ ID NO: 265937 - RNA, 64 nt, Homo Sapiens
ucagauauauuuuaguaacaaguucuucugggaagcgcagaauuaguacuuucuuccugaugcc

SEQ ID NO: 265938 - RNA, 64 nt, Homo Sapiens
cuucaccuucucuuccccuuaacccgagcuucgggcgcagaauuaaagcaguugagcaaacacc

SEQ ID NO: 265939 - RNA, 64 nt, Homo Sapiens
agcacaacgggucauuuuccuuuguauguuccuagcgcagaacuguuucuaaaacaacuugaag

SEQ ID NO: 265940 - RNA, 64 nt, Homo Sapiens
ggauauuggaacucagagagguggcuauugcauugcgcagaacgcuacagagcccaugcucuuc

SEQ ID NO: 265941 - RNA, 64 nt, Homo Sapiens
cucccccacucccuccuaucguugguuugucuagaacacucagcugcuucuuuggucauccuug

SEQ ID NO: 265942 - RNA, 64 nt, Homo Sapiens
augguccguucuauaccuuuuucuggucauaaugaacacucauuuuguuagcgagggugguaaa

SEQ ID NO: 265943 - RNA, 64 nt, Homo Sapiens
uugauuagaaagaccaggccaugucuggggcagaaacacucaagcucaacccaaggggauuuuu

SEQ ID NO: 265944 - RNA, 64 nt, Homo Sapiens
ggcccauggcauuuuauaggucauccucacagugaacacucaguauccauccuugccaauagug

SEQ ID NO: 265945 - RNA, 64 nt, Homo Sapiens
uaauguuccauauauuuuuauacaaucccuucuuuaccucuacuuucguuauucuaaguuuagu

SEQ ID NO: 265946 - RNA, 64 nt, Homo Sapiens
aguugauacuucaggaagucguuguuauuaguaauaccucuaguuuuuuccucuuuuuuggccc

SEQ ID NO: 265947 - RNA, 64 nt, Homo Sapiens
ggaauuaauucagugaaggaguuuaagaaaagagaaagagaaaacucuauaaaaugaauaaaau

SEQ ID NO: 265948 - RNA, 64 nt, Homo Sapiens
agaaaaggaauuaauucaguuaaaauguuuaagaaaagagaaagaaaucucucuauaaaaugaa

SEQ ID NO: 265949 - RNA, 64 nt, Homo Sapiens
gaaaagaaaauuucuacuaaucuacuagggccaaaaagagaaaaacuguggaagcuaaaacacu

SEQ ID NO: 265950 - RNA, 64 nt, Homo Sapiens
cuaaauucagcaucuccccuugaggcuuuuugugaaagagaagcuaauaucaagagucuagaug

SEQ ID NO: 265951 - RNA, 64 nt, Homo Sapiens
cacagcacuuucugauccaacugguuucuuaacaaaagagaaagaaggaaauuucaguggcucu

SEQ ID NO: 265952 - RNA, 64 nt, Homo Sapiens
gacauuccacaaaugucaaggccuauaauucuauaaagagaaauaguuuuauuggagaaaucuu

SEQ ID NO: 265953 - RNA, 64 nt, Homo Sapiens
uguaugggcacuguaucuauuugaaaauugugggaaagagaauuuaaagcaagagaucuggcag

SEQ ID NO: 265954 - RNA, 64 nt, Homo Sapiens
cacacagacaaucaugugccaagucuuccucuggaaagagaaguccuagaauuuaaaaauaaaa

SEQ ID NO: 265955 - RNA, 64 nt, Homo Sapiens
aaaucuucacugaauaucauauguaucuaaaugaaaagagaauuacuuauauucaucuauuuuc

SEQ ID NO: 265956 - RNA, 64 nt, Homo Sapiens
augggaguccacgauucucagguauugauugaaaaaagagaaaggggcaagaaauucauuaaag

SEQ ID NO: 265957 - RNA, 64 nt, Homo Sapiens
aacuuuuuuuuuuuuuuacaauuauuacaacacuaaagagaaguuuagaauauagagaguuuuu

SEQ ID NO: 265958 - RNA, 64 nt, Homo Sapiens
gagaggcaugugugccggcauccuugauggguucaaagagaaagguuggagaugauagugggug

SEQ ID NO: 265959 - RNA, 64 nt, Homo Sapiens
ccagcugcuccuaaggacacagggcuggguugguaaagagaaggcuaugguugacuucuugcuu

SEQ ID NO: 265960 - RNA, 64 nt, Homo Sapiens
aaagugccacagauaggaaacagcuguuaauuacaaagagaaagaauugucauagcaucuuauu

SEQ ID NO: 265961 - RNA, 64 nt, Homo Sapiens
cacugucauuuaaggcugugcuugugcuuuauacaaagagaaagagguggucuuaaggggaugc

SEQ ID NO: 265962 - RNA, 64 nt, Homo Sapiens
augaaauuaaaaguggauagcuuucaggaaagauaaagagaacaugcuuagaauguaagcuaaa

SEQ ID NO: 265963 - RNA, 64 nt, Homo Sapiens
ucugaugcauuaauaaaagcagccaaauagggccaaagagaaaaauaacaggacucuguacugg

SEQ ID NO: 265964 - RNA, 64 nt, Homo Sapiens
cuggcugccuggccguggcuucucuuuggcucccaaagagaaggacaguguugggaguaucugc

SEQ ID NO: 265965 - RNA, 64 nt, Homo Sapiens
ugggaguaucugccguggcuucucuuuggcucccaaagagaaggacaguguugggaguaucugc

SEQ ID NO: 265966 - RNA, 64 nt, Homo Sapiens
guucaggguuguagggauggcugcuucaucaaggaaagagaaauuuuagggaugagacuauucu

SEQ ID NO: 265967 - RNA, 64 nt, Homo Sapiens
ccagaagucuuugaggucucauuggccuaaauaaaaagagaagauuaggauagagagugggcuc

SEQ ID NO: 265968 - RNA, 64 nt, Homo Sapiens
cuugggaacaugaugaauguucaguauucaucucaaagagaaacccauuaguagaguucaagcu

SEQ ID NO: 265969 - RNA, 64 nt, Homo Sapiens
ccugucaaugucaagaggggaggcaauaauuacuaaagagaaucaccacaucuuguuccacauc

SEQ ID NO: 265970 - RNA, 64 nt, Homo Sapiens
uugagaaggcuugugcccaacugucuccaaagagaaagagaaaccugggcaacagagugagacc

SEQ ID NO: 265971 - RNA, 64 nt, Homo Sapiens
agaaacuugagaaggcuugugagacccugucuccaaagagaaaguccagccugggcaacagagu

SEQ ID NO: 265972 - RNA, 64 nt, Homo Sapiens
auuaaagagacugguagcucaucauccuaccauaaaagagaaaaaaauucggaaagugaucaga

SEQ ID NO: 265973 - RNA, 64 nt, Homo Sapiens
gucaaguguucaggccacacagucagcccaggaaaaagagaagcagggccaaauggaaagaaca

SEQ ID NO: 265974 - RNA, 64 nt, Homo Sapiens
acgggaaugcccucauucaaaaaaaagaacuuugaaagagaaucuuucugaucaccuuagaaau

SEQ ID NO: 265975 - RNA, 64 nt, Homo Sapiens
caaaagcacaaacaugggucaaaggaaaaucuuaaaagagaacacaccaaaaaagugaaagaga

SEQ ID NO: 265976 - RNA, 64 nt, Homo Sapiens
ggaaaaucuuaaaagagaacacaccaaaaaagugaaagagaaauugaaagggaaaaaagacaaa

SEQ ID NO: 265977 - RNA, 64 nt, Homo Sapiens
ggagauugaugacaagcaaguuacucaggaaucaaaagagaaaaaaguuucugaaaacaaugaa

SEQ ID NO: 265978 - RNA, 64 nt, Homo Sapiens
uuuauagaaugcaugucuuuuguguuaagaaaccaaagagaaauaaagagaacacuccuaauag

SEQ ID NO: 265979 - RNA, 64 nt, Homo Sapiens
gcaugucuuuuguguuaagaaaccaaagagaaauaaagagaacacuccuaauagcucuuguccu

SEQ ID NO: 265980 - RNA, 64 nt, Homo Sapiens
gcuccuucaucguaaauuuauauugcaaccugagaaagagaacugcaaaugacaagcgauaggc

SEQ ID NO: 265981 - RNA, 64 nt, Homo Sapiens
aaugacagaaaaaaaaaagaugacguccugccagaaagagaaugaaggcccucucacacagacg

SEQ ID NO: 265982 - RNA, 64 nt, Homo Sapiens
uuucaggaaauaaaacuacauacaguauuuaguaaaagagaaagauaucaaaacaucucuaaga

SEQ ID NO: 265983 - RNA, 64 nt, Homo Sapiens
aaagaaauucaugcauagcuagaagggaacuguaaaagagaaaaggauuuuuuuuuuuuaagua

SEQ ID NO: 265984 - RNA, 64 nt, Homo Sapiens
ugcagagguugagaggaggacuugguugauguuuaaagagaaguucccagccaagggccucggg

SEQ ID NO: 265985 - RNA, 64 nt, Homo Sapiens
cagacaucagccuccuucuuucaccccuuaccccaaagagaaagaguuugaaacucgagaccau

SEQ ID NO: 265986 - RNA, 64 nt, Homo Sapiens
uuagucaaaagaaaaaaugcuuuauagcaaaaugaaagagaacaugaaaugcuucuuucucagu

SEQ ID NO: 265987 - RNA, 64 nt, Homo Sapiens
uguagaagcaaacaaaauacuuuuacccacuuaaaaagagaauauaacauuuuaugucacuaua

SEQ ID NO: 265988 - RNA, 64 nt, Homo Sapiens
uccugucacauuauauucccuugguagcguauauaaagagaagucagugaauagugcucauaaa

SEQ ID NO: 265989 - RNA, 64 nt, Homo Sapiens
gguguuucguuggguauugccauuucugaauaauaaagagaaaacaaacagauccauguuagga

SEQ ID NO: 265990 - RNA, 64 nt, Homo Sapiens
ucauuuuuuuaaagugaaauauauauccuuauccaaagagaaaccacuaaauaacccaguuuua

SEQ ID NO: 265991 - RNA, 64 nt, Homo Sapiens
uuaccauagcaacuuucaguuaaacuccuugaguaaagagaaguaaauacuccucuaaaguaga

SEQ ID NO: 265992 - RNA, 64 nt, Homo Sapiens
uaucauuacuguuacauuugcucuuucccuuggaaaagagaauuauguccauucugcagcguuu

SEQ ID NO: 265993 - RNA, 64 nt, Homo Sapiens
gcagcuuucuagggacagcugagcugaaaaugaaaaagagaacagguggucccugcccuuacca

SEQ ID NO: 265994 - RNA, 64 nt, Homo Sapiens
uucgcuguuuguuguuucauagauuuauuuaaaaaaagagaaagucuauagcuauaaaucuuua

SEQ ID NO: 265995 - RNA, 64 nt, Homo Sapiens
uaaaaaaagagaaagucuauagcuauaaaucuuuaaagagaaauaugaauacaauuccccuaaa

SEQ ID NO: 265996 - RNA, 64 nt, Homo Sapiens
gaaauaugaauacaauuccccuaaacucuccucaaaagagaauucagucuacagccauuuaaau

SEQ ID NO: 265997 - RNA, 64 nt, Homo Sapiens
agacgcaggaagaugaaaggcuuuucugccugagaaagagaaccaaugcaauaaggaaucaauu

SEQ ID NO: 265998 - RNA, 64 nt, Homo Sapiens
auauauauauccacccccaguaauacauuaagagaaagagaaaucaauguccuuugauuuuuuu

SEQ ID NO: 265999 - RNA, 64 nt, Homo Sapiens
auuccucaccuuucuugccuuuaccagacacuggaaagagaauacuauauugcucauuuagcua

SEQ ID NO: 266000 - RNA, 64 nt, Homo Sapiens
aagaaauaaauacaucucaucuaacacacacgacaaagagaagcugugcgugccccgggguggg

SEQ ID NO: 266001 - RNA, 64 nt, Homo Sapiens
cauuuguaaaauaaaauagagcagaaaaacacaaaaagagaacacugguucagacauucagugg

SEQ ID NO: 266002 - RNA, 64 nt, Homo Sapiens
guuucuguugauuucuuuuuuguaugcugugauaaaagagaaaugaaaagugccagucacugug

SEQ ID NO: 266003 - RNA, 64 nt, Homo Sapiens
agaguugauuaagaaaaaugaagaaaaaacgcaaaaagagaacacauguagaaggugguggaug

SEQ ID NO: 266004 - RNA, 64 nt, Homo Sapiens
aaacugcacaaauuuuuaugggacaaagccuagaaaagagaaauguaguuugaaucauaaucua

SEQ ID NO: 266005 - RNA, 64 nt, Homo Sapiens
cacugaaaaggggugggaguuggaaaucagaaagaaagagaaauauuucauuauguuaaugaag

SEQ ID NO: 266006 - RNA, 64 nt, Homo Sapiens
aagaaagagaaauauuucauuauguuaaugaagaaaagagaaaauugaagcauaaauguauuuu

SEQ ID NO: 266007 - RNA, 64 nt, Homo Sapiens
uuagugccugacacagaaacaacugggaauccugaaagagaagcagacaccgucacaggccccu

SEQ ID NO: 266008 - RNA, 64 nt, Homo Sapiens
gcauuucccagccccaguguccacaccucucagaaaagagaaaaaagaaugucaguuuaggaga

SEQ ID NO: 266009 - RNA, 64 nt, Homo Sapiens
cucaugccuuauucagcaucacaaaaugcauaggaaagagaaaucguaugaauguaaugaguau

SEQ ID NO: 266010 - RNA, 64 nt, Homo Sapiens
agcacaucuaguucaacaucagagcauucauaccaaagagaacucaugaauguaaugaagaugg

SEQ ID NO: 266011 - RNA, 64 nt, Homo Sapiens
gagaugccuuuuguguuuuggcuuggugcauaagaaagagaaaaagacaucagcuauauacucu

SEQ ID NO: 266012 - RNA, 64 nt, Homo Sapiens
gcugcucagggaaacauugggacgaagaguaggaaaagagaagggaucuagaacugguccagcc

SEQ ID NO: 266013 - RNA, 64 nt, Homo Sapiens
uguaaaucaucuggcaucacugauagaauuucugaaagagaaagagaaguagauggucaaccag

SEQ ID NO: 266014 - RNA, 64 nt, Homo Sapiens
ucaucuggcaucacugauagaauuucugaaagagaaagagaaguagauggucaaccagucacua

SEQ ID NO: 266015 - RNA, 64 nt, Homo Sapiens
gucaggauugcacaguauguuacaauacaauuucaaagagaacccacauuugugagauuuacag

SEQ ID NO: 266016 - RNA, 64 nt, Homo Sapiens
uaagagaugaaaaagaauugacacaguucucuuuaaagagaagaacuuuuuuauuauuauuuuu

SEQ ID NO: 266017 - RNA, 64 nt, Homo Sapiens
agaggcucuguuuuccacugaagcuuuguuggagaaagagaauaugaaaauuacacauuuuaua

SEQ ID NO: 266018 - RNA, 64 nt, Homo Sapiens
cauuaaaucguagguagggcaauguaguaaaaugaaagagaauuaagaaagguuuugaauucuu

SEQ ID NO: 266019 - RNA, 64 nt, Homo Sapiens
agaacagugugguaaaaggguaaaaauaaaaaguaaagagaauguaguauuuauagaaauaaug

SEQ ID NO: 266020 - RNA, 64 nt, Homo Sapiens
acgacguaucagaaagagguuuguucacuuccagaaagagaaaggcuugaaaaauuaaaggagg

SEQ ID NO: 266021 - RNA, 64 nt, Homo Sapiens
ccauucucuuggguggguaauuguggucugagccaaagagaaugaagucacucaauuguuuuug

SEQ ID NO: 266022 - RNA, 64 nt, Homo Sapiens
uagaccugugagaaaacguuuauagugguguuuuaaagagaaugaguuuccguuuccagguguu

SEQ ID NO: 266023 - RNA, 64 nt, Homo Sapiens
caagagacagaaaucaggacauuaaaaaaagagaaaagagaaaguugcauuuuuuuguuugcau

SEQ ID NO: 266024 - RNA, 64 nt, Homo Sapiens
gagaaagcaagagacagaaauuugcauauuaaaaaaagagaaaauucauuuuugcauuuuuuug

SEQ ID NO: 266025 - RNA, 64 nt, Homo Sapiens
uuccgugagagucaucucaaacacugcuuaaggaaaagagaaacacuaauggccaaguguacau

SEQ ID NO: 266026 - RNA, 64 nt, Homo Sapiens
aaguaauaacuguuagaauuagguaauggauaugaaagagaaaaugcuuucucaugcauagaca

SEQ ID NO: 266027 - RNA, 64 nt, Homo Sapiens
ccguggcacuauguaaauaaaaaaagagaagaaaaaagagaaacuaccaucucccccgccaaua

SEQ ID NO: 266028 - RNA, 64 nt, Homo Sapiens
aaaaagagaaacccguggcacccccgccaauaaaaaagagaagaaacaaguuauaguaccaucu

SEQ ID NO: 266029 - RNA, 64 nt, Homo Sapiens
aauauuuguguaggugaauccauuuugugaacuuaaagagaaggucauuuuucuuuucuucuug

SEQ ID NO: 266030 - RNA, 64 nt, Homo Sapiens
cacugguccugacaauuuuuucaccuccuacuguaaagagaauggaaccaacccaaccccuagc

SEQ ID NO: 266031 - RNA, 64 nt, Homo Sapiens
cucuggggucagggagagacauuuuaaggagaggaaagagaaaagaccagaagaggcacuagcc

SEQ ID NO: 266032 - RNA, 64 nt, Homo Sapiens
gacagugaccaacccugagaucaaguuaauucagaaagagaagauuuccaucugucugguuaug

SEQ ID NO: 266033 - RNA, 64 nt, Homo Sapiens
uuuaauuaauugguaagauauaaugcaaaaaaaaaaagagaaauguuugccuuauguauauucc

SEQ ID NO: 266034 - RNA, 64 nt, Homo Sapiens
ugaccuaauacaauuaauuuucuggauaacucuuaaagagaagucauuuuaacuguuuuugcua

SEQ ID NO: 266035 - RNA, 64 nt, Homo Sapiens
gucaauaauuagaaauagaagauuuauauagcaaaaagagaaugauguuuggcaauauagaacu

SEQ ID NO: 266036 - RNA, 64 nt, Homo Sapiens
augcaaaaagguaacaaauucauaacuggaaagcaaagagaagaacaaguaugauuuggaugau

SEQ ID NO: 266037 - RNA, 64 nt, Homo Sapiens
ucuccccugcgagcccuuuuuauuugagaaggaaaaagagaaaagagaaucguuuaagggaacc

SEQ ID NO: 266038 - RNA, 64 nt, Homo Sapiens
ugcgagcccuuuuuauuugagaaggaaaaagagaaaagagaaucguuuaagggaacccggcgcc

SEQ ID NO: 266039 - RNA, 64 nt, Homo Sapiens
uggagaggaccuaacauaugaugaugucaguuucaaagagaaagguaauuuuacauuucaugaa

SEQ ID NO: 266040 - RNA, 64 nt, Homo Sapiens
ucugauucagcuggggcuaggacguauccacagaaaagagaagcuuuauuuaggccuucugugu

SEQ ID NO: 266041 - RNA, 64 nt, Homo Sapiens
aacaggaaugaaaggaaaccacuguucaaaagcaaaagagaaggagcuauuaguauauuuaaaa

SEQ ID NO: 266042 - RNA, 64 nt, Homo Sapiens
ucugguuaaaacaccaugagcucagcaacaccaaaaagagaaaggaauuugcaaacuaccgucg

SEQ ID NO: 266043 - RNA, 64 nt, Homo Sapiens
guugaaaugaaaagagagacagagagaaaaaaaaaaagagaacccacaugaagcucugaaacca

SEQ ID NO: 266044 - RNA, 64 nt, Homo Sapiens
ugguaaauuuuugaguuguuuguuucuguuuuguaaagagaauccuuauuggacaccagugaag

SEQ ID NO: 266045 - RNA, 64 nt, Homo Sapiens
gcugcauuuugaugaauuuuuucuagccauuuuuaaagagaaaacuaggaauugaguauuuugu

SEQ ID NO: 266046 - RNA, 64 nt, Homo Sapiens
gaggaggcauaagcuauggagguuggaaaggaagaaagagaagagcugaaguaaauguauggua

SEQ ID NO: 266047 - RNA, 64 nt, Homo Sapiens
aaaccauauugaucaacuagaaagaaaaauaugaaaagagaaaaauauuuuaauuuaaaaauug

SEQ ID NO: 266048 - RNA, 64 nt, Homo Sapiens
uuguguuuaucuaaauacguaaacucaagcuaccaaagagaaagauguuguaaucauaucugca

SEQ ID NO: 266049 - RNA, 64 nt, Homo Sapiens
agacucugucucaaaaaaaaaaaaaaaaaggaagaaagagaagauagagacacaggggagaaug

SEQ ID NO: 266050 - RNA, 64 nt, Homo Sapiens
accuaccuuuucaggauuuagaaccuaaaauuagaaagagaaucccagcugucauuguuccuuc

SEQ ID NO: 266051 - RNA, 64 nt, Homo Sapiens
gggcuucccuguucccucagccccagucgagaggaaagagaaucgggccacugccagaaagaga

SEQ ID NO: 266052 - RNA, 64 nt, Homo Sapiens
agagcagguagcccaaaauagagaaagauuagauaaagagaaaauaaguauccaucagagacag

SEQ ID NO: 266053 - RNA, 64 nt, Homo Sapiens
uaaaugaauaaaacauuugcaaagaccuuuagagaaagagaaugggagcauaugugagaaauaa

SEQ ID NO: 266054 - RNA, 64 nt, Homo Sapiens
acguaucccaccugacauguuuucuucagcucugaaagagaaacugauuccgcagcucagaccc

SEQ ID NO: 266055 - RNA, 64 nt, Homo Sapiens
cccuucuccuuauuguaacccuauggagugcaccaaagagaaugagcucaggacugccauugga

SEQ ID NO: 266056 - RNA, 64 nt, Homo Sapiens
ggaauuuuuguuuaaaugagcauuauuaauaaauaaagagaaaaguugauauuauuguuauuau

SEQ ID NO: 266057 - RNA, 64 nt, Homo Sapiens
ccccaagccuggaacgcagacaaaaagaacaaaaaaagagaaacggcuucuggcacuuagaaaa

SEQ ID NO: 266058 - RNA, 64 nt, Homo Sapiens
gagcugaggccauucccugucuuguuuaauucuaaaagagaaggaaguuaacucuuaguuuuua

SEQ ID NO: 266059 - RNA, 64 nt, Homo Sapiens
aagaagcacucugcuggcggcuguaggaaacagaaaagagaagaguggguuccagggacuguac

SEQ ID NO: 266060 - RNA, 64 nt, Homo Sapiens
cagcaaguucuauuuaugcuaauuugccuucaacaaagagaaguuuuucugcaucaauucaguc

SEQ ID NO: 266061 - RNA, 64 nt, Homo Sapiens
ucaacucauaaacgugauugaaccucuauuuuaaaaagagaagugggaggcauuuugaagauag

SEQ ID NO: 266062 - RNA, 64 nt, Homo Sapiens
gggaagccugagguagucaacccaggagccaagaaaagagaacuacgaggaacaggugcccgga

SEQ ID NO: 266063 - RNA, 64 nt, Homo Sapiens
aaaagggcaaaaaacaaucucaaaaagauuagaaaaagagaaggggggaagggaagagaaaauc

SEQ ID NO: 266064 - RNA, 64 nt, Homo Sapiens
aacauagcgugacccugucucuacaaaaaauuaaaaagagaacauacaaaguugacauaugaga

SEQ ID NO: 266065 - RNA, 64 nt, Homo Sapiens
accaauuuuguuuuuacagaaaagauaaaacucaaaagagaacaguguauuccuucugaggggc

SEQ ID NO: 266066 - RNA, 64 nt, Homo Sapiens
uucauuagcugaaugaggauauuuuaagaaguugaaagagaauuuauuuucaaguugugaguaa

SEQ ID NO: 266067 - RNA, 64 nt, Homo Sapiens
ccuaaagggaaccugcaauaaucuugaaaaagaaaaagagaaaaauuuuaaaauccugcuauag

SEQ ID NO: 266068 - RNA, 64 nt, Homo Sapiens
gagaaaaauuuuaaaauccugcuauaggagaaaaaaagagaaaaaaauaaaaaucaaaaaaaaa

SEQ ID NO: 266069 - RNA, 64 nt, Homo Sapiens
ucagguuuuuaaagacccagcccuucccaaucucaaagagaaaaaggaaacugaguuaucuuga

SEQ ID NO: 266070 - RNA, 64 nt, Homo Sapiens
gcauuuaagaugacagugagaaaaugauaagcauaaagagaaguaucagguuauuugcuuuuuc

SEQ ID NO: 266071 - RNA, 64 nt, Homo Sapiens
uucuucuucuucuuuuuuuuuuuuuauaaaagcaaaagagaaauacauaaaaaaguguuuaccc

SEQ ID NO: 266072 - RNA, 64 nt, Homo Sapiens
ugcaauacauuuuuuucucuuuccuugaaaauaaaaagagaaacaaguauuuugcuauauauaa

SEQ ID NO: 266073 - RNA, 64 nt, Homo Sapiens
aaaaauaaacugauuuaauuugcucuauaguccuaaagagaauuauauccucucauagaccaau

SEQ ID NO: 266074 - RNA, 64 nt, Homo Sapiens
uaucuuuaaagucaucugggaggugcagguaaguaaagagaaacaauuuuugucacaaaguagu

SEQ ID NO: 266075 - RNA, 64 nt, Homo Sapiens
gcuguaguaaacuguguuaaugcuuguuuaaaugaaagagaaaagauuuuaaaagggaaugaua

SEQ ID NO: 266076 - RNA, 64 nt, Homo Sapiens
acuuccaucucaacuucaacgcaacugaauuacaaaagagaauuccucuggaucaucuggcuga

SEQ ID NO: 266077 - RNA, 64 nt, Homo Sapiens
ucuauacagaauguauaucaacugugccuuacacaaagagaaacuauauacucaauaugguuuu

SEQ ID NO: 266078 - RNA, 64 nt, Homo Sapiens
ugcauuuguuccucaaucaaacagucuauuguuuaaagagaagguuaguuaaaucuaguaaagg

SEQ ID NO: 266079 - RNA, 64 nt, Homo Sapiens
gcugaugcuggcaaggagcgguacccaaagggaaaaagagaaaacugcaaagaagggagagaag

SEQ ID NO: 266080 - RNA, 64 nt, Homo Sapiens
aaacaagauuuccauucccauuugucauacuaucaaagagaaaggaugacaauauccuuacaca

SEQ ID NO: 266081 - RNA, 64 nt, Homo Sapiens
cagaguuuauucugguuaaccauuuggguacucaaaagagaaaucauguuaaaagccuuaaucu

SEQ ID NO: 266082 - RNA, 64 nt, Homo Sapiens
ugugccugguguguguaaugugauaagcucugugaaagagaagagccaaaaggagauaccaucc

SEQ ID NO: 266083 - RNA, 64 nt, Homo Sapiens
cucuaaaagaauaugaucuugggggcggggguacaaagagaaauuuucuuuaauggcgggggcg

SEQ ID NO: 266084 - RNA, 64 nt, Homo Sapiens
aaaucacaaaaacaaacuuuaagaaaaaaaagaaaaagagaaaaacaaugcauggauuccuuug

SEQ ID NO: 266085 - RNA, 64 nt, Homo Sapiens
gcauaggccucuguucucaugaggcuccuuuuuuaaagagaaaagucggcugugcaucgcauuc

SEQ ID NO: 266086 - RNA, 64 nt, Homo Sapiens
gccuucugugcccaggcuaacaggaaagaacaggaaagagaaaagguccugaaguuugcugguu

SEQ ID NO: 266087 - RNA, 64 nt, Homo Sapiens
cuuuuuguuuuaacuauugucaggagauugggcuaaagagaagacgacgagaguaaggaaauaa

SEQ ID NO: 266088 - RNA, 64 nt, Homo Sapiens
cagucuugcacauaagugcagauuuggcucaaguaaagagaauuuccucaacacuaacuucacu

SEQ ID NO: 266089 - RNA, 64 nt, Homo Sapiens
ugugcugaugaaguccucuauaagcacaagccaaaaagagaaagagaaaaaaagguaauuauug

SEQ ID NO: 266090 - RNA, 64 nt, Homo Sapiens
cuaauucuuaaaucccagcacaagccaaaaagagaaagagaaaaaaagguaauuauuguagaac

SEQ ID NO: 266091 - RNA, 64 nt, Homo Sapiens
uuugcaugugacuuagcaagggcucugaaaugacaaagagaacgagcaccacaaaugagaacag

SEQ ID NO: 266092 - RNA, 64 nt, Homo Sapiens
cgacagaugccuccuggguuccagacugucuaccaaagagaagggcagaggguuucugcugucu

SEQ ID NO: 266093 - RNA, 64 nt, Homo Sapiens
uguccaaagaguccucagaagaaggguugagaagaaagagaaaugggggguggauuaggagauu

SEQ ID NO: 266094 - RNA, 64 nt, Homo Sapiens
gccgucaaguaguaagaagaacuuggaugccagcaaagagaauggggcugggcagaucugugag

SEQ ID NO: 266095 - RNA, 64 nt, Homo Sapiens
ggaaaccacagugaagaagacagcacugaugaccaaagagaagacacucauauuaagccuauuu

SEQ ID NO: 266096 - RNA, 64 nt, Homo Sapiens
auuuagugcagcuguuauggcucaccucagaacaaaagagaauugaaccaaauuugggaguuug

SEQ ID NO: 266097 - RNA, 64 nt, Homo Sapiens
cuaauuucaaaagaaucccaauauugcuguauagaaagagaacuagcuugcacauuuuaggucu

SEQ ID NO: 266098 - RNA, 64 nt, Homo Sapiens
cguaaggugcuuccuuuaaguguucggauaugccaaagagaaacaugcugguagugaugcuggc

SEQ ID NO: 266099 - RNA, 64 nt, Homo Sapiens
cuguaucccauaggcccaggcagguaguuuauucaaagagaacucagacuccugccagaugggg

SEQ ID NO: 266100 - RNA, 64 nt, Homo Sapiens
gccccaugcccagcuugugaggucccaagugggaaaagagaacuccagaaagucugguggcuuu

SEQ ID NO: 266101 - RNA, 64 nt, Homo Sapiens
aaauggccaguauucauccucuuucuucuaaaauaaagagaagagguagugagcugaucaucca

SEQ ID NO: 266102 - RNA, 64 nt, Homo Sapiens
aaaggcuauuuagcauuacauuaaguugcaguaaaaagagaaaacuguguucuaaauagaaaua

SEQ ID NO: 266103 - RNA, 64 nt, Homo Sapiens
gguguaaaaaagauguuucacuaauguaacggugaaagagaaucccuguuguacuuuaucuuuu

SEQ ID NO: 266104 - RNA, 64 nt, Homo Sapiens
aagauauuuucuuuuuguuauuagaaggaaauacaaagagaaaaauuucuuucuuucaugggca

SEQ ID NO: 266105 - RNA, 64 nt, Homo Sapiens
ugcuuucuuuaaaauaacuagaagaacauaaaagaaagagaaucucagaaguaguuugcugcua

SEQ ID NO: 266106 - RNA, 64 nt, Homo Sapiens
uugacagacucacucggccucacuucauccuugcaaagagaauccuguacuucauccuugcaaa

SEQ ID NO: 266107 - RNA, 64 nt, Homo Sapiens
uccuugcaaagagaauccuguacuucauccuugcaaagagaauccuguacuucacucagaauga

SEQ ID NO: 266108 - RNA, 64 nt, Homo Sapiens
agaauucagcugacaggagguccuguguuggaugaaagagaauaccaugugcuuuucgcagccu

SEQ ID NO: 266109 - RNA, 64 nt, Homo Sapiens
ccugugaaauaggcagggccccggaggaagggugaaagagaaagguggcuuuuaaaccaggagc

SEQ ID NO: 266110 - RNA, 64 nt, Homo Sapiens
acuucggacagucuagguccgugaccuccagagcaaagagaaaguuggaugguccaggcucuau

SEQ ID NO: 266111 - RNA, 64 nt, Homo Sapiens
agccuccuggggggucugacggccaggguuccaaaaagagaauaugcagagaaggugggaccag

SEQ ID NO: 266112 - RNA, 64 nt, Homo Sapiens
uuuccuaaagcuccucugcacauagaggggagaaaaagagaauuuaggcaacuccacucccccu

SEQ ID NO: 266113 - RNA, 64 nt, Homo Sapiens
ccuucacccccaacccuguauucuacucucccgaaaagagaagagaaucgcaugaguagcaaga

SEQ ID NO: 266114 - RNA, 64 nt, Homo Sapiens
ucugguauuugcaaugaucuauuuacaaaaagagaaagagaaaauagcuuauauaugacgguau

SEQ ID NO: 266115 - RNA, 64 nt, Homo Sapiens
agaaaaucugguauuugcaacgguauauuuacaaaaagagaaagaaauuuuagcuuauauauga

SEQ ID NO: 266116 - RNA, 64 nt, Homo Sapiens; identical to SEQ ID NO: 51753

SEQ ID NO: 266117 - RNA, 64 nt, Homo Sapiens; identical to SEQ ID NO: 51754

SEQ ID NO: 266118 - RNA, 64 nt, Homo Sapiens; identical to SEQ ID NO: 51755

SEQ ID NO: 266119 - RNA, 64 nt, Homo Sapiens; identical to SEQ ID NO: 51756

SEQ ID NO: 266120 - RNA, 64 nt, Homo Sapiens; identical to SEQ ID NO: 51757

SEQ ID NO: 266121 - RNA, 64 nt, Homo Sapiens; identical to SEQ ID NO: 51758

SEQ ID NO: 266122 - RNA, 64 nt, Homo Sapiens; identical to SEQ ID NO: 51759

SEQ ID NO: 266123 - RNA, 64 nt, Homo Sapiens; identical to SEQ ID NO: 51760

SEQ ID NO: 266124 - RNA, 64 nt, Homo Sapiens; identical to SEQ ID NO: 51761

SEQ ID NO: 266125 - RNA, 64 nt, Homo Sapiens; identical to SEQ ID NO: 51762

SEQ ID NO: 266126 - RNA, 64 nt, Homo Sapiens; identical to SEQ ID NO: 51763

SEQ ID NO: 266127 - RNA, 64 nt, Homo Sapiens; identical to SEQ ID NO: 51764

SEQ ID NO: 266128 - RNA, 64 nt, Homo Sapiens
gagugagugguaguuacuuauguugauuaacacucauaacuaggggaucucaggaaggcaucag

SEQ ID NO: 266129 - RNA, 64 nt, Homo Sapiens
caaggacuacuaaaaggaaaggaaacuauucuaucauaacuaccaaagaaacaaaaaaaagagu

SEQ ID NO: 266130 - RNA, 64 nt, Homo Sapiens
auuaugacuagcuuuacuauuuuaauucaccuugcauaacuacugaauuuugucauucuugaaa

SEQ ID NO: 266131 - RNA, 64 nt, Homo Sapiens
gcugggauuacagaugugagccaccgugcuuggccauaacuauugaaugcuuucuauguggaga

SEQ ID NO: 266132 - RNA, 64 nt, Homo Sapiens
aaugauuauccuuuuaucaggagcccacuucugacauaacuaacccacaccugagauaacggca

SEQ ID NO: 266133 - RNA, 64 nt, Homo Sapiens
cccucuacugaugagacuuccugcugccuuuggacauaacuaagccaggaaacuuuaaaagccu

SEQ ID NO: 266134 - RNA, 64 nt, Homo Sapiens
ugcagcccaguuuaauucagcacuuucccauuuucauaacuaugugaaaacaucugggaauuug

SEQ ID NO: 266135 - RNA, 64 nt, Homo Sapiens; identical to SEQ ID NO: 212887

SEQ ID NO: 266136 - RNA, 64 nt, Homo Sapiens; identical to SEQ ID NO: 212888

SEQ ID NO: 266137 - RNA, 64 nt, Homo Sapiens; identical to SEQ ID NO: 212889

SEQ ID NO: 266138 - RNA, 64 nt, Homo Sapiens; identical to SEQ ID NO: 212890

SEQ ID NO: 266139 - RNA, 64 nt, Homo Sapiens; identical to SEQ ID NO: 212891

SEQ ID NO: 266140 - RNA, 64 nt, Homo Sapiens; identical to SEQ ID NO: 212892

SEQ ID NO: 266141 - RNA, 64 nt, Homo Sapiens; identical to SEQ ID NO: 212893

SEQ ID NO: 266142 - RNA, 64 nt, Homo Sapiens; identical to SEQ ID NO: 212894

SEQ ID NO: 266143 - RNA, 64 nt, Homo Sapiens; identical to SEQ ID NO: 212895

SEQ ID NO: 266144 - RNA, 64 nt, Homo Sapiens; identical to SEQ ID NO: 212896

SEQ ID NO: 266145 - RNA, 64 nt, Homo Sapiens; identical to SEQ ID NO: 212897

SEQ ID NO: 266146 - RNA, 64 nt, Homo Sapiens; identical to SEQ ID NO: 212898

SEQ ID NO: 266147 - RNA, 64 nt, Homo Sapiens; identical to SEQ ID NO: 212899

SEQ ID NO: 266148 - RNA, 64 nt, Homo Sapiens; identical to SEQ ID NO: 212900

SEQ ID NO: 266149 - RNA, 64 nt, Homo Sapiens; identical to SEQ ID NO: 212901

SEQ ID NO: 266150 - RNA, 64 nt, Homo Sapiens; identical to SEQ ID NO: 212902

SEQ ID NO: 266151 - RNA, 64 nt, Homo Sapiens; identical to SEQ ID NO: 212903

SEQ ID NO: 266152 - RNA, 64 nt, Homo Sapiens; identical to SEQ ID NO: 212904

SEQ ID NO: 266153 - RNA, 64 nt, Homo Sapiens; identical to SEQ ID NO: 212905

SEQ ID NO: 266154 - RNA, 64 nt, Homo Sapiens; identical to SEQ ID NO: 212906

SEQ ID NO: 266155 - RNA, 64 nt, Homo Sapiens; identical to SEQ ID NO: 212907

SEQ ID NO: 266156 - RNA, 64 nt, Homo Sapiens; identical to SEQ ID NO: 212908

SEQ ID NO: 266157 - RNA, 64 nt, Homo Sapiens; identical to SEQ ID NO: 212909

SEQ ID NO: 266158 - RNA, 64 nt, Homo Sapiens; identical to SEQ ID NO: 212910

SEQ ID NO: 266159 - RNA, 64 nt, Homo Sapiens; identical to SEQ ID NO: 212911

SEQ ID NO: 266160 - RNA, 64 nt, Homo Sapiens; identical to SEQ ID NO: 164705

SEQ ID NO: 266161 - RNA, 64 nt, Homo Sapiens; identical to SEQ ID NO: 164706

SEQ ID NO: 266162 - RNA, 64 nt, Homo Sapiens; identical to SEQ ID NO: 172749

SEQ ID NO: 266163 - RNA, 64 nt, Homo Sapiens; identical to SEQ ID NO: 172750

SEQ ID NO: 266164 - RNA, 64 nt, Homo Sapiens; identical to SEQ ID NO: 172751

SEQ ID NO: 266165 - RNA, 64 nt, Homo Sapiens; identical to SEQ ID NO: 172752

SEQ ID NO: 266166 - RNA, 64 nt, Homo Sapiens; identical to SEQ ID NO: 172753

SEQ ID NO: 266167 - RNA, 64 nt, Homo Sapiens; identical to SEQ ID NO: 172754

SEQ ID NO: 266168 - RNA, 64 nt, Homo Sapiens; identical to SEQ ID NO: 172755

SEQ ID NO: 266169 - RNA, 64 nt, Homo Sapiens; identical to SEQ ID NO: 172756

SEQ ID NO: 266170 - RNA, 64 nt, Homo Sapiens; identical to SEQ ID NO: 172757

SEQ ID NO: 266171 - RNA, 64 nt, Homo Sapiens
guuagguggccuuaaguucucaguaaugacacuuaucaaauaggaacuuaguguuacucaccuu

SEQ ID NO: 266172 - RNA, 64 nt, Homo Sapiens
aauugccuuugcuauaucccuaugagaugagcagaucaaauauuccccgugaguuaaugaaaac

SEQ ID NO: 266173 - RNA, 51 nt, Homo Sapiens
cugaaagagauugcuaauaaaaucaaauaaaacuguaugaacucuaaugga

SEQ ID NO: 266174 - RNA, 64 nt, Homo Sapiens
uacuuuuuauguaagcuuuuucacuuaguauuuuaucaaauauguuuuuauuauauucauagcc

SEQ ID NO: 266175 - RNA, 64 nt, Homo Sapiens
uugcuuuugggucuucuccacaguauaagaaagaaucaaauaucuggauuguuagggauuucag

SEQ ID NO: 266176 - RNA, 64 nt, Homo Sapiens
gaucuucuuuugcuaacauaaguauuuuuuuaguaucaaauaguaauuuagaagcucuccagug

SEQ ID NO: 266177 - RNA, 64 nt, Homo Sapiens
acgcuauagcagaguaaauaaagccacuagaauuaucaaauaugguuuuuacaaaacauuauuc

SEQ ID NO: 266178 - RNA, 64 nt, Homo Sapiens
uucuuaucucagacuuacguuuccaaacagugccaucaaauauguuuuuaauaaggacaccucu

SEQ ID NO: 266179 - RNA, 64 nt, Homo Sapiens
uuauucacuuuucauguggcgacaggcccaucauaucaaauaaccagagacucacucaggaagu

SEQ ID NO: 266180 - RNA, 64 nt, Homo Sapiens
uaagucaagcagaggacuucuucaagaagguaacaucaaauaaaguaacuggggugcaaaccuc

SEQ ID NO: 266181 - RNA, 64 nt, Homo Sapiens
aaagcugugauuauaucaaaaauccagauaaaucaucaaauauaucagauuaagaccaggguuu

SEQ ID NO: 266182 - RNA, 64 nt, Homo Sapiens
gccaguuuaagugcuuuguguugaugccaugcuuaucaaauacaugcacaagcuaaacauaauu

SEQ ID NO: 266183 - RNA, 64 nt, Homo Sapiens
uaaugcuggaauacucaagauguauuuuacucugaucaaauaaacaguuuguagugaugggaag

SEQ ID NO: 266184 - RNA, 64 nt, Homo Sapiens
aaucaaucaaucagcauauacuggauauguacuaaucaaauaauaugucaaaaucugaauauau

SEQ ID NO: 266185 - RNA, 64 nt, Homo Sapiens
aggagaaaccuccaaaaccaguaaugccgcugucaucaaauauguuucuguuuuauuacagcug

SEQ ID NO: 266186 - RNA, 64 nt, Homo Sapiens
gaaacagcagucacuucuagucuuguuauuuaauaucaaauaauauacuucaucacuaaagaau

SEQ ID NO: 266187 - RNA, 64 nt, Homo Sapiens
ucaucacuaaagaauucuuguggguauggaaugaaucaaauacuuuugauauuuagcuugagaa

SEQ ID NO: 266188 - RNA, 64 nt, Homo Sapiens
agauuuuuaaaauuucuugaugugguuuguaauaaucaaauauugacaagaaccuuaggucucg

SEQ ID NO: 266189 - RNA, 64 nt, Homo Sapiens
uguuacuucauacuggaacuuuuaaaaagauuucaucaaauaaaguuuuguuuucuacuuuuaa

SEQ ID NO: 266190 - RNA, 64 nt, Homo Sapiens
uugucaaccuuuucugcacaaggaguccuauaaaaucaaauacaggagguugugguaacuaaau

SEQ ID NO: 266191 - RNA, 64 nt, Homo Sapiens
ucuucauaauggucacagucuuucuuccuuuaccaucaaauacuuucuucuggucaccagauga

SEQ ID NO: 266192 - RNA, 64 nt, Homo Sapiens
ucccaggaauucaagguugguucaacaucuaaaaaucaaauaagcuaauauacagucaguucuc

SEQ ID NO: 266193 - RNA, 64 nt, Homo Sapiens
gguuaggaauucaagguuuguucaacaucuaaaaaucaaauaagcuaauaaagaaaagagguuu

SEQ ID NO: 266194 - RNA, 64 nt, Homo Sapiens
aggccucccaggugggggaacugcuugggccuugcugagccaggguccucagggugaagcagga

SEQ ID NO: 266195 - RNA, 64 nt, Homo Sapiens
cccugccccauccccuuugagugucagaagcacucugagccaaggggacagggggcacgugcac

SEQ ID NO: 266196 - RNA, 64 nt, Homo Sapiens
cgccccugguggucacaggcugugccuugguuuccugagccaccuuuacucugcucuaugccag

SEQ ID NO: 266197 - RNA, 64 nt, Homo Sapiens
agggggcgugccugccaagcucacacagcaggaacugagccagaaacgcagauugggcuggcuc

SEQ ID NO: 266198 - RNA, 64 nt, Homo Sapiens
uucucagaggauuauguaaccccugcaguggaaacugagccagcuaacuuaaaaagcugccuua

SEQ ID NO: 266199 - RNA, 64 nt, Homo Sapiens
auuuauuagauucguaggucauauuacuuaucaacugagccaaaugucugugugcaauuguguu

SEQ ID NO: 266200 - RNA, 64 nt, Homo Sapiens
gcggccccucagccugccuggaaguucaccagcccugagccaugccauggggguuuggggcuaa

SEQ ID NO: 266201 - RNA, 64 nt, Homo Sapiens
gggguuuggggcuaagaaguaucggaagagagggcugagccaugcaggcccugcccagccagcc

SEQ ID NO: 266202 - RNA, 64 nt, Homo Sapiens
ugaaaugagccaccgugaacuuuggucauaaacccugagccagaucccuggaacauccugucag

SEQ ID NO: 266203 - RNA, 64 nt, Homo Sapiens
cucuccccuccucugcccugggugcuucaggacucugagccauugauacugaucugaaggaggu

SEQ ID NO: 266204 - RNA, 64 nt, Homo Sapiens
ugucuuccacuguaucuacucagugggcugccagcugagccaccugcgaccuccaccaccccug

SEQ ID NO: 266205 - RNA, 64 nt, Homo Sapiens
ccccucaggcccggcauggguuggauacuaaagucugagccagguggucaaggcagcagucccc

SEQ ID NO: 266206 - RNA, 64 nt, Homo Sapiens
uacaggacacccccagccugauuaaugcuggaggcugagccaaguggggccauuaggcagccua

SEQ ID NO: 266207 - RNA, 64 nt, Homo Sapiens
guucccccagggaacucagugaggccaacugacucugagccaggaccagcccucugccuccagg

SEQ ID NO: 266208 - RNA, 64 nt, Homo Sapiens
ccagaguaugcgacggacagaggaacuaaucuaccugagccagaagauugaguuugagugcaaa

SEQ ID NO: 266209 - RNA, 64 nt, Homo Sapiens
cuuucaucauuaaaaaaagggggaccauuggggccugagccaaggaacuuuccuucuacugccu

SEQ ID NO: 266210 - RNA, 64 nt, Homo Sapiens
acccuggacuggcccagucuggugauucucugcccugagccaccuugagccacgcugucuggug

SEQ ID NO: 266211 - RNA, 64 nt, Homo Sapiens
gcugcugacugacuccagcccccaagccuaugcccugagccaugcuggucacugccucaggacc

SEQ ID NO: 266212 - RNA, 64 nt, Homo Sapiens
uauaccuuugaaauauuaaagcuccuugucaauacugagccauuaccuaguucagauacagggu

SEQ ID NO: 266213 - RNA, 64 nt, Homo Sapiens
auuuccugggagaaagaccacagcaucgugaucacugagccaucgcuugaaugugaagcaaaca

SEQ ID NO: 266214 - RNA, 64 nt, Homo Sapiens
aggagacauuagugaauuggagcuuuagccuguucugagccauugggagggguuaucugggaga

SEQ ID NO: 266215 - RNA, 64 nt, Homo Sapiens
gauucagauggcacaggaagcauaagaucugauccugagccagaaugcccaccagagauguggu

SEQ ID NO: 266216 - RNA, 64 nt, Homo Sapiens
cccuuucacccuccucuaccggaagaagcgggcucugagccacgcucccaggauacgcccgagc

SEQ ID NO: 266217 - RNA, 64 nt, Homo Sapiens
gugaguuggucaaaugcucccugcguaagggacccugagccacaccacugguuuccccaacagg

SEQ ID NO: 266218 - RNA, 64 nt, Homo Sapiens
aucacuucugaggagcagaguugagggagccgagcugagccacgcugggaggccagagccuuuc

SEQ ID NO: 266219 - RNA, 64 nt, Homo Sapiens
gcaggauccucagccauguucaagugaaguaagccugagccagugcguggacuggugccacggg

SEQ ID NO: 266220 - RNA, 64 nt, Homo Sapiens
ccucucuucugcacagcuccuccccugcuaccugcugagccagauuccccaggaaucuugaaug

SEQ ID NO: 266221 - RNA, 64 nt, Homo Sapiens
uuuaccucuucuucuccaaaggaucuuuguuccucugagccaagacugagguaaauaaagccac

SEQ ID NO: 266222 - RNA, 64 nt, Homo Sapiens
ugcaauaagaacauagauccugucccuagacgggcugagccauggaccaucuggucuugguaga

SEQ ID NO: 266223 - RNA, 64 nt, Homo Sapiens
gugauggacuguauauuugauuuggugacaugcacugagccaaguaugaaaucccuggagaauu

SEQ ID NO: 266224 - RNA, 64 nt, Homo Sapiens
accacacguccauccugggaccauggaggcagcacugagccagcagaauggauggacagacagg

SEQ ID NO: 266225 - RNA, 64 nt, Homo Sapiens
ggcagaauggauggacagacgccuggagccagcccugagccagacgacacacagggagacgggg

SEQ ID NO: 266226 - RNA, 64 nt, Homo Sapiens
accucaccuuguugguaccucccucccuggaucucugagccagcagccaggaggaccugaccca

SEQ ID NO: 266227 - RNA, 64 nt, Homo Sapiens
ccccggucagcacagugccuuuuccucuccugcucugagccaggguggggcauucccucuagau

SEQ ID NO: 266228 - RNA, 64 nt, Homo Sapiens
agugaauggcccuuccuuaguguucuagaaacuucugagccaggggcgggcacuuucaccaaga

SEQ ID NO: 266229 - RNA, 64 nt, Homo Sapiens
gccuucacggaccucccuaguuaccccugcugcccugagccaacccccauucccagggcacucc

SEQ ID NO: 266230 - RNA, 64 nt, Homo Sapiens
cacauugacuuucuguugagguaccuuggagaagcugagccauucugaggacaucuggcugugu

SEQ ID NO: 266231 - RNA, 64 nt, Homo Sapiens
acugccuugggucaguccagcccccuccacaucacugagccaucaaugagcugagagaucaaug

SEQ ID NO: 266232 - RNA, 64 nt, Homo Sapiens
cgcaggggcucugagcccgggccacgcaggggcccugagccaaaagagggggagaaugagaagg

SEQ ID NO: 266233 - RNA, 64 nt, Homo Sapiens
cagccccuccagucguuauuucuguuuguuuaagcugagccacggauaccgccacggguuuccc

SEQ ID NO: 266234 - RNA, 64 nt, Homo Sapiens
gcuuggaacccaauaccuaggcuuacaggccauccugagccaggggccucuggaaauucucuuc

SEQ ID NO: 266235 - RNA, 64 nt, Homo Sapiens
gagcuggauguuccccagcuggcaguugagcugccugagccaaugugucugucuuugguaacug

SEQ ID NO: 266236 - RNA, 64 nt, Homo Sapiens
acuggauguccagagcuggccaggccacugggcccugagccagagacaaggucaccugggcugu

SEQ ID NO: 266237 - RNA, 64 nt, Homo Sapiens
gaaucccgacucugauaccuucuggcugugcuaccugagccaagucgccuccccucucugggcu

SEQ ID NO: 266238 - RNA, 64 nt, Homo Sapiens
ccacucauucacccaaccucaggguucuccccaucugagccagccugcuggugugacuuacuca

SEQ ID NO: 266239 - RNA, 64 nt, Homo Sapiens
acucauccuccauuccucugcacuugcagacuuucugagccaggguuuucuuuuaguggaaaca

SEQ ID NO: 266240 - RNA, 64 nt, Homo Sapiens
gcgaugugcaccuguagucccagcuacucgggggcugagccaggcggauagcuugagcucaggg

SEQ ID NO: 266241 - RNA, 64 nt, Homo Sapiens
caccccguaccacuguugaugugaagcaccucuucugagccaggccgagccccuggccgacuug

SEQ ID NO: 266242 - RNA, 64 nt, Homo Sapiens
cuucuggcugggacugacuuggccauguucucagcugagccacgcggcugguagugcagccuuc

SEQ ID NO: 266243 - RNA, 64 nt, Homo Sapiens
cccaagggauuucuggcucaggcuguaaaaguagcugagccauccugcccauuccuggaggucc

SEQ ID NO: 266244 - RNA, 64 nt, Homo Sapiens
ccuggugauuucaaugauggcauccaggaauuagcugagccaacagaccauguggacagcuuug

SEQ ID NO: 266245 - RNA, 64 nt, Homo Sapiens
acugcugaccugccuagcgagcaggacaucccuucugagccaucugcugcucucucauuucauc

SEQ ID NO: 266246 - RNA, 64 nt, Homo Sapiens
ugaagcagggugguccugcguccacuucccaagccugagccaagcucaucuucauugaaugucu

SEQ ID NO: 266247 - RNA, 64 nt, Homo Sapiens
gcaccuccuguuggagggguggagggauguuccccugagccaggcugagacuagaaccccaucu

SEQ ID NO: 266248 - RNA, 64 nt, Homo Sapiens
ccugagccaggcugagacuagaaccccaucuucccugagccaggcugagacuagaaccccaucu

SEQ ID NO: 266249 - RNA, 64 nt, Homo Sapiens
cggugggcugaggcaggggccgcugucgucaggccugagccagggugagcuggugccugccuug

SEQ ID NO: 266250 - RNA, 64 nt, Homo Sapiens
gccacacaaucaguggggcagccagagcucagaccugagccauuuugucaguauccaggacccc

SEQ ID NO: 266251 - RNA, 64 nt, Homo Sapiens
gugggaaacccguuguuccucccgucuucagaugcugagccaacugcuuggacagcagccagcg

SEQ ID NO: 266252 - RNA, 64 nt, Homo Sapiens
cacagaugucuuaaaagacuagaauccacacuuccugagccagaggggccguguugacgguaau

SEQ ID NO: 266253 - RNA, 64 nt, Homo Sapiens
auugcucaauacagcaaauuauucaucgauaccauuauucaaauauguauaauguauuuauaau

SEQ ID NO: 266254 - RNA, 64 nt, Homo Sapiens
acauugcuguguucucuuucauagcaguuuguuuuuauucaaaguacaucauugaagacaaggg

SEQ ID NO: 266255 - RNA, 64 nt, Homo Sapiens
ccuuccaguugucuugaacaggacucacuggauguuauucaacuguagagccugaagucuugca

SEQ ID NO: 266256 - RNA, 64 nt, Homo Sapiens
ccuucaguuuaucuuggacuucacuggauagauguuauucaacuagccugaagucuugcaggac

SEQ ID NO: 266257 - RNA, 64 nt, Homo Sapiens
aauuuaaaggauggaaauuuaucauguuuaaaaauuauucaagcacucuuaaaaccacuuaaac

SEQ ID NO: 266258 - RNA, 64 nt, Homo Sapiens
guucacgagaaacauaggcuuuucaaaaaaauuuuuauucaaggcaaagcaaggaacaucuuga

SEQ ID NO: 266259 - RNA, 64 nt, Homo Sapiens
ucugucauauaauaucuauugcauauaugucuauuuauucaauaagaucuuugcgaauuacaau

SEQ ID NO: 266260 - RNA, 64 nt, Homo Sapiens
ugucauuacuguagugaacacuugcuacguuccguuauucaauuaaaaugacucaauaaaauga

SEQ ID NO: 266261 - RNA, 64 nt, Homo Sapiens
uugucuuaagauggaaauacaguuauuucaucuuuuauucaaggaaguuuuaacuuuaauacag

SEQ ID NO: 266262 - RNA, 64 nt, Homo Sapiens
guuuuuaaaaagaguaauuucauuuaaauaucuguuauucaaauuugaugauguuaaauguaau

SEQ ID NO: 266263 - RNA, 64 nt, Homo Sapiens
cuuuaacuaaauuaagauugcagaaugauagugauuauucaauuagauuuuaaguaaggauugu

SEQ ID NO: 266264 - RNA, 64 nt, Homo Sapiens
guuaaaaaugggugucucuguacuaguauuguauuuauucaauugaacuuguauucugauuucu

SEQ ID NO: 266265 - RNA, 64 nt, Homo Sapiens
caaggaacauauuguuaacuccugauucuuaacuuuauucaacuggacucagaauuguagggau

SEQ ID NO: 266266 - RNA, 64 nt, Homo Sapiens
aaugaauuuucuaucucuaggcaacaugucuuuauuauucaagcugaauguuuaagagagauuu

SEQ ID NO: 266267 - RNA, 64 nt, Homo Sapiens
aauaccaucagcauucugcuuuaaagcucauguuuuauucaaagcacaaggacgguuauaacuc

SEQ ID NO: 266268 - RNA, 64 nt, Homo Sapiens
uuuugauguacuuucugauuccaggauuggauauuuauucaaggacuauuuuaaaaauagaaag

SEQ ID NO: 266269 - RNA, 64 nt, Homo Sapiens
guuucaaaauucaaagcauuagcauucaaacauuuuauucaaguagaggaggaauuuuauucaa

SEQ ID NO: 266270 - RNA, 64 nt, Homo Sapiens
cauucaaacauuuuauucaaaaagaggaggaauuuuauucaaagcuaaaauaagguuuacucug

SEQ ID NO: 266271 - RNA, 64 nt, Homo Sapiens
gcaaaguauuaaaaauuucuaaacugcucucugauuauucaagaauguaaaacuuuacuaagcu

SEQ ID NO: 266272 - RNA, 64 nt, Homo Sapiens
uggucugugcugacacuaagucucugggagauuuuuauucaaauaaaauacauauuuccaccuc

SEQ ID NO: 266273 - RNA, 64 nt, Homo Sapiens
ucuugaauaaaucuguuauuuuaagaauaucacauuauucaaugcauauaaaacuaucagaagu

SEQ ID NO: 266274 - RNA, 64 nt, Homo Sapiens
aagaggaaagacaagugucguauuucgauccuguuuauucaaaugugugauuuugcugaaauga

SEQ ID NO: 266275 - RNA, 64 nt, Homo Sapiens
uuugacaaucagagcacuggccuuucacugagcuuuauucaaauaagucauuaauuacuguccu

SEQ ID NO: 266276 - RNA, 64 nt, Homo Sapiens
cuuuuugaacugacugaauucuuuccaaguuuaauuauucaaaacuuuggcuuuauugcaguga

SEQ ID NO: 266277 - RNA, 64 nt, Homo Sapiens
uagucuguaagcuccuuaagaguaggguugugccuuauucaacugcauacauagcuccuagcac

SEQ ID NO: 266278 - RNA, 64 nt, Homo Sapiens
uaucuuuaaagauaucauauuuuauguauguagcuuauucaaagaaguguuuccuauuucuaua

SEQ ID NO: 266279 - RNA, 64 nt, Homo Sapiens
cuauagaacucauacuaauguuguuauucaacauuuauucaacagauuguaaaaaagcuuuucu

SEQ ID NO: 266280 - RNA, 64 nt, Homo Sapiens
uuuauucaacacuauagaacaaagcuuuucuuuguuauucaacaaugaauguaaagauuguaaa

SEQ ID NO: 266281 - RNA, 64 nt, Homo Sapiens
acagguccugcuucccacuauccuuuuccuguuauuauucaaauuuuacacaaggacuaauccu

SEQ ID NO: 266282 - RNA, 64 nt, Homo Sapiens
ucucccauacaagaugacccucugagcuuuucauuuauucaagcucugugguacagccuuuuuu

SEQ ID NO: 266283 - RNA, 64 nt, Homo Sapiens
guggugagcacaucugggaggcuggucucccuccagcuggaauugcugcucucugagggagagg

SEQ ID NO: 266284 - RNA, 64 nt, Homo Sapiens
ggugaugaugaccaagaauuacaaguagaauggcagcuggaauuuaaggagggacaagaaucaa

SEQ ID NO: 266285 - RNA, 64 nt, Homo Sapiens
aucugcuucauuuuagaaccuuuauaaaagcaauagcuggaauauacucccaguuuuaaaauaa

SEQ ID NO: 266286 - RNA, 64 nt, Homo Sapiens
uuuuguuuuaacugaaucauuuuuuaacuuaaaaagcuggaaaauaucaaaugcuguuuuuuuu

SEQ ID NO: 266287 - RNA, 64 nt, Homo Sapiens
aucccaucuagauuucuucuugcuuuugacucacagcuggaaguuagaaaagccucgauuucau

SEQ ID NO: 266288 - RNA, 64 nt, Homo Sapiens
acucaagcaauucuucuacccuggccucccaaguagcuggaauuacaggugugcgccaucacaa

SEQ ID NO: 266289 - RNA, 64 nt, Homo Sapiens
aggaagaaacuuuuuuuccuucuuuuccaggaguagcuggaaauuaagaucggguuccuuuucu

SEQ ID NO: 266290 - RNA, 64 nt, Homo Sapiens
gucauaagagcauagauuuuuuguuuuucacaacagcuggaauaaguuccugcauuauaaguau

SEQ ID NO: 266291 - RNA, 64 nt, Homo Sapiens
uguuugagcuuucaugaguuucccagagagacauagcuggaaaauuccuauugauuuucucuaa

SEQ ID NO: 266292 - RNA, 64 nt, Homo Sapiens
ccaugagcaauucuccugccucagccucccaaguagcuggaacuacaggcucaugccacugcgc

SEQ ID NO: 266293 - RNA, 64 nt, Homo Sapiens
ugugugcaugcucuagacaccaccucgcuggagaagcuggaagggcuguugucuucccaggucu

SEQ ID NO: 266294 - RNA, 64 nt, Homo Sapiens
uugugugugagggcaggucuugacucuaggucucagcuggaaccccacccuuucuccuccuccu

SEQ ID NO: 266295 - RNA, 64 nt, Homo Sapiens
augggugguaauccccacuuugugugagaaggaaagcuggaaucuuuuaguaagucagacccca

SEQ ID NO: 266296 - RNA, 64 nt, Homo Sapiens
uaaggguucuugaaacagcaaauguguagagcagagcuggaaaagcuggggaggauuugguagc

SEQ ID NO: 266297 - RNA, 64 nt, Homo Sapiens
cacuccuuuuuuucccauugcuucccauuucuagagcuggaaccccaaggguggaaacuugccc

SEQ ID NO: 266298 - RNA, 64 nt, Homo Sapiens
gcccuuauuuccacccucacgcaacacagccaaaagcuggaauccacaccaucaaugauccaga

SEQ ID NO: 266299 - RNA, 64 nt, Homo Sapiens
ggucccggugagauggagugggucacaccuggcaagcuggaagaaaguucccuggggaugggag

SEQ ID NO: 266300 - RNA, 64 nt, Homo Sapiens
ugcugugaccuccgagcccuccuggugggaagacagcuggaaaggcugggaggagaagggaggg

SEQ ID NO: 266301 - RNA, 64 nt, Homo Sapiens
gucaaggauaaaacaagcacgcgcacaaucaaggagcuggaacacacucuccaggccgucaaau

SEQ ID NO: 266302 - RNA, 64 nt, Homo Sapiens
augauuugacaguguccaaacugagacauucuggagcuggaaagccugucacacuagagugugu

SEQ ID NO: 266303 - RNA, 64 nt, Homo Sapiens
agguuguuggguuuugagcaguacuuauauuaacagcuggaaaucuuacuuuuagugacuuuau

SEQ ID NO: 266304 - RNA, 64 nt, Homo Sapiens
uauucacuuccgagauucaggcugauaauuuguuagcuggaacccugcuuccacuuacaggaga

SEQ ID NO: 266305 - RNA, 64 nt, Homo Sapiens
ucaggagagucacagggcuugacaccugacucugagcuggaacaguaggggcagggagaagaca

SEQ ID NO: 266306 - RNA, 64 nt, Homo Sapiens
ucuacuugaucuggagggcauugacaccuggcucagcuggaacaguggggacaggaggaggcag

SEQ ID NO: 266307 - RNA, 64 nt, Homo Sapiens
aaggcagccuggaauguguugacaaauaaaauuuagcuggaacguagacgucugucaaaaaucc

SEQ ID NO: 266308 - RNA, 64 nt, Homo Sapiens
ggaagaccccuuuuccccucaagacagaauuugaagcuggaaagcacuccugcccccugaccag

SEQ ID NO: 266309 - RNA, 64 nt, Homo Sapiens
gggcaacccugagcagcagggggcagugagagagagcuggaaagaccaggccaugggacuuugg

SEQ ID NO: 266310 - RNA, 64 nt, Homo Sapiens
uaggggaugggggugcccacccaagccaucccacagcuggaaggaccucaaagaugcccccugu

SEQ ID NO: 266311 - RNA, 64 nt, Homo Sapiens
aagcagucaguacccucccagggcgggacugaagagcuggaagaauucccuucguccugcccaa

SEQ ID NO: 266312 - RNA, 64 nt, Homo Sapiens
agcuuucucuucuuuacauuucccaugugcuucuagcuggaagguguuuccauccuagaagcag

SEQ ID NO: 266313 - RNA, 64 nt, Homo Sapiens
ucaccugcaggugccaaagagaugucaggucaggagcuggaaguagagcaagccuguguguggg

SEQ ID NO: 266314 - RNA, 64 nt, Homo Sapiens
caaggggcuaccuaccgagacucgucugcccucaagcuggaaaacaggcugugcuuggaucaug

SEQ ID NO: 266315 - RNA, 64 nt, Homo Sapiens
ccaaggccaaguccugcagguaaaaagcagcagcagcuggaauugaagaccagcaggggcuucc

SEQ ID NO: 266316 - RNA, 64 nt, Homo Sapiens
ugaagguaauggcuccucucagaaccccaucuccagcuggaacgcuguugcuaugacaacaggg

SEQ ID NO: 266317 - RNA, 64 nt, Homo Sapiens
ugaggcuugccuggacuacauaaaaauaaacuugagcuggaauuaaacuugcucaacuaauccu

SEQ ID NO: 266318 - RNA, 64 nt, Homo Sapiens
acaggugugugccaucacacucagccuccccaguagcuggaacuuucaagccaucccuccugcc

SEQ ID NO: 266319 - RNA, 64 nt, Homo Sapiens
uaagagaaagucaccugcccaugcucaagcccccagcuggaaguuagcaauuccccuacaucaa

SEQ ID NO: 266320 - RNA, 64 nt, Homo Sapiens
uaagaaaaagucgcccgaaaggccccucacccccagcuggaaauagaaggcacuaagcuuccug

SEQ ID NO: 266321 - RNA, 64 nt, Homo Sapiens
gcacggaguguggaagggggucuaggagagggagagcuggaaaaggagcugauggggucuuauc

SEQ ID NO: 266322 - RNA, 64 nt, Homo Sapiens
acuuucuuucucccuauguggaagacaccagauuagcuggaauucugccaccuuccuuugugcc

SEQ ID NO: 266323 - RNA, 64 nt, Homo Sapiens
ccaggugcagugucucacccuuucagcauaguaaagcuggaagggaggggaggaagaaaguugu

SEQ ID NO: 266324 - RNA, 64 nt, Homo Sapiens
guuuauggagaccuucaaggccugccuccagacgagcuggaaaaaagcacuucaucggagacuu

SEQ ID NO: 266325 - RNA, 64 nt, Homo Sapiens
guccugaguaaauguguucuguauaaacaaaugcagcuggaaucgcucaagaaucuuauuuuuc

SEQ ID NO: 266326 - RNA, 64 nt, Homo Sapiens
gaauggaaauucuuaaagggaaugaugugauucaagcuggaaagaggguugggagaaacagcuu

SEQ ID NO: 266327 - RNA, 64 nt, Homo Sapiens
acgacugagccuuccugccuccagccuggcuucuagcuggaagccagcccagcguuucucuacc

SEQ ID NO: 266328 - RNA, 64 nt, Homo Sapiens
ucugugaaccaccuuuuccagccagaguucccaaagcuggaacgcuagcugccugcucuuccuu

SEQ ID NO: 266329 - RNA, 64 nt, Homo Sapiens
cgaucagcaucaagggcuuugguuuucaugaaaaagcuggaaagcaaaguauuuaaauuuccua

SEQ ID NO: 266330 - RNA, 64 nt, Homo Sapiens
aggacugucccaacaacaguuuuucccacuguuaagcuggaaugcuggacugggcuaaauuuag

SEQ ID NO: 266331 - RNA, 64 nt, Homo Sapiens
aucuaaggcuguuugcuucauaaagauagagucauugcuguaggugugaggagccccaucuguc

SEQ ID NO: 266332 - RNA, 64 nt, Homo Sapiens
augucuguuugcugauggucuuagagggauuucuuugcuguaagcugugcauucuccuggaugc

SEQ ID NO: 266333 - RNA, 64 nt, Homo Sapiens
agggcuuccuccccagagguuugccgacuugauguugcuguacccacaggucagcuccugaucc

SEQ ID NO: 266334 - RNA, 64 nt, Homo Sapiens
auuucuuauccccugagagcuguuucguuucccauugcuguagcggaauacgagcuucugggua

SEQ ID NO: 266335 - RNA, 64 nt, Homo Sapiens
gcuugaaaaggcguugguauugaacauacuggcuuugcuguaauagcugggugucacuuggcuc

SEQ ID NO: 266336 - RNA, 64 nt, Homo Sapiens
ucuggaaauuugauagacuuuuagagggcacauuuugcuguaaaacugaagaauguacacuuuu

SEQ ID NO: 266337 - RNA, 64 nt, Homo Sapiens
agauggcacuuauaaccaaacuuaagacgugauuuugcuguagacguggaacguuuuuccuguu

SEQ ID NO: 266338 - RNA, 64 nt, Homo Sapiens
ucucgugguaggacuguagaggccaaguucuuaguugcuguaugugugucuaggcaggaccugu

SEQ ID NO: 266339 - RNA, 64 nt, Homo Sapiens
aguauguucuaaauauuugucugcuguagucuauuugcuguauaugcugaaauuuuuguaugcc

SEQ ID NO: 266340 - RNA, 64 nt, Homo Sapiens
uuagaugacucuuauuccuguaguaauauucaauuugcuguaccugcuuggugguuagaaggag

SEQ ID NO: 266341 - RNA, 64 nt, Homo Sapiens
cuguagcuauaguuguuaugugauuguuuuuuaauugcuguaggauccuguucuuucagcaggu

SEQ ID NO: 266342 - RNA, 64 nt, Homo Sapiens
uaugcuuauuuuauuauuacugcaguaguugacuuugcuguauggaaaaauaaagugaaauugc

SEQ ID NO: 266343 - RNA, 64 nt, Homo Sapiens
uuuugcugcccauccuguuaucuguuuucauucuuugcuguaccaugcuguuuguaaccaugca

SEQ ID NO: 266344 - RNA, 64 nt, Homo Sapiens
ugcugcccucugccgccuuuugaguaagaaagucuugcuguaaaccucuugucuugaaacaguu

SEQ ID NO: 266345 - RNA, 64 nt, Homo Sapiens
aauaggauggcgaguuugugcagauaccauugaauugcuguaaauuggaguaggcacugcauag

SEQ ID NO: 266346 - RNA, 64 nt, Homo Sapiens
uuacaucaugcgcaguggaaaugaauaauuuuuuuugcuguaagcaugugauaugaaaagaagc

SEQ ID NO: 266347 - RNA, 64 nt, Homo Sapiens
uucuuuguauucuucuucgucuauauuugucaguuugcuguacauguacuccaagcugcaggau

SEQ ID NO: 266348 - RNA, 64 nt, Homo Sapiens
aaaucauuuguaauagcauagugcuuuuuacucauugcuguaucuuuuucugaaaacacuguug

SEQ ID NO: 266349 - RNA, 64 nt, Homo Sapiens
aacacauaacaaagggcagcauuuugugggcugguugcuguagaagacagagaagguucuucuu

SEQ ID NO: 266350 - RNA, 64 nt, Homo Sapiens
uuagaaaauagggguuaagaccauguuucucacauugcuguauugcaacucgaacugcuuucgu

SEQ ID NO: 266351 - RNA, 64 nt, Homo Sapiens
auauucagcauuugauuucccuggaccuuuucccuugcuguacccccucaaagggagagaaaag

SEQ ID NO: 266352 - RNA, 64 nt, Homo Sapiens
uacagcacauauaaaauauguaaacaccagccuguugcuguacuuuucugcuuauuuuacagcc

SEQ ID NO: 266353 - RNA, 64 nt, Homo Sapiens
gaaaugagaaguauuauaauguaaaggccuuguuuugcuguagcaauaaaaugaccaagugcaa

SEQ ID NO: 266354 - RNA, 64 nt, Homo Sapiens
uuauaaagggugugauagaauuaaccacugaagauugcuguaaauauagauguacaguuuugcu

SEQ ID NO: 266355 - RNA, 64 nt, Homo Sapiens
ucauauuugaaguccuagucgaaauguggaaagcuugcuguaaugagucuuauuuuuauuuaua

SEQ ID NO: 266356 - RNA, 64 nt, Homo Sapiens
guauaugcaugcugauuuacuuguuaauacuauauugcuguaugcugagaucagugccuauggg

SEQ ID NO: 266357 - RNA, 64 nt, Homo Sapiens
guauauguaugcugauuuacuuguuaauacuguauugcuguaugcugagaucagugccucuggg

SEQ ID NO: 266358 - RNA, 64 nt, Homo Sapiens
gaaaaucgaugacaacaguccucuuacagauagcuugcuguauucuguauagcuuacucuaccu

SEQ ID NO: 266359 - RNA, 64 nt, Homo Sapiens
aaagaaugacaaaggaggcacucguucucuuuucuugcuguaugccuagaaagugguugaagga

SEQ ID NO: 266360 - RNA, 64 nt, Homo Sapiens
uuacuagcaugcuaugcugcaugcuuuacugccauugcuguaugcuuuacugucuuuguaaaaa

SEQ ID NO: 266361 - RNA, 64 nt, Homo Sapiens
uguauaggugagacucuguuucuguuauuuuuaauugcuguaugaaaugugaucagauuauuuu

SEQ ID NO: 266362 - RNA, 64 nt, Homo Sapiens
gacaguccugcuucagaagucuucuuaaggguccuugcuguauacauuguauguaccuuuauug

SEQ ID NO: 266363 - RNA, 64 nt, Homo Sapiens
uuacaguaaagcuaucuggacaccaggauaaacauugcuguaugcuguuuacagaagacucacu

SEQ ID NO: 266364 - RNA, 64 nt, Homo Sapiens
guucgguuuuauuuacaguugcuuuuacaaauauuugcuguaacauuugacuucuaagguuuag

SEQ ID NO: 266365 - RNA, 64 nt, Homo Sapiens
auucgaagcuuuuggucuauauuguuaauugccauugcuguaaaucuuaaaaugaaugaauaaa

SEQ ID NO: 266366 - RNA, 64 nt, Homo Sapiens
gaguugaagaguacuccacauggacgcaguagccuugcuguaggaguuugacucccuuauacug

SEQ ID NO: 266367 - RNA, 64 nt, Homo Sapiens
gauugucaucauaugauuacuccaucuucuguaauugcuguauauguuacuuaauguagcucaa

SEQ ID NO: 266368 - RNA, 64 nt, Homo Sapiens; identical to SEQ ID NO: 53273

SEQ ID NO: 266369 - RNA, 64 nt, Homo Sapiens; identical to SEQ ID NO: 53274

SEQ ID NO: 266370 - RNA, 64 nt, Homo Sapiens; identical to SEQ ID NO: 53275

SEQ ID NO: 266371 - RNA, 64 nt, Homo Sapiens; identical to SEQ ID NO: 53276

SEQ ID NO: 266372 - RNA, 64 nt, Homo Sapiens; identical to SEQ ID NO: 53277

SEQ ID NO: 266373 - RNA, 64 nt, Homo Sapiens; identical to SEQ ID NO: 53278

SEQ ID NO: 266374 - RNA, 64 nt, Homo Sapiens; identical to SEQ ID NO: 53279

SEQ ID NO: 266375 - RNA, 64 nt, Homo Sapiens; identical to SEQ ID NO: 53280

SEQ ID NO: 266376 - RNA, 64 nt, Homo Sapiens; identical to SEQ ID NO: 53281

SEQ ID NO: 266377 - RNA, 64 nt, Homo Sapiens; identical to SEQ ID NO: 53282

SEQ ID NO: 266378 - RNA, 64 nt, Homo Sapiens; identical to SEQ ID NO: 53283

SEQ ID NO: 266379 - RNA, 64 nt, Homo Sapiens; identical to SEQ ID NO: 53284

SEQ ID NO: 266380 - RNA, 64 nt, Homo Sapiens; identical to SEQ ID NO: 53285

SEQ ID NO: 266381 - RNA, 64 nt, Homo Sapiens; identical to SEQ ID NO: 53286

SEQ ID NO: 266382 - RNA, 64 nt, Homo Sapiens; identical to SEQ ID NO: 53287

SEQ ID NO: 266383 - RNA, 64 nt, Homo Sapiens; identical to SEQ ID NO: 53288

SEQ ID NO: 266384 - RNA, 64 nt, Homo Sapiens; identical to SEQ ID NO: 53289

SEQ ID NO: 266385 - RNA, 64 nt, Homo Sapiens; identical to SEQ ID NO: 53290

SEQ ID NO: 266386 - RNA, 64 nt, Homo Sapiens
gagaacagaagggcgucgggggaaccugccgcaaggagcagagacagcacagccccccgggccc

SEQ ID NO: 266387 - RNA, 64 nt, Homo Sapiens
ggacggauggagcccucagcgugucuuuucagcaggagcagaaccgaugagagccgcccuuacc

SEQ ID NO: 266388 - RNA, 64 nt, Homo Sapiens
cagauacagccccaaaccagggugcauggcuuggggagcagaguauaggauggauugcaguccc

SEQ ID NO: 266389 - RNA, 64 nt, Homo Sapiens
aagagaagcugagaagaagcugaggauccucacaggagcagacagagaaaugugaagggugggg

SEQ ID NO: 266390 - RNA, 64 nt, Homo Sapiens
ccacaguccuuccuggggcauuccaggcagagaaggagcagaggcucucccggcaggagcuggg

SEQ ID NO: 266391 - RNA, 64 nt, Homo Sapiens
ccccucagaacuggcuugaucaagggccuuauguggagcagagguugucucugaaccaggagag

SEQ ID NO: 266392 - RNA, 64 nt, Homo Sapiens
agugauagaaguucagaaagcucaccaaggucaaggagcagaucuucuaggaguagaucuuauu

SEQ ID NO: 266393 - RNA, 64 nt, Homo Sapiens
uuuaauuguagaucaagaagcuacucuagaagucggagcagaggaugguacagcagaggccgaa

SEQ ID NO: 266394 - RNA, 64 nt, Homo Sapiens
uaccggaguuacaaaagucacaggacguccagcaggagcagauccaggagcagcucauaugauc

SEQ ID NO: 266395 - RNA, 64 nt, Homo Sapiens
cccagucacugaccaacuaaggagagagcaugauggagcagaguaauggugcuggguggagaau

SEQ ID NO: 266396 - RNA, 64 nt, Homo Sapiens
agcuucugauggacaugggccucucuugccuugaggagcagaaagucugagugcacgaaaauuu

SEQ ID NO: 266397 - RNA, 64 nt, Homo Sapiens
uguauuaaauagccaugagcuucacugcuuagagggagcagaaaggucaacaucuaaaagcacc

SEQ ID NO: 266398 - RNA, 64 nt, Homo Sapiens
aaagaggaggagaaacagggugagucaagguaaaggagcagaaauguaguuacaagccaggucg

SEQ ID NO: 266399 - RNA, 64 nt, Homo Sapiens
cauuccccacaucccacugagcaugggaccauugggagcagagcugauauuaaagcauguuuag

SEQ ID NO: 266400 - RNA, 64 nt, Homo Sapiens
auccccaaaagucuuggccuaaaccaucccuaggggagcagauuaaccuaccacuacauugcac

SEQ ID NO: 266401 - RNA, 64 nt, Homo Sapiens
gccaagcagauagguuaugucccaugagaauuggggagcagaugagaaacgcacacaagguuug

SEQ ID NO: 266402 - RNA, 64 nt, Homo Sapiens
uagccagaaaugccuccugcugaagcauaguccaggagcagaguacuucuuggguaaucugacc

SEQ ID NO: 266403 - RNA, 64 nt, Homo Sapiens
ggugaccugauagcuccuguggcaucagguagagggagcagaguauggucuguuaaacagggcu

SEQ ID NO: 266404 - RNA, 64 nt, Homo Sapiens
uuggccuugugcccagcuggaagaugacucugggggagcagagccugcaccauugcugaaauga

SEQ ID NO: 266405 - RNA, 64 nt, Homo Sapiens
uccuagaagguuuuaggaauugaaaguucuuccuggagcagaugauugagaugaauuuuggugu

SEQ ID NO: 266406 - RNA, 64 nt, Homo Sapiens
ggguucccugggcccagucucucugggaaaaagaggagcagacacuuggcuagagaacucacag

SEQ ID NO: 266407 - RNA, 64 nt, Homo Sapiens
aacuggaaaaaacuuuaguccccuagauuuugagggagcagagaauaauuuucagauuuuuuuc

SEQ ID NO: 266408 - RNA, 64 nt, Homo Sapiens
uaagccuuaggugcugcccauaagaggauaaacuggagcagaaagcucaacugaauaagaggcu

SEQ ID NO: 266409 - RNA, 64 nt, Homo Sapiens
ccucacacugacacuuuguccccacaugggguggggagcagagugcccgccccguggagauacc

SEQ ID NO: 266410 - RNA, 64 nt, Homo Sapiens
ccgccuccgcaggaacccccaaagugcagauuccggagcagacacauccgggcggagagacuca

SEQ ID NO: 266411 - RNA, 64 nt, Homo Sapiens
aggaaaagacacugaggucuagaaauagcuccguggagcagaaucaguauugggagccgguggc

SEQ ID NO: 266412 - RNA, 64 nt, Homo Sapiens
gcaccagagcacgugauggucugagacucucuuaggagcagagcucugccgcaauggccaugug

SEQ ID NO: 266413 - RNA, 64 nt, Homo Sapiens
cgucuggcuggcuggccagccugugggucuguugggagcagaugugcucacugacguuugugcc

SEQ ID NO: 266414 - RNA, 64 nt, Homo Sapiens
gccccaucaccggccuucuccuggcaggagaggaggagcagagagcuggguccugggcugggau

SEQ ID NO: 266415 - RNA, 64 nt, Homo Sapiens
uuauaggaagacauaauuccagugccuuuaugguggagcagaauucgacaacacauguccauuc

SEQ ID NO: 266416 - RNA, 64 nt, Homo Sapiens
ucccuccuccccacguaccauugcgcgugcagcuggagcagaauacccucauuuuuaggaaucu

SEQ ID NO: 266417 - RNA, 64 nt, Homo Sapiens
aaaacucugcugauguucgggugagacauuuuugggagcagagguaggggaacaguucuaggga

SEQ ID NO: 266418 - RNA, 64 nt, Homo Sapiens
aauugcaauuuagcaggagggguaucaugaaacuggagcagaggcaucuugagaaauccuccuu

SEQ ID NO: 266419 - RNA, 64 nt, Homo Sapiens
agcgcugcuggccuggcagccccgggcuuucuccggagcagagcgagccugcggcccgggccag

SEQ ID NO: 266420 - RNA, 64 nt, Homo Sapiens
uugggucuggaucucccugggcucggcuaucuggggagcagauuggcaguucccaguccugugg

SEQ ID NO: 266421 - RNA, 64 nt, Homo Sapiens
uccgcugaggcagucuguccaugaucgugggcagggagcagagggccggcauguuuugggggua

SEQ ID NO: 266422 - RNA, 64 nt, Homo Sapiens
cuugccggcauguuuuggggcucugccgacgcagggagcagagaaagagagggcuuauaaaucc

SEQ ID NO: 266423 - RNA, 64 nt, Homo Sapiens
cagaccugggaugccccagucgccuuuggccacaggagcagaggggauagagaaggaucugcuc

SEQ ID NO: 266424 - RNA, 64 nt, Homo Sapiens
uugucuguggauggagacagcuuguccaucccuuggagcagauuguaggguccuaacagugcuc

SEQ ID NO: 266425 - RNA, 64 nt, Homo Sapiens
gcucuucgcuuuuaaugauaucuucucuaaccauauacgauaggagacguaggaaacucaauau

SEQ ID NO: 266426 - RNA, 64 nt, Homo Sapiens
ccacuugauggaguagaucugucacauuacuaagauacgauauuucuuuuuuuuuccgagacgg

SEQ ID NO: 266427 - RNA, 64 nt, Homo Sapiens
uaacuuuuuuuuaaguuacaaaagacuuuuuuuuauacgauaaacuccagcuaacacagaugua

SEQ ID NO: 266428 - RNA, 64 nt, Homo Sapiens
cugaaugucugaggcuaccaugccaacggugcuaauacgauaggcacaguacauuaacaaucca

SEQ ID NO: 266429 - RNA, 64 nt, Homo Sapiens
uuccaauuauuuaaccaguuacuuccaccuggacauacgauaggaaauucaaacucaaaauaug

SEQ ID NO: 266430 - RNA, 64 nt, Homo Sapiens
gcaagacauuuuauaacgauuucccucccacaccauacgauaaauugagaauguacuacgguac

SEQ ID NO: 266431 - RNA, 64 nt, Homo Sapiens
acaccauuuccuauaggagugguauuaagaauagauacgauauucaugucagguccggagggga

SEQ ID NO: 266432 - RNA, 64 nt, Homo Sapiens
aaacauaagaaaaacauuuaaaccuaugcugaaaauacgauaaaagaaaaacaacuccaauaug

SEQ ID NO: 266433 - RNA, 64 nt, Homo Sapiens
caugauacauaaugaaaaugguguguucaugccuauacgauaaacugccuggaaggggccgcgc

SEQ ID NO: 266434 - RNA, 64 nt, Homo Sapiens
cgacauugggacaugcugcucaagguaguuauauauacgauaaguuguauauaugaucacuggu

SEQ ID NO: 266435 - RNA, 64 nt, Homo Sapiens
cugaacaucacuccaauuauuaaugaaccaaaucauacgauaaguuacuguuugcauugaaaua

SEQ ID NO: 266436 - RNA, 64 nt, Homo Sapiens
cucauccugccuuagugugcaaucucauuugacuauacgauaaaguuugcacagucuuacuucu

SEQ ID NO: 266437 - RNA, 64 nt, Homo Sapiens
uacauaaucaguauauuuggaugucuguaccuugauacgauaguaaccuuguagcaugugaaga

SEQ ID NO: 266438 - RNA, 64 nt, Homo Sapiens
cuuaacaaaguucuuccccugggcaauguugcaaauacgauaaccgcugccagggcuggagccg

SEQ ID NO: 266439 - RNA, 64 nt, Homo Sapiens
auauugucuaauaauuaaaaauaaaaacuuuaauauacgauauguuaaaaauucuuacuaagga

SEQ ID NO: 266440 - RNA, 64 nt, Homo Sapiens
ucuaaccuauuugaauacgcuuuuccuuaaagugauacgauaauauuacucuugauugcugcug

SEQ ID NO: 266441 - RNA, 64 nt, Homo Sapiens
uugcuuaggcauaucuuuugguggccuugugcaaauacgauaugacuaauauccaugacauuca

SEQ ID NO: 266442 - RNA, 64 nt, Homo Sapiens
auagaacaagcugcacaaccuggauuuuuuuucaauacgauacugagccauuugcugcauuucu

SEQ ID NO: 266443 - RNA, 64 nt, Homo Sapiens
cuuucucaagaagggggcucagcuggauucuuucauacgauacuuuggguuugcugcucccuga

SEQ ID NO: 266444 - RNA, 64 nt, Homo Sapiens
uuacaccuuauccacauagccugaggguaauuuuauacgauauuuuaaauaguuguguacauga

SEQ ID NO: 266445 - RNA, 64 nt, Homo Sapiens
aaaggcuuuaacuaguccucaguucuuaacacacauacgauaauucuuacugcagagaaacucu

SEQ ID NO: 266446 - RNA, 64 nt, Homo Sapiens
ugucugguagugaagacaagcaaguggagaaguuauacgauauaguuuaaugagaguuaaaaaa

SEQ ID NO: 266447 - RNA, 64 nt, Homo Sapiens; identical to SEQ ID NO: 80183

SEQ ID NO: 266448 - RNA, 64 nt, Homo Sapiens; identical to SEQ ID NO: 80184

SEQ ID NO: 266449 - RNA, 64 nt, Homo Sapiens; identical to SEQ ID NO: 80185

SEQ ID NO: 266450 - RNA, 64 nt, Homo Sapiens; identical to SEQ ID NO: 80186

SEQ ID NO: 266451 - RNA, 64 nt, Homo Sapiens; identical to SEQ ID NO: 80187

SEQ ID NO: 266452 - RNA, 64 nt, Homo Sapiens; identical to SEQ ID NO: 80188

SEQ ID NO: 266453 - RNA, 64 nt, Homo Sapiens; identical to SEQ ID NO: 80189

SEQ ID NO: 266454 - RNA, 64 nt, Homo Sapiens; identical to SEQ ID NO: 80190

SEQ ID NO: 266455 - RNA, 64 nt, Homo Sapiens; identical to SEQ ID NO: 80191

SEQ ID NO: 266456 - RNA, 64 nt, Homo Sapiens; identical to SEQ ID NO: 80192

SEQ ID NO: 266457 - RNA, 64 nt, Homo Sapiens; identical to SEQ ID NO: 80193

SEQ ID NO: 266458 - RNA, 64 nt, Homo Sapiens; identical to SEQ ID NO: 80194

SEQ ID NO: 266459 - RNA, 64 nt, Homo Sapiens; identical to SEQ ID NO: 80195

SEQ ID NO: 266460 - RNA, 64 nt, Homo Sapiens; identical to SEQ ID NO: 80196

SEQ ID NO: 266461 - RNA, 64 nt, Homo Sapiens; identical to SEQ ID NO: 80197

SEQ ID NO: 266462 - RNA, 64 nt, Homo Sapiens; identical to SEQ ID NO: 80198

SEQ ID NO: 266463 - RNA, 64 nt, Homo Sapiens
gugagcaucuuagcuuagcaccaaccaacacagucucaccuagaaaacagauggaagcuucguu

SEQ ID NO: 266464 - RNA, 64 nt, Homo Sapiens
gguggcuggcaagaaggaagcaguucuccacguucucaccuaagcccagagcaaggaacaggua

SEQ ID NO: 266465 - RNA, 64 nt, Homo Sapiens
cugcacugacagccugaagggucuacacccucggcucaccuaagugcccugugcugguugccag

SEQ ID NO: 266466 - RNA, 64 nt, Homo Sapiens
gaccacaggguucaaaaugucuguagcuccucaacucaccuaauguuuaugagccagacaaaug

SEQ ID NO: 266467 - RNA, 64 nt, Homo Sapiens
ugguaggaauauuauucccaagaaauacccgcuccucaccuacucccucauccuaccaaggugc

SEQ ID NO: 266468 - RNA, 64 nt, Homo Sapiens
caguugcucuguggucagugucaacaauccaaugcucaccuauuguucugcugaagaguuguca

SEQ ID NO: 266469 - RNA, 64 nt, Homo Sapiens
uggguacaauaaaaagaacaccuuuugcucaaggcucaccuagaagaguugggcagugaaauua

SEQ ID NO: 266470 - RNA, 64 nt, Homo Sapiens
ugucaacuugucauugaauguucuccuuuucccucucaccuaaagcggagaguggcagacuuuc

SEQ ID NO: 266471 - RNA, 64 nt, Homo Sapiens
cugaugagauuuuuaaaaaacagacacgagccaccucaccuagccucccaaagugcugggauua

SEQ ID NO: 266472 - RNA, 64 nt, Homo Sapiens
accuagagaagguaagauggauucagacuaugagcucaccuacaugaaaauauucuguuuguga

SEQ ID NO: 266473 - RNA, 64 nt, Homo Sapiens
ggguugauguuaugaagacuuagcuauuacagaucucaccuagaaaaauucccagauaauuaac

SEQ ID NO: 266474 - RNA, 64 nt, Homo Sapiens
ccugcugcacagggcaggagggcacuuucaaucccucaccuagugugcuggguugagaggucag

SEQ ID NO: 266475 - RNA, 64 nt, Homo Sapiens
ucugagcuuauuuuuccauuuagagaucauaauucucaccuacuagaaaucagcaccugcguuu

SEQ ID NO: 266476 - RNA, 64 nt, Homo Sapiens
uuuugcuucucaggaaugagcucugacaaguuaccucaccuaaugugagcccugaauuugcuuc

SEQ ID NO: 266477 - RNA, 64 nt, Homo Sapiens
uggugcuaguuggucaaccccauuuuucuugacccucaccuaccccuggccccagggaggagca

SEQ ID NO: 266478 - RNA, 64 nt, Homo Sapiens
cagccccagcagccauggguacauggguccccagcucaccuauggauucccgccagucugccca

SEQ ID NO: 266479 - RNA, 64 nt, Homo Sapiens
uauuuacagaacaugcauccuuaaacugugacuucucaccuagugcagaacuuuuaccaggcug

SEQ ID NO: 266480 - RNA, 64 nt, Homo Sapiens
uaaauaauauuauauuguauuuaacccauuauuccucaccuacccucaaaguagguauacaaaa

SEQ ID NO: 266481 - RNA, 64 nt, Homo Sapiens
cuuagcuaaucugaccaaauguugggaaaaaugucucaccuaacccacuauuccuuaauuaugg

SEQ ID NO: 266482 - RNA, 64 nt, Homo Sapiens
uuauagaaauaaagaaaugggugacaggcuuaaccucaccuaugaauguacaguauguggauuu

SEQ ID NO: 266483 - RNA, 64 nt, Homo Sapiens
aucuaacuccauacugaacaaggggcuuuauguccucaccuaugaccuggaauaguuuaaauau

SEQ ID NO: 266484 - RNA, 64 nt, Homo Sapiens
aauuaaugguacuccuauaauuuuugauugugagcucaccuauuuggguuaagcaugccaauuu

SEQ ID NO: 266485 - RNA, 64 nt, Homo Sapiens
ugagugcacagccugugacgccugcucuuaggggcucaccuagguaggugaagcagaagcaaac

SEQ ID NO: 266486 - RNA, 64 nt, Homo Sapiens
gguauuugcaauauuccuuugggccucugcuucucucaccuaaaaaaagagaauuagauuauau

SEQ ID NO: 266487 - RNA, 64 nt, Homo Sapiens
gcagggaaguugacucauccuucauccaaaucgccucaccuacaucucuuaaaaguauggaugc

SEQ ID NO: 266488 - RNA, 64 nt, Homo Sapiens
aacaacuggcuggagcugggcuggggcucacauucucaccuagcgaucagaagaucuggccaug

SEQ ID NO: 266489 - RNA, 64 nt, Homo Sapiens
uccuccaucacaaccauuaaaagaacuuaagguccucaccuaauaaugcauuauuuccugaggc

SEQ ID NO: 266490 - RNA, 64 nt, Homo Sapiens
uuuuggguggauugccuaggcugagauuuggccacucaccuaugagauccacaugaacgcacgc

SEQ ID NO: 266491 - RNA, 64 nt, Homo Sapiens
ccgcagggagauacacccaaccaaagccucggcgcucaccuaagucgcagcagcuggggaggag

SEQ ID NO: 266492 - RNA, 64 nt, Homo Sapiens
cccugaggucuauucacugcaacacccaaccgcucucaccuacacugaugccuccccauuaugu

SEQ ID NO: 266493 - RNA, 64 nt, Homo Sapiens
agauagcaaaugugucugguguuccaggaaugagcucaccuaacaugaacggaauaccugcuag

SEQ ID NO: 266494 - RNA, 64 nt, Homo Sapiens
aguuuuuccagagcuggaggucacguuucuaaaacucaccuacgaaagauagcauuaaaggaac

SEQ ID NO: 266495 - RNA, 64 nt, Homo Sapiens
ugaugcaaagcaggugaaacaaaaucacuuucaucucaccuaccuuuuucugaaagcuacccau

SEQ ID NO: 266496 - RNA, 64 nt, Homo Sapiens
ugucagaucccuucuuugucuuacuaguuaaauccucaccuaaucucuuggguaugaauauaaa

SEQ ID NO: 266497 - RNA, 64 nt, Homo Sapiens
uggugugugcuuggaugggaaagaaaaggcuccacucaccuauaggagauuauuuuuaagugga

SEQ ID NO: 266498 - RNA, 64 nt, Homo Sapiens
cccagucaccaagggccccagcuggcccguucuacucaccuaagugccgccugacccuuguaca

SEQ ID NO: 266499 - RNA, 64 nt, Homo Sapiens
uaaagaacccuccuggccuccagcucagccuucucucaccuacuaugucuguccaacaggucug

SEQ ID NO: 266500 - RNA, 64 nt, Homo Sapiens
uauuauagggagaauaauuuuuuaggauauuuuccucaccuauauguacguuaccuccaucuau

SEQ ID NO: 266501 - RNA, 64 nt, Homo Sapiens
ucugauaaaaggaauacugcuuuuacaaucaauacucaccuaauagagcaagaguugauagagc

SEQ ID NO: 266502 - RNA, 64 nt, Homo Sapiens
guucuggccagaaugcugcaggacuugagaagaccucaccuagaaauugacacaaguggaccuu

SEQ ID NO: 266503 - RNA, 64 nt, Homo Sapiens
cacacaccggcacuuucauacccugaccucugaccucaccuacagcugggauguaccuggagag

SEQ ID NO: 266504 - RNA, 64 nt, Homo Sapiens
acagugcugcagcucccuggcuucuguggggccccucaccuacuuacccaggugggucccggcu

SEQ ID NO: 266505 - RNA, 64 nt, Homo Sapiens
ggauauuuugauucuaaauaugauaaaauaauuucucaccuauuuugugugugugacuugaaau

SEQ ID NO: 266506 - RNA, 64 nt, Homo Sapiens
uacuauaaauuucauccaacuacuugugaucucucucaccuacaucaauuauguauguuaauuu

SEQ ID NO: 266507 - RNA, 64 nt, Homo Sapiens
gguuuagaggcuaaaauuguguugaugcuguuuacucaccuaauuacauaguuuuaaucauuug

SEQ ID NO: 266508 - RNA, 64 nt, Homo Sapiens
ccugggcgcuuguuagaaucaaagacucucaggccucaccuagacauccagaaucaaaaucugc

SEQ ID NO: 266509 - RNA, 64 nt, Homo Sapiens
ccuauacauuuuucccacguuuccaacagcacuucucaccuauucaauaacugaaaaagacauu

SEQ ID NO: 266510 - RNA, 64 nt, Homo Sapiens
aauuaauuggacgggagacagagugacgcacugacucaccuagaggcuggaacguggguaggga

SEQ ID NO: 266511 - RNA, 64 nt, Homo Sapiens
cccucugugaaauuuguaauacuuccaagucauucucaccuaaacccucacugggacuuuguaa

SEQ ID NO: 266512 - RNA, 64 nt, Homo Sapiens
aaauaugaagagcaaaagcuuuaaaagccccagucucaccuacguuuuuuaugaaauauuucuu

SEQ ID NO: 266513 - RNA, 64 nt, Homo Sapiens
aauagagagguaaucagaugaaguuuguuuuuuucucaccuaaugccaaacugcuauaagaucg

SEQ ID NO: 266514 - RNA, 64 nt, Homo Sapiens
aaauugugauaauaauaaugugugcuucaguuuccucaccuauauuugcaagucuuaacuuacc

SEQ ID NO: 266515 - RNA, 64 nt, Homo Sapiens
ggagauuugggaagguugaauaauaaacuucaugcucaccuauuugucuugauauugaaaagug

SEQ ID NO: 266516 - RNA, 64 nt, Homo Sapiens
gcugugguuuugcuguguuccggcuuccugugugcucaccuaaagcaccugcucagcccugugu

SEQ ID NO: 266517 - RNA, 64 nt, Homo Sapiens
cuucacucuuuuuuuuucuuuuuugagacagagucucaccuauugcccagacugaagugcagug

SEQ ID NO: 266518 - RNA, 64 nt, Homo Sapiens
aggccgugcaccuccaccuccagccuccagucaccucaccuagcucacugcucucucuccugca

SEQ ID NO: 266519 - RNA, 64 nt, Homo Sapiens
ccacucccaucuuuaugacauuagcucccuccuccucaccuacugaagcgaaucaugcaugcaa

SEQ ID NO: 266520 - RNA, 64 nt, Homo Sapiens
ggcaaaaacaagauguucuaugucucauaaaguccucaccuacuuaaaagaaauacucaggaau

SEQ ID NO: 266521 - RNA, 64 nt, Homo Sapiens
ugagauguguuucaauuauauuuagcaaucucaucucaccuaacuuuuuuaguucuguauguau

SEQ ID NO: 266522 - RNA, 64 nt, Homo Sapiens
ccuggcacauuuuggaguguccuggcuaccagcucucaccuacacccacgcacccccccacaca

SEQ ID NO: 266523 - RNA, 64 nt, Homo Sapiens
gaggggcgcagagcagauccaggccccagaaagccucaccuacagacagcugugguccucugau

SEQ ID NO: 266524 - RNA, 64 nt, Homo Sapiens
aauauuuaaugcuaaaugcuuugcuacauuguaacucaccuaaaaccuuuuagugacaaaaucc

SEQ ID NO: 266525 - RNA, 64 nt, Homo Sapiens
aaaggcuuuuuccccgccuucccuguaaauuuaacucaccuacauaugugugucccaaggaaau

SEQ ID NO: 266526 - RNA, 64 nt, Homo Sapiens
agguaauggcacacauauucaugcacaagaagcacucaccuagagcugucugugccucucuggg

SEQ ID NO: 266527 - RNA, 64 nt, Homo Sapiens
aaauguucuugguguuugacuguaauguaacuaucucaccuaaugguuguacauauccuuuggu

SEQ ID NO: 266528 - RNA, 64 nt, Homo Sapiens
uaguggugcguuaguggcauuaucuauaaauacacucaccuaaauugaaagcuaagaaggaaau

SEQ ID NO: 266529 - RNA, 64 nt, Homo Sapiens
aaccucaaccguuaaagcagaugcaaaaauucaccucaccuaaauugaacuucuugcauauuuc

SEQ ID NO: 266530 - RNA, 64 nt, Homo Sapiens
ccucacccuugcugcuccuggcauagugaccugccucaccuaauaaagaccucaauuacgagag

SEQ ID NO: 266531 - RNA, 64 nt, Homo Sapiens
ugaaaucauggcuauauuguguuauauaaggaaacucaccuauuuacaauaaauaugaauaaau

SEQ ID NO: 266532 - RNA, 64 nt, Homo Sapiens
gccuggaauuaggaucccagggaccuaaguccaccucaccuagacuggccuagccuggagccca

SEQ ID NO: 266533 - RNA, 64 nt, Homo Sapiens
gacuuaaacugucaauuugcuuauuagauaauuucucaccuauagcugaaaaaauugauuauuu

SEQ ID NO: 266534 - RNA, 64 nt, Homo Sapiens
gaaacugacccagaaaacaggaaugugaacaaggcucaccuaagugucagcugguuuugauacu

SEQ ID NO: 266535 - RNA, 64 nt, Homo Sapiens
uccuaccacucuucuuagagcaaaauuacuuauccucaccuagccaaggcuugucuagucugcc

SEQ ID NO: 266536 - RNA, 64 nt, Homo Sapiens
aaaaucaacauucauuguauuuuauaaaagcagacucaccuaauuauaaccuuguuuacuugga

SEQ ID NO: 266537 - RNA, 64 nt, Homo Sapiens
gccacucaacaaguuugugggagugcuuaugugacucaccuaagcaauaaggaagcuauaucua

SEQ ID NO: 266538 - RNA, 64 nt, Homo Sapiens
gguaucaucacgcagugcaccaugaaccaaaguucucaccuaauaccucugcggcagccgacug

SEQ ID NO: 266539 - RNA, 64 nt, Homo Sapiens
ccuuagaaaaugaauguuaguuguuguuguuuuacucaccuaacgaacagagcauuuccagcau

SEQ ID NO: 266540 - RNA, 64 nt, Homo Sapiens
ucaggccacagacuuguaguaaucauuugaaggccucaccuaguguccccuuggugacguaugc

SEQ ID NO: 266541 - RNA, 64 nt, Homo Sapiens
guaucaaacaucuaugccccacuucuucucuugccucaccuauuccuuagauucuuggucacuu

SEQ ID NO: 266542 - RNA, 64 nt, Homo Sapiens
cuggcugugccccuagguggagacagcccucuuucucaccuacccccugccgcacagcccagca

SEQ ID NO: 266543 - RNA, 64 nt, Homo Sapiens
acccuaacuccaucuccuuucuuuaaagucaaaucucaccuaccuguuugggucagagagaugu

SEQ ID NO: 266544 - RNA, 64 nt, Homo Sapiens
gagugagcugagacagauaagagaauaccuuggucucaccuauccugcccucacaucuuccacc

SEQ ID NO: 266545 - RNA, 64 nt, Homo Sapiens
cgagucuuacuuugaguuaggcuaugcaacagcucucaccuacgacaugugaaguuauacugug

SEQ ID NO: 266546 - RNA, 64 nt, Homo Sapiens
ggaagcugacuucccucaguauggcaacagcccccucaccuaugauuuagauucugagcccaua

SEQ ID NO: 266547 - RNA, 64 nt, Homo Sapiens
gauuuuuagcacaaaaauagggaauuccaaauaacucaccuacaugcauuuuuauuuaaaugaa

SEQ ID NO: 266548 - RNA, 64 nt, Homo Sapiens
cugguccuggugcuccaggcggggccguggaccccucaccuacauuccauagugggcccguggg

SEQ ID NO: 266549 - RNA, 64 nt, Homo Sapiens
accaugugagguuaucugaagcacaaggcccacccucaccuaucugucgaccccauuuccuacc

SEQ ID NO: 266550 - RNA, 64 nt, Homo Sapiens
cucaggaccauccgaucaagcugcagcugccacccucaccuagaaacaugccuuugugcccacc

SEQ ID NO: 266551 - RNA, 64 nt, Homo Sapiens
aaauaagccagggauuguggcaugcaccuguagucucaccuacuccagaggcugaggugggagg

SEQ ID NO: 266552 - RNA, 64 nt, Homo Sapiens
gccagaccaacguuacucagccuccucggaaccgcucaccuagaagccccuagaaacccaagcu

SEQ ID NO: 266553 - RNA, 64 nt, Homo Sapiens
ggaggugaggaagaggaaaaaucugcuuucagcccucaccuaagcuagguccccaugugaggag

SEQ ID NO: 266554 - RNA, 64 nt, Homo Sapiens
auccaaucaguuuauacccuaguuaguguuuugccucaccuaauaggcugggagacugaagacu

SEQ ID NO: 266555 - RNA, 64 nt, Homo Sapiens
ggccaccugaccucacaccugacccugaccccuccucaccuauucucuuccucuauccugaccg

SEQ ID NO: 266556 - RNA, 64 nt, Homo Sapiens
aaugaaaagguacaacagaauaaugcaugaugaacucaccuaauuaugaggugggaggagcgaa

SEQ ID NO: 266557 - RNA, 64 nt, Homo Sapiens
gaaugguacacaaugugauuuuauggugaugucacucaccuagacaaccagaggcuggcauuga

SEQ ID NO: 266558 - RNA, 64 nt, Homo Sapiens
ugaauuuucuccuaccuaauuaacuucuugcuuucucaccuauugaaaaagacccaaacaaauc

SEQ ID NO: 266559 - RNA, 64 nt, Homo Sapiens
ggaagugugaauuacuugacacuuuuucaaaaugcucaccuacuuuauuguguccagagaguac

SEQ ID NO: 266560 - RNA, 64 nt, Homo Sapiens
uccccaggguccaagggagaacauucacaugcuucucaccuaagucauggagaggugacaucau

SEQ ID NO: 266561 - RNA, 55 nt, Homo Sapiens
ccaucuccauaagcacccuaagccccucaccuaugcugccugcaguccuguguga

SEQ ID NO: 266562 - RNA, 64 nt, Homo Sapiens
ucuccuuuucuucauaacauauaaauaaaaacaucucaccuaagcaauuaaugcagcaguugcg

SEQ ID NO: 266563 - RNA, 64 nt, Homo Sapiens
uuucuaucacagaugaauguugaaggaaaugaaacucaccuaucuguuuauccauuggccaacc

SEQ ID NO: 266564 - RNA, 64 nt, Homo Sapiens
ucccauuuuugcccuuaguuaacauuuacuggugcucaccuaggauuggcuauucugagggauu

SEQ ID NO: 266565 - RNA, 64 nt, Homo Sapiens
cagucagucaaguuccucggagaucugccucugccucaccuaccccagggaacuuccaaggaag

SEQ ID NO: 266566 - RNA, 64 nt, Homo Sapiens
aaguuggaagaugaacacuugaggacuucagcuucucaccuacuuaguacaguugggaaccaua

SEQ ID NO: 266567 - RNA, 64 nt, Homo Sapiens
uguuucagagcuucuucccuaagccauaaacugucucaccuaaacaagauagaccucaauaaaa

SEQ ID NO: 266568 - RNA, 64 nt, Homo Sapiens
ccugaaagcauuucacccucuuuccugguacccccucaccuaugaaaagagucucccccuuaaa

SEQ ID NO: 266569 - RNA, 64 nt, Homo Sapiens
cccaacuuagaauuugcuacucuacccaagaagccucaccuaucccgggaacacagacagggug

SEQ ID NO: 266570 - RNA, 64 nt, Homo Sapiens
ugaaagccugugggcaacguagggguuugguccacucaccuacuugacagccugaaaagcaugc

SEQ ID NO: 266571 - RNA, 64 nt, Homo Sapiens
cugcacuucaaguucgacacaucagcaccgacuucucaccuaaggcgccggcaugcccaaccuc

SEQ ID NO: 266572 - RNA, 64 nt, Homo Sapiens
cucauucugggcccuugcugccaaggagcccagccucaccuagcaggaaaggagaugaaggccc

SEQ ID NO: 266573 - RNA, 64 nt, Homo Sapiens
uauauccuuagcaccucguacugaaucauaguuucucaccuacauucuucuugauuggcugaca

SEQ ID NO: 266574 - RNA, 64 nt, Homo Sapiens
gaccugacuuacucuggaaugcaaucagucacaacucaccuagcucacgugcgcugcaggaaaa

SEQ ID NO: 266575 - RNA, 64 nt, Homo Sapiens
guuguuacuuuuuugaugggccaccacuaagccgcucaccuagaguuucagcugugggcuucua

SEQ ID NO: 266576 - RNA, 60 nt, Homo Sapiens
uggccagugugcucaucugagaggcugccgcucaccuaccugcacaucugccacagcugg

SEQ ID NO: 266577 - RNA, 64 nt, Homo Sapiens
caagaaaugggggcaagggccugccccccacucccucaccuaccuccuuagcauuccuucaggc

SEQ ID NO: 266578 - RNA, 64 nt, Homo Sapiens
gacaccuuucuuuugggagcucaaagcaagugagcucaccuaccugccaccgcccaggaccagu

SEQ ID NO: 266579 - RNA, 64 nt, Homo Sapiens
ggugucccagucuggccacagcccugccuccgcccucaccuacaugcccucccagccccuccca

SEQ ID NO: 266580 - RNA, 64 nt, Homo Sapiens
ccuccccugggcccaucucaaggcugcccccuuccucaccuacuucggacucuuccagguucac

SEQ ID NO: 266581 - RNA, 64 nt, Homo Sapiens
uuucccuguuaagggggagggccccaggacaccccucaccuacuuucagcuucaaccccaggcc

SEQ ID NO: 266582 - RNA, 64 nt, Homo Sapiens
ccgcccaccccagcgucuguugguacuuaccugucucaccuacccuccaguccccucccagcuc

SEQ ID NO: 266583 - RNA, 64 nt, Homo Sapiens
ucauccagguccuuuccuucucgucuuccucucucucaccuacuuccuccuccuccuccuguuc

SEQ ID NO: 266584 - RNA, 64 nt, Homo Sapiens
ccacuguuugcuucaacaguauauccuaauaagccucaccuauuuaauccaaugaguuuuaaau

SEQ ID NO: 266585 - RNA, 64 nt, Homo Sapiens
cacggcaacugaagcggcuggaaucagucagccgcucaccuaucuacucccacuuuucggagac

SEQ ID NO: 266586 - RNA, 64 nt, Homo Sapiens
cuuggcccuuaaccuuuaucuuucuuccuguccucucaccuagauuguaagcucccugggccag

SEQ ID NO: 266587 - RNA, 64 nt, Homo Sapiens
agaauggggccacagggcagccgggacucccugucucaccuacauuaacccaugcauacuguau

SEQ ID NO: 266588 - RNA, 64 nt, Homo Sapiens
agggcagcucucaggauugugacgagguucgaggcucaccuaucuuugccuucuuacggauuua

SEQ ID NO: 266589 - RNA, 64 nt, Homo Sapiens
guacaaagaaauugcgauguuacugcagauuuuucucaccuauuucucugccucuauucuucua

SEQ ID NO: 266590 - RNA, 64 nt, Homo Sapiens
gacccgccuuguucugaagcgggaaaccaucucucucaccuaauccccugauucguaaaccuag

SEQ ID NO: 266591 - RNA, 54 nt, Homo Sapiens
cucaccugccuuuauuaaccugcccucaccuauacuaguggcucuugcugcuga

SEQ ID NO: 266592 - RNA, 64 nt, Homo Sapiens
caauuuucucaccucuguaaauuuuagucucaaucucaccuaaaugaaucaggucugcccuuua

SEQ ID NO: 266593 - RNA, 64 nt, Homo Sapiens
gagaacagugcagccccauuuccgguccugcuaccucaccuagauguugugaggauucauauuc

SEQ ID NO: 266594 - RNA, 64 nt, Homo Sapiens
cccaccccaagggaaaauuuuacuuguuucuguacucaccuacuuggcaaugcagaguuguauu

SEQ ID NO: 266595 - RNA, 64 nt, Homo Sapiens
cucaucagaaacucaaaagaaggccacuguuugucucaccuacccaugaccugaagccccuccc

SEQ ID NO: 266596 - RNA, 64 nt, Homo Sapiens
cgucccguuugagucaaagucuuacuucccugcucucaccuacucacagacgggaugcuaagca

SEQ ID NO: 266597 - RNA, 64 nt, Homo Sapiens
uaauagcacuaaugcuuuaagauuuggucacacucucaccuaggugagcgcauugagccagugg

SEQ ID NO: 266598 - RNA, 64 nt, Homo Sapiens
aaucaucuuccccacacacaaucauucauaucuacucaccuaacagcaacacuggggagagccu

SEQ ID NO: 266599 - RNA, 64 nt, Homo Sapiens
uuuauccuccaagccuaucucucaccauccagcccucaccuagccauuucccaacccuaguccu

SEQ ID NO: 266600 - RNA, 64 nt, Homo Sapiens
ccccacaaaggggggcuacgcagucacugacuuccucaccuacaacugccucacgguaagcaug

SEQ ID NO: 266601 - RNA, 64 nt, Homo Sapiens
uagggucucacuagucggggcacuuucccagggccucaccuaccggccugggcugccgggaccu

SEQ ID NO: 266602 - RNA, 64 nt, Homo Sapiens
aggaccugaggcagcuccuuuuccccagaccuaccucaccuacucaccucaauccccucccauc

SEQ ID NO: 266603 - RNA, 64 nt, Homo Sapiens
gucacguucccccgacccugcuuucuacccaauucucaccuagucgcaugcccuuucacacaca

SEQ ID NO: 266604 - RNA, 64 nt, Homo Sapiens
aguaucuaacugucccuaacauuaucucccguuacucaccuagcuucccucacgaugaugaaca

SEQ ID NO: 266605 - RNA, 64 nt, Homo Sapiens
uggaguuccgguccuuccagagcuggcucagcaccucaccuacccgaccacuuggagacggggg

SEQ ID NO: 266606 - RNA, 64 nt, Homo Sapiens
ucucuggcccuggguacccccuggaaauuucccucucaccuacuccuacugugagcuucuccac

SEQ ID NO: 266607 - RNA, 64 nt, Homo Sapiens
ccuugccuccccuccucuccguuccagaacgucucucaccuagaaccuaccaccccacuggcug

SEQ ID NO: 266608 - RNA, 64 nt, Homo Sapiens
gcaggcaucugucacugccgugaggucagcgcuucucaccuaacugccuccuggauugucaucu

SEQ ID NO: 266609 - RNA, 64 nt, Homo Sapiens
ucccuccuccuuuuuuaaguuauuugauggaagacucaccuaauuugugaccugagacuguuga

SEQ ID NO: 266610 - RNA, 64 nt, Homo Sapiens
cuuucccaccaggcguguguaacaucccaugugccucaccuaauaaaauggcucuucuucugca

SEQ ID NO: 266611 - RNA, 64 nt, Homo Sapiens
uguuggugucagauaccuucccauccugagcucucucaccuaccugcucucucuccuagagcag

SEQ ID NO: 266612 - RNA, 64 nt, Homo Sapiens
ccucuguccccauagcugguuuuucccaccaauccucaccuaacaguuacuuuacaauuaaacu

SEQ ID NO: 266613 - RNA, 64 nt, Homo Sapiens
ggcaggaccgagagugacauccaguugcaccuuucucaccuacuuugggaccuuugggggugag

SEQ ID NO: 266614 - RNA, 64 nt, Homo Sapiens
caggccugaugcagguguccacucacagguggcgcucaccuaggcugucacaggacccaccucc

SEQ ID NO: 266615 - RNA, 64 nt, Homo Sapiens
ggguagaggauacuauuuccagaauaguguuuagcucaccuagggggauauguuuguauacaca

SEQ ID NO: 266616 - RNA, 64 nt, Homo Sapiens
aaucagaaacucaaaagaaugcaacuguuugugucucaccuaucugugaccuggaagcucccuc

SEQ ID NO: 266617 - RNA, 64 nt, Homo Sapiens
gcccaggauugaccuguguguaagucccaauaaacucaccuacucaucaagcuggacuuguucg

SEQ ID NO: 266618 - RNA, 64 nt, Homo Sapiens
gucccagggccccaccuaggugcagagccggccccucaccuaacagcugguuccuaccagaccg

SEQ ID NO: 266619 - RNA, 64 nt, Homo Sapiens
ccacgucagagacauguacugccccucacauuuucucaccuaaaccagcagcaccuccaucuua

SEQ ID NO: 266620 - RNA, 64 nt, Homo Sapiens
cuaaggcagguguguaugcucccuagccuuuguccucaccuaccaauaaauagcaaaaugaauc

SEQ ID NO: 266621 - RNA, 64 nt, Homo Sapiens
caccaagcuggacuuauucguaaguccuaauaaacucaccuacuccugcugagugcccugugug

SEQ ID NO: 266622 - RNA, 64 nt, Homo Sapiens
caccaagcuggacuuguucguaagucccaauaaacucaccuacugcccaggauugaccugugug

SEQ ID NO: 266623 - RNA, 64 nt, Homo Sapiens
aaauguguguagauuucaugcucgacacuuaccacucaccuaucaacagaucauccugcuugac

SEQ ID NO: 266624 - RNA, 64 nt, Homo Sapiens
cccuuuuuccuuguccccacacuccuacaccuaacucaccuaacucauacugugcuggagccac

SEQ ID NO: 266625 - RNA, 64 nt, Homo Sapiens
acaaggauacuuuaauauccagugccgguucagacucaccuauguggcaccuuaaacuuaaaua

SEQ ID NO: 266626 - RNA, 64 nt, Homo Sapiens
uuaugcuuuuggggggcauauauuggguuccauucucaccuauccacacaacauauccguauau

SEQ ID NO: 266627 - RNA, 64 nt, Homo Sapiens
guccuuugcacuuccucaaagcuuguguacagugcucaccuaaauccaucugacuacuuguucc

SEQ ID NO: 266628 - RNA, 64 nt, Homo Sapiens
cccaucuccuacuuugggcgccuccccuuuucuccucaccuaaaaacccaaaaaucugagaacc

SEQ ID NO: 266629 - RNA, 64 nt, Homo Sapiens
aagugauuuuugagcccuuggaggccuuacugaccucaccuaggcccccaauaguagucucugu

SEQ ID NO: 266630 - RNA, 64 nt, Homo Sapiens
uucccuggcuaagaagucagucuucggauaucuucucaccuaugguuuguagagauuuuaggcg

SEQ ID NO: 266631 - RNA, 64 nt, Homo Sapiens
gcaccaaaguucucgauuuuguuaguaacugcagcucaccuacuugugcuuuucauuugcagaa

SEQ ID NO: 266632 - RNA, 64 nt, Homo Sapiens
cuuuggggaugauaauccaaaauuuucucaugaucucaccuauaaucugagagaaggacugcca

SEQ ID NO: 266633 - RNA, 64 nt, Homo Sapiens
gcuucucugaccacaugugcccaacuucaauaagagaaccaagggacccucauuuucugaggug

SEQ ID NO: 266634 - RNA, 64 nt, Homo Sapiens
cggaagacauuuauuucuccuuuggauuuuggggagaaccaagcccugguagggaagagguaag

SEQ ID NO: 266635 - RNA, 64 nt, Homo Sapiens
cuguuuuuuugugagaauugauucagugauggcaagaaccaacauugggagauuuauacuauaa

SEQ ID NO: 266636 - RNA, 64 nt, Homo Sapiens
gaaauaugggcacuauuuugauucuuuauauuauagaaccaacgaacagaucuugacuacacua

SEQ ID NO: 266637 - RNA, 64 nt, Homo Sapiens
auggucauguacacaaagaccauucgugaugcuuagaaccaagggaauuaaagcagagagaagc

SEQ ID NO: 266638 - RNA, 64 nt, Homo Sapiens
uaacagaguaaacagaggcaucuuugauaacuuaagaaccaaaguggggccuucuuaacaaaag

SEQ ID NO: 266639 - RNA, 64 nt, Homo Sapiens
ucuuccuugguacagugguuuuuaaauacugagaagaaccaagucagguuuuuuaaagcagacu

SEQ ID NO: 266640 - RNA, 64 nt, Homo Sapiens
gcaaggacccaucucugcccugggucagcuccucagaaccaacccccagcaucucuaaagcaaa

SEQ ID NO: 266641 - RNA, 64 nt, Homo Sapiens
aucuuucagccacagaaucuaacuggugagcuucagaaccaauaauugccacauuuauuguccu

SEQ ID NO: 266642 - RNA, 64 nt, Homo Sapiens
auuugauguuuuguuugaaacaauacagcauuaaagaaccaauguuauucacuaauaucauuca

SEQ ID NO: 266643 - RNA, 64 nt, Homo Sapiens
ccuuggauaucuaggggaaaucuacuuggagaaaagaaccaagucucuguggaguagaaccaag

SEQ ID NO: 266644 - RNA, 64 nt, Homo Sapiens
cuacuuggagaaaagaaccacuacucuguggaguagaaccaaguauuagaaaugagggcuguau

SEQ ID NO: 266645 - RNA, 64 nt, Homo Sapiens
ugcggucacccugcaaaagacuugcacuuuccucagaaccaacaugacgcagcucaauaagggu

SEQ ID NO: 266646 - RNA, 64 nt, Homo Sapiens
cuuucccacagacuucccuccuggguccagguucagaaccaagacuucuguaccuagugcugcc

SEQ ID NO: 266647 - RNA, 63 nt, Homo Sapiens
ccuugguggucauuucucuuaaaauacauauucaagaaccaaaaugaaugauuuuuucaguaa

SEQ ID NO: 266648 - RNA, 64 nt, Homo Sapiens
agcacucaaauagggagccaaguaacugauacauagaaccaaggaaagauucuuugucaacauu

SEQ ID NO: 266649 - RNA, 64 nt, Homo Sapiens
cuccggaucugucgauuuggagaccuuccgagagagaaccaagggugcagucagcuuaaagugu

SEQ ID NO: 266650 - RNA, 64 nt, Homo Sapiens
gccucuauagaccacagaugacucaagccaugccagaaccaagcagcccaugccuggcuguggc

SEQ ID NO: 266651 - RNA, 63 nt, Homo Sapiens
aagcagugucgccgucccucugccuugcacaaaaagcacaagcauuccuuagcagcucaggcg

SEQ ID NO: 266652 - RNA, 63 nt, Homo Sapiens
ccccaaagcccagcccggcugaccaacauucaaaagcacaaacccuggggacucugcuuggcu

SEQ ID NO: 266653 - RNA, 63 nt, Homo Sapiens
auugacagaaaaauacaggugcacaauaauugaaagcacaauaauauauauauauaauucaaa

SEQ ID NO: 266654 - RNA, 63 nt, Homo Sapiens
auugaaagcacaauaauugauauauauaauucaaagcacaauacacacacacacauauauaua

SEQ ID NO: 266655 - RNA, 63 nt, Homo Sapiens
aaaauuaggcuacauucuuuuuuugcccaucuaaagcacaauucuuuccuacaacauuuuagc

SEQ ID NO: 266656 - RNA, 63 nt, Homo Sapiens
aauagugagguaguaguuagaaggaaauuucuaaagcacaagagauacuuuaagagaaauaca

SEQ ID NO: 266657 - RNA, 63 nt, Homo Sapiens
uuuccaaaucagucguuuuccuaguaacagugaaagcacaagauuugcaagcaguaauuaaca

SEQ ID NO: 266658 - RNA, 63 nt, Homo Sapiens
agcuuauauucagauccuaucauagcugaaaauaagcacaaauugaacagcuuauguguuagc

SEQ ID NO: 266659 - RNA, 63 nt, Homo Sapiens
aaaucccccauaaaauaaacuuuugggguacuaaagcacaaaaauguaugcgaacauauguga

SEQ ID NO: 266660 - RNA, 63 nt, Homo Sapiens
acagcuacaaugaaauauuuuagaagaucuucuaagcacaaauccauuuucuguuuuuaaauc

SEQ ID NO: 266661 - RNA, 63 nt, Homo Sapiens
uucaggcauaaucccuaauacaauuuaaagcacaagcacaaugauuuccuuaaaauuucauag

SEQ ID NO: 266662 - RNA, 63 nt, Homo Sapiens
acaauguucaggcauaauccucauagcaauuuaaagcacaagccaauaaauuuccuuaaaauu

SEQ ID NO: 266663 - RNA, 63 nt, Homo Sapiens
uugcccuuugcgagacauugagucaauucacagaagcacaauucacagccuagaguuaaguaa

SEQ ID NO: 266664 - RNA, 60 nt, Homo Sapiens
uuaguuuggguguuccucauccaaccuaagaagcacaaauugcaucgggauucagaauga

SEQ ID NO: 266665 - RNA, 63 nt, Homo Sapiens
guguagauauaacuuaaauauggagcuuucaaaaagcacaaauaggcuggacaugguggcuca

SEQ ID NO: 266666 - RNA, 63 nt, Homo Sapiens
agggcaaaauucuagagagugguaaaucucagaaagcacaagcauaaaaugcagcucuggggg

SEQ ID NO: 266667 - RNA, 63 nt, Homo Sapiens
ccuaaauaaucauugaugaaguaugucaguuacaagcacaaaagaauauaacugcuuuuauaa

SEQ ID NO: 266668 - RNA, 63 nt, Homo Sapiens
aaaaucagcuuuuuaauguagguuaccacuuauaagcacaaaagaaacauguauaagaaacca

SEQ ID NO: 266669 - RNA, 63 nt, Homo Sapiens
cuggaggcugggcgccugcgugggagccugugaaagcacaaagccacuucugcugaaaugcau

SEQ ID NO: 266670 - RNA, 63 nt, Homo Sapiens
ucaccaucaaugagccuggauuuguuaggaucaaagcacaagcuccacuuuugugcauuuauc

SEQ ID NO: 266671 - RNA, 63 nt, Homo Sapiens
agacggagaccccgguggcaguggaaaaaucagaagcacaaaggaaaacucuuggccucugcu

SEQ ID NO: 266672 - RNA, 63 nt, Homo Sapiens
gcugggauagccauuuccauggcucuguuaugcaagcacaaauuucaucuccuagauggacuu

SEQ ID NO: 266673 - RNA, 63 nt, Homo Sapiens
gaauggcuugucccaucagcagaugaauguguuaagcacaaagcaucuuccuuaaagcacaaa

SEQ ID NO: 266674 - RNA, 63 nt, Homo Sapiens
gaugaauguguuaagcacaaagcaucuuccuuaaagcacaaagagagggacuaacugaugcug

SEQ ID NO: 266675 - RNA, 63 nt, Homo Sapiens
uuuuaagaaaaaaaaguggcacagauaguuuauaagcacaauacugcaaguuuaaauaguugu

SEQ ID NO: 266676 - RNA, 63 nt, Homo Sapiens
ucacgauuccacaauggaggauggaguuagucaaagcacaaaggguggccaagcagaugucac

SEQ ID NO: 266677 - RNA, 63 nt, Homo Sapiens
auccugugacagaaguugcuaugcuccuccucaaagcacaauccucuaccuuacgagagagcu

SEQ ID NO: 266678 - RNA, 63 nt, Homo Sapiens
uaacaaacauguuuacuauaccacucuuggaaaaagcacaaccgcugcauauugcauuguuag

SEQ ID NO: 266679 - RNA, 63 nt, Homo Sapiens
aaauguaguggaaaaugacaaauauuaauauaaaagcacaacaauuaaauuauagcauuugca

SEQ ID NO: 266680 - RNA, 63 nt, Homo Sapiens
ucauggcugguuuuguuucagaaauccuugucaaagcacaaagagaaaaaaaaaagagcuaua

SEQ ID NO: 266681 - RNA, 63 nt, Homo Sapiens
acaaucaguguucaggcuucaguuauauaauguaagcacaacuaaaaugaaacuuguugacug

SEQ ID NO: 266682 - RNA, 63 nt, Homo Sapiens
uccagcgcacagaagcaagugcaaaaaugacacaagcacaacucuccagacguggcuccuucu

SEQ ID NO: 266683 - RNA, 63 nt, Homo Sapiens
guccuuuguaaagcuguacagacuuugcaguuuaagcacaaugugcacauguuaguuuuauau

SEQ ID NO: 266684 - RNA, 63 nt, Homo Sapiens
gcuauauauacuggaaguugaagguuaaaggaaaagcacaagaaacuuuggaagcacuuuuuc

SEQ ID NO: 266685 - RNA, 63 nt, Homo Sapiens
ggucuuugccauaacuuuaugaagugcuacagaaagcacaaagaauugauucauguucaucaa

SEQ ID NO: 266686 - RNA, 63 nt, Homo Sapiens
ggccugagugggggauauugacacccccagcuaaagcacaagcaccuuagucaccccuccucu

SEQ ID NO: 266687 - RNA, 63 nt, Homo Sapiens
cuggccugccaccccaccccagcguuuaccccaaagcacaaugcccuggucacuuggcaagcg

SEQ ID NO: 266688 - RNA, 63 nt, Homo Sapiens
aagggaauuucugcugaagaaccagaaaaaagaaagcacaacaccuuucccaugccuccucug

SEQ ID NO: 266689 - RNA, 63 nt, Homo Sapiens
ggcugaacucugggagugugucccagcugagggaagcacaaguagcaaagcucauuggucugg

SEQ ID NO: 266690 - RNA, 63 nt, Homo Sapiens
gauagucuucccuguacguagggagaggcugaaaagcacaaaaaggggguggggauuaucuug

SEQ ID NO: 266691 - RNA, 63 nt, Homo Sapiens
ucacauucucugugaucacaggaugguggaauuaagcacaaggaaccugagccuaucuggcug

SEQ ID NO: 266692 - RNA, 63 nt, Homo Sapiens
uauugagucucuugaaaaucgauuuuuaccugaaagcacaauguaacugaucuuuugucuaag

SEQ ID NO: 266693 - RNA, 63 nt, Homo Sapiens
auuuacauuucuuuauagccaaaaaaguccccuaagcacaacuauuauuaagacaacuuugcc

SEQ ID NO: 266694 - RNA, 64 nt, Homo Sapiens; identical to SEQ ID NO: 91802

SEQ ID NO: 266695 - RNA, 64 nt, Homo Sapiens; identical to SEQ ID NO: 91803

SEQ ID NO: 266696 - RNA, 64 nt, Homo Sapiens; identical to SEQ ID NO: 91804

SEQ ID NO: 266697 - RNA, 64 nt, Homo Sapiens; identical to SEQ ID NO: 91805

SEQ ID NO: 266698 - RNA, 64 nt, Homo Sapiens; identical to SEQ ID NO: 91806

SEQ ID NO: 266699 - RNA, 64 nt, Homo Sapiens; identical to SEQ ID NO: 91807

SEQ ID NO: 266700 - RNA, 64 nt, Homo Sapiens; identical to SEQ ID NO: 91808

SEQ ID NO: 266701 - RNA, 64 nt, Homo Sapiens; identical to SEQ ID NO: 91809

SEQ ID NO: 266702 - RNA, 64 nt, Homo Sapiens; identical to SEQ ID NO: 91810

SEQ ID NO: 266703 - RNA, 64 nt, Homo Sapiens; identical to SEQ ID NO: 91811

SEQ ID NO: 266704 - RNA, 64 nt, Homo Sapiens; identical to SEQ ID NO: 91812

SEQ ID NO: 266705 - RNA, 64 nt, Homo Sapiens; identical to SEQ ID NO: 91813

SEQ ID NO: 266706 - RNA, 64 nt, Homo Sapiens; identical to SEQ ID NO: 91814

SEQ ID NO: 266707 - RNA, 64 nt, Homo Sapiens; identical to SEQ ID NO: 91815

SEQ ID NO: 266708 - RNA, 64 nt, Homo Sapiens; identical to SEQ ID NO: 91816

SEQ ID NO: 266709 - RNA, 64 nt, Homo Sapiens; identical to SEQ ID NO: 91817

SEQ ID NO: 266710 - RNA, 64 nt, Homo Sapiens; identical to SEQ ID NO: 91818

SEQ ID NO: 266711 - RNA, 64 nt, Homo Sapiens; identical to SEQ ID NO: 91819

SEQ ID NO: 266712 - RNA, 64 nt, Homo Sapiens; identical to SEQ ID NO: 91820

SEQ ID NO: 266713 - RNA, 64 nt, Homo Sapiens; identical to SEQ ID NO: 91821

SEQ ID NO: 266714 - RNA, 64 nt, Homo Sapiens; identical to SEQ ID NO: 91822

SEQ ID NO: 266715 - RNA, 64 nt, Homo Sapiens; identical to SEQ ID NO: 91823

SEQ ID NO: 266716 - RNA, 64 nt, Homo Sapiens; identical to SEQ ID NO: 91824

SEQ ID NO: 266717 - RNA, 64 nt, Homo Sapiens; identical to SEQ ID NO: 91825

SEQ ID NO: 266718 - RNA, 64 nt, Homo Sapiens; identical to SEQ ID NO: 91826

SEQ ID NO: 266719 - RNA, 64 nt, Homo Sapiens; identical to SEQ ID NO: 91827

SEQ ID NO: 266720 - RNA, 64 nt, Homo Sapiens; identical to SEQ ID NO: 91828

SEQ ID NO: 266721 - RNA, 64 nt, Homo Sapiens; identical to SEQ ID NO: 91829

SEQ ID NO: 266722 - RNA, 64 nt, Homo Sapiens; identical to SEQ ID NO: 91830

SEQ ID NO: 266723 - RNA, 64 nt, Homo Sapiens; identical to SEQ ID NO: 91831

SEQ ID NO: 266724 - RNA, 64 nt, Homo Sapiens; identical to SEQ ID NO: 91832

SEQ ID NO: 266725 - RNA, 64 nt, Homo Sapiens; identical to SEQ ID NO: 91833

SEQ ID NO: 266726 - RNA, 64 nt, Homo Sapiens; identical to SEQ ID NO: 91834

SEQ ID NO: 266727 - RNA, 64 nt, Homo Sapiens; identical to SEQ ID NO: 91835

SEQ ID NO: 266728 - RNA, 64 nt, Homo Sapiens; identical to SEQ ID NO: 91836

SEQ ID NO: 266729 - RNA, 64 nt, Homo Sapiens; identical to SEQ ID NO: 91837

SEQ ID NO: 266730 - RNA, 64 nt, Homo Sapiens; identical to SEQ ID NO: 91838

SEQ ID NO: 266731 - RNA, 64 nt, Homo Sapiens; identical to SEQ ID NO: 91839

SEQ ID NO: 266732 - RNA, 64 nt, Homo Sapiens; identical to SEQ ID NO: 91840

SEQ ID NO: 266733 - RNA, 64 nt, Homo Sapiens; identical to SEQ ID NO: 91841

SEQ ID NO: 266734 - RNA, 64 nt, Homo Sapiens; identical to SEQ ID NO: 91842

SEQ ID NO: 266735 - RNA, 64 nt, Homo Sapiens; identical to SEQ ID NO: 91843

SEQ ID NO: 266736 - RNA, 64 nt, Homo Sapiens; identical to SEQ ID NO: 91844

SEQ ID NO: 266737 - RNA, 64 nt, Homo Sapiens; identical to SEQ ID NO: 91845

SEQ ID NO: 266738 - RNA, 64 nt, Homo Sapiens; identical to SEQ ID NO: 91846

SEQ ID NO: 266739 - RNA, 64 nt, Homo Sapiens; identical to SEQ ID NO: 91847

SEQ ID NO: 266740 - RNA, 64 nt, Homo Sapiens; identical to SEQ ID NO: 91848

SEQ ID NO: 266741 - RNA, 64 nt, Homo Sapiens; identical to SEQ ID NO: 91849

SEQ ID NO: 266742 - RNA, 64 nt, Homo Sapiens; identical to SEQ ID NO: 91850

SEQ ID NO: 266743 - RNA, 64 nt, Homo Sapiens; identical to SEQ ID NO: 91851

SEQ ID NO: 266744 - RNA, 64 nt, Homo Sapiens; identical to SEQ ID NO: 91852

SEQ ID NO: 266745 - RNA, 64 nt, Homo Sapiens; identical to SEQ ID NO: 91853

SEQ ID NO: 266746 - RNA, 64 nt, Homo Sapiens; identical to SEQ ID NO: 91854

SEQ ID NO: 266747 - RNA, 64 nt, Homo Sapiens; identical to SEQ ID NO: 91855

SEQ ID NO: 266748 - RNA, 64 nt, Homo Sapiens; identical to SEQ ID NO: 91856

SEQ ID NO: 266749 - RNA, 64 nt, Homo Sapiens; identical to SEQ ID NO: 91857

SEQ ID NO: 266750 - RNA, 64 nt, Homo Sapiens; identical to SEQ ID NO: 91858

SEQ ID NO: 266751 - RNA, 64 nt, Homo Sapiens; identical to SEQ ID NO: 91859

SEQ ID NO: 266752 - RNA, 64 nt, Homo Sapiens; identical to SEQ ID NO: 91860

SEQ ID NO: 266753 - RNA, 64 nt, Homo Sapiens; identical to SEQ ID NO: 91861

SEQ ID NO: 266754 - RNA, 64 nt, Homo Sapiens; identical to SEQ ID NO: 91862

SEQ ID NO: 266755 - RNA, 60 nt, Homo Sapiens
acaauguauauagcugaaaugcucagaugaacaacauauuaaaauuaaaaccacugccua

SEQ ID NO: 266756 - RNA, 60 nt, Homo Sapiens
guuauuugcagugcagaugaugucuguguaacaacauaaugguuauucaccuuuuuuuga

SEQ ID NO: 266757 - RNA, 60 nt, Homo Sapiens
auguuguuucucuguagcccuaauuaaaguacaacauaauuuuuaauuacacauaauaug

SEQ ID NO: 266758 - RNA, 60 nt, Homo Sapiens
acugucuuauuuuugugaaauaauguuuuuacaacauaaaacauaccuuugacaaauaac

SEQ ID NO: 266759 - RNA, 60 nt, Homo Sapiens
gcacaauaaaaaugcaaauacauaaagcaaacaacauaaaaaguaagcccaagagaacaa

SEQ ID NO: 266760 - RNA, 60 nt, Homo Sapiens
gcaaacaacauaaagcacaagcccaagagaacaacauaaacaucuccaacucggaaguaa

SEQ ID NO: 266761 - RNA, 60 nt, Homo Sapiens
ucuucccccuuauccccaguuuccuuggaaacaacauaccgggaccccagaccccuuggu

SEQ ID NO: 266762 - RNA, 60 nt, Homo Sapiens
caagcgggaccuucuuucucgaguguacauacaacauacuauuuuuuuuaauuucucucu

SEQ ID NO: 266763 - RNA, 64 nt, Homo Sapiens
uaauuucucauauggugcuggaaaugguugggcuuuguaacauuugaaguguuuccaugguagc

SEQ ID NO: 266764 - RNA, 64 nt, Homo Sapiens
uagcggaggacuacccuugcucacugacuuccuguuguaacacacuuuccuuacggagccuggc

SEQ ID NO: 266765 - RNA, 64 nt, Homo Sapiens
uugaaaccuuuuaaggaugccuuuccggauaaccuuguaacauacauuagccuuugcuuuuucu

SEQ ID NO: 266766 - RNA, 64 nt, Homo Sapiens
ccagagaagaaugaaaaggcagagcguguugcuguuguaacaucgcauguaacuuaauuguuuu

SEQ ID NO: 266767 - RNA, 64 nt, Homo Sapiens
guucaucuuuagugcacuuuaaauuucaguuuguuuguaacauuccgaagauuuaagauacacc

SEQ ID NO: 266768 - RNA, 64 nt, Homo Sapiens
gaaaaagaaaaagcauuuuaaucaaagcaugcacuuguaacaauugacuucugacauguuggca

SEQ ID NO: 266769 - RNA, 64 nt, Homo Sapiens
uuugcguucaucuugucuauuuuuucucuucauguuguaacaaaaaggaaaaaagaaaaaaaaa

SEQ ID NO: 266770 - RNA, 64 nt, Homo Sapiens
ucaucgguuggauuggaugcuuacaggguuuuucuuguaacauuuauaagugcugcuuacauca

SEQ ID NO: 266771 - RNA, 64 nt, Homo Sapiens
cuacaauaauuccaaaagguuugcacauuagaguuuguaacaaaauauuuuauuauauaaaacc

SEQ ID NO: 266772 - RNA, 64 nt, Homo Sapiens
caguggauagcacucaauuuauuccguagugauauuguaacaauacugccauucccuucuacug

SEQ ID NO: 266773 - RNA, 64 nt, Homo Sapiens
gcuaaauaugcuaaguacaggugauuuggaugcguuguaacacuauguaccauaggacuuaaag

SEQ ID NO: 266774 - RNA, 64 nt, Homo Sapiens
auugagauauaauucacauaguuucuuaauauguuuguaacauuucucuuugggguaugucuuc

SEQ ID NO: 266775 - RNA, 64 nt, Homo Sapiens
aagcacaugggauguaaucaugagcucugaagauuuucagcauuuaucucccaugacagaaaua

SEQ ID NO: 266776 - RNA, 64 nt, Homo Sapiens
augcccauaaaaacauaaauggccuuauugaugcuuucagcagaauuucaucuagaaguggcag

SEQ ID NO: 266777 - RNA, 64 nt, Homo Sapiens
gaauggcuaacucuugccugcuuugguuuuagcuuuucagcaugccaaagucauguaaguuugu

SEQ ID NO: 266778 - RNA, 64 nt, Homo Sapiens
aggcagccagucagucugucccagaaagggcccuuuucagcacccaaagcugggcuggcuggga

SEQ ID NO: 266779 - RNA, 62 nt, Homo Sapiens
ggcuaaggagaaacacauagcuuguggcuaucuuucagcacuccucuugcauauuauaaugu

SEQ ID NO: 266780 - RNA, 64 nt, Homo Sapiens
agagaauuuuuucuucaaauguagaaauguaaauuuucagcaauaaaauaucugcaugccuaca

SEQ ID NO: 266781 - RNA, 64 nt, Homo Sapiens
ggguacuuuuaccuguguguucaaaggcauuucuuuucagcagugaucauuauaacuucacaaa

SEQ ID NO: 266782 - RNA, 64 nt, Homo Sapiens
uaguugaucuuugacugucuuauuuauuauaaccuuucagcacauuccaagguuuuaguuacuc

SEQ ID NO: 266783 - RNA, 64 nt, Homo Sapiens
gcuucauugacaccugcaccagaugcagccauucuuucagcaaauacucucuucaaagagcaug

SEQ ID NO: 266784 - RNA, 64 nt, Homo Sapiens
cugaucaggaccuccaagccgaggcauccacuucuuucagcagacccguaacaccugauuaacu

SEQ ID NO: 266785 - RNA, 64 nt, Homo Sapiens
ugccuucccaacagucccccaaagucuuaacucauuucagcauuaacccaaaaguccgcagucc

SEQ ID NO: 266786 - RNA, 64 nt, Homo Sapiens
aguuccaaacuugcuuucauauuuuuggcuaucuuuucagcaaugccccacucuacuguuagca

SEQ ID NO: 266787 - RNA, 64 nt, Homo Sapiens
uuuucucagguauaacacauagaaacaccaagauuuucagcaucugaaucaaacuaaaauuacu

SEQ ID NO: 266788 - RNA, 64 nt, Homo Sapiens
augcagauuccagcauccccuccucagagaucaauuucagcagggccaggcaggaccuggguuu

SEQ ID NO: 266789 - RNA, 64 nt, Homo Sapiens
ugcuguuuuguacuuugguaucuuaauuuuuguuuuucagcaguuuuucuuaacacgugcaaca

SEQ ID NO: 266790 - RNA, 64 nt, Homo Sapiens
agugugcaauuuuugcuugguuugguauuugguauuucagcagcccuggcuggaaccuucgcug

SEQ ID NO: 266791 - RNA, 64 nt, Homo Sapiens
guaaaauagcccuugacaugaugaacaucacuuauuucagcacuuggauugucuggcaaugauu

SEQ ID NO: 266792 - RNA, 64 nt, Homo Sapiens
uaagcaaguaauaccuauuagucauaccuaaauuuuucagcacuucauucaauuaaaauacaug

SEQ ID NO: 266793 - RNA, 64 nt, Homo Sapiens
aaauuauacuaaagugagaugcauuuuuucucauuuucagcaagacuccucuaagcauuuacuc

SEQ ID NO: 266794 - RNA, 64 nt, Homo Sapiens
caaaauacgaacuuugagaugcacuaaaguuuuguuucagcaguggcucaaaaaauuucagaaa

SEQ ID NO: 266795 - RNA, 64 nt, Homo Sapiens
cagagagcuaguacuucauuuucacuggauacauuuucagcaucaugaguugucacagccucug

SEQ ID NO: 266796 - RNA, 64 nt, Homo Sapiens
caauugaggaacuugggaugcuauuaauuuuguauuucagcaacugccccuucuccuaucccaa

SEQ ID NO: 266797 - RNA, 64 nt, Homo Sapiens
ccuucgccaaguaggcgcacucuuugugauauuguuucagcagacuucuuucagcagcucgugu

SEQ ID NO: 266798 - RNA, 64 nt, Homo Sapiens
gcgcacucuuugugauauuguuucagcagacuucuuucagcagcucguguuuuucuaaagugaa

SEQ ID NO: 266799 - RNA, 64 nt, Homo Sapiens
acugauauucacuuuauuuuaauauucuaggaauuuucagcaauuuucauuuaaaguuuuaucc

SEQ ID NO: 266800 - RNA, 64 nt, Homo Sapiens
acuaauauucucauuuuuaaaguauucuaggaauuuucagcaauuguuauuuaaaguuuuaucc

SEQ ID NO: 266801 - RNA, 64 nt, Homo Sapiens
gcgggucccaaguucucucccauuuccccaucaaaauccccaaggauucacagaaccgugguca

SEQ ID NO: 266802 - RNA, 64 nt, Homo Sapiens
uauugaggcacacuccuuggggcauagcugucugaauccccaauaacaaaaaauaaaucaagaa

SEQ ID NO: 266803 - RNA, 64 nt, Homo Sapiens
ugucuagggagagaccugguauuguaauccccauaauccccaugucacccaaauuucaucucga

SEQ ID NO: 266804 - RNA, 64 nt, Homo Sapiens
auccccaugugucuagggagucaucucgaauuguaauccccauaucuguguccucacccaaauu

SEQ ID NO: 266805 - RNA, 64 nt, Homo Sapiens
uucauuccagaucuauuuuuaaaaaaaaccaccaaauccccaaaugaugcaaaaaacaaaaaca

SEQ ID NO: 266806 - RNA, 64 nt, Homo Sapiens
ccccaaaucacuggauccugacaccccagcccuuaauccccauccacaagauucaagauuaucc

SEQ ID NO: 266807 - RNA, 62 nt, Homo Sapiens
uuucaccaacugaaaugucucccuuugaaaguagcaaacaugauuuguauguuaacuuaacu

SEQ ID NO: 266808 - RNA, 62 nt, Homo Sapiens
aaauagugucucagcuaaauggaaaacuguuaagcaaacauccauaguaaaacaaauaaucu

SEQ ID NO: 266809 - RNA, 62 nt, Homo Sapiens
uucacugagaauuccaaaagauauuuugggcaagcaaacaaaaaauuacagaauggaaaaua

SEQ ID NO: 266810 - RNA, 62 nt, Homo Sapiens
acauuuggagaagaggaaauaucacauauuuaagcaaacaucguuuuaaaaagauacacucu

SEQ ID NO: 266811 - RNA, 62 nt, Homo Sapiens
uacugggcgugugcaucugaauccugcuggagagcaaacacgaacuucuguucccugcaaaa

SEQ ID NO: 266812 - RNA, 62 nt, Homo Sapiens
auuuuguucuggcauuagaagaaaaacaagcaagcaaacaaaaacacagccuccgaugccaa

SEQ ID NO: 266813 - RNA, 62 nt, Homo Sapiens
gaguaccaauuauuugcuagguucauucauccagcaaacauuaguggccguaugggaauuua

SEQ ID NO: 266814 - RNA, 62 nt, Homo Sapiens
uacuguccaaggacagccuucuuugugagcaaagcaaacaagauuguuucuuuccuuuucuc

SEQ ID NO: 266815 - RNA, 62 nt, Homo Sapiens
augcaguacuccuguguucuugaaagaauaguagcaaacagugucuagacuaaaaauauccu

SEQ ID NO: 266816 - RNA, 62 nt, Homo Sapiens
auccuuuuuucuccuucccccaguuacuguauagcaaacaguugcagggucaguuaaugcua

SEQ ID NO: 266817 - RNA, 62 nt, Homo Sapiens
cuuuuaaagggauccuuucaaaaggaucacuuagcaaacacauguugacuuuuaacugaugu

SEQ ID NO: 266818 - RNA, 62 nt, Homo Sapiens
gagaagucaggugauagaugauauuaaaaauuagcaaacaaaagugacuugcucagggucau

SEQ ID NO: 266819 - RNA, 62 nt, Homo Sapiens
acuuccaguauaguggggacaaucaguuaauaagcaaacaaacacauuucuauuuauaaaug

SEQ ID NO: 266820 - RNA, 62 nt, Homo Sapiens
ugcauuugcuaugcuuuaccugucuggcaucuagcaaacauucuucacauguuugcuguuau

SEQ ID NO: 266821 - RNA, 62 nt, Homo Sapiens
aacagaggccaaagaaacgaagcaagacaaacagcaaacaggcauuuuggucaggucauuug

SEQ ID NO: 266822 - RNA, 62 nt, Homo Sapiens
uacuuuucaggccuuuuuaaaaaauucauuacagcaaacagcuggggaaggacaugcagucc

SEQ ID NO: 266823 - RNA, 62 nt, Homo Sapiens
uaaucaauaaaguaugucuguugaagcaagcaagcaaacaaauccauaacaaccacaacaag

SEQ ID NO: 266824 - RNA, 62 nt, Homo Sapiens
acuuagacauaauccauuccacucauuauuccagcaaacacuuacugacaaaucggguccug

SEQ ID NO: 266825 - RNA, 62 nt, Homo Sapiens
uacugggcgugugcaucugaaucccgcuggagagcaaacacgaacuucuguucgcugcaaaa

SEQ ID NO: 266826 - RNA, 62 nt, Homo Sapiens
auuuuguucuggcauuaaaagaaaaacaagcaagcaaacaaaaacacagccuccgaugccaa

SEQ ID NO: 266827 - RNA, 62 nt, Homo Sapiens
cuuaacugacccuaacgugugcuaucacccaaagcaaacaucaaauaagagaccaaaaguag

SEQ ID NO: 266828 - RNA, 62 nt, Homo Sapiens
gcccauuacagguucagaaccuagcccugguaagcaaacauacacgaccaagucagcgagag

SEQ ID NO: 266829 - RNA, 62 nt, Homo Sapiens
ccguccauuucugaagaggcucuuuuauaugcagcaaacacauagcuacuuaaugguucugu

SEQ ID NO: 266830 - RNA, 62 nt, Homo Sapiens
auaaagaaagauugugcacuaugucuguucccagcaaacacgccacccgagcuaaucaugga

SEQ ID NO: 266831 - RNA, 62 nt, Homo Sapiens
gaaagucagcaaaagaaagaaugcauuucgaaagcaaacagaagaaaaaaguauauucucac

SEQ ID NO: 266832 - RNA, 62 nt, Homo Sapiens
uuaaaccaguuuuuacuugucaguuuucucucagcaaacagucuuacuauuauguggaauuu

SEQ ID NO: 266833 - RNA, 62 nt, Homo Sapiens
agugaggcucuauugagccacugcccaaucugagcaaacacccaaguagcuuugggcauagg

SEQ ID NO: 266834 - RNA, 62 nt, Homo Sapiens
ggaauaugacucaggagccuaucucuccagagagcaaacauaaaagauaaacaguuuagccc

SEQ ID NO: 266835 - RNA, 62 nt, Homo Sapiens
ugaagagguaaaaaauaaauaaauacauaaaaagcaaacaagcggggacaccugcagucuua

SEQ ID NO: 266836 - RNA, 62 nt, Homo Sapiens
acauuuucauggaaugguacugugggagacugagcaaacacucuuuuggcaacuuaguagaa

SEQ ID NO: 266837 - RNA, 62 nt, Homo Sapiens
cucugauaagaaaaguguucaauuuguauuuaagcaaacagugaacgacguuugcaaucaac

SEQ ID NO: 266838 - RNA, 62 nt, Homo Sapiens
ucuguggaguuuguucagugguacgguguccaagcaaacagcagaaugcaacuuucuaaaca

SEQ ID NO: 266839 - RNA, 62 nt, Homo Sapiens
aacagcagaaugcaacuuucuaaacagccccaagcaaacagcagaauucaacuuuuuaaaca

SEQ ID NO: 266840 - RNA, 62 nt, Homo Sapiens
aaucuggaauauucuacauggcuugauuacauagcaaacaagaccaagauuuagggcugucu

SEQ ID NO: 266841 - RNA, 62 nt, Homo Sapiens
uuuuggcuaaguagaggacauggacuaguuguagcaaacagaacaugcuguuugcucuugcc

SEQ ID NO: 266842 - RNA, 64 nt, Homo Sapiens; identical to SEQ ID NO: 168029

SEQ ID NO: 266843 - RNA, 64 nt, Homo Sapiens; identical to SEQ ID NO: 168030

SEQ ID NO: 266844 - RNA, 64 nt, Homo Sapiens; identical to SEQ ID NO: 168031

SEQ ID NO: 266845 - RNA, 64 nt, Homo Sapiens; identical to SEQ ID NO: 168032

SEQ ID NO: 266846 - RNA, 64 nt, Homo Sapiens; identical to SEQ ID NO: 168033

SEQ ID NO: 266847 - RNA, 64 nt, Homo Sapiens; identical to SEQ ID NO: 168034

SEQ ID NO: 266848 - RNA, 64 nt, Homo Sapiens; identical to SEQ ID NO: 168035

SEQ ID NO: 266849 - RNA, 64 nt, Homo Sapiens; identical to SEQ ID NO: 168036

SEQ ID NO: 266850 - RNA, 64 nt, Homo Sapiens; identical to SEQ ID NO: 168037

SEQ ID NO: 266851 - RNA, 64 nt, Homo Sapiens; identical to SEQ ID NO: 168038

SEQ ID NO: 266852 - RNA, 64 nt, Homo Sapiens; identical to SEQ ID NO: 168039

SEQ ID NO: 266853 - RNA, 64 nt, Homo Sapiens; identical to SEQ ID NO: 168040

SEQ ID NO: 266854 - RNA, 64 nt, Homo Sapiens; identical to SEQ ID NO: 168041

SEQ ID NO: 266855 - RNA, 64 nt, Homo Sapiens; identical to SEQ ID NO: 168042

SEQ ID NO: 266856 - RNA, 64 nt, Homo Sapiens; identical to SEQ ID NO: 168043

SEQ ID NO: 266857 - RNA, 64 nt, Homo Sapiens; identical to SEQ ID NO: 168044

SEQ ID NO: 266858 - RNA, 64 nt, Homo Sapiens; identical to SEQ ID NO: 168045

SEQ ID NO: 266859 - RNA, 64 nt, Homo Sapiens; identical to SEQ ID NO: 168046

SEQ ID NO: 266860 - RNA, 64 nt, Homo Sapiens; identical to SEQ ID NO: 168047

SEQ ID NO: 266861 - RNA, 64 nt, Homo Sapiens; identical to SEQ ID NO: 168048

SEQ ID NO: 266862 - RNA, 64 nt, Homo Sapiens; identical to SEQ ID NO: 168049

SEQ ID NO: 266863 - RNA, 64 nt, Homo Sapiens; identical to SEQ ID NO: 168050

SEQ ID NO: 266864 - RNA, 64 nt, Homo Sapiens; identical to SEQ ID NO: 168051

SEQ ID NO: 266865 - RNA, 64 nt, Homo Sapiens; identical to SEQ ID NO: 168052

SEQ ID NO: 266866 - RNA, 64 nt, Homo Sapiens; identical to SEQ ID NO: 168053

SEQ ID NO: 266867 - RNA, 64 nt, Homo Sapiens; identical to SEQ ID NO: 168054

SEQ ID NO: 266868 - RNA, 64 nt, Homo Sapiens; identical to SEQ ID NO: 168055

SEQ ID NO: 266869 - RNA, 64 nt, Homo Sapiens; identical to SEQ ID NO: 168056

SEQ ID NO: 266870 - RNA, 64 nt, Homo Sapiens; identical to SEQ ID NO: 168057

SEQ ID NO: 266871 - RNA, 64 nt, Homo Sapiens; identical to SEQ ID NO: 168058

SEQ ID NO: 266872 - RNA, 64 nt, Homo Sapiens; identical to SEQ ID NO: 168059

SEQ ID NO: 266873 - RNA, 64 nt, Homo Sapiens; identical to SEQ ID NO: 168060

SEQ ID NO: 266874 - RNA, 64 nt, Homo Sapiens; identical to SEQ ID NO: 168061

SEQ ID NO: 266875 - RNA, 64 nt, Homo Sapiens; identical to SEQ ID NO: 168062

SEQ ID NO: 266876 - RNA, 64 nt, Homo Sapiens; identical to SEQ ID NO: 168063

SEQ ID NO: 266877 - RNA, 64 nt, Homo Sapiens; identical to SEQ ID NO: 168064

SEQ ID NO: 266878 - RNA, 64 nt, Homo Sapiens; identical to SEQ ID NO: 168065

SEQ ID NO: 266879 - RNA, 64 nt, Homo Sapiens; identical to SEQ ID NO: 168066

SEQ ID NO: 266880 - RNA, 64 nt, Homo Sapiens; identical to SEQ ID NO: 195795

SEQ ID NO: 266881 - RNA, 64 nt, Homo Sapiens; identical to SEQ ID NO: 195796

SEQ ID NO: 266882 - RNA, 64 nt, Homo Sapiens; identical to SEQ ID NO: 195797

SEQ ID NO: 266883 - RNA, 64 nt, Homo Sapiens; identical to SEQ ID NO: 195798

SEQ ID NO: 266884 - RNA, 64 nt, Homo Sapiens; identical to SEQ ID NO: 195799

SEQ ID NO: 266885 - RNA, 64 nt, Homo Sapiens; identical to SEQ ID NO: 195800

SEQ ID NO: 266886 - RNA, 64 nt, Homo Sapiens; identical to SEQ ID NO: 195801

SEQ ID NO: 266887 - RNA, 64 nt, Homo Sapiens; identical to SEQ ID NO: 195802

SEQ ID NO: 266888 - RNA, 64 nt, Homo Sapiens; identical to SEQ ID NO: 195803

SEQ ID NO: 266889 - RNA, 64 nt, Homo Sapiens; identical to SEQ ID NO: 195804

SEQ ID NO: 266890 - RNA, 64 nt, Homo Sapiens; identical to SEQ ID NO: 195805

SEQ ID NO: 266891 - RNA, 64 nt, Homo Sapiens; identical to SEQ ID NO: 195806

SEQ ID NO: 266892 - RNA, 64 nt, Homo Sapiens; identical to SEQ ID NO: 195807

SEQ ID NO: 266893 - RNA, 64 nt, Homo Sapiens; identical to SEQ ID NO: 195808

SEQ ID NO: 266894 - RNA, 64 nt, Homo Sapiens; identical to SEQ ID NO: 195809

SEQ ID NO: 266895 - RNA, 64 nt, Homo Sapiens; identical to SEQ ID NO: 195810

SEQ ID NO: 266896 - RNA, 64 nt, Homo Sapiens; identical to SEQ ID NO: 195811

SEQ ID NO: 266897 - RNA, 64 nt, Homo Sapiens; identical to SEQ ID NO: 195812

SEQ ID NO: 266898 - RNA, 64 nt, Homo Sapiens; identical to SEQ ID NO: 195813

SEQ ID NO: 266899 - RNA, 64 nt, Homo Sapiens; identical to SEQ ID NO: 195814

SEQ ID NO: 266900 - RNA, 64 nt, Homo Sapiens; identical to SEQ ID NO: 195815

SEQ ID NO: 266901 - RNA, 64 nt, Homo Sapiens; identical to SEQ ID NO: 195816

SEQ ID NO: 266902 - RNA, 64 nt, Homo Sapiens; identical to SEQ ID NO: 195817

SEQ ID NO: 266903 - RNA, 64 nt, Homo Sapiens; identical to SEQ ID NO: 195818

SEQ ID NO: 266904 - RNA, 64 nt, Homo Sapiens; identical to SEQ ID NO: 195819

SEQ ID NO: 266905 - RNA, 64 nt, Homo Sapiens; identical to SEQ ID NO: 195820

SEQ ID NO: 266906 - RNA, 64 nt, Homo Sapiens; identical to SEQ ID NO: 195821

SEQ ID NO: 266907 - RNA, 64 nt, Homo Sapiens; identical to SEQ ID NO: 195822

SEQ ID NO: 266908 - RNA, 64 nt, Homo Sapiens; identical to SEQ ID NO: 195823

SEQ ID NO: 266909 - RNA, 64 nt, Homo Sapiens; identical to SEQ ID NO: 195824

SEQ ID NO: 266910 - RNA, 64 nt, Homo Sapiens; identical to SEQ ID NO: 195825

SEQ ID NO: 266911 - RNA, 64 nt, Homo Sapiens; identical to SEQ ID NO: 195826

SEQ ID NO: 266912 - RNA, 64 nt, Homo Sapiens; identical to SEQ ID NO: 195827

SEQ ID NO: 266913 - RNA, 64 nt, Homo Sapiens; identical to SEQ ID NO: 195828

SEQ ID NO: 266914 - RNA, 64 nt, Homo Sapiens; identical to SEQ ID NO: 195829

SEQ ID NO: 266915 - RNA, 64 nt, Homo Sapiens; identical to SEQ ID NO: 195830

SEQ ID NO: 266916 - RNA, 64 nt, Homo Sapiens; identical to SEQ ID NO: 195831

SEQ ID NO: 266917 - RNA, 64 nt, Homo Sapiens; identical to SEQ ID NO: 195832

SEQ ID NO: 266918 - RNA, 64 nt, Homo Sapiens; identical to SEQ ID NO: 195833

SEQ ID NO: 266919 - RNA, 64 nt, Homo Sapiens; identical to SEQ ID NO: 195834

SEQ ID NO: 266920 - RNA, 64 nt, Homo Sapiens; identical to SEQ ID NO: 195835

SEQ ID NO: 266921 - RNA, 64 nt, Homo Sapiens; identical to SEQ ID NO: 195836

SEQ ID NO: 266922 - RNA, 64 nt, Homo Sapiens
uggguuccaacuagaauucuagaaauauuucuagaacacacagagagggaauaagucccucuau

SEQ ID NO: 266923 - RNA, 64 nt, Homo Sapiens
uauuuucaaagugaagcugagagagaaucuuggaaacacacauaccuguugaucaugggcccug

SEQ ID NO: 266924 - RNA, 64 nt, Homo Sapiens
uaugcuucuaaauaucuaaacucauuaacauggaaacacacacacaggagcuacaguacauauu

SEQ ID NO: 266925 - RNA, 64 nt, Homo Sapiens
uaguaauucaggcucuaauuagcugagggaaugaaacacacaaaaaucacugaauuccuaagag

SEQ ID NO: 266926 - RNA, 64 nt, Homo Sapiens
cacacacacacacacaggugucccucccuugcugaacacacacagcuugcaggaggccaaacug

SEQ ID NO: 266927 - RNA, 64 nt, Homo Sapiens
cuauggggugggguggguguugggcacacgcacaaacacacacaucacauucgacauaccccac

SEQ ID NO: 266928 - RNA, 64 nt, Homo Sapiens
agaagcuaccucagguguuuuuuuuaacgagaaaaacacacagagggcguuaaauucacagauu

SEQ ID NO: 266929 - RNA, 64 nt, Homo Sapiens
ccagccucaacuuacacuugaggaacaaaagcgaaacacacaaaugaguaucacaucacacaaa

SEQ ID NO: 266930 - RNA, 64 nt, Homo Sapiens
aagcacugggagaacuaacagaggagaaaggugaaacacacacacauucuuaaggcaauaaaac

SEQ ID NO: 266931 - RNA, 64 nt, Homo Sapiens
agcucgccaaccgcaucugcucaucugauauucaaacacacaguauucgugaauaaguugauuc

SEQ ID NO: 266932 - RNA, 64 nt, Homo Sapiens
auauauaaaacagccuuucuggcuuuuuaugaguaacacacaccacaauauuagagaaaggaca

SEQ ID NO: 266933 - RNA, 64 nt, Homo Sapiens
auuuaauugaaaggacaucauguuuuucauuuuaaacacacaaggauauuuguaccaggcugcg

SEQ ID NO: 266934 - RNA, 64 nt, Homo Sapiens
auaccucaauugacaaucuuaagagaggcaggugaacacacaugagcaaccaaagaaauagggc

SEQ ID NO: 266935 - RNA, 64 nt, Homo Sapiens
cacacacacacacgcacacacacacacacacacgaacacacacacacacacacgagcacacaca

SEQ ID NO: 266936 - RNA, 64 nt, Homo Sapiens
gccauggcaggauuaucuauccucgauuuuuaagaacacacauuuuuuacaccuggaaaauuua

SEQ ID NO: 266937 - RNA, 64 nt, Homo Sapiens
uguagcugcuucuggcugaggcacucagagacacaacacacauggagagccacugagggaccca

SEQ ID NO: 266938 - RNA, 64 nt, Homo Sapiens
cagccaaccacuuauaugaagagugguagaaaaaaacacacauuguucuugaacauuucagaag

SEQ ID NO: 266939 - RNA, 64 nt, Homo Sapiens
cucugugagauucuaaauguaagccaaugaagcaaacacacagaccauuuaacuagcacuuuau

SEQ ID NO: 266940 - RNA, 64 nt, Homo Sapiens
uaacuccguuuccaaauacacucugcugcuuuccaacacacaauucugaggugucaggagagcc

SEQ ID NO: 266941 - RNA, 64 nt, Homo Sapiens
guuuggagcaauaggaacaucacuaagaugggaaaacacacauggacuggauccacuaaaccaa

SEQ ID NO: 266942 - RNA, 64 nt, Homo Sapiens
accuuuuggcuuacuucgaguguggacucagaaaaacacacaccauaucacuauuuacaacuca

SEQ ID NO: 266943 - RNA, 64 nt, Homo Sapiens
cacacacaccccucacauacucccucucucucccaacacacacacccaccauuuucucaguuuc

SEQ ID NO: 266944 - RNA, 64 nt, Homo Sapiens
aaagaaagcaggauuuucucaauugccuuccauuaacacacaagauuaaguacacuuuauugaa

SEQ ID NO: 266945 - RNA, 64 nt, Homo Sapiens
aaagguucaucucacaacaggaaaaacaaaucucaacacacauuagagauaauugauucagggg

SEQ ID NO: 266946 - RNA, 64 nt, Homo Sapiens
uauuuuuguuucauugguuguuucacagaauuagaacacacacgacuuuuuauuccuccauugc

SEQ ID NO: 266947 - RNA, 64 nt, Homo Sapiens
cauuggagucuaggagcucagcuguguguccaucaacacacaaauucguaaaaaacacacaugg

SEQ ID NO: 266948 - RNA, 64 nt, Homo Sapiens
agcuguguguccaucaacacacaaauucguaaaaaacacacauggccucgccaucguggguaaa

SEQ ID NO: 266949 - RNA, 64 nt, Homo Sapiens
aaaaagcacaagcccgcugcguguaaaacacacaaacacacacaacuucauuuggagauguaug

SEQ ID NO: 266950 - RNA, 64 nt, Homo Sapiens
cacacacaaaaaagcacaaggauguaugguguaaaacacacaaauaauaaauacuucauuugga

SEQ ID NO: 266951 - RNA, 64 nt, Homo Sapiens
acaccacagacacacacacgcacgcacacacacaaacacacaugcacacacacacaucucauuu

SEQ ID NO: 266952 - RNA, 64 nt, Homo Sapiens
agagaagauuguauaguuggggcuggucuuggugaacacacauuauuaccccacacauccccuu

SEQ ID NO: 266953 - RNA, 64 nt, Homo Sapiens
cgugcgccuucauagcccagccaugaugugagcaaacacacacaacacacagacacacauacac

SEQ ID NO: 266954 - RNA, 64 nt, Homo Sapiens
cagacacacauacacccaugcauacacaccccugaacacacacaacagacacacaacacacaca

SEQ ID NO: 266955 - RNA, 64 nt, Homo Sapiens
cauacacaccccugaacacaacacacagacacacaacacacacacacaugcacacccugaaaac

SEQ ID NO: 266956 - RNA, 64 nt, Homo Sapiens
gacacacaacacacacacauaugcacacccugaaaacacacacacucaaucuggcccucuccac

SEQ ID NO: 266957 - RNA, 64 nt, Homo Sapiens
acacacacgcgcuuuuccagaaaaacaaaaacaaaacacacacccauaaugcagcaguuucucc

SEQ ID NO: 266958 - RNA, 64 nt, Homo Sapiens
caggcuuccagcacauucuccacaugggccgcaaaacacacaguccaaaagaggucaccagaug

SEQ ID NO: 266959 - RNA, 63 nt, Homo Sapiens
acaaaagcaaauugucaaucaaaugaaacagaccaacacacaccauuaccuaaaaccagucca

SEQ ID NO: 266960 - RNA, 64 nt, Homo Sapiens
gagauaucuauacauauauacucugccauggggaaacacacacaucaaggcacaugagugugac

SEQ ID NO: 266961 - RNA, 64 nt, Homo Sapiens
uuugccccuuuuggaaugaucucugaauauauaaaacacacacacaaagagcaauaguuugccc

SEQ ID NO: 266962 - RNA, 64 nt, Homo Sapiens
uuugccccuuuuggaacgaccccugaauauauaaaacacacacacaccccgcgcacucucacuc

SEQ ID NO: 266963 - RNA, 64 nt, Homo Sapiens
cauucuucauaucaauuuuguauaaauauauagaaacacacacacagccucagacuuacaaacu

SEQ ID NO: 266964 - RNA, 64 nt, Homo Sapiens
gugugcauucugaggucuaacccggggugccaggaacacacacauccuccaucccagcauagag

SEQ ID NO: 266965 - RNA, 64 nt, Homo Sapiens
cuuucugugacgcagacagagcugaacucuucagaacacacagaguggguuugguuagaggaag

SEQ ID NO: 266966 - RNA, 64 nt, Homo Sapiens
caacaaaccucacugagaggcccgcuccucgggaaacacacaaggaaccaccacugccugacug

SEQ ID NO: 266967 - RNA, 64 nt, Homo Sapiens
ggcccacagcuucacgugguauggagaguuugcaaacacacagcauuugauuccagccuuggua

SEQ ID NO: 266968 - RNA, 64 nt, Homo Sapiens
uauauagugauuucuaaagaaaaauauauauauaaacacacauaaugauaauccuaauuauaua

SEQ ID NO: 266969 - RNA, 64 nt, Homo Sapiens
cuccuaggcaggacaugcugaagccaaagccaauaacacacagcuaacacacagcucccauaac

SEQ ID NO: 266970 - RNA, 64 nt, Homo Sapiens
gacaugcugaagccaaagccaauaacacacagcuaacacacagcucccauaaccgcugauucuc

SEQ ID NO: 266971 - RNA, 64 nt, Homo Sapiens
gcuaugcuguucuuuccauuccuuuucccucugaaacacacaaaauaccaaaggaacuuacgca

SEQ ID NO: 266972 - RNA, 64 nt, Homo Sapiens
agucuccaaaaaaauugaagucacccacaauuccaacacacagcaaucacugcuguuaauagug

SEQ ID NO: 266973 - RNA, 64 nt, Homo Sapiens
ugggggugaggcuggauuaauaaggucugugugaaacacacaugaauaaacucuguuuaaaaaa

SEQ ID NO: 266974 - RNA, 64 nt, Homo Sapiens
accaauaacucaaacaaaaauaugcaaaaaggaaaacacacacagacuaaauggacauauuucu

SEQ ID NO: 266975 - RNA, 64 nt, Homo Sapiens
ccagccucccgcggggccacacacuuccccucccaacacacacacacaccugccaucuugguca

SEQ ID NO: 266976 - RNA, 64 nt, Homo Sapiens
gggcagguggcgugagguccguguugccuucuuuaacacacacucgugcagugggggaguucug

SEQ ID NO: 266977 - RNA, 64 nt, Homo Sapiens
ucagcccaaguuccgucuuuggucuugguggauaaacacacaguguggagaucccacguacugc

SEQ ID NO: 266978 - RNA, 64 nt, Homo Sapiens
cauauuguagagagaugcucaguguuaaaacugaaacacacaaacacacacacacacacauuuu

SEQ ID NO: 266979 - RNA, 64 nt, Homo Sapiens
agagagaugcucaguguuaaaacugaaacacacaaacacacacacacacacauuuuucucuugu

SEQ ID NO: 266980 - RNA, 64 nt, Homo Sapiens
uucucaugguauuaucuaguaggucugcacacauaacacacaucaguccacccccauugugaau

SEQ ID NO: 266981 - RNA, 64 nt, Homo Sapiens
aaaacuuuccaugacaguagcauacugaugagacaacacacacacacacaaaacaacagcaaca

SEQ ID NO: 266982 - RNA, 64 nt, Homo Sapiens
cacacauuaauaucuaucuuuacauagacacacaaacacacacacacacacauacacacacaua

SEQ ID NO: 266983 - RNA, 64 nt, Homo Sapiens
cacacacauacacacacauacugucucccuccucaacacacacaccccuuuuagcuccuccaca

SEQ ID NO: 266984 - RNA, 64 nt, Homo Sapiens
ucccaucugcaccaguacacaggcaggcauuaucauucuucaccuacuuuuuaaauaguggcaa

SEQ ID NO: 266985 - RNA, 64 nt, Homo Sapiens
gcgagguggagggcuaacaagaggaaagaacuacauucuucagaauacagugaugaaaauucau

SEQ ID NO: 266986 - RNA, 64 nt, Homo Sapiens
ucacugcccaugugauacugaagccagacaccuaauucuucaguacgaguguaagauacacuuu

SEQ ID NO: 266987 - RNA, 64 nt, Homo Sapiens
ucacuacucaugugauacugaauccagacaccuaauucuucaguaaacuguuaagauaaacugu

SEQ ID NO: 266988 - RNA, 64 nt, Homo Sapiens
aaacauauacauauauacauacacacauacacauauucuucaggucucuaagccccuggaagca

SEQ ID NO: 266989 - RNA, 64 nt, Homo Sapiens
gccagaucacgggaacuugagagcuuuuacugugauucuucaauguaaaaaauaaacaacaaug

SEQ ID NO: 266990 - RNA, 64 nt, Homo Sapiens
uuuugcuaaaaauaugucuauacugacaaaaccuauucuucauagaaacacacuggauacugcc

SEQ ID NO: 266991 - RNA, 64 nt, Homo Sapiens
agucuugguuaaagaaugucauuuuacucaauccauucuucacaaauauugccuaugcugcucu

SEQ ID NO: 266992 - RNA, 64 nt, Homo Sapiens
caccacugcugcaugggucacucucggccucucaauucuucaggcucagucuggacucuacuua

SEQ ID NO: 266993 - RNA, 64 nt, Homo Sapiens
cacaguuuugucaccauggaacaccccaaaugccauucuucagcgugucugguaccuuggaugu

SEQ ID NO: 266994 - RNA, 64 nt, Homo Sapiens
ucuucucagugaauuuaagagaagcuguuugcucauucuucagagcucugagagcucugaggga

SEQ ID NO: 266995 - RNA, 64 nt, Homo Sapiens
guggggugucagacauaacuaugagaaaguucuaauucuucauguccacuggccacucugauag

SEQ ID NO: 266996 - RNA, 64 nt, Homo Sapiens
uauauaccuaauuaugugcacuggagaguaauuuauucuucauuaucauuuguaaacauuguuu

SEQ ID NO: 266997 - RNA, 64 nt, Homo Sapiens
gagaucguaggugaaaaaagaugggccauuaaggauucuucaaggaaaacauuccucaaaauga

SEQ ID NO: 266998 - RNA, 64 nt, Homo Sapiens
gcuuggaaagaugguuaguugauaccguccgaugauucuucaguaaagauagauucccacaaag

SEQ ID NO: 266999 - RNA, 64 nt, Homo Sapiens
uuggccuugggaaaaaccacguucuuccuuuccgauucuucauccggucuacgcuaugcaauuc

SEQ ID NO: 267000 - RNA, 64 nt, Homo Sapiens
uuugcugcugagccuagcugcaccuuucauucuuauucuucacucguggcaucugucagcuuuu

SEQ ID NO: 267001 - RNA, 64 nt, Homo Sapiens
acuuuaaaauggcuuuuuccaagaaauacgucucauucuucaauaauuuucaucaauaggaaaa

SEQ ID NO: 267002 - RNA, 64 nt, Homo Sapiens
guucaucaacauuuaagaaauuccccuguguaacauucuucauuggaagguuuuuuucuuuuuu

SEQ ID NO: 267003 - RNA, 64 nt, Homo Sapiens
auggaaagccacaagccucagugucaugauuuccauucuucaucaaaagccuguugccacuguu

SEQ ID NO: 267004 - RNA, 64 nt, Homo Sapiens
gucuucuauuuggucuugauuaagcauuuuucauauucuucacuccauuuuccuucuucuuuuu

SEQ ID NO: 267005 - RNA, 64 nt, Homo Sapiens
uguauacaucacaaggcucauucauuagccucagauucuucaucaaaaacaaaaaacaaaacaa

SEQ ID NO: 267006 - RNA, 64 nt, Homo Sapiens
uguucuacggggaggaaagaugggguccauuuuaauucuucauuaccuccuucagaggaugcua

SEQ ID NO: 267007 - RNA, 64 nt, Homo Sapiens
ggcaggauaauauuucaggacagccaaggcauuuauucuucagacaaaauuauguggugugaaa

SEQ ID NO: 267008 - RNA, 64 nt, Homo Sapiens
auaguaaaucuaugagcaacaaaaucguauucuaauucuucauuuaugguuuccucauuuuacu

SEQ ID NO: 267009 - RNA, 64 nt, Homo Sapiens
agggaaaacagcuagcuugaagucuaaacaaugaauucuucaacaagaaaguauaagggucaca

SEQ ID NO: 267010 - RNA, 64 nt, Homo Sapiens
auauuaguuuuguugcuucacaccuuggguuaaaauucuucaccgacaugggaaaccuaaguua

SEQ ID NO: 267011 - RNA, 64 nt, Homo Sapiens
acuuaguuauugucacacuacuaggcaauuauccauucuucaaggcaagagugccacauuauaa

SEQ ID NO: 267012 - RNA, 64 nt, Homo Sapiens
uaguagucuaggaaaaaguuacuccuuugaccucauucuucauagugugcuuucgccuuggcua

SEQ ID NO: 267013 - RNA, 64 nt, Homo Sapiens
aaugcauuuuggcauggugguauuuaaaaaauauauucuucaaagagcuuuuaggcauuaugua

SEQ ID NO: 267014 - RNA, 64 nt, Homo Sapiens
uacaaacugcagccuguaguaaacaccuagcuuuauucuucagagaaaugucuaaaugcugaaa

SEQ ID NO: 267015 - RNA, 64 nt, Homo Sapiens
gauaaugacauaguaauuguaauuauuuuucugaauucuucauggauuaucuuggugugcauuu

SEQ ID NO: 267016 - RNA, 64 nt, Homo Sapiens
cuagacuuccaaguuuguuucugcauuagauguaauucuucauugaaaggugggaagaauauua

SEQ ID NO: 267017 - RNA, 64 nt, Homo Sapiens
gcuauuacagcucauauauacuuuuuccaucuggauucuucacaaaagaauauguugugagcau

SEQ ID NO: 267018 - RNA, 64 nt, Homo Sapiens
gcuugagguaucauuaucaguuacaaauugaguuauucuucaucaaaugacuuuuggaguagag

SEQ ID NO: 267019 - RNA, 64 nt, Homo Sapiens
ccuaugucugucucuaccuuuuguucacuuuuguauucuucaguauaugaccugagaccacaau

SEQ ID NO: 267020 - RNA, 64 nt, Homo Sapiens
cagauaguggaaauagaacuagguaguaacugucauucuucaauugcagggcucuaagcuucag

SEQ ID NO: 267021 - RNA, 64 nt, Homo Sapiens
aacaagggaugcaugcagucaaauugauaguuuaauucuucaagugauaauauaggaaguuuca

SEQ ID NO: 267022 - RNA, 64 nt, Homo Sapiens
guuucacugccaaacagauucacuacucuuacugauucuucacugagcuuugcuaguauaagca

SEQ ID NO: 267023 - RNA, 64 nt, Homo Sapiens
ucccgugugcacgcugaacguguaguuuaugagaauucuucaaaaagaaagauauaaaggaucu

SEQ ID NO: 267024 - RNA, 64 nt, Homo Sapiens
aaacacagcccacuuauccaacgaggcuuugaaaauucuucaaaaaguaaacaugcagcugccg

SEQ ID NO: 267025 - RNA, 64 nt, Homo Sapiens
uugcuggaacccuugcuagcugacuuacagaccaaccaaccacccuguuucaaguacucaagac

SEQ ID NO: 267026 - RNA, 64 nt, Homo Sapiens
caccuugcuggaacccuugcagacugacuuacagaccaaccaacagaacuguuucaaguacuca

SEQ ID NO: 267027 - RNA, 64 nt, Homo Sapiens
ucacauguacagcuuucuacuucuuuguaagaacaccaaccaaccaagguuuaagugauuaaua

SEQ ID NO: 267028 - RNA, 64 nt, Homo Sapiens
auguacagcuuucuacuucuuuguaagaacaccaaccaaccaagguuuaagugauuaauaggcu

SEQ ID NO: 267029 - RNA, 64 nt, Homo Sapiens
aaccacccuaaaaugacagccaaccaaccaaccaaccaaccacaaaggaaagaaaacuaacaac

SEQ ID NO: 267030 - RNA, 64 nt, Homo Sapiens
cacaaaccacccuaaaaugacaaccaaccaaccaaccaaccaacuaaaaaggaaagaaaacuaa

SEQ ID NO: 267031 - RNA, 64 nt, Homo Sapiens
caaccacaaaccacccuaaacuaacaaccaaccaaccaaccaacaaauuaaaaaggaaagaaaa

SEQ ID NO: 267032 - RNA, 64 nt, Homo Sapiens
caaccaaccacaaaccacccaaaacuaacaaccaaccaaccaacauauaaauuaaaaaggaaag

SEQ ID NO: 267033 - RNA, 64 nt, Homo Sapiens
caaccaaccaaccacaaaccaaagaaaacuaacaaccaaccaacauauauauaaauuaaaaagg

SEQ ID NO: 267034 - RNA, 64 nt, Homo Sapiens
gccauuuuuacacacuugacuuuuuaaaaauacaaccaaccaaccaccacaacuucuuauacau

SEQ ID NO: 267035 - RNA, 64 nt, Homo Sapiens
uuuuuacacacuugacuuuuuaaaaauacaaccaaccaaccaccacaacuucuuauacauuugg

SEQ ID NO: 267036 - RNA, 64 nt, Homo Sapiens
gcugaagagauuuuagaacccguacaaucuaccaaccaaccagucccaagcaccaugucagugu

SEQ ID NO: 267037 - RNA, 64 nt, Homo Sapiens
cagugcugaagagauuuuaggugucguacaaucuaccaaccaaccccucccaagcaccauguca

SEQ ID NO: 267038 - RNA, 64 nt, Homo Sapiens
aucucguauuggcagaucuucuaucuagaauuguaccaaccaaaauauccaacuaaaaauuacg

SEQ ID NO: 267039 - RNA, 64 nt, Homo Sapiens
aaaauguaaucuaguuggcaagguguucagaaauaccaaccauauuugcacuuuguguggauug

SEQ ID NO: 267040 - RNA, 64 nt, Homo Sapiens
cccggugggggcacagcacaagcaccucccaccaaccaaccacaugccccccgguaugggaacc

SEQ ID NO: 267041 - RNA, 64 nt, Homo Sapiens
cacacccggugggggcacagaaccagcaccucccaccaaccaacccgaugccccccgguauggg

SEQ ID NO: 267042 - RNA, 64 nt, Homo Sapiens
cacacccggugggggcacagaaccagcaccucccaccaaccagcccgaugccccccaguauggg

SEQ ID NO: 267043 - RNA, 64 nt, Homo Sapiens
cacacccagugggggcacagaaccagcaccucccaccaaccagcccgaugccccccgguguggg

SEQ ID NO: 267044 - RNA, 64 nt, Homo Sapiens
cacucccgguggggacacagaaacagcaccucccaccaaccagcggggggcccccgggugcaga

SEQ ID NO: 267045 - RNA, 64 nt, Homo Sapiens
cacacuuccggauggagggaucacauaucgaauuaccaaccacuccaggaccucaacucggcca

SEQ ID NO: 267046 - RNA, 64 nt, Homo Sapiens
agaacaaagaggagcgguugaccaaccacuuuaaaccaaccacggagaaaugcacuuuugcacu

SEQ ID NO: 267047 - RNA, 64 nt, Homo Sapiens
uuaaaccaaccacgagaacaugcacuuuugcacuaccaaccacucccugacaccaguagagaaa

SEQ ID NO: 267048 - RNA, 64 nt, Homo Sapiens
ccaggaaugcacuuuaacaauauuucuauaguauaccaaccaccaaccagugugccaucuccaa

SEQ ID NO: 267049 - RNA, 64 nt, Homo Sapiens
cauauguauguauucacugaccaaaaauucacugaccaaccaaccaaacuccacacuucaucug

SEQ ID NO: 267050 - RNA, 64 nt, Homo Sapiens
uguauguauucacugaccaaaaauucacugaccaaccaaccaaacuccacacuucaucugaucc

SEQ ID NO: 267051 - RNA, 64 nt, Homo Sapiens
cucuaucagcaguggcccagaaucagcugccucuaccaaccaccccuuugaggcucuaaaggaa

SEQ ID NO: 267052 - RNA, 64 nt, Homo Sapiens
uggaaaaacccaauggggacaaccgaugaucuaaaccaaccacugggcauucaaacggagggca

SEQ ID NO: 267053 - RNA, 64 nt, Homo Sapiens
uauccaguguuguguaaagagacuggccaacaggaccaaccaagcaccuuaccucucccauaca

SEQ ID NO: 267054 - RNA, 64 nt, Homo Sapiens
aauaaauuaaucuauauugguugacaaacaagccaccaaccacugacugcaaaacugccugaug

SEQ ID NO: 267055 - RNA, 64 nt, Homo Sapiens
cuccaagaucaagauccuguucugagucagaugaugaugacagcagugaaacuccuccucacug

SEQ ID NO: 267056 - RNA, 64 nt, Homo Sapiens
cacuagaauuuggugaagaggaggaggaggagauugaugacaagcaaguuacucaggaaucaaa

SEQ ID NO: 267057 - RNA, 64 nt, Homo Sapiens
ugcuuccccuggaaaaaaaucguguuaagcuagaugaugacagugaugaugaugaagaaagcaa

SEQ ID NO: 267058 - RNA, 64 nt, Homo Sapiens
cauggacccuugguggcuuuuguaaauuaauuuuugaugacauuuugaguuuuaagauuucuga

SEQ ID NO: 267059 - RNA, 64 nt, Homo Sapiens
uuccaauagcuuauaugcccggaaauaguuuaagugaugacaaggccugauuuucaucuuuaua

SEQ ID NO: 267060 - RNA, 64 nt, Homo Sapiens
cuuuuuuuuuuuuguauguuacucaaggcauacaugaugacaguaaagcuucucagcugaggac

SEQ ID NO: 267061 - RNA, 64 nt, Homo Sapiens
agcuucuccagggccgacagcugagggcugcucccugcaucauccaagcaaugaccucagacuu

SEQ ID NO: 267062 - RNA, 64 nt, Homo Sapiens
cagagcgggugggcggggggugaauaugguuggccugcaucagguggccuucccauuuaagugc

SEQ ID NO: 267063 - RNA, 64 nt, Homo Sapiens
cgcacucuccuggacgccaucagugauggccaagcugcaucagccuucugcuccagcugcauca

SEQ ID NO: 267064 - RNA, 64 nt, Homo Sapiens
gugauggccaagcugcaucagccuucugcuccagcugcaucacacuggcugaagugaacgggcc

SEQ ID NO: 267065 - RNA, 64 nt, Homo Sapiens
ugcaaccuccgccucuuggguucaagcaauucugcugcaucagccucccgaguaccugggauua

SEQ ID NO: 267066 - RNA, 64 nt, Homo Sapiens
gacaccacguccucacucaccugcacaagaaucccugcaucagguucuccuuugaggguaccca

SEQ ID NO: 267067 - RNA, 64 nt, Homo Sapiens
uaacuuauaggaguuaacauuugaggacuuuguucugcaucagaucuuacuauuugaauguuua

SEQ ID NO: 267068 - RNA, 64 nt, Homo Sapiens
ggcaucuuauuacuguuacucaaaaacauugacucugcaucaagaaagaaacaagaaagcaaua

SEQ ID NO: 267069 - RNA, 64 nt, Homo Sapiens
uuuuuguauuaacaaaguuagggauggagauggucugcaucagcugacuuacuuaaccagguuu

SEQ ID NO: 267070 - RNA, 64 nt, Homo Sapiens
gguauacacacucguuagcgucguccacggucuucugcaucacuagcugccucugagcccucgc

SEQ ID NO: 267071 - RNA, 64 nt, Homo Sapiens
gcccuuccuuucuugggggaagcuccugcucccucugcaucagagcaguggccgucuccaccuc

SEQ ID NO: 267072 - RNA, 64 nt, Homo Sapiens
cugagccccauuugcuuccccaacaucacauuuucugcaucaccgcuuuauuuggauggccugg

SEQ ID NO: 267073 - RNA, 64 nt, Homo Sapiens
uuggucaaauuuugcugccucaauuuggacacaccugcaucacggguucaagaugcagauuucu

SEQ ID NO: 267074 - RNA, 64 nt, Homo Sapiens
caggcaacacucccagccuuaaagguccuuuuugcugcaucaccauuguguccaggacuggaau

SEQ ID NO: 267075 - RNA, 64 nt, Homo Sapiens
uauuuaacaaugacaagaugggaagccgaugugacugcaucauaaguacgagccccacagagca

SEQ ID NO: 267076 - RNA, 64 nt, Homo Sapiens
cauggaacacucaugucuggccuccacuccacaucugcaucacucugcagcaccucaccugaga

SEQ ID NO: 267077 - RNA, 64 nt, Homo Sapiens
ggcuuuaccccaaccugcagaaacauguuacagccugcaucaagaaccaauaacuucugcauca

SEQ ID NO: 267078 - RNA, 64 nt, Homo Sapiens
acauguuacagccugcaucaagaaccaauaacuucugcaucaaauuaccuugcccuuucuacuc

SEQ ID NO: 267079 - RNA, 64 nt, Homo Sapiens
aaauuggaauggcuggcuuggaacaaacagcuaacugcaucagcucagcccuuaauucucaggu

SEQ ID NO: 267080 - RNA, 64 nt, Homo Sapiens
cugcugucagaugaauaaauccuagcucuuuucacugcaucauaagggucaaggacucgugacu

SEQ ID NO: 267081 - RNA, 61 nt, Homo Sapiens
uguuuuuggucuguugaagaaaagcagggacugugaacauugugugugaacaaauggaaau

SEQ ID NO: 267082 - RNA, 61 nt, Homo Sapiens
uggaaauaaagcagggacuguuuaaagcgugugugaacaaacauguguuuuuuuuuuuuuu

SEQ ID NO: 267083 - RNA, 61 nt, Homo Sapiens
auuuugauuaauuaauaaggaauuaaguugaugugaacauagagcuauaauaaacuuguaa

SEQ ID NO: 267084 - RNA, 61 nt, Homo Sapiens
guuaaauagcaucaguuuguaauuaaauggcugugaacaauaaucuaaaauuuguuauuca

SEQ ID NO: 267085 - RNA, 61 nt, Homo Sapiens
uguaguucucuacauuucucuggauggagacugugaacaucugauuguucagcaaccuuca

SEQ ID NO: 267086 - RNA, 61 nt, Homo Sapiens
gcucucaucauaugcaaauucucagaagggcugugaacaccuuaguaauaaauuuaucuuu

SEQ ID NO: 267087 - RNA, 61 nt, Homo Sapiens
uuugagaaugaugcuacucugaucuaaugaaugugaacauguagauguuuuguguguauuu

SEQ ID NO: 267088 - RNA, 61 nt, Homo Sapiens
aaaauuuuguuaggccacaaaaacacugcacugugaacauuuuagaaaagguaugucagac

SEQ ID NO: 267089 - RNA, 61 nt, Homo Sapiens
auauguguguuuacacauaugucugcaugcaugugaacacacacacacacacacacacacc

SEQ ID NO: 267090 - RNA, 61 nt, Homo Sapiens
uguuucuauuuacaacugugcuuaucaaaauugugaacacccccacccccgcauuuuugug

SEQ ID NO: 267091 - RNA, 61 nt, Homo Sapiens
cgugucuggguugccuggggacagccucacaugugaacacccuuugugcuauguggagcuc

SEQ ID NO: 267092 - RNA, 61 nt, Homo Sapiens
uacuuuccuuuuuuacaugucucaaaaguuuugugaacaaguuacacacucacacacauaa

SEQ ID NO: 267093 - RNA, 61 nt, Homo Sapiens
cauuuucauuuucugggauaacagguuuuuaugugaacauagcugcugugaacauucaugu

SEQ ID NO: 267094 - RNA, 61 nt, Homo Sapiens
cauguacagguuuuuaugugaauaaagcugcugugaacauuuguuuucaguuuuuugcccu

SEQ ID NO: 267095 - RNA, 61 nt, Homo Sapiens
uaaagagcugauaacaguacucagaagaaucugugaacaaauacuugaaaauggguucaau

SEQ ID NO: 267096 - RNA, 61 nt, Homo Sapiens
gacugccauuauguguggucuucccauuaaaugugaacauuuuaauauguaugcauucacc

SEQ ID NO: 267097 - RNA, 64 nt, Homo Sapiens; identical to SEQ ID NO: 199615

SEQ ID NO: 267098 - RNA, 64 nt, Homo Sapiens; identical to SEQ ID NO: 199616

SEQ ID NO: 267099 - RNA, 64 nt, Homo Sapiens; identical to SEQ ID NO: 199617

SEQ ID NO: 267100 - RNA, 64 nt, Homo Sapiens; identical to SEQ ID NO: 199618

SEQ ID NO: 267101 - RNA, 64 nt, Homo Sapiens; identical to SEQ ID NO: 199619

SEQ ID NO: 267102 - RNA, 64 nt, Homo Sapiens; identical to SEQ ID NO: 199620

SEQ ID NO: 267103 - RNA, 64 nt, Homo Sapiens; identical to SEQ ID NO: 199621

SEQ ID NO: 267104 - RNA, 64 nt, Homo Sapiens; identical to SEQ ID NO: 199622

SEQ ID NO: 267105 - RNA, 64 nt, Homo Sapiens; identical to SEQ ID NO: 199623

SEQ ID NO: 267106 - RNA, 64 nt, Homo Sapiens; identical to SEQ ID NO: 199624

SEQ ID NO: 267107 - RNA, 64 nt, Homo Sapiens; identical to SEQ ID NO: 199625

SEQ ID NO: 267108 - RNA, 64 nt, Homo Sapiens; identical to SEQ ID NO: 199626

SEQ ID NO: 267109 - RNA, 64 nt, Homo Sapiens; identical to SEQ ID NO: 199627

SEQ ID NO: 267110 - RNA, 64 nt, Homo Sapiens; identical to SEQ ID NO: 199628

SEQ ID NO: 267111 - RNA, 64 nt, Homo Sapiens; identical to SEQ ID NO: 161976

SEQ ID NO: 267112 - RNA, 64 nt, Homo Sapiens; identical to SEQ ID NO: 161977

SEQ ID NO: 267113 - RNA, 64 nt, Homo Sapiens; identical to SEQ ID NO: 161978

SEQ ID NO: 267114 - RNA, 64 nt, Homo Sapiens; identical to SEQ ID NO: 161979

SEQ ID NO: 267115 - RNA, 64 nt, Homo Sapiens; identical to SEQ ID NO: 161980

SEQ ID NO: 267116 - RNA, 64 nt, Homo Sapiens; identical to SEQ ID NO: 161981

SEQ ID NO: 267117 - RNA, 64 nt, Homo Sapiens; identical to SEQ ID NO: 161982

SEQ ID NO: 267118 - RNA, 64 nt, Homo Sapiens; identical to SEQ ID NO: 161983

SEQ ID NO: 267119 - RNA, 64 nt, Homo Sapiens; identical to SEQ ID NO: 161984

SEQ ID NO: 267120 - RNA, 64 nt, Homo Sapiens; identical to SEQ ID NO: 161985

SEQ ID NO: 267121 - RNA, 64 nt, Homo Sapiens; identical to SEQ ID NO: 161986

SEQ ID NO: 267122 - RNA, 64 nt, Homo Sapiens; identical to SEQ ID NO: 161987

SEQ ID NO: 267123 - RNA, 64 nt, Homo Sapiens; identical to SEQ ID NO: 161988

SEQ ID NO: 267124 - RNA, 64 nt, Homo Sapiens; identical to SEQ ID NO: 161989

SEQ ID NO: 267125 - RNA, 64 nt, Homo Sapiens; identical to SEQ ID NO: 161990

SEQ ID NO: 267126 - RNA, 64 nt, Homo Sapiens; identical to SEQ ID NO: 161991

SEQ ID NO: 267127 - RNA, 64 nt, Homo Sapiens; identical to SEQ ID NO: 161992

SEQ ID NO: 267128 - RNA, 64 nt, Homo Sapiens; identical to SEQ ID NO: 161993

SEQ ID NO: 267129 - RNA, 64 nt, Homo Sapiens; identical to SEQ ID NO: 161994

SEQ ID NO: 267130 - RNA, 64 nt, Homo Sapiens; identical to SEQ ID NO: 161995

SEQ ID NO: 267131 - RNA, 64 nt, Homo Sapiens; identical to SEQ ID NO: 161996

SEQ ID NO: 267132 - RNA, 64 nt, Homo Sapiens; identical to SEQ ID NO: 161997

SEQ ID NO: 267133 - RNA, 64 nt, Homo Sapiens; identical to SEQ ID NO: 161998

SEQ ID NO: 267134 - RNA, 64 nt, Homo Sapiens; identical to SEQ ID NO: 161999

SEQ ID NO: 267135 - RNA, 64 nt, Homo Sapiens; identical to SEQ ID NO: 162000

SEQ ID NO: 267136 - RNA, 64 nt, Homo Sapiens; identical to SEQ ID NO: 162001

SEQ ID NO: 267137 - RNA, 64 nt, Homo Sapiens; identical to SEQ ID NO: 162002

SEQ ID NO: 267138 - RNA, 64 nt, Homo Sapiens; identical to SEQ ID NO: 162003

SEQ ID NO: 267139 - RNA, 64 nt, Homo Sapiens; identical to SEQ ID NO: 162004

SEQ ID NO: 267140 - RNA, 64 nt, Homo Sapiens; identical to SEQ ID NO: 162005

SEQ ID NO: 267141 - RNA, 64 nt, Homo Sapiens; identical to SEQ ID NO: 162006

SEQ ID NO: 267142 - RNA, 64 nt, Homo Sapiens; identical to SEQ ID NO: 162007

SEQ ID NO: 267143 - RNA, 64 nt, Homo Sapiens; identical to SEQ ID NO: 162008

SEQ ID NO: 267144 - RNA, 64 nt, Homo Sapiens
cauucaugcaaugacuauuucuaaagcaccugcuacacagcaggcuguacacagcagaucagua

SEQ ID NO: 267145 - RNA, 64 nt, Homo Sapiens
cuauuucuaaagcaccugcuacacagcaggcuguacacagcagaucaguacuguucaacagaac

SEQ ID NO: 267146 - RNA, 64 nt, Homo Sapiens
auauaggggaguuguauggaaaaauaguagaauuacacagcaugaaaagcagcccaugguuuaa

SEQ ID NO: 267147 - RNA, 64 nt, Homo Sapiens
uuuucccuucugccuucaccuuugccguggguggacacagcaagaaggcccucaucagaugcug

SEQ ID NO: 267148 - RNA, 64 nt, Homo Sapiens
uuccaccccaguccuauuuggagauuaaauauaaacacagcaagauacuacgcauauacgguaa

SEQ ID NO: 267149 - RNA, 64 nt, Homo Sapiens
acucuaucucaaaaaaaagaauccacccuggguaacacagcaaggugagcuaugaucagcugca

SEQ ID NO: 267150 - RNA, 64 nt, Homo Sapiens
accccaucucuacaaaaauaaacuagcccagguaacacagcaagucuaauauagaaacucacau

SEQ ID NO: 267151 - RNA, 64 nt, Homo Sapiens
augggggauuuucccucugcucccacccaccuaaacacagcagccauuuguaccuguuugcuuc

SEQ ID NO: 267152 - RNA, 64 nt, Homo Sapiens
cugguaagacaaguacauccacucaugaaugcagacacagcagcuggugguuuuguguauaccu

SEQ ID NO: 267153 - RNA, 64 nt, Homo Sapiens
caguggcaggcaguagugaaacaugcucacagucacacagcaggagacccagagaggcugaaug

SEQ ID NO: 267154 - RNA, 64 nt, Homo Sapiens
auuuggcaggugagccuuacguuuucucaaagccacacagcaagaggcucagagagguuaugug

SEQ ID NO: 267155 - RNA, 64 nt, Homo Sapiens
aggagagggagguggcgcugggggaagccaacagacacagcagggcuaacuaacuuacauuugu

SEQ ID NO: 267156 - RNA, 64 nt, Homo Sapiens
ccugauaugggaucccuuaggcaguuugguuucaacacagcagagcagaaacguugguaaaagg

SEQ ID NO: 267157 - RNA, 64 nt, Homo Sapiens
agagaugacucagcacugucccuuagcagggaugacacagcaaggaugacucagcacugccccu

SEQ ID NO: 267158 - RNA, 64 nt, Homo Sapiens; identical to SEQ ID NO: 267157

SEQ ID NO: 267159 - RNA, 64 nt, Homo Sapiens
agggaugacucagcacugucccuuagcagugaugacacagcaaggaugacucagcacugccccu

SEQ ID NO: 267160 - RNA, 64 nt, Homo Sapiens
agggaugacucagcagugucccuuagcagcgaugacacagcaaggaugacucagcacugccccu

SEQ ID NO: 267161 - RNA, 64 nt, Homo Sapiens
caucuuuaggggucuggauuuuguagguccgacuacacagcaguguuaacucauuucucaugcc

SEQ ID NO: 267162 - RNA, 64 nt, Homo Sapiens
aauuagaaaacaugaaauagggaacuccagacugacacagcaguuguuuuugaaaaggaaauaa

SEQ ID NO: 267163 - RNA, 64 nt, Homo Sapiens
cacaagugcacagagcacaccaggugcacagaccacacagcacaggccacacagcacaugcaca

SEQ ID NO: 267164 - RNA, 64 nt, Homo Sapiens
ugcacacaggugcacagaccaaagugcauaggccacacagcacagcacuaacacaugcacacac

SEQ ID NO: 267165 - RNA, 64 nt, Homo Sapiens
aacacaugcacacacaaaguagugcacagaccacacacagcacuacacaguauacacauacaca

SEQ ID NO: 267166 - RNA, 64 nt, Homo Sapiens
aaacuuuuagauuggauuguuugcuauugcucugugugaggauacauaaucuuucaguaaacug

SEQ ID NO: 267167 - RNA, 64 nt, Homo Sapiens
cuuggauacaguuugcuuguaauauuuuuaauaaugugaggaguacaguguuuucuaauucauu

SEQ ID NO: 267168 - RNA, 64 nt, Homo Sapiens
gagaagaacaaugucaaaugccucacagggguguugugaggacuaauggggucaauaccaccua

SEQ ID NO: 267169 - RNA, 64 nt, Homo Sapiens
cacuaaaccuuuccgugccucccaccacgcggccugugaggagcccagagcaccacucugcugc

SEQ ID NO: 267170 - RNA, 64 nt, Homo Sapiens
uaucgggaagauuucuaaaugauguguauauauaugugaggaugaaaaaaacccauguggugau

SEQ ID NO: 267171 - RNA, 64 nt, Homo Sapiens
cccaucugucuaaagauagacguuuggaagauccugugaggagcuaggguugguuccuuuccaa

SEQ ID NO: 267172 - RNA, 64 nt, Homo Sapiens
uuuuggcucuuaagauauccuggguuaaagcuucugugaggaccuccauauucuuaugauuacu

SEQ ID NO: 267173 - RNA, 64 nt, Homo Sapiens
aaaguaaaacauguuuaauuaauuuuuauguucuugugaggaaacccuguuaagucccuuccgu

SEQ ID NO: 267174 - RNA, 64 nt, Homo Sapiens
ucuugggaagagguuucuguaaccccugcccuggugugaggaggaaauggcucuggccuggcug

SEQ ID NO: 267175 - RNA, 64 nt, Homo Sapiens
uaaaaaccauuuuucuaauucuaacaaguuagaaugugaggaaggaaugaacaugaguguuuag

SEQ ID NO: 267176 - RNA, 64 nt, Homo Sapiens
aguaucuugagauucaccuggagaaggcaaaugaugugaggauuggucaagacgagggaaauau

SEQ ID NO: 267177 - RNA, 64 nt, Homo Sapiens
uagauguuugcuaacuucaacuaccuuguagagaugugaggauugagaagaaucauacuuugac

SEQ ID NO: 267178 - RNA, 64 nt, Homo Sapiens
gggggaaggcaguguggucccuacccugugugaaugugaggauguagacauccaucagugcaac

SEQ ID NO: 267179 - RNA, 64 nt, Homo Sapiens
ugauuuaucugggagaaaacuguggugcacagcuugugaggagggcaagguugugacguucgag

SEQ ID NO: 267180 - RNA, 64 nt, Homo Sapiens
uuugacucagugacaaucauauuauuacaggguuugugaggaccuuauuuccagaauuuuagac

SEQ ID NO: 267181 - RNA, 64 nt, Homo Sapiens
uuguaagucagcauaaaaauucuauaaguuuuuaugugaggacuggcaaagaggguugauuaaa

SEQ ID NO: 267182 - RNA, 64 nt, Homo Sapiens
uguccucagcgacauuucugaugugcugcucuuaugugaggaccagugcuuucucucuuugcac

SEQ ID NO: 267183 - RNA, 64 nt, Homo Sapiens
gauggcacgggcuccucagagcgugguagccgacugugaggaaaagcagagggaaugugaaaga

SEQ ID NO: 267184 - RNA, 64 nt, Homo Sapiens
gggcccccacaggggauggugaaggggccugggcugugaggacacucuuccugucuaacuuggg

SEQ ID NO: 267185 - RNA, 64 nt, Homo Sapiens
gagacuugcaguuagacucauauuuuuaauuuccugugaggauaagauguaggaaccgaucugc

SEQ ID NO: 267186 - RNA, 64 nt, Homo Sapiens
gguugucucucuucgguggcggaccccagauaccugugaggacuuugauaucccaaguuggaag

SEQ ID NO: 267187 - RNA, 64 nt, Homo Sapiens
gagaggagaaaugagaagaaggcuggggagagccugugaggaccugggcgagcugggcgagcug

SEQ ID NO: 267188 - RNA, 64 nt, Homo Sapiens
gggguggugggaagaauuggccuuugcgaugggcugugaggauggcagggccuacaacgagggg

SEQ ID NO: 267189 - RNA, 64 nt, Homo Sapiens
acuuaaugcaggaagaacaugacaaccaagcaaaugugaggagucuggugaccuggggcaacuu

SEQ ID NO: 267190 - RNA, 64 nt, Homo Sapiens
cuuccgcuauagaauggaguguccagaaauagacugugaggaaggaugggccuugcugaagugu

SEQ ID NO: 267191 - RNA, 64 nt, Homo Sapiens
ucucagacaaaggcaaggcccugaucagcuguggugugaggacuugcuuccccauuguuuccau

SEQ ID NO: 267192 - RNA, 64 nt, Homo Sapiens
ugcagacccaaacccacguggcuggacaggcgggugugaggaguucgaccguggccgcuggcug

SEQ ID NO: 267193 - RNA, 64 nt, Homo Sapiens
uagaacuccaagauguuccauaaguguuuuuacuugugaggaaugagaagccauccauggaaau

SEQ ID NO: 267194 - RNA, 64 nt, Homo Sapiens
gucuuccuucuguagccauuaacugcugaauccaugugaggaagacaggcuucccuuccuuccc

SEQ ID NO: 267195 - RNA, 64 nt, Homo Sapiens
aaggggggcaaugauaccuaccucacagggguguugugaggauuaaaugugaggaggauagugg

SEQ ID NO: 267196 - RNA, 64 nt, Homo Sapiens
auaccuaccucacagggguguugugaggauuaaaugugaggaggauaguggcagaugagugaug

SEQ ID NO: 267197 - RNA, 64 nt, Homo Sapiens
gccgucucccugcuugacucauggucuucaagguugugaggaaaguuguacaucaugaugacug

SEQ ID NO: 267198 - RNA, 64 nt, Homo Sapiens
cugcacguccucagcagagugcucugugaguggcugugaggaugggggggacggcgacagcgcg

SEQ ID NO: 267199 - RNA, 64 nt, Homo Sapiens
gguucugcagcuugaguccuuugugaaaauggggugugaggaguacaaccagccaaaugcacuu

SEQ ID NO: 267200 - RNA, 64 nt, Homo Sapiens
ggagcuuucuggaaguacuuuguaggcaucacauugugaggaagaauuuagaauagccaggguc

SEQ ID NO: 267201 - RNA, 64 nt, Homo Sapiens
ccuggcccuccuggugcccacucccgccagccccugccucgaggacugauacugcagugacugc

SEQ ID NO: 267202 - RNA, 64 nt, Homo Sapiens
caugguccucauaucucccaugggaauccuguccugccucgaaggagcagccugggcagccauc

SEQ ID NO: 267203 - RNA, 64 nt, Homo Sapiens
caggucuccaaguggaacccgguccagacagggcugccucgacuucaccuuucccccuaacuuc

SEQ ID NO: 267204 - RNA, 64 nt, Homo Sapiens
agccauggcaacgggcccagccuccugccacuggugccucgagugccucagcccuagacucccu

SEQ ID NO: 267205 - RNA, 64 nt, Homo Sapiens
caccggcgcugcagguacuuagcccgugaagcagugccucgagguggccugcugggaaccccgc

SEQ ID NO: 267206 - RNA, 64 nt, Homo Sapiens
cucuggagguuggagcaucaaaccugucuugcugugccucgaaauggagggaaggacauuacug

SEQ ID NO: 267207 - RNA, 64 nt, Homo Sapiens
gcaaaccaaggggguuuauagucaucugucgcauugccucgaguugcaguaauugaaaaaaugc

SEQ ID NO: 267208 - RNA, 64 nt, Homo Sapiens
caugguggcccaccuggccugguuguccaagcugugccucgacacauccucauccccagcaugg

SEQ ID NO: 267209 - RNA, 64 nt, Homo Sapiens
ggagauccccgaucacuggcggaggccuggucucugccucgacgugccucgcuggggcggucuu

SEQ ID NO: 267210 - RNA, 64 nt, Homo Sapiens
cagaguuucccgugagcaauauagcauuuuugccugccucgagguucuccuaauacaacccgua

SEQ ID NO: 267211 - RNA, 64 nt, Homo Sapiens
ccggaaugagccuucgacccugaaauccuuggggugccucgaggacgacuggccgaaaagccgc

SEQ ID NO: 267212 - RNA, 64 nt, Homo Sapiens
aaaccgaaacgugaccacgcacaaaggcagucacugccucgaggggugcagaccgcagaauuuu

SEQ ID NO: 267213 - RNA, 64 nt, Homo Sapiens
uccuccuaggcgcucagaggccgcucugggggguugccucgaguccccccaccccuccccaccc

SEQ ID NO: 267214 - RNA, 64 nt, Homo Sapiens
gaccuuaaaaaagcaagaaggccaugaccaucccugccucgaaacuugcaagucacuugucuga

SEQ ID NO: 267215 - RNA, 64 nt, Homo Sapiens
cagucaaauggaguauugcgaagcgucgccucucugccucgaacccauccuguucuauggaaua

SEQ ID NO: 267216 - RNA, 64 nt, Homo Sapiens
auaaguccagaagcacuggauaguaaguacaccaugccucgaaaucuuugggccaggcauggcc

SEQ ID NO: 267217 - RNA, 64 nt, Homo Sapiens
acccaccagaccaagaaggcgcaagguucucaacugccucgagucgaggugcccgcucagcuca

SEQ ID NO: 267218 - RNA, 64 nt, Homo Sapiens
ucccaaaguacugggauuacucaagugauccaccugccucgacccuggucuugaacuccugaac

SEQ ID NO: 267219 - RNA, 64 nt, Homo Sapiens
uggaagcuguauagagcccguccuuucuuccucuugccucgaggacgggacugcuugcugccuc

SEQ ID NO: 267220 - RNA, 64 nt, Homo Sapiens
ggaccccuugaaggcugucggacagcagucuugaugccucgacgagacgcuggccucagacaca

SEQ ID NO: 267221 - RNA, 64 nt, Homo Sapiens
guuuuggaaggauuccuuuuucuguagaauacuuugccucgauauauaagcauacagaugcacu

SEQ ID NO: 267222 - RNA, 64 nt, Homo Sapiens
uccaugggucucuucguguucucaacgcugccccugccucgaccaaagcaauaacucaccaaag

SEQ ID NO: 267223 - RNA, 64 nt, Homo Sapiens
gugucaucaauuuguaauuucaguuacccugcuuugccucgaaaugauggcaacacugaaggaa

SEQ ID NO: 267224 - RNA, 56 nt, Homo Sapiens
cgugggcuccccucuuccucacuugcugccucgacagcuuugccacugccgccuag

SEQ ID NO: 267225 - RNA, 64 nt, Homo Sapiens
cuggucuccaacuccugaccucaggugauccaccugccucgaccucacaaagugcugggauuac

SEQ ID NO: 267226 - RNA, 64 nt, Homo Sapiens
gauuuuccucuguuuuucacaguccugcuucuuuugccucgaguucagaacuaacccaggacuc

SEQ ID NO: 267227 - RNA, 64 nt, Homo Sapiens
gcauucaggaagcccugcaacccucaugaagccaugccucgacgcaucggggugcccgcgaugg

SEQ ID NO: 267228 - RNA, 64 nt, Homo Sapiens
ucacaaagugcugggauuacucaggugauccaccugccucgacccuggucuccaacuccugacc

SEQ ID NO: 267229 - RNA, 64 nt, Homo Sapiens
ccucucuggcgcaucaccugacguugccuggcccugccucgauggauugcucccuccugugugg

SEQ ID NO: 267230 - RNA, 64 nt, Homo Sapiens
gaaggugaccucugccccagaggucagugcuucgugccucgauuucagggcuacagcaguaggg

SEQ ID NO: 267231 - RNA, 64 nt, Homo Sapiens
ccugcugagccugcccccuggauuggcuguaauuugccucgaaguucagcaguucaucuucaug

SEQ ID NO: 267232 - RNA, 64 nt, Homo Sapiens
cuaugaucugagcaagcaggugagcugugugaucugccucgaggguuccaguccaugugcaucc

SEQ ID NO: 267233 - RNA, 64 nt, Homo Sapiens
cucacgaaccgccagcgugggcuauauuuaguggugccucgacauaaugaguggacggcagaca

SEQ ID NO: 267234 - RNA, 64 nt, Homo Sapiens
auuuuauuaaggcacgaagaugcugguuugggcuugccucgaagugcugauaaugcugcagccc

SEQ ID NO: 267235 - RNA, 64 nt, Homo Sapiens
agccuggcauccccagucuuugccuucuuccagcugccucgacacagcacuguggccugucccu

SEQ ID NO: 267236 - RNA, 56 nt, Homo Sapiens
ccguuuugcccccgcucuuuagccucugccucgaugagaugggggaggagccauag

SEQ ID NO: 267237 - RNA, 64 nt, Homo Sapiens
gaugcgagugcggcggucuuuggagggacaaucgugccucgauguagaucccuguguuccagcg

SEQ ID NO: 267238 - RNA, 64 nt, Homo Sapiens
ugucuuccaguauuacgguggagcaucaggaccuugccucgaauuggcaaacaaaacccgagcu

SEQ ID NO: 267239 - RNA, 64 nt, Homo Sapiens
ggcuggucucaaacuccuaaccucgugauccgccugccucgaccucccaaagugcugggauuac

SEQ ID NO: 267240 - RNA, 64 nt, Homo Sapiens
acugcaaccuccaccuuccugguucaagcgauucugccucgaccucucaaguagcugggauuac

SEQ ID NO: 267241 - RNA, 64 nt, Homo Sapiens
gcugguccagcugugcccagaucugucacugaugugccucgaaagauccgguguuuguggcucc

SEQ ID NO: 267242 - RNA, 64 nt, Homo Sapiens
gguaguccucugcgucagggagcacuuuuuuguuugccucgagacuacucauuagcgcacuggc

SEQ ID NO: 267243 - RNA, 64 nt, Homo Sapiens
cugagcuggaaaaucuugaaccugggggaccuuuugccucgagggggcugcacugacauugaug

SEQ ID NO: 267244 - RNA, 64 nt, Homo Sapiens
ggauggggugggggcgggcuccccuagggacaggugccucgagugcccgugccuggggucccgc

SEQ ID NO: 267245 - RNA, 64 nt, Homo Sapiens
ggucccaaggucccugggaggacugggccccucaugccucgagcuuggcaaccgaaaacccgag

SEQ ID NO: 267246 - RNA, 64 nt, Homo Sapiens
ggucugcauaaugaucccauuucagccugugcucugccucgauuguuguguuggacauuccggu

SEQ ID NO: 267247 - RNA, 64 nt, Homo Sapiens
gguugaugaucuuugcagacaggcaagcaccuccugccucgaacuggcugcaaaggguaucagg

SEQ ID NO: 267248 - RNA, 64 nt, Homo Sapiens
cuggucaccagauuguuuuguaaugcccgccccuugccucgauauugccaguuucuugugcaau

SEQ ID NO: 267249 - RNA, 64 nt, Homo Sapiens
ucacugccuuccggagcugcugccgugcugaggcugccucgagguggaagaggacccaagagag

SEQ ID NO: 267250 - RNA, 64 nt, Homo Sapiens
ccaagaugccuaaaaaagcuccccacaucccuucugccucgaggcauccaggcaccugccuaua

SEQ ID NO: 267251 - RNA, 64 nt, Homo Sapiens
cauagagccugaaaucaucuuucauccagggaaaugccucgagcaagucuuuuugaaguguuau

SEQ ID NO: 267252 - RNA, 63 nt, Homo Sapiens
ugccgcagggguccgggauuuuuauuucuucaaugccucgaccaggagccaccucuccuuuaa

SEQ ID NO: 267253 - RNA, 64 nt, Homo Sapiens
cugcccuuggucguuccugacuaacuaucuaucuugccucgaaagacagugaaagagaucugac

SEQ ID NO: 267254 - RNA, 64 nt, Homo Sapiens
ugcccggucagcgcagccccagcccgcccaccccugccucgaguuaguuuuacaauuaaaacau

SEQ ID NO: 267255 - RNA, 64 nt, Homo Sapiens
ccccagagcaauaaagucagcuggcuuucucaccugccucgacugggccucccuuuuugaaacg

SEQ ID NO: 267256 - RNA, 64 nt, Homo Sapiens
ccuggaucuccaagcucagcaccccagauccccaugccucgagccgcuggauccuagaucccca

SEQ ID NO: 267257 - RNA, 64 nt, Homo Sapiens
ugaggcaacuccuuuccccgcuucagcccucaacugccucgaguccugugaugguccagggaau

SEQ ID NO: 267258 - RNA, 64 nt, Homo Sapiens
gguggcgggaccguucccaggagguaccagcaccugccucgaucuccucugagccucuucugcc

SEQ ID NO: 267259 - RNA, 64 nt, Homo Sapiens
ggcuggucucgaacuccugaccucgugauccgccugccucgacuucccagagugcugggauuac

SEQ ID NO: 267260 - RNA, 64 nt, Homo Sapiens
acacaugcagccccuggagggcagccucuuccugugccucgauggggugggugggagggcaucu

SEQ ID NO: 267261 - RNA, 64 nt, Homo Sapiens
gaaggccggguggagcccauccaugcugugguguugccucgagggaagucgcuggaccagugug

SEQ ID NO: 267262 - RNA, 64 nt, Homo Sapiens
gccgccugccuuagcaauggauccccacgaccccugccucgagguugcaggcggcccucagugc

SEQ ID NO: 267263 - RNA, 64 nt, Homo Sapiens
cgccuggguuucuuggccccagcugcccagcaggugccucgauucccugcccuugugaccuccc

SEQ ID NO: 267264 - RNA, 64 nt, Homo Sapiens
ccugugucucccuaauauguaucaaagcaagcugugccucgaccaccuugggcacauauccuca

SEQ ID NO: 267265 - RNA, 64 nt, Homo Sapiens
ccacgauggaucgcugguuuggaugucugucuuuugccucgaagaguaguguaaacugcgucuc

SEQ ID NO: 267266 - RNA, 64 nt, Homo Sapiens
ggcccagggaagccugggugagggggugaccucuugccucgagggguguggcucugcccuggaa

SEQ ID NO: 267267 - RNA, 64 nt, Homo Sapiens
uucuacaucagaucaaaacacuaaguugguguacugccucgaccuuuuuucagcucauccugga

SEQ ID NO: 267268 - RNA, 64 nt, Homo Sapiens
cacagaaaccuuuuuaaaaaaaaucuuuuacaacugccucgaaaagugggcuugauucugcagu

SEQ ID NO: 267269 - RNA, 64 nt, Homo Sapiens; identical to SEQ ID NO: 53427

SEQ ID NO: 267270 - RNA, 64 nt, Homo Sapiens; identical to SEQ ID NO: 53428

SEQ ID NO: 267271 - RNA, 64 nt, Homo Sapiens; identical to SEQ ID NO: 53429

SEQ ID NO: 267272 - RNA, 64 nt, Homo Sapiens; identical to SEQ ID NO: 53430

SEQ ID NO: 267273 - RNA, 64 nt, Homo Sapiens; identical to SEQ ID NO: 53431

SEQ ID NO: 267274 - RNA, 64 nt, Homo Sapiens; identical to SEQ ID NO: 53432

SEQ ID NO: 267275 - RNA, 64 nt, Homo Sapiens; identical to SEQ ID NO: 53433

SEQ ID NO: 267276 - RNA, 64 nt, Homo Sapiens; identical to SEQ ID NO: 53434

SEQ ID NO: 267277 - RNA, 64 nt, Homo Sapiens
ggcaaaaucuuugguucaggguacuaguuguuuaaaaguugauucauauucuuaccuugugcug

SEQ ID NO: 267278 - RNA, 64 nt, Homo Sapiens
ucagcaucuguuuaugguaguaggagaaauagccaaaguugaggauuuuauguauguuuuccug

SEQ ID NO: 267279 - RNA, 64 nt, Homo Sapiens
ucauauuuauaugggggggagggcgcuggaugcaaaaguugaagaucgugaugcuaugauguua

SEQ ID NO: 267280 - RNA, 64 nt, Homo Sapiens
aacuuauuaauauuuuugaaaaaugcacugggaaaaaguugaugucaauaacaguauaaaacag

SEQ ID NO: 267281 - RNA, 64 nt, Homo Sapiens
ucuagaagcuccagugauaagagauguugacucuaaaguugauuuaaggccaggcauggugguu

SEQ ID NO: 267282 - RNA, 64 nt, Homo Sapiens
aaauaaauaaauaaauaaauaaauaaauaaaaacaaaguugauuaagaaaggaaguauaggcca

SEQ ID NO: 267283 - RNA, 64 nt, Homo Sapiens
uagaaucccaauuaacaaaauauacuuuaucuucaaaguugaugucauuuaaaauuuuuccguc

SEQ ID NO: 267284 - RNA, 64 nt, Homo Sapiens
uauguuuaaucuguauuucuugcuuauuauauguaaaguugagcuucuuucuagauauuaggcc

SEQ ID NO: 267285 - RNA, 64 nt, Homo Sapiens
uuacuuaccuuguaaauaacuuuaauaauauucaaaaguugacucuccuguggcucaugccaca

SEQ ID NO: 267286 - RNA, 64 nt, Homo Sapiens
gggugacagagugagacuccaucucaaaaaaaaaaaaguugacucuacccccuaauuugguagg

SEQ ID NO: 267287 - RNA, 64 nt, Homo Sapiens
gauuauagugaguacccuuaaaaguaaaaguuucaaaguugaaauuuuaauuuugggaaauuuu

SEQ ID NO: 267288 - RNA, 64 nt, Homo Sapiens
auguuccugcauuucagcaggauuuuuacauuaaaaaguugaauugcaucauggaacgccacag

SEQ ID NO: 267289 - RNA, 64 nt, Homo Sapiens
guuaaagaacauaaguggauucucuuagaaaaacaaaguugauaggcaacagaacgagauccca

SEQ ID NO: 267290 - RNA, 64 nt, Homo Sapiens
aacuucugguuugguuuagaccuaaaggagaggaaaaguugauuucuuaaauauccuuuuuguu

SEQ ID NO: 267291 - RNA, 64 nt, Homo Sapiens
aaccacccaagaugacuaccuuauaauuuauuuaaaaguugaaaacuuccuuuagaaggaacug

SEQ ID NO: 267292 - RNA, 64 nt, Homo Sapiens
cauuuguucccaggauuuaugacauacuuuuccuaaaguugaagguacuacgaucacagacaca

SEQ ID NO: 267293 - RNA, 64 nt, Homo Sapiens
cuuuuguuuugcuuuguuuguuuugcuguaagaaaaaguugagagcgguguagguguugugagc

SEQ ID NO: 267294 - RNA, 64 nt, Homo Sapiens
ugcggaaaauguuuucuugggucaugcuuuuuaaaaaguugaugcaaguaaaaggaauaaaugu

SEQ ID NO: 267295 - RNA, 64 nt, Homo Sapiens
agauauucuggacucagcagaagaauucucggcaaaaguugauaucgaaguugacagcccaaac

SEQ ID NO: 267296 - RNA, 64 nt, Homo Sapiens
uuuggucaaaccaaugacaaaaccgccuuccacaaaaguugaaauaagaaacaagaguauuacu

SEQ ID NO: 267297 - RNA, 64 nt, Homo Sapiens
uaaaagcacauuucauguguauucaacccuaaguaaaguugaaugaaacuuaacagaauggaaa

SEQ ID NO: 267298 - RNA, 64 nt, Homo Sapiens
auuucuaagguugugcuaauucuuuugguugugaaaaguugaauuuuucuguugccuucguuuu

SEQ ID NO: 267299 - RNA, 64 nt, Homo Sapiens
uuuuuuuuuuuucaaaaaggaaaguuuuuaauggaaaguugagccagaacuaaaccagggagcu

SEQ ID NO: 267300 - RNA, 64 nt, Homo Sapiens
ggccacuccuggguuggagcccgauuuuauuuguaaaguugacagucgagcaaauguuccuauu

SEQ ID NO: 267301 - RNA, 64 nt, Homo Sapiens
ugcacuucgcaacugacuucuuguccugggguuaaaaguugaagauauuuucugaugauauuaa

SEQ ID NO: 267302 - RNA, 64 nt, Homo Sapiens
gguuaaaaguugaagauauuuucugaugauauuaaaaguugaagauauuucugcacuugggccc

SEQ ID NO: 267303 - RNA, 64 nt, Homo Sapiens
gugcugucaugcugccugcuuucuggagcuguagaaaguugaaacaccuggcgcagauugcagc

SEQ ID NO: 267304 - RNA, 64 nt, Homo Sapiens
uuccacccuugacugccaaaaaugugugaaauggaaaguugauggcagcagggccgacgauguc

SEQ ID NO: 267305 - RNA, 64 nt, Homo Sapiens
agaaugguggcgugcucauuaauaaaaaggagccaaaguugaucgaauuaguguaugcuuccug

SEQ ID NO: 267306 - RNA, 64 nt, Homo Sapiens
uugacuacaauaaaaauccacugcaacaauauguaaaguugauaaaagggcauagcacagcaau

SEQ ID NO: 267307 - RNA, 64 nt, Homo Sapiens
uauuuaagcaugugguuuuaaaaauagacaguauuuuuuaaaaaucaaaaaaugacuugcaaau

SEQ ID NO: 267308 - RNA, 64 nt, Homo Sapiens
uuuuuuaaaaaucaaaaaaugacuugcaaauuguuuuuuaaaaguaauuuugcauugcuuugaa

SEQ ID NO: 267309 - RNA, 64 nt, Homo Sapiens
gagugaaggaggcaggugggaaaugguauuucuauuuuuaaauccagugaaauuaucuugaguc

SEQ ID NO: 267310 - RNA, 64 nt, Homo Sapiens
aaauccagugaaauuaucuugagucuacacauuauuuuuaaaacacaaaaauuguucggcugga

SEQ ID NO: 267311 - RNA, 64 nt, Homo Sapiens
gaggcagggaguuauuuuagauuaugggaaauaauuuuuaaagguauugguuaaauaacguuua

SEQ ID NO: 267312 - RNA, 64 nt, Homo Sapiens
ggccucacuuuagaaugaaugagucaccuugugauuuuuaaauuuuuauuuuaauaaagcuaau

SEQ ID NO: 267313 - RNA, 64 nt, Homo Sapiens
ugagugaaauauuuuaagccaaaaaaaaauucccuuuuuaaaaaaggggguuuaaauacuguug

SEQ ID NO: 267314 - RNA, 64 nt, Homo Sapiens
uguuuuuguuuugauuuuuuuuuuguuuugauuuuuuuuaaacuaaagcuauauaaagcuugug

SEQ ID NO: 267315 - RNA, 64 nt, Homo Sapiens
ugcugaaaauaaaacuuugcuauguauuuacucuuuuuuaaaagacaaaagcaaaaccagacuu

SEQ ID NO: 267316 - RNA, 64 nt, Homo Sapiens
aguacacaggcaggcauuaucauucuucaccuacuuuuuaaauaguggcaacuugggauucauu

SEQ ID NO: 267317 - RNA, 64 nt, Homo Sapiens
uguuucaaauguguauuaccaauguggguguaaauuuuuaaaaaaugauuauugauagaaguuu

SEQ ID NO: 267318 - RNA, 64 nt, Homo Sapiens
gaaaaugauuguaauuuauuguucaugacuuuuuuuuuuaaauaaagugaguuucaacaaaaaa

SEQ ID NO: 267319 - RNA, 64 nt, Homo Sapiens
uauaaggguugcugggcauuugaaggcaggaagauuuuuaaagauagauugagguugguuuaaa

SEQ ID NO: 267320 - RNA, 64 nt, Homo Sapiens
ugcacuguugcacuuacuuaauacaaauaaauguuuuuuaaagcuuuuguaguauguuuuuaug

SEQ ID NO: 267321 - RNA, 64 nt, Homo Sapiens
uuaguggugauuuggggaaggaaaguuaaugagguuuuuaaaauaagguuuucuaguuuugaga

SEQ ID NO: 267322 - RNA, 64 nt, Homo Sapiens
uuuggugacaaaaaugaaggagcuuuguaaauuuuuuuuaaaauuaugaaucauaucaaguagu

SEQ ID NO: 267323 - RNA, 64 nt, Homo Sapiens
gcacugucugaugcgucaacaaaauugagccauuuuuuuaaaguaauagauacuaauagauuau

SEQ ID NO: 267324 - RNA, 64 nt, Homo Sapiens
uuaugcugcugugugguuuguuaaaucuaaaugauuuuuaaacuuuucucauagaaacuuaacu

SEQ ID NO: 267325 - RNA, 64 nt, Homo Sapiens
gaaaccagucagaaaagacauauauuuccaugccuuuuuaaagaauuauuuuuaccuguuuuau

SEQ ID NO: 267326 - RNA, 64 nt, Homo Sapiens
uuucuguccuggcagcauguuccagcucuugauguuuuuaaacuuuuuuuuagaagaaaaauua

SEQ ID NO: 267327 - RNA, 64 nt, Homo Sapiens
ucuuaaaacacugaaugaauuuugaagcuuaauguuuuuaaaggcauaguuuuaucuuugacau

SEQ ID NO: 267328 - RNA, 64 nt, Homo Sapiens
uacuuugaaaacaaaugucaugaaugauuuccaguuuuuaaagcuauauguuucacugcuucau

SEQ ID NO: 267329 - RNA, 64 nt, Homo Sapiens
uaaagacgucucuuuuugguaauaacaaacguguuuuuuaaaaaagccugguuuuucucaauac

SEQ ID NO: 267330 - RNA, 64 nt, Homo Sapiens
aaaagccugguuuuucucaauacgccuuuaaagguuuuuaaauuguuucauaucuggucaaguu

SEQ ID NO: 267331 - RNA, 64 nt, Homo Sapiens
auggugcucaccaaacgaaggguaucagcuauuuuuuuuaaaauucaaaaagaauaucccuuuu

SEQ ID NO: 267332 - RNA, 64 nt, Homo Sapiens
uuggcaucauguugaagcaccgaaagauaaaugauuuuuaaaaggcuauagaguccaaaggaau

SEQ ID NO: 267333 - RNA, 64 nt, Homo Sapiens
guuuuuugaaagaccccaauuuaagccuugcuuauuuuuaaauuauuuccauucagugauguug

SEQ ID NO: 267334 - RNA, 64 nt, Homo Sapiens
uuuccauuggaaauggaauucauugccuuaggucuuuuuaaauaguguauuauuaucguugggg

SEQ ID NO: 267335 - RNA, 64 nt, Homo Sapiens
uuuuuucuagauuguuaaaauuggcaaaugaacuuuuuuaaaaaucaucuuccauguugcaguu

SEQ ID NO: 267336 - RNA, 64 nt, Homo Sapiens
acagcaaaggccauaaccuuuugggauuuuuuuuuuuuuaaaauacuuuagggacuguuguaau

SEQ ID NO: 267337 - RNA, 64 nt, Homo Sapiens
cgaaaauggcaaacuacuacuacuacuguucaguuuuuuaaaaguuuugaaaugcugcacuuac

SEQ ID NO: 267338 - RNA, 64 nt, Homo Sapiens
aacacuuggauuuacaccagucuuuuguguuugcuuuuuaaaauaaagugcucguauuuguauu

SEQ ID NO: 267339 - RNA, 64 nt, Homo Sapiens
aucaaacuuagaggugugaccuuaaauuuaacuuuuuuuaaaaacugggaggucaauaaaauuu

SEQ ID NO: 267340 - RNA, 64 nt, Homo Sapiens
auaaaggauuauaaaauuuuuuuuuuuuuuuuuuuuuuuaaauuucuacuuaagggcaaguaau

SEQ ID NO: 267341 - RNA, 64 nt, Homo Sapiens
ucauuuuucagccaucaguucaagagccaaugccuuuuuaaaauaaagcuucuguggucuuguu

SEQ ID NO: 267342 - RNA, 64 nt, Homo Sapiens
ccuagcucuuugucaaagauggucuguagaaauguuuuuaaagauuagggaugcuguacuuuuu

SEQ ID NO: 267343 - RNA, 64 nt, Homo Sapiens
gaauuguugcaguguuggagaugccauuuucaccuuuuuaaaaagaugcauuuuauuugcaggu

SEQ ID NO: 267344 - RNA, 64 nt, Homo Sapiens
ugucugccauucugaauaugcuuauuaaaauauuuuuuuaaacauauuugccuacauaauacug

SEQ ID NO: 267345 - RNA, 64 nt, Homo Sapiens
agaauauccugaugcaucuguuucaccauuuugauuuuuaaaguaugcuguagcauuucuuaau

SEQ ID NO: 267346 - RNA, 64 nt, Homo Sapiens
caauugcuugaauuacugauauuuuagaauagacuuuuuaaaaugccauauguaauuuuaugca

SEQ ID NO: 267347 - RNA, 64 nt, Homo Sapiens
acauguauagauugcauuucuuagguguuuuaauuuuuuaaauauauuuauguuuuaaaaauuu

SEQ ID NO: 267348 - RNA, 64 nt, Homo Sapiens
cugaagaaacaacccaucguucuuuuuuuucucuuuuuuaaaaaguccuauaagaucuguuuuu

SEQ ID NO: 267349 - RNA, 64 nt, Homo Sapiens
aaauaaggaucaauuguaauauucauucaaaagguuuuuaaaaguaaguuuuaaggaguauuuc

SEQ ID NO: 267350 - RNA, 64 nt, Homo Sapiens
uuuuaaauuuucucuaauaguccucaucauaaacuuuuuaaaggaaaauaagcaaacuaaaaag

SEQ ID NO: 267351 - RNA, 64 nt, Homo Sapiens
auuucugaccaaucaaguacacuaaauuagaauauuuuuaaaguauguaacauucccaguuuca

SEQ ID NO: 267352 - RNA, 64 nt, Homo Sapiens
uggauuugcccauauuuauguaggugguuuuaauuuuuuaaauggugauuaguguuaaaaauca

SEQ ID NO: 267353 - RNA, 64 nt, Homo Sapiens
aauauaaaaauauuaaaagaacauaggcaggcuuuuuuuaaauuuggcuuuuuucuuuccuuuu

SEQ ID NO: 267354 - RNA, 64 nt, Homo Sapiens
uaaauaaauagaaccacugagacaauaauguauuuuuuuaaaguggcaaaugugguuuucuuuu

SEQ ID NO: 267355 - RNA, 64 nt, Homo Sapiens
ugcugcuaaguaguucucuguauuaaaggagauauuuuuaaaacaggguacaacccccugcugc

SEQ ID NO: 267356 - RNA, 64 nt, Homo Sapiens
augcuucaucaaaacaucuuguucauguuuuauguuuuuaaaaaaggcauuugaaugaauguuu

SEQ ID NO: 267357 - RNA, 64 nt, Homo Sapiens
cugguacuguacgauccaaaacauuguacccagcuuuuuaaaagagagaaauuaucacuacaac

SEQ ID NO: 267358 - RNA, 64 nt, Homo Sapiens
acugcuuucauucccacaaaaccaguauuacuuuuuuuuaaaaaaagaaagaaauuggaaaucu

SEQ ID NO: 267359 - RNA, 64 nt, Homo Sapiens
uuaucuucacagaaaauaaaagguguuaauuugcuuuuuaaaacaaauuuaauuaucacauuuu

SEQ ID NO: 267360 - RNA, 64 nt, Homo Sapiens
gugugagccaccgugcucagccacuagcuuugguuuuuuaaacauagauuauauuccucaagau

SEQ ID NO: 267361 - RNA, 64 nt, Homo Sapiens
uuuucagugcaauuaaaccgagagaugucuuguuuuuuuaaaaagaauaguauuuaauagguuu

SEQ ID NO: 267362 - RNA, 63 nt, Homo Sapiens
gcuuuaucaacuuuuaaacauuaauaaacugauuuuuuuaaagaucccuuugugaagagcauu

SEQ ID NO: 267363 - RNA, 64 nt, Homo Sapiens
uaaugugguaacuuugucaauuucccauuuuauuuuuuuaaauaaauauaugaucuaaaagcca

SEQ ID NO: 267364 - RNA, 64 nt, Homo Sapiens
ucaguggaaagauaaacuaaguuuuaauguuauuuuuuuaaauuuaagcaaaauuuauuucugu

SEQ ID NO: 267365 - RNA, 64 nt, Homo Sapiens
ggcaaaggaagugccagcuucucuggggaacuuguuuuuaaauccaaagacuugaaccacauuc

SEQ ID NO: 267366 - RNA, 64 nt, Homo Sapiens
ucugcauuuuuuagaagcauuuuacccauuuauuuuuuuaaacauucaagaacugcugacguac

SEQ ID NO: 267367 - RNA, 64 nt, Homo Sapiens
cacuucuaugaccaggccuuaagggaaggucaguuuuuuaaaaaaccaaguagugucuuccuac

SEQ ID NO: 267368 - RNA, 64 nt, Homo Sapiens
cugcauuguuguagucuucccaaaguuugcccuauuuuuaaauucauuauuuuugugacaguaa

SEQ ID NO: 267369 - RNA, 64 nt, Homo Sapiens
agaauccauaucugcgugaaaacaccaaguauucuuuuuaaaugaagcaccaugaauucuuuuu

SEQ ID NO: 267370 - RNA, 64 nt, Homo Sapiens
aaguauucuuuuuaaaugaagcaccaugaauucuuuuuuaaauuauuuuuuaaaagucuuucuc

SEQ ID NO: 267371 - RNA, 64 nt, Homo Sapiens
uaaaugaagcaccaugaauucuuuuuuaaauuauuuuuuaaaagucuuucucucucugauucag

SEQ ID NO: 267372 - RNA, 64 nt, Homo Sapiens
acagccuaccaggaacauguuguguuuucuuuauuuuuuaaaaucauuauauugaguuguguuu

SEQ ID NO: 267373 - RNA, 64 nt, Homo Sapiens
aucuuacuaucaguagguuuugcauugauauuucuuuuuaaauaaacuacuaguucuuuauauu

SEQ ID NO: 267374 - RNA, 64 nt, Homo Sapiens
acuugccagugucauguuuuauuuuuguuauagauuuuuaaauuauuuccuucaagaucaauuc

SEQ ID NO: 267375 - RNA, 64 nt, Homo Sapiens
ucucucaugacuucauggacccuccucugccaguuuuuuaaaucagaucacccuccauguuguu

SEQ ID NO: 267376 - RNA, 64 nt, Homo Sapiens
gggccucauaccaacagccucuccuuguacuauauuuuuaaaacuggaacuaugaacuucaucc

SEQ ID NO: 267377 - RNA, 64 nt, Homo Sapiens
aaauuagcugcacguauauacauauauauauuucuuuuuaaauuucauauugauggcaguaccu

SEQ ID NO: 267378 - RNA, 64 nt, Homo Sapiens
uccuuuuuauuucauaagacugcuaggaagugauuuuuuaaaauuaggacuccuuaagaauaaa

SEQ ID NO: 267379 - RNA, 64 nt, Homo Sapiens
gugaauggaaccaaugugcaagauacauacugcauuuuuaaaauagugucucagcuaaauggaa

SEQ ID NO: 267380 - RNA, 64 nt, Homo Sapiens
auacauguacuuaguaugugugguaucaggauauuuuuuaaacugugauaauacaacagauagc

SEQ ID NO: 267381 - RNA, 64 nt, Homo Sapiens
augggaaaggcauucagaaauuaugguuucuaccuuuuuaaaaaguagaugggauugugucaau

SEQ ID NO: 267382 - RNA, 64 nt, Homo Sapiens
auaacuuauugagcacuuuuaguagugauaacuguuuuuaaacuugccuaauaccuuucuuggg

SEQ ID NO: 267383 - RNA, 64 nt, Homo Sapiens
agcccgguuuugacugguugaaaccggacauugguuuuuaaauuuuuugucaguuuauguggag

SEQ ID NO: 267384 - RNA, 64 nt, Homo Sapiens
gaaaauuuuuaucaauuaacugacaaauaguuucuuuuuaaaguaguuucuuccaucuuuauuc

SEQ ID NO: 267385 - RNA, 64 nt, Homo Sapiens
cauagaguugauugucuagugaggaagacaagcauuuuuaaaaaauaaauuuaaacuuacaaac

SEQ ID NO: 267386 - RNA, 64 nt, Homo Sapiens
ugcuucuguauuuccuuggauuuuccugaaaguguuuuuaaauaaagaacaauuguuagaugcc

SEQ ID NO: 267387 - RNA, 64 nt, Homo Sapiens
agaauuuuguuuauuuuccugucaaugaaagcaauuuuuaaagauaccagugggacagauuugg

SEQ ID NO: 267388 - RNA, 64 nt, Homo Sapiens
caauuuuuaaagauaccagugggacagauuugguuuuuuaaaaaucucauguguucaaauuaac

SEQ ID NO: 267389 - RNA, 64 nt, Homo Sapiens
acuuccugauacaaauguagggauauauacuguauuuuuaaacauuucucaccaacuuucuuau

SEQ ID NO: 267390 - RNA, 64 nt, Homo Sapiens
uaaacauuucucaccaacuuucuuauguguguucuuuuuaaaaauuuuuuuucuuuuaaaauau

SEQ ID NO: 267391 - RNA, 64 nt, Homo Sapiens
caaaccuuuucuaacauugguuuuuuuuuuuuaguuuuuaaauucuuccucuucuuuuuauuau

SEQ ID NO: 267392 - RNA, 64 nt, Homo Sapiens
agguuaauaaagaaccagauaauuaauuaguuacuuuuuaaaucuugcaauuguaugugugauu

SEQ ID NO: 267393 - RNA, 64 nt, Homo Sapiens
uaugugugauuauggaguuuugaaaacguuacauuuuuuaaaucuuaaaacugaaaacuuguuu

SEQ ID NO: 267394 - RNA, 64 nt, Homo Sapiens
auauuuauaacucauauaaaaauuauauuuagaauuuuuaaacauguacaaagggcuacauuuu

SEQ ID NO: 267395 - RNA, 64 nt, Homo Sapiens
uuuuuuauuauggugcagcuuuuuuuuaauuauguuuuuaaaauuauacaguugaaaaauaugc

SEQ ID NO: 267396 - RNA, 64 nt, Homo Sapiens
augguagaaucuacuccuugguagucacuugucauuuuuaaagaaaugaugacaauccucuugg

SEQ ID NO: 267397 - RNA, 64 nt, Homo Sapiens
gccugacagguuacccuugagggcuugugucuacuuuuuaaaagucaaugguuuuuuuucuugu

SEQ ID NO: 267398 - RNA, 64 nt, Homo Sapiens
guaguuuauaguuagagcucuauuuuguuaugguuuuuuaaacuuuuaaguccugcucuauuuu

SEQ ID NO: 267399 - RNA, 64 nt, Homo Sapiens
gggcagguuuauguugauguuuacccacuacaauuuuuuaaaaauauaagcucacaugccuuuu

SEQ ID NO: 267400 - RNA, 64 nt, Homo Sapiens
uucaaaggcaacacaagcucgcaacucuaagauuuuuuuaaaccacaaaaacccugguuagcca

SEQ ID NO: 267401 - RNA, 64 nt, Homo Sapiens
ucaguguguaaguguuuguuuccaggauauuuucuuuuuaaaugucuuucuuauauggguuuua

SEQ ID NO: 267402 - RNA, 64 nt, Homo Sapiens
uggaauuucugguuuguaagguggucacuguucuuuuuuaaaauauuuguaauauggaaugggc

SEQ ID NO: 267403 - RNA, 64 nt, Homo Sapiens
acuuuuguauggauucagaauauacuaaauuaacuuuuuaaaacacaacuuuuaaaaaauguau

SEQ ID NO: 267404 - RNA, 64 nt, Homo Sapiens
agcuagaaaguguauguguggcauuuguuuucacuuuuuaaaacaucccuaacugaucgaauau

SEQ ID NO: 267405 - RNA, 64 nt, Homo Sapiens
gaagucucacugauagagguucuuuauugcucauuuuuuaaaaaauggacucuugaaaucuguu

SEQ ID NO: 267406 - RNA, 64 nt, Homo Sapiens
cuuaaguuaaggauguuuggcuuuuuucuuuaauuuuuuaaaaaccauuuuccuauguuaggag

SEQ ID NO: 267407 - RNA, 64 nt, Homo Sapiens
ugcauaucccuucuuucaaaaaauguugcuuuuuuuuuuaaaggaauuuuaauauauuccuuua

SEQ ID NO: 267408 - RNA, 64 nt, Homo Sapiens
gggacaguuaaauaucuuaaaauaucuaaaacauuuuuuaaagcacuuagauugucuuacguau

SEQ ID NO: 267409 - RNA, 64 nt, Homo Sapiens
guuaucauuuuugagaaaucuacaccaaagugguuuuuuaaaauuacauaacuaaaaauaaacc

SEQ ID NO: 267410 - RNA, 64 nt, Homo Sapiens
aaauguucuucccuguuauuuacauucugguggguuuuuaaaauucuuaccuccaucaugcaau

SEQ ID NO: 267411 - RNA, 64 nt, Homo Sapiens
agauacaaaauguuuacaguguuggcacuuagaguuuuuaaauucaaguacaugaaauucagua

SEQ ID NO: 267412 - RNA, 64 nt, Homo Sapiens
uaacgagggcaacagggagcaccugucuggauuguuuuuaaaccuccauacucaagcugucucu

SEQ ID NO: 267413 - RNA, 64 nt, Homo Sapiens
aaaaaucuaguggguugaccuuuaaaugcaacaguuuuuaaaauauauugcugcauuuuauaga

SEQ ID NO: 267414 - RNA, 64 nt, Homo Sapiens
uucuucgugaacauagaguuuggggccgaaaauguuuuuaaaguauguguuugaguuaaauaua

SEQ ID NO: 267415 - RNA, 64 nt, Homo Sapiens
uaaucaucaggacuaucucacccucccacuccuguuuuuaaaacucagaauucuuuccuaagag

SEQ ID NO: 267416 - RNA, 64 nt, Homo Sapiens
aaaauauaguuugguaauuuuuuuuuccaguugauuuuuaaaaagaacugcuguacagagcuug

SEQ ID NO: 267417 - RNA, 64 nt, Homo Sapiens
ggagccuugcuauuucaguggguauaauuuaaacuuuuuaaagaaaaucuguacuuuuauaaag

SEQ ID NO: 267418 - RNA, 64 nt, Homo Sapiens
cacuuuaaaaauauagaauauauggucuaauaguuuuuuaaagcuuuuggacuaaaguauucca

SEQ ID NO: 267419 - RNA, 64 nt, Homo Sapiens
caaauggaaaauuucugaaaugcuggauuaucuauuuuuaaacaagcaguugacuuaaaacuuu

SEQ ID NO: 267420 - RNA, 64 nt, Homo Sapiens
gcauuaucuuuaguuacuugaagaguuucuaguuuuuuuaaaauacaguuuauguuaaaauaau

SEQ ID NO: 267421 - RNA, 64 nt, Homo Sapiens
cuguuuaguuuuguacuauugguguguuggugaauuuuuaaacugugugcuaacugcaauaaau

SEQ ID NO: 267422 - RNA, 64 nt, Homo Sapiens
gguuucucugacggccccacacauucaucuccauuuuuuaaaaaucggguuguccaauucugua

SEQ ID NO: 267423 - RNA, 64 nt, Homo Sapiens
gccgcaaaaaaucuuuuccuugccaagaaccagauuuuuaaaagaucgauacagauggauaaac

SEQ ID NO: 267424 - RNA, 64 nt, Homo Sapiens
auuugcgccucgguaucugguuucugacucuuauuuuuuaaaaaacagaaaccuuuuauuuuua

SEQ ID NO: 267425 - RNA, 64 nt, Homo Sapiens
uugaccaacagaaaccuuuuagaaacuuuuuuauuuuuuaaaucacuugugauuggcugcagga

SEQ ID NO: 267426 - RNA, 64 nt, Homo Sapiens
aggacucauacuuaaaaaaaguuuuaaucuuuucuuuuuaaacaauuuauagaaaauauuuucu

SEQ ID NO: 267427 - RNA, 64 nt, Homo Sapiens
guuucacgucuucgccaaucacaauuuaaguauuuuuuuaaaaacacaaaaugaaacaaaagaa

SEQ ID NO: 267428 - RNA, 64 nt, Homo Sapiens
aaaaagguacaauugaauggaauaaagagcucuauuuuuaaagaguauuacccuaaacuguuua

SEQ ID NO: 267429 - RNA, 64 nt, Homo Sapiens
auuuuuuccagaguuuaauucaaaccuuacuauuuuuuuaaagacgugagccaccgcgcccagc

SEQ ID NO: 267430 - RNA, 64 nt, Homo Sapiens
cagugcucuaagaccucagcacuggugaaaauauuuuuuaaagccggguuuucauuuacucugg

SEQ ID NO: 267431 - RNA, 64 nt, Homo Sapiens
acaccaugcuuggaggguggagggaaaaauuaauuuuuuaaaaagugagaguuuuuaaagugua

SEQ ID NO: 267432 - RNA, 64 nt, Homo Sapiens
guaagggaaaaauuaauuuuuacauaggugagaguuuuuaaaguuaguguggcaguuucuuuua

SEQ ID NO: 267433 - RNA, 64 nt, Homo Sapiens
accaacaaaucucaagcccuuuccccauuucuuguuuuuaaaaggaaaggucauuuuguugcau

SEQ ID NO: 267434 - RNA, 64 nt, Homo Sapiens
guuauguaagcaaagcugaacuggugcuaaguauuuuuuaaauguuuggcauauaggaagcacg

SEQ ID NO: 267435 - RNA, 64 nt, Homo Sapiens
auuagcuggguguggugaugucucuacaaaaacauuuuuaaaaaggcaacacagggagaccccc

SEQ ID NO: 267436 - RNA, 64 nt, Homo Sapiens
acuguacuuguacucacucaccuggccuaaaauguuuuuaaauauacaggcaugaaccaccacg

SEQ ID NO: 267437 - RNA, 64 nt, Homo Sapiens
gauuuaucuggauuuagagaaugugugaaauaaauuuuuaaaaaacuaaaaauauuaaagccuc

SEQ ID NO: 267438 - RNA, 64 nt, Homo Sapiens
uccucuacuuaauuuguuuuuuggcuaaagugcauuuuuaaauuucuuuuaugauuggugcaaa

SEQ ID NO: 267439 - RNA, 64 nt, Homo Sapiens
aaagcucguaacacaacuaauguauuaaaugugcuuuuuaaauauguaucugcgaaacuauacu

SEQ ID NO: 267440 - RNA, 64 nt, Homo Sapiens
ucaacuaaaauaucauaguugcauugaguuaauuuuuuuaaauauacauuagcugcuuaaaaaa

SEQ ID NO: 267441 - RNA, 64 nt, Homo Sapiens
ggaaaaaaaaaauguuuuacuuuugcccgacugauuuuuaaaaaaguagaauguagggaaaaac

SEQ ID NO: 267442 - RNA, 64 nt, Homo Sapiens
auuuuuaagaauuguuugucaaacagugaaggaauuuuuaaaaaauucugccacauuuauugau

SEQ ID NO: 267443 - RNA, 64 nt, Homo Sapiens
cuugaguuucccauuuuaaaucagcuauauuuacuuuuuaaaugauuauaacugauuuacauuu

SEQ ID NO: 267444 - RNA, 64 nt, Homo Sapiens
cauuuaccuuauuaaaaugauaaaaaaugucagguuuuuaaaaugcuaguuuuuuuuuuucuuc

SEQ ID NO: 267445 - RNA, 64 nt, Homo Sapiens
agggaaauauuuuauauaccuuuuacagaaacauuuuuuaaauagauuucaugacuccgaagua

SEQ ID NO: 267446 - RNA, 64 nt, Homo Sapiens
cauaauuauauacuuuagaaaguugaucugggccuuuuuaaaaauuggguuacuguuuaaggaa

SEQ ID NO: 267447 - RNA, 64 nt, Homo Sapiens
cugaucuaauguucauuuuuaaauaaacuagagauuuuuaaacucaucaagugguguuuguuag

SEQ ID NO: 267448 - RNA, 64 nt, Homo Sapiens
aguuggugucuuacuuggucgugcaugaagcauauuuuuaaagaucuuaaaaaaauccaguaca

SEQ ID NO: 267449 - RNA, 64 nt, Homo Sapiens
ccuagucuuugaaaagcaguuuguuugcuuagaguuuuuaaaaauguauaaucugaaguggaaa

SEQ ID NO: 267450 - RNA, 64 nt, Homo Sapiens
auguauaaucugaaguggaacgaaucaaugcugauuuuuaaaauuauaguaaaauauaugcuca

SEQ ID NO: 267451 - RNA, 64 nt, Homo Sapiens
aaaucucuuauuuuagcaaaaauaagcacucuaauuuuuaaaguccaugguguacuuugcaaga

SEQ ID NO: 267452 - RNA, 64 nt, Homo Sapiens
gacuauugaugauagaagaaguagaauauuauaauuuuuaaaaguagauuuuuauuuuguauau

SEQ ID NO: 267453 - RNA, 64 nt, Homo Sapiens
aacuuuaaugaggaaagcuauuaugcugggauuguuuuuaaaaauauuuaaugucuuugcaacu

SEQ ID NO: 267454 - RNA, 64 nt, Homo Sapiens
caauauuuaaugucuuugcaaauaacuguuuauauuuuuaaaagauugagaccuauaauucacc

SEQ ID NO: 267455 - RNA, 64 nt, Homo Sapiens
agugagugcuauuuuggaguucaacaauaaaauuuuuuuaaaguuagaaauggaaauuuugcua

SEQ ID NO: 267456 - RNA, 64 nt, Homo Sapiens
auauuuucucuguacuuuuccuagccugaugagauuuuuaaaaaacagacacgagccaccucac

SEQ ID NO: 267457 - RNA, 64 nt, Homo Sapiens
uuuucuauuuuaagacugauggucuuucaguacuuuuuuaaauauuucuuuuuuuccuuuuuaa

SEQ ID NO: 267458 - RNA, 64 nt, Homo Sapiens
ucaugaucaucuggaaugauguugugccauacuguuuuuaaaguguuugggguacagauugggg

SEQ ID NO: 267459 - RNA, 64 nt, Homo Sapiens
guuguaaaaauuauuauagguguuuuuguuuuauuuuuuaaauugcaaaagaauuagauuucuu

SEQ ID NO: 267460 - RNA, 64 nt, Homo Sapiens
acuaugauugauaaaguauuaaggagaaaaggcauuuuuaaaggagaacagacuuccuccuaag

SEQ ID NO: 267461 - RNA, 64 nt, Homo Sapiens
gacaaaaauaugagauuaaauauuaacgccacauuuuuuaaauauuuggcucuuggcuuaaugu

SEQ ID NO: 267462 - RNA, 64 nt, Homo Sapiens
cauauaugucuucuuuugaaugauuuuuauaugcuuuuuaaauguagugauuagugaugaugag

SEQ ID NO: 267463 - RNA, 64 nt, Homo Sapiens
uuuuuuccaaaaacaauuagauaaauugugauucuuuuuaaaaagugcaggugucuuggucaug

SEQ ID NO: 267464 - RNA, 64 nt, Homo Sapiens
cacauggaacgguuuuuuuuauguguaaguguuuuuuuuaaaaucagaguacuauucuaucuag

SEQ ID NO: 267465 - RNA, 64 nt, Homo Sapiens
uuuacauaauggccagaaggggcaauucaguuaauuuuuaaauguaagcucuuauuuuucaauu

SEQ ID NO: 267466 - RNA, 64 nt, Homo Sapiens
ucaguugacuuuccccaccaagguggauucguauuuuuuaaaguuuuaaaguugugaauaagau

SEQ ID NO: 267467 - RNA, 64 nt, Homo Sapiens
ugugaauaagauagguggaucuuuaaauucuguauuuuuaaaguuugugccucacuggaauuau

SEQ ID NO: 267468 - RNA, 64 nt, Homo Sapiens
auagguaucucuuugcauauacagguagcucucuuuuuuaaaauuuggaugggaugcaugacau

SEQ ID NO: 267469 - RNA, 64 nt, Homo Sapiens
ucaccuagaaucauagggcccuuggggaaaaauuuuuuuaaaaugaaaguuuuaagaauuguuc

SEQ ID NO: 267470 - RNA, 64 nt, Homo Sapiens
uucagugcuuccuaaauguuuuugagcugacaaguuuuuaaaaccagauuaagugcuuuuguca

SEQ ID NO: 267471 - RNA, 64 nt, Homo Sapiens
uagccugguggcucacgccucucaaaaaacauuauuuuuaaaaugcaacauagugagaucccau

SEQ ID NO: 267472 - RNA, 64 nt, Homo Sapiens
aaauuugagaagucuacuuccacugacauuucuuuuuuuaaaaagguacuuuaaauguagcagc

SEQ ID NO: 267473 - RNA, 64 nt, Homo Sapiens
ucuugcuaacauuuuauugggugcuguacagucauuuuuaaaucuaacacaauucucugaugcg

SEQ ID NO: 267474 - RNA, 64 nt, Homo Sapiens
ugucauuuuuuacugucuuucacgaaugucuuuuuuuuuaaaacgacuaaugguggcuuaaaug

SEQ ID NO: 267475 - RNA, 64 nt, Homo Sapiens
uggacaaaauccaugaacaauuaagacaacugaguuuuuaaaaaauauaaagaccuauaaauca

SEQ ID NO: 267476 - RNA, 64 nt, Homo Sapiens
aauaacaaucacaaaggaaacuuuauucuuuuacuuuuuaaaaucugccuguggaguagccauu

SEQ ID NO: 267477 - RNA, 64 nt, Homo Sapiens
agaaccuuucacuagcuagcaucauugcuacagguuuuuaaaaaguaucuuucuaaucuguuuu

SEQ ID NO: 267478 - RNA, 64 nt, Homo Sapiens
ugcuuauggaaaggacccaagagcagagggaugguuuuuaaaugauaaguuuuaauauuuugug

SEQ ID NO: 267479 - RNA, 64 nt, Homo Sapiens
uuggguauaaauucuaggguuuauugcagggguguuuuuaaaucugguaugaaagguaauguga

SEQ ID NO: 267480 - RNA, 64 nt, Homo Sapiens
uugaugugaaguuauaguuucacauuuuuuaacuuuuuuaaauugugauauguacauauucaaa

SEQ ID NO: 267481 - RNA, 64 nt, Homo Sapiens
aaaacuauuuguaagauguugauuuguuucuguuuuuuuaaagggcaugauguagagagcuguu

SEQ ID NO: 267482 - RNA, 64 nt, Homo Sapiens
ccuuuaguuuacccuuuuuguuuguaauguacucuuuuuaaaucuguuacagggcuucuuauuc

SEQ ID NO: 267483 - RNA, 64 nt, Homo Sapiens
gaaaucuauauauugacuuuuuacaaaauacuuauuuuuaaaauucauuacauacuaugccaga

SEQ ID NO: 267484 - RNA, 64 nt, Homo Sapiens
uuggcuaucuaaaauuuuuuuucaaggcaauggcuuuuuaaaucuuugcuauggaggcuccaug

SEQ ID NO: 267485 - RNA, 64 nt, Homo Sapiens
caagcuuacuguauuagucauauuuagacuuaauuuuuuaaauuuguggaauucccuagcaauu

SEQ ID NO: 267486 - RNA, 64 nt, Homo Sapiens
cauaaaauauauaggauuacuucuuaaaaucauguuuuuaaauguguuaaagccuaugaaugcc

SEQ ID NO: 267487 - RNA, 64 nt, Homo Sapiens
ugcaaaucucaggauaaaguuuugauucuucauuuuuuuaaauuaaacagaaaagaaaauauag

SEQ ID NO: 267488 - RNA, 64 nt, Homo Sapiens
ugaucaggacuauaauauuguuuuaauaaucgacuuuuuaaauguuuccaauggaacccuuguu

SEQ ID NO: 267489 - RNA, 64 nt, Homo Sapiens
ggcuuuggccaguagcuaaacuuuuuuuuuuuuuuuuuuaaauuguaacagucguagauaccag

SEQ ID NO: 267490 - RNA, 64 nt, Homo Sapiens
gcaaaucuuucuguaaacagaaaaucacuguuuguuuuuaaaaaggauaaggggugggggagaa

SEQ ID NO: 267491 - RNA, 64 nt, Homo Sapiens
auuaaaaauuuaauucagguccagcaacuuuccuuuuuuaaaauuguuucuguuuaccagcuuc

SEQ ID NO: 267492 - RNA, 64 nt, Homo Sapiens
cuuaaaccuggaacuccuuacugggugccaccuguuuuuaaacuccugucuccugaaugauggu

SEQ ID NO: 267493 - RNA, 64 nt, Homo Sapiens
uguuuuccccacaagucaucaaaauuggaagcuuuuuuuaaaaauuugcuuuucucucuuccac

SEQ ID NO: 267494 - RNA, 64 nt, Homo Sapiens
aggcacuuuuaaaauuaacauaaaauuaaguaauuuuuuaaagaguuuccccacuuuuauuuuu

SEQ ID NO: 267495 - RNA, 64 nt, Homo Sapiens
uaaguaauuuuuuaaagaaguuccccacuuuuauuuuuuaaaauugaaagucaccugaggaagu

SEQ ID NO: 267496 - RNA, 64 nt, Homo Sapiens
cacccgaggagcccaagggggcugccaaaacauuuuuuuaaauagcccagaugauaaacacuga

SEQ ID NO: 267497 - RNA, 64 nt, Homo Sapiens
gccaaacaaauccccuuccuugcuuacuccucuauuuuuaaaguuucucuggccucuccagucc

SEQ ID NO: 267498 - RNA, 64 nt, Homo Sapiens
uuggaauguguuuaaauuuaauuuucaaacaauuuuuuuaaacugauaaauaaaauccaaggca

SEQ ID NO: 267499 - RNA, 64 nt, Homo Sapiens
uauuuuuuggggcaaaguuagaauaaaguaauucuuuuuaaaaauuugcuuuauuccgauuaua

SEQ ID NO: 267500 - RNA, 64 nt, Homo Sapiens
cucucaauuucuaauucaccgaaaugcuaaaaaguuuuuaaacauuggauaucacagcaacauu

SEQ ID NO: 267501 - RNA, 64 nt, Homo Sapiens
ccuguuuaucccaaccuuuuuuuaccuccucucuuuuuuaaacaauccccugcccauccucccu

SEQ ID NO: 267502 - RNA, 64 nt, Homo Sapiens
auguuucaguucugugucauagccaaggaugagauuuuuaaaguagaugugagccaccgugccu

SEQ ID NO: 267503 - RNA, 64 nt, Homo Sapiens
cggagucucgcucugucaccuguuuuguuuuguuuuuuuaaagagaguuuguuguuuuuuguuu

SEQ ID NO: 267504 - RNA, 64 nt, Homo Sapiens
caagcuguggcccuuuccacccaaauuauagaauuuuuuaaaaaaaauuaaucgccacccucuu

SEQ ID NO: 267505 - RNA, 64 nt, Homo Sapiens
aaaagacaaaagaaaguggaccuuuuuuuuuuuuuuuuuaaagauccaaccaaucacaccccug

SEQ ID NO: 267506 - RNA, 64 nt, Homo Sapiens
uaaaaaaaaacccaaaaauauuaaauacauaucauuuuuaaaaaccaaaacaugacccauagua

SEQ ID NO: 267507 - RNA, 64 nt, Homo Sapiens
uucagccaaauaaugcauuuuagugaaaaaaauauuuuuaaaauucuaagauugcucuaacguc

SEQ ID NO: 267508 - RNA, 64 nt, Homo Sapiens
gaauuuuaccguaacuauaauucuacacagaaaguuuuuaaaauuauuacuuggcacaauuuau

SEQ ID NO: 267509 - RNA, 64 nt, Homo Sapiens
aggcuuuuugcccaucaagacuuaagaauaauguuuuuuaaagguuuuuuucucucccagguuu

SEQ ID NO: 267510 - RNA, 64 nt, Homo Sapiens
uuuuuguuuuguuuuguuugcucagcacacuuuuuuuuuaaaccuugucuuuuugggugcauuc

SEQ ID NO: 267511 - RNA, 64 nt, Homo Sapiens
gccucaaaugugcacauguaaaccuucugaugacuuuuuaaaaucugcugagacacuaaacuuu

SEQ ID NO: 267512 - RNA, 64 nt, Homo Sapiens
caucucuucagcaauccagacagaugugacuuuuuuuuuaaagucuggugaacacugugagccg

SEQ ID NO: 267513 - RNA, 64 nt, Homo Sapiens
aaaaaaaucuuagucccuguauugaaaaguagauuuuuuaaaaaaggauucugucacaagucuu

SEQ ID NO: 267514 - RNA, 64 nt, Homo Sapiens
aaaaacuugauuuguuauuaacuguucacuguuuuuuuuaaaaaucaauaugcuuguauaaaac

SEQ ID NO: 267515 - RNA, 64 nt, Homo Sapiens
aaacgcugauuacagauaauuguggguuuuaauauuuuuaaaucaaauauucugugucaagcac

SEQ ID NO: 267516 - RNA, 64 nt, Homo Sapiens
cagcaaugaaacaauaauuuaauuucaugucuacuuuuuaaaauuuaaauuagacauuaccagu

SEQ ID NO: 267517 - RNA, 64 nt, Homo Sapiens
uaaaggaaaacaaaaaacuugcacuuuuaugaaguuuuuaaaaaggaugaacaauguauacaau

SEQ ID NO: 267518 - RNA, 64 nt, Homo Sapiens
uaacugagauauuauuuuaaacgaaaguauuuacuuuuuaaaaaguuucaucaaugcaguucuc

SEQ ID NO: 267519 - RNA, 64 nt, Homo Sapiens
aauuauacuugcacaugaaaaaugaaauguugccuuuuuaaaaucaugcuuauaaaagacuuuu

SEQ ID NO: 267520 - RNA, 64 nt, Homo Sapiens
aaagauauucuaauguacucaaaggauaauaaaauuuuuaaagaauaaugaagcagaucaacuu

SEQ ID NO: 267521 - RNA, 64 nt, Homo Sapiens
aaaaaaguuguuaguuugaauagaauaauggauuuuuuuaaaaaaagaagcacaguugaagucc

SEQ ID NO: 267522 - RNA, 64 nt, Homo Sapiens
auucuuauuucuuugugugguuacuauguucuccuuuuuaaagucuuaagacuaguggacauac

SEQ ID NO: 267523 - RNA, 64 nt, Homo Sapiens
ugaaauuaggaauuugaauuuuacguuauacaaauuuuuaaaauucuuauccuaagauucaaua

SEQ ID NO: 267524 - RNA, 64 nt, Homo Sapiens
uuauuuagugcuaacuuuuagcacauuuuugugauuuuuaaagaucuggcauaauauuugaagu

SEQ ID NO: 267525 - RNA, 64 nt, Homo Sapiens
aauauuuuuuagaaauacaucgucucuuuuuuuuuuuuuaaaguuccaugccugccacuuuguc

SEQ ID NO: 267526 - RNA, 64 nt, Homo Sapiens
ugacccuuggcuguauuucccacuucuagcagguuuuuuaaacggggaggauuccaccgaucuu

SEQ ID NO: 267527 - RNA, 64 nt, Homo Sapiens
ucuguuagaagaaaaaaagcuccuucuuuuuaccuuuuuaaaaacgauuucucccgcaauuugu

SEQ ID NO: 267528 - RNA, 64 nt, Homo Sapiens
uuaacacaaucagaaauuuuagaaaaccagcuuguuuuuaaaaccuauguacaaacauacugga

SEQ ID NO: 267529 - RNA, 64 nt, Homo Sapiens
uguuuuaagauuuuugggucaaguuuguuaaaauuuuuuaaaaagcuggucgggaauaccuggg

SEQ ID NO: 267530 - RNA, 64 nt, Homo Sapiens
accuaucucaugcaaugaaaaaaaagaauagucauuuuuaaacuuccgucucaaaaaaaaaaga

SEQ ID NO: 267531 - RNA, 64 nt, Homo Sapiens
ucuccgugaguuguaaauaguaugugaguuaauuuuuuuaaauagggugacaaaugccaauaga

SEQ ID NO: 267532 - RNA, 64 nt, Homo Sapiens
uaagcauuucauuauguguuuaaaaugcaauuuuuuuuuaaaucgguuuggggacugguuguua

SEQ ID NO: 267533 - RNA, 64 nt, Homo Sapiens
aaccaaaaaaaaacagaaaaguugcuguuuucuauuuuuaaauaaggcuauaaaacaaaaaaag

SEQ ID NO: 267534 - RNA, 64 nt, Homo Sapiens
uccacuaaaaauaauuauccgagcuucucacagguuuuuaaagcggaggccaaaaagucaaugu

SEQ ID NO: 267535 - RNA, 64 nt, Homo Sapiens
aacaaacagaugaaaaccucauuugcuauaauuauuuuuaaaaacuaagucuuuguacuaaagc

SEQ ID NO: 267536 - RNA, 64 nt, Homo Sapiens
uucaguuuuaagaucucugggcacauggcagcauuuuuuaaaaagauuacaggcgggagccacu

SEQ ID NO: 267537 - RNA, 64 nt, Homo Sapiens
uaaugcaucuuccuuugucuaaaauugacagugauuuuuaaauauuuauauucuaaauccuagu

SEQ ID NO: 267538 - RNA, 64 nt, Homo Sapiens
cuguauauauggcuuucacuauagauaagucuaauuuuuaaaugacuuugaauauuucaagaau

SEQ ID NO: 267539 - RNA, 64 nt, Homo Sapiens
uguuuuguuucuucuuacaaauccugaaggaagauuuuuaaaaacaauaaugaaggacaaauga

SEQ ID NO: 267540 - RNA, 64 nt, Homo Sapiens
guaaaaguucuaaaaugaaggaccguuuuaugauuuuuuaaaaauuaguaucuucucagauaca

SEQ ID NO: 267541 - RNA, 64 nt, Homo Sapiens
auugauauuaguaucuucucucaacuccucucacuuuuuaaagcgaugaacgaaagcccccucu

SEQ ID NO: 267542 - RNA, 64 nt, Homo Sapiens
aguguuugaaaauuauacauuguuauucaccagcuuuuuaaaaaauuauuuaauccuagcucuu

SEQ ID NO: 267543 - RNA, 64 nt, Homo Sapiens
aauuauuuaauccuagcucuuaugagaaaaguuuuuuuuaaauaauaugcuuaugaaacagauu

SEQ ID NO: 267544 - RNA, 64 nt, Homo Sapiens
guggaguaaaagugaggcaccaguuuaaaaacacuuuuuaaaaauucagagugcuucugaagua

SEQ ID NO: 267545 - RNA, 64 nt, Homo Sapiens
uaaauuaagaaguauuuauaguuaacagcacaauuuuuuaaaaagcuuguugccccguaaaagg

SEQ ID NO: 267546 - RNA, 64 nt, Homo Sapiens
uucaaauccuaaaucacuuccugaaguacuuagauuuuuaaaauguuguuauuguauguuguua

SEQ ID NO: 267547 - RNA, 64 nt, Homo Sapiens
uuaaaaacucaacaccucacuugauuaaaggccauuuuuaaaacuauaucaggugcagcuggcu

SEQ ID NO: 267548 - RNA, 64 nt, Homo Sapiens
cacauguuuguaugaguacuacaggaaaacauguuuuuuaaauugcagaagcuuuauuuuuuga

SEQ ID NO: 267549 - RNA, 64 nt, Homo Sapiens
ggcagaagcuuuauuuuuuggaaagccugacaaguuuuuaaaaguuuucaacauuuuggcacau

SEQ ID NO: 267550 - RNA, 64 nt, Homo Sapiens
ucuauagcacugaaguuauuuuaauaauuguaacuuuuuaaaugagaucuuuuuauucagaguu

SEQ ID NO: 267551 - RNA, 64 nt, Homo Sapiens
uggaaguacaggauuuucuuauagaauugucugcuuuuuaaaacauuuaaaugguugcuucuuc

SEQ ID NO: 267552 - RNA, 64 nt, Homo Sapiens
ugaauauaaugcuuacuucauuuuccuugcuuuguuuuuaaacaauuuuuguuucauuuuuuau

SEQ ID NO: 267553 - RNA, 64 nt, Homo Sapiens
ucagcagauacaauuuggaauaaaaucuugauuuuuuuuaaauguaaaaucuuuagacaauauu

SEQ ID NO: 267554 - RNA, 64 nt, Homo Sapiens
auuuauuuuagaauacaaucacuuaaaguaagcauuuuuaaaggacacaaaauuugcuauuuuc

SEQ ID NO: 267555 - RNA, 64 nt, Homo Sapiens
ugaacaaacucccaugggaguuuaaagagcuauauuuuuaaacagaugccuaaauagaagcaag

SEQ ID NO: 267556 - RNA, 64 nt, Homo Sapiens
ucucauuucuacaucuuagcugcaggauacacaauuuuuaaaaacaaagacuaauucaagaagu

SEQ ID NO: 267557 - RNA, 64 nt, Homo Sapiens
aaguguuucuggaacuuuaucauuuacaacuccauuuuuaaauaacuuauguuauuuuguuaug

SEQ ID NO: 267558 - RNA, 64 nt, Homo Sapiens
cuguauuguuggaucaauuaagacuuuacaggauuuuuuaaaucaaguaacucuauacacuuca

SEQ ID NO: 267559 - RNA, 64 nt, Homo Sapiens
ucagaacauguauauuggucuuagguggaguauauuuuuaaaacgauuaaacuagacagauagu

SEQ ID NO: 267560 - RNA, 64 nt, Homo Sapiens
gaaaauuuugguggaguuaaagugaaaugaguaguuuuuaaacauuuuuccuguccuuuuuuug

SEQ ID NO: 267561 - RNA, 64 nt, Homo Sapiens
ugaaacauuuuugauacauaacagaccucagucuuuuuuaaaaauuaauauauuuucaggcgua

SEQ ID NO: 267562 - RNA, 64 nt, Homo Sapiens
cuucagaaugggaagagauagucaagauuuuuuuuuuuuaaagccauguggccuaacuugauac

SEQ ID NO: 267563 - RNA, 64 nt, Homo Sapiens
ugggggcuagggaagagccugccagauuuucacauuuuuaaaauguucuagucauuuugagaaa

SEQ ID NO: 267564 - RNA, 64 nt, Homo Sapiens
cuuuuaucucaguuauuugcccaucacaagcacauuuuuaaaauguugcuuuguguguguuuga

SEQ ID NO: 267565 - RNA, 64 nt, Homo Sapiens
gccugaaagguccauuaggacaucacucaugggauuuuuaaaaagccucuuuccaggaauggaa

SEQ ID NO: 267566 - RNA, 64 nt, Homo Sapiens
uuguaguuucagaaguuuuuuuguuuugguuuuuuuuuuaaagaaaugguagaaaauuugauaa

SEQ ID NO: 267567 - RNA, 64 nt, Homo Sapiens
gacagucacugccacuuugcacauuuugauuuuuuuuuuaaacaaacauuguguugacauuaag

SEQ ID NO: 267568 - RNA, 64 nt, Homo Sapiens
uccaaguuuccaaacaacagaaagucauuccuucuuuuuaaaauggugcuuaaguuccagcaga

SEQ ID NO: 267569 - RNA, 64 nt, Homo Sapiens
cacuuguacgcuguaaccucaucuacuucugauguuuuuaaaaaaugacuuuuaacaaggagag

SEQ ID NO: 267570 - RNA, 64 nt, Homo Sapiens
gguacuucuacuaaauuguugucuuguuuuuuauuuuuuaaauaaacugacaaaugacaaaaug

SEQ ID NO: 267571 - RNA, 64 nt, Homo Sapiens
aaaaauguauagaaaaaucaugucugugaguucauuuuuaaauguacuugcucagcucaacugc

SEQ ID NO: 267572 - RNA, 64 nt, Homo Sapiens
ccucuagcagcuugguagccuaguacagguuguuuuuuuaaaaaaggaaaagcaggaaggagga

SEQ ID NO: 267573 - RNA, 64 nt, Homo Sapiens
uuauccauuaaaguuacaucuucauguaucacaauuuuuaaaguugaaaagcaucccaguuaaa

SEQ ID NO: 267574 - RNA, 64 nt, Homo Sapiens
aauggcaaauacuucuaauuuuuuucccuaaacauuuuuaaaagugaaauaugggaagagcuuu

SEQ ID NO: 267575 - RNA, 64 nt, Homo Sapiens
uaaguauguugguuaauaggaauccuuuuuuuuuuuuuuaaagacuaaaugugaaaaaauaauc

SEQ ID NO: 267576 - RNA, 64 nt, Homo Sapiens
ucuaagauggaaccuuucuuucuuucuuucuuuuuuuuuaaauuuuguauuuuccauccaacag

SEQ ID NO: 267577 - RNA, 64 nt, Homo Sapiens
ugucaauugugaaaggaaaauguuaggaguaugguuuuuaaacuugggcuucauuuuaaacuuu

SEQ ID NO: 267578 - RNA, 64 nt, Homo Sapiens
gguuuuuaaacuugggcuucauuuuaaacuuuuuuuuuuaaacccaguuauuucacuugauuug

SEQ ID NO: 267579 - RNA, 64 nt, Homo Sapiens
ucuguuaaaaaugguauacaugaagucacauacuuuuuuaaaggaacacucagaacauucuguc

SEQ ID NO: 267580 - RNA, 64 nt, Homo Sapiens
uguuuuuucuuuuucuuuucuuuuuuuuuuuuuuuuuuuaaaaaagcaccuuuuuuuguuguuu

SEQ ID NO: 267581 - RNA, 64 nt, Homo Sapiens
aguuccuuggcuacuguuuuucuuuuacuucaguuuuuuaaaaaucucaaaugaaaaagucuuc

SEQ ID NO: 267582 - RNA, 64 nt, Homo Sapiens
aguauuguaauauguaaaguaagcccaacaaaaauuuuuaaaaauuugaugauccccaauauau

SEQ ID NO: 267583 - RNA, 64 nt, Homo Sapiens
agcuacuaggugaaaugcaaaacaaccaucaauuuuuuuaaacucaauaauuuugugaaaaaaa

SEQ ID NO: 267584 - RNA, 64 nt, Homo Sapiens
auuaacauuucauuuaagcuuuuaaaauaucaauuuuuuaaauagcucccauuuacccaaaaua

SEQ ID NO: 267585 - RNA, 64 nt, Homo Sapiens
agauaacugaccaaguguuuucuuagaaccaaaguuuuuaaaguugcuaagauauauuugccug

SEQ ID NO: 267586 - RNA, 64 nt, Homo Sapiens
guuuuuguugaagcucuagcuuaagaagaaacuuuuuuuaaaaagacuguuuggggauucuuuu

SEQ ID NO: 267587 - RNA, 64 nt, Homo Sapiens
aguagccucucugggcccaauaaaacaacacacauuuuuaaaaaauauggguauugauguccgg

SEQ ID NO: 267588 - RNA, 64 nt, Homo Sapiens
cuauucacaggaaacugauaagauauauguuauuuuuuuaaaugagcuagggcaauauguuuug

SEQ ID NO: 267589 - RNA, 64 nt, Homo Sapiens
aggcaugagccaccgugcccagccucaaaaauauuuuuuaaaagaaaagagaaaauaauucuuc

SEQ ID NO: 267590 - RNA, 64 nt, Homo Sapiens
uauuuuacuuuauugauaaugacaaaaagaauauuuuuuaaaccccaucaaaauagauuucaau

SEQ ID NO: 267591 - RNA, 64 nt, Homo Sapiens
acuuauacaaaaugguaguacuacuguguugugguuuuuaaacauuaaacauguaaaguuauau

SEQ ID NO: 267592 - RNA, 64 nt, Homo Sapiens
cuaaugaugacauucaguucucuuuuguuuuuauuuuuuaaaaacucagguguaauuauuaucu

SEQ ID NO: 267593 - RNA, 64 nt, Homo Sapiens
uuaaaaaaaaaaaagaaggcuaaaaaauuaccucuuuuuaaauuaugugcaaaauaauucuggc

SEQ ID NO: 267594 - RNA, 64 nt, Homo Sapiens
gccuuuuucugagaugcucacuuuauuaucccuauuuuuaaaguacacaauuguuuuaccuguu

SEQ ID NO: 267595 - RNA, 64 nt, Homo Sapiens
guggcgucucccucgcagagcccuucucguuucuuuuuuaaacuaaucaccauauuguaaauuu

SEQ ID NO: 267596 - RNA, 64 nt, Homo Sapiens
gauuuuuuauuauuauucaaaaacauaacugaguuuuuuaaaagaggagaaaauuuauaucugg

SEQ ID NO: 267597 - RNA, 64 nt, Homo Sapiens
uaguagaauuuuauugaaaggccuagguauuaauuuuuuaaaugagugcuuuaacuuaaaacag

SEQ ID NO: 267598 - RNA, 64 nt, Homo Sapiens
caacaauuucucuuguaaauggaaugguuugggguuuuuaaauaagcauuaacuaacaaccuuu

SEQ ID NO: 267599 - RNA, 64 nt, Homo Sapiens
guagccugucaacuaaauuugaguguuaacggucuuuuuaaagugcauuuaaauacaaaccagg

SEQ ID NO: 267600 - RNA, 64 nt, Homo Sapiens
uacuuauuucuuucaaaacauuuuugguuuuugguuuuuaaaauuuuuauuaaacaauugcugu

SEQ ID NO: 267601 - RNA, 64 nt, Homo Sapiens
acauuaaugaauuggugcugucaaaauauaguaauuuuuaaauuuguuaauaaugaaaacccuu

SEQ ID NO: 267602 - RNA, 64 nt, Homo Sapiens
gcaucuaacugccagugccauugucaaaacuuauuuuuuaaaucguuguacauuucuuauuaaa

SEQ ID NO: 267603 - RNA, 64 nt, Homo Sapiens
uguauaauugccaauugauuguaacuauuauuuauuuuuaaaugaaaguguaagaaugcuuucu

SEQ ID NO: 267604 - RNA, 64 nt, Homo Sapiens
uuguagguuuccuuaugcuguuuuuacugugcacuuuuuaaaauuagguuuuaauuucaguaug

SEQ ID NO: 267605 - RNA, 64 nt, Homo Sapiens
cuucuuauuauaguugaaggcauucuccagauucuuuuuaaaagauuuguucauauuucucucu

SEQ ID NO: 267606 - RNA, 64 nt, Homo Sapiens
gcaaucauuuaguggcauagaugcagccacuuguuuuuuaaauagaaguggcugucauacguga

SEQ ID NO: 267607 - RNA, 64 nt, Homo Sapiens
guuuaaaaccuuuauugucucuccuuagucuaauuuuuuaaauauggauuaugcuugaauuacu

SEQ ID NO: 267608 - RNA, 64 nt, Homo Sapiens
auuccauuacuauguggcuuagggauuuauuuguuuuuuaaaaucaaccauguuagcugggauu

SEQ ID NO: 267609 - RNA, 64 nt, Homo Sapiens
gcuacuuaaauuuccaauaauuaaaaauuuaaaauuuuuaaauuagaauugccaauacuucuac

SEQ ID NO: 267610 - RNA, 64 nt, Homo Sapiens
agauuuuaaaguagaaauaaauauguauuccauguuuuuaaaagauuacuuucuacuuuguguu

SEQ ID NO: 267611 - RNA, 64 nt, Homo Sapiens
uaaauuauuccauauuuucuuuucagugaaaaauuuuuuaaauggaagacuguucuaaaaucac

SEQ ID NO: 267612 - RNA, 64 nt, Homo Sapiens
ugauauaaagaaaacuuuuuugugcuaaaaauacuuuuuaaaaucaauuuuguugauuguagua

SEQ ID NO: 267613 - RNA, 64 nt, Homo Sapiens
ucugacaagauaaaggaagucaccaaaauuucuuuuuuuaaauuguaucuaauccucaacaaca

SEQ ID NO: 267614 - RNA, 64 nt, Homo Sapiens
agguacuaucugugaaguuacacuuuuuuuuuuuuuuuuaaagguagagaugugugugugugua

SEQ ID NO: 267615 - RNA, 64 nt, Homo Sapiens
aauccagucuuaugaaguauuguuauuaaaugucuuuuuaaaaagagaaauauaaacauauauu

SEQ ID NO: 267616 - RNA, 64 nt, Homo Sapiens
auaaacauauauuuuuacuauuaaaauauucaguuuuuuaaaugaaguagaacuugaguucaug

SEQ ID NO: 267617 - RNA, 64 nt, Homo Sapiens
caugccgaacuuucuugugacaaauugucuggauuuuuuaaaaaaggaaaaagcaagaaugaau

SEQ ID NO: 267618 - RNA, 64 nt, Homo Sapiens
ggagauucuguuaaauauuuuggaacucuuuuuuuuuuuaaauuauaguauuuccucuaaaaaa

SEQ ID NO: 267619 - RNA, 64 nt, Homo Sapiens
uggagagagagaauaaagagauuauuuuucauuauuuuuaaaugguuguuuuuguuuuaauuug

SEQ ID NO: 267620 - RNA, 64 nt, Homo Sapiens
uacacagaggaaauaacuuaggcacuuucuguuuuuuuuaaaaaaauaauaaggucucauggcu

SEQ ID NO: 267621 - RNA, 64 nt, Homo Sapiens
uauucuaauuuuauauauagagaaagugaccuauuuuuuaaaaaaaucacacucuaaguucuau

SEQ ID NO: 267622 - RNA, 64 nt, Homo Sapiens
uaauuagauuuucuugcaguuuuuuuauggcauuuuuuuaaagaugcccuaaguguugaagaag

SEQ ID NO: 267623 - RNA, 64 nt, Homo Sapiens
ccuuucuuauuugcaauaaaagguauugagccauuuuuuaaaugacauuuuugauaaauuaugu

SEQ ID NO: 267624 - RNA, 64 nt, Homo Sapiens
cucugugaugauuaacaguaugucaccacuucauuuuuuaaaaaggaucacgucuaaugcccau

SEQ ID NO: 267625 - RNA, 64 nt, Homo Sapiens
cugaaugcuuuuuguuggauuucguaggguauuuuuuuuaaaauagggucuugcuauguugccc

SEQ ID NO: 267626 - RNA, 64 nt, Homo Sapiens
uuuuauguguauuguaaguagcaguuaaauuauuuuuuuaaaagcaauuucaguuuuaaucacu

SEQ ID NO: 267627 - RNA, 64 nt, Homo Sapiens
caaucuuggagucuagguugccuugucucuccuauuuuuaaauaagugaaauuugggagauugu

SEQ ID NO: 267628 - RNA, 64 nt, Homo Sapiens
aagcugccuuaguuuauuuuuagagauuacagaauuuuuaaacagggagacgugugauauacuc

SEQ ID NO: 267629 - RNA, 64 nt, Homo Sapiens
acucccucccuucccuacuauugccucucugaccuuuuuaaauuauuuuuaauaccaaaagagu

SEQ ID NO: 267630 - RNA, 64 nt, Homo Sapiens
cuuuccccaagaaucuccuugggacuuugacuuauuuuuaaagcuguguuggagcucaucuugu

SEQ ID NO: 267631 - RNA, 64 nt, Homo Sapiens
aaaguaugccucccguggguauacguuuuuaccuuuuuuaaaaaacauuuuuguagaaaaaaua

SEQ ID NO: 267632 - RNA, 64 nt, Homo Sapiens
gguagagaaacagaugacaaaucucugaaagagguuuuuaaaacuuuugauccaacugcuucac

SEQ ID NO: 267633 - RNA, 64 nt, Homo Sapiens
guuuuguaacugguuuaccucuauaguuuauuuauuuuuaaauuauaaacacuuuucagcugcu

SEQ ID NO: 267634 - RNA, 64 nt, Homo Sapiens
uauuuguguaaaugaagcauuugaaugucauaucuuuuuaaaguauuuuauuguauacuguauc

SEQ ID NO: 267635 - RNA, 64 nt, Homo Sapiens
guguucaucaugacuuuggcgauuuuuaacaaaauuuuuaaagacccagugagagucuguagug

SEQ ID NO: 267636 - RNA, 64 nt, Homo Sapiens
uugaaugaaagcagugcccuugagaagggauuuuuuuuuaaauauacaguaaaauauuucgugg

SEQ ID NO: 267637 - RNA, 64 nt, Homo Sapiens
ugccuaguucccuuuuuuuuucuuuuuuuacuuuuuuuuaaacguuuguaaaaaccucuuugag

SEQ ID NO: 267638 - RNA, 64 nt, Homo Sapiens
uggcuuccaauaaguaucuuaggaacuuauuuccuuuuuaaaaaauauuuuuuaaauuuuuaaa

SEQ ID NO: 267639 - RNA, 64 nt, Homo Sapiens
uaucuuaggaacuuauuuccuuuuuaaaaaauauuuuuuaaauuuuuaaaauuugauuuuaaau

SEQ ID NO: 267640 - RNA, 64 nt, Homo Sapiens
gaacuuauuuccuuuuuaaaaaauauuuuuuaaauuuuuaaaauuugauuuuaaauuucaaaua

SEQ ID NO: 267641 - RNA, 64 nt, Homo Sapiens
uacuacauuaaaaaguguugauuaauagaugaaauuuuuaaauuaauuuuuuaaaacaugccau

SEQ ID NO: 267642 - RNA, 64 nt, Homo Sapiens
aguguugauuaauagaugaaauuuuuaaauuaauuuuuuaaaacaugccauacauuguaucaca

SEQ ID NO: 267643 - RNA, 64 nt, Homo Sapiens
acuuucuauuuuuuaccugugaaauaacagugacuuuuuaaaauggugacaguguuggcaagga

SEQ ID NO: 267644 - RNA, 64 nt, Homo Sapiens
guuugucaucuuuaaaaauacagcaauaugugacuuuuuaaaaaagcugucaaauaggugugac

SEQ ID NO: 267645 - RNA, 64 nt, Homo Sapiens
uuuuggaguaggagguucccuccucaauuuuguauuuuuaaaaguacaugguaaaaaaaaaaau

SEQ ID NO: 267646 - RNA, 64 nt, Homo Sapiens
uguaugcguauauaagcaaauauguaaucuuuauuuuuuaaauaaaugggaucauauuauauau

SEQ ID NO: 267647 - RNA, 64 nt, Homo Sapiens
uucuauuuaguauuuucagagaaaauugaagguuuuuuuaaacaucacuggauuucuugauuga

SEQ ID NO: 267648 - RNA, 64 nt, Homo Sapiens
ugaaaauuuauucuuaugagacguauaguauucauuuuuaaaugcaugauuguacauuauguau

SEQ ID NO: 267649 - RNA, 64 nt, Homo Sapiens
auuugcaguacuguguucuucagcuagaggcagcuuuuuaaauaaugcaaguguauuuauuagc

SEQ ID NO: 267650 - RNA, 64 nt, Homo Sapiens
ggucccuuuuccuuggauguguaguuauaugaucuuuuuaaauguacagauauuuugcuauaaa

SEQ ID NO: 267651 - RNA, 64 nt, Homo Sapiens
uaaaccaaugugaauucaaaaaagagaaggaaacuuuuuaaauucaauuuagaguacauaaaaa

SEQ ID NO: 267652 - RNA, 64 nt, Homo Sapiens
acuaaaacuacaugaguuucauguuagaaaagaauuuuuaaacaaucuucagauggcuugaaca

SEQ ID NO: 267653 - RNA, 64 nt, Homo Sapiens
uugaauuccaaauucaccuagcaauaaaaucuaauuuuuaaaaaguauauaaauauaaaaugua

SEQ ID NO: 267654 - RNA, 64 nt, Homo Sapiens
aaaaaaauuauugcaaucucaaguuaauggaauauuuuuaaaucccacauucagaguuuaaaac

SEQ ID NO: 267655 - RNA, 64 nt, Homo Sapiens
gaauuuuuuucuggauuuacuauauaacucuuauuuuuuaaaagaucauucuguucuuucaagg

SEQ ID NO: 267656 - RNA, 64 nt, Homo Sapiens
aaaacaacugguagaauuauuuaaacacuuuagauuuuuaaauaauauacauggcuuuaauuuu

SEQ ID NO: 267657 - RNA, 64 nt, Homo Sapiens
uuuacacuuauauuuucacaguuaauugaacauauuuuuaaacaacuguaguuuugggcaacuu

SEQ ID NO: 267658 - RNA, 64 nt, Homo Sapiens
caugcauugucuuagcucugagguuaauuuaccauuuuuaaauuuuauuguaaagaaguguaau

SEQ ID NO: 267659 - RNA, 64 nt, Homo Sapiens
cggaaucccuagggcuagagccuagaaaucucacuuuuuaaaaugcuuccaagguaagucugau

SEQ ID NO: 267660 - RNA, 64 nt, Homo Sapiens
uuuguauuugacuuuauuuccuuuauucaaaucauuuuuaaaaacuuacauuuugaacaaacac

SEQ ID NO: 267661 - RNA, 64 nt, Homo Sapiens
gaaggaggacaaggcccauggguggguguugagguuuuuaaaguguggucaggaaaggccccac

SEQ ID NO: 267662 - RNA, 64 nt, Homo Sapiens
uucucuuuguuauuauaaugugugauuaaaugcuuuuuuaaauugcuaagggaaaauaacaaag

SEQ ID NO: 267663 - RNA, 64 nt, Homo Sapiens
acuuaacuuacuauuucaaagggaaguauauuucuuuuuaaagaaucuuuuuaagauuaaaaau

SEQ ID NO: 267664 - RNA, 64 nt, Homo Sapiens
ugacuuagaagauaucauugccauguagguuuuauuuuuaaaagucuugagcucuucuuaaaua

SEQ ID NO: 267665 - RNA, 64 nt, Homo Sapiens
ugccucuuuguuuuucaauagauuauucugccauuuuuuaaaggaaagggaaaaugaaaacagc

SEQ ID NO: 267666 - RNA, 64 nt, Homo Sapiens
uuuuaaaggaaagggaaaaugaaaacagcaugucuuuuuaaacauugaaaagaaauauggaggc

SEQ ID NO: 267667 - RNA, 64 nt, Homo Sapiens
auucuauuuauuugagguuaauugaaguuaauaauuuuuaaauuuuuuucuaauuuuaugccuu

SEQ ID NO: 267668 - RNA, 64 nt, Homo Sapiens
aaugauuucccaaaagccauaccuuaaagauaacuuuuuaaauucugaagagacaugccaaugu

SEQ ID NO: 267669 - RNA, 64 nt, Homo Sapiens
agagacaugccaaugucaaacuaaacauguucuguuuuuaaaccaacaaacauguuacuauuca

SEQ ID NO: 267670 - RNA, 64 nt, Homo Sapiens
auaagcuguauauucaccaguguggcacucaugguuuuuaaauaagauuaguauuaucuguuua

SEQ ID NO: 267671 - RNA, 64 nt, Homo Sapiens
uauuaauggcacuauaaaccaaugguaaugguaauuuuuaaacuugcuaaauauugagaaacua

SEQ ID NO: 267672 - RNA, 64 nt, Homo Sapiens
aagagaaaaguaaaauauuucuuaugccuauuuuuuuuuaaaucaaaagggagagaacaaaagc

SEQ ID NO: 267673 - RNA, 64 nt, Homo Sapiens
ggacuacaggggcccgccaccacaccuggcuaauuuuuuaaaaauauuuuuaguagagacaggg

SEQ ID NO: 267674 - RNA, 64 nt, Homo Sapiens
caaucuugcaacacuauccuguuucucagaacaguuuuuaaaugccaaucauagaggguacugu

SEQ ID NO: 267675 - RNA, 64 nt, Homo Sapiens
uucuucaaccuucaaaacuaucucaucugucagauuuuuaaaacuccaacacagguuuuggcau

SEQ ID NO: 267676 - RNA, 64 nt, Homo Sapiens
ccacuuuaucacauguacagaucacaaauaaauuuuuuuaaauacaaaaugaacauuuauuuag

SEQ ID NO: 267677 - RNA, 64 nt, Homo Sapiens
agcuaugcagaaaaauuuagcuuaugcuuccauauuuuuaaauuuuguuuuuuaaguuuugcac

SEQ ID NO: 267678 - RNA, 64 nt, Homo Sapiens
ccuuuuaguaauaaaaugacuugaaaucauauuauuuuuaaaagcccuuugcuucuuucauuac

SEQ ID NO: 267679 - RNA, 64 nt, Homo Sapiens
uuauaaucuccucuaaaacaaccucugcauguuuuuuuuaaauaaagcacuuucugucaaauaa

SEQ ID NO: 267680 - RNA, 64 nt, Homo Sapiens
caagauggugaaaccccgucucuauuaaaaauauuuuuuaaaaauuaacugagcgugguggugg

SEQ ID NO: 267681 - RNA, 64 nt, Homo Sapiens
guaaauugaugggagaaaugaggaaaagaaaaucuuuuuaaaaaugauuucaagguuugugcug

SEQ ID NO: 267682 - RNA, 64 nt, Homo Sapiens
ucaguaaaccaaucccuugaguuauauaacaagauuuuuaaauaaauguuauuguccucaccuu

SEQ ID NO: 267683 - RNA, 64 nt, Homo Sapiens
auauuaacaauuuaacagagaaucucuagugaauuuuuuaaaugaaagaaguuguaaggauaua

SEQ ID NO: 267684 - RNA, 64 nt, Homo Sapiens
uuuccagcuugccuguuuuugaguauguuugauguuuuuaaaauuuugucuucucuguggaaga

SEQ ID NO: 267685 - RNA, 64 nt, Homo Sapiens
acagcaauuaacuuuaagccuccuuuuagagauauuuuuaaaacuuguuuaaaauuuuugugca

SEQ ID NO: 267686 - RNA, 64 nt, Homo Sapiens
cauauuggggaagcagugauuuuaaaaccucaaguuuuuaaacaugauuuauauguucuguaua

SEQ ID NO: 267687 - RNA, 64 nt, Homo Sapiens
auuuauauguucuguauaauguucaguuuguaacuuuuuaaaaguuuggauguauagagggaua

SEQ ID NO: 267688 - RNA, 64 nt, Homo Sapiens
ggaaauacuguaugguuuuguuuuguuuuguugguuuuuaaagauuuuuguuuguuuauugaau

SEQ ID NO: 267689 - RNA, 64 nt, Homo Sapiens
guacggcuggcuacaacugcuccauccgugccucuuuuuaaaguucaaacucacaggugacucu

SEQ ID NO: 267690 - RNA, 64 nt, Homo Sapiens
cagacugcaaaaggccuauuuuaacuauugauuuuuuuuaaaaaaaauugucuuugaauguauu

SEQ ID NO: 267691 - RNA, 64 nt, Homo Sapiens
aaaccgaacacaacucagaaacuuggaaucguuuuuuuuaaaaaugccucugagcaacccauau

SEQ ID NO: 267692 - RNA, 64 nt, Homo Sapiens
uauuuuaaaaguuuuaucuuaaauugauuaaaacuuuuuaaaaagcuuugguauuaaaagaggu

SEQ ID NO: 267693 - RNA, 64 nt, Homo Sapiens
aaaaaaacuucaacguaagacuguguaagauuuguuuuuaaaccguacacuguguuuuuuugua

SEQ ID NO: 267694 - RNA, 64 nt, Homo Sapiens
uguugacauucugaaugcuucuaaguaaauacaauuuuuaaaaaaccguaugagggaacugugu

SEQ ID NO: 267695 - RNA, 64 nt, Homo Sapiens
cacauuuuaacaguaccugugccugagaauuuaauuuuuaaaagacuuugauguguuuuuguau

SEQ ID NO: 267696 - RNA, 64 nt, Homo Sapiens
uuuaaagaagucucuuaauucugaugcuagguuguuuuuaaaaccacuaugcaaagaacucacc

SEQ ID NO: 267697 - RNA, 64 nt, Homo Sapiens
cugucaaaguuacaguuuacaauuugauuuuuauuuuuuaaaugaaguggccucaaaggcacuu

SEQ ID NO: 267698 - RNA, 64 nt, Homo Sapiens
auuauugguuauagaaacaauugauuaacaaauguuuuuaaaguuauaucaaugucagccuauu

SEQ ID NO: 267699 - RNA, 64 nt, Homo Sapiens
ucccacuuuauuuuuuauacuacugcaagaagguuuuuuaaacuauauauauauaguacucuaa

SEQ ID NO: 267700 - RNA, 64 nt, Homo Sapiens
ccacacaaagccgcugucucguguuuguuucauuuuuuuaaaacagucacugcagcaacgccuu

SEQ ID NO: 267701 - RNA, 64 nt, Homo Sapiens
uuuuuuaucuuuauaugguuaaaucgagagugauuuuuuaaaaauaauguaaauuuauuucucc

SEQ ID NO: 267702 - RNA, 64 nt, Homo Sapiens
aaaaaguacaguauucuuuuagucacaaaaauaguuuuuaaagguguaaauuuuuaccuuguaa

SEQ ID NO: 267703 - RNA, 64 nt, Homo Sapiens
aaaacuauuuauugacuuuagaaucuucaauuuuuuuuuaaagcucaaaacacaacucaacuau

SEQ ID NO: 267704 - RNA, 64 nt, Homo Sapiens
aaagaaaaaaaaaaaaaaggagcucugaaucaguuuuuuaaaaaguaaguaagcagccacugca

SEQ ID NO: 267705 - RNA, 64 nt, Homo Sapiens
uguuagaaaucccuggaggcccaagaaguaacacuuuuuaaacuugucuucaacaucugaguca

SEQ ID NO: 267706 - RNA, 64 nt, Homo Sapiens
aacugauugauauauguuauaauaucaaaacaacuuuuuaaaugaucgcacuuuucaucuuggu

SEQ ID NO: 267707 - RNA, 64 nt, Homo Sapiens
auagcuuacaaaauacauucucugaagaguaauauuuuuaaacuuccugcuugggcuccaaauu

SEQ ID NO: 267708 - RNA, 64 nt, Homo Sapiens
uuguuuagccacuuaaaaucuuauuguuacuugcuuuuuaaacuuguaccagaaacauuuucuu

SEQ ID NO: 267709 - RNA, 64 nt, Homo Sapiens
aguuuucuuuaggaacugucucuggguuaugccuuuuuuaaaguguuggucaaaugagggaaca

SEQ ID NO: 267710 - RNA, 64 nt, Homo Sapiens
aauuacaguguaguguuuauacaauuacuuuuauuuuuuaaagaugccaccauuauaaauugcc

SEQ ID NO: 267711 - RNA, 64 nt, Homo Sapiens
auaaaaacaaguaucucaugcaggaaggaaagacuuuuuaaaaaaagaagacagggaaugcaau

SEQ ID NO: 267712 - RNA, 64 nt, Homo Sapiens
acauuuuucauuuuguuucuauaccacuguuuguuuuuuaaaaacauccaacucaugacaagag

SEQ ID NO: 267713 - RNA, 64 nt, Homo Sapiens
ggugguuaccaaagaguucaugcuuucauccaaauuuuuaaauucagaucuguccauguggaaa

SEQ ID NO: 267714 - RNA, 64 nt, Homo Sapiens
uuuaacaguguacuucuuagagaaacauacugacuuuuuaaaauaaucuucaaggucugaaaug

SEQ ID NO: 267715 - RNA, 64 nt, Homo Sapiens
uuuuaggacuuacuauaccuucaacugccaaaauuuuuuaaaggaucaaggagcacuacuggau

SEQ ID NO: 267716 - RNA, 64 nt, Homo Sapiens
ucuuuaaggagacuuuuaacaacuauaggaaucauuuuuaaaaagaaguaacaagacaccuagc

SEQ ID NO: 267717 - RNA, 64 nt, Homo Sapiens
acacuucauuauguuuagggguuaagaaaaauuuuuuuuaaaaaaaacuuuuuuaaauauaaau

SEQ ID NO: 267718 - RNA, 64 nt, Homo Sapiens
uaaauguuaagaaaaauuuuuuuuguacaaaacuuuuuuaaauacuucuacagugcaaggauuu

SEQ ID NO: 267719 - RNA, 64 nt, Homo Sapiens
cuaaaaaaaaaaaaacuuugucauugaggagcauuuuuuaaaaaaaaaaaaauugaacacaauc

SEQ ID NO: 267720 - RNA, 64 nt, Homo Sapiens
uacuggcaccaaaagaaauagcuuuaauaaugucuuuuuaaaaauucauuuuaugaagauauuu

SEQ ID NO: 267721 - RNA, 64 nt, Homo Sapiens
augauuaaauugaauguguaccaaaguuuuauuuuuuuuaaacaaaagaaaugggcuguuuugc

SEQ ID NO: 267722 - RNA, 64 nt, Homo Sapiens
uagacagcauguaugguaugguuguguauguuuuuuuuuaaacuucuugugcaauaauuuacau

SEQ ID NO: 267723 - RNA, 64 nt, Homo Sapiens
acaaaacuuguugcuuagaagaauuuucuuuugguuuuuaaaaauccuauuacaaaacuguucu

SEQ ID NO: 267724 - RNA, 64 nt, Homo Sapiens
auuuauaauaaauaguagcauuaagaugaagaauuuuuuaaaacuucugcucuggucauuugca

SEQ ID NO: 267725 - RNA, 64 nt, Homo Sapiens
uuaaauuuaugaaccaccuucaacuuacagaucguuuuuaaagcgcuccaaagagccaaaguau

SEQ ID NO: 267726 - RNA, 64 nt, Homo Sapiens
uuuuuuaguagcacuuucuccaaaggguugauauuuuuuaaagucaaauuuuuaagaaaagcau

SEQ ID NO: 267727 - RNA, 64 nt, Homo Sapiens
augggauguuuuguuguuguuauuuauuuaaaaauuuuuaaauuuucuuuaggaauaacuuuua

SEQ ID NO: 267728 - RNA, 64 nt, Homo Sapiens
ucauaaauuugaagagugguauggggagaggggauuuuuaaaugccccuggcuauuuuauauua

SEQ ID NO: 267729 - RNA, 64 nt, Homo Sapiens
guguugccaccacuucuaaacuaaaguagaacauuuuuuaaauuuaugagccuccccauuaccc

SEQ ID NO: 267730 - RNA, 64 nt, Homo Sapiens
acugcugaaugacauauuuucuguagucuuuuauuuuuuaaaugugguuuuuauuuccuuguau

SEQ ID NO: 267731 - RNA, 64 nt, Homo Sapiens
aaacuguaaaacuuaaaacuuuguuucuguuuuguuuuuaaaucgaugugauuuauuuugaaau

SEQ ID NO: 267732 - RNA, 64 nt, Homo Sapiens
uucuaacauaagaccuguucgacaaacauguauauuuuuaaaugagaacacauugcagaaguaa

SEQ ID NO: 267733 - RNA, 64 nt, Homo Sapiens
gccuccaauacucuuauggaaaaauaacaaacauuuuuuaaaagaugaaaagcccccauuuaaa

SEQ ID NO: 267734 - RNA, 64 nt, Homo Sapiens
acuaaaauaaguucaaguuugacacagcuccagguuuuuaaauugacccccuagcaacguaguu

SEQ ID NO: 267735 - RNA, 64 nt, Homo Sapiens
gagaaguuuaacuuugcuaugguuuguugcuuuauuuuuaaaaguuccauuuuguugcuugguu

SEQ ID NO: 267736 - RNA, 64 nt, Homo Sapiens
uauugauuuuuugcccaugcuuaagaccuuuauauuuuuaaagaccaucuuuuucuuauggacu

SEQ ID NO: 267737 - RNA, 64 nt, Homo Sapiens
ugcauugaaaauuugaaaggaguaguuauuauccuuuuuaaaaagccaaugaaucccuaccagc

SEQ ID NO: 267738 - RNA, 64 nt, Homo Sapiens
cauaaaauaaauuuuuauaaaauaauuuaaauauuuuuuaaaacuuuuaaagaaauguuuauac

SEQ ID NO: 267739 - RNA, 64 nt, Homo Sapiens
aauguuuauacaauaauuuauucuacagaccauauuuuuaaagacuuagguuuuacucuuuucu

SEQ ID NO: 267740 - RNA, 64 nt, Homo Sapiens
auuguaaagucaagguuuucaguccuuagaguguuuuuuaaaaaccuguaaauguguuuugucc

SEQ ID NO: 267741 - RNA, 64 nt, Homo Sapiens
guugguaaaucuuaccuguaaaggacacuauguauuuuuaaagauucuggagaguuuguaaaac

SEQ ID NO: 267742 - RNA, 64 nt, Homo Sapiens
caccuuuagagccuaauuacaccacuaggcccccuuuuuaaaaaucucucuuccuccucagcga

SEQ ID NO: 267743 - RNA, 64 nt, Homo Sapiens
ucagagcgcucuagccacuauguguggggugcaguuuuuaaaaagcugagauggcgaaacccug

SEQ ID NO: 267744 - RNA, 64 nt, Homo Sapiens
cuuaaauccucuguccaacuuuaugcuucuuaauuuuuuaaaauuugaccagagcacagauuac

SEQ ID NO: 267745 - RNA, 64 nt, Homo Sapiens
guccacagaggagaauuugcaaaaaaauguaaauuuuuuaaaaauacucugcaaaguagccuuu

SEQ ID NO: 267746 - RNA, 64 nt, Homo Sapiens
uuuuuauagaggugggguuucaacucucagcuaauuuuuaaaauggggccacaggugugcacca

SEQ ID NO: 267747 - RNA, 64 nt, Homo Sapiens
gagauagggucuuaacucuugcuuuuuuuuuuuuuuuuuaaaugaaccgcuguuaguuugaaau

SEQ ID NO: 267748 - RNA, 64 nt, Homo Sapiens
guugaagucacuguguauguaacuuuuguugcauuuuuuaaacuuuauaacuguuauaaagcag

SEQ ID NO: 267749 - RNA, 64 nt, Homo Sapiens
uuuuaaucuccuuuacaaaaccacuuugauuuaauuuuuaaauguauaaucuauucauggaucu

SEQ ID NO: 267750 - RNA, 64 nt, Homo Sapiens
acauuuaaaaaaaauccaaauuacaaaauaauaauuuuuaaaaaggaaacaaaucuucuguuau

SEQ ID NO: 267751 - RNA, 64 nt, Homo Sapiens
aagcagucauucuuucuacuuuucuauauuuguuuuuuuaaaggaaaguuacguggaagcaaga

SEQ ID NO: 267752 - RNA, 64 nt, Homo Sapiens
guuacguggaagcaagauuuacaauggacauuaguuuuuaaaaaacauauucagauugggaaaa

SEQ ID NO: 267753 - RNA, 64 nt, Homo Sapiens
ggugauucaaguaccguugcagugguguguuguuuuuuuaaagauggaugauaaguguguuuuu

SEQ ID NO: 267754 - RNA, 64 nt, Homo Sapiens
cuauucaggauuauuagccuuguuuaaauuaucuuuuuuaaaacaugugaacacugcaaaaaug

SEQ ID NO: 267755 - RNA, 64 nt, Homo Sapiens
uuuaggugccuuugcggauguuuuauuuguuauuuuuuuaaaagauccaucaccaguggaguuu

SEQ ID NO: 267756 - RNA, 64 nt, Homo Sapiens
aacuaaauaaaacaaauaaaaacuaaugaaggguuuuuuaaaagcagcagagaaauaagaauaa

SEQ ID NO: 267757 - RNA, 64 nt, Homo Sapiens
uuuggcuauacuuaagauauagaaaaggggugauuuuuuaaagacaaauguagcacuagaggca

SEQ ID NO: 267758 - RNA, 64 nt, Homo Sapiens
auuaaaauuucugaaaaccacaaaaggcaucugauuuuuaaaaaucagauaaacauacaacuuc

SEQ ID NO: 267759 - RNA, 64 nt, Homo Sapiens
aaaauuuuuuuaaucucuagggcaaaguguuggcuuuuuaaaaauaauaagguauaacaagcuu

SEQ ID NO: 267760 - RNA, 64 nt, Homo Sapiens
cacaugaccacauauguauauuaccauuacuuguuuuuuaaaaauuacaugguuuuguuuaaaa

SEQ ID NO: 267761 - RNA, 64 nt, Homo Sapiens
acagaaaaugaggggccaggugcugcagccugaguuuuuaaaaacacuugcuaucuauucugug

SEQ ID NO: 267762 - RNA, 64 nt, Homo Sapiens
uaauuucaucagguuuuuuguguggaauauaaacuuuuuaaaaagaaauaggaaacugaaacuc

SEQ ID NO: 267763 - RNA, 64 nt, Homo Sapiens
ccagaaagucauuuaaaauaguauuuaaagaaauuuuuuaaaauuaaauauuacaaaaaugauu

SEQ ID NO: 267764 - RNA, 64 nt, Homo Sapiens
uacauaaaugucauaaaguuuaacgauacaaaguuuuuuaaaaaaagaaugacuagccuuuuua

SEQ ID NO: 267765 - RNA, 64 nt, Homo Sapiens
aaauagagucuggaaugcuaguaucugggcugauuuuuuaaauaguauguuaauaucugauacu

SEQ ID NO: 267766 - RNA, 64 nt, Homo Sapiens
aaauauauaaugcaacaauguacaaccuauguaauuuuuaaagcauagucucaaaucaaauaca

SEQ ID NO: 267767 - RNA, 64 nt, Homo Sapiens
uuccuuggaggcuggaagggaacauaauugcauguuuuuaaaaauacaguagccaaggaauaca

SEQ ID NO: 267768 - RNA, 64 nt, Homo Sapiens
uguauuuuuauacaaccuccuaauaaaaguucauuuuuuaaauuaauuauuuuguauuuaugau

SEQ ID NO: 267769 - RNA, 64 nt, Homo Sapiens
cuugauauuccuguauggugcucaguguucuguuuuuuuaaaaagccacaauaccuuuuuaaua

SEQ ID NO: 267770 - RNA, 64 nt, Homo Sapiens
ucuugucagaagaucccagaaggcauuuuaagauuuuuuaaaaaagauggcuucacugaagaaa

SEQ ID NO: 267771 - RNA, 64 nt, Homo Sapiens
uuacgugugcacagagagguauauuacccucuccuuuuuaaaaaaucaagccucaguccccuuc

SEQ ID NO: 267772 - RNA, 64 nt, Homo Sapiens
uaguucuuuuguaaugugguucaauccuuuuuuauuuuuaaaaauuuauuuuuuuucuuuuccc

SEQ ID NO: 267773 - RNA, 64 nt, Homo Sapiens
gcaacauguguacuuaauuuaccugcuagacacauuuuuaaaaucauuuuaauuuuguacaaua

SEQ ID NO: 267774 - RNA, 64 nt, Homo Sapiens
acugaaaauacuuaggaaggguggcaauaaauuuuuuuuaaaaauccucuugacuccuugugau

SEQ ID NO: 267775 - RNA, 64 nt, Homo Sapiens
gggacaaaaauaucugcuuuauuaauuucuucauuuuuuaaaugaggguaccacccuauuaagc

SEQ ID NO: 267776 - RNA, 64 nt, Homo Sapiens
aaaagaaaacaaaagccagauuacuguacauuuauuuuuaaagaacaaacuuuugcuuguaguu

SEQ ID NO: 267777 - RNA, 64 nt, Homo Sapiens
acuggcaaugacccacucccacaccccuauguaguuuuuaaaacauaaacauacacacacacac

SEQ ID NO: 267778 - RNA, 64 nt, Homo Sapiens
aagagcuaagauaaagacugcuaauuuaaguacauuuuuaaaaaggaagcaaccagcaaauuaa

SEQ ID NO: 267779 - RNA, 64 nt, Homo Sapiens
agaugguugaaacacccaugcuuuuuuuuuuuuuuuuuuaaagcuuuguuucuuucuuccucuu

SEQ ID NO: 267780 - RNA, 64 nt, Homo Sapiens
ucucuguuguuuguaauauucuaguuuuuaggguuuuuuaaaaccugucaaguacuuuuuuaaa

SEQ ID NO: 267781 - RNA, 64 nt, Homo Sapiens
aguuuuuaggguuuuuuaaacacugucaaguacuuuuuuaaacuauccauggguauuaaaagga

SEQ ID NO: 267782 - RNA, 64 nt, Homo Sapiens
ggugaaacugacccaaauauuguuaguaccuauauuuuuaaacuucccaugaaagaauucaguu

SEQ ID NO: 267783 - RNA, 64 nt, Homo Sapiens
acaaauauaaaaauagcaacgagaagggccuaccuuuuuaaagguagggauauggaaguaagug

SEQ ID NO: 267784 - RNA, 64 nt, Homo Sapiens
gaaaauguaaagguguguuucaaacaaaucaacauuuuuaaaaagaauggacaguagccacuua

SEQ ID NO: 267785 - RNA, 64 nt, Homo Sapiens
augcucuggcauguugaauagacccauuugauauuuuuuaaaccgaauauuuccuaguucauuu

SEQ ID NO: 267786 - RNA, 64 nt, Homo Sapiens
agaaaaaaaaaaauucacaccaaagagagauuuuuuuuuaaagaauaaugguaaaaccaugacg

SEQ ID NO: 267787 - RNA, 64 nt, Homo Sapiens
aucccagaauacuguguguauagaauacacuuauuuuuuaaacacuuugugcuaucaaauggaa

SEQ ID NO: 267788 - RNA, 64 nt, Homo Sapiens
ucacaaaguaauuuuaaaugauacuuuuacucuauuuuuaaagauuaaggacuucuggauaacu

SEQ ID NO: 267789 - RNA, 64 nt, Homo Sapiens
cagaaaccuagcagcccaucuucuuauaugaaauuuuuuaaaaggcuuccugcuugaaacccaa

SEQ ID NO: 267790 - RNA, 64 nt, Homo Sapiens
ggaaucucugcacccaaaugagcgaugcuucgaauuuuuaaaacgcgaacaaagagcgaaccaa

SEQ ID NO: 267791 - RNA, 64 nt, Homo Sapiens
uauuuuuuauuauauauuuaguguuuuauagaauuuuuuaaaguuaacauauaauguagauauu

SEQ ID NO: 267792 - RNA, 64 nt, Homo Sapiens
augauauuuaccagugaucuagcauauguaaucuuuuuuaaagguauuguuaauaaauauucug

SEQ ID NO: 267793 - RNA, 64 nt, Homo Sapiens
gccaguuucaaagguuacuuguuuuuuuuuuuuuuuuuuaaagucagaauguuaacagcuguga

SEQ ID NO: 267794 - RNA, 64 nt, Homo Sapiens
aaaccagcuucuguauucaaaucuuuccuucauuuuuuuaaauuuuuuuuuuggcagcgcuugu

SEQ ID NO: 267795 - RNA, 64 nt, Homo Sapiens
cucuuccuucuuucugcaaggcagaggaauaauauuuuuaaagguuauuuuguuuuaguuuuaa

SEQ ID NO: 267796 - RNA, 64 nt, Homo Sapiens
uuuuccacuuuuguucuacuccuucccuaauagcuuuuuaaaaaaaucuccccaguagagaaac

SEQ ID NO: 267797 - RNA, 64 nt, Homo Sapiens
ugggcucauagugagaacccaucuauacaaaaaauuuuuaaaaauuagcauggcggcacacauc

SEQ ID NO: 267798 - RNA, 64 nt, Homo Sapiens
agugugacuuuaucuucugggugguuugauaguguuuuuaaaaguaauauauaaugugggguga

SEQ ID NO: 267799 - RNA, 64 nt, Homo Sapiens
ccuuuauuuuauuauuaacuaauuaacuaugagauuuuuaaaaaauggggccgcugaugugcaa

SEQ ID NO: 267800 - RNA, 64 nt, Homo Sapiens
aagaacuuaaagaaauucacuacugcaguuuuuauuuuuaaaaaacaguaauugagauauugaa

SEQ ID NO: 267801 - RNA, 64 nt, Homo Sapiens
auugaagacauuacaauuuaguuuguguggucuuuuuuuaaauugcuguaucguucagucucuu

SEQ ID NO: 267802 - RNA, 64 nt, Homo Sapiens
uuuagguggacaaauuuaacaaguuuucuguuacuuuuuaaaaagaaaaaauccagaacauaag

SEQ ID NO: 267803 - RNA, 64 nt, Homo Sapiens
guuugaagucucuuuauagacuuuuuauauauauuuuuuaaaacacucaucuagaugaggugcu

SEQ ID NO: 267804 - RNA, 64 nt, Homo Sapiens
auauucagaaugcucacacugaaaaugccucaacuuuuuaaaguguaagaaaccaccaugagug

SEQ ID NO: 267805 - RNA, 64 nt, Homo Sapiens
ugaagaaucuugcuacagccaaauggcaucucacuuuuuaaagacguuugcaauuauuaguuga

SEQ ID NO: 267806 - RNA, 64 nt, Homo Sapiens
auuuacuuggaagagcaaagaaggaaaaauuauauuuuuaaagaaagagaauauucaggcuuua

SEQ ID NO: 267807 - RNA, 64 nt, Homo Sapiens
uauucaggcuuuauuucugguaugaaguuuauauuuuuuaaaaaaauccuauauuaucacacca

SEQ ID NO: 267808 - RNA, 64 nt, Homo Sapiens
uuaugggcuuacauaauauuccuuucauccauucuuuuuaaagaacggcuuaccuuuccuauuu

SEQ ID NO: 267809 - RNA, 64 nt, Homo Sapiens
acggcuuaccuuuccuauuuauuuuuagggugauuuuuuaaaaagacuugugcaauacauuuug

SEQ ID NO: 267810 - RNA, 64 nt, Homo Sapiens
aaacccuuggauauaaaagaaaucuguuuauugauuuuuaaaucuuuccuuuccaaaagcugga

SEQ ID NO: 267811 - RNA, 64 nt, Homo Sapiens
agucuguaaccuggcaacauuuuacaacccuguauuuuuaaagauggcuuucuaauaaaaaauc

SEQ ID NO: 267812 - RNA, 64 nt, Homo Sapiens
auagcaauuaauagcaaaaccuuuacauucuugguuuuuaaacuuuaccaugugucugaauuac

SEQ ID NO: 267813 - RNA, 64 nt, Homo Sapiens
cacugcaccuggccuguaacaugauuugcugaaauuuuuaaaaaucuuaaauaauguacuguuu

SEQ ID NO: 267814 - RNA, 64 nt, Homo Sapiens
gugaugauuaaagcauucucauugcacaguucuguuuuuaaauacagagucugaugccuccuau

SEQ ID NO: 267815 - RNA, 64 nt, Homo Sapiens
uuucuuuucagcuuacacauguguucaaaguggauuuuuaaaaaguguuuuagcaauacuccuu

SEQ ID NO: 267816 - RNA, 64 nt, Homo Sapiens
ucuuaguuaugcaucucauaaucagacuccaugcuuuuuaaagacagagauaauaucuucucua

SEQ ID NO: 267817 - RNA, 64 nt, Homo Sapiens
aguauuuuguacauaccaguuguuaaauaaauaauuuuuaaaaucucagcucucacauugaauu

SEQ ID NO: 267818 - RNA, 64 nt, Homo Sapiens
uauccauaugaugguucugcagccauugcaaacauuuuuaaagacaauuuaaugccauggggaa

SEQ ID NO: 267819 - RNA, 64 nt, Homo Sapiens
acuaauuuuauaugcaagaaaaaaagcacaguauuuuuuaaaugcaaugaagacgugcuuauuu

SEQ ID NO: 267820 - RNA, 64 nt, Homo Sapiens
uauuuggggaaaggucuuuuuugcuuaauuuuguuuuuuaaaacucugaugauugcuugagcaa

SEQ ID NO: 267821 - RNA, 64 nt, Homo Sapiens
cgaauguuuauaagcuuuccauuuccuagguaauuuuuuaaaagccagucaaaacaaaaacuuu

SEQ ID NO: 267822 - RNA, 64 nt, Homo Sapiens
auuccuucucuuuacuuuuuuuuucuuuuuucuuuuuuuaaagaaaugguagcauaauauacac

SEQ ID NO: 267823 - RNA, 64 nt, Homo Sapiens
aagaaaugguagcauaauauacacaguuguccauuuuuuaaagacuaaaccaucucacagauug

SEQ ID NO: 267824 - RNA, 64 nt, Homo Sapiens
caaaacuaaguucuuagauuuugggggauuuuuuuuuuuaaacgaugagaagggaauccgguua

SEQ ID NO: 267825 - RNA, 64 nt, Homo Sapiens
aaaguugucaguaaaaccuuugacagaggauggauuuuuaaaccuguucagaguccugguuuaa

SEQ ID NO: 267826 - RNA, 64 nt, Homo Sapiens
aaacaaagacagacuuguaguuuauuuuguauuuuuuuuaaauaaauacacuuuacauuaaaga

SEQ ID NO: 267827 - RNA, 64 nt, Homo Sapiens
guaagcaauaauuugcuugcaauuuuucauguaauuuuuaaauuaguauguuaagauucugaau

SEQ ID NO: 267828 - RNA, 64 nt, Homo Sapiens
uauuguucugaaaugcuuaacuucagaauuacauuuuuuaaaguaaauaauuguuuuaaaucua

SEQ ID NO: 267829 - RNA, 64 nt, Homo Sapiens
cugggcauauuucuaauuggcuuuacuauuuuuauuuuuaaauuauguuuuacuguucauuuga

SEQ ID NO: 267830 - RNA, 64 nt, Homo Sapiens
aacuucuuucaucaggaaaccuuauucaggaggguuuuuaaaaaguguuuaaaugucaaaugug

SEQ ID NO: 267831 - RNA, 64 nt, Homo Sapiens
uaugauguuaguuuuccuuagcugauuuugaggguuuuuaaaaauaaagcaagguugacuaacc

SEQ ID NO: 267832 - RNA, 64 nt, Homo Sapiens
gucauacauaggaugacaaaauucuuucugguuguuuuuaaacaauaaagcaauaagaacaaau

SEQ ID NO: 267833 - RNA, 64 nt, Homo Sapiens
agguguuuugcaagagcuguauuuauauuacaguuuuuuaaaaacauuuucugaauuaucguaa

SEQ ID NO: 267834 - RNA, 64 nt, Homo Sapiens
auuuaaaaggagaaaaaaaugcauguuuauaaacuuuuuaaauaaaaccagaccuuguaagugg

SEQ ID NO: 267835 - RNA, 64 nt, Homo Sapiens
ggaugggugggugggguauuuuuuuguaauugcuuuuuuaaauauuaguuaauggauuaaauuu

SEQ ID NO: 267836 - RNA, 64 nt, Homo Sapiens
agaugaaguuuguaguuguuuuaaguacuacacauuuuuaaauuguuagcuuccuuaaguauau

SEQ ID NO: 267837 - RNA, 64 nt, Homo Sapiens
cuuucagauuuuuugaaccauccacuuacauauauuuuuaaaaaaugaaauccuuuuccuguuc

SEQ ID NO: 267838 - RNA, 64 nt, Homo Sapiens
uagaauucuguauuggauauauaagagcaugaaauuuuuaaaaauacacuugugauuauaaaau

SEQ ID NO: 267839 - RNA, 64 nt, Homo Sapiens
uuauaccugcuaucagcagcuagaaaacauuuuuuuuuuaaaucaaguauuuuguguuuggaau

SEQ ID NO: 267840 - RNA, 64 nt, Homo Sapiens
uuuauaaccaaaauuuuaaaacuauuuuuauauuuuuuuaaaucuuuaaaaauuuuaauuacug

SEQ ID NO: 267841 - RNA, 64 nt, Homo Sapiens
aaugagacuggaaauaccuuuuguaccuaaauguuuuuuaaauuaaucaaaauacauucuguga

SEQ ID NO: 267842 - RNA, 64 nt, Homo Sapiens
uuuuuaauauuuaucucguuugggaguauacguguuuuuaaaauuuguguuuucuaucuguuua

SEQ ID NO: 267843 - RNA, 64 nt, Homo Sapiens
gggguggguguaaaguuaaaaggaacaguuuccuuuuuuaaagaaugguauaagacuaucuuug

SEQ ID NO: 267844 - RNA, 64 nt, Homo Sapiens
uaucuuuggagccgcuuuuuuuuucuuuuucauuuuuuuaaaagauugagugguacacuaauaa

SEQ ID NO: 267845 - RNA, 64 nt, Homo Sapiens
uguacauauugcuuaaguauuuggcuguuuuuauuuuuuaaaagguauaaacaccaaaaaaaaa

SEQ ID NO: 267846 - RNA, 64 nt, Homo Sapiens
guuuguuuuguauuuuuguauuguauaugaacuuuuuuuaaaugugacaguuaaacacaucuuu

SEQ ID NO: 267847 - RNA, 64 nt, Homo Sapiens
uugaaauuugccagucucccugguguaaaauguuuuuuuaaagccuuuuuuccuccuuucggag

SEQ ID NO: 267848 - RNA, 64 nt, Homo Sapiens
ggaucacaugguacguggcauuuguuguuauuguuuuuuaaagagauggaggcuggcucuguug

SEQ ID NO: 267849 - RNA, 64 nt, Homo Sapiens
uuuguaauaaauuugacucauuaaaaaccuuuuuuuuuuaaaaaaaaaaaaaaagaaaaucuca

SEQ ID NO: 267850 - RNA, 64 nt, Homo Sapiens
gugaacuuaucuuugcagcugaguacuuaaauucuuuuuaaaaagauacccuuuggauugauca

SEQ ID NO: 267851 - RNA, 64 nt, Homo Sapiens
acuggcauugacauuauugguaaucaacuggcuuuuuuuaaaaaagguagcauuuuguugacag

SEQ ID NO: 267852 - RNA, 64 nt, Homo Sapiens
cagugaaggacaaaaaucaugauuguggaagauauuuuuaaaaucugauuuugcagcgaucacu

SEQ ID NO: 267853 - RNA, 64 nt, Homo Sapiens
cgugagccaccgcgccuggccagggacuauacucuuuuuaaaauagacauuuguggggcucaca

SEQ ID NO: 267854 - RNA, 64 nt, Homo Sapiens
aaggacuauuacauacuucauuacuaggaaguucuuuuuaaaaugacacuuaaaacaaucacug

SEQ ID NO: 267855 - RNA, 64 nt, Homo Sapiens
gguuucgccuuguugcccaggcugaauuuggguuuuuuuaaaaugagacuuucaguccuaauuu

SEQ ID NO: 267856 - RNA, 64 nt, Homo Sapiens
ggaaauuuauagcuucaaauacuuauauacauauuuuuuaaaaguagcuuuacauaggaaggaa

SEQ ID NO: 267857 - RNA, 64 nt, Homo Sapiens
guuuugucuguuacuaaggguagaagauuauugcuuuuuaaaggcuaaauauuguuugugggaa

SEQ ID NO: 267858 - RNA, 64 nt, Homo Sapiens
ucauucccuuugacaagcuguagaacuggauucauuuuuaaaccauuuucaucaguuucaaaug

SEQ ID NO: 267859 - RNA, 64 nt, Homo Sapiens
uuuucaucaguuucaaaugguaaauucugauugauuuuuaaaugcguuuuuggaagaacuuugc

SEQ ID NO: 267860 - RNA, 64 nt, Homo Sapiens
uauauguuauguaaaguguguauauagaauuaguuuuuuaaaccuucuguuaguggcuuuuugc

SEQ ID NO: 267861 - RNA, 64 nt, Homo Sapiens
aucauucuugcugcuuaagaugaaaagcauugguuuuuuaaaauuagagaauaaaauauguauu

SEQ ID NO: 267862 - RNA, 64 nt, Homo Sapiens
ugauuaccagagaacuacuaaaaaaaccaacugcuuuuuaaauccuauuguguaguuaaagugu

SEQ ID NO: 267863 - RNA, 64 nt, Homo Sapiens
aauuuuauuguauaugaugaacaaaacuuaaaauuuuuuaaauuuaauuuuuaaauacuguuuc

SEQ ID NO: 267864 - RNA, 64 nt, Homo Sapiens
augaugaacaaaacuuaaaauuuuuuaaauuuaauuuuuaaauacuguuucagaguucuaaaaa

SEQ ID NO: 267865 - RNA, 64 nt, Homo Sapiens
uuuaaauacuguuucagaguucuaaaaaggcaguuuuuuaaaaaacuuaaguugauaaaaacug

SEQ ID NO: 267866 - RNA, 64 nt, Homo Sapiens
gauuuuaaacauggugugguauucuaaagccuuuuuuuuaaaaaaagagaucuuuuugagagaa

SEQ ID NO: 267867 - RNA, 64 nt, Homo Sapiens
aaauuuucagguauuuagcuccccuuucauauuauuuuuaaauuuuuuaauuaccuguuguagg

SEQ ID NO: 267868 - RNA, 64 nt, Homo Sapiens
ucucuucauuuuaagacuuuuaauacaaaugucauuuuuaaagaaacaaacccaaaacuauugu

SEQ ID NO: 267869 - RNA, 64 nt, Homo Sapiens
ucucagugacaaguuggaugacacuacucccaacuuuuuaaauuuggagaaaaccaucaagguc

SEQ ID NO: 267870 - RNA, 64 nt, Homo Sapiens
agcaaaagcugacuuuuaaacuugaccccugcuguuuuuaaacagcuuuuccuuuuggucucug

SEQ ID NO: 267871 - RNA, 64 nt, Homo Sapiens
cauuggacauuaauagggcacuuuucagacccauuuuuuaaagugcuagaaaaugcuuuuuuua

SEQ ID NO: 267872 - RNA, 64 nt, Homo Sapiens
ucagacccauuuuuuaaagugcuagaaaaugcuuuuuuuaaaaaaaaaauacaaguuuuaaaau

SEQ ID NO: 267873 - RNA, 64 nt, Homo Sapiens
aucaugucaaaauuuaguugaacugguuuuucaguuuuuaaaaggccuacagaugaguaaugaa

SEQ ID NO: 267874 - RNA, 64 nt, Homo Sapiens
ugagguuuuaaccauuauucaggguggucuuuuguuuuuaaaucuuuuuuuaacuaauaagauu

SEQ ID NO: 267875 - RNA, 64 nt, Homo Sapiens
uccaaaugaaugaaaauguauguuucuuuguacuuuuuuaaaaaaaucagcuuaguaacaauac

SEQ ID NO: 267876 - RNA, 64 nt, Homo Sapiens
uuauauuucuaaugcaaacuuaacaauuguguacuuuuuaaaagcugcaauauguguuggaaaa

SEQ ID NO: 267877 - RNA, 64 nt, Homo Sapiens
acaagauacuuuuuuuuuuuuuuuuuuuuuuuuuuuuuuaaauagggccucacucuguugcuca

SEQ ID NO: 267878 - RNA, 64 nt, Homo Sapiens
aaucguacauuuucauaugcuucaaacuaacacauuuuuaaagcuuucccccacuuuucucucu

SEQ ID NO: 267879 - RNA, 64 nt, Homo Sapiens
cauuuuaauacacacauuuauucagauacuccccuuuuuaaagcccuuuuguuuuuugauuuau

SEQ ID NO: 267880 - RNA, 64 nt, Homo Sapiens
ugcaaaacuaggaaaagguuaaacuggauuuuuuuuuuuaaaaaaaagaaaaaaaaagaagaaa

SEQ ID NO: 267881 - RNA, 64 nt, Homo Sapiens
uguaguauuauuaaucuucugacauuuucuuauguuuuuaaaaagauaagagcaucuagugcau

SEQ ID NO: 267882 - RNA, 64 nt, Homo Sapiens
cuuuguccucaaagaaauuguugaaaaagaaaacuuuuuaaagagauuuuuugcauauucucug

SEQ ID NO: 267883 - RNA, 64 nt, Homo Sapiens
ucuuggaugggaagaauugagaaaacucugagcauuuuuaaaaguuuguuuacaauuccacaag

SEQ ID NO: 267884 - RNA, 64 nt, Homo Sapiens
uuuugacaaguauaaagcuauuauuacauuguauuuuuuaaauguaaauauagaaagaacauuu

SEQ ID NO: 267885 - RNA, 64 nt, Homo Sapiens
cacaacuuaugaaaucugccuuuaacaaguaacuuuuuuaaauuauaaaauuuuauuggcauug

SEQ ID NO: 267886 - RNA, 64 nt, Homo Sapiens
caguuuuccuuccuuaaccaugggugcuaguaacuuuuuaaaacucaagacaagauuaguuuuu

SEQ ID NO: 267887 - RNA, 64 nt, Homo Sapiens
ggaagaaaagauuugguuuucauggcagucuguuuuuuuaaaaaaaaauuuuugagccacuauc

SEQ ID NO: 267888 - RNA, 64 nt, Homo Sapiens
aggacuacaggcauguggcaccaugcccgcuaaguuuuuaaauuucuuguagagaugagaucuc

SEQ ID NO: 267889 - RNA, 64 nt, Homo Sapiens
caaauaagcugauuuuaaugacguuuucaacugguuuuuaaauauucaauauuggucuguguuu

SEQ ID NO: 267890 - RNA, 64 nt, Homo Sapiens
gugauagaaaaguugccaguuugggguuaaagcauuuuuaaagcugcauguuccuuguaaucaa

SEQ ID NO: 267891 - RNA, 64 nt, Homo Sapiens
aaaaaacuuuuuggugcuccaguguagggcuaucuuuuuaaaaaaugucaacaaagggaaaaua

SEQ ID NO: 267892 - RNA, 64 nt, Homo Sapiens
accuugccuuagaaacacauaaauuaugagauuuuuuuuaaaaguuguuaccaaauacacauuu

SEQ ID NO: 267893 - RNA, 64 nt, Homo Sapiens
uuauaacauaaccucagaguaucuuuaccaaagguuuuuaaaguaaaucucuuuuuaagauaga

SEQ ID NO: 267894 - RNA, 64 nt, Homo Sapiens
cauugucuaucccuguuuuuauaugucuccauucuuuuuaaaaucuuaacauauggagcagccu

SEQ ID NO: 267895 - RNA, 64 nt, Homo Sapiens
uacaauauuaaaaaccacuggaacucuuguccaguuuuuaaauuauguuuuuacuggaauguuu

SEQ ID NO: 267896 - RNA, 64 nt, Homo Sapiens
auuuagagaacaagaacaaaccaugucucaaauuuuuuuaaaaaaaauuaaugguuuuaaauau

SEQ ID NO: 267897 - RNA, 64 nt, Homo Sapiens
agaaauauacuuugguuaauuuugaaaugugucauuuuuaaacaaucuuaaaaguaauacagaa

SEQ ID NO: 267898 - RNA, 64 nt, Homo Sapiens
uuacaggcgugagccacugcaccuggccucauguuuuuuaaauaauugccuuuuauauuuaccc

SEQ ID NO: 267899 - RNA, 64 nt, Homo Sapiens
aaauaacucuuauuuuuauuuuugaagguuuuuuuuuuuaaaaaaaaaaacguauaaaauaaug

SEQ ID NO: 267900 - RNA, 64 nt, Homo Sapiens
uuguaauccuuguucaguucuuaaguuucgguuuuuuuuaaaaacaggaugcaacuuaaacuuu

SEQ ID NO: 267901 - RNA, 64 nt, Homo Sapiens
ccaggcuccccaaagcacuccaauucucgggucuuuuuuaaaagcccuggugucuccgacucau

SEQ ID NO: 267902 - RNA, 64 nt, Homo Sapiens
ugugacuuuaacccgcccacucuagaguuuagccuuuuuaaaaaagagagagcaaauacagcaa

SEQ ID NO: 267903 - RNA, 64 nt, Homo Sapiens
ccaucacauaaacaaagugaaaagaacaugcuauuuuuuaaaugagauauaaaauucaguuuaa

SEQ ID NO: 267904 - RNA, 64 nt, Homo Sapiens
aguuuaauuauaaagugaagucaagaaaaaaaauuuuuuaaauaggccacagagcaagacuguc

SEQ ID NO: 267905 - RNA, 64 nt, Homo Sapiens
auccaagacaaacuaaacuuauucugggccuaauuuuuuaaagauaguaauuaggauaacuaaa

SEQ ID NO: 267906 - RNA, 64 nt, Homo Sapiens
ugcauuuuuaaucaguggaaccacaaaagcaaaauuuuuaaaacaugauuucuccagaaauuua

SEQ ID NO: 267907 - RNA, 64 nt, Homo Sapiens
ccuauuuugaaaggucagaauuuucaaaaaaauguuuuuaaaaauguuuaaaagcaaauacuga

SEQ ID NO: 267908 - RNA, 64 nt, Homo Sapiens
uuggcauuuuaaguguuuaauuaucugcaaggauuuuuuaaaaaagacugaaagaaacuaagau

SEQ ID NO: 267909 - RNA, 64 nt, Homo Sapiens
gaaauuuaauuagcacauauucauccaaagaucauuuuuaaaauaaacauaguuggaaauguaa

SEQ ID NO: 267910 - RNA, 64 nt, Homo Sapiens
aaguugccuuaaauaaguguacuacauauauugauuuuuaaauagacagugacagauauaauuu

SEQ ID NO: 267911 - RNA, 64 nt, Homo Sapiens
uccccugauguaccugaacaaguauuugcugcuauuuuuaaaacuaauuauuuccaaagacccc

SEQ ID NO: 267912 - RNA, 64 nt, Homo Sapiens
cuaacaaaucuuuuuagucauugcuuuucugagcuuuuuaaaguuuuauuuuguguauuaguuu

SEQ ID NO: 267913 - RNA, 64 nt, Homo Sapiens
uuaaaaccuucauaucuagguuauguuuaaauuuuuuuuaaaucauaaugauaguuuuuaacuu

SEQ ID NO: 267914 - RNA, 64 nt, Homo Sapiens
uagugucuggaguuuguaaugugugacuaccggguuuuuaaaaguuguaugucaugcuguuuau

SEQ ID NO: 267915 - RNA, 64 nt, Homo Sapiens
aauccauuuaauuaaaacgucagauuuuauagucuuuuuaaauauuuuuuaucucucuugaugu

SEQ ID NO: 267916 - RNA, 64 nt, Homo Sapiens
aacaguuaugauaaauuuuacaaauuuaaaauaauuuuuaaauuaauggcaaauucaauaaacu

SEQ ID NO: 267917 - RNA, 64 nt, Homo Sapiens
aauuugcuuagcuguuuguuuagaaauuguuuuauuuuuaaauucgugauuauauucaucuacu

SEQ ID NO: 267918 - RNA, 64 nt, Homo Sapiens
acacagcucaacgguugauaggagaaaacaauuguuuuuaaaucuggagauuuuggugggagga

SEQ ID NO: 267919 - RNA, 64 nt, Homo Sapiens
auaauugaaacuuaucucaauuaaaaaaaauuuuuuuuuaaauacacaaaguaggccagauaag

SEQ ID NO: 267920 - RNA, 64 nt, Homo Sapiens
aauuuguuuuagacugccuuaucuguucuucguauuuuuaaaaaaggcaccucuucccuucaau

SEQ ID NO: 267921 - RNA, 64 nt, Homo Sapiens
aauauaguuguuacugguccuggcagucuuuuuuuuuuuaaauauaaguaauucuguaacugca

SEQ ID NO: 267922 - RNA, 64 nt, Homo Sapiens
uuucugaguucgaagguaauauguuugagacuuuuuuuuaaacauguuuugucuaaccaucaaa

SEQ ID NO: 267923 - RNA, 64 nt, Homo Sapiens
uuaguuuagugacaaagucaugagaaugccaccuuuuuuaaaacggcagcaugggacugaaaca

SEQ ID NO: 267924 - RNA, 64 nt, Homo Sapiens
acguauauucaacauaaaauuucaauaagaacacuuuuuaaaagauguuauuuuacauuuuaug

SEQ ID NO: 267925 - RNA, 64 nt, Homo Sapiens
ugaaaucuuaauucauuuacaauaugucucuuuauuuuuaaaaaaaagagaguuauuacaaaua

SEQ ID NO: 267926 - RNA, 64 nt, Homo Sapiens
gggcagccccuugauggcucacucuuuuuuuuuuuuuuuaaaagcguccuugggaucccagauc

SEQ ID NO: 267927 - RNA, 64 nt, Homo Sapiens
gucagcugcuccaaaaucauucacauaaagcauuuuuuuaaaaaacacugcucuuccucaccug

SEQ ID NO: 267928 - RNA, 64 nt, Homo Sapiens
auguuuuuauaauuucauucgauguagaacuuuguuuuuaaauauuuuuuggcccaauguugaa

SEQ ID NO: 267929 - RNA, 64 nt, Homo Sapiens
ucauguuugacaucuuucuaacugguaguaguuauuuuuaaaaaucgccagggaucuuuucaaa

SEQ ID NO: 267930 - RNA, 64 nt, Homo Sapiens
gaguaguucugaguaauccuauagauauuuuaaguuuuuaaauuuuacuaaaaucuaaauaaug

SEQ ID NO: 267931 - RNA, 64 nt, Homo Sapiens
cccguuuugucacuuuuucugauggaaaauucauuuuuuaaauuuguauuuggaaauaaaguca

SEQ ID NO: 267932 - RNA, 64 nt, Homo Sapiens
agaaaguguauuuggaaauagaaaguguauugguuuuuuaaaaacuaauacugucauccucaaa

SEQ ID NO: 267933 - RNA, 64 nt, Homo Sapiens
uaaaacaguucauuuugggguuguguuuuuaaacuuuuuaaaauauaucagugcuucauuguca

SEQ ID NO: 267934 - RNA, 64 nt, Homo Sapiens
uuuuaaaauuaaaacaguucucauugucauuguguuuuuaaacuuccuaaggcauaucagugcu

SEQ ID NO: 267935 - RNA, 64 nt, Homo Sapiens
auaaagguugugaggaaaagucagcagauggcaguuuuuaaaaagaaauguggacaucucuugu

SEQ ID NO: 267936 - RNA, 64 nt, Homo Sapiens
guguuuaugacgagaccucaggguuucaauuuacuuuuuaaacagucaacuuucauuugaaagu

SEQ ID NO: 267937 - RNA, 64 nt, Homo Sapiens
guuggugcaauuaacucugggucauuauuauuacuuuuuaaaaugaagucuugcauugaauuua

SEQ ID NO: 267938 - RNA, 64 nt, Homo Sapiens
acaaacagugaauuuaagcagaugaaaaccugcauuuuuaaaggccacguguaugcaaguggga

SEQ ID NO: 267939 - RNA, 64 nt, Homo Sapiens
aaaugugucugcaacauggaucucuuuuuuuuuuuuuuuaaagaucuguaaaugaagggucauu

SEQ ID NO: 267940 - RNA, 64 nt, Homo Sapiens
acuaaugcuugccaagaaaugaaaagaaaucaauuuuuuaaaccgucaccucugggccagguug

SEQ ID NO: 267941 - RNA, 64 nt, Homo Sapiens
agcaaugcacauguugguugcauugucacugauuuuuuuaaaaagguauuaauaugacauuugu

SEQ ID NO: 267942 - RNA, 64 nt, Homo Sapiens
gcaaauguaauuuuugccaagugguaguaauuuuuuuuuaaauuuagaauuuauuuucuacaaa

SEQ ID NO: 267943 - RNA, 64 nt, Homo Sapiens
aaucuagccaucaucaagguuuuuaaaaugaauuuuuuuaaaacuaaauguuuuauuguuacuu

SEQ ID NO: 267944 - RNA, 64 nt, Homo Sapiens
gaauuuuuuuaaaacaaucuguuuuauuguuacuuuuuuaaaauuuuacuuuucaucuguaaau

SEQ ID NO: 267945 - RNA, 64 nt, Homo Sapiens
uauuuuacaguuguaaaaaaaauagcuaaauaauuuuuuaaaaaaauggaguaacaaauuacag

SEQ ID NO: 267946 - RNA, 64 nt, Homo Sapiens
aauggaguaacaaauuacagcuaguuacuucuauuuuuuaaaauugaguagucugauuuagaga

SEQ ID NO: 267947 - RNA, 64 nt, Homo Sapiens
uugcugugugggucacacaaugaaguggguacauuuuuuaaauuguuggauagguggggaaauc

SEQ ID NO: 267948 - RNA, 64 nt, Homo Sapiens
guccuuugucaaggaaaaaaguccuuuccugggauuuuuaaaagcagucuuugauuauuuugug

SEQ ID NO: 267949 - RNA, 64 nt, Homo Sapiens
augcaccuucugauaaccccaccgcugcauuuuguuuuuaaauuuggaugaugggaaguuugag

SEQ ID NO: 267950 - RNA, 64 nt, Homo Sapiens
caaagugcagauugcuuguaaaaauuuuagaacuuuuuuaaaauagcaagaccccauccuuuaa

SEQ ID NO: 267951 - RNA, 64 nt, Homo Sapiens
aacguaguaaaugcuguaaauuacagcauguugauuuuuaaauugugugaauaauguaaguauu

SEQ ID NO: 267952 - RNA, 64 nt, Homo Sapiens
aaguugcaaagaguacaaauacauguuaaagggauuuuuaaauacugugcaacaaaagauuaga

SEQ ID NO: 267953 - RNA, 64 nt, Homo Sapiens
uuuacccccucuucaacugagcagacugacccucuuuuuaaaagcauuauaaaacagggggaaa

SEQ ID NO: 267954 - RNA, 64 nt, Homo Sapiens
guagcuuuuagagaccuaugucauugcuuuuauauuuuuaaauuucugcaaagccagauugcuc

SEQ ID NO: 267955 - RNA, 64 nt, Homo Sapiens
uuauacauguagcucaacuucugugcaaaauaguuuuuuaaaaauuugaaacaaaaaauuuuac

SEQ ID NO: 267956 - RNA, 64 nt, Homo Sapiens
aauaauuuaguaucaaggcuugaauacuguguauuuuuuaaaaaugcagcucaagcaugcagua

SEQ ID NO: 267957 - RNA, 64 nt, Homo Sapiens
ccaccuccucaagcuauccaauucauauguuugauuuuuaaaucaugaaaacuaaguuauauua

SEQ ID NO: 267958 - RNA, 64 nt, Homo Sapiens
uuaugaaaacuaaguuauauuugaagauaaauuauuuuuaaaggauuacaguuccacuaaauug

SEQ ID NO: 267959 - RNA, 64 nt, Homo Sapiens
gccauuaaaaugcaugaaauaaaugaauagcuaauuuuuaaaauuaucuauaugaggaacccau

SEQ ID NO: 267960 - RNA, 64 nt, Homo Sapiens
cuuuagaucugugauucuuguagguauauuacguuuuuuaaaugaagcauuucaauaggaugca

SEQ ID NO: 267961 - RNA, 64 nt, Homo Sapiens
uucauucacucuucuguuugccauuauuguuuuauuuuuaaauuuucaggaauagauuuauaca

SEQ ID NO: 267962 - RNA, 64 nt, Homo Sapiens
auucaaacaaaacuaaaacaauaaguaagaacuauuuuuaaaaucccaauacguuucauagaaa

SEQ ID NO: 267963 - RNA, 64 nt, Homo Sapiens
agaaauguuuauuuuuguccaaauuuguggguuuuuuuuaaauacagauaagcuauaguugggg

SEQ ID NO: 267964 - RNA, 64 nt, Homo Sapiens
uagaacuuggcuauauugaaucaucaggugcuucuuuuuaaaacaaaugaauucagaagaaaac

SEQ ID NO: 267965 - RNA, 64 nt, Homo Sapiens
aguauuuuguugagguugaacagguacaaaucuuuuuuuaaauaaaagaucaggaaguuguauu

SEQ ID NO: 267966 - RNA, 64 nt, Homo Sapiens
uguguuaaugucaauaugaucacuugagagacacuuuuuaaaaaccuaguuuuauuaaauauua

SEQ ID NO: 267967 - RNA, 64 nt, Homo Sapiens
gugugugaacaaauggaaauuguuuuuuuuuuuuuuuuuaaagcggguauugugugagugcaug

SEQ ID NO: 267968 - RNA, 64 nt, Homo Sapiens
aagaaaacuuuaaaaaaacuuuucuuuuuuuuuuuuuuuaaaaaguuugccguuuguccuuaac

SEQ ID NO: 267969 - RNA, 64 nt, Homo Sapiens
cuugaaaaauuaaaggauuuaaguauaaaauuguuuuuuaaacacuuaucuucaaggcuggcuu

SEQ ID NO: 267970 - RNA, 64 nt, Homo Sapiens
uaaacugguaaauuuugugccguuuuuuguuuguuuuuuaaauggcgggugcuugaguuguugu

SEQ ID NO: 267971 - RNA, 64 nt, Homo Sapiens
uacuuauuagaagcaaacugaggaaaaaaaaauuuuuuuaaaaaaaaauuuaaagaaaagcuag

SEQ ID NO: 267972 - RNA, 64 nt, Homo Sapiens
uguuuagacacagauauuugaaauaaauaaacaguuuuuaaaauacuagggguacauucuuaca

SEQ ID NO: 267973 - RNA, 64 nt, Homo Sapiens
auacuuacuuuggacuaggguuuuuggccaaaauuuuuuaaaaccugaaaggguuuuuguaaau

SEQ ID NO: 267974 - RNA, 64 nt, Homo Sapiens
auuccccuaccccuguuuaagacaauugcaauuuuuuuuaaaaauuaaacauuugcauuugcug

SEQ ID NO: 267975 - RNA, 64 nt, Homo Sapiens
uuugcauuugcuggacaauuuuccucaaguuuccuuuuuaaacaguguuguuuuauuuccaugg

SEQ ID NO: 267976 - RNA, 64 nt, Homo Sapiens
uauaaaaagauuuuauuuaguaugugacagaauuuuuuuaaaauauuaaauuuagacuauguag

SEQ ID NO: 267977 - RNA, 64 nt, Homo Sapiens
guaaaauucugucagacuacauguuuaagaaaucuuuuuaaaaaaaaaauucccccucauuaga

SEQ ID NO: 267978 - RNA, 64 nt, Homo Sapiens
aacuguacaauuucucagccauuuagagcacaguuuuuuaaagccugucacgcuucuucccauu

SEQ ID NO: 267979 - RNA, 64 nt, Homo Sapiens
aaacaucuauuaugguaauaaaacucucucuuuguuuuuaaaggguguauaauuauugccucau

SEQ ID NO: 267980 - RNA, 64 nt, Homo Sapiens
gcugguauuaaacuaaauggguagucuuacuuguuuuuuaaaauacucugccaugacucuuaaa

SEQ ID NO: 267981 - RNA, 64 nt, Homo Sapiens
uaggaaccacaaucuuuauaaguuauagcauacuuuuuuaaaagcuuauauuuuuaaggaagua

SEQ ID NO: 267982 - RNA, 64 nt, Homo Sapiens
auuauauuugucucuuagaguauuuuuaauuucuuuuuuaaaaaauauuuagcauaagacguga

SEQ ID NO: 267983 - RNA, 64 nt, Homo Sapiens
aaguaaaaguugcugcuuucgcuacuagcuuuuuuuuuuaaaaaaaugcucauuuuuacaugcu

SEQ ID NO: 267984 - RNA, 64 nt, Homo Sapiens
uggaaauaugacauuuuauggaacuggaguuauguuuuuaaauuccaugcuguucucaugguaa

SEQ ID NO: 267985 - RNA, 64 nt, Homo Sapiens
caaaaaggcaggcagacagaaaugauagucuucauuuuuaaaaaacugaagacaaacuuguuuc

SEQ ID NO: 267986 - RNA, 63 nt, Homo Sapiens
acuuggugaacuuuuuuuacauaauuaaaacacauuuuuaaacuuccuggaauucaugaaaau

SEQ ID NO: 267987 - RNA, 64 nt, Homo Sapiens
uguauuugggucucccuuuggauuuucaaauguauuuuuaaacuaaguuccuuggcuuuggaau

SEQ ID NO: 267988 - RNA, 64 nt, Homo Sapiens
auacaguuccuaguguuuuugaaguauugucuuguuuuuaaaaagaauuaaagcaagaaaaucu

SEQ ID NO: 267989 - RNA, 64 nt, Homo Sapiens
uuuugacgauuucaauacaaacuucaacuuuguguuuuuaaaugaguuauuauuauuuaaaauu

SEQ ID NO: 267990 - RNA, 64 nt, Homo Sapiens
uacaacuuuccacaacuuguuugguaacuuuuuuuuuuuaaauugucuguuggugccucaacug

SEQ ID NO: 267991 - RNA, 64 nt, Homo Sapiens
auuaucaauauguauaauuucaagcaauugauaauuuuuaaaaaauugugcuggguuaguuuug

SEQ ID NO: 267992 - RNA, 64 nt, Homo Sapiens
guacucuuuaagagugaaauuugaagaaaagcacuuuuuaaaaauauguuugcuuuaaugugua

SEQ ID NO: 267993 - RNA, 64 nt, Homo Sapiens
augauuccuugagcauuuuaaagggaaccgucuguuuuuaaauguugacaugaacagaaacaau

SEQ ID NO: 267994 - RNA, 64 nt, Homo Sapiens
ugauucuaguuaaauguagauuuaauaucaguuuuuuuuaaacaaguagcucugaagugucaca

SEQ ID NO: 267995 - RNA, 64 nt, Homo Sapiens
uuuacaucaagagaggcaguauacuguaauaauauuuuuaaaaauguuguuaguggggacuaug

SEQ ID NO: 267996 - RNA, 64 nt, Homo Sapiens
gcagugauucagaauuuuuucuugcuucaagguguuuuuaaauaaaacaaucucaaacaaaaga

SEQ ID NO: 267997 - RNA, 64 nt, Homo Sapiens
caaaaccuuuucaacaaaauuuuacauauuuuucuuuuuaaaugcguggccuagugccuuggau

SEQ ID NO: 267998 - RNA, 64 nt, Homo Sapiens
auauauauaucuauauaucuucaauuaugaaaaauuuuuaaaaguguaaauauaaagaggaacu

SEQ ID NO: 267999 - RNA, 64 nt, Homo Sapiens
ucaaggaagaaauaaauguuagaauacuaaaguauuuuuaaaaaagaaggcacauacauaguua

SEQ ID NO: 268000 - RNA, 64 nt, Homo Sapiens
cugccaugaaauuuggagaccagucuuauauuguuuuuuaaacuuuugcguuuguaccuuacca

SEQ ID NO: 268001 - RNA, 64 nt, Homo Sapiens
guuauauuuucuaaagaaaauuguagauggcaucuuuuuaaaaauuuuugauuugucauugcua

SEQ ID NO: 268002 - RNA, 64 nt, Homo Sapiens
agagacggggcuuugccauagcuaauuuuuguacuuuuuaaaguggcgugugccacuacacccg

SEQ ID NO: 268003 - RNA, 64 nt, Homo Sapiens
aauaaauauucuaauguagcgacuucagagcaguuuuuuaaaaauguuuuugguacacugggca

SEQ ID NO: 268004 - RNA, 64 nt, Homo Sapiens
uccuguugaguuucuuuguguuucugaccuacuauuuuuaaaauuauaagaguuacuguugcau

SEQ ID NO: 268005 - RNA, 64 nt, Homo Sapiens
ucaaaagccaauugaacaacuuauugauuugauuuuuuuaaaaaugugguagcucuuacaaagu

SEQ ID NO: 268006 - RNA, 64 nt, Homo Sapiens
uccuucacacuguaauuuaaggauacacuguucauuuuuaaaauacuuugcaaacauuuaauga

SEQ ID NO: 268007 - RNA, 64 nt, Homo Sapiens
agcuguaacuaguuguaaguuguagaaaucugaauuuuuaaaaggucucucccguuaaacugag

SEQ ID NO: 268008 - RNA, 64 nt, Homo Sapiens
cauauaaacuuguauuauuuuucuuauuuuaaauuuuuuaaaauuucuguagguacauaguaug

SEQ ID NO: 268009 - RNA, 64 nt, Homo Sapiens
gggugugagccaucguaccuggccacuuuaauuauuuuuaaaugugcaauuauuuuuuuacuac

SEQ ID NO: 268010 - RNA, 64 nt, Homo Sapiens
aagcaugcaaucgcucugaauggcaguuuccucauuuuuaaacagggauaauaaaacuaauauu

SEQ ID NO: 268011 - RNA, 64 nt, Homo Sapiens
cauuuuaauguaugguuagguuuuauauuuuuauuuuuuaaaaaagaaauagucaguguuuucc

SEQ ID NO: 268012 - RNA, 64 nt, Homo Sapiens
uacuugguccuuaaaaaauaugcucuccccucccuuuuuaaacaaauggcuuguucagucacuu

SEQ ID NO: 268013 - RNA, 64 nt, Homo Sapiens
ggcuuguucagucacuuguuuguguuugaauugauuuuuaaacagcagguugugugugugugca

SEQ ID NO: 268014 - RNA, 64 nt, Homo Sapiens
aauaauaccucaagauaaucugauuuauuagcuauuuuuaaacauuuuuaaucacaagcuguau

SEQ ID NO: 268015 - RNA, 64 nt, Homo Sapiens
caaucuaagcaaagcacccaacaaugguaaauguuuuuuaaaaaugcagaacuaagauuuuuga

SEQ ID NO: 268016 - RNA, 64 nt, Homo Sapiens
caauguuaauuauuuagauauuuaauuucgcagauuuuuaaacuuuauuuucauaauuucugcu

SEQ ID NO: 268017 - RNA, 64 nt, Homo Sapiens
ucagaaaagauaccccuuuugucauugcaacuauuuuuuaaauccagaaaucuuuguacugaug

SEQ ID NO: 268018 - RNA, 64 nt, Homo Sapiens
gaauaguuugcugccaacuauuuauauuaaguaauuuuuaaauauuuguaauauuguugacuga

SEQ ID NO: 268019 - RNA, 64 nt, Homo Sapiens
gaguaagagaaacaaacuguuuagaauuaucauguuuuuaaaacaucauaguaauauaaaucug

SEQ ID NO: 268020 - RNA, 64 nt, Homo Sapiens
uguagugaggaaaaaaccuaagaaauuuccccuuuuuuuaaaaaauggaaauauucaauugaga

SEQ ID NO: 268021 - RNA, 64 nt, Homo Sapiens
aagaagucuguaucuagugauaaauauaccaguuuuuuuaaaaagaugcuguugugccuauauc

SEQ ID NO: 268022 - RNA, 64 nt, Homo Sapiens
uuauuuccguaaguacuucuguggccuugaguauuuuuuaaaaggcucaacuguaagccucuua

SEQ ID NO: 268023 - RNA, 64 nt, Homo Sapiens
aucuucaauauucuggcuaaaucuugguaugugguuuuuaaacagucacuccguuucaaagucu

SEQ ID NO: 268024 - RNA, 64 nt, Homo Sapiens
ccuagauauuuccaugggccagugugaugacuuuuuuuuaaaugagguucaguaccauaauguu

SEQ ID NO: 268025 - RNA, 64 nt, Homo Sapiens
cccucuugaaaccugaugucagcugcuguugaacuuuuuaaagaagugcaugaaaaaccauuuu

SEQ ID NO: 268026 - RNA, 64 nt, Homo Sapiens
aaucaaagccggccugagaaacacuauuugugacuuuuuaaacgauuagugauguccuuaaaau

SEQ ID NO: 268027 - RNA, 64 nt, Homo Sapiens
uggcuggugaugagaauauucuuguugcaggcuguuuuuaaacuagugucagugacacuaggaa

SEQ ID NO: 268028 - RNA, 64 nt, Homo Sapiens
aaagcagaauuugcaguggcaucuaaagagaucuuuuuuaaauaaaaauuauguauuguggcau

SEQ ID NO: 268029 - RNA, 64 nt, Homo Sapiens
cugaugcuguguuacuaaaauuacaaggaccugcuuuuuaaaaggccagaacaauugucugaaa

SEQ ID NO: 268030 - RNA, 64 nt, Homo Sapiens
aagcauuggaaggucaaauuauuuugaagugauuuuuuuaaaaaaaagucuucuguuuauuaac

SEQ ID NO: 268031 - RNA, 64 nt, Homo Sapiens
cuauacacuugauaaggguaaauuuaucuuaguguuuuuaaacuugguuuugguuacuugagga

SEQ ID NO: 268032 - RNA, 64 nt, Homo Sapiens
uuacacuaaacacuuuuggcagcuuaauaugaccuuuuuaaauuuuuuuuauuuuuuuuauuuu

SEQ ID NO: 268033 - RNA, 64 nt, Homo Sapiens
aguggaaauuaucacuuggauguggagguuuuacuuuuuaaaaacauucagcuuaauuaccuua

SEQ ID NO: 268034 - RNA, 64 nt, Homo Sapiens
aguuuuuaaucguuuuuguuuuaaggaaaaaagauuuuuaaaaugaaucuuaugcaaaacuuuu

SEQ ID NO: 268035 - RNA, 64 nt, Homo Sapiens
aaacuuuuugaccaguuucuuuucuuuuguuuuuuuuuuaaaaaagacauuuaaagacaaagac

SEQ ID NO: 268036 - RNA, 64 nt, Homo Sapiens
uauggggccuaaccugccacuuauuuuuugucaauuuuuaaaacuuuuuuuuaauuacuguaaa

SEQ ID NO: 268037 - RNA, 64 nt, Homo Sapiens
caaauccuuucaauauucugggaacccagggaaguuuuuaaaaaugucauuacuuucaaaggaa

SEQ ID NO: 268038 - RNA, 64 nt, Homo Sapiens
uuauuuauuugaaucuacaaaaaacaacaaauaauuuuuaaauauaaggauuuuccuagauauu

SEQ ID NO: 268039 - RNA, 64 nt, Homo Sapiens
aauagauucuuauaauauuauuuaaaugacugcauuuuuaaauacaaggcuuuauauuuuuaac

SEQ ID NO: 268040 - RNA, 64 nt, Homo Sapiens
uagugucugacuuuuguuaaauucaguaaugcaguuuuuaaaaaccuguaucugacccacuuug

SEQ ID NO: 268041 - RNA, 64 nt, Homo Sapiens
uguacaaacaguauuucugguguauauuuuaauguuuuuaaaaagaguaauuucauuuaaauau

SEQ ID NO: 268042 - RNA, 64 nt, Homo Sapiens
cuacuggaccaacauucuuguuuuugcuuuuguuuuuuuaaauaauucuagucuggagcuaacu

SEQ ID NO: 268043 - RNA, 64 nt, Homo Sapiens
acacuuuuaaauugucucuugcaucacuaaaauuuuuuuaaaaugagcauaacaacgaaaggca

SEQ ID NO: 268044 - RNA, 64 nt, Homo Sapiens
auaaaaagucaaaagaaacaaauagaagcuuuuuuuuuuaaaaaauguauugcuucugaacuuu

SEQ ID NO: 268045 - RNA, 64 nt, Homo Sapiens
caaagucuaguuuguauguagguaugaagggaauuuuuuaaauaaauugaaaagcugugaacag

SEQ ID NO: 268046 - RNA, 64 nt, Homo Sapiens
ucauauauguaagcugcauguuagacauuugucuuuuuuaaacuaaaguaauuguauugaugug

SEQ ID NO: 268047 - RNA, 64 nt, Homo Sapiens
ggugcugauaccuucaauuuguuacuuuucaagauuuuuaaaaauaacuaguguagcuuaucuu

SEQ ID NO: 268048 - RNA, 64 nt, Homo Sapiens
cucuuaaaugucaaacacauuuuuguuguuuuguuuuuuaaaugaucagugucuauuugaugug

SEQ ID NO: 268049 - RNA, 64 nt, Homo Sapiens
gguguaugaauggucuagaaacauuucuauuuuuuuuuuaaaccagcaggauacaaguugcaaa

SEQ ID NO: 268050 - RNA, 64 nt, Homo Sapiens
gguuauuauuggaaacauuacuuugagugcaguguuuuuaaaagccaauucuuuuuuaucccuu

SEQ ID NO: 268051 - RNA, 64 nt, Homo Sapiens
cauuuauucauguuauaaagcaaagcccugguccuuuuuaaacuacuaguuuuaaaaaccugug

SEQ ID NO: 268052 - RNA, 64 nt, Homo Sapiens
uugcuguuacgguuguauauagaggucugaaggauuuuuaaaaugauuugcacuuuuucacugc

SEQ ID NO: 268053 - RNA, 64 nt, Homo Sapiens
gucuuuaguaggaaauggaagaacacuguuuuauuuuuuaaaguguuuaauguuucuguccuuu

SEQ ID NO: 268054 - RNA, 64 nt, Homo Sapiens
agguugauugaauugugccuuugagugaacccaguuuuuaaauaccgcuguguuuguuucgcca

SEQ ID NO: 268055 - RNA, 64 nt, Homo Sapiens
uguguugcacucugcuggaugaaauggcaguggauuuuuaaacuuuaauuucccaaaugucucu

SEQ ID NO: 268056 - RNA, 64 nt, Homo Sapiens
augaaggauuguagauuuuugcuuuuucuuuuuguuuuuaaaacuuauuccaauugcuaaauug

SEQ ID NO: 268057 - RNA, 64 nt, Homo Sapiens
uaaaauagaaaaugcuuguggcauuuauuuucucuuuuuaaaagguucagaaauuuggcagguc

SEQ ID NO: 268058 - RNA, 64 nt, Homo Sapiens
uuagguaguauaauaaagguaaaugaagguacaauuuuuaaaccauuauuuucacccuguuggg

SEQ ID NO: 268059 - RNA, 64 nt, Homo Sapiens
uagaaacugauuucuucagaauuagauggcuuauuuuuuaaaauauuugaaugaaaacauuuua

SEQ ID NO: 268060 - RNA, 64 nt, Homo Sapiens
uuauuuuuuaaaauauuugaaugaaaacauuuuauuuuuaaaauauuacacaggaggcuucgga

SEQ ID NO: 268061 - RNA, 64 nt, Homo Sapiens
aaagaaacaccacuuaaucuucucucuugauugauuuuuaaaguuuaaauaccaguacuugagg

SEQ ID NO: 268062 - RNA, 64 nt, Homo Sapiens
gcucuuauaaaaucaauaagagaacucuccucuuuuuuuaaaaauaaaucuaaaugauuaucuu

SEQ ID NO: 268063 - RNA, 64 nt, Homo Sapiens
aaguuagaagaacggaucaugugccaacuguaguuuuuuaaaaaaaacgcuccuuuguaggguu

SEQ ID NO: 268064 - RNA, 64 nt, Homo Sapiens
cgugagccaccacaccuggccuuucugcaacauuuuuuuaaaaaaaucuaauaaaucuuagauu

SEQ ID NO: 268065 - RNA, 64 nt, Homo Sapiens
aacauuuuuuuaaaaaaaucuaauaaaucuuagauuuuuaaaaaagaauuaaaaugugggaguu

SEQ ID NO: 268066 - RNA, 64 nt, Homo Sapiens
aaaaaccaucuuaaguauucaaaauuuccuugguuuuuuaaaggugauaauuuugcuuuguguu

SEQ ID NO: 268067 - RNA, 64 nt, Homo Sapiens
gauaccuuauccuauuccuccccacccacccauguuuuuaaacuaauuuauauaaaaucuggag

SEQ ID NO: 268068 - RNA, 64 nt, Homo Sapiens
cucaguuguuucaggcaagcccaagacuuuguaauuuuuaaagggcccaagauuuuuuuuuuuu

SEQ ID NO: 268069 - RNA, 64 nt, Homo Sapiens
cagcuguaguaacuaugauggguguaacaacauuuuuuuaaagaagggaaucuguuuaucgcuu

SEQ ID NO: 268070 - RNA, 64 nt, Homo Sapiens
caauuuguuuuaauuuuuuauauauauguuuuuauuuuuaaaaaacauaccaguugaauggggu

SEQ ID NO: 268071 - RNA, 64 nt, Homo Sapiens
ccaaaaugauagcuaucuaacaacuaauuacuaauuuuuaaagaacaaaucacacauuuaaaaa

SEQ ID NO: 268072 - RNA, 64 nt, Homo Sapiens
aagaauugaugcuagagguaaaaaaaaauacuuguuuuuaaaaaauccuuuacgucuuguguaa

SEQ ID NO: 268073 - RNA, 64 nt, Homo Sapiens
cagcaucacugugucuguauuucaaguacaaauguuuuuaaaaaggauucuuuauacauaugug

SEQ ID NO: 268074 - RNA, 64 nt, Homo Sapiens
ucacgguaccaaaugcugaccaguguugcuccauuuuuuaaaucuugaaaaggguuucuguacu

SEQ ID NO: 268075 - RNA, 64 nt, Homo Sapiens
cuacugcaaaacaccacuguuggaaaaauagguauuuuuaaauuguuuuuaaucuuuuuuggug

SEQ ID NO: 268076 - RNA, 64 nt, Homo Sapiens
aauuagauuaguauuuuccacgucacuguuuauuuuuuuaaaacacaaauucuaaagcuacaac

SEQ ID NO: 268077 - RNA, 64 nt, Homo Sapiens
uuacucaaagaauuuuuuaagaacuguauuuuauuuuuuaaaugguguuuuauuacaagggacc

SEQ ID NO: 268078 - RNA, 64 nt, Homo Sapiens
uuuuaacguggacaucucuuccuugguacagugguuuuuaaauacugagaagaaccaagucagg

SEQ ID NO: 268079 - RNA, 64 nt, Homo Sapiens
ugguuuuuaaauacugagaagaaccaagucagguuuuuuaaagcagacuaaaagcaugaaauug

SEQ ID NO: 268080 - RNA, 64 nt, Homo Sapiens
aaaggaaugugcauaauggagagaagacauauuuuuuuuaaaacugaagauauuggcacaaaug

SEQ ID NO: 268081 - RNA, 64 nt, Homo Sapiens
auuauuauuguugauguugucaugguuaaucuauuuuuuaaaauugaaaugaagcagaaguagg

SEQ ID NO: 268082 - RNA, 64 nt, Homo Sapiens
ugaggaugaauuuucugcuuuaaaggcauguguguuuuuaaaauuaaugaauguagauguguga

SEQ ID NO: 268083 - RNA, 64 nt, Homo Sapiens
cuccuacccgugugcuaggaaugugcacuagcucuuuuuaaauuccaugcuacacuuugaggac

SEQ ID NO: 268084 - RNA, 64 nt, Homo Sapiens
uuacuuacugcuccaggcauuuuauuaaauuaauuuuuuaaauuauuuuccacccuacaucagu

SEQ ID NO: 268085 - RNA, 64 nt, Homo Sapiens
uguugacauuuguuggcagugugcuaaguaauguuuuuuaaagcacaggcuugaggacuauggu

SEQ ID NO: 268086 - RNA, 64 nt, Homo Sapiens
uuauuuuuaauauuacuacuauaugaauuaucuuuuuuuaaacuuguagauaaaaguguuccag

SEQ ID NO: 268087 - RNA, 64 nt, Homo Sapiens
cugauagaagauuuuuguccaugcuugauuuuuuuuuuuaaagaaaaacuuucauggguuagca

SEQ ID NO: 268088 - RNA, 64 nt, Homo Sapiens
uuuuauuaucuuuaaacuuguugcauuuaaaauauuuuuaaaaccuucuuaacaaaacuucuua

SEQ ID NO: 268089 - RNA, 64 nt, Homo Sapiens
auggauaauauaaaaagaguaccugagauguauuuuuuuaaacucuuagagauaucuguaacuc

SEQ ID NO: 268090 - RNA, 64 nt, Homo Sapiens
gccucuguaaaggaagagucucauuagacaaugauuuuuaaagcauuggaaaaauauuuugccu

SEQ ID NO: 268091 - RNA, 64 nt, Homo Sapiens
augagccaccaugccuggcccaaaguucuagaauuuuuuaaagguauucauggugacucaggaa

SEQ ID NO: 268092 - RNA, 64 nt, Homo Sapiens
auuugauaggcaauacaucuacccacuccauuauuuuuuaaaacuucauuuaauaguuuaaaca

SEQ ID NO: 268093 - RNA, 64 nt, Homo Sapiens
cuuuucuauuuucccucgcuuguuagacucuuacuuuuuaaaauauuuuagugacagcucugcc

SEQ ID NO: 268094 - RNA, 64 nt, Homo Sapiens
uuuaauauggguucuuuuuuguauuuggggcuuauuuuuaaaauucuggaugcauuucucuggg

SEQ ID NO: 268095 - RNA, 64 nt, Homo Sapiens
gaagaaagccuaaagacucuaaaaaaaaaaaccauuuuuaaaaacagagaggcuuucccagaaa

SEQ ID NO: 268096 - RNA, 64 nt, Homo Sapiens
aaaagcaaaaaaguaaaauguuacucaucucccuuuuuuaaacagccgcuggguccucgggggc

SEQ ID NO: 268097 - RNA, 64 nt, Homo Sapiens
uguaaaugucuauaugagcaggccuuuggaauaauuuuuaaaucuugaagaugugauguugcuc

SEQ ID NO: 268098 - RNA, 64 nt, Homo Sapiens
agguuuucuuacuuugguggcauuuucaacuuauuuuuuaaaguguuaauacugccaauaaaau

SEQ ID NO: 268099 - RNA, 64 nt, Homo Sapiens
ugcaguacacaucagccucaaauuccugugauuuuuuuuaaauggguuuuauucauuguaugaa

SEQ ID NO: 268100 - RNA, 64 nt, Homo Sapiens
agauguagcagaauaauucuguggauuuuuuucuuuuuuaaaagcgaacuggugcuuuaguaau

SEQ ID NO: 268101 - RNA, 64 nt, Homo Sapiens
gcuguuuuguuuuaauuuuuagaagucaaaaaucuuuuuaaaauucaacaguaguuuugaaacu

SEQ ID NO: 268102 - RNA, 64 nt, Homo Sapiens
gcacaaaacugcaggacaguaaaguaaauuagaauuuuuaaaaaagauauuuauucuuuaaauc

SEQ ID NO: 268103 - RNA, 64 nt, Homo Sapiens
auuauuaagguuguaauguuuugauuuuuagauuuuuuuaaauuacaggguccuguuguuuugu

SEQ ID NO: 268104 - RNA, 64 nt, Homo Sapiens
aagcaaggaguuaaauguccaaaaaccacuggaguuuuuaaaagauuuauuguaguggcugccu

SEQ ID NO: 268105 - RNA, 64 nt, Homo Sapiens
cuugaagcagaaccuuguaagaauuuuuaaauuuuuuuuaaaaaucuugugcugcacaugggcu

SEQ ID NO: 268106 - RNA, 64 nt, Homo Sapiens
uuuuuuaaaaacuugaagcagcacaugggcugaauuuuuaaauuguuuugcauauucuugugcu

SEQ ID NO: 268107 - RNA, 64 nt, Homo Sapiens
auaguuggacuuuggcagcuguaaaaaaaaucaauuuuuaaaaagucaccagauuuuuauuaau

SEQ ID NO: 268108 - RNA, 64 nt, Homo Sapiens
aaaagagaucagauuaaauaucuacugaauuaauuuuuuaaaaguacacaggaaaaaauagaag

SEQ ID NO: 268109 - RNA, 64 nt, Homo Sapiens
ugaucaacuuuaaauuaagcauuucuuuaauaaguuuuuaaaauuuauuuuaaguuaaagacag

SEQ ID NO: 268110 - RNA, 64 nt, Homo Sapiens
aucuuccucuuucucuggggcuugagaaauaauuuuuuuaaaaaccaaguauaaguuucaccac

SEQ ID NO: 268111 - RNA, 64 nt, Homo Sapiens
uuuaauuaauuuauuuauaauggaaauaucuaguuuuuuaaauugcaugauuauacacguguau

SEQ ID NO: 268112 - RNA, 64 nt, Homo Sapiens
aucaguuacugaagacuuauaagaaauugauuuauuuuuaaacucaagauauuguauucccaag

SEQ ID NO: 268113 - RNA, 64 nt, Homo Sapiens
ucaaaauuaaugcaaaagauuauuuaagugaauauuuuuaaaacucaauaaucaagauaccuaa

SEQ ID NO: 268114 - RNA, 64 nt, Homo Sapiens
uaaacaaauauucuuuacuaugucuuuuuaaauguuuuuaaauaaagaugaugaaaaugcagaa

SEQ ID NO: 268115 - RNA, 64 nt, Homo Sapiens
uuuuuaaauauaaacaaauaaaaugcagaaugucuuuuuaaaugaguuugcuaaaagaugauga

SEQ ID NO: 268116 - RNA, 64 nt, Homo Sapiens
aaaagaaugagauuuauaacaacacugagcgcuguuuuuaaaugauuggauugacuuacuaccu

SEQ ID NO: 268117 - RNA, 64 nt, Homo Sapiens
uccacuaucccuuuucuaaauguuuaaagacguguuuuuaaaaugcaaauaaaaucaaaaguca

SEQ ID NO: 268118 - RNA, 64 nt, Homo Sapiens
aagagacucagggaaaguacuggccuuacuuugauuuuuaaaacccugugggucaauuuugaac

SEQ ID NO: 268119 - RNA, 64 nt, Homo Sapiens
uaaaaguguuuguuucuguuuguuuauguaagaauuuuuaaacaaugacuugaccccaaaccuu

SEQ ID NO: 268120 - RNA, 64 nt, Homo Sapiens
gugauuuuuagauuuguuaguuucaguuucuucauuuuuaaauuuuuaaaauauuuaaaaaaau

SEQ ID NO: 268121 - RNA, 64 nt, Homo Sapiens
uuugacauuuaaauuacuuguuuaaaguaaauauuuuuuaaaguaauuuaaaaaguaucugauu

SEQ ID NO: 268122 - RNA, 64 nt, Homo Sapiens
aaauauuuuuuaaaguuuuguaaaaaguaucugauuuuuaaaguucaaaaaauaaaauuuaauu

SEQ ID NO: 268123 - RNA, 64 nt, Homo Sapiens
gcucaacauuaacuauucauggucaauaaguauauuuuuaaaauccaaaggaagacauauacau

SEQ ID NO: 268124 - RNA, 64 nt, Homo Sapiens
gguaagauaccauuauauuuaagccauuuaacauuuuuuaaauauaagagucuuaaaagaaauu

SEQ ID NO: 268125 - RNA, 64 nt, Homo Sapiens
caugcuuugauccacuuaucucuuucucuuugccuuuuuaaaccagacccaguaaaucacuucu

SEQ ID NO: 268126 - RNA, 64 nt, Homo Sapiens
aaaaauuccuauguucaguaucuaauuuuuaaucuuuuuaaaugauauuaagaagacauugcua

SEQ ID NO: 268127 - RNA, 64 nt, Homo Sapiens
acuuauaaagucacuuuuuaccccauugccucuuuuuuuaaaaauagcagccucuuguuuuuuu

SEQ ID NO: 268128 - RNA, 64 nt, Homo Sapiens
gaguaguacaucccauauuugucuccucauuugcuuuuuaaaugucuagauaggaaaaaaauca

SEQ ID NO: 268129 - RNA, 64 nt, Homo Sapiens
ucaaaacaaaaaauaccacacuuagagauaggaauuuuuaaaaaaauuuugcuguauuugauua

SEQ ID NO: 268130 - RNA, 64 nt, Homo Sapiens
aagcguccuccuuuuguccaguguuauucuacacuuuuuaaaagccucuagaugauuuguagca

SEQ ID NO: 268131 - RNA, 64 nt, Homo Sapiens
uguguuauguacauauauauuugguggugggauuuuuuuaaauguuaguuuacagagaaaaggc

SEQ ID NO: 268132 - RNA, 64 nt, Homo Sapiens
cccaaagacauuaucuguggauuauaaauauguuuuuuuaaauccaucccucacuuaccaauua

SEQ ID NO: 268133 - RNA, 64 nt, Homo Sapiens
uguuggcucuuaagaugaauuuuuuuccauauuuuuuuuaaauugcucuuagcagcugugguuu

SEQ ID NO: 268134 - RNA, 64 nt, Homo Sapiens
cucaguaguuucuagauaauuuuuuuuguuuuuguuuuuaaagcgauuuaaauguguaugugau

SEQ ID NO: 268135 - RNA, 64 nt, Homo Sapiens
cuuuuuuuuggaccuaaauauauuucuguugugauuuuuaaaaaaagaacauuuuauuuucucu

SEQ ID NO: 268136 - RNA, 64 nt, Homo Sapiens
uugucauuuuauuaagaguguuuguaauaaaacauuuuuaaaaaagcauuuuuuuaaaagaagc

SEQ ID NO: 268137 - RNA, 64 nt, Homo Sapiens
aagcuuuguaauaaaacauuaugugcugagcauuuuuuuaaaagugucauuccaguuugaguua

SEQ ID NO: 268138 - RNA, 64 nt, Homo Sapiens
agcaaggcacagccuuugccauugauguacccauuuuuuaaaaaugccaguuguuaaaaugagc

SEQ ID NO: 268139 - RNA, 64 nt, Homo Sapiens
guaaaccuuaacagaugcguuuucuucuuuucuuuuuuuaaacacaguuuauuuuuucuucugu

SEQ ID NO: 268140 - RNA, 64 nt, Homo Sapiens
ugaauuuuuuuaauuuacaccguuuuuuuuugcuuuuuuaaacuauuuaacagugcaaaaggau

SEQ ID NO: 268141 - RNA, 64 nt, Homo Sapiens
gaaauguaaaagcacaugagaagcauaaaaagguuuuuuaaaagaagagccaaguuccaaaaua

SEQ ID NO: 268142 - RNA, 64 nt, Homo Sapiens
gaguuauguuugggcaaagcaaacaaguugugcuuuuuuaaaagcacuuaaccucugugugccu

SEQ ID NO: 268143 - RNA, 64 nt, Homo Sapiens
caugguagaucguguuuagaugucacugagaaauuuuuuaaagaguuugguccccucuaguaug

SEQ ID NO: 268144 - RNA, 64 nt, Homo Sapiens
ucugaguguguacaaauaucguauguuccuuaaguuuuuaaaauuaaauuuugccuaaaauuca

SEQ ID NO: 268145 - RNA, 64 nt, Homo Sapiens
guuaaggcacucugaaacaaguuaacagugucuuuuuuuaaaaauaagagaaauaauuguauuu

SEQ ID NO: 268146 - RNA, 64 nt, Homo Sapiens
gagaaguaauauguggaaaaaguggcuguuuuaauuuuuaaauuauuuuaaugaauuuuuggca

SEQ ID NO: 268147 - RNA, 64 nt, Homo Sapiens
acaaguagaaugauuuaaauaaagagucuuuuuauuuuuaaaacaauugaacuuucuaaaacua

SEQ ID NO: 268148 - RNA, 64 nt, Homo Sapiens
aaugcuucuauuucuuuugaugagauauaauggcuuuuuaaaguuuuuuauaucuaaaaauauu

SEQ ID NO: 268149 - RNA, 64 nt, Homo Sapiens
auauugaagacaaccagauauuucucuuucuuucuuuuuaaaauuuuccuucuuuccuuucuuc

SEQ ID NO: 268150 - RNA, 64 nt, Homo Sapiens
gcaagaaagucacaauauuaaggagacagggauuuuuuuaaagagcuucaucauccugaaaaga

SEQ ID NO: 268151 - RNA, 64 nt, Homo Sapiens
gucaaaugaaguaguguuaauauuuacaggaugauuuuuaaacugcugcuguuguuuuuuauuc

SEQ ID NO: 268152 - RNA, 64 nt, Homo Sapiens
aaauuagagcuguaaggaaauuguguauucaggcuuuuuaaauacuaaguaaggcagcagucau

SEQ ID NO: 268153 - RNA, 64 nt, Homo Sapiens
guuucuguuuuuauucaucugaaacccaaugguguuuuuaaacuagagguaucaaguaaauacu

SEQ ID NO: 268154 - RNA, 64 nt, Homo Sapiens
uuauuuguaguuuacuuuccuuucuuuggcaauuuuuuuaaagaguuuuuggcauguuguuuga

SEQ ID NO: 268155 - RNA, 64 nt, Homo Sapiens
aggucuuucuccccgaaauacuaauugggauuauuuuuuaaaaggucagccauuuacucuccca

SEQ ID NO: 268156 - RNA, 64 nt, Homo Sapiens
uauuaguccaggggauuuuguuccuuuaaguuuguuuuuaaauggaagguugguuucgcuuuuu

SEQ ID NO: 268157 - RNA, 64 nt, Homo Sapiens
uguaaagacacaucuuauugaaugguguccagucuuuuuaaacugugcauuauucauaaaaaau

SEQ ID NO: 268158 - RNA, 64 nt, Homo Sapiens
gguuaugugcauuauucauagccaaguaaaauguuuuuuaaaauggugugagccaccgugcccg

SEQ ID NO: 268159 - RNA, 64 nt, Homo Sapiens
aaaacaauguauauuauguucuaaauuaaccuuuuuuuuaaaaagguugaagaugaaaucauuc

SEQ ID NO: 268160 - RNA, 64 nt, Homo Sapiens
ugaacuuuucguauaauagacuaauuuauuugcuuuuuuaaacucaauuguuuacaaggcuuaa

SEQ ID NO: 268161 - RNA, 64 nt, Homo Sapiens
uaauuugggaaauuaacagcacuucuccagggauuuuuuaaaguaaguucauuuccugggauuc

SEQ ID NO: 268162 - RNA, 64 nt, Homo Sapiens
ccugcuacugucccuucucagcggaccagagaucuuuuuaaauccuggcuggagaaucucacaa

SEQ ID NO: 268163 - RNA, 64 nt, Homo Sapiens
gccauuaaagauggguuucauaaguaaagagcacuuuuuaaacuacauaauaaaagaucggccc

SEQ ID NO: 268164 - RNA, 64 nt, Homo Sapiens
ccugugguaaaagccucaaugcucauuuuccauauuuuuaaaacaauuguuucuuugugcuuca

SEQ ID NO: 268165 - RNA, 64 nt, Homo Sapiens
ucacauaaguuauauuuaagggaggagggaauuuuuuuuaaacaagcuuagguccuuucccgag

SEQ ID NO: 268166 - RNA, 64 nt, Homo Sapiens
guugguugcaucuuguaggccaucugacuuccuguuuuuaaaacgggggucuggucuugcuaaa

SEQ ID NO: 268167 - RNA, 64 nt, Homo Sapiens
cguuguauucacacaaaccugaacaaagcaaauuuuuuuaaaagcagcguauguaagcaccgac

SEQ ID NO: 268168 - RNA, 64 nt, Homo Sapiens
uagcacuuugcauaggcaaaauacuuuucaggccuuuuuaaaaaauucauuacagcaaacagcu

SEQ ID NO: 268169 - RNA, 64 nt, Homo Sapiens
aucuuguaaaaacacuuuuuugguuuaauauauauuuuuaaaacauuucacuagugauugaauu

SEQ ID NO: 268170 - RNA, 64 nt, Homo Sapiens
uuccauaugacacugguuccgauuuuaaaaauuauuuuuaaauaaccgauuauugauuacugua

SEQ ID NO: 268171 - RNA, 64 nt, Homo Sapiens
ugaaaguaaaaugaaguaguauauaugaaaaugcuuuuuaaacacaaaagcuuuauacaaaaua

SEQ ID NO: 268172 - RNA, 64 nt, Homo Sapiens
acacaaguuuaccauuuuuaucaucuuuagauuauuuuuaaaucucacuaccuugaaguuugcc

SEQ ID NO: 268173 - RNA, 64 nt, Homo Sapiens
aggacucagcuucagugauucuguuuucauaggcuuuuuaaagcccuuuucagucaaauuagau

SEQ ID NO: 268174 - RNA, 64 nt, Homo Sapiens
ugccagauuuuauccuagacccugaggauauagcuuuuuaaaacccccuccuguuucagagcuu

SEQ ID NO: 268175 - RNA, 64 nt, Homo Sapiens
guuaaaaggcauucuuagauucauuuuaaccacauuuuuaaaaacucacaguugguuaacauga

SEQ ID NO: 268176 - RNA, 64 nt, Homo Sapiens
ucugcauuauuggaauauaauuguuuuaucugaauuuuuaaacaaguauuuguuaauuuagaaa

SEQ ID NO: 268177 - RNA, 64 nt, Homo Sapiens
gaagaaucucaucucagugaagaauacuucucauuuuuuaaaaaagcuuaaaacuuugaaguua

SEQ ID NO: 268178 - RNA, 64 nt, Homo Sapiens
cucauuuuuguugaguaagcaaaauuacaaaguguuuuuaaaaaaaccuguacaaauauguuua

SEQ ID NO: 268179 - RNA, 64 nt, Homo Sapiens
acccccaagcugugagaguguguuuauuuuuaauuuuuuaaaagguauuuaauuuccaaccaca

SEQ ID NO: 268180 - RNA, 64 nt, Homo Sapiens
acuguugaauucauaccauauaaaacuuguuagguuuuuaaacauagcaaucaaggcuacaaaa

SEQ ID NO: 268181 - RNA, 64 nt, Homo Sapiens
gacaagucucgguguucccuuuauucuuaguuuguuuuuaaauauuaauuuuggcauucuaaaa

SEQ ID NO: 268182 - RNA, 64 nt, Homo Sapiens
ccggauuuuuguuaauauucauuuuuguuauccuuuuuuaaaaguaaauguacaggaugccagu

SEQ ID NO: 268183 - RNA, 64 nt, Homo Sapiens
ucauacacaagucuaacaguuaauuaguuaacaguuuuuaaacuagguuuguggguauuuuuuu

SEQ ID NO: 268184 - RNA, 64 nt, Homo Sapiens
agugagaaguucauauuucuuuggcuuuuuuguguuuuuaaaaguuacuccuuuuagggagcug

SEQ ID NO: 268185 - RNA, 64 nt, Homo Sapiens
caugggacaaaguuccaaaaugccaaauucuuauuuuuuaaaaagcuaguucuauaaaauacug

SEQ ID NO: 268186 - RNA, 64 nt, Homo Sapiens
caaaacaaaaaaaaacucauuuauaccuguguauuuuuuaaagcuacaaucuguucaauguuuu

SEQ ID NO: 268187 - RNA, 64 nt, Homo Sapiens
cuguguauuuuuuaaagcuacaaucuguucaauguuuuuaaaaaucuguuuauaugacauuguu

SEQ ID NO: 268188 - RNA, 64 nt, Homo Sapiens
auucucaguaaaaaugaaguuuuuguaggauuaauuuuuaaauuauuuccagugucuauguuga

SEQ ID NO: 268189 - RNA, 64 nt, Homo Sapiens
cauauuaauaaaguauaagugauguuuuauaugauuuuuaaaaaaaauucucaagugcaaugug

SEQ ID NO: 268190 - RNA, 64 nt, Homo Sapiens
acaugaguuuuaugguauuuugugagggaugcauuuuuuaaaagauuaauuuuggaaacagaag

SEQ ID NO: 268191 - RNA, 64 nt, Homo Sapiens
ccaaugcagagcaguuugcuuugaaaaauaguuguuuuuaaaaguuuaauguaaauaauuauuu

SEQ ID NO: 268192 - RNA, 64 nt, Homo Sapiens
uguaaauaauuauuuuuuagaaguuuuuuuuuuuuuuuuaaagacagggucucgcuuuaucgcc

SEQ ID NO: 268193 - RNA, 64 nt, Homo Sapiens
cuggauuaggaaaugaauuuguuuaauauuuuuguuuuuaaacaugauugaaaucacugcuuau

SEQ ID NO: 268194 - RNA, 64 nt, Homo Sapiens
caugauugaaaucacugcuuauaaaugugugauuuuuuuaaaacgaccaaaacuguucugaaga

SEQ ID NO: 268195 - RNA, 64 nt, Homo Sapiens
uuuuuguaaugcuaaaaaaucaguaucuagaugguuuuuaaauguauucucuggaaauuguuuu

SEQ ID NO: 268196 - RNA, 64 nt, Homo Sapiens
gugaaggcuaaucauagaaaaaaaaccucuaguuuuuuuaaaaauagaauuuggaaacuuauuu

SEQ ID NO: 268197 - RNA, 64 nt, Homo Sapiens
aaauguguaugguuugcagcuuuuaaaaaccauuuuuuuaaaacuaauaaauagugacugaacc

SEQ ID NO: 268198 - RNA, 64 nt, Homo Sapiens
aguuaaugcaguagaaaguagugguaauaauuccuuuuuaaaaaaauuucgguagucauauagu

SEQ ID NO: 268199 - RNA, 64 nt, Homo Sapiens
aaggauugugauauuagaggcuggaaauccuuauuuuuuaaaaaaucagauaggcauaaauagu

SEQ ID NO: 268200 - RNA, 64 nt, Homo Sapiens
aguuauuuaauaugaguuugagagagaaaauuguuuuuuaaaaauauaugugcauugaaaugau

SEQ ID NO: 268201 - RNA, 64 nt, Homo Sapiens
aagguuugauguauauagaaauuccauguuugauuuuuuaaaauauguguauaagucugucaug

SEQ ID NO: 268202 - RNA, 64 nt, Homo Sapiens
uugcuuuuuucauaguucuuguuuucauguuuuauuuuuaaaaagacauauaaagauugcauau

SEQ ID NO: 268203 - RNA, 64 nt, Homo Sapiens
auuuccuaauaaaccccuuugauuuaaaaauguauuuuuaaaaauguuuacauugaugaugagu

SEQ ID NO: 268204 - RNA, 64 nt, Homo Sapiens
gcuacaugacgacaaagcugcuaaaucuccuauuuuuuuaaaaucacuaacauuauauugcaau

SEQ ID NO: 268205 - RNA, 64 nt, Homo Sapiens
augaaggaaauaaaaaagucucuauuuaaauucuuuuuuaaauuuucuucaguugguguguuuu

SEQ ID NO: 268206 - RNA, 64 nt, Homo Sapiens
uaacucacuccuaggaauguauuuugcuucaggauuuuuaaauucaaauaaggauggcagugcc

SEQ ID NO: 268207 - RNA, 64 nt, Homo Sapiens
ugucuuugagagagauacaggucuuggaauucacuuuuuaaauguuacguuccaaccuuauaug

SEQ ID NO: 268208 - RNA, 64 nt, Homo Sapiens
auguuccaaggugcagugcacugugaaucuuuuauuuuuaaaaaaauuuguaggugcuuuuaug

SEQ ID NO: 268209 - RNA, 64 nt, Homo Sapiens
auuuuaaacaaacaauuugaaguuaaacauuucauuuuuaaaaacacugaauuacaguucuuau

SEQ ID NO: 268210 - RNA, 64 nt, Homo Sapiens
aaacaaguucaaaauuuaaacaaguucauacaaguuuuuaaaaauucucaacugguagcuugcu

SEQ ID NO: 268211 - RNA, 64 nt, Homo Sapiens
agccagagucaaaagaacucuucuuguaaaucacuuuuuaaauuuucucucacugaugcccuuu

SEQ ID NO: 268212 - RNA, 64 nt, Homo Sapiens
cauuuuggggugauaucuguauauauaacuuguuuuuuuaaaagaugccguuuaaaagcaugau

SEQ ID NO: 268213 - RNA, 64 nt, Homo Sapiens
cauguacccaacuuuucauuaauuuguauuuccauuuuuaaauugcauauucuauguuuuguag

SEQ ID NO: 268214 - RNA, 64 nt, Homo Sapiens
cccaaagagccacaguagcugucaauuauugagauuuuuaaaugguaaauauugcaaaaguuaa

SEQ ID NO: 268215 - RNA, 64 nt, Homo Sapiens
uaaaaucauaaaaaaucaaguuuuaagguuauauuuuuuaaaauaaugaauuuucuaucucuag

SEQ ID NO: 268216 - RNA, 64 nt, Homo Sapiens
gcuucauuuugauaugacugaauugcaaucuauauuuuuaaaaagaaaaaucaaaauacauuag

SEQ ID NO: 268217 - RNA, 64 nt, Homo Sapiens
ccuuagccuccugguuugugucuuuuuuuuuuuuuuuuuaaaacagaaucacucuggcaauugu

SEQ ID NO: 268218 - RNA, 64 nt, Homo Sapiens
ugggaaaugagaaaguuuuaauaaguaaaaugauuuuuuaaauaacagcaacugccuagaaucu

SEQ ID NO: 268219 - RNA, 64 nt, Homo Sapiens
uguggugguuuuguaauuugaugcuuuuauucuguuuuuaaauugaaaugagguaaugcaacuu

SEQ ID NO: 268220 - RNA, 64 nt, Homo Sapiens
ggguggcuauuuugauuuggcaugacuacuuaauuuuuuaaaaaaauugugguuugugaauugc

SEQ ID NO: 268221 - RNA, 64 nt, Homo Sapiens
uuuuaaagauaugaaaucuguuuacucaaccaauuuuuuaaaugucauauugugauaaugcucu

SEQ ID NO: 268222 - RNA, 64 nt, Homo Sapiens
aaauauugaaugccuuauuuuugaauucuuuagauuuuuaaauuggagaaaagcacuuaaaguu

SEQ ID NO: 268223 - RNA, 64 nt, Homo Sapiens
gggcaacauaauaagacuuuucucuacuuuaaauuuuuuaaaaaauuaguugggcauaguggca

SEQ ID NO: 268224 - RNA, 64 nt, Homo Sapiens
ugucugcaguuuacaauguauuguaaaugaagauuuuuuaaauucuaucuugcugauuuuuuuu

SEQ ID NO: 268225 - RNA, 64 nt, Homo Sapiens
aaugaagauuuuuuaaauucuaucuugcugauuuuuuuuaaauauaagaaacugguacuuggua

SEQ ID NO: 268226 - RNA, 64 nt, Homo Sapiens
cuucaugcuauauaucuuuuguaagacauuuccuuuuuuaaaaaaauuuuugcaaauaacugau

SEQ ID NO: 268227 - RNA, 64 nt, Homo Sapiens
aucuauguauaggagauaaaauuugcuaguaagauuuuuaaaaacuggcuagugaaaggaaagu

SEQ ID NO: 268228 - RNA, 64 nt, Homo Sapiens
uacccauuauagcacaaaaucagccaaagcagaauuuuuaaaaauuggcuuuuuuaggauucuu

SEQ ID NO: 268229 - RNA, 64 nt, Homo Sapiens
gcuguuuauauguucacaguuacuuuuuuuuuuuuuuuuaaauaaaagucauuuaauguagaau

SEQ ID NO: 268230 - RNA, 64 nt, Homo Sapiens
gaaaauaaugguucuuuguuuuuaauguuaaccuuuuuuaaauacaauacugauaguuagaaga

SEQ ID NO: 268231 - RNA, 64 nt, Homo Sapiens
ucauauuuucaagauguaauuuuacauuucugcauuuuuaaaacaguuuggccauaauccuaga

SEQ ID NO: 268232 - RNA, 64 nt, Homo Sapiens
uugaaauucaguuuacagaaauuggagaaaaugcuuuuuaaacaaguguuuccuuucuucaaga

SEQ ID NO: 268233 - RNA, 64 nt, Homo Sapiens
guucugucaguaauccauaagacagaaaucuguuuuuuuaaaaauaucuuuuucuccucucagc

SEQ ID NO: 268234 - RNA, 64 nt, Homo Sapiens
gccaguaacguuuauuuaaaacaaaauauuuuaauuuuuaaauuuucccuuaaaacacacuuuu

SEQ ID NO: 268235 - RNA, 64 nt, Homo Sapiens
uuaaauuuuguaaaaauaacuuauuuauaaauaauuuuuaaagagaaaaaucucauauaauuug

SEQ ID NO: 268236 - RNA, 64 nt, Homo Sapiens
acuuugcagauauggacagccuuuacaaaaauaauuuuuaaaugcuuaauuauuuuaauuuguu

SEQ ID NO: 268237 - RNA, 64 nt, Homo Sapiens
cagaagcauagacuguagaguaucuuuuuaagcauuuuuaaaaaaugcuuuuaaugcaucauac

SEQ ID NO: 268238 - RNA, 64 nt, Homo Sapiens
cauuuguaauacauuuuccugauuugaaaguuuguuuuuaaaaguuuucuauuaauuauagugc

SEQ ID NO: 268239 - RNA, 64 nt, Homo Sapiens
acccuaguuucagaagcauagauuguaguguaccuuuuuaaacuuuauuuuuuuaaaaaaaguu

SEQ ID NO: 268240 - RNA, 64 nt, Homo Sapiens
gcauagauuguaguguaccuuuuuaaacuuuauuuuuuuaaaaaaaguuguuuuaugaaucaua

SEQ ID NO: 268241 - RNA, 64 nt, Homo Sapiens
caugugguacuacugaagaaggugcauugauacauuuuuaaauguaaguugagaaaaauuuaua

SEQ ID NO: 268242 - RNA, 64 nt, Homo Sapiens
acuacaguaguuccaguccuaacuuucugaauuauuuuuaaagaucuucucuaacaagcuaugg

SEQ ID NO: 268243 - RNA, 64 nt, Homo Sapiens
agucacggugcacacauugcauuuucuaacuauguuuuuaaaaccucuuugaaugcugaaaggu

SEQ ID NO: 268244 - RNA, 64 nt, Homo Sapiens
aaugcugaaaggucuucccucagcucacuuugaguuuuuaaaugacauuguuuuugaggcccua

SEQ ID NO: 268245 - RNA, 64 nt, Homo Sapiens
gggauuggugggaaaugucaaaacaugcccuuuauuuuuaaaggcauucacaaacucucugacu

SEQ ID NO: 268246 - RNA, 64 nt, Homo Sapiens
gucauuuguggcuagauagguuaagacaggugauuuuuuaaaguagacugucuuugcauuuugc

SEQ ID NO: 268247 - RNA, 64 nt, Homo Sapiens
ggagcuuuuacauuaaaaaucuacuaacgccuacuuuuuaaaaaaugagauucuuucuaaucuu

SEQ ID NO: 268248 - RNA, 64 nt, Homo Sapiens
cacaaacuauggugugcuuauguuuuuguuuugcuuuuuaaacugauguauagcuuuaacauuu

SEQ ID NO: 268249 - RNA, 64 nt, Homo Sapiens
uaaauauacagcaugagauuguacauuuuuuacuuuuuuaaaauuguguucuuaaaauauugug

SEQ ID NO: 268250 - RNA, 64 nt, Homo Sapiens
gaaaauacauuguguuuuccuaaacacacuuuucuuuuuaaaugugcuucauuguuugauuugg

SEQ ID NO: 268251 - RNA, 64 nt, Homo Sapiens
uuucauuaguuuauuuguguuggguucuuuuuuuuuuuuaaaugaaaaguauaguauguggcac

SEQ ID NO: 268252 - RNA, 64 nt, Homo Sapiens
uuuuuuuuuaaaugaaaaguauaguauguggcacuuuuuaaagaacaaaggaaauaguuuugua

SEQ ID NO: 268253 - RNA, 64 nt, Homo Sapiens
cauguaaugcuuaguuuucuuguauuuacuucuuuuuuuaaauguaaggaccaaacuucuaaac

SEQ ID NO: 268254 - RNA, 64 nt, Homo Sapiens
aacuucuaaacuaauuguucuuuuguugcuuuaauuuuuaaaaauuacauucuucugauguaac

SEQ ID NO: 268255 - RNA, 64 nt, Homo Sapiens
ggaagucaaugcacuaacucaauaccaagaugaguuuuuaaauaaugaauauuauuuaauacca

SEQ ID NO: 268256 - RNA, 64 nt, Homo Sapiens
aaaugugguuguaugagccaaucauauuugugauuuuuuaaaaaaaguuuaaaaggaaauaucu

SEQ ID NO: 268257 - RNA, 64 nt, Homo Sapiens
guaggcagagcuagguuuauuuucucuuaaacaauuuuuaaaauucagaauguaaaaauugggu

SEQ ID NO: 268258 - RNA, 64 nt, Homo Sapiens
aaaauaacaaaauugucuacagcuucuuacuaaguuuuuaaaauuauucauaaaaugcagacau

SEQ ID NO: 268259 - RNA, 64 nt, Homo Sapiens
aaucaaucuuucuacuaauguaaauuugagauuauuuuuaaaaauggaauaaaagagguuuugg

SEQ ID NO: 268260 - RNA, 64 nt, Homo Sapiens
gacaauauuguauucaacuguuuuauuuuuuauauuuuuaaaauuuaaaguauaauuaguuuuu

SEQ ID NO: 268261 - RNA, 64 nt, Homo Sapiens
aagcaaacuaacuuuuuuuuuuuuaacaucuuuguuuuuaaaauagaaugauagaacuuugcca

SEQ ID NO: 268262 - RNA, 64 nt, Homo Sapiens
uagggagaugaguugcaguuuuuauaauagauuuuuuuuaaaguuugguauuguaaaacauuca

SEQ ID NO: 268263 - RNA, 64 nt, Homo Sapiens
cuguucaaauuuuuuuuuaacguggcuuguagaauuuuuaaaaaagugaucuuagguuuguuuu

SEQ ID NO: 268264 - RNA, 64 nt, Homo Sapiens
uguaaaagaugaaggcuguaucuauuuuuuuuucuuuuuaaaguuuguucacuuaaauucuuuu

SEQ ID NO: 268265 - RNA, 64 nt, Homo Sapiens
gcagaauuauuugcaauuuguagcauagaaaagauuuuuaaauuuuuuuacaaaagguuuuuaa

SEQ ID NO: 268266 - RNA, 64 nt, Homo Sapiens
cauagaaaagauuuuuaaauuuuuuuacaaaagguuuuuaaacagauuaggguaggugaugguu

SEQ ID NO: 268267 - RNA, 64 nt, Homo Sapiens
gaaaugauuguauuguaaacugaggcuaaauuuuuuuuuaaaccuguuucauguguuauaaagg

SEQ ID NO: 268268 - RNA, 64 nt, Homo Sapiens
cuuaggguuuuguuagcccuuuuguacuacuuucuuuuuaaauugagaacaugguucuuuacau

SEQ ID NO: 268269 - RNA, 64 nt, Homo Sapiens
ugaauguaaugguugauauauguacauucugauauuuuuaaaucuuuaacuuuuuaaaguuaaa

SEQ ID NO: 268270 - RNA, 64 nt, Homo Sapiens
uauauguacauucugauauuuuuaaaucuuuaacuuuuuaaaguuaaaaaccuacagcugcuua

SEQ ID NO: 268271 - RNA, 64 nt, Homo Sapiens
gcaugcagagaaaaucugugcauccucuuuuauauuuuuaaaauacuguuuaacauuugugaga

SEQ ID NO: 268272 - RNA, 64 nt, Homo Sapiens
ucaaaacaggucccuaagacaauucuucagaucauuuuuaaaaugacuaagucauuuuaguaug

SEQ ID NO: 268273 - RNA, 64 nt, Homo Sapiens
ggguugggauccuuggaauacuuuacaauuuuuauuuuuaaaugugcuuuuauugaauggagug

SEQ ID NO: 268274 - RNA, 64 nt, Homo Sapiens
auuauuuauagaaagaaucuuuaaggugcaguauuuuuuaaauuuuguuaagccuguauugguc

SEQ ID NO: 268275 - RNA, 64 nt, Homo Sapiens
acauuacuagaaaauuaaaccaauguaucagcuuuuuuuaaaggagaagauuaaaaaaaaaucu

SEQ ID NO: 268276 - RNA, 64 nt, Homo Sapiens
gucacaaaagcgcaucuccauacaugagcuaacuuuuuuaaauuucucacccccaccguguaua

SEQ ID NO: 268277 - RNA, 64 nt, Homo Sapiens
guaugcuaaaacguauuugugguuuucuuuuucuuuuuuaaacucaccuucuucuaauucaaaa

SEQ ID NO: 268278 - RNA, 64 nt, Homo Sapiens
agaaaaagaaacacaaauauaccgagaggggagauuuuuaaaaagucguggaggcuaaaauaca

SEQ ID NO: 268279 - RNA, 64 nt, Homo Sapiens
uuauuuuuacuauuucuuuacuauaaaccuuugcuuuuuaaaguggauaauuagcauugucaga

SEQ ID NO: 268280 - RNA, 64 nt, Homo Sapiens
uuaucuuacuguuuuuauaacccuuguuagauuuuuuuuaaauuguacucuuugccuaugcauc

SEQ ID NO: 268281 - RNA, 64 nt, Homo Sapiens
gaaacagcacaguaaauacuacuuagcaaaauuauuuuuaaauuagacuucaguugagauguau

SEQ ID NO: 268282 - RNA, 64 nt, Homo Sapiens
aaguuuuacugccauauuggccuuccucuuucuguuuuuaaaaagauucugcugguacgagagg

SEQ ID NO: 268283 - RNA, 64 nt, Homo Sapiens
ccauguuguggaaaaaagccgcucauauuguaucuuuuuaaaaaaucaauuaauuuuuuuugaa

SEQ ID NO: 268284 - RNA, 64 nt, Homo Sapiens
uaaaacuaaagagagaaugcauccaguccucacauuuuuaaauaucaucaugccacauuaucug

SEQ ID NO: 268285 - RNA, 64 nt, Homo Sapiens
ucauuuuauuuugugauacacuagagacccacauuuuuuaaaaauaaaauuuacacuucuaaga

SEQ ID NO: 268286 - RNA, 64 nt, Homo Sapiens
ucaaaguuagaucaagagaacaguacaaugucaguuuuuaaaaggauugagaauuauguaaauu

SEQ ID NO: 268287 - RNA, 64 nt, Homo Sapiens
cauugauuaaauaaugauuaaagcuuuugucuauuuuuuaaacuacuucagucccauguuucag

SEQ ID NO: 268288 - RNA, 64 nt, Homo Sapiens
ccauuuuacuggaaaguugguuuuuuuuucucuuuuuuuaaaauuuguuucaauuaccgcuaga

SEQ ID NO: 268289 - RNA, 64 nt, Homo Sapiens
uuuuguuuuuguuucaauuauauaaugaagacacuuuuuaaaguuuuuaugcauggcaccucuu

SEQ ID NO: 268290 - RNA, 64 nt, Homo Sapiens
uuuuguuuuauuggaaugcauuuuaugaagaugguuuuuaaaacuauaaguaaugaucuacauu

SEQ ID NO: 268291 - RNA, 64 nt, Homo Sapiens
aauggcuuuuacagauagguuuuuaaaauaugcauuuuuaaaugccuuaccacaaaugagucau

SEQ ID NO: 268292 - RNA, 64 nt, Homo Sapiens
augcauuuuuaaaugaauggccacaaaugagucauuuuuaaaauguuacaguaaguaauccuua

SEQ ID NO: 268293 - RNA, 64 nt, Homo Sapiens
uacaaauuuguauauggaauaacagaagacuguauuuuuaaaguagcauaauguuccugauguu

SEQ ID NO: 268294 - RNA, 64 nt, Homo Sapiens
uacuggauuuuccuaagauuugggcuuaaauuacuuuuuaaagaauaaguggucacauuuguuu

SEQ ID NO: 268295 - RNA, 64 nt, Homo Sapiens
cagaaaaauugaaaaacuguuuuuauuaugaacauuuuuaaaaagauaugacuucccccccaaa

SEQ ID NO: 268296 - RNA, 64 nt, Homo Sapiens
uauuguuuguuuacauuuaauuucuaauuauugcuuuuuaaaugaaaaucuuauuccuacuauu

SEQ ID NO: 268297 - RNA, 64 nt, Homo Sapiens
cucuuuuucccuuauguuucuugcugguugucaguuuuuaaauuuacauuaagaugugcuuuca

SEQ ID NO: 268298 - RNA, 64 nt, Homo Sapiens
uuauuugcuguuaaauucugguacagaacuaaauuuuuuaaacuuagggauaguuggaacuaau

SEQ ID NO: 268299 - RNA, 64 nt, Homo Sapiens
uuuaaaauggaagggaagaauuuuucugguuacuuuuuuaaaaauuuaaagaauaaaugaaaca

SEQ ID NO: 268300 - RNA, 64 nt, Homo Sapiens
ugguauaaugaauuguguacugcaugauguuugguuuuuaaacauaccucuuuggccauuugua

SEQ ID NO: 268301 - RNA, 64 nt, Homo Sapiens
ugccauaccucguguuucuuaaauaaacuuauuuuuuuuaaaaauuugaaaguaagugaaaugu

SEQ ID NO: 268302 - RNA, 64 nt, Homo Sapiens
uguuuggccauuaguauuuuaaagauugccuuaguuuuuaaaaaaagacuacugaaauauagau

SEQ ID NO: 268303 - RNA, 64 nt, Homo Sapiens
aauauuuuucucaagcuccuuugugugugauucauuuuuaaagaguauguauaaugguaggugu

SEQ ID NO: 268304 - RNA, 64 nt, Homo Sapiens
auauuauuauggaagcacgauuuacuguuuuucauuuuuaaagaguaaauaaaaaugugugcuc

SEQ ID NO: 268305 - RNA, 64 nt, Homo Sapiens
acucuuuggugcacaaguaacguaggcaaaucucuuuuuaaaaauguauacuucagugcucacc

SEQ ID NO: 268306 - RNA, 64 nt, Homo Sapiens
gucaagacagggaaggaugauggggagggguggauuuuuaaaauagcauaacuggagggugggu

SEQ ID NO: 268307 - RNA, 64 nt, Homo Sapiens
cucaaagcaguuaaacagcauguggcugaaugaauuuuuaaaaugcuccaugcuuugaauacua

SEQ ID NO: 268308 - RNA, 64 nt, Homo Sapiens
cacuuuaucaguauuuuaaagccagcauuaguaauuuuuaaaaaaggcgugagccacugagcca

SEQ ID NO: 268309 - RNA, 64 nt, Homo Sapiens
ugucaaccaacuuuauaguaauguuuuauuacaauuuuuaaaugugguuaaaauguuaaguuuu

SEQ ID NO: 268310 - RNA, 64 nt, Homo Sapiens
aaaugaauaaauggacaaauaugccuggccucauuuuuuaaaacgauuacaggcaugagucacc

SEQ ID NO: 268311 - RNA, 64 nt, Homo Sapiens
uugacauagugaucauuuaagauguaauaaaauauuuuuaaauuggcaagugaauuauuuuaau

SEQ ID NO: 268312 - RNA, 64 nt, Homo Sapiens
guaugcuugaguaacugacuuugaggaggguucuuuuuuaaagugcuguacaaugccugugaug

SEQ ID NO: 268313 - RNA, 64 nt, Homo Sapiens
aauuuauuuacgauaucuagugaagauuaucugcuuuuuaaauuccuuuuuguguucaacacag

SEQ ID NO: 268314 - RNA, 64 nt, Homo Sapiens
gacuuaccuguaaaguuaucuugcuuuguuuugguuuuuaaacauuugugcacuguguuuugcu

SEQ ID NO: 268315 - RNA, 64 nt, Homo Sapiens
uuuucagauuggcuaaauauguauguugggguaauuuuuaaaaaaaucaaagaaagaaggccac

SEQ ID NO: 268316 - RNA, 64 nt, Homo Sapiens
aucaggguauaguaggcacuauauuuuaggccuuuuuuuaaaaaaaccacugaccauuuuuauc

SEQ ID NO: 268317 - RNA, 64 nt, Homo Sapiens
aauugcaaaaugugcauuagguacuacagagggauuuuuaaauucuuuuacuuaacaugcauau

SEQ ID NO: 268318 - RNA, 64 nt, Homo Sapiens
uauuggucaauuccugacauuuagaggcauuacuuuuuuaaaaaccccuuuaaaauguauuucu

SEQ ID NO: 268319 - RNA, 64 nt, Homo Sapiens
aaaccagcaucucugauguuauucagcucugauguuuuuaaagaguuguuguauuuuagaagga

SEQ ID NO: 268320 - RNA, 64 nt, Homo Sapiens
agcaguuuagagcaaacuguuuaccauauuauuguuuuuaaaaaaaguuccacaaaauccaaau

SEQ ID NO: 268321 - RNA, 64 nt, Homo Sapiens
ccacacucuuccauauaugguuuuguaacaauaauuuuuaaaacaaaauuaauguuuaaaaugu

SEQ ID NO: 268322 - RNA, 64 nt, Homo Sapiens
aguuuuauuuugcacggcucgugccuggccgacauuuuuaaaaagauuacaggcgugagccacc

SEQ ID NO: 268323 - RNA, 64 nt, Homo Sapiens
cuaucacacaaagacuuuuuuaaaguucuuauacuuuuuaaaagaaacuuuaaguaauuauuuu

SEQ ID NO: 268324 - RNA, 64 nt, Homo Sapiens
ucuuauacuuuuuaaaagcuacuuuaaguaauuauuuuuaaagugcauaugagugaggaaauaa

SEQ ID NO: 268325 - RNA, 64 nt, Homo Sapiens
agcgcuuuaaugaaaaugguuuauaaggugauacuuuuuaaauauguauuuuauauacucaguu

SEQ ID NO: 268326 - RNA, 64 nt, Homo Sapiens
uauguauacuagccuggccuuaccauguaauuuguuuuuaaauuuaugaauuuaaaaccagguu

SEQ ID NO: 268327 - RNA, 64 nt, Homo Sapiens
ugaagcuuuaacaggaauagauaugauguagacauuuuuaaaugcucaagccuuguacaagcac

SEQ ID NO: 268328 - RNA, 64 nt, Homo Sapiens
ccuuauggauaggaauuagucuaagagaagauauuuuuuaaauguuuuauaucauguuuauguc

SEQ ID NO: 268329 - RNA, 64 nt, Homo Sapiens
agagugacuuauuuugucuugaugaccauaauuuuuuuuaaagagggauuauucuuugaaaaca

SEQ ID NO: 268330 - RNA, 64 nt, Homo Sapiens
cucuucagugcaaauuguauguguguagguuaucuuuuuaaaaauugaggcaaauuaacuguau

SEQ ID NO: 268331 - RNA, 64 nt, Homo Sapiens
guagagucuuacaaucaaauccaagugugcucuuuuuuuaaaagaguuuaaaagccauguauaa

SEQ ID NO: 268332 - RNA, 64 nt, Homo Sapiens
auauucuuacucauuugcuauaauugagauuuaauuuuuaaaagcauuagacuuuuugguuaaa

SEQ ID NO: 268333 - RNA, 64 nt, Homo Sapiens
gacccaccuuucaugcugcuuaaaaggaagaaucuuuuuaaagucaucuuaauauaucaugcag

SEQ ID NO: 268334 - RNA, 64 nt, Homo Sapiens
aaauguuuuuauucuuuacugaugcuaaaugguauuuuuaaaaucugccaaacuuggggcaauu

SEQ ID NO: 268335 - RNA, 64 nt, Homo Sapiens
aaaaaccucucuuauggaagggccagauauucacuuuuuaaaucaggcguauaacugugugagu

SEQ ID NO: 268336 - RNA, 64 nt, Homo Sapiens
aacccagucaaauguauuuugagaaugguggaacuuuuuaaaagauaaaaucagaaauagaugu

SEQ ID NO: 268337 - RNA, 64 nt, Homo Sapiens
ugugacaacacuuuuauucuuuguaugacagacauuuuuaaaaaauugaaccuugaacaaaaac

SEQ ID NO: 268338 - RNA, 64 nt, Homo Sapiens
agaauaaauaauggaaagcacauaguuguauauauuuuuaaagucagaauacauauuugaacau

SEQ ID NO: 268339 - RNA, 64 nt, Homo Sapiens
cuuacucauacacuuguugguaauauuggcaacauuuuuaaaucauuuuagguacugaagaacu

SEQ ID NO: 268340 - RNA, 64 nt, Homo Sapiens
guauauuugguggucucuuuguguuguuguuguuuuuuuaaacacauacuguaaaccaugagca

SEQ ID NO: 268341 - RNA, 64 nt, Homo Sapiens
caagaaaauuuaaaaagacaaaacacaaauacauuuuuuaaaaugguuugcguuccaaccugca

SEQ ID NO: 268342 - RNA, 64 nt, Homo Sapiens
gcagaaauagaaauacaagauauguaccuauuuuuuuuuaaaaaguuauccacccaaguguaca

SEQ ID NO: 268343 - RNA, 64 nt, Homo Sapiens
aaugaaauuaaagcaacaauuggguggugguagauuuuuaaacauuucuuuuugacuggacuuu

SEQ ID NO: 268344 - RNA, 64 nt, Homo Sapiens
cucuguuugccuggagaagcccaguuaguuggaguuuuuaaaggaggcugagcaaacucauauu

SEQ ID NO: 268345 - RNA, 64 nt, Homo Sapiens
uuauuauuauuauuauuauucauuugcaucaugguuuuuaaaauuguuuuguguauuuaucugc

SEQ ID NO: 268346 - RNA, 64 nt, Homo Sapiens
uaccauauucaagggagucugagccuuuuuuuuuuuuuuaaaaauucaguagcuccagguagau

SEQ ID NO: 268347 - RNA, 64 nt, Homo Sapiens
uuuaauuauucaacuaagaagcauuuuauaagacuuuuuaaagcauaaagaacaaauagguccu

SEQ ID NO: 268348 - RNA, 64 nt, Homo Sapiens
aagagaacuucaugaugauuauuagcagcuuuuuuuuuuaaauguuaaaaaagaaaaguaguaa

SEQ ID NO: 268349 - RNA, 64 nt, Homo Sapiens
agaaaaguaguaaauuagcaguuagcuguauuuuuuuuuaaaaaauaguauauucauuuaugga

SEQ ID NO: 268350 - RNA, 64 nt, Homo Sapiens
acaaauuguugcuauuuccuuuuuugccaaacucuuuuuaaaaauggguguccaagagaaaugg

SEQ ID NO: 268351 - RNA, 64 nt, Homo Sapiens
uguguaaaggaagaaugaaguuuaauuuaugauguuuuuaaagccuauaaauaagacuccaugu

SEQ ID NO: 268352 - RNA, 64 nt, Homo Sapiens
aacaaaaucaccgaccuugcacaauaacugcagauuuuuaaacaaggccuuuuuaagaggaauc

SEQ ID NO: 268353 - RNA, 64 nt, Homo Sapiens
uuggcuuuccuaggauuuuauugucauaugcuauuuuuuaaaauacuuuuuuuaaacuuaagca

SEQ ID NO: 268354 - RNA, 64 nt, Homo Sapiens
uaagcauugucauaugcuauaagcugagaaacuuuuuuuaaacuuucuuccugguuuggagacu

SEQ ID NO: 268355 - RNA, 64 nt, Homo Sapiens
auuucaauugcuuugugacuucuucuucuuuguuuuuuuaaauauuaugcugcuuuaacagugg

SEQ ID NO: 268356 - RNA, 64 nt, Homo Sapiens
ccuuuccuaucuuuacaucuauguguauguugacuuuuuaaaauucugagugauccaggguaug

SEQ ID NO: 268357 - RNA, 64 nt, Homo Sapiens
gccuucaguguacuguuucuuauuaacuuuacuuuuuuuaaaucaacuugcuauagacuuuaua

SEQ ID NO: 268358 - RNA, 64 nt, Homo Sapiens
gcauaaaccuuccacucuugaacaaagcagcugcuuuuuaaaagcgguaauugcuucuuuaccu

SEQ ID NO: 268359 - RNA, 64 nt, Homo Sapiens
auaaagucuuuugugaacaaggcauuuguagccauuuuuaaaaguuuuugucuucagugcuggu

SEQ ID NO: 268360 - RNA, 64 nt, Homo Sapiens
cauucucuauggcuauauaauguacguaaaucuauuuuuaaagguucagaggaauccauaccaa

SEQ ID NO: 268361 - RNA, 64 nt, Homo Sapiens
agagggaacuuuagcuuuauccauaacauuaauuuuuuuaaaaaauaaggucuuaauguuucau

SEQ ID NO: 268362 - RNA, 64 nt, Homo Sapiens
gugugaucuaccacaccugucuaaaaaguauguauuuuuaaauuuuuuuguagagacaggaucu

SEQ ID NO: 268363 - RNA, 64 nt, Homo Sapiens
uaucaagucauauugcuauguuaauugguuuuuuuuuuuaaaagguaaguuagugauuacuguu

SEQ ID NO: 268364 - RNA, 64 nt, Homo Sapiens
ugcccuucacagugaaaaaaagaaaaaucuuucauuuuuaaaauuaggagauguuacguaacuu

SEQ ID NO: 268365 - RNA, 64 nt, Homo Sapiens
caaacuucagaagaaagcugacauuuuaaugaauuuuuuaaaaaauuaauaaacaaauugucua

SEQ ID NO: 268366 - RNA, 64 nt, Homo Sapiens
ugaauuuuuucauaauguaaugccguauuuauuguuuuuaaaaugaaaggaauacuaauaaguc

SEQ ID NO: 268367 - RNA, 64 nt, Homo Sapiens
ggaggggagaacccagcgcaccccucccccccuuuuuuuaaacgcgugaugaagacagaaggcu

SEQ ID NO: 268368 - RNA, 64 nt, Homo Sapiens
cuuuuaaagauuucuguauaagacuguugagcaguuuuuaaaauaguguaggauaauauaaaaa

SEQ ID NO: 268369 - RNA, 64 nt, Homo Sapiens
ugccuuuuuaaggcaguuccguuaaggguuuuuguuuuuaaacuuuuuuuugccauccauccug

SEQ ID NO: 268370 - RNA, 64 nt, Homo Sapiens
uuuuuuuuagaggcaggaucuugcuguccaauuuuuuuuaaaaagcuaaaauugccaacuuuag

SEQ ID NO: 268371 - RNA, 64 nt, Homo Sapiens
auccaaccccagcaauuuauacaacgcugucauauuuuuaaaaaaacaaaaguaagccauccuc

SEQ ID NO: 268372 - RNA, 64 nt, Homo Sapiens
uacuuauagugacucuacuguuugaaauacuauuuuuuuaaaucaaguuuuauaaaaguguaga

SEQ ID NO: 268373 - RNA, 64 nt, Homo Sapiens
uagauuguugccuauuuccugcugaaaguaaauguuuuuaaaaaguaucauauaaagcugaaua

SEQ ID NO: 268374 - RNA, 64 nt, Homo Sapiens
acuuauguggcuuuuugaccuuugaauagggaauuuuuuaaauuuuuuaaaaauuaaaauaaaa

SEQ ID NO: 268375 - RNA, 64 nt, Homo Sapiens
gcuuuuugaccuuugaauagggaauuuuuuaaauuuuuuaaaaauuaaaauaaaaaaaacacau

SEQ ID NO: 268376 - RNA, 64 nt, Homo Sapiens
cuucccauuuccuuugauguuauuuuguuacagcuuuuuaaauauuuuuuaaaauuauuuaacc

SEQ ID NO: 268377 - RNA, 64 nt, Homo Sapiens
cuuugauguuauuuuguuacagcuuuuuaaauauuuuuuaaaauuauuuaaccccugggggcag

SEQ ID NO: 268378 - RNA, 64 nt, Homo Sapiens
cuggggagaucacugccauuuuuacacacuugacuuuuuaaaaauacaaccaaccaaccaccac

SEQ ID NO: 268379 - RNA, 64 nt, Homo Sapiens
ucucugaauauuuuagucucucucugagucucauuuuuuaaaaugcucuuuuagaacgggaaac

SEQ ID NO: 268380 - RNA, 64 nt, Homo Sapiens
aagugcuuauaggcauuuuguuuauuuguuuuguuuuuuaaaaacacuguaacucaaugagacc

SEQ ID NO: 268381 - RNA, 64 nt, Homo Sapiens
cuuacuaaaaucaaacgagacggauagaagcuacuuuuuaaagaauaucccacugcaucugcaa

SEQ ID NO: 268382 - RNA, 64 nt, Homo Sapiens
ggagacgaagugaaaacaaaucuauaaauauauauuuuuaaaauauuuaacuuuuuuuuauggc

SEQ ID NO: 268383 - RNA, 64 nt, Homo Sapiens
caguucucccagggagugagcagcuacuguaacuuuuuuaaauuaagacaaaaagccuugaaga

SEQ ID NO: 268384 - RNA, 64 nt, Homo Sapiens
ccuuauuucuuaacugugcugggauugcaaacacuuuuuaaaaaauuguuugcuugaaaauacu

SEQ ID NO: 268385 - RNA, 64 nt, Homo Sapiens
gugcacaguaguuuuuuuauugaaacuuguauuauuuuuaaagagaucuauacuauaaauaugg

SEQ ID NO: 268386 - RNA, 64 nt, Homo Sapiens
gguaacaucuaaaacacaaguggguuuauuuaaauuuuuaaaauuugaaauuuuuuauuugcaa

SEQ ID NO: 268387 - RNA, 64 nt, Homo Sapiens
auuuuaaugaauuaccuacuuuauuuuguuugucuuuuuaaagaagauaagauucugggcuugg

SEQ ID NO: 268388 - RNA, 64 nt, Homo Sapiens
uacaacauacggauauaguauuuccuccucuuuguuuuuaaaaguuauaacauggcugaaaaga

SEQ ID NO: 268389 - RNA, 64 nt, Homo Sapiens
aauguuucuuucaagaaaauauauuuggauggccuuuuuaaaguaacaggauauuuaauaagag

SEQ ID NO: 268390 - RNA, 64 nt, Homo Sapiens
uucauagguucccacaauucaguaugggauaggcuuuuuaaaaagcacauacagaccaggcgug

SEQ ID NO: 268391 - RNA, 64 nt, Homo Sapiens
auguagaauaugcucuuuaauuuaguaaaauauuuuuuuaaaagguagagaugcuuuguuauug

SEQ ID NO: 268392 - RNA, 64 nt, Homo Sapiens
aacuuuaauacuaaaagcacuuuccauuauauacuuuuuaaaggucuagauaauuuugaaccaa

SEQ ID NO: 268393 - RNA, 64 nt, Homo Sapiens
uuuuggcuaauuuuuaaccugagguuuuguuuuuuuuuuaaaggaaaugcagccuagucuugag

SEQ ID NO: 268394 - RNA, 64 nt, Homo Sapiens
cauaccaacggucccuaguuauaggaauuuaauauuuuuaaaaguuuuacauugcuguauauuc

SEQ ID NO: 268395 - RNA, 64 nt, Homo Sapiens
ugugugcucuguaaguuuguuuuaaauugcacuguuuuuaaagaaacuguagaggagcaacaaa

SEQ ID NO: 268396 - RNA, 64 nt, Homo Sapiens
caaaaucaacucuguauaauagcacauucucuacuuuuuaaagaucagaaaugcuagaauucuu

SEQ ID NO: 268397 - RNA, 64 nt, Homo Sapiens
aagguagugaugguggccacgugccucguugcuauuuuuaaaguaauauucagaugugguuuua

SEQ ID NO: 268398 - RNA, 64 nt, Homo Sapiens
ugauuaaaguuuaauaguuaucaaaaucaccuaauuuuuaaaaauagcuuucguuuugaguucu

SEQ ID NO: 268399 - RNA, 64 nt, Homo Sapiens
ucaguauauacuauuaguuauauuuaaaaauauuuuuuuaaauucuuuacagauaauauuauac

SEQ ID NO: 268400 - RNA, 64 nt, Homo Sapiens
uuauaaaauagaccagaugacaaaauuuauuuuauuuuuaaacagugguuuugacacaaauuau

SEQ ID NO: 268401 - RNA, 64 nt, Homo Sapiens
ccucucuaggguaacguguauauuuugguggagauuuuuaaaagcucagcaugagcaaucauuc

SEQ ID NO: 268402 - RNA, 64 nt, Homo Sapiens
uauucucauggucuuaaauuaaauuauucaaguauuuuuaaauauccaauuuguugugauuuuc

SEQ ID NO: 268403 - RNA, 64 nt, Homo Sapiens
uauggauuggaacacaaaaaaucuuuuuuuaaucuuuuuaaaaacugcugugguuuugcugcua

SEQ ID NO: 268404 - RNA, 64 nt, Homo Sapiens
gagcuugggggacacaccuggcgagcaagcucgcuuuuuaaaaaugaaauuugggggcagggga

SEQ ID NO: 268405 - RNA, 64 nt, Homo Sapiens
aauauauacaacagaacuuuuuaagauuaaaaaauuuuuaaaccucuaugucugaaaaaaaaaa

SEQ ID NO: 268406 - RNA, 64 nt, Homo Sapiens
acuguuucuaaaguaaguguguauaaaagucuccuuuuuaaaaagaucauauuuuuaaauaaag

SEQ ID NO: 268407 - RNA, 64 nt, Homo Sapiens
uguguauaaaagucuccuuuuuaaaaagaucauauuuuuaaauaaagcauuuuuuguagaaagu

SEQ ID NO: 268408 - RNA, 64 nt, Homo Sapiens
uauggauaauggaauauguguuuguacauuccuguuuuuaaaagggcucagguuucacaugguc

SEQ ID NO: 268409 - RNA, 64 nt, Homo Sapiens
auaacccacaggaaauucuuggaaacaucaauacuuuuuaaagagugucaagggguaugaagac

SEQ ID NO: 268410 - RNA, 64 nt, Homo Sapiens
cuuauucuuagggcuuuuguguaugucugacuuguuuuuaaauaacuuccucagcaaugcagac

SEQ ID NO: 268411 - RNA, 64 nt, Homo Sapiens
cuuccucagcaaugcagaccuuaauuuuuauauuuuuuuaaaguagcuaacauagcaguaggca

SEQ ID NO: 268412 - RNA, 64 nt, Homo Sapiens
acagcacuuaaagggaauauaugagguuuuuuuuuuuuuaaaaaaaaacuuuuauuuauuauuu

SEQ ID NO: 268413 - RNA, 64 nt, Homo Sapiens
ucuuaaaagggacucaguauauuaauuucugcauuuuuuaaaucaaaugaaaaacgucaaauug

SEQ ID NO: 268414 - RNA, 64 nt, Homo Sapiens
ugaagucuucuuggauuucacccaacuaaaaggauuuuuaaaaauaaauaacagucuuaccuaa

SEQ ID NO: 268415 - RNA, 64 nt, Homo Sapiens
auuguagccaguuguuaauaucuuaaugcagauuuuuuuaaaaaaaacauaaaaugauuuaucu

SEQ ID NO: 268416 - RNA, 64 nt, Homo Sapiens
uucacuuuucucgaucacuaaacauaugcauauauuuuuaaaaaucaguaaaagcauuacucua

SEQ ID NO: 268417 - RNA, 64 nt, Homo Sapiens
auauaauauacccuuacauuauguaugagggauuuuuuuaaauuauauugaaaugcugcccuag

SEQ ID NO: 268418 - RNA, 64 nt, Homo Sapiens
guauacacugcuugcauaaacucaaccagcugccuuuuuaaagggagcucuaguccuuuuugug

SEQ ID NO: 268419 - RNA, 64 nt, Homo Sapiens
gcuuuuaaguagcauuagcuaugcacacuugacauuuuuaaauaucccuuuccuaguguaccag

SEQ ID NO: 268420 - RNA, 64 nt, Homo Sapiens
gaauaaggacuaguuauuuuuuuagugcugcauuuuuuuaaaguuggauugcugcuauuuaaaa

SEQ ID NO: 268421 - RNA, 64 nt, Homo Sapiens
uuuuaauugucuaugcuuaaucaucuuuaaacacuuuuuaaauuucuaaccacaagaccucucu

SEQ ID NO: 268422 - RNA, 64 nt, Homo Sapiens
acaaagcauuuagauuauuccagguuauaucauuuuuuuaaagauuuuccacagcuacuugagu

SEQ ID NO: 268423 - RNA, 64 nt, Homo Sapiens
acaucccuaauaucacagggcuugugcauucagauuuuuaaaaaauuaggauagauaaggaaac

SEQ ID NO: 268424 - RNA, 64 nt, Homo Sapiens
gacagagugagacucugucucaauuaauuuuuuuuuuuuaaaggaggaggaucuccauggguaa

SEQ ID NO: 268425 - RNA, 64 nt, Homo Sapiens
aauuaaaaugauuuuauuuuggucugauggauguuuuuuaaaaggaaaauuauuauuaugaacc

SEQ ID NO: 268426 - RNA, 64 nt, Homo Sapiens
gccaaugagguccaagaaguucucacccauugaauuuuuaaauggcuguucaguucauguugua

SEQ ID NO: 268427 - RNA, 64 nt, Homo Sapiens
auaacugaaaaagacauuaccauagugcuuuacauuuuuaaaguaauguuacaaggucuggaau

SEQ ID NO: 268428 - RNA, 64 nt, Homo Sapiens
uuuuaucucacagguuuguguaauuguuggaaaauuuuuaaacuucuaagugaaaguagucuga

SEQ ID NO: 268429 - RNA, 64 nt, Homo Sapiens
agaggcuugugucuguugcacauuucuugaagcauuuuuaaaauaacauguaaccuguaaccuu

SEQ ID NO: 268430 - RNA, 64 nt, Homo Sapiens
uauuguacaguuuaaaauguuagauguuuuuaauuuuuuaaauaaauggaauacuuuuuuuuuu

SEQ ID NO: 268431 - RNA, 64 nt, Homo Sapiens
uaauuuuuuaaauaaauggaauacuuuuuuuuuuuuuuuaaagaaagcaacuuuacugagacaa

SEQ ID NO: 268432 - RNA, 64 nt, Homo Sapiens
ucuucaaugacauagaaaguucauggaacucauguuuuuaaagggcuauguaaauauaugaaca

SEQ ID NO: 268433 - RNA, 64 nt, Homo Sapiens
augcaaaauaaugucuuaagauucaaagucuguauuuuuaaagcauggcuuuggcuuugcaaaa

SEQ ID NO: 268434 - RNA, 64 nt, Homo Sapiens
guacccuugccucccccacccccuucuuuuuuuuuuuuuaaacaaaucaguuuguuuugguacc

SEQ ID NO: 268435 - RNA, 64 nt, Homo Sapiens
aguuuuuauauuucuaccagaaaaguaaaaaucuuuuuuaaaaguguuguuuuucuaauuuaua

SEQ ID NO: 268436 - RNA, 64 nt, Homo Sapiens
cuaaaauuaauguccucauuuuuuuaaaucucuuuuuuuaaauguucaaguuuuucuaugguua

SEQ ID NO: 268437 - RNA, 64 nt, Homo Sapiens
ucuuuuuuuaaaugcuaaaauuuuucuaugguuauuuuuaaaucggcuugucaggguuuucaag

SEQ ID NO: 268438 - RNA, 64 nt, Homo Sapiens
guaaauauuuggaugaaguuauuuuuuaaaugucuuuuuaaaaugcacacuuaauaaguagccu

SEQ ID NO: 268439 - RNA, 64 nt, Homo Sapiens
ucuuuuuaaaauguaaauauaauaaguagccuauuuuuuaaaugugguuuguucaagcacacuu

SEQ ID NO: 268440 - RNA, 64 nt, Homo Sapiens
aguuaacuaauuuuuucuuaaagugaguuggauauuuuuaaagcuuacuccuaaucaaugaaga

SEQ ID NO: 268441 - RNA, 64 nt, Homo Sapiens
gaaguugccuugguccacacuaauagaagcauccuuuuuaaagaagagagaauuuuucucuccu

SEQ ID NO: 268442 - RNA, 64 nt, Homo Sapiens
auuaaaaucuaugugugugcacaaauuugguuuuuuuuuaaaccgcauucauuuuucuaaagua

SEQ ID NO: 268443 - RNA, 64 nt, Homo Sapiens
aacaaaauggaauguuaacuauaauucccccaauuuuuuaaacuacuguaaagcauaucuauua

SEQ ID NO: 268444 - RNA, 64 nt, Homo Sapiens
aguuuuuagguccugacacuucuccugccuuauuuuuuuaaauagaugaagucacuucaucuuc

SEQ ID NO: 268445 - RNA, 64 nt, Homo Sapiens
auuaaauuuuuagaucucugguauguagaggcuauuuuuaaaucguauuacucuuugccgucuu

SEQ ID NO: 268446 - RNA, 64 nt, Homo Sapiens
caaauguucaaucuguauuaggagacauuucacauuuuuaaaacuugauugaucuacgcuaagu

SEQ ID NO: 268447 - RNA, 64 nt, Homo Sapiens
aguaacagcaggccuuuugcuuuccuguuuuccauuuuuaaacucagccgucuuuuguucuuuc

SEQ ID NO: 268448 - RNA, 64 nt, Homo Sapiens
uuucuguucagagaacuugcauuuagugcuguauuuuuuaaacguucuugcagucauacugcuu

SEQ ID NO: 268449 - RNA, 64 nt, Homo Sapiens
uucuuacuuggauggcugcauaaguagggagaaauuuuuaaauaugcuuuaaaaaaaaguuuua

SEQ ID NO: 268450 - RNA, 64 nt, Homo Sapiens
uuucauucccagagauccgaaggguauuucauaguuuuuaaaccuguuugguacaaacccagaa

SEQ ID NO: 268451 - RNA, 64 nt, Homo Sapiens
auuacuuuauuauuguuguuugugagcaagauuuuuuuuaaacauccauaaagacauuuauaua

SEQ ID NO: 268452 - RNA, 64 nt, Homo Sapiens
gcaacugccacaugcgggauacugauauauauuuuuuuuaaagaccccuauggggccugacugc

SEQ ID NO: 268453 - RNA, 64 nt, Homo Sapiens
cacauagguagguaucuuuauuugugcagaucacuuuuuaaacuuauaaaguuuuuuuauuucu

SEQ ID NO: 268454 - RNA, 64 nt, Homo Sapiens
acaauugguuguauauaaagauguuauuuuuguauuuuuaaaaacagcaugacaaaagugacag

SEQ ID NO: 268455 - RNA, 64 nt, Homo Sapiens
cuaacaaaaaauaaaaacuuauuuuuaaaugcauuuuuuaaaugcuucuuuuuuggauauaaag

SEQ ID NO: 268456 - RNA, 64 nt, Homo Sapiens
cauuuuuuaaaugcuaacaauuuggauauaaagauuuuuaaaugauccaugguuguacuucuuu

SEQ ID NO: 268457 - RNA, 64 nt, Homo Sapiens
auucagaaauccaauaaaggugcuuuacuuuuacuuuuuaaaaauaucugaacuacuuaaugau

SEQ ID NO: 268458 - RNA, 64 nt, Homo Sapiens
ccuucagugucaguugugcucaccggagaacaacuuuuuaaaugucucguuguaagagaauuca

SEQ ID NO: 268459 - RNA, 64 nt, Homo Sapiens
acuacuauuugaaaauuggagacaugucuuuaauuuuuuaaaaaugccaucuuccccugugagu

SEQ ID NO: 268460 - RNA, 64 nt, Homo Sapiens
aagaaaaagaaacccugggaguugaacuuuuuuuuuuuuaaagaauuauugacugggcuuuggg

SEQ ID NO: 268461 - RNA, 64 nt, Homo Sapiens
agggauaacauauucuuuauuccccacuuuuauuuuuuuaaauauguuaauuuuuuucccucuu

SEQ ID NO: 268462 - RNA, 64 nt, Homo Sapiens
aaaauuauuuugccuacagagaaaaaaagccaucuuuuuaaacaggaaaaaguuuaaaaugggg

SEQ ID NO: 268463 - RNA, 64 nt, Homo Sapiens
aaaaaaaucauuuagaugcaaauuaaagacauuguuuuuaaaaaugccaagucagcauaugagg

SEQ ID NO: 268464 - RNA, 64 nt, Homo Sapiens
cuaaaaaacacuggcaguuauggaacaucucaccuuuuuaaaucaggaaccauuugcuuaaacc

SEQ ID NO: 268465 - RNA, 64 nt, Homo Sapiens
caaaaucuguaggguugacaaguacuaagcuuaauuuuuaaaaacaaaaaaauuuugacuuuuu

SEQ ID NO: 268466 - RNA, 64 nt, Homo Sapiens
acugaagugcuauaaauguaggauaagcuuuuguuuuuuaaauguggguaggguaggggaagga

SEQ ID NO: 268467 - RNA, 64 nt, Homo Sapiens
ucaaagugauuuugaaaaucucacauuugaugaguuuuuaaaaaguggucuuccccgccaugau

SEQ ID NO: 268468 - RNA, 64 nt, Homo Sapiens
aaaauuaacauguuuuuguuccuuugaaucaucauuuuuaaaaaauuacuucccuucaaaucug

SEQ ID NO: 268469 - RNA, 64 nt, Homo Sapiens
acacaucugacauuuuuaacugauuuuuaaauguuuuuuaaaagugagagaaaguauuugaaaa

SEQ ID NO: 268470 - RNA, 64 nt, Homo Sapiens
uuuuuuaaaagacacaucugguauuugaaaaugauuuuuaaaugagaaaucuagaugagagaaa

SEQ ID NO: 268471 - RNA, 64 nt, Homo Sapiens
aagaugcaagugucaguuguaucaagaccacuuguuuuuaaauagauuagccaacaucuuugcu

SEQ ID NO: 268472 - RNA, 64 nt, Homo Sapiens
caaauauuauuacuauuuuuacauucacaccuacuuuuuaaaaaagcagucuuuaugucucuua

SEQ ID NO: 268473 - RNA, 64 nt, Homo Sapiens
acucuucugggaaguugguucucucucucuuuuuuuuuuaaauacuugaguucuuucuccuucu

SEQ ID NO: 268474 - RNA, 64 nt, Homo Sapiens
guuuguccuaagguguuuaaauaaaaaauguugcuuuuuaaauauuaagcaagacccuucugaa

SEQ ID NO: 268475 - RNA, 64 nt, Homo Sapiens
uaucucuugccuaaaggacugauuuucaaauaauuuuuuaaaugauuuauguaggaagaaacuu

SEQ ID NO: 268476 - RNA, 64 nt, Homo Sapiens
uuaauugauuuuccuuugggacuuuguaaugaacuuuuuaaaaauuuagcauuuuauacaguca

SEQ ID NO: 268477 - RNA, 64 nt, Homo Sapiens
auugauuugaaugcaguagguuuuuuaaaguuuuuuuuuaaaauacuaagacaugucaauauuc

SEQ ID NO: 268478 - RNA, 64 nt, Homo Sapiens
uuuuuuuuaaaauauugauucaugucaauauucuuuuuuaaaguguuauucuucugaacuaaga

SEQ ID NO: 268479 - RNA, 64 nt, Homo Sapiens
cugcugaucucuguagaaucugguuguaauuaaauuuuuaaaaucucuagucagaguauaauuu

SEQ ID NO: 268480 - RNA, 64 nt, Homo Sapiens
uuagccuugauauucuccaguauuuuaaacauuuuuuuuaaaaauguuuuauuuaugaaguuuu

SEQ ID NO: 268481 - RNA, 64 nt, Homo Sapiens
aaguuuucuccugcagugcuccugaguuuuaauguuuuuaaacacaaaaauguauuuauauuca

SEQ ID NO: 268482 - RNA, 64 nt, Homo Sapiens
ccagggcuacuucugcuuuacugggagacuucuuuuuuuaaaugguccuuuauguguuguucuc

SEQ ID NO: 268483 - RNA, 64 nt, Homo Sapiens
aagaaaguuaucguagccagacacauuugaauuuuuuuuaaaaagacuguggcuugauguugau

SEQ ID NO: 268484 - RNA, 64 nt, Homo Sapiens
uuuauuuauuaaaccauauuaaggaucuggcuuguuuuuaaagcuacccuagaaggaagaggug

SEQ ID NO: 268485 - RNA, 64 nt, Homo Sapiens
gaauuuuuuuguaaagaucaaagagcucugauauuuuuuaaaaaucaagaaaaugcaaguugcc

SEQ ID NO: 268486 - RNA, 64 nt, Homo Sapiens
cauuuguguuuauucuucauuuucagacuauuccuuuuuaaaauuauuuuccuuaaauauguga

SEQ ID NO: 268487 - RNA, 64 nt, Homo Sapiens
guacauaaagaauuuaagaauuugucuuauagacuuuuuaaaauuugagcucucuaaccuccuu

SEQ ID NO: 268488 - RNA, 64 nt, Homo Sapiens
cacaccucuaaggaagaagcgaaacgugagacuauuuuuaaacagagccacuuagccugaaugg

SEQ ID NO: 268489 - RNA, 64 nt, Homo Sapiens
aauuauuguaguaauuucauuuuuccuaaauauguuuuuaaagcgcucaucuagggucaccuca

SEQ ID NO: 268490 - RNA, 64 nt, Homo Sapiens
uucagauguaauuuaacaucgauuuuuaaauacauuuuuaaaaugaaauuguaagcuuuauuug

SEQ ID NO: 268491 - RNA, 64 nt, Homo Sapiens
cauuuuuaaaauuucagaugaagcuuuauuuggauuuuuaaauaaaaggaaauaaggaaauugu

SEQ ID NO: 268492 - RNA, 64 nt, Homo Sapiens
aauauuuucuucuuaagauaauuuaaauugucauuuuuuaaaggauguagcauuaucacacugu

SEQ ID NO: 268493 - RNA, 64 nt, Homo Sapiens
uaguaagccacauuacauuuaaccucccugacaauuuuuaaaaguuuugaaaccacugauugca

SEQ ID NO: 268494 - RNA, 64 nt, Homo Sapiens
agaauuuucgauuuuucuuuggacuucagauccauuuuuaaauacaagcucuuaagaaauacaa

SEQ ID NO: 268495 - RNA, 64 nt, Homo Sapiens
aagaagaauuuuucuccaaucaguauuacugguauuuuuaaauagaauugcuuuugaagucugu

SEQ ID NO: 268496 - RNA, 64 nt, Homo Sapiens
caggguucuggauauuaaauuuucuuucauuaguuuuuuaaauuauuuugaugguaacaguuaa

SEQ ID NO: 268497 - RNA, 64 nt, Homo Sapiens
guuuuaacagaaauauagaguaaauguguaccauuuuuuaaauuuuucacaauucauuuucuac

SEQ ID NO: 268498 - RNA, 64 nt, Homo Sapiens
aucaucaaaagauuaaauuacuguaauuguaugauuuuuaaaucacuuuguagccagcaugugu

SEQ ID NO: 268499 - RNA, 64 nt, Homo Sapiens
acguguuguaccuaaggccaucauuguuuuaggguuuuuaaaaaagucacaaauauaacaaagu

SEQ ID NO: 268500 - RNA, 64 nt, Homo Sapiens
aagaaauuagcagcccucuguuuaccccuuccauuuuuuaaaauuucugauagucuccugcugu

SEQ ID NO: 268501 - RNA, 64 nt, Homo Sapiens
cuauucuuucugaacuuaucgcaaauuacaugcauuuuuaaaaaaauagcugauuauuguauau

SEQ ID NO: 268502 - RNA, 64 nt, Homo Sapiens
auguuaaaaauuuagguuuuauauagagugacuauuuuuaaagcuccauucguauuuguauuag

SEQ ID NO: 268503 - RNA, 64 nt, Homo Sapiens
ggaaaucauuuuguuuuaaaggucagugcauuguuuuuuaaacuaaauaaaaaaggaauuaugu

SEQ ID NO: 268504 - RNA, 64 nt, Homo Sapiens
augcugucuugcuuuagcuaugaaacauuauuuuuuuuuaaaaauaguaccacguguagcauuu

SEQ ID NO: 268505 - RNA, 64 nt, Homo Sapiens
uuuuauaacuuuuaaauggauguucuguuuucucuuuuuaaauaaaaaacuaagguuauuugaa

SEQ ID NO: 268506 - RNA, 64 nt, Homo Sapiens
aaaaugucacaaguuuaauaauucuuguuuauucuuuuuaaauagauaaaauaauaccauugau

SEQ ID NO: 268507 - RNA, 64 nt, Homo Sapiens
uuauauuuguaaauacaguauuauaaucuuaaaauuuuuaaauuaugauguaauucuucaauuu

SEQ ID NO: 268508 - RNA, 64 nt, Homo Sapiens
uaaguuaauugcuuuugcaguucuccaauuucuuuuuuuaaaaaaaucaugcuuaaaugguuga

SEQ ID NO: 268509 - RNA, 64 nt, Homo Sapiens
gacuugaaauuuuauuauaaaaggcuucauauucuuuuuaaaauguugcauuguaggagcaaac

SEQ ID NO: 268510 - RNA, 64 nt, Homo Sapiens
auauacuuucucuuuguccuuacuaugaaaucaguuuuuaaaaguucaaaauauguagaaacau

SEQ ID NO: 268511 - RNA, 64 nt, Homo Sapiens
accaaacuuguccuuaaagaaaaacaagacuuaguuuuuaaauguaauuaaaaacaagcaaaac

SEQ ID NO: 268512 - RNA, 64 nt, Homo Sapiens
uuuacgcgcaaaacuccgugcaccguaggaaggguuuuuaaaauaugcuccuggccuuaaacau

SEQ ID NO: 268513 - RNA, 64 nt, Homo Sapiens
aagaauuuuaaaacucguuuauuacaguuagagauuuuuaaauaguguauauuuuuuaugaaac

SEQ ID NO: 268514 - RNA, 64 nt, Homo Sapiens
aaaaaagcauuguaacuuaucagacuuuuuuuuuuuuuuaaacacacuuuuggcuuguaaagua

SEQ ID NO: 268515 - RNA, 64 nt, Homo Sapiens
uccauugucuuauguuuuuaguaaaaccuaaccuuuuuuaaagcuauuaaugaguuuuaaagau

SEQ ID NO: 268516 - RNA, 54 nt, Homo Sapiens
guauuuuucguauucuggaauugauuuuuaaaguuccaucaugcauucagauaa

SEQ ID NO: 268517 - RNA, 64 nt, Homo Sapiens
uagacuucuuauuuccacacuuuaaaauucauuguuuuuaaauuuuuguuuuauaguuaugcuu

SEQ ID NO: 268518 - RNA, 64 nt, Homo Sapiens
ucauuguuuuuaaauuuagauuuuauaguuaugcuuuuuaaaauagcacaagcauuaacuuuug

SEQ ID NO: 268519 - RNA, 64 nt, Homo Sapiens
uacauugauuauuaucuaggcacaggugaagaaauuuuuaaaaauuagauaggccuuucaguaa

SEQ ID NO: 268520 - RNA, 64 nt, Homo Sapiens
ugauucuuuucuuugcaauguccaucuuuguauuuuuuuaaauuguuuucuggaggguuuuuuu

SEQ ID NO: 268521 - RNA, 64 nt, Homo Sapiens
agagagaauuagcauuguguuaaaaaaaauaucuuuuuuaaaaacugugaacuuaaaacugcuc

SEQ ID NO: 268522 - RNA, 64 nt, Homo Sapiens
gauuugggguggaaauauuuugaauauuaauuuauuuuuaaagaugcaagauaggacuuugugc

SEQ ID NO: 268523 - RNA, 64 nt, Homo Sapiens
gaugcuauuaagagguuuaaauaaagaguuuuaauuuuuaaaagggcaugggauauaaacaguc

SEQ ID NO: 268524 - RNA, 64 nt, Homo Sapiens
cuagguguaaaaaucauguguugcagcuuuauaguuuuuaaaauauuuuagauaauucuuaaac

SEQ ID NO: 268525 - RNA, 64 nt, Homo Sapiens
acagcgugggacccuucagccacuacaacagaauuuuuuaaauugacaguugcagaauugugga

SEQ ID NO: 268526 - RNA, 64 nt, Homo Sapiens
gugcagagggagaaaugguuuuguuuuuguuuuguuuuuaaauggagcccugaggcaucagcua

SEQ ID NO: 268527 - RNA, 64 nt, Homo Sapiens
guaucugcucauguaugugauuugacaaaccaguuuuuuaaaauaaauggcuuuuuaaaaaucu

SEQ ID NO: 268528 - RNA, 64 nt, Homo Sapiens
ugauuugacaaaccaguuuuuuaaaauaaauggcuuuuuaaaaaucugggcuuauauugucaga

SEQ ID NO: 268529 - RNA, 64 nt, Homo Sapiens
aaaaaaaucugaggauagugcuuuacucuuucuguuuuuaaagggcacucuaugaauugauuua

SEQ ID NO: 268530 - RNA, 64 nt, Homo Sapiens
uuuaaaaauguuacugcuaaagauacauuauccuuuuuuaaaaagucuccauucaaauuaaauu

SEQ ID NO: 268531 - RNA, 64 nt, Homo Sapiens
uguuauaagucucuuccuuucucaaauaaaguuuuuuuuaaaagauccccuuucauacacuugg

SEQ ID NO: 268532 - RNA, 57 nt, Homo Sapiens
cuuucaggugcaacuucuaaaaaaagauuuuuaaacacuuaaugggaaacuggaauu

SEQ ID NO: 268533 - RNA, 64 nt, Homo Sapiens
aacagauacaaccuuaaucuuaaaagauuauugcuuuuuaaaguguguaguuuuaugcaugugu

SEQ ID NO: 268534 - RNA, 64 nt, Homo Sapiens
auauaacuaguuucaguuuuaucuaauaacuuacuuuuuaaaucaauauuuaucaacaaucuuu

SEQ ID NO: 268535 - RNA, 64 nt, Homo Sapiens
cgaguauuuuaaauacugaauucauaguuguuguuuuuuaaauuccaacaguaacagcugaaug

SEQ ID NO: 268536 - RNA, 64 nt, Homo Sapiens
ucuuuacugcaugcauagcacuuaauaaaauggauuuuuaaaaaauccacuaguaauaucagaa

SEQ ID NO: 268537 - RNA, 64 nt, Homo Sapiens
gacuucuacauaggaaagcuaaaauauguuaauauuuuuaaauuaaagguuuaauaucagaaug

SEQ ID NO: 268538 - RNA, 64 nt, Homo Sapiens
cagauaaucuggagguuagcauuugauaaaugauuuuuuaaaguagauaugaagauuuuguuaa

SEQ ID NO: 268539 - RNA, 64 nt, Homo Sapiens
uuuuucccccuacuuucuugcuucuguuucacauuuuuuaaaagggcaaguacaggagcaacug

SEQ ID NO: 268540 - RNA, 64 nt, Homo Sapiens
gaaaucuaauuauucaguuauucaugacaauauuuuuuuaaaaguaagaaauucugaguugucu

SEQ ID NO: 268541 - RNA, 64 nt, Homo Sapiens
aauuauuaagucaccuaucaccuuuaaacgccuuuuuuuaaaauuauaaaauauuguaaagcag

SEQ ID NO: 268542 - RNA, 64 nt, Homo Sapiens
aaaaaucaccaauuuuuuacauauaaaagauaccuuuuuaaaaaaauagguuuuaagagcucuu

SEQ ID NO: 268543 - RNA, 64 nt, Homo Sapiens
caccguguccggccguaguuuauuuuaaaauauauuuuuaaaagcuuuguaaaaauuaugucau

SEQ ID NO: 268544 - RNA, 64 nt, Homo Sapiens
cuauuuccuaaauaucauucuauacaaaagauauuuuuuaaacgguaaggauuaagacaaucac

SEQ ID NO: 268545 - RNA, 64 nt, Homo Sapiens
gugucccucaccaguuccuugcaggauuccuucguuuuuaaaugcccuugaaucuagcuuugcc

SEQ ID NO: 268546 - RNA, 64 nt, Homo Sapiens
guagauguuagaaaaccuaaauuaaugaaccauauuuuuaaaauccuauuuuucccaaacaggg

SEQ ID NO: 268547 - RNA, 64 nt, Homo Sapiens
cacagcuccaacugugcaugcucaaaaugugcacuuuuuaaaauuguuacuuuuaaugcguauc

SEQ ID NO: 268548 - RNA, 64 nt, Homo Sapiens
aauuacaugaaacaugaaacaguuuuugcaauuuuuuuuaaacugggcaucugguuucuaaaaa

SEQ ID NO: 268549 - RNA, 64 nt, Homo Sapiens
uuauuaucuuguacccucuuuuuuuuuuuuuuuuuuuuuaaagacagagucuugcucugucacc

SEQ ID NO: 268550 - RNA, 64 nt, Homo Sapiens
uacuuguguaaaagggcuucaagaauauauccaauuuuuaaauauuuuaauauaucuccuaucu

SEQ ID NO: 268551 - RNA, 64 nt, Homo Sapiens
uuuuuaugagaaguauauuauauuaaaugugaauuuuuuaaauuuugcuucuuauacuggaagg

SEQ ID NO: 268552 - RNA, 64 nt, Homo Sapiens
uuauauauauagcgaauaaaucuaguuguauaaauuuuuaaaugccgucaguagaaagcacaca

SEQ ID NO: 268553 - RNA, 64 nt, Homo Sapiens
uucuuuaguguuucugauuugcuaucaguagcuguuuuuaaagccguccaaggaaaauaauuau

SEQ ID NO: 268554 - RNA, 64 nt, Homo Sapiens
aaaauauauacguacugagguuuguaaacuguccuuuuuaaaucaaacugaaaacaaaaagcuu

SEQ ID NO: 268555 - RNA, 64 nt, Homo Sapiens
acugaaaacaaaaagcuuuaaccuuucaacagaauuuuuaaaaaggcaguuaguucuaaauuau

SEQ ID NO: 268556 - RNA, 64 nt, Homo Sapiens
ucaggguggcauuaaaauggacuccaaaaacauuuuuuuaaauguucuguaagauaaacuguau

SEQ ID NO: 268557 - RNA, 64 nt, Homo Sapiens
aaacuguauauuucauauguaccuguuaagguacuuuuuaaagcuuguacaugaaccuuuguau

SEQ ID NO: 268558 - RNA, 64 nt, Homo Sapiens
cagugcucuuucguuguauuuuucucauuuuugcuuuuuaaaauuccuuuaaaaaaugugcugu

SEQ ID NO: 268559 - RNA, 64 nt, Homo Sapiens
uugaucuugacauuuaaugucacaaaguuuuguuuuuuuaaaaagugauuuaaacuuaagaucc

SEQ ID NO: 268560 - RNA, 64 nt, Homo Sapiens
auaguaagaaaguaugguucuguauggcaauagguuuuuaaaauuauuagcuauucaucaugug

SEQ ID NO: 268561 - RNA, 64 nt, Homo Sapiens
ucugagcuauuucaucuauuuuuggcagucugaauuuuuaaaacccauuuaaauuuuuuuccuu

SEQ ID NO: 268562 - RNA, 64 nt, Homo Sapiens
guguacauaacugaaaaugugcuauacugcauacuuuuuaaauguaaagauauuuuuaucuuua

SEQ ID NO: 268563 - RNA, 64 nt, Homo Sapiens
uauuggaguccaaaacuugaauucuggguugaauuuuuuaaaaaucagguaccacuugauuuca

SEQ ID NO: 268564 - RNA, 64 nt, Homo Sapiens
augaaugugaacauguagauguuuuguguguauuuuuuuaaaugaaaacucaaaauaagacaag

SEQ ID NO: 268565 - RNA, 64 nt, Homo Sapiens
acucaaaauaagacaaguaauuuguugauaaauauuuuuaaagauaacucagcauguuuguaaa

SEQ ID NO: 268566 - RNA, 64 nt, Homo Sapiens
gguuauuuagcuagcuuaguguugaacuaaauuuuuuuuaaacaaggcaaggucuaaugcuguu

SEQ ID NO: 268567 - RNA, 64 nt, Homo Sapiens
caauaaaauauuucauuagcuugaauuguauagauuuuuaaaaauucaaugaaagcauguuguu

SEQ ID NO: 268568 - RNA, 64 nt, Homo Sapiens
uuaaaaauucaaugaaagcauguuguuuaauuucuuuuuaaaaucacuguugggcuuugaaagc

SEQ ID NO: 268569 - RNA, 64 nt, Homo Sapiens
agucagugcuucuaaaaagaauuuaagauaaugguuuuuaaaaugccuuuauaauaagcuuugu

SEQ ID NO: 268570 - RNA, 64 nt, Homo Sapiens
uaaaauugcaauuguauuagguguuaaaauaaaguuuuuaaaaaauuacuuguauuuauacuuu

SEQ ID NO: 268571 - RNA, 64 nt, Homo Sapiens
acaggacucaauaauggugggugaacauuagucauuuuuaaaagacaccucuuauagcaauaag

SEQ ID NO: 268572 - RNA, 64 nt, Homo Sapiens
uuaaauauuucaguauuauauagaaaaaaauagauuuuuaaaauucagaauggacaaagagaau

SEQ ID NO: 268573 - RNA, 64 nt, Homo Sapiens
cgacuuuggaaggaaaguuuuguuaaccuuuuuuuuuuuaaaaggaagaaagcggauuuuggaa

SEQ ID NO: 268574 - RNA, 64 nt, Homo Sapiens
uuuaaaaggaagaaagcggauuuuggaauugcauuuuuuaaagcaccacucuugauuuucuggg

SEQ ID NO: 268575 - RNA, 64 nt, Homo Sapiens
aaagaccuaugagcaaauggugcugaauacuuuuuuuuuaaagccacauuucauugucuuaguc

SEQ ID NO: 268576 - RNA, 64 nt, Homo Sapiens
agcaggauuauuaagugauuauuuaaaauucguuuuuuuaaauuagcaacuucaaguauaacaa

SEQ ID NO: 268577 - RNA, 64 nt, Homo Sapiens
uguaaacaaauggggacaaugcauccaaaaaaucuuuuuaaacagauuacacaaaaauuauuuc

SEQ ID NO: 268578 - RNA, 64 nt, Homo Sapiens
aauuuuaaacaugauguuuuagaaguguuucugauuuuuaaaccugguuuacagguauuacuuc

SEQ ID NO: 268579 - RNA, 64 nt, Homo Sapiens
guucuagauuuuacuaaguuuuauuuugucagguuuuuuaaauuuuuucagugagcguggugac

SEQ ID NO: 268580 - RNA, 64 nt, Homo Sapiens
uaugguguaauaggaauaauauuuauccaaaagauuuuuaaaaauagggcuguguuuaaaaaaa

SEQ ID NO: 268581 - RNA, 64 nt, Homo Sapiens
uuccuggaguuaauuuguuuuacaggaauuuuguuuuuuaaaaaaauaggaucauucugaacuu

SEQ ID NO: 268582 - RNA, 64 nt, Homo Sapiens
ucauuucuuaucaucacuuuuugucuuuucuuguuuuuuaaaauauacauuuuauuuuugaagg

SEQ ID NO: 268583 - RNA, 64 nt, Homo Sapiens
uaauaguuuuacguuguacauaauaguguaaaccuuuuuaaaaaggaaaguauaaaaacaaaag

SEQ ID NO: 268584 - RNA, 64 nt, Homo Sapiens
gugcaguuauaaagaaauugaugagguuuuuaccuuuuuaaaauauugguuagaaguucaaaaa

SEQ ID NO: 268585 - RNA, 64 nt, Homo Sapiens
uagaaugacuaaacagcugucuuucaggguaucauuuuuaaagguauaaggaacaaacuuuaau

SEQ ID NO: 268586 - RNA, 64 nt, Homo Sapiens
cucaggacauuaacuaauuuuauuuuauuuugcuuuuuuaaaaaggcuucaccuuauuacaugc

SEQ ID NO: 268587 - RNA, 64 nt, Homo Sapiens
aucgaucuacauacaauagauaaacacgauucaguuuuuaaaaguaauuuucuuuaguguauuu

SEQ ID NO: 268588 - RNA, 64 nt, Homo Sapiens
uauacacauaggugcugcauccccaauauuugauuuuuuaaaaaucucaguauuugauuuuuuu

SEQ ID NO: 268589 - RNA, 64 nt, Homo Sapiens
auaaauuuaaaauuuaacagagaaguccaaccguuuuuuaaaaauuuauauacuuuauaaugau

SEQ ID NO: 268590 - RNA, 64 nt, Homo Sapiens
caaggaugagcauaagugcuagauuuuguuagacuuuuuaaacuuuaaaggaacccggguucuu

SEQ ID NO: 268591 - RNA, 64 nt, Homo Sapiens
gacacuuauaaauccuaauaguuuaaaucgacuguuuuuaaaauugcauacuuauuucuacaug

SEQ ID NO: 268592 - RNA, 64 nt, Homo Sapiens
uuuucuuuuaaauuuuucucuuuuuaaacagauuuuuuuaaagcucucaucauccacaguagaa

SEQ ID NO: 268593 - RNA, 64 nt, Homo Sapiens
gauuuuuuuaaagcuuuucucauccacaguagaauuuuuaaacagacuauuucucuacucucau

SEQ ID NO: 268594 - RNA, 64 nt, Homo Sapiens
aauagauuaugaugcagaaucauaaaauuaggcuuuuuuaaaaagggcgggaaauaauugugua

SEQ ID NO: 268595 - RNA, 64 nt, Homo Sapiens
gcaugccugccccuuauuugcaaucuuaguauuuuuuuuaaacuggcaaguaaccccgccucca

SEQ ID NO: 268596 - RNA, 64 nt, Homo Sapiens
aaugguuuugcauggaaccuaaauuggauccauuuuuuuaaaaaccaucuaagaauacagaacc

SEQ ID NO: 268597 - RNA, 64 nt, Homo Sapiens
ggggggagcaaaagaaacacaguuauauauuuuguuuuuaaaagauguugcuauagugacaugc

SEQ ID NO: 268598 - RNA, 64 nt, Homo Sapiens
uuuuuuuuuuuuaauuuaauuuaagucuucaaauuuuuuaaagguauuccuaugacaaaaaaaa

SEQ ID NO: 268599 - RNA, 64 nt, Homo Sapiens
aaugcacuugccuaugauacuuuucuuuucuuuauuuuuaaagaauuuaagcagcuugaauggu

SEQ ID NO: 268600 - RNA, 64 nt, Homo Sapiens
uauuuccuccauaaauauucuuauuaaccaaauauuuuuaaaaauaagauaucuuaccuguuug

SEQ ID NO: 268601 - RNA, 64 nt, Homo Sapiens
uguuggauuaucaccagauuauuuuuauacaauguuuuuaaaaccuacaaauaauuauuuaaac

SEQ ID NO: 268602 - RNA, 64 nt, Homo Sapiens
cuauauucaguaaaagccuguguagugaaauguauuuuuaaaaaaauaauaacugaaaagacua

SEQ ID NO: 268603 - RNA, 64 nt, Homo Sapiens
aaugcauugcuuaaugguuuuaaaauuaacuaauuuuuuaaauauugacuggauaaacuuuaca

SEQ ID NO: 268604 - RNA, 64 nt, Homo Sapiens
auuuuaagcuguacacuuucauaauggaaggaauuuuuuaaaaaaguaagcagguacuacauuu

SEQ ID NO: 268605 - RNA, 64 nt, Homo Sapiens
acugauacauccauuuugauaaaucagauuuuaguuuuuaaaauuucuauaugcuuuccuuuua

SEQ ID NO: 268606 - RNA, 64 nt, Homo Sapiens
acuggaagacucauguuaaaguauauuacaguucuuuuuaaaacgccaaaauauuuugcuuuau

SEQ ID NO: 268607 - RNA, 64 nt, Homo Sapiens
gugagaucagugaacucuggaacaaacuuuuuucuuuuuaaaauucauauugauuaaaacaguu

SEQ ID NO: 268608 - RNA, 64 nt, Homo Sapiens
ggaguaauagccuaaauaagaaaacuuucacugauuuuuaaauuuauuaggagacuaaacauug

SEQ ID NO: 268609 - RNA, 64 nt, Homo Sapiens
acuuuagaaaauauaagggaguagauuaaaugaguuuuuaaagcgaccuaccucugaaaaaugu

SEQ ID NO: 268610 - RNA, 64 nt, Homo Sapiens
uagaagaucuucuaagcacauaugccauuuucuguuuuuaaaucguggcuaugagaauaugauu

SEQ ID NO: 268611 - RNA, 64 nt, Homo Sapiens
aacaguauauucuuuuuuucaccauucacuuaaauuuuuaaaaggcauuaaugcacccaugacc

SEQ ID NO: 268612 - RNA, 64 nt, Homo Sapiens
cuugauuuucucuauuguggcauaggggcuaucauuuuuaaagauauuuagguaagcauaaaaa

SEQ ID NO: 268613 - RNA, 64 nt, Homo Sapiens
ccuaucagcagccuccuaauaacauuguuuuuaauuuuuaaaauauggcucuuguuccacuauu

SEQ ID NO: 268614 - RNA, 64 nt, Homo Sapiens
ccugaugcccaacuugcacuaucaccaggggauuuuuuuaaaauuuggcugcacauucauacca

SEQ ID NO: 268615 - RNA, 64 nt, Homo Sapiens
guguucauuugucagugaauaauaucuuugacauuuuuuaaaguucaaaauuaaaguuauaucu

SEQ ID NO: 268616 - RNA, 64 nt, Homo Sapiens
gugguuuguuacuuugacuucaauguggaguuuuuuuuuaaaaauuccauaggaaaaauuuuga

SEQ ID NO: 268617 - RNA, 64 nt, Homo Sapiens
aauauuuaacauacgaauuauauaguaaagaggguuuuuaaaauaacuuauucuugaaacuaaa

SEQ ID NO: 268618 - RNA, 64 nt, Homo Sapiens
guaagugcuauuggcauuccuaucaauaaauaaauuuuuaaagaaaauauguacaaauauuaua

SEQ ID NO: 268619 - RNA, 64 nt, Homo Sapiens
aaaaaugaaauauaacaagauugcuugauuuuuuuuuuuaaacauuacuggaaaugacaaguuu

SEQ ID NO: 268620 - RNA, 64 nt, Homo Sapiens
gguagggggaggggcuggggucgggauggcuuacuuuuuaaaagugaugaaauaggcuauccac

SEQ ID NO: 268621 - RNA, 64 nt, Homo Sapiens
aaagcauuaagacauaaaauguugacuuuuuuuuuuuuuaaagaagagcauguccuaguucaau

SEQ ID NO: 268622 - RNA, 64 nt, Homo Sapiens
guagucagcaaaauggggguuucugccaauagauuuuuuaaaauuuugaagaaaauaucuuguu

SEQ ID NO: 268623 - RNA, 64 nt, Homo Sapiens
uauacuauaguaccaguagguuuuguaguagcguuuuuuaaaugaaacaaaaagaaaagaaaau

SEQ ID NO: 268624 - RNA, 64 nt, Homo Sapiens
acuuugcgccuugcuuugauucccaaaccccuuauuuuuaaaaugaauaggucagaucuuggcc

SEQ ID NO: 268625 - RNA, 64 nt, Homo Sapiens
uuacuuaguaaugcacauuccaagaagguuauauuuuuuaaaauuugcuguguuuucuucagag

SEQ ID NO: 268626 - RNA, 64 nt, Homo Sapiens
ccuucugaugauuccaaugugcuggcaguuguauuuuuuaaagcgguaugagccaccaugcccg

SEQ ID NO: 268627 - RNA, 64 nt, Homo Sapiens
auuuuuuucagagaucacuuuauguauacucaguuuuuuaaagcgauuuuuaccuuauaggcua

SEQ ID NO: 268628 - RNA, 64 nt, Homo Sapiens
uaacuuucugauggacccuggcuauggcugaucuuuuuuaaauucauaaucuacgaagaacuug

SEQ ID NO: 268629 - RNA, 64 nt, Homo Sapiens
gcuuuagagcuguguguugagcuaaaaauauaauuuuuuaaaaauugacuagcaaaaucuaugg

SEQ ID NO: 268630 - RNA, 64 nt, Homo Sapiens
caggagauacguaaaguaggccccacaaauaauauuuuuaaaauacaaaggaucaccacaaucc

SEQ ID NO: 268631 - RNA, 64 nt, Homo Sapiens
uuuaaucagaagaacauuguuguuugauuauauguuuuuaaaaaccugaagcuuuuuugguggc

SEQ ID NO: 268632 - RNA, 64 nt, Homo Sapiens
uaauagacauucaugucagaucccauaugggggauuuuuaaacauuucuuugaacuuugaggcc

SEQ ID NO: 268633 - RNA, 64 nt, Homo Sapiens
gauguugauagauaugcuuauaccuaauuuuuaguuuuuaaacuauuuuaaaauauacuaugau

SEQ ID NO: 268634 - RNA, 64 nt, Homo Sapiens
uuuguuuucuuuuaauuucuaugaauaaaagaaauuuuuaaaaacuuuaaaauuuuaaauauua

SEQ ID NO: 268635 - RNA, 64 nt, Homo Sapiens
aaucuaacuuuuuauauugucauuauuauuguuguuuuuaaacgguucuuugucuuuucuguuu

SEQ ID NO: 268636 - RNA, 64 nt, Homo Sapiens
ucccuuuacaguucugcaguuccaucacaguauuuuuuuaaauaacucagguguaugagaagaa

SEQ ID NO: 268637 - RNA, 64 nt, Homo Sapiens
ggguuuucuuuuguauuuuuuuuuguuuguuuuguuuuuaaacauucaaaagcaauuaaugauc

SEQ ID NO: 268638 - RNA, 64 nt, Homo Sapiens
cuugcccaguuuuuuuuuuuuuuuuuuuuuuuuuuuuuuaaagccuggauuguaaccagauuuu

SEQ ID NO: 268639 - RNA, 64 nt, Homo Sapiens
aaagugaauugcccagagcugccuuuuucuuuucuuuuuaaaaauuuuaagaaguuuucuuugu

SEQ ID NO: 268640 - RNA, 64 nt, Homo Sapiens
gggccggggucagggagagucuuuuuuuuuuuuuuuuuuaaauacuaaauuggaacauuuaauu

SEQ ID NO: 268641 - RNA, 64 nt, Homo Sapiens
uggggaguacuuggcaguugggauaugauccauuuuuuuaaacaaguuuuuuguagaucccuug

SEQ ID NO: 268642 - RNA, 64 nt, Homo Sapiens
ucuuuuuuuuuagauguuugauacauuuuaaguauuuuuaaauagaugaaaauucuaaaugauu

SEQ ID NO: 268643 - RNA, 64 nt, Homo Sapiens
ugauaaaaggacucuauucacuaaguagccuguguuuuuaaauccagggcugcaggcagcaacg

SEQ ID NO: 268644 - RNA, 64 nt, Homo Sapiens
gaagugauucauauucaguacuguuuuuaaucacuuuuuaaaauauaaggaccgaaugcaagga

SEQ ID NO: 268645 - RNA, 64 nt, Homo Sapiens
augaaccacuccaaaaaucagugcauuuugcauauuuuuaaacaaagacagcuuguugaauacu

SEQ ID NO: 268646 - RNA, 64 nt, Homo Sapiens
caaaaagguuugacuggccuccagauuccaguuauuuuuaaaaagcaacuuaccacuaaauccu

SEQ ID NO: 268647 - RNA, 64 nt, Homo Sapiens
aaaacacuuguacuucuggaaauggacuggagacuuuuuaaauuugaguccacuauugacaugg

SEQ ID NO: 268648 - RNA, 64 nt, Homo Sapiens
ggccauuuuccuguuaccugauccuucuacaggauuuuuaaaaaguaagagaguuucagagaag

SEQ ID NO: 268649 - RNA, 64 nt, Homo Sapiens
gagucacacugcuucaacuuuuucuuuguuguaguuuuuaaauugucgauuuuuagcuauuuga

SEQ ID NO: 268650 - RNA, 64 nt, Homo Sapiens
uuucauuuauauaauuuuauuuuguacaauguuuuuuuuaaaugugcaaauacuguauucaagu

SEQ ID NO: 268651 - RNA, 64 nt, Homo Sapiens
gcuaagcaaauauuuuuccaggcugugcugugcauuuuuaaaaggucuaauuuaauugcuuuua

SEQ ID NO: 268652 - RNA, 64 nt, Homo Sapiens
cugccuuuccgcccuaugaaaaucaagaaaaucuuuuuuaaaaauggaguccugcuauuuucca

SEQ ID NO: 268653 - RNA, 64 nt, Homo Sapiens
ugauuaaaauuuauauucuuguuuaauaagcuuauuuuuaaacaauuuaaaagcuauuauucuu

SEQ ID NO: 268654 - RNA, 64 nt, Homo Sapiens
caauuuaaaagcuauuauucuuagcauuaaccuauuuuuaaagaaaccuuuuuugcuauugacu

SEQ ID NO: 268655 - RNA, 64 nt, Homo Sapiens
uucagugaaauaggagauacauaguaguauuuuauuuuuaaaauuaauuucucauuugguuuug

SEQ ID NO: 268656 - RNA, 64 nt, Homo Sapiens
guuguaucuaaaucauauuuuaaaauuauuuuuauuuuuaaaaaauuaugguaaaaacauauaa

SEQ ID NO: 268657 - RNA, 64 nt, Homo Sapiens
gacauuuuauggauucuaaacuuguguuguuucuuuuuuaaaucaacuuuuuaaaaaaauaaag

SEQ ID NO: 268658 - RNA, 64 nt, Homo Sapiens
uucuaaacuuguguuguuucuuuuuuaaaucaacuuuuuaaaaaaauaaaguguaaauuaaccg

SEQ ID NO: 268659 - RNA, 64 nt, Homo Sapiens
aucuagaauacauagcagcucugcaaaggaacaguuuuuaaaaaugggaacuucuacauugaaa

SEQ ID NO: 268660 - RNA, 64 nt, Homo Sapiens
ugauaauaugauucaguagucaacuugagggaaauuuuuaaaaaacuauucucaauuauauacg

SEQ ID NO: 268661 - RNA, 64 nt, Homo Sapiens
aauauaacggguauauuuguuauucuaacucuauuuuuuaaaguuaauaauauaaaguggccau

SEQ ID NO: 268662 - RNA, 64 nt, Homo Sapiens
ucacauccaauuauuugaacacaugcaaaauaauuuuuuaaauuauguuauuguuuaaauuuga

SEQ ID NO: 268663 - RNA, 64 nt, Homo Sapiens
ucagaaaucucaguuuaauauaaaaugagcuaaguuuuuaaaaauaaauuauaaacuuggagau

SEQ ID NO: 268664 - RNA, 64 nt, Homo Sapiens
aaugaaaaaugugaacuucuuacucauagugugguuuuuaaauauaugcaguugagugaugauu

SEQ ID NO: 268665 - RNA, 64 nt, Homo Sapiens
uuggaaaaacuggucgaguaauuaucaauaauuuuuuuuaaaaagaggaucccaaacuguaaaa

SEQ ID NO: 268666 - RNA, 64 nt, Homo Sapiens
aacuguaaaagauugaaauaaucuuucucaggauuuuuuaaaugucuaagauuaugaugucaua

SEQ ID NO: 268667 - RNA, 64 nt, Homo Sapiens
ugauguacauuacugugaauuuuuauaccacucauuuuuaaaagggcugucuuuucauuuuagu

SEQ ID NO: 268668 - RNA, 64 nt, Homo Sapiens
auacuguggugguguacacaggauagaacacccuuuuuuaaaacacagucuuuccccuugcuca

SEQ ID NO: 268669 - RNA, 64 nt, Homo Sapiens
cuagguuauaggaaagaucuguuuauguaguuuguuuuuaaaaugugccaaugccuguacauua

SEQ ID NO: 268670 - RNA, 64 nt, Homo Sapiens
uuuaaaaugugccaaugccuguacauuaacaagauuuuuaaaaauaaaauuguauaaaacauuc

SEQ ID NO: 268671 - RNA, 64 nt, Homo Sapiens
aggaccacaggcaugcacaagcaugccuggcuaauuuuuaaauuuuuuuuuuuuaagaaauagg

SEQ ID NO: 268672 - RNA, 64 nt, Homo Sapiens
caaguaaaauacauugucuuuugaaaauaguuucuuuuuaaaggaauacuaauuaauuguaacu

SEQ ID NO: 268673 - RNA, 64 nt, Homo Sapiens
uaauuguaacuuguaaaaccaaaaguucuaaugguuuuuaaaaaccaguguugaguggaaaagu

SEQ ID NO: 268674 - RNA, 64 nt, Homo Sapiens
gguuuaaauguguuaaaaugguuauauugccuccuuuuuaaacaaauuaaagaguuguaaauac

SEQ ID NO: 268675 - RNA, 64 nt, Homo Sapiens
guacugaaugagcaggaaaaggcacauacucaguuuuuuaaauguacaaucaacaaguaaaaau

SEQ ID NO: 268676 - RNA, 64 nt, Homo Sapiens
uuuucuccuuuuuuuaagaaccauuuucaucugauuuuuaaacucacgauaccaguuaucuguu

SEQ ID NO: 268677 - RNA, 64 nt, Homo Sapiens
cagauuuuucuggaagaaacccuuuuuuuuuuuuuuuuuaaacaguaacauccagagugacaaa

SEQ ID NO: 268678 - RNA, 64 nt, Homo Sapiens
uaacuagaacugucaaauaacaaaacggcucauguuuuuaaaauauauguaacucauuuuaaaa

SEQ ID NO: 268679 - RNA, 64 nt, Homo Sapiens
caauucucaaaugauauacauuuaaagggcagauuuuuuaaaaagauacuacuauaauaaacau

SEQ ID NO: 268680 - RNA, 64 nt, Homo Sapiens
guaaacuuucaugguauuuagccuuucuuaaauuuuuuuaaaauuuaaacuuucuaaccuaugu

SEQ ID NO: 268681 - RNA, 64 nt, Homo Sapiens
aacauguacagaguuuuauauaaauuuaaaccaauuuuuaaaacaaaacugcggacaccaccau

SEQ ID NO: 268682 - RNA, 64 nt, Homo Sapiens
uuguuuaacuaaacugucaugguuuaguuuacaauuuuuaaaaaguucuuaaaauacugaaaau

SEQ ID NO: 268683 - RNA, 64 nt, Homo Sapiens
agggcugcauuuugccaccauaaagggcugcauuuuuuuaaaaagccuaggcagcucuaacauc

SEQ ID NO: 268684 - RNA, 64 nt, Homo Sapiens
accaccacagguaugcaccaccauaccuggcugauuuuuaaaauuuuuucuagagaugaggucu

SEQ ID NO: 268685 - RNA, 64 nt, Homo Sapiens
auucucccacaguggucuguaucucaacauuuucuuuuuaaaggaaaaaauauauauauauagu

SEQ ID NO: 268686 - RNA, 64 nt, Homo Sapiens
ggccuacaggugcgugcuaccacgccuggccaauuuuuuaaauuuuagcacagaugaggucuca

SEQ ID NO: 268687 - RNA, 64 nt, Homo Sapiens
auauguuuacagaccaaagugugauuucacacuguuuuuaaaucuagcauuauucauuuugcuu

SEQ ID NO: 268688 - RNA, 64 nt, Homo Sapiens
guuguggucuuuuguuuuuucucuuaguauagcauuuuuaaaaaaauauaaaagcuaccaaucu

SEQ ID NO: 268689 - RNA, 64 nt, Homo Sapiens
auuuugguuaaucuucaugaauugaauaauuguuuuuuuaaagcaaaauaaaguuuuuuaaaua

SEQ ID NO: 268690 - RNA, 64 nt, Homo Sapiens
auugaauaauuguuuuuuuaaagcaaaauaaaguuuuuuaaauaaauguuaauauuugauuaau

SEQ ID NO: 268691 - RNA, 64 nt, Homo Sapiens
uuuuuuucuuuaacagauuuguauuuaagaauuguuuuuaaaaaauuuuaagauuuacacaaug

SEQ ID NO: 268692 - RNA, 64 nt, Homo Sapiens
aaacccuaauuuuuuuuauuuaaguacauuuugcuuuuuaaaguugauuuuuuucuauuguuuu

SEQ ID NO: 268693 - RNA, 64 nt, Homo Sapiens
acuggaaaagcuucauuucugaagaugaauuuuauuuuuaaaaaauacaugcacacucaaaacu

SEQ ID NO: 268694 - RNA, 64 nt, Homo Sapiens
ugguuaacaugaaauguuaccuuuuaacagacuguuuuuaaaaauuaaaaauguauguauaggu

SEQ ID NO: 268695 - RNA, 64 nt, Homo Sapiens
aaaaauuaaaaauguauguauagguuuugaaauuuuuuuaaaaggggagaaagacuguuaagag

SEQ ID NO: 268696 - RNA, 64 nt, Homo Sapiens
uggcuccucucauuucauuaucuuuuuuuuuuuuuuuuuaaagacagauucucacucaguugcc

SEQ ID NO: 268697 - RNA, 64 nt, Homo Sapiens
gcgugagccaccaugccuggccuucauuaucucuuuuuuaaaaaugaaaaaguuuauaauuuac

SEQ ID NO: 268698 - RNA, 64 nt, Homo Sapiens
uuuuguaaauaaaggcuucagaggguauuauuuguuuuuaaagcaaaacauuauuugcaaaaca

SEQ ID NO: 268699 - RNA, 64 nt, Homo Sapiens
aaacauuauuugcaaaacaguaacugggugguccuuuuuaaacauucaugauauuacagugcug

SEQ ID NO: 268700 - RNA, 64 nt, Homo Sapiens
uuguagccauucuuaugauguuacccuuuuuuuuuuuuuaaauuuauuuuuauuccaucaccau

SEQ ID NO: 268701 - RNA, 64 nt, Homo Sapiens
uaaauacaguuaacauagagccauuucaaacuauuuuuuaaaaacugaaaauugcauuuuauua

SEQ ID NO: 268702 - RNA, 64 nt, Homo Sapiens
aagcaguucuacucgaucacaguaacugaauuauuuuuuaaauuuccaccccaggccaggugga

SEQ ID NO: 268703 - RNA, 64 nt, Homo Sapiens
ccgaaauauugaaaugguguuaaugaaaacagcauuuuuaaaaauaaugccaauauaauauagu

SEQ ID NO: 268704 - RNA, 64 nt, Homo Sapiens
cacuuuaugcguuuuccacuuuacagaaugucuguuuuuaaaguaaggaacaaaggucuggagu

SEQ ID NO: 268705 - RNA, 64 nt, Homo Sapiens
uagcaacucuuauuucuuuccuaaaagacaugcauuuuuaaaacgggggcagauucugaauugg

SEQ ID NO: 268706 - RNA, 64 nt, Homo Sapiens
aguuugggggcagauucugauuaucugucuugacuuuuuaaaaauuuuccgucuccccaaagcu

SEQ ID NO: 268707 - RNA, 64 nt, Homo Sapiens
ugugaaauguaauguuuuuauacuguuaaaaaauuuuuuaaaaaugucuuccaaguauuauuuu

SEQ ID NO: 268708 - RNA, 64 nt, Homo Sapiens
acugucgccaaauagcugagccagagaaagagguuuuuuaaaagaaauggcuucuucuuaaagc

SEQ ID NO: 268709 - RNA, 64 nt, Homo Sapiens
aaagaaacaaaaauauuuuuugcgaacauuuuauuuuuuaaaaaaaagcaauuuucucccauug

SEQ ID NO: 268710 - RNA, 64 nt, Homo Sapiens
aaaaagaaaagaaaaagacauagguuugaauugcuuuuuaaaaaggaggaagaaagggaagaau

SEQ ID NO: 268711 - RNA, 64 nt, Homo Sapiens
aaaucuucgaaggugugguuuaaaggaauuucauuuuuuaaaaguuuguugucguuguuguagu

SEQ ID NO: 268712 - RNA, 64 nt, Homo Sapiens
auguucuaaaccuauuuucauuugcuguuuuauuuuuuuaaauugucauauauuuuuugcuacu

SEQ ID NO: 268713 - RNA, 64 nt, Homo Sapiens
ggucauauauuuuuugcuacaaaaaaggaaaauguuuuuaaaaaauauuaaaaacaaaaaagaa

SEQ ID NO: 268714 - RNA, 64 nt, Homo Sapiens
ggucguuaccagagauuuacuauauuuacaugucuuuuuaaaagaaaguguauaaaucugagua

SEQ ID NO: 268715 - RNA, 64 nt, Homo Sapiens
auccuguguaacacuuggcuccaaaaacauuuuauuuuuaaaauuagcaugggaggugaggauu

SEQ ID NO: 268716 - RNA, 64 nt, Homo Sapiens
aacaaugacaaacacccacuuuuuccuuuucacauuuuuaaaaguaggauucuaaucucauguu

SEQ ID NO: 268717 - RNA, 64 nt, Homo Sapiens
auucccacucagcacucagaaauuuuuuucuucuuuuuuaaaauucuugaaucaaguguaauau

SEQ ID NO: 268718 - RNA, 64 nt, Homo Sapiens
uuauauacaucucaaggguuucccaauguugucauuuuuaaauguuccccucacuguuugcagc

SEQ ID NO: 268719 - RNA, 64 nt, Homo Sapiens
acaauuuucaaguuuuuuuuaaaucaauguuucuuuuuuaaaaaaaacaaccugaagacuugug

SEQ ID NO: 268720 - RNA, 64 nt, Homo Sapiens
guauaguugaugagucaaugcccuuccaagugccuuuuuaaauucaaaugcaauaauacaauac

SEQ ID NO: 268721 - RNA, 64 nt, Homo Sapiens
ggaggaaaaaaauaacaagaugcuuuaaaguauauuuuuaaaagcuuuuuuugauuaccuguag

SEQ ID NO: 268722 - RNA, 64 nt, Homo Sapiens
uguauaucuaauaguacaaaauaaguuaaauauuuuuuuaaauauauuuaauuucuucauaaaa

SEQ ID NO: 268723 - RNA, 64 nt, Homo Sapiens
cccuuugauguuucaaaaaaaaauuguuucaguuuuuuuaaauggccucaguagauacuaaagc

SEQ ID NO: 268724 - RNA, 64 nt, Homo Sapiens
uccguguuaagaauuggcccuacagaaagcagcauuuuuaaaugugcauaucauuuuguuguaa

SEQ ID NO: 268725 - RNA, 64 nt, Homo Sapiens
aacuuggguuagacuuuguuuccugcaaaucaaauuuuuaaagccuaggccaagcaacuaguuu

SEQ ID NO: 268726 - RNA, 64 nt, Homo Sapiens
auagagcuuggucaaccucuuauaggccaauauuuuuuuaaaaacuagugagcaauacacauau

SEQ ID NO: 268727 - RNA, 64 nt, Homo Sapiens
ccauauacugacugaaacauuuggacaguagcgguuuuuaaaaauagugauauauuguguuaau

SEQ ID NO: 268728 - RNA, 64 nt, Homo Sapiens
uucaauuguccuggcugauuuuaccaaguucaguuuuuuaaaacacuuucauuuuaaaauccua

SEQ ID NO: 268729 - RNA, 64 nt, Homo Sapiens
ugacuguaguggucacuaaaauucagcuaauuuguuuuuaaaauacacuucagaguaagaggga

SEQ ID NO: 268730 - RNA, 64 nt, Homo Sapiens
gaaaucacaaauagcaagugaaauagaaaaccuauuuuuaaauaaaaaauuggugacagagcac

SEQ ID NO: 268731 - RNA, 64 nt, Homo Sapiens
uuucaaacugcuccuagcuuaauaaggaaguacauuuuuaaauugcauuaaaauuauauauguu

SEQ ID NO: 268732 - RNA, 64 nt, Homo Sapiens
aacugacugauaguucuauaauauuuuuacuucauuuuuaaaacgguuaaauuggcaaacauuc

SEQ ID NO: 268733 - RNA, 64 nt, Homo Sapiens
gcuugauguagcagucauagaaacuacuaaagacuuuuuaaaugucauaauggguguuuauaug

SEQ ID NO: 268734 - RNA, 64 nt, Homo Sapiens
uuuaagguauugccuacuuuuaucaauuacuuaguuuuuaaauuugauguuaccugcuugugag

SEQ ID NO: 268735 - RNA, 64 nt, Homo Sapiens
ucauccuuugucuuuccauaggguuucuuuuaaguuuuuaaauacacaaagaaguuuuagaaua

SEQ ID NO: 268736 - RNA, 64 nt, Homo Sapiens
uuuauauuguacacuauuuuaaaacagcaggaaauuuuuaaacuuccuaaauuuucucccuauc

SEQ ID NO: 268737 - RNA, 64 nt, Homo Sapiens
auaauauaagcuacagaaaccuauuuucauuccuuuuuuaaaaaucucucauuccccauacucc

SEQ ID NO: 268738 - RNA, 64 nt, Homo Sapiens
auuaaacuaaagauguuuuaggaaagaaaagaauuuuuuaaaaaagauuaagauuuuaucuggg

SEQ ID NO: 268739 - RNA, 64 nt, Homo Sapiens
ucaaauaauugaagagacaaucacccaccagacuuuuuuaaacacagcuuuauugagguauaau

SEQ ID NO: 268740 - RNA, 64 nt, Homo Sapiens
gauaaaaaaacagcuuuauuuuaugaacagacuuuuuuuaaaaaaucuguacaucucuacuuau

SEQ ID NO: 268741 - RNA, 64 nt, Homo Sapiens
gcuuaugcuuacauaauauagcauugcuaaggccuuuuuaaaaaagucugcuucccucauuauu

SEQ ID NO: 268742 - RNA, 64 nt, Homo Sapiens
uguuuuuauuucuaagcucucagaaugucuuaauuuuuuaaauuaguagcuguaauuuugcuac

SEQ ID NO: 268743 - RNA, 64 nt, Homo Sapiens
aagaauucagugucacuaguguguuacaaaaauuuuuuuaaauaaagagaagaggagguacugu

SEQ ID NO: 268744 - RNA, 64 nt, Homo Sapiens
ccuauuguuuuucagaauuguaaucaagucuuauuuuuuaaaaguacauauuacuuguuucugg

SEQ ID NO: 268745 - RNA, 64 nt, Homo Sapiens
uacauuuuaugguucucuuaguuuuuaagagaauuuuuuaaaaaagagagaaggauuguuuuca

SEQ ID NO: 268746 - RNA, 64 nt, Homo Sapiens
gugauuaauguauuuuauaacuacaacuaaguucuuuuuaaaaauaccaugugaguuaaugaua

SEQ ID NO: 268747 - RNA, 64 nt, Homo Sapiens
aaagcucaaauuguugguauaugauuuauaagcuuuuuuaaaacucccauuuauaaauauaugu

SEQ ID NO: 268748 - RNA, 64 nt, Homo Sapiens
aauaauaauaaaauauuuaacugggaaagcugguuuuuuaaaaaaaacccuauagcuccuuacg

SEQ ID NO: 268749 - RNA, 64 nt, Homo Sapiens
cugcugaagcagccccauccuuaauaauaauucuuuuuuaaaaugccauguuggagagcaaaac

SEQ ID NO: 268750 - RNA, 64 nt, Homo Sapiens
cuaguuguuaaauuuuguucucauguauuagcaguuuuuaaaaauuaauguuuuuuucaucaug

SEQ ID NO: 268751 - RNA, 64 nt, Homo Sapiens
cuaaagguuuguugguuuacuucagauaauuuuuuuuuuaaagaaaaaaggaaaaagguacacu

SEQ ID NO: 268752 - RNA, 64 nt, Homo Sapiens
guacuuggagcuccugauucuuuaaagacucaccuuuuuaaauguguuuaaaacacugaugguu

SEQ ID NO: 268753 - RNA, 64 nt, Homo Sapiens
cucaccuuuuuaaaugguacuaaaacacugaugguuuuuaaagacuuuuuucuaaucaaguguu

SEQ ID NO: 268754 - RNA, 64 nt, Homo Sapiens
aguccaaaagcagcuaugggugcggauguaauuuuuuuuaaaaaagcauucaauaagaacuagc

SEQ ID NO: 268755 - RNA, 64 nt, Homo Sapiens
auagaaguuuuaaacaguccaggaaagguggaucuuuuuaaauauauuuuccauaggcaauggg

SEQ ID NO: 268756 - RNA, 64 nt, Homo Sapiens
cuucucagccuuccuagggagaaaugaaggucuuuuuuuaaaagccagcugcaagggaguuagg

SEQ ID NO: 268757 - RNA, 64 nt, Homo Sapiens
auuuccuacacaaaugauaguauucaaauuccuauuuuuaaauauuccagggauuuuugagucc

SEQ ID NO: 268758 - RNA, 64 nt, Homo Sapiens
uguuuuguuuauuaaauagugcaucuuuuuuucauuuuuaaauguguuuucaggcuuugucauu

SEQ ID NO: 268759 - RNA, 64 nt, Homo Sapiens
aauauuuguuucaguauuuuuucuguauaguuuguuuuuaaacuuauuguuacgguaugaaguc

SEQ ID NO: 268760 - RNA, 64 nt, Homo Sapiens
aguuuauuugccuugccauagugaaauuuaauguuuuuuaaacuaacuugaauuucuacaaaug

SEQ ID NO: 268761 - RNA, 64 nt, Homo Sapiens
gucuaccucauauaauacaacuaauggagaguuuuuuuuaaacuuuacaaaauuuuaagucugu

SEQ ID NO: 268762 - RNA, 64 nt, Homo Sapiens
uuauauucgaguuguacaaauauaauuucuaauauuuuuaaagucguuauaugcacucaaaugu

SEQ ID NO: 268763 - RNA, 64 nt, Homo Sapiens
uuaguaaugagaaacugugaucaguuaggcaauguuuuuaaaacauugguucagauuguaauua

SEQ ID NO: 268764 - RNA, 64 nt, Homo Sapiens
ugcuuugagcauauguauauucacaacuuaaaaguuuuuaaaaguugcagaaguucugguuaaa

SEQ ID NO: 268765 - RNA, 64 nt, Homo Sapiens
aauauaauagaaagaacacuuaacucgguuuaaauuuuuaaauuuuaacuuguaaaacugcugu

SEQ ID NO: 268766 - RNA, 64 nt, Homo Sapiens
aaugguuacauuaguuuuaauuaaauaguuucuuuuuuuaaaaauuuaaaaaucauuuucuugu

SEQ ID NO: 268767 - RNA, 64 nt, Homo Sapiens
ucauuuucuuguuuaaauaguuucuuacuuagaauuuuuaaaaaucaucuuugcuuguacuaga

SEQ ID NO: 268768 - RNA, 64 nt, Homo Sapiens
uuaccaucaagucuuuuuuaguuaagaaaaauacuuuuuaaaguaaaauaaagcuauucacauu

SEQ ID NO: 268769 - RNA, 64 nt, Homo Sapiens
uuauuaucaggggagaaaaauaggcaauuuuuaauuuuuaaaaaucuccuucaguccauucccu

SEQ ID NO: 268770 - RNA, 64 nt, Homo Sapiens
ucuguaccuuuauuguuaaacauauuuuuauauauuuuuaaauugccuacaauuguggacuuau

SEQ ID NO: 268771 - RNA, 64 nt, Homo Sapiens
ggagauuauucuaaaauauacaguuuauuugcuuuuuuuaaaaaacucugagagugcuuacuca

SEQ ID NO: 268772 - RNA, 64 nt, Homo Sapiens
aaaauaaguucuuaaaaaauaaccuguucuuccuuuuuuaaaauuuuacuuuucugccaaaaua

SEQ ID NO: 268773 - RNA, 64 nt, Homo Sapiens
uuguaugccaaucuuaaagaauaauuguacuguguuuuuaaauuuggcugugcuguauuuugau

SEQ ID NO: 268774 - RNA, 64 nt, Homo Sapiens
aagguggaaaauaggaacugagagacuaaagcuuuuuuuaaaaaaacaugaugcuuggaaauua

SEQ ID NO: 268775 - RNA, 64 nt, Homo Sapiens
gcuguuuaguaucauuuuguuucuuaggacaucuuuuuuaaaaauaacuuauuguggcuugauc

SEQ ID NO: 268776 - RNA, 64 nt, Homo Sapiens
ugguuucccuuguaucuauuuguggugaauguguuuuuuaaauggaacuaucuccaaauuuuuc

SEQ ID NO: 268777 - RNA, 64 nt, Homo Sapiens
auuuaagcuuaagccauaaaauagauuagauuguuuuuuaaaaauggauagcucauuaagaagu

SEQ ID NO: 268778 - RNA, 64 nt, Homo Sapiens
uguaaagugaauaacuucauuucuaauuguuuaauuuuuaaaauucugauuuuuauauauugag

SEQ ID NO: 268779 - RNA, 64 nt, Homo Sapiens
uauuaggaauauguaacaugcuaaaacuuuuuuuuuuuuaaagaguacugagucacaacauguu

SEQ ID NO: 268780 - RNA, 64 nt, Homo Sapiens
cuuauuuguuucaaauugcaguuuuuauaaaacauuuuuaaaacacaaauggcauguaugcuaa

SEQ ID NO: 268781 - RNA, 64 nt, Homo Sapiens
uuauauauuuaaagagggagaucuggggcuguuauuuuuaaacacuuuuuuucauaauacauau

SEQ ID NO: 268782 - RNA, 64 nt, Homo Sapiens
gcauaguuuugaacuaauguaacaugauuuuucuuuuuuaaaacagccugaaaauguacuagug

SEQ ID NO: 268783 - RNA, 64 nt, Homo Sapiens
cccaaauccagcaugaccaaaaguaaaugauguuuuuuuaaagugucuuucuucaaguuucuuc

SEQ ID NO: 268784 - RNA, 64 nt, Homo Sapiens
aaucuacauugggcaucuggucauucaaucuguuuuuuuaaauguuauuuuugccuuucaaugu

SEQ ID NO: 268785 - RNA, 64 nt, Homo Sapiens
uggagacucuuagacaucuuuucauuguuguccauuuuuaaaguugaugauugcuggaaacauu

SEQ ID NO: 268786 - RNA, 64 nt, Homo Sapiens
acuaagaaguguuauaggcaaugacuugaaaugguuuuuaaauuguauggauuguuaagaauug

SEQ ID NO: 268787 - RNA, 64 nt, Homo Sapiens
aucaucuuauguuauuagcaagguuaagacaucuuuuuuaaaaaaauuauagcuucuaccaaga

SEQ ID NO: 268788 - RNA, 64 nt, Homo Sapiens
agacuuuaaacaagaauuaaaaucaugugcuguauuuuuaaaaucuagccaaauuaaauaguac

SEQ ID NO: 268789 - RNA, 64 nt, Homo Sapiens
gucagaaaacauuuucaucuuauugagagauauguuuuuaaacuuuuaucaucauuuguaaaug

SEQ ID NO: 268790 - RNA, 64 nt, Homo Sapiens
guauuucugaacuuggcaaaauuggaaauuaaaauuuuuaaaaauuacaaauauacaaaguuau

SEQ ID NO: 268791 - RNA, 64 nt, Homo Sapiens
guucuugagaaucagccauuugguacaaaaaagauuuuuaaagcuuuuauguuauaccauggag

SEQ ID NO: 268792 - RNA, 64 nt, Homo Sapiens
aaaugucccgauuguuaaaaaguuggcucaauuauuuuuaaaacauuuuguaagccaacaaaag

SEQ ID NO: 268793 - RNA, 64 nt, Homo Sapiens
gcauauuuuucauagaauguagcguguaaauagcuuuuuaaauaacuucuuuuuuauaagagua

SEQ ID NO: 268794 - RNA, 64 nt, Homo Sapiens
ucucacggggccccaggcuuauucagaacugguguuuuuaaaguuuccuuuacccugcccuugu

SEQ ID NO: 268795 - RNA, 64 nt, Homo Sapiens
uauauuuguuacgaagaaggcuauugcuacaauauuuuuaaagguuucuuuuuuaacuuugaaa

SEQ ID NO: 268796 - RNA, 64 nt, Homo Sapiens
auauuuggcugcuuucuuacaaugagaauuaagauuuuuaaacugaaguugaccauacagguug

SEQ ID NO: 268797 - RNA, 64 nt, Homo Sapiens
auaauggcuguuugcuuccauaaacaagugcaauuuuuuaaagugcugucuuacuaagucuugu

SEQ ID NO: 268798 - RNA, 64 nt, Homo Sapiens
gguuaaggagacaauuuuggagagcaagcaaaucuuuuuaaaaaauaguaugaaugugaauacu

SEQ ID NO: 268799 - RNA, 64 nt, Homo Sapiens
uuuuuguuagcuuuaaaucauuuuugcuuuagucuuuuuaaaggaaaauaacaaaacuaugcug

SEQ ID NO: 268800 - RNA, 64 nt, Homo Sapiens
acacugaccaugugauguacauuuauuaugucuuuuuuuaaagaauggaaauauuuauuucaga

SEQ ID NO: 268801 - RNA, 64 nt, Homo Sapiens
caguuuuggacuguuuaguagucuuuguuuuauguuuuuaaauacagaaauugcuuucacaaau

SEQ ID NO: 268802 - RNA, 64 nt, Homo Sapiens
auucuaccaguuaaacuacuuuaauacacauucauuuuuaaagaaaauguuuguuuuaacauaa

SEQ ID NO: 268803 - RNA, 64 nt, Homo Sapiens
ucuguuuaugcgauaacuccuuuuuguuacaauuuuuuuaaaaaaagcuauuuuuguuaaugua

SEQ ID NO: 268804 - RNA, 64 nt, Homo Sapiens
uuuguuaauguaaaguaaauauuucagagcaaauuuuuuaaacuuauugcacuaaauacaggcu

SEQ ID NO: 268805 - RNA, 64 nt, Homo Sapiens
ccccacccuuugaagaguucaaguucuguacagguuuuuaaaacgugaaguaauguuugaacug

SEQ ID NO: 268806 - RNA, 64 nt, Homo Sapiens
cccaauuuuaaugacacuaaaauauuaauagaauuuuuuaaauauacucuaauuuuuaaaacau

SEQ ID NO: 268807 - RNA, 64 nt, Homo Sapiens
aaaauauuaauagaauuuuuuaaauauacucuaauuuuuaaaacauacucuuuauuaucuucau

SEQ ID NO: 268808 - RNA, 64 nt, Homo Sapiens
ucuuaaaagcuagaaaaaccauaauguaauauucuuuuuaaacccucuuauuuuauaacuaaau

SEQ ID NO: 268809 - RNA, 64 nt, Homo Sapiens
ccccccuaguuucacuuucuggaaagugaacaguuuuuuaaauccuaaauguuauaaauccuua

SEQ ID NO: 268810 - RNA, 64 nt, Homo Sapiens
ugaauaguuuuauauuaauaaaagaagacaaaauuuuuuaaauguuagaaaaagcagaucuguc

SEQ ID NO: 268811 - RNA, 64 nt, Homo Sapiens
aauuuuaagcuuuuaaaaauguagauuuuucauauuuuuaaaauuugaaucuauuugagcuuua

SEQ ID NO: 268812 - RNA, 64 nt, Homo Sapiens
aaugacaaucaauuugagaaaauagaaauagauauuuuuaaauaaaaccauucacaguuuacuu

SEQ ID NO: 268813 - RNA, 64 nt, Homo Sapiens
uuuuuacuagccuguaugaaaucacuaguccuuauuuuuaaaggucuaugguuucuuggaagua

SEQ ID NO: 268814 - RNA, 64 nt, Homo Sapiens
cuuguuugaaacaaaagaaaauaaugcauuguguuuuuuaaaaagaguaucuuauacauguauc

SEQ ID NO: 268815 - RNA, 64 nt, Homo Sapiens
auugcuuggguauggaacgguagaaauuuggguguuuuuaaaaccuuguuugggguuguuccug

SEQ ID NO: 268816 - RNA, 64 nt, Homo Sapiens
cuaaauagaacacugauggauuccaaccuuccuuuuuuuaaauuuucuccagucccugggagca

SEQ ID NO: 268817 - RNA, 64 nt, Homo Sapiens
uugacauucucuauuguaauuuuguuccuguuuauuuuuaaauuuucuuuuuguuucacuggaa

SEQ ID NO: 268818 - RNA, 64 nt, Homo Sapiens
cauugugcccuugauuuuuaucuccaaguggcaguuuuuaaaauuggccuuuuaccuggauaua

SEQ ID NO: 268819 - RNA, 64 nt, Homo Sapiens
cccaccacuaacuuuggagaaaauguggguuugcuuuuuaaaggaauccuauaucuaguccuau

SEQ ID NO: 268820 - RNA, 64 nt, Homo Sapiens
caaagugauuuuagaauaaaaugcaggaaaaacuuuuuuaaagauguuagucuuguagcgugaa

SEQ ID NO: 268821 - RNA, 64 nt, Homo Sapiens
cuggcaggucauauacuuuuuuuuggcauauaccuuuuuaaagacuguaauuagugcaguaaca

SEQ ID NO: 268822 - RNA, 64 nt, Homo Sapiens
gugaucauuuaaauaauuucgagauuaaaaaaaauuuuuaaagacugucacauuaguagauucu

SEQ ID NO: 268823 - RNA, 64 nt, Homo Sapiens
augccccucguugccugccuuguguaugaugugcuuuuuaaaucccuugaagcugcuugucuca

SEQ ID NO: 268824 - RNA, 64 nt, Homo Sapiens
auuuauguacucacagucuuaaaacccauauaucuuuuuaaaaauuuuuccauuagaauacugc

SEQ ID NO: 268825 - RNA, 64 nt, Homo Sapiens
gcuaguauaacuagauaguauuagaaugcauauguuuuuaaaauccuuuucuagugcaguuaua

SEQ ID NO: 268826 - RNA, 64 nt, Homo Sapiens
ugcagcagcauaggagugaaaaugugcugcaacguuuuuaaaaauaaaauaaccuuuccuuuua

SEQ ID NO: 268827 - RNA, 64 nt, Homo Sapiens
aacacuuggugauucuuucacaccagaaaaccgcuuuuuaaaaaccacaggccaauuuguuggc

SEQ ID NO: 268828 - RNA, 64 nt, Homo Sapiens
aaauucacuuguauaaaaauuucaguaagugucuuuuuuaaaaauccuuaaacuauugccauac

SEQ ID NO: 268829 - RNA, 64 nt, Homo Sapiens
guccuguacuaguacauaaaagcacagaucugauuuuuuaaaaugaggugcuggcaugcuuuac

SEQ ID NO: 268830 - RNA, 64 nt, Homo Sapiens
aagaaaaaaacauggucuugagcauuaaugcacauuuuuaaaaauagcucuauucauuuauguu

SEQ ID NO: 268831 - RNA, 64 nt, Homo Sapiens
uacaguauuuuacaauuauucuacaagaauaauauuuuuaaaguaagcacucaaucauuagagg

SEQ ID NO: 268832 - RNA, 64 nt, Homo Sapiens
aaagcagaaauacacaaugacaugaagauaacuuuuuuuaaaaaccaaaaucaugaaugauaca

SEQ ID NO: 268833 - RNA, 64 nt, Homo Sapiens
uuauuuuaguaaaguuaaaacuaugcaguauuuuuuuuuaaaguaacaagaaucagacauuuuc

SEQ ID NO: 268834 - RNA, 64 nt, Homo Sapiens
agaaaaauuauauaaauuuuaaaacuugggguccuuuuuaaauaauacugcuagcagcuuauuu

SEQ ID NO: 268835 - RNA, 64 nt, Homo Sapiens
uguagcacuugacuuuuugcuuugagauuuucuguuuuuaaaaaauggguaaugcguuugauug

SEQ ID NO: 268836 - RNA, 64 nt, Homo Sapiens
ugcaggcagcugacugugauuguuuagucugagguuuuuaaacuuguuccucccuugaacuguc

SEQ ID NO: 268837 - RNA, 64 nt, Homo Sapiens
acuucaguucuuaauguaacagaauguuuaaagcuuuuuaaaagcgaauguuuugguucaagaa

SEQ ID NO: 268838 - RNA, 64 nt, Homo Sapiens
gguacaccagaaaaggacuguaugugccuguauuuuuuuaaaauguauaaucuuuggcuagugu

SEQ ID NO: 268839 - RNA, 64 nt, Homo Sapiens
uuagccuaugguaguaauuuuccaguuuauuugcuuuuuaaacacagauuuuguccugcaucug

SEQ ID NO: 268840 - RNA, 64 nt, Homo Sapiens
caucaccuuuuauaguuggggcauuuauuguaauuuuuuaaaaacuacugcaugcaucacuucu

SEQ ID NO: 268841 - RNA, 64 nt, Homo Sapiens
acuauggauuuguguauuuuuuaaaaauccuaaguuuuuaaauauauuuuuauagacauguuuu

SEQ ID NO: 268842 - RNA, 64 nt, Homo Sapiens
uccuaaguuuuuaaauaacuuuuuauagacauguuuuuuaaaaaaacugccuuaaacguuguau

SEQ ID NO: 268843 - RNA, 64 nt, Homo Sapiens
gaaauuaaaaguuuuaaacuucagaaauaauuuauuuuuaaaaaauuuuuauaaauuguaugcu

SEQ ID NO: 268844 - RNA, 64 nt, Homo Sapiens
auuuguacguuuccauuccccacagaauuagauuuuuuuaaagcagaguuugaggaguuaguau

SEQ ID NO: 268845 - RNA, 64 nt, Homo Sapiens
ggauuaaaaaacacagccucguccauuuuacacuuuuuuaaagguccaaaguggaccacacuug

SEQ ID NO: 268846 - RNA, 64 nt, Homo Sapiens
acacauacuuuuugaauguuuggucuucaacaucuuuuuaaacaaccugugcuuauuacucaaa

SEQ ID NO: 268847 - RNA, 64 nt, Homo Sapiens
gaaaacacaucuaaaagcccaaggaugcuuauuuuuuuuaaaaaaccaauugugugaccaugag

SEQ ID NO: 268848 - RNA, 64 nt, Homo Sapiens
auugguuaagugaaaaccagcuacacaauagcgauuuuuaaaugcacagagugguggccagugg

SEQ ID NO: 268849 - RNA, 64 nt, Homo Sapiens
aauuuuuuuuucuuccaaaggggcagcaccucccuuuuuaaaaagguacugaccccucccucuu

SEQ ID NO: 268850 - RNA, 64 nt, Homo Sapiens; identical to SEQ ID NO: 268457

SEQ ID NO: 268851 - RNA, 64 nt, Homo Sapiens; identical to SEQ ID NO: 268458

SEQ ID NO: 268852 - RNA, 64 nt, Homo Sapiens
ugagggcaaaaaggaauggauuuuuuuuuuuucuuuuuuaaaccgcuaagguugucaagaaggc

SEQ ID NO: 268853 - RNA, 64 nt, Homo Sapiens
auggauguuaaggcuguuuucguggauaaaaagguuuuuaaaacgugcuuggaugaaaggacag

SEQ ID NO: 268854 - RNA, 64 nt, Homo Sapiens
ccagcuuauaauuccucguuuuuaaugauuguuauuuuuaaaaaauuaauauuuauaauggaua

SEQ ID NO: 268855 - RNA, 64 nt, Homo Sapiens
aaugugaaaugucaucuugucaugaaggauucuuuuuuuaaaaaugauuauuaggauauauucc

SEQ ID NO: 268856 - RNA, 64 nt, Homo Sapiens
auacguuucacuuaauaaacgcuucccuuuuuuauuuuuaaaggacaacuucauuuauauacag

SEQ ID NO: 268857 - RNA, 64 nt, Homo Sapiens
acaaaagugauagauguucagauagcaaauacuuuuuuuaaauugguugucucuuaaaaagaaa

SEQ ID NO: 268858 - RNA, 64 nt, Homo Sapiens
ugucuauuaauauuccaucgaaauauucuacaacuuuuuaaaaaagaccuuuuuuuauauuauu

SEQ ID NO: 268859 - RNA, 64 nt, Homo Sapiens
aaacgaugggaucauucugaggauauuuuguuuguuuuuaaacagguguuuucuguguauacau

SEQ ID NO: 268860 - RNA, 64 nt, Homo Sapiens
uuuuuuuuuuuuucauauuguuuaaccuagauuuuuuuuaaaacuuuaacaagguaacuuuuug

SEQ ID NO: 268861 - RNA, 64 nt, Homo Sapiens
ccaauugacagauuacaccuggauguguuuccuuuuuuuaaaagauuuacuggucugggaaaca

SEQ ID NO: 268862 - RNA, 64 nt, Homo Sapiens
uuaaauuaucuaaauuuauucucuugccuuuuuuuuuuuaaauucuuugcugcugaaaugcugc

SEQ ID NO: 268863 - RNA, 64 nt, Homo Sapiens
gguccagaauucuauuuuaauaucauccaaaaacuuuuuaaaaaggcucugccuccugugcuua

SEQ ID NO: 268864 - RNA, 64 nt, Homo Sapiens
uuuccaccaccugcguccaaacuccuccgccuguuuuuuaaacuuaugcuuguauccccccguc

SEQ ID NO: 268865 - RNA, 64 nt, Homo Sapiens
aggugagcgugagccucucugaaguggcuuuggguuuuuaaaguaggcccaggcaggugaagag

SEQ ID NO: 268866 - RNA, 64 nt, Homo Sapiens
uggauuuuguuuaaaaaaucugucuguaaauauguuuuuaaaggauagccuauggcagaaaaaa

SEQ ID NO: 268867 - RNA, 64 nt, Homo Sapiens
acauguuuuuauacaaaauacgaccagaggagccuuuuuaaaaccgcucuguggaugccagggc

SEQ ID NO: 268868 - RNA, 64 nt, Homo Sapiens
auauacagauuacuguuaaauugcaguccuuuuuuuuuuaaagauauuuucuugaauuauuuag

SEQ ID NO: 268869 - RNA, 64 nt, Homo Sapiens
uguauguguguguguguguguauauauauauauauuuuuaaaucacauuaauuuuaccaaguga

SEQ ID NO: 268870 - RNA, 64 nt, Homo Sapiens
cauacuguuuuugagccaauuaagaaaauugccauuuuuaaaguguagcauuucaggguaaaga

SEQ ID NO: 268871 - RNA, 64 nt, Homo Sapiens
ugaccaaauaccuagcaccaguuccugcugccacuuuuuaaagugccauaugacuuucuacgaa

SEQ ID NO: 268872 - RNA, 64 nt, Homo Sapiens
auuaauaaucauuuuguuuagaauuacaaaauaguuuuuaaauauugucugagaaaagccaaag

SEQ ID NO: 268873 - RNA, 64 nt, Homo Sapiens
guauccagcccugauauuuuguguaaauaaaauguuuuuaaaaccuguuaguuaaaacacuuag

SEQ ID NO: 268874 - RNA, 64 nt, Homo Sapiens
aaugcaaauguccuucaccaguaaagcaagcaaauuuuuaaaaucucuguuuuugaaaucuacu

SEQ ID NO: 268875 - RNA, 64 nt, Homo Sapiens
cuuacuuuguuucuuucauugcacucuauaaugauuuuuaaauuaagaauuuuuuaucuuaggc

SEQ ID NO: 268876 - RNA, 64 nt, Homo Sapiens
ucuuugguuuccaacaccaugaugaagcucuugcuuuuuaaaaaguaguuaguaaauucugcau

SEQ ID NO: 268877 - RNA, 64 nt, Homo Sapiens
aaaugcauauugaucacuauaauucuaaaacaauuuuuuaaauaaaccagcagguugcuaaaag

SEQ ID NO: 268878 - RNA, 64 nt, Homo Sapiens
aauagaagcuauuuauuaugagcuucuacagguauuuuuaaauagagcaagcauguugaauuua

SEQ ID NO: 268879 - RNA, 64 nt, Homo Sapiens
uaucgggaccggcagaaauggaaguauccauacauuuuuaaaaagcaacaaguuugcacagcua

SEQ ID NO: 268880 - RNA, 64 nt, Homo Sapiens
ucaguuccuggaggggcucuuauuauuuucucucuuuuuaaaaaacuuccaguagaaguaaagu

SEQ ID NO: 268881 - RNA, 64 nt, Homo Sapiens
gggaaaaaaagcaauucacaaaaccauuucauauuuuuuaaaauauugugcuuaaagauggucc

SEQ ID NO: 268882 - RNA, 64 nt, Homo Sapiens
agaaagcaguacagaggaaaacaggaaccugauuuuuuuaaaauaaauuuuaaauaaaauagaa

SEQ ID NO: 268883 - RNA, 64 nt, Homo Sapiens
cuguacuuguacaaacucaacacuaacuuuuuuuuuuuuaaaaaaaaaaagguacuaaguaucu

SEQ ID NO: 268884 - RNA, 64 nt, Homo Sapiens
uaauuuuuuuuguuuugucuagugaguuucaacauuuuuaaaguuuucaaaaagccaucggaau

SEQ ID NO: 268885 - RNA, 64 nt, Homo Sapiens
guuacgcuaaacuuuugauucuuuaacacaauuauuuuuaaacacuggcauuuuccaaaacugu

SEQ ID NO: 268886 - RNA, 64 nt, Homo Sapiens
aacacuggcauuuuccaaaacuguggcagcuaacuuuuuaaaaucucaaaugacaugcagugug

SEQ ID NO: 268887 - RNA, 64 nt, Homo Sapiens
augauuaaucuugggacaaagaauuuuauagaaauuuuuaaacaucugaaaaagaagcuuaagu

SEQ ID NO: 268888 - RNA, 64 nt, Homo Sapiens
uggccauaaaauggcuuuaaagaauauauauauauuuuuaaaguagcuugagaagcaaauuggc

SEQ ID NO: 268889 - RNA, 64 nt, Homo Sapiens
gaggacgacccgagucccaagagugggguuuugcuuuuuaaaaggagagaggaggggugauggc

SEQ ID NO: 268890 - RNA, 64 nt, Homo Sapiens
uuuccauguguuuuccuccuguuguuuuagaacuuuuuuaaaaaaacagaccucguuuuagauu

SEQ ID NO: 268891 - RNA, 64 nt, Homo Sapiens
ugugugaucuuucagggaauguuuuguuuauuuguuuuuaaaaguauugggaaucagauuaaga

SEQ ID NO: 268892 - RNA, 64 nt, Homo Sapiens
guguuuucaacucaggaccuauccaaaugaggaauuuuuaaauauucuuuuuuuuuuccuauuu

SEQ ID NO: 268893 - RNA, 64 nt, Homo Sapiens
uuacaggcgugagccaccuugcccagccaauuuuuuuuuaaagagacauggucuugcuauguug

SEQ ID NO: 268894 - RNA, 64 nt, Homo Sapiens
gcggcaacuucuaacuuugcuccaagccacucucuuuuuaaacagcaacaauuuaaagcuauga

SEQ ID NO: 268895 - RNA, 64 nt, Homo Sapiens
cauuuucaugaccugguuauagccuuugcugguguuuuuaaaauaccuggacucaaugacaaag

SEQ ID NO: 268896 - RNA, 64 nt, Homo Sapiens
ccuggacucaaugacaaagaccgagucuucuuuuuuuuuaaacaaaaacaaaaaaagcaaccag

SEQ ID NO: 268897 - RNA, 64 nt, Homo Sapiens
cuuugacaaagcucaccaacuuuaaaauauuaaguuuuuaaaaaaucaaauaugaaguauguuc

SEQ ID NO: 268898 - RNA, 64 nt, Homo Sapiens
guaaauuaaagcauuacacaguauuuaucaguauuuuuuaaacauccuguccuuuuuuaaaauc

SEQ ID NO: 268899 - RNA, 64 nt, Homo Sapiens
aguauuuaucaguauuuuuuaaacauccuguccuuuuuuaaaaucuuugcuuagucagucauau

SEQ ID NO: 268900 - RNA, 64 nt, Homo Sapiens
cuagcaccuuaaucacuguuuaguuuuguauucauuuuuaaaagcaauuauugaagccauuuuc

SEQ ID NO: 268901 - RNA, 64 nt, Homo Sapiens
aauuagucacugccuugcuaacuuugcuguaauuuuuuuaaacgucuuguuuuuaauauagcaa

SEQ ID NO: 268902 - RNA, 64 nt, Homo Sapiens
ccaaaacauuuuauggcuaguaauauuuauguaauuuuuaaaauguauuuuugguacugauggg

SEQ ID NO: 268903 - RNA, 64 nt, Homo Sapiens
ucucuaaaugaaauagaagacuuuggaguauauguuuuuaaaguaauuuuuuaaaauaugguaa

SEQ ID NO: 268904 - RNA, 64 nt, Homo Sapiens
uagaagacuuuggaguauauguuuuuaaaguaauuuuuuaaaauaugguaauguauuaaacuua

SEQ ID NO: 268905 - RNA, 64 nt, Homo Sapiens
uauauacuaaaauuaaggguggagaagaucuuauuuuuuaaaucauggucauaauuuuucuuuu

SEQ ID NO: 268906 - RNA, 64 nt, Homo Sapiens
gaaaauuguuuucugaaaguaucaucacuuuuccuuuuuaaagaaggcugcuaauuggauuuug

SEQ ID NO: 268907 - RNA, 64 nt, Homo Sapiens
ggggugggauggggugguuggagaaccagaacuauuuuuaaaacauuagguuucaauauaaaua

SEQ ID NO: 268908 - RNA, 64 nt, Homo Sapiens
aacuaaucacagcacagaaguaccuugauuuaauuuuuuaaacguguucucgggaaguuagggc

SEQ ID NO: 268909 - RNA, 64 nt, Homo Sapiens
ggucccaaaugggcccauuccccuaauaguuuuauuuuuaaagaaagccauacauagaaugcuu

SEQ ID NO: 268910 - RNA, 64 nt, Homo Sapiens
cugcaaagauguccagaagccauguauauaauguuuuuuaaacagaacuucauuccccguugaa

SEQ ID NO: 268911 - RNA, 64 nt, Homo Sapiens
gaagccaaggggagagucuaaaagggcuagagcauuuuuaaaaauagacacagggucuugggac

SEQ ID NO: 268912 - RNA, 64 nt, Homo Sapiens
augaccuuuagauugugcgacuuuuguuuuuguuuuuuuaaauuuuuuuaaaccaagaaugauu

SEQ ID NO: 268913 - RNA, 64 nt, Homo Sapiens
gauugugcgacuuuuguuuuuguuuuuuuaaauuuuuuuaaaccaagaaugauuucuccugcuu

SEQ ID NO: 268914 - RNA, 64 nt, Homo Sapiens
aaauuguugcgauuuauuuuuucaagagaucauguuuuuaaagugucuuuugcagaguuuuaag

SEQ ID NO: 268915 - RNA, 64 nt, Homo Sapiens
uacugugugccgagaaggcauuucuagacccguguuuuuaaaggagggaacuuuggggauugcc

SEQ ID NO: 268916 - RNA, 64 nt, Homo Sapiens
gaaucuauagcauuaguauacacuggcacauaauuuuuuaaaaaguuuuaagaaaagauucauu

SEQ ID NO: 268917 - RNA, 64 nt, Homo Sapiens
aaauaguaaccugugaacuaugcuuuuccauaacuuuuuaaaaauauauauaucuaaaugaaug

SEQ ID NO: 268918 - RNA, 64 nt, Homo Sapiens
uauauaucuaaaugaaugcaaugugcauaaauauuuuuuaaacauaacagugaacuauugcacc

SEQ ID NO: 268919 - RNA, 64 nt, Homo Sapiens
acuguuuauauguguugaaaaccaaaaugacaucuuuuuaaagcuuauccauaaaaaaaaauag

SEQ ID NO: 268920 - RNA, 64 nt, Homo Sapiens
ggugguguagauuguaugaguaagaaguauuaauuuuuuaaaagacaaaucaacuuugaagaca

SEQ ID NO: 268921 - RNA, 64 nt, Homo Sapiens
uucugacauuuuauaaaccuacauuuaaggggaauuuuuaaaggaaauguuuuuucuuuuuuuu

SEQ ID NO: 268922 - RNA, 64 nt, Homo Sapiens
uaaaaaaagaaaguuauuucuuugucuuaaagaauuuuuaaaaaauuagucaugagacuuauuc

SEQ ID NO: 268923 - RNA, 64 nt, Homo Sapiens
gcuaauuccccuuccauucccaacucucucucucuuuuuaaagaaaaaugcuaagggcagcccu

SEQ ID NO: 268924 - RNA, 64 nt, Homo Sapiens
augucagcacauguugcuaaugacaguggauuuuuuuuuaaauaaaaaaguuuacagaucaaau

SEQ ID NO: 268925 - RNA, 64 nt, Homo Sapiens
ccuugugagccaccgugcccaacccuaacaauuauuuuuaaaaggaggaauuuaaaugagcugu

SEQ ID NO: 268926 - RNA, 64 nt, Homo Sapiens
aacaaaaaaguucuaacaaaauaauaaggcugaauuuuuaaagucucuuccgcaucuucuguuc

SEQ ID NO: 268927 - RNA, 64 nt, Homo Sapiens
caagcacuuuguaccaaguuauuaaguaacauaauuuuuaaaauuuaaagaaugugucuucaac

SEQ ID NO: 268928 - RNA, 64 nt, Homo Sapiens
uuucugaaaguucccuaucccucuuuaccauaauuuuuuaaauguagccacauuguaauaguaa

SEQ ID NO: 268929 - RNA, 64 nt, Homo Sapiens
auacaaguuuuuagauguuuaugcuuugccuuucuuuuuaaagguguuuuccugcuuuguaguc

SEQ ID NO: 268930 - RNA, 64 nt, Homo Sapiens
aguuuacuaauagaggaguagagauuguugaccauuuuuaaaaaacgauagccacucuuuuucu

SEQ ID NO: 268931 - RNA, 64 nt, Homo Sapiens
augaauggaggcacuuuacuaggucuagaauauuuuuuuaaaagccucugaacugagcuuaaaa

SEQ ID NO: 268932 - RNA, 64 nt, Homo Sapiens
ccucuccacuacucaggcagccacuauucaucuauuuuuaaaguaccccauuuucaggccgggu

SEQ ID NO: 268933 - RNA, 64 nt, Homo Sapiens
caccugcuauacaguuguuaaaucuuaaauaugcuuuuuaaaaauuggaauaauguauuaaggu

SEQ ID NO: 268934 - RNA, 64 nt, Homo Sapiens
agaaaagaauccuuaaaaucuagauuuauaccauuuuuuaaagucccaccuuucaauguuuaau

SEQ ID NO: 268935 - RNA, 64 nt, Homo Sapiens
ugcauaccaguguuuuaaaagguauuuuuauguguuuuuaaacacuuuuuuaaaugagccugac

SEQ ID NO: 268936 - RNA, 64 nt, Homo Sapiens
uuuuaaaagguauuuuuauguguuuuuaaacacuuuuuuaaaugagccugacaccuguguuuca

SEQ ID NO: 268937 - RNA, 64 nt, Homo Sapiens
gacauuaaguagaaauauugguuuuuuuuuuuuuuuuuuaaauaagucacaguccuguugucaa

SEQ ID NO: 268938 - RNA, 64 nt, Homo Sapiens
uuuuauauauauauaaauauauauaaauauauacuuuuuaaaaauaauuuauaaaucuuaccaa

SEQ ID NO: 268939 - RNA, 64 nt, Homo Sapiens
aaagacacauucaaucuugcaacacaaggcugcauuuuuaaaaaaaucacuuauuucagagugc

SEQ ID NO: 268940 - RNA, 64 nt, Homo Sapiens
acuuauuucagagugcaacaguaucauguuuuucuuuuuaaaucaaggucaggaugggaucucu

SEQ ID NO: 268941 - RNA, 64 nt, Homo Sapiens
uaaucaauaguaaagacuguaauuacacaaauaauuuuuaaauaucauuuacaauucaauauau

SEQ ID NO: 268942 - RNA, 64 nt, Homo Sapiens
ugcuuucacauagcacaggccuugccgcauaggcuuuuuaaagggaaucuuuagacacuuaucu

SEQ ID NO: 268943 - RNA, 64 nt, Homo Sapiens
gaucuauuucccuuaucacugcuguuugguuuuguuuuuaaauaucuuaaucuagacagaaaua

SEQ ID NO: 268944 - RNA, 64 nt, Homo Sapiens
uaacuauauaaggauggucccagaaaaagcaagauuuuuaaaacaaucauaacaucugauuaaa

SEQ ID NO: 268945 - RNA, 64 nt, Homo Sapiens
guauacagaucaaagcaaaaacucacugguaauauuuuuaaaaaacaugaagcaaucaucgaag

SEQ ID NO: 268946 - RNA, 64 nt, Homo Sapiens
caucauuuaaaaaaaaaugaaaaccaaagugcuauuuuuaaaagauuggaaaauuauauguaua

SEQ ID NO: 268947 - RNA, 64 nt, Homo Sapiens
auagaagauacuuuuaagacucccaaaccuaaucuuuuuaaaaguugagcuuuauucuaaugua

SEQ ID NO: 268948 - RNA, 64 nt, Homo Sapiens
uguaaaauaacauauuuuuuagauuguuuuguaauuuuuaaagguguucaguuuauauuguuuu

SEQ ID NO: 268949 - RNA, 64 nt, Homo Sapiens
caacagacuuaaaguuguccacacucguuuguuguuuuuaaaggcagaaggaaagcacuaagaa

SEQ ID NO: 268950 - RNA, 64 nt, Homo Sapiens
acuguagccucaguacugguauuaggcuguuuucuuuuuaaaguucgugcauaggcaaagaagg

SEQ ID NO: 268951 - RNA, 64 nt, Homo Sapiens
aggacuaauguuucuuuuguuugguacuuuuuucuuuuuaaauuuugaagauuuuuuuuguuuc

SEQ ID NO: 268952 - RNA, 64 nt, Homo Sapiens
cugaaaauuaauaauuaggguugcauuguuuaaguuuuuaaauuccacucaacucuuaauaugc

SEQ ID NO: 268953 - RNA, 64 nt, Homo Sapiens
ccaagaggucaggggauuuuuuuaaauaauaauuuuuuuaaaacaauggaaaaacauuuauucu

SEQ ID NO: 268954 - RNA, 64 nt, Homo Sapiens
aauauauuuuaaccuacaguagcaaauuggucauuuuuuaaaaaagccuuaagaauugcagugg

SEQ ID NO: 268955 - RNA, 64 nt, Homo Sapiens
accaaagguauuugguaagcucauggacauacauuuuuuaaaguuuggauuaaaaaguauuaua

SEQ ID NO: 268956 - RNA, 64 nt, Homo Sapiens
acaagucaucauuugaaaauauguuaccuuuggguuuuuaaaagcuuaguuaacucugggaaag

SEQ ID NO: 268957 - RNA, 64 nt, Homo Sapiens
uuuacauauguuuacauguucaaaggcaucacuauuuuuaaauggacauuuuccccuuacauuu

SEQ ID NO: 268958 - RNA, 64 nt, Homo Sapiens
ucuaaaugcacaccuccuaagggcaaagaaggcauuuuuaaaauuguauuuuaauaucuugcaa

SEQ ID NO: 268959 - RNA, 64 nt, Homo Sapiens
uucauugcuguuuuugacagaauuuuuggguuauuuuuuaaaaccuaaaggauauuauuguuug

SEQ ID NO: 268960 - RNA, 64 nt, Homo Sapiens
uagcaagaacucuauuuggaaaucucuugagaucuuuuuaaagcuaaauugcugcccuguguau

SEQ ID NO: 268961 - RNA, 64 nt, Homo Sapiens
uuuaauuagauuuccuuuucauuuucagaauucuuuuuuaaaauaaaguuggccaugguaaaua

SEQ ID NO: 268962 - RNA, 64 nt, Homo Sapiens
aaauuaauguuguauuuaaacuucuuuccuucauuuuuuaaauaacuggauaauaggaaaaaca

SEQ ID NO: 268963 - RNA, 64 nt, Homo Sapiens
acugacaguguuuauuauuaaauuguuaucaugguuuuuaaaagucaugcuguucaaaguuuuu

SEQ ID NO: 268964 - RNA, 64 nt, Homo Sapiens
aaugaaugacauuuagauacucuauucuuuuuuuuuuuuaaacuauuuacuugguccagaguuu

SEQ ID NO: 268965 - RNA, 64 nt, Homo Sapiens
aagcguuguuaauguaauuggaaagugauucuauuuuuuaaagaccacugugguugauucaaaa

SEQ ID NO: 268966 - RNA, 64 nt, Homo Sapiens
agguccaacccugcaaugaaaaugucaaaucugguuuuuaaacagaaaggaaguucgguaagga

SEQ ID NO: 268967 - RNA, 64 nt, Homo Sapiens
ucccccaacaaauaggauucuucucucggcucuuuuuuuaaaaggauaaccacccucccagagu

SEQ ID NO: 268968 - RNA, 64 nt, Homo Sapiens
cugcagggauuugguuaaguuauauauagucuacuuuuuaaacuggcauauaugaagauauaua

SEQ ID NO: 268969 - RNA, 64 nt, Homo Sapiens
ucuuuuucuuagaaagccaagagggaauugauuuuuuuuaaaagguacaaguccuuucagugau

SEQ ID NO: 268970 - RNA, 64 nt, Homo Sapiens
gacagaugauuuuguucaggguuuuuuuaucccuuuuuuaaaauaaaugcucaccacuuagccu

SEQ ID NO: 268971 - RNA, 64 nt, Homo Sapiens
aaguauacuguauuuuaccauuccucccaagucuuuuuuaaagagaucuucuaaguugauuuuu

SEQ ID NO: 268972 - RNA, 64 nt, Homo Sapiens
ucucugagucucagugacuugaucuuuaaaaauguuuuuaaaaccauuuacaaacaacaaacuu

SEQ ID NO: 268973 - RNA, 64 nt, Homo Sapiens
aaaucauaauaguuaggauauuuaaucuaaacuuuuuuuaaaaaaugcauuuguggcuagaaau

SEQ ID NO: 268974 - RNA, 64 nt, Homo Sapiens
gaagaccuucugcugcuuuuccccuuuguucauauuuuuaaagguuuucauucuguaguucuca

SEQ ID NO: 268975 - RNA, 64 nt, Homo Sapiens
cugacaaacuucauaaauggagaccagaacuauuuuuuuaaagcgaugaauguugacucccagg

SEQ ID NO: 268976 - RNA, 64 nt, Homo Sapiens
auaacuaauugucgagcacuuuguuuuguuuuguuuuuuaaauaccucaguguuuaacaguuuu

SEQ ID NO: 268977 - RNA, 64 nt, Homo Sapiens
caguggcugccuucuauuguugccagcuguaauguuuuuaaaugaaucggggcucuuguaucag

SEQ ID NO: 268978 - RNA, 64 nt, Homo Sapiens
acagagguguucugaccugcuucaaaaaaauuauuuuuuaaaacuauauuaaaagagagggucc

SEQ ID NO: 268979 - RNA, 64 nt, Homo Sapiens
gaacuuuuuuaguuuauuaacuucuguuuguauuuuuuuaaagaaccaggauugugaaagaguu

SEQ ID NO: 268980 - RNA, 64 nt, Homo Sapiens
cuggaagauuguacagcauaauaacacugagauuuuuuuaaaagccccucuuucauguauuaaa

SEQ ID NO: 268981 - RNA, 64 nt, Homo Sapiens
aaguuuuuuucauucaaagaauaaaaauacucauuuuuuaaaaaauuaagaaucuauauaagcu

SEQ ID NO: 268982 - RNA, 64 nt, Homo Sapiens
agaauugggucuuuuuauuagcauucguucucgauuuuuaaagaacaguguucuggaaaucugu

SEQ ID NO: 268983 - RNA, 64 nt, Homo Sapiens
gacauucccagucauccuggagcagauuuagccauuuuuaaacaggaucuaauuaccuuaaaca

SEQ ID NO: 268984 - RNA, 64 nt, Homo Sapiens
cuucagauuaaacaagagccuucuuuuauuuuauuuuuuaaaggauaguuguuaaaguuacaac

SEQ ID NO: 268985 - RNA, 64 nt, Homo Sapiens
aagacauuaugauaccucugaacauuuugcuuaauuuuuaaaguacacuuugucuuuacaauga

SEQ ID NO: 268986 - RNA, 64 nt, Homo Sapiens
aggggaaauauuugccucauccucaguuuuugcuuuuuuaaaggaguuguuuaacauuuucaag

SEQ ID NO: 268987 - RNA, 64 nt, Homo Sapiens
ggaaaauuguuuaaaguauuugccuaaaauuuuauuuuuaaaaauucugaagaguaauaccaaa

SEQ ID NO: 268988 - RNA, 64 nt, Homo Sapiens
uucuuuuguagaccgaacuuggcuuuagcagauguuuuuaaaguuugugaacaaauguucccuu

SEQ ID NO: 268989 - RNA, 64 nt, Homo Sapiens
acauuguaagauucuuucugacaaauucguaaacuuuuuaaaaaggcuuugaauauggcccgac

SEQ ID NO: 268990 - RNA, 64 nt, Homo Sapiens
auguuuacauaacuguaaguuuauguuggaauaauuuuuaaauauguuagcuuuaaaagaguau

SEQ ID NO: 268991 - RNA, 64 nt, Homo Sapiens
uaugcuauaaacuaugcuacauuaccgaaugccauuuuuaaaagcuuucuguccagaaggcaaa

SEQ ID NO: 268992 - RNA, 64 nt, Homo Sapiens
agagaauuagaaaauauuaacaacagcauccuuuuuuuuaaaagacuuuuuuuuuuucccaauc

SEQ ID NO: 268993 - RNA, 64 nt, Homo Sapiens
aagaaacuaaauaaaauuauuugaaaugcuaccuuuuuuaaaaucuugagucuaaauuuauaug

SEQ ID NO: 268994 - RNA, 64 nt, Homo Sapiens
uggaucugggguauauucauacaggaaguuuuuauuuuuaaaaccacaguauuguaucauaauu

SEQ ID NO: 268995 - RNA, 64 nt, Homo Sapiens
uauuuuagaaaccugagacuggcuguaaaccuguuuuuuaaaacgguuucuaagacuuacuaug

SEQ ID NO: 268996 - RNA, 64 nt, Homo Sapiens
ucauguaauguuaaaacguuguaauuauggugauuuuuuaaauaauaauuauugguuuauuaug

SEQ ID NO: 268997 - RNA, 64 nt, Homo Sapiens
aaaugcuuuaguuuucuucuuagaaacuggaaauuuuuuaaagacuguuuugccuuauacauuu

SEQ ID NO: 268998 - RNA, 64 nt, Homo Sapiens
uuuuaguuacuuaaaauaugaguuaaugguugaauuuuuaaaguuuucagauucugauuguuug

SEQ ID NO: 268999 - RNA, 64 nt, Homo Sapiens
aaaauguucauuguauuugaugaguuaguuagguuuuuuaaaauggugaccuuuuaccaagugg

SEQ ID NO: 269000 - RNA, 64 nt, Homo Sapiens
gugaaaaccuccuguuuagauugcuuuacuaagauuuuuaaauauuuuuugaaguugucaucaa

SEQ ID NO: 269001 - RNA, 64 nt, Homo Sapiens
aguauuauuuuauaaccaauuauuucugcuauuauuuuuaaagccuucuguuacauaauuaaac

SEQ ID NO: 269002 - RNA, 64 nt, Homo Sapiens
cacagaauugauauuuaucuaccaacaagaggauuuuuuaaaauugcaugcccaaaacacuacu

SEQ ID NO: 269003 - RNA, 64 nt, Homo Sapiens
uggugccacuuuuaauuaacuaguuuuuuuuuuuuuuuuaaacauuucccguuugaggucuugg

SEQ ID NO: 269004 - RNA, 64 nt, Homo Sapiens
augacaaauuuuaggagacuugaucucaaguccuuuuuuaaagauucucuuuccccaaaaguga

SEQ ID NO: 269005 - RNA, 64 nt, Homo Sapiens
uuagaguagauguuuggaaaagcuaaguagaaauuuuuuaaaauagaaguuguauuuuaaacgu

SEQ ID NO: 269006 - RNA, 64 nt, Homo Sapiens
gaggggcagaacagauagauuacgacagguuugguuuuuaaauuuuccaaccaaguggaaaggc

SEQ ID NO: 269007 - RNA, 64 nt, Homo Sapiens
uguaacuuguucugguaauguccuucccggacucuuuuuaaaugucucccccuaaguuuuauac

SEQ ID NO: 269008 - RNA, 64 nt, Homo Sapiens
ccuaaguuuuauacuugauuguauuauuagucuguuuuuaaauguuuugcccgguuuuucucuu

SEQ ID NO: 269009 - RNA, 64 nt, Homo Sapiens
ggaaguuaugaaagaauguaauucacuaaauuauuuuuuaaaugaaaccuuuuuuuuucuuuuu

SEQ ID NO: 269010 - RNA, 64 nt, Homo Sapiens
gguuuacuccuugcucuuacaacauuucuaaggauuuuuaaaaguuuacuucuugucuuguucu

SEQ ID NO: 269011 - RNA, 64 nt, Homo Sapiens
aaaccuuaggagcaaauaaaccgugcuuucauguuuuuuaaauggugcuuuccuuacccgagag

SEQ ID NO: 269012 - RNA, 64 nt, Homo Sapiens
aaagugcugcauuuugaugaauuuuuucuagccauuuuuaaagagaaaacuaggaauugaguau

SEQ ID NO: 269013 - RNA, 64 nt, Homo Sapiens
cggucacauguuuuuccuucagcuugaaagcuuuuuuuuaaaaggaaaagauaccaaaugccug

SEQ ID NO: 269014 - RNA, 64 nt, Homo Sapiens
aauguauaucuuuuaugucucuacucagaccauauuuuuaaaggggugccucauuauggggcag

SEQ ID NO: 269015 - RNA, 64 nt, Homo Sapiens
aauauaaaucaucucauguggauaugaaacuucuuuuuuaaaacuuaaaaagguagaauguuau

SEQ ID NO: 269016 - RNA, 64 nt, Homo Sapiens
auaucuuggcuugcuauauaagauucaaaagagcuuuuuaaauuuuucuaauaauaucuuacau

SEQ ID NO: 269017 - RNA, 64 nt, Homo Sapiens
gggauuacauuuuuauggggcagggguaagcaaguuuuuaaaucauuugugugcucuggcucuu

SEQ ID NO: 269018 - RNA, 64 nt, Homo Sapiens
ucccucaaggggcuccccucccgugcauggacauuuuuuaaaccaccgauuccaagaggaugag

SEQ ID NO: 269019 - RNA, 64 nt, Homo Sapiens
ugugcaauugcucgcccuggagggaaccagaucauuuuuaaaccagaaauaauuuuuuuuauua

SEQ ID NO: 269020 - RNA, 64 nt, Homo Sapiens
acauuuuaaaaacauagaaaaauucagcaaaccauuuuuaaaguagaagaggguuuuagguaga

SEQ ID NO: 269021 - RNA, 64 nt, Homo Sapiens
uuaaggguuaucuuagauguuucacaccggaagguuuuuaaacacuaaaauauauaauuuauag

SEQ ID NO: 269022 - RNA, 64 nt, Homo Sapiens
ucugccuuugauguuacagauuuaauacaguuuauuuuuaaagauagauccuuuuauaggugag

SEQ ID NO: 269023 - RNA, 64 nt, Homo Sapiens
caguguuucaacaagauguugcugcaggagcagcuuuuuaaaacaagauaaaacucacagggga

SEQ ID NO: 269024 - RNA, 64 nt, Homo Sapiens
uuaaaacaagauaaaacucacaggggaauguacuuuuuuaaaaaaaaaugaaaaagaaaaaaaa

SEQ ID NO: 269025 - RNA, 64 nt, Homo Sapiens
uaguuguauuuugaaaugaugugucaggaaaaguuuuuuaaaaacuuguauguuuuugcaaauc

SEQ ID NO: 269026 - RNA, 64 nt, Homo Sapiens
ugacaaguuguggcaaaggaaacuauacuuuucauuuuuaaaaauguaaauagaaaaguuuuua

SEQ ID NO: 269027 - RNA, 64 nt, Homo Sapiens
caguuuaaauaaaaugagaaagguauguuuuucuuuuuuaaaaaagcugcuguuggaucuagaa

SEQ ID NO: 269028 - RNA, 64 nt, Homo Sapiens
uaacaaauauauuuaaguacuaaaggugauuuuuuuuuuaaagacuuuuucaaauugucaaaug

SEQ ID NO: 269029 - RNA, 64 nt, Homo Sapiens
gcacaaagaagagauaacuuccaaaagagugcuguuuuuaaaaauaauaauuaggaaauguuua

SEQ ID NO: 269030 - RNA, 64 nt, Homo Sapiens
uuaaaauauuacuaacuuaaggguuucuaugugcuuuuuaaaauauuccuucuuugauguugac

SEQ ID NO: 269031 - RNA, 64 nt, Homo Sapiens
auaggcaagcucuccuuauaaguaaggcuuucaauuuuuaaaacagacauccugcuuuaacaau

SEQ ID NO: 269032 - RNA, 64 nt, Homo Sapiens
uucuucugucuuuauguuuuucuauaaccuggauuuuuuaaaucauauuaaaauuacagaugug

SEQ ID NO: 269033 - RNA, 64 nt, Homo Sapiens
agauguaaauuauauauauaguauauuauauauauuuuuaaagcuuuauaugccucaaauauca

SEQ ID NO: 269034 - RNA, 64 nt, Homo Sapiens
aacagauuaccaguuuuuuacuugugggugugauuuuuuaaaauaguucuuuauauauaauuaa

SEQ ID NO: 269035 - RNA, 64 nt, Homo Sapiens
uaugcuauaggcagugcuugcuugaaaagucucauuuuuaaaucucccuggcaugaggugccca

SEQ ID NO: 269036 - RNA, 64 nt, Homo Sapiens
uaagugcacuuguauugcuuuuuaaucuguuaauuuuuuaaagacccaagcagucauuuugagu

SEQ ID NO: 269037 - RNA, 64 nt, Homo Sapiens
uaaccuuuuauaaauuuaaagucaauaaagcaccuuuuuaaaggaaacacugcaacuuuccuua

SEQ ID NO: 269038 - RNA, 64 nt, Homo Sapiens
ggaugaaaugaggaaaaacaggaaaagaauucacuuuuuaaaugaagaaauuagugaaaaaauu

SEQ ID NO: 269039 - RNA, 64 nt, Homo Sapiens
aaaugaauaaauaaaauaaaaauaaaaauguuacuuuuuaaaaaguaacuuuuuuaauaauaua

SEQ ID NO: 269040 - RNA, 64 nt, Homo Sapiens
uauccuuuuuuagguuucccugcuuuccaguuaauuuuuaaaaugguagcgcuuuguaugcauu

SEQ ID NO: 269041 - RNA, 64 nt, Homo Sapiens
gucuacaggaguaauaaugguuuccaaagaguauuuuuuaaaggaacaaaacgagcaugaauua

SEQ ID NO: 269042 - RNA, 64 nt, Homo Sapiens
cuuguuuaguaucaaauuuuauuucacgaaaguuuuuuuaaagaacagaaacuuuuccaauuaa

SEQ ID NO: 269043 - RNA, 64 nt, Homo Sapiens
cuuggcaaaugaauccauauugacauauuugauuuuuuuaaaaacauggaaacguacuguuuug

SEQ ID NO: 269044 - RNA, 64 nt, Homo Sapiens
auuuuugccaauguaauuaaaaaaugguaugucauuuuuaaaauuuguauuucuuucauuacaa

SEQ ID NO: 269045 - RNA, 64 nt, Homo Sapiens
auauucaugcacugaaaaaugcuguuaucuuuuguuuuuaaaaaaugcaauuaaaacuagaaau

SEQ ID NO: 269046 - RNA, 64 nt, Homo Sapiens
uuuaguuguuguuaaaugaugaggaguuuuuuuuuuuuuaaauauggcuggaaagcuuguuuug

SEQ ID NO: 269047 - RNA, 64 nt, Homo Sapiens
uacauauauauuuauauauuuuaaaaauaaacauuuuuuaaaucgucagaaggcaacauuuacc

SEQ ID NO: 269048 - RNA, 64 nt, Homo Sapiens
aauuauuuuauaucuuauuugauguuaaguaauauuuuuaaaguaugguuuuugaagauaguag

SEQ ID NO: 269049 - RNA, 64 nt, Homo Sapiens
gcuuuuuaagaugucuauuauauuuacuuauuaguuuuuaaaaauugcgcuacuugccugggaa

SEQ ID NO: 269050 - RNA, 64 nt, Homo Sapiens
gggaaacauagcagaccucguuucuacuaaaaauuuuuuaaaaaagaaaauuagggcaaggugu

SEQ ID NO: 269051 - RNA, 64 nt, Homo Sapiens
gcaacaugaugugaaaacccaucucuacaaaaauuuuuuaaaaaauaagccagggauuguggca

SEQ ID NO: 269052 - RNA, 64 nt, Homo Sapiens
guagacuucugaauaagaugauagacgagaauuuuuuuuaaaaaaggaauuuaaaggaaucuug

SEQ ID NO: 269053 - RNA, 64 nt, Homo Sapiens
gauuguaagccuuuucuggcaagcuuuucuucuuuuuuuaaacucuuuuccugaaacuuuuuau

SEQ ID NO: 269054 - RNA, 64 nt, Homo Sapiens
uauuuuccccuuguuaagacauaggaagacuuaauuuuuaaacggucaguguccaguugaaggc

SEQ ID NO: 269055 - RNA, 64 nt, Homo Sapiens
acuucauagggagaagcacuuaugacaaggcuauuuuuuaaaccgcgguauuauccuaauuuaa

SEQ ID NO: 269056 - RNA, 64 nt, Homo Sapiens
ugagguuuuuuuguaaauccuuguauuccuauuuuuuuuaaagaaaaaaaaaaaaccuuaagcu

SEQ ID NO: 269057 - RNA, 64 nt, Homo Sapiens
ucccuaaauauaguuauauuucauacuuaguuuguuuuuaaaaaguuuucucuguagaaaauuu

SEQ ID NO: 269058 - RNA, 64 nt, Homo Sapiens
ccaguuuuguuugaaaguuguuuguccguaugauuuuuuaaaagucaaguuuaauuucaaaaaa

SEQ ID NO: 269059 - RNA, 64 nt, Homo Sapiens
aaagacggggaauuaaauuacuaauuuuuuuuuuuuuuuaaaugaugacaguggucccagaacu

SEQ ID NO: 269060 - RNA, 64 nt, Homo Sapiens
uacauuugggcugucuguauguuuuuauagcugguuuuuaaaaagcauaauaugccuauagcug

SEQ ID NO: 269061 - RNA, 64 nt, Homo Sapiens
ggccuacagcauccuguguaucuugcaguugggauuuuuaaacauacuauaaagucuguguugg

SEQ ID NO: 269062 - RNA, 64 nt, Homo Sapiens
uuauaagugacaaaauuaggccaaaggugauuuuuuuuuaaaucaggaagcugguuacuggcuc

SEQ ID NO: 269063 - RNA, 64 nt, Homo Sapiens
uugauacccuaaucuugcuucuggaucuguucuuuuuuuaaaaaaacuuccuucaccgcgccua

SEQ ID NO: 269064 - RNA, 64 nt, Homo Sapiens
aaugaucuauugcagauauuugauguaguuuucuuuuuuaaauuaaucagaaaccccacuucca

SEQ ID NO: 269065 - RNA, 64 nt, Homo Sapiens
gcuuuuauuuaaagaaaaaaaaggcaguauucccuuuuuaaaugagcuuucaggaaguugcuga

SEQ ID NO: 269066 - RNA, 64 nt, Homo Sapiens
aaauauauugucauacaauguuaaauaaccuauuuuuuuaaaaaaguucaacuuaagguagaag

SEQ ID NO: 269067 - RNA, 64 nt, Homo Sapiens
aauugcgaaaucaagucugucaaguacaauaacauuuuuaaaagaaaauggaucccacuguucc

SEQ ID NO: 269068 - RNA, 64 nt, Homo Sapiens
guuuuauuuauuuaacccgccuuuucuuuuuucuuuuuuaaaaugcauguuuuaacagguuuuu

SEQ ID NO: 269069 - RNA, 64 nt, Homo Sapiens
aauguuuuucuauauuaacagcccuuccacaucauuuuuaaacuugccccgucgcauuaaugag

SEQ ID NO: 269070 - RNA, 64 nt, Homo Sapiens
ugaaguacuuaaauguacuuguacagcuuugucuuuuuuaaauaauguacacuuuuuguauucu

SEQ ID NO: 269071 - RNA, 64 nt, Homo Sapiens
aauuuuuuaauuaaauucaaagugggagucguuuuuuuuaaaaauuggugaguaacacacauau

SEQ ID NO: 269072 - RNA, 64 nt, Homo Sapiens
aguacaacucuagcauuuugagcugaaugguuuuuuuuuaaaugcuuuuuuaaagaccaaaggu

SEQ ID NO: 269073 - RNA, 64 nt, Homo Sapiens
ccaaagguagcugaaugguuuugcaguguaggcuuuuuuaaagaacauaacaauguuuaggaua

SEQ ID NO: 269074 - RNA, 64 nt, Homo Sapiens
auaaacaaauuauguauuuauucacaagguuuacuuuuuaaaguuuaucagagauaauugcagu

SEQ ID NO: 269075 - RNA, 64 nt, Homo Sapiens
uuagcagcuaucauuaguguaauuuuuuuguaauuuuuuaaaucacuuucuuaaaacauucugg

SEQ ID NO: 269076 - RNA, 64 nt, Homo Sapiens
aauauuaacagcuguuagguaaaaccugaagauguuuuuaaaacuuuaagcaauuuauaaaucu

SEQ ID NO: 269077 - RNA, 64 nt, Homo Sapiens
ucuauuuuaaaaugugauuuacagcuguuaauauuuuuuaaaaauauuaagcacaagauaaaga

SEQ ID NO: 269078 - RNA, 64 nt, Homo Sapiens
aacuggcaaaugcuaugcuuuguauugacucgguuuuuuaaaaucaagaacuuugagacuaauu

SEQ ID NO: 269079 - RNA, 64 nt, Homo Sapiens
auaucauuguccuccuccuccagccucaaauauguuuuuaaaaacuggcgugagccaccaugcc

SEQ ID NO: 269080 - RNA, 64 nt, Homo Sapiens
cugaaacaaucauugcuaaauuuaugaaaguaaguuuuuaaacauggauauucauuuauacuga

SEQ ID NO: 269081 - RNA, 64 nt, Homo Sapiens
gcuuuuuuaauauuaaaaugaaguuguuauagauuuuuuaaaaucaaaugcagauuuugucaua

SEQ ID NO: 269082 - RNA, 64 nt, Homo Sapiens
uauuuucaaaguacauaaaauagaauuuuuaauguuuuuaaauauauaauauauguuuuaaaua

SEQ ID NO: 269083 - RNA, 64 nt, Homo Sapiens
cuugcuguggucucuuugugcuguuuuguuuuguuuuuuaaagucuguuguguucguucuuguu

SEQ ID NO: 269084 - RNA, 64 nt, Homo Sapiens
uaagaauuuagaagugguaaauuaucuuuauuauuuuuuaaaaaaguaaaugguagugaguuaa

SEQ ID NO: 269085 - RNA, 64 nt, Homo Sapiens
uuuguugccuuuuaaaauccguugucuuuuaaguuuuuuaaauaauaaaauuucaaaagaaaag

SEQ ID NO: 269086 - RNA, 64 nt, Homo Sapiens
ugcuggugauaauaaaauucagaauuccucuuaauuuuuaaagauuuuuuauauauacucucag

SEQ ID NO: 269087 - RNA, 64 nt, Homo Sapiens
cuuaacagcaaaauauuugcuauguuucuguuuauuuuuaaaucgaaaugaaaauuuuauacuc

SEQ ID NO: 269088 - RNA, 64 nt, Homo Sapiens
aauugaaauuuuucaugaugaaaugaaagcuauuuuuuuaaauggcuaaacguaauuauuauuu

SEQ ID NO: 269089 - RNA, 64 nt, Homo Sapiens
aggcccaauaucaguauucucuggccagaggcauuuuuuaaaucuacuuucacuuuuuuacaac

SEQ ID NO: 269090 - RNA, 64 nt, Homo Sapiens
auaaacaguuuagcccaucuuuuuaaucaucugguuuuuaaaaguauaauacuaaaauguaacu

SEQ ID NO: 269091 - RNA, 64 nt, Homo Sapiens
cuaauauguuucacacuauacaauuuuuuuuuguuuuuuaaauaaauauugauuuucccauuaa

SEQ ID NO: 269092 - RNA, 64 nt, Homo Sapiens
aaccuuauuuggaugcaucuauaaaaguaugaccuuuuuaaaucacuauuucuguggaauaauu

SEQ ID NO: 269093 - RNA, 64 nt, Homo Sapiens
cucagguuagaacaaaaauguuuccagcacauuuuuuuuaaaaaugacuuuuuaaggguccuuc

SEQ ID NO: 269094 - RNA, 64 nt, Homo Sapiens
cagcauggaaaguuuaagaugaauaaggaucuuuuuuuuaaagaagugaagacagaaccagagg

SEQ ID NO: 269095 - RNA, 64 nt, Homo Sapiens
guguaaaacaucuuuuguuugaauuuuuguuuuauuuuuaaaaucacuggagaagauaugugua

SEQ ID NO: 269096 - RNA, 64 nt, Homo Sapiens
uuugguuugagccuuaugccuaagcauuuccucuuuuuuaaaaaagguggucaaauucuggaag

SEQ ID NO: 269097 - RNA, 64 nt, Homo Sapiens
auaagaauguuaucagaaucaaaaauuuuuuuauuuuuuaaagccucagaaugauagugccuuu

SEQ ID NO: 269098 - RNA, 64 nt, Homo Sapiens
aaaguuuuaaaaauaacugcaauagaugcucauauuuuuaaaauauaauuaucaaaacuuuuaa

SEQ ID NO: 269099 - RNA, 64 nt, Homo Sapiens
guaccaaucacaagaaaauaaaaacauagacuuauuuuuaaauuuauuuuuuaaaaucaaugug

SEQ ID NO: 269100 - RNA, 64 nt, Homo Sapiens
caaugugaaaacauagacuucaaacaugcuauauuuuuuaaaauuugcuuaaucauuuguaauu

SEQ ID NO: 269101 - RNA, 64 nt, Homo Sapiens
auaauauguuguaaggaaaauuuucuuugaagcauuuuuaaaccugauuuuaaaggauuuugcc

SEQ ID NO: 269102 - RNA, 64 nt, Homo Sapiens
uuuaucuuuucacuuaguguuaauauauuaaagauuuuuaaaaguaaugcaaguucuacaauga

SEQ ID NO: 269103 - RNA, 64 nt, Homo Sapiens
agucuacuagauugugauccgacauccaaauuuuuuuuuaaagcaguauguauauuaaaaaaga

SEQ ID NO: 269104 - RNA, 55 nt, Homo Sapiens
uuguuauuuaaauccugaaggugucuuuuuaaaaaauuccauuuugugguguuaa

SEQ ID NO: 269105 - RNA, 64 nt, Homo Sapiens
uauguuuagaacuuuauaucuuuccauuuugcucuuuuuaaaucaacagcaaauauuuauauuu

SEQ ID NO: 269106 - RNA, 64 nt, Homo Sapiens
uuuauauugccucugccaaauuaaacaucuuacauuuuuaaaaaugcuaaaggcuaauggcauu

SEQ ID NO: 269107 - RNA, 64 nt, Homo Sapiens
gguuacaucuauucuugcugaaacaauguaacuauuuuuaaaguaaauauuuacuuaaucugga

SEQ ID NO: 269108 - RNA, 64 nt, Homo Sapiens
acuacucauauccuuuaaacuguggagggaauauuuuuuaaagcauuaaagguggcauggagac

SEQ ID NO: 269109 - RNA, 64 nt, Homo Sapiens
guuaacucuuaguuuuuacucccuggagucaguuuuuuuaaaaaguaauauaauaauguccuuu

SEQ ID NO: 269110 - RNA, 64 nt, Homo Sapiens
cugcuccugaaaaaugacugauuauacaucuguauuuuuaaauuucuugcuuguaaaaauaugu

SEQ ID NO: 269111 - RNA, 64 nt, Homo Sapiens
aaacuugcacuuguuuuucuaucagccuauuauuuuuuuaaagaccccuucgauagcaaguccc

SEQ ID NO: 269112 - RNA, 64 nt, Homo Sapiens
gcccaacuuuuuuuuuuuaaaacgcugguuuugguuuuuaaaaaacgaagggacaucuuuggaa

SEQ ID NO: 269113 - RNA, 64 nt, Homo Sapiens
gacaaaaacaaaacaacaaccccgcucccuaaauuuuuuaaaaaucucccuuccccgugguggc

SEQ ID NO: 269114 - RNA, 64 nt, Homo Sapiens
aaaaugcaaaaaaauucuuauaagugucgauguuuuuuuaaaaaagcuuagagauguagcgaug

SEQ ID NO: 269115 - RNA, 64 nt, Homo Sapiens
ucagaacugagguagcuuagggaaaagcaggugcuuuuuaaaaauagaagcaagaugaaaaaaa

SEQ ID NO: 269116 - RNA, 64 nt, Homo Sapiens
cugaaaauuuagaagcaagacauauaauuuauauuuuuuaaaaguauuuuccaacuuguauuuu

SEQ ID NO: 269117 - RNA, 64 nt, Homo Sapiens
cacacguuaacuucagaggauguugcguuuaugcuuuuuaaaaaggugguuuauacacuggaaa

SEQ ID NO: 269118 - RNA, 64 nt, Homo Sapiens
ucauccaugaaaaagugucuaauguguccaaucauuuuuaaaaagcuuaacagagaaagagacu

SEQ ID NO: 269119 - RNA, 64 nt, Homo Sapiens
aaaaaucuuuaaacuggccuaaagguuuaaacuuuuuuuaaaaagauuguuuaaucuuuuuaaa

SEQ ID NO: 269120 - RNA, 64 nt, Homo Sapiens
agguuuaaacuuuuuuuaaacugauuguuuaaucuuuuuaaaaauugaguaccuuuuugcuagc

SEQ ID NO: 269121 - RNA, 64 nt, Homo Sapiens
aaauuuuguuuuucuguaauuuugauguaacaauuuuuuaaauacagauuugaaggaaaaaaau

SEQ ID NO: 269122 - RNA, 64 nt, Homo Sapiens
agcaacggucccuaauagagauaucucaagguauuuuuuaaaaaagugaugacuucuaaugcuu

SEQ ID NO: 269123 - RNA, 64 nt, Homo Sapiens
acagcauguugcaguuucuuuucgguuuugguuuuuuuuaaauguuuuauuuugcuuucccagc

SEQ ID NO: 269124 - RNA, 64 nt, Homo Sapiens
gaauucaggucaguuucaguauuuuucaaauauuuuuuuaaaacugaauugcaauugugccaag

SEQ ID NO: 269125 - RNA, 64 nt, Homo Sapiens
uucaaauauucugggauaagguagcaagaucuuguuuuuaaacaaucucuugaaggcaauucca

SEQ ID NO: 269126 - RNA, 64 nt, Homo Sapiens
uccuuggacuuuuagcuguuaaaugguaucucauuuuuuaaaacacauuucacauuuaaaguca

SEQ ID NO: 269127 - RNA, 64 nt, Homo Sapiens
augccaacguugucuuugauaauauuuaauauauuuuuuaaaaaacaauucuuguaaaauacuu

SEQ ID NO: 269128 - RNA, 64 nt, Homo Sapiens
cuaucuaaaguuuguuagauagcugcauguggcuuuuuuaaaaaagcaacagaaaccuauccuc

SEQ ID NO: 269129 - RNA, 64 nt, Homo Sapiens
aaacacagucaaaauaauucuaaaucccucgauauuuuuaaagaucuguaaguaacuucacauu

SEQ ID NO: 269130 - RNA, 64 nt, Homo Sapiens
cauuagagucaaccccuucuuuuuuuuuuuuuuuuuuuuaaauccaguauuuaggauaauauuu

SEQ ID NO: 269131 - RNA, 64 nt, Homo Sapiens
agugauauaaaaaccagcaguuuuuacacuaaauuuuuuaaagaaauauuagacaaaaauauag

SEQ ID NO: 269132 - RNA, 64 nt, Homo Sapiens
uauuauccauuugaucuauagcaaugugauuuuauuuuuaaaaagaaaagcaguguguuuucuu

SEQ ID NO: 269133 - RNA, 64 nt, Homo Sapiens
guaucugcgaaguaaucugcaaucucuuuuguucuuuuuaaaauuugauuuguuauaaaauugc

SEQ ID NO: 269134 - RNA, 64 nt, Homo Sapiens
augucaugauguaauuuuucuuucuucuuucuuuuuuuuaaauuuuagcaguggcuuauuauuu

SEQ ID NO: 269135 - RNA, 64 nt, Homo Sapiens
cauguaacauguuaaaagguuaaacuuauggcuauuuuuaaagggcuauucauuuaaucugagu

SEQ ID NO: 269136 - RNA, 64 nt, Homo Sapiens
uuauauuucuuauucagaacccuugaugagacuauuuuuaaacauacuagucugcugauagaaa

SEQ ID NO: 269137 - RNA, 64 nt, Homo Sapiens
gcuuguagaauuaguguauuuuuauuaaacuauuuuuuuaaaugucaaacuucuaucauguaaa

SEQ ID NO: 269138 - RNA, 64 nt, Homo Sapiens
ccuaauguuugucauaacuguuaauggaugaaauuuuuuaaagauacaaccaugauaaccauua

SEQ ID NO: 269139 - RNA, 64 nt, Homo Sapiens
guuucccccaacucccccauuuuugguuuguuucuuuuuaaauauuuguugaguacuuacgugu

SEQ ID NO: 269140 - RNA, 64 nt, Homo Sapiens
uuaugagauuuucucaccccacaucgcuccccuuuuuuuaaaaaggacuguuuugcuaguguga

SEQ ID NO: 269141 - RNA, 64 nt, Homo Sapiens
gauaggguuucauuuauuucuauacuuuuucuguuuuuuaaacaccugcauauuuuuauguaaa

SEQ ID NO: 269142 - RNA, 64 nt, Homo Sapiens
gaauugguagaugaaaaaaaccugguucaaguuuuuuuuaaaauguggugucccauuccaaggg

SEQ ID NO: 269143 - RNA, 64 nt, Homo Sapiens
aaaacugguggaaaaaagagaccaacuuuguuauuuuuuaaauuauugauuuuuaaauuauggg

SEQ ID NO: 269144 - RNA, 64 nt, Homo Sapiens
aagagaccaacuuuguuauuuuuuaaauuauugauuuuuaaauuaugggagcaaauccaucucc

SEQ ID NO: 269145 - RNA, 64 nt, Homo Sapiens
augguguuaacuuuucguugcugaagagcuuaacuuuuuaaaggcuuuguccuauacauuuaga

SEQ ID NO: 269146 - RNA, 64 nt, Homo Sapiens
gaauggcuuuauuuacuuuggugacuguuuauaguuuuuaaauaaaagacugaacauuuucuug

SEQ ID NO: 269147 - RNA, 64 nt, Homo Sapiens
auguuuuuuuaaccaugaaaugacaauaaaaugauuuuuaaaaugagaauguuuuggauaagug

SEQ ID NO: 269148 - RNA, 64 nt, Homo Sapiens
agugauaggaucccaaaauucaucucuaaugugguuuuuaaaugcuggaggauuccaaucaaua

SEQ ID NO: 269149 - RNA, 64 nt, Homo Sapiens
uuaaguguuaaauaauguagaaguaaaaaaauuuuuuuuaaaggcuuaauuugggaggggggac

SEQ ID NO: 269150 - RNA, 64 nt, Homo Sapiens
uacucaguuugaaacuauucauuucuacacacuauuuuuaaaaauugccuacuaggugaaacau

SEQ ID NO: 269151 - RNA, 64 nt, Homo Sapiens
acuuaauuacugcacuuaaaaugaaacauuacuuuuuuuaaacaaugugucacaaauguagguc

SEQ ID NO: 269152 - RNA, 64 nt, Homo Sapiens
gauagcuugaauauuauuucacauuccuuuuucuuuuuuaaauaaacagguuugcuuuggaaag

SEQ ID NO: 269153 - RNA, 64 nt, Homo Sapiens
aaauucaccugauuauuagauaacuuaaaguuuauuuuuaaaagcugacaacuuuuuaugaauc

SEQ ID NO: 269154 - RNA, 64 nt, Homo Sapiens
gguguauuuuauaaacuaaagcugccuauguuucuuuuuaaagcucgcauucccagaaucagcu

SEQ ID NO: 269155 - RNA, 64 nt, Homo Sapiens
guuaaaucguauuauuuuuuucuuaacagaaauauuuuuaaaaaugaaaaaguacucaaaagug

SEQ ID NO: 269156 - RNA, 64 nt, Homo Sapiens
uuaccccacuguaacaucauguaaacuaaguauguuuuuaaacaauuuuuaagacuuguaauua

SEQ ID NO: 269157 - RNA, 64 nt, Homo Sapiens
caucuguaauuuaaauguuucuaguaaccacauuuuuuuaaaaguaaaaagaaacccaugguau

SEQ ID NO: 269158 - RNA, 64 nt, Homo Sapiens
uuuuuuauuuauuugaaguuagacuagauauacguuuuuaaauuuaacaucuggcuggacagug

SEQ ID NO: 269159 - RNA, 64 nt, Homo Sapiens
aaacucaccaucuccugaagaccuuucuuaccuuuuuuuaaaaacaaaaaaugaaauuauuuug

SEQ ID NO: 269160 - RNA, 64 nt, Homo Sapiens
aagaguauugaagauugaaaggguuuuucuuucuuuuuuaaaaaagaaaaacaaacuauugauu

SEQ ID NO: 269161 - RNA, 64 nt, Homo Sapiens
uuacaauuaugaauggaggauauucuacuguacuuuuuuaaaaagaaacuauuuuuguguuuga

SEQ ID NO: 269162 - RNA, 64 nt, Homo Sapiens
uuuuccuaaguuuuuuucauuuuuuugaaugaguuuuuuaaauuuuuuagaugaccaaaacuug

SEQ ID NO: 269163 - RNA, 64 nt, Homo Sapiens
aguguucuuuugaaauguucaucaggaauaggcuuuuuuaaaaaauguuguguaucuguauaua

SEQ ID NO: 269164 - RNA, 64 nt, Homo Sapiens
cugaaugcaaaaaggaaaaaaacccacaaacauguuuuuaaaauaaaauaucuuuuuuugccuu

SEQ ID NO: 269165 - RNA, 64 nt, Homo Sapiens
ugacuuuaucuaggaguuuguuuuucauuuuguuuuuuuaaaguauuagaaaagguuuuagcug

SEQ ID NO: 269166 - RNA, 64 nt, Homo Sapiens
gugauauuuuccucaauggcaaauuuuaaauuaguuuuuaaaaacuuacuuauuuggguaguua

SEQ ID NO: 269167 - RNA, 64 nt, Homo Sapiens
aauuugaaucacuccugaauacagaggcauauucuuuuuaaacuauaaauaccauuuugaguga

SEQ ID NO: 269168 - RNA, 64 nt, Homo Sapiens
aauaggaaaauuccuguuuggcuuuuugucuuccuuuuuaaaugcuuuuuguauguaauauuuu

SEQ ID NO: 269169 - RNA, 64 nt, Homo Sapiens
gcugaguaaauuuuacuuguaaucuacaauuggcuuuuuaaaaauaaccuguugauauauaauu

SEQ ID NO: 269170 - RNA, 64 nt, Homo Sapiens
uuauucauauaaugacuuuuuuuuaagagucucuuuuuuaaaaaaacuuaauucucuaaaaccg

SEQ ID NO: 269171 - RNA, 64 nt, Homo Sapiens
cuuaauucucuaaaaccgaaaugguucaugcuucuuuuuaaaaaugauuguauaaaauguaugg

SEQ ID NO: 269172 - RNA, 64 nt, Homo Sapiens
uuuugacaggguacagaguauuuuacuaaaaguauuuuuaaauguuucucaugugauuucugua

SEQ ID NO: 269173 - RNA, 64 nt, Homo Sapiens
auuucuguaccuucuuccuccugccccuuuugcuuuuuuaaagaaacuggggaaggauuuauga

SEQ ID NO: 269174 - RNA, 64 nt, Homo Sapiens
aucaaauaguuuucucuuugugucuguguuaguguuuuuaaagcugcucauuucauuuugucca

SEQ ID NO: 269175 - RNA, 64 nt, Homo Sapiens
guuuugacuacuaauugggggaaauuuuagauaauuuuuaaauucaaaguuauuuauaaaaugc

SEQ ID NO: 269176 - RNA, 64 nt, Homo Sapiens
cugguuuuauaagguuguuuuuaccacaguggucuuuuuaaaccaccugcccacucccuuaaca

SEQ ID NO: 269177 - RNA, 64 nt, Homo Sapiens
gcacagucuacuggguagguauuguaaauaauaauuuuuaaaacuugcacaaaucaaaacaaac

SEQ ID NO: 269178 - RNA, 64 nt, Homo Sapiens
gcuauuaauaguaucagauacagaacccucauaauuuuuaaaugaucugaauuuggcagugaau

SEQ ID NO: 269179 - RNA, 64 nt, Homo Sapiens
uaaacccaacucuucaugauuugccugugacuuauuuuuaaaacuuuuuuaaaaaagauuuagc

SEQ ID NO: 269180 - RNA, 64 nt, Homo Sapiens
cuucaugauuugccugugacuuauuuuuaaaacuuuuuuaaaaaagauuuagcuuuaaaauagu

SEQ ID NO: 269181 - RNA, 64 nt, Homo Sapiens
agaauaaaauaguuaagcauuaauguaguugaacuuuuuaaauuuuugaauuggaaaaaaauuc

SEQ ID NO: 269182 - RNA, 64 nt, Homo Sapiens
gaaaccugaucuuuccuaauccucacuuuuuucuuuuuuaaaaagcaguuucuccacugcuaaa

SEQ ID NO: 269183 - RNA, 64 nt, Homo Sapiens
auacaauccuuugcauuguuaaggagguuuuuuguuuuuaaauggugggucaaggagcuaguuu

SEQ ID NO: 269184 - RNA, 64 nt, Homo Sapiens
cauaguaguuguauggacuucuaaccaguugaguuuuuuaaagcauugaggauuuuuuccucuu

SEQ ID NO: 269185 - RNA, 64 nt, Homo Sapiens
gaggauuuuuuccucuuaccaacuccucuucagguuuuuaaagacccagcccuucccaaucuca

SEQ ID NO: 269186 - RNA, 64 nt, Homo Sapiens
aucugaagagucaaaugguuuugugacuccauaguuuuuaaaguaauaagggucaaagacuaca

SEQ ID NO: 269187 - RNA, 64 nt, Homo Sapiens
aagggucaaagacuacaucagagauucaaauagguuuuuaaagaaaagcuaagcaagagagcca

SEQ ID NO: 269188 - RNA, 64 nt, Homo Sapiens
uucuuagguaaaguucuucugaaagaauuuucuauuuuuaaaaaauguaucucuuuagccuuuu

SEQ ID NO: 269189 - RNA, 64 nt, Homo Sapiens
gaaauaaucuggcaaauuuuuaggggugggaacuuuuuuaaauguucauuuaaaaaaaaacaaa

SEQ ID NO: 269190 - RNA, 64 nt, Homo Sapiens
ucuguguuugagauuuuucuuuauuucuuuuuuuuuuuuaaauaguaagucacagguccacacu

SEQ ID NO: 269191 - RNA, 64 nt, Homo Sapiens
guuacuagccagagaguaugacuauguuagauuauuuuuaaagaugaaacauguaugauaggau

SEQ ID NO: 269192 - RNA, 64 nt, Homo Sapiens
uguugauaauuuuacugaucuaaagcugagugauuuuuuaaaagaauuugaauuuggcuuccuc

SEQ ID NO: 269193 - RNA, 64 nt, Homo Sapiens
uaucgccaugcaaauuacaaucuugaaugaguguuuuuuaaaaauaaaguauuagaaaaaugug

SEQ ID NO: 269194 - RNA, 64 nt, Homo Sapiens
uaaaauuguccuuguguauaacgugugaaucauuuuuuuaaacugaaauuuaaaaugcaacaua

SEQ ID NO: 269195 - RNA, 64 nt, Homo Sapiens
uuacacacuuaaucuuagcggauuacuucagauguuuuuaaaaaguauauuaagaugccuuuuc

SEQ ID NO: 269196 - RNA, 64 nt, Homo Sapiens
gucucaacaggcgcucacugaaguguaugaauauuuuuuaaaaagguuuuugcaguaagcuagu

SEQ ID NO: 269197 - RNA, 64 nt, Homo Sapiens
gauaauauuuuccaacagcugaaguagggauaguuuuuuaaaaaauuuaaugauggguaaucaa

SEQ ID NO: 269198 - RNA, 64 nt, Homo Sapiens
gacauacaacaaaugguuaucccacuuguauauuuuuuuaaagacucuuauccuguuacccuua

SEQ ID NO: 269199 - RNA, 64 nt, Homo Sapiens
uaaaaaucaguuauggcacaauaaagauuuucuguuuuuaaauuguauuucaucugcuuccucc

SEQ ID NO: 269200 - RNA, 64 nt, Homo Sapiens
uuuauucugaugauaaaaacaguuagccagacuguuuuuaaagcaccuggcgggaagcagaagg

SEQ ID NO: 269201 - RNA, 64 nt, Homo Sapiens
uuggucaaucuucauagauguuaaauagaaagccuuuuuaaaaucuguaacauuuuucuauugu

SEQ ID NO: 269202 - RNA, 64 nt, Homo Sapiens
gcuagguuuuuacugauuauugcacuaccuacauuuuuuaaauacuugaucuuacccaugaaug

SEQ ID NO: 269203 - RNA, 64 nt, Homo Sapiens
aucaucauaauccuuugcuuucuuacucuguuuauuuuuaaauguuuaagugguaaggauuuuc

SEQ ID NO: 269204 - RNA, 64 nt, Homo Sapiens
ggugaauuuaagugguaaggaagacggaaaaguguuuuuaaaauggagcacucauuaaaggcag

SEQ ID NO: 269205 - RNA, 64 nt, Homo Sapiens
ucugauuauuauuggauggagcucagaaauuauauuuuuaaaugacaacuuaaccaaguauagg

SEQ ID NO: 269206 - RNA, 64 nt, Homo Sapiens
gaaaaaaguuuuguuuuguuguuuugugcuacaauuuuuaaaaagcuugugaauguguuuuguu

SEQ ID NO: 269207 - RNA, 64 nt, Homo Sapiens
aacuuuauggcuguuuguucucaacuuuuuuuuuuuuuuaaauaaagcacugaagucuuacccg

SEQ ID NO: 269208 - RNA, 64 nt, Homo Sapiens
aagcuaaauuacauagacuuuccuuguugaaguuuuuuuaaaaauacagccuuaaagacaaaaa

SEQ ID NO: 269209 - RNA, 64 nt, Homo Sapiens
augaagugaaaaaguuuuacagacauuaauuuuuuuuuuaaacauuuggggugguggugugcca

SEQ ID NO: 269210 - RNA, 64 nt, Homo Sapiens
uuacuuuuaaauauuaacucagaaaacaaacucuuuuuuaaaaaagcauugcuuuuguuucuua

SEQ ID NO: 269211 - RNA, 64 nt, Homo Sapiens
agugucuuacucccucuucuagauguuuuguggcuuuuuaaagaacuggcugugguuuuucaua

SEQ ID NO: 269212 - RNA, 64 nt, Homo Sapiens
auaaaacauauuucuagauagugcauugcaauuuuuuuuaaagcaucagaaaaaaauuuuugga

SEQ ID NO: 269213 - RNA, 64 nt, Homo Sapiens
acuggagagaauuuauauguuauuuagauaccaauuuuuaaaauaaccuaguucaaaaugaaau

SEQ ID NO: 269214 - RNA, 64 nt, Homo Sapiens
aacuuaagaaauuuagauuauuguuuuucucugauuuuuaaauacuuguuuuuauccccuuggg

SEQ ID NO: 269215 - RNA, 64 nt, Homo Sapiens
aagaggcaagaaaauaaaaacaaaauuggugguuuuuuuaaaaauauauauuucaagcuuauuu

SEQ ID NO: 269216 - RNA, 64 nt, Homo Sapiens
ucuaauaaucuucaucucaacuguucaacugauauuuuuaaaauuagcucaaauaucuguugca

SEQ ID NO: 269217 - RNA, 64 nt, Homo Sapiens
guucauacuuaccuaaaauugcauaugaaauguuuuuuuaaacauuacuauguuguaauucuuu

SEQ ID NO: 269218 - RNA, 64 nt, Homo Sapiens
uagcuuuauuuaucaacccaguauuaccuacagauuuuuaaauuaauauuuaugccacuacagu

SEQ ID NO: 269219 - RNA, 64 nt, Homo Sapiens
ucaauacuuuuauaacuguuuuacauguuacuacuuuuuaaauuagcagucucuguaucaaugu

SEQ ID NO: 269220 - RNA, 64 nt, Homo Sapiens
agaauuuagaguauuugggguguggguugacagauuuuuaaaauguaaagcauauuagaauaau

SEQ ID NO: 269221 - RNA, 64 nt, Homo Sapiens
uaauguuauagaagacucauuucacuucuguguguuuuuaaaaucuuuuuggaaaauagcacuu

SEQ ID NO: 269222 - RNA, 64 nt, Homo Sapiens
uccagcuuuuaguacaggagauuguaauacuaguuuuuuaaaaguuaaagucaucacauuaaac

SEQ ID NO: 269223 - RNA, 64 nt, Homo Sapiens
augggagugggcaacagugaaagaaagaagauaauuuuuaaagaagauugauuguccuggggcu

SEQ ID NO: 269224 - RNA, 64 nt, Homo Sapiens
gggaggggaaggcuuuaaugucuuaaaguugauuuuuuuaaaggagcaaaucucucuccaaaau

SEQ ID NO: 269225 - RNA, 64 nt, Homo Sapiens
auguagaaagaagaaucaagaguguccaauuucauuuuuaaaaguuauuuuaaagaaaaacacu

SEQ ID NO: 269226 - RNA, 64 nt, Homo Sapiens
uuccauuguuaacugaauguaaagaaaacuauuuuuuuuaaauauaccacaaguuacaauuuga

SEQ ID NO: 269227 - RNA, 64 nt, Homo Sapiens
cugaauguguucaccauuuagggauaugcuuuuuuuuuuaaagauguauguauaaaauuucaca

SEQ ID NO: 269228 - RNA, 64 nt, Homo Sapiens
cuuacuagcucugaaauauauuuugagacacuaauuuuuaaauauuucccuuaugauguccccu

SEQ ID NO: 269229 - RNA, 64 nt, Homo Sapiens
aauaccaauuuaauuuuuuagcacaguuuguauauuuuuaaaugaaugcacuuuaguauaaagg

SEQ ID NO: 269230 - RNA, 64 nt, Homo Sapiens
cagggucuugcuauauugccugcccuauuuuuuuuuuuuaaagacaccauggcaugcgccacca

SEQ ID NO: 269231 - RNA, 64 nt, Homo Sapiens
gggucucacucuguugcccauggggauuuuuuuuuuuuuaaacagcuggggaugguaggauugc

SEQ ID NO: 269232 - RNA, 64 nt, Homo Sapiens
ucuacauucuuucuaauaaaugacaguggggauuuuuuuaaaugaaaaccucaauuuauguuca

SEQ ID NO: 269233 - RNA, 64 nt, Homo Sapiens
gcuucacuaaggguugauauuucaaccuguuuguuuuuuaaaaguugccuacuuuaacccauuu

SEQ ID NO: 269234 - RNA, 64 nt, Homo Sapiens
uaaaaaaaaaaaucugucacggagguugguuuuguuuuuaaauauguuuggggguuauuugggg

SEQ ID NO: 269235 - RNA, 64 nt, Homo Sapiens
ucuucuccuaucauaaaauuccucuucuaucauuuuuuuaaaucccacugugccuggcuuccau

SEQ ID NO: 269236 - RNA, 64 nt, Homo Sapiens
gaaguuacuucauuauauuucugccuuguaccauuuuuuaaauauaaagcauuuuaaauaauac

SEQ ID NO: 269237 - RNA, 64 nt, Homo Sapiens
auuuuuuaacuuuguuuuaucauauaagaauaccuuuuuaaacuuuuauacugggaaugaugcu

SEQ ID NO: 269238 - RNA, 64 nt, Homo Sapiens
gaguuaugaauuuuaaaaggagagaaucuuauguuuuuuaaaugugaacuuuuauuuaaaagag

SEQ ID NO: 269239 - RNA, 64 nt, Homo Sapiens
auguucuuuaaaucaacacuaucaugcuucucauuuuuuaaacuuuugagauuugaaauuauac

SEQ ID NO: 269240 - RNA, 64 nt, Homo Sapiens
acuguccuaucucauuuuaaauuucuuccaguauuuuuuaaaaacuugaacauuauucacuuag

SEQ ID NO: 269241 - RNA, 64 nt, Homo Sapiens
ucagacaugaacuugcaugucuugaaaucaagacuuuuuaaaagaagggauuucauggccucuu

SEQ ID NO: 269242 - RNA, 64 nt, Homo Sapiens
cucaauacaauauauuuugaaaaauugcucuuaauuuuuaaacuagauguuuguuacauuuuua

SEQ ID NO: 269243 - RNA, 64 nt, Homo Sapiens
uugcucuuaauuuuuaaacuagauguuuguuacauuuuuaaaaagauuuuauugucagauauuu

SEQ ID NO: 269244 - RNA, 64 nt, Homo Sapiens
uaaccuccauuaacuaagcaugaauuuaacuguauuuuuaaauugggauuuucagaaguuagcc

SEQ ID NO: 269245 - RNA, 64 nt, Homo Sapiens
acaggaaacugauauuuuaagacuagguaauuuuuuuuuaaaggguuuuuguauuuucuuggua

SEQ ID NO: 269246 - RNA, 64 nt, Homo Sapiens
uucuuuuuagagcaaauguuaguuguguucuuuauuuuuaaaauucuucuaagacuaaauaggu

SEQ ID NO: 269247 - RNA, 64 nt, Homo Sapiens
uuuacauaaguuuuuuuuaaaauggcaaauugcuuuuuuaaaagugaauacaucgagagagaua

SEQ ID NO: 269248 - RNA, 64 nt, Homo Sapiens
acgcucuaggaaaguaauugcuuguuuguuauuauuuuuaaaggauuaagugaauucuagguag

SEQ ID NO: 269249 - RNA, 64 nt, Homo Sapiens
gacaaauaaaaacaguguuuaaagugugcuuacauuuuuaaaaauagugaaaagugacacuuca

SEQ ID NO: 269250 - RNA, 64 nt, Homo Sapiens
uucucuuuuuauuuauuuuuuuauuuuuuacuuauuuuuaaauuugcuuuuuaaaaauauuuuu

SEQ ID NO: 269251 - RNA, 64 nt, Homo Sapiens
uauuuuuuuauuuuuuacuucuugcccaggcugcuuuuuaaaaauccuaaacccacccacuucu

SEQ ID NO: 269252 - RNA, 64 nt, Homo Sapiens
uauuuuuacugguuuuauacggaaguaaacgcuuuuuuuaaaaguuuccaaacuaaauuacucg

SEQ ID NO: 269253 - RNA, 64 nt, Homo Sapiens
cuuuagacucugaaaguaauuugaaccaauuuuguuuuuaaaacucguuucguuuugauaauug

SEQ ID NO: 269254 - RNA, 64 nt, Homo Sapiens
uccuuuucuccucaucauuguaaucuuuguauauuuuuuaaaaauuuugcaucccaaauguuuu

SEQ ID NO: 269255 - RNA, 64 nt, Homo Sapiens
acauuucagcuucuuuacucuucauggcaauguuuuuuuaaaagaugcccuuuuauuaaauaaa

SEQ ID NO: 269256 - RNA, 64 nt, Homo Sapiens
uuuugaaaacuugcuaauaaaagcaacuguuuaauuuuuaaaauuuuacuacuuaaugguuuug

SEQ ID NO: 269257 - RNA, 64 nt, Homo Sapiens
aaaaaaagcaaagcuuucugaauguagauuuauuuuuuuaaaaaacagaagacacacuuguacg

SEQ ID NO: 269258 - RNA, 64 nt, Homo Sapiens
acuaaaccagaagagacuuuuggaggcuagaaacuuuuuaaaaagugaagucucagcuuugagc

SEQ ID NO: 269259 - RNA, 64 nt, Homo Sapiens
gccaaaacauauagaaaugucaggaaacuggaauuuuuuaaaguuagagcaagaagaccucaga

SEQ ID NO: 269260 - RNA, 64 nt, Homo Sapiens
caauuuuuuuuagaaacauauguuuaaaaguucuuuuuuaaacuacaguucccacauuagauac

SEQ ID NO: 269261 - RNA, 64 nt, Homo Sapiens
gucuggacucaaaaaaugcuagcaaacacuacuuuuuuuaaaacuuaaagggcuaaauuauaua

SEQ ID NO: 269262 - RNA, 64 nt, Homo Sapiens
uagaaggcuccauuguuuugcaggaguuggaaauuuuuuaaaguugaauuugggggugcagggg

SEQ ID NO: 269263 - RNA, 64 nt, Homo Sapiens
auaaaaacaacaauucuauaagcauagacauauuuuuuuaaagugaaaaaaagaaaaaaaagaa

SEQ ID NO: 269264 - RNA, 64 nt, Homo Sapiens
uuuguuaaaauaugcuugacgcuguauauacauuuuuuuaaaagaaacuuuacucuuauucuua

SEQ ID NO: 269265 - RNA, 64 nt, Homo Sapiens
gcuggggcaaacaaagcaacaaaaagagcuguauuuuuuaaaguuaacuguucuuccuggcgcu

SEQ ID NO: 269266 - RNA, 64 nt, Homo Sapiens
gcaaacugguguguauucucccccuaugugggauuuuuuaaaaaugauuuaaaauuaugcaggg

SEQ ID NO: 269267 - RNA, 64 nt, Homo Sapiens
uagugucacagucucucuugaaggacuuugccgcuuuuuaaaacuccaagcauguauguagaga

SEQ ID NO: 269268 - RNA, 64 nt, Homo Sapiens
aaaacucaguauuauuuuugugacgguuuaaaacuuuuuaaaagcuacaaaaagaaacauuuaa

SEQ ID NO: 269269 - RNA, 64 nt, Homo Sapiens
uaaaagcuguacauuucuggauauuucagaaccuuuuuuaaauguguccagcaugcuuguaugu

SEQ ID NO: 269270 - RNA, 64 nt, Homo Sapiens
ggcuguuuuuaaugcaggggaacuuugaauuuuuuuuuuaaauguuuuucccggaauucaucag

SEQ ID NO: 269271 - RNA, 64 nt, Homo Sapiens
auuaauggcuaauugaaguauuuaaaaaaaugccuuuuuaaagcgagccuuuguggugggacuu

SEQ ID NO: 269272 - RNA, 64 nt, Homo Sapiens
aaugccuuuuuaaagcauuacuuuguggugggacuuuuuaaaaaauuaguacuugaaguugagc

SEQ ID NO: 269273 - RNA, 64 nt, Homo Sapiens
uaagaaccagcucaaguacaccauaaucugggacuuuuuaaaaagccuguggguuaccugaacu

SEQ ID NO: 269274 - RNA, 64 nt, Homo Sapiens
uuuuccaaaacuuuucuccaaaaucauaaguuucuuuuuaaaaauuuggauccuguacucuaau

SEQ ID NO: 269275 - RNA, 64 nt, Homo Sapiens
ucuuucuucaugaaugcuucauguaucuagacuguuuuuaaauguuacugacccagcuguacau

SEQ ID NO: 269276 - RNA, 64 nt, Homo Sapiens
uaaaugggaauauaacacaguguuuuaucuuuuuuuuuuaaauuugugaaacacagauuucaag

SEQ ID NO: 269277 - RNA, 64 nt, Homo Sapiens
auuucuagguuugugaauguuuuuaaagaaaccuuuuuuaaacucuuuuuuuuuuuuuuuuuuu

SEQ ID NO: 269278 - RNA, 64 nt, Homo Sapiens
aaccuuuuuuaaacuauuucuuuuuuuuuuuuuuuuuuuaaagauccuuuacccuuucccuuuu

SEQ ID NO: 269279 - RNA, 64 nt, Homo Sapiens
uuuuauggguagaauuguagauuuguaagaaggauuuuuaaauuagggagcuuugaugcaacuu

SEQ ID NO: 269280 - RNA, 64 nt, Homo Sapiens
guuuuuaugccaaaaauccuuuugggacaauugcuuuuuaaaacagacccaaacccacgugcau

SEQ ID NO: 269281 - RNA, 64 nt, Homo Sapiens
auaaagcuuaauagcuuccauaaauacaauucaguuuuuaaaaauauagacuuguucuacauug

SEQ ID NO: 269282 - RNA, 64 nt, Homo Sapiens
guaucugucuccaauuuauauuuaaaaagcauuauuuuuaaauaaucucuuguauauuuuacua

SEQ ID NO: 269283 - RNA, 64 nt, Homo Sapiens
aucaacauuacuuuucuuuccaaaaaguacuuacuuuuuaaaccacacauuucaucugcugcuu

SEQ ID NO: 269284 - RNA, 64 nt, Homo Sapiens
uaaaagcauggucagaugcuugaggauuuuuuuuuuuuuaaagaguuacuuauauuuaagaaag

SEQ ID NO: 269285 - RNA, 64 nt, Homo Sapiens
uaguugaguagacugcaucacacuuaagugugaauuuuuaaauaguaaagugugaugacgauaa

SEQ ID NO: 269286 - RNA, 64 nt, Homo Sapiens
ggaauuggcugcuuaaagcccucuuuuuaaaaucuuuuuaaaaguaaauauaaaagauauuucu

SEQ ID NO: 269287 - RNA, 64 nt, Homo Sapiens
cuuuuuaaaagggaauuggcaagauauuucucucuuuuuaaaaugaauauguggguaaauauaa

SEQ ID NO: 269288 - RNA, 64 nt, Homo Sapiens
gcaaacaguguaaaaaaaguuuuagaaagagaaguuuuuaaaaaucaagagucacuaagcagaa

SEQ ID NO: 269289 - RNA, 64 nt, Homo Sapiens
ugggugcuugccaaagagauagggacgcauaugcuuuuuaaagcaaucuaaaaauaauaauaag

SEQ ID NO: 269290 - RNA, 64 nt, Homo Sapiens
uauaaacaucguuuuuuacuucuucugguagaauuuuuuaaagcauaauuggaauccuuggaua

SEQ ID NO: 269291 - RNA, 64 nt, Homo Sapiens
cugaacacaauuauuuguaaaaguuaguaguucuuuuuuaaaucauuaaaagaggcuugcugaa

SEQ ID NO: 269292 - RNA, 64 nt, Homo Sapiens
ccugagagugacuuugacauuagguccuuuguuguuuuuaaagaggcugcuggccacaggcaaa

SEQ ID NO: 269293 - RNA, 64 nt, Homo Sapiens
auuuaaauauuagaaauagcacaaagucauggaguuuuuaaaaauuguuauaauuaaguaaaaa

SEQ ID NO: 269294 - RNA, 64 nt, Homo Sapiens
uguuuuuuccacuuguauaugcacuaauuuuaauuuuuuaaagacuuuuucugaucuuugaacu

SEQ ID NO: 269295 - RNA, 64 nt, Homo Sapiens
uguauagcucuuuccuucaaauucaacuagagccuuuuuaaaaagacauuugccugcuagucag

SEQ ID NO: 269296 - RNA, 64 nt, Homo Sapiens
ccugcuagucagauacauuuacauuuaugcaaauuuuuuaaauaggagaaaauuaagaaauugu

SEQ ID NO: 269297 - RNA, 64 nt, Homo Sapiens
gcuuaucuuuccaaauaacauuuaauuauaauguuuuuuaaaaaauauauuccucuucagucau

SEQ ID NO: 269298 - RNA, 64 nt, Homo Sapiens
cucaaguuuaacucuacaaaaauuuguuacuuguuuuuuaaacucuauauauaaaguucgacuu

SEQ ID NO: 269299 - RNA, 64 nt, Homo Sapiens
cuucucuuaggcagcucugcacuucauguucaguuuuuuaaaaauagacuguaguauccuuuca

SEQ ID NO: 269300 - RNA, 64 nt, Homo Sapiens
aaaagagaaucugugggaaauaggcagauauagcuuuuuaaaauauaaaguacuugggauuuug

SEQ ID NO: 269301 - RNA, 64 nt, Homo Sapiens
augcugagaguuaaaauauucccagguuaaaauuuuuuuaaaguaccaauaauagagcuaaaua

SEQ ID NO: 269302 - RNA, 64 nt, Homo Sapiens
cuagucugacaucagaaaauaaaauugaggcugauuuuuaaaaauuucuaguagauuuuuggcc

SEQ ID NO: 269303 - RNA, 64 nt, Homo Sapiens
uuaaaaauuucuaguagauuuuuggccuuuccuguuuuuaaaaaucaguuucauuuucauauuu

SEQ ID NO: 269304 - RNA, 64 nt, Homo Sapiens
cagaacuugagauguggcagcacuggacuggguuuuuuuaaauguuaggacuaggaauguuugc

SEQ ID NO: 269305 - RNA, 64 nt, Homo Sapiens
gaguguuauguauuuccuggauguuuggaaacauuuuuuaaaacaagccaagaaagauguauau

SEQ ID NO: 269306 - RNA, 64 nt, Homo Sapiens
ggagauguuagacucaugguguguuacacaaugguuuuuaaauuuuguaaugaauuccuagaau

SEQ ID NO: 269307 - RNA, 64 nt, Homo Sapiens
gaaugaauuaggaagauuguauuuacuuaacuguuuuuuaaauacauguuuaaugaaauaaacu

SEQ ID NO: 269308 - RNA, 64 nt, Homo Sapiens
uggcuagaaauugcuguuuuuaauaaaugugaauuuuuuaaaaauaaagauuuuugcuuccuac

SEQ ID NO: 269309 - RNA, 64 nt, Homo Sapiens
uaaccccacccuuuacauuuugugcagugauuauuuuuuaaagucuucuuucauguaaguagca

SEQ ID NO: 269310 - RNA, 64 nt, Homo Sapiens
aucuuaagagaauccacauaaaagaagaaacuauuuuuuaaaaauucacuucuauauauacaau

SEQ ID NO: 269311 - RNA, 64 nt, Homo Sapiens
gaacuuacugauuauuuucuucauccaacuuauguuuuuaaaugaggauuauugauaguacucu

SEQ ID NO: 269312 - RNA, 64 nt, Homo Sapiens
uuuuaggaaaaucacuuugucuaacucagaauuauuuuuaaaaagaaaucuggucuuguuagaa

SEQ ID NO: 269313 - RNA, 64 nt, Homo Sapiens
auauauauaguuuuacuagguuuucauggauaaguuuuuaaauguaagacaggaaagggaucua

SEQ ID NO: 269314 - RNA, 64 nt, Homo Sapiens
gauucaacuacuguuuuuccuucagcugacuuuauuuuuaaacacccuuaaagacagauauauc

SEQ ID NO: 269315 - RNA, 64 nt, Homo Sapiens
aaaacaaaauucagcuuaaucguguacucagcauuuuuuaaauaacaauguuuauuugaacuaa

SEQ ID NO: 269316 - RNA, 64 nt, Homo Sapiens
uaaaugucauacacaaauacuaagacacuuugcauuuuuaaaaauuaagaaucauuugugaagu

SEQ ID NO: 269317 - RNA, 64 nt, Homo Sapiens
caauucacaaauagccauugaacaaauguguggguuuuuaaaaauuauauacauauaugaguug

SEQ ID NO: 269318 - RNA, 64 nt, Homo Sapiens
uucaaccucuuacaauaagcuaaacgcaaugucauuuuuaaaaagaaggacuuagggugucguu

SEQ ID NO: 269319 - RNA, 64 nt, Homo Sapiens
aaggggucuuaauugaaaugaaaauuuaauuuuguuuuuaaaauauuguuuaucuuuauuuauu

SEQ ID NO: 269320 - RNA, 64 nt, Homo Sapiens
cuauaaauauguguuguaugucuuuuuugcuuuuuuuuuaaaaaaaagaauaacuuuuuuugcc

SEQ ID NO: 269321 - RNA, 64 nt, Homo Sapiens
aguuagugguguuuugaagaggguauuuuauuguuuuuuaaaaaaagguucuuaaacauuauuu

SEQ ID NO: 269322 - RNA, 64 nt, Homo Sapiens
cuuucuguauccuuccuucuaccuauuauucugauuuuuaaaaaugcaguuaauguaccauuua

SEQ ID NO: 269323 - RNA, 64 nt, Homo Sapiens
cuccccuccccucccuucucauuccuuuucuuuguuuuuaaaggauguguuuguaugcauucug

SEQ ID NO: 269324 - RNA, 64 nt, Homo Sapiens
guuacagucucauauguaucccagcacauguaauuuuuuaaauaguuucugaauaaacacuuga

SEQ ID NO: 269325 - RNA, 64 nt, Homo Sapiens
aauggugugcuuuuggggagauacacuagcaauuuuuuuaaaaacuggaacagugugauaggaa

SEQ ID NO: 269326 - RNA, 64 nt, Homo Sapiens
uuuggaaagaaagcacuuaacauuuuaggaauucuuuuuaaagcugcuugcaaaguguugguga

SEQ ID NO: 269327 - RNA, 64 nt, Homo Sapiens
cuaguccaguuaugaaaucaguguaauacauugauuuuuaaaacugcugcuuuuuaugcuuuaa

SEQ ID NO: 269328 - RNA, 64 nt, Homo Sapiens
uauuacucugcuugcauuuaugaaacuaaccaguuuuuuaaacuuuaauucuuaaauuuauggu

SEQ ID NO: 269329 - RNA, 64 nt, Homo Sapiens
ccuaacauuucuaaacuggccacauaaccuuagauuuuuaaaggaauauuucagaguuuaaucu

SEQ ID NO: 269330 - RNA, 64 nt, Homo Sapiens
gucuugaaauuuugccaccacagaaagaaagauguuuuuaaaagcuuggcccaaagaauaggaa

SEQ ID NO: 269331 - RNA, 64 nt, Homo Sapiens
aguaugaggacuccuuguuaugccuuuaagguaauuuuuaaaaaaaaucugaguagagauagua

SEQ ID NO: 269332 - RNA, 64 nt, Homo Sapiens
aacaaagucuugaagguauuauuuuacaaguauauuuuuaaaguuguuuuauaagagagacuuu

SEQ ID NO: 269333 - RNA, 64 nt, Homo Sapiens
aauuacuauguaaacaaaaaguagauaguuucacuuuuuaaaaaauccauuacuguuuugcauu

SEQ ID NO: 269334 - RNA, 64 nt, Homo Sapiens
uauauggaugaaacauauuuuaauguuguuuacuuuuuuaaauacuugguugaucuucaaggua

SEQ ID NO: 269335 - RNA, 64 nt, Homo Sapiens
uauguugcacauagccuauacaguaccuacauaguuuuuaaauuauuguuuaaaaaacaaaaca

SEQ ID NO: 269336 - RNA, 64 nt, Homo Sapiens
ucuuucuuuuuuuucuuuuguuucaugauuuugauuuuuaaaauuauuagcacacaacuauuuu

SEQ ID NO: 269337 - RNA, 64 nt, Homo Sapiens
uuucauguuuuuaauauaagaaugaucuaauauuuuuuuaaaguaauagcuaucaguaauagcu

SEQ ID NO: 269338 - RNA, 64 nt, Homo Sapiens
guuagaaacuuuggcauaacucaauuuggaguauuuuuuaaaugcuguaucuuuaaagaaaagu

SEQ ID NO: 269339 - RNA, 64 nt, Homo Sapiens
ggugcaaaugggugacuuagugcauugauucagauuuuuaaaauuucuugaugugguuuguaau

SEQ ID NO: 269340 - RNA, 64 nt, Homo Sapiens
caacuacccauauuccagacucugagcuguuuccuuuuuaaaaaucauauagacaauuagcugu

SEQ ID NO: 269341 - RNA, 64 nt, Homo Sapiens
gcaauacaccucaaggaaaagguucagauuuuuauuuuuaaaauauuuucauuuuuuucuugaa

SEQ ID NO: 269342 - RNA, 64 nt, Homo Sapiens
uuuucuauaaauuacuaauuguaaaaagucuugcuuuuuaaaacaaguugguaaugcauaucau

SEQ ID NO: 269343 - RNA, 64 nt, Homo Sapiens
gauagaaacaacuagaaaggaaagugugacacaguuuuuaaauuuagauguagaaaauaaugaa

SEQ ID NO: 269344 - RNA, 64 nt, Homo Sapiens
cccauuuuccuauuauguuugauaauuauauguauuuuuaaaaacugugagaggaaaaauuagu

SEQ ID NO: 269345 - RNA, 64 nt, Homo Sapiens
guaaagauggaaaugacagagcacagacauuuauuuuuuaaauugauaggguagaaaaugaaau

SEQ ID NO: 269346 - RNA, 64 nt, Homo Sapiens
ccuuuguugaggugcaaggaguguaaaauguauauuuuuaaagaauguuaguaaaggaaccauu

SEQ ID NO: 269347 - RNA, 64 nt, Homo Sapiens
auucaguaacaaagguuuaaaguuugaagauuauuuuuuaaaaagguaaaugguuaaauuuuac

SEQ ID NO: 269348 - RNA, 64 nt, Homo Sapiens
uuuauuuaacauacugucuaauuuuaaaaauagguuuuuaaagcuuucauuuuuaaguuuauga

SEQ ID NO: 269349 - RNA, 64 nt, Homo Sapiens
aaagucacuaaacuuuuacacacucccaaacgucuuuuuaaaaauugcuugggaaauuauuaaa

SEQ ID NO: 269350 - RNA, 64 nt, Homo Sapiens
uugguuuucuaaaauuaaaaacugcauuuaagaauuuuuaaaaagguaacuauguucugaaaac

SEQ ID NO: 269351 - RNA, 64 nt, Homo Sapiens
auaagugguuauucucugacauaauguuuuaaucuuuuuaaaauauuguugauuugaggauaua

SEQ ID NO: 269352 - RNA, 64 nt, Homo Sapiens
aaaaacauuauuugugcccuuguuguuaaaauauuuuuuaaaacgauuuuuuuucuauuaaaac

SEQ ID NO: 269353 - RNA, 64 nt, Homo Sapiens
gcaacagaaaugcacuauaauuaaaaaauauuccuuuuuaaacaucuguaauacauuauguaau

SEQ ID NO: 269354 - RNA, 64 nt, Homo Sapiens
gccuuauugcucaaugaguucauguauauguauauuuuuaaacucugagaaacaaugaauagua

SEQ ID NO: 269355 - RNA, 64 nt, Homo Sapiens
uuguaagaaugugucauuucccaacuuugcuauuuuuuuaaaguccccaaauagaauuuuguaa

SEQ ID NO: 269356 - RNA, 64 nt, Homo Sapiens
acauaucuauuuggaauaaguaguuuuauaaugauuuuuaaaaaaugucacugauuauuucagu

SEQ ID NO: 269357 - RNA, 64 nt, Homo Sapiens
aaauuaauauuaguaaaauaccccauaauuucuuuuuuuaaaggguuuacuauaaaccuuuugc

SEQ ID NO: 269358 - RNA, 64 nt, Homo Sapiens
aagagauuugauuauuuuucuacuaagaagguuuuuuuuaaaaauuuuggacauuuaaccaaga

SEQ ID NO: 269359 - RNA, 64 nt, Homo Sapiens
acaaguuuggaauuuuuuucagaaauuccugcaauuuuuaaaaauuuuuguugauaaaauacga

SEQ ID NO: 269360 - RNA, 64 nt, Homo Sapiens
acaugucauuacuuuugcaauacauuaauauggauuuuuaaaucucaacccugaaacuaugguc

SEQ ID NO: 269361 - RNA, 64 nt, Homo Sapiens
ccacugucuuuagcuguccacccuaaaaugauuuuuuuuaaauacugaggauaaaaccuccauc

SEQ ID NO: 269362 - RNA, 64 nt, Homo Sapiens
uagaagcaaugaauguuuuccaauuugcaauuuuuuuuuaaacuaguccucaaaggguuaaggc

SEQ ID NO: 269363 - RNA, 64 nt, Homo Sapiens
aaaacagggaaaugguuuaagcacaaccuuaucauuuuuaaauauguacaaacuuuauacagaa

SEQ ID NO: 269364 - RNA, 64 nt, Homo Sapiens
cacaagagcacugaaucaaauacuuuuuguuccuuuuuuaaaaacaaaauuuugagucuugcau

SEQ ID NO: 269365 - RNA, 64 nt, Homo Sapiens
ucacauacacuuuuuuguaauuguaguguagauuuuuuuaaaguagagauaauaucaauucaua

SEQ ID NO: 269366 - RNA, 64 nt, Homo Sapiens
ggcaguggaugacugaauaguauuuagaaaagcauuuuuaaacuacuaauaggcuucuuggaau

SEQ ID NO: 269367 - RNA, 64 nt, Homo Sapiens
caaagaccauaguuuuaguuauuuuuugacuuucuuuuuaaagcugcagucauuaaaagucaaa

SEQ ID NO: 269368 - RNA, 64 nt, Homo Sapiens
cacucucuuauuuuucuacugcauuugauuauuuuuuuuaaauagagaacaggucuuucaaaaa

SEQ ID NO: 269369 - RNA, 64 nt, Homo Sapiens
ugugucuauuggggugggaauauuuuuagcaauguuuuuaaauuugaagacaugcuacaacuac

SEQ ID NO: 269370 - RNA, 64 nt, Homo Sapiens
ucuuagguauaacagcacaauugguuuuccucuguuuuuaaacaaacuuuaucaucuuucacuu

SEQ ID NO: 269371 - RNA, 64 nt, Homo Sapiens
caguuuaaaaagacuaaaacugcauuguuauuuuuuuuuaaacuucaaaacaguguuuaaaaau

SEQ ID NO: 269372 - RNA, 64 nt, Homo Sapiens
aaauaauuugugcugucacauauggauuuaaaaauuuuuaaacucccaguuauuaaugaaagaa

SEQ ID NO: 269373 - RNA, 64 nt, Homo Sapiens
aaucuugcuuucagcuuucacccauuggugauguuuuuuaaaaaaacugcaaaagucuaaaaua

SEQ ID NO: 269374 - RNA, 64 nt, Homo Sapiens
aauaguuguauauaacauacacauggauauaaguuuuuuaaaaauauauacccaucuacuccca

SEQ ID NO: 269375 - RNA, 64 nt, Homo Sapiens
uugauuuauaaauacaaaaauuugaaugagacaguuuuuaaaagaacacaggucuuuauucccu

SEQ ID NO: 269376 - RNA, 64 nt, Homo Sapiens
aaaaaacuugaaagaacacuaaagacugguuucuuuuuuaaaaguauauucaacaaaaaucuuc

SEQ ID NO: 269377 - RNA, 64 nt, Homo Sapiens
aaugagcacuuuucauucacaacauaaaccacauuuuuuaaaaaaaaagcaguugaguaacagc

SEQ ID NO: 269378 - RNA, 64 nt, Homo Sapiens
auuaagcaacaguguaaugauauucaaaaggaauuuuuuaaaacggacaauuuguguuggaugg

SEQ ID NO: 269379 - RNA, 64 nt, Homo Sapiens
ucuggacauucugaaauaauauauuacuagcucauuuuuaaauguugcacauauuaaccucaca

SEQ ID NO: 269380 - RNA, 64 nt, Homo Sapiens
aguaaacugaauauuuuuguuuuacucaauuuaguuuuuaaaauauagucuaaaucacaaauac

SEQ ID NO: 269381 - RNA, 64 nt, Homo Sapiens
gguguagacaauggugguuaaguaacaaacuuaauuuuuaaaaagugaaugacauuggacuuuu

SEQ ID NO: 269382 - RNA, 64 nt, Homo Sapiens
ugaaucucguacuguaucuugcuauuuuuccuuguuuuuaaaaauuuucaguguuuaaauuagu

SEQ ID NO: 269383 - RNA, 64 nt, Homo Sapiens
aaggcaaauaaguacuuaaauguaaaauggaauauuuuuaaauggcugccuaucuguagauagc

SEQ ID NO: 269384 - RNA, 64 nt, Homo Sapiens
aauguuugauucaaaacuuuuugcauucaguggcuuuuuaaaaauugcauuauuuauaauaaaa

SEQ ID NO: 269385 - RNA, 64 nt, Homo Sapiens
aaugggacucugauauaaaguaaaaagagauuuauuuuuaaauccucagaauuucuauucuuuc

SEQ ID NO: 269386 - RNA, 64 nt, Homo Sapiens
aauguuuuuauuuugcuguaauguagaauauugcuuuuuaaaauucaauaucuuaauguauuua

SEQ ID NO: 269387 - RNA, 64 nt, Homo Sapiens
gauaauuuuguaaaauugauagcauaucuaacacuuuuuaaauuuaauaauggaacaaaauaga

SEQ ID NO: 269388 - RNA, 64 nt, Homo Sapiens
uuuaaauaugguuuuaaccuuauguaauauaaaguuuuuaaaauauuuaguuucauuuuggcuu

SEQ ID NO: 269389 - RNA, 64 nt, Homo Sapiens
uauauauuuugacuaauguuauuagcuuuguuucuuuuuaaauggaaaaaaggaaccuucaauu

SEQ ID NO: 269390 - RNA, 64 nt, Homo Sapiens
aguaggacaaaguugucacaagagucaaagcucauuuuuaaagguuugugccuuaagagacuac

SEQ ID NO: 269391 - RNA, 64 nt, Homo Sapiens
ccaaaucagaggugcaggccaugucaauaguuguuuuuuaaaauaaugguuuauuuuuauuuaa

SEQ ID NO: 269392 - RNA, 64 nt, Homo Sapiens
aauguuguagaauacuuaaacaaaaagauuuaccuuuuuaaauacagauaacuugcugcuucaa

SEQ ID NO: 269393 - RNA, 64 nt, Homo Sapiens
uacagcauguuuugguuugauuuuuagugaauuuuuuuuaaacuguguauuuuuuucaacuaau

SEQ ID NO: 269394 - RNA, 64 nt, Homo Sapiens
aauuugaaaagucgauuaaaaugauagcucucuauuuuuaaaugaaauagcugagcuuucuaaa

SEQ ID NO: 269395 - RNA, 64 nt, Homo Sapiens
guugccuucuccaguggcagaucugacuucuguauuuuuaaaaaguaauauaacaugggcaaau

SEQ ID NO: 269396 - RNA, 64 nt, Homo Sapiens
auauuuuaauuacauuuaaaucauaaaguauguuuuuuuaaaauuuugaccugccugagaagcu

SEQ ID NO: 269397 - RNA, 64 nt, Homo Sapiens
uggugccagcaauucacgauguagagucuaauguuuuuuaaaaucuaagggagaggaucuuguc

SEQ ID NO: 269398 - RNA, 64 nt, Homo Sapiens
gcucuuggccaagaaggcugaguaugguucccaauuuuuaaauccauuucauuuuuuaaaaaau

SEQ ID NO: 269399 - RNA, 64 nt, Homo Sapiens
ugaguaugguucccaauuuuuaaauccauuucauuuuuuaaaaaauaagggaaauaaauguaau

SEQ ID NO: 269400 - RNA, 64 nt, Homo Sapiens
cacuuauucuagggcacacaaacacuauuuuacuuuuuuaaaaucauaaaacggcagaacagau

SEQ ID NO: 269401 - RNA, 64 nt, Homo Sapiens
ucucuuuccucucuauucgcuuucuccuguuuuuuuuuuaaaaaaaaagcaugaaaaaggaaga

SEQ ID NO: 269402 - RNA, 64 nt, Homo Sapiens
auccucaauaucaacuccaguuuaaaaaguguuauuuuuaaaacauuugaaaccaaguacuguu

SEQ ID NO: 269403 - RNA, 64 nt, Homo Sapiens
ucugcaauagaugacacugaugguuuuacuccuuuuuuuaaaaacacaugcgcgcgcacacaca

SEQ ID NO: 269404 - RNA, 64 nt, Homo Sapiens
aaaaguucuuaacauuuuuguguaauuuccuuucuuuuuaaaccauaaauuaguuuaaacugaa

SEQ ID NO: 269405 - RNA, 64 nt, Homo Sapiens
uaagauuuaagaaugauuaaaaauaagcuuuuacuuuuuaaaaccacuugagguuucauaaagc

SEQ ID NO: 269406 - RNA, 64 nt, Homo Sapiens
cugcaguucuaugguuuuguuucacuucuuuucuuuuuuaaagccauucuguucuuuggaugug

SEQ ID NO: 269407 - RNA, 64 nt, Homo Sapiens
ccuucugugcgaccaaugagacgacuucagcaucuuuuuaaaauaaucuaagcaucauugaagc

SEQ ID NO: 269408 - RNA, 64 nt, Homo Sapiens
aguaccuagcucugcucuuuuauauugcuuuaaauuuuuaaagaaauuguauugcauggaugug

SEQ ID NO: 269409 - RNA, 64 nt, Homo Sapiens
cccaaucuguaugaauaauguaaacuucgauuuuuuuuuaaaaaaauuagauuuuagcuggagc

SEQ ID NO: 269410 - RNA, 64 nt, Homo Sapiens
guugaaauacaguuuugaguuauuuugauguggcuuuuuaaaaaaguuaauggguagcuaaugu

SEQ ID NO: 269411 - RNA, 64 nt, Homo Sapiens
ucaaauguaaauguuuugaggauauuuuucuuguuuuuuaaaaucaauuuuuaaccaaauauua

SEQ ID NO: 269412 - RNA, 64 nt, Homo Sapiens
cacaaaauaacuggugucuuguaaauguucuguuuuuuuaaauaaaacuucucuacuuuagucu

SEQ ID NO: 269413 - RNA, 64 nt, Homo Sapiens
aauuaaacuguaaauaacuugcccugggggccuuuuuuuaaaaaacaaaaaccacaaaaauucc

SEQ ID NO: 269414 - RNA, 64 nt, Homo Sapiens
uugauacaaucauuaauggaucauacacaauagguuuuuaaaaauuaauaacuuuuaguaauua

SEQ ID NO: 269415 - RNA, 64 nt, Homo Sapiens
ugauacaaccauuaaugaaucauacacaauagguuuuuuaaaauuaauauuaauaacuuuuauu

SEQ ID NO: 269416 - RNA, 64 nt, Homo Sapiens
gguauauaaccacgacucugguggggaaaaccguuuuuuaaaggacacacacacacacagcgau

SEQ ID NO: 269417 - RNA, 64 nt, Homo Sapiens
ccuuccauuugcucacuucucucuucacccaucuuuuuuaaaaacaaauaaaugaauaaagcug

SEQ ID NO: 269418 - RNA, 64 nt, Homo Sapiens
caaguuaauuacaaacaguuuuguaacucuuugcuuuuuaaaucuuaaaaaaaaaaaaguugcu

SEQ ID NO: 269419 - RNA, 64 nt, Homo Sapiens
aggacacaucaaagcuggccaaaauaaugaauuuuuuuuaaaaagcaauaccugguuuccaccu

SEQ ID NO: 269420 - RNA, 64 nt, Homo Sapiens
uagucuauuagcuagaggguuuuggcuguugcuuuuuuuaaaguuagguccacacagugaaggg

SEQ ID NO: 269421 - RNA, 64 nt, Homo Sapiens
guacacaaaagcuaaagcaguggcuggggcuuuguuuuuaaauuuuggguuuuuuuuuuuguug

SEQ ID NO: 269422 - RNA, 64 nt, Homo Sapiens
gcauauaacuauauugauauuagaagauauuuguuuuuuaaaauauauugauguaugauaaaga

SEQ ID NO: 269423 - RNA, 64 nt, Homo Sapiens
aauuuauuguuuacauuggggaauguaucucaaauuuuuaaauagaagaguaauaaacagacuu

SEQ ID NO: 269424 - RNA, 64 nt, Homo Sapiens
uacgugguuuugugaauacuggcaaaagcaauuguuuuuaaauuaacaauggagagaaugauaa

SEQ ID NO: 269425 - RNA, 64 nt, Homo Sapiens
cauauaccaccuuaguucauuuuuuuaaauuuuguuuuuaaaaguaaagauugccuuuuuugaa

SEQ ID NO: 269426 - RNA, 64 nt, Homo Sapiens
uuguuuuuaaaagcauauacugccuuuuuugaauuuuuuaaauuuguugaaacaagauaaagau

SEQ ID NO: 269427 - RNA, 64 nt, Homo Sapiens
auagaguauuuuuccucguaggaagcaaguuauuuuuuuaaaaauuuaaauagcgauuuguaua

SEQ ID NO: 269428 - RNA, 64 nt, Homo Sapiens
gcgauuuguauaggaagcaagccuuauuuguauauuuuuaaauagaguuagauuuuaugcuugg

SEQ ID NO: 269429 - RNA, 64 nt, Homo Sapiens
aaaaguuuaccgcuguaguggaaucugcgguauuuuuuuaaaaaccuucuuuaaaaaaaaaaaa

SEQ ID NO: 269430 - RNA, 56 nt, Homo Sapiens
uuuaaguuuuguaagagcuugcugauuuuuuaaaaaaacauggaaaaaauuuuuga

SEQ ID NO: 269431 - RNA, 64 nt, Homo Sapiens
gacacugucccacuccaucacaccuggcccacauuuuuuaaagaaugacaggugcgagccacug

SEQ ID NO: 269432 - RNA, 64 nt, Homo Sapiens
cugcuccuuguggagcaggaucuuaaacuuuuuuuuuuuaaaaaaaagugcuacauaaaacacu

SEQ ID NO: 269433 - RNA, 64 nt, Homo Sapiens
uuagccugguaaggccggguauuaaaaacgcauguuuuuaaaaauuaucagguaaauccuggua

SEQ ID NO: 269434 - RNA, 64 nt, Homo Sapiens
ugaagaauuaaauauuuuaaugauuuuauuuaauuuuuuaaaguuucuggucauuauccuauuu

SEQ ID NO: 269435 - RNA, 64 nt, Homo Sapiens
uggagguccuccauaaugucuuuaguuuugcuuauuuuuaaauuccuuauuuugucuugcaugu

SEQ ID NO: 269436 - RNA, 64 nt, Homo Sapiens
guccaaauaaaauaauuuucgugaaauuaauacuuuuuuaaaggcugccaguauuccacauuug

SEQ ID NO: 269437 - RNA, 64 nt, Homo Sapiens
uagcccaguauaaacauuaguuggcuugaguaccuuuuuaaaucgaguuuaaguacagugaugg

SEQ ID NO: 269438 - RNA, 64 nt, Homo Sapiens
agccauuauuuuaugagacuuagauacuuuugccuuuuuaaaaauaagaauaucauuuagagug

SEQ ID NO: 269439 - RNA, 64 nt, Homo Sapiens
caagaauagggaauuaguucucuaccuucuauuguuuuuaaauugugaguuaaaaaggcacauu

SEQ ID NO: 269440 - RNA, 64 nt, Homo Sapiens
uuauaaguggucaugaaauuuuuuuaaauuugauuuuuuaaauauguucaauguauggucauac

SEQ ID NO: 269441 - RNA, 64 nt, Homo Sapiens
ugauuuuuuaaauauuauaaauguauggucauacuuuuuaaauuuguuuuucuuaauauguuca

SEQ ID NO: 269442 - RNA, 64 nt, Homo Sapiens
uuuucacagcacaggucuucuuaaaaauuugagauuuuuaaaauuuuuauaaaugauuuuuuau

SEQ ID NO: 269443 - RNA, 64 nt, Homo Sapiens
guaaagcauauacuuguugcuuuguuuggauuaauuuuuaaaauagagaagugcuucaaauuau

SEQ ID NO: 269444 - RNA, 64 nt, Homo Sapiens
guacacguuucagugccuuuaguaaugaaaagacuuuuuaaauuuauaucucauguauauuuau

SEQ ID NO: 269445 - RNA, 64 nt, Homo Sapiens
uaaguagcaugcauauauauauaaaugguacauauuuuuaaagucauugaaaagguuaagaaac

SEQ ID NO: 269446 - RNA, 64 nt, Homo Sapiens
aaaaaauguauacaccuaacuggaacuugauaguuuuuuaaauucuauaauucuaaggucaaaa

SEQ ID NO: 269447 - RNA, 64 nt, Homo Sapiens
ugaaauguguaaaaucuuauuguaugagaagacauuuuuaaagaaguauuuggcaauaccuauc

SEQ ID NO: 269448 - RNA, 64 nt, Homo Sapiens
acaguagggugugaauuauuggacuuuguuguuauuuuuaaaguuauagcaaaacaagaaaagu

SEQ ID NO: 269449 - RNA, 64 nt, Homo Sapiens
aaaacaccccaacuuggcagguccccaacaggaauuuuuaaaccauucccuucagggauucccu

SEQ ID NO: 269450 - RNA, 64 nt, Homo Sapiens
uuuauuuuuacguagaagcucuuucucccuuuuuuuuuuaaauuaagagacucuuuauuuuucu

SEQ ID NO: 269451 - RNA, 64 nt, Homo Sapiens
caguugcuggccaaagauugaaaaaaauaaaauauuuuuaaauaccauauguaucaccuauuca

SEQ ID NO: 269452 - RNA, 64 nt, Homo Sapiens
ugucagauuggcaaagaucaccauacugagauccuuuuuaaaacaaaagaaaugcaacuuaaaa

SEQ ID NO: 269453 - RNA, 64 nt, Homo Sapiens
uccaacucuagagaaaaccacuucaaguucuugauuuuuaaaaugccuuucuuucuuucuguac

SEQ ID NO: 269454 - RNA, 64 nt, Homo Sapiens
acagaaaaagaugaaugaaaaguuuuauuuuacuuuuuuaaagaaagcccuugagauauuccaa

SEQ ID NO: 269455 - RNA, 64 nt, Homo Sapiens
acuuacuguuuucagagcaccacgucccacccccuuuuuaaagcuucccaagcucuaaccguaa

SEQ ID NO: 269456 - RNA, 64 nt, Homo Sapiens
aggaggucguuuaugugugcccaguugugcuauauuuuuaaagaaaggaugauggaaaaaucac

SEQ ID NO: 269457 - RNA, 64 nt, Homo Sapiens
ggagcaacauaucagucgugguauuuuauuuuauuuuuuaaauguaggugugcaagaaccaaac

SEQ ID NO: 269458 - RNA, 64 nt, Homo Sapiens
agacacuauaguuuuacccaaaaauauuuuuuucuuuuuaaaauauuuuaaaaaauauauauau

SEQ ID NO: 269459 - RNA, 64 nt, Homo Sapiens
gaacauuauagagguguaaugauguaucuaauauuuuuuaaaacaaaccaagugauuuccagcu

SEQ ID NO: 269460 - RNA, 64 nt, Homo Sapiens
ccaaauauguuuauauuuaauaagauguacuuacuuuuuaaagucccagaauuggaucaucucc

SEQ ID NO: 269461 - RNA, 64 nt, Homo Sapiens
caguacuccuagggaaaugguuuguuuugcaugauuuuuaaaaguauaacaucacuauuuggcu

SEQ ID NO: 269462 - RNA, 64 nt, Homo Sapiens
uagacuuuuuuuuuuagagcacuuuuaaaaauuguuuuuaaaaauugaaucugagacgaauaca

SEQ ID NO: 269463 - RNA, 64 nt, Homo Sapiens
uuagauuauucuauaauuuacacuucguuuuuaguuuuuaaaauauucaguauuuuaugauaau

SEQ ID NO: 269464 - RNA, 64 nt, Homo Sapiens
gaaaagcauaggccucuguucauucgaggcuccuuuuuuaaagaugcaggucggcugugcaucg

SEQ ID NO: 269465 - RNA, 64 nt, Homo Sapiens
acuucaacauuauuugagcauaugaguauuugaguuuuuaaauccuuacucuccaauguaaaua

SEQ ID NO: 269466 - RNA, 64 nt, Homo Sapiens
uguuggagacgccaauagcagacuauuaaaaugauuuuuaaaguaaagauauguuuaagaccaa

SEQ ID NO: 269467 - RNA, 64 nt, Homo Sapiens
guuuguuauauuucuuuucuaacucuuaauuauguuuuuaaaauugaaacagauuuguuaacug

SEQ ID NO: 269468 - RNA, 64 nt, Homo Sapiens
uucuuuuauaauaugcuuuccuucauuuguaaauuuuuuaaaaugcaaguuaguuaacaugaac

SEQ ID NO: 269469 - RNA, 64 nt, Homo Sapiens
accuuaauguaagauaugacgaugucuauuugauuuuuuaaaaaaauuccgauuuggaaccuua

SEQ ID NO: 269470 - RNA, 64 nt, Homo Sapiens
cugugggucagucuugcacuccucuuaauuuaccuuuuuaaaaguuugcacuguaacuauaaua

SEQ ID NO: 269471 - RNA, 56 nt, Homo Sapiens
ucaaaacaagaaacaaaacaaaccgcuuuuuaaaaucucagguucccaauagcuga

SEQ ID NO: 269472 - RNA, 64 nt, Homo Sapiens
aaauaccaauaucaggaagcgagggaauaaugcauuuuuaaauaaaagugguggucuuuuggau

SEQ ID NO: 269473 - RNA, 64 nt, Homo Sapiens
aguaaaacaagaaaaguacaugaaaugaaaagacuuuuuaaaaacaaaugcaaaacuuuuuuuu

SEQ ID NO: 269474 - RNA, 64 nt, Homo Sapiens
acccccaccacauaaaucucacggcuucucucuuuuuuuaaaucuuuaggcguuuucuggcuug

SEQ ID NO: 269475 - RNA, 64 nt, Homo Sapiens
aaacaugaccaucgucaaagaccugcucaagaaauuuuuaaaaaagaaacaaaguuaugggguu

SEQ ID NO: 269476 - RNA, 64 nt, Homo Sapiens
auuggugaugggaguaauaacauuuugggggagcuuuuuaaauuucacagaagaggaaaguugc

SEQ ID NO: 269477 - RNA, 64 nt, Homo Sapiens
ucaccgauuuaaagagugcaauauauaauaaucauuuuuaaaguauuggauuaaaucugauagg

SEQ ID NO: 269478 - RNA, 64 nt, Homo Sapiens
caaauuacuucuuuguuuuucuuaaugauggcaauuuuuaaacuuuaauuuuauugugaucucu

SEQ ID NO: 269479 - RNA, 64 nt, Homo Sapiens
uggaaauaauugauaacuuuuaagccauacuauguuuuuaaagauaauuugcacaaacacguuu

SEQ ID NO: 269480 - RNA, 64 nt, Homo Sapiens
auauagucagauauauguugucugcuuuaaacaauuuuuaaauuuuaaaaaugcauuaacgucu

SEQ ID NO: 269481 - RNA, 64 nt, Homo Sapiens
aaaauacucuaauagccuugagugaccaacuuuuuuuuuaaagcacagauguaauugucuaaug

SEQ ID NO: 269482 - RNA, 64 nt, Homo Sapiens
cacacuacuauuugaagcucauuuucuaugcagguuuuuaaacgucauuuauguaucauucuuu

SEQ ID NO: 269483 - RNA, 64 nt, Homo Sapiens
ucuguuuucuuuguuuguuuugcuuugcuuuuuguuuuuaaaguuucccccagugauuccagug

SEQ ID NO: 269484 - RNA, 64 nt, Homo Sapiens
uucuuaguguaguuaugauguggauccuacguauuuuuuaaaaaacucuccagauaauuuugau

SEQ ID NO: 269485 - RNA, 64 nt, Homo Sapiens
uacagaaugugaaauacugauacaguuauucuuuuuuuuaaagaacauuguuuuauaaagaacg

SEQ ID NO: 269486 - RNA, 64 nt, Homo Sapiens
aacauuaaaucuagucucuauccuguuaauuuaauuuuuaaaugcuuuauccauuugugcaaag

SEQ ID NO: 269487 - RNA, 64 nt, Homo Sapiens
uuguaggaaauuugcauacccguaaagggagacuuuuuuaaauaacaguugagucuuugcaagu

SEQ ID NO: 269488 - RNA, 64 nt, Homo Sapiens
uugcaaacugagcuuguuggagggaaggcauuauuuuuuaaaauacuuaguaaauuaaaugaac

SEQ ID NO: 269489 - RNA, 64 nt, Homo Sapiens
guagaacugggccagagccaguccauugccuguuuuuuuaaauaagguuuuacugagcacagcc

SEQ ID NO: 269490 - RNA, 64 nt, Homo Sapiens
aagauuuuauucuuucuuguaaacauuacuugauuuuuuaaagaaguuuugggcucacugcuaa

SEQ ID NO: 269491 - RNA, 64 nt, Homo Sapiens
uguagaauaauuugaacauugugaggaccaaucuuuuuuaaaucaaaagggauguugcugguau

SEQ ID NO: 269492 - RNA, 64 nt, Homo Sapiens
uuuucuucacuccgugaccuggagaguuuuccauuuuuuaaaauacaugaacuuggcaagggug

SEQ ID NO: 269493 - RNA, 64 nt, Homo Sapiens
ggugucauuuaguaaggauuuuaugaguucuuguuuuuuaaaauccagacuuucuuuuucuaca

SEQ ID NO: 269494 - RNA, 64 nt, Homo Sapiens
auuuucuguauuuaauuauaaaaaauuaacuuaguuuuuaaaauuuauuugcaaauauacuuua

SEQ ID NO: 269495 - RNA, 64 nt, Homo Sapiens
auaaaaugcuccuagaagucuuaauuguguuuauuuuuuaaaaaaacaaauguuagacuugugu

SEQ ID NO: 269496 - RNA, 64 nt, Homo Sapiens
uguuguaugaauggcauuuguauauuaaaacacuuuuuuaaaggacaguugaaaagggcaagag

SEQ ID NO: 269497 - RNA, 64 nt, Homo Sapiens
uauuuuuuuuuuuuuauugaccauggugauuauuuuuuuaaaccaucguuaauauacugaagug

SEQ ID NO: 269498 - RNA, 64 nt, Homo Sapiens
guacuuguagccuggauagcagacuguguucaacuuuuuaaaaagauguuuccuuucuaaagau

SEQ ID NO: 269499 - RNA, 64 nt, Homo Sapiens
acuuauucugagcuuagagagaauggggaggguauuuuuaaauuuuauuguuuuauuucuuuaa

SEQ ID NO: 269500 - RNA, 64 nt, Homo Sapiens
aguggagcuccaguuuucuuaccuagcugucacuuuuuuaaaugccucuggggguuauuuuugc

SEQ ID NO: 269501 - RNA, 64 nt, Homo Sapiens
uuaguccaaaggaaaacaacagcaacaaaaucuguuuuuaaaaugucuuauaugaacauauauc

SEQ ID NO: 269502 - RNA, 64 nt, Homo Sapiens
caaaggaagcauuucuagaaaaaaggagauaauguuuuuaaauuucauuaucaaacuugggcaa

SEQ ID NO: 269503 - RNA, 64 nt, Homo Sapiens
aggaauggguuagcccuaauguagaaugucauuguuuuuaaaacuguuuuauaucuuaagagug

SEQ ID NO: 269504 - RNA, 64 nt, Homo Sapiens
uaaugcaucaaaagccuuagaauaagaaaagcuuuuuuuaaauugcuuuaucuguauaucugaa

SEQ ID NO: 269505 - RNA, 64 nt, Homo Sapiens
gaccuuguuuuuuguuguauuuuggaagacagguuuuuuaaagaaacauuuuccucagauuaaa

SEQ ID NO: 269506 - RNA, 64 nt, Homo Sapiens
uucuaaccuaccucuaaugggguuaucagauauguuuuuaaaucucucgcccugaguacucuuc

SEQ ID NO: 269507 - RNA, 64 nt, Homo Sapiens
ugaaauugucacaaaacguuauuccuugauuugguuuuuaaauuuugcuuucgugugugugucu

SEQ ID NO: 269508 - RNA, 64 nt, Homo Sapiens
ucacagaagaggaaaguugccauuuugggggagcuuuuuaaauuauuggugaugggaguaauaa

SEQ ID NO: 269509 - RNA, 64 nt, Homo Sapiens
agaaacaaaguuaugggguuagcugcugaagaaauuuuuaaaaaaaacaucaccaucgucaaag

SEQ ID NO: 269510 - RNA, 64 nt, Homo Sapiens
aaagugcuggcuuggucugucuccaaaauaaaacuuuuuaaaauaaaaucucaaauuucuaaau

SEQ ID NO: 269511 - RNA, 64 nt, Homo Sapiens
caccuggaauauauaaccaguaauaugcacacauuuuuuaaauguuauuuuauuaugcaugaag

SEQ ID NO: 269512 - RNA, 64 nt, Homo Sapiens
guugcaaagugcuguuuuuguguaaugcaauaaauuuuuaaauugacugcugaugugaugcuac

SEQ ID NO: 269513 - RNA, 64 nt, Homo Sapiens
cgaaacaaaguuaugggguuagcugcucaagaaauuuuuaaaaaaaacaccaccaucaucaaag

SEQ ID NO: 269514 - RNA, 64 nt, Homo Sapiens
aauuauuccuuaagacaugcuuagccucauucauuuuuuaaaggaugauggcuguacaaauaau

SEQ ID NO: 269515 - RNA, 64 nt, Homo Sapiens
cuguauuauuuaaaaugcaucucuggugaucuuauuuuuaaagccaaccacuaacaauuguggu

SEQ ID NO: 269516 - RNA, 64 nt, Homo Sapiens
uacuuuuacucauucuagccgcuggaaguaaacauuuuuaaagcggcgcgagccaccacacccg

SEQ ID NO: 269517 - RNA, 64 nt, Homo Sapiens
uuucuuggguuaguauuuaauuacugaauuuguauuuuuaaauuuuguuguuagagcaaaaguc

SEQ ID NO: 269518 - RNA, 64 nt, Homo Sapiens
uugauuuaaaugaagaaaugucuaagguucaagauuuuuaaaauaauuacuguaaguuuuagau

SEQ ID NO: 269519 - RNA, 64 nt, Homo Sapiens
cagcaagucuggucauucagaucucaaguuuggguuuuuaaagaauauacuguaauuuuuguua

SEQ ID NO: 269520 - RNA, 64 nt, Homo Sapiens
aauauuguaugcuuacaaaauaguaaaagucauuuuuuuaaaguaucuguuuugcugaaucucc

SEQ ID NO: 269521 - RNA, 64 nt, Homo Sapiens
caaaauuuucaagucugggacuauaggucacaauuuuuuaaaacauaaugagcuaaugugauau

SEQ ID NO: 269522 - RNA, 64 nt, Homo Sapiens
uucagaauugaagccaaacauucaacauuuccaauuuuuaaagcauagucuaugggcaaauauu

SEQ ID NO: 269523 - RNA, 64 nt, Homo Sapiens
aaccuagauaccaauugaccacagauuuuuuuuuuuuuuaaaucaaacacucgcuguuacaagu

SEQ ID NO: 269524 - RNA, 64 nt, Homo Sapiens
uuguuuuaucaagucacuguaauguuaauuggguuuuuuaaacauagaacccaaauuguguaaa

SEQ ID NO: 269525 - RNA, 64 nt, Homo Sapiens
gaacccaaauuguguaaaaaagagccaguuuuuuuuuuuaaauauaggcuccauauuuaaagau

SEQ ID NO: 269526 - RNA, 64 nt, Homo Sapiens
gcucuuuguauagcagaggauuaguauuuauaacuuuuuaaaggauuuuaaagguaauugauaa

SEQ ID NO: 269527 - RNA, 64 nt, Homo Sapiens
uucucaaaaaguaacuaaaauuucaauguauuuauuuuuaaauucuuucgcucucuaaucagca

SEQ ID NO: 269528 - RNA, 64 nt, Homo Sapiens
aaccucagauugaaaaagcauucauacaauaacuuuuuuaaaacuuuuuuauuuuuuaauaccu

SEQ ID NO: 269529 - RNA, 64 nt, Homo Sapiens
guugaugugcggaaaauguuuaaaugugucaugcuuuuuaaaaagccaucucaaguaaaaggaa

SEQ ID NO: 269530 - RNA, 64 nt, Homo Sapiens
agcuuuuggaagagaaaugaugaacugaacuuaguuuuuaaaguuucuugagugagguggccuu

SEQ ID NO: 269531 - RNA, 64 nt, Homo Sapiens
cuugaauccacaaauaaaguaaguguaaaaucauuuuuuaaaauaaaauuuauugcacacuuua

SEQ ID NO: 269532 - RNA, 64 nt, Homo Sapiens
cuucugacacaguaaauauaauaaacuauuugacuuuuuaaaauaaacacaauucauuuugauu

SEQ ID NO: 269533 - RNA, 64 nt, Homo Sapiens
ugcuuugagagguaauuacuguguaauaaugcguuuuuuaaaaaagaaauaauucauugguaaa

SEQ ID NO: 269534 - RNA, 64 nt, Homo Sapiens
agaauuaggaauuugagauaucuaguguuuuguguuuuuaaaacaguaauuucauagcaacugu

SEQ ID NO: 269535 - RNA, 64 nt, Homo Sapiens
agaaaaaaaaacugcccugagguuugauuuuuuuuuuuuaaagaaagccucauuuuauuuugcu

SEQ ID NO: 269536 - RNA, 64 nt, Homo Sapiens
guggaaugucucucagcacauuuuuuuuuuuuuuuuuuuaaaugauaaccaguccauuuuuccu

SEQ ID NO: 269537 - RNA, 64 nt, Homo Sapiens
acagauuuguaauauauguugaaacggcaauacuuuuuuaaaucagagguauuaaugagacuau

SEQ ID NO: 269538 - RNA, 64 nt, Homo Sapiens
auuuuaagauacagcuacucccuggauuauaugauuuuuaaaacacccacucagccccaaaugc

SEQ ID NO: 269539 - RNA, 64 nt, Homo Sapiens
ccauuuuacugguuuggcauuugucuacuauacauuuuuaaaaguacuuuuauacaaacugaca

SEQ ID NO: 269540 - RNA, 64 nt, Homo Sapiens
guguucuuuucacuugggagggagcaauuaauuuuuuuuaaaaauccccugggccugaaaacuu

SEQ ID NO: 269541 - RNA, 64 nt, Homo Sapiens
ccauuuuuguuuaauagggucaucccgaaccagauuuuuaaaucccuuagcaauuaucuuugaa

SEQ ID NO: 269542 - RNA, 64 nt, Homo Sapiens
uuuagagaaaaguacaguaauuuuagauaacagauuuuuaaaguaauuagcauuagagaauuga

SEQ ID NO: 269543 - RNA, 64 nt, Homo Sapiens
uucaagucccuaauaaaacaggauugacuacauauuuuuaaaccaaacaacauaacuuugcccu

SEQ ID NO: 269544 - RNA, 64 nt, Homo Sapiens
uagaugaauauguuagucuuuauugguagguuuuuuuuuaaaauaaauaaaauauauuuuguuc

SEQ ID NO: 269545 - RNA, 64 nt, Homo Sapiens
agauaguuuucuagcucucgggucccuuuauugcuuuuuaaaauaggguuugaaacaugccaca

SEQ ID NO: 269546 - RNA, 64 nt, Homo Sapiens
uuguaauucuaaaagagaucuuauuuaaauuuccuuuuuaaaagccgcaugguucugugaucca

SEQ ID NO: 269547 - RNA, 64 nt, Homo Sapiens
aguggaaagaaucuuuacaaacccugcaauuacuuuuuuaaaggcacuuuuacucuuugguuuu

SEQ ID NO: 269548 - RNA, 64 nt, Homo Sapiens
ggauucaaccaacugcaaauggaaaauacgauuuuuuuuaaaaaaaggaugguuacauccguau

SEQ ID NO: 269549 - RNA, 64 nt, Homo Sapiens
cuagauugccucuccuggacauggcaaugaugaguuuuuaaaaaacaguguggaugaugauaug

SEQ ID NO: 269550 - RNA, 64 nt, Homo Sapiens
aggacuuuucuaggaaagacuuauguauaauugcuuuuuaaaaugcagugcuuuacuuuaaacu

SEQ ID NO: 269551 - RNA, 64 nt, Homo Sapiens
agccucccagaguacugggauuacaggcucuuucuuuuuaaacauaaaaguuuuaaauugguau

SEQ ID NO: 269552 - RNA, 64 nt, Homo Sapiens
agucacaggcuggcuucuguuuuauucagggauuuuuuuaaaaagucaaucagaaaagggauac

SEQ ID NO: 269553 - RNA, 64 nt, Homo Sapiens
uagaaccuuuugagaugaauuaauguaagaauauuuuuuaaauaggcuuacugucaaauugcaa

SEQ ID NO: 269554 - RNA, 64 nt, Homo Sapiens
gagcuccuugguuuuuuacuucugcacuuaaauuuuuuuaaauaacaugaugaugguacauuuu

SEQ ID NO: 269555 - RNA, 64 nt, Homo Sapiens
agcuacucuaguucuguuguuuuguguauauaauuuuuuaaaaaaaauuugugugcuucugcuc

SEQ ID NO: 269556 - RNA, 64 nt, Homo Sapiens
ggaccacaggcaugcaccacuacgcaugacuaauuuuuuaaauauuugagacggggucucccug

SEQ ID NO: 269557 - RNA, 64 nt, Homo Sapiens
guaaauagccauacccaguuguacuacaaugagcuuuuuaaaaucuugaaugaauugaguauuc

SEQ ID NO: 269558 - RNA, 64 nt, Homo Sapiens
aauuauuuuaaauaacugucaacuguuucauugcuuuuuaaauuuuucacgugcauaacccccu

SEQ ID NO: 269559 - RNA, 64 nt, Homo Sapiens
cagcugucggguuagugguaguauuauuguuauuuuuuuaaaggaaacaaacagacaacaaaaa

SEQ ID NO: 269560 - RNA, 64 nt, Homo Sapiens
guagacuuuauuacccccccacuaugcccucauuuuuuuaaaaaaggaaaaaaaaaagaaacug

SEQ ID NO: 269561 - RNA, 64 nt, Homo Sapiens
cgagcaaccaauguaggauugcccacaguuuuucuuuuuaaaggugguuuucgcccuuccucuc

SEQ ID NO: 269562 - RNA, 64 nt, Homo Sapiens
cugcugcuggucaggacauuaaaauauugaaguguuuuuaaaaauuaaagaagaagaaaaguaa

SEQ ID NO: 269563 - RNA, 64 nt, Homo Sapiens
aaaacagagauggggucuuaaacagaauuucuuuuuuuuaaaaauuuggucugaaauacuuuug

SEQ ID NO: 269564 - RNA, 64 nt, Homo Sapiens
caaggagggggcuauuaacaauuucuuaauuuuuuuuuuaaauauagcacacagauucacuuua

SEQ ID NO: 269565 - RNA, 64 nt, Homo Sapiens
agcuuuuaaacaaaguaauacaaaugugcaauuuuuuuuaaaggguguuacaggaagugaaaug

SEQ ID NO: 269566 - RNA, 64 nt, Homo Sapiens
uuucuacuuugggguuccaucuucaucacaaauuuuuuuaaacgucuguaguugacaaaagugg

SEQ ID NO: 269567 - RNA, 64 nt, Homo Sapiens
ugccgagcagggcaaugcaaaaggaaagagccauuuuuuaaaaauguucugacgugugaaauuu

SEQ ID NO: 269568 - RNA, 64 nt, Homo Sapiens
ccaagauagaguaucuauuauguaaucuuuuaccuuuuuaaaaaauagaaaguagcuaauccag

SEQ ID NO: 269569 - RNA, 64 nt, Homo Sapiens
ugaaauauauaauauucagccuauauguagugcauuuuuaaacucgccuuaaacucuggacacu

SEQ ID NO: 269570 - RNA, 64 nt, Homo Sapiens
aaggaaaggcucauuuaaaauguaaacagguauuuuuuuaaaucucucaagaaucuagaagaug

SEQ ID NO: 269571 - RNA, 64 nt, Homo Sapiens
aaaauucauuuuauuugcaguaaacagccuuuaguuuuuaaaguuggaaccaaaggccaaauaa

SEQ ID NO: 269572 - RNA, 64 nt, Homo Sapiens
aacaaauguauuguggcuucuuuuuuaauucaguuuuuuaaaaagagauauacuauuuuuuucc

SEQ ID NO: 269573 - RNA, 64 nt, Homo Sapiens
aaauuuuuuguuuuuacuauagcuccugcuuuauuuuuuaaauuuugaauuuuguugucuaaau

SEQ ID NO: 269574 - RNA, 64 nt, Homo Sapiens
uguuuucagccauguuucucccaaagacauguucuuuuuaaagccagcagcaccacacaugaac

SEQ ID NO: 269575 - RNA, 64 nt, Homo Sapiens
acacaggacccuuaacuuuguugaccaaauggacuuuuuaaaagcuuccuuaaaugaaaaguua

SEQ ID NO: 269576 - RNA, 64 nt, Homo Sapiens
gauuuuuugucagggugacuuuaugguuaccauauuuuuaaaaagugccuuugagcaacuuuau

SEQ ID NO: 269577 - RNA, 64 nt, Homo Sapiens
ugcaucaagaaagacuacugaggaguugugcugguuuuuaaauggaaauugaccauuucacuag

SEQ ID NO: 269578 - RNA, 64 nt, Homo Sapiens
aaaaaaaaaaagcccacaucuuuugaacuaucuuuuuuuaaaaagagagaauacuuuuuaaggc

SEQ ID NO: 269579 - RNA, 64 nt, Homo Sapiens
uaaauaaaauaucuuguagcaagaagaaaaccuauuuuuaaaugcgggccuuuccacuacguug

SEQ ID NO: 269580 - RNA, 64 nt, Homo Sapiens
aacacucaaucauccuaccguugugggguuuuuauuuuuaaagagguaggguguucuggcuuuu

SEQ ID NO: 269581 - RNA, 64 nt, Homo Sapiens
uaaauuuugggucaacuugauuauauauauauuuuuuuuaaacucccuucccuccuuuguuuac

SEQ ID NO: 269582 - RNA, 64 nt, Homo Sapiens
uucuuacggcauggacaaggauuuuucaauuuauuuuuuaaacuguuuccauacccuuucuuuu

SEQ ID NO: 269583 - RNA, 64 nt, Homo Sapiens
uguccacugguuuuuuuauuuugauauuugucuuuuuuuaaauuuuacaguagucauugaaagu

SEQ ID NO: 269584 - RNA, 64 nt, Homo Sapiens
uguguguguguguguguguguaugauguuuuguuuuuuuaaauguuuuaaaagcuuaauagguu

SEQ ID NO: 269585 - RNA, 64 nt, Homo Sapiens
gauuuuuuucucauaaaauagucugauaagcuaauuuuuaaaaagaaaugccauuaacuguguu

SEQ ID NO: 269586 - RNA, 64 nt, Homo Sapiens
aagaaaaauaauauuugauuuugaaucuuaaauguuuuuaaaaauuagacuugaaugggcacaa

SEQ ID NO: 269587 - RNA, 64 nt, Homo Sapiens
uccacuuucugcuuuucuuucuuucuuuuuuucuuuuuuaaaguaauuucccccacaguaaaau

SEQ ID NO: 269588 - RNA, 64 nt, Homo Sapiens
aauuuguuaaccuuacguuuucugucuguauauuuuuuuaaaaaucugguaguuucuggaaaaa

SEQ ID NO: 269589 - RNA, 64 nt, Homo Sapiens
aaauugcauugccuuuauuuuauguuuaggcuuauuuuuaaauuaacauuuaacagaaacauuu

SEQ ID NO: 269590 - RNA, 64 nt, Homo Sapiens
acaaaccucaagcuuuacugacuucaauuaucuguuuuuaaagacguagaagauuuauuuaauu

SEQ ID NO: 269591 - RNA, 64 nt, Homo Sapiens
auagaaguauuucugaacauaucaaauauaaauuuuuuuaaagaucuaacugugaaaacauaca

SEQ ID NO: 269592 - RNA, 64 nt, Homo Sapiens
uuuucuuauucagguuuaauggagguugaauugauuuuuaaacacauauaacaguaggaaauga

SEQ ID NO: 269593 - RNA, 64 nt, Homo Sapiens
ggcuggaggccaugccuuuuaagcauguguaaaauuuuuaaagaaaugaacauacacauaguua

SEQ ID NO: 269594 - RNA, 64 nt, Homo Sapiens
gguuuauuucaugcacugugccuucaaaaugaaauuuuuaaaagggacuuuaaaugaaguugaa

SEQ ID NO: 269595 - RNA, 64 nt, Homo Sapiens
uuuaaaagggacuuuaaaugaaguugaauaguaguuuuuaaaagucaauuuguaauuuauguga

SEQ ID NO: 269596 - RNA, 64 nt, Homo Sapiens
ugacauuuuucaaaaagguguugauuuguacagauuuuuaaagucaguuaacuuuacugcuauu

SEQ ID NO: 269597 - RNA, 64 nt, Homo Sapiens
uuacaguaacugcaaguguguuuuuacaucugcauuuuuaaaacauuuuacuguaauucuguug

SEQ ID NO: 269598 - RNA, 64 nt, Homo Sapiens
agggcauggguuuuauuauauauauauauuuuuuuuuuuaaaaaaaaaacguauugcauuuaau

SEQ ID NO: 269599 - RNA, 64 nt, Homo Sapiens
ggcuuuaaaacuuauccuccaugaauaucaguuauuuuuaaacuguaaagcuuugugcagauuc

SEQ ID NO: 269600 - RNA, 64 nt, Homo Sapiens
cgggguggggccccuacagacuccguauuuuauuuuuuuaaauaaaaaacgaucgaaaccauuu

SEQ ID NO: 269601 - RNA, 64 nt, Homo Sapiens
aaaaacgaucgaaaccauuucacuuuuagguugcuuuuuaaaagagaacucucugcccaacacc

SEQ ID NO: 269602 - RNA, 64 nt, Homo Sapiens
cugauucccaucguucucaggcggauuuuauauuuuuuuaaagucuauuuuaaugauuggauau

SEQ ID NO: 269603 - RNA, 64 nt, Homo Sapiens
uauuuuuaagaaaggaccaucucuuuaggauauauuuuuaaauucuuugaaacacauaaccaaa

SEQ ID NO: 269604 - RNA, 64 nt, Homo Sapiens
agcaaugaucagauuguuaaucuacagauuuuauuuuuuaaaauuuggauguaaguagagacuu

SEQ ID NO: 269605 - RNA, 64 nt, Homo Sapiens
aguccaaagugcuuagcgaaguaaaaaaaaaagcuuuuuaaaauuucuauuguugucuauuggu

SEQ ID NO: 269606 - RNA, 64 nt, Homo Sapiens
cuuugugggaaaaugaucuaaauuauuguuuuaauuuuuaaaccuaauuuauucacucagugaa

SEQ ID NO: 269607 - RNA, 64 nt, Homo Sapiens
augagguuuuuccaaacuuaggauauaagagggcuuuuuaaauuuggugccgauguugaacuuu

SEQ ID NO: 269608 - RNA, 64 nt, Homo Sapiens
aagaaucuauuagauuuuagaaaaacauuuaaacuuuuuaaaauacuuauuaaaaaauuuguau

SEQ ID NO: 269609 - RNA, 64 nt, Homo Sapiens
uuguauaagccacuugucuugaaaacugugcaacuuuuuaaaguaaauuauuaagcagacugga

SEQ ID NO: 269610 - RNA, 64 nt, Homo Sapiens
auccaaaaugcuugggaccagaaguguuucagauuuuuuaaaauuuuggaauauuugcuuuaua

SEQ ID NO: 269611 - RNA, 64 nt, Homo Sapiens
cuagaguuaguguuuuaucccuaaauaauuucaauuuuuaaaaacaugcagcuucccucucccc

SEQ ID NO: 269612 - RNA, 64 nt, Homo Sapiens
cgguugucccuuuuaauuuauuugaagugcuauuuuuuuaaauaaagguucaucuguccaugca

SEQ ID NO: 269613 - RNA, 64 nt, Homo Sapiens
auuuauuucucuggcaaacuuuucuuucuuuucuuuuuuaaaguaaacuuguguauugagucuu

SEQ ID NO: 269614 - RNA, 64 nt, Homo Sapiens
uuccaaugauacccaacaguuuauuuuuauuauuuuuuuaaacaaaauuucacaguucuguaau

SEQ ID NO: 269615 - RNA, 64 nt, Homo Sapiens
aaaaauagacaaguaagacagcauaaauaauacauuuuuaaacaugucaacauugauaauacaa

SEQ ID NO: 269616 - RNA, 64 nt, Homo Sapiens
uuuuuuuuuuuugaccugggaguaauaaaguuacuuuuuaaaugcacguaugcaaucuuuuauu

SEQ ID NO: 269617 - RNA, 64 nt, Homo Sapiens
uuuguuuuuucaagaaaauuuugcagaagcuauguuuuuaaaguguacauuuuauaaaguuuau

SEQ ID NO: 269618 - RNA, 64 nt, Homo Sapiens
uuuugggaggagccauagauuccugguuauccuauuuuuaaacaaaauguagacaaagugaacu

SEQ ID NO: 269619 - RNA, 64 nt, Homo Sapiens
uaaauggagcagcgaaaucaacgagaaacuggacuuuuuaaacccucuucagagcaagcgugga

SEQ ID NO: 269620 - RNA, 64 nt, Homo Sapiens
gagaagcauuugguaagcuuuaucauauauauauuuuuuaaagaagagaaaaacaccuugagcc

SEQ ID NO: 269621 - RNA, 64 nt, Homo Sapiens
aauuacugcuguggcuagagaguuugaggauugcuuuuuaaaaaagacagcaaacuuuuuuuuu

SEQ ID NO: 269622 - RNA, 64 nt, Homo Sapiens
auggcauccuucaauuucuguauaaaagcagaucuuuuuaaaaagauacuucuguaacuuaaga

SEQ ID NO: 269623 - RNA, 64 nt, Homo Sapiens
cuccucccucagaaaaaggcaguggccuaaauccuuuuuaaaugacuuggcucgaugcuguggg

SEQ ID NO: 269624 - RNA, 64 nt, Homo Sapiens
ugucauuucaaacacugcuguggacccuacuggguuuuuaaaauauugucaguuuuucaucguc

SEQ ID NO: 269625 - RNA, 64 nt, Homo Sapiens
ccuuucagauuauuuuaccauuuuaguucauuuauuuuuaaacuaaagauaauaguuauaaaaa

SEQ ID NO: 269626 - RNA, 64 nt, Homo Sapiens
cuccuaguuguauagucugugaggagucuuauuauuuuuaaaugucuuuggaagaaggcagaga

SEQ ID NO: 269627 - RNA, 64 nt, Homo Sapiens
auuuuacaguagucauugaauuugauauuagucuuuuuuaaaaaauguccacuaauuuuuuuau

SEQ ID NO: 269628 - RNA, 64 nt, Homo Sapiens
uuccauacccuuucuuugucauuuuucaauuuauuuuuuaaaguuucuuacggcaugggcgagg

SEQ ID NO: 269629 - RNA, 64 nt, Homo Sapiens
uccauuuugcuugccuggaacucucuaguccccuuuuuuaaaugcgccuuagggccagauuccc

SEQ ID NO: 269630 - RNA, 64 nt, Homo Sapiens
aaaauuuucaaaaaguuaaauguguuuuuguguuuuuuuaaauauaacugaagugaaaaaaguc

SEQ ID NO: 269631 - RNA, 64 nt, Homo Sapiens
accauagacucucacuuauuucucucucucucucuuuuuaaaccgccugccucucucucucucc

SEQ ID NO: 269632 - RNA, 64 nt, Homo Sapiens
ucauagauuauauuugaauuccaugcugccuauuuuuuuaaauuccuuccccaugcuguugucc

SEQ ID NO: 269633 - RNA, 64 nt, Homo Sapiens
cuuacuuaaauuuguguguaguaaauacuuauuuuuuuuaaaaagcagagcaaaaaaauauagc

SEQ ID NO: 269634 - RNA, 64 nt, Homo Sapiens
cuugaccaagugucuaaaauccaauuuuuguauuuuuuuaaauggugugagccacugcagugga

SEQ ID NO: 269635 - RNA, 64 nt, Homo Sapiens
caucuuaaaggauccaagucuuaauguaauauuauuuuuaaaaugguuauuagaccaggaaaac

SEQ ID NO: 269636 - RNA, 64 nt, Homo Sapiens
gauauuaucaauaaauauuuggauuaccaaacauuuuuuaaaaagcauuuugaaugauuaguug

SEQ ID NO: 269637 - RNA, 64 nt, Homo Sapiens
uuugucuagggguuucuuuguaaugcuacugugguuuuuaaauucauuccagcaaaccccgugu

SEQ ID NO: 269638 - RNA, 64 nt, Homo Sapiens
uuggugaaauuauuucagauuuuuauaauuuuucuuuuuaaaacacuuaaaaugaaaguauacu

SEQ ID NO: 269639 - RNA, 64 nt, Homo Sapiens
ugccguuugccuuggcuuggauuggaagaugacuuuuuuaaagcuccucuauaguaaauuauuu

SEQ ID NO: 269640 - RNA, 64 nt, Homo Sapiens
gaaguuuaauguccguuguaaaauuguuuuuuucuuuuuaaaagacagaaaagggagagcuacc

SEQ ID NO: 269641 - RNA, 64 nt, Homo Sapiens
aaaggaacugagguucagaauuguauugugaccuuuuuuaaaaaaaaguuaguagagcuuguuc

SEQ ID NO: 269642 - RNA, 64 nt, Homo Sapiens
uuagcauugucauacaguacauauauauauauuauuuuuaaaaauccuuaacagaaacaaaaau

SEQ ID NO: 269643 - RNA, 64 nt, Homo Sapiens
auguaaacugugcuuaguuaguauuaaaaugauuuuuuuaaaagauuucauggucaagccugua

SEQ ID NO: 269644 - RNA, 64 nt, Homo Sapiens
cugcaguuuuccaaacuuuuggagaaauugccaauuuuuaaaaacugauaguuuuauuaagcau

SEQ ID NO: 269645 - RNA, 64 nt, Homo Sapiens
aauauuucauugauaugcauuaguuuuuuguaaauuuuuaaaaaucuuuuuuaaauagaaacuu

SEQ ID NO: 269646 - RNA, 64 nt, Homo Sapiens
gaaacuuuaguuuuuuguaacauaacaugguucuuuuuuaaauauuuaccauguuucaucuugg

SEQ ID NO: 269647 - RNA, 64 nt, Homo Sapiens
aaaucauauugaacuaaacauucagcuguacacauuuuuaaauaacaaaagaucagaucccucc

SEQ ID NO: 269648 - RNA, 64 nt, Homo Sapiens
ggauuuggaaguuguauggacaaacuuuuuuuuuuuuuuaaagauugugaaagugacuauaacc

SEQ ID NO: 269649 - RNA, 64 nt, Homo Sapiens
auugcguuaaaaaaaaaauucaugccacgcauuguuuuuaaagcacagauacucuuuacaccau

SEQ ID NO: 269650 - RNA, 64 nt, Homo Sapiens
ucuccuuccguuucuuaagugcagaguguaucuuuuuuuaaauuuguaugccccuucagaacau

SEQ ID NO: 269651 - RNA, 64 nt, Homo Sapiens
aaaaaaaaauuuaaaaaaaagcauuguaguugacuuuuuaaaaaauuaaucccgauggaauaua

SEQ ID NO: 269652 - RNA, 64 nt, Homo Sapiens
acuaugcaugguuguccuuugaaaaaauaaacauuuuuuaaaaauggcuauugccguuuucuuu

SEQ ID NO: 269653 - RNA, 64 nt, Homo Sapiens
caacaagauagaguauaauaguggguacaggguguuuuuaaaucgaccugcuguugguguacau

SEQ ID NO: 269654 - RNA, 64 nt, Homo Sapiens
uuggcaauuguggcaaaauuuacaauugcuuugcuuuuuaaaccuuuauucaguugucuuuagc

SEQ ID NO: 269655 - RNA, 64 nt, Homo Sapiens
uuacaguagucaucgaaaguugauauuugucuuuuuuuuaaauuguccacuaauuuuuuuauuu

SEQ ID NO: 269656 - RNA, 64 nt, Homo Sapiens
guuuccauacccuuucuuugauuuuucaauuuauuuuuuaaacuuucuuaaggcauggacgagg

SEQ ID NO: 269657 - RNA, 64 nt, Homo Sapiens
uuggaaagaguaaauugacgaucgaauuauuuucuuuuuaaauuaaccugaguuuacuccucaa

SEQ ID NO: 269658 - RNA, 64 nt, Homo Sapiens
auucauuuugcagaaagccuucuuuuuuuuguuguuuuuaaaaaguagaacaaacaacaggaaa

SEQ ID NO: 269659 - RNA, 64 nt, Homo Sapiens
aaggaaaauuuguagacucuauucaggguuuuuuuuuuuaaauaaauaagguugccuuuuucaa

SEQ ID NO: 269660 - RNA, 64 nt, Homo Sapiens
uucgaaaacuuuggggaacgauccuuguuugaacuuuuuaaaaagggucuguccugcgcuucga

SEQ ID NO: 269661 - RNA, 64 nt, Homo Sapiens
uguguauuguuacauauguuguagaauaaaaaaauuuuuaaauuaaaacuuugacagcuuuuau

SEQ ID NO: 269662 - RNA, 64 nt, Homo Sapiens
auauuccauuauuuugcauuacuugcaacuaauuuuuuuaaagucuuaauugcuuugcugcuag

SEQ ID NO: 269663 - RNA, 64 nt, Homo Sapiens
uaaccaaaaaaggccgggugugcuaucacuuaucuuuuuaaaacacacuaauaacaucaacauc

SEQ ID NO: 269664 - RNA, 64 nt, Homo Sapiens
aaacaaaucucauuguaaaggauuuggcaaguguuuuuuaaauaucaacauuuugugggguagu

SEQ ID NO: 269665 - RNA, 64 nt, Homo Sapiens
uccuaauuuucagaaauaugaaagacuucaaucauuuuuaaaauaauuggccagucaaaaaaaa

SEQ ID NO: 269666 - RNA, 64 nt, Homo Sapiens
caaaacaaaaaacaaccaaguuuuuuuuugcuuguuuuuaaagcuuuuguuuuguuuuaagcuu

SEQ ID NO: 269667 - RNA, 64 nt, Homo Sapiens
uuauuuacucggauucuaauaaauguaucagcuauuuuuaaacaagguuuuuagccugaacuuc

SEQ ID NO: 269668 - RNA, 64 nt, Homo Sapiens
uuuaggaugaaggaaacaaggauuacaguuuucauuuuuaaaaauuuaauaaacauucaauaau

SEQ ID NO: 269669 - RNA, 64 nt, Homo Sapiens
ucuaaauauggaccugcucauuuuaaaaauaaaauuuuuaaaaaaguuauuuacaaugaaaagu

SEQ ID NO: 269670 - RNA, 64 nt, Homo Sapiens
uaaaauuuuuaaaaaucuaauuuacaaugaaaaguuuuuaaaaaaaccuuuuucaugaaaguua

SEQ ID NO: 269671 - RNA, 64 nt, Homo Sapiens
ucauuuguuaaguuuauaucuggauauaauguucuuuuuaaacaaguauaaucauaucgucgga

SEQ ID NO: 269672 - RNA, 64 nt, Homo Sapiens
aaaaaauuagguuauuacuuuuuuuauaaccagauuuuuaaagcacuagguuuuaaaucagugg

SEQ ID NO: 269673 - RNA, 64 nt, Homo Sapiens
cuuaaaauaacuauuuuaacccuugaguggcuucuuuuuaaaccaaaaaccgucuuucuuugcu

SEQ ID NO: 269674 - RNA, 64 nt, Homo Sapiens
aaaaaagcuuuguuauagaaaucagcauacuauuuuuuuaaaucuggagagaagauauucuggu

SEQ ID NO: 269675 - RNA, 64 nt, Homo Sapiens
guguaaacucuaauuucuaucaaggugucauggauuuuuaaaauuaguauuucauuacaaaugu

SEQ ID NO: 269676 - RNA, 64 nt, Homo Sapiens
auuuuuauucuuaaacauagguguguuggcucuuuuuuuaaaagaugcgcucuaccugaaaagg

SEQ ID NO: 269677 - RNA, 64 nt, Homo Sapiens
guaaauaccaaguuugguaucucauagcuaucuuuuuuuaaagaaauuaaguucuugaaaauuu

SEQ ID NO: 269678 - RNA, 64 nt, Homo Sapiens
ugggccuugccugcuauggaauauugagagagauuuuuuaaaaaagauuuugcauuuuguccaa

SEQ ID NO: 269679 - RNA, 64 nt, Homo Sapiens
aacaagauauuuuucuuccauguauacaauaauuuuuuuaaaaagugcaauuugcguugcagca

SEQ ID NO: 269680 - RNA, 64 nt, Homo Sapiens
augugacuugugguguaaaaugucuugaugauaauuuuuaaaacuuggguaacacuuccaaaua

SEQ ID NO: 269681 - RNA, 64 nt, Homo Sapiens
ugauacuggcuuuacagaaauuucagagaacuaauuuuuaaaaucuuuagcauuuaaaacuuuu

SEQ ID NO: 269682 - RNA, 64 nt, Homo Sapiens
cagucacugaacuaguagaugucaauaauuauuauuuuuaaaaauuuuuauuuguuggccgggc

SEQ ID NO: 269683 - RNA, 64 nt, Homo Sapiens
cacuguguugcccagccugggugucaauaauuauuuuuuaaaaaaaauuuuuaaaaagguuuuu

SEQ ID NO: 269684 - RNA, 64 nt, Homo Sapiens
agccugggugucaauaauuauuuuuuaaaaaaaauuuuuaaaaagguuuuuugagacagauucu

SEQ ID NO: 269685 - RNA, 64 nt, Homo Sapiens
ccgcaggcacuugccaccacgccccacuaaaaauuuuuuaaauuguugccuuucuugaaguguu

SEQ ID NO: 269686 - RNA, 64 nt, Homo Sapiens
cuugaagugcuaaauggaauaauccaaaggaaauuuuuuaaaugcagguucuagcugaaaaauu

SEQ ID NO: 269687 - RNA, 64 nt, Homo Sapiens
uugucagguuauauauagaauuucuauuaaggauuuuuuaaauggacaagcaauaggggguuga

SEQ ID NO: 269688 - RNA, 64 nt, Homo Sapiens
aucugauuuguuuaaaauuuuguauaucaccaaauuuuuaaaaagugauagucacagugcuaag

SEQ ID NO: 269689 - RNA, 64 nt, Homo Sapiens
aaaaaaggcagcauucaaauuauauagaaucuaguuuuuaaaaucagcacagaucuucuuaaaa

SEQ ID NO: 269690 - RNA, 64 nt, Homo Sapiens
aaaaguaaucuucuacuugcuucaagauuugauuuuuuuaaaaaagccugcgaccuauucaaua

SEQ ID NO: 269691 - RNA, 64 nt, Homo Sapiens
uuuuggaguggaauaauuucuucauuaaaaaauguuuuuaaaaacacuauaucuugggugguuu

SEQ ID NO: 269692 - RNA, 64 nt, Homo Sapiens
ugucggugucaugucacuaaguuuaaugcugcuguuuuuaaaaaaaaaaaaaaguuuuuuuaaa

SEQ ID NO: 269693 - RNA, 64 nt, Homo Sapiens
uuaaugcugcuguuuuuaaaaaaaaaaaaaaguuuuuuuaaaaagccaaucuauguacuaaauu

SEQ ID NO: 269694 - RNA, 64 nt, Homo Sapiens
auauacuaaauauuugcucacauccuuaauauauuuuuuaaaauuccuaacaauaguacuguug

SEQ ID NO: 269695 - RNA, 64 nt, Homo Sapiens
caaucuucuuucugucacuauagauuaauuugcauuuuuaaagaaauuuacauacauggaacca

SEQ ID NO: 269696 - RNA, 64 nt, Homo Sapiens
cugauauauucugaauuuauauauucucauucguuuuuuaaaaaaaucguuuuaguugcuauuc

SEQ ID NO: 269697 - RNA, 64 nt, Homo Sapiens
aauaaugguagccuaaacuuccuucuagcacacuuuuuuaaaugaaggaaguuggcaaaaacag

SEQ ID NO: 269698 - RNA, 64 nt, Homo Sapiens
gccaagaaaaacaacuuuguuaaauuguucuguauuuuuaaauuaacuuaauguguauucauuu

SEQ ID NO: 269699 - RNA, 64 nt, Homo Sapiens
gugaagauggacuucaugcaucaaauucaaaccauuuuuaaaaucugugccauggcauauaugu

SEQ ID NO: 269700 - RNA, 64 nt, Homo Sapiens
cuagacuucguacugugagucauuuuaaaagcccuuuuuaaaaagcaugcaaaguaagacccag

SEQ ID NO: 269701 - RNA, 64 nt, Homo Sapiens
uucuugcauuuauuauucucaauuccauuccaguuuuuuaaaguggaauaucaugggaccaaau

SEQ ID NO: 269702 - RNA, 64 nt, Homo Sapiens
uugagguauaauuuucacaauauuauguauugacuuuuuaaaaacuuugaaaugcauauugauu

SEQ ID NO: 269703 - RNA, 64 nt, Homo Sapiens
ucagaggcucuggcuacacacagauuucugcuucuuuuuaaacaggcuauuucacauuaaaguc

SEQ ID NO: 269704 - RNA, 64 nt, Homo Sapiens
aaugacuacuguuuuuauuacuaggagaaugugcuuuuuaaaauauauguauauaaauaugcac

SEQ ID NO: 269705 - RNA, 64 nt, Homo Sapiens
gacuacccagaagggcacaaaccccaggcuugaguuuuuaaaauuaaaucuaccccuuuugaug

SEQ ID NO: 269706 - RNA, 64 nt, Homo Sapiens
uuguugcuuggagauaaaaacacucuucaacugauuuuuaaaugaaccuagaagcaccugcuga

SEQ ID NO: 269707 - RNA, 64 nt, Homo Sapiens
gccugaacuauacuuugaaggaauuugaagcuaauuuuuaaaaggugcaauauuaaguguuuug

SEQ ID NO: 269708 - RNA, 64 nt, Homo Sapiens
agauauuuuauuaucuuuuagcuuauuguuuuguuuuuuaaagauuggaaacaaugcaguaaua

SEQ ID NO: 269709 - RNA, 64 nt, Homo Sapiens
accgagguugcauucuagauguuuauucuaucuguuuuuaaagcggaaaaugcuuauugaugag

SEQ ID NO: 269710 - RNA, 64 nt, Homo Sapiens
ccuuccaguuuuguggauuagaguaaaaagacauuuuuuaaaaggggcacugugauacaguuuu

SEQ ID NO: 269711 - RNA, 64 nt, Homo Sapiens
auuuuuguuacugacucacugcuaacccaacacauuuuuaaacuucauuucuggauauauugua

SEQ ID NO: 269712 - RNA, 64 nt, Homo Sapiens
auuuauuggcaaaacugggguaccacuuugcuuauuuuuaaaaaaucuaagcuuuuaaccccuu

SEQ ID NO: 269713 - RNA, 64 nt, Homo Sapiens
guucuuaagcaaauauauacuaaaaaaagaaauauuuuuaaaauccuauugugaauuccaaauc

SEQ ID NO: 269714 - RNA, 64 nt, Homo Sapiens
uuucauuuuucccccagugaugcaagaaaauauauuuuuaaagcaaauuuaugguauuugagug

SEQ ID NO: 269715 - RNA, 64 nt, Homo Sapiens
aaguuguugcuuaucuuuuccucaccaauuuauauuuuuaaagccucaauuuugaauuaugcua

SEQ ID NO: 269716 - RNA, 64 nt, Homo Sapiens
auuuggaacccaaauuuauuaagauggccuugacuuuuuaaauacugcagugaaaagcaggaag

SEQ ID NO: 269717 - RNA, 64 nt, Homo Sapiens
guagaguuuguuuuggagacuuccuguuauacauuuuuuaaaauaguaagaccccuuccuuaga

SEQ ID NO: 269718 - RNA, 64 nt, Homo Sapiens
uuagugugaguuuguucaucaguaaauuaagcaguuuuuaaaacuauauuacuagucaugauaa

SEQ ID NO: 269719 - RNA, 64 nt, Homo Sapiens
acuuaucuucuauccaaggaucaauuuuuacauauuuuuaaauuuaaacaaguacacaaauuuu

SEQ ID NO: 269720 - RNA, 64 nt, Homo Sapiens
agaagaugcuauuugugggguacaaaccaagaauuuuuuaaagcuuaugacuuuuaaaaaaaau

SEQ ID NO: 269721 - RNA, 64 nt, Homo Sapiens
caaugaaagagauugagaauuuucuauuacauaguuuuuaaaguguguauuaguucauuuucug

SEQ ID NO: 269722 - RNA, 64 nt, Homo Sapiens
aaugaucuauggaagaaaacaaaucaagucaguuuuuuuaaaagaaguaucuucauuuaaaaag

SEQ ID NO: 269723 - RNA, 64 nt, Homo Sapiens
cacggugaacagcacuuuuauauacuguguauuuuuuuuaaauuuguuuccaagguuguguguu

SEQ ID NO: 269724 - RNA, 64 nt, Homo Sapiens
auaguuacugaacugauucuaugagcaacucaucuuuuuaaaguguugucaguuaucacuguag

SEQ ID NO: 269725 - RNA, 64 nt, Homo Sapiens
gcuugaugagauuugugauaaaaaaugcauuauuuuuuuaaagacugcucuaaauauuuaugau

SEQ ID NO: 269726 - RNA, 64 nt, Homo Sapiens
auguuguauucaguuuauaaauaugggccaucuguuuuuaaaguugcugagguaggaucagcag

SEQ ID NO: 269727 - RNA, 64 nt, Homo Sapiens
agcuaaucuauaaauaccgucacauauuuaucccuuuuuaaaaaggauaugcuagaauuacuuc

SEQ ID NO: 269728 - RNA, 64 nt, Homo Sapiens
ucacaauaaauuuuugcacuuugaacuacuuaacuuuuuaaaaacuucuaaagaauaugcauuc

SEQ ID NO: 269729 - RNA, 64 nt, Homo Sapiens
uucaaauugguuuuucuacugaguagcauccacauuuuuaaaauacguugaugacagcccucau

SEQ ID NO: 269730 - RNA, 64 nt, Homo Sapiens
aacacaguugaguauuugaacauauaguugcuguuuuuuaaauggagaucuguuuagucucgug

SEQ ID NO: 269731 - RNA, 64 nt, Homo Sapiens
uucaaacaacauagauuuacuaaugauaauuggcuuuuuaaauucaaaagugaaguaacaaaua

SEQ ID NO: 269732 - RNA, 64 nt, Homo Sapiens
ggaaacagaauuggaaaacugccacugcagugucuuuuuaaacuacucugugacucaaaguagu

SEQ ID NO: 269733 - RNA, 64 nt, Homo Sapiens
aacaguuugguauguuuauuucuaaaaacucuuuuuuuuaaagugaauucuuuccaaagcaaug

SEQ ID NO: 269734 - RNA, 64 nt, Homo Sapiens
agaagaaauguuacuuuuuauauuuuguuaguuauuuuuaaagguuuauauagcauagugguuu

SEQ ID NO: 269735 - RNA, 64 nt, Homo Sapiens
aaaauauuguccgaagcucuaaauauuaaaauguuuuuuaaacaauauauguuguauuuuauua

SEQ ID NO: 269736 - RNA, 64 nt, Homo Sapiens
ucagugaaauuuucuuauacguuuuucuguguucuuuuuaaauuuugcuguuugccccagauau

SEQ ID NO: 269737 - RNA, 64 nt, Homo Sapiens
agucaaauucauguuuuuaagcuuuaaaauuacuuuuuuaaaauuacuuuguuuuuaaagugaa

SEQ ID NO: 269738 - RNA, 64 nt, Homo Sapiens
gaagcuuuaaaauuacuuuuuuacaaauacuuuguuuuuaaaguaaaaaugcuuuuuaaaauuu

SEQ ID NO: 269739 - RNA, 64 nt, Homo Sapiens
uuuuacaaauacuuuguuuugugcaaaaaaaugcuuuuuaaaaugauagaaaagaucugaccaa

SEQ ID NO: 269740 - RNA, 64 nt, Homo Sapiens
gcugaagugaccuuagcagaccagagauuuuauuuuuuuaaagagaaaucaguuuaccuguuuu

SEQ ID NO: 269741 - RNA, 64 nt, Homo Sapiens
auuuuauuuuuuuaaagagaaaucaguuuaccuguuuuuaaaaaaauuaaaucuaguucaccuu

SEQ ID NO: 269742 - RNA, 64 nt, Homo Sapiens
uuuuucuuuucuucuuuuuuauuauuuuuuucuuuuuuuaaaaaguucugaccgugguuuccug

SEQ ID NO: 269743 - RNA, 64 nt, Homo Sapiens
auuuaaauguguguucuguuuuguuuuuuaacgauuuuuaaauaacgucugugccuccacuggu

SEQ ID NO: 269744 - RNA, 64 nt, Homo Sapiens
aagccugcaauuucucgacaaaacaacacaagauuuuuuaaagauggaaucagaaacuacgugg

SEQ ID NO: 269745 - RNA, 64 nt, Homo Sapiens
uuuaacucagcaagugagaacuuacaagaggguuuuuuuaaaauuuuuuuuucucuuaaugaac

SEQ ID NO: 269746 - RNA, 64 nt, Homo Sapiens
aucacauaccugcagacaaacuggagcaauguuauuuuuaaaggguuuuuuucaccuccuuauu

SEQ ID NO: 269747 - RNA, 64 nt, Homo Sapiens
cauucaaaguacuuuuuuuugaaaauacagauuuuuuuuaaaagugaauaauguguucaacucu

SEQ ID NO: 269748 - RNA, 64 nt, Homo Sapiens
uuaauuguacuucuaugaaauaauaugcagucuauuuuuaaauuauaaauuaugugugaacuua

SEQ ID NO: 269749 - RNA, 64 nt, Homo Sapiens
uauuacaagcaauucaauuguacacuuuuaguuauuuuuaaauuuacaauguuauugauuacag

SEQ ID NO: 269750 - RNA, 64 nt, Homo Sapiens
uaaaaucuauacauuucugaguucugaauaaauauuuuuaaaaauuuuaauauauuuuucuuug

SEQ ID NO: 269751 - RNA, 64 nt, Homo Sapiens
uauuuaugaaaguuaauccauuucugauacgugguuuuuaaaaauaugaaauggauuuauauau

SEQ ID NO: 269752 - RNA, 64 nt, Homo Sapiens
augaaaagcauccccaaaauuucaaugaugugaauuuuuaaauuaccuuuauuucuuuaaacua

SEQ ID NO: 269753 - RNA, 64 nt, Homo Sapiens
uguguuuuuaguuuucauagacacuuauuuaaucuuuuuaaauuguacagcaaggugcucuaag

SEQ ID NO: 269754 - RNA, 64 nt, Homo Sapiens
uguuacacgaagauaaacugaauaagcauuuagcuuuuuaaaucauuuuaaaaauuaagucuaa

SEQ ID NO: 269755 - RNA, 64 nt, Homo Sapiens
caaugauaacccuguuuauugugggauaucaauauuuuuaaagugccaacacagucaugauagg

SEQ ID NO: 269756 - RNA, 64 nt, Homo Sapiens
guggccauuggccaaauauggccucccaacuguuuuuuuaaaauaaaguuuuauuggaacacag

SEQ ID NO: 269757 - RNA, 64 nt, Homo Sapiens
ucuguaucaucaccaguacuuuguacuuugagucuuuuuaaauaugcucuguuaguuuguaugg

SEQ ID NO: 269758 - RNA, 64 nt, Homo Sapiens
uuugugaaguguguguugaagccuugcagauuauuuuuuaaauuagagguuuaucacuagguau

SEQ ID NO: 269759 - RNA, 64 nt, Homo Sapiens
cuuaguuuacagugcaauuuuaucucaggaauuauuuuuaaaaggaggaggggacauagaaaaa

SEQ ID NO: 269760 - RNA, 64 nt, Homo Sapiens
auuguagccauaugguaaauuuuuauuuguuaaauuuuuaaaaauuacuuagcucaaaauguca

SEQ ID NO: 269761 - RNA, 64 nt, Homo Sapiens
uaaaaauuacuuagcucaaaaugucagugguaaauuuuuaaauugaguaaagugauucuucuuu

SEQ ID NO: 269762 - RNA, 64 nt, Homo Sapiens
aacauugucucuugaccuuuuuuuuuuuuuuuuuuuuuuaaagagacagagucucacucuguca

SEQ ID NO: 269763 - RNA, 64 nt, Homo Sapiens
uuguccaguuuccaauagaagugggagauccagauuuuuaaaugggauaacuuuuuauagguuc

SEQ ID NO: 269764 - RNA, 64 nt, Homo Sapiens
auuuaucuuaauugaugucuguacuccacccccauuuuuaaauauuaaaaagcugcugcaaaua

SEQ ID NO: 269765 - RNA, 64 nt, Homo Sapiens
gggggaaaaacauccaagcaaaaccucaaaaguuuuuuuaaaguaaaagacaaaaaaaaaaaaa

SEQ ID NO: 269766 - RNA, 64 nt, Homo Sapiens
acaaaaaaaaaaaaaaaaccuuaauguuacgauguuuuuaaaagggacggugaacggccaugug

SEQ ID NO: 269767 - RNA, 64 nt, Homo Sapiens
uccaggugugccgcacccacuuuuauuucugacuuuuuuaaaaugcauugggaugucugguugu

SEQ ID NO: 269768 - RNA, 64 nt, Homo Sapiens
ucucgauugccguuucaauugaugggguaacaauuuuuuaaaacaauaacugaaaucccccagc

SEQ ID NO: 269769 - RNA, 64 nt, Homo Sapiens
aagguuucuguuaacgaggcuucuuguucugccauuuuuaaaucuuuuuuuuuaaauaaaugug

SEQ ID NO: 269770 - RNA, 64 nt, Homo Sapiens
aauguguucuuguucugccaucacuuuuuuuuuuuuuuuaaauauagcucaauacaaugugaac

SEQ ID NO: 269771 - RNA, 64 nt, Homo Sapiens
caaaguaaauccugccaccagaacuugggggaucuuuuuaaaagcugguagccaggguucccuc

SEQ ID NO: 269772 - RNA, 64 nt, Homo Sapiens
aucaugaaaccaaaaagagauuugucuuuucuguuuuuuaaauguuuuuaaagacugugaaaug

SEQ ID NO: 269773 - RNA, 64 nt, Homo Sapiens
cugugaaauguuugucuuuuccucagacuucuauuuuuuaaagacccaggacucuggcuucucu

SEQ ID NO: 269774 - RNA, 64 nt, Homo Sapiens
uucagaugaugugugaacuuuaaaaugcaguacauuuuuaaauucuauuuguacuuuuauguaa

SEQ ID NO: 269775 - RNA, 64 nt, Homo Sapiens
gcuaauauugcugugauucaaaagaaguacagauuuuuuaaaaaaaguguucuuuuuuccuuga

SEQ ID NO: 269776 - RNA, 64 nt, Homo Sapiens
uaauuccacaauuaguguauuagugcauacaaaauuuuuaaaugagaauaauuuuuacaaaauu

SEQ ID NO: 269777 - RNA, 64 nt, Homo Sapiens
uuucuaauauuuauuuuuugggccugaauaaguauuuuuaaaguuaaaaucccuacauuucuga

SEQ ID NO: 269778 - RNA, 64 nt, Homo Sapiens
ucagauuauaugugauguuaaaaaugcaguauauuuuuuaaauuuuuuacuaauacuuuuauau

SEQ ID NO: 269779 - RNA, 64 nt, Homo Sapiens
uuuuaaucauuaagucuguagauacaggaaaaauuuuuuaaaaauacuaaaacauauuuuugca

SEQ ID NO: 269780 - RNA, 64 nt, Homo Sapiens
uauuuauuagaaaucaaagauauuuugcacaugauuuuuaaaggucccuggcaggcaucagaac

SEQ ID NO: 269781 - RNA, 64 nt, Homo Sapiens
ccuuaccagcuuaguuauaaguaugaagcucuguuuuuuaaacuuaaaauaaaauaauaauaau

SEQ ID NO: 269782 - RNA, 64 nt, Homo Sapiens
auuagagugaagaaaaaugauauuaacagaaauauuuuuaaaaaagugacaaauuaagucuaua

SEQ ID NO: 269783 - RNA, 64 nt, Homo Sapiens
cuuagggcaggaaagaacuuuuuauaagaagauguuuuuaaaacauacuuaauaauauaacagu

SEQ ID NO: 269784 - RNA, 64 nt, Homo Sapiens
uuaaaauguauuuggaggagauuuuuaagcgcauuuuuuaaaacguaaagguaaaagguuugaa

SEQ ID NO: 269785 - RNA, 64 nt, Homo Sapiens
uuaaaauguaauguugcugccaguagaaaaagaauuuuuaaaaauccagucacuagaguucuuu

SEQ ID NO: 269786 - RNA, 64 nt, Homo Sapiens
agcaaauguuaauauuccaguuaaauuuaaaacauuuuuaaaaugcaugcagaaggcggaguuu

SEQ ID NO: 269787 - RNA, 64 nt, Homo Sapiens
uaaaacauuuuuaaaauagcugcagaaggcggaguuuuuaaauucccacuugggcaaaaacgca

SEQ ID NO: 269788 - RNA, 64 nt, Homo Sapiens
ucgcuuuauaaaaacaaaaaguuugguacauaucuuuuuaaagauuuccaccuuucuaaaacca

SEQ ID NO: 269789 - RNA, 64 nt, Homo Sapiens
gcuacauaugccccucccaaauaguuacaaagauuuuuuaaaaaccauuuuauuccuaaacaag

SEQ ID NO: 269790 - RNA, 64 nt, Homo Sapiens
guuuauuguuaauguauggauuuuuuuaauuuucuuuuuaaauuuucuuuagcaaaugaaagug

SEQ ID NO: 269791 - RNA, 64 nt, Homo Sapiens
gaaauuauauaaaaauacuuugaagcuccauuauuuuuuaaaaaaaauaccugaugcccuuauu

SEQ ID NO: 269792 - RNA, 64 nt, Homo Sapiens
ugagccaggugugguaguguucucuacaaacaauuuuuuaaaaaggcaacaugaugagacccca

SEQ ID NO: 269793 - RNA, 64 nt, Homo Sapiens
guuuauuuuagccauucuaaagccccagcuuaguuuuuuaaaaaaggggugagccaccacgccc

SEQ ID NO: 269794 - RNA, 64 nt, Homo Sapiens
cuuuucuuguuuauuuguuuuagugguuuaucaauuuuuaaaacguccucucucucuuucuugc

SEQ ID NO: 269795 - RNA, 64 nt, Homo Sapiens
cagccagcuuaucccucuuaagugccaaaacuuuuuuuuaaaccauuuuuuaucguuuuugaag

SEQ ID NO: 269796 - RNA, 64 nt, Homo Sapiens
uuuaaaccauuuuuuaucguuuuugaaggagaucuuuuuaaaaccuacaagagacaucucucua

SEQ ID NO: 269797 - RNA, 64 nt, Homo Sapiens
cagaugaauuguuuucaucugaagccugcuaucuuuuuuaaaagaugugcuauuuauucuugca

SEQ ID NO: 269798 - RNA, 64 nt, Homo Sapiens
uaugucuuauuuuuuuccuaaaagauaauguuuauuuuuaaaaaggaaggaaggagcaagugaa

SEQ ID NO: 269799 - RNA, 64 nt, Homo Sapiens
uugaugaacagaaauaaagugauaacaagaguuauuuuuaaacagaacuccucuuaccccccaa

SEQ ID NO: 269800 - RNA, 64 nt, Homo Sapiens
cuacauuuaauguaaugagauaccuuuguucauuuuuuuaaauuugaaauauacuuuaccugau

SEQ ID NO: 269801 - RNA, 64 nt, Homo Sapiens
ucaauuaaaaagcacacuucuacaaaagauuugguuuuuaaauuaugguuacacauuucaguaa

SEQ ID NO: 269802 - RNA, 64 nt, Homo Sapiens
cucuauaucaugcuuuaaaguguaauaauaugauuuuuuaaaagaaauuuauuacuuguugcaa

SEQ ID NO: 269803 - RNA, 64 nt, Homo Sapiens
uuuuaaaagaaauuuauuacuuguugcaaaggucuuuuuaaaccaguuuagauuucaagaaaaa

SEQ ID NO: 269804 - RNA, 64 nt, Homo Sapiens
aaauaaaucucuugcuggauuugagaguauugcauuuuuaaagucucucuucuguaacuggaug

SEQ ID NO: 269805 - RNA, 64 nt, Homo Sapiens
cuuguucacguuuagugguguuuugcuguuuuguuuuuuaaacaaaugaugcugagaauaagga

SEQ ID NO: 269806 - RNA, 64 nt, Homo Sapiens
ucagcacauacuguguuguacuuuuguaaaugauuuuuuaaauggaauuuugcacauaauacau

SEQ ID NO: 269807 - RNA, 64 nt, Homo Sapiens
aacuucugcuaacuugcacggcuuuaucacagcauuuuuaaagcuuucccucaaaaauccugau

SEQ ID NO: 269808 - RNA, 64 nt, Homo Sapiens
auaaaugucugcuuuguaaaagcaguuuugcaauuuuuuaaagaucuauuucuguuauaauuua

SEQ ID NO: 269809 - RNA, 64 nt, Homo Sapiens
uccuuuuacauccuggaacaacaauaaaaacauuuuuuuaaacuugucuacuguaagauacugc

SEQ ID NO: 269810 - RNA, 64 nt, Homo Sapiens
uauaaauaucacccaaaaggcuuucugcccuauauuuuuaaaauacagaauaguuauauuugaa

SEQ ID NO: 269811 - RNA, 64 nt, Homo Sapiens
aucaguguuuucugcaaggguugugaccugaaacuuuuuaaaaaccacccaccuuuggggaagc

SEQ ID NO: 269812 - RNA, 64 nt, Homo Sapiens
aauugucuuccucgauucuccaucggguguagaguuuuuaaacuaucaauggcauuucaagucu

SEQ ID NO: 269813 - RNA, 64 nt, Homo Sapiens
cuggcaggguuuuuuuguuuuauuuguuugcuuauuuuuaaauuaacuguuuugagcuuugaau

SEQ ID NO: 269814 - RNA, 64 nt, Homo Sapiens
gggaaagaacauaaaagcuuuuugaacuacagccuuuuuaaaagagggaugggaggauauuaca

SEQ ID NO: 269815 - RNA, 64 nt, Homo Sapiens
ugauuaacauugacaggauuacuguguguuuaauuuuuuaaaaacugaacacugugauuauggg

SEQ ID NO: 269816 - RNA, 64 nt, Homo Sapiens
cuucagucauaccggaaucugaaucaaaaaaguauuuuuaaauauccaugauuucucccuguau

SEQ ID NO: 269817 - RNA, 64 nt, Homo Sapiens
guggccagauucuguuauuugcaauuaaagcaaguuuuuaaaaaaugcaagaggcaguuguuag

SEQ ID NO: 269818 - RNA, 64 nt, Homo Sapiens
caggcaugagccaccgcuccuggccucucuuucuuuuuuaaacaaagaacuuugcacuuggcca

SEQ ID NO: 269819 - RNA, 64 nt, Homo Sapiens
acacuuacguguuagacaagaacuaugauuuuuuuuuuuaaaguacuggugucacccuuugccu

SEQ ID NO: 269820 - RNA, 64 nt, Homo Sapiens
gucacccuuugccuauaugguagagcaauaaugcuuuuuaaaaauaaacuucugaaaacccaag

SEQ ID NO: 269821 - RNA, 64 nt, Homo Sapiens
ugccucgcucuuuucaaucucuuaaucuaaaugcuuuuuaaagagauuauuuguuuagauguag

SEQ ID NO: 269822 - RNA, 64 nt, Homo Sapiens
aagagauuauuuguuuagauguaggcauuuuaauuuuuuaaaaauuccucuaccagaacuaagc

SEQ ID NO: 269823 - RNA, 52 nt, Homo Sapiens
uauggaaugcaucuuggugauauuuuuaaauuaauauuuuaaauugcuugaa

SEQ ID NO: 269824 - RNA, 64 nt, Homo Sapiens
aaagaaauauauauauacuuuuuuucuuuuuucuuuuuuaaagacagggucucacucucauugc

SEQ ID NO: 269825 - RNA, 64 nt, Homo Sapiens
ccuucuucaaaugacauggaaagcaaaacuuucuuuuuuaaaaauuuucauuuauuuaauggaa

SEQ ID NO: 269826 - RNA, 64 nt, Homo Sapiens
gcccauuuucacaugucugcuuauuuauuuuauauuuuuaaaagaagacaguauucaccuaugu

SEQ ID NO: 269827 - RNA, 64 nt, Homo Sapiens
ucaugugugugccaccaaacacguuauuggcaccuuuuuaaauaagcucucaugaucaagaugg

SEQ ID NO: 269828 - RNA, 64 nt, Homo Sapiens
aacauguuugguuuucuuacgauacagggccauuuuuuuaaaacucucaggacugaacagaaga

SEQ ID NO: 269829 - RNA, 64 nt, Homo Sapiens
ucaagaguuuuucuaccucuuuaacaguuaauauuuuuuaaaggaagaaauggaauguaccuuc

SEQ ID NO: 269830 - RNA, 64 nt, Homo Sapiens
guccacaguggcaauaccggacuucuguucaagcuuuuuaaagugcugagccuuacaaaccccu

SEQ ID NO: 269831 - RNA, 64 nt, Homo Sapiens
gaagcacuucuauccaaaaugacuuuuuuguccuuuuuuaaaaccaauuuacuguuacuggaaa

SEQ ID NO: 269832 - RNA, 64 nt, Homo Sapiens
auucauugaguuuaccaaaauuaccaucggguauuuuuuaaagugaaauuuuucuguaauuuuc

SEQ ID NO: 269833 - RNA, 64 nt, Homo Sapiens
agaauaaacauuaaaaacuagaaaaagaaaaucuuuuuuaaaccauguagaaguagaaagaaaa

SEQ ID NO: 269834 - RNA, 64 nt, Homo Sapiens
ucuguaugcuagcacaccaauucauuugucaccauuuuuaaaacaacagggcaagacguuuggu

SEQ ID NO: 269835 - RNA, 64 nt, Homo Sapiens
ucacauuuuccaugaacgccgauaaaguuaaauauuuuuaaagacacaguauaccacuccuugg

SEQ ID NO: 269836 - RNA, 64 nt, Homo Sapiens
ugcuuagacaaaaaaaaucaaccaaaagucuugguuuuuaaaugauucagagcuaucgcucaaa

SEQ ID NO: 269837 - RNA, 64 nt, Homo Sapiens
gaaccuuuccauacuucgugccaaaagacaaguguuuuuaaaaagggacaauuuggauuuuguu

SEQ ID NO: 269838 - RNA, 64 nt, Homo Sapiens
uggggaaugcaaauauauauucuccaaauuguaguuuuuaaauuauuuuuuguguggaaaaaaa

SEQ ID NO: 269839 - RNA, 64 nt, Homo Sapiens
agaauuuuaauaaaaauccuagaaagcuuucgauuuuuuaaauauccccaacagcgccgggcgc

SEQ ID NO: 269840 - RNA, 64 nt, Homo Sapiens
aaaauaagaaaaugcuaaauagaauuucuuccuuuuuuuaaaaaagaacacuuuaaaaauacag

SEQ ID NO: 269841 - RNA, 64 nt, Homo Sapiens
uaacauaggaaagccuuuccaaaauaacacagucuuuuuaaaacgacaaaaaaaaauugaauua

SEQ ID NO: 269842 - RNA, 64 nt, Homo Sapiens
caucucauggucuccaguuugcauuuggaacuucuuuuuaaaguguuuugugcggcucgauggg

SEQ ID NO: 269843 - RNA, 64 nt, Homo Sapiens
auagauuuucuaaaacacagcuuaaaaauagauauuuuuaaaaaauguaagguuuaucuucugg

SEQ ID NO: 269844 - RNA, 64 nt, Homo Sapiens
uauguuauuaaucuuuuaguucuguaucuggagcuuuuuaaaauggaaauauauuauuuguuag

SEQ ID NO: 269845 - RNA, 64 nt, Homo Sapiens
augaaacaguguuaagugaauuauuauuaguggcuuuuuaaaaaacaguaguuuggauguacaa

SEQ ID NO: 269846 - RNA, 64 nt, Homo Sapiens
auucuugaaaauguauucugcauuggaguuucaguuuuuaaaaaacuguuuaucuuguucuggg

SEQ ID NO: 269847 - RNA, 64 nt, Homo Sapiens
ugaaguugaaauuaucuuugguguuauaucuagguuuuuaaaacaggggcccauucauaagaaa

SEQ ID NO: 269848 - RNA, 64 nt, Homo Sapiens
gaacuuuuuuuccccccaaucggccuaaacuuuguuuuuaaaaucaggcaugagccaccaugcc

SEQ ID NO: 269849 - RNA, 64 nt, Homo Sapiens
uuuuuuuuuuuuuuugagacuuaaacagacucgcuuuuuaaacuuguuuaccaaauauucuccu

SEQ ID NO: 269850 - RNA, 64 nt, Homo Sapiens
uuaauuuucuagcuggcuccccauguaaaaugccuuuuuaaaaugaaguauaauuguaaauaag

SEQ ID NO: 269851 - RNA, 64 nt, Homo Sapiens
auuaccuucuuuggguggggucuuugguuucauuuuuuuaaaaacuucuagaucucugguguuc

SEQ ID NO: 269852 - RNA, 64 nt, Homo Sapiens
augcaacguaagauguccucgaaaaaauuuuuuuuuuuuaaauuauagagcaaggguaauccua

SEQ ID NO: 269853 - RNA, 64 nt, Homo Sapiens
gucaaugauuuuguauuauguguauguuuuuuuuuuuuuaaacuuugugcucuuucauuuaaaa

SEQ ID NO: 269854 - RNA, 64 nt, Homo Sapiens
uuugagagacuuccccucuuaguaaaaauaaaaguuuuuaaauaauaccuucaaauucucugaa

SEQ ID NO: 269855 - RNA, 64 nt, Homo Sapiens
guguaugugcauaugaagcaagaugaagcaauaauuuuuaaauuccuuuauggcauuaggguaa

SEQ ID NO: 269856 - RNA, 64 nt, Homo Sapiens
ugauuccuuuauggcauuaguuaaaauuguuuauuuuuuaaaugcauuauuuuguuagaggacc

SEQ ID NO: 269857 - RNA, 64 nt, Homo Sapiens
gacuuuaacgaagucaaacaagagaacaccucuauuuuuaaaagaaaaacauuauugggaaacu

SEQ ID NO: 269858 - RNA, 64 nt, Homo Sapiens
gauguucaaacuaauaaauaaugugacugauuuuuuuuuaaaucugucaugaaggguuuuuuuu

SEQ ID NO: 269859 - RNA, 64 nt, Homo Sapiens
cuuuuucuaaacagacugacuaccuuuccccugauuuuuaaaccugagaauucucagaacuuug

SEQ ID NO: 269860 - RNA, 64 nt, Homo Sapiens
aauaaagguuuguuuugguuuguuauggcuuccuuuuuuaaaaaauuacccuguagugccaguu

SEQ ID NO: 269861 - RNA, 64 nt, Homo Sapiens
auagacaugucucaauuauauauguguguguauguuuuuaaagcuaaaaacauuacuuuuagau

SEQ ID NO: 269862 - RNA, 64 nt, Homo Sapiens
uuuuuucucaucuaugcaauucccauaugguuuuuuuuuaaaucauauuuuauucauuuucucc

SEQ ID NO: 269863 - RNA, 64 nt, Homo Sapiens
augcuaaugauugaauuaucuuuuccaaagauuuuuuuuaaaugugaugucgguaaauugaaau

SEQ ID NO: 269864 - RNA, 64 nt, Homo Sapiens
uaaaugugaugucgguaaauugaaauaacauaauuuuuuaaaacuuggauggagagaugagaag

SEQ ID NO: 269865 - RNA, 64 nt, Homo Sapiens
cuuguaaauauacuccuaguaauuuaagauuuuguuuuuaaacuggaaauaaaagauuguauag

SEQ ID NO: 269866 - RNA, 64 nt, Homo Sapiens
uuaaacuggaaauaaaagauuguauagugcauguuuuuuaaagucuaugugaaguguuuucuuu

SEQ ID NO: 269867 - RNA, 64 nt, Homo Sapiens
gaaaacaaauuagguuuggguucaauuccuucaauuuuuaaaaaacuggucucugagaguuuuu

SEQ ID NO: 269868 - RNA, 64 nt, Homo Sapiens
uccuucaauuuuuaaaaaacuggucucugagaguuuuuuaaaucauugagagccuguuuuucuu

SEQ ID NO: 269869 - RNA, 64 nt, Homo Sapiens
ucugcacaaagaugucuucuguucauccugaacauuuuuaaaaaaugcagaauuuuaugugacu

SEQ ID NO: 269870 - RNA, 64 nt, Homo Sapiens
guucugcacuuugacacaagguguaacuagaccauuuuuaaaugucaguugaaaauuauggcug

SEQ ID NO: 269871 - RNA, 64 nt, Homo Sapiens
ccacaucuuagcaagcaccaaaaaacuaaagcaguuuuuaaaccgauauuuacguaaagaaaau

SEQ ID NO: 269872 - RNA, 64 nt, Homo Sapiens
caccaggaaagcuuuucuuuuucuuuuuuuuuuuuuuuuaaacaccaagagcacguauagcaug

SEQ ID NO: 269873 - RNA, 64 nt, Homo Sapiens
guagaccguaaggaugaauuccacaauaggauccuuuuuaaaaucgauuuuaaauuguugccua

SEQ ID NO: 269874 - RNA, 64 nt, Homo Sapiens
ccuaucugaccuuguguguaaauacguacaucuguuuuuaaaguggaugggccccugagaacuc

SEQ ID NO: 269875 - RNA, 64 nt, Homo Sapiens
uucagaagaagcgacggcaccgucaacccucuguuuuuuaaaggugguuggagacuguuaacac

SEQ ID NO: 269876 - RNA, 64 nt, Homo Sapiens
uguaaauuuaauuguacauaugguugauuuauuauuuuuaaaaauacagacuaacugauguaau

SEQ ID NO: 269877 - RNA, 64 nt, Homo Sapiens
uucaacuguguucuuuaaaauaaauccuaccugguuuuuaaauuuuauuuuucaugaaaaugcu

SEQ ID NO: 269878 - RNA, 64 nt, Homo Sapiens
ugauguaaauagugauuuccgauguuaaaaucgguuuuuaaaggauauugacuuguuacaugaa

SEQ ID NO: 269879 - RNA, 64 nt, Homo Sapiens
cuaaacuguuaaacaacucugccuacauaacacauuuuuaaaguauuuugcuuuucagaaguca

SEQ ID NO: 269880 - RNA, 64 nt, Homo Sapiens
uaaugaguaugaacuugagauccaguuuuggaucuuuuuaaaacagaauaaaauguaccugcca

SEQ ID NO: 269881 - RNA, 64 nt, Homo Sapiens
uaggcaacuacuuuggguuauuuuacaaguuucauuuuuaaaagugguuugggcucccucuuau

SEQ ID NO: 269882 - RNA, 64 nt, Homo Sapiens
gccaauuuuuguccaguuuucauuacuuuucagcuuuuuaaaaguugaacuuaugaaucauacu

SEQ ID NO: 269883 - RNA, 64 nt, Homo Sapiens
uuccuuuuagagacagucuuuacaaugucagguguuuuuaaaaacuggaggagaaaaaaugagu

SEQ ID NO: 269884 - RNA, 64 nt, Homo Sapiens
uaauauuguuaaucaguaaaacauuuucgaagauuuuuuaaaaaaggaccuaaaccuuuaugcu

SEQ ID NO: 269885 - RNA, 64 nt, Homo Sapiens
ccaacuacugucauuaagaaauucuuucaaauuuuuuuuaaaagucuaguuuguguuacgaggu

SEQ ID NO: 269886 - RNA, 64 nt, Homo Sapiens
agaauaauaaagguuggagaaagaaacaaaauauuuuuuaaacaugaauugugaaaugugucau

SEQ ID NO: 269887 - RNA, 64 nt, Homo Sapiens
gauuucuguucuaaugccauaaaaccccuuccccuuuuuaaaauagcacaacugauuccaacac

SEQ ID NO: 269888 - RNA, 64 nt, Homo Sapiens
ccaaagauugacccaguuacgggaaaggcggguauuuuuaaaagaaacagaggcauugagaaag

SEQ ID NO: 269889 - RNA, 64 nt, Homo Sapiens
aaauccuguauauguaucuaaaguuuuuguuuuuuuuuuaaagcagguuuaggucaguguuuuu

SEQ ID NO: 269890 - RNA, 64 nt, Homo Sapiens
uuguaucuuuacuagaacaucccuuuuuggacaauuuuuaaaauccuucauauaaaaauucagg

SEQ ID NO: 269891 - RNA, 64 nt, Homo Sapiens
aauuuauuggauuuuccuccggaauagcuaaaccuuuuuaaaaaauuguauuaaauagcauugg

SEQ ID NO: 269892 - RNA, 64 nt, Homo Sapiens
gaucuguuccucuguuuuucuuuuugauuuuuguuuuuuaaaccaaaacagacaauagcuuauu

SEQ ID NO: 269893 - RNA, 64 nt, Homo Sapiens
aaaauaagcucauacccaaauucacaaagccuauuuuuuaaaccaaagcacauuuugaaugagu

SEQ ID NO: 269894 - RNA, 64 nt, Homo Sapiens
cagcacuaaccagaccuccagccacucacagcucuuuuuaaaaaacagcuucaaaauaugcagc

SEQ ID NO: 269895 - RNA, 64 nt, Homo Sapiens
aauccagaaaauuucaaaugcaguugaguauucuuuuuuaaaugcagauuuucaaaacauauuu

SEQ ID NO: 269896 - RNA, 64 nt, Homo Sapiens
gaccccgcagagcugcauugacuaccagauuuauuuuuuaaaccagaaaauguuuuaaauuuau

SEQ ID NO: 269897 - RNA, 64 nt, Homo Sapiens
uaacaauguucaugguugugauguuuuuuuuuuuuuuuuaaauaaaauuccaaauguuuauaaa

SEQ ID NO: 269898 - RNA, 64 nt, Homo Sapiens
guuggaaagaagacaguugagcacuucaggaugguuuuuaaauuugguaugagauucucugcca

SEQ ID NO: 269899 - RNA, 64 nt, Homo Sapiens
uucuugcaguuuuuauaucauuguuuuauuuuguuuuuuaaauaaauucuagugguuugaucca

SEQ ID NO: 269900 - RNA, 64 nt, Homo Sapiens
uaccuuaucucuccccacucuuuuccuugauuucuuuuuaaagggucuggagaaaucucucccu

SEQ ID NO: 269901 - RNA, 64 nt, Homo Sapiens
agauucaggauauauauuauggauuauauaugacuuuuuaaacaccaaaaauagugaaacuagu

SEQ ID NO: 269902 - RNA, 64 nt, Homo Sapiens
aauauguaaagugcagucuuauuuuuuucuuucuuuuuuaaaaaagcucaugaaauugaguguu

SEQ ID NO: 269903 - RNA, 64 nt, Homo Sapiens
agaaacuugucugccacagugaaccucaaaaguuuuuuuaaaaaaggguuaauuuaaagggggg

SEQ ID NO: 269904 - RNA, 64 nt, Homo Sapiens
uaaaagcaaaauguaagaucuuuuagaaguuuacuuuuuaaaaacacauaccaguguauaagau

SEQ ID NO: 269905 - RNA, 64 nt, Homo Sapiens
gagguggaauacccaaggucgauuaucugccccauuuuuaaaacucuucuugcaaucuccugag

SEQ ID NO: 269906 - RNA, 64 nt, Homo Sapiens
cuuuaaaaacacucaccauacugauggagcaugcuuuuuaaaucaaugagaaaaagcuauuaug

SEQ ID NO: 269907 - RNA, 64 nt, Homo Sapiens
cuuuaucuuuuucuuuaaagcauuuugacuugucuuuuuaaauguggauaugugguuccugaug

SEQ ID NO: 269908 - RNA, 64 nt, Homo Sapiens
uucaaaauauuuaaaacaaacaaacuuuaaacacuuuuuaaaucuguuuuccuacuaggaauua

SEQ ID NO: 269909 - RNA, 64 nt, Homo Sapiens
acagcuauagucaagagcuuuauaauaucugcuauuuuuaaaagaugcgaaauuagaaaaaaau

SEQ ID NO: 269910 - RNA, 64 nt, Homo Sapiens
ccagucuuauccugaauuccauuuuaccacauuuuuuuuaaaggugguaaauuuuauguaguau

SEQ ID NO: 269911 - RNA, 64 nt, Homo Sapiens
uuuagcuggguguggugguaucuaugaaaaaacuuuuuuaaaaauaacauaaugagaccugucc

SEQ ID NO: 269912 - RNA, 64 nt, Homo Sapiens
gagucuauauguuuucguaaucuucaucaagaaguuuuuaaaaggcaagcaaaaacagaagcaa

SEQ ID NO: 269913 - RNA, 64 nt, Homo Sapiens
uucuuugucucacagaagacuaggagaaagaucuuuuuuaaauaaucuuuuugcuguuuuuaaa

SEQ ID NO: 269914 - RNA, 64 nt, Homo Sapiens
ggagaaagaucuuuuuuaaauaaucuuuuugcuguuuuuaaaaaauuaaacaaggcuuuguguu

SEQ ID NO: 269915 - RNA, 64 nt, Homo Sapiens
ugaauaaucaagugcuaaaacaaaaucaggugcuuuuuuaaaacagcuugauugagauauaauc

SEQ ID NO: 269916 - RNA, 64 nt, Homo Sapiens
uugauugaagauugaaaagggucagcugggaaaauuuuuaaaaagacuguuuuuaaaaaggugc

SEQ ID NO: 269917 - RNA, 64 nt, Homo Sapiens
aaagggucagcugggaaaauuuuuaaaaagacuguuuuuaaaaaggugcuacaaaauaaagugc

SEQ ID NO: 269918 - RNA, 64 nt, Homo Sapiens
uuagacauaucagagcaguguauuucuggaucauuuuuuaaaugaccucuucuaaaacauaacu

SEQ ID NO: 269919 - RNA, 64 nt, Homo Sapiens
uguauagagcuaguuuuaaaauaaugaucucagauuuuuaaaaaggauauaggaaccugcauug

SEQ ID NO: 269920 - RNA, 64 nt, Homo Sapiens
uuuauuauugacauuaaguaaugguaccauauauuuuuuaaaauacauauugacuugaauugug

SEQ ID NO: 269921 - RNA, 64 nt, Homo Sapiens
acguaucuauguuguguaggggaaauuuuuucauuuuuuaaaaauucuacuuugguuuuguugu

SEQ ID NO: 269922 - RNA, 64 nt, Homo Sapiens
auuuuguauuuuuguaauauuuguaaauaugaacuuuuuaaauugcugcaaagaugguuucuuu

SEQ ID NO: 269923 - RNA, 64 nt, Homo Sapiens
uuuauaugucguuggaauuuguaaauuuacauuuuuuuuaaagaagagacugauguguagauag

SEQ ID NO: 269924 - RNA, 64 nt, Homo Sapiens
uuuaguuuuagaauggguuuuuauuuuauuuccuuuuuuaaaauuuuacuuugcuuuuaacauu

SEQ ID NO: 269925 - RNA, 64 nt, Homo Sapiens
agggcaugaaauuggggaagaguguuauuuccguuuuuuaaaugaguugauguacccuuauaua

SEQ ID NO: 269926 - RNA, 64 nt, Homo Sapiens
agaaugcuauagaaauauuuggugguuuuuuuuuuuuuuaaacauccacaguuaagguugggcc

SEQ ID NO: 269927 - RNA, 64 nt, Homo Sapiens
uaagaaguuaccuaauccugcuucuuaacaucaauuuuuaaaaauaucuuaaaauuacuuuguu

SEQ ID NO: 269928 - RNA, 64 nt, Homo Sapiens
aaaugaagcugcaaacuucuuuuuacucuaaucauuuuuaaaauacuaauggaagaacuuucua

SEQ ID NO: 269929 - RNA, 64 nt, Homo Sapiens
aacuguguauguaugugugggguuuuuuucuuuauuuuuaaaugaaaauuaagacaccuuuugu

SEQ ID NO: 269930 - RNA, 64 nt, Homo Sapiens
uuuguuugguuugaguuugauuuggcuuuuauauuuuuuaaaaucccuuuugcuaccccaucug

SEQ ID NO: 269931 - RNA, 64 nt, Homo Sapiens
uuaccugauugauauuacauucaccuuugauuguuuuuuaaaaguuuauuuuuacagaauauau

SEQ ID NO: 269932 - RNA, 64 nt, Homo Sapiens
uguuucuguguuuuugguaugcuaaauaaagcuauuuuuaaacccaagagauuuuuuuucugcc

SEQ ID NO: 269933 - RNA, 64 nt, Homo Sapiens
gaaaacauaagccauggugaacugauaauuuuuguuuuuaaauuauuuauauuacugaauuggc

SEQ ID NO: 269934 - RNA, 64 nt, Homo Sapiens
ggaguuaaaauguguuuuucaguuauaauuucaauuuuuaaauuucuuggugcuuugucuaauu

SEQ ID NO: 269935 - RNA, 64 nt, Homo Sapiens
acauggaguugacauaauacuuuguaaauugaauuuuuuaaagaaauaggcauuugauaaccag

SEQ ID NO: 269936 - RNA, 64 nt, Homo Sapiens
aaugcuaaaacuguagaagcccaaucaccagcaguuuuuaaaaaggugauaacuuuuauuagcu

SEQ ID NO: 269937 - RNA, 64 nt, Homo Sapiens
agcagcuauuaugaaaucagcuuucauaggccuauuuuuaaaaggaaucugaaauuuaauucua

SEQ ID NO: 269938 - RNA, 64 nt, Homo Sapiens
gcuucucauuuaaauaagagagaaaugaugccguuuuuuaaaugugaagcagacuauaauucuc

SEQ ID NO: 269939 - RNA, 64 nt, Homo Sapiens
gugggaauauucagacaaaagaggccauuuuccauuuuuaaagcuucuuacuggugaaacagcc

SEQ ID NO: 269940 - RNA, 64 nt, Homo Sapiens
gaagcaucuuauuuuauaguauaucaaccuuuuguuuuuaaauugaccugccaagguagcugaa

SEQ ID NO: 269941 - RNA, 64 nt, Homo Sapiens
guagcugaagaccuuuuagacaguuccaucuuuuuuuuuaaauuuuuucugccuauuuaaagac

SEQ ID NO: 269942 - RNA, 64 nt, Homo Sapiens
ugggagaugcuuucagguugcagccagaagggguuuuuuaaaugacuucucuggauuucagguu

SEQ ID NO: 269943 - RNA, 64 nt, Homo Sapiens
gauugucugccauguuguugaagcaaaugaauuauuuuuaaauguuaaguaaguaaauaaaccu

SEQ ID NO: 269944 - RNA, 64 nt, Homo Sapiens
ucuuuugagcuggagcugcaaggaaauacaaaaauuuuuaaaaagaaaagauauuggaugcucc

SEQ ID NO: 269945 - RNA, 64 nt, Homo Sapiens
uggcacguuaugccuuucaguguuaacuccuuucuuuuuaaauaaauguuuauuggaggaaaaa

SEQ ID NO: 269946 - RNA, 64 nt, Homo Sapiens
aaaauaacugacaacuguucuaauauuuugcuccuuuuuaaauuuuguagcucaaaagaccuua

SEQ ID NO: 269947 - RNA, 64 nt, Homo Sapiens
cuugugaacaaguaauuuuauauugugcuuuaauuuuuuaaaaaguauucuuuauucauaugua

SEQ ID NO: 269948 - RNA, 64 nt, Homo Sapiens
aguuacaauugcuuucauucgugaagccgaaacguuuuuaaacaugaauuacauaugaauuauu

SEQ ID NO: 269949 - RNA, 64 nt, Homo Sapiens
aagagccuuaaaaguuaaaaacauuuucaguuuuuuuuuaaaaaacguacucuuauuaucugga

SEQ ID NO: 269950 - RNA, 64 nt, Homo Sapiens
cguuaaguuaaacaaguuuucaaaaacaaaacaauuuuuaaaguaccuuaaaauugaggauguu

SEQ ID NO: 269951 - RNA, 64 nt, Homo Sapiens
gaucuccauauuucaaaggaaaguuuuaaaaauguuuuuaaaacuucaaauaucucaccacagu

SEQ ID NO: 269952 - RNA, 64 nt, Homo Sapiens
uacacuaaccgucaugugcuuuuaguaaauaugauuuuuaaaagcaguucaaguugacaacagc

SEQ ID NO: 269953 - RNA, 64 nt, Homo Sapiens
uuaauggcaauuguuuagugauuguaagugauacuuuuuaaagaguaaacugugugaaauuuau

SEQ ID NO: 269954 - RNA, 64 nt, Homo Sapiens
uuugaguuuuaucccguaaguucuguuuugauuuuuuuuaaaaaacaaacccuuuuagucacuu

SEQ ID NO: 269955 - RNA, 64 nt, Homo Sapiens
uaaguuacaaaaagccaauugauguuucuuauucuuuuuaaauuuuaaauauuuuguuauaaau

SEQ ID NO: 269956 - RNA, 64 nt, Homo Sapiens
uuauuucccuagcuaucaucuccugacuuaauguuuuuuaaacccaccaauauaaauuuaauua

SEQ ID NO: 269957 - RNA, 64 nt, Homo Sapiens
uuuacaauaauguaaaaauuaaacuguuuacauuuuuuuaaagcauuguaguuuuuaaaaauua

SEQ ID NO: 269958 - RNA, 64 nt, Homo Sapiens
auuaaacuguuuacauuuuuuuaaagcauuguaguuuuuaaaaauuaagcuguuuuguuuugug

SEQ ID NO: 269959 - RNA, 64 nt, Homo Sapiens
aaguuucagaauuauuggucuucuggguuuuugcuuuuuaaaagaggugugggagcagaggaau

SEQ ID NO: 269960 - RNA, 64 nt, Homo Sapiens
uuuugagcuagggaaaguuggagcuccuuuaaucuuuuuaaaggaucagugcugcccuaaguga

SEQ ID NO: 269961 - RNA, 64 nt, Homo Sapiens
uguguauaaaaugacauugugggagcuguucgauuuuuuaaagguagugucuccugaugacaaa

SEQ ID NO: 269962 - RNA, 64 nt, Homo Sapiens
guucugggauagagaugaagaccguccuugugacuuuuuaaagagguggggcucacugcaacug

SEQ ID NO: 269963 - RNA, 64 nt, Homo Sapiens
uuaaaguuauaaacacguacuugugcgaauuauuuuuuuaaagugauuugccauuuuugaaagc

SEQ ID NO: 269964 - RNA, 64 nt, Homo Sapiens
auuggcaagaaaagaagaauaguuguuuaaauauuuuuuaaaaaacacuugaauaagaaucagu

SEQ ID NO: 269965 - RNA, 64 nt, Homo Sapiens
uaaaguuuucuacaaggggagaaaaguguuaaaauuuuuaaaauauguuuuccaggacacuuca

SEQ ID NO: 269966 - RNA, 64 nt, Homo Sapiens
uuaguuggcuuuugaaucgauuauuucaugcuuuuuuuuaaaaaaaaaaaaaaacaaaauaaca

SEQ ID NO: 269967 - RNA, 64 nt, Homo Sapiens
uuacaauuuuuucaucuaaaaguauuuuaagauauuuuuaaaauccaagagcuucucuauacuu

SEQ ID NO: 269968 - RNA, 64 nt, Homo Sapiens
auagaaaagcaugaguguucaugcuuuaaaaugauuuuuaaauuuguauuuuauauuguuuuau

SEQ ID NO: 269969 - RNA, 64 nt, Homo Sapiens
cuuuuguaaauuaucaagcuucaaaaagcuuuuuuuuuuaaaaaaaaacaugcauauucuaaaa

SEQ ID NO: 269970 - RNA, 64 nt, Homo Sapiens
uucauaauuaucacuaauaagcaucaguuuguuguuuuuaaaaggauauuuaagugagcauuuu

SEQ ID NO: 269971 - RNA, 64 nt, Homo Sapiens
uaguugaauuauuaagccaccacaauaaagcagauuuuuaaauaagaaauaauaauguuaacuu

SEQ ID NO: 269972 - RNA, 64 nt, Homo Sapiens
guggaaaauuacacugugcuuaaugacugauuuuuuuuuaaacugcgagucccuuaagaucacg

SEQ ID NO: 269973 - RNA, 64 nt, Homo Sapiens
agcaaaagaaaaaguguucuagaguguuguugcuuuuuuaaaaaaagcgcugaaguuagaccaa

SEQ ID NO: 269974 - RNA, 64 nt, Homo Sapiens
caaacccuguuaauuauagaauggaccaaauacauuuuuaaaagaaaacugagaccaaucagau

SEQ ID NO: 269975 - RNA, 64 nt, Homo Sapiens
augaugcuaugggaaaaaaauugcaaaauauguauuuuuaaaguucaugauuuguaggcaaaga

SEQ ID NO: 269976 - RNA, 64 nt, Homo Sapiens
acacaguugguaaguggguccauaacuggcaggauuuuuaaauuguauuuugcucaaaucuaug

SEQ ID NO: 269977 - RNA, 64 nt, Homo Sapiens
cuccaaacucucuaaauaguagcuaacuuuuauuuuuuuaaaaugagucgugggguagugcuuc

SEQ ID NO: 269978 - RNA, 64 nt, Homo Sapiens
uuccccuaauuuuccagagaagccuauuuuuauauuuuuaaaaaacugacagggcccaguuaaa

SEQ ID NO: 269979 - RNA, 64 nt, Homo Sapiens
aaacugacagggcccaguuaaauaugauuugcauuuuuuaaauuugccaguuuuauuuucuaaa

SEQ ID NO: 269980 - RNA, 64 nt, Homo Sapiens
gaaacuguaucaaaguuguacauauuuccaaacauuuuuaaaaugaaaaggcacucucguguuc

SEQ ID NO: 269981 - RNA, 64 nt, Homo Sapiens
gcaugagaauauuuuuuuuuuuuaagugcgguaguuuuuaaacuguuuguuuuuaaacaaacua

SEQ ID NO: 269982 - RNA, 64 nt, Homo Sapiens
uuuuuuuuaagugcgguaguuuuuaaacuguuuguuuuuaaacaaacuauagaacucuucauug

SEQ ID NO: 269983 - RNA, 64 nt, Homo Sapiens
gaaauguuuuugaaguuaaauaaacaguauuacauuuuuaaaacucuucucuauuauaacaguc

SEQ ID NO: 269984 - RNA, 64 nt, Homo Sapiens
ugaaauaaaugaccagcaucuguacugauuacaguuuuuaaauuuuuaaguauuuggagcucca

SEQ ID NO: 269985 - RNA, 64 nt, Homo Sapiens
gccacugaggcaacccuaguccuuaaauuucuuuuuuuuaaauuaaguuuuacucugcaauggu

SEQ ID NO: 269986 - RNA, 64 nt, Homo Sapiens
gucauuuaauucuuaaacugauuuuugcuuaauuuuuuuaaauuugccaccauuuuuuccuuau

SEQ ID NO: 269987 - RNA, 64 nt, Homo Sapiens
cuagaaguuagggguuuuguaagcaagagugcaauuuuuaaaauuuguuuguacuaaaaugcaa

SEQ ID NO: 269988 - RNA, 64 nt, Homo Sapiens
auaacaugccuauuaacuggacaaaauuuauuacuuuuuaaaaauuuuaaaaaugacaacauuc

SEQ ID NO: 269989 - RNA, 64 nt, Homo Sapiens
ugacaacauucacaaaauuugauucuguauaggauuuuuaaaaaauagauucugacaguguugu

SEQ ID NO: 269990 - RNA, 64 nt, Homo Sapiens
cuggggaccgauaucacuguaagguauuuuuugcuuuuuaaauacaucuucaguuguguuugug

SEQ ID NO: 269991 - RNA, 64 nt, Homo Sapiens
uauguaauuguucagcgucaagauggcucuauauuuuuuaaagcgaaugagguaaaauggcauu

SEQ ID NO: 269992 - RNA, 64 nt, Homo Sapiens
acuacagauuauuuuuaaugaccuuuuuuuuuuuuuuuuaaaggacuuguauuggaaauuacau

SEQ ID NO: 269993 - RNA, 64 nt, Homo Sapiens
ggaacuuuaguuaauuaagugccuacacaauuuuuuuuuaaaagugcuaagccgcuucauucau

SEQ ID NO: 269994 - RNA, 64 nt, Homo Sapiens
auaggauagaauugucauuuaguuuuugauaaauuuuuuaaauuuuucaugaaguguucuuacc

SEQ ID NO: 269995 - RNA, 64 nt, Homo Sapiens
uucauuguacaguuuacaaacaguucuuuaugucuuuuuaaauuuauuggcauauucaaauugg

SEQ ID NO: 269996 - RNA, 64 nt, Homo Sapiens
ucaguuuuacugcauuuucaauuuacgaauuauuuuuuuaaacuuuuaacaccaacacuguaac

SEQ ID NO: 269997 - RNA, 64 nt, Homo Sapiens
ucagauuuaaaacaagggguucuuuacccaaggauuuuuaaaacuuaugugacgcuggaccuuu

SEQ ID NO: 269998 - RNA, 64 nt, Homo Sapiens
auucauucaauagauaccacuuauuucuuuuugauuuuuaaauccuuuacucuuucaugccauu

SEQ ID NO: 269999 - RNA, 64 nt, Homo Sapiens
ccacaagacauaauuuaaaaccaugugggaugaguuuuuaaauggcuuuuuuagauuuauuguc

SEQ ID NO: 270000 - RNA, 64 nt, Homo Sapiens
gaacaugugaaugaauacacuaaaguauuggauuuuuuuaaaggcacugacaacgaaaguaaag

SEQ ID NO: 270001 - RNA, 64 nt, Homo Sapiens
uucaugucacauccuaauagcugacuuuuuccauuuuuuaaauggagauacgaauuucuauaga

SEQ ID NO: 270002 - RNA, 64 nt, Homo Sapiens
uuaagagcuaaauauucuaaggaaaaggacuuuuuuuuuaaacuucagccuucaguuuaaaaaa

SEQ ID NO: 270003 - RNA, 59 nt, Homo Sapiens
aggaaggcugacagaugagaacacuauuguuuuuaaaccccccuggugggcguccauag

SEQ ID NO: 270004 - RNA, 64 nt, Homo Sapiens
cuagaugagauuaaccuguucagaauucucucucuuuuuaaaacauucuuaguucauacccuuc

SEQ ID NO: 270005 - RNA, 64 nt, Homo Sapiens
cuuaaaugucuggccgggugaaugagcaaagauuuuuuuaaaacuacauuuuuuaaaaaccaca

SEQ ID NO: 270006 - RNA, 64 nt, Homo Sapiens
ccacaaaugagcaaagauuuucauuguaguacauuuuuuaaaaaguuccacaaauaguaugugc

SEQ ID NO: 270007 - RNA, 64 nt, Homo Sapiens
guaaagcaauauauacacagcuuuuucuuuuuccuuuuuaaaaacaucagaaucguuuguaaag

SEQ ID NO: 270008 - RNA, 64 nt, Homo Sapiens
uuaaguccauucuaauuaccaaucuguauauugcuuuuuaaaagcaccaucacacuuuaauucc

SEQ ID NO: 270009 - RNA, 64 nt, Homo Sapiens
ugauuucccgucaucacagccagaacaugagcccuuuuuaaaugaauaauuuugucaaccaaua

SEQ ID NO: 270010 - RNA, 64 nt, Homo Sapiens
uacuguucagaaugcuuuaacuuugauacuugauuuuuuaaaaauucacuucaaauucuauccu

SEQ ID NO: 270011 - RNA, 64 nt, Homo Sapiens
guuggggguguucagccacuuuugaaguuuuuguuuuuuaaaagagaaauauugaauuuuuauu

SEQ ID NO: 270012 - RNA, 64 nt, Homo Sapiens
aaggagacuguguuugguccgcugaacacauuucuuuuuaaaaacaaucaagaaacaaacaaaa

SEQ ID NO: 270013 - RNA, 64 nt, Homo Sapiens
aaagcauucaaguaugacaaggacuggaauuguguuuuuaaagacuguuuuguaauauauauaa

SEQ ID NO: 270014 - RNA, 64 nt, Homo Sapiens
guuucagaguuuguuuuuuuaguuuccuuacauuuuuuuaaauuucaucauguucuuuuacccc

SEQ ID NO: 270015 - RNA, 64 nt, Homo Sapiens
gggcauaccauuucuuccuguuuuacuuuuuuuuuuuuuaaauaaugccaaucuuccauauuag

SEQ ID NO: 270016 - RNA, 64 nt, Homo Sapiens
auacaauuuagaucucugaaucuaaucagaaauauuuuuaaaaacgcuuagugauccacugauc

SEQ ID NO: 270017 - RNA, 64 nt, Homo Sapiens
uuuccccuuuaaguuaugauaacacauuaaaaauuuuuuaaaaauugcaagugacuauuugauu

SEQ ID NO: 270018 - RNA, 64 nt, Homo Sapiens
aacacacuguagauccuuuucuaggaauacacccuuuuuaaauuccaacucuuuuugcuguagg

SEQ ID NO: 270019 - RNA, 64 nt, Homo Sapiens
caguuacaaauuauaauguagagaaauauuuuaauuuuuaaaugugugguguuuuggauuugga

SEQ ID NO: 270020 - RNA, 64 nt, Homo Sapiens
uuagccuaagauauacuugugagcagaaauucuguuuuuaaaaaccuuuagcuguguuauuaua

SEQ ID NO: 270021 - RNA, 64 nt, Homo Sapiens
uugaguggcacaucaaagaaugucaaauauaauuuuuuuaaaaacacauacacacaugcacaua

SEQ ID NO: 270022 - RNA, 64 nt, Homo Sapiens
guguauacauacauacacauacaaggguuugguguuuuuaaagucaugaacccucuacuuauaa

SEQ ID NO: 270023 - RNA, 64 nt, Homo Sapiens
cuguguauuggguguaagguuguuucuucaguacuuuuuaaaugaaaaaguauugucuauaaaa

SEQ ID NO: 270024 - RNA, 64 nt, Homo Sapiens
aacuggauauuucaaucuuuauuguuuaaucuuuuuuuuaaaaauuagaguagguauuaaucuu

SEQ ID NO: 270025 - RNA, 64 nt, Homo Sapiens
uuagaguagguauuaaucuuaaagauacaaaagcuuuuuaaaauuuuauguggcuguaaugaca

SEQ ID NO: 270026 - RNA, 64 nt, Homo Sapiens
uuuuuuuuaauuuuauuuuggaccgauacucacauuuuuaaacuaggugugagccacugcaccc

SEQ ID NO: 270027 - RNA, 64 nt, Homo Sapiens
uuuuuuacauuuuauuuuguuacuaauauucucauuuuuaaacaauucuaggaauuuucagcaa

SEQ ID NO: 270028 - RNA, 64 nt, Homo Sapiens
auaaauauuccuuuuuauacuguucaaaguuguauuuuuaaaaguguaaaugagaugccaguag

SEQ ID NO: 270029 - RNA, 64 nt, Homo Sapiens
cuguuaacugaaauguuuuguagaccuugguauuuuuuuaaacacagugucuguacuacuguug

SEQ ID NO: 270030 - RNA, 64 nt, Homo Sapiens
guguugcauuugauuccugaacuuugauuuccuuuuuuuaaaucacugaguagaaauugacuaa

SEQ ID NO: 270031 - RNA, 64 nt, Homo Sapiens
guguaaguuugacaguauuuuuuucuagcaaugauuuuuaaauuacaucgugacaaugagggcu

SEQ ID NO: 270032 - RNA, 64 nt, Homo Sapiens
caggcagguuagcuagcccauuuagggguguuuuuuuuuaaaacaucacauguucacacuuggg

SEQ ID NO: 270033 - RNA, 64 nt, Homo Sapiens
auuauuaagacagaaugugaaggugauuuucuuuuuuuuaaauuccuuaucuggagagacgugg

SEQ ID NO: 270034 - RNA, 64 nt, Homo Sapiens
aauggacaacaauguacaguccuagugacuuugcuuuuuaaaugaguuaucacuuuucuaccau

SEQ ID NO: 270035 - RNA, 64 nt, Homo Sapiens
aagaagcacucauuaaauaaaccagauuauauuauuuuuaaaugaugagaauguagccuuugug

SEQ ID NO: 270036 - RNA, 64 nt, Homo Sapiens
cagcucuaggaagagcucaauucuuaaagaaugauuuuuaaaaugagcauaucagagaggcaaa

SEQ ID NO: 270037 - RNA, 64 nt, Homo Sapiens; identical to SEQ ID NO: 269952

SEQ ID NO: 270038 - RNA, 64 nt, Homo Sapiens
uuaauggcaauuguuuagugacuguaagugauacuuuuuaaagaguaaacugugugaaauuuau

SEQ ID NO: 270039 - RNA, 64 nt, Homo Sapiens
uuggggacaacaucugaaggguauguugcaugcauuuuuaaaaaaaucaucucauaugcauugu

SEQ ID NO: 270040 - RNA, 64 nt, Homo Sapiens
acuguggagaguuucuguuaggaaaagccauacauuuuuaaaaauguagcaaaaugucaaggga

SEQ ID NO: 270041 - RNA, 64 nt, Homo Sapiens
ggaagauccgcagauucaugcagcauuccauauuuuuuuaaaaaaagguuacacugugcaccga

SEQ ID NO: 270042 - RNA, 64 nt, Homo Sapiens
agacugaaagaauguuaagauuuaucugcaaggauuuuuaaaaaauugaaacuugcauuuuaag

SEQ ID NO: 270043 - RNA, 64 nt, Homo Sapiens
aguguuuaaaagcaaauacugacuuucaaaaaaguuuuuaaaaccugauuugaaagcuaacaau

SEQ ID NO: 270044 - RNA, 64 nt, Homo Sapiens
augauuuaucuagaaauuuaccucaaaagcagaauuuuuaaaacugcauuuuuaaucaguggaa

SEQ ID NO: 270045 - RNA, 64 nt, Homo Sapiens
uaguaguuaggauaacuaaaauucugggccuaauuuuuuaaagaauccaagacaaacuaaacuu

SEQ ID NO: 270046 - RNA, 64 nt, Homo Sapiens; identical to SEQ ID NO: 270042

SEQ ID NO: 270047 - RNA, 64 nt, Homo Sapiens; identical to SEQ ID NO: 270043

SEQ ID NO: 270048 - RNA, 64 nt, Homo Sapiens; identical to SEQ ID NO: 270044

SEQ ID NO: 270049 - RNA, 64 nt, Homo Sapiens; identical to SEQ ID NO: 270045

SEQ ID NO: 270050 - RNA, 64 nt, Homo Sapiens
ugguaucugccagucucuucaacccucuucucacuuuuuaaaaucuuguuccaugccuccaggu

SEQ ID NO: 270051 - RNA, 64 nt, Homo Sapiens
agaugaagguuuaaauauuguugaaaguugcaguuuuuuaaauguguuccuuuuucuucuguga

SEQ ID NO: 270052 - RNA, 64 nt, Homo Sapiens
aacuguuccuuggucuauuuauguauaagaaugcuuuuuaaagcacaugucucauuuuaaauga

SEQ ID NO: 270053 - RNA, 64 nt, Homo Sapiens
uagaugacuuugaaaugcuaauaagugacuuauuuuuuuaaagcuaaccucuuuuagagaacaa

SEQ ID NO: 270054 - RNA, 64 nt, Homo Sapiens
aaaugucuuuuagugugauuacggaaguuugcuguuuuuaaaguggugccuauuauaaaguauu

SEQ ID NO: 270055 - RNA, 64 nt, Homo Sapiens
uuaauagcccauauacaaagguuccaaaauaauuuuuuuaaauaccaugaugauuacauuugug

SEQ ID NO: 270056 - RNA, 64 nt, Homo Sapiens; identical to SEQ ID NO: 226265

SEQ ID NO: 270057 - RNA, 64 nt, Homo Sapiens; identical to SEQ ID NO: 226266

SEQ ID NO: 270058 - RNA, 64 nt, Homo Sapiens; identical to SEQ ID NO: 226267

SEQ ID NO: 270059 - RNA, 64 nt, Homo Sapiens; identical to SEQ ID NO: 226268

SEQ ID NO: 270060 - RNA, 64 nt, Homo Sapiens; identical to SEQ ID NO: 226269

SEQ ID NO: 270061 - RNA, 64 nt, Homo Sapiens; identical to SEQ ID NO: 226270

SEQ ID NO: 270062 - RNA, 64 nt, Homo Sapiens; identical to SEQ ID NO: 226271

SEQ ID NO: 270063 - RNA, 64 nt, Homo Sapiens; identical to SEQ ID NO: 226272

SEQ ID NO: 270064 - RNA, 64 nt, Homo Sapiens; identical to SEQ ID NO: 226273

SEQ ID NO: 270065 - RNA, 64 nt, Homo Sapiens; identical to SEQ ID NO: 226274

SEQ ID NO: 270066 - RNA, 64 nt, Homo Sapiens; identical to SEQ ID NO: 226275

SEQ ID NO: 270067 - RNA, 64 nt, Homo Sapiens; identical to SEQ ID NO: 226276

SEQ ID NO: 270068 - RNA, 64 nt, Homo Sapiens; identical to SEQ ID NO: 226277

SEQ ID NO: 270069 - RNA, 64 nt, Homo Sapiens; identical to SEQ ID NO: 226278

SEQ ID NO: 270070 - RNA, 64 nt, Homo Sapiens; identical to SEQ ID NO: 226279

SEQ ID NO: 270071 - RNA, 64 nt, Homo Sapiens; identical to SEQ ID NO: 226280

SEQ ID NO: 270072 - RNA, 64 nt, Homo Sapiens; identical to SEQ ID NO: 226281

SEQ ID NO: 270073 - RNA, 64 nt, Homo Sapiens; identical to SEQ ID NO: 226282

SEQ ID NO: 270074 - RNA, 64 nt, Homo Sapiens; identical to SEQ ID NO: 226283

SEQ ID NO: 270075 - RNA, 64 nt, Homo Sapiens; identical to SEQ ID NO: 226284

SEQ ID NO: 270076 - RNA, 64 nt, Homo Sapiens; identical to SEQ ID NO: 226285

SEQ ID NO: 270077 - RNA, 64 nt, Homo Sapiens; identical to SEQ ID NO: 226286

SEQ ID NO: 270078 - RNA, 64 nt, Homo Sapiens; identical to SEQ ID NO: 226287

SEQ ID NO: 270079 - RNA, 64 nt, Homo Sapiens; identical to SEQ ID NO: 226288

SEQ ID NO: 270080 - RNA, 64 nt, Homo Sapiens; identical to SEQ ID NO: 226289

SEQ ID NO: 270081 - RNA, 64 nt, Homo Sapiens; identical to SEQ ID NO: 226290

SEQ ID NO: 270082 - RNA, 64 nt, Homo Sapiens; identical to SEQ ID NO: 226291

SEQ ID NO: 270083 - RNA, 64 nt, Homo Sapiens; identical to SEQ ID NO: 226292

SEQ ID NO: 270084 - RNA, 64 nt, Homo Sapiens; identical to SEQ ID NO: 226293

SEQ ID NO: 270085 - RNA, 64 nt, Homo Sapiens; identical to SEQ ID NO: 226294

SEQ ID NO: 270086 - RNA, 64 nt, Homo Sapiens; identical to SEQ ID NO: 226295

SEQ ID NO: 270087 - RNA, 64 nt, Homo Sapiens; identical to SEQ ID NO: 226296

SEQ ID NO: 270088 - RNA, 64 nt, Homo Sapiens; identical to SEQ ID NO: 226297

SEQ ID NO: 270089 - RNA, 64 nt, Homo Sapiens; identical to SEQ ID NO: 226298

SEQ ID NO: 270090 - RNA, 64 nt, Homo Sapiens; identical to SEQ ID NO: 226299

SEQ ID NO: 270091 - RNA, 64 nt, Homo Sapiens; identical to SEQ ID NO: 226300

SEQ ID NO: 270092 - RNA, 64 nt, Homo Sapiens; identical to SEQ ID NO: 226301

SEQ ID NO: 270093 - RNA, 64 nt, Homo Sapiens; identical to SEQ ID NO: 226302

SEQ ID NO: 270094 - RNA, 64 nt, Homo Sapiens; identical to SEQ ID NO: 226303

SEQ ID NO: 270095 - RNA, 64 nt, Homo Sapiens; identical to SEQ ID NO: 226304

SEQ ID NO: 270096 - RNA, 64 nt, Homo Sapiens; identical to SEQ ID NO: 226305

SEQ ID NO: 270097 - RNA, 64 nt, Homo Sapiens; identical to SEQ ID NO: 226306

SEQ ID NO: 270098 - RNA, 64 nt, Homo Sapiens; identical to SEQ ID NO: 226307

SEQ ID NO: 270099 - RNA, 64 nt, Homo Sapiens; identical to SEQ ID NO: 226308

SEQ ID NO: 270100 - RNA, 64 nt, Homo Sapiens; identical to SEQ ID NO: 226309

SEQ ID NO: 270101 - RNA, 64 nt, Homo Sapiens; identical to SEQ ID NO: 226310

SEQ ID NO: 270102 - RNA, 64 nt, Homo Sapiens; identical to SEQ ID NO: 226311

SEQ ID NO: 270103 - RNA, 64 nt, Homo Sapiens; identical to SEQ ID NO: 226312

SEQ ID NO: 270104 - RNA, 64 nt, Homo Sapiens; identical to SEQ ID NO: 226313

SEQ ID NO: 270105 - RNA, 64 nt, Homo Sapiens
cugccucugaggaaagauacagggaacaaaaaucaauuuguacagucuuaauauuaaaagcagc

SEQ ID NO: 270106 - RNA, 64 nt, Homo Sapiens
caugauggcgguugugcaauucugguauccucuaaauuuguaagcauucauaaaacaggaaaaa

SEQ ID NO: 270107 - RNA, 64 nt, Homo Sapiens
agaugugaugaggauuaaaugaaucaaaagacuuaauuuguagauucuuuuagaguuaugagcu

SEQ ID NO: 270108 - RNA, 64 nt, Homo Sapiens
ugccauaaucuuaaaaaaaauuugaaugcucuugaauuuguauauucaauaaaguuauccuuuu

SEQ ID NO: 270109 - RNA, 64 nt, Homo Sapiens
cucuacugucucuaacauuuguaaaccugucucuaauuuguaauuuguaaacccugucucucau

SEQ ID NO: 270110 - RNA, 64 nt, Homo Sapiens
gucucuaacauuuguaaaccugucucuaauuuguaauuuguaaacccugucucucauauuugua

SEQ ID NO: 270111 - RNA, 64 nt, Homo Sapiens
aguuacuaauucuuuugagaacuccuaagagaccaauuuguaagacuuauuuaguauuucauuu

SEQ ID NO: 270112 - RNA, 64 nt, Homo Sapiens
ucugaaguuuggagugauaauuuuuaguggaagcaauuuguaauuuaaguugguaguuauauua

SEQ ID NO: 270113 - RNA, 64 nt, Homo Sapiens
aaauguauacagacuuccaaucugauaucuugcaaauuuguauugaauuuucaggagagaucau

SEQ ID NO: 270114 - RNA, 64 nt, Homo Sapiens
uuuauuaugcaguuaaaucuaucuaguuuuucucaauuuguagucuuccuaaauguuuauacuc

SEQ ID NO: 270115 - RNA, 64 nt, Homo Sapiens
uggggauugguaaagauuguauaauauaggaacaaauuuguacuuacugcuuuuauggcaguuu

SEQ ID NO: 270116 - RNA, 64 nt, Homo Sapiens
cuaauauuaagaaauuguuggaaauacuaagaaaaauuuguauagaaaaaauaaaacuaccuac

SEQ ID NO: 270117 - RNA, 64 nt, Homo Sapiens
gauauuucaugauacaccuaaauaggaagccacaaauuuguaugaaugaagaaggaauaaaaga

SEQ ID NO: 270118 - RNA, 64 nt, Homo Sapiens
uauaauagaucagcgauuuuuguaaggcaaacagaauuuguaaguuggcagaucuuccuaaguu

SEQ ID NO: 270119 - RNA, 64 nt, Homo Sapiens
acauugggugagacagaaaaugaaucuguucuaaaauuuguaauuugcuaacuugauuugaguu

SEQ ID NO: 270120 - RNA, 64 nt, Homo Sapiens
acuuuuauguuccuuucuguuucuacuguagaugaauuuguaauugaaagacauauuauacaaa

SEQ ID NO: 270121 - RNA, 64 nt, Homo Sapiens
cuugugucugaguucuauuuaguuagcaucuugaaauuuguauucauuuuccagauggcuaguu

SEQ ID NO: 270122 - RNA, 64 nt, Homo Sapiens
guuuccuauaccuuuacccuuuaccuaacagacuaauuuguacucaguaaaacaaaaauuuaug

SEQ ID NO: 270123 - RNA, 64 nt, Homo Sapiens
ucuuuauaauuuuguuugucagauaguauuuuggaauuuguauaauaaggauguuuagaagcca

SEQ ID NO: 270124 - RNA, 64 nt, Homo Sapiens
agaagccauauaaguggcuuuuuuuaacagauagaauuuguauuuuuauuguacuuuaaaaaga

SEQ ID NO: 270125 - RNA, 64 nt, Homo Sapiens
cuacuaauuucuuugcagcuuauuaauuuugugaaauuuguauauaugaagaauuugcauguau

SEQ ID NO: 270126 - RNA, 64 nt, Homo Sapiens
aaucacuuucuuccucaaaauaaguccuucuguuaauuuguaaaagcacauuagugcuuuaccu

SEQ ID NO: 270127 - RNA, 64 nt, Homo Sapiens
cuuuuuuauaauuaaugacuucuguauugaguauaauuuguauaugaacuagaucuugccgugc

SEQ ID NO: 270128 - RNA, 64 nt, Homo Sapiens
ucauaaagugacucugggguaaaaauaccauuugaauuuguauucauauuccaauucacuuuua

SEQ ID NO: 270129 - RNA, 64 nt, Homo Sapiens
uuuauacaaccuccaaaaaaaaguucauuuuuuaaauuuguauuuuuguauuuaugauuaauaa

SEQ ID NO: 270130 - RNA, 64 nt, Homo Sapiens
agaguacaauuuaaaguguuuuaauugugcaacaaauuuguauucucuuugaguaaguugaagu

SEQ ID NO: 270131 - RNA, 64 nt, Homo Sapiens
gauagggauuaaggaauacaugaauaugcaggcuaauuuguacauuuacugguuguuccauucc

SEQ ID NO: 270132 - RNA, 64 nt, Homo Sapiens
uuuugcaagcuucuuuuuacuuugaguagcuuuuaauuuguauguuuuuauguggaugaagagc

SEQ ID NO: 270133 - RNA, 64 nt, Homo Sapiens
uaaguagauuagaaaaucauucaaaugauaccauaauuuguacgggacagggugcgggcaaugg

SEQ ID NO: 270134 - RNA, 64 nt, Homo Sapiens
agugcuauaucuccuauauuguauuuuuguagaaaauuuguauuuuauguuguuguuaguuuaa

SEQ ID NO: 270135 - RNA, 64 nt, Homo Sapiens
uuuugaauaucauccauaugucugacauuauuggaauuuguaacauuguuaaugcacuaaguga

SEQ ID NO: 270136 - RNA, 64 nt, Homo Sapiens
gugauuuccagccuuuacugcuuugaagaaacagaauuuguaaagguaugcauguagaacauaa

SEQ ID NO: 270137 - RNA, 64 nt, Homo Sapiens
augucuguuggauucuuuuuggauuucuuuaauuaauuuguaaguaaccaagauaauuauuuuc

SEQ ID NO: 270138 - RNA, 64 nt, Homo Sapiens
cagaaucuccagaacaaccuagagagugaaugcuaauuuguagagcgaacuuccauuuggccca

SEQ ID NO: 270139 - RNA, 64 nt, Homo Sapiens
uucugauuucuccaauaguauaugccacuauauaaauuuguauuaauaaaugacagucuuguug

SEQ ID NO: 270140 - RNA, 64 nt, Homo Sapiens
auuuguuuuuauuucaacaauuggaaaaauuaccaauuuguacauuuuaauuauucaauuucua

SEQ ID NO: 270141 - RNA, 64 nt, Homo Sapiens
agugauaaacuuuguagcugccucuuuaaccaagaauuuguaaacacaacucuaauaaauguga

SEQ ID NO: 270142 - RNA, 64 nt, Homo Sapiens
gugcagugcacugugaaucuuuuauuuuuaaaaaaauuuguaggugcuuuuauguauaacuuua

SEQ ID NO: 270143 - RNA, 64 nt, Homo Sapiens
uugaauugguacuuuuccuuauuaaggcuuuaguaauuuguauguaaugucaaauaaaaggaau

SEQ ID NO: 270144 - RNA, 64 nt, Homo Sapiens
uguuauuuguacaguucaguuccucuuugcauggaauuuguaaguuuaugucuaaagagcuuua

SEQ ID NO: 270145 - RNA, 64 nt, Homo Sapiens
auucaaguauuagggguaauauauugcugcugguaauuuguaucugaaggagauuuuccuuccu

SEQ ID NO: 270146 - RNA, 64 nt, Homo Sapiens
accuauaaauaaaauucagcauucuauuuuuaauaauuuguaugccaccaauuuguauuauuug

SEQ ID NO: 270147 - RNA, 64 nt, Homo Sapiens
ucagcauucuauuuuuaauaauuuguaugccaccaauuuguauuauuugucucaauaaauacuu

SEQ ID NO: 270148 - RNA, 64 nt, Homo Sapiens
uauuccuuaguauuaauuuaucucauugggaagaaauuuguaguuaaaacuauuuaauguaauu

SEQ ID NO: 270149 - RNA, 64 nt, Homo Sapiens
gaugcaugcaauggaaagaaaaaaaauuuguuaaaauuuguaaauguucagcuaaaucucagau

SEQ ID NO: 270150 - RNA, 64 nt, Homo Sapiens
guaaaucaaacaugauugauuuaaaacuucauggaauuuguagaaaauuauggacauuuuuggu

SEQ ID NO: 270151 - RNA, 64 nt, Homo Sapiens
gccuacugugauuuuuuucauguggaaaaugcaaaauuuguaacaaaaugguuauauggaacau

SEQ ID NO: 270152 - RNA, 64 nt, Homo Sapiens
agcucuguuuagaaaaaaucuucaaguuuguauuaauuuguaauuaguuuaaauuaggguaugu

SEQ ID NO: 270153 - RNA, 64 nt, Homo Sapiens
auguuguuaugguagagaaaugauuguaaauguaaauuuguacauuaacuguagaucaugcaug

SEQ ID NO: 270154 - RNA, 64 nt, Homo Sapiens
aaaaaucauggcaacauaaucuguuuuuggaaauaauuuguaauaauucauuugcuuauuuuuu

SEQ ID NO: 270155 - RNA, 64 nt, Homo Sapiens
uauaaagcauaaggcauuaaauugcuucagaaugaauuuguaccaaauuaaaauuuccacaagc

SEQ ID NO: 270156 - RNA, 64 nt, Homo Sapiens
uguggaacauaacuguucuuaaaaagucaauuauaauuuguaacucacauccuuugagcuaaac

SEQ ID NO: 270157 - RNA, 64 nt, Homo Sapiens
uuuaauaauucuuugggcauuuuuaagaggucugaauuuguauuuuucuucauuuuugaaacuu

SEQ ID NO: 270158 - RNA, 64 nt, Homo Sapiens
uaaccuguugucuaaauuuuuggauuguucucuuaauuuguauaucuacuuuccauuuuucaag

SEQ ID NO: 270159 - RNA, 64 nt, Homo Sapiens
uaaguuuuuuaaugagugaaaucuguaauguuguaauuuguaccaaacaagcaaaaagagaauu

SEQ ID NO: 270160 - RNA, 64 nt, Homo Sapiens
gaggggaauucuauucaucuacuuuucauuagaaaauuuguacuagcuuucaagaaaaauuaaa

SEQ ID NO: 270161 - RNA, 64 nt, Homo Sapiens
aaaugacuucuuguuugaaucaaagaaugucagaaauuuguagaaaaaggagaucagagaaagc

SEQ ID NO: 270162 - RNA, 64 nt, Homo Sapiens
ugggugguuuuuugcaguauaugaugcauacagcaauuuguaggaaguauuucauguuucagaa

SEQ ID NO: 270163 - RNA, 64 nt, Homo Sapiens
gagggaaacaguuauacuacauaaaaauucaaauaauuuguacuaaauauuuggaagguguuca

SEQ ID NO: 270164 - RNA, 64 nt, Homo Sapiens
uacugcuucuguuuuguuucucucauguaguuuaaauuuguaaaacaaaagauuguucacaaca

SEQ ID NO: 270165 - RNA, 64 nt, Homo Sapiens
uaggcuaauccauuuagugauuagaaaugaucaaaauuuguaauuucuugcaguugugaguuau

SEQ ID NO: 270166 - RNA, 64 nt, Homo Sapiens
guacaauguggucccucucaauauuuaaaaauauaauuuguaacagugcuuaccauucaccucc

SEQ ID NO: 270167 - RNA, 64 nt, Homo Sapiens
ggcagaugcuuagcuacuucuuuggcuaccucauaauuuguaugggaaugaacaugaauuaggg

SEQ ID NO: 270168 - RNA, 64 nt, Homo Sapiens
gagcagaguuuuaaaaugaaacugaucagaauuaaauuuguauaucuacgaaaauauuguucau

SEQ ID NO: 270169 - RNA, 64 nt, Homo Sapiens
cacauccagugucaugcuuaccauaauuaucauuaauuuguaacuaucagcaaauugaaauuuu

SEQ ID NO: 270170 - RNA, 64 nt, Homo Sapiens
cuuugcauaccuuagauuauacaagcugcuaauaaauuuguaagcauuaaaagaaacuuacugc

SEQ ID NO: 270171 - RNA, 64 nt, Homo Sapiens
aaaacuauuuguauaaaaauuucuuaagaauucaaauuuguaauuaauuucuuuaaauguguau

SEQ ID NO: 270172 - RNA, 64 nt, Homo Sapiens
agugggggggaaagaugacacauguaguaucuauaauuuguaacauaaauuauguaucaucauu

SEQ ID NO: 270173 - RNA, 64 nt, Homo Sapiens
uuaauauuaaagauuuaaguaaauaauuuuaaauaauuuguagcuuugagaaaacacuggauuu

SEQ ID NO: 270174 - RNA, 64 nt, Homo Sapiens
cuuugcuucuccaaauacaacucuauuuuuugcaaauuuguaaaugcuuucaauugauggacua

SEQ ID NO: 270175 - RNA, 64 nt, Homo Sapiens
aauaagcacuauucuuuguaucuuucaccaaguaaauuuguauaucaucauaucauagguacaa

SEQ ID NO: 270176 - RNA, 64 nt, Homo Sapiens
acaaucaaaaguaggcguaacaaaugugucuaugaauuuguaaaccugauccucaaggaacuug

SEQ ID NO: 270177 - RNA, 64 nt, Homo Sapiens
aaauuuauuacuauuucuuauuguuauaaugcauaauuuguauuuguuuaaaauaaccaaagag

SEQ ID NO: 270178 - RNA, 64 nt, Homo Sapiens
guuguuuuaaaaugcggucuuuucuuacagcucaaauuuguauagcuuacagaaaaugucagug

SEQ ID NO: 270179 - RNA, 64 nt, Homo Sapiens
uaaauuugacuacaauuggaucaauugacuacaaaauuuguaguauuuguaguuaaauuugacc

SEQ ID NO: 270180 - RNA, 64 nt, Homo Sapiens
uaaauuugaccucaauugacuguagacaaugcaaaauuuguaguuuuaagaaucauguguucaa

SEQ ID NO: 270181 - RNA, 64 nt, Homo Sapiens
guuguuuuaaaaugcggucuuuucuuacagcucaaauuuguauagcuuauagaaaaugucagug

SEQ ID NO: 270182 - RNA, 64 nt, Homo Sapiens
uaaauuugaccucagugcccuguagacaaugcaaaauuuguaguuuuaagaaucauguguucaa

SEQ ID NO: 270183 - RNA, 64 nt, Homo Sapiens
cuucuucaaagagcuuugggaaauuaaauugcuaaauuuguauucucugugaauuucacuggca

SEQ ID NO: 270184 - RNA, 64 nt, Homo Sapiens
uuuaaaugaaguugaauaguaguuuuuaaaagucaauuuguaauuuaugugaaaucuaacugua

SEQ ID NO: 270185 - RNA, 64 nt, Homo Sapiens
auguuaggguauaaguugcuguaaaauuuguguaaauuuguauccacacaaauucagucucuga

SEQ ID NO: 270186 - RNA, 64 nt, Homo Sapiens
aaaacauuuaaacuuuuuaaaauacuuauuaaaaaauuuguauaagccacuugucuugaaaacu

SEQ ID NO: 270187 - RNA, 64 nt, Homo Sapiens
cuaauaaaucagugaacuguuccucauguugcugaauuuguaguuguugguuuauuuuaauggu

SEQ ID NO: 270188 - RNA, 64 nt, Homo Sapiens
aagacuuuucaggugaaaagguaaucugaacccaaauuuguauauuuaccuucagaucuaaaug

SEQ ID NO: 270189 - RNA, 64 nt, Homo Sapiens
uguuauuuaccuucagaucucaaaaguugguguaaauuuguauauccuuaaaauuaaaaaccua

SEQ ID NO: 270190 - RNA, 64 nt, Homo Sapiens
auacuuacauacuuauauggguaucuguauagauaauuuguauuagaguauuauauagcuucuu

SEQ ID NO: 270191 - RNA, 64 nt, Homo Sapiens
aggcagcuauuuuaccaucugguauuuauggucuaauuuguauuuaaacauaugcacacauaua

SEQ ID NO: 270192 - RNA, 64 nt, Homo Sapiens
aaaaaaaaaaaaaaaggaaacaaauguuuuacauaauuuguaccagggagaaaaguucuuagca

SEQ ID NO: 270193 - RNA, 64 nt, Homo Sapiens
aaaauugaauuuuuucauaaguuuucauaucaccaauuuguagcgcugguugcaaauaaaggga

SEQ ID NO: 270194 - RNA, 64 nt, Homo Sapiens
uacgauggccuuuagaaaaugcccuuuagcagagaauuuguaauuuaagaaauuuucuguuugu

SEQ ID NO: 270195 - RNA, 64 nt, Homo Sapiens
auucaugugagaggaaggcccuguggguguaagaaauuuguaaaaacuguccauuaccuuucac

SEQ ID NO: 270196 - RNA, 64 nt, Homo Sapiens
ugaagaaaauccagugacugauggaauagcaaacaauuuguaagugauuuugaaauuaucaauu

SEQ ID NO: 270197 - RNA, 64 nt, Homo Sapiens
ggugagaagccuaaugaaagcuuuuucauaacagaauuuguacauuaccugucccucagcuaua

SEQ ID NO: 270198 - RNA, 64 nt, Homo Sapiens
uauucugaaauuauauaaauuguugcuaaacguaaauuuguaucgagauuuauggugcuugaaa

SEQ ID NO: 270199 - RNA, 64 nt, Homo Sapiens
aaagaaaaacucuugaaaguguaaaauaugggagaauuuguagaggauauggaaaacauuuuuc

SEQ ID NO: 270200 - RNA, 64 nt, Homo Sapiens
aucccagugguauucaauaauguuccaauuauuaaauuuguauuaaaaaaugguuaugaaauaa

SEQ ID NO: 270201 - RNA, 64 nt, Homo Sapiens
guauuuuccuugcaaauauuuaguauuuuuuaguaauuuguacucugaacacaauucuauauuu

SEQ ID NO: 270202 - RNA, 64 nt, Homo Sapiens
uuucuaccuuauuccaauacuauauuguugauaaaauuuguauauacauuuucaauaaagaaua

SEQ ID NO: 270203 - RNA, 64 nt, Homo Sapiens
guaguccauuauuacuugggucuuuacuucugggaauuuguauguaacagccuagaaaauuaaa

SEQ ID NO: 270204 - RNA, 64 nt, Homo Sapiens
auuuuuuuucuuagaaguagucuucauuauuauaaauuuguacaccaaaaggccauggggaacu

SEQ ID NO: 270205 - RNA, 64 nt, Homo Sapiens
uuguuccaagaaaugugccuacugaaaucaaauuaauuuguauucaauguguacuucaagacug

SEQ ID NO: 270206 - RNA, 64 nt, Homo Sapiens
uaauguggaaauuguauaguggaauucuucuacuaauuuguauuuauaugcaauacuacuugga

SEQ ID NO: 270207 - RNA, 64 nt, Homo Sapiens
cuuaguaguugcagaaauuguaauagcaguauugaauuuguaagcguuuucagaaccuggguuu

SEQ ID NO: 270208 - RNA, 64 nt, Homo Sapiens; identical to SEQ ID NO: 270202

SEQ ID NO: 270209 - RNA, 64 nt, Homo Sapiens; identical to SEQ ID NO: 270203

SEQ ID NO: 270210 - RNA, 64 nt, Homo Sapiens
uggaaccaucagaaacacccucaugcauggaaauucccuucaucugccuuugaccugccucccu

SEQ ID NO: 270211 - RNA, 64 nt, Homo Sapiens
cauggaaauucccuucaucugccuuugaccugccucccuucauguggcaggugcagcccccacu

SEQ ID NO: 270212 - RNA, 64 nt, Homo Sapiens
uuuggggauugcucaaccaucaagacugcaggucucccuucagccaccuccuuccugcuaaaag

SEQ ID NO: 270213 - RNA, 64 nt, Homo Sapiens
gauaauaucuuugaugacuucugaaaguuaugcuucccuucauguuauaugcacauugccaaga

SEQ ID NO: 270214 - RNA, 64 nt, Homo Sapiens
agacuccugggcccuuggauacucuucucccaucucccuucacaggaugacacccucccauacc

SEQ ID NO: 270215 - RNA, 64 nt, Homo Sapiens
cugguguagggacccccaagagaccccuguccugucccuucaccaguccuggggaggcugggac

SEQ ID NO: 270216 - RNA, 64 nt, Homo Sapiens
uggagugccacaccccucucugccuugugcugccucccuucaccgccagccccccagaguguuc

SEQ ID NO: 270217 - RNA, 64 nt, Homo Sapiens
gucccaaaacuggcacuagauggcacugaagaugucccuucacuccuacggcagcagcuguuca

SEQ ID NO: 270218 - RNA, 64 nt, Homo Sapiens
caggggcuucucccccucagcucucccucacaccucccuucaucccaggguauccaccugcacc

SEQ ID NO: 270219 - RNA, 64 nt, Homo Sapiens
cccaccuggagagacauggccccugccaagcuggucccuucaaauggauccuuuguggacuuua

SEQ ID NO: 270220 - RNA, 64 nt, Homo Sapiens
uuuuguuucuuacguucuuuguaacauuuccauuucccuucaugcagggaggaggggagugagg

SEQ ID NO: 270221 - RNA, 64 nt, Homo Sapiens
ugcacgagggguuaggcugcagaagcucugggguucccuucaaggcccucaguguuggcucugc

SEQ ID NO: 270222 - RNA, 64 nt, Homo Sapiens
ucugccuuugaaucaucauuaccuaaauauuacuucccuucaaaugcauuugccuucuucugcc

SEQ ID NO: 270223 - RNA, 64 nt, Homo Sapiens
ggcugcauuugccuucuucuauaauuagaacaguucccuucagaguaacuuuauuuuuuaggua

SEQ ID NO: 270224 - RNA, 64 nt, Homo Sapiens
gauuacggguacuugcacugcucagcagagccccucccuucagauuggcccccugcuuuuccug

SEQ ID NO: 270225 - RNA, 64 nt, Homo Sapiens
ggaaaaaaaaauguucagagucucccaaaucuuuucccuucaaaguuccucccuccuuuucucu

SEQ ID NO: 270226 - RNA, 64 nt, Homo Sapiens
aaacgauggcaggcauuccuaaaccccugcccuuucccuucagauguuuuuccccuccacucag

SEQ ID NO: 270227 - RNA, 64 nt, Homo Sapiens
cagagaagcaaggcugauauggaguggcagaagaucccuucacuagcccauucucugaccccaa

SEQ ID NO: 270228 - RNA, 64 nt, Homo Sapiens
ggguucuauccuuuggugcagccccauugccuuuucccuucaggcucuguugcucccuccucug

SEQ ID NO: 270229 - RNA, 64 nt, Homo Sapiens
acagcuggccuugccccguccacccugugcugcuucccuucacagcauuaaccuuccagucugg

SEQ ID NO: 270230 - RNA, 64 nt, Homo Sapiens
agaccuuuguagcuccuccagccucugcagagacucccuucaccucgcacuuacugccugggaa

SEQ ID NO: 270231 - RNA, 64 nt, Homo Sapiens
ucaggccacacucaagggcugacuguccaggcgcucccuucagccgccucgucgucagcguucu

SEQ ID NO: 270232 - RNA, 64 nt, Homo Sapiens
auuguugcaguguucaguuuccuugggggccugcucccuucacaccuugagcccaaguccuuuu

SEQ ID NO: 270233 - RNA, 64 nt, Homo Sapiens
ccuccuggaaacugggagcuaagggcgaggcccuucccuucagaggcuccugggggauuagggu

SEQ ID NO: 270234 - RNA, 64 nt, Homo Sapiens
ucaugucacuagauacacaacccccuucccaccaucccuucagucacuaguggaagcuuucaag

SEQ ID NO: 270235 - RNA, 64 nt, Homo Sapiens
uucucucuuaacgccacuggugauaggaaguaguucccuucaguucaaauccugugcccuuauu

SEQ ID NO: 270236 - RNA, 64 nt, Homo Sapiens
ugcaucugcuaugcaauaguugacuagccccaagucccuucauucuucccuuucccuuucuucc

SEQ ID NO: 270237 - RNA, 64 nt, Homo Sapiens
ccucucucuugccuuccuucccccuuccugagguucccuucaccuuuuccgguuguccuuaaca

SEQ ID NO: 270238 - RNA, 64 nt, Homo Sapiens
aucaugagacaacucauauguuagugaucuuuauucccuucaaaauguaaaugugggaaagccu

SEQ ID NO: 270239 - RNA, 64 nt, Homo Sapiens
gacgugaaaccacucacaguucagugcuuccacuucccuucaaauaaacaaugugggaaagccu

SEQ ID NO: 270240 - RNA, 64 nt, Homo Sapiens
gccacaucagaguugaugcuucacgggucuuucaucccuucauuaacaaugaguggagaagucg

SEQ ID NO: 270241 - RNA, 64 nt, Homo Sapiens
gcuugggaaccuucucccuuucagcuuucccauuucccuucaauggaguuugcuucugauaggg

SEQ ID NO: 270242 - RNA, 64 nt, Homo Sapiens
ucuguggaccuuggaggcuuaacugcugcuguccucccuucauuauccaagcugagccagaggg

SEQ ID NO: 270243 - RNA, 64 nt, Homo Sapiens
aucaccugaauucagucuguuuggugucugcacagacuggaauucaaucugucaaauuuguuuu

SEQ ID NO: 270244 - RNA, 64 nt, Homo Sapiens
aaagguagaaaagaaaagccaagaucauacuaaggacuggaaauauuuuguucuauggaaucaa

SEQ ID NO: 270245 - RNA, 64 nt, Homo Sapiens
uggcucugggugagucaguagaacaaguuggcaggacuggaagccuauuuaggacauuuaccau

SEQ ID NO: 270246 - RNA, 64 nt, Homo Sapiens
augguuguguuuuuauugccggauauuuugaccugacuggaaagugguagaaaggcaaaaagua

SEQ ID NO: 270247 - RNA, 64 nt, Homo Sapiens
auuucuuuacauuugcauucagggaacauguucggacuggaaacagaucugguuuuuuggucaa

SEQ ID NO: 270248 - RNA, 64 nt, Homo Sapiens
uuagcaaacaauuguaagucuuuuugaaagacuggacuggaaucuccaaaggggcacccacauu

SEQ ID NO: 270249 - RNA, 64 nt, Homo Sapiens; identical to SEQ ID NO: 164139

SEQ ID NO: 270250 - RNA, 64 nt, Homo Sapiens; identical to SEQ ID NO: 164140

SEQ ID NO: 270251 - RNA, 64 nt, Homo Sapiens; identical to SEQ ID NO: 164141

SEQ ID NO: 270252 - RNA, 64 nt, Homo Sapiens; identical to SEQ ID NO: 164142

SEQ ID NO: 270253 - RNA, 64 nt, Homo Sapiens; identical to SEQ ID NO: 164143

SEQ ID NO: 270254 - RNA, 64 nt, Homo Sapiens; identical to SEQ ID NO: 164144

SEQ ID NO: 270255 - RNA, 64 nt, Homo Sapiens; identical to SEQ ID NO: 164145

SEQ ID NO: 270256 - RNA, 64 nt, Homo Sapiens; identical to SEQ ID NO: 164146

SEQ ID NO: 270257 - RNA, 64 nt, Homo Sapiens; identical to SEQ ID NO: 164147

SEQ ID NO: 270258 - RNA, 64 nt, Homo Sapiens; identical to SEQ ID NO: 164148

SEQ ID NO: 270259 - RNA, 62 nt, Homo Sapiens
aucaaguuccauaauucauuuugucugccugauccaaucauuauauuaggacugaucaggug

SEQ ID NO: 270260 - RNA, 62 nt, Homo Sapiens
aauuauacguuauauguaguuuaaauccaggauccaaucaaguccuuuauagcuguuuauuu

SEQ ID NO: 270261 - RNA, 62 nt, Homo Sapiens
ugcuuuccuuacccgagagguauuuugccuguuccaaucaaaccaccccauucagguccauc

SEQ ID NO: 270262 - RNA, 62 nt, Homo Sapiens
agguaaaguugacuucuccucgugggcaguuuuccaaucaccuugugaguagacaccugcca

SEQ ID NO: 270263 - RNA, 62 nt, Homo Sapiens
aggaaagauuuauuuaaaauuucaaaacuauuuccaaucacacuccaaucaguuuacuucau

SEQ ID NO: 270264 - RNA, 62 nt, Homo Sapiens
uuacuucauuucaaaacuaugcugugacaaccuccaaucaguuggcauaauucacaaaagca

SEQ ID NO: 270265 - RNA, 62 nt, Homo Sapiens
ucaugccucacuacccucugcucauuacaagauccaaucauagaucaagccuccugaauccc

SEQ ID NO: 270266 - RNA, 62 nt, Homo Sapiens
uugagcccuggcgugauccacaugauccuugauccaaucagaaagaaguggacaccacgugg

SEQ ID NO: 270267 - RNA, 64 nt, Homo Sapiens
cuauacuguaugaaauaugucugugccauuuacaguuucuaauauugugauaauuaugauuauu

SEQ ID NO: 270268 - RNA, 64 nt, Homo Sapiens
uaucgcuguuguauauucuagugagcuucccaagguuucuaaacaacaaaauaacuaaagaaau

SEQ ID NO: 270269 - RNA, 64 nt, Homo Sapiens
gaaaugcagaguuggauaagaaauacauugcuggguuucuaaaaugcugccuuccugccucuac

SEQ ID NO: 270270 - RNA, 64 nt, Homo Sapiens
auagacaggggcguauucaugggagcaucagccaguuucuaaaacccacaggccaucagcagcu

SEQ ID NO: 270271 - RNA, 64 nt, Homo Sapiens
caguaugaguuaugagugcccuaauuugugguuaguuucuaauuuaauguuguuucauagaguu

SEQ ID NO: 270272 - RNA, 64 nt, Homo Sapiens
agcauauaggaaacuccaaacagaucacaaugagguuucuaaaucuguuggguucugucuucua

SEQ ID NO: 270273 - RNA, 64 nt, Homo Sapiens
agauaaaaaucaaacuucuuguuaguuucaaaccguuucuaaagugucaaacucccucugcccc

SEQ ID NO: 270274 - RNA, 64 nt, Homo Sapiens
gcgaggaaaugguuuguaagggguuugauggcgaguuucuaaagggugaucagagggcgcguuu

SEQ ID NO: 270275 - RNA, 64 nt, Homo Sapiens
cuaaccucgauucuguguugugaugugcaauacuguuucuaauguuuguauaaaaaaaaacagu

SEQ ID NO: 270276 - RNA, 64 nt, Homo Sapiens
uggagcugaaaucuuuguaauauuaaagcaacuaguuucuaauucccaguuucuguauagaauc

SEQ ID NO: 270277 - RNA, 64 nt, Homo Sapiens
ggcaucgaagcuggucuuuaauugaugggaaaugguuucuaaauuucaagaauguuucacugga

SEQ ID NO: 270278 - RNA, 64 nt, Homo Sapiens
uaaagaaacaauuucagaaauuacccuuaucuuuguuucuaauuuuuuauuagcauaugugauu

SEQ ID NO: 270279 - RNA, 64 nt, Homo Sapiens
agucagauguuugagcagugauguauguaaauagguuucuaaaauaucuacugauuugggcuga

SEQ ID NO: 270280 - RNA, 64 nt, Homo Sapiens
uugaguucuuccuguaaucuugcacauggauucaguuucuaaaauuuaccacuugcugcacucu

SEQ ID NO: 270281 - RNA, 64 nt, Homo Sapiens
auguuuggaaaugcguggaauuaggauucaugugguuucuaagauuuggacaugucagaauuuu

SEQ ID NO: 270282 - RNA, 64 nt, Homo Sapiens
caaggauguaaacauucaguccauugcaauacguguuucuaacuuccuaagaaauugucacaca

SEQ ID NO: 270283 - RNA, 64 nt, Homo Sapiens
auuacauuuuacuuuaaaaacuuuacacauuucaguuucuaaaauuuuaaauuaacaaaaauua

SEQ ID NO: 270284 - RNA, 64 nt, Homo Sapiens
cucagacuuaacuguugccuugaauuacagccuaguuucuaagcagugaaauguaaugauaaag

SEQ ID NO: 270285 - RNA, 64 nt, Homo Sapiens
aucaguuugauaacuuuauaaugucuuuucuuuuguuucuaaguaugaaauuaccaagaugaca

SEQ ID NO: 270286 - RNA, 64 nt, Homo Sapiens
guugugcuuuauggccacugcuuguaagguuaccguuucuaagauuuuaugauuugaugaguuu

SEQ ID NO: 270287 - RNA, 64 nt, Homo Sapiens
uuucuccuucugauuuugcccuuuuugguuuaguguuucuaaauaacaucacguucucuauugg

SEQ ID NO: 270288 - RNA, 64 nt, Homo Sapiens
ugaaauguauuucaauaagcuucuuugguagucuguuucuaaaauuuagaguuuuuguauagac

SEQ ID NO: 270289 - RNA, 64 nt, Homo Sapiens
aaaauaauccagaucugcuuucuaaaaugaaucaguuucuaaagugaaacaugcaauauuuaug

SEQ ID NO: 270290 - RNA, 64 nt, Homo Sapiens
agaccugugauugcccagaacacauaguccccacguuucuaauuuggagcaaaucuaaaaggug

SEQ ID NO: 270291 - RNA, 64 nt, Homo Sapiens
cugagagaauucuguguccugcucauugucuugaguuucuaaccaugugcagaugcaagcguuc

SEQ ID NO: 270292 - RNA, 64 nt, Homo Sapiens
augagaauuauuuuggaucuuagauccaaacacaguuucuaauagaaaacuauuauuuauauug

SEQ ID NO: 270293 - RNA, 64 nt, Homo Sapiens
ucaauaaacuaaaagguucaauuccuaccaaauaguuucuaaugugggagaaaaacuuggcaca

SEQ ID NO: 270294 - RNA, 64 nt, Homo Sapiens
caaauauucagaaguaacuugauaagauaugaauguuucuaaagaaguuucuaaagguucggaa

SEQ ID NO: 270295 - RNA, 64 nt, Homo Sapiens
aguaacuugauaagauaugaauguuucuaaagaaguuucuaaagguucggaaaaugcuccuugu

SEQ ID NO: 270296 - RNA, 64 nt, Homo Sapiens
ugcaauucaaaaguuccaagagucuaaagauggaguuucuaagguccgguguucuaagauguga

SEQ ID NO: 270297 - RNA, 64 nt, Homo Sapiens
uaggcacuguaguucuaagacucaaauguucuaaguuucuaagauucuaaagguccacaggucu

SEQ ID NO: 270298 - RNA, 64 nt, Homo Sapiens
uucuucccaagugcuguuggcuuucauugaaaugguuucuaauucauuauaccagaucugguca

SEQ ID NO: 270299 - RNA, 64 nt, Homo Sapiens
ccuguucuauaguaguuacaucaaagaggcaguaguuucuaaccgcaguuauuuucugaauuug

SEQ ID NO: 270300 - RNA, 64 nt, Homo Sapiens
auucagcuauaaccccaguugguuugucuggagaguuucuaaaaacuuaccuccucuaacacgu

SEQ ID NO: 270301 - RNA, 64 nt, Homo Sapiens
uauuuuugguuuuuuuaaaaaagcagacugauuuguuucuaagaagcaugaaugcaauuuguua

SEQ ID NO: 270302 - RNA, 64 nt, Homo Sapiens
aaaucaccaggacauugaccuuuucucaguggggcagucucauaggaugccugaaguaaguaag

SEQ ID NO: 270303 - RNA, 64 nt, Homo Sapiens
ucugcugggagcacccacaguaacucaacggagccagucucaacaagcacuauauucuagucau

SEQ ID NO: 270304 - RNA, 64 nt, Homo Sapiens
gggccucugugauggacaucucguaggacccagccagucucauccagcagguuggguucuaggg

SEQ ID NO: 270305 - RNA, 64 nt, Homo Sapiens
uugugaaaagauuuuuucuuuuuuuuuugggacacagucucacucugucgcccaggcuagagug

SEQ ID NO: 270306 - RNA, 64 nt, Homo Sapiens
uagagagaacuggguaggccucucccaccaugugcagucucauggggagaggcuucuuucguuu

SEQ ID NO: 270307 - RNA, 64 nt, Homo Sapiens
acuaagaugucaguauucuccucauggauauuuucagucucaauguugccagucuaauaguaua

SEQ ID NO: 270308 - RNA, 64 nt, Homo Sapiens; identical to SEQ ID NO: 125533

SEQ ID NO: 270309 - RNA, 64 nt, Homo Sapiens; identical to SEQ ID NO: 125534

SEQ ID NO: 270310 - RNA, 64 nt, Homo Sapiens; identical to SEQ ID NO: 125535

SEQ ID NO: 270311 - RNA, 64 nt, Homo Sapiens; identical to SEQ ID NO: 125536

SEQ ID NO: 270312 - RNA, 64 nt, Homo Sapiens; identical to SEQ ID NO: 125537

SEQ ID NO: 270313 - RNA, 64 nt, Homo Sapiens; identical to SEQ ID NO: 125538

SEQ ID NO: 270314 - RNA, 64 nt, Homo Sapiens; identical to SEQ ID NO: 125539

SEQ ID NO: 270315 - RNA, 64 nt, Homo Sapiens; identical to SEQ ID NO: 125540

SEQ ID NO: 270316 - RNA, 64 nt, Homo Sapiens; identical to SEQ ID NO: 125541

SEQ ID NO: 270317 - RNA, 64 nt, Homo Sapiens; identical to SEQ ID NO: 125542

SEQ ID NO: 270318 - RNA, 64 nt, Homo Sapiens; identical to SEQ ID NO: 125543

SEQ ID NO: 270319 - RNA, 64 nt, Homo Sapiens; identical to SEQ ID NO: 125544

SEQ ID NO: 270320 - RNA, 64 nt, Homo Sapiens; identical to SEQ ID NO: 125545

SEQ ID NO: 270321 - RNA, 64 nt, Homo Sapiens; identical to SEQ ID NO: 125546

SEQ ID NO: 270322 - RNA, 64 nt, Homo Sapiens; identical to SEQ ID NO: 125547

SEQ ID NO: 270323 - RNA, 64 nt, Homo Sapiens; identical to SEQ ID NO: 125548

SEQ ID NO: 270324 - RNA, 64 nt, Homo Sapiens; identical to SEQ ID NO: 125549

SEQ ID NO: 270325 - RNA, 64 nt, Homo Sapiens; identical to SEQ ID NO: 125550

SEQ ID NO: 270326 - RNA, 64 nt, Homo Sapiens; identical to SEQ ID NO: 125551

SEQ ID NO: 270327 - RNA, 64 nt, Homo Sapiens; identical to SEQ ID NO: 125552

SEQ ID NO: 270328 - RNA, 64 nt, Homo Sapiens; identical to SEQ ID NO: 125553

SEQ ID NO: 270329 - RNA, 64 nt, Homo Sapiens; identical to SEQ ID NO: 125554

SEQ ID NO: 270330 - RNA, 64 nt, Homo Sapiens; identical to SEQ ID NO: 125555

SEQ ID NO: 270331 - RNA, 64 nt, Homo Sapiens; identical to SEQ ID NO: 125556

SEQ ID NO: 270332 - RNA, 64 nt, Homo Sapiens; identical to SEQ ID NO: 125557

SEQ ID NO: 270333 - RNA, 64 nt, Homo Sapiens; identical to SEQ ID NO: 125558

SEQ ID NO: 270334 - RNA, 64 nt, Homo Sapiens; identical to SEQ ID NO: 125559

SEQ ID NO: 270335 - RNA, 64 nt, Homo Sapiens; identical to SEQ ID NO: 125560

SEQ ID NO: 270336 - RNA, 64 nt, Homo Sapiens; identical to SEQ ID NO: 125561

SEQ ID NO: 270337 - RNA, 64 nt, Homo Sapiens; identical to SEQ ID NO: 125562

SEQ ID NO: 270338 - RNA, 64 nt, Homo Sapiens; identical to SEQ ID NO: 125563

SEQ ID NO: 270339 - RNA, 64 nt, Homo Sapiens; identical to SEQ ID NO: 125564

SEQ ID NO: 270340 - RNA, 64 nt, Homo Sapiens; identical to SEQ ID NO: 125565

SEQ ID NO: 270341 - RNA, 64 nt, Homo Sapiens; identical to SEQ ID NO: 125566

SEQ ID NO: 270342 - RNA, 64 nt, Homo Sapiens; identical to SEQ ID NO: 125567

SEQ ID NO: 270343 - RNA, 64 nt, Homo Sapiens; identical to SEQ ID NO: 125568

SEQ ID NO: 270344 - RNA, 65 nt, Homo Sapiens
auuuuuuuaccaauuccaauuucaaaaugucucaauggugcuauaauaaauaaacuucaacacuc

SEQ ID NO: 270345 - RNA, 65 nt, Homo Sapiens
acuaauauuugggaaggcuuuaaagacgcauguuauggugcuaauguacuuucacuuuuaaacuc

SEQ ID NO: 270346 - RNA, 65 nt, Homo Sapiens
uacuaaagauuuuggcagaaagaagccugacuacuuggugcuaacuagcugaaaggaaaaaaagu

SEQ ID NO: 270347 - RNA, 65 nt, Homo Sapiens
aaucagauucaacccgaagguccauguaugagaucuggugcuagccucagcuucacauaccccuc

SEQ ID NO: 270348 - RNA, 65 nt, Homo Sapiens
uugcuacccccgcugcccccuccacaguuccugaauggugcuaaggaucugcagcaguuggcaac

SEQ ID NO: 270349 - RNA, 65 nt, Homo Sapiens
ccccuugugcagcggaccacuugcccaguuugcuguggugcuagccuuccccaucauccaccggg

SEQ ID NO: 270350 - RNA, 65 nt, Homo Sapiens
guuacugaauaaggugcuucugcuucuucuagagauggugcuaaagaaaggacuagcauaugaga

SEQ ID NO: 270351 - RNA, 65 nt, Homo Sapiens
uaccaauggggcuggugggcaugcuguccacuguguggugcuaggacugccaaugccaggcccaa

SEQ ID NO: 270352 - RNA, 65 nt, Homo Sapiens
aucagguaauaauaggcuugaaaauugauauccuguggugcuaaaguacaguagaaagagaggag

SEQ ID NO: 270353 - RNA, 65 nt, Homo Sapiens
aguuaguuaauagcauugggauauagucacuguaauggugcuauuaacaaacagucaacaccauu

SEQ ID NO: 270354 - RNA, 65 nt, Homo Sapiens
guuucuuuaagaaaguacuuccagcuaugccaauguggugcuauucuuucccauuuauuguuugg

SEQ ID NO: 270355 - RNA, 65 nt, Homo Sapiens
uuguaguuuguuauaugaaauguuuuuuaguauaauggugcuauuucaaacaguauguaaaacuc

SEQ ID NO: 270356 - RNA, 65 nt, Homo Sapiens
ucucagggaggccgggugugaccucaucuuucucauggugcuauccuggugcuauuggggugggg

SEQ ID NO: 270357 - RNA, 65 nt, Homo Sapiens
ccgggugugaccucaucuuucucauggugcuauccuggugcuauugggguggggagcucccuccc

SEQ ID NO: 270358 - RNA, 64 nt, Homo Sapiens
uuccacccccugccauccucacuuagaggggccauggcacuagauggcacuagucccccgauaa

SEQ ID NO: 270359 - RNA, 64 nt, Homo Sapiens
ugccauccucacuuagaggggccauggcacuagauggcacuagucccccgauaauuuaugucuc

SEQ ID NO: 270360 - RNA, 64 nt, Homo Sapiens
uguauuaaucuaagguuucaaaguauaaaaguauaugggguaggccgggugcaguggcucacgc

SEQ ID NO: 270361 - RNA, 64 nt, Homo Sapiens
acucugucucagaaaaaaaaaaaaagaaaaauauaugggguaaauacaguaaaacguuuuguua

SEQ ID NO: 270362 - RNA, 64 nt, Homo Sapiens
agcuuucaguguagugagauuauuccuguagguuaugggguauaauucaggauuuaacuaaugu

SEQ ID NO: 270363 - RNA, 64 nt, Homo Sapiens
guauuuuaucauuuguaagcagaacucuagcuauaugggguagaaauaaaaucucugagaugaa

SEQ ID NO: 270364 - RNA, 64 nt, Homo Sapiens
aauuuuuuaaaacucucgaugaaaucccccagcgaugggguaacacuucccguucggaauaacu

SEQ ID NO: 270365 - RNA, 64 nt, Homo Sapiens
auggaccuuguagguggagauucccaccgcccggaugggguagaucuccccgccaaaaaaggcg

SEQ ID NO: 270366 - RNA, 64 nt, Homo Sapiens; identical to SEQ ID NO: 160354

SEQ ID NO: 270367 - RNA, 64 nt, Homo Sapiens; identical to SEQ ID NO: 160355

SEQ ID NO: 270368 - RNA, 64 nt, Homo Sapiens; identical to SEQ ID NO: 160356

SEQ ID NO: 270369 - RNA, 64 nt, Homo Sapiens; identical to SEQ ID NO: 160357

SEQ ID NO: 270370 - RNA, 64 nt, Homo Sapiens; identical to SEQ ID NO: 160358

SEQ ID NO: 270371 - RNA, 64 nt, Homo Sapiens; identical to SEQ ID NO: 160359

SEQ ID NO: 270372 - RNA, 64 nt, Homo Sapiens; identical to SEQ ID NO: 160360

SEQ ID NO: 270373 - RNA, 64 nt, Homo Sapiens; identical to SEQ ID NO: 160361

SEQ ID NO: 270374 - RNA, 64 nt, Homo Sapiens; identical to SEQ ID NO: 160362

SEQ ID NO: 270375 - RNA, 64 nt, Homo Sapiens; identical to SEQ ID NO: 160363

SEQ ID NO: 270376 - RNA, 64 nt, Homo Sapiens; identical to SEQ ID NO: 160364

SEQ ID NO: 270377 - RNA, 64 nt, Homo Sapiens; identical to SEQ ID NO: 160365

SEQ ID NO: 270378 - RNA, 64 nt, Homo Sapiens; identical to SEQ ID NO: 160366

SEQ ID NO: 270379 - RNA, 64 nt, Homo Sapiens; identical to SEQ ID NO: 160367

SEQ ID NO: 270380 - RNA, 64 nt, Homo Sapiens; identical to SEQ ID NO: 160368

SEQ ID NO: 270381 - RNA, 64 nt, Homo Sapiens; identical to SEQ ID NO: 160369

SEQ ID NO: 270382 - RNA, 64 nt, Homo Sapiens; identical to SEQ ID NO: 160370

SEQ ID NO: 270383 - RNA, 64 nt, Homo Sapiens; identical to SEQ ID NO: 160371

SEQ ID NO: 270384 - RNA, 64 nt, Homo Sapiens; identical to SEQ ID NO: 160372

SEQ ID NO: 270385 - RNA, 64 nt, Homo Sapiens; identical to SEQ ID NO: 160373

SEQ ID NO: 270386 - RNA, 64 nt, Homo Sapiens; identical to SEQ ID NO: 160374

SEQ ID NO: 270387 - RNA, 64 nt, Homo Sapiens; identical to SEQ ID NO: 160375

SEQ ID NO: 270388 - RNA, 64 nt, Homo Sapiens; identical to SEQ ID NO: 160376

SEQ ID NO: 270389 - RNA, 64 nt, Homo Sapiens; identical to SEQ ID NO: 160377

SEQ ID NO: 270390 - RNA, 64 nt, Homo Sapiens; identical to SEQ ID NO: 206011

SEQ ID NO: 270391 - RNA, 64 nt, Homo Sapiens; identical to SEQ ID NO: 206012

SEQ ID NO: 270392 - RNA, 64 nt, Homo Sapiens; identical to SEQ ID NO: 206013

SEQ ID NO: 270393 - RNA, 64 nt, Homo Sapiens; identical to SEQ ID NO: 206014

SEQ ID NO: 270394 - RNA, 64 nt, Homo Sapiens; identical to SEQ ID NO: 206015

SEQ ID NO: 270395 - RNA, 64 nt, Homo Sapiens; identical to SEQ ID NO: 206016

SEQ ID NO: 270396 - RNA, 64 nt, Homo Sapiens; identical to SEQ ID NO: 206017

SEQ ID NO: 270397 - RNA, 64 nt, Homo Sapiens; identical to SEQ ID NO: 206018

SEQ ID NO: 270398 - RNA, 64 nt, Homo Sapiens; identical to SEQ ID NO: 206019

SEQ ID NO: 270399 - RNA, 64 nt, Homo Sapiens; identical to SEQ ID NO: 206020

SEQ ID NO: 270400 - RNA, 64 nt, Homo Sapiens; identical to SEQ ID NO: 84026

SEQ ID NO: 270401 - RNA, 64 nt, Homo Sapiens; identical to SEQ ID NO: 84027

SEQ ID NO: 270402 - RNA, 64 nt, Homo Sapiens; identical to SEQ ID NO: 84028

SEQ ID NO: 270403 - RNA, 64 nt, Homo Sapiens; identical to SEQ ID NO: 84029

SEQ ID NO: 270404 - RNA, 64 nt, Homo Sapiens; identical to SEQ ID NO: 84030

SEQ ID NO: 270405 - RNA, 64 nt, Homo Sapiens; identical to SEQ ID NO: 84031

SEQ ID NO: 270406 - RNA, 64 nt, Homo Sapiens; identical to SEQ ID NO: 84032

SEQ ID NO: 270407 - RNA, 64 nt, Homo Sapiens; identical to SEQ ID NO: 84033

SEQ ID NO: 270408 - RNA, 64 nt, Homo Sapiens; identical to SEQ ID NO: 84034

SEQ ID NO: 270409 - RNA, 64 nt, Homo Sapiens; identical to SEQ ID NO: 84035

SEQ ID NO: 270410 - RNA, 64 nt, Homo Sapiens; identical to SEQ ID NO: 84036

SEQ ID NO: 270411 - RNA, 64 nt, Homo Sapiens; identical to SEQ ID NO: 84037

SEQ ID NO: 270412 - RNA, 64 nt, Homo Sapiens; identical to SEQ ID NO: 84038

SEQ ID NO: 270413 - RNA, 64 nt, Homo Sapiens; identical to SEQ ID NO: 84039

SEQ ID NO: 270414 - RNA, 64 nt, Homo Sapiens; identical to SEQ ID NO: 84040

SEQ ID NO: 270415 - RNA, 64 nt, Homo Sapiens; identical to SEQ ID NO: 84041

SEQ ID NO: 270416 - RNA, 64 nt, Homo Sapiens; identical to SEQ ID NO: 84042

SEQ ID NO: 270417 - RNA, 64 nt, Homo Sapiens; identical to SEQ ID NO: 84043

SEQ ID NO: 270418 - RNA, 64 nt, Homo Sapiens; identical to SEQ ID NO: 84044

SEQ ID NO: 270419 - RNA, 64 nt, Homo Sapiens; identical to SEQ ID NO: 84045

SEQ ID NO: 270420 - RNA, 64 nt, Homo Sapiens; identical to SEQ ID NO: 84046

SEQ ID NO: 270421 - RNA, 64 nt, Homo Sapiens; identical to SEQ ID NO: 84047

SEQ ID NO: 270422 - RNA, 64 nt, Homo Sapiens; identical to SEQ ID NO: 84048

SEQ ID NO: 270423 - RNA, 64 nt, Homo Sapiens; identical to SEQ ID NO: 84049

SEQ ID NO: 270424 - RNA, 64 nt, Homo Sapiens; identical to SEQ ID NO: 84050

SEQ ID NO: 270425 - RNA, 64 nt, Homo Sapiens; identical to SEQ ID NO: 84051

SEQ ID NO: 270426 - RNA, 64 nt, Homo Sapiens; identical to SEQ ID NO: 84052

SEQ ID NO: 270427 - RNA, 64 nt, Homo Sapiens; identical to SEQ ID NO: 84053

SEQ ID NO: 270428 - RNA, 64 nt, Homo Sapiens; identical to SEQ ID NO: 84054

SEQ ID NO: 270429 - RNA, 64 nt, Homo Sapiens; identical to SEQ ID NO: 84055

SEQ ID NO: 270430 - RNA, 64 nt, Homo Sapiens; identical to SEQ ID NO: 84056

SEQ ID NO: 270431 - RNA, 64 nt, Homo Sapiens; identical to SEQ ID NO: 84057

SEQ ID NO: 270432 - RNA, 64 nt, Homo Sapiens; identical to SEQ ID NO: 84058

SEQ ID NO: 270433 - RNA, 64 nt, Homo Sapiens; identical to SEQ ID NO: 84059

SEQ ID NO: 270434 - RNA, 64 nt, Homo Sapiens; identical to SEQ ID NO: 84060

SEQ ID NO: 270435 - RNA, 64 nt, Homo Sapiens; identical to SEQ ID NO: 84061

SEQ ID NO: 270436 - RNA, 64 nt, Homo Sapiens; identical to SEQ ID NO: 84062

SEQ ID NO: 270437 - RNA, 64 nt, Homo Sapiens; identical to SEQ ID NO: 84063

SEQ ID NO: 270438 - RNA, 64 nt, Homo Sapiens; identical to SEQ ID NO: 84064

SEQ ID NO: 270439 - RNA, 64 nt, Homo Sapiens; identical to SEQ ID NO: 84065

SEQ ID NO: 270440 - RNA, 64 nt, Homo Sapiens; identical to SEQ ID NO: 84066

SEQ ID NO: 270441 - RNA, 64 nt, Homo Sapiens; identical to SEQ ID NO: 84067

SEQ ID NO: 270442 - RNA, 64 nt, Homo Sapiens; identical to SEQ ID NO: 84068

SEQ ID NO: 270443 - RNA, 64 nt, Homo Sapiens; identical to SEQ ID NO: 84069

SEQ ID NO: 270444 - RNA, 64 nt, Homo Sapiens; identical to SEQ ID NO: 84070

SEQ ID NO: 270445 - RNA, 64 nt, Homo Sapiens; identical to SEQ ID NO: 84071

SEQ ID NO: 270446 - RNA, 64 nt, Homo Sapiens; identical to SEQ ID NO: 84072

SEQ ID NO: 270447 - RNA, 64 nt, Homo Sapiens; identical to SEQ ID NO: 84073

SEQ ID NO: 270448 - RNA, 64 nt, Homo Sapiens; identical to SEQ ID NO: 84074

SEQ ID NO: 270449 - RNA, 64 nt, Homo Sapiens; identical to SEQ ID NO: 84075

SEQ ID NO: 270450 - RNA, 64 nt, Homo Sapiens; identical to SEQ ID NO: 84076

SEQ ID NO: 270451 - RNA, 64 nt, Homo Sapiens; identical to SEQ ID NO: 84077

SEQ ID NO: 270452 - RNA, 57 nt, Homo Sapiens; identical to SEQ ID NO: 84078

SEQ ID NO: 270453 - RNA, 64 nt, Homo Sapiens; identical to SEQ ID NO: 84079

SEQ ID NO: 270454 - RNA, 64 nt, Homo Sapiens; identical to SEQ ID NO: 84080

SEQ ID NO: 270455 - RNA, 64 nt, Homo Sapiens; identical to SEQ ID NO: 84081

SEQ ID NO: 270456 - RNA, 64 nt, Homo Sapiens; identical to SEQ ID NO: 84082

SEQ ID NO: 270457 - RNA, 64 nt, Homo Sapiens; identical to SEQ ID NO: 84083

SEQ ID NO: 270458 - RNA, 64 nt, Homo Sapiens; identical to SEQ ID NO: 247175

SEQ ID NO: 270459 - RNA, 64 nt, Homo Sapiens; identical to SEQ ID NO: 247176

SEQ ID NO: 270460 - RNA, 64 nt, Homo Sapiens; identical to SEQ ID NO: 247177

SEQ ID NO: 270461 - RNA, 64 nt, Homo Sapiens; identical to SEQ ID NO: 247178

SEQ ID NO: 270462 - RNA, 64 nt, Homo Sapiens; identical to SEQ ID NO: 247179

SEQ ID NO: 270463 - RNA, 64 nt, Homo Sapiens; identical to SEQ ID NO: 247180

SEQ ID NO: 270464 - RNA, 64 nt, Homo Sapiens; identical to SEQ ID NO: 247181

SEQ ID NO: 270465 - RNA, 64 nt, Homo Sapiens; identical to SEQ ID NO: 247182

SEQ ID NO: 270466 - RNA, 64 nt, Homo Sapiens; identical to SEQ ID NO: 247183

SEQ ID NO: 270467 - RNA, 64 nt, Homo Sapiens; identical to SEQ ID NO: 247184

SEQ ID NO: 270468 - RNA, 64 nt, Homo Sapiens; identical to SEQ ID NO: 247185

SEQ ID NO: 270469 - RNA, 64 nt, Homo Sapiens; identical to SEQ ID NO: 247186

SEQ ID NO: 270470 - RNA, 64 nt, Homo Sapiens; identical to SEQ ID NO: 247187

SEQ ID NO: 270471 - RNA, 64 nt, Homo Sapiens; identical to SEQ ID NO: 247188

SEQ ID NO: 270472 - RNA, 64 nt, Homo Sapiens; identical to SEQ ID NO: 247189

SEQ ID NO: 270473 - RNA, 64 nt, Homo Sapiens; identical to SEQ ID NO: 247190

SEQ ID NO: 270474 - RNA, 64 nt, Homo Sapiens; identical to SEQ ID NO: 247191

SEQ ID NO: 270475 - RNA, 64 nt, Homo Sapiens; identical to SEQ ID NO: 247192

SEQ ID NO: 270476 - RNA, 64 nt, Homo Sapiens; identical to SEQ ID NO: 247193

SEQ ID NO: 270477 - RNA, 64 nt, Homo Sapiens; identical to SEQ ID NO: 247194

SEQ ID NO: 270478 - RNA, 64 nt, Homo Sapiens; identical to SEQ ID NO: 247195

SEQ ID NO: 270479 - RNA, 64 nt, Homo Sapiens; identical to SEQ ID NO: 247196

SEQ ID NO: 270480 - RNA, 64 nt, Homo Sapiens; identical to SEQ ID NO: 247197

SEQ ID NO: 270481 - RNA, 64 nt, Homo Sapiens; identical to SEQ ID NO: 247198

SEQ ID NO: 270482 - RNA, 64 nt, Homo Sapiens; identical to SEQ ID NO: 247199

SEQ ID NO: 270483 - RNA, 64 nt, Homo Sapiens; identical to SEQ ID NO: 247200

SEQ ID NO: 270484 - RNA, 64 nt, Homo Sapiens; identical to SEQ ID NO: 247201

SEQ ID NO: 270485 - RNA, 61 nt, Homo Sapiens; identical to SEQ ID NO: 247202

SEQ ID NO: 270486 - RNA, 64 nt, Homo Sapiens; identical to SEQ ID NO: 247203

SEQ ID NO: 270487 - RNA, 64 nt, Homo Sapiens; identical to SEQ ID NO: 247204

SEQ ID NO: 270488 - RNA, 64 nt, Homo Sapiens; identical to SEQ ID NO: 247205

SEQ ID NO: 270489 - RNA, 64 nt, Homo Sapiens; identical to SEQ ID NO: 247206

SEQ ID NO: 270490 - RNA, 64 nt, Homo Sapiens; identical to SEQ ID NO: 247207

SEQ ID NO: 270491 - RNA, 64 nt, Homo Sapiens; identical to SEQ ID NO: 247208

SEQ ID NO: 270492 - RNA, 64 nt, Homo Sapiens; identical to SEQ ID NO: 247209

SEQ ID NO: 270493 - RNA, 64 nt, Homo Sapiens; identical to SEQ ID NO: 247210

SEQ ID NO: 270494 - RNA, 64 nt, Homo Sapiens; identical to SEQ ID NO: 247211

SEQ ID NO: 270495 - RNA, 64 nt, Homo Sapiens; identical to SEQ ID NO: 247212

SEQ ID NO: 270496 - RNA, 64 nt, Homo Sapiens; identical to SEQ ID NO: 247213

SEQ ID NO: 270497 - RNA, 64 nt, Homo Sapiens; identical to SEQ ID NO: 247214

SEQ ID NO: 270498 - RNA, 64 nt, Homo Sapiens; identical to SEQ ID NO: 247215

SEQ ID NO: 270499 - RNA, 64 nt, Homo Sapiens; identical to SEQ ID NO: 247216

SEQ ID NO: 270500 - RNA, 64 nt, Homo Sapiens; identical to SEQ ID NO: 247217

SEQ ID NO: 270501 - RNA, 64 nt, Homo Sapiens; identical to SEQ ID NO: 247218

SEQ ID NO: 270502 - RNA, 64 nt, Homo Sapiens; identical to SEQ ID NO: 247219

SEQ ID NO: 270503 - RNA, 64 nt, Homo Sapiens; identical to SEQ ID NO: 247220

SEQ ID NO: 270504 - RNA, 64 nt, Homo Sapiens; identical to SEQ ID NO: 247221

SEQ ID NO: 270505 - RNA, 64 nt, Homo Sapiens; identical to SEQ ID NO: 247222

SEQ ID NO: 270506 - RNA, 64 nt, Homo Sapiens; identical to SEQ ID NO: 247223

SEQ ID NO: 270507 - RNA, 64 nt, Homo Sapiens; identical to SEQ ID NO: 247224

SEQ ID NO: 270508 - RNA, 64 nt, Homo Sapiens; identical to SEQ ID NO: 247225

SEQ ID NO: 270509 - RNA, 64 nt, Homo Sapiens; identical to SEQ ID NO: 247226

SEQ ID NO: 270510 - RNA, 64 nt, Homo Sapiens; identical to SEQ ID NO: 247227

SEQ ID NO: 270511 - RNA, 64 nt, Homo Sapiens; identical to SEQ ID NO: 247228

SEQ ID NO: 270512 - RNA, 64 nt, Homo Sapiens; identical to SEQ ID NO: 247229

SEQ ID NO: 270513 - RNA, 64 nt, Homo Sapiens; identical to SEQ ID NO: 247230

SEQ ID NO: 270514 - RNA, 64 nt, Homo Sapiens; identical to SEQ ID NO: 247231

SEQ ID NO: 270515 - RNA, 64 nt, Homo Sapiens; identical to SEQ ID NO: 247232

SEQ ID NO: 270516 - RNA, 64 nt, Homo Sapiens; identical to SEQ ID NO: 247233

SEQ ID NO: 270517 - RNA, 64 nt, Homo Sapiens; identical to SEQ ID NO: 247234

SEQ ID NO: 270518 - RNA, 64 nt, Homo Sapiens; identical to SEQ ID NO: 247235

SEQ ID NO: 270519 - RNA, 64 nt, Homo Sapiens; identical to SEQ ID NO: 247236

SEQ ID NO: 270520 - RNA, 64 nt, Homo Sapiens; identical to SEQ ID NO: 247237

SEQ ID NO: 270521 - RNA, 64 nt, Homo Sapiens; identical to SEQ ID NO: 247238

SEQ ID NO: 270522 - RNA, 64 nt, Homo Sapiens; identical to SEQ ID NO: 247239

SEQ ID NO: 270523 - RNA, 64 nt, Homo Sapiens; identical to SEQ ID NO: 247240

SEQ ID NO: 270524 - RNA, 64 nt, Homo Sapiens; identical to SEQ ID NO: 247241

SEQ ID NO: 270525 - RNA, 64 nt, Homo Sapiens; identical to SEQ ID NO: 247242

SEQ ID NO: 270526 - RNA, 64 nt, Homo Sapiens; identical to SEQ ID NO: 247243

SEQ ID NO: 270527 - RNA, 64 nt, Homo Sapiens; identical to SEQ ID NO: 247244

SEQ ID NO: 270528 - RNA, 64 nt, Homo Sapiens; identical to SEQ ID NO: 247245

SEQ ID NO: 270529 - RNA, 64 nt, Homo Sapiens; identical to SEQ ID NO: 247246

SEQ ID NO: 270530 - RNA, 64 nt, Homo Sapiens; identical to SEQ ID NO: 247247

SEQ ID NO: 270531 - RNA, 64 nt, Homo Sapiens; identical to SEQ ID NO: 247248

SEQ ID NO: 270532 - RNA, 64 nt, Homo Sapiens; identical to SEQ ID NO: 247249

SEQ ID NO: 270533 - RNA, 64 nt, Homo Sapiens; identical to SEQ ID NO: 247250

SEQ ID NO: 270534 - RNA, 64 nt, Homo Sapiens; identical to SEQ ID NO: 247251

SEQ ID NO: 270535 - RNA, 64 nt, Homo Sapiens; identical to SEQ ID NO: 247252

SEQ ID NO: 270536 - RNA, 64 nt, Homo Sapiens
ccaaaugggaucuccauaccuguggaccaaaccaacaagagagacuauguuucuaaguauauug

SEQ ID NO: 270537 - RNA, 64 nt, Homo Sapiens
uggauccuucuguucuuccuuacaccuaaauaauacaagagauuaaugaauagugguuagaagu

SEQ ID NO: 270538 - RNA, 64 nt, Homo Sapiens
agccucuguacuguaaauaacaaaccauauugugacaagagauguucccagggauuuuaaugca

SEQ ID NO: 270539 - RNA, 64 nt, Homo Sapiens
gaaagccaaagcacuuucuguuggauuauggauaacaagagaguauacccaugugaaauaauaa

SEQ ID NO: 270540 - RNA, 64 nt, Homo Sapiens
cuaaucuuacggauaauccacgugagauuuccacacaagagaaaagcacacgcauagugaaaug

SEQ ID NO: 270541 - RNA, 64 nt, Homo Sapiens
caaaccucaagacuaucagugugaccuccccauaacaagagaaccccauauauaguuugagacu

SEQ ID NO: 270542 - RNA, 64 nt, Homo Sapiens
ugagauuccaguuguuuuuguaccuuugaaacauacaagagacacuucucucuuuuaaaucaga

SEQ ID NO: 270543 - RNA, 64 nt, Homo Sapiens
cuauuaaaagccucuagaagucgccuuguuaugcacaagagauucuuaaaguguucuccauguc

SEQ ID NO: 270544 - RNA, 64 nt, Homo Sapiens
uggggagguuuuuaguuauacaaauacccauccaacaagagagauaucaagaguuuguuauuuu

SEQ ID NO: 270545 - RNA, 64 nt, Homo Sapiens
uuagauugaucugcaugaaggcaaguauaugcauacaagagacuaaggaaaacacucuaguuuu

SEQ ID NO: 270546 - RNA, 64 nt, Homo Sapiens
ucucuucagcuguaaauaacaggauacagaauuaacaagagaaaaugucuaacuuuuuaagaaa

SEQ ID NO: 270547 - RNA, 64 nt, Homo Sapiens
gcacaaaaugacacucuucuaaaacuaaaugggcacaagagaauuuuccugggaaaguucacau

SEQ ID NO: 270548 - RNA, 64 nt, Homo Sapiens
ugcauguaagagugagggagggaaggaaggaacuacaagagagucggagaugaugcagcacaca

SEQ ID NO: 270549 - RNA, 64 nt, Homo Sapiens
uguccugaaacccagaagugauggagagaaaccaacaagagaucucgaacccugucuagaagga

SEQ ID NO: 270550 - RNA, 64 nt, Homo Sapiens
auuccuuucuaaguguguuuuauggcauccugcccacaaagaacucacagucugauuaggauga

SEQ ID NO: 270551 - RNA, 64 nt, Homo Sapiens
aggaugauuuuaaaaauaggguauaaucaugacucacaaagauaugaggcugggugugguggcu

SEQ ID NO: 270552 - RNA, 64 nt, Homo Sapiens
ucaucauaguaaaagaaaugagggcauaucggcucacaaagagauaaacuacauagggguguuu

SEQ ID NO: 270553 - RNA, 64 nt, Homo Sapiens
aagagauaaacuacauagggguguuuauuugugucacaaagaauuuaaaauaacacuugcccau

SEQ ID NO: 270554 - RNA, 64 nt, Homo Sapiens
caggaagaaugggcugcagauagagguuugucaacacaaagacaaacacaaagacauggaagau

SEQ ID NO: 270555 - RNA, 64 nt, Homo Sapiens
uggaagauuagagguuugucguuagguuugucaacacaaagacaucaacaaaaagacauggaag

SEQ ID NO: 270556 - RNA, 64 nt, Homo Sapiens
uggaagguuagagguuugucgagagguuugucaacacaaagacaggucagaugcaccacccaug

SEQ ID NO: 270557 - RNA, 64 nt, Homo Sapiens
cagcaauuuuuuucccuccuuuuugagacagaggcacaaagacuuauauauuucucucacccua

SEQ ID NO: 270558 - RNA, 64 nt, Homo Sapiens
uugacaguacaagucaaaucccaugaagccagggcacaaagaauugaaacuauuuucuucuucu

SEQ ID NO: 270559 - RNA, 64 nt, Homo Sapiens
aauuugaggcucuaagcuuccaagaaaacgcuuacacaaagaacaugaaccaaccaaucaauga

SEQ ID NO: 270560 - RNA, 64 nt, Homo Sapiens
ccugagccccgcaauugugaucaaagucuaccagcacaaagacccgaaaguaggaugagagccu

SEQ ID NO: 270561 - RNA, 64 nt, Homo Sapiens
agacgaugcacaaaaaaccacccuguacgaaggccacaaagaacagcucagaugcacaaagauu

SEQ ID NO: 270562 - RNA, 64 nt, Homo Sapiens
cccuguacgaaggccacaaagaacagcucagaugcacaaagauucacaccauacaggccaaauu

SEQ ID NO: 270563 - RNA, 64 nt, Homo Sapiens
uguaguccagucucuccagcaucaauuccaucagcacaaagacauaauuuaauuccuucuaccu

SEQ ID NO: 270564 - RNA, 64 nt, Homo Sapiens
aggaugagacaggaggucagcacaagauacacgucacaaagaccuugcugauaaaacagauugu

SEQ ID NO: 270565 - RNA, 64 nt, Homo Sapiens
cugggcagcugccaccucaguugcaucuguaauccacaaagauuuccaaggacuccuaacuacu

SEQ ID NO: 270566 - RNA, 64 nt, Homo Sapiens
cuucauauuuuuuuuauaagaccccuucaguccacacaaagaagaccaacauccacaggcuaac

SEQ ID NO: 270567 - RNA, 64 nt, Homo Sapiens
uuaagaaguuguccgucccaaaaaggcagugccucacaaagaaaauucaguuaaccaaacaaga

SEQ ID NO: 270568 - RNA, 64 nt, Homo Sapiens
aaacaaaaggaacuuuuaaaauauaugauauauucacaaagagaguaacagauuauguauaauc

SEQ ID NO: 270569 - RNA, 64 nt, Homo Sapiens
ccuucaagagcaguuaucaaucuuccucagccaucuuugugaguuuuuucuggacaagcuuaca

SEQ ID NO: 270570 - RNA, 64 nt, Homo Sapiens
aagaaaaaauagaugccucuagccuacuaggcaccuuugugagacacaccccaagauugccuug

SEQ ID NO: 270571 - RNA, 64 nt, Homo Sapiens
gaggugcuguugugggugucucagcucugagggucuuugugagcucccacuguugugggugucu

SEQ ID NO: 270572 - RNA, 64 nt, Homo Sapiens
cucccacuguugugggugucucagcucugagggucuuugugagcucccacuguugugggugucu

SEQ ID NO: 270573 - RNA, 64 nt, Homo Sapiens
cucccacuguugugggugucucagcucugagggucuuugugaguucccaccaacuuuuaauuau

SEQ ID NO: 270574 - RNA, 64 nt, Homo Sapiens
uuuuaugugugcaaaggauccaaauuaaaagcagcuuugugaacgcaguacuacagaacaaagg

SEQ ID NO: 270575 - RNA, 64 nt, Homo Sapiens
aauuguuuacagccuaugaaaaacaaagaauuaucuuugugaucagaaaaucaaaaguaaaaag

SEQ ID NO: 270576 - RNA, 64 nt, Homo Sapiens
uauuuauuaucuaccuuuucggggaugcugaguucuuugugauggguaguccuucaaaguagaa

SEQ ID NO: 270577 - RNA, 64 nt, Homo Sapiens
guagccuugcacacaucauuacuucugcauccuucuuugugaccaagugaauaccuaccuaccu

SEQ ID NO: 270578 - RNA, 64 nt, Homo Sapiens
acagucucuguuucauggcaacacuggauaauggcuuugugaaauuuaaaaaauuuuuguagcg

SEQ ID NO: 270579 - RNA, 64 nt, Homo Sapiens
aaacaaccauugcauguuugcuuuugauguaucccuuugugaaauuagcacuuuuggggccaau

SEQ ID NO: 270580 - RNA, 55 nt, Homo Sapiens
uggacacguuugauaguuaacauuucuuugugaaagguaauggacucacaagggg

SEQ ID NO: 270581 - RNA, 64 nt, Homo Sapiens
aacaugcugagaauggaaagucuaccggcccuuucuuugugaacgucacauuggccgagccgug

SEQ ID NO: 270582 - RNA, 64 nt, Homo Sapiens
ucucccuuuuuucaaaauugaaguuggguuggcucuuugugaaccucucauccccacagcagaa

SEQ ID NO: 270583 - RNA, 64 nt, Homo Sapiens
uggggguggauguagcugcagaaagcaugcacaacuuugugaaagaggcccugccuugugcaug

SEQ ID NO: 270584 - RNA, 64 nt, Homo Sapiens
cuguuaauuuuugugggauguuguucccauucuucuuugugagacagagagaaugugauauaga

SEQ ID NO: 270585 - RNA, 64 nt, Homo Sapiens
gcagaccuggcuguguugcccccaccucaucccucuuugugacaggaaaaaaaugucaucuccc

SEQ ID NO: 270586 - RNA, 64 nt, Homo Sapiens
cugaaggauacugccggcaggagcuacugagcugcuuugugaugggcgagagggccuuucccuu

SEQ ID NO: 270587 - RNA, 64 nt, Homo Sapiens
guugacaaggucuagcuacaaggucacagucuggcuuugugauggaauguccccaggagucagc

SEQ ID NO: 270588 - RNA, 64 nt, Homo Sapiens
gcaccauuuugaugaucauguguguugggagaaacuuugugaaugccaugucuaguaauugcua

SEQ ID NO: 270589 - RNA, 64 nt, Homo Sapiens
ugaacuuguuuacuauuggacauuuaguaacagccuuugugaaaagauaacaucauacauaagu

SEQ ID NO: 270590 - RNA, 64 nt, Homo Sapiens
aaggguggaugaaaaugcaucugagcucuccugacuuugugaaauauuuuugacuuuauauuuc

SEQ ID NO: 270591 - RNA, 64 nt, Homo Sapiens
auugacagaauaugucugauauaaaugauuauugcuuugugacaccuguaaacgacuuuaaaaa

SEQ ID NO: 270592 - RNA, 64 nt, Homo Sapiens
gugauauauuugcuaaguuuagauacaacuuagucuuugugauuccauuucauuuuggcuaugu

SEQ ID NO: 270593 - RNA, 64 nt, Homo Sapiens
cacaucacugacuccuaggucuagcacgacugcucuuugugauucucuugaguacccuuggcuu

SEQ ID NO: 270594 - RNA, 64 nt, Homo Sapiens
acucacugacaugaucuuagcuucuuuaaucagacuuugugacuuaaaaguuuggggguuuucu

SEQ ID NO: 270595 - RNA, 64 nt, Homo Sapiens
aaguugaaaaaccuucucuucagaaaagaagaaaaauucagaaaucaguagaucuuggcaauuc

SEQ ID NO: 270596 - RNA, 64 nt, Homo Sapiens
aagaagaaaaauucagaaaucaguagaucuuggcaauucagauaauauguuuuuuccuacuuca

SEQ ID NO: 270597 - RNA, 64 nt, Homo Sapiens
guagcucugagacuugcuucaaugaaagaucugaaauucagaguggacgauggauauugcuucc

SEQ ID NO: 270598 - RNA, 64 nt, Homo Sapiens
uccagcacgagcugacugacccaaacacggaacgaauucagacuguugcaagccuacucagacu

SEQ ID NO: 270599 - RNA, 64 nt, Homo Sapiens
ccuccacugccauggagacucugggagcugccuaaauucagaagggugggcugaguggaggugc

SEQ ID NO: 270600 - RNA, 64 nt, Homo Sapiens
ccagguggccugugcuccccacaucccaaaauaaaauucagaagaaucucccaggugaggauuc

SEQ ID NO: 270601 - RNA, 64 nt, Homo Sapiens
aacagcauagccaaggcuaggccagccauuuacuaauucagagggacaaaagcaaauuggaaaa

SEQ ID NO: 270602 - RNA, 64 nt, Homo Sapiens
ccuuuaauguaauucuaauaaaguccauaucaugaauucagaacuggguuaguagauauuauca

SEQ ID NO: 270603 - RNA, 64 nt, Homo Sapiens
gcguccaauugacugcccucuuacuguuuugaggaauucagaaguggagauuucaguucagcgg

SEQ ID NO: 270604 - RNA, 64 nt, Homo Sapiens
cuugugugugcgugucaguuacuuuuuuaguaacaauucagauccaguguaaacuuccguucau

SEQ ID NO: 270605 - RNA, 64 nt, Homo Sapiens
cuuaagcuguuagucuuaaagauuauuguuaaaaaauucagaagaaaagagagacaagugcucu

SEQ ID NO: 270606 - RNA, 64 nt, Homo Sapiens
aaguuugaguuaaguguuuuuaauucagucagugaauucagaauaaguacauucauguauaaca

SEQ ID NO: 270607 - RNA, 64 nt, Homo Sapiens
auauucuuuuuauauucuguggaaaaauaaaggaaauucagauuguuuaaaugccuaaaaguuu

SEQ ID NO: 270608 - RNA, 64 nt, Homo Sapiens
uuugguaauuguagaccuguuucauaagcuuuguaauucagaaauccuuguauuuaguaagugc

SEQ ID NO: 270609 - RNA, 64 nt, Homo Sapiens
cuacuauauuuuuuuauucuugguaucaguuuaaaauucagacaaggcccacagaauaagauuu

SEQ ID NO: 270610 - RNA, 64 nt, Homo Sapiens
ugguauucuuggguuuuccuacuuaauacacaguaauucagaacuuguauucuauuaugaguuu

SEQ ID NO: 270611 - RNA, 64 nt, Homo Sapiens
ucuuauuauuuaacccagaacugccugguuuucaaauucagaaacaggcgugagccaccaggcc

SEQ ID NO: 270612 - RNA, 64 nt, Homo Sapiens
augaaugacugacagaauauaucucauacaccagaauucagaucuguguaccauccuuuaauag

SEQ ID NO: 270613 - RNA, 64 nt, Homo Sapiens
aaguuccugagugcguggauuguugucaaacugaaauucagagcuuagaaauauucuacuucuc

SEQ ID NO: 270614 - RNA, 64 nt, Homo Sapiens
agccugccuguccccccgcacuauggaucaaagaaauucagaacuuuccuuugaacuugauugc

SEQ ID NO: 270615 - RNA, 64 nt, Homo Sapiens
agacccugugccuggccccacuucaccuucccugaauucagaacgcuggauagagguggggucu

SEQ ID NO: 270616 - RNA, 64 nt, Homo Sapiens
ggagaggccagcaccucccucuccugggggaguuaauucagaggaaacugaggccagagcugag

SEQ ID NO: 270617 - RNA, 64 nt, Homo Sapiens
acugcuuuguaauauuucacuuuguuuuacuacaaauucagaucacuuuguuuuacuauaaauu

SEQ ID NO: 270618 - RNA, 64 nt, Homo Sapiens
uuacuacaaauucagaucacuuuguuuuacuauaaauucagauuauccaaauauuuuccuaaua

SEQ ID NO: 270619 - RNA, 64 nt, Homo Sapiens
uuuugguuuuucuaaguauauagaaagcuuguauaauucagauuuaucaauuuccugauuuaau

SEQ ID NO: 270620 - RNA, 64 nt, Homo Sapiens
uggcuaccaaacacauucuccuuugaauuguuaaaauucagaacauucaaaauaacuguuuugc

SEQ ID NO: 270621 - RNA, 64 nt, Homo Sapiens
cuugucuccuguagacccaguggaacccauaaguaauucagaaccaucaaugaauucagauaug

SEQ ID NO: 270622 - RNA, 64 nt, Homo Sapiens
aguggaacccauaaguaauucagaaccaucaaugaauucagauaugggaaaagucaguaaaaau

SEQ ID NO: 270623 - RNA, 64 nt, Homo Sapiens
uuuuuuuuuugacaaaaggaggauacaggaagaaaauucagacucauuugaauauuuguaaacc

SEQ ID NO: 270624 - RNA, 64 nt, Homo Sapiens
uauucacauugaaauaaagaauuaucuagaugauaauucagauaauucaguuuguucauagaau

SEQ ID NO: 270625 - RNA, 64 nt, Homo Sapiens
uuuaauaucuuuuaucaguguauacuaggauuguaauucagauacuccuuuauuuuuauaugga

SEQ ID NO: 270626 - RNA, 64 nt, Homo Sapiens
aaauugaaagauggagucuaauggccacugagagaauucagaauguuucuaagaguugugcuuu

SEQ ID NO: 270627 - RNA, 64 nt, Homo Sapiens
aaaccaggacuagcuuuuugauaacuaggacucaaauucagaccguagccuugaagucaccaga

SEQ ID NO: 270628 - RNA, 64 nt, Homo Sapiens
ugugugcaugaauauauggggagacagaauauugaauucagaaagcagucauaaaacugagacu

SEQ ID NO: 270629 - RNA, 64 nt, Homo Sapiens
acacacauacuacuuuaagggggugaggaucauuaauucagauaauuuuuaaguuuccuaguga

SEQ ID NO: 270630 - RNA, 64 nt, Homo Sapiens
auacacauaucauuuuaagaagcugaggaucacuaauucagauaauguauaaguuucccaguga

SEQ ID NO: 270631 - RNA, 64 nt, Homo Sapiens
aaauagaagaacaaacacuagcucucagaauaaucucucagauguuuguuuugguagauaaugg

SEQ ID NO: 270632 - RNA, 64 nt, Homo Sapiens
aaucucucagaugaaauagaucuaagauaaugggcucucagaauaagaguuucgacuaaaacaa

SEQ ID NO: 270633 - RNA, 64 nt, Homo Sapiens
cucaagaaacucuuauuuauaauagguugcuucucucucagaacuuuuaucuauuacuuuuuuc

SEQ ID NO: 270634 - RNA, 64 nt, Homo Sapiens
aucuauuacuuuuuucuucuuaugaguauguuuacucucagaguaucuaucugauguagacagu

SEQ ID NO: 270635 - RNA, 64 nt, Homo Sapiens
uuuuucuucuuuaaaaaucuuaguuuguauuuuucucucagauauggcaucauuguuucaguuc

SEQ ID NO: 270636 - RNA, 64 nt, Homo Sapiens
gcugaagugcugcugguaaggcacuaccuugugccucucagauuucugucacuuguguaaguug

SEQ ID NO: 270637 - RNA, 64 nt, Homo Sapiens
ucucuggcagggaucucagaugaccguggccucccucucagagggggagaacgccagagcccug

SEQ ID NO: 270638 - RNA, 64 nt, Homo Sapiens
ugugcuggcugggggugaaucccaaugagggucccucucagagcgggagaacgccagagcccug

SEQ ID NO: 270639 - RNA, 64 nt, Homo Sapiens
ugcgcuggcugggggugaaucccaaugagggucccucucagaaagggagaacgccagagcccug

SEQ ID NO: 270640 - RNA, 64 nt, Homo Sapiens
gugagcuucggccuggccgaggugggugggugggcucucagauucagcucuguguaaagauucu

SEQ ID NO: 270641 - RNA, 64 nt, Homo Sapiens
ugggcaccguggcccugugcuccaucacaaacaccucucagaaacaacgugggaugaaaaagca

SEQ ID NO: 270642 - RNA, 64 nt, Homo Sapiens
aggccugagcauuucccagccccaguguccacaccucucagaaaagagaaaaaagaaugucagu

SEQ ID NO: 270643 - RNA, 64 nt, Homo Sapiens
aacacagccagcacggugcucuccagggcagccccucucagacgaggaggcagcgggugcagcc

SEQ ID NO: 270644 - RNA, 64 nt, Homo Sapiens
aucagcauccuccuggccagcuuucugcaauaagcucucagaccacuaagggcaccugcagaca

SEQ ID NO: 270645 - RNA, 64 nt, Homo Sapiens
aucagcauccuccuggccaguuuucugcaauucacucucagaccgcuaagggcacaugcacaca

SEQ ID NO: 270646 - RNA, 64 nt, Homo Sapiens
uuuaugugugguuuuaaagucuuauggcaaaaaucucucagaaauacaguaagguggaugguac

SEQ ID NO: 270647 - RNA, 64 nt, Homo Sapiens
acauugcaaucacacuagacuuauuacaaacggucucucagaccuaaaaguaaaauaacagaaa

SEQ ID NO: 270648 - RNA, 64 nt, Homo Sapiens
caucugauuugggguuaaacgacauucugauuugcucucagaaaacuuggcuuuuuacuuagag

SEQ ID NO: 270649 - RNA, 64 nt, Homo Sapiens
acaugacuugacauaguaaccccuuacuggaugacucucagaggcaucuuguggguuucuuuug

SEQ ID NO: 270650 - RNA, 64 nt, Homo Sapiens
ucuuuuuaauugaagaugucaagggcuucucugccucucagaauacccauccaggauggagaau

SEQ ID NO: 270651 - RNA, 64 nt, Homo Sapiens
acaccugaugcucaccugcccucaguccuguggccucucagagggccccggcaugaggccuuuc

SEQ ID NO: 270652 - RNA, 64 nt, Homo Sapiens
ugcauauacaaccaaguggguagaccuagguguucucucagaggggugugugugugugugcgug

SEQ ID NO: 270653 - RNA, 64 nt, Homo Sapiens
ugugugcgugcgcgugugccuagaauauauauuacucucagaggagauucuguugcuuuugaau

SEQ ID NO: 270654 - RNA, 64 nt, Homo Sapiens
gucacucuucugccuucgugaaaagccaauagcacucucagauaucaggggauuuuaguuccaa

SEQ ID NO: 270655 - RNA, 64 nt, Homo Sapiens
auccgaaccauugcccuuguuucccccacguucucucucagaucuuugucucgaagggaaaaca

SEQ ID NO: 270656 - RNA, 64 nt, Homo Sapiens
cccagggguggugggcccuagcccgcuacucccacucucagacacucgugcuuugcuggccccu

SEQ ID NO: 270657 - RNA, 64 nt, Homo Sapiens
cguccgugaugccuccuaauuucaaucauguuuccucucagaugccaugaggccaagcuugucc

SEQ ID NO: 270658 - RNA, 62 nt, Homo Sapiens
caaagcggagcugcugcugaccgaaccucagccucucagacuugaugaugaaguaggugguc

SEQ ID NO: 270659 - RNA, 64 nt, Homo Sapiens
uucuaaugcuuagcaacaacaacaaaaaauugcucucucagauccauaauccauacucagugaa

SEQ ID NO: 270660 - RNA, 64 nt, Homo Sapiens
gccggcacguggcugucuacaugugcuacagcaccucucagacagcccguggccuguaucacag

SEQ ID NO: 270661 - RNA, 64 nt, Homo Sapiens
cagaaaaugcugacagccucggaacaucuugcugcucucagagcaccucaccccauucccccag

SEQ ID NO: 270662 - RNA, 64 nt, Homo Sapiens
acaccugugacauccuccagcuuauuagcuccccgcuccacaagaccaccaaucccgaucggcu

SEQ ID NO: 270663 - RNA, 64 nt, Homo Sapiens
acaccugugaucuggaaauccuuauuagcuccccgcuccacaagaccaccaaucccgaucggcu

SEQ ID NO: 270664 - RNA, 64 nt, Homo Sapiens
acaccugugcuuuggaaauccuuauuagcuccccgcuccacaagacgaccaaucccgaucggcu

SEQ ID NO: 270665 - RNA, 64 nt, Homo Sapiens
ucuucaugggcagggguuguaggggaugcccugagcuccacagggguccugaccaaccugcauc

SEQ ID NO: 270666 - RNA, 64 nt, Homo Sapiens
gcggccaggccagcugagucccucauaccucugugcuccacacucucagaucugcccuugcuug

SEQ ID NO: 270667 - RNA, 64 nt, Homo Sapiens
agcuaaccaccauccauggucaagaccucuccuagcuccacacaagcaguagagucucagcucc

SEQ ID NO: 270668 - RNA, 64 nt, Homo Sapiens
ccucuccuagcuccacacaagcaguagagucucagcuccacagcuuuacccagaagcccuguaa

SEQ ID NO: 270669 - RNA, 64 nt, Homo Sapiens
gaaugcagcauuugugggaaauccuuuagaugucgcuccacacuugauacacaucagagaauuc

SEQ ID NO: 270670 - RNA, 64 nt, Homo Sapiens
aaaugcagcaaaugugggaaauuuuuuauggacagcuccacacucauuagucaugagagaguuc

SEQ ID NO: 270671 - RNA, 64 nt, Homo Sapiens
auuguucauguaaaaaucauacacguggcauguugcuccacauuccuuacacacagggguagag

SEQ ID NO: 270672 - RNA, 64 nt, Homo Sapiens
cgagccagaucauucaguuucagcgaguccuugagcuccacaacaucuaccagauauagcagac

SEQ ID NO: 270673 - RNA, 64 nt, Homo Sapiens
uuugcuguguguucuggggcucagaccacaaggggcuccacaccgccauaggguccugaauguu

SEQ ID NO: 270674 - RNA, 64 nt, Homo Sapiens
cguugagccuuggaaagguaugcuuguggacaaggcuccacaaggggaggcccuugggagcagg

SEQ ID NO: 270675 - RNA, 64 nt, Homo Sapiens
gcagggccucauuauuuuucccuccagaagggcagcuccacaggcucagggacuggcacacugg

SEQ ID NO: 270676 - RNA, 64 nt, Homo Sapiens; identical to SEQ ID NO: 175633

SEQ ID NO: 270677 - RNA, 64 nt, Homo Sapiens; identical to SEQ ID NO: 175634

SEQ ID NO: 270678 - RNA, 64 nt, Homo Sapiens; identical to SEQ ID NO: 175635

SEQ ID NO: 270679 - RNA, 64 nt, Homo Sapiens; identical to SEQ ID NO: 175636

SEQ ID NO: 270680 - RNA, 64 nt, Homo Sapiens; identical to SEQ ID NO: 175637

SEQ ID NO: 270681 - RNA, 64 nt, Homo Sapiens; identical to SEQ ID NO: 175638

SEQ ID NO: 270682 - RNA, 64 nt, Homo Sapiens; identical to SEQ ID NO: 175639

SEQ ID NO: 270683 - RNA, 64 nt, Homo Sapiens; identical to SEQ ID NO: 175640

SEQ ID NO: 270684 - RNA, 64 nt, Homo Sapiens; identical to SEQ ID NO: 175641

SEQ ID NO: 270685 - RNA, 64 nt, Homo Sapiens; identical to SEQ ID NO: 175642

SEQ ID NO: 270686 - RNA, 64 nt, Homo Sapiens; identical to SEQ ID NO: 175643

SEQ ID NO: 270687 - RNA, 64 nt, Homo Sapiens; identical to SEQ ID NO: 175644

SEQ ID NO: 270688 - RNA, 64 nt, Homo Sapiens; identical to SEQ ID NO: 175645

SEQ ID NO: 270689 - RNA, 64 nt, Homo Sapiens; identical to SEQ ID NO: 175646

SEQ ID NO: 270690 - RNA, 64 nt, Homo Sapiens; identical to SEQ ID NO: 175647

SEQ ID NO: 270691 - RNA, 64 nt, Homo Sapiens; identical to SEQ ID NO: 175648

SEQ ID NO: 270692 - RNA, 64 nt, Homo Sapiens; identical to SEQ ID NO: 175649

SEQ ID NO: 270693 - RNA, 64 nt, Homo Sapiens; identical to SEQ ID NO: 175650

SEQ ID NO: 270694 - RNA, 64 nt, Homo Sapiens; identical to SEQ ID NO: 175651

SEQ ID NO: 270695 - RNA, 64 nt, Homo Sapiens; identical to SEQ ID NO: 175652

SEQ ID NO: 270696 - RNA, 64 nt, Homo Sapiens; identical to SEQ ID NO: 175653

SEQ ID NO: 270697 - RNA, 64 nt, Homo Sapiens; identical to SEQ ID NO: 175654

SEQ ID NO: 270698 - RNA, 64 nt, Homo Sapiens; identical to SEQ ID NO: 175655

SEQ ID NO: 270699 - RNA, 64 nt, Homo Sapiens; identical to SEQ ID NO: 175656

SEQ ID NO: 270700 - RNA, 64 nt, Homo Sapiens; identical to SEQ ID NO: 175657

SEQ ID NO: 270701 - RNA, 64 nt, Homo Sapiens; identical to SEQ ID NO: 175658

SEQ ID NO: 270702 - RNA, 64 nt, Homo Sapiens; identical to SEQ ID NO: 175659

SEQ ID NO: 270703 - RNA, 64 nt, Homo Sapiens; identical to SEQ ID NO: 175660

SEQ ID NO: 270704 - RNA, 64 nt, Homo Sapiens; identical to SEQ ID NO: 175661

SEQ ID NO: 270705 - RNA, 64 nt, Homo Sapiens; identical to SEQ ID NO: 175662

SEQ ID NO: 270706 - RNA, 64 nt, Homo Sapiens; identical to SEQ ID NO: 175663

SEQ ID NO: 270707 - RNA, 64 nt, Homo Sapiens; identical to SEQ ID NO: 175664

SEQ ID NO: 270708 - RNA, 64 nt, Homo Sapiens; identical to SEQ ID NO: 175665

SEQ ID NO: 270709 - RNA, 64 nt, Homo Sapiens; identical to SEQ ID NO: 175666

SEQ ID NO: 270710 - RNA, 64 nt, Homo Sapiens; identical to SEQ ID NO: 175667

SEQ ID NO: 270711 - RNA, 64 nt, Homo Sapiens; identical to SEQ ID NO: 175668

SEQ ID NO: 270712 - RNA, 64 nt, Homo Sapiens; identical to SEQ ID NO: 175669

SEQ ID NO: 270713 - RNA, 64 nt, Homo Sapiens; identical to SEQ ID NO: 175670

SEQ ID NO: 270714 - RNA, 64 nt, Homo Sapiens; identical to SEQ ID NO: 175671

SEQ ID NO: 270715 - RNA, 64 nt, Homo Sapiens; identical to SEQ ID NO: 175672

SEQ ID NO: 270716 - RNA, 64 nt, Homo Sapiens; identical to SEQ ID NO: 175673

SEQ ID NO: 270717 - RNA, 64 nt, Homo Sapiens; identical to SEQ ID NO: 175674

SEQ ID NO: 270718 - RNA, 64 nt, Homo Sapiens; identical to SEQ ID NO: 175675

SEQ ID NO: 270719 - RNA, 64 nt, Homo Sapiens; identical to SEQ ID NO: 175676

SEQ ID NO: 270720 - RNA, 64 nt, Homo Sapiens; identical to SEQ ID NO: 175677

SEQ ID NO: 270721 - RNA, 64 nt, Homo Sapiens; identical to SEQ ID NO: 175678

SEQ ID NO: 270722 - RNA, 64 nt, Homo Sapiens; identical to SEQ ID NO: 175679

SEQ ID NO: 270723 - RNA, 64 nt, Homo Sapiens; identical to SEQ ID NO: 175680

SEQ ID NO: 270724 - RNA, 64 nt, Homo Sapiens; identical to SEQ ID NO: 175681

SEQ ID NO: 270725 - RNA, 64 nt, Homo Sapiens; identical to SEQ ID NO: 175682

SEQ ID NO: 270726 - RNA, 64 nt, Homo Sapiens; identical to SEQ ID NO: 175683

SEQ ID NO: 270727 - RNA, 64 nt, Homo Sapiens; identical to SEQ ID NO: 175684

SEQ ID NO: 270728 - RNA, 64 nt, Homo Sapiens; identical to SEQ ID NO: 175685

SEQ ID NO: 270729 - RNA, 64 nt, Homo Sapiens; identical to SEQ ID NO: 175686

SEQ ID NO: 270730 - RNA, 64 nt, Homo Sapiens; identical to SEQ ID NO: 175687

SEQ ID NO: 270731 - RNA, 64 nt, Homo Sapiens; identical to SEQ ID NO: 175688

SEQ ID NO: 270732 - RNA, 64 nt, Homo Sapiens; identical to SEQ ID NO: 175689

SEQ ID NO: 270733 - RNA, 64 nt, Homo Sapiens; identical to SEQ ID NO: 175690

SEQ ID NO: 270734 - RNA, 64 nt, Homo Sapiens; identical to SEQ ID NO: 175691

SEQ ID NO: 270735 - RNA, 64 nt, Homo Sapiens; identical to SEQ ID NO: 175692

SEQ ID NO: 270736 - RNA, 64 nt, Homo Sapiens; identical to SEQ ID NO: 175693

SEQ ID NO: 270737 - RNA, 64 nt, Homo Sapiens; identical to SEQ ID NO: 175694

SEQ ID NO: 270738 - RNA, 64 nt, Homo Sapiens; identical to SEQ ID NO: 175695

SEQ ID NO: 270739 - RNA, 64 nt, Homo Sapiens; identical to SEQ ID NO: 175696

SEQ ID NO: 270740 - RNA, 64 nt, Homo Sapiens; identical to SEQ ID NO: 175697

SEQ ID NO: 270741 - RNA, 64 nt, Homo Sapiens; identical to SEQ ID NO: 175698

SEQ ID NO: 270742 - RNA, 64 nt, Homo Sapiens; identical to SEQ ID NO: 175699

SEQ ID NO: 270743 - RNA, 64 nt, Homo Sapiens; identical to SEQ ID NO: 175700

SEQ ID NO: 270744 - RNA, 64 nt, Homo Sapiens; identical to SEQ ID NO: 175701

SEQ ID NO: 270745 - RNA, 64 nt, Homo Sapiens; identical to SEQ ID NO: 175702

SEQ ID NO: 270746 - RNA, 64 nt, Homo Sapiens; identical to SEQ ID NO: 175703

SEQ ID NO: 270747 - RNA, 64 nt, Homo Sapiens; identical to SEQ ID NO: 175704

SEQ ID NO: 270748 - RNA, 64 nt, Homo Sapiens; identical to SEQ ID NO: 175705

SEQ ID NO: 270749 - RNA, 64 nt, Homo Sapiens; identical to SEQ ID NO: 175706

SEQ ID NO: 270750 - RNA, 64 nt, Homo Sapiens; identical to SEQ ID NO: 175707

SEQ ID NO: 270751 - RNA, 64 nt, Homo Sapiens; identical to SEQ ID NO: 175708

SEQ ID NO: 270752 - RNA, 64 nt, Homo Sapiens; identical to SEQ ID NO: 175709

SEQ ID NO: 270753 - RNA, 64 nt, Homo Sapiens; identical to SEQ ID NO: 175710

SEQ ID NO: 270754 - RNA, 64 nt, Homo Sapiens; identical to SEQ ID NO: 175711

SEQ ID NO: 270755 - RNA, 64 nt, Homo Sapiens; identical to SEQ ID NO: 175712

SEQ ID NO: 270756 - RNA, 64 nt, Homo Sapiens; identical to SEQ ID NO: 175713

SEQ ID NO: 270757 - RNA, 64 nt, Homo Sapiens; identical to SEQ ID NO: 175714

SEQ ID NO: 270758 - RNA, 64 nt, Homo Sapiens; identical to SEQ ID NO: 175715

SEQ ID NO: 270759 - RNA, 64 nt, Homo Sapiens; identical to SEQ ID NO: 175716

SEQ ID NO: 270760 - RNA, 64 nt, Homo Sapiens; identical to SEQ ID NO: 175717

SEQ ID NO: 270761 - RNA, 64 nt, Homo Sapiens; identical to SEQ ID NO: 175718

SEQ ID NO: 270762 - RNA, 64 nt, Homo Sapiens; identical to SEQ ID NO: 175719

SEQ ID NO: 270763 - RNA, 64 nt, Homo Sapiens; identical to SEQ ID NO: 175720

SEQ ID NO: 270764 - RNA, 64 nt, Homo Sapiens; identical to SEQ ID NO: 175721

SEQ ID NO: 270765 - RNA, 64 nt, Homo Sapiens; identical to SEQ ID NO: 175722

SEQ ID NO: 270766 - RNA, 64 nt, Homo Sapiens; identical to SEQ ID NO: 175723

SEQ ID NO: 270767 - RNA, 64 nt, Homo Sapiens; identical to SEQ ID NO: 175724

SEQ ID NO: 270768 - RNA, 64 nt, Homo Sapiens; identical to SEQ ID NO: 175725

SEQ ID NO: 270769 - RNA, 64 nt, Homo Sapiens; identical to SEQ ID NO: 175726

SEQ ID NO: 270770 - RNA, 64 nt, Homo Sapiens; identical to SEQ ID NO: 175727

SEQ ID NO: 270771 - RNA, 64 nt, Homo Sapiens
ugacaaggaaggcuaauucuaaaccugaaggcauccuugaaaucaugcuugaauauugcuuuga

SEQ ID NO: 270772 - RNA, 64 nt, Homo Sapiens
ucagcugaucuuaacaaaauucguagcaguggaaccuugaaaugcauguggcuagauuuaugcu

SEQ ID NO: 270773 - RNA, 64 nt, Homo Sapiens
uugcuaagugaaagaagccaacaacauggaugagccuugaaaacaugaaguacucacacaugcc

SEQ ID NO: 270774 - RNA, 64 nt, Homo Sapiens
gaacaaaguugguggauucaaauauccaaauaagccuugaaaaaaagaaaugcaagggacccag

SEQ ID NO: 270775 - RNA, 64 nt, Homo Sapiens
gccucuucugggaacacagcagguggauguccauccuugaaacacacagguggccccugcauuc

SEQ ID NO: 270776 - RNA, 64 nt, Homo Sapiens
ucacauuccaucaaaguuuacauggcggauacucccuugaaauugccugacaguggguuccuuc

SEQ ID NO: 270777 - RNA, 64 nt, Homo Sapiens
aguuuuugauguuuugugauuaaauggaaauaauccuugaaaauaaauggaaaaaccuauuagg

SEQ ID NO: 270778 - RNA, 64 nt, Homo Sapiens
cucaagacuguagcauggugcaaauugcagacuuccuugaaagggagguaaagaaaauaauuuu

SEQ ID NO: 270779 - RNA, 64 nt, Homo Sapiens
aauuuugacuaagugauauuugaauguuuucaggccuugaaauauaguaccauuuugauuaguc

SEQ ID NO: 270780 - RNA, 64 nt, Homo Sapiens
auauuccaaggcaaaucuaauuuaauauuuaaggccuugaaauugaaauaguuauaaaauuauu

SEQ ID NO: 270781 - RNA, 64 nt, Homo Sapiens
uuuaugaaaugccuacugugugcaagucauccauccuugaaaaggccacuucucagugagggag

SEQ ID NO: 270782 - RNA, 64 nt, Homo Sapiens
auaugggcauacaacugcuacugaaguuauauagccuugaaaacucagugcagguugcccuuaa

SEQ ID NO: 270783 - RNA, 64 nt, Homo Sapiens
guugcaguaaaauuuaaauguacccuuuucuuuuccuugaaaauuuacaaaacaagaaaaaaaa

SEQ ID NO: 270784 - RNA, 64 nt, Homo Sapiens
ugaucuuccuauuugagucuauuugaugugagugccuugaaaacaguuuuucuacugccauuca

SEQ ID NO: 270785 - RNA, 64 nt, Homo Sapiens
gggaacuuugacagccaugaugaccuucuuugauccuugaaaaugagcaccagacucaagacca

SEQ ID NO: 270786 - RNA, 64 nt, Homo Sapiens
cauggucgugggcccuuuccgacucuggugccagccuugaaaguucugcuucucuuggcugggg

SEQ ID NO: 270787 - RNA, 64 nt, Homo Sapiens
uuuggucauaugagaagcaggugcgcagagaauuccuugaaagaucugagguuuuuaacaugaa

SEQ ID NO: 270788 - RNA, 64 nt, Homo Sapiens
cuuccuuuuaccuagaaugccucauuuaaaagugccuugaaaacauuuagcuccccuucuucau

SEQ ID NO: 270789 - RNA, 64 nt, Homo Sapiens
cagaugaagguucaauuuucaauuagaacuccuaccuugaaaccccacauauucggacuuagua

SEQ ID NO: 270790 - RNA, 64 nt, Homo Sapiens
gcuguuugcucaaucuuucuaccacgauuugugcccuugaaaauacaugcugaucuccaggugc

SEQ ID NO: 270791 - RNA, 64 nt, Homo Sapiens
uaauuuaauguuuuuucuuuguaccugaugugaauucuagcaaccuuuguuaggaaaaagcaca

SEQ ID NO: 270792 - RNA, 64 nt, Homo Sapiens
auuuaugaauccaagggguggcagcaucacucuguucuagcauucuuuguggagauggucuggu

SEQ ID NO: 270793 - RNA, 64 nt, Homo Sapiens
cuuuagauaaacaagagacauuuucauaauugcuuucuagcaaucagcuuuuauuugccuuaau

SEQ ID NO: 270794 - RNA, 64 nt, Homo Sapiens
uggccucuguccucuuuuagucuagugucugguuuucuagcaaacaguaaauuuaaacaaguaa

SEQ ID NO: 270795 - RNA, 64 nt, Homo Sapiens
uuuugauuuuguuucaauuucuacccacccucccuucuagcagauaaacaaggcugguggcugu

SEQ ID NO: 270796 - RNA, 64 nt, Homo Sapiens
uucuuauuuuguuugaauuucuacccacccucccuucuagcagaugugacggggcggguggcgu

SEQ ID NO: 270797 - RNA, 64 nt, Homo Sapiens
ccuuuccaaccccuuugcugguugcugggccucauucuagcaccuuguucuuagagcagauucu

SEQ ID NO: 270798 - RNA, 64 nt, Homo Sapiens
gggccucauucuagcaccuuguucuuagagcagauucuagcacaucauggcagugggaccaagc

SEQ ID NO: 270799 - RNA, 64 nt, Homo Sapiens
uuuuuacuaccuauauggguauuagcuuuuuaucuucuagcauucagaaggaaggauggugcaa

SEQ ID NO: 270800 - RNA, 64 nt, Homo Sapiens
uugucagaaggaaggauggucaugaaugcagauauucuagcauacucuaugacccuacaaccau

SEQ ID NO: 270801 - RNA, 64 nt, Homo Sapiens
gugauuuagcaggaagcugugagagcaguuugguuucuagcaugaagacagagccccacccuca

SEQ ID NO: 270802 - RNA, 63 nt, Homo Sapiens
ggagcccugucuccucucucuguaauaaacucauuucuagcagacacugcucugccauguuuu

SEQ ID NO: 270803 - RNA, 64 nt, Homo Sapiens
guauguacaauccugggcauugacucugugacauuucuagcauauccaaggcaccaccagugau

SEQ ID NO: 270804 - RNA, 64 nt, Homo Sapiens
cauaccacagggaaauaccuuuccugggcuuguuuucuagcauaucacugaccugggaucuuug

SEQ ID NO: 270805 - RNA, 64 nt, Homo Sapiens
gggaccaggauaccacucuggcccuagggaagaagucagggacaugagaugcccaggaggagga

SEQ ID NO: 270806 - RNA, 64 nt, Homo Sapiens
uuccaauggccaagagaguggcauugaacccugggucagggacggggauaaaugugacaacugu

SEQ ID NO: 270807 - RNA, 64 nt, Homo Sapiens
aagggucaguugggugccugguaaguucuagaucgucagggagggcaaaggcagcacguaaugu

SEQ ID NO: 270808 - RNA, 64 nt, Homo Sapiens
aggggucaguugggugcuugguagguuauagaucgucagggaggguggaggcagcacggaacau

SEQ ID NO: 270809 - RNA, 64 nt, Homo Sapiens
uguugugaaaaaaaaaacccuguuguaggaauuagucagggaguccuucgcugugcuagaguug

SEQ ID NO: 270810 - RNA, 64 nt, Homo Sapiens
augucugugacuuagcugcagugccaggccucaggucagggagagcuccucagagagggcagcg

SEQ ID NO: 270811 - RNA, 64 nt, Homo Sapiens
gucacaggcgccccaccauucaaccuuccgggaggucagggaccuucuauaugaggcgaguggg

SEQ ID NO: 270812 - RNA, 64 nt, Homo Sapiens
uaggaacucccuuuugcaaaaaagaaaccugggugucagggaggugaagugacuugcccuagga

SEQ ID NO: 270813 - RNA, 64 nt, Homo Sapiens
guggcgauccgguugcacacuggccucuguggaggucagggaggugggaaggugggugggccug

SEQ ID NO: 270814 - RNA, 64 nt, Homo Sapiens
uggccaggccccaugguccugcucugggucagcugucagggagaccucccuucagccugagcca

SEQ ID NO: 270815 - RNA, 64 nt, Homo Sapiens
gggggaaaucucggaagaggggggaagacggggagucagggagguccccagggccaagcgcugg

SEQ ID NO: 270816 - RNA, 64 nt, Homo Sapiens
cggggggcaggccccucccacccgcccgguggacgucagggacuagcccaauuaggugccugca

SEQ ID NO: 270817 - RNA, 64 nt, Homo Sapiens
aaaacauaguccaaguggaagcauccaugaacacaccgguaaaucugauguaaaaaucaugcug

SEQ ID NO: 270818 - RNA, 64 nt, Homo Sapiens
caggaaugacaaagcuugcuuuagacgagaucauaccgguaaaguucugaaaugaaauguuugu

SEQ ID NO: 270819 - RNA, 64 nt, Homo Sapiens
uagguuuuaccaccaaaugccguacuucaaugccaccgguaacuagagaacuugagcuuacuua

SEQ ID NO: 270820 - RNA, 64 nt, Homo Sapiens
uauuguauuuccaccguacuuugcugaauaguguaccgguaauauuuuuugucauuccauaagc

SEQ ID NO: 270821 - RNA, 64 nt, Homo Sapiens
guaccugucacccuccuuguaacacauaccacaaaccgguaacucagcauacacacagggaaca

SEQ ID NO: 270822 - RNA, 64 nt, Homo Sapiens
aaaauacaaaaauuauccgggcaugggggcacacaccgguaaucccagcuacucaggaggcuga

SEQ ID NO: 270823 - RNA, 64 nt, Homo Sapiens
cauaaauugcaucacuguaucauuuucuuuuuuaaccgguaagaguuucaguuuguuggaaagu

SEQ ID NO: 270824 - RNA, 64 nt, Homo Sapiens
ucccaauagcuuugaauauuaaacagaaaaaucuaccgguaauuaguggaaaaccgaaaaaaaa

SEQ ID NO: 270825 - RNA, 64 nt, Homo Sapiens
aaaaaaaaaaaaaaaaaaaagcuuaaacagcuccaccgguaaaagagaucuccacaacuccuug

SEQ ID NO: 270826 - RNA, 64 nt, Homo Sapiens
ccagcacuuugagaggcugaaugcaggggcucacaccgguaaucauaacgagacuuugggucgg

SEQ ID NO: 270827 - RNA, 64 nt, Homo Sapiens
ccagcacuuugggaggccgagugcaguggcucacaccgguaaucaguaaaugcauuaaggccaa

SEQ ID NO: 270828 - RNA, 64 nt, Homo Sapiens
acccugggcucuggucuguagguuuguaguagccaccgguaauaagccaagggcuaggcucuug

SEQ ID NO: 270829 - RNA, 64 nt, Homo Sapiens
acuugugccucccaucccuggaguacugacuggcaccgguaagacagaaucucuuugaauccau

SEQ ID NO: 270830 - RNA, 64 nt, Homo Sapiens
uccaugucacuaguuaugcaucccaggccuggggaccgguaagaugucaccaaacagaccaucu

SEQ ID NO: 270831 - RNA, 64 nt, Homo Sapiens
uuaccacugagauacacuauuugauccauggauaaccgguaaugggaaaaugcuccgacccuca

SEQ ID NO: 270832 - RNA, 64 nt, Homo Sapiens
uggcagaucaccuugaaggcaagccagagaacaaaccgguaagaauuuaggacucgucguagac

SEQ ID NO: 270833 - RNA, 64 nt, Homo Sapiens
ggagaaugacuccaaagguuugagcuuggcuagaaccgguaagauggugacauuguugaucaag

SEQ ID NO: 270834 - RNA, 64 nt, Homo Sapiens
accacuuccccacaccgccgcgcuuaaacaaccaaccgguaaccgcugcuuucccagaaauuca

SEQ ID NO: 270835 - RNA, 64 nt, Homo Sapiens
ccuguaagcuaaacaaacaacucuuucuuauaaugccaccuaucgagaaauuacaaagcccgag

SEQ ID NO: 270836 - RNA, 64 nt, Homo Sapiens
agugccagugacuuauuuuaaugcauuuaaccaugccaccuaugauacaacuacaaggaaaaaa

SEQ ID NO: 270837 - RNA, 64 nt, Homo Sapiens
accaaagaggaccccacucugaagccagccuggagccaccuaccucuggccucaggcugugggc

SEQ ID NO: 270838 - RNA, 64 nt, Homo Sapiens
cuggagcaucugaucugucucuaugccaccacuggccaccuagagcccuuggcugugguaaucc

SEQ ID NO: 270839 - RNA, 64 nt, Homo Sapiens; identical to SEQ ID NO: 98571

SEQ ID NO: 270840 - RNA, 64 nt, Homo Sapiens; identical to SEQ ID NO: 98572

SEQ ID NO: 270841 - RNA, 64 nt, Homo Sapiens; identical to SEQ ID NO: 98573

SEQ ID NO: 270842 - RNA, 64 nt, Homo Sapiens; identical to SEQ ID NO: 98574

SEQ ID NO: 270843 - RNA, 64 nt, Homo Sapiens; identical to SEQ ID NO: 98575

SEQ ID NO: 270844 - RNA, 64 nt, Homo Sapiens; identical to SEQ ID NO: 98576

SEQ ID NO: 270845 - RNA, 64 nt, Homo Sapiens; identical to SEQ ID NO: 189259

SEQ ID NO: 270846 - RNA, 64 nt, Homo Sapiens; identical to SEQ ID NO: 189260

SEQ ID NO: 270847 - RNA, 64 nt, Homo Sapiens; identical to SEQ ID NO: 189261

SEQ ID NO: 270848 - RNA, 64 nt, Homo Sapiens; identical to SEQ ID NO: 189262

SEQ ID NO: 270849 - RNA, 56 nt, Homo Sapiens; identical to SEQ ID NO: 189263

SEQ ID NO: 270850 - RNA, 64 nt, Homo Sapiens; identical to SEQ ID NO: 189264

SEQ ID NO: 270851 - RNA, 64 nt, Homo Sapiens; identical to SEQ ID NO: 189265

SEQ ID NO: 270852 - RNA, 64 nt, Homo Sapiens; identical to SEQ ID NO: 189266

SEQ ID NO: 270853 - RNA, 64 nt, Homo Sapiens; identical to SEQ ID NO: 189267

SEQ ID NO: 270854 - RNA, 64 nt, Homo Sapiens; identical to SEQ ID NO: 189268

SEQ ID NO: 270855 - RNA, 64 nt, Homo Sapiens; identical to SEQ ID NO: 189269

SEQ ID NO: 270856 - RNA, 64 nt, Homo Sapiens; identical to SEQ ID NO: 189270

SEQ ID NO: 270857 - RNA, 64 nt, Homo Sapiens; identical to SEQ ID NO: 189271

SEQ ID NO: 270858 - RNA, 64 nt, Homo Sapiens; identical to SEQ ID NO: 189272

SEQ ID NO: 270859 - RNA, 64 nt, Homo Sapiens; identical to SEQ ID NO: 189273

SEQ ID NO: 270860 - RNA, 64 nt, Homo Sapiens; identical to SEQ ID NO: 189274

SEQ ID NO: 270861 - RNA, 64 nt, Homo Sapiens; identical to SEQ ID NO: 189275

SEQ ID NO: 270862 - RNA, 64 nt, Homo Sapiens; identical to SEQ ID NO: 189276

SEQ ID NO: 270863 - RNA, 64 nt, Homo Sapiens; identical to SEQ ID NO: 189277

SEQ ID NO: 270864 - RNA, 64 nt, Homo Sapiens; identical to SEQ ID NO: 189278

SEQ ID NO: 270865 - RNA, 64 nt, Homo Sapiens; identical to SEQ ID NO: 189279

SEQ ID NO: 270866 - RNA, 64 nt, Homo Sapiens; identical to SEQ ID NO: 189280

SEQ ID NO: 270867 - RNA, 64 nt, Homo Sapiens
uauuugaaccuuuggaacuugggaguucucauuguaacccuaacaugugagaauaaaaugucuu

SEQ ID NO: 270868 - RNA, 64 nt, Homo Sapiens
ggagaggucgugaggccagcucccggggccccuguaacccuacucuccucucucccuggaccuc

SEQ ID NO: 270869 - RNA, 64 nt, Homo Sapiens
aauucugccugccuccucccucccagcugcacuuuaacccuagaagguggggaccuggggggag

SEQ ID NO: 270870 - RNA, 64 nt, Homo Sapiens
ugcuuuucuguauuguuucacuccguauguaacauaacccuaaauaaauuauuucguauuugag

SEQ ID NO: 270871 - RNA, 64 nt, Homo Sapiens
gaaaaugaaagguugcaccucauuuaaugaagcuuaacccuauguagaaagucucuuucggggg

SEQ ID NO: 270872 - RNA, 64 nt, Homo Sapiens
uugccauguguauaaagcuuuauucuuuagcccuuaacccuaaggcucagggaaauacccuaug

SEQ ID NO: 270873 - RNA, 64 nt, Homo Sapiens
caguauuuaaaaagacauguuugcauugagaaauuaacccuaaaggguuuucaauaggguguag

SEQ ID NO: 270874 - RNA, 64 nt, Homo Sapiens
gugaugaccaugcaccuuacaauuucugaacaguuaacccuauagaagcaugcuuuauaugagu

SEQ ID NO: 270875 - RNA, 64 nt, Homo Sapiens
cucugggcuugcccuuugccuugucuuuggucucuaacccuaauauauuagggguaacgaccgc

SEQ ID NO: 270876 - RNA, 64 nt, Homo Sapiens
cuaauuguccacauacguggcacaaggauuucucuaacccuaucccuccaggcccaucucaaau

SEQ ID NO: 270877 - RNA, 64 nt, Homo Sapiens
uugagauuauuauauacuguauuuucuucuaaauuaacccuaauguuuaaaaacucacuuuccc

SEQ ID NO: 270878 - RNA, 64 nt, Homo Sapiens
acuaaaacacugaaaaauauuccaagcuucauauuaacccuaccugucaacguaacgauuucau

SEQ ID NO: 270879 - RNA, 64 nt, Homo Sapiens
ucugaggauuauuuaaccauuguucuauuuggcauaacccuauuuaauggugcuuagagcugaa

SEQ ID NO: 270880 - RNA, 64 nt, Homo Sapiens
gagacucuuuugcucaacauuaaauugugcuuccuaacccuaaaucuguccagaguaggaacau

SEQ ID NO: 270881 - RNA, 64 nt, Homo Sapiens
cagaauguguuaaauagauuaagacacaguaaguuaacccuacauguuauaaagauggcgacug

SEQ ID NO: 270882 - RNA, 64 nt, Homo Sapiens
uuaagagcuaaccaguuaccacacaucuaugauauaacccuaacacacacagaaaagcauacau

SEQ ID NO: 270883 - RNA, 64 nt, Homo Sapiens
caggaaaggauugauaacuaccggcugauaaggcuaacccuaccuaucuaaaaguaaguguuuu

SEQ ID NO: 270884 - RNA, 64 nt, Homo Sapiens
accuagauguuguccaccugaugaaacaguauauuaacccuaaagaugaaacuuuguacaguau

SEQ ID NO: 270885 - RNA, 64 nt, Homo Sapiens
uugccugaggcccuuaugucggggcaguggcccguaacccuaguuuguggcccacucaacucuu

SEQ ID NO: 270886 - RNA, 64 nt, Homo Sapiens
uaaaaauucagucugauaacgaauaauguggaaauaacccuagaugacucucuuuuucacugua

SEQ ID NO: 270887 - RNA, 64 nt, Homo Sapiens
uauggcagcucuuuaauguaugcucuuuccuagcuaacccuagaggcucccaggaugguaccau

SEQ ID NO: 270888 - RNA, 64 nt, Homo Sapiens
uccuaccguuucauagucuuugucuaacugcuaguaacccuaccgaguuuuauauaugaguggg

SEQ ID NO: 270889 - RNA, 64 nt, Homo Sapiens
cuuuucaaucccaucuagauaauuuauagaaauauaacccuaauuggacaugugguacaggauc

SEQ ID NO: 270890 - RNA, 64 nt, Homo Sapiens
augccugcccugcgugcugguuccuucagaccccuaacccuacuaaccagcaggcucaucucac

SEQ ID NO: 270891 - RNA, 64 nt, Homo Sapiens
cacuauucaauaaguaguaguaaacaaaugauuguaacccuacaaguugaaaaacucuggggug

SEQ ID NO: 270892 - RNA, 64 nt, Homo Sapiens
aagagccuuccuauuccccuuguuguuugaucccuaacccuacacuuuauuggguuuuuauugu

SEQ ID NO: 270893 - RNA, 64 nt, Homo Sapiens
aauugacacaaaucucauauaccaccuuagugaguaacccuaaguuauucauugguggaaccaa

SEQ ID NO: 270894 - RNA, 64 nt, Homo Sapiens
acuauauguccuuaguucuuagauaauggaggaguaacccuacagugucggggaaauaguuugc

SEQ ID NO: 270895 - RNA, 64 nt, Homo Sapiens
auucuuagucaaggaauaaucagaaaaguccacauaacccuagagaacuaagucaggauguuaa

SEQ ID NO: 270896 - RNA, 64 nt, Homo Sapiens
cagcugagaaaggacaacuggguuccgcuuuccuuaacccuacacccuuuagcuggaugcuguc

SEQ ID NO: 270897 - RNA, 64 nt, Homo Sapiens
cucggaauucccugaagcaaagaaaauggaacauuaacccuacaaggaauuuuagaagagguag

SEQ ID NO: 270898 - RNA, 64 nt, Homo Sapiens
uaagaguaaaugagaaauauguuuaauuaaagcuuaacccuaggggguaggauuaaguagguga

SEQ ID NO: 270899 - RNA, 64 nt, Homo Sapiens
cucaauggaggggucuggggaaagaccccagaaguaacccuaggugccggucagguaucccccc

SEQ ID NO: 270900 - RNA, 64 nt, Homo Sapiens
acucuacuuccucuucagucugugguacuccuccuaacccuaaacccucuaugcucaggggcug

SEQ ID NO: 270901 - RNA, 64 nt, Homo Sapiens
aucaugaggaauggaagaaugaucugaaugaggauaacccuaaaguacuauuauaacuagagua

SEQ ID NO: 270902 - RNA, 64 nt, Homo Sapiens
caaaaugcagugacggaguuaaaauaauuuaauauaacccuaagcugucaagcuuuggggccac

SEQ ID NO: 270903 - RNA, 64 nt, Homo Sapiens
auacccacauguauugagcuaucacuucugguguuaacccuaaauuccuacacccccacaaccc

SEQ ID NO: 270904 - RNA, 64 nt, Homo Sapiens
ugaugagaggcucgcugcuugaaccuugguucccuaacccuaauauugugauuuccugagaauc

SEQ ID NO: 270905 - RNA, 64 nt, Homo Sapiens
cccagaccccaggcuggacaacagggagaagggauaacccuacacauggacgagaugggaaggc

SEQ ID NO: 270906 - RNA, 64 nt, Homo Sapiens
agauccaaccauggauucgagguauuauacuguauaacccuacaaaauacauagaaguauuauu

SEQ ID NO: 270907 - RNA, 64 nt, Homo Sapiens
ggccgccaccugaggugggcuggggcugcuccccuaacccuacuuugcuuccgccacucagcca

SEQ ID NO: 270908 - RNA, 50 nt, Homo Sapiens
uccugaggcccuacaaauaguaacccuaggcucagagacccaauuuuuua

SEQ ID NO: 270909 - RNA, 64 nt, Homo Sapiens
gguaugguggugccuguuggugguguucuugucuuaacccuagauagaaucuaaugaacucaga

SEQ ID NO: 270910 - RNA, 64 nt, Homo Sapiens
gccucccaugcaucuguacuugcuccccuuuaccuaacccuacgugccucaucuucaacuuuag

SEQ ID NO: 270911 - RNA, 64 nt, Homo Sapiens
ccucuagaggaauagaaacaaauuuuuaugagcauaacccuauauaaagacaaaaugaauuucu

SEQ ID NO: 270912 - RNA, 64 nt, Homo Sapiens
uuuuugaagugucucaaaaauauuuuacuaacuguaacccuaaaauugaugucuuuugguuuau

SEQ ID NO: 270913 - RNA, 64 nt, Homo Sapiens
gaggagugguauuugaugcuuucuguggacaauguaacccuaaacacaucauguauuuuaaaug

SEQ ID NO: 270914 - RNA, 64 nt, Homo Sapiens
cgcuuuaugucauuacccauacaaaggccauggauaacccuacccuuucauuucuaugggccaa

SEQ ID NO: 270915 - RNA, 64 nt, Homo Sapiens
gaaguugcuaacuuaaaaaaacucuacuucccaguaacccuaagguguucccuuuuucauaauu

SEQ ID NO: 270916 - RNA, 64 nt, Homo Sapiens
uuuuauaguugccauaucaauucaaacuuugugguaacccuacaauacuauaguauucuauaau

SEQ ID NO: 270917 - RNA, 64 nt, Homo Sapiens
uauacuuuaaaauaauguuauaaaacauuaaaaauaacccuagauuauagagaauauaaaagua

SEQ ID NO: 270918 - RNA, 64 nt, Homo Sapiens
gggcaccucugcugaggucaucuguccuacucuguaacccuagaucuccaaguaagcacaggcu

SEQ ID NO: 270919 - RNA, 64 nt, Homo Sapiens
cacugcucugcgauuuggcaggaaauaaggcgauuaacccuauguguccacaagccucaagccu

SEQ ID NO: 270920 - RNA, 64 nt, Homo Sapiens
uacuuugacuauucuaauguuuaauuacauaugguaacccuaaggccuggggagaaaagcuuuu

SEQ ID NO: 270921 - RNA, 64 nt, Homo Sapiens
gugaaauaacuuaagauaucaaauugugcauuuuuaacccuacagucugcuguuaagggauuuu

SEQ ID NO: 270922 - RNA, 64 nt, Homo Sapiens
guaaagcacuuguugcuuugcugaaaacuaugguuaacccuauauaggugugggaaauuuuugu

SEQ ID NO: 270923 - RNA, 64 nt, Homo Sapiens
ugguuauuucuaaaaucacugucaacaauaaaucuaacccuaguuguaucccuccuuucaguau

SEQ ID NO: 270924 - RNA, 64 nt, Homo Sapiens
uaaauguuaaaaauuguccaaucuggugaaugucuaacccuaaaguuuaaaaauuucugccucc

SEQ ID NO: 270925 - RNA, 64 nt, Homo Sapiens
ggggcauaagcugaucaccgucuaguugggaaaguaacccuacaggguuuguagggacaugauc

SEQ ID NO: 270926 - RNA, 64 nt, Homo Sapiens
uuucuaaucauuguuauuggcucagaguacauucuaacccuacaauauaauuguguuguauagu

SEQ ID NO: 270927 - RNA, 64 nt, Homo Sapiens
gcugcucuaaaaaaugaagugcucaauuuuucuguaacccuaaagagaauucucuguacuuuuu

SEQ ID NO: 270928 - RNA, 64 nt, Homo Sapiens
ccaggcggaccucacccuucgggggaccaugcucuaacccuagugagggggucaguguuuccug

SEQ ID NO: 270929 - RNA, 64 nt, Homo Sapiens
uaguugaccugcacagcuugguuagaccuagauuuaacccuaagguaagaugcugggguauaga

SEQ ID NO: 270930 - RNA, 64 nt, Homo Sapiens
caucacaugcucaaugacuccagggucugcacucuaacccuaggaguuucagggcuaacgacca

SEQ ID NO: 270931 - RNA, 64 nt, Homo Sapiens
uuaccuagcuaauuauuuaauaaaaguugcauuuuaacccuauuauuauuugauuauuuaagac

SEQ ID NO: 270932 - RNA, 64 nt, Homo Sapiens
uuuuuucaauguuugaaauaguucaaacugcagcuaacccuagucaaaacuauuuuuguaaaag

SEQ ID NO: 270933 - RNA, 64 nt, Homo Sapiens
cugucuauaagagaauuauauauuucuaacuauauaacccuaggaauuuagacaaccugaaauu

SEQ ID NO: 270934 - RNA, 64 nt, Homo Sapiens
aauauuuucaacugauaguagguuuauugggauguaacccuaugauaaguugagaaacaucucu

SEQ ID NO: 270935 - RNA, 64 nt, Homo Sapiens
aucagaaaagguguuuguuauuuuaaggaaucccuaacccuacuacuuaaaguaaugaaugacg

SEQ ID NO: 270936 - RNA, 64 nt, Homo Sapiens
auuacuaucuauuuaucuuauaucguagaucugauaacccuaucuaaaagaaagucacacgcua

SEQ ID NO: 270937 - RNA, 64 nt, Homo Sapiens
aggcccuugacauuuugcguuuuaauauuucucuuaacccuauucucagggaagauggaauuua

SEQ ID NO: 270938 - RNA, 64 nt, Homo Sapiens
caugagagauucaagaucagauucuaguguucaguaacccuaugugaaucagaugucuccugga

SEQ ID NO: 270939 - RNA, 64 nt, Homo Sapiens
auuacuucagguagcuacacccaugauguaauuauaacccuacagaaacccauucauauuccca

SEQ ID NO: 270940 - RNA, 64 nt, Homo Sapiens
gaugcaagucauaugggggaugaacucuuacccauaacccuaauacaggucucuccaaagugaa

SEQ ID NO: 270941 - RNA, 64 nt, Homo Sapiens
cugccugggugaaugcugcuuguucucucaccccuaacccuaguaguuccuccacuaacuuucu

SEQ ID NO: 270942 - RNA, 64 nt, Homo Sapiens
guugaccggaagggauuggaggcggcagaaccauuaacccuacacaagaacacuccagcccaaa

SEQ ID NO: 270943 - RNA, 64 nt, Homo Sapiens
ccagcaccacaaagccccccccaauuaaggauucuaacccuaaccucauugaucaaagguaggg

SEQ ID NO: 270944 - RNA, 64 nt, Homo Sapiens
uuaauaaaagaguuaacaucagcaaguacaauguuaacccuaaaucugaaagagaaaucaauga

SEQ ID NO: 270945 - RNA, 64 nt, Homo Sapiens
agggagggcuggggcuggcaccacgcacagugccuaacccuagaaaagccaugucuucagccgc

SEQ ID NO: 270946 - RNA, 64 nt, Homo Sapiens
uggcccuaaccugucugucuccguggaugcauccuaacccuaaggaaaauuccccaggcuguga

SEQ ID NO: 270947 - RNA, 64 nt, Homo Sapiens
ggaagucugggcugggcaugguggcucacgccuguaacccuagcacuuuaggaaaucgaggcga

SEQ ID NO: 270948 - RNA, 64 nt, Homo Sapiens
auuagauguccccuggcccucuguccccucuuaauaacccuagucacagucuccgcagauucuu

SEQ ID NO: 270949 - RNA, 64 nt, Homo Sapiens
caauccagugcuucaguuugaaaauguaaaauucuaacccuaaaguaggguugguugaaauuuc

SEQ ID NO: 270950 - RNA, 64 nt, Homo Sapiens
ucuggaaaaaaaagagaaggggguuuguaguacuuaacccuauuuauuuccguauauuuuaguu

SEQ ID NO: 270951 - RNA, 64 nt, Homo Sapiens
caaaauccuucagaucuggaaaccggcucaguauuaacccuaccuuugguuguccugcccuacc

SEQ ID NO: 270952 - RNA, 64 nt, Homo Sapiens
uugcugucuuaagaauaagaccugagauuaacacuaacccuagaauagaaauguaauagggaga

SEQ ID NO: 270953 - RNA, 64 nt, Homo Sapiens
aggagaaaaaggaauggagcagagccuguaccccuaacccuaacagcuaaaucaaggaccucag

SEQ ID NO: 270954 - RNA, 64 nt, Homo Sapiens
cccccagcccuccccgcagugggaagugaauccuuaacccuaaaauuuuaaggccacggccuug

SEQ ID NO: 270955 - RNA, 64 nt, Homo Sapiens
ucauaaaugggauuuggggugaauccgagacacauaacccuaauaagaaaaugguaaugucugg

SEQ ID NO: 270956 - RNA, 64 nt, Homo Sapiens
gauggugggauuuuuauccaggcccaacagggcuuaacccuauguggguaagaugaaaaacugu

SEQ ID NO: 270957 - RNA, 64 nt, Homo Sapiens
caggucuagacuauuaggugcaauuucaagguucuaacccuauacuguaguauucuuuggggug

SEQ ID NO: 270958 - RNA, 64 nt, Homo Sapiens
uagugaauauggaaaaagguuucagccaaaggccuaacccuauucaacaccagaaaguuuacac

SEQ ID NO: 270959 - RNA, 64 nt, Homo Sapiens
gggguuaguucccacccuuucauuaauuugauuguaacccuauuauuaugaugaucugaaauaa

SEQ ID NO: 270960 - RNA, 64 nt, Homo Sapiens
aauguuaguggcauauuugcuucuaauguuccccuaacccuacaugcauguuuuaugugcacuc

SEQ ID NO: 270961 - RNA, 64 nt, Homo Sapiens
aaaaaacagaaagaaagaaaaagaaaacugcagauaacccuauacauuaauacugguaucucga

SEQ ID NO: 270962 - RNA, 64 nt, Homo Sapiens
gggcuccauucccaauuccugggucaaggugaauuaacccuauguuggagcacuggaaaccguu

SEQ ID NO: 270963 - RNA, 64 nt, Homo Sapiens
gcuguacccuuuaagauauccaucuuuuucuuuuuaacccuaaucuuucacuugaaagauuuua

SEQ ID NO: 270964 - RNA, 64 nt, Homo Sapiens
uccaacucauuuauacuuuuaugucuuacugaucuaacccuaaaacuucuguucaguaagaauc

SEQ ID NO: 270965 - RNA, 64 nt, Homo Sapiens
aucacagcuuugugugugggcugagugcuggccuuaacccuaggcguggaagagaaaaugugag

SEQ ID NO: 270966 - RNA, 64 nt, Homo Sapiens
agaugaacacuacuuuuuuaauuuuuuauuuuuuuaacccuacccuuaacccaugaacacuauu

SEQ ID NO: 270967 - RNA, 64 nt, Homo Sapiens
agucauucaguauucuuuucguagaacauuucauuaacccuauaaaacuggccuaaauggcuau

SEQ ID NO: 270968 - RNA, 64 nt, Homo Sapiens
caagcuuuaggcuggucgcaguggcuuacacuuguaacccuagaacuugggaggcugagguggg

SEQ ID NO: 270969 - RNA, 64 nt, Homo Sapiens
uuuuggaaaacgauuuaauuuauucuaauuagauuaacccuauuaaucuauggauuggguauca

SEQ ID NO: 270970 - RNA, 64 nt, Homo Sapiens
ggcaaauuuaaaaaauaacacaauuucuugccuguaacccuagcacuuugggaggccgaggcag

SEQ ID NO: 270971 - RNA, 64 nt, Homo Sapiens
gaguaacugauuuguaacaagccuccuuuuaaaguaacccuacaaaaccacuggaaaguuuaug

SEQ ID NO: 270972 - RNA, 64 nt, Homo Sapiens
cgguuaagcccacccccuguuaacugccuauuuauaacccuaggauccuccuuauggagaacua

SEQ ID NO: 270973 - RNA, 64 nt, Homo Sapiens
aucacccaccucauugauccacugaccaaauccuuaacccuagcgauggcuugggagauggggg

SEQ ID NO: 270974 - RNA, 64 nt, Homo Sapiens
acuuugggaggcugaggcggguggcucaugccuguaacccuagcuuaguucagggcugggcgcg

SEQ ID NO: 270975 - RNA, 64 nt, Homo Sapiens; identical to SEQ ID NO: 184094

SEQ ID NO: 270976 - RNA, 64 nt, Homo Sapiens; identical to SEQ ID NO: 184095

SEQ ID NO: 270977 - RNA, 64 nt, Homo Sapiens; identical to SEQ ID NO: 184096

SEQ ID NO: 270978 - RNA, 64 nt, Homo Sapiens; identical to SEQ ID NO: 184097

SEQ ID NO: 270979 - RNA, 64 nt, Homo Sapiens; identical to SEQ ID NO: 184098

SEQ ID NO: 270980 - RNA, 64 nt, Homo Sapiens; identical to SEQ ID NO: 184099

SEQ ID NO: 270981 - RNA, 64 nt, Homo Sapiens; identical to SEQ ID NO: 184100

SEQ ID NO: 270982 - RNA, 64 nt, Homo Sapiens; identical to SEQ ID NO: 184101

SEQ ID NO: 270983 - RNA, 64 nt, Homo Sapiens; identical to SEQ ID NO: 184102

SEQ ID NO: 270984 - RNA, 64 nt, Homo Sapiens; identical to SEQ ID NO: 184103

SEQ ID NO: 270985 - RNA, 64 nt, Homo Sapiens; identical to SEQ ID NO: 184104

SEQ ID NO: 270986 - RNA, 64 nt, Homo Sapiens; identical to SEQ ID NO: 184105

SEQ ID NO: 270987 - RNA, 64 nt, Homo Sapiens; identical to SEQ ID NO: 184106

SEQ ID NO: 270988 - RNA, 64 nt, Homo Sapiens; identical to SEQ ID NO: 184107

SEQ ID NO: 270989 - RNA, 64 nt, Homo Sapiens; identical to SEQ ID NO: 184108

SEQ ID NO: 270990 - RNA, 64 nt, Homo Sapiens; identical to SEQ ID NO: 184109

SEQ ID NO: 270991 - RNA, 64 nt, Homo Sapiens; identical to SEQ ID NO: 184110

SEQ ID NO: 270992 - RNA, 64 nt, Homo Sapiens; identical to SEQ ID NO: 184111

SEQ ID NO: 270993 - RNA, 64 nt, Homo Sapiens; identical to SEQ ID NO: 184112

SEQ ID NO: 270994 - RNA, 64 nt, Homo Sapiens; identical to SEQ ID NO: 184113

SEQ ID NO: 270995 - RNA, 64 nt, Homo Sapiens; identical to SEQ ID NO: 184114

SEQ ID NO: 270996 - RNA, 64 nt, Homo Sapiens; identical to SEQ ID NO: 184115

SEQ ID NO: 270997 - RNA, 64 nt, Homo Sapiens; identical to SEQ ID NO: 184116

SEQ ID NO: 270998 - RNA, 64 nt, Homo Sapiens; identical to SEQ ID NO: 184117

SEQ ID NO: 270999 - RNA, 64 nt, Homo Sapiens; identical to SEQ ID NO: 184118

SEQ ID NO: 271000 - RNA, 64 nt, Homo Sapiens; identical to SEQ ID NO: 184119

SEQ ID NO: 271001 - RNA, 64 nt, Homo Sapiens; identical to SEQ ID NO: 184120

SEQ ID NO: 271002 - RNA, 64 nt, Homo Sapiens; identical to SEQ ID NO: 184121

SEQ ID NO: 271003 - RNA, 64 nt, Homo Sapiens
ccaggcccgucucuccuguaauugggcuuuagugagaccacagauucucuggaccuaauugggc

SEQ ID NO: 271004 - RNA, 64 nt, Homo Sapiens
gauuuuucuuuucccuuguuuuuucagagaccacagaccacagucccacuuacucuuuuuuuuu

SEQ ID NO: 271005 - RNA, 64 nt, Homo Sapiens
ccacagugauuuuucuuuucuuuuuuuuuuucagagaccacagacacagaucccacuuacucuu

SEQ ID NO: 271006 - RNA, 64 nt, Homo Sapiens
uuguuuuguuuuuuaaaaacacuguaacucaaugagaccacaguauacuuggcccuugguaaaa

SEQ ID NO: 271007 - RNA, 64 nt, Homo Sapiens
uuuuguguguguuuuguuguuauuguugaggggaagaccacaugguucuucccccucagccauc

SEQ ID NO: 271008 - RNA, 64 nt, Homo Sapiens
uagauggaaaugagaggacccuacuugaucuuggagaccacauuggggaagggccagccacuga

SEQ ID NO: 271009 - RNA, 64 nt, Homo Sapiens
gcacagaccccuggcucugauuccucuggauugcagaccacaucugggggguuagggcaagggg

SEQ ID NO: 271010 - RNA, 64 nt, Homo Sapiens
ggcucagacucacuguuaagugaaaggaucucugagaccacagaguauaaaauggucaugggga

SEQ ID NO: 271011 - RNA, 64 nt, Homo Sapiens
cccuuugggaaagcucuuguagcuggcacuguggagaccacacaagccuguuucagaaaucugg

SEQ ID NO: 271012 - RNA, 64 nt, Homo Sapiens
gcacacacaagugcacagaggcacacaggugcacagaccacacagcauaggccacacagcacau

SEQ ID NO: 271013 - RNA, 64 nt, Homo Sapiens
cagcacuaacacaugcacacauacacaagugcacagaccacacaagcucacacacaguauacac

SEQ ID NO: 271014 - RNA, 64 nt, Homo Sapiens
gcacacaugugcacugaccagcacacaugcacacagaccacauaaggcguacacaugcacgcuu

SEQ ID NO: 271015 - RNA, 64 nt, Homo Sapiens
gcuuuauuaauauagucgcucuucagccaugccuuugcugcagcugaaauggaagucagaagug

SEQ ID NO: 271016 - RNA, 64 nt, Homo Sapiens
aacauuguaaacucuuugccaaaauccuggggcuuugcugcauucccuaagauaauuacaggaa

SEQ ID NO: 271017 - RNA, 64 nt, Homo Sapiens
uuuuacuuuuuugcguguggguuguguuguuguuuugcugcacuuguuuccuuugagguugauc

SEQ ID NO: 271018 - RNA, 57 nt, Homo Sapiens
uccggcaaugcccugugcauacaagauuugcugcauuuucuuuuuguagauauuuaa

SEQ ID NO: 271019 - RNA, 64 nt, Homo Sapiens
aggaaaguuuaaucccccaucugccaaaugagguuugcugcagggagguucuagaauagaaggg

SEQ ID NO: 271020 - RNA, 64 nt, Homo Sapiens
aucuguccaguuugacuuuuuuuaagggucccuuuugcugcauuuacauagagaaaaacgaucu

SEQ ID NO: 271021 - RNA, 64 nt, Homo Sapiens
auugguucugaggggcccaagcagugagcccaccuugcugcaacugguggcucugccccuugcu

SEQ ID NO: 271022 - RNA, 64 nt, Homo Sapiens
gagcccaccuugcugcaacagguggcucugccccuugcugcaguugagcagaaggcaccguggu

SEQ ID NO: 271023 - RNA, 64 nt, Homo Sapiens
aaugcuguucagugaagauuucagccccaggccuuugcugcaagugacccuguggcaacagugg

SEQ ID NO: 271024 - RNA, 64 nt, Homo Sapiens
cacacuggagcuacuuggacaagaccagcaugccuugcugcacguguguguauuucacugcuga

SEQ ID NO: 271025 - RNA, 64 nt, Homo Sapiens
ugauuguuguggaaaaucuguaccugucgaauuguugcugcagaaauuauaaaaauaaaaucuu

SEQ ID NO: 271026 - RNA, 64 nt, Homo Sapiens
guauuguaucauaauuacagcaauuccuagugacuugcugcacaccacaaauaggagcagcaug

SEQ ID NO: 271027 - RNA, 64 nt, Homo Sapiens
cauuaugaaaaucuuauuccucagugagguuaucuugcugcacucuguagcaaauuuguuuaau

SEQ ID NO: 271028 - RNA, 64 nt, Homo Sapiens
caaauuuguuuaaucuacauuauaauaaaauuucuugcugcagugcaacaggaggcuuuuucag

SEQ ID NO: 271029 - RNA, 64 nt, Homo Sapiens
agcugcugacuaaucuucaucaccacuguagauuuugcugcaugugcagguccucuauuuuuaa

SEQ ID NO: 271030 - RNA, 64 nt, Homo Sapiens
ugugcagguccucuauuuuuaauugcuguuuucguugcugcaguacuuuacaaacuucuaguuc

SEQ ID NO: 271031 - RNA, 64 nt, Homo Sapiens
caggccgcccaggucuucacagccucaggagagcuugcugcaccccuucuugcugcauguacuc

SEQ ID NO: 271032 - RNA, 64 nt, Homo Sapiens
uacucagccucaggagagcugugugccggccuucuugcugcaugucagaagacgaugcggggcu

SEQ ID NO: 271033 - RNA, 64 nt, Homo Sapiens
uuugcucuugccaaaggucagugagugagugcauuugcugcagugguggcacguagagaacuag

SEQ ID NO: 271034 - RNA, 64 nt, Homo Sapiens
uuuuuguaauauuuguaaauaugaacuuuuuaaauugcugcaaagaugguuucuuuuguaagau

SEQ ID NO: 271035 - RNA, 64 nt, Homo Sapiens
uuuauaaggacuuccugauugaaacucuaaguguuugcugcaauuaggguucccacgaagcucc

SEQ ID NO: 271036 - RNA, 64 nt, Homo Sapiens
uacuacugaccagacaagcuuccuucaacaaggcuugcugcagaugcacuuuucuaaacuaggc

SEQ ID NO: 271037 - RNA, 64 nt, Homo Sapiens
aaccaagcuguaucuucgccauugcaucuacucuuugcugcacacacugugcuugcuccuggcu

SEQ ID NO: 271038 - RNA, 64 nt, Homo Sapiens
uauguuaugaugauuauuaauaauguuaaugauauugcugcaaauggugccauauauaagguua

SEQ ID NO: 271039 - RNA, 64 nt, Homo Sapiens
cucagcacugccgcucaacagacaugacucagggauggcuuaguacugccccucagcagggaug

SEQ ID NO: 271040 - RNA, 64 nt, Homo Sapiens
cucagcacugccgcucaacagggaugacucagggauggcuuaguacugccccucaacagggaug

SEQ ID NO: 271041 - RNA, 64 nt, Homo Sapiens; identical to SEQ ID NO: 271039

SEQ ID NO: 271042 - RNA, 64 nt, Homo Sapiens; identical to SEQ ID NO: 271039

SEQ ID NO: 271043 - RNA, 64 nt, Homo Sapiens
ggggaucauuuuagagaguggagaugugcaguagcaaggagaggcuguccuccuggacccaucu

SEQ ID NO: 271044 - RNA, 64 nt, Homo Sapiens
uaaagaggaaagcaccucuuaaagacagacuccucaaggagagagacccagaaagcucuuuuga

SEQ ID NO: 271045 - RNA, 64 nt, Homo Sapiens
aacaaaguauagaaacauguucauugcacacacccaaggagaagagcucaagcgcuuggaagag

SEQ ID NO: 271046 - RNA, 64 nt, Homo Sapiens
agcugucuccaccuccaggauguccagcaggcugcaaggagaaggaugccagccacccauccuc

SEQ ID NO: 271047 - RNA, 64 nt, Homo Sapiens
uuuuaucauuaggaaacaaacuuuccaagcaaggcaaggagacugcaaggagacuuucucucau

SEQ ID NO: 271048 - RNA, 64 nt, Homo Sapiens
uucucucaucuuuccaagcacuguccaaacaaggcaaggagacuaggaggaucucaucucucau

SEQ ID NO: 271049 - RNA, 64 nt, Homo Sapiens
aagauuaggaugugaaagguuguccuaaacagaccaaggagacuguucccuaauuuauucucuu

SEQ ID NO: 271050 - RNA, 64 nt, Homo Sapiens
uguugaaaaaaaauuuuuuuuuuuuggacagcuucaaggagauguuagcaauuucagauauacu

SEQ ID NO: 271051 - RNA, 64 nt, Homo Sapiens
gaccuuaggauaugacuaacucaccaaacaaugccaaggagaaaggcggacaggucaccaucac

SEQ ID NO: 271052 - RNA, 64 nt, Homo Sapiens
gucugaaaguguaggaggaaggaagagauacaaacaaggagaggaaaugaugggagaguguugu

SEQ ID NO: 271053 - RNA, 64 nt, Homo Sapiens
ggagcaaaugguuuugggcaucuccuucccuuaccaaggagagguccuuucccuucucuccagu

SEQ ID NO: 271054 - RNA, 64 nt, Homo Sapiens
cucuccccggucuucugcugcuucagacuccguccaaggagaugacuucuuuaucuuuuccuuu

SEQ ID NO: 271055 - RNA, 64 nt, Homo Sapiens
aggagugcaucccauauaggccauuuuagaaggccaaggagagccacaccgaaaaaggagacag

SEQ ID NO: 271056 - RNA, 64 nt, Homo Sapiens
aauauuggcaagaagguccccaggauagaccuagcaaggagauaagaauagaucauuaaaaaau

SEQ ID NO: 271057 - RNA, 64 nt, Homo Sapiens
guucucuaccaagcuauccuggcucuuuggagaucaaggagaggaggcaacuuuccuuguuccc

SEQ ID NO: 271058 - RNA, 64 nt, Homo Sapiens
gucucuggccuguuuuagaagguucucuccuccccaaggagacacaacaacuccuagggccacu

SEQ ID NO: 271059 - RNA, 64 nt, Homo Sapiens
agcugcuuccccacgagcagcaggcaacggcguccaaggagacuaggaugaguucuuggcaagg

SEQ ID NO: 271060 - RNA, 64 nt, Homo Sapiens
uuccaaaauuagcaucucauugagccagagaagacaaggagaucucccucugggcaucuggcuu

SEQ ID NO: 271061 - RNA, 64 nt, Homo Sapiens
gagcugacugcaugaugaguuuggagugagaaaucaaggagacauucucuauggcucaccuuau

SEQ ID NO: 271062 - RNA, 64 nt, Homo Sapiens
ccacaaggaauaugggugggcaggccuucaagggcaaggagaggcagagggcaacaggaagaug

SEQ ID NO: 271063 - RNA, 64 nt, Homo Sapiens
ugggugagccugaagaugguagcaugccacugagcaaggagagaaaaagcucccacccugggac

SEQ ID NO: 271064 - RNA, 64 nt, Homo Sapiens
acugguggcccuguguuccaacccugccugacuccaaggagaagcucaggagcucugagguggc

SEQ ID NO: 271065 - RNA, 64 nt, Homo Sapiens
cugauaaaauuuacaauagccacgcaauagccaucaaggagaauuucuauuaugauuauaaauu

SEQ ID NO: 271066 - RNA, 64 nt, Homo Sapiens
cuucuuaacaccuccaccagggggaaggcuggcacaaggagaaaaaaaaagcaagcaucagcga

SEQ ID NO: 271067 - RNA, 64 nt, Homo Sapiens
ccgggagcccagugccagccagagguugugcaggcaaggagaccaaagauugaugagaagaccc

SEQ ID NO: 271068 - RNA, 64 nt, Homo Sapiens
uguacagggccaccagacuccuggagagaucaagcaaggagaaccuggggcugccauggccaaa

SEQ ID NO: 271069 - RNA, 64 nt, Homo Sapiens; identical to SEQ ID NO: 147194

SEQ ID NO: 271070 - RNA, 64 nt, Homo Sapiens; identical to SEQ ID NO: 147195

SEQ ID NO: 271071 - RNA, 64 nt, Homo Sapiens; identical to SEQ ID NO: 147196

SEQ ID NO: 271072 - RNA, 64 nt, Homo Sapiens; identical to SEQ ID NO: 147197

SEQ ID NO: 271073 - RNA, 64 nt, Homo Sapiens; identical to SEQ ID NO: 147198

SEQ ID NO: 271074 - RNA, 64 nt, Homo Sapiens; identical to SEQ ID NO: 147199

SEQ ID NO: 271075 - RNA, 64 nt, Homo Sapiens; identical to SEQ ID NO: 147200

SEQ ID NO: 271076 - RNA, 64 nt, Homo Sapiens; identical to SEQ ID NO: 147201

SEQ ID NO: 271077 - RNA, 64 nt, Homo Sapiens; identical to SEQ ID NO: 147202

SEQ ID NO: 271078 - RNA, 64 nt, Homo Sapiens; identical to SEQ ID NO: 147203

SEQ ID NO: 271079 - RNA, 64 nt, Homo Sapiens; identical to SEQ ID NO: 147204

SEQ ID NO: 271080 - RNA, 64 nt, Homo Sapiens; identical to SEQ ID NO: 147205

SEQ ID NO: 271081 - RNA, 64 nt, Homo Sapiens; identical to SEQ ID NO: 147206

SEQ ID NO: 271082 - RNA, 64 nt, Homo Sapiens; identical to SEQ ID NO: 147207

SEQ ID NO: 271083 - RNA, 64 nt, Homo Sapiens; identical to SEQ ID NO: 147208

SEQ ID NO: 271084 - RNA, 64 nt, Homo Sapiens; identical to SEQ ID NO: 147209

SEQ ID NO: 271085 - RNA, 64 nt, Homo Sapiens; identical to SEQ ID NO: 147210

SEQ ID NO: 271086 - RNA, 64 nt, Homo Sapiens; identical to SEQ ID NO: 147211

SEQ ID NO: 271087 - RNA, 64 nt, Homo Sapiens; identical to SEQ ID NO: 147212

SEQ ID NO: 271088 - RNA, 64 nt, Homo Sapiens; identical to SEQ ID NO: 147213

SEQ ID NO: 271089 - RNA, 64 nt, Homo Sapiens; identical to SEQ ID NO: 147214

SEQ ID NO: 271090 - RNA, 64 nt, Homo Sapiens; identical to SEQ ID NO: 147215

SEQ ID NO: 271091 - RNA, 64 nt, Homo Sapiens; identical to SEQ ID NO: 147216

SEQ ID NO: 271092 - RNA, 64 nt, Homo Sapiens; identical to SEQ ID NO: 147217

SEQ ID NO: 271093 - RNA, 64 nt, Homo Sapiens; identical to SEQ ID NO: 147218

SEQ ID NO: 271094 - RNA, 64 nt, Homo Sapiens; identical to SEQ ID NO: 147219

SEQ ID NO: 271095 - RNA, 64 nt, Homo Sapiens; identical to SEQ ID NO: 147220

SEQ ID NO: 271096 - RNA, 64 nt, Homo Sapiens; identical to SEQ ID NO: 147221

SEQ ID NO: 271097 - RNA, 64 nt, Homo Sapiens; identical to SEQ ID NO: 147222

SEQ ID NO: 271098 - RNA, 64 nt, Homo Sapiens; identical to SEQ ID NO: 147223

SEQ ID NO: 271099 - RNA, 64 nt, Homo Sapiens; identical to SEQ ID NO: 147224

SEQ ID NO: 271100 - RNA, 64 nt, Homo Sapiens; identical to SEQ ID NO: 147225

SEQ ID NO: 271101 - RNA, 64 nt, Homo Sapiens; identical to SEQ ID NO: 147226

SEQ ID NO: 271102 - RNA, 64 nt, Homo Sapiens; identical to SEQ ID NO: 147227

SEQ ID NO: 271103 - RNA, 64 nt, Homo Sapiens; identical to SEQ ID NO: 147228

SEQ ID NO: 271104 - RNA, 64 nt, Homo Sapiens; identical to SEQ ID NO: 147229

SEQ ID NO: 271105 - RNA, 64 nt, Homo Sapiens; identical to SEQ ID NO: 147230

SEQ ID NO: 271106 - RNA, 64 nt, Homo Sapiens; identical to SEQ ID NO: 147231

SEQ ID NO: 271107 - RNA, 64 nt, Homo Sapiens; identical to SEQ ID NO: 147232

SEQ ID NO: 271108 - RNA, 64 nt, Homo Sapiens; identical to SEQ ID NO: 147233

SEQ ID NO: 271109 - RNA, 64 nt, Homo Sapiens; identical to SEQ ID NO: 147234

SEQ ID NO: 271110 - RNA, 64 nt, Homo Sapiens; identical to SEQ ID NO: 147235

SEQ ID NO: 271111 - RNA, 64 nt, Homo Sapiens; identical to SEQ ID NO: 147236

SEQ ID NO: 271112 - RNA, 64 nt, Homo Sapiens; identical to SEQ ID NO: 147237

SEQ ID NO: 271113 - RNA, 64 nt, Homo Sapiens; identical to SEQ ID NO: 147238

SEQ ID NO: 271114 - RNA, 64 nt, Homo Sapiens; identical to SEQ ID NO: 147239

SEQ ID NO: 271115 - RNA, 64 nt, Homo Sapiens; identical to SEQ ID NO: 147240

SEQ ID NO: 271116 - RNA, 64 nt, Homo Sapiens; identical to SEQ ID NO: 147241

SEQ ID NO: 271117 - RNA, 64 nt, Homo Sapiens; identical to SEQ ID NO: 147242

SEQ ID NO: 271118 - RNA, 64 nt, Homo Sapiens; identical to SEQ ID NO: 147243

SEQ ID NO: 271119 - RNA, 64 nt, Homo Sapiens; identical to SEQ ID NO: 147244

SEQ ID NO: 271120 - RNA, 64 nt, Homo Sapiens; identical to SEQ ID NO: 147245

SEQ ID NO: 271121 - RNA, 64 nt, Homo Sapiens; identical to SEQ ID NO: 147246

SEQ ID NO: 271122 - RNA, 64 nt, Homo Sapiens; identical to SEQ ID NO: 147247

SEQ ID NO: 271123 - RNA, 64 nt, Homo Sapiens; identical to SEQ ID NO: 147248

SEQ ID NO: 271124 - RNA, 64 nt, Homo Sapiens; identical to SEQ ID NO: 147249

SEQ ID NO: 271125 - RNA, 64 nt, Homo Sapiens; identical to SEQ ID NO: 147250

SEQ ID NO: 271126 - RNA, 64 nt, Homo Sapiens; identical to SEQ ID NO: 147251

SEQ ID NO: 271127 - RNA, 64 nt, Homo Sapiens; identical to SEQ ID NO: 147252

SEQ ID NO: 271128 - RNA, 64 nt, Homo Sapiens; identical to SEQ ID NO: 147253

SEQ ID NO: 271129 - RNA, 64 nt, Homo Sapiens; identical to SEQ ID NO: 147254

SEQ ID NO: 271130 - RNA, 64 nt, Homo Sapiens; identical to SEQ ID NO: 147255

SEQ ID NO: 271131 - RNA, 64 nt, Homo Sapiens; identical to SEQ ID NO: 147256

SEQ ID NO: 271132 - RNA, 64 nt, Homo Sapiens; identical to SEQ ID NO: 147257

SEQ ID NO: 271133 - RNA, 64 nt, Homo Sapiens; identical to SEQ ID NO: 147258

SEQ ID NO: 271134 - RNA, 64 nt, Homo Sapiens; identical to SEQ ID NO: 147259

SEQ ID NO: 271135 - RNA, 64 nt, Homo Sapiens; identical to SEQ ID NO: 147260

SEQ ID NO: 271136 - RNA, 64 nt, Homo Sapiens; identical to SEQ ID NO: 147261

SEQ ID NO: 271137 - RNA, 64 nt, Homo Sapiens; identical to SEQ ID NO: 147262

SEQ ID NO: 271138 - RNA, 64 nt, Homo Sapiens; identical to SEQ ID NO: 147263

SEQ ID NO: 271139 - RNA, 64 nt, Homo Sapiens; identical to SEQ ID NO: 147264

SEQ ID NO: 271140 - RNA, 64 nt, Homo Sapiens; identical to SEQ ID NO: 147265

SEQ ID NO: 271141 - RNA, 64 nt, Homo Sapiens; identical to SEQ ID NO: 147266

SEQ ID NO: 271142 - RNA, 64 nt, Homo Sapiens
ucuaaaauguauuuuagacuuccuguagggggcgauauacuaaauguauauaguacauuuauac

SEQ ID NO: 271143 - RNA, 64 nt, Homo Sapiens
uacauuuauacuaaauguauuccuguagggggcgauauacuaaauguauuuuagacuuccugua

SEQ ID NO: 271144 - RNA, 64 nt, Homo Sapiens
uauaguuuaauuaucggcaccucauuuuuguuuaauauacuaccuuucacauaauugcuaaaaa

SEQ ID NO: 271145 - RNA, 64 nt, Homo Sapiens
auauaccacuuaagcauugauccagaaauguaauauauacuaaauugaaugcaaugagagauug

SEQ ID NO: 271146 - RNA, 64 nt, Homo Sapiens
gcauuucgguuuuauccuuuauuauggucacacuauauacuauagcuaauucucuucuucugaa

SEQ ID NO: 271147 - RNA, 64 nt, Homo Sapiens
ugugcuuagaaauaauauguugaacuauuuugcaauauacuauuuuaaaucuaaauucugucac

SEQ ID NO: 271148 - RNA, 64 nt, Homo Sapiens
uucucuuuauauuuagaugaggaugauugaguccauauacuauguauguuuacauauacuauac

SEQ ID NO: 271149 - RNA, 64 nt, Homo Sapiens
aggaugauugaguccauauacuauguauguuuacauauacuauacaugcacauuagguguuuuc

SEQ ID NO: 271150 - RNA, 64 nt, Homo Sapiens
aauucaguugugauuuuuaacaugugucagauauauauacuaacacgucuaauauauacuauuu

SEQ ID NO: 271151 - RNA, 64 nt, Homo Sapiens
acaugugucagauauauauacuaacacgucuaauauauacuauuuuauugguuuauuuugaaaa

SEQ ID NO: 271152 - RNA, 64 nt, Homo Sapiens
uauaccuaauuuuuaguuuuuaaacuauuuuaaaauauacuaugauuuuauauguauauuuccu

SEQ ID NO: 271153 - RNA, 64 nt, Homo Sapiens
aacuaugaggaaaacuuauauuagaacuuuugauauauacuaaaauacugauuaucuuaaucac

SEQ ID NO: 271154 - RNA, 64 nt, Homo Sapiens
cuggccaugccaauaaguuuauacuaaugagaaaauauacuagcuuuuccuauaauuaguugau

SEQ ID NO: 271155 - RNA, 64 nt, Homo Sapiens
gagaaaauauacuagccuggccuauaauuaguugauauacuaauacuuuagaaacaguacuuuu

SEQ ID NO: 271156 - RNA, 64 nt, Homo Sapiens
uguuuauauuccuuagagaaaauuucacauucuaauauacuaaaaagagauuauuuuccuaugu

SEQ ID NO: 271157 - RNA, 64 nt, Homo Sapiens
aaugugauuaagucaaugaaauuauauaaacuuuauauacuauaauauuauuauaaauuuccuu

SEQ ID NO: 271158 - RNA, 64 nt, Homo Sapiens
auuguaauucagauauuuaauuauuuuuauauggauauacuaggaaaaacuaauacagacuccu

SEQ ID NO: 271159 - RNA, 64 nt, Homo Sapiens
caugaauuucuuuuuccuucgaacauaauucuauauauacuauggaugcuggaaaccagggaua

SEQ ID NO: 271160 - RNA, 64 nt, Homo Sapiens
acugaugaaaugcuaagacaugugucaauauaaaauauacuaaauugaacugauaagcacuuuu

SEQ ID NO: 271161 - RNA, 64 nt, Homo Sapiens
uuuuuccuuuuuuaauucagguuuuauuguugagauauacuauuuagaaauguuucuugugcca

SEQ ID NO: 271162 - RNA, 64 nt, Homo Sapiens
caaagaaaccauugucuuugucuuaauaaauauuauauacuaggauacaaugucuucugucauu

SEQ ID NO: 271163 - RNA, 64 nt, Homo Sapiens
ucugauauuucugcaggauuucaauuugcuugggauauacuauuacaaagccaccugcugauca

SEQ ID NO: 271164 - RNA, 64 nt, Homo Sapiens; identical to SEQ ID NO: 250961

SEQ ID NO: 271165 - RNA, 64 nt, Homo Sapiens; identical to SEQ ID NO: 250962

SEQ ID NO: 271166 - RNA, 64 nt, Homo Sapiens; identical to SEQ ID NO: 250963

SEQ ID NO: 271167 - RNA, 64 nt, Homo Sapiens; identical to SEQ ID NO: 250964

SEQ ID NO: 271168 - RNA, 64 nt, Homo Sapiens; identical to SEQ ID NO: 250965

SEQ ID NO: 271169 - RNA, 64 nt, Homo Sapiens; identical to SEQ ID NO: 250966

SEQ ID NO: 271170 - RNA, 64 nt, Homo Sapiens; identical to SEQ ID NO: 250967

SEQ ID NO: 271171 - RNA, 64 nt, Homo Sapiens; identical to SEQ ID NO: 250968

SEQ ID NO: 271172 - RNA, 64 nt, Homo Sapiens; identical to SEQ ID NO: 250969

SEQ ID NO: 271173 - RNA, 64 nt, Homo Sapiens; identical to SEQ ID NO: 250970

SEQ ID NO: 271174 - RNA, 64 nt, Homo Sapiens; identical to SEQ ID NO: 250971

SEQ ID NO: 271175 - RNA, 64 nt, Homo Sapiens; identical to SEQ ID NO: 250972

SEQ ID NO: 271176 - RNA, 64 nt, Homo Sapiens; identical to SEQ ID NO: 250973

SEQ ID NO: 271177 - RNA, 64 nt, Homo Sapiens; identical to SEQ ID NO: 250974

SEQ ID NO: 271178 - RNA, 64 nt, Homo Sapiens; identical to SEQ ID NO: 250975

SEQ ID NO: 271179 - RNA, 64 nt, Homo Sapiens; identical to SEQ ID NO: 250976

SEQ ID NO: 271180 - RNA, 64 nt, Homo Sapiens; identical to SEQ ID NO: 250977

SEQ ID NO: 271181 - RNA, 64 nt, Homo Sapiens; identical to SEQ ID NO: 250978

SEQ ID NO: 271182 - RNA, 64 nt, Homo Sapiens; identical to SEQ ID NO: 250979

SEQ ID NO: 271183 - RNA, 64 nt, Homo Sapiens; identical to SEQ ID NO: 250980

SEQ ID NO: 271184 - RNA, 64 nt, Homo Sapiens; identical to SEQ ID NO: 250981

SEQ ID NO: 271185 - RNA, 64 nt, Homo Sapiens; identical to SEQ ID NO: 250982

SEQ ID NO: 271186 - RNA, 64 nt, Homo Sapiens; identical to SEQ ID NO: 250983

SEQ ID NO: 271187 - RNA, 64 nt, Homo Sapiens; identical to SEQ ID NO: 250984

SEQ ID NO: 271188 - RNA, 64 nt, Homo Sapiens; identical to SEQ ID NO: 250985

SEQ ID NO: 271189 - RNA, 64 nt, Homo Sapiens; identical to SEQ ID NO: 250986

SEQ ID NO: 271190 - RNA, 64 nt, Homo Sapiens
cuuuaaugaggaaaaaacaaauaauaaauguucucguuuugaaacucaagcaacgcucaucagg

SEQ ID NO: 271191 - RNA, 64 nt, Homo Sapiens
agaaacucaucuauauauucuguaucuggaguuccguuuugaauauuaacuguguuauuuuuau

SEQ ID NO: 271192 - RNA, 64 nt, Homo Sapiens
cugaacaauuuagggacucuuuuaacuugagggucguuuugacuacuagagcuccauuucuacu

SEQ ID NO: 271193 - RNA, 64 nt, Homo Sapiens
uugguuuuaauuuaucaugguuuuuuguuguuuucguuuugaacuuauccuuccucccacaaaa

SEQ ID NO: 271194 - RNA, 64 nt, Homo Sapiens
acagacagucccccgagguagggccuucucagcccguuuugagggugggaccugggccccugac

SEQ ID NO: 271195 - RNA, 64 nt, Homo Sapiens
uaguguuacugugagccugucgaggaaaggaagacguuuugauaacacacugauguaggaagca

SEQ ID NO: 271196 - RNA, 64 nt, Homo Sapiens
uaauaaaagcauaaaugcaauccaugaggccaaacguuuugaacgguuuccacgaugaaaaacu

SEQ ID NO: 271197 - RNA, 64 nt, Homo Sapiens
gugauugcuacauauguuguagaggugcagcuugcguuuugagguguaccagggcuuccucccc

SEQ ID NO: 271198 - RNA, 64 nt, Homo Sapiens
ugggcuuucugcccuuguuggucaggcagaaagacguuuugaauggggcuauuuggggccugcu

SEQ ID NO: 271199 - RNA, 64 nt, Homo Sapiens
auuuuguuccuaguuuuauaacauuaccauccuucguuuugaacuacagauguuguaguggguu

SEQ ID NO: 271200 - RNA, 64 nt, Homo Sapiens
gcugaagcaaggugcuugcaccaugcucagaaugcguuuugagaugugcuauugguugcagcug

SEQ ID NO: 271201 - RNA, 64 nt, Homo Sapiens
uaucgcugguuuauuuaacuaagugaagagaccucguuuugauguuguuucccagaagcucuaa

SEQ ID NO: 271202 - RNA, 64 nt, Homo Sapiens
guuggcaauuugggaugccugcuccugccacuggcguuuugagugacugggugaaagaggagua

SEQ ID NO: 271203 - RNA, 64 nt, Homo Sapiens
uuuuguuuuuuucuuauuuagacauccgugacaccguuuugacuuacgccacaaaagugcucuu

SEQ ID NO: 271204 - RNA, 64 nt, Homo Sapiens
cuucccacauccuugaaagaaaaacuguggcuuacguuuugaaguauucugagaaugaaguauu

SEQ ID NO: 271205 - RNA, 64 nt, Homo Sapiens
acucugaaauguguuaacucgaggauuuucacuacguuuugacauccauuuguuguacagucug

SEQ ID NO: 271206 - RNA, 64 nt, Homo Sapiens
gcaguuuuguaaagggcaaguaccgacguuuccucguuuugaaacagacgaccuuuuguuuucc

SEQ ID NO: 271207 - RNA, 64 nt, Homo Sapiens
agacauucccagaucauucuacuaaauuuacuaccguuuugaacuaaaugaaauuguguuuaag

SEQ ID NO: 271208 - RNA, 64 nt, Homo Sapiens
ccgucuugguggacaccuguguggcucucaccugcguuuugagucuguucuuccaggaguaaua

SEQ ID NO: 271209 - RNA, 64 nt, Homo Sapiens
caaaagcagugggucucaacaagguauaaacuuucguuuugacuuuccccaaggaagcagaguc

SEQ ID NO: 271210 - RNA, 64 nt, Homo Sapiens
uagagugaaugcauuuucccgagagcaagagauucguuuugacaaagcuggauuaucuccuguu

SEQ ID NO: 271211 - RNA, 64 nt, Homo Sapiens
ugguguugcaauuggcucuuucuaaaucaugugacguuuugacuggcuugagauucagaugcau

SEQ ID NO: 271212 - RNA, 53 nt, Homo Sapiens
auugaugcaccauugccacucuacguuuugagacaacucguguuggaucauaa

SEQ ID NO: 271213 - RNA, 64 nt, Homo Sapiens
uuaucaaaaucaccuaauuuuuaaaaauagcuuucguuuugaguucuggaaagaaaacugucaa

SEQ ID NO: 271214 - RNA, 64 nt, Homo Sapiens
uuugcauuguacgguuuuggaccuauauuguucacguuuugauggcggagaggggugguccugg

SEQ ID NO: 271215 - RNA, 64 nt, Homo Sapiens
gugaaucuuugguuuucucccuccugaaacaccucguuuugaaguagaauguuaugcuuugggg

SEQ ID NO: 271216 - RNA, 64 nt, Homo Sapiens
uugcagugaaguacacugcuauaaucccugcacacguuuugaacuuaggugcaaaggaugucua

SEQ ID NO: 271217 - RNA, 64 nt, Homo Sapiens
gguuauugggucccuuccuccaggcagcaguuugcguuuugaaaaagacccugggcccucaccg

SEQ ID NO: 271218 - RNA, 64 nt, Homo Sapiens
agaugcgagacauguuugauccaucacacaccagcguuuugaccgcugcccgccacagggguac

SEQ ID NO: 271219 - RNA, 64 nt, Homo Sapiens
agcagcaguuugaagggccagcagaaucauuucacguuuugaacagacaucaagaauggauuca

SEQ ID NO: 271220 - RNA, 64 nt, Homo Sapiens
acgugcaugcaaacagcgauaaaugucuuuugcccguuuugauuccccagaaaacuugaugaag

SEQ ID NO: 271221 - RNA, 64 nt, Homo Sapiens
uccccuuuauuuauuuguugcuuauugccccuuccguuuugacuaguuagauucccccuuucuc

SEQ ID NO: 271222 - RNA, 64 nt, Homo Sapiens
aguuucuuuucaggaaacauaaaaaggcuucaaacguuuugaucugucacacuuugaggcaacu

SEQ ID NO: 271223 - RNA, 64 nt, Homo Sapiens
cuggaugggugguggccaggugacauuuucugugcguuuugacccugaggcaucugaggagagg

SEQ ID NO: 271224 - RNA, 64 nt, Homo Sapiens
uccuuugaaauggcuggacucagagaguuggagucguuuugagaugagcauuagccccagcuuu

SEQ ID NO: 271225 - RNA, 64 nt, Homo Sapiens
gaaccugcauauauaccagugaacuaggaaucaccguuuugagauuuaaagaggucuuauaaug

SEQ ID NO: 271226 - RNA, 56 nt, Homo Sapiens
agcuugagcuggguccccagcugccacguuuugaagcaaagucuugugaccuguag

SEQ ID NO: 271227 - RNA, 64 nt, Homo Sapiens
gacuaauggaggcuuauugucuuauuuauaucaucguuuugaggucuaugcuagguuguacaga

SEQ ID NO: 271228 - RNA, 64 nt, Homo Sapiens
uaugagcaaaguuuugcuggcugagucuuggcuccguuuugagguuugauuuguguguauuagu

SEQ ID NO: 271229 - RNA, 64 nt, Homo Sapiens
aaaacuucuccuaaggcauucauguagaggaccacguuuugaccgaaugauuucuucuagagcu

SEQ ID NO: 271230 - RNA, 64 nt, Homo Sapiens
uuuggaaacacaucaaaauaguuguguuugaaaacguuuugauuaugcuguauuuuauaucuua

SEQ ID NO: 271231 - RNA, 64 nt, Homo Sapiens
aguauguuugauguggauuaccuauacuuauguucguuuugauacauuuuuagcuucucauuau

SEQ ID NO: 271232 - RNA, 64 nt, Homo Sapiens
ucuggucuccucggccacuuucagugcgucgguucguuuugauucuuuuucuuuugugcacaua

SEQ ID NO: 271233 - RNA, 64 nt, Homo Sapiens
aaaggagaaacaauaaagggucccagcugugacacguuuugaucuuuuuuuacuuccucuuggu

SEQ ID NO: 271234 - RNA, 64 nt, Homo Sapiens
auuucgugccuuuuuuuuuuguagacuccucccacguuuugaauaugugugacuggguggccug

SEQ ID NO: 271235 - RNA, 64 nt, Homo Sapiens
auauauguuguuauuuugauuuauuugagguuuucguuuugaauagaauguauaguggcuuagg

SEQ ID NO: 271236 - RNA, 64 nt, Homo Sapiens
agguaugggcugggggcuauguauagucuguauacguuuugaggagaaauuugauaaugacacu

SEQ ID NO: 271237 - RNA, 64 nt, Homo Sapiens
cucaaauuaagcauauguguuacuucaaguaauacguuuugacauaagaugguugaccaaggug

SEQ ID NO: 271238 - RNA, 64 nt, Homo Sapiens
ugagaaacggacucugauaaaagucuucgggauccguuuugacauccugguuuuuggcaccgua

SEQ ID NO: 271239 - RNA, 64 nt, Homo Sapiens
cugaucucaaggagaaacagacacagaccuggcccguuuugaggcaaacacauucggcggcugg

SEQ ID NO: 271240 - RNA, 64 nt, Homo Sapiens
auguauuuguacacuaucugucugaggauugauacguuuugaguuaccuauuucacaagguugu

SEQ ID NO: 271241 - RNA, 64 nt, Homo Sapiens
auuguugaaccaauuuuguuguucauagucguuucguuuugauaguuaagaaguucuagucagu

SEQ ID NO: 271242 - RNA, 54 nt, Homo Sapiens
cugccuagucgggacuuguaaugucguuuugacacaaagcaagcaaagaaauag

SEQ ID NO: 271243 - RNA, 64 nt, Homo Sapiens
augucgagcaguuuacugugcaggggcuugcugucguuuugagcagaucacgcuguguagcuga

SEQ ID NO: 271244 - RNA, 64 nt, Homo Sapiens
cugcugauuucuuuuucagagauaacaaugguuucguuuugaccaaacuuguauuaggacagaa

SEQ ID NO: 271245 - RNA, 64 nt, Homo Sapiens
cacggagguggaggaguaacuucggaaccuguugcguuuugaccaguuggcguuugcuuugcac

SEQ ID NO: 271246 - RNA, 64 nt, Homo Sapiens
uuuaaaaacuacaguuuccaugauaaaaggaaaacguuuugauuuauaguaccaagugcuuaaa

SEQ ID NO: 271247 - RNA, 64 nt, Homo Sapiens
acuuugcagccuuuuuucccccuggucccucucccguuuugauuuugugagagcguaggucauc

SEQ ID NO: 271248 - RNA, 64 nt, Homo Sapiens
uuuuguccaucagauucugugagacaccaggcaucguuuugaggauguggguuauacacaugga

SEQ ID NO: 271249 - RNA, 64 nt, Homo Sapiens
uucuaaacuaagaagccgcauaggaugugacuugcguuuugaguagaggggaaggcugauaacg

SEQ ID NO: 271250 - RNA, 64 nt, Homo Sapiens
acuugcaucauuacccuaaaaauaggcuguuaugcguuuugacaauugcgcuauccuacacucu

SEQ ID NO: 271251 - RNA, 64 nt, Homo Sapiens
auguggcuguccuuuuccacugaagaaggaaagacguuuugaucuagaaauagcguugugauuu

SEQ ID NO: 271252 - RNA, 64 nt, Homo Sapiens
aauuguuguuagagcaaaaguuuuguuguugauucguuuugaaaaaaagaaacacuggauacuu

SEQ ID NO: 271253 - RNA, 64 nt, Homo Sapiens
ggcugcgacgagcaauggaagagaacauuuaguucguuuugaaagaugaaggaacaaagguuga

SEQ ID NO: 271254 - RNA, 64 nt, Homo Sapiens
ugaagugauccucucgucuccacugcagccucaacguuuugagccuugcucugucucccaggcu

SEQ ID NO: 271255 - RNA, 64 nt, Homo Sapiens
gguuaucaguuuauauuaaauauacugaguugcccguuuugaaaaugcacuuugaauaaucuca

SEQ ID NO: 271256 - RNA, 64 nt, Homo Sapiens
ugggugcucagggcccugccccaggccacugggccguuuugaugaccucgaaggucacaggcag

SEQ ID NO: 271257 - RNA, 64 nt, Homo Sapiens
uuuuccagugacuugcaauccaggcuguucucagcguuuugaguuuaaaaccugggauccugac

SEQ ID NO: 271258 - RNA, 64 nt, Homo Sapiens
guauuuauagagagagacuauccuggagaagccucguuuugaugccauucuuccuugcaagguu

SEQ ID NO: 271259 - RNA, 64 nt, Homo Sapiens
cagcauuugcaaaaaaauuggauggggauugguacguuuugaauguauuggcauaggcaugaua

SEQ ID NO: 271260 - RNA, 64 nt, Homo Sapiens
gugacuuaacgccuuuuccggcccuagcuccaggcguuuugaggcgucuggugccugaugguag

SEQ ID NO: 271261 - RNA, 64 nt, Homo Sapiens
uuaaucauuccaaaauuguguccguuuucuugagcguuuugauuuuuuacuuuuagcuuauacc

SEQ ID NO: 271262 - RNA, 64 nt, Homo Sapiens
uaaauguuuccuguugaaaugauaacuaccuucacguuuugaaaguacuuuaaacucauggaag

SEQ ID NO: 271263 - RNA, 64 nt, Homo Sapiens
cuacagaauauccuucccagcucauuuuuuaaaucguuuugagcuauuccaauccucuaaauuc

SEQ ID NO: 271264 - RNA, 64 nt, Homo Sapiens
caagcagggucucccuacuuuuucucacuggccucguuuugacccagagaaagccuauggaagu

SEQ ID NO: 271265 - RNA, 64 nt, Homo Sapiens
ccagugacucgcucaucugcccugcccaggcccacguuuugaaguuggagcaucaggccuccga

SEQ ID NO: 271266 - RNA, 64 nt, Homo Sapiens
gaauuuaaguauuuaaauugguacaaaaugaugucguuuugagguguguacuucaucuauuugu

SEQ ID NO: 271267 - RNA, 64 nt, Homo Sapiens
aacuuacuuucauccuauuuugcaucccucuuaucguuuugagcuaccugccaucuucucuuug

SEQ ID NO: 271268 - RNA, 64 nt, Homo Sapiens
uuaaaaacaucgacgauacauugaaaugugugaacguuuugaaaagcuacagcuuccagcagcc

SEQ ID NO: 271269 - RNA, 64 nt, Homo Sapiens
cauugguuggggucguacggggcugggagcccugcguuuugaggcagaccacugcccuuccgac

SEQ ID NO: 271270 - RNA, 64 nt, Homo Sapiens
uauuuucccugcaagauuagaauggugcucuucacguuuugacggugguuuucaaaauguuguu

SEQ ID NO: 271271 - RNA, 64 nt, Homo Sapiens
auguguaaccgacagucugccccggcccuucccccguuuugaacaccucgcgaagcgcagcagc

SEQ ID NO: 271272 - RNA, 64 nt, Homo Sapiens
aaaauauagaaauuagccugacauggcgaauccucguuuugaccauuugagaacagccuggcua

SEQ ID NO: 271273 - RNA, 64 nt, Homo Sapiens
accugugacggaagcacuucuggaagugaacacucguuuugaaagcuugauuuuguagcuuugg

SEQ ID NO: 271274 - RNA, 64 nt, Homo Sapiens
ucaucuuuauguccccuuuagcacaauauccauccguuuugauuccaucuuuggcucuuuugau

SEQ ID NO: 271275 - RNA, 64 nt, Homo Sapiens
uaucgacugugauuccuuccggguuguaaggugucguuuugagguuuccuguuuguuaauauua

SEQ ID NO: 271276 - RNA, 64 nt, Homo Sapiens
uaagagcagccccgguaacuggaggaaugggagccguuuugaugagaaaaaugggcuggagaga

SEQ ID NO: 271277 - RNA, 64 nt, Homo Sapiens
agagaaagcaucggagccauucauucggagaaaacguuuugaucaaaauggagacuuuuguagu

SEQ ID NO: 271278 - RNA, 64 nt, Homo Sapiens
uccaucugucugauucuuguagcagcaaagcugacguuuugaucccagccaccuccuucugauc

SEQ ID NO: 271279 - RNA, 64 nt, Homo Sapiens
guugcgacacccucccccccacauacacacgcagcguuuugauaaauuauugguuuucaacgau

SEQ ID NO: 271280 - RNA, 52 nt, Homo Sapiens
acauauauaccaagccccuauucguuuugaccggaagccauuaaugaacuaa

SEQ ID NO: 271281 - RNA, 64 nt, Homo Sapiens
acguggacuccucuugguggcuucuuuucguuuucguuuugaagggugccucugugcacagugg

SEQ ID NO: 271282 - RNA, 64 nt, Homo Sapiens
uccuuccuuauuuccuuuaguuuccuuccuuagccguuuugaguggugggaaucaaugcuguuu

SEQ ID NO: 271283 - RNA, 64 nt, Homo Sapiens
agguucuuaaauccucauaucuggaaacuugugacguuuugacaccuuuccuauagaugauaua

SEQ ID NO: 271284 - RNA, 64 nt, Homo Sapiens
acuuugcuuuagucguuccuccugcuaccaguagcguuuugacccaccugccaguguuugcuug

SEQ ID NO: 271285 - RNA, 64 nt, Homo Sapiens
cuugcccuguuuauaguauccauccugaaccauucguuuugacccauaauaauagugauaguau

SEQ ID NO: 271286 - RNA, 64 nt, Homo Sapiens
uaaaaagaguauauucaaaauugaguuauucccacguuuugaaaugguccuggaggcucaaauu

SEQ ID NO: 271287 - RNA, 64 nt, Homo Sapiens
ugccuauguguggacuccuugaguauuuaaagcccguuuugaaaccuuuguguggcacccugau

SEQ ID NO: 271288 - RNA, 64 nt, Homo Sapiens
uuaccuauuucuugugggucaccuuugucguaaacguuuugaugaacuuacacauuuguggugu

SEQ ID NO: 271289 - RNA, 64 nt, Homo Sapiens
ucaauaaauaguaacagcaugucucagcuuguuucguuuugaugcuguuaaauagcaacuuuua

SEQ ID NO: 271290 - RNA, 64 nt, Homo Sapiens
uucaaagaagcagguucuggauuuucaaagaagccguuuugauuccauacaagaagucauuuug

SEQ ID NO: 271291 - RNA, 64 nt, Homo Sapiens
cuacugugugugugaaugaacaaacagaucgaaccguuuugaaguuuacaaaacuacaugagaa

SEQ ID NO: 271292 - RNA, 64 nt, Homo Sapiens
uuuguuauacucuuugcaccuuaaacccccaccacuccccgacacuauugccuucccagcaugg

SEQ ID NO: 271293 - RNA, 64 nt, Homo Sapiens
gcuccugcuguccugggggagagaagguucgccccuccccgaggaagaaggcuucuggucagga

SEQ ID NO: 271294 - RNA, 64 nt, Homo Sapiens
auuagguccuccacggggcuugcugggugaaggccuccccgagcagugucggcauggcucacug

SEQ ID NO: 271295 - RNA, 64 nt, Homo Sapiens
ugccagccagcccgagccagguuucauccaacagcuccccgagcccacagccacacgcauggac

SEQ ID NO: 271296 - RNA, 64 nt, Homo Sapiens
ggcagcagugauccucugaaccugcagaggcccccuccccgagccuggccuggcucuggcccgg

SEQ ID NO: 271297 - RNA, 64 nt, Homo Sapiens
gcccccaugggcuuuacccuucccugcgggcucucuccccgacacauuuguuaaaaucaaaccu

SEQ ID NO: 271298 - RNA, 64 nt, Homo Sapiens
cucccuccgagugagucagugaugaggccgcggccuccccgagguuguggggaggcugcacugg

SEQ ID NO: 271299 - RNA, 64 nt, Homo Sapiens
cugaauugacaugacccucuguccccaggccuggcuccccgagggcucagaagagcagcuucgg

SEQ ID NO: 271300 - RNA, 64 nt, Homo Sapiens
cugcuccgugucuguccuaggacguccccucccgcuccccgaugguggcguggacaugguuauu

SEQ ID NO: 271301 - RNA, 64 nt, Homo Sapiens
ccuuugcuucgugggggccuggcagggccccugccuccccgacccccgacccacugcaaauccc

SEQ ID NO: 271302 - RNA, 64 nt, Homo Sapiens
uggccagccaagcccugccgaucagacaugugggcuccccgaagcccagccagagacugccgug

SEQ ID NO: 271303 - RNA, 64 nt, Homo Sapiens
ugggugccaccaggcccagggacugcagccugagcuccccgaggcccagggcagccgggugagg

SEQ ID NO: 271304 - RNA, 64 nt, Homo Sapiens
ugcagcugccgaaagugucaugcccgaugugcaccuccccgaggcaaggugccugagauggcug

SEQ ID NO: 271305 - RNA, 64 nt, Homo Sapiens
ugcagcugccaaaagucucaugccagagguucgacuccccgagguaaaaugccugagauggcug

SEQ ID NO: 271306 - RNA, 64 nt, Homo Sapiens
agcaugaugcagcgugaggacagcugagcagggaccgggacagcccucaccgcaugcgugugga

SEQ ID NO: 271307 - RNA, 64 nt, Homo Sapiens
accacagcugcgcacacagcugcuugcucaggggccgggacagcacugggugcucaggcuggcc

SEQ ID NO: 271308 - RNA, 64 nt, Homo Sapiens
agaaaggcuuugggccugagagugaagaggaaggccuguguagccuuggcguguaucugguccu

SEQ ID NO: 271309 - RNA, 64 nt, Homo Sapiens
aggaugugggagaggaggguaaggacuuuacacaccuguguaaauggaaauccuuuugcauuaa

SEQ ID NO: 271310 - RNA, 64 nt, Homo Sapiens
aagcuuuaauguuacauaguaaaugguaguguguccuguguaaauuaguguaccuauuaaaagu

SEQ ID NO: 271311 - RNA, 64 nt, Homo Sapiens
ucuaguuuguuuaguuaaggugugcaguguuuuuccuguguauuaaaccuuuccauuuuacguu

SEQ ID NO: 271312 - RNA, 64 nt, Homo Sapiens
aaauacuuggcaaacuccuuugcucugcugucauccuguguacccuugucaauccauggagcug

SEQ ID NO: 271313 - RNA, 64 nt, Homo Sapiens
cuggugggugcccucucuagacugguaucagcagccuguguaaccccuuuccuguaaaaggggu

SEQ ID NO: 271314 - RNA, 64 nt, Homo Sapiens
auuuaaguguacaagguuuugaaaaaucuauacaccuguguaaccaccaccaccuguguaacca

SEQ ID NO: 271315 - RNA, 64 nt, Homo Sapiens
uugaaaaaucuauacaccuguguaaccaccaccaccuguguaaccaccaccgccagaaccaaaa

SEQ ID NO: 271316 - RNA, 64 nt, Homo Sapiens
acguaagugugugagugcagguauuuagaucagaccuguguaucguuguguagaucagaccugu

SEQ ID NO: 271317 - RNA, 64 nt, Homo Sapiens
uagaucagaccuguguaucauuguguagaucagaccuguguauuaaagcgguagcaccacaugg

SEQ ID NO: 271318 - RNA, 64 nt, Homo Sapiens
ccuaauugugguagaaauuuauuuuuuacauuuuccuguguaaauguuaccuuuuaaaauagua

SEQ ID NO: 271319 - RNA, 64 nt, Homo Sapiens
cucauugggguugcaacaauuuuuuuuuuuuguuccuguguauugguuugaacucacacuuuuu

SEQ ID NO: 271320 - RNA, 64 nt, Homo Sapiens
gugacagcugauguuaucagaaaaauccuguuauccuguguauuuacuaguccucaugaucuag

SEQ ID NO: 271321 - RNA, 64 nt, Homo Sapiens
ccuuguccacagccauuuuaaauauccacuuagcccuguguaguugguagguggacaccacuuu

SEQ ID NO: 271322 - RNA, 64 nt, Homo Sapiens
aucugccauuuauuuccucaauguuauauugcuuccuguguaacaauacaguuacuuaaugacc

SEQ ID NO: 271323 - RNA, 64 nt, Homo Sapiens
acuuuuuaaauagggaauauaccacugugcccggccuguguacauguugggauuacagguguga

SEQ ID NO: 271324 - RNA, 64 nt, Homo Sapiens
aauuagguuuuuccuuauuugcuucauuguacuaccuguguauauaguuuuuaccuuuuaugua

SEQ ID NO: 271325 - RNA, 64 nt, Homo Sapiens
aauggauacuacaucuuuaaacaguauuucauugccuguguauggaaaaaccauuugaagugua

SEQ ID NO: 271326 - RNA, 64 nt, Homo Sapiens
auugccuguguauggaaaaaccauuugaaguguaccuguguacauaacucuguaaaaacacuga

SEQ ID NO: 271327 - RNA, 64 nt, Homo Sapiens
acugccuaccugaguagaaucuuauuuaugaacuccuguguauugcaaugguaugaaucugcuc

SEQ ID NO: 271328 - RNA, 64 nt, Homo Sapiens
guugugcaaagcaguuugccuguggauaagaugaccuguguaauaaucuuuguuaguagucuua

SEQ ID NO: 271329 - RNA, 64 nt, Homo Sapiens
uguuuguuguuuuaauuagcugcaauauauacggccuguguacacagaauuuaaucacuucggc

SEQ ID NO: 271330 - RNA, 64 nt, Homo Sapiens
ggaaauccuaaaagaggcggcaagaagguaccucccuguguaacucaccuucccccaugacagu

SEQ ID NO: 271331 - RNA, 64 nt, Homo Sapiens
gugacaccuguaugaaaaugugaugauugaacucccuguguacagcgagugaauuaaaaugucu

SEQ ID NO: 271332 - RNA, 64 nt, Homo Sapiens
uuccacuuaauagacucuaugugugcugaauguuccuguguacauauguguguuaaauaaaaca

SEQ ID NO: 271333 - RNA, 64 nt, Homo Sapiens
cccagggaccuggaaacagugcuggggaguucugccuguguauacuuggccgugggcaugagac

SEQ ID NO: 271334 - RNA, 64 nt, Homo Sapiens
ggacuggugggcggggcuccccagccaucaccauccuguguacaauggcuguagacuuguauau

SEQ ID NO: 271335 - RNA, 64 nt, Homo Sapiens
cagauugugagugaaguucccauggggaguagacccuguguacacauguuaccccagagagaca

SEQ ID NO: 271336 - RNA, 59 nt, Homo Sapiens
caggggucaugaacaagacccgggagaaaccuguguauggacaccagaggacacacuga

SEQ ID NO: 271337 - RNA, 64 nt, Homo Sapiens
uuugaaguggcagacaaggcacaaaaccuuuucuccuguguauccuaauuguguuugguuucag

SEQ ID NO: 271338 - RNA, 64 nt, Homo Sapiens
uuugaaguggcagauaagguauuaacccuuuucuccuguguaucuguguuugauuucagacaaa

SEQ ID NO: 271339 - RNA, 64 nt, Homo Sapiens
caggcugcccccuguuccaggaagcucauccucaccuguguaggccccuguagugacccacgcg

SEQ ID NO: 271340 - RNA, 64 nt, Homo Sapiens
gcugucccgcgucaugagcaccaccucugcuuucccuguguagaucuaggccaguggcugcuug

SEQ ID NO: 271341 - RNA, 64 nt, Homo Sapiens
uagagaagcuaccccucaaacugcacaucuacacacaaacaaacaaugcauaggauuccaaggc

SEQ ID NO: 271342 - RNA, 64 nt, Homo Sapiens
gaagcuaccccucaaacugcacaucuacacacaaacaaacaaugcauaggauuccaaggcuuua

SEQ ID NO: 271343 - RNA, 64 nt, Homo Sapiens
gcgacacagugagacucugucucaaaaaaacaaaacaaacaaacaaaaauacaaaaaauuagcc

SEQ ID NO: 271344 - RNA, 64 nt, Homo Sapiens
cacagugagacucugucucaaaaaaacaaaacaaacaaacaaaaauacaaaaaauuagccgggc

SEQ ID NO: 271345 - RNA, 64 nt, Homo Sapiens
acuccggccuaggcaacgagagcaaaacuccaauacaaacaaacaaacaaacaccugugcuagg

SEQ ID NO: 271346 - RNA, 64 nt, Homo Sapiens
cggccuaggcaacgagagcaaaacuccaauacaaacaaacaaacaaacaccugugcuaggucag

SEQ ID NO: 271347 - RNA, 64 nt, Homo Sapiens
cuaggcaacgagagcaaaacuccaauacaaacaaacaaacaaacaccugugcuaggucagucug

SEQ ID NO: 271348 - RNA, 64 nt, Homo Sapiens
uauuucuucaucugcuggggggaaaaaguaaauuacaaacaaacaaacaaagcagaacuaaaau

SEQ ID NO: 271349 - RNA, 64 nt, Homo Sapiens
ucuucaucugcuggggggaaaaaguaaauuacaaacaaacaaacaaagcagaacuaaaauauug

SEQ ID NO: 271350 - RNA, 64 nt, Homo Sapiens
caucugcuggggggaaaaaguaaauuacaaacaaacaaacaaagcagaacuaaaauauugggac

SEQ ID NO: 271351 - RNA, 64 nt, Homo Sapiens
uguguuaauuuggcuguaauggcauuuaaagcaaacaaacaaacaaaaaaagcugugaaaaugg

SEQ ID NO: 271352 - RNA, 64 nt, Homo Sapiens
uuaauuuggcuguaauggcauuuaaagcaaacaaacaaacaaaaaaagcugugaaaauggccuu

SEQ ID NO: 271353 - RNA, 64 nt, Homo Sapiens
acacagacagaaguaguuaaaaacaaacaaacaaacaaacaaauacagagcaaacccuguuucc

SEQ ID NO: 271354 - RNA, 64 nt, Homo Sapiens
aaauacacagacagaaguaguuccaaacaaacaaacaaacaaacggcgacagagcaaacccugu

SEQ ID NO: 271355 - RNA, 64 nt, Homo Sapiens
aaacaaauacacagacagaacuguuuccaaacaaacaaacaaacccugggcgacagagcaaacc

SEQ ID NO: 271356 - RNA, 64 nt, Homo Sapiens
aaacaaacaaauacacagacaacccuguuuccaaacaaacaaacccagccugggcgacagagca

SEQ ID NO: 271357 - RNA, 64 nt, Homo Sapiens
uagcuauuagagggugguugaucauucugccuauacaaacaagccaacuaaaauggagagauga

SEQ ID NO: 271358 - RNA, 52 nt, Homo Sapiens
cuuuggaccaaaaucccaguaaacaaacaaaagaggcagaagcagauacuag

SEQ ID NO: 271359 - RNA, 64 nt, Homo Sapiens
aaaaaaaacucuugucuccuucucaaacaaacaaacaaacaaaaggcaacagaacaagaaccca

SEQ ID NO: 271360 - RNA, 64 nt, Homo Sapiens
aaaaaaaaaaaacucuuguccccaucucaaacaaacaaacaaacccugggcaacagaacaagaa

SEQ ID NO: 271361 - RNA, 64 nt, Homo Sapiens
aaacaaaaaaaaaaaacucuagaacccaucucaaacaaacaaacccaaccugggcaacagaaca

SEQ ID NO: 271362 - RNA, 64 nt, Homo Sapiens
gacuuagugaaauaaaauaagaggaaagccaaaaacaaacaaacaaaaagcauauggggagcug

SEQ ID NO: 271363 - RNA, 64 nt, Homo Sapiens
uagugaaauaaaauaagaggaaagccaaaaacaaacaaacaaaaagcauauggggagcugguau

SEQ ID NO: 271364 - RNA, 64 nt, Homo Sapiens
cugauuaaugcaaggggaaauuuuuauacugaaaacaaacaaacaaacuagcagcuacuaaaau

SEQ ID NO: 271365 - RNA, 64 nt, Homo Sapiens
uuaaugcaaggggaaauuuuuauacugaaaacaaacaaacaaacuagcagcuacuaaaauagag

SEQ ID NO: 271366 - RNA, 64 nt, Homo Sapiens
gagccaccacacauggccuauugcacaagucuugacaaacaacauauauuuucuaaaacuaucc

SEQ ID NO: 271367 - RNA, 64 nt, Homo Sapiens
uaguaacuagaugcagugugaauuuuuuccauuaacaaacaaacaagucaguggcuuaaaugug

SEQ ID NO: 271368 - RNA, 64 nt, Homo Sapiens
aacuagaugcagugugaauuuuuuccauuaacaaacaaacaagucaguggcuuaaaugugauua

SEQ ID NO: 271369 - RNA, 64 nt, Homo Sapiens
aacacaaaacauaauaaaacacaaaguuaaacaaacaaacaaaagggcaaacugagguagcgac

SEQ ID NO: 271370 - RNA, 64 nt, Homo Sapiens
aaaaaacacaaaacauaauacgacacaaaguuaaacaaacaaacaugggggcaaacugagguag

SEQ ID NO: 271371 - RNA, 64 nt, Homo Sapiens
agguggaagcuuuuuaauaacaaauuguacacaaacaaacaaaaccgcuuucagaauaguuuug

SEQ ID NO: 271372 - RNA, 64 nt, Homo Sapiens
aaaaagguggaagcuuuuuauuugcaaauuguacacaaacaaacuauuccgcuuucagaauagu

SEQ ID NO: 271373 - RNA, 64 nt, Homo Sapiens
agaaguaacgaagcuaagaaauuuaaacaaacaaacaaacaaacuuuuuuucuagucccaugug

SEQ ID NO: 271374 - RNA, 64 nt, Homo Sapiens
aaacagaaguaacgaagcuaugugauuuaaacaaacaaacaaacaggauuuuuuucuaguccca

SEQ ID NO: 271375 - RNA, 64 nt, Homo Sapiens
aaacaaacagaaguaacgaacccaugugauuuaaacaaacaaaccuguaggauuuuuuucuagu

SEQ ID NO: 271376 - RNA, 64 nt, Homo Sapiens
acuguugcuauuuccuaaccaagaaaacaaacaaacaaacaaaaccuagcccccuugaucccua

SEQ ID NO: 271377 - RNA, 64 nt, Homo Sapiens
aaaaacuguugcuauuuccuccuaaagaaaacaaacaaacaaaccccuccuagcccccuugauc

SEQ ID NO: 271378 - RNA, 64 nt, Homo Sapiens
aaacaaaaacuguugcuauugaucccuaaagaaaacaaacaaacguaacccuccuagcccccuu

SEQ ID NO: 271379 - RNA, 64 nt, Homo Sapiens
ggcuuuuuguucuguuggugugauucaaagcaaaacaaacaaacaaaaacaaauuuuaagaaca

SEQ ID NO: 271380 - RNA, 64 nt, Homo Sapiens
uuuuguucuguuggugugauucaaagcaaaacaaacaaacaaaaacaaauuuuaagaacacaac

SEQ ID NO: 271381 - RNA, 64 nt, Homo Sapiens
augaagucucuuuaugguuagagaagaccaaaaaacaaacaaacaaacuuagaaacauaaaagg

SEQ ID NO: 271382 - RNA, 64 nt, Homo Sapiens
agucucuuuaugguuagagaagaccaaaaaacaaacaaacaaacuuagaaacauaaaaggaaau

SEQ ID NO: 271383 - RNA, 64 nt, Homo Sapiens
aagaaagggaaaaagcagaaacacugcagaagacacaaacaaacaaagaagagaaggauucuua

SEQ ID NO: 271384 - RNA, 64 nt, Homo Sapiens
aagggaaaaagcagaaacacugcagaagacacaaacaaacaaagaagagaaggauucuuauacc

SEQ ID NO: 271385 - RNA, 64 nt, Homo Sapiens
agccuuguuucucuagucacucucuaacaaacaaacaaacaaacgccgcagggccagccuuguu

SEQ ID NO: 271386 - RNA, 64 nt, Homo Sapiens
aaacagccuuguuucucuaguguuucucuaacaaacaaacaaaccggggccgcagggccagccu

SEQ ID NO: 271387 - RNA, 64 nt, Homo Sapiens
aaacaaacagccuuguuucugccuuguuucucuaacaaacaaacggggcggggccgcagggcca

SEQ ID NO: 271388 - RNA, 64 nt, Homo Sapiens
acuguuaauauauuagccaucuacuaucaaacaaacaaacaaaaaaucagaccaucugagccca

SEQ ID NO: 271389 - RNA, 64 nt, Homo Sapiens
aaaaacuguuaauauauuagcccacuacuaucaaacaaacaaaccccaaaucagaccaucugag

SEQ ID NO: 271390 - RNA, 64 nt, Homo Sapiens
ggauguuuuuaaugaccaauuauaaauacguauuacaaacaaguuucaaucaucaaaaaguaau

SEQ ID NO: 271391 - RNA, 64 nt, Homo Sapiens
cgaaugggguagaaacauuggcaaaugcagaaccacaaacaauuuggaagaaacuaaaaauaua

SEQ ID NO: 271392 - RNA, 64 nt, Homo Sapiens
aguucuauauauaauaguuuaaacaaacaaacaaacaaacaaacccuaucccuguaagcuaaac

SEQ ID NO: 271393 - RNA, 64 nt, Homo Sapiens
aaacaguucuauauauaauaaaacaaacaaacaaacaaacaaacgccaccuaucccuguaagcu

SEQ ID NO: 271394 - RNA, 64 nt, Homo Sapiens
aaacaaacaguucuauauauagcuaaacaaacaaacaaacaaacuaaugccaccuaucccugua

SEQ ID NO: 271395 - RNA, 64 nt, Homo Sapiens
aaacaaacaaacaguucuauuguaagcuaaacaaacaaacaaaccuuauaaugccaccuauccc

SEQ ID NO: 271396 - RNA, 64 nt, Homo Sapiens
aaacaaacaaacaaacaguuucccuguaagcuaaacaaacaaaccuuucuuauaaugccaccua

SEQ ID NO: 271397 - RNA, 64 nt, Homo Sapiens
aagcuauggcacuagaauuuacaacaaaaaacaaacaaacaaaacuuaugaacaaaacaaaaca

SEQ ID NO: 271398 - RNA, 64 nt, Homo Sapiens
aaaaaagcuauggcacuagaaacaacaacaaaaaacaaacaaaccuuucuuaugaacaaaacaa

SEQ ID NO: 271399 - RNA, 64 nt, Homo Sapiens
aacccauguguuaaaauacuuacaaaacaaacaaacaaacaaaauguaaucugaaguaugguau

SEQ ID NO: 271400 - RNA, 64 nt, Homo Sapiens
aaaaaacccauguguuaaaaguauuacaaaacaaacaaacaaacguauuguaaucugaaguaug

SEQ ID NO: 271401 - RNA, 64 nt, Homo Sapiens
aaacaaaaaacccauguguuuaugguauuacaaaacaaacaaacuuggguauuguaaucugaag

SEQ ID NO: 271402 - RNA, 64 nt, Homo Sapiens
auuagauaaauuucaaucaggguuuuuagauuaaacaaacaaacaauuggguacccaguuaaau

SEQ ID NO: 271403 - RNA, 64 nt, Homo Sapiens
gauaaauuucaaucaggguuuuuagauuaaacaaacaaacaauuggguacccaguuaaauuuuc

SEQ ID NO: 271404 - RNA, 64 nt, Homo Sapiens
ccugggugacagagucagacuccgucccaaaaaaacaaacaaacaaaacaaaacaaaaaaaaac

SEQ ID NO: 271405 - RNA, 64 nt, Homo Sapiens
ggugacagagucagacuccgucccaaaaaaacaaacaaacaaaacaaaacaaaaaaaaacagaa

SEQ ID NO: 271406 - RNA, 64 nt, Homo Sapiens
ccagccugggugacagagcgagacuccgucucaaacaaacaaacaaaaaacuguuuucauuugc

SEQ ID NO: 271407 - RNA, 64 nt, Homo Sapiens
ccugggugacagagcgagacuccgucucaaacaaacaaacaaaaaacuguuuucauuugcucuc

SEQ ID NO: 271408 - RNA, 64 nt, Homo Sapiens
aaaacaaggguggguggggaaaagaucaaaacaaacaaacaaaaugauaauaaacaucauuuua

SEQ ID NO: 271409 - RNA, 64 nt, Homo Sapiens
aaaaaaaacaaggguggguguuuaaaagaucaaaacaaacaaacguccugauaauaaacaucau

SEQ ID NO: 271410 - RNA, 64 nt, Homo Sapiens
uguuuauucaacaacuacuacuugauggucagacacaaacaaacaagcuaggugcuaauuaaua

SEQ ID NO: 271411 - RNA, 64 nt, Homo Sapiens
uauucaacaacuacuacuugauggucagacacaaacaaacaagcuaggugcuaauuaauaaaga

SEQ ID NO: 271412 - RNA, 64 nt, Homo Sapiens
gccaacauggugaaaccccaucucuacuaaaaauacaaacaauuaacugagcauaguggugggc

SEQ ID NO: 271413 - RNA, 64 nt, Homo Sapiens
guuuauuguauguaaggaaaaauuuuaccugaaaacaaacaaacaaacccuaaaacucagcacc

SEQ ID NO: 271414 - RNA, 64 nt, Homo Sapiens
auuguauguaaggaaaaauuuuaccugaaaacaaacaaacaaacccuaaaacucagcaccacua

SEQ ID NO: 271415 - RNA, 64 nt, Homo Sapiens
uccagccuggcaacagagcuagaauccgucucaaacaaacaaacaaaaaaucccacagcuauug

SEQ ID NO: 271416 - RNA, 64 nt, Homo Sapiens
gccuggcaacagagcuagaauccgucucaaacaaacaaacaaaaaaucccacagcuauuggauc

SEQ ID NO: 271417 - RNA, 64 nt, Homo Sapiens
agauuuuauuaaagauauuuccaaaacaaaacaaacaaacaaaacugggugacagacucugucu

SEQ ID NO: 271418 - RNA, 64 nt, Homo Sapiens
aaaaagauuuuauuaaagaugucuccaaaacaaaacaaacaaaccaaccugggugacagacucu

SEQ ID NO: 271419 - RNA, 64 nt, Homo Sapiens
aacagaaacaaaaucuguaagcauccacaaacaaacaaacaaauggucuuguuugauaaugugg

SEQ ID NO: 271420 - RNA, 64 nt, Homo Sapiens
aaauaacagaaacaaaaucugugggcauccacaaacaaacaaacaauuggucuuguuugauaau

SEQ ID NO: 271421 - RNA, 64 nt, Homo Sapiens
aaacaaauaacagaaacaaauaaugugggcauccacaaacaaacucauaauuggucuuguuuga

SEQ ID NO: 271422 - RNA, 64 nt, Homo Sapiens
aaaaaaaaauuaaaaaaaaaacaaacaacaaaaaacaaacaacagaaguccugcuauguuaaaa

SEQ ID NO: 271423 - RNA, 64 nt, Homo Sapiens
aaaaacaaacaacaaaaaaacugcuauguuaaaaacaaacaacaaaaauaucaccaaagaaguc

SEQ ID NO: 271424 - RNA, 64 nt, Homo Sapiens
ucacagagaugaaacagauuguagcacuccagucacaaacaaugaaucaugauaauuuacucag

SEQ ID NO: 271425 - RNA, 64 nt, Homo Sapiens
aacaaccuuagcauuaagaacuguaaacaaacaaacaaacaaaauacuaagaagccuuaauacu

SEQ ID NO: 271426 - RNA, 64 nt, Homo Sapiens
aaaaaacaaccuuagcauuauacucuguaaacaaacaaacaaacgcuuuacuaagaagccuuaa

SEQ ID NO: 271427 - RNA, 64 nt, Homo Sapiens
aaacaaaaaacaaccuuagcuuaauacucuguaaacaaacaaacccaagcuuuacuaagaagcc

SEQ ID NO: 271428 - RNA, 64 nt, Homo Sapiens
uucaggaggacuauguccuuugaugcuauaaaauacaaacaacuuugaaggcaacagaagacac

SEQ ID NO: 271429 - RNA, 64 nt, Homo Sapiens
cuuuuguauaauauuacuucaaagauauguaaucacaaacaaaaaaaacuauuuuuuauaaugu

SEQ ID NO: 271430 - RNA, 64 nt, Homo Sapiens
uuggaaauguacauauccaauaugaaauacuaaaacaaacaaacaaacaaaaaaccagaaugca

SEQ ID NO: 271431 - RNA, 64 nt, Homo Sapiens
aaauguacauauccaauaugaaauacuaaaacaaacaaacaaacaaaaaaccagaaugcauugu

SEQ ID NO: 271432 - RNA, 64 nt, Homo Sapiens
guacauauccaauaugaaauacuaaaacaaacaaacaaacaaaaaaccagaaugcauuguauag

SEQ ID NO: 271433 - RNA, 64 nt, Homo Sapiens
cgaaagacugcaguugugcuaaaaacaaaacaaaacaaacaaacaaacaaaaaaguaaaaaaag

SEQ ID NO: 271434 - RNA, 64 nt, Homo Sapiens
agacugcaguugugcuaaaaacaaaacaaaacaaacaaacaaacaaaaaaguaaaaaaagauua

SEQ ID NO: 271435 - RNA, 64 nt, Homo Sapiens
ugcaguugugcuaaaaacaaaacaaaacaaacaaacaaacaaaaaaguaaaaaaagauuacuuu

SEQ ID NO: 271436 - RNA, 64 nt, Homo Sapiens
aaagggugggggagggagggaaacaaacaaacaaacaaacaaaaauguaugacacccagcuuua

SEQ ID NO: 271437 - RNA, 64 nt, Homo Sapiens
aaaaaaagggugggggaggguuuaaaacaaacaaacaaacaaacugaaauguaugacacccagc

SEQ ID NO: 271438 - RNA, 64 nt, Homo Sapiens
aaacaaaaaaagggugggggcagcuuuaaaacaaacaaacaaacucucugaaauguaugacacc

SEQ ID NO: 271439 - RNA, 64 nt, Homo Sapiens
aaacaaacaaaaaaagggugcacccagcuuuaaaacaaacaaacaugcucucugaaauguauga

SEQ ID NO: 271440 - RNA, 64 nt, Homo Sapiens
aagauauugcaguuguguugacaaaaacaaacaaacaaacaaaaguggcgaaauccccgucuuu

SEQ ID NO: 271441 - RNA, 64 nt, Homo Sapiens
aaaaaagauauugcaguugucuuuacaaaaacaaacaaacaaaccaacguggcgaaauccccgu

SEQ ID NO: 271442 - RNA, 64 nt, Homo Sapiens
aaacaaaaaagauauugcagccgucuuuacaaaaacaaacaaacugggcaacguggcgaaaucc

SEQ ID NO: 271443 - RNA, 64 nt, Homo Sapiens
aaccuucaacugccuuaugccaaaacaaacacaaacaaacaaaaauugaaagaacaaaacaaaa

SEQ ID NO: 271444 - RNA, 64 nt, Homo Sapiens
aaaaaaccuucaacugccuuaaaacaaaacaaacacaaacaaacgcugauugaaagaacaaaac

SEQ ID NO: 271445 - RNA, 64 nt, Homo Sapiens
aagccauagagagcagaacuaaauuuuaaaacaaacaaacaaaaguguauuuucucuggcuuua

SEQ ID NO: 271446 - RNA, 64 nt, Homo Sapiens
aaaaaagccauagagagcaguuuaaaauuuuaaaacaaacaaacguguguguauuuucucuggc

SEQ ID NO: 271447 - RNA, 64 nt, Homo Sapiens
agccugggugacagagugaaacucguaucuccaaacaaacaaacaaaaaguccuuaaacauaug

SEQ ID NO: 271448 - RNA, 64 nt, Homo Sapiens
ugggugacagagugaaacucguaucuccaaacaaacaaacaaaaaguccuuaaacauaugugaa

SEQ ID NO: 271449 - RNA, 64 nt, Homo Sapiens
guguuaagacuaaaauuuugccuauaccuuuaagacaaacaaacaaacacacacacaaacaagc

SEQ ID NO: 271450 - RNA, 64 nt, Homo Sapiens
uaagacuaaaauuuugccuauaccuuuaagacaaacaaacaaacacacacacaaacaagcucua

SEQ ID NO: 271451 - RNA, 64 nt, Homo Sapiens
ccuauaccuuuaagacaaacaaacaaacacacacacaaacaagcucuaagcugcuguagccuga

SEQ ID NO: 271452 - RNA, 64 nt, Homo Sapiens
cuagcuucuugucuuaggccugaaccaaaaaacaacaaacaaacaaaaaacaagaaugaaaaac

SEQ ID NO: 271453 - RNA, 64 nt, Homo Sapiens
cuucuugucuuaggccugaaccaaaaaacaacaaacaaacaaaaaacaagaaugaaaaacagaa

SEQ ID NO: 271454 - RNA, 64 nt, Homo Sapiens
uccacugaagcaugcacaugccacugucaccaaaacaaacaacuaccacuuuccaaauuucauu

SEQ ID NO: 271455 - RNA, 64 nt, Homo Sapiens
aacaucauacuuaaacauuacagaaaauagaaauacaaacaagguugguacaugagagaaaaug

SEQ ID NO: 271456 - RNA, 64 nt, Homo Sapiens
aacuucaggucuuaagugcaaaucaaagcaaaaaacaaacaaaacuuacauggaaaaacuguaa

SEQ ID NO: 271457 - RNA, 64 nt, Homo Sapiens
aggucucagaccuacaaagaguuaaaacaaacagacaaacaaaaaaaaacacuacuauuuuaaa

SEQ ID NO: 271458 - RNA, 64 nt, Homo Sapiens
gacccaaucugagucuuauccucaaaacaaacaaacaaacaaaagcgacggagcgagacucugu

SEQ ID NO: 271459 - RNA, 64 nt, Homo Sapiens
aaaagacccaaucugagucucugucucaaaacaaacaaacaaaccugggcgacggagcgagacu

SEQ ID NO: 271460 - RNA, 64 nt, Homo Sapiens
aaacaaaagacccaaucugagacucugucucaaaacaaacaaaccagccugggcgacggagcga

SEQ ID NO: 271461 - RNA, 64 nt, Homo Sapiens
acucacugcaucgggacuuucaaaauccaaacaaacaaacaaacaaacauaaaauauaaacaau

SEQ ID NO: 271462 - RNA, 64 nt, Homo Sapiens
aaacacucacugcaucgggacaaucaaaauccaaacaaacaaacaacaaaacauaaaauauaaa

SEQ ID NO: 271463 - RNA, 64 nt, Homo Sapiens
cuccuauaucaaaaugccguaggccggguggcuuacaaacaacagaaacguauugcucacaguc

SEQ ID NO: 271464 - RNA, 64 nt, Homo Sapiens
ggugccuucucgcuguauccucaaugguagaagcacaaacaagcaagcuccuuccugccucuuu

SEQ ID NO: 271465 - RNA, 64 nt, Homo Sapiens
gcccuuuggcuucugauuuuucucuuuuuuaaaaacaaacaaacaaacuguugcagauuaugag

SEQ ID NO: 271466 - RNA, 64 nt, Homo Sapiens
uuuggcuucugauuuuucucuuuuuuaaaaacaaacaaacaaacuguugcagauuaugagugaa

SEQ ID NO: 271467 - RNA, 64 nt, Homo Sapiens
aguuuuuccaauuauaaauagcucagaaaaacaaacaaacaaaccgugcuuguggucugugcuu

SEQ ID NO: 271468 - RNA, 64 nt, Homo Sapiens
aaacaguuuuuccaauuauagcuugcucagaaaaacaaacaaacgugacgugcuuguggucugu

SEQ ID NO: 271469 - RNA, 64 nt, Homo Sapiens
cagauguauaaguacuaggcaucugaagaucaaaacaaacaauccauuccuugagaauguauuu

SEQ ID NO: 271470 - RNA, 64 nt, Homo Sapiens
ccuaucuuuuuuuuuuuggcaaguucauaguaagacaaacaaguguucauacaaugguuuuagc

SEQ ID NO: 271471 - RNA, 64 nt, Homo Sapiens
agaaagcaccgucgagaaaucaaaacaaaaacaaacaaacaaacgacagagagagacuccaucu

SEQ ID NO: 271472 - RNA, 64 nt, Homo Sapiens
aaacagaaagcaccgucgagaucucaaaacaaaaacaaacaaacgggcgacagagagagacucc

SEQ ID NO: 271473 - RNA, 64 nt, Homo Sapiens
augcuucagcugugacucagcaguuccuuaaaucacaaacaaugguaggucuauuauuuucucc

SEQ ID NO: 271474 - RNA, 64 nt, Homo Sapiens
auaauaaugacaaaaagcacaugcagaguaauacacaaacaaaaaaagugacaguuacuuuuuu

SEQ ID NO: 271475 - RNA, 64 nt, Homo Sapiens
aaagcucuaagacacuaauauauguaucuuauaaacaaacaauucaacucagaaguuuaugaga

SEQ ID NO: 271476 - RNA, 64 nt, Homo Sapiens
gaacaguggucuauucugcuacaugaagaugaauacaaacaaaauuuuuguauaaacuacuauu

SEQ ID NO: 271477 - RNA, 64 nt, Homo Sapiens
aaaacauagacuucuuuauacuuuaaaaaaacaaacaaacaaaaggcaauuuuaaaacagacuc

SEQ ID NO: 271478 - RNA, 64 nt, Homo Sapiens
aaaaaaaacauagacuucuuacuccuuuaaaaaaacaaacaaacaauaggcaauuuuaaaacag

SEQ ID NO: 271479 - RNA, 64 nt, Homo Sapiens
aaaacaccucaccaugagugaaaaacaaaaacaaacaaacaaaaagacucugucucaaaaaaaa

SEQ ID NO: 271480 - RNA, 64 nt, Homo Sapiens
aaaaaaaacaccucaccaugaaaaaaaaacaaaaacaaacaaacaguaagacucugucucaaaa

SEQ ID NO: 271481 - RNA, 64 nt, Homo Sapiens
agccuguccacccuugagaauaaaaaacaaacaaacaaacaaaacacuuccuugaaaauuuuau

SEQ ID NO: 271482 - RNA, 64 nt, Homo Sapiens
aaaaagccuguccacccuuguuauuaaaaaacaaacaaacaaacaaaucacuuccuugaaaauu

SEQ ID NO: 271483 - RNA, 64 nt, Homo Sapiens
aaacaaaaagccuguccaccaauuuuauuaaaaaacaaacaaacaaagaaaucacuuccuugaa

SEQ ID NO: 271484 - RNA, 64 nt, Homo Sapiens
uuuagauauucauucaucaaauacaugggacuucacaaacaauuuuccauaacuuuuuagccug

SEQ ID NO: 271485 - RNA, 64 nt, Homo Sapiens
uaaguauuuuccaguuuugcuugacaguuucuaaacaaacaaaaauaaacucaaugaaaggaaa

SEQ ID NO: 271486 - RNA, 64 nt, Homo Sapiens
gacauucccuagauucaaaggcaaaacagaagaaacaaacaaacaaacaaaaaaagcuugcaaa

SEQ ID NO: 271487 - RNA, 64 nt, Homo Sapiens
uucccuagauucaaaggcaaaacagaagaaacaaacaaacaaacaaaaaaagcuugcaaaauau

SEQ ID NO: 271488 - RNA, 64 nt, Homo Sapiens
cuagauucaaaggcaaaacagaagaaacaaacaaacaaacaaaaaaagcuugcaaaauauuuua

SEQ ID NO: 271489 - RNA, 64 nt, Homo Sapiens
uguguucuuuugccuucaaucuguugucuucaaaacaaacaaacaaaaaaagcuucuugcgccu

SEQ ID NO: 271490 - RNA, 64 nt, Homo Sapiens
uucuuuugccuucaaucuguugucuucaaaacaaacaaacaaaaaaagcuucuugcgccuuucc

SEQ ID NO: 271491 - RNA, 64 nt, Homo Sapiens
aaaacaauucuucauucagaaauccuaaaaacaaacaaacaaaaaaaaaaaaaaaaaaaaaaaa

SEQ ID NO: 271492 - RNA, 64 nt, Homo Sapiens
aaaaaaaacaauucuucauuaaaaaauccuaaaaacaaacaaacaaaaaaaaaaaaaaaaaaaa

SEQ ID NO: 271493 - RNA, 64 nt, Homo Sapiens
ccaggauaauuuuuaaaccaaucaaaugaaaaaaacaaacaaacaaaaaaggaaaugucaugug

SEQ ID NO: 271494 - RNA, 64 nt, Homo Sapiens
gauaauuuuuaaaccaaucaaaugaaaaaaacaaacaaacaaaaaaggaaaugucaugugaggu

SEQ ID NO: 271495 - RNA, 64 nt, Homo Sapiens
uaugacagagugagacccuguuucuaaaaacaaaacaaacaaacaaacaaacaacguaucuuac

SEQ ID NO: 271496 - RNA, 64 nt, Homo Sapiens
acagagugagacccuguuucuaaaaacaaaacaaacaaacaaacaaacaacguaucuuacugac

SEQ ID NO: 271497 - RNA, 64 nt, Homo Sapiens
agugagacccuguuucuaaaaacaaaacaaacaaacaaacaaacaacguaucuuacugacuaaa

SEQ ID NO: 271498 - RNA, 64 nt, Homo Sapiens
agacccuguuucuaaaaacaaaacaaacaaacaaacaaacaacguaucuuacugacuaaacugg

SEQ ID NO: 271499 - RNA, 64 nt, Homo Sapiens
aacuccuccuaccccccaagguaagaaacaaaaaacaaacaaacaaacaaaaauagaagacaaa

SEQ ID NO: 271500 - RNA, 64 nt, Homo Sapiens
ccuccuaccccccaagguaagaaacaaaaaacaaacaaacaaacaaaaauagaagacaaaagaa

SEQ ID NO: 271501 - RNA, 64 nt, Homo Sapiens
cuaccccccaagguaagaaacaaaaaacaaacaaacaaacaaaaauagaagacaaaagaaagac

SEQ ID NO: 271502 - RNA, 64 nt, Homo Sapiens
agugacagagcaagaccccaucucaaaaaaaaaaacaaacaaacaaaaaaaaaaccauauauau

SEQ ID NO: 271503 - RNA, 64 nt, Homo Sapiens
acagagcaagaccccaucucaaaaaaaaaaacaaacaaacaaaaaaaaaaccauauauauacau

SEQ ID NO: 271504 - RNA, 64 nt, Homo Sapiens
acaaaaaaagacaguauagaaaacaaaaaacaagacaaacaacuauuaaaacaaagaaacaaac

SEQ ID NO: 271505 - RNA, 64 nt, Homo Sapiens
aacaagacaaacaacuacaaaaacaaagaaacaaacaaacaaaaauauauaucuauauaaauua

SEQ ID NO: 271506 - RNA, 64 nt, Homo Sapiens
aaaaaacaagacaaacaacuauuaaaacaaagaaacaaacaaacgaauauauauaucuauauaa

SEQ ID NO: 271507 - RNA, 64 nt, Homo Sapiens
agguacaacucaaacaagccaugguuccuugaugacaaacaaacaacaucaaggcaaauccaau

SEQ ID NO: 271508 - RNA, 64 nt, Homo Sapiens
acaacucaaacaagccaugguuccuugaugacaaacaaacaacaucaaggcaaauccaauaauc

SEQ ID NO: 271509 - RNA, 64 nt, Homo Sapiens
ugucauuuuguuuuaugacagacacacguaucuaacaaacaaacaaacagugaccuucuccaug

SEQ ID NO: 271510 - RNA, 64 nt, Homo Sapiens
auuuuguuuuaugacagacacacguaucuaacaaacaaacaaacagugaccuucuccauggguc

SEQ ID NO: 271511 - RNA, 64 nt, Homo Sapiens
cuaagguuuucuggcuuauugaggaaauuuccuaacaaacaaacaaacaaacaaacagaagaga

SEQ ID NO: 271512 - RNA, 64 nt, Homo Sapiens
gguuuucuggcuuauugaggaaauuuccuaacaaacaaacaaacaaacaaacagaagagaagau

SEQ ID NO: 271513 - RNA, 64 nt, Homo Sapiens
uucuggcuuauugaggaaauuuccuaacaaacaaacaaacaaacaaacagaagagaagaucauu

SEQ ID NO: 271514 - RNA, 64 nt, Homo Sapiens
ggcuuauugaggaaauuuccuaacaaacaaacaaacaaacaaacagaagagaagaucauuaacc

SEQ ID NO: 271515 - RNA, 64 nt, Homo Sapiens
uugggcgacagaucaagacucugucacacacaaaacaaacaaacaaauuuucccguuucucucu

SEQ ID NO: 271516 - RNA, 64 nt, Homo Sapiens
gcgacagaucaagacucugucacacacaaaacaaacaaacaaauuuucccguuucucucugucc

SEQ ID NO: 271517 - RNA, 64 nt, Homo Sapiens
aaaacccaacaacaacccagaaaaaccaaaacaaacaaacaaaaugcaccacggcaagaaaacc

SEQ ID NO: 271518 - RNA, 64 nt, Homo Sapiens
aaaaaaaacccaacaacaacaaccaaaaaccaaaacaaacaaacguuuugcaccacggcaagaa

SEQ ID NO: 271519 - RNA, 64 nt, Homo Sapiens
aauauuaaagauuuccuuggagucagaggaaaaaacaaacaauuauaauguugucuagggacga

SEQ ID NO: 271520 - RNA, 64 nt, Homo Sapiens
uguguguauuugauggcucuaagggcuauaaauuacaaacaaaacacaucccagacauuaggag

SEQ ID NO: 271521 - RNA, 64 nt, Homo Sapiens
cacaucccagacauuaggagaagggcuauaaauuacaaacaaaauguguguauuugauggcucu

SEQ ID NO: 271522 - RNA, 64 nt, Homo Sapiens
auaauguugucuagggacgaagucagaguaaaaaacaaacaauuaauauuaaagauuuccuugg

SEQ ID NO: 271523 - RNA, 64 nt, Homo Sapiens
aaacucauggagcgauuuuaaaauacaaaauuaaacaaacaaaacauugcauuugcuuuuauua

SEQ ID NO: 271524 - RNA, 64 nt, Homo Sapiens
ucaacugauauucccaaaaaguuuuuggacaaguacaaacaauuugaacuucagggugaacuug

SEQ ID NO: 271525 - RNA, 64 nt, Homo Sapiens
aucagucuuagucucuugcuugaagguaaaacaaacaaacaaacucaauuuaagacuaagacuu

SEQ ID NO: 271526 - RNA, 64 nt, Homo Sapiens
aaacaucagucuuagucucuacuuugaagguaaaacaaacaaaccuugucaauuuaagacuaag

SEQ ID NO: 271527 - RNA, 64 nt, Homo Sapiens
gaggggggagcagguuuuauuuuuacauucacaaacaaacaaagggaaagagacuuugccucac

SEQ ID NO: 271528 - RNA, 64 nt, Homo Sapiens
aaaggaggggggagcagguuucacuuuuacauucacaaacaaacacacggaaagagacuuugcc

SEQ ID NO: 271529 - RNA, 64 nt, Homo Sapiens
aaggauggaggaagaucuacgaagcaaauggaaaacaaacaaaaaaagaggcagggguugcaau

SEQ ID NO: 271530 - RNA, 64 nt, Homo Sapiens
agaaucuacaaugaacucaaacaaauuuacaggaacaaacaaccccaucaaaaagucggcaaag

SEQ ID NO: 271531 - RNA, 64 nt, Homo Sapiens
agagccagugggggagggagccccgucucaacaaacaaacaaaagccugggcaacagagggagc

SEQ ID NO: 271532 - RNA, 64 nt, Homo Sapiens
aaaaagagccagugggggaggagcccccgucucaacaaacaaacuccagccugggcaacagagg

SEQ ID NO: 271533 - RNA, 64 nt, Homo Sapiens
aaaaaaccacaauuagacuggcaaaacaaaacaaacaaacaagcgagacuccaacucagaaaaa

SEQ ID NO: 271534 - RNA, 64 nt, Homo Sapiens
aagcaaaaaaccacaauuagaaaagcaaaacaaaacaaacaaacgagcgagacuccaacucaga

SEQ ID NO: 271535 - RNA, 64 nt, Homo Sapiens
ggaaagccuggcgauaccccaucucuauuuagaaacaaacaaacaaacaaauaaaaaaccuggc

SEQ ID NO: 271536 - RNA, 64 nt, Homo Sapiens
agccuggcgauaccccaucucuauuuagaaacaaacaaacaaacaaauaaaaaaccuggcaccu

SEQ ID NO: 271537 - RNA, 64 nt, Homo Sapiens
gccugagugacagagcgagacccugucucaaaaaacaaacaaacaaacaaacaaaaacagaaca

SEQ ID NO: 271538 - RNA, 64 nt, Homo Sapiens
gagugacagagcgagacccugucucaaaaaacaaacaaacaaacaaacaaaaacagaacauucu

SEQ ID NO: 271539 - RNA, 64 nt, Homo Sapiens
gacagagcgagacccugucucaaaaaacaaacaaacaaacaaacaaaaacagaacauucugggc

SEQ ID NO: 271540 - RNA, 64 nt, Homo Sapiens
gagcgagacccugucucaaaaaacaaacaaacaaacaaacaaaaacagaacauucugggcacgg

SEQ ID NO: 271541 - RNA, 64 nt, Homo Sapiens
aacacaaaaaaaaccacucuuucucaaaaaacaaacaaacaaaaggcuucaauuagaauuauuu

SEQ ID NO: 271542 - RNA, 64 nt, Homo Sapiens
aaaaaacacaaaaaaaaccaauuuuucucaaaaaacaaacaaacaugaggcuucaauuagaauu

SEQ ID NO: 271543 - RNA, 64 nt, Homo Sapiens
aagacauugcuggaguugacuuucuucuguccaaacaaacaaacaaaaacuaaacacacacaca

SEQ ID NO: 271544 - RNA, 64 nt, Homo Sapiens
cauugcuggaguugacuuucuucuguccaaacaaacaaacaaaaacuaaacacacacacaaacc

SEQ ID NO: 271545 - RNA, 64 nt, Homo Sapiens
cagccuggugacagaacgagacucugucuuaaaaacaaacaaacaaaaaaaaaaucuguuagau

SEQ ID NO: 271546 - RNA, 64 nt, Homo Sapiens
cuggugacagaacgagacucugucuuaaaaacaaacaaacaaaaaaaaaaucuguuagauaagc

SEQ ID NO: 271547 - RNA, 64 nt, Homo Sapiens
aaagaaagaacauuggacauaaacaaacaaacaaacaaacaaaugccagacuccgucucuaaac

SEQ ID NO: 271548 - RNA, 64 nt, Homo Sapiens
aaauaaagaaagaacauuggaaacaaacaaacaaacaaacaaaccagagccagacuccgucucu

SEQ ID NO: 271549 - RNA, 64 nt, Homo Sapiens
aaacaaauaaagaaagaacacucuaaacaaacaaacaaacaaacgcaacagagccagacuccgu

SEQ ID NO: 271550 - RNA, 64 nt, Homo Sapiens
aaacaaacaaauaaagaaagccgucucuaaacaaacaaacaaaccugggcaacagagccagacu

SEQ ID NO: 271551 - RNA, 64 nt, Homo Sapiens
aaacaaacaaacaaauaaaggacuccgucucuaaacaaacaaaccagccugggcaacagagcca

SEQ ID NO: 271552 - RNA, 64 nt, Homo Sapiens
aaaaacacaaaaaaagaaagggaaaaacaaacaaacaaacaaaaacucuauagcaagaugaaga

SEQ ID NO: 271553 - RNA, 64 nt, Homo Sapiens
aaaaaaaaacacaaaaaaagaagaggaaaaacaaacaaacaaacaggaacucuauagcaagaug

SEQ ID NO: 271554 - RNA, 64 nt, Homo Sapiens
aaacaaaaaaaaacacaaaagaugaagaggaaaaacaaacaaacguagaggaacucuauagcaa

SEQ ID NO: 271555 - RNA, 64 nt, Homo Sapiens
uuguugauaaugggcuuuguuagcacuuuuuaaaacaaacaaacaaacaaaacaaaaaagcaaa

SEQ ID NO: 271556 - RNA, 64 nt, Homo Sapiens
ugauaaugggcuuuguuagcacuuuuuaaaacaaacaaacaaacaaaacaaaaaagcaaaccac

SEQ ID NO: 271557 - RNA, 64 nt, Homo Sapiens
aaugggcuuuguuagcacuuuuuaaaacaaacaaacaaacaaaacaaaaaagcaaaccacauuu

SEQ ID NO: 271558 - RNA, 64 nt, Homo Sapiens
gauuccaucugaaaaacaaaaacaaaaacagaaaacaaacaaacaaaaaacaaaaaauccccac

SEQ ID NO: 271559 - RNA, 64 nt, Homo Sapiens
ccaucugaaaaacaaaaacaaaaacagaaaacaaacaaacaaaaaacaaaaaauccccacaacu

SEQ ID NO: 271560 - RNA, 64 nt, Homo Sapiens
uaaaaaacucagccaacagguaguauugguaaaaacaaacaaacaaaaauccuuugcccucaga

SEQ ID NO: 271561 - RNA, 64 nt, Homo Sapiens
aaacucagccaacagguaguauugguaaaaacaaacaaacaaaaauccuuugcccucagaagug

SEQ ID NO: 271562 - RNA, 64 nt, Homo Sapiens
auugcucaaaaaagaggagaaaauauauaaacaaacaaacaaaacuugguggauuagacagguu

SEQ ID NO: 271563 - RNA, 64 nt, Homo Sapiens
aaaaauugcucaaaaaagaggguuaaauauauaaacaaacaaacccuucuugguggauuagaca

SEQ ID NO: 271564 - RNA, 64 nt, Homo Sapiens
cuugcaucuaaccaaaaaguaacaaaacaaacaaacaaacaaaauccaucucaaaacaaaacaa

SEQ ID NO: 271565 - RNA, 64 nt, Homo Sapiens
aaaacuugcaucuaaccaaaacaaaacaaaacaaacaaacaaacaaacuccaucucaaaacaaa

SEQ ID NO: 271566 - RNA, 64 nt, Homo Sapiens
aaacaaaacuugcaucuaaccaaaacaaaacaaaacaaacaaacaacgaaacuccaucucaaaa

SEQ ID NO: 271567 - RNA, 64 nt, Homo Sapiens
uagcuauuagagggugguugaucauucuaccuauacaaacaagccaucuaaaauggagagauga

SEQ ID NO: 271568 - RNA, 52 nt, Homo Sapiens; identical to SEQ ID NO: 271358

SEQ ID NO: 271569 - RNA, 64 nt, Homo Sapiens
uuauugucggcaggcggugagggguagaaaaaaaacaaacaaacaaacagaaaaaaaaaccaaa

SEQ ID NO: 271570 - RNA, 64 nt, Homo Sapiens
ugucggcaggcggugagggguagaaaaaaaacaaacaaacaaacagaaaaaaaaaccaaaaaaa

SEQ ID NO: 271571 - RNA, 64 nt, Homo Sapiens; identical to SEQ ID NO: 259109

SEQ ID NO: 271572 - RNA, 64 nt, Homo Sapiens; identical to SEQ ID NO: 259110

SEQ ID NO: 271573 - RNA, 64 nt, Homo Sapiens; identical to SEQ ID NO: 259111

SEQ ID NO: 271574 - RNA, 64 nt, Homo Sapiens; identical to SEQ ID NO: 259112

SEQ ID NO: 271575 - RNA, 64 nt, Homo Sapiens
cugaggcaggagaauugcuucuguagucccagcuacuugcgaggccgggcgugguggcgugugc

SEQ ID NO: 271576 - RNA, 64 nt, Homo Sapiens
gaaucauccgcaacucagugagccagugaaggauacuugcgauaaagaacaagagauaccuuua

SEQ ID NO: 271577 - RNA, 64 nt, Homo Sapiens
uuuuaaaaaauguauauuuuuaaaucuauugucuacuugcgauuugaucagaaaaauaauucca

SEQ ID NO: 271578 - RNA, 64 nt, Homo Sapiens
gucaaccauuugaugcuucugaaaaguacuuucaacuugcgaaggaaacucuucuuuaaagacu

SEQ ID NO: 271579 - RNA, 64 nt, Homo Sapiens
ggacuuuugaguuggcuuuccgguguaguuaaaaacuugcgaaguuguuguauaaagaugggau

SEQ ID NO: 271580 - RNA, 64 nt, Homo Sapiens
guagugacuuuaggacuggcugauuuuuggcacaacuugcgagucccugggaaagccagagcug

SEQ ID NO: 271581 - RNA, 64 nt, Homo Sapiens
ccaaggccaguccccauuucgggagcgucugggaacuugcgagucugccugcugagaugaggag

SEQ ID NO: 271582 - RNA, 64 nt, Homo Sapiens
ucaucccuaauuucuuccucaugcuugcucugccacuugcgauucugcugacuucagccugguc

SEQ ID NO: 271583 - RNA, 64 nt, Homo Sapiens
cuguuuacccucacuugcaaguaaugacuacguaacuugcgaauggcaguugacaaaagaaaau

SEQ ID NO: 271584 - RNA, 64 nt, Homo Sapiens
cucagucccuuccaagcugccgacugugccacccacuugcgagccuuuggagccacugaagagc

SEQ ID NO: 271585 - RNA, 64 nt, Homo Sapiens
ccugaaagagacacagucacauggccagaugagaacuugcgauacuagccugcacccacuggcu

SEQ ID NO: 271586 - RNA, 64 nt, Homo Sapiens
aauucguguguuuuuuuaugacagugauauuggaacuugcgagaccuauuuagaugauaaagag

SEQ ID NO: 271587 - RNA, 64 nt, Homo Sapiens
gggccgcggggugcugguaggagugguuggagagacuugcgaaggcggcugggguguucggauu

SEQ ID NO: 271588 - RNA, 64 nt, Homo Sapiens
guguuagcucuaacaucucccacaagcuagaggaacuugcgaguauauuaacaaggacacaucu

SEQ ID NO: 271589 - RNA, 64 nt, Homo Sapiens
caaucucaggagcuguggacucaugcccaagaugacuugcgagguucugaugcaccgcucugcu

SEQ ID NO: 271590 - RNA, 64 nt, Homo Sapiens
aaaaaguaaaacacauucugagaucugcaguaggacuugcgaucaccuucccaaaaugguucuu

SEQ ID NO: 271591 - RNA, 64 nt, Homo Sapiens
cuucuuaguuuucugcauacucacccuacugaaaacuugcgauucagaucaaguaguuuggaca

SEQ ID NO: 271592 - RNA, 64 nt, Homo Sapiens
ugaaucaacaaguuauuuucaacucaauuuuaugacuugcgaaaaagcuuuugcccuguugugu

SEQ ID NO: 271593 - RNA, 64 nt, Homo Sapiens
ccucaagguguucucuguagucggcucucuggacacuugcgacaugcuuuggacccuacacacu

SEQ ID NO: 271594 - RNA, 64 nt, Homo Sapiens
cuuuuuucccugguggggcuucuucuguaacaugacuugcgaauauuuauauaaaaacgagugu

SEQ ID NO: 271595 - RNA, 64 nt, Homo Sapiens
ggaggcucagcaggccaggaggcccaaggacaggacuugcgaccuugaagccaaaggaaucuca

SEQ ID NO: 271596 - RNA, 64 nt, Homo Sapiens
acccugagauaguaaguauuaaguucuauuuaauacuugcgacaacggucaaagugcuuuuugu

SEQ ID NO: 271597 - RNA, 64 nt, Homo Sapiens
ccaggaguuagggaauauagugcaccgugauuggacuugcgaauagccacugcacugcggccug

SEQ ID NO: 271598 - RNA, 64 nt, Homo Sapiens
agcagcauugaagcagccuuccugcagacccucuacuugcgaaaggauggugaucccuuugacc

SEQ ID NO: 271599 - RNA, 64 nt, Homo Sapiens
ggacaauaaaaucuagaagaaauugagaagagagacuugcgauacucuggauaacugcuuuuug

SEQ ID NO: 271600 - RNA, 64 nt, Homo Sapiens
ugaagcaggguuuucauuuuaaaacuuugacuugacuugcgaagggauugaaaaacagaaacac

SEQ ID NO: 271601 - RNA, 64 nt, Homo Sapiens
cauguagaaaugugaagaguuuuagguucugugaacuugcgaguuucuuccaggggcauguuau

SEQ ID NO: 271602 - RNA, 64 nt, Homo Sapiens
ccggauuuaaaacuugcucaccucuccaaaggguacuugcgaugccuuucucaggcccuaaauc

SEQ ID NO: 271603 - RNA, 64 nt, Homo Sapiens
caaggucuugcucuguugcccaggcugaucuuggacuugcgagccaccaugccuggcuggguuu

SEQ ID NO: 271604 - RNA, 64 nt, Homo Sapiens
gauaaaacuuaaggaaaaccaugcaugaacuucauccuaauaaguaguuaagaguaguguagaa

SEQ ID NO: 271605 - RNA, 64 nt, Homo Sapiens
acaaucagauugguuuuauuuuccagaacaaauuuccuaauaacucaauaauuuaugaauaagu

SEQ ID NO: 271606 - RNA, 64 nt, Homo Sapiens
accaccuaacagagaacacauaauaggcuuuuuuuccuaauaccaaauccaugaguaacuuucc

SEQ ID NO: 271607 - RNA, 64 nt, Homo Sapiens
cuuuuuuuccuaauaccaccuccaugaguaacuuuccuaauagguccaccaauuauaaauuaaa

SEQ ID NO: 271608 - RNA, 64 nt, Homo Sapiens
aacauaguaaaacuauugaauuucucuuaagaauuccuaauaggucaauagauuuacccuccag

SEQ ID NO: 271609 - RNA, 64 nt, Homo Sapiens
augcauucaaugaaguucauauccaugaauucacuccuaauauacccuaauaaagugguugauc

SEQ ID NO: 271610 - RNA, 64 nt, Homo Sapiens
uacaaucuagaaaugaugaagcucuuucacuaauuccuaauaugaaauguaugauggccaaaga

SEQ ID NO: 271611 - RNA, 64 nt, Homo Sapiens
ggaagaauccauaaacagacauucuaugucuguuuccuaauaucuuguggcugugugcaauucu

SEQ ID NO: 271612 - RNA, 64 nt, Homo Sapiens
uacauagaaacuuuguggggauugcacaauuuuguccuaauauauuaucaaaacuguugucacc

SEQ ID NO: 271613 - RNA, 64 nt, Homo Sapiens
uuuuccuguuaaggcagaccauuacuauaaagacuccuaauagcuuccuuuucacauuagauaa

SEQ ID NO: 271614 - RNA, 64 nt, Homo Sapiens
uuauuugaaaacguugcugguuucaguuuuaaauuccuaauaaacuucuuuuuccagguuuuau

SEQ ID NO: 271615 - RNA, 64 nt, Homo Sapiens
agagaagcugcauuuuauuguuuuuuuuaauguuuccuaauaaaguucguguuuuggguuuuuu

SEQ ID NO: 271616 - RNA, 64 nt, Homo Sapiens
gcaggaauuacuuuuuguuguuuuugccaccguggagagcaacuauuuggagugcacagccuau

SEQ ID NO: 271617 - RNA, 64 nt, Homo Sapiens
aggcuaggagaggcugggcccggugaaaaggccagagagcaagccaagauuaggugaggguugu

SEQ ID NO: 271618 - RNA, 64 nt, Homo Sapiens
caaucagucccucaggaaagggaauugaauagcagagagcaaacgcaggaacaagugggcuugg

SEQ ID NO: 271619 - RNA, 64 nt, Homo Sapiens
cccccaaaaaaaagaaaaagcucaacugcagucagagagcaagcaggccaggacccuggggccc

SEQ ID NO: 271620 - RNA, 64 nt, Homo Sapiens
ggucuauagaaacaucauguugcauugucaccuagagagcaagaaaacaccuuugcccuggcuc

SEQ ID NO: 271621 - RNA, 64 nt, Homo Sapiens
caguugauuuuuuaauucauuuuucaggugggaagagagcaaacuauauuaaugcagucauccc

SEQ ID NO: 271622 - RNA, 64 nt, Homo Sapiens
gaaaaauuucaacuuguauagaagaaggcagaaagagagcaaauugugaccaauauggaauaaa

SEQ ID NO: 271623 - RNA, 64 nt, Homo Sapiens
cuuaauaauaauucuuuuuuacacggccauguuggagagcaaaagguccucugggagcugaagc

SEQ ID NO: 271624 - RNA, 64 nt, Homo Sapiens
gauaaggcaaauaagguaaccaaacauacauaaagagagcaauuugcaugugcaacaguacaca

SEQ ID NO: 271625 - RNA, 64 nt, Homo Sapiens
uaauugagaaaaauaaauaaacuugagccaaucugagagcaaaaaaggggcucccacuggccaa

SEQ ID NO: 271626 - RNA, 64 nt, Homo Sapiens
auauuauuaagauggguuggggaaaaaggcugaagagagcaaauuacugaugagaguacuaacu

SEQ ID NO: 271627 - RNA, 53 nt, Homo Sapiens
aucauuauaugaaaguccucgaggagagcaaauuuggagccuucuuacuauag

SEQ ID NO: 271628 - RNA, 64 nt, Homo Sapiens
ggucccgaguccccuccuaguuuuucugggaaaggagagcaagaacugacucuuccacccuuuu

SEQ ID NO: 271629 - RNA, 64 nt, Homo Sapiens
caguuagaguucagaggccacuuuuuugaaacaggagagcaaaguucuuuuuuuucuuucguuc

SEQ ID NO: 271630 - RNA, 64 nt, Homo Sapiens
aguuacuaaggccuucagugaacagaaaggagcagagagcaagauuagaucugagaagaugcuc

SEQ ID NO: 271631 - RNA, 64 nt, Homo Sapiens
ugaguaaggggcuuuguugaaagaggggguuagagagagcaagacagcacuugagugcacuggc

SEQ ID NO: 271632 - RNA, 64 nt, Homo Sapiens
ugaugaggagacugagcgucacaccuguaucccagagagcaaagggaaaaugaacguccaggac

SEQ ID NO: 271633 - RNA, 64 nt, Homo Sapiens
ccaggggucuuggugcucccccgugacccacccagagagcaaggcuccugcggcagaacagcac

SEQ ID NO: 271634 - RNA, 64 nt, Homo Sapiens; identical to SEQ ID NO: 102083

SEQ ID NO: 271635 - RNA, 64 nt, Homo Sapiens; identical to SEQ ID NO: 102084

SEQ ID NO: 271636 - RNA, 64 nt, Homo Sapiens; identical to SEQ ID NO: 138766

SEQ ID NO: 271637 - RNA, 64 nt, Homo Sapiens; identical to SEQ ID NO: 138767

SEQ ID NO: 271638 - RNA, 64 nt, Homo Sapiens; identical to SEQ ID NO: 138768

SEQ ID NO: 271639 - RNA, 64 nt, Homo Sapiens; identical to SEQ ID NO: 138769

SEQ ID NO: 271640 - RNA, 64 nt, Homo Sapiens; identical to SEQ ID NO: 138770

SEQ ID NO: 271641 - RNA, 64 nt, Homo Sapiens; identical to SEQ ID NO: 138771

SEQ ID NO: 271642 - RNA, 64 nt, Homo Sapiens; identical to SEQ ID NO: 138772

SEQ ID NO: 271643 - RNA, 64 nt, Homo Sapiens; identical to SEQ ID NO: 138773

SEQ ID NO: 271644 - RNA, 64 nt, Homo Sapiens; identical to SEQ ID NO: 138774

SEQ ID NO: 271645 - RNA, 64 nt, Homo Sapiens; identical to SEQ ID NO: 138775

SEQ ID NO: 271646 - RNA, 64 nt, Homo Sapiens; identical to SEQ ID NO: 138776

SEQ ID NO: 271647 - RNA, 64 nt, Homo Sapiens; identical to SEQ ID NO: 138777

SEQ ID NO: 271648 - RNA, 64 nt, Homo Sapiens; identical to SEQ ID NO: 138778

SEQ ID NO: 271649 - RNA, 64 nt, Homo Sapiens; identical to SEQ ID NO: 138779

SEQ ID NO: 271650 - RNA, 64 nt, Homo Sapiens; identical to SEQ ID NO: 138780

SEQ ID NO: 271651 - RNA, 64 nt, Homo Sapiens; identical to SEQ ID NO: 138781

SEQ ID NO: 271652 - RNA, 64 nt, Homo Sapiens; identical to SEQ ID NO: 138782

SEQ ID NO: 271653 - RNA, 64 nt, Homo Sapiens
aagcagcccuuacuaagcugagagaugucauugcugcaggcaggacguauaggcacauguaggu

SEQ ID NO: 271654 - RNA, 64 nt, Homo Sapiens
uggguagcuacaaaguuccucagggguuucauuuugcaggcaugucucugagcuucuauaccug

SEQ ID NO: 271655 - RNA, 64 nt, Homo Sapiens
agcugcuggauaaaauaggcuuggauggcaagaaugcaggcagaaguccugaaaggccaaugag

SEQ ID NO: 271656 - RNA, 64 nt, Homo Sapiens
cacugccacgcccagcuaaucgaguagcugggacugcaggcacaauuauccugccucagccucc

SEQ ID NO: 271657 - RNA, 64 nt, Homo Sapiens
ucucugagcuucuauaccugcagggauuucauuuugcaggcauguggguagcuacaaaauuccu

SEQ ID NO: 271658 - RNA, 64 nt, Homo Sapiens
accuauaggcaccugaagauagaggugucauuccugcaggcaggaagcagcccuuacuaagccg

SEQ ID NO: 271659 - RNA, 64 nt, Homo Sapiens
ggcuguacccaagcugauuucccacugaaagggcugcaggcauggacaacacuaucuggagcca

SEQ ID NO: 271660 - RNA, 64 nt, Homo Sapiens
guccuaggagccccugcuucgaggcagagaggcaugcaggcaggagcuuagggagucacuauug

SEQ ID NO: 271661 - RNA, 64 nt, Homo Sapiens
gcacauggugugagaaggucccugcugcucagagugcaggcauuaggcccugggcccagucagc

SEQ ID NO: 271662 - RNA, 64 nt, Homo Sapiens
gcacagagcaugaaugggcccuagcugcauggggugcaggcauugugagucccugggcucaguc

SEQ ID NO: 271663 - RNA, 64 nt, Homo Sapiens
gcacacggugugaagggucuccugcugcacagggugcaggcauuaguucccaggcccugccagc

SEQ ID NO: 271664 - RNA, 64 nt, Homo Sapiens
cagaaaaggaggaggcacggcuggggcuguguucugcaggcagcccuguuugguuuuguuucuc

SEQ ID NO: 271665 - RNA, 64 nt, Homo Sapiens
guacccgaagaagcagaggcugccccaaugcaccugcaggcaagcuggcccaacagaaaaaccc

SEQ ID NO: 271666 - RNA, 64 nt, Homo Sapiens
cuuacacccacaguggaaagacagcuucucauccugcaggcagcuuuuucucucccacuagaca

SEQ ID NO: 271667 - RNA, 64 nt, Homo Sapiens
gggcugaggcauccuuccucacaccaggcuugccugcaggcaugagucagucugaugagaacuc

SEQ ID NO: 271668 - RNA, 64 nt, Homo Sapiens
cauguuuaauuugaacuaucucuagaaaagaauuugcaggcaacuguguuuugcguuuacuucc

SEQ ID NO: 271669 - RNA, 64 nt, Homo Sapiens
aaaaaaaccaccucacugcaaauguguauauaguugcaggcaaagugacgcagaauaguuuugc

SEQ ID NO: 271670 - RNA, 64 nt, Homo Sapiens
uguguaauaaauuauuuuugguuugaaaauuuaaugcaggcaggaagugcuuauuuuuauagaa

SEQ ID NO: 271671 - RNA, 64 nt, Homo Sapiens
agccacugcacccaaccccucaaagugcugggauugcaggcaugauccacccgccucagccucc

SEQ ID NO: 271672 - RNA, 64 nt, Homo Sapiens
ugggcccacuucauaucacaagacuucccaccauugcaggcagccacuucccaccauugcaggc

SEQ ID NO: 271673 - RNA, 64 nt, Homo Sapiens
cuucccaccauugcaggcagucacuucccaccauugcaggcagaaggagcccucccuccagugg

SEQ ID NO: 271674 - RNA, 64 nt, Homo Sapiens
uuuuaccuggccuccagggccuguugaugggcuuugcaggcaguccagcagcccacaccugcag

SEQ ID NO: 271675 - RNA, 64 nt, Homo Sapiens
gaugggcuuugcaggcaguccagcagcccacaccugcaggcaggaugcugucgucaaugagcug

SEQ ID NO: 271676 - RNA, 64 nt, Homo Sapiens
uucacuaaguagccuguguuuuuaaauccagggcugcaggcagcaacgcaagucaggcugaaca

SEQ ID NO: 271677 - RNA, 64 nt, Homo Sapiens
gacuccugggacuucugguccugggcacacuuuuugcaggcaacaaaaugugccugggagugau

SEQ ID NO: 271678 - RNA, 64 nt, Homo Sapiens
acaguuuaagaaugcauuccggcaaaaacaaaguugcaggcacacucggucugaacuucauccu

SEQ ID NO: 271679 - RNA, 64 nt, Homo Sapiens
ugggagcaacaggggcuucaaucaguagccguccugcaggcaggucccagaaggccuuuguaaa

SEQ ID NO: 271680 - RNA, 64 nt, Homo Sapiens
aaggcaugugaguguacguucucccgccaucugcugcaggcagguugagccccuugucccacca

SEQ ID NO: 271681 - RNA, 64 nt, Homo Sapiens
agccaccaugccuggcuguucaagcagccgggacugcaggcacaauccucccaccucagccucc

SEQ ID NO: 271682 - RNA, 64 nt, Homo Sapiens
uguuccccacagguccuccaucaccccugguggcugcaggcaccgcuggguucugacucuggac

SEQ ID NO: 271683 - RNA, 64 nt, Homo Sapiens
aaggcagaaggccaggaguaagcccaagcuaagcugcaggcacacacgccuucaugccagugca

SEQ ID NO: 271684 - RNA, 64 nt, Homo Sapiens
gacacaggaugaaggcaaugccauccucaaacacugcaggcaucacagcuaacaauugugaagu

SEQ ID NO: 271685 - RNA, 64 nt, Homo Sapiens
caguuuaaccugaugcagucacguggaggagcagugcaggcacaguaugucccauaggcccagu

SEQ ID NO: 271686 - RNA, 64 nt, Homo Sapiens
ccaagggcuggcgagggugggggcgggcaagggaugcaggcaggacagccaugagguggggcug

SEQ ID NO: 271687 - RNA, 64 nt, Homo Sapiens
caggagcacgaaggccugucauccauggggccauugcaggcacucugccgcccgaccuugaggg

SEQ ID NO: 271688 - RNA, 64 nt, Homo Sapiens
gugaguuuaguaaggcuguguacacugacaccuuugcaggcaugcaugugcuugugugugugug

SEQ ID NO: 271689 - RNA, 64 nt, Homo Sapiens
gucucugucaugguagagaccgagccucugucacugcaggcacucaaugcagccagaccuauuc

SEQ ID NO: 271690 - RNA, 64 nt, Homo Sapiens
cauuaugcugcuauugaagaucuggcuuagcagcugcaggcaagugcuccagcuccuccaaagu

SEQ ID NO: 271691 - RNA, 64 nt, Homo Sapiens
ccucugugguccuaagaccuuuauguuauugggaugcaggcaaagcuuuccacaucaagagucc

SEQ ID NO: 271692 - RNA, 64 nt, Homo Sapiens
acagacuuuugcagaggcgauggcagagagcagcugcaggcauggucccuggagccgagccuuc

SEQ ID NO: 271693 - RNA, 64 nt, Homo Sapiens
ucaggaggacuuaaugcuauuuauguugugccucugcaggcaaagcccuuaauaaauauuuuac

SEQ ID NO: 271694 - RNA, 64 nt, Homo Sapiens
cuggcugccugggagccccacaccaccgggccagugcaggcacuguggugaucccauaaaaggc

SEQ ID NO: 271695 - RNA, 64 nt, Homo Sapiens
ucgugcuguugcuucccguagauggcgagcaccuugcaggcagccuucugaucaguacugcucu

SEQ ID NO: 271696 - RNA, 64 nt, Homo Sapiens
uaauuggcuguugccuggggaacaggagagcugcugcaggcagaugaccucaugggggguggag

SEQ ID NO: 271697 - RNA, 64 nt, Homo Sapiens
acggcugcuaacagacugccacuugagugcgccuugcaggcacucccagagcagccauggaagg

SEQ ID NO: 271698 - RNA, 64 nt, Homo Sapiens
ccaaggaucucuuggcgacaguaccaagcacgguucucuacacaggugacugaaguugccucug

SEQ ID NO: 271699 - RNA, 64 nt, Homo Sapiens
uaaagaccagccugggcaacauagugagacuccgucucuacaaaaaauaaauuuagcugggcau

SEQ ID NO: 271700 - RNA, 64 nt, Homo Sapiens
gaggggagucuagggaauuucagugagcugauggucucuacagguacugaggcucaagccuuca

SEQ ID NO: 271701 - RNA, 64 nt, Homo Sapiens
gcacaacgaaaaacaacaaaauagcaagaccccgucucuacaaauugagacuagacugggcaac

SEQ ID NO: 271702 - RNA, 64 nt, Homo Sapiens
uuuccccucuacuaacaagauccucccagcuuucucucuacauguagaaaggauaacauuucuc

SEQ ID NO: 271703 - RNA, 64 nt, Homo Sapiens
ucaagaccaccuuggcgaacacggugaaaccccgucucuacaaaaaauacaaaaauuagccagg

SEQ ID NO: 271704 - RNA, 64 nt, Homo Sapiens
ccuuuauauuucauaccaucuucucuuacuguuuucucuacaguuuguaaacagcuuuuccuuu

SEQ ID NO: 271705 - RNA, 64 nt, Homo Sapiens
gccagccuggccugggcauugugcucacuccugcucucuacagagugcuuauuucuagugccuu

SEQ ID NO: 271706 - RNA, 64 nt, Homo Sapiens
gccaucuuacucugccuuucugcuuuggauguggucucuacacuaaccuucuugauguccaggg

SEQ ID NO: 271707 - RNA, 64 nt, Homo Sapiens
agagcaccagccagggcaacauagcgugacccugucucuacaaaaaauuaaaaagagaacauac

SEQ ID NO: 271708 - RNA, 64 nt, Homo Sapiens
agccaccuguuacuaagucaggaguguaguuggaucucuacauuaauguccucuugcugucuac

SEQ ID NO: 271709 - RNA, 64 nt, Homo Sapiens
gggaugauaguugaagggaggugaagaggcugcuucucuacagaggugaaauuccagaugaguc

SEQ ID NO: 271710 - RNA, 64 nt, Homo Sapiens
ugcagccuaaugagagugcacugcucccugggguucucuacaggccucuuccuguugugacugc

SEQ ID NO: 271711 - RNA, 64 nt, Homo Sapiens
uuaaguccagcuuggccaagguggugaaaucccaucucuacaaaaaaugcagaacuuaaucugg

SEQ ID NO: 271712 - RNA, 64 nt, Homo Sapiens
cugagacaagccuaggcaacaaaacaagacucugucucuacaaaaaguuuaagaaaugagccag

SEQ ID NO: 271713 - RNA, 64 nt, Homo Sapiens
ggcacucaagccugggcaauguagcaagauccugucucuacaagaaauuuuuuaaaaaugagcc

SEQ ID NO: 271714 - RNA, 64 nt, Homo Sapiens
uccuucucuccgugggauacuggguccacgcaucucucuacacuggaaugcgugaccccugaga

SEQ ID NO: 271715 - RNA, 64 nt, Homo Sapiens
aaauuuaaaaacuagccaggcacagcaagacccaucucuacaaguuaaagaccagccugggcaa

SEQ ID NO: 271716 - RNA, 64 nt, Homo Sapiens
ggaagagguggacaucugcauuacggcugccagaugccugcaugucuucccuaggacugacgag

SEQ ID NO: 271717 - RNA, 64 nt, Homo Sapiens
cucuaucuucuuugacccuuaagacugagcugguugccugcaucagggcagagaaauucccccg

SEQ ID NO: 271718 - RNA, 64 nt, Homo Sapiens
ccacaucgccuaccuacaaugcuccugggccugcugccugcacacacccucugaccucagcaga

SEQ ID NO: 271719 - RNA, 64 nt, Homo Sapiens
ugcacucuagugacccugggaggcucucuccuggugccugcaccaaccaagcuaugggugacag

SEQ ID NO: 271720 - RNA, 64 nt, Homo Sapiens
ugagaggagagaaauacacgccugcccaggaaggugccugcacacaguucugcuaggucugcuu

SEQ ID NO: 271721 - RNA, 64 nt, Homo Sapiens
ccucuggcagcuggcccagguccaggcauccuggugccugcauaugggcccccacugucccucc

SEQ ID NO: 271722 - RNA, 64 nt, Homo Sapiens
aguuucuauagcgagacauaggguauagucaauaugccugcaggauuuaguuuugucuuucuca

SEQ ID NO: 271723 - RNA, 64 nt, Homo Sapiens
cagacgaggccuuugcuuuacgugcaguuccugcugccugcaggcaucagacagaaggguaaug

SEQ ID NO: 271724 - RNA, 64 nt, Homo Sapiens
cuggccaggauagcuuaacccugacuuugggaucugccugcaucggcguuggccacugucccca

SEQ ID NO: 271725 - RNA, 64 nt, Homo Sapiens
ccacuguccccauuuacauuuuccccacucugucugccugcaucuccucuguuccggguaggcc

SEQ ID NO: 271726 - RNA, 64 nt, Homo Sapiens
cugcaugccugccccuucugcuuaccugcccugcugccugcacagcagcaaccugccuuucccc

SEQ ID NO: 271727 - RNA, 64 nt, Homo Sapiens
auacuuuucguuggggaagaagguaauuuacuccugccugcagaaugaguuuagccaacagaac

SEQ ID NO: 271728 - RNA, 64 nt, Homo Sapiens
agaaggaccuugcacugccuaccgagcucccucaugccugcaauuuaaauaccgagguguguuc

SEQ ID NO: 271729 - RNA, 64 nt, Homo Sapiens
ucccaccuccuuucucuguccucuccugagguucugccugcagcccccaggaggugggccugcc

SEQ ID NO: 271730 - RNA, 64 nt, Homo Sapiens
gcagucaggggucaggugucaggcccgucggagcugccugcagcacaugcgggcucgcccauac

SEQ ID NO: 271731 - RNA, 64 nt, Homo Sapiens
aagccugaacugaggccuugugugucaggcccucugccugcacucccuggccuugcccgucgug

SEQ ID NO: 271732 - RNA, 64 nt, Homo Sapiens
guuugauagaguagucuuggaaaccaucagguacugccugcagacuucuccagcacuaaauaua

SEQ ID NO: 271733 - RNA, 64 nt, Homo Sapiens
guuuauuuaucuaaaggaaucaaguccacucuucugccugcaacauuuguucaaaaacuaacca

SEQ ID NO: 271734 - RNA, 64 nt, Homo Sapiens
guaucuccaucuggucacugagcaugguagcagcugccugcauuggcuuguacccuggucacca

SEQ ID NO: 271735 - RNA, 64 nt, Homo Sapiens
cccacuuugcucacccuucccagccacagccugaugccugcagcgcuccaggcugaccacagau

SEQ ID NO: 271736 - RNA, 64 nt, Homo Sapiens
cugagccagugcuuuaauggccgguuugaaaauaugccugcaaugugauacuauccaguuacug

SEQ ID NO: 271737 - RNA, 59 nt, Homo Sapiens
auuugaauuuuaaaucuaaaugguuguccugccugcaaugucgaagagcaucccaguaa

SEQ ID NO: 271738 - RNA, 64 nt, Homo Sapiens
acuggacucaggaugcccagggccacucugccucugccugcauucugccgugugcccucgggcg

SEQ ID NO: 271739 - RNA, 64 nt, Homo Sapiens
gucugcuaacuuggagccccagugccaagcacagugccugcauguauuuauccaauaaauguga

SEQ ID NO: 271740 - RNA, 64 nt, Homo Sapiens
gggagagcaguugaggcccgagccgccugccgacugccugcacacccuggaccccuagaccccg

SEQ ID NO: 271741 - RNA, 64 nt, Homo Sapiens
cucgcaugcacgcugcccgcaaugucgucucgcaugccugcacccuuuauuuuugucugcugcc

SEQ ID NO: 271742 - RNA, 58 nt, Homo Sapiens
gcuccaugaucuccagguagugccgcgcugccugcaccuagugugcagaggggacggc

SEQ ID NO: 271743 - RNA, 64 nt, Homo Sapiens
agcccucuugcccggucgggucagcccuaguggcugccugcacacuguagacgucccagggccu

SEQ ID NO: 271744 - RNA, 64 nt, Homo Sapiens
accccagagaaggccccacccuugcuuugggagcugccugcaccuugcucuuugccaaaccuac

SEQ ID NO: 271745 - RNA, 64 nt, Homo Sapiens
ugccuucagagggaggcacacguggagcuggaacugccugcacuucucaacugguuucugucuc

SEQ ID NO: 271746 - RNA, 64 nt, Homo Sapiens
gggaaggaaacaaauguguaucucacgggcucuaugccugcacuccucauucagagacugcccu

SEQ ID NO: 271747 - RNA, 60 nt, Homo Sapiens
uccgcgggcugacugggccagggcccacccugccugcaccuccuccagcugccccaguga

SEQ ID NO: 271748 - RNA, 64 nt, Homo Sapiens
cuuugcgaccagagcccuuugccaggaccacccuugccugcagccaaaaguggucggcugcagu

SEQ ID NO: 271749 - RNA, 64 nt, Homo Sapiens
agagacacccaggaggaguuugcggagcugugagugccugcaggagucagguuguguccaggca

SEQ ID NO: 271750 - RNA, 64 nt, Homo Sapiens
ggcuguugugucgggcaguguaccaagggacaccugccugcaaaacauaagacagcccguaggc

SEQ ID NO: 271751 - RNA, 64 nt, Homo Sapiens
cuuuguaaugaagguuuggcuacuuguauaggucugccugcagggugaaaaugccagugugaau

SEQ ID NO: 271752 - RNA, 64 nt, Homo Sapiens
ucccauguaggccuaaagucaccccacuccuuagugccugcaccucaccacgauauugaggaag

SEQ ID NO: 271753 - RNA, 64 nt, Homo Sapiens
ugucauggcaacagaacgugggaugcuggaggcaugccugcagaaggacuguugaugcgaccca

SEQ ID NO: 271754 - RNA, 64 nt, Homo Sapiens
aggguggaccagcugccuggcauucaggcccagaugccugcagggcuggggcucucgggacaga

SEQ ID NO: 271755 - RNA, 64 nt, Homo Sapiens
acacuugccuuuaggccuguaggccuuuccugugugccugcaucucagggagggucucucucca

SEQ ID NO: 271756 - RNA, 64 nt, Homo Sapiens
uuaacaaguaugauacaagcagaggcuugagaagugccugcacaaugaggcuugcccacuuuug

SEQ ID NO: 271757 - RNA, 62 nt, Homo Sapiens
ggggguggggggugggggugggucagaacccugccauggaacuguuuccuucaucaugaguu

SEQ ID NO: 271758 - RNA, 62 nt, Homo Sapiens
uccucccucacccccuccuucauaugaaaggugccauggaagaggcuacagggccaaacgcu

SEQ ID NO: 271759 - RNA, 62 nt, Homo Sapiens
ccacccgcucccuuuuuuccuuagccuucagugccauggaacuaaucaagggaggaaaaggu

SEQ ID NO: 271760 - RNA, 62 nt, Homo Sapiens
augaaauaacuguccugucacaugugcagcaggccauggaguguagcgggcaucgcugccgc

SEQ ID NO: 271761 - RNA, 62 nt, Homo Sapiens
uggcccuaaacgcugugggagagagggguggcgccauggacgcuuuucaguugggaagaaag

SEQ ID NO: 271762 - RNA, 62 nt, Homo Sapiens
ggagaguuuguuacuuacgggaggaggggacugccauggaaagugugguaaagccauuggau

SEQ ID NO: 271763 - RNA, 62 nt, Homo Sapiens
guucuccuguugcagguuuccauguugcugaggccauggagauucccagagcuggucacacc

SEQ ID NO: 271764 - RNA, 62 nt, Homo Sapiens
gaccuuacucaggagcagauaucuccuuggccgccauggagccucauccauccacacgugcc

SEQ ID NO: 271765 - RNA, 62 nt, Homo Sapiens
gucaaaugauuuccacuucagucuucagguuugccauggaaaccucaaaaugcaugcccauu

SEQ ID NO: 271766 - RNA, 62 nt, Homo Sapiens
acuagaugguccuuuucacugguaaccuguuugccauggagcauagcucuagagcauggcuu

SEQ ID NO: 271767 - RNA, 62 nt, Homo Sapiens
ugguugcugcauuugagaggcggcggucugaggccauggagggaaaggcgagcagaaaacuc

SEQ ID NO: 271768 - RNA, 62 nt, Homo Sapiens
ccgaguagcugccuggaucgcggccggaggaggccauggagcccgcacgcaugcauccacug

SEQ ID NO: 271769 - RNA, 62 nt, Homo Sapiens
gggccugugggccagaggacuccaugacaguagccauggagucccaccugugccaggucaga

SEQ ID NO: 271770 - RNA, 62 nt, Homo Sapiens
ccagugacuuugacagugugcucacucucagagccauggauuaccuggaacaaagugcagau

SEQ ID NO: 271771 - RNA, 62 nt, Homo Sapiens
ggacacaagcggaccaaggaaugugguugaacgccauggacggcacuauccugaggagcgac

SEQ ID NO: 271772 - RNA, 62 nt, Homo Sapiens
cgacuacucucgccaacagaaugcacgauuuggccauggaucaaaguugucucuagauacag

SEQ ID NO: 271773 - RNA, 62 nt, Homo Sapiens
aagaaagggcaggugaggccuggguaaccccagccauggaccgucaguggcuggagggagcu

SEQ ID NO: 271774 - RNA, 62 nt, Homo Sapiens
caaguugauacgauggggugcuugguggaugggccauggagguccgugagcuggaacugggc

SEQ ID NO: 271775 - RNA, 64 nt, Homo Sapiens
aaagucucuaauucuauuaaagugcuaagguucuaaggccuacuuuuuuuuuuuuuuuuuuuuu

SEQ ID NO: 271776 - RNA, 64 nt, Homo Sapiens
cuaaagauucuauaguucuagacauggagguucuaaggccuaggauucuaaaaugugauguucu

SEQ ID NO: 271777 - RNA, 64 nt, Homo Sapiens
cggcaugccuucuguuucuccuucaaugcuccuuaaggccuaugugcugggaaaagggucuucc

SEQ ID NO: 271778 - RNA, 64 nt, Homo Sapiens
cuccagaugagucagugaguggugaaugaaugugaaggccuagggcauuacuguauacuacugu

SEQ ID NO: 271779 - RNA, 64 nt, Homo Sapiens
aacuccaucaauccaguccaagaggaggaggacgaaggccuagacucagcugaaggaucuucaa

SEQ ID NO: 271780 - RNA, 64 nt, Homo Sapiens
ucuucaaagcaggaugaagaccuagacuuaccugaaggccuagacucagcugaaggaucuucaa

SEQ ID NO: 271781 - RNA, 64 nt, Homo Sapiens
aggauccaacacaggcaauagagaaugacaugaauccagcaaauaugaaggaguacacaaacca

SEQ ID NO: 271782 - RNA, 64 nt, Homo Sapiens
ugaaggaguacacaaaccagguuggagaaaauacuccagcaaaagugcccuuuuuagggaagcu

SEQ ID NO: 271783 - RNA, 64 nt, Homo Sapiens
ugaggggugagaagugauguuuguuacuauguucuccagcaaguaaacauuccucugcucaccu

SEQ ID NO: 271784 - RNA, 64 nt, Homo Sapiens
cacuauuauguagugcauuuuaacuuaaauuuuuuccagcaacauguuacuuauuuaagauaca

SEQ ID NO: 271785 - RNA, 64 nt, Homo Sapiens
uuuauauauuuaguaauuuucuuuauguugaucuuccagcaacgaaauacuaaauucauccuca

SEQ ID NO: 271786 - RNA, 64 nt, Homo Sapiens
ucuuugagaaugcagucauuaagcaucgcacauguccagcaauguuucagcagaaaugaaggau

SEQ ID NO: 271787 - RNA, 64 nt, Homo Sapiens
uaaguugucuuuguagaaaaugaagagccuuucuuccagcaaaaaucccugcuguaugcaauag

SEQ ID NO: 271788 - RNA, 64 nt, Homo Sapiens
gaucuagggcagacacacaaccuccuccuccucuuccagcaaggaacgcaccgaaaagucacau

SEQ ID NO: 271789 - RNA, 64 nt, Homo Sapiens; identical to SEQ ID NO: 138011

SEQ ID NO: 271790 - RNA, 64 nt, Homo Sapiens; identical to SEQ ID NO: 138012

SEQ ID NO: 271791 - RNA, 64 nt, Homo Sapiens; identical to SEQ ID NO: 138013

SEQ ID NO: 271792 - RNA, 64 nt, Homo Sapiens; identical to SEQ ID NO: 138014

SEQ ID NO: 271793 - RNA, 64 nt, Homo Sapiens; identical to SEQ ID NO: 138015

SEQ ID NO: 271794 - RNA, 59 nt, Homo Sapiens; identical to SEQ ID NO: 138016

SEQ ID NO: 271795 - RNA, 64 nt, Homo Sapiens; identical to SEQ ID NO: 138017

SEQ ID NO: 271796 - RNA, 64 nt, Homo Sapiens; identical to SEQ ID NO: 138018

SEQ ID NO: 271797 - RNA, 64 nt, Homo Sapiens; identical to SEQ ID NO: 138019

SEQ ID NO: 271798 - RNA, 64 nt, Homo Sapiens; identical to SEQ ID NO: 138020

SEQ ID NO: 271799 - RNA, 64 nt, Homo Sapiens; identical to SEQ ID NO: 138021

SEQ ID NO: 271800 - RNA, 64 nt, Homo Sapiens; identical to SEQ ID NO: 138022

SEQ ID NO: 271801 - RNA, 64 nt, Homo Sapiens; identical to SEQ ID NO: 138023

SEQ ID NO: 271802 - RNA, 64 nt, Homo Sapiens; identical to SEQ ID NO: 138024

SEQ ID NO: 271803 - RNA, 64 nt, Homo Sapiens; identical to SEQ ID NO: 138025

SEQ ID NO: 271804 - RNA, 64 nt, Homo Sapiens; identical to SEQ ID NO: 138026

SEQ ID NO: 271805 - RNA, 64 nt, Homo Sapiens; identical to SEQ ID NO: 138027

SEQ ID NO: 271806 - RNA, 64 nt, Homo Sapiens; identical to SEQ ID NO: 138028

SEQ ID NO: 271807 - RNA, 64 nt, Homo Sapiens; identical to SEQ ID NO: 138029

SEQ ID NO: 271808 - RNA, 64 nt, Homo Sapiens; identical to SEQ ID NO: 138030

SEQ ID NO: 271809 - RNA, 64 nt, Homo Sapiens; identical to SEQ ID NO: 138031

SEQ ID NO: 271810 - RNA, 64 nt, Homo Sapiens; identical to SEQ ID NO: 138032

SEQ ID NO: 271811 - RNA, 64 nt, Homo Sapiens; identical to SEQ ID NO: 138033

SEQ ID NO: 271812 - RNA, 64 nt, Homo Sapiens; identical to SEQ ID NO: 138034

SEQ ID NO: 271813 - RNA, 64 nt, Homo Sapiens; identical to SEQ ID NO: 138035

SEQ ID NO: 271814 - RNA, 64 nt, Homo Sapiens; identical to SEQ ID NO: 138036

SEQ ID NO: 271815 - RNA, 64 nt, Homo Sapiens; identical to SEQ ID NO: 138037

SEQ ID NO: 271816 - RNA, 64 nt, Homo Sapiens; identical to SEQ ID NO: 138038

SEQ ID NO: 271817 - RNA, 64 nt, Homo Sapiens; identical to SEQ ID NO: 138039

SEQ ID NO: 271818 - RNA, 64 nt, Homo Sapiens; identical to SEQ ID NO: 138040

SEQ ID NO: 271819 - RNA, 64 nt, Homo Sapiens; identical to SEQ ID NO: 138041

SEQ ID NO: 271820 - RNA, 64 nt, Homo Sapiens; identical to SEQ ID NO: 138042

SEQ ID NO: 271821 - RNA, 64 nt, Homo Sapiens; identical to SEQ ID NO: 138043

SEQ ID NO: 271822 - RNA, 64 nt, Homo Sapiens; identical to SEQ ID NO: 138044

SEQ ID NO: 271823 - RNA, 64 nt, Homo Sapiens; identical to SEQ ID NO: 138045

SEQ ID NO: 271824 - RNA, 64 nt, Homo Sapiens; identical to SEQ ID NO: 138046

SEQ ID NO: 271825 - RNA, 64 nt, Homo Sapiens; identical to SEQ ID NO: 138047

SEQ ID NO: 271826 - RNA, 64 nt, Homo Sapiens; identical to SEQ ID NO: 138048

SEQ ID NO: 271827 - RNA, 64 nt, Homo Sapiens; identical to SEQ ID NO: 138049

SEQ ID NO: 271828 - RNA, 64 nt, Homo Sapiens; identical to SEQ ID NO: 138050

SEQ ID NO: 271829 - RNA, 64 nt, Homo Sapiens; identical to SEQ ID NO: 138051

SEQ ID NO: 271830 - RNA, 64 nt, Homo Sapiens; identical to SEQ ID NO: 138052

SEQ ID NO: 271831 - RNA, 64 nt, Homo Sapiens; identical to SEQ ID NO: 138053

SEQ ID NO: 271832 - RNA, 64 nt, Homo Sapiens; identical to SEQ ID NO: 138054

SEQ ID NO: 271833 - RNA, 64 nt, Homo Sapiens; identical to SEQ ID NO: 138055

SEQ ID NO: 271834 - RNA, 64 nt, Homo Sapiens; identical to SEQ ID NO: 138056

SEQ ID NO: 271835 - RNA, 64 nt, Homo Sapiens; identical to SEQ ID NO: 138057

SEQ ID NO: 271836 - RNA, 64 nt, Homo Sapiens; identical to SEQ ID NO: 138058

SEQ ID NO: 271837 - RNA, 64 nt, Homo Sapiens; identical to SEQ ID NO: 138059

SEQ ID NO: 271838 - RNA, 64 nt, Homo Sapiens; identical to SEQ ID NO: 138060

SEQ ID NO: 271839 - RNA, 64 nt, Homo Sapiens; identical to SEQ ID NO: 138061

SEQ ID NO: 271840 - RNA, 64 nt, Homo Sapiens; identical to SEQ ID NO: 138062

SEQ ID NO: 271841 - RNA, 64 nt, Homo Sapiens; identical to SEQ ID NO: 138063

SEQ ID NO: 271842 - RNA, 64 nt, Homo Sapiens; identical to SEQ ID NO: 138064

SEQ ID NO: 271843 - RNA, 64 nt, Homo Sapiens; identical to SEQ ID NO: 138065

SEQ ID NO: 271844 - RNA, 64 nt, Homo Sapiens; identical to SEQ ID NO: 138066

SEQ ID NO: 271845 - RNA, 64 nt, Homo Sapiens; identical to SEQ ID NO: 156991

SEQ ID NO: 271846 - RNA, 64 nt, Homo Sapiens; identical to SEQ ID NO: 156992

SEQ ID NO: 271847 - RNA, 64 nt, Homo Sapiens; identical to SEQ ID NO: 156993

SEQ ID NO: 271848 - RNA, 64 nt, Homo Sapiens; identical to SEQ ID NO: 156994

SEQ ID NO: 271849 - RNA, 64 nt, Homo Sapiens; identical to SEQ ID NO: 156995

SEQ ID NO: 271850 - RNA, 64 nt, Homo Sapiens; identical to SEQ ID NO: 156996

SEQ ID NO: 271851 - RNA, 64 nt, Homo Sapiens; identical to SEQ ID NO: 156997

SEQ ID NO: 271852 - RNA, 64 nt, Homo Sapiens; identical to SEQ ID NO: 156998

SEQ ID NO: 271853 - RNA, 64 nt, Homo Sapiens; identical to SEQ ID NO: 156999

SEQ ID NO: 271854 - RNA, 64 nt, Homo Sapiens; identical to SEQ ID NO: 157000

SEQ ID NO: 271855 - RNA, 64 nt, Homo Sapiens; identical to SEQ ID NO: 157001

SEQ ID NO: 271856 - RNA, 64 nt, Homo Sapiens; identical to SEQ ID NO: 157002

SEQ ID NO: 271857 - RNA, 64 nt, Homo Sapiens; identical to SEQ ID NO: 157003

SEQ ID NO: 271858 - RNA, 64 nt, Homo Sapiens; identical to SEQ ID NO: 157004

SEQ ID NO: 271859 - RNA, 64 nt, Homo Sapiens; identical to SEQ ID NO: 157005

SEQ ID NO: 271860 - RNA, 64 nt, Homo Sapiens; identical to SEQ ID NO: 157006

SEQ ID NO: 271861 - RNA, 64 nt, Homo Sapiens; identical to SEQ ID NO: 157007

SEQ ID NO: 271862 - RNA, 64 nt, Homo Sapiens; identical to SEQ ID NO: 157008

SEQ ID NO: 271863 - RNA, 64 nt, Homo Sapiens; identical to SEQ ID NO: 157009

SEQ ID NO: 271864 - RNA, 64 nt, Homo Sapiens; identical to SEQ ID NO: 157010

SEQ ID NO: 271865 - RNA, 64 nt, Homo Sapiens; identical to SEQ ID NO: 157011

SEQ ID NO: 271866 - RNA, 64 nt, Homo Sapiens; identical to SEQ ID NO: 157012

SEQ ID NO: 271867 - RNA, 64 nt, Homo Sapiens; identical to SEQ ID NO: 157013

SEQ ID NO: 271868 - RNA, 64 nt, Homo Sapiens; identical to SEQ ID NO: 157014

SEQ ID NO: 271869 - RNA, 64 nt, Homo Sapiens; identical to SEQ ID NO: 157015

SEQ ID NO: 271870 - RNA, 64 nt, Homo Sapiens; identical to SEQ ID NO: 157016

SEQ ID NO: 271871 - RNA, 64 nt, Homo Sapiens; identical to SEQ ID NO: 157017

SEQ ID NO: 271872 - RNA, 64 nt, Homo Sapiens; identical to SEQ ID NO: 157018

SEQ ID NO: 271873 - RNA, 64 nt, Homo Sapiens; identical to SEQ ID NO: 157019

SEQ ID NO: 271874 - RNA, 64 nt, Homo Sapiens; identical to SEQ ID NO: 157020

SEQ ID NO: 271875 - RNA, 64 nt, Homo Sapiens; identical to SEQ ID NO: 157021

SEQ ID NO: 271876 - RNA, 64 nt, Homo Sapiens; identical to SEQ ID NO: 157022

SEQ ID NO: 271877 - RNA, 64 nt, Homo Sapiens; identical to SEQ ID NO: 157023

SEQ ID NO: 271878 - RNA, 64 nt, Homo Sapiens; identical to SEQ ID NO: 157024

SEQ ID NO: 271879 - RNA, 64 nt, Homo Sapiens; identical to SEQ ID NO: 157025

SEQ ID NO: 271880 - RNA, 64 nt, Homo Sapiens; identical to SEQ ID NO: 157026

SEQ ID NO: 271881 - RNA, 64 nt, Homo Sapiens; identical to SEQ ID NO: 157027

SEQ ID NO: 271882 - RNA, 64 nt, Homo Sapiens; identical to SEQ ID NO: 157028

SEQ ID NO: 271883 - RNA, 64 nt, Homo Sapiens; identical to SEQ ID NO: 157029

SEQ ID NO: 271884 - RNA, 64 nt, Homo Sapiens; identical to SEQ ID NO: 157030

SEQ ID NO: 271885 - RNA, 64 nt, Homo Sapiens; identical to SEQ ID NO: 157031

SEQ ID NO: 271886 - RNA, 64 nt, Homo Sapiens; identical to SEQ ID NO: 157032

SEQ ID NO: 271887 - RNA, 64 nt, Homo Sapiens; identical to SEQ ID NO: 157033

SEQ ID NO: 271888 - RNA, 64 nt, Homo Sapiens; identical to SEQ ID NO: 157034

SEQ ID NO: 271889 - RNA, 64 nt, Homo Sapiens; identical to SEQ ID NO: 157035

SEQ ID NO: 271890 - RNA, 64 nt, Homo Sapiens; identical to SEQ ID NO: 157036

SEQ ID NO: 271891 - RNA, 64 nt, Homo Sapiens; identical to SEQ ID NO: 157037

SEQ ID NO: 271892 - RNA, 64 nt, Homo Sapiens; identical to SEQ ID NO: 157038

SEQ ID NO: 271893 - RNA, 64 nt, Homo Sapiens; identical to SEQ ID NO: 157039

SEQ ID NO: 271894 - RNA, 64 nt, Homo Sapiens; identical to SEQ ID NO: 157040

SEQ ID NO: 271895 - RNA, 64 nt, Homo Sapiens; identical to SEQ ID NO: 157041

SEQ ID NO: 271896 - RNA, 64 nt, Homo Sapiens; identical to SEQ ID NO: 157042

SEQ ID NO: 271897 - RNA, 64 nt, Homo Sapiens; identical to SEQ ID NO: 157043

SEQ ID NO: 271898 - RNA, 64 nt, Homo Sapiens; identical to SEQ ID NO: 157044

SEQ ID NO: 271899 - RNA, 64 nt, Homo Sapiens; identical to SEQ ID NO: 157045

SEQ ID NO: 271900 - RNA, 64 nt, Homo Sapiens; identical to SEQ ID NO: 157046

SEQ ID NO: 271901 - RNA, 64 nt, Homo Sapiens; identical to SEQ ID NO: 157047

SEQ ID NO: 271902 - RNA, 64 nt, Homo Sapiens; identical to SEQ ID NO: 157048

SEQ ID NO: 271903 - RNA, 64 nt, Homo Sapiens; identical to SEQ ID NO: 157049

SEQ ID NO: 271904 - RNA, 64 nt, Homo Sapiens; identical to SEQ ID NO: 157050

SEQ ID NO: 271905 - RNA, 64 nt, Homo Sapiens; identical to SEQ ID NO: 157051

SEQ ID NO: 271906 - RNA, 64 nt, Homo Sapiens; identical to SEQ ID NO: 157052

SEQ ID NO: 271907 - RNA, 64 nt, Homo Sapiens; identical to SEQ ID NO: 157053

SEQ ID NO: 271908 - RNA, 64 nt, Homo Sapiens; identical to SEQ ID NO: 157054

SEQ ID NO: 271909 - RNA, 64 nt, Homo Sapiens; identical to SEQ ID NO: 157055

SEQ ID NO: 271910 - RNA, 64 nt, Homo Sapiens; identical to SEQ ID NO: 157056

SEQ ID NO: 271911 - RNA, 64 nt, Homo Sapiens; identical to SEQ ID NO: 157057

SEQ ID NO: 271912 - RNA, 64 nt, Homo Sapiens; identical to SEQ ID NO: 157058

SEQ ID NO: 271913 - RNA, 64 nt, Homo Sapiens; identical to SEQ ID NO: 157059

SEQ ID NO: 271914 - RNA, 64 nt, Homo Sapiens; identical to SEQ ID NO: 157060

SEQ ID NO: 271915 - RNA, 64 nt, Homo Sapiens; identical to SEQ ID NO: 157061

SEQ ID NO: 271916 - RNA, 64 nt, Homo Sapiens; identical to SEQ ID NO: 157062

SEQ ID NO: 271917 - RNA, 64 nt, Homo Sapiens; identical to SEQ ID NO: 157063

SEQ ID NO: 271918 - RNA, 64 nt, Homo Sapiens; identical to SEQ ID NO: 157064

SEQ ID NO: 271919 - RNA, 64 nt, Homo Sapiens; identical to SEQ ID NO: 157065

SEQ ID NO: 271920 - RNA, 64 nt, Homo Sapiens; identical to SEQ ID NO: 157066

SEQ ID NO: 271921 - RNA, 64 nt, Homo Sapiens; identical to SEQ ID NO: 157067

SEQ ID NO: 271922 - RNA, 64 nt, Homo Sapiens; identical to SEQ ID NO: 157068

SEQ ID NO: 271923 - RNA, 64 nt, Homo Sapiens; identical to SEQ ID NO: 157069

SEQ ID NO: 271924 - RNA, 64 nt, Homo Sapiens; identical to SEQ ID NO: 157070

SEQ ID NO: 271925 - RNA, 64 nt, Homo Sapiens; identical to SEQ ID NO: 157071

SEQ ID NO: 271926 - RNA, 64 nt, Homo Sapiens; identical to SEQ ID NO: 157072

SEQ ID NO: 271927 - RNA, 64 nt, Homo Sapiens; identical to SEQ ID NO: 157073

SEQ ID NO: 271928 - RNA, 64 nt, Homo Sapiens; identical to SEQ ID NO: 157074

SEQ ID NO: 271929 - RNA, 64 nt, Homo Sapiens; identical to SEQ ID NO: 157075

SEQ ID NO: 271930 - RNA, 64 nt, Homo Sapiens; identical to SEQ ID NO: 157076

SEQ ID NO: 271931 - RNA, 64 nt, Homo Sapiens; identical to SEQ ID NO: 157077

SEQ ID NO: 271932 - RNA, 64 nt, Homo Sapiens; identical to SEQ ID NO: 157078

SEQ ID NO: 271933 - RNA, 64 nt, Homo Sapiens; identical to SEQ ID NO: 157079

SEQ ID NO: 271934 - RNA, 64 nt, Homo Sapiens; identical to SEQ ID NO: 157080

SEQ ID NO: 271935 - RNA, 64 nt, Homo Sapiens; identical to SEQ ID NO: 157081

SEQ ID NO: 271936 - RNA, 64 nt, Homo Sapiens; identical to SEQ ID NO: 157082

SEQ ID NO: 271937 - RNA, 64 nt, Homo Sapiens; identical to SEQ ID NO: 157083

SEQ ID NO: 271938 - RNA, 64 nt, Homo Sapiens; identical to SEQ ID NO: 157084

SEQ ID NO: 271939 - RNA, 64 nt, Homo Sapiens; identical to SEQ ID NO: 157085

SEQ ID NO: 271940 - RNA, 64 nt, Homo Sapiens; identical to SEQ ID NO: 157086

SEQ ID NO: 271941 - RNA, 64 nt, Homo Sapiens; identical to SEQ ID NO: 157087

SEQ ID NO: 271942 - RNA, 64 nt, Homo Sapiens; identical to SEQ ID NO: 157088

SEQ ID NO: 271943 - RNA, 64 nt, Homo Sapiens; identical to SEQ ID NO: 157089

SEQ ID NO: 271944 - RNA, 64 nt, Homo Sapiens; identical to SEQ ID NO: 157090

SEQ ID NO: 271945 - RNA, 64 nt, Homo Sapiens; identical to SEQ ID NO: 157091

SEQ ID NO: 271946 - RNA, 64 nt, Homo Sapiens; identical to SEQ ID NO: 157092

SEQ ID NO: 271947 - RNA, 64 nt, Homo Sapiens; identical to SEQ ID NO: 157093

SEQ ID NO: 271948 - RNA, 64 nt, Homo Sapiens; identical to SEQ ID NO: 157094

SEQ ID NO: 271949 - RNA, 64 nt, Homo Sapiens; identical to SEQ ID NO: 157095

SEQ ID NO: 271950 - RNA, 64 nt, Homo Sapiens; identical to SEQ ID NO: 157096

SEQ ID NO: 271951 - RNA, 64 nt, Homo Sapiens; identical to SEQ ID NO: 157097

SEQ ID NO: 271952 - RNA, 64 nt, Homo Sapiens; identical to SEQ ID NO: 157098

SEQ ID NO: 271953 - RNA, 64 nt, Homo Sapiens; identical to SEQ ID NO: 157099

SEQ ID NO: 271954 - RNA, 64 nt, Homo Sapiens; identical to SEQ ID NO: 157100

SEQ ID NO: 271955 - RNA, 64 nt, Homo Sapiens; identical to SEQ ID NO: 157101

SEQ ID NO: 271956 - RNA, 64 nt, Homo Sapiens; identical to SEQ ID NO: 157102

SEQ ID NO: 271957 - RNA, 64 nt, Homo Sapiens; identical to SEQ ID NO: 157103

SEQ ID NO: 271958 - RNA, 64 nt, Homo Sapiens; identical to SEQ ID NO: 157104

SEQ ID NO: 271959 - RNA, 64 nt, Homo Sapiens; identical to SEQ ID NO: 157105

SEQ ID NO: 271960 - RNA, 64 nt, Homo Sapiens; identical to SEQ ID NO: 157106

SEQ ID NO: 271961 - RNA, 64 nt, Homo Sapiens; identical to SEQ ID NO: 157107

SEQ ID NO: 271962 - RNA, 64 nt, Homo Sapiens; identical to SEQ ID NO: 157108

SEQ ID NO: 271963 - RNA, 64 nt, Homo Sapiens; identical to SEQ ID NO: 157109

SEQ ID NO: 271964 - RNA, 64 nt, Homo Sapiens; identical to SEQ ID NO: 157110

SEQ ID NO: 271965 - RNA, 64 nt, Homo Sapiens; identical to SEQ ID NO: 157111

SEQ ID NO: 271966 - RNA, 64 nt, Homo Sapiens; identical to SEQ ID NO: 157112

SEQ ID NO: 271967 - RNA, 64 nt, Homo Sapiens; identical to SEQ ID NO: 157113

SEQ ID NO: 271968 - RNA, 64 nt, Homo Sapiens; identical to SEQ ID NO: 157114

SEQ ID NO: 271969 - RNA, 64 nt, Homo Sapiens; identical to SEQ ID NO: 157115

SEQ ID NO: 271970 - RNA, 64 nt, Homo Sapiens; identical to SEQ ID NO: 157116

SEQ ID NO: 271971 - RNA, 64 nt, Homo Sapiens; identical to SEQ ID NO: 157117

SEQ ID NO: 271972 - RNA, 64 nt, Homo Sapiens; identical to SEQ ID NO: 157118

SEQ ID NO: 271973 - RNA, 64 nt, Homo Sapiens; identical to SEQ ID NO: 157119

SEQ ID NO: 271974 - RNA, 64 nt, Homo Sapiens; identical to SEQ ID NO: 157120

SEQ ID NO: 271975 - RNA, 50 nt, Homo Sapiens; identical to SEQ ID NO: 157121

SEQ ID NO: 271976 - RNA, 52 nt, Homo Sapiens; identical to SEQ ID NO: 157122

SEQ ID NO: 271977 - RNA, 54 nt, Homo Sapiens; identical to SEQ ID NO: 157123

SEQ ID NO: 271978 - RNA, 56 nt, Homo Sapiens; identical to SEQ ID NO: 157124

SEQ ID NO: 271979 - RNA, 58 nt, Homo Sapiens; identical to SEQ ID NO: 157125

SEQ ID NO: 271980 - RNA, 60 nt, Homo Sapiens; identical to SEQ ID NO: 157126

SEQ ID NO: 271981 - RNA, 62 nt, Homo Sapiens; identical to SEQ ID NO: 157127

SEQ ID NO: 271982 - RNA, 64 nt, Homo Sapiens; identical to SEQ ID NO: 157128

SEQ ID NO: 271983 - RNA, 64 nt, Homo Sapiens; identical to SEQ ID NO: 157129

SEQ ID NO: 271984 - RNA, 64 nt, Homo Sapiens; identical to SEQ ID NO: 157130

SEQ ID NO: 271985 - RNA, 64 nt, Homo Sapiens; identical to SEQ ID NO: 157131

SEQ ID NO: 271986 - RNA, 64 nt, Homo Sapiens; identical to SEQ ID NO: 157132

SEQ ID NO: 271987 - RNA, 64 nt, Homo Sapiens; identical to SEQ ID NO: 157133

SEQ ID NO: 271988 - RNA, 64 nt, Homo Sapiens; identical to SEQ ID NO: 157134

SEQ ID NO: 271989 - RNA, 64 nt, Homo Sapiens; identical to SEQ ID NO: 157135

SEQ ID NO: 271990 - RNA, 64 nt, Homo Sapiens; identical to SEQ ID NO: 157136

SEQ ID NO: 271991 - RNA, 64 nt, Homo Sapiens; identical to SEQ ID NO: 157137

SEQ ID NO: 271992 - RNA, 64 nt, Homo Sapiens; identical to SEQ ID NO: 157138

SEQ ID NO: 271993 - RNA, 64 nt, Homo Sapiens; identical to SEQ ID NO: 157139

SEQ ID NO: 271994 - RNA, 64 nt, Homo Sapiens; identical to SEQ ID NO: 157140

SEQ ID NO: 271995 - RNA, 64 nt, Homo Sapiens; identical to SEQ ID NO: 157141

SEQ ID NO: 271996 - RNA, 64 nt, Homo Sapiens; identical to SEQ ID NO: 157142

SEQ ID NO: 271997 - RNA, 64 nt, Homo Sapiens; identical to SEQ ID NO: 157143

SEQ ID NO: 271998 - RNA, 64 nt, Homo Sapiens; identical to SEQ ID NO: 157144

SEQ ID NO: 271999 - RNA, 64 nt, Homo Sapiens; identical to SEQ ID NO: 157145

SEQ ID NO: 272000 - RNA, 64 nt, Homo Sapiens; identical to SEQ ID NO: 157146

SEQ ID NO: 272001 - RNA, 64 nt, Homo Sapiens; identical to SEQ ID NO: 157147

SEQ ID NO: 272002 - RNA, 64 nt, Homo Sapiens; identical to SEQ ID NO: 157148

SEQ ID NO: 272003 - RNA, 64 nt, Homo Sapiens; identical to SEQ ID NO: 157149

SEQ ID NO: 272004 - RNA, 64 nt, Homo Sapiens; identical to SEQ ID NO: 157150

SEQ ID NO: 272005 - RNA, 64 nt, Homo Sapiens; identical to SEQ ID NO: 157151

SEQ ID NO: 272006 - RNA, 64 nt, Homo Sapiens; identical to SEQ ID NO: 157152

SEQ ID NO: 272007 - RNA, 64 nt, Homo Sapiens; identical to SEQ ID NO: 157153

SEQ ID NO: 272008 - RNA, 64 nt, Homo Sapiens; identical to SEQ ID NO: 157154

SEQ ID NO: 272009 - RNA, 64 nt, Homo Sapiens; identical to SEQ ID NO: 157155

SEQ ID NO: 272010 - RNA, 64 nt, Homo Sapiens; identical to SEQ ID NO: 157156

SEQ ID NO: 272011 - RNA, 64 nt, Homo Sapiens; identical to SEQ ID NO: 157157

SEQ ID NO: 272012 - RNA, 64 nt, Homo Sapiens; identical to SEQ ID NO: 157158

SEQ ID NO: 272013 - RNA, 64 nt, Homo Sapiens; identical to SEQ ID NO: 157159

SEQ ID NO: 272014 - RNA, 64 nt, Homo Sapiens; identical to SEQ ID NO: 157160

SEQ ID NO: 272015 - RNA, 64 nt, Homo Sapiens; identical to SEQ ID NO: 157161

SEQ ID NO: 272016 - RNA, 64 nt, Homo Sapiens; identical to SEQ ID NO: 157162

SEQ ID NO: 272017 - RNA, 64 nt, Homo Sapiens; identical to SEQ ID NO: 157163

SEQ ID NO: 272018 - RNA, 64 nt, Homo Sapiens; identical to SEQ ID NO: 157164

SEQ ID NO: 272019 - RNA, 64 nt, Homo Sapiens; identical to SEQ ID NO: 157165

SEQ ID NO: 272020 - RNA, 64 nt, Homo Sapiens; identical to SEQ ID NO: 157166

SEQ ID NO: 272021 - RNA, 64 nt, Homo Sapiens; identical to SEQ ID NO: 157167

SEQ ID NO: 272022 - RNA, 64 nt, Homo Sapiens; identical to SEQ ID NO: 157168

SEQ ID NO: 272023 - RNA, 64 nt, Homo Sapiens; identical to SEQ ID NO: 157169

SEQ ID NO: 272024 - RNA, 64 nt, Homo Sapiens; identical to SEQ ID NO: 157170

SEQ ID NO: 272025 - RNA, 64 nt, Homo Sapiens; identical to SEQ ID NO: 157171

SEQ ID NO: 272026 - RNA, 64 nt, Homo Sapiens; identical to SEQ ID NO: 157172

SEQ ID NO: 272027 - RNA, 64 nt, Homo Sapiens; identical to SEQ ID NO: 157173

SEQ ID NO: 272028 - RNA, 64 nt, Homo Sapiens; identical to SEQ ID NO: 157174

SEQ ID NO: 272029 - RNA, 64 nt, Homo Sapiens; identical to SEQ ID NO: 157175

SEQ ID NO: 272030 - RNA, 64 nt, Homo Sapiens; identical to SEQ ID NO: 157176

SEQ ID NO: 272031 - RNA, 64 nt, Homo Sapiens; identical to SEQ ID NO: 157177

SEQ ID NO: 272032 - RNA, 64 nt, Homo Sapiens; identical to SEQ ID NO: 157178

SEQ ID NO: 272033 - RNA, 64 nt, Homo Sapiens; identical to SEQ ID NO: 157179

SEQ ID NO: 272034 - RNA, 64 nt, Homo Sapiens; identical to SEQ ID NO: 157180

SEQ ID NO: 272035 - RNA, 64 nt, Homo Sapiens; identical to SEQ ID NO: 157181

SEQ ID NO: 272036 - RNA, 64 nt, Homo Sapiens; identical to SEQ ID NO: 157182

SEQ ID NO: 272037 - RNA, 64 nt, Homo Sapiens; identical to SEQ ID NO: 157183

SEQ ID NO: 272038 - RNA, 64 nt, Homo Sapiens; identical to SEQ ID NO: 157184

SEQ ID NO: 272039 - RNA, 64 nt, Homo Sapiens; identical to SEQ ID NO: 157185

SEQ ID NO: 272040 - RNA, 64 nt, Homo Sapiens; identical to SEQ ID NO: 157186

SEQ ID NO: 272041 - RNA, 64 nt, Homo Sapiens; identical to SEQ ID NO: 157187

SEQ ID NO: 272042 - RNA, 64 nt, Homo Sapiens; identical to SEQ ID NO: 157188

SEQ ID NO: 272043 - RNA, 64 nt, Homo Sapiens; identical to SEQ ID NO: 157189

SEQ ID NO: 272044 - RNA, 64 nt, Homo Sapiens; identical to SEQ ID NO: 157190

SEQ ID NO: 272045 - RNA, 64 nt, Homo Sapiens; identical to SEQ ID NO: 157191

SEQ ID NO: 272046 - RNA, 64 nt, Homo Sapiens; identical to SEQ ID NO: 157192

SEQ ID NO: 272047 - RNA, 64 nt, Homo Sapiens; identical to SEQ ID NO: 157193

SEQ ID NO: 272048 - RNA, 64 nt, Homo Sapiens; identical to SEQ ID NO: 157194

SEQ ID NO: 272049 - RNA, 64 nt, Homo Sapiens; identical to SEQ ID NO: 157195

SEQ ID NO: 272050 - RNA, 64 nt, Homo Sapiens; identical to SEQ ID NO: 157196

SEQ ID NO: 272051 - RNA, 64 nt, Homo Sapiens; identical to SEQ ID NO: 157197

SEQ ID NO: 272052 - RNA, 64 nt, Homo Sapiens; identical to SEQ ID NO: 157198

SEQ ID NO: 272053 - RNA, 64 nt, Homo Sapiens; identical to SEQ ID NO: 157199

SEQ ID NO: 272054 - RNA, 64 nt, Homo Sapiens; identical to SEQ ID NO: 157200

SEQ ID NO: 272055 - RNA, 64 nt, Homo Sapiens; identical to SEQ ID NO: 157201

SEQ ID NO: 272056 - RNA, 64 nt, Homo Sapiens; identical to SEQ ID NO: 157202

SEQ ID NO: 272057 - RNA, 64 nt, Homo Sapiens; identical to SEQ ID NO: 157203

SEQ ID NO: 272058 - RNA, 64 nt, Homo Sapiens; identical to SEQ ID NO: 157204

SEQ ID NO: 272059 - RNA, 64 nt, Homo Sapiens; identical to SEQ ID NO: 157205

SEQ ID NO: 272060 - RNA, 64 nt, Homo Sapiens; identical to SEQ ID NO: 157206

SEQ ID NO: 272061 - RNA, 64 nt, Homo Sapiens; identical to SEQ ID NO: 157207

SEQ ID NO: 272062 - RNA, 64 nt, Homo Sapiens; identical to SEQ ID NO: 157208

SEQ ID NO: 272063 - RNA, 64 nt, Homo Sapiens; identical to SEQ ID NO: 157209

SEQ ID NO: 272064 - RNA, 64 nt, Homo Sapiens; identical to SEQ ID NO: 157210

SEQ ID NO: 272065 - RNA, 64 nt, Homo Sapiens; identical to SEQ ID NO: 157211

SEQ ID NO: 272066 - RNA, 64 nt, Homo Sapiens; identical to SEQ ID NO: 157212

SEQ ID NO: 272067 - RNA, 64 nt, Homo Sapiens; identical to SEQ ID NO: 157213

SEQ ID NO: 272068 - RNA, 64 nt, Homo Sapiens; identical to SEQ ID NO: 157214

SEQ ID NO: 272069 - RNA, 64 nt, Homo Sapiens; identical to SEQ ID NO: 157215

SEQ ID NO: 272070 - RNA, 64 nt, Homo Sapiens; identical to SEQ ID NO: 157216

SEQ ID NO: 272071 - RNA, 64 nt, Homo Sapiens; identical to SEQ ID NO: 157217

SEQ ID NO: 272072 - RNA, 64 nt, Homo Sapiens; identical to SEQ ID NO: 157218

SEQ ID NO: 272073 - RNA, 64 nt, Homo Sapiens; identical to SEQ ID NO: 157219

SEQ ID NO: 272074 - RNA, 64 nt, Homo Sapiens; identical to SEQ ID NO: 157220

SEQ ID NO: 272075 - RNA, 64 nt, Homo Sapiens; identical to SEQ ID NO: 157221

SEQ ID NO: 272076 - RNA, 64 nt, Homo Sapiens; identical to SEQ ID NO: 157222

SEQ ID NO: 272077 - RNA, 64 nt, Homo Sapiens; identical to SEQ ID NO: 157223

SEQ ID NO: 272078 - RNA, 64 nt, Homo Sapiens; identical to SEQ ID NO: 157224

SEQ ID NO: 272079 - RNA, 64 nt, Homo Sapiens; identical to SEQ ID NO: 157225

SEQ ID NO: 272080 - RNA, 64 nt, Homo Sapiens; identical to SEQ ID NO: 157226

SEQ ID NO: 272081 - RNA, 64 nt, Homo Sapiens; identical to SEQ ID NO: 157227

SEQ ID NO: 272082 - RNA, 64 nt, Homo Sapiens; identical to SEQ ID NO: 157228

SEQ ID NO: 272083 - RNA, 64 nt, Homo Sapiens; identical to SEQ ID NO: 157229

SEQ ID NO: 272084 - RNA, 64 nt, Homo Sapiens; identical to SEQ ID NO: 157230

SEQ ID NO: 272085 - RNA, 64 nt, Homo Sapiens; identical to SEQ ID NO: 157231

SEQ ID NO: 272086 - RNA, 63 nt, Homo Sapiens; identical to SEQ ID NO: 157232

SEQ ID NO: 272087 - RNA, 64 nt, Homo Sapiens; identical to SEQ ID NO: 157233

SEQ ID NO: 272088 - RNA, 64 nt, Homo Sapiens; identical to SEQ ID NO: 157234

SEQ ID NO: 272089 - RNA, 64 nt, Homo Sapiens; identical to SEQ ID NO: 157235

SEQ ID NO: 272090 - RNA, 64 nt, Homo Sapiens; identical to SEQ ID NO: 157236

SEQ ID NO: 272091 - RNA, 64 nt, Homo Sapiens; identical to SEQ ID NO: 157237

SEQ ID NO: 272092 - RNA, 64 nt, Homo Sapiens; identical to SEQ ID NO: 157238

SEQ ID NO: 272093 - RNA, 64 nt, Homo Sapiens; identical to SEQ ID NO: 157239

SEQ ID NO: 272094 - RNA, 64 nt, Homo Sapiens; identical to SEQ ID NO: 157240

SEQ ID NO: 272095 - RNA, 64 nt, Homo Sapiens; identical to SEQ ID NO: 157241

SEQ ID NO: 272096 - RNA, 64 nt, Homo Sapiens; identical to SEQ ID NO: 157242

SEQ ID NO: 272097 - RNA, 64 nt, Homo Sapiens; identical to SEQ ID NO: 157243

SEQ ID NO: 272098 - RNA, 64 nt, Homo Sapiens; identical to SEQ ID NO: 157244

SEQ ID NO: 272099 - RNA, 64 nt, Homo Sapiens; identical to SEQ ID NO: 157245

SEQ ID NO: 272100 - RNA, 64 nt, Homo Sapiens; identical to SEQ ID NO: 157246

SEQ ID NO: 272101 - RNA, 64 nt, Homo Sapiens; identical to SEQ ID NO: 157247

SEQ ID NO: 272102 - RNA, 64 nt, Homo Sapiens; identical to SEQ ID NO: 157248

SEQ ID NO: 272103 - RNA, 64 nt, Homo Sapiens; identical to SEQ ID NO: 157249

SEQ ID NO: 272104 - RNA, 64 nt, Homo Sapiens; identical to SEQ ID NO: 157250

SEQ ID NO: 272105 - RNA, 64 nt, Homo Sapiens; identical to SEQ ID NO: 157251

SEQ ID NO: 272106 - RNA, 64 nt, Homo Sapiens; identical to SEQ ID NO: 157252

SEQ ID NO: 272107 - RNA, 64 nt, Homo Sapiens; identical to SEQ ID NO: 157253

SEQ ID NO: 272108 - RNA, 64 nt, Homo Sapiens; identical to SEQ ID NO: 157254

SEQ ID NO: 272109 - RNA, 64 nt, Homo Sapiens; identical to SEQ ID NO: 157255

SEQ ID NO: 272110 - RNA, 64 nt, Homo Sapiens; identical to SEQ ID NO: 157256

SEQ ID NO: 272111 - RNA, 64 nt, Homo Sapiens; identical to SEQ ID NO: 157257

SEQ ID NO: 272112 - RNA, 64 nt, Homo Sapiens; identical to SEQ ID NO: 157258

SEQ ID NO: 272113 - RNA, 64 nt, Homo Sapiens; identical to SEQ ID NO: 157259

SEQ ID NO: 272114 - RNA, 64 nt, Homo Sapiens; identical to SEQ ID NO: 157260

SEQ ID NO: 272115 - RNA, 64 nt, Homo Sapiens; identical to SEQ ID NO: 157261

SEQ ID NO: 272116 - RNA, 64 nt, Homo Sapiens; identical to SEQ ID NO: 157262

SEQ ID NO: 272117 - RNA, 64 nt, Homo Sapiens; identical to SEQ ID NO: 157263

SEQ ID NO: 272118 - RNA, 64 nt, Homo Sapiens; identical to SEQ ID NO: 157264

SEQ ID NO: 272119 - RNA, 64 nt, Homo Sapiens; identical to SEQ ID NO: 157265

SEQ ID NO: 272120 - RNA, 64 nt, Homo Sapiens; identical to SEQ ID NO: 157266

SEQ ID NO: 272121 - RNA, 64 nt, Homo Sapiens; identical to SEQ ID NO: 157267

SEQ ID NO: 272122 - RNA, 64 nt, Homo Sapiens; identical to SEQ ID NO: 157268

SEQ ID NO: 272123 - RNA, 64 nt, Homo Sapiens; identical to SEQ ID NO: 157269

SEQ ID NO: 272124 - RNA, 64 nt, Homo Sapiens; identical to SEQ ID NO: 157270

SEQ ID NO: 272125 - RNA, 64 nt, Homo Sapiens; identical to SEQ ID NO: 157271

SEQ ID NO: 272126 - RNA, 64 nt, Homo Sapiens; identical to SEQ ID NO: 157272

SEQ ID NO: 272127 - RNA, 64 nt, Homo Sapiens; identical to SEQ ID NO: 157273

SEQ ID NO: 272128 - RNA, 64 nt, Homo Sapiens; identical to SEQ ID NO: 157274

SEQ ID NO: 272129 - RNA, 64 nt, Homo Sapiens; identical to SEQ ID NO: 157275

SEQ ID NO: 272130 - RNA, 64 nt, Homo Sapiens; identical to SEQ ID NO: 157276

SEQ ID NO: 272131 - RNA, 64 nt, Homo Sapiens; identical to SEQ ID NO: 157277

SEQ ID NO: 272132 - RNA, 64 nt, Homo Sapiens; identical to SEQ ID NO: 157278

SEQ ID NO: 272133 - RNA, 64 nt, Homo Sapiens; identical to SEQ ID NO: 157279

SEQ ID NO: 272134 - RNA, 64 nt, Homo Sapiens; identical to SEQ ID NO: 157280

SEQ ID NO: 272135 - RNA, 64 nt, Homo Sapiens; identical to SEQ ID NO: 157281

SEQ ID NO: 272136 - RNA, 64 nt, Homo Sapiens; identical to SEQ ID NO: 157282

SEQ ID NO: 272137 - RNA, 64 nt, Homo Sapiens; identical to SEQ ID NO: 157283

SEQ ID NO: 272138 - RNA, 64 nt, Homo Sapiens; identical to SEQ ID NO: 157284

SEQ ID NO: 272139 - RNA, 64 nt, Homo Sapiens; identical to SEQ ID NO: 157285

SEQ ID NO: 272140 - RNA, 64 nt, Homo Sapiens; identical to SEQ ID NO: 157286

SEQ ID NO: 272141 - RNA, 64 nt, Homo Sapiens; identical to SEQ ID NO: 157287

SEQ ID NO: 272142 - RNA, 64 nt, Homo Sapiens; identical to SEQ ID NO: 157288

SEQ ID NO: 272143 - RNA, 64 nt, Homo Sapiens; identical to SEQ ID NO: 157289

SEQ ID NO: 272144 - RNA, 64 nt, Homo Sapiens; identical to SEQ ID NO: 157290

SEQ ID NO: 272145 - RNA, 64 nt, Homo Sapiens; identical to SEQ ID NO: 157291

SEQ ID NO: 272146 - RNA, 64 nt, Homo Sapiens; identical to SEQ ID NO: 157292

SEQ ID NO: 272147 - RNA, 64 nt, Homo Sapiens; identical to SEQ ID NO: 157293

SEQ ID NO: 272148 - RNA, 64 nt, Homo Sapiens; identical to SEQ ID NO: 157294

SEQ ID NO: 272149 - RNA, 64 nt, Homo Sapiens; identical to SEQ ID NO: 157295

SEQ ID NO: 272150 - RNA, 64 nt, Homo Sapiens; identical to SEQ ID NO: 157296

SEQ ID NO: 272151 - RNA, 64 nt, Homo Sapiens; identical to SEQ ID NO: 157297

SEQ ID NO: 272152 - RNA, 64 nt, Homo Sapiens; identical to SEQ ID NO: 157298

SEQ ID NO: 272153 - RNA, 64 nt, Homo Sapiens; identical to SEQ ID NO: 157299

SEQ ID NO: 272154 - RNA, 64 nt, Homo Sapiens; identical to SEQ ID NO: 157300

SEQ ID NO: 272155 - RNA, 64 nt, Homo Sapiens; identical to SEQ ID NO: 157301

SEQ ID NO: 272156 - RNA, 64 nt, Homo Sapiens; identical to SEQ ID NO: 157302

SEQ ID NO: 272157 - RNA, 64 nt, Homo Sapiens; identical to SEQ ID NO: 157303

SEQ ID NO: 272158 - RNA, 64 nt, Homo Sapiens; identical to SEQ ID NO: 157304

SEQ ID NO: 272159 - RNA, 64 nt, Homo Sapiens; identical to SEQ ID NO: 157305

SEQ ID NO: 272160 - RNA, 64 nt, Homo Sapiens; identical to SEQ ID NO: 157306

SEQ ID NO: 272161 - RNA, 64 nt, Homo Sapiens; identical to SEQ ID NO: 157307

SEQ ID NO: 272162 - RNA, 64 nt, Homo Sapiens; identical to SEQ ID NO: 157308

SEQ ID NO: 272163 - RNA, 64 nt, Homo Sapiens; identical to SEQ ID NO: 157309

SEQ ID NO: 272164 - RNA, 64 nt, Homo Sapiens; identical to SEQ ID NO: 157310

SEQ ID NO: 272165 - RNA, 64 nt, Homo Sapiens; identical to SEQ ID NO: 157311

SEQ ID NO: 272166 - RNA, 64 nt, Homo Sapiens; identical to SEQ ID NO: 157312

SEQ ID NO: 272167 - RNA, 64 nt, Homo Sapiens; identical to SEQ ID NO: 157313

SEQ ID NO: 272168 - RNA, 64 nt, Homo Sapiens; identical to SEQ ID NO: 157314

SEQ ID NO: 272169 - RNA, 64 nt, Homo Sapiens; identical to SEQ ID NO: 157315

SEQ ID NO: 272170 - RNA, 64 nt, Homo Sapiens; identical to SEQ ID NO: 157316

SEQ ID NO: 272171 - RNA, 64 nt, Homo Sapiens; identical to SEQ ID NO: 157317

SEQ ID NO: 272172 - RNA, 64 nt, Homo Sapiens; identical to SEQ ID NO: 157318

SEQ ID NO: 272173 - RNA, 64 nt, Homo Sapiens; identical to SEQ ID NO: 157319

SEQ ID NO: 272174 - RNA, 64 nt, Homo Sapiens; identical to SEQ ID NO: 157320

SEQ ID NO: 272175 - RNA, 64 nt, Homo Sapiens; identical to SEQ ID NO: 157321

SEQ ID NO: 272176 - RNA, 64 nt, Homo Sapiens; identical to SEQ ID NO: 157322

SEQ ID NO: 272177 - RNA, 64 nt, Homo Sapiens; identical to SEQ ID NO: 157323

SEQ ID NO: 272178 - RNA, 64 nt, Homo Sapiens; identical to SEQ ID NO: 157324

SEQ ID NO: 272179 - RNA, 64 nt, Homo Sapiens; identical to SEQ ID NO: 157325

SEQ ID NO: 272180 - RNA, 64 nt, Homo Sapiens; identical to SEQ ID NO: 157326

SEQ ID NO: 272181 - RNA, 64 nt, Homo Sapiens; identical to SEQ ID NO: 157327

SEQ ID NO: 272182 - RNA, 64 nt, Homo Sapiens; identical to SEQ ID NO: 157328

SEQ ID NO: 272183 - RNA, 64 nt, Homo Sapiens; identical to SEQ ID NO: 157329

SEQ ID NO: 272184 - RNA, 64 nt, Homo Sapiens; identical to SEQ ID NO: 157330

SEQ ID NO: 272185 - RNA, 64 nt, Homo Sapiens; identical to SEQ ID NO: 157331

SEQ ID NO: 272186 - RNA, 64 nt, Homo Sapiens; identical to SEQ ID NO: 157332

SEQ ID NO: 272187 - RNA, 64 nt, Homo Sapiens; identical to SEQ ID NO: 157333

SEQ ID NO: 272188 - RNA, 64 nt, Homo Sapiens; identical to SEQ ID NO: 157334

SEQ ID NO: 272189 - RNA, 64 nt, Homo Sapiens; identical to SEQ ID NO: 157335

SEQ ID NO: 272190 - RNA, 64 nt, Homo Sapiens; identical to SEQ ID NO: 157336

SEQ ID NO: 272191 - RNA, 64 nt, Homo Sapiens; identical to SEQ ID NO: 157337

SEQ ID NO: 272192 - RNA, 64 nt, Homo Sapiens; identical to SEQ ID NO: 157338

SEQ ID NO: 272193 - RNA, 64 nt, Homo Sapiens; identical to SEQ ID NO: 157339

SEQ ID NO: 272194 - RNA, 64 nt, Homo Sapiens; identical to SEQ ID NO: 157340

SEQ ID NO: 272195 - RNA, 64 nt, Homo Sapiens; identical to SEQ ID NO: 157341

SEQ ID NO: 272196 - RNA, 64 nt, Homo Sapiens; identical to SEQ ID NO: 157342

SEQ ID NO: 272197 - RNA, 64 nt, Homo Sapiens; identical to SEQ ID NO: 157343

SEQ ID NO: 272198 - RNA, 64 nt, Homo Sapiens; identical to SEQ ID NO: 157344

SEQ ID NO: 272199 - RNA, 64 nt, Homo Sapiens; identical to SEQ ID NO: 157345

SEQ ID NO: 272200 - RNA, 64 nt, Homo Sapiens; identical to SEQ ID NO: 157346

SEQ ID NO: 272201 - RNA, 64 nt, Homo Sapiens; identical to SEQ ID NO: 157347

SEQ ID NO: 272202 - RNA, 64 nt, Homo Sapiens; identical to SEQ ID NO: 157348

SEQ ID NO: 272203 - RNA, 64 nt, Homo Sapiens; identical to SEQ ID NO: 157349

SEQ ID NO: 272204 - RNA, 64 nt, Homo Sapiens; identical to SEQ ID NO: 157350

SEQ ID NO: 272205 - RNA, 64 nt, Homo Sapiens; identical to SEQ ID NO: 157351

SEQ ID NO: 272206 - RNA, 64 nt, Homo Sapiens; identical to SEQ ID NO: 157352

SEQ ID NO: 272207 - RNA, 64 nt, Homo Sapiens; identical to SEQ ID NO: 157353

SEQ ID NO: 272208 - RNA, 64 nt, Homo Sapiens; identical to SEQ ID NO: 157354

SEQ ID NO: 272209 - RNA, 64 nt, Homo Sapiens; identical to SEQ ID NO: 157355

SEQ ID NO: 272210 - RNA, 64 nt, Homo Sapiens; identical to SEQ ID NO: 157356

SEQ ID NO: 272211 - RNA, 64 nt, Homo Sapiens; identical to SEQ ID NO: 157357

SEQ ID NO: 272212 - RNA, 64 nt, Homo Sapiens; identical to SEQ ID NO: 157358

SEQ ID NO: 272213 - RNA, 64 nt, Homo Sapiens; identical to SEQ ID NO: 157359

SEQ ID NO: 272214 - RNA, 64 nt, Homo Sapiens; identical to SEQ ID NO: 157360

SEQ ID NO: 272215 - RNA, 64 nt, Homo Sapiens; identical to SEQ ID NO: 157361

SEQ ID NO: 272216 - RNA, 64 nt, Homo Sapiens; identical to SEQ ID NO: 157362

SEQ ID NO: 272217 - RNA, 64 nt, Homo Sapiens; identical to SEQ ID NO: 157363

SEQ ID NO: 272218 - RNA, 64 nt, Homo Sapiens; identical to SEQ ID NO: 157364

SEQ ID NO: 272219 - RNA, 64 nt, Homo Sapiens; identical to SEQ ID NO: 157365

SEQ ID NO: 272220 - RNA, 64 nt, Homo Sapiens; identical to SEQ ID NO: 157366

SEQ ID NO: 272221 - RNA, 64 nt, Homo Sapiens; identical to SEQ ID NO: 157367

SEQ ID NO: 272222 - RNA, 64 nt, Homo Sapiens; identical to SEQ ID NO: 157368

SEQ ID NO: 272223 - RNA, 64 nt, Homo Sapiens; identical to SEQ ID NO: 157369

SEQ ID NO: 272224 - RNA, 64 nt, Homo Sapiens; identical to SEQ ID NO: 157370

SEQ ID NO: 272225 - RNA, 64 nt, Homo Sapiens; identical to SEQ ID NO: 157371

SEQ ID NO: 272226 - RNA, 64 nt, Homo Sapiens; identical to SEQ ID NO: 157372

SEQ ID NO: 272227 - RNA, 64 nt, Homo Sapiens; identical to SEQ ID NO: 157373

SEQ ID NO: 272228 - RNA, 64 nt, Homo Sapiens; identical to SEQ ID NO: 157374

SEQ ID NO: 272229 - RNA, 64 nt, Homo Sapiens; identical to SEQ ID NO: 157375

SEQ ID NO: 272230 - RNA, 64 nt, Homo Sapiens; identical to SEQ ID NO: 157376

SEQ ID NO: 272231 - RNA, 64 nt, Homo Sapiens; identical to SEQ ID NO: 157377

SEQ ID NO: 272232 - RNA, 64 nt, Homo Sapiens; identical to SEQ ID NO: 157378

SEQ ID NO: 272233 - RNA, 64 nt, Homo Sapiens; identical to SEQ ID NO: 157379

SEQ ID NO: 272234 - RNA, 64 nt, Homo Sapiens; identical to SEQ ID NO: 157380

SEQ ID NO: 272235 - RNA, 64 nt, Homo Sapiens; identical to SEQ ID NO: 157381

SEQ ID NO: 272236 - RNA, 64 nt, Homo Sapiens; identical to SEQ ID NO: 157382

SEQ ID NO: 272237 - RNA, 64 nt, Homo Sapiens; identical to SEQ ID NO: 157383

SEQ ID NO: 272238 - RNA, 64 nt, Homo Sapiens; identical to SEQ ID NO: 157384

SEQ ID NO: 272239 - RNA, 64 nt, Homo Sapiens; identical to SEQ ID NO: 157385

SEQ ID NO: 272240 - RNA, 64 nt, Homo Sapiens; identical to SEQ ID NO: 157386

SEQ ID NO: 272241 - RNA, 64 nt, Homo Sapiens; identical to SEQ ID NO: 157387

SEQ ID NO: 272242 - RNA, 64 nt, Homo Sapiens; identical to SEQ ID NO: 157388

SEQ ID NO: 272243 - RNA, 64 nt, Homo Sapiens; identical to SEQ ID NO: 157389

SEQ ID NO: 272244 - RNA, 64 nt, Homo Sapiens; identical to SEQ ID NO: 157390

SEQ ID NO: 272245 - RNA, 64 nt, Homo Sapiens; identical to SEQ ID NO: 157391

SEQ ID NO: 272246 - RNA, 64 nt, Homo Sapiens; identical to SEQ ID NO: 157392

SEQ ID NO: 272247 - RNA, 64 nt, Homo Sapiens; identical to SEQ ID NO: 157393

SEQ ID NO: 272248 - RNA, 64 nt, Homo Sapiens; identical to SEQ ID NO: 157394

SEQ ID NO: 272249 - RNA, 64 nt, Homo Sapiens; identical to SEQ ID NO: 157395

SEQ ID NO: 272250 - RNA, 64 nt, Homo Sapiens; identical to SEQ ID NO: 157396

SEQ ID NO: 272251 - RNA, 64 nt, Homo Sapiens; identical to SEQ ID NO: 157397

SEQ ID NO: 272252 - RNA, 64 nt, Homo Sapiens; identical to SEQ ID NO: 157398

SEQ ID NO: 272253 - RNA, 64 nt, Homo Sapiens; identical to SEQ ID NO: 157399

SEQ ID NO: 272254 - RNA, 64 nt, Homo Sapiens; identical to SEQ ID NO: 157400

SEQ ID NO: 272255 - RNA, 64 nt, Homo Sapiens; identical to SEQ ID NO: 157401

SEQ ID NO: 272256 - RNA, 64 nt, Homo Sapiens; identical to SEQ ID NO: 157402

SEQ ID NO: 272257 - RNA, 64 nt, Homo Sapiens; identical to SEQ ID NO: 157403

SEQ ID NO: 272258 - RNA, 64 nt, Homo Sapiens; identical to SEQ ID NO: 157404

SEQ ID NO: 272259 - RNA, 64 nt, Homo Sapiens; identical to SEQ ID NO: 157405

SEQ ID NO: 272260 - RNA, 64 nt, Homo Sapiens; identical to SEQ ID NO: 157406

SEQ ID NO: 272261 - RNA, 64 nt, Homo Sapiens; identical to SEQ ID NO: 157407

SEQ ID NO: 272262 - RNA, 64 nt, Homo Sapiens; identical to SEQ ID NO: 157408

SEQ ID NO: 272263 - RNA, 64 nt, Homo Sapiens; identical to SEQ ID NO: 157409

SEQ ID NO: 272264 - RNA, 64 nt, Homo Sapiens; identical to SEQ ID NO: 157410

SEQ ID NO: 272265 - RNA, 64 nt, Homo Sapiens; identical to SEQ ID NO: 157411

SEQ ID NO: 272266 - RNA, 64 nt, Homo Sapiens; identical to SEQ ID NO: 157412

SEQ ID NO: 272267 - RNA, 64 nt, Homo Sapiens; identical to SEQ ID NO: 157413

SEQ ID NO: 272268 - RNA, 64 nt, Homo Sapiens; identical to SEQ ID NO: 157414

SEQ ID NO: 272269 - RNA, 64 nt, Homo Sapiens; identical to SEQ ID NO: 157415

SEQ ID NO: 272270 - RNA, 64 nt, Homo Sapiens; identical to SEQ ID NO: 157416

SEQ ID NO: 272271 - RNA, 64 nt, Homo Sapiens; identical to SEQ ID NO: 157417

SEQ ID NO: 272272 - RNA, 64 nt, Homo Sapiens; identical to SEQ ID NO: 157418

SEQ ID NO: 272273 - RNA, 64 nt, Homo Sapiens; identical to SEQ ID NO: 157419

SEQ ID NO: 272274 - RNA, 64 nt, Homo Sapiens; identical to SEQ ID NO: 157420

SEQ ID NO: 272275 - RNA, 64 nt, Homo Sapiens; identical to SEQ ID NO: 157421

SEQ ID NO: 272276 - RNA, 64 nt, Homo Sapiens; identical to SEQ ID NO: 157422

SEQ ID NO: 272277 - RNA, 64 nt, Homo Sapiens; identical to SEQ ID NO: 157423

SEQ ID NO: 272278 - RNA, 64 nt, Homo Sapiens; identical to SEQ ID NO: 157424

SEQ ID NO: 272279 - RNA, 64 nt, Homo Sapiens; identical to SEQ ID NO: 157425

SEQ ID NO: 272280 - RNA, 64 nt, Homo Sapiens; identical to SEQ ID NO: 157426

SEQ ID NO: 272281 - RNA, 64 nt, Homo Sapiens; identical to SEQ ID NO: 157427

SEQ ID NO: 272282 - RNA, 64 nt, Homo Sapiens; identical to SEQ ID NO: 157428

SEQ ID NO: 272283 - RNA, 64 nt, Homo Sapiens; identical to SEQ ID NO: 157429

SEQ ID NO: 272284 - RNA, 64 nt, Homo Sapiens; identical to SEQ ID NO: 157430

SEQ ID NO: 272285 - RNA, 64 nt, Homo Sapiens; identical to SEQ ID NO: 157431

SEQ ID NO: 272286 - RNA, 64 nt, Homo Sapiens; identical to SEQ ID NO: 157432

SEQ ID NO: 272287 - RNA, 64 nt, Homo Sapiens; identical to SEQ ID NO: 157433

SEQ ID NO: 272288 - RNA, 64 nt, Homo Sapiens; identical to SEQ ID NO: 157434

SEQ ID NO: 272289 - RNA, 64 nt, Homo Sapiens; identical to SEQ ID NO: 157435

SEQ ID NO: 272290 - RNA, 64 nt, Homo Sapiens; identical to SEQ ID NO: 157436

SEQ ID NO: 272291 - RNA, 64 nt, Homo Sapiens; identical to SEQ ID NO: 157437

SEQ ID NO: 272292 - RNA, 64 nt, Homo Sapiens; identical to SEQ ID NO: 157438

SEQ ID NO: 272293 - RNA, 64 nt, Homo Sapiens; identical to SEQ ID NO: 157439

SEQ ID NO: 272294 - RNA, 64 nt, Homo Sapiens; identical to SEQ ID NO: 157440

SEQ ID NO: 272295 - RNA, 64 nt, Homo Sapiens; identical to SEQ ID NO: 157441

SEQ ID NO: 272296 - RNA, 64 nt, Homo Sapiens; identical to SEQ ID NO: 157442

SEQ ID NO: 272297 - RNA, 64 nt, Homo Sapiens; identical to SEQ ID NO: 157443

SEQ ID NO: 272298 - RNA, 64 nt, Homo Sapiens; identical to SEQ ID NO: 157444

SEQ ID NO: 272299 - RNA, 64 nt, Homo Sapiens; identical to SEQ ID NO: 157445

SEQ ID NO: 272300 - RNA, 64 nt, Homo Sapiens; identical to SEQ ID NO: 157446

SEQ ID NO: 272301 - RNA, 64 nt, Homo Sapiens; identical to SEQ ID NO: 157447

SEQ ID NO: 272302 - RNA, 64 nt, Homo Sapiens; identical to SEQ ID NO: 157448

SEQ ID NO: 272303 - RNA, 64 nt, Homo Sapiens; identical to SEQ ID NO: 157449

SEQ ID NO: 272304 - RNA, 64 nt, Homo Sapiens; identical to SEQ ID NO: 157450

SEQ ID NO: 272305 - RNA, 64 nt, Homo Sapiens; identical to SEQ ID NO: 157451

SEQ ID NO: 272306 - RNA, 64 nt, Homo Sapiens; identical to SEQ ID NO: 157452

SEQ ID NO: 272307 - RNA, 64 nt, Homo Sapiens; identical to SEQ ID NO: 157453

SEQ ID NO: 272308 - RNA, 64 nt, Homo Sapiens; identical to SEQ ID NO: 157454

SEQ ID NO: 272309 - RNA, 64 nt, Homo Sapiens; identical to SEQ ID NO: 157455

SEQ ID NO: 272310 - RNA, 64 nt, Homo Sapiens; identical to SEQ ID NO: 157456

SEQ ID NO: 272311 - RNA, 64 nt, Homo Sapiens; identical to SEQ ID NO: 157457

SEQ ID NO: 272312 - RNA, 64 nt, Homo Sapiens; identical to SEQ ID NO: 157458

SEQ ID NO: 272313 - RNA, 64 nt, Homo Sapiens; identical to SEQ ID NO: 157459

SEQ ID NO: 272314 - RNA, 64 nt, Homo Sapiens; identical to SEQ ID NO: 157460

SEQ ID NO: 272315 - RNA, 64 nt, Homo Sapiens; identical to SEQ ID NO: 157461

SEQ ID NO: 272316 - RNA, 64 nt, Homo Sapiens; identical to SEQ ID NO: 157462

SEQ ID NO: 272317 - RNA, 64 nt, Homo Sapiens; identical to SEQ ID NO: 157463

SEQ ID NO: 272318 - RNA, 64 nt, Homo Sapiens; identical to SEQ ID NO: 157464

SEQ ID NO: 272319 - RNA, 64 nt, Homo Sapiens; identical to SEQ ID NO: 157465

SEQ ID NO: 272320 - RNA, 64 nt, Homo Sapiens; identical to SEQ ID NO: 157466

SEQ ID NO: 272321 - RNA, 64 nt, Homo Sapiens; identical to SEQ ID NO: 157467

SEQ ID NO: 272322 - RNA, 64 nt, Homo Sapiens; identical to SEQ ID NO: 157468

SEQ ID NO: 272323 - RNA, 64 nt, Homo Sapiens; identical to SEQ ID NO: 157469

SEQ ID NO: 272324 - RNA, 64 nt, Homo Sapiens; identical to SEQ ID NO: 157470

SEQ ID NO: 272325 - RNA, 64 nt, Homo Sapiens; identical to SEQ ID NO: 157471

SEQ ID NO: 272326 - RNA, 64 nt, Homo Sapiens; identical to SEQ ID NO: 157472

SEQ ID NO: 272327 - RNA, 64 nt, Homo Sapiens; identical to SEQ ID NO: 157473

SEQ ID NO: 272328 - RNA, 64 nt, Homo Sapiens; identical to SEQ ID NO: 157474

SEQ ID NO: 272329 - RNA, 64 nt, Homo Sapiens; identical to SEQ ID NO: 157475

SEQ ID NO: 272330 - RNA, 64 nt, Homo Sapiens; identical to SEQ ID NO: 157476

SEQ ID NO: 272331 - RNA, 64 nt, Homo Sapiens; identical to SEQ ID NO: 157477

SEQ ID NO: 272332 - RNA, 64 nt, Homo Sapiens; identical to SEQ ID NO: 157478

SEQ ID NO: 272333 - RNA, 64 nt, Homo Sapiens; identical to SEQ ID NO: 157479

SEQ ID NO: 272334 - RNA, 64 nt, Homo Sapiens; identical to SEQ ID NO: 157480

SEQ ID NO: 272335 - RNA, 64 nt, Homo Sapiens; identical to SEQ ID NO: 157481

SEQ ID NO: 272336 - RNA, 64 nt, Homo Sapiens; identical to SEQ ID NO: 157482

SEQ ID NO: 272337 - RNA, 64 nt, Homo Sapiens; identical to SEQ ID NO: 157483

SEQ ID NO: 272338 - RNA, 64 nt, Homo Sapiens; identical to SEQ ID NO: 157484

SEQ ID NO: 272339 - RNA, 64 nt, Homo Sapiens; identical to SEQ ID NO: 157485

SEQ ID NO: 272340 - RNA, 64 nt, Homo Sapiens; identical to SEQ ID NO: 157486

SEQ ID NO: 272341 - RNA, 64 nt, Homo Sapiens; identical to SEQ ID NO: 157487

SEQ ID NO: 272342 - RNA, 64 nt, Homo Sapiens; identical to SEQ ID NO: 157488

SEQ ID NO: 272343 - RNA, 64 nt, Homo Sapiens; identical to SEQ ID NO: 157489

SEQ ID NO: 272344 - RNA, 64 nt, Homo Sapiens; identical to SEQ ID NO: 157490

SEQ ID NO: 272345 - RNA, 64 nt, Homo Sapiens; identical to SEQ ID NO: 157491

SEQ ID NO: 272346 - RNA, 64 nt, Homo Sapiens; identical to SEQ ID NO: 157492

SEQ ID NO: 272347 - RNA, 64 nt, Homo Sapiens; identical to SEQ ID NO: 157493

SEQ ID NO: 272348 - RNA, 64 nt, Homo Sapiens; identical to SEQ ID NO: 157494

SEQ ID NO: 272349 - RNA, 64 nt, Homo Sapiens; identical to SEQ ID NO: 157495

SEQ ID NO: 272350 - RNA, 64 nt, Homo Sapiens; identical to SEQ ID NO: 157496

SEQ ID NO: 272351 - RNA, 64 nt, Homo Sapiens; identical to SEQ ID NO: 157497

SEQ ID NO: 272352 - RNA, 64 nt, Homo Sapiens; identical to SEQ ID NO: 157498

SEQ ID NO: 272353 - RNA, 64 nt, Homo Sapiens; identical to SEQ ID NO: 157499

SEQ ID NO: 272354 - RNA, 64 nt, Homo Sapiens; identical to SEQ ID NO: 157500

SEQ ID NO: 272355 - RNA, 64 nt, Homo Sapiens; identical to SEQ ID NO: 157501

SEQ ID NO: 272356 - RNA, 64 nt, Homo Sapiens; identical to SEQ ID NO: 157502

SEQ ID NO: 272357 - RNA, 64 nt, Homo Sapiens; identical to SEQ ID NO: 157503

SEQ ID NO: 272358 - RNA, 64 nt, Homo Sapiens; identical to SEQ ID NO: 157504

SEQ ID NO: 272359 - RNA, 64 nt, Homo Sapiens; identical to SEQ ID NO: 157505

SEQ ID NO: 272360 - RNA, 64 nt, Homo Sapiens; identical to SEQ ID NO: 157506

SEQ ID NO: 272361 - RNA, 64 nt, Homo Sapiens; identical to SEQ ID NO: 157507

SEQ ID NO: 272362 - RNA, 64 nt, Homo Sapiens; identical to SEQ ID NO: 157508

SEQ ID NO: 272363 - RNA, 64 nt, Homo Sapiens; identical to SEQ ID NO: 157509

SEQ ID NO: 272364 - RNA, 64 nt, Homo Sapiens; identical to SEQ ID NO: 157510

SEQ ID NO: 272365 - RNA, 64 nt, Homo Sapiens; identical to SEQ ID NO: 157511

SEQ ID NO: 272366 - RNA, 64 nt, Homo Sapiens; identical to SEQ ID NO: 157512

SEQ ID NO: 272367 - RNA, 64 nt, Homo Sapiens; identical to SEQ ID NO: 157513

SEQ ID NO: 272368 - RNA, 64 nt, Homo Sapiens; identical to SEQ ID NO: 157514

SEQ ID NO: 272369 - RNA, 64 nt, Homo Sapiens; identical to SEQ ID NO: 157515

SEQ ID NO: 272370 - RNA, 64 nt, Homo Sapiens; identical to SEQ ID NO: 157516

SEQ ID NO: 272371 - RNA, 64 nt, Homo Sapiens; identical to SEQ ID NO: 157517

SEQ ID NO: 272372 - RNA, 64 nt, Homo Sapiens; identical to SEQ ID NO: 157518

SEQ ID NO: 272373 - RNA, 64 nt, Homo Sapiens; identical to SEQ ID NO: 157519

SEQ ID NO: 272374 - RNA, 64 nt, Homo Sapiens; identical to SEQ ID NO: 157520

SEQ ID NO: 272375 - RNA, 64 nt, Homo Sapiens; identical to SEQ ID NO: 157521

SEQ ID NO: 272376 - RNA, 64 nt, Homo Sapiens; identical to SEQ ID NO: 157522

SEQ ID NO: 272377 - RNA, 64 nt, Homo Sapiens; identical to SEQ ID NO: 157523

SEQ ID NO: 272378 - RNA, 64 nt, Homo Sapiens; identical to SEQ ID NO: 157524

SEQ ID NO: 272379 - RNA, 64 nt, Homo Sapiens; identical to SEQ ID NO: 157525

SEQ ID NO: 272380 - RNA, 64 nt, Homo Sapiens; identical to SEQ ID NO: 157526

SEQ ID NO: 272381 - RNA, 64 nt, Homo Sapiens; identical to SEQ ID NO: 157527

SEQ ID NO: 272382 - RNA, 64 nt, Homo Sapiens; identical to SEQ ID NO: 157528

SEQ ID NO: 272383 - RNA, 64 nt, Homo Sapiens; identical to SEQ ID NO: 157529

SEQ ID NO: 272384 - RNA, 64 nt, Homo Sapiens; identical to SEQ ID NO: 157530

SEQ ID NO: 272385 - RNA, 64 nt, Homo Sapiens; identical to SEQ ID NO: 157531

SEQ ID NO: 272386 - RNA, 64 nt, Homo Sapiens; identical to SEQ ID NO: 157532

SEQ ID NO: 272387 - RNA, 64 nt, Homo Sapiens; identical to SEQ ID NO: 157533

SEQ ID NO: 272388 - RNA, 64 nt, Homo Sapiens; identical to SEQ ID NO: 157534

SEQ ID NO: 272389 - RNA, 64 nt, Homo Sapiens; identical to SEQ ID NO: 157535

SEQ ID NO: 272390 - RNA, 64 nt, Homo Sapiens; identical to SEQ ID NO: 157536

SEQ ID NO: 272391 - RNA, 64 nt, Homo Sapiens; identical to SEQ ID NO: 157537

SEQ ID NO: 272392 - RNA, 64 nt, Homo Sapiens; identical to SEQ ID NO: 157538

SEQ ID NO: 272393 - RNA, 64 nt, Homo Sapiens; identical to SEQ ID NO: 157539

SEQ ID NO: 272394 - RNA, 64 nt, Homo Sapiens; identical to SEQ ID NO: 157540

SEQ ID NO: 272395 - RNA, 64 nt, Homo Sapiens; identical to SEQ ID NO: 157541

SEQ ID NO: 272396 - RNA, 64 nt, Homo Sapiens; identical to SEQ ID NO: 157542

SEQ ID NO: 272397 - RNA, 64 nt, Homo Sapiens; identical to SEQ ID NO: 157543

SEQ ID NO: 272398 - RNA, 64 nt, Homo Sapiens; identical to SEQ ID NO: 157544

SEQ ID NO: 272399 - RNA, 64 nt, Homo Sapiens; identical to SEQ ID NO: 157545

SEQ ID NO: 272400 - RNA, 64 nt, Homo Sapiens; identical to SEQ ID NO: 157546

SEQ ID NO: 272401 - RNA, 64 nt, Homo Sapiens; identical to SEQ ID NO: 157547

SEQ ID NO: 272402 - RNA, 64 nt, Homo Sapiens; identical to SEQ ID NO: 157548

SEQ ID NO: 272403 - RNA, 64 nt, Homo Sapiens; identical to SEQ ID NO: 157549

SEQ ID NO: 272404 - RNA, 64 nt, Homo Sapiens; identical to SEQ ID NO: 157550

SEQ ID NO: 272405 - RNA, 64 nt, Homo Sapiens; identical to SEQ ID NO: 157551

SEQ ID NO: 272406 - RNA, 64 nt, Homo Sapiens; identical to SEQ ID NO: 157552

SEQ ID NO: 272407 - RNA, 64 nt, Homo Sapiens; identical to SEQ ID NO: 157553

SEQ ID NO: 272408 - RNA, 64 nt, Homo Sapiens; identical to SEQ ID NO: 157554

SEQ ID NO: 272409 - RNA, 64 nt, Homo Sapiens; identical to SEQ ID NO: 157555

SEQ ID NO: 272410 - RNA, 64 nt, Homo Sapiens; identical to SEQ ID NO: 157556

SEQ ID NO: 272411 - RNA, 64 nt, Homo Sapiens; identical to SEQ ID NO: 157557

SEQ ID NO: 272412 - RNA, 64 nt, Homo Sapiens; identical to SEQ ID NO: 157558

SEQ ID NO: 272413 - RNA, 64 nt, Homo Sapiens; identical to SEQ ID NO: 157559

SEQ ID NO: 272414 - RNA, 64 nt, Homo Sapiens; identical to SEQ ID NO: 157560

SEQ ID NO: 272415 - RNA, 64 nt, Homo Sapiens; identical to SEQ ID NO: 157561

SEQ ID NO: 272416 - RNA, 64 nt, Homo Sapiens; identical to SEQ ID NO: 157562

SEQ ID NO: 272417 - RNA, 64 nt, Homo Sapiens; identical to SEQ ID NO: 157563

SEQ ID NO: 272418 - RNA, 64 nt, Homo Sapiens; identical to SEQ ID NO: 157564

SEQ ID NO: 272419 - RNA, 64 nt, Homo Sapiens; identical to SEQ ID NO: 157565

SEQ ID NO: 272420 - RNA, 64 nt, Homo Sapiens; identical to SEQ ID NO: 157566

SEQ ID NO: 272421 - RNA, 64 nt, Homo Sapiens; identical to SEQ ID NO: 157567

SEQ ID NO: 272422 - RNA, 64 nt, Homo Sapiens; identical to SEQ ID NO: 157568

SEQ ID NO: 272423 - RNA, 64 nt, Homo Sapiens; identical to SEQ ID NO: 157569

SEQ ID NO: 272424 - RNA, 64 nt, Homo Sapiens; identical to SEQ ID NO: 157570

SEQ ID NO: 272425 - RNA, 64 nt, Homo Sapiens; identical to SEQ ID NO: 157571

SEQ ID NO: 272426 - RNA, 64 nt, Homo Sapiens; identical to SEQ ID NO: 157572

SEQ ID NO: 272427 - RNA, 64 nt, Homo Sapiens; identical to SEQ ID NO: 157573

SEQ ID NO: 272428 - RNA, 64 nt, Homo Sapiens; identical to SEQ ID NO: 157574

SEQ ID NO: 272429 - RNA, 64 nt, Homo Sapiens; identical to SEQ ID NO: 157575

SEQ ID NO: 272430 - RNA, 64 nt, Homo Sapiens; identical to SEQ ID NO: 157576

SEQ ID NO: 272431 - RNA, 64 nt, Homo Sapiens; identical to SEQ ID NO: 157577

SEQ ID NO: 272432 - RNA, 64 nt, Homo Sapiens; identical to SEQ ID NO: 157578

SEQ ID NO: 272433 - RNA, 64 nt, Homo Sapiens; identical to SEQ ID NO: 157579

SEQ ID NO: 272434 - RNA, 64 nt, Homo Sapiens; identical to SEQ ID NO: 157580

SEQ ID NO: 272435 - RNA, 64 nt, Homo Sapiens; identical to SEQ ID NO: 157581

SEQ ID NO: 272436 - RNA, 64 nt, Homo Sapiens; identical to SEQ ID NO: 157582

SEQ ID NO: 272437 - RNA, 64 nt, Homo Sapiens; identical to SEQ ID NO: 157583

SEQ ID NO: 272438 - RNA, 64 nt, Homo Sapiens; identical to SEQ ID NO: 157584

SEQ ID NO: 272439 - RNA, 64 nt, Homo Sapiens; identical to SEQ ID NO: 157585

SEQ ID NO: 272440 - RNA, 64 nt, Homo Sapiens; identical to SEQ ID NO: 157586

SEQ ID NO: 272441 - RNA, 64 nt, Homo Sapiens; identical to SEQ ID NO: 157587

SEQ ID NO: 272442 - RNA, 64 nt, Homo Sapiens; identical to SEQ ID NO: 157588

SEQ ID NO: 272443 - RNA, 64 nt, Homo Sapiens; identical to SEQ ID NO: 157589

SEQ ID NO: 272444 - RNA, 64 nt, Homo Sapiens; identical to SEQ ID NO: 157590

SEQ ID NO: 272445 - RNA, 64 nt, Homo Sapiens; identical to SEQ ID NO: 157591

SEQ ID NO: 272446 - RNA, 64 nt, Homo Sapiens; identical to SEQ ID NO: 157592

SEQ ID NO: 272447 - RNA, 64 nt, Homo Sapiens; identical to SEQ ID NO: 157593

SEQ ID NO: 272448 - RNA, 64 nt, Homo Sapiens; identical to SEQ ID NO: 157594

SEQ ID NO: 272449 - RNA, 64 nt, Homo Sapiens; identical to SEQ ID NO: 157595

SEQ ID NO: 272450 - RNA, 64 nt, Homo Sapiens; identical to SEQ ID NO: 157596

SEQ ID NO: 272451 - RNA, 64 nt, Homo Sapiens; identical to SEQ ID NO: 157597

SEQ ID NO: 272452 - RNA, 64 nt, Homo Sapiens; identical to SEQ ID NO: 157598

SEQ ID NO: 272453 - RNA, 64 nt, Homo Sapiens; identical to SEQ ID NO: 157599

SEQ ID NO: 272454 - RNA, 64 nt, Homo Sapiens; identical to SEQ ID NO: 157600

SEQ ID NO: 272455 - RNA, 64 nt, Homo Sapiens; identical to SEQ ID NO: 157601

SEQ ID NO: 272456 - RNA, 64 nt, Homo Sapiens; identical to SEQ ID NO: 157602

SEQ ID NO: 272457 - RNA, 64 nt, Homo Sapiens; identical to SEQ ID NO: 157603

SEQ ID NO: 272458 - RNA, 64 nt, Homo Sapiens; identical to SEQ ID NO: 157604

SEQ ID NO: 272459 - RNA, 64 nt, Homo Sapiens; identical to SEQ ID NO: 157605

SEQ ID NO: 272460 - RNA, 64 nt, Homo Sapiens; identical to SEQ ID NO: 157606

SEQ ID NO: 272461 - RNA, 64 nt, Homo Sapiens
caucuucaguugaaugcccucacuccaagacuggaugcuggaucucauagaaaauucacagcca

SEQ ID NO: 272462 - RNA, 64 nt, Homo Sapiens
cucacauaacuugauuauucacuccucugaaaagaugcuggauaggcuaccaaaguucccaagu

SEQ ID NO: 272463 - RNA, 64 nt, Homo Sapiens
ggugcuugaugaugaccaggagugugcucugggaaugcuggaggucccccugugccagauccuc

SEQ ID NO: 272464 - RNA, 64 nt, Homo Sapiens
uuauggcucuagcugcguacugacuauaaaauagaugcuggacucugguugguaaggucccuuc

SEQ ID NO: 272465 - RNA, 64 nt, Homo Sapiens
guaacuguuaaaaugugaaacuguauuugcuuaaaugcuggaaauuuuaguccacuauauauug

SEQ ID NO: 272466 - RNA, 64 nt, Homo Sapiens
cuauacuguccagccaggacagucauguguuugcaugcuggaugaggcugcgucaggcucuuaa

SEQ ID NO: 272467 - RNA, 64 nt, Homo Sapiens
guugaagagguguaagaagacaggaaagguuuagaugcuggagaucuccagagcagacuucuga

SEQ ID NO: 272468 - RNA, 64 nt, Homo Sapiens
cuuuguauuuuugaagcggcaagugcuugacugcaugcuggaaauguuuagcauucccuuguca

SEQ ID NO: 272469 - RNA, 64 nt, Homo Sapiens
cagcccucaccggugaauaaacauaagaaaaaucaugcuggagggaagcccuacacauguggca

SEQ ID NO: 272470 - RNA, 64 nt, Homo Sapiens
uuaauugguccucaaugcuuaauaaauauaauucaugcuggagagaaacuucacaugugaaccg

SEQ ID NO: 272471 - RNA, 64 nt, Homo Sapiens
ugguccucaacccuuaaugaacguaagugaauucaugcuggagcaaaaugcuucacaugcgaag

SEQ ID NO: 272472 - RNA, 64 nt, Homo Sapiens
uguaccugccagcaggagcaugauggggacuuccaugcuggaauugcucccugauuaaaaugag

SEQ ID NO: 272473 - RNA, 64 nt, Homo Sapiens
cucugcacacgcuagcucuccuucgccuucugccaugcuggaaguagccugaggcccucaccag

SEQ ID NO: 272474 - RNA, 64 nt, Homo Sapiens
uuauucuuccaaacaguaucgcuaguaaaauagcaugcuggacuucagaccucagggauccuuu

SEQ ID NO: 272475 - RNA, 64 nt, Homo Sapiens
uggcagcuaaacauuaaauucgcaugaaccacagaugcuggagaucaccagaccggggagagaa

SEQ ID NO: 272476 - RNA, 64 nt, Homo Sapiens
gcgagugaguugcccauuaauugugaugacuaaaaugcuggaaauaggguuccugugauuaauu

SEQ ID NO: 272477 - RNA, 64 nt, Homo Sapiens
ucuuugaaccauuucaagucgccauggaacacauaugcuggaaaaauugaauuagcauaauugg

SEQ ID NO: 272478 - RNA, 64 nt, Homo Sapiens
gcgucacaccuguugaggagugggguggcuuugaaugcuggaaauggcuucauagugaagugcc

SEQ ID NO: 272479 - RNA, 64 nt, Homo Sapiens
uucugcccuucucgguguccaggcuccuugggugaugcuggaguugucauggccgcaguucagu

SEQ ID NO: 272480 - RNA, 64 nt, Homo Sapiens
acucccaagaaaccaggcaggcagaagcuccugaaugcuggacuagacaaacuacaugcuggcu

SEQ ID NO: 272481 - RNA, 64 nt, Homo Sapiens
aaacaaguagugaucaguuuauacuuugauauuuaugcuggaaauggauagaaguucaaucaga

SEQ ID NO: 272482 - RNA, 64 nt, Homo Sapiens
gacucacauuggggcgaaugaaccaaguuucgccaugcuggaugaugaaauggauucccauccc

SEQ ID NO: 272483 - RNA, 64 nt, Homo Sapiens
ccucucacccuggaaaggaguugagggacaucagaugcuggaacccucacugaaaguccagaau

SEQ ID NO: 272484 - RNA, 64 nt, Homo Sapiens
gagcuccuagcaucagaggauguuuggggacauuaugcuggaaaccaccccuuggugcuggcag

SEQ ID NO: 272485 - RNA, 64 nt, Homo Sapiens
ucaugauuuuuacccucccuuaaaccgagcacugaugcuggacuuaugucaccaauauaugauu

SEQ ID NO: 272486 - RNA, 64 nt, Homo Sapiens
gaguguauguaugugaagauacccagauuuuaucaugcuggaaauauaugagggagaacgccuc

SEQ ID NO: 272487 - RNA, 64 nt, Homo Sapiens
cuggaaggguucccuuguccuaaugaagaggcccaugcuggagaauagagaacacaguggcuau

SEQ ID NO: 272488 - RNA, 64 nt, Homo Sapiens
uuggauucuagcacuggguucugagugguugaagaugcuggacauggucucucagcaaacacuc

SEQ ID NO: 272489 - RNA, 64 nt, Homo Sapiens
uggauauuuaauuuauguuuuguagcuguaacauaugcuggaauauuacaauuaaaaauaguga

SEQ ID NO: 272490 - RNA, 64 nt, Homo Sapiens
uguagaggguuuagucccgaggcuuaguaaaggaaugcuggaugccuagcucugggggcaaagg

SEQ ID NO: 272491 - RNA, 64 nt, Homo Sapiens
agccuggaaggaggcaauaagaccagaguuuaucaugcuggacagaggaggcugugaaugcuga

SEQ ID NO: 272492 - RNA, 64 nt, Homo Sapiens
ccagaggcacagccggggccugccuagcacucacaugcuggacaggucugggagaggcagagug

SEQ ID NO: 272493 - RNA, 64 nt, Homo Sapiens
acacaagacuuuccccauacucugucucccuauaaugcuggagcggcuacuaaaaaggauaaaa

SEQ ID NO: 272494 - RNA, 64 nt, Homo Sapiens
ucacagggggcuuugcugagugcgcucaauaaaaaugcuggaaugccgccccuccccgaugugg

SEQ ID NO: 272495 - RNA, 64 nt, Homo Sapiens
aaccaggccuuucccgcuuuccaaaagcugggaaaugcuggaggccacuaucucuugggagccc

SEQ ID NO: 272496 - RNA, 64 nt, Homo Sapiens
caguacuuuacccuuaauacacauaagauaauuaaugcuggagagaaacccuacaaaugugaag

SEQ ID NO: 272497 - RNA, 64 nt, Homo Sapiens
caauccucaacccuuacuacacauuagauaauucaugcuggagagaaacccuacaaaugugaaa

SEQ ID NO: 272498 - RNA, 64 nt, Homo Sapiens
gaaaucuuacaaaugucaucacaucagagaauccaugcuggacaucacauucacaccucaauag

SEQ ID NO: 272499 - RNA, 64 nt, Homo Sapiens
gaaaccuuauaaaugucaugucaucaucgaacucaugcuggagauaucguucauauauugcuau

SEQ ID NO: 272500 - RNA, 64 nt, Homo Sapiens
gaaaucuuacaaaugucaucacaucagagaauccaugcuggacaucacauucacaccucauuag

SEQ ID NO: 272501 - RNA, 64 nt, Homo Sapiens
gaaaccuuauaaaugucaugucacuggugaacucaugcuggagacaucguucaugccuugcauu

SEQ ID NO: 272502 - RNA, 64 nt, Homo Sapiens
uugacccaccuugggauuuuuccuauaaagagccaugcuggaauaccagguugucacuugcuug

SEQ ID NO: 272503 - RNA, 64 nt, Homo Sapiens
aagacauuccaaauauaacuacaucagagaacucaugcuggagaauguggaaggcauuccauca

SEQ ID NO: 272504 - RNA, 64 nt, Homo Sapiens
ugucauuuuaaacauugguaggccuugguacaugaugcuggauuaccucucuuaaaaugacacc

SEQ ID NO: 272505 - RNA, 64 nt, Homo Sapiens
agagucuggucauguggaggugggguuuauugggaugcuggagaagagcugccaggaaguguuu

SEQ ID NO: 272506 - RNA, 64 nt, Homo Sapiens
ggguaaauacccuaccucuuagaaagggcaaaaaugcaaagaagcuuucuuuaaaacuaaaagg

SEQ ID NO: 272507 - RNA, 64 nt, Homo Sapiens
uauucauccccuuugaaagaugagaagguugagaugcaaagagucuaccuuuccaaguucucac

SEQ ID NO: 272508 - RNA, 64 nt, Homo Sapiens
aaagaaaacuucuuguagccucacauuccccuugugcaaagagcucuuuuggaccuacauacau

SEQ ID NO: 272509 - RNA, 64 nt, Homo Sapiens
guguguauuuuucuuuuucuauaauaccuuuaacugcaaagaaaaggcaguuucaaauauaaga

SEQ ID NO: 272510 - RNA, 64 nt, Homo Sapiens
guuuccuaaauuguaugggaaaauuuuucuccguugcaaagaauuuuuuuaaagcuuuucuuuu

SEQ ID NO: 272511 - RNA, 64 nt, Homo Sapiens
aaaacagcaucuccucaccuaacugacagcaaccugcaaagaggaaagcagucaaguuccaagg

SEQ ID NO: 272512 - RNA, 64 nt, Homo Sapiens
guaugaugaugaucaugaucugcaaacagcgauuugcaaagaccgcccguuuugauuacgugca

SEQ ID NO: 272513 - RNA, 64 nt, Homo Sapiens
acugagaauacuuuggcuuaaggcauuugggaaaugcaaagaggcuuuuugaucaaacaagaaa

SEQ ID NO: 272514 - RNA, 64 nt, Homo Sapiens
ccaaggcauugauugcacuugccccccagauugcugcaaagaucuccagaguucugugacacau

SEQ ID NO: 272515 - RNA, 64 nt, Homo Sapiens
uccagagucaguaguuagguguaggcuuucauguugcaaagaacaaggugcccaaccuaaaaau

SEQ ID NO: 272516 - RNA, 64 nt, Homo Sapiens
cuagaggcuggcuucacuagaugacacagguucuugcaaagaaaacacuuguggggacuuaggc

SEQ ID NO: 272517 - RNA, 64 nt, Homo Sapiens
ucuuaugagggaccaauucagcauuugcaaaaugugcaaagacccuugacauccaauucaaacu

SEQ ID NO: 272518 - RNA, 64 nt, Homo Sapiens
uaucuaauugcaaauggugcugugguuggcaccaugcaaagauaacuugcauaggacuuucugu

SEQ ID NO: 272519 - RNA, 64 nt, Homo Sapiens
cuacacaauggacccucaauaaauggccuauaugugcaaagaaagaauguguagcaaaugaaaa

SEQ ID NO: 272520 - RNA, 64 nt, Homo Sapiens
auaaauuccuuaagcuauuguaaccauguuuuauugcaaagauguaaaauaugccagaugugug

SEQ ID NO: 272521 - RNA, 64 nt, Homo Sapiens
gugaguuggaaaucaaaaaaagaaaaauaaaauaugcaaagaauucaccgacuguuucagauuu

SEQ ID NO: 272522 - RNA, 64 nt, Homo Sapiens
guguucauuuuuauacaauuuuuggaauagcuuaugcaaagauucguuuucauuaugguucaga

SEQ ID NO: 272523 - RNA, 64 nt, Homo Sapiens
gggcacucaggcagcccuuugaggucccauuaccugcaaagaaagaaacgaagaagcagaugga

SEQ ID NO: 272524 - RNA, 64 nt, Homo Sapiens
ugcuugacagacucacucggccucacuucauccuugcaaagagaauccuguacuucauccuugc

SEQ ID NO: 272525 - RNA, 64 nt, Homo Sapiens
ucauccuugcaaagagaauccuguacuucauccuugcaaagagaauccuguacuucacucagaa

SEQ ID NO: 272526 - RNA, 64 nt, Homo Sapiens
gagaaucacuugaccccaggugguggagguugcagugagccaagauugcaccauugcacuccag

SEQ ID NO: 272527 - RNA, 64 nt, Homo Sapiens
gagaaucgcuugaacccgggaggcacagguuccagugagccaagguugugccacugcacuccag

SEQ ID NO: 272528 - RNA, 64 nt, Homo Sapiens
caccucagccucccaaagugcugggauuacaggugugagccaccacgcccggcuauguuuuuuu

SEQ ID NO: 272529 - RNA, 64 nt, Homo Sapiens
ugccucggccucccaaagugcugagacuacaggugugagccaccgugcucagccacuagcuuug

SEQ ID NO: 272530 - RNA, 64 nt, Homo Sapiens
gaggaucgcuugugccuuggaggucaaaacugcagugagccaugguugcaccacugcucuccag

SEQ ID NO: 272531 - RNA, 64 nt, Homo Sapiens
gagaauugcuugaaccugggagguggagguugcagugagccaagaucgugccacugcacuccag

SEQ ID NO: 272532 - RNA, 64 nt, Homo Sapiens
ucuaggaauauuaguuagagacugauuaucucaugugagccaggacauucuuccagcaagguug

SEQ ID NO: 272533 - RNA, 64 nt, Homo Sapiens
caccucggccucccaaagugcuaggauuacaggagugagccacugcgccuggcccacuuuucuu

SEQ ID NO: 272534 - RNA, 64 nt, Homo Sapiens
gccagggggaccccgguaaauuaacggugucgaggugagccagguccuaaaggagacgagcgaa

SEQ ID NO: 272535 - RNA, 64 nt, Homo Sapiens
auuucagggggagcuggcggagcccgucuccucagugagccagccagaagagugggaggugaga

SEQ ID NO: 272536 - RNA, 64 nt, Homo Sapiens
acgcccgguacauauuuuuucugggauuacaggugugagccaccugccucggccucccaaagug

SEQ ID NO: 272537 - RNA, 64 nt, Homo Sapiens
gugccuggccacgcccaacucugggauuacaggcgugagccacccgccuucaucucccaaagug

SEQ ID NO: 272538 - RNA, 64 nt, Homo Sapiens
cuccucagccucccaaagugcugggauuacaagugugagccaccacaccuggcuccagaaauuu

SEQ ID NO: 272539 - RNA, 64 nt, Homo Sapiens
cuaaguuccuagagagccauuuaauaauuaguuggugagccagaggcuugacagagcuguuacu

SEQ ID NO: 272540 - RNA, 64 nt, Homo Sapiens
aagaaucaccuggaguuaggagguggugguugcagugagccaaucucaccauugcacuucagcc

SEQ ID NO: 272541 - RNA, 64 nt, Homo Sapiens
ggagaauugccucaaccgggaggcggagguugcagugagccaagaucgcaccacugcacuccag

SEQ ID NO: 272542 - RNA, 64 nt, Homo Sapiens
caccucggccuccgaaagugcuaggauuacaggugugagccacugugccuggccuccggugagu

SEQ ID NO: 272543 - RNA, 64 nt, Homo Sapiens
gaggauugcuugaacccaagaggucgaggcugcagugagccaagauugugccacugcacuccag

SEQ ID NO: 272544 - RNA, 64 nt, Homo Sapiens
ugggagaaucuccugagccuggaagguccaggcagugagccaagauugugccaccacacuccag

SEQ ID NO: 272545 - RNA, 64 nt, Homo Sapiens
caccucggccucccaaagugcugggauuacaggcgugagccaccgcgccuggccgaugguacua

SEQ ID NO: 272546 - RNA, 64 nt, Homo Sapiens
gaggauugcuugaacccaagaggucaaggcugcagugagccauguucacaccgcugcacucaag

SEQ ID NO: 272547 - RNA, 64 nt, Homo Sapiens
uuguaaugaugaagauguuaaaucuuuuuagaaagugagccauuauuaaagaaauucacuguaa

SEQ ID NO: 272548 - RNA, 64 nt, Homo Sapiens
aaacucuccuuggauacguuugauaauggcaucugugagccagauacaugguuguuaaagcuga

SEQ ID NO: 272549 - RNA, 64 nt, Homo Sapiens
ugccuuggccccccaaagugcugggauuacaggagugagccacugugcccagccuccaaccuaa

SEQ ID NO: 272550 - RNA, 64 nt, Homo Sapiens
caccucggucucccaaaguguugggauuacaggcgugagccacugcaccuggccuguaacauga

SEQ ID NO: 272551 - RNA, 64 nt, Homo Sapiens
cgccuuggccucccaaagugcugggauuacaggugugagccaccaugccuggcccuaauuuuug

SEQ ID NO: 272552 - RNA, 64 nt, Homo Sapiens
ugccucagccucccaaagugcugggauuacaggcgugagccacugcacagggccagauucauca

SEQ ID NO: 272553 - RNA, 64 nt, Homo Sapiens
gagauuugcuugaaccugggaggcagagguugcagugagccaagauugcgccguuguacuccag

SEQ ID NO: 272554 - RNA, 64 nt, Homo Sapiens
acacccacauaccuggcccaaccagacuucucccgugagccaggcaaaggaaauugucaucugc

SEQ ID NO: 272555 - RNA, 64 nt, Homo Sapiens
gaggaucacuugagccccggaggucgaggcuacagugagccaagagugcacuacuguacuccag

SEQ ID NO: 272556 - RNA, 64 nt, Homo Sapiens
guccauuuucuaugcuuguaacugucuucuagcagugagccaaauguaaaauagugaauaaagu

SEQ ID NO: 272557 - RNA, 64 nt, Homo Sapiens
gugcccggccaaaagaacagcugggauuacaggugugagccacucgccucggccucccaaaaug

SEQ ID NO: 272558 - RNA, 64 nt, Homo Sapiens
gugccugaccugucauuuuucugggauuacaggcgugagccacucaccucugccucccaaagug

SEQ ID NO: 272559 - RNA, 64 nt, Homo Sapiens
acgccuggcccaugaaccaacugggauuacaggugugagccacccgucucggccucccaaagug

SEQ ID NO: 272560 - RNA, 64 nt, Homo Sapiens
auggucucaaucuccugacccaggguuucaccaugugagccagguuuuguauuuuuaguagaga

SEQ ID NO: 272561 - RNA, 64 nt, Homo Sapiens
caccucggccucccaaagugcugggauuaaagcugugagccacugugccaaggcuuuuuuauuu

SEQ ID NO: 272562 - RNA, 64 nt, Homo Sapiens
cgccucagccucccaaaaugcugggauuacaggcgugagccaccgcgccuggccuaaaaugugu

SEQ ID NO: 272563 - RNA, 64 nt, Homo Sapiens
gccuuuuggaaguaaugguguuaaacagaauacugugagccaaugggauaaaugguccacaauc

SEQ ID NO: 272564 - RNA, 64 nt, Homo Sapiens
gcgcccggccaaaaagaacacugggauuacaggcgugagccacuugccucggccucccaaagug

SEQ ID NO: 272565 - RNA, 64 nt, Homo Sapiens
gcagccggaccauuuuuagucugggauuacaggugugagccacccaccucagccucccaaagug

SEQ ID NO: 272566 - RNA, 64 nt, Homo Sapiens
gugccuggccgacauuuuuacugggauuacaggcgugagccacccgccuuggccucccaaagug

SEQ ID NO: 272567 - RNA, 64 nt, Homo Sapiens
acgcccagccucuccccuuucugagauuacaagugugagccaccugccucggccucccaaagug

SEQ ID NO: 272568 - RNA, 64 nt, Homo Sapiens
ucgccuggccagaucucuuucugggaucacaggcgugagccacccaccccggccucccaaaaug

SEQ ID NO: 272569 - RNA, 64 nt, Homo Sapiens
gcgcccggcggcgaaacacgcugggauuacaggcgugagccacccgccucggccucccaaagug

SEQ ID NO: 272570 - RNA, 64 nt, Homo Sapiens
gcgcccggcugcaaauaaucuugggauuacccgcgugagccacccgccucggccucccaaagua

SEQ ID NO: 272571 - RNA, 64 nt, Homo Sapiens
acaccaggcccgagaaaugccugggauuacaggcgugagccacccaccucagccucccaaagug

SEQ ID NO: 272572 - RNA, 64 nt, Homo Sapiens
uaguauuuguaaccauaagacugggauuacaggcgugagccacucgccucggccucccaaagug

SEQ ID NO: 272573 - RNA, 64 nt, Homo Sapiens
gcacccggccugaaauuuuucugugauuacaggugugagccacucgccucgaccucccaaagug

SEQ ID NO: 272574 - RNA, 64 nt, Homo Sapiens
gcgcccggccgaaguguuugcugggauuacaggcgugagccacuugccuuggccucccaaagug

SEQ ID NO: 272575 - RNA, 64 nt, Homo Sapiens
gcucccggcccagaacuuuucugggauuacaggagugagccacccgccucagccucccaaagug

SEQ ID NO: 272576 - RNA, 64 nt, Homo Sapiens
uauagcccagguccucugauacccagagcauuacgugagccagguaaugagggacuggaaccag

SEQ ID NO: 272577 - RNA, 64 nt, Homo Sapiens
gagaaucgcuuaaaccugggaggcggagaguacagugagccaagaucgcgccacugcacuccgg

SEQ ID NO: 272578 - RNA, 64 nt, Homo Sapiens
auugugccacugcacucaagagguggagguugcagugagccaagaagaaucacuugaacuuggg

SEQ ID NO: 272579 - RNA, 64 nt, Homo Sapiens
acgccuggccaauuauguaacugggauuacaggcgugagccaccugccucggccucccaaagug

SEQ ID NO: 272580 - RNA, 64 nt, Homo Sapiens
acguccggccaauuuuucuccuaggauuacaggugugagccacccaccuuggccucccaaaguu

SEQ ID NO: 272581 - RNA, 64 nt, Homo Sapiens
aggcccugccugguuuucaacugggauuacaggcgugagccaccugccuuggcuccccaaagug

SEQ ID NO: 272582 - RNA, 64 nt, Homo Sapiens
ucaauuuugcaaaggugcagguugcucagcugcagugagccagucuugcuucaguggugguucu

SEQ ID NO: 272583 - RNA, 64 nt, Homo Sapiens
gaauuauggcuaauucggcucagaucuccacugugugagccagugcuuugguaugaaugagagc

SEQ ID NO: 272584 - RNA, 64 nt, Homo Sapiens
ggaaguuuggggcguggugagggcaaaagauggagugagccacaaucaccgaagcucccuagag

SEQ ID NO: 272585 - RNA, 64 nt, Homo Sapiens
aggccugaccuccccuuccccugccauuacaggcgugagccacuugacucugccucccaaagug

SEQ ID NO: 272586 - RNA, 64 nt, Homo Sapiens
ggaacagcgggagaccugugugcuaaucaugugggugagccaguuuuuauuuuuucgugcacuc

SEQ ID NO: 272587 - RNA, 64 nt, Homo Sapiens
gcugccagcacagagcguccugcagacaggccaugugagccaccaucccagccugugguuacag

SEQ ID NO: 272588 - RNA, 64 nt, Homo Sapiens
gagaaucacuugaacucgggagguggagguugcagugagccaagaucgcgccacugcacuccag

SEQ ID NO: 272589 - RNA, 64 nt, Homo Sapiens
aaggauugcuugagcgagggaggucgaggcugcagugagccacgaucacaccacugcacuccag

SEQ ID NO: 272590 - RNA, 64 nt, Homo Sapiens
gagaaucacuugaaccuaggaggcggagguugcagugagccaagauggcgccauugcacuccag

SEQ ID NO: 272591 - RNA, 64 nt, Homo Sapiens
gagaaucgcuugaacccaggaggcggagguugcagugagccaagauggcgccauugcacuccag

SEQ ID NO: 272592 - RNA, 64 nt, Homo Sapiens
uugauuuuuuauuuuauuaucaucagacuauguugugagccaggaagacuggugaaaacacaua

SEQ ID NO: 272593 - RNA, 64 nt, Homo Sapiens
ccggccuaaucugaccgccucccgggacccucgugugagccagcacgggcaggaaaaagccaag

SEQ ID NO: 272594 - RNA, 64 nt, Homo Sapiens
acuccuagccuuaaugcauacuaggauuacuggcgugagccacccaccucggccucccaaagug

SEQ ID NO: 272595 - RNA, 64 nt, Homo Sapiens
gcccgggcaaauuuuuguaucugggauuauaggcgugagccaccgccuuggccucccaaaagug

SEQ ID NO: 272596 - RNA, 64 nt, Homo Sapiens
augcccagccucaaauaugucuggaauuacuggcgugagccacccgccucggccucccaaagug

SEQ ID NO: 272597 - RNA, 64 nt, Homo Sapiens
gcaccuggccaaguaauuucuuaggauuauaggcgugagccacucaccucagccucccaaagca

SEQ ID NO: 272598 - RNA, 64 nt, Homo Sapiens
gcgccuggucuauaugugauuuggaauuacaggcgugagccaccugccuuggccuuccaaagug

SEQ ID NO: 272599 - RNA, 64 nt, Homo Sapiens
uuauggaggauucugugacuaaagugaauuuagagugagccagagccugccccuguccuagugc

SEQ ID NO: 272600 - RNA, 64 nt, Homo Sapiens
caccucagccuuucaaagugcuggaauuacaggugugagccacucugccuggccuaccacuaac

SEQ ID NO: 272601 - RNA, 64 nt, Homo Sapiens
ccccucggucucccaaagugcugggauuacaggcgugagccaccaugcccggcccaaauauuuu

SEQ ID NO: 272602 - RNA, 64 nt, Homo Sapiens
gcacccagccuagaaucuugcugggauuacaggcgugagccacucugccucggccucccaagug

SEQ ID NO: 272603 - RNA, 64 nt, Homo Sapiens
acaccuggccccaagcuugacugggauuacagaugugagccacccgccuuggccucccaaagug

SEQ ID NO: 272604 - RNA, 64 nt, Homo Sapiens
acagguguauggagucaccuguaaauugauucaagugagccaggaaagcagcaaaggaaagaga

SEQ ID NO: 272605 - RNA, 64 nt, Homo Sapiens
uaccucggccucccaaagugcugggauuacaggcgugagccaccacgcccggucaccuuugucc

SEQ ID NO: 272606 - RNA, 64 nt, Homo Sapiens
ugccuuggcuucccaaaguccugggauuacaggugugagccaccacauccagccuaacuuacau

SEQ ID NO: 272607 - RNA, 64 nt, Homo Sapiens
ccucgaccucucucaaagugcuggcauuacaggugugagccacggugcccggcccacaauuaau

SEQ ID NO: 272608 - RNA, 64 nt, Homo Sapiens
guuacaaguuauagcuacauaugggagagacucagugagccagcaaaggccauagaaacaacaa

SEQ ID NO: 272609 - RNA, 64 nt, Homo Sapiens
aaauguauuuauggcagaaggaccuaaauaaacugugagccaccuuuucuucuuuauauuguua

SEQ ID NO: 272610 - RNA, 64 nt, Homo Sapiens
gcacccggccucuguguagccugggauuacaggcgugagccaccugccuuggccucccagagug

SEQ ID NO: 272611 - RNA, 64 nt, Homo Sapiens
acgcccagcuaauuuuuguacugggacuacaggcgugagccagcugccucagccucucgaguag

SEQ ID NO: 272612 - RNA, 64 nt, Homo Sapiens
acaaugccacuacacuccagaggcagaggcugcagugagccaaggagaauugcuugaaccuggg

SEQ ID NO: 272613 - RNA, 64 nt, Homo Sapiens
aucacagcacugcacugcugaggcggagguugcagugagccaaggagaauuguuugaaccugga

SEQ ID NO: 272614 - RNA, 64 nt, Homo Sapiens
agccauaccccucuucucaauugggauuauaggugugagccagccgccuuggccucccuaagug

SEQ ID NO: 272615 - RNA, 64 nt, Homo Sapiens
ucgcccagcggcaucaggcucugggauuacaggcgugagccacccgccugggucuccuaaagua

SEQ ID NO: 272616 - RNA, 64 nt, Homo Sapiens
augcccggcuaauuuuuguauugggacuacaggcgugagccaccugccucaaccucccaagcag

SEQ ID NO: 272617 - RNA, 64 nt, Homo Sapiens
augcccagcugggagcguuccuaggauuacaggcgugagccaccugccucggccucccaaagug

SEQ ID NO: 272618 - RNA, 64 nt, Homo Sapiens
augcccggccaauacuacaccugggauuacacgcgugagccacccaccuuggccucccaaagug

SEQ ID NO: 272619 - RNA, 64 nt, Homo Sapiens
aucaugccacugcacuccagaggcggagguugcagugagccaaggagaaucccuugagcccggg

SEQ ID NO: 272620 - RNA, 64 nt, Homo Sapiens
ggccaguuuugacaggucaguugaugggaacccagugagccagguuauggaucccccacuauau

SEQ ID NO: 272621 - RNA, 64 nt, Homo Sapiens
ccugccucagccucccagugcugggauuauaggugugagccacugcgccuggcuaaguuauuau

SEQ ID NO: 272622 - RNA, 64 nt, Homo Sapiens
ugccuugaccucccaaagugcuaggauaacaggugugagccaccgcacccugccaaguuauuuu

SEQ ID NO: 272623 - RNA, 64 nt, Homo Sapiens
gugcccggccaagaauuuuucugggauuacaggcgugagccacuagccucagccucccaaagug

SEQ ID NO: 272624 - RNA, 64 nt, Homo Sapiens
gcacccagcccucucucuuccuggaaucacaggggugagccaccauccucggccucccaaagug

SEQ ID NO: 272625 - RNA, 64 nt, Homo Sapiens
aucgcgccacugcacuccagaggcggagguugcggugagccaaggauaaucacuugaauccggg

SEQ ID NO: 272626 - RNA, 64 nt, Homo Sapiens
augcacugcaccccagccugggguggggguugcagugagccaaggaagaucucuugagcccaag

SEQ ID NO: 272627 - RNA, 64 nt, Homo Sapiens
cugccuggcugguuauuuugcugggauuacaggcgugagccacuaccucggucuccccaaagug

SEQ ID NO: 272628 - RNA, 64 nt, Homo Sapiens
gcgcccggccuccaguucaucugggauuauaggcgugagccacccuccucggccucccaaagug

SEQ ID NO: 272629 - RNA, 64 nt, Homo Sapiens
acacccggcccccaguucuucugggauuacaggcgugagccaccugccuuggccucccaaagug

SEQ ID NO: 272630 - RNA, 64 nt, Homo Sapiens
gcacccaaccuuuuuuuccccugggauuacaggugugagccacaugccucggccucccaaagug

SEQ ID NO: 272631 - RNA, 64 nt, Homo Sapiens
guacccagccuggucccauacuaggauuacaggcgugagccacccaucuccaccucccaaagug

SEQ ID NO: 272632 - RNA, 64 nt, Homo Sapiens
guggccgaccuacuauuuuucugggauuacaggugugagccacucaccucagccucucaaagug

SEQ ID NO: 272633 - RNA, 64 nt, Homo Sapiens
augcccagccuaauuuuuguuugggauuauaggcgugagccaccugccuuggccucccaaagug

SEQ ID NO: 272634 - RNA, 64 nt, Homo Sapiens
gugcccggccugauguuuuucugggauuacaggcgugagccacccaccuuggccucccgaagug

SEQ ID NO: 272635 - RNA, 64 nt, Homo Sapiens
acgccuggcuaauuuuguaucuaggauuacaggugugagccaccugcuucggccucccaaagug

SEQ ID NO: 272636 - RNA, 64 nt, Homo Sapiens
acaccgggccaagugaagaacuggguuuauagaugugagccagccaccuuggccucccagaaug

SEQ ID NO: 272637 - RNA, 64 nt, Homo Sapiens
augccuggcccggauaauuucugggauuaccggcgugagccacccaccucggccucccacagug

SEQ ID NO: 272638 - RNA, 64 nt, Homo Sapiens
acagcuggcugaagauuauacugggauuacagacgugagccacccgccucugccucccaaagug

SEQ ID NO: 272639 - RNA, 64 nt, Homo Sapiens
augccaggcucauuguuauacugggacuacaauugugagccacccauuucagccucccaaguag

SEQ ID NO: 272640 - RNA, 64 nt, Homo Sapiens
acgcccagccccagcuuagucugggauuacaggggugagccacccgccucagccucccaaagug

SEQ ID NO: 272641 - RNA, 64 nt, Homo Sapiens
gcaccuggccaaccaacacuuugggauuacaggugugagccacacgccucagccucccaaagug

SEQ ID NO: 272642 - RNA, 64 nt, Homo Sapiens
cagaagcucccagcaccuccuacuugggagaaaagugagccaucugcuggucaggaaguccucc

SEQ ID NO: 272643 - RNA, 64 nt, Homo Sapiens
ucuuggccaggcuggucuuggaacuccugaccucgugagccaccacgcccagccucuuuugcug

SEQ ID NO: 272644 - RNA, 64 nt, Homo Sapiens
cgccucggccucccaaagugcugggauuacaggcgugagccaccuugccuggccaaaaaucuca

SEQ ID NO: 272645 - RNA, 64 nt, Homo Sapiens
aggaucaccugagcccagggaggucaaggaugcagugagccauggucucaccacugcacucuag

SEQ ID NO: 272646 - RNA, 64 nt, Homo Sapiens
gaggaucacuugaaccuaggaggucgaggcugcagugagccaagaucaugcuacugcacuccag

SEQ ID NO: 272647 - RNA, 64 nt, Homo Sapiens
caccuuggccucccaaagugcugagauuacaggcgugagccacugugccuggccuuauguaaag

SEQ ID NO: 272648 - RNA, 64 nt, Homo Sapiens
gugcccagcaguuucccagacugagauuacaggugugagccacuugucuuggccucccaaagug

SEQ ID NO: 272649 - RNA, 64 nt, Homo Sapiens
acacccagccucuguaguuccugggauuacaggugugagccacccgccuuggccucccaaagug

SEQ ID NO: 272650 - RNA, 64 nt, Homo Sapiens
auggcaccacugcacuccagaggcagagauugcggugagccaaggagaauugcuugaacccagg

SEQ ID NO: 272651 - RNA, 64 nt, Homo Sapiens
aaacagaaagucuaagaguuuuucacuuuucaaagugagccacuggaguacgugauucccuccc

SEQ ID NO: 272652 - RNA, 64 nt, Homo Sapiens
gugcccggcccagauagguucugggauuacaggugugagccaccugccucagccucccaaagug

SEQ ID NO: 272653 - RNA, 64 nt, Homo Sapiens
acgcccggccaugaaauauugggauuacaggcgugugagccacccacccaccucaggaagugcu

SEQ ID NO: 272654 - RNA, 64 nt, Homo Sapiens
gugcccaaccaugaaauauucugggauuacaggcgugagccacccgccuuggccucccaaagua

SEQ ID NO: 272655 - RNA, 64 nt, Homo Sapiens
agcaugccgcguuaggcucgaaagugugaguuugacggugcaucagagucggguuuugggguug

SEQ ID NO: 272656 - RNA, 64 nt, Homo Sapiens
uucaugguaaguuaggauuuaguguuucuucgccacggugcaucaaagggcccgcgcacaaagc

SEQ ID NO: 272657 - RNA, 64 nt, Homo Sapiens
augggaggguugaugugagcuugcuuggagacacacggugcagcaucagggaccuucccaggcc

SEQ ID NO: 272658 - RNA, 64 nt, Homo Sapiens
uggugucagagaaggcagagcccacaguaggugcacggugcaaggcccugggagggcacuggcc

SEQ ID NO: 272659 - RNA, 64 nt, Homo Sapiens
aaagagaagguuucuuccagagucaucuaccugaguccugaagcucccuguccugaaagccaca

SEQ ID NO: 272660 - RNA, 64 nt, Homo Sapiens
uccagagucaucuaccugaguccugaagcucccuguccugaaagccacagacaauaugguccca

SEQ ID NO: 272661 - RNA, 64 nt, Homo Sapiens
aaaacaacagaguggcugaaaaaagaccuggcagguccugaaucagccgcugaccauagccagc

SEQ ID NO: 272662 - RNA, 64 nt, Homo Sapiens
ggcagaaaaggaagaggggcaggacuccugccguguccugaaaacuaugccaguuacccuggag

SEQ ID NO: 272663 - RNA, 64 nt, Homo Sapiens
ugacccgaggucuuccuauccagcucuacuuuauguccugaagcuccuuccagggaugucucuc

SEQ ID NO: 272664 - RNA, 64 nt, Homo Sapiens
auaaccaccccugggaaacagugccugcagccagguccugaacccccaccaggcuugggaggaa

SEQ ID NO: 272665 - RNA, 64 nt, Homo Sapiens
cugacuuaauaaaacaaaauaaugcaauucaguaguccugaagcuuucaaauagcauuuuagug

SEQ ID NO: 272666 - RNA, 64 nt, Homo Sapiens
aaugguuuuucacucucuuauacagacugaggcgguccugaagcuaauuuuuuuaaaauagcau

SEQ ID NO: 272667 - RNA, 64 nt, Homo Sapiens
agcccagcugcuuuaccaggaguauagugauguuguccugaauaaggagauccagagccagcag

SEQ ID NO: 272668 - RNA, 64 nt, Homo Sapiens
gaacaauaucuucuccuuccaaguaugugacguaguccugaaccacgccccagacuuccgccgg

SEQ ID NO: 272669 - RNA, 64 nt, Homo Sapiens
caaauguuucuucucuuccuuuccccaagacagaguccugaaccuguuaaauuaagucauugga

SEQ ID NO: 272670 - RNA, 64 nt, Homo Sapiens
gcauuuguuacugaaaugauuaaugcacugauggguccugaauucaccuugagaaagacccaaa

SEQ ID NO: 272671 - RNA, 64 nt, Homo Sapiens; identical to SEQ ID NO: 73516

SEQ ID NO: 272672 - RNA, 64 nt, Homo Sapiens; identical to SEQ ID NO: 73517

SEQ ID NO: 272673 - RNA, 64 nt, Homo Sapiens; identical to SEQ ID NO: 91418

SEQ ID NO: 272674 - RNA, 64 nt, Homo Sapiens; identical to SEQ ID NO: 91419

SEQ ID NO: 272675 - RNA, 56 nt, Homo Sapiens; identical to SEQ ID NO: 91420

SEQ ID NO: 272676 - RNA, 64 nt, Homo Sapiens; identical to SEQ ID NO: 91421

SEQ ID NO: 272677 - RNA, 64 nt, Homo Sapiens; identical to SEQ ID NO: 91422

SEQ ID NO: 272678 - RNA, 64 nt, Homo Sapiens; identical to SEQ ID NO: 91423

SEQ ID NO: 272679 - RNA, 64 nt, Homo Sapiens; identical to SEQ ID NO: 91424

SEQ ID NO: 272680 - RNA, 64 nt, Homo Sapiens; identical to SEQ ID NO: 91425

SEQ ID NO: 272681 - RNA, 64 nt, Homo Sapiens; identical to SEQ ID NO: 91426

SEQ ID NO: 272682 - RNA, 64 nt, Homo Sapiens; identical to SEQ ID NO: 91427

SEQ ID NO: 272683 - RNA, 64 nt, Homo Sapiens; identical to SEQ ID NO: 91428

SEQ ID NO: 272684 - RNA, 64 nt, Homo Sapiens; identical to SEQ ID NO: 91429

SEQ ID NO: 272685 - RNA, 64 nt, Homo Sapiens; identical to SEQ ID NO: 91430

SEQ ID NO: 272686 - RNA, 64 nt, Homo Sapiens; identical to SEQ ID NO: 91431

SEQ ID NO: 272687 - RNA, 64 nt, Homo Sapiens; identical to SEQ ID NO: 91432

SEQ ID NO: 272688 - RNA, 64 nt, Homo Sapiens; identical to SEQ ID NO: 91433

SEQ ID NO: 272689 - RNA, 64 nt, Homo Sapiens; identical to SEQ ID NO: 91434

SEQ ID NO: 272690 - RNA, 64 nt, Homo Sapiens; identical to SEQ ID NO: 91435

SEQ ID NO: 272691 - RNA, 64 nt, Homo Sapiens; identical to SEQ ID NO: 91436

SEQ ID NO: 272692 - RNA, 64 nt, Homo Sapiens
uuagguacugcauggaaauaggucauuaacuugaaacucuuaucaaaauauauuuuaccaguuu

SEQ ID NO: 272693 - RNA, 64 nt, Homo Sapiens
guaguacgacccucuggauuuggaaggcaaauaaaacucuuacagugauuauuuagauauuaaa

SEQ ID NO: 272694 - RNA, 64 nt, Homo Sapiens
aauauaaaaagaguaccugagauguauuuuuuuaaacucuuagagauaucuguaacucaaauuu

SEQ ID NO: 272695 - RNA, 64 nt, Homo Sapiens
guauaucaguaauauagaagacaucuuuauagucaacucuuaauuaaugcuuauuguaccaaau

SEQ ID NO: 272696 - RNA, 57 nt, Homo Sapiens
aaaaaaacacaacugauugacacucagaacucuuagcuguggaagaacaucaugccu

SEQ ID NO: 272697 - RNA, 64 nt, Homo Sapiens
uaucagaacaucugagcaccauuuuagaagagucaacucuuaagauuaucauuagaaaacaaau

SEQ ID NO: 272698 - RNA, 64 nt, Homo Sapiens
uacagucauuuuccucaguuccuuuucucgccugaacucuuaagcugcaucuggaagauggcuu

SEQ ID NO: 272699 - RNA, 64 nt, Homo Sapiens
gcaugauaaauguuuaaauguagucaacaucuguaacucuuacaugaguguccagaggcacuca

SEQ ID NO: 272700 - RNA, 64 nt, Homo Sapiens
guggagaaugcggaaaagccuuuaacugguccucaacucuuauuacacauaagauaauucacag

SEQ ID NO: 272701 - RNA, 64 nt, Homo Sapiens
gugaacaguguggcaaggucuuuaagaaguccucaacucuuacugcacauaagaucauucauac

SEQ ID NO: 272702 - RNA, 64 nt, Homo Sapiens
gaaugugacgaaugaagaaaagguauuaguguuaaacucuuaaucgacuccugcaaaucuauac

SEQ ID NO: 272703 - RNA, 64 nt, Homo Sapiens
ucugcuguucuuggcccaaguucuuuccaaaaccaacucuuaggccugcucuuuacuagggauc

SEQ ID NO: 272704 - RNA, 64 nt, Homo Sapiens
uauuuauauaauucaaaagaggaauguuauuauaaacucuuagauacccuggaaagaaaauauu

SEQ ID NO: 272705 - RNA, 64 nt, Homo Sapiens
uaguaccaaacauuuugaaccaucuugaugagaaaacucuuaaaacucuccagaauguacuauc

SEQ ID NO: 272706 - RNA, 64 nt, Homo Sapiens
gaucuugaaauaucucaggauagcacuuuuggcaaacucuuagccaaggcuucuucauuggugc

SEQ ID NO: 272707 - RNA, 64 nt, Homo Sapiens
aacuguaaaauauaucauauggggggaguuuuuuaacucuuauuuuuugaaaauuuacuguagc

SEQ ID NO: 272708 - RNA, 64 nt, Homo Sapiens
aguccacaugcaauuagacaugcgauaacugagaaacucuuaccucuugaaaauguuuuggaac

SEQ ID NO: 272709 - RNA, 64 nt, Homo Sapiens
uaaacugagcugaauguuuguuucagggauaaguaacucuuaccuuagaaucugaugccuuuau

SEQ ID NO: 272710 - RNA, 64 nt, Homo Sapiens
uuauuuccugccuuuucuucuaauaauguaauucaacucuuaaauagauuuuuugaaaagugag

SEQ ID NO: 272711 - RNA, 64 nt, Homo Sapiens
aaacauaaaaaaauucauacuuuuaccaguccucaacucuuacugugaaaaauguggcaaagcc

SEQ ID NO: 272712 - RNA, 64 nt, Homo Sapiens
accagagaauucacacugguuuuauugauuguucaacucuuaacguaaaaaauguagaaaaucc

SEQ ID NO: 272713 - RNA, 64 nt, Homo Sapiens
caacaucaaagaauucauacuuuaauaauuauccaacucuuacuguaaagaaugugggaagguu

SEQ ID NO: 272714 - RNA, 64 nt, Homo Sapiens; identical to SEQ ID NO: 96836

SEQ ID NO: 272715 - RNA, 64 nt, Homo Sapiens; identical to SEQ ID NO: 96837

SEQ ID NO: 272716 - RNA, 64 nt, Homo Sapiens; identical to SEQ ID NO: 96838

SEQ ID NO: 272717 - RNA, 64 nt, Homo Sapiens; identical to SEQ ID NO: 96839

SEQ ID NO: 272718 - RNA, 64 nt, Homo Sapiens; identical to SEQ ID NO: 96840

SEQ ID NO: 272719 - RNA, 64 nt, Homo Sapiens; identical to SEQ ID NO: 96841

SEQ ID NO: 272720 - RNA, 64 nt, Homo Sapiens; identical to SEQ ID NO: 96842

SEQ ID NO: 272721 - RNA, 64 nt, Homo Sapiens; identical to SEQ ID NO: 96843

SEQ ID NO: 272722 - RNA, 64 nt, Homo Sapiens; identical to SEQ ID NO: 96844

SEQ ID NO: 272723 - RNA, 64 nt, Homo Sapiens; identical to SEQ ID NO: 96845

SEQ ID NO: 272724 - RNA, 64 nt, Homo Sapiens; identical to SEQ ID NO: 96846

SEQ ID NO: 272725 - RNA, 64 nt, Homo Sapiens; identical to SEQ ID NO: 96847

SEQ ID NO: 272726 - RNA, 64 nt, Homo Sapiens; identical to SEQ ID NO: 96848

SEQ ID NO: 272727 - RNA, 64 nt, Homo Sapiens; identical to SEQ ID NO: 96849

SEQ ID NO: 272728 - RNA, 64 nt, Homo Sapiens; identical to SEQ ID NO: 96850

SEQ ID NO: 272729 - RNA, 64 nt, Homo Sapiens; identical to SEQ ID NO: 96851

SEQ ID NO: 272730 - RNA, 64 nt, Homo Sapiens; identical to SEQ ID NO: 96852

SEQ ID NO: 272731 - RNA, 64 nt, Homo Sapiens; identical to SEQ ID NO: 96853

SEQ ID NO: 272732 - RNA, 64 nt, Homo Sapiens; identical to SEQ ID NO: 96854

SEQ ID NO: 272733 - RNA, 64 nt, Homo Sapiens; identical to SEQ ID NO: 96855

SEQ ID NO: 272734 - RNA, 64 nt, Homo Sapiens; identical to SEQ ID NO: 96856

SEQ ID NO: 272735 - RNA, 64 nt, Homo Sapiens; identical to SEQ ID NO: 96857

SEQ ID NO: 272736 - RNA, 64 nt, Homo Sapiens; identical to SEQ ID NO: 96858

SEQ ID NO: 272737 - RNA, 64 nt, Homo Sapiens; identical to SEQ ID NO: 96859

SEQ ID NO: 272738 - RNA, 64 nt, Homo Sapiens; identical to SEQ ID NO: 96860

SEQ ID NO: 272739 - RNA, 64 nt, Homo Sapiens; identical to SEQ ID NO: 96861

SEQ ID NO: 272740 - RNA, 64 nt, Homo Sapiens; identical to SEQ ID NO: 96862

SEQ ID NO: 272741 - RNA, 64 nt, Homo Sapiens; identical to SEQ ID NO: 96863

SEQ ID NO: 272742 - RNA, 64 nt, Homo Sapiens; identical to SEQ ID NO: 96864

SEQ ID NO: 272743 - RNA, 64 nt, Homo Sapiens; identical to SEQ ID NO: 96865

SEQ ID NO: 272744 - RNA, 64 nt, Homo Sapiens; identical to SEQ ID NO: 96866

SEQ ID NO: 272745 - RNA, 64 nt, Homo Sapiens; identical to SEQ ID NO: 96867

SEQ ID NO: 272746 - RNA, 64 nt, Homo Sapiens; identical to SEQ ID NO: 96868

SEQ ID NO: 272747 - RNA, 64 nt, Homo Sapiens; identical to SEQ ID NO: 96869

SEQ ID NO: 272748 - RNA, 64 nt, Homo Sapiens; identical to SEQ ID NO: 96870

SEQ ID NO: 272749 - RNA, 64 nt, Homo Sapiens; identical to SEQ ID NO: 96871

SEQ ID NO: 272750 - RNA, 64 nt, Homo Sapiens; identical to SEQ ID NO: 96872

SEQ ID NO: 272751 - RNA, 64 nt, Homo Sapiens; identical to SEQ ID NO: 96873

SEQ ID NO: 272752 - RNA, 64 nt, Homo Sapiens; identical to SEQ ID NO: 96874

SEQ ID NO: 272753 - RNA, 64 nt, Homo Sapiens; identical to SEQ ID NO: 96875

SEQ ID NO: 272754 - RNA, 64 nt, Homo Sapiens
caguuuauaaauuuggcgcucuuuuaauuacacucuguagaagguuaauagagcuugagcccug

SEQ ID NO: 272755 - RNA, 64 nt, Homo Sapiens
ugagcccugcuuuaauauguagugaaagauaauucuguagaaaaacgucagccaguaggguaaa

SEQ ID NO: 272756 - RNA, 64 nt, Homo Sapiens
uggcacuuauaaccaaagccaagacgugauuuugcuguagaagaggaacguuuuuccuguucuu

SEQ ID NO: 272757 - RNA, 64 nt, Homo Sapiens
gggaacugaacauuccagaggucucgugguaggacuguagaaaacaaguucuuaguugcuguau

SEQ ID NO: 272758 - RNA, 64 nt, Homo Sapiens
agaggugggugaccuauggugagaugauggauuccuguagaacuuauuuugaguuauuccaaca

SEQ ID NO: 272759 - RNA, 64 nt, Homo Sapiens
auguggaaauaacccuagaugacucucuuuuucacuguagaauacuuggagggagguggaaguu

SEQ ID NO: 272760 - RNA, 64 nt, Homo Sapiens
agaguuuaccaugauucagagaaguucuucaggccuguagaaagaggaguauggaacaaccuua

SEQ ID NO: 272761 - RNA, 64 nt, Homo Sapiens
auaauuuccugguaaggcuaacuccugaucguuucuguagaaagaugacaaauaaagaaaaagu

SEQ ID NO: 272762 - RNA, 64 nt, Homo Sapiens
cugucuuucuauagaaauauucagaggaguggaucuguagaagucaggcuguugaagcauuuuc

SEQ ID NO: 272763 - RNA, 64 nt, Homo Sapiens
ugucuccuacuuugaaaacuacuguaaaaugauacuguagaaccuuguuuucaauguguuggaa

SEQ ID NO: 272764 - RNA, 64 nt, Homo Sapiens
agcuugcugagccccuccgaguagaaguggcuuacuguagaagcuuccuguuugaaggcuuacu

SEQ ID NO: 272765 - RNA, 64 nt, Homo Sapiens
ggcuuacuguagaagcagcuuguuugaaggcuuacuguagaaguucauuuuaugcuuuauuucc

SEQ ID NO: 272766 - RNA, 64 nt, Homo Sapiens
ucuacugcauuaugagcacuuaaaguacugcuagcuguagaacuccagcuucggccugucgccc

SEQ ID NO: 272767 - RNA, 64 nt, Homo Sapiens
aauccaugcaaaacugacugugguagugaaaagucuguagaaaaguaagggaaacucaaacccc

SEQ ID NO: 272768 - RNA, 64 nt, Homo Sapiens
gucggggccgggcccgccaguucuuuuccggauucuguagaaaauacauacuuccugugccaua

SEQ ID NO: 272769 - RNA, 64 nt, Homo Sapiens
aagucugugguacuccaggauuccaggaguaagccuguagaagagauuuauuuuaaaagagauu

SEQ ID NO: 272770 - RNA, 64 nt, Homo Sapiens
cuacgaccccagagugacugacggcuguguauuucuguagaaugcuguagaauccgguuuuagu

SEQ ID NO: 272771 - RNA, 64 nt, Homo Sapiens
agagugacugacggcuguguauuucuguagaaugcuguagaauccgguuuuaguugagucuuca

SEQ ID NO: 272772 - RNA, 64 nt, Homo Sapiens
agaugguacgucaugcucaguguccaguuuaauucuguagaaguuacgucuggcucuagguuaa

SEQ ID NO: 272773 - RNA, 64 nt, Homo Sapiens
cauuucuaguucacguugaaugacaggccuggagcuguagaaucaggaaacccggaugccuaac

SEQ ID NO: 272774 - RNA, 64 nt, Homo Sapiens
uccaaagugcugucaugcugccugcuuucuggagcuguagaaaguugaaacaccuggcgcagau

SEQ ID NO: 272775 - RNA, 64 nt, Homo Sapiens
ugcuaaaacaggugccaugaaucagguacaauuacuguagaaacuaacauuagcuauuauacac

SEQ ID NO: 272776 - RNA, 64 nt, Homo Sapiens
gauguaggaagcacgaggaaaaaguuguacuaggcaaacacacucuuauuuacaaggcugcguu

SEQ ID NO: 272777 - RNA, 64 nt, Homo Sapiens
gucucuuacagguauaguucuaaucuaacguuuucaaacacaagugauuuuagaaaaagaagcu

SEQ ID NO: 272778 - RNA, 64 nt, Homo Sapiens
ucuaggaugaacaauguauacuacaaacguuugacaaacacaauuuugggagggauggggaaaa

SEQ ID NO: 272779 - RNA, 64 nt, Homo Sapiens
auaaaguucagauguuucauguugaguuauuccacaaacacauuucuaaaugcaauaagauuua

SEQ ID NO: 272780 - RNA, 64 nt, Homo Sapiens
uuagaggccuuugcugaugaguuccauuacuacgcaaacacauaaacaggcccaauuaaaaacu

SEQ ID NO: 272781 - RNA, 64 nt, Homo Sapiens
aaaaacugagaacucugcuguagcuuagcaaaaacaaacacacagaacucuagcaaaacuuguu

SEQ ID NO: 272782 - RNA, 64 nt, Homo Sapiens
auuuuuuacaacuuucuuuguaguccuguaaaugcaaacacagcucuguugcauacuuaguuuu

SEQ ID NO: 272783 - RNA, 64 nt, Homo Sapiens
cuuucaucagaagcccauucagaggaaaugaagccaaacacauccaaaagcguaagaugaagag

SEQ ID NO: 272784 - RNA, 64 nt, Homo Sapiens
cauuuaucauuuaaugcauagccauacacacacacaaacacacauaaagcuuaugcucagaaau

SEQ ID NO: 272785 - RNA, 64 nt, Homo Sapiens
cagccacauauauacaugugcacaaucccacaugcaaacacacauaaacauauacauacacaaa

SEQ ID NO: 272786 - RNA, 64 nt, Homo Sapiens
cccacaugcaaacacacacaaacauauacauacacaaacacaauauucaacucacacacacaua

SEQ ID NO: 272787 - RNA, 64 nt, Homo Sapiens
caccugaagacaugcucucacauauagagguacacaaacacaccgucaugcacauuucagcuug

SEQ ID NO: 272788 - RNA, 64 nt, Homo Sapiens
aaugugucuuuagagcucaguauucuuuauuuuacaaacacaacaaaauguaguaacuuuuuuc

SEQ ID NO: 272789 - RNA, 64 nt, Homo Sapiens
gacccaugggaacaaaugagcaugcuuauguauccaaacacagagcuguaugagcagggauauc

SEQ ID NO: 272790 - RNA, 64 nt, Homo Sapiens
gaugguggaguacggccggguguggagugggggccaaacacauggggccuggugaggcaacagc

SEQ ID NO: 272791 - RNA, 64 nt, Homo Sapiens
agcgcuacuuggccaagaagcagaucugcugaagcaaacacaggccuggcccaggcugggggua

SEQ ID NO: 272792 - RNA, 64 nt, Homo Sapiens
acaaaggaagccucugcuucugcagccaggccuccaaacacaccgugacagacaacaggccuuc

SEQ ID NO: 272793 - RNA, 64 nt, Homo Sapiens
uuaauugacaacacuagggcccgugcccggccugcaaacacauugggauuacgggugugagcca

SEQ ID NO: 272794 - RNA, 64 nt, Homo Sapiens
gacacaccuuuugauauguacuuuaggacacacacaaacacacacauucagauaaauggcagua

SEQ ID NO: 272795 - RNA, 64 nt, Homo Sapiens
augagcucaagaagguccuuaacacagucgugaacaaacacaaggaccugaagacacacggguu

SEQ ID NO: 272796 - RNA, 64 nt, Homo Sapiens
agcucuaugacaucauuaccaugcgguacgcagacaaacacaugaacaucgacuuugacaguuu

SEQ ID NO: 272797 - RNA, 64 nt, Homo Sapiens
caaacauaccuacacacacacuugcacauacauacaaacacaugcacaaacacacacacaagca

SEQ ID NO: 272798 - RNA, 64 nt, Homo Sapiens
cacaagcacuugcacauacacucacacauacucacaaacacacacauggcagaggaauacaucu

SEQ ID NO: 272799 - RNA, 64 nt, Homo Sapiens
cuguaacgugguucaucccugguuaaaaagcaaacaaacacaggcugaaaacccaugcugcugu

SEQ ID NO: 272800 - RNA, 64 nt, Homo Sapiens
uugacuccaagucucugugagcagugacuugaaccaaacacaccaggaauaauccauucuuugg

SEQ ID NO: 272801 - RNA, 64 nt, Homo Sapiens
aucugccucacaccuucaaauucaugaaaggacacaaacacacauaagaauacacucuggagaa

SEQ ID NO: 272802 - RNA, 64 nt, Homo Sapiens
aucugccaagaaccuucgaauucaugaaaggacacaaacacacguaagaaugcacucuguagaa

SEQ ID NO: 272803 - RNA, 64 nt, Homo Sapiens
guuuuccuugcugcaaggcuagggcaaaaggguccaaacacaugggccuuccacagcagaaacc

SEQ ID NO: 272804 - RNA, 64 nt, Homo Sapiens
ugccccuuuucucuggaucuagauccaagaaugacaaacacaaggaaaaaaaaaacucauuggc

SEQ ID NO: 272805 - RNA, 64 nt, Homo Sapiens
agaaggggaaggggaagaaacucuugacgugggagaaauugaaaggaaaaacauguuggcuuuu

SEQ ID NO: 272806 - RNA, 64 nt, Homo Sapiens
aguaccaagaaguggaagaacuguugacauggaugaaauugaaagcaacagcguauuggcuugg

SEQ ID NO: 272807 - RNA, 64 nt, Homo Sapiens
aauacuccaacaggaaugguagucacacugucuugaaauugaaucuguccaucuguuuauaauc

SEQ ID NO: 272808 - RNA, 64 nt, Homo Sapiens
uugguugcagcacaacuguauauauuguauaaccgaaauugauuauuuucauuguccuuaaugc

SEQ ID NO: 272809 - RNA, 64 nt, Homo Sapiens
acaguuccacuaaauuguugguaucauacuugaagaaauugauuuauucagugcagcccucaua

SEQ ID NO: 272810 - RNA, 64 nt, Homo Sapiens
acagaucuauuagguuggugccguuuaguguagagaaauugaaaaauggguucuauagaaaagu

SEQ ID NO: 272811 - RNA, 64 nt, Homo Sapiens
caagaaggaaaagucacgauaaaccuggucaccugaaauugaaauugagccacuuccuugaaga

SEQ ID NO: 272812 - RNA, 64 nt, Homo Sapiens
ggaaaagucacgauaaaccuggucaccugaaauugaaauugagccacuuccuugaagaaucaaa

SEQ ID NO: 272813 - RNA, 64 nt, Homo Sapiens
agaaguagagaaugaaggaaaaggugaaugcuaugaaauugauauuuuuucuggaacugaauuc

SEQ ID NO: 272814 - RNA, 64 nt, Homo Sapiens
aacacugacuuuguuuuuauaaguuauuaaaugugaaauugaucugcaucagcuuauuuauaaa

SEQ ID NO: 272815 - RNA, 64 nt, Homo Sapiens
uccgguauauauaaauauuuuuaccacagaaacagaaauugaccuaagcuuaccuguagggcag

SEQ ID NO: 272816 - RNA, 53 nt, Homo Sapiens
uccaucaggcaaaauuuaaaagugaaauugaacaacaagaaugccucgacuag

SEQ ID NO: 272817 - RNA, 64 nt, Homo Sapiens
ugggggagucauggucagggaaaaaaaaaaaaaagaaauugaauaagacuccgucucaaaaaaa

SEQ ID NO: 272818 - RNA, 64 nt, Homo Sapiens
gggggaggcccaaugaggugucagucaugucacugaaauugaauuggcauggguggguggggag

SEQ ID NO: 272819 - RNA, 64 nt, Homo Sapiens
caccuuuauuagauaaaucaugaagugucccugugaaauugaagugaaacuaucucuguaggac

SEQ ID NO: 272820 - RNA, 64 nt, Homo Sapiens
ggccuuggaauuuucauuuugaugcagaaauuuugaaauugaaaaugugcauguuuuggugcac

SEQ ID NO: 272821 - RNA, 64 nt, Homo Sapiens
uggggagggaaaauuggaaugguucccuuuuuuagaaauugaaguggucuucauaugucaacua

SEQ ID NO: 272822 - RNA, 64 nt, Homo Sapiens
cuucauaugucaacuacagaaaaggaaaaaaauagaaauugaaggauuuuuaugaaauuauauu

SEQ ID NO: 272823 - RNA, 64 nt, Homo Sapiens
ucacucagcuguuacauuucggacuugaaaaaucgaaauugacagacuuacccaguccggcauc

SEQ ID NO: 272824 - RNA, 64 nt, Homo Sapiens
aauaggcaggcaccaccgucauuuauugaagugugaaauugagcuuauaccuauuuauguauuu

SEQ ID NO: 272825 - RNA, 64 nt, Homo Sapiens
aagaaaaagaagaaaacgaaagaaguauguugcugaaauugaaauuuaaauccugaagaaauug

SEQ ID NO: 272826 - RNA, 64 nt, Homo Sapiens
aguauguugcugaaauugaauuuuaaauccugaagaaauugagaaugaaguuuuuuucuauaga

SEQ ID NO: 272827 - RNA, 64 nt, Homo Sapiens
ugcuuuuuuugaaacuuugaaauauauuuaaagggaaauugagcaacaccaaaaaauaucuagu

SEQ ID NO: 272828 - RNA, 64 nt, Homo Sapiens
aguuauuucccuuuagcuguguucuagugcagcugaaauugaaacuuuaacuuaguuuugcaua

SEQ ID NO: 272829 - RNA, 64 nt, Homo Sapiens
aaacuuugauuuccuuuuuuuuaauuacugaguagaaauugacuuuuaugggucagcaugacca

SEQ ID NO: 272830 - RNA, 64 nt, Homo Sapiens
guagagcauuuaguugaagauacaauugauauuugaaauugacuaauuaacauguucugaaggu

SEQ ID NO: 272831 - RNA, 64 nt, Homo Sapiens
cagugaauaaaacaccaaaaacccaaaaaugcuuuaaccacaguauaaauaauagauuauacac

SEQ ID NO: 272832 - RNA, 64 nt, Homo Sapiens
cucauuccucagguguuuugagaaacaugacuaauaaccacacaauuaaguagagucauuccaa

SEQ ID NO: 272833 - RNA, 64 nt, Homo Sapiens
gauuacugaaaccugauuuauugcuuugucacuuuaaccacaucucucaacucucugcaauguu

SEQ ID NO: 272834 - RNA, 64 nt, Homo Sapiens
ugcaaggcuuuuaucccugaaaaucauuuacagauaaccacaauuugcugugguauauaaacua

SEQ ID NO: 272835 - RNA, 64 nt, Homo Sapiens
aaaaauccuuuguaaaauuuuaaccacacacagauaaccacacagguuuguaucuuccauauaa

SEQ ID NO: 272836 - RNA, 64 nt, Homo Sapiens
cagauaaccacacaaaaaauuaucuuccauauaauaaccacacauuaaauagaauuucgguuug

SEQ ID NO: 272837 - RNA, 64 nt, Homo Sapiens
ggcagccucagcuaccacaauugccugagcugguuaaccacaucguuuccgauguuuacacaug

SEQ ID NO: 272838 - RNA, 64 nt, Homo Sapiens
ccaauuuguuggccaccagauuagucacucaacauaaccacagguuccagaaaagaaaauacaa

SEQ ID NO: 272839 - RNA, 64 nt, Homo Sapiens
auaucccucuaaauuaguucauaaagcaacccccuaaccacaaaacuugaacaacuuugcagga

SEQ ID NO: 272840 - RNA, 64 nt, Homo Sapiens
gguuaauaugauguaggaucuguguaucuguuaauaaccacagguuccuuuucagaaguaccug

SEQ ID NO: 272841 - RNA, 64 nt, Homo Sapiens
ugcuuccucuccugucaauuccaggcucuuuccauaaccacaagccugaggcugcagccuuuua

SEQ ID NO: 272842 - RNA, 64 nt, Homo Sapiens
ccuaacuuugucgcuaguccuaaggagaaaccuuuaaccacaaaguuuuuaucauugaagacaa

SEQ ID NO: 272843 - RNA, 64 nt, Homo Sapiens
cgugggcagggcaggccccaucgcuuuccucugauaaccacauggacacauccugaagucagcc

SEQ ID NO: 272844 - RNA, 64 nt, Homo Sapiens
ggggucuggugggggacacccaagaauaaaagaauaaccacaaagugugcaagggaccaacagc

SEQ ID NO: 272845 - RNA, 64 nt, Homo Sapiens
cauauauuuauagauuguguucacagcaaucauuuaaccacaaauaaaauaucccuugaugaua

SEQ ID NO: 272846 - RNA, 64 nt, Homo Sapiens
gucagcuuagaagaguacuccaagcuucagaugauaaccacagccugggcugacaccuggauuu

SEQ ID NO: 272847 - RNA, 64 nt, Homo Sapiens
gauuuuuuaaaaacuacauuacguguuacauuuaguaaaccauaaaauuuuucagugauuuuua

SEQ ID NO: 272848 - RNA, 64 nt, Homo Sapiens
guuuuagaacuaaacacauccuccccagaauacaguaaaccacagguuuuuuuauauacaugcu

SEQ ID NO: 272849 - RNA, 64 nt, Homo Sapiens
ggcuugcaucgcuauucuuugucucucuuacugaguaaaccagaggccuuuucaagccuaagaa

SEQ ID NO: 272850 - RNA, 64 nt, Homo Sapiens
uaaugaacucaaauuuaaauaaauagcuuuuauaguaaaccauggcuugaauacugcauaugcc

SEQ ID NO: 272851 - RNA, 64 nt, Homo Sapiens
aguuugagauuuaaaacuaugcaaauuuugcacaguaaaccaauugcuauuaaaucauacaaaa

SEQ ID NO: 272852 - RNA, 64 nt, Homo Sapiens
uaaguggaagcuuuacugccuuuguuuuuucacaguaaaccauguucauauuaauuccagguga

SEQ ID NO: 272853 - RNA, 64 nt, Homo Sapiens
uuggaagcuauucggauaauucuguuauuuagcuguaaaccaagaaaaaaaccuaaaagcagua

SEQ ID NO: 272854 - RNA, 64 nt, Homo Sapiens
aaauuaauccuguguuuaucaauaauuuugauuuguaaaccaaggaggcaugcuuuaauaucac

SEQ ID NO: 272855 - RNA, 64 nt, Homo Sapiens
ugacuuugcuaauggcuauuuucuaaugggcuuuguaaaccacucagcucagauacugaucucu

SEQ ID NO: 272856 - RNA, 64 nt, Homo Sapiens
aagucuuuucuugcaagacguacauuugaucguuguaaaccaugccaaucaggcaaauagccca

SEQ ID NO: 272857 - RNA, 64 nt, Homo Sapiens
uuaucuuugaaacaauauuaauaagaaaucuaaaguaaaccagccuuuaaaauuggaaaguggg

SEQ ID NO: 272858 - RNA, 64 nt, Homo Sapiens
aaaucgccuuuucaguugguucacugcugagauaguaaaccaugcuucauaaaucauggaaaac

SEQ ID NO: 272859 - RNA, 64 nt, Homo Sapiens
cucacccauaucccacuauagaucucuuccugauguaaaccaugagugauaugggucugauuuc

SEQ ID NO: 272860 - RNA, 64 nt, Homo Sapiens; identical to SEQ ID NO: 75247

SEQ ID NO: 272861 - RNA, 64 nt, Homo Sapiens; identical to SEQ ID NO: 75248

SEQ ID NO: 272862 - RNA, 64 nt, Homo Sapiens; identical to SEQ ID NO: 75249

SEQ ID NO: 272863 - RNA, 64 nt, Homo Sapiens; identical to SEQ ID NO: 75250

SEQ ID NO: 272864 - RNA, 64 nt, Homo Sapiens; identical to SEQ ID NO: 75251

SEQ ID NO: 272865 - RNA, 64 nt, Homo Sapiens; identical to SEQ ID NO: 75252

SEQ ID NO: 272866 - RNA, 64 nt, Homo Sapiens; identical to SEQ ID NO: 75253

SEQ ID NO: 272867 - RNA, 64 nt, Homo Sapiens; identical to SEQ ID NO: 75254

SEQ ID NO: 272868 - RNA, 64 nt, Homo Sapiens; identical to SEQ ID NO: 75255

SEQ ID NO: 272869 - RNA, 64 nt, Homo Sapiens; identical to SEQ ID NO: 75256

SEQ ID NO: 272870 - RNA, 64 nt, Homo Sapiens; identical to SEQ ID NO: 75257

SEQ ID NO: 272871 - RNA, 64 nt, Homo Sapiens; identical to SEQ ID NO: 75258

SEQ ID NO: 272872 - RNA, 64 nt, Homo Sapiens; identical to SEQ ID NO: 75259

SEQ ID NO: 272873 - RNA, 64 nt, Homo Sapiens; identical to SEQ ID NO: 75260

SEQ ID NO: 272874 - RNA, 64 nt, Homo Sapiens; identical to SEQ ID NO: 75261

SEQ ID NO: 272875 - RNA, 64 nt, Homo Sapiens; identical to SEQ ID NO: 75262

SEQ ID NO: 272876 - RNA, 64 nt, Homo Sapiens; identical to SEQ ID NO: 75263

SEQ ID NO: 272877 - RNA, 64 nt, Homo Sapiens; identical to SEQ ID NO: 75264

SEQ ID NO: 272878 - RNA, 64 nt, Homo Sapiens; identical to SEQ ID NO: 75265

SEQ ID NO: 272879 - RNA, 64 nt, Homo Sapiens; identical to SEQ ID NO: 75266

SEQ ID NO: 272880 - RNA, 64 nt, Homo Sapiens; identical to SEQ ID NO: 75267

SEQ ID NO: 272881 - RNA, 64 nt, Homo Sapiens; identical to SEQ ID NO: 75268

SEQ ID NO: 272882 - RNA, 64 nt, Homo Sapiens; identical to SEQ ID NO: 75269

SEQ ID NO: 272883 - RNA, 64 nt, Homo Sapiens; identical to SEQ ID NO: 75270

SEQ ID NO: 272884 - RNA, 64 nt, Homo Sapiens; identical to SEQ ID NO: 75271

SEQ ID NO: 272885 - RNA, 64 nt, Homo Sapiens; identical to SEQ ID NO: 75272

SEQ ID NO: 272886 - RNA, 64 nt, Homo Sapiens; identical to SEQ ID NO: 75273

SEQ ID NO: 272887 - RNA, 64 nt, Homo Sapiens; identical to SEQ ID NO: 75274

SEQ ID NO: 272888 - RNA, 64 nt, Homo Sapiens; identical to SEQ ID NO: 75275

SEQ ID NO: 272889 - RNA, 64 nt, Homo Sapiens; identical to SEQ ID NO: 75276

SEQ ID NO: 272890 - RNA, 64 nt, Homo Sapiens; identical to SEQ ID NO: 75277

SEQ ID NO: 272891 - RNA, 64 nt, Homo Sapiens; identical to SEQ ID NO: 75278

SEQ ID NO: 272892 - RNA, 64 nt, Homo Sapiens; identical to SEQ ID NO: 75279

SEQ ID NO: 272893 - RNA, 64 nt, Homo Sapiens; identical to SEQ ID NO: 75280

SEQ ID NO: 272894 - RNA, 64 nt, Homo Sapiens; identical to SEQ ID NO: 75281

SEQ ID NO: 272895 - RNA, 64 nt, Homo Sapiens; identical to SEQ ID NO: 75282

SEQ ID NO: 272896 - RNA, 64 nt, Homo Sapiens; identical to SEQ ID NO: 75283

SEQ ID NO: 272897 - RNA, 64 nt, Homo Sapiens; identical to SEQ ID NO: 75284

SEQ ID NO: 272898 - RNA, 64 nt, Homo Sapiens; identical to SEQ ID NO: 75285

SEQ ID NO: 272899 - RNA, 64 nt, Homo Sapiens; identical to SEQ ID NO: 75286

SEQ ID NO: 272900 - RNA, 64 nt, Homo Sapiens; identical to SEQ ID NO: 75287

SEQ ID NO: 272901 - RNA, 64 nt, Homo Sapiens; identical to SEQ ID NO: 75288

SEQ ID NO: 272902 - RNA, 64 nt, Homo Sapiens; identical to SEQ ID NO: 75289

SEQ ID NO: 272903 - RNA, 64 nt, Homo Sapiens; identical to SEQ ID NO: 75290

SEQ ID NO: 272904 - RNA, 64 nt, Homo Sapiens; identical to SEQ ID NO: 75291

SEQ ID NO: 272905 - RNA, 64 nt, Homo Sapiens; identical to SEQ ID NO: 75292

SEQ ID NO: 272906 - RNA, 64 nt, Homo Sapiens; identical to SEQ ID NO: 75293

SEQ ID NO: 272907 - RNA, 64 nt, Homo Sapiens; identical to SEQ ID NO: 75294

SEQ ID NO: 272908 - RNA, 64 nt, Homo Sapiens; identical to SEQ ID NO: 75295

SEQ ID NO: 272909 - RNA, 64 nt, Homo Sapiens; identical to SEQ ID NO: 75296

SEQ ID NO: 272910 - RNA, 64 nt, Homo Sapiens; identical to SEQ ID NO: 75297

SEQ ID NO: 272911 - RNA, 64 nt, Homo Sapiens; identical to SEQ ID NO: 75298

SEQ ID NO: 272912 - RNA, 64 nt, Homo Sapiens; identical to SEQ ID NO: 75299

SEQ ID NO: 272913 - RNA, 64 nt, Homo Sapiens; identical to SEQ ID NO: 75300

SEQ ID NO: 272914 - RNA, 64 nt, Homo Sapiens; identical to SEQ ID NO: 75301

SEQ ID NO: 272915 - RNA, 64 nt, Homo Sapiens; identical to SEQ ID NO: 75302

SEQ ID NO: 272916 - RNA, 64 nt, Homo Sapiens; identical to SEQ ID NO: 75303

SEQ ID NO: 272917 - RNA, 64 nt, Homo Sapiens; identical to SEQ ID NO: 75304

SEQ ID NO: 272918 - RNA, 64 nt, Homo Sapiens; identical to SEQ ID NO: 75305

SEQ ID NO: 272919 - RNA, 64 nt, Homo Sapiens; identical to SEQ ID NO: 75306

SEQ ID NO: 272920 - RNA, 64 nt, Homo Sapiens; identical to SEQ ID NO: 75307

SEQ ID NO: 272921 - RNA, 64 nt, Homo Sapiens; identical to SEQ ID NO: 75308

SEQ ID NO: 272922 - RNA, 64 nt, Homo Sapiens; identical to SEQ ID NO: 75309

SEQ ID NO: 272923 - RNA, 64 nt, Homo Sapiens; identical to SEQ ID NO: 75310

SEQ ID NO: 272924 - RNA, 64 nt, Homo Sapiens; identical to SEQ ID NO: 75311

SEQ ID NO: 272925 - RNA, 64 nt, Homo Sapiens; identical to SEQ ID NO: 75312

SEQ ID NO: 272926 - RNA, 64 nt, Homo Sapiens; identical to SEQ ID NO: 75313

SEQ ID NO: 272927 - RNA, 64 nt, Homo Sapiens; identical to SEQ ID NO: 75314

SEQ ID NO: 272928 - RNA, 64 nt, Homo Sapiens
uagccguuccccuucugccccagucugagccagugagggguagcuuuuuaaaaccauuauucua

SEQ ID NO: 272929 - RNA, 64 nt, Homo Sapiens
agcaccuccagguugguucuggguguccugcugugagggguagaacgggaggcugcugaaguga

SEQ ID NO: 272930 - RNA, 64 nt, Homo Sapiens
gacagaagcuagacccaaucugguguaagggagggagggguagggccacauagcagcagaggac

SEQ ID NO: 272931 - RNA, 64 nt, Homo Sapiens
guaaaaggcaugugcugcaaccaggguggcaggggagggguaggagugcagccccuuccccugc

SEQ ID NO: 272932 - RNA, 64 nt, Homo Sapiens
ugcaucucucauuacuguagugcugagguuauugaaguuauacaaaacacaucucagucucugu

SEQ ID NO: 272933 - RNA, 64 nt, Homo Sapiens
ccaucaauuuugacuuuuacuaaguuguuaaauaaaguuauaauacagcugugaagggcuaaag

SEQ ID NO: 272934 - RNA, 64 nt, Homo Sapiens
uaucgaguagcucuaaaacaccggugcuuauaaaaaguuauaaaaaucaguucucaaaaaauga

SEQ ID NO: 272935 - RNA, 64 nt, Homo Sapiens
uuuguuuuugcuugccuccuugaauaccacugcuaaguuauagcuuuuuggaauaagugguggg

SEQ ID NO: 272936 - RNA, 64 nt, Homo Sapiens
acuacauagagauaaauuaagagacuuuuaaagaaaguuauauaguuugguuauuaauauauau

SEQ ID NO: 272937 - RNA, 64 nt, Homo Sapiens
aauaaaaagcauuuaaaaauaagugggaaaugagaaguuauaccuauauuucuuaauacaaaau

SEQ ID NO: 272938 - RNA, 64 nt, Homo Sapiens
agugaaguaagauccuuuuguuaaaauuaaaagcaaguuauaucaaaguuauauauacugggua

SEQ ID NO: 272939 - RNA, 64 nt, Homo Sapiens
uacuggguauuaaaauuaaaauuugaacaucucaaaguuauauaugaauucagauugccuagcu

SEQ ID NO: 272940 - RNA, 64 nt, Homo Sapiens
uguucuagguccaucuaaauaaaucuuaauuuccaaguuauacucaacuucuuuucugaacuuc

SEQ ID NO: 272941 - RNA, 64 nt, Homo Sapiens
uugauagucuguauaauauugagagaaacacaaaaaguuauagacauaagcuauucuaauuuuu

SEQ ID NO: 272942 - RNA, 64 nt, Homo Sapiens
uaauaucuuugacauuuuuucacauucaaaauuaaaguuauaucugguuugaucguaucuaaau

SEQ ID NO: 272943 - RNA, 64 nt, Homo Sapiens
uacacaucuuauugaaccaucaaauauuuguuuuaaguuauauaacuuuccagaggaaauaauc

SEQ ID NO: 272944 - RNA, 64 nt, Homo Sapiens
gaaaaaaaugcaguuuccuuuaauccuugacuauaaguuauacuauguugcguacauggcaaau

SEQ ID NO: 272945 - RNA, 64 nt, Homo Sapiens
uguuuccuucuauaaacuguucuuuggaaaaauuaaguuauacauaaaauucauauuaaacuuu

SEQ ID NO: 272946 - RNA, 64 nt, Homo Sapiens
caaagcucacuuuacaaaauauaaugauggggcuaaguuauacccuuccuccucuauucucuaa

SEQ ID NO: 272947 - RNA, 64 nt, Homo Sapiens
uguuuggcauaguacuuuuguggaauuuuuauacaaguuauaagagguggccaauauggggaug

SEQ ID NO: 272948 - RNA, 64 nt, Homo Sapiens
cacuucauucgcuuugaggcccugcuuuaaccuuaaguuauagcccuguccaccgaggaagguc

SEQ ID NO: 272949 - RNA, 64 nt, Homo Sapiens
uuuuaagcaaauggaucauggcaccccaaaaugaaaguuauagaaagcugucuacaacugugga

SEQ ID NO: 272950 - RNA, 64 nt, Homo Sapiens
uaguuuggcaaugcucuucuuaaauuugaaaccuaaguuauauaacaaaugucuggggauaauu

SEQ ID NO: 272951 - RNA, 64 nt, Homo Sapiens
ccaaaagauauuugaauuauuuggaaaugguuacaaguuauacuaaaaauacuuucuuuuucua

SEQ ID NO: 272952 - RNA, 64 nt, Homo Sapiens
uugguguuuugauuggaauacuuuagguuuccaaaaguuauacaggauucuucaguuuugcuug

SEQ ID NO: 272953 - RNA, 64 nt, Homo Sapiens
auaauguacaggucacagauagcuuuccuuuuugaaguuauaugcuaggcuuuuuggacuaagg

SEQ ID NO: 272954 - RNA, 64 nt, Homo Sapiens
gagaccacacugggucggcgucccaucccaagaauuguaggacacucuucugccauugugcugg

SEQ ID NO: 272955 - RNA, 64 nt, Homo Sapiens
ucuucauaauuggagaaaguuuuauuuuaauacauuguaggaaaauuuuuaaaaaaaaaaaucu

SEQ ID NO: 272956 - RNA, 64 nt, Homo Sapiens
ugguuuacacagaacuuuuuaauauaugauuuaauuguaggaauauguccguccuaaugcuuua

SEQ ID NO: 272957 - RNA, 64 nt, Homo Sapiens
gaaauaauaauccagauaauagauuagcuauuauuuguaggacucagaaagcuuaacuaaugua

SEQ ID NO: 272958 - RNA, 64 nt, Homo Sapiens
ggcuuuccucacuguucucucccuugaaucucauuuguaggaaucaagagauuccuauacaugg

SEQ ID NO: 272959 - RNA, 64 nt, Homo Sapiens
auguaagguguuaauguguguguaugugcuuugguuguaggaaaacuugaaaauuccaaaaucc

SEQ ID NO: 272960 - RNA, 64 nt, Homo Sapiens
uguauuaacaaacacugcaauuuauagauuacauuuguaggaaguuaugcuuuuuucugguuuu

SEQ ID NO: 272961 - RNA, 64 nt, Homo Sapiens
uaaccaggcuuauggcaugaucucuggaacaaauuuguaggaaaaaauuacuccaauugaauga

SEQ ID NO: 272962 - RNA, 64 nt, Homo Sapiens
caaaaaaacaaaaacaaaaaaacaaaaccagaaucagguaaaacagcuaugugauuaaaauauu

SEQ ID NO: 272963 - RNA, 64 nt, Homo Sapiens
aagaucuuugcaccuuaauauuaauggacuguuucagguaaaagagaaugaauguaugauugug

SEQ ID NO: 272964 - RNA, 64 nt, Homo Sapiens
cugucucaaaaacaaaaaaccaaccugggugacagagcaagaccaagaucacaucacugcacuu

SEQ ID NO: 272965 - RNA, 64 nt, Homo Sapiens
cuaucucaaaaauaaaauaacagccugagcaacagagcaagacugagaucgugccacugcacuc

SEQ ID NO: 272966 - RNA, 64 nt, Homo Sapiens
uuuuuuaaacaauuacuuuaacauuuauauaugugagcaagauuugagagaguuuuccauaaag

SEQ ID NO: 272967 - RNA, 64 nt, Homo Sapiens
uugaaaguuucaaugugguugcagaauugcugaagagcaagauauguaacuacauuucagcucu

SEQ ID NO: 272968 - RNA, 64 nt, Homo Sapiens
augauugcaccacugcacuccagccugggugauagagcaagaccccaacucaaaaaaaaaaaaa

SEQ ID NO: 272969 - RNA, 64 nt, Homo Sapiens
gagaucgcgccacugcacuccagccugggcgacagagcaagacuccaucucaaaaaaaaaguua

SEQ ID NO: 272970 - RNA, 64 nt, Homo Sapiens
agaucgugccacugcacuccagccuggguggacagagcaagacuccgucucaaagaaacaaaca

SEQ ID NO: 272971 - RNA, 64 nt, Homo Sapiens
gagaucgugccacugcacuccagccugggugauagagcaagacugucucaaaaaagaaaaaaaa

SEQ ID NO: 272972 - RNA, 64 nt, Homo Sapiens
gcauuuuccuugggagagaaaaagcacaagugaugagcaagaagaccccccgccgccccccugg

SEQ ID NO: 272973 - RNA, 64 nt, Homo Sapiens
gaggcaugaacacacagucaguauaauggugagagagcaagagagaauuccagcagccauccag

SEQ ID NO: 272974 - RNA, 64 nt, Homo Sapiens
aggaucacaccauugcuguccagccugggugacagagcaagacugcguuucaaaaaaaaaaaaa

SEQ ID NO: 272975 - RNA, 64 nt, Homo Sapiens
gaaauggcgccacuguacuccaaccugggcgacagagcaagacuccaucucauaaauuaaaagg

SEQ ID NO: 272976 - RNA, 64 nt, Homo Sapiens
gagauccugccacugcacuccagucugggugacagagcaagacuccaucucaaaaaauaaauaa

SEQ ID NO: 272977 - RNA, 64 nt, Homo Sapiens
cugcccaccuggggaucccccaaagucagacacagagcaagaguccccuuggguacaccccucu

SEQ ID NO: 272978 - RNA, 64 nt, Homo Sapiens
cccuguccgucuucacccauccccaagccuacuagagcaagaaaccaguuguaauauaaaaugc

SEQ ID NO: 272979 - RNA, 64 nt, Homo Sapiens
uauaacagcaaggaaacauucaguugaaccugaugagcaagaaucaaaccucagagggauaagg

SEQ ID NO: 272980 - RNA, 64 nt, Homo Sapiens
ccauuucaaaaaaaaaaaaacagccugggcgacagagcaagacugagaucacgccauuguacuc

SEQ ID NO: 272981 - RNA, 64 nt, Homo Sapiens
ggacuuggcuuucuuacaugugagcaagacaggugagcaagauaagcagguuuuuccucccugu

SEQ ID NO: 272982 - RNA, 64 nt, Homo Sapiens
ggugagcaagauaggacuuguuuuccucccuguugagcaagacaagcagcugcagcaagcaggu

SEQ ID NO: 272983 - RNA, 64 nt, Homo Sapiens
gcgugugucaguggcugugugcaggagugugagugagcaagagcaagagcgcauggcuccugcu

SEQ ID NO: 272984 - RNA, 64 nt, Homo Sapiens
gucaguggcugugugcaggagugugagugagcaagagcaagagcgcauggcuccugcuguaccu

SEQ ID NO: 272985 - RNA, 64 nt, Homo Sapiens
cgggaaauaacagcacuuuagguguaguucaggugagcaagaugccagauaguuucuacuaacc

SEQ ID NO: 272986 - RNA, 64 nt, Homo Sapiens
aagaucgugccacugcacuccagccuuggugacagagcaagacuccgucuccaaaaaaaagaaa

SEQ ID NO: 272987 - RNA, 64 nt, Homo Sapiens
aagguaacaaucaucuaaaauacugagcucaggagagcaagaugaccccugcauccccauuuuu

SEQ ID NO: 272988 - RNA, 64 nt, Homo Sapiens
agaggcugcuggagcuugagaggagaggaugcuggagcaagagggaagagguugcuggagcaag

SEQ ID NO: 272989 - RNA, 64 nt, Homo Sapiens
agaggaugcuggagcaagagggaagagguugcuggagcaagaggagucgccugaaccaagagca

SEQ ID NO: 272990 - RNA, 64 nt, Homo Sapiens
agagguugcuggagcugcagaggagagguugcuggagcaagaggcgagagguuguuggagcaag

SEQ ID NO: 272991 - RNA, 64 nt, Homo Sapiens
agagguugcuggagcaagagacgagagguuguuggagcaagagggcugagauuguuggaacaag

SEQ ID NO: 272992 - RNA, 64 nt, Homo Sapiens
agaggcuacuggagcugcagaggagagguugcuggagcaagaggggagagguugcuggagcaag

SEQ ID NO: 272993 - RNA, 64 nt, Homo Sapiens
agagguugcuggagcaagagaggagagguugcuggagcaagaggggagaaguugcuggagcaag

SEQ ID NO: 272994 - RNA, 64 nt, Homo Sapiens
agagguugcuggagcaagagaggagaaguugcuggagcaagagggcucagguuguuggagcaag

SEQ ID NO: 272995 - RNA, 64 nt, Homo Sapiens
agaaguugcuggagcaagagugcucagguuguuggagcaagaggaaccaagagcaggaagaggu

SEQ ID NO: 272996 - RNA, 64 nt, Homo Sapiens
uuacuaaggccuucagugaacagaaaggagcagagagcaagauuagaucugagaagaugcucug

SEQ ID NO: 272997 - RNA, 64 nt, Homo Sapiens
aguaaggggcuuuguugaaagaggggguuagagagagcaagacagcacuugagugcacuggcag

SEQ ID NO: 272998 - RNA, 64 nt, Homo Sapiens
gagucgcuugaaugcaggagguggagguugcaaugagcaagauugugccacugcacuccagccu

SEQ ID NO: 272999 - RNA, 64 nt, Homo Sapiens
aagauugugccacugcacuccagccugggcaacagagcaagacucugucucaaaaaaaaaaaag

SEQ ID NO: 273000 - RNA, 64 nt, Homo Sapiens
gugucucaaaaaaaaaaaaacagcccgggugacagagcaagacuaagauuguaccacuguauuc

SEQ ID NO: 273001 - RNA, 64 nt, Homo Sapiens
ccgucuuaaaaccaaaaguuuagccugggcaacagagcaagacaaagauggcaccauugcaccc

SEQ ID NO: 273002 - RNA, 64 nt, Homo Sapiens; identical to SEQ ID NO: 247878

SEQ ID NO: 273003 - RNA, 64 nt, Homo Sapiens; identical to SEQ ID NO: 247879

SEQ ID NO: 273004 - RNA, 64 nt, Homo Sapiens; identical to SEQ ID NO: 247880

SEQ ID NO: 273005 - RNA, 64 nt, Homo Sapiens; identical to SEQ ID NO: 247881

SEQ ID NO: 273006 - RNA, 64 nt, Homo Sapiens
caggaaaaacuaaugauauggaucaucacccagauucucucacuugguaccagcauuucuguag

SEQ ID NO: 273007 - RNA, 64 nt, Homo Sapiens
auauuuucagauauuucauaauuucuaaccucuguucucucaguaaacagaaugucugaucgau

SEQ ID NO: 273008 - RNA, 64 nt, Homo Sapiens
ccauuucugccuuaacuuuauuuuucuuucauuuuucucucauuguugaaaauguuucuaguuu

SEQ ID NO: 273009 - RNA, 64 nt, Homo Sapiens
cacuggaggucucuucugcccucuuccgauccuuuucucucagagcuuccugccaggacguggc

SEQ ID NO: 273010 - RNA, 64 nt, Homo Sapiens
auccaauaaucauggccccuuuaaguaugcuacuuucucucagcugauuaucuguacugugggu

SEQ ID NO: 273011 - RNA, 64 nt, Homo Sapiens
uuugccuucuugcuuuuucauggguagcaucuguuucucucagccaaaugccaccgcugcccug

SEQ ID NO: 273012 - RNA, 64 nt, Homo Sapiens
ucucauaaaucucuucugucguguacacuuucuuuucucucauccuaaugaagugccagaguga

SEQ ID NO: 273013 - RNA, 64 nt, Homo Sapiens
cugaagauugagaccuugguguuuaaacuuuccguucucucaaccugacuuuccuguacccucu

SEQ ID NO: 273014 - RNA, 64 nt, Homo Sapiens
ucaaucaguauguauucuuuugugccuggcuucuuucucucagccuuacauuugugagauuccu

SEQ ID NO: 273015 - RNA, 64 nt, Homo Sapiens
cuuggguauuugcaauauuccuuugggccucugcuucucucaccuaaaaaaagagaauuagauu

SEQ ID NO: 273016 - RNA, 64 nt, Homo Sapiens
gauguacuuguuuuagguacaucuacuauacuuauucucucaaaccuggguaauaguuucucag

SEQ ID NO: 273017 - RNA, 64 nt, Homo Sapiens
gugcaugugugcauuaaaaacauuucacuaccuauucucucauggacuucucauccuuucuuuu

SEQ ID NO: 273018 - RNA, 64 nt, Homo Sapiens
cgaguguuaagugucaaggugagaaagccucacauucucucaagacaguugcucuaggagcuga

SEQ ID NO: 273019 - RNA, 64 nt, Homo Sapiens
gcugguuuggaaguguggagauugcauuucuggcuucucucaauggcuuguguugaggacucug

SEQ ID NO: 273020 - RNA, 64 nt, Homo Sapiens
uggugagagggcuucuguuuaguggauuuucauuuucucucagaagucuucaguuuucucucau

SEQ ID NO: 273021 - RNA, 64 nt, Homo Sapiens
guggauuuucauuuucucucuaaagucuucaguuuucucucauacauuuuacuuaaaucuguau

SEQ ID NO: 273022 - RNA, 64 nt, Homo Sapiens
uagcuagugccucuugcccucuccucaccuccuuuucucucagugacucuggaaccugaaugca

SEQ ID NO: 273023 - RNA, 64 nt, Homo Sapiens
ccauuuuuucaaagucuguuuaauugccuauuacuucucucaaagagaaccugaagucagaaca

SEQ ID NO: 273024 - RNA, 64 nt, Homo Sapiens
acucaccucuguauucauucccuuuucucacucuuucucucaucgcucaugcguucucauucuu

SEQ ID NO: 273025 - RNA, 64 nt, Homo Sapiens
ggccauguuucagauuuugacucucaauuuagucuucucucauuaaugaaagaaaaauggcgcc

SEQ ID NO: 273026 - RNA, 64 nt, Homo Sapiens
agaagcauaaaacugacuucugguuguucugcaguucucucauccuuaugaaucuguuguguug

SEQ ID NO: 273027 - RNA, 64 nt, Homo Sapiens
acuguauguaugauuuuggcuaaaggauuugacuuucucucaacugcaguuuucuuaaucuuug

SEQ ID NO: 273028 - RNA, 64 nt, Homo Sapiens
ggcuguuuucuguaguaugcgugaugcuuguagauucucucacaaugauaaguuacaauuguaa

SEQ ID NO: 273029 - RNA, 64 nt, Homo Sapiens
agagaaucaaagagaacuucugcuggccaagagcuucucucagggcugcagcggggaguggugg

SEQ ID NO: 273030 - RNA, 64 nt, Homo Sapiens
uccacgccauuuccuuuuccuucaagccuagcccuucucucauuauuucucucugacccucucc

SEQ ID NO: 273031 - RNA, 64 nt, Homo Sapiens
agggaaaucaggguuacaaaucuucuugauccacuucucucaggauccccucucuuccuacccu

SEQ ID NO: 273032 - RNA, 64 nt, Homo Sapiens
uuuauuaaugcacacagucauugccaugguaucuuucucucagaccccuuuuguuguagugcuu

SEQ ID NO: 273033 - RNA, 64 nt, Homo Sapiens
guuuuaccagucaaagguccucaggguucuccucuucucucacgggcggcucgcccgccucugg

SEQ ID NO: 273034 - RNA, 64 nt, Homo Sapiens
aagugaauuauuccuuuuuucugucucucuuuucuucucucauaaauccaaauauuuuaaaaau

SEQ ID NO: 273035 - RNA, 64 nt, Homo Sapiens
auuuggauggaaucucuuugauuuguggggguuuuucucucauuuuuuuaaagcagaagaugcu

SEQ ID NO: 273036 - RNA, 64 nt, Homo Sapiens
aggaacauuuaugguaguauccaggaacauucgcuucucucaccgcacaccuucgcuucucuca

SEQ ID NO: 273037 - RNA, 64 nt, Homo Sapiens
aggaacauucgcuucucucaaugcacaccuucgcuucucucaccccugguggcugagccaggag

SEQ ID NO: 273038 - RNA, 64 nt, Homo Sapiens
auuuguuuagauccuuuuguauuuucagaucuccuuggagcaguagaguaccugguagaccaua

SEQ ID NO: 273039 - RNA, 64 nt, Homo Sapiens
cagcuagagggagauaaagagggcuaguuaguucuuggagcagcugcuuuugaggagaaaauau

SEQ ID NO: 273040 - RNA, 64 nt, Homo Sapiens
uuccugcacaaacuaccaaguggguuugcacagauuggagcacagaaaaacaauggaacaaggg

SEQ ID NO: 273041 - RNA, 64 nt, Homo Sapiens
auccugcacauuaaaggaugggucacuuggaacuuuggagcagauguaccucauugcuuuagcu

SEQ ID NO: 273042 - RNA, 64 nt, Homo Sapiens
aacucucgagccaacugccucauuaguguaguaauuggagcacuagguauagaggugucauagg

SEQ ID NO: 273043 - RNA, 64 nt, Homo Sapiens
guugugugaacuugccuagaccgugccuggacccuuggagcaguuugguccugacggguuugac

SEQ ID NO: 273044 - RNA, 64 nt, Homo Sapiens
uucaucacaugaguucaggcauggaaauuuucauuuggagcaucaugucagcacucaaaaaguu

SEQ ID NO: 273045 - RNA, 64 nt, Homo Sapiens
gagcaucaugucagcacucaaaaaguucuggaucuuggagcaguucagauuuucagauuaggga

SEQ ID NO: 273046 - RNA, 64 nt, Homo Sapiens
gacuguacauaguguggugauguagcccaucaccuuggagcacucagacucacugaugcagcac

SEQ ID NO: 273047 - RNA, 58 nt, Homo Sapiens
gcauggucuugccagcuaccacuuccuuuuggagcaccgacagcgaacacucgccuga

SEQ ID NO: 273048 - RNA, 64 nt, Homo Sapiens
aggagagguugcuggagcaaaagacgagagguuguuggagcaagguugcugagauuguuggaac

SEQ ID NO: 273049 - RNA, 64 nt, Homo Sapiens
aggagaaguugcuggagcaagguugcucagguuguuggagcaagcugaaccaagagcaggaaga

SEQ ID NO: 273050 - RNA, 64 nt, Homo Sapiens
gggcacgagucccucucccuuggguuccauuuucuuggagcagccuauuaguucuggugggguu

SEQ ID NO: 273051 - RNA, 64 nt, Homo Sapiens
uaugauuagaauucuguuugggggucuaguugucuuggagcaaguauguacuuaacuagccgag

SEQ ID NO: 273052 - RNA, 64 nt, Homo Sapiens
ccagaaugauggccgguugccagauauaacugcuuuggagcaaaucucuucuguuuagagagau

SEQ ID NO: 273053 - RNA, 64 nt, Homo Sapiens
uuuugucuuguuggugcucaaaaaguuuuggauuuuggagcauuucggauuuuggauuuuugga

SEQ ID NO: 273054 - RNA, 64 nt, Homo Sapiens
cgagaucaggccccaccugccagcucuacugggcuuggagcacguccgggcaguggagggaggg

SEQ ID NO: 273055 - RNA, 64 nt, Homo Sapiens
gagggacacagccugggacaggaagccucuuggguuggagcaggagacccucauuugccaccca

SEQ ID NO: 273056 - RNA, 64 nt, Homo Sapiens; identical to SEQ ID NO: 195697

SEQ ID NO: 273057 - RNA, 64 nt, Homo Sapiens; identical to SEQ ID NO: 195698

SEQ ID NO: 273058 - RNA, 64 nt, Homo Sapiens; identical to SEQ ID NO: 195699

SEQ ID NO: 273059 - RNA, 64 nt, Homo Sapiens; identical to SEQ ID NO: 195700

SEQ ID NO: 273060 - RNA, 64 nt, Homo Sapiens; identical to SEQ ID NO: 195701

SEQ ID NO: 273061 - RNA, 64 nt, Homo Sapiens; identical to SEQ ID NO: 195702

SEQ ID NO: 273062 - RNA, 64 nt, Homo Sapiens; identical to SEQ ID NO: 195703

SEQ ID NO: 273063 - RNA, 64 nt, Homo Sapiens; identical to SEQ ID NO: 195704

SEQ ID NO: 273064 - RNA, 64 nt, Homo Sapiens; identical to SEQ ID NO: 195705

SEQ ID NO: 273065 - RNA, 64 nt, Homo Sapiens; identical to SEQ ID NO: 195706

SEQ ID NO: 273066 - RNA, 64 nt, Homo Sapiens; identical to SEQ ID NO: 195707

SEQ ID NO: 273067 - RNA, 64 nt, Homo Sapiens; identical to SEQ ID NO: 195708

SEQ ID NO: 273068 - RNA, 64 nt, Homo Sapiens; identical to SEQ ID NO: 195709

SEQ ID NO: 273069 - RNA, 64 nt, Homo Sapiens; identical to SEQ ID NO: 195710

SEQ ID NO: 273070 - RNA, 64 nt, Homo Sapiens
ucaaauuaguggaacuuaguucagggacauagaagagucuuaaugaauuaaaaucauucacuug

SEQ ID NO: 273071 - RNA, 64 nt, Homo Sapiens
cuuccucugguuuucaaguaaacucaacaagguggagucuuaccugguuuuccuuuccaagcau

SEQ ID NO: 273072 - RNA, 64 nt, Homo Sapiens
aaggaggccagaaccugucgugcagcagcuccaagcaugggaccccugccccuuagagucuagg

SEQ ID NO: 273073 - RNA, 64 nt, Homo Sapiens
caguguucauccugaccuugucugccuucacucagcaugggaaccuccagaggaauuugucuuc

SEQ ID NO: 273074 - RNA, 64 nt, Homo Sapiens
gccuggcacaaugaagaauucucaccccugcagugcaugggacaggcauuuaagccuaaagaca

SEQ ID NO: 273075 - RNA, 64 nt, Homo Sapiens
gaaacaugagaaugccaccucaucucaaauggcagcaugggacucugacaguugccuuuuuuuu

SEQ ID NO: 273076 - RNA, 64 nt, Homo Sapiens
ugaaauuaagagugaacuucgggaccaagacaaagcaugggacaagcugaccccuuuccucaca

SEQ ID NO: 273077 - RNA, 64 nt, Homo Sapiens
cauucaagaccucgaagucagcccuuggggccuugcaugggacaccacugcuguugaaaugagu

SEQ ID NO: 273078 - RNA, 64 nt, Homo Sapiens
ccucaaacaccgucagaugcauuagcagcccacugcaugggacaaucgcaggcagauacgagga

SEQ ID NO: 273079 - RNA, 64 nt, Homo Sapiens
auagcaguuuugcucaugacuuaccauuccagcugcaugggaaagcaaagcagaaaacagugcc

SEQ ID NO: 273080 - RNA, 64 nt, Homo Sapiens
ucgcuggacugugaagucaacaauaauggcaguaacagggcaguucauuccaaauccagcacug

SEQ ID NO: 273081 - RNA, 64 nt, Homo Sapiens
ccacaaauaagcuuucuuguaagcucucuuccuaacagggcacauauucuuccauaauauaaac

SEQ ID NO: 273082 - RNA, 64 nt, Homo Sapiens
gcuggggcagagaaaggaagacaccgccaugagcacagggcaggccccacucagccuggccugg

SEQ ID NO: 273083 - RNA, 64 nt, Homo Sapiens
uagaucucucccacuagagccagccuuagccuaaacagggcacagggcuaggaaaaaccauuuc

SEQ ID NO: 273084 - RNA, 64 nt, Homo Sapiens
ucucaagagggcacugguggcccgacagccuggcacagggcagugggacagggcauggccaggu

SEQ ID NO: 273085 - RNA, 64 nt, Homo Sapiens
cugguggcccgacagccuggcacagggcagugggacagggcauggccagguggccacuccagac

SEQ ID NO: 273086 - RNA, 64 nt, Homo Sapiens
uagccagcucaaguucuuuuacuaacaccucugcacagggcaguagugaagguacuuuggaacc

SEQ ID NO: 273087 - RNA, 64 nt, Homo Sapiens
ugaccccugccacccagcauuucuguggcucauuacagggcaucgccuacccaugggcccaagu

SEQ ID NO: 273088 - RNA, 64 nt, Homo Sapiens
gccucauuauuuuucacugcagaagggcagcuccacagggcaggggacuggcacacuggccucc

SEQ ID NO: 273089 - RNA, 64 nt, Homo Sapiens
cugagcgugcuuuccaaaacuccccuccccguccacagggcagcgccccagccuccuccuuccc

SEQ ID NO: 273090 - RNA, 64 nt, Homo Sapiens; identical to SEQ ID NO: 99247

SEQ ID NO: 273091 - RNA, 64 nt, Homo Sapiens; identical to SEQ ID NO: 99248

SEQ ID NO: 273092 - RNA, 64 nt, Homo Sapiens; identical to SEQ ID NO: 99249

SEQ ID NO: 273093 - RNA, 64 nt, Homo Sapiens; identical to SEQ ID NO: 99250

SEQ ID NO: 273094 - RNA, 64 nt, Homo Sapiens; identical to SEQ ID NO: 99251

SEQ ID NO: 273095 - RNA, 64 nt, Homo Sapiens; identical to SEQ ID NO: 99252

SEQ ID NO: 273096 - RNA, 64 nt, Homo Sapiens; identical to SEQ ID NO: 99253

SEQ ID NO: 273097 - RNA, 64 nt, Homo Sapiens; identical to SEQ ID NO: 99254

SEQ ID NO: 273098 - RNA, 64 nt, Homo Sapiens; identical to SEQ ID NO: 99255

SEQ ID NO: 273099 - RNA, 64 nt, Homo Sapiens; identical to SEQ ID NO: 99256

SEQ ID NO: 273100 - RNA, 64 nt, Homo Sapiens; identical to SEQ ID NO: 99257

SEQ ID NO: 273101 - RNA, 64 nt, Homo Sapiens; identical to SEQ ID NO: 99258

SEQ ID NO: 273102 - RNA, 64 nt, Homo Sapiens; identical to SEQ ID NO: 99259

SEQ ID NO: 273103 - RNA, 64 nt, Homo Sapiens; identical to SEQ ID NO: 99260

SEQ ID NO: 273104 - RNA, 64 nt, Homo Sapiens; identical to SEQ ID NO: 99261

SEQ ID NO: 273105 - RNA, 64 nt, Homo Sapiens; identical to SEQ ID NO: 99262

SEQ ID NO: 273106 - RNA, 64 nt, Homo Sapiens; identical to SEQ ID NO: 99263

SEQ ID NO: 273107 - RNA, 64 nt, Homo Sapiens; identical to SEQ ID NO: 99264

SEQ ID NO: 273108 - RNA, 64 nt, Homo Sapiens; identical to SEQ ID NO: 99265

SEQ ID NO: 273109 - RNA, 64 nt, Homo Sapiens; identical to SEQ ID NO: 99266

SEQ ID NO: 273110 - RNA, 64 nt, Homo Sapiens; identical to SEQ ID NO: 99267

SEQ ID NO: 273111 - RNA, 64 nt, Homo Sapiens; identical to SEQ ID NO: 99268

SEQ ID NO: 273112 - RNA, 64 nt, Homo Sapiens; identical to SEQ ID NO: 99269

SEQ ID NO: 273113 - RNA, 64 nt, Homo Sapiens; identical to SEQ ID NO: 99270

SEQ ID NO: 273114 - RNA, 64 nt, Homo Sapiens; identical to SEQ ID NO: 99271

SEQ ID NO: 273115 - RNA, 62 nt, Homo Sapiens
uuuaauguguuuauucaaauguggucucuucugugucaaauguuaaaugaaauauaaacauu

SEQ ID NO: 273116 - RNA, 62 nt, Homo Sapiens
guauaucagauggucagaacaaauaaaguucagugucaaaugacuuuuggcucuauauguau

SEQ ID NO: 273117 - RNA, 62 nt, Homo Sapiens
uuguaaaaaugaaacucaaaaauaaaauaaaugugucaaauuuugaaaaaaaaagaaaacug

SEQ ID NO: 273118 - RNA, 62 nt, Homo Sapiens
guauacuguaauugauuacaugggcugggggggugucaaagaacuugacagguuguguugau

SEQ ID NO: 273119 - RNA, 62 nt, Homo Sapiens
uucgugagcuggggacucaguggggacagagggugucaaacagcagggggccccgccagggc

SEQ ID NO: 273120 - RNA, 62 nt, Homo Sapiens
guguacauauguauguguguaauccaugaggugugucaaagauugguuaaacugauggcagc

SEQ ID NO: 273121 - RNA, 62 nt, Homo Sapiens
acugccauuaaacuuaacucagcaacuucagagugucaaacacccaagaaacaacaugaaug

SEQ ID NO: 273122 - RNA, 62 nt, Homo Sapiens
uccccucaggaauuuucagauuugggggcaaugugucaaaagaacuauuguuuuauccuguc

SEQ ID NO: 273123 - RNA, 62 nt, Homo Sapiens
uucuauuuuuauuuguucugcacugcugaggggugucaaagucuauuuuguaugcaacuagu

SEQ ID NO: 273124 - RNA, 60 nt, Homo Sapiens
auuuauuauucauuucuucaaaauguuuuucagugucaaagucaauauucuuuauuaaua

SEQ ID NO: 273125 - RNA, 62 nt, Homo Sapiens
aucuuuguagggugacucuacaaccuuaaaaagugucaaagcguacacuaauaauuuucuau

SEQ ID NO: 273126 - RNA, 62 nt, Homo Sapiens
cacaggccaguauuaagcagugccaaccauaagugucaaaagaccaacuccuagacaaaguu

SEQ ID NO: 273127 - RNA, 62 nt, Homo Sapiens
gaacccacguuguuagccauaaucaucuguaagugucaaaaugccugccgauaugccuacag

SEQ ID NO: 273128 - RNA, 62 nt, Homo Sapiens
uaugaacccgaagccauuuagaaaaucccugugugucaaaauuacauucaaaaagcucuccu

SEQ ID NO: 273129 - RNA, 62 nt, Homo Sapiens
aacuacaaaaugucaaacuaacugcaagacaagugucaaaaugggauguuuaagcaguuuug

SEQ ID NO: 273130 - RNA, 62 nt, Homo Sapiens
ugcucaagacccuggagcuguacuuggccagggugucaaagggacaggccuccuuguuggga

SEQ ID NO: 273131 - RNA, 62 nt, Homo Sapiens
ucaucaaaaguguacggcuuccugugcugcuugugucaaauggaaccugcccucuaaagcac

SEQ ID NO: 273132 - RNA, 62 nt, Homo Sapiens
uaccuugagucagccaggagcccucuuuuccugugucaaagccugcccucgggcucugcuca

SEQ ID NO: 273133 - RNA, 62 nt, Homo Sapiens
guuugucagguuugaagccccuaugauggugugugucaaaucaguuguagcuaaucugucca

SEQ ID NO: 273134 - RNA, 62 nt, Homo Sapiens
ggaguugaggaauugagcaguuuuuaacuuuugugucaaauauuuaaauuuaguuuaaaaau

SEQ ID NO: 273135 - RNA, 62 nt, Homo Sapiens
acguauugaauauuuaugaaacucaaaccaaugugucaaauaaauuguacuuguggagcuuc

SEQ ID NO: 273136 - RNA, 62 nt, Homo Sapiens
cuauuuuuuauauuacauuaagaacuauuuuggugucaaaugcauaauaauugcauuuucuu

SEQ ID NO: 273137 - RNA, 62 nt, Homo Sapiens
guccauucaccugagaaauggaagaaaugaaggugucaaagauaauagcacagcaguuugga

SEQ ID NO: 273138 - RNA, 62 nt, Homo Sapiens
aacuuuaucauacaggaaacuuaaaacaagaggugucaaaagacccaaauuaggugcauuuu

SEQ ID NO: 273139 - RNA, 62 nt, Homo Sapiens
aggcuguaccuccuugacuaagcugguuccuugugucaaagcaccucaugccuuccauuaaa

SEQ ID NO: 273140 - RNA, 62 nt, Homo Sapiens
uuacaaaguuauauucacaguuuuuuaaaaaugugucaaaauaaaggauaacucuguauuac

SEQ ID NO: 273141 - RNA, 62 nt, Homo Sapiens
aauuuguauggaggguacgaucuaaguuaagugugucaaaagcaaggcuuaggauuuguuau

SEQ ID NO: 273142 - RNA, 62 nt, Homo Sapiens
auguucuuugaaagaaagaaaaaucucuugcugugucaaaccucaaaauguugcuauugggg

SEQ ID NO: 273143 - RNA, 62 nt, Homo Sapiens
caagaauucguauaguacgagccuggaucugcgugucaaacuguuccauuuguuuauguaaa

SEQ ID NO: 273144 - RNA, 62 nt, Homo Sapiens
auuuagaauuuuuaacuaaugucaaaacuacagugucaaacauucuagguuguaguuacuuu

SEQ ID NO: 273145 - RNA, 62 nt, Homo Sapiens
cucuccugggcuuccauauuuugggggcuggggugucaaaagugagaugaaguucuuagcuc

SEQ ID NO: 273146 - RNA, 62 nt, Homo Sapiens
auauacugagauccacaucuagugaaaugucagugucaaaauauuauagauuauagcuaaaa

SEQ ID NO: 273147 - RNA, 62 nt, Homo Sapiens
ugaccucccuuguuuggccuagggagaggccagugucaaacuggaacaaaaaaagggaucuc

SEQ ID NO: 273148 - RNA, 62 nt, Homo Sapiens
ugaauccugauucuuauggagcuuccauuuuugugucaaaaauugugauuuugggaguggaa

SEQ ID NO: 273149 - RNA, 62 nt, Homo Sapiens
uauugaacuuuuguauaaaauaacaauggggagugucaaaacuuuaucagugaaguagugau

SEQ ID NO: 273150 - RNA, 62 nt, Homo Sapiens
uauaugucaaauucccuccaauauguuaaauugugucaaauagugcauuuuacuauugauau

SEQ ID NO: 273151 - RNA, 62 nt, Homo Sapiens
uaagucccaaguauuuccaguacuuuuagccugugucaaauguuuguuccucucucauccca

SEQ ID NO: 273152 - RNA, 62 nt, Homo Sapiens
ugcuauagcauaaaagccgguugauacagcaagugucaaacugugauccucaagcaauauuu

SEQ ID NO: 273153 - RNA, 62 nt, Homo Sapiens
acuucuucacugaaguuauaauauguaguucugugucaaaaauggauuaccaauuuaaaaau

SEQ ID NO: 273154 - RNA, 62 nt, Homo Sapiens
auaauagauuuuaaaaaagcaaaugaggcaaugugucaaaauuuaauguuucauaauaaaaa

SEQ ID NO: 273155 - RNA, 62 nt, Homo Sapiens
guaucaaaaauaucuuugcuuacuaucaagaagugucaaauagguucagcuugcugccaaaa

SEQ ID NO: 273156 - RNA, 62 nt, Homo Sapiens
uucaggaaggauuuuacccuaagcuguguguggugucaaaguaaugcgggagguucaaugug

SEQ ID NO: 273157 - RNA, 62 nt, Homo Sapiens
cuggcuucaaugucuauuucuguggagaauaagugucaaaacacuggugacaacuggcugga

SEQ ID NO: 273158 - RNA, 62 nt, Homo Sapiens
agagagcaaaguauaacaggucauguuuuaaugugucaaauuuaaauuggcagauuuaccuc

SEQ ID NO: 273159 - RNA, 62 nt, Homo Sapiens
auaguuacagugaguuguuuuuuaccuaguuugugucaaauuaguguuguauaugacccaca

SEQ ID NO: 273160 - RNA, 62 nt, Homo Sapiens
ccacuugacauuuacuguaugguuguauacaggugucaaacugaaggcauaaguuggucuua

SEQ ID NO: 273161 - RNA, 62 nt, Homo Sapiens
ucaucaugguuugaaaaaagguauuuuuuuaagugucaaauauuaucaauagccaacuuugg

SEQ ID NO: 273162 - RNA, 62 nt, Homo Sapiens
acaauucagucuucucuuugggguuuuaguaugugucaaacauaggacuggaaguuugcccc

SEQ ID NO: 273163 - RNA, 62 nt, Homo Sapiens
auaacgucuuugaugcuuuuagaauaagaacagugucaaaucaucugucuucuggaaaauca

SEQ ID NO: 273164 - RNA, 62 nt, Homo Sapiens
cccuggggcucagauagaggugcugagccccugugucaaaguuguuaaauguuuuuguuuug

SEQ ID NO: 273165 - RNA, 62 nt, Homo Sapiens
aggagugucaccaucagaggcuucucuucauugugucaaagaagccccuagcugcucucgug

SEQ ID NO: 273166 - RNA, 62 nt, Homo Sapiens
uuugacggcacagaugccuggaaggcagaguggugucaaaucgauguauuugcagagaagac

SEQ ID NO: 273167 - RNA, 62 nt, Homo Sapiens
acugauaguuuuugagcuggaauugggcaaaagugucaaaguaaagucaguacaugaaaggc

SEQ ID NO: 273168 - RNA, 62 nt, Homo Sapiens
cagagaaaugugugcaaaaauagcuccagagagugucaaaccuaauguggaacaguccauau

SEQ ID NO: 273169 - RNA, 62 nt, Homo Sapiens
ggcaagucagaguuuuacaaucaguuuaauuagugucaaacucaacuaaaauauucguggug

SEQ ID NO: 273170 - RNA, 62 nt, Homo Sapiens
cacuugaugaguaaacccaggucauuuauauggugucaaaagcauaacugugguguuacucu

SEQ ID NO: 273171 - RNA, 62 nt, Homo Sapiens
uuacauccacauuccuacacuuaaggagaccugugucaaaacaggcaucacugccucagcug

SEQ ID NO: 273172 - RNA, 62 nt, Homo Sapiens
cccuuucauccucaagagcuguuguugugggugugucaaaucugcgaagcauggaccccagu

SEQ ID NO: 273173 - RNA, 62 nt, Homo Sapiens
gacaaugcaggggcaggguguccugaaacuuugugucaaacauuuggggcuuuuuuucaggg

SEQ ID NO: 273174 - RNA, 62 nt, Homo Sapiens
aagucuuaguagauuuccuucaugacacuccagugucaaaauuguuagauugaggauggggg

SEQ ID NO: 273175 - RNA, 62 nt, Homo Sapiens
caaauaaaucugggcuuaggugcuguuuugaggugucaaauauuucuuuccagugcccagua

SEQ ID NO: 273176 - RNA, 62 nt, Homo Sapiens
uuauuauauuucacuuauagaccugauuuucugugucaaaguauaauucucaugcugaagcu

SEQ ID NO: 273177 - RNA, 62 nt, Homo Sapiens
cagcagaccucggaguacugcuaaguguaccugugucaaauccgcacaggacucaauauagc

SEQ ID NO: 273178 - RNA, 62 nt, Homo Sapiens
uugacuucugcacuaauccagugaaggaggcugugucaaaagaagggcucagaagcccucuu

SEQ ID NO: 273179 - RNA, 62 nt, Homo Sapiens
ugaaaugugucggcaguuuuuuuucuuuuaaugugucaaaucuugaaauauuaaauguauac

SEQ ID NO: 273180 - RNA, 62 nt, Homo Sapiens
uaguaucugaagauacugaagauuuauggcaagugucaaaaaaaauggauuuacuuugcuaa

SEQ ID NO: 273181 - RNA, 62 nt, Homo Sapiens
uuguuauuuuuuucauacuaugcuuagauuuugugucaaagcaagagugccaggaaagcaga

SEQ ID NO: 273182 - RNA, 62 nt, Homo Sapiens
ccugaugcaggccccaggcccuccuuucuugggugucaaaugacuguguccuggacaucuga

SEQ ID NO: 273183 - RNA, 62 nt, Homo Sapiens
ccugugugcuccucuuuuggauuuacagaaaugugucaaauguaaaucuuucaaagccauuu

SEQ ID NO: 273184 - RNA, 62 nt, Homo Sapiens
gugaacuuuauaaaagacacuugcaauauacugugucaaaaugauaauuuuguuauguuagc

SEQ ID NO: 273185 - RNA, 62 nt, Homo Sapiens
uuuguguucaauauauaggcagaaaaaaauuugugucaaaauguugaauggaauaauaauga

SEQ ID NO: 273186 - RNA, 62 nt, Homo Sapiens
gaauuccaaacuacagaaaauguuuguuuuuagugucaaauuuuuagcuguauuuguagcaa

SEQ ID NO: 273187 - RNA, 62 nt, Homo Sapiens
ggguggggugguaugccccaggacccuuguuugugucaaaaaugacuuucccugcccuugcc

SEQ ID NO: 273188 - RNA, 62 nt, Homo Sapiens
uuaaugaaucugugaucaauacccuuucuaucgugucaaauguuacaaacguguuucuguac

SEQ ID NO: 273189 - RNA, 60 nt, Homo Sapiens
acuauggcuuaaggcucuuggcuaauacuuaagugucaaaauaagugcuugaaauaaaau

SEQ ID NO: 273190 - RNA, 62 nt, Homo Sapiens
gugggcaggaguggagagcuuuugggugcacggugucaaagugcuccccauaagacguccuc

SEQ ID NO: 273191 - RNA, 62 nt, Homo Sapiens
cugcagccugccaagcuguguauacuguaccagugucaaauguuaugauaauuugccauugc

SEQ ID NO: 273192 - RNA, 62 nt, Homo Sapiens
auaauuauaaaagguacagcuuuuaguuauuugugucaaauucuuuuagggaauauuuuauu

SEQ ID NO: 273193 - RNA, 62 nt, Homo Sapiens
cugucuuugcccccaaagguauuuugugucuagugucaaauuggagcuauucuucacugguc

SEQ ID NO: 273194 - RNA, 62 nt, Homo Sapiens
agagacgaggucccaccauguugcccaggcuggugucaaacuccugggcucagucagucccc

SEQ ID NO: 273195 - RNA, 62 nt, Homo Sapiens
aaaaaaaaaaguucaagucauguuauacaggugugucaaaagguaucuuggucauuaaguau

SEQ ID NO: 273196 - RNA, 62 nt, Homo Sapiens
aaggaacagcucguucugcuauuagcuugugcgugucaaaagacauccccacucucuagggg

SEQ ID NO: 273197 - RNA, 62 nt, Homo Sapiens
guuuauguaaacuugaauuuucucauauacuagugucaaaagugaugucaucaagguaacca

SEQ ID NO: 273198 - RNA, 62 nt, Homo Sapiens
uaauuggcuuugacuuuuuguucaagggcucagugucaaagauugugacuugaaugucagga

SEQ ID NO: 273199 - RNA, 62 nt, Homo Sapiens
gauaaagcuuaacacuugacgagauaaggacagugucaaaguuuucuaaauuccuccauugu

SEQ ID NO: 273200 - RNA, 62 nt, Homo Sapiens
uugacauaagugcuuuuacaggguuaugauuugugucaaaaaugaaaauaccuguguacuga

SEQ ID NO: 273201 - RNA, 62 nt, Homo Sapiens
ggacacccaucuuaccggccguuccuuuccaagugucaaauacugguaccugggcuagcuug

SEQ ID NO: 273202 - RNA, 62 nt, Homo Sapiens
ugguuuaggauuacuuagauaggcaaugguuugugucaaaaccacuaugaauggguuguuaa

SEQ ID NO: 273203 - RNA, 62 nt, Homo Sapiens
cauauccuggguguacugagccacauaauaaggugucaaaaugugcuugagauuccaaaaac

SEQ ID NO: 273204 - RNA, 62 nt, Homo Sapiens
gguccuuggaggaggggcuaggacagccgugggugucaaagguggcauuugaggcucguuug

SEQ ID NO: 273205 - RNA, 62 nt, Homo Sapiens
guuguguagcugugucauguauauaccuuuuugugucaaaaggacauuuaaaauucaauuag

SEQ ID NO: 273206 - RNA, 62 nt, Homo Sapiens
auuugacaaaagugaauacaauaauaacacuugugucaaaaugauauagcuuaguauaaaaa

SEQ ID NO: 273207 - RNA, 62 nt, Homo Sapiens
cucccaaggugauuuucuuuuucuaagugacugugucaaauguugcaguagaugggcagcuu

SEQ ID NO: 273208 - RNA, 62 nt, Homo Sapiens
gagauuucauuuuacaacacaaaaauaagccugugucaaagauuuuaaaaucauggaaaguu

SEQ ID NO: 273209 - RNA, 62 nt, Homo Sapiens
gcaguuggugucuucauuuuuuacccguagucgugucaaauagcuuucacauagcacaggca

SEQ ID NO: 273210 - RNA, 62 nt, Homo Sapiens
gaagcuuguuuguaauacguauggucccagcugugucaaaaguuaaaacuaacuauauaagg

SEQ ID NO: 273211 - RNA, 62 nt, Homo Sapiens
gugugcauucauucuguaggaacuaagaaaaugugucaaauuuuuuuuaaauaaucuuuuga

SEQ ID NO: 273212 - RNA, 62 nt, Homo Sapiens
aacaugaaaagguagauggaagauuuguuuuggugucaaaauuauguauucauucacuuuca

SEQ ID NO: 273213 - RNA, 62 nt, Homo Sapiens
cccucccacauugugucaagcuccacggggcugugucaaauggccuccccgagcauuagguc

SEQ ID NO: 273214 - RNA, 62 nt, Homo Sapiens
guacacuaucuuaauuauuguuguugaugcuugugucaaacaggcugucuauucuagucuau

SEQ ID NO: 273215 - RNA, 62 nt, Homo Sapiens
guguuucaaaagaauuguuuuaguuaagcacugugucaaagauuaaaaaaaaaaucuaaaaa

SEQ ID NO: 273216 - RNA, 62 nt, Homo Sapiens
gguacagugauucagccauuagauuuaagguugugucaaaaaaauaauauauaguaaaacua

SEQ ID NO: 273217 - RNA, 62 nt, Homo Sapiens
gucugagagaauaaaugggguuguguuuaagagugucaaacagagaaacagguuaauggacu

SEQ ID NO: 273218 - RNA, 62 nt, Homo Sapiens
gcuucuugacuuuaacaucagcauuauaaaaagugucaaauaaaaaauuaccaucauuauca

SEQ ID NO: 273219 - RNA, 62 nt, Homo Sapiens
aacuuaaguguuggaggaggcaggggcugaaggugucaaaaccuccucaguaggauaacccc

SEQ ID NO: 273220 - RNA, 62 nt, Homo Sapiens
cugguugggagacaggauuccuagcaccuccggugucaaaaggcugucaugggguugugcca

SEQ ID NO: 273221 - RNA, 62 nt, Homo Sapiens
aaagccccugcagggccuggugaaacaaaguggugucaaaauucuuucuggacuguuuguau

SEQ ID NO: 273222 - RNA, 62 nt, Homo Sapiens
uuucuagugacggucaguccaaaaaaaguguugugucaaagcuuuggcagugugcuauaaua

SEQ ID NO: 273223 - RNA, 62 nt, Homo Sapiens
ccucaccuccuucauaaccacuagucuuccgugugucaaaauguuuauauaaauaaauguuu

SEQ ID NO: 273224 - RNA, 62 nt, Homo Sapiens
auaagagacagacacuuggucauaccuggaaugugucaaauucucaugaccauuagaauagu

SEQ ID NO: 273225 - RNA, 62 nt, Homo Sapiens
uuagccguuuguuuuuuuuuuucaguucucuagugucaaaguugauauagcaucaaaaauua

SEQ ID NO: 273226 - RNA, 62 nt, Homo Sapiens
uuuuagcauguuuuuaaauaaaaacggauaaagugucaaaagcacagcaggcugucucucag

SEQ ID NO: 273227 - RNA, 62 nt, Homo Sapiens
uucuucaaaaaaguaauauccucacuuggagagugucaaauacauacuuugaggauugacuu

SEQ ID NO: 273228 - RNA, 62 nt, Homo Sapiens
guuuuguuuacuuucugucaagauauuuacccgugucaaauucaaacuacaguacuguguaa

SEQ ID NO: 273229 - RNA, 62 nt, Homo Sapiens
uuacuucaugacugccacgcauuuacagauuggugucaaagacauucacuauguuuuuaugg

SEQ ID NO: 273230 - RNA, 62 nt, Homo Sapiens
uugaaauaagauccuggaaacgaauuuaaauggugucaaacugcagagcaacagggcuucag

SEQ ID NO: 273231 - RNA, 62 nt, Homo Sapiens
uguaacugcuuuauaauauugugugugugugugugucaaaaaauagaaaaguguauuuauuu

SEQ ID NO: 273232 - RNA, 62 nt, Homo Sapiens
auggccuauuggcccucagucaaggguguucugugucaaaagaaggauucugggagaugguc

SEQ ID NO: 273233 - RNA, 62 nt, Homo Sapiens
ccucuguauuuuuuaaaacauggugcuauucugugucaaacaacuguguguguccuacacaa

SEQ ID NO: 273234 - RNA, 62 nt, Homo Sapiens
gacaccagcugucuguacuaguguggccccaggugucaaaauagcugggcugcuuucuuugu

SEQ ID NO: 273235 - RNA, 62 nt, Homo Sapiens
cagaaugaagaguauucguguuuaaggaauuugugucaaaacuuaaauggccuuaauuuuuu

SEQ ID NO: 273236 - RNA, 62 nt, Homo Sapiens
aaaauauugaauauuggcaggugugaaaacaagugucaaaauuccucauauagagaaaauaa

SEQ ID NO: 273237 - RNA, 62 nt, Homo Sapiens
uuuuccucuaauuaaaaugugcaguauuuucagugucaaauauauuuaacuauuuagagaau

SEQ ID NO: 273238 - RNA, 62 nt, Homo Sapiens
auucuauuuuuuucugaaugauagcaugaaaagugucaaagugguuuguccgcuagcgucug

SEQ ID NO: 273239 - RNA, 62 nt, Homo Sapiens
aaucccaaaccaaaucaacuccagauauaucagugucaaaagcccaagaaaagacaaaaaag

SEQ ID NO: 273240 - RNA, 62 nt, Homo Sapiens
aacaagaggguaaaguucauacauggcgaccugugucaaauccguccauugaucugcccucc

SEQ ID NO: 273241 - RNA, 62 nt, Homo Sapiens
uaugauuuguacuucugcugugagauucccuagugucaaaauuaaaucaauaaaacugagca

SEQ ID NO: 273242 - RNA, 62 nt, Homo Sapiens
uagaaguuacuuaauugccagcaaauaaauacgugucaaaaaagaaucuguauucagacccu

SEQ ID NO: 273243 - RNA, 62 nt, Homo Sapiens
aaagagaaguuccuuuaaaaggucuuguucuugugucaaaaagcugcaaguuugguuuguuc

SEQ ID NO: 273244 - RNA, 62 nt, Homo Sapiens
uucauuguuaagagaagaauaaaauuggauuugugucaaacaguauguugacuuuuaacauc

SEQ ID NO: 273245 - RNA, 62 nt, Homo Sapiens
guauauucugugaauuaaaaguuaugugauuggugucaaacuuaaggagauucaagaccugg

SEQ ID NO: 273246 - RNA, 62 nt, Homo Sapiens
auucuuuaucccccuucaaagaaauuaccuuugugucaaaugccgcuuuguugagcccuuaa

SEQ ID NO: 273247 - RNA, 62 nt, Homo Sapiens
gcaaaagauccaccuguauucccugugugugugugucaaaaugaccauuugccaaccuggcu

SEQ ID NO: 273248 - RNA, 62 nt, Homo Sapiens
gaacauccugggcaccagucaugagucuuacugugucaaaaaucugaaaacacuugcugaga

SEQ ID NO: 273249 - RNA, 62 nt, Homo Sapiens
aagugugaauuuuaguuuugucacaguuaacugugucaaagagaauuaaaaaaaaaaacuuc

SEQ ID NO: 273250 - RNA, 62 nt, Homo Sapiens
gugugugguuuuuaaaacuguuaaggcaagaagugucaaaugcuuuagaguuaaauaacaga

SEQ ID NO: 273251 - RNA, 62 nt, Homo Sapiens
uguccuaaucuuugugguguucgcuaucucuugugucaaaucuggugaacgcuacgcuuaca

SEQ ID NO: 273252 - RNA, 62 nt, Homo Sapiens
aucucaaguguaggccugccuauaaaaaugaagugucaaaaaauuaauaauuucuugauaau

SEQ ID NO: 273253 - RNA, 62 nt, Homo Sapiens
gaugaggaaauaagacuuuucacuuugguaaugugucaaagaugugauuacagcauaggguc

SEQ ID NO: 273254 - RNA, 62 nt, Homo Sapiens
aguccacgaaaaaacaauuuuuuucaccucaggugucaaaguaaauuuguuaaaaaaacaaa

SEQ ID NO: 273255 - RNA, 62 nt, Homo Sapiens
uccauuguugguuuauugcagauuuguauccugugucaaauucaagguauuauugauaaacc

SEQ ID NO: 273256 - RNA, 62 nt, Homo Sapiens
ugcuuucuauuguacagaagcucuucguuucagugucaaauaaacacuguguaagcuauuuc

SEQ ID NO: 273257 - RNA, 62 nt, Homo Sapiens
uugcucaggcaauaauugguuuaaugcugguagugucaaauuuugaaguguuaauuuugucu

SEQ ID NO: 273258 - RNA, 62 nt, Homo Sapiens
uugaauuuacagugggaaaauuucauauaaacgugucaaagucgugcuuuguuuuuggaaga

SEQ ID NO: 273259 - RNA, 62 nt, Homo Sapiens
ucuacugugcccaaauguaccaacuauuuuucgugucaaauauucugaugcucauucugaua

SEQ ID NO: 273260 - RNA, 62 nt, Homo Sapiens
cauaaauggccacaaaaaagccauacaaucuagugucaaaaauacaucuuggcuaaauaaua

SEQ ID NO: 273261 - RNA, 62 nt, Homo Sapiens
ccuccgccaccuaggaaaggagggagaugugcgugucaaauauucaucuaguccccuggggg

SEQ ID NO: 273262 - RNA, 62 nt, Homo Sapiens
gauggccuggccuuggcuuccaucugccugcagugucaaauccaagaggcaucccaagaccu

SEQ ID NO: 273263 - RNA, 62 nt, Homo Sapiens
uaaaugacuagauaaaaaaagagcuagacucugugucaaaaagcacuccagccugggcaaca

SEQ ID NO: 273264 - RNA, 62 nt, Homo Sapiens
acagcuaguuacugugccaauuguucuugagugugucaaaauacauacuucaguauaggcau

SEQ ID NO: 273265 - RNA, 62 nt, Homo Sapiens
aguaacucagucuuauacuuccaagaaaucuugugucaaauugggucacccucaggaucucu

SEQ ID NO: 273266 - RNA, 62 nt, Homo Sapiens
ugccaguguuguuuaggcaagugugugcaugugugucaaaaugugucugugcgugugcgcgc

SEQ ID NO: 273267 - RNA, 62 nt, Homo Sapiens
aucauuaggcuuacguacuacuuguuucaaaugugucaaauacaaaaaugguaacuagguug

SEQ ID NO: 273268 - RNA, 62 nt, Homo Sapiens
uugguacagagacugagaaguuuuucauucuggugucaaaguuuuguuacauuaugggugug

SEQ ID NO: 273269 - RNA, 62 nt, Homo Sapiens
uuggcgauucuccacuggagcggaagggcugugugucaaaagaaggaagccaggcugugaag

SEQ ID NO: 273270 - RNA, 62 nt, Homo Sapiens
augggggcugcacuucccuuuuacauuuugaugugucaaaggcuuuuggagugaccaaaagc

SEQ ID NO: 273271 - RNA, 62 nt, Homo Sapiens
ggcaucugugcucuccgagagaaaaccaaggugugucaaaugacgucaagucucuauuuaaa

SEQ ID NO: 273272 - RNA, 62 nt, Homo Sapiens
ccuggguccucuuuuugaugcuuucacuuacugugucaaagcucucggccuucgagcacuuu

SEQ ID NO: 273273 - RNA, 62 nt, Homo Sapiens
uuugacagcuuuuauguagaugcauuuuugaugugucaaaacuaaaguauauuccauuauuu

SEQ ID NO: 273274 - RNA, 62 nt, Homo Sapiens
uugggggaaaacuuuuaaaagauacccucauugugucaaagagugugccaaucuauuuuugu

SEQ ID NO: 273275 - RNA, 62 nt, Homo Sapiens
ugccaugacaauaaaggucauagaaccugguagugucaaauuuaacccuuugaggacuguaa

SEQ ID NO: 273276 - RNA, 62 nt, Homo Sapiens
cagugaauuuugaaaacauacuccaauuuucagugucaaauugguauaauuuucacaaaauu

SEQ ID NO: 273277 - RNA, 62 nt, Homo Sapiens
uuggaacuuuggguugacucgguuugaguuuugugucaaagaagauuucccgcggcugaaga

SEQ ID NO: 273278 - RNA, 62 nt, Homo Sapiens
uaauggagaaaaacccuacaaaugugaagaaugugucaaagcuuuuaacuguuccucaaucc

SEQ ID NO: 273279 - RNA, 62 nt, Homo Sapiens
guaaguuauaauaauuguagcuuucugaauaagugucaaacuauaucuuuaagugugcugua

SEQ ID NO: 273280 - RNA, 62 nt, Homo Sapiens
ggacuaacagcagaaucuacccauuucugugugugucaaaggucacaccugcugcccauucu

SEQ ID NO: 273281 - RNA, 62 nt, Homo Sapiens
uguagaaaagccuucagucaaaaaccuuaugagugucaaacauaaaaaaaucauacagcaga

SEQ ID NO: 273282 - RNA, 62 nt, Homo Sapiens
aauaaaaaauaaaaaaucuagaaugagacucugugucaaaaagcacuucagccugggugaca

SEQ ID NO: 273283 - RNA, 62 nt, Homo Sapiens
ugccccccaguuccuuaggacugaccucaugagugucaaacgccccgcccaccagaccuguu

SEQ ID NO: 273284 - RNA, 51 nt, Homo Sapiens
cuuuaguguauuuucaacuuugugucaaaucaacccuacaaauguaaauaa

SEQ ID NO: 273285 - RNA, 62 nt, Homo Sapiens
uuacacuggaaaauaacuuuugaccucagugagugucaaaguaaagucuuuacucagaaaua

SEQ ID NO: 273286 - RNA, 62 nt, Homo Sapiens
auuauggcugucacaagcuuaacaguaucagugugucaaagcuuguggaaaaaucuauauaa

SEQ ID NO: 273287 - RNA, 62 nt, Homo Sapiens
agagccuucagacugcaacgcuggccugauacgugucaaaggagagagggauagaggaggau

SEQ ID NO: 273288 - RNA, 62 nt, Homo Sapiens
ugaugcuggugacucaaacgugccuacucauggugucaaauuggcauaauccucuugggaag

SEQ ID NO: 273289 - RNA, 62 nt, Homo Sapiens
uaguuuauuccuuuaacaacaauauuuuaugugugucaaaagucucacuugggaguaguguu

SEQ ID NO: 273290 - RNA, 62 nt, Homo Sapiens
ucaaccaaaucauguuuuccucuuggauggaagugucaaaggcagaagggugugggaggggg

SEQ ID NO: 273291 - RNA, 62 nt, Homo Sapiens
gaauuugauuuguacuuagaauguauggaugagugucaaaguuuucuggaaguacuugcuuc

SEQ ID NO: 273292 - RNA, 62 nt, Homo Sapiens
ugcaaaagaaauaguuuauuaaagauaugcaagugucaaauaacaucacuaguguagacuca

SEQ ID NO: 273293 - RNA, 62 nt, Homo Sapiens
ugaaccgaguccaguauuagccaccucuccaggugucaaaggcuccccacccccuggcuucc

SEQ ID NO: 273294 - RNA, 62 nt, Homo Sapiens
uuuuaccugggauaugacaaacucaaaaaggugugucaaagaguguuguacaauaccagauc

SEQ ID NO: 273295 - RNA, 62 nt, Homo Sapiens
gaauuguauugaaaaaaugcugaggaaugaaugugucaaaauggguuaacuguguauauuga

SEQ ID NO: 273296 - RNA, 62 nt, Homo Sapiens
ucuccuauuaaauaaaauuauuuuaaguuuuagugucaaaagugagaugcugagaguaggug

SEQ ID NO: 273297 - RNA, 62 nt, Homo Sapiens
aguuugcuguuucuguagccauauuguauucugugucaaauaaaguccaguuggauucugga

SEQ ID NO: 273298 - RNA, 62 nt, Homo Sapiens
agaaaagcugccuggagucugacaaccaccaggugucaaauggugccaccaggcugggcagg

SEQ ID NO: 273299 - RNA, 62 nt, Homo Sapiens
ugaacccaacuacuugucauagauguuugacugugucaaaagcugugagcagcaaaauauaa

SEQ ID NO: 273300 - RNA, 62 nt, Homo Sapiens
cuucggauaauuuucauuuuuaauuccucuuggugucaaauuuuuaaguaauuucaugcaca

SEQ ID NO: 273301 - RNA, 62 nt, Homo Sapiens
uuguaucaugugcuagauuggaguggggaagugugucaaaucaauaaaugaauaaauucaau

SEQ ID NO: 273302 - RNA, 62 nt, Homo Sapiens
auauuuuuagccuaacauuauuaauaagaaaugugucaaauuuuuaacauugguaaaauaug

SEQ ID NO: 273303 - RNA, 62 nt, Homo Sapiens
aucuaauugcaauaauaucuuaacagaagggggugucaaacagaggcaucagccugcuguug

SEQ ID NO: 273304 - RNA, 62 nt, Homo Sapiens
ucuuacuucuacauuuuuuucuagugacccaugugucaaaaauguuguauauaagcuaaauu

SEQ ID NO: 273305 - RNA, 62 nt, Homo Sapiens
uguguguuaaaaaauguuuaucugucaaacaagugucaaaguguuucuuuuaucugacugac

SEQ ID NO: 273306 - RNA, 62 nt, Homo Sapiens
uucaggggcaguuaaggaguuuaaaaauaauagugucaaaaagugugaguuuuccaaaauac

SEQ ID NO: 273307 - RNA, 62 nt, Homo Sapiens
augagaaaagagcaucuucacauauugcugaagugucaaaauuauuuuuaucagaaaaaugg

SEQ ID NO: 273308 - RNA, 62 nt, Homo Sapiens
aggaaucugaucagagguucggaguaagucuugugucaaagccuggugggguacacugcaga

SEQ ID NO: 273309 - RNA, 62 nt, Homo Sapiens
cuacuucagauugucuccuucagaauaauauugugucaaacucuaccagaauuucauauggg

SEQ ID NO: 273310 - RNA, 64 nt, Homo Sapiens
uauuccaagucuaaaauacaccuggaucugucuagucaaucaacauagcagagacagucuuaaa

SEQ ID NO: 273311 - RNA, 64 nt, Homo Sapiens
aacuuuuaaaaaauucuuuuacuuuuaacuucuugucaaucaaaguauccugaaaaaugauaua

SEQ ID NO: 273312 - RNA, 64 nt, Homo Sapiens
acuucugaaguaauuuguaaaaaagauuuguagagucaaucauguguuuaaauuauuuuaucac

SEQ ID NO: 273313 - RNA, 64 nt, Homo Sapiens
gggcacuugcauacucuuagcugauguugugcacgucaaucaccgaaaugucaauugcaggaug

SEQ ID NO: 273314 - RNA, 64 nt, Homo Sapiens
acugaagaugaaacacuaauugcaagcaucaagugucaaucaaauaaaaguuuguuuaaaaauu

SEQ ID NO: 273315 - RNA, 64 nt, Homo Sapiens
uugguuauguguaauguucacgugaccuuuuuuugucaaucauuuuuggaauuuuucuuucuuu

SEQ ID NO: 273316 - RNA, 64 nt, Homo Sapiens
acauuuuaguuccuaugugauuuggccuuucgaugucaaucaucacucccagccauugauuuug

SEQ ID NO: 273317 - RNA, 64 nt, Homo Sapiens
uccaugugcauaauuuaccucaugauuucuuuuggucaaucaggaucuuuaauacaauauagaa

SEQ ID NO: 273318 - RNA, 64 nt, Homo Sapiens
cguucuuuucgauagcucacgaugguguaugagugucaaucaucugacccuucuuggagucuca

SEQ ID NO: 273319 - RNA, 64 nt, Homo Sapiens
acuccaaaauagugauuccuccuuucuuuuuuaggucaaucaagaagcgcacugggcuguuuua

SEQ ID NO: 273320 - RNA, 64 nt, Homo Sapiens; identical to SEQ ID NO: 189841

SEQ ID NO: 273321 - RNA, 64 nt, Homo Sapiens; identical to SEQ ID NO: 189842

SEQ ID NO: 273322 - RNA, 64 nt, Homo Sapiens
gaaaauuucuuaaugaaauaccagcugcccugaggucaaucaagccauagccccuuggagugcc

SEQ ID NO: 273323 - RNA, 64 nt, Homo Sapiens
ugagagaaauuauucagauuuuugccauacugacgucaaucauuguaguauuuucccagucagc

SEQ ID NO: 273324 - RNA, 64 nt, Homo Sapiens
aaugcauuucaugucugauucugcugcuaauuaagucaaucauuuaauuuuugggaccucaguu

SEQ ID NO: 273325 - RNA, 64 nt, Homo Sapiens
augcggaaugugcacguuuccaggggcgaguauugucaaucaaaagguuugcaaugauuuccuu

SEQ ID NO: 273326 - RNA, 64 nt, Homo Sapiens
caccaucuucaugaguggacccuguuuggcuugugucaaucaguuuaucccauccccuuggcca

SEQ ID NO: 273327 - RNA, 64 nt, Homo Sapiens
acaggugccugaugaaaacgguucagaaagaucugucaaucaagcaguagugugaaaaaagcac

SEQ ID NO: 273328 - RNA, 64 nt, Homo Sapiens
uuugcuuaugacacuaacacuauuaaugacaggagucaaucagccuuuacagcuaucaaaauau

SEQ ID NO: 273329 - RNA, 64 nt, Homo Sapiens
uguggagggaggaagggggucuaaggucuaucaagucaaucauuucucacuguguacauaaugc

SEQ ID NO: 273330 - RNA, 64 nt, Homo Sapiens
ucuguaacacugaauccaagauuuuuucacuugggucaaucaaauaaaaaugauuagugucagu

SEQ ID NO: 273331 - RNA, 64 nt, Homo Sapiens
uggagacuucuuuugugaugacaucagaaaaccagucaaucauauuugagaaguugcuucuuuu

SEQ ID NO: 273332 - RNA, 64 nt, Homo Sapiens
gagucccgccacuuccagauuucaaagaugaccagucaaucaggcagaccccgagguugucugg

SEQ ID NO: 273333 - RNA, 64 nt, Homo Sapiens
cugguuuuggggaugcuaugguuucuuaagagccgucaaucagcgacuucaaaccauuuaacug

SEQ ID NO: 273334 - RNA, 64 nt, Homo Sapiens
cacaggucuuuccaccucugugaguccaagucaggucaaucagcaaggacccaucucugcccug

SEQ ID NO: 273335 - RNA, 64 nt, Homo Sapiens
auaguuacaucuugugaaaauauaugauuuuuaugucaaucaagacaaaugaaauauauaugua

SEQ ID NO: 273336 - RNA, 64 nt, Homo Sapiens
uuaaaguguguaauccuauuccuacuuccucagugucaaucagauaaauuucuuucauguccuc

SEQ ID NO: 273337 - RNA, 64 nt, Homo Sapiens
augcaguuucuccaucgguaauauccaaagucuugucaaucaggaagaaugcugacgaaaagca

SEQ ID NO: 273338 - RNA, 64 nt, Homo Sapiens
cacaguauuagccucuguuacaaccauugccaaugucaaucaauuuuuuuuuuuuuuuuuuugc

SEQ ID NO: 273339 - RNA, 64 nt, Homo Sapiens
cccacugccccucccccuguuccugccccaagccgucaaucagauuguggagcaguacacaguc

SEQ ID NO: 273340 - RNA, 64 nt, Homo Sapiens
uaacccucuuuuuaagaggagauuuaaggaagacgucaaucaaaaugucaaauaugugugucag

SEQ ID NO: 273341 - RNA, 64 nt, Homo Sapiens
ucagccaacaugcaucaguacugcaagaaaagaagucaaucagcagaggagagcauuugauaac

SEQ ID NO: 273342 - RNA, 64 nt, Homo Sapiens
ugagaguaugaaugaagaacaacuagauauuaaugucaaucauuuaagauuaaugggcaugcaa

SEQ ID NO: 273343 - RNA, 64 nt, Homo Sapiens
cuuuaaccaaaagauuucaacccacaaugaucaggucaaucaaaaucccuaagagcagaacucc

SEQ ID NO: 273344 - RNA, 64 nt, Homo Sapiens
ugauuagaaaaucaaaaaacacucauccauaugggucaaucaacgacauugccaucucuauuua

SEQ ID NO: 273345 - RNA, 64 nt, Homo Sapiens
acaugcuguuuaaagcagcugggaccacccuuuggucaaucauacgacaacaacgcccucuuaa

SEQ ID NO: 273346 - RNA, 64 nt, Homo Sapiens
cagggacacuacaaacauggcuguguuguucauagucaaucaaaaauacauuccaguguauuuu

SEQ ID NO: 273347 - RNA, 64 nt, Homo Sapiens
uuuuauuuuuuuucuguaacugugcuuguugaaugucaaucauauuuaaagggaaugacuuuga

SEQ ID NO: 273348 - RNA, 64 nt, Homo Sapiens
auggcugaucaauuuucauacauugagaaaccaagucaaucaagcaggaaucauuuaaaaacca

SEQ ID NO: 273349 - RNA, 64 nt, Homo Sapiens
aggcuccugugaggacaacagccugggccucggcgucaaucaucgauaagaagccucuacagca

SEQ ID NO: 273350 - RNA, 64 nt, Homo Sapiens
gcacuuuagcaggcuccgagcuuuccuggcauaggucaaucaggucccaggaugaauaauccag

SEQ ID NO: 273351 - RNA, 64 nt, Homo Sapiens
ggggaggggaggguguugagaaagcugaacuggagucaaucacccuucccacaaaucaccaaac

SEQ ID NO: 273352 - RNA, 64 nt, Homo Sapiens
ugcugcuaaaggacuggacucaaacaaaaacgaggucaaucaugccauugaccgagugaccacu

SEQ ID NO: 273353 - RNA, 64 nt, Homo Sapiens
aaaaauagaugcaugcauauguuaacauugaauagucaaucacuagaugaagaugcucucuacc

SEQ ID NO: 273354 - RNA, 64 nt, Homo Sapiens
uuaagcaucaaaugcaaucaucuaaaauauaaaggucaaucauuuauaauagaaacaccuugac

SEQ ID NO: 273355 - RNA, 64 nt, Homo Sapiens
aaauuuguucguaaagaaaaguggaugcuuauuugucaaucaguccuaacauucuucuuccugu

SEQ ID NO: 273356 - RNA, 64 nt, Homo Sapiens
cuuacauuccugccaagaugugaagguuaacacagucaaucaaagcuucaaaaggcucucaaca

SEQ ID NO: 273357 - RNA, 64 nt, Homo Sapiens
aauaagaucauccugguuuaaagugcgaugcccagucaaucacaaaaaaagaauaaagaaagaa

SEQ ID NO: 273358 - RNA, 64 nt, Homo Sapiens
ugucuugaugugaugcacugcacagcauuauugugucaaucaugcugugaugcagcgaguggca

SEQ ID NO: 273359 - RNA, 64 nt, Homo Sapiens
ugaccauauagauuuuauuauguuaguuuaaaaggucaaucagccucaugacuuuauaguuaug

SEQ ID NO: 273360 - RNA, 64 nt, Homo Sapiens
ccaugugcuaguaauuggaaaggcagcucuaaaugucaaucagccuaguugaucagcuuauugu

SEQ ID NO: 273361 - RNA, 64 nt, Homo Sapiens
gacaccugguacuggcaguucaggaauuugacuagucaaucagugaguguguagccccuuuguc

SEQ ID NO: 273362 - RNA, 64 nt, Homo Sapiens
aagagaauggaaaacuuauauuuaguaagggaaagucaaucagguuuccaagaccugcccagga

SEQ ID NO: 273363 - RNA, 64 nt, Homo Sapiens
uggauguguaaagaaugauauauauauuaaauaggucaaucagacuaugacagcuauguacgac

SEQ ID NO: 273364 - RNA, 64 nt, Homo Sapiens
cuuuaggucuuuaguccgggucaaucaggaaugagucaaucagcgugggagacuuuccauuaaa

SEQ ID NO: 273365 - RNA, 64 nt, Homo Sapiens
acucaaagaaugaugaaggucauuaaacgagacugucaaucauuguauuugacaaacauuauuu

SEQ ID NO: 273366 - RNA, 64 nt, Homo Sapiens
uaagaaguauacuuugauuauuggaauauagacagucaaucagaauguuaggucaacuggcaaa

SEQ ID NO: 273367 - RNA, 64 nt, Homo Sapiens
ccaagccugcauguacagaaugaaauacauuauggucaaucaaguguaucuaaauuuuuuuugc

SEQ ID NO: 273368 - RNA, 64 nt, Homo Sapiens
auguuuccuuucugcucuuacacagcauuguuuugucaaucaacacagccugcacugaaaggac

SEQ ID NO: 273369 - RNA, 64 nt, Homo Sapiens
gggcacaaaccuuauuaggauaagccaggcuuaagucaaucagagaaggcagaaagcuucugug

SEQ ID NO: 273370 - RNA, 64 nt, Homo Sapiens
guagaggggguauuucugagagggucugcgcacagucaaucaggggugucuuucuugugcaguc

SEQ ID NO: 273371 - RNA, 59 nt, Homo Sapiens
guuaacuugcauauuguuggggaaugauggucaaucagucucaucaugaacacagcuaa

SEQ ID NO: 273372 - RNA, 64 nt, Homo Sapiens
agauauaagaaucaaauauucccaaggaggauuugucaaucaaggaaaacaugacagaugguga

SEQ ID NO: 273373 - RNA, 64 nt, Homo Sapiens
ugcuaccgccccaaaguaaaagaaaccacuucuggucaaucaacacuaccagcguauauauaag

SEQ ID NO: 273374 - RNA, 64 nt, Homo Sapiens
accacuaaaauuuuaguuuuagccuaucacucaugucaaucauaucuaugagacaaaugucucc

SEQ ID NO: 273375 - RNA, 64 nt, Homo Sapiens
uuaauuuucauccaucuuuuggucguagguaaaggucaaucagguuuuucaaaaagacucccug

SEQ ID NO: 273376 - RNA, 64 nt, Homo Sapiens
agaaagcugaacgugcacucugacaaggggagcugucaaucaaacaccaaaccggggagacaag

SEQ ID NO: 273377 - RNA, 64 nt, Homo Sapiens
ugucacauuuauccaguuuggugugaaaugcuuugucaaucauuugaugugguguaauugaagg

SEQ ID NO: 273378 - RNA, 64 nt, Homo Sapiens
gacuagcuuccuguagccaagccuuguggaacaagucaaucaguuaaguuauguaagaaucauc

SEQ ID NO: 273379 - RNA, 64 nt, Homo Sapiens
ucuguuuacugcaagguucaauuaaccagaucuagucaaucaagacuauuuucagaugugaacc

SEQ ID NO: 273380 - RNA, 64 nt, Homo Sapiens
uaugcaauuuuuauuuugguuauauuacaaaaaugucaaucaaauauuaaaaaauaguuaaugu

SEQ ID NO: 273381 - RNA, 64 nt, Homo Sapiens
auuguuauuuaucauuaagguuuucaaaauaaaagucaaucagcuuauuccaguuuucaaugau

SEQ ID NO: 273382 - RNA, 64 nt, Homo Sapiens
aggcaucuggaaagggggggacccaguguacuaggucaaucaggauguuuuuaauucccuuuua

SEQ ID NO: 273383 - RNA, 64 nt, Homo Sapiens
aaaugaauacuauugucagaaccauaucuauauagucaaucauuuccucuuuuaacgucugucu

SEQ ID NO: 273384 - RNA, 52 nt, Homo Sapiens
cuccugauguuaaggccugagcgucaaucauaugugcaguuaguauacaacu

SEQ ID NO: 273385 - RNA, 64 nt, Homo Sapiens
ccugacaaaacuguugcugcacacaucuguacucgucaaucaacaaaaccugaugcaaaaaaca

SEQ ID NO: 273386 - RNA, 64 nt, Homo Sapiens
gagugggcgggugagaaaaaccgaauuggguuuagucaaucacugcacugcaugcaaacaagaa

SEQ ID NO: 273387 - RNA, 64 nt, Homo Sapiens
auuuucugaccaggcacaugccauccaauuuucugucaaucacacuguuguauaaagcagcaga

SEQ ID NO: 273388 - RNA, 64 nt, Homo Sapiens
ugauuucauacguacccagggagcaugcuguuuugucaaucaauauaaaauauuuaugaggucu

SEQ ID NO: 273389 - RNA, 64 nt, Homo Sapiens
ggagccucucccuccgagauacccacccagcuuugucaaucacccaagcacuuuaugcauauag

SEQ ID NO: 273390 - RNA, 64 nt, Homo Sapiens
ucguggucuucgcagaggggaaggccugucuaaagucaaucauccgagauggguuuuccauucc

SEQ ID NO: 273391 - RNA, 64 nt, Homo Sapiens
cugucccauugucuacugggccagaacucauccugucaaucacuguacauuucugccauguacu

SEQ ID NO: 273392 - RNA, 64 nt, Homo Sapiens
gcuuuauuucaggccgaaugagaaaccgggcucagucaaucaaucauuccuuaucucagaaaac

SEQ ID NO: 273393 - RNA, 64 nt, Homo Sapiens
guuaaaguauuuguaaauagguggacacuuguaagucaaucaguuugugcuguuaacaacguua

SEQ ID NO: 273394 - RNA, 64 nt, Homo Sapiens
gaacaucuugcacacaauuugaauuauguagaaugucaaucaaguuuuuguauauuuaaaaguu

SEQ ID NO: 273395 - RNA, 64 nt, Homo Sapiens
cuguuccugucucagcaaccaagggauuguuccugucaaucaaugguuuauuggaagguggccc

SEQ ID NO: 273396 - RNA, 64 nt, Homo Sapiens
caagcauguugaauaagggacuaguucucuacaugucaaucaauaucagaacaaagggcccacu

SEQ ID NO: 273397 - RNA, 64 nt, Homo Sapiens
uguuagccaagcaaagccaucaguaagucucuaagucaaucauuugaaaaugaggcugcaacaa

SEQ ID NO: 273398 - RNA, 64 nt, Homo Sapiens
aaugaacauaaaggacuccacuugguccaaaauugucaaucagagaauuagggggccucuuggc

SEQ ID NO: 273399 - RNA, 64 nt, Homo Sapiens
gugcucuccucuuuuuuguuuuguuuugcacuuugucaaucauuuggggaaauagccuggaggu

SEQ ID NO: 273400 - RNA, 64 nt, Homo Sapiens
uggcuucuguuuuauucagggauuuuuuuaaaaagucaaucagaaaagggauacuggagcuucu

SEQ ID NO: 273401 - RNA, 64 nt, Homo Sapiens
uugaagcugaugggugccagcccugcauugcugagucaaucaauaaagagcuuucuuuugaccc

SEQ ID NO: 273402 - RNA, 64 nt, Homo Sapiens; identical to SEQ ID NO: 273401

SEQ ID NO: 273403 - RNA, 64 nt, Homo Sapiens
gcagagaauaaaacguuaguuaaucccuuugucugucaaucacagucucaguucucuugcuuuc

SEQ ID NO: 273404 - RNA, 64 nt, Homo Sapiens
gaauuggaaaaaaagauguagcauaagcacucuugucaaucaugucuggugccuuccaugcguc

SEQ ID NO: 273405 - RNA, 64 nt, Homo Sapiens
guggcucacguagguggcaccugccaauagcuuugucaaucacagccccauaggaacgucugga

SEQ ID NO: 273406 - RNA, 64 nt, Homo Sapiens
accacaacagguuggucaucgaccccccccccaagucaaucagacuuggagaagcuguugcuga

SEQ ID NO: 273407 - RNA, 64 nt, Homo Sapiens
acugacaggacugcaagagggagaaaggaauuuugucaaucaaaauuauucuguauugcaacuu

SEQ ID NO: 273408 - RNA, 64 nt, Homo Sapiens
uggauaugcuguuuaguuuuguuggauggauuuugucaaucagcguuuuguuuugccuuuaaca

SEQ ID NO: 273409 - RNA, 64 nt, Homo Sapiens
cugauucuagcccauuuuccugauucucuggcuugucaaucaagaguauccuccaaaucucuug

SEQ ID NO: 273410 - RNA, 64 nt, Homo Sapiens
auuguacuccaucaauauaauacaauuauuauuugucaaucaaauauuaauaaaaucaaagaug

SEQ ID NO: 273411 - RNA, 64 nt, Homo Sapiens
ggcggaagccaucuuauugcuaccagcugugugugucaaucacuccauuuugcucagggaaggc

SEQ ID NO: 273412 - RNA, 64 nt, Homo Sapiens
gccaccuuccuguuaucuccauguugccuuuccugucaaucacacagcaggaugcugaggaacc

SEQ ID NO: 273413 - RNA, 64 nt, Homo Sapiens
cauugaauugcuauggaagagauggaguaaaauugucaaucauaucagagaugaccuuaaauau

SEQ ID NO: 273414 - RNA, 64 nt, Homo Sapiens
aaaacaaugaucauucugugaagcagucuccauagucaaucagagugcaaccugaaacccagga

SEQ ID NO: 273415 - RNA, 64 nt, Homo Sapiens
accuuuccuccagaggaggacugucucccugccugucaaucaccggcuuucucuagccuuguca

SEQ ID NO: 273416 - RNA, 64 nt, Homo Sapiens
auucaacaucuuuuacacuaaaaauuauuaaaaagucaaucaguguauuucugacuuauacuau

SEQ ID NO: 273417 - RNA, 64 nt, Homo Sapiens
guguauccugacagcgccaugugugucagcccaugucaaucaagaugggugauuaugaaaugcc

SEQ ID NO: 273418 - RNA, 64 nt, Homo Sapiens
uagcaagugauggagcccaggucaucugccuggugucaaucagccuggggcacagagaggugau

SEQ ID NO: 273419 - RNA, 64 nt, Homo Sapiens
aagguacuauagaagggcgaagaaucguucaacugucaaucagccucuugauucuuuguaaauu

SEQ ID NO: 273420 - RNA, 64 nt, Homo Sapiens
auaaugaaaaaaucacacaauuuugaagaaaacugucaaucagcuuauaacgacaauguggcac

SEQ ID NO: 273421 - RNA, 64 nt, Homo Sapiens
uguuuuuagcauucuaaauuuaaaugcuuaaaacgucaaucaacaaaacuuuguuuuaaauauu

SEQ ID NO: 273422 - RNA, 64 nt, Homo Sapiens
gacgcaucuggagacaagugcaggaagaacuucugucaaucaugucuccuaugugacuuuagug

SEQ ID NO: 273423 - RNA, 64 nt, Homo Sapiens
cuucguuguuguuguuuuuaauuguaaauuguuaucaaucaaacuauuguagcagcuacaaagu

SEQ ID NO: 273424 - RNA, 64 nt, Homo Sapiens
auuccaagucuaaaauacaccuggaucugucuagucaaucaacauagcagagacagucuuaaac

SEQ ID NO: 273425 - RNA, 64 nt, Homo Sapiens
gaagauggucuguuuugacagaaacugacaggaaucaaucaaaacaaucgaauuuugaauugag

SEQ ID NO: 273426 - RNA, 64 nt, Homo Sapiens
aucacauaaccuuaaagaauaccguuuacauuucucaaucaaaauucuuauaauacuauuuguu

SEQ ID NO: 273427 - RNA, 64 nt, Homo Sapiens
aacagaauacauacauguguauauguaaagaauuucaaucaaaugaaacguuauccuauuggau

SEQ ID NO: 273428 - RNA, 64 nt, Homo Sapiens
cuuuguauauuuaaguguuguaaggaaacguguuucaaucaaaacugaccaugagauaaaggaa

SEQ ID NO: 273429 - RNA, 64 nt, Homo Sapiens
acuuuuaaaaaauucuuuuacuuuuaacuucuugucaaucaaaguauccugaaaaaugauauaa

SEQ ID NO: 273430 - RNA, 64 nt, Homo Sapiens
aaacacagugcuggcucggcugcccugagggugcucaaucaagcacagguuucaagucuggguu

SEQ ID NO: 273431 - RNA, 64 nt, Homo Sapiens
cuccguguugcuggauaaagcuuuuuuauuuaccucaaucaaaaaaagaaaacaaaaaugaacu

SEQ ID NO: 273432 - RNA, 64 nt, Homo Sapiens
uaucacuaucaccaccaccccucacccuaugcaaucaaucaaucaaucaucuuaaguuaaagau

SEQ ID NO: 273433 - RNA, 64 nt, Homo Sapiens
acuaucaccaccaccccucacccuaugcaaucaaucaaucaaucaucuuaaguuaaagauauuu

SEQ ID NO: 273434 - RNA, 64 nt, Homo Sapiens
aacuuuauuuuuauaaagggagaggaugacuuucucaaucaagugccaccagauaaaaacaacu

SEQ ID NO: 273435 - RNA, 64 nt, Homo Sapiens
uuuaauagauagggcugggcuuggucuguuauauucaaucaagguccauuuggugcaguuguac

SEQ ID NO: 273436 - RNA, 64 nt, Homo Sapiens
gaauuguucuuuuuccuguuucuugagucuugguucaaucaacaacuuggauuaauucauggua

SEQ ID NO: 273437 - RNA, 64 nt, Homo Sapiens
aacuucauaauacuuucaggaagcaaguucacuuucaaucaagaaauccaagaauagaagaaug

SEQ ID NO: 273438 - RNA, 64 nt, Homo Sapiens
ugccagaaacaguuugguuuagacucucaagagaucaaucaaauccauggaaugaaugcacugc

SEQ ID NO: 273439 - RNA, 64 nt, Homo Sapiens
cugaagaugaaacacuaauggcaagcaucaagugucaaucaaaaaaaaguuuguuuaaaaauuu

SEQ ID NO: 273440 - RNA, 64 nt, Homo Sapiens
cuguauuugguuuaauguuuuuguccuaaucucuucaaucaauaaaauugugcguauuuaacua

SEQ ID NO: 273441 - RNA, 64 nt, Homo Sapiens
uguuuugcacuuucaaagauuguaaauaguucauucaaucaaugguauggaguuauuuauuugc

SEQ ID NO: 273442 - RNA, 64 nt, Homo Sapiens
aagauauuacaggguagacacguuuuaacugaaaucaaucaagauaacuuuauucaaagagcag

SEQ ID NO: 273443 - RNA, 64 nt, Homo Sapiens
cacugugugacauccauaugaauuuugguauauaucaaucaaucaaucaaucacauugcauuca

SEQ ID NO: 273444 - RNA, 64 nt, Homo Sapiens
gugugacauccauaugaauuuugguauauaucaaucaaucaaucaaucacauugcauucaauca

SEQ ID NO: 273445 - RNA, 64 nt, Homo Sapiens
gacauccauaugaauuuugguauauaucaaucaaucaaucaaucacauugcauucaaucaauca

SEQ ID NO: 273446 - RNA, 64 nt, Homo Sapiens
guauauaucaaucaaucaaucaaucacauugcauucaaucaaucagcugugauugauugauuau

SEQ ID NO: 273447 - RNA, 64 nt, Homo Sapiens
cugguggguccauggcccugucauuuucuguaacucaaucaagaggaaguguaaagagucaccu

SEQ ID NO: 273448 - RNA, 64 nt, Homo Sapiens
cuuuuucagacuaaaggccaucuguuguacacuuucaaucaacaucggccgcuugcacccgcuc

SEQ ID NO: 273449 - RNA, 64 nt, Homo Sapiens
cauaucuauuuauuaaauuuauacuauuaaugaaucaaucaauucacccccaaauuuucuuuuu

SEQ ID NO: 273450 - RNA, 64 nt, Homo Sapiens
cuccaaaauagugauuccuacuuucuuuuuuaggucaaucaagaagcgcacugggcuguuuuac

SEQ ID NO: 273451 - RNA, 64 nt, Homo Sapiens
cucaccuggcucauuuggcuaaaaucuucuugcgucaaucaagcugaccacauucccaacuaga

SEQ ID NO: 273452 - RNA, 64 nt, Homo Sapiens
aaaauuucuuaaugaaauaacagcugcccugaggucaaucaaggcauagccccuuggagugccc

SEQ ID NO: 273453 - RNA, 64 nt, Homo Sapiens
cuuauccaccaaauacacagucaguaccugagccucaaucaagccucaaugugccagcagggac

SEQ ID NO: 273454 - RNA, 64 nt, Homo Sapiens
agcauuuccuaggcagcucccccuccucuguucaucaaucaaaauuguauuuaauguguguaga

SEQ ID NO: 273455 - RNA, 64 nt, Homo Sapiens
cagauaaauuuuugagacaacaauuuggccuucuucaaucaagccugccauuuuuuucccucca

SEQ ID NO: 273456 - RNA, 64 nt, Homo Sapiens
guucuugacugccaaacuuuaacccaaccgucuuucaaucaacagagcuugaugcccagggaac

SEQ ID NO: 273457 - RNA, 64 nt, Homo Sapiens
ugagaacauuuuaaaaauauugucuuagcaauuuucaaucaagccugucccauggagacacaag

SEQ ID NO: 273458 - RNA, 64 nt, Homo Sapiens
ugcggaaugugcacguuuccaggggcgaguauugucaaucaaaagguuugcaaugauuuccuuc

SEQ ID NO: 273459 - RNA, 64 nt, Homo Sapiens
aaaaaauaaaaaauauauaguggacaguaaccuuucaaucaaaacucaguaucauaaguagaga

SEQ ID NO: 273460 - RNA, 64 nt, Homo Sapiens
uggauuuuuaaaccuguucagaguccugguuuaaucaaucaagcuaaaagaaucgaagacaucc

SEQ ID NO: 273461 - RNA, 64 nt, Homo Sapiens
uccauuucaguggcagaagaauuuuuuaaggguuucaaucaauuauuaaugcagagaguauuga

SEQ ID NO: 273462 - RNA, 64 nt, Homo Sapiens
caggugccugaugaaaacgguucagaaagaucugucaaucaagcaguagugugaaaaaagcacu

SEQ ID NO: 273463 - RNA, 64 nt, Homo Sapiens
cugguaacucacucaguuuaugcugugcuaaauaucaaucaagccauguauaaaugugauauga

SEQ ID NO: 273464 - RNA, 64 nt, Homo Sapiens
guagugguaacuauucacuucuuaauuuaugaccucaaucaauuuaauugucuagaauguaaaa

SEQ ID NO: 273465 - RNA, 64 nt, Homo Sapiens
aauauccaaaugaaauuaagucucacugaacauuucaaucaagaauggcagggaucuauuuuau

SEQ ID NO: 273466 - RNA, 64 nt, Homo Sapiens
cuguaacacugaauccaagcuuuuuucacuugggucaaucaaauaaaaaugauuagugucagua

SEQ ID NO: 273467 - RNA, 64 nt, Homo Sapiens
aauguugaacauuuuuuuucauuuuaacagucuaucaaucaauaaauguuauuccaaacauuaa

SEQ ID NO: 273468 - RNA, 64 nt, Homo Sapiens
acuaaaauguaccauacaaaaacacuagauguuaucaaucaaacaagaugaauuuuuuucugga

SEQ ID NO: 273469 - RNA, 64 nt, Homo Sapiens
uguggcuuccauugaggagcagaaacucccaggcucaaucaaggaagcacccccugccccggca

SEQ ID NO: 273470 - RNA, 64 nt, Homo Sapiens
aaaagcuuuuguaaaauugcaaaugucuuucauuucaaucaauagguaauuguagcauuucaga

SEQ ID NO: 273471 - RNA, 64 nt, Homo Sapiens
gaagaguuugccuagaggagguuggcauaaacuuucaaucaaauggagguugacuaauaagaaa

SEQ ID NO: 273472 - RNA, 64 nt, Homo Sapiens
cagagaacgcuuuuagauaaguuuuuugaugaauucaaucaauggcuguugucauggcugagua

SEQ ID NO: 273473 - RNA, 64 nt, Homo Sapiens
ggcuccaguagcucuggauuaucucugaaaguaaucaaucaagugccuuugcuacauccugauu

SEQ ID NO: 273474 - RNA, 64 nt, Homo Sapiens
ugccccaaaacagaagcacaaauugaauuucucuucaaucaaaguagcaagauguaauccugug

SEQ ID NO: 273475 - RNA, 64 nt, Homo Sapiens
acauuaaacgcaaacugauuugugauguauggacucaaucaaaauugguuuugccuaucuacag

SEQ ID NO: 273476 - RNA, 64 nt, Homo Sapiens
uacauuacaagauccagguucuucccccccacacucaaucaagccagcccucuccucuucuguc

SEQ ID NO: 273477 - RNA, 64 nt, Homo Sapiens
uauuaaccucaguccugucccccaaggucuugacucaaucaacucuaaguuccaagggaggacc

SEQ ID NO: 273478 - RNA, 64 nt, Homo Sapiens
agauuuuccagaaguaaaaucugaugguucuaaaucaaucaaugugauaguucauuuuuaacuc

SEQ ID NO: 273479 - RNA, 64 nt, Homo Sapiens
uucuguauguaaauauguuuauauuuauagagcaucaaucaauauaagcauuauugagaaaaau

SEQ ID NO: 273480 - RNA, 64 nt, Homo Sapiens
ccuuuauauuguauuuauaaaaaaaaaaguacuaucaaucaaucauacuacuuuggauuguugu

SEQ ID NO: 273481 - RNA, 64 nt, Homo Sapiens
uaguuacaucuugugaaaauauaugauuuuuaugucaaucaagacaaaugaaauauauauguau

SEQ ID NO: 273482 - RNA, 64 nt, Homo Sapiens
agggaagaaaugcaggggagccagccaccuccuaucaaucaaucuugacaaauucaguggcagc

SEQ ID NO: 273483 - RNA, 64 nt, Homo Sapiens
cagucagguaauuauuuucucuaaaguaacugaaucaaucaaucauagucaguggcaccauuuc

SEQ ID NO: 273484 - RNA, 64 nt, Homo Sapiens
uuuuuuguuguuuucuguucuuugauugaaguauucaaucaagucucacauaaaaaagaagcac

SEQ ID NO: 273485 - RNA, 64 nt, Homo Sapiens
auuuccuauauaacaauuaugaaaauggaacauuucaaucaaacugcuauaagcuuggugaaau

SEQ ID NO: 273486 - RNA, 64 nt, Homo Sapiens
gucuugguagauaagaaaaaacuacuucugcuguucaaucaagaauuaccuuuugauuuguaac

SEQ ID NO: 273487 - RNA, 64 nt, Homo Sapiens
acaguauuagccucuguuaaaaccauugccaaugucaaucaaucuuuuuuuuuuuuuuuuugcc

SEQ ID NO: 273488 - RNA, 64 nt, Homo Sapiens
aauaaauaaaucacuaaggagcauggaucaccaaucaaucaaaauccagaaaggacguaacuua

SEQ ID NO: 273489 - RNA, 64 nt, Homo Sapiens
uaagaaaaaaaaaaaaaaaaaaaaagccaugcuaucaaucaagauucuuuuuuuuuaaacuuuc

SEQ ID NO: 273490 - RNA, 64 nt, Homo Sapiens
aacccucuuuuuaagaggagauuuaaggaagacgucaaucaaaaugucaaauaugugugucaga

SEQ ID NO: 273491 - RNA, 64 nt, Homo Sapiens
uuuaaccaaaagauuucaacccacaaugaucaggucaaucaaaaucccuaagagcagaacuccu

SEQ ID NO: 273492 - RNA, 64 nt, Homo Sapiens
accucgacuuguuuuuuagcccuucagcuccguuucaaucaaucugacagacauuuaaaaacaa

SEQ ID NO: 273493 - RNA, 64 nt, Homo Sapiens
uuauacagcaaacccuccauuaaaggcaaacccuucaaucaaguccugaguaauccaccccagc

SEQ ID NO: 273494 - RNA, 64 nt, Homo Sapiens
aaaauauuuuauucaaaaaaagagggucaaagguucaaucaauagccucuaaauguaauaagau

SEQ ID NO: 273495 - RNA, 64 nt, Homo Sapiens
cuaaaauuuucagaagucuguggggaagcuuauuucaaucaaaggauauauuaacaugaaggaa

SEQ ID NO: 273496 - RNA, 64 nt, Homo Sapiens
aggaggguaugauugguucaaaugaaccuuuacuucaaucaaaaugaacugccacaugccacca

SEQ ID NO: 273497 - RNA, 64 nt, Homo Sapiens
gauuagaaaaucaaaaaacacucauccauaugggucaaucaacuacauugccaucucuauuuaa

SEQ ID NO: 273498 - RNA, 64 nt, Homo Sapiens
ggcuuaaaucagcaaaauauucagauuuguguguucaaucaauguguaggaacucugauggugc

SEQ ID NO: 273499 - RNA, 64 nt, Homo Sapiens
agggacacuacaaacauggguguguuguucauagucaaucaaacauacauuccaguguauuuuc

SEQ ID NO: 273500 - RNA, 64 nt, Homo Sapiens
cccucauucauccauccguucauucauucagccuucaaucaacaucucuugagugucuauuaug

SEQ ID NO: 273501 - RNA, 64 nt, Homo Sapiens
uggcugaucaauuuucauacauugagaaaccaagucaaucaagcaggaaucauuuaaaaaccag

SEQ ID NO: 273502 - RNA, 64 nt, Homo Sapiens
gauaagugaucaugcagccagagccagccuuccuucaaucaagguuuccaggcagagcaaauac

SEQ ID NO: 273503 - RNA, 64 nt, Homo Sapiens
gauaagugauugugcagccagagccagccuuccuucaaucaagguuuccaggcagagcaaauac

SEQ ID NO: 273504 - RNA, 64 nt, Homo Sapiens
ucucacucuaguucccccaaagcuguagucccaaucaaucaaaggcuaccaacugaguccucag

SEQ ID NO: 273505 - RNA, 64 nt, Homo Sapiens
aaugaaagaaacuucagaaagcuagaauugcuuaucaaucaaaagacuuucucaaucuauuuug

SEQ ID NO: 273506 - RNA, 64 nt, Homo Sapiens
uauuucuuacauuauccuaaugauugaaaacuccucaaucaagcuuacuuacacacauucuaca

SEQ ID NO: 273507 - RNA, 64 nt, Homo Sapiens
uuuuuuaaaauugauuuuucucuucauuuuuuuuucaaucaacuuuacuguaauauaaaguauu

SEQ ID NO: 273508 - RNA, 64 nt, Homo Sapiens
acaucauaaugcacaauuuuauauacugauuuuuucaaucaauguauaucaugaguuuuuaaaa

SEQ ID NO: 273509 - RNA, 64 nt, Homo Sapiens
uguuuguaacuuaaaauuuuaccaugacugacuaucaaucaaaagaguaaggacuaggugcacc

SEQ ID NO: 273510 - RNA, 64 nt, Homo Sapiens
uuacauuccugccaagaugcgaagguuaacacagucaaucaaaccuucaaaaggcucucaacau

SEQ ID NO: 273511 - RNA, 64 nt, Homo Sapiens
uuuacaucucacaauguacuauauuuaggagcuaucaaucaaauauuuguguauauuugggaug

SEQ ID NO: 273512 - RNA, 64 nt, Homo Sapiens
aaaaucuaauaaauuuuagguuacuuauucgugaucaaucaaggugaaagaagcuuugccaauu

SEQ ID NO: 273513 - RNA, 64 nt, Homo Sapiens
uauugauuccaaagaacucccaggcauuguguuuucaaucaaguuagacuuuggaggucaaguc

SEQ ID NO: 273514 - RNA, 64 nt, Homo Sapiens
uuucagcuuuuuuuucagccgauuggauuucaguucaaucaaacauauuccuuauguugacaug

SEQ ID NO: 273515 - RNA, 64 nt, Homo Sapiens
guggugggaagaguuagggccagugucuugaaaaucaaucaaguagugaaugugaucucuuugc

SEQ ID NO: 273516 - RNA, 64 nt, Homo Sapiens
guccaucucucucccuuacuauucccacuuucauucaaucaaccugcacuucauaucuagauuu

SEQ ID NO: 273517 - RNA, 64 nt, Homo Sapiens
gccuuccucagccucuggcccucuuggcucagauucaaucaaauguugcuucccucuccugucu

SEQ ID NO: 273518 - RNA, 64 nt, Homo Sapiens
aaucaaucaguagacgucagucagccaagauuaaucaaucaaucugagaacucauaaauaaaau

SEQ ID NO: 273519 - RNA, 64 nt, Homo Sapiens
caauagucagucuuguaagguccguagacuacaaucaaucaaauaaaauucacuccuggagauc

SEQ ID NO: 273520 - RNA, 64 nt, Homo Sapiens
gcugcaacccuauggccucuuaggccucugcaaaucaaucaaagcuuuugacggagacagcaaa

SEQ ID NO: 273521 - RNA, 64 nt, Homo Sapiens
uuaccuaaauguuuuguagaguuuugacuaguaaucaaucaaaauuauauaaagucuucuccag

SEQ ID NO: 273522 - RNA, 64 nt, Homo Sapiens
uuaacuuaauucaccucagacuucagccuaagauucaaucaaauucauccuucagccugucuug

SEQ ID NO: 273523 - RNA, 64 nt, Homo Sapiens
uggcuauaauaaagcaggagcaauuauaaaaucuucaaucaauugaacuuuuacaaaaccacuu

SEQ ID NO: 273524 - RNA, 64 nt, Homo Sapiens
ucuucagguaugggauuucugaacguuucaaauuucaaucaaugagcacugucaacacccacag

SEQ ID NO: 273525 - RNA, 64 nt, Homo Sapiens
cacuguuuuuaaaucuagcauuauucauuuugcuucaaucaaaagugguuucaauauuuuuuuu

SEQ ID NO: 273526 - RNA, 64 nt, Homo Sapiens
agcauauacauuucagccaauaaucaaauaauaaucaaucaaucgaauauaucuggauauguac

SEQ ID NO: 273527 - RNA, 64 nt, Homo Sapiens
augagaagcuugaaugggcaaagcucuguacaacucaaucaagauuucuccaaggaucugcuga

SEQ ID NO: 273528 - RNA, 64 nt, Homo Sapiens
uguuugaaaauaauguugcucuggacuagaauuuucaaucaauguaccacuccuauucuguuau

SEQ ID NO: 273529 - RNA, 64 nt, Homo Sapiens
uaaaaauuuuuacuuucacauauacauugagaaaucaaucaaaaaaacuggcauuauacugaac

SEQ ID NO: 273530 - RNA, 64 nt, Homo Sapiens
auugguaaauaauauuuuaacccaguaaaaccauucaaucaauagaaagguuugaaauacguac

SEQ ID NO: 273531 - RNA, 64 nt, Homo Sapiens
cuaaagcuagggggaaauuuucaggcaagaauuaucaaucaaugaccaucacaguaaauauggc

SEQ ID NO: 273532 - RNA, 64 nt, Homo Sapiens
caagccugcauguacagaaugaaauacauuauggucaaucaagcguaucuaaauuuuuuuugcu

SEQ ID NO: 273533 - RNA, 64 nt, Homo Sapiens
cagcuuugauuuuccagaucucaaucguguugcuucaaucaauauugagauccagcagccuuca

SEQ ID NO: 273534 - RNA, 64 nt, Homo Sapiens
uaacucuuagaagaaaccccacaaauaaagcaauucaaucaaggcuguucuauuuaaaucagag

SEQ ID NO: 273535 - RNA, 64 nt, Homo Sapiens
cauuggauuuacuagacgaaaaccauaccucucuucaaucaaaaugaaaacaaagcaaaugaau

SEQ ID NO: 273536 - RNA, 64 nt, Homo Sapiens
uguuuccuuucugcucuuacacagcauuguuuugucaaucaacacagccugcacugaaaggacc

SEQ ID NO: 273537 - RNA, 64 nt, Homo Sapiens
uaguaccggguucaguuuaguucuuaguaucuuuucaaucaagcugugugcuuaauuuacucug

SEQ ID NO: 273538 - RNA, 64 nt, Homo Sapiens
gccuagagcacugacuguuaauucugacaaucaaucaaucaaugcucuuguguagucacuucug

SEQ ID NO: 273539 - RNA, 64 nt, Homo Sapiens
aauggccuagagcacugacuucugauucugacaaucaaucaaucaaugcucuuguguagucacu

SEQ ID NO: 273540 - RNA, 64 nt, Homo Sapiens
aaaauuucuguauauucccuuaccaacucuauacucaaucaagccuaauugugguagaaauuuu

SEQ ID NO: 273541 - RNA, 64 nt, Homo Sapiens
auuuuuugaguguaugcuguuuaaucucacuucaucaaucaaauucagaucauuuaggauacuc

SEQ ID NO: 273542 - RNA, 64 nt, Homo Sapiens
uuguaguuuguaaaaguauucuuuucagagugacucaaucaaauaggucaagggccacauucac

SEQ ID NO: 273543 - RNA, 64 nt, Homo Sapiens
gauauaagaaucaaauauucccaaggaggauuugucaaucaaggaaaacaugacagauggugag

SEQ ID NO: 273544 - RNA, 64 nt, Homo Sapiens
gaggauaauuaauugacacaucugaaauccccaaucaaucaaucaagagaaagguagaacuaaa

SEQ ID NO: 273545 - RNA, 64 nt, Homo Sapiens
auaauuaauugacacaucugaaauccccaaucaaucaaucaagagaaagguagaacuaaaaacu

SEQ ID NO: 273546 - RNA, 64 nt, Homo Sapiens
gcuaccgccccaaaguaaaagaaaccacuucuggucaaucaacacuaccagcguauauauaaga

SEQ ID NO: 273547 - RNA, 64 nt, Homo Sapiens
gaaagcugaacgugcacucugacaaggggagcugucaaucaaacaccaaaccggggagacaaga

SEQ ID NO: 273548 - RNA, 64 nt, Homo Sapiens
uaugcagaacuggcaacuuaccacauugagucuaucaaucaacuugaugagguuucuacuggga

SEQ ID NO: 273549 - RNA, 64 nt, Homo Sapiens
ugggcucuccccaccccaccauucacuagaaucuucaaucaaccucugaacccagugugggggc

SEQ ID NO: 273550 - RNA, 64 nt, Homo Sapiens
cuaacucggagacgucuagccccaauccaguauaucaaucaacuucaguucucauccucuccau

SEQ ID NO: 273551 - RNA, 64 nt, Homo Sapiens
uuuuuaucuuuaaaucugaggauuugguuauaacucaaucaaaaagcuuuauucauacaugagu

SEQ ID NO: 273552 - RNA, 64 nt, Homo Sapiens
auaauuuuaauuuucuuuuguuggguuuuagagaucaaucaagaaauaaugagcaucuaagugg

SEQ ID NO: 273553 - RNA, 64 nt, Homo Sapiens
cuguuuacugcaagguucaauuaaccagaucuagucaaucaagucuauuuucagaugugaacca

SEQ ID NO: 273554 - RNA, 64 nt, Homo Sapiens
ucucuaugccagauaaacacuuucuccuuacucaucaaucaagaauaaaauuuucuacaucaaa

SEQ ID NO: 273555 - RNA, 64 nt, Homo Sapiens
gaacgaaaaagagguagcacuacaaacacaauauucaaucaaaauuucagcauuauugaaauug

SEQ ID NO: 273556 - RNA, 64 nt, Homo Sapiens
augcaauuuuuauuuugguuauauuacaaaaaugucaaucaaauauuaaaaaauaguuaaugug

SEQ ID NO: 273557 - RNA, 64 nt, Homo Sapiens
agcuuucuucccgaaccccaaggagggagauggaucaaucaaacccggcgguccccuccgccag

SEQ ID NO: 273558 - RNA, 64 nt, Homo Sapiens
aguccuacugacugcacauccaaucaacaaguccucaaucaacaucaucuuuucaccccaccuu

SEQ ID NO: 273559 - RNA, 64 nt, Homo Sapiens
aguccucaaucaacaaguccuuuucaccccaccuucaaucaacaagccagaaaccugugucauc

SEQ ID NO: 273560 - RNA, 64 nt, Homo Sapiens
cuauggaaaaauuauuuauaguuugcaacaauccucaaucaagugcaguguaucuuuuuguaaa

SEQ ID NO: 273561 - RNA, 64 nt, Homo Sapiens
ucaccaugcagggcagucacaccuuagccagcguucaaucaagcgauugcccagguggaaagaa

SEQ ID NO: 273562 - RNA, 64 nt, Homo Sapiens
ccaucacuucuuaaaucgguguuaccagugaccuucaaucaacuacuuuguggcugagggguca

SEQ ID NO: 273563 - RNA, 64 nt, Homo Sapiens
gcaguuagggauuuggcauuuuauauauguugauucaaucaaguuuggcaagcaggguguucga

SEQ ID NO: 273564 - RNA, 64 nt, Homo Sapiens
cuugguucuacauauuuuagggaggcaugaggcaucaaucaaauacauuuaaggaguguagggg

SEQ ID NO: 273565 - RNA, 64 nt, Homo Sapiens
cagauuucgugauccuugauuaacuucugaguacucaaucaaucauaauccuuuugcugcuuau

SEQ ID NO: 273566 - RNA, 64 nt, Homo Sapiens
cugacaaaacuguugcugcacacaucuguacucgucaaucaacaaaaccugaugcaaaaaacag

SEQ ID NO: 273567 - RNA, 64 nt, Homo Sapiens
ucuaaaagcauauaagagcuugucaauagagcaaucaaucaaaaagauuuugugauucauaaca

SEQ ID NO: 273568 - RNA, 64 nt, Homo Sapiens
gauuucauacguacccagggagcaugcuguuuugucaaucaauauaaaauauuuaugaggucuc

SEQ ID NO: 273569 - RNA, 64 nt, Homo Sapiens
aaguauuuauaauagcaacuuauuuuuagacucaucaaucaaaucauuauuuauauggggaaua

SEQ ID NO: 273570 - RNA, 64 nt, Homo Sapiens
uucuaggucuccaaaaguacaaagcuuauuagcaucaaucaagaguaacacgaaauugcuguca

SEQ ID NO: 273571 - RNA, 64 nt, Homo Sapiens
cuuuauuucaggccgaaugagaaaccgggcucagucaaucaaugauuccuuaucucagaaaaca

SEQ ID NO: 273572 - RNA, 64 nt, Homo Sapiens
guucaauugauguagacuguuagagcaaguauacucaaucaacuugcugauauuuuaguaguua

SEQ ID NO: 273573 - RNA, 64 nt, Homo Sapiens
aacaucuugcacacaauuugaauuauguagaaugucaaucaaguuuuuguauauuuaaaaguug

SEQ ID NO: 273574 - RNA, 64 nt, Homo Sapiens
uguuccugucucagcaaccaagggauuguuccugucaaucaaugguuuauuggaagguggccca

SEQ ID NO: 273575 - RNA, 64 nt, Homo Sapiens
aaaguaacacccucccuuuuaacuuccuuaaugaucaaucaaaauacuguguuuuuauuccucu

SEQ ID NO: 273576 - RNA, 64 nt, Homo Sapiens
aagagcaccuguguuguacuggugcauuuguuccucaaucaagcagucuauuguuuaaagagaa

SEQ ID NO: 273577 - RNA, 64 nt, Homo Sapiens
auguugaauaagggacauagucucuacaugucaaucaaucaagcaacaaagggcccacucuagu

SEQ ID NO: 273578 - RNA, 64 nt, Homo Sapiens
aagcauguugaauaagggacuaguucucuacaugucaaucaaucucagaacaaagggcccacuc

SEQ ID NO: 273579 - RNA, 64 nt, Homo Sapiens
aauggaggaaucaccgacuugggcaaagucuuaaucaaucaaacgcccuggcaauuaacugaaa

SEQ ID NO: 273580 - RNA, 64 nt, Homo Sapiens
aagaaagauggaaggaagggcaaaaucuugagaaucaaucaauacccccaaagaguuuucugug

SEQ ID NO: 273581 - RNA, 64 nt, Homo Sapiens
ccuguccuagugugugcaguggcaggauuuaaauucaaucaaauccgaggucuccuuggugggu

SEQ ID NO: 273582 - RNA, 64 nt, Homo Sapiens
aaaguuaguucaguagcuuaauacuucauuaauuucaaucaaccauuacaaguauucaguucca

SEQ ID NO: 273583 - RNA, 64 nt, Homo Sapiens
caaacuuuuauaauuuuucuucuuguacauucauucaaucaaggacugauguguugaaccuuau

SEQ ID NO: 273584 - RNA, 64 nt, Homo Sapiens
uugcacauaaaaaauaccgaagaaaacccaaaauucaaucaacaauucugucuuauugaagagu

SEQ ID NO: 273585 - RNA, 64 nt, Homo Sapiens
ugaagcugaugggugccagcccugcauugcugagucaaucaauaaagagcuuucuuuugaccca

SEQ ID NO: 273586 - RNA, 64 nt, Homo Sapiens; identical to SEQ ID NO: 273585

SEQ ID NO: 273587 - RNA, 64 nt, Homo Sapiens
acuguccuggccaguugcagaaccaaucaaucaaucaaucaauccagagugagacucugucuca

SEQ ID NO: 273588 - RNA, 64 nt, Homo Sapiens
aaucacuguccuggccaguucucaaaccaaucaaucaaucaaucacgacagagugagacucugu

SEQ ID NO: 273589 - RNA, 64 nt, Homo Sapiens
aaucaaucacuguccuggcccugucucaaaccaaucaaucaauccuggacgacagagugagacu

SEQ ID NO: 273590 - RNA, 64 nt, Homo Sapiens
aaccucaaaauuuaaacugaacugguacucccaaucaaucaaagacucauccaacucccucuuc

SEQ ID NO: 273591 - RNA, 64 nt, Homo Sapiens
gaacucugggaaggagguugauucuuuaucccacucaaucaaaggaggguuuggcaccauucuc

SEQ ID NO: 273592 - RNA, 64 nt, Homo Sapiens
ugguuuagagguucacugcugcuuugucacuuucucaaucaaauuggccacuuaagaaauaaag

SEQ ID NO: 273593 - RNA, 64 nt, Homo Sapiens
uauguuuuggcgaguagccagucuuucuuuaacaucaaucaaccguagcaauguggucaucacg

SEQ ID NO: 273594 - RNA, 64 nt, Homo Sapiens
agacacaggaaaaauaaacguggauuuuaaaaaaucaaucaauggugcaaaaaaaaacuuaaag

SEQ ID NO: 273595 - RNA, 64 nt, Homo Sapiens
acugugcuaaaugagauuguagaauccccaugacucaaucaaggggguucuaauuccuuguccu

SEQ ID NO: 273596 - RNA, 64 nt, Homo Sapiens
uaacaacuguuaaauaaaauauauuuaaaaguuaucaaucaagcgccucauaccauaugucuaa

SEQ ID NO: 273597 - RNA, 64 nt, Homo Sapiens
cacuaccuuaaaaaaaaaguugcugaaauaaagcucaaucaacaucuuagaaauauuuuuuguu

SEQ ID NO: 273598 - RNA, 64 nt, Homo Sapiens
cugacaggacugcaagagggagaaaggaauuuugucaaucaaaauuauucuguauugcaacuuu

SEQ ID NO: 273599 - RNA, 64 nt, Homo Sapiens
agcugugccgccgcggguccaccgaggacgccaaucaaucaacccaacaccacaagcuugguug

SEQ ID NO: 273600 - RNA, 64 nt, Homo Sapiens
ugauucuagcccauuuuccugauucucuggcuugucaaucaagaguauccuccaaaucucuuga

SEQ ID NO: 273601 - RNA, 64 nt, Homo Sapiens
gguucaaaccagagaauucaugcugcagggaaacucaaucaauguuauugugaaaacugggaau

SEQ ID NO: 273602 - RNA, 64 nt, Homo Sapiens
aaaguaaccuuccuugaaguguaucuauccguaaucaaucaaguugcugcagccuaugcacugg

SEQ ID NO: 273603 - RNA, 64 nt, Homo Sapiens
uuguacuccaucaauauaauacaauuauuauuugucaaucaaauauuaauaaaaucaaagauga

SEQ ID NO: 273604 - RNA, 64 nt, Homo Sapiens
uaugaaaagcaaggauagcuuaauuuucaaaaacucaaucaauguaauucaguauuuuaacaaa

SEQ ID NO: 273605 - RNA, 64 nt, Homo Sapiens
aaauuugcuauuuuaucucaaugugaauucuaccucaaucaaaagaaauggugaauuucguggu

SEQ ID NO: 273606 - RNA, 64 nt, Homo Sapiens
gguggaaucuacaucccucuaguuugacacacuuucaaucaagauggucauauaagagugcagc

SEQ ID NO: 273607 - RNA, 64 nt, Homo Sapiens
ccuacaguucuucuaugauuuauuggagcagcaaucaaucaauggaaggugaguuagaauaaua

SEQ ID NO: 273608 - RNA, 64 nt, Homo Sapiens
uuauauuuuguuuuuuuccuguauuuauguugaaucaaucaauaccaucuagaaauaaaccaua

SEQ ID NO: 273609 - RNA, 64 nt, Homo Sapiens
caauguaaauucugcuaaaaguuugaaaagagacucaaucaaggcucagauggguaagacauga

SEQ ID NO: 273610 - RNA, 64 nt, Homo Sapiens
ucauaccuauuaaagcuguucauuguaacaaaauucaaucaaaaaggcagcuaggucagaagga

SEQ ID NO: 273611 - RNA, 64 nt, Homo Sapiens
gaauugacuuauacucuugagaaugaauucaguuucaaucaaguuuacauuauguugcuuaaaa

SEQ ID NO: 273612 - RNA, 64 nt, Homo Sapiens
uauuuuugaaccuuuuaaguguaagaaaaauaacucaaucaauaaaucaauauaauuuauuuau

SEQ ID NO: 273613 - RNA, 64 nt, Homo Sapiens
guuagugugauacugccaaacuaaaguucugacuucaaucaacgggucuaaggauuagaaaacu

SEQ ID NO: 273614 - RNA, 64 nt, Homo Sapiens
gaacaauuaaauaaacaccugugaacuuaaaaauucaaucaaaucaucucauccacguaguaaa

SEQ ID NO: 273615 - RNA, 64 nt, Homo Sapiens
acuuuuguguauagaaaauauuaaaacacaaauuucaaucaaauucuuagcaaugaaauugcug

SEQ ID NO: 273616 - RNA, 64 nt, Homo Sapiens
cuaccuuuuuuuuacggaauacaauucaaacaauucaaucaaagacuggacagcgguuguaaau

SEQ ID NO: 273617 - RNA, 64 nt, Homo Sapiens
uguauccugacagcgccaugugugucagcccaugucaaucaagaugggugauuaugaaaugcca

SEQ ID NO: 273618 - RNA, 64 nt, Homo Sapiens
ccucucuucuacccagugcccugugugcugacccucaaucaagauggcaccgugugggugacag

SEQ ID NO: 273619 - RNA, 64 nt, Homo Sapiens
uuguagguugaaacugaaaaauaaguuaaaaugaucaaucaagauaaaaggugaucuauccauc

SEQ ID NO: 273620 - RNA, 64 nt, Homo Sapiens
aaccuacucaacacagcacucuaggcagccacuaucaaucaauugaaguugacacucugcauua

SEQ ID NO: 273621 - RNA, 64 nt, Homo Sapiens
uucaagcugaaugacuuauaugagaauaauacguucaaucaaaguaguuauucuauuuuguguc

SEQ ID NO: 273622 - RNA, 64 nt, Homo Sapiens
guuuuuagcauucuaaauuuaaaugcuuaaaacgucaaucaacaaaacuuuguuuuaaauauug

SEQ ID NO: 273623 - RNA, 64 nt, Homo Sapiens
cuauccagccacucugaccagccgaaccaggaacucaaucaaaaugcgccacagcaggaccaca

SEQ ID NO: 273624 - RNA, 64 nt, Homo Sapiens
cuauccagccacucugaccagccgaacgaggaacucaaucaaaaugagccauagcgggaccaca

SEQ ID NO: 273625 - RNA, 64 nt, Homo Sapiens
aaugcugcuuuuaaaaccuucuacacauuuauuuucaaucaauaauuccauacugagagccuau

SEQ ID NO: 273626 - RNA, 64 nt, Homo Sapiens
uguauguuugcuauguucuacgcagugggcugauucaaucaagaauucaaucaagauccgugcu

SEQ ID NO: 273627 - RNA, 64 nt, Homo Sapiens
uccgugcucgcagugggcugaccaauaggcugauucaaucaagaguauguagaccuaaaacuac

SEQ ID NO: 273628 - RNA, 64 nt, Homo Sapiens
uguauguagaccuaaaacuaaccaguagguugauucaaucaagacugauagaccaaaaaacuac

SEQ ID NO: 273629 - RNA, 64 nt, Homo Sapiens
ucccuuaaauuuguauggcaaccaucacaaucaaucaaucaaauguuauacccggggcacucua

SEQ ID NO: 273630 - RNA, 64 nt, Homo Sapiens
aaauucccuuaaauuuguauucuaaccaucacaaucaaucaauccacuguuauacccggggcac

SEQ ID NO: 273631 - RNA, 64 nt, Homo Sapiens
uucaaacugaaugacuuauaugagaauaauauguucaaucaaaguaguuauucuauuuuguguc

SEQ ID NO: 273632 - RNA, 62 nt, Homo Sapiens; identical to SEQ ID NO: 273115

SEQ ID NO: 273633 - RNA, 62 nt, Homo Sapiens; identical to SEQ ID NO: 273116

SEQ ID NO: 273634 - RNA, 62 nt, Homo Sapiens; identical to SEQ ID NO: 273117

SEQ ID NO: 273635 - RNA, 62 nt, Homo Sapiens; identical to SEQ ID NO: 273118

SEQ ID NO: 273636 - RNA, 62 nt, Homo Sapiens; identical to SEQ ID NO: 273119

SEQ ID NO: 273637 - RNA, 62 nt, Homo Sapiens; identical to SEQ ID NO: 273120

SEQ ID NO: 273638 - RNA, 62 nt, Homo Sapiens; identical to SEQ ID NO: 273121

SEQ ID NO: 273639 - RNA, 62 nt, Homo Sapiens; identical to SEQ ID NO: 273122

SEQ ID NO: 273640 - RNA, 62 nt, Homo Sapiens; identical to SEQ ID NO: 273123

SEQ ID NO: 273641 - RNA, 60 nt, Homo Sapiens; identical to SEQ ID NO: 273124

SEQ ID NO: 273642 - RNA, 62 nt, Homo Sapiens; identical to SEQ ID NO: 273125

SEQ ID NO: 273643 - RNA, 62 nt, Homo Sapiens; identical to SEQ ID NO: 273126

SEQ ID NO: 273644 - RNA, 62 nt, Homo Sapiens; identical to SEQ ID NO: 273127

SEQ ID NO: 273645 - RNA, 62 nt, Homo Sapiens; identical to SEQ ID NO: 273128

SEQ ID NO: 273646 - RNA, 62 nt, Homo Sapiens; identical to SEQ ID NO: 273129

SEQ ID NO: 273647 - RNA, 62 nt, Homo Sapiens; identical to SEQ ID NO: 273130

SEQ ID NO: 273648 - RNA, 62 nt, Homo Sapiens; identical to SEQ ID NO: 273131

SEQ ID NO: 273649 - RNA, 62 nt, Homo Sapiens; identical to SEQ ID NO: 273132

SEQ ID NO: 273650 - RNA, 62 nt, Homo Sapiens; identical to SEQ ID NO: 273133

SEQ ID NO: 273651 - RNA, 62 nt, Homo Sapiens; identical to SEQ ID NO: 273134

SEQ ID NO: 273652 - RNA, 62 nt, Homo Sapiens; identical to SEQ ID NO: 273135

SEQ ID NO: 273653 - RNA, 62 nt, Homo Sapiens; identical to SEQ ID NO: 273136

SEQ ID NO: 273654 - RNA, 62 nt, Homo Sapiens; identical to SEQ ID NO: 273137

SEQ ID NO: 273655 - RNA, 62 nt, Homo Sapiens; identical to SEQ ID NO: 273138

SEQ ID NO: 273656 - RNA, 62 nt, Homo Sapiens; identical to SEQ ID NO: 273139

SEQ ID NO: 273657 - RNA, 62 nt, Homo Sapiens; identical to SEQ ID NO: 273140

SEQ ID NO: 273658 - RNA, 62 nt, Homo Sapiens; identical to SEQ ID NO: 273141

SEQ ID NO: 273659 - RNA, 62 nt, Homo Sapiens; identical to SEQ ID NO: 273142

SEQ ID NO: 273660 - RNA, 62 nt, Homo Sapiens; identical to SEQ ID NO: 273143

SEQ ID NO: 273661 - RNA, 62 nt, Homo Sapiens; identical to SEQ ID NO: 273144

SEQ ID NO: 273662 - RNA, 62 nt, Homo Sapiens; identical to SEQ ID NO: 273145

SEQ ID NO: 273663 - RNA, 62 nt, Homo Sapiens; identical to SEQ ID NO: 273146

SEQ ID NO: 273664 - RNA, 62 nt, Homo Sapiens; identical to SEQ ID NO: 273147

SEQ ID NO: 273665 - RNA, 62 nt, Homo Sapiens; identical to SEQ ID NO: 273148

SEQ ID NO: 273666 - RNA, 62 nt, Homo Sapiens; identical to SEQ ID NO: 273149

SEQ ID NO: 273667 - RNA, 62 nt, Homo Sapiens; identical to SEQ ID NO: 273150

SEQ ID NO: 273668 - RNA, 62 nt, Homo Sapiens; identical to SEQ ID NO: 273151

SEQ ID NO: 273669 - RNA, 62 nt, Homo Sapiens; identical to SEQ ID NO: 273152

SEQ ID NO: 273670 - RNA, 62 nt, Homo Sapiens; identical to SEQ ID NO: 273153

SEQ ID NO: 273671 - RNA, 62 nt, Homo Sapiens; identical to SEQ ID NO: 273154

SEQ ID NO: 273672 - RNA, 62 nt, Homo Sapiens; identical to SEQ ID NO: 273155

SEQ ID NO: 273673 - RNA, 62 nt, Homo Sapiens; identical to SEQ ID NO: 273156

SEQ ID NO: 273674 - RNA, 62 nt, Homo Sapiens; identical to SEQ ID NO: 273157

SEQ ID NO: 273675 - RNA, 62 nt, Homo Sapiens; identical to SEQ ID NO: 273158

SEQ ID NO: 273676 - RNA, 62 nt, Homo Sapiens; identical to SEQ ID NO: 273159

SEQ ID NO: 273677 - RNA, 62 nt, Homo Sapiens; identical to SEQ ID NO: 273160

SEQ ID NO: 273678 - RNA, 62 nt, Homo Sapiens; identical to SEQ ID NO: 273161

SEQ ID NO: 273679 - RNA, 62 nt, Homo Sapiens; identical to SEQ ID NO: 273162

SEQ ID NO: 273680 - RNA, 62 nt, Homo Sapiens; identical to SEQ ID NO: 273163

SEQ ID NO: 273681 - RNA, 62 nt, Homo Sapiens; identical to SEQ ID NO: 273164

SEQ ID NO: 273682 - RNA, 62 nt, Homo Sapiens; identical to SEQ ID NO: 273165

SEQ ID NO: 273683 - RNA, 62 nt, Homo Sapiens; identical to SEQ ID NO: 273166

SEQ ID NO: 273684 - RNA, 62 nt, Homo Sapiens; identical to SEQ ID NO: 273167

SEQ ID NO: 273685 - RNA, 62 nt, Homo Sapiens; identical to SEQ ID NO: 273168

SEQ ID NO: 273686 - RNA, 62 nt, Homo Sapiens; identical to SEQ ID NO: 273169

SEQ ID NO: 273687 - RNA, 62 nt, Homo Sapiens; identical to SEQ ID NO: 273170

SEQ ID NO: 273688 - RNA, 62 nt, Homo Sapiens; identical to SEQ ID NO: 273171

SEQ ID NO: 273689 - RNA, 62 nt, Homo Sapiens; identical to SEQ ID NO: 273172

SEQ ID NO: 273690 - RNA, 62 nt, Homo Sapiens; identical to SEQ ID NO: 273173

SEQ ID NO: 273691 - RNA, 62 nt, Homo Sapiens; identical to SEQ ID NO: 273174

SEQ ID NO: 273692 - RNA, 62 nt, Homo Sapiens; identical to SEQ ID NO: 273175

SEQ ID NO: 273693 - RNA, 62 nt, Homo Sapiens; identical to SEQ ID NO: 273176

SEQ ID NO: 273694 - RNA, 62 nt, Homo Sapiens; identical to SEQ ID NO: 273177

SEQ ID NO: 273695 - RNA, 62 nt, Homo Sapiens; identical to SEQ ID NO: 273178

SEQ ID NO: 273696 - RNA, 62 nt, Homo Sapiens; identical to SEQ ID NO: 273179

SEQ ID NO: 273697 - RNA, 62 nt, Homo Sapiens; identical to SEQ ID NO: 273180

SEQ ID NO: 273698 - RNA, 62 nt, Homo Sapiens; identical to SEQ ID NO: 273181

SEQ ID NO: 273699 - RNA, 62 nt, Homo Sapiens; identical to SEQ ID NO: 273182

SEQ ID NO: 273700 - RNA, 62 nt, Homo Sapiens; identical to SEQ ID NO: 273183

SEQ ID NO: 273701 - RNA, 62 nt, Homo Sapiens; identical to SEQ ID NO: 273184

SEQ ID NO: 273702 - RNA, 62 nt, Homo Sapiens; identical to SEQ ID NO: 273185

SEQ ID NO: 273703 - RNA, 62 nt, Homo Sapiens; identical to SEQ ID NO: 273186

SEQ ID NO: 273704 - RNA, 62 nt, Homo Sapiens; identical to SEQ ID NO: 273187

SEQ ID NO: 273705 - RNA, 62 nt, Homo Sapiens; identical to SEQ ID NO: 273188

SEQ ID NO: 273706 - RNA, 60 nt, Homo Sapiens; identical to SEQ ID NO: 273189

SEQ ID NO: 273707 - RNA, 62 nt, Homo Sapiens; identical to SEQ ID NO: 273190

SEQ ID NO: 273708 - RNA, 62 nt, Homo Sapiens; identical to SEQ ID NO: 273191

SEQ ID NO: 273709 - RNA, 62 nt, Homo Sapiens; identical to SEQ ID NO: 273192

SEQ ID NO: 273710 - RNA, 62 nt, Homo Sapiens; identical to SEQ ID NO: 273193

SEQ ID NO: 273711 - RNA, 62 nt, Homo Sapiens; identical to SEQ ID NO: 273194

SEQ ID NO: 273712 - RNA, 62 nt, Homo Sapiens; identical to SEQ ID NO: 273195

SEQ ID NO: 273713 - RNA, 62 nt, Homo Sapiens; identical to SEQ ID NO: 273196

SEQ ID NO: 273714 - RNA, 62 nt, Homo Sapiens; identical to SEQ ID NO: 273197

SEQ ID NO: 273715 - RNA, 62 nt, Homo Sapiens; identical to SEQ ID NO: 273198

SEQ ID NO: 273716 - RNA, 62 nt, Homo Sapiens; identical to SEQ ID NO: 273199

SEQ ID NO: 273717 - RNA, 62 nt, Homo Sapiens; identical to SEQ ID NO: 273200

SEQ ID NO: 273718 - RNA, 62 nt, Homo Sapiens; identical to SEQ ID NO: 273201

SEQ ID NO: 273719 - RNA, 62 nt, Homo Sapiens; identical to SEQ ID NO: 273202

SEQ ID NO: 273720 - RNA, 62 nt, Homo Sapiens; identical to SEQ ID NO: 273203

SEQ ID NO: 273721 - RNA, 62 nt, Homo Sapiens; identical to SEQ ID NO: 273204

SEQ ID NO: 273722 - RNA, 62 nt, Homo Sapiens; identical to SEQ ID NO: 273205

SEQ ID NO: 273723 - RNA, 62 nt, Homo Sapiens; identical to SEQ ID NO: 273206

SEQ ID NO: 273724 - RNA, 62 nt, Homo Sapiens; identical to SEQ ID NO: 273207

SEQ ID NO: 273725 - RNA, 62 nt, Homo Sapiens; identical to SEQ ID NO: 273208

SEQ ID NO: 273726 - RNA, 62 nt, Homo Sapiens; identical to SEQ ID NO: 273209

SEQ ID NO: 273727 - RNA, 62 nt, Homo Sapiens; identical to SEQ ID NO: 273210

SEQ ID NO: 273728 - RNA, 62 nt, Homo Sapiens; identical to SEQ ID NO: 273211

SEQ ID NO: 273729 - RNA, 62 nt, Homo Sapiens; identical to SEQ ID NO: 273212

SEQ ID NO: 273730 - RNA, 62 nt, Homo Sapiens; identical to SEQ ID NO: 273213

SEQ ID NO: 273731 - RNA, 62 nt, Homo Sapiens; identical to SEQ ID NO: 273214

SEQ ID NO: 273732 - RNA, 62 nt, Homo Sapiens; identical to SEQ ID NO: 273215

SEQ ID NO: 273733 - RNA, 62 nt, Homo Sapiens; identical to SEQ ID NO: 273216

SEQ ID NO: 273734 - RNA, 62 nt, Homo Sapiens; identical to SEQ ID NO: 273217

SEQ ID NO: 273735 - RNA, 62 nt, Homo Sapiens; identical to SEQ ID NO: 273218

SEQ ID NO: 273736 - RNA, 62 nt, Homo Sapiens; identical to SEQ ID NO: 273219

SEQ ID NO: 273737 - RNA, 62 nt, Homo Sapiens; identical to SEQ ID NO: 273220

SEQ ID NO: 273738 - RNA, 62 nt, Homo Sapiens; identical to SEQ ID NO: 273221

SEQ ID NO: 273739 - RNA, 62 nt, Homo Sapiens; identical to SEQ ID NO: 273222

SEQ ID NO: 273740 - RNA, 62 nt, Homo Sapiens; identical to SEQ ID NO: 273223

SEQ ID NO: 273741 - RNA, 62 nt, Homo Sapiens; identical to SEQ ID NO: 273224

SEQ ID NO: 273742 - RNA, 62 nt, Homo Sapiens; identical to SEQ ID NO: 273225

SEQ ID NO: 273743 - RNA, 62 nt, Homo Sapiens; identical to SEQ ID NO: 273226

SEQ ID NO: 273744 - RNA, 62 nt, Homo Sapiens; identical to SEQ ID NO: 273227

SEQ ID NO: 273745 - RNA, 62 nt, Homo Sapiens; identical to SEQ ID NO: 273228

SEQ ID NO: 273746 - RNA, 62 nt, Homo Sapiens; identical to SEQ ID NO: 273229

SEQ ID NO: 273747 - RNA, 62 nt, Homo Sapiens; identical to SEQ ID NO: 273230

SEQ ID NO: 273748 - RNA, 62 nt, Homo Sapiens; identical to SEQ ID NO: 273231

SEQ ID NO: 273749 - RNA, 62 nt, Homo Sapiens; identical to SEQ ID NO: 273232

SEQ ID NO: 273750 - RNA, 62 nt, Homo Sapiens; identical to SEQ ID NO: 273233

SEQ ID NO: 273751 - RNA, 62 nt, Homo Sapiens; identical to SEQ ID NO: 273234

SEQ ID NO: 273752 - RNA, 62 nt, Homo Sapiens; identical to SEQ ID NO: 273235

SEQ ID NO: 273753 - RNA, 62 nt, Homo Sapiens; identical to SEQ ID NO: 273236

SEQ ID NO: 273754 - RNA, 62 nt, Homo Sapiens; identical to SEQ ID NO: 273237

SEQ ID NO: 273755 - RNA, 62 nt, Homo Sapiens; identical to SEQ ID NO: 273238

SEQ ID NO: 273756 - RNA, 62 nt, Homo Sapiens; identical to SEQ ID NO: 273239

SEQ ID NO: 273757 - RNA, 62 nt, Homo Sapiens; identical to SEQ ID NO: 273240

SEQ ID NO: 273758 - RNA, 62 nt, Homo Sapiens; identical to SEQ ID NO: 273241

SEQ ID NO: 273759 - RNA, 62 nt, Homo Sapiens; identical to SEQ ID NO: 273242

SEQ ID NO: 273760 - RNA, 62 nt, Homo Sapiens; identical to SEQ ID NO: 273243

SEQ ID NO: 273761 - RNA, 62 nt, Homo Sapiens; identical to SEQ ID NO: 273244

SEQ ID NO: 273762 - RNA, 62 nt, Homo Sapiens; identical to SEQ ID NO: 273245

SEQ ID NO: 273763 - RNA, 62 nt, Homo Sapiens; identical to SEQ ID NO: 273246

SEQ ID NO: 273764 - RNA, 62 nt, Homo Sapiens; identical to SEQ ID NO: 273247

SEQ ID NO: 273765 - RNA, 62 nt, Homo Sapiens; identical to SEQ ID NO: 273248

SEQ ID NO: 273766 - RNA, 62 nt, Homo Sapiens; identical to SEQ ID NO: 273249

SEQ ID NO: 273767 - RNA, 62 nt, Homo Sapiens; identical to SEQ ID NO: 273250

SEQ ID NO: 273768 - RNA, 62 nt, Homo Sapiens; identical to SEQ ID NO: 273251

SEQ ID NO: 273769 - RNA, 62 nt, Homo Sapiens; identical to SEQ ID NO: 273252

SEQ ID NO: 273770 - RNA, 62 nt, Homo Sapiens; identical to SEQ ID NO: 273253

SEQ ID NO: 273771 - RNA, 62 nt, Homo Sapiens; identical to SEQ ID NO: 273254

SEQ ID NO: 273772 - RNA, 62 nt, Homo Sapiens; identical to SEQ ID NO: 273255

SEQ ID NO: 273773 - RNA, 62 nt, Homo Sapiens; identical to SEQ ID NO: 273256

SEQ ID NO: 273774 - RNA, 62 nt, Homo Sapiens; identical to SEQ ID NO: 273257

SEQ ID NO: 273775 - RNA, 62 nt, Homo Sapiens; identical to SEQ ID NO: 273258

SEQ ID NO: 273776 - RNA, 62 nt, Homo Sapiens; identical to SEQ ID NO: 273259

SEQ ID NO: 273777 - RNA, 62 nt, Homo Sapiens; identical to SEQ ID NO: 273260

SEQ ID NO: 273778 - RNA, 62 nt, Homo Sapiens; identical to SEQ ID NO: 273261

SEQ ID NO: 273779 - RNA, 62 nt, Homo Sapiens; identical to SEQ ID NO: 273262

SEQ ID NO: 273780 - RNA, 62 nt, Homo Sapiens; identical to SEQ ID NO: 273263

SEQ ID NO: 273781 - RNA, 62 nt, Homo Sapiens; identical to SEQ ID NO: 273264

SEQ ID NO: 273782 - RNA, 62 nt, Homo Sapiens; identical to SEQ ID NO: 273265

SEQ ID NO: 273783 - RNA, 62 nt, Homo Sapiens; identical to SEQ ID NO: 273266

SEQ ID NO: 273784 - RNA, 62 nt, Homo Sapiens; identical to SEQ ID NO: 273267

SEQ ID NO: 273785 - RNA, 62 nt, Homo Sapiens; identical to SEQ ID NO: 273268

SEQ ID NO: 273786 - RNA, 62 nt, Homo Sapiens; identical to SEQ ID NO: 273269

SEQ ID NO: 273787 - RNA, 62 nt, Homo Sapiens; identical to SEQ ID NO: 273270

SEQ ID NO: 273788 - RNA, 62 nt, Homo Sapiens; identical to SEQ ID NO: 273271

SEQ ID NO: 273789 - RNA, 62 nt, Homo Sapiens; identical to SEQ ID NO: 273272

SEQ ID NO: 273790 - RNA, 62 nt, Homo Sapiens; identical to SEQ ID NO: 273273

SEQ ID NO: 273791 - RNA, 62 nt, Homo Sapiens; identical to SEQ ID NO: 273274

SEQ ID NO: 273792 - RNA, 62 nt, Homo Sapiens; identical to SEQ ID NO: 273275

SEQ ID NO: 273793 - RNA, 62 nt, Homo Sapiens; identical to SEQ ID NO: 273276

SEQ ID NO: 273794 - RNA, 62 nt, Homo Sapiens; identical to SEQ ID NO: 273277

SEQ ID NO: 273795 - RNA, 62 nt, Homo Sapiens; identical to SEQ ID NO: 273278

SEQ ID NO: 273796 - RNA, 62 nt, Homo Sapiens; identical to SEQ ID NO: 273279

SEQ ID NO: 273797 - RNA, 62 nt, Homo Sapiens; identical to SEQ ID NO: 273280

SEQ ID NO: 273798 - RNA, 62 nt, Homo Sapiens; identical to SEQ ID NO: 273281

SEQ ID NO: 273799 - RNA, 62 nt, Homo Sapiens; identical to SEQ ID NO: 273282

SEQ ID NO: 273800 - RNA, 62 nt, Homo Sapiens; identical to SEQ ID NO: 273283

SEQ ID NO: 273801 - RNA, 51 nt, Homo Sapiens; identical to SEQ ID NO: 273284

SEQ ID NO: 273802 - RNA, 62 nt, Homo Sapiens; identical to SEQ ID NO: 273285

SEQ ID NO: 273803 - RNA, 62 nt, Homo Sapiens; identical to SEQ ID NO: 273286

SEQ ID NO: 273804 - RNA, 62 nt, Homo Sapiens; identical to SEQ ID NO: 273287

SEQ ID NO: 273805 - RNA, 62 nt, Homo Sapiens; identical to SEQ ID NO: 273288

SEQ ID NO: 273806 - RNA, 62 nt, Homo Sapiens; identical to SEQ ID NO: 273289

SEQ ID NO: 273807 - RNA, 62 nt, Homo Sapiens; identical to SEQ ID NO: 273290

SEQ ID NO: 273808 - RNA, 62 nt, Homo Sapiens; identical to SEQ ID NO: 273291

SEQ ID NO: 273809 - RNA, 62 nt, Homo Sapiens; identical to SEQ ID NO: 273292

SEQ ID NO: 273810 - RNA, 62 nt, Homo Sapiens; identical to SEQ ID NO: 273293

SEQ ID NO: 273811 - RNA, 62 nt, Homo Sapiens; identical to SEQ ID NO: 273294

SEQ ID NO: 273812 - RNA, 62 nt, Homo Sapiens; identical to SEQ ID NO: 273295

SEQ ID NO: 273813 - RNA, 62 nt, Homo Sapiens; identical to SEQ ID NO: 273296

SEQ ID NO: 273814 - RNA, 62 nt, Homo Sapiens; identical to SEQ ID NO: 273297

SEQ ID NO: 273815 - RNA, 62 nt, Homo Sapiens; identical to SEQ ID NO: 273298

SEQ ID NO: 273816 - RNA, 62 nt, Homo Sapiens; identical to SEQ ID NO: 273299

SEQ ID NO: 273817 - RNA, 62 nt, Homo Sapiens; identical to SEQ ID NO: 273300

SEQ ID NO: 273818 - RNA, 62 nt, Homo Sapiens; identical to SEQ ID NO: 273301

SEQ ID NO: 273819 - RNA, 62 nt, Homo Sapiens; identical to SEQ ID NO: 273302

SEQ ID NO: 273820 - RNA, 62 nt, Homo Sapiens; identical to SEQ ID NO: 273303

SEQ ID NO: 273821 - RNA, 62 nt, Homo Sapiens; identical to SEQ ID NO: 273304

SEQ ID NO: 273822 - RNA, 62 nt, Homo Sapiens; identical to SEQ ID NO: 273305

SEQ ID NO: 273823 - RNA, 62 nt, Homo Sapiens; identical to SEQ ID NO: 273306

SEQ ID NO: 273824 - RNA, 62 nt, Homo Sapiens; identical to SEQ ID NO: 273307

SEQ ID NO: 273825 - RNA, 62 nt, Homo Sapiens; identical to SEQ ID NO: 273308

SEQ ID NO: 273826 - RNA, 62 nt, Homo Sapiens; identical to SEQ ID NO: 273309

SEQ ID NO: 273827 - RNA, 64 nt, Homo Sapiens; identical to SEQ ID NO: 273310

SEQ ID NO: 273828 - RNA, 64 nt, Homo Sapiens; identical to SEQ ID NO: 273311

SEQ ID NO: 273829 - RNA, 64 nt, Homo Sapiens; identical to SEQ ID NO: 273312

SEQ ID NO: 273830 - RNA, 64 nt, Homo Sapiens; identical to SEQ ID NO: 273313

SEQ ID NO: 273831 - RNA, 64 nt, Homo Sapiens; identical to SEQ ID NO: 273314

SEQ ID NO: 273832 - RNA, 64 nt, Homo Sapiens; identical to SEQ ID NO: 273315

SEQ ID NO: 273833 - RNA, 64 nt, Homo Sapiens; identical to SEQ ID NO: 273316

SEQ ID NO: 273834 - RNA, 64 nt, Homo Sapiens; identical to SEQ ID NO: 273317

SEQ ID NO: 273835 - RNA, 64 nt, Homo Sapiens; identical to SEQ ID NO: 273318

SEQ ID NO: 273836 - RNA, 64 nt, Homo Sapiens; identical to SEQ ID NO: 273319

SEQ ID NO: 273837 - RNA, 64 nt, Homo Sapiens; identical to SEQ ID NO: 189841

SEQ ID NO: 273838 - RNA, 64 nt, Homo Sapiens; identical to SEQ ID NO: 189842

SEQ ID NO: 273839 - RNA, 64 nt, Homo Sapiens; identical to SEQ ID NO: 273322

SEQ ID NO: 273840 - RNA, 64 nt, Homo Sapiens; identical to SEQ ID NO: 273323

SEQ ID NO: 273841 - RNA, 64 nt, Homo Sapiens; identical to SEQ ID NO: 273324

SEQ ID NO: 273842 - RNA, 64 nt, Homo Sapiens; identical to SEQ ID NO: 273325

SEQ ID NO: 273843 - RNA, 64 nt, Homo Sapiens; identical to SEQ ID NO: 273326

SEQ ID NO: 273844 - RNA, 64 nt, Homo Sapiens; identical to SEQ ID NO: 273327

SEQ ID NO: 273845 - RNA, 64 nt, Homo Sapiens; identical to SEQ ID NO: 273328

SEQ ID NO: 273846 - RNA, 64 nt, Homo Sapiens; identical to SEQ ID NO: 273329

SEQ ID NO: 273847 - RNA, 64 nt, Homo Sapiens; identical to SEQ ID NO: 273330

SEQ ID NO: 273848 - RNA, 64 nt, Homo Sapiens; identical to SEQ ID NO: 273331

SEQ ID NO: 273849 - RNA, 64 nt, Homo Sapiens; identical to SEQ ID NO: 273332

SEQ ID NO: 273850 - RNA, 64 nt, Homo Sapiens; identical to SEQ ID NO: 273333

SEQ ID NO: 273851 - RNA, 64 nt, Homo Sapiens; identical to SEQ ID NO: 273334

SEQ ID NO: 273852 - RNA, 64 nt, Homo Sapiens; identical to SEQ ID NO: 273335

SEQ ID NO: 273853 - RNA, 64 nt, Homo Sapiens; identical to SEQ ID NO: 273336

SEQ ID NO: 273854 - RNA, 64 nt, Homo Sapiens; identical to SEQ ID NO: 273337

SEQ ID NO: 273855 - RNA, 64 nt, Homo Sapiens; identical to SEQ ID NO: 273338

SEQ ID NO: 273856 - RNA, 64 nt, Homo Sapiens; identical to SEQ ID NO: 273339

SEQ ID NO: 273857 - RNA, 64 nt, Homo Sapiens; identical to SEQ ID NO: 273340

SEQ ID NO: 273858 - RNA, 64 nt, Homo Sapiens; identical to SEQ ID NO: 273341

SEQ ID NO: 273859 - RNA, 64 nt, Homo Sapiens; identical to SEQ ID NO: 273342

SEQ ID NO: 273860 - RNA, 64 nt, Homo Sapiens; identical to SEQ ID NO: 273343

SEQ ID NO: 273861 - RNA, 64 nt, Homo Sapiens; identical to SEQ ID NO: 273344

SEQ ID NO: 273862 - RNA, 64 nt, Homo Sapiens; identical to SEQ ID NO: 273345

SEQ ID NO: 273863 - RNA, 64 nt, Homo Sapiens; identical to SEQ ID NO: 273346

SEQ ID NO: 273864 - RNA, 64 nt, Homo Sapiens; identical to SEQ ID NO: 273347

SEQ ID NO: 273865 - RNA, 64 nt, Homo Sapiens; identical to SEQ ID NO: 273348

SEQ ID NO: 273866 - RNA, 64 nt, Homo Sapiens; identical to SEQ ID NO: 273349

SEQ ID NO: 273867 - RNA, 64 nt, Homo Sapiens; identical to SEQ ID NO: 273350

SEQ ID NO: 273868 - RNA, 64 nt, Homo Sapiens; identical to SEQ ID NO: 273351

SEQ ID NO: 273869 - RNA, 64 nt, Homo Sapiens; identical to SEQ ID NO: 273352

SEQ ID NO: 273870 - RNA, 64 nt, Homo Sapiens; identical to SEQ ID NO: 273353

SEQ ID NO: 273871 - RNA, 64 nt, Homo Sapiens; identical to SEQ ID NO: 273354

SEQ ID NO: 273872 - RNA, 64 nt, Homo Sapiens; identical to SEQ ID NO: 273355

SEQ ID NO: 273873 - RNA, 64 nt, Homo Sapiens; identical to SEQ ID NO: 273356

SEQ ID NO: 273874 - RNA, 64 nt, Homo Sapiens; identical to SEQ ID NO: 273357

SEQ ID NO: 273875 - RNA, 64 nt, Homo Sapiens; identical to SEQ ID NO: 273358

SEQ ID NO: 273876 - RNA, 64 nt, Homo Sapiens; identical to SEQ ID NO: 273359

SEQ ID NO: 273877 - RNA, 64 nt, Homo Sapiens; identical to SEQ ID NO: 273360

SEQ ID NO: 273878 - RNA, 64 nt, Homo Sapiens; identical to SEQ ID NO: 273361

SEQ ID NO: 273879 - RNA, 64 nt, Homo Sapiens; identical to SEQ ID NO: 273362

SEQ ID NO: 273880 - RNA, 64 nt, Homo Sapiens; identical to SEQ ID NO: 273363

SEQ ID NO: 273881 - RNA, 64 nt, Homo Sapiens; identical to SEQ ID NO: 273364

SEQ ID NO: 273882 - RNA, 64 nt, Homo Sapiens; identical to SEQ ID NO: 273365

SEQ ID NO: 273883 - RNA, 64 nt, Homo Sapiens; identical to SEQ ID NO: 273366

SEQ ID NO: 273884 - RNA, 64 nt, Homo Sapiens; identical to SEQ ID NO: 273367

SEQ ID NO: 273885 - RNA, 64 nt, Homo Sapiens; identical to SEQ ID NO: 273368

SEQ ID NO: 273886 - RNA, 64 nt, Homo Sapiens; identical to SEQ ID NO: 273369

SEQ ID NO: 273887 - RNA, 64 nt, Homo Sapiens; identical to SEQ ID NO: 273370

SEQ ID NO: 273888 - RNA, 59 nt, Homo Sapiens; identical to SEQ ID NO: 273371

SEQ ID NO: 273889 - RNA, 64 nt, Homo Sapiens; identical to SEQ ID NO: 273372

SEQ ID NO: 273890 - RNA, 64 nt, Homo Sapiens; identical to SEQ ID NO: 273373

SEQ ID NO: 273891 - RNA, 64 nt, Homo Sapiens; identical to SEQ ID NO: 273374

SEQ ID NO: 273892 - RNA, 64 nt, Homo Sapiens; identical to SEQ ID NO: 273375

SEQ ID NO: 273893 - RNA, 64 nt, Homo Sapiens; identical to SEQ ID NO: 273376

SEQ ID NO: 273894 - RNA, 64 nt, Homo Sapiens; identical to SEQ ID NO: 273377

SEQ ID NO: 273895 - RNA, 64 nt, Homo Sapiens; identical to SEQ ID NO: 273378

SEQ ID NO: 273896 - RNA, 64 nt, Homo Sapiens; identical to SEQ ID NO: 273379

SEQ ID NO: 273897 - RNA, 64 nt, Homo Sapiens; identical to SEQ ID NO: 273380

SEQ ID NO: 273898 - RNA, 64 nt, Homo Sapiens; identical to SEQ ID NO: 273381

SEQ ID NO: 273899 - RNA, 64 nt, Homo Sapiens; identical to SEQ ID NO: 273382

SEQ ID NO: 273900 - RNA, 64 nt, Homo Sapiens; identical to SEQ ID NO: 273383

SEQ ID NO: 273901 - RNA, 52 nt, Homo Sapiens; identical to SEQ ID NO: 273384

SEQ ID NO: 273902 - RNA, 64 nt, Homo Sapiens; identical to SEQ ID NO: 273385

SEQ ID NO: 273903 - RNA, 64 nt, Homo Sapiens; identical to SEQ ID NO: 273386

SEQ ID NO: 273904 - RNA, 64 nt, Homo Sapiens; identical to SEQ ID NO: 273387

SEQ ID NO: 273905 - RNA, 64 nt, Homo Sapiens; identical to SEQ ID NO: 273388

SEQ ID NO: 273906 - RNA, 64 nt, Homo Sapiens; identical to SEQ ID NO: 273389

SEQ ID NO: 273907 - RNA, 64 nt, Homo Sapiens; identical to SEQ ID NO: 273390

SEQ ID NO: 273908 - RNA, 64 nt, Homo Sapiens; identical to SEQ ID NO: 273391

SEQ ID NO: 273909 - RNA, 64 nt, Homo Sapiens; identical to SEQ ID NO: 273392

SEQ ID NO: 273910 - RNA, 64 nt, Homo Sapiens; identical to SEQ ID NO: 273393

SEQ ID NO: 273911 - RNA, 64 nt, Homo Sapiens; identical to SEQ ID NO: 273394

SEQ ID NO: 273912 - RNA, 64 nt, Homo Sapiens; identical to SEQ ID NO: 273395

SEQ ID NO: 273913 - RNA, 64 nt, Homo Sapiens; identical to SEQ ID NO: 273396

SEQ ID NO: 273914 - RNA, 64 nt, Homo Sapiens; identical to SEQ ID NO: 273397

SEQ ID NO: 273915 - RNA, 64 nt, Homo Sapiens; identical to SEQ ID NO: 273398

SEQ ID NO: 273916 - RNA, 64 nt, Homo Sapiens; identical to SEQ ID NO: 273399

SEQ ID NO: 273917 - RNA, 64 nt, Homo Sapiens; identical to SEQ ID NO: 273400

SEQ ID NO: 273918 - RNA, 64 nt, Homo Sapiens; identical to SEQ ID NO: 273401

SEQ ID NO: 273919 - RNA, 64 nt, Homo Sapiens; identical to SEQ ID NO: 273401

SEQ ID NO: 273920 - RNA, 64 nt, Homo Sapiens; identical to SEQ ID NO: 273403

SEQ ID NO: 273921 - RNA, 64 nt, Homo Sapiens; identical to SEQ ID NO: 273404

SEQ ID NO: 273922 - RNA, 64 nt, Homo Sapiens; identical to SEQ ID NO: 273405

SEQ ID NO: 273923 - RNA, 64 nt, Homo Sapiens; identical to SEQ ID NO: 273406

SEQ ID NO: 273924 - RNA, 64 nt, Homo Sapiens; identical to SEQ ID NO: 273407

SEQ ID NO: 273925 - RNA, 64 nt, Homo Sapiens; identical to SEQ ID NO: 273408

SEQ ID NO: 273926 - RNA, 64 nt, Homo Sapiens; identical to SEQ ID NO: 273409

SEQ ID NO: 273927 - RNA, 64 nt, Homo Sapiens; identical to SEQ ID NO: 273410

SEQ ID NO: 273928 - RNA, 64 nt, Homo Sapiens; identical to SEQ ID NO: 273411

SEQ ID NO: 273929 - RNA, 64 nt, Homo Sapiens; identical to SEQ ID NO: 273412

SEQ ID NO: 273930 - RNA, 64 nt, Homo Sapiens; identical to SEQ ID NO: 273413

SEQ ID NO: 273931 - RNA, 64 nt, Homo Sapiens; identical to SEQ ID NO: 273414

SEQ ID NO: 273932 - RNA, 64 nt, Homo Sapiens; identical to SEQ ID NO: 273415

SEQ ID NO: 273933 - RNA, 64 nt, Homo Sapiens; identical to SEQ ID NO: 273416

SEQ ID NO: 273934 - RNA, 64 nt, Homo Sapiens; identical to SEQ ID NO: 273417

SEQ ID NO: 273935 - RNA, 64 nt, Homo Sapiens; identical to SEQ ID NO: 273418

SEQ ID NO: 273936 - RNA, 64 nt, Homo Sapiens; identical to SEQ ID NO: 273419

SEQ ID NO: 273937 - RNA, 64 nt, Homo Sapiens; identical to SEQ ID NO: 273420

SEQ ID NO: 273938 - RNA, 64 nt, Homo Sapiens; identical to SEQ ID NO: 273421

SEQ ID NO: 273939 - RNA, 64 nt, Homo Sapiens; identical to SEQ ID NO: 273422

SEQ ID NO: 273940 - RNA, 64 nt, Homo Sapiens; identical to SEQ ID NO: 273423

SEQ ID NO: 273941 - RNA, 64 nt, Homo Sapiens; identical to SEQ ID NO: 273424

SEQ ID NO: 273942 - RNA, 64 nt, Homo Sapiens; identical to SEQ ID NO: 273425

SEQ ID NO: 273943 - RNA, 64 nt, Homo Sapiens; identical to SEQ ID NO: 273426

SEQ ID NO: 273944 - RNA, 64 nt, Homo Sapiens; identical to SEQ ID NO: 273427

SEQ ID NO: 273945 - RNA, 64 nt, Homo Sapiens; identical to SEQ ID NO: 273428

SEQ ID NO: 273946 - RNA, 64 nt, Homo Sapiens; identical to SEQ ID NO: 273429

SEQ ID NO: 273947 - RNA, 64 nt, Homo Sapiens; identical to SEQ ID NO: 273430

SEQ ID NO: 273948 - RNA, 64 nt, Homo Sapiens; identical to SEQ ID NO: 273431

SEQ ID NO: 273949 - RNA, 64 nt, Homo Sapiens; identical to SEQ ID NO: 273432

SEQ ID NO: 273950 - RNA, 64 nt, Homo Sapiens; identical to SEQ ID NO: 273433

SEQ ID NO: 273951 - RNA, 64 nt, Homo Sapiens; identical to SEQ ID NO: 273434

SEQ ID NO: 273952 - RNA, 64 nt, Homo Sapiens; identical to SEQ ID NO: 273435

SEQ ID NO: 273953 - RNA, 64 nt, Homo Sapiens; identical to SEQ ID NO: 273436

SEQ ID NO: 273954 - RNA, 64 nt, Homo Sapiens; identical to SEQ ID NO: 273437

SEQ ID NO: 273955 - RNA, 64 nt, Homo Sapiens; identical to SEQ ID NO: 273438

SEQ ID NO: 273956 - RNA, 64 nt, Homo Sapiens; identical to SEQ ID NO: 273439

SEQ ID NO: 273957 - RNA, 64 nt, Homo Sapiens; identical to SEQ ID NO: 273440

SEQ ID NO: 273958 - RNA, 64 nt, Homo Sapiens; identical to SEQ ID NO: 273441

SEQ ID NO: 273959 - RNA, 64 nt, Homo Sapiens; identical to SEQ ID NO: 273442

SEQ ID NO: 273960 - RNA, 64 nt, Homo Sapiens; identical to SEQ ID NO: 273443

SEQ ID NO: 273961 - RNA, 64 nt, Homo Sapiens; identical to SEQ ID NO: 273444

SEQ ID NO: 273962 - RNA, 64 nt, Homo Sapiens; identical to SEQ ID NO: 273445

SEQ ID NO: 273963 - RNA, 64 nt, Homo Sapiens; identical to SEQ ID NO: 273446

SEQ ID NO: 273964 - RNA, 64 nt, Homo Sapiens; identical to SEQ ID NO: 273447

SEQ ID NO: 273965 - RNA, 64 nt, Homo Sapiens; identical to SEQ ID NO: 273448

SEQ ID NO: 273966 - RNA, 64 nt, Homo Sapiens; identical to SEQ ID NO: 273449

SEQ ID NO: 273967 - RNA, 64 nt, Homo Sapiens; identical to SEQ ID NO: 273450

SEQ ID NO: 273968 - RNA, 64 nt, Homo Sapiens; identical to SEQ ID NO: 273451

SEQ ID NO: 273969 - RNA, 64 nt, Homo Sapiens; identical to SEQ ID NO: 273452

SEQ ID NO: 273970 - RNA, 64 nt, Homo Sapiens; identical to SEQ ID NO: 273453

SEQ ID NO: 273971 - RNA, 64 nt, Homo Sapiens; identical to SEQ ID NO: 273454

SEQ ID NO: 273972 - RNA, 64 nt, Homo Sapiens; identical to SEQ ID NO: 273455

SEQ ID NO: 273973 - RNA, 64 nt, Homo Sapiens; identical to SEQ ID NO: 273456

SEQ ID NO: 273974 - RNA, 64 nt, Homo Sapiens; identical to SEQ ID NO: 273457

SEQ ID NO: 273975 - RNA, 64 nt, Homo Sapiens; identical to SEQ ID NO: 273458

SEQ ID NO: 273976 - RNA, 64 nt, Homo Sapiens; identical to SEQ ID NO: 273459

SEQ ID NO: 273977 - RNA, 64 nt, Homo Sapiens; identical to SEQ ID NO: 273460

SEQ ID NO: 273978 - RNA, 64 nt, Homo Sapiens; identical to SEQ ID NO: 273461

SEQ ID NO: 273979 - RNA, 64 nt, Homo Sapiens; identical to SEQ ID NO: 273462

SEQ ID NO: 273980 - RNA, 64 nt, Homo Sapiens; identical to SEQ ID NO: 273463

SEQ ID NO: 273981 - RNA, 64 nt, Homo Sapiens; identical to SEQ ID NO: 273464

SEQ ID NO: 273982 - RNA, 64 nt, Homo Sapiens; identical to SEQ ID NO: 273465

SEQ ID NO: 273983 - RNA, 64 nt, Homo Sapiens; identical to SEQ ID NO: 273466

SEQ ID NO: 273984 - RNA, 64 nt, Homo Sapiens; identical to SEQ ID NO: 273467

SEQ ID NO: 273985 - RNA, 64 nt, Homo Sapiens; identical to SEQ ID NO: 273468

SEQ ID NO: 273986 - RNA, 64 nt, Homo Sapiens; identical to SEQ ID NO: 273469

SEQ ID NO: 273987 - RNA, 64 nt, Homo Sapiens; identical to SEQ ID NO: 273470

SEQ ID NO: 273988 - RNA, 64 nt, Homo Sapiens; identical to SEQ ID NO: 273471

SEQ ID NO: 273989 - RNA, 64 nt, Homo Sapiens; identical to SEQ ID NO: 273472

SEQ ID NO: 273990 - RNA, 64 nt, Homo Sapiens; identical to SEQ ID NO: 273473

SEQ ID NO: 273991 - RNA, 64 nt, Homo Sapiens; identical to SEQ ID NO: 273474

SEQ ID NO: 273992 - RNA, 64 nt, Homo Sapiens; identical to SEQ ID NO: 273475

SEQ ID NO: 273993 - RNA, 64 nt, Homo Sapiens; identical to SEQ ID NO: 273476

SEQ ID NO: 273994 - RNA, 64 nt, Homo Sapiens; identical to SEQ ID NO: 273477

SEQ ID NO: 273995 - RNA, 64 nt, Homo Sapiens; identical to SEQ ID NO: 273478

SEQ ID NO: 273996 - RNA, 64 nt, Homo Sapiens; identical to SEQ ID NO: 273479

SEQ ID NO: 273997 - RNA, 64 nt, Homo Sapiens; identical to SEQ ID NO: 273480

SEQ ID NO: 273998 - RNA, 64 nt, Homo Sapiens; identical to SEQ ID NO: 273481

SEQ ID NO: 273999 - RNA, 64 nt, Homo Sapiens; identical to SEQ ID NO: 273482

SEQ ID NO: 274000 - RNA, 64 nt, Homo Sapiens; identical to SEQ ID NO: 273483

SEQ ID NO: 274001 - RNA, 64 nt, Homo Sapiens; identical to SEQ ID NO: 273484

SEQ ID NO: 274002 - RNA, 64 nt, Homo Sapiens; identical to SEQ ID NO: 273485

SEQ ID NO: 274003 - RNA, 64 nt, Homo Sapiens; identical to SEQ ID NO: 273486

SEQ ID NO: 274004 - RNA, 64 nt, Homo Sapiens; identical to SEQ ID NO: 273487

SEQ ID NO: 274005 - RNA, 64 nt, Homo Sapiens; identical to SEQ ID NO: 273488

SEQ ID NO: 274006 - RNA, 64 nt, Homo Sapiens; identical to SEQ ID NO: 273489

SEQ ID NO: 274007 - RNA, 64 nt, Homo Sapiens; identical to SEQ ID NO: 273490

SEQ ID NO: 274008 - RNA, 64 nt, Homo Sapiens; identical to SEQ ID NO: 273491

SEQ ID NO: 274009 - RNA, 64 nt, Homo Sapiens; identical to SEQ ID NO: 273492

SEQ ID NO: 274010 - RNA, 64 nt, Homo Sapiens; identical to SEQ ID NO: 273493

SEQ ID NO: 274011 - RNA, 64 nt, Homo Sapiens; identical to SEQ ID NO: 273494

SEQ ID NO: 274012 - RNA, 64 nt, Homo Sapiens; identical to SEQ ID NO: 273495

SEQ ID NO: 274013 - RNA, 64 nt, Homo Sapiens; identical to SEQ ID NO: 273496

SEQ ID NO: 274014 - RNA, 64 nt, Homo Sapiens; identical to SEQ ID NO: 273497

SEQ ID NO: 274015 - RNA, 64 nt, Homo Sapiens; identical to SEQ ID NO: 273498

SEQ ID NO: 274016 - RNA, 64 nt, Homo Sapiens; identical to SEQ ID NO: 273499

SEQ ID NO: 274017 - RNA, 64 nt, Homo Sapiens; identical to SEQ ID NO: 273500

SEQ ID NO: 274018 - RNA, 64 nt, Homo Sapiens; identical to SEQ ID NO: 273501

SEQ ID NO: 274019 - RNA, 64 nt, Homo Sapiens; identical to SEQ ID NO: 273502

SEQ ID NO: 274020 - RNA, 64 nt, Homo Sapiens; identical to SEQ ID NO: 273503

SEQ ID NO: 274021 - RNA, 64 nt, Homo Sapiens; identical to SEQ ID NO: 273504

SEQ ID NO: 274022 - RNA, 64 nt, Homo Sapiens; identical to SEQ ID NO: 273505

SEQ ID NO: 274023 - RNA, 64 nt, Homo Sapiens; identical to SEQ ID NO: 273506

SEQ ID NO: 274024 - RNA, 64 nt, Homo Sapiens; identical to SEQ ID NO: 273507

SEQ ID NO: 274025 - RNA, 64 nt, Homo Sapiens; identical to SEQ ID NO: 273508

SEQ ID NO: 274026 - RNA, 64 nt, Homo Sapiens; identical to SEQ ID NO: 273509

SEQ ID NO: 274027 - RNA, 64 nt, Homo Sapiens; identical to SEQ ID NO: 273510

SEQ ID NO: 274028 - RNA, 64 nt, Homo Sapiens; identical to SEQ ID NO: 273511

SEQ ID NO: 274029 - RNA, 64 nt, Homo Sapiens; identical to SEQ ID NO: 273512

SEQ ID NO: 274030 - RNA, 64 nt, Homo Sapiens; identical to SEQ ID NO: 273513

SEQ ID NO: 274031 - RNA, 64 nt, Homo Sapiens; identical to SEQ ID NO: 273514

SEQ ID NO: 274032 - RNA, 64 nt, Homo Sapiens; identical to SEQ ID NO: 273515

SEQ ID NO: 274033 - RNA, 64 nt, Homo Sapiens; identical to SEQ ID NO: 273516

SEQ ID NO: 274034 - RNA, 64 nt, Homo Sapiens; identical to SEQ ID NO: 273517

SEQ ID NO: 274035 - RNA, 64 nt, Homo Sapiens; identical to SEQ ID NO: 273518

SEQ ID NO: 274036 - RNA, 64 nt, Homo Sapiens; identical to SEQ ID NO: 273519

SEQ ID NO: 274037 - RNA, 64 nt, Homo Sapiens; identical to SEQ ID NO: 273520

SEQ ID NO: 274038 - RNA, 64 nt, Homo Sapiens; identical to SEQ ID NO: 273521

SEQ ID NO: 274039 - RNA, 64 nt, Homo Sapiens; identical to SEQ ID NO: 273522

SEQ ID NO: 274040 - RNA, 64 nt, Homo Sapiens; identical to SEQ ID NO: 273523

SEQ ID NO: 274041 - RNA, 64 nt, Homo Sapiens; identical to SEQ ID NO: 273524

SEQ ID NO: 274042 - RNA, 64 nt, Homo Sapiens; identical to SEQ ID NO: 273525

SEQ ID NO: 274043 - RNA, 64 nt, Homo Sapiens; identical to SEQ ID NO: 273526

SEQ ID NO: 274044 - RNA, 64 nt, Homo Sapiens; identical to SEQ ID NO: 273527

SEQ ID NO: 274045 - RNA, 64 nt, Homo Sapiens; identical to SEQ ID NO: 273528

SEQ ID NO: 274046 - RNA, 64 nt, Homo Sapiens; identical to SEQ ID NO: 273529

SEQ ID NO: 274047 - RNA, 64 nt, Homo Sapiens; identical to SEQ ID NO: 273530

SEQ ID NO: 274048 - RNA, 64 nt, Homo Sapiens; identical to SEQ ID NO: 273531

SEQ ID NO: 274049 - RNA, 64 nt, Homo Sapiens; identical to SEQ ID NO: 273532

SEQ ID NO: 274050 - RNA, 64 nt, Homo Sapiens; identical to SEQ ID NO: 273533

SEQ ID NO: 274051 - RNA, 64 nt, Homo Sapiens; identical to SEQ ID NO: 273534

SEQ ID NO: 274052 - RNA, 64 nt, Homo Sapiens; identical to SEQ ID NO: 273535

SEQ ID NO: 274053 - RNA, 64 nt, Homo Sapiens; identical to SEQ ID NO: 273536

SEQ ID NO: 274054 - RNA, 64 nt, Homo Sapiens; identical to SEQ ID NO: 273537

SEQ ID NO: 274055 - RNA, 64 nt, Homo Sapiens; identical to SEQ ID NO: 273538

SEQ ID NO: 274056 - RNA, 64 nt, Homo Sapiens; identical to SEQ ID NO: 273539

SEQ ID NO: 274057 - RNA, 64 nt, Homo Sapiens; identical to SEQ ID NO: 273540

SEQ ID NO: 274058 - RNA, 64 nt, Homo Sapiens; identical to SEQ ID NO: 273541

SEQ ID NO: 274059 - RNA, 64 nt, Homo Sapiens; identical to SEQ ID NO: 273542

SEQ ID NO: 274060 - RNA, 64 nt, Homo Sapiens; identical to SEQ ID NO: 273543

SEQ ID NO: 274061 - RNA, 64 nt, Homo Sapiens; identical to SEQ ID NO: 273544

SEQ ID NO: 274062 - RNA, 64 nt, Homo Sapiens; identical to SEQ ID NO: 273545

SEQ ID NO: 274063 - RNA, 64 nt, Homo Sapiens; identical to SEQ ID NO: 273546

SEQ ID NO: 274064 - RNA, 64 nt, Homo Sapiens; identical to SEQ ID NO: 273547

SEQ ID NO: 274065 - RNA, 64 nt, Homo Sapiens; identical to SEQ ID NO: 273548

SEQ ID NO: 274066 - RNA, 64 nt, Homo Sapiens; identical to SEQ ID NO: 273549

SEQ ID NO: 274067 - RNA, 64 nt, Homo Sapiens; identical to SEQ ID NO: 273550

SEQ ID NO: 274068 - RNA, 64 nt, Homo Sapiens; identical to SEQ ID NO: 273551

SEQ ID NO: 274069 - RNA, 64 nt, Homo Sapiens; identical to SEQ ID NO: 273552

SEQ ID NO: 274070 - RNA, 64 nt, Homo Sapiens; identical to SEQ ID NO: 273553

SEQ ID NO: 274071 - RNA, 64 nt, Homo Sapiens; identical to SEQ ID NO: 273554

SEQ ID NO: 274072 - RNA, 64 nt, Homo Sapiens; identical to SEQ ID NO: 273555

SEQ ID NO: 274073 - RNA, 64 nt, Homo Sapiens; identical to SEQ ID NO: 273556

SEQ ID NO: 274074 - RNA, 64 nt, Homo Sapiens; identical to SEQ ID NO: 273557

SEQ ID NO: 274075 - RNA, 64 nt, Homo Sapiens; identical to SEQ ID NO: 273558

SEQ ID NO: 274076 - RNA, 64 nt, Homo Sapiens; identical to SEQ ID NO: 273559

SEQ ID NO: 274077 - RNA, 64 nt, Homo Sapiens; identical to SEQ ID NO: 273560

SEQ ID NO: 274078 - RNA, 64 nt, Homo Sapiens; identical to SEQ ID NO: 273561

SEQ ID NO: 274079 - RNA, 64 nt, Homo Sapiens; identical to SEQ ID NO: 273562

SEQ ID NO: 274080 - RNA, 64 nt, Homo Sapiens; identical to SEQ ID NO: 273563

SEQ ID NO: 274081 - RNA, 64 nt, Homo Sapiens; identical to SEQ ID NO: 273564

SEQ ID NO: 274082 - RNA, 64 nt, Homo Sapiens; identical to SEQ ID NO: 273565

SEQ ID NO: 274083 - RNA, 64 nt, Homo Sapiens; identical to SEQ ID NO: 273566

SEQ ID NO: 274084 - RNA, 64 nt, Homo Sapiens; identical to SEQ ID NO: 273567

SEQ ID NO: 274085 - RNA, 64 nt, Homo Sapiens; identical to SEQ ID NO: 273568

SEQ ID NO: 274086 - RNA, 64 nt, Homo Sapiens; identical to SEQ ID NO: 273569

SEQ ID NO: 274087 - RNA, 64 nt, Homo Sapiens; identical to SEQ ID NO: 273570

SEQ ID NO: 274088 - RNA, 64 nt, Homo Sapiens; identical to SEQ ID NO: 273571

SEQ ID NO: 274089 - RNA, 64 nt, Homo Sapiens; identical to SEQ ID NO: 273572

SEQ ID NO: 274090 - RNA, 64 nt, Homo Sapiens; identical to SEQ ID NO: 273573

SEQ ID NO: 274091 - RNA, 64 nt, Homo Sapiens; identical to SEQ ID NO: 273574

SEQ ID NO: 274092 - RNA, 64 nt, Homo Sapiens; identical to SEQ ID NO: 273575

SEQ ID NO: 274093 - RNA, 64 nt, Homo Sapiens; identical to SEQ ID NO: 273576

SEQ ID NO: 274094 - RNA, 64 nt, Homo Sapiens; identical to SEQ ID NO: 273577

SEQ ID NO: 274095 - RNA, 64 nt, Homo Sapiens; identical to SEQ ID NO: 273578

SEQ ID NO: 274096 - RNA, 64 nt, Homo Sapiens; identical to SEQ ID NO: 273579

SEQ ID NO: 274097 - RNA, 64 nt, Homo Sapiens; identical to SEQ ID NO: 273580

SEQ ID NO: 274098 - RNA, 64 nt, Homo Sapiens; identical to SEQ ID NO: 273581

SEQ ID NO: 274099 - RNA, 64 nt, Homo Sapiens; identical to SEQ ID NO: 273582

SEQ ID NO: 274100 - RNA, 64 nt, Homo Sapiens; identical to SEQ ID NO: 273583

SEQ ID NO: 274101 - RNA, 64 nt, Homo Sapiens; identical to SEQ ID NO: 273584

SEQ ID NO: 274102 - RNA, 64 nt, Homo Sapiens; identical to SEQ ID NO: 273585

SEQ ID NO: 274103 - RNA, 64 nt, Homo Sapiens; identical to SEQ ID NO: 273585

SEQ ID NO: 274104 - RNA, 64 nt, Homo Sapiens; identical to SEQ ID NO: 273587

SEQ ID NO: 274105 - RNA, 64 nt, Homo Sapiens; identical to SEQ ID NO: 273588

SEQ ID NO: 274106 - RNA, 64 nt, Homo Sapiens; identical to SEQ ID NO: 273589

SEQ ID NO: 274107 - RNA, 64 nt, Homo Sapiens; identical to SEQ ID NO: 273590

SEQ ID NO: 274108 - RNA, 64 nt, Homo Sapiens; identical to SEQ ID NO: 273591

SEQ ID NO: 274109 - RNA, 64 nt, Homo Sapiens; identical to SEQ ID NO: 273592

SEQ ID NO: 274110 - RNA, 64 nt, Homo Sapiens; identical to SEQ ID NO: 273593

SEQ ID NO: 274111 - RNA, 64 nt, Homo Sapiens; identical to SEQ ID NO: 273594

SEQ ID NO: 274112 - RNA, 64 nt, Homo Sapiens; identical to SEQ ID NO: 273595

SEQ ID NO: 274113 - RNA, 64 nt, Homo Sapiens; identical to SEQ ID NO: 273596

SEQ ID NO: 274114 - RNA, 64 nt, Homo Sapiens; identical to SEQ ID NO: 273597

SEQ ID NO: 274115 - RNA, 64 nt, Homo Sapiens; identical to SEQ ID NO: 273598

SEQ ID NO: 274116 - RNA, 64 nt, Homo Sapiens; identical to SEQ ID NO: 273599

SEQ ID NO: 274117 - RNA, 64 nt, Homo Sapiens; identical to SEQ ID NO: 273600

SEQ ID NO: 274118 - RNA, 64 nt, Homo Sapiens; identical to SEQ ID NO: 273601

SEQ ID NO: 274119 - RNA, 64 nt, Homo Sapiens; identical to SEQ ID NO: 273602

SEQ ID NO: 274120 - RNA, 64 nt, Homo Sapiens; identical to SEQ ID NO: 273603

SEQ ID NO: 274121 - RNA, 64 nt, Homo Sapiens; identical to SEQ ID NO: 273604

SEQ ID NO: 274122 - RNA, 64 nt, Homo Sapiens; identical to SEQ ID NO: 273605

SEQ ID NO: 274123 - RNA, 64 nt, Homo Sapiens; identical to SEQ ID NO: 273606

SEQ ID NO: 274124 - RNA, 64 nt, Homo Sapiens; identical to SEQ ID NO: 273607

SEQ ID NO: 274125 - RNA, 64 nt, Homo Sapiens; identical to SEQ ID NO: 273608

SEQ ID NO: 274126 - RNA, 64 nt, Homo Sapiens; identical to SEQ ID NO: 273609

SEQ ID NO: 274127 - RNA, 64 nt, Homo Sapiens; identical to SEQ ID NO: 273610

SEQ ID NO: 274128 - RNA, 64 nt, Homo Sapiens; identical to SEQ ID NO: 273611

SEQ ID NO: 274129 - RNA, 64 nt, Homo Sapiens; identical to SEQ ID NO: 273612

SEQ ID NO: 274130 - RNA, 64 nt, Homo Sapiens; identical to SEQ ID NO: 273613

SEQ ID NO: 274131 - RNA, 64 nt, Homo Sapiens; identical to SEQ ID NO: 273614

SEQ ID NO: 274132 - RNA, 64 nt, Homo Sapiens; identical to SEQ ID NO: 273615

SEQ ID NO: 274133 - RNA, 64 nt, Homo Sapiens; identical to SEQ ID NO: 273616

SEQ ID NO: 274134 - RNA, 64 nt, Homo Sapiens; identical to SEQ ID NO: 273617

SEQ ID NO: 274135 - RNA, 64 nt, Homo Sapiens; identical to SEQ ID NO: 273618

SEQ ID NO: 274136 - RNA, 64 nt, Homo Sapiens; identical to SEQ ID NO: 273619

SEQ ID NO: 274137 - RNA, 64 nt, Homo Sapiens; identical to SEQ ID NO: 273620

SEQ ID NO: 274138 - RNA, 64 nt, Homo Sapiens; identical to SEQ ID NO: 273621

SEQ ID NO: 274139 - RNA, 64 nt, Homo Sapiens; identical to SEQ ID NO: 273622

SEQ ID NO: 274140 - RNA, 64 nt, Homo Sapiens; identical to SEQ ID NO: 273623

SEQ ID NO: 274141 - RNA, 64 nt, Homo Sapiens; identical to SEQ ID NO: 273624

SEQ ID NO: 274142 - RNA, 64 nt, Homo Sapiens; identical to SEQ ID NO: 273625

SEQ ID NO: 274143 - RNA, 64 nt, Homo Sapiens; identical to SEQ ID NO: 273626

SEQ ID NO: 274144 - RNA, 64 nt, Homo Sapiens; identical to SEQ ID NO: 273627

SEQ ID NO: 274145 - RNA, 64 nt, Homo Sapiens; identical to SEQ ID NO: 273628

SEQ ID NO: 274146 - RNA, 64 nt, Homo Sapiens; identical to SEQ ID NO: 273629

SEQ ID NO: 274147 - RNA, 64 nt, Homo Sapiens; identical to SEQ ID NO: 273630

SEQ ID NO: 274148 - RNA, 64 nt, Homo Sapiens; identical to SEQ ID NO: 273631

SEQ ID NO: 274149 - RNA, 62 nt, Homo Sapiens; identical to SEQ ID NO: 273115

SEQ ID NO: 274150 - RNA, 62 nt, Homo Sapiens; identical to SEQ ID NO: 273116

SEQ ID NO: 274151 - RNA, 62 nt, Homo Sapiens; identical to SEQ ID NO: 273117

SEQ ID NO: 274152 - RNA, 62 nt, Homo Sapiens; identical to SEQ ID NO: 273118

SEQ ID NO: 274153 - RNA, 62 nt, Homo Sapiens; identical to SEQ ID NO: 273119

SEQ ID NO: 274154 - RNA, 62 nt, Homo Sapiens; identical to SEQ ID NO: 273120

SEQ ID NO: 274155 - RNA, 62 nt, Homo Sapiens; identical to SEQ ID NO: 273121

SEQ ID NO: 274156 - RNA, 62 nt, Homo Sapiens; identical to SEQ ID NO: 273122

SEQ ID NO: 274157 - RNA, 62 nt, Homo Sapiens; identical to SEQ ID NO: 273123

SEQ ID NO: 274158 - RNA, 60 nt, Homo Sapiens; identical to SEQ ID NO: 273124

SEQ ID NO: 274159 - RNA, 62 nt, Homo Sapiens; identical to SEQ ID NO: 273125

SEQ ID NO: 274160 - RNA, 62 nt, Homo Sapiens; identical to SEQ ID NO: 273126

SEQ ID NO: 274161 - RNA, 62 nt, Homo Sapiens; identical to SEQ ID NO: 273127

SEQ ID NO: 274162 - RNA, 62 nt, Homo Sapiens; identical to SEQ ID NO: 273128

SEQ ID NO: 274163 - RNA, 62 nt, Homo Sapiens; identical to SEQ ID NO: 273129

SEQ ID NO: 274164 - RNA, 62 nt, Homo Sapiens; identical to SEQ ID NO: 273130

SEQ ID NO: 274165 - RNA, 62 nt, Homo Sapiens; identical to SEQ ID NO: 273131

SEQ ID NO: 274166 - RNA, 62 nt, Homo Sapiens; identical to SEQ ID NO: 273132

SEQ ID NO: 274167 - RNA, 62 nt, Homo Sapiens; identical to SEQ ID NO: 273133

SEQ ID NO: 274168 - RNA, 62 nt, Homo Sapiens; identical to SEQ ID NO: 273134

SEQ ID NO: 274169 - RNA, 62 nt, Homo Sapiens; identical to SEQ ID NO: 273135

SEQ ID NO: 274170 - RNA, 62 nt, Homo Sapiens; identical to SEQ ID NO: 273136

SEQ ID NO: 274171 - RNA, 62 nt, Homo Sapiens; identical to SEQ ID NO: 273137

SEQ ID NO: 274172 - RNA, 62 nt, Homo Sapiens; identical to SEQ ID NO: 273138

SEQ ID NO: 274173 - RNA, 62 nt, Homo Sapiens; identical to SEQ ID NO: 273139

SEQ ID NO: 274174 - RNA, 62 nt, Homo Sapiens; identical to SEQ ID NO: 273140

SEQ ID NO: 274175 - RNA, 62 nt, Homo Sapiens; identical to SEQ ID NO: 273141

SEQ ID NO: 274176 - RNA, 62 nt, Homo Sapiens; identical to SEQ ID NO: 273142

SEQ ID NO: 274177 - RNA, 62 nt, Homo Sapiens; identical to SEQ ID NO: 273143

SEQ ID NO: 274178 - RNA, 62 nt, Homo Sapiens; identical to SEQ ID NO: 273144

SEQ ID NO: 274179 - RNA, 62 nt, Homo Sapiens; identical to SEQ ID NO: 273145

SEQ ID NO: 274180 - RNA, 62 nt, Homo Sapiens; identical to SEQ ID NO: 273146

SEQ ID NO: 274181 - RNA, 62 nt, Homo Sapiens; identical to SEQ ID NO: 273147

SEQ ID NO: 274182 - RNA, 62 nt, Homo Sapiens; identical to SEQ ID NO: 273148

SEQ ID NO: 274183 - RNA, 62 nt, Homo Sapiens; identical to SEQ ID NO: 273149

SEQ ID NO: 274184 - RNA, 62 nt, Homo Sapiens; identical to SEQ ID NO: 273150

SEQ ID NO: 274185 - RNA, 62 nt, Homo Sapiens; identical to SEQ ID NO: 273151

SEQ ID NO: 274186 - RNA, 62 nt, Homo Sapiens; identical to SEQ ID NO: 273152

SEQ ID NO: 274187 - RNA, 62 nt, Homo Sapiens; identical to SEQ ID NO: 273153

SEQ ID NO: 274188 - RNA, 62 nt, Homo Sapiens; identical to SEQ ID NO: 273154

SEQ ID NO: 274189 - RNA, 62 nt, Homo Sapiens; identical to SEQ ID NO: 273155

SEQ ID NO: 274190 - RNA, 62 nt, Homo Sapiens; identical to SEQ ID NO: 273156

SEQ ID NO: 274191 - RNA, 62 nt, Homo Sapiens; identical to SEQ ID NO: 273157

SEQ ID NO: 274192 - RNA, 62 nt, Homo Sapiens; identical to SEQ ID NO: 273158

SEQ ID NO: 274193 - RNA, 62 nt, Homo Sapiens; identical to SEQ ID NO: 273159

SEQ ID NO: 274194 - RNA, 62 nt, Homo Sapiens; identical to SEQ ID NO: 273160

SEQ ID NO: 274195 - RNA, 62 nt, Homo Sapiens; identical to SEQ ID NO: 273161

SEQ ID NO: 274196 - RNA, 62 nt, Homo Sapiens; identical to SEQ ID NO: 273162

SEQ ID NO: 274197 - RNA, 62 nt, Homo Sapiens; identical to SEQ ID NO: 273163

SEQ ID NO: 274198 - RNA, 62 nt, Homo Sapiens; identical to SEQ ID NO: 273164

SEQ ID NO: 274199 - RNA, 62 nt, Homo Sapiens; identical to SEQ ID NO: 273165

SEQ ID NO: 274200 - RNA, 62 nt, Homo Sapiens; identical to SEQ ID NO: 273166

SEQ ID NO: 274201 - RNA, 62 nt, Homo Sapiens; identical to SEQ ID NO: 273167

SEQ ID NO: 274202 - RNA, 62 nt, Homo Sapiens; identical to SEQ ID NO: 273168

SEQ ID NO: 274203 - RNA, 62 nt, Homo Sapiens; identical to SEQ ID NO: 273169

SEQ ID NO: 274204 - RNA, 62 nt, Homo Sapiens; identical to SEQ ID NO: 273170

SEQ ID NO: 274205 - RNA, 62 nt, Homo Sapiens; identical to SEQ ID NO: 273171

SEQ ID NO: 274206 - RNA, 62 nt, Homo Sapiens; identical to SEQ ID NO: 273172

SEQ ID NO: 274207 - RNA, 62 nt, Homo Sapiens; identical to SEQ ID NO: 273173

SEQ ID NO: 274208 - RNA, 62 nt, Homo Sapiens; identical to SEQ ID NO: 273174

SEQ ID NO: 274209 - RNA, 62 nt, Homo Sapiens; identical to SEQ ID NO: 273175

SEQ ID NO: 274210 - RNA, 62 nt, Homo Sapiens; identical to SEQ ID NO: 273176

SEQ ID NO: 274211 - RNA, 62 nt, Homo Sapiens; identical to SEQ ID NO: 273177

SEQ ID NO: 274212 - RNA, 62 nt, Homo Sapiens; identical to SEQ ID NO: 273178

SEQ ID NO: 274213 - RNA, 62 nt, Homo Sapiens; identical to SEQ ID NO: 273179

SEQ ID NO: 274214 - RNA, 62 nt, Homo Sapiens; identical to SEQ ID NO: 273180

SEQ ID NO: 274215 - RNA, 62 nt, Homo Sapiens; identical to SEQ ID NO: 273181

SEQ ID NO: 274216 - RNA, 62 nt, Homo Sapiens; identical to SEQ ID NO: 273182

SEQ ID NO: 274217 - RNA, 62 nt, Homo Sapiens; identical to SEQ ID NO: 273183

SEQ ID NO: 274218 - RNA, 62 nt, Homo Sapiens; identical to SEQ ID NO: 273184

SEQ ID NO: 274219 - RNA, 62 nt, Homo Sapiens; identical to SEQ ID NO: 273185

SEQ ID NO: 274220 - RNA, 62 nt, Homo Sapiens; identical to SEQ ID NO: 273186

SEQ ID NO: 274221 - RNA, 62 nt, Homo Sapiens; identical to SEQ ID NO: 273187

SEQ ID NO: 274222 - RNA, 62 nt, Homo Sapiens; identical to SEQ ID NO: 273188

SEQ ID NO: 274223 - RNA, 60 nt, Homo Sapiens; identical to SEQ ID NO: 273189

SEQ ID NO: 274224 - RNA, 62 nt, Homo Sapiens; identical to SEQ ID NO: 273190

SEQ ID NO: 274225 - RNA, 62 nt, Homo Sapiens; identical to SEQ ID NO: 273191

SEQ ID NO: 274226 - RNA, 62 nt, Homo Sapiens; identical to SEQ ID NO: 273192

SEQ ID NO: 274227 - RNA, 62 nt, Homo Sapiens; identical to SEQ ID NO: 273193

SEQ ID NO: 274228 - RNA, 62 nt, Homo Sapiens; identical to SEQ ID NO: 273194

SEQ ID NO: 274229 - RNA, 62 nt, Homo Sapiens; identical to SEQ ID NO: 273195

SEQ ID NO: 274230 - RNA, 62 nt, Homo Sapiens; identical to SEQ ID NO: 273196

SEQ ID NO: 274231 - RNA, 62 nt, Homo Sapiens; identical to SEQ ID NO: 273197

SEQ ID NO: 274232 - RNA, 62 nt, Homo Sapiens; identical to SEQ ID NO: 273198

SEQ ID NO: 274233 - RNA, 62 nt, Homo Sapiens; identical to SEQ ID NO: 273199

SEQ ID NO: 274234 - RNA, 62 nt, Homo Sapiens; identical to SEQ ID NO: 273200

SEQ ID NO: 274235 - RNA, 62 nt, Homo Sapiens; identical to SEQ ID NO: 273201

SEQ ID NO: 274236 - RNA, 62 nt, Homo Sapiens; identical to SEQ ID NO: 273202

SEQ ID NO: 274237 - RNA, 62 nt, Homo Sapiens; identical to SEQ ID NO: 273203

SEQ ID NO: 274238 - RNA, 62 nt, Homo Sapiens; identical to SEQ ID NO: 273204

SEQ ID NO: 274239 - RNA, 62 nt, Homo Sapiens; identical to SEQ ID NO: 273205

SEQ ID NO: 274240 - RNA, 62 nt, Homo Sapiens; identical to SEQ ID NO: 273206

SEQ ID NO: 274241 - RNA, 62 nt, Homo Sapiens; identical to SEQ ID NO: 273207

SEQ ID NO: 274242 - RNA, 62 nt, Homo Sapiens; identical to SEQ ID NO: 273208

SEQ ID NO: 274243 - RNA, 62 nt, Homo Sapiens; identical to SEQ ID NO: 273209

SEQ ID NO: 274244 - RNA, 62 nt, Homo Sapiens; identical to SEQ ID NO: 273210

SEQ ID NO: 274245 - RNA, 62 nt, Homo Sapiens; identical to SEQ ID NO: 273211

SEQ ID NO: 274246 - RNA, 62 nt, Homo Sapiens; identical to SEQ ID NO: 273212

SEQ ID NO: 274247 - RNA, 62 nt, Homo Sapiens; identical to SEQ ID NO: 273213

SEQ ID NO: 274248 - RNA, 62 nt, Homo Sapiens; identical to SEQ ID NO: 273214

SEQ ID NO: 274249 - RNA, 62 nt, Homo Sapiens; identical to SEQ ID NO: 273215

SEQ ID NO: 274250 - RNA, 62 nt, Homo Sapiens; identical to SEQ ID NO: 273216

SEQ ID NO: 274251 - RNA, 62 nt, Homo Sapiens; identical to SEQ ID NO: 273217

SEQ ID NO: 274252 - RNA, 62 nt, Homo Sapiens; identical to SEQ ID NO: 273218

SEQ ID NO: 274253 - RNA, 62 nt, Homo Sapiens; identical to SEQ ID NO: 273219

SEQ ID NO: 274254 - RNA, 62 nt, Homo Sapiens; identical to SEQ ID NO: 273220

SEQ ID NO: 274255 - RNA, 62 nt, Homo Sapiens; identical to SEQ ID NO: 273221

SEQ ID NO: 274256 - RNA, 62 nt, Homo Sapiens; identical to SEQ ID NO: 273222

SEQ ID NO: 274257 - RNA, 62 nt, Homo Sapiens; identical to SEQ ID NO: 273223

SEQ ID NO: 274258 - RNA, 62 nt, Homo Sapiens; identical to SEQ ID NO: 273224

SEQ ID NO: 274259 - RNA, 62 nt, Homo Sapiens; identical to SEQ ID NO: 273225

SEQ ID NO: 274260 - RNA, 62 nt, Homo Sapiens; identical to SEQ ID NO: 273226

SEQ ID NO: 274261 - RNA, 62 nt, Homo Sapiens; identical to SEQ ID NO: 273227

SEQ ID NO: 274262 - RNA, 62 nt, Homo Sapiens; identical to SEQ ID NO: 273228

SEQ ID NO: 274263 - RNA, 62 nt, Homo Sapiens; identical to SEQ ID NO: 273229

SEQ ID NO: 274264 - RNA, 62 nt, Homo Sapiens; identical to SEQ ID NO: 273230

SEQ ID NO: 274265 - RNA, 62 nt, Homo Sapiens; identical to SEQ ID NO: 273231

SEQ ID NO: 274266 - RNA, 62 nt, Homo Sapiens; identical to SEQ ID NO: 273232

SEQ ID NO: 274267 - RNA, 62 nt, Homo Sapiens; identical to SEQ ID NO: 273233

SEQ ID NO: 274268 - RNA, 62 nt, Homo Sapiens; identical to SEQ ID NO: 273234

SEQ ID NO: 274269 - RNA, 62 nt, Homo Sapiens; identical to SEQ ID NO: 273235

SEQ ID NO: 274270 - RNA, 62 nt, Homo Sapiens; identical to SEQ ID NO: 273236

SEQ ID NO: 274271 - RNA, 62 nt, Homo Sapiens; identical to SEQ ID NO: 273237

SEQ ID NO: 274272 - RNA, 62 nt, Homo Sapiens; identical to SEQ ID NO: 273238

SEQ ID NO: 274273 - RNA, 62 nt, Homo Sapiens; identical to SEQ ID NO: 273239

SEQ ID NO: 274274 - RNA, 62 nt, Homo Sapiens; identical to SEQ ID NO: 273240

SEQ ID NO: 274275 - RNA, 62 nt, Homo Sapiens; identical to SEQ ID NO: 273241

SEQ ID NO: 274276 - RNA, 62 nt, Homo Sapiens; identical to SEQ ID NO: 273242

SEQ ID NO: 274277 - RNA, 62 nt, Homo Sapiens; identical to SEQ ID NO: 273243

SEQ ID NO: 274278 - RNA, 62 nt, Homo Sapiens; identical to SEQ ID NO: 273244

SEQ ID NO: 274279 - RNA, 62 nt, Homo Sapiens; identical to SEQ ID NO: 273245

SEQ ID NO: 274280 - RNA, 62 nt, Homo Sapiens; identical to SEQ ID NO: 273246

SEQ ID NO: 274281 - RNA, 62 nt, Homo Sapiens; identical to SEQ ID NO: 273247

SEQ ID NO: 274282 - RNA, 62 nt, Homo Sapiens; identical to SEQ ID NO: 273248

SEQ ID NO: 274283 - RNA, 62 nt, Homo Sapiens; identical to SEQ ID NO: 273249

SEQ ID NO: 274284 - RNA, 62 nt, Homo Sapiens; identical to SEQ ID NO: 273250

SEQ ID NO: 274285 - RNA, 62 nt, Homo Sapiens; identical to SEQ ID NO: 273251

SEQ ID NO: 274286 - RNA, 62 nt, Homo Sapiens; identical to SEQ ID NO: 273252

SEQ ID NO: 274287 - RNA, 62 nt, Homo Sapiens; identical to SEQ ID NO: 273253

SEQ ID NO: 274288 - RNA, 62 nt, Homo Sapiens; identical to SEQ ID NO: 273254

SEQ ID NO: 274289 - RNA, 62 nt, Homo Sapiens; identical to SEQ ID NO: 273255

SEQ ID NO: 274290 - RNA, 62 nt, Homo Sapiens; identical to SEQ ID NO: 273256

SEQ ID NO: 274291 - RNA, 62 nt, Homo Sapiens; identical to SEQ ID NO: 273257

SEQ ID NO: 274292 - RNA, 62 nt, Homo Sapiens; identical to SEQ ID NO: 273258

SEQ ID NO: 274293 - RNA, 62 nt, Homo Sapiens; identical to SEQ ID NO: 273259

SEQ ID NO: 274294 - RNA, 62 nt, Homo Sapiens; identical to SEQ ID NO: 273260

SEQ ID NO: 274295 - RNA, 62 nt, Homo Sapiens; identical to SEQ ID NO: 273261

SEQ ID NO: 274296 - RNA, 62 nt, Homo Sapiens; identical to SEQ ID NO: 273262

SEQ ID NO: 274297 - RNA, 62 nt, Homo Sapiens; identical to SEQ ID NO: 273263

SEQ ID NO: 274298 - RNA, 62 nt, Homo Sapiens; identical to SEQ ID NO: 273264

SEQ ID NO: 274299 - RNA, 62 nt, Homo Sapiens; identical to SEQ ID NO: 273265

SEQ ID NO: 274300 - RNA, 62 nt, Homo Sapiens; identical to SEQ ID NO: 273266

SEQ ID NO: 274301 - RNA, 62 nt, Homo Sapiens; identical to SEQ ID NO: 273267

SEQ ID NO: 274302 - RNA, 62 nt, Homo Sapiens; identical to SEQ ID NO: 273268

SEQ ID NO: 274303 - RNA, 62 nt, Homo Sapiens; identical to SEQ ID NO: 273269

SEQ ID NO: 274304 - RNA, 62 nt, Homo Sapiens; identical to SEQ ID NO: 273270

SEQ ID NO: 274305 - RNA, 62 nt, Homo Sapiens; identical to SEQ ID NO: 273271

SEQ ID NO: 274306 - RNA, 62 nt, Homo Sapiens; identical to SEQ ID NO: 273272

SEQ ID NO: 274307 - RNA, 62 nt, Homo Sapiens; identical to SEQ ID NO: 273273

SEQ ID NO: 274308 - RNA, 62 nt, Homo Sapiens; identical to SEQ ID NO: 273274

SEQ ID NO: 274309 - RNA, 62 nt, Homo Sapiens; identical to SEQ ID NO: 273275

SEQ ID NO: 274310 - RNA, 62 nt, Homo Sapiens; identical to SEQ ID NO: 273276

SEQ ID NO: 274311 - RNA, 62 nt, Homo Sapiens; identical to SEQ ID NO: 273277

SEQ ID NO: 274312 - RNA, 62 nt, Homo Sapiens; identical to SEQ ID NO: 273278

SEQ ID NO: 274313 - RNA, 62 nt, Homo Sapiens; identical to SEQ ID NO: 273279

SEQ ID NO: 274314 - RNA, 62 nt, Homo Sapiens; identical to SEQ ID NO: 273280

SEQ ID NO: 274315 - RNA, 62 nt, Homo Sapiens; identical to SEQ ID NO: 273281

SEQ ID NO: 274316 - RNA, 62 nt, Homo Sapiens; identical to SEQ ID NO: 273282

SEQ ID NO: 274317 - RNA, 62 nt, Homo Sapiens; identical to SEQ ID NO: 273283

SEQ ID NO: 274318 - RNA, 51 nt, Homo Sapiens; identical to SEQ ID NO: 273284

SEQ ID NO: 274319 - RNA, 62 nt, Homo Sapiens; identical to SEQ ID NO: 273285

SEQ ID NO: 274320 - RNA, 62 nt, Homo Sapiens; identical to SEQ ID NO: 273286

SEQ ID NO: 274321 - RNA, 62 nt, Homo Sapiens; identical to SEQ ID NO: 273287

SEQ ID NO: 274322 - RNA, 62 nt, Homo Sapiens; identical to SEQ ID NO: 273288

SEQ ID NO: 274323 - RNA, 62 nt, Homo Sapiens; identical to SEQ ID NO: 273289

SEQ ID NO: 274324 - RNA, 62 nt, Homo Sapiens; identical to SEQ ID NO: 273290

SEQ ID NO: 274325 - RNA, 62 nt, Homo Sapiens; identical to SEQ ID NO: 273291

SEQ ID NO: 274326 - RNA, 62 nt, Homo Sapiens; identical to SEQ ID NO: 273292

SEQ ID NO: 274327 - RNA, 62 nt, Homo Sapiens; identical to SEQ ID NO: 273293

SEQ ID NO: 274328 - RNA, 62 nt, Homo Sapiens; identical to SEQ ID NO: 273294

SEQ ID NO: 274329 - RNA, 62 nt, Homo Sapiens; identical to SEQ ID NO: 273295

SEQ ID NO: 274330 - RNA, 62 nt, Homo Sapiens; identical to SEQ ID NO: 273296

SEQ ID NO: 274331 - RNA, 62 nt, Homo Sapiens; identical to SEQ ID NO: 273297

SEQ ID NO: 274332 - RNA, 62 nt, Homo Sapiens; identical to SEQ ID NO: 273298

SEQ ID NO: 274333 - RNA, 62 nt, Homo Sapiens; identical to SEQ ID NO: 273299

SEQ ID NO: 274334 - RNA, 62 nt, Homo Sapiens; identical to SEQ ID NO: 273300

SEQ ID NO: 274335 - RNA, 62 nt, Homo Sapiens; identical to SEQ ID NO: 273301

SEQ ID NO: 274336 - RNA, 62 nt, Homo Sapiens; identical to SEQ ID NO: 273302

SEQ ID NO: 274337 - RNA, 62 nt, Homo Sapiens; identical to SEQ ID NO: 273303

SEQ ID NO: 274338 - RNA, 62 nt, Homo Sapiens; identical to SEQ ID NO: 273304

SEQ ID NO: 274339 - RNA, 62 nt, Homo Sapiens; identical to SEQ ID NO: 273305

SEQ ID NO: 274340 - RNA, 62 nt, Homo Sapiens; identical to SEQ ID NO: 273306

SEQ ID NO: 274341 - RNA, 62 nt, Homo Sapiens; identical to SEQ ID NO: 273307

SEQ ID NO: 274342 - RNA, 62 nt, Homo Sapiens; identical to SEQ ID NO: 273308

SEQ ID NO: 274343 - RNA, 62 nt, Homo Sapiens; identical to SEQ ID NO: 273309

SEQ ID NO: 274344 - RNA, 64 nt, Homo Sapiens; identical to SEQ ID NO: 273310

SEQ ID NO: 274345 - RNA, 64 nt, Homo Sapiens; identical to SEQ ID NO: 273311

SEQ ID NO: 274346 - RNA, 64 nt, Homo Sapiens; identical to SEQ ID NO: 273312

SEQ ID NO: 274347 - RNA, 64 nt, Homo Sapiens; identical to SEQ ID NO: 273313

SEQ ID NO: 274348 - RNA, 64 nt, Homo Sapiens; identical to SEQ ID NO: 273314

SEQ ID NO: 274349 - RNA, 64 nt, Homo Sapiens; identical to SEQ ID NO: 273315

SEQ ID NO: 274350 - RNA, 64 nt, Homo Sapiens; identical to SEQ ID NO: 273316

SEQ ID NO: 274351 - RNA, 64 nt, Homo Sapiens; identical to SEQ ID NO: 273317

SEQ ID NO: 274352 - RNA, 64 nt, Homo Sapiens; identical to SEQ ID NO: 273318

SEQ ID NO: 274353 - RNA, 64 nt, Homo Sapiens; identical to SEQ ID NO: 273319

SEQ ID NO: 274354 - RNA, 64 nt, Homo Sapiens; identical to SEQ ID NO: 189841

SEQ ID NO: 274355 - RNA, 64 nt, Homo Sapiens; identical to SEQ ID NO: 189842

SEQ ID NO: 274356 - RNA, 64 nt, Homo Sapiens; identical to SEQ ID NO: 273322

SEQ ID NO: 274357 - RNA, 64 nt, Homo Sapiens; identical to SEQ ID NO: 273323

SEQ ID NO: 274358 - RNA, 64 nt, Homo Sapiens; identical to SEQ ID NO: 273324

SEQ ID NO: 274359 - RNA, 64 nt, Homo Sapiens; identical to SEQ ID NO: 273325

SEQ ID NO: 274360 - RNA, 64 nt, Homo Sapiens; identical to SEQ ID NO: 273326

SEQ ID NO: 274361 - RNA, 64 nt, Homo Sapiens; identical to SEQ ID NO: 273327

SEQ ID NO: 274362 - RNA, 64 nt, Homo Sapiens; identical to SEQ ID NO: 273328

SEQ ID NO: 274363 - RNA, 64 nt, Homo Sapiens; identical to SEQ ID NO: 273329

SEQ ID NO: 274364 - RNA, 64 nt, Homo Sapiens; identical to SEQ ID NO: 273330

SEQ ID NO: 274365 - RNA, 64 nt, Homo Sapiens; identical to SEQ ID NO: 273331

SEQ ID NO: 274366 - RNA, 64 nt, Homo Sapiens; identical to SEQ ID NO: 273332

SEQ ID NO: 274367 - RNA, 64 nt, Homo Sapiens; identical to SEQ ID NO: 273333

SEQ ID NO: 274368 - RNA, 64 nt, Homo Sapiens; identical to SEQ ID NO: 273334

SEQ ID NO: 274369 - RNA, 64 nt, Homo Sapiens; identical to SEQ ID NO: 273335

SEQ ID NO: 274370 - RNA, 64 nt, Homo Sapiens; identical to SEQ ID NO: 273336

SEQ ID NO: 274371 - RNA, 64 nt, Homo Sapiens; identical to SEQ ID NO: 273337

SEQ ID NO: 274372 - RNA, 64 nt, Homo Sapiens; identical to SEQ ID NO: 273338

SEQ ID NO: 274373 - RNA, 64 nt, Homo Sapiens; identical to SEQ ID NO: 273339

SEQ ID NO: 274374 - RNA, 64 nt, Homo Sapiens; identical to SEQ ID NO: 273340

SEQ ID NO: 274375 - RNA, 64 nt, Homo Sapiens; identical to SEQ ID NO: 273341

SEQ ID NO: 274376 - RNA, 64 nt, Homo Sapiens; identical to SEQ ID NO: 273342

SEQ ID NO: 274377 - RNA, 64 nt, Homo Sapiens; identical to SEQ ID NO: 273343

SEQ ID NO: 274378 - RNA, 64 nt, Homo Sapiens; identical to SEQ ID NO: 273344

SEQ ID NO: 274379 - RNA, 64 nt, Homo Sapiens; identical to SEQ ID NO: 273345

SEQ ID NO: 274380 - RNA, 64 nt, Homo Sapiens; identical to SEQ ID NO: 273346

SEQ ID NO: 274381 - RNA, 64 nt, Homo Sapiens; identical to SEQ ID NO: 273347

SEQ ID NO: 274382 - RNA, 64 nt, Homo Sapiens; identical to SEQ ID NO: 273348

SEQ ID NO: 274383 - RNA, 64 nt, Homo Sapiens; identical to SEQ ID NO: 273349

SEQ ID NO: 274384 - RNA, 64 nt, Homo Sapiens; identical to SEQ ID NO: 273350

SEQ ID NO: 274385 - RNA, 64 nt, Homo Sapiens; identical to SEQ ID NO: 273351

SEQ ID NO: 274386 - RNA, 64 nt, Homo Sapiens; identical to SEQ ID NO: 273352

SEQ ID NO: 274387 - RNA, 64 nt, Homo Sapiens; identical to SEQ ID NO: 273353

SEQ ID NO: 274388 - RNA, 64 nt, Homo Sapiens; identical to SEQ ID NO: 273354

SEQ ID NO: 274389 - RNA, 64 nt, Homo Sapiens; identical to SEQ ID NO: 273355

SEQ ID NO: 274390 - RNA, 64 nt, Homo Sapiens; identical to SEQ ID NO: 273356

SEQ ID NO: 274391 - RNA, 64 nt, Homo Sapiens; identical to SEQ ID NO: 273357

SEQ ID NO: 274392 - RNA, 64 nt, Homo Sapiens; identical to SEQ ID NO: 273358

SEQ ID NO: 274393 - RNA, 64 nt, Homo Sapiens; identical to SEQ ID NO: 273359

SEQ ID NO: 274394 - RNA, 64 nt, Homo Sapiens; identical to SEQ ID NO: 273360

SEQ ID NO: 274395 - RNA, 64 nt, Homo Sapiens; identical to SEQ ID NO: 273361

SEQ ID NO: 274396 - RNA, 64 nt, Homo Sapiens; identical to SEQ ID NO: 273362

SEQ ID NO: 274397 - RNA, 64 nt, Homo Sapiens; identical to SEQ ID NO: 273363

SEQ ID NO: 274398 - RNA, 64 nt, Homo Sapiens; identical to SEQ ID NO: 273364

SEQ ID NO: 274399 - RNA, 64 nt, Homo Sapiens; identical to SEQ ID NO: 273365

SEQ ID NO: 274400 - RNA, 64 nt, Homo Sapiens; identical to SEQ ID NO: 273366

SEQ ID NO: 274401 - RNA, 64 nt, Homo Sapiens; identical to SEQ ID NO: 273367

SEQ ID NO: 274402 - RNA, 64 nt, Homo Sapiens; identical to SEQ ID NO: 273368

SEQ ID NO: 274403 - RNA, 64 nt, Homo Sapiens; identical to SEQ ID NO: 273369

SEQ ID NO: 274404 - RNA, 64 nt, Homo Sapiens; identical to SEQ ID NO: 273370

SEQ ID NO: 274405 - RNA, 59 nt, Homo Sapiens; identical to SEQ ID NO: 273371

SEQ ID NO: 274406 - RNA, 64 nt, Homo Sapiens; identical to SEQ ID NO: 273372

SEQ ID NO: 274407 - RNA, 64 nt, Homo Sapiens; identical to SEQ ID NO: 273373

SEQ ID NO: 274408 - RNA, 64 nt, Homo Sapiens; identical to SEQ ID NO: 273374

SEQ ID NO: 274409 - RNA, 64 nt, Homo Sapiens; identical to SEQ ID NO: 273375

SEQ ID NO: 274410 - RNA, 64 nt, Homo Sapiens; identical to SEQ ID NO: 273376

SEQ ID NO: 274411 - RNA, 64 nt, Homo Sapiens; identical to SEQ ID NO: 273377

SEQ ID NO: 274412 - RNA, 64 nt, Homo Sapiens; identical to SEQ ID NO: 273378

SEQ ID NO: 274413 - RNA, 64 nt, Homo Sapiens; identical to SEQ ID NO: 273379

SEQ ID NO: 274414 - RNA, 64 nt, Homo Sapiens; identical to SEQ ID NO: 273380

SEQ ID NO: 274415 - RNA, 64 nt, Homo Sapiens; identical to SEQ ID NO: 273381

SEQ ID NO: 274416 - RNA, 64 nt, Homo Sapiens; identical to SEQ ID NO: 273382

SEQ ID NO: 274417 - RNA, 64 nt, Homo Sapiens; identical to SEQ ID NO: 273383

SEQ ID NO: 274418 - RNA, 52 nt, Homo Sapiens; identical to SEQ ID NO: 273384

SEQ ID NO: 274419 - RNA, 64 nt, Homo Sapiens; identical to SEQ ID NO: 273385

SEQ ID NO: 274420 - RNA, 64 nt, Homo Sapiens; identical to SEQ ID NO: 273386

SEQ ID NO: 274421 - RNA, 64 nt, Homo Sapiens; identical to SEQ ID NO: 273387

SEQ ID NO: 274422 - RNA, 64 nt, Homo Sapiens; identical to SEQ ID NO: 273388

SEQ ID NO: 274423 - RNA, 64 nt, Homo Sapiens; identical to SEQ ID NO: 273389

SEQ ID NO: 274424 - RNA, 64 nt, Homo Sapiens; identical to SEQ ID NO: 273390

SEQ ID NO: 274425 - RNA, 64 nt, Homo Sapiens; identical to SEQ ID NO: 273391

SEQ ID NO: 274426 - RNA, 64 nt, Homo Sapiens; identical to SEQ ID NO: 273392

SEQ ID NO: 274427 - RNA, 64 nt, Homo Sapiens; identical to SEQ ID NO: 273393

SEQ ID NO: 274428 - RNA, 64 nt, Homo Sapiens; identical to SEQ ID NO: 273394

SEQ ID NO: 274429 - RNA, 64 nt, Homo Sapiens; identical to SEQ ID NO: 273395

SEQ ID NO: 274430 - RNA, 64 nt, Homo Sapiens; identical to SEQ ID NO: 273396

SEQ ID NO: 274431 - RNA, 64 nt, Homo Sapiens; identical to SEQ ID NO: 273397

SEQ ID NO: 274432 - RNA, 64 nt, Homo Sapiens; identical to SEQ ID NO: 273398

SEQ ID NO: 274433 - RNA, 64 nt, Homo Sapiens; identical to SEQ ID NO: 273399

SEQ ID NO: 274434 - RNA, 64 nt, Homo Sapiens; identical to SEQ ID NO: 273400

SEQ ID NO: 274435 - RNA, 64 nt, Homo Sapiens; identical to SEQ ID NO: 273401

SEQ ID NO: 274436 - RNA, 64 nt, Homo Sapiens; identical to SEQ ID NO: 273401

SEQ ID NO: 274437 - RNA, 64 nt, Homo Sapiens; identical to SEQ ID NO: 273403

SEQ ID NO: 274438 - RNA, 64 nt, Homo Sapiens; identical to SEQ ID NO: 273404

SEQ ID NO: 274439 - RNA, 64 nt, Homo Sapiens; identical to SEQ ID NO: 273405

SEQ ID NO: 274440 - RNA, 64 nt, Homo Sapiens; identical to SEQ ID NO: 273406

SEQ ID NO: 274441 - RNA, 64 nt, Homo Sapiens; identical to SEQ ID NO: 273407

SEQ ID NO: 274442 - RNA, 64 nt, Homo Sapiens; identical to SEQ ID NO: 273408

SEQ ID NO: 274443 - RNA, 64 nt, Homo Sapiens; identical to SEQ ID NO: 273409

SEQ ID NO: 274444 - RNA, 64 nt, Homo Sapiens; identical to SEQ ID NO: 273410

SEQ ID NO: 274445 - RNA, 64 nt, Homo Sapiens; identical to SEQ ID NO: 273411

SEQ ID NO: 274446 - RNA, 64 nt, Homo Sapiens; identical to SEQ ID NO: 273412

SEQ ID NO: 274447 - RNA, 64 nt, Homo Sapiens; identical to SEQ ID NO: 273413

SEQ ID NO: 274448 - RNA, 64 nt, Homo Sapiens; identical to SEQ ID NO: 273414

SEQ ID NO: 274449 - RNA, 64 nt, Homo Sapiens; identical to SEQ ID NO: 273415

SEQ ID NO: 274450 - RNA, 64 nt, Homo Sapiens; identical to SEQ ID NO: 273416

SEQ ID NO: 274451 - RNA, 64 nt, Homo Sapiens; identical to SEQ ID NO: 273417

SEQ ID NO: 274452 - RNA, 64 nt, Homo Sapiens; identical to SEQ ID NO: 273418

SEQ ID NO: 274453 - RNA, 64 nt, Homo Sapiens; identical to SEQ ID NO: 273419

SEQ ID NO: 274454 - RNA, 64 nt, Homo Sapiens; identical to SEQ ID NO: 273420

SEQ ID NO: 274455 - RNA, 64 nt, Homo Sapiens; identical to SEQ ID NO: 273421

SEQ ID NO: 274456 - RNA, 64 nt, Homo Sapiens; identical to SEQ ID NO: 273422

SEQ ID NO: 274457 - RNA, 64 nt, Homo Sapiens; identical to SEQ ID NO: 273423

SEQ ID NO: 274458 - RNA, 64 nt, Homo Sapiens; identical to SEQ ID NO: 273424

SEQ ID NO: 274459 - RNA, 64 nt, Homo Sapiens; identical to SEQ ID NO: 273425

SEQ ID NO: 274460 - RNA, 64 nt, Homo Sapiens; identical to SEQ ID NO: 273426

SEQ ID NO: 274461 - RNA, 64 nt, Homo Sapiens; identical to SEQ ID NO: 273427

SEQ ID NO: 274462 - RNA, 64 nt, Homo Sapiens; identical to SEQ ID NO: 273428

SEQ ID NO: 274463 - RNA, 64 nt, Homo Sapiens; identical to SEQ ID NO: 273429

SEQ ID NO: 274464 - RNA, 64 nt, Homo Sapiens; identical to SEQ ID NO: 273430

SEQ ID NO: 274465 - RNA, 64 nt, Homo Sapiens; identical to SEQ ID NO: 273431

SEQ ID NO: 274466 - RNA, 64 nt, Homo Sapiens; identical to SEQ ID NO: 273432

SEQ ID NO: 274467 - RNA, 64 nt, Homo Sapiens; identical to SEQ ID NO: 273433

SEQ ID NO: 274468 - RNA, 64 nt, Homo Sapiens; identical to SEQ ID NO: 273434

SEQ ID NO: 274469 - RNA, 64 nt, Homo Sapiens; identical to SEQ ID NO: 273435

SEQ ID NO: 274470 - RNA, 64 nt, Homo Sapiens; identical to SEQ ID NO: 273436

SEQ ID NO: 274471 - RNA, 64 nt, Homo Sapiens; identical to SEQ ID NO: 273437

SEQ ID NO: 274472 - RNA, 64 nt, Homo Sapiens; identical to SEQ ID NO: 273438

SEQ ID NO: 274473 - RNA, 64 nt, Homo Sapiens; identical to SEQ ID NO: 273439

SEQ ID NO: 274474 - RNA, 64 nt, Homo Sapiens; identical to SEQ ID NO: 273440

SEQ ID NO: 274475 - RNA, 64 nt, Homo Sapiens; identical to SEQ ID NO: 273441

SEQ ID NO: 274476 - RNA, 64 nt, Homo Sapiens; identical to SEQ ID NO: 273442

SEQ ID NO: 274477 - RNA, 64 nt, Homo Sapiens; identical to SEQ ID NO: 273443

SEQ ID NO: 274478 - RNA, 64 nt, Homo Sapiens; identical to SEQ ID NO: 273444

SEQ ID NO: 274479 - RNA, 64 nt, Homo Sapiens; identical to SEQ ID NO: 273445

SEQ ID NO: 274480 - RNA, 64 nt, Homo Sapiens; identical to SEQ ID NO: 273446

SEQ ID NO: 274481 - RNA, 64 nt, Homo Sapiens; identical to SEQ ID NO: 273447

SEQ ID NO: 274482 - RNA, 64 nt, Homo Sapiens; identical to SEQ ID NO: 273448

SEQ ID NO: 274483 - RNA, 64 nt, Homo Sapiens; identical to SEQ ID NO: 273449

SEQ ID NO: 274484 - RNA, 64 nt, Homo Sapiens; identical to SEQ ID NO: 273450

SEQ ID NO: 274485 - RNA, 64 nt, Homo Sapiens; identical to SEQ ID NO: 273451

SEQ ID NO: 274486 - RNA, 64 nt, Homo Sapiens; identical to SEQ ID NO: 273452

SEQ ID NO: 274487 - RNA, 64 nt, Homo Sapiens; identical to SEQ ID NO: 273453

SEQ ID NO: 274488 - RNA, 64 nt, Homo Sapiens; identical to SEQ ID NO: 273454

SEQ ID NO: 274489 - RNA, 64 nt, Homo Sapiens; identical to SEQ ID NO: 273455

SEQ ID NO: 274490 - RNA, 64 nt, Homo Sapiens; identical to SEQ ID NO: 273456

SEQ ID NO: 274491 - RNA, 64 nt, Homo Sapiens; identical to SEQ ID NO: 273457

SEQ ID NO: 274492 - RNA, 64 nt, Homo Sapiens; identical to SEQ ID NO: 273458

SEQ ID NO: 274493 - RNA, 64 nt, Homo Sapiens; identical to SEQ ID NO: 273459

SEQ ID NO: 274494 - RNA, 64 nt, Homo Sapiens; identical to SEQ ID NO: 273460

SEQ ID NO: 274495 - RNA, 64 nt, Homo Sapiens; identical to SEQ ID NO: 273461

SEQ ID NO: 274496 - RNA, 64 nt, Homo Sapiens; identical to SEQ ID NO: 273462

SEQ ID NO: 274497 - RNA, 64 nt, Homo Sapiens; identical to SEQ ID NO: 273463

SEQ ID NO: 274498 - RNA, 64 nt, Homo Sapiens; identical to SEQ ID NO: 273464

SEQ ID NO: 274499 - RNA, 64 nt, Homo Sapiens; identical to SEQ ID NO: 273465

SEQ ID NO: 274500 - RNA, 64 nt, Homo Sapiens; identical to SEQ ID NO: 273466

SEQ ID NO: 274501 - RNA, 64 nt, Homo Sapiens; identical to SEQ ID NO: 273467

SEQ ID NO: 274502 - RNA, 64 nt, Homo Sapiens; identical to SEQ ID NO: 273468

SEQ ID NO: 274503 - RNA, 64 nt, Homo Sapiens; identical to SEQ ID NO: 273469

SEQ ID NO: 274504 - RNA, 64 nt, Homo Sapiens; identical to SEQ ID NO: 273470

SEQ ID NO: 274505 - RNA, 64 nt, Homo Sapiens; identical to SEQ ID NO: 273471

SEQ ID NO: 274506 - RNA, 64 nt, Homo Sapiens; identical to SEQ ID NO: 273472

SEQ ID NO: 274507 - RNA, 64 nt, Homo Sapiens; identical to SEQ ID NO: 273473

SEQ ID NO: 274508 - RNA, 64 nt, Homo Sapiens; identical to SEQ ID NO: 273474

SEQ ID NO: 274509 - RNA, 64 nt, Homo Sapiens; identical to SEQ ID NO: 273475

SEQ ID NO: 274510 - RNA, 64 nt, Homo Sapiens; identical to SEQ ID NO: 273476

SEQ ID NO: 274511 - RNA, 64 nt, Homo Sapiens; identical to SEQ ID NO: 273477

SEQ ID NO: 274512 - RNA, 64 nt, Homo Sapiens; identical to SEQ ID NO: 273478

SEQ ID NO: 274513 - RNA, 64 nt, Homo Sapiens; identical to SEQ ID NO: 273479

SEQ ID NO: 274514 - RNA, 64 nt, Homo Sapiens; identical to SEQ ID NO: 273480

SEQ ID NO: 274515 - RNA, 64 nt, Homo Sapiens; identical to SEQ ID NO: 273481

SEQ ID NO: 274516 - RNA, 64 nt, Homo Sapiens; identical to SEQ ID NO: 273482

SEQ ID NO: 274517 - RNA, 64 nt, Homo Sapiens; identical to SEQ ID NO: 273483

SEQ ID NO: 274518 - RNA, 64 nt, Homo Sapiens; identical to SEQ ID NO: 273484

SEQ ID NO: 274519 - RNA, 64 nt, Homo Sapiens; identical to SEQ ID NO: 273485

SEQ ID NO: 274520 - RNA, 64 nt, Homo Sapiens; identical to SEQ ID NO: 273486

SEQ ID NO: 274521 - RNA, 64 nt, Homo Sapiens; identical to SEQ ID NO: 273487

SEQ ID NO: 274522 - RNA, 64 nt, Homo Sapiens; identical to SEQ ID NO: 273488

SEQ ID NO: 274523 - RNA, 64 nt, Homo Sapiens; identical to SEQ ID NO: 273489

SEQ ID NO: 274524 - RNA, 64 nt, Homo Sapiens; identical to SEQ ID NO: 273490

SEQ ID NO: 274525 - RNA, 64 nt, Homo Sapiens; identical to SEQ ID NO: 273491

SEQ ID NO: 274526 - RNA, 64 nt, Homo Sapiens; identical to SEQ ID NO: 273492

SEQ ID NO: 274527 - RNA, 64 nt, Homo Sapiens; identical to SEQ ID NO: 273493

SEQ ID NO: 274528 - RNA, 64 nt, Homo Sapiens; identical to SEQ ID NO: 273494

SEQ ID NO: 274529 - RNA, 64 nt, Homo Sapiens; identical to SEQ ID NO: 273495

SEQ ID NO: 274530 - RNA, 64 nt, Homo Sapiens; identical to SEQ ID NO: 273496

SEQ ID NO: 274531 - RNA, 64 nt, Homo Sapiens; identical to SEQ ID NO: 273497

SEQ ID NO: 274532 - RNA, 64 nt, Homo Sapiens; identical to SEQ ID NO: 273498

SEQ ID NO: 274533 - RNA, 64 nt, Homo Sapiens; identical to SEQ ID NO: 273499

SEQ ID NO: 274534 - RNA, 64 nt, Homo Sapiens; identical to SEQ ID NO: 273500

SEQ ID NO: 274535 - RNA, 64 nt, Homo Sapiens; identical to SEQ ID NO: 273501

SEQ ID NO: 274536 - RNA, 64 nt, Homo Sapiens; identical to SEQ ID NO: 273502

SEQ ID NO: 274537 - RNA, 64 nt, Homo Sapiens; identical to SEQ ID NO: 273503

SEQ ID NO: 274538 - RNA, 64 nt, Homo Sapiens; identical to SEQ ID NO: 273504

SEQ ID NO: 274539 - RNA, 64 nt, Homo Sapiens; identical to SEQ ID NO: 273505

SEQ ID NO: 274540 - RNA, 64 nt, Homo Sapiens; identical to SEQ ID NO: 273506

SEQ ID NO: 274541 - RNA, 64 nt, Homo Sapiens; identical to SEQ ID NO: 273507

SEQ ID NO: 274542 - RNA, 64 nt, Homo Sapiens; identical to SEQ ID NO: 273508

SEQ ID NO: 274543 - RNA, 64 nt, Homo Sapiens; identical to SEQ ID NO: 273509

SEQ ID NO: 274544 - RNA, 64 nt, Homo Sapiens; identical to SEQ ID NO: 273510

SEQ ID NO: 274545 - RNA, 64 nt, Homo Sapiens; identical to SEQ ID NO: 273511

SEQ ID NO: 274546 - RNA, 64 nt, Homo Sapiens; identical to SEQ ID NO: 273512

SEQ ID NO: 274547 - RNA, 64 nt, Homo Sapiens; identical to SEQ ID NO: 273513

SEQ ID NO: 274548 - RNA, 64 nt, Homo Sapiens; identical to SEQ ID NO: 273514

SEQ ID NO: 274549 - RNA, 64 nt, Homo Sapiens; identical to SEQ ID NO: 273515

SEQ ID NO: 274550 - RNA, 64 nt, Homo Sapiens; identical to SEQ ID NO: 273516

SEQ ID NO: 274551 - RNA, 64 nt, Homo Sapiens; identical to SEQ ID NO: 273517

SEQ ID NO: 274552 - RNA, 64 nt, Homo Sapiens; identical to SEQ ID NO: 273518

SEQ ID NO: 274553 - RNA, 64 nt, Homo Sapiens; identical to SEQ ID NO: 273519

SEQ ID NO: 274554 - RNA, 64 nt, Homo Sapiens; identical to SEQ ID NO: 273520

SEQ ID NO: 274555 - RNA, 64 nt, Homo Sapiens; identical to SEQ ID NO: 273521

SEQ ID NO: 274556 - RNA, 64 nt, Homo Sapiens; identical to SEQ ID NO: 273522

SEQ ID NO: 274557 - RNA, 64 nt, Homo Sapiens; identical to SEQ ID NO: 273523

SEQ ID NO: 274558 - RNA, 64 nt, Homo Sapiens; identical to SEQ ID NO: 273524

SEQ ID NO: 274559 - RNA, 64 nt, Homo Sapiens; identical to SEQ ID NO: 273525

SEQ ID NO: 274560 - RNA, 64 nt, Homo Sapiens; identical to SEQ ID NO: 273526

SEQ ID NO: 274561 - RNA, 64 nt, Homo Sapiens; identical to SEQ ID NO: 273527

SEQ ID NO: 274562 - RNA, 64 nt, Homo Sapiens; identical to SEQ ID NO: 273528

SEQ ID NO: 274563 - RNA, 64 nt, Homo Sapiens; identical to SEQ ID NO: 273529

SEQ ID NO: 274564 - RNA, 64 nt, Homo Sapiens; identical to SEQ ID NO: 273530

SEQ ID NO: 274565 - RNA, 64 nt, Homo Sapiens; identical to SEQ ID NO: 273531

SEQ ID NO: 274566 - RNA, 64 nt, Homo Sapiens; identical to SEQ ID NO: 273532

SEQ ID NO: 274567 - RNA, 64 nt, Homo Sapiens; identical to SEQ ID NO: 273533

SEQ ID NO: 274568 - RNA, 64 nt, Homo Sapiens; identical to SEQ ID NO: 273534

SEQ ID NO: 274569 - RNA, 64 nt, Homo Sapiens; identical to SEQ ID NO: 273535

SEQ ID NO: 274570 - RNA, 64 nt, Homo Sapiens; identical to SEQ ID NO: 273536

SEQ ID NO: 274571 - RNA, 64 nt, Homo Sapiens; identical to SEQ ID NO: 273537

SEQ ID NO: 274572 - RNA, 64 nt, Homo Sapiens; identical to SEQ ID NO: 273538

SEQ ID NO: 274573 - RNA, 64 nt, Homo Sapiens; identical to SEQ ID NO: 273539

SEQ ID NO: 274574 - RNA, 64 nt, Homo Sapiens; identical to SEQ ID NO: 273540

SEQ ID NO: 274575 - RNA, 64 nt, Homo Sapiens; identical to SEQ ID NO: 273541

SEQ ID NO: 274576 - RNA, 64 nt, Homo Sapiens; identical to SEQ ID NO: 273542

SEQ ID NO: 274577 - RNA, 64 nt, Homo Sapiens; identical to SEQ ID NO: 273543

SEQ ID NO: 274578 - RNA, 64 nt, Homo Sapiens; identical to SEQ ID NO: 273544

SEQ ID NO: 274579 - RNA, 64 nt, Homo Sapiens; identical to SEQ ID NO: 273545

SEQ ID NO: 274580 - RNA, 64 nt, Homo Sapiens; identical to SEQ ID NO: 273546

SEQ ID NO: 274581 - RNA, 64 nt, Homo Sapiens; identical to SEQ ID NO: 273547

SEQ ID NO: 274582 - RNA, 64 nt, Homo Sapiens; identical to SEQ ID NO: 273548

SEQ ID NO: 274583 - RNA, 64 nt, Homo Sapiens; identical to SEQ ID NO: 273549

SEQ ID NO: 274584 - RNA, 64 nt, Homo Sapiens; identical to SEQ ID NO: 273550

SEQ ID NO: 274585 - RNA, 64 nt, Homo Sapiens; identical to SEQ ID NO: 273551

SEQ ID NO: 274586 - RNA, 64 nt, Homo Sapiens; identical to SEQ ID NO: 273552

SEQ ID NO: 274587 - RNA, 64 nt, Homo Sapiens; identical to SEQ ID NO: 273553

SEQ ID NO: 274588 - RNA, 64 nt, Homo Sapiens; identical to SEQ ID NO: 273554

SEQ ID NO: 274589 - RNA, 64 nt, Homo Sapiens; identical to SEQ ID NO: 273555

SEQ ID NO: 274590 - RNA, 64 nt, Homo Sapiens; identical to SEQ ID NO: 273556

SEQ ID NO: 274591 - RNA, 64 nt, Homo Sapiens; identical to SEQ ID NO: 273557

SEQ ID NO: 274592 - RNA, 64 nt, Homo Sapiens; identical to SEQ ID NO: 273558

SEQ ID NO: 274593 - RNA, 64 nt, Homo Sapiens; identical to SEQ ID NO: 273559

SEQ ID NO: 274594 - RNA, 64 nt, Homo Sapiens; identical to SEQ ID NO: 273560

SEQ ID NO: 274595 - RNA, 64 nt, Homo Sapiens; identical to SEQ ID NO: 273561

SEQ ID NO: 274596 - RNA, 64 nt, Homo Sapiens; identical to SEQ ID NO: 273562

SEQ ID NO: 274597 - RNA, 64 nt, Homo Sapiens; identical to SEQ ID NO: 273563

SEQ ID NO: 274598 - RNA, 64 nt, Homo Sapiens; identical to SEQ ID NO: 273564

SEQ ID NO: 274599 - RNA, 64 nt, Homo Sapiens; identical to SEQ ID NO: 273565

SEQ ID NO: 274600 - RNA, 64 nt, Homo Sapiens; identical to SEQ ID NO: 273566

SEQ ID NO: 274601 - RNA, 64 nt, Homo Sapiens; identical to SEQ ID NO: 273567

SEQ ID NO: 274602 - RNA, 64 nt, Homo Sapiens; identical to SEQ ID NO: 273568

SEQ ID NO: 274603 - RNA, 64 nt, Homo Sapiens; identical to SEQ ID NO: 273569

SEQ ID NO: 274604 - RNA, 64 nt, Homo Sapiens; identical to SEQ ID NO: 273570

SEQ ID NO: 274605 - RNA, 64 nt, Homo Sapiens; identical to SEQ ID NO: 273571

SEQ ID NO: 274606 - RNA, 64 nt, Homo Sapiens; identical to SEQ ID NO: 273572

SEQ ID NO: 274607 - RNA, 64 nt, Homo Sapiens; identical to SEQ ID NO: 273573

SEQ ID NO: 274608 - RNA, 64 nt, Homo Sapiens; identical to SEQ ID NO: 273574

SEQ ID NO: 274609 - RNA, 64 nt, Homo Sapiens; identical to SEQ ID NO: 273575

SEQ ID NO: 274610 - RNA, 64 nt, Homo Sapiens; identical to SEQ ID NO: 273576

SEQ ID NO: 274611 - RNA, 64 nt, Homo Sapiens; identical to SEQ ID NO: 273577

SEQ ID NO: 274612 - RNA, 64 nt, Homo Sapiens; identical to SEQ ID NO: 273578

SEQ ID NO: 274613 - RNA, 64 nt, Homo Sapiens; identical to SEQ ID NO: 273579

SEQ ID NO: 274614 - RNA, 64 nt, Homo Sapiens; identical to SEQ ID NO: 273580

SEQ ID NO: 274615 - RNA, 64 nt, Homo Sapiens; identical to SEQ ID NO: 273581

SEQ ID NO: 274616 - RNA, 64 nt, Homo Sapiens; identical to SEQ ID NO: 273582

SEQ ID NO: 274617 - RNA, 64 nt, Homo Sapiens; identical to SEQ ID NO: 273583

SEQ ID NO: 274618 - RNA, 64 nt, Homo Sapiens; identical to SEQ ID NO: 273584

SEQ ID NO: 274619 - RNA, 64 nt, Homo Sapiens; identical to SEQ ID NO: 273585

SEQ ID NO: 274620 - RNA, 64 nt, Homo Sapiens; identical to SEQ ID NO: 273585

SEQ ID NO: 274621 - RNA, 64 nt, Homo Sapiens; identical to SEQ ID NO: 273587

SEQ ID NO: 274622 - RNA, 64 nt, Homo Sapiens; identical to SEQ ID NO: 273588

SEQ ID NO: 274623 - RNA, 64 nt, Homo Sapiens; identical to SEQ ID NO: 273589

SEQ ID NO: 274624 - RNA, 64 nt, Homo Sapiens; identical to SEQ ID NO: 273590

SEQ ID NO: 274625 - RNA, 64 nt, Homo Sapiens; identical to SEQ ID NO: 273591

SEQ ID NO: 274626 - RNA, 64 nt, Homo Sapiens; identical to SEQ ID NO: 273592

SEQ ID NO: 274627 - RNA, 64 nt, Homo Sapiens; identical to SEQ ID NO: 273593

SEQ ID NO: 274628 - RNA, 64 nt, Homo Sapiens; identical to SEQ ID NO: 273594

SEQ ID NO: 274629 - RNA, 64 nt, Homo Sapiens; identical to SEQ ID NO: 273595

SEQ ID NO: 274630 - RNA, 64 nt, Homo Sapiens; identical to SEQ ID NO: 273596

SEQ ID NO: 274631 - RNA, 64 nt, Homo Sapiens; identical to SEQ ID NO: 273597

SEQ ID NO: 274632 - RNA, 64 nt, Homo Sapiens; identical to SEQ ID NO: 273598

SEQ ID NO: 274633 - RNA, 64 nt, Homo Sapiens; identical to SEQ ID NO: 273599

SEQ ID NO: 274634 - RNA, 64 nt, Homo Sapiens; identical to SEQ ID NO: 273600

SEQ ID NO: 274635 - RNA, 64 nt, Homo Sapiens; identical to SEQ ID NO: 273601

SEQ ID NO: 274636 - RNA, 64 nt, Homo Sapiens; identical to SEQ ID NO: 273602

SEQ ID NO: 274637 - RNA, 64 nt, Homo Sapiens; identical to SEQ ID NO: 273603

SEQ ID NO: 274638 - RNA, 64 nt, Homo Sapiens; identical to SEQ ID NO: 273604

SEQ ID NO: 274639 - RNA, 64 nt, Homo Sapiens; identical to SEQ ID NO: 273605

SEQ ID NO: 274640 - RNA, 64 nt, Homo Sapiens; identical to SEQ ID NO: 273606

SEQ ID NO: 274641 - RNA, 64 nt, Homo Sapiens; identical to SEQ ID NO: 273607

SEQ ID NO: 274642 - RNA, 64 nt, Homo Sapiens; identical to SEQ ID NO: 273608

SEQ ID NO: 274643 - RNA, 64 nt, Homo Sapiens; identical to SEQ ID NO: 273609

SEQ ID NO: 274644 - RNA, 64 nt, Homo Sapiens; identical to SEQ ID NO: 273610

SEQ ID NO: 274645 - RNA, 64 nt, Homo Sapiens; identical to SEQ ID NO: 273611

SEQ ID NO: 274646 - RNA, 64 nt, Homo Sapiens; identical to SEQ ID NO: 273612

SEQ ID NO: 274647 - RNA, 64 nt, Homo Sapiens; identical to SEQ ID NO: 273613

SEQ ID NO: 274648 - RNA, 64 nt, Homo Sapiens; identical to SEQ ID NO: 273614

SEQ ID NO: 274649 - RNA, 64 nt, Homo Sapiens; identical to SEQ ID NO: 273615

SEQ ID NO: 274650 - RNA, 64 nt, Homo Sapiens; identical to SEQ ID NO: 273616

SEQ ID NO: 274651 - RNA, 64 nt, Homo Sapiens; identical to SEQ ID NO: 273617

SEQ ID NO: 274652 - RNA, 64 nt, Homo Sapiens; identical to SEQ ID NO: 273618

SEQ ID NO: 274653 - RNA, 64 nt, Homo Sapiens; identical to SEQ ID NO: 273619

SEQ ID NO: 274654 - RNA, 64 nt, Homo Sapiens; identical to SEQ ID NO: 273620

SEQ ID NO: 274655 - RNA, 64 nt, Homo Sapiens; identical to SEQ ID NO: 273621

SEQ ID NO: 274656 - RNA, 64 nt, Homo Sapiens; identical to SEQ ID NO: 273622

SEQ ID NO: 274657 - RNA, 64 nt, Homo Sapiens; identical to SEQ ID NO: 273623

SEQ ID NO: 274658 - RNA, 64 nt, Homo Sapiens; identical to SEQ ID NO: 273624

SEQ ID NO: 274659 - RNA, 64 nt, Homo Sapiens; identical to SEQ ID NO: 273625

SEQ ID NO: 274660 - RNA, 64 nt, Homo Sapiens; identical to SEQ ID NO: 273626

SEQ ID NO: 274661 - RNA, 64 nt, Homo Sapiens; identical to SEQ ID NO: 273627

SEQ ID NO: 274662 - RNA, 64 nt, Homo Sapiens; identical to SEQ ID NO: 273628

SEQ ID NO: 274663 - RNA, 64 nt, Homo Sapiens; identical to SEQ ID NO: 273629

SEQ ID NO: 274664 - RNA, 64 nt, Homo Sapiens; identical to SEQ ID NO: 273630

SEQ ID NO: 274665 - RNA, 64 nt, Homo Sapiens; identical to SEQ ID NO: 273631

SEQ ID NO: 274666 - RNA, 64 nt, Homo Sapiens
uacagcgcucucucugcuucucucuugcauagacacaaucaagacaauagugcaccguuccuua

SEQ ID NO: 274667 - RNA, 64 nt, Homo Sapiens
gagcaugaagcccaguggcaccaaauggcuggguacaaucaagugauauuuuguagcaccucac

SEQ ID NO: 274668 - RNA, 61 nt, Homo Sapiens
aacaugcgaacacugcucacacgcgaguuuucacaguuauuucuauccacgccuaugaauc

SEQ ID NO: 274669 - RNA, 61 nt, Homo Sapiens
aaugugaagaaagugugaauuuuaguuuugucacaguuaacugugucaaagagaauuaaaa

SEQ ID NO: 274670 - RNA, 61 nt, Homo Sapiens
gagaaucauguuucuuugauauucaaaaagucacaguuaaguucagaaauacagauaaaug

SEQ ID NO: 274671 - RNA, 61 nt, Homo Sapiens
acauacacaucagccaucaauuuaaauugcucacaguuauuaucucacauuuuuauaccug

SEQ ID NO: 274672 - RNA, 64 nt, Homo Sapiens; identical to SEQ ID NO: 76027

SEQ ID NO: 274673 - RNA, 64 nt, Homo Sapiens; identical to SEQ ID NO: 76028

SEQ ID NO: 274674 - RNA, 64 nt, Homo Sapiens; identical to SEQ ID NO: 76029

SEQ ID NO: 274675 - RNA, 64 nt, Homo Sapiens; identical to SEQ ID NO: 76030

SEQ ID NO: 274676 - RNA, 64 nt, Homo Sapiens; identical to SEQ ID NO: 76031

SEQ ID NO: 274677 - RNA, 64 nt, Homo Sapiens; identical to SEQ ID NO: 76032

SEQ ID NO: 274678 - RNA, 64 nt, Homo Sapiens; identical to SEQ ID NO: 76033

SEQ ID NO: 274679 - RNA, 64 nt, Homo Sapiens; identical to SEQ ID NO: 76034

SEQ ID NO: 274680 - RNA, 64 nt, Homo Sapiens; identical to SEQ ID NO: 76035

SEQ ID NO: 274681 - RNA, 64 nt, Homo Sapiens; identical to SEQ ID NO: 76036

SEQ ID NO: 274682 - RNA, 64 nt, Homo Sapiens; identical to SEQ ID NO: 76037

SEQ ID NO: 274683 - RNA, 64 nt, Homo Sapiens; identical to SEQ ID NO: 76038

SEQ ID NO: 274684 - RNA, 64 nt, Homo Sapiens; identical to SEQ ID NO: 76039

SEQ ID NO: 274685 - RNA, 64 nt, Homo Sapiens; identical to SEQ ID NO: 76040

SEQ ID NO: 274686 - RNA, 64 nt, Homo Sapiens; identical to SEQ ID NO: 76041

SEQ ID NO: 274687 - RNA, 64 nt, Homo Sapiens; identical to SEQ ID NO: 76042

SEQ ID NO: 274688 - RNA, 64 nt, Homo Sapiens; identical to SEQ ID NO: 76043

SEQ ID NO: 274689 - RNA, 64 nt, Homo Sapiens; identical to SEQ ID NO: 76044

SEQ ID NO: 274690 - RNA, 64 nt, Homo Sapiens; identical to SEQ ID NO: 76045

SEQ ID NO: 274691 - RNA, 64 nt, Homo Sapiens; identical to SEQ ID NO: 76046

SEQ ID NO: 274692 - RNA, 64 nt, Homo Sapiens; identical to SEQ ID NO: 76047

SEQ ID NO: 274693 - RNA, 64 nt, Homo Sapiens; identical to SEQ ID NO: 76048

SEQ ID NO: 274694 - RNA, 64 nt, Homo Sapiens; identical to SEQ ID NO: 76049

SEQ ID NO: 274695 - RNA, 64 nt, Homo Sapiens; identical to SEQ ID NO: 76050

SEQ ID NO: 274696 - RNA, 64 nt, Homo Sapiens; identical to SEQ ID NO: 76051

SEQ ID NO: 274697 - RNA, 64 nt, Homo Sapiens; identical to SEQ ID NO: 76052

SEQ ID NO: 274698 - RNA, 64 nt, Homo Sapiens; identical to SEQ ID NO: 76053

SEQ ID NO: 274699 - RNA, 64 nt, Homo Sapiens; identical to SEQ ID NO: 76054

SEQ ID NO: 274700 - RNA, 64 nt, Homo Sapiens; identical to SEQ ID NO: 76055

SEQ ID NO: 274701 - RNA, 64 nt, Homo Sapiens; identical to SEQ ID NO: 76056

SEQ ID NO: 274702 - RNA, 64 nt, Homo Sapiens; identical to SEQ ID NO: 76057

SEQ ID NO: 274703 - RNA, 64 nt, Homo Sapiens; identical to SEQ ID NO: 76058

SEQ ID NO: 274704 - RNA, 52 nt, Homo Sapiens; identical to SEQ ID NO: 76059

SEQ ID NO: 274705 - RNA, 64 nt, Homo Sapiens; identical to SEQ ID NO: 76060

SEQ ID NO: 274706 - RNA, 64 nt, Homo Sapiens; identical to SEQ ID NO: 76061

SEQ ID NO: 274707 - RNA, 64 nt, Homo Sapiens; identical to SEQ ID NO: 76062

SEQ ID NO: 274708 - RNA, 64 nt, Homo Sapiens; identical to SEQ ID NO: 76062

SEQ ID NO: 274709 - RNA, 64 nt, Homo Sapiens; identical to SEQ ID NO: 76064

SEQ ID NO: 274710 - RNA, 64 nt, Homo Sapiens; identical to SEQ ID NO: 76065

SEQ ID NO: 274711 - RNA, 64 nt, Homo Sapiens; identical to SEQ ID NO: 76066

SEQ ID NO: 274712 - RNA, 64 nt, Homo Sapiens; identical to SEQ ID NO: 76067

SEQ ID NO: 274713 - RNA, 64 nt, Homo Sapiens; identical to SEQ ID NO: 76068

SEQ ID NO: 274714 - RNA, 64 nt, Homo Sapiens; identical to SEQ ID NO: 76069

SEQ ID NO: 274715 - RNA, 64 nt, Homo Sapiens; identical to SEQ ID NO: 76070

SEQ ID NO: 274716 - RNA, 64 nt, Homo Sapiens; identical to SEQ ID NO: 76071

SEQ ID NO: 274717 - RNA, 64 nt, Homo Sapiens; identical to SEQ ID NO: 76072

SEQ ID NO: 274718 - RNA, 64 nt, Homo Sapiens; identical to SEQ ID NO: 76073

SEQ ID NO: 274719 - RNA, 64 nt, Homo Sapiens; identical to SEQ ID NO: 76074

SEQ ID NO: 274720 - RNA, 64 nt, Homo Sapiens; identical to SEQ ID NO: 76075

SEQ ID NO: 274721 - RNA, 64 nt, Homo Sapiens; identical to SEQ ID NO: 76076

SEQ ID NO: 274722 - RNA, 64 nt, Homo Sapiens; identical to SEQ ID NO: 76077

SEQ ID NO: 274723 - RNA, 64 nt, Homo Sapiens; identical to SEQ ID NO: 76078

SEQ ID NO: 274724 - RNA, 64 nt, Homo Sapiens; identical to SEQ ID NO: 76079

SEQ ID NO: 274725 - RNA, 64 nt, Homo Sapiens; identical to SEQ ID NO: 76080

SEQ ID NO: 274726 - RNA, 64 nt, Homo Sapiens; identical to SEQ ID NO: 76081

SEQ ID NO: 274727 - RNA, 64 nt, Homo Sapiens; identical to SEQ ID NO: 76082

SEQ ID NO: 274728 - RNA, 64 nt, Homo Sapiens; identical to SEQ ID NO: 76083

SEQ ID NO: 274729 - RNA, 64 nt, Homo Sapiens; identical to SEQ ID NO: 76084

SEQ ID NO: 274730 - RNA, 64 nt, Homo Sapiens; identical to SEQ ID NO: 76085

SEQ ID NO: 274731 - RNA, 64 nt, Homo Sapiens; identical to SEQ ID NO: 76086

SEQ ID NO: 274732 - RNA, 64 nt, Homo Sapiens; identical to SEQ ID NO: 76087

SEQ ID NO: 274733 - RNA, 64 nt, Homo Sapiens; identical to SEQ ID NO: 76088

SEQ ID NO: 274734 - RNA, 64 nt, Homo Sapiens; identical to SEQ ID NO: 76089

SEQ ID NO: 274735 - RNA, 64 nt, Homo Sapiens; identical to SEQ ID NO: 76090

SEQ ID NO: 274736 - RNA, 64 nt, Homo Sapiens; identical to SEQ ID NO: 76090

SEQ ID NO: 274737 - RNA, 64 nt, Homo Sapiens
ccugugacauccuccagggcauuagcuccccgcuccacaagacaaccaaucccgaucggcucuu

SEQ ID NO: 274738 - RNA, 64 nt, Homo Sapiens
ccugugaucuggaaaucuacauuagcuccccgcuccacaagacaaccaaucccgaucggcucuu

SEQ ID NO: 274739 - RNA, 64 nt, Homo Sapiens
ccugugcuuuggaaauccacauuagcuccccgcuccacaagacaaccaaucccgaucggcucuu

SEQ ID NO: 274740 - RNA, 64 nt, Homo Sapiens
ucuuuaccaacaucuugaauauauauucuaguguccacaagauuuagcaaaaagauaaagcuug

SEQ ID NO: 274741 - RNA, 64 nt, Homo Sapiens
agaaaauguauugugauugaaauuauuuuguccuccacaagauggcucuaugaguauucuucca

SEQ ID NO: 274742 - RNA, 64 nt, Homo Sapiens
cucucucccuguccucagacccuggaaaagugaaccacaagacucccuccagugaggagcuggg

SEQ ID NO: 274743 - RNA, 64 nt, Homo Sapiens
uguguuuauuaauugacaaugacccaaaucucuuccacaagacuuaaaaccaaauucagggaca

SEQ ID NO: 274744 - RNA, 64 nt, Homo Sapiens; identical to SEQ ID NO: 76027

SEQ ID NO: 274745 - RNA, 64 nt, Homo Sapiens; identical to SEQ ID NO: 76028

SEQ ID NO: 274746 - RNA, 64 nt, Homo Sapiens; identical to SEQ ID NO: 76029

SEQ ID NO: 274747 - RNA, 64 nt, Homo Sapiens; identical to SEQ ID NO: 76030

SEQ ID NO: 274748 - RNA, 64 nt, Homo Sapiens; identical to SEQ ID NO: 76031

SEQ ID NO: 274749 - RNA, 64 nt, Homo Sapiens; identical to SEQ ID NO: 76032

SEQ ID NO: 274750 - RNA, 64 nt, Homo Sapiens; identical to SEQ ID NO: 76033

SEQ ID NO: 274751 - RNA, 64 nt, Homo Sapiens; identical to SEQ ID NO: 76034

SEQ ID NO: 274752 - RNA, 64 nt, Homo Sapiens; identical to SEQ ID NO: 76035

SEQ ID NO: 274753 - RNA, 64 nt, Homo Sapiens; identical to SEQ ID NO: 76036

SEQ ID NO: 274754 - RNA, 64 nt, Homo Sapiens; identical to SEQ ID NO: 76037

SEQ ID NO: 274755 - RNA, 64 nt, Homo Sapiens; identical to SEQ ID NO: 76038

SEQ ID NO: 274756 - RNA, 64 nt, Homo Sapiens; identical to SEQ ID NO: 76039

SEQ ID NO: 274757 - RNA, 64 nt, Homo Sapiens; identical to SEQ ID NO: 76040

SEQ ID NO: 274758 - RNA, 64 nt, Homo Sapiens; identical to SEQ ID NO: 76041

SEQ ID NO: 274759 - RNA, 64 nt, Homo Sapiens; identical to SEQ ID NO: 76042

SEQ ID NO: 274760 - RNA, 64 nt, Homo Sapiens; identical to SEQ ID NO: 76043

SEQ ID NO: 274761 - RNA, 64 nt, Homo Sapiens; identical to SEQ ID NO: 76044

SEQ ID NO: 274762 - RNA, 64 nt, Homo Sapiens; identical to SEQ ID NO: 76045

SEQ ID NO: 274763 - RNA, 64 nt, Homo Sapiens; identical to SEQ ID NO: 76046

SEQ ID NO: 274764 - RNA, 64 nt, Homo Sapiens; identical to SEQ ID NO: 76047

SEQ ID NO: 274765 - RNA, 64 nt, Homo Sapiens; identical to SEQ ID NO: 76048

SEQ ID NO: 274766 - RNA, 64 nt, Homo Sapiens; identical to SEQ ID NO: 76049

SEQ ID NO: 274767 - RNA, 64 nt, Homo Sapiens; identical to SEQ ID NO: 76050

SEQ ID NO: 274768 - RNA, 64 nt, Homo Sapiens; identical to SEQ ID NO: 76051

SEQ ID NO: 274769 - RNA, 64 nt, Homo Sapiens; identical to SEQ ID NO: 76052

SEQ ID NO: 274770 - RNA, 64 nt, Homo Sapiens; identical to SEQ ID NO: 76053

SEQ ID NO: 274771 - RNA, 64 nt, Homo Sapiens; identical to SEQ ID NO: 76054

SEQ ID NO: 274772 - RNA, 64 nt, Homo Sapiens; identical to SEQ ID NO: 76055

SEQ ID NO: 274773 - RNA, 64 nt, Homo Sapiens; identical to SEQ ID NO: 76056

SEQ ID NO: 274774 - RNA, 64 nt, Homo Sapiens; identical to SEQ ID NO: 76057

SEQ ID NO: 274775 - RNA, 64 nt, Homo Sapiens; identical to SEQ ID NO: 76058

SEQ ID NO: 274776 - RNA, 52 nt, Homo Sapiens; identical to SEQ ID NO: 76059

SEQ ID NO: 274777 - RNA, 64 nt, Homo Sapiens; identical to SEQ ID NO: 76060

SEQ ID NO: 274778 - RNA, 64 nt, Homo Sapiens; identical to SEQ ID NO: 76061

SEQ ID NO: 274779 - RNA, 64 nt, Homo Sapiens; identical to SEQ ID NO: 76062

SEQ ID NO: 274780 - RNA, 64 nt, Homo Sapiens; identical to SEQ ID NO: 76062

SEQ ID NO: 274781 - RNA, 64 nt, Homo Sapiens; identical to SEQ ID NO: 76064

SEQ ID NO: 274782 - RNA, 64 nt, Homo Sapiens; identical to SEQ ID NO: 76065

SEQ ID NO: 274783 - RNA, 64 nt, Homo Sapiens; identical to SEQ ID NO: 76066

SEQ ID NO: 274784 - RNA, 64 nt, Homo Sapiens; identical to SEQ ID NO: 76067

SEQ ID NO: 274785 - RNA, 64 nt, Homo Sapiens; identical to SEQ ID NO: 76068

SEQ ID NO: 274786 - RNA, 64 nt, Homo Sapiens; identical to SEQ ID NO: 76069

SEQ ID NO: 274787 - RNA, 64 nt, Homo Sapiens; identical to SEQ ID NO: 76070

SEQ ID NO: 274788 - RNA, 64 nt, Homo Sapiens; identical to SEQ ID NO: 76071

SEQ ID NO: 274789 - RNA, 64 nt, Homo Sapiens; identical to SEQ ID NO: 76072

SEQ ID NO: 274790 - RNA, 64 nt, Homo Sapiens; identical to SEQ ID NO: 76073

SEQ ID NO: 274791 - RNA, 64 nt, Homo Sapiens; identical to SEQ ID NO: 76074

SEQ ID NO: 274792 - RNA, 64 nt, Homo Sapiens; identical to SEQ ID NO: 76075

SEQ ID NO: 274793 - RNA, 64 nt, Homo Sapiens; identical to SEQ ID NO: 76076

SEQ ID NO: 274794 - RNA, 64 nt, Homo Sapiens; identical to SEQ ID NO: 76077

SEQ ID NO: 274795 - RNA, 64 nt, Homo Sapiens; identical to SEQ ID NO: 76078

SEQ ID NO: 274796 - RNA, 64 nt, Homo Sapiens; identical to SEQ ID NO: 76079

SEQ ID NO: 274797 - RNA, 64 nt, Homo Sapiens; identical to SEQ ID NO: 76080

SEQ ID NO: 274798 - RNA, 64 nt, Homo Sapiens; identical to SEQ ID NO: 76081

SEQ ID NO: 274799 - RNA, 64 nt, Homo Sapiens; identical to SEQ ID NO: 76082

SEQ ID NO: 274800 - RNA, 64 nt, Homo Sapiens; identical to SEQ ID NO: 76083

SEQ ID NO: 274801 - RNA, 64 nt, Homo Sapiens; identical to SEQ ID NO: 76084

SEQ ID NO: 274802 - RNA, 64 nt, Homo Sapiens; identical to SEQ ID NO: 76085

SEQ ID NO: 274803 - RNA, 64 nt, Homo Sapiens; identical to SEQ ID NO: 76086

SEQ ID NO: 274804 - RNA, 64 nt, Homo Sapiens; identical to SEQ ID NO: 76087

SEQ ID NO: 274805 - RNA, 64 nt, Homo Sapiens; identical to SEQ ID NO: 76088

SEQ ID NO: 274806 - RNA, 64 nt, Homo Sapiens; identical to SEQ ID NO: 76089

SEQ ID NO: 274807 - RNA, 64 nt, Homo Sapiens; identical to SEQ ID NO: 76090

SEQ ID NO: 274808 - RNA, 64 nt, Homo Sapiens; identical to SEQ ID NO: 76090

SEQ ID NO: 274809 - RNA, 64 nt, Homo Sapiens; identical to SEQ ID NO: 274737

SEQ ID NO: 274810 - RNA, 64 nt, Homo Sapiens; identical to SEQ ID NO: 274738

SEQ ID NO: 274811 - RNA, 64 nt, Homo Sapiens; identical to SEQ ID NO: 274739

SEQ ID NO: 274812 - RNA, 64 nt, Homo Sapiens; identical to SEQ ID NO: 274740

SEQ ID NO: 274813 - RNA, 64 nt, Homo Sapiens; identical to SEQ ID NO: 274741

SEQ ID NO: 274814 - RNA, 64 nt, Homo Sapiens; identical to SEQ ID NO: 274742

SEQ ID NO: 274815 - RNA, 64 nt, Homo Sapiens; identical to SEQ ID NO: 274743

SEQ ID NO: 274816 - RNA, 64 nt, Homo Sapiens
cuagccaggugcaguccccgccccgccuaguccucggcgucacgcaaugcucaccucgccucuu

SEQ ID NO: 274817 - RNA, 64 nt, Homo Sapiens
aaaaugagcugagaaggaguguuauggccaggugcggcgucaugcaccuauagucccagcugcu

SEQ ID NO: 274818 - RNA, 64 nt, Homo Sapiens
aaccaggcuccugugaggacaacagccugggccucggcgucaaucaucgauaagaagccucuac

SEQ ID NO: 274819 - RNA, 64 nt, Homo Sapiens
gagauugacccacaauaaagcacaggccuuaccgcggcgucacccucucccacuccuuuguucu

SEQ ID NO: 274820 - RNA, 64 nt, Homo Sapiens
cuccagccucuguuccccuaagaccccuggccuccggcgucagcaccccccacacucacuccug

SEQ ID NO: 274821 - RNA, 64 nt, Homo Sapiens
ggugcugggugacagagccacgaaggcuaggaggcggcgucagaauuccugguuaucucaccaa

SEQ ID NO: 274822 - RNA, 64 nt, Homo Sapiens
gaccgcugcuucccucaccugcuuauaauaaagccggcgucagaccugccucgugccaccucau

SEQ ID NO: 274823 - RNA, 64 nt, Homo Sapiens
aguuuaccaagugcaaauccaagaagacccagaacggcgucacuucucagacacugaagaacuc

SEQ ID NO: 274824 - RNA, 64 nt, Homo Sapiens
uauuacggugacuugaaugucagauucaagggcccggcgucaaaggaaauugguuuugacuuuu

SEQ ID NO: 274825 - RNA, 64 nt, Homo Sapiens
cuuuuucuguuguaacuuaucaguuugguauuugcggcgucaguaaucuguguauauuauuugg

SEQ ID NO: 274826 - RNA, 64 nt, Homo Sapiens
uacuguguauucuuaugaaugaacaucaugaaagcggcgucauggguuaguuuucuuuguucca

SEQ ID NO: 274827 - RNA, 64 nt, Homo Sapiens
ucacacaaggggaaagggcgccaagccaaggagccggcgucauccgacguaacuuccgcccuuu

SEQ ID NO: 274828 - RNA, 64 nt, Homo Sapiens
accaagcugccggccacuguucccugcacgcacacggcgucaaauuguuuuguccaugccuucc

SEQ ID NO: 274829 - RNA, 64 nt, Homo Sapiens
acacauacacacucacugaucuacagccccuguucggcgucagaguccccacuagacccagugg

SEQ ID NO: 274830 - RNA, 64 nt, Homo Sapiens
cuuuucuuugcgauguccucagacucggccgcagcggcgucagauguuucugugcuccaaguug

SEQ ID NO: 274831 - RNA, 64 nt, Homo Sapiens
gaagagaggcggggccgcguccuccuggcgucaccggcgucacugucauuccuuggugucugug

SEQ ID NO: 274832 - RNA, 64 nt, Homo Sapiens
gggauagcggguggugagggcauuaggcggacugcggcgucaggugaguuggccucgcccggac

SEQ ID NO: 274833 - RNA, 64 nt, Homo Sapiens; identical to SEQ ID NO: 71880

SEQ ID NO: 274834 - RNA, 64 nt, Homo Sapiens; identical to SEQ ID NO: 71881

SEQ ID NO: 274835 - RNA, 64 nt, Homo Sapiens; identical to SEQ ID NO: 71882

SEQ ID NO: 274836 - RNA, 64 nt, Homo Sapiens; identical to SEQ ID NO: 71883

SEQ ID NO: 274837 - RNA, 64 nt, Homo Sapiens; identical to SEQ ID NO: 71884

SEQ ID NO: 274838 - RNA, 64 nt, Homo Sapiens; identical to SEQ ID NO: 71885

SEQ ID NO: 274839 - RNA, 64 nt, Homo Sapiens; identical to SEQ ID NO: 71886

SEQ ID NO: 274840 - RNA, 64 nt, Homo Sapiens; identical to SEQ ID NO: 71887

SEQ ID NO: 274841 - RNA, 64 nt, Homo Sapiens; identical to SEQ ID NO: 71888

SEQ ID NO: 274842 - RNA, 64 nt, Homo Sapiens; identical to SEQ ID NO: 71889

SEQ ID NO: 274843 - RNA, 64 nt, Homo Sapiens; identical to SEQ ID NO: 71890

SEQ ID NO: 274844 - RNA, 64 nt, Homo Sapiens; identical to SEQ ID NO: 71891

SEQ ID NO: 274845 - RNA, 64 nt, Homo Sapiens; identical to SEQ ID NO: 71892

SEQ ID NO: 274846 - RNA, 64 nt, Homo Sapiens; identical to SEQ ID NO: 71893

SEQ ID NO: 274847 - RNA, 64 nt, Homo Sapiens; identical to SEQ ID NO: 71894

SEQ ID NO: 274848 - RNA, 64 nt, Homo Sapiens; identical to SEQ ID NO: 71895

SEQ ID NO: 274849 - RNA, 64 nt, Homo Sapiens; identical to SEQ ID NO: 71896

SEQ ID NO: 274850 - RNA, 64 nt, Homo Sapiens; identical to SEQ ID NO: 71897

SEQ ID NO: 274851 - RNA, 64 nt, Homo Sapiens; identical to SEQ ID NO: 71898

SEQ ID NO: 274852 - RNA, 64 nt, Homo Sapiens; identical to SEQ ID NO: 71899

SEQ ID NO: 274853 - RNA, 64 nt, Homo Sapiens; identical to SEQ ID NO: 71900

SEQ ID NO: 274854 - RNA, 64 nt, Homo Sapiens; identical to SEQ ID NO: 147936

SEQ ID NO: 274855 - RNA, 64 nt, Homo Sapiens; identical to SEQ ID NO: 147937

SEQ ID NO: 274856 - RNA, 64 nt, Homo Sapiens; identical to SEQ ID NO: 147938

SEQ ID NO: 274857 - RNA, 64 nt, Homo Sapiens; identical to SEQ ID NO: 147939

SEQ ID NO: 274858 - RNA, 64 nt, Homo Sapiens; identical to SEQ ID NO: 147940

SEQ ID NO: 274859 - RNA, 64 nt, Homo Sapiens; identical to SEQ ID NO: 147941

SEQ ID NO: 274860 - RNA, 64 nt, Homo Sapiens; identical to SEQ ID NO: 94750

SEQ ID NO: 274861 - RNA, 64 nt, Homo Sapiens; identical to SEQ ID NO: 94751

SEQ ID NO: 274862 - RNA, 64 nt, Homo Sapiens; identical to SEQ ID NO: 94752

SEQ ID NO: 274863 - RNA, 64 nt, Homo Sapiens; identical to SEQ ID NO: 94753

SEQ ID NO: 274864 - RNA, 64 nt, Homo Sapiens; identical to SEQ ID NO: 94754

SEQ ID NO: 274865 - RNA, 64 nt, Homo Sapiens; identical to SEQ ID NO: 94755

SEQ ID NO: 274866 - RNA, 64 nt, Homo Sapiens; identical to SEQ ID NO: 94756

SEQ ID NO: 274867 - RNA, 64 nt, Homo Sapiens; identical to SEQ ID NO: 94757

SEQ ID NO: 274868 - RNA, 64 nt, Homo Sapiens; identical to SEQ ID NO: 94758

SEQ ID NO: 274869 - RNA, 64 nt, Homo Sapiens; identical to SEQ ID NO: 94759

SEQ ID NO: 274870 - RNA, 64 nt, Homo Sapiens; identical to SEQ ID NO: 94760

SEQ ID NO: 274871 - RNA, 64 nt, Homo Sapiens; identical to SEQ ID NO: 94761

SEQ ID NO: 274872 - RNA, 64 nt, Homo Sapiens; identical to SEQ ID NO: 94762

SEQ ID NO: 274873 - RNA, 64 nt, Homo Sapiens; identical to SEQ ID NO: 94763

SEQ ID NO: 274874 - RNA, 64 nt, Homo Sapiens; identical to SEQ ID NO: 94764

SEQ ID NO: 274875 - RNA, 64 nt, Homo Sapiens; identical to SEQ ID NO: 94765

SEQ ID NO: 274876 - RNA, 64 nt, Homo Sapiens; identical to SEQ ID NO: 94766

SEQ ID NO: 274877 - RNA, 64 nt, Homo Sapiens; identical to SEQ ID NO: 94767

SEQ ID NO: 274878 - RNA, 64 nt, Homo Sapiens; identical to SEQ ID NO: 94768

SEQ ID NO: 274879 - RNA, 64 nt, Homo Sapiens; identical to SEQ ID NO: 94769

SEQ ID NO: 274880 - RNA, 64 nt, Homo Sapiens; identical to SEQ ID NO: 94770

SEQ ID NO: 274881 - RNA, 64 nt, Homo Sapiens; identical to SEQ ID NO: 94771

SEQ ID NO: 274882 - RNA, 64 nt, Homo Sapiens; identical to SEQ ID NO: 94772

SEQ ID NO: 274883 - RNA, 64 nt, Homo Sapiens; identical to SEQ ID NO: 94773

SEQ ID NO: 274884 - RNA, 64 nt, Homo Sapiens; identical to SEQ ID NO: 94774

SEQ ID NO: 274885 - RNA, 64 nt, Homo Sapiens; identical to SEQ ID NO: 94775

SEQ ID NO: 274886 - RNA, 64 nt, Homo Sapiens; identical to SEQ ID NO: 94776

SEQ ID NO: 274887 - RNA, 64 nt, Homo Sapiens; identical to SEQ ID NO: 94777

SEQ ID NO: 274888 - RNA, 64 nt, Homo Sapiens; identical to SEQ ID NO: 94778

SEQ ID NO: 274889 - RNA, 64 nt, Homo Sapiens; identical to SEQ ID NO: 94779

SEQ ID NO: 274890 - RNA, 64 nt, Homo Sapiens; identical to SEQ ID NO: 94780

SEQ ID NO: 274891 - RNA, 64 nt, Homo Sapiens; identical to SEQ ID NO: 94781

SEQ ID NO: 274892 - RNA, 64 nt, Homo Sapiens; identical to SEQ ID NO: 94782

SEQ ID NO: 274893 - RNA, 64 nt, Homo Sapiens; identical to SEQ ID NO: 94783

SEQ ID NO: 274894 - RNA, 64 nt, Homo Sapiens; identical to SEQ ID NO: 94784

SEQ ID NO: 274895 - RNA, 64 nt, Homo Sapiens; identical to SEQ ID NO: 94785

SEQ ID NO: 274896 - RNA, 64 nt, Homo Sapiens; identical to SEQ ID NO: 94786

SEQ ID NO: 274897 - RNA, 64 nt, Homo Sapiens; identical to SEQ ID NO: 94787

SEQ ID NO: 274898 - RNA, 64 nt, Homo Sapiens; identical to SEQ ID NO: 94788

SEQ ID NO: 274899 - RNA, 64 nt, Homo Sapiens; identical to SEQ ID NO: 94789

SEQ ID NO: 274900 - RNA, 64 nt, Homo Sapiens; identical to SEQ ID NO: 94790

SEQ ID NO: 274901 - RNA, 64 nt, Homo Sapiens; identical to SEQ ID NO: 94791

SEQ ID NO: 274902 - RNA, 64 nt, Homo Sapiens; identical to SEQ ID NO: 94792

SEQ ID NO: 274903 - RNA, 64 nt, Homo Sapiens; identical to SEQ ID NO: 94793

SEQ ID NO: 274904 - RNA, 64 nt, Homo Sapiens; identical to SEQ ID NO: 94794

SEQ ID NO: 274905 - RNA, 64 nt, Homo Sapiens; identical to SEQ ID NO: 94795

SEQ ID NO: 274906 - RNA, 64 nt, Homo Sapiens; identical to SEQ ID NO: 94796

SEQ ID NO: 274907 - RNA, 64 nt, Homo Sapiens; identical to SEQ ID NO: 94797

SEQ ID NO: 274908 - RNA, 64 nt, Homo Sapiens; identical to SEQ ID NO: 94798

SEQ ID NO: 274909 - RNA, 64 nt, Homo Sapiens; identical to SEQ ID NO: 94799

SEQ ID NO: 274910 - RNA, 64 nt, Homo Sapiens; identical to SEQ ID NO: 94800

SEQ ID NO: 274911 - RNA, 64 nt, Homo Sapiens; identical to SEQ ID NO: 94801

SEQ ID NO: 274912 - RNA, 64 nt, Homo Sapiens; identical to SEQ ID NO: 94802

SEQ ID NO: 274913 - RNA, 64 nt, Homo Sapiens; identical to SEQ ID NO: 94803

SEQ ID NO: 274914 - RNA, 64 nt, Homo Sapiens; identical to SEQ ID NO: 94804

SEQ ID NO: 274915 - RNA, 64 nt, Homo Sapiens; identical to SEQ ID NO: 94805

SEQ ID NO: 274916 - RNA, 64 nt, Homo Sapiens; identical to SEQ ID NO: 94806

SEQ ID NO: 274917 - RNA, 64 nt, Homo Sapiens; identical to SEQ ID NO: 94807

SEQ ID NO: 274918 - RNA, 64 nt, Homo Sapiens; identical to SEQ ID NO: 94808

SEQ ID NO: 274919 - RNA, 64 nt, Homo Sapiens; identical to SEQ ID NO: 94809

SEQ ID NO: 274920 - RNA, 64 nt, Homo Sapiens; identical to SEQ ID NO: 94810

SEQ ID NO: 274921 - RNA, 64 nt, Homo Sapiens; identical to SEQ ID NO: 94811

SEQ ID NO: 274922 - RNA, 64 nt, Homo Sapiens; identical to SEQ ID NO: 94812

SEQ ID NO: 274923 - RNA, 64 nt, Homo Sapiens; identical to SEQ ID NO: 94813

SEQ ID NO: 274924 - RNA, 64 nt, Homo Sapiens; identical to SEQ ID NO: 94814

SEQ ID NO: 274925 - RNA, 64 nt, Homo Sapiens; identical to SEQ ID NO: 94815

SEQ ID NO: 274926 - RNA, 64 nt, Homo Sapiens; identical to SEQ ID NO: 94816

SEQ ID NO: 274927 - RNA, 64 nt, Homo Sapiens; identical to SEQ ID NO: 94817

SEQ ID NO: 274928 - RNA, 64 nt, Homo Sapiens; identical to SEQ ID NO: 94818

SEQ ID NO: 274929 - RNA, 64 nt, Homo Sapiens; identical to SEQ ID NO: 94819

SEQ ID NO: 274930 - RNA, 64 nt, Homo Sapiens; identical to SEQ ID NO: 94820

SEQ ID NO: 274931 - RNA, 64 nt, Homo Sapiens; identical to SEQ ID NO: 94821

SEQ ID NO: 274932 - RNA, 64 nt, Homo Sapiens; identical to SEQ ID NO: 94822

SEQ ID NO: 274933 - RNA, 64 nt, Homo Sapiens; identical to SEQ ID NO: 94823

SEQ ID NO: 274934 - RNA, 64 nt, Homo Sapiens; identical to SEQ ID NO: 94824

SEQ ID NO: 274935 - RNA, 64 nt, Homo Sapiens; identical to SEQ ID NO: 94825

SEQ ID NO: 274936 - RNA, 64 nt, Homo Sapiens; identical to SEQ ID NO: 94826

SEQ ID NO: 274937 - RNA, 64 nt, Homo Sapiens; identical to SEQ ID NO: 94827

SEQ ID NO: 274938 - RNA, 64 nt, Homo Sapiens; identical to SEQ ID NO: 94828

SEQ ID NO: 274939 - RNA, 64 nt, Homo Sapiens; identical to SEQ ID NO: 94829

SEQ ID NO: 274940 - RNA, 64 nt, Homo Sapiens; identical to SEQ ID NO: 94830

SEQ ID NO: 274941 - RNA, 64 nt, Homo Sapiens; identical to SEQ ID NO: 94831

SEQ ID NO: 274942 - RNA, 64 nt, Homo Sapiens; identical to SEQ ID NO: 94832

SEQ ID NO: 274943 - RNA, 64 nt, Homo Sapiens; identical to SEQ ID NO: 94833

SEQ ID NO: 274944 - RNA, 64 nt, Homo Sapiens; identical to SEQ ID NO: 94834

SEQ ID NO: 274945 - RNA, 64 nt, Homo Sapiens; identical to SEQ ID NO: 94835

SEQ ID NO: 274946 - RNA, 64 nt, Homo Sapiens
acaaagucacagacauccuggaaaggucauuucucccacacacgauuauauucccacauccuga

SEQ ID NO: 274947 - RNA, 64 nt, Homo Sapiens
acauccucugccagucuuaaccagugauagaaaacccacacaauguuuuaaauuuuucucaguu

SEQ ID NO: 274948 - RNA, 64 nt, Homo Sapiens
uccagcaauggaaaugcuugcauucccucaugcucccacacaagaagaagccuuacucccugca

SEQ ID NO: 274949 - RNA, 64 nt, Homo Sapiens
ccccugcagccuccccagaucccugaagguugaacccacacacauggaagcugaaauugaugau

SEQ ID NO: 274950 - RNA, 64 nt, Homo Sapiens
ucccaguauuucaucaaggacagggaauaucccucccacacacaggccagcugcucacccugcc

SEQ ID NO: 274951 - RNA, 64 nt, Homo Sapiens
uccuuggacagcagauccacacaccacuuccccacccacacacaguacccugggcugguuggac

SEQ ID NO: 274952 - RNA, 64 nt, Homo Sapiens
agcuuggaggagcccagagaccguuugcuuuauacccacacagcaacugguccacugcuuuacu

SEQ ID NO: 274953 - RNA, 64 nt, Homo Sapiens
uaggaaacagacuaugauuaauccauuuauucuucccacacacuuaccuuacuaagucuuugcu

SEQ ID NO: 274954 - RNA, 64 nt, Homo Sapiens
aguaggggcagugccacuuucuacaaccugccaacccacacacuggaguaauucugaaaaaaau

SEQ ID NO: 274955 - RNA, 64 nt, Homo Sapiens
ucaucugcauuguuauuggaccccaccacccacccccacacacggucucuccuucucucucucc

SEQ ID NO: 274956 - RNA, 64 nt, Homo Sapiens
cauaguucugccuccccagcccacaaccugguuccccacacauccuugucgcuuuuaggaccuc

SEQ ID NO: 274957 - RNA, 64 nt, Homo Sapiens
uccgccccggugcacccccggaggggcccugcuucccacacaaaccgcggggccugugagcgga

SEQ ID NO: 274958 - RNA, 64 nt, Homo Sapiens
cugccaugcacacaggaggacccaaccccugaaccccacacacucccaggaucacaccucgaca

SEQ ID NO: 274959 - RNA, 64 nt, Homo Sapiens
ucugcccuagagccaccucugcaaagccccuggucccacacagcuggaguugaggcuguuguca

SEQ ID NO: 274960 - RNA, 64 nt, Homo Sapiens
gagccugcacagcaagccaggcuggcaccauagacccacacaagugggagagcagccauccccu

SEQ ID NO: 274961 - RNA, 64 nt, Homo Sapiens
ugcuuccacuugcagagcaccgugccaagcacuucccacacacuuacccguuugauucuccuag

SEQ ID NO: 274962 - RNA, 64 nt, Homo Sapiens
cccggggccacugguggcuccccagagccucagacccacacagcccagaggacgaggccuucaa

SEQ ID NO: 274963 - RNA, 64 nt, Homo Sapiens
aggcugccaccgcggccugaucaugcccucugugcccacacaggucucugagcggccccugaug

SEQ ID NO: 274964 - RNA, 64 nt, Homo Sapiens
ucuuugcuggcuggcugccucugcugccccauaccccacacacucaucagccugaaguuagccc

SEQ ID NO: 274965 - RNA, 64 nt, Homo Sapiens
ccuauuuauugaaucugcuggcccacacaggcaccccacacaaacagucuccacagccauccug

SEQ ID NO: 274966 - RNA, 64 nt, Homo Sapiens
caccccacacaaaccuauuucacagccauccuggcccacacaggaguccaccagcuccagucuc

SEQ ID NO: 274967 - RNA, 64 nt, Homo Sapiens
cgcccgcccacuguccugggcccucccacacacacccacacacugaggccccuggcccagcggc

SEQ ID NO: 274968 - RNA, 64 nt, Homo Sapiens
cccacacacucgcccgcccagcccagcggccccucccacacacacccagagcaggaggccccug

SEQ ID NO: 274969 - RNA, 64 nt, Homo Sapiens
ugcacccuagcuucgugcuucugggcaggacccucccacacacccugguggggaauggcugggg

SEQ ID NO: 274970 - RNA, 64 nt, Homo Sapiens
cugagggagcccuacccuaggcuccggcuccgaccccacacaccagagaccugugcaaaucuga

SEQ ID NO: 274971 - RNA, 64 nt, Homo Sapiens
gcugcccugcccgucucagggccaccaagucugacccacacagcgucacucacucccacacaca

SEQ ID NO: 274972 - RNA, 64 nt, Homo Sapiens
gccaccaagucugacccacacagcgucacucacucccacacacacccccuggcucugcugaggu

SEQ ID NO: 274973 - RNA, 64 nt, Homo Sapiens
gggcagggaggggacuggggaagugcgcacacagcccacacagacaacacgcacccacacagac

SEQ ID NO: 274974 - RNA, 64 nt, Homo Sapiens
gaagugcgcacacagcccacacagacaacacgcacccacacagacacagagggaagggguuggg

SEQ ID NO: 274975 - RNA, 64 nt, Homo Sapiens
cuggugcccagagccggcuucagucacagaguaucccacacacaaagucuagauccuggcagcc

SEQ ID NO: 274976 - RNA, 64 nt, Homo Sapiens
ucagugaauggaucccaacacuuaaccacuggaucccacacaaauggauccuggaccucuacgu

SEQ ID NO: 274977 - RNA, 64 nt, Homo Sapiens
cccauagcuagcauucaacaccuggagucucacucccacacauguucccgcuucugaaacuccc

SEQ ID NO: 274978 - RNA, 64 nt, Homo Sapiens
ggauacuguuguucacgauaugcaugcacagcgccccacacauuccgaguuucuguccacacau

SEQ ID NO: 274979 - RNA, 64 nt, Homo Sapiens
ccccccccaccgaggccuagagagggggcaccuccccacacaccuggggggggccaggcuccag

SEQ ID NO: 274980 - RNA, 64 nt, Homo Sapiens
ugagggagaggcccagcccuggccgaggccuuggcccacacagccggggcucagccucccccug

SEQ ID NO: 274981 - RNA, 64 nt, Homo Sapiens
gacacuuccucuaggaugccugcggaugcagugucccacacaagcagccugggcuguguaugcc

SEQ ID NO: 274982 - RNA, 59 nt, Homo Sapiens
gcuugaaagccugugccagaaaagaggagcccacacaaaauucuggggagaagcuauag

SEQ ID NO: 274983 - RNA, 64 nt, Homo Sapiens
uuaguuuugcuuaagaaguuauguuacaacugaucagcccuauaugaauuaacugaucagcccu

SEQ ID NO: 274984 - RNA, 64 nt, Homo Sapiens
uuacaacugaucagcccuauaugaauuaacugaucagcccuauaugaaacauaaguuguguuau

SEQ ID NO: 274985 - RNA, 64 nt, Homo Sapiens
cuucucccuguuggccugaagggagcuuagaaugcagcccuaccuggagauagugcgggcaccu

SEQ ID NO: 274986 - RNA, 64 nt, Homo Sapiens
ugggaccgagccacccagccccacuauccccaagcagcccuacagccgggaugggaggcacgug

SEQ ID NO: 274987 - RNA, 64 nt, Homo Sapiens
gaaguuccuuuuaugcauugagccugacuccugccagcccuacguccuuccaguugucuugaac

SEQ ID NO: 274988 - RNA, 64 nt, Homo Sapiens
gaagugcuguuuacucauugugccugacuuaggccagcccuacauccuucagguuaucuugaac

SEQ ID NO: 274989 - RNA, 64 nt, Homo Sapiens
gaagugccuuuuacguauugugacugacucaugccagcccuacauccuucaguuuaucuuggac

SEQ ID NO: 274990 - RNA, 64 nt, Homo Sapiens
gggccauaacacuugaccaaggagcugaccaaagcagcccuaaccaugccucccucucauugga

SEQ ID NO: 274991 - RNA, 64 nt, Homo Sapiens
cccaugccucccucucauugaucccccauccucucagcccuauuuccaggagaccauaagauag

SEQ ID NO: 274992 - RNA, 64 nt, Homo Sapiens
uagaguacccauccaggcccagcccuacauuguccagcccuaccugcccaucacacagacgucc

SEQ ID NO: 274993 - RNA, 64 nt, Homo Sapiens
uuguccagcccuaccuagagaucacacagacguccagcccuacauuggcaguuccuuucugccc

SEQ ID NO: 274994 - RNA, 64 nt, Homo Sapiens
gcaucggcauaauuuucuuuccucuggcugaucccagcccuaaaggaaggguagacccgugucu

SEQ ID NO: 274995 - RNA, 64 nt, Homo Sapiens
ccagcccuaaaggaaggguagacccgugucuuuccagcccuaaaggaaggguagacccgugucu

SEQ ID NO: 274996 - RNA, 64 nt, Homo Sapiens
ccagcccuaaaggaaggguagacccgugucuuuccagcccuaaaggaagggcagacccgugucu

SEQ ID NO: 274997 - RNA, 64 nt, Homo Sapiens
guuuaucugcuguaauugaacauucagcuacccuauaacccaguuaauccaauacuggggauaa

SEQ ID NO: 274998 - RNA, 64 nt, Homo Sapiens
uagcaacccuauucacaaaagcaaaagccuagaaauaacccagaugcccaugagcaagagagug

SEQ ID NO: 274999 - RNA, 64 nt, Homo Sapiens
aaauauccaaguauaaagcccaggaacuucuagaauaacccagaugcgcuuuaauuuuuuuuaa

SEQ ID NO: 275000 - RNA, 64 nt, Homo Sapiens
uuuuuuaauauguuuugaucacagaacuucuagaauaacccagaugcucuuucauauucuuuua

SEQ ID NO: 275001 - RNA, 64 nt, Homo Sapiens; identical to SEQ ID NO: 209051

SEQ ID NO: 275002 - RNA, 64 nt, Homo Sapiens; identical to SEQ ID NO: 209052

SEQ ID NO: 275003 - RNA, 64 nt, Homo Sapiens; identical to SEQ ID NO: 209053

SEQ ID NO: 275004 - RNA, 64 nt, Homo Sapiens; identical to SEQ ID NO: 209054

SEQ ID NO: 275005 - RNA, 64 nt, Homo Sapiens
uggggucagauggugguggugagaggccuuggggcuggggaaggagaguggacuuuggcucacu

SEQ ID NO: 275006 - RNA, 64 nt, Homo Sapiens
gaguucacaggcuuauccccaggaagccucacuccuggggaaagacagauaauuucacugcccc

SEQ ID NO: 275007 - RNA, 64 nt, Homo Sapiens
ugaaaaccuuuggaaaaugagucaaacuucacagcuggggaaguguaucuucuuuguuuagcaa

SEQ ID NO: 275008 - RNA, 64 nt, Homo Sapiens
gcuguaguaucuucuuuguuccacaggagccacacuggggaaaauguguguguugggggagcuu

SEQ ID NO: 275009 - RNA, 64 nt, Homo Sapiens
gauuaaauaaaagcaacgcaaggcgauggaagggcuggggaaguggguuucuuauccucaaaaa

SEQ ID NO: 275010 - RNA, 64 nt, Homo Sapiens
caaucugauucugaagcuaauuuugggguggggucuggggaaggggagaugggagaggagccug

SEQ ID NO: 275011 - RNA, 64 nt, Homo Sapiens
caggccuuuuuaaaaaauucauuacagcaaacagcuggggaaggacaugcaguccucccccagc

SEQ ID NO: 275012 - RNA, 64 nt, Homo Sapiens
ucucccuuggggugggaaucuaugauggagguuacuggggaaacagcucagcagauuuuuggag

SEQ ID NO: 275013 - RNA, 64 nt, Homo Sapiens
cggggggugcccaagcccaggucaccucaccggccuggggaaggcuucguggcuccuuuaggau

SEQ ID NO: 275014 - RNA, 64 nt, Homo Sapiens
uuuuccagagccuguuagccagccugcggcaguccuggggaaaccuggagucuaccugcggaug

SEQ ID NO: 275015 - RNA, 64 nt, Homo Sapiens
acaccuauguaacucaucuuuuaguuuacacuuccuggggaaauugucuuugguguuuagagga

SEQ ID NO: 275016 - RNA, 64 nt, Homo Sapiens
uacacuagcauuaguuuauacaccacuuuugccgcuggggaauucaaguugaaaugucccucaa

SEQ ID NO: 275017 - RNA, 51 nt, Homo Sapiens
uaaaccggcuaaauuauugaccuggggaacuagccacacaggaggccggga

SEQ ID NO: 275018 - RNA, 64 nt, Homo Sapiens
cagccucucccuacucccaucccauuuccaccaacuggggaacugugacuaucuaucucccccg

SEQ ID NO: 275019 - RNA, 64 nt, Homo Sapiens
ucccgaggaugcugucaggauccugugcuguccccuggggaagguggguguuggguccucugcu

SEQ ID NO: 275020 - RNA, 64 nt, Homo Sapiens
ucuugcugaccuuguccccaaugccagggcacagcuggggaagaguuugccaggcuaagcagca

SEQ ID NO: 275021 - RNA, 64 nt, Homo Sapiens
cgaggcagcucuggaaucugugcccaccuggggccuggggaacaaggcccuccuuucuccaggc

SEQ ID NO: 275022 - RNA, 64 nt, Homo Sapiens
ggagugugccccucggggcaggagggaagggcaucuggggaagggcaggagggaagagcugucc

SEQ ID NO: 275023 - RNA, 64 nt, Homo Sapiens
auuuauucuccaaauuaagugggaauuagauccucuggggaacccuggagcuuggugagaguga

SEQ ID NO: 275024 - RNA, 64 nt, Homo Sapiens
cguagagcgcgugcugaagaguguggcugugaagcuggggaagacgcagaaggugaaggugcuc

SEQ ID NO: 275025 - RNA, 64 nt, Homo Sapiens
cucccacacaagcucgguggugacucuucggccccuggggaaaaacaaaaagauauugcugaga

SEQ ID NO: 275026 - RNA, 64 nt, Homo Sapiens
acgaggccagugagggacggcguggcugugcuuccuggggaaaugaacccccuccccacagaca

SEQ ID NO: 275027 - RNA, 64 nt, Homo Sapiens
cccucgugcagccccuccuuucagcccacugcaccuggggaagcgcgaccgucacacacugucc

SEQ ID NO: 275028 - RNA, 64 nt, Homo Sapiens
gcaagaaaggaauggacccugggcgagggcacagcuggggaacggguccacagcacaggaugug

SEQ ID NO: 275029 - RNA, 64 nt, Homo Sapiens
guuagggagcucugccuguucuugauuccaaagccuggggaacgcugccccucaccuucuccuu

SEQ ID NO: 275030 - RNA, 64 nt, Homo Sapiens
gagaaccggcuaggugggcuaugagaucagaacucuggggaaagcugcaucuguuuuggaggag

SEQ ID NO: 275031 - RNA, 64 nt, Homo Sapiens
cccggaaucuuaguucuuccuccuucgguaucaccuggggaagcuucccgggcacaccuauggc

SEQ ID NO: 275032 - RNA, 64 nt, Homo Sapiens
cgggcagaagaugccgcagcgcuucuuugcagagcuggggaagcucacagccauuugagaaaug

SEQ ID NO: 275033 - RNA, 64 nt, Homo Sapiens
ucuuuccugugcucugaagaugccagcuacaucacuggggaaacaguggugguggguggaggaa

SEQ ID NO: 275034 - RNA, 64 nt, Homo Sapiens
cuuggcaaagaccaagauauuuuuuccugggccacuggggaaucugaggggugaugggagagaa

SEQ ID NO: 275035 - RNA, 64 nt, Homo Sapiens
uuuugaaugaauucaugucaaaaauguuauucagcuggggaaauuucucuaaauguacacugau

SEQ ID NO: 275036 - RNA, 64 nt, Homo Sapiens
ugauuucguuaguuuuauuaucuguuuacuuccucuggggaaggcagacugauaaaauuauaug

SEQ ID NO: 275037 - RNA, 64 nt, Homo Sapiens
ccucagcccaauucgggcccuguggugaggagcacuggggaaagcuucuccggguauuuaguac

SEQ ID NO: 275038 - RNA, 64 nt, Homo Sapiens
aguggaugaagacgucccuccagccauguggccucuggggaaucugaauucacaucuaggaccu

SEQ ID NO: 275039 - RNA, 64 nt, Homo Sapiens; identical to SEQ ID NO: 275038

SEQ ID NO: 275040 - RNA, 64 nt, Homo Sapiens
uacuuauggucggaagucguugucaauggaggaucuggggaaaacuguuuguagguggcuacag

SEQ ID NO: 275041 - RNA, 64 nt, Homo Sapiens
uagaccuagcaaaacccuggaaggauauugaggucuggggaaaagggaggacuuugcauuuucc

SEQ ID NO: 275042 - RNA, 64 nt, Homo Sapiens
cugaggcaaccauggaccuguugcuaggagauagcuggggaaggcccaaggccgcccagggcag

SEQ ID NO: 275043 - RNA, 64 nt, Homo Sapiens
uucccuucugcauacugcaaucugaucugucagacuggggaauguuggguucuggggucugguc

SEQ ID NO: 275044 - RNA, 64 nt, Homo Sapiens
ugccugccucagaucucagacuauccugauuaaucuggggaagaacagagccagggaaagaaug

SEQ ID NO: 275045 - RNA, 64 nt, Homo Sapiens
uauuugcugcuucucccagcccuggggaagauuccuggggaauucuugcugggcugaguccagc

SEQ ID NO: 275046 - RNA, 64 nt, Homo Sapiens
uuccuggggaauuuauuugcggcugaguccagcccuggggaagagcaccccagucuacuugcug

SEQ ID NO: 275047 - RNA, 64 nt, Homo Sapiens
uuuuauuucuugggugggguaggagccuuuuguacuggggaagaggugccacuuaccguggcuu

SEQ ID NO: 275048 - RNA, 64 nt, Homo Sapiens
accaucuucacuacaaacacgccugagaguggcacuggggaaacauaacuccaucuacaccuug

SEQ ID NO: 275049 - RNA, 64 nt, Homo Sapiens
uugccuuuguggcccaugaaagucuuacugggcccuggggaagguauccuacccuggugaagca

SEQ ID NO: 275050 - RNA, 64 nt, Homo Sapiens
caucccacaucagguauauuagagcuuauccgaacuggggaaagacggauugagauuaacugcu

SEQ ID NO: 275051 - RNA, 64 nt, Homo Sapiens
uuugaggauguugugugaggguguuugacugugacuggggaagcucagacuacuuuguauguga

SEQ ID NO: 275052 - RNA, 63 nt, Homo Sapiens
ucuucucuauuauguuuaauucuaucaucccaaaucaaagaacuaauuuuuaauaucuuuacu

SEQ ID NO: 275053 - RNA, 63 nt, Homo Sapiens
uuaagaaguaucacuucaaauuuaagauuaagaaucaaagagaguauugccuguggcuuguug

SEQ ID NO: 275054 - RNA, 63 nt, Homo Sapiens
gaaaaugccugaccaaauucaaaaaaaaaaaucaucaaagacaauaaggcaaaugccagaauu

SEQ ID NO: 275055 - RNA, 63 nt, Homo Sapiens
gagaaccaacguuccuaaaacaaugacuaaggaaucaaagagaauugugaaccauacuguccc

SEQ ID NO: 275056 - RNA, 63 nt, Homo Sapiens
acucacucaggcaucuucuuaaaacacaacauaaucaaagacauagaaauuuaaauaguaaau

SEQ ID NO: 275057 - RNA, 63 nt, Homo Sapiens
acauacccaucaguaauuucgcuuuuuuguaacaucaaagaaaauucaaauauaaguuuccau

SEQ ID NO: 275058 - RNA, 63 nt, Homo Sapiens
aagacuucagauugaauucacaucuuauucagcaucaaagaauucacacaggagagaaagcac

SEQ ID NO: 275059 - RNA, 63 nt, Homo Sapiens
ggagauucagucauaacccaacgcucauucaacaucaaagaauuuauaccuaagagaacuuau

SEQ ID NO: 275060 - RNA, 63 nt, Homo Sapiens
cauggaguggccguaaugagaauauguuugaagaucaaagaguuagaccaaugcuugaauaag

SEQ ID NO: 275061 - RNA, 63 nt, Homo Sapiens
uuuuguauagccaggaguuuauugugauuaaacaucaaagaaacagguagaaagccuggguuu

SEQ ID NO: 275062 - RNA, 63 nt, Homo Sapiens
acuucuucaguguccuucacggcacuggaucccaucaaagaaccuugaagaaguggcugcccc

SEQ ID NO: 275063 - RNA, 63 nt, Homo Sapiens
uucccucucuaucggggucacuugcaauuguuaaucaaagauugaacacugcguaggagaggg

SEQ ID NO: 275064 - RNA, 63 nt, Homo Sapiens
aggugagguuuauagaaagaagguuauaguaacaucaaagauuuauggguuaaaucaaagaua

SEQ ID NO: 275065 - RNA, 63 nt, Homo Sapiens
agguuauaguaacaucaaagguguauggguuaaaucaaagauacaagauuaugaugaguaaau

SEQ ID NO: 275066 - RNA, 63 nt, Homo Sapiens
cauaggcagguuuuucuuaaaaaugaaaaaaaaaucaaagauuuuuuuaacaguucucagacu

SEQ ID NO: 275067 - RNA, 63 nt, Homo Sapiens
auugcuauccauaaugggauucaccuccaaauuaucaaagaaauaacucagaguaauuugaca

SEQ ID NO: 275068 - RNA, 63 nt, Homo Sapiens
acuucuuuucaaaauguauuaaagaaaaaguaaaucaaagauguuugauuagcagucaauggc

SEQ ID NO: 275069 - RNA, 63 nt, Homo Sapiens
gauuaaacucagugguugauuaaaacucagagaaucaaagaugagugacuacuauuauaauac

SEQ ID NO: 275070 - RNA, 63 nt, Homo Sapiens
uccuacuggugagaaacccucaucuuacucaacaucaaagaauaggccuuuaggcagagggcg

SEQ ID NO: 275071 - RNA, 63 nt, Homo Sapiens
ucauaccagugugaaacccuacucuuacucaacaucaaagaauagguuuuuaauaauuaucca

SEQ ID NO: 275072 - RNA, 64 nt, Homo Sapiens
uacaagagacccugguuggucauuuuguggaauagcagcaaaucggcauggcagcaaaugccaa

SEQ ID NO: 275073 - RNA, 64 nt, Homo Sapiens
ccaacauuuuguggaauagcaacauuguggcauggcagcaaaugaaauccuauuucaguggacc

SEQ ID NO: 275074 - RNA, 64 nt, Homo Sapiens
gccuuuacguuguucuaaacccaagaggaaagaagcagcaaaaucagccugggaugcugccgua

SEQ ID NO: 275075 - RNA, 64 nt, Homo Sapiens
ucugaggcuguugggaccaucaaaaaauuuuccugcagcaaaaguuuaaucugugaccauuggg

SEQ ID NO: 275076 - RNA, 64 nt, Homo Sapiens
guccuauauguagauuccaaguggcccauggccugcagcaaaacgucucuguauggcagcaaau

SEQ ID NO: 275077 - RNA, 64 nt, Homo Sapiens
uggcccauggccugcagcaauaugucucuguauggcagcaaaugccaaugcccccacccccagg

SEQ ID NO: 275078 - RNA, 64 nt, Homo Sapiens
aacaguaguaugaaacuccaaaaugcaaacugaagcagcaaacccacaaagcaucaaaagacuc

SEQ ID NO: 275079 - RNA, 64 nt, Homo Sapiens
ucuccuuugugaugccuuaggacauguuugaacugcagcaaaaaacaaaaacaaaaaacagugc

SEQ ID NO: 275080 - RNA, 64 nt, Homo Sapiens
agaaacagguugacaacucagcccugcucaugaggcagcaaacccugcaaagggcugggacugg

SEQ ID NO: 275081 - RNA, 64 nt, Homo Sapiens
aaaaacacugaagugcuuuucaugaagcacagcugcagcaaagccuugcaaucccaggcugggg

SEQ ID NO: 275082 - RNA, 64 nt, Homo Sapiens
gaacuauuguagaacagcgcuggcuuuugggggagcagcaaaaaugagaggagugcuagguggg

SEQ ID NO: 275083 - RNA, 62 nt, Homo Sapiens
auacauauguguauauaagagguuauugauaaacuucugaggcagacauuugucucgcuuuu

SEQ ID NO: 275084 - RNA, 62 nt, Homo Sapiens
cccuuguacuugccuacuguaauauggauuucacuucugaacaguuuacagcacaauauuua

SEQ ID NO: 275085 - RNA, 62 nt, Homo Sapiens
gccuaauaaauaugacauggcucuagcuccauacuucugauuuccuagaguucuuuccugac

SEQ ID NO: 275086 - RNA, 62 nt, Homo Sapiens
aaaggucuccaugcuuuugcuugcaacuucccacuucugacgcuugauuuuggggacacaca

SEQ ID NO: 275087 - RNA, 62 nt, Homo Sapiens
gacaaaagugguagggaaauuguucccucuccacuucugaaaguaugaugauguauuaagga

SEQ ID NO: 275088 - RNA, 62 nt, Homo Sapiens
auuuuuuuaauuacuggcuucugauuucuuucacuucugauccuuuuccuuuuucucagaug

SEQ ID NO: 275089 - RNA, 62 nt, Homo Sapiens
cacauuuggaggagacguaauccagcauuggaacuucugaucuucaagcagggauucucaac

SEQ ID NO: 275090 - RNA, 62 nt, Homo Sapiens
gcucaucgacgccugugacagggagaaaggauacuucugaacaaggagccuccaagcaaauc

SEQ ID NO: 275091 - RNA, 62 nt, Homo Sapiens
ucacuagcuuggccauagcaccucucuucuccacuucugaucugcugcuucuaaccuucuau

SEQ ID NO: 275092 - RNA, 62 nt, Homo Sapiens
ggguuucaccacguuagccaugauggucucaaacuucugaccucauaauccacccaccuugg

SEQ ID NO: 275093 - RNA, 62 nt, Homo Sapiens
ugggugugauugucuuccuagaagaaguugugacuucugacaugggucauauucuuuauuug

SEQ ID NO: 275094 - RNA, 62 nt, Homo Sapiens
uacagcucaggaaaagccugugcaggacgaaaacuucugaguacauuuguaaauacauuguu

SEQ ID NO: 275095 - RNA, 62 nt, Homo Sapiens
gacagaggaggauagcucuuuccagaauccacacuucugaccucagccucggucucaugaac

SEQ ID NO: 275096 - RNA, 62 nt, Homo Sapiens
gaagaccuacuugaacagggcauauuuuuuagacuucugaacaucaguauguucgaggguac

SEQ ID NO: 275097 - RNA, 62 nt, Homo Sapiens
gccaaaaaaugugacugacgcuuuaggaaugaacuucugaggaaauuuagaguaguugaaau

SEQ ID NO: 275098 - RNA, 62 nt, Homo Sapiens
aagagaccaauuaagauucaaccaaguuuaccacuucugaugcugacuucgugaauauagag

SEQ ID NO: 275099 - RNA, 62 nt, Homo Sapiens
acauggaaaauucaaggauuaugcuguuaacaacuucugauauuucauauacuuccgucucg

SEQ ID NO: 275100 - RNA, 62 nt, Homo Sapiens
ugaagggaaaaaaaccacccguagaagaacuuacuucugaaauauguaacagauacacuaca

SEQ ID NO: 275101 - RNA, 62 nt, Homo Sapiens
ucuguaucgugccaaaguuguaucacuguuaaacuucugaagacauaaccaguugagucuua

SEQ ID NO: 275102 - RNA, 62 nt, Homo Sapiens
ucaacccauauuauuggcuguacauccuggucacuucugacuucuguuuuuacuaauggaag

SEQ ID NO: 275103 - RNA, 62 nt, Homo Sapiens
cucagccaaggacacuugaugaagcagcugacacuucugaaacggguguuuccaacgucaug

SEQ ID NO: 275104 - RNA, 62 nt, Homo Sapiens
cugugaaaugugagaaguacauuacaagaucaacuucugaccuaucguugguguuuuccagu

SEQ ID NO: 275105 - RNA, 64 nt, Homo Sapiens
gaccggccggucacugcaggggucugguggucucugcuugcauccccaacuuagcuguccccug

SEQ ID NO: 275106 - RNA, 64 nt, Homo Sapiens
gggaaaugaagaagcaucuuccuuaggucugcccugcuugcaaauccacuagcaccgaccccac

SEQ ID NO: 275107 - RNA, 64 nt, Homo Sapiens
accuggccagauccgcucccagacggccuuggacugcuugcauuuccccggagaaaaagggguu

SEQ ID NO: 275108 - RNA, 64 nt, Homo Sapiens
acagccuccugcuagagugacuuguacaugagcuugcuugcagaagacuagauuagauguuucu

SEQ ID NO: 275109 - RNA, 64 nt, Homo Sapiens
auucauguugacaacagaguaaaaaauaaagaccugcuugcaguguggaaguucccauugucaa

SEQ ID NO: 275110 - RNA, 64 nt, Homo Sapiens
gcugguuguguaucaucaauccaauguauuugaaugcuugcacuuauuuuaaauggugcuauag

SEQ ID NO: 275111 - RNA, 64 nt, Homo Sapiens
caugcacccccucacucucaucaggaaugaaggaugcuugcacauuagcguuggucuucucuug

SEQ ID NO: 275112 - RNA, 64 nt, Homo Sapiens
gcauggucucaguuguauaggugaguuuuugaaaugcuugcacauuuauccaauccacuggucu

SEQ ID NO: 275113 - RNA, 64 nt, Homo Sapiens
auguaauaaauacacuugugaauguagaacagagugcuugcaaacuugaugguggcguuuuuga

SEQ ID NO: 275114 - RNA, 64 nt, Homo Sapiens
cuuccaaucuauguugguuuuaauauaauagcuuugcuugcagcauauuugaaaaggcuuccau

SEQ ID NO: 275115 - RNA, 64 nt, Homo Sapiens
aaauaauuucaucaacuuuuagaauauuuuauguugcuugcacuauaggagucauaaaaggaac

SEQ ID NO: 275116 - RNA, 64 nt, Homo Sapiens
caagugcucucuagauuuguugauaaacauuuuaugcuugcauuuaaacuugaaauguaugagc

SEQ ID NO: 275117 - RNA, 64 nt, Homo Sapiens
cugggcucccgugagguccuagggcagaaggaggugcuugcagggccucucgcugcuacuggga

SEQ ID NO: 275118 - RNA, 64 nt, Homo Sapiens
guagaguagaacacagccccggaaugcuuccaguugcuugcaagggaccaugccggcccgggug

SEQ ID NO: 275119 - RNA, 64 nt, Homo Sapiens
gaaaauuaaauugcuaucaacagguauuugcuuuugcuugcacuaucauguguauuacaguggg

SEQ ID NO: 275120 - RNA, 64 nt, Homo Sapiens
gaaaauuaaauugcuaucaauauguguuugcuuuugcuugcacuugcguauggcagugagcagg

SEQ ID NO: 275121 - RNA, 64 nt, Homo Sapiens
agggcaagcaaggaauggcuugugugaagcucugugcuugcaugcgaagcugaagucauugaag

SEQ ID NO: 275122 - RNA, 64 nt, Homo Sapiens
ucuucugguugggauguggauuuugacgcuauucugcuugcaugcugcucucugcuugcuguug

SEQ ID NO: 275123 - RNA, 64 nt, Homo Sapiens
aauucacugauuugacuagaaacaucaaggaagaaugaagaacguugacuuuuuuccaggauaa

SEQ ID NO: 275124 - RNA, 64 nt, Homo Sapiens
gauccacaggacuugaaggucaaaguucacaaagaugaagaaucaggguagcugaccauguuug

SEQ ID NO: 275125 - RNA, 64 nt, Homo Sapiens
aaaaagaagugugggcaaccaaauguagguaaggaugaagaagaacaggaacucucacuggugg

SEQ ID NO: 275126 - RNA, 64 nt, Homo Sapiens
uauaugacauucuggaaaaggcaaaacuauagggaugaagaacagaucaguuguugucagguuu

SEQ ID NO: 275127 - RNA, 64 nt, Homo Sapiens
auuuuauuccccucaauucucaauauauucaguaaugaagaauggugccaccacucaagcaaca

SEQ ID NO: 275128 - RNA, 64 nt, Homo Sapiens
gaaggaugaagacgaagaagcaagggaggaacaaaugaagaaccaucuuuguucaugaauagga

SEQ ID NO: 275129 - RNA, 64 nt, Homo Sapiens
uucagaugaaaaaggcaagaugagugaugcugucaugaagaaaaauaggcucaagauuguacag

SEQ ID NO: 275130 - RNA, 64 nt, Homo Sapiens
uuugaaugucuugacccuuuuggaaauuuagaacaugaagaaaccuagagcaauucaguccugu

SEQ ID NO: 275131 - RNA, 64 nt, Homo Sapiens
guaauuagaauauuuucaacagaagaaaagaaaaaugaagaaaaagggaggaagaaagggagag

SEQ ID NO: 275132 - RNA, 64 nt, Homo Sapiens
aauaaaagaaauaggaagccaauucuugcaauaaaugaagaagguaauuaguuuauaugagaau

SEQ ID NO: 275133 - RNA, 64 nt, Homo Sapiens
agaagucccauuaccagaaaauaaauaucaaacuaugaagaaacaaaucucacucuuauugaca

SEQ ID NO: 275134 - RNA, 64 nt, Homo Sapiens
ccacuaagugggagaucuucuuggggacccugacaugaagaagugugugggaaaagaaggcucu

SEQ ID NO: 275135 - RNA, 64 nt, Homo Sapiens
ucucuagaagagaaugaaggguagcuugaaagcgaugaagaaugagacuuauuuuaaugacaau

SEQ ID NO: 275136 - RNA, 64 nt, Homo Sapiens
aaucucuguuaagaagaagucagaauuuuagucaaugaagaauucuuggccugaaacuuccaca

SEQ ID NO: 275137 - RNA, 64 nt, Homo Sapiens
auguaauauauuguacaaauaggaucugcaaacaaugaagaauuaaagcuauaaaguauauauu

SEQ ID NO: 275138 - RNA, 64 nt, Homo Sapiens
aguacaaugaacugcuuuucaagugcacuuuuuuaugaagaaaagacaagcugacuuggcacuu

SEQ ID NO: 275139 - RNA, 64 nt, Homo Sapiens
aaauaaggauggugauagagagguugaagaagaaaugaagaagcaugaaaguaauaauguggga

SEQ ID NO: 275140 - RNA, 64 nt, Homo Sapiens
uuuccagcuagaaaauuuuauggcuaucgaagaaaugaagaagcacggaaguacucaugucgga

SEQ ID NO: 275141 - RNA, 64 nt, Homo Sapiens
aacacuggaauauuacacgaugagauucugauucaugaagaaaagcagauagaagugguugaaa

SEQ ID NO: 275142 - RNA, 64 nt, Homo Sapiens
auauacuuucgaaagaauaaaauaguucuccuacaugaagaaagaauaugucaggaaauaaggu

SEQ ID NO: 275143 - RNA, 64 nt, Homo Sapiens
gagcaaugcuuucauaguuucagauaugguaguuaugaagaaaacaaugucauuugcugcuauu

SEQ ID NO: 275144 - RNA, 64 nt, Homo Sapiens
uccguggguuccccugggauaggaguuaauacaaaugaagaaauuucuucuuccaugccauguc

SEQ ID NO: 275145 - RNA, 64 nt, Homo Sapiens
aaguacugugaccugagagacuaaaucaaaagaaaugaagaaaauccucccugcugauuuguuu

SEQ ID NO: 275146 - RNA, 64 nt, Homo Sapiens
cccagcuugaauguaaauuuuguauaguguaaguaugaagaacauagugcaacuguacagguag

SEQ ID NO: 275147 - RNA, 64 nt, Homo Sapiens
uuauugugauaugauaaauaauugggcuauuuugaugaagaaaacuuuguucauuuguuucuac

SEQ ID NO: 275148 - RNA, 64 nt, Homo Sapiens
ugguucagauuaacuucacuauuaaguguucaauaugaagaauucaaguauucugacugaguga

SEQ ID NO: 275149 - RNA, 64 nt, Homo Sapiens
auaguuguuuuaucaauaaaagccccuuaauauuaugaagaaacuuuucauauuuuuucuucuu

SEQ ID NO: 275150 - RNA, 64 nt, Homo Sapiens
acaucucucauacaguuuggggugaauuguaaaaaugaagaacuauaauuuauguagugaaaua

SEQ ID NO: 275151 - RNA, 64 nt, Homo Sapiens
cccauuagaagaggauuuuuugggggacuucaauaugaagaaaaccaagaauguuuuguugggc

SEQ ID NO: 275152 - RNA, 64 nt, Homo Sapiens
uagcagacagcuguuccacgcgggccagggcggcaugaagaagucccgccgcuacgugcccggc

SEQ ID NO: 275153 - RNA, 64 nt, Homo Sapiens
uugacaggauaguuaauaauaaaccuuaaaacccaugaagaaaucugagguaaaguguuagcac

SEQ ID NO: 275154 - RNA, 64 nt, Homo Sapiens
aauaaaauuggagcagacagaaaagauauagcaaaugaagaaauauuuuaaggaaaccuauuug

SEQ ID NO: 275155 - RNA, 64 nt, Homo Sapiens
ugcuagcugguaccuucuaguaaucaaaauuaauaugaagaaacuagguugugacagacuagau

SEQ ID NO: 275156 - RNA, 64 nt, Homo Sapiens
cagugaauauucauuaauguguguccugugcaguaugaagaauuugugcaaaaauaccaaauuu

SEQ ID NO: 275157 - RNA, 64 nt, Homo Sapiens
aggcugcagccugcauugugccugcuccuaacaaaugaagaagcucagcuucugcauuuccuuc

SEQ ID NO: 275158 - RNA, 64 nt, Homo Sapiens
ugaacauauuguugaaagguaauuugagagaaauaugaagaacugaggaggaaaaaaaaaaaaa

SEQ ID NO: 275159 - RNA, 64 nt, Homo Sapiens
uacuuuuuaaauguaaagauauuuuuaucuuuauaugaagaaaaucacuuaggaaauggcuuug

SEQ ID NO: 275160 - RNA, 64 nt, Homo Sapiens
cacaggcaugugcuucucaggugcacaugccgguaugaagaagaugaaggagauacaggugugu

SEQ ID NO: 275161 - RNA, 64 nt, Homo Sapiens
cccuucaggccagucgugguaccaacuccccaagaugaagaagcaaggggcagagacagggucc

SEQ ID NO: 275162 - RNA, 64 nt, Homo Sapiens
gagucuauacaaaggcuugcaacuugugauaaaaaugaagaaaauaggaaaaggaauguagcuc

SEQ ID NO: 275163 - RNA, 64 nt, Homo Sapiens
caucauuuuaucgagagaacuuauaggaaaauauaugaagaaccauauuaggcucuuugucauc

SEQ ID NO: 275164 - RNA, 64 nt, Homo Sapiens
cuuaauacugacauacuggacuaacuggauuuggaugaagaaguuauuuauaauagcaauaaac

SEQ ID NO: 275165 - RNA, 64 nt, Homo Sapiens
cuuaauacugaaauacugaaagaccugucuuuggaugaagaagugccugagccuaguuagaguu

SEQ ID NO: 275166 - RNA, 64 nt, Homo Sapiens
ccagaggcucgagagcaggccauuucccaagaagaugaagaauggugacuguguuuuuauugaa

SEQ ID NO: 275167 - RNA, 64 nt, Homo Sapiens
aauggugacuguguuuuuauugaaggaauuucaaaugaagaauaauguuuaaaauguguauaua

SEQ ID NO: 275168 - RNA, 64 nt, Homo Sapiens
auacgguuucagacugaaaauuaugucagguccuaugaagaaagauauugcagguuaaauuacu

SEQ ID NO: 275169 - RNA, 64 nt, Homo Sapiens
ggaaaucauuaagaaaggguacgagaacaagaauaugaagaacucuuuuuuuuuuuuuuuuuaa

SEQ ID NO: 275170 - RNA, 64 nt, Homo Sapiens
uaaagucgcugaucauccucuuccucaucuguaaaugaagaaaguaggcccugucuaccucaca

SEQ ID NO: 275171 - RNA, 64 nt, Homo Sapiens
gagaaccagagcuccaagucuuuaauuugccaagaugaagaaaaugaguucucaaggagggaau

SEQ ID NO: 275172 - RNA, 64 nt, Homo Sapiens
caaaagacaaacaauaugucuuuuuuuuuuuugcaugaagaaaaaugucuaucauuuacaguuu

SEQ ID NO: 275173 - RNA, 64 nt, Homo Sapiens
aauuccugggagggggauuauuuagugaaauaauaugaagaacuuuaugacuuauguuugccuu

SEQ ID NO: 275174 - RNA, 64 nt, Homo Sapiens
aaaagcacuucguacauggugguggcaagagaaaaugaagaagaagcaaaaguggaaaccccug

SEQ ID NO: 275175 - RNA, 64 nt, Homo Sapiens
uugauauuuucugaaagaggaacauguguuagagaugaagaaucuuccaaggcucaugcaguug

SEQ ID NO: 275176 - RNA, 64 nt, Homo Sapiens
ucugagccccuagcccauccuucacuccuuaucuaugaagaacagcaaguggccaaccuagaga

SEQ ID NO: 275177 - RNA, 64 nt, Homo Sapiens
aguccccuaccccccaucauccaagggaguaaaaaugaagaaauggggugggguggucagcugg

SEQ ID NO: 275178 - RNA, 64 nt, Homo Sapiens
ucaggagucagcucugacaaugaagaugaugaugaugaagaagaugggaauuaccuucaucccu

SEQ ID NO: 275179 - RNA, 64 nt, Homo Sapiens
aaucguguuaagcuagaugaugacagugaugaugaugaagaaagcaaagaaggccaagaaaguu

SEQ ID NO: 275180 - RNA, 64 nt, Homo Sapiens
gcagauagaaguggcugaaaugagauucugauucaugaagaaaaaacacuggaauauuacaaga

SEQ ID NO: 275181 - RNA, 64 nt, Homo Sapiens
acggaaguacucauaugggaagguugaagaagaaaugaagaagcaaauaaggguggugauagaa

SEQ ID NO: 275182 - RNA, 64 nt, Homo Sapiens
uuccaugaaguauguuuuaaagcugcuaugauacaugaagaacacuuguucuaucacagguaug

SEQ ID NO: 275183 - RNA, 64 nt, Homo Sapiens
gcccacaugcuggcaggggcaaagaauagacuuaaugaagaagucagcacgcgugucagcugcc

SEQ ID NO: 275184 - RNA, 64 nt, Homo Sapiens
caaaccaccaucuuuuauaacgucaucuguuccaaugaagaaacccacuugaacacccaaacua

SEQ ID NO: 275185 - RNA, 64 nt, Homo Sapiens
agucuuuguaaauggacauucaccaggcacuggcaugaagaaagggcagaggcuauaaaagauu

SEQ ID NO: 275186 - RNA, 64 nt, Homo Sapiens
aggaacgggcuuggaagaaaauugguuucagaugaugaagaaagguuggucugagugacaagga

SEQ ID NO: 275187 - RNA, 64 nt, Homo Sapiens
aguucagacuguuaauacagaaaaaagcaagaauaugaagaaguaauuguaagcauccugaaau

SEQ ID NO: 275188 - RNA, 64 nt, Homo Sapiens
ggagagguagauacagucagagcaagaggaucagaugaagaaaagaaaauggacuuuagacaaa

SEQ ID NO: 275189 - RNA, 64 nt, Homo Sapiens
ggagagguagauacagucagaaaaggaacaccugaugaagaaaaacagucaauauggauuuaga

SEQ ID NO: 275190 - RNA, 64 nt, Homo Sapiens
auuagucaaaccacuguuauuaacagauguagcaacaugagaaacgcuuauguuacagguuaca

SEQ ID NO: 275191 - RNA, 64 nt, Homo Sapiens
uguagcaacaugagaaacgcuuauguuacagguuacaugagagcaaucauguaagucuauauga

SEQ ID NO: 275192 - RNA, 64 nt, Homo Sapiens
ucaguagucaguugguuuucuuuuaaauacaccaacaugagacaaauucaagauucaaaaagaa

SEQ ID NO: 275193 - RNA, 64 nt, Homo Sapiens
uggucagaaacagugcuuggucuucuggaauaccacaugagacaauacacaguauaacugaugc

SEQ ID NO: 275194 - RNA, 64 nt, Homo Sapiens
cguccaagguggaugcugucaaugcccgagugacacaugagagcuguaugaauugagagaaaag

SEQ ID NO: 275195 - RNA, 64 nt, Homo Sapiens
uucauguguuuggcauaccagugaaugaugaagaacaugagauuaauuuaauuuaucuucggua

SEQ ID NO: 275196 - RNA, 64 nt, Homo Sapiens
ugauaguagauuaugucucuagguagagacagauacaugagaagagccuccaaaacuggaagcc

SEQ ID NO: 275197 - RNA, 64 nt, Homo Sapiens
aaaccaugcaauuuaacacuucaguuaaagaaauacaugagaacugcuugucaugaccagacaa

SEQ ID NO: 275198 - RNA, 64 nt, Homo Sapiens
aaagacacacuuuucaugacguuguggccaagccacaugagaucgagaagggugccuuaaaaau

SEQ ID NO: 275199 - RNA, 64 nt, Homo Sapiens
acacaucaggugucagaacucuuacaauuuuuuaacaugagauauuggcuccuuagcauggcca

SEQ ID NO: 275200 - RNA, 64 nt, Homo Sapiens
cuguucacaccuuucuucacugagauuccaguguacaugagaacauauauuuauugcaugauuu

SEQ ID NO: 275201 - RNA, 64 nt, Homo Sapiens
uauuguagcuuaagauauauguguuaagauauauacaugagaaacuuuaaaagguaacuacugu

SEQ ID NO: 275202 - RNA, 64 nt, Homo Sapiens
uggagcagaggagccucucaccuccuguccucugacaugagaaugaaaccaggaauggacuugg

SEQ ID NO: 275203 - RNA, 64 nt, Homo Sapiens
cucuucuuuuuacugucucuucugcuuacuuuccacaugagaugcuuuguaccggggagcugug

SEQ ID NO: 275204 - RNA, 64 nt, Homo Sapiens
gaaaauauguguaaaccucuaacuuaauacuaaaacaugagaggaagaugugagaagguacuaa

SEQ ID NO: 275205 - RNA, 64 nt, Homo Sapiens
ugugauacaugugaacccaauauacuuggcagcaacaugagaaggacauaucacuguauccauc

SEQ ID NO: 275206 - RNA, 64 nt, Homo Sapiens
gcacacuggagagaaaccuuaggcuuucgagugcacaugagaauaaacccuucaguuuccuuac

SEQ ID NO: 275207 - RNA, 64 nt, Homo Sapiens
aaucacacugcacagaaacauguacugcucaaaaacaugagaggggaaagccuucaguuaccac

SEQ ID NO: 275208 - RNA, 64 nt, Homo Sapiens
uguaccuugcagcugaauggaaacuuauggccauacaugagaaaaucaguauuauguucuaaau

SEQ ID NO: 275209 - RNA, 64 nt, Homo Sapiens
aggugcaauauauugacuuaaauauaggaaaaacacaugagaacagggaaggaacuuacugucu

SEQ ID NO: 275210 - RNA, 64 nt, Homo Sapiens
aaacagaucgaaccguuuugaucuuuacaaaacuacaugagaacgaccaaaguccuuuuuuucc

SEQ ID NO: 275211 - RNA, 64 nt, Homo Sapiens
gaacuuccagguguuacuguuucuauuuauauguacaugagaagaauauaaaaagcuuccauga

SEQ ID NO: 275212 - RNA, 64 nt, Homo Sapiens; identical to SEQ ID NO: 124726

SEQ ID NO: 275213 - RNA, 64 nt, Homo Sapiens; identical to SEQ ID NO: 124727

SEQ ID NO: 275214 - RNA, 64 nt, Homo Sapiens; identical to SEQ ID NO: 124728

SEQ ID NO: 275215 - RNA, 64 nt, Homo Sapiens; identical to SEQ ID NO: 124729

SEQ ID NO: 275216 - RNA, 64 nt, Homo Sapiens; identical to SEQ ID NO: 124730

SEQ ID NO: 275217 - RNA, 64 nt, Homo Sapiens; identical to SEQ ID NO: 124731

SEQ ID NO: 275218 - RNA, 64 nt, Homo Sapiens; identical to SEQ ID NO: 124732

SEQ ID NO: 275219 - RNA, 64 nt, Homo Sapiens; identical to SEQ ID NO: 124733

SEQ ID NO: 275220 - RNA, 64 nt, Homo Sapiens; identical to SEQ ID NO: 124734

SEQ ID NO: 275221 - RNA, 64 nt, Homo Sapiens; identical to SEQ ID NO: 124735

SEQ ID NO: 275222 - RNA, 64 nt, Homo Sapiens; identical to SEQ ID NO: 124736

SEQ ID NO: 275223 - RNA, 64 nt, Homo Sapiens; identical to SEQ ID NO: 124737

SEQ ID NO: 275224 - RNA, 64 nt, Homo Sapiens; identical to SEQ ID NO: 124738

SEQ ID NO: 275225 - RNA, 64 nt, Homo Sapiens; identical to SEQ ID NO: 124739

SEQ ID NO: 275226 - RNA, 64 nt, Homo Sapiens; identical to SEQ ID NO: 124740

SEQ ID NO: 275227 - RNA, 64 nt, Homo Sapiens; identical to SEQ ID NO: 124741

SEQ ID NO: 275228 - RNA, 64 nt, Homo Sapiens; identical to SEQ ID NO: 124742

SEQ ID NO: 275229 - RNA, 64 nt, Homo Sapiens; identical to SEQ ID NO: 124743

SEQ ID NO: 275230 - RNA, 64 nt, Homo Sapiens; identical to SEQ ID NO: 124744

SEQ ID NO: 275231 - RNA, 64 nt, Homo Sapiens; identical to SEQ ID NO: 124745

SEQ ID NO: 275232 - RNA, 64 nt, Homo Sapiens; identical to SEQ ID NO: 124746

SEQ ID NO: 275233 - RNA, 64 nt, Homo Sapiens; identical to SEQ ID NO: 124747

SEQ ID NO: 275234 - RNA, 64 nt, Homo Sapiens; identical to SEQ ID NO: 124748

SEQ ID NO: 275235 - RNA, 64 nt, Homo Sapiens; identical to SEQ ID NO: 124749

SEQ ID NO: 275236 - RNA, 64 nt, Homo Sapiens; identical to SEQ ID NO: 124750

SEQ ID NO: 275237 - RNA, 64 nt, Homo Sapiens; identical to SEQ ID NO: 124751

SEQ ID NO: 275238 - RNA, 60 nt, Homo Sapiens; identical to SEQ ID NO: 124752

SEQ ID NO: 275239 - RNA, 64 nt, Homo Sapiens; identical to SEQ ID NO: 124753

SEQ ID NO: 275240 - RNA, 64 nt, Homo Sapiens; identical to SEQ ID NO: 124754

SEQ ID NO: 275241 - RNA, 64 nt, Homo Sapiens; identical to SEQ ID NO: 124755

SEQ ID NO: 275242 - RNA, 64 nt, Homo Sapiens; identical to SEQ ID NO: 124756

SEQ ID NO: 275243 - RNA, 64 nt, Homo Sapiens; identical to SEQ ID NO: 124757

SEQ ID NO: 275244 - RNA, 64 nt, Homo Sapiens; identical to SEQ ID NO: 124758

SEQ ID NO: 275245 - RNA, 64 nt, Homo Sapiens; identical to SEQ ID NO: 124759

SEQ ID NO: 275246 - RNA, 64 nt, Homo Sapiens; identical to SEQ ID NO: 124760

SEQ ID NO: 275247 - RNA, 64 nt, Homo Sapiens; identical to SEQ ID NO: 124761

SEQ ID NO: 275248 - RNA, 64 nt, Homo Sapiens; identical to SEQ ID NO: 124762

SEQ ID NO: 275249 - RNA, 64 nt, Homo Sapiens; identical to SEQ ID NO: 124763

SEQ ID NO: 275250 - RNA, 64 nt, Homo Sapiens; identical to SEQ ID NO: 124764

SEQ ID NO: 275251 - RNA, 64 nt, Homo Sapiens; identical to SEQ ID NO: 124765

SEQ ID NO: 275252 - RNA, 64 nt, Homo Sapiens; identical to SEQ ID NO: 124766

SEQ ID NO: 275253 - RNA, 64 nt, Homo Sapiens; identical to SEQ ID NO: 124767

SEQ ID NO: 275254 - RNA, 64 nt, Homo Sapiens; identical to SEQ ID NO: 124768

SEQ ID NO: 275255 - RNA, 64 nt, Homo Sapiens; identical to SEQ ID NO: 124769

SEQ ID NO: 275256 - RNA, 64 nt, Homo Sapiens; identical to SEQ ID NO: 124770

SEQ ID NO: 275257 - RNA, 64 nt, Homo Sapiens; identical to SEQ ID NO: 124771

SEQ ID NO: 275258 - RNA, 64 nt, Homo Sapiens; identical to SEQ ID NO: 124772

SEQ ID NO: 275259 - RNA, 64 nt, Homo Sapiens; identical to SEQ ID NO: 124773

SEQ ID NO: 275260 - RNA, 64 nt, Homo Sapiens; identical to SEQ ID NO: 124774

SEQ ID NO: 275261 - RNA, 64 nt, Homo Sapiens; identical to SEQ ID NO: 124775

SEQ ID NO: 275262 - RNA, 64 nt, Homo Sapiens; identical to SEQ ID NO: 124776

SEQ ID NO: 275263 - RNA, 64 nt, Homo Sapiens; identical to SEQ ID NO: 124777

SEQ ID NO: 275264 - RNA, 64 nt, Homo Sapiens; identical to SEQ ID NO: 124778

SEQ ID NO: 275265 - RNA, 64 nt, Homo Sapiens; identical to SEQ ID NO: 124779

SEQ ID NO: 275266 - RNA, 64 nt, Homo Sapiens; identical to SEQ ID NO: 124780

SEQ ID NO: 275267 - RNA, 64 nt, Homo Sapiens; identical to SEQ ID NO: 124781

SEQ ID NO: 275268 - RNA, 64 nt, Homo Sapiens; identical to SEQ ID NO: 124782

SEQ ID NO: 275269 - RNA, 64 nt, Homo Sapiens; identical to SEQ ID NO: 124783

SEQ ID NO: 275270 - RNA, 64 nt, Homo Sapiens; identical to SEQ ID NO: 124784

SEQ ID NO: 275271 - RNA, 64 nt, Homo Sapiens; identical to SEQ ID NO: 124785

SEQ ID NO: 275272 - RNA, 64 nt, Homo Sapiens; identical to SEQ ID NO: 124786

SEQ ID NO: 275273 - RNA, 64 nt, Homo Sapiens; identical to SEQ ID NO: 124787

SEQ ID NO: 275274 - RNA, 64 nt, Homo Sapiens; identical to SEQ ID NO: 124788

SEQ ID NO: 275275 - RNA, 64 nt, Homo Sapiens; identical to SEQ ID NO: 124789

SEQ ID NO: 275276 - RNA, 64 nt, Homo Sapiens; identical to SEQ ID NO: 124790

SEQ ID NO: 275277 - RNA, 64 nt, Homo Sapiens; identical to SEQ ID NO: 124791

SEQ ID NO: 275278 - RNA, 64 nt, Homo Sapiens; identical to SEQ ID NO: 124792

SEQ ID NO: 275279 - RNA, 64 nt, Homo Sapiens; identical to SEQ ID NO: 124793

SEQ ID NO: 275280 - RNA, 64 nt, Homo Sapiens; identical to SEQ ID NO: 124794

SEQ ID NO: 275281 - RNA, 64 nt, Homo Sapiens; identical to SEQ ID NO: 124795

SEQ ID NO: 275282 - RNA, 64 nt, Homo Sapiens; identical to SEQ ID NO: 124796

SEQ ID NO: 275283 - RNA, 64 nt, Homo Sapiens; identical to SEQ ID NO: 124797

SEQ ID NO: 275284 - RNA, 64 nt, Homo Sapiens; identical to SEQ ID NO: 124798

SEQ ID NO: 275285 - RNA, 64 nt, Homo Sapiens; identical to SEQ ID NO: 124799

SEQ ID NO: 275286 - RNA, 64 nt, Homo Sapiens; identical to SEQ ID NO: 124800

SEQ ID NO: 275287 - RNA, 64 nt, Homo Sapiens; identical to SEQ ID NO: 124801

SEQ ID NO: 275288 - RNA, 64 nt, Homo Sapiens; identical to SEQ ID NO: 124802

SEQ ID NO: 275289 - RNA, 64 nt, Homo Sapiens; identical to SEQ ID NO: 124803

SEQ ID NO: 275290 - RNA, 64 nt, Homo Sapiens; identical to SEQ ID NO: 124804

SEQ ID NO: 275291 - RNA, 64 nt, Homo Sapiens; identical to SEQ ID NO: 124805

SEQ ID NO: 275292 - RNA, 64 nt, Homo Sapiens; identical to SEQ ID NO: 124806

SEQ ID NO: 275293 - RNA, 64 nt, Homo Sapiens; identical to SEQ ID NO: 124807

SEQ ID NO: 275294 - RNA, 64 nt, Homo Sapiens; identical to SEQ ID NO: 124808

SEQ ID NO: 275295 - RNA, 64 nt, Homo Sapiens; identical to SEQ ID NO: 124809

SEQ ID NO: 275296 - RNA, 64 nt, Homo Sapiens; identical to SEQ ID NO: 124810

SEQ ID NO: 275297 - RNA, 64 nt, Homo Sapiens; identical to SEQ ID NO: 124811

SEQ ID NO: 275298 - RNA, 64 nt, Homo Sapiens; identical to SEQ ID NO: 124812

SEQ ID NO: 275299 - RNA, 64 nt, Homo Sapiens; identical to SEQ ID NO: 103795

SEQ ID NO: 275300 - RNA, 64 nt, Homo Sapiens; identical to SEQ ID NO: 103796

SEQ ID NO: 275301 - RNA, 64 nt, Homo Sapiens; identical to SEQ ID NO: 103797

SEQ ID NO: 275302 - RNA, 64 nt, Homo Sapiens; identical to SEQ ID NO: 103798

SEQ ID NO: 275303 - RNA, 64 nt, Homo Sapiens; identical to SEQ ID NO: 103799

SEQ ID NO: 275304 - RNA, 64 nt, Homo Sapiens; identical to SEQ ID NO: 103800

SEQ ID NO: 275305 - RNA, 64 nt, Homo Sapiens; identical to SEQ ID NO: 103801

SEQ ID NO: 275306 - RNA, 64 nt, Homo Sapiens; identical to SEQ ID NO: 103802

SEQ ID NO: 275307 - RNA, 64 nt, Homo Sapiens; identical to SEQ ID NO: 103803

SEQ ID NO: 275308 - RNA, 64 nt, Homo Sapiens; identical to SEQ ID NO: 103804

SEQ ID NO: 275309 - RNA, 64 nt, Homo Sapiens; identical to SEQ ID NO: 103805

SEQ ID NO: 275310 - RNA, 64 nt, Homo Sapiens; identical to SEQ ID NO: 103806

SEQ ID NO: 275311 - RNA, 64 nt, Homo Sapiens; identical to SEQ ID NO: 103807

SEQ ID NO: 275312 - RNA, 64 nt, Homo Sapiens; identical to SEQ ID NO: 103808

SEQ ID NO: 275313 - RNA, 64 nt, Homo Sapiens; identical to SEQ ID NO: 103809

SEQ ID NO: 275314 - RNA, 64 nt, Homo Sapiens; identical to SEQ ID NO: 103810

SEQ ID NO: 275315 - RNA, 64 nt, Homo Sapiens; identical to SEQ ID NO: 103811

SEQ ID NO: 275316 - RNA, 64 nt, Homo Sapiens; identical to SEQ ID NO: 103812

SEQ ID NO: 275317 - RNA, 64 nt, Homo Sapiens; identical to SEQ ID NO: 103813

SEQ ID NO: 275318 - RNA, 64 nt, Homo Sapiens; identical to SEQ ID NO: 103814

SEQ ID NO: 275319 - RNA, 64 nt, Homo Sapiens; identical to SEQ ID NO: 103815

SEQ ID NO: 275320 - RNA, 64 nt, Homo Sapiens; identical to SEQ ID NO: 103816

SEQ ID NO: 275321 - RNA, 64 nt, Homo Sapiens; identical to SEQ ID NO: 103817

SEQ ID NO: 275322 - RNA, 64 nt, Homo Sapiens; identical to SEQ ID NO: 103818

SEQ ID NO: 275323 - RNA, 64 nt, Homo Sapiens; identical to SEQ ID NO: 103819

SEQ ID NO: 275324 - RNA, 64 nt, Homo Sapiens; identical to SEQ ID NO: 103820

SEQ ID NO: 275325 - RNA, 64 nt, Homo Sapiens; identical to SEQ ID NO: 103821

SEQ ID NO: 275326 - RNA, 64 nt, Homo Sapiens; identical to SEQ ID NO: 103822

SEQ ID NO: 275327 - RNA, 64 nt, Homo Sapiens; identical to SEQ ID NO: 103823

SEQ ID NO: 275328 - RNA, 64 nt, Homo Sapiens; identical to SEQ ID NO: 103824

SEQ ID NO: 275329 - RNA, 64 nt, Homo Sapiens; identical to SEQ ID NO: 103825

SEQ ID NO: 275330 - RNA, 64 nt, Homo Sapiens; identical to SEQ ID NO: 103826

SEQ ID NO: 275331 - RNA, 64 nt, Homo Sapiens; identical to SEQ ID NO: 103827

SEQ ID NO: 275332 - RNA, 64 nt, Homo Sapiens; identical to SEQ ID NO: 103828

SEQ ID NO: 275333 - RNA, 64 nt, Homo Sapiens; identical to SEQ ID NO: 103829

SEQ ID NO: 275334 - RNA, 64 nt, Homo Sapiens; identical to SEQ ID NO: 103830

SEQ ID NO: 275335 - RNA, 64 nt, Homo Sapiens; identical to SEQ ID NO: 103831

SEQ ID NO: 275336 - RNA, 64 nt, Homo Sapiens; identical to SEQ ID NO: 103832

SEQ ID NO: 275337 - RNA, 64 nt, Homo Sapiens; identical to SEQ ID NO: 103833

SEQ ID NO: 275338 - RNA, 64 nt, Homo Sapiens; identical to SEQ ID NO: 103834

SEQ ID NO: 275339 - RNA, 64 nt, Homo Sapiens; identical to SEQ ID NO: 103835

SEQ ID NO: 275340 - RNA, 64 nt, Homo Sapiens; identical to SEQ ID NO: 103836

SEQ ID NO: 275341 - RNA, 64 nt, Homo Sapiens; identical to SEQ ID NO: 103837

SEQ ID NO: 275342 - RNA, 64 nt, Homo Sapiens; identical to SEQ ID NO: 103838

SEQ ID NO: 275343 - RNA, 64 nt, Homo Sapiens; identical to SEQ ID NO: 103839

SEQ ID NO: 275344 - RNA, 64 nt, Homo Sapiens; identical to SEQ ID NO: 103840

SEQ ID NO: 275345 - RNA, 64 nt, Homo Sapiens
cuuccuuucccacuggcucuguauaaaaaacuucuggaccaaaagccaucauuggaagauuuaa

SEQ ID NO: 275346 - RNA, 64 nt, Homo Sapiens
guugacuuaauuccaaaugggaucuccauaccuguggaccaaaccaacaaguaaguuuugacag

SEQ ID NO: 275347 - RNA, 64 nt, Homo Sapiens
agccaaacuaucaguauuuuuuaagccuaauaaauggaccaauaaucacuuuauaaaacauaca

SEQ ID NO: 275348 - RNA, 64 nt, Homo Sapiens
gcuaaaaauauugcagggcaaugauggagaaaaauggaccaaagaaaaaaaaggagaguauaga

SEQ ID NO: 275349 - RNA, 64 nt, Homo Sapiens
uucagcucuaacauggaggucagagaaagggacuuggaccaauaaaaugacauggaggccuaac

SEQ ID NO: 275350 - RNA, 64 nt, Homo Sapiens
cacaucuucuaugagccagaugcuuaugaugaccuggaccaagaagacccagaugacgaccugg

SEQ ID NO: 275351 - RNA, 64 nt, Homo Sapiens
cuccaucucucagggagacaaagaaccuccuuccuggaccaaggaggugcugccaaguuuucua

SEQ ID NO: 275352 - RNA, 64 nt, Homo Sapiens
uaaggauuuggaauaaggauuugguccuguuuucuggaccaaauccuuacucuggcucugcuua

SEQ ID NO: 275353 - RNA, 64 nt, Homo Sapiens
agcaggacaugggcggggacagcgcucuguaaaauggaccaauccucuguaagauggaccaauc

SEQ ID NO: 275354 - RNA, 64 nt, Homo Sapiens
agcgcucuguaaaauggaccagcacucuguaagauggaccaaucgauuguaaaauggaccaauc

SEQ ID NO: 275355 - RNA, 64 nt, Homo Sapiens
agcacucuguaagauggaccagaggauuguaaaauggaccaaucgagaacuuuucugucuuaca

SEQ ID NO: 275356 - RNA, 64 nt, Homo Sapiens
uccucagauuggugcagcuucucuugucucuuuuuggaccaauacucugcuugagccucguggu

SEQ ID NO: 275357 - RNA, 64 nt, Homo Sapiens
caccuugacacaaggacuccgguggcuguucagguggaccaaaguuucucuuggcugagugaca

SEQ ID NO: 275358 - RNA, 64 nt, Homo Sapiens
aggucuagggaaccacaacccuuauuguccuggguggaccaauccaaaggcuaagugauaguga

SEQ ID NO: 275359 - RNA, 64 nt, Homo Sapiens
guaauagugacccuuucacguccuggagcccgaguggaccaaucggaagccuaagugacgauga

SEQ ID NO: 275360 - RNA, 64 nt, Homo Sapiens
guaguggacccaguucuauuguuggcuucagcgguggaccaagcacugguguuggcuucugcag

SEQ ID NO: 275361 - RNA, 64 nt, Homo Sapiens
gcgguggaccaagcacugguguuggcuucugcaguggaccaagcaccaguggcuucagcggugg

SEQ ID NO: 275362 - RNA, 64 nt, Homo Sapiens
gcgguggaccgagcacaggagcuggcuucggcgguggaccaaacacuggugcuggcuuuggugg

SEQ ID NO: 275363 - RNA, 64 nt, Homo Sapiens
ccagauauuucacauuuugaaacugcagucagcaugaauccaguggcaacaguacuucaaacag

SEQ ID NO: 275364 - RNA, 64 nt, Homo Sapiens
aaggcauaccuuaaacaagcggaccaggaagcccugaauccauauuacuccaguauaugcugau

SEQ ID NO: 275365 - RNA, 64 nt, Homo Sapiens
uacaguauaguaccauuauuuuauguugugccagugaauccaguugccagaaauaagucugaau

SEQ ID NO: 275366 - RNA, 64 nt, Homo Sapiens
aguauuggcaaucaugacaccuguaauaaaaacuugaauccaaagucaaaacuuaagcaagaua

SEQ ID NO: 275367 - RNA, 64 nt, Homo Sapiens
aguaccaaauaauauauaguuuuaccccaacuacugaauccaggguuugaauauagaaacuuuu

SEQ ID NO: 275368 - RNA, 64 nt, Homo Sapiens
cugaacgugggugcuuguguugaggaggaacaguugaauccagcuuacuguuggucaaaaauca

SEQ ID NO: 275369 - RNA, 64 nt, Homo Sapiens
uuuccuuucagaacauuuuccagauggcgaggucacagcagagagauguggccaccuagccuuu

SEQ ID NO: 275370 - RNA, 64 nt, Homo Sapiens
gaauuucaugucucuggaauugaggugguagugaacagcagaucggucagcaccagaagucaac

SEQ ID NO: 275371 - RNA, 64 nt, Homo Sapiens
agcuggaugggacuaccuuucuguucaucaccacacagcagaauuucuaauggaaguuuguugu

SEQ ID NO: 275372 - RNA, 64 nt, Homo Sapiens
cagcaucaggucccagagggccaccguguccauuacagcagaguccagcugcagcauccagcuc

SEQ ID NO: 275373 - RNA, 64 nt, Homo Sapiens
guauuugaaggaaaaauacccugauuugaaaccaacagcagauguugcaaacuuucauaccacu

SEQ ID NO: 275374 - RNA, 64 nt, Homo Sapiens
acucuaccaccaagaaccuaaaaggaauuagaauacagcagaauuggccucagugaagagcuua

SEQ ID NO: 275375 - RNA, 64 nt, Homo Sapiens
aaauucauuagugcucccacacagaugagcaauuacagcagagaaccucauucagccguauugc

SEQ ID NO: 275376 - RNA, 64 nt, Homo Sapiens
guagaagucauaugaaugagacaugucuguccucacagcagaauaucaugcugaaagcacucag

SEQ ID NO: 275377 - RNA, 64 nt, Homo Sapiens
cacguggguauuuuaguacuuuagggcaaauaacacagcagaaccacucugccccucacuuccu

SEQ ID NO: 275378 - RNA, 64 nt, Homo Sapiens
ggauagaagucugguggaggauugggggcugggaacagcagaggugggguuuccugcugcagga

SEQ ID NO: 275379 - RNA, 64 nt, Homo Sapiens
uucauuuggaugcagugaaaagggcagaaauaccacagcagagaauaaaauugauaauguuggc

SEQ ID NO: 275380 - RNA, 64 nt, Homo Sapiens
uagaaggugggaggggaaugcuauacagcugggaacagcagacuuucucugaagggccagaugg

SEQ ID NO: 275381 - RNA, 64 nt, Homo Sapiens
cugcaauucaacacauccacagguucgagcccaaacagcagaacuuuuugccaaaaugacagca

SEQ ID NO: 275382 - RNA, 64 nt, Homo Sapiens
ucgagcccaaacagcagaacuuuuugccaaaaugacagcagauaaacugauagguccaaaggua

SEQ ID NO: 275383 - RNA, 64 nt, Homo Sapiens
uacaaagcuguaguucacaauaauguuaauuaugacagcagaucuuucaguguagcuucaagau

SEQ ID NO: 275384 - RNA, 64 nt, Homo Sapiens
aucauggauauacggcacuuaugcaaauccagccacagcagacagcagucagcagcaucuaugg

SEQ ID NO: 275385 - RNA, 64 nt, Homo Sapiens
cuuugucagcaauacuaaggaauuccuguauucuacagcagauaacuauguuucuauucuaagu

SEQ ID NO: 275386 - RNA, 64 nt, Homo Sapiens
ggagaacuauccaaaacuaacucccccaugagguacagcagaaaucucuauugcugcucucuca

SEQ ID NO: 275387 - RNA, 64 nt, Homo Sapiens
gcuuucuccuacagggcuuuuccugaguccccagacagcagaguaugaacugcugacacccaga

SEQ ID NO: 275388 - RNA, 64 nt, Homo Sapiens
cagauacaugcugguucuccuugcugugugugacacagcagacagaggcacuauuccuggugca

SEQ ID NO: 275389 - RNA, 64 nt, Homo Sapiens
aagugcaauguguuuuaaaauaagcuugcaaaugacagcagagacauuuacuucugcaguuagu

SEQ ID NO: 275390 - RNA, 64 nt, Homo Sapiens
cuagacauuuauguaacaucuugcuguacuaaauacagcagaaaaucuacucuuuagcaauaua

SEQ ID NO: 275391 - RNA, 64 nt, Homo Sapiens
gaauaauaaaauugcaaccaguuugguaaugcaaacagcagaauagaaugaaaucucaguaaug

SEQ ID NO: 275392 - RNA, 64 nt, Homo Sapiens
agagaauguuuauacaaaaaaugaaauucuuccaacagcagagaaacucuaaaaaguuugauag

SEQ ID NO: 275393 - RNA, 64 nt, Homo Sapiens
cuaugggaaggagcaggcgguuggaaauccugugacagcagagaucuucuggauuuuugccugg

SEQ ID NO: 275394 - RNA, 64 nt, Homo Sapiens
ugcgccuccacugucaccuguaccaagugccaaaacagcagaggggccaguuagagcaagagcu

SEQ ID NO: 275395 - RNA, 64 nt, Homo Sapiens
uuuaaauagauuauuuuauaacaaucacugaaaaacagcagaugguugcuuccacauuaacaaa

SEQ ID NO: 275396 - RNA, 64 nt, Homo Sapiens
aaucauagaaaauguugcuuagucaaaacagguaacagcagauuuuuucuuuuuguaguagcuc

SEQ ID NO: 275397 - RNA, 64 nt, Homo Sapiens
cauuaaacuugcuguguccgucuuaauucuauguacagcagagaggaugaggagggggaaaggg

SEQ ID NO: 275398 - RNA, 64 nt, Homo Sapiens
ucacacacugacccuccgcccccugcccagcaccacagcagagaccuuggcuuaacuccuaagc

SEQ ID NO: 275399 - RNA, 64 nt, Homo Sapiens
caagucuguggcagguugacggcacguuuauuucacagcagagccucccccugccacccucccu

SEQ ID NO: 275400 - RNA, 64 nt, Homo Sapiens
ugauaugggaucccuuagccaguuugguuucaacacagcagaccagaaacguugguaaaagggc

SEQ ID NO: 275401 - RNA, 64 nt, Homo Sapiens
cguugguaaaagggcaguuucuucucugggcugcacagcagaaacucccucuccuucccugaca

SEQ ID NO: 275402 - RNA, 64 nt, Homo Sapiens
caucugcgacaccaccaacauuuguccacacaagacagcagagcagcuccugaaucccuuucag

SEQ ID NO: 275403 - RNA, 64 nt, Homo Sapiens
aaaauuacagaagaagcuccuauguccaugaaaaacagcagaguaacuccuggaucccuuucac

SEQ ID NO: 275404 - RNA, 64 nt, Homo Sapiens
guuauaacgcaaguucauguuagggcagaucuggacagcagaaucagaccgaccaccagcacag

SEQ ID NO: 275405 - RNA, 64 nt, Homo Sapiens
cucagagaaaagcuguuugcguaagucucaauuaacagcagaaucucagagacacaaaaauacu

SEQ ID NO: 275406 - RNA, 64 nt, Homo Sapiens
caaucacagacccaccacacacaccagcucagccacagcagagccauccccugcacccgcuacc

SEQ ID NO: 275407 - RNA, 64 nt, Homo Sapiens
aguacaagucacccuacaacaccaccccaaguacacagcagaaucgaguuugggccaguuuacc

SEQ ID NO: 275408 - RNA, 64 nt, Homo Sapiens
aaugaaacauacucucccuauuaaggcucucaaaacagcagaacccacuucccauauaagaugc

SEQ ID NO: 275409 - RNA, 64 nt, Homo Sapiens
uggaugcuagcuacaccagcacaauugugucuccacagcagagggcucacagaugcagagacug

SEQ ID NO: 275410 - RNA, 64 nt, Homo Sapiens
uagaagauaucacugcagccauccccagaagcaaacagcagaggucagugaccugccugcaagc

SEQ ID NO: 275411 - RNA, 64 nt, Homo Sapiens
auuugcuggcgagaguccugcauccauuaugaauacagcagaacaauugcagugggggcuaagg

SEQ ID NO: 275412 - RNA, 64 nt, Homo Sapiens
guggaguuuguucagugguacgguguccaagcaaacagcagaaugcaacuuucuaaacagcccc

SEQ ID NO: 275413 - RNA, 64 nt, Homo Sapiens
agcagaaugcaacuuucuaaacagccccaagcaaacagcagaauucaacuuuuuaaacaauaaa

SEQ ID NO: 275414 - RNA, 64 nt, Homo Sapiens
cauagacugcuccuccaaggggaagcaguguggaacagcagagaaagucccgucccuaucucug

SEQ ID NO: 275415 - RNA, 64 nt, Homo Sapiens
uuaguccccaaccuuguggucacaucagaggucaacagcagaacagaggcaggucaggguuguc

SEQ ID NO: 275416 - RNA, 64 nt, Homo Sapiens
gggggaagcuguguggaaggagaagcugguggccacagcagaguccugcucuggggacgccugc

SEQ ID NO: 275417 - RNA, 64 nt, Homo Sapiens
gccugagcuugcugcccaacgggaggauggcuucacagcagagccagcaugagggguggggccu

SEQ ID NO: 275418 - RNA, 64 nt, Homo Sapiens
ccacaacggccagcaggugccccauccucugcccacagcagacucugucccauggcucuccggg

SEQ ID NO: 275419 - RNA, 64 nt, Homo Sapiens
ggccugguguggaaccagggagcugugggaagccacagcagaaauggaagaaaaacaggucuca

SEQ ID NO: 275420 - RNA, 64 nt, Homo Sapiens
auauuuugaaauggacugugaaggaaaaggggacaggaacaaaggaccaaaaauaagcuacaug

SEQ ID NO: 275421 - RNA, 64 nt, Homo Sapiens
uaaauguggaacauuauuaacuuacuuugugucuaggaacaauggauuuuguaucugauuuaaa

SEQ ID NO: 275422 - RNA, 64 nt, Homo Sapiens
augaucuuguuacugugauagcccgcaauacuguaggaacaagcugcuuucacuuaagugucug

SEQ ID NO: 275423 - RNA, 64 nt, Homo Sapiens
augucucucugccaagauccucuuuccaauccagaggaacaagcagauucccgagaguaaauca

SEQ ID NO: 275424 - RNA, 64 nt, Homo Sapiens
aagcuuucagugaaacacuacauacacgaagaaaaggaacaagguuuaacuauuuaagaaccau

SEQ ID NO: 275425 - RNA, 64 nt, Homo Sapiens
gcacgaucaugucccuuuuuaagccuuaccugagaggaacaaugccuuaaaauaaaaaagcauu

SEQ ID NO: 275426 - RNA, 64 nt, Homo Sapiens
auuaauacagauacucagaacuucauaugcuggcaggaacaacuucaguuguguauuuguucau

SEQ ID NO: 275427 - RNA, 64 nt, Homo Sapiens
gaaagagcugaaggccaccuggcaauugcagcuaaggaacaauguggcucaucucaggacagaa

SEQ ID NO: 275428 - RNA, 64 nt, Homo Sapiens
ccccagaaaagaaagggaagcugcaaguggacaaaggaacaagcaaucuauagaaagaauuuag

SEQ ID NO: 275429 - RNA, 64 nt, Homo Sapiens
gaggucccuguuaggguucucuggcaggacucacaggaacaaacaagcacccauuaaacaaguc

SEQ ID NO: 275430 - RNA, 64 nt, Homo Sapiens
gucuuuugaacuuccaguagucaaccucagaaacaggaacaaucaauuuucuugcauuuagaug

SEQ ID NO: 275431 - RNA, 64 nt, Homo Sapiens
uagcacugaauuuuggguggaauccacuugcccuaggaacaaguugcacuguuccaguaguuau

SEQ ID NO: 275432 - RNA, 64 nt, Homo Sapiens
aaaagagcuccugaaggaagcacuaaacauggaaaggaacaacugauaccagccgcugcaaaau

SEQ ID NO: 275433 - RNA, 64 nt, Homo Sapiens
uaguuggaaguaaagcacuccucagcaaauguaaaggaacaaaaauuauaacaaacugucucuc

SEQ ID NO: 275434 - RNA, 64 nt, Homo Sapiens
auccagaaucuacaaugaacucaaacaaauuuacaggaacaaacaaccccaucaaaaagucggc

SEQ ID NO: 275435 - RNA, 64 nt, Homo Sapiens
aaaaugaaaaaagagcaggcauccauuuccauacaggaacaaaauaggaggcagcacuacagac

SEQ ID NO: 275436 - RNA, 64 nt, Homo Sapiens
uguauauauuuacacaaauacauuugaucagacuaggaacaaguugauaccaaaaccugaaaag

SEQ ID NO: 275437 - RNA, 64 nt, Homo Sapiens
uaaauuauguaucaaggccaucaguaucccuggguuacacuaauugaugauuuagaaauuaaag

SEQ ID NO: 275438 - RNA, 64 nt, Homo Sapiens
gcaaaggaaggguagaaaggaauugaaaauuaauuuacacuaguugcuacuugggaauaaaggg

SEQ ID NO: 275439 - RNA, 64 nt, Homo Sapiens
aguaacaggccuugagcacauugaaacacaagaauuacacuaauguaugcucguuucucucaau

SEQ ID NO: 275440 - RNA, 64 nt, Homo Sapiens
ugauauucauauucaagcaaccuucuacauuuuauuacacuaaagcuggaacacaauaaugugu

SEQ ID NO: 275441 - RNA, 64 nt, Homo Sapiens
aaaaaaaaaaaaaaaaaaguaucaaccaacaaauguuaccaagauaacgugacuucaugaggga

SEQ ID NO: 275442 - RNA, 64 nt, Homo Sapiens
ccagaaaauuagaagauggucaaaaaaaguccaaguuaccaauuuuuuaaaauuuauaggcaaa

SEQ ID NO: 275443 - RNA, 64 nt, Homo Sapiens
aacaacugucaguuuuauugauuugaucagaacuguuaccaaaaaucacgagguguaauuuuua

SEQ ID NO: 275444 - RNA, 64 nt, Homo Sapiens
uguuuuuggaaauucacacccacacucuucaacgguuaccaaaccagagggacaaagccacagc

SEQ ID NO: 275445 - RNA, 64 nt, Homo Sapiens; identical to SEQ ID NO: 53771

SEQ ID NO: 275446 - RNA, 64 nt, Homo Sapiens; identical to SEQ ID NO: 53772

SEQ ID NO: 275447 - RNA, 64 nt, Homo Sapiens; identical to SEQ ID NO: 53773

SEQ ID NO: 275448 - RNA, 64 nt, Homo Sapiens; identical to SEQ ID NO: 53774

SEQ ID NO: 275449 - RNA, 64 nt, Homo Sapiens; identical to SEQ ID NO: 53775

SEQ ID NO: 275450 - RNA, 64 nt, Homo Sapiens; identical to SEQ ID NO: 53776

SEQ ID NO: 275451 - RNA, 64 nt, Homo Sapiens; identical to SEQ ID NO: 53777

SEQ ID NO: 275452 - RNA, 64 nt, Homo Sapiens; identical to SEQ ID NO: 53778

SEQ ID NO: 275453 - RNA, 64 nt, Homo Sapiens; identical to SEQ ID NO: 53779

SEQ ID NO: 275454 - RNA, 64 nt, Homo Sapiens; identical to SEQ ID NO: 53780

SEQ ID NO: 275455 - RNA, 64 nt, Homo Sapiens; identical to SEQ ID NO: 53781

SEQ ID NO: 275456 - RNA, 64 nt, Homo Sapiens; identical to SEQ ID NO: 53782

SEQ ID NO: 275457 - RNA, 64 nt, Homo Sapiens; identical to SEQ ID NO: 53783

SEQ ID NO: 275458 - RNA, 64 nt, Homo Sapiens; identical to SEQ ID NO: 53784

SEQ ID NO: 275459 - RNA, 64 nt, Homo Sapiens; identical to SEQ ID NO: 53785

SEQ ID NO: 275460 - RNA, 64 nt, Homo Sapiens; identical to SEQ ID NO: 53786

SEQ ID NO: 275461 - RNA, 64 nt, Homo Sapiens; identical to SEQ ID NO: 53787

SEQ ID NO: 275462 - RNA, 64 nt, Homo Sapiens; identical to SEQ ID NO: 53788

SEQ ID NO: 275463 - RNA, 64 nt, Homo Sapiens; identical to SEQ ID NO: 53789

SEQ ID NO: 275464 - RNA, 64 nt, Homo Sapiens; identical to SEQ ID NO: 53790

SEQ ID NO: 275465 - RNA, 64 nt, Homo Sapiens; identical to SEQ ID NO: 53791

SEQ ID NO: 275466 - RNA, 64 nt, Homo Sapiens; identical to SEQ ID NO: 53792

SEQ ID NO: 275467 - RNA, 64 nt, Homo Sapiens; identical to SEQ ID NO: 53793

SEQ ID NO: 275468 - RNA, 64 nt, Homo Sapiens; identical to SEQ ID NO: 53794

SEQ ID NO: 275469 - RNA, 64 nt, Homo Sapiens; identical to SEQ ID NO: 53795

SEQ ID NO: 275470 - RNA, 64 nt, Homo Sapiens; identical to SEQ ID NO: 53796

SEQ ID NO: 275471 - RNA, 64 nt, Homo Sapiens; identical to SEQ ID NO: 53797

SEQ ID NO: 275472 - RNA, 64 nt, Homo Sapiens; identical to SEQ ID NO: 53798

SEQ ID NO: 275473 - RNA, 64 nt, Homo Sapiens; identical to SEQ ID NO: 53799

SEQ ID NO: 275474 - RNA, 64 nt, Homo Sapiens; identical to SEQ ID NO: 53800

SEQ ID NO: 275475 - RNA, 64 nt, Homo Sapiens; identical to SEQ ID NO: 53801

SEQ ID NO: 275476 - RNA, 64 nt, Homo Sapiens; identical to SEQ ID NO: 53802

SEQ ID NO: 275477 - RNA, 64 nt, Homo Sapiens; identical to SEQ ID NO: 53803

SEQ ID NO: 275478 - RNA, 64 nt, Homo Sapiens; identical to SEQ ID NO: 53804

SEQ ID NO: 275479 - RNA, 64 nt, Homo Sapiens; identical to SEQ ID NO: 53805

SEQ ID NO: 275480 - RNA, 64 nt, Homo Sapiens; identical to SEQ ID NO: 53806

SEQ ID NO: 275481 - RNA, 64 nt, Homo Sapiens; identical to SEQ ID NO: 53807

SEQ ID NO: 275482 - RNA, 64 nt, Homo Sapiens; identical to SEQ ID NO: 53808

SEQ ID NO: 275483 - RNA, 64 nt, Homo Sapiens; identical to SEQ ID NO: 53809

SEQ ID NO: 275484 - RNA, 64 nt, Homo Sapiens; identical to SEQ ID NO: 53810

SEQ ID NO: 275485 - RNA, 64 nt, Homo Sapiens; identical to SEQ ID NO: 53811

SEQ ID NO: 275486 - RNA, 64 nt, Homo Sapiens; identical to SEQ ID NO: 53812

SEQ ID NO: 275487 - RNA, 64 nt, Homo Sapiens; identical to SEQ ID NO: 53813

SEQ ID NO: 275488 - RNA, 64 nt, Homo Sapiens; identical to SEQ ID NO: 53814

SEQ ID NO: 275489 - RNA, 64 nt, Homo Sapiens; identical to SEQ ID NO: 53815

SEQ ID NO: 275490 - RNA, 64 nt, Homo Sapiens
uuguugagcuucuaaguuucaugccugaugggauuaucuucagcguugacaaggccuaugggaa

SEQ ID NO: 275491 - RNA, 64 nt, Homo Sapiens
gacauauuagaaguugggaagaacaagauaaaucuaucuucaaaaaagcagaaggcuccaauau

SEQ ID NO: 275492 - RNA, 64 nt, Homo Sapiens
uaguuuuuaaaugggaauaauuguuguggugggguaucuucagugauagcauuuagaaagggcu

SEQ ID NO: 275493 - RNA, 64 nt, Homo Sapiens
cuuuuuccuauaaucauggaaaacaagaagacuguaucuucagcgaucucaacaguguggggug

SEQ ID NO: 275494 - RNA, 64 nt, Homo Sapiens
acaccaaauugucuuuagaaagacuaaugacauuuaucuucaaauccuaugaugcuauuaucau

SEQ ID NO: 275495 - RNA, 64 nt, Homo Sapiens
uuguagucagacacaaucagguuauuaauuaagauaucuucagccacucaauucuuccugcccu

SEQ ID NO: 275496 - RNA, 64 nt, Homo Sapiens
uuacaguucauuaacccaagugaaaaggcguugguaucuucauuacuggcuuugcuguaaugcu

SEQ ID NO: 275497 - RNA, 64 nt, Homo Sapiens
guaccuccuuaauccugcuuguugccuuuugcuuuaucuucaguaucugcuuguaaaaaugcuu

SEQ ID NO: 275498 - RNA, 64 nt, Homo Sapiens
ugucaccuuugcuacgcaagagaggccagcacauuaucuucauagguauccagggacuaugaug

SEQ ID NO: 275499 - RNA, 64 nt, Homo Sapiens
cucauccuuuacauuuuucaucaugcuaucaaauuaucuucaccgaaagggaggcuaauauuuu

SEQ ID NO: 275500 - RNA, 64 nt, Homo Sapiens
uuuucucuggccuuuaagguuaguuaagucaaucuaucuucaguacccauaaucugcuuggcaa

SEQ ID NO: 275501 - RNA, 64 nt, Homo Sapiens
gcggagaaacauguugauuuaccauuucugguuuuaucuucaaagucaagaugcuacaauggaa

SEQ ID NO: 275502 - RNA, 64 nt, Homo Sapiens
ggagaugaacacugacuuuuccauuauuuuuaaguaucuucauucuggccacagguccuuauug

SEQ ID NO: 275503 - RNA, 64 nt, Homo Sapiens
cuaaauuuucucccuaucaauugucuuuauauuuuaucuucaucuuuuuaucacauuaucacgu

SEQ ID NO: 275504 - RNA, 64 nt, Homo Sapiens
agaagaauugauccuauuuugaaccccucuccaguaucuucacacucuugucaacucuccaggc

SEQ ID NO: 275505 - RNA, 64 nt, Homo Sapiens
ccagcuucccucaaaucaguccuuauccucuuucuaucuucacucccaucaucaucuauuuuca

SEQ ID NO: 275506 - RNA, 64 nt, Homo Sapiens
uccagcuaagcaaagauuccuggaggcugacuuguaucuucagacucacagagugaauucagcu

SEQ ID NO: 275507 - RNA, 64 nt, Homo Sapiens
accauuuaaagcgauuuagcuuguuuuuacuuucuaucuucauaugaacuuugaugggguuuuu

SEQ ID NO: 275508 - RNA, 64 nt, Homo Sapiens
ucauuacuauaauaagauacuuuucauaauucauuaucuucagauuacaauuucugagcaugau

SEQ ID NO: 275509 - RNA, 64 nt, Homo Sapiens
gcuuuuaauguucuauucuguccagaaagccgauuaucuucauuaagcaccaguacuccaaccu

SEQ ID NO: 275510 - RNA, 64 nt, Homo Sapiens
uguacuuugggaugcuuuacgauggaauagaugguaucuucaggcagcucaaaugaucacauua

SEQ ID NO: 275511 - RNA, 64 nt, Homo Sapiens
uaauaugggcacauucuugccaauuucacacuuguaucuucagcagggacauuacaaucaaaca

SEQ ID NO: 275512 - RNA, 64 nt, Homo Sapiens
gcuguuagugugacauagcuuccagcuccucuguuaucuucacagcugacuucacacucacugg

SEQ ID NO: 275513 - RNA, 64 nt, Homo Sapiens
guauuaauuauuacauaaaggagcugugcccguuuaucuucauuauguuucugugagagugaca

SEQ ID NO: 275514 - RNA, 64 nt, Homo Sapiens
ugacuguucucugaaaaaaggggcuuuguccaguuaucuucauaacauguuugcaugaguguca

SEQ ID NO: 275515 - RNA, 64 nt, Homo Sapiens
uaaaaagaaaucaagucagugagccaaaaaaaaguaucuucauuuuauuauuuccaguucagaa

SEQ ID NO: 275516 - RNA, 64 nt, Homo Sapiens
caguaggaguuguuucaaguugcucaaaaugccauaucuucaacuaagucaguauacuuuugga

SEQ ID NO: 275517 - RNA, 64 nt, Homo Sapiens
aaauuccuaugagagaauaaauuuaaacaugguuuaucuucagcuuuaaaagccuuccaacacc

SEQ ID NO: 275518 - RNA, 64 nt, Homo Sapiens
aauacucuguacacauggugagggcccaucuccugcaucccaugccuggaaagagaacucuccc

SEQ ID NO: 275519 - RNA, 64 nt, Homo Sapiens
ucagaaggcugagaggguuuaccucccaggaccugcaucccagcggggagaugccuucuccccc

SEQ ID NO: 275520 - RNA, 64 nt, Homo Sapiens
ggggugcugcagccaggaggucccagagcccagggcaucccauggcaugccagagccuggggca

SEQ ID NO: 275521 - RNA, 64 nt, Homo Sapiens
gcccagggcaucccauggggugccagagccuggggcaucccagacacgccugcccagccucgca

SEQ ID NO: 275522 - RNA, 64 nt, Homo Sapiens
cagccucugccccagcccacuggcaugccacccagcaucccaccugugccugucccuguuugca

SEQ ID NO: 275523 - RNA, 64 nt, Homo Sapiens
gaucccacccacccaccguagggugcacagcaaggcaucccagcuucuggcccgcuccucacug

SEQ ID NO: 275524 - RNA, 64 nt, Homo Sapiens
uguguagcaaaguccacaugaaacucaucuggcugcaucccaggagauguacugcaauggaaca

SEQ ID NO: 275525 - RNA, 64 nt, Homo Sapiens
ggcaucuucuugacuguggcguuguaagagcucagcaucccaggguaaaagcuguugauuucga

SEQ ID NO: 275526 - RNA, 64 nt, Homo Sapiens
aucauucuacaaguaauuuuaaaauuaaaauccagcaucccaagccccuaacuuucuugcuuca

SEQ ID NO: 275527 - RNA, 64 nt, Homo Sapiens
ucagaagauggguguuguuuucaucuccaagauagcaucccaucaccaguccuaguuuuagacc

SEQ ID NO: 275528 - RNA, 64 nt, Homo Sapiens
gccaguuuagagaaauacauggcuucaggaauaugcaucccacaaacggaaugaccuuggcgcu

SEQ ID NO: 275529 - RNA, 64 nt, Homo Sapiens
auucuguuccgggcaggcauauucacaguugagugcaucccagcaaaggaagaccucaagaaaa

SEQ ID NO: 275530 - RNA, 64 nt, Homo Sapiens
ugaggugacaucucauccccucacugaagcaacagcaucccaaggugcucagccggacucccug

SEQ ID NO: 275531 - RNA, 64 nt, Homo Sapiens
gguccaggacgaucccagugggcucgcuuccaaagcaucccacucaagggagacuugaaacuuc

SEQ ID NO: 275532 - RNA, 64 nt, Homo Sapiens
ucaggagucagggcauggacagggugaugcagggaagggugacaauccaccaaauacacaggga

SEQ ID NO: 275533 - RNA, 64 nt, Homo Sapiens
cagggaagggugacaucaggccaaauacacagggaagggugaugccucaaucaagccuuaucca

SEQ ID NO: 275534 - RNA, 64 nt, Homo Sapiens
uccaaaaggagaaagcuauguagaaagauacauuaagggugaaaauagcaauacaguagauuug

SEQ ID NO: 275535 - RNA, 64 nt, Homo Sapiens
gucauucuggagguccuauuagagaauauuauaaaagggugaccuuguaggaaggaucugaguc

SEQ ID NO: 275536 - RNA, 64 nt, Homo Sapiens
uuuacuuucaaccauaagcgguaauagcagaggaaagggugaagggagucugggcaagcaaagc

SEQ ID NO: 275537 - RNA, 64 nt, Homo Sapiens
ggucuaguagguggaucccauccaguugguuuccaagggugauccugaaacaguguaaaaggag

SEQ ID NO: 275538 - RNA, 64 nt, Homo Sapiens
gcuaggacagcuggcugagaaguggguucaggcgaagggugaagccauguguagcaguuccugc

SEQ ID NO: 275539 - RNA, 64 nt, Homo Sapiens
uauuguauuuguguguuuguguuuguuuuuuuuuaagggugagccaggucuagcccaacagucu

SEQ ID NO: 275540 - RNA, 64 nt, Homo Sapiens
acuaaucaguugaacuuaacauuuaauaaaaagaaagggugaaauaaacugaagaccauuuuag

SEQ ID NO: 275541 - RNA, 64 nt, Homo Sapiens
ccaggacugcacgguuuaacacagcagaguacagaagggugaagaagugagcagaggcuuauga

SEQ ID NO: 275542 - RNA, 64 nt, Homo Sapiens
ucuugccagccgcaucgagaccagucacuugcagaagggugacuguguauaucuggcauguguc

SEQ ID NO: 275543 - RNA, 64 nt, Homo Sapiens
ugggggugugugugccgugugaggggguggguguaagggugagguguggaaggaggucgguucc

SEQ ID NO: 275544 - RNA, 64 nt, Homo Sapiens
gugagucaucccuacucccaacaucuggaggggaaagggugauucuggggguccacuugucugu

SEQ ID NO: 275545 - RNA, 64 nt, Homo Sapiens
caaggaaucaaaugucaucucccaggaguuauucaagggugagcccuuuacuugggauguacag

SEQ ID NO: 275546 - RNA, 64 nt, Homo Sapiens
aaacugaguaugaagaaaaaugauauucaaauguucuauuaaaauuuuaguuaacuacacuucu

SEQ ID NO: 275547 - RNA, 64 nt, Homo Sapiens
aggcacccugugcucacucacuccccaugaaaagucuauuaaguugcucaagagcucugccgug

SEQ ID NO: 275548 - RNA, 64 nt, Homo Sapiens
aaauaauggacuuuuuucuaaacagaaauuauuuucuauuaauuugcaaacugaugauuucacu

SEQ ID NO: 275549 - RNA, 64 nt, Homo Sapiens
ucuggcacguaauuuuuuucacaguuauuauucuucuauuaacaaauuauuuuuaucuuuccua

SEQ ID NO: 275550 - RNA, 64 nt, Homo Sapiens
aacaccagccuggccaagauggugaaaccccgucucuauuaaaaauauuuuuuaaaaauuaacu

SEQ ID NO: 275551 - RNA, 64 nt, Homo Sapiens
cuguauauuuuuauggcugcauuauuuuaauauuucuauuaaaacaaugagaggaaguguaaug

SEQ ID NO: 275552 - RNA, 64 nt, Homo Sapiens
aaauagaaucuguuuacaaaauggaaggaauacuucuauuaaccguuuggacuucgauagguug

SEQ ID NO: 275553 - RNA, 64 nt, Homo Sapiens
acccucuuuguccuagguguacccuuuccucaucucuauuaaauuguaaacaggacuacugcau

SEQ ID NO: 275554 - RNA, 64 nt, Homo Sapiens
uuauuuaauuuuuuagguaaugccuaucucuuggucuauuaaggaaagaagcaaucaguagaga

SEQ ID NO: 275555 - RNA, 64 nt, Homo Sapiens
acugauguguugauuuuacugauuguacuguacaucuauuaaagccuuagauuauuacauuacg

SEQ ID NO: 275556 - RNA, 64 nt, Homo Sapiens
uuuuucauuuccuacauuuauuagauuuucauuuucuauuaacaauugaauaccauuucaguuu

SEQ ID NO: 275557 - RNA, 64 nt, Homo Sapiens
aacacagaaaaguugaaaccacaacaaaaugaauucuauuaaagaauagccccagauauaaauu

SEQ ID NO: 275558 - RNA, 64 nt, Homo Sapiens
auuuaagcaaauuaaagacaauguuaacaaauuuucuauuaaaugcccugagugauaaaaccag

SEQ ID NO: 275559 - RNA, 64 nt, Homo Sapiens
ggcauguaauuuuaaaacugcaguagguuaaaauucuauuaaacaaauauagaaaauauuuugu

SEQ ID NO: 275560 - RNA, 64 nt, Homo Sapiens
aagaccagccuggccaacauggugaauccccgucucuauuaaaaauacaaaaauuagcugggug

SEQ ID NO: 275561 - RNA, 64 nt, Homo Sapiens
uuuucuccucuaaaaacugaauaauaagauaaaaucuauuaaauuuguaauuuaggaaaaaugu

SEQ ID NO: 275562 - RNA, 64 nt, Homo Sapiens
auuucaacuucccacauauauuugagccuguauaucuauuaaaauucucccaguagagauugag

SEQ ID NO: 275563 - RNA, 64 nt, Homo Sapiens
uguuuuaugucaaacaauuaugcuuaauauacagucuauuaaauguaagucuuguuugagauau

SEQ ID NO: 275564 - RNA, 64 nt, Homo Sapiens
uuuuccugauuugaaaguuuguuuuuaaaaguuuucuauuaauuauagugcacuauugaaucag

SEQ ID NO: 275565 - RNA, 64 nt, Homo Sapiens
auucccccaauuuuuuaaacuacuguaaagcauaucuauuaauaugggaaugaaaauacuuaaa

SEQ ID NO: 275566 - RNA, 64 nt, Homo Sapiens
aaaauggagaauguuuucucuaauauuucuauaaucuauuaaaauucuaaaacuauugaaaaau

SEQ ID NO: 275567 - RNA, 64 nt, Homo Sapiens
auuuagcaauuaccuuucuaaagucuuuccuucuucuauuaaauuuaagaauguuuauuuauca

SEQ ID NO: 275568 - RNA, 64 nt, Homo Sapiens
cuccaaauuuuaaguuucuaugcagcacugaaaaucuauuaaagcaagucaaaaaugaagauuu

SEQ ID NO: 275569 - RNA, 64 nt, Homo Sapiens
augaggcagacucgcuuauuuuuuugagagaauuucuauuaaagcuguaguggucacuaaaccc

SEQ ID NO: 275570 - RNA, 64 nt, Homo Sapiens
acuuguuaacaccuuauuuuaccuaagaaacauaucuauuaagcaagggucaguugggacauua

SEQ ID NO: 275571 - RNA, 64 nt, Homo Sapiens
uagcucagucaucaaagcagaagucuggcuuugcucuauuaagauuggaaauguacacuaccaa

SEQ ID NO: 275572 - RNA, 64 nt, Homo Sapiens
aguuacuugugacaagaauaauuuuggaauaauuucuauuaauaucaacucugaagcuaauugu

SEQ ID NO: 275573 - RNA, 64 nt, Homo Sapiens
auauugguacaacaugacuuaaaacuuuuuuuuuucuauuaaaacuuaaaggggaacaaaacuu

SEQ ID NO: 275574 - RNA, 64 nt, Homo Sapiens
auaugcacaguaaauccaugucuuuguuuguuuuucuauuaaaaagcaaucaagaaagauaaug

SEQ ID NO: 275575 - RNA, 64 nt, Homo Sapiens
ugaggguuucauuguguguuagcagcagugagcuucuauuaaauguauaugucauuuauuuugu

SEQ ID NO: 275576 - RNA, 64 nt, Homo Sapiens
auucuuaugcaggguauugcgaaacaacuuguguucuauuaaucgugucuucaauuaaaagacc

SEQ ID NO: 275577 - RNA, 64 nt, Homo Sapiens
uguugacucaacaagggcccgaggccuuagguuuucuauuaaggucucugccccaggcauggug

SEQ ID NO: 275578 - RNA, 64 nt, Homo Sapiens
acguuuuuaaauuuaacaucuggcuggacaguguucuauuaacucauugaauguguuuccuuug

SEQ ID NO: 275579 - RNA, 64 nt, Homo Sapiens
aagcauggaauuuaggguugggguacaauuuguuucuauuaagcaaguaccaguuuaccaauac

SEQ ID NO: 275580 - RNA, 64 nt, Homo Sapiens
cuuuagaaugugaggcaaauuuuacauucuugguucuauuaagauuuucuuaggcaugcuaaca

SEQ ID NO: 275581 - RNA, 64 nt, Homo Sapiens
cuguuguuaaaauauuuuuucaguugauuuuuuuucuauuaaaaaacacuggcuuaauucaagu

SEQ ID NO: 275582 - RNA, 64 nt, Homo Sapiens
cauucugcaaauacgguuuuguuccugacaccuaucuauuaaacugaaacucugcuuccaccau

SEQ ID NO: 275583 - RNA, 64 nt, Homo Sapiens
aauaaagggaccauaagcauaacgguucuagcccucuauuaagauuaguguguuaccccaaaug

SEQ ID NO: 275584 - RNA, 64 nt, Homo Sapiens
auacaaaaauuagcugggugagugaaaccccgucucuauuaaaagagaccagccuggccaacau

SEQ ID NO: 275585 - RNA, 64 nt, Homo Sapiens
uaucaucuuauaaucacuuuaucaacuuacaauccaaguccaagaaccacuuuggggaauuagu

SEQ ID NO: 275586 - RNA, 64 nt, Homo Sapiens
cuuuaaaggguuugcaagaaucacugacauuucccaaguccauguggucagagaaggcaggugg

SEQ ID NO: 275587 - RNA, 64 nt, Homo Sapiens
accugccuuaaauuuaaauccuggaguaaaaggucaaguccaacuguuuuaaacuuucuuagug

SEQ ID NO: 275588 - RNA, 64 nt, Homo Sapiens
aucugggaugcaaccacucaucgacugugacauacaaguccauucaucuacuaugaugaauacu

SEQ ID NO: 275589 - RNA, 64 nt, Homo Sapiens
cccaccagguccauccaggaggcucuccugaccucaaguccaacaacaguguccacacuaguca

SEQ ID NO: 275590 - RNA, 64 nt, Homo Sapiens
uuucuugcagccagaaggcagagaaagugaagaccaaguccagaacugaauccuaagaaaugca

SEQ ID NO: 275591 - RNA, 64 nt, Homo Sapiens
caagaucacguucucccaaguaccauucgucauccaaguccaggucuagaucacacucaaaagc

SEQ ID NO: 275592 - RNA, 64 nt, Homo Sapiens
agaagaagaagaagaggcggucccggucgcggaccaaguccaaggccaggucucagucgguguc

SEQ ID NO: 275593 - RNA, 64 nt, Homo Sapiens
cugggcuacauagugagaccugagcccaggauuucaaguccagcggcugagugggaugaccgcu

SEQ ID NO: 275594 - RNA, 64 nt, Homo Sapiens
ggccacuuagagcccagcucucccuucuaaucagcaaguccagugcugugguuuauggcaucac

SEQ ID NO: 275595 - RNA, 64 nt, Homo Sapiens; identical to SEQ ID NO: 152055

SEQ ID NO: 275596 - RNA, 64 nt, Homo Sapiens; identical to SEQ ID NO: 152056

SEQ ID NO: 275597 - RNA, 64 nt, Homo Sapiens; identical to SEQ ID NO: 152057

SEQ ID NO: 275598 - RNA, 64 nt, Homo Sapiens; identical to SEQ ID NO: 152058

SEQ ID NO: 275599 - RNA, 64 nt, Homo Sapiens; identical to SEQ ID NO: 152059

SEQ ID NO: 275600 - RNA, 64 nt, Homo Sapiens; identical to SEQ ID NO: 152060

SEQ ID NO: 275601 - RNA, 64 nt, Homo Sapiens; identical to SEQ ID NO: 152061

SEQ ID NO: 275602 - RNA, 64 nt, Homo Sapiens; identical to SEQ ID NO: 152062

SEQ ID NO: 275603 - RNA, 64 nt, Homo Sapiens; identical to SEQ ID NO: 152063

SEQ ID NO: 275604 - RNA, 64 nt, Homo Sapiens; identical to SEQ ID NO: 152064

SEQ ID NO: 275605 - RNA, 64 nt, Homo Sapiens; identical to SEQ ID NO: 152065

SEQ ID NO: 275606 - RNA, 64 nt, Homo Sapiens; identical to SEQ ID NO: 152066

SEQ ID NO: 275607 - RNA, 64 nt, Homo Sapiens; identical to SEQ ID NO: 152067

SEQ ID NO: 275608 - RNA, 64 nt, Homo Sapiens; identical to SEQ ID NO: 152068

SEQ ID NO: 275609 - RNA, 64 nt, Homo Sapiens; identical to SEQ ID NO: 152069

SEQ ID NO: 275610 - RNA, 64 nt, Homo Sapiens; identical to SEQ ID NO: 152070

SEQ ID NO: 275611 - RNA, 64 nt, Homo Sapiens; identical to SEQ ID NO: 152071

SEQ ID NO: 275612 - RNA, 64 nt, Homo Sapiens; identical to SEQ ID NO: 152072

SEQ ID NO: 275613 - RNA, 64 nt, Homo Sapiens; identical to SEQ ID NO: 152073

SEQ ID NO: 275614 - RNA, 64 nt, Homo Sapiens; identical to SEQ ID NO: 152074

SEQ ID NO: 275615 - RNA, 64 nt, Homo Sapiens; identical to SEQ ID NO: 152075

SEQ ID NO: 275616 - RNA, 64 nt, Homo Sapiens; identical to SEQ ID NO: 152076

SEQ ID NO: 275617 - RNA, 64 nt, Homo Sapiens; identical to SEQ ID NO: 152077

SEQ ID NO: 275618 - RNA, 64 nt, Homo Sapiens; identical to SEQ ID NO: 152078

SEQ ID NO: 275619 - RNA, 64 nt, Homo Sapiens; identical to SEQ ID NO: 152079

SEQ ID NO: 275620 - RNA, 64 nt, Homo Sapiens; identical to SEQ ID NO: 152080

SEQ ID NO: 275621 - RNA, 64 nt, Homo Sapiens; identical to SEQ ID NO: 112922

SEQ ID NO: 275622 - RNA, 64 nt, Homo Sapiens; identical to SEQ ID NO: 112923

SEQ ID NO: 275623 - RNA, 64 nt, Homo Sapiens; identical to SEQ ID NO: 112924

SEQ ID NO: 275624 - RNA, 64 nt, Homo Sapiens; identical to SEQ ID NO: 112925

SEQ ID NO: 275625 - RNA, 64 nt, Homo Sapiens; identical to SEQ ID NO: 112926

SEQ ID NO: 275626 - RNA, 64 nt, Homo Sapiens; identical to SEQ ID NO: 112927

SEQ ID NO: 275627 - RNA, 64 nt, Homo Sapiens; identical to SEQ ID NO: 112928

SEQ ID NO: 275628 - RNA, 64 nt, Homo Sapiens; identical to SEQ ID NO: 112929

SEQ ID NO: 275629 - RNA, 64 nt, Homo Sapiens; identical to SEQ ID NO: 112930

SEQ ID NO: 275630 - RNA, 64 nt, Homo Sapiens; identical to SEQ ID NO: 112931

SEQ ID NO: 275631 - RNA, 64 nt, Homo Sapiens; identical to SEQ ID NO: 112932

SEQ ID NO: 275632 - RNA, 64 nt, Homo Sapiens; identical to SEQ ID NO: 112933

SEQ ID NO: 275633 - RNA, 64 nt, Homo Sapiens; identical to SEQ ID NO: 112934

SEQ ID NO: 275634 - RNA, 64 nt, Homo Sapiens; identical to SEQ ID NO: 112935

SEQ ID NO: 275635 - RNA, 64 nt, Homo Sapiens; identical to SEQ ID NO: 112936

SEQ ID NO: 275636 - RNA, 64 nt, Homo Sapiens; identical to SEQ ID NO: 112937

SEQ ID NO: 275637 - RNA, 64 nt, Homo Sapiens; identical to SEQ ID NO: 112938

SEQ ID NO: 275638 - RNA, 64 nt, Homo Sapiens; identical to SEQ ID NO: 112939

SEQ ID NO: 275639 - RNA, 64 nt, Homo Sapiens; identical to SEQ ID NO: 112940

SEQ ID NO: 275640 - RNA, 64 nt, Homo Sapiens; identical to SEQ ID NO: 112941

SEQ ID NO: 275641 - RNA, 64 nt, Homo Sapiens; identical to SEQ ID NO: 112942

SEQ ID NO: 275642 - RNA, 64 nt, Homo Sapiens; identical to SEQ ID NO: 112943

SEQ ID NO: 275643 - RNA, 64 nt, Homo Sapiens; identical to SEQ ID NO: 112944

SEQ ID NO: 275644 - RNA, 64 nt, Homo Sapiens; identical to SEQ ID NO: 112945

SEQ ID NO: 275645 - RNA, 64 nt, Homo Sapiens; identical to SEQ ID NO: 112946

SEQ ID NO: 275646 - RNA, 64 nt, Homo Sapiens; identical to SEQ ID NO: 112947

SEQ ID NO: 275647 - RNA, 64 nt, Homo Sapiens; identical to SEQ ID NO: 112948

SEQ ID NO: 275648 - RNA, 64 nt, Homo Sapiens; identical to SEQ ID NO: 112949

SEQ ID NO: 275649 - RNA, 64 nt, Homo Sapiens; identical to SEQ ID NO: 112950

SEQ ID NO: 275650 - RNA, 64 nt, Homo Sapiens; identical to SEQ ID NO: 112951

SEQ ID NO: 275651 - RNA, 64 nt, Homo Sapiens; identical to SEQ ID NO: 112952

SEQ ID NO: 275652 - RNA, 64 nt, Homo Sapiens; identical to SEQ ID NO: 112953

SEQ ID NO: 275653 - RNA, 64 nt, Homo Sapiens; identical to SEQ ID NO: 112954

SEQ ID NO: 275654 - RNA, 50 nt, Homo Sapiens; identical to SEQ ID NO: 112955

SEQ ID NO: 275655 - RNA, 64 nt, Homo Sapiens; identical to SEQ ID NO: 112956

SEQ ID NO: 275656 - RNA, 64 nt, Homo Sapiens; identical to SEQ ID NO: 112957

SEQ ID NO: 275657 - RNA, 64 nt, Homo Sapiens; identical to SEQ ID NO: 112958

SEQ ID NO: 275658 - RNA, 64 nt, Homo Sapiens; identical to SEQ ID NO: 112959

SEQ ID NO: 275659 - RNA, 64 nt, Homo Sapiens; identical to SEQ ID NO: 112960

SEQ ID NO: 275660 - RNA, 64 nt, Homo Sapiens; identical to SEQ ID NO: 112961

SEQ ID NO: 275661 - RNA, 64 nt, Homo Sapiens
ccaaagaagcauauugacccugcccaauggaagaaccaggaagauguggucauucauucaauag

SEQ ID NO: 275662 - RNA, 64 nt, Homo Sapiens
cuccccauccccacaaaggcuguugaaccacagcaccaggaagccugagaaugaauccugaggg

SEQ ID NO: 275663 - RNA, 64 nt, Homo Sapiens
cugccauaguucugccucuuugcuggggaaagaaaccaggaacguggaggguuauuacugcggg

SEQ ID NO: 275664 - RNA, 64 nt, Homo Sapiens
gugaaugggugcccuacggggcccuccuucccccaccaggaacagauggaaccugccacccagg

SEQ ID NO: 275665 - RNA, 64 nt, Homo Sapiens
uuuugagauacccugcuaucgauggucgcuacaaaccaggaaauacucaaguuauuauguguau

SEQ ID NO: 275666 - RNA, 64 nt, Homo Sapiens
uucuguuguuuuaauuaguauuuguguaguucaaaccaggaaggauuugacuaucauuagauuu

SEQ ID NO: 275667 - RNA, 64 nt, Homo Sapiens
gagaaugaaguauguaaauccuguggaugaaaugaccaggaacgcaugauugacaacagucaag

SEQ ID NO: 275668 - RNA, 64 nt, Homo Sapiens
agaagagacccuuguucaauaccggacuacuuaaaccaggaacauuaucuagugauuuccuagu

SEQ ID NO: 275669 - RNA, 64 nt, Homo Sapiens
gucacaacgacgaagugcugagaagguuauggguaccaggaagaaacaaacagaagucuuaaga

SEQ ID NO: 275670 - RNA, 64 nt, Homo Sapiens
gaauauaaguagguguuggaugccuuuuuccuagaccaggaauggggaauauauaacaccugug

SEQ ID NO: 275671 - RNA, 64 nt, Homo Sapiens
cugcugucagguugagaguuucucaacaguuggaaccaggaacuccauuggagguagagacagg

SEQ ID NO: 275672 - RNA, 64 nt, Homo Sapiens
aggacaaguaauuucaaaaaaugguuuaaguaguaccaggaaguuacccagcuuaaucaacaga

SEQ ID NO: 275673 - RNA, 64 nt, Homo Sapiens
uuuaugguaguaugaggggucauucgcuucucucaccaggaacauucgcuucucucaccaggaa

SEQ ID NO: 275674 - RNA, 64 nt, Homo Sapiens
uucgcuucucucaccaggaaccuucgcuucucucaccaggaacagcugagccaggagaugcaca

SEQ ID NO: 275675 - RNA, 64 nt, Homo Sapiens
agugcuuuuaagugaaaauggucgagaaagaggcaccaggaagccguccuggcgccuggcaguc

SEQ ID NO: 275676 - RNA, 64 nt, Homo Sapiens
cagacuauuuuuagauuuucuuuugccuuuugcaaccaggaacagcaaaugcaaaaacucuuug

SEQ ID NO: 275677 - RNA, 64 nt, Homo Sapiens; identical to SEQ ID NO: 82354

SEQ ID NO: 275678 - RNA, 64 nt, Homo Sapiens; identical to SEQ ID NO: 82355

SEQ ID NO: 275679 - RNA, 64 nt, Homo Sapiens; identical to SEQ ID NO: 82356

SEQ ID NO: 275680 - RNA, 64 nt, Homo Sapiens; identical to SEQ ID NO: 82357

SEQ ID NO: 275681 - RNA, 64 nt, Homo Sapiens; identical to SEQ ID NO: 82358

SEQ ID NO: 275682 - RNA, 64 nt, Homo Sapiens; identical to SEQ ID NO: 82359

SEQ ID NO: 275683 - RNA, 64 nt, Homo Sapiens; identical to SEQ ID NO: 82360

SEQ ID NO: 275684 - RNA, 64 nt, Homo Sapiens; identical to SEQ ID NO: 82361

SEQ ID NO: 275685 - RNA, 64 nt, Homo Sapiens; identical to SEQ ID NO: 82362

SEQ ID NO: 275686 - RNA, 64 nt, Homo Sapiens; identical to SEQ ID NO: 82363

SEQ ID NO: 275687 - RNA, 64 nt, Homo Sapiens; identical to SEQ ID NO: 82364

SEQ ID NO: 275688 - RNA, 64 nt, Homo Sapiens; identical to SEQ ID NO: 82365

SEQ ID NO: 275689 - RNA, 64 nt, Homo Sapiens; identical to SEQ ID NO: 82366

SEQ ID NO: 275690 - RNA, 64 nt, Homo Sapiens; identical to SEQ ID NO: 82367

SEQ ID NO: 275691 - RNA, 64 nt, Homo Sapiens; identical to SEQ ID NO: 82368

SEQ ID NO: 275692 - RNA, 64 nt, Homo Sapiens; identical to SEQ ID NO: 82369

SEQ ID NO: 275693 - RNA, 64 nt, Homo Sapiens; identical to SEQ ID NO: 82370

SEQ ID NO: 275694 - RNA, 64 nt, Homo Sapiens; identical to SEQ ID NO: 82371

SEQ ID NO: 275695 - RNA, 64 nt, Homo Sapiens; identical to SEQ ID NO: 82372

SEQ ID NO: 275696 - RNA, 64 nt, Homo Sapiens; identical to SEQ ID NO: 82373

SEQ ID NO: 275697 - RNA, 64 nt, Homo Sapiens; identical to SEQ ID NO: 82374

SEQ ID NO: 275698 - RNA, 64 nt, Homo Sapiens; identical to SEQ ID NO: 82375

SEQ ID NO: 275699 - RNA, 64 nt, Homo Sapiens; identical to SEQ ID NO: 82376

SEQ ID NO: 275700 - RNA, 64 nt, Homo Sapiens; identical to SEQ ID NO: 82377

SEQ ID NO: 275701 - RNA, 64 nt, Homo Sapiens; identical to SEQ ID NO: 82378

SEQ ID NO: 275702 - RNA, 64 nt, Homo Sapiens; identical to SEQ ID NO: 82379

SEQ ID NO: 275703 - RNA, 64 nt, Homo Sapiens; identical to SEQ ID NO: 82380

SEQ ID NO: 275704 - RNA, 64 nt, Homo Sapiens; identical to SEQ ID NO: 82381

SEQ ID NO: 275705 - RNA, 64 nt, Homo Sapiens; identical to SEQ ID NO: 82382

SEQ ID NO: 275706 - RNA, 64 nt, Homo Sapiens; identical to SEQ ID NO: 82383

SEQ ID NO: 275707 - RNA, 64 nt, Homo Sapiens; identical to SEQ ID NO: 82384

SEQ ID NO: 275708 - RNA, 64 nt, Homo Sapiens; identical to SEQ ID NO: 82385

SEQ ID NO: 275709 - RNA, 64 nt, Homo Sapiens; identical to SEQ ID NO: 82386

SEQ ID NO: 275710 - RNA, 64 nt, Homo Sapiens; identical to SEQ ID NO: 82387

SEQ ID NO: 275711 - RNA, 64 nt, Homo Sapiens; identical to SEQ ID NO: 82388

SEQ ID NO: 275712 - RNA, 64 nt, Homo Sapiens; identical to SEQ ID NO: 161670

SEQ ID NO: 275713 - RNA, 64 nt, Homo Sapiens; identical to SEQ ID NO: 161671

SEQ ID NO: 275714 - RNA, 64 nt, Homo Sapiens; identical to SEQ ID NO: 161672

SEQ ID NO: 275715 - RNA, 64 nt, Homo Sapiens; identical to SEQ ID NO: 161673

SEQ ID NO: 275716 - RNA, 64 nt, Homo Sapiens; identical to SEQ ID NO: 161674

SEQ ID NO: 275717 - RNA, 64 nt, Homo Sapiens; identical to SEQ ID NO: 161675

SEQ ID NO: 275718 - RNA, 64 nt, Homo Sapiens; identical to SEQ ID NO: 161676

SEQ ID NO: 275719 - RNA, 64 nt, Homo Sapiens; identical to SEQ ID NO: 161677

SEQ ID NO: 275720 - RNA, 64 nt, Homo Sapiens; identical to SEQ ID NO: 161678

SEQ ID NO: 275721 - RNA, 64 nt, Homo Sapiens; identical to SEQ ID NO: 161679

SEQ ID NO: 275722 - RNA, 64 nt, Homo Sapiens; identical to SEQ ID NO: 161680

SEQ ID NO: 275723 - RNA, 64 nt, Homo Sapiens; identical to SEQ ID NO: 161681

SEQ ID NO: 275724 - RNA, 64 nt, Homo Sapiens; identical to SEQ ID NO: 161682

SEQ ID NO: 275725 - RNA, 64 nt, Homo Sapiens; identical to SEQ ID NO: 161683

SEQ ID NO: 275726 - RNA, 64 nt, Homo Sapiens; identical to SEQ ID NO: 161684

SEQ ID NO: 275727 - RNA, 64 nt, Homo Sapiens; identical to SEQ ID NO: 161685

SEQ ID NO: 275728 - RNA, 64 nt, Homo Sapiens; identical to SEQ ID NO: 161686

SEQ ID NO: 275729 - RNA, 64 nt, Homo Sapiens; identical to SEQ ID NO: 161687

SEQ ID NO: 275730 - RNA, 64 nt, Homo Sapiens; identical to SEQ ID NO: 161688

SEQ ID NO: 275731 - RNA, 64 nt, Homo Sapiens; identical to SEQ ID NO: 161689

SEQ ID NO: 275732 - RNA, 64 nt, Homo Sapiens; identical to SEQ ID NO: 161690

SEQ ID NO: 275733 - RNA, 64 nt, Homo Sapiens; identical to SEQ ID NO: 161691

SEQ ID NO: 275734 - RNA, 64 nt, Homo Sapiens; identical to SEQ ID NO: 161692

SEQ ID NO: 275735 - RNA, 64 nt, Homo Sapiens; identical to SEQ ID NO: 161693

SEQ ID NO: 275736 - RNA, 64 nt, Homo Sapiens; identical to SEQ ID NO: 161694

SEQ ID NO: 275737 - RNA, 64 nt, Homo Sapiens; identical to SEQ ID NO: 161695

SEQ ID NO: 275738 - RNA, 64 nt, Homo Sapiens; identical to SEQ ID NO: 161696

SEQ ID NO: 275739 - RNA, 64 nt, Homo Sapiens; identical to SEQ ID NO: 161697

SEQ ID NO: 275740 - RNA, 64 nt, Homo Sapiens; identical to SEQ ID NO: 161698

SEQ ID NO: 275741 - RNA, 64 nt, Homo Sapiens; identical to SEQ ID NO: 161699

SEQ ID NO: 275742 - RNA, 64 nt, Homo Sapiens; identical to SEQ ID NO: 161700

SEQ ID NO: 275743 - RNA, 64 nt, Homo Sapiens; identical to SEQ ID NO: 161701

SEQ ID NO: 275744 - RNA, 64 nt, Homo Sapiens; identical to SEQ ID NO: 161702

SEQ ID NO: 275745 - RNA, 64 nt, Homo Sapiens; identical to SEQ ID NO: 161703

SEQ ID NO: 275746 - RNA, 64 nt, Homo Sapiens; identical to SEQ ID NO: 161704

SEQ ID NO: 275747 - RNA, 64 nt, Homo Sapiens; identical to SEQ ID NO: 161705

SEQ ID NO: 275748 - RNA, 64 nt, Homo Sapiens; identical to SEQ ID NO: 161706

SEQ ID NO: 275749 - RNA, 64 nt, Homo Sapiens; identical to SEQ ID NO: 161707

SEQ ID NO: 275750 - RNA, 64 nt, Homo Sapiens; identical to SEQ ID NO: 161708

SEQ ID NO: 275751 - RNA, 64 nt, Homo Sapiens; identical to SEQ ID NO: 161709

SEQ ID NO: 275752 - RNA, 64 nt, Homo Sapiens; identical to SEQ ID NO: 52870

SEQ ID NO: 275753 - RNA, 64 nt, Homo Sapiens; identical to SEQ ID NO: 52871

SEQ ID NO: 275754 - RNA, 64 nt, Homo Sapiens; identical to SEQ ID NO: 52872

SEQ ID NO: 275755 - RNA, 64 nt, Homo Sapiens; identical to SEQ ID NO: 52873

SEQ ID NO: 275756 - RNA, 64 nt, Homo Sapiens; identical to SEQ ID NO: 52874

SEQ ID NO: 275757 - RNA, 64 nt, Homo Sapiens
auuuaaagacagagcaggagucuucaaagagcuugccaaugaaguauuauuuuugggggacucu

SEQ ID NO: 275758 - RNA, 64 nt, Homo Sapiens
aaagaaccacacuggagaucuuuaaaccuguugggccaaugagaggagagacugugguauauau

SEQ ID NO: 275759 - RNA, 64 nt, Homo Sapiens
ggcaaccauagagaucgagcuucaggacagagcagccaaugaaaacggccgccugaacccacag

SEQ ID NO: 275760 - RNA, 64 nt, Homo Sapiens
gcagccaauggguacugagcuggcugagccuauggccaaugaguauuccugcuaugcucagggc

SEQ ID NO: 275761 - RNA, 60 nt, Homo Sapiens
caagauuaauauuugauucucuaucucuuaacuguagauuuuauuggccuguuuuuuuuu

SEQ ID NO: 275762 - RNA, 60 nt, Homo Sapiens
ugggcggugaggguauugauuuacauaaaaacuguagacaaacacaguacgagucucagc

SEQ ID NO: 275763 - RNA, 60 nt, Homo Sapiens
aaucauugagauagaaaaagauucccauugacuguagacuucuucccauuuugucuuccc

SEQ ID NO: 275764 - RNA, 60 nt, Homo Sapiens
uguuacagagaagcagccgauagcaaaucgacuguagagacuuggcggcgguggcauugc

SEQ ID NO: 275765 - RNA, 60 nt, Homo Sapiens
cagcuugcugagccccuccggaaguggcuuacuguagaagcuguuugaaggcuuacugua

SEQ ID NO: 275766 - RNA, 60 nt, Homo Sapiens
uggcuuacuguagaagcagcuugaaggcuuacuguagaaguuuuaugcuuuauuuccugu

SEQ ID NO: 275767 - RNA, 60 nt, Homo Sapiens
cuugaauguucuacuugcuaauuuauaaugacuguagauauauggcauguacuuuacacu

SEQ ID NO: 275768 - RNA, 60 nt, Homo Sapiens
uggcauguacuuuacacuaucucuucccacacuguagauacucauuuucccauguuuaua

SEQ ID NO: 275769 - RNA, 60 nt, Homo Sapiens
gaguuucggguguuuuucuccagucuuguuacuguagacuguagaaagcacgggccccag

SEQ ID NO: 275770 - RNA, 60 nt, Homo Sapiens
ggguguuuuucuccagucuuguuacuguagacuguagaaagcacgggccccaggcucuga

SEQ ID NO: 275771 - RNA, 60 nt, Homo Sapiens
cgccugcaggcgguguagauacauguagauacuguagauacuguagauaccgccccggcg

SEQ ID NO: 275772 - RNA, 60 nt, Homo Sapiens
gcgguguagauacauguagauacuguagauacuguagauaccgccccggcgccgacuuga

SEQ ID NO: 275773 - RNA, 64 nt, Homo Sapiens
uggcauuuggucucaggcagcaccacacugggugcgucuccagucaucuguaagagcuugcucc

SEQ ID NO: 275774 - RNA, 64 nt, Homo Sapiens
gaagagcacacaugagggcaaggcugcuggcagacgucuccauuguccuuauguugucuguguu

SEQ ID NO: 275775 - RNA, 64 nt, Homo Sapiens
uuuugaauaccccgagugggaaagagcugcuuuuagggauuauucucugacaagauugcuuugg

SEQ ID NO: 275776 - RNA, 64 nt, Homo Sapiens
ugggauggucucugaggcucucugcaaagugugaagggauuagauccgugggccuguuucccaa

SEQ ID NO: 275777 - RNA, 64 nt, Homo Sapiens
auuuuuuuuaaucuaggugauggggauguuguauagggauuagucacuaauuaaaucugaauuu

SEQ ID NO: 275778 - RNA, 64 nt, Homo Sapiens
cuauaauucuguucuuaaaaaacugagcuguguuagggauuaaauuauuuacuugaauuuugaa

SEQ ID NO: 275779 - RNA, 64 nt, Homo Sapiens
gcugucugugaccauuuccauggcagcaggaugcagggauuaauaaggacacauacacauuauu

SEQ ID NO: 275780 - RNA, 64 nt, Homo Sapiens
uuaaccuaagcccuuaugaaaauaaacaaaaugaagggauuaugacagguauuaccaaaaacac

SEQ ID NO: 275781 - RNA, 64 nt, Homo Sapiens
aaaaacguauaaaauaaugcccugaaagaauaauagggauuauaccugucuguucuuaaagauu

SEQ ID NO: 275782 - RNA, 64 nt, Homo Sapiens
aauaucugauauuuuccugguacucguacugauaagggauuauuggaagucagucacagaauuu

SEQ ID NO: 275783 - RNA, 64 nt, Homo Sapiens
accagaauaucaguggauuucacauuuucuguucagggauuaagaaauaguuaauggaugugug

SEQ ID NO: 275784 - RNA, 64 nt, Homo Sapiens
cccacacccuggcuuccauugagccuguacuuagagggauuaagcgucaucugcauuguuauug

SEQ ID NO: 275785 - RNA, 64 nt, Homo Sapiens; identical to SEQ ID NO: 236284

SEQ ID NO: 275786 - RNA, 64 nt, Homo Sapiens; identical to SEQ ID NO: 236285

SEQ ID NO: 275787 - RNA, 64 nt, Homo Sapiens; identical to SEQ ID NO: 236286

SEQ ID NO: 275788 - RNA, 64 nt, Homo Sapiens; identical to SEQ ID NO: 236287

SEQ ID NO: 275789 - RNA, 64 nt, Homo Sapiens; identical to SEQ ID NO: 236288

SEQ ID NO: 275790 - RNA, 64 nt, Homo Sapiens; identical to SEQ ID NO: 236289

SEQ ID NO: 275791 - RNA, 64 nt, Homo Sapiens
acccaggcacagccaccacuuugcaagugggaggaggggagaaggggagacaaaaccacugcag

SEQ ID NO: 275792 - RNA, 64 nt, Homo Sapiens
acagccaccacuuugcaagugggaggaggggagaaggggagacaaaaccacugcagaccuacca

SEQ ID NO: 275793 - RNA, 64 nt, Homo Sapiens
ucagaagacgggcgaaacaagcacagguguaaaaaggggagauuaaaaggggagauuucgguag

SEQ ID NO: 275794 - RNA, 64 nt, Homo Sapiens
ucgguaggcacagguguaaagcacaguuguaaaaaggggagauugaauaucagcagaguaguag

SEQ ID NO: 275795 - RNA, 64 nt, Homo Sapiens
uaggccagaggugaacauucggggucuccaccucaggggagacugccccaggccucccuccccc

SEQ ID NO: 275796 - RNA, 64 nt, Homo Sapiens
agguggucugcaccccacaggggcuggcauggggaggggagagagccagcccagauggcucccu

SEQ ID NO: 275797 - RNA, 64 nt, Homo Sapiens
cuggguaaggcucaucuuuaaaaacuggcuucagaggggagaggggagaacaaugaauuggcuc

SEQ ID NO: 275798 - RNA, 64 nt, Homo Sapiens
aggcucaucuuuaaaaacuggcuucagaggggagaggggagaacaaugaauuggcucuauuuuc

SEQ ID NO: 275799 - RNA, 64 nt, Homo Sapiens
ucacuggacacgucuccucgcagcugcccuagcaaggggagacauugugguagcuaucagacau

SEQ ID NO: 275800 - RNA, 64 nt, Homo Sapiens
ucacacguggccuugucuagacccaguccugagcaggggagaggcucuugagaccugaugcccu

SEQ ID NO: 275801 - RNA, 64 nt, Homo Sapiens
gcagagaaguacaggucaucugccucuuugcaguaggggagagacuuacuaaugcugcccucac

SEQ ID NO: 275802 - RNA, 64 nt, Homo Sapiens
aggccaagcugaggaggugcacggaggcggggucaggggagacgggcaaacugaggcagcaugc

SEQ ID NO: 275803 - RNA, 64 nt, Homo Sapiens
aggcuggcuggauccagcacgagugacccccgccaggggagaccuguguugauggguggcccau

SEQ ID NO: 275804 - RNA, 64 nt, Homo Sapiens
ugucucccuuguuccccucacuggcugcuccgacaggggagacuaauccauuugccccgcaacc

SEQ ID NO: 275805 - RNA, 64 nt, Homo Sapiens
cccuggccacagccuucccucugcauugaccuggaggggagaggucagccuugaccuaaugagg

SEQ ID NO: 275806 - RNA, 64 nt, Homo Sapiens
ggccaggggccaggaguggggagaguugugauggaggggagaggggucacacccacccccugcc

SEQ ID NO: 275807 - RNA, 64 nt, Homo Sapiens
uuagaaaaaaaugaaacaacaggugagcugguagaggggagacacauuuucauucuguuaucuc

SEQ ID NO: 275808 - RNA, 64 nt, Homo Sapiens
gggaaaaucaagugguauuuggcuaccuguuugaaggggagagaaggucauuuuuuuugcuucu

SEQ ID NO: 275809 - RNA, 64 nt, Homo Sapiens
gcugcccucaaguccaggccuugaggcccaccugaggggagauacugcccuucucucugccugc

SEQ ID NO: 275810 - RNA, 64 nt, Homo Sapiens
accccagccuccucagaacaggggugaccacugcaggggagacugccccuaaccugugucuuug

SEQ ID NO: 275811 - RNA, 64 nt, Homo Sapiens
caccacagaaggagacccagcuggcggcagucccaggggagagaggucgucgagaggcugcggg

SEQ ID NO: 275812 - RNA, 64 nt, Homo Sapiens
cacccacaggccauguccagaucuuccuccugccaggggagagcuuccgcacucugagaccaug

SEQ ID NO: 275813 - RNA, 64 nt, Homo Sapiens
gaggaagggcagagccagaaaaacccugccucugaggggagacuuuugucacagccuugcccac

SEQ ID NO: 275814 - RNA, 64 nt, Homo Sapiens
augguggcuaucccuucugcaccacgcagcagucaggggagaaacgccugccuguccugugccc

SEQ ID NO: 275815 - RNA, 64 nt, Homo Sapiens
uuacucuucccauuccucagaccagcaggaaaagaggggagacgucagucuuuuuccugugguu

SEQ ID NO: 275816 - RNA, 64 nt, Homo Sapiens
gguagaggggauaccuggguucuaaccucuaaauaggggagaucccagccuccacaaagaggcc

SEQ ID NO: 275817 - RNA, 64 nt, Homo Sapiens
ggggccaggcagcugggggccuuuggggaccagaaggggagaugugcucccagagccucucugc

SEQ ID NO: 275818 - RNA, 64 nt, Homo Sapiens
agagucaggccacccacugggcucggcaggagauaggggagagcaauuacuuuguucacuguau

SEQ ID NO: 275819 - RNA, 64 nt, Homo Sapiens
uguccugcuuauuaaaugugugacaugguaggagaggggagaugauucagcaaguuauuaaauc

SEQ ID NO: 275820 - RNA, 64 nt, Homo Sapiens
ccaaaagagucaucgcaggauuaugccuuggcagaggggagacugcaagggagccaguacugaa

SEQ ID NO: 275821 - RNA, 64 nt, Homo Sapiens
ucacauccugggugggacagggagacauugggcaaggggagaaugcgaggagcauagacagugu

SEQ ID NO: 275822 - RNA, 64 nt, Homo Sapiens
guuccuuuuguucuuaacuacagcaauggauggcaggggagaguaucaaacacacacaggauac

SEQ ID NO: 275823 - RNA, 64 nt, Homo Sapiens
ccccagucugcaggaaggauaccagaggacacacaggggagacggaagucaguccuccucauuc

SEQ ID NO: 275824 - RNA, 64 nt, Homo Sapiens
ccuuaugucugcagagagugcagaggacacacacaggggagaagagucagaccuccucagucac

SEQ ID NO: 275825 - RNA, 64 nt, Homo Sapiens
agaacgcauuugagauuuuaagaugucacuuauaaggggagaaguguucuuaaaaagucaacca

SEQ ID NO: 275826 - RNA, 64 nt, Homo Sapiens
acauauguaaaaaaaaaaaaaaaaagauuauuuuaggggagauguagguguagaauuauugcuu

SEQ ID NO: 275827 - RNA, 64 nt, Homo Sapiens
gauaugaggagagagagacaagagagguggggagaggggagagaggagaggaggggagagagaa

SEQ ID NO: 275828 - RNA, 64 nt, Homo Sapiens
gaaagagagguggggagagggagagauggagaggaggggagagagggagggaaaggaggaggga

SEQ ID NO: 275829 - RNA, 64 nt, Homo Sapiens
ggcuaauauuagggacuggggaggggaccaccagaggggagagggaagcugcuuacuuuggggg

SEQ ID NO: 275830 - RNA, 64 nt, Homo Sapiens
caggccucagcaucucacauccaccaccuccaggaggggagaccacugguaaguccuccuccug

SEQ ID NO: 275831 - RNA, 64 nt, Homo Sapiens
ccugagucucagagcaggggucacucuguuuuccaggggagaaaugucagacaggcugggggcc

SEQ ID NO: 275832 - RNA, 64 nt, Homo Sapiens
gggagaaaacuguacucugugagccacaagggaaaggggagaggaugcucagacauggagguca

SEQ ID NO: 275833 - RNA, 64 nt, Homo Sapiens
cuauuuuguguuuagggaagggaaaauggaggaaaggggagaagagcaaagggcgcuuuuaaag

SEQ ID NO: 275834 - RNA, 64 nt, Homo Sapiens
ccuaauaacaaagggguucugacacuaagacauuaggggagaauguuggguaggcagccagcac

SEQ ID NO: 275835 - RNA, 64 nt, Homo Sapiens
aaaccagauuggggggcccaucuuccaguccuguaggggagacaugaggagugacuucucccuc

SEQ ID NO: 275836 - RNA, 64 nt, Homo Sapiens
aucccacuacucucccaccauaccgagcagcaaaaggggagaagaauuauuuuauuuaaaaaaa

SEQ ID NO: 275837 - RNA, 64 nt, Homo Sapiens
uggggacgauauggggagggagaugggaggggaaaggggagaggguuuuucucacugugccaau

SEQ ID NO: 275838 - RNA, 64 nt, Homo Sapiens
cuggaauuagcuuggggccagggaagggacugggaggggagagaagagaaggagggaaggauuu

SEQ ID NO: 275839 - RNA, 64 nt, Homo Sapiens
gugggggauggcuaagaaagcagccccguggggaaggggagaaaccaugaccugcagccaagcc

SEQ ID NO: 275840 - RNA, 64 nt, Homo Sapiens
aaggaagggaagggcagaagugggggaggcggagaggggagaaguccuuccagggcuuuuccuu

SEQ ID NO: 275841 - RNA, 63 nt, Homo Sapiens
ggagagucaaggaaaccgcugccaggcaaaacacuagcucaaaguauuaccucugugcucagu

SEQ ID NO: 275842 - RNA, 63 nt, Homo Sapiens
ccaucucuaauuauaaaacauauuauuucagaacuagcucagcugucagguuuuugguuuuau

SEQ ID NO: 275843 - RNA, 63 nt, Homo Sapiens
gggauuguaaauacaccgaugggcacucuguaucuagcucaagguuuguaaacacaccaauca

SEQ ID NO: 275844 - RNA, 63 nt, Homo Sapiens
agguuuguaaacacaccaaucagcacccugugucuagcucaguguuugugaaugcaccaaucc

SEQ ID NO: 275845 - RNA, 63 nt, Homo Sapiens
cuaaucuaguggggauguggagaaccuuugugucuagcucagggaucguaaacgcaccaauca

SEQ ID NO: 275846 - RNA, 64 nt, Homo Sapiens; identical to SEQ ID NO: 58312

SEQ ID NO: 275847 - RNA, 64 nt, Homo Sapiens; identical to SEQ ID NO: 58313

SEQ ID NO: 275848 - RNA, 64 nt, Homo Sapiens; identical to SEQ ID NO: 58314

SEQ ID NO: 275849 - RNA, 64 nt, Homo Sapiens; identical to SEQ ID NO: 58315

SEQ ID NO: 275850 - RNA, 64 nt, Homo Sapiens; identical to SEQ ID NO: 58316

SEQ ID NO: 275851 - RNA, 64 nt, Homo Sapiens; identical to SEQ ID NO: 58317

SEQ ID NO: 275852 - RNA, 64 nt, Homo Sapiens; identical to SEQ ID NO: 58318

SEQ ID NO: 275853 - RNA, 64 nt, Homo Sapiens; identical to SEQ ID NO: 58319

SEQ ID NO: 275854 - RNA, 64 nt, Homo Sapiens; identical to SEQ ID NO: 58320

SEQ ID NO: 275855 - RNA, 64 nt, Homo Sapiens; identical to SEQ ID NO: 58321

SEQ ID NO: 275856 - RNA, 64 nt, Homo Sapiens; identical to SEQ ID NO: 58322

SEQ ID NO: 275857 - RNA, 64 nt, Homo Sapiens; identical to SEQ ID NO: 58323

SEQ ID NO: 275858 - RNA, 64 nt, Homo Sapiens; identical to SEQ ID NO: 58324

SEQ ID NO: 275859 - RNA, 64 nt, Homo Sapiens; identical to SEQ ID NO: 58325

SEQ ID NO: 275860 - RNA, 64 nt, Homo Sapiens; identical to SEQ ID NO: 58326

SEQ ID NO: 275861 - RNA, 64 nt, Homo Sapiens; identical to SEQ ID NO: 58327

SEQ ID NO: 275862 - RNA, 64 nt, Homo Sapiens; identical to SEQ ID NO: 58328

SEQ ID NO: 275863 - RNA, 64 nt, Homo Sapiens; identical to SEQ ID NO: 58329

SEQ ID NO: 275864 - RNA, 64 nt, Homo Sapiens; identical to SEQ ID NO: 58330

SEQ ID NO: 275865 - RNA, 64 nt, Homo Sapiens; identical to SEQ ID NO: 58331

SEQ ID NO: 275866 - RNA, 64 nt, Homo Sapiens; identical to SEQ ID NO: 58332

SEQ ID NO: 275867 - RNA, 64 nt, Homo Sapiens; identical to SEQ ID NO: 58333

SEQ ID NO: 275868 - RNA, 64 nt, Homo Sapiens; identical to SEQ ID NO: 58334

SEQ ID NO: 275869 - RNA, 64 nt, Homo Sapiens; identical to SEQ ID NO: 58335

SEQ ID NO: 275870 - RNA, 64 nt, Homo Sapiens; identical to SEQ ID NO: 58336

SEQ ID NO: 275871 - RNA, 64 nt, Homo Sapiens; identical to SEQ ID NO: 58337

SEQ ID NO: 275872 - RNA, 64 nt, Homo Sapiens; identical to SEQ ID NO: 58338

SEQ ID NO: 275873 - RNA, 64 nt, Homo Sapiens; identical to SEQ ID NO: 58339

SEQ ID NO: 275874 - RNA, 64 nt, Homo Sapiens; identical to SEQ ID NO: 58340

SEQ ID NO: 275875 - RNA, 64 nt, Homo Sapiens; identical to SEQ ID NO: 58341

SEQ ID NO: 275876 - RNA, 64 nt, Homo Sapiens; identical to SEQ ID NO: 58342

SEQ ID NO: 275877 - RNA, 64 nt, Homo Sapiens; identical to SEQ ID NO: 58343

SEQ ID NO: 275878 - RNA, 64 nt, Homo Sapiens; identical to SEQ ID NO: 58344

SEQ ID NO: 275879 - RNA, 64 nt, Homo Sapiens; identical to SEQ ID NO: 58345

SEQ ID NO: 275880 - RNA, 64 nt, Homo Sapiens; identical to SEQ ID NO: 58346

SEQ ID NO: 275881 - RNA, 64 nt, Homo Sapiens; identical to SEQ ID NO: 58347

SEQ ID NO: 275882 - RNA, 64 nt, Homo Sapiens; identical to SEQ ID NO: 58348

SEQ ID NO: 275883 - RNA, 64 nt, Homo Sapiens; identical to SEQ ID NO: 58349

SEQ ID NO: 275884 - RNA, 64 nt, Homo Sapiens; identical to SEQ ID NO: 58350

SEQ ID NO: 275885 - RNA, 64 nt, Homo Sapiens; identical to SEQ ID NO: 58351

SEQ ID NO: 275886 - RNA, 64 nt, Homo Sapiens; identical to SEQ ID NO: 58352

SEQ ID NO: 275887 - RNA, 64 nt, Homo Sapiens; identical to SEQ ID NO: 58353

SEQ ID NO: 275888 - RNA, 64 nt, Homo Sapiens; identical to SEQ ID NO: 58354

SEQ ID NO: 275889 - RNA, 64 nt, Homo Sapiens; identical to SEQ ID NO: 58355

SEQ ID NO: 275890 - RNA, 64 nt, Homo Sapiens; identical to SEQ ID NO: 58356

SEQ ID NO: 275891 - RNA, 64 nt, Homo Sapiens; identical to SEQ ID NO: 58357

SEQ ID NO: 275892 - RNA, 64 nt, Homo Sapiens; identical to SEQ ID NO: 58358

SEQ ID NO: 275893 - RNA, 64 nt, Homo Sapiens; identical to SEQ ID NO: 58359

SEQ ID NO: 275894 - RNA, 64 nt, Homo Sapiens; identical to SEQ ID NO: 58360

SEQ ID NO: 275895 - RNA, 64 nt, Homo Sapiens; identical to SEQ ID NO: 58361

SEQ ID NO: 275896 - RNA, 64 nt, Homo Sapiens; identical to SEQ ID NO: 58362

SEQ ID NO: 275897 - RNA, 64 nt, Homo Sapiens; identical to SEQ ID NO: 58363

SEQ ID NO: 275898 - RNA, 64 nt, Homo Sapiens; identical to SEQ ID NO: 58364

SEQ ID NO: 275899 - RNA, 64 nt, Homo Sapiens; identical to SEQ ID NO: 58365

SEQ ID NO: 275900 - RNA, 64 nt, Homo Sapiens; identical to SEQ ID NO: 58366

SEQ ID NO: 275901 - RNA, 64 nt, Homo Sapiens; identical to SEQ ID NO: 58367

SEQ ID NO: 275902 - RNA, 64 nt, Homo Sapiens; identical to SEQ ID NO: 58368

SEQ ID NO: 275903 - RNA, 64 nt, Homo Sapiens; identical to SEQ ID NO: 58369

SEQ ID NO: 275904 - RNA, 64 nt, Homo Sapiens; identical to SEQ ID NO: 58370

SEQ ID NO: 275905 - RNA, 64 nt, Homo Sapiens; identical to SEQ ID NO: 58371

SEQ ID NO: 275906 - RNA, 64 nt, Homo Sapiens; identical to SEQ ID NO: 58372

SEQ ID NO: 275907 - RNA, 64 nt, Homo Sapiens; identical to SEQ ID NO: 58373

SEQ ID NO: 275908 - RNA, 64 nt, Homo Sapiens; identical to SEQ ID NO: 58374

SEQ ID NO: 275909 - RNA, 64 nt, Homo Sapiens; identical to SEQ ID NO: 58375

SEQ ID NO: 275910 - RNA, 64 nt, Homo Sapiens; identical to SEQ ID NO: 58376

SEQ ID NO: 275911 - RNA, 64 nt, Homo Sapiens; identical to SEQ ID NO: 58377

SEQ ID NO: 275912 - RNA, 64 nt, Homo Sapiens; identical to SEQ ID NO: 58378

SEQ ID NO: 275913 - RNA, 64 nt, Homo Sapiens; identical to SEQ ID NO: 58379

SEQ ID NO: 275914 - RNA, 64 nt, Homo Sapiens; identical to SEQ ID NO: 58380

SEQ ID NO: 275915 - RNA, 64 nt, Homo Sapiens; identical to SEQ ID NO: 58381

SEQ ID NO: 275916 - RNA, 64 nt, Homo Sapiens; identical to SEQ ID NO: 58382

SEQ ID NO: 275917 - RNA, 64 nt, Homo Sapiens; identical to SEQ ID NO: 58383

SEQ ID NO: 275918 - RNA, 64 nt, Homo Sapiens; identical to SEQ ID NO: 58384

SEQ ID NO: 275919 - RNA, 64 nt, Homo Sapiens; identical to SEQ ID NO: 58385

SEQ ID NO: 275920 - RNA, 64 nt, Homo Sapiens; identical to SEQ ID NO: 58386

SEQ ID NO: 275921 - RNA, 64 nt, Homo Sapiens; identical to SEQ ID NO: 58387

SEQ ID NO: 275922 - RNA, 64 nt, Homo Sapiens; identical to SEQ ID NO: 58388

SEQ ID NO: 275923 - RNA, 64 nt, Homo Sapiens; identical to SEQ ID NO: 58389

SEQ ID NO: 275924 - RNA, 64 nt, Homo Sapiens; identical to SEQ ID NO: 58390

SEQ ID NO: 275925 - RNA, 64 nt, Homo Sapiens; identical to SEQ ID NO: 58391

SEQ ID NO: 275926 - RNA, 64 nt, Homo Sapiens; identical to SEQ ID NO: 58392

SEQ ID NO: 275927 - RNA, 64 nt, Homo Sapiens; identical to SEQ ID NO: 58393

SEQ ID NO: 275928 - RNA, 64 nt, Homo Sapiens; identical to SEQ ID NO: 58394

SEQ ID NO: 275929 - RNA, 64 nt, Homo Sapiens; identical to SEQ ID NO: 58395

SEQ ID NO: 275930 - RNA, 64 nt, Homo Sapiens; identical to SEQ ID NO: 58396

SEQ ID NO: 275931 - RNA, 64 nt, Homo Sapiens; identical to SEQ ID NO: 58397

SEQ ID NO: 275932 - RNA, 64 nt, Homo Sapiens; identical to SEQ ID NO: 58398

SEQ ID NO: 275933 - RNA, 64 nt, Homo Sapiens; identical to SEQ ID NO: 58399

SEQ ID NO: 275934 - RNA, 64 nt, Homo Sapiens; identical to SEQ ID NO: 58400

SEQ ID NO: 275935 - RNA, 64 nt, Homo Sapiens; identical to SEQ ID NO: 58401

SEQ ID NO: 275936 - RNA, 64 nt, Homo Sapiens; identical to SEQ ID NO: 58402

SEQ ID NO: 275937 - RNA, 64 nt, Homo Sapiens; identical to SEQ ID NO: 58403

SEQ ID NO: 275938 - RNA, 64 nt, Homo Sapiens; identical to SEQ ID NO: 58404

SEQ ID NO: 275939 - RNA, 64 nt, Homo Sapiens; identical to SEQ ID NO: 58405

SEQ ID NO: 275940 - RNA, 64 nt, Homo Sapiens; identical to SEQ ID NO: 58406

SEQ ID NO: 275941 - RNA, 64 nt, Homo Sapiens; identical to SEQ ID NO: 58407

SEQ ID NO: 275942 - RNA, 64 nt, Homo Sapiens; identical to SEQ ID NO: 58408

SEQ ID NO: 275943 - RNA, 64 nt, Homo Sapiens; identical to SEQ ID NO: 58409

SEQ ID NO: 275944 - RNA, 64 nt, Homo Sapiens; identical to SEQ ID NO: 58410

SEQ ID NO: 275945 - RNA, 64 nt, Homo Sapiens; identical to SEQ ID NO: 58411

SEQ ID NO: 275946 - RNA, 64 nt, Homo Sapiens; identical to SEQ ID NO: 58412

SEQ ID NO: 275947 - RNA, 64 nt, Homo Sapiens; identical to SEQ ID NO: 58413

SEQ ID NO: 275948 - RNA, 64 nt, Homo Sapiens; identical to SEQ ID NO: 58414

SEQ ID NO: 275949 - RNA, 64 nt, Homo Sapiens; identical to SEQ ID NO: 58415

SEQ ID NO: 275950 - RNA, 64 nt, Homo Sapiens; identical to SEQ ID NO: 58416

SEQ ID NO: 275951 - RNA, 64 nt, Homo Sapiens; identical to SEQ ID NO: 58417

SEQ ID NO: 275952 - RNA, 64 nt, Homo Sapiens; identical to SEQ ID NO: 58418

SEQ ID NO: 275953 - RNA, 64 nt, Homo Sapiens; identical to SEQ ID NO: 58419

SEQ ID NO: 275954 - RNA, 64 nt, Homo Sapiens; identical to SEQ ID NO: 58420

SEQ ID NO: 275955 - RNA, 64 nt, Homo Sapiens; identical to SEQ ID NO: 58421

SEQ ID NO: 275956 - RNA, 64 nt, Homo Sapiens; identical to SEQ ID NO: 58422

SEQ ID NO: 275957 - RNA, 64 nt, Homo Sapiens; identical to SEQ ID NO: 58423

SEQ ID NO: 275958 - RNA, 64 nt, Homo Sapiens; identical to SEQ ID NO: 58424

SEQ ID NO: 275959 - RNA, 64 nt, Homo Sapiens; identical to SEQ ID NO: 58425

SEQ ID NO: 275960 - RNA, 64 nt, Homo Sapiens; identical to SEQ ID NO: 58426

SEQ ID NO: 275961 - RNA, 64 nt, Homo Sapiens; identical to SEQ ID NO: 58427

SEQ ID NO: 275962 - RNA, 64 nt, Homo Sapiens; identical to SEQ ID NO: 58428

SEQ ID NO: 275963 - RNA, 64 nt, Homo Sapiens; identical to SEQ ID NO: 58429

SEQ ID NO: 275964 - RNA, 64 nt, Homo Sapiens; identical to SEQ ID NO: 58430

SEQ ID NO: 275965 - RNA, 64 nt, Homo Sapiens; identical to SEQ ID NO: 58431

SEQ ID NO: 275966 - RNA, 64 nt, Homo Sapiens; identical to SEQ ID NO: 58432

SEQ ID NO: 275967 - RNA, 64 nt, Homo Sapiens; identical to SEQ ID NO: 58433

SEQ ID NO: 275968 - RNA, 64 nt, Homo Sapiens; identical to SEQ ID NO: 58434

SEQ ID NO: 275969 - RNA, 64 nt, Homo Sapiens; identical to SEQ ID NO: 58435

SEQ ID NO: 275970 - RNA, 50 nt, Homo Sapiens; identical to SEQ ID NO: 58436

SEQ ID NO: 275971 - RNA, 64 nt, Homo Sapiens; identical to SEQ ID NO: 58437

SEQ ID NO: 275972 - RNA, 64 nt, Homo Sapiens; identical to SEQ ID NO: 58438

SEQ ID NO: 275973 - RNA, 64 nt, Homo Sapiens; identical to SEQ ID NO: 58439

SEQ ID NO: 275974 - RNA, 64 nt, Homo Sapiens; identical to SEQ ID NO: 58440

SEQ ID NO: 275975 - RNA, 64 nt, Homo Sapiens; identical to SEQ ID NO: 58441

SEQ ID NO: 275976 - RNA, 64 nt, Homo Sapiens; identical to SEQ ID NO: 58442

SEQ ID NO: 275977 - RNA, 64 nt, Homo Sapiens; identical to SEQ ID NO: 58443

SEQ ID NO: 275978 - RNA, 64 nt, Homo Sapiens; identical to SEQ ID NO: 58444

SEQ ID NO: 275979 - RNA, 64 nt, Homo Sapiens; identical to SEQ ID NO: 58445

SEQ ID NO: 275980 - RNA, 64 nt, Homo Sapiens; identical to SEQ ID NO: 58446

SEQ ID NO: 275981 - RNA, 64 nt, Homo Sapiens; identical to SEQ ID NO: 58447

SEQ ID NO: 275982 - RNA, 64 nt, Homo Sapiens; identical to SEQ ID NO: 58448

SEQ ID NO: 275983 - RNA, 64 nt, Homo Sapiens; identical to SEQ ID NO: 58449

SEQ ID NO: 275984 - RNA, 64 nt, Homo Sapiens; identical to SEQ ID NO: 58450

SEQ ID NO: 275985 - RNA, 64 nt, Homo Sapiens; identical to SEQ ID NO: 58451

SEQ ID NO: 275986 - RNA, 64 nt, Homo Sapiens; identical to SEQ ID NO: 58452

SEQ ID NO: 275987 - RNA, 64 nt, Homo Sapiens; identical to SEQ ID NO: 58453

SEQ ID NO: 275988 - RNA, 64 nt, Homo Sapiens; identical to SEQ ID NO: 58454

SEQ ID NO: 275989 - RNA, 64 nt, Homo Sapiens; identical to SEQ ID NO: 58455

SEQ ID NO: 275990 - RNA, 64 nt, Homo Sapiens; identical to SEQ ID NO: 58456

SEQ ID NO: 275991 - RNA, 64 nt, Homo Sapiens; identical to SEQ ID NO: 58457

SEQ ID NO: 275992 - RNA, 64 nt, Homo Sapiens; identical to SEQ ID NO: 58458

SEQ ID NO: 275993 - RNA, 64 nt, Homo Sapiens; identical to SEQ ID NO: 58459

SEQ ID NO: 275994 - RNA, 64 nt, Homo Sapiens; identical to SEQ ID NO: 58460

SEQ ID NO: 275995 - RNA, 64 nt, Homo Sapiens; identical to SEQ ID NO: 58461

SEQ ID NO: 275996 - RNA, 64 nt, Homo Sapiens; identical to SEQ ID NO: 58462

SEQ ID NO: 275997 - RNA, 64 nt, Homo Sapiens; identical to SEQ ID NO: 58463

SEQ ID NO: 275998 - RNA, 64 nt, Homo Sapiens; identical to SEQ ID NO: 58464

SEQ ID NO: 275999 - RNA, 64 nt, Homo Sapiens; identical to SEQ ID NO: 58465

SEQ ID NO: 276000 - RNA, 64 nt, Homo Sapiens; identical to SEQ ID NO: 58466

SEQ ID NO: 276001 - RNA, 64 nt, Homo Sapiens; identical to SEQ ID NO: 58467

SEQ ID NO: 276002 - RNA, 62 nt, Homo Sapiens
gacggcaggcucacugccaggccagccuccgagagggagagagagagagagaggacagcuug

SEQ ID NO: 276003 - RNA, 62 nt, Homo Sapiens
cuggagguugaagccaaguggggugcugggaggagggagagggaggucacuggaaaggggag

SEQ ID NO: 276004 - RNA, 62 nt, Homo Sapiens
cucacaagcaacccugagagagacagucuugugagggagaucugggggaggcaggaagcucc

SEQ ID NO: 276005 - RNA, 62 nt, Homo Sapiens
uauaugagacaugaagcauuggcucagaaguagagggagaagaggaacccaguucccuugac

SEQ ID NO: 276006 - RNA, 62 nt, Homo Sapiens
cauuugaggggccaggggcaggcagggcugcagagggagacggcccugcuggggcuuaggaa

SEQ ID NO: 276007 - RNA, 62 nt, Homo Sapiens
ugugccauggccccccacucccccuucccuuggagggagagguggcaggaauacuucaccuu

SEQ ID NO: 276008 - RNA, 62 nt, Homo Sapiens
gagugaagagccugcccuccgggagagagagggagggagagguuggauucugagggugggga

SEQ ID NO: 276009 - RNA, 62 nt, Homo Sapiens
gagggagggagagggagugaucugaggguggggagggagagagcaaacgacugcuguuggau

SEQ ID NO: 276010 - RNA, 62 nt, Homo Sapiens
aaaccucauggcaaucuugucuguuacugggagagggagacaguugccuguuucacuuguua

SEQ ID NO: 276011 - RNA, 62 nt, Homo Sapiens
cugagagaugcuccuuuggguugcguguacuugagggagauucaucucagugaucauuuacg

SEQ ID NO: 276012 - RNA, 62 nt, Homo Sapiens
gcccugcuuuggucccagagggguuucaggaggagggagacucuccucccacacuagacacu

SEQ ID NO: 276013 - RNA, 62 nt, Homo Sapiens
ggggguccagggcuggugcuugaaggacugaggagggagaguugccaugauaaguccuucca

SEQ ID NO: 276014 - RNA, 62 nt, Homo Sapiens
uuucccaggccgcaccauuugaaaauguaaaggagggagaucaaggaggaggagggagaaga

SEQ ID NO: 276015 - RNA, 62 nt, Homo Sapiens
agaaaauguaaaggagggagaauaaggaggaggagggagaaguguuggaggcacaguuuuag

SEQ ID NO: 276016 - RNA, 62 nt, Homo Sapiens
caaaguuuugaagucaucuuagcuuuccacaggagggagagaacuuaaaaaagcaacaguag

SEQ ID NO: 276017 - RNA, 62 nt, Homo Sapiens
uggucucccuccagcuggaauugcugcucucugagggagaggcugugguggcugucucuguc

SEQ ID NO: 276018 - RNA, 62 nt, Homo Sapiens
uaauuuauugugcaaaugcugguaccagggaagagggagaauucaggggugguaaggacucu

SEQ ID NO: 276019 - RNA, 62 nt, Homo Sapiens
agcaauugucagucaggauaaaucuucucucagagggagaugcuagguguuaccauucacug

SEQ ID NO: 276020 - RNA, 62 nt, Homo Sapiens
guggcaaaaagguuuagauguaagagauggcagagggagauggagcaggagggagacugaag

SEQ ID NO: 276021 - RNA, 62 nt, Homo Sapiens
gaaguaagagauggcagaggcuggcagagcaggagggagacuagccucccucacucuccaug

SEQ ID NO: 276022 - RNA, 62 nt, Homo Sapiens
cagggcucgggaagccacgcgggggguucugugagggagaauggcucucccaggggcugaug

SEQ ID NO: 276023 - RNA, 62 nt, Homo Sapiens
gcacaucucuucugggcggcuuccucuggugggagggagaacggcauggaggguggugugag

SEQ ID NO: 276024 - RNA, 62 nt, Homo Sapiens
cugagaaguggcccaugugcuucaaggcccaggagggagaucugucagcucauucuugccuu

SEQ ID NO: 276025 - RNA, 62 nt, Homo Sapiens
ucuugguaaaaggagggagccugcugagccaggagggagaaaagaagauugaccagcuugcu

SEQ ID NO: 276026 - RNA, 62 nt, Homo Sapiens
guggaagugggguaggggaagaggaggggcaggagggagaguuccugugagcaugugggggg

SEQ ID NO: 276027 - RNA, 62 nt, Homo Sapiens
uccuguccccucugggaacauuucaugcuucagagggagagguuuuuauugagcuuguuuca

SEQ ID NO: 276028 - RNA, 62 nt, Homo Sapiens
cugccgcccccucuccccuuaccgaagugcucgagggagaggguuaccuuccuggugcacac

SEQ ID NO: 276029 - RNA, 62 nt, Homo Sapiens
ccuucccauccuuacccaccugccucuggugagagggagagcauggggcccugagcuucugc

SEQ ID NO: 276030 - RNA, 62 nt, Homo Sapiens
ugcaguuugaccccauuugggggagggagauagagggagagauuugaggcugggcugggagg

SEQ ID NO: 276031 - RNA, 62 nt, Homo Sapiens
gagggagagaugcaguuugaggcugggagggggagggagauauccugggggguuugaggcug

SEQ ID NO: 276032 - RNA, 62 nt, Homo Sapiens
uuuauacguuuuguaccuuugacgggggacuggagggagacuaugcgugugacaggugcaga

SEQ ID NO: 276033 - RNA, 62 nt, Homo Sapiens
ucaccagccccaaggucccgaagggcaggucagagggagagaggcuggagaccugggcuggg

SEQ ID NO: 276034 - RNA, 62 nt, Homo Sapiens
ccugcccugauagggcuuaccugugggugggggagggagaccacacaugucagagguaguga

SEQ ID NO: 276035 - RNA, 62 nt, Homo Sapiens
gcugagaagacuguucacgcaggagaaaggcagagggagagcucgugucucagcaucaggaa

SEQ ID NO: 276036 - RNA, 62 nt, Homo Sapiens
ccccacgcccccacucucccccugggauccuggagggagaggcccguccuggccuggagcac

SEQ ID NO: 276037 - RNA, 62 nt, Homo Sapiens
ggaaaagacugccugccuuggaggggucacaugagggagaccugugccugauuucauuagga

SEQ ID NO: 276038 - RNA, 62 nt, Homo Sapiens
uuuauuagcgcugcucugcaccccucccuugggagggagacuucaugugguuuauugcgagu

SEQ ID NO: 276039 - RNA, 62 nt, Homo Sapiens
agcgguuuuugcaaauucauauuacuuaagcagagggagagaaccucuacugaucagagcau

SEQ ID NO: 276040 - RNA, 62 nt, Homo Sapiens
ggugugguccuagaugaagcauuggggugggggagggagagggagcuuuguguuaagugccu

SEQ ID NO: 276041 - RNA, 62 nt, Homo Sapiens
gccucccaccuuuccccugcggaaggagccaggagggagagauggccagagcagggcuggag

SEQ ID NO: 276042 - RNA, 62 nt, Homo Sapiens
gcgaacacccacgcugguuugggggugggggagagggagagacacaugggguaagggggguu

SEQ ID NO: 276043 - RNA, 62 nt, Homo Sapiens
ggaagaaagaaacaaugucugaagaaaggaaggagggagaagggagagagaggaaagggaag

SEQ ID NO: 276044 - RNA, 62 nt, Homo Sapiens
gaggaaagggaaggaagaaacaggaaagaagagagggagagaggauagcugcaacaaugaaa

SEQ ID NO: 276045 - RNA, 62 nt, Homo Sapiens
aaggggcuaggacuagggugagagggaguggggagggagagggcaggaaggaggcagagcug

SEQ ID NO: 276046 - RNA, 62 nt, Homo Sapiens
cauucuucaaaaccauuccugauagaguagccgagggagagucuuggggccaagaagggccc

SEQ ID NO: 276047 - RNA, 62 nt, Homo Sapiens
aagaaaaagccacguaagggcugcuggaugaugagggagaucacuagugccugagcucagug

SEQ ID NO: 276048 - RNA, 62 nt, Homo Sapiens
gaacuccgagggguguccccggaaagacuggggagggagagugugccguuuggauggggaag

SEQ ID NO: 276049 - RNA, 62 nt, Homo Sapiens
aggagggaggcgcuccugggggcccgagggaggagggagagagagggagggagggagagaau

SEQ ID NO: 276050 - RNA, 62 nt, Homo Sapiens
auggcccgagggaggagggagagggagggagggagggagagauauaaacacuggaggggagg

SEQ ID NO: 276051 - RNA, 62 nt, Homo Sapiens
gccuauaccccuuacuuagccauagagggagagagggagagauauuuuuauauagcuugaaa

SEQ ID NO: 276052 - RNA, 62 nt, Homo Sapiens
gggagagagccuauaccccugcuugaaacauagagggagagacauuuguuuauuuuuauaua

SEQ ID NO: 276053 - RNA, 62 nt, Homo Sapiens
gggaggggaggaguccagggagcgagggagaggagggagaggugagggcggccgggagggcg

SEQ ID NO: 276054 - RNA, 62 nt, Homo Sapiens
agggagagggggaggggagggggagggcgagcgagggagaggggguaucagugagggcggcc

SEQ ID NO: 276055 - RNA, 62 nt, Homo Sapiens
cccuguugcccaguguucucuaugaaacuguagagggagaggauuuuucuccacugcuugga

SEQ ID NO: 276056 - RNA, 62 nt, Homo Sapiens
gggcccuggcuuucucaagcaacuguuugagagagggagagucauugacuucucuacccuaa

SEQ ID NO: 276057 - RNA, 62 nt, Homo Sapiens
gcaacagcagcaggacagggcacggagggagcgagggagagaggaccggucccagcuuuugg

SEQ ID NO: 276058 - RNA, 62 nt, Homo Sapiens
ggauuuaucucaaaaaccaacauccaaaaugggagggagauguggcuugaggucaagcgcca

SEQ ID NO: 276059 - RNA, 62 nt, Homo Sapiens
aguccuuuuugugccaaaucugguagcaaaaggagggagaggcacaggagugggauggggug

SEQ ID NO: 276060 - RNA, 62 nt, Homo Sapiens
cucuggggagccagcuuuggcacagagcagaggagggagaagagccaggugucccuccuaug

SEQ ID NO: 276061 - RNA, 62 nt, Homo Sapiens
auggggcuaugccuggcuuagagagggagggggagggagaaagaugccgacuggaagggagg

SEQ ID NO: 276062 - RNA, 62 nt, Homo Sapiens
gagggggagggagaaaauggccgacuggaagggagggagagggcugugggcagcagacgaug

SEQ ID NO: 276063 - RNA, 62 nt, Homo Sapiens
gcaguuaaugggguagaggagggcaugggagggagggagagguggggagggagacagagaca

SEQ ID NO: 276064 - RNA, 62 nt, Homo Sapiens
agaggagggcaugggagggagggagagguggggagggagacagagacagaaacagagagaga

SEQ ID NO: 276065 - RNA, 62 nt, Homo Sapiens
gaaacagagagagacagagacagagagagacugagggagagacucugaggacauggagagag

SEQ ID NO: 276066 - RNA, 62 nt, Homo Sapiens
uggucaugaaagcgugguucuguaagaaaucagagggagaaagggagagaagggggagggag

SEQ ID NO: 276067 - RNA, 62 nt, Homo Sapiens
aagaaaucagagggagaaagggagagaagggggagggagacaacccaaacguuggaggguau

SEQ ID NO: 276068 - RNA, 62 nt, Homo Sapiens
aaugccuccccaggucugucucuggaggcucugagggagaugggcuugggggcuguaggagg

SEQ ID NO: 276069 - RNA, 62 nt, Homo Sapiens
ccaaccaagagagcgggagggagggaaggagggagggagagagauagagagagagagagaga

SEQ ID NO: 276070 - RNA, 62 nt, Homo Sapiens
agagaauggcuacugcugaguccuuugggguugagggagaugggagcuagggggaggggagg

SEQ ID NO: 276071 - RNA, 62 nt, Homo Sapiens
gggguugagggagaugggagcuagggggaggggagggagaugucuuguuguggggacuuggg

SEQ ID NO: 276072 - RNA, 62 nt, Homo Sapiens
augggucucagagagcaaccuccucccucguagagggagauuauauccccaacuccagggac

SEQ ID NO: 276073 - RNA, 62 nt, Homo Sapiens
gcugccaaaggggcagagggugguggagaggagagggagaaagggaagucccagggcccggg

SEQ ID NO: 276074 - RNA, 62 nt, Homo Sapiens
ucgugguucuuccccgagggugcauguugcaggagggagagggcagggaagacucacagcag

SEQ ID NO: 276075 - RNA, 62 nt, Homo Sapiens
aaugggcuuccuuuuugguucaguauuagugagagggagagggagauggauggugggguagg

SEQ ID NO: 276076 - RNA, 62 nt, Homo Sapiens
cuuccuuuuugguucaguauuagugagagggagagggagauggauggugggguagguuuucu

SEQ ID NO: 276077 - RNA, 62 nt, Homo Sapiens
aucgccugaacccaggaggcggagguugcagggagggagacugcaccacugcacuucagccu

SEQ ID NO: 276078 - RNA, 62 nt, Homo Sapiens
gacugcaccacugcacuucagccugggugacagagggagacucugucuuaaaaaaaaaaaaa

SEQ ID NO: 276079 - RNA, 62 nt, Homo Sapiens
gcggcccaggcacagaagggcagggccauagggagggagauucgcuacggauccaggccauu

SEQ ID NO: 276080 - RNA, 62 nt, Homo Sapiens
uccucuguccccacagugaccugacugggggugagggagaaggaggagagagcccaugugug

SEQ ID NO: 276081 - RNA, 62 nt, Homo Sapiens
gccuccugcagagccagcgaaggaaagcucuagagggagacgacuccaccgccucucugcuc

SEQ ID NO: 276082 - RNA, 62 nt, Homo Sapiens
uggagggcgcaucaaagaagaguccuacccaggagggagagcgcagcugcugcaggauucuc

SEQ ID NO: 276083 - RNA, 62 nt, Homo Sapiens
cuaccacucuggcugcuagacagcuugguggcgagggagaugacuccuuguagcugauacuu

SEQ ID NO: 276084 - RNA, 62 nt, Homo Sapiens
ggcucucuuaagagcuaugugccuuccaaccagagggagacccaguagaaagaaaaacaucc

SEQ ID NO: 276085 - RNA, 62 nt, Homo Sapiens
gcuuuuaaugaauuuaaggcaaaaaagguggagagggagaugugugagcauccugcaaggug

SEQ ID NO: 276086 - RNA, 62 nt, Homo Sapiens
ggauaaaaaauacauacuguggucggcaaggugagggagauagggauauccaggggaagagg

SEQ ID NO: 276087 - RNA, 62 nt, Homo Sapiens
gggacagagagagauagagccagagagacagagagggagagagaggcagagagggagagagg

SEQ ID NO: 276088 - RNA, 62 nt, Homo Sapiens
ggcagagagacagagagggagagagaggcagagagggagagagaaggagagaggcagagagg

SEQ ID NO: 276089 - RNA, 62 nt, Homo Sapiens
ggcagagagggagagaggcagagagaggcagagagggagagagaaagagacaggcagagaag

SEQ ID NO: 276090 - RNA, 62 nt, Homo Sapiens
gagacagaggggaagagagggagagagagacagagggagagaaaacagaggagacagagagg

SEQ ID NO: 276091 - RNA, 62 nt, Homo Sapiens
gagacagagggagagagagaagaggagacagagagggagagaaggcagagagggagagaaac

SEQ ID NO: 276092 - RNA, 62 nt, Homo Sapiens
aacagaggagacagagagggagaggaggcagagagggagagaagauaugaggagagagagac

SEQ ID NO: 276093 - RNA, 62 nt, Homo Sapiens
gauggagaggaggggagagagagggaaaggaggagggagagagugcauaaaugggggucagg

SEQ ID NO: 276094 - RNA, 62 nt, Homo Sapiens
caguagaaagaaaaacauccgccuuccacccagagggagaccggcucucuuaagagcuaugu

SEQ ID NO: 276095 - RNA, 62 nt, Homo Sapiens
acuccuuguagcugauacuuuagcuugguggggagggagaugcuaccacucuggcugcuaga

SEQ ID NO: 276096 - RNA, 62 nt, Homo Sapiens
cagccuguguuuuuuaugcaaggggguaggaggagggagaaaacugcugugaacucacuuug

SEQ ID NO: 276097 - RNA, 62 nt, Homo Sapiens
cgagaugggaugggggagcccuaggguuuccggagggagagccacuuaaagugcuucugccc

SEQ ID NO: 276098 - RNA, 62 nt, Homo Sapiens
ggacccgaggcugaggcauaugagcugagggagagggagagggcucuggccacugcuuccca

SEQ ID NO: 276099 - RNA, 62 nt, Homo Sapiens
gagaggggacccgaggcugauucccaugagcugagggagagguggggagcucuggccacugc

SEQ ID NO: 276100 - RNA, 62 nt, Homo Sapiens
uuguggaaagaggaguuggugguaucggugucgagggagaggaggggguuggggaggaccca

SEQ ID NO: 276101 - RNA, 62 nt, Homo Sapiens
acagugcacggaguguggaagggggucuaggagagggagagcuggaaaaggagcugaugggg

SEQ ID NO: 276102 - RNA, 62 nt, Homo Sapiens
ggggugucuccuggcugggaaggagggaaagggagggagaguuuugcggggguuggcagugg

SEQ ID NO: 276103 - RNA, 62 nt, Homo Sapiens
ucugcucaucagcacugucccaggauccuggagagggagaacuccuggccccaggggaaaga

SEQ ID NO: 276104 - RNA, 62 nt, Homo Sapiens
uuggaagggugcagcccacucaggggagugaggagggagaacaggaggagcccagaggaccc

SEQ ID NO: 276105 - RNA, 62 nt, Homo Sapiens
gauggaggcaguggcugguggcucuggugggagagggagacagggagggaacccugggcagg

SEQ ID NO: 276106 - RNA, 62 nt, Homo Sapiens
ugaguggguuagcuaccugccuauaaagaaaagagggagagacucuuuaaaaaaaauagaag

SEQ ID NO: 276107 - RNA, 62 nt, Homo Sapiens
aaagaaccccagaccucugauagcuuuagcuggagggagauagacacauaaugaggucccuc

SEQ ID NO: 276108 - RNA, 64 nt, Homo Sapiens
agaaugagguuggaccuuuagagacaaugauaugcaagugcaaaucuuuucaacaaauggcacc

SEQ ID NO: 276109 - RNA, 64 nt, Homo Sapiens
acugaaaacuacaaaauuggucaacuuaacaaaacaagugcaagcagaaagaauaaaauaggaa

SEQ ID NO: 276110 - RNA, 64 nt, Homo Sapiens
agguggguauggacaguggaggcagcuggaauggcaagugcagaaaauaggaacaguucuauac

SEQ ID NO: 276111 - RNA, 64 nt, Homo Sapiens
cuugaaacacgagaagcagcaaagacagagcacacaagugcauaaggcuguugucuucggcuug

SEQ ID NO: 276112 - RNA, 64 nt, Homo Sapiens
cgacuggaggcaggacuccuccagcucucaguuacaagugcagguaugcugcuauggacgaccu

SEQ ID NO: 276113 - RNA, 64 nt, Homo Sapiens
gaccaaagggggcccuggcuugaacaaagcaccucaagugcaagugccacuccugacccagccc

SEQ ID NO: 276114 - RNA, 64 nt, Homo Sapiens
gagcacacugcacacaugcaccacacagcacacacaagugcacacaugcacacaggugcacaga

SEQ ID NO: 276115 - RNA, 64 nt, Homo Sapiens
gaccacacacagcacuaacaaguauacacauacacaagugcacacacacguguagcucacacac

SEQ ID NO: 276116 - RNA, 64 nt, Homo Sapiens
agccuagccugauaauccuauuacauaguuugaaaaauaguauuuuauuucucagaacaaggua

SEQ ID NO: 276117 - RNA, 64 nt, Homo Sapiens
agacaagagggaauaguauagacaauaaggaaggaaauaguacuuacaaaugacuccuaaggga

SEQ ID NO: 276118 - RNA, 64 nt, Homo Sapiens
auccaaaguauuaauuacagagcaucaaaagaacaaauaguaaaagcagaacagccauuaaauc

SEQ ID NO: 276119 - RNA, 64 nt, Homo Sapiens
uaaaaugagaaauacauaaggaaauagaccuauaaaauaguaauacagaacaacugaaauacuu

SEQ ID NO: 276120 - RNA, 64 nt, Homo Sapiens
uaucauguguuugguaccuacaguuuuugcucugaaauaguauugaguaugaugaucccuguga

SEQ ID NO: 276121 - RNA, 64 nt, Homo Sapiens
ggcuaauaaauuaugaauucgaaauaguauuuuaaaauaguauuaauaucaauuuuacaguacg

SEQ ID NO: 276122 - RNA, 64 nt, Homo Sapiens
uuaaaauaguauuggcuaauauuuuacaguacggaaauaguauucuuuuuuuccucuaauauca

SEQ ID NO: 276123 - RNA, 64 nt, Homo Sapiens
auaaagauuucagaguacagauuucaugcauuaaaaauaguauguguacauauaaaccauuuuu

SEQ ID NO: 276124 - RNA, 64 nt, Homo Sapiens
auggaaauuagcuuaagcugaauuagacugugauaaauaguaugugggagacugauaaacuggu

SEQ ID NO: 276125 - RNA, 64 nt, Homo Sapiens
auuaaaucgcacuuuuaaagugagucauugaaauaaauaguacugaaaugauucucuauguugu

SEQ ID NO: 276126 - RNA, 64 nt, Homo Sapiens
gguuaaacauuucuaaaaauaaacuaccaauacuaaauaguaagaaaccuaacuuuaguagcaa

SEQ ID NO: 276127 - RNA, 64 nt, Homo Sapiens
agaaugagaaaauauacaauuagaauuauuuuagaaauaguaggaaguauugcagaagucaaua

SEQ ID NO: 276128 - RNA, 64 nt, Homo Sapiens
uauaauuugaauugauuaaaauuggucguuacuaaaauaguauaguaaccacaagugauuggcu

SEQ ID NO: 276129 - RNA, 64 nt, Homo Sapiens
aagguaauguugggacuuuuaacacugacuuaguaaauaguaaaaaaccacuaaaaacuaccua

SEQ ID NO: 276130 - RNA, 64 nt, Homo Sapiens
uaauccuagaccuggaguugggaauggaacaugaaaauaguauagucugcagugcacauuauaa

SEQ ID NO: 276131 - RNA, 64 nt, Homo Sapiens
uuuggugaguuauacccauuuuauuuauuuagaaaaauaguaucuuuguuaacgacuuacaugg

SEQ ID NO: 276132 - RNA, 64 nt, Homo Sapiens
auacaaaggagacuuuuuuuuugagauaacacucaaauaguauucucuucuuuugaaaauuuua

SEQ ID NO: 276133 - RNA, 64 nt, Homo Sapiens
agaaaugaaugcauuuauucaguuuagcauaaacaaauaguaguaauuaagaauuuuaguuuac

SEQ ID NO: 276134 - RNA, 64 nt, Homo Sapiens
ugaagauacugaaucaucauauggcaagugucaaaaauaguaucgauuuacuuugcuaagauuu

SEQ ID NO: 276135 - RNA, 64 nt, Homo Sapiens
uuucaauguuaagugucugcggagugaaaaucuaaaauaguaaacuauauugauagcucuuaaa

SEQ ID NO: 276136 - RNA, 64 nt, Homo Sapiens
cuguauguugaaaauuguacucaaauaucuugagaaauaguagaagaaauuuuguuuuaagucu

SEQ ID NO: 276137 - RNA, 64 nt, Homo Sapiens
agacaauuuuggagagcaagcaaaucuuuuuaaaaaauaguaugaaugugaauacuagaaaaga

SEQ ID NO: 276138 - RNA, 64 nt, Homo Sapiens
auaguaugaaugugaauacuagaaaagauuuaaaaaauaguaugagugugaguacuaggaagga

SEQ ID NO: 276139 - RNA, 64 nt, Homo Sapiens
gucuugggaaaacuauaacuugccaaaguagaagaaauaguaguaccauaugccaaagugauag

SEQ ID NO: 276140 - RNA, 64 nt, Homo Sapiens
aacaagguuauaauuuagcaucuucccuggaucuaaauaguauauuauauccugaaauaaauga

SEQ ID NO: 276141 - RNA, 64 nt, Homo Sapiens
ggaugugaaaguuuugaauuugcuucuuggggaaaaauaguauacugauuguuuucauagauga

SEQ ID NO: 276142 - RNA, 64 nt, Homo Sapiens
uggguucauugggccucagagggauaacaaaaucaaauaguagagguagagacacgcuccagaa

SEQ ID NO: 276143 - RNA, 64 nt, Homo Sapiens
aauguggucagaggauuauauaaaaugacuauugaaauaguaugacugcuuuccaucuacuggg

SEQ ID NO: 276144 - RNA, 64 nt, Homo Sapiens
uugauuauuucauucaugaaugagaauuugagagaaauaguaaucugagcgagucucuagaggg

SEQ ID NO: 276145 - RNA, 64 nt, Homo Sapiens
gcugcaccuaaagaggaaaugaaagguuccuuucaaauaguagaacagcuuguaaauuacaaca

SEQ ID NO: 276146 - RNA, 64 nt, Homo Sapiens
cuuauuuucuaaccaaauacaaaguuuaucacacaaauaguacauuuauaauccauuuaaagug

SEQ ID NO: 276147 - RNA, 64 nt, Homo Sapiens
uguccauugaaaagcaaguauagaucuuaauguaaaauaguaaaugucucuuuguuccuauaag

SEQ ID NO: 276148 - RNA, 64 nt, Homo Sapiens
uucugucucaugucacguauccuuuuauauuuaaaaauaguacauaucuaaaccuaaugaaauu

SEQ ID NO: 276149 - RNA, 64 nt, Homo Sapiens; identical to SEQ ID NO: 46130

SEQ ID NO: 276150 - RNA, 64 nt, Homo Sapiens; identical to SEQ ID NO: 46131

SEQ ID NO: 276151 - RNA, 64 nt, Homo Sapiens; identical to SEQ ID NO: 46132

SEQ ID NO: 276152 - RNA, 64 nt, Homo Sapiens; identical to SEQ ID NO: 46133

SEQ ID NO: 276153 - RNA, 64 nt, Homo Sapiens; identical to SEQ ID NO: 46134

SEQ ID NO: 276154 - RNA, 64 nt, Homo Sapiens; identical to SEQ ID NO: 46135

SEQ ID NO: 276155 - RNA, 64 nt, Homo Sapiens; identical to SEQ ID NO: 46136

SEQ ID NO: 276156 - RNA, 64 nt, Homo Sapiens; identical to SEQ ID NO: 46137

SEQ ID NO: 276157 - RNA, 64 nt, Homo Sapiens; identical to SEQ ID NO: 46138

SEQ ID NO: 276158 - RNA, 64 nt, Homo Sapiens; identical to SEQ ID NO: 46139

SEQ ID NO: 276159 - RNA, 64 nt, Homo Sapiens; identical to SEQ ID NO: 46140

SEQ ID NO: 276160 - RNA, 64 nt, Homo Sapiens; identical to SEQ ID NO: 46141

SEQ ID NO: 276161 - RNA, 64 nt, Homo Sapiens; identical to SEQ ID NO: 46142

SEQ ID NO: 276162 - RNA, 64 nt, Homo Sapiens; identical to SEQ ID NO: 46143

SEQ ID NO: 276163 - RNA, 64 nt, Homo Sapiens; identical to SEQ ID NO: 46144

SEQ ID NO: 276164 - RNA, 64 nt, Homo Sapiens; identical to SEQ ID NO: 46145

SEQ ID NO: 276165 - RNA, 64 nt, Homo Sapiens; identical to SEQ ID NO: 46146

SEQ ID NO: 276166 - RNA, 64 nt, Homo Sapiens; identical to SEQ ID NO: 46147

SEQ ID NO: 276167 - RNA, 64 nt, Homo Sapiens; identical to SEQ ID NO: 46148

SEQ ID NO: 276168 - RNA, 64 nt, Homo Sapiens; identical to SEQ ID NO: 46149

SEQ ID NO: 276169 - RNA, 64 nt, Homo Sapiens; identical to SEQ ID NO: 46150

SEQ ID NO: 276170 - RNA, 64 nt, Homo Sapiens; identical to SEQ ID NO: 46151

SEQ ID NO: 276171 - RNA, 64 nt, Homo Sapiens
aagagacuugaaaacagaaaacugguuaaugacuacuauaaaugcacugaaacuauguuuaugg

SEQ ID NO: 276172 - RNA, 64 nt, Homo Sapiens
gagaaaguuuuuagaaagugauuuuuaugcucgcacuauaaauauggcaggucaguucauucuu

SEQ ID NO: 276173 - RNA, 64 nt, Homo Sapiens
caggaggcaaacuauuuuaguucaauuaaaaauuacuauaaaucgcagaauaaaugagguuuuu

SEQ ID NO: 276174 - RNA, 64 nt, Homo Sapiens
uuaguugaaaaaaaaaauaucccaggcugauguaacuauaaaaauaaauuuucuguauaauuag

SEQ ID NO: 276175 - RNA, 64 nt, Homo Sapiens
auacgaauaugccaacauuaggagggucaacuguacuauaaauagauguggaaccugugcauau

SEQ ID NO: 276176 - RNA, 64 nt, Homo Sapiens
acaaaaaauuaguugggugugaaaccccgucucuacuauaaaauaccagccuggccaacauggc

SEQ ID NO: 276177 - RNA, 64 nt, Homo Sapiens
cagucuccccagucuguuggugucuuuauaggaaacuauaaagcagagcaguggugucuuuaga

SEQ ID NO: 276178 - RNA, 64 nt, Homo Sapiens
auguauagagugugauguccaauugguauucagcacuauaaauguguuuuuaaccucccgcauu

SEQ ID NO: 276179 - RNA, 64 nt, Homo Sapiens
uguuaauaccagcuuuuuccaauuguugaauaaaacuauaaauauggugucucacaaauuaccc

SEQ ID NO: 276180 - RNA, 64 nt, Homo Sapiens
ccaguugaccuggacaguauuuuguuuauauaucacuauaaaauaucaacgugaaugaagaaug

SEQ ID NO: 276181 - RNA, 64 nt, Homo Sapiens
acaucauucagaaaacuuuacugugugaauucagacuauaaaaauacuauaaauuaauguaaua

SEQ ID NO: 276182 - RNA, 64 nt, Homo Sapiens
aauguaauacugugugaauuccaagcacuguaauacuauaaauuuauuucauuucuucaaauua

SEQ ID NO: 276183 - RNA, 64 nt, Homo Sapiens
uuugcuuuuuaaaguuuauuauuagcauugucagacuauaaaccuuuuauauacaauuaggaua

SEQ ID NO: 276184 - RNA, 64 nt, Homo Sapiens
uccaauuguuucacagagccuuguuauaauuuuaacuauaaaggaaucuauuguauuauuacac

SEQ ID NO: 276185 - RNA, 64 nt, Homo Sapiens
uuuaugugcaaguguuuucagugcccugaaucaaacuauaaauguggggagaaaucaccuccau

SEQ ID NO: 276186 - RNA, 64 nt, Homo Sapiens
ugaauaguuugccaucgagauuauuuucauuuauacuauaaaacaaaagcaaacuaguccaguu

SEQ ID NO: 276187 - RNA, 64 nt, Homo Sapiens
uuuuuuuuuuuuuuuuacuuuggaaaggacaauaacuauaaaccuauauccagauuuucuuucu

SEQ ID NO: 276188 - RNA, 64 nt, Homo Sapiens
cagaaucuuccuuuggacaaaacaucacuagcugacuauaaaaacaaaagugucaucauugaag

SEQ ID NO: 276189 - RNA, 64 nt, Homo Sapiens
ccauuuaacugguguucuuaaacaugucuucuguacuauaaaauugaaguucuucacuacuaua

SEQ ID NO: 276190 - RNA, 64 nt, Homo Sapiens
ugucuucuguacuauaaaauugaaguucuucacuacuauaaacauuuaaacuauuuuuuauagc

SEQ ID NO: 276191 - RNA, 64 nt, Homo Sapiens
gagggugauccuuauucaaaaauaacaucugacuacuauaaaaauauuugcauauauaaguuug

SEQ ID NO: 276192 - RNA, 64 nt, Homo Sapiens
aucacuccugaauacagaggcauauucuuuuuaaacuauaaauaccauuuugagugagaaagua

SEQ ID NO: 276193 - RNA, 64 nt, Homo Sapiens
acuagcugagaaggaacugacuggcaccaguauaacuauaaagcuauaaaauaggucucuuaac

SEQ ID NO: 276194 - RNA, 64 nt, Homo Sapiens
aggucucuuaaccuggcacccuuucaugucacucacuauaaaauugugcuuuucuuguaguuga

SEQ ID NO: 276195 - RNA, 64 nt, Homo Sapiens
auuuuauugaacauuuauuauugaguaauuuuccacuauaaagaaugauuugagugguuauuca

SEQ ID NO: 276196 - RNA, 59 nt, Homo Sapiens
auuuguuaggacuucaaauugacuugaugacuauaaaauuagaaaagaagaaagauuga

SEQ ID NO: 276197 - RNA, 64 nt, Homo Sapiens
cuuggaggacucauuuuaccugacuucaagacuuacuauaaagcuauaguaaucaagauagaug

SEQ ID NO: 276198 - RNA, 64 nt, Homo Sapiens
ggauagggacuggagggggugugggguauguaugacuauaaagggaugacgcaaggaguuccuu

SEQ ID NO: 276199 - RNA, 64 nt, Homo Sapiens
auggaucuugaacagaaccaguaucugucauggaacugaacauucaucgauggucuccauguau

SEQ ID NO: 276200 - RNA, 64 nt, Homo Sapiens
acagcucuguuccauguaaguugccaacaguuucacugaacagugggguaugugaugguuuugg

SEQ ID NO: 276201 - RNA, 64 nt, Homo Sapiens
accuacgcacauaccuucauaccagucuauuuccacugaacaaauucagugccuuccucucucu

SEQ ID NO: 276202 - RNA, 64 nt, Homo Sapiens
accuacacacauaccuucauaccagucuauuuccacugaacaaauucacugccuuccucucucu

SEQ ID NO: 276203 - RNA, 64 nt, Homo Sapiens
accuacacacguaccuucauacacugaagaagucacugaacaaauauuugcucagcuggcugag

SEQ ID NO: 276204 - RNA, 64 nt, Homo Sapiens
auauauuuucucacaagcucgucuguugaacuagacugaacaaauucauuaagggccaccugcu

SEQ ID NO: 276205 - RNA, 64 nt, Homo Sapiens
uuuucagugggaucugagacagagagccugugaaacugaacagaguacauaugcauuuuucugg

SEQ ID NO: 276206 - RNA, 64 nt, Homo Sapiens
caggugaucagauaaaauauauuuugggaaauuaacugaacaaauaaaaaguuuuugauauaac

SEQ ID NO: 276207 - RNA, 64 nt, Homo Sapiens
uuucauuucagucaaaucacugcagucaugaaauacugaacaauugccuuaagucuuugcuuga

SEQ ID NO: 276208 - RNA, 64 nt, Homo Sapiens
guugaaaaauugugccugauauucuuagcauauaacugaacacaugcuaaacuuuguaaugcac

SEQ ID NO: 276209 - RNA, 64 nt, Homo Sapiens
aauaaaacuguggaaguaaucagguuaguaauaaacugaacaguuguuacccaauuaggcuugu

SEQ ID NO: 276210 - RNA, 56 nt, Homo Sapiens
aagcuuuuaaccuaucuuaacaacuuacugaacauaagaaaauuuacacuagagag

SEQ ID NO: 276211 - RNA, 64 nt, Homo Sapiens
auguggcagagcuuuuaaccaguccgcaaagcucacugaacauaaguuaauucauacuggagaa

SEQ ID NO: 276212 - RNA, 64 nt, Homo Sapiens
aggggaccaucaacauuguauuuauuaaaacuugacugaacaaaaacuguagaacaguuuuauu

SEQ ID NO: 276213 - RNA, 64 nt, Homo Sapiens
gugcaauuaacuguagaacacauuggaaauuuacacugaacaaaucguuuaaccugcucuuggu

SEQ ID NO: 276214 - RNA, 64 nt, Homo Sapiens
ccacgugauuucccuuucagcauuuauacccaggacugaacaugcagaacuguuuuuuuuuuuu

SEQ ID NO: 276215 - RNA, 64 nt, Homo Sapiens
auacacaccuccaguuuuugcucuuuuguguuguacugaacacaauauuuguguuuuuauuauu

SEQ ID NO: 276216 - RNA, 64 nt, Homo Sapiens
caaauggaggcuauguggaggccagugacaugagacugaacagcucagaacaggaauccacauu

SEQ ID NO: 276217 - RNA, 64 nt, Homo Sapiens
aaaaugcucacacuccacauuaaaaauuaaggcaacugaacaaaucagaugacuagaaagugaa

SEQ ID NO: 276218 - RNA, 64 nt, Homo Sapiens
gguuuuuccauaauuuacuuaaccaauccuugucacugaacauuaaggcugcuuucacacuguc

SEQ ID NO: 276219 - RNA, 64 nt, Homo Sapiens
guuuuuccuacauucugaaaagcaaacaugaaaaacugaacacaguuuuuacagauauacaaua

SEQ ID NO: 276220 - RNA, 64 nt, Homo Sapiens
ugaguccuggaugauacuaaauuucaggaggaauacugaacauccauuugcauuuguuuaugua

SEQ ID NO: 276221 - RNA, 64 nt, Homo Sapiens
caaaaucuugaucaguuaagaguuuucauccauaacugaacaucggguaaaguuaaguugagau

SEQ ID NO: 276222 - RNA, 64 nt, Homo Sapiens
gaaguggcuugauugcuuaacaugauguaaagaaacugaacaguuuaauaccaaguauucauuu

SEQ ID NO: 276223 - RNA, 64 nt, Homo Sapiens; identical to SEQ ID NO: 276222

SEQ ID NO: 276224 - RNA, 64 nt, Homo Sapiens
aauauuucccagauagcugguuauugcuguuggaacugaacaauaugugucaaguuacucaaag

SEQ ID NO: 276225 - RNA, 64 nt, Homo Sapiens
ccacuuuggaguaaauagcuacuauagggaaagcacugaacaaacacauaauuaaagcaguuga

SEQ ID NO: 276226 - RNA, 64 nt, Homo Sapiens
ucaaacuaaauuguauuuucagagcuauccugaaacugaacagcugaaacuuuaaaaaauaauu

SEQ ID NO: 276227 - RNA, 64 nt, Homo Sapiens
uacgauacagggccauuuuuuuaaaacucucaggacugaacagaagagaaaaauuauuaauuag

SEQ ID NO: 276228 - RNA, 64 nt, Homo Sapiens
cacugcuggacaugagauggagaggcugagggacaggaucuauaggcagcuucuaagagcgaac

SEQ ID NO: 276229 - RNA, 64 nt, Homo Sapiens
uccuugucuuuugagcuauucaccucaguagaaaaggaucuaagggaagaucacuguaguuuag

SEQ ID NO: 276230 - RNA, 64 nt, Homo Sapiens
uugagauguguaacuggcaugauucugcuuuugaaggaucuauaguaucauuuuaguuaagugg

SEQ ID NO: 276231 - RNA, 64 nt, Homo Sapiens
aauaguuuaaaauagguuaauucgaacacaggaaaggaucuauuuguuguuucuuuugucuggu

SEQ ID NO: 276232 - RNA, 64 nt, Homo Sapiens
auuguagguggcuuggggaauguggguggcuuagaggaucuaaaccgauucacuuccugguuga

SEQ ID NO: 276233 - RNA, 64 nt, Homo Sapiens
acgagggcuugcucuaaaucguuuagaggauaacaggaucuagagaugcucucugcuugacaac

SEQ ID NO: 276234 - RNA, 64 nt, Homo Sapiens; identical to SEQ ID NO: 83098

SEQ ID NO: 276235 - RNA, 64 nt, Homo Sapiens; identical to SEQ ID NO: 83099

SEQ ID NO: 276236 - RNA, 64 nt, Homo Sapiens; identical to SEQ ID NO: 83100

SEQ ID NO: 276237 - RNA, 64 nt, Homo Sapiens; identical to SEQ ID NO: 83101

SEQ ID NO: 276238 - RNA, 64 nt, Homo Sapiens; identical to SEQ ID NO: 83102

SEQ ID NO: 276239 - RNA, 64 nt, Homo Sapiens; identical to SEQ ID NO: 83103

SEQ ID NO: 276240 - RNA, 64 nt, Homo Sapiens; identical to SEQ ID NO: 83104

SEQ ID NO: 276241 - RNA, 64 nt, Homo Sapiens; identical to SEQ ID NO: 83105

SEQ ID NO: 276242 - RNA, 64 nt, Homo Sapiens; identical to SEQ ID NO: 83106

SEQ ID NO: 276243 - RNA, 64 nt, Homo Sapiens; identical to SEQ ID NO: 83107

SEQ ID NO: 276244 - RNA, 64 nt, Homo Sapiens; identical to SEQ ID NO: 83108

SEQ ID NO: 276245 - RNA, 64 nt, Homo Sapiens; identical to SEQ ID NO: 83109

SEQ ID NO: 276246 - RNA, 64 nt, Homo Sapiens; identical to SEQ ID NO: 83110

SEQ ID NO: 276247 - RNA, 64 nt, Homo Sapiens; identical to SEQ ID NO: 83111

SEQ ID NO: 276248 - RNA, 64 nt, Homo Sapiens; identical to SEQ ID NO: 83112

SEQ ID NO: 276249 - RNA, 64 nt, Homo Sapiens; identical to SEQ ID NO: 83113

SEQ ID NO: 276250 - RNA, 64 nt, Homo Sapiens; identical to SEQ ID NO: 83114

SEQ ID NO: 276251 - RNA, 64 nt, Homo Sapiens; identical to SEQ ID NO: 83115

SEQ ID NO: 276252 - RNA, 64 nt, Homo Sapiens; identical to SEQ ID NO: 83116

SEQ ID NO: 276253 - RNA, 64 nt, Homo Sapiens; identical to SEQ ID NO: 83117

SEQ ID NO: 276254 - RNA, 64 nt, Homo Sapiens; identical to SEQ ID NO: 83118

SEQ ID NO: 276255 - RNA, 64 nt, Homo Sapiens; identical to SEQ ID NO: 83119

SEQ ID NO: 276256 - RNA, 64 nt, Homo Sapiens; identical to SEQ ID NO: 83120

SEQ ID NO: 276257 - RNA, 64 nt, Homo Sapiens; identical to SEQ ID NO: 83121

SEQ ID NO: 276258 - RNA, 64 nt, Homo Sapiens
cauuuucaucauuauuauucguugacaugaauagaccauggaaaaacaugguuguuauugugcu

SEQ ID NO: 276259 - RNA, 64 nt, Homo Sapiens
aggauauucacaguaguacauguguguguguguuaccauggaaaaaaagcaugaaguacgugug

SEQ ID NO: 276260 - RNA, 64 nt, Homo Sapiens
ccaucagacagguaaaugggcagugccuccugggaccauggacacauuuucuccuaggagaagc

SEQ ID NO: 276261 - RNA, 64 nt, Homo Sapiens
gacucucuuagggaaaccaauaguccccaucagcaccauggaggcaggcucccccugccuuuga

SEQ ID NO: 276262 - RNA, 64 nt, Homo Sapiens
gagggcuccacaagcgugucuggcauucccacccaccauggaagacuggauacgcaccuggaaa

SEQ ID NO: 276263 - RNA, 64 nt, Homo Sapiens
ugccacuguagccagaucuccaacagugccuuggaccauggacucauacucaacugaguaagaa

SEQ ID NO: 276264 - RNA, 64 nt, Homo Sapiens
acuaugcagccauaaagaaguguggcacauauacaccauggaaugauagacuggauuaagaaaa

SEQ ID NO: 276265 - RNA, 64 nt, Homo Sapiens
uaaaaagaagaguaaaauacagguucugggcuaaaccauggagauuacugauaguuucugugcc

SEQ ID NO: 276266 - RNA, 64 nt, Homo Sapiens
caaacugucccuguccccagguucuccggcucucaccauggaaaccagggugacccaacaucca

SEQ ID NO: 276267 - RNA, 64 nt, Homo Sapiens
ccacacauuucucaucucaucuccuccagcuguaaccauggauacccaugaagacagugccucc

SEQ ID NO: 276268 - RNA, 64 nt, Homo Sapiens
ugggaguugggggccagaguggaaaugaguugagaccauggacuagcuccaggaaggcuuugug

SEQ ID NO: 276269 - RNA, 64 nt, Homo Sapiens
cuuggcaugcccagggcaagaccacugagccuagaccauggagcaugugacaggcugugguggc

SEQ ID NO: 276270 - RNA, 64 nt, Homo Sapiens
ccagacaagguugaagcggaagcagccugugcggaaacgccagugacacguacacaccacgucc

SEQ ID NO: 276271 - RNA, 64 nt, Homo Sapiens
agugaagcccaagccaggccugguugagggugauaaacgccacugucucuaaggguucugacuc

SEQ ID NO: 276272 - RNA, 64 nt, Homo Sapiens
ugaaagcaaucaaguuucuugagaggagaugccaaaacgccagaaaacugugcauaugaaaugg

SEQ ID NO: 276273 - RNA, 64 nt, Homo Sapiens
uguaguggcucaugccuguacagaagaggauucaaaacgccacgacucagauuguaucuuugua

SEQ ID NO: 276274 - RNA, 64 nt, Homo Sapiens
gcuuguccaacaacuccaggaaaacuguuuuucaaaacgccauguccuaggggccgagggaaau

SEQ ID NO: 276275 - RNA, 64 nt, Homo Sapiens
guguguguuuuuuaauagguuauuucugacagacaaacgccaaaaaaagaugaaagucuuguau

SEQ ID NO: 276276 - RNA, 64 nt, Homo Sapiens
uucauuuuaauuuguagaaguacuuuacaguaggaaacgccaguaaacaacuuuuauacuguua

SEQ ID NO: 276277 - RNA, 64 nt, Homo Sapiens
aggcagggggcuggacuucacuagugucuaaaggaaacgccaugcagaguugccauggcaucgg

SEQ ID NO: 276278 - RNA, 64 nt, Homo Sapiens
guaguuuagagcagaggaaagguagagugguagaaaacgccagauguaaugaauguuccaaaau

SEQ ID NO: 276279 - RNA, 64 nt, Homo Sapiens
caguaguaauucuuguaacuguacuucuuucagcaaacgccaaaaaagcauauaauauucucac

SEQ ID NO: 276280 - RNA, 64 nt, Homo Sapiens
aaagccagcccacugcucucuuggauuccaguacaaacgccaccccagcccucagaugugcuua

SEQ ID NO: 276281 - RNA, 64 nt, Homo Sapiens
gccuuccgcagagaccagagaggcugaacacccaaaacgccauuacaaccaggaggagcuugag

SEQ ID NO: 276282 - RNA, 64 nt, Homo Sapiens
cagaggaaguaaauguucacuuaaaugaaauugaaaacgccauguggcaccacaaaagagcucu

SEQ ID NO: 276283 - RNA, 64 nt, Homo Sapiens
uaucauaguacuuuacauggauucacaugaacugaaacgccaccacuuggcccaggauguugaa

SEQ ID NO: 276284 - RNA, 64 nt, Homo Sapiens
uuggacuaauuuaaaaaagaacaacuaaguuccuaaacgccacuuggugucagcgcagcagccu

SEQ ID NO: 276285 - RNA, 64 nt, Homo Sapiens
cccaacccuuuccggaacucagucuuuagaaaagaaacgccagguucaagaauugcaaaccagc

SEQ ID NO: 276286 - RNA, 64 nt, Homo Sapiens
aaaaaucagcagauguugaaauaacaaaaaagagaaacgccaacuuuaaaguguggaaagcaaa

SEQ ID NO: 276287 - RNA, 64 nt, Homo Sapiens
uucauccuucuuagaaagagacaaggccaaggacaaacgccaucccuccucuccguccauaccu

SEQ ID NO: 276288 - RNA, 64 nt, Homo Sapiens
guaacguuuuuuacuagaguagugaauuuauccaaaacgccauuucccaagucauguaauguau

SEQ ID NO: 276289 - RNA, 64 nt, Homo Sapiens
ucaaaaaauauacauauauaugggcaaaagagcaaaacgccauccgugccacuucacuccagcc

SEQ ID NO: 276290 - RNA, 64 nt, Homo Sapiens
uggggaacccagcaggaaauuagaauagaaccaaaaacgccagucaugggaggcagagcugggg

SEQ ID NO: 276291 - RNA, 64 nt, Homo Sapiens
ugcuuugguuauuagaguuugaaguugagaaggaaaacgccaaacuccauguagcaaccaggac

SEQ ID NO: 276292 - RNA, 64 nt, Homo Sapiens
aaaauagagaaaauucagguuugagagaaacgugaaacgccacacaccaaaauuauuaauccuc

SEQ ID NO: 276293 - RNA, 64 nt, Homo Sapiens
ccuccagggucuuaagagucccauuuuucgggugaaacgccacaugcuuaggggaaugaaauug

SEQ ID NO: 276294 - RNA, 64 nt, Homo Sapiens
caaacccaccaaaccaacaggauaauugacaaauaaacgccauaggcuaggcugaacuguaugu

SEQ ID NO: 276295 - RNA, 64 nt, Homo Sapiens
gccaccagauccucuugcaagauugccccaacuuaaacgccacauaaaacagcuccuaauugac

SEQ ID NO: 276296 - RNA, 64 nt, Homo Sapiens
guguuuaaauugauagcagauccaaaaugggagaaaacgccaguguuccccagcaacucuggcc

SEQ ID NO: 276297 - RNA, 64 nt, Homo Sapiens
gacuggguugcugacaaacaaggaugcucuaagaaaacgccauauuauuuguguuaaucuauuc

SEQ ID NO: 276298 - RNA, 64 nt, Homo Sapiens
aacuguucucuuggaugguuaccuuauuucuaagaaacgccacugaggaacaggauccacuuug

SEQ ID NO: 276299 - RNA, 64 nt, Homo Sapiens
ucaggaguucgagaccagccugaccaacauggugaaacgccaucucuacuaaaaauacaaaaau

SEQ ID NO: 276300 - RNA, 64 nt, Homo Sapiens
gcuucuagagauugaggugaaagcuucguccgagaaacgccaggacagacgauggcagaggaga

SEQ ID NO: 276301 - RNA, 64 nt, Homo Sapiens
gcacagcugucuuuaugcaagagauuaaaaaaaaaaacgccauacuugaaucacguuaacuuuu

SEQ ID NO: 276302 - RNA, 64 nt, Homo Sapiens
ggcucaugagcaacauuaggcuugcguggaaugaaaacgccaaagcuggcucagaggggcccac

SEQ ID NO: 276303 - RNA, 64 nt, Homo Sapiens
gauauuugugaaggccuuuacucuuaggcauggcaaacgccagucuucuggguuagccugcuga

SEQ ID NO: 276304 - RNA, 64 nt, Homo Sapiens
ucaugcucuagagaaaauaauuuuauuuuuaaauaaacgccaaaaaaugucaaaaucucaagau

SEQ ID NO: 276305 - RNA, 64 nt, Homo Sapiens
ugccucagucuccugagcagcugggauuacaggcaaacgccaccacacccagcuaaauuuuuuu

SEQ ID NO: 276306 - RNA, 64 nt, Homo Sapiens
gaagcgccggagcaagaggcuguacgugaauuaaaaacgccaccuugggcucgagcagcgaccc

SEQ ID NO: 276307 - RNA, 64 nt, Homo Sapiens
ugcaccccacccacucacccaaauccaugaaaauaaacgccaccgaggcuuuuccaguguguau

SEQ ID NO: 276308 - RNA, 64 nt, Homo Sapiens
agaaaaaugggaagaaccaguuuuauccaucuuaaaacgccaggcaccucuucacaggugguaa

SEQ ID NO: 276309 - RNA, 52 nt, Homo Sapiens
gggcagggagcagacagugagcaaacgccagcagggcugcugugaauuugug

SEQ ID NO: 276310 - RNA, 64 nt, Homo Sapiens
uuugugucuuauuuuauuuuaccuucaaaaacaaaaacgccauccaaaaccaaggaaguccuug

SEQ ID NO: 276311 - RNA, 64 nt, Homo Sapiens
gccaugucccccagccauggcauggcugcacuguaaacgccaaucggggggucaccaggaucaa

SEQ ID NO: 276312 - RNA, 64 nt, Homo Sapiens
acgcaagggcgcugucccgcccaaccccgccuuuaaacgccacaaauaaagagcauuguuaccg

SEQ ID NO: 276313 - RNA, 64 nt, Homo Sapiens
ccucugcccagcucaccacaucuucaucaccagcaaacgccaggacuuggcucccccauccuca

SEQ ID NO: 276314 - RNA, 64 nt, Homo Sapiens
gguucuuucagcaggacaggcauuuacacugaugaaacgccacugggagugaggaagccagacu

SEQ ID NO: 276315 - RNA, 64 nt, Homo Sapiens
gauaugaaaacucucaugaauaaacaucuccgugaaacgccaaggcccucgucaaacccugagu

SEQ ID NO: 276316 - RNA, 64 nt, Homo Sapiens
ucugccuguucuugcugggcggagucaggcuaagaaacgccaggagggugggcugugcccagca

SEQ ID NO: 276317 - RNA, 64 nt, Homo Sapiens
uucuaaaacuaauuugacaaaucaugacacuagaaaacgccaauguuuuaugucuuugcccauc

SEQ ID NO: 276318 - RNA, 64 nt, Homo Sapiens
cacucucugcuucaucuaagaaaaccaauaccaaaaacgccacuuuaaugcucagcccugcguu

SEQ ID NO: 276319 - RNA, 64 nt, Homo Sapiens
ggguucucuagugcucauuuauguguuucucucuaaacgccauuaacaggccuccauaccaggc

SEQ ID NO: 276320 - RNA, 64 nt, Homo Sapiens
aauauuuauaucauccagaaaagaaaaacacgagaaacgccaucgcgggauggugcagacgcgg

SEQ ID NO: 276321 - RNA, 64 nt, Homo Sapiens
aggaagccccagaacacccacaggucuugguaacaaacgccaccuuacacucugcaggcugcag

SEQ ID NO: 276322 - RNA, 64 nt, Homo Sapiens
cauucucccacuucaguucgcucgagauggccugaaacgccacuggcucaugugucugcugcga

SEQ ID NO: 276323 - RNA, 64 nt, Homo Sapiens
cacgguggcucaugccuguauacagaagggaaacaaacgccaggacccaaccccaaacucccug

SEQ ID NO: 276324 - RNA, 64 nt, Homo Sapiens
uccccaggaccauuccccugauccaacaguugcuaaacgccacggagcucacgcaggacccggc

SEQ ID NO: 276325 - RNA, 64 nt, Homo Sapiens
ggccauguggaauccauggcucugcccugaaagaaaacgccacuauccaaagggugggagcaca

SEQ ID NO: 276326 - RNA, 64 nt, Homo Sapiens
gugcucacuaaaacaacuuuuuccauuuuuaauaaaacgccaaaaauaucacaacccaccaaaa

SEQ ID NO: 276327 - RNA, 64 nt, Homo Sapiens
ucccccaauccaucagugcccaggggacacccagaaacgccacauauucccauaucaaaagaca

SEQ ID NO: 276328 - RNA, 64 nt, Homo Sapiens
ucucuuccugaagaaacugaaguguccaacuuccucuaaguauugcuaugcaaaagcugcugua

SEQ ID NO: 276329 - RNA, 64 nt, Homo Sapiens
uuguauuccuuuaaucaaaaaggaaacacaauauucuaaguaucuuuagcccaaauaccaugac

SEQ ID NO: 276330 - RNA, 64 nt, Homo Sapiens
uccuaacuuuauuuuucaaauuauaaagugauuuucuaaguauugugcaaaaaaaaagauucug

SEQ ID NO: 276331 - RNA, 64 nt, Homo Sapiens
ugaaugggguuugauucugaucucuaugaagguuucuaaguaccaagccauuuucuagcaaaug

SEQ ID NO: 276332 - RNA, 64 nt, Homo Sapiens
uaacugugcuucagggguagcccaguuccuaccccagaaccaguagaacccugucccuccggcc

SEQ ID NO: 276333 - RNA, 64 nt, Homo Sapiens
acccugucccuccggcccccagccaagguugagccagaaccagaaggcccuggaucucaccagc

SEQ ID NO: 276334 - RNA, 64 nt, Homo Sapiens
gaaguuuccauuuuucauccaaguuaggagugaucagaaccagugcuuauuaagaucacccagc

SEQ ID NO: 276335 - RNA, 64 nt, Homo Sapiens
accuugaaagauccauguucggggguguugucugcagaaccaccauggggaggcgggggggggg

SEQ ID NO: 276336 - RNA, 64 nt, Homo Sapiens
aaggaccauucaagguucacuguuguuuuguccucagaaccaggagcuucagauccuaagucaa

SEQ ID NO: 276337 - RNA, 64 nt, Homo Sapiens
aauuuuguuuguccaguauagcauuuaacugcaucagaaccaguaugaaaagaccaggaaucca

SEQ ID NO: 276338 - RNA, 64 nt, Homo Sapiens
gcagucaggaauaaacuguucaauaaucucuucccagaaccacuuggcagcuucaacaggcagg

SEQ ID NO: 276339 - RNA, 64 nt, Homo Sapiens
cugggcagaggggucugcugggccucccccgugacagaaccacaggugggaggccugggcccgg

SEQ ID NO: 276340 - RNA, 64 nt, Homo Sapiens
augcggucacccugcaaaagacuugcacuuuccucagaaccaacaugacgcagcucaauaaggg

SEQ ID NO: 276341 - RNA, 64 nt, Homo Sapiens
ccuuucccacagacuucccuccuggguccagguucagaaccaagacuucuguaccuagugcugc

SEQ ID NO: 276342 - RNA, 64 nt, Homo Sapiens
auaacugauaauguugguucagggaacacacuuucagaaccacugcuuuaauauuuuaaauaag

SEQ ID NO: 276343 - RNA, 64 nt, Homo Sapiens
ucuccuguagacccaguggaacccauaaguaauucagaaccaucaaugaauucagauaugggaa

SEQ ID NO: 276344 - RNA, 64 nt, Homo Sapiens
caggcaacaacugccccuucuuuaugcagaggugcagaaccagggacuccugggcccauccagg

SEQ ID NO: 276345 - RNA, 64 nt, Homo Sapiens
gaagugggcaagcuggccaaaauauuggaacacacagaaccaaaccagguguguucuacaccug

SEQ ID NO: 276346 - RNA, 64 nt, Homo Sapiens
gaagccaggacgucaggcugauccugugaccucccagaaccaugaccuugggugugagggacca

SEQ ID NO: 276347 - RNA, 64 nt, Homo Sapiens
cuggccaaaaauuacaccagaggcugaggggguucagaaccagcacuaaggcagccuucuucac

SEQ ID NO: 276348 - RNA, 64 nt, Homo Sapiens
gaaucucugcagcggaaacgugcauaccucagugcagaaccacacuccccguccccugcuccga

SEQ ID NO: 276349 - RNA, 64 nt, Homo Sapiens
ggggucugugccggcagcacgccgggguccagcucagaaccacgacccacgggggcuccucccu

SEQ ID NO: 276350 - RNA, 64 nt, Homo Sapiens
cugucucccuggaggggcucucacguuuuuagagcagaaccacagacauauuucaguuuccacc

SEQ ID NO: 276351 - RNA, 64 nt, Homo Sapiens
caucgagcuagcucccugcaccaagcauccaguacagaaccaggcuccuagccaccagugaucc

SEQ ID NO: 276352 - RNA, 64 nt, Homo Sapiens
ugucugccugggcuccaagugggcaggaccaggacagaaccacaggcacacacugagggggcag

SEQ ID NO: 276353 - RNA, 64 nt, Homo Sapiens
gcagcugugccacgggucagcugagccacagucccagaaccaagcucucggugucucgggccac

SEQ ID NO: 276354 - RNA, 64 nt, Homo Sapiens
cacuauggaggucgaggauuggcagaggcauaaacagaaccagucccuagggcuucaguccugg

SEQ ID NO: 276355 - RNA, 64 nt, Homo Sapiens
gagaggaaucgccaaaacaaggucacguggucugcagaaccaaaagggcuggcucgggcaggug

SEQ ID NO: 276356 - RNA, 64 nt, Homo Sapiens
uuacuuuaaaauuaauaauaaggccaguaaugaucagaaccauuuugucauguacucuuagagg

SEQ ID NO: 276357 - RNA, 64 nt, Homo Sapiens
ucucuagucaccacccugccauuucccaaggucacagaaccagcgggcucagaggggugagacc

SEQ ID NO: 276358 - RNA, 64 nt, Homo Sapiens
uuugagaugaugauacaacaucaacucaacauggcagaaccauuauuguuuuugacuaugggag

SEQ ID NO: 276359 - RNA, 64 nt, Homo Sapiens
gcugacuuuagguucacaugcaacaucaaaauggcagaaccauuuucacacccuguuuuauaaa

SEQ ID NO: 276360 - RNA, 64 nt, Homo Sapiens
ccuuaacgcuguguguaugagggccgugccugcuggcacagacggagagaagcugggcccagcc

SEQ ID NO: 276361 - RNA, 64 nt, Homo Sapiens
auggggcuuuaugcuuguaagcagagagguagguggcacagaagcuuucauuucugugggaggg

SEQ ID NO: 276362 - RNA, 64 nt, Homo Sapiens
cugggaaggagacaggacauuccuguacuaagguggcacagagcuguccuuugcaacauucuca

SEQ ID NO: 276363 - RNA, 64 nt, Homo Sapiens
cagagcuguccuuugcaacauucucauaaaauugggcacagaguucgcauuggcgcaauauuua

SEQ ID NO: 276364 - RNA, 64 nt, Homo Sapiens
aguggcagggcccagcuagccauuccccauucauggcacagagcauuggcaagaggagcugguc

SEQ ID NO: 276365 - RNA, 64 nt, Homo Sapiens
acaaauaucaaagaucuaauuucaguugacacgaggcacagaaacaggcggccgagcugccgaa

SEQ ID NO: 276366 - RNA, 64 nt, Homo Sapiens
uucuccccucucucagauuggccuggcagccccuggcacagagcagacccggccacugguagcu

SEQ ID NO: 276367 - RNA, 64 nt, Homo Sapiens
ggccugcuccacuugucugggaaccugggcaggaggcacagaggaagccaaggccuggagcugc

SEQ ID NO: 276368 - RNA, 64 nt, Homo Sapiens
ccaugaugugaaaccaaugacccugugaccacauggcacagaacacuaaauuuuggucccaugg

SEQ ID NO: 276369 - RNA, 64 nt, Homo Sapiens
uuuguguagcuucagaguuagauugaaauuaccaggcacagauuuagucuugucauuuuguuua

SEQ ID NO: 276370 - RNA, 64 nt, Homo Sapiens
gacggaagcagaaaggacagcaggcggcagggcuggcacagacaucugagggagcaagagcugg

SEQ ID NO: 276371 - RNA, 64 nt, Homo Sapiens
cuccuggaaaagggagagggggaccagggcuacaggcacagaguggugggggccagguucacug

SEQ ID NO: 276372 - RNA, 64 nt, Homo Sapiens
cacaagaaagggaggguacgccaggcgagcccagggcacagaugcugagacagccucuccuucu

SEQ ID NO: 276373 - RNA, 64 nt, Homo Sapiens
gugcagggacgucaccccugccaggcaagcccagggcacagaugccaggauggcuucucccucu

SEQ ID NO: 276374 - RNA, 64 nt, Homo Sapiens
gugcagggacgucaccccugccaggcaagcccagggcacagaggccgggacggccucucccucu

SEQ ID NO: 276375 - RNA, 64 nt, Homo Sapiens
agugugaggcuucacccaugcuaggcaagcccagggcacagaugccgggauggccccucccucu

SEQ ID NO: 276376 - RNA, 64 nt, Homo Sapiens
gugcgggaacgucaccccugccaggcaagcccagggcacagaugcugcgauggccucuuccucu

SEQ ID NO: 276377 - RNA, 64 nt, Homo Sapiens
uggccccuugccuguuuguuggauucgcauucaaggcacagaaugaaggagcagggcucuggag

SEQ ID NO: 276378 - RNA, 64 nt, Homo Sapiens
ccuaggugccucgcuccaugggugccgggggccuggcacagaccgggaccaaaggaaaggagga

SEQ ID NO: 276379 - RNA, 64 nt, Homo Sapiens; identical to SEQ ID NO: 70892

SEQ ID NO: 276380 - RNA, 64 nt, Homo Sapiens; identical to SEQ ID NO: 70893

SEQ ID NO: 276381 - RNA, 64 nt, Homo Sapiens; identical to SEQ ID NO: 70894

SEQ ID NO: 276382 - RNA, 64 nt, Homo Sapiens; identical to SEQ ID NO: 70895

SEQ ID NO: 276383 - RNA, 64 nt, Homo Sapiens; identical to SEQ ID NO: 70896

SEQ ID NO: 276384 - RNA, 64 nt, Homo Sapiens; identical to SEQ ID NO: 70897

SEQ ID NO: 276385 - RNA, 64 nt, Homo Sapiens; identical to SEQ ID NO: 70898

SEQ ID NO: 276386 - RNA, 64 nt, Homo Sapiens; identical to SEQ ID NO: 70899

SEQ ID NO: 276387 - RNA, 64 nt, Homo Sapiens; identical to SEQ ID NO: 70900

SEQ ID NO: 276388 - RNA, 64 nt, Homo Sapiens; identical to SEQ ID NO: 70901

SEQ ID NO: 276389 - RNA, 64 nt, Homo Sapiens; identical to SEQ ID NO: 70902

SEQ ID NO: 276390 - RNA, 64 nt, Homo Sapiens; identical to SEQ ID NO: 70903

SEQ ID NO: 276391 - RNA, 64 nt, Homo Sapiens; identical to SEQ ID NO: 70904

SEQ ID NO: 276392 - RNA, 64 nt, Homo Sapiens; identical to SEQ ID NO: 70905

SEQ ID NO: 276393 - RNA, 64 nt, Homo Sapiens; identical to SEQ ID NO: 70906

SEQ ID NO: 276394 - RNA, 64 nt, Homo Sapiens; identical to SEQ ID NO: 70907

SEQ ID NO: 276395 - RNA, 64 nt, Homo Sapiens
ugggggguggugaugauugucucagcacucacgcacugcacaagauggcagcaggauacagcac

SEQ ID NO: 276396 - RNA, 64 nt, Homo Sapiens
ucacgcacugcacaagauggcagcaggauacagcacugcacaagauggcagcuccucugcagcu

SEQ ID NO: 276397 - RNA, 64 nt, Homo Sapiens
cagcugcgaccagagacuggggacgucagccagcacugcacagaugcacagacagcugcgacca

SEQ ID NO: 276398 - RNA, 64 nt, Homo Sapiens
cagcugcgaccaggacgucaggacaucagccagcacugcacagaugugaggccgugguuagcgu

SEQ ID NO: 276399 - RNA, 64 nt, Homo Sapiens
aaacuuuaguucacuugcaguaugcuuauccuugacugcacaugagaaugccuugugcagaguu

SEQ ID NO: 276400 - RNA, 64 nt, Homo Sapiens
ggaggcagagcuugcagugagccgagauugugccacugcacacuccaaucugggugaaagaccg

SEQ ID NO: 276401 - RNA, 64 nt, Homo Sapiens
cuugaaggaguuuaaaaggaggcuggaaaucaauacugcacacugcacauuugcucagaauugc

SEQ ID NO: 276402 - RNA, 64 nt, Homo Sapiens
gaguuuaaaaggaggcuggaaaucaauacugcacacugcacauuugcucagaauugcacaucua

SEQ ID NO: 276403 - RNA, 64 nt, Homo Sapiens
cugcaaaccaggagagaggguuugugaauaacaaacugcacaaccaacagaaaauaaaugugua

SEQ ID NO: 276404 - RNA, 64 nt, Homo Sapiens
acagacccgugcaucuuccuuggacggcagccccacugcacauauccgaacacagaacauuguu

SEQ ID NO: 276405 - RNA, 64 nt, Homo Sapiens
acuggggucuaugggugcuucugcagcaagagagacugcacaccauuaguuuuauugaugcuug

SEQ ID NO: 276406 - RNA, 64 nt, Homo Sapiens
uuuuaaggaaaaguaacuuauuugauucaauuauacugcacaugauguauuugcaguuuucucu

SEQ ID NO: 276407 - RNA, 64 nt, Homo Sapiens
aauuuugcaaaugugguuuuuuuacuuggaaauaacugcacauuuauauauaggauauuggacu

SEQ ID NO: 276408 - RNA, 64 nt, Homo Sapiens
gaugguaagaauaguacaaacaccuuagcacaucacugcacacacaguauucugaaaggagauu

SEQ ID NO: 276409 - RNA, 64 nt, Homo Sapiens
gcacaggcacacacauguacgcacacacacaugcacugcacacauauccaugcacacaaacaca

SEQ ID NO: 276410 - RNA, 64 nt, Homo Sapiens
ccuccugacuguccuggaugugcaacugguuugcacugcacaccccacggccauguaacucucc

SEQ ID NO: 276411 - RNA, 64 nt, Homo Sapiens
ggggaccuguguagccccaagagcuucuguggaaacugcacaaugacucucuauggaaaacgag

SEQ ID NO: 276412 - RNA, 64 nt, Homo Sapiens
cgucaugggugaauuugccucuacauccuugaaaacugcacaguuuuuaaaccccaaggaaagc

SEQ ID NO: 276413 - RNA, 64 nt, Homo Sapiens
cuuggcuggagguccaauugccagagccucccacacugcacauacaaaggucugagcccagggc

SEQ ID NO: 276414 - RNA, 64 nt, Homo Sapiens
acaaaggucugagcccagggcagcuucuggggccacugcacaggccaccugcuuggguuccucg

SEQ ID NO: 276415 - RNA, 64 nt, Homo Sapiens
ugauaguguaccaauagagggaccucccuggggcacugcacaaucucuugugagggccauuugg

SEQ ID NO: 276416 - RNA, 64 nt, Homo Sapiens
aggggagugagagagacuaguuuuuaagauaaaaacugcacaaaagaagacuuuuauuuauuuu

SEQ ID NO: 276417 - RNA, 64 nt, Homo Sapiens
uaacuuuuauggacuagaaggaaucacgagggcuacugcacaauacauggccuaaguucccucu

SEQ ID NO: 276418 - RNA, 64 nt, Homo Sapiens
cagaucugaggaugggauuagcgaagcuguggagacugcacauccggaccugcccaugucucaa

SEQ ID NO: 276419 - RNA, 64 nt, Homo Sapiens
gaggugccggaucugugagcugguaggcggugugacugcacagcucaacccccacaccaggugg

SEQ ID NO: 276420 - RNA, 64 nt, Homo Sapiens
ucugccaggggugagguucuaucaggcccgcaggacugcacaaccuggccaugaucuggagagc

SEQ ID NO: 276421 - RNA, 64 nt, Homo Sapiens; identical to SEQ ID NO: 58312

SEQ ID NO: 276422 - RNA, 64 nt, Homo Sapiens; identical to SEQ ID NO: 58313

SEQ ID NO: 276423 - RNA, 64 nt, Homo Sapiens; identical to SEQ ID NO: 58314

SEQ ID NO: 276424 - RNA, 64 nt, Homo Sapiens; identical to SEQ ID NO: 58315

SEQ ID NO: 276425 - RNA, 64 nt, Homo Sapiens; identical to SEQ ID NO: 58316

SEQ ID NO: 276426 - RNA, 64 nt, Homo Sapiens; identical to SEQ ID NO: 58317

SEQ ID NO: 276427 - RNA, 64 nt, Homo Sapiens; identical to SEQ ID NO: 58318

SEQ ID NO: 276428 - RNA, 64 nt, Homo Sapiens; identical to SEQ ID NO: 58319

SEQ ID NO: 276429 - RNA, 64 nt, Homo Sapiens; identical to SEQ ID NO: 58320

SEQ ID NO: 276430 - RNA, 64 nt, Homo Sapiens; identical to SEQ ID NO: 58321

SEQ ID NO: 276431 - RNA, 64 nt, Homo Sapiens; identical to SEQ ID NO: 58322

SEQ ID NO: 276432 - RNA, 64 nt, Homo Sapiens; identical to SEQ ID NO: 58323

SEQ ID NO: 276433 - RNA, 64 nt, Homo Sapiens; identical to SEQ ID NO: 58324

SEQ ID NO: 276434 - RNA, 64 nt, Homo Sapiens; identical to SEQ ID NO: 58325

SEQ ID NO: 276435 - RNA, 64 nt, Homo Sapiens; identical to SEQ ID NO: 58326

SEQ ID NO: 276436 - RNA, 64 nt, Homo Sapiens; identical to SEQ ID NO: 58327

SEQ ID NO: 276437 - RNA, 64 nt, Homo Sapiens; identical to SEQ ID NO: 58328

SEQ ID NO: 276438 - RNA, 64 nt, Homo Sapiens; identical to SEQ ID NO: 58329

SEQ ID NO: 276439 - RNA, 64 nt, Homo Sapiens; identical to SEQ ID NO: 58330

SEQ ID NO: 276440 - RNA, 64 nt, Homo Sapiens; identical to SEQ ID NO: 58331

SEQ ID NO: 276441 - RNA, 64 nt, Homo Sapiens; identical to SEQ ID NO: 58332

SEQ ID NO: 276442 - RNA, 64 nt, Homo Sapiens; identical to SEQ ID NO: 58333

SEQ ID NO: 276443 - RNA, 64 nt, Homo Sapiens; identical to SEQ ID NO: 58334

SEQ ID NO: 276444 - RNA, 64 nt, Homo Sapiens; identical to SEQ ID NO: 58335

SEQ ID NO: 276445 - RNA, 64 nt, Homo Sapiens; identical to SEQ ID NO: 58336

SEQ ID NO: 276446 - RNA, 64 nt, Homo Sapiens; identical to SEQ ID NO: 58337

SEQ ID NO: 276447 - RNA, 64 nt, Homo Sapiens; identical to SEQ ID NO: 58338

SEQ ID NO: 276448 - RNA, 64 nt, Homo Sapiens; identical to SEQ ID NO: 58339

SEQ ID NO: 276449 - RNA, 64 nt, Homo Sapiens; identical to SEQ ID NO: 58340

SEQ ID NO: 276450 - RNA, 64 nt, Homo Sapiens; identical to SEQ ID NO: 58341

SEQ ID NO: 276451 - RNA, 64 nt, Homo Sapiens; identical to SEQ ID NO: 58342

SEQ ID NO: 276452 - RNA, 64 nt, Homo Sapiens; identical to SEQ ID NO: 58343

SEQ ID NO: 276453 - RNA, 64 nt, Homo Sapiens; identical to SEQ ID NO: 58344

SEQ ID NO: 276454 - RNA, 64 nt, Homo Sapiens; identical to SEQ ID NO: 58345

SEQ ID NO: 276455 - RNA, 64 nt, Homo Sapiens; identical to SEQ ID NO: 58346

SEQ ID NO: 276456 - RNA, 64 nt, Homo Sapiens; identical to SEQ ID NO: 58347

SEQ ID NO: 276457 - RNA, 64 nt, Homo Sapiens; identical to SEQ ID NO: 58348

SEQ ID NO: 276458 - RNA, 64 nt, Homo Sapiens; identical to SEQ ID NO: 58349

SEQ ID NO: 276459 - RNA, 64 nt, Homo Sapiens; identical to SEQ ID NO: 58350

SEQ ID NO: 276460 - RNA, 64 nt, Homo Sapiens; identical to SEQ ID NO: 58351

SEQ ID NO: 276461 - RNA, 64 nt, Homo Sapiens; identical to SEQ ID NO: 58352

SEQ ID NO: 276462 - RNA, 64 nt, Homo Sapiens; identical to SEQ ID NO: 58353

SEQ ID NO: 276463 - RNA, 64 nt, Homo Sapiens; identical to SEQ ID NO: 58354

SEQ ID NO: 276464 - RNA, 64 nt, Homo Sapiens; identical to SEQ ID NO: 58355

SEQ ID NO: 276465 - RNA, 64 nt, Homo Sapiens; identical to SEQ ID NO: 58356

SEQ ID NO: 276466 - RNA, 64 nt, Homo Sapiens; identical to SEQ ID NO: 58357

SEQ ID NO: 276467 - RNA, 64 nt, Homo Sapiens; identical to SEQ ID NO: 58358

SEQ ID NO: 276468 - RNA, 64 nt, Homo Sapiens; identical to SEQ ID NO: 58359

SEQ ID NO: 276469 - RNA, 64 nt, Homo Sapiens; identical to SEQ ID NO: 58360

SEQ ID NO: 276470 - RNA, 64 nt, Homo Sapiens; identical to SEQ ID NO: 58361

SEQ ID NO: 276471 - RNA, 64 nt, Homo Sapiens; identical to SEQ ID NO: 58362

SEQ ID NO: 276472 - RNA, 64 nt, Homo Sapiens; identical to SEQ ID NO: 58363

SEQ ID NO: 276473 - RNA, 64 nt, Homo Sapiens; identical to SEQ ID NO: 58364

SEQ ID NO: 276474 - RNA, 64 nt, Homo Sapiens; identical to SEQ ID NO: 58365

SEQ ID NO: 276475 - RNA, 64 nt, Homo Sapiens; identical to SEQ ID NO: 58366

SEQ ID NO: 276476 - RNA, 64 nt, Homo Sapiens; identical to SEQ ID NO: 58367

SEQ ID NO: 276477 - RNA, 64 nt, Homo Sapiens; identical to SEQ ID NO: 58368

SEQ ID NO: 276478 - RNA, 64 nt, Homo Sapiens; identical to SEQ ID NO: 58369

SEQ ID NO: 276479 - RNA, 64 nt, Homo Sapiens; identical to SEQ ID NO: 58370

SEQ ID NO: 276480 - RNA, 64 nt, Homo Sapiens; identical to SEQ ID NO: 58371

SEQ ID NO: 276481 - RNA, 64 nt, Homo Sapiens; identical to SEQ ID NO: 58372

SEQ ID NO: 276482 - RNA, 64 nt, Homo Sapiens; identical to SEQ ID NO: 58373

SEQ ID NO: 276483 - RNA, 64 nt, Homo Sapiens; identical to SEQ ID NO: 58374

SEQ ID NO: 276484 - RNA, 64 nt, Homo Sapiens; identical to SEQ ID NO: 58375

SEQ ID NO: 276485 - RNA, 64 nt, Homo Sapiens; identical to SEQ ID NO: 58376

SEQ ID NO: 276486 - RNA, 64 nt, Homo Sapiens; identical to SEQ ID NO: 58377

SEQ ID NO: 276487 - RNA, 64 nt, Homo Sapiens; identical to SEQ ID NO: 58378

SEQ ID NO: 276488 - RNA, 64 nt, Homo Sapiens; identical to SEQ ID NO: 58379

SEQ ID NO: 276489 - RNA, 64 nt, Homo Sapiens; identical to SEQ ID NO: 58380

SEQ ID NO: 276490 - RNA, 64 nt, Homo Sapiens; identical to SEQ ID NO: 58381

SEQ ID NO: 276491 - RNA, 64 nt, Homo Sapiens; identical to SEQ ID NO: 58382

SEQ ID NO: 276492 - RNA, 64 nt, Homo Sapiens; identical to SEQ ID NO: 58383

SEQ ID NO: 276493 - RNA, 64 nt, Homo Sapiens; identical to SEQ ID NO: 58384

SEQ ID NO: 276494 - RNA, 64 nt, Homo Sapiens; identical to SEQ ID NO: 58385

SEQ ID NO: 276495 - RNA, 64 nt, Homo Sapiens; identical to SEQ ID NO: 58386

SEQ ID NO: 276496 - RNA, 64 nt, Homo Sapiens; identical to SEQ ID NO: 58387

SEQ ID NO: 276497 - RNA, 64 nt, Homo Sapiens; identical to SEQ ID NO: 58388

SEQ ID NO: 276498 - RNA, 64 nt, Homo Sapiens; identical to SEQ ID NO: 58389

SEQ ID NO: 276499 - RNA, 64 nt, Homo Sapiens; identical to SEQ ID NO: 58390

SEQ ID NO: 276500 - RNA, 64 nt, Homo Sapiens; identical to SEQ ID NO: 58391

SEQ ID NO: 276501 - RNA, 64 nt, Homo Sapiens; identical to SEQ ID NO: 58392

SEQ ID NO: 276502 - RNA, 64 nt, Homo Sapiens; identical to SEQ ID NO: 58393

SEQ ID NO: 276503 - RNA, 64 nt, Homo Sapiens; identical to SEQ ID NO: 58394

SEQ ID NO: 276504 - RNA, 64 nt, Homo Sapiens; identical to SEQ ID NO: 58395

SEQ ID NO: 276505 - RNA, 64 nt, Homo Sapiens; identical to SEQ ID NO: 58396

SEQ ID NO: 276506 - RNA, 64 nt, Homo Sapiens; identical to SEQ ID NO: 58397

SEQ ID NO: 276507 - RNA, 64 nt, Homo Sapiens; identical to SEQ ID NO: 58398

SEQ ID NO: 276508 - RNA, 64 nt, Homo Sapiens; identical to SEQ ID NO: 58399

SEQ ID NO: 276509 - RNA, 64 nt, Homo Sapiens; identical to SEQ ID NO: 58400

SEQ ID NO: 276510 - RNA, 64 nt, Homo Sapiens; identical to SEQ ID NO: 58401

SEQ ID NO: 276511 - RNA, 64 nt, Homo Sapiens; identical to SEQ ID NO: 58402

SEQ ID NO: 276512 - RNA, 64 nt, Homo Sapiens; identical to SEQ ID NO: 58403

SEQ ID NO: 276513 - RNA, 64 nt, Homo Sapiens; identical to SEQ ID NO: 58404

SEQ ID NO: 276514 - RNA, 64 nt, Homo Sapiens; identical to SEQ ID NO: 58405

SEQ ID NO: 276515 - RNA, 64 nt, Homo Sapiens; identical to SEQ ID NO: 58406

SEQ ID NO: 276516 - RNA, 64 nt, Homo Sapiens; identical to SEQ ID NO: 58407

SEQ ID NO: 276517 - RNA, 64 nt, Homo Sapiens; identical to SEQ ID NO: 58408

SEQ ID NO: 276518 - RNA, 64 nt, Homo Sapiens; identical to SEQ ID NO: 58409

SEQ ID NO: 276519 - RNA, 64 nt, Homo Sapiens; identical to SEQ ID NO: 58410

SEQ ID NO: 276520 - RNA, 64 nt, Homo Sapiens; identical to SEQ ID NO: 58411

SEQ ID NO: 276521 - RNA, 64 nt, Homo Sapiens; identical to SEQ ID NO: 58412

SEQ ID NO: 276522 - RNA, 64 nt, Homo Sapiens; identical to SEQ ID NO: 58413

SEQ ID NO: 276523 - RNA, 64 nt, Homo Sapiens; identical to SEQ ID NO: 58414

SEQ ID NO: 276524 - RNA, 64 nt, Homo Sapiens; identical to SEQ ID NO: 58415

SEQ ID NO: 276525 - RNA, 64 nt, Homo Sapiens; identical to SEQ ID NO: 58416

SEQ ID NO: 276526 - RNA, 64 nt, Homo Sapiens; identical to SEQ ID NO: 58417

SEQ ID NO: 276527 - RNA, 64 nt, Homo Sapiens; identical to SEQ ID NO: 58418

SEQ ID NO: 276528 - RNA, 64 nt, Homo Sapiens; identical to SEQ ID NO: 58419

SEQ ID NO: 276529 - RNA, 64 nt, Homo Sapiens; identical to SEQ ID NO: 58420

SEQ ID NO: 276530 - RNA, 64 nt, Homo Sapiens; identical to SEQ ID NO: 58421

SEQ ID NO: 276531 - RNA, 64 nt, Homo Sapiens; identical to SEQ ID NO: 58422

SEQ ID NO: 276532 - RNA, 64 nt, Homo Sapiens; identical to SEQ ID NO: 58423

SEQ ID NO: 276533 - RNA, 64 nt, Homo Sapiens; identical to SEQ ID NO: 58424

SEQ ID NO: 276534 - RNA, 64 nt, Homo Sapiens; identical to SEQ ID NO: 58425

SEQ ID NO: 276535 - RNA, 64 nt, Homo Sapiens; identical to SEQ ID NO: 58426

SEQ ID NO: 276536 - RNA, 64 nt, Homo Sapiens; identical to SEQ ID NO: 58427

SEQ ID NO: 276537 - RNA, 64 nt, Homo Sapiens; identical to SEQ ID NO: 58428

SEQ ID NO: 276538 - RNA, 64 nt, Homo Sapiens; identical to SEQ ID NO: 58429

SEQ ID NO: 276539 - RNA, 64 nt, Homo Sapiens; identical to SEQ ID NO: 58430

SEQ ID NO: 276540 - RNA, 64 nt, Homo Sapiens; identical to SEQ ID NO: 58431

SEQ ID NO: 276541 - RNA, 64 nt, Homo Sapiens; identical to SEQ ID NO: 58432

SEQ ID NO: 276542 - RNA, 64 nt, Homo Sapiens; identical to SEQ ID NO: 58433

SEQ ID NO: 276543 - RNA, 64 nt, Homo Sapiens; identical to SEQ ID NO: 58434

SEQ ID NO: 276544 - RNA, 64 nt, Homo Sapiens; identical to SEQ ID NO: 58435

SEQ ID NO: 276545 - RNA, 50 nt, Homo Sapiens; identical to SEQ ID NO: 58436

SEQ ID NO: 276546 - RNA, 64 nt, Homo Sapiens; identical to SEQ ID NO: 58437

SEQ ID NO: 276547 - RNA, 64 nt, Homo Sapiens; identical to SEQ ID NO: 58438

SEQ ID NO: 276548 - RNA, 64 nt, Homo Sapiens; identical to SEQ ID NO: 58439

SEQ ID NO: 276549 - RNA, 64 nt, Homo Sapiens; identical to SEQ ID NO: 58440

SEQ ID NO: 276550 - RNA, 64 nt, Homo Sapiens; identical to SEQ ID NO: 58441

SEQ ID NO: 276551 - RNA, 64 nt, Homo Sapiens; identical to SEQ ID NO: 58442

SEQ ID NO: 276552 - RNA, 64 nt, Homo Sapiens; identical to SEQ ID NO: 58443

SEQ ID NO: 276553 - RNA, 64 nt, Homo Sapiens; identical to SEQ ID NO: 58444

SEQ ID NO: 276554 - RNA, 64 nt, Homo Sapiens; identical to SEQ ID NO: 58445

SEQ ID NO: 276555 - RNA, 64 nt, Homo Sapiens; identical to SEQ ID NO: 58446

SEQ ID NO: 276556 - RNA, 64 nt, Homo Sapiens; identical to SEQ ID NO: 58447

SEQ ID NO: 276557 - RNA, 64 nt, Homo Sapiens; identical to SEQ ID NO: 58448

SEQ ID NO: 276558 - RNA, 64 nt, Homo Sapiens; identical to SEQ ID NO: 58449

SEQ ID NO: 276559 - RNA, 64 nt, Homo Sapiens; identical to SEQ ID NO: 58450

SEQ ID NO: 276560 - RNA, 64 nt, Homo Sapiens; identical to SEQ ID NO: 58451

SEQ ID NO: 276561 - RNA, 64 nt, Homo Sapiens; identical to SEQ ID NO: 58452

SEQ ID NO: 276562 - RNA, 64 nt, Homo Sapiens; identical to SEQ ID NO: 58453

SEQ ID NO: 276563 - RNA, 64 nt, Homo Sapiens; identical to SEQ ID NO: 58454

SEQ ID NO: 276564 - RNA, 64 nt, Homo Sapiens; identical to SEQ ID NO: 58455

SEQ ID NO: 276565 - RNA, 64 nt, Homo Sapiens; identical to SEQ ID NO: 58456

SEQ ID NO: 276566 - RNA, 64 nt, Homo Sapiens; identical to SEQ ID NO: 58457

SEQ ID NO: 276567 - RNA, 64 nt, Homo Sapiens; identical to SEQ ID NO: 58458

SEQ ID NO: 276568 - RNA, 64 nt, Homo Sapiens; identical to SEQ ID NO: 58459

SEQ ID NO: 276569 - RNA, 64 nt, Homo Sapiens; identical to SEQ ID NO: 58460

SEQ ID NO: 276570 - RNA, 64 nt, Homo Sapiens; identical to SEQ ID NO: 58461

SEQ ID NO: 276571 - RNA, 64 nt, Homo Sapiens; identical to SEQ ID NO: 58462

SEQ ID NO: 276572 - RNA, 64 nt, Homo Sapiens; identical to SEQ ID NO: 58463

SEQ ID NO: 276573 - RNA, 64 nt, Homo Sapiens; identical to SEQ ID NO: 58464

SEQ ID NO: 276574 - RNA, 64 nt, Homo Sapiens; identical to SEQ ID NO: 58465

SEQ ID NO: 276575 - RNA, 64 nt, Homo Sapiens; identical to SEQ ID NO: 58466

SEQ ID NO: 276576 - RNA, 64 nt, Homo Sapiens; identical to SEQ ID NO: 58467

SEQ ID NO: 276577 - RNA, 64 nt, Homo Sapiens
gggaucuggggaaggaccaacccaugcccugccaagccuggagccccuguguuggggggcaagg

SEQ ID NO: 276578 - RNA, 64 nt, Homo Sapiens
ccuggagccccuguguuggggggcaaggugggggagccuggagccccugugugggagggcgagg

SEQ ID NO: 276579 - RNA, 64 nt, Homo Sapiens
ccuggagccccugugugggagggcgaggcgggggagccuggagccccugugugggagggcgagg

SEQ ID NO: 276580 - RNA, 64 nt, Homo Sapiens
acauagugagaccuugucucaggaguucaagaccagccuggacaaggaggaucgucuugagccc

SEQ ID NO: 276581 - RNA, 64 nt, Homo Sapiens
acagaguggagacucuguuucaccacuguacuccagccuggauggcuauguugagcugagauca

SEQ ID NO: 276582 - RNA, 64 nt, Homo Sapiens
uuguugcuucucuuugcuaucucaaagguagaagagccuggaguggauccucauugccauggua

SEQ ID NO: 276583 - RNA, 64 nt, Homo Sapiens
gcucacuguuuugggaaacuugggcaggcagaagagccuggauugagcagaaaaggaauugagg

SEQ ID NO: 276584 - RNA, 64 nt, Homo Sapiens
accgugccugcccagcccucaccccugcccuggcagccuggaaggugaaauggaaucucccaga

SEQ ID NO: 276585 - RNA, 64 nt, Homo Sapiens
uaccaccugcggaggccugccccuaggaagcaccagccuggaccgagcccugccucugggagcc

SEQ ID NO: 276586 - RNA, 64 nt, Homo Sapiens
ccucugggcuugacaggucaaaaugguccccaucagccuggagcagcccuccagaccugggugg

SEQ ID NO: 276587 - RNA, 64 nt, Homo Sapiens
gucagggcacaauucccucucauaaaaaccacacagccuggaaauuggcccuggcccuucaaga

SEQ ID NO: 276588 - RNA, 64 nt, Homo Sapiens
cagcacccgaacacaucuuccuccuccccacccgagccuggagcacucuaacccucggagaccc

SEQ ID NO: 276589 - RNA, 64 nt, Homo Sapiens
cuccggaaggggugaguggggaggggcuuuccugagccuggagcugggcuuuggggcagccugc

SEQ ID NO: 276590 - RNA, 64 nt, Homo Sapiens
cacugcuguccuuccugcagugaagaugcccaagagccuggagguguccuuaucuagaaacaug

SEQ ID NO: 276591 - RNA, 64 nt, Homo Sapiens
cugccaucucuagagcagaguccugggaaucaggagccuggacauuuccuuuagcuucccugcu

SEQ ID NO: 276592 - RNA, 64 nt, Homo Sapiens
cagucagggcggggcuggccugggguggaggcuaagccuggacaggggcagauugguucaugcc

SEQ ID NO: 276593 - RNA, 64 nt, Homo Sapiens
acaaaacagcgggaguguggagaaggguuagacaagccuggaggugcugcccgugaggaggggg

SEQ ID NO: 276594 - RNA, 64 nt, Homo Sapiens
acaucauggaugccauggauuaaaaaucaagagaagccuggaagaguuuggcuaaagguuggug

SEQ ID NO: 276595 - RNA, 64 nt, Homo Sapiens
guguucuugucucuagcagcuggccugagcaugcagccuggagagguauggaaggagcaggcac

SEQ ID NO: 276596 - RNA, 64 nt, Homo Sapiens
uguugccauuuaaugcauggauaaacuugcugcaagccuggauacaauuaaccauuuuauauuu

SEQ ID NO: 276597 - RNA, 64 nt, Homo Sapiens
auaagcauguggucagaucauuuugugcauaugcagccuggauuggauguuaaguaaaugcuug

SEQ ID NO: 276598 - RNA, 64 nt, Homo Sapiens
cacucacccccgcugcuucguuaaauuuaccuacagccuggaagaauugucaaccagaaaaugu

SEQ ID NO: 276599 - RNA, 64 nt, Homo Sapiens
auaaaauauccucagcccugaaaagcugcaccacagccuggagaaugcuuugcaaagcacccuc

SEQ ID NO: 276600 - RNA, 64 nt, Homo Sapiens
acagagcaagacuccgucuccgccacugcucuccagccuggacggguugcaugagccgagaugg

SEQ ID NO: 276601 - RNA, 64 nt, Homo Sapiens
aaucaggaaagaccccuuccuagccuggccugucagccuggagggaaaaaagccugcucuccag

SEQ ID NO: 276602 - RNA, 64 nt, Homo Sapiens
uucacucaucccugagaagcagggcugacaccugagccuggauuagagugucauguuuccacaa

SEQ ID NO: 276603 - RNA, 64 nt, Homo Sapiens
aagguggagggugcagaggggaguggguggugggagccuggagcggacgcagguuauuuggggu

SEQ ID NO: 276604 - RNA, 64 nt, Homo Sapiens
ggaaguguggccuguugugugagcccugccucugagccuggacggucuguguccuugagacuug

SEQ ID NO: 276605 - RNA, 64 nt, Homo Sapiens
caacccauuuuccacggucucucuggagccauguagccuggaguagauucauuucuaagacgca

SEQ ID NO: 276606 - RNA, 64 nt, Homo Sapiens
gacuggcugcccccuagagccugccaggagcagaagccuggagggguggcagggcagagcagcc

SEQ ID NO: 276607 - RNA, 64 nt, Homo Sapiens
caccgaggaacacugggcugagcacaugacagggagccuggagccccggggccuccagcgaggc

SEQ ID NO: 276608 - RNA, 64 nt, Homo Sapiens
uaggaucccagaguucagccuccaccucaccuagagccuggaauccuggagcccaggaccuaag

SEQ ID NO: 276609 - RNA, 63 nt, Homo Sapiens
ccaggaccuaaguccaccucaggccccuggccuagccuggagcgcuaccugcugcagcccuga

SEQ ID NO: 276610 - RNA, 64 nt, Homo Sapiens
cacccggcccacgcgugcugcugcagauguggggagccuggaaaaaacacccggcccacgcgug

SEQ ID NO: 276611 - RNA, 64 nt, Homo Sapiens; identical to SEQ ID NO: 276610

SEQ ID NO: 276612 - RNA, 64 nt, Homo Sapiens
cacccggcccacgcgugcugccugugacguggggagccuggaaaccugcgaggcagaguuaaga

SEQ ID NO: 276613 - RNA, 64 nt, Homo Sapiens
agcuggggagaugcgguucacugauucuuggaaaagccuggagaaccaacaggcuacagugucc

SEQ ID NO: 276614 - RNA, 64 nt, Homo Sapiens
aggugauuaaagauacggagagcagcaggaagauagccuggagaagcugcagaggcccagggag

SEQ ID NO: 276615 - RNA, 64 nt, Homo Sapiens
ucaggagcagccucagaacaaagugagacaguccagccuggagaugaaaucuuacagcugggug

SEQ ID NO: 276616 - RNA, 64 nt, Homo Sapiens
guggcacugccaugcagggccucacacgguuugaagccuggaacaucaucaaggcacugccuga

SEQ ID NO: 276617 - RNA, 64 nt, Homo Sapiens
aacacagcugggcaaguauuaauguauauggaacagccuggauuucugcauauggauaagccac

SEQ ID NO: 276618 - RNA, 64 nt, Homo Sapiens
uggauaagccaccuuggaauaggaagagguguugagccuggacugugggaggaaagagcugcgu

SEQ ID NO: 276619 - RNA, 64 nt, Homo Sapiens
aacagugcuuuggaggcucuacuugguuccauggagccuggauauagggcaggcagcugggggc

SEQ ID NO: 276620 - RNA, 64 nt, Homo Sapiens
acugcaggggccaagguggacucagcucacuccgagccuggagaagucaagagcuggaaccucc

SEQ ID NO: 276621 - RNA, 64 nt, Homo Sapiens
acuguugggcauguagacuggacuguggccuugaagccuggaggggcagucucugagugacggu

SEQ ID NO: 276622 - RNA, 64 nt, Homo Sapiens
ccccauggacugaugccuccaagugggacccuccagccuggagaaucuggggacacacuuugga

SEQ ID NO: 276623 - RNA, 64 nt, Homo Sapiens
cgaccccaccucuguuccuaacaaagcgguugugagccuggauccgacucccggcagugcugac

SEQ ID NO: 276624 - RNA, 64 nt, Homo Sapiens
aucugggaguagccccacugccaccugcagccgcagccuggacugcugcccacgagugaaccug

SEQ ID NO: 276625 - RNA, 64 nt, Homo Sapiens
acauggcaaaaccccaucuagauugcuugagcucagccuggacauugggaggccgaggcaggug

SEQ ID NO: 276626 - RNA, 64 nt, Homo Sapiens
acauauagcaagacucugccaggaguuugaaaccagccuggacacaggaagauugcuugagcuc

SEQ ID NO: 276627 - RNA, 64 nt, Homo Sapiens
gcagcaggucagagcaggcgagcugacauucugcagccuggacggccauggcaggaagcuuuua

SEQ ID NO: 276628 - RNA, 64 nt, Homo Sapiens
uuaauaguguaucauguuuucccuguugguauguagccuggauaaaugcucuuaauuauaaaaa

SEQ ID NO: 276629 - RNA, 64 nt, Homo Sapiens
ucagggacuuuugcccacagaaauggagccagagagccuggacacauucuugcacaagucauga

SEQ ID NO: 276630 - RNA, 64 nt, Homo Sapiens
gagaaguugcuugacggaugagaccgcaggacugagccuggagacauggcaauggucuccccac

SEQ ID NO: 276631 - RNA, 64 nt, Homo Sapiens
ggagcccggggagcagggucggggcauugaggcaagccuggagauucucccuagggaugggaag

SEQ ID NO: 276632 - RNA, 64 nt, Homo Sapiens
ugagacuuuggggucucuuacgggggcagcccugagccuggaguuuuuagaguuagugucugug

SEQ ID NO: 276633 - RNA, 64 nt, Homo Sapiens
gagaugaauguuacagaauuggacaacccgaacugcuuuucaaaaccagaggaaggagguucuu

SEQ ID NO: 276634 - RNA, 64 nt, Homo Sapiens
cacagcagaggcucccugaccgggaggccugccugcuuuucagguuguuucccauguucagcgu

SEQ ID NO: 276635 - RNA, 64 nt, Homo Sapiens
guuucauguuugcugugcuuagaaauguaguucagcuuuucaauuuguaauccuaacaaacaaa

SEQ ID NO: 276636 - RNA, 64 nt, Homo Sapiens
caguauugucacagcaugaaaagccaauauaugugcuuuucaacugcaguuuuuaccaagagcu

SEQ ID NO: 276637 - RNA, 64 nt, Homo Sapiens
gcccuucaaauuggaauggaaaggucuugcaguggcuuuucaugacagguuugaauuaggcuaa

SEQ ID NO: 276638 - RNA, 64 nt, Homo Sapiens
gccuguagagacaauacaguuguggcaaauggaggcuuuucacuguaacuggaaggccuuccac

SEQ ID NO: 276639 - RNA, 64 nt, Homo Sapiens
guuuagaccuaaaaccgaacaaucuguauuuuuugcuuuucauguguuuuuguccuagggguuc

SEQ ID NO: 276640 - RNA, 64 nt, Homo Sapiens
uuaugauggucuguaucaaucagcagauuuuauugcuuuucauuauuuuacuguaaaggcaaag

SEQ ID NO: 276641 - RNA, 64 nt, Homo Sapiens
aaccauauuacucucaugauuccaaauuguagaagcuuuucaggucacgugauuaagacccuac

SEQ ID NO: 276642 - RNA, 64 nt, Homo Sapiens
ugauuaagacccuacuccaaaugugaacagcuuugcuuuucacgaugaaaugcagguucacuaa

SEQ ID NO: 276643 - RNA, 64 nt, Homo Sapiens
acaugauaguuuccuaaccuaagauucaauauuagcuuuucauauaaaguucaguuguuuuuaa

SEQ ID NO: 276644 - RNA, 64 nt, Homo Sapiens
aaaucucuagcaaugguaaacguguguaucuacagcuuuucaaauuugauuguuuuaucuccaa

SEQ ID NO: 276645 - RNA, 64 nt, Homo Sapiens
aaauccagaaagcauuuaaguccucaagcugcaugcuuuucacaaguaaaagucaaaccaaacu

SEQ ID NO: 276646 - RNA, 64 nt, Homo Sapiens
uagcagcaaauuaaaguaacauaaagccaaaccugcuuuucauuuaguuuuuacaguaacauga

SEQ ID NO: 276647 - RNA, 64 nt, Homo Sapiens
aauugacuaacuguaaaagauuuugauuuuccuggcuuuucaggauuagccuuaaaauucacaa

SEQ ID NO: 276648 - RNA, 64 nt, Homo Sapiens
uguucuuuguagucccuuuuuccuuugucuucuggcuuuucagcacgucauuguuuauuuuugu

SEQ ID NO: 276649 - RNA, 64 nt, Homo Sapiens
gugcucagauguuucauaauuugaccauaaauuggcuuuucauaggugugagauguaacccacc

SEQ ID NO: 276650 - RNA, 64 nt, Homo Sapiens
acuuuguaucaauccaggcuaagguuggagcagugcuuuucacucuguggaucacgacaggaaa

SEQ ID NO: 276651 - RNA, 64 nt, Homo Sapiens
ggcuuaauucuugcguauaaaauuugacauuauagcuuuucauauguauauuugauuuguugca

SEQ ID NO: 276652 - RNA, 64 nt, Homo Sapiens
uuuguaaauugguuuuauguauuggaccacuacugcuuuucacaauucauguguaauggugaau

SEQ ID NO: 276653 - RNA, 64 nt, Homo Sapiens
uauagaaauguuuuauagugaaagauucaaauuugcuuuucaagaaaaaugccaaaagcuauuu

SEQ ID NO: 276654 - RNA, 64 nt, Homo Sapiens
aggaauuguauaaccagaauuguuccugccuuuagcuuuucagaacuugagauguggcagcacu

SEQ ID NO: 276655 - RNA, 64 nt, Homo Sapiens
aagaucuuguacuguguaacaguaacucuuuuuugcuuuucaguaauuuaauauguucacuuaa

SEQ ID NO: 276656 - RNA, 64 nt, Homo Sapiens
aggggccaggcuuccuggagagcaaguugugggggcuuuucaaggaggcagcucagcucuuagg

SEQ ID NO: 276657 - RNA, 64 nt, Homo Sapiens
ucccuucccugcuguucuaucuguuucuucuacugcuuuucaguuaucagugaggcaucucuga

SEQ ID NO: 276658 - RNA, 64 nt, Homo Sapiens
ccccccacucccguuccguaaaguauauuaauaagcuuuucagcuugcagugugggcuaagaca

SEQ ID NO: 276659 - RNA, 64 nt, Homo Sapiens
guguugugugguuggucucaaacuaguuagugcagcuuuucauuucaucuuaacuaacauucug

SEQ ID NO: 276660 - RNA, 64 nt, Homo Sapiens
cuuuguuuucagaaugcuuuggccuuccuguugugcuuuucagacuucagaugcagugagaccu

SEQ ID NO: 276661 - RNA, 64 nt, Homo Sapiens
aacagggcagagccuggcugguuguucagggguagcuuuucaaacuccagccaucaccgcugug

SEQ ID NO: 276662 - RNA, 64 nt, Homo Sapiens
gguggcugcgugaaagggaggguaaaagcacugugcuuuucagugaguuuacaagaugucuggg

SEQ ID NO: 276663 - RNA, 64 nt, Homo Sapiens
cuuucucucccgaacaucuucuucuuguaaaagugcuuuucaacccuuucuuagcuuauaucuu

SEQ ID NO: 276664 - RNA, 64 nt, Homo Sapiens; identical to SEQ ID NO: 45025

SEQ ID NO: 276665 - RNA, 64 nt, Homo Sapiens; identical to SEQ ID NO: 45026

SEQ ID NO: 276666 - RNA, 64 nt, Homo Sapiens; identical to SEQ ID NO: 45027

SEQ ID NO: 276667 - RNA, 64 nt, Homo Sapiens; identical to SEQ ID NO: 45028

SEQ ID NO: 276668 - RNA, 64 nt, Homo Sapiens; identical to SEQ ID NO: 45029

SEQ ID NO: 276669 - RNA, 64 nt, Homo Sapiens; identical to SEQ ID NO: 45030

SEQ ID NO: 276670 - RNA, 64 nt, Homo Sapiens; identical to SEQ ID NO: 45031

SEQ ID NO: 276671 - RNA, 64 nt, Homo Sapiens; identical to SEQ ID NO: 45032

SEQ ID NO: 276672 - RNA, 64 nt, Homo Sapiens; identical to SEQ ID NO: 45033

SEQ ID NO: 276673 - RNA, 64 nt, Homo Sapiens; identical to SEQ ID NO: 45034

SEQ ID NO: 276674 - RNA, 64 nt, Homo Sapiens; identical to SEQ ID NO: 45035

SEQ ID NO: 276675 - RNA, 64 nt, Homo Sapiens; identical to SEQ ID NO: 45036

SEQ ID NO: 276676 - RNA, 64 nt, Homo Sapiens; identical to SEQ ID NO: 45037

SEQ ID NO: 276677 - RNA, 64 nt, Homo Sapiens; identical to SEQ ID NO: 45038

SEQ ID NO: 276678 - RNA, 64 nt, Homo Sapiens; identical to SEQ ID NO: 45039

SEQ ID NO: 276679 - RNA, 64 nt, Homo Sapiens; identical to SEQ ID NO: 45040

SEQ ID NO: 276680 - RNA, 64 nt, Homo Sapiens; identical to SEQ ID NO: 45041

SEQ ID NO: 276681 - RNA, 64 nt, Homo Sapiens; identical to SEQ ID NO: 45042

SEQ ID NO: 276682 - RNA, 64 nt, Homo Sapiens; identical to SEQ ID NO: 45043

SEQ ID NO: 276683 - RNA, 64 nt, Homo Sapiens; identical to SEQ ID NO: 45044

SEQ ID NO: 276684 - RNA, 64 nt, Homo Sapiens; identical to SEQ ID NO: 45045

SEQ ID NO: 276685 - RNA, 64 nt, Homo Sapiens; identical to SEQ ID NO: 45046

SEQ ID NO: 276686 - RNA, 64 nt, Homo Sapiens; identical to SEQ ID NO: 45047

SEQ ID NO: 276687 - RNA, 64 nt, Homo Sapiens; identical to SEQ ID NO: 45048

SEQ ID NO: 276688 - RNA, 64 nt, Homo Sapiens; identical to SEQ ID NO: 45049

SEQ ID NO: 276689 - RNA, 64 nt, Homo Sapiens; identical to SEQ ID NO: 45050

SEQ ID NO: 276690 - RNA, 64 nt, Homo Sapiens; identical to SEQ ID NO: 45051

SEQ ID NO: 276691 - RNA, 64 nt, Homo Sapiens; identical to SEQ ID NO: 45052

SEQ ID NO: 276692 - RNA, 64 nt, Homo Sapiens; identical to SEQ ID NO: 45053

SEQ ID NO: 276693 - RNA, 64 nt, Homo Sapiens; identical to SEQ ID NO: 45054

SEQ ID NO: 276694 - RNA, 64 nt, Homo Sapiens; identical to SEQ ID NO: 45055

SEQ ID NO: 276695 - RNA, 64 nt, Homo Sapiens; identical to SEQ ID NO: 45056

SEQ ID NO: 276696 - RNA, 64 nt, Homo Sapiens; identical to SEQ ID NO: 45057

SEQ ID NO: 276697 - RNA, 64 nt, Homo Sapiens; identical to SEQ ID NO: 45058

SEQ ID NO: 276698 - RNA, 64 nt, Homo Sapiens; identical to SEQ ID NO: 45059

SEQ ID NO: 276699 - RNA, 64 nt, Homo Sapiens; identical to SEQ ID NO: 45060

SEQ ID NO: 276700 - RNA, 64 nt, Homo Sapiens; identical to SEQ ID NO: 45061

SEQ ID NO: 276701 - RNA, 64 nt, Homo Sapiens; identical to SEQ ID NO: 45062

SEQ ID NO: 276702 - RNA, 64 nt, Homo Sapiens; identical to SEQ ID NO: 45063

SEQ ID NO: 276703 - RNA, 64 nt, Homo Sapiens; identical to SEQ ID NO: 45064

SEQ ID NO: 276704 - RNA, 64 nt, Homo Sapiens; identical to SEQ ID NO: 45065

SEQ ID NO: 276705 - RNA, 64 nt, Homo Sapiens; identical to SEQ ID NO: 45066

SEQ ID NO: 276706 - RNA, 64 nt, Homo Sapiens
cuggcuccaucuuugagagcucuggugggcagggcagaaacaggccacagugcucaacccggac

SEQ ID NO: 276707 - RNA, 64 nt, Homo Sapiens
uggugacucauugccuucacaccacuggguuugccagaaacagggaaggagggcguuaagggaa

SEQ ID NO: 276708 - RNA, 64 nt, Homo Sapiens
gcaaugggaaggagccagaaaugccaucuucacccagaaacaaagaauacugaagccacucaag

SEQ ID NO: 276709 - RNA, 64 nt, Homo Sapiens
uauuauaaauaacccagucucagauauucuguuacagaaacacaaaauggacuaagacaccacc

SEQ ID NO: 276710 - RNA, 64 nt, Homo Sapiens
ccuguggaugguauuguagccagccucacacaagcagaaacacugaacuuuguuauggagggag

SEQ ID NO: 276711 - RNA, 64 nt, Homo Sapiens
ucaagggcuauaauuuaugugcuggcauuguuuacagaaacagaguugccaauaaccugaagaa

SEQ ID NO: 276712 - RNA, 64 nt, Homo Sapiens
auauuuuguggcuuucuuucguaaaaucuuggcacagaaacacacuaacucucccuugcucgcu

SEQ ID NO: 276713 - RNA, 62 nt, Homo Sapiens
ugcaucuggggaacuagaggguucaaaagaaucagaaacaggagccuucuuacauccuuuaa

SEQ ID NO: 276714 - RNA, 64 nt, Homo Sapiens
gaaggauucaccaccuccaggaaaagugucuucucagaaacaaccagcugagaagguaauuaaa

SEQ ID NO: 276715 - RNA, 64 nt, Homo Sapiens
aaaggagggaccaauaucugggacagugucuucucagaaacaaccagcugagaagguaauuaaa

SEQ ID NO: 276716 - RNA, 64 nt, Homo Sapiens
aaagaagggacaacaaucugggacagugucuccucagaaacaaucggccuggaagguaguuacu

SEQ ID NO: 276717 - RNA, 64 nt, Homo Sapiens
aauggguggugggaaaucuggaacagugucuucucagaaacaaccagccucaaagguaauuaaa

SEQ ID NO: 276718 - RNA, 64 nt, Homo Sapiens
aaaggauggacuacagugugggacagugucuucucagaaacaaccagccuugaagguaauuaaa

SEQ ID NO: 276719 - RNA, 64 nt, Homo Sapiens
aaaggauggagaaaaaucugggacagugucuucucagaaacaaccagccuugaagguaauuaaa

SEQ ID NO: 276720 - RNA, 64 nt, Homo Sapiens
ugcaaaugcaguuccuuucauaauaucucagcaccagaaacaaaaauuaagauuaucaaagcau

SEQ ID NO: 276721 - RNA, 64 nt, Homo Sapiens
ugugaagacaacagcagaaaugcuaacaagcgugcagaaacaccagagagugcguauccugcuc

SEQ ID NO: 276722 - RNA, 64 nt, Homo Sapiens
ugcuuacagaccgaaacuggccuucccucacccccagaaacacuaguggucagguuuccccuga

SEQ ID NO: 276723 - RNA, 64 nt, Homo Sapiens
caaagccgccaccacagagcagguacuaagaagacagaaacaagucuuuugaucuuuuucuaga

SEQ ID NO: 276724 - RNA, 64 nt, Homo Sapiens
gacucagaaaaaagguaugaccuuaucugaaggucagaaacauuuacaguauaggcuggaaaga

SEQ ID NO: 276725 - RNA, 64 nt, Homo Sapiens
aaaaucuaucuucccaucucaagcccauccucugcagaaacagaagcaggauaauuaauuugcu

SEQ ID NO: 276726 - RNA, 64 nt, Homo Sapiens
uuacaaguugcuaguuuauaaugucuuacuaaugcagaaacaaggaaaaaagcaaaauuggccu

SEQ ID NO: 276727 - RNA, 64 nt, Homo Sapiens
guuugcaaaagugcuuuuauacauuuucuaauuucagaaacaggauaauuuguuaaguggguuu

SEQ ID NO: 276728 - RNA, 64 nt, Homo Sapiens
guggccaugccuaccuguuuuguuuuuuuaagaacagaaacaacuauuuuaaaagaacucuuuu

SEQ ID NO: 276729 - RNA, 64 nt, Homo Sapiens
augcucacugcuaagcuacaaacucggacagggucagaaacagaggugucccaucccauugcag

SEQ ID NO: 276730 - RNA, 64 nt, Homo Sapiens
uguaugguccuguaaaacuuugccauaaauaauucagaaacacuugguggcagaaacaugcauu

SEQ ID NO: 276731 - RNA, 64 nt, Homo Sapiens
cauuugccauaaauaauucaauguacacugguggcagaaacaugcugcccguguccacacagga

SEQ ID NO: 276732 - RNA, 64 nt, Homo Sapiens
acauuguguaacauguuuuaaaugucuauaugagcagaaacaaagaauaauuuuuaaaucugua

SEQ ID NO: 276733 - RNA, 64 nt, Homo Sapiens
agugaccaauuuaaaaugcugcccuuaccacucccagaaacauaucuaaaacuauuuucucuuu

SEQ ID NO: 276734 - RNA, 64 nt, Homo Sapiens
ccuuagcacuuuaagaaaguauuguaucaugauacagaaacacugacauuaugggagcuucaaa

SEQ ID NO: 276735 - RNA, 64 nt, Homo Sapiens
cuacucugacauuaugggagugaccagagcagcacagaaacaagaggaagauaguaucucagaa

SEQ ID NO: 276736 - RNA, 64 nt, Homo Sapiens
ccucuucuggggcuucagaagcguuuccuucuuucagaaacauucacacaguuggcagcacaua

SEQ ID NO: 276737 - RNA, 64 nt, Homo Sapiens
aaaaccagcuggccuugcagucugucuuuaaugacagaaacacaguguauguguguacacacgc

SEQ ID NO: 276738 - RNA, 64 nt, Homo Sapiens
agguucuauagauuuuuaacuaguccaacacagucagaaacauuguuuugaauccucuguaaac

SEQ ID NO: 276739 - RNA, 64 nt, Homo Sapiens
acccaugccuuaaagaggggcaguuucucaaaagcagaaacaugccgccaguucucaaguuuuc

SEQ ID NO: 276740 - RNA, 64 nt, Homo Sapiens
uucaguccugcuugggaggacgcagcccacugcccagaaacaagaaacacgauaccauucuggc

SEQ ID NO: 276741 - RNA, 64 nt, Homo Sapiens
aggugguguucuauaccuaaaggaugaccugcuccagaaacagcaccagcacagcauguauuuu

SEQ ID NO: 276742 - RNA, 64 nt, Homo Sapiens
agcacagaccucugcuguaggauagagagugaagcagaaacaggguauugagacugaggagaau

SEQ ID NO: 276743 - RNA, 64 nt, Homo Sapiens
acgugauuuaaaagcugagcgucucccaaauuugcagaaacaaauuccaguaagaacucaauuu

SEQ ID NO: 276744 - RNA, 64 nt, Homo Sapiens
aacacaguuauuccaugaagccgcaacuccuccacagaaacacaccaaauuaaaacaaacaaaa

SEQ ID NO: 276745 - RNA, 64 nt, Homo Sapiens
ugagagugcccaucauuuucuuucuaaguauuuccagaaacauuuuuuaaucuuauaagauauu

SEQ ID NO: 276746 - RNA, 64 nt, Homo Sapiens
gaaagacauaugaaaggaauuguaauuggcuuaacagaaacagucuguaaaaaccuaacagugg

SEQ ID NO: 276747 - RNA, 64 nt, Homo Sapiens
accagcaccuaaaaagacucuuuucaaaaaaucacagaaacaaccuaggacaauuauuuguuac

SEQ ID NO: 276748 - RNA, 64 nt, Homo Sapiens
uuaugguugaguuuccauauaaguggaccagacacagaaacaaacagaaugagcuaguaagcga

SEQ ID NO: 276749 - RNA, 64 nt, Homo Sapiens
uuuuucaauuuuauuuuaguucuaaauuauguuucagaaacaaaagacaaugcuguacaguuuu

SEQ ID NO: 276750 - RNA, 64 nt, Homo Sapiens
uuugaaaaauucuuuucaauuccauucauuuguacagaaacauucaugggcagccuggugcaau

SEQ ID NO: 276751 - RNA, 64 nt, Homo Sapiens
aaacuuugacuugacuugcgcgcggauugaaaaacagaaacacaagcccagugccaugacugcc

SEQ ID NO: 276752 - RNA, 64 nt, Homo Sapiens
accgagucccacccccucuggugcauuuccgugucagaaacagucuucagccaggagcuccugg

SEQ ID NO: 276753 - RNA, 64 nt, Homo Sapiens
aagugacucacacaagacccgggaaacugaggcccagaaacagguguagcccaucugagagguu

SEQ ID NO: 276754 - RNA, 64 nt, Homo Sapiens
uacucagucuacugauucaaaugcuaaucucuuccagaaacagccucacagacacacccagaca

SEQ ID NO: 276755 - RNA, 64 nt, Homo Sapiens
auagacaguauuauuacauucaguauuacaauggcagaaacagacagaaaggguggaguaauuu

SEQ ID NO: 276756 - RNA, 64 nt, Homo Sapiens
cugaaauucacaaaguuaaacgugaugugcucaucagaaacaauuucuguguccuguuuuuauu

SEQ ID NO: 276757 - RNA, 64 nt, Homo Sapiens
uuuauucccuucaaugcaaaauacaugaugauuucagaaacaaagcauuugacuuucugucugu

SEQ ID NO: 276758 - RNA, 64 nt, Homo Sapiens
ccauuaucuuguaugugcacauuuuauaaauguacagaaacaucaccaacuuaauuuucuucca

SEQ ID NO: 276759 - RNA, 64 nt, Homo Sapiens
uaugauuuuuaaaagcaguucaaguugacaacagcagaaacaguaacaaaaaaaucugcucaga

SEQ ID NO: 276760 - RNA, 64 nt, Homo Sapiens
ccauuaucuuguaugugcacauuuuauaaauguacagaaacaucaccaacuugauuuucuucca

SEQ ID NO: 276761 - RNA, 64 nt, Homo Sapiens; identical to SEQ ID NO: 276759

SEQ ID NO: 276762 - RNA, 64 nt, Homo Sapiens; identical to SEQ ID NO: 247795

SEQ ID NO: 276763 - RNA, 64 nt, Homo Sapiens; identical to SEQ ID NO: 247796

SEQ ID NO: 276764 - RNA, 64 nt, Homo Sapiens
auaguaccuccaaggaccaggcuaaacuuggcacaguaucaagugauccaugguacaggcuacu

SEQ ID NO: 276765 - RNA, 64 nt, Homo Sapiens
aagggaguuagggcuuaaacaguaauuauacuaaaguaucaagaaggcccugugcaggaccaga

SEQ ID NO: 276766 - RNA, 64 nt, Homo Sapiens
uauagagagacauuugaacuaauauauauauuaaaguaucaaaacauuaauugaauauacuuua

SEQ ID NO: 276767 - RNA, 64 nt, Homo Sapiens
gguagccugagccuaguuagauuuauuuuuaguaaguaucaagauuuuugagaagucugccccu

SEQ ID NO: 276768 - RNA, 64 nt, Homo Sapiens
ucuuccguauucacugaaaaauaaaugcuuguuuaguaucaaauuuuauuucacgaaaguuuuu

SEQ ID NO: 276769 - RNA, 64 nt, Homo Sapiens
ugguuguagugcaugucuuggaguuaaacucuuaaguaucaagaaguaaaauaauuucauuguu

SEQ ID NO: 276770 - RNA, 64 nt, Homo Sapiens
gcagaaaggagaucauuuagcaaagaaggaaaagaguaucaaagugauaggcaaggaugaaaga

SEQ ID NO: 276771 - RNA, 64 nt, Homo Sapiens
cugccuggagaaaggauggcacauuacugccuucaguaucaagguacagugcuuuauggcucua

SEQ ID NO: 276772 - RNA, 64 nt, Homo Sapiens
uuuuucacuuaaagaaaaaauaaaacuguuuuacaguaucaaaaaucuuuuugcauuuauuaug

SEQ ID NO: 276773 - RNA, 64 nt, Homo Sapiens
ucugaaguuuaauuuuuuuagaguaucuacgaagaguaucaaguuguaaaacguguaauaaguu

SEQ ID NO: 276774 - RNA, 64 nt, Homo Sapiens
uacuuuugggcauaaaaauaaaacguaauguagcaguaucaauauacugaacugaacuuucuga

SEQ ID NO: 276775 - RNA, 64 nt, Homo Sapiens
auauccacauucuuuaucagguuaccugggauccaguaucaaauuuuauuuguauucgaucugu

SEQ ID NO: 276776 - RNA, 64 nt, Homo Sapiens
uuuaagauuuuucaucacuaacauauccauuaaaaguaucaacuggccaggcaggguggcucac

SEQ ID NO: 276777 - RNA, 64 nt, Homo Sapiens
gcaagacacugucucaaaaaaaaaaaaaaaaaaaaguaucaaccaacaaauguuaccaagauaa

SEQ ID NO: 276778 - RNA, 64 nt, Homo Sapiens
uccaaguuaccaauuuuuuaaaauuuauaggcaaaguaucaaauugucuucuuaauaugauaaa

SEQ ID NO: 276779 - RNA, 64 nt, Homo Sapiens
uuggggcucuucaguuaaaaaccauaacuccucuaguaucaaaaaagauguguguucacaauag

SEQ ID NO: 276780 - RNA, 64 nt, Homo Sapiens
gggggaaaaugacaaagugaguuaaauuuggcagaguaucaaaauuaaaucauaaauucuugaa

SEQ ID NO: 276781 - RNA, 64 nt, Homo Sapiens
ugguuagauguuguagcaacaucauaaaaucaagaguaucaagaaaauaaaugagcauagcaau

SEQ ID NO: 276782 - RNA, 64 nt, Homo Sapiens
gagaaaaauguguggcaagaugauacagcuacacaguaucaaaugaaugggucaauucagcacc

SEQ ID NO: 276783 - RNA, 64 nt, Homo Sapiens
ccucacgccaggccccguccugccgugacacccuucauccuacccuuggaaccccaaggccaag

SEQ ID NO: 276784 - RNA, 64 nt, Homo Sapiens
gagauaaagcaacagccugcccagaucccucuguucauccuaucccuuccaagguugguccaug

SEQ ID NO: 276785 - RNA, 64 nt, Homo Sapiens
auguguagacaauaaucugcgccaaauaaugaauucauccuagguauguaggaaaaacaaucuu

SEQ ID NO: 276786 - RNA, 64 nt, Homo Sapiens
acuggaaacuuauuucucauaugccucaacuuucucauccuaaauccauaugcaaaaguccugc

SEQ ID NO: 276787 - RNA, 64 nt, Homo Sapiens
uagcugccuggcaaaucccucccuuuucuuucucucauccuacaucccuccacccagaaaacug

SEQ ID NO: 276788 - RNA, 64 nt, Homo Sapiens
acccaaaagagggacaaacacauacauaccuaggucauccuaucaaccucccccaauccauaca

SEQ ID NO: 276789 - RNA, 64 nt, Homo Sapiens
ccuuggcacuguggaacugccauucucuugaaggugcugccaccaaaggcaucuuucugaauuu

SEQ ID NO: 276790 - RNA, 64 nt, Homo Sapiens
cccaccaucggguguaggugaggaaugcugacaaugcugccaugccacuuccugccccaacugc

SEQ ID NO: 276791 - RNA, 64 nt, Homo Sapiens
cugugcugcugaggugcguaguaauguggcucucugcugccacccaguuucuguugcugccaaa

SEQ ID NO: 276792 - RNA, 64 nt, Homo Sapiens
guaauguggcucucugcugcccgccaguuucuguugcugccaaaccauggggcugccgggcugg

SEQ ID NO: 276793 - RNA, 64 nt, Homo Sapiens
acucccagcggggcucccugagcucucaaggagaugcugccaucacugggaggcucagaggacc

SEQ ID NO: 276794 - RNA, 64 nt, Homo Sapiens
gauuuaaugagcgugggccuggaccuuccccagaugcugccaggcagccccuccccaagccuca

SEQ ID NO: 276795 - RNA, 64 nt, Homo Sapiens
ccugccugcugcucccuuuuucugucucuguccaugcugccauguuucucugcugccaaauugg

SEQ ID NO: 276796 - RNA, 64 nt, Homo Sapiens
uuuuucugucucuguccaugcugccauguuucucugcugccaaauugggccccuuggccccuuc

SEQ ID NO: 276797 - RNA, 64 nt, Homo Sapiens
cuggaccccagggacuugccuuccccacccacucugcugccagcaggcccagggaucccugacc

SEQ ID NO: 276798 - RNA, 64 nt, Homo Sapiens
ggccacaguucugggagccuucaacccuggcucaugcugccauagucuccacggugcccuucac

SEQ ID NO: 276799 - RNA, 64 nt, Homo Sapiens
gucuguggcauguuugaccuguggcaggacucgcugcugccaggugagucaccgccuguccugc

SEQ ID NO: 276800 - RNA, 64 nt, Homo Sapiens
augccaucucugucucccugggugccagcagcccugcugccaugugcacugggguggcacugga

SEQ ID NO: 276801 - RNA, 64 nt, Homo Sapiens
ggccugugggcagccgcgccagcugccgggacacugcugccagaccugcccccaggguaagucu

SEQ ID NO: 276802 - RNA, 64 nt, Homo Sapiens
caggcaggccagggcugcgcaucaguggacacauugcugccaggaagagcugcgacggugaggc

SEQ ID NO: 276803 - RNA, 64 nt, Homo Sapiens
uguacaaugguggagugaguucuccgggccucagugcugccaucuucucccaaguuccagagcc

SEQ ID NO: 276804 - RNA, 64 nt, Homo Sapiens
ucucaucuacguggugucgcgcccauggacgaccugcugccacuuugggccgggaguacaagcu

SEQ ID NO: 276805 - RNA, 64 nt, Homo Sapiens
uaaggucacugcuguggcgaccggacagcuuggaugcugccacgcccacagaccuaauauaugu

SEQ ID NO: 276806 - RNA, 64 nt, Homo Sapiens
ucugggcauacagugucuggcacagcuggacggaugcugccacagaagaccuggagggcagcca

SEQ ID NO: 276807 - RNA, 64 nt, Homo Sapiens
gucaugacuugggggugcuacuagaagccaggaaugcugccaaacauucuaccaugcacagcac

SEQ ID NO: 276808 - RNA, 64 nt, Homo Sapiens
cugaaaaugaacuuuuguuucuaaaguuggaccuugcugccaugacuguuuaguuuacagaaac

SEQ ID NO: 276809 - RNA, 64 nt, Homo Sapiens
gggaauacuuuuacuacucagaaaugaauuuaugugcugccauuugcuauaaaguugaacuuug

SEQ ID NO: 276810 - RNA, 64 nt, Homo Sapiens
aucagaaaaccuaccaaacaaaaacaucagaagcugcugccauaaugacuauuuucuacuguag

SEQ ID NO: 276811 - RNA, 64 nt, Homo Sapiens
guuggcucugauuugaaaucgggagaaacagagcugcugccaaugggaucuuuuagguaacucc

SEQ ID NO: 276812 - RNA, 64 nt, Homo Sapiens
cuagcuuccgugugucugugcagugcccaugagcugcugccaaugggaucuuucagguaccccc

SEQ ID NO: 276813 - RNA, 64 nt, Homo Sapiens
gggaucgcccugcuggcugccggcaccgcccuccugcugccagagacgaggcaggcacagcugc

SEQ ID NO: 276814 - RNA, 64 nt, Homo Sapiens
ugggaguaucgaacccucugccuagggccggaguugcugccaguacccgcucccucugcucauc

SEQ ID NO: 276815 - RNA, 64 nt, Homo Sapiens
gcccguaccgccaacucgggucacaccugaacgcugcugccagccgaugccccagcccugcacg

SEQ ID NO: 276816 - RNA, 64 nt, Homo Sapiens
cucgccacaccuacuggggcaucuggcuggugccugcugccauggccagcccccacucucaccc

SEQ ID NO: 276817 - RNA, 64 nt, Homo Sapiens
ucucccuucuuuaccuucauuucauccuguuggcugcugccaccaaaucugucuagaauccugc

SEQ ID NO: 276818 - RNA, 64 nt, Homo Sapiens
ucaauaaauauuuguuugggugguuugugagccuugcugccaaguccugccuuugggucgacau

SEQ ID NO: 276819 - RNA, 64 nt, Homo Sapiens
guggaguggguaauccaggcuuucuaaccuugaaugcugccaguaauugugcugccauuugauu

SEQ ID NO: 276820 - RNA, 64 nt, Homo Sapiens
ugauuuuucuaaccuugaaucugcugaccaauugugcugccauuaaauuccagaagaagagaag

SEQ ID NO: 276821 - RNA, 64 nt, Homo Sapiens
cugccauccucccacuugcagugcaggaucccacugcugccaaagagaugggacaaggaaccuc

SEQ ID NO: 276822 - RNA, 64 nt, Homo Sapiens
cccagaccuggacuccaaggccggccugcgcacuugcugccaccagaaacuggaggacaugauc

SEQ ID NO: 276823 - RNA, 64 nt, Homo Sapiens
gacagagaaaggggcuguggugcuuguugguugaugcugccauguaagcuggacuccugggacu

SEQ ID NO: 276824 - RNA, 64 nt, Homo Sapiens
uucaacagcgcucaugucucuuggcccagucaggugcugccagguuuagauaggaaaguacaug

SEQ ID NO: 276825 - RNA, 64 nt, Homo Sapiens
agaugcuuccaugguccguggcucaguucucuggugcugccaaauaaugccugaccuuugagau

SEQ ID NO: 276826 - RNA, 64 nt, Homo Sapiens
uagauagaaaaagaagcaugaacagaagaacucaugcugccagauggucaacccacgcagaaga

SEQ ID NO: 276827 - RNA, 64 nt, Homo Sapiens
agaucugaacuaaugcuaacgcauuaguuucuguugcugccaacuguucaaagucuacuagcuc

SEQ ID NO: 276828 - RNA, 64 nt, Homo Sapiens
gccugugacuuucuaaccugaaaggcucucugccugcugccaagaagcucuucacuaugacagu

SEQ ID NO: 276829 - RNA, 64 nt, Homo Sapiens
uucuaaaggcuugauauuuuaguccgcuuucucuugcugccacacaaacuccccguuccugcgu

SEQ ID NO: 276830 - RNA, 64 nt, Homo Sapiens
gcaagcuggcgugugccagggcucgagucccacgugcugccaacucaaacauagccuccuuccc

SEQ ID NO: 276831 - RNA, 64 nt, Homo Sapiens
cccggcuccccuaaagguagaagauacucgagcaugcugccaggggagcuggauggugaaacac

SEQ ID NO: 276832 - RNA, 64 nt, Homo Sapiens
cacagccuaauuuucuggagaaauccauccacucugcugccauucugugccuguuaugaaugaa

SEQ ID NO: 276833 - RNA, 64 nt, Homo Sapiens
caucacagagcccuucuugguuaauuaugguaccugcugccacuugccuuuucagcugcacuau

SEQ ID NO: 276834 - RNA, 64 nt, Homo Sapiens
ugaugggccaagggaaggcuaucagagacccuggugcugccaccugccccuacucaagugucua

SEQ ID NO: 276835 - RNA, 64 nt, Homo Sapiens
uaagggagggccuggggagccccacccuagcccuugcugccacaccacauugccucaacaaccg

SEQ ID NO: 276836 - RNA, 64 nt, Homo Sapiens
gaaacguggugucaucugaugcauuuggaccauaugcugccagacugcagaacgggggagccgg

SEQ ID NO: 276837 - RNA, 64 nt, Homo Sapiens
cagccuagcgaugccgcuggccagaccgugaccaugcugccagugugcucgccaugagcugggu

SEQ ID NO: 276838 - RNA, 64 nt, Homo Sapiens
uccaugucagggaagucgcugguccugcuugaacugcugccaacucagucuccuuggugauuaa

SEQ ID NO: 276839 - RNA, 64 nt, Homo Sapiens
uuagcuauugggagcaaucuugaaaaaugccugcugcugccaagaaaggucuauggcucauguc

SEQ ID NO: 276840 - RNA, 64 nt, Homo Sapiens
accacaaccugucucccaguccugcucucaccccugcugccacacacaugcccugagcagccag

SEQ ID NO: 276841 - RNA, 64 nt, Homo Sapiens
uucugcacuagggcucugugcuggaacccaggcaugcugccagccuuuucucuggaucugucag

SEQ ID NO: 276842 - RNA, 64 nt, Homo Sapiens
ccaugugcugccgcccaaccgcugccgccccaacugcugccagacuccugcugcaucuccaguu

SEQ ID NO: 276843 - RNA, 64 nt, Homo Sapiens
cuuccugcaguaucucuagcauugcauuuccagcugcugccagccaccugcugccaccccagcu

SEQ ID NO: 276844 - RNA, 64 nt, Homo Sapiens
ccagcuauugcauuuccagcgcuacaggaccaccugcugccacccaucugcuggcaaaccaccu

SEQ ID NO: 276845 - RNA, 64 nt, Homo Sapiens
gccacugugcugaggcccugcagugucugcucacugcugccaucuucgcugcuagucaggguuc

SEQ ID NO: 276846 - RNA, 64 nt, Homo Sapiens
ugauuccuguguggggagaagcucaguggccguuugcugccacugacaaggauuucacaugcag

SEQ ID NO: 276847 - RNA, 64 nt, Homo Sapiens
cccucuccccacugccccaagcuggcguaaacccugcugccagggacggaaaacagaccucggg

SEQ ID NO: 276848 - RNA, 64 nt, Homo Sapiens
agccaaaacaaagucuuuuuuggauuuugccaagugcugccaguacaguaaccaaacacauaca

SEQ ID NO: 276849 - RNA, 64 nt, Homo Sapiens
agagccuacugcugcucuccacucaacuggccucugcugccaggccacugccugucucugcuuc

SEQ ID NO: 276850 - RNA, 64 nt, Homo Sapiens
ucugagccucccuggagaagguauuuuauaugucugcugccagcugcuggucuccacacccuca

SEQ ID NO: 276851 - RNA, 64 nt, Homo Sapiens
agguuggggugguuaagucucacaggggcccuccugcugccagccuggggagaugcugccagca

SEQ ID NO: 276852 - RNA, 64 nt, Homo Sapiens
acacaggggcccuccugcugguguccuggggagaugcugccagcgugggugcaggugagccggc

SEQ ID NO: 276853 - RNA, 64 nt, Homo Sapiens
ucacauccacucaccacaucuucccagagaacuaugcugccacuccugcugccaggcuuacauc

SEQ ID NO: 276854 - RNA, 64 nt, Homo Sapiens
cuuacaucuucccagagaacgcugccaccugcccugcugccaggagaccacccauagcccugcu

SEQ ID NO: 276855 - RNA, 64 nt, Homo Sapiens
ugcccugcugccaggcuuacacccauagcccugcugcugccaccuguuacaaacugcgcagacc

SEQ ID NO: 276856 - RNA, 64 nt, Homo Sapiens
aacugucaaguguguguuguugucccaugugagcugcugccauguccagaaacacccacaggca

SEQ ID NO: 276857 - RNA, 64 nt, Homo Sapiens
accagccccacccuguuuuggcccuuuguccuccugcugccagucaguccccagaacucugccu

SEQ ID NO: 276858 - RNA, 63 nt, Homo Sapiens
gaguuaaugaaacagacacugugaauaaaauggaaauugcauugaguagaggauacaagugau

SEQ ID NO: 276859 - RNA, 63 nt, Homo Sapiens
guccauaaguaaaguuuuauuuauaugaaauucaaauugcaguuauuuugugucacaugaaaa

SEQ ID NO: 276860 - RNA, 63 nt, Homo Sapiens
cauauaaauaaguguuuuuguacugaaaaaugcaaauugcaauggucugaggaugauguagau

SEQ ID NO: 276861 - RNA, 63 nt, Homo Sapiens
cagaggggcacgucugggcaaggcagagacugaaaauugcagagccucccucaaaggaccugc

SEQ ID NO: 276862 - RNA, 63 nt, Homo Sapiens
uguucuccuacaagcaaccuugagaaacugaucaaauugcacuuuaucagcucaguagagcag

SEQ ID NO: 276863 - RNA, 63 nt, Homo Sapiens
ugcauauuugucuauuuuuuuuggaaaagcuguaaauugcaugagugaagcacaaggauuaag

SEQ ID NO: 276864 - RNA, 63 nt, Homo Sapiens
uugugcaacagaaccauuaacuucuaaugugguaaauugcacaugcaauuuuacuuugucuag

SEQ ID NO: 276865 - RNA, 63 nt, Homo Sapiens
gacuucuuaaagaaguuugaucuucuccaaaguaaauugcaugucaaauaucuugcuuuuggg

SEQ ID NO: 276866 - RNA, 63 nt, Homo Sapiens
uaguuaacuuuucaucauguuauaguaauuuagaaauugcaaacugucacauguuucuguuuc

SEQ ID NO: 276867 - RNA, 63 nt, Homo Sapiens
ccccagcauaaauggguuaguuuuucacacaaaaaauugcaacaagucauugccaaggucuga

SEQ ID NO: 276868 - RNA, 63 nt, Homo Sapiens
cugcaguucuggaccauguggagcuacauggagaaauugcacagacagaaucacuuugccaca

SEQ ID NO: 276869 - RNA, 63 nt, Homo Sapiens
gcccucccuccaggguagagaugcaccgaauggaaauugcacuaaggaccucuuccuuugcug

SEQ ID NO: 276870 - RNA, 63 nt, Homo Sapiens
aagcgaucaagaauccagauucuauaacaaaucaaauugcacuuuuggaagcccggugucaug

SEQ ID NO: 276871 - RNA, 63 nt, Homo Sapiens
acauaacaaaaaguguugcuguaaauccaaaagaaauugcaucuaagggacuuuguugaacuu

SEQ ID NO: 276872 - RNA, 63 nt, Homo Sapiens
uauaaaauuaugagauugguuuuccuguggcauaaauugcaucacuguaucauuuucuuuuuu

SEQ ID NO: 276873 - RNA, 63 nt, Homo Sapiens
uugccucugaaaaguguguauauauuuugugugaaauugcauacuuuguauuuugauuauuuu

SEQ ID NO: 276874 - RNA, 63 nt, Homo Sapiens
auuuggcaaucuucauauaauaaaauaguguucaaauugcaaacuuuaaggacauucaaaguu

SEQ ID NO: 276875 - RNA, 63 nt, Homo Sapiens
ugauuugauaauuaagcaccugacagacaaguaaaauugcaggucauaucuagguauccauug

SEQ ID NO: 276876 - RNA, 63 nt, Homo Sapiens
aaaggcucaauauccaagagcuaauggacaaucaaauugcagaccguguuguaaagauaccca

SEQ ID NO: 276877 - RNA, 63 nt, Homo Sapiens
auuuucuaauuucaagucuuggaugagccacagaaauugcauaaucuguuaccaguaggagga

SEQ ID NO: 276878 - RNA, 63 nt, Homo Sapiens
auguaauauaucaaagucagaauugauugccagaaauugcaagaauuuugucuauugucuuag

SEQ ID NO: 276879 - RNA, 63 nt, Homo Sapiens
gauaagaauagguugauacauguccugaugucuaaauugcaguaauuguaagcuauuuuuuuu

SEQ ID NO: 276880 - RNA, 63 nt, Homo Sapiens
cugaggauaaauaauaaaacucagucaucagguaaauugcaaguaagucaacaaaaugcaaua

SEQ ID NO: 276881 - RNA, 63 nt, Homo Sapiens
uuuaaacucacgauaccaguuaucuguuaaucaaaauugcauuuuacaauuuaauaaugugau

SEQ ID NO: 276882 - RNA, 63 nt, Homo Sapiens
auuggccaauuaucuuuaauaauuuaccuuuugaaauugcauguuuaucauauauccuuaagu

SEQ ID NO: 276883 - RNA, 63 nt, Homo Sapiens
uuuuuuuuuuuaaacaguaacauccagagugacaaauugcaggagauuuaauguauaaaauuu

SEQ ID NO: 276884 - RNA, 63 nt, Homo Sapiens
uccauuccauuauuacaagugaugaaaaacaaaaaauugcaaguaguaugcaaauuauaaaua

SEQ ID NO: 276885 - RNA, 63 nt, Homo Sapiens
gucaacucuugacaguugccucaagauggagugaaauugcaucgaggguaagacuguguccac

SEQ ID NO: 276886 - RNA, 63 nt, Homo Sapiens
cuuugggauaauuccuauccuuuucagggaggcaaauugcacgugaguuuaaguaugaaggca

SEQ ID NO: 276887 - RNA, 63 nt, Homo Sapiens
agugaucauaaugagguuuguuuuaggugacugaaauugcaucauuaauagucaugguucgua

SEQ ID NO: 276888 - RNA, 63 nt, Homo Sapiens
uauguauauagacaugcacaugucaccucccugaaauugcauacaugaccucucagaauaagg

SEQ ID NO: 276889 - RNA, 63 nt, Homo Sapiens
aauaggcucugcuaacgugaugaaauccuuucuaaauugcaugccuuuugguuugggcuguau

SEQ ID NO: 276890 - RNA, 63 nt, Homo Sapiens
gagagguugauaugcaccugaagauacagauguaaauugcaugaaaccaguuucucauugcau

SEQ ID NO: 276891 - RNA, 63 nt, Homo Sapiens
uucagauguuuacuacgaggcacacugaaugugaaauugcaugaccuaugacacuucuuauuc

SEQ ID NO: 276892 - RNA, 63 nt, Homo Sapiens
uaaaccacuuucuaauuuuugaggaauccauguaaauugcaaaauacuaaaccucacaaagua

SEQ ID NO: 276893 - RNA, 63 nt, Homo Sapiens
acauuucaauuauacuaaacguaauguuccugaaaauugcaaucaccuaauaucaauuuguag

SEQ ID NO: 276894 - RNA, 63 nt, Homo Sapiens
guaaucccagcuacucaggaggcugaggcaggaaaauugcaugaaccuaaguggcagagguug

SEQ ID NO: 276895 - RNA, 63 nt, Homo Sapiens
auauuuacauauuuugcuguaguauuugaguauaaauugcagauacuauaacacaucacaucu

SEQ ID NO: 276896 - RNA, 63 nt, Homo Sapiens
uuuuaaaauuuauuuuugacaaaaccccaaaguaaauugcaaaauuagcaaaauuauuaauuu

SEQ ID NO: 276897 - RNA, 63 nt, Homo Sapiens
agauuagcaaaauuauuaauuaaggacauuuuaaaauugcaugcagcccuuaaaauuuuagcu

SEQ ID NO: 276898 - RNA, 63 nt, Homo Sapiens
guuucauggauuuuucaucuucuaccguaugugaaauugcaaguguuugaagauuuauaagua

SEQ ID NO: 276899 - RNA, 63 nt, Homo Sapiens
aggugccacucaguuuuagccaugucuucacugaaauugcaaaaguacuuuuagggagcagga

SEQ ID NO: 276900 - RNA, 63 nt, Homo Sapiens
cuaaaucaccuggaaggagagcauuacucaccaaaauugcaaaacaaggguaucaagaauuug

SEQ ID NO: 276901 - RNA, 63 nt, Homo Sapiens
uauuggauauaaugcugcuuuuuagagacaccuaaauugcaguaucagaaugaauguugaugu

SEQ ID NO: 276902 - RNA, 64 nt, Homo Sapiens
accugguauuccaucaccauucaccccaggggacagccucgaccgagacaaggaggcccuuaaa

SEQ ID NO: 276903 - RNA, 64 nt, Homo Sapiens
gccccagaaagagccuaagcuauguucagauagaagccucgaaauuccuguaaauuguuuacuu

SEQ ID NO: 276904 - RNA, 64 nt, Homo Sapiens
uguucuaugucaauuugcucuugccgaaaagaugagccucgauuuuaaaaucuauccacaucca

SEQ ID NO: 276905 - RNA, 64 nt, Homo Sapiens
agagucaaggccaagucugcagggaccuguugaaagccucgagaaugucuuggcugcccaagac

SEQ ID NO: 276906 - RNA, 64 nt, Homo Sapiens
cugucccugcugaaaauagcagccauccccagugagccucgacuggggccucaguguccucuga

SEQ ID NO: 276907 - RNA, 64 nt, Homo Sapiens
gccuugugcuuuggucucuugcccuuucugugccagccucgaucaguccuugcaagaaggauca

SEQ ID NO: 276908 - RNA, 64 nt, Homo Sapiens
ugccuucuucagggccuggugcugcagagucacaagccucgaggauccauccagcuugccagau

SEQ ID NO: 276909 - RNA, 64 nt, Homo Sapiens
guaccacugcacuccagccucagagguugcagugagccucgauuaaucccuugagcccaggaag

SEQ ID NO: 276910 - RNA, 64 nt, Homo Sapiens
uccuggagacccccaggugggaaccucagaggccagccucgacuccccaucuugcuuuucugug

SEQ ID NO: 276911 - RNA, 64 nt, Homo Sapiens
cagggcuugaaagaagccaguucaaaaacugaugagccucgaucugcaggcuucuagacggagu

SEQ ID NO: 276912 - RNA, 64 nt, Homo Sapiens
accccauagcacuggcccagggcugagcagggugagccucgaaauguggguccccugagacgaa

SEQ ID NO: 276913 - RNA, 64 nt, Homo Sapiens
aaguugcccuuaccuccuaggggggugcuucugcagccucgaaaagauggggcuuuguggcccu

SEQ ID NO: 276914 - RNA, 64 nt, Homo Sapiens
cuuucucgguaaccacggcaacagcaggauagggagccucgacuucuguguagcaccauucacc

SEQ ID NO: 276915 - RNA, 64 nt, Homo Sapiens
gcuggagugcaguggugccaucauagcucacuguagccucgaccuuccgggaucaagcaauccc

SEQ ID NO: 276916 - RNA, 64 nt, Homo Sapiens
gcuggaauacaguggcaugauuucaguucacugcagccucgaccucccaggcucaagugauccu

SEQ ID NO: 276917 - RNA, 64 nt, Homo Sapiens
guggcuauucgcaguuguaaucauagcacacugcagccucgaauuucugggcuugagcaguccu

SEQ ID NO: 276918 - RNA, 64 nt, Homo Sapiens
cuuggcgcggccugauacugggaugagaggcugcagccucgacaacucaggaggggaaggguca

SEQ ID NO: 276919 - RNA, 64 nt, Homo Sapiens
agguaaugaauuaaagaagagauacugugcccagagccucgaggaaguacuucuugauaccugg

SEQ ID NO: 276920 - RNA, 64 nt, Homo Sapiens
gauggagugcaguggugagaucacggcucauugcagccucgaccucccaggugauccucccacc

SEQ ID NO: 276921 - RNA, 64 nt, Homo Sapiens
uucuugcuuuugacucacagcuggaaguuagaaaagccucgauuucaucuuuggagaggccaaa

SEQ ID NO: 276922 - RNA, 64 nt, Homo Sapiens
uucuuuguaaaauuuauuuuuuacaugcugaauuagccucgaucuuuuugauuaagagcacaaa

SEQ ID NO: 276923 - RNA, 64 nt, Homo Sapiens
aaaacagcaguggccaguccuaaaucaccuggagagccucgaaauuccaauccuggcuggccuc

SEQ ID NO: 276924 - RNA, 64 nt, Homo Sapiens
cagggacaugcagggcucacaccccugcauccccagccucgaccaggcccuguccuccccacgu

SEQ ID NO: 276925 - RNA, 64 nt, Homo Sapiens
ccgcgucccugggggcugggucgggaguacuuagagccucgaaccccgccaaccgcugccuuuc

SEQ ID NO: 276926 - RNA, 64 nt, Homo Sapiens
aaagcccuggagggaaucacacaggucacccaggagccucgagggauucuccagccauggucag

SEQ ID NO: 276927 - RNA, 64 nt, Homo Sapiens
gcccuuguauaguguccccaugggcucccacugcagccucgagugccccugucccaccuggcuc

SEQ ID NO: 276928 - RNA, 64 nt, Homo Sapiens
gcuggagugcagugaugcaaucacggcucacugcagccucgaccuccccagcucaagcaauccu

SEQ ID NO: 276929 - RNA, 64 nt, Homo Sapiens
uccuccucugugaaacugggcuacuuaacuugguagccucgaugggcugugaaaccaggacaag

SEQ ID NO: 276930 - RNA, 64 nt, Homo Sapiens
uucccugguaaacuuuuaaaaagaguucuuuaugagccucgaugggagagaugggugaagacaa

SEQ ID NO: 276931 - RNA, 64 nt, Homo Sapiens
ugugaaguugguuacgggggaggccuguguauggagccucgagaugcgccaccucccagaaagc

SEQ ID NO: 276932 - RNA, 64 nt, Homo Sapiens
cagaguggacuguucccugaccacucaggcccaaagccucgacaagggucuugguuccagccug

SEQ ID NO: 276933 - RNA, 64 nt, Homo Sapiens
uauauuucuguuuguggugacagcagcuggcuacagccucgauuaagacugccaaggacaugac

SEQ ID NO: 276934 - RNA, 64 nt, Homo Sapiens
ucccaggcuccagugacucucaaucuugcacugcagccucgacccagugcaauccugcaauucu

SEQ ID NO: 276935 - RNA, 64 nt, Homo Sapiens
ugcugcucaagccagucuggcaagcacucagcccagccucgagguccuucuggggagaguguaa

SEQ ID NO: 276936 - RNA, 64 nt, Homo Sapiens
gcuacagugcaguggugugaucacagcucacugcagccucgacuucccaggcucaagugauccu

SEQ ID NO: 276937 - RNA, 64 nt, Homo Sapiens
uccggcgccgccgcccucucgccaaugcugagggagccucgacuagagcagaagcuagggcaga

SEQ ID NO: 276938 - RNA, 64 nt, Homo Sapiens
ucccuggcuugagugauccuucccagcucacugcagccucgaccgcuggagugaagugguguga

SEQ ID NO: 276939 - RNA, 64 nt, Homo Sapiens
caccaggcagcagccuugcuucugcgaccacagcagccucgaaagagccaaggcgaggcggcug

SEQ ID NO: 276940 - RNA, 64 nt, Homo Sapiens
gggccccuccuccuccguucccggugagaggcggagccucgagcggcuguagccgaggccgcag

SEQ ID NO: 276941 - RNA, 64 nt, Homo Sapiens
gagacacuggggcagucugcagcagcugucccccagccucgaugccgcugucuccagugggggc

SEQ ID NO: 276942 - RNA, 56 nt, Homo Sapiens
ucagugcgcuccagcugaucacacaaagccucgaaaaggggccuagggcgaaauga

SEQ ID NO: 276943 - RNA, 64 nt, Homo Sapiens
cuccaucucccaucagugcugugggcuggcugcaagccucgaaacaguucuccuggaagggagg

SEQ ID NO: 276944 - RNA, 64 nt, Homo Sapiens
gcuggagugcaguggcacgauuauggcucauugcagccucgacuucucggggccaagcgauccu

SEQ ID NO: 276945 - RNA, 64 nt, Homo Sapiens
cugcaacggucuucuugugcuagaacucaggcucagccucgaauuccacagacgaaguacuuuc

SEQ ID NO: 276946 - RNA, 64 nt, Homo Sapiens
agagcugcgggaacaccgagaccccccguccuucagccucgaccugggugcaggcaucccgggc

SEQ ID NO: 276947 - RNA, 64 nt, Homo Sapiens
aucaagaaauacuuucgaaauaauucauaaccauagccucgaucuguguaagguauauguuuua

SEQ ID NO: 276948 - RNA, 64 nt, Homo Sapiens
gcuugagugcaguggugcgaucacagcccagugcagccucgaccaccugugcucaagcaauccu

SEQ ID NO: 276949 - RNA, 64 nt, Homo Sapiens
uacucuaagacuggcuaaacaaccuugaucauugagccucgagccaugggagagaugcugacca

SEQ ID NO: 276950 - RNA, 64 nt, Homo Sapiens
agugggcucuggaaucccuucggggucuuuccucagccucgaaacgcgcugugcaaagcgcucu

SEQ ID NO: 276951 - RNA, 64 nt, Homo Sapiens
gucaucucugguuauuuguucagcacguguguagagccucgauccagcauguccuacggaaacc

SEQ ID NO: 276952 - RNA, 64 nt, Homo Sapiens
gacuuggaggccaaaccuuaaauccagagauagcagccucgauagggaccuuaaaaggauucac

SEQ ID NO: 276953 - RNA, 64 nt, Homo Sapiens
ccugccaggcucucccucucugcaccugucucauagccucgaauaucuuaauuccuuaggcuua

SEQ ID NO: 276954 - RNA, 64 nt, Homo Sapiens
accaacagccaccuuccagggauggggggccugaagccucgaugcuugucuccugauccuuauu

SEQ ID NO: 276955 - RNA, 64 nt, Homo Sapiens
agggcgggacugggccgcccagccccuugacuccagccucgaccgccaggccccaggccagagc

SEQ ID NO: 276956 - RNA, 64 nt, Homo Sapiens
gcucugcggcguagugcccuggcagugugcugagagccucgaaugccgcauuuucacgcuggcu

SEQ ID NO: 276957 - RNA, 64 nt, Homo Sapiens
ccugggguggcaucccggccucaagaccucuaacagccucgaagguuugugugugugugugcac

SEQ ID NO: 276958 - RNA, 64 nt, Homo Sapiens
uguagccacccucaggccuggcaggcaccuugcaagccucgagcggccucaacccagggguggc

SEQ ID NO: 276959 - RNA, 64 nt, Homo Sapiens
cccccccaacccccgcaccaauggccgcuucuagagccucgacauguguaccacuucugugggc

SEQ ID NO: 276960 - RNA, 64 nt, Homo Sapiens
cccugggcucaaguguuccuucauagcucacugcagccucgaaugcgggaauacagugccauga

SEQ ID NO: 276961 - RNA, 57 nt, Homo Sapiens
ucuccuguuucucuuccugaguccagaagccucgaggcagcugcccggaccuccuaa

SEQ ID NO: 276962 - RNA, 64 nt, Homo Sapiens
uccugggcuuaagcgauccuucauaguuugcugcagccucgaccguuggagugcaguugcagga

SEQ ID NO: 276963 - RNA, 64 nt, Homo Sapiens
gagcuuuagacagcagagcacaagcauccucagaagccucgacuaccuccugacaacgucucuu

SEQ ID NO: 276964 - RNA, 64 nt, Homo Sapiens
cauaucgcuguaggguccugcccuccggaggagcagccucgaggcuggugguuuucagagcagg

SEQ ID NO: 276965 - RNA, 64 nt, Homo Sapiens
ccacugcucagaaagcuuccauucugcuguccucagccucgacccucuucugugcuggacuucc

SEQ ID NO: 276966 - RNA, 64 nt, Homo Sapiens
gcuggagugcgguggugcgaucauagcucacugcagccucgaacucuugggcuucaagcaaucc

SEQ ID NO: 276967 - RNA, 64 nt, Homo Sapiens
ccccucccugccagagucugucuuggccagugccagccucgaugcuuugguuuugaccccaccu

SEQ ID NO: 276968 - RNA, 64 nt, Homo Sapiens
gcuggagugcaguggugcgaucauggcucacugcagccucgaacuccugggcucaagcaauccu

SEQ ID NO: 276969 - RNA, 64 nt, Homo Sapiens
cccacuacuccuucuccuucuagaugguaaccacagccucgaccaugccugcucccucugaccc

SEQ ID NO: 276970 - RNA, 64 nt, Homo Sapiens
gcagcacacacacccuaccuuccacgcgcugcgcagccucgaccagcagauguaccucuguuac

SEQ ID NO: 276971 - RNA, 64 nt, Homo Sapiens
gacagacugcacaccuguuguugggagguggcucagccucgaagcccuggaguuguucaggcug

SEQ ID NO: 276972 - RNA, 64 nt, Homo Sapiens
uccuggucucaagcaguccuucuuggcucacuacagccucgaacgcuagagugcaguggugcag

SEQ ID NO: 276973 - RNA, 64 nt, Homo Sapiens
uccugagcucaaaggauccuucauggcucacugcagccucgagcgcuggaguacaguggcacaa

SEQ ID NO: 276974 - RNA, 64 nt, Homo Sapiens
ugcagcggugcaaucaugagucaaugcagccuccagccucgaccucccgaggcucaggugaucc

SEQ ID NO: 276975 - RNA, 64 nt, Homo Sapiens
gcaggacugugggguguucgcacccccagacgucagccucgaaggccccgagguguuugugcuu

SEQ ID NO: 276976 - RNA, 64 nt, Homo Sapiens
ucccaaggccuaagcaauccacacugcucacugcagccucgaccgcuggaguacaauggcacaa

SEQ ID NO: 276977 - RNA, 64 nt, Homo Sapiens
uugcccccucgucccucuccggggugccccugugagccucgaccggaagggggcauuuggcuag

SEQ ID NO: 276978 - RNA, 64 nt, Homo Sapiens
agagaccuccccacugauggcuaggacuccagggagccucgacccuagggcugauccucaagua

SEQ ID NO: 276979 - RNA, 64 nt, Homo Sapiens
uggccugcgccccgccagcugcccgcagaggugcagccucgaggaaucugagggcgucggggca

SEQ ID NO: 276980 - RNA, 64 nt, Homo Sapiens
guccuguugcugugagggagugcuggccgcaggcagccucgagucaccgccaggcucacaggcu

SEQ ID NO: 276981 - RNA, 64 nt, Homo Sapiens
uccugggcuuaagggauccuucauaacucauugcagccucgaacgcuugagggcaguggugcaa

SEQ ID NO: 276982 - RNA, 64 nt, Homo Sapiens
cccaggccccagcccaggcagggauggguggcucagccucgaauuggaggugcugggcccuccu

SEQ ID NO: 276983 - RNA, 64 nt, Homo Sapiens
ggugagugggugaggccgagccugcugcguguggagccucgagugggcccuggcugccacuacc

SEQ ID NO: 276984 - RNA, 64 nt, Homo Sapiens
agccccaggggccaccgcggcucuccccuuccccagccucgaagccaugggggcccccucgcca

SEQ ID NO: 276985 - RNA, 64 nt, Homo Sapiens
ggucagcugccugcaugacuuuucuggaaggcagagccucgaaaauaggcagaccguuugagcc

SEQ ID NO: 276986 - RNA, 64 nt, Homo Sapiens
cuggcccucucucugaucaugccagguuugcaccagccucgagucucccauguuguaguacauu

SEQ ID NO: 276987 - RNA, 64 nt, Homo Sapiens
aggaauuuugaacauuuccuucuucaguaucugcagccucgaccuggucacuuuauuuccauag

SEQ ID NO: 276988 - RNA, 64 nt, Homo Sapiens
ccggaagucucaaggugccuggggaacccuggagagccucgacucagaaaaugauugaugggcu

SEQ ID NO: 276989 - RNA, 63 nt, Homo Sapiens
ggcuauuuguucuuuggaaugacugcuccacuccacacucacaccucuauucacagaccagca

SEQ ID NO: 276990 - RNA, 63 nt, Homo Sapiens
cuaaagagaaagaauacuugacagcucuaugcccacacucacauuacagcugaugugaaagag

SEQ ID NO: 276991 - RNA, 63 nt, Homo Sapiens
agcuuaaccaagagugagaggauaugucauguucacacucaaugcaauucguagugguuuucu

SEQ ID NO: 276992 - RNA, 63 nt, Homo Sapiens
aaugcaccuagggaaaaaauuuaaggagguauucacacucagggucaugcacuugcacaaugu

SEQ ID NO: 276993 - RNA, 63 nt, Homo Sapiens
caugcacacacacacacacacacaauuuaugugcacacucacaaacuauaaugcacacucaca

SEQ ID NO: 276994 - RNA, 63 nt, Homo Sapiens
cacaauuuaugugcacacucagaaacuauaaugcacacucacacuaaaccaagagagaaagca

SEQ ID NO: 276995 - RNA, 63 nt, Homo Sapiens
agaauauuuauaacuuuuguaugagagagaauucacacucaacaagacacuaccagcaccacg

SEQ ID NO: 276996 - RNA, 63 nt, Homo Sapiens
uuugcuggugguggcuucgggcucaugcccagacacacucacugccccgucuguccaaggccu

SEQ ID NO: 276997 - RNA, 63 nt, Homo Sapiens
aaauuacauuacaagauccagguucuucccccccacacucaaucaagccagcccucuccucuu

SEQ ID NO: 276998 - RNA, 63 nt, Homo Sapiens
ccucuccucuucugucacguaaaggauauuuggcacacucaugcgucauucauucacaaaaca

SEQ ID NO: 276999 - RNA, 63 nt, Homo Sapiens
cgccccgacugcacccgguggacacacucauuacacacucacaugcucacauggacgcggacg

SEQ ID NO: 277000 - RNA, 63 nt, Homo Sapiens
acacacucacacgccccgacggacgcggacggacacacucauuccccgucugcaugcucacau

SEQ ID NO: 277001 - RNA, 63 nt, Homo Sapiens
aggacaggcuugucugccaguggaugaggucgucacacucagagcccccgccugugucaggug

SEQ ID NO: 277002 - RNA, 63 nt, Homo Sapiens
ggccucacugugcugggggcacagaccacaagccacacucagaauuaacaacucuaacccagg

SEQ ID NO: 277003 - RNA, 63 nt, Homo Sapiens
ucuaugagaauguggauuuauggcauugaguaucacacucagcucugcuguguuaacuuugug

SEQ ID NO: 277004 - RNA, 63 nt, Homo Sapiens
uaucuguacaguugugcaagauaugaaugguuucacacucaaauaaaaaauauugaaacgacc

SEQ ID NO: 277005 - RNA, 63 nt, Homo Sapiens
cucccuugucugaugccccagcacacacacacucacacucacagcuucugauacacagccacu

SEQ ID NO: 277006 - RNA, 63 nt, Homo Sapiens
cucacacucccuugucugaugccacugcacacacacacucacacugguugcuucugauacaca

SEQ ID NO: 277007 - RNA, 63 nt, Homo Sapiens
cacaugcauacacuuagguuacucaugcacacacacacucacaucguacaugcacaaauacac

SEQ ID NO: 277008 - RNA, 63 nt, Homo Sapiens
cacacacacacucacacacaacaugcacaaauacacacucauggagugaucuuacucccucgu

SEQ ID NO: 277009 - RNA, 63 nt, Homo Sapiens
uacacacacacacacacacuucacacacacacucacacucacagcccuaacuuuuaauguaca

SEQ ID NO: 277010 - RNA, 63 nt, Homo Sapiens
cucacauacacacacacacauguacaucacacacacacucacaugcccagcccuaacuuuuaa

SEQ ID NO: 277011 - RNA, 63 nt, Homo Sapiens
guuucaaauuggaaccuugaggcuaguuaguaucacacucaggccacacucagcacuugccca

SEQ ID NO: 277012 - RNA, 63 nt, Homo Sapiens
gaaccuugaggcuaguuaguaucacacucaggccacacucagcacuugcccacucuuguuuac

SEQ ID NO: 277013 - RNA, 63 nt, Homo Sapiens
accgugccucacagggcccacguuccuggcgggcacacucaggugugggcacuaacacgugug

SEQ ID NO: 277014 - RNA, 63 nt, Homo Sapiens
uucucaugggcaggcucagggugcgcagguuugcacacucaaguggagucuguucucacaccu

SEQ ID NO: 277015 - RNA, 64 nt, Homo Sapiens; identical to SEQ ID NO: 189281

SEQ ID NO: 277016 - RNA, 64 nt, Homo Sapiens; identical to SEQ ID NO: 189282

SEQ ID NO: 277017 - RNA, 64 nt, Homo Sapiens; identical to SEQ ID NO: 189283

SEQ ID NO: 277018 - RNA, 64 nt, Homo Sapiens; identical to SEQ ID NO: 189284

SEQ ID NO: 277019 - RNA, 64 nt, Homo Sapiens; identical to SEQ ID NO: 189285

SEQ ID NO: 277020 - RNA, 64 nt, Homo Sapiens; identical to SEQ ID NO: 189286

SEQ ID NO: 277021 - RNA, 64 nt, Homo Sapiens; identical to SEQ ID NO: 189287

SEQ ID NO: 277022 - RNA, 64 nt, Homo Sapiens; identical to SEQ ID NO: 189288

SEQ ID NO: 277023 - RNA, 64 nt, Homo Sapiens; identical to SEQ ID NO: 189289

SEQ ID NO: 277024 - RNA, 64 nt, Homo Sapiens; identical to SEQ ID NO: 189290

SEQ ID NO: 277025 - RNA, 64 nt, Homo Sapiens; identical to SEQ ID NO: 189291

SEQ ID NO: 277026 - RNA, 64 nt, Homo Sapiens; identical to SEQ ID NO: 189292

SEQ ID NO: 277027 - RNA, 64 nt, Homo Sapiens; identical to SEQ ID NO: 189293

SEQ ID NO: 277028 - RNA, 64 nt, Homo Sapiens; identical to SEQ ID NO: 189294

SEQ ID NO: 277029 - RNA, 64 nt, Homo Sapiens; identical to SEQ ID NO: 189295

SEQ ID NO: 277030 - RNA, 64 nt, Homo Sapiens; identical to SEQ ID NO: 189296

SEQ ID NO: 277031 - RNA, 64 nt, Homo Sapiens; identical to SEQ ID NO: 189297

SEQ ID NO: 277032 - RNA, 64 nt, Homo Sapiens; identical to SEQ ID NO: 189298

SEQ ID NO: 277033 - RNA, 64 nt, Homo Sapiens; identical to SEQ ID NO: 189299

SEQ ID NO: 277034 - RNA, 64 nt, Homo Sapiens; identical to SEQ ID NO: 189300

SEQ ID NO: 277035 - RNA, 64 nt, Homo Sapiens; identical to SEQ ID NO: 189301

SEQ ID NO: 277036 - RNA, 64 nt, Homo Sapiens; identical to SEQ ID NO: 189302

SEQ ID NO: 277037 - RNA, 64 nt, Homo Sapiens; identical to SEQ ID NO: 189303

SEQ ID NO: 277038 - RNA, 64 nt, Homo Sapiens; identical to SEQ ID NO: 189304

SEQ ID NO: 277039 - RNA, 64 nt, Homo Sapiens; identical to SEQ ID NO: 189305

SEQ ID NO: 277040 - RNA, 64 nt, Homo Sapiens; identical to SEQ ID NO: 189306

SEQ ID NO: 277041 - RNA, 64 nt, Homo Sapiens; identical to SEQ ID NO: 189307

SEQ ID NO: 277042 - RNA, 64 nt, Homo Sapiens; identical to SEQ ID NO: 189308

SEQ ID NO: 277043 - RNA, 64 nt, Homo Sapiens; identical to SEQ ID NO: 189309

SEQ ID NO: 277044 - RNA, 64 nt, Homo Sapiens; identical to SEQ ID NO: 189310

SEQ ID NO: 277045 - RNA, 64 nt, Homo Sapiens; identical to SEQ ID NO: 189311

SEQ ID NO: 277046 - RNA, 64 nt, Homo Sapiens; identical to SEQ ID NO: 189312

SEQ ID NO: 277047 - RNA, 64 nt, Homo Sapiens; identical to SEQ ID NO: 189313

SEQ ID NO: 277048 - RNA, 64 nt, Homo Sapiens; identical to SEQ ID NO: 189314

SEQ ID NO: 277049 - RNA, 64 nt, Homo Sapiens; identical to SEQ ID NO: 189315

SEQ ID NO: 277050 - RNA, 64 nt, Homo Sapiens; identical to SEQ ID NO: 189316

SEQ ID NO: 277051 - RNA, 64 nt, Homo Sapiens; identical to SEQ ID NO: 189317

SEQ ID NO: 277052 - RNA, 64 nt, Homo Sapiens; identical to SEQ ID NO: 189318

SEQ ID NO: 277053 - RNA, 64 nt, Homo Sapiens; identical to SEQ ID NO: 189319

SEQ ID NO: 277054 - RNA, 50 nt, Homo Sapiens; identical to SEQ ID NO: 189320

SEQ ID NO: 277055 - RNA, 64 nt, Homo Sapiens; identical to SEQ ID NO: 189321

SEQ ID NO: 277056 - RNA, 64 nt, Homo Sapiens; identical to SEQ ID NO: 189322

SEQ ID NO: 277057 - RNA, 64 nt, Homo Sapiens; identical to SEQ ID NO: 189323

SEQ ID NO: 277058 - RNA, 61 nt, Homo Sapiens; identical to SEQ ID NO: 260215

SEQ ID NO: 277059 - RNA, 64 nt, Homo Sapiens; identical to SEQ ID NO: 260216

SEQ ID NO: 277060 - RNA, 57 nt, Homo Sapiens; identical to SEQ ID NO: 260217

SEQ ID NO: 277061 - RNA, 64 nt, Homo Sapiens; identical to SEQ ID NO: 260218

SEQ ID NO: 277062 - RNA, 64 nt, Homo Sapiens; identical to SEQ ID NO: 260219

SEQ ID NO: 277063 - RNA, 64 nt, Homo Sapiens; identical to SEQ ID NO: 260220

SEQ ID NO: 277064 - RNA, 64 nt, Homo Sapiens; identical to SEQ ID NO: 260221

SEQ ID NO: 277065 - RNA, 64 nt, Homo Sapiens; identical to SEQ ID NO: 260222

SEQ ID NO: 277066 - RNA, 64 nt, Homo Sapiens; identical to SEQ ID NO: 260223

SEQ ID NO: 277067 - RNA, 64 nt, Homo Sapiens; identical to SEQ ID NO: 260224

SEQ ID NO: 277068 - RNA, 64 nt, Homo Sapiens; identical to SEQ ID NO: 260225

SEQ ID NO: 277069 - RNA, 64 nt, Homo Sapiens; identical to SEQ ID NO: 260226

SEQ ID NO: 277070 - RNA, 64 nt, Homo Sapiens; identical to SEQ ID NO: 260227

SEQ ID NO: 277071 - RNA, 64 nt, Homo Sapiens; identical to SEQ ID NO: 260228

SEQ ID NO: 277072 - RNA, 64 nt, Homo Sapiens; identical to SEQ ID NO: 260229

SEQ ID NO: 277073 - RNA, 64 nt, Homo Sapiens; identical to SEQ ID NO: 260230

SEQ ID NO: 277074 - RNA, 64 nt, Homo Sapiens; identical to SEQ ID NO: 260231

SEQ ID NO: 277075 - RNA, 64 nt, Homo Sapiens; identical to SEQ ID NO: 260232

SEQ ID NO: 277076 - RNA, 64 nt, Homo Sapiens; identical to SEQ ID NO: 260233

SEQ ID NO: 277077 - RNA, 64 nt, Homo Sapiens; identical to SEQ ID NO: 260234

SEQ ID NO: 277078 - RNA, 64 nt, Homo Sapiens; identical to SEQ ID NO: 260235

SEQ ID NO: 277079 - RNA, 64 nt, Homo Sapiens; identical to SEQ ID NO: 260236

SEQ ID NO: 277080 - RNA, 64 nt, Homo Sapiens; identical to SEQ ID NO: 260237

SEQ ID NO: 277081 - RNA, 64 nt, Homo Sapiens; identical to SEQ ID NO: 260238

SEQ ID NO: 277082 - RNA, 64 nt, Homo Sapiens; identical to SEQ ID NO: 260239

SEQ ID NO: 277083 - RNA, 64 nt, Homo Sapiens; identical to SEQ ID NO: 260240

SEQ ID NO: 277084 - RNA, 64 nt, Homo Sapiens; identical to SEQ ID NO: 260241

SEQ ID NO: 277085 - RNA, 64 nt, Homo Sapiens; identical to SEQ ID NO: 260242

SEQ ID NO: 277086 - RNA, 64 nt, Homo Sapiens; identical to SEQ ID NO: 260243

SEQ ID NO: 277087 - RNA, 64 nt, Homo Sapiens; identical to SEQ ID NO: 260244

SEQ ID NO: 277088 - RNA, 64 nt, Homo Sapiens; identical to SEQ ID NO: 260245

SEQ ID NO: 277089 - RNA, 64 nt, Homo Sapiens; identical to SEQ ID NO: 260246

SEQ ID NO: 277090 - RNA, 64 nt, Homo Sapiens; identical to SEQ ID NO: 260247

SEQ ID NO: 277091 - RNA, 64 nt, Homo Sapiens; identical to SEQ ID NO: 260248

SEQ ID NO: 277092 - RNA, 64 nt, Homo Sapiens; identical to SEQ ID NO: 260249

SEQ ID NO: 277093 - RNA, 64 nt, Homo Sapiens; identical to SEQ ID NO: 260250

SEQ ID NO: 277094 - RNA, 64 nt, Homo Sapiens; identical to SEQ ID NO: 260251

SEQ ID NO: 277095 - RNA, 64 nt, Homo Sapiens; identical to SEQ ID NO: 260252

SEQ ID NO: 277096 - RNA, 64 nt, Homo Sapiens; identical to SEQ ID NO: 260253

SEQ ID NO: 277097 - RNA, 64 nt, Homo Sapiens; identical to SEQ ID NO: 260254

SEQ ID NO: 277098 - RNA, 64 nt, Homo Sapiens; identical to SEQ ID NO: 260255

SEQ ID NO: 277099 - RNA, 64 nt, Homo Sapiens; identical to SEQ ID NO: 260256

SEQ ID NO: 277100 - RNA, 64 nt, Homo Sapiens; identical to SEQ ID NO: 260257

SEQ ID NO: 277101 - RNA, 64 nt, Homo Sapiens; identical to SEQ ID NO: 260258

SEQ ID NO: 277102 - RNA, 64 nt, Homo Sapiens; identical to SEQ ID NO: 260259

SEQ ID NO: 277103 - RNA, 64 nt, Homo Sapiens; identical to SEQ ID NO: 260260

SEQ ID NO: 277104 - RNA, 64 nt, Homo Sapiens; identical to SEQ ID NO: 260261

SEQ ID NO: 277105 - RNA, 64 nt, Homo Sapiens; identical to SEQ ID NO: 260262

SEQ ID NO: 277106 - RNA, 64 nt, Homo Sapiens; identical to SEQ ID NO: 260263

SEQ ID NO: 277107 - RNA, 64 nt, Homo Sapiens
cuagagcauauuuuggaaauguucuaaaccuuucuaagcucagaugcauuuuugcaugacuaug

SEQ ID NO: 277108 - RNA, 64 nt, Homo Sapiens
cacaguuccuacauacguuucaguucuuucaugguaagcucaauggacuuugaauuguuuacag

SEQ ID NO: 277109 - RNA, 64 nt, Homo Sapiens
gaaguacucaguaauacaguacaguauucaguaaggcagugaaguacucaguaauacaauacag

SEQ ID NO: 277110 - RNA, 64 nt, Homo Sapiens
gcagugcucaauaaggcagugcagugcucaguaaggcagugaauugcuuaguaacacaguguag

SEQ ID NO: 277111 - RNA, 64 nt, Homo Sapiens
augggcgcacugccuaacauaaaaaaaaguaauuggcagugacucuccgucucaaaaaaaaaaa

SEQ ID NO: 277112 - RNA, 64 nt, Homo Sapiens
ggccaggcgcaguggcucacguucaaaaguaauuggcagugauuaauuacauaugauguucucu

SEQ ID NO: 277113 - RNA, 64 nt, Homo Sapiens
guagaaaauacgaaauauauaauugugcacaucuggcagugacuuaaacaaaagcaucugaaau

SEQ ID NO: 277114 - RNA, 64 nt, Homo Sapiens
cuccugguuaacugaauaauacuugguucuguuuggcagugaugcaaagaaguauguaauuguc

SEQ ID NO: 277115 - RNA, 64 nt, Homo Sapiens
ccaaccccagguucccuacacccugcucucagcaggcagugagugucacacaccuguuaaucca

SEQ ID NO: 277116 - RNA, 64 nt, Homo Sapiens
gaggugggagaaucuccugagccuggaagguccaggcagugagccaagauugugccaccacacu

SEQ ID NO: 277117 - RNA, 64 nt, Homo Sapiens
agguauguguuugcuuuugcuuggucgugcguauggcagugagcuuugaauauuccagaugugu

SEQ ID NO: 277118 - RNA, 64 nt, Homo Sapiens
uuuaauauuauuaaauccagagagagaugacuauggcagugauguacccaaauaucguuuacac

SEQ ID NO: 277119 - RNA, 64 nt, Homo Sapiens
gagagcuggaaaggggcaaccaugggacuuugggggcagugagaccucacuauucucaccaggc

SEQ ID NO: 277120 - RNA, 64 nt, Homo Sapiens
agggauugccaugccccaguagcauguagauuugggcagugaacgaaugcugccaucuggugac

SEQ ID NO: 277121 - RNA, 64 nt, Homo Sapiens
aauuugccagggaacaguggcaggcugcuagcaaggcagugagaagcucuuggcagccaaaugg

SEQ ID NO: 277122 - RNA, 64 nt, Homo Sapiens
uauuuauuguauauccuaaauauauuucuccuuuggcagugacuagauuuccacuaaugugucu

SEQ ID NO: 277123 - RNA, 64 nt, Homo Sapiens
aguaaaaagaucagugauuuccaggagcugcaagggcagugagaggaagggagggaugaggagg

SEQ ID NO: 277124 - RNA, 64 nt, Homo Sapiens
gagggaugaggagguggagugcaggggauguuagggcagugaaagguucuguaugacacuguga

SEQ ID NO: 277125 - RNA, 64 nt, Homo Sapiens
uguagccuggcccuggaacucauucccccuaagaggcagugagauuugaucucacacaccaggg

SEQ ID NO: 277126 - RNA, 64 nt, Homo Sapiens
agacuggcaggcagcagaaagagggcuaaacaagggcagugagauuaugacucuuaacauuaga

SEQ ID NO: 277127 - RNA, 64 nt, Homo Sapiens
ugccaaagugacacagagcagaggcccagaaagaggcagugauuggaauuugaagaaaggaacu

SEQ ID NO: 277128 - RNA, 64 nt, Homo Sapiens; identical to SEQ ID NO: 277107

SEQ ID NO: 277129 - RNA, 64 nt, Homo Sapiens; identical to SEQ ID NO: 277108

SEQ ID NO: 277130 - RNA, 64 nt, Homo Sapiens; identical to SEQ ID NO: 277109

SEQ ID NO: 277131 - RNA, 64 nt, Homo Sapiens; identical to SEQ ID NO: 277110

SEQ ID NO: 277132 - RNA, 64 nt, Homo Sapiens; identical to SEQ ID NO: 277111

SEQ ID NO: 277133 - RNA, 64 nt, Homo Sapiens; identical to SEQ ID NO: 277112

SEQ ID NO: 277134 - RNA, 64 nt, Homo Sapiens; identical to SEQ ID NO: 277113

SEQ ID NO: 277135 - RNA, 64 nt, Homo Sapiens; identical to SEQ ID NO: 277114

SEQ ID NO: 277136 - RNA, 64 nt, Homo Sapiens; identical to SEQ ID NO: 277115

SEQ ID NO: 277137 - RNA, 64 nt, Homo Sapiens; identical to SEQ ID NO: 277116

SEQ ID NO: 277138 - RNA, 64 nt, Homo Sapiens; identical to SEQ ID NO: 277117

SEQ ID NO: 277139 - RNA, 64 nt, Homo Sapiens; identical to SEQ ID NO: 277118

SEQ ID NO: 277140 - RNA, 64 nt, Homo Sapiens; identical to SEQ ID NO: 277119

SEQ ID NO: 277141 - RNA, 64 nt, Homo Sapiens; identical to SEQ ID NO: 277120

SEQ ID NO: 277142 - RNA, 64 nt, Homo Sapiens; identical to SEQ ID NO: 277121

SEQ ID NO: 277143 - RNA, 64 nt, Homo Sapiens; identical to SEQ ID NO: 277122

SEQ ID NO: 277144 - RNA, 64 nt, Homo Sapiens; identical to SEQ ID NO: 277123

SEQ ID NO: 277145 - RNA, 64 nt, Homo Sapiens; identical to SEQ ID NO: 277124

SEQ ID NO: 277146 - RNA, 64 nt, Homo Sapiens; identical to SEQ ID NO: 277125

SEQ ID NO: 277147 - RNA, 64 nt, Homo Sapiens; identical to SEQ ID NO: 277126

SEQ ID NO: 277148 - RNA, 64 nt, Homo Sapiens; identical to SEQ ID NO: 277127

SEQ ID NO: 277149 - RNA, 64 nt, Homo Sapiens; identical to SEQ ID NO: 277107

SEQ ID NO: 277150 - RNA, 64 nt, Homo Sapiens; identical to SEQ ID NO: 277108

SEQ ID NO: 277151 - RNA, 64 nt, Homo Sapiens; identical to SEQ ID NO: 277109

SEQ ID NO: 277152 - RNA, 64 nt, Homo Sapiens; identical to SEQ ID NO: 277110

SEQ ID NO: 277153 - RNA, 64 nt, Homo Sapiens; identical to SEQ ID NO: 277111

SEQ ID NO: 277154 - RNA, 64 nt, Homo Sapiens; identical to SEQ ID NO: 277112

SEQ ID NO: 277155 - RNA, 64 nt, Homo Sapiens; identical to SEQ ID NO: 277113

SEQ ID NO: 277156 - RNA, 64 nt, Homo Sapiens; identical to SEQ ID NO: 277114

SEQ ID NO: 277157 - RNA, 64 nt, Homo Sapiens; identical to SEQ ID NO: 277115

SEQ ID NO: 277158 - RNA, 64 nt, Homo Sapiens; identical to SEQ ID NO: 277116

SEQ ID NO: 277159 - RNA, 64 nt, Homo Sapiens; identical to SEQ ID NO: 277117

SEQ ID NO: 277160 - RNA, 64 nt, Homo Sapiens; identical to SEQ ID NO: 277118

SEQ ID NO: 277161 - RNA, 64 nt, Homo Sapiens; identical to SEQ ID NO: 277119

SEQ ID NO: 277162 - RNA, 64 nt, Homo Sapiens; identical to SEQ ID NO: 277120

SEQ ID NO: 277163 - RNA, 64 nt, Homo Sapiens; identical to SEQ ID NO: 277121

SEQ ID NO: 277164 - RNA, 64 nt, Homo Sapiens; identical to SEQ ID NO: 277122

SEQ ID NO: 277165 - RNA, 64 nt, Homo Sapiens; identical to SEQ ID NO: 277123

SEQ ID NO: 277166 - RNA, 64 nt, Homo Sapiens; identical to SEQ ID NO: 277124

SEQ ID NO: 277167 - RNA, 64 nt, Homo Sapiens; identical to SEQ ID NO: 277125

SEQ ID NO: 277168 - RNA, 64 nt, Homo Sapiens; identical to SEQ ID NO: 277126

SEQ ID NO: 277169 - RNA, 64 nt, Homo Sapiens; identical to SEQ ID NO: 277127

SEQ ID NO: 277170 - RNA, 64 nt, Homo Sapiens
gcacuuggcucgugcauuugagaacugaaauuuugaugcuuacagugugugugccuaguguaaa

SEQ ID NO: 277171 - RNA, 64 nt, Homo Sapiens
aaacacuuguuaguuuucccuacaauguugcaaugaugcuuaaauuuacuuaaauuaucaggaa

SEQ ID NO: 277172 - RNA, 64 nt, Homo Sapiens
uuguuguaucuuggggacuuuuacuuuguuguuugaugcuuaaacuucaaaauucucuguauuc

SEQ ID NO: 277173 - RNA, 64 nt, Homo Sapiens
accagucuuaaauuauucaugauucaauaaaauugaugcuuauuuauucagauuagugguuugg

SEQ ID NO: 277174 - RNA, 64 nt, Homo Sapiens
uuuuuaggcugucacccuugacccaaacuuucuggaugcuuauaucaauuuaggaaaugucuug

SEQ ID NO: 277175 - RNA, 64 nt, Homo Sapiens
ccgcacggcucugaaacuuaagccugauuuuccugaugcuuauuguaacuuggcucauugccug

SEQ ID NO: 277176 - RNA, 64 nt, Homo Sapiens
uuucuggagcagaagauuccacuucuuugguccucaucuuuacuuaaaaagcucuuauagaaag

SEQ ID NO: 277177 - RNA, 64 nt, Homo Sapiens
guccauugaggccucauguaaaauucccauuuuucaucuuuacacuccuuuucuccccucauuu

SEQ ID NO: 277178 - RNA, 64 nt, Homo Sapiens
aucuuaguucugacuucucaaaucugguaaauggcaucuuuaccguucuaacauggucucaguu

SEQ ID NO: 277179 - RNA, 64 nt, Homo Sapiens
gcugagauccuugggaacacaagaagaagucuuucaucuuuacuuucaugaagcacagaagaua

SEQ ID NO: 277180 - RNA, 64 nt, Homo Sapiens
uucuugcuuauguaagaaguacauauuagucugccaucuuuaaaaaaaaauacaguauuuucau

SEQ ID NO: 277181 - RNA, 64 nt, Homo Sapiens
gaugagccccaguguucuugccuccuacuauucacaucuuuaugugguccccuccaaugcugaa

SEQ ID NO: 277182 - RNA, 64 nt, Homo Sapiens
uuuuuuuaauccuaauauaauacuaaugauuucucaucuuuacuuagauaauuuggaaccagga

SEQ ID NO: 277183 - RNA, 64 nt, Homo Sapiens
uaaaaccaugucccuucuauguuauugaucuugccaucuuuauuaaaacugauauugucuauug

SEQ ID NO: 277184 - RNA, 64 nt, Homo Sapiens
ugggcauauauacaauaaagcucuccccacuuuccaucuuuaaauuaaccucuugaagcuaguc

SEQ ID NO: 277185 - RNA, 64 nt, Homo Sapiens
cuguccuaccucucauuuucccauaauguucucacaucuuuacuuugauccaaaaacuaccuuu

SEQ ID NO: 277186 - RNA, 52 nt, Homo Sapiens
cuuuacugaaacaacaguaaaccaucuuuauuauggucauauuucacagcac

SEQ ID NO: 277187 - RNA, 64 nt, Homo Sapiens
uauuauggucauauuucacagcaccaaaauaaaucaucuuuauuaaguagaugaaacauuaacu

SEQ ID NO: 277188 - RNA, 64 nt, Homo Sapiens
auguguuuguguguguguaguuuauccucucucucaucuuuaucuagagauugacugauaccuc

SEQ ID NO: 277189 - RNA, 64 nt, Homo Sapiens
agcagaaacuuuacauaaagcuguauuucuuaaucaucuuuaauuugaaacuuaagaaaaugaa

SEQ ID NO: 277190 - RNA, 64 nt, Homo Sapiens
ggcuagaauccggaauguuuucuugauuuaaagacaucuuuagaccgggcacaguggcucacgc

SEQ ID NO: 277191 - RNA, 64 nt, Homo Sapiens
agcgagaccuugucuuuaaaaauaaaaauaaaaacaucuuuacaacauuccuguuuguauuuua

SEQ ID NO: 277192 - RNA, 64 nt, Homo Sapiens
uacuaucccagaaacagggcaacguuuuuagaaacaucuuuagcccaaaguaacuaguaaaaau

SEQ ID NO: 277193 - RNA, 64 nt, Homo Sapiens
ccuuuuacaagguuagaaaagucucauacuaccucaucuuuauuguggcgcuuuuguagaucac

SEQ ID NO: 277194 - RNA, 64 nt, Homo Sapiens
gauuaggagagagacagcaguguuugaacuacagcaucuuuacacuagcuuguguuuugugcua

SEQ ID NO: 277195 - RNA, 64 nt, Homo Sapiens
ucauuucugguggauaaccuuuuuaguuuaauagcaucuuuaauuagaucacagcauugaauuc

SEQ ID NO: 277196 - RNA, 64 nt, Homo Sapiens
cuuuguauggcuugccagcuaacaauagugguuccaucuuuaaggaagaagaauguuugaugga

SEQ ID NO: 277197 - RNA, 64 nt, Homo Sapiens
caucaugaaaacagagccccguucauaaauuuuucaucuuuauuuuuaagguuauacuccucua

SEQ ID NO: 277198 - RNA, 64 nt, Homo Sapiens
gaggaggcacugccccccuuuccugcccccuccucaucuuuaauaaagaccuggcuucucaucu

SEQ ID NO: 277199 - RNA, 64 nt, Homo Sapiens
cccccuccucaucuuuaauaaagaccuggcuucucaucuuuaauaaagaccuguuuguaacaga

SEQ ID NO: 277200 - RNA, 64 nt, Homo Sapiens; identical to SEQ ID NO: 87818

SEQ ID NO: 277201 - RNA, 64 nt, Homo Sapiens; identical to SEQ ID NO: 87819

SEQ ID NO: 277202 - RNA, 64 nt, Homo Sapiens; identical to SEQ ID NO: 87820

SEQ ID NO: 277203 - RNA, 64 nt, Homo Sapiens; identical to SEQ ID NO: 87821

SEQ ID NO: 277204 - RNA, 64 nt, Homo Sapiens; identical to SEQ ID NO: 87822

SEQ ID NO: 277205 - RNA, 64 nt, Homo Sapiens; identical to SEQ ID NO: 87823

SEQ ID NO: 277206 - RNA, 64 nt, Homo Sapiens; identical to SEQ ID NO: 87824

SEQ ID NO: 277207 - RNA, 64 nt, Homo Sapiens; identical to SEQ ID NO: 87825

SEQ ID NO: 277208 - RNA, 64 nt, Homo Sapiens; identical to SEQ ID NO: 87826

SEQ ID NO: 277209 - RNA, 64 nt, Homo Sapiens; identical to SEQ ID NO: 87827

SEQ ID NO: 277210 - RNA, 64 nt, Homo Sapiens; identical to SEQ ID NO: 87828

SEQ ID NO: 277211 - RNA, 64 nt, Homo Sapiens; identical to SEQ ID NO: 87829

SEQ ID NO: 277212 - RNA, 64 nt, Homo Sapiens; identical to SEQ ID NO: 87830

SEQ ID NO: 277213 - RNA, 64 nt, Homo Sapiens; identical to SEQ ID NO: 87831

SEQ ID NO: 277214 - RNA, 64 nt, Homo Sapiens; identical to SEQ ID NO: 87832

SEQ ID NO: 277215 - RNA, 64 nt, Homo Sapiens; identical to SEQ ID NO: 87833

SEQ ID NO: 277216 - RNA, 64 nt, Homo Sapiens; identical to SEQ ID NO: 87834

SEQ ID NO: 277217 - RNA, 64 nt, Homo Sapiens; identical to SEQ ID NO: 87835

SEQ ID NO: 277218 - RNA, 64 nt, Homo Sapiens; identical to SEQ ID NO: 87836

SEQ ID NO: 277219 - RNA, 64 nt, Homo Sapiens; identical to SEQ ID NO: 87837

SEQ ID NO: 277220 - RNA, 64 nt, Homo Sapiens; identical to SEQ ID NO: 87838

SEQ ID NO: 277221 - RNA, 64 nt, Homo Sapiens; identical to SEQ ID NO: 87839

SEQ ID NO: 277222 - RNA, 64 nt, Homo Sapiens; identical to SEQ ID NO: 87840

SEQ ID NO: 277223 - RNA, 64 nt, Homo Sapiens; identical to SEQ ID NO: 87841

SEQ ID NO: 277224 - RNA, 64 nt, Homo Sapiens; identical to SEQ ID NO: 87842

SEQ ID NO: 277225 - RNA, 64 nt, Homo Sapiens; identical to SEQ ID NO: 87843

SEQ ID NO: 277226 - RNA, 64 nt, Homo Sapiens; identical to SEQ ID NO: 87844

SEQ ID NO: 277227 - RNA, 64 nt, Homo Sapiens; identical to SEQ ID NO: 87845

SEQ ID NO: 277228 - RNA, 64 nt, Homo Sapiens; identical to SEQ ID NO: 87846

SEQ ID NO: 277229 - RNA, 64 nt, Homo Sapiens; identical to SEQ ID NO: 87847

SEQ ID NO: 277230 - RNA, 64 nt, Homo Sapiens; identical to SEQ ID NO: 87848

SEQ ID NO: 277231 - RNA, 64 nt, Homo Sapiens; identical to SEQ ID NO: 87849

SEQ ID NO: 277232 - RNA, 64 nt, Homo Sapiens; identical to SEQ ID NO: 87850

SEQ ID NO: 277233 - RNA, 64 nt, Homo Sapiens; identical to SEQ ID NO: 87851

SEQ ID NO: 277234 - RNA, 64 nt, Homo Sapiens; identical to SEQ ID NO: 179628

SEQ ID NO: 277235 - RNA, 64 nt, Homo Sapiens; identical to SEQ ID NO: 179629

SEQ ID NO: 277236 - RNA, 64 nt, Homo Sapiens; identical to SEQ ID NO: 179630

SEQ ID NO: 277237 - RNA, 64 nt, Homo Sapiens; identical to SEQ ID NO: 179631

SEQ ID NO: 277238 - RNA, 64 nt, Homo Sapiens; identical to SEQ ID NO: 179632

SEQ ID NO: 277239 - RNA, 64 nt, Homo Sapiens; identical to SEQ ID NO: 179633

SEQ ID NO: 277240 - RNA, 64 nt, Homo Sapiens; identical to SEQ ID NO: 179634

SEQ ID NO: 277241 - RNA, 64 nt, Homo Sapiens; identical to SEQ ID NO: 179635

SEQ ID NO: 277242 - RNA, 64 nt, Homo Sapiens; identical to SEQ ID NO: 179636

SEQ ID NO: 277243 - RNA, 64 nt, Homo Sapiens; identical to SEQ ID NO: 179637

SEQ ID NO: 277244 - RNA, 64 nt, Homo Sapiens; identical to SEQ ID NO: 179638

SEQ ID NO: 277245 - RNA, 64 nt, Homo Sapiens; identical to SEQ ID NO: 179639

SEQ ID NO: 277246 - RNA, 64 nt, Homo Sapiens; identical to SEQ ID NO: 179640

SEQ ID NO: 277247 - RNA, 64 nt, Homo Sapiens; identical to SEQ ID NO: 179641

SEQ ID NO: 277248 - RNA, 64 nt, Homo Sapiens; identical to SEQ ID NO: 179642

SEQ ID NO: 277249 - RNA, 64 nt, Homo Sapiens; identical to SEQ ID NO: 179643

SEQ ID NO: 277250 - RNA, 64 nt, Homo Sapiens; identical to SEQ ID NO: 179644

SEQ ID NO: 277251 - RNA, 64 nt, Homo Sapiens; identical to SEQ ID NO: 179645

SEQ ID NO: 277252 - RNA, 64 nt, Homo Sapiens; identical to SEQ ID NO: 259559

SEQ ID NO: 277253 - RNA, 64 nt, Homo Sapiens; identical to SEQ ID NO: 259560

SEQ ID NO: 277254 - RNA, 64 nt, Homo Sapiens; identical to SEQ ID NO: 259561

SEQ ID NO: 277255 - RNA, 64 nt, Homo Sapiens; identical to SEQ ID NO: 259562

SEQ ID NO: 277256 - RNA, 64 nt, Homo Sapiens; identical to SEQ ID NO: 259563

SEQ ID NO: 277257 - RNA, 64 nt, Homo Sapiens; identical to SEQ ID NO: 259564

SEQ ID NO: 277258 - RNA, 64 nt, Homo Sapiens; identical to SEQ ID NO: 259565

SEQ ID NO: 277259 - RNA, 64 nt, Homo Sapiens; identical to SEQ ID NO: 259566

SEQ ID NO: 277260 - RNA, 64 nt, Homo Sapiens; identical to SEQ ID NO: 259567

SEQ ID NO: 277261 - RNA, 64 nt, Homo Sapiens; identical to SEQ ID NO: 259568

SEQ ID NO: 277262 - RNA, 64 nt, Homo Sapiens; identical to SEQ ID NO: 259569

SEQ ID NO: 277263 - RNA, 64 nt, Homo Sapiens; identical to SEQ ID NO: 259570

SEQ ID NO: 277264 - RNA, 64 nt, Homo Sapiens; identical to SEQ ID NO: 259571

SEQ ID NO: 277265 - RNA, 64 nt, Homo Sapiens; identical to SEQ ID NO: 259572

SEQ ID NO: 277266 - RNA, 64 nt, Homo Sapiens; identical to SEQ ID NO: 259573

SEQ ID NO: 277267 - RNA, 64 nt, Homo Sapiens; identical to SEQ ID NO: 259574

SEQ ID NO: 277268 - RNA, 64 nt, Homo Sapiens; identical to SEQ ID NO: 259575

SEQ ID NO: 277269 - RNA, 64 nt, Homo Sapiens; identical to SEQ ID NO: 259576

SEQ ID NO: 277270 - RNA, 64 nt, Homo Sapiens; identical to SEQ ID NO: 259577

SEQ ID NO: 277271 - RNA, 64 nt, Homo Sapiens; identical to SEQ ID NO: 259578

SEQ ID NO: 277272 - RNA, 64 nt, Homo Sapiens; identical to SEQ ID NO: 259579

SEQ ID NO: 277273 - RNA, 64 nt, Homo Sapiens; identical to SEQ ID NO: 259580

SEQ ID NO: 277274 - RNA, 64 nt, Homo Sapiens; identical to SEQ ID NO: 128887

SEQ ID NO: 277275 - RNA, 64 nt, Homo Sapiens; identical to SEQ ID NO: 128888

SEQ ID NO: 277276 - RNA, 54 nt, Homo Sapiens; identical to SEQ ID NO: 128889

SEQ ID NO: 277277 - RNA, 64 nt, Homo Sapiens; identical to SEQ ID NO: 128890

SEQ ID NO: 277278 - RNA, 64 nt, Homo Sapiens; identical to SEQ ID NO: 128891

SEQ ID NO: 277279 - RNA, 64 nt, Homo Sapiens; identical to SEQ ID NO: 128892

SEQ ID NO: 277280 - RNA, 64 nt, Homo Sapiens; identical to SEQ ID NO: 128893

SEQ ID NO: 277281 - RNA, 64 nt, Homo Sapiens; identical to SEQ ID NO: 128894

SEQ ID NO: 277282 - RNA, 64 nt, Homo Sapiens; identical to SEQ ID NO: 128895

SEQ ID NO: 277283 - RNA, 64 nt, Homo Sapiens; identical to SEQ ID NO: 128896

SEQ ID NO: 277284 - RNA, 64 nt, Homo Sapiens; identical to SEQ ID NO: 128897

SEQ ID NO: 277285 - RNA, 64 nt, Homo Sapiens; identical to SEQ ID NO: 128898

SEQ ID NO: 277286 - RNA, 64 nt, Homo Sapiens; identical to SEQ ID NO: 128899

SEQ ID NO: 277287 - RNA, 64 nt, Homo Sapiens; identical to SEQ ID NO: 128900

SEQ ID NO: 277288 - RNA, 64 nt, Homo Sapiens; identical to SEQ ID NO: 128901

SEQ ID NO: 277289 - RNA, 64 nt, Homo Sapiens; identical to SEQ ID NO: 128902

SEQ ID NO: 277290 - RNA, 64 nt, Homo Sapiens; identical to SEQ ID NO: 128903

SEQ ID NO: 277291 - RNA, 64 nt, Homo Sapiens; identical to SEQ ID NO: 128904

SEQ ID NO: 277292 - RNA, 64 nt, Homo Sapiens; identical to SEQ ID NO: 128905

SEQ ID NO: 277293 - RNA, 64 nt, Homo Sapiens; identical to SEQ ID NO: 128906

SEQ ID NO: 277294 - RNA, 64 nt, Homo Sapiens; identical to SEQ ID NO: 128907

SEQ ID NO: 277295 - RNA, 64 nt, Homo Sapiens; identical to SEQ ID NO: 128908

SEQ ID NO: 277296 - RNA, 64 nt, Homo Sapiens; identical to SEQ ID NO: 128909

SEQ ID NO: 277297 - RNA, 64 nt, Homo Sapiens
ucgguuuugaaucucaugaaccuugagugcuggagcaucugaucugucucuaugccaccacugg

SEQ ID NO: 277298 - RNA, 64 nt, Homo Sapiens
cuuggcugugguaauccaggguaauugcgcagaggcaucugauguguaggaaaguaauucuggg

SEQ ID NO: 277299 - RNA, 64 nt, Homo Sapiens
agugggaauaacaaauguucugguugugaagagugcaucugaagugcuuacacggcgucuggca

SEQ ID NO: 277300 - RNA, 64 nt, Homo Sapiens
aucaguaggguuugucccugaugccuuuacaacagcaucugagcaccucucaaguuuuuccagg

SEQ ID NO: 277301 - RNA, 64 nt, Homo Sapiens
aauacacacuagagaaaaaccuuacaaaugugaagcaucugauaaauccugugaagcgucugau

SEQ ID NO: 277302 - RNA, 64 nt, Homo Sapiens
ugggaagauauuuaucaaauucaggcuucauucagcaucugagaguucacaccagggagaaauc

SEQ ID NO: 277303 - RNA, 64 nt, Homo Sapiens
ucacacaugcucccaggauuacugugguagaaggaagacagaaccggagggaggcagaggggag

SEQ ID NO: 277304 - RNA, 64 nt, Homo Sapiens
ccucaaggagagauaaagagaaagcucuuuugaaaagacagacugagaucauugagugacccag

SEQ ID NO: 277305 - RNA, 64 nt, Homo Sapiens
aggguaucuccucuggaaggaucuaagagaagguaagacagauuaggacaucgaaaaggaggau

SEQ ID NO: 277306 - RNA, 64 nt, Homo Sapiens
auaauuuguuugcuguguaaggaagaauguagacaagacagauaaaucugaaggucauguggca

SEQ ID NO: 277307 - RNA, 64 nt, Homo Sapiens
cugucauauauuuaauggcugauauguugcacugaagacagaccacccuucaauugccaaauuu

SEQ ID NO: 277308 - RNA, 64 nt, Homo Sapiens
aaaaauaauuguuauguuucggcuuucuuuuguaaagacagaauagacuuuuucauagagaaga

SEQ ID NO: 277309 - RNA, 64 nt, Homo Sapiens
cacuugguugcugagucacuccaucacggccccaaagacagaguagauuccuccaugucagcuc

SEQ ID NO: 277310 - RNA, 64 nt, Homo Sapiens
aguguuuuaaguguaagaucaagaagcagauaagaagacagaaacccauauagacuugaucuca

SEQ ID NO: 277311 - RNA, 64 nt, Homo Sapiens
uaccauucaacccagcaaucacaguguggggauaaagacagagauaguucagccauuguggaag

SEQ ID NO: 277312 - RNA, 64 nt, Homo Sapiens
cuugcucugucucccaggcuuuaaaauuuuucuuaagacagaguugcaggguacuacgcaagcc

SEQ ID NO: 277313 - RNA, 64 nt, Homo Sapiens
aaauaacugauuagacccaaauaaaaguagaagaaagacagaaaaaccucuuagacucuuagaa

SEQ ID NO: 277314 - RNA, 64 nt, Homo Sapiens
gaugcaccuucccgcugcugccaucuuuuaugggaagacagaguugccuuggugccgcaguggc

SEQ ID NO: 277315 - RNA, 64 nt, Homo Sapiens
agaucccacuggauggguagcugaaauaaaggaaaagacagagaaaggggcuguggugcuuguu

SEQ ID NO: 277316 - RNA, 64 nt, Homo Sapiens
cagggguguguggaguaaauagcucgaagagcugaagacagaaaaccaguuucacgccaggugc

SEQ ID NO: 277317 - RNA, 64 nt, Homo Sapiens
cuugcucuguugcccaagcuauuuuuuuuuuuccaagacagaguaggcaagccuggccaucugu

SEQ ID NO: 277318 - RNA, 64 nt, Homo Sapiens
gugaagauugauagaaaaucaugggaaccauuucaagacagauuauuccugcacgaaguggcug

SEQ ID NO: 277319 - RNA, 64 nt, Homo Sapiens
agucagcucuaauuguucaccacagaacucauauaagacagaaacccuauggguguaaugaaug

SEQ ID NO: 277320 - RNA, 64 nt, Homo Sapiens
ugagcugugaucgugccacuguacucuagccuggaagacagagugagaccccaucucaggaaaa

SEQ ID NO: 277321 - RNA, 64 nt, Homo Sapiens
uucuggacaagauggguaaguaauccacuucccuaagacagaauugggccuucagaugucaccc

SEQ ID NO: 277322 - RNA, 64 nt, Homo Sapiens
aggaaauggaauaugcggguucuuagaaauaagcaagacagagcucucucaucauacucuuguu

SEQ ID NO: 277323 - RNA, 62 nt, Homo Sapiens
agaugcuggaugagcucugaggcaggguugagaagacagaucuagucaggaccaccagccau

SEQ ID NO: 277324 - RNA, 64 nt, Homo Sapiens
gagcauggugggccaugcucugggcagcuguuccaagacagagcugacccuuccauuaccaaug

SEQ ID NO: 277325 - RNA, 64 nt, Homo Sapiens
gggucgggggucuucuguuucacuaacaggaacaaagacagaaaccaugacagggcugccccgc

SEQ ID NO: 277326 - RNA, 64 nt, Homo Sapiens
uuucaaagaagagcucauagacugacugguccagaagacagaggguacaacaguggcaucacag

SEQ ID NO: 277327 - RNA, 64 nt, Homo Sapiens
ugaccagccggagcagccggagcugaagcggaucaagacagaagacggcgagggcaucgucauu

SEQ ID NO: 277328 - RNA, 64 nt, Homo Sapiens
aaacccaaaacccagcuggccuuaacacuccuuaaagacagaagucacacuugaacaaaaccca

SEQ ID NO: 277329 - RNA, 64 nt, Homo Sapiens
ggucagccccacccgaucccgcgaugauccaaagaagacagagaagggaggacagugugagaag

SEQ ID NO: 277330 - RNA, 64 nt, Homo Sapiens
agaaugagcccucacccuggcugaggcaguggggaagacagagcaaagcagcuuuugggggaaa

SEQ ID NO: 277331 - RNA, 64 nt, Homo Sapiens
ucuaauuauucucucuuuuucuguggggaguccuaagacagacaaguguguucaaugggaccug

SEQ ID NO: 277332 - RNA, 64 nt, Homo Sapiens
ccaccugaucaagaucaucaguauggagggguucaagacagagcuuugggcagcauugauagaa

SEQ ID NO: 277333 - RNA, 64 nt, Homo Sapiens
cuggcgggcgggcugcgcggaggcucgggagcuggccggggaggggcggauggaggggccuggg

SEQ ID NO: 277334 - RNA, 64 nt, Homo Sapiens
cggagacaccagcgcuggcuucccgggcccgcgggccggggagggaagccucggggcugcgggg

SEQ ID NO: 277335 - RNA, 59 nt, Homo Sapiens
ucccguuccugggggcguagaggggccgggccggggacgaggccuccugcggacaccag

SEQ ID NO: 277336 - RNA, 64 nt, Homo Sapiens
gacaccagcuccucucuccgccgucaccggggaggccggggauccuugcagggcuucuggggcg

SEQ ID NO: 277337 - RNA, 64 nt, Homo Sapiens
cacccaccaccccccgcaccuccgcccccagcgagccggggaccccagguggaccggcccgcgc

SEQ ID NO: 277338 - RNA, 64 nt, Homo Sapiens
ccgccagguggaccggcccgccggcgcgcucaucgccggggagccccggaagccgagcgagcgg

SEQ ID NO: 277339 - RNA, 64 nt, Homo Sapiens
gguuggggcagaccggacccagguuuccugacuccuggcccaagucucuuccuccuauccugcg

SEQ ID NO: 277340 - RNA, 64 nt, Homo Sapiens
gcggaagaaagcucgggcccuggaggcugcggcucuggcccacugagccaccgcgcccuccugc

SEQ ID NO: 277341 - RNA, 64 nt, Homo Sapiens
gaugggggugggugcugguguuccccaagugccacuggcccaugacccggagcugguguggcca

SEQ ID NO: 277342 - RNA, 64 nt, Homo Sapiens
cuuuuuuugacgcagccaauggaccagucccucacuggcccauugccugggaguggcucugugu

SEQ ID NO: 277343 - RNA, 64 nt, Homo Sapiens
cuaguuaugacaaccaaaaaauuuagcagcaacccuggcccacuuauuuugugcauuacaggau

SEQ ID NO: 277344 - RNA, 64 nt, Homo Sapiens
ugagaggaggaagaggggucugccaaccucccugcuggcccaggggggcaucuuuccugcccuc

SEQ ID NO: 277345 - RNA, 64 nt, Homo Sapiens
guuaccaccaacuggcuggcccuccuccucuucccuggcccauugaucaucccuucucacagag

SEQ ID NO: 277346 - RNA, 64 nt, Homo Sapiens
accucugguuccugggaugagccauacccuggaacuggcccacccacugugucuuccacguaag

SEQ ID NO: 277347 - RNA, 64 nt, Homo Sapiens
gagagugaggcccccgcacggguggucuucaagccuggcccaguaggcugguggacagacccag

SEQ ID NO: 277348 - RNA, 64 nt, Homo Sapiens
cuguggccucagcaucucauagaggccuggugcccuggcccagccuucccgcccucccccugcc

SEQ ID NO: 277349 - RNA, 64 nt, Homo Sapiens
acuauccagauggaggcaccaaacacccacauaccuggcccaaccagacuucucccgugagcca

SEQ ID NO: 277350 - RNA, 64 nt, Homo Sapiens
gcagcuguacugaggaugauguuauucacagccccuggcccacccacuaauacuacugcacaga

SEQ ID NO: 277351 - RNA, 64 nt, Homo Sapiens
aggccaaggaccccugaugcagacucuggaaucccuggcccaaaggccugucugggcccaucug

SEQ ID NO: 277352 - RNA, 64 nt, Homo Sapiens
ccuuagccaaagggaacgugucauuugcucgacccuggcccacccuugccgcccagcuguugug

SEQ ID NO: 277353 - RNA, 64 nt, Homo Sapiens
uaucuaucucuugccuucccccaagcaagccucucuggcccacauccuaaucagaaucagccac

SEQ ID NO: 277354 - RNA, 64 nt, Homo Sapiens
uacaaguaccaaacaguagucucucccuaucaagcuggcccagacucuacauuccuuaggauuu

SEQ ID NO: 277355 - RNA, 64 nt, Homo Sapiens
uaaccucacccccaaacuccacgggugccccuagcuggcccagagccggcagugugagcccaag

SEQ ID NO: 277356 - RNA, 64 nt, Homo Sapiens
aggaucggacgugcuaccccucccggucccggcccuggcccagccagcccagcccucgaggcuc

SEQ ID NO: 277357 - RNA, 64 nt, Homo Sapiens
guugguagugaaugggccugguugggagcagccccuggcccauugcccacccacccaucucacu

SEQ ID NO: 277358 - RNA, 64 nt, Homo Sapiens
caaggugccuggggcaggcguccugaagcagggccuggcccacccuccggaguggcccgccacc

SEQ ID NO: 277359 - RNA, 64 nt, Homo Sapiens
gacagaugagaggucugaagccugaggcaucacucuggcccauugcccuggguuucuagcggug

SEQ ID NO: 277360 - RNA, 64 nt, Homo Sapiens
gaaagagccucuuaaggcagggaugguucugaagcuggcccauuccaggccgcugcgguacacu

SEQ ID NO: 277361 - RNA, 64 nt, Homo Sapiens
uucuggagcgaacugcaccggcaccuccccggcccuggcccaccagcaugccaggggugugugc

SEQ ID NO: 277362 - RNA, 64 nt, Homo Sapiens
gccugagcaagcugcagcccguccagcaugcauccuggcccacggcuuuuuuauuuggagaacc

SEQ ID NO: 277363 - RNA, 64 nt, Homo Sapiens
cugggcucccuuuaagccaaccuuaacaccugaucuggcccaagucaauuuggugcucacgugu

SEQ ID NO: 277364 - RNA, 64 nt, Homo Sapiens
ggguagugaauuggcuuccugcggcccacgccagcuggcccagugggcuuccugggcaguuggg

SEQ ID NO: 277365 - RNA, 64 nt, Homo Sapiens
caaucuagaggcaagccuggugaccccagaaauucuggcccagcagaaugcagacuuuucagac

SEQ ID NO: 277366 - RNA, 64 nt, Homo Sapiens
uccccugcgccuccauggcuccgugaccuacacccuggcccagcgcugcgggcacccauccgcu

SEQ ID NO: 277367 - RNA, 64 nt, Homo Sapiens
ggugcggugguggccgacccgugaacagccgcgccuggcccaacccucgcccagguaccuguac

SEQ ID NO: 277368 - RNA, 64 nt, Homo Sapiens
gccacaccaagccacccgagagguggccgagcugcuggcccaggggagcgcaugcuagagacca

SEQ ID NO: 277369 - RNA, 64 nt, Homo Sapiens
gggaccagcaguagaccccccacucuccccaccccuggcccacuguggugugugcugggcaaau

SEQ ID NO: 277370 - RNA, 64 nt, Homo Sapiens
gcacccucuguccagagucuagggcaguccuccacuggcccagcacuccaguuuccuuucccug

SEQ ID NO: 277371 - RNA, 64 nt, Homo Sapiens
cucuuccugggagaugcgugcauaucgaugaggucuggcccagcgucaggcugccacacugaac

SEQ ID NO: 277372 - RNA, 64 nt, Homo Sapiens
cggacacacagaagauggugugcugcuggaggcucuggcccaggccuggcacugauccugcugg

SEQ ID NO: 277373 - RNA, 64 nt, Homo Sapiens
uuuuguaauuauugugauuucccguggccccagccuggcccagcucccccgggaggggcccgcu

SEQ ID NO: 277374 - RNA, 64 nt, Homo Sapiens
aggcuggcuggggccuaucagugugccccccauccuggcccaucaguguacccccgcccaggcu

SEQ ID NO: 277375 - RNA, 64 nt, Homo Sapiens
cauccuaggggcugaaaucccuccuucuccuguccuggcccaggcgaaacaccacccucugcuc

SEQ ID NO: 277376 - RNA, 64 nt, Homo Sapiens
auuucacagucgaaaaggaagcguggcugaccagcuggcccaggucacuacugggugcugcccu

SEQ ID NO: 277377 - RNA, 58 nt, Homo Sapiens
agaaugggaaucuggauuagcccuggggcuggcccaggucuucauugaguccaaagug

SEQ ID NO: 277378 - RNA, 64 nt, Homo Sapiens
agagggucuguccccuccucuccacgucccagaacuggcccagcugcaggcacuaagaagcucc

SEQ ID NO: 277379 - RNA, 64 nt, Homo Sapiens
gcuggggcgucagcuaaacccugccucagccccccuggcccaguccuagccuuccccauaucuc

SEQ ID NO: 277380 - RNA, 64 nt, Homo Sapiens
uaguccucaagcucccaaccgugguaggacaggacuggcccacuuguggacuguuccccccacu

SEQ ID NO: 277381 - RNA, 64 nt, Homo Sapiens
ggacaccaggcuggcugcuuuuuuuagccugccccuggcccaggcccaguccuuggugucaggg

SEQ ID NO: 277382 - RNA, 64 nt, Homo Sapiens
aguguaagggcccuucacaaaagcagaaggaacacuggcccaaacccccagcaccccggaagca

SEQ ID NO: 277383 - RNA, 64 nt, Homo Sapiens
ggugacuacggggucgcccuuugcucacgucucucuggcccacucaugauggagaagugugguc

SEQ ID NO: 277384 - RNA, 64 nt, Homo Sapiens
ccuuucagcugcugcuuaaugcccugcucucucccuggcccaccuuauagagagcccaaagagc

SEQ ID NO: 277385 - RNA, 64 nt, Homo Sapiens
auggccccugugugguucccuuuaccuuggcuuccuggcccagucccugccucuccaccugcac

SEQ ID NO: 277386 - RNA, 64 nt, Homo Sapiens
cccagucccugccucuccaccugcacccugcuuccuggcccagucccagguuggagucccucug

SEQ ID NO: 277387 - RNA, 64 nt, Homo Sapiens
acgucacuagagacugggagccgaggcaguggugcuggcccaagugaaggccagagugaggacu

SEQ ID NO: 277388 - RNA, 64 nt, Homo Sapiens
aaagguguccuccaugcccucaggcagcagagaacuggcccagagcccuuggaguguuggugga

SEQ ID NO: 277389 - RNA, 64 nt, Homo Sapiens
gucacgcuggcaaccacgagaggcucaggcaggccuggcccagacuagacucccaaaggagccc

SEQ ID NO: 277390 - RNA, 64 nt, Homo Sapiens
gugugcuccuggcucagcaguggcgugggcuuugcuggcccagugcccaggcucuccuuucgcu

SEQ ID NO: 277391 - RNA, 64 nt, Homo Sapiens
agguucugcgaugagaggugcaggaggcaggagccuggcccagggggugcuggugccuccccgg

SEQ ID NO: 277392 - RNA, 64 nt, Homo Sapiens
uccugggcauuggagaugaugaaaccgagcagaccuggcccauguggagcuggcaugggggaca

SEQ ID NO: 277393 - RNA, 64 nt, Homo Sapiens
acuucccauuagcaggagcuccccagcggcaagccuggcccagugggcucgguagugcccagcu

SEQ ID NO: 277394 - RNA, 64 nt, Homo Sapiens
uccuucccggccauauuaaccacacagccugagccuggcccagccucggcugccagaggugccu

SEQ ID NO: 277395 - RNA, 64 nt, Homo Sapiens
cugccugggcaucccugguggccuguccuggcugcuggcccaucugcaauaggaggggacccga

SEQ ID NO: 277396 - RNA, 64 nt, Homo Sapiens
gcccaccagcagcugauguuccccaaaacuugggcuggcccagggucugagcagagcugggucc

SEQ ID NO: 277397 - RNA, 64 nt, Homo Sapiens
aggcggggcaccugcaugcacugggagggggcggcuggcccagcccucggggcaggagcccccu

SEQ ID NO: 277398 - RNA, 64 nt, Homo Sapiens
uggccugagaccaccggugugggucacgagggcccuggcccacaguguugaggguccucucuuu

SEQ ID NO: 277399 - RNA, 64 nt, Homo Sapiens
gggacaggcccugggacugugguggccgguggcccuggcccagcucuggagugcaugugugugu

SEQ ID NO: 277400 - RNA, 64 nt, Homo Sapiens
acagaacuauuucuugcugcucaauccauuuccucuggcccagcuucccagugcucacagaugg

SEQ ID NO: 277401 - RNA, 64 nt, Homo Sapiens
uccucuggcccagcuucccagugcucacagauggcuggcccaugugcuggaagaugacacaguu

SEQ ID NO: 277402 - RNA, 64 nt, Homo Sapiens
uugauguauccugagguuccuagaucucacugaacuggcccagcuaaggagaccuggacucugg

SEQ ID NO: 277403 - RNA, 64 nt, Homo Sapiens
agccaccugagccagcuuuauauuucaaccauggcuggcccaucugagagcaucuccccacucu

SEQ ID NO: 277404 - RNA, 64 nt, Homo Sapiens
ccuggaguuaagggaugaaggcaaggcugcaggucuggcccaggggaauuaaaagccagccacu

SEQ ID NO: 277405 - RNA, 64 nt, Homo Sapiens
ugcccaaccuccaaguggacuucuugcaaagggucuggcccagggcagggcugccccacacaag

SEQ ID NO: 277406 - RNA, 64 nt, Homo Sapiens
cagauaucagagcagacggagccaccagaucucucuggcccauauaacaucucuggucuuuaga

SEQ ID NO: 277407 - RNA, 64 nt, Homo Sapiens
aaaggcugccugcagaggaccacgugagcaacagcuggcccaggucucugaucagcuggauccc

SEQ ID NO: 277408 - RNA, 64 nt, Homo Sapiens
cacgccugucucgucuuccuuccucugucuugcccuggcccacggccucugcuucccucccuuc

SEQ ID NO: 277409 - RNA, 64 nt, Homo Sapiens
ggacagacaggaccaggaucccggggcggccaggcuggcccaaccucuuggacccugcgggaug

SEQ ID NO: 277410 - RNA, 64 nt, Homo Sapiens
cugagugugagucacagagacagccuguggacgccuggcccaccacuguccuccagcccgcccc

SEQ ID NO: 277411 - RNA, 64 nt, Homo Sapiens
cuggccugagccugaugcugagaggcgccuguaccuggcccagggucauggccauccugcccgg

SEQ ID NO: 277412 - RNA, 64 nt, Homo Sapiens
gcuaagggggcaaaaagcccagauaccauuuuaacuggcccaguucauuuucuccuuucauuuu

SEQ ID NO: 277413 - RNA, 64 nt, Homo Sapiens
aaaauaacagugccuuugaccuuaaaacauggcacuggcccaugugaccuuugccauuucccag

SEQ ID NO: 277414 - RNA, 64 nt, Homo Sapiens
aaaggcccagaucaccgaggaggaggcaaaacuucuggcccagaaggccgcagaggcugagcag

SEQ ID NO: 277415 - RNA, 64 nt, Homo Sapiens
guaagcccuguggcuccacaggugcugcuucucacuggcccagacucugagcuccaccggccca

SEQ ID NO: 277416 - RNA, 64 nt, Homo Sapiens
aaguuagcaaugccuguggcgcuccgcccacaagcuggcccaugauggucucaagccugaagag

SEQ ID NO: 277417 - RNA, 64 nt, Homo Sapiens
acauccuguccuccugagcucccgaggguuuaggcuggcccagcuuaucccugcgcuagucucc

SEQ ID NO: 277418 - RNA, 64 nt, Homo Sapiens
cuugggagucugcucaggacagcugacgaggcagcuggcccagucuucaccucucagacgaggc

SEQ ID NO: 277419 - RNA, 64 nt, Homo Sapiens
cuuggggcugcugggguuggccgcucaggaugcccuggcccaggcauccccaccccagccgggc

SEQ ID NO: 277420 - RNA, 64 nt, Homo Sapiens
ucccuccuccccagggaugcgcagaggcugcagacuggcccacuguugucagaggcgggggaca

SEQ ID NO: 277421 - RNA, 60 nt, Homo Sapiens
ucccugugcgcaugcacaugucaggcccugcuggcccagggccgcaugucuggacacuga

SEQ ID NO: 277422 - RNA, 64 nt, Homo Sapiens
uuuuaauagguucacuggaaguaggagaauuuucaagaaccauacuucgacauuuccucugcca

SEQ ID NO: 277423 - RNA, 64 nt, Homo Sapiens
aggaaugaaguuggaaccacaggcagaucugaaaaagaaccaaauagagcuccuaaaaaugaga

SEQ ID NO: 277424 - RNA, 64 nt, Homo Sapiens
aggaggcugggcagaaccagaaccaggccuggaaaagaaccagagggaagagagccuggaaaag

SEQ ID NO: 277425 - RNA, 64 nt, Homo Sapiens
ccuggaaaagaaccagaaggaagagagccuggaaaagaaccaggugucauuguucaaagguggg

SEQ ID NO: 277426 - RNA, 64 nt, Homo Sapiens
aauuauaucuguuuuggagcagagaaaauuaucaaagaaccagaucaucacauaccccucucac

SEQ ID NO: 277427 - RNA, 64 nt, Homo Sapiens
ggaaagaggaaucugcaaucauacgcauuucaugaagaaccauuauguagaagaucuuaagucc

SEQ ID NO: 277428 - RNA, 64 nt, Homo Sapiens
gcugcaggugguagcccugggcaaauagcaauugaagaaccacucugggguacuuuaaagaaau

SEQ ID NO: 277429 - RNA, 64 nt, Homo Sapiens
auucacugaguagcuaaugggcaccauaugcaacaagaaccaccgaccuucugaagugucacug

SEQ ID NO: 277430 - RNA, 64 nt, Homo Sapiens
guaacagaguaaacagaggcgucuuugauaacuuaagaaccaaauuggggccuucuuaacaaaa

SEQ ID NO: 277431 - RNA, 64 nt, Homo Sapiens
aaaauaauuaaucucucuggggaaaaugaccauuaagaaccagauuucuauuuuuaagauuaga

SEQ ID NO: 277432 - RNA, 64 nt, Homo Sapiens
gguauucaguuucuuguauuuuuuucaugcagaaaagaaccacacaaaugauaaggaugccaca

SEQ ID NO: 277433 - RNA, 64 nt, Homo Sapiens
gguuucuucacaucugggucagucggcuucucuaaagaaccauuuuaguguguauuguacauaa

SEQ ID NO: 277434 - RNA, 64 nt, Homo Sapiens
aaaaugcaaacuaugaugccaugucugcauugaaaagaaccaaaagagcacaggcuccagcaau

SEQ ID NO: 277435 - RNA, 64 nt, Homo Sapiens
acauuacaaguggccaaaaccccuguucucagugaagaaccacauuggauuuguauucuguuca

SEQ ID NO: 277436 - RNA, 64 nt, Homo Sapiens
ggguuaugagccuacuggauugagguuaaaauccaagaaccaacauuuagagcuuugugcuuuu

SEQ ID NO: 277437 - RNA, 64 nt, Homo Sapiens
cugugucuuauucucccacugaacaaauaaucaaaagaaccagauauccuccaaugugugcaug

SEQ ID NO: 277438 - RNA, 64 nt, Homo Sapiens
gggauaauacugugcagauuuuucgaaugagucuaagaaccacaugugagauugcaguucugua

SEQ ID NO: 277439 - RNA, 64 nt, Homo Sapiens
gacagagcagcauaucuuugcucauacaaacuagaagaaccagcugauccuugagaaauuuacg

SEQ ID NO: 277440 - RNA, 64 nt, Homo Sapiens
cuggaaugccaugaacuggagaaggugagcgcugaagaaccaggaugggacggggcuggaacag

SEQ ID NO: 277441 - RNA, 64 nt, Homo Sapiens
uugguucuagaugaaccaauuaucuggaaaaugaaagaaccagaguuggaaggcacuugacugg

SEQ ID NO: 277442 - RNA, 64 nt, Homo Sapiens
agaacaaugggaaagaggacugggagaggaaucuaagaaccagauggcuucagcucucuagagg

SEQ ID NO: 277443 - RNA, 64 nt, Homo Sapiens
aaaccuuuccuccugacuuaaaaagaaguggggaaagaaccauccucacuuccuuacuccucca

SEQ ID NO: 277444 - RNA, 64 nt, Homo Sapiens
auccagggcacucauaugugaguauucaucaacuaagaaccaaaaaacaaagaacuggguguug

SEQ ID NO: 277445 - RNA, 64 nt, Homo Sapiens
ccaaaccaguaucugaacugcuuggggggugggaaagaaccaagccaugcucugucuacuggca

SEQ ID NO: 277446 - RNA, 64 nt, Homo Sapiens
gucaauguaagaagggaaagggagaagauauuugaagaaccagaauguaaauucauguguuucc

SEQ ID NO: 277447 - RNA, 64 nt, Homo Sapiens
gccaugauuguuauaaaucaauucuccucuacccaagaaccauaaugucauuccaguauaaaac

SEQ ID NO: 277448 - RNA, 64 nt, Homo Sapiens
cagcucagggacccucuugccugugcacgaagucaagaaccaaaugacaaagaagagcuacgcu

SEQ ID NO: 277449 - RNA, 64 nt, Homo Sapiens
guugggaucugccuuuuucauccagagcucugaugccugugaacacugaaagagaaagccuaau

SEQ ID NO: 277450 - RNA, 64 nt, Homo Sapiens
ccaggaguucaaggcuauagugugcuaugaucaugccugugaauagccacugcacuugagccuc

SEQ ID NO: 277451 - RNA, 64 nt, Homo Sapiens
caaagaaaagguccuuuucaguccugugucuugggccugugaguccuggaugcccagcagcccu

SEQ ID NO: 277452 - RNA, 64 nt, Homo Sapiens
gggucuggggcgaggccaggcggcaacaugggcagccugugaccaucccugcccgagcauguau

SEQ ID NO: 277453 - RNA, 64 nt, Homo Sapiens
ggcucuaggcuucuccugcugaguccuggucuuggccugugaaugugccucguucaucccuggu

SEQ ID NO: 277454 - RNA, 64 nt, Homo Sapiens
uuugaaguuuucugcucuacuuuccuuggcagcagccugugaacuacucaaaagaguccccuug

SEQ ID NO: 277455 - RNA, 64 nt, Homo Sapiens
ucuuauugcgacaugcaggucccccaguguucuugccugugacccuugugugcgccccauggga

SEQ ID NO: 277456 - RNA, 64 nt, Homo Sapiens
gguggcagcgcccccaggugagucuaagaugagagccugugacaaauauccacaccucggcaac

SEQ ID NO: 277457 - RNA, 64 nt, Homo Sapiens
cccccaggaaggggguggaaugguucugccaggagccugugacacaaaugcagggcaugggcuc

SEQ ID NO: 277458 - RNA, 64 nt, Homo Sapiens
ggaggguugagggaggcucuaaguacugacuucagccugugaggggguguggcucccccaaacg

SEQ ID NO: 277459 - RNA, 64 nt, Homo Sapiens
auuguguauauagcagacauagcgacaccagcaagccugugagcuuuccuuaucuguaaagcaa

SEQ ID NO: 277460 - RNA, 64 nt, Homo Sapiens
auggcagccuugucuuauggcccgaacacaggaagccugugaccggugucuccaggcacaaagg

SEQ ID NO: 277461 - RNA, 64 nt, Homo Sapiens
aaagaucccuggaucccaggauaaucuccaggaugccugugaagcaggagauacaacagaggag

SEQ ID NO: 277462 - RNA, 64 nt, Homo Sapiens
uuugggaccaacuccaccuauuggaccccucccagccugugaccugauugcucacaccaaagcc

SEQ ID NO: 277463 - RNA, 64 nt, Homo Sapiens
cagcaucucuguaucagugucugugucugugugugccugugagcaccuggugacuugucagugu

SEQ ID NO: 277464 - RNA, 64 nt, Homo Sapiens
cuggauugagacccauucguaaucucacauaucugccugugagaaaacacaggucugugugugc

SEQ ID NO: 277465 - RNA, 64 nt, Homo Sapiens
uuaaagcagucacuucagacaggagccacagggagccugugagggaguagugcgguggugguga

SEQ ID NO: 277466 - RNA, 64 nt, Homo Sapiens
ugaguggagcccaguccagcgacaccuugguuuggccugugagacugagaagagagccagccac

SEQ ID NO: 277467 - RNA, 64 nt, Homo Sapiens
gugcagguacgugcagcacuacggccugggcagugccugugacaacguagagcgcgugcugaag

SEQ ID NO: 277468 - RNA, 64 nt, Homo Sapiens
uaaaaucuccaguuaaagggccuguuucuuacuggccugugaggugcaccguagugccuugggc

SEQ ID NO: 277469 - RNA, 64 nt, Homo Sapiens
aaagaugggaggagaccagcgguccaugggucuggccugugagucuccccuugcagccugguca

SEQ ID NO: 277470 - RNA, 64 nt, Homo Sapiens
ucacgggccccauuccaccgccuccccaacuugagccugugaccuugggaccaaagggggaguc

SEQ ID NO: 277471 - RNA, 64 nt, Homo Sapiens
aguagcguagcgugcccgugugcauguccuuugcgccugugaccaccaccccaacaaaccaucc

SEQ ID NO: 277472 - RNA, 64 nt, Homo Sapiens
agagaccaggcugugucccucuucucuucccugcgccugugaugcugggcacuucaucugaucg

SEQ ID NO: 277473 - RNA, 64 nt, Homo Sapiens
guucauuguagguaaggacaauuucuaggugggugccugugauguaaaugaccacaguaccuua

SEQ ID NO: 277474 - RNA, 64 nt, Homo Sapiens
uucuaaccuggccucacgcuugccugcugccaaggccugugacucuaugacaguaaaggcucuc

SEQ ID NO: 277475 - RNA, 64 nt, Homo Sapiens
uauuugcuuuccuagaggggagaucugcagagaugccugugagagauugcuggacccagaggca

SEQ ID NO: 277476 - RNA, 64 nt, Homo Sapiens
guagugagugccccaucacuauguuugaauggcugccugugaagccagcagcugaaacucuuca

SEQ ID NO: 277477 - RNA, 64 nt, Homo Sapiens
ugcuuugaaaauuuuuauuuugcuuagcucuuuggccugugagagaaugucugagugagggucc

SEQ ID NO: 277478 - RNA, 64 nt, Homo Sapiens
ggagcccucgaccccgugacggagacccuguaaggccugugagcuugaagcuggggugaccgca

SEQ ID NO: 277479 - RNA, 64 nt, Homo Sapiens
acacaggcagcccggcccaguggauaaauaaacagccugugagcgucucucuccuccuuacucu

SEQ ID NO: 277480 - RNA, 64 nt, Homo Sapiens
ggguggccuuccugcugcccacagaguggacucugccugugauggcccaggacccagacgcagg

SEQ ID NO: 277481 - RNA, 64 nt, Homo Sapiens
gggguccugaggcuggggcuccccacccccgggugccugugaccucugaacugcugcuggucac

SEQ ID NO: 277482 - RNA, 64 nt, Homo Sapiens
gacaucgguucaggaggagaauggcguguccccugccugugagucccagaggggcggggccagg

SEQ ID NO: 277483 - RNA, 64 nt, Homo Sapiens
cuucaguguagcccauucuugauccagagcuguugccugugacagcgguuucucuggaugucaa

SEQ ID NO: 277484 - RNA, 64 nt, Homo Sapiens
ugacugugacuguugcccuuagccagccagaugcgccugugaaccaaagcuucgugcacaugug

SEQ ID NO: 277485 - RNA, 64 nt, Homo Sapiens; identical to SEQ ID NO: 182019

SEQ ID NO: 277486 - RNA, 64 nt, Homo Sapiens; identical to SEQ ID NO: 182020

SEQ ID NO: 277487 - RNA, 64 nt, Homo Sapiens; identical to SEQ ID NO: 182021

SEQ ID NO: 277488 - RNA, 64 nt, Homo Sapiens; identical to SEQ ID NO: 182022

SEQ ID NO: 277489 - RNA, 64 nt, Homo Sapiens; identical to SEQ ID NO: 182023

SEQ ID NO: 277490 - RNA, 64 nt, Homo Sapiens; identical to SEQ ID NO: 182024

SEQ ID NO: 277491 - RNA, 64 nt, Homo Sapiens; identical to SEQ ID NO: 182025

SEQ ID NO: 277492 - RNA, 64 nt, Homo Sapiens; identical to SEQ ID NO: 182026

SEQ ID NO: 277493 - RNA, 64 nt, Homo Sapiens; identical to SEQ ID NO: 182027

SEQ ID NO: 277494 - RNA, 64 nt, Homo Sapiens; identical to SEQ ID NO: 182028

SEQ ID NO: 277495 - RNA, 64 nt, Homo Sapiens; identical to SEQ ID NO: 182029

SEQ ID NO: 277496 - RNA, 64 nt, Homo Sapiens; identical to SEQ ID NO: 182030

SEQ ID NO: 277497 - RNA, 64 nt, Homo Sapiens; identical to SEQ ID NO: 182031

SEQ ID NO: 277498 - RNA, 64 nt, Homo Sapiens; identical to SEQ ID NO: 182032

SEQ ID NO: 277499 - RNA, 64 nt, Homo Sapiens; identical to SEQ ID NO: 182033

SEQ ID NO: 277500 - RNA, 64 nt, Homo Sapiens; identical to SEQ ID NO: 182034

SEQ ID NO: 277501 - RNA, 64 nt, Homo Sapiens; identical to SEQ ID NO: 182035

SEQ ID NO: 277502 - RNA, 64 nt, Homo Sapiens; identical to SEQ ID NO: 182036

SEQ ID NO: 277503 - RNA, 64 nt, Homo Sapiens; identical to SEQ ID NO: 182037

SEQ ID NO: 277504 - RNA, 64 nt, Homo Sapiens; identical to SEQ ID NO: 182038

SEQ ID NO: 277505 - RNA, 64 nt, Homo Sapiens; identical to SEQ ID NO: 182039

SEQ ID NO: 277506 - RNA, 63 nt, Homo Sapiens; identical to SEQ ID NO: 182040

SEQ ID NO: 277507 - RNA, 62 nt, Homo Sapiens
gaagccccgcugcugagaugggcgcucccgacacagcgcagacccaccaggaggaaagaggc

SEQ ID NO: 277508 - RNA, 62 nt, Homo Sapiens
gugaauggugagggugggagucaggagacaagacagcgcagagagggcugguuagccggaaa

SEQ ID NO: 277509 - RNA, 62 nt, Homo Sapiens
ugcauucuggccacuuugacuugcacaguguaacagcgcaguacaagacaguugacuugauu

SEQ ID NO: 277510 - RNA, 62 nt, Homo Sapiens
uucuaccugaaauuggaagacacacaggggcuacagcgcauuccagaacuucguacccuuug

SEQ ID NO: 277511 - RNA, 62 nt, Homo Sapiens
ccuuuuuucuuuaaggcucccaacaaugcuauacagcgcaguuguuuccauuccuauuuuua

SEQ ID NO: 277512 - RNA, 62 nt, Homo Sapiens
ccugaugauaauggugcuuggaaaucaagcaaacagcgcacaucaacuucugacucugaggg

SEQ ID NO: 277513 - RNA, 62 nt, Homo Sapiens
gcgaccuccaccaccccugccaugugguggggacagcgcauugugcggaggcaagcaagcuc

SEQ ID NO: 277514 - RNA, 62 nt, Homo Sapiens
aauaaagcuacgaugccaacgccuucacccucacagcgcacaagaaaaguugaugauagauu

SEQ ID NO: 277515 - RNA, 62 nt, Homo Sapiens
ugugcucuggugacccgaggaggucgugcagcacagcgcagaagccccugcccacgggaucc

SEQ ID NO: 277516 - RNA, 62 nt, Homo Sapiens
agggucacugucauucccuggccauguugcaaacagcgcaauuccaagcucgagagcuucag

SEQ ID NO: 277517 - RNA, 62 nt, Homo Sapiens
cuucuguagacauuugcucacagacauauagaacagcgcauuaguuaagugcagauuccuua

SEQ ID NO: 277518 - RNA, 62 nt, Homo Sapiens
augaagggccaggcuuacugcagaggaagaacacagcgcagauaagagguauuggauuuuca

SEQ ID NO: 277519 - RNA, 62 nt, Homo Sapiens
uccugaggacuucugcggcuguacagagccugacagcgcagcauagaaacauuuagcaguac

SEQ ID NO: 277520 - RNA, 62 nt, Homo Sapiens
gcugcucugugaccagggaccucggcacuuugacagcgcacacuggaguaccuguaacagcg

SEQ ID NO: 277521 - RNA, 62 nt, Homo Sapiens
aaacuccauauauguuagucuuccuuuaucuuacagcgcagcauuuauuuuaugauauaaug

SEQ ID NO: 277522 - RNA, 62 nt, Homo Sapiens
ucagcugccaugucuuugaggacucggaacccacagcgcaaucccugguccacuggaggaug

SEQ ID NO: 277523 - RNA, 62 nt, Homo Sapiens
ggcuccaccccaucucugccgccaacaggaccacagcgcacugauuggccccacaucaccac

SEQ ID NO: 277524 - RNA, 62 nt, Homo Sapiens
gcauaugagcacacaaauggacaauaaaugccacagcgcaaaagcguguagcgagccugcca

SEQ ID NO: 277525 - RNA, 62 nt, Homo Sapiens
ccacgauuuuuuuccacaucugucugugagacacagcgcaaugcuacugcccuuccagaaac

SEQ ID NO: 277526 - RNA, 62 nt, Homo Sapiens
ggaaacaggccagcccagugccacuccuccccacagcgcagacaugagaguacuagccuccu

SEQ ID NO: 277527 - RNA, 62 nt, Homo Sapiens
ggaggaugggugccagaggggcucccucgugcacagcgcaggaggacagcgccucuugggcu

SEQ ID NO: 277528 - RNA, 62 nt, Homo Sapiens
cgugugugcugauuugaguggcuuagcuugccacagcgcagccucuucugucccuuucaguc

SEQ ID NO: 277529 - RNA, 62 nt, Homo Sapiens
cuggugcagcguaaggacgaugcugaugagagacagcgcauggggagccgcuucuccaaguc

SEQ ID NO: 277530 - RNA, 62 nt, Homo Sapiens
gaaaauggaaccacccauccaguaggagcuacacagcgcagagucgagaaucgucagcugua

SEQ ID NO: 277531 - RNA, 62 nt, Homo Sapiens
cagcucuggguggggagcaguggccgcuaccgacagcgcaugucccgcucuuauccaacucu

SEQ ID NO: 277532 - RNA, 62 nt, Homo Sapiens
cuguggagcuuuuacucuguaccaccagguagacagcgcaauagccacuguugcugccacug

SEQ ID NO: 277533 - RNA, 62 nt, Homo Sapiens
ugccugggugaugggcaccucucacugaccucacagcgcaguccgcccaucugagcacaggg

SEQ ID NO: 277534 - RNA, 62 nt, Homo Sapiens
ugagaggcaucucccagccccucugcugccggacagcgcacuccagggcaggacgccgcccc

SEQ ID NO: 277535 - RNA, 62 nt, Homo Sapiens
caggaacgggggucuccucucguggcggggcgacagcgcaugcucaccccugcggagagcac

SEQ ID NO: 277536 - RNA, 62 nt, Homo Sapiens
ccgaagcaaaauucuuguauuucaaaguggccacagcgcagaggguuuucuuggcuccccug

SEQ ID NO: 277537 - RNA, 62 nt, Homo Sapiens
agucacggcuuuuguuuuuuaggacuccagguacagcgcagguccuguggaggaguacaugg

SEQ ID NO: 277538 - RNA, 62 nt, Homo Sapiens
gaaggccugucaggugaagucuucagccucccacagcgcagggucccagcaucuccacgcgc

SEQ ID NO: 277539 - RNA, 62 nt, Homo Sapiens
auccgccauggugccacggggaccaggaccccacagcgcacccccccuccccaccaacuucu

SEQ ID NO: 277540 - RNA, 62 nt, Homo Sapiens
cauagaggaaguggugagugcgcugcugggagacagcgcagcgucccugcuggcugaggagc

SEQ ID NO: 277541 - RNA, 62 nt, Homo Sapiens
ugcgguagagaugggaggaaguggcaguuggcacagcgcagagggaccugaguuuggguggg

SEQ ID NO: 277542 - RNA, 64 nt, Homo Sapiens
aaaaugaacuccauugcuuaagaaacacauaaacaccauuuagucacugaacauagcuauaugu

SEQ ID NO: 277543 - RNA, 64 nt, Homo Sapiens
uuaggaaugaauuuaacuguccuuggguuacacuaccauuuauuggaacaagccccagaggcag

SEQ ID NO: 277544 - RNA, 64 nt, Homo Sapiens
gguccuacugcaaaccaccccuccauauuuccguaccauuuacaauucaguuucugugacaucu

SEQ ID NO: 277545 - RNA, 64 nt, Homo Sapiens
uauauucagugaaaagauuuuauuuauggaauuaaccauuuaauaaagaaauauuuaccuaaua

SEQ ID NO: 277546 - RNA, 64 nt, Homo Sapiens
uagaaaguaaccugucuuugaugaugcuucucuuaccauuuaguuuuuguauauuacccugggg

SEQ ID NO: 277547 - RNA, 64 nt, Homo Sapiens
uccucaguuuugccgacugcuuuucaucugagucaccauuuacuccaagcauguauuccagacu

SEQ ID NO: 277548 - RNA, 64 nt, Homo Sapiens
gugaagagacuuguuucaucuccggaaaugcaaaaccauuuauagcaugaagcccuacaugauc

SEQ ID NO: 277549 - RNA, 64 nt, Homo Sapiens
gugucaguguaucauuuaguauuuguaucacuguaccauuuaguguuguauaucacucagucau

SEQ ID NO: 277550 - RNA, 64 nt, Homo Sapiens
gcagauuaucagcucggugacuuuucuuucugccaccauuuaggugaugguguuugauucagag

SEQ ID NO: 277551 - RNA, 64 nt, Homo Sapiens
aauccuuccaaaaauauugauggugauuugugcuaccauuuacucguuuauuuaauaaagacau

SEQ ID NO: 277552 - RNA, 64 nt, Homo Sapiens
gcauacccaggguggccuuuagcacaguaucaguaccauuuauuugucugccgcuuuuaaaaaa

SEQ ID NO: 277553 - RNA, 64 nt, Homo Sapiens
aucaugggaauugcaguuagagagaguaaggaauaccauuuagucaucuauccguucuucacuu

SEQ ID NO: 277554 - RNA, 64 nt, Homo Sapiens
cccaaaucucacuuggcuggaaacaucaaucuuaaccauuuauucagaaccauuaaaccaauga

SEQ ID NO: 277555 - RNA, 64 nt, Homo Sapiens
cuaaauauugcaugcauauugacuaauuggaauaaccauuuacucaauuauggacagcuuauug

SEQ ID NO: 277556 - RNA, 64 nt, Homo Sapiens
uggaacauguuucuuuuugaaagggagagaauugaccauuuauuguugugauguuuaaguuaua

SEQ ID NO: 277557 - RNA, 64 nt, Homo Sapiens
uaaccagggauuuucccauuauguucccuuuuauaccauuuaggugugaguuccuuagcuucug

SEQ ID NO: 277558 - RNA, 64 nt, Homo Sapiens
ugauaaucuuauucacaguuguuauuguuuacagaccauuuaauuaauauuuccucuguuuauu

SEQ ID NO: 277559 - RNA, 64 nt, Homo Sapiens
gucauguguuuccccaaagggaagccagucauugaccauuuaaaaagucuccugcuaaguaugg

SEQ ID NO: 277560 - RNA, 64 nt, Homo Sapiens
aaguaauacaaaaguuuugagcucuuccaaguauaccauuuauauacaaacaaauagguuuauu

SEQ ID NO: 277561 - RNA, 64 nt, Homo Sapiens
uuuucagggucuaccuaacugagccuagauauggaccauuuauggaugacaacaauuuuuuuuu

SEQ ID NO: 277562 - RNA, 64 nt, Homo Sapiens
augcccaggugagugcagagguggcuggguggacaccauuuacacaguggccaggccuugugcc

SEQ ID NO: 277563 - RNA, 64 nt, Homo Sapiens
aaaaauaauuaacacuauuuaauuuuauuucuguaccauuuaaaucccaguuuaguaucuuuug

SEQ ID NO: 277564 - RNA, 64 nt, Homo Sapiens
auuucuaguauuucucugaaaguaauacccuuaaaccauuuauauaguaccugacuaaaaauga

SEQ ID NO: 277565 - RNA, 64 nt, Homo Sapiens
ucaaaugaacccaucaacugacguuagccuccaaaccauuuaaugaaauucaauuuaaaaaauc

SEQ ID NO: 277566 - RNA, 64 nt, Homo Sapiens
uuuauuuaacaguuaucuugaauuguagacacccaccauuuaaagaauugcaggacuauccugu

SEQ ID NO: 277567 - RNA, 64 nt, Homo Sapiens
auguuaguagaaauuuuacauggcaugugcugugaccauuuauaaaaguuuggauuguaucaag

SEQ ID NO: 277568 - RNA, 64 nt, Homo Sapiens
gauucauuuuggaaccauuuuuuuaauuuauauuaccauuuauaauucacuuuaaguucguauu

SEQ ID NO: 277569 - RNA, 64 nt, Homo Sapiens
ccuuccuuguucuaaaacaaauccauaaucagccaccauuuaacucccaaaaucaaaaugguac

SEQ ID NO: 277570 - RNA, 64 nt, Homo Sapiens
ugugugcuaaacaacuacggccucccacaauaagaccauuuaagugcaagaaccuccccuuucc

SEQ ID NO: 277571 - RNA, 64 nt, Homo Sapiens
aaauggggacuucuuuccccccaguaaucccagcaccauuuauuaaucuucugcauauggcuag

SEQ ID NO: 277572 - RNA, 64 nt, Homo Sapiens
agguggacaaaugcuaauaugaagaggaggaaucaccauuuacacuaccccagauauuugugug

SEQ ID NO: 277573 - RNA, 64 nt, Homo Sapiens
aaauaccgaugccuuuguggcugcauauacagguaccauuuaggggaugguauagaaaacaacg

SEQ ID NO: 277574 - RNA, 64 nt, Homo Sapiens
ucuuuguauauguguaaauguauuauuugcuaaaaccauuuaagugauuguguuuuagaaaaau

SEQ ID NO: 277575 - RNA, 64 nt, Homo Sapiens
aauuggaagugauguuggcuacauuucaauguaaaccauuuaugggaugaagacaaauagggau

SEQ ID NO: 277576 - RNA, 64 nt, Homo Sapiens
gaagguuuuacaaauuggaugaagcuggacaaggaccauuuagaaagcgugaaauugaaaaacu

SEQ ID NO: 277577 - RNA, 64 nt, Homo Sapiens
uggcucuuuugucauugugcuauguuaaaauuauaccauuuaacguauggauucacuuuuuacu

SEQ ID NO: 277578 - RNA, 64 nt, Homo Sapiens
cugaaggacccuauauuauagcagaguucuucucaccauuuaaauauuuuuguucugcaggcuu

SEQ ID NO: 277579 - RNA, 64 nt, Homo Sapiens
ucugggccacuuaauggcuggcaucuucuguaggaccauuuaagcugacuuuuuucucacuguu

SEQ ID NO: 277580 - RNA, 64 nt, Homo Sapiens
augggcaauguauuuuacgccuuuaagaccucaaaccauuuagaaaaaaccccuggaagagacu

SEQ ID NO: 277581 - RNA, 64 nt, Homo Sapiens
augccccguaaaugucuucacuaguauuuaagauaccauuuaauagacauuaugagguauacaa

SEQ ID NO: 277582 - RNA, 64 nt, Homo Sapiens
cagaaauuaaaauaucacccucacacacaguucaaccauuuaacaguucuuuagagcauuugcu

SEQ ID NO: 277583 - RNA, 64 nt, Homo Sapiens
cagugggaggauucgauggccaacuguagggaacaccauuuaugaaggagcaaugcugggauug

SEQ ID NO: 277584 - RNA, 64 nt, Homo Sapiens
uucauguauaucuaacuucgucuuaaacagcaccaccauuuaaugauuagaccaauuacugcac

SEQ ID NO: 277585 - RNA, 64 nt, Homo Sapiens
uuguuaaauuaucucuaggacaaaucacuacuagaccauuuaauugggcagggcuuuuuaguau

SEQ ID NO: 277586 - RNA, 64 nt, Homo Sapiens
uaaugugaaguuuuggaaagaaguuucaagcaagaccauuuacucacuagagggaagucuucuc

SEQ ID NO: 277587 - RNA, 64 nt, Homo Sapiens
gaguguuauuuaaugcuaagugcuucauagguguaccauuuaaacuggguuuauauuuaacucu

SEQ ID NO: 277588 - RNA, 64 nt, Homo Sapiens
accaauaacuuuuaguuaauauuguaaaacagucaccauuuacuauugucaauaacgaaaccua

SEQ ID NO: 277589 - RNA, 64 nt, Homo Sapiens
acauaaagucauuauauuaauuaaaagaaaaaacaccauuuaauauguucugaaaacauuacuc

SEQ ID NO: 277590 - RNA, 64 nt, Homo Sapiens
uuuuguacaaaaacuaauucuuuugguaaaaugaaccauuuacaguucgguuuuggacucugag

SEQ ID NO: 277591 - RNA, 64 nt, Homo Sapiens
agucaguacuuuuuucucauguaucuuucucuagaccauuuauauacgggugaaaugaaagcuu

SEQ ID NO: 277592 - RNA, 64 nt, Homo Sapiens
uaaaugaagucuugugaauuuguaauagaucaguaccauuuauugguuuggggaccaucuuaau

SEQ ID NO: 277593 - RNA, 64 nt, Homo Sapiens
uauauguuauuuggcgagacaucaaauaaaguuaaccauuuaaaaauuauuuucauauacuguu

SEQ ID NO: 277594 - RNA, 64 nt, Homo Sapiens
ucuucuguggucgcccgcccccccccaaaaaaauaccauuuaugguucucuccgcaaguauaaa

SEQ ID NO: 277595 - RNA, 64 nt, Homo Sapiens
uaggagcauggauguauaaggcagguuuuauacaaccauuuagauucaacauuaaugguagagu

SEQ ID NO: 277596 - RNA, 64 nt, Homo Sapiens
gguaaaugagcuugcaauguguuaaagaagauuaaccauuuaaaggcauguguuccauagccaa

SEQ ID NO: 277597 - RNA, 64 nt, Homo Sapiens
ugcccauuuugaaauugccuauacagucuuagugaccauuuaaaccggacgaacuagguguuua

SEQ ID NO: 277598 - RNA, 64 nt, Homo Sapiens
cucuuucuacauauggcuagccaguuuucccagcaccauuuauuaaauagggaauccuuucccc

SEQ ID NO: 277599 - RNA, 64 nt, Homo Sapiens
gcugugaucuuacaaguuagauguuacuauaccuaccauuuauucagcuggauugcugaacaca

SEQ ID NO: 277600 - RNA, 64 nt, Homo Sapiens
uuuaaaaucauuguuaaauugauugaggaaaacaaccauuuaaaaaaaaucuauguugaauccu

SEQ ID NO: 277601 - RNA, 64 nt, Homo Sapiens
auggagucuccaccuuuggacacaacacuuacucaccauuuacucuuuaucacucugcaacaaa

SEQ ID NO: 277602 - RNA, 64 nt, Homo Sapiens
uuauuaaauauuaaaauaucuauuuauuauuaaaaccauuuauaaggcuuuuucauaaauguau

SEQ ID NO: 277603 - RNA, 64 nt, Homo Sapiens
auggcuuuguaacaauugcaaguacauuuuauaaaccauuuacugcagaguaacauaaaauaaa

SEQ ID NO: 277604 - RNA, 64 nt, Homo Sapiens
uguguuuugcuuaaaguauuuccucauaugaauaaccauuuauagauuuacuacuaggaaaccu

SEQ ID NO: 277605 - RNA, 64 nt, Homo Sapiens
aauauucuucugaacucaucaaauaguuuucucaaccauuuaaaaagguuauuccaguaaaagg

SEQ ID NO: 277606 - RNA, 64 nt, Homo Sapiens
auuguguuuuagaucuacagucuuacaucuuuauaccauuuacaugacuuuaucacaauaugau

SEQ ID NO: 277607 - RNA, 64 nt, Homo Sapiens
uuaugacauuuuacaauguauuauaaaguuuuguaccauuuauuguauauagccggauuaacgg

SEQ ID NO: 277608 - RNA, 64 nt, Homo Sapiens
ucauaauuagaacaauagcuuuaaauaaauucaaaccauuuaauuagucaauuaguacaguagc

SEQ ID NO: 277609 - RNA, 64 nt, Homo Sapiens
acauuuacacuuucuuauuuucacacuaguauauaccauuuaauucuaucaauauugauagaag

SEQ ID NO: 277610 - RNA, 64 nt, Homo Sapiens
uacuauuugaaaaaagaagauaaguuccaaaaauaccauuuaucgaccaguucuuggccuauga

SEQ ID NO: 277611 - RNA, 64 nt, Homo Sapiens
gacucuaagccagaauggaagaaaacaccugaccaccauuuaagaagguccacuggacaguugg

SEQ ID NO: 277612 - RNA, 64 nt, Homo Sapiens
gucuggcuuugcccuuaaaaaccuugggcauuuaaccauuuacuguacuugagcuguaggacaa

SEQ ID NO: 277613 - RNA, 64 nt, Homo Sapiens
guugaauaaguagagaaaauaaaauagauucugaaccauuuauuucagggaaaaaugaggaaaa

SEQ ID NO: 277614 - RNA, 64 nt, Homo Sapiens
aauuuucugaaugguaauaauuacauuuuuccucaccauuuagcuaagcauuguuuuaugaauu

SEQ ID NO: 277615 - RNA, 64 nt, Homo Sapiens
aaguauuuucugaguguugagaagaaugaguuaaaccauuuaaacacauuugaaacauacaaaa

SEQ ID NO: 277616 - RNA, 64 nt, Homo Sapiens
ucuuccuaaaucaaggaaaggaaaucauccccagaccauuuaugcugagcuuuggaauacuauu

SEQ ID NO: 277617 - RNA, 64 nt, Homo Sapiens
auauauggugcucacuuuaggaucagcaguguugaccauuuaugcugcauagcuguauuauagc

SEQ ID NO: 277618 - RNA, 64 nt, Homo Sapiens
uaucuucucuauucuauucuacuuccuccauuucaccauuuauacaaagucauucaaaaaggcu

SEQ ID NO: 277619 - RNA, 64 nt, Homo Sapiens
guguguggggaggggggcugguuuacaauauuaaaccauuuaaaguauuuuauucuacaaaugg

SEQ ID NO: 277620 - RNA, 64 nt, Homo Sapiens
uacgcugacaaucaguuaaacacaccggagaagaaccauuuacaugcaccuuauauuucugugu

SEQ ID NO: 277621 - RNA, 64 nt, Homo Sapiens
cuagaagcagaggcacuuaaaacauguaccaggaaccauuuaacaaagaauauaaaaugucaca

SEQ ID NO: 277622 - RNA, 64 nt, Homo Sapiens
cugugcccacacuuaaugucaaucuauaauuuuaaccauuuauccaagauucuacuaaguguaa

SEQ ID NO: 277623 - RNA, 64 nt, Homo Sapiens
uaucaaguuugggucugugcugcuguuacuguuaaccauuuaaguggggcaaaaccuugcuaau

SEQ ID NO: 277624 - RNA, 64 nt, Homo Sapiens
uuuaaauauaugcuuuucuagaauuugauguuugaccauuuaugacuuaauuaccagagagcca

SEQ ID NO: 277625 - RNA, 64 nt, Homo Sapiens
ccucauucucucguuuccccuuuagcucccuuucaccauuuauucagcuacaucaucccucuau

SEQ ID NO: 277626 - RNA, 64 nt, Homo Sapiens
ccuuuuuuuaucguuuuuguauuuucaugaaaauaccauuuaguaagaauaccacaucaaauaa

SEQ ID NO: 277627 - RNA, 64 nt, Homo Sapiens
auuugauuuguaaauuuacuuauguuaaaaauaaaccauuuauuuucagcuuugaauuuuauuu

SEQ ID NO: 277628 - RNA, 64 nt, Homo Sapiens
auuugcuguucuguaagagugcuucacagagacaaccauuuauguaucgaaugcaaagcuacug

SEQ ID NO: 277629 - RNA, 64 nt, Homo Sapiens
acuucugaauuuaaaaaguuaauuaagcacccauaccauuuauaaaaauugcaggugauuugau

SEQ ID NO: 277630 - RNA, 64 nt, Homo Sapiens
ugcaaaugacugucagauucuccaugguuuccuuaccauuuauagcuagcugaucucauuuccu

SEQ ID NO: 277631 - RNA, 64 nt, Homo Sapiens
uuacauauucguuuucaauauuagucagggcaaaaccauuuacucauaaaauacugaggcugau

SEQ ID NO: 277632 - RNA, 64 nt, Homo Sapiens
aacucagacaagauuauauuaaaaagaaaaacagaccauuuaaagcaucuaauccuacauaaug

SEQ ID NO: 277633 - RNA, 64 nt, Homo Sapiens
cugaacaacaccauuugagaaaaucuaaagaucaaccauuuauccucuuagcacgcaaaagcca

SEQ ID NO: 277634 - RNA, 64 nt, Homo Sapiens
cagcaccuguuaugcaccaguccuaacugcagccaccauuuauuggucucucccagcucucgaa

SEQ ID NO: 277635 - RNA, 64 nt, Homo Sapiens
aauuauuccuucaguuggcuccuuaaagguaaugaccauuuauauacauuguauucagcuagcc

SEQ ID NO: 277636 - RNA, 64 nt, Homo Sapiens
aucaagaaaaguguaagaaaauauauagccaggaaccauuuaucacuauguuaauaccuauaaa

SEQ ID NO: 277637 - RNA, 64 nt, Homo Sapiens
ugguuucuuaagagccgucaaaagaagacuucaaaccauuuaacgcagggugaguucucuccuc

SEQ ID NO: 277638 - RNA, 64 nt, Homo Sapiens
ugcuacaaauuagucugauuuauggauaaacauuaccauuuauaaccccugaauuccaaaauau

SEQ ID NO: 277639 - RNA, 64 nt, Homo Sapiens
ugacacuagauacaguaaauuuuuagaaaaaaauaccauuuacaguauuauugugaaccauuua

SEQ ID NO: 277640 - RNA, 64 nt, Homo Sapiens
uuagaaaaaaauaccauuuacaguauuauugugaaccauuuaacccuuuugauccaaggccccg

SEQ ID NO: 277641 - RNA, 64 nt, Homo Sapiens
guucuaguccacauauaaggguaggguugggauuaccauuuacugaccacaucugugaggugcc

SEQ ID NO: 277642 - RNA, 64 nt, Homo Sapiens
augauacaaccaugauuugcaacuguaacaggagaccauuuauuauaagcguaccuguuuguga

SEQ ID NO: 277643 - RNA, 64 nt, Homo Sapiens
cuuagauaaagagagaauauuguaugggccaucaaccauuuacuuuucccugaauguuagaaac

SEQ ID NO: 277644 - RNA, 64 nt, Homo Sapiens
gaucauagaauugcagucauuuggugcucugcuaaccauuuauauaaaacuuaaaaacaagaga

SEQ ID NO: 277645 - RNA, 64 nt, Homo Sapiens
auaggucagucaaguugguaaugccuguccauuaaccauuuaugcauacuaauaaaauuauaag

SEQ ID NO: 277646 - RNA, 64 nt, Homo Sapiens
aaaaaaucuuaaagccuguagacaugcccauucuaccauuuaaacauuuauuggcuaacugcau

SEQ ID NO: 277647 - RNA, 64 nt, Homo Sapiens
ugugguauuaaaaauuaaugucgggucgcaguucaccauuuauaguagguaaaaauauauaccu

SEQ ID NO: 277648 - RNA, 64 nt, Homo Sapiens
aagcauuuaccaugugcuaauuaauaauaaagcuaccauuuaucguuaggucuuaggaauugaa

SEQ ID NO: 277649 - RNA, 64 nt, Homo Sapiens
gucaucuaccugaaaacaguuaaaauuaaccuuuaccauuuaauugaaucaugucagaacugcu

SEQ ID NO: 277650 - RNA, 64 nt, Homo Sapiens
uacaauuuuuagccagaaaauaacagaguaacauaccauuuaauauuuuuuguuuguuuaguua

SEQ ID NO: 277651 - RNA, 64 nt, Homo Sapiens
ggaaauuucuagauauagaaggaaauugcuuuaaaccauuuaaaucucuuauuaauaaaacuuu

SEQ ID NO: 277652 - RNA, 64 nt, Homo Sapiens
auuuuuaaaacaucaaaauugguaaguccuuuaaaccauuuaggaacuggguuaaucaagucuc

SEQ ID NO: 277653 - RNA, 64 nt, Homo Sapiens
ugggauuaugguuuugugauaacugcauuuuuagaccauuuaucuugauauacacggaugacuu

SEQ ID NO: 277654 - RNA, 64 nt, Homo Sapiens
aacuuuuaaacuuuuuuaugaauuccuaaacauuaccauuuauguggcagaaguucuguucccu

SEQ ID NO: 277655 - RNA, 64 nt, Homo Sapiens
ugcauaaaaguuaacauuaggcuguggugcaguaaccauuuaaugucgaggcucuauuucggaa

SEQ ID NO: 277656 - RNA, 56 nt, Homo Sapiens
aucaaacugcuacugguuaaaggaccaccauuuaauuaacaugauucgaaagccuu

SEQ ID NO: 277657 - RNA, 64 nt, Homo Sapiens
ugaauaauuuucacucauuuauugucuucuggaaaccauuuaacuuuuacuguuuuuuauuuuu

SEQ ID NO: 277658 - RNA, 64 nt, Homo Sapiens
aaacaaaaugaacacugcuugucuucuuccauugaccauuuaguguugaguacuguauguguuu

SEQ ID NO: 277659 - RNA, 64 nt, Homo Sapiens
ccaaaugcuauuuuucaaugcauuuggacugcugaccauuuaaaagcagccuaugauugcuucu

SEQ ID NO: 277660 - RNA, 64 nt, Homo Sapiens
uaauguauuaaucuguuugugcaaacauaauaccaccauuuaaaaauguuagggagaugaguug

SEQ ID NO: 277661 - RNA, 64 nt, Homo Sapiens
uugcccauauuaaaaagccacaguagcuuccuagaccauuuacugcugagaauccccgugcuca

SEQ ID NO: 277662 - RNA, 64 nt, Homo Sapiens
uuguuuaaaaugcuguacugagagcugaaaugagaccauuuacuguggauuaugcuuaacagug

SEQ ID NO: 277663 - RNA, 64 nt, Homo Sapiens
aucucccuccagccccaacgugugugcucccuuuaccauuuacuugauacacaaaagugcacac

SEQ ID NO: 277664 - RNA, 64 nt, Homo Sapiens
gaaagaaugcauuccagaacauuacccaaauauaaccauuuaaauccucguccauuuuauuagg

SEQ ID NO: 277665 - RNA, 64 nt, Homo Sapiens
uugaauuaaugcuugguagcgauguuguagugacaccauuuacaugccuagcacugcucuuuuu

SEQ ID NO: 277666 - RNA, 64 nt, Homo Sapiens
uucagcaguuguuaauguuugcacauguauaucuaccauuuagaauugaaaaacuguuugguaa

SEQ ID NO: 277667 - RNA, 64 nt, Homo Sapiens
auucugaauuuuaaaguuggcuacuacuguugucaccauuuaugugacuauuuuugguucaaua

SEQ ID NO: 277668 - RNA, 64 nt, Homo Sapiens
auaucagaaaguauauguacgcuugcuugugguaaccauuuauaauuucugaauauguuacuga

SEQ ID NO: 277669 - RNA, 64 nt, Homo Sapiens
uguagaauuugaaaugguuguuuccaugggccccaccauuuaugguaccauauucagcauuuga

SEQ ID NO: 277670 - RNA, 64 nt, Homo Sapiens
agacauucuugcuauaacuaugucucuaucagauaccauuuauguuuuuauuccccacuacucu

SEQ ID NO: 277671 - RNA, 64 nt, Homo Sapiens
aaaucagaauguuuauacaaaaauauauauucauaccauuuauuucuuuauuguaaaguaugca

SEQ ID NO: 277672 - RNA, 64 nt, Homo Sapiens
guuuuuuucuguagcaccaggauacacuugaaggaccauuuacuuucucucucaguucuacacu

SEQ ID NO: 277673 - RNA, 64 nt, Homo Sapiens
cuccuuucaucguccccggguguccaccuugggcaccauuuaucgagcagcaggaaggcaccgc

SEQ ID NO: 277674 - RNA, 64 nt, Homo Sapiens
acuacuuuucuuauagguaguuugauuccuuuuaaccauuuaagcgcacacuaaacuuugguau

SEQ ID NO: 277675 - RNA, 64 nt, Homo Sapiens
uguaccaacucaccuuaaaucccaucccaaauugaccauuuagauaguggcagcugaccaaucc

SEQ ID NO: 277676 - RNA, 64 nt, Homo Sapiens
ugguguaaagaacuuaauuuagugguuguggacaaccauuuacuaguucauauguacacuagcc

SEQ ID NO: 277677 - RNA, 64 nt, Homo Sapiens
uuagaacacucaacaacuauuuaagaaauagauaaccauuuauuauuucuaauuugaaaggcag

SEQ ID NO: 277678 - RNA, 64 nt, Homo Sapiens
gaaaugcacugugggguuuuuuccuguaugggaaaccauuuaugccaagcuuuuccccauuucc

SEQ ID NO: 277679 - RNA, 64 nt, Homo Sapiens
gacaucagcaacuuuugaaaacuucacacuuguuaccauuuagaaguuuccuggaaaauauaug

SEQ ID NO: 277680 - RNA, 64 nt, Homo Sapiens
ugagauaucaggaaugucucaugauaucacguuuaccauuuacaccaucugcaaccauaugcua

SEQ ID NO: 277681 - RNA, 64 nt, Homo Sapiens
uucccuuacccagaaaugaaaauacucaauauggaccauuuaggaauuauaagcagcaacugug

SEQ ID NO: 277682 - RNA, 64 nt, Homo Sapiens
uaauagauguccguacaaguagcgcauauauuuaaccauuuaguuuggggcucuauauuacuug

SEQ ID NO: 277683 - RNA, 64 nt, Homo Sapiens
uuccagcaccaagcaaacuacugguaacaguuccaccauuuaggcagacccauuggauuugcug

SEQ ID NO: 277684 - RNA, 64 nt, Homo Sapiens
agaacauuuuucucuccaacgauuuggaaaguuaaccauuuaaacggagacgcgucagauggca

SEQ ID NO: 277685 - RNA, 64 nt, Homo Sapiens
gaaugcauacucugugcaaguuggagauuaaucuaccauuuauuuacaaagcuugggacaguua

SEQ ID NO: 277686 - RNA, 64 nt, Homo Sapiens
uuguguuaacuaugaaccaaucacauucucuagaaccauuuaguuaauguuagaguucauguaa

SEQ ID NO: 277687 - RNA, 64 nt, Homo Sapiens
gaguuuuaaugggaguaggacauugguaacagcuaccauuuauaauuaacaguauuaauagcga

SEQ ID NO: 277688 - RNA, 64 nt, Homo Sapiens
uauuguguauauguuuuuauaauucacuuauaaaaccauuuacaagaaaauguacauucuaauu

SEQ ID NO: 277689 - RNA, 64 nt, Homo Sapiens
agugguuguaucugaauuuaaauagauguaugguaccauuuaaagccuauuuuucaaauuauuu

SEQ ID NO: 277690 - RNA, 64 nt, Homo Sapiens
cacaaauuugcugcacagaaaguucacaauuuucaccauuuaaacugaagcaugauaaaggggc

SEQ ID NO: 277691 - RNA, 64 nt, Homo Sapiens
auuuaaaaaauuauguuccauauuaaccuauauaaccauuuaaauuuugaaaagcaaaaaauac

SEQ ID NO: 277692 - RNA, 64 nt, Homo Sapiens
gaaauucacuucauuguaccuaugauguauuugaaccauuuagauauuccaagagccaucuccu

SEQ ID NO: 277693 - RNA, 64 nt, Homo Sapiens
gcuggcaccagagacccgauuacaagaaaguuauaccauuuaaauguggugguguucuguuggu

SEQ ID NO: 277694 - RNA, 64 nt, Homo Sapiens
uauguacaaauaaguuaauauuuuucacacugaaaccauuuaagaaugcuaggucagaagcugc

SEQ ID NO: 277695 - RNA, 64 nt, Homo Sapiens
uagcagaaccacauauuuuaaaggcuguuugagaaccauuuacuccuuaugagcaggaagaggg

SEQ ID NO: 277696 - RNA, 64 nt, Homo Sapiens
ucuucuaaucaucuauguguguaugauggaugugaccauuuauaugucauguguugaaauuaaa

SEQ ID NO: 277697 - RNA, 64 nt, Homo Sapiens
gaaggaaguaauguuaccuauccuugauaccaugaccauuuauuagauguuuugcuauauaaau

SEQ ID NO: 277698 - RNA, 64 nt, Homo Sapiens
uugaugccaagugaauauaagagcuuguacugaaaccauuuauuucuuucuauuuugcuauuug

SEQ ID NO: 277699 - RNA, 64 nt, Homo Sapiens
aaauuuuauucaaaggaauuguaaaccuuaaaccaccauuuauuuccaugugaaaaaguguuau

SEQ ID NO: 277700 - RNA, 64 nt, Homo Sapiens
aaaagauuaagcaagugaaauucugcugcccuccaccauuuauuuuuacagugcuuuguaauuu

SEQ ID NO: 277701 - RNA, 64 nt, Homo Sapiens
guaggcugcuaccuaacuuuuagucccuuccaaaaccauuuaguaggguucuauuacauaaaca

SEQ ID NO: 277702 - RNA, 64 nt, Homo Sapiens
aacagauuacacaaaaauuauuuccagaaaggcuaccauuuaucaucauuauauuucaagccuc

SEQ ID NO: 277703 - RNA, 64 nt, Homo Sapiens
ggccuuguucuguucucuggaacuaaacagaacaaccauuuaccccuccuuuucaaacuagaga

SEQ ID NO: 277704 - RNA, 64 nt, Homo Sapiens
cuuucauuuauaguugggaauggagagcagcacuaccauuuauuacggagcagugccuaguauc

SEQ ID NO: 277705 - RNA, 64 nt, Homo Sapiens
cauaaaauggacaacugagauagaccuuaguaaaaccauuuaacggaguuagaaaugaauuuuu

SEQ ID NO: 277706 - RNA, 64 nt, Homo Sapiens
acuuuccugagccauuaucaaucuagucuguuacaccauuuagauucuuuggaacuuuaauaag

SEQ ID NO: 277707 - RNA, 64 nt, Homo Sapiens
cuguuuucuuauagucuuaacauuauugaauuauaccauuuacuuagugucauuuuauuuuagu

SEQ ID NO: 277708 - RNA, 64 nt, Homo Sapiens
acauaaucucuagugaucauuggcuugaauuuuaaccauuuauucaggcuggaccugcaagaug

SEQ ID NO: 277709 - RNA, 64 nt, Homo Sapiens
uaaaauacgacacccaguauuuucuuuaaguuucaccauuuacgcuacaugugauuuuuuuaau

SEQ ID NO: 277710 - RNA, 64 nt, Homo Sapiens
uucaaaagugaacaauccugugauaaguuggaguaccauuuaguaauacagcaacauuguguca

SEQ ID NO: 277711 - RNA, 64 nt, Homo Sapiens
acaugucacuugugcuuuaaaauuagucuguaucaccauuuauuacaguuauaauuuuggaguu

SEQ ID NO: 277712 - RNA, 64 nt, Homo Sapiens
aauuuucaugugucaugaaauacuguuuucuccaaccauuuaauaauguaaauacuugcuagcu

SEQ ID NO: 277713 - RNA, 64 nt, Homo Sapiens
cuuuuuuuuuuuuuaaauuuauuuuuauuccaucaccauuuaccacacuucccuugaucugcuu

SEQ ID NO: 277714 - RNA, 64 nt, Homo Sapiens
uauaugugcuaggcaaaucucagugcagaugagcaccauuuaguaucacguaagugugugagug

SEQ ID NO: 277715 - RNA, 64 nt, Homo Sapiens
guaaaauagcuuggauucaaugcaaagcaaaaggaccauuuaaauggccaagcgaggucucagg

SEQ ID NO: 277716 - RNA, 64 nt, Homo Sapiens
uuacacugaucaauuucaacccagccuaaaaaccaccauuuaacguacagcuuaaaucaugggu

SEQ ID NO: 277717 - RNA, 64 nt, Homo Sapiens
ggucauuuaaauaacaaaauuucauugcacauuaaccauuuagagaguuucagaacaaaagaua

SEQ ID NO: 277718 - RNA, 64 nt, Homo Sapiens
auaauaauagcgccauauucgugaauuaaaaaccaccauuuauauaaauuccaccuaucuuaau

SEQ ID NO: 277719 - RNA, 64 nt, Homo Sapiens
uauccuuuauaaggaauguggucauccuaaguauaccauuuauguguuuaaauucuuaauauua

SEQ ID NO: 277720 - RNA, 64 nt, Homo Sapiens
cauagaggaagggcuuauggaaagcuggccgagaaccauuuauaccucagaacaaagauuggaa

SEQ ID NO: 277721 - RNA, 64 nt, Homo Sapiens
uagugaauuauuaaaaaucuucaugaaacaaaagaccauuuaaauuuaguauuguuguaaaacu

SEQ ID NO: 277722 - RNA, 64 nt, Homo Sapiens
cagaaggaucagacaauaaaaugaguuagugcaaaccauuuaguaaaaauaacuaucagcagag

SEQ ID NO: 277723 - RNA, 64 nt, Homo Sapiens
uguucucagaacauuuagccugcaguugggcaaaaccauuuaacacaaagccuauuuuauaaug

SEQ ID NO: 277724 - RNA, 64 nt, Homo Sapiens
gugucugugguagcuuuuaggcugcuccuaacccaccauuuauugccuucugagagguggguga

SEQ ID NO: 277725 - RNA, 64 nt, Homo Sapiens
aaucauguuuuuauauaaauguuuauacuagacuaccauuuaaaaacagcauuacaaaauccua

SEQ ID NO: 277726 - RNA, 64 nt, Homo Sapiens
acaagacuuccuuauuuaucccccaccccugggcaccauuuaggcucuccuucaacauccucac

SEQ ID NO: 277727 - RNA, 64 nt, Homo Sapiens
aaaaauguauacuaccuuaauuaauuuguuuuucaccauuuagcgaggccauuuagaugauuag

SEQ ID NO: 277728 - RNA, 64 nt, Homo Sapiens
aaaauugugugaugaaugaaguaauauacuuuguaccauuuauagcccuucuguauuuuaaaau

SEQ ID NO: 277729 - RNA, 64 nt, Homo Sapiens
aaaacaaccaucugagacacuaaaguauggcccgaccauuuaaguucauuuccauaaaccaagu

SEQ ID NO: 277730 - RNA, 64 nt, Homo Sapiens
aaggguaaacaaaaaacuaaaacuuauacaagauaccauuuacacugaacauagaauucccuag

SEQ ID NO: 277731 - RNA, 64 nt, Homo Sapiens
cuuccagaucgugaggcuggggagcauucuagguaccauuuauuaucuacugcguuucggucag

SEQ ID NO: 277732 - RNA, 64 nt, Homo Sapiens
gucccucccacaacacaugggaauucugagagauaccauuuaaguugagauuucaguggggaca

SEQ ID NO: 277733 - RNA, 64 nt, Homo Sapiens
cacagauguauaggggauguucuaagagaccauuaccauuuauuuguucacaaaaaguagaaac

SEQ ID NO: 277734 - RNA, 64 nt, Homo Sapiens
ugucacuguuaacacuuuucauuaaaaucauguaaccauuuaaaugcuuauuaucaaaagaaua

SEQ ID NO: 277735 - RNA, 64 nt, Homo Sapiens
auacaaaauccuauuuuggaacauuuuuugguaaaccauuuaaauuuacccaaaaguauaagau

SEQ ID NO: 277736 - RNA, 64 nt, Homo Sapiens
uucuaguagccaucuucacuaacuuuaacugaugaccauuuauagaauuauugaauaguaauua

SEQ ID NO: 277737 - RNA, 64 nt, Homo Sapiens
agccugagcaaggaccaccaccuuuuuaccuagaaccauuuaaacuuugaaacaggacugaagc

SEQ ID NO: 277738 - RNA, 64 nt, Homo Sapiens
augagggugcaagagccacacaaguucccuaguuaccauuuaauuguugaaaggagaaaaagca

SEQ ID NO: 277739 - RNA, 64 nt, Homo Sapiens
ucugccuuuuucuuccguucuagcaaaugacccuaccauuuauuaucccagcuuucuuuucuac

SEQ ID NO: 277740 - RNA, 64 nt, Homo Sapiens
uggcaggcagucugcucucuaggaaauaauauggaccauuuacccccugucagggccucugcca

SEQ ID NO: 277741 - RNA, 64 nt, Homo Sapiens
gcgauuuagcuugaaauuaauuucuaucuucauaaccauuuaaaugggguuuuuuuguuuuuac

SEQ ID NO: 277742 - RNA, 64 nt, Homo Sapiens
gcuaacugggucuuagcaucaagucuuucuaaaaaccauuuaaauuaaccacuuuugacuaggu

SEQ ID NO: 277743 - RNA, 64 nt, Homo Sapiens
acauggaaaccagaaaugcaacaguuacuaaaacaccauuuaauaguuauaacgucguuacuug

SEQ ID NO: 277744 - RNA, 64 nt, Homo Sapiens
uguuguagaauaaauuaaaaggauaaucuaaaucaccauuuagauuaagcuugacuugcaaacu

SEQ ID NO: 277745 - RNA, 64 nt, Homo Sapiens
agcaauauucaaagaaagaaccacagauguguuaaccauuuaagcagaucaucugccaaacauu

SEQ ID NO: 277746 - RNA, 64 nt, Homo Sapiens
auucuguuauuuuagucuccucuauuuuauacuuaccauuuauuuaagaaauaacauuuuaaaa

SEQ ID NO: 277747 - RNA, 64 nt, Homo Sapiens
uuccacggaugagucacaaugauuuaggugcuaaaccauuuauugccacugaugggaauauaca

SEQ ID NO: 277748 - RNA, 64 nt, Homo Sapiens
agauuagccaaauagucugacggggcuguaaauuaccauuuacucauugacuucagcaaaagca

SEQ ID NO: 277749 - RNA, 64 nt, Homo Sapiens
aauguaaaaacgaccugacuauaugaccuuuguaaccauuuaaaauauuauuauguggguauuu

SEQ ID NO: 277750 - RNA, 64 nt, Homo Sapiens
ccugacugggguaagaaauguggcuccucaggccaccauuuaggaaucugagaagucagccucu

SEQ ID NO: 277751 - RNA, 64 nt, Homo Sapiens
auugacauuuaauuuucaaaguucuugucuuguuaccauuuaaauaguggaagcccagucuuga

SEQ ID NO: 277752 - RNA, 64 nt, Homo Sapiens
cuacuuaucccucaaugcacaaugcuguuuaaacaccauuuaccugcuuuaauccuuucuuuag

SEQ ID NO: 277753 - RNA, 64 nt, Homo Sapiens
gaauguucugaucuuucauuagagaauuuuguaaaccauuuauucuguucucuuuguuuuaaag

SEQ ID NO: 277754 - RNA, 64 nt, Homo Sapiens
uccaccuccucuuuuuugcucugcuggcccaaagaccauuuaggaaaaacagucaauagggcua

SEQ ID NO: 277755 - RNA, 64 nt, Homo Sapiens
uguuuuaaagaaagaaguguagaggagucacguuaccauuuacaggggagccucgggaaaaggu

SEQ ID NO: 277756 - RNA, 64 nt, Homo Sapiens
gagcaucuauuaugugccaggcuucaauucagcaaccauuuauuugggagauucagcuuaauuu

SEQ ID NO: 277757 - RNA, 64 nt, Homo Sapiens
auuugccuacagaauuucaucuacuggcccagcuaccauuuaccuaauccacccaugcaaauag

SEQ ID NO: 277758 - RNA, 64 nt, Homo Sapiens
cacuuugucauuaucaagagagauggcaguauugaccauuuaguuuaguuaaaaaaaaaaaaaa

SEQ ID NO: 277759 - RNA, 64 nt, Homo Sapiens
augaguauggaugucacucaacuaagaucaaaucaccauuuaaggggauggcauucuuuauacc

SEQ ID NO: 277760 - RNA, 64 nt, Homo Sapiens
aaacuccaaggcagaaauuguaucuuuauagcuaaccauuuaguaaauaaauacauuacauuuu

SEQ ID NO: 277761 - RNA, 64 nt, Homo Sapiens
gugguugacuaccuuuugauaagcaaaauuugaaaccauuuaaagaccacuguauuuuaacuca

SEQ ID NO: 277762 - RNA, 64 nt, Homo Sapiens
uuguguuuuaaaaaucuacucugagugcucauguaccauuuagcacugacacaagccaccgccc

SEQ ID NO: 277763 - RNA, 64 nt, Homo Sapiens
acacugcuugugaaaggaaaagcaucuaugugagaccauuuagccauuuaggugaggaagcaaa

SEQ ID NO: 277764 - RNA, 64 nt, Homo Sapiens
aaauaucacagagccacuaggcccagccuugcccaccauuuaagaugaguuacauuaucagcca

SEQ ID NO: 277765 - RNA, 64 nt, Homo Sapiens
uuuguuuuuauuuaauaguauuguuucuauuaugaccauuuaauugaucuauuuuccuauggag

SEQ ID NO: 277766 - RNA, 64 nt, Homo Sapiens
auuauuaguggcaacagaguccuuuuuuccuaagaccauuuauacccagugacuucagugguau

SEQ ID NO: 277767 - RNA, 64 nt, Homo Sapiens
gucuucucucagucuugcacguggcaaagcuaucaccauuuaaucaucaaacaaaaaugcccug

SEQ ID NO: 277768 - RNA, 64 nt, Homo Sapiens
cuguagauuuauuuccauuugacugaauguguucaccauuuagcgauaugcuuuuuuuuuuaaa

SEQ ID NO: 277769 - RNA, 64 nt, Homo Sapiens
cguauguaaacuugguuucucugagcuuuuaguaaccauuuaacgguguuaggagugguuacaa

SEQ ID NO: 277770 - RNA, 64 nt, Homo Sapiens
uucucugcccaagcccuguccauuuuuuugucccaccauuuaucucucagguggcaauguaacu

SEQ ID NO: 277771 - RNA, 64 nt, Homo Sapiens
aaaauguagcuggcccaggacuaugccaucauccaccauuuagucuuuuuagcuguuaaaugua

SEQ ID NO: 277772 - RNA, 64 nt, Homo Sapiens
cucagaauucauaauuccugcugaucaugauaugaccauuuaacugcuaucuuuuuuuauuauu

SEQ ID NO: 277773 - RNA, 64 nt, Homo Sapiens
caagagauggcuuuuuccuugggugaauuggaucaccauuuacagugaaauucagucuuaagua

SEQ ID NO: 277774 - RNA, 64 nt, Homo Sapiens
cuauuauucugauuuuuaaaaaugcaguuaauguaccauuuauuugcuugaugaagggagcucu

SEQ ID NO: 277775 - RNA, 64 nt, Homo Sapiens
guucacaguuaauuguugcgcucuaauacaacugaccauuuaaaauugaacaaguuuauuguuu

SEQ ID NO: 277776 - RNA, 64 nt, Homo Sapiens
uaaaugucaauguauuuuuggcacugcgauuuuaaccauuuauuaaauaaaaauuuuguuaaag

SEQ ID NO: 277777 - RNA, 64 nt, Homo Sapiens
ggggaggacaaaauggggcauuuauugacacaguaccauuuaauuaaagaggucgcuugggaau

SEQ ID NO: 277778 - RNA, 64 nt, Homo Sapiens
ugguguaaaaaacuuuauuuaguggcugugaacaaccauuuaguaguucauauguacaccagcu

SEQ ID NO: 277779 - RNA, 64 nt, Homo Sapiens
augccaucugaaggggauucuauaaugucuguuaaccauuuaagguuucauuuuacuuuaacua

SEQ ID NO: 277780 - RNA, 64 nt, Homo Sapiens
aaaguuugccggcuaggugcccccacccccgccaaccauuuaaaaacauuacucauuugauuuc

SEQ ID NO: 277781 - RNA, 52 nt, Homo Sapiens
uagucgagacaguugucaaaucaccauuuauauagaacccuuuccgguauaa

SEQ ID NO: 277782 - RNA, 64 nt, Homo Sapiens
uuuuuaaaaaagugugccuugcuguauuucuuauaccauuuauuaaaaagcugcuuucacggua

SEQ ID NO: 277783 - RNA, 64 nt, Homo Sapiens
gucaauuaguagcuuaccacagauacuguuuccuaccauuuauaaaauuuacuuuuuauugaaa

SEQ ID NO: 277784 - RNA, 64 nt, Homo Sapiens
uucugacuggagaccccagugugggggaggucuuaccauuuaauauagaaaugauaucaauaac

SEQ ID NO: 277785 - RNA, 64 nt, Homo Sapiens
gaaaauagaagaguguguugggcagguaguuuguaccauuuaugaagguuuguuccuuuguuaa

SEQ ID NO: 277786 - RNA, 64 nt, Homo Sapiens
gcucaacuuuuuaaaauccagacccaguguuaaaaccauuuauuccuuuuuucauaagaauaau

SEQ ID NO: 277787 - RNA, 64 nt, Homo Sapiens
cucaaauauauauuuaaaagauuuaugaauacaaaccauuuaugguuuaugauuucuaaaaaga

SEQ ID NO: 277788 - RNA, 64 nt, Homo Sapiens
uggaggaagaaaacaggugaaagaagaaguaaaaaccauuuaguauuaguauuagaaugaaguc

SEQ ID NO: 277789 - RNA, 64 nt, Homo Sapiens
gcuaugacaauuugcacagcccaguggcuuaaacaccauuuauaccacagguccagaugaaucc

SEQ ID NO: 277790 - RNA, 64 nt, Homo Sapiens
gaauuuuuuuuucaguaaaauucuaugaguguauaccauuuaaaacauaacacauaaaauuagu

SEQ ID NO: 277791 - RNA, 64 nt, Homo Sapiens
uaagagaaggugagaaggauaagaaaauuuugcuaccauuuaagaacagauuuuuuuuuauuuc

SEQ ID NO: 277792 - RNA, 64 nt, Homo Sapiens
ugaggggaaacacuagccaguguauaaauauaucaccauuuacaccuaauguaauaaauuuuau

SEQ ID NO: 277793 - RNA, 64 nt, Homo Sapiens
agacucuuuauuuuucucuuguagagcccucagaaccauuuaagauccuccuuucaguucguug

SEQ ID NO: 277794 - RNA, 64 nt, Homo Sapiens
auggaugaaagagaucuguaaucauaauuuagcaaccauuuaucuaugggauuacuuuugcaga

SEQ ID NO: 277795 - RNA, 64 nt, Homo Sapiens
uuuuuuaauaaguuuuuuacuuuaacuuuaacugaccauuuaagaaauugugcagcaauagauu

SEQ ID NO: 277796 - RNA, 64 nt, Homo Sapiens
uuaacaaguauugcaguaaucaucacuuacagguaccauuuauuucaaaacaacuuuuuuaguc

SEQ ID NO: 277797 - RNA, 64 nt, Homo Sapiens
gaauuugagaagccaaauggaauuuuuaauggaaaccauuuaucagauuaaucucuugcucucc

SEQ ID NO: 277798 - RNA, 64 nt, Homo Sapiens
gggaaacgauuuuuuguguccuuaaaauggcaugaccauuuauuugccccuuucuccauccugu

SEQ ID NO: 277799 - RNA, 64 nt, Homo Sapiens
auugucaauaaugaaacccaauuguaaaacagucaccauuuacuaccaguaacuuuuaguuaau

SEQ ID NO: 277800 - RNA, 64 nt, Homo Sapiens
gugauuuuagcuguggguuuagcauaagucucucaccauuuaguguuccugacucugacaagaa

SEQ ID NO: 277801 - RNA, 64 nt, Homo Sapiens
acuucccucacugcccuaccuccuuuucuuucucaccauuuauccgcccuguuaguuuucaguc

SEQ ID NO: 277802 - RNA, 64 nt, Homo Sapiens
auguucuacuuuagugauauuaacauguauauauaccauuuauuucuuuaagcuauaaaugugu

SEQ ID NO: 277803 - RNA, 64 nt, Homo Sapiens
aaguaaugcugauauuuauuguacauaaaauaaaaccauuuaaaacaacguauguucauuauuu

SEQ ID NO: 277804 - RNA, 64 nt, Homo Sapiens
aaaaaaaaaucuuugaaggguaggaucuuaaaaaaccauuuaauuaggggaaacugggagacuu

SEQ ID NO: 277805 - RNA, 64 nt, Homo Sapiens
uugaaaggaaacaguuuaaugguggaaaugaacuaccauuuauaacuucuguuuuuuuauugag

SEQ ID NO: 277806 - RNA, 64 nt, Homo Sapiens
acggcuauuaaaugucacaauccuuuaauuagaaaccauuuauuggccggacgcgguggcucac

SEQ ID NO: 277807 - RNA, 64 nt, Homo Sapiens
agacuccgucucaaaaaaaaaaaaaaaaaaagaaaccauuuauuuuaaaaaugauuagauugcu

SEQ ID NO: 277808 - RNA, 64 nt, Homo Sapiens
guuggagaauuuagguuuuuauuaguaccauaguaccauuuauacaaauuagaaaauguuauuu

SEQ ID NO: 277809 - RNA, 64 nt, Homo Sapiens
aacugaaaggacacgaagucugauucuauagaaaaccauuuaccuuuaaagaaagaaauauuau

SEQ ID NO: 277810 - RNA, 64 nt, Homo Sapiens
acuaguauuuguuaaauggguuuuaagccaaauaaccauuuaacaaggauuuucuuaacucaga

SEQ ID NO: 277811 - RNA, 64 nt, Homo Sapiens
cuacauauaacuggggaaaaacauuuaugauuaaaccauuuaugguuuaucaugccuaagggag

SEQ ID NO: 277812 - RNA, 64 nt, Homo Sapiens
aauuaagugguucucaucucuaauuaacugugaaaccauuuaauccaaacauguaagcacacac

SEQ ID NO: 277813 - RNA, 64 nt, Homo Sapiens
cucagcuccacucggguggaguggaaguggccagaccauuuagacggacaggguccucacccua

SEQ ID NO: 277814 - RNA, 64 nt, Homo Sapiens
gaugucagguacaaauacacuauagagucaaaauaccauuuacaaagaaaaucaaaagcauuuc

SEQ ID NO: 277815 - RNA, 64 nt, Homo Sapiens
ugcuguuagaauagugcuauauaucagguaugugaccauuuauuucagaaggcugaacauaaga

SEQ ID NO: 277816 - RNA, 64 nt, Homo Sapiens
gauugcaagaaacucuuuuauuaaacuuggaacaaccauuuaaaugaaggauuuugugagauag

SEQ ID NO: 277817 - RNA, 64 nt, Homo Sapiens
aucaugagccuaauggcucaccaaaggcuuuuggaccauuuagcuucuuguccauaucacacca

SEQ ID NO: 277818 - RNA, 64 nt, Homo Sapiens
ugcucccaauguuuaugauaguugcccuuucuguaccauuuauuccugaagaggaacugggccu

SEQ ID NO: 277819 - RNA, 64 nt, Homo Sapiens
cuaaacuuagucauuuauuuaaauuccuaaugcaaccauuuagugcgauauaauuuugguuguc

SEQ ID NO: 277820 - RNA, 64 nt, Homo Sapiens
auuaaaacgaagggaaaagggaccacugaauugcaccauuuaagaugcugcuugaacaaauggg

SEQ ID NO: 277821 - RNA, 64 nt, Homo Sapiens
uguauuaacuuuggaauguauuauugcauuauauaccauuuaucgauggaauaacucuguggca

SEQ ID NO: 277822 - RNA, 64 nt, Homo Sapiens
cauuccucccuucuuucuuaaaguaauaaaauuuaccauuuaguucaagcuggcaauguggaca

SEQ ID NO: 277823 - RNA, 64 nt, Homo Sapiens
auuuauccuuuuuuucuuuccugauuauccuaacaccauuuauucaauaaccuuguccauuuuc

SEQ ID NO: 277824 - RNA, 64 nt, Homo Sapiens
guguguggaagugaccacugggaugucaucauucaccauuuauccaggauggccgcucaccagg

SEQ ID NO: 277825 - RNA, 64 nt, Homo Sapiens
ccuccacacuccauggagacucaguucuccuaggaccauuuauucaaaaggacugcccucucuu

SEQ ID NO: 277826 - RNA, 64 nt, Homo Sapiens
caaaaggagagguagaugcauauuuuuguguggaaccauuuaucuuaaaacauugaggugcagu

SEQ ID NO: 277827 - RNA, 64 nt, Homo Sapiens
cuuuuguacaucaaccgugcccuuuuuggggcuaaccauuuaugggagggugacauuuuuacuc

SEQ ID NO: 277828 - RNA, 64 nt, Homo Sapiens
ccauugguugccaucuuuaaauaugaguguuguuaccauuuagcgaaauacuaugaauguaagg

SEQ ID NO: 277829 - RNA, 64 nt, Homo Sapiens
uaccuacacgcacgcaagagccacaagccuauacaccauuuauagacugucuaugcaugcacac

SEQ ID NO: 277830 - RNA, 64 nt, Homo Sapiens
caugguuuaucuucagcaaaaaaagccuuccaacaccauuuaaagagaaagaauauguugauuu

SEQ ID NO: 277831 - RNA, 64 nt, Homo Sapiens
uccuauuaccuuuucucauccuaggcacuuuaucaccauuuagauguaccacuuaaaguggaau

SEQ ID NO: 277832 - RNA, 64 nt, Homo Sapiens
auuucauagucauuuauguuuuuuuuuuuccuucaccauuuaucucuccagucuuccuucacua

SEQ ID NO: 277833 - RNA, 64 nt, Homo Sapiens
acaugaucuguuuuucaccacuucacugaaagacaccauuuaucuacccaagggcagaaaguag

SEQ ID NO: 277834 - RNA, 64 nt, Homo Sapiens
aaagaauuuuaaaaaagauggauuugacacacucaccauuuaaucauuuccagcaaaauauaug

SEQ ID NO: 277835 - RNA, 64 nt, Homo Sapiens
cagucaccuucucggcaacuaagcagucccugagaccauuuaacaugcaacccgaagguuaugg

SEQ ID NO: 277836 - RNA, 64 nt, Homo Sapiens
gcacuggaaaccguuauuugcaaacauugcuguuaccauuuagaaauaugugcacuaucagcug

SEQ ID NO: 277837 - RNA, 64 nt, Homo Sapiens
uuuauuuagcaccugccagaugccagaaauuuauaccauuuaaaacucaguaagucuuuuaaau

SEQ ID NO: 277838 - RNA, 64 nt, Homo Sapiens
agucucaaguuuuauuauugacccuucccccagcaccauuuauguggugagaaaucguugcugc

SEQ ID NO: 277839 - RNA, 64 nt, Homo Sapiens
aaaagauaccaaaguagaaggggggacagagggaaccauuuaagcccccauucugugugugucg

SEQ ID NO: 277840 - RNA, 64 nt, Homo Sapiens
uuguguucuacugaguaagauauuggaguuauaaaccauuuacuuacuguauuuuccuugcaaa

SEQ ID NO: 277841 - RNA, 64 nt, Homo Sapiens
gaugaggaaacuaaggcuccgguuugugauugucaccauuuacucuuccagcauucuaaaggag

SEQ ID NO: 277842 - RNA, 64 nt, Homo Sapiens
uaauguuuucuuuaaauggcacgcugccuguaccaccauuuacuauagcaccaugauagguugc

SEQ ID NO: 277843 - RNA, 64 nt, Homo Sapiens
uugaaaaauuuccaaguuguuagaguuuuuaauaaccauuuaauucaugaaaauaucauuaauc

SEQ ID NO: 277844 - RNA, 64 nt, Homo Sapiens
aguucauauauagaauuuacgggagaaacuugagaccauuuacggggagaaacuugauucuggg

SEQ ID NO: 277845 - RNA, 64 nt, Homo Sapiens
uccagauagagcagaggagauaaaauucuaaauuaccauuuacuaagaauuagcacagcugaug

SEQ ID NO: 277846 - RNA, 64 nt, Homo Sapiens
ugucagucucccaguuuuucaaucaugcagauaaaccauuuaaaguuggaaaugugauuaauuu

SEQ ID NO: 277847 - RNA, 64 nt, Homo Sapiens
uucuuguucugugucacucggcccuggguagucuaccauuuacuucaccccaaguccugcugcc

SEQ ID NO: 277848 - RNA, 64 nt, Homo Sapiens
caaugcacauugcuuuagaucacauucgugauuuaccauuuaauuaacugguaaccucaaaauu

SEQ ID NO: 277849 - RNA, 64 nt, Homo Sapiens
uguuaaugauucccacauuucuuugcuuuuucauaccauuuauucuggguggucucauccauuc

SEQ ID NO: 277850 - RNA, 64 nt, Homo Sapiens
gguugguggcaacaauuuuacuugguguaguguaaccauuuagugcucccugccauuuuagugu

SEQ ID NO: 277851 - RNA, 64 nt, Homo Sapiens
cccucagcaaauaccuaugucaacaguauaaguuaccauuuacucuauaaucugcagugaugca

SEQ ID NO: 277852 - RNA, 64 nt, Homo Sapiens
gauuugugguaacuguagucaucuuaaauuucaaaccauuuaccaucugaaaguuuugauuuga

SEQ ID NO: 277853 - RNA, 64 nt, Homo Sapiens
gaacuauguuauaguccagucuacuucuuuaaaaaccauuuaaacugcuagauaguauuagaau

SEQ ID NO: 277854 - RNA, 64 nt, Homo Sapiens
aguauuauauuuuauuuaucuuuguagccuaaagaccauuuaaucuugaaggaacacaaagauc

SEQ ID NO: 277855 - RNA, 64 nt, Homo Sapiens
uuuguuggccauauuacugccacacaugagaagcaccauuuaugcagauuuucuucagaauauu

SEQ ID NO: 277856 - RNA, 64 nt, Homo Sapiens
aaaucauaccuuaauuuuuuuuuuuuuuuuuuuuaccauuuaugauuuauucuccuauguguca

SEQ ID NO: 277857 - RNA, 64 nt, Homo Sapiens
ugggaacuuauuaaauggaaacugaaacuacugcaccauuuaaaaacaggcagcucauaagagc

SEQ ID NO: 277858 - RNA, 64 nt, Homo Sapiens
ggcacauguaucauuuuacaaaugagcuuucaagaccauuuaaggaaacagaugcuucauuugc

SEQ ID NO: 277859 - RNA, 64 nt, Homo Sapiens
aauugguaugaacaugagacaauguuccccagaaaccauuuauuaguagagaacauguugcuau

SEQ ID NO: 277860 - RNA, 64 nt, Homo Sapiens
ugaucauacaggacaggcugccgugucuguggucaccauuuaggaauccauuccagcaaauucc

SEQ ID NO: 277861 - RNA, 64 nt, Homo Sapiens
ccucaccuucuguuuuagaggaaagacaguaaagaccauuuaguaauacuguauuguuacagcu

SEQ ID NO: 277862 - RNA, 64 nt, Homo Sapiens
ggguugggagucuuggccaacaggaagaauuuguaccauuuaauccuggccauacucagggguc

SEQ ID NO: 277863 - RNA, 64 nt, Homo Sapiens
uagugaugugggauaaccuuaggagaacuuggaaaccauuuauguagacaacaaugaauaaaua

SEQ ID NO: 277864 - RNA, 64 nt, Homo Sapiens
uaaaacacagagcuuagacaaaagcgaugaggggaccauuuacaaagguaagaaauaaacaaug

SEQ ID NO: 277865 - RNA, 64 nt, Homo Sapiens
uugaaggaaaaauucaauagaaaauucucuuccaaccauuuauccaaaagugcugcagggcuuu

SEQ ID NO: 277866 - RNA, 64 nt, Homo Sapiens
uuauggcuaagaaauggacuaaacauaaaaugugaccauuuaacuaguuauggagacaaaguga

SEQ ID NO: 277867 - RNA, 64 nt, Homo Sapiens
uguguguuaaacaacuacagcuucccccaauaagaccauuuaagugcaagaaccuccccuuucc

SEQ ID NO: 277868 - RNA, 64 nt, Homo Sapiens
agauugcuuguugauuggaaagaguguuuuauucaccauuuaaacguuugcaaaguggcgugcc

SEQ ID NO: 277869 - RNA, 64 nt, Homo Sapiens
augacauauagaauuaauacaaaacaguuuaacaaccauuuaacugcaguguaagaaaauugga

SEQ ID NO: 277870 - RNA, 65 nt, Homo Sapiens
caaaaugaacuccauugcuuaagaaacacauaaacaccauuuagucacugaacauagcuauaugu

SEQ ID NO: 277871 - RNA, 65 nt, Homo Sapiens
uuuaggaaugaauuuaacuguccuuggguuacacuaccauuuauuggaacaagccccagaggcag

SEQ ID NO: 277872 - RNA, 65 nt, Homo Sapiens
agguccuacugcaaaccaccccuccauauuuccguaccauuuacaauucaguuucugugacaucu

SEQ ID NO: 277873 - RNA, 65 nt, Homo Sapiens
uuauauucagugaaaagauuuuauuuauggaauuaaccauuuaauaaagaaauauuuaccuaaua

SEQ ID NO: 277874 - RNA, 65 nt, Homo Sapiens
uuagaaaguaaccugucuuugaugaugcuucucuuaccauuuaguuuuuguauauuacccugggg

SEQ ID NO: 277875 - RNA, 65 nt, Homo Sapiens
cuccucaguuuugccgacugcuuuucaucugagucaccauuuacuccaagcauguauuccagacu

SEQ ID NO: 277876 - RNA, 65 nt, Homo Sapiens
ggugaagagacuuguuucaucuccggaaaugcaaaaccauuuauagcaugaagcccuacaugauc

SEQ ID NO: 277877 - RNA, 65 nt, Homo Sapiens
agugucaguguaucauuuaguauuuguaucacuguaccauuuaguguuguauaucacucagucau

SEQ ID NO: 277878 - RNA, 65 nt, Homo Sapiens
agcagauuaucagcucggugacuuuucuuucugccaccauuuaggugaugguguuugauucagag

SEQ ID NO: 277879 - RNA, 65 nt, Homo Sapiens
caauccuuccaaaaauauugauggugauuugugcuaccauuuacucguuuauuuaauaaagacau

SEQ ID NO: 277880 - RNA, 65 nt, Homo Sapiens
agcauacccaggguggccuuuagcacaguaucaguaccauuuauuugucugccgcuuuuaaaaaa

SEQ ID NO: 277881 - RNA, 65 nt, Homo Sapiens
uaucaugggaauugcaguuagagagaguaaggaauaccauuuagucaucuauccguucuucacuu

SEQ ID NO: 277882 - RNA, 65 nt, Homo Sapiens
acccaaaucucacuuggcuggaaacaucaaucuuaaccauuuauucagaaccauuaaaccaauga

SEQ ID NO: 277883 - RNA, 65 nt, Homo Sapiens
gcuaaauauugcaugcauauugacuaauuggaauaaccauuuacucaauuauggacagcuuauug

SEQ ID NO: 277884 - RNA, 65 nt, Homo Sapiens
guggaacauguuucuuuuugaaagggagagaauugaccauuuauuguugugauguuuaaguuaua

SEQ ID NO: 277885 - RNA, 65 nt, Homo Sapiens
guaaccagggauuuucccauuauguucccuuuuauaccauuuaggugugaguuccuuagcuucug

SEQ ID NO: 277886 - RNA, 65 nt, Homo Sapiens
uugauaaucuuauucacaguuguuauuguuuacagaccauuuaauuaauauuuccucuguuuauu

SEQ ID NO: 277887 - RNA, 65 nt, Homo Sapiens
cgucauguguuuccccaaagggaagccagucauugaccauuuaaaaagucuccugcuaaguaugg

SEQ ID NO: 277888 - RNA, 65 nt, Homo Sapiens
uaaguaauacaaaaguuuugagcucuuccaaguauaccauuuauauacaaacaaauagguuuauu

SEQ ID NO: 277889 - RNA, 65 nt, Homo Sapiens
cuuuucagggucuaccuaacugagccuagauauggaccauuuauggaugacaacaauuuuuuuuu

SEQ ID NO: 277890 - RNA, 65 nt, Homo Sapiens
augcccaggugagugcagagcguggcuggguggacaccauuuacaccaguggccaggccuugugc

SEQ ID NO: 277891 - RNA, 65 nt, Homo Sapiens
aaaaauaauuaacacuauuugaauuuuauuucuguaccauuuaaacucccaguuuaguaucuuuu

SEQ ID NO: 277892 - RNA, 65 nt, Homo Sapiens
auuucuaguauuucucugaaaaguaauacccuuaaaccauuuauaguaguaccugacuaaaaaug

SEQ ID NO: 277893 - RNA, 65 nt, Homo Sapiens
ucaaaugaacccaucaacugcacguuagccuccaaaccauuuaauugaaauucaauuuaaaaaau

SEQ ID NO: 277894 - RNA, 65 nt, Homo Sapiens
uuuauuuaacaguuaucuuguaauuguagacacccaccauuuaaaggaauugcaggacuauccug

SEQ ID NO: 277895 - RNA, 65 nt, Homo Sapiens
auguuaguagaaauuuuacaguggcaugugcugugaccauuuauacaaaguuuggauuguaucaa

SEQ ID NO: 277896 - RNA, 65 nt, Homo Sapiens
gauucauuuuggaaccauuuuuuuuaauuuauauuaccauuuauauauucacuuuaaguucguau

SEQ ID NO: 277897 - RNA, 65 nt, Homo Sapiens
ccuuccuuguucuaaaacaacauccauaaucagccaccauuuaacgucccaaaaucaaaauggua

SEQ ID NO: 277898 - RNA, 65 nt, Homo Sapiens
ugugugcuaaacaacuacggcccucccacaauaagaccauuuaagcugcaagaaccuccccuuuc

SEQ ID NO: 277899 - RNA, 65 nt, Homo Sapiens
aaauggggacuucuuuccccgccaguaaucccagcaccauuuauucaaucuucugcauauggcua

SEQ ID NO: 277900 - RNA, 65 nt, Homo Sapiens
agguggacaaaugcuaauauggaagaggaggaaucaccauuuacaccuaccccagauauuugugu

SEQ ID NO: 277901 - RNA, 65 nt, Homo Sapiens
aaauaccgaugccuuugugggcugcauauacagguaccauuuaggaggaugguauagaaaacaac

SEQ ID NO: 277902 - RNA, 65 nt, Homo Sapiens
ucuuuguauauguguaaauguuauuauuugcuaaaaccauuuaaggugauuguguuuuagaaaaa

SEQ ID NO: 277903 - RNA, 65 nt, Homo Sapiens
aauuggaagugauguuggcuuacauuucaauguaaaccauuuaugaggaugaagacaaauaggga

SEQ ID NO: 277904 - RNA, 65 nt, Homo Sapiens
gaagguuuuacaaauuggauugaagcuggacaaggaccauuuagauaagcgugaaauugaaaaac

SEQ ID NO: 277905 - RNA, 65 nt, Homo Sapiens
uggcucuuuugucauugugcuuauguuaaaauuauaccauuuaacgguauggauucacuuuuuac

SEQ ID NO: 277906 - RNA, 65 nt, Homo Sapiens
cugaaggacccuauauuauaugcagaguucuucucaccauuuaaauuauuuuuguucugcaggcu

SEQ ID NO: 277907 - RNA, 65 nt, Homo Sapiens
ucugggccacuuaauggcugugcaucuucuguaggaccauuuaagacugacuuuuuucucacugu

SEQ ID NO: 277908 - RNA, 65 nt, Homo Sapiens
augggcaauguauuuuacgcucuuuaagaccucaaaccauuuagacaaaaaccccuggaagagac

SEQ ID NO: 277909 - RNA, 65 nt, Homo Sapiens
augccccguaaaugucuucaacuaguauuuaagauaccauuuaauuagacauuaugagguauaca

SEQ ID NO: 277910 - RNA, 65 nt, Homo Sapiens
cagaaauuaaaauaucacccuucacacacaguucaaccauuuaaccaguucuuuagagcauuugc

SEQ ID NO: 277911 - RNA, 65 nt, Homo Sapiens
cagugggaggauucgauggcgcaacuguagggaacaccauuuaugcaaggagcaaugcugggauu

SEQ ID NO: 277912 - RNA, 65 nt, Homo Sapiens
uucauguauaucuaacuucgcucuuaaacagcaccaccauuuaauggauuagaccaauuacugca

SEQ ID NO: 277913 - RNA, 65 nt, Homo Sapiens
uuguuaaauuaucucuaggaucaaaucacuacuagaccauuuaauuugggcagggcuuuuuagua

SEQ ID NO: 277914 - RNA, 65 nt, Homo Sapiens
uaaugugaaguuuuggaaagcaaguuucaagcaagaccauuuacuucacuagagggaagucuucu

SEQ ID NO: 277915 - RNA, 65 nt, Homo Sapiens
gaguguuauuuaaugcuaaguugcuucauagguguaccauuuaaaacuggguuuauauuuaacuc

SEQ ID NO: 277916 - RNA, 65 nt, Homo Sapiens
accaauaacuuuuaguuaauaauuguaaaacagucaccauuuacucauugucaauaacgaaaccu

SEQ ID NO: 277917 - RNA, 65 nt, Homo Sapiens
aacauaaagucauuauauuaauuaaaagaaaaaacaccauuuaauauguucugaaaacauuacuc

SEQ ID NO: 277918 - RNA, 65 nt, Homo Sapiens
auuuuguacaaaaacuaauucuuuugguaaaaugaaccauuuacaguucgguuuuggacucugag

SEQ ID NO: 277919 - RNA, 65 nt, Homo Sapiens
uagucaguacuuuuuucucauguaucuuucucuagaccauuuauauacgggugaaaugaaagcuu

SEQ ID NO: 277920 - RNA, 65 nt, Homo Sapiens
uuaaaugaagucuugugaauuuguaauagaucaguaccauuuauugguuuggggaccaucuuaau

SEQ ID NO: 277921 - RNA, 65 nt, Homo Sapiens
auauauguuauuuggcgagacaucaaauaaaguuaaccauuuaaaaauuauuuucauauacuguu

SEQ ID NO: 277922 - RNA, 65 nt, Homo Sapiens
aucuucuguggucgcccgcccccccccaaaaaaauaccauuuaugguucucuccgcaaguauaaa

SEQ ID NO: 277923 - RNA, 65 nt, Homo Sapiens
cuaggagcauggauguauaaggcagguuuuauacaaccauuuagauucaacauuaaugguagagu

SEQ ID NO: 277924 - RNA, 65 nt, Homo Sapiens
ugguaaaugagcuugcaauguguuaaagaagauuaaccauuuaaaggcauguguuccauagccaa

SEQ ID NO: 277925 - RNA, 65 nt, Homo Sapiens
gugcccauuuugaaauugccuauacagucuuagugaccauuuaaaccggacgaacuagguguuua

SEQ ID NO: 277926 - RNA, 65 nt, Homo Sapiens
ucucuuucuacauauggcuagccaguuuucccagcaccauuuauuaaauagggaauccuuucccc

SEQ ID NO: 277927 - RNA, 65 nt, Homo Sapiens
ugcugugaucuuacaaguuagauguuacuauaccuaccauuuauucagcuggauugcugaacaca

SEQ ID NO: 277928 - RNA, 65 nt, Homo Sapiens
auuuaaaaucauuguuaaauugauugaggaaaacaaccauuuaaaaaaaaucuauguugaauccu

SEQ ID NO: 277929 - RNA, 65 nt, Homo Sapiens
uauggagucuccaccuuuggacacaacacuuacucaccauuuacucuuuaucacucugcaacaaa

SEQ ID NO: 277930 - RNA, 65 nt, Homo Sapiens
auuauuaaauauuaaaauaucuauuuauuauuaaaaccauuuauaaggcuuuuucauaaauguau

SEQ ID NO: 277931 - RNA, 65 nt, Homo Sapiens
auggcuuuguaacaauugcaaaguacauuuuauaaaccauuuacuagcagaguaacauaaaauaa

SEQ ID NO: 277932 - RNA, 65 nt, Homo Sapiens
uguguuuugcuuaaaguauuuuccucauaugaauaaccauuuauaagauuuacuacuaggaaacc

SEQ ID NO: 277933 - RNA, 65 nt, Homo Sapiens
aauauucuucugaacucaucgaaauaguuuucucaaccauuuaaaaaagguuauuccaguaaaag

SEQ ID NO: 277934 - RNA, 65 nt, Homo Sapiens
auuguguuuuagaucuacaguucuuacaucuuuauaccauuuacauugacuuuaucacaauauga

SEQ ID NO: 277935 - RNA, 65 nt, Homo Sapiens
uuaugacauuuuacaauguaguuauaaaguuuuguaccauuuauuuguauauagccggauuaacg

SEQ ID NO: 277936 - RNA, 65 nt, Homo Sapiens
ucauaauuagaacaauagcucuuaaauaaauucaaaccauuuaauguagucaauuaguacaguag

SEQ ID NO: 277937 - RNA, 65 nt, Homo Sapiens
acauuuacacuuucuuauuugucacacuaguauauaccauuuaauaucuaucaauauugauagaa

SEQ ID NO: 277938 - RNA, 65 nt, Homo Sapiens
uacuauuugaaaaaagaagaauaaguuccaaaaauaccauuuaucagaccaguucuuggccuaug

SEQ ID NO: 277939 - RNA, 65 nt, Homo Sapiens
gacucuaagccagaauggaaggaaaacaccugaccaccauuuaaguaagguccacuggacaguug

SEQ ID NO: 277940 - RNA, 65 nt, Homo Sapiens
gucuggcuuugcccuuaaaaaaccuugggcauuuaaccauuuacuaguacuugagcuguaggaca

SEQ ID NO: 277941 - RNA, 65 nt, Homo Sapiens
guugaauaaguagagaaaauaaaaauagauucugaaccauuuauuaucagggaaaaaugaggaaa

SEQ ID NO: 277942 - RNA, 65 nt, Homo Sapiens
aauuuucugaaugguaauaauuuacauuuuuccucaccauuuagcauaagcauuguuuuaugaau

SEQ ID NO: 277943 - RNA, 65 nt, Homo Sapiens
gaaguauuuucugaguguugagaagaaugaguuaaaccauuuaaacacauuugaaacauacaaaa

SEQ ID NO: 277944 - RNA, 65 nt, Homo Sapiens
aucuuccuaaaucaaggaaaggaaaucauccccagaccauuuaugcugagcuuuggaauacuauu

SEQ ID NO: 277945 - RNA, 65 nt, Homo Sapiens
uauauauggugcucacuuuaggaucagcaguguugaccauuuaugcugcauagcuguauuauagc

SEQ ID NO: 277946 - RNA, 65 nt, Homo Sapiens
auaucuucucuauucuauucuacuuccuccauuucaccauuuauacaaagucauucaaaaaggcu

SEQ ID NO: 277947 - RNA, 65 nt, Homo Sapiens
uguguguggggaggggggcugguuuacaauauuaaaccauuuaaaguauuuuauucuacaaaugg

SEQ ID NO: 277948 - RNA, 65 nt, Homo Sapiens
cuacgcugacaaucaguuaaacacaccggagaagaaccauuuacaugcaccuuauauuucugugu

SEQ ID NO: 277949 - RNA, 65 nt, Homo Sapiens
acuagaagcagaggcacuuaaaacauguaccaggaaccauuuaacaaagaauauaaaaugucaca

SEQ ID NO: 277950 - RNA, 65 nt, Homo Sapiens
ccugugcccacacuuaaugucaaucuauaauuuuaaccauuuauccaagauucuacuaaguguaa

SEQ ID NO: 277951 - RNA, 65 nt, Homo Sapiens
uuaucaaguuugggucugugcugcuguuacuguuaaccauuuaaguggggcaaaaccuugcuaau

SEQ ID NO: 277952 - RNA, 65 nt, Homo Sapiens
auuuaaauauaugcuuuucuagaauuugauguuugaccauuuaugacuuaauuaccagagagcca

SEQ ID NO: 277953 - RNA, 65 nt, Homo Sapiens
cccucauucucucguuuccccuuuagcucccuuucaccauuuauucagcuacaucaucccucuau

SEQ ID NO: 277954 - RNA, 65 nt, Homo Sapiens
accuuuuuuuaucguuuuuguauuuucaugaaaauaccauuuaguaagaauaccacaucaaauaa

SEQ ID NO: 277955 - RNA, 65 nt, Homo Sapiens
cauuugauuuguaaauuuacuuauguuaaaaauaaaccauuuauuuucagcuuugaauuuuauuu

SEQ ID NO: 277956 - RNA, 65 nt, Homo Sapiens
auuugcuguucuguaagaguggcuucacagagacaaccauuuaugauaucgaaugcaaagcuacu

SEQ ID NO: 277957 - RNA, 65 nt, Homo Sapiens
acuucugaauuuaaaaaguuuaauuaagcacccauaccauuuauauaaaauugcaggugauuuga

SEQ ID NO: 277958 - RNA, 65 nt, Homo Sapiens
ugcaaaugacugucagauucuuccaugguuuccuuaccauuuauacgcuagcugaucucauuucc

SEQ ID NO: 277959 - RNA, 65 nt, Homo Sapiens
uuacauauucguuuucaauauuuagucagggcaaaaccauuuacugcauaaaauacugaggcuga

SEQ ID NO: 277960 - RNA, 65 nt, Homo Sapiens
aacucagacaagauuauauugaaaaagaaaaacagaccauuuaaaggcaucuaauccuacauaau

SEQ ID NO: 277961 - RNA, 65 nt, Homo Sapiens
cugaacaacaccauuugagaaaaaucuaaagaucaaccauuuaucccucuuagcacgcaaaagcc

SEQ ID NO: 277962 - RNA, 65 nt, Homo Sapiens
cagcaccuguuaugcaccagauccuaacugcagccaccauuuauugggucucucccagcucucga

SEQ ID NO: 277963 - RNA, 65 nt, Homo Sapiens
aauuauuccuucaguuggcucccuuaaagguaaugaccauuuauauuacauuguauucagcuagc

SEQ ID NO: 277964 - RNA, 65 nt, Homo Sapiens
aucaagaaaaguguaagaaaaauauauagccaggaaccauuuaucaacuauguuaauaccuauaa

SEQ ID NO: 277965 - RNA, 65 nt, Homo Sapiens
ugguuucuuaagagccgucacaaagaagacuucaaaccauuuaacggcagggugaguucucuccu

SEQ ID NO: 277966 - RNA, 65 nt, Homo Sapiens
ugcuacaaauuagucugauuuuauggauaaacauuaccauuuauagaccccugaauuccaaaaua

SEQ ID NO: 277967 - RNA, 65 nt, Homo Sapiens
augacacuagauacaguaaauuuuuagaaaaaaauaccauuuacaguauuauugugaaccauuua

SEQ ID NO: 277968 - RNA, 65 nt, Homo Sapiens
uuuagaaaaaaauaccauuuacaguauuauugugaaccauuuaacccuuuugauccaaggccccg

SEQ ID NO: 277969 - RNA, 65 nt, Homo Sapiens
uguucuaguccacauauaaggguaggguugggauuaccauuuacugaccacaucugugaggugcc

SEQ ID NO: 277970 - RNA, 65 nt, Homo Sapiens
gaugauacaaccaugauuugcaacuguaacaggagaccauuuauuauaagcguaccuguuuguga

SEQ ID NO: 277971 - RNA, 65 nt, Homo Sapiens
ccuuagauaaagagagaauauuguaugggccaucaaccauuuacuuuucccugaauguuagaaac

SEQ ID NO: 277972 - RNA, 65 nt, Homo Sapiens
ggaucauagaauugcagucauuuggugcucugcuaaccauuuauauaaaacuuaaaaacaagaga

SEQ ID NO: 277973 - RNA, 65 nt, Homo Sapiens
gauaggucagucaaguugguaaugccuguccauuaaccauuuaugcauacuaauaaaauuauaag

SEQ ID NO: 277974 - RNA, 65 nt, Homo Sapiens
aaaaaaucuuaaagccuguaugacaugcccauucuaccauuuaaagcauuuauuggcuaacugca

SEQ ID NO: 277975 - RNA, 65 nt, Homo Sapiens
ugugguauuaaaaauuaauguucgggucgcaguucaccauuuauauguagguaaaaauauauacc

SEQ ID NO: 277976 - RNA, 65 nt, Homo Sapiens
aagcauuuaccaugugcuaaauuaauaauaaagcuaccauuuaucgguuaggucuuaggaauuga

SEQ ID NO: 277977 - RNA, 65 nt, Homo Sapiens
gucaucuaccugaaaacaguuuaaaauuaaccuuuaccauuuaaucugaaucaugucagaacugc

SEQ ID NO: 277978 - RNA, 65 nt, Homo Sapiens
uacaauuuuuagccagaaaaauaacagaguaacauaccauuuaaugauuuuuuguuuguuuaguu

SEQ ID NO: 277979 - RNA, 65 nt, Homo Sapiens
ggaaauuucuagauauagaauggaaauugcuuuaaaccauuuaaauucucuuauuaauaaaacuu

SEQ ID NO: 277980 - RNA, 65 nt, Homo Sapiens
auuuuuaaaacaucaaaauucgguaaguccuuuaaaccauuuaggaaacuggguuaaucaagucu

SEQ ID NO: 277981 - RNA, 65 nt, Homo Sapiens
ugggauuaugguuuugugauuaacugcauuuuuagaccauuuaucauugauauacacggaugacu

SEQ ID NO: 277982 - RNA, 65 nt, Homo Sapiens
gaacuuuuaaacuuuuuuaugaauuccuaaacauuaccauuuauguggcagaaguucuguucccu

SEQ ID NO: 277983 - RNA, 65 nt, Homo Sapiens
gugcauaaaaguuaacauuaggcuguggugcaguaaccauuuaaugucgaggcucuauuucggaa

SEQ ID NO: 277984 - RNA, 56 nt, Homo Sapiens; identical to SEQ ID NO: 277656

SEQ ID NO: 277985 - RNA, 65 nt, Homo Sapiens
augaauaauuuucacucauuuauugucuucuggaaaccauuuaacuuuuacuguuuuuuauuuuu

SEQ ID NO: 277986 - RNA, 65 nt, Homo Sapiens
aaaacaaaaugaacacugcuugucuucuuccauugaccauuuaguguugaguacuguauguguuu

SEQ ID NO: 277987 - RNA, 65 nt, Homo Sapiens
accaaaugcuauuuuucaaugcauuuggacugcugaccauuuaaaagcagccuaugauugcuucu

SEQ ID NO: 277988 - RNA, 65 nt, Homo Sapiens
uuaauguauuaaucuguuugugcaaacauaauaccaccauuuaaaaauguuagggagaugaguug

SEQ ID NO: 277989 - RNA, 65 nt, Homo Sapiens
uugcccauauuaaaaagccaacaguagcuuccuagaccauuuacuugcugagaauccccgugcuc

SEQ ID NO: 277990 - RNA, 65 nt, Homo Sapiens
uuguuuaaaaugcuguacuggagagcugaaaugagaccauuuacuuguggauuaugcuuaacagu

SEQ ID NO: 277991 - RNA, 65 nt, Homo Sapiens
aucucccuccagccccaacgcugugugcucccuuuaccauuuacuaugauacacaaaagugcaca

SEQ ID NO: 277992 - RNA, 65 nt, Homo Sapiens
gaaagaaugcauuccagaacgauuacccaaauauaaccauuuaaacuccucguccauuuuauuag

SEQ ID NO: 277993 - RNA, 65 nt, Homo Sapiens
uugaauuaaugcuugguagcugauguuguagugacaccauuuacacugccuagcacugcucuuuu

SEQ ID NO: 277994 - RNA, 65 nt, Homo Sapiens
uucagcaguuguuaauguuuagcacauguauaucuaccauuuagaaauugaaaaacuguuuggua

SEQ ID NO: 277995 - RNA, 65 nt, Homo Sapiens
auucugaauuuuaaaguuggacuacuacuguugucaccauuuauguugacuauuuuugguucaau

SEQ ID NO: 277996 - RNA, 65 nt, Homo Sapiens
auaucagaaaguauauguacagcuugcuugugguaaccauuuauaaauuucugaauauguuacug

SEQ ID NO: 277997 - RNA, 65 nt, Homo Sapiens
uguagaauuugaaaugguugauuuccaugggccccaccauuuauguguaccauauucagcauuug

SEQ ID NO: 277998 - RNA, 65 nt, Homo Sapiens
agacauucuugcuauaacuauugucucuaucagauaccauuuaugguuuuuauuccccacuacuc

SEQ ID NO: 277999 - RNA, 65 nt, Homo Sapiens
aaaucagaauguuuauacaaaaaauauauauucauaccauuuauuuucuuuauuguaaaguaugc

SEQ ID NO: 278000 - RNA, 65 nt, Homo Sapiens
guuuuuuucuguagcaccagugauacacuugaaggaccauuuacucuucucucucaguucuacac

SEQ ID NO: 278001 - RNA, 65 nt, Homo Sapiens
cuccuuucaucguccccgggcuguccaccuugggcaccauuuaucagagcagcaggaaggcaccg

SEQ ID NO: 278002 - RNA, 65 nt, Homo Sapiens
acuacuuuucuuauagguaguuuugauuccuuuuaaccauuuaagucgcacacuaaacuuuggua

SEQ ID NO: 278003 - RNA, 65 nt, Homo Sapiens
uguaccaacucaccuuaaauccccaucccaaauugaccauuuagaauaguggcagcugaccaauc

SEQ ID NO: 278004 - RNA, 65 nt, Homo Sapiens
ugguguaaagaacuuaauuucagugguuguggacaaccauuuacuuaguucauauguacacuagc

SEQ ID NO: 278005 - RNA, 65 nt, Homo Sapiens
uuagaacacucaacaacuauguuaagaaauagauaaccauuuauuaauuucuaauuugaaaggca

SEQ ID NO: 278006 - RNA, 65 nt, Homo Sapiens
ggaaaugcacugugggguuuuuuccuguaugggaaaccauuuaugccaagcuuuuccccauuucc

SEQ ID NO: 278007 - RNA, 65 nt, Homo Sapiens
ugacaucagcaacuuuugaaaacuucacacuuguuaccauuuagaaguuuccuggaaaauauaug

SEQ ID NO: 278008 - RNA, 65 nt, Homo Sapiens
gugagauaucaggaaugucucaugauaucacguuuaccauuuacaccaucugcaaccauaugcua

SEQ ID NO: 278009 - RNA, 65 nt, Homo Sapiens
uuucccuuacccagaaaugaaaauacucaauauggaccauuuaggaauuauaagcagcaacugug

SEQ ID NO: 278010 - RNA, 65 nt, Homo Sapiens
auaauagauguccguacaaguagcgcauauauuuaaccauuuaguuuggggcucuauauuacuug

SEQ ID NO: 278011 - RNA, 65 nt, Homo Sapiens
uuccagcaccaagcaaacuagcugguaacaguuccaccauuuagggcagacccauuggauuugcu

SEQ ID NO: 278012 - RNA, 65 nt, Homo Sapiens
agaacauuuuucucuccaacagauuuggaaaguuaaccauuuaaagcggagacgcgucagauggc

SEQ ID NO: 278013 - RNA, 65 nt, Homo Sapiens
gaaugcauacucugugcaagauuggagauuaaucuaccauuuauuuuacaaagcuugggacaguu

SEQ ID NO: 278014 - RNA, 65 nt, Homo Sapiens
uuguguuaacuaugaaccaaaucacauucucuagaaccauuuaguauaauguuagaguucaugua

SEQ ID NO: 278015 - RNA, 65 nt, Homo Sapiens
gaguuuuaaugggaguaggaacauugguaacagcuaccauuuauagauuaacaguauuaauagcg

SEQ ID NO: 278016 - RNA, 65 nt, Homo Sapiens
uauuguguauauguuuuuauuaauucacuuauaaaaccauuuacaaagaaaauguacauucuaau

SEQ ID NO: 278017 - RNA, 65 nt, Homo Sapiens
agugguuguaucugaauuuauaauagauguaugguaccauuuaaaugccuauuuuucaaauuauu

SEQ ID NO: 278018 - RNA, 65 nt, Homo Sapiens
cacaaauuugcugcacagaacaguucacaauuuucaccauuuaaaucugaagcaugauaaagggg

SEQ ID NO: 278019 - RNA, 65 nt, Homo Sapiens
auuuaaaaaauuauguuccacuauuaaccuauauaaccauuuaaaauuuugaaaagcaaaaaaua

SEQ ID NO: 278020 - RNA, 65 nt, Homo Sapiens
gaaauucacuucauuguaccuuaugauguauuugaaccauuuagaguauuccaagagccaucucc

SEQ ID NO: 278021 - RNA, 65 nt, Homo Sapiens
gcuggcaccagagacccgauuuacaagaaaguuauaccauuuaaacuguggugguguucuguugg

SEQ ID NO: 278022 - RNA, 65 nt, Homo Sapiens
uauguacaaauaaguuaauacuuuuucacacugaaaccauuuaaggaaugcuaggucagaagcug

SEQ ID NO: 278023 - RNA, 65 nt, Homo Sapiens
uagcagaaccacauauuuuagaaggcuguuugagaaccauuuacuaccuuaugagcaggaagagg

SEQ ID NO: 278024 - RNA, 65 nt, Homo Sapiens
gucuucuaaucaucuauguguguaugauggaugugaccauuuauaugucauguguugaaauuaaa

SEQ ID NO: 278025 - RNA, 65 nt, Homo Sapiens
ggaaggaaguaauguuaccuauccuugauaccaugaccauuuauuagauguuuugcuauauaaau

SEQ ID NO: 278026 - RNA, 65 nt, Homo Sapiens
uuugaugccaagugaauauaagagcuuguacugaaaccauuuauuucuuucuauuuugcuauuug

SEQ ID NO: 278027 - RNA, 65 nt, Homo Sapiens
gaaauuuuauucaaaggaauuguaaaccuuaaaccaccauuuauuuccaugugaaaaaguguuau

SEQ ID NO: 278028 - RNA, 65 nt, Homo Sapiens
aaaaagauuaagcaagugaaauucugcugcccuccaccauuuauuuuuacagugcuuuguaauuu

SEQ ID NO: 278029 - RNA, 65 nt, Homo Sapiens
aguaggcugcuaccuaacuuuuagucccuuccaaaaccauuuaguaggguucuauuacauaaaca

SEQ ID NO: 278030 - RNA, 65 nt, Homo Sapiens
aaacagauuacacaaaaauuauuuccagaaaggcuaccauuuaucaucauuauauuucaagccuc

SEQ ID NO: 278031 - RNA, 65 nt, Homo Sapiens
gggccuuguucuguucucuggaacuaaacagaacaaccauuuaccccuccuuuucaaacuagaga

SEQ ID NO: 278032 - RNA, 65 nt, Homo Sapiens
cuuucauuuauaguugggaacuggagagcagcacuaccauuuauuuacggagcagugccuaguau

SEQ ID NO: 278033 - RNA, 65 nt, Homo Sapiens
cauaaaauggacaacugagauuagaccuuaguaaaaccauuuaacaggaguuagaaaugaauuuu

SEQ ID NO: 278034 - RNA, 65 nt, Homo Sapiens
acuuuccugagccauuaucagaucuagucuguuacaccauuuagaauucuuuggaacuuuaauaa

SEQ ID NO: 278035 - RNA, 65 nt, Homo Sapiens
cuguuuucuuauagucuuaaucauuauugaauuauaccauuuacuauagugucauuuuauuuuag

SEQ ID NO: 278036 - RNA, 65 nt, Homo Sapiens
acauaaucucuagugaucauguggcuugaauuuuaaccauuuauuacaggcuggaccugcaagau

SEQ ID NO: 278037 - RNA, 65 nt, Homo Sapiens
uuaaaauacgacacccaguauuuucuuuaaguuucaccauuuacgcuacaugugauuuuuuuaau

SEQ ID NO: 278038 - RNA, 65 nt, Homo Sapiens
uuucaaaagugaacaauccugugauaaguuggaguaccauuuaguaauacagcaacauuguguca

SEQ ID NO: 278039 - RNA, 65 nt, Homo Sapiens
aacaugucacuugugcuuuaaaauuagucuguaucaccauuuauuacaguuauaauuuuggaguu

SEQ ID NO: 278040 - RNA, 65 nt, Homo Sapiens
uaauuuucaugugucaugaaauacuguuuucuccaaccauuuaauaauguaaauacuugcuagcu

SEQ ID NO: 278041 - RNA, 65 nt, Homo Sapiens
cuuuuuuuuuuuuuaaauuuuauuuuuauuccaucaccauuuacccacacuucccuugaucugcu

SEQ ID NO: 278042 - RNA, 65 nt, Homo Sapiens
uauaugugcuaggcaaaucugcagugcagaugagcaccauuuaguuaucacguaagugugugagu

SEQ ID NO: 278043 - RNA, 65 nt, Homo Sapiens
guaaaauagcuuggauucaagugcaaagcaaaaggaccauuuaaaguggccaagcgaggucucag

SEQ ID NO: 278044 - RNA, 65 nt, Homo Sapiens
uuacacugaucaauuucaacuccagccuaaaaaccaccauuuaacgguacagcuuaaaucauggg

SEQ ID NO: 278045 - RNA, 65 nt, Homo Sapiens
ggucauuuaaauaacaaaauauucauugcacauuaaccauuuagaugaguuucagaacaaaagau

SEQ ID NO: 278046 - RNA, 65 nt, Homo Sapiens
auaauaauagcgccauauucugugaauuaaaaaccaccauuuauauuaaauuccaccuaucuuaa

SEQ ID NO: 278047 - RNA, 65 nt, Homo Sapiens
uauccuuuauaaggaaugugagucauccuaaguauaccauuuaugguguuuaaauucuuaauauu

SEQ ID NO: 278048 - RNA, 65 nt, Homo Sapiens
cauagaggaagggcuuauggaaaagcuggccgagaaccauuuauauccucagaacaaagauugga

SEQ ID NO: 278049 - RNA, 65 nt, Homo Sapiens
uagugaauuauuaaaaaucuuucaugaaacaaaagaccauuuaaauuuuaguauuguuguaaaac

SEQ ID NO: 278050 - RNA, 65 nt, Homo Sapiens
gcagaaggaucagacaauaaaaugaguuagugcaaaccauuuaguaaaaauaacuaucagcagag

SEQ ID NO: 278051 - RNA, 65 nt, Homo Sapiens
auguucucagaacauuuagccugcaguugggcaaaaccauuuaacacaaagccuauuuuauaaug

SEQ ID NO: 278052 - RNA, 65 nt, Homo Sapiens
ggugucugugguagcuuuuaggcugcuccuaacccaccauuuauugccuucugagagguggguga

SEQ ID NO: 278053 - RNA, 65 nt, Homo Sapiens
aaucauguuuuuauauaaauaguuuauacuagacuaccauuuaaaaaacagcauuacaaaauccu

SEQ ID NO: 278054 - RNA, 65 nt, Homo Sapiens
acaagacuuccuuauuuauccccccaccccugggcaccauuuaggacucuccuucaacauccuca

SEQ ID NO: 278055 - RNA, 65 nt, Homo Sapiens
aaaaauguauacuaccuuaaguuaauuuguuuuucaccauuuagcggaggccauuuagaugauua

SEQ ID NO: 278056 - RNA, 65 nt, Homo Sapiens
aaaauugugugaugaaugaauguaauauacuuuguaccauuuauaagcccuucuguauuuuaaaa

SEQ ID NO: 278057 - RNA, 65 nt, Homo Sapiens
aaaacaaccaucugagacacuuaaaguauggcccgaccauuuaagauucauuuccauaaaccaag

SEQ ID NO: 278058 - RNA, 65 nt, Homo Sapiens
aaaggguaaacaaaaaacuaaaacuuauacaagauaccauuuacacugaacauagaauucccuag

SEQ ID NO: 278059 - RNA, 65 nt, Homo Sapiens
gcuuccagaucgugaggcuggggagcauucuagguaccauuuauuaucuacugcguuucggucag

SEQ ID NO: 278060 - RNA, 65 nt, Homo Sapiens
ggucccucccacaacacaugggaauucugagagauaccauuuaaguugagauuucaguggggaca

SEQ ID NO: 278061 - RNA, 65 nt, Homo Sapiens
cacagauguauaggggaugucucuaagagaccauuaccauuuauuauguucacaaaaaguagaaa

SEQ ID NO: 278062 - RNA, 65 nt, Homo Sapiens
ugucacuguuaacacuuuucaauuaaaaucauguaaccauuuaaauugcuuauuaucaaaagaau

SEQ ID NO: 278063 - RNA, 65 nt, Homo Sapiens
auacaaaauccuauuuuggauacauuuuuugguaaaccauuuaaaguuuacccaaaaguauaaga

SEQ ID NO: 278064 - RNA, 65 nt, Homo Sapiens
uucuaguagccaucuucacuaaacuuuaacugaugaccauuuauaugaauuauugaauaguaauu

SEQ ID NO: 278065 - RNA, 65 nt, Homo Sapiens
agccugagcaaggaccaccacccuuuuuaccuagaaccauuuaaaacuuugaaacaggacugaag

SEQ ID NO: 278066 - RNA, 65 nt, Homo Sapiens
augagggugcaagagccacaacaaguucccuaguuaccauuuaauauguugaaaggagaaaaagc

SEQ ID NO: 278067 - RNA, 65 nt, Homo Sapiens
ucugccuuuuucuuccguuccuagcaaaugacccuaccauuuauuaaucccagcuuucuuuucua

SEQ ID NO: 278068 - RNA, 65 nt, Homo Sapiens
uggcaggcagucugcucucuaaggaaauaauauggaccauuuaccccccugucagggccucugcc

SEQ ID NO: 278069 - RNA, 65 nt, Homo Sapiens
gcgauuuagcuugaaauuaacuuucuaucuucauaaccauuuaaaaugggguuuuuuuguuuuua

SEQ ID NO: 278070 - RNA, 65 nt, Homo Sapiens
gcuaacugggucuuagcaucuaagucuuucuaaaaaccauuuaaaauuaaccacuuuugacuagg

SEQ ID NO: 278071 - RNA, 65 nt, Homo Sapiens
uacauggaaaccagaaaugcaacaguuacuaaaacaccauuuaauaguuauaacgucguuacuug

SEQ ID NO: 278072 - RNA, 65 nt, Homo Sapiens
auguuguagaauaaauuaaaaggauaaucuaaaucaccauuuagauuaagcuugacuugcaaacu

SEQ ID NO: 278073 - RNA, 65 nt, Homo Sapiens
cagcaauauucaaagaaagaaccacagauguguuaaccauuuaagcagaucaucugccaaacauu

SEQ ID NO: 278074 - RNA, 65 nt, Homo Sapiens
auucuguuauuuuagucuccaucuauuuuauacuuaccauuuauuuuaagaaauaacauuuuaaa

SEQ ID NO: 278075 - RNA, 65 nt, Homo Sapiens
uuccacggaugagucacaauagauuuaggugcuaaaccauuuauuagccacugaugggaauauac

SEQ ID NO: 278076 - RNA, 65 nt, Homo Sapiens
agauuagccaaauagucugaacggggcuguaaauuaccauuuacuacauugacuucagcaaaagc

SEQ ID NO: 278077 - RNA, 65 nt, Homo Sapiens
aauguaaaaacgaccugacuuauaugaccuuuguaaccauuuaaagauauuauuauguggguauu

SEQ ID NO: 278078 - RNA, 65 nt, Homo Sapiens
ccugacugggguaagaaauguuggcuccucaggccaccauuuagguaaucugagaagucagccuc

SEQ ID NO: 278079 - RNA, 65 nt, Homo Sapiens
auugacauuuaauuuucaaaaguucuugucuuguuaccauuuaaacuaguggaagcccagucuug

SEQ ID NO: 278080 - RNA, 65 nt, Homo Sapiens
cuacuuaucccucaaugcacgaaugcuguuuaaacaccauuuaccaugcuuuaauccuuucuuua

SEQ ID NO: 278081 - RNA, 65 nt, Homo Sapiens
gaauguucugaucuuucauugagagaauuuuguaaaccauuuauuucuguucucuuuguuuuaaa

SEQ ID NO: 278082 - RNA, 65 nt, Homo Sapiens
uccaccuccucuuuuuugcuacugcuggcccaaagaccauuuaggcaaaaacagucaauagggcu

SEQ ID NO: 278083 - RNA, 65 nt, Homo Sapiens
uguuuuaaagaaagaaguguuagaggagucacguuaccauuuacauggggagccucgggaaaagg

SEQ ID NO: 278084 - RNA, 65 nt, Homo Sapiens
gagcaucuauuaugugccagugcuucaauucagcaaccauuuauucugggagauucagcuuaauu

SEQ ID NO: 278085 - RNA, 65 nt, Homo Sapiens
auuugccuacagaauuucaugcuacuggcccagcuaccauuuaccauaauccacccaugcaaaua

SEQ ID NO: 278086 - RNA, 65 nt, Homo Sapiens
acacuuugucauuaucaagagagauggcaguauugaccauuuaguuuaguuaaaaaaaaaaaaaa

SEQ ID NO: 278087 - RNA, 65 nt, Homo Sapiens
uaugaguauggaugucacucaacuaagaucaaaucaccauuuaaggggauggcauucuuuauacc

SEQ ID NO: 278088 - RNA, 65 nt, Homo Sapiens
uaaacuccaaggcagaaauuguaucuuuauagcuaaccauuuaguaaauaaauacauuacauuuu

SEQ ID NO: 278089 - RNA, 65 nt, Homo Sapiens
ugugguugacuaccuuuugauaagcaaaauuugaaaccauuuaaagaccacuguauuuuaacuca

SEQ ID NO: 278090 - RNA, 65 nt, Homo Sapiens
uuguguuuuaaaaaucuacuccugagugcucauguaccauuuagcuacugacacaagccaccgcc

SEQ ID NO: 278091 - RNA, 65 nt, Homo Sapiens
acacugcuugugaaaggaaaaagcaucuaugugagaccauuuagcucauuuaggugaggaagcaa

SEQ ID NO: 278092 - RNA, 65 nt, Homo Sapiens
aaauaucacagagccacuagagcccagccuugcccaccauuuaagaaugaguuacauuaucagcc

SEQ ID NO: 278093 - RNA, 65 nt, Homo Sapiens
uuuguuuuuauuuaauaguaguuguuucuauuaugaccauuuaauuugaucuauuuuccuaugga

SEQ ID NO: 278094 - RNA, 65 nt, Homo Sapiens
auuauuaguggcaacagaguuccuuuuuuccuaagaccauuuauaacccagugacuucaguggua

SEQ ID NO: 278095 - RNA, 65 nt, Homo Sapiens
gucuucucucagucuugcacgguggcaaagcuaucaccauuuaauacaucaaacaaaaaugcccu

SEQ ID NO: 278096 - RNA, 65 nt, Homo Sapiens
cuguagauuuauuuccauuuagacugaauguguucaccauuuagcggauaugcuuuuuuuuuuaa

SEQ ID NO: 278097 - RNA, 65 nt, Homo Sapiens
cguauguaaacuugguuucuacugagcuuuuaguaaccauuuaacugguguuaggagugguuaca

SEQ ID NO: 278098 - RNA, 65 nt, Homo Sapiens
uucucugcccaagcccugucucauuuuuuugucccaccauuuaucuucucagguggcaauguaac

SEQ ID NO: 278099 - RNA, 65 nt, Homo Sapiens
aaaauguagcuggcccaggaacuaugccaucauccaccauuuaguucuuuuuagcuguuaaaugu

SEQ ID NO: 278100 - RNA, 65 nt, Homo Sapiens
cucagaauucauaauuccugucugaucaugauaugaccauuuaacuugcuaucuuuuuuuauuau

SEQ ID NO: 278101 - RNA, 65 nt, Homo Sapiens
caagagauggcuuuuuccuuagggugaauuggaucaccauuuacaagugaaauucagucuuaagu

SEQ ID NO: 278102 - RNA, 65 nt, Homo Sapiens
ccuauuauucugauuuuuaaaaaugcaguuaauguaccauuuauuugcuugaugaagggagcucu

SEQ ID NO: 278103 - RNA, 65 nt, Homo Sapiens
aguucacaguuaauuguugcgcucuaauacaacugaccauuuaaaauugaacaaguuuauuguuu

SEQ ID NO: 278104 - RNA, 65 nt, Homo Sapiens
cuaaaugucaauguauuuuuggcacugcgauuuuaaccauuuauuaaauaaaaauuuuguuaaag

SEQ ID NO: 278105 - RNA, 65 nt, Homo Sapiens
ggggaggacaaaauggggcauuuuauugacacaguaccauuuaauuuaaagaggucgcuugggaa

SEQ ID NO: 278106 - RNA, 65 nt, Homo Sapiens
ugguguaaaaaacuuuauuuuaguggcugugaacaaccauuuaguuaguucauauguacaccagc

SEQ ID NO: 278107 - RNA, 65 nt, Homo Sapiens
augccaucugaaggggauucauauaaugucuguuaaccauuuaagaguuucauuuuacuuuaacu

SEQ ID NO: 278108 - RNA, 65 nt, Homo Sapiens
aaaguuugccggcuaggugccccccacccccgccaaccauuuaaaaaacauuacucauuugauuu

SEQ ID NO: 278109 - RNA, 52 nt, Homo Sapiens; identical to SEQ ID NO: 277781

SEQ ID NO: 278110 - RNA, 65 nt, Homo Sapiens
uuuuuuaaaaaagugugccuugcuguauuucuuauaccauuuauuaaaaagcugcuuucacggua

SEQ ID NO: 278111 - RNA, 65 nt, Homo Sapiens
ugucaauuaguagcuuaccacagauacuguuuccuaccauuuauaaaauuuacuuuuuauugaaa

SEQ ID NO: 278112 - RNA, 65 nt, Homo Sapiens
guucugacuggagaccccagugugggggaggucuuaccauuuaauauagaaaugauaucaauaac

SEQ ID NO: 278113 - RNA, 65 nt, Homo Sapiens
ggaaaauagaagaguguguugggcagguaguuuguaccauuuaugaagguuuguuccuuuguuaa

SEQ ID NO: 278114 - RNA, 65 nt, Homo Sapiens
ggcucaacuuuuuaaaauccagacccaguguuaaaaccauuuauuccuuuuuucauaagaauaau

SEQ ID NO: 278115 - RNA, 65 nt, Homo Sapiens
ucucaaauauauauuuaaaagauuuaugaauacaaaccauuuaugguuuaugauuucuaaaaaga

SEQ ID NO: 278116 - RNA, 65 nt, Homo Sapiens
cuggaggaagaaaacaggugaaagaagaaguaaaaaccauuuaguauuaguauuagaaugaaguc

SEQ ID NO: 278117 - RNA, 65 nt, Homo Sapiens
ugcuaugacaauuugcacagcccaguggcuuaaacaccauuuauaccacagguccagaugaaucc

SEQ ID NO: 278118 - RNA, 65 nt, Homo Sapiens
gaauuuuuuuuucaguaaaauuucuaugaguguauaccauuuaaacacauaacacauaaaauuag

SEQ ID NO: 278119 - RNA, 65 nt, Homo Sapiens
uaagagaaggugagaaggaucaagaaaauuuugcuaccauuuaagaaacagauuuuuuuuuauuu

SEQ ID NO: 278120 - RNA, 65 nt, Homo Sapiens
ugaggggaaacacuagccaguuguauaaauauaucaccauuuacaaccuaauguaauaaauuuua

SEQ ID NO: 278121 - RNA, 65 nt, Homo Sapiens
agacucuuuauuuuucucuugguagagcccucagaaccauuuaagcauccuccuuucaguucguu

SEQ ID NO: 278122 - RNA, 65 nt, Homo Sapiens
auggaugaaagagaucuguaaaucauaauuuagcaaccauuuaucuuaugggauuacuuuugcag

SEQ ID NO: 278123 - RNA, 65 nt, Homo Sapiens
uuuuuuaauaaguuuuuuacuuuuaacuuuaacugaccauuuaaguaaauugugcagcaauagau

SEQ ID NO: 278124 - RNA, 65 nt, Homo Sapiens
uuuaacaaguauugcaguaaucaucacuuacagguaccauuuauuucaaaacaacuuuuuuaguc

SEQ ID NO: 278125 - RNA, 65 nt, Homo Sapiens
ugaauuugagaagccaaauggaauuuuuaauggaaaccauuuaucagauuaaucucuugcucucc

SEQ ID NO: 278126 - RNA, 65 nt, Homo Sapiens
ggggaaacgauuuuuuguguccuuaaaauggcaugaccauuuauuugccccuuucuccauccugu

SEQ ID NO: 278127 - RNA, 65 nt, Homo Sapiens
uauugucaauaaugaaacccaauuguaaaacagucaccauuuacuaccaguaacuuuuaguuaau

SEQ ID NO: 278128 - RNA, 65 nt, Homo Sapiens
gugauuuuagcuguggguuuaagcauaagucucucaccauuuaguuguuccugacucugacaaga

SEQ ID NO: 278129 - RNA, 65 nt, Homo Sapiens
acuucccucacugcccuacccuccuuuucuuucucaccauuuaucccgcccuguuaguuuucagu

SEQ ID NO: 278130 - RNA, 65 nt, Homo Sapiens
auguucuacuuuagugauauuuaacauguauauauaccauuuauuaucuuuaagcuauaaaugug

SEQ ID NO: 278131 - RNA, 65 nt, Homo Sapiens
aaguaaugcugauauuuauuuguacauaaaauaaaaccauuuaaauacaacguauguucauuauu

SEQ ID NO: 278132 - RNA, 65 nt, Homo Sapiens
aaaaaaaaaucuuugaaggguuaggaucuuaaaaaaccauuuaauauaggggaaacugggagacu

SEQ ID NO: 278133 - RNA, 65 nt, Homo Sapiens
cuugaaaggaaacaguuuaaugguggaaaugaacuaccauuuauaacuucuguuuuuuuauugag

SEQ ID NO: 278134 - RNA, 65 nt, Homo Sapiens
aacggcuauuaaaugucacaauccuuuaauuagaaaccauuuauuggccggacgcgguggcucac

SEQ ID NO: 278135 - RNA, 65 nt, Homo Sapiens
gagacuccgucucaaaaaaaaaaaaaaaaaaagaaaccauuuauuuuaaaaaugauuagauugcu

SEQ ID NO: 278136 - RNA, 65 nt, Homo Sapiens
gguuggagaauuuagguuuuuauuaguaccauaguaccauuuauacaaauuagaaaauguuauuu

SEQ ID NO: 278137 - RNA, 65 nt, Homo Sapiens
aacugaaaggacacgaagucuugauucuauagaaaaccauuuaccauuuaaagaaagaaauauua

SEQ ID NO: 278138 - RNA, 65 nt, Homo Sapiens
acuaguauuuguuaaaugggauuuuaagccaaauaaccauuuaacaaaggauuuucuuaacucag

SEQ ID NO: 278139 - RNA, 65 nt, Homo Sapiens
cuacauauaacuggggaaaagacauuuaugauuaaaccauuuauguguuuaucaugccuaaggga

SEQ ID NO: 278140 - RNA, 65 nt, Homo Sapiens
caauuaagugguucucaucucuaauuaacugugaaaccauuuaauccaaacauguaagcacacac

SEQ ID NO: 278141 - RNA, 65 nt, Homo Sapiens
gcucagcuccacucggguggaguggaaguggccagaccauuuagacggacaggguccucacccua

SEQ ID NO: 278142 - RNA, 65 nt, Homo Sapiens
ugaugucagguacaaauacacuauagagucaaaauaccauuuacaaagaaaaucaaaagcauuuc

SEQ ID NO: 278143 - RNA, 65 nt, Homo Sapiens
uugcuguuagaauagugcuauauaucagguaugugaccauuuauuucagaaggcugaacauaaga

SEQ ID NO: 278144 - RNA, 65 nt, Homo Sapiens
ggauugcaagaaacucuuuuauuaaacuuggaacaaccauuuaaaugaaggauuuugugagauag

SEQ ID NO: 278145 - RNA, 65 nt, Homo Sapiens
aucaugagccuaauggcucaaccaaaggcuuuuggaccauuuagcuuucuuguccauaucacacc

SEQ ID NO: 278146 - RNA, 65 nt, Homo Sapiens
ugcucccaauguuuaugauauguugcccuuucuguaccauuuauuuccugaagaggaacugggcc

SEQ ID NO: 278147 - RNA, 65 nt, Homo Sapiens
cuaaacuuagucauuuauuucaaauuccuaaugcaaccauuuaguagcgauauaauuuugguugu

SEQ ID NO: 278148 - RNA, 65 nt, Homo Sapiens
uauuaaaacgaagggaaaagggaccacugaauugcaccauuuaagaugcugcuugaacaaauggg

SEQ ID NO: 278149 - RNA, 65 nt, Homo Sapiens
uguauuaacuuuggaauguaauuauugcauuauauaccauuuaucugauggaauaacucuguggc

SEQ ID NO: 278150 - RNA, 65 nt, Homo Sapiens
ccauuccucccuucuuucuuaaaguaauaaaauuuaccauuuaguucaagcuggcaauguggaca

SEQ ID NO: 278151 - RNA, 65 nt, Homo Sapiens
aauuuauccuuuuuuucuuuccugauuauccuaacaccauuuauucaauaaccuuguccauuuuc

SEQ ID NO: 278152 - RNA, 65 nt, Homo Sapiens
gguguguggaagugaccacugggaugucaucauucaccauuuauccaggauggccgcucaccagg

SEQ ID NO: 278153 - RNA, 65 nt, Homo Sapiens
accuccacacuccauggagacucaguucuccuaggaccauuuauucaaaaggacugcccucucuu

SEQ ID NO: 278154 - RNA, 65 nt, Homo Sapiens
ccaaaaggagagguagaugcauauuuuuguguggaaccauuuaucuuaaaacauugaggugcagu

SEQ ID NO: 278155 - RNA, 65 nt, Homo Sapiens
cuuuuguacaucaaccgugccccuuuuuggggcuaaccauuuaugaggagggugacauuuuuacu

SEQ ID NO: 278156 - RNA, 65 nt, Homo Sapiens
ccauugguugccaucuuuaagauaugaguguuguuaccauuuagcagaaauacuaugaauguaag

SEQ ID NO: 278157 - RNA, 65 nt, Homo Sapiens
uaccuacacgcacgcaagagcccacaagccuauacaccauuuauaggacugucuaugcaugcaca

SEQ ID NO: 278158 - RNA, 65 nt, Homo Sapiens
caugguuuaucuucagcaaauaaaagccuuccaacaccauuuaaaagagaaagaauauguugauu

SEQ ID NO: 278159 - RNA, 65 nt, Homo Sapiens
uccuauuaccuuuucucaucucuaggcacuuuaucaccauuuagauuguaccacuuaaaguggaa

SEQ ID NO: 278160 - RNA, 65 nt, Homo Sapiens
auuucauagucauuuauguuauuuuuuuuuccuucaccauuuaucuucuccagucuuccuucacu

SEQ ID NO: 278161 - RNA, 65 nt, Homo Sapiens
cacaugaucuguuuuucaccacuucacugaaagacaccauuuaucuacccaagggcagaaaguag

SEQ ID NO: 278162 - RNA, 65 nt, Homo Sapiens
aaaagaauuuuaaaaaagauggauuugacacacucaccauuuaaucauuuccagcaaaauauaug

SEQ ID NO: 278163 - RNA, 65 nt, Homo Sapiens
acagucaccuucucggcaacuaagcagucccugagaccauuuaacaugcaacccgaagguuaugg

SEQ ID NO: 278164 - RNA, 65 nt, Homo Sapiens
agcacuggaaaccguuauuugcaaacauugcuguuaccauuuagaaauaugugcacuaucagcug

SEQ ID NO: 278165 - RNA, 65 nt, Homo Sapiens
auuuauuuagcaccugccagaugccagaaauuuauaccauuuaaaacucaguaagucuuuuaaau

SEQ ID NO: 278166 - RNA, 65 nt, Homo Sapiens
agucucaaguuuuauuauugcacccuucccccagcaccauuuauguuggugagaaaucguugcug

SEQ ID NO: 278167 - RNA, 65 nt, Homo Sapiens
aaaagauaccaaaguagaagggggggacagagggaaccauuuaagucccccauucuguguguguc

SEQ ID NO: 278168 - RNA, 65 nt, Homo Sapiens
uuguguucuacugaguaagaauauuggaguuauaaaccauuuacuguacuguauuuuccuugcaa

SEQ ID NO: 278169 - RNA, 65 nt, Homo Sapiens
gaugaggaaacuaaggcuccggguuugugauugucaccauuuacuucuuccagcauucuaaagga

SEQ ID NO: 278170 - RNA, 65 nt, Homo Sapiens
uaauguuuucuuuaaauggccacgcugccuguaccaccauuuacuaauagcaccaugauagguug

SEQ ID NO: 278171 - RNA, 65 nt, Homo Sapiens
auugaaaaauuuccaaguuguuagaguuuuuaauaaccauuuaauucaugaaaauaucauuaauc

SEQ ID NO: 278172 - RNA, 65 nt, Homo Sapiens
aaguucauauauagaauuuacgggagaaacuugagaccauuuacggggagaaacuugauucuggg

SEQ ID NO: 278173 - RNA, 65 nt, Homo Sapiens
uccagauagagcagaggagaguaaaauucuaaauuaccauuuacucaagaauuagcacagcugau

SEQ ID NO: 278174 - RNA, 65 nt, Homo Sapiens
ugucagucucccaguuuuucuaaucaugcagauaaaccauuuaaauguuggaaaugugauuaauu

SEQ ID NO: 278175 - RNA, 65 nt, Homo Sapiens
guucuuguucugugucacucggcccuggguagucuaccauuuacuucaccccaaguccugcugcc

SEQ ID NO: 278176 - RNA, 65 nt, Homo Sapiens
ucaaugcacauugcuuuagaucacauucgugauuuaccauuuaauuaacugguaaccucaaaauu

SEQ ID NO: 278177 - RNA, 65 nt, Homo Sapiens
uguuaaugauucccacauuuccuuugcuuuuucauaccauuuauuccuggguggucucauccauu

SEQ ID NO: 278178 - RNA, 65 nt, Homo Sapiens
gguugguggcaacaauuuuaucuugguguaguguaaccauuuaguggcucccugccauuuuagug

SEQ ID NO: 278179 - RNA, 65 nt, Homo Sapiens
ccccucagcaaauaccuaugucaacaguauaaguuaccauuuacucuauaaucugcagugaugca

SEQ ID NO: 278180 - RNA, 65 nt, Homo Sapiens
cgauuugugguaacuguagucaucuuaaauuucaaaccauuuaccaucugaaaguuuugauuuga

SEQ ID NO: 278181 - RNA, 65 nt, Homo Sapiens
agaacuauguuauaguccagucuacuucuuuaaaaaccauuuaaacugcuagauaguauuagaau

SEQ ID NO: 278182 - RNA, 65 nt, Homo Sapiens
aaguauuauauuuuauuuaucuuuguagccuaaagaccauuuaaucuugaaggaacacaaagauc

SEQ ID NO: 278183 - RNA, 65 nt, Homo Sapiens
uuuuguuggccauauuacugccacacaugagaagcaccauuuaugcagauuuucuucagaauauu

SEQ ID NO: 278184 - RNA, 65 nt, Homo Sapiens
gaaaucauaccuuaauuuuuuuuuuuuuuuuuuuuaccauuuaugauuuauucuccuauguguca

SEQ ID NO: 278185 - RNA, 65 nt, Homo Sapiens
cugggaacuuauuaaauggaaacugaaacuacugcaccauuuaaaaacaggcagcucauaagagc

SEQ ID NO: 278186 - RNA, 65 nt, Homo Sapiens
gggcacauguaucauuuuacaaaugagcuuucaagaccauuuaaggaaacagaugcuucauuugc

SEQ ID NO: 278187 - RNA, 65 nt, Homo Sapiens
aauugguaugaacaugagacuaauguuccccagaaaccauuuauuaaguagagaacauguugcua

SEQ ID NO: 278188 - RNA, 65 nt, Homo Sapiens
ugaucauacaggacaggcugcccgugucuguggucaccauuuaggcaauccauuccagcaaauuc

SEQ ID NO: 278189 - RNA, 65 nt, Homo Sapiens
ccucaccuucuguuuuagagugaaagacaguaaagaccauuuagugaauacuguauuguuacagc

SEQ ID NO: 278190 - RNA, 65 nt, Homo Sapiens
ggguugggagucuuggccaaccaggaagaauuuguaccauuuaauuccuggccauacucaggggu

SEQ ID NO: 278191 - RNA, 65 nt, Homo Sapiens
uagugaugugggauaaccuuaaggagaacuuggaaaccauuuaugguagacaacaaugaauaaau

SEQ ID NO: 278192 - RNA, 65 nt, Homo Sapiens
uaaaacacagagcuuagacagaaagcgaugaggggaccauuuacaaaagguaagaaauaaacaau

SEQ ID NO: 278193 - RNA, 65 nt, Homo Sapiens
uugaaggaaaaauucaauaguaaaauucucuuccaaccauuuaucgcaaaagugcugcagggcuu

SEQ ID NO: 278194 - RNA, 65 nt, Homo Sapiens
uuauggcuaagaaauggacuaaaacauaaaaugugaccauuuaacuuaguuauggagacaaagug

SEQ ID NO: 278195 - RNA, 65 nt, Homo Sapiens
uguguguuaaacaacuacagccuucccccaauaagaccauuuaagcugcaagaaccuccccuuuc

SEQ ID NO: 278196 - RNA, 65 nt, Homo Sapiens
gagauugcuuguugauuggaaagaguguuuuauucaccauuuaaacguuugcaaaguggcgugcc

SEQ ID NO: 278197 - RNA, 65 nt, Homo Sapiens
uaugacauauagaauuaauacaaaacaguuuaacaaccauuuaacugcaguguaagaaaauugga

SEQ ID NO: 278198 - RNA, 62 nt, Homo Sapiens; identical to SEQ ID NO: 253135

SEQ ID NO: 278199 - RNA, 62 nt, Homo Sapiens; identical to SEQ ID NO: 253136

SEQ ID NO: 278200 - RNA, 62 nt, Homo Sapiens; identical to SEQ ID NO: 253137

SEQ ID NO: 278201 - RNA, 62 nt, Homo Sapiens; identical to SEQ ID NO: 253138

SEQ ID NO: 278202 - RNA, 62 nt, Homo Sapiens; identical to SEQ ID NO: 253139

SEQ ID NO: 278203 - RNA, 62 nt, Homo Sapiens; identical to SEQ ID NO: 253140

SEQ ID NO: 278204 - RNA, 62 nt, Homo Sapiens; identical to SEQ ID NO: 253141

SEQ ID NO: 278205 - RNA, 62 nt, Homo Sapiens; identical to SEQ ID NO: 253142

SEQ ID NO: 278206 - RNA, 62 nt, Homo Sapiens; identical to SEQ ID NO: 253143

SEQ ID NO: 278207 - RNA, 62 nt, Homo Sapiens; identical to SEQ ID NO: 253144

SEQ ID NO: 278208 - RNA, 62 nt, Homo Sapiens; identical to SEQ ID NO: 253145

SEQ ID NO: 278209 - RNA, 58 nt, Homo Sapiens; identical to SEQ ID NO: 102991

SEQ ID NO: 278210 - RNA, 62 nt, Homo Sapiens; identical to SEQ ID NO: 253147

SEQ ID NO: 278211 - RNA, 62 nt, Homo Sapiens; identical to SEQ ID NO: 253148

SEQ ID NO: 278212 - RNA, 62 nt, Homo Sapiens; identical to SEQ ID NO: 253149

SEQ ID NO: 278213 - RNA, 62 nt, Homo Sapiens; identical to SEQ ID NO: 253150

SEQ ID NO: 278214 - RNA, 62 nt, Homo Sapiens; identical to SEQ ID NO: 253151

SEQ ID NO: 278215 - RNA, 62 nt, Homo Sapiens; identical to SEQ ID NO: 253152

SEQ ID NO: 278216 - RNA, 62 nt, Homo Sapiens; identical to SEQ ID NO: 253153

SEQ ID NO: 278217 - RNA, 62 nt, Homo Sapiens; identical to SEQ ID NO: 253154

SEQ ID NO: 278218 - RNA, 62 nt, Homo Sapiens; identical to SEQ ID NO: 253155

SEQ ID NO: 278219 - RNA, 62 nt, Homo Sapiens; identical to SEQ ID NO: 253156

SEQ ID NO: 278220 - RNA, 62 nt, Homo Sapiens; identical to SEQ ID NO: 253157

SEQ ID NO: 278221 - RNA, 62 nt, Homo Sapiens; identical to SEQ ID NO: 253158

SEQ ID NO: 278222 - RNA, 62 nt, Homo Sapiens; identical to SEQ ID NO: 253159

SEQ ID NO: 278223 - RNA, 62 nt, Homo Sapiens; identical to SEQ ID NO: 253160

SEQ ID NO: 278224 - RNA, 62 nt, Homo Sapiens; identical to SEQ ID NO: 253161

SEQ ID NO: 278225 - RNA, 62 nt, Homo Sapiens; identical to SEQ ID NO: 253162

SEQ ID NO: 278226 - RNA, 62 nt, Homo Sapiens; identical to SEQ ID NO: 253163

SEQ ID NO: 278227 - RNA, 62 nt, Homo Sapiens; identical to SEQ ID NO: 253164

SEQ ID NO: 278228 - RNA, 62 nt, Homo Sapiens; identical to SEQ ID NO: 253165

SEQ ID NO: 278229 - RNA, 62 nt, Homo Sapiens; identical to SEQ ID NO: 253166

SEQ ID NO: 278230 - RNA, 62 nt, Homo Sapiens; identical to SEQ ID NO: 253167

SEQ ID NO: 278231 - RNA, 62 nt, Homo Sapiens; identical to SEQ ID NO: 253168

SEQ ID NO: 278232 - RNA, 53 nt, Homo Sapiens; identical to SEQ ID NO: 103014

SEQ ID NO: 278233 - RNA, 62 nt, Homo Sapiens; identical to SEQ ID NO: 253170

SEQ ID NO: 278234 - RNA, 62 nt, Homo Sapiens; identical to SEQ ID NO: 253171

SEQ ID NO: 278235 - RNA, 62 nt, Homo Sapiens; identical to SEQ ID NO: 253172

SEQ ID NO: 278236 - RNA, 62 nt, Homo Sapiens; identical to SEQ ID NO: 253173

SEQ ID NO: 278237 - RNA, 62 nt, Homo Sapiens; identical to SEQ ID NO: 253174

SEQ ID NO: 278238 - RNA, 62 nt, Homo Sapiens; identical to SEQ ID NO: 253175

SEQ ID NO: 278239 - RNA, 62 nt, Homo Sapiens; identical to SEQ ID NO: 253176

SEQ ID NO: 278240 - RNA, 62 nt, Homo Sapiens; identical to SEQ ID NO: 253177

SEQ ID NO: 278241 - RNA, 62 nt, Homo Sapiens; identical to SEQ ID NO: 253178

SEQ ID NO: 278242 - RNA, 62 nt, Homo Sapiens; identical to SEQ ID NO: 253179

SEQ ID NO: 278243 - RNA, 62 nt, Homo Sapiens; identical to SEQ ID NO: 253180

SEQ ID NO: 278244 - RNA, 62 nt, Homo Sapiens; identical to SEQ ID NO: 253181

SEQ ID NO: 278245 - RNA, 62 nt, Homo Sapiens; identical to SEQ ID NO: 253182

SEQ ID NO: 278246 - RNA, 62 nt, Homo Sapiens; identical to SEQ ID NO: 253183

SEQ ID NO: 278247 - RNA, 62 nt, Homo Sapiens; identical to SEQ ID NO: 253184

SEQ ID NO: 278248 - RNA, 62 nt, Homo Sapiens; identical to SEQ ID NO: 253185

SEQ ID NO: 278249 - RNA, 62 nt, Homo Sapiens; identical to SEQ ID NO: 253186

SEQ ID NO: 278250 - RNA, 62 nt, Homo Sapiens; identical to SEQ ID NO: 253187

SEQ ID NO: 278251 - RNA, 62 nt, Homo Sapiens; identical to SEQ ID NO: 253188

SEQ ID NO: 278252 - RNA, 62 nt, Homo Sapiens; identical to SEQ ID NO: 253189

SEQ ID NO: 278253 - RNA, 62 nt, Homo Sapiens; identical to SEQ ID NO: 253190

SEQ ID NO: 278254 - RNA, 62 nt, Homo Sapiens; identical to SEQ ID NO: 253191

SEQ ID NO: 278255 - RNA, 62 nt, Homo Sapiens; identical to SEQ ID NO: 253192

SEQ ID NO: 278256 - RNA, 62 nt, Homo Sapiens; identical to SEQ ID NO: 253193

SEQ ID NO: 278257 - RNA, 62 nt, Homo Sapiens; identical to SEQ ID NO: 253194

SEQ ID NO: 278258 - RNA, 62 nt, Homo Sapiens; identical to SEQ ID NO: 253195

SEQ ID NO: 278259 - RNA, 62 nt, Homo Sapiens; identical to SEQ ID NO: 253196

SEQ ID NO: 278260 - RNA, 62 nt, Homo Sapiens; identical to SEQ ID NO: 253197

SEQ ID NO: 278261 - RNA, 62 nt, Homo Sapiens; identical to SEQ ID NO: 253198

SEQ ID NO: 278262 - RNA, 62 nt, Homo Sapiens; identical to SEQ ID NO: 253199

SEQ ID NO: 278263 - RNA, 62 nt, Homo Sapiens; identical to SEQ ID NO: 253200

SEQ ID NO: 278264 - RNA, 62 nt, Homo Sapiens; identical to SEQ ID NO: 253201

SEQ ID NO: 278265 - RNA, 62 nt, Homo Sapiens; identical to SEQ ID NO: 253202

SEQ ID NO: 278266 - RNA, 62 nt, Homo Sapiens; identical to SEQ ID NO: 253203

SEQ ID NO: 278267 - RNA, 62 nt, Homo Sapiens; identical to SEQ ID NO: 253204

SEQ ID NO: 278268 - RNA, 62 nt, Homo Sapiens; identical to SEQ ID NO: 253205

SEQ ID NO: 278269 - RNA, 62 nt, Homo Sapiens; identical to SEQ ID NO: 253206

SEQ ID NO: 278270 - RNA, 62 nt, Homo Sapiens; identical to SEQ ID NO: 253207

SEQ ID NO: 278271 - RNA, 62 nt, Homo Sapiens; identical to SEQ ID NO: 253208

SEQ ID NO: 278272 - RNA, 62 nt, Homo Sapiens; identical to SEQ ID NO: 253209

SEQ ID NO: 278273 - RNA, 62 nt, Homo Sapiens; identical to SEQ ID NO: 253210

SEQ ID NO: 278274 - RNA, 62 nt, Homo Sapiens; identical to SEQ ID NO: 253211

SEQ ID NO: 278275 - RNA, 62 nt, Homo Sapiens; identical to SEQ ID NO: 253212

SEQ ID NO: 278276 - RNA, 62 nt, Homo Sapiens; identical to SEQ ID NO: 253213

SEQ ID NO: 278277 - RNA, 62 nt, Homo Sapiens; identical to SEQ ID NO: 253214

SEQ ID NO: 278278 - RNA, 62 nt, Homo Sapiens; identical to SEQ ID NO: 253215

SEQ ID NO: 278279 - RNA, 62 nt, Homo Sapiens; identical to SEQ ID NO: 253216

SEQ ID NO: 278280 - RNA, 62 nt, Homo Sapiens; identical to SEQ ID NO: 253217

SEQ ID NO: 278281 - RNA, 62 nt, Homo Sapiens; identical to SEQ ID NO: 253218

SEQ ID NO: 278282 - RNA, 62 nt, Homo Sapiens; identical to SEQ ID NO: 253219

SEQ ID NO: 278283 - RNA, 62 nt, Homo Sapiens; identical to SEQ ID NO: 253220

SEQ ID NO: 278284 - RNA, 62 nt, Homo Sapiens; identical to SEQ ID NO: 253221

SEQ ID NO: 278285 - RNA, 62 nt, Homo Sapiens; identical to SEQ ID NO: 253222

SEQ ID NO: 278286 - RNA, 62 nt, Homo Sapiens; identical to SEQ ID NO: 253223

SEQ ID NO: 278287 - RNA, 62 nt, Homo Sapiens; identical to SEQ ID NO: 253224

SEQ ID NO: 278288 - RNA, 62 nt, Homo Sapiens; identical to SEQ ID NO: 253225

SEQ ID NO: 278289 - RNA, 62 nt, Homo Sapiens; identical to SEQ ID NO: 253226

SEQ ID NO: 278290 - RNA, 62 nt, Homo Sapiens; identical to SEQ ID NO: 253227

SEQ ID NO: 278291 - RNA, 62 nt, Homo Sapiens; identical to SEQ ID NO: 253228

SEQ ID NO: 278292 - RNA, 62 nt, Homo Sapiens; identical to SEQ ID NO: 253229

SEQ ID NO: 278293 - RNA, 62 nt, Homo Sapiens; identical to SEQ ID NO: 253230

SEQ ID NO: 278294 - RNA, 62 nt, Homo Sapiens; identical to SEQ ID NO: 253231

SEQ ID NO: 278295 - RNA, 62 nt, Homo Sapiens; identical to SEQ ID NO: 253232

SEQ ID NO: 278296 - RNA, 62 nt, Homo Sapiens; identical to SEQ ID NO: 253233

SEQ ID NO: 278297 - RNA, 62 nt, Homo Sapiens; identical to SEQ ID NO: 253234

SEQ ID NO: 278298 - RNA, 62 nt, Homo Sapiens; identical to SEQ ID NO: 253235

SEQ ID NO: 278299 - RNA, 62 nt, Homo Sapiens; identical to SEQ ID NO: 253236

SEQ ID NO: 278300 - RNA, 62 nt, Homo Sapiens; identical to SEQ ID NO: 253237

SEQ ID NO: 278301 - RNA, 62 nt, Homo Sapiens; identical to SEQ ID NO: 253238

SEQ ID NO: 278302 - RNA, 62 nt, Homo Sapiens; identical to SEQ ID NO: 253239

SEQ ID NO: 278303 - RNA, 62 nt, Homo Sapiens; identical to SEQ ID NO: 253240

SEQ ID NO: 278304 - RNA, 62 nt, Homo Sapiens; identical to SEQ ID NO: 253241

SEQ ID NO: 278305 - RNA, 62 nt, Homo Sapiens; identical to SEQ ID NO: 253242

SEQ ID NO: 278306 - RNA, 62 nt, Homo Sapiens; identical to SEQ ID NO: 253243

SEQ ID NO: 278307 - RNA, 62 nt, Homo Sapiens; identical to SEQ ID NO: 253244

SEQ ID NO: 278308 - RNA, 62 nt, Homo Sapiens; identical to SEQ ID NO: 253245

SEQ ID NO: 278309 - RNA, 62 nt, Homo Sapiens; identical to SEQ ID NO: 253246

SEQ ID NO: 278310 - RNA, 62 nt, Homo Sapiens; identical to SEQ ID NO: 253247

SEQ ID NO: 278311 - RNA, 62 nt, Homo Sapiens; identical to SEQ ID NO: 253248

SEQ ID NO: 278312 - RNA, 62 nt, Homo Sapiens; identical to SEQ ID NO: 253249

SEQ ID NO: 278313 - RNA, 62 nt, Homo Sapiens; identical to SEQ ID NO: 253250

SEQ ID NO: 278314 - RNA, 62 nt, Homo Sapiens; identical to SEQ ID NO: 253251

SEQ ID NO: 278315 - RNA, 62 nt, Homo Sapiens; identical to SEQ ID NO: 253252

SEQ ID NO: 278316 - RNA, 60 nt, Homo Sapiens; identical to SEQ ID NO: 103098

SEQ ID NO: 278317 - RNA, 62 nt, Homo Sapiens; identical to SEQ ID NO: 253254

SEQ ID NO: 278318 - RNA, 62 nt, Homo Sapiens; identical to SEQ ID NO: 253255

SEQ ID NO: 278319 - RNA, 62 nt, Homo Sapiens; identical to SEQ ID NO: 253256

SEQ ID NO: 278320 - RNA, 62 nt, Homo Sapiens; identical to SEQ ID NO: 253257

SEQ ID NO: 278321 - RNA, 62 nt, Homo Sapiens; identical to SEQ ID NO: 253258

SEQ ID NO: 278322 - RNA, 62 nt, Homo Sapiens; identical to SEQ ID NO: 253259

SEQ ID NO: 278323 - RNA, 62 nt, Homo Sapiens; identical to SEQ ID NO: 253260

SEQ ID NO: 278324 - RNA, 62 nt, Homo Sapiens; identical to SEQ ID NO: 253261

SEQ ID NO: 278325 - RNA, 62 nt, Homo Sapiens; identical to SEQ ID NO: 253262

SEQ ID NO: 278326 - RNA, 62 nt, Homo Sapiens; identical to SEQ ID NO: 253263

SEQ ID NO: 278327 - RNA, 62 nt, Homo Sapiens; identical to SEQ ID NO: 253264

SEQ ID NO: 278328 - RNA, 62 nt, Homo Sapiens; identical to SEQ ID NO: 253265

SEQ ID NO: 278329 - RNA, 62 nt, Homo Sapiens; identical to SEQ ID NO: 253266

SEQ ID NO: 278330 - RNA, 62 nt, Homo Sapiens; identical to SEQ ID NO: 253267

SEQ ID NO: 278331 - RNA, 62 nt, Homo Sapiens; identical to SEQ ID NO: 253268

SEQ ID NO: 278332 - RNA, 62 nt, Homo Sapiens; identical to SEQ ID NO: 253269

SEQ ID NO: 278333 - RNA, 62 nt, Homo Sapiens; identical to SEQ ID NO: 253270

SEQ ID NO: 278334 - RNA, 62 nt, Homo Sapiens; identical to SEQ ID NO: 253271

SEQ ID NO: 278335 - RNA, 62 nt, Homo Sapiens; identical to SEQ ID NO: 253272

SEQ ID NO: 278336 - RNA, 62 nt, Homo Sapiens; identical to SEQ ID NO: 253273

SEQ ID NO: 278337 - RNA, 62 nt, Homo Sapiens; identical to SEQ ID NO: 253274

SEQ ID NO: 278338 - RNA, 62 nt, Homo Sapiens; identical to SEQ ID NO: 253275

SEQ ID NO: 278339 - RNA, 62 nt, Homo Sapiens; identical to SEQ ID NO: 253276

SEQ ID NO: 278340 - RNA, 62 nt, Homo Sapiens; identical to SEQ ID NO: 253277

SEQ ID NO: 278341 - RNA, 62 nt, Homo Sapiens; identical to SEQ ID NO: 253278

SEQ ID NO: 278342 - RNA, 62 nt, Homo Sapiens; identical to SEQ ID NO: 253279

SEQ ID NO: 278343 - RNA, 62 nt, Homo Sapiens; identical to SEQ ID NO: 253280

SEQ ID NO: 278344 - RNA, 62 nt, Homo Sapiens; identical to SEQ ID NO: 253281

SEQ ID NO: 278345 - RNA, 62 nt, Homo Sapiens; identical to SEQ ID NO: 253282

SEQ ID NO: 278346 - RNA, 62 nt, Homo Sapiens; identical to SEQ ID NO: 253283

SEQ ID NO: 278347 - RNA, 62 nt, Homo Sapiens; identical to SEQ ID NO: 253284

SEQ ID NO: 278348 - RNA, 62 nt, Homo Sapiens; identical to SEQ ID NO: 253285

SEQ ID NO: 278349 - RNA, 62 nt, Homo Sapiens; identical to SEQ ID NO: 253286

SEQ ID NO: 278350 - RNA, 62 nt, Homo Sapiens; identical to SEQ ID NO: 253287

SEQ ID NO: 278351 - RNA, 62 nt, Homo Sapiens; identical to SEQ ID NO: 253288

SEQ ID NO: 278352 - RNA, 62 nt, Homo Sapiens; identical to SEQ ID NO: 253289

SEQ ID NO: 278353 - RNA, 62 nt, Homo Sapiens; identical to SEQ ID NO: 253290

SEQ ID NO: 278354 - RNA, 62 nt, Homo Sapiens; identical to SEQ ID NO: 253291

SEQ ID NO: 278355 - RNA, 62 nt, Homo Sapiens; identical to SEQ ID NO: 253292

SEQ ID NO: 278356 - RNA, 62 nt, Homo Sapiens; identical to SEQ ID NO: 253293

SEQ ID NO: 278357 - RNA, 62 nt, Homo Sapiens; identical to SEQ ID NO: 253294

SEQ ID NO: 278358 - RNA, 62 nt, Homo Sapiens; identical to SEQ ID NO: 253295

SEQ ID NO: 278359 - RNA, 62 nt, Homo Sapiens; identical to SEQ ID NO: 253296

SEQ ID NO: 278360 - RNA, 62 nt, Homo Sapiens; identical to SEQ ID NO: 253297

SEQ ID NO: 278361 - RNA, 62 nt, Homo Sapiens; identical to SEQ ID NO: 253298

SEQ ID NO: 278362 - RNA, 62 nt, Homo Sapiens; identical to SEQ ID NO: 253299

SEQ ID NO: 278363 - RNA, 62 nt, Homo Sapiens; identical to SEQ ID NO: 253300

SEQ ID NO: 278364 - RNA, 62 nt, Homo Sapiens; identical to SEQ ID NO: 253301

SEQ ID NO: 278365 - RNA, 62 nt, Homo Sapiens; identical to SEQ ID NO: 253302

SEQ ID NO: 278366 - RNA, 62 nt, Homo Sapiens; identical to SEQ ID NO: 253303

SEQ ID NO: 278367 - RNA, 62 nt, Homo Sapiens; identical to SEQ ID NO: 253304

SEQ ID NO: 278368 - RNA, 62 nt, Homo Sapiens; identical to SEQ ID NO: 253305

SEQ ID NO: 278369 - RNA, 62 nt, Homo Sapiens; identical to SEQ ID NO: 253306

SEQ ID NO: 278370 - RNA, 62 nt, Homo Sapiens; identical to SEQ ID NO: 253307

SEQ ID NO: 278371 - RNA, 62 nt, Homo Sapiens; identical to SEQ ID NO: 253308

SEQ ID NO: 278372 - RNA, 62 nt, Homo Sapiens; identical to SEQ ID NO: 253309

SEQ ID NO: 278373 - RNA, 62 nt, Homo Sapiens; identical to SEQ ID NO: 253310

SEQ ID NO: 278374 - RNA, 62 nt, Homo Sapiens; identical to SEQ ID NO: 253311

SEQ ID NO: 278375 - RNA, 62 nt, Homo Sapiens; identical to SEQ ID NO: 253312

SEQ ID NO: 278376 - RNA, 62 nt, Homo Sapiens; identical to SEQ ID NO: 253313

SEQ ID NO: 278377 - RNA, 62 nt, Homo Sapiens; identical to SEQ ID NO: 253314

SEQ ID NO: 278378 - RNA, 62 nt, Homo Sapiens; identical to SEQ ID NO: 253315

SEQ ID NO: 278379 - RNA, 62 nt, Homo Sapiens; identical to SEQ ID NO: 253316

SEQ ID NO: 278380 - RNA, 62 nt, Homo Sapiens; identical to SEQ ID NO: 253317

SEQ ID NO: 278381 - RNA, 62 nt, Homo Sapiens; identical to SEQ ID NO: 253318

SEQ ID NO: 278382 - RNA, 62 nt, Homo Sapiens; identical to SEQ ID NO: 253319

SEQ ID NO: 278383 - RNA, 62 nt, Homo Sapiens; identical to SEQ ID NO: 253320

SEQ ID NO: 278384 - RNA, 62 nt, Homo Sapiens; identical to SEQ ID NO: 253321

SEQ ID NO: 278385 - RNA, 62 nt, Homo Sapiens; identical to SEQ ID NO: 253322

SEQ ID NO: 278386 - RNA, 62 nt, Homo Sapiens; identical to SEQ ID NO: 253323

SEQ ID NO: 278387 - RNA, 62 nt, Homo Sapiens; identical to SEQ ID NO: 253324

SEQ ID NO: 278388 - RNA, 62 nt, Homo Sapiens; identical to SEQ ID NO: 253325

SEQ ID NO: 278389 - RNA, 62 nt, Homo Sapiens; identical to SEQ ID NO: 253326

SEQ ID NO: 278390 - RNA, 62 nt, Homo Sapiens; identical to SEQ ID NO: 253327

SEQ ID NO: 278391 - RNA, 62 nt, Homo Sapiens; identical to SEQ ID NO: 253328

SEQ ID NO: 278392 - RNA, 62 nt, Homo Sapiens; identical to SEQ ID NO: 253329

SEQ ID NO: 278393 - RNA, 62 nt, Homo Sapiens; identical to SEQ ID NO: 253330

SEQ ID NO: 278394 - RNA, 62 nt, Homo Sapiens; identical to SEQ ID NO: 253331

SEQ ID NO: 278395 - RNA, 62 nt, Homo Sapiens; identical to SEQ ID NO: 253332

SEQ ID NO: 278396 - RNA, 62 nt, Homo Sapiens; identical to SEQ ID NO: 253333

SEQ ID NO: 278397 - RNA, 62 nt, Homo Sapiens; identical to SEQ ID NO: 253334

SEQ ID NO: 278398 - RNA, 62 nt, Homo Sapiens; identical to SEQ ID NO: 253335

SEQ ID NO: 278399 - RNA, 62 nt, Homo Sapiens; identical to SEQ ID NO: 253336

SEQ ID NO: 278400 - RNA, 62 nt, Homo Sapiens; identical to SEQ ID NO: 253337

SEQ ID NO: 278401 - RNA, 62 nt, Homo Sapiens; identical to SEQ ID NO: 253338

SEQ ID NO: 278402 - RNA, 62 nt, Homo Sapiens; identical to SEQ ID NO: 253339

SEQ ID NO: 278403 - RNA, 62 nt, Homo Sapiens; identical to SEQ ID NO: 253340

SEQ ID NO: 278404 - RNA, 62 nt, Homo Sapiens; identical to SEQ ID NO: 253341

SEQ ID NO: 278405 - RNA, 62 nt, Homo Sapiens; identical to SEQ ID NO: 253342

SEQ ID NO: 278406 - RNA, 62 nt, Homo Sapiens; identical to SEQ ID NO: 253343

SEQ ID NO: 278407 - RNA, 62 nt, Homo Sapiens; identical to SEQ ID NO: 253344

SEQ ID NO: 278408 - RNA, 62 nt, Homo Sapiens; identical to SEQ ID NO: 253345

SEQ ID NO: 278409 - RNA, 62 nt, Homo Sapiens; identical to SEQ ID NO: 253346

SEQ ID NO: 278410 - RNA, 62 nt, Homo Sapiens; identical to SEQ ID NO: 253347

SEQ ID NO: 278411 - RNA, 62 nt, Homo Sapiens; identical to SEQ ID NO: 253348

SEQ ID NO: 278412 - RNA, 62 nt, Homo Sapiens; identical to SEQ ID NO: 253349

SEQ ID NO: 278413 - RNA, 62 nt, Homo Sapiens; identical to SEQ ID NO: 253350

SEQ ID NO: 278414 - RNA, 51 nt, Homo Sapiens; identical to SEQ ID NO: 103196

SEQ ID NO: 278415 - RNA, 62 nt, Homo Sapiens; identical to SEQ ID NO: 253352

SEQ ID NO: 278416 - RNA, 62 nt, Homo Sapiens; identical to SEQ ID NO: 253353

SEQ ID NO: 278417 - RNA, 62 nt, Homo Sapiens; identical to SEQ ID NO: 253354

SEQ ID NO: 278418 - RNA, 62 nt, Homo Sapiens; identical to SEQ ID NO: 253355

SEQ ID NO: 278419 - RNA, 62 nt, Homo Sapiens; identical to SEQ ID NO: 253356

SEQ ID NO: 278420 - RNA, 62 nt, Homo Sapiens; identical to SEQ ID NO: 253357

SEQ ID NO: 278421 - RNA, 62 nt, Homo Sapiens; identical to SEQ ID NO: 253358

SEQ ID NO: 278422 - RNA, 62 nt, Homo Sapiens; identical to SEQ ID NO: 253359

SEQ ID NO: 278423 - RNA, 62 nt, Homo Sapiens; identical to SEQ ID NO: 253360

SEQ ID NO: 278424 - RNA, 62 nt, Homo Sapiens; identical to SEQ ID NO: 253361

SEQ ID NO: 278425 - RNA, 62 nt, Homo Sapiens; identical to SEQ ID NO: 253362

SEQ ID NO: 278426 - RNA, 62 nt, Homo Sapiens; identical to SEQ ID NO: 253363

SEQ ID NO: 278427 - RNA, 62 nt, Homo Sapiens; identical to SEQ ID NO: 253364

SEQ ID NO: 278428 - RNA, 62 nt, Homo Sapiens; identical to SEQ ID NO: 253365

SEQ ID NO: 278429 - RNA, 62 nt, Homo Sapiens; identical to SEQ ID NO: 253366

SEQ ID NO: 278430 - RNA, 62 nt, Homo Sapiens; identical to SEQ ID NO: 253367

SEQ ID NO: 278431 - RNA, 62 nt, Homo Sapiens; identical to SEQ ID NO: 253368

SEQ ID NO: 278432 - RNA, 62 nt, Homo Sapiens; identical to SEQ ID NO: 253369

SEQ ID NO: 278433 - RNA, 62 nt, Homo Sapiens; identical to SEQ ID NO: 253370

SEQ ID NO: 278434 - RNA, 62 nt, Homo Sapiens; identical to SEQ ID NO: 253371

SEQ ID NO: 278435 - RNA, 62 nt, Homo Sapiens; identical to SEQ ID NO: 253372

SEQ ID NO: 278436 - RNA, 62 nt, Homo Sapiens; identical to SEQ ID NO: 253373

SEQ ID NO: 278437 - RNA, 62 nt, Homo Sapiens; identical to SEQ ID NO: 253374

SEQ ID NO: 278438 - RNA, 62 nt, Homo Sapiens; identical to SEQ ID NO: 253375

SEQ ID NO: 278439 - RNA, 62 nt, Homo Sapiens; identical to SEQ ID NO: 253376

SEQ ID NO: 278440 - RNA, 62 nt, Homo Sapiens; identical to SEQ ID NO: 253377

SEQ ID NO: 278441 - RNA, 62 nt, Homo Sapiens; identical to SEQ ID NO: 253378

SEQ ID NO: 278442 - RNA, 62 nt, Homo Sapiens; identical to SEQ ID NO: 253379

SEQ ID NO: 278443 - RNA, 62 nt, Homo Sapiens; identical to SEQ ID NO: 253380

SEQ ID NO: 278444 - RNA, 62 nt, Homo Sapiens; identical to SEQ ID NO: 253381

SEQ ID NO: 278445 - RNA, 62 nt, Homo Sapiens; identical to SEQ ID NO: 253382

SEQ ID NO: 278446 - RNA, 62 nt, Homo Sapiens; identical to SEQ ID NO: 253383

SEQ ID NO: 278447 - RNA, 62 nt, Homo Sapiens; identical to SEQ ID NO: 253384

SEQ ID NO: 278448 - RNA, 62 nt, Homo Sapiens; identical to SEQ ID NO: 253385

SEQ ID NO: 278449 - RNA, 62 nt, Homo Sapiens; identical to SEQ ID NO: 253386

SEQ ID NO: 278450 - RNA, 62 nt, Homo Sapiens; identical to SEQ ID NO: 253387

SEQ ID NO: 278451 - RNA, 62 nt, Homo Sapiens; identical to SEQ ID NO: 253388

SEQ ID NO: 278452 - RNA, 62 nt, Homo Sapiens; identical to SEQ ID NO: 253389

SEQ ID NO: 278453 - RNA, 62 nt, Homo Sapiens; identical to SEQ ID NO: 253390

SEQ ID NO: 278454 - RNA, 62 nt, Homo Sapiens; identical to SEQ ID NO: 253391

SEQ ID NO: 278455 - RNA, 62 nt, Homo Sapiens; identical to SEQ ID NO: 253392

SEQ ID NO: 278456 - RNA, 62 nt, Homo Sapiens; identical to SEQ ID NO: 253393

SEQ ID NO: 278457 - RNA, 62 nt, Homo Sapiens; identical to SEQ ID NO: 253394

SEQ ID NO: 278458 - RNA, 62 nt, Homo Sapiens; identical to SEQ ID NO: 253395

SEQ ID NO: 278459 - RNA, 62 nt, Homo Sapiens; identical to SEQ ID NO: 253396

SEQ ID NO: 278460 - RNA, 62 nt, Homo Sapiens; identical to SEQ ID NO: 253397

SEQ ID NO: 278461 - RNA, 62 nt, Homo Sapiens; identical to SEQ ID NO: 253398

SEQ ID NO: 278462 - RNA, 62 nt, Homo Sapiens; identical to SEQ ID NO: 253399

SEQ ID NO: 278463 - RNA, 62 nt, Homo Sapiens; identical to SEQ ID NO: 253400

SEQ ID NO: 278464 - RNA, 62 nt, Homo Sapiens; identical to SEQ ID NO: 253401

SEQ ID NO: 278465 - RNA, 62 nt, Homo Sapiens; identical to SEQ ID NO: 253402

SEQ ID NO: 278466 - RNA, 62 nt, Homo Sapiens; identical to SEQ ID NO: 253403

SEQ ID NO: 278467 - RNA, 62 nt, Homo Sapiens; identical to SEQ ID NO: 253404

SEQ ID NO: 278468 - RNA, 62 nt, Homo Sapiens; identical to SEQ ID NO: 253405

SEQ ID NO: 278469 - RNA, 62 nt, Homo Sapiens; identical to SEQ ID NO: 253406

SEQ ID NO: 278470 - RNA, 62 nt, Homo Sapiens; identical to SEQ ID NO: 253407

SEQ ID NO: 278471 - RNA, 62 nt, Homo Sapiens; identical to SEQ ID NO: 253408

SEQ ID NO: 278472 - RNA, 62 nt, Homo Sapiens; identical to SEQ ID NO: 253409

SEQ ID NO: 278473 - RNA, 62 nt, Homo Sapiens; identical to SEQ ID NO: 253410

SEQ ID NO: 278474 - RNA, 62 nt, Homo Sapiens; identical to SEQ ID NO: 253411

SEQ ID NO: 278475 - RNA, 62 nt, Homo Sapiens; identical to SEQ ID NO: 253412

SEQ ID NO: 278476 - RNA, 62 nt, Homo Sapiens; identical to SEQ ID NO: 253413

SEQ ID NO: 278477 - RNA, 62 nt, Homo Sapiens; identical to SEQ ID NO: 253414

SEQ ID NO: 278478 - RNA, 62 nt, Homo Sapiens; identical to SEQ ID NO: 253415

SEQ ID NO: 278479 - RNA, 62 nt, Homo Sapiens; identical to SEQ ID NO: 253416

SEQ ID NO: 278480 - RNA, 62 nt, Homo Sapiens; identical to SEQ ID NO: 253417

SEQ ID NO: 278481 - RNA, 62 nt, Homo Sapiens; identical to SEQ ID NO: 253418

SEQ ID NO: 278482 - RNA, 62 nt, Homo Sapiens; identical to SEQ ID NO: 253419

SEQ ID NO: 278483 - RNA, 62 nt, Homo Sapiens; identical to SEQ ID NO: 253420

SEQ ID NO: 278484 - RNA, 62 nt, Homo Sapiens; identical to SEQ ID NO: 253421

SEQ ID NO: 278485 - RNA, 62 nt, Homo Sapiens; identical to SEQ ID NO: 253422

SEQ ID NO: 278486 - RNA, 62 nt, Homo Sapiens; identical to SEQ ID NO: 253423

SEQ ID NO: 278487 - RNA, 62 nt, Homo Sapiens; identical to SEQ ID NO: 253424

SEQ ID NO: 278488 - RNA, 62 nt, Homo Sapiens; identical to SEQ ID NO: 253425

SEQ ID NO: 278489 - RNA, 62 nt, Homo Sapiens; identical to SEQ ID NO: 253426

SEQ ID NO: 278490 - RNA, 62 nt, Homo Sapiens; identical to SEQ ID NO: 253427

SEQ ID NO: 278491 - RNA, 62 nt, Homo Sapiens; identical to SEQ ID NO: 253428

SEQ ID NO: 278492 - RNA, 62 nt, Homo Sapiens; identical to SEQ ID NO: 253429

SEQ ID NO: 278493 - RNA, 62 nt, Homo Sapiens; identical to SEQ ID NO: 253430

SEQ ID NO: 278494 - RNA, 62 nt, Homo Sapiens; identical to SEQ ID NO: 253431

SEQ ID NO: 278495 - RNA, 62 nt, Homo Sapiens; identical to SEQ ID NO: 253432

SEQ ID NO: 278496 - RNA, 62 nt, Homo Sapiens; identical to SEQ ID NO: 253433

SEQ ID NO: 278497 - RNA, 62 nt, Homo Sapiens; identical to SEQ ID NO: 253434

SEQ ID NO: 278498 - RNA, 62 nt, Homo Sapiens; identical to SEQ ID NO: 253435

SEQ ID NO: 278499 - RNA, 62 nt, Homo Sapiens; identical to SEQ ID NO: 253436

SEQ ID NO: 278500 - RNA, 62 nt, Homo Sapiens; identical to SEQ ID NO: 253437

SEQ ID NO: 278501 - RNA, 62 nt, Homo Sapiens; identical to SEQ ID NO: 253438

SEQ ID NO: 278502 - RNA, 62 nt, Homo Sapiens; identical to SEQ ID NO: 253439

SEQ ID NO: 278503 - RNA, 62 nt, Homo Sapiens; identical to SEQ ID NO: 253440

SEQ ID NO: 278504 - RNA, 62 nt, Homo Sapiens; identical to SEQ ID NO: 253441

SEQ ID NO: 278505 - RNA, 62 nt, Homo Sapiens; identical to SEQ ID NO: 253442

SEQ ID NO: 278506 - RNA, 62 nt, Homo Sapiens; identical to SEQ ID NO: 253443

SEQ ID NO: 278507 - RNA, 66 nt, Homo Sapiens; identical to SEQ ID NO: 253444

SEQ ID NO: 278508 - RNA, 66 nt, Homo Sapiens; identical to SEQ ID NO: 253445

SEQ ID NO: 278509 - RNA, 66 nt, Homo Sapiens; identical to SEQ ID NO: 253446

SEQ ID NO: 278510 - RNA, 66 nt, Homo Sapiens; identical to SEQ ID NO: 253447

SEQ ID NO: 278511 - RNA, 66 nt, Homo Sapiens; identical to SEQ ID NO: 253448

SEQ ID NO: 278512 - RNA, 66 nt, Homo Sapiens; identical to SEQ ID NO: 253449

SEQ ID NO: 278513 - RNA, 66 nt, Homo Sapiens; identical to SEQ ID NO: 253450

SEQ ID NO: 278514 - RNA, 66 nt, Homo Sapiens; identical to SEQ ID NO: 253451

SEQ ID NO: 278515 - RNA, 66 nt, Homo Sapiens; identical to SEQ ID NO: 253452

SEQ ID NO: 278516 - RNA, 66 nt, Homo Sapiens; identical to SEQ ID NO: 253453

SEQ ID NO: 278517 - RNA, 66 nt, Homo Sapiens; identical to SEQ ID NO: 253454

SEQ ID NO: 278518 - RNA, 58 nt, Homo Sapiens; identical to SEQ ID NO: 102991

SEQ ID NO: 278519 - RNA, 66 nt, Homo Sapiens; identical to SEQ ID NO: 253456

SEQ ID NO: 278520 - RNA, 66 nt, Homo Sapiens; identical to SEQ ID NO: 253457

SEQ ID NO: 278521 - RNA, 66 nt, Homo Sapiens; identical to SEQ ID NO: 253458

SEQ ID NO: 278522 - RNA, 66 nt, Homo Sapiens; identical to SEQ ID NO: 253459

SEQ ID NO: 278523 - RNA, 66 nt, Homo Sapiens; identical to SEQ ID NO: 253460

SEQ ID NO: 278524 - RNA, 66 nt, Homo Sapiens; identical to SEQ ID NO: 253461

SEQ ID NO: 278525 - RNA, 66 nt, Homo Sapiens; identical to SEQ ID NO: 253462

SEQ ID NO: 278526 - RNA, 66 nt, Homo Sapiens; identical to SEQ ID NO: 253463

SEQ ID NO: 278527 - RNA, 66 nt, Homo Sapiens; identical to SEQ ID NO: 253464

SEQ ID NO: 278528 - RNA, 66 nt, Homo Sapiens; identical to SEQ ID NO: 253465

SEQ ID NO: 278529 - RNA, 66 nt, Homo Sapiens; identical to SEQ ID NO: 253466

SEQ ID NO: 278530 - RNA, 66 nt, Homo Sapiens; identical to SEQ ID NO: 253467

SEQ ID NO: 278531 - RNA, 66 nt, Homo Sapiens; identical to SEQ ID NO: 253468

SEQ ID NO: 278532 - RNA, 66 nt, Homo Sapiens; identical to SEQ ID NO: 253469

SEQ ID NO: 278533 - RNA, 66 nt, Homo Sapiens; identical to SEQ ID NO: 253470

SEQ ID NO: 278534 - RNA, 66 nt, Homo Sapiens; identical to SEQ ID NO: 253471

SEQ ID NO: 278535 - RNA, 66 nt, Homo Sapiens; identical to SEQ ID NO: 253472

SEQ ID NO: 278536 - RNA, 66 nt, Homo Sapiens; identical to SEQ ID NO: 253473

SEQ ID NO: 278537 - RNA, 66 nt, Homo Sapiens; identical to SEQ ID NO: 253474

SEQ ID NO: 278538 - RNA, 66 nt, Homo Sapiens; identical to SEQ ID NO: 253475

SEQ ID NO: 278539 - RNA, 66 nt, Homo Sapiens; identical to SEQ ID NO: 253476

SEQ ID NO: 278540 - RNA, 66 nt, Homo Sapiens; identical to SEQ ID NO: 253477

SEQ ID NO: 278541 - RNA, 53 nt, Homo Sapiens; identical to SEQ ID NO: 103014

SEQ ID NO: 278542 - RNA, 66 nt, Homo Sapiens; identical to SEQ ID NO: 253479

SEQ ID NO: 278543 - RNA, 66 nt, Homo Sapiens; identical to SEQ ID NO: 253480

SEQ ID NO: 278544 - RNA, 66 nt, Homo Sapiens; identical to SEQ ID NO: 253481

SEQ ID NO: 278545 - RNA, 66 nt, Homo Sapiens; identical to SEQ ID NO: 253482

SEQ ID NO: 278546 - RNA, 66 nt, Homo Sapiens; identical to SEQ ID NO: 253483

SEQ ID NO: 278547 - RNA, 66 nt, Homo Sapiens; identical to SEQ ID NO: 253484

SEQ ID NO: 278548 - RNA, 66 nt, Homo Sapiens; identical to SEQ ID NO: 253485

SEQ ID NO: 278549 - RNA, 66 nt, Homo Sapiens; identical to SEQ ID NO: 253486

SEQ ID NO: 278550 - RNA, 66 nt, Homo Sapiens; identical to SEQ ID NO: 253487

SEQ ID NO: 278551 - RNA, 66 nt, Homo Sapiens; identical to SEQ ID NO: 253488

SEQ ID NO: 278552 - RNA, 66 nt, Homo Sapiens; identical to SEQ ID NO: 253489

SEQ ID NO: 278553 - RNA, 66 nt, Homo Sapiens; identical to SEQ ID NO: 253490

SEQ ID NO: 278554 - RNA, 66 nt, Homo Sapiens; identical to SEQ ID NO: 253491

SEQ ID NO: 278555 - RNA, 66 nt, Homo Sapiens; identical to SEQ ID NO: 253492

SEQ ID NO: 278556 - RNA, 66 nt, Homo Sapiens; identical to SEQ ID NO: 253493

SEQ ID NO: 278557 - RNA, 66 nt, Homo Sapiens; identical to SEQ ID NO: 253494

SEQ ID NO: 278558 - RNA, 66 nt, Homo Sapiens; identical to SEQ ID NO: 253495

SEQ ID NO: 278559 - RNA, 66 nt, Homo Sapiens; identical to SEQ ID NO: 253496

SEQ ID NO: 278560 - RNA, 66 nt, Homo Sapiens; identical to SEQ ID NO: 253497

SEQ ID NO: 278561 - RNA, 66 nt, Homo Sapiens; identical to SEQ ID NO: 253498

SEQ ID NO: 278562 - RNA, 66 nt, Homo Sapiens; identical to SEQ ID NO: 253499

SEQ ID NO: 278563 - RNA, 66 nt, Homo Sapiens; identical to SEQ ID NO: 253500

SEQ ID NO: 278564 - RNA, 66 nt, Homo Sapiens; identical to SEQ ID NO: 253501

SEQ ID NO: 278565 - RNA, 66 nt, Homo Sapiens; identical to SEQ ID NO: 253502

SEQ ID NO: 278566 - RNA, 66 nt, Homo Sapiens; identical to SEQ ID NO: 253503

SEQ ID NO: 278567 - RNA, 66 nt, Homo Sapiens; identical to SEQ ID NO: 253504

SEQ ID NO: 278568 - RNA, 66 nt, Homo Sapiens; identical to SEQ ID NO: 253505

SEQ ID NO: 278569 - RNA, 66 nt, Homo Sapiens; identical to SEQ ID NO: 253506

SEQ ID NO: 278570 - RNA, 66 nt, Homo Sapiens; identical to SEQ ID NO: 253507

SEQ ID NO: 278571 - RNA, 66 nt, Homo Sapiens; identical to SEQ ID NO: 253508

SEQ ID NO: 278572 - RNA, 66 nt, Homo Sapiens; identical to SEQ ID NO: 253509

SEQ ID NO: 278573 - RNA, 66 nt, Homo Sapiens; identical to SEQ ID NO: 253510

SEQ ID NO: 278574 - RNA, 66 nt, Homo Sapiens; identical to SEQ ID NO: 253511

SEQ ID NO: 278575 - RNA, 66 nt, Homo Sapiens; identical to SEQ ID NO: 253512

SEQ ID NO: 278576 - RNA, 66 nt, Homo Sapiens; identical to SEQ ID NO: 253513

SEQ ID NO: 278577 - RNA, 66 nt, Homo Sapiens; identical to SEQ ID NO: 253514

SEQ ID NO: 278578 - RNA, 66 nt, Homo Sapiens; identical to SEQ ID NO: 253515

SEQ ID NO: 278579 - RNA, 66 nt, Homo Sapiens; identical to SEQ ID NO: 253516

SEQ ID NO: 278580 - RNA, 66 nt, Homo Sapiens; identical to SEQ ID NO: 253517

SEQ ID NO: 278581 - RNA, 66 nt, Homo Sapiens; identical to SEQ ID NO: 253518

SEQ ID NO: 278582 - RNA, 66 nt, Homo Sapiens; identical to SEQ ID NO: 253519

SEQ ID NO: 278583 - RNA, 66 nt, Homo Sapiens; identical to SEQ ID NO: 253520

SEQ ID NO: 278584 - RNA, 66 nt, Homo Sapiens; identical to SEQ ID NO: 253521

SEQ ID NO: 278585 - RNA, 66 nt, Homo Sapiens; identical to SEQ ID NO: 253522

SEQ ID NO: 278586 - RNA, 66 nt, Homo Sapiens; identical to SEQ ID NO: 253523

SEQ ID NO: 278587 - RNA, 66 nt, Homo Sapiens; identical to SEQ ID NO: 253524

SEQ ID NO: 278588 - RNA, 66 nt, Homo Sapiens; identical to SEQ ID NO: 253525

SEQ ID NO: 278589 - RNA, 66 nt, Homo Sapiens; identical to SEQ ID NO: 253526

SEQ ID NO: 278590 - RNA, 66 nt, Homo Sapiens; identical to SEQ ID NO: 253527

SEQ ID NO: 278591 - RNA, 66 nt, Homo Sapiens; identical to SEQ ID NO: 253528

SEQ ID NO: 278592 - RNA, 66 nt, Homo Sapiens; identical to SEQ ID NO: 253529

SEQ ID NO: 278593 - RNA, 66 nt, Homo Sapiens; identical to SEQ ID NO: 253530

SEQ ID NO: 278594 - RNA, 66 nt, Homo Sapiens; identical to SEQ ID NO: 253531

SEQ ID NO: 278595 - RNA, 66 nt, Homo Sapiens; identical to SEQ ID NO: 253532

SEQ ID NO: 278596 - RNA, 66 nt, Homo Sapiens; identical to SEQ ID NO: 253533

SEQ ID NO: 278597 - RNA, 66 nt, Homo Sapiens; identical to SEQ ID NO: 253534

SEQ ID NO: 278598 - RNA, 66 nt, Homo Sapiens; identical to SEQ ID NO: 253535

SEQ ID NO: 278599 - RNA, 66 nt, Homo Sapiens; identical to SEQ ID NO: 253536

SEQ ID NO: 278600 - RNA, 66 nt, Homo Sapiens; identical to SEQ ID NO: 253537

SEQ ID NO: 278601 - RNA, 66 nt, Homo Sapiens; identical to SEQ ID NO: 253538

SEQ ID NO: 278602 - RNA, 66 nt, Homo Sapiens; identical to SEQ ID NO: 253539

SEQ ID NO: 278603 - RNA, 66 nt, Homo Sapiens; identical to SEQ ID NO: 253540

SEQ ID NO: 278604 - RNA, 66 nt, Homo Sapiens; identical to SEQ ID NO: 253541

SEQ ID NO: 278605 - RNA, 66 nt, Homo Sapiens; identical to SEQ ID NO: 253542

SEQ ID NO: 278606 - RNA, 66 nt, Homo Sapiens; identical to SEQ ID NO: 253543

SEQ ID NO: 278607 - RNA, 66 nt, Homo Sapiens; identical to SEQ ID NO: 253544

SEQ ID NO: 278608 - RNA, 66 nt, Homo Sapiens; identical to SEQ ID NO: 253545

SEQ ID NO: 278609 - RNA, 66 nt, Homo Sapiens; identical to SEQ ID NO: 253546

SEQ ID NO: 278610 - RNA, 66 nt, Homo Sapiens; identical to SEQ ID NO: 253547

SEQ ID NO: 278611 - RNA, 66 nt, Homo Sapiens; identical to SEQ ID NO: 253548

SEQ ID NO: 278612 - RNA, 66 nt, Homo Sapiens; identical to SEQ ID NO: 253549

SEQ ID NO: 278613 - RNA, 66 nt, Homo Sapiens; identical to SEQ ID NO: 253550

SEQ ID NO: 278614 - RNA, 66 nt, Homo Sapiens; identical to SEQ ID NO: 253551

SEQ ID NO: 278615 - RNA, 66 nt, Homo Sapiens; identical to SEQ ID NO: 253552

SEQ ID NO: 278616 - RNA, 66 nt, Homo Sapiens; identical to SEQ ID NO: 253553

SEQ ID NO: 278617 - RNA, 66 nt, Homo Sapiens; identical to SEQ ID NO: 253554

SEQ ID NO: 278618 - RNA, 66 nt, Homo Sapiens; identical to SEQ ID NO: 253555

SEQ ID NO: 278619 - RNA, 66 nt, Homo Sapiens; identical to SEQ ID NO: 253556

SEQ ID NO: 278620 - RNA, 66 nt, Homo Sapiens; identical to SEQ ID NO: 253557

SEQ ID NO: 278621 - RNA, 66 nt, Homo Sapiens; identical to SEQ ID NO: 253558

SEQ ID NO: 278622 - RNA, 66 nt, Homo Sapiens; identical to SEQ ID NO: 253559

SEQ ID NO: 278623 - RNA, 66 nt, Homo Sapiens; identical to SEQ ID NO: 253560

SEQ ID NO: 278624 - RNA, 66 nt, Homo Sapiens; identical to SEQ ID NO: 253561

SEQ ID NO: 278625 - RNA, 60 nt, Homo Sapiens; identical to SEQ ID NO: 103098

SEQ ID NO: 278626 - RNA, 66 nt, Homo Sapiens; identical to SEQ ID NO: 253563

SEQ ID NO: 278627 - RNA, 66 nt, Homo Sapiens; identical to SEQ ID NO: 253564

SEQ ID NO: 278628 - RNA, 66 nt, Homo Sapiens; identical to SEQ ID NO: 253565

SEQ ID NO: 278629 - RNA, 66 nt, Homo Sapiens; identical to SEQ ID NO: 253566

SEQ ID NO: 278630 - RNA, 66 nt, Homo Sapiens; identical to SEQ ID NO: 253567

SEQ ID NO: 278631 - RNA, 66 nt, Homo Sapiens; identical to SEQ ID NO: 253568

SEQ ID NO: 278632 - RNA, 66 nt, Homo Sapiens; identical to SEQ ID NO: 253569

SEQ ID NO: 278633 - RNA, 66 nt, Homo Sapiens; identical to SEQ ID NO: 253570

SEQ ID NO: 278634 - RNA, 66 nt, Homo Sapiens; identical to SEQ ID NO: 253571

SEQ ID NO: 278635 - RNA, 66 nt, Homo Sapiens; identical to SEQ ID NO: 253572

SEQ ID NO: 278636 - RNA, 66 nt, Homo Sapiens; identical to SEQ ID NO: 253573

SEQ ID NO: 278637 - RNA, 66 nt, Homo Sapiens; identical to SEQ ID NO: 253574

SEQ ID NO: 278638 - RNA, 66 nt, Homo Sapiens; identical to SEQ ID NO: 253575

SEQ ID NO: 278639 - RNA, 66 nt, Homo Sapiens; identical to SEQ ID NO: 253576

SEQ ID NO: 278640 - RNA, 66 nt, Homo Sapiens; identical to SEQ ID NO: 253577

SEQ ID NO: 278641 - RNA, 66 nt, Homo Sapiens; identical to SEQ ID NO: 253578

SEQ ID NO: 278642 - RNA, 66 nt, Homo Sapiens; identical to SEQ ID NO: 253579

SEQ ID NO: 278643 - RNA, 66 nt, Homo Sapiens; identical to SEQ ID NO: 253580

SEQ ID NO: 278644 - RNA, 66 nt, Homo Sapiens; identical to SEQ ID NO: 253581

SEQ ID NO: 278645 - RNA, 66 nt, Homo Sapiens; identical to SEQ ID NO: 253582

SEQ ID NO: 278646 - RNA, 66 nt, Homo Sapiens; identical to SEQ ID NO: 253583

SEQ ID NO: 278647 - RNA, 66 nt, Homo Sapiens; identical to SEQ ID NO: 253584

SEQ ID NO: 278648 - RNA, 66 nt, Homo Sapiens; identical to SEQ ID NO: 253585

SEQ ID NO: 278649 - RNA, 66 nt, Homo Sapiens; identical to SEQ ID NO: 253586

SEQ ID NO: 278650 - RNA, 66 nt, Homo Sapiens; identical to SEQ ID NO: 253587

SEQ ID NO: 278651 - RNA, 66 nt, Homo Sapiens; identical to SEQ ID NO: 253588

SEQ ID NO: 278652 - RNA, 66 nt, Homo Sapiens; identical to SEQ ID NO: 253589

SEQ ID NO: 278653 - RNA, 66 nt, Homo Sapiens; identical to SEQ ID NO: 253590

SEQ ID NO: 278654 - RNA, 66 nt, Homo Sapiens; identical to SEQ ID NO: 253591

SEQ ID NO: 278655 - RNA, 66 nt, Homo Sapiens; identical to SEQ ID NO: 253592

SEQ ID NO: 278656 - RNA, 66 nt, Homo Sapiens; identical to SEQ ID NO: 253593

SEQ ID NO: 278657 - RNA, 66 nt, Homo Sapiens; identical to SEQ ID NO: 253594

SEQ ID NO: 278658 - RNA, 66 nt, Homo Sapiens; identical to SEQ ID NO: 253595

SEQ ID NO: 278659 - RNA, 66 nt, Homo Sapiens; identical to SEQ ID NO: 253596

SEQ ID NO: 278660 - RNA, 66 nt, Homo Sapiens; identical to SEQ ID NO: 253597

SEQ ID NO: 278661 - RNA, 66 nt, Homo Sapiens; identical to SEQ ID NO: 253598

SEQ ID NO: 278662 - RNA, 66 nt, Homo Sapiens; identical to SEQ ID NO: 253599

SEQ ID NO: 278663 - RNA, 66 nt, Homo Sapiens; identical to SEQ ID NO: 253600

SEQ ID NO: 278664 - RNA, 66 nt, Homo Sapiens; identical to SEQ ID NO: 253601

SEQ ID NO: 278665 - RNA, 66 nt, Homo Sapiens; identical to SEQ ID NO: 253602

SEQ ID NO: 278666 - RNA, 66 nt, Homo Sapiens; identical to SEQ ID NO: 253603

SEQ ID NO: 278667 - RNA, 66 nt, Homo Sapiens; identical to SEQ ID NO: 253604

SEQ ID NO: 278668 - RNA, 66 nt, Homo Sapiens; identical to SEQ ID NO: 253605

SEQ ID NO: 278669 - RNA, 66 nt, Homo Sapiens; identical to SEQ ID NO: 253606

SEQ ID NO: 278670 - RNA, 66 nt, Homo Sapiens; identical to SEQ ID NO: 253607

SEQ ID NO: 278671 - RNA, 66 nt, Homo Sapiens; identical to SEQ ID NO: 253608

SEQ ID NO: 278672 - RNA, 66 nt, Homo Sapiens; identical to SEQ ID NO: 253609

SEQ ID NO: 278673 - RNA, 66 nt, Homo Sapiens; identical to SEQ ID NO: 253610

SEQ ID NO: 278674 - RNA, 66 nt, Homo Sapiens; identical to SEQ ID NO: 253611

SEQ ID NO: 278675 - RNA, 66 nt, Homo Sapiens; identical to SEQ ID NO: 253612

SEQ ID NO: 278676 - RNA, 66 nt, Homo Sapiens; identical to SEQ ID NO: 253613

SEQ ID NO: 278677 - RNA, 66 nt, Homo Sapiens; identical to SEQ ID NO: 253614

SEQ ID NO: 278678 - RNA, 66 nt, Homo Sapiens; identical to SEQ ID NO: 253615

SEQ ID NO: 278679 - RNA, 66 nt, Homo Sapiens; identical to SEQ ID NO: 253616

SEQ ID NO: 278680 - RNA, 66 nt, Homo Sapiens; identical to SEQ ID NO: 253617

SEQ ID NO: 278681 - RNA, 66 nt, Homo Sapiens; identical to SEQ ID NO: 253618

SEQ ID NO: 278682 - RNA, 66 nt, Homo Sapiens; identical to SEQ ID NO: 253619

SEQ ID NO: 278683 - RNA, 66 nt, Homo Sapiens; identical to SEQ ID NO: 253620

SEQ ID NO: 278684 - RNA, 66 nt, Homo Sapiens; identical to SEQ ID NO: 253621

SEQ ID NO: 278685 - RNA, 66 nt, Homo Sapiens; identical to SEQ ID NO: 253622

SEQ ID NO: 278686 - RNA, 66 nt, Homo Sapiens; identical to SEQ ID NO: 253623

SEQ ID NO: 278687 - RNA, 66 nt, Homo Sapiens; identical to SEQ ID NO: 253624

SEQ ID NO: 278688 - RNA, 66 nt, Homo Sapiens; identical to SEQ ID NO: 253625

SEQ ID NO: 278689 - RNA, 66 nt, Homo Sapiens; identical to SEQ ID NO: 253626

SEQ ID NO: 278690 - RNA, 66 nt, Homo Sapiens; identical to SEQ ID NO: 253627

SEQ ID NO: 278691 - RNA, 66 nt, Homo Sapiens; identical to SEQ ID NO: 253628

SEQ ID NO: 278692 - RNA, 66 nt, Homo Sapiens; identical to SEQ ID NO: 253629

SEQ ID NO: 278693 - RNA, 66 nt, Homo Sapiens; identical to SEQ ID NO: 253630

SEQ ID NO: 278694 - RNA, 66 nt, Homo Sapiens; identical to SEQ ID NO: 253631

SEQ ID NO: 278695 - RNA, 66 nt, Homo Sapiens; identical to SEQ ID NO: 253632

SEQ ID NO: 278696 - RNA, 66 nt, Homo Sapiens; identical to SEQ ID NO: 253633

SEQ ID NO: 278697 - RNA, 66 nt, Homo Sapiens; identical to SEQ ID NO: 253634

SEQ ID NO: 278698 - RNA, 66 nt, Homo Sapiens; identical to SEQ ID NO: 253635

SEQ ID NO: 278699 - RNA, 66 nt, Homo Sapiens; identical to SEQ ID NO: 253636

SEQ ID NO: 278700 - RNA, 66 nt, Homo Sapiens; identical to SEQ ID NO: 253637

SEQ ID NO: 278701 - RNA, 66 nt, Homo Sapiens; identical to SEQ ID NO: 253638

SEQ ID NO: 278702 - RNA, 66 nt, Homo Sapiens; identical to SEQ ID NO: 253639

SEQ ID NO: 278703 - RNA, 66 nt, Homo Sapiens; identical to SEQ ID NO: 253640

SEQ ID NO: 278704 - RNA, 66 nt, Homo Sapiens; identical to SEQ ID NO: 253641

SEQ ID NO: 278705 - RNA, 66 nt, Homo Sapiens; identical to SEQ ID NO: 253642

SEQ ID NO: 278706 - RNA, 66 nt, Homo Sapiens; identical to SEQ ID NO: 253643

SEQ ID NO: 278707 - RNA, 66 nt, Homo Sapiens; identical to SEQ ID NO: 253644

SEQ ID NO: 278708 - RNA, 66 nt, Homo Sapiens; identical to SEQ ID NO: 253645

SEQ ID NO: 278709 - RNA, 66 nt, Homo Sapiens; identical to SEQ ID NO: 253646

SEQ ID NO: 278710 - RNA, 66 nt, Homo Sapiens; identical to SEQ ID NO: 253647

SEQ ID NO: 278711 - RNA, 66 nt, Homo Sapiens; identical to SEQ ID NO: 253648

SEQ ID NO: 278712 - RNA, 66 nt, Homo Sapiens; identical to SEQ ID NO: 253649

SEQ ID NO: 278713 - RNA, 66 nt, Homo Sapiens; identical to SEQ ID NO: 253650

SEQ ID NO: 278714 - RNA, 66 nt, Homo Sapiens; identical to SEQ ID NO: 253651

SEQ ID NO: 278715 - RNA, 66 nt, Homo Sapiens; identical to SEQ ID NO: 253652

SEQ ID NO: 278716 - RNA, 66 nt, Homo Sapiens; identical to SEQ ID NO: 253653

SEQ ID NO: 278717 - RNA, 66 nt, Homo Sapiens; identical to SEQ ID NO: 253654

SEQ ID NO: 278718 - RNA, 66 nt, Homo Sapiens; identical to SEQ ID NO: 253655

SEQ ID NO: 278719 - RNA, 66 nt, Homo Sapiens; identical to SEQ ID NO: 253656

SEQ ID NO: 278720 - RNA, 66 nt, Homo Sapiens; identical to SEQ ID NO: 253657

SEQ ID NO: 278721 - RNA, 66 nt, Homo Sapiens; identical to SEQ ID NO: 253658

SEQ ID NO: 278722 - RNA, 63 nt, Homo Sapiens; identical to SEQ ID NO: 103195

SEQ ID NO: 278723 - RNA, 51 nt, Homo Sapiens; identical to SEQ ID NO: 103196

SEQ ID NO: 278724 - RNA, 66 nt, Homo Sapiens; identical to SEQ ID NO: 253661

SEQ ID NO: 278725 - RNA, 66 nt, Homo Sapiens; identical to SEQ ID NO: 253662

SEQ ID NO: 278726 - RNA, 66 nt, Homo Sapiens; identical to SEQ ID NO: 253663

SEQ ID NO: 278727 - RNA, 66 nt, Homo Sapiens; identical to SEQ ID NO: 253664

SEQ ID NO: 278728 - RNA, 66 nt, Homo Sapiens; identical to SEQ ID NO: 253665

SEQ ID NO: 278729 - RNA, 66 nt, Homo Sapiens; identical to SEQ ID NO: 253666

SEQ ID NO: 278730 - RNA, 66 nt, Homo Sapiens; identical to SEQ ID NO: 253667

SEQ ID NO: 278731 - RNA, 66 nt, Homo Sapiens; identical to SEQ ID NO: 253668

SEQ ID NO: 278732 - RNA, 66 nt, Homo Sapiens; identical to SEQ ID NO: 253669

SEQ ID NO: 278733 - RNA, 66 nt, Homo Sapiens; identical to SEQ ID NO: 253670

SEQ ID NO: 278734 - RNA, 66 nt, Homo Sapiens; identical to SEQ ID NO: 253671

SEQ ID NO: 278735 - RNA, 66 nt, Homo Sapiens; identical to SEQ ID NO: 253672

SEQ ID NO: 278736 - RNA, 66 nt, Homo Sapiens; identical to SEQ ID NO: 253673

SEQ ID NO: 278737 - RNA, 66 nt, Homo Sapiens; identical to SEQ ID NO: 253674

SEQ ID NO: 278738 - RNA, 66 nt, Homo Sapiens; identical to SEQ ID NO: 253675

SEQ ID NO: 278739 - RNA, 66 nt, Homo Sapiens; identical to SEQ ID NO: 253676

SEQ ID NO: 278740 - RNA, 66 nt, Homo Sapiens; identical to SEQ ID NO: 253677

SEQ ID NO: 278741 - RNA, 66 nt, Homo Sapiens; identical to SEQ ID NO: 253678

SEQ ID NO: 278742 - RNA, 66 nt, Homo Sapiens; identical to SEQ ID NO: 253679

SEQ ID NO: 278743 - RNA, 66 nt, Homo Sapiens; identical to SEQ ID NO: 253680

SEQ ID NO: 278744 - RNA, 66 nt, Homo Sapiens; identical to SEQ ID NO: 253681

SEQ ID NO: 278745 - RNA, 66 nt, Homo Sapiens; identical to SEQ ID NO: 253682

SEQ ID NO: 278746 - RNA, 66 nt, Homo Sapiens; identical to SEQ ID NO: 253683

SEQ ID NO: 278747 - RNA, 66 nt, Homo Sapiens; identical to SEQ ID NO: 253684

SEQ ID NO: 278748 - RNA, 66 nt, Homo Sapiens; identical to SEQ ID NO: 253685

SEQ ID NO: 278749 - RNA, 66 nt, Homo Sapiens; identical to SEQ ID NO: 253686

SEQ ID NO: 278750 - RNA, 66 nt, Homo Sapiens; identical to SEQ ID NO: 253687

SEQ ID NO: 278751 - RNA, 66 nt, Homo Sapiens; identical to SEQ ID NO: 253688

SEQ ID NO: 278752 - RNA, 66 nt, Homo Sapiens; identical to SEQ ID NO: 253689

SEQ ID NO: 278753 - RNA, 66 nt, Homo Sapiens; identical to SEQ ID NO: 253690

SEQ ID NO: 278754 - RNA, 66 nt, Homo Sapiens; identical to SEQ ID NO: 253691

SEQ ID NO: 278755 - RNA, 66 nt, Homo Sapiens; identical to SEQ ID NO: 253692

SEQ ID NO: 278756 - RNA, 66 nt, Homo Sapiens; identical to SEQ ID NO: 253693

SEQ ID NO: 278757 - RNA, 66 nt, Homo Sapiens; identical to SEQ ID NO: 253694

SEQ ID NO: 278758 - RNA, 66 nt, Homo Sapiens; identical to SEQ ID NO: 253695

SEQ ID NO: 278759 - RNA, 66 nt, Homo Sapiens; identical to SEQ ID NO: 253696

SEQ ID NO: 278760 - RNA, 66 nt, Homo Sapiens; identical to SEQ ID NO: 253697

SEQ ID NO: 278761 - RNA, 66 nt, Homo Sapiens; identical to SEQ ID NO: 253698

SEQ ID NO: 278762 - RNA, 66 nt, Homo Sapiens; identical to SEQ ID NO: 253699

SEQ ID NO: 278763 - RNA, 66 nt, Homo Sapiens; identical to SEQ ID NO: 253700

SEQ ID NO: 278764 - RNA, 66 nt, Homo Sapiens; identical to SEQ ID NO: 253701

SEQ ID NO: 278765 - RNA, 66 nt, Homo Sapiens; identical to SEQ ID NO: 253702

SEQ ID NO: 278766 - RNA, 66 nt, Homo Sapiens; identical to SEQ ID NO: 253703

SEQ ID NO: 278767 - RNA, 66 nt, Homo Sapiens; identical to SEQ ID NO: 253704

SEQ ID NO: 278768 - RNA, 66 nt, Homo Sapiens; identical to SEQ ID NO: 253705

SEQ ID NO: 278769 - RNA, 66 nt, Homo Sapiens; identical to SEQ ID NO: 253706

SEQ ID NO: 278770 - RNA, 66 nt, Homo Sapiens; identical to SEQ ID NO: 253707

SEQ ID NO: 278771 - RNA, 66 nt, Homo Sapiens; identical to SEQ ID NO: 253708

SEQ ID NO: 278772 - RNA, 66 nt, Homo Sapiens; identical to SEQ ID NO: 253709

SEQ ID NO: 278773 - RNA, 66 nt, Homo Sapiens; identical to SEQ ID NO: 253710

SEQ ID NO: 278774 - RNA, 66 nt, Homo Sapiens; identical to SEQ ID NO: 253711

SEQ ID NO: 278775 - RNA, 66 nt, Homo Sapiens; identical to SEQ ID NO: 253712

SEQ ID NO: 278776 - RNA, 66 nt, Homo Sapiens; identical to SEQ ID NO: 253713

SEQ ID NO: 278777 - RNA, 66 nt, Homo Sapiens; identical to SEQ ID NO: 253714

SEQ ID NO: 278778 - RNA, 66 nt, Homo Sapiens; identical to SEQ ID NO: 253715

SEQ ID NO: 278779 - RNA, 66 nt, Homo Sapiens; identical to SEQ ID NO: 253716

SEQ ID NO: 278780 - RNA, 66 nt, Homo Sapiens; identical to SEQ ID NO: 253717

SEQ ID NO: 278781 - RNA, 66 nt, Homo Sapiens; identical to SEQ ID NO: 253718

SEQ ID NO: 278782 - RNA, 66 nt, Homo Sapiens; identical to SEQ ID NO: 253719

SEQ ID NO: 278783 - RNA, 66 nt, Homo Sapiens; identical to SEQ ID NO: 253720

SEQ ID NO: 278784 - RNA, 66 nt, Homo Sapiens; identical to SEQ ID NO: 253721

SEQ ID NO: 278785 - RNA, 66 nt, Homo Sapiens; identical to SEQ ID NO: 253722

SEQ ID NO: 278786 - RNA, 66 nt, Homo Sapiens; identical to SEQ ID NO: 253723

SEQ ID NO: 278787 - RNA, 66 nt, Homo Sapiens; identical to SEQ ID NO: 253724

SEQ ID NO: 278788 - RNA, 66 nt, Homo Sapiens; identical to SEQ ID NO: 253725

SEQ ID NO: 278789 - RNA, 66 nt, Homo Sapiens; identical to SEQ ID NO: 253726

SEQ ID NO: 278790 - RNA, 66 nt, Homo Sapiens; identical to SEQ ID NO: 253727

SEQ ID NO: 278791 - RNA, 66 nt, Homo Sapiens; identical to SEQ ID NO: 253728

SEQ ID NO: 278792 - RNA, 66 nt, Homo Sapiens; identical to SEQ ID NO: 253729

SEQ ID NO: 278793 - RNA, 66 nt, Homo Sapiens; identical to SEQ ID NO: 253730

SEQ ID NO: 278794 - RNA, 66 nt, Homo Sapiens; identical to SEQ ID NO: 253731

SEQ ID NO: 278795 - RNA, 66 nt, Homo Sapiens; identical to SEQ ID NO: 253732

SEQ ID NO: 278796 - RNA, 66 nt, Homo Sapiens; identical to SEQ ID NO: 253733

SEQ ID NO: 278797 - RNA, 66 nt, Homo Sapiens; identical to SEQ ID NO: 253734

SEQ ID NO: 278798 - RNA, 66 nt, Homo Sapiens; identical to SEQ ID NO: 253735

SEQ ID NO: 278799 - RNA, 66 nt, Homo Sapiens; identical to SEQ ID NO: 253736

SEQ ID NO: 278800 - RNA, 66 nt, Homo Sapiens; identical to SEQ ID NO: 253737

SEQ ID NO: 278801 - RNA, 66 nt, Homo Sapiens; identical to SEQ ID NO: 253738

SEQ ID NO: 278802 - RNA, 66 nt, Homo Sapiens; identical to SEQ ID NO: 253739

SEQ ID NO: 278803 - RNA, 66 nt, Homo Sapiens; identical to SEQ ID NO: 253740

SEQ ID NO: 278804 - RNA, 66 nt, Homo Sapiens; identical to SEQ ID NO: 253741

SEQ ID NO: 278805 - RNA, 66 nt, Homo Sapiens; identical to SEQ ID NO: 253742

SEQ ID NO: 278806 - RNA, 66 nt, Homo Sapiens; identical to SEQ ID NO: 253743

SEQ ID NO: 278807 - RNA, 66 nt, Homo Sapiens; identical to SEQ ID NO: 253744

SEQ ID NO: 278808 - RNA, 66 nt, Homo Sapiens; identical to SEQ ID NO: 253745

SEQ ID NO: 278809 - RNA, 66 nt, Homo Sapiens; identical to SEQ ID NO: 253746

SEQ ID NO: 278810 - RNA, 66 nt, Homo Sapiens; identical to SEQ ID NO: 253747

SEQ ID NO: 278811 - RNA, 66 nt, Homo Sapiens; identical to SEQ ID NO: 253748

SEQ ID NO: 278812 - RNA, 66 nt, Homo Sapiens; identical to SEQ ID NO: 253749

SEQ ID NO: 278813 - RNA, 66 nt, Homo Sapiens; identical to SEQ ID NO: 253750

SEQ ID NO: 278814 - RNA, 66 nt, Homo Sapiens; identical to SEQ ID NO: 253751

SEQ ID NO: 278815 - RNA, 66 nt, Homo Sapiens; identical to SEQ ID NO: 253752

SEQ ID NO: 278816 - RNA, 62 nt, Homo Sapiens
acucuuaaguguaaauaauauaaaauguuucaagcgcuuaacucccccucauucacaaagua

SEQ ID NO: 278817 - RNA, 62 nt, Homo Sapiens
acauucccaauucagugagauaugguuugaccagcgcuuaucgacaguaaauaucagaauuu

SEQ ID NO: 278818 - RNA, 62 nt, Homo Sapiens
cugaaguauuagauuaaagcauauucacuuucagcgcuuauaguuuuuauaaaagcaaaagg

SEQ ID NO: 278819 - RNA, 62 nt, Homo Sapiens
aauuaaaugggggcucuuacugacuuuaaauuagcgcuuauaaaauaaaaauguuuaguuca

SEQ ID NO: 278820 - RNA, 62 nt, Homo Sapiens
uuccuagcgaagugccguaaacuucaaagagcagcgcuuaaagaguauaaagcagcugucac

SEQ ID NO: 278821 - RNA, 62 nt, Homo Sapiens
aacauguuccuguuccucggcuccaaucccccagcgcuuagacagucugaaggauuccccac

SEQ ID NO: 278822 - RNA, 50 nt, Homo Sapiens; identical to SEQ ID NO: 57621

SEQ ID NO: 278823 - RNA, 62 nt, Homo Sapiens
uaugugaaguacuguguugcagaaguggcaaaagcgcuuauuuuuaaaaaugcaaaauauuu

SEQ ID NO: 278824 - RNA, 62 nt, Homo Sapiens
augcccccacgugugaacauuuuggagcugguagcgcuuacgcaaguucccaucacgucaga

SEQ ID NO: 278825 - RNA, 62 nt, Homo Sapiens
ccuuacccaggaaauauccugguaccaagaguagcgcuuagcggugagggucagaaggggac

SEQ ID NO: 278826 - RNA, 62 nt, Homo Sapiens
uuguuccucuguuaucaugcuuugggguuuagagcgcuuaagggaggcaagaaagcauuucc

SEQ ID NO: 278827 - RNA, 62 nt, Homo Sapiens
guauauuuaaauacuaccaugaagcacuauuaagcgcuuaacgaguaaaagucuaccccucu

SEQ ID NO: 278828 - RNA, 62 nt, Homo Sapiens
aaaacaaauuggacagcuacgucccaaugcucagcgcuuaaaucauuuguggcaauuaagug

SEQ ID NO: 278829 - RNA, 62 nt, Homo Sapiens
gcacgcugucaucauggacauugguuggacacagcgcuuagucuaaaaugccagguaaaggg

SEQ ID NO: 278830 - RNA, 62 nt, Homo Sapiens
uccaagacuauuuuuuauuguuuagguauaucagcgcuuaaaacuuaagccuagaauuucuc

SEQ ID NO: 278831 - RNA, 62 nt, Homo Sapiens
ccuuuuucuauuuuagucggucccuucucgugagcgcuuagaugagcauuguauuucucgca

SEQ ID NO: 278832 - RNA, 62 nt, Homo Sapiens
gacacgcgggccuuuggugggcugcuguaguuagcgcuuagugcacugcucgagacacaagu

SEQ ID NO: 278833 - RNA, 62 nt, Homo Sapiens
auguuuuucuugaauagguauugauaaauggaagcgcuuaccagcccagcuuugccagcccu

SEQ ID NO: 278834 - RNA, 62 nt, Homo Sapiens
aaauccggaaaaaugggguuuucuuauuuuagagcgcuuaaacuggcuugcacuuucuuauu

SEQ ID NO: 278835 - RNA, 63 nt, Homo Sapiens; identical to SEQ ID NO: 57615

SEQ ID NO: 278836 - RNA, 63 nt, Homo Sapiens; identical to SEQ ID NO: 57616

SEQ ID NO: 278837 - RNA, 63 nt, Homo Sapiens; identical to SEQ ID NO: 57617

SEQ ID NO: 278838 - RNA, 63 nt, Homo Sapiens; identical to SEQ ID NO: 57618

SEQ ID NO: 278839 - RNA, 63 nt, Homo Sapiens; identical to SEQ ID NO: 57619

SEQ ID NO: 278840 - RNA, 63 nt, Homo Sapiens; identical to SEQ ID NO: 57620

SEQ ID NO: 278841 - RNA, 50 nt, Homo Sapiens; identical to SEQ ID NO: 57621

SEQ ID NO: 278842 - RNA, 63 nt, Homo Sapiens; identical to SEQ ID NO: 57622

SEQ ID NO: 278843 - RNA, 63 nt, Homo Sapiens; identical to SEQ ID NO: 57623

SEQ ID NO: 278844 - RNA, 63 nt, Homo Sapiens; identical to SEQ ID NO: 57624

SEQ ID NO: 278845 - RNA, 63 nt, Homo Sapiens; identical to SEQ ID NO: 57625

SEQ ID NO: 278846 - RNA, 63 nt, Homo Sapiens; identical to SEQ ID NO: 57626

SEQ ID NO: 278847 - RNA, 63 nt, Homo Sapiens; identical to SEQ ID NO: 57627

SEQ ID NO: 278848 - RNA, 63 nt, Homo Sapiens; identical to SEQ ID NO: 57628

SEQ ID NO: 278849 - RNA, 63 nt, Homo Sapiens; identical to SEQ ID NO: 57629

SEQ ID NO: 278850 - RNA, 63 nt, Homo Sapiens; identical to SEQ ID NO: 57630

SEQ ID NO: 278851 - RNA, 63 nt, Homo Sapiens; identical to SEQ ID NO: 57631

SEQ ID NO: 278852 - RNA, 63 nt, Homo Sapiens; identical to SEQ ID NO: 57632

SEQ ID NO: 278853 - RNA, 63 nt, Homo Sapiens; identical to SEQ ID NO: 57633

SEQ ID NO: 278854 - RNA, 64 nt, Homo Sapiens; identical to SEQ ID NO: 194820

SEQ ID NO: 278855 - RNA, 64 nt, Homo Sapiens; identical to SEQ ID NO: 194821

SEQ ID NO: 278856 - RNA, 64 nt, Homo Sapiens; identical to SEQ ID NO: 194822

SEQ ID NO: 278857 - RNA, 64 nt, Homo Sapiens; identical to SEQ ID NO: 194823

SEQ ID NO: 278858 - RNA, 64 nt, Homo Sapiens; identical to SEQ ID NO: 194824

SEQ ID NO: 278859 - RNA, 64 nt, Homo Sapiens; identical to SEQ ID NO: 194825

SEQ ID NO: 278860 - RNA, 50 nt, Homo Sapiens; identical to SEQ ID NO: 57621

SEQ ID NO: 278861 - RNA, 64 nt, Homo Sapiens; identical to SEQ ID NO: 194827

SEQ ID NO: 278862 - RNA, 64 nt, Homo Sapiens; identical to SEQ ID NO: 194828

SEQ ID NO: 278863 - RNA, 64 nt, Homo Sapiens; identical to SEQ ID NO: 194829

SEQ ID NO: 278864 - RNA, 64 nt, Homo Sapiens; identical to SEQ ID NO: 194830

SEQ ID NO: 278865 - RNA, 64 nt, Homo Sapiens; identical to SEQ ID NO: 194831

SEQ ID NO: 278866 - RNA, 64 nt, Homo Sapiens; identical to SEQ ID NO: 194832

SEQ ID NO: 278867 - RNA, 64 nt, Homo Sapiens; identical to SEQ ID NO: 194833

SEQ ID NO: 278868 - RNA, 64 nt, Homo Sapiens; identical to SEQ ID NO: 194834

SEQ ID NO: 278869 - RNA, 64 nt, Homo Sapiens; identical to SEQ ID NO: 194835

SEQ ID NO: 278870 - RNA, 64 nt, Homo Sapiens; identical to SEQ ID NO: 194836

SEQ ID NO: 278871 - RNA, 64 nt, Homo Sapiens; identical to SEQ ID NO: 194837

SEQ ID NO: 278872 - RNA, 64 nt, Homo Sapiens; identical to SEQ ID NO: 194838

SEQ ID NO: 278873 - RNA, 62 nt, Homo Sapiens
agauggcaugugaaagcacuuugaaaauuguaaagcgcuauguaaauguaagguauuauaga

SEQ ID NO: 278874 - RNA, 62 nt, Homo Sapiens
gugcuguguuuugguuguggucugaagcuuugaagcgcuacuuagcaucuccuuucuuccau

SEQ ID NO: 278875 - RNA, 62 nt, Homo Sapiens
gggccgccagugccuucuucgacagcucucagaagcgcuaccuggacgccgacccuguugug

SEQ ID NO: 278876 - RNA, 62 nt, Homo Sapiens
cagcuagucuaaccacuagggaaacauaaucaaagcgcuaguccccuccacacacaaaacag

SEQ ID NO: 278877 - RNA, 62 nt, Homo Sapiens
aauguagagaaugaauugaauuuuuuuuuuuuaagcgcuacuauuaauuuugccuuuuuuuu

SEQ ID NO: 278878 - RNA, 62 nt, Homo Sapiens
gugauucaugaaugaauuucgaguagauugccaagcgcuacucagaaauuuggguaauguuu

SEQ ID NO: 278879 - RNA, 62 nt, Homo Sapiens
uaaaaauauuaacugacgaacucguuaaagcaaagcgcuaagcaaucucuuuguguucagaa

SEQ ID NO: 278880 - RNA, 62 nt, Homo Sapiens
cacuuauuacccuucugcagcaaaggcauuaaaagcgcuaagcauauauuaauaaaugcaag

SEQ ID NO: 278881 - RNA, 62 nt, Homo Sapiens
ggaagcagccaagucgguuacggugaaguacuaagcgcuagaucucccaugaagaaagggaa

SEQ ID NO: 278882 - RNA, 62 nt, Homo Sapiens
uaaaggacucagcaaccagccagggacagauaaagcgcuauggaaaggggcuuccaaguucu

SEQ ID NO: 278883 - RNA, 62 nt, Homo Sapiens
aaauguuuacaauuuuauaugaaagauggaauaagcgcuagagcuuccaacuguauauuuuu

SEQ ID NO: 278884 - RNA, 62 nt, Homo Sapiens
accagcuccaaguaaacuaguuaccuggguaaaagcgcuaacgacccaaaggcucuucuaag

SEQ ID NO: 278885 - RNA, 62 nt, Homo Sapiens
agggcuaaaggauuauaguaugcagucuacaaaagcgcuauacuaaagaaagcuuguuggaa

SEQ ID NO: 278886 - RNA, 62 nt, Homo Sapiens
cuaaaguguguaaguuuuucaagauaaguauuaagcgcuaccagcaucagcaauagauuuca

SEQ ID NO: 278887 - RNA, 62 nt, Homo Sapiens
gccugcggagccucaagaagccagaccgcaagaagcgcuacaccguggugggcaaccccuac

SEQ ID NO: 278888 - RNA, 62 nt, Homo Sapiens
uucuauuugaucugauaucauauuuguuuaaaaagcgcuaauuucugcaaauguaauugauu

SEQ ID NO: 278889 - RNA, 62 nt, Homo Sapiens
uuugcucuugauuuaaaaaaaaguuuuguugaaagcgcuauugaauauugcaaucuauauag

SEQ ID NO: 278890 - RNA, 62 nt, Homo Sapiens
acaccgcuucauugaugaggacaggagacuccaagcgcuaguauugcacgcugcacuuaaug

SEQ ID NO: 278891 - RNA, 62 nt, Homo Sapiens
augccuuuugccucugcauaaagaggagagccaagcgcuagcagaaagaugucaacaaggaa

SEQ ID NO: 278892 - RNA, 62 nt, Homo Sapiens
acacguauuuccuugacaaaugauguguauucaagcgcuauauuuuguuuugucuuucuacc

SEQ ID NO: 278893 - RNA, 62 nt, Homo Sapiens
caggcuuuuaaaaaaauaccacugugagaauaaagcgcuagcaagauacaucacuuacugau

SEQ ID NO: 278894 - RNA, 62 nt, Homo Sapiens
acuccgaguucuauaaaaaccucaccuccaucaagcgcuaugauggggacaucacugaccug

SEQ ID NO: 278895 - RNA, 62 nt, Homo Sapiens
gcuucaagagauccacccaccucagccucccaaagcgcuaggauuacaaguaugagacuuug

SEQ ID NO: 278896 - RNA, 62 nt, Homo Sapiens
uuauaaagaacgugauuuccagugaucucuggaagcgcuaaagcuaaaauuucuguucuuga

SEQ ID NO: 278897 - RNA, 62 nt, Homo Sapiens
guaagaacuguuaauaaaaguugucaaguaaaaagcgcuauaucuaaaaagacuuuaugaac

SEQ ID NO: 278898 - RNA, 62 nt, Homo Sapiens
ugcccaugaccugaaggcuccagguggcuuuaaagcgcuauguuuaccaacuaucccggugu

SEQ ID NO: 278899 - RNA, 62 nt, Homo Sapiens
aaaacgugcuuuucggcaaagcccugaaccccaagcgcuaccagcagacucuggaggccugu

SEQ ID NO: 278900 - RNA, 62 nt, Homo Sapiens
cuguaauuguagcuuuccacgcaguucccaacaagcgcuagcggccucaggaaucaacuuag

SEQ ID NO: 278901 - RNA, 62 nt, Homo Sapiens
cuuuucaauucccuucugguucaugaugcauaaagcgcuaggcccuagaacuccagaaacag

SEQ ID NO: 278902 - RNA, 62 nt, Homo Sapiens
gucuuaagcaaucuuccugcuuuggccucccaaagcgcuaggauuccaggugugagcuacug

SEQ ID NO: 278903 - RNA, 62 nt, Homo Sapiens
ggaguggggagggcguggagacagucuacggaaagcgcuagcagacccccgagagggugcag

SEQ ID NO: 278904 - RNA, 62 nt, Homo Sapiens
auuguguccacauaauccacgcucaucuugcaaagcgcuauuucaggcacaucauuggaaua

SEQ ID NO: 278905 - RNA, 62 nt, Homo Sapiens
cagccggagagacagccaggucggccccagcaaagcgcuaagcccagcgcgcagucuccacc

SEQ ID NO: 278906 - RNA, 62 nt, Homo Sapiens
ugacugugcccauuccugcauggaccuuucccaagcgcuagcacaggugcaaaauccaucag

SEQ ID NO: 278907 - RNA, 62 nt, Homo Sapiens
ggcucaugcaauccuccugccuuggccucccaaagcgcuaggauuagaggugugagccgcug

SEQ ID NO: 278908 - RNA, 62 nt, Homo Sapiens; identical to SEQ ID NO: 253135

SEQ ID NO: 278909 - RNA, 62 nt, Homo Sapiens; identical to SEQ ID NO: 253136

SEQ ID NO: 278910 - RNA, 62 nt, Homo Sapiens; identical to SEQ ID NO: 253137

SEQ ID NO: 278911 - RNA, 62 nt, Homo Sapiens; identical to SEQ ID NO: 253138

SEQ ID NO: 278912 - RNA, 62 nt, Homo Sapiens; identical to SEQ ID NO: 253139

SEQ ID NO: 278913 - RNA, 62 nt, Homo Sapiens; identical to SEQ ID NO: 253140

SEQ ID NO: 278914 - RNA, 62 nt, Homo Sapiens; identical to SEQ ID NO: 253141

SEQ ID NO: 278915 - RNA, 62 nt, Homo Sapiens; identical to SEQ ID NO: 253142

SEQ ID NO: 278916 - RNA, 62 nt, Homo Sapiens; identical to SEQ ID NO: 253143

SEQ ID NO: 278917 - RNA, 62 nt, Homo Sapiens; identical to SEQ ID NO: 253144

SEQ ID NO: 278918 - RNA, 62 nt, Homo Sapiens; identical to SEQ ID NO: 253145

SEQ ID NO: 278919 - RNA, 58 nt, Homo Sapiens; identical to SEQ ID NO: 102991

SEQ ID NO: 278920 - RNA, 62 nt, Homo Sapiens; identical to SEQ ID NO: 253147

SEQ ID NO: 278921 - RNA, 62 nt, Homo Sapiens; identical to SEQ ID NO: 253148

SEQ ID NO: 278922 - RNA, 62 nt, Homo Sapiens; identical to SEQ ID NO: 253149

SEQ ID NO: 278923 - RNA, 62 nt, Homo Sapiens; identical to SEQ ID NO: 253150

SEQ ID NO: 278924 - RNA, 62 nt, Homo Sapiens; identical to SEQ ID NO: 253151

SEQ ID NO: 278925 - RNA, 62 nt, Homo Sapiens; identical to SEQ ID NO: 253152

SEQ ID NO: 278926 - RNA, 62 nt, Homo Sapiens; identical to SEQ ID NO: 253153

SEQ ID NO: 278927 - RNA, 62 nt, Homo Sapiens; identical to SEQ ID NO: 253154

SEQ ID NO: 278928 - RNA, 62 nt, Homo Sapiens; identical to SEQ ID NO: 253155

SEQ ID NO: 278929 - RNA, 62 nt, Homo Sapiens; identical to SEQ ID NO: 253156

SEQ ID NO: 278930 - RNA, 62 nt, Homo Sapiens; identical to SEQ ID NO: 253157

SEQ ID NO: 278931 - RNA, 62 nt, Homo Sapiens; identical to SEQ ID NO: 253158

SEQ ID NO: 278932 - RNA, 62 nt, Homo Sapiens; identical to SEQ ID NO: 253159

SEQ ID NO: 278933 - RNA, 62 nt, Homo Sapiens; identical to SEQ ID NO: 253160

SEQ ID NO: 278934 - RNA, 62 nt, Homo Sapiens; identical to SEQ ID NO: 253161

SEQ ID NO: 278935 - RNA, 62 nt, Homo Sapiens; identical to SEQ ID NO: 253162

SEQ ID NO: 278936 - RNA, 62 nt, Homo Sapiens; identical to SEQ ID NO: 253163

SEQ ID NO: 278937 - RNA, 62 nt, Homo Sapiens; identical to SEQ ID NO: 253164

SEQ ID NO: 278938 - RNA, 62 nt, Homo Sapiens; identical to SEQ ID NO: 253165

SEQ ID NO: 278939 - RNA, 62 nt, Homo Sapiens; identical to SEQ ID NO: 253166

SEQ ID NO: 278940 - RNA, 62 nt, Homo Sapiens; identical to SEQ ID NO: 253167

SEQ ID NO: 278941 - RNA, 62 nt, Homo Sapiens; identical to SEQ ID NO: 253168

SEQ ID NO: 278942 - RNA, 53 nt, Homo Sapiens; identical to SEQ ID NO: 103014

SEQ ID NO: 278943 - RNA, 62 nt, Homo Sapiens; identical to SEQ ID NO: 253170

SEQ ID NO: 278944 - RNA, 62 nt, Homo Sapiens; identical to SEQ ID NO: 253171

SEQ ID NO: 278945 - RNA, 62 nt, Homo Sapiens; identical to SEQ ID NO: 253172

SEQ ID NO: 278946 - RNA, 62 nt, Homo Sapiens; identical to SEQ ID NO: 253173

SEQ ID NO: 278947 - RNA, 62 nt, Homo Sapiens; identical to SEQ ID NO: 253174

SEQ ID NO: 278948 - RNA, 62 nt, Homo Sapiens; identical to SEQ ID NO: 253175

SEQ ID NO: 278949 - RNA, 62 nt, Homo Sapiens; identical to SEQ ID NO: 253176

SEQ ID NO: 278950 - RNA, 62 nt, Homo Sapiens; identical to SEQ ID NO: 253177

SEQ ID NO: 278951 - RNA, 62 nt, Homo Sapiens; identical to SEQ ID NO: 253178

SEQ ID NO: 278952 - RNA, 62 nt, Homo Sapiens; identical to SEQ ID NO: 253179

SEQ ID NO: 278953 - RNA, 62 nt, Homo Sapiens; identical to SEQ ID NO: 253180

SEQ ID NO: 278954 - RNA, 62 nt, Homo Sapiens; identical to SEQ ID NO: 253181

SEQ ID NO: 278955 - RNA, 62 nt, Homo Sapiens; identical to SEQ ID NO: 253182

SEQ ID NO: 278956 - RNA, 62 nt, Homo Sapiens; identical to SEQ ID NO: 253183

SEQ ID NO: 278957 - RNA, 62 nt, Homo Sapiens; identical to SEQ ID NO: 253184

SEQ ID NO: 278958 - RNA, 62 nt, Homo Sapiens; identical to SEQ ID NO: 253185

SEQ ID NO: 278959 - RNA, 62 nt, Homo Sapiens; identical to SEQ ID NO: 253186

SEQ ID NO: 278960 - RNA, 62 nt, Homo Sapiens; identical to SEQ ID NO: 253187

SEQ ID NO: 278961 - RNA, 62 nt, Homo Sapiens; identical to SEQ ID NO: 253188

SEQ ID NO: 278962 - RNA, 62 nt, Homo Sapiens; identical to SEQ ID NO: 253189

SEQ ID NO: 278963 - RNA, 62 nt, Homo Sapiens; identical to SEQ ID NO: 253190

SEQ ID NO: 278964 - RNA, 62 nt, Homo Sapiens; identical to SEQ ID NO: 253191

SEQ ID NO: 278965 - RNA, 62 nt, Homo Sapiens; identical to SEQ ID NO: 253192

SEQ ID NO: 278966 - RNA, 62 nt, Homo Sapiens; identical to SEQ ID NO: 253193

SEQ ID NO: 278967 - RNA, 62 nt, Homo Sapiens; identical to SEQ ID NO: 253194

SEQ ID NO: 278968 - RNA, 62 nt, Homo Sapiens; identical to SEQ ID NO: 253195

SEQ ID NO: 278969 - RNA, 62 nt, Homo Sapiens; identical to SEQ ID NO: 253196

SEQ ID NO: 278970 - RNA, 62 nt, Homo Sapiens; identical to SEQ ID NO: 253197

SEQ ID NO: 278971 - RNA, 62 nt, Homo Sapiens; identical to SEQ ID NO: 253198

SEQ ID NO: 278972 - RNA, 62 nt, Homo Sapiens; identical to SEQ ID NO: 253199

SEQ ID NO: 278973 - RNA, 62 nt, Homo Sapiens; identical to SEQ ID NO: 253200

SEQ ID NO: 278974 - RNA, 62 nt, Homo Sapiens; identical to SEQ ID NO: 253201

SEQ ID NO: 278975 - RNA, 62 nt, Homo Sapiens; identical to SEQ ID NO: 253202

SEQ ID NO: 278976 - RNA, 62 nt, Homo Sapiens; identical to SEQ ID NO: 253203

SEQ ID NO: 278977 - RNA, 62 nt, Homo Sapiens; identical to SEQ ID NO: 253204

SEQ ID NO: 278978 - RNA, 62 nt, Homo Sapiens; identical to SEQ ID NO: 253205

SEQ ID NO: 278979 - RNA, 62 nt, Homo Sapiens; identical to SEQ ID NO: 253206

SEQ ID NO: 278980 - RNA, 62 nt, Homo Sapiens; identical to SEQ ID NO: 253207

SEQ ID NO: 278981 - RNA, 62 nt, Homo Sapiens; identical to SEQ ID NO: 253208

SEQ ID NO: 278982 - RNA, 62 nt, Homo Sapiens; identical to SEQ ID NO: 253209

SEQ ID NO: 278983 - RNA, 62 nt, Homo Sapiens; identical to SEQ ID NO: 253210

SEQ ID NO: 278984 - RNA, 62 nt, Homo Sapiens; identical to SEQ ID NO: 253211

SEQ ID NO: 278985 - RNA, 62 nt, Homo Sapiens; identical to SEQ ID NO: 253212

SEQ ID NO: 278986 - RNA, 62 nt, Homo Sapiens; identical to SEQ ID NO: 253213

SEQ ID NO: 278987 - RNA, 62 nt, Homo Sapiens; identical to SEQ ID NO: 253214

SEQ ID NO: 278988 - RNA, 62 nt, Homo Sapiens; identical to SEQ ID NO: 253215

SEQ ID NO: 278989 - RNA, 62 nt, Homo Sapiens; identical to SEQ ID NO: 253216

SEQ ID NO: 278990 - RNA, 62 nt, Homo Sapiens; identical to SEQ ID NO: 253217

SEQ ID NO: 278991 - RNA, 62 nt, Homo Sapiens; identical to SEQ ID NO: 253218

SEQ ID NO: 278992 - RNA, 62 nt, Homo Sapiens; identical to SEQ ID NO: 253219

SEQ ID NO: 278993 - RNA, 62 nt, Homo Sapiens; identical to SEQ ID NO: 253220

SEQ ID NO: 278994 - RNA, 62 nt, Homo Sapiens; identical to SEQ ID NO: 253221

SEQ ID NO: 278995 - RNA, 62 nt, Homo Sapiens; identical to SEQ ID NO: 253222

SEQ ID NO: 278996 - RNA, 62 nt, Homo Sapiens; identical to SEQ ID NO: 253223

SEQ ID NO: 278997 - RNA, 62 nt, Homo Sapiens; identical to SEQ ID NO: 253224

SEQ ID NO: 278998 - RNA, 62 nt, Homo Sapiens; identical to SEQ ID NO: 253225

SEQ ID NO: 278999 - RNA, 62 nt, Homo Sapiens; identical to SEQ ID NO: 253226

SEQ ID NO: 279000 - RNA, 62 nt, Homo Sapiens; identical to SEQ ID NO: 253227

SEQ ID NO: 279001 - RNA, 62 nt, Homo Sapiens; identical to SEQ ID NO: 253228

SEQ ID NO: 279002 - RNA, 62 nt, Homo Sapiens; identical to SEQ ID NO: 253229

SEQ ID NO: 279003 - RNA, 62 nt, Homo Sapiens; identical to SEQ ID NO: 253230

SEQ ID NO: 279004 - RNA, 62 nt, Homo Sapiens; identical to SEQ ID NO: 253231

SEQ ID NO: 279005 - RNA, 62 nt, Homo Sapiens; identical to SEQ ID NO: 253232

SEQ ID NO: 279006 - RNA, 62 nt, Homo Sapiens; identical to SEQ ID NO: 253233

SEQ ID NO: 279007 - RNA, 62 nt, Homo Sapiens; identical to SEQ ID NO: 253234

SEQ ID NO: 279008 - RNA, 62 nt, Homo Sapiens; identical to SEQ ID NO: 253235

SEQ ID NO: 279009 - RNA, 62 nt, Homo Sapiens; identical to SEQ ID NO: 253236

SEQ ID NO: 279010 - RNA, 62 nt, Homo Sapiens; identical to SEQ ID NO: 253237

SEQ ID NO: 279011 - RNA, 62 nt, Homo Sapiens; identical to SEQ ID NO: 253238

SEQ ID NO: 279012 - RNA, 62 nt, Homo Sapiens; identical to SEQ ID NO: 253239

SEQ ID NO: 279013 - RNA, 62 nt, Homo Sapiens; identical to SEQ ID NO: 253240

SEQ ID NO: 279014 - RNA, 62 nt, Homo Sapiens; identical to SEQ ID NO: 253241

SEQ ID NO: 279015 - RNA, 62 nt, Homo Sapiens; identical to SEQ ID NO: 253242

SEQ ID NO: 279016 - RNA, 62 nt, Homo Sapiens; identical to SEQ ID NO: 253243

SEQ ID NO: 279017 - RNA, 62 nt, Homo Sapiens; identical to SEQ ID NO: 253244

SEQ ID NO: 279018 - RNA, 62 nt, Homo Sapiens; identical to SEQ ID NO: 253245

SEQ ID NO: 279019 - RNA, 62 nt, Homo Sapiens; identical to SEQ ID NO: 253246

SEQ ID NO: 279020 - RNA, 62 nt, Homo Sapiens; identical to SEQ ID NO: 253247

SEQ ID NO: 279021 - RNA, 62 nt, Homo Sapiens; identical to SEQ ID NO: 253248

SEQ ID NO: 279022 - RNA, 62 nt, Homo Sapiens; identical to SEQ ID NO: 253249

SEQ ID NO: 279023 - RNA, 62 nt, Homo Sapiens; identical to SEQ ID NO: 253250

SEQ ID NO: 279024 - RNA, 62 nt, Homo Sapiens; identical to SEQ ID NO: 253251

SEQ ID NO: 279025 - RNA, 62 nt, Homo Sapiens; identical to SEQ ID NO: 253252

SEQ ID NO: 279026 - RNA, 60 nt, Homo Sapiens; identical to SEQ ID NO: 103098

SEQ ID NO: 279027 - RNA, 62 nt, Homo Sapiens; identical to SEQ ID NO: 253254

SEQ ID NO: 279028 - RNA, 62 nt, Homo Sapiens; identical to SEQ ID NO: 253255

SEQ ID NO: 279029 - RNA, 62 nt, Homo Sapiens; identical to SEQ ID NO: 253256

SEQ ID NO: 279030 - RNA, 62 nt, Homo Sapiens; identical to SEQ ID NO: 253257

SEQ ID NO: 279031 - RNA, 62 nt, Homo Sapiens; identical to SEQ ID NO: 253258

SEQ ID NO: 279032 - RNA, 62 nt, Homo Sapiens; identical to SEQ ID NO: 253259

SEQ ID NO: 279033 - RNA, 62 nt, Homo Sapiens; identical to SEQ ID NO: 253260

SEQ ID NO: 279034 - RNA, 62 nt, Homo Sapiens; identical to SEQ ID NO: 253261

SEQ ID NO: 279035 - RNA, 62 nt, Homo Sapiens; identical to SEQ ID NO: 253262

SEQ ID NO: 279036 - RNA, 62 nt, Homo Sapiens; identical to SEQ ID NO: 253263

SEQ ID NO: 279037 - RNA, 62 nt, Homo Sapiens; identical to SEQ ID NO: 253264

SEQ ID NO: 279038 - RNA, 62 nt, Homo Sapiens; identical to SEQ ID NO: 253265

SEQ ID NO: 279039 - RNA, 62 nt, Homo Sapiens; identical to SEQ ID NO: 253266

SEQ ID NO: 279040 - RNA, 62 nt, Homo Sapiens; identical to SEQ ID NO: 253267

SEQ ID NO: 279041 - RNA, 62 nt, Homo Sapiens; identical to SEQ ID NO: 253268

SEQ ID NO: 279042 - RNA, 62 nt, Homo Sapiens; identical to SEQ ID NO: 253269

SEQ ID NO: 279043 - RNA, 62 nt, Homo Sapiens; identical to SEQ ID NO: 253270

SEQ ID NO: 279044 - RNA, 62 nt, Homo Sapiens; identical to SEQ ID NO: 253271

SEQ ID NO: 279045 - RNA, 62 nt, Homo Sapiens; identical to SEQ ID NO: 253272

SEQ ID NO: 279046 - RNA, 62 nt, Homo Sapiens; identical to SEQ ID NO: 253273

SEQ ID NO: 279047 - RNA, 62 nt, Homo Sapiens; identical to SEQ ID NO: 253274

SEQ ID NO: 279048 - RNA, 62 nt, Homo Sapiens; identical to SEQ ID NO: 253275

SEQ ID NO: 279049 - RNA, 62 nt, Homo Sapiens; identical to SEQ ID NO: 253276

SEQ ID NO: 279050 - RNA, 62 nt, Homo Sapiens; identical to SEQ ID NO: 253277

SEQ ID NO: 279051 - RNA, 62 nt, Homo Sapiens; identical to SEQ ID NO: 253278

SEQ ID NO: 279052 - RNA, 62 nt, Homo Sapiens; identical to SEQ ID NO: 253279

SEQ ID NO: 279053 - RNA, 62 nt, Homo Sapiens; identical to SEQ ID NO: 253280

SEQ ID NO: 279054 - RNA, 62 nt, Homo Sapiens; identical to SEQ ID NO: 253281

SEQ ID NO: 279055 - RNA, 62 nt, Homo Sapiens; identical to SEQ ID NO: 253282

SEQ ID NO: 279056 - RNA, 62 nt, Homo Sapiens; identical to SEQ ID NO: 253283

SEQ ID NO: 279057 - RNA, 62 nt, Homo Sapiens; identical to SEQ ID NO: 253284

SEQ ID NO: 279058 - RNA, 62 nt, Homo Sapiens; identical to SEQ ID NO: 253285

SEQ ID NO: 279059 - RNA, 62 nt, Homo Sapiens; identical to SEQ ID NO: 253286

SEQ ID NO: 279060 - RNA, 62 nt, Homo Sapiens; identical to SEQ ID NO: 253287

SEQ ID NO: 279061 - RNA, 62 nt, Homo Sapiens; identical to SEQ ID NO: 253288

SEQ ID NO: 279062 - RNA, 62 nt, Homo Sapiens; identical to SEQ ID NO: 253289

SEQ ID NO: 279063 - RNA, 62 nt, Homo Sapiens; identical to SEQ ID NO: 253290

SEQ ID NO: 279064 - RNA, 62 nt, Homo Sapiens; identical to SEQ ID NO: 253291

SEQ ID NO: 279065 - RNA, 62 nt, Homo Sapiens; identical to SEQ ID NO: 253292

SEQ ID NO: 279066 - RNA, 62 nt, Homo Sapiens; identical to SEQ ID NO: 253293

SEQ ID NO: 279067 - RNA, 62 nt, Homo Sapiens; identical to SEQ ID NO: 253294

SEQ ID NO: 279068 - RNA, 62 nt, Homo Sapiens; identical to SEQ ID NO: 253295

SEQ ID NO: 279069 - RNA, 62 nt, Homo Sapiens; identical to SEQ ID NO: 253296

SEQ ID NO: 279070 - RNA, 62 nt, Homo Sapiens; identical to SEQ ID NO: 253297

SEQ ID NO: 279071 - RNA, 62 nt, Homo Sapiens; identical to SEQ ID NO: 253298

SEQ ID NO: 279072 - RNA, 62 nt, Homo Sapiens; identical to SEQ ID NO: 253299

SEQ ID NO: 279073 - RNA, 62 nt, Homo Sapiens; identical to SEQ ID NO: 253300

SEQ ID NO: 279074 - RNA, 62 nt, Homo Sapiens; identical to SEQ ID NO: 253301

SEQ ID NO: 279075 - RNA, 62 nt, Homo Sapiens; identical to SEQ ID NO: 253302

SEQ ID NO: 279076 - RNA, 62 nt, Homo Sapiens; identical to SEQ ID NO: 253303

SEQ ID NO: 279077 - RNA, 62 nt, Homo Sapiens; identical to SEQ ID NO: 253304

SEQ ID NO: 279078 - RNA, 62 nt, Homo Sapiens; identical to SEQ ID NO: 253305

SEQ ID NO: 279079 - RNA, 62 nt, Homo Sapiens; identical to SEQ ID NO: 253306

SEQ ID NO: 279080 - RNA, 62 nt, Homo Sapiens; identical to SEQ ID NO: 253307

SEQ ID NO: 279081 - RNA, 62 nt, Homo Sapiens; identical to SEQ ID NO: 253308

SEQ ID NO: 279082 - RNA, 62 nt, Homo Sapiens; identical to SEQ ID NO: 253309

SEQ ID NO: 279083 - RNA, 62 nt, Homo Sapiens; identical to SEQ ID NO: 253310

SEQ ID NO: 279084 - RNA, 62 nt, Homo Sapiens; identical to SEQ ID NO: 253311

SEQ ID NO: 279085 - RNA, 62 nt, Homo Sapiens; identical to SEQ ID NO: 253312

SEQ ID NO: 279086 - RNA, 62 nt, Homo Sapiens; identical to SEQ ID NO: 253313

SEQ ID NO: 279087 - RNA, 62 nt, Homo Sapiens; identical to SEQ ID NO: 253314

SEQ ID NO: 279088 - RNA, 62 nt, Homo Sapiens; identical to SEQ ID NO: 253315

SEQ ID NO: 279089 - RNA, 62 nt, Homo Sapiens; identical to SEQ ID NO: 253316

SEQ ID NO: 279090 - RNA, 62 nt, Homo Sapiens; identical to SEQ ID NO: 253317

SEQ ID NO: 279091 - RNA, 62 nt, Homo Sapiens; identical to SEQ ID NO: 253318

SEQ ID NO: 279092 - RNA, 62 nt, Homo Sapiens; identical to SEQ ID NO: 253319

SEQ ID NO: 279093 - RNA, 62 nt, Homo Sapiens; identical to SEQ ID NO: 253320

SEQ ID NO: 279094 - RNA, 62 nt, Homo Sapiens; identical to SEQ ID NO: 253321

SEQ ID NO: 279095 - RNA, 62 nt, Homo Sapiens; identical to SEQ ID NO: 253322

SEQ ID NO: 279096 - RNA, 62 nt, Homo Sapiens; identical to SEQ ID NO: 253323

SEQ ID NO: 279097 - RNA, 62 nt, Homo Sapiens; identical to SEQ ID NO: 253324

SEQ ID NO: 279098 - RNA, 62 nt, Homo Sapiens; identical to SEQ ID NO: 253325

SEQ ID NO: 279099 - RNA, 62 nt, Homo Sapiens; identical to SEQ ID NO: 253326

SEQ ID NO: 279100 - RNA, 62 nt, Homo Sapiens; identical to SEQ ID NO: 253327

SEQ ID NO: 279101 - RNA, 62 nt, Homo Sapiens; identical to SEQ ID NO: 253328

SEQ ID NO: 279102 - RNA, 62 nt, Homo Sapiens; identical to SEQ ID NO: 253329

SEQ ID NO: 279103 - RNA, 62 nt, Homo Sapiens; identical to SEQ ID NO: 253330

SEQ ID NO: 279104 - RNA, 62 nt, Homo Sapiens; identical to SEQ ID NO: 253331

SEQ ID NO: 279105 - RNA, 62 nt, Homo Sapiens; identical to SEQ ID NO: 253332

SEQ ID NO: 279106 - RNA, 62 nt, Homo Sapiens; identical to SEQ ID NO: 253333

SEQ ID NO: 279107 - RNA, 62 nt, Homo Sapiens; identical to SEQ ID NO: 253334

SEQ ID NO: 279108 - RNA, 62 nt, Homo Sapiens; identical to SEQ ID NO: 253335

SEQ ID NO: 279109 - RNA, 62 nt, Homo Sapiens; identical to SEQ ID NO: 253336

SEQ ID NO: 279110 - RNA, 62 nt, Homo Sapiens; identical to SEQ ID NO: 253337

SEQ ID NO: 279111 - RNA, 62 nt, Homo Sapiens; identical to SEQ ID NO: 253338

SEQ ID NO: 279112 - RNA, 62 nt, Homo Sapiens; identical to SEQ ID NO: 253339

SEQ ID NO: 279113 - RNA, 62 nt, Homo Sapiens; identical to SEQ ID NO: 253340

SEQ ID NO: 279114 - RNA, 62 nt, Homo Sapiens; identical to SEQ ID NO: 253341

SEQ ID NO: 279115 - RNA, 62 nt, Homo Sapiens; identical to SEQ ID NO: 253342

SEQ ID NO: 279116 - RNA, 62 nt, Homo Sapiens; identical to SEQ ID NO: 253343

SEQ ID NO: 279117 - RNA, 62 nt, Homo Sapiens; identical to SEQ ID NO: 253344

SEQ ID NO: 279118 - RNA, 62 nt, Homo Sapiens; identical to SEQ ID NO: 253345

SEQ ID NO: 279119 - RNA, 62 nt, Homo Sapiens; identical to SEQ ID NO: 253346

SEQ ID NO: 279120 - RNA, 62 nt, Homo Sapiens; identical to SEQ ID NO: 253347

SEQ ID NO: 279121 - RNA, 62 nt, Homo Sapiens; identical to SEQ ID NO: 253348

SEQ ID NO: 279122 - RNA, 62 nt, Homo Sapiens; identical to SEQ ID NO: 253349

SEQ ID NO: 279123 - RNA, 62 nt, Homo Sapiens; identical to SEQ ID NO: 253350

SEQ ID NO: 279124 - RNA, 51 nt, Homo Sapiens; identical to SEQ ID NO: 103196

SEQ ID NO: 279125 - RNA, 62 nt, Homo Sapiens; identical to SEQ ID NO: 253352

SEQ ID NO: 279126 - RNA, 62 nt, Homo Sapiens; identical to SEQ ID NO: 253353

SEQ ID NO: 279127 - RNA, 62 nt, Homo Sapiens; identical to SEQ ID NO: 253354

SEQ ID NO: 279128 - RNA, 62 nt, Homo Sapiens; identical to SEQ ID NO: 253355

SEQ ID NO: 279129 - RNA, 62 nt, Homo Sapiens; identical to SEQ ID NO: 253356

SEQ ID NO: 279130 - RNA, 62 nt, Homo Sapiens; identical to SEQ ID NO: 253357

SEQ ID NO: 279131 - RNA, 62 nt, Homo Sapiens; identical to SEQ ID NO: 253358

SEQ ID NO: 279132 - RNA, 62 nt, Homo Sapiens; identical to SEQ ID NO: 253359

SEQ ID NO: 279133 - RNA, 62 nt, Homo Sapiens; identical to SEQ ID NO: 253360

SEQ ID NO: 279134 - RNA, 62 nt, Homo Sapiens; identical to SEQ ID NO: 253361

SEQ ID NO: 279135 - RNA, 62 nt, Homo Sapiens; identical to SEQ ID NO: 253362

SEQ ID NO: 279136 - RNA, 62 nt, Homo Sapiens; identical to SEQ ID NO: 253363

SEQ ID NO: 279137 - RNA, 62 nt, Homo Sapiens; identical to SEQ ID NO: 253364

SEQ ID NO: 279138 - RNA, 62 nt, Homo Sapiens; identical to SEQ ID NO: 253365

SEQ ID NO: 279139 - RNA, 62 nt, Homo Sapiens; identical to SEQ ID NO: 253366

SEQ ID NO: 279140 - RNA, 62 nt, Homo Sapiens; identical to SEQ ID NO: 253367

SEQ ID NO: 279141 - RNA, 62 nt, Homo Sapiens; identical to SEQ ID NO: 253368

SEQ ID NO: 279142 - RNA, 62 nt, Homo Sapiens; identical to SEQ ID NO: 253369

SEQ ID NO: 279143 - RNA, 62 nt, Homo Sapiens; identical to SEQ ID NO: 253370

SEQ ID NO: 279144 - RNA, 62 nt, Homo Sapiens; identical to SEQ ID NO: 253371

SEQ ID NO: 279145 - RNA, 62 nt, Homo Sapiens; identical to SEQ ID NO: 253372

SEQ ID NO: 279146 - RNA, 62 nt, Homo Sapiens; identical to SEQ ID NO: 253373

SEQ ID NO: 279147 - RNA, 62 nt, Homo Sapiens; identical to SEQ ID NO: 253374

SEQ ID NO: 279148 - RNA, 62 nt, Homo Sapiens; identical to SEQ ID NO: 253375

SEQ ID NO: 279149 - RNA, 62 nt, Homo Sapiens; identical to SEQ ID NO: 253376

SEQ ID NO: 279150 - RNA, 62 nt, Homo Sapiens; identical to SEQ ID NO: 253377

SEQ ID NO: 279151 - RNA, 62 nt, Homo Sapiens; identical to SEQ ID NO: 253378

SEQ ID NO: 279152 - RNA, 62 nt, Homo Sapiens; identical to SEQ ID NO: 253379

SEQ ID NO: 279153 - RNA, 62 nt, Homo Sapiens; identical to SEQ ID NO: 253380

SEQ ID NO: 279154 - RNA, 62 nt, Homo Sapiens; identical to SEQ ID NO: 253381

SEQ ID NO: 279155 - RNA, 62 nt, Homo Sapiens; identical to SEQ ID NO: 253382

SEQ ID NO: 279156 - RNA, 62 nt, Homo Sapiens; identical to SEQ ID NO: 253383

SEQ ID NO: 279157 - RNA, 62 nt, Homo Sapiens; identical to SEQ ID NO: 253384

SEQ ID NO: 279158 - RNA, 62 nt, Homo Sapiens; identical to SEQ ID NO: 253385

SEQ ID NO: 279159 - RNA, 62 nt, Homo Sapiens; identical to SEQ ID NO: 253386

SEQ ID NO: 279160 - RNA, 62 nt, Homo Sapiens; identical to SEQ ID NO: 253387

SEQ ID NO: 279161 - RNA, 62 nt, Homo Sapiens; identical to SEQ ID NO: 253388

SEQ ID NO: 279162 - RNA, 62 nt, Homo Sapiens; identical to SEQ ID NO: 253389

SEQ ID NO: 279163 - RNA, 62 nt, Homo Sapiens; identical to SEQ ID NO: 253390

SEQ ID NO: 279164 - RNA, 62 nt, Homo Sapiens; identical to SEQ ID NO: 253391

SEQ ID NO: 279165 - RNA, 62 nt, Homo Sapiens; identical to SEQ ID NO: 253392

SEQ ID NO: 279166 - RNA, 62 nt, Homo Sapiens; identical to SEQ ID NO: 253393

SEQ ID NO: 279167 - RNA, 62 nt, Homo Sapiens; identical to SEQ ID NO: 253394

SEQ ID NO: 279168 - RNA, 62 nt, Homo Sapiens; identical to SEQ ID NO: 253395

SEQ ID NO: 279169 - RNA, 62 nt, Homo Sapiens; identical to SEQ ID NO: 253396

SEQ ID NO: 279170 - RNA, 62 nt, Homo Sapiens; identical to SEQ ID NO: 253397

SEQ ID NO: 279171 - RNA, 62 nt, Homo Sapiens; identical to SEQ ID NO: 253398

SEQ ID NO: 279172 - RNA, 62 nt, Homo Sapiens; identical to SEQ ID NO: 253399

SEQ ID NO: 279173 - RNA, 62 nt, Homo Sapiens; identical to SEQ ID NO: 253400

SEQ ID NO: 279174 - RNA, 62 nt, Homo Sapiens; identical to SEQ ID NO: 253401

SEQ ID NO: 279175 - RNA, 62 nt, Homo Sapiens; identical to SEQ ID NO: 253402

SEQ ID NO: 279176 - RNA, 62 nt, Homo Sapiens; identical to SEQ ID NO: 253403

SEQ ID NO: 279177 - RNA, 62 nt, Homo Sapiens; identical to SEQ ID NO: 253404

SEQ ID NO: 279178 - RNA, 62 nt, Homo Sapiens; identical to SEQ ID NO: 253405

SEQ ID NO: 279179 - RNA, 62 nt, Homo Sapiens; identical to SEQ ID NO: 253406

SEQ ID NO: 279180 - RNA, 62 nt, Homo Sapiens; identical to SEQ ID NO: 253407

SEQ ID NO: 279181 - RNA, 62 nt, Homo Sapiens; identical to SEQ ID NO: 253408

SEQ ID NO: 279182 - RNA, 62 nt, Homo Sapiens; identical to SEQ ID NO: 253409

SEQ ID NO: 279183 - RNA, 62 nt, Homo Sapiens; identical to SEQ ID NO: 253410

SEQ ID NO: 279184 - RNA, 62 nt, Homo Sapiens; identical to SEQ ID NO: 253411

SEQ ID NO: 279185 - RNA, 62 nt, Homo Sapiens; identical to SEQ ID NO: 253412

SEQ ID NO: 279186 - RNA, 62 nt, Homo Sapiens; identical to SEQ ID NO: 253413

SEQ ID NO: 279187 - RNA, 62 nt, Homo Sapiens; identical to SEQ ID NO: 253414

SEQ ID NO: 279188 - RNA, 62 nt, Homo Sapiens; identical to SEQ ID NO: 253415

SEQ ID NO: 279189 - RNA, 62 nt, Homo Sapiens; identical to SEQ ID NO: 253416

SEQ ID NO: 279190 - RNA, 62 nt, Homo Sapiens; identical to SEQ ID NO: 253417

SEQ ID NO: 279191 - RNA, 62 nt, Homo Sapiens; identical to SEQ ID NO: 253418

SEQ ID NO: 279192 - RNA, 62 nt, Homo Sapiens; identical to SEQ ID NO: 253419

SEQ ID NO: 279193 - RNA, 62 nt, Homo Sapiens; identical to SEQ ID NO: 253420

SEQ ID NO: 279194 - RNA, 62 nt, Homo Sapiens; identical to SEQ ID NO: 253421

SEQ ID NO: 279195 - RNA, 62 nt, Homo Sapiens; identical to SEQ ID NO: 253422

SEQ ID NO: 279196 - RNA, 62 nt, Homo Sapiens; identical to SEQ ID NO: 253423

SEQ ID NO: 279197 - RNA, 62 nt, Homo Sapiens; identical to SEQ ID NO: 253424

SEQ ID NO: 279198 - RNA, 62 nt, Homo Sapiens; identical to SEQ ID NO: 253425

SEQ ID NO: 279199 - RNA, 62 nt, Homo Sapiens; identical to SEQ ID NO: 253426

SEQ ID NO: 279200 - RNA, 62 nt, Homo Sapiens; identical to SEQ ID NO: 253427

SEQ ID NO: 279201 - RNA, 62 nt, Homo Sapiens; identical to SEQ ID NO: 253428

SEQ ID NO: 279202 - RNA, 62 nt, Homo Sapiens; identical to SEQ ID NO: 253429

SEQ ID NO: 279203 - RNA, 62 nt, Homo Sapiens; identical to SEQ ID NO: 253430

SEQ ID NO: 279204 - RNA, 62 nt, Homo Sapiens; identical to SEQ ID NO: 253431

SEQ ID NO: 279205 - RNA, 62 nt, Homo Sapiens; identical to SEQ ID NO: 253432

SEQ ID NO: 279206 - RNA, 62 nt, Homo Sapiens; identical to SEQ ID NO: 253433

SEQ ID NO: 279207 - RNA, 62 nt, Homo Sapiens; identical to SEQ ID NO: 253434

SEQ ID NO: 279208 - RNA, 62 nt, Homo Sapiens; identical to SEQ ID NO: 253435

SEQ ID NO: 279209 - RNA, 62 nt, Homo Sapiens; identical to SEQ ID NO: 253436

SEQ ID NO: 279210 - RNA, 62 nt, Homo Sapiens; identical to SEQ ID NO: 253437

SEQ ID NO: 279211 - RNA, 62 nt, Homo Sapiens; identical to SEQ ID NO: 253438

SEQ ID NO: 279212 - RNA, 62 nt, Homo Sapiens; identical to SEQ ID NO: 253439

SEQ ID NO: 279213 - RNA, 62 nt, Homo Sapiens; identical to SEQ ID NO: 253440

SEQ ID NO: 279214 - RNA, 62 nt, Homo Sapiens; identical to SEQ ID NO: 253441

SEQ ID NO: 279215 - RNA, 62 nt, Homo Sapiens; identical to SEQ ID NO: 253442

SEQ ID NO: 279216 - RNA, 62 nt, Homo Sapiens; identical to SEQ ID NO: 253443

SEQ ID NO: 279217 - RNA, 66 nt, Homo Sapiens; identical to SEQ ID NO: 253444

SEQ ID NO: 279218 - RNA, 66 nt, Homo Sapiens; identical to SEQ ID NO: 253445

SEQ ID NO: 279219 - RNA, 66 nt, Homo Sapiens; identical to SEQ ID NO: 253446

SEQ ID NO: 279220 - RNA, 66 nt, Homo Sapiens; identical to SEQ ID NO: 253447

SEQ ID NO: 279221 - RNA, 66 nt, Homo Sapiens; identical to SEQ ID NO: 253448

SEQ ID NO: 279222 - RNA, 66 nt, Homo Sapiens; identical to SEQ ID NO: 253449

SEQ ID NO: 279223 - RNA, 66 nt, Homo Sapiens; identical to SEQ ID NO: 253450

SEQ ID NO: 279224 - RNA, 66 nt, Homo Sapiens; identical to SEQ ID NO: 253451

SEQ ID NO: 279225 - RNA, 66 nt, Homo Sapiens; identical to SEQ ID NO: 253452

SEQ ID NO: 279226 - RNA, 66 nt, Homo Sapiens; identical to SEQ ID NO: 253453

SEQ ID NO: 279227 - RNA, 66 nt, Homo Sapiens; identical to SEQ ID NO: 253454

SEQ ID NO: 279228 - RNA, 58 nt, Homo Sapiens; identical to SEQ ID NO: 102991

SEQ ID NO: 279229 - RNA, 66 nt, Homo Sapiens; identical to SEQ ID NO: 253456

SEQ ID NO: 279230 - RNA, 66 nt, Homo Sapiens; identical to SEQ ID NO: 253457

SEQ ID NO: 279231 - RNA, 66 nt, Homo Sapiens; identical to SEQ ID NO: 253458

SEQ ID NO: 279232 - RNA, 66 nt, Homo Sapiens; identical to SEQ ID NO: 253459

SEQ ID NO: 279233 - RNA, 66 nt, Homo Sapiens; identical to SEQ ID NO: 253460

SEQ ID NO: 279234 - RNA, 66 nt, Homo Sapiens; identical to SEQ ID NO: 253461

SEQ ID NO: 279235 - RNA, 66 nt, Homo Sapiens; identical to SEQ ID NO: 253462

SEQ ID NO: 279236 - RNA, 66 nt, Homo Sapiens; identical to SEQ ID NO: 253463

SEQ ID NO: 279237 - RNA, 66 nt, Homo Sapiens; identical to SEQ ID NO: 253464

SEQ ID NO: 279238 - RNA, 66 nt, Homo Sapiens; identical to SEQ ID NO: 253465

SEQ ID NO: 279239 - RNA, 66 nt, Homo Sapiens; identical to SEQ ID NO: 253466

SEQ ID NO: 279240 - RNA, 66 nt, Homo Sapiens; identical to SEQ ID NO: 253467

SEQ ID NO: 279241 - RNA, 66 nt, Homo Sapiens; identical to SEQ ID NO: 253468

SEQ ID NO: 279242 - RNA, 66 nt, Homo Sapiens; identical to SEQ ID NO: 253469

SEQ ID NO: 279243 - RNA, 66 nt, Homo Sapiens; identical to SEQ ID NO: 253470

SEQ ID NO: 279244 - RNA, 66 nt, Homo Sapiens; identical to SEQ ID NO: 253471

SEQ ID NO: 279245 - RNA, 66 nt, Homo Sapiens; identical to SEQ ID NO: 253472

SEQ ID NO: 279246 - RNA, 66 nt, Homo Sapiens; identical to SEQ ID NO: 253473

SEQ ID NO: 279247 - RNA, 66 nt, Homo Sapiens; identical to SEQ ID NO: 253474

SEQ ID NO: 279248 - RNA, 66 nt, Homo Sapiens; identical to SEQ ID NO: 253475

SEQ ID NO: 279249 - RNA, 66 nt, Homo Sapiens; identical to SEQ ID NO: 253476

SEQ ID NO: 279250 - RNA, 66 nt, Homo Sapiens; identical to SEQ ID NO: 253477

SEQ ID NO: 279251 - RNA, 53 nt, Homo Sapiens; identical to SEQ ID NO: 103014

SEQ ID NO: 279252 - RNA, 66 nt, Homo Sapiens; identical to SEQ ID NO: 253479

SEQ ID NO: 279253 - RNA, 66 nt, Homo Sapiens; identical to SEQ ID NO: 253480

SEQ ID NO: 279254 - RNA, 66 nt, Homo Sapiens; identical to SEQ ID NO: 253481

SEQ ID NO: 279255 - RNA, 66 nt, Homo Sapiens; identical to SEQ ID NO: 253482

SEQ ID NO: 279256 - RNA, 66 nt, Homo Sapiens; identical to SEQ ID NO: 253483

SEQ ID NO: 279257 - RNA, 66 nt, Homo Sapiens; identical to SEQ ID NO: 253484

SEQ ID NO: 279258 - RNA, 66 nt, Homo Sapiens; identical to SEQ ID NO: 253485

SEQ ID NO: 279259 - RNA, 66 nt, Homo Sapiens; identical to SEQ ID NO: 253486

SEQ ID NO: 279260 - RNA, 66 nt, Homo Sapiens; identical to SEQ ID NO: 253487

SEQ ID NO: 279261 - RNA, 66 nt, Homo Sapiens; identical to SEQ ID NO: 253488

SEQ ID NO: 279262 - RNA, 66 nt, Homo Sapiens; identical to SEQ ID NO: 253489

SEQ ID NO: 279263 - RNA, 66 nt, Homo Sapiens; identical to SEQ ID NO: 253490

SEQ ID NO: 279264 - RNA, 66 nt, Homo Sapiens; identical to SEQ ID NO: 253491

SEQ ID NO: 279265 - RNA, 66 nt, Homo Sapiens; identical to SEQ ID NO: 253492

SEQ ID NO: 279266 - RNA, 66 nt, Homo Sapiens; identical to SEQ ID NO: 253493

SEQ ID NO: 279267 - RNA, 66 nt, Homo Sapiens; identical to SEQ ID NO: 253494

SEQ ID NO: 279268 - RNA, 66 nt, Homo Sapiens; identical to SEQ ID NO: 253495

SEQ ID NO: 279269 - RNA, 66 nt, Homo Sapiens; identical to SEQ ID NO: 253496

SEQ ID NO: 279270 - RNA, 66 nt, Homo Sapiens; identical to SEQ ID NO: 253497

SEQ ID NO: 279271 - RNA, 66 nt, Homo Sapiens; identical to SEQ ID NO: 253498

SEQ ID NO: 279272 - RNA, 66 nt, Homo Sapiens; identical to SEQ ID NO: 253499

SEQ ID NO: 279273 - RNA, 66 nt, Homo Sapiens; identical to SEQ ID NO: 253500

SEQ ID NO: 279274 - RNA, 66 nt, Homo Sapiens; identical to SEQ ID NO: 253501

SEQ ID NO: 279275 - RNA, 66 nt, Homo Sapiens; identical to SEQ ID NO: 253502

SEQ ID NO: 279276 - RNA, 66 nt, Homo Sapiens; identical to SEQ ID NO: 253503

SEQ ID NO: 279277 - RNA, 66 nt, Homo Sapiens; identical to SEQ ID NO: 253504

SEQ ID NO: 279278 - RNA, 66 nt, Homo Sapiens; identical to SEQ ID NO: 253505

SEQ ID NO: 279279 - RNA, 66 nt, Homo Sapiens; identical to SEQ ID NO: 253506

SEQ ID NO: 279280 - RNA, 66 nt, Homo Sapiens; identical to SEQ ID NO: 253507

SEQ ID NO: 279281 - RNA, 66 nt, Homo Sapiens; identical to SEQ ID NO: 253508

SEQ ID NO: 279282 - RNA, 66 nt, Homo Sapiens; identical to SEQ ID NO: 253509

SEQ ID NO: 279283 - RNA, 66 nt, Homo Sapiens; identical to SEQ ID NO: 253510

SEQ ID NO: 279284 - RNA, 66 nt, Homo Sapiens; identical to SEQ ID NO: 253511

SEQ ID NO: 279285 - RNA, 66 nt, Homo Sapiens; identical to SEQ ID NO: 253512

SEQ ID NO: 279286 - RNA, 66 nt, Homo Sapiens; identical to SEQ ID NO: 253513

SEQ ID NO: 279287 - RNA, 66 nt, Homo Sapiens; identical to SEQ ID NO: 253514

SEQ ID NO: 279288 - RNA, 66 nt, Homo Sapiens; identical to SEQ ID NO: 253515

SEQ ID NO: 279289 - RNA, 66 nt, Homo Sapiens; identical to SEQ ID NO: 253516

SEQ ID NO: 279290 - RNA, 66 nt, Homo Sapiens; identical to SEQ ID NO: 253517

SEQ ID NO: 279291 - RNA, 66 nt, Homo Sapiens; identical to SEQ ID NO: 253518

SEQ ID NO: 279292 - RNA, 66 nt, Homo Sapiens; identical to SEQ ID NO: 253519

SEQ ID NO: 279293 - RNA, 66 nt, Homo Sapiens; identical to SEQ ID NO: 253520

SEQ ID NO: 279294 - RNA, 66 nt, Homo Sapiens; identical to SEQ ID NO: 253521

SEQ ID NO: 279295 - RNA, 66 nt, Homo Sapiens; identical to SEQ ID NO: 253522

SEQ ID NO: 279296 - RNA, 66 nt, Homo Sapiens; identical to SEQ ID NO: 253523

SEQ ID NO: 279297 - RNA, 66 nt, Homo Sapiens; identical to SEQ ID NO: 253524

SEQ ID NO: 279298 - RNA, 66 nt, Homo Sapiens; identical to SEQ ID NO: 253525

SEQ ID NO: 279299 - RNA, 66 nt, Homo Sapiens; identical to SEQ ID NO: 253526

SEQ ID NO: 279300 - RNA, 66 nt, Homo Sapiens; identical to SEQ ID NO: 253527

SEQ ID NO: 279301 - RNA, 66 nt, Homo Sapiens; identical to SEQ ID NO: 253528

SEQ ID NO: 279302 - RNA, 66 nt, Homo Sapiens; identical to SEQ ID NO: 253529

SEQ ID NO: 279303 - RNA, 66 nt, Homo Sapiens; identical to SEQ ID NO: 253530

SEQ ID NO: 279304 - RNA, 66 nt, Homo Sapiens; identical to SEQ ID NO: 253531

SEQ ID NO: 279305 - RNA, 66 nt, Homo Sapiens; identical to SEQ ID NO: 253532

SEQ ID NO: 279306 - RNA, 66 nt, Homo Sapiens; identical to SEQ ID NO: 253533

SEQ ID NO: 279307 - RNA, 66 nt, Homo Sapiens; identical to SEQ ID NO: 253534

SEQ ID NO: 279308 - RNA, 66 nt, Homo Sapiens; identical to SEQ ID NO: 253535

SEQ ID NO: 279309 - RNA, 66 nt, Homo Sapiens; identical to SEQ ID NO: 253536

SEQ ID NO: 279310 - RNA, 66 nt, Homo Sapiens; identical to SEQ ID NO: 253537

SEQ ID NO: 279311 - RNA, 66 nt, Homo Sapiens; identical to SEQ ID NO: 253538

SEQ ID NO: 279312 - RNA, 66 nt, Homo Sapiens; identical to SEQ ID NO: 253539

SEQ ID NO: 279313 - RNA, 66 nt, Homo Sapiens; identical to SEQ ID NO: 253540

SEQ ID NO: 279314 - RNA, 66 nt, Homo Sapiens; identical to SEQ ID NO: 253541

SEQ ID NO: 279315 - RNA, 66 nt, Homo Sapiens; identical to SEQ ID NO: 253542

SEQ ID NO: 279316 - RNA, 66 nt, Homo Sapiens; identical to SEQ ID NO: 253543

SEQ ID NO: 279317 - RNA, 66 nt, Homo Sapiens; identical to SEQ ID NO: 253544

SEQ ID NO: 279318 - RNA, 66 nt, Homo Sapiens; identical to SEQ ID NO: 253545

SEQ ID NO: 279319 - RNA, 66 nt, Homo Sapiens; identical to SEQ ID NO: 253546

SEQ ID NO: 279320 - RNA, 66 nt, Homo Sapiens; identical to SEQ ID NO: 253547

SEQ ID NO: 279321 - RNA, 66 nt, Homo Sapiens; identical to SEQ ID NO: 253548

SEQ ID NO: 279322 - RNA, 66 nt, Homo Sapiens; identical to SEQ ID NO: 253549

SEQ ID NO: 279323 - RNA, 66 nt, Homo Sapiens; identical to SEQ ID NO: 253550

SEQ ID NO: 279324 - RNA, 66 nt, Homo Sapiens; identical to SEQ ID NO: 253551

SEQ ID NO: 279325 - RNA, 66 nt, Homo Sapiens; identical to SEQ ID NO: 253552

SEQ ID NO: 279326 - RNA, 66 nt, Homo Sapiens; identical to SEQ ID NO: 253553

SEQ ID NO: 279327 - RNA, 66 nt, Homo Sapiens; identical to SEQ ID NO: 253554

SEQ ID NO: 279328 - RNA, 66 nt, Homo Sapiens; identical to SEQ ID NO: 253555

SEQ ID NO: 279329 - RNA, 66 nt, Homo Sapiens; identical to SEQ ID NO: 253556

SEQ ID NO: 279330 - RNA, 66 nt, Homo Sapiens; identical to SEQ ID NO: 253557

SEQ ID NO: 279331 - RNA, 66 nt, Homo Sapiens; identical to SEQ ID NO: 253558

SEQ ID NO: 279332 - RNA, 66 nt, Homo Sapiens; identical to SEQ ID NO: 253559

SEQ ID NO: 279333 - RNA, 66 nt, Homo Sapiens; identical to SEQ ID NO: 253560

SEQ ID NO: 279334 - RNA, 66 nt, Homo Sapiens; identical to SEQ ID NO: 253561

SEQ ID NO: 279335 - RNA, 60 nt, Homo Sapiens; identical to SEQ ID NO: 103098

SEQ ID NO: 279336 - RNA, 66 nt, Homo Sapiens; identical to SEQ ID NO: 253563

SEQ ID NO: 279337 - RNA, 66 nt, Homo Sapiens; identical to SEQ ID NO: 253564

SEQ ID NO: 279338 - RNA, 66 nt, Homo Sapiens; identical to SEQ ID NO: 253565

SEQ ID NO: 279339 - RNA, 66 nt, Homo Sapiens; identical to SEQ ID NO: 253566

SEQ ID NO: 279340 - RNA, 66 nt, Homo Sapiens; identical to SEQ ID NO: 253567

SEQ ID NO: 279341 - RNA, 66 nt, Homo Sapiens; identical to SEQ ID NO: 253568

SEQ ID NO: 279342 - RNA, 66 nt, Homo Sapiens; identical to SEQ ID NO: 253569

SEQ ID NO: 279343 - RNA, 66 nt, Homo Sapiens; identical to SEQ ID NO: 253570

SEQ ID NO: 279344 - RNA, 66 nt, Homo Sapiens; identical to SEQ ID NO: 253571

SEQ ID NO: 279345 - RNA, 66 nt, Homo Sapiens; identical to SEQ ID NO: 253572

SEQ ID NO: 279346 - RNA, 66 nt, Homo Sapiens; identical to SEQ ID NO: 253573

SEQ ID NO: 279347 - RNA, 66 nt, Homo Sapiens; identical to SEQ ID NO: 253574

SEQ ID NO: 279348 - RNA, 66 nt, Homo Sapiens; identical to SEQ ID NO: 253575

SEQ ID NO: 279349 - RNA, 66 nt, Homo Sapiens; identical to SEQ ID NO: 253576

SEQ ID NO: 279350 - RNA, 66 nt, Homo Sapiens; identical to SEQ ID NO: 253577

SEQ ID NO: 279351 - RNA, 66 nt, Homo Sapiens; identical to SEQ ID NO: 253578

SEQ ID NO: 279352 - RNA, 66 nt, Homo Sapiens; identical to SEQ ID NO: 253579

SEQ ID NO: 279353 - RNA, 66 nt, Homo Sapiens; identical to SEQ ID NO: 253580

SEQ ID NO: 279354 - RNA, 66 nt, Homo Sapiens; identical to SEQ ID NO: 253581

SEQ ID NO: 279355 - RNA, 66 nt, Homo Sapiens; identical to SEQ ID NO: 253582

SEQ ID NO: 279356 - RNA, 66 nt, Homo Sapiens; identical to SEQ ID NO: 253583

SEQ ID NO: 279357 - RNA, 66 nt, Homo Sapiens; identical to SEQ ID NO: 253584

SEQ ID NO: 279358 - RNA, 66 nt, Homo Sapiens; identical to SEQ ID NO: 253585

SEQ ID NO: 279359 - RNA, 66 nt, Homo Sapiens; identical to SEQ ID NO: 253586

SEQ ID NO: 279360 - RNA, 66 nt, Homo Sapiens; identical to SEQ ID NO: 253587

SEQ ID NO: 279361 - RNA, 66 nt, Homo Sapiens; identical to SEQ ID NO: 253588

SEQ ID NO: 279362 - RNA, 66 nt, Homo Sapiens; identical to SEQ ID NO: 253589

SEQ ID NO: 279363 - RNA, 66 nt, Homo Sapiens; identical to SEQ ID NO: 253590

SEQ ID NO: 279364 - RNA, 66 nt, Homo Sapiens; identical to SEQ ID NO: 253591

SEQ ID NO: 279365 - RNA, 66 nt, Homo Sapiens; identical to SEQ ID NO: 253592

SEQ ID NO: 279366 - RNA, 66 nt, Homo Sapiens; identical to SEQ ID NO: 253593

SEQ ID NO: 279367 - RNA, 66 nt, Homo Sapiens; identical to SEQ ID NO: 253594

SEQ ID NO: 279368 - RNA, 66 nt, Homo Sapiens; identical to SEQ ID NO: 253595

SEQ ID NO: 279369 - RNA, 66 nt, Homo Sapiens; identical to SEQ ID NO: 253596

SEQ ID NO: 279370 - RNA, 66 nt, Homo Sapiens; identical to SEQ ID NO: 253597

SEQ ID NO: 279371 - RNA, 66 nt, Homo Sapiens; identical to SEQ ID NO: 253598

SEQ ID NO: 279372 - RNA, 66 nt, Homo Sapiens; identical to SEQ ID NO: 253599

SEQ ID NO: 279373 - RNA, 66 nt, Homo Sapiens; identical to SEQ ID NO: 253600

SEQ ID NO: 279374 - RNA, 66 nt, Homo Sapiens; identical to SEQ ID NO: 253601

SEQ ID NO: 279375 - RNA, 66 nt, Homo Sapiens; identical to SEQ ID NO: 253602

SEQ ID NO: 279376 - RNA, 66 nt, Homo Sapiens; identical to SEQ ID NO: 253603

SEQ ID NO: 279377 - RNA, 66 nt, Homo Sapiens; identical to SEQ ID NO: 253604

SEQ ID NO: 279378 - RNA, 66 nt, Homo Sapiens; identical to SEQ ID NO: 253605

SEQ ID NO: 279379 - RNA, 66 nt, Homo Sapiens; identical to SEQ ID NO: 253606

SEQ ID NO: 279380 - RNA, 66 nt, Homo Sapiens; identical to SEQ ID NO: 253607

SEQ ID NO: 279381 - RNA, 66 nt, Homo Sapiens; identical to SEQ ID NO: 253608

SEQ ID NO: 279382 - RNA, 66 nt, Homo Sapiens; identical to SEQ ID NO: 253609

SEQ ID NO: 279383 - RNA, 66 nt, Homo Sapiens; identical to SEQ ID NO: 253610

SEQ ID NO: 279384 - RNA, 66 nt, Homo Sapiens; identical to SEQ ID NO: 253611

SEQ ID NO: 279385 - RNA, 66 nt, Homo Sapiens; identical to SEQ ID NO: 253612

SEQ ID NO: 279386 - RNA, 66 nt, Homo Sapiens; identical to SEQ ID NO: 253613

SEQ ID NO: 279387 - RNA, 66 nt, Homo Sapiens; identical to SEQ ID NO: 253614

SEQ ID NO: 279388 - RNA, 66 nt, Homo Sapiens; identical to SEQ ID NO: 253615

SEQ ID NO: 279389 - RNA, 66 nt, Homo Sapiens; identical to SEQ ID NO: 253616

SEQ ID NO: 279390 - RNA, 66 nt, Homo Sapiens; identical to SEQ ID NO: 253617

SEQ ID NO: 279391 - RNA, 66 nt, Homo Sapiens; identical to SEQ ID NO: 253618

SEQ ID NO: 279392 - RNA, 66 nt, Homo Sapiens; identical to SEQ ID NO: 253619

SEQ ID NO: 279393 - RNA, 66 nt, Homo Sapiens; identical to SEQ ID NO: 253620

SEQ ID NO: 279394 - RNA, 66 nt, Homo Sapiens; identical to SEQ ID NO: 253621

SEQ ID NO: 279395 - RNA, 66 nt, Homo Sapiens; identical to SEQ ID NO: 253622

SEQ ID NO: 279396 - RNA, 66 nt, Homo Sapiens; identical to SEQ ID NO: 253623

SEQ ID NO: 279397 - RNA, 66 nt, Homo Sapiens; identical to SEQ ID NO: 253624

SEQ ID NO: 279398 - RNA, 66 nt, Homo Sapiens; identical to SEQ ID NO: 253625

SEQ ID NO: 279399 - RNA, 66 nt, Homo Sapiens; identical to SEQ ID NO: 253626

SEQ ID NO: 279400 - RNA, 66 nt, Homo Sapiens; identical to SEQ ID NO: 253627

SEQ ID NO: 279401 - RNA, 66 nt, Homo Sapiens; identical to SEQ ID NO: 253628

SEQ ID NO: 279402 - RNA, 66 nt, Homo Sapiens; identical to SEQ ID NO: 253629

SEQ ID NO: 279403 - RNA, 66 nt, Homo Sapiens; identical to SEQ ID NO: 253630

SEQ ID NO: 279404 - RNA, 66 nt, Homo Sapiens; identical to SEQ ID NO: 253631

SEQ ID NO: 279405 - RNA, 66 nt, Homo Sapiens; identical to SEQ ID NO: 253632

SEQ ID NO: 279406 - RNA, 66 nt, Homo Sapiens; identical to SEQ ID NO: 253633

SEQ ID NO: 279407 - RNA, 66 nt, Homo Sapiens; identical to SEQ ID NO: 253634

SEQ ID NO: 279408 - RNA, 66 nt, Homo Sapiens; identical to SEQ ID NO: 253635

SEQ ID NO: 279409 - RNA, 66 nt, Homo Sapiens; identical to SEQ ID NO: 253636

SEQ ID NO: 279410 - RNA, 66 nt, Homo Sapiens; identical to SEQ ID NO: 253637

SEQ ID NO: 279411 - RNA, 66 nt, Homo Sapiens; identical to SEQ ID NO: 253638

SEQ ID NO: 279412 - RNA, 66 nt, Homo Sapiens; identical to SEQ ID NO: 253639

SEQ ID NO: 279413 - RNA, 66 nt, Homo Sapiens; identical to SEQ ID NO: 253640

SEQ ID NO: 279414 - RNA, 66 nt, Homo Sapiens; identical to SEQ ID NO: 253641

SEQ ID NO: 279415 - RNA, 66 nt, Homo Sapiens; identical to SEQ ID NO: 253642

SEQ ID NO: 279416 - RNA, 66 nt, Homo Sapiens; identical to SEQ ID NO: 253643

SEQ ID NO: 279417 - RNA, 66 nt, Homo Sapiens; identical to SEQ ID NO: 253644

SEQ ID NO: 279418 - RNA, 66 nt, Homo Sapiens; identical to SEQ ID NO: 253645

SEQ ID NO: 279419 - RNA, 66 nt, Homo Sapiens; identical to SEQ ID NO: 253646

SEQ ID NO: 279420 - RNA, 66 nt, Homo Sapiens; identical to SEQ ID NO: 253647

SEQ ID NO: 279421 - RNA, 66 nt, Homo Sapiens; identical to SEQ ID NO: 253648

SEQ ID NO: 279422 - RNA, 66 nt, Homo Sapiens; identical to SEQ ID NO: 253649

SEQ ID NO: 279423 - RNA, 66 nt, Homo Sapiens; identical to SEQ ID NO: 253650

SEQ ID NO: 279424 - RNA, 66 nt, Homo Sapiens; identical to SEQ ID NO: 253651

SEQ ID NO: 279425 - RNA, 66 nt, Homo Sapiens; identical to SEQ ID NO: 253652

SEQ ID NO: 279426 - RNA, 66 nt, Homo Sapiens; identical to SEQ ID NO: 253653

SEQ ID NO: 279427 - RNA, 66 nt, Homo Sapiens; identical to SEQ ID NO: 253654

SEQ ID NO: 279428 - RNA, 66 nt, Homo Sapiens; identical to SEQ ID NO: 253655

SEQ ID NO: 279429 - RNA, 66 nt, Homo Sapiens; identical to SEQ ID NO: 253656

SEQ ID NO: 279430 - RNA, 66 nt, Homo Sapiens; identical to SEQ ID NO: 253657

SEQ ID NO: 279431 - RNA, 66 nt, Homo Sapiens; identical to SEQ ID NO: 253658

SEQ ID NO: 279432 - RNA, 63 nt, Homo Sapiens; identical to SEQ ID NO: 103195

SEQ ID NO: 279433 - RNA, 51 nt, Homo Sapiens; identical to SEQ ID NO: 103196

SEQ ID NO: 279434 - RNA, 66 nt, Homo Sapiens; identical to SEQ ID NO: 253661

SEQ ID NO: 279435 - RNA, 66 nt, Homo Sapiens; identical to SEQ ID NO: 253662

SEQ ID NO: 279436 - RNA, 66 nt, Homo Sapiens; identical to SEQ ID NO: 253663

SEQ ID NO: 279437 - RNA, 66 nt, Homo Sapiens; identical to SEQ ID NO: 253664

SEQ ID NO: 279438 - RNA, 66 nt, Homo Sapiens; identical to SEQ ID NO: 253665

SEQ ID NO: 279439 - RNA, 66 nt, Homo Sapiens; identical to SEQ ID NO: 253666

SEQ ID NO: 279440 - RNA, 66 nt, Homo Sapiens; identical to SEQ ID NO: 253667

SEQ ID NO: 279441 - RNA, 66 nt, Homo Sapiens; identical to SEQ ID NO: 253668

SEQ ID NO: 279442 - RNA, 66 nt, Homo Sapiens; identical to SEQ ID NO: 253669

SEQ ID NO: 279443 - RNA, 66 nt, Homo Sapiens; identical to SEQ ID NO: 253670

SEQ ID NO: 279444 - RNA, 66 nt, Homo Sapiens; identical to SEQ ID NO: 253671

SEQ ID NO: 279445 - RNA, 66 nt, Homo Sapiens; identical to SEQ ID NO: 253672

SEQ ID NO: 279446 - RNA, 66 nt, Homo Sapiens; identical to SEQ ID NO: 253673

SEQ ID NO: 279447 - RNA, 66 nt, Homo Sapiens; identical to SEQ ID NO: 253674

SEQ ID NO: 279448 - RNA, 66 nt, Homo Sapiens; identical to SEQ ID NO: 253675

SEQ ID NO: 279449 - RNA, 66 nt, Homo Sapiens; identical to SEQ ID NO: 253676

SEQ ID NO: 279450 - RNA, 66 nt, Homo Sapiens; identical to SEQ ID NO: 253677

SEQ ID NO: 279451 - RNA, 66 nt, Homo Sapiens; identical to SEQ ID NO: 253678

SEQ ID NO: 279452 - RNA, 66 nt, Homo Sapiens; identical to SEQ ID NO: 253679

SEQ ID NO: 279453 - RNA, 66 nt, Homo Sapiens; identical to SEQ ID NO: 253680

SEQ ID NO: 279454 - RNA, 66 nt, Homo Sapiens; identical to SEQ ID NO: 253681

SEQ ID NO: 279455 - RNA, 66 nt, Homo Sapiens; identical to SEQ ID NO: 253682

SEQ ID NO: 279456 - RNA, 66 nt, Homo Sapiens; identical to SEQ ID NO: 253683

SEQ ID NO: 279457 - RNA, 66 nt, Homo Sapiens; identical to SEQ ID NO: 253684

SEQ ID NO: 279458 - RNA, 66 nt, Homo Sapiens; identical to SEQ ID NO: 253685

SEQ ID NO: 279459 - RNA, 66 nt, Homo Sapiens; identical to SEQ ID NO: 253686

SEQ ID NO: 279460 - RNA, 66 nt, Homo Sapiens; identical to SEQ ID NO: 253687

SEQ ID NO: 279461 - RNA, 66 nt, Homo Sapiens; identical to SEQ ID NO: 253688

SEQ ID NO: 279462 - RNA, 66 nt, Homo Sapiens; identical to SEQ ID NO: 253689

SEQ ID NO: 279463 - RNA, 66 nt, Homo Sapiens; identical to SEQ ID NO: 253690

SEQ ID NO: 279464 - RNA, 66 nt, Homo Sapiens; identical to SEQ ID NO: 253691

SEQ ID NO: 279465 - RNA, 66 nt, Homo Sapiens; identical to SEQ ID NO: 253692

SEQ ID NO: 279466 - RNA, 66 nt, Homo Sapiens; identical to SEQ ID NO: 253693

SEQ ID NO: 279467 - RNA, 66 nt, Homo Sapiens; identical to SEQ ID NO: 253694

SEQ ID NO: 279468 - RNA, 66 nt, Homo Sapiens; identical to SEQ ID NO: 253695

SEQ ID NO: 279469 - RNA, 66 nt, Homo Sapiens; identical to SEQ ID NO: 253696

SEQ ID NO: 279470 - RNA, 66 nt, Homo Sapiens; identical to SEQ ID NO: 253697

SEQ ID NO: 279471 - RNA, 66 nt, Homo Sapiens; identical to SEQ ID NO: 253698

SEQ ID NO: 279472 - RNA, 66 nt, Homo Sapiens; identical to SEQ ID NO: 253699

SEQ ID NO: 279473 - RNA, 66 nt, Homo Sapiens; identical to SEQ ID NO: 253700

SEQ ID NO: 279474 - RNA, 66 nt, Homo Sapiens; identical to SEQ ID NO: 253701

SEQ ID NO: 279475 - RNA, 66 nt, Homo Sapiens; identical to SEQ ID NO: 253702

SEQ ID NO: 279476 - RNA, 66 nt, Homo Sapiens; identical to SEQ ID NO: 253703

SEQ ID NO: 279477 - RNA, 66 nt, Homo Sapiens; identical to SEQ ID NO: 253704

SEQ ID NO: 279478 - RNA, 66 nt, Homo Sapiens; identical to SEQ ID NO: 253705

SEQ ID NO: 279479 - RNA, 66 nt, Homo Sapiens; identical to SEQ ID NO: 253706

SEQ ID NO: 279480 - RNA, 66 nt, Homo Sapiens; identical to SEQ ID NO: 253707

SEQ ID NO: 279481 - RNA, 66 nt, Homo Sapiens; identical to SEQ ID NO: 253708

SEQ ID NO: 279482 - RNA, 66 nt, Homo Sapiens; identical to SEQ ID NO: 253709

SEQ ID NO: 279483 - RNA, 66 nt, Homo Sapiens; identical to SEQ ID NO: 253710

SEQ ID NO: 279484 - RNA, 66 nt, Homo Sapiens; identical to SEQ ID NO: 253711

SEQ ID NO: 279485 - RNA, 66 nt, Homo Sapiens; identical to SEQ ID NO: 253712

SEQ ID NO: 279486 - RNA, 66 nt, Homo Sapiens; identical to SEQ ID NO: 253713

SEQ ID NO: 279487 - RNA, 66 nt, Homo Sapiens; identical to SEQ ID NO: 253714

SEQ ID NO: 279488 - RNA, 66 nt, Homo Sapiens; identical to SEQ ID NO: 253715

SEQ ID NO: 279489 - RNA, 66 nt, Homo Sapiens; identical to SEQ ID NO: 253716

SEQ ID NO: 279490 - RNA, 66 nt, Homo Sapiens; identical to SEQ ID NO: 253717

SEQ ID NO: 279491 - RNA, 66 nt, Homo Sapiens; identical to SEQ ID NO: 253718

SEQ ID NO: 279492 - RNA, 66 nt, Homo Sapiens; identical to SEQ ID NO: 253719

SEQ ID NO: 279493 - RNA, 66 nt, Homo Sapiens; identical to SEQ ID NO: 253720

SEQ ID NO: 279494 - RNA, 66 nt, Homo Sapiens; identical to SEQ ID NO: 253721

SEQ ID NO: 279495 - RNA, 66 nt, Homo Sapiens; identical to SEQ ID NO: 253722

SEQ ID NO: 279496 - RNA, 66 nt, Homo Sapiens; identical to SEQ ID NO: 253723

SEQ ID NO: 279497 - RNA, 66 nt, Homo Sapiens; identical to SEQ ID NO: 253724

SEQ ID NO: 279498 - RNA, 66 nt, Homo Sapiens; identical to SEQ ID NO: 253725

SEQ ID NO: 279499 - RNA, 66 nt, Homo Sapiens; identical to SEQ ID NO: 253726

SEQ ID NO: 279500 - RNA, 66 nt, Homo Sapiens; identical to SEQ ID NO: 253727

SEQ ID NO: 279501 - RNA, 66 nt, Homo Sapiens; identical to SEQ ID NO: 253728

SEQ ID NO: 279502 - RNA, 66 nt, Homo Sapiens; identical to SEQ ID NO: 253729

SEQ ID NO: 279503 - RNA, 66 nt, Homo Sapiens; identical to SEQ ID NO: 253730

SEQ ID NO: 279504 - RNA, 66 nt, Homo Sapiens; identical to SEQ ID NO: 253731

SEQ ID NO: 279505 - RNA, 66 nt, Homo Sapiens; identical to SEQ ID NO: 253732

SEQ ID NO: 279506 - RNA, 66 nt, Homo Sapiens; identical to SEQ ID NO: 253733

SEQ ID NO: 279507 - RNA, 66 nt, Homo Sapiens; identical to SEQ ID NO: 253734

SEQ ID NO: 279508 - RNA, 66 nt, Homo Sapiens; identical to SEQ ID NO: 253735

SEQ ID NO: 279509 - RNA, 66 nt, Homo Sapiens; identical to SEQ ID NO: 253736

SEQ ID NO: 279510 - RNA, 66 nt, Homo Sapiens; identical to SEQ ID NO: 253737

SEQ ID NO: 279511 - RNA, 66 nt, Homo Sapiens; identical to SEQ ID NO: 253738

SEQ ID NO: 279512 - RNA, 66 nt, Homo Sapiens; identical to SEQ ID NO: 253739

SEQ ID NO: 279513 - RNA, 66 nt, Homo Sapiens; identical to SEQ ID NO: 253740

SEQ ID NO: 279514 - RNA, 66 nt, Homo Sapiens; identical to SEQ ID NO: 253741

SEQ ID NO: 279515 - RNA, 66 nt, Homo Sapiens; identical to SEQ ID NO: 253742

SEQ ID NO: 279516 - RNA, 66 nt, Homo Sapiens; identical to SEQ ID NO: 253743

SEQ ID NO: 279517 - RNA, 66 nt, Homo Sapiens; identical to SEQ ID NO: 253744

SEQ ID NO: 279518 - RNA, 66 nt, Homo Sapiens; identical to SEQ ID NO: 253745

SEQ ID NO: 279519 - RNA, 66 nt, Homo Sapiens; identical to SEQ ID NO: 253746

SEQ ID NO: 279520 - RNA, 66 nt, Homo Sapiens; identical to SEQ ID NO: 253747

SEQ ID NO: 279521 - RNA, 66 nt, Homo Sapiens; identical to SEQ ID NO: 253748

SEQ ID NO: 279522 - RNA, 66 nt, Homo Sapiens; identical to SEQ ID NO: 253749

SEQ ID NO: 279523 - RNA, 66 nt, Homo Sapiens; identical to SEQ ID NO: 253750

SEQ ID NO: 279524 - RNA, 66 nt, Homo Sapiens; identical to SEQ ID NO: 253751

SEQ ID NO: 279525 - RNA, 66 nt, Homo Sapiens; identical to SEQ ID NO: 253752

SEQ ID NO: 279526 - RNA, 64 nt, Homo Sapiens
uuugaaguuucgccgcuuuuugcaaacaagcagcaucacucaagauaacugcugccuggcaaac

SEQ ID NO: 279527 - RNA, 64 nt, Homo Sapiens
gcauaagcagauuuuacuguucuccccuucccacaucacucaagaaaauaaauaaaugaguaca

SEQ ID NO: 279528 - RNA, 64 nt, Homo Sapiens
gcuuaggcauguucaaacgccugcaaaacuacuuaucacucagcuuuaguuuuucuaauccaag

SEQ ID NO: 279529 - RNA, 64 nt, Homo Sapiens
uuguuuagaaaugcuguugcuucagguucuuaaaaucacucagcacuccaacuucuaaucaaau

SEQ ID NO: 279530 - RNA, 64 nt, Homo Sapiens
cccgucauacccguaaugcuuucuuuuuuccuuuauugccaaucuuugaacucauucaacucca

SEQ ID NO: 279531 - RNA, 64 nt, Homo Sapiens
gcuucuguuuauuccagaagcauuaagguaacccauugccaaguaucauucuugcaaauuauuc

SEQ ID NO: 279532 - RNA, 64 nt, Homo Sapiens
ccaauaauuaaaaauuuaaaauuuuuaaauuagaauugccaauacuucuacauuugagaagggu

SEQ ID NO: 279533 - RNA, 64 nt, Homo Sapiens
aaaucggccaugguuugcauggucuuaagaaauaauugccaaaauaaggacuuuugugcaauau

SEQ ID NO: 279534 - RNA, 64 nt, Homo Sapiens
uguuuguuuuauucaagacuacacaaaacaaugaauugccaaauuuaaguuuggagaaaauacc

SEQ ID NO: 279535 - RNA, 64 nt, Homo Sapiens
ggaauuuuuauuaugucaccucuaaaacacuuaaauugccaaauuuggcuaguaguuuuguuuc

SEQ ID NO: 279536 - RNA, 64 nt, Homo Sapiens
uuucucaggaucuuauuagguugaaccauauguaauugccaagauuuuacuauuuuaacuuaga

SEQ ID NO: 279537 - RNA, 64 nt, Homo Sapiens
aacacagucgaagcccaggccgaucuugaaauccauugccaagacccacaucucuuggaggagc

SEQ ID NO: 279538 - RNA, 64 nt, Homo Sapiens
cuuucgugaguaucuuucacgugaggugcauaggauugccaaaaccugagagaggcagauuuga

SEQ ID NO: 279539 - RNA, 64 nt, Homo Sapiens
aauuguuuguaaauaaugaaccuuauuuuuuauuauugccaauccccuaagauauuguauuuua

SEQ ID NO: 279540 - RNA, 64 nt, Homo Sapiens
ccccugcugcugcccaagccgcugggccuuuuuaauugccaaacugcucucuucaucagcucag

SEQ ID NO: 279541 - RNA, 64 nt, Homo Sapiens
aaaucaaauuuuuaaagaugaaaccucccaguguauugccaacugaaaccuagauauuuaugug

SEQ ID NO: 279542 - RNA, 64 nt, Homo Sapiens
uggaacagagcccagggccaugccgugggcucucauugccaauaaagccugcuggaagucuccc

SEQ ID NO: 279543 - RNA, 64 nt, Homo Sapiens
cauauccuacacagaaaaauacuuuuagacuuauauugccaagccaaaguuaccauauuuuggu

SEQ ID NO: 279544 - RNA, 64 nt, Homo Sapiens
cccuaccauggcuauuccagcaccccaaccuguaauugccaaguccucuaagguacuaauuugu

SEQ ID NO: 279545 - RNA, 64 nt, Homo Sapiens; identical to SEQ ID NO: 58517

SEQ ID NO: 279546 - RNA, 64 nt, Homo Sapiens; identical to SEQ ID NO: 58518

SEQ ID NO: 279547 - RNA, 64 nt, Homo Sapiens; identical to SEQ ID NO: 58519

SEQ ID NO: 279548 - RNA, 64 nt, Homo Sapiens; identical to SEQ ID NO: 58520

SEQ ID NO: 279549 - RNA, 64 nt, Homo Sapiens; identical to SEQ ID NO: 58521

SEQ ID NO: 279550 - RNA, 64 nt, Homo Sapiens; identical to SEQ ID NO: 58522

SEQ ID NO: 279551 - RNA, 64 nt, Homo Sapiens; identical to SEQ ID NO: 58523

SEQ ID NO: 279552 - RNA, 64 nt, Homo Sapiens; identical to SEQ ID NO: 58524

SEQ ID NO: 279553 - RNA, 64 nt, Homo Sapiens; identical to SEQ ID NO: 58525

SEQ ID NO: 279554 - RNA, 64 nt, Homo Sapiens; identical to SEQ ID NO: 58526

SEQ ID NO: 279555 - RNA, 64 nt, Homo Sapiens; identical to SEQ ID NO: 58527

SEQ ID NO: 279556 - RNA, 64 nt, Homo Sapiens; identical to SEQ ID NO: 58528

SEQ ID NO: 279557 - RNA, 64 nt, Homo Sapiens; identical to SEQ ID NO: 58529

SEQ ID NO: 279558 - RNA, 64 nt, Homo Sapiens; identical to SEQ ID NO: 58530

SEQ ID NO: 279559 - RNA, 64 nt, Homo Sapiens; identical to SEQ ID NO: 58531

SEQ ID NO: 279560 - RNA, 64 nt, Homo Sapiens; identical to SEQ ID NO: 58532

SEQ ID NO: 279561 - RNA, 64 nt, Homo Sapiens
acagaucuuggauauguuguucaauuuucuuucugagccagacuaguuuacgcuauucaaaucu

SEQ ID NO: 279562 - RNA, 64 nt, Homo Sapiens
auuuuuauauugaggaacaauauuggguguuugggagccagaaagcuuuguugacagaucagaa

SEQ ID NO: 279563 - RNA, 64 nt, Homo Sapiens
gucugaaaagcaagucccccagccccaccccagggagccagagaggcuugcacucaggagagaa

SEQ ID NO: 279564 - RNA, 64 nt, Homo Sapiens
aucucccgcccucugggguuugaguggagguauggagccagagaggcuauccuagcuaccuucc

SEQ ID NO: 279565 - RNA, 64 nt, Homo Sapiens
uacaggcggcuccagcccugggcagcggcuucaagagccagagugggaagucaggccucucugg

SEQ ID NO: 279566 - RNA, 64 nt, Homo Sapiens
uggcugcuggcuuucaagcgugguuuuuugcuaagagccagaggcaggucuucuggaguucuca

SEQ ID NO: 279567 - RNA, 64 nt, Homo Sapiens
acagaucuggaggcagcagugugcuggguggagagagccagaaaacauagauccgagggcagca

SEQ ID NO: 279568 - RNA, 64 nt, Homo Sapiens
acauagauccgagggcagcaguggggcgaggagagagccagaaaugggggcuaaauuaauugga

SEQ ID NO: 279569 - RNA, 64 nt, Homo Sapiens
ugggguggccugaagcccucgcuaggacuggaaagagccagaagcuggaucuccucuuuuaccu

SEQ ID NO: 279570 - RNA, 64 nt, Homo Sapiens
ugccagccuuccugaagggcuccccagguagggagagccagagggauccaguagcccuggaggu

SEQ ID NO: 279571 - RNA, 64 nt, Homo Sapiens
ucagugcugaagacguggacgucacaucauaccagagccagaggguccuccugcaggaaaguac

SEQ ID NO: 279572 - RNA, 64 nt, Homo Sapiens
cagcagccucagccccagggccuuggcccagaaggagccagagggcgccugucuuacccggugg

SEQ ID NO: 279573 - RNA, 64 nt, Homo Sapiens
gaggagugaggguggcucaaccucagaugggagagagccagagaguuaguuccagccugcuaua

SEQ ID NO: 279574 - RNA, 61 nt, Homo Sapiens
aucuggucuuccaagacuuugugccucaccagagccagauuugcgacacugcugcacguag

SEQ ID NO: 279575 - RNA, 64 nt, Homo Sapiens
uccaguuguccccagagcacccugggccugggcugagccagaccagacccuugggagguggccc

SEQ ID NO: 279576 - RNA, 64 nt, Homo Sapiens
uaggccagggcaggcuaccagccacaucuucuaugagccagaugcuuaugaugaccuggaccaa

SEQ ID NO: 279577 - RNA, 64 nt, Homo Sapiens
cgccgcgucccggcgcuuuccggguggcgcugccgagccagagcccgccucugucuccggccac

SEQ ID NO: 279578 - RNA, 64 nt, Homo Sapiens
aggggccccaccaccaaggcaccacacagugccagagccagagaucugggccgaagcacguccc

SEQ ID NO: 279579 - RNA, 64 nt, Homo Sapiens
gaacugcugcuguccucccuguggcauccaagcugagccagaggcuccaagccuggggaaggac

SEQ ID NO: 279580 - RNA, 63 nt, Homo Sapiens
uuccugcugaggacaugaggccgucgcuuaccagagccagaaguuguucaccuccugaccuga

SEQ ID NO: 279581 - RNA, 64 nt, Homo Sapiens
agcugucgguccccagcccugcccggcgggcccggagccagagccgcgaggagcaggcugugcu

SEQ ID NO: 279582 - RNA, 64 nt, Homo Sapiens
auggcaugcccugcacucagucaccccgagggcugagccagauuccuggaugugauggaccagc

SEQ ID NO: 279583 - RNA, 64 nt, Homo Sapiens
gccuggacaucagggacuuuaagucaugaaaauggagccagagaacuguguugcauucuugcac

SEQ ID NO: 279584 - RNA, 64 nt, Homo Sapiens
cauggcaauggucuccccaccccuuguugccuuugagccagaucgaaguccagucccgacagug

SEQ ID NO: 279585 - RNA, 64 nt, Homo Sapiens
auuaacugaaaagcaguuuaauauaguagacaaagagccagaaaguaaaagucucguugcucau

SEQ ID NO: 279586 - RNA, 64 nt, Homo Sapiens
caggccgggacaaaacgcagccaccagggaaggugagccagacaaugaccccagagcagugcag

SEQ ID NO: 279587 - RNA, 64 nt, Homo Sapiens
augcugacagccucaugcugucuugcugcucucagagccagaaaccccauucccccagggaaca

SEQ ID NO: 279588 - RNA, 64 nt, Homo Sapiens
gcucuggagugagcagaaccaacccaagauggaagagccagaggagaaggcaucugagucuccu

SEQ ID NO: 279589 - RNA, 64 nt, Homo Sapiens
gccugaguccuucuguccguagagcugggguugggagccagaauaggcagagauugaagccauc

SEQ ID NO: 279590 - RNA, 64 nt, Homo Sapiens
cccgucuccaacuccucaucccagaggaguacaagagccagaggcuccgcccccacccccgccg

SEQ ID NO: 279591 - RNA, 64 nt, Homo Sapiens; identical to SEQ ID NO: 126039

SEQ ID NO: 279592 - RNA, 64 nt, Homo Sapiens; identical to SEQ ID NO: 126040

SEQ ID NO: 279593 - RNA, 64 nt, Homo Sapiens; identical to SEQ ID NO: 126041

SEQ ID NO: 279594 - RNA, 64 nt, Homo Sapiens; identical to SEQ ID NO: 126042

SEQ ID NO: 279595 - RNA, 64 nt, Homo Sapiens; identical to SEQ ID NO: 209225

SEQ ID NO: 279596 - RNA, 64 nt, Homo Sapiens; identical to SEQ ID NO: 209226

SEQ ID NO: 279597 - RNA, 64 nt, Homo Sapiens; identical to SEQ ID NO: 209227

SEQ ID NO: 279598 - RNA, 64 nt, Homo Sapiens; identical to SEQ ID NO: 209228

SEQ ID NO: 279599 - RNA, 64 nt, Homo Sapiens; identical to SEQ ID NO: 209229

SEQ ID NO: 279600 - RNA, 64 nt, Homo Sapiens; identical to SEQ ID NO: 209230

SEQ ID NO: 279601 - RNA, 64 nt, Homo Sapiens; identical to SEQ ID NO: 209231

SEQ ID NO: 279602 - RNA, 64 nt, Homo Sapiens; identical to SEQ ID NO: 209232

SEQ ID NO: 279603 - RNA, 64 nt, Homo Sapiens; identical to SEQ ID NO: 209233

SEQ ID NO: 279604 - RNA, 64 nt, Homo Sapiens; identical to SEQ ID NO: 209234

SEQ ID NO: 279605 - RNA, 64 nt, Homo Sapiens; identical to SEQ ID NO: 209235

SEQ ID NO: 279606 - RNA, 64 nt, Homo Sapiens; identical to SEQ ID NO: 209236

SEQ ID NO: 279607 - RNA, 64 nt, Homo Sapiens; identical to SEQ ID NO: 209237

SEQ ID NO: 279608 - RNA, 64 nt, Homo Sapiens; identical to SEQ ID NO: 209238

SEQ ID NO: 279609 - RNA, 64 nt, Homo Sapiens; identical to SEQ ID NO: 209239

SEQ ID NO: 279610 - RNA, 64 nt, Homo Sapiens; identical to SEQ ID NO: 209240

SEQ ID NO: 279611 - RNA, 64 nt, Homo Sapiens; identical to SEQ ID NO: 209241

SEQ ID NO: 279612 - RNA, 64 nt, Homo Sapiens; identical to SEQ ID NO: 209242

SEQ ID NO: 279613 - RNA, 64 nt, Homo Sapiens; identical to SEQ ID NO: 209243

SEQ ID NO: 279614 - RNA, 64 nt, Homo Sapiens; identical to SEQ ID NO: 209244

SEQ ID NO: 279615 - RNA, 64 nt, Homo Sapiens; identical to SEQ ID NO: 209245

SEQ ID NO: 279616 - RNA, 64 nt, Homo Sapiens; identical to SEQ ID NO: 209246

SEQ ID NO: 279617 - RNA, 64 nt, Homo Sapiens; identical to SEQ ID NO: 209247

SEQ ID NO: 279618 - RNA, 64 nt, Homo Sapiens; identical to SEQ ID NO: 209248

SEQ ID NO: 279619 - RNA, 64 nt, Homo Sapiens; identical to SEQ ID NO: 209249

SEQ ID NO: 279620 - RNA, 64 nt, Homo Sapiens; identical to SEQ ID NO: 209250

SEQ ID NO: 279621 - RNA, 64 nt, Homo Sapiens; identical to SEQ ID NO: 209251

SEQ ID NO: 279622 - RNA, 64 nt, Homo Sapiens; identical to SEQ ID NO: 209252

SEQ ID NO: 279623 - RNA, 64 nt, Homo Sapiens; identical to SEQ ID NO: 209253

SEQ ID NO: 279624 - RNA, 64 nt, Homo Sapiens; identical to SEQ ID NO: 209254

SEQ ID NO: 279625 - RNA, 64 nt, Homo Sapiens; identical to SEQ ID NO: 209255

SEQ ID NO: 279626 - RNA, 64 nt, Homo Sapiens; identical to SEQ ID NO: 209256

SEQ ID NO: 279627 - RNA, 64 nt, Homo Sapiens; identical to SEQ ID NO: 209257

SEQ ID NO: 279628 - RNA, 64 nt, Homo Sapiens; identical to SEQ ID NO: 209258

SEQ ID NO: 279629 - RNA, 64 nt, Homo Sapiens; identical to SEQ ID NO: 209259

SEQ ID NO: 279630 - RNA, 64 nt, Homo Sapiens; identical to SEQ ID NO: 209260

SEQ ID NO: 279631 - RNA, 64 nt, Homo Sapiens; identical to SEQ ID NO: 209261

SEQ ID NO: 279632 - RNA, 64 nt, Homo Sapiens; identical to SEQ ID NO: 209262

SEQ ID NO: 279633 - RNA, 64 nt, Homo Sapiens; identical to SEQ ID NO: 209263

SEQ ID NO: 279634 - RNA, 64 nt, Homo Sapiens; identical to SEQ ID NO: 209264

SEQ ID NO: 279635 - RNA, 64 nt, Homo Sapiens; identical to SEQ ID NO: 209263

SEQ ID NO: 279636 - RNA, 64 nt, Homo Sapiens; identical to SEQ ID NO: 209266

SEQ ID NO: 279637 - RNA, 64 nt, Homo Sapiens; identical to SEQ ID NO: 209267

SEQ ID NO: 279638 - RNA, 64 nt, Homo Sapiens; identical to SEQ ID NO: 209268

SEQ ID NO: 279639 - RNA, 64 nt, Homo Sapiens; identical to SEQ ID NO: 209269

SEQ ID NO: 279640 - RNA, 64 nt, Homo Sapiens; identical to SEQ ID NO: 209270

SEQ ID NO: 279641 - RNA, 64 nt, Homo Sapiens; identical to SEQ ID NO: 209271

SEQ ID NO: 279642 - RNA, 64 nt, Homo Sapiens; identical to SEQ ID NO: 209272

SEQ ID NO: 279643 - RNA, 64 nt, Homo Sapiens; identical to SEQ ID NO: 209273

SEQ ID NO: 279644 - RNA, 64 nt, Homo Sapiens; identical to SEQ ID NO: 209274

SEQ ID NO: 279645 - RNA, 64 nt, Homo Sapiens; identical to SEQ ID NO: 209275

SEQ ID NO: 279646 - RNA, 64 nt, Homo Sapiens; identical to SEQ ID NO: 102053

SEQ ID NO: 279647 - RNA, 64 nt, Homo Sapiens; identical to SEQ ID NO: 102054

SEQ ID NO: 279648 - RNA, 64 nt, Homo Sapiens; identical to SEQ ID NO: 102055

SEQ ID NO: 279649 - RNA, 64 nt, Homo Sapiens; identical to SEQ ID NO: 102056

SEQ ID NO: 279650 - RNA, 64 nt, Homo Sapiens; identical to SEQ ID NO: 102057

SEQ ID NO: 279651 - RNA, 64 nt, Homo Sapiens; identical to SEQ ID NO: 102058

SEQ ID NO: 279652 - RNA, 64 nt, Homo Sapiens; identical to SEQ ID NO: 102059

SEQ ID NO: 279653 - RNA, 64 nt, Homo Sapiens; identical to SEQ ID NO: 102060

SEQ ID NO: 279654 - RNA, 64 nt, Homo Sapiens; identical to SEQ ID NO: 102061

SEQ ID NO: 279655 - RNA, 64 nt, Homo Sapiens; identical to SEQ ID NO: 102062

SEQ ID NO: 279656 - RNA, 64 nt, Homo Sapiens; identical to SEQ ID NO: 102063

SEQ ID NO: 279657 - RNA, 64 nt, Homo Sapiens; identical to SEQ ID NO: 102064

SEQ ID NO: 279658 - RNA, 52 nt, Homo Sapiens; identical to SEQ ID NO: 102065

SEQ ID NO: 279659 - RNA, 63 nt, Homo Sapiens; identical to SEQ ID NO: 102066

SEQ ID NO: 279660 - RNA, 64 nt, Homo Sapiens; identical to SEQ ID NO: 102067

SEQ ID NO: 279661 - RNA, 64 nt, Homo Sapiens; identical to SEQ ID NO: 102068

SEQ ID NO: 279662 - RNA, 64 nt, Homo Sapiens; identical to SEQ ID NO: 102069

SEQ ID NO: 279663 - RNA, 62 nt, Homo Sapiens
gcacauguauauuacuaaaguagauaauuccaaugagaaauacuaccagauuauuguuauaa

SEQ ID NO: 279664 - RNA, 62 nt, Homo Sapiens
gaagcaguguaguucuaccucucauuuuacagaugagaaaaccgaagcccagaaaaacucuc

SEQ ID NO: 279665 - RNA, 62 nt, Homo Sapiens
ggaugugcuuugaucguuaaugagguggucacaugagaaaugauaccuguuacuacuguauu

SEQ ID NO: 279666 - RNA, 62 nt, Homo Sapiens
aucuuuuacuacuugaacauuuaaauuucuaaaugagaaagguauauauauuacuguaacug

SEQ ID NO: 279667 - RNA, 62 nt, Homo Sapiens
uaaguggccuggugaguggagguagaaaaaugaugagaaaugaacugagagcauuaagcaga

SEQ ID NO: 279668 - RNA, 62 nt, Homo Sapiens
auuuagggacaaagaagguauaaaguccagagaugagaaaacugggucagcccucagaaacu

SEQ ID NO: 279669 - RNA, 62 nt, Homo Sapiens
auauuuauuagaauaaaaugaauauuaagaaaaugagaaauucaaauguuguggaaaacugg

SEQ ID NO: 279670 - RNA, 62 nt, Homo Sapiens
cuuuuagaauggauuuauuuacagaaugcuauaugagaaacauuugucacuugagcuuaugu

SEQ ID NO: 279671 - RNA, 62 nt, Homo Sapiens
uuuuuuuuaaauaaauuauuugaaacagauuuaugagaaaaggauguuauuauauaugcuua

SEQ ID NO: 279672 - RNA, 62 nt, Homo Sapiens
gcuuuaguuccaauugacaguuagguggagaaaugagaaaaauuauauuuguuuuccuguau

SEQ ID NO: 279673 - RNA, 62 nt, Homo Sapiens
ggcaguguaacaaccuauagugccauugauccaugagaaaaagauuuucugguacuacucca

SEQ ID NO: 279674 - RNA, 62 nt, Homo Sapiens
acuuuuaauuuuuauuuuggcaaaacugucaaaugagaaaaaugauuuuaaaaacuuuuuuu

SEQ ID NO: 279675 - RNA, 62 nt, Homo Sapiens
aguuuauuuuuaccaaagagaugcaauucauuaugagaaaguauugcauaauaaauuuuguu

SEQ ID NO: 279676 - RNA, 62 nt, Homo Sapiens
ggggccagaccuuugccugauuccugauucccaugagaaaucagaacugcuuucugcagcaa

SEQ ID NO: 279677 - RNA, 62 nt, Homo Sapiens
aaaaccuaccucaggguugcuucaaggauuaaaugagaaaauaugucaacaauaaagaccug

SEQ ID NO: 279678 - RNA, 62 nt, Homo Sapiens
ucagaaacaaccagccuugaaggcuacaacugaugagaaagauucuguuucgaacauagcca

SEQ ID NO: 279679 - RNA, 62 nt, Homo Sapiens
ugagaaaccaccaggcuugaaggcuacaagugaugagaaagauucuguuuugaauauagcca

SEQ ID NO: 279680 - RNA, 62 nt, Homo Sapiens
ccaagcuauuaaguaccauuagacuaguauaaaugagaaaauuguccuauuucugauuauua

SEQ ID NO: 279681 - RNA, 62 nt, Homo Sapiens
ucuuugaaagaaauauggagcaaacagauaguaugagaaauaucagagaaauuugauagacu

SEQ ID NO: 279682 - RNA, 62 nt, Homo Sapiens
ugaaauugcauuacaguucauaaaaauugaaaaugagaaauuaaaccugcaagugaaacauu

SEQ ID NO: 279683 - RNA, 62 nt, Homo Sapiens
ucaguaaaaauagugaagacaugcaucauggaaugagaaaaugagaaaggaaugaguugucu

SEQ ID NO: 279684 - RNA, 62 nt, Homo Sapiens
aauagugaagacaugcaucauggaaugagaaaaugagaaaggaaugaguugucuaacaucac

SEQ ID NO: 279685 - RNA, 62 nt, Homo Sapiens
aaauccuaaucaggaaaaagacucaucuaguaaugagaaacaaacuauuagucugccaguuu

SEQ ID NO: 279686 - RNA, 62 nt, Homo Sapiens
uuaauagcagcagcauguucaguuucgcuuauaugagaaacauguuuaggcaacuagucaga

SEQ ID NO: 279687 - RNA, 62 nt, Homo Sapiens
ucuuacaagaaugaagccauauucaaccccagaugagaaaacccaacagauccaucccuuga

SEQ ID NO: 279688 - RNA, 62 nt, Homo Sapiens
ucauaauaaauagcaaaauaauugaagcuuccaugagaaagaaaacacuauuuugauaaauu

SEQ ID NO: 279689 - RNA, 62 nt, Homo Sapiens
uggaggcauuucauacacacaguauauauaguaugagaaacuuaauuuccuucuuuaaagca

SEQ ID NO: 279690 - RNA, 62 nt, Homo Sapiens
auuuccuucuuuaaagcaaguuggaaaaugaaaugagaaauaauuuaggcaauguuucucau

SEQ ID NO: 279691 - RNA, 62 nt, Homo Sapiens
augcacacacacaaaaaauaccuaaauuuuggaugagaaaaugauaaaauaugcuaaguucu

SEQ ID NO: 279692 - RNA, 62 nt, Homo Sapiens
ggugggaugguaauggggauuagagaacugacaugagaaaagaggagcuguuuugguauuaa

SEQ ID NO: 279693 - RNA, 62 nt, Homo Sapiens
cuucaauccuggccaaguuggaguagacugguaugagaaaacuaugauuaguucacauuuac

SEQ ID NO: 279694 - RNA, 62 nt, Homo Sapiens
acuuguacuucuaauaacauuuuucaugaaucaugagaaaauuuccacagauacuucccuua

SEQ ID NO: 279695 - RNA, 62 nt, Homo Sapiens
cccuugauucuggcaaggcaaauaaagccagaaugagaaauuaccaucuucuacuagagaaa

SEQ ID NO: 279696 - RNA, 62 nt, Homo Sapiens
aacuacauguauguguggcauuuuuguuagagaugagaaaaggauugagaaggauaaacugg

SEQ ID NO: 279697 - RNA, 62 nt, Homo Sapiens
ucgcuguuuaaguagaacaaugccaacgauguaugagaaacagggaauaaaucaggauuugu

SEQ ID NO: 279698 - RNA, 62 nt, Homo Sapiens
aauuucuauuguuuaagucagccuccaaaacuaugagaaauaaccuugaucuuggacuucca

SEQ ID NO: 279699 - RNA, 62 nt, Homo Sapiens
aaagauugguccggguuaauaaaaaaugauggaugagaaaaguuuuuuauuugggauaauuu

SEQ ID NO: 279700 - RNA, 62 nt, Homo Sapiens
ccugaagugaaggcuagagaaauucuggacuaaugagaaagacaaguagcuuacaaggggac

SEQ ID NO: 279701 - RNA, 62 nt, Homo Sapiens
aaaucuaugcuggugcagcuucauaaagaauaaugagaaaaugauggugagcacaagguaag

SEQ ID NO: 279702 - RNA, 62 nt, Homo Sapiens
gugaaaagagccaaguguuauaaaacuuaguaaugagaaacuuaucaguuaggcaauguuuu

SEQ ID NO: 279703 - RNA, 62 nt, Homo Sapiens
acaaggccugccucugacugccuugaaggauaaugagaaaccgaauuaguccaaauggaacc

SEQ ID NO: 279704 - RNA, 62 nt, Homo Sapiens
gacagagcucuaauugauaagacuccaaguauaugagaaaaggauugagagagacacuacau

SEQ ID NO: 279705 - RNA, 62 nt, Homo Sapiens
auggaagaugguaaacaaucgauaaauggucaaugagaaagauuaccaagauuaaaaaguga

SEQ ID NO: 279706 - RNA, 62 nt, Homo Sapiens
cuuaucagaacuccuuucuaaggagcacuagaaugagaaaucauguuguucgaucguuucac

SEQ ID NO: 279707 - RNA, 62 nt, Homo Sapiens
ccaacuuaaaccugugcuuucauguuuaagaaaugagaaauugugccaaagauagcagaaga

SEQ ID NO: 279708 - RNA, 62 nt, Homo Sapiens
guauucaauaauugggugcccuaaauuucuggaugagaaaauuuucaauucuggccaugaga

SEQ ID NO: 279709 - RNA, 62 nt, Homo Sapiens
auuucuggaugagaaaauuuucaauucuggccaugagaaagaaaaaaaaauaaacagccuuc

SEQ ID NO: 279710 - RNA, 62 nt, Homo Sapiens
uuuaauacaacagguguccaauuuuuguuugaaugagaaaaguuuuacugccuuuccuuuua

SEQ ID NO: 279711 - RNA, 62 nt, Homo Sapiens
ccuucuuccuuugcuucaggccagugaauggaaugagaaaagauacuccauccccuucccuc

SEQ ID NO: 279712 - RNA, 62 nt, Homo Sapiens
aagcacuucuuacauggcggcagcaagagaaaaugagaaagaagcaaaaguggaaaccccua

SEQ ID NO: 279713 - RNA, 62 nt, Homo Sapiens
augcaguugcuuagaauaaucauuacuguuauaugagaaacauuuuaguaauuuaauaaaag

SEQ ID NO: 279714 - RNA, 62 nt, Homo Sapiens
cuuaaaacuugagaauauauuaugucuuugagaugagaaaggauaguacauauugcuuuguu

SEQ ID NO: 279715 - RNA, 62 nt, Homo Sapiens
aaugguaauuauuucacgcauauauaacuuuuaugagaaaaaacugguugggguccauuuug

SEQ ID NO: 279716 - RNA, 62 nt, Homo Sapiens
cuucuuuugggggucaacagucugaguguuuuaugagaaagcacaacaguuacauaauucac

SEQ ID NO: 279717 - RNA, 62 nt, Homo Sapiens
caaaaauacucagauaaggugugacuaauggcaugagaaauauguuucacaaggucuuuaaa

SEQ ID NO: 279718 - RNA, 62 nt, Homo Sapiens
ugauguuuuguauauuuuaauagacugauaggaugagaaagauuuauauuauuagauuucag

SEQ ID NO: 279719 - RNA, 62 nt, Homo Sapiens
auuugaaaaauauugucauaucuggcccuuugaugagaaaaggaaauuacaauaauaaaguu

SEQ ID NO: 279720 - RNA, 62 nt, Homo Sapiens
cugugguuucacuuauuuauaaaugcucuaaaaugagaaagcgccuucuaaaaagcagguua

SEQ ID NO: 279721 - RNA, 62 nt, Homo Sapiens
auuuuguaaaacuuaacaaaauuccaagaaaaaugagaaauauuuguaaaaugaagaguaga

SEQ ID NO: 279722 - RNA, 62 nt, Homo Sapiens
acuucccugugauucccccgaauacccccaaaaugagaaacaaaauuuuuuuucuuacucca

SEQ ID NO: 279723 - RNA, 62 nt, Homo Sapiens
guaccagcaagucaugagauuuuuuaguaaagaugagaaagaugguugaagaaaauuagugc

SEQ ID NO: 279724 - RNA, 62 nt, Homo Sapiens
guuucuucucuaaggguuuaagggcagauauuaugagaaacuuuaauaaugcacuauuaccc

SEQ ID NO: 279725 - RNA, 62 nt, Homo Sapiens
ccauacagauaccuuaaaugaaaaagaucaauaugagaaauaaucccacuuaugagauuggg

SEQ ID NO: 279726 - RNA, 62 nt, Homo Sapiens
acaaagcuuucuuuguaucuaacuaucuaagcaugagaaaauauuuaaauauuauguuugug

SEQ ID NO: 279727 - RNA, 62 nt, Homo Sapiens
aaaaaguacuuuguaaagugaguuccagacagaugagaaagcugucaugccagauugucaga

SEQ ID NO: 279728 - RNA, 62 nt, Homo Sapiens
ugcucuuuuuccaaaaauuagagcaacucaagaugagaaaacauaaaaaauacagacuuaau

SEQ ID NO: 279729 - RNA, 62 nt, Homo Sapiens
aaggagucaggggccugauaaaaaaaccauggaugagaaagacuguacuugccccccucccc

SEQ ID NO: 279730 - RNA, 62 nt, Homo Sapiens
ucaguaacccagcugcaauaccugucuguaauaugagaaaaaaaaaaugaaucuauuuaauc

SEQ ID NO: 279731 - RNA, 62 nt, Homo Sapiens
agcuuacaagggcuagaucuaagauuauucccaugagaaauguugaauuuaugaagaauaga

SEQ ID NO: 279732 - RNA, 62 nt, Homo Sapiens
aguuacucugcuacucuuaggcugcauaguuuaugagaaaaugaacacaugcauuuauggau

SEQ ID NO: 279733 - RNA, 62 nt, Homo Sapiens
aucucuuucaccuuuauuucaucuucauaagaaugagaaaggcucaaaaggaagcacuuuua

SEQ ID NO: 279734 - RNA, 62 nt, Homo Sapiens
ccccgguaacuggaggaaugggagccguuuugaugagaaaaaugggcuggagagaaggagaa

SEQ ID NO: 279735 - RNA, 62 nt, Homo Sapiens
aaaauuggcaaccagccacuauuuuguugacuaugagaaaguuaaaaguuuauguuaauuuu

SEQ ID NO: 279736 - RNA, 62 nt, Homo Sapiens
uaauuucaaauagaauauggacuuaaauguuaaugagaaaauggcuuuaaucaauucuagca

SEQ ID NO: 279737 - RNA, 62 nt, Homo Sapiens
auuggaagauaaacuugucaaacuugucaagaaugagaaaagccaaauuagaaaauccuaug

SEQ ID NO: 279738 - RNA, 62 nt, Homo Sapiens
acuccauuuguugagggucuuuguguucuucaaugagaaaucaaauuugagacguugaaauu

SEQ ID NO: 279739 - RNA, 62 nt, Homo Sapiens
cugccuguuauaaagaugaacaaaaaaacuuaaugagaaagaucacagauacguaauaauuu

SEQ ID NO: 279740 - RNA, 62 nt, Homo Sapiens
aguaagaaaaaaaaaaauccaaaagaaaaaaaaugagaaaaagcuaucuauaaaaaagagaa

SEQ ID NO: 279741 - RNA, 62 nt, Homo Sapiens
auauacuugcuaucuauaaaucauagaguucuaugagaaaaaggaaagaaguuauagaaucu

SEQ ID NO: 279742 - RNA, 64 nt, Homo Sapiens
gaggggacacgaaggaggagcaagagcucuggagguucuugaaagcaaugggggccccugaugc

SEQ ID NO: 279743 - RNA, 64 nt, Homo Sapiens
aaaacuugggaaccaaaaugaaaauuuuguaugaguucuugaauauuaaauuucauuuaucugg

SEQ ID NO: 279744 - RNA, 64 nt, Homo Sapiens
cagcuaugaacacauccuaaccaggauauacucuguucuugaacaacauacaaaguuuaaagua

SEQ ID NO: 279745 - RNA, 64 nt, Homo Sapiens
ucuuuuuaagcuguuuuaugaaaaagaccuagaaguucuugauucauuuuuaccauucuuucca

SEQ ID NO: 279746 - RNA, 64 nt, Homo Sapiens
uagucugcaccgucaucuagacugcacaacuuuaguucuugacuuucaugccuuaacucggguu

SEQ ID NO: 279747 - RNA, 64 nt, Homo Sapiens
uucagacaucugcagaaaugccuuuuagagauagguucuugauacgaacauuuccugauaaaug

SEQ ID NO: 279748 - RNA, 64 nt, Homo Sapiens
gcugccuuuuacguuuucuuguccuuucaaaaguguucuugaaagaaacaaagcgaauaggcag

SEQ ID NO: 279749 - RNA, 64 nt, Homo Sapiens
ucagauguuuaccagaguguguauuuuacauaauguucuugauuaaaaagacuuguuuguaaau

SEQ ID NO: 279750 - RNA, 64 nt, Homo Sapiens
uuuaccaccacuuaguucccauggguagaguuggguucuugaguugauccaccaauggaauuag

SEQ ID NO: 279751 - RNA, 64 nt, Homo Sapiens
auuccucuugugguuaaagaauccuggggccacaguucuugauuguucucacuguauucuuuuu

SEQ ID NO: 279752 - RNA, 64 nt, Homo Sapiens
agcacauucaauccuccaacuuacccguaucaugguucuugaccugguacaaggugacccuuaa

SEQ ID NO: 279753 - RNA, 64 nt, Homo Sapiens
acaggaggaggcucccgcuggcaagggaggagguguucuugaagccaauggccccauucagaug

SEQ ID NO: 279754 - RNA, 64 nt, Homo Sapiens
guauuuuguaaacugauguuugugauggucucugguucuugaacagccauaucugaaugccgug

SEQ ID NO: 279755 - RNA, 64 nt, Homo Sapiens
uguaaagaaaacuuacagaagaggcaacaauuugguucuugacagugagaggauauugagggcu

SEQ ID NO: 279756 - RNA, 64 nt, Homo Sapiens
uauaaugcugucagcucaaaaucauagccagguaguucuugaacucagaacuuaaauccugcac

SEQ ID NO: 279757 - RNA, 64 nt, Homo Sapiens
cagagggaguugugcuggagauugugaaaaauggguucuugaaugaucuacuauaaggcaggga

SEQ ID NO: 279758 - RNA, 64 nt, Homo Sapiens
ugguauagacugccucuggggaagcaaguuggcaguucuugaacagcaucagauaucaagaguu

SEQ ID NO: 279759 - RNA, 64 nt, Homo Sapiens
guggguuuagaaagacugaagugacagauuaagaguucuugauauuagauaacuccaacuucug

SEQ ID NO: 279760 - RNA, 64 nt, Homo Sapiens
agcacugcugugcagaccuagagguccuuagaacauagucuaagaaccauucauuguagccauu

SEQ ID NO: 279761 - RNA, 64 nt, Homo Sapiens
gcuaaaugguacugauucucaaaacaaggagcucauagucuaaaaccauuuuucuuucuuuuuu

SEQ ID NO: 279762 - RNA, 64 nt, Homo Sapiens
ucugcuccugccccuggccauuggugacuaguggggccaagagaagcuggagcagagagcuggc

SEQ ID NO: 279763 - RNA, 64 nt, Homo Sapiens
aaucgcuugaacccaggagauggagauugcaguaggccaagaugaugccacugcacuccagccu

SEQ ID NO: 279764 - RNA, 64 nt, Homo Sapiens
acagcccugagcauggggcuuaaugggacaauggggccaagagugaagcgggcagggccccugg

SEQ ID NO: 279765 - RNA, 64 nt, Homo Sapiens
cccugccaaccaacugccucucugaggaggagguggccaagaagcggaaaaaccuggccacuua

SEQ ID NO: 279766 - RNA, 64 nt, Homo Sapiens
ccucggcuccugcacggcacgggcugcucccugaggccaagaagugaagcgggagauggcgcag

SEQ ID NO: 279767 - RNA, 64 nt, Homo Sapiens
auggaguuccugaagcagaacuggugcauggcgaggccaagaagcagagccggagagcgugcug

SEQ ID NO: 279768 - RNA, 64 nt, Homo Sapiens
ccuuccauuuccagccaggccucaucugggguagggccaagaggaaaguacagagugcccgugg

SEQ ID NO: 279769 - RNA, 64 nt, Homo Sapiens
uggacaguagacuuuaucccuccuucuuacucugggccaagaccucccacuccgcccucugagg

SEQ ID NO: 279770 - RNA, 64 nt, Homo Sapiens
cggacagaguagguggccgcuuugcgccauccggggccaagaggggguggacccgcgugucugg

SEQ ID NO: 279771 - RNA, 64 nt, Homo Sapiens
gugguucuggccaggaaggcacaagguagcugugggccaagacaccagcccuguccuagcccuu

SEQ ID NO: 279772 - RNA, 64 nt, Homo Sapiens
cuccuacgggucccuggggcagcuguccccaucaggccaagagcgagcgagaggcgcugcccca

SEQ ID NO: 279773 - RNA, 64 nt, Homo Sapiens
cggcucuccugcgguguggcugguggccugccguggccaagagcaucuucuggguggauggaac

SEQ ID NO: 279774 - RNA, 64 nt, Homo Sapiens
ccuucugggccaauggggcucucagcuucguguuggccaagacuuggagcuuuagagagaugca

SEQ ID NO: 279775 - RNA, 64 nt, Homo Sapiens
aucaggccuggagaucuagguuugauuuaaaauaggccaagagacauuguggagcccauuauac

SEQ ID NO: 279776 - RNA, 62 nt, Homo Sapiens
ggggaucauuuuagagaguggaugugcaguagcaaggagaggguccuccuggacccaucuga

SEQ ID NO: 279777 - RNA, 62 nt, Homo Sapiens
uaaagaggaaagcaccucuuagacagacuccucaaggagagacccagaaagcucuuuugaaa

SEQ ID NO: 279778 - RNA, 62 nt, Homo Sapiens
caaaguauagaaacauguucauugcacacacccaaggagaagagcucaagcgcuuggaagag

SEQ ID NO: 279779 - RNA, 62 nt, Homo Sapiens
cugucuccaccuccaggauguccagcaggcugcaaggagaaggaugccagccacccauccuc

SEQ ID NO: 279780 - RNA, 62 nt, Homo Sapiens
uuuuaucauuaggaaacaaauuccaagcaaggcaaggagacuaaggagacuuucucucaucu

SEQ ID NO: 279781 - RNA, 62 nt, Homo Sapiens
uucucucaucuuuccaagcaguccaaacaaggcaaggagacugaggaucucaucucucaucu

SEQ ID NO: 279782 - RNA, 62 nt, Homo Sapiens
gauuaggaugugaaagguuguccuaaacagaccaaggagacuguucccuaauuuauucucuu

SEQ ID NO: 279783 - RNA, 62 nt, Homo Sapiens
uugaaaaaaaauuuuuuuuuuuuggacagcuucaaggagauguuagcaauuucagauauacu

SEQ ID NO: 279784 - RNA, 62 nt, Homo Sapiens
ccuuaggauaugacuaacucaccaaacaaugccaaggagaaaggcggacaggucaccaucac

SEQ ID NO: 279785 - RNA, 62 nt, Homo Sapiens
cugaaaguguaggaggaaggaagagauacaaacaaggagaggaaaugaugggagaguguugu

SEQ ID NO: 279786 - RNA, 62 nt, Homo Sapiens
ggagcaaaugguuuugggcauccuucccuuaccaaggagaggcuuucccuucucuccaguuc

SEQ ID NO: 279787 - RNA, 62 nt, Homo Sapiens
cucuccccggucuucugcugucagacuccguccaaggagauguucuuuaucuuuuccuuucu

SEQ ID NO: 279788 - RNA, 62 nt, Homo Sapiens
gagugcaucccauauaggccauuuuagaaggccaaggagagccacaccgaaaaaggagacag

SEQ ID NO: 279789 - RNA, 62 nt, Homo Sapiens
uauuggcaagaagguccccaggauagaccuagcaaggagauaagaauagaucauuaaaaaau

SEQ ID NO: 279790 - RNA, 62 nt, Homo Sapiens
ucucuaccaagcuauccuggcucuuuggagaucaaggagaggaggcaacuuuccuuguuccc

SEQ ID NO: 279791 - RNA, 62 nt, Homo Sapiens
cucuggccuguuuuagaagguucucuccuccccaaggagacacaacaacuccuagggccacu

SEQ ID NO: 279792 - RNA, 62 nt, Homo Sapiens
cugcuuccccacgagcagcaggcaacggcguccaaggagacuaggaugaguucuuggcaagg

SEQ ID NO: 279793 - RNA, 62 nt, Homo Sapiens
ccaaaauuagcaucucauugagccagagaagacaaggagaucucccucugggcaucuggcuu

SEQ ID NO: 279794 - RNA, 62 nt, Homo Sapiens
gagcugacugcaugaugaguggagugagaaaucaaggagacacucuauggcucaccuuauuu

SEQ ID NO: 279795 - RNA, 62 nt, Homo Sapiens
ccacaaggaauaugggugggggccuucaagggcaaggagagggagggcaacaggaagaugca

SEQ ID NO: 279796 - RNA, 62 nt, Homo Sapiens
ugggugagccugaagauggucaugccacugagcaaggagagaaagcucccacccugggacag

SEQ ID NO: 279797 - RNA, 62 nt, Homo Sapiens
acugguggcccuguguuccaccugccugacuccaaggagaagcaggagcucugagguggcac

SEQ ID NO: 279798 - RNA, 62 nt, Homo Sapiens
gauaaaauuuacaauagccacgcaauagccaucaaggagaauuucuauuaugauuauaaauu

SEQ ID NO: 279799 - RNA, 62 nt, Homo Sapiens
ucuuaacaccuccaccagggggaaggcuggcacaaggagaaaaaaaaagcaagcaucagcga

SEQ ID NO: 279800 - RNA, 62 nt, Homo Sapiens
gggagcccagugccagccagagguugugcaggcaaggagaccaaagauugaugagaagaccc

SEQ ID NO: 279801 - RNA, 62 nt, Homo Sapiens
uacagggccaccagacuccuggagagaucaagcaaggagaaccuggggcugccauggccaaa

SEQ ID NO: 279802 - RNA, 64 nt, Homo Sapiens
agaagcuuaaugaugcuucuauggaugaugacagaaagcccaauaccaaucucaauuuagaggu

SEQ ID NO: 279803 - RNA, 64 nt, Homo Sapiens
gcagcuucaucuuuacgauaagcaacaccaaauaaaagcccacacaguuaugugggaaagguaa

SEQ ID NO: 279804 - RNA, 64 nt, Homo Sapiens
cuuaccugaaccagccugguccacugggaacucaaaagcccacgucaggaccacagacccccca

SEQ ID NO: 279805 - RNA, 64 nt, Homo Sapiens
ggaagaaaugaaauguacaucugcagaaauugccaaagcccaaauuaacgaguauuauaaaagg

SEQ ID NO: 279806 - RNA, 64 nt, Homo Sapiens
cuauuugucuugccugcuguagcagauaaaaauaaaagcccagcgaaggaaagcuuaaagccca

SEQ ID NO: 279807 - RNA, 64 nt, Homo Sapiens
cagauaaaaauaaaagcccaaugaaggaaagcuuaaagcccaagaggcagaaucugucacuuga

SEQ ID NO: 279808 - RNA, 64 nt, Homo Sapiens
ccccacuuacguaaaacauuuggcucuuuucuuuaaagcccagggggcccagccugaggaaccc

SEQ ID NO: 279809 - RNA, 64 nt, Homo Sapiens
aggaagauccaggauaaucuccucuuugacuuacaaagcccaccgacacuggcccucccacuuc

SEQ ID NO: 279810 - RNA, 64 nt, Homo Sapiens
acagcagaagcagacaccucaugaaggccucgaaaaagcccaagcaacauaugaugaaaacccc

SEQ ID NO: 279811 - RNA, 64 nt, Homo Sapiens
agaugaugccagccuugagcuccuccuacuugggaaagcccaggucuaggcagacucaguggga

SEQ ID NO: 279812 - RNA, 64 nt, Homo Sapiens
gggccugggucugggcauggggaggccgugccucaaagcccacccuaccccaugccuuggugcu

SEQ ID NO: 279813 - RNA, 64 nt, Homo Sapiens
caggcagacugggagcaggaaaacagagggccccaaagcccaaggcaccagaagguuuguuuca

SEQ ID NO: 279814 - RNA, 64 nt, Homo Sapiens
cuuccagagucuugugccuuucauaaauaaauacaaagcccauuugacagagcaagacucuguc

SEQ ID NO: 279815 - RNA, 64 nt, Homo Sapiens
cuuggccgggcauguuggcuaaaugucagauacuaaagcccauuaaugccugaucacucuggcc

SEQ ID NO: 279816 - RNA, 64 nt, Homo Sapiens
ugaaagccugucucuuuccaaaaaaaaaaaaaaaaaagcccaccacagagcgagauuccgucuc

SEQ ID NO: 279817 - RNA, 64 nt, Homo Sapiens
ugggcugggcgcgguggcuccauggcuuccugagaaagcccaccggaaagcaugucucugcuuc

SEQ ID NO: 279818 - RNA, 64 nt, Homo Sapiens
gccccucgcuggcuuccccaccucucucaggaugaaagcccaagucaucaggguggcacgucag

SEQ ID NO: 279819 - RNA, 64 nt, Homo Sapiens
cggccaucgccauugggaaggggcgacuccacggaaagcccagacgggcuucugcauccauucc

SEQ ID NO: 279820 - RNA, 64 nt, Homo Sapiens
accugaaauuauuauagauuacaugucuuguuuuaaagcccagauaaacaguugccccagaaag

SEQ ID NO: 279821 - RNA, 64 nt, Homo Sapiens
agcgcacagggugcuuguuaguagagaaacaagcaaagcccagcgucuccaggcuucacucagg

SEQ ID NO: 279822 - RNA, 64 nt, Homo Sapiens
cccaucaugcgccgcccuccuccaucgagggagaggccugaagggacugccuacugcagcucgu

SEQ ID NO: 279823 - RNA, 64 nt, Homo Sapiens
cuuccuuaguauaaucaauguauacucccuuacuggccugaaacguuguauagcuacuuauuca

SEQ ID NO: 279824 - RNA, 64 nt, Homo Sapiens
cauuagugugaaagaggugggagugagguuuucuggccugaagcagucugcacugaaagguacc

SEQ ID NO: 279825 - RNA, 64 nt, Homo Sapiens
gccugaagcagucugcacugaaagguacccaaguggccugaaacaguguagggaaagaccuggg

SEQ ID NO: 279826 - RNA, 64 nt, Homo Sapiens
ggaggcugcucagcacagaguaggccaugugaugggccugaaguggugcuguaaucauggaccg

SEQ ID NO: 279827 - RNA, 64 nt, Homo Sapiens
ugugcacccucccagggacauggguuugcaggaaggccugaacaagugaaccccaugaagcuga

SEQ ID NO: 279828 - RNA, 64 nt, Homo Sapiens
ugcaagagcauuucuggcauuuuuacuaaauaauggccugaaauuuguauucaaguaacccuug

SEQ ID NO: 279829 - RNA, 64 nt, Homo Sapiens
aagucauacccuauuagauagaguacuauggauaggccugaaugcagacaggcuucuguuuuca

SEQ ID NO: 279830 - RNA, 64 nt, Homo Sapiens
cauuuuccaaugauguuaguucugaagaggcuucggccugaaggcagcaaacacaccguccauu

SEQ ID NO: 279831 - RNA, 64 nt, Homo Sapiens
acaauguccaggaugucugccuuugcucaagaaaggccugaaugcauuccuagacagguucauu

SEQ ID NO: 279832 - RNA, 64 nt, Homo Sapiens
gaaagaacauccaagacaacuccgagacgagaguggccugaaccucagcaguuugagcaguauu

SEQ ID NO: 279833 - RNA, 62 nt, Homo Sapiens
ggagagaagauuggcgcuggggcuggggcaaaggccugaaaggucuggcacugcuuuuuuaa

SEQ ID NO: 279834 - RNA, 64 nt, Homo Sapiens
aaauuccugagugggggguaugcccugggcuuuuggccugaagcccgauggcgccuuacccugc

SEQ ID NO: 279835 - RNA, 64 nt, Homo Sapiens
ccuuguggauccgcugugucuggaguggcugcgaggccugaacggucgguguuuccugggccuu

SEQ ID NO: 279836 - RNA, 64 nt, Homo Sapiens
ggauaagguagagcucccacgaagagccggugggggccugaagagccaccgugaagaggaagcg

SEQ ID NO: 279837 - RNA, 64 nt, Homo Sapiens
gcaaguccccuccugaggcccagcaccugaucccggccugaagccagcuccacaggcagcuuca

SEQ ID NO: 279838 - RNA, 64 nt, Homo Sapiens
cugcgccaguccugcuaccucccuugccuuucgaggccugaagccagcugcccuaugggccugc

SEQ ID NO: 279839 - RNA, 64 nt, Homo Sapiens
uauuauccuugggggcucccagggcaaggguuaaggccugaaucaugagccugcuggaagccca

SEQ ID NO: 279840 - RNA, 64 nt, Homo Sapiens; identical to SEQ ID NO: 276199

SEQ ID NO: 279841 - RNA, 64 nt, Homo Sapiens; identical to SEQ ID NO: 276200

SEQ ID NO: 279842 - RNA, 64 nt, Homo Sapiens; identical to SEQ ID NO: 276201

SEQ ID NO: 279843 - RNA, 64 nt, Homo Sapiens; identical to SEQ ID NO: 276202

SEQ ID NO: 279844 - RNA, 64 nt, Homo Sapiens; identical to SEQ ID NO: 276203

SEQ ID NO: 279845 - RNA, 64 nt, Homo Sapiens; identical to SEQ ID NO: 276204

SEQ ID NO: 279846 - RNA, 64 nt, Homo Sapiens; identical to SEQ ID NO: 276205

SEQ ID NO: 279847 - RNA, 64 nt, Homo Sapiens; identical to SEQ ID NO: 276206

SEQ ID NO: 279848 - RNA, 64 nt, Homo Sapiens; identical to SEQ ID NO: 276207

SEQ ID NO: 279849 - RNA, 64 nt, Homo Sapiens; identical to SEQ ID NO: 276208

SEQ ID NO: 279850 - RNA, 64 nt, Homo Sapiens; identical to SEQ ID NO: 276209

SEQ ID NO: 279851 - RNA, 56 nt, Homo Sapiens; identical to SEQ ID NO: 276210

SEQ ID NO: 279852 - RNA, 64 nt, Homo Sapiens; identical to SEQ ID NO: 276211

SEQ ID NO: 279853 - RNA, 64 nt, Homo Sapiens; identical to SEQ ID NO: 276212

SEQ ID NO: 279854 - RNA, 64 nt, Homo Sapiens; identical to SEQ ID NO: 276213

SEQ ID NO: 279855 - RNA, 64 nt, Homo Sapiens; identical to SEQ ID NO: 276214

SEQ ID NO: 279856 - RNA, 64 nt, Homo Sapiens; identical to SEQ ID NO: 276215

SEQ ID NO: 279857 - RNA, 64 nt, Homo Sapiens; identical to SEQ ID NO: 276216

SEQ ID NO: 279858 - RNA, 64 nt, Homo Sapiens; identical to SEQ ID NO: 276217

SEQ ID NO: 279859 - RNA, 64 nt, Homo Sapiens; identical to SEQ ID NO: 276218

SEQ ID NO: 279860 - RNA, 64 nt, Homo Sapiens; identical to SEQ ID NO: 276219

SEQ ID NO: 279861 - RNA, 64 nt, Homo Sapiens; identical to SEQ ID NO: 276220

SEQ ID NO: 279862 - RNA, 64 nt, Homo Sapiens; identical to SEQ ID NO: 276221

SEQ ID NO: 279863 - RNA, 64 nt, Homo Sapiens; identical to SEQ ID NO: 276222

SEQ ID NO: 279864 - RNA, 64 nt, Homo Sapiens; identical to SEQ ID NO: 276222

SEQ ID NO: 279865 - RNA, 64 nt, Homo Sapiens; identical to SEQ ID NO: 276224

SEQ ID NO: 279866 - RNA, 64 nt, Homo Sapiens; identical to SEQ ID NO: 276225

SEQ ID NO: 279867 - RNA, 64 nt, Homo Sapiens; identical to SEQ ID NO: 276226

SEQ ID NO: 279868 - RNA, 64 nt, Homo Sapiens; identical to SEQ ID NO: 276227

SEQ ID NO: 279869 - RNA, 64 nt, Homo Sapiens
caguuagguagagcugucuguucacccucccaucccagcugaucccagucacugcuugcugggg

SEQ ID NO: 279870 - RNA, 64 nt, Homo Sapiens
uggggccaugccauggaagcuucccaucagucucccagcugaauccucccugcucucugagcug

SEQ ID NO: 279871 - RNA, 64 nt, Homo Sapiens
ucccuuuugcuuuucagugucuucucagaaacaaccagcugagaagguaauuaaagucucauuu

SEQ ID NO: 279872 - RNA, 64 nt, Homo Sapiens; identical to SEQ ID NO: 279871

SEQ ID NO: 279873 - RNA, 64 nt, Homo Sapiens
gcaucaggaaggccuuugcuucuugcacccaggcccagcugagacaggccccugaguccuggcu

SEQ ID NO: 279874 - RNA, 64 nt, Homo Sapiens
acucucccuggagcugcucuccuaucagaagcucccagcugaccagacacugccugggguggac

SEQ ID NO: 279875 - RNA, 64 nt, Homo Sapiens
agugacagagcccagcaucccuucugcccccguuccagcugacaucuugcacggugaccccuuu

SEQ ID NO: 279876 - RNA, 64 nt, Homo Sapiens
cuuucccaaaaugugccucccuuccgcugcgggcccagcugagucuauguaggugauguuucca

SEQ ID NO: 279877 - RNA, 64 nt, Homo Sapiens
agaagaaauggagagcagcaguaugagugugcacccagcugaagccagcccagcaggguccucu

SEQ ID NO: 279878 - RNA, 64 nt, Homo Sapiens
caggugggcagauaugcagaccccuagguguggaccagcugagggacaagcugguacagccaac

SEQ ID NO: 279879 - RNA, 64 nt, Homo Sapiens
aauguggccaccauguccaaaaggguggcuucucccagcugagucaggaggcaggaaccaggau

SEQ ID NO: 279880 - RNA, 64 nt, Homo Sapiens
uacauggucacuuuuucaguuacuggaacuucccccagcugaguuuuuaagaaaacauggauac

SEQ ID NO: 279881 - RNA, 64 nt, Homo Sapiens
aagaagcugcuuccccuccuguauaagggccuccccagcugagugcgaggaggccugcacccca

SEQ ID NO: 279882 - RNA, 64 nt, Homo Sapiens
aagccacacagccuccaggagugggccccagagcccagcugaggcuggggccucagaccucuga

SEQ ID NO: 279883 - RNA, 64 nt, Homo Sapiens
ugucucacugcuccuggcagggacccagaggggcccagcugaccauguggcaggcuuguuugaa

SEQ ID NO: 279884 - RNA, 64 nt, Homo Sapiens
acgguggaggcuuuguggcuauccugaccuguaaccagcugaagggagggagagucugaccugg

SEQ ID NO: 279885 - RNA, 64 nt, Homo Sapiens
uugguuuucagcugauaggaucuaugccucuggaccagcugaacuuacuggugcagcuuuuugu

SEQ ID NO: 279886 - RNA, 64 nt, Homo Sapiens
agcuagguuugguuuccuguuuuuugucuaugucccagcugacauucagucaaauguugggaua

SEQ ID NO: 279887 - RNA, 64 nt, Homo Sapiens
ccagcacugcggccaagucgacauaugagcgaggccagcugagcugagaagaguagcuauaaag

SEQ ID NO: 279888 - RNA, 64 nt, Homo Sapiens
cgcacgcagccacuucggcuuagaccagccagcuccagcugaucggucccaaaccaggccaucc

SEQ ID NO: 279889 - RNA, 64 nt, Homo Sapiens
aggucuguguguugcaggugcgcugaccagcugaccagcugaccaauucugggacggaccaccu

SEQ ID NO: 279890 - RNA, 64 nt, Homo Sapiens
agcugaccaggucugugugugaccaccucgcugaccagcugaccugucccaaaauucugggacg

SEQ ID NO: 279891 - RNA, 64 nt, Homo Sapiens
cccacgugggcccaccccgggcagcagagaaggcccagcugacagggggugaggugugggucug

SEQ ID NO: 279892 - RNA, 64 nt, Homo Sapiens
ggugcccggcccccuguccacuaggccgcuucuaccagcugacugccccggcccggccucccgc

SEQ ID NO: 279893 - RNA, 64 nt, Homo Sapiens
cccgugugagccagaaaccagggcuucccuacccccagcugacacuggaccccaacauguaugc

SEQ ID NO: 279894 - RNA, 64 nt, Homo Sapiens
uauuaggcugaggaccuuguggaguguagcugauccagcugauagaggaacuagccaggugggg

SEQ ID NO: 279895 - RNA, 64 nt, Homo Sapiens
cauuaggcugagaaccuuguggaaugcagcugacccagcugauagaggaaguagccagguggga

SEQ ID NO: 279896 - RNA, 64 nt, Homo Sapiens
agaucaacgcagaaggugggugcuuucuguauuuccagcugagguaccuggcucaucucauugg

SEQ ID NO: 279897 - RNA, 64 nt, Homo Sapiens
ccccucacagcguaaacaaagccauggggaaguuccagcugagcagagcccuccacagcucagc

SEQ ID NO: 279898 - RNA, 64 nt, Homo Sapiens
cccaaguaacugggacuauagcaugccaccacacccagcugauuaucauauuuuuuuuuguaga

SEQ ID NO: 279899 - RNA, 64 nt, Homo Sapiens; identical to SEQ ID NO: 279898

SEQ ID NO: 279900 - RNA, 64 nt, Homo Sapiens
caucuguggauauggagcggccugagggcaggggcugucucauuccccacccaucagugaaauc

SEQ ID NO: 279901 - RNA, 64 nt, Homo Sapiens
auuaguuauguuugccuguccggcauuucucucgcugucucauguuucucucacaugccugggu

SEQ ID NO: 279902 - RNA, 64 nt, Homo Sapiens
cacugcacuccagccuggacaacagagcaagacucugucucaaaaaaaaaauaaaaaauaaaaa

SEQ ID NO: 279903 - RNA, 64 nt, Homo Sapiens
gccacugcacuccagcuugagcaacacagugauacugucucaauaaauaaauaaauagaagaaa

SEQ ID NO: 279904 - RNA, 64 nt, Homo Sapiens
agcaaaacaaacagcaauaagacagagugagacccugucucaaacacugcccuccagccugggu

SEQ ID NO: 279905 - RNA, 64 nt, Homo Sapiens
aaaaaaaaaaaagaaaagaagacagagccagacucugucucaaagacugcacuccagccugggu

SEQ ID NO: 279906 - RNA, 64 nt, Homo Sapiens
ugugugaaucuucugacacaaccauuuucuuaggcugucucacuagaagagcuucuguauagua

SEQ ID NO: 279907 - RNA, 64 nt, Homo Sapiens
aaaacaaaacaaaaaaacacgacagagcgagacucugucucaaacacuguacuccagccugggu

SEQ ID NO: 279908 - RNA, 64 nt, Homo Sapiens
aagaggagaccuggggcugugaguggaggaggagcugucucagccagaaugaaacaugggguug

SEQ ID NO: 279909 - RNA, 64 nt, Homo Sapiens
uuccccaccacuagccccacuuaaacuacuacuacugucucagagaacaguguuuccuaaugua

SEQ ID NO: 279910 - RNA, 64 nt, Homo Sapiens
caacuuuucauaaaguagaaaaauucaaaggaagcugucucaauuugagaauaccagcugggca

SEQ ID NO: 279911 - RNA, 64 nt, Homo Sapiens
aaaauaaaaaaauucagauugacagaccgagacacugucucaaaccgcuacacuccagccugau

SEQ ID NO: 279912 - RNA, 64 nt, Homo Sapiens
aaaaugcagacuggccaggcgacagagcaaaacccugucucaaacacugcauuccagccuggau

SEQ ID NO: 279913 - RNA, 64 nt, Homo Sapiens
aagagaaggucuuuacuuacuugucuguaucuuucugucucacucgaaaggcacagucucaaug

SEQ ID NO: 279914 - RNA, 64 nt, Homo Sapiens
cauugcacucuagccugggcaaccaagagugaaacugucucaaaaaacaacuuuuaucaauguc

SEQ ID NO: 279915 - RNA, 64 nt, Homo Sapiens
cauugcacucuagucugggugacagagcgagacucugucucaaaaaaaaaaaaauaaagccggg

SEQ ID NO: 279916 - RNA, 64 nt, Homo Sapiens
ccugugugcuccagccugagcaacaagagcgaaacugucucaaaaaaaagaagaaaauaaauaa

SEQ ID NO: 279917 - RNA, 64 nt, Homo Sapiens
aacuauuuggccaugugcucugcucuuucauacccugucucaguuaaccccaaucugccugugc

SEQ ID NO: 279918 - RNA, 64 nt, Homo Sapiens
uguccucaucuccuucuugcucuaggaaauuccucugucucauuggcagacugcuccggacucu

SEQ ID NO: 279919 - RNA, 64 nt, Homo Sapiens
aaaaaaaaaagaaaaaagaagacagagcgaaccucugucucaaacacugcacuccagccggggu

SEQ ID NO: 279920 - RNA, 64 nt, Homo Sapiens
aaaaaaaaaacaaaaacaaaaacagaguaagacucugucucaaacauuguacuccagcuugggc

SEQ ID NO: 279921 - RNA, 64 nt, Homo Sapiens
aaagaaaaaaaagaaaaaaaacaaaagcgaaacucugucucaaaacugcauuccagccugggca

SEQ ID NO: 279922 - RNA, 64 nt, Homo Sapiens
aaaaaaaaaaagagguggguacaagagcgaaacucugucucaaaauugcacuccagccugggca

SEQ ID NO: 279923 - RNA, 57 nt, Homo Sapiens; identical to SEQ ID NO: 244788

SEQ ID NO: 279924 - RNA, 64 nt, Homo Sapiens
gagguccugucuaaacccugugucccugagggaucugucucacuggcaucuuguugagggccuu

SEQ ID NO: 279925 - RNA, 64 nt, Homo Sapiens
cacugcacuccagucugggcaacagagugagacccugucucaauaauaauaauaauaauaauga

SEQ ID NO: 279926 - RNA, 64 nt, Homo Sapiens
uucugaagauacagaugacagugacgaaugccuucugucucaugauugacagggaaaaggaagg

SEQ ID NO: 279927 - RNA, 64 nt, Homo Sapiens
uaguaccuaccuuaguuuaugguuuucacugucucugucucaucgguagggguuguuugguuuu

SEQ ID NO: 279928 - RNA, 64 nt, Homo Sapiens
aaaaaaaaaacaaauuaaccgacagagcaagacccugucucaaacaccacacuccaaccuaggu

SEQ ID NO: 279929 - RNA, 64 nt, Homo Sapiens
auuacacucaagcuugggcaacgagagcaaaacucugucucaaaaaaaaaauuagccagaugug

SEQ ID NO: 279930 - RNA, 64 nt, Homo Sapiens
caauguacuccagccuaggugacagagugagacccugucucaaaaauaaauaauaaauaaauaa

SEQ ID NO: 279931 - RNA, 64 nt, Homo Sapiens
uccugggagaggcagacgagauucuccuccaguccugucucaucggaagaagagagggugggag

SEQ ID NO: 279932 - RNA, 64 nt, Homo Sapiens
gagaggggagacagaggcagcagagggcacaaaacugucucaauagugaggccucugccauguc

SEQ ID NO: 279933 - RNA, 64 nt, Homo Sapiens
cacugcacuccagccugggcaacagagcaaaacucugucucaaaaaaaaaaaaaaaaaggcaaa

SEQ ID NO: 279934 - RNA, 64 nt, Homo Sapiens
accccggacagggccacauuugcaugagacauggcugucucacaggucacagagccauuacaac

SEQ ID NO: 279935 - RNA, 64 nt, Homo Sapiens
caccagagucugcccuuuggcccaaaauuuaugucugucucauguguaaaagacauucauccca

SEQ ID NO: 279936 - RNA, 64 nt, Homo Sapiens
gggaacaggcauaggauaacaguuacagacauuucugucucaaaaaggagagaauggaaauugg

SEQ ID NO: 279937 - RNA, 64 nt, Homo Sapiens
ugcccccagcaaauaaacacguguaccaccucugcugucucagagccagagcagcaucuucucu

SEQ ID NO: 279938 - RNA, 64 nt, Homo Sapiens
gggccccucucccuucuguuugagucaguguccucugucucacagugagggccacucaccgacc

SEQ ID NO: 279939 - RNA, 62 nt, Homo Sapiens
ggucaauaguuucccaauuucaggauauuucgaugucagaaauaacgcaucuuaggaaugac

SEQ ID NO: 279940 - RNA, 62 nt, Homo Sapiens
cacuauaccaagcacuaggcuuagaggaaaagaugucagauuguacugucacuggcuaugua

SEQ ID NO: 279941 - RNA, 62 nt, Homo Sapiens
uggucaguagggagcuccauuugggcucuccaaugucagaugaugacuaugucagaagacau

SEQ ID NO: 279942 - RNA, 62 nt, Homo Sapiens
acauuugguaugaagcuucugaguggaugacuaugucagaagccgaguugaacugaagaaac

SEQ ID NO: 279943 - RNA, 62 nt, Homo Sapiens
auuaggauucaugugguuucuaagauuuggacaugucagaauuuugugagucauggaugggg

SEQ ID NO: 279944 - RNA, 62 nt, Homo Sapiens
gugauuacugcuauuacuauauuuacuugcauaugucagaaugaugugauagacuaucucug

SEQ ID NO: 279945 - RNA, 62 nt, Homo Sapiens
gcaaaauacaggaaaagaacuauccaguauaaaugucagaagacagauuuccuaaacaagua

SEQ ID NO: 279946 - RNA, 62 nt, Homo Sapiens
acuuguggaucuuuuguacuucucauaaccuaaugucagacuaagaaaaauaaaauaucuga

SEQ ID NO: 279947 - RNA, 62 nt, Homo Sapiens
auauugaccugccauacguuagguccuccauaaugucagauauugcuuauuuuuaaauuugg

SEQ ID NO: 279948 - RNA, 62 nt, Homo Sapiens
auauucugaacuggaugccucuuauauccuaaaugucagaagcacuucaauagcaaucacau

SEQ ID NO: 279949 - RNA, 62 nt, Homo Sapiens
uaugucucugcugauacuauugcccagggcccaugucagauucugcauugcaccuuuugccc

SEQ ID NO: 279950 - RNA, 62 nt, Homo Sapiens
gcuucagcugaaggccauauaguacacagugaaugucagaaacacccuggagaaaguccuug

SEQ ID NO: 279951 - RNA, 62 nt, Homo Sapiens
cuuuuuaaauaauagucugaagcagagaauuaaugucagaacugguuucagugaaacaaucu

SEQ ID NO: 279952 - RNA, 62 nt, Homo Sapiens
ugaagaguaaaucuacuugucgcugaugugauaugucagaaccguaaagagguaccaacugu

SEQ ID NO: 279953 - RNA, 64 nt, Homo Sapiens
uagcccagcacagagccaccggaacaucaagauccuagaggacgaaccccacaguaaggaugag

SEQ ID NO: 279954 - RNA, 64 nt, Homo Sapiens
gcagaagggcaguaucggcaaccuccugggcuuccuagaggacagccuugccgccacacaguuc

SEQ ID NO: 279955 - RNA, 64 nt, Homo Sapiens
ucaucucugggugccaccaucggucuggcugcagcuagaggacaggcaagccagcucuggggga

SEQ ID NO: 279956 - RNA, 64 nt, Homo Sapiens
gaaaccacagcucuuaguaguaauggcauacagucuagaggaccauucaugcaaugacuauuuc

SEQ ID NO: 279957 - RNA, 64 nt, Homo Sapiens
ugaucuaauuucuuucuagcuagcauuuaguuuucuagaggauggggaacuggcacugugaccu

SEQ ID NO: 279958 - RNA, 64 nt, Homo Sapiens
augaggggggaugcgaguacgagauacaaaugagcuagaggaagaaaaauaugccaaaaaauga

SEQ ID NO: 279959 - RNA, 64 nt, Homo Sapiens
caguugaaaagggcaagaggaaaccagggcaguucuagaggagugcuggugacuggauagcagu

SEQ ID NO: 279960 - RNA, 64 nt, Homo Sapiens
uggcaggcuguagaccugacauuuugagacaagccuagaggagucaggagcagggacuuugacu

SEQ ID NO: 279961 - RNA, 64 nt, Homo Sapiens
auuuggagcuuauguaauaauggcauaaagccaacuagaggauguuguauuuugcacaucagau

SEQ ID NO: 279962 - RNA, 64 nt, Homo Sapiens
gugacaagcuuugcuuuguuaucauuggucuucacuagaggauaccuuuuacauguacuucucu

SEQ ID NO: 279963 - RNA, 64 nt, Homo Sapiens
aauguaggaauuuauuuuuuucuaggcagucccccuagaggaaagcugcuuggcugccugucuu

SEQ ID NO: 279964 - RNA, 64 nt, Homo Sapiens
cagcaagucccaguccccggcuggcggggacaggcuagaggagagacacccguaccgcggcugg

SEQ ID NO: 279965 - RNA, 64 nt, Homo Sapiens
aauuagcaagaggguauuuuagucugaacugacucuagaggauguguucauguaucgugcugga

SEQ ID NO: 279966 - RNA, 64 nt, Homo Sapiens
uugaacaaagccuuuccuacguaauacuuguuuacuagaggaguuagccauuguaucaguugaa

SEQ ID NO: 279967 - RNA, 64 nt, Homo Sapiens
gcuaugcaaaagcauaacgacuuugauaaaacugcuagaggaugguguaggcaauuauguccug

SEQ ID NO: 279968 - RNA, 64 nt, Homo Sapiens
gaacacuuugcccaagauuaaagaacacugagaacuagaggaggguugaugccacuuugaagaa

SEQ ID NO: 279969 - RNA, 64 nt, Homo Sapiens
auaaauguuuaucaugcauguauucuagagcucauucauuuauucaacaaacauuuggugagca

SEQ ID NO: 279970 - RNA, 64 nt, Homo Sapiens
aacauuuggugagcaccuauuucguucgagaaacuucauuuaucuccuauaauuggcaaacuua

SEQ ID NO: 279971 - RNA, 64 nt, Homo Sapiens
uugugugauauuuuuuucuucgcuuguuuauuuauucauuuauuuaauuguauuuauucauuua

SEQ ID NO: 279972 - RNA, 64 nt, Homo Sapiens
cuuguuuauuuauucauuuauuuaauuguauuuauucauuuacuaacuuuauguguuaccaauu

SEQ ID NO: 279973 - RNA, 64 nt, Homo Sapiens
agacauugugcuaugugcauaucauauguauuauuucauuuaauucucacaacaauucugugaa

SEQ ID NO: 279974 - RNA, 64 nt, Homo Sapiens
aauaaaauuuuauaauaguacacagccacacucauucauuuauuuucugugguugcuuucaagc

SEQ ID NO: 279975 - RNA, 64 nt, Homo Sapiens
cuagccauuucuccaaggcgcaaauggcccuggcuucauuuauuccuuuccuuucuauccuuuu

SEQ ID NO: 279976 - RNA, 64 nt, Homo Sapiens
ccuaguucccaccccaaguuuaagaagacuuagauucauuuauugcuaucugaggccacuagug

SEQ ID NO: 279977 - RNA, 64 nt, Homo Sapiens
uuuuacacuaaaacuuuacaagauaaaauuggacuucauuuaguaucuuuuuaacagaauuacu

SEQ ID NO: 279978 - RNA, 64 nt, Homo Sapiens
guaagagcaaaagaacguuuuuguacaauuuuuuuucauuuaauuggaaugaucuucagguuuc

SEQ ID NO: 279979 - RNA, 64 nt, Homo Sapiens
aaccugggggauugauacgaauucaucccuucuguucauuuaccgagccuaaaaaguaggcuuu

SEQ ID NO: 279980 - RNA, 64 nt, Homo Sapiens
cgaaaaacacagaccgcuuuugcauuuacaaccuuucauuuaaccuucuuaucagcgguaaaaa

SEQ ID NO: 279981 - RNA, 64 nt, Homo Sapiens
aauguucguuuaaauuaaucuccauauaaguuuauucauuuagggaccaaauucuaaaaccuaa

SEQ ID NO: 279982 - RNA, 64 nt, Homo Sapiens
aggcaauaaggcaaaugccagcugugagccaguauucauuuaagcagaccuugccucagaagga

SEQ ID NO: 279983 - RNA, 64 nt, Homo Sapiens
guggaaagaauauuuguaguaguaacaagaauuuuucauuuaggaaagauuucuuagguuuuga

SEQ ID NO: 279984 - RNA, 64 nt, Homo Sapiens
gacauuucaguuaagcucauaaaauuucauuguuuucauuuaaaagauuaacguuauugauacu

SEQ ID NO: 279985 - RNA, 64 nt, Homo Sapiens
guagcuuucuguuuacauccuaugccacauggucuucauuuaugccagguaaacuguauuugaa

SEQ ID NO: 279986 - RNA, 64 nt, Homo Sapiens
gagccaaacucuuuuccauuccaucuaaaauguuuucauuuaguacucuucuuuccuccuacuc

SEQ ID NO: 279987 - RNA, 64 nt, Homo Sapiens
uuguaccucauucacaugaacauauuaaaaaauuuucauuuauuuacaaauugacaugauuuuc

SEQ ID NO: 279988 - RNA, 64 nt, Homo Sapiens
ugucauauuggcuuuauguguuuauguauauucauucauuuaguccagauacuauucugaauau

SEQ ID NO: 279989 - RNA, 64 nt, Homo Sapiens
guagacaaaaauaaugaauuggugguguuuuuauuucauuuauugcuaauaguggauuguauag

SEQ ID NO: 279990 - RNA, 64 nt, Homo Sapiens
uuagucugccaucuuuaaaaaaaaauacaguauuuucauuuaaauucucugauggagggacaac

SEQ ID NO: 279991 - RNA, 64 nt, Homo Sapiens
caguuauucucuuuuucaucuggggauuuaccuguucauuuaaucugccuguuuugaucuguuu

SEQ ID NO: 279992 - RNA, 64 nt, Homo Sapiens
aauuccauuuuuauuuugcauuuuagaauugcccuucauuuacuaaaucagccaguuaauguga

SEQ ID NO: 279993 - RNA, 64 nt, Homo Sapiens
ucucaaaaucuagaaaagugcauauaaauuuuuguucauuuagaacugaguauucuggagaaaa

SEQ ID NO: 279994 - RNA, 64 nt, Homo Sapiens
uauuauuuaguuggaggccuuuagauauuauucauucauuuacucauucauuuauucauucauu

SEQ ID NO: 279995 - RNA, 64 nt, Homo Sapiens
ggaggccuuuagauauuauucauucauuuacucauucauuuauucauucauucaucgaguaacu

SEQ ID NO: 279996 - RNA, 64 nt, Homo Sapiens
ugaaguauaagccucuacuguagaacugauauuuuucauuuauacaaaguaaacauuuaaauug

SEQ ID NO: 279997 - RNA, 64 nt, Homo Sapiens
uaaaaucugauaccuugaugauugaauuuuauuguucauuuauacuacguuuaaauaaauaaaa

SEQ ID NO: 279998 - RNA, 64 nt, Homo Sapiens
uuuauuaucuuaaagcaauuaguuggugcuuacuuucauuuaugaguaaauuguuaauguaaau

SEQ ID NO: 279999 - RNA, 64 nt, Homo Sapiens
uaucucaugaguaaaauggagugugguuuggggcuucauuuauuuaguuuagccaaaaguuuau

SEQ ID NO: 280000 - RNA, 64 nt, Homo Sapiens
auuugcccaaauacauggaguuugauaugauuguuucauuuauauacuuugguccauaauuuga

SEQ ID NO: 280001 - RNA, 64 nt, Homo Sapiens
uccuauccgucuuuugagcucuguaauuuauguauucauuuauauuuucaaauauuuuccuugg

SEQ ID NO: 280002 - RNA, 64 nt, Homo Sapiens
aacugccuucuucaacacauaagauuuguaauguuucauuuauauaaguuguaugcauaaacau

SEQ ID NO: 280003 - RNA, 64 nt, Homo Sapiens
aaagaaaaagccaaagugaauuuuaccacaaaucuucauuuauagacuuggaguuaucuuugac
